United States Patent 12,606,847 (ENGINEERED VIRAL CAPSID POLYPEPTIDES AND USES THEREOF) - sequence listing, part 5

SEQ ID NO: 89721 - protein, 33 aa, Artificial Sequence
  Description of Artificial Sequence: Synthetic polypeptide
DESEIRTTNPCATEQYGSVSTGHSSQSVGNNIY

SEQ ID NO: 89722 - protein, 31 aa, Artificial Sequence
  Description of Artificial Sequence: Synthetic polypeptide
DESEIRTTNPEATQQYGEVCTIDQGQREGNF

SEQ ID NO: 89723 - protein, 33 aa, Artificial Sequence
  Description of Artificial Sequence: Synthetic polypeptide
DESEIRTTNPGATECWGSVSCTNEPQDREGENG

SEQ ID NO: 89724 - protein, 35 aa, Artificial Sequence
  Description of Artificial Sequence: Synthetic polypeptide
DEMEIRTTNPVATEQYGSVTSPTDNLETQTEEQNK

SEQ ID NO: 89725 - protein, 34 aa, Artificial Sequence
  Description of Artificial Sequence: Synthetic polypeptide
DEMEIRTTNPVATEQYGSVTPWTNLESFQTDNSQ

SEQ ID NO: 89726 - protein, 33 aa, Artificial Sequence
  Description of Artificial Sequence: Synthetic polypeptide
DESEIRTTNPIATECWGSVSCINELQDREGENG

SEQ ID NO: 89727 - protein, 33 aa, Artificial Sequence
  Description of Artificial Sequence: Synthetic polypeptide
DECEICTTNPVATTQYGVVSTNALQQGTEGGND

SEQ ID NO: 89728 - protein, 33 aa, Artificial Sequence
  Description of Artificial Sequence: Synthetic polypeptide
DEMEIRTTNPVATEQYGSVTPWTNLEMFGDVTQ

SEQ ID NO: 89729 - protein, 32 aa, Artificial Sequence
  Description of Artificial Sequence: Synthetic polypeptide
CTEEIRYTNPVATEQYGMNVSTNQQNHGMTRE

SEQ ID NO: 89730 - protein, 33 aa, Artificial Sequence
  Description of Artificial Sequence: Synthetic polypeptide
DECEICTTNPVATTQYGVVSTNLQLNQIGTNTD

SEQ ID NO: 89731 - protein, 33 aa, Artificial Sequence
  Description of Artificial Sequence: Synthetic polypeptide
DECEICTTNPVATTQYGVVSTNQNLQAGTNTDG

SEQ ID NO: 89732 - protein, 33 aa, Artificial Sequence
  Description of Artificial Sequence: Synthetic polypeptide
DECEICTTNPVATTQYGVVSTNQQLQQGTNNDE

SEQ ID NO: 89733 - protein, 32 aa, Artificial Sequence
  Description of Artificial Sequence: Synthetic polypeptide
CTEEIRYTNPVATEQYGSNVSLNQQAQGMTRE

SEQ ID NO: 89734 - protein, 32 aa, Artificial Sequence
  Description of Artificial Sequence: Synthetic polypeptide
DECEICTTNPVATTQYGVVSTNSNLQAGTTDE

SEQ ID NO: 89735 - protein, 32 aa, Artificial Sequence
  Description of Artificial Sequence: Synthetic polypeptide
DEMEIRTTNPVATEQYGSVSWNHTVELNEDDL

SEQ ID NO: 89736 - protein, 32 aa, Artificial Sequence
  Description of Artificial Sequence: Synthetic polypeptide
DEMEIRTTNPVATEQYGSVSWMLSIESDQEND

SEQ ID NO: 89737 - protein, 31 aa, Artificial Sequence
  Description of Artificial Sequence: Synthetic polypeptide
DECEICTTNPVATTQYGVVSTTALQQGTEET

SEQ ID NO: 89738 - protein, 30 aa, Artificial Sequence
  Description of Artificial Sequence: Synthetic polypeptide
CEDVIATTNPVATAQWGSVSTADDGQRGNS

SEQ ID NO: 89739 - protein, 33 aa, Artificial Sequence
  Description of Artificial Sequence: Synthetic polypeptide
DESEIRTTNPVATECCGSVSCINEPQDREGANG

SEQ ID NO: 89740 - protein, 31 aa, Artificial Sequence
  Description of Artificial Sequence: Synthetic polypeptide
DESEIATTNPVCTEQYGVVSCNEPQDSEGNG

SEQ ID NO: 89741 - protein, 31 aa, Artificial Sequence
  Description of Artificial Sequence: Synthetic polypeptide
DEMEIVSTNPVATEQYGTVAATDGPERVGNR

SEQ ID NO: 89742 - protein, 32 aa, Artificial Sequence
  Description of Artificial Sequence: Synthetic polypeptide
DECEIATTNPVAYEKWGSVSTNLNQGDLGNGS

SEQ ID NO: 89743 - protein, 32 aa, Artificial Sequence
  Description of Artificial Sequence: Synthetic polypeptide
DESEIATTNPVATECYGSVSCIDEPQDREGNG

SEQ ID NO: 89744 - protein, 32 aa, Artificial Sequence
  Description of Artificial Sequence: Synthetic polypeptide
DESEIATTNPVATECYGSVSCINEPQDHEGNG

SEQ ID NO: 89745 - protein, 33 aa, Artificial Sequence
  Description of Artificial Sequence: Synthetic polypeptide
DESEIATTNPVATECYGSVSCINEPQDREGENG

SEQ ID NO: 89746 - protein, 31 aa, Artificial Sequence
  Description of Artificial Sequence: Synthetic polypeptide
DEMEIVTTNPVATEQYGTVPATDGPQFEGND

SEQ ID NO: 89747 - protein, 32 aa, Artificial Sequence
  Description of Artificial Sequence: Synthetic polypeptide
DESEIATTNPVATEGWGSVACNLPQDREGENI

SEQ ID NO: 89748 - protein, 32 aa, Artificial Sequence
  Description of Artificial Sequence: Synthetic polypeptide
DECEIATTNPVAYEQWGEVSTNAQHDEGGDNR

SEQ ID NO: 89749 - protein, 31 aa, Artificial Sequence
  Description of Artificial Sequence: Synthetic polypeptide
DEMEIVTTNPVATEQYGTVPATDVPQFEGND

SEQ ID NO: 89750 - protein, 31 aa, Artificial Sequence
  Description of Artificial Sequence: Synthetic polypeptide
DEAEIATTNPVAYEQYGSVCTAQIGEPGNRE

SEQ ID NO: 89751 - protein, 34 aa, Artificial Sequence
  Description of Artificial Sequence: Synthetic polypeptide
DEEEIRTTNPVATEQYGTSCSTGEPLQHFNSNQS

SEQ ID NO: 89752 - protein, 31 aa, Artificial Sequence
  Description of Artificial Sequence: Synthetic polypeptide
DEMEIVTTNPVATEQYGTVCSTDVPEFEGND

SEQ ID NO: 89753 - protein, 32 aa, Artificial Sequence
  Description of Artificial Sequence: Synthetic polypeptide
DECEIATTNPVAYEQWGEVSTNLQGEDGNNSS

SEQ ID NO: 89754 - protein, 32 aa, Artificial Sequence
  Description of Artificial Sequence: Synthetic polypeptide
DESEIATTNPVATEGYGSMSCINEQDREGENG

SEQ ID NO: 89755 - protein, 31 aa, Artificial Sequence
  Description of Artificial Sequence: Synthetic polypeptide
CEEEIACTNPVATEQYGCVATNLQEAGTDEF

SEQ ID NO: 89756 - protein, 32 aa, Artificial Sequence
  Description of Artificial Sequence: Synthetic polypeptide
DESEIATTNPVATEGYGSVSASPTLPNRNGNV

SEQ ID NO: 89757 - protein, 32 aa, Artificial Sequence
  Description of Artificial Sequence: Synthetic polypeptide
DEMEIVTTNPVATEQYGTVCSTDGPVQFEGTR

SEQ ID NO: 89758 - protein, 32 aa, Artificial Sequence
  Description of Artificial Sequence: Synthetic polypeptide
DEMEIVTTNPVATEQYGTVCSTEGIVEQEGND

SEQ ID NO: 89759 - protein, 31 aa, Artificial Sequence
  Description of Artificial Sequence: Synthetic polypeptide
DEMEIVTTNPVATEQYGTVPATDVPQHEGND

SEQ ID NO: 89760 - protein, 32 aa, Artificial Sequence
  Description of Artificial Sequence: Synthetic polypeptide
DEMEIVTTNPVATEQYGTVSACDGLVQFEGTR

SEQ ID NO: 89761 - protein, 33 aa, Artificial Sequence
  Description of Artificial Sequence: Synthetic polypeptide
DESEIATTNPVATECYGSVSACINEQDRVGENG

SEQ ID NO: 89762 - protein, 32 aa, Artificial Sequence
  Description of Artificial Sequence: Synthetic polypeptide
DEMEIVTTNPVATEQYGTVSATDLEDHEGNDD

SEQ ID NO: 89763 - protein, 31 aa, Artificial Sequence
  Description of Artificial Sequence: Synthetic polypeptide
DEMEIVTTNPVATEQYGTVSATDIPEFEGND

SEQ ID NO: 89764 - protein, 31 aa, Artificial Sequence
  Description of Artificial Sequence: Synthetic polypeptide
DESEIATTNPVATECWGSVSCINLQDHEGEL

SEQ ID NO: 89765 - protein, 32 aa, Artificial Sequence
  Description of Artificial Sequence: Synthetic polypeptide
DEMEIVTTNPVATEQYGTVSATDGLVEFEGNL

SEQ ID NO: 89766 - protein, 31 aa, Artificial Sequence
  Description of Artificial Sequence: Synthetic polypeptide
DESEIATTNPVATECWGSVSCNEPQDREGQG

SEQ ID NO: 89767 - protein, 31 aa, Artificial Sequence
  Description of Artificial Sequence: Synthetic polypeptide
DESEIATTNPVATECWGSVSCNEPQDSGETR

SEQ ID NO: 89768 - protein, 32 aa, Artificial Sequence
  Description of Artificial Sequence: Synthetic polypeptide
CEEEIACTNPVATEQYGCVATNLQRMNNNMEM

SEQ ID NO: 89769 - protein, 33 aa, Artificial Sequence
  Description of Artificial Sequence: Synthetic polypeptide
DESEIATTNPVATECWGSVSEINEPQDREGENR

SEQ ID NO: 89770 - protein, 31 aa, Artificial Sequence
  Description of Artificial Sequence: Synthetic polypeptide
DESEIATTNPVATECWGSVSENEPQHEGENL

SEQ ID NO: 89771 - protein, 32 aa, Artificial Sequence
  Description of Artificial Sequence: Synthetic polypeptide
DEMEIVTTNPVATEQYGTVSATDGIQEFEGND

SEQ ID NO: 89772 - protein, 32 aa, Artificial Sequence
  Description of Artificial Sequence: Synthetic polypeptide
DECEIATTNPVAYEGWGSVSTSNGQQNDGNNR

SEQ ID NO: 89773 - protein, 33 aa, Artificial Sequence
  Description of Artificial Sequence: Synthetic polypeptide
DEEEIRTTNPVATEQYGTISTEDIPQQQNGNPV

SEQ ID NO: 89774 - protein, 33 aa, Artificial Sequence
  Description of Artificial Sequence: Synthetic polypeptide
DEEEIRTTNPVATEQYGTISTEDIQQQQNGNPV

SEQ ID NO: 89775 - protein, 32 aa, Artificial Sequence
  Description of Artificial Sequence: Synthetic polypeptide
DESEIATTNPVATECYGSVSACIDLEDREGNG

SEQ ID NO: 89776 - protein, 33 aa, Artificial Sequence
  Description of Artificial Sequence: Synthetic polypeptide
DESEIATTNPVATECYGSVSACIDLPQDREGNG

SEQ ID NO: 89777 - protein, 31 aa, Artificial Sequence
  Description of Artificial Sequence: Synthetic polypeptide
DEMEIVTTNPVATEQYGTVSAEDCLVQFGED

SEQ ID NO: 89778 - protein, 32 aa, Artificial Sequence
  Description of Artificial Sequence: Synthetic polypeptide
DEMEIVTTNPVATEQYGTVSACDGLVQSEGTR

SEQ ID NO: 89779 - protein, 32 aa, Artificial Sequence
  Description of Artificial Sequence: Synthetic polypeptide
DEAEIATTNPVAYEQYGSVATNPTQTGNGDEV

SEQ ID NO: 89780 - protein, 33 aa, Artificial Sequence
  Description of Artificial Sequence: Synthetic polypeptide
DEAEIATTNPVAYEQYGSVSVANLGQDAGPNTE

SEQ ID NO: 89781 - protein, 33 aa, Artificial Sequence
  Description of Artificial Sequence: Synthetic polypeptide
DESEIATTNPVATEGYGSVSCINEPQDREGENG

SEQ ID NO: 89782 - protein, 32 aa, Artificial Sequence
  Description of Artificial Sequence: Synthetic polypeptide
DEMEIVTTNPVATEQYGTVCSTDGPVQFEGND

SEQ ID NO: 89783 - protein, 32 aa, Artificial Sequence
  Description of Artificial Sequence: Synthetic polypeptide
DECEIATTNPVAYEQWGSVSTNLMMNEGGNTQ

SEQ ID NO: 89784 - protein, 32 aa, Artificial Sequence
  Description of Artificial Sequence: Synthetic polypeptide
DEAEIATTNPVAYEQYGSVATNDAQGMDPNRN

SEQ ID NO: 89785 - protein, 33 aa, Artificial Sequence
  Description of Artificial Sequence: Synthetic polypeptide
DEAEIATTNPVAYEQYGSVATHLQDSMGDNDRM

SEQ ID NO: 89786 - protein, 32 aa, Artificial Sequence
  Description of Artificial Sequence: Synthetic polypeptide
DECEIATTNPVAYEQWGSVSTNLNMEDGQNTQ

SEQ ID NO: 89787 - protein, 32 aa, Artificial Sequence
  Description of Artificial Sequence: Synthetic polypeptide
DECEIATTNPVAYEQWGSVSTNLQGNSGGDGD

SEQ ID NO: 89788 - protein, 31 aa, Artificial Sequence
  Description of Artificial Sequence: Synthetic polypeptide
DEMEIVTTNPVATEQYGTVCSCDGPQFEGTR

SEQ ID NO: 89789 - protein, 32 aa, Artificial Sequence
  Description of Artificial Sequence: Synthetic polypeptide
DEMEIVTTNPVATEQYGTVCSATNPVEFEGND

SEQ ID NO: 89790 - protein, 31 aa, Artificial Sequence
  Description of Artificial Sequence: Synthetic polypeptide
DEAEIATTNPVAYEQYGSVATNGAQGMNPEN

SEQ ID NO: 89791 - protein, 34 aa, Artificial Sequence
  Description of Artificial Sequence: Synthetic polypeptide
DECEIATTNPVAYEQWGSVSTTNLGDRSQGDNDR

SEQ ID NO: 89792 - protein, 34 aa, Artificial Sequence
  Description of Artificial Sequence: Synthetic polypeptide
DEEEIRTTNPVATEQYGTTVSMNAFSDNRLGDNQ

SEQ ID NO: 89793 - protein, 32 aa, Artificial Sequence
  Description of Artificial Sequence: Synthetic polypeptide
DEAEIATTNPVAYEQYGSVATAGTQTRNNDPR

SEQ ID NO: 89794 - protein, 31 aa, Artificial Sequence
  Description of Artificial Sequence: Synthetic polypeptide
DEAEIATTNPVAYEQYGSVATAGIDERGNEE

SEQ ID NO: 89795 - protein, 33 aa, Artificial Sequence
  Description of Artificial Sequence: Synthetic polypeptide
DECEIATTNPVAYEQWGSVSTTNLGQSQGENDV

SEQ ID NO: 89796 - protein, 33 aa, Artificial Sequence
  Description of Artificial Sequence: Synthetic polypeptide
DECEIATTNPVAYEQWGSVSTTNMLGDSGDNDR

SEQ ID NO: 89797 - protein, 33 aa, Artificial Sequence
  Description of Artificial Sequence: Synthetic polypeptide
DESEIATTNPVATEQWGSVSCINEPQDREGENG

SEQ ID NO: 89798 - protein, 32 aa, Artificial Sequence
  Description of Artificial Sequence: Synthetic polypeptide
DEMEIVTTNPVATEQYGTVCSATGPVEREGND

SEQ ID NO: 89799 - protein, 32 aa, Artificial Sequence
  Description of Artificial Sequence: Synthetic polypeptide
DECEIATTNPVAYEQWGSVSTTNLGDSGQNQQ

SEQ ID NO: 89800 - protein, 32 aa, Artificial Sequence
  Description of Artificial Sequence: Synthetic polypeptide
DECEIATTNPVAYEQWGSVSTNLMMNDGNGTQ

SEQ ID NO: 89801 - protein, 30 aa, Artificial Sequence
  Description of Artificial Sequence: Synthetic polypeptide
DECEIATTNPVAYEQWGSVSTGMDLGDNAE

SEQ ID NO: 89802 - protein, 33 aa, Artificial Sequence
  Description of Artificial Sequence: Synthetic polypeptide
DECEIATTNPVAYEQWGSVSKTNDLQQQRNGEH

SEQ ID NO: 89803 - protein, 32 aa, Artificial Sequence
  Description of Artificial Sequence: Synthetic polypeptide
DEMEIVTTNPVATEQYGTVCSTDGPPQFEGNG

SEQ ID NO: 89804 - protein, 31 aa, Artificial Sequence
  Description of Artificial Sequence: Synthetic polypeptide
DEAEIATTNPVAYEQYGSVATNLQATPPDDE

SEQ ID NO: 89805 - protein, 32 aa, Artificial Sequence
  Description of Artificial Sequence: Synthetic polypeptide
DEMEIVTTNPVATEQYGTVCSTDGPPQFEGND

SEQ ID NO: 89806 - protein, 32 aa, Artificial Sequence
  Description of Artificial Sequence: Synthetic polypeptide
DESEIATTNPVATEGYGSVSSSPTGPNRNGNV

SEQ ID NO: 89807 - protein, 32 aa, Artificial Sequence
  Description of Artificial Sequence: Synthetic polypeptide
DESEIATTNPVATEGYGSVSSSPTLPNRNGNV

SEQ ID NO: 89808 - protein, 29 aa, Artificial Sequence
  Description of Artificial Sequence: Synthetic peptide
DESEIATTNPVATEGYGVMATDGLQHGDI

SEQ ID NO: 89809 - protein, 29 aa, Artificial Sequence
  Description of Artificial Sequence: Synthetic peptide
DESEIATTNPVATEGYGVMATDTLQHGDI

SEQ ID NO: 89810 - protein, 33 aa, Artificial Sequence
  Description of Artificial Sequence: Synthetic polypeptide
DECEIATTNPVAYEQWGSVCSTNDQGERNNGNG

SEQ ID NO: 89811 - protein, 32 aa, Artificial Sequence
  Description of Artificial Sequence: Synthetic polypeptide
DEMEIVTTNPVATEQYGTVCSTDGLVEFEGND

SEQ ID NO: 89812 - protein, 31 aa, Artificial Sequence
  Description of Artificial Sequence: Synthetic polypeptide
CEEEIACTNPVATEQYGCVATNLQAEAAGMN

SEQ ID NO: 89813 - protein, 31 aa, Artificial Sequence
  Description of Artificial Sequence: Synthetic polypeptide
CEEEIACTNPVATEQYGCVATNLQAAEDGEN

SEQ ID NO: 89814 - protein, 33 aa, Artificial Sequence
  Description of Artificial Sequence: Synthetic polypeptide
DEAEIATTNPVAYEQYGSVATNLPQERGGDIEA

SEQ ID NO: 89815 - protein, 31 aa, Artificial Sequence
  Description of Artificial Sequence: Synthetic polypeptide
DESEIATTNPVATEMWGSVSAEANAQHGNQS

SEQ ID NO: 89816 - protein, 29 aa, Artificial Sequence
  Description of Artificial Sequence: Synthetic peptide
DESEIATTNPVATEQWGEASCIVCQRENK

SEQ ID NO: 89817 - protein, 32 aa, Artificial Sequence
  Description of Artificial Sequence: Synthetic polypeptide
DECEIATTNPVAYEQWGSVSGTNLMMEDGNTQ

SEQ ID NO: 89818 - protein, 32 aa, Artificial Sequence
  Description of Artificial Sequence: Synthetic polypeptide
DESEIATTNPVATEQWGSASEINEPQDREGNG

SEQ ID NO: 89819 - protein, 33 aa, Artificial Sequence
  Description of Artificial Sequence: Synthetic polypeptide
DECEIATTNPVAYEQWGSVSKTDEQLQDRQGNM

SEQ ID NO: 89820 - protein, 35 aa, Artificial Sequence
  Description of Artificial Sequence: Synthetic polypeptide
DEEEIRTTNPVATEQYGTSTPSMTENISQRIGEHT

SEQ ID NO: 89821 - protein, 32 aa, Artificial Sequence
  Description of Artificial Sequence: Synthetic polypeptide
DEMEIVTTNPVATEQYGTVSATDNPVESEGND

SEQ ID NO: 89822 - protein, 30 aa, Artificial Sequence
  Description of Artificial Sequence: Synthetic polypeptide
DESEIATTNPVATECWGSVSCINEQREEEL

SEQ ID NO: 89823 - protein, 32 aa, Artificial Sequence
  Description of Artificial Sequence: Synthetic polypeptide
DEMEIVTTNPVATEQYGTVSATGLEDHEGNDD

SEQ ID NO: 89824 - protein, 32 aa, Artificial Sequence
  Description of Artificial Sequence: Synthetic polypeptide
DECEIATTNPVATEPYGSVCYNNDHQDGNNGR

SEQ ID NO: 89825 - protein, 31 aa, Artificial Sequence
  Description of Artificial Sequence: Synthetic polypeptide
DESEIATTNPVAIYDPHYGSVATNLQRTNDM

SEQ ID NO: 89826 - protein, 31 aa, Artificial Sequence
  Description of Artificial Sequence: Synthetic polypeptide
CEEEIACTNPVATEQYGCVATNLQTMNPETH

SEQ ID NO: 89827 - protein, 32 aa, Artificial Sequence
  Description of Artificial Sequence: Synthetic polypeptide
CEEEIACTNPVATEQYGCVATNLQRNPENPDE

SEQ ID NO: 89828 - protein, 32 aa, Artificial Sequence
  Description of Artificial Sequence: Synthetic polypeptide
DEMVIRYTNPVATEQYGSVSVNQDRIGSNSDP

SEQ ID NO: 89829 - protein, 32 aa, Artificial Sequence
  Description of Artificial Sequence: Synthetic polypeptide
DECEIATTNPVATEPYGSVCYNNDSQDGENDR

SEQ ID NO: 89830 - protein, 33 aa, Artificial Sequence
  Description of Artificial Sequence: Synthetic polypeptide
CESEIRTTNPVATECWGSVSCTNEPQDREGENG

SEQ ID NO: 89831 - protein, 33 aa, Artificial Sequence
  Description of Artificial Sequence: Synthetic polypeptide
DENAIRTTNPVATEQYGSVSPTMNEHTGNELDE

SEQ ID NO: 89832 - protein, 34 aa, Artificial Sequence
  Description of Artificial Sequence: Synthetic polypeptide
CESEIRTTNPVATEQYGCVVSTHAFSQTRPGGNR

SEQ ID NO: 89833 - protein, 31 aa, Artificial Sequence
  Description of Artificial Sequence: Synthetic polypeptide
DEMVIGTTNPVATEQWGCVTSTEDLQNGSNQ

SEQ ID NO: 89834 - protein, 31 aa, Artificial Sequence
  Description of Artificial Sequence: Synthetic polypeptide
DEMVIGTTNPVATEQWGCVSTDPLQNFGSNQ

SEQ ID NO: 89835 - protein, 31 aa, Artificial Sequence
  Description of Artificial Sequence: Synthetic polypeptide
DESEIATTNPVATECWGEVSCINCPQREGNG

SEQ ID NO: 89836 - protein, 31 aa, Artificial Sequence
  Description of Artificial Sequence: Synthetic polypeptide
DESEIATTNPVATECWGEVSCINEPQREGNG

SEQ ID NO: 89837 - protein, 31 aa, Artificial Sequence
  Description of Artificial Sequence: Synthetic polypeptide
DEMVIGTTNPVATEQWGCVSTDGLQNGSNQS

SEQ ID NO: 89838 - protein, 35 aa, Artificial Sequence
  Description of Artificial Sequence: Synthetic polypeptide
DEEEIRTTNPVATEQYGSYVSVPNLPQMRILVDDD

SEQ ID NO: 89839 - protein, 34 aa, Artificial Sequence
  Description of Artificial Sequence: Synthetic polypeptide
DECEIATTNPVATEQYGSTVSCTNELSGYGNNTS

SEQ ID NO: 89840 - protein, 30 aa, Artificial Sequence
  Description of Artificial Sequence: Synthetic polypeptide
DESEIATTNPVATECWGEASCINCQREGNK

SEQ ID NO: 89841 - protein, 30 aa, Artificial Sequence
  Description of Artificial Sequence: Synthetic polypeptide
DESEIASVNPVSTEQYGVVSDNLQSSVGNQ

SEQ ID NO: 89842 - protein, 30 aa, Artificial Sequence
  Description of Artificial Sequence: Synthetic polypeptide
DESEIASVNPVCTEQYGVVSDNLQSSVGNQ

SEQ ID NO: 89843 - protein, 34 aa, Artificial Sequence
  Description of Artificial Sequence: Synthetic polypeptide
DENEAEIATTNPVAYECWGSVSTNLQGEDGNNSR

SEQ ID NO: 89844 - protein, 35 aa, Artificial Sequence
  Description of Artificial Sequence: Synthetic polypeptide
DEEEIRTTNPVATEQYGSYVPIYNMPNRQGNEERD

SEQ ID NO: 89845 - protein, 34 aa, Artificial Sequence
  Description of Artificial Sequence: Synthetic polypeptide
DENEAEIATTNPVAYERWGSVSTNLQGEDHGNAR

SEQ ID NO: 89846 - protein, 29 aa, Artificial Sequence
  Description of Artificial Sequence: Synthetic peptide
DESEIASTNPVGTEQYGVMSTGLQHEGDI

SEQ ID NO: 89847 - protein, 33 aa, Artificial Sequence
  Description of Artificial Sequence: Synthetic polypeptide
DENEAEIATTNPVAYERWGEVSTNLQGEDGNDR

SEQ ID NO: 89848 - protein, 29 aa, Artificial Sequence
  Description of Artificial Sequence: Synthetic peptide
DESEIASTNPVGTEQYGVMSTTLQHEGDI

SEQ ID NO: 89849 - protein, 28 aa, Artificial Sequence
  Description of Artificial Sequence: Synthetic peptide
DESEIASTNPVSTECYGDVAECLQREQR

SEQ ID NO: 89850 - protein, 28 aa, Artificial Sequence
  Description of Artificial Sequence: Synthetic peptide
DESEIASTNPVSTECYGNVAECLQREQR

SEQ ID NO: 89851 - protein, 29 aa, Artificial Sequence
  Description of Artificial Sequence: Synthetic peptide
DESEIASTNPVSTEGYGNVAANCLQREQR

SEQ ID NO: 89852 - protein, 28 aa, Artificial Sequence
  Description of Artificial Sequence: Synthetic peptide
DESEIASTNPVSTEGYGNVAECLQREQR

SEQ ID NO: 89853 - protein, 32 aa, Artificial Sequence
  Description of Artificial Sequence: Synthetic polypeptide
DECEIATTNPVATEPYGSVCYNNDDQDGHNER

SEQ ID NO: 89854 - protein, 32 aa, Artificial Sequence
  Description of Artificial Sequence: Synthetic polypeptide
DECEIATTNPVATEPYGSVCYNNDDQDGNGDR

SEQ ID NO: 89855 - protein, 28 aa, Artificial Sequence
  Description of Artificial Sequence: Synthetic peptide
DESEIASTNPVSTEGYGNVANTLQREQR

SEQ ID NO: 89856 - protein, 28 aa, Artificial Sequence
  Description of Artificial Sequence: Synthetic peptide
DESEIASTNPVSTEGYGTMASTLQHGNI

SEQ ID NO: 89857 - protein, 33 aa, Artificial Sequence
  Description of Artificial Sequence: Synthetic polypeptide
DENEAEIATTNPVAYECWGSVTTNLQGEDGNAR

SEQ ID NO: 89858 - protein, 30 aa, Artificial Sequence
  Description of Artificial Sequence: Synthetic polypeptide
DESEIASTNPVSTEGYGVVAANTLQRVGQR

SEQ ID NO: 89859 - protein, 31 aa, Artificial Sequence
  Description of Artificial Sequence: Synthetic polypeptide
DESEIASTNPVSTEQYGTVAANDGIQRVGNR

SEQ ID NO: 89860 - protein, 29 aa, Artificial Sequence
  Description of Artificial Sequence: Synthetic peptide
DESEIASVNPVCTEGYGVVSDNIQRVGNQ

SEQ ID NO: 89861 - protein, 34 aa, Artificial Sequence
  Description of Artificial Sequence: Synthetic polypeptide
DECEIATTNPVATEQYGSTVSCTNELSMYTGNNT

SEQ ID NO: 89862 - protein, 31 aa, Artificial Sequence
  Description of Artificial Sequence: Synthetic polypeptide
DEMEIVTTNPVSTEQYGTVSTDDIVQFEGND

SEQ ID NO: 89863 - protein, 33 aa, Artificial Sequence
  Description of Artificial Sequence: Synthetic polypeptide
DESEIATTNPVATECWGIVSCINLPQDREGENR

SEQ ID NO: 89864 - protein, 32 aa, Artificial Sequence
  Description of Artificial Sequence: Synthetic polypeptide
DECEIATTNPVATEQYGSVSATDLEDHEGEDL

SEQ ID NO: 89865 - protein, 31 aa, Artificial Sequence
  Description of Artificial Sequence: Synthetic polypeptide
DESEIATTNPVATECWGSVSCCEPQDRGENL

SEQ ID NO: 89866 - protein, 31 aa, Artificial Sequence
  Description of Artificial Sequence: Synthetic polypeptide
DEMEIVTTNPVATEQYGTVSTDDIVEFEGND

SEQ ID NO: 89867 - protein, 35 aa, Artificial Sequence
  Description of Artificial Sequence: Synthetic polypeptide
DEEEIRTTNPVATEQYGTCISTINPLQTAGEPNNN

SEQ ID NO: 89868 - protein, 31 aa, Artificial Sequence
  Description of Artificial Sequence: Synthetic polypeptide
DESEIATTNPVATECWGSVSCCLPQDRGEEL

SEQ ID NO: 89869 - protein, 31 aa, Artificial Sequence
  Description of Artificial Sequence: Synthetic polypeptide
DEMEIVTTNPVATEQYGTVSMEGIVQFNGND

SEQ ID NO: 89870 - protein, 32 aa, Artificial Sequence
  Description of Artificial Sequence: Synthetic polypeptide
DECEIATTNPVATEVYGSVCYNNDHQDGGNDR

SEQ ID NO: 89871 - protein, 32 aa, Artificial Sequence
  Description of Artificial Sequence: Synthetic polypeptide
DECEIATTNPVAYEAWGSVSTTNLGQSGENDS

SEQ ID NO: 89872 - protein, 33 aa, Artificial Sequence
  Description of Artificial Sequence: Synthetic polypeptide
DESEIATTNPVATECWGSVSCINEPQDREGENR

SEQ ID NO: 89873 - protein, 32 aa, Artificial Sequence
  Description of Artificial Sequence: Synthetic polypeptide
DESEIATTNPVATECWGSVSCINEPQDREGNG

SEQ ID NO: 89874 - protein, 32 aa, Artificial Sequence
  Description of Artificial Sequence: Synthetic polypeptide
DESEIATTNPVATECWGSVSCINEPQDRGENG

SEQ ID NO: 89875 - protein, 31 aa, Artificial Sequence
  Description of Artificial Sequence: Synthetic polypeptide
DEMEIVTTNPVATEQYGTVSATGPVEHEGND

SEQ ID NO: 89876 - protein, 31 aa, Artificial Sequence
  Description of Artificial Sequence: Synthetic polypeptide
DEMEIVTTNPVATEQYGTVSATGPVEFEGND

SEQ ID NO: 89877 - protein, 31 aa, Artificial Sequence
  Description of Artificial Sequence: Synthetic polypeptide
DEMEIVTTNPVATEQYGTVSATGPEHEGNDD

SEQ ID NO: 89878 - protein, 31 aa, Artificial Sequence
  Description of Artificial Sequence: Synthetic polypeptide
DESEIATTNPVATECWGSVSCINEQDREGEL

SEQ ID NO: 89879 - protein, 32 aa, Artificial Sequence
  Description of Artificial Sequence: Synthetic polypeptide
DESEIATTNPVATECWGSVSCINEQDREGENG

SEQ ID NO: 89880 - protein, 32 aa, Artificial Sequence
  Description of Artificial Sequence: Synthetic polypeptide
DESEIATTNPVATECWGSVSCINEQDREGENL

SEQ ID NO: 89881 - protein, 31 aa, Artificial Sequence
  Description of Artificial Sequence: Synthetic polypeptide
DESEIATTNPVATECWGSVSCINEQDRGEEG

SEQ ID NO: 89882 - protein, 31 aa, Artificial Sequence
  Description of Artificial Sequence: Synthetic polypeptide
DESEIATTNPVATECWGSVPEINEQREGENG

SEQ ID NO: 89883 - protein, 34 aa, Artificial Sequence
  Description of Artificial Sequence: Synthetic polypeptide
DEEEIRTTNPVATEQYGTVCSATDAGPEMREGNV

SEQ ID NO: 89884 - protein, 31 aa, Artificial Sequence
  Description of Artificial Sequence: Synthetic polypeptide
DESEIATTNPVATECWGSVPCINEQREGENG

SEQ ID NO: 89885 - protein, 33 aa, Artificial Sequence
  Description of Artificial Sequence: Synthetic polypeptide
DECEIATTNPVATESYGSVCYNNDSQDRGGNDR

SEQ ID NO: 89886 - protein, 32 aa, Artificial Sequence
  Description of Artificial Sequence: Synthetic polypeptide
DECEIATTNPVATEQYGSVSATDLEDHEGEEL

SEQ ID NO: 89887 - protein, 32 aa, Artificial Sequence
  Description of Artificial Sequence: Synthetic polypeptide
DECEIATTNPVATEQYGSVSATDLEDHIGEDL

SEQ ID NO: 89888 - protein, 32 aa, Artificial Sequence
  Description of Artificial Sequence: Synthetic polypeptide
DECEIATTNPVATEQYGSVSATQLEDTEGEDL

SEQ ID NO: 89889 - protein, 33 aa, Artificial Sequence
  Description of Artificial Sequence: Synthetic polypeptide
DECEIATTNPVATEQYGSVSTTNDLEDTEGEDS

SEQ ID NO: 89890 - protein, 31 aa, Artificial Sequence
  Description of Artificial Sequence: Synthetic polypeptide
DEMEIVTTNPVSTEQYGTVSATGLVEFEGND

SEQ ID NO: 89891 - protein, 34 aa, Artificial Sequence
  Description of Artificial Sequence: Synthetic polypeptide
DEEEIRTTNPVATEQYGSYVYSPTEVLERMVEEL

SEQ ID NO: 89892 - protein, 30 aa, Artificial Sequence
  Description of Artificial Sequence: Synthetic polypeptide
DESEIATTNPVATECWGNVSCNEQDREGQG

SEQ ID NO: 89893 - protein, 33 aa, Artificial Sequence
  Description of Artificial Sequence: Synthetic polypeptide
DEEEIRTTNPVATEQYGSYVYTSSDQYGEEEFM

SEQ ID NO: 89894 - protein, 31 aa, Artificial Sequence
  Description of Artificial Sequence: Synthetic polypeptide
DEMEIVTTNPVATEQYGTVSTGPVMNFEGND

SEQ ID NO: 89895 - protein, 31 aa, Artificial Sequence
  Description of Artificial Sequence: Synthetic polypeptide
DEMEIVTTNPVATEQYGTVSTGPVMNAEGND

SEQ ID NO: 89896 - protein, 31 aa, Artificial Sequence
  Description of Artificial Sequence: Synthetic polypeptide
DEMEIVTTNPVATEQYGTVSTDGPVEFEGND

SEQ ID NO: 89897 - protein, 30 aa, Artificial Sequence
  Description of Artificial Sequence: Synthetic polypeptide
DESEIATTNPVATECWGNVSNNEQDREGQG

SEQ ID NO: 89898 - protein, 31 aa, Artificial Sequence
  Description of Artificial Sequence: Synthetic polypeptide
DEMEIVTTNPVATEQYGTVSTDGPVEAEGND

SEQ ID NO: 89899 - protein, 32 aa, Artificial Sequence
  Description of Artificial Sequence: Synthetic polypeptide
DEMEIVTTNPVATEQYGTVSTDGIVEQFNGNH

SEQ ID NO: 89900 - protein, 31 aa, Artificial Sequence
  Description of Artificial Sequence: Synthetic polypeptide
DECEIATTNPVATEQYYSVSATDLEDHGEDL

SEQ ID NO: 89901 - protein, 31 aa, Artificial Sequence
  Description of Artificial Sequence: Synthetic polypeptide
DESEIATTNPVATECWGSASEINEQREGENG

SEQ ID NO: 89902 - protein, 31 aa, Artificial Sequence
  Description of Artificial Sequence: Synthetic polypeptide
DEMEIVTTNPVATEQYGTVSTDGEVEFEGND

SEQ ID NO: 89903 - protein, 31 aa, Artificial Sequence
  Description of Artificial Sequence: Synthetic polypeptide
DESEIATTNPVATECWGSVPCINEQDRGENK

SEQ ID NO: 89904 - protein, 34 aa, Artificial Sequence
  Description of Artificial Sequence: Synthetic polypeptide
DEEEIRTTNPVATEQYGTVCSATDAGPNMREGNV

SEQ ID NO: 89905 - protein, 34 aa, Artificial Sequence
  Description of Artificial Sequence: Synthetic polypeptide
DEEEIRTTNPVATEQYGTVCSATDAGPNMRNGNV

SEQ ID NO: 89906 - protein, 33 aa, Artificial Sequence
  Description of Artificial Sequence: Synthetic polypeptide
DEEEIRTTNPVATEQYGTVCSATDAPPEFEGNV

SEQ ID NO: 89907 - protein, 32 aa, Artificial Sequence
  Description of Artificial Sequence: Synthetic polypeptide
DEMEIVTTNPVATEQYGSVCSATDPEDHEGND

SEQ ID NO: 89908 - protein, 32 aa, Artificial Sequence
  Description of Artificial Sequence: Synthetic polypeptide
DEMEIVTTNPVATEQYGSVCSATDLEDHEGED

SEQ ID NO: 89909 - protein, 33 aa, Artificial Sequence
  Description of Artificial Sequence: Synthetic polypeptide
DESEIATTNPVAYEQWGSVCSTNLQGDAGNDEE

SEQ ID NO: 89910 - protein, 33 aa, Artificial Sequence
  Description of Artificial Sequence: Synthetic polypeptide
DECEICTTNPVATEQYGSVSTTDNLEDTEGEQL

SEQ ID NO: 89911 - protein, 33 aa, Artificial Sequence
  Description of Artificial Sequence: Synthetic polypeptide
DEMEIVTTNPVATEQYGSVCSATDGPVEFEGNR

SEQ ID NO: 89912 - protein, 31 aa, Artificial Sequence
  Description of Artificial Sequence: Synthetic polypeptide
DEMEIVTTNPVATEQYGNVSATDGPEFEGND

SEQ ID NO: 89913 - protein, 31 aa, Artificial Sequence
  Description of Artificial Sequence: Synthetic polypeptide
DEMEIVTTNPVATEQYGNVSATDGIEFEGND

SEQ ID NO: 89914 - protein, 33 aa, Artificial Sequence
  Description of Artificial Sequence: Synthetic polypeptide
DESEIATTNPVAYEPYGSVSTGNLSQTYGGATR

SEQ ID NO: 89915 - protein, 30 aa, Artificial Sequence
  Description of Artificial Sequence: Synthetic polypeptide
DESEIATTNPVAYEQYGSVAASLDRESNDE

SEQ ID NO: 89916 - protein, 33 aa, Artificial Sequence
  Description of Artificial Sequence: Synthetic polypeptide
DECEICTTNPVATEQYGSVSTTNALEDTEGEDE

SEQ ID NO: 89917 - protein, 32 aa, Artificial Sequence
  Description of Artificial Sequence: Synthetic polypeptide
DEMEIVTTNPVATEQYGIVCSATNPVEFEGND

SEQ ID NO: 89918 - protein, 31 aa, Artificial Sequence
  Description of Artificial Sequence: Synthetic polypeptide
DESEIATTNPVAYEQYGSVAATNEQDGTGTD

SEQ ID NO: 89919 - protein, 31 aa, Artificial Sequence
  Description of Artificial Sequence: Synthetic polypeptide
DEMEIVTTNPVATEQYGEACSTDNPEFEGND

SEQ ID NO: 89920 - protein, 32 aa, Artificial Sequence
  Description of Artificial Sequence: Synthetic polypeptide
DEAEIATTNPVAYEQWGSVSGNDLQGGMNGGH

SEQ ID NO: 89921 - protein, 32 aa, Artificial Sequence
  Description of Artificial Sequence: Synthetic polypeptide
DEMEIVTTNPVATEQYGEACSEDGLVQFEGNR

SEQ ID NO: 89922 - protein, 35 aa, Artificial Sequence
  Description of Artificial Sequence: Synthetic polypeptide
DECEICTTNPVATEQYGSVSTTNLGNQENGNEDEE

SEQ ID NO: 89923 - protein, 33 aa, Artificial Sequence
  Description of Artificial Sequence: Synthetic polypeptide
DECEICTTNPVATEQYGSVSTTLQLENTEEEDD

SEQ ID NO: 89924 - protein, 31 aa, Artificial Sequence
  Description of Artificial Sequence: Synthetic polypeptide
DEAEIATTNPVAYEQWGSVSTNLEGEHNNGA

SEQ ID NO: 89925 - protein, 33 aa, Artificial Sequence
  Description of Artificial Sequence: Synthetic polypeptide
DECEICTTNPVATEQYGSVSTTANLEDTEGEAL

SEQ ID NO: 89926 - protein, 32 aa, Artificial Sequence
  Description of Artificial Sequence: Synthetic polypeptide
DESEIATTNPVAYEPYGSVSTGNLSNTRGGAT

SEQ ID NO: 89927 - protein, 30 aa, Artificial Sequence
  Description of Artificial Sequence: Synthetic polypeptide
DEAEIATTNPVAYEQWGTISATANLAAPNR

SEQ ID NO: 89928 - protein, 32 aa, Artificial Sequence
  Description of Artificial Sequence: Synthetic polypeptide
DEAEIATTNPVAYEQWGSVYHTNDNQDGNGDR

SEQ ID NO: 89929 - protein, 33 aa, Artificial Sequence
  Description of Artificial Sequence: Synthetic polypeptide
DEMEIVTTNPVATEQYGTACSATDNPVQREGND

SEQ ID NO: 89930 - protein, 32 aa, Artificial Sequence
  Description of Artificial Sequence: Synthetic polypeptide
DEMEIVTTNPVATEQYGSVSATDLEDFEGEDL

SEQ ID NO: 89931 - protein, 32 aa, Artificial Sequence
  Description of Artificial Sequence: Synthetic polypeptide
DEMEIVTTNPVATEQYGSVSATDGPEDHEGND

SEQ ID NO: 89932 - protein, 33 aa, Artificial Sequence
  Description of Artificial Sequence: Synthetic polypeptide
DEMEIVTTNPVATEQYGSVSATDGLVEDFEGNL

SEQ ID NO: 89933 - protein, 31 aa, Artificial Sequence
  Description of Artificial Sequence: Synthetic polypeptide
DESEIATTNPVAYDPHYGSVSTNLQDDTGDM

SEQ ID NO: 89934 - protein, 31 aa, Artificial Sequence
  Description of Artificial Sequence: Synthetic polypeptide
DEAEIATTNPVAYEQWGSVSTNLQGQDQDTM

SEQ ID NO: 89935 - protein, 32 aa, Artificial Sequence
  Description of Artificial Sequence: Synthetic polypeptide
DEMEIVTTNPVATEQYGSVSACDGPVEREGND

SEQ ID NO: 89936 - protein, 34 aa, Artificial Sequence
  Description of Artificial Sequence: Synthetic polypeptide
DEMEIVTTNPVATEQYGSVCSATINPVEREGENG

SEQ ID NO: 89937 - protein, 33 aa, Artificial Sequence
  Description of Artificial Sequence: Synthetic polypeptide
DEAEIATTNPVAYEQWGSVSTNLNGDAGGGNGR

SEQ ID NO: 89938 - protein, 34 aa, Artificial Sequence
  Description of Artificial Sequence: Synthetic polypeptide
DEMEIVTTNPVATEQYGSVCSATINPVEREGEND

SEQ ID NO: 89939 - protein, 32 aa, Artificial Sequence
  Description of Artificial Sequence: Synthetic polypeptide
DECEICTTNPVATEQYGSVSTTALEDTIGEDL

SEQ ID NO: 89940 - protein, 31 aa, Artificial Sequence
  Description of Artificial Sequence: Synthetic polypeptide
DESEIATTNPVAYECYGVVSTTNLQHGDEAD

SEQ ID NO: 89941 - protein, 33 aa, Artificial Sequence
  Description of Artificial Sequence: Synthetic polypeptide
DEMEIVTTNPVATEQYGSVCSATINPVEFEGND

SEQ ID NO: 89942 - protein, 33 aa, Artificial Sequence
  Description of Artificial Sequence: Synthetic polypeptide
DESEIATTNPVAYEPYGSVSTGNFSQTRGGAER

SEQ ID NO: 89943 - protein, 33 aa, Artificial Sequence
  Description of Artificial Sequence: Synthetic polypeptide
DEMEIVTTNPVATEQYGSVCSATIGPVQFEGND

SEQ ID NO: 89944 - protein, 31 aa, Artificial Sequence
  Description of Artificial Sequence: Synthetic polypeptide
DEMEIVTTNPVATEQYGDVCSTDGPVEFGNL

SEQ ID NO: 89945 - protein, 32 aa, Artificial Sequence
  Description of Artificial Sequence: Synthetic polypeptide
DESEIATTNPVAYEQYGSVAITDNDQQGNDTY

SEQ ID NO: 89946 - protein, 33 aa, Artificial Sequence
  Description of Artificial Sequence: Synthetic polypeptide
DESEIATTNPVAYEQYGSVAITDNDQQGNNDRF

SEQ ID NO: 89947 - protein, 32 aa, Artificial Sequence
  Description of Artificial Sequence: Synthetic polypeptide
DESEIATTNPVAYEQYGSVAITDNDQQTNDRL

SEQ ID NO: 89948 - protein, 35 aa, Artificial Sequence
  Description of Artificial Sequence: Synthetic polypeptide
DECEICTTNPVATEQYGSVSTTNNLNQVNGNEEEE

SEQ ID NO: 89949 - protein, 31 aa, Artificial Sequence
  Description of Artificial Sequence: Synthetic polypeptide
DESEIATTNPVAYEQYGSVATALPREAGTEM

SEQ ID NO: 89950 - protein, 32 aa, Artificial Sequence
  Description of Artificial Sequence: Synthetic polypeptide
DESEIATTNPVAYEQYGSVATALQRENPGTEK

SEQ ID NO: 89951 - protein, 34 aa, Artificial Sequence
  Description of Artificial Sequence: Synthetic polypeptide
DECEICTTNPVATEQYGSVSTTNNQLNMEQGNTE

SEQ ID NO: 89952 - protein, 32 aa, Artificial Sequence
  Description of Artificial Sequence: Synthetic polypeptide
DESEIATTNPVAYEQYGSVATALQRENPNTDM

SEQ ID NO: 89953 - protein, 31 aa, Artificial Sequence
  Description of Artificial Sequence: Synthetic polypeptide
DEMEIVTTNPIATEQYGTVCSATDNPEFGND

SEQ ID NO: 89954 - protein, 33 aa, Artificial Sequence
  Description of Artificial Sequence: Synthetic polypeptide
DEMEIVTTNPIATEQYGTVCSATDGLVEREGNR

SEQ ID NO: 89955 - protein, 30 aa, Artificial Sequence
  Description of Artificial Sequence: Synthetic polypeptide
DEMEIVTTNPCATEQYGIVSCDGPQFEGTR

SEQ ID NO: 89956 - protein, 32 aa, Artificial Sequence
  Description of Artificial Sequence: Synthetic polypeptide
DESEIATTNPVAYEQYGSVATSLQREADNTEK

SEQ ID NO: 89957 - protein, 31 aa, Artificial Sequence
  Description of Artificial Sequence: Synthetic polypeptide
DEMEIVSTNPVATEQYGTVSATDGPEFVGNR

SEQ ID NO: 89958 - protein, 31 aa, Artificial Sequence
  Description of Artificial Sequence: Synthetic polypeptide
DEMEIVSTNPVATEQYGTVCSTDGLVEFGND

SEQ ID NO: 89959 - protein, 30 aa, Artificial Sequence
  Description of Artificial Sequence: Synthetic polypeptide
DESEIATTNPVCTECWGSVSDNEPQDSGNG

SEQ ID NO: 89960 - protein, 34 aa, Artificial Sequence
  Description of Artificial Sequence: Synthetic polypeptide
DECEICTTNPVATEQYGSVSTTNNQQEQQGVNLT

SEQ ID NO: 89961 - protein, 31 aa, Artificial Sequence
  Description of Artificial Sequence: Synthetic polypeptide
DEMEIVSTNPVATEQYGTVCSATGPVQFGND

SEQ ID NO: 89962 - protein, 34 aa, Artificial Sequence
  Description of Artificial Sequence: Synthetic polypeptide
DEEEIRTTNPVATEQYGTVSVDDNMGQDEGGENG

SEQ ID NO: 89963 - protein, 33 aa, Artificial Sequence
  Description of Artificial Sequence: Synthetic polypeptide
DEEEIRTTNPVATEQYGTVSVDQNMGMEGGENI

SEQ ID NO: 89964 - protein, 31 aa, Artificial Sequence
  Description of Artificial Sequence: Synthetic polypeptide
DEMEIVSTNPVATEQYGTVCSATGLEFEGNQ

SEQ ID NO: 89965 - protein, 31 aa, Artificial Sequence
  Description of Artificial Sequence: Synthetic polypeptide
DESEIATTNPVAYEQYGSVASSLQREAPGGE

SEQ ID NO: 89966 - protein, 31 aa, Artificial Sequence
  Description of Artificial Sequence: Synthetic polypeptide
DEMEIVTTNPVATEQYGTACSTDNPEFEGND

SEQ ID NO: 89967 - protein, 35 aa, Artificial Sequence
  Description of Artificial Sequence: Synthetic polypeptide
DECEICTTNPVATEQYGSVSTTNNLNGNQQGTNTD

SEQ ID NO: 89968 - protein, 29 aa, Artificial Sequence
  Description of Artificial Sequence: Synthetic peptide
DEMEIVTTNPVATEGYGTMCASTLQHGDD

SEQ ID NO: 89969 - protein, 31 aa, Artificial Sequence
  Description of Artificial Sequence: Synthetic polypeptide
DEMEIVTTNPVATEQYGDVCSTDGPVEFGND

SEQ ID NO: 89970 - protein, 32 aa, Artificial Sequence
  Description of Artificial Sequence: Synthetic polypeptide
DEMEIVTTNPVATEQWGTVSTINPVQFEGENG

SEQ ID NO: 89971 - protein, 32 aa, Artificial Sequence
  Description of Artificial Sequence: Synthetic polypeptide
DEMEIVTTNPVATEQWGTVSATINPVQFEGND

SEQ ID NO: 89972 - protein, 35 aa, Artificial Sequence
  Description of Artificial Sequence: Synthetic polypeptide
DECEICTTNPVATEQYGSVSTTNLLNQQNNGTENN

SEQ ID NO: 89973 - protein, 34 aa, Artificial Sequence
  Description of Artificial Sequence: Synthetic polypeptide
DECEICTTNPVATEQYGSVSTTNLLNQQNQGEEE

SEQ ID NO: 89974 - protein, 34 aa, Artificial Sequence
  Description of Artificial Sequence: Synthetic polypeptide
DECEICTTNPVATEQYGSVSTTNLLNQVNGETEE

SEQ ID NO: 89975 - protein, 35 aa, Artificial Sequence
  Description of Artificial Sequence: Synthetic polypeptide
DEEEIRTTNPVATEQYGTVSTTPAIPNMQNGMNPV

SEQ ID NO: 89976 - protein, 35 aa, Artificial Sequence
  Description of Artificial Sequence: Synthetic polypeptide
DEEEIRTTNPVATEQYGTVSTTPDIPNMQNGMNPV

SEQ ID NO: 89977 - protein, 34 aa, Artificial Sequence
  Description of Artificial Sequence: Synthetic polypeptide
DECEICTTNPVATEQYGSVSTTNLLNQVNNGETE

SEQ ID NO: 89978 - protein, 33 aa, Artificial Sequence
  Description of Artificial Sequence: Synthetic polypeptide
DECEICTTNPVATEQYGSVSTTNLLNQVNQEEE

SEQ ID NO: 89979 - protein, 33 aa, Artificial Sequence
  Description of Artificial Sequence: Synthetic polypeptide
DESEIATTNPVAYEQYGSVAITDNDQRGPNDQV

SEQ ID NO: 89980 - protein, 32 aa, Artificial Sequence
  Description of Artificial Sequence: Synthetic polypeptide
DEMEIVTTNPVATEQWGTVSATDNPVQFEGND

SEQ ID NO: 89981 - protein, 32 aa, Artificial Sequence
  Description of Artificial Sequence: Synthetic polypeptide
DEMEIVTTNPVATEQWGSVSCIGPVQDREGNG

SEQ ID NO: 89982 - protein, 31 aa, Artificial Sequence
  Description of Artificial Sequence: Synthetic polypeptide
DEMEIVTTNPVATEGYGTVCSANTPEREGND

SEQ ID NO: 89983 - protein, 31 aa, Artificial Sequence
  Description of Artificial Sequence: Synthetic polypeptide
DEMEIVTTNPVATEGYGTVCSANTIEREGND

SEQ ID NO: 89984 - protein, 29 aa, Artificial Sequence
  Description of Artificial Sequence: Synthetic peptide
DEMEIVTTNPVATEGYGTMCATTLQFGDD

SEQ ID NO: 89985 - protein, 35 aa, Artificial Sequence
  Description of Artificial Sequence: Synthetic polypeptide
DECEICTTNPVATEQYGSVSTTNLQQEQQGTNTTQ

SEQ ID NO: 89986 - protein, 29 aa, Artificial Sequence
  Description of Artificial Sequence: Synthetic peptide
DEMEIVTTNPVATEGYGTMCASTLQFGDD

SEQ ID NO: 89987 - protein, 31 aa, Artificial Sequence
  Description of Artificial Sequence: Synthetic polypeptide
DEMEIVSTNPVATEGYGTVSANTIESRVGNR

SEQ ID NO: 89988 - protein, 33 aa, Artificial Sequence
  Description of Artificial Sequence: Synthetic polypeptide
DEMEIVTTNPVATEQYGTVCSANDGPQSRVGND

SEQ ID NO: 89989 - protein, 31 aa, Artificial Sequence
  Description of Artificial Sequence: Synthetic polypeptide
DEMEIVTTNPVATEQYGTVCSANGPEFEGND

SEQ ID NO: 89990 - protein, 32 aa, Artificial Sequence
  Description of Artificial Sequence: Synthetic polypeptide
DESEIATTNPVATEQYGNVAANGIVQSREGND

SEQ ID NO: 89991 - protein, 30 aa, Artificial Sequence
  Description of Artificial Sequence: Synthetic polypeptide
DEAEIATTNPVAYEQYGSVAATNLAPPEDD

SEQ ID NO: 89992 - protein, 35 aa, Artificial Sequence
  Description of Artificial Sequence: Synthetic polypeptide
DEEEIRTTNPVATEQYGTVDSTVNGLETGGNGNGD

SEQ ID NO: 89993 - protein, 33 aa, Artificial Sequence
  Description of Artificial Sequence: Synthetic polypeptide
DEMEIVTTNPVATEQYGTVCSATDGQVEREGND

SEQ ID NO: 89994 - protein, 32 aa, Artificial Sequence
  Description of Artificial Sequence: Synthetic polypeptide
DESEIATTNPVATEQYGNVSANTIQSHEGQDR

SEQ ID NO: 89995 - protein, 29 aa, Artificial Sequence
  Description of Artificial Sequence: Synthetic peptide
DESEIATTNPVATEQYGSAPEVCQHEGEK

SEQ ID NO: 89996 - protein, 29 aa, Artificial Sequence
  Description of Artificial Sequence: Synthetic peptide
DECEIATTNPVAYEQYGVCSTIDQDHNDN

SEQ ID NO: 89997 - protein, 32 aa, Artificial Sequence
  Description of Artificial Sequence: Synthetic polypeptide
DECEIATTNPVAYEQYGTVSWTELDNRNGMDR

SEQ ID NO: 89998 - protein, 37 aa, Artificial Sequence
  Description of Artificial Sequence: Synthetic polypeptide
DEEEIRTTNPVATEQYGSVSTNLQQGNQQGNVTEEED

SEQ ID NO: 89999 - protein, 34 aa, Artificial Sequence
  Description of Artificial Sequence: Synthetic polypeptide
DESEIATTNPVATEQYGSTVASCTNGLSAYGGNS

SEQ ID NO: 90000 - protein, 33 aa, Artificial Sequence
  Description of Artificial Sequence: Synthetic polypeptide
DEMEIVTTNPVATEQYGTVCSATDGPVQREGND

SEQ ID NO: 90001 - protein, 32 aa, Artificial Sequence
  Description of Artificial Sequence: Synthetic polypeptide
DEMEIVTTNPVATEQYGTVCSATDGPVQFGND

SEQ ID NO: 90002 - protein, 34 aa, Artificial Sequence
  Description of Artificial Sequence: Synthetic polypeptide
DEEEIRTTNPVATEQYGTVITNLGVGVGGGNNGD

SEQ ID NO: 90003 - protein, 32 aa, Artificial Sequence
  Description of Artificial Sequence: Synthetic polypeptide
DESEIATTNPVATEQYGSVAATDLQDHEGEDL

SEQ ID NO: 90004 - protein, 31 aa, Artificial Sequence
  Description of Artificial Sequence: Synthetic polypeptide
DEAEIATTNPVAYEQYGSTVAANNLADSGNF

SEQ ID NO: 90005 - protein, 34 aa, Artificial Sequence
  Description of Artificial Sequence: Synthetic polypeptide
DEEEIRTTNPVATEQYGTVMGTNDQGGGEDNEGG

SEQ ID NO: 90006 - protein, 37 aa, Artificial Sequence
  Description of Artificial Sequence: Synthetic polypeptide
DEEEIRTTNPVATEQYGSVSTNLQQGNNNQEQNEEQD

SEQ ID NO: 90007 - protein, 33 aa, Artificial Sequence
  Description of Artificial Sequence: Synthetic polypeptide
DEEEIRTTNPVATEQYGTVCSTTDGPVNFNGND

SEQ ID NO: 90008 - protein, 34 aa, Artificial Sequence
  Description of Artificial Sequence: Synthetic polypeptide
DEEEIRTTNPVATEQYGTVCSTTDAGPNMRNGNV

SEQ ID NO: 90009 - protein, 33 aa, Artificial Sequence
  Description of Artificial Sequence: Synthetic polypeptide
DECEIATTNPVAYEQYGTVSCTNLQDGDGHNQQ

SEQ ID NO: 90010 - protein, 31 aa, Artificial Sequence
  Description of Artificial Sequence: Synthetic polypeptide
DEMEIVTTNPVATEQYGTVCSATGPEFEGND

SEQ ID NO: 90011 - protein, 32 aa, Artificial Sequence
  Description of Artificial Sequence: Synthetic polypeptide
DEMEIVTTNPVATEQYGTVCSATGLVEFEGNQ

SEQ ID NO: 90012 - protein, 33 aa, Artificial Sequence
  Description of Artificial Sequence: Synthetic polypeptide
DEEEIRTTNPVATEQYGTVCSATDAPVEFEGNV

SEQ ID NO: 90013 - protein, 32 aa, Artificial Sequence
  Description of Artificial Sequence: Synthetic polypeptide
DEMEIVTTNPVATEQYGTVCSATGLVEFEGND

SEQ ID NO: 90014 - protein, 33 aa, Artificial Sequence
  Description of Artificial Sequence: Synthetic polypeptide
DEEEIRTTNPVATEQYGTVCSATDGPVEFEGND

SEQ ID NO: 90015 - protein, 33 aa, Artificial Sequence
  Description of Artificial Sequence: Synthetic polypeptide
DEEEIRTTNPVATEQYGTVCSATDGPVEFEGNV

SEQ ID NO: 90016 - protein, 34 aa, Artificial Sequence
  Description of Artificial Sequence: Synthetic polypeptide
DEEEIRTTNPVATEQYGTVCSNTEPHQNFGSNQS

SEQ ID NO: 90017 - protein, 31 aa, Artificial Sequence
  Description of Artificial Sequence: Synthetic polypeptide
DEAEIATTNPVAYEQYGSVATADQRENPNEE

SEQ ID NO: 90018 - protein, 34 aa, Artificial Sequence
  Description of Artificial Sequence: Synthetic polypeptide
DEEEIRTTNPVATEQYGTVCSTEHQENFGSNTQS

SEQ ID NO: 90019 - protein, 32 aa, Artificial Sequence
  Description of Artificial Sequence: Synthetic polypeptide
DEMEIVTTNPVATEQYGTVCSATDNPVEFGND

SEQ ID NO: 90020 - protein, 33 aa, Artificial Sequence
  Description of Artificial Sequence: Synthetic polypeptide
DEEEIRTTNPVATEQYGTVCSTGEHQNFGSDTQ

SEQ ID NO: 90021 - protein, 31 aa, Artificial Sequence
  Description of Artificial Sequence: Synthetic polypeptide
DECEIATTNPVAYEQYGTVATGGNGQAGNVQ

SEQ ID NO: 90022 - protein, 32 aa, Artificial Sequence
  Description of Artificial Sequence: Synthetic polypeptide
DEMEIVTTNPVATEQYGTVCSATDNPMFEGND

SEQ ID NO: 90023 - protein, 31 aa, Artificial Sequence
  Description of Artificial Sequence: Synthetic polypeptide
DECEIATTNPVAYEQYGTVATNLQGEHNNGQ

SEQ ID NO: 90024 - protein, 32 aa, Artificial Sequence
  Description of Artificial Sequence: Synthetic polypeptide
DEAEIATTNPVAYEQYGSVAGTNLQDDSNNSD

SEQ ID NO: 90025 - protein, 35 aa, Artificial Sequence
  Description of Artificial Sequence: Synthetic polypeptide
DESEIATTNPVATEQYGCSVSCTNGSQRTGTKNFV

SEQ ID NO: 90026 - protein, 37 aa, Artificial Sequence
  Description of Artificial Sequence: Synthetic polypeptide
DEEEIRTTNPVATEQYGSVSTNLQQLGNQAGNQEGED

SEQ ID NO: 90027 - protein, 33 aa, Artificial Sequence
  Description of Artificial Sequence: Synthetic polypeptide
DESEIATTNPVATEQYGSVAITNSLFQVAGEDF

SEQ ID NO: 90028 - protein, 34 aa, Artificial Sequence
  Description of Artificial Sequence: Synthetic polypeptide
DEEEIRTTNPVATEQYGTVMGTVNGLEGGNINEE

SEQ ID NO: 90029 - protein, 31 aa, Artificial Sequence
  Description of Artificial Sequence: Synthetic polypeptide
DECEIATTNPVAYEQYGVCSTIDQRGPNNDN

SEQ ID NO: 90030 - protein, 33 aa, Artificial Sequence
  Description of Artificial Sequence: Synthetic polypeptide
DEEEIRTTNPVATEQYGTVNNGQTDIQTGGGNQ

SEQ ID NO: 90031 - protein, 34 aa, Artificial Sequence
  Description of Artificial Sequence: Synthetic polypeptide
DEEEIRTTNPVATEQYGTVSSMEAIPNQRNGNPH

SEQ ID NO: 90032 - protein, 33 aa, Artificial Sequence
  Description of Artificial Sequence: Synthetic polypeptide
DEMEIVTTNPVATEQYGTVCSATDGLVMFEGNR

SEQ ID NO: 90033 - protein, 34 aa, Artificial Sequence
  Description of Artificial Sequence: Synthetic polypeptide
DEEEIRTTNPVATEQYGTVSSTTPAGPNREGNPV

SEQ ID NO: 90034 - protein, 32 aa, Artificial Sequence
  Description of Artificial Sequence: Synthetic polypeptide
DEMEIVTTNPVATEQYGTVCSATDGLEHEGNL

SEQ ID NO: 90035 - protein, 32 aa, Artificial Sequence
  Description of Artificial Sequence: Synthetic polypeptide
DESEIATTNPVATEQYGTVCSATGIVQFEGND

SEQ ID NO: 90036 - protein, 32 aa, Artificial Sequence
  Description of Artificial Sequence: Synthetic polypeptide
DEMEIVTTNPVATEQYGTVCSATDGLEHEGND

SEQ ID NO: 90037 - protein, 32 aa, Artificial Sequence
  Description of Artificial Sequence: Synthetic polypeptide
DEMEIVTTNPVATEQYGTVCSATDGLEFEGNI

SEQ ID NO: 90038 - protein, 29 aa, Artificial Sequence
  Description of Artificial Sequence: Synthetic peptide
DESEIATTNPVATEQYGVMATDGLEHGDD

SEQ ID NO: 90039 - protein, 29 aa, Artificial Sequence
  Description of Artificial Sequence: Synthetic peptide
DESEIATTNPVATEQYGVMATDGLEHGDI

SEQ ID NO: 90040 - protein, 29 aa, Artificial Sequence
  Description of Artificial Sequence: Synthetic peptide
DESEIATTNPVATEQYGVMATTLVEHGDD

SEQ ID NO: 90041 - protein, 31 aa, Artificial Sequence
  Description of Artificial Sequence: Synthetic polypeptide
DESEIATTNPVATEQYGVVATDLQDHEGDDL

SEQ ID NO: 90042 - protein, 32 aa, Artificial Sequence
  Description of Artificial Sequence: Synthetic polypeptide
DEMEIVTTNPVATEQYGTVCSATDGLEFEGND

SEQ ID NO: 90043 - protein, 31 aa, Artificial Sequence
  Description of Artificial Sequence: Synthetic polypeptide
DESEIATTNPVATEQYGVVSATDGLVEFGDD

SEQ ID NO: 90044 - protein, 32 aa, Artificial Sequence
  Description of Artificial Sequence: Synthetic polypeptide
DEMEIVTTNPVATEQYGTVCSATDDLEHEGNL

SEQ ID NO: 90045 - protein, 33 aa, Artificial Sequence
  Description of Artificial Sequence: Synthetic polypeptide
DESEIATTNPVATTNWGSVSWTNDLDQRQTGNM

SEQ ID NO: 90046 - protein, 29 aa, Artificial Sequence
  Description of Artificial Sequence: Synthetic peptide
DESEIATTNPVAYDHYGAVSTNLQHDTMK

SEQ ID NO: 90047 - protein, 30 aa, Artificial Sequence
  Description of Artificial Sequence: Synthetic polypeptide
DESEIATTNPVAYDHYGKVSENELSQRVNM

SEQ ID NO: 90048 - protein, 33 aa, Artificial Sequence
  Description of Artificial Sequence: Synthetic polypeptide
DESEIATTNPVATEQYGSVSTTPAGNMRGMNPI

SEQ ID NO: 90049 - protein, 35 aa, Artificial Sequence
  Description of Artificial Sequence: Synthetic polypeptide
DEEEIRTTNPVATEQYGTVSTGNELSQMPGGMPSS

SEQ ID NO: 90050 - protein, 33 aa, Artificial Sequence
  Description of Artificial Sequence: Synthetic polypeptide
DESEIATTNPVATEQYGSVSTNEPEDREGEEDL

SEQ ID NO: 90051 - protein, 33 aa, Artificial Sequence
  Description of Artificial Sequence: Synthetic polypeptide
DESEIATTNPVATEQYGSVSSTPTGPNMRNGNV

SEQ ID NO: 90052 - protein, 31 aa, Artificial Sequence
  Description of Artificial Sequence: Synthetic polypeptide
DECEIATTNPVAYERWGEVSTNLQGNDMDGR

SEQ ID NO: 90053 - protein, 33 aa, Artificial Sequence
  Description of Artificial Sequence: Synthetic polypeptide
DECEIATTNPVAYERWGSVCSTNLQGDAGNGER

SEQ ID NO: 90054 - protein, 33 aa, Artificial Sequence
  Description of Artificial Sequence: Synthetic polypeptide
DESEIATTNPVATEQYGSVCTIDNHDGGGDNPR

SEQ ID NO: 90055 - protein, 32 aa, Artificial Sequence
  Description of Artificial Sequence: Synthetic polypeptide
DEAEIATTNPVAYEQYGSIACTNLTDTEPGNR

SEQ ID NO: 90056 - protein, 32 aa, Artificial Sequence
  Description of Artificial Sequence: Synthetic polypeptide
DESEIATTNPVATEQYGSVSACDLEDHEGNDG

SEQ ID NO: 90057 - protein, 35 aa, Artificial Sequence
  Description of Artificial Sequence: Synthetic polypeptide
DEEEIRTTNPVATEQYGTVSNTELGLGQEGGGNQG

SEQ ID NO: 90058 - protein, 31 aa, Artificial Sequence
  Description of Artificial Sequence: Synthetic polypeptide
DEAEIATTNPVAYEQYGSCSTNLEIAPNEAM

SEQ ID NO: 90059 - protein, 35 aa, Artificial Sequence
  Description of Artificial Sequence: Synthetic polypeptide
DEEEIRTTNPVATEQYGTVSNTELTLGQEGGGGNQ

SEQ ID NO: 90060 - protein, 32 aa, Artificial Sequence
  Description of Artificial Sequence: Synthetic polypeptide
DESEIATTNPVATEQYGSVSATDLEDHEGEDL

SEQ ID NO: 90061 - protein, 35 aa, Artificial Sequence
  Description of Artificial Sequence: Synthetic polypeptide
DEEEIRTTNPVATEQYGTVSNTELTLGQEGGGNES

SEQ ID NO: 90062 - protein, 33 aa, Artificial Sequence
  Description of Artificial Sequence: Synthetic polypeptide
DECEIATVNPVATEQYGSVSWTEDLRDEGGNHR

SEQ ID NO: 90063 - protein, 32 aa, Artificial Sequence
  Description of Artificial Sequence: Synthetic polypeptide
DESEIATTNPVATEQYGSVSATDLEDHEGEWL

SEQ ID NO: 90064 - protein, 35 aa, Artificial Sequence
  Description of Artificial Sequence: Synthetic polypeptide
DEEEIRTTNPVATEQYGTVSNTELTLGQEGGGNNT

SEQ ID NO: 90065 - protein, 32 aa, Artificial Sequence
  Description of Artificial Sequence: Synthetic polypeptide
DESEIATTNPVATEQYGSVSATDLESHEGQDL

SEQ ID NO: 90066 - protein, 33 aa, Artificial Sequence
  Description of Artificial Sequence: Synthetic polypeptide
DESEIATTNPVATEQYGSVSATDLQDHEGEEDL

SEQ ID NO: 90067 - protein, 33 aa, Artificial Sequence
  Description of Artificial Sequence: Synthetic polypeptide
DECEICTTNPMATEQWGSVAPTDNDQDRNGNGR

SEQ ID NO: 90068 - protein, 34 aa, Artificial Sequence
  Description of Artificial Sequence: Synthetic polypeptide
DESEIATTNPVATEQYGSVSSCTNGSHRTGTKNF

SEQ ID NO: 90069 - protein, 33 aa, Artificial Sequence
  Description of Artificial Sequence: Synthetic polypeptide
DECEICTTNPMATEQWGSVAPTDNNDQHRGNGR

SEQ ID NO: 90070 - protein, 33 aa, Artificial Sequence
  Description of Artificial Sequence: Synthetic polypeptide
DEGEIATTNPVATEQYGSVCAANNLQEAGENHN

SEQ ID NO: 90071 - protein, 33 aa, Artificial Sequence
  Description of Artificial Sequence: Synthetic polypeptide
DESEIRTTNPVATECCGSVSCINEPQDREGENG

SEQ ID NO: 90072 - protein, 33 aa, Artificial Sequence
  Description of Artificial Sequence: Synthetic polypeptide
DESEIRTTNPVATECFGSVSCINEPQDREGENG

SEQ ID NO: 90073 - protein, 33 aa, Artificial Sequence
  Description of Artificial Sequence: Synthetic polypeptide
DESEIRTTNPVATECWGSVSCINEPQDRRGENG

SEQ ID NO: 90074 - protein, 33 aa, Artificial Sequence
  Description of Artificial Sequence: Synthetic polypeptide
DESEIRTTNPVATECWGSVSCINEPQDRSGENG

SEQ ID NO: 90075 - protein, 33 aa, Artificial Sequence
  Description of Artificial Sequence: Synthetic polypeptide
DESEIRTTNPVATECWGSVSCINEPQDRTGENF

SEQ ID NO: 90076 - protein, 33 aa, Artificial Sequence
  Description of Artificial Sequence: Synthetic polypeptide
DESEIRTTNPVATECWGSVSCINEPQDRTGENG

SEQ ID NO: 90077 - protein, 33 aa, Artificial Sequence
  Description of Artificial Sequence: Synthetic polypeptide
DESEIRTTNPVATECWGSVSCINEPQDRTGENQ

SEQ ID NO: 90078 - protein, 33 aa, Artificial Sequence
  Description of Artificial Sequence: Synthetic polypeptide
DESEIRTTNPVATECWGSVSCINEPQDRVGENG

SEQ ID NO: 90079 - protein, 33 aa, Artificial Sequence
  Description of Artificial Sequence: Synthetic polypeptide
DESEIRTTNPVATECWGSVSCINEPQDRWGENG

SEQ ID NO: 90080 - protein, 31 aa, Artificial Sequence
  Description of Artificial Sequence: Synthetic polypeptide
DEDEIATTNPVATEQWGCVATNLQEEGGEQA

SEQ ID NO: 90081 - protein, 33 aa, Artificial Sequence
  Description of Artificial Sequence: Synthetic polypeptide
DESEIRTTNPVATECWGSVSCINEPQDRYGENG

SEQ ID NO: 90082 - protein, 33 aa, Artificial Sequence
  Description of Artificial Sequence: Synthetic polypeptide
DESEIRTTNPVATECWGSVSCINEPQFREGENG

SEQ ID NO: 90083 - protein, 33 aa, Artificial Sequence
  Description of Artificial Sequence: Synthetic polypeptide
DESEIRTTNPVATECWGSVSCINEPQFREGENT

SEQ ID NO: 90084 - protein, 32 aa, Artificial Sequence
  Description of Artificial Sequence: Synthetic polypeptide
DESEIRTTNPVATECWGSVSCINEPQGEGENG

SEQ ID NO: 90085 - protein, 33 aa, Artificial Sequence
  Description of Artificial Sequence: Synthetic polypeptide
DESEIRTTNPVATECWGSVSCINEPQGREGENG

SEQ ID NO: 90086 - protein, 33 aa, Artificial Sequence
  Description of Artificial Sequence: Synthetic polypeptide
DESEIRTTNPVATECWGSVSCINEPQGREGENQ

SEQ ID NO: 90087 - protein, 33 aa, Artificial Sequence
  Description of Artificial Sequence: Synthetic polypeptide
DESEIRTTNPVATECWGSVSCINEPQGREGFNG

SEQ ID NO: 90088 - protein, 33 aa, Artificial Sequence
  Description of Artificial Sequence: Synthetic polypeptide
DESEIRTTNPVATECWGSVSCINEPQHREGENG

SEQ ID NO: 90089 - protein, 33 aa, Artificial Sequence
  Description of Artificial Sequence: Synthetic polypeptide
DESEIRTTNPVATECWGSVSCINEPQEREGENG

SEQ ID NO: 90090 - protein, 33 aa, Artificial Sequence
  Description of Artificial Sequence: Synthetic polypeptide
DESEIRTTNPVATECWGSVSCINEPQDRQGENG

SEQ ID NO: 90091 - protein, 33 aa, Artificial Sequence
  Description of Artificial Sequence: Synthetic polypeptide
DESEIRTTNPVATECWGSVSCINEPQDRPGERG

SEQ ID NO: 90092 - protein, 33 aa, Artificial Sequence
  Description of Artificial Sequence: Synthetic polypeptide
DESEIRTTNPVATECWGSVSCINEPQDRPGENG

SEQ ID NO: 90093 - protein, 33 aa, Artificial Sequence
  Description of Artificial Sequence: Synthetic polypeptide
DESEIRTTNPVATECWGSVSCINEPQDREGVNG

SEQ ID NO: 90094 - protein, 33 aa, Artificial Sequence
  Description of Artificial Sequence: Synthetic polypeptide
DESEIRTTNPVATECWGSVSCINEPQDREGVNV

SEQ ID NO: 90095 - protein, 33 aa, Artificial Sequence
  Description of Artificial Sequence: Synthetic polypeptide
DESEIRTTNPVATECWGSVSCINEPQDREGWNG

SEQ ID NO: 90096 - protein, 33 aa, Artificial Sequence
  Description of Artificial Sequence: Synthetic polypeptide
DESEIRTTNPVATECWGSVSCINEPQDREGYNG

SEQ ID NO: 90097 - protein, 33 aa, Artificial Sequence
  Description of Artificial Sequence: Synthetic polypeptide
DESEIRTTNPVATECWGSVSCINEPQDRESENR

SEQ ID NO: 90098 - protein, 33 aa, Artificial Sequence
  Description of Artificial Sequence: Synthetic polypeptide
DESEIRTTNPVATECWGSVSCINEPQDRFGENG

SEQ ID NO: 90099 - protein, 33 aa, Artificial Sequence
  Description of Artificial Sequence: Synthetic polypeptide
DESEIRTTNPVATECWGSVSCINEPQDRGGENG

SEQ ID NO: 90100 - protein, 33 aa, Artificial Sequence
  Description of Artificial Sequence: Synthetic polypeptide
DESEIRTTNPVATECWGSVSCINEPQDRHGENG

SEQ ID NO: 90101 - protein, 33 aa, Artificial Sequence
  Description of Artificial Sequence: Synthetic polypeptide
DESEIRTTNPVATECWGSVSCINEPQDRIGENG

SEQ ID NO: 90102 - protein, 33 aa, Artificial Sequence
  Description of Artificial Sequence: Synthetic polypeptide
DESEIRTTNPVATECWGSVSCINEPQDRKGENG

SEQ ID NO: 90103 - protein, 30 aa, Artificial Sequence
  Description of Artificial Sequence: Synthetic polypeptide
DEDEIATTNPVATEQWGCVAATHLQTRPDD

SEQ ID NO: 90104 - protein, 33 aa, Artificial Sequence
  Description of Artificial Sequence: Synthetic polypeptide
DESEIRTTNPVATECWGSVSCINEPQDRLGENG

SEQ ID NO: 90105 - protein, 33 aa, Artificial Sequence
  Description of Artificial Sequence: Synthetic polypeptide
DESEIRTTNPVATECWGSVSCINEPQDRLGENW

SEQ ID NO: 90106 - protein, 33 aa, Artificial Sequence
  Description of Artificial Sequence: Synthetic polypeptide
DESEIRTTNPVATECWGSVSCINEPQDRMGENG

SEQ ID NO: 90107 - protein, 33 aa, Artificial Sequence
  Description of Artificial Sequence: Synthetic polypeptide
DESEIRTTNPVATECWGSVSCINEPQDRMGHNG

SEQ ID NO: 90108 - protein, 33 aa, Artificial Sequence
  Description of Artificial Sequence: Synthetic polypeptide
DESEIRTTNPVATECWGSVSCINEPQDRNGENG

SEQ ID NO: 90109 - protein, 33 aa, Artificial Sequence
  Description of Artificial Sequence: Synthetic polypeptide
DESEIRTTNPVATECWGSVSCINEPQDRNGMNG

SEQ ID NO: 90110 - protein, 33 aa, Artificial Sequence
  Description of Artificial Sequence: Synthetic polypeptide
DEMEIRTTNPVATEQYGSVCSTWALQPETQADQ

SEQ ID NO: 90111 - protein, 33 aa, Artificial Sequence
  Description of Artificial Sequence: Synthetic polypeptide
DESEIRTTNPVATECWGSVSCINEPQDREGTNG

SEQ ID NO: 90112 - protein, 33 aa, Artificial Sequence
  Description of Artificial Sequence: Synthetic polypeptide
DESEIRTTNPVATECWGSVSCINEPQIREGENG

SEQ ID NO: 90113 - protein, 33 aa, Artificial Sequence
  Description of Artificial Sequence: Synthetic polypeptide
DESEIRTTNPVATECWGSVSCINEPQKREGENI

SEQ ID NO: 90114 - protein, 33 aa, Artificial Sequence
  Description of Artificial Sequence: Synthetic polypeptide
DESEIRTTNPVATECWGSVSCINEPQQRNGENG

SEQ ID NO: 90115 - protein, 35 aa, Artificial Sequence
  Description of Artificial Sequence: Synthetic polypeptide
DEMEIRTTNPVATEQYGSVCSPTNDLNEGSEEVER

SEQ ID NO: 90116 - protein, 31 aa, Artificial Sequence
  Description of Artificial Sequence: Synthetic polypeptide
DEDEIATTNPVATEQWGSVAMNLNEAEGPRN

SEQ ID NO: 90117 - protein, 33 aa, Artificial Sequence
  Description of Artificial Sequence: Synthetic polypeptide
DESEIRTTNPVATECWGSVSCINEPQRKEGENG

SEQ ID NO: 90118 - protein, 32 aa, Artificial Sequence
  Description of Artificial Sequence: Synthetic polypeptide
DEAEIATTNPVATEQYGSVCADMNDGDTDGNR

SEQ ID NO: 90119 - protein, 32 aa, Artificial Sequence
  Description of Artificial Sequence: Synthetic polypeptide
DEMEIRTTNPVATEQYGSVCSLDNTEREVQDI

SEQ ID NO: 90120 - protein, 30 aa, Artificial Sequence
  Description of Artificial Sequence: Synthetic polypeptide
DAAEIATTNPVAYEQYGSVATNGTAEGGNE

SEQ ID NO: 90121 - protein, 33 aa, Artificial Sequence
  Description of Artificial Sequence: Synthetic polypeptide
DESEIRTTNPVATECWGSVSCINEPQQREGTNG

SEQ ID NO: 90122 - protein, 33 aa, Artificial Sequence
  Description of Artificial Sequence: Synthetic polypeptide
DESEIRTTNPVATECWGSVSCINEPQRREGENG

SEQ ID NO: 90123 - protein, 33 aa, Artificial Sequence
  Description of Artificial Sequence: Synthetic polypeptide
DEMEIRTTNPVATEQYGSVCSDYNDLEETQNQD

SEQ ID NO: 90124 - protein, 33 aa, Artificial Sequence
  Description of Artificial Sequence: Synthetic polypeptide
DESEIRTTNPVATECWGSVSCINEPQSRVGENG

SEQ ID NO: 90125 - protein, 33 aa, Artificial Sequence
  Description of Artificial Sequence: Synthetic polypeptide
DESEIRTTNPVATECWGSVSCINEPQTREGENG

SEQ ID NO: 90126 - protein, 34 aa, Artificial Sequence
  Description of Artificial Sequence: Synthetic polypeptide
DEMEIRTTNPVATEQYGSVCSCINPVEDREGENG

SEQ ID NO: 90127 - protein, 33 aa, Artificial Sequence
  Description of Artificial Sequence: Synthetic polypeptide
DESEIRTTNPVATECWGSVSCINEPQTRWGENG

SEQ ID NO: 90128 - protein, 33 aa, Artificial Sequence
  Description of Artificial Sequence: Synthetic polypeptide
DESEIRTTNPVATECWGSVSCINEPQVREGENG

SEQ ID NO: 90129 - protein, 33 aa, Artificial Sequence
  Description of Artificial Sequence: Synthetic polypeptide
DESEIRTTNPVATECWGSVSCINEPQWREGENG

SEQ ID NO: 90130 - protein, 33 aa, Artificial Sequence
  Description of Artificial Sequence: Synthetic polypeptide
DESEIRTTNPVATECWGSVSCINEPQSREGENG

SEQ ID NO: 90131 - protein, 35 aa, Artificial Sequence
  Description of Artificial Sequence: Synthetic polypeptide
DEEEIRTTNPVATEQYGSVSTMNLDIENELTNDTD

SEQ ID NO: 90132 - protein, 34 aa, Artificial Sequence
  Description of Artificial Sequence: Synthetic polypeptide
DEEEIRTTNPVATEQYGSVSTMNLDINELTEETD

SEQ ID NO: 90133 - protein, 33 aa, Artificial Sequence
  Description of Artificial Sequence: Synthetic polypeptide
DEMEIRTTNPVATEQYGSVCSTDYEAQEGIEFT

SEQ ID NO: 90134 - protein, 33 aa, Artificial Sequence
  Description of Artificial Sequence: Synthetic polypeptide
DESEIRTTNPVATECWGSVSCINEPQKREGPNG

SEQ ID NO: 90135 - protein, 33 aa, Artificial Sequence
  Description of Artificial Sequence: Synthetic polypeptide
DESEIRTTNPVATECWGSVSCINEPQLREGENG

SEQ ID NO: 90136 - protein, 33 aa, Artificial Sequence
  Description of Artificial Sequence: Synthetic polypeptide
DEAEIATTNPVATEQYGSVCAMANDGLTDDGNR

SEQ ID NO: 90137 - protein, 33 aa, Artificial Sequence
  Description of Artificial Sequence: Synthetic polypeptide
DEDEIATTNPVATEQWGSCSATENLEATRDGDR

SEQ ID NO: 90138 - protein, 33 aa, Artificial Sequence
  Description of Artificial Sequence: Synthetic polypeptide
DESEIRTTNPVATECWGSVSCINEPQMREGENG

SEQ ID NO: 90139 - protein, 33 aa, Artificial Sequence
  Description of Artificial Sequence: Synthetic polypeptide
DESEIRTTNPVATECWGSVSCINEPQNRAGENG

SEQ ID NO: 90140 - protein, 32 aa, Artificial Sequence
  Description of Artificial Sequence: Synthetic polypeptide
DESEIRTTNPVATECWGSVSCINEPQNREGDG

SEQ ID NO: 90141 - protein, 33 aa, Artificial Sequence
  Description of Artificial Sequence: Synthetic polypeptide
DEMEIRTTNPVATEQYGSVCSTTDGGVNFEGND

SEQ ID NO: 90142 - protein, 33 aa, Artificial Sequence
  Description of Artificial Sequence: Synthetic polypeptide
DESEIRTTNPVATECWGSVSCINEPQNREGENG

SEQ ID NO: 90143 - protein, 33 aa, Artificial Sequence
  Description of Artificial Sequence: Synthetic polypeptide
DESEIRTTNPVATECWGSVSCINEPQNRIGENG

SEQ ID NO: 90144 - protein, 33 aa, Artificial Sequence
  Description of Artificial Sequence: Synthetic polypeptide
DESEIRTTNPVATECWGSVSCINEPQPRCGENG

SEQ ID NO: 90145 - protein, 33 aa, Artificial Sequence
  Description of Artificial Sequence: Synthetic polypeptide
DESEIRTTNPVATECWGSVSCINEPQPREGENG

SEQ ID NO: 90146 - protein, 33 aa, Artificial Sequence
  Description of Artificial Sequence: Synthetic polypeptide
DESEIRTTNPVATECWGSVSCINEPQPRVGENG

SEQ ID NO: 90147 - protein, 33 aa, Artificial Sequence
  Description of Artificial Sequence: Synthetic polypeptide
DEAEIATTNPVATEQYGSVCAGMNPGETRGENR

SEQ ID NO: 90148 - protein, 33 aa, Artificial Sequence
  Description of Artificial Sequence: Synthetic polypeptide
DESEIRTTNPVATECWGSVSCINEPQQREGENG

SEQ ID NO: 90149 - protein, 32 aa, Artificial Sequence
  Description of Artificial Sequence: Synthetic polypeptide
DEAEIATTNPVATEQYGSVCAGEGNLQNDNNE

SEQ ID NO: 90150 - protein, 32 aa, Artificial Sequence
  Description of Artificial Sequence: Synthetic polypeptide
DEAEIATTNPVATEQYGSVCAFMNDGLTMGNN

SEQ ID NO: 90151 - protein, 33 aa, Artificial Sequence
  Description of Artificial Sequence: Synthetic polypeptide
DESEIRTTNPVATECWGSVSCINEPQKREGENG

SEQ ID NO: 90152 - protein, 33 aa, Artificial Sequence
  Description of Artificial Sequence: Synthetic polypeptide
DESEIRTTNPVATECWGSVSCINEPQDREGSNG

SEQ ID NO: 90153 - protein, 33 aa, Artificial Sequence
  Description of Artificial Sequence: Synthetic polypeptide
DESEIRTTNPVATECWGSVSCINEPQDREGRNG

SEQ ID NO: 90154 - protein, 31 aa, Artificial Sequence
  Description of Artificial Sequence: Synthetic polypeptide
DEAEIATTNPVATEQYGSVCAMNLNMGEDTL

SEQ ID NO: 90155 - protein, 36 aa, Artificial Sequence
  Description of Artificial Sequence: Synthetic polypeptide
DEEEIRTTNPVATEQYGSVSTMNTGIQGEQGENEDQ

SEQ ID NO: 90156 - protein, 33 aa, Artificial Sequence
  Description of Artificial Sequence: Synthetic polypeptide
DESEIRTTNPVATECWGSVSCINEPQDREGANG

SEQ ID NO: 90157 - protein, 33 aa, Artificial Sequence
  Description of Artificial Sequence: Synthetic polypeptide
DESEIRTTNPVATECWGSVSCINEPQDREGCNG

SEQ ID NO: 90158 - protein, 32 aa, Artificial Sequence
  Description of Artificial Sequence: Synthetic polypeptide
DEAEIATTNPVATEQYGSVCATNLADLMNDNH

SEQ ID NO: 90159 - protein, 33 aa, Artificial Sequence
  Description of Artificial Sequence: Synthetic polypeptide
DESEIRTTNPVATECWGSVSCINEPQDREGDNG

SEQ ID NO: 90160 - protein, 32 aa, Artificial Sequence
  Description of Artificial Sequence: Synthetic polypeptide
DESEIRTTNPVATECWGSVSCINEPQDREGEG

SEQ ID NO: 90161 - protein, 33 aa, Artificial Sequence
  Description of Artificial Sequence: Synthetic polypeptide
DESEIRTTNPVATECWGSVSCINEPQDREGENA

SEQ ID NO: 90162 - protein, 32 aa, Artificial Sequence
  Description of Artificial Sequence: Synthetic polypeptide
DESEIRTTNPVATECWGSVSCINEPQDREENG

SEQ ID NO: 90163 - protein, 33 aa, Artificial Sequence
  Description of Artificial Sequence: Synthetic polypeptide
DESEIRTTNPVATECWGSVSCINEPQDREGENC

SEQ ID NO: 90164 - protein, 33 aa, Artificial Sequence
  Description of Artificial Sequence: Synthetic polypeptide
DESEIRTTNPVATECWGSVSCINEPQDREGENE

SEQ ID NO: 90165 - protein, 34 aa, Artificial Sequence
  Description of Artificial Sequence: Synthetic polypeptide
DEMEIRTTNPVATEQYGSVNTNDDLQQEGEEDKN

SEQ ID NO: 90166 - protein, 33 aa, Artificial Sequence
  Description of Artificial Sequence: Synthetic polypeptide
DESEIRTTNPVATECWGSVSCINEPQDREGENF

SEQ ID NO: 90167 - protein, 33 aa, Artificial Sequence
  Description of Artificial Sequence: Synthetic polypeptide
DEAEIATTNPVATEQYGSVCAPMNQGLTMDGNR

SEQ ID NO: 90168 - protein, 34 aa, Artificial Sequence
  Description of Artificial Sequence: Synthetic polypeptide
DESEIRTTNPVATECWGSVSCINEPQDREGENGR

SEQ ID NO: 90169 - protein, 29 aa, Artificial Sequence
  Description of Artificial Sequence: Synthetic peptide
DEDEIATTNPVATASWGCVSTANYDRSNQ

SEQ ID NO: 90170 - protein, 33 aa, Artificial Sequence
  Description of Artificial Sequence: Synthetic polypeptide
DESEIRTTNPVATECWGSVSCINEPQDREGENH

SEQ ID NO: 90171 - protein, 33 aa, Artificial Sequence
  Description of Artificial Sequence: Synthetic polypeptide
DESEIRTTNPVATECWGSVSCINEPQDREGEND

SEQ ID NO: 90172 - protein, 33 aa, Artificial Sequence
  Description of Artificial Sequence: Synthetic polypeptide
DESEIRTTNPVATECWGSVSCINEPQDRDGWNG

SEQ ID NO: 90173 - protein, 33 aa, Artificial Sequence
  Description of Artificial Sequence: Synthetic polypeptide
DESEIRTTNPVATECWGSVSCINEPQDRDGENG

SEQ ID NO: 90174 - protein, 33 aa, Artificial Sequence
  Description of Artificial Sequence: Synthetic polypeptide
DESEIRTTNPVATECWGSVSCINEPQDRCGENG

SEQ ID NO: 90175 - protein, 34 aa, Artificial Sequence
  Description of Artificial Sequence: Synthetic polypeptide
DEAEIATTNPVATEQYGSVCATNVLQPDDGGDRA

SEQ ID NO: 90176 - protein, 32 aa, Artificial Sequence
  Description of Artificial Sequence: Synthetic polypeptide
DESEIRTTNPVATECWGSVSCINEPMDRGENG

SEQ ID NO: 90177 - protein, 32 aa, Artificial Sequence
  Description of Artificial Sequence: Synthetic polypeptide
DESEIRTTNPVATECWGSVSCINEPMREGENG

SEQ ID NO: 90178 - protein, 33 aa, Artificial Sequence
  Description of Artificial Sequence: Synthetic polypeptide
DESEIRTTNPVATECWGSVSCINEPQAREGENG

SEQ ID NO: 90179 - protein, 33 aa, Artificial Sequence
  Description of Artificial Sequence: Synthetic polypeptide
DESEIRTTNPVATECWGSVSCINEPQCRAGENG

SEQ ID NO: 90180 - protein, 33 aa, Artificial Sequence
  Description of Artificial Sequence: Synthetic polypeptide
DESEIRTTNPVATECWGSVSCINEPQCREGENG

SEQ ID NO: 90181 - protein, 34 aa, Artificial Sequence
  Description of Artificial Sequence: Synthetic polypeptide
DEEEIRTTNPVATEQYGSVSTMTTQQERNVPVTS

SEQ ID NO: 90182 - protein, 35 aa, Artificial Sequence
  Description of Artificial Sequence: Synthetic polypeptide
DEEEIRTTNPVATEQYGSVSTMTTLSDGNEGFNIS

SEQ ID NO: 90183 - protein, 34 aa, Artificial Sequence
  Description of Artificial Sequence: Synthetic polypeptide
DEEEIRTTNPVATEQYGSVSTMTLGFGEGGETTE

SEQ ID NO: 90184 - protein, 32 aa, Artificial Sequence
  Description of Artificial Sequence: Synthetic polypeptide
DESEIRTTNPVATECWGSVSCINEPQDFEGNG

SEQ ID NO: 90185 - protein, 32 aa, Artificial Sequence
  Description of Artificial Sequence: Synthetic polypeptide
DESEIRTTNPVATECWGSVSCINEPQDHEGNG

SEQ ID NO: 90186 - protein, 36 aa, Artificial Sequence
  Description of Artificial Sequence: Synthetic polypeptide
DEEEIRTTNPVATEQYGSVSTMQDDNLDEFGENGGT

SEQ ID NO: 90187 - protein, 35 aa, Artificial Sequence
  Description of Artificial Sequence: Synthetic polypeptide
DEEEIRTTNPVATEQYGSVSTMPVDGQGEPEGNGP

SEQ ID NO: 90188 - protein, 34 aa, Artificial Sequence
  Description of Artificial Sequence: Synthetic polypeptide
DEEEIRTTNPVATEQYGSVSTMPVDGQGEFENFD

SEQ ID NO: 90189 - protein, 33 aa, Artificial Sequence
  Description of Artificial Sequence: Synthetic polypeptide
DESEIRTTNPVATECWGSVSCINEPQDRAGENA

SEQ ID NO: 90190 - protein, 33 aa, Artificial Sequence
  Description of Artificial Sequence: Synthetic polypeptide
DESEIRTTNPVATECWGSVSCINEPQDRAGENG

SEQ ID NO: 90191 - protein, 33 aa, Artificial Sequence
  Description of Artificial Sequence: Synthetic polypeptide
DESEIRTTNPVATECWGSVSCINEPQDRAGENI

SEQ ID NO: 90192 - protein, 33 aa, Artificial Sequence
  Description of Artificial Sequence: Synthetic polypeptide
DESEIRTTNPVATECWGSVSCINEPQDREGENI

SEQ ID NO: 90193 - protein, 33 aa, Artificial Sequence
  Description of Artificial Sequence: Synthetic polypeptide
DESEIRTTNPVATECWGSVSCINEPQDREGENK

SEQ ID NO: 90194 - protein, 33 aa, Artificial Sequence
  Description of Artificial Sequence: Synthetic polypeptide
DESEIRTTNPVATECWGSVSCINEPQDREGENL

SEQ ID NO: 90195 - protein, 33 aa, Artificial Sequence
  Description of Artificial Sequence: Synthetic polypeptide
DESEIRTTNPVATECWGSVSCINEPQDREGENM

SEQ ID NO: 90196 - protein, 31 aa, Artificial Sequence
  Description of Artificial Sequence: Synthetic polypeptide
DEDEIATTNPVATEPYGSVASNLQNNQDDND

SEQ ID NO: 90197 - protein, 33 aa, Artificial Sequence
  Description of Artificial Sequence: Synthetic polypeptide
DESEIRTTNPVATECWGSVSCINEPQDREGHNG

SEQ ID NO: 90198 - protein, 33 aa, Artificial Sequence
  Description of Artificial Sequence: Synthetic polypeptide
DESEIRTTNPVATECWGSVSCINEPQDREGING

SEQ ID NO: 90199 - protein, 33 aa, Artificial Sequence
  Description of Artificial Sequence: Synthetic polypeptide
DEMEIRTTNPVATEQYGSVFSTLWNNDNEGQDQ

SEQ ID NO: 90200 - protein, 31 aa, Artificial Sequence
  Description of Artificial Sequence: Synthetic polypeptide
DEMEIRTTNPVATEQYGSVEVPNDQNSIEHN

SEQ ID NO: 90201 - protein, 30 aa, Artificial Sequence
  Description of Artificial Sequence: Synthetic polypeptide
DEDEIATTNPVATEPYGSVSANNDRNDTHQ

SEQ ID NO: 90202 - protein, 32 aa, Artificial Sequence
  Description of Artificial Sequence: Synthetic polypeptide
DEMEIRTTNPVATEQYGSVETNTLESMEVMQG

SEQ ID NO: 90203 - protein, 33 aa, Artificial Sequence
  Description of Artificial Sequence: Synthetic polypeptide
DESEIRTTNPVATECWGSVSCINEPQDREGKNG

SEQ ID NO: 90204 - protein, 33 aa, Artificial Sequence
  Description of Artificial Sequence: Synthetic polypeptide
DESEIRTTNPVATECWGSVSCINEPQDREGLNG

SEQ ID NO: 90205 - protein, 33 aa, Artificial Sequence
  Description of Artificial Sequence: Synthetic polypeptide
DESEIRTTNPVATECWGSVSCINEPQDREGMNG

SEQ ID NO: 90206 - protein, 33 aa, Artificial Sequence
  Description of Artificial Sequence: Synthetic polypeptide
DEMEIRTTNPVATEQYGSVEPSNLENRSENDQE

SEQ ID NO: 90207 - protein, 33 aa, Artificial Sequence
  Description of Artificial Sequence: Synthetic polypeptide
DEMEIRTTNPVATEQYGSVCTDYNDLEEHNEHQ

SEQ ID NO: 90208 - protein, 34 aa, Artificial Sequence
  Description of Artificial Sequence: Synthetic polypeptide
DEMEIRTTNPVATEQYGSVCSVTNLMETLSDQRQ

SEQ ID NO: 90209 - protein, 33 aa, Artificial Sequence
  Description of Artificial Sequence: Synthetic polypeptide
DESEIRTTNPVATECWGSVSCINEPQDREGNNG

SEQ ID NO: 90210 - protein, 33 aa, Artificial Sequence
  Description of Artificial Sequence: Synthetic polypeptide
DESEIRTTNPVATECWGSVSCINEPQDREGNYG

SEQ ID NO: 90211 - protein, 33 aa, Artificial Sequence
  Description of Artificial Sequence: Synthetic polypeptide
DESEIRTTNPVATECWGSVSCINEPQDREGPNG

SEQ ID NO: 90212 - protein, 33 aa, Artificial Sequence
  Description of Artificial Sequence: Synthetic polypeptide
DESEIRTTNPVATECWGSVSCINEPQDREGQNG

SEQ ID NO: 90213 - protein, 33 aa, Artificial Sequence
  Description of Artificial Sequence: Synthetic polypeptide
DESEIRTTNPVATECWGSVSCINEPQDREGGNG

SEQ ID NO: 90214 - protein, 33 aa, Artificial Sequence
  Description of Artificial Sequence: Synthetic polypeptide
DESEIRTTNPVATECWGSVSCINEPQWREGVNG

SEQ ID NO: 90215 - protein, 35 aa, Artificial Sequence
  Description of Artificial Sequence: Synthetic polypeptide
DEEEIRTTNPVATEQYGVVSTMTNFGQGEQGNEQE

SEQ ID NO: 90216 - protein, 32 aa, Artificial Sequence
  Description of Artificial Sequence: Synthetic polypeptide
DEDEIATTNPVATENYGSVATGNLQMDPNGGQ

SEQ ID NO: 90217 - protein, 33 aa, Artificial Sequence
  Description of Artificial Sequence: Synthetic polypeptide
DEAEIATTNPVATEQYGSVCAPMNDGDTRDGNR

SEQ ID NO: 90218 - protein, 33 aa, Artificial Sequence
  Description of Artificial Sequence: Synthetic polypeptide
DESEIRTTNPVATECWGSVSCINEPQDREGENN

SEQ ID NO: 90219 - protein, 35 aa, Artificial Sequence
  Description of Artificial Sequence: Synthetic polypeptide
DEMEIRTTNPVATEQYGSVNSTNVGVERFNNEQRG

SEQ ID NO: 90220 - protein, 33 aa, Artificial Sequence
  Description of Artificial Sequence: Synthetic polypeptide
DESEIRTTNPVATECWGSVSCINEPQDREGENP

SEQ ID NO: 90221 - protein, 34 aa, Artificial Sequence
  Description of Artificial Sequence: Synthetic polypeptide
DEMEIRTTNPVATEQYGSVNSTNIGVERDNNNDG

SEQ ID NO: 90222 - protein, 33 aa, Artificial Sequence
  Description of Artificial Sequence: Synthetic polypeptide
DESEIRTTNPVATECWGSVSCINEPQDREGENQ

SEQ ID NO: 90223 - protein, 32 aa, Artificial Sequence
  Description of Artificial Sequence: Synthetic polypeptide
DEMEIRTTNPVATEQYGSVNNTNMEEGESYQN

SEQ ID NO: 90224 - protein, 34 aa, Artificial Sequence
  Description of Artificial Sequence: Synthetic polypeptide
DEMEIRTTNPVATEQYGSVMTLLEQQESGENEKN

SEQ ID NO: 90225 - protein, 34 aa, Artificial Sequence
  Description of Artificial Sequence: Synthetic polypeptide
DESEIRTTNPVATECWGSVSCINEPQDREGENRG

SEQ ID NO: 90226 - protein, 33 aa, Artificial Sequence
  Description of Artificial Sequence: Synthetic polypeptide
DESEIRTTNPVATECWGSVSCINEPQDREGENS

SEQ ID NO: 90227 - protein, 33 aa, Artificial Sequence
  Description of Artificial Sequence: Synthetic polypeptide
DESEIRTTNPVATECWGSVSCINEPQDREGENT

SEQ ID NO: 90228 - protein, 33 aa, Artificial Sequence
  Description of Artificial Sequence: Synthetic polypeptide
DESEIRTTNPVATECWGSVSCINEPQDREGENV

SEQ ID NO: 90229 - protein, 33 aa, Artificial Sequence
  Description of Artificial Sequence: Synthetic polypeptide
DESEIRTTNPVATECWGSVSCINEPQDREGENW

SEQ ID NO: 90230 - protein, 33 aa, Artificial Sequence
  Description of Artificial Sequence: Synthetic polypeptide
DESEIRTTNPVATECWGSVSCINEPQDREGENY

SEQ ID NO: 90231 - protein, 33 aa, Artificial Sequence
  Description of Artificial Sequence: Synthetic polypeptide
DESEIRTTNPVATECWGSVSCINEPQDREGERG

SEQ ID NO: 90232 - protein, 34 aa, Artificial Sequence
  Description of Artificial Sequence: Synthetic polypeptide
DEEEIRTTNPVATEQYGVVSTMNNFQEGGGQGDQ

SEQ ID NO: 90233 - protein, 32 aa, Artificial Sequence
  Description of Artificial Sequence: Synthetic polypeptide
DEDEIATTNPVATENYGSVATGNLQMDDNNGH

SEQ ID NO: 90234 - protein, 33 aa, Artificial Sequence
  Description of Artificial Sequence: Synthetic polypeptide
DESEIRTTNPVATECWGSVSCINEPQDREGFNG

SEQ ID NO: 90235 - protein, 36 aa, Artificial Sequence
  Description of Artificial Sequence: Synthetic polypeptide
DEEEIRTTNPVATEQYGVVSTNLQQGNNTQEEEEED

SEQ ID NO: 90236 - protein, 36 aa, Artificial Sequence
  Description of Artificial Sequence: Synthetic polypeptide
DEEEIRTTNPVATEQYGVVSTNLQQGNQAGNQETEE

SEQ ID NO: 90237 - protein, 33 aa, Artificial Sequence
  Description of Artificial Sequence: Synthetic polypeptide
DESEIRTTNPVATECWGSVSCINEPQYREGENG

SEQ ID NO: 90238 - protein, 33 aa, Artificial Sequence
  Description of Artificial Sequence: Synthetic polypeptide
DESEIRTTNPVATECWGSVSCITIPQDREGENG

SEQ ID NO: 90239 - protein, 33 aa, Artificial Sequence
  Description of Artificial Sequence: Synthetic polypeptide
DEDEIATTNPVATEQYGSVAMNLNPADQTEGNN

SEQ ID NO: 90240 - protein, 31 aa, Artificial Sequence
  Description of Artificial Sequence: Synthetic polypeptide
DEDEIATTNPVATEQYGSVANTGALNGAATR

SEQ ID NO: 90241 - protein, 33 aa, Artificial Sequence
  Description of Artificial Sequence: Synthetic polypeptide
DESEIRTTNPVATECWGSVSCKNEPQDREGENG

SEQ ID NO: 90242 - protein, 33 aa, Artificial Sequence
  Description of Artificial Sequence: Synthetic polypeptide
DEMEIRTTNPVATEQYGCVSTVWIMEENNQDGN

SEQ ID NO: 90243 - protein, 33 aa, Artificial Sequence
  Description of Artificial Sequence: Synthetic polypeptide
DEDEIATTNPVATEQYGSVATNLATAPGGEPRN

SEQ ID NO: 90244 - protein, 32 aa, Artificial Sequence
  Description of Artificial Sequence: Synthetic polypeptide
DAEEIATTNPVATAQWGSVSGTGNPDTDGNRD

SEQ ID NO: 90245 - protein, 33 aa, Artificial Sequence
  Description of Artificial Sequence: Synthetic polypeptide
DEMEIRTTNPVATEQYGCVSVPDLQTSGSNQGY

SEQ ID NO: 90246 - protein, 34 aa, Artificial Sequence
  Description of Artificial Sequence: Synthetic polypeptide
DEMEIRTTNPVATEQYGCVSTVNNLTQRPDDQQS

SEQ ID NO: 90247 - protein, 33 aa, Artificial Sequence
  Description of Artificial Sequence: Synthetic polypeptide
DEMEIRTTNPVATEQYGCVSTVNNLDQEDDAQE

SEQ ID NO: 90248 - protein, 33 aa, Artificial Sequence
  Description of Artificial Sequence: Synthetic polypeptide
DEMEIRTTNPVATEQYGCVSTVNLDERIFDMQE

SEQ ID NO: 90249 - protein, 32 aa, Artificial Sequence
  Description of Artificial Sequence: Synthetic polypeptide
DAEEIATTNPVATAQWGSVSTGNPDNAGENRD

SEQ ID NO: 90250 - protein, 32 aa, Artificial Sequence
  Description of Artificial Sequence: Synthetic polypeptide
DEMEIRTTNPVATEQYGCVSTVLLQENEDPMS

SEQ ID NO: 90251 - protein, 31 aa, Artificial Sequence
  Description of Artificial Sequence: Synthetic polypeptide
DEMEIRTTNPVATEQYGCVSTVLEGSLPDKS

SEQ ID NO: 90252 - protein, 32 aa, Artificial Sequence
  Description of Artificial Sequence: Synthetic polypeptide
DEMEIRTTNPVATEQYGCVSTVLEGSAQDKSW

SEQ ID NO: 90253 - protein, 32 aa, Artificial Sequence
  Description of Artificial Sequence: Synthetic polypeptide
DEMEIRTTNPVATEQYGCVSTQLLMNVQDDDQ

SEQ ID NO: 90254 - protein, 33 aa, Artificial Sequence
  Description of Artificial Sequence: Synthetic polypeptide
DEMEIRTTNPVATEQYGCVSTVNNLDTRDIQQS

SEQ ID NO: 90255 - protein, 32 aa, Artificial Sequence
  Description of Artificial Sequence: Synthetic polypeptide
DEMEIRTTNPVATEQYGCVSVPNNQEIGIDDN

SEQ ID NO: 90256 - protein, 31 aa, Artificial Sequence
  Description of Artificial Sequence: Synthetic polypeptide
DEMEIRTTNPVATEQYGDVCSATGPEFAGDD

SEQ ID NO: 90257 - protein, 33 aa, Artificial Sequence
  Description of Artificial Sequence: Synthetic polypeptide
DESEIRTTNPVATECWGSVSCITEPQDREGENG

SEQ ID NO: 90258 - protein, 33 aa, Artificial Sequence
  Description of Artificial Sequence: Synthetic polypeptide
DESEIRTTNPVATECWGSVSCINTPQDREGENG

SEQ ID NO: 90259 - protein, 33 aa, Artificial Sequence
  Description of Artificial Sequence: Synthetic polypeptide
DESEIRTTNPVATECWGSVSCINTPQDREGENK

SEQ ID NO: 90260 - protein, 33 aa, Artificial Sequence
  Description of Artificial Sequence: Synthetic polypeptide
DESEIRTTNPVATECWGSVSCINVPQDREGENG

SEQ ID NO: 90261 - protein, 33 aa, Artificial Sequence
  Description of Artificial Sequence: Synthetic polypeptide
DESEIRTTNPVATECWGSVSCINWPQDREGENG

SEQ ID NO: 90262 - protein, 33 aa, Artificial Sequence
  Description of Artificial Sequence: Synthetic polypeptide
DESEIRTTNPVATECWGSVSCINYPQDREGENE

SEQ ID NO: 90263 - protein, 33 aa, Artificial Sequence
  Description of Artificial Sequence: Synthetic polypeptide
DESEIRTTNPVATECWGSVSCINYPQDREGENG

SEQ ID NO: 90264 - protein, 33 aa, Artificial Sequence
  Description of Artificial Sequence: Synthetic polypeptide
DESEIRTTNPVATECWGSVSCINYPQDREGMNG

SEQ ID NO: 90265 - protein, 33 aa, Artificial Sequence
  Description of Artificial Sequence: Synthetic polypeptide
DEAEIATTNPVATEQYGSVATNLTDRPQPNDQV

SEQ ID NO: 90266 - protein, 33 aa, Artificial Sequence
  Description of Artificial Sequence: Synthetic polypeptide
DEDEIATTNPVATEQYGSVAANLQEAQDGTDNH

SEQ ID NO: 90267 - protein, 31 aa, Artificial Sequence
  Description of Artificial Sequence: Synthetic polypeptide
DEDEIATTNPVATEQYGSVAANNDVRGTPDE

SEQ ID NO: 90268 - protein, 32 aa, Artificial Sequence
  Description of Artificial Sequence: Synthetic polypeptide
DEDEIATTNPVATEQYGSVAATANLDANNNNE

SEQ ID NO: 90269 - protein, 32 aa, Artificial Sequence
  Description of Artificial Sequence: Synthetic polypeptide
DEDEIATTNPVATEQYGSVAATANLMGMPNTN

SEQ ID NO: 90270 - protein, 32 aa, Artificial Sequence
  Description of Artificial Sequence: Synthetic polypeptide
DEDEIATTNPVATEQYGSVAATANPQESGTVQ

SEQ ID NO: 90271 - protein, 33 aa, Artificial Sequence
  Description of Artificial Sequence: Synthetic polypeptide
DEDEIATTNPVATEQYGSVAATPNDQQMGPNDG

SEQ ID NO: 90272 - protein, 32 aa, Artificial Sequence
  Description of Artificial Sequence: Synthetic polypeptide
DEMEIRTTNPVATEQYGDVCSATIEVEAEGND

SEQ ID NO: 90273 - protein, 32 aa, Artificial Sequence
  Description of Artificial Sequence: Synthetic polypeptide
DEMEIRTTNPVATEQYGDVCSATGPVEFEGND

SEQ ID NO: 90274 - protein, 31 aa, Artificial Sequence
  Description of Artificial Sequence: Synthetic polypeptide
DEDEIATTNPVATEQYGSVAGTNPDNQHNEQ

SEQ ID NO: 90275 - protein, 33 aa, Artificial Sequence
  Description of Artificial Sequence: Synthetic polypeptide
DAEEIATTNPVATEQWGAVTSTNHLNTRGNTEQ

SEQ ID NO: 90276 - protein, 33 aa, Artificial Sequence
  Description of Artificial Sequence: Synthetic polypeptide
DEMEIRTTNPVATEQYGCVSTNLLQTFVVQDHE

SEQ ID NO: 90277 - protein, 36 aa, Artificial Sequence
  Description of Artificial Sequence: Synthetic polypeptide
DEEEIRTTNPVATEQYGVVSTTNNLQAGNQAGTVVE

SEQ ID NO: 90278 - protein, 33 aa, Artificial Sequence
  Description of Artificial Sequence: Synthetic polypeptide
DEMEIRTTNPVATEQYGCVSTNLLESGFTQIET

SEQ ID NO: 90279 - protein, 33 aa, Artificial Sequence
  Description of Artificial Sequence: Synthetic polypeptide
DEDEIATTNPVATEQYGSVCAANNLQEAGNMDT

SEQ ID NO: 90280 - protein, 33 aa, Artificial Sequence
  Description of Artificial Sequence: Synthetic polypeptide
DESEIRTTNPVATECWGSVSCPNEPQDREGVNG

SEQ ID NO: 90281 - protein, 32 aa, Artificial Sequence
  Description of Artificial Sequence: Synthetic polypeptide
DEDEIATTNPVATEQYGSVCAANNLQEAGTVN

SEQ ID NO: 90282 - protein, 31 aa, Artificial Sequence
  Description of Artificial Sequence: Synthetic polypeptide
DEDEIATTNPVATEQYGSVCAANNLTSDNEH

SEQ ID NO: 90283 - protein, 34 aa, Artificial Sequence
  Description of Artificial Sequence: Synthetic polypeptide
DEEEIRTTNPVATEQYGSVSTMELTDLDEGEGGQ

SEQ ID NO: 90284 - protein, 32 aa, Artificial Sequence
  Description of Artificial Sequence: Synthetic polypeptide
DEMEIRTTNPVATEQYGCVCSTEHQNFGSEQS

SEQ ID NO: 90285 - protein, 33 aa, Artificial Sequence
  Description of Artificial Sequence: Synthetic polypeptide
DESEIRTTNPVATECWGSVSCPNGPQDREGENG

SEQ ID NO: 90286 - protein, 33 aa, Artificial Sequence
  Description of Artificial Sequence: Synthetic polypeptide
DEDEIATTNPVATEQYGSVCAANPLQEADNNRQ

SEQ ID NO: 90287 - protein, 33 aa, Artificial Sequence
  Description of Artificial Sequence: Synthetic polypeptide
DESEIRTTNPVATECWGSVSCQNEPQDREGENG

SEQ ID NO: 90288 - protein, 33 aa, Artificial Sequence
  Description of Artificial Sequence: Synthetic polypeptide
DESEIRTTNPVATECWGSVSCQNEPQDREGENL

SEQ ID NO: 90289 - protein, 33 aa, Artificial Sequence
  Description of Artificial Sequence: Synthetic polypeptide
DESEIRTTNPVATECWGSVSCQNEPQDREGENQ

SEQ ID NO: 90290 - protein, 33 aa, Artificial Sequence
  Description of Artificial Sequence: Synthetic polypeptide
DESEIRTTNPVATECWGSVSCQNEPQEREGENG

SEQ ID NO: 90291 - protein, 33 aa, Artificial Sequence
  Description of Artificial Sequence: Synthetic polypeptide
DESEIRTTNPVATECWGSVSCQNHSQDREGGNG

SEQ ID NO: 90292 - protein, 33 aa, Artificial Sequence
  Description of Artificial Sequence: Synthetic polypeptide
DESEIRTTNPVATECWGSVSCRNEPQDREGENG

SEQ ID NO: 90293 - protein, 33 aa, Artificial Sequence
  Description of Artificial Sequence: Synthetic polypeptide
DESEIRTTNPVATECWGSVSCRNEPQDREGWNG

SEQ ID NO: 90294 - protein, 31 aa, Artificial Sequence
  Description of Artificial Sequence: Synthetic polypeptide
DEMEIRTTNPVATEQYGCVCSSNHAYFNSNQ

SEQ ID NO: 90295 - protein, 35 aa, Artificial Sequence
  Description of Artificial Sequence: Synthetic polypeptide
DEEEIRTTNPVATEQYGSVSTMEHNPDAAMNELRV

SEQ ID NO: 90296 - protein, 33 aa, Artificial Sequence
  Description of Artificial Sequence: Synthetic polypeptide
DESEIRTTNPVATECWGSVSCPNEPQDREGENG

SEQ ID NO: 90297 - protein, 33 aa, Artificial Sequence
  Description of Artificial Sequence: Synthetic polypeptide
DESEIRTTNPVATECWGSVSCINSPQDREGENG

SEQ ID NO: 90298 - protein, 31 aa, Artificial Sequence
  Description of Artificial Sequence: Synthetic polypeptide
DAEEIATTNPVATEQWGSVTSADLQDGPKSM

SEQ ID NO: 90299 - protein, 33 aa, Artificial Sequence
  Description of Artificial Sequence: Synthetic polypeptide
DESEIRTTNPVATECWGSVSCNNECQDREGENG

SEQ ID NO: 90300 - protein, 33 aa, Artificial Sequence
  Description of Artificial Sequence: Synthetic polypeptide
DEMEIRTTNPVATEQYGCVSTLNLTNFNGLQDT

SEQ ID NO: 90301 - protein, 31 aa, Artificial Sequence
  Description of Artificial Sequence: Synthetic polypeptide
DEMEIRTTNPVATEQYGCVSTLLETDAPDKS

SEQ ID NO: 90302 - protein, 33 aa, Artificial Sequence
  Description of Artificial Sequence: Synthetic polypeptide
DEEEIRTTNPVATEQYGSVSTMGMEISDTGQGG

SEQ ID NO: 90303 - protein, 33 aa, Artificial Sequence
  Description of Artificial Sequence: Synthetic polypeptide
DEMEIRTTNPVATEQYGCVSPTNNEQETGLEDI

SEQ ID NO: 90304 - protein, 32 aa, Artificial Sequence
  Description of Artificial Sequence: Synthetic polypeptide
DEMEIRTTNPVATEQYGCVSPAEVDRGSNQES

SEQ ID NO: 90305 - protein, 33 aa, Artificial Sequence
  Description of Artificial Sequence: Synthetic polypeptide
DESEIRTTNPVATECWGSVSCKNEPQNREGENG

SEQ ID NO: 90306 - protein, 33 aa, Artificial Sequence
  Description of Artificial Sequence: Synthetic polypeptide
DESEIRTTNPVATECWGSVSCLNEPQDREGENG

SEQ ID NO: 90307 - protein, 33 aa, Artificial Sequence
  Description of Artificial Sequence: Synthetic polypeptide
DESEIRTTNPVATECWGSVSCMNENQDRFGSNV

SEQ ID NO: 90308 - protein, 33 aa, Artificial Sequence
  Description of Artificial Sequence: Synthetic polypeptide
DESEIRTTNPVATECWGSVSCMNEPQDREGENG

SEQ ID NO: 90309 - protein, 32 aa, Artificial Sequence
  Description of Artificial Sequence: Synthetic polypeptide
DEMEIRTTNPVATEQYGCVIWTNETQETQNEN

SEQ ID NO: 90310 - protein, 32 aa, Artificial Sequence
  Description of Artificial Sequence: Synthetic polypeptide
DESEIRTTNPVATECWGSVSCNEPQDREGEEG

SEQ ID NO: 90311 - protein, 32 aa, Artificial Sequence
  Description of Artificial Sequence: Synthetic polypeptide
DESEIRTTNPVATECWGSVSCNEPQDREGEHG

SEQ ID NO: 90312 - protein, 33 aa, Artificial Sequence
  Description of Artificial Sequence: Synthetic polypeptide
DEMEIRTTNPVATEQYGCVCSTNHQNFNSNNQL

SEQ ID NO: 90313 - protein, 33 aa, Artificial Sequence
  Description of Artificial Sequence: Synthetic polypeptide
DEMEIRTTNPVATEQYGCVCSTGELQNFGSEQA

SEQ ID NO: 90314 - protein, 33 aa, Artificial Sequence
  Description of Artificial Sequence: Synthetic polypeptide
DESEIRTTNPVATECWGSVSCNEPQDREGENSG

SEQ ID NO: 90315 - protein, 31 aa, Artificial Sequence
  Description of Artificial Sequence: Synthetic polypeptide
DESEIRTTNPVATECWGSVSCNEPQNAEGDG

SEQ ID NO: 90316 - protein, 33 aa, Artificial Sequence
  Description of Artificial Sequence: Synthetic polypeptide
DEMEIRTTNPVATEQYGCVCSTENHQNFGSEQF

SEQ ID NO: 90317 - protein, 33 aa, Artificial Sequence
  Description of Artificial Sequence: Synthetic polypeptide
DESEIRTTNPVATECWGSVSCNNEPQDREGENG

SEQ ID NO: 90318 - protein, 33 aa, Artificial Sequence
  Description of Artificial Sequence: Synthetic polypeptide
DESEIRTTNPVATECWGSVSCINEPLDREGENG

SEQ ID NO: 90319 - protein, 34 aa, Artificial Sequence
  Description of Artificial Sequence: Synthetic polypeptide
DESEIRTTNPVATECWGSVSCINSELQDREGENG

SEQ ID NO: 90320 - protein, 33 aa, Artificial Sequence
  Description of Artificial Sequence: Synthetic polypeptide
DESEIRTTNPVATECWGSVSCINRPQDREGENG

SEQ ID NO: 90321 - protein, 35 aa, Artificial Sequence
  Description of Artificial Sequence: Synthetic polypeptide
DEEEIRTTNPVATEQYGSVSTMNGGQQGTGQGQGE

SEQ ID NO: 90322 - protein, 35 aa, Artificial Sequence
  Description of Artificial Sequence: Synthetic polypeptide
DEEEIRTTNPVATEQYGSVSTMNGGQQGISEGQGG

SEQ ID NO: 90323 - protein, 33 aa, Artificial Sequence
  Description of Artificial Sequence: Synthetic polypeptide
DESEIRTTNPVATECWGSVSCINEWQDREGENG

SEQ ID NO: 90324 - protein, 33 aa, Artificial Sequence
  Description of Artificial Sequence: Synthetic polypeptide
DESEIRTTNPVATECWGSVSCINEWQWREGENG

SEQ ID NO: 90325 - protein, 35 aa, Artificial Sequence
  Description of Artificial Sequence: Synthetic polypeptide
DEEEIRTTNPVATEQYGSVSTMNGFGQENDGEFGE

SEQ ID NO: 90326 - protein, 33 aa, Artificial Sequence
  Description of Artificial Sequence: Synthetic polypeptide
DESEIRTTNPVATECWGSVSCINEYQDREGENG

SEQ ID NO: 90327 - protein, 34 aa, Artificial Sequence
  Description of Artificial Sequence: Synthetic polypeptide
DEEEIRTTNPVATEQYGSVSTMNGDTPEGGEEHG

SEQ ID NO: 90328 - protein, 31 aa, Artificial Sequence
  Description of Artificial Sequence: Synthetic polypeptide
DEDEIATTNPVATEQYGCNNATNHQAEGPRS

SEQ ID NO: 90329 - protein, 32 aa, Artificial Sequence
  Description of Artificial Sequence: Synthetic polypeptide
DEMEIRTTNPVATEQYGSSSSNTSQQHEGETN

SEQ ID NO: 90330 - protein, 33 aa, Artificial Sequence
  Description of Artificial Sequence: Synthetic polypeptide
DESEIRTTNPVATECWGSVSCINGPQDREGENG

SEQ ID NO: 90331 - protein, 33 aa, Artificial Sequence
  Description of Artificial Sequence: Synthetic polypeptide
DESEIRTTNPVATECWGSVSCINGPQDRNGENG

SEQ ID NO: 90332 - protein, 33 aa, Artificial Sequence
  Description of Artificial Sequence: Synthetic polypeptide
DESEIRTTNPVATECWGSVSCINHPQDREGENG

SEQ ID NO: 90333 - protein, 33 aa, Artificial Sequence
  Description of Artificial Sequence: Synthetic polypeptide
DESEIRTTNPVATECWGSVSCINHPQVREGENG

SEQ ID NO: 90334 - protein, 34 aa, Artificial Sequence
  Description of Artificial Sequence: Synthetic polypeptide
DEEEIRTTNPVATEQYGSVSTMNDMQQSTSIHPS

SEQ ID NO: 90335 - protein, 33 aa, Artificial Sequence
  Description of Artificial Sequence: Synthetic polypeptide
DESEIRTTNPVATECWGSVSCINIPQDREGENG

SEQ ID NO: 90336 - protein, 30 aa, Artificial Sequence
  Description of Artificial Sequence: Synthetic polypeptide
DEDEIATTNPVATEQYGCVAATANDDMPNN

SEQ ID NO: 90337 - protein, 33 aa, Artificial Sequence
  Description of Artificial Sequence: Synthetic polypeptide
DESEIRTTNPVATECWGSVSCINFPQDREGENG

SEQ ID NO: 90338 - protein, 31 aa, Artificial Sequence
  Description of Artificial Sequence: Synthetic polypeptide
DEDEIATTNPVATEQYGCNATNNHQAEGPER

SEQ ID NO: 90339 - protein, 30 aa, Artificial Sequence
  Description of Artificial Sequence: Synthetic polypeptide
DEMEIRTTNPVATEQYGSVCQTAHINMSQQ

SEQ ID NO: 90340 - protein, 31 aa, Artificial Sequence
  Description of Artificial Sequence: Synthetic polypeptide
DEDEIATTNPVATEQYGCIATTNHQNAEGPR

SEQ ID NO: 90341 - protein, 31 aa, Artificial Sequence
  Description of Artificial Sequence: Synthetic polypeptide
DEDEIATTNPVATEQWGSVSTGNNDNRDIDQ

SEQ ID NO: 90342 - protein, 34 aa, Artificial Sequence
  Description of Artificial Sequence: Synthetic polypeptide
DEMEIRTTNPVATEQYGSVCSCIGPVQDREGENG

SEQ ID NO: 90343 - protein, 34 aa, Artificial Sequence
  Description of Artificial Sequence: Synthetic polypeptide
DEMEIRTTNPVATEQYGSVCSCIGPPQDREGENG

SEQ ID NO: 90344 - protein, 33 aa, Artificial Sequence
  Description of Artificial Sequence: Synthetic polypeptide
DESEIRTTNPVATECWGSVSCINEQQDREGENG

SEQ ID NO: 90345 - protein, 33 aa, Artificial Sequence
  Description of Artificial Sequence: Synthetic polypeptide
DESEIRTTNPVATECWGSVSCINEQQDREGENL

SEQ ID NO: 90346 - protein, 33 aa, Artificial Sequence
  Description of Artificial Sequence: Synthetic polypeptide
DESEIRTTNPVATECWGSVSCINEQQDRTGENG

SEQ ID NO: 90347 - protein, 33 aa, Artificial Sequence
  Description of Artificial Sequence: Synthetic polypeptide
DESEIRTTNPVATECWGSVSCINEQQQREGENG

SEQ ID NO: 90348 - protein, 33 aa, Artificial Sequence
  Description of Artificial Sequence: Synthetic polypeptide
DESEIRTTNPVATECWGSVSCINERQDREGENG

SEQ ID NO: 90349 - protein, 33 aa, Artificial Sequence
  Description of Artificial Sequence: Synthetic polypeptide
DESEIRTTNPVATECWGSVSCINERQDREGENL

SEQ ID NO: 90350 - protein, 33 aa, Artificial Sequence
  Description of Artificial Sequence: Synthetic polypeptide
DESEIRTTNPVATECWGSVSCINESQDRCGENG

SEQ ID NO: 90351 - protein, 33 aa, Artificial Sequence
  Description of Artificial Sequence: Synthetic polypeptide
DESEIRTTNPVATECWGSVSCINESQDREGENG

SEQ ID NO: 90352 - protein, 33 aa, Artificial Sequence
  Description of Artificial Sequence: Synthetic polypeptide
DESEIRTTNPVATECWGSVSCINESQQREGENG

SEQ ID NO: 90353 - protein, 29 aa, Artificial Sequence
  Description of Artificial Sequence: Synthetic peptide
DEDEIATTNPVATEQWGTNCSAALDRSNS

SEQ ID NO: 90354 - protein, 33 aa, Artificial Sequence
  Description of Artificial Sequence: Synthetic polypeptide
DESEIRTTNPVATECWGSVSCINETQDREGENG

SEQ ID NO: 90355 - protein, 33 aa, Artificial Sequence
  Description of Artificial Sequence: Synthetic polypeptide
DESEIRTTNPVATECWGSVSCINEVQDREGENF

SEQ ID NO: 90356 - protein, 33 aa, Artificial Sequence
  Description of Artificial Sequence: Synthetic polypeptide
DESEIRTTNPVATECWGSVSCINEVQDREGENG

SEQ ID NO: 90357 - protein, 31 aa, Artificial Sequence
  Description of Artificial Sequence: Synthetic polypeptide
DEDEIATTNPVATEQYGCFTATNLQVGGDSM

SEQ ID NO: 90358 - protein, 33 aa, Artificial Sequence
  Description of Artificial Sequence: Synthetic polypeptide
DESEIRTTNPVATECWGSVSCINIPQDREGWNG

SEQ ID NO: 90359 - protein, 36 aa, Artificial Sequence
  Description of Artificial Sequence: Synthetic polypeptide
DEEEIRTTNPVATEQYGVVSTNTNNLNNQQGTNQEE

SEQ ID NO: 90360 - protein, 31 aa, Artificial Sequence
  Description of Artificial Sequence: Synthetic polypeptide
DEDEIATTNPVATEQYGCVAATANLMDGTGT

SEQ ID NO: 90361 - protein, 30 aa, Artificial Sequence
  Description of Artificial Sequence: Synthetic polypeptide
DEMEIRTTNPVATEQYGSCYTPPLNNNQED

SEQ ID NO: 90362 - protein, 33 aa, Artificial Sequence
  Description of Artificial Sequence: Synthetic polypeptide
DESEIRTTNPVATECWGSVSCINMPQDRKGENG

SEQ ID NO: 90363 - protein, 33 aa, Artificial Sequence
  Description of Artificial Sequence: Synthetic polypeptide
DESEIRTTNPVATECWGSVSCINNPQDREGENA

SEQ ID NO: 90364 - protein, 33 aa, Artificial Sequence
  Description of Artificial Sequence: Synthetic polypeptide
DESEIRTTNPVATECWGSVSCINNPQDREGENG

SEQ ID NO: 90365 - protein, 32 aa, Artificial Sequence
  Description of Artificial Sequence: Synthetic polypeptide
DAEEIASTNPVATEQYGSVSWNEQERNGQKDA

SEQ ID NO: 90366 - protein, 32 aa, Artificial Sequence
  Description of Artificial Sequence: Synthetic polypeptide
DEAEIATTNPVATEQYGSVCAADNGDDRMINR

SEQ ID NO: 90367 - protein, 32 aa, Artificial Sequence
  Description of Artificial Sequence: Synthetic polypeptide
DEAEIATTNPVATEQYGSVATTNLEQHMDEAE

SEQ ID NO: 90368 - protein, 31 aa, Artificial Sequence
  Description of Artificial Sequence: Synthetic polypeptide
DEAEIATTNPVATEQYGSVATTNLEANAEAQ

SEQ ID NO: 90369 - protein, 32 aa, Artificial Sequence
  Description of Artificial Sequence: Synthetic polypeptide
DEMEIRTTNPVATEQYGSAPDTNLENRIDTQD

SEQ ID NO: 90370 - protein, 31 aa, Artificial Sequence
  Description of Artificial Sequence: Synthetic polypeptide
DEDEIATTNPVATEQYGCVATHLQTAPNQDD

SEQ ID NO: 90371 - protein, 32 aa, Artificial Sequence
  Description of Artificial Sequence: Synthetic polypeptide
DAEEIASTNPVATEQYGSVSWNEVDERNGQDR

SEQ ID NO: 90372 - protein, 33 aa, Artificial Sequence
  Description of Artificial Sequence: Synthetic polypeptide
DEDEIATTNPVATEQYGCVATNGLFQVRGGEED

SEQ ID NO: 90373 - protein, 33 aa, Artificial Sequence
  Description of Artificial Sequence: Synthetic polypeptide
DEDEIATTNPVATEQYGCVATNLQNQGEGNPQD

SEQ ID NO: 90374 - protein, 32 aa, Artificial Sequence
  Description of Artificial Sequence: Synthetic polypeptide
DESEIRTTNPVATECWGSVSCINPPQDFEGNG

SEQ ID NO: 90375 - protein, 30 aa, Artificial Sequence
  Description of Artificial Sequence: Synthetic polypeptide
DAEEIATTNPCAYEPWGSVYFVDLQREGNR

SEQ ID NO: 90376 - protein, 33 aa, Artificial Sequence
  Description of Artificial Sequence: Synthetic polypeptide
DESEIRTTNPVATECWGSVSCINPPQDREGENG

SEQ ID NO: 90377 - protein, 33 aa, Artificial Sequence
  Description of Artificial Sequence: Synthetic polypeptide
DESEIRTTNPVATECWGSVSCINPWQDREGENG

SEQ ID NO: 90378 - protein, 33 aa, Artificial Sequence
  Description of Artificial Sequence: Synthetic polypeptide
DESEIRTTNPVATECWGSVSCINQPQDREGENG

SEQ ID NO: 90379 - protein, 30 aa, Artificial Sequence
  Description of Artificial Sequence: Synthetic polypeptide
DEDEIATTNPVATEQYGCVAGNGLARPPQD

SEQ ID NO: 90380 - protein, 33 aa, Artificial Sequence
  Description of Artificial Sequence: Synthetic polypeptide
DESEIRTTNPVATECWGSVSCINRPQDRPGENG

SEQ ID NO: 90381 - protein, 33 aa, Artificial Sequence
  Description of Artificial Sequence: Synthetic polypeptide
DESEIRTTNPVATECWGSVSCINMPQDREGENG

SEQ ID NO: 90382 - protein, 32 aa, Artificial Sequence
  Description of Artificial Sequence: Synthetic polypeptide
DEDEIATTNPVATEQYGCVADTWLAQDNAGNH

SEQ ID NO: 90383 - protein, 31 aa, Artificial Sequence
  Description of Artificial Sequence: Synthetic polypeptide
DEDEIATTNPVATEQYGCVAATANLMMPTNV

SEQ ID NO: 90384 - protein, 33 aa, Artificial Sequence
  Description of Artificial Sequence: Synthetic polypeptide
DESEIRTTNPVATECWGSVSCINKPQDREGENG

SEQ ID NO: 90385 - protein, 30 aa, Artificial Sequence
  Description of Artificial Sequence: Synthetic polypeptide
DEDEIATTNPVATEQYGCVAATANLNMPEF

SEQ ID NO: 90386 - protein, 34 aa, Artificial Sequence
  Description of Artificial Sequence: Synthetic polypeptide
DEMEIRTTNPVATEQYGSCSVTDMDNDRPGNDRQ

SEQ ID NO: 90387 - protein, 34 aa, Artificial Sequence
  Description of Artificial Sequence: Synthetic polypeptide
DESEIRTTNPVATECWGSVSCINLELQDREGENG

SEQ ID NO: 90388 - protein, 30 aa, Artificial Sequence
  Description of Artificial Sequence: Synthetic polypeptide
DEDEIATTNPVATEQYGCVAATHLARPDDI

SEQ ID NO: 90389 - protein, 31 aa, Artificial Sequence
  Description of Artificial Sequence: Synthetic polypeptide
DEDEIATTNPVATEQYGCVAATHLQARMPSD

SEQ ID NO: 90390 - protein, 34 aa, Artificial Sequence
  Description of Artificial Sequence: Synthetic polypeptide
DESEIRTTNPVATECWGSVSCINLEPQDREGENG

SEQ ID NO: 90391 - protein, 32 aa, Artificial Sequence
  Description of Artificial Sequence: Synthetic polypeptide
DEMEIRTTNPVATEQYGSCSVFLLDEYGDDRQ

SEQ ID NO: 90392 - protein, 31 aa, Artificial Sequence
  Description of Artificial Sequence: Synthetic polypeptide
DEDEIATTNPVATEQYGCVAATNEQANENNQ

SEQ ID NO: 90393 - protein, 32 aa, Artificial Sequence
  Description of Artificial Sequence: Synthetic polypeptide
DEDEIATTNPVATEQYGCVAATNLQGAPNVDN

SEQ ID NO: 90394 - protein, 33 aa, Artificial Sequence
  Description of Artificial Sequence: Synthetic polypeptide
DESEIRTTNPVATECWGSVSCINLPQDHEGENG

SEQ ID NO: 90395 - protein, 33 aa, Artificial Sequence
  Description of Artificial Sequence: Synthetic polypeptide
DESEIRTTNPVATECWGSVSCINLPQDREGEDG

SEQ ID NO: 90396 - protein, 34 aa, Artificial Sequence
  Description of Artificial Sequence: Synthetic polypeptide
DEEEIRTTNPVATEQYGSVSTMMLLAIRQHDQEE

SEQ ID NO: 90397 - protein, 34 aa, Artificial Sequence
  Description of Artificial Sequence: Synthetic polypeptide
DESEIRTTNPVATECWGSVSCINLPQDREGENDG

SEQ ID NO: 90398 - protein, 32 aa, Artificial Sequence
  Description of Artificial Sequence: Synthetic polypeptide
DEDEIATTNPVATEQYGCVAATNPQESGTERN

SEQ ID NO: 90399 - protein, 31 aa, Artificial Sequence
  Description of Artificial Sequence: Synthetic polypeptide
DEDEIATTNPVATEQYGCVAATNPQTESGTQ

SEQ ID NO: 90400 - protein, 31 aa, Artificial Sequence
  Description of Artificial Sequence: Synthetic polypeptide
DEDEIATTNPVATEQYGCVADTWLVQDSQNH

SEQ ID NO: 90401 - protein, 33 aa, Artificial Sequence
  Description of Artificial Sequence: Synthetic polypeptide
DESEIRTTNPVATECFGSVSCINEDQDREGENG

SEQ ID NO: 90402 - protein, 32 aa, Artificial Sequence
  Description of Artificial Sequence: Synthetic polypeptide
DEMEIRTTNPVATEQYGSVNWNLHEPFNNDFN

SEQ ID NO: 90403 - protein, 30 aa, Artificial Sequence
  Description of Artificial Sequence: Synthetic polypeptide
DEDEIATTNPVATAQWGCVATNLETGDNPM

SEQ ID NO: 90404 - protein, 33 aa, Artificial Sequence
  Description of Artificial Sequence: Synthetic polypeptide
DEMEIRTTNPVATEQYGSVSSTNGAISGMEEFA

SEQ ID NO: 90405 - protein, 33 aa, Artificial Sequence
  Description of Artificial Sequence: Synthetic polypeptide
DEMEIRTTNPVATEQYGSVSSTDPSEGRGSEAS

SEQ ID NO: 90406 - protein, 33 aa, Artificial Sequence
  Description of Artificial Sequence: Synthetic polypeptide
DEMEIRTTNPVATEQYGSVSSATPAPPEFEGND

SEQ ID NO: 90407 - protein, 34 aa, Artificial Sequence
  Description of Artificial Sequence: Synthetic polypeptide
DEMEIRTTNPVATEQYGSVSPTYNLETRTEEQMM

SEQ ID NO: 90408 - protein, 34 aa, Artificial Sequence
  Description of Artificial Sequence: Synthetic polypeptide
DEMEIRTTNPVATEQYGSVSPTTNLETGTEEQTM

SEQ ID NO: 90409 - protein, 33 aa, Artificial Sequence
  Description of Artificial Sequence: Synthetic polypeptide
DESEIRTTNPVATECWGSPVSCNEPQDREGENG

SEQ ID NO: 90410 - protein, 34 aa, Artificial Sequence
  Description of Artificial Sequence: Synthetic polypeptide
DEEEIRTTNPVATEQYGSVSTNGHVENMMEEQVD

SEQ ID NO: 90411 - protein, 33 aa, Artificial Sequence
  Description of Artificial Sequence: Synthetic polypeptide
DEMEIRTTNPVATEQYGSVSSTNGAISGTEEEF

SEQ ID NO: 90412 - protein, 33 aa, Artificial Sequence
  Description of Artificial Sequence: Synthetic polypeptide
DEMEIRTTNPVATEQYGSVSPTPLEFRTEEQIM

SEQ ID NO: 90413 - protein, 34 aa, Artificial Sequence
  Description of Artificial Sequence: Synthetic polypeptide
DEMEIRTTNPVATEQYGSVSPTNNNLLQSDEEQD

SEQ ID NO: 90414 - protein, 33 aa, Artificial Sequence
  Description of Artificial Sequence: Synthetic polypeptide
DEEEIRTTNPVATEQYGVVNGQTDIQTGGEGNG

SEQ ID NO: 90415 - protein, 33 aa, Artificial Sequence
  Description of Artificial Sequence: Synthetic polypeptide
DEEEIRTTNPVATEQYGVVNNDTGMGQGTGNIN

SEQ ID NO: 90416 - protein, 33 aa, Artificial Sequence
  Description of Artificial Sequence: Synthetic polypeptide
DEEEIRTTNPVATEQYGVVNSDGNEQGQGEGEI

SEQ ID NO: 90417 - protein, 34 aa, Artificial Sequence
  Description of Artificial Sequence: Synthetic polypeptide
DEMEIRTTNPVATEQYGSVSPTNLLEFRTEEQFM

SEQ ID NO: 90418 - protein, 32 aa, Artificial Sequence
  Description of Artificial Sequence: Synthetic polypeptide
DEDCIACTNPVAYEQPYLYSVVSVNLQRGDNR

SEQ ID NO: 90419 - protein, 32 aa, Artificial Sequence
  Description of Artificial Sequence: Synthetic polypeptide
DEDCIACTNPVAYEQYDYTSTVSINLQRGDNR

SEQ ID NO: 90420 - protein, 34 aa, Artificial Sequence
  Description of Artificial Sequence: Synthetic polypeptide
DEMEIRTTNPVATEQYGSVSPTNSDIEILEDNNE

SEQ ID NO: 90421 - protein, 30 aa, Artificial Sequence
  Description of Artificial Sequence: Synthetic polypeptide
DEDACIACTNPVAYEQYGSVAMNDQRGNDL

SEQ ID NO: 90422 - protein, 31 aa, Artificial Sequence
  Description of Artificial Sequence: Synthetic polypeptide
DECTICTTNPVATEQYGVVVTNPNQLGGNDD

SEQ ID NO: 90423 - protein, 36 aa, Artificial Sequence
  Description of Artificial Sequence: Synthetic polypeptide
DEAEIATTNPVATEQYGTSVTSWTQNLSQVRGMNDL

SEQ ID NO: 90424 - protein, 33 aa, Artificial Sequence
  Description of Artificial Sequence: Synthetic polypeptide
DECTICTTNPVATEQYGSVTVVSTNLGINIGNL

SEQ ID NO: 90425 - protein, 33 aa, Artificial Sequence
  Description of Artificial Sequence: Synthetic polypeptide
DECTICTTNPVATEQYGSVTVVSTNLNIIGNLE

SEQ ID NO: 90426 - protein, 34 aa, Artificial Sequence
  Description of Artificial Sequence: Synthetic polypeptide
DECTICTTNPVATEQYGSVTVVSTNLQIGIGNNL

SEQ ID NO: 90427 - protein, 34 aa, Artificial Sequence
  Description of Artificial Sequence: Synthetic polypeptide
DEEEIRTTNPVATEQYGSVSTNGPTMHTESPQRQ

SEQ ID NO: 90428 - protein, 31 aa, Artificial Sequence
  Description of Artificial Sequence: Synthetic polypeptide
DECTICTTNPVATEQYGVVATNPQNGNGNED

SEQ ID NO: 90429 - protein, 31 aa, Artificial Sequence
  Description of Artificial Sequence: Synthetic polypeptide
DECTICTTNPVATEQYGVVETNPNQQGGNDE

SEQ ID NO: 90430 - protein, 33 aa, Artificial Sequence
  Description of Artificial Sequence: Synthetic polypeptide
DEEEIRTTNPVATEQYGVVGSDLNEGEGNGNGV

SEQ ID NO: 90431 - protein, 31 aa, Artificial Sequence
  Description of Artificial Sequence: Synthetic polypeptide
DECTICTTNPVATEQYGVVETNPQNGTNNTA

SEQ ID NO: 90432 - protein, 33 aa, Artificial Sequence
  Description of Artificial Sequence: Synthetic polypeptide
DEMEIRTTNPVATEQYGSVSSTTPAPPNFEGND

SEQ ID NO: 90433 - protein, 33 aa, Artificial Sequence
  Description of Artificial Sequence: Synthetic polypeptide
DEMEIRTTNPVATEQYGSVSSTTPAPPEFEGND

SEQ ID NO: 90434 - protein, 32 aa, Artificial Sequence
  Description of Artificial Sequence: Synthetic polypeptide
DESEIRTTNPVATECWGSISCENEPQDREGNH

SEQ ID NO: 90435 - protein, 32 aa, Artificial Sequence
  Description of Artificial Sequence: Synthetic polypeptide
DESEIRTTNPVATECWGSISCINEPQDREGNH

SEQ ID NO: 90436 - protein, 33 aa, Artificial Sequence
  Description of Artificial Sequence: Synthetic polypeptide
DESEIRTTNPVATECWGSKSTINEPQDREGENG

SEQ ID NO: 90437 - protein, 34 aa, Artificial Sequence
  Description of Artificial Sequence: Synthetic polypeptide
DESEIRTTNPVATECWGSLVSCINEPQDREGENR

SEQ ID NO: 90438 - protein, 34 aa, Artificial Sequence
  Description of Artificial Sequence: Synthetic polypeptide
DEMEIRTTNPVATEQYGSVSSTTPAGPNMREGNV

SEQ ID NO: 90439 - protein, 32 aa, Artificial Sequence
  Description of Artificial Sequence: Synthetic polypeptide
DECTICTTNPVATEQYGVVSVTNPNQIGTNTD

SEQ ID NO: 90440 - protein, 31 aa, Artificial Sequence
  Description of Artificial Sequence: Synthetic polypeptide
DECTICTTNPVATEQYGVVTTNPQQGNENVD

SEQ ID NO: 90441 - protein, 31 aa, Artificial Sequence
  Description of Artificial Sequence: Synthetic polypeptide
DEDCIACTNPVAYEQYDYTSVSANLQRGDNG

SEQ ID NO: 90442 - protein, 33 aa, Artificial Sequence
  Description of Artificial Sequence: Synthetic polypeptide
DEEEIRTTNPVATEQYGVVGNTDTGMGQGTGNE

SEQ ID NO: 90443 - protein, 32 aa, Artificial Sequence
  Description of Artificial Sequence: Synthetic polypeptide
DESEIRTTNPVATECWGSVACENEPQDREGNI

SEQ ID NO: 90444 - protein, 32 aa, Artificial Sequence
  Description of Artificial Sequence: Synthetic polypeptide
DESEIRTTNPVATECWGSVACINEPQDREGNG

SEQ ID NO: 90445 - protein, 33 aa, Artificial Sequence
  Description of Artificial Sequence: Synthetic polypeptide
DESEIRTTNPVATECWGSVSAINEPQDREGANG

SEQ ID NO: 90446 - protein, 33 aa, Artificial Sequence
  Description of Artificial Sequence: Synthetic polypeptide
DESEIRTTNPVATECWGSVSAINEPQDREGENG

SEQ ID NO: 90447 - protein, 33 aa, Artificial Sequence
  Description of Artificial Sequence: Synthetic polypeptide
DESEIRTTNPVATECWGSVSAINEPQEREGENG

SEQ ID NO: 90448 - protein, 32 aa, Artificial Sequence
  Description of Artificial Sequence: Synthetic polypeptide
DEDEIACTNPVATEQYGCVATNGQRDGPDNQM

SEQ ID NO: 90449 - protein, 33 aa, Artificial Sequence
  Description of Artificial Sequence: Synthetic polypeptide
DESEIRTTNPVATECWGSVSAINEPQEREGENI

SEQ ID NO: 90450 - protein, 31 aa, Artificial Sequence
  Description of Artificial Sequence: Synthetic polypeptide
DEDEIACTNPVATEQYGCVATNLQAADNDNE

SEQ ID NO: 90451 - protein, 30 aa, Artificial Sequence
  Description of Artificial Sequence: Synthetic polypeptide
DEDEIACTNPVATEQYGCVATNLQAAEADE

SEQ ID NO: 90452 - protein, 32 aa, Artificial Sequence
  Description of Artificial Sequence: Synthetic polypeptide
DEAEIATTNPVATEQYGSVSYTDLEDHIGEDL

SEQ ID NO: 90453 - protein, 33 aa, Artificial Sequence
  Description of Artificial Sequence: Synthetic polypeptide
DESEIRTTNPVATECWGSVSAINEQDRKGENYG

SEQ ID NO: 90454 - protein, 30 aa, Artificial Sequence
  Description of Artificial Sequence: Synthetic polypeptide
DEDEIACTNPVATEQYGCVATNLQAEAEGG

SEQ ID NO: 90455 - protein, 33 aa, Artificial Sequence
  Description of Artificial Sequence: Synthetic polypeptide
DEMEIRTTNPVATEQYGSVSPTELAETRTEEQN

SEQ ID NO: 90456 - protein, 32 aa, Artificial Sequence
  Description of Artificial Sequence: Synthetic polypeptide
DEAEIATTNPVATEQYGSVSTTDLEDHIGGDL

SEQ ID NO: 90457 - protein, 33 aa, Artificial Sequence
  Description of Artificial Sequence: Synthetic polypeptide
DEEEIRTTNPVATEQYGVVSGLNNVDELGENQV

SEQ ID NO: 90458 - protein, 34 aa, Artificial Sequence
  Description of Artificial Sequence: Synthetic polypeptide
DEAEIATTNPVATEQYGSVSTPNPQQDHQDGNNA

SEQ ID NO: 90459 - protein, 34 aa, Artificial Sequence
  Description of Artificial Sequence: Synthetic polypeptide
DEEEIRTTNPVATEQYGVVSGTDDTGQNEGGGNT

SEQ ID NO: 90460 - protein, 33 aa, Artificial Sequence
  Description of Artificial Sequence: Synthetic polypeptide
DEAEIATTNPVATEQYGSVSTNNPNRAGEPDMW

SEQ ID NO: 90461 - protein, 32 aa, Artificial Sequence
  Description of Artificial Sequence: Synthetic polypeptide
DEAEIATTNPVATEQYGSVSTTPLEDHEGEDL

SEQ ID NO: 90462 - protein, 33 aa, Artificial Sequence
  Description of Artificial Sequence: Synthetic polypeptide
DESEIRTTNPVATECWGSVSAINENQDRVGENG

SEQ ID NO: 90463 - protein, 29 aa, Artificial Sequence
  Description of Artificial Sequence: Synthetic peptide
DEDEIACTNPVATEQYGCTATNLQGVDPL

SEQ ID NO: 90464 - protein, 33 aa, Artificial Sequence
  Description of Artificial Sequence: Synthetic polypeptide
DESEIRTTNPVATECWGSVSADNEPQDREGENG

SEQ ID NO: 90465 - protein, 32 aa, Artificial Sequence
  Description of Artificial Sequence: Synthetic polypeptide
DESEIRTTNPVATECWGSVACINEPQDREGNI

SEQ ID NO: 90466 - protein, 34 aa, Artificial Sequence
  Description of Artificial Sequence: Synthetic polypeptide
DEDCIRTTNPVATEQWGSVASTGNMLSNNGGNNR

SEQ ID NO: 90467 - protein, 32 aa, Artificial Sequence
  Description of Artificial Sequence: Synthetic polypeptide
DESEIRTTNPVATECWGSVACINEQDREGENG

SEQ ID NO: 90468 - protein, 31 aa, Artificial Sequence
  Description of Artificial Sequence: Synthetic polypeptide
DESEIRTTNPVATECWGSVACINWQDPEGNG

SEQ ID NO: 90469 - protein, 33 aa, Artificial Sequence
  Description of Artificial Sequence: Synthetic polypeptide
DESEIRTTNPVATECWGSVCSCINPPQDREGNG

SEQ ID NO: 90470 - protein, 33 aa, Artificial Sequence
  Description of Artificial Sequence: Synthetic polypeptide
DESEIRTTNPVATECWGSVCSTINPPEDREGNG

SEQ ID NO: 90471 - protein, 34 aa, Artificial Sequence
  Description of Artificial Sequence: Synthetic polypeptide
DEMEIRTTNPVATEQYGSVSPTNGETTMGENNQA

SEQ ID NO: 90472 - protein, 33 aa, Artificial Sequence
  Description of Artificial Sequence: Synthetic polypeptide
DEEEIRTTNPVATEQYGVVSAQSEDFRTGANPQ

SEQ ID NO: 90473 - protein, 32 aa, Artificial Sequence
  Description of Artificial Sequence: Synthetic polypeptide
DESEIRTTNPVATECWGSVNCNEPQDREGENG

SEQ ID NO: 90474 - protein, 32 aa, Artificial Sequence
  Description of Artificial Sequence: Synthetic polypeptide
DESEIRTTNPVATECWGSVPCINEPQREGENG

SEQ ID NO: 90475 - protein, 31 aa, Artificial Sequence
  Description of Artificial Sequence: Synthetic polypeptide
DESEIRTTNPVATECWGSVPCINEQDHEGNG

SEQ ID NO: 90476 - protein, 31 aa, Artificial Sequence
  Description of Artificial Sequence: Synthetic polypeptide
DESEIRTTNPVATECWGSVPEINEQDHEGNG

SEQ ID NO: 90477 - protein, 32 aa, Artificial Sequence
  Description of Artificial Sequence: Synthetic polypeptide
DESEIRTTNPVATECWGSVSACDEQDREGENG

SEQ ID NO: 90478 - protein, 33 aa, Artificial Sequence
  Description of Artificial Sequence: Synthetic polypeptide
DEMEIRTTNPVATEQYGSVSPTISLETRTEEQN

SEQ ID NO: 90479 - protein, 34 aa, Artificial Sequence
  Description of Artificial Sequence: Synthetic polypeptide
DEMEIRTTNPVATEQYGSVSPTINSDQDLEDNIE

SEQ ID NO: 90480 - protein, 33 aa, Artificial Sequence
  Description of Artificial Sequence: Synthetic polypeptide
DESEIRTTNPVATECWGSVSACINEQDREGENG

SEQ ID NO: 90481 - protein, 34 aa, Artificial Sequence
  Description of Artificial Sequence: Synthetic polypeptide
DESEIRTTNPVATECWGSVSACINLPQDREGENG

SEQ ID NO: 90482 - protein, 32 aa, Artificial Sequence
  Description of Artificial Sequence: Synthetic polypeptide
DESEIRTTNPVATECWGSVACENWPQDREGNI

SEQ ID NO: 90483 - protein, 33 aa, Artificial Sequence
  Description of Artificial Sequence: Synthetic polypeptide
DECTICTTNPVATEQYGSVTVTTNNLQIIGTNL

SEQ ID NO: 90484 - protein, 32 aa, Artificial Sequence
  Description of Artificial Sequence: Synthetic polypeptide
DECTICTTNPVATEQYGSVTVTTNNLIIGNNL

SEQ ID NO: 90485 - protein, 34 aa, Artificial Sequence
  Description of Artificial Sequence: Synthetic polypeptide
DEMEIRTTNPVATEQYGSVSSTTPAPPNREGNPD

SEQ ID NO: 90486 - protein, 33 aa, Artificial Sequence
  Description of Artificial Sequence: Synthetic polypeptide
DEMEIRTTNPVATEQYGSVSTPDDEQTTASPQR

SEQ ID NO: 90487 - protein, 34 aa, Artificial Sequence
  Description of Artificial Sequence: Synthetic polypeptide
DECEIRTTNPVATEQYGSVSWTYNDLEQNSEDGV

SEQ ID NO: 90488 - protein, 31 aa, Artificial Sequence
  Description of Artificial Sequence: Synthetic polypeptide
DAAEIACTNPVATEQYGSVATNLQATPGQES

SEQ ID NO: 90489 - protein, 34 aa, Artificial Sequence
  Description of Artificial Sequence: Synthetic polypeptide
DEMEIRTTNPVATEQYGSVSTNPIDTSELQIDGG

SEQ ID NO: 90490 - protein, 34 aa, Artificial Sequence
  Description of Artificial Sequence: Synthetic polypeptide
DECEIRTTNPVAYEPYGQLVSTGNLSGDRGGNNR

SEQ ID NO: 90491 - protein, 34 aa, Artificial Sequence
  Description of Artificial Sequence: Synthetic polypeptide
DECEIRTTNPVAYEPYGSLVSIGNGSQDRGGNNR

SEQ ID NO: 90492 - protein, 34 aa, Artificial Sequence
  Description of Artificial Sequence: Synthetic polypeptide
DECEIRTTNPVAYEPYGSLVSTGNISQDDGGNNR

SEQ ID NO: 90493 - protein, 34 aa, Artificial Sequence
  Description of Artificial Sequence: Synthetic polypeptide
DEEEIRTTNPVATEQYGVVCSTGEPHQNFGSNQL

SEQ ID NO: 90494 - protein, 32 aa, Artificial Sequence
  Description of Artificial Sequence: Synthetic polypeptide
DECEIRTTNPVAYEQWGEVSTNLNGDHGTNEQ

SEQ ID NO: 90495 - protein, 32 aa, Artificial Sequence
  Description of Artificial Sequence: Synthetic polypeptide
DESEIRTTNPVATECWGDVSCINEQDREGENG

SEQ ID NO: 90496 - protein, 32 aa, Artificial Sequence
  Description of Artificial Sequence: Synthetic polypeptide
DESEIRTTNPVATECWGDVSCNEPQDREGENG

SEQ ID NO: 90497 - protein, 31 aa, Artificial Sequence
  Description of Artificial Sequence: Synthetic polypeptide
DECEIRTTNPVAYEQWGVVSGGLQRPENGDA

SEQ ID NO: 90498 - protein, 32 aa, Artificial Sequence
  Description of Artificial Sequence: Synthetic polypeptide
DAAEIATTNPVATEQWGSVSTNPLQHQDGMAH

SEQ ID NO: 90499 - protein, 32 aa, Artificial Sequence
  Description of Artificial Sequence: Synthetic polypeptide
DESEIRTTNPVATECWGEVSCINEPQDREGNG

SEQ ID NO: 90500 - protein, 32 aa, Artificial Sequence
  Description of Artificial Sequence: Synthetic polypeptide
DESEIRTTNPVATECWGEVSCINEPQREGENG

SEQ ID NO: 90501 - protein, 32 aa, Artificial Sequence
  Description of Artificial Sequence: Synthetic polypeptide
DEMEIRTTNPVATEQYGSVSTLNNNDNELQDS

SEQ ID NO: 90502 - protein, 34 aa, Artificial Sequence
  Description of Artificial Sequence: Synthetic polypeptide
DECEIRTTNPVAYEQWGSTSPTENQDDQRDGNGR

SEQ ID NO: 90503 - protein, 34 aa, Artificial Sequence
  Description of Artificial Sequence: Synthetic polypeptide
DEEEIRTTNPVATEQYGVVCSTGEHQEGFNSNQM

SEQ ID NO: 90504 - protein, 33 aa, Artificial Sequence
  Description of Artificial Sequence: Synthetic polypeptide
DEMEIRTTNPVATEQYGSVSTPDHNGEQQDSEG

SEQ ID NO: 90505 - protein, 32 aa, Artificial Sequence
  Description of Artificial Sequence: Synthetic polypeptide
DESEIRTTNPVATECWGAVSAINEQDREGENG

SEQ ID NO: 90506 - protein, 31 aa, Artificial Sequence
  Description of Artificial Sequence: Synthetic polypeptide
DAAEIACTNPVATEQYGCVATNLQADGGERD

SEQ ID NO: 90507 - protein, 33 aa, Artificial Sequence
  Description of Artificial Sequence: Synthetic polypeptide
DESEIRTTNPVATECHGSVSCINEPQDREGENG

SEQ ID NO: 90508 - protein, 33 aa, Artificial Sequence
  Description of Artificial Sequence: Synthetic polypeptide
DESEIRTTNPVATECHGSVSCINMPQDREGENG

SEQ ID NO: 90509 - protein, 30 aa, Artificial Sequence
  Description of Artificial Sequence: Synthetic polypeptide
DAAEIACTNPVATEQYGCVATNLQADPGQS

SEQ ID NO: 90510 - protein, 33 aa, Artificial Sequence
  Description of Artificial Sequence: Synthetic polypeptide
DESEIRTTNPVATECMGSVSCINEPQDREGENG

SEQ ID NO: 90511 - protein, 33 aa, Artificial Sequence
  Description of Artificial Sequence: Synthetic polypeptide
DECEIRTTNPVATECWGSVSCINEPQDREGENG

SEQ ID NO: 90512 - protein, 31 aa, Artificial Sequence
  Description of Artificial Sequence: Synthetic polypeptide
DAAEIACTNPVATEQYGSTVATNLQMEPGEF

SEQ ID NO: 90513 - protein, 31 aa, Artificial Sequence
  Description of Artificial Sequence: Synthetic polypeptide
DAAEIACTNPVATEQYGSTVATNLQMEPGRD

SEQ ID NO: 90514 - protein, 33 aa, Artificial Sequence
  Description of Artificial Sequence: Synthetic polypeptide
DECEIRTTNPVATECWGSVSCINEPQGRGGENE

SEQ ID NO: 90515 - protein, 33 aa, Artificial Sequence
  Description of Artificial Sequence: Synthetic polypeptide
DECEIRTTNPVATECWGSVSCKNEPQDREGENG

SEQ ID NO: 90516 - protein, 33 aa, Artificial Sequence
  Description of Artificial Sequence: Synthetic polypeptide
DEMEIRTTNPVATEQYGSVSTPDQNQQQQDSEF

SEQ ID NO: 90517 - protein, 33 aa, Artificial Sequence
  Description of Artificial Sequence: Synthetic polypeptide
DESEIRTTNPVATECMGSVSCINEPQDRVGENG

SEQ ID NO: 90518 - protein, 32 aa, Artificial Sequence
  Description of Artificial Sequence: Synthetic polypeptide
DECEIRTTNPVATEQAGQVSITGKLQQRPTDA

SEQ ID NO: 90519 - protein, 33 aa, Artificial Sequence
  Description of Artificial Sequence: Synthetic polypeptide
DESEIRTTNPVATECSGSVSCINDPQDREGENG

SEQ ID NO: 90520 - protein, 33 aa, Artificial Sequence
  Description of Artificial Sequence: Synthetic polypeptide
DESEIRTTNPVATECSGSVSCINEPQDREGENG

SEQ ID NO: 90521 - protein, 33 aa, Artificial Sequence
  Description of Artificial Sequence: Synthetic polypeptide
DESEIRTTNPVATECWASVSTINEPQDREGENG

SEQ ID NO: 90522 - protein, 32 aa, Artificial Sequence
  Description of Artificial Sequence: Synthetic polypeptide
DECEIRTTNPVATEQYGCVVDTTSLIMYGNQD

SEQ ID NO: 90523 - protein, 30 aa, Artificial Sequence
  Description of Artificial Sequence: Synthetic polypeptide
DECEIYPTNPVATEQYGTVSGSNLWYSGET

SEQ ID NO: 90524 - protein, 32 aa, Artificial Sequence
  Description of Artificial Sequence: Synthetic polypeptide
DECEIYTTNPVATEQYGITVSGSNLMQYEGET

SEQ ID NO: 90525 - protein, 31 aa, Artificial Sequence
  Description of Artificial Sequence: Synthetic polypeptide
DECELRTTNPVATEQAGVVSITGGLQQRPTD

SEQ ID NO: 90526 - protein, 31 aa, Artificial Sequence
  Description of Artificial Sequence: Synthetic polypeptide
DECEVYTTNPVATEQYGTVSGTNLMYSGETQ

SEQ ID NO: 90527 - protein, 34 aa, Artificial Sequence
  Description of Artificial Sequence: Synthetic polypeptide
DEEEIRTTNPVATEQYGVVDSDNTTEGGNGQGNE

SEQ ID NO: 90528 - protein, 34 aa, Artificial Sequence
  Description of Artificial Sequence: Synthetic polypeptide
DEMEIRTTNPVATEQYGSVSTGNDDEQQEGEEDK

SEQ ID NO: 90529 - protein, 34 aa, Artificial Sequence
  Description of Artificial Sequence: Synthetic polypeptide
DEEEIRTTNPVATEQYGVVDSTMGDTGQGGGNQT

SEQ ID NO: 90530 - protein, 31 aa, Artificial Sequence
  Description of Artificial Sequence: Synthetic polypeptide
DESEIRTTNPVATECWGSASEINEQHEGENG

SEQ ID NO: 90531 - protein, 32 aa, Artificial Sequence
  Description of Artificial Sequence: Synthetic polypeptide
DAAEIATTNPVATEQYGSVATNLQQDDQNGEM

SEQ ID NO: 90532 - protein, 33 aa, Artificial Sequence
  Description of Artificial Sequence: Synthetic polypeptide
DESEIRTTNPVATECWGSAVSCINEPQDRGENG

SEQ ID NO: 90533 - protein, 33 aa, Artificial Sequence
  Description of Artificial Sequence: Synthetic polypeptide
DECTICTTNPVATEQWGSVSTTTNLQTGTNVAD

SEQ ID NO: 90534 - protein, 33 aa, Artificial Sequence
  Description of Artificial Sequence: Synthetic polypeptide
DECTICTTNPVATEQWGSVSTTVNLQQGNNQDE

SEQ ID NO: 90535 - protein, 32 aa, Artificial Sequence
  Description of Artificial Sequence: Synthetic polypeptide
DECTICTTNPVATEQWGSVSTVDGLQQGSNTD

SEQ ID NO: 90536 - protein, 33 aa, Artificial Sequence
  Description of Artificial Sequence: Synthetic polypeptide
DECTICTTNPVATEQWGSVSTVDNLQQGNNQGE

SEQ ID NO: 90537 - protein, 33 aa, Artificial Sequence
  Description of Artificial Sequence: Synthetic polypeptide
DESEIRTTNPVATECWGSCVSCINEQDREGENG

SEQ ID NO: 90538 - protein, 34 aa, Artificial Sequence
  Description of Artificial Sequence: Synthetic polypeptide
DEMEIRTTNPVATEQYGSVSTDALTNERETQNDG

SEQ ID NO: 90539 - protein, 33 aa, Artificial Sequence
  Description of Artificial Sequence: Synthetic polypeptide
DEMEIRTTNPVATEQYGSVSTASNQTGPMEDHN

SEQ ID NO: 90540 - protein, 34 aa, Artificial Sequence
  Description of Artificial Sequence: Synthetic polypeptide
DEMEIRTTNPVATEQYGSVSTANEDRIESNNDQQ

SEQ ID NO: 90541 - protein, 34 aa, Artificial Sequence
  Description of Artificial Sequence: Synthetic polypeptide
DEEEIRTTNPVATEQYGVVFENTNDTDQNIGGNI

SEQ ID NO: 90542 - protein, 32 aa, Artificial Sequence
  Description of Artificial Sequence: Synthetic polypeptide
DECTICTTNPVATEQYGSVTVTTNLIIGTNEL

SEQ ID NO: 90543 - protein, 32 aa, Artificial Sequence
  Description of Artificial Sequence: Synthetic polypeptide
DECTICTTNPVATEQYGSVTVTTNLNIGIGNL

SEQ ID NO: 90544 - protein, 32 aa, Artificial Sequence
  Description of Artificial Sequence: Synthetic polypeptide
DESEIRTTNPVATECWGNVSCINEQDREGENG

SEQ ID NO: 90545 - protein, 33 aa, Artificial Sequence
  Description of Artificial Sequence: Synthetic polypeptide
DEMEIRTTNPVATEQYGSVSPTDMNPQINSTQQ

SEQ ID NO: 90546 - protein, 33 aa, Artificial Sequence
  Description of Artificial Sequence: Synthetic polypeptide
DECTICTTNPVATEQWGSVSTTDNLQQGTNQTE

SEQ ID NO: 90547 - protein, 34 aa, Artificial Sequence
  Description of Artificial Sequence: Synthetic polypeptide
DEMEIRTTNPVATEQYGSVSTIDEQPQSANELRF

SEQ ID NO: 90548 - protein, 34 aa, Artificial Sequence
  Description of Artificial Sequence: Synthetic polypeptide
DEMEIRTTNPVATEQYGSVSTLGDHQDMVNDDRF

SEQ ID NO: 90549 - protein, 32 aa, Artificial Sequence
  Description of Artificial Sequence: Synthetic polypeptide
DESEIRTTNPVATECWGIVSCINEPQDRGENG

SEQ ID NO: 90550 - protein, 33 aa, Artificial Sequence
  Description of Artificial Sequence: Synthetic polypeptide
DEMEIRTTNPVATEQYGSVSTLEGQDDFGSEMN

SEQ ID NO: 90551 - protein, 32 aa, Artificial Sequence
  Description of Artificial Sequence: Synthetic polypeptide
DESEIRTTNPVATECWGIVSCINEPQREGENG

SEQ ID NO: 90552 - protein, 32 aa, Artificial Sequence
  Description of Artificial Sequence: Synthetic polypeptide
DESEIRTTNPVATECWGIVSCINLPQREGETG

SEQ ID NO: 90553 - protein, 32 aa, Artificial Sequence
  Description of Artificial Sequence: Synthetic polypeptide
DECQEICTTNPVATEEWGSVSTIPNTQRDNNV

SEQ ID NO: 90554 - protein, 31 aa, Artificial Sequence
  Description of Artificial Sequence: Synthetic polypeptide
DECSIMTTNPVATECYGCVNTNTLQRIPNNM

SEQ ID NO: 90555 - protein, 32 aa, Artificial Sequence
  Description of Artificial Sequence: Synthetic polypeptide
DECSIMTTNPVATECYGSVNTNTLQTFGNQFP

SEQ ID NO: 90556 - protein, 33 aa, Artificial Sequence
  Description of Artificial Sequence: Synthetic polypeptide
DESEIRTTNPVATECWGNSVSCINEPQDRGENG

SEQ ID NO: 90557 - protein, 32 aa, Artificial Sequence
  Description of Artificial Sequence: Synthetic polypeptide
DECTICTTNPVATEQWGSVSTDLLNQNGNNNM

SEQ ID NO: 90558 - protein, 32 aa, Artificial Sequence
  Description of Artificial Sequence: Synthetic polypeptide
DAAEIATTNPVATEQYGCVATNLQRAEANNTD

SEQ ID NO: 90559 - protein, 34 aa, Artificial Sequence
  Description of Artificial Sequence: Synthetic polypeptide
DEMEIRTTNPVATEQYGSVSTLDLTQNQGGEDEH

SEQ ID NO: 90560 - protein, 33 aa, Artificial Sequence
  Description of Artificial Sequence: Synthetic polypeptide
DESEIRTTNPVATECWGNVSANINEPQDREGNR

SEQ ID NO: 90561 - protein, 33 aa, Artificial Sequence
  Description of Artificial Sequence: Synthetic polypeptide
DEMEIRTTNPVATEQYGSVSTLDLLLHPGDEDG

SEQ ID NO: 90562 - protein, 32 aa, Artificial Sequence
  Description of Artificial Sequence: Synthetic polypeptide
DECTICTTNPVATEQWGSVSTTDGLQQGNNTM

SEQ ID NO: 90563 - protein, 32 aa, Artificial Sequence
  Description of Artificial Sequence: Synthetic polypeptide
DECTICTTNPVATEQWGSVSTTDGLQQGTNME

SEQ ID NO: 90564 - protein, 34 aa, Artificial Sequence
  Description of Artificial Sequence: Synthetic polypeptide
DEEEIRTTNPVATEQYGVVDNSTGDEGQGGENGD

SEQ ID NO: 90565 - protein, 35 aa, Artificial Sequence
  Description of Artificial Sequence: Synthetic polypeptide
DEMEIRTTNPVATEQYGSVSTGNDTLQQEGEEDKQ

SEQ ID NO: 90566 - protein, 35 aa, Artificial Sequence
  Description of Artificial Sequence: Synthetic polypeptide
DEEEIRTTNPVATEQYGVVSGTMTNLLGSGGNGQG

SEQ ID NO: 90567 - protein, 31 aa, Artificial Sequence
  Description of Artificial Sequence: Synthetic polypeptide
DEDEIACTNPVATEQYGCVATNLQAEAHNND

SEQ ID NO: 90568 - protein, 31 aa, Artificial Sequence
  Description of Artificial Sequence: Synthetic polypeptide
DEDEIACTNPVATEQYGCVATNLQAEDDTNE

SEQ ID NO: 90569 - protein, 32 aa, Artificial Sequence
  Description of Artificial Sequence: Synthetic polypeptide
DEDEIACTNPVATEQYGSVCATNLQEAGTDEH

SEQ ID NO: 90570 - protein, 34 aa, Artificial Sequence
  Description of Artificial Sequence: Synthetic polypeptide
DEAEIATTNPVATEQYGSVCSPMNDGNTTRGNPR

SEQ ID NO: 90571 - protein, 32 aa, Artificial Sequence
  Description of Artificial Sequence: Synthetic polypeptide
DESEIRTTNPVATECWGSVSCIIEPQDREGNG

SEQ ID NO: 90572 - protein, 34 aa, Artificial Sequence
  Description of Artificial Sequence: Synthetic polypeptide
DEEEIRTTNPVATEQYGVVSTMDGLGQGEEQNEG

SEQ ID NO: 90573 - protein, 34 aa, Artificial Sequence
  Description of Artificial Sequence: Synthetic polypeptide
DEEEIRTTNPVATEQYGVVSTMDGLGQGEQGGDE

SEQ ID NO: 90574 - protein, 33 aa, Artificial Sequence
  Description of Artificial Sequence: Synthetic polypeptide
DESEIRTTNPVATECWGSVSCILEPQDREGENG

SEQ ID NO: 90575 - protein, 32 aa, Artificial Sequence
  Description of Artificial Sequence: Synthetic polypeptide
DEMEIRTTNPVATEQYGSVSCSEDLQESEDIQ

SEQ ID NO: 90576 - protein, 33 aa, Artificial Sequence
  Description of Artificial Sequence: Synthetic polypeptide
DESEIRTTNPVATECWGSVSCHNEPQDRHGENG

SEQ ID NO: 90577 - protein, 33 aa, Artificial Sequence
  Description of Artificial Sequence: Synthetic polypeptide
DEEEIRTTNPVATEQYGVVSTMDIMGQGEENEI

SEQ ID NO: 90578 - protein, 33 aa, Artificial Sequence
  Description of Artificial Sequence: Synthetic polypeptide
DEEEIRTTNPVATEQYGVVSTMDNQGEIDNEDV

SEQ ID NO: 90579 - protein, 33 aa, Artificial Sequence
  Description of Artificial Sequence: Synthetic polypeptide
DEMEIRTTNPVATEQYGSVSCLMLNARNDGQQL

SEQ ID NO: 90580 - protein, 34 aa, Artificial Sequence
  Description of Artificial Sequence: Synthetic polypeptide
DEEEIRTTNPVATEQYGVVSTMGDTGQGGGGNNT

SEQ ID NO: 90581 - protein, 33 aa, Artificial Sequence
  Description of Artificial Sequence: Synthetic polypeptide
DEEEIRTTNPVATEQYGVVSTMGFMGQGENAID

SEQ ID NO: 90582 - protein, 33 aa, Artificial Sequence
  Description of Artificial Sequence: Synthetic polypeptide
DEEEIRTTNPVATEQYGVVSTMGFMGQGENNIQ

SEQ ID NO: 90583 - protein, 33 aa, Artificial Sequence
  Description of Artificial Sequence: Synthetic polypeptide
DESEIRTTNPVATECWGSVSCINAPQDREGENG

SEQ ID NO: 90584 - protein, 34 aa, Artificial Sequence
  Description of Artificial Sequence: Synthetic polypeptide
DEMEIRTTNPVATEQYGSVSANDEHTEGSEENQR

SEQ ID NO: 90585 - protein, 33 aa, Artificial Sequence
  Description of Artificial Sequence: Synthetic polypeptide
DEAEIATTNPVATEQYGSVCSPMNDGNTDRGSR

SEQ ID NO: 90586 - protein, 34 aa, Artificial Sequence
  Description of Artificial Sequence: Synthetic polypeptide
DEAEIATTNPVATEQYGSVCSPMNPGLNMDGNGR

SEQ ID NO: 90587 - protein, 33 aa, Artificial Sequence
  Description of Artificial Sequence: Synthetic polypeptide
DESEIRTTNPVATECWGSVSCHNEPQDREGENG

SEQ ID NO: 90588 - protein, 33 aa, Artificial Sequence
  Description of Artificial Sequence: Synthetic polypeptide
DESEIRTTNPVATECWGSVSCGNHPQNRTGENG

SEQ ID NO: 90589 - protein, 32 aa, Artificial Sequence
  Description of Artificial Sequence: Synthetic polypeptide
DEDEIACTNPVATEQYGSVATNLQNVATNPTP

SEQ ID NO: 90590 - protein, 34 aa, Artificial Sequence
  Description of Artificial Sequence: Synthetic polypeptide
DEAEIATTNPVATEQYGSVCSTDTLQNHQGNDQV

SEQ ID NO: 90591 - protein, 32 aa, Artificial Sequence
  Description of Artificial Sequence: Synthetic polypeptide
DEAEIATTNPVATEQYGSVCSTDGPQHMDNAE

SEQ ID NO: 90592 - protein, 34 aa, Artificial Sequence
  Description of Artificial Sequence: Synthetic polypeptide
DEEEIRTTNPVATEQYGVVSTENLTNGFGESGTS

SEQ ID NO: 90593 - protein, 32 aa, Artificial Sequence
  Description of Artificial Sequence: Synthetic polypeptide
DEDEIACTNPVATEQYGSVATNLQQDDQNDEM

SEQ ID NO: 90594 - protein, 31 aa, Artificial Sequence
  Description of Artificial Sequence: Synthetic polypeptide
DEMEIRTTNPVATEQYGSVSDVEDSQELEHI

SEQ ID NO: 90595 - protein, 33 aa, Artificial Sequence
  Description of Artificial Sequence: Synthetic polypeptide
DEAEIATTNPVATEQYGSVCSPTNLFNQASVEM

SEQ ID NO: 90596 - protein, 33 aa, Artificial Sequence
  Description of Artificial Sequence: Synthetic polypeptide
DEEEIRTTNPVATEQYGVVSTGDTGEGGGEENE

SEQ ID NO: 90597 - protein, 33 aa, Artificial Sequence
  Description of Artificial Sequence: Synthetic polypeptide
DEEEIRTTNPVATEQYGVVSTGDTGEGGGENQT

SEQ ID NO: 90598 - protein, 32 aa, Artificial Sequence
  Description of Artificial Sequence: Synthetic polypeptide
DEDEIACTNPVATEQYGSVATNLQRTEEPTGE

SEQ ID NO: 90599 - protein, 32 aa, Artificial Sequence
  Description of Artificial Sequence: Synthetic polypeptide
DEMEIRTTNPVATEQYGSVSDLNEHTMESNED

SEQ ID NO: 90600 - protein, 32 aa, Artificial Sequence
  Description of Artificial Sequence: Synthetic polypeptide
DEDEIACTNPVATEQYGSVATNLQTRNHTPEQ

SEQ ID NO: 90601 - protein, 33 aa, Artificial Sequence
  Description of Artificial Sequence: Synthetic polypeptide
DEAEIATTNPVATEQYGSVCSPMNPGNTMDGNR

SEQ ID NO: 90602 - protein, 34 aa, Artificial Sequence
  Description of Artificial Sequence: Synthetic polypeptide
DEEEIRTTNPVATEQYGVVSTGVGGQGEDGNNMS

SEQ ID NO: 90603 - protein, 34 aa, Artificial Sequence
  Description of Artificial Sequence: Synthetic polypeptide
DEEEIRTTNPVATEQYGVVSTGVGGQGEDGNVMQ

SEQ ID NO: 90604 - protein, 34 aa, Artificial Sequence
  Description of Artificial Sequence: Synthetic polypeptide
DEEEIRTTNPVATEQYGVVSTGVGGQGENDGNMF

SEQ ID NO: 90605 - protein, 33 aa, Artificial Sequence
  Description of Artificial Sequence: Synthetic polypeptide
DESEIRTTNPVATECWGSVSCGNGPQDREGENG

SEQ ID NO: 90606 - protein, 35 aa, Artificial Sequence
  Description of Artificial Sequence: Synthetic polypeptide
DEEEIRTTNPVATEQYGVVSTMNGLDQLENGEGGD

SEQ ID NO: 90607 - protein, 33 aa, Artificial Sequence
  Description of Artificial Sequence: Synthetic polypeptide
DEMEIRTTNPVATEQYGSVSAENYDQRTEDTQM

SEQ ID NO: 90608 - protein, 33 aa, Artificial Sequence
  Description of Artificial Sequence: Synthetic polypeptide
DESEIRTTNPVATECWGSVSCINCPQDREGENE

SEQ ID NO: 90609 - protein, 33 aa, Artificial Sequence
  Description of Artificial Sequence: Synthetic polypeptide
DESEIRTTNPVATECWGSVSCINCPQDREGENG

SEQ ID NO: 90610 - protein, 33 aa, Artificial Sequence
  Description of Artificial Sequence: Synthetic polypeptide
DESEIRTTNPVATECWGSVSCINEKQDREGENG

SEQ ID NO: 90611 - protein, 30 aa, Artificial Sequence
  Description of Artificial Sequence: Synthetic polypeptide
DEDEIATTNPCATEPYGCVVALLQRDGPHR

SEQ ID NO: 90612 - protein, 33 aa, Artificial Sequence
  Description of Artificial Sequence: Synthetic polypeptide
DEAEIATTNPVATEQYGSVCSAPLQMEMGDNDN

SEQ ID NO: 90613 - protein, 33 aa, Artificial Sequence
  Description of Artificial Sequence: Synthetic polypeptide
DEAEIATTNPVATEQYGSVCSAIALQNHGENDA

SEQ ID NO: 90614 - protein, 31 aa, Artificial Sequence
  Description of Artificial Sequence: Synthetic polypeptide
DESEIRTTNPVATECWGSVSCINEMNRAENG

SEQ ID NO: 90615 - protein, 32 aa, Artificial Sequence
  Description of Artificial Sequence: Synthetic polypeptide
DESEIRTTNPVATECWGSVSCINEMNRAGENG

SEQ ID NO: 90616 - protein, 32 aa, Artificial Sequence
  Description of Artificial Sequence: Synthetic polypeptide
DESEIRTTNPVATECWGSVSCINEMNREGENG

SEQ ID NO: 90617 - protein, 33 aa, Artificial Sequence
  Description of Artificial Sequence: Synthetic polypeptide
DESEIRTTNPVATECWGSVSCINEMQDREGENG

SEQ ID NO: 90618 - protein, 33 aa, Artificial Sequence
  Description of Artificial Sequence: Synthetic polypeptide
DESEIRTTNPVATECWGSVSCINEMQDREGTNG

SEQ ID NO: 90619 - protein, 35 aa, Artificial Sequence
  Description of Artificial Sequence: Synthetic polypeptide
DEAEIATTNPVATEQYGSVCSAGNALGQDHGNDRW

SEQ ID NO: 90620 - protein, 29 aa, Artificial Sequence
  Description of Artificial Sequence: Synthetic peptide
DEDEIATTNPVATAQWGCIATNADDRGND

SEQ ID NO: 90621 - protein, 33 aa, Artificial Sequence
  Description of Artificial Sequence: Synthetic polypeptide
DESEIRTTNPVATECWGSVSCINENQDREGEND

SEQ ID NO: 90622 - protein, 33 aa, Artificial Sequence
  Description of Artificial Sequence: Synthetic polypeptide
DESEIRTTNPVATECWGSVSCINENQDREGENG

SEQ ID NO: 90623 - protein, 28 aa, Artificial Sequence
  Description of Artificial Sequence: Synthetic peptide
DEDEIATTNPVATAQWGCVATALDPSND

SEQ ID NO: 90624 - protein, 32 aa, Artificial Sequence
  Description of Artificial Sequence: Synthetic polypeptide
DESEIRTTNPVATECWGSVSCINEPEREGENG

SEQ ID NO: 90625 - protein, 30 aa, Artificial Sequence
  Description of Artificial Sequence: Synthetic polypeptide
DEDEIATTNPVATAQWGCVATGLERDGNTP

SEQ ID NO: 90626 - protein, 32 aa, Artificial Sequence
  Description of Artificial Sequence: Synthetic polypeptide
DEMEIRTTNPVATEQYGSVPTTTLESMTENQF

SEQ ID NO: 90627 - protein, 33 aa, Artificial Sequence
  Description of Artificial Sequence: Synthetic polypeptide
DESEIRTTNPVATECWGSVSCINEIQDREGENG

SEQ ID NO: 90628 - protein, 32 aa, Artificial Sequence
  Description of Artificial Sequence: Synthetic polypeptide
DEDEIACTNPVATEQYGSVATNLQNPDGDPTP

SEQ ID NO: 90629 - protein, 33 aa, Artificial Sequence
  Description of Artificial Sequence: Synthetic polypeptide
DESEIRTTNPVATECWGSVSCINEHQDRTGENG

SEQ ID NO: 90630 - protein, 33 aa, Artificial Sequence
  Description of Artificial Sequence: Synthetic polypeptide
DESEIRTTNPVATECWGSVSCINEHQDREGENG

SEQ ID NO: 90631 - protein, 33 aa, Artificial Sequence
  Description of Artificial Sequence: Synthetic polypeptide
DESEIRTTNPVATECWGSVSCINCPQDREGENK

SEQ ID NO: 90632 - protein, 34 aa, Artificial Sequence
  Description of Artificial Sequence: Synthetic polypeptide
DEEEIRTTNPVATEQYGSVSTNDADQALSLEMHY

SEQ ID NO: 90633 - protein, 33 aa, Artificial Sequence
  Description of Artificial Sequence: Synthetic polypeptide
DESEIRTTNPVATECWGSVSCINDPQDREGENG

SEQ ID NO: 90634 - protein, 33 aa, Artificial Sequence
  Description of Artificial Sequence: Synthetic polypeptide
DESEIRTTNPVATECWGSVSCINEAQDREGENG

SEQ ID NO: 90635 - protein, 33 aa, Artificial Sequence
  Description of Artificial Sequence: Synthetic polypeptide
DESEIRTTNPVATECWGSVSCINEAQDREGFNG

SEQ ID NO: 90636 - protein, 33 aa, Artificial Sequence
  Description of Artificial Sequence: Synthetic polypeptide
DESEIRTTNPVATECWGSVSCINECQDREGENG

SEQ ID NO: 90637 - protein, 32 aa, Artificial Sequence
  Description of Artificial Sequence: Synthetic polypeptide
DEMEIRTTNPVATEQYGSVSAEDGPVEFEGND

SEQ ID NO: 90638 - protein, 33 aa, Artificial Sequence
  Description of Artificial Sequence: Synthetic polypeptide
DESEIRTTNPVATECWGSVSCINEDQDREGENG

SEQ ID NO: 90639 - protein, 33 aa, Artificial Sequence
  Description of Artificial Sequence: Synthetic polypeptide
DESEIRTTNPVATECWGSVSCINEEQDREGENG

SEQ ID NO: 90640 - protein, 33 aa, Artificial Sequence
  Description of Artificial Sequence: Synthetic polypeptide
DESEIRTTNPVATECWGSVSCINEFQDRAGENG

SEQ ID NO: 90641 - protein, 33 aa, Artificial Sequence
  Description of Artificial Sequence: Synthetic polypeptide
DESEIRTTNPVATECWGSVSCINEFQDREGENG

SEQ ID NO: 90642 - protein, 31 aa, Artificial Sequence
  Description of Artificial Sequence: Synthetic polypeptide
DEDEIACTNPVAYEQYGSVATNLEQNRTDQE

SEQ ID NO: 90643 - protein, 33 aa, Artificial Sequence
  Description of Artificial Sequence: Synthetic polypeptide
DESEIRTTNPVATECWGSVSCINEGQDREGENG

SEQ ID NO: 90644 - protein, 34 aa, Artificial Sequence
  Description of Artificial Sequence: Synthetic polypeptide
DEMEIRTTNPVATEQYGSVQWTNDVQQRENEMDN

SEQ ID NO: 90645 - protein, 33 aa, Artificial Sequence
  Description of Artificial Sequence: Synthetic polypeptide
DESEIRTTNPVATECWGSVSCINEHQDREGDNG

SEQ ID NO: 90646 - protein, 31 aa, Artificial Sequence
  Description of Artificial Sequence: Synthetic polypeptide
DEMEIRTTNPVATEQYGSVQTDWVQSEEDQE

SEQ ID NO: 90647 - protein, 31 aa, Artificial Sequence
  Description of Artificial Sequence: Synthetic polypeptide
DEDEIACTNPVAYEQYGSVATNLQTANPTEH

SEQ ID NO: 90648 - protein, 33 aa, Artificial Sequence
  Description of Artificial Sequence: Synthetic polypeptide
DESEIRTTNPVATECWGSVSCINEHQDREGNNG

SEQ ID NO: 90649 - protein, 32 aa, Artificial Sequence
  Description of Artificial Sequence: Synthetic polypeptide
DEMEIRTTNPVATEQYGSVPPNLMNTSDNQIS

SEQ ID NO: 90650 - protein, 35 aa, Artificial Sequence
  Description of Artificial Sequence: Synthetic polypeptide
DEMEIRTTNPVATEQYGSVSEANLDQERFGEDTDM

SEQ ID NO: 90651 - protein, 33 aa, Artificial Sequence
  Description of Artificial Sequence: Synthetic polypeptide
DESEIRTTNPVATECWGSVSCGNESQNREGGNG

SEQ ID NO: 90652 - protein, 32 aa, Artificial Sequence
  Description of Artificial Sequence: Synthetic polypeptide
DEAEIATTNPVATEQYGSVSATGLEDHNGEDL

SEQ ID NO: 90653 - protein, 32 aa, Artificial Sequence
  Description of Artificial Sequence: Synthetic polypeptide
DEEEIRTTNPVATEQYGVVSSSAGPNRNGMDI

SEQ ID NO: 90654 - protein, 31 aa, Artificial Sequence
  Description of Artificial Sequence: Synthetic polypeptide
DEDEIACTNPVATEQYGCVATNLQATEEPNQ

SEQ ID NO: 90655 - protein, 32 aa, Artificial Sequence
  Description of Artificial Sequence: Synthetic polypeptide
DEEEIRTTNPVATEQYGVVSSSAGPNRNGMDV

SEQ ID NO: 90656 - protein, 33 aa, Artificial Sequence
  Description of Artificial Sequence: Synthetic polypeptide
DESEIRTTNPVATECWGSVSCANEPQDREGENG

SEQ ID NO: 90657 - protein, 33 aa, Artificial Sequence
  Description of Artificial Sequence: Synthetic polypeptide
DESEIRTTNPVATECWGSVSCANEPQDRTGTNG

SEQ ID NO: 90658 - protein, 31 aa, Artificial Sequence
  Description of Artificial Sequence: Synthetic polypeptide
DEDEIACTNPVATEQYGCVATNLQDAGIEIQ

SEQ ID NO: 90659 - protein, 31 aa, Artificial Sequence
  Description of Artificial Sequence: Synthetic polypeptide
DEDEIACTNPVATEQYGCVATNLQATEEGRE

SEQ ID NO: 90660 - protein, 33 aa, Artificial Sequence
  Description of Artificial Sequence: Synthetic polypeptide
DEEEIRTTNPVATEQYGVVSSSPAGPNRNGMNV

SEQ ID NO: 90661 - protein, 33 aa, Artificial Sequence
  Description of Artificial Sequence: Synthetic polypeptide
DAAEIATTNPVATEQYGSVSTNPLQAEMGGMGM

SEQ ID NO: 90662 - protein, 31 aa, Artificial Sequence
  Description of Artificial Sequence: Synthetic polypeptide
DEDEIACTNPVATEQYGCVATNLQDGQIEHE

SEQ ID NO: 90663 - protein, 32 aa, Artificial Sequence
  Description of Artificial Sequence: Synthetic polypeptide
DEAEIATTNPVATEQYGSVSATDLEEHFGEDL

SEQ ID NO: 90664 - protein, 30 aa, Artificial Sequence
  Description of Artificial Sequence: Synthetic polypeptide
DEDEIACTNPVATEQYGCVATNLQDSIEEE

SEQ ID NO: 90665 - protein, 32 aa, Artificial Sequence
  Description of Artificial Sequence: Synthetic polypeptide
DEDEIACTNPVATEQYGCVATNLQEADDGPRN

SEQ ID NO: 90666 - protein, 33 aa, Artificial Sequence
  Description of Artificial Sequence: Synthetic polypeptide
DESEIRTTNPVATECWGSVSCCNEPQDREGENG

SEQ ID NO: 90667 - protein, 33 aa, Artificial Sequence
  Description of Artificial Sequence: Synthetic polypeptide
DESEIRTTNPVATECWGSVSCCNGPQDREGENG

SEQ ID NO: 90668 - protein, 34 aa, Artificial Sequence
  Description of Artificial Sequence: Synthetic polypeptide
DEEEIRTTNPVATEQYGVVSSTDNGQGEGDEFTN

SEQ ID NO: 90669 - protein, 33 aa, Artificial Sequence
  Description of Artificial Sequence: Synthetic polypeptide
DEAEIATTNPVATEQYGSVSATNEQNPGPVDQV

SEQ ID NO: 90670 - protein, 33 aa, Artificial Sequence
  Description of Artificial Sequence: Synthetic polypeptide
DAAEIATTNPVATEQYGSVSATNPLQAEMGGMV

SEQ ID NO: 90671 - protein, 32 aa, Artificial Sequence
  Description of Artificial Sequence: Synthetic polypeptide
DEMEIRTTNPVATEQYGSVSPDNGMENFNDIH

SEQ ID NO: 90672 - protein, 35 aa, Artificial Sequence
  Description of Artificial Sequence: Synthetic polypeptide
DESEIRTTNPVATECWGSVSATINLPQDREGENDG

SEQ ID NO: 90673 - protein, 33 aa, Artificial Sequence
  Description of Artificial Sequence: Synthetic polypeptide
DEMEIRTTNPVATEQYGSVSPTDMENRGDIQEI

SEQ ID NO: 90674 - protein, 32 aa, Artificial Sequence
  Description of Artificial Sequence: Synthetic polypeptide
DEDEIACTNPVATEQYGCVATNLQAEGGNAEE

SEQ ID NO: 90675 - protein, 34 aa, Artificial Sequence
  Description of Artificial Sequence: Synthetic polypeptide
DEEEIRTTNPVATEQYGVVSGTNNGQAEGGGEQG

SEQ ID NO: 90676 - protein, 33 aa, Artificial Sequence
  Description of Artificial Sequence: Synthetic polypeptide
DEMEIRTTNPVATEQYGSVSPTDLETQTEEQEK

SEQ ID NO: 90677 - protein, 34 aa, Artificial Sequence
  Description of Artificial Sequence: Synthetic polypeptide
DEMEIRTTNPVATEQYGSVSPSNLQEFRTEEQIM

SEQ ID NO: 90678 - protein, 33 aa, Artificial Sequence
  Description of Artificial Sequence: Synthetic polypeptide
DEMEIRTTNPVATEQYGSVSPNYDQIEGSEEHS

SEQ ID NO: 90679 - protein, 32 aa, Artificial Sequence
  Description of Artificial Sequence: Synthetic polypeptide
DEAEIATTNPVATEQYGSVSITDLEDHEGETL

SEQ ID NO: 90680 - protein, 32 aa, Artificial Sequence
  Description of Artificial Sequence: Synthetic polypeptide
DEDEIACTNPVATEQYGCVATNLQAGEDNESN

SEQ ID NO: 90681 - protein, 31 aa, Artificial Sequence
  Description of Artificial Sequence: Synthetic polypeptide
DEMEIRTTNPVATEQYGSVSPLDLNPNDEDG

SEQ ID NO: 90682 - protein, 30 aa, Artificial Sequence
  Description of Artificial Sequence: Synthetic polypeptide
DEDEIACTNPVATEQYGCVATNLQALDEAE

SEQ ID NO: 90683 - protein, 31 aa, Artificial Sequence
  Description of Artificial Sequence: Synthetic polypeptide
DEDEIACTNPVATEQYGCVATNLQANDPNEQ

SEQ ID NO: 90684 - protein, 31 aa, Artificial Sequence
  Description of Artificial Sequence: Synthetic polypeptide
DEDEIACTNPVATEQYGCVATNLQANNPNPE

SEQ ID NO: 90685 - protein, 34 aa, Artificial Sequence
  Description of Artificial Sequence: Synthetic polypeptide
DEEEIRTTNPVATEQYGVVSNTDNMNIIGGNFDE

SEQ ID NO: 90686 - protein, 34 aa, Artificial Sequence
  Description of Artificial Sequence: Synthetic polypeptide
DEMEIRTTNPVATEQYGSVSPETDNQEEGNEDTT

SEQ ID NO: 90687 - protein, 32 aa, Artificial Sequence
  Description of Artificial Sequence: Synthetic polypeptide
DEMEIRTTNPVATEQYGSVSPDNTSGPMEDRG

SEQ ID NO: 90688 - protein, 30 aa, Artificial Sequence
  Description of Artificial Sequence: Synthetic polypeptide
DEDEIACTNPVATEQYGCVATNLQAPSIEE

SEQ ID NO: 90689 - protein, 32 aa, Artificial Sequence
  Description of Artificial Sequence: Synthetic polypeptide
DEDEIACTNPVATEQYGCVATNLQMAGENTSN

SEQ ID NO: 90690 - protein, 31 aa, Artificial Sequence
  Description of Artificial Sequence: Synthetic polypeptide
DEDEIACTNPVATEQYGCVATNLQMGDIEAE

SEQ ID NO: 90691 - protein, 32 aa, Artificial Sequence
  Description of Artificial Sequence: Synthetic polypeptide
DEAEIATTNPVATEQYGSVSATDLEDHGGEDL

SEQ ID NO: 90692 - protein, 33 aa, Artificial Sequence
  Description of Artificial Sequence: Synthetic polypeptide
DESEIRTTNPVATECWGSVSCDNEPQDREGENG

SEQ ID NO: 90693 - protein, 31 aa, Artificial Sequence
  Description of Artificial Sequence: Synthetic polypeptide
DEMEIRTTNPVATEQYGSVSMDNNGIESSQS

SEQ ID NO: 90694 - protein, 32 aa, Artificial Sequence
  Description of Artificial Sequence: Synthetic polypeptide
DESEIRTTNPVATECWGSVSCENIPQDQEGNG

SEQ ID NO: 90695 - protein, 32 aa, Artificial Sequence
  Description of Artificial Sequence: Synthetic polypeptide
DEAEIATTNPVATEQYGSVCYTQDQNQGQNNH

SEQ ID NO: 90696 - protein, 31 aa, Artificial Sequence
  Description of Artificial Sequence: Synthetic polypeptide
DEMEIRTTNPVATEQYGSVSMDLNTTEEVFS

SEQ ID NO: 90697 - protein, 33 aa, Artificial Sequence
  Description of Artificial Sequence: Synthetic polypeptide
DESEIRTTNPVATECWGSVSCFNEPQDREGENG

SEQ ID NO: 90698 - protein, 33 aa, Artificial Sequence
  Description of Artificial Sequence: Synthetic polypeptide
DESEIRTTNPVATECWGSVSCFNEPQDREGENW

SEQ ID NO: 90699 - protein, 33 aa, Artificial Sequence
  Description of Artificial Sequence: Synthetic polypeptide
DEAEIATTNPVATEQYGSVCVNELQQAQGDNNH

SEQ ID NO: 90700 - protein, 33 aa, Artificial Sequence
  Description of Artificial Sequence: Synthetic polypeptide
DEAEIATTNPVATEQYGSVCTTNGQPEGGDNSD

SEQ ID NO: 90701 - protein, 33 aa, Artificial Sequence
  Description of Artificial Sequence: Synthetic polypeptide
DESEIRTTNPVATECWGSVSCGNEPQDREGENG

SEQ ID NO: 90702 - protein, 32 aa, Artificial Sequence
  Description of Artificial Sequence: Synthetic polypeptide
DEMEIRTTNPVATEQYGSVSMDLMNRPESTQS

SEQ ID NO: 90703 - protein, 32 aa, Artificial Sequence
  Description of Artificial Sequence: Synthetic polypeptide
DEMEIRTTNPVATEQYGSVSMDLLNGIESDQT

SEQ ID NO: 90704 - protein, 31 aa, Artificial Sequence
  Description of Artificial Sequence: Synthetic polypeptide
DEDEIACTNPVATEQYGSVATNLEMNPNPAE

SEQ ID NO: 90705 - protein, 32 aa, Artificial Sequence
  Description of Artificial Sequence: Synthetic polypeptide
DEAEIATTNPVATEQYGSVCTIDDQHQGNNNH

SEQ ID NO: 90706 - protein, 32 aa, Artificial Sequence
  Description of Artificial Sequence: Synthetic polypeptide
DEDEIACTNPVATEQYGSVATNLPAEGPNENQ

SEQ ID NO: 90707 - protein, 31 aa, Artificial Sequence
  Description of Artificial Sequence: Synthetic polypeptide
DEMEIRTTNPVATEQYGSVSMDLEHIESTQS

SEQ ID NO: 90708 - protein, 32 aa, Artificial Sequence
  Description of Artificial Sequence: Synthetic polypeptide
DEMEIRTTNPVATEQYGSVSMDALNRIESDQE

SEQ ID NO: 90709 - protein, 32 aa, Artificial Sequence
  Description of Artificial Sequence: Synthetic polypeptide
DEMEIRTTNPVATEQYGSVSEVPLNSEQNQIQ

SEQ ID NO: 90710 - protein, 33 aa, Artificial Sequence
  Description of Artificial Sequence: Synthetic polypeptide
DESEIRTTNPVATECWGSVSCENEQQQRNGENG

SEQ ID NO: 90711 - protein, 34 aa, Artificial Sequence
  Description of Artificial Sequence: Synthetic polypeptide
DEMEIRTTNPVATEQYGSVSESWEQDRIGDNNQE

SEQ ID NO: 90712 - protein, 33 aa, Artificial Sequence
  Description of Artificial Sequence: Synthetic polypeptide
DESEIRTTNPVATECWGSVSCENEQQQREGENG

SEQ ID NO: 90713 - protein, 33 aa, Artificial Sequence
  Description of Artificial Sequence: Synthetic polypeptide
DESEIRTTNPVATECWGSVSCENEPQQREGENG

SEQ ID NO: 90714 - protein, 34 aa, Artificial Sequence
  Description of Artificial Sequence: Synthetic polypeptide
DEMEIRTTNPVATEQYGSVSNTNGTQTFGSKGFE

SEQ ID NO: 90715 - protein, 32 aa, Artificial Sequence
  Description of Artificial Sequence: Synthetic polypeptide
DEAEIATTNPVATEQYGSVSATDLEDHEGEDL

SEQ ID NO: 90716 - protein, 33 aa, Artificial Sequence
  Description of Artificial Sequence: Synthetic polypeptide
DESEIRTTNPVATECWGSVSCDNEPQDRRGENG

SEQ ID NO: 90717 - protein, 34 aa, Artificial Sequence
  Description of Artificial Sequence: Synthetic polypeptide
DEAEIATTNPVATEQYGSVSATANGGQPHQGANF

SEQ ID NO: 90718 - protein, 32 aa, Artificial Sequence
  Description of Artificial Sequence: Synthetic polypeptide
DEDEIACTNPVATEQYGCVATNLQQGEGNNQD

SEQ ID NO: 90719 - protein, 32 aa, Artificial Sequence
  Description of Artificial Sequence: Synthetic polypeptide
DEAEIATTNPVATEQYGSVSANNQGENMPDNQ

SEQ ID NO: 90720 - protein, 32 aa, Artificial Sequence
  Description of Artificial Sequence: Synthetic polypeptide
DEDEIACTNPVATEQYGCVATNLQREADNEAM

SEQ ID NO: 90721 - protein, 32 aa, Artificial Sequence
  Description of Artificial Sequence: Synthetic polypeptide
DEAEIATTNPVATEQYGSVSAGNLFSNNDNND

SEQ ID NO: 90722 - protein, 35 aa, Artificial Sequence
  Description of Artificial Sequence: Synthetic polypeptide
DEEEIRTTNPVATEQYGSVSTNDLTQLESKQDSPL

SEQ ID NO: 90723 - protein, 34 aa, Artificial Sequence
  Description of Artificial Sequence: Synthetic polypeptide
DEMEIRTTNPVATEQYGSVSNTENTIIVFGNEQN

SEQ ID NO: 90724 - protein, 31 aa, Artificial Sequence
  Description of Artificial Sequence: Synthetic polypeptide
DEDEIACTNPVATEQYGCVATNLQRTEEPEE

SEQ ID NO: 90725 - protein, 33 aa, Artificial Sequence
  Description of Artificial Sequence: Synthetic polypeptide
DESEIRTTNPVATECWGSVSCENEAQDREGENG

SEQ ID NO: 90726 - protein, 33 aa, Artificial Sequence
  Description of Artificial Sequence: Synthetic polypeptide
DESEIRTTNPVATECWGSVSCENEPQDREGENG

SEQ ID NO: 90727 - protein, 33 aa, Artificial Sequence
  Description of Artificial Sequence: Synthetic polypeptide
DESEIRTTNPVATECWGSVSCENEPQDREGPNG

SEQ ID NO: 90728 - protein, 32 aa, Artificial Sequence
  Description of Artificial Sequence: Synthetic polypeptide
DEDEIACTNPVATEQYGCVSTNNHQENDMGND

SEQ ID NO: 90729 - protein, 33 aa, Artificial Sequence
  Description of Artificial Sequence: Synthetic polypeptide
DEMEIRTTNPVATEQYGSVSNDVDAQTRENQEM

SEQ ID NO: 90730 - protein, 32 aa, Artificial Sequence
  Description of Artificial Sequence: Synthetic polypeptide
DEMEIRTTNPVATEQYGSVSMVLQNTSDEDYE

SEQ ID NO: 90731 - protein, 33 aa, Artificial Sequence
  Description of Artificial Sequence: Synthetic polypeptide
DESEIRTTNPVATECWGSVSCENEPQVREGENG

SEQ ID NO: 90732 - protein, 30 aa, Artificial Sequence
  Description of Artificial Sequence: Synthetic polypeptide
DEMEIATTNPCATEQYGTVSCNPVQSEGTD

SEQ ID NO: 90733 - protein, 34 aa, Artificial Sequence
  Description of Artificial Sequence: Synthetic polypeptide
DEEEIRTTNPVATEQYGSVYTDDPKNASEGSNFE

SEQ ID NO: 90734 - protein, 34 aa, Artificial Sequence
  Description of Artificial Sequence: Synthetic polypeptide
DEEEIRTTNPVATEQYGSVSPIPDMLQIDNDELI

SEQ ID NO: 90735 - protein, 33 aa, Artificial Sequence
  Description of Artificial Sequence: Synthetic polypeptide
QESEIRTTNPVATEQYGSVSASPTGPQRNGDPV

SEQ ID NO: 90736 - protein, 33 aa, Artificial Sequence
  Description of Artificial Sequence: Synthetic polypeptide
QESEIRTTNPVATEQYGSVSASPTLPQRNGDPV

SEQ ID NO: 90737 - protein, 32 aa, Artificial Sequence
  Description of Artificial Sequence: Synthetic polypeptide
DEEEIRATNPVTTEQYGSVATNNNLEQGTTTE

SEQ ID NO: 90738 - protein, 33 aa, Artificial Sequence
  Description of Artificial Sequence: Synthetic polypeptide
QESEIRTTNPVATEQYGSVSATPTGPQRNGDPV

SEQ ID NO: 90739 - protein, 31 aa, Artificial Sequence
  Description of Artificial Sequence: Synthetic polypeptide
DEEEIRTTNPVATEQYGSCSPTYAEFETQDL

SEQ ID NO: 90740 - protein, 33 aa, Artificial Sequence
  Description of Artificial Sequence: Synthetic polypeptide
DEEEIRATNPVTTEQYGSVATNNNNQQGTVNTG

SEQ ID NO: 90741 - protein, 30 aa, Artificial Sequence
  Description of Artificial Sequence: Synthetic polypeptide
QESEIRTTNPVGTEGWGSMSCNLQDHGENI

SEQ ID NO: 90742 - protein, 34 aa, Artificial Sequence
  Description of Artificial Sequence: Synthetic polypeptide
DEEEIRTTNPVATEQYGSCSPTNVPENTSDSNQR

SEQ ID NO: 90743 - protein, 34 aa, Artificial Sequence
  Description of Artificial Sequence: Synthetic polypeptide
DEEEIRTTNPVATEQYGSCSPTNVPENRSQSNQI

SEQ ID NO: 90744 - protein, 28 aa, Artificial Sequence
  Description of Artificial Sequence: Synthetic peptide
QESEIRTTNPVGTEGYGTIASTLQHGDH

SEQ ID NO: 90745 - protein, 28 aa, Artificial Sequence
  Description of Artificial Sequence: Synthetic peptide
QESEIRTTNPVGTEGYGTIASTLQHGDI

SEQ ID NO: 90746 - protein, 28 aa, Artificial Sequence
  Description of Artificial Sequence: Synthetic peptide
QESEIRTTNPVGTEGYGVIASTLQHGDI

SEQ ID NO: 90747 - protein, 29 aa, Artificial Sequence
  Description of Artificial Sequence: Synthetic peptide
QESEIRTTNPVGTEGYGVMASTLQDHGNI

SEQ ID NO: 90748 - protein, 28 aa, Artificial Sequence
  Description of Artificial Sequence: Synthetic peptide
QESEIRTTNPVGTEGYGVMASTLQHGDI

SEQ ID NO: 90749 - protein, 29 aa, Artificial Sequence
  Description of Artificial Sequence: Synthetic peptide
QESEIRTTNPVGTEQYGSMATTGPQHGDI

SEQ ID NO: 90750 - protein, 32 aa, Artificial Sequence
  Description of Artificial Sequence: Synthetic polypeptide
DEEEIRATNPVTTEQYGSVSTNNATEIGTTTM

SEQ ID NO: 90751 - protein, 29 aa, Artificial Sequence
  Description of Artificial Sequence: Synthetic peptide
QESEIRTTNPVGTEQYGSMATTGPQHGDV

SEQ ID NO: 90752 - protein, 32 aa, Artificial Sequence
  Description of Artificial Sequence: Synthetic polypeptide
DEEEIRATNPVTTEQYGSVSTNNATEIYGTDD

SEQ ID NO: 90753 - protein, 33 aa, Artificial Sequence
  Description of Artificial Sequence: Synthetic polypeptide
DEEEIRTTNPVATEQYGSCSPPNALENPRTEDD

SEQ ID NO: 90754 - protein, 30 aa, Artificial Sequence
  Description of Artificial Sequence: Synthetic polypeptide
DEEEIRTTNPVATEQYGSCSPDYAEFEQQD

SEQ ID NO: 90755 - protein, 29 aa, Artificial Sequence
  Description of Artificial Sequence: Synthetic peptide
QESEIRTTNPVSTEPYGTMSMEDLQQGNH

SEQ ID NO: 90756 - protein, 32 aa, Artificial Sequence
  Description of Artificial Sequence: Synthetic polypeptide
QESEIRTTNPVATEQWGSVSCINEPQDREGTG

SEQ ID NO: 90757 - protein, 29 aa, Artificial Sequence
  Description of Artificial Sequence: Synthetic peptide
QESEIRTTNPVSTEPYGTMSSEDLQQGNH

SEQ ID NO: 90758 - protein, 33 aa, Artificial Sequence
  Description of Artificial Sequence: Synthetic polypeptide
QESEIRTTNPVATEQWGSVSCINEPQDREGENG

SEQ ID NO: 90759 - protein, 31 aa, Artificial Sequence
  Description of Artificial Sequence: Synthetic polypeptide
QESEIRTTNPVATEQWGSVPEINEPQREENG

SEQ ID NO: 90760 - protein, 35 aa, Artificial Sequence
  Description of Artificial Sequence: Synthetic polypeptide
DEEEIRTTNPVATEQYGSCSTNDEDTLSGGQNHEM

SEQ ID NO: 90761 - protein, 34 aa, Artificial Sequence
  Description of Artificial Sequence: Synthetic polypeptide
DEEEIRATNPVATESYGSVASANNDMQTGMNYRM

SEQ ID NO: 90762 - protein, 31 aa, Artificial Sequence
  Description of Artificial Sequence: Synthetic polypeptide
QESEIRTTNPVATECYGIVSCINLPQSGETG

SEQ ID NO: 90763 - protein, 33 aa, Artificial Sequence
  Description of Artificial Sequence: Synthetic polypeptide
DEEEIRTTNPVATEQYGSCSTINAPQNTESQQY

SEQ ID NO: 90764 - protein, 31 aa, Artificial Sequence
  Description of Artificial Sequence: Synthetic polypeptide
DEEEIRATNPVAYEQWGMVSGGEGDMQGGNR

SEQ ID NO: 90765 - protein, 32 aa, Artificial Sequence
  Description of Artificial Sequence: Synthetic polypeptide
DEEEIRATNPVAYEQWGMVSGWNDDHQGGNLR

SEQ ID NO: 90766 - protein, 29 aa, Artificial Sequence
  Description of Artificial Sequence: Synthetic peptide
QESEIRTTNPVATECYGSVPENEQHEEEK

SEQ ID NO: 90767 - protein, 30 aa, Artificial Sequence
  Description of Artificial Sequence: Synthetic polypeptide
QESEIRTTNPVATECYGSVPENEQHEEENK

SEQ ID NO: 90768 - protein, 33 aa, Artificial Sequence
  Description of Artificial Sequence: Synthetic polypeptide
QESEIRTTNPVATECYGSVSCINEPQDREGENG

SEQ ID NO: 90769 - protein, 31 aa, Artificial Sequence
  Description of Artificial Sequence: Synthetic polypeptide
QESEIRTTNPVATECYGSVSCVCPQREEENG

SEQ ID NO: 90770 - protein, 31 aa, Artificial Sequence
  Description of Artificial Sequence: Synthetic polypeptide
QESEIRTTNPVATECYGSVSCVEPQREEENG

SEQ ID NO: 90771 - protein, 32 aa, Artificial Sequence
  Description of Artificial Sequence: Synthetic polypeptide
QESEIRTTNPVATECYGSVSEINEPQREGEEL

SEQ ID NO: 90772 - protein, 32 aa, Artificial Sequence
  Description of Artificial Sequence: Synthetic polypeptide
QESEIRTTNPVATECYGSVSEINLPQREEEEL

SEQ ID NO: 90773 - protein, 32 aa, Artificial Sequence
  Description of Artificial Sequence: Synthetic polypeptide
DEEEIRATNPVAYEQWGVVPTGWNDHQGGDNR

SEQ ID NO: 90774 - protein, 32 aa, Artificial Sequence
  Description of Artificial Sequence: Synthetic polypeptide
DEEEIRATNPVAYEQWGVVSGWNDHQQDVGNR

SEQ ID NO: 90775 - protein, 31 aa, Artificial Sequence
  Description of Artificial Sequence: Synthetic polypeptide
QESEIRTTNPVATEGWGVVSCNLPQREGEDG

SEQ ID NO: 90776 - protein, 32 aa, Artificial Sequence
  Description of Artificial Sequence: Synthetic polypeptide
DEEEIRATNPVAYEQYGSVCATTDQGGDNSAM

SEQ ID NO: 90777 - protein, 32 aa, Artificial Sequence
  Description of Artificial Sequence: Synthetic polypeptide
DEEEIRATNPVAYEQYGSVSANNHDAPSGSRM

SEQ ID NO: 90778 - protein, 30 aa, Artificial Sequence
  Description of Artificial Sequence: Synthetic polypeptide
QESEIRTTNPVATEGYGVVSSTLQHEGEDI

SEQ ID NO: 90779 - protein, 34 aa, Artificial Sequence
  Description of Artificial Sequence: Synthetic polypeptide
DEEEIRTTNPVATEQYGSCSTDDPMMNRVGLNDD

SEQ ID NO: 90780 - protein, 31 aa, Artificial Sequence
  Description of Artificial Sequence: Synthetic polypeptide
QESEIRTTNPVATEQWGSVPCINEPQREENG

SEQ ID NO: 90781 - protein, 32 aa, Artificial Sequence
  Description of Artificial Sequence: Synthetic polypeptide
QESEIRTTNPVATEQWGSVSCINEPQDREENG

SEQ ID NO: 90782 - protein, 28 aa, Artificial Sequence
  Description of Artificial Sequence: Synthetic peptide
QESEIVSTNPVATEGYGTMASTLQHGND

SEQ ID NO: 90783 - protein, 32 aa, Artificial Sequence
  Description of Artificial Sequence: Synthetic polypeptide
DEEEIRCTNPAATEQYGSVSGNGQDEGGQDST

SEQ ID NO: 90784 - protein, 32 aa, Artificial Sequence
  Description of Artificial Sequence: Synthetic polypeptide
DEEEIRTTNPVATEQYGSCSNTDLEGTTESIE

SEQ ID NO: 90785 - protein, 28 aa, Artificial Sequence
  Description of Artificial Sequence: Synthetic peptide
QETEIATTNPVATECYGQVSECLQHEEL

SEQ ID NO: 90786 - protein, 34 aa, Artificial Sequence
  Description of Artificial Sequence: Synthetic polypeptide
DEEEIRTTNPVATEQYGSCSAGNALGQHPDGAQM

SEQ ID NO: 90787 - protein, 28 aa, Artificial Sequence
  Description of Artificial Sequence: Synthetic peptide
QETEIATTNPVATECYGVVSELLQTEEL

SEQ ID NO: 90788 - protein, 29 aa, Artificial Sequence
  Description of Artificial Sequence: Synthetic peptide
QETEIRTTNPCATECWGIVSANLQSGPYI

SEQ ID NO: 90789 - protein, 29 aa, Artificial Sequence
  Description of Artificial Sequence: Synthetic peptide
QETEIRTTNPCATECWGIVSCNLQSGPYI

SEQ ID NO: 90790 - protein, 33 aa, Artificial Sequence
  Description of Artificial Sequence: Synthetic polypeptide
DEEEIRCTNPVATECWGSVSCINEPQDREGENG

SEQ ID NO: 90791 - protein, 34 aa, Artificial Sequence
  Description of Artificial Sequence: Synthetic polypeptide
DEEEIRTTNPVATEQYGSCQSGPNEIEEQERNRF

SEQ ID NO: 90792 - protein, 29 aa, Artificial Sequence
  Description of Artificial Sequence: Synthetic peptide
QETEIRTTNPCSTECWGIVSCNLQSGPYR

SEQ ID NO: 90793 - protein, 33 aa, Artificial Sequence
  Description of Artificial Sequence: Synthetic polypeptide
QETEIRTTNPVAVEQYGSVISTNGGERGNGNGD

SEQ ID NO: 90794 - protein, 33 aa, Artificial Sequence
  Description of Artificial Sequence: Synthetic polypeptide
DEEEIRTTNPVATEQYGSCQETTFNEQVQNEPE

SEQ ID NO: 90795 - protein, 28 aa, Artificial Sequence
  Description of Artificial Sequence: Synthetic peptide
QEVEIAPTNPCSSEQYGIVSCNLQSGER

SEQ ID NO: 90796 - protein, 28 aa, Artificial Sequence
  Description of Artificial Sequence: Synthetic peptide
QEVEIAPTNPCSSEQYGIVSCNLQSGTR

SEQ ID NO: 90797 - protein, 32 aa, Artificial Sequence
  Description of Artificial Sequence: Synthetic polypeptide
DEEEIRTTNPVATEQYGSCPTDDLQENSQDTN

SEQ ID NO: 90798 - protein, 28 aa, Artificial Sequence
  Description of Artificial Sequence: Synthetic peptide
QEVEIATTNPVATECYGDVSECLQHEEL

SEQ ID NO: 90799 - protein, 32 aa, Artificial Sequence
  Description of Artificial Sequence: Synthetic polypeptide
QEVEIRTTNPVATEQYGSVSNDINNGGNGNGQ

SEQ ID NO: 90800 - protein, 33 aa, Artificial Sequence
  Description of Artificial Sequence: Synthetic polypeptide
QEVEIRTTNPVATEQYGSVSTGNGGGDGEGNEG

SEQ ID NO: 90801 - protein, 34 aa, Artificial Sequence
  Description of Artificial Sequence: Synthetic polypeptide
QEVEIRTTNPVATEQYGSVSTSNNLTVGVGNGNE

SEQ ID NO: 90802 - protein, 28 aa, Artificial Sequence
  Description of Artificial Sequence: Synthetic peptide
QEWEIATTNPVATECYGDVSECLQHEEL

SEQ ID NO: 90803 - protein, 28 aa, Artificial Sequence
  Description of Artificial Sequence: Synthetic peptide
QEWEIATTNPVATECYGDVSECLQTEEL

SEQ ID NO: 90804 - protein, 28 aa, Artificial Sequence
  Description of Artificial Sequence: Synthetic peptide
QEYEIACTNPCSYEQYGVVSSNLQSGDR

SEQ ID NO: 90805 - protein, 28 aa, Artificial Sequence
  Description of Artificial Sequence: Synthetic peptide
QEYEIAPTNPCSSEQYGIVSCNLQSGTR

SEQ ID NO: 90806 - protein, 32 aa, Artificial Sequence
  Description of Artificial Sequence: Synthetic polypeptide
DEEEIRCTNPISTEQYGTVSEENLQQQQNGNH

SEQ ID NO: 90807 - protein, 30 aa, Artificial Sequence
  Description of Artificial Sequence: Synthetic polypeptide
DEEEIRCTNPISTEQYGTISEENIQQQGNH

SEQ ID NO: 90808 - protein, 28 aa, Artificial Sequence
  Description of Artificial Sequence: Synthetic peptide
QETEIATTNPVATECYGGVSCCLQHEEL

SEQ ID NO: 90809 - protein, 33 aa, Artificial Sequence
  Description of Artificial Sequence: Synthetic polypeptide
DEEEIRTTNPVATEQYGSCSAGNFLQDADDSAE

SEQ ID NO: 90810 - protein, 30 aa, Artificial Sequence
  Description of Artificial Sequence: Synthetic polypeptide
QESEIVSTNPVATEQYGTVSSDGLVQFGNI

SEQ ID NO: 90811 - protein, 29 aa, Artificial Sequence
  Description of Artificial Sequence: Synthetic peptide
QESEIVSTNPVATEQYGVVSTGLVEHGDD

SEQ ID NO: 90812 - protein, 29 aa, Artificial Sequence
  Description of Artificial Sequence: Synthetic peptide
DEEEIRCTNPIATECYGATVAENWMPGNI

SEQ ID NO: 90813 - protein, 32 aa, Artificial Sequence
  Description of Artificial Sequence: Synthetic polypeptide
DEEEIRCTNPIATEQWGSVSCNEPMDREGENG

SEQ ID NO: 90814 - protein, 29 aa, Artificial Sequence
  Description of Artificial Sequence: Synthetic peptide
QESEVATTNPVATECYGNVSECIQRVGER

SEQ ID NO: 90815 - protein, 33 aa, Artificial Sequence
  Description of Artificial Sequence: Synthetic polypeptide
QETAEIATTNPVAYEQYGSVSTNLQGNGDDNEM

SEQ ID NO: 90816 - protein, 30 aa, Artificial Sequence
  Description of Artificial Sequence: Synthetic polypeptide
DEEEIRCTNPIATEQYGAVSNEDWMPKGNI

SEQ ID NO: 90817 - protein, 28 aa, Artificial Sequence
  Description of Artificial Sequence: Synthetic peptide
QETEIAPTNPCSSEQYGIVSANLQSGTR

SEQ ID NO: 90818 - protein, 28 aa, Artificial Sequence
  Description of Artificial Sequence: Synthetic peptide
QETEIAPTNPCSSEQYGIVSCNLQSGTR

SEQ ID NO: 90819 - protein, 28 aa, Artificial Sequence
  Description of Artificial Sequence: Synthetic peptide
QETEIASTNPCSYEQYGCVSWNLQSGTR

SEQ ID NO: 90820 - protein, 29 aa, Artificial Sequence
  Description of Artificial Sequence: Synthetic peptide
QESEIRTTNPVATECWGVVACTLQRGEDG

SEQ ID NO: 90821 - protein, 28 aa, Artificial Sequence
  Description of Artificial Sequence: Synthetic peptide
QETEIATTNPCSSEQWGIVSCNLQSGTR

SEQ ID NO: 90822 - protein, 31 aa, Artificial Sequence
  Description of Artificial Sequence: Synthetic polypeptide
DEEEIRCTNPIATEQYGAVWSADWAEPKGNR

SEQ ID NO: 90823 - protein, 33 aa, Artificial Sequence
  Description of Artificial Sequence: Synthetic polypeptide
DEEEIRTTNPVATEQYGSCSETMSLNQEHPIAK

SEQ ID NO: 90824 - protein, 28 aa, Artificial Sequence
  Description of Artificial Sequence: Synthetic peptide
QETEIATTNPCSTECWGIVSCNLQSGPR

SEQ ID NO: 90825 - protein, 28 aa, Artificial Sequence
  Description of Artificial Sequence: Synthetic peptide
QETEIATTNPVATECYGDVSECLQHEEI

SEQ ID NO: 90826 - protein, 32 aa, Artificial Sequence
  Description of Artificial Sequence: Synthetic polypeptide
DEEEIRTTNPVATEQYGSCSDENFLDNAFEIK

SEQ ID NO: 90827 - protein, 28 aa, Artificial Sequence
  Description of Artificial Sequence: Synthetic peptide
QETEIATTNPVATECYGDVSECLQHEEL

SEQ ID NO: 90828 - protein, 35 aa, Artificial Sequence
  Description of Artificial Sequence: Synthetic polypeptide
DEEEIRCTNPIATEQYGSVSSTTPNLPNMRNGNPV

SEQ ID NO: 90829 - protein, 32 aa, Artificial Sequence
  Description of Artificial Sequence: Synthetic polypeptide
DEEEIRCTNPIATEQYGTVCSAEDNPEREGND

SEQ ID NO: 90830 - protein, 33 aa, Artificial Sequence
  Description of Artificial Sequence: Synthetic polypeptide
DEEEIRTTNPVATEQYGSCSAGNMIGQAQDNNN

SEQ ID NO: 90831 - protein, 32 aa, Artificial Sequence
  Description of Artificial Sequence: Synthetic polypeptide
DEEEIRCTNPIATEQYGTVSMEDIQQQRNGNH

SEQ ID NO: 90832 - protein, 33 aa, Artificial Sequence
  Description of Artificial Sequence: Synthetic polypeptide
DEEEIRTTNPVATEQYGSCSETNLDSNMFEDDF

SEQ ID NO: 90833 - protein, 30 aa, Artificial Sequence
  Description of Artificial Sequence: Synthetic polypeptide
QESEIRTTNPVATECWGSVSENLPQDHEEL

SEQ ID NO: 90834 - protein, 31 aa, Artificial Sequence
  Description of Artificial Sequence: Synthetic polypeptide
QESEIRTTNPVATECWGSVSEIVEPQDRGNG

SEQ ID NO: 90835 - protein, 32 aa, Artificial Sequence
  Description of Artificial Sequence: Synthetic polypeptide
QESEIRTTNPVATECWGSVSEINEPQREGENL

SEQ ID NO: 90836 - protein, 34 aa, Artificial Sequence
  Description of Artificial Sequence: Synthetic polypeptide
DEEEIRATNPVATEQYGSVCATNPEQQGNQTEGT

SEQ ID NO: 90837 - protein, 34 aa, Artificial Sequence
  Description of Artificial Sequence: Synthetic polypeptide
DEEEIRATNPVATEQYGSVCATPLDQPDSGAEER

SEQ ID NO: 90838 - protein, 34 aa, Artificial Sequence
  Description of Artificial Sequence: Synthetic polypeptide
DEEEIRATNPVATEQYGSVCIVNDQHDRQGSNTA

SEQ ID NO: 90839 - protein, 35 aa, Artificial Sequence
  Description of Artificial Sequence: Synthetic polypeptide
DEEEIRATNPVATEQYGSVCSGVNDQDQRQDSNSR

SEQ ID NO: 90840 - protein, 34 aa, Artificial Sequence
  Description of Artificial Sequence: Synthetic polypeptide
DEEEIRTTNPVATEQYGSCSVYDVLDNSNGSNPR

SEQ ID NO: 90841 - protein, 28 aa, Artificial Sequence
  Description of Artificial Sequence: Synthetic peptide
QESEIATTNPVGTEQYGVMASTLQHGDL

SEQ ID NO: 90842 - protein, 28 aa, Artificial Sequence
  Description of Artificial Sequence: Synthetic peptide
QESEIATTNPVGTEQYGVMASTLQHGEI

SEQ ID NO: 90843 - protein, 28 aa, Artificial Sequence
  Description of Artificial Sequence: Synthetic peptide
QESEIATTNPVSTECYGDVSNCLQHGEL

SEQ ID NO: 90844 - protein, 28 aa, Artificial Sequence
  Description of Artificial Sequence: Synthetic peptide
QESEIATTNPVSTECYGDVSNTLQHGEL

SEQ ID NO: 90845 - protein, 28 aa, Artificial Sequence
  Description of Artificial Sequence: Synthetic peptide
QESEIATTNPVSTECYGDVSNTLQHGQL

SEQ ID NO: 90846 - protein, 28 aa, Artificial Sequence
  Description of Artificial Sequence: Synthetic peptide
QESEICTTNPVATECYGDVSECLQHEEL

SEQ ID NO: 90847 - protein, 33 aa, Artificial Sequence
  Description of Artificial Sequence: Synthetic polypeptide
DEEEIRATNPVATEQYGSVSAANQDEAGSNSNS

SEQ ID NO: 90848 - protein, 35 aa, Artificial Sequence
  Description of Artificial Sequence: Synthetic polypeptide
DEEEIRTTNPVATEQYGSCSTTNLIDDRNIENEQS

SEQ ID NO: 90849 - protein, 35 aa, Artificial Sequence
  Description of Artificial Sequence: Synthetic polypeptide
DEEEIRTTNPVATEQYGSCSTTNLIDDRNIEMERN

SEQ ID NO: 90850 - protein, 28 aa, Artificial Sequence
  Description of Artificial Sequence: Synthetic peptide
QESEIRCTNPIATEGYGSVAETLMHGNI

SEQ ID NO: 90851 - protein, 33 aa, Artificial Sequence
  Description of Artificial Sequence: Synthetic polypeptide
DEEEIRATNPVATEQYGSVSAGNQDEATGSNSD

SEQ ID NO: 90852 - protein, 34 aa, Artificial Sequence
  Description of Artificial Sequence: Synthetic polypeptide
DEEEIRTTNPVATEQYGSCSTTENDLDVRAFEIK

SEQ ID NO: 90853 - protein, 32 aa, Artificial Sequence
  Description of Artificial Sequence: Synthetic polypeptide
DEEEIRATNPVATEQYGSVSANNHDAPSGSDN

SEQ ID NO: 90854 - protein, 28 aa, Artificial Sequence
  Description of Artificial Sequence: Synthetic peptide
QESEIRCTNPIATEGYGVMASNLQHGDR

SEQ ID NO: 90855 - protein, 28 aa, Artificial Sequence
  Description of Artificial Sequence: Synthetic peptide
QESEIRCTNPIATEGYGVVASNLMHGDR

SEQ ID NO: 90856 - protein, 28 aa, Artificial Sequence
  Description of Artificial Sequence: Synthetic peptide
QESEIRCTNPVATEGYGVMASTLQHGDI

SEQ ID NO: 90857 - protein, 34 aa, Artificial Sequence
  Description of Artificial Sequence: Synthetic polypeptide
DEEEIRTTNPVATEQYGSCTSLIPMLQREMNQDF

SEQ ID NO: 90858 - protein, 35 aa, Artificial Sequence
  Description of Artificial Sequence: Synthetic polypeptide
DEEEIRTTNPVATEQYGSCTSMTEALSQTIGNTQE

SEQ ID NO: 90859 - protein, 28 aa, Artificial Sequence
  Description of Artificial Sequence: Synthetic peptide
QESEIATTNPVGTEGYGSMASTLNHGNI

SEQ ID NO: 90860 - protein, 34 aa, Artificial Sequence
  Description of Artificial Sequence: Synthetic polypeptide
DEEEIRTTNPVATEQYGSCVCSETLENREDNQVQ

SEQ ID NO: 90861 - protein, 32 aa, Artificial Sequence
  Description of Artificial Sequence: Synthetic polypeptide
QESEIATTNPVATECYGSVSCINLQDSEGENG

SEQ ID NO: 90862 - protein, 33 aa, Artificial Sequence
  Description of Artificial Sequence: Synthetic polypeptide
DEEEIRTTNPVATEQYGSDCFSFAMQQEVANRT

SEQ ID NO: 90863 - protein, 30 aa, Artificial Sequence
  Description of Artificial Sequence: Synthetic polypeptide
QESEIATTNPVATECYGSVSCVCPQREENG

SEQ ID NO: 90864 - protein, 30 aa, Artificial Sequence
  Description of Artificial Sequence: Synthetic polypeptide
QESEIATTNPVATECYGSVSENEPQHEGEL

SEQ ID NO: 90865 - protein, 31 aa, Artificial Sequence
  Description of Artificial Sequence: Synthetic polypeptide
QESEIATTNPVATECYGSVSENEPQHEGENL

SEQ ID NO: 90866 - protein, 28 aa, Artificial Sequence
  Description of Artificial Sequence: Synthetic peptide
QESEIATTNPVATECYGTVSECLQHEEL

SEQ ID NO: 90867 - protein, 28 aa, Artificial Sequence
  Description of Artificial Sequence: Synthetic peptide
QESEIATTNPVATECYGVVSETLQHEEI

SEQ ID NO: 90868 - protein, 28 aa, Artificial Sequence
  Description of Artificial Sequence: Synthetic peptide
QESEIATTNPVATECYGVVSETLQHEEL

SEQ ID NO: 90869 - protein, 28 aa, Artificial Sequence
  Description of Artificial Sequence: Synthetic peptide
QESEIATTNPVATEGYGDMASTLQHGDI

SEQ ID NO: 90870 - protein, 36 aa, Artificial Sequence
  Description of Artificial Sequence: Synthetic polypeptide
DEEEIRTTNPVATEQYGSCVVSITNLENGPEENDQE

SEQ ID NO: 90871 - protein, 36 aa, Artificial Sequence
  Description of Artificial Sequence: Synthetic polypeptide
DEEEIRATNPVATEQYGSVSTVNNLQNDEIGSNNET

SEQ ID NO: 90872 - protein, 35 aa, Artificial Sequence
  Description of Artificial Sequence: Synthetic polypeptide
DEEEIRTTNPVATEQYGSCVVSETNLDENGSEQMI

SEQ ID NO: 90873 - protein, 28 aa, Artificial Sequence
  Description of Artificial Sequence: Synthetic peptide
QESEIATTNPVATEGYGVMATTLQHGDL

SEQ ID NO: 90874 - protein, 28 aa, Artificial Sequence
  Description of Artificial Sequence: Synthetic peptide
QESEIATTNPVATEGYGVVSSTLQHEEL

SEQ ID NO: 90875 - protein, 28 aa, Artificial Sequence
  Description of Artificial Sequence: Synthetic peptide
QESEIATTNPVATEQWGSVPEVCQREEK

SEQ ID NO: 90876 - protein, 32 aa, Artificial Sequence
  Description of Artificial Sequence: Synthetic polypeptide
DEEEIRATNPVATEQYGSVCAGNGLQNSDESE

SEQ ID NO: 90877 - protein, 28 aa, Artificial Sequence
  Description of Artificial Sequence: Synthetic peptide
QESEIATTNPVATEQYGSAPEVCQHGEK

SEQ ID NO: 90878 - protein, 35 aa, Artificial Sequence
  Description of Artificial Sequence: Synthetic polypeptide
DEEEIRTTNPVATEQYGSCVSPAFNLLPQVDMVER

SEQ ID NO: 90879 - protein, 29 aa, Artificial Sequence
  Description of Artificial Sequence: Synthetic peptide
QESEIATTNPVATEQYGSASCVCQREEEK

SEQ ID NO: 90880 - protein, 28 aa, Artificial Sequence
  Description of Artificial Sequence: Synthetic peptide
QESEIATTNPVATEQYGSVPEVCQHEEK

SEQ ID NO: 90881 - protein, 28 aa, Artificial Sequence
  Description of Artificial Sequence: Synthetic peptide
QESEIATTNPVATEQYGVMPSTCQHGDI

SEQ ID NO: 90882 - protein, 31 aa, Artificial Sequence
  Description of Artificial Sequence: Synthetic polypeptide
QESEIATTNPVAYDHYGSVPSTNELSQRVND

SEQ ID NO: 90883 - protein, 35 aa, Artificial Sequence
  Description of Artificial Sequence: Synthetic polypeptide
AEEEIRTTNPVATEQYGSVSTVVNDQQGDEGNGNE

SEQ ID NO: 90884 - protein, 28 aa, Artificial Sequence
  Description of Artificial Sequence: Synthetic peptide
QEYEIAPTNPCSYEQYGEVSCNLQSGTR

SEQ ID NO: 90885 - protein, 36 aa, Artificial Sequence
  Description of Artificial Sequence: Synthetic polypeptide
DEEEIRATNPVATEQYGSVSTVTNLQNDEIGTNNEE

SEQ ID NO: 90886 - protein, 32 aa, Artificial Sequence
  Description of Artificial Sequence: Synthetic polypeptide
QESEIRPTNPVATECWGSVSCINEPQDREGNR

SEQ ID NO: 90887 - protein, 30 aa, Artificial Sequence
  Description of Artificial Sequence: Synthetic polypeptide
QESEIRTTNPVASEQWGIVSCNEQDSGENG

SEQ ID NO: 90888 - protein, 32 aa, Artificial Sequence
  Description of Artificial Sequence: Synthetic polypeptide
QESEIRTTNPVASEQWGSVSCNEPQDREGENG

SEQ ID NO: 90889 - protein, 31 aa, Artificial Sequence
  Description of Artificial Sequence: Synthetic polypeptide
QESEIRTTNPVASEQWGSVSCNEPQDSGENG

SEQ ID NO: 90890 - protein, 35 aa, Artificial Sequence
  Description of Artificial Sequence: Synthetic polypeptide
DEEEIRATNPVATEQYGVVSTTNQLLQLGGNNNTD

SEQ ID NO: 90891 - protein, 35 aa, Artificial Sequence
  Description of Artificial Sequence: Synthetic polypeptide
DEEEIRATNPVATEQYGVVSTTNQLLQSGNGNNEQ

SEQ ID NO: 90892 - protein, 35 aa, Artificial Sequence
  Description of Artificial Sequence: Synthetic polypeptide
DEEEIRATNPVATEQYGVVSTTNQNLQLGGNNGDD

SEQ ID NO: 90893 - protein, 30 aa, Artificial Sequence
  Description of Artificial Sequence: Synthetic polypeptide
QESEIRTTNPVATECWGSVACITLQRGEDG

SEQ ID NO: 90894 - protein, 30 aa, Artificial Sequence
  Description of Artificial Sequence: Synthetic polypeptide
QESEIRTTNPVATECWGSVPENEQHEGENG

SEQ ID NO: 90895 - protein, 30 aa, Artificial Sequence
  Description of Artificial Sequence: Synthetic polypeptide
QESEIRTTNPVATECWGSVPENEQHEGENK

SEQ ID NO: 90896 - protein, 31 aa, Artificial Sequence
  Description of Artificial Sequence: Synthetic polypeptide
QESEIRTTNPVATECWGSVSCCEPQREGENL

SEQ ID NO: 90897 - protein, 32 aa, Artificial Sequence
  Description of Artificial Sequence: Synthetic polypeptide
QESEIRTTNPVATECWGSVSCINEPQDRGENG

SEQ ID NO: 90898 - protein, 32 aa, Artificial Sequence
  Description of Artificial Sequence: Synthetic polypeptide
QESEIRTTNPVATECWGSVSCINEPQDRGENL

SEQ ID NO: 90899 - protein, 32 aa, Artificial Sequence
  Description of Artificial Sequence: Synthetic polypeptide
QESEIRTTNPVATECWGSVSCINEQDREGENG

SEQ ID NO: 90900 - protein, 32 aa, Artificial Sequence
  Description of Artificial Sequence: Synthetic polypeptide
QESEIRTTNPVATECWGSVSCINLPQDHGENL

SEQ ID NO: 90901 - protein, 32 aa, Artificial Sequence
  Description of Artificial Sequence: Synthetic polypeptide
QESEIRTTNPVATECWGSVSCITEPQREGENG

SEQ ID NO: 90902 - protein, 31 aa, Artificial Sequence
  Description of Artificial Sequence: Synthetic polypeptide
QESEIRTTNPVATECWGSVSCITEPQRGEDG

SEQ ID NO: 90903 - protein, 32 aa, Artificial Sequence
  Description of Artificial Sequence: Synthetic polypeptide
QESEIRTTNPVATECWGSVSCNEPQDREGENG

SEQ ID NO: 90904 - protein, 32 aa, Artificial Sequence
  Description of Artificial Sequence: Synthetic polypeptide
QESEIRTTNPVATECWGSVSCNEPQDREGENL

SEQ ID NO: 90905 - protein, 30 aa, Artificial Sequence
  Description of Artificial Sequence: Synthetic polypeptide
QESEIRTTNPVATECWGSVSCNLPQDHEEL

SEQ ID NO: 90906 - protein, 31 aa, Artificial Sequence
  Description of Artificial Sequence: Synthetic polypeptide
QESEIRTTNPVATECWGSVSCNLPQDHGEEL

SEQ ID NO: 90907 - protein, 32 aa, Artificial Sequence
  Description of Artificial Sequence: Synthetic polypeptide
QESEIRTTNPVATECWGSVSEINEPQDREGNG

SEQ ID NO: 90908 - protein, 31 aa, Artificial Sequence
  Description of Artificial Sequence: Synthetic polypeptide
QESEIRTTNPCATECWGSVSCINEQREGENG

SEQ ID NO: 90909 - protein, 28 aa, Artificial Sequence
  Description of Artificial Sequence: Synthetic peptide
QESEIRSTNPVGTEQYGVMASTLQHGDI

SEQ ID NO: 90910 - protein, 28 aa, Artificial Sequence
  Description of Artificial Sequence: Synthetic peptide
QESEIRSTNPVGTEQYGVMASTLQAGDI

SEQ ID NO: 90911 - protein, 35 aa, Artificial Sequence
  Description of Artificial Sequence: Synthetic polypeptide
DEEEIRATNPVATEQYGVVSTTNNLQQLGGNNIED

SEQ ID NO: 90912 - protein, 35 aa, Artificial Sequence
  Description of Artificial Sequence: Synthetic polypeptide
DEEEIRATNPVATEQYGSVSTVVNNQNDEGNNLDG

SEQ ID NO: 90913 - protein, 35 aa, Artificial Sequence
  Description of Artificial Sequence: Synthetic polypeptide
DEEEIRATNPVATEQYGSVSTVVNNQNDEGSNGDD

SEQ ID NO: 90914 - protein, 35 aa, Artificial Sequence
  Description of Artificial Sequence: Synthetic polypeptide
DEEEIRATNPVATEQYGSVSTVVNNQNDENGSNVD

SEQ ID NO: 90915 - protein, 34 aa, Artificial Sequence
  Description of Artificial Sequence: Synthetic polypeptide
DEEEIRATNPVATEQYGSVSTVVNQGDESGSNVD

SEQ ID NO: 90916 - protein, 34 aa, Artificial Sequence
  Description of Artificial Sequence: Synthetic polypeptide
DEEEIRTTNPVATEQYGSCSTNNLETGLESMQEM

SEQ ID NO: 90917 - protein, 31 aa, Artificial Sequence
  Description of Artificial Sequence: Synthetic polypeptide
QESEIRSTNPVATECWGSMSCINLPQDRGNG

SEQ ID NO: 90918 - protein, 30 aa, Artificial Sequence
  Description of Artificial Sequence: Synthetic polypeptide
QESEIRSTNPVATECWGSMSCITLPQRGNG

SEQ ID NO: 90919 - protein, 30 aa, Artificial Sequence
  Description of Artificial Sequence: Synthetic polypeptide
QESEIRSTNPVATECWGSMSCITLPQRGNI

SEQ ID NO: 90920 - protein, 32 aa, Artificial Sequence
  Description of Artificial Sequence: Synthetic polypeptide
QESEIRSTNPVATECWGSVSCINLPQDREGNG

SEQ ID NO: 90921 - protein, 30 aa, Artificial Sequence
  Description of Artificial Sequence: Synthetic polypeptide
QESEIRSTNPVATEGWGSMSCITLPQRGNI

SEQ ID NO: 90922 - protein, 34 aa, Artificial Sequence
  Description of Artificial Sequence: Synthetic polypeptide
DEEEIRATNPVATEQYGSVSTVTNQNDEIGSNNE

SEQ ID NO: 90923 - protein, 32 aa, Artificial Sequence
  Description of Artificial Sequence: Synthetic polypeptide
DEEEIRATNPVATEQYGSVTPVHSLPLVGFNQ

SEQ ID NO: 90924 - protein, 28 aa, Artificial Sequence
  Description of Artificial Sequence: Synthetic peptide
QESEIRSTNPVATEGYGVMASTLQHGDI

SEQ ID NO: 90925 - protein, 29 aa, Artificial Sequence
  Description of Artificial Sequence: Synthetic peptide
QESEIRSTNPVATEGYGVVASTLQHGEDI

SEQ ID NO: 90926 - protein, 28 aa, Artificial Sequence
  Description of Artificial Sequence: Synthetic peptide
QESEIRSTNPVATEQWGDMASTLQHGDA

SEQ ID NO: 90927 - protein, 32 aa, Artificial Sequence
  Description of Artificial Sequence: Synthetic polypeptide
QESEIRSTNPVATEQYGSVSASPTLQRNGDPV

SEQ ID NO: 90928 - protein, 34 aa, Artificial Sequence
  Description of Artificial Sequence: Synthetic polypeptide
DEEEIRATNPVATEQYGTVSNGTNLQSDVGGGGI

SEQ ID NO: 90929 - protein, 28 aa, Artificial Sequence
  Description of Artificial Sequence: Synthetic peptide
QESEIRSTNPVGTEGYGSVASALQHGDV

SEQ ID NO: 90930 - protein, 29 aa, Artificial Sequence
  Description of Artificial Sequence: Synthetic peptide
QESEIRSTNPVGTEGYGVVSSTLQRNGDV

SEQ ID NO: 90931 - protein, 32 aa, Artificial Sequence
  Description of Artificial Sequence: Synthetic polypeptide
DEEEIRATNPVATEQYGVSLGTDRPATVGGNR

SEQ ID NO: 90932 - protein, 30 aa, Artificial Sequence
  Description of Artificial Sequence: Synthetic polypeptide
QESEIRSTNPVGTEQYGSVASTGNHNGMNV

SEQ ID NO: 90933 - protein, 35 aa, Artificial Sequence
  Description of Artificial Sequence: Synthetic polypeptide
DEEEIRATNPVATEQYGVVSTTNNLLQGNGNNEFG

SEQ ID NO: 90934 - protein, 28 aa, Artificial Sequence
  Description of Artificial Sequence: Synthetic peptide
QESEIRSTNPVATEGYGSVASAGQHGDV

SEQ ID NO: 90935 - protein, 28 aa, Artificial Sequence
  Description of Artificial Sequence: Synthetic peptide
QESEIATTNPVATECYGSVPENEQHEEK

SEQ ID NO: 90936 - protein, 28 aa, Artificial Sequence
  Description of Artificial Sequence: Synthetic peptide
QEYEIATTNPVATECYGDVSECLQHEEL

SEQ ID NO: 90937 - protein, 33 aa, Artificial Sequence
  Description of Artificial Sequence: Synthetic polypeptide
DEEEIRTTNPVATEQYGSCNSENDDHAGQIERQ

SEQ ID NO: 90938 - protein, 35 aa, Artificial Sequence
  Description of Artificial Sequence: Synthetic polypeptide
AEEEIRTTNPVATEQYGSVSTVTNNNQQIGNNTTD

SEQ ID NO: 90939 - protein, 34 aa, Artificial Sequence
  Description of Artificial Sequence: Synthetic polypeptide
DEEEIRTTNPVATEQYGSASSTTPAGPNMRGNPV

SEQ ID NO: 90940 - protein, 33 aa, Artificial Sequence
  Description of Artificial Sequence: Synthetic polypeptide
DEEEIRTTNPVATEQYGSASSTTPAGPNMHGNV

SEQ ID NO: 90941 - protein, 34 aa, Artificial Sequence
  Description of Artificial Sequence: Synthetic polypeptide
DEEEIRTTNPVATEQYGSASSTTPAGNMRNGMNV

SEQ ID NO: 90942 - protein, 28 aa, Artificial Sequence
  Description of Artificial Sequence: Synthetic peptide
SEECIACTNPEATAQWGSVSENLDNGNH

SEQ ID NO: 90943 - protein, 34 aa, Artificial Sequence
  Description of Artificial Sequence: Synthetic polypeptide
DEEEIRTTNPVATEQYGSASSTTPACNMRNGMNV

SEQ ID NO: 90944 - protein, 35 aa, Artificial Sequence
  Description of Artificial Sequence: Synthetic polypeptide
DEEEIRTTNPVATEQYGSASSTTAGPNMRNGMNPR

SEQ ID NO: 90945 - protein, 33 aa, Artificial Sequence
  Description of Artificial Sequence: Synthetic polypeptide
DEEEIRTTNPVATEQYGSASSTPVCNMRNEMNK

SEQ ID NO: 90946 - protein, 34 aa, Artificial Sequence
  Description of Artificial Sequence: Synthetic polypeptide
DEEEIRTTNPVATEQYGSASSTPAGPNMRNGMNV

SEQ ID NO: 90947 - protein, 28 aa, Artificial Sequence
  Description of Artificial Sequence: Synthetic peptide
SEECIACTNPIAYAQWGSVSENLDRGNE

SEQ ID NO: 90948 - protein, 34 aa, Artificial Sequence
  Description of Artificial Sequence: Synthetic polypeptide
DEEEIRTTNPVATEQYGSASSTEPAGPNMRGMNV

SEQ ID NO: 90949 - protein, 29 aa, Artificial Sequence
  Description of Artificial Sequence: Synthetic peptide
SEECIACTNPIAYEEPYGSVSENLMRGDR

SEQ ID NO: 90950 - protein, 30 aa, Artificial Sequence
  Description of Artificial Sequence: Synthetic polypeptide
SEECIACTNPTATEQYGSVASNLMNRGNEM

SEQ ID NO: 90951 - protein, 35 aa, Artificial Sequence
  Description of Artificial Sequence: Synthetic polypeptide
AEEEIRTTNPVATEQYGSVSTVTNNNQQGIGNTED

SEQ ID NO: 90952 - protein, 30 aa, Artificial Sequence
  Description of Artificial Sequence: Synthetic polypeptide
SEECIACTNPTAYEQYGSVAANLMRHGNER

SEQ ID NO: 90953 - protein, 29 aa, Artificial Sequence
  Description of Artificial Sequence: Synthetic peptide
SEECIACTNPTAYEQYGSVAENLARGNEM

SEQ ID NO: 90954 - protein, 34 aa, Artificial Sequence
  Description of Artificial Sequence: Synthetic polypeptide
DEEEIRTTNPVATEQYGSASPVTQSLQRSEVEGA

SEQ ID NO: 90955 - protein, 34 aa, Artificial Sequence
  Description of Artificial Sequence: Synthetic polypeptide
DEEEIRTTNPVATEQYGSASPTTSTLPGRGVEFN

SEQ ID NO: 90956 - protein, 29 aa, Artificial Sequence
  Description of Artificial Sequence: Synthetic peptide
SEECIACTNPTAYEQYGSVAENLMRGTER

SEQ ID NO: 90957 - protein, 30 aa, Artificial Sequence
  Description of Artificial Sequence: Synthetic polypeptide
SEECIACTNPTAYEQYGSVAENLNRGNERF

SEQ ID NO: 90958 - protein, 29 aa, Artificial Sequence
  Description of Artificial Sequence: Synthetic peptide
SEECIACTNPTAYEQYGSVAENLNRGNQM

SEQ ID NO: 90959 - protein, 32 aa, Artificial Sequence
  Description of Artificial Sequence: Synthetic polypeptide
SEDEIRTTNPVAYERYGSCNCTNLDQPEGNNR

SEQ ID NO: 90960 - protein, 29 aa, Artificial Sequence
  Description of Artificial Sequence: Synthetic peptide
SEECIACTNPTAYEQYGSVAPNLNRGNES

SEQ ID NO: 90961 - protein, 35 aa, Artificial Sequence
  Description of Artificial Sequence: Synthetic polypeptide
DEEEIRTTNPVATEQYGSASSTTPAGQMRNGMGPR

SEQ ID NO: 90962 - protein, 32 aa, Artificial Sequence
  Description of Artificial Sequence: Synthetic polypeptide
DEEEIRTTNPVATEQYGSASSTVCNMRNEMEK

SEQ ID NO: 90963 - protein, 35 aa, Artificial Sequence
  Description of Artificial Sequence: Synthetic polypeptide
AEEEIRTTNPVATEQYGSVSTVTNNQNDESGTNVD

SEQ ID NO: 90964 - protein, 32 aa, Artificial Sequence
  Description of Artificial Sequence: Synthetic polypeptide
SEDEIATTNPVATEPYGSVAATNLQDDDGGNN

SEQ ID NO: 90965 - protein, 32 aa, Artificial Sequence
  Description of Artificial Sequence: Synthetic polypeptide
DEEEIRTTNPVATEQYGSATPTNNDREIPEAE

SEQ ID NO: 90966 - protein, 34 aa, Artificial Sequence
  Description of Artificial Sequence: Synthetic polypeptide
DEEEIRTTNPVATEQYGSATPTNLSNETGVNENF

SEQ ID NO: 90967 - protein, 35 aa, Artificial Sequence
  Description of Artificial Sequence: Synthetic polypeptide
AEEEIRTTNPVATEQYGSVSTVTNNQNAEQGNNNQ

SEQ ID NO: 90968 - protein, 31 aa, Artificial Sequence
  Description of Artificial Sequence: Synthetic polypeptide
SEDEIRATNPVATEQYGSVFCELDQHGGNHQ

SEQ ID NO: 90969 - protein, 31 aa, Artificial Sequence
  Description of Artificial Sequence: Synthetic polypeptide
SEDEIRATNPVATEQYGSVFCELQHHGGGNQ

SEQ ID NO: 90970 - protein, 31 aa, Artificial Sequence
  Description of Artificial Sequence: Synthetic polypeptide
SEDEIRCTNPCATEQYGSVCSPENLHGGNID

SEQ ID NO: 90971 - protein, 33 aa, Artificial Sequence
  Description of Artificial Sequence: Synthetic polypeptide
DEEEIRTTNPVATEQYGSASTTGLEVILANIQE

SEQ ID NO: 90972 - protein, 32 aa, Artificial Sequence
  Description of Artificial Sequence: Synthetic polypeptide
DEEEIRCTNPVATEQYGCVCSWGNHDSGSNTA

SEQ ID NO: 90973 - protein, 36 aa, Artificial Sequence
  Description of Artificial Sequence: Synthetic polypeptide
AEEEIRTTNPVATEQYGSVSTVTNNQLNQDEQGNED

SEQ ID NO: 90974 - protein, 34 aa, Artificial Sequence
  Description of Artificial Sequence: Synthetic polypeptide
DEEEIRTTNPVATEQYGSASTNNLEVSQMVSLHD

SEQ ID NO: 90975 - protein, 32 aa, Artificial Sequence
  Description of Artificial Sequence: Synthetic polypeptide
SEDEIRCTNPVATEQYGSVYCTWNDQHGQNQA

SEQ ID NO: 90976 - protein, 32 aa, Artificial Sequence
  Description of Artificial Sequence: Synthetic polypeptide
DEEEIRCTNPVATEQYGCVCSWNPDGGSDNQG

SEQ ID NO: 90977 - protein, 31 aa, Artificial Sequence
  Description of Artificial Sequence: Synthetic polypeptide
SEDEIRSTNPVATEQYGSVFCELQDHGNHQD

SEQ ID NO: 90978 - protein, 34 aa, Artificial Sequence
  Description of Artificial Sequence: Synthetic polypeptide
DEEEIRCTNPVATEQYGCVSMTENDFQGFGSNQG

SEQ ID NO: 90979 - protein, 33 aa, Artificial Sequence
  Description of Artificial Sequence: Synthetic polypeptide
DEEEIRCTNPVATEQYGCVSMTNDFQGFGSEQM

SEQ ID NO: 90980 - protein, 33 aa, Artificial Sequence
  Description of Artificial Sequence: Synthetic polypeptide
DEEEIRCTNPVATEQYGCVSMTPDFQGFGSNQS

SEQ ID NO: 90981 - protein, 33 aa, Artificial Sequence
  Description of Artificial Sequence: Synthetic polypeptide
DEEEIRCTNPVATEQYGCVSWGNTDRFGSNTQS

SEQ ID NO: 90982 - protein, 34 aa, Artificial Sequence
  Description of Artificial Sequence: Synthetic polypeptide
DEEEIRCTNPVATEQYGEASSTEPNGQRNGMGPR

SEQ ID NO: 90983 - protein, 31 aa, Artificial Sequence
  Description of Artificial Sequence: Synthetic polypeptide
SEDEIRTTNPVAYEQWGEVSTNLQLGEDDMS

SEQ ID NO: 90984 - protein, 34 aa, Artificial Sequence
  Description of Artificial Sequence: Synthetic polypeptide
DEEEIRTTNPVATEQYGSASSTTPVCNMRNGMNV

SEQ ID NO: 90985 - protein, 29 aa, Artificial Sequence
  Description of Artificial Sequence: Synthetic peptide
SEECIACTNPTAYEQYGSVASNLNRGMER

SEQ ID NO: 90986 - protein, 30 aa, Artificial Sequence
  Description of Artificial Sequence: Synthetic polypeptide
SEECIACTNPTAYEQYGSVSANLMRGNEDV

SEQ ID NO: 90987 - protein, 30 aa, Artificial Sequence
  Description of Artificial Sequence: Synthetic polypeptide
SEECIACTNPTAYEQYGSVSENLMRGNEVM

SEQ ID NO: 90988 - protein, 32 aa, Artificial Sequence
  Description of Artificial Sequence: Synthetic polypeptide
DEEEIRTTNPVATEQYGSASEGLEVRMMVVEE

SEQ ID NO: 90989 - protein, 33 aa, Artificial Sequence
  Description of Artificial Sequence: Synthetic polypeptide
DEEEIRTTNPVATEQYGSASDVWLNNQDGQEMQ

SEQ ID NO: 90990 - protein, 31 aa, Artificial Sequence
  Description of Artificial Sequence: Synthetic polypeptide
SEEDIRCTNPCATEQYGHVCSPENLHRGNFD

SEQ ID NO: 90991 - protein, 31 aa, Artificial Sequence
  Description of Artificial Sequence: Synthetic polypeptide
SEEDIRCTNPCATEQYGSVNSEVLERGSNQE

SEQ ID NO: 90992 - protein, 35 aa, Artificial Sequence
  Description of Artificial Sequence: Synthetic polypeptide
AEEEIRTTNPVATEQYGSVSTVTNNNNQQTGNNVE

SEQ ID NO: 90993 - protein, 35 aa, Artificial Sequence
  Description of Artificial Sequence: Synthetic polypeptide
AEEEIRTTNPVATEQYGSVSTVTNNNNQQDTGNVE

SEQ ID NO: 90994 - protein, 35 aa, Artificial Sequence
  Description of Artificial Sequence: Synthetic polypeptide
AEEEIRTTNPVATEQYGSVSTVTNNNNQDNGNNVE

SEQ ID NO: 90995 - protein, 32 aa, Artificial Sequence
  Description of Artificial Sequence: Synthetic polypeptide
DEEEIRTTNPVATEQYGSAPVYDLVQRDTQQE

SEQ ID NO: 90996 - protein, 33 aa, Artificial Sequence
  Description of Artificial Sequence: Synthetic polypeptide
DEEEIRTTNPVATEQYGSAPVTNALEQIDTQQE

SEQ ID NO: 90997 - protein, 33 aa, Artificial Sequence
  Description of Artificial Sequence: Synthetic polypeptide
DEEEIRTTNPVATEQYGSAPVPNLVQQRDEIQE

SEQ ID NO: 90998 - protein, 28 aa, Artificial Sequence
  Description of Artificial Sequence: Synthetic peptide
SEEEIACTNPIATEQYGEAPENCQHGNK

SEQ ID NO: 90999 - protein, 28 aa, Artificial Sequence
  Description of Artificial Sequence: Synthetic peptide
SEEEIACTNPIATEQYGEASEVLQHENK

SEQ ID NO: 91000 - protein, 33 aa, Artificial Sequence
  Description of Artificial Sequence: Synthetic polypeptide
DEEEIRTTNPVATEQYGSANSVINDDDRSNEHT

SEQ ID NO: 91001 - protein, 33 aa, Artificial Sequence
  Description of Artificial Sequence: Synthetic polypeptide
DEEEIRTTNPVATEQYGSANSVFNDDDRSNEGM

SEQ ID NO: 91002 - protein, 35 aa, Artificial Sequence
  Description of Artificial Sequence: Synthetic polypeptide
DEEEIRTTNPVATEQYGSANSTNIDDDQRGTEEIN

SEQ ID NO: 91003 - protein, 28 aa, Artificial Sequence
  Description of Artificial Sequence: Synthetic peptide
SEEEIACTNPIATEQYGSAPENCMHGNK

SEQ ID NO: 91004 - protein, 35 aa, Artificial Sequence
  Description of Artificial Sequence: Synthetic polypeptide
AEEEIRTTNPVATEQYGSVSTVTNNNLNNQGNNNQ

SEQ ID NO: 91005 - protein, 36 aa, Artificial Sequence
  Description of Artificial Sequence: Synthetic polypeptide
AEEEIRTTNPVATEQYGSVSTVTNNLQQGNTNNQDN

SEQ ID NO: 91006 - protein, 36 aa, Artificial Sequence
  Description of Artificial Sequence: Synthetic polypeptide
AEEEIRTTNPVATEQYGSVSTVTNNLQQGNTEAGNE

SEQ ID NO: 91007 - protein, 36 aa, Artificial Sequence
  Description of Artificial Sequence: Synthetic polypeptide
AEEEIRTTNPVATEQYGSVSTVTNNLQQGENEENSE

SEQ ID NO: 91008 - protein, 36 aa, Artificial Sequence
  Description of Artificial Sequence: Synthetic polypeptide
AEEEIRTTNPVATEQYGSVSTVTNNLNQNQENGNSQ

SEQ ID NO: 91009 - protein, 31 aa, Artificial Sequence
  Description of Artificial Sequence: Synthetic polypeptide
SEECISTTNPVATEQYGSVCSWNHQNFGSDQ

SEQ ID NO: 91010 - protein, 31 aa, Artificial Sequence
  Description of Artificial Sequence: Synthetic polypeptide
SEECISTTNPVATEQYGCVCSWNPQNGSNNQ

SEQ ID NO: 91011 - protein, 30 aa, Artificial Sequence
  Description of Artificial Sequence: Synthetic polypeptide
SEECISTTNPVATEQYGCVCSWNPQNFGDQ

SEQ ID NO: 91012 - protein, 35 aa, Artificial Sequence
  Description of Artificial Sequence: Synthetic polypeptide
DEEEIRCTNPVATEQYGSVAAYTLPMVQRNGNARS

SEQ ID NO: 91013 - protein, 30 aa, Artificial Sequence
  Description of Artificial Sequence: Synthetic polypeptide
SEECIACTNPTAYEQYGSVSENLMRHGDER

SEQ ID NO: 91014 - protein, 31 aa, Artificial Sequence
  Description of Artificial Sequence: Synthetic polypeptide
SEECIACTNPTAYEQYGSVSENLMTRGNERQ

SEQ ID NO: 91015 - protein, 35 aa, Artificial Sequence
  Description of Artificial Sequence: Synthetic polypeptide
AEEEIRTTNPVATEQYGSVSTVTNNNQQDEGNNVE

SEQ ID NO: 91016 - protein, 35 aa, Artificial Sequence
  Description of Artificial Sequence: Synthetic polypeptide
DEEEIRTTNPVATEQYGSASPTFTPLEQRLVNEPG

SEQ ID NO: 91017 - protein, 30 aa, Artificial Sequence
  Description of Artificial Sequence: Synthetic polypeptide
SEECIACTNPTAYEQYGSVSPENLMRGNED

SEQ ID NO: 91018 - protein, 35 aa, Artificial Sequence
  Description of Artificial Sequence: Synthetic polypeptide
DEEEIRTTNPVATEQYGSASPTFEHIQIRHGNAQD

SEQ ID NO: 91019 - protein, 29 aa, Artificial Sequence
  Description of Artificial Sequence: Synthetic peptide
SEECIACTNPTAYEVYGSVANNLNRGNER

SEQ ID NO: 91020 - protein, 32 aa, Artificial Sequence
  Description of Artificial Sequence: Synthetic polypeptide
DEEEIRCTNPVATEQYGSASSEALNMRNGMGV

SEQ ID NO: 91021 - protein, 29 aa, Artificial Sequence
  Description of Artificial Sequence: Synthetic peptide
SEECIACTNPTAYMQYGSVSANLDRGNEM

SEQ ID NO: 91022 - protein, 33 aa, Artificial Sequence
  Description of Artificial Sequence: Synthetic polypeptide
DEEEIRCTNPVATEQYGSASSTEALNMRNGMGV

SEQ ID NO: 91023 - protein, 35 aa, Artificial Sequence
  Description of Artificial Sequence: Synthetic polypeptide
SEDEAEIRTTNPVAYEQWGSVSTNLQGNQRDGNDM

SEQ ID NO: 91024 - protein, 35 aa, Artificial Sequence
  Description of Artificial Sequence: Synthetic polypeptide
DEEEIRTTNPVATEQYGSASPTEMHIQQTIGNAGR

SEQ ID NO: 91025 - protein, 33 aa, Artificial Sequence
  Description of Artificial Sequence: Synthetic polypeptide
DEEEIRTTNPVATEQYGSASPTEACQMRNEEPV

SEQ ID NO: 91026 - protein, 33 aa, Artificial Sequence
  Description of Artificial Sequence: Synthetic polypeptide
DEEEIRTTNPVATEQYGSASPTEACQMRNEEPK

SEQ ID NO: 91027 - protein, 29 aa, Artificial Sequence
  Description of Artificial Sequence: Synthetic peptide
SEECIACTNPTTYEPYGSVSENLMRGNER

SEQ ID NO: 91028 - protein, 34 aa, Artificial Sequence
  Description of Artificial Sequence: Synthetic polypeptide
DEEEIRCTNPVATEQYGSASSTENGPNMRGMGPR

SEQ ID NO: 91029 - protein, 29 aa, Artificial Sequence
  Description of Artificial Sequence: Synthetic peptide
SEECIACTNPVAYEQYGQVSTINVQADNN

SEQ ID NO: 91030 - protein, 34 aa, Artificial Sequence
  Description of Artificial Sequence: Synthetic polypeptide
DEEEIRTTNPVATEQYGSASPETSSLQRQEVEGD

SEQ ID NO: 91031 - protein, 32 aa, Artificial Sequence
  Description of Artificial Sequence: Synthetic polypeptide
SEECIRTTNPVATDQWGKVSMTNMDVQYGNRV

SEQ ID NO: 91032 - protein, 31 aa, Artificial Sequence
  Description of Artificial Sequence: Synthetic polypeptide
SEECIRTTNPVAWEQYGQVCTINVQGQGNIV

SEQ ID NO: 91033 - protein, 34 aa, Artificial Sequence
  Description of Artificial Sequence: Synthetic polypeptide
DEEEIRCTNPVATEQYGSASSTEPNGPNMRGMNV

SEQ ID NO: 91034 - protein, 32 aa, Artificial Sequence
  Description of Artificial Sequence: Synthetic polypeptide
DEEEIRCTNPVATEQYGSCANSASNLNQIDEM

SEQ ID NO: 91035 - protein, 35 aa, Artificial Sequence
  Description of Artificial Sequence: Synthetic polypeptide
DEEEIRTTNPVATEQYGSASPTEFHIQHTIGNANR

SEQ ID NO: 91036 - protein, 35 aa, Artificial Sequence
  Description of Artificial Sequence: Synthetic polypeptide
AEEEIRTTNPVATEQYGSVSTVTNNQNGDEANEDD

SEQ ID NO: 91037 - protein, 32 aa, Artificial Sequence
  Description of Artificial Sequence: Synthetic polypeptide
SECEIATTNPVATEGYGTVSTNLQGGNGGNTS

SEQ ID NO: 91038 - protein, 32 aa, Artificial Sequence
  Description of Artificial Sequence: Synthetic polypeptide
SECEIATTNPVATEGYGTVSTNLQGDTGGNNQ

SEQ ID NO: 91039 - protein, 31 aa, Artificial Sequence
  Description of Artificial Sequence: Synthetic polypeptide
SAEEIATTNPVATAQWGSVSTDLQHGGNESL

SEQ ID NO: 91040 - protein, 31 aa, Artificial Sequence
  Description of Artificial Sequence: Synthetic polypeptide
SAEEIATTNPVATAQWGSVSTDLQNHGNESW

SEQ ID NO: 91041 - protein, 34 aa, Artificial Sequence
  Description of Artificial Sequence: Synthetic polypeptide
DEEEIRTTNPVATEQYGSCFVPPTNLENGSEQEV

SEQ ID NO: 91042 - protein, 30 aa, Artificial Sequence
  Description of Artificial Sequence: Synthetic polypeptide
SAEEIATTNPVATAQWGSVSTGNPDDDGNN

SEQ ID NO: 91043 - protein, 35 aa, Artificial Sequence
  Description of Artificial Sequence: Synthetic polypeptide
AEEEIRTTNPVATEQYGSVSTVTNVNNQQGTENQE

SEQ ID NO: 91044 - protein, 34 aa, Artificial Sequence
  Description of Artificial Sequence: Synthetic polypeptide
AEEEIRTTNPVATEQYGSVSTVTNVNNQGEEENE

SEQ ID NO: 91045 - protein, 33 aa, Artificial Sequence
  Description of Artificial Sequence: Synthetic polypeptide
DEEEIRCTNPVATEQYGCVCSMTEDNQGFGNQA

SEQ ID NO: 91046 - protein, 32 aa, Artificial Sequence
  Description of Artificial Sequence: Synthetic polypeptide
SAEEIATTNPVATEQWGCVAGTNGLQDEGGNR

SEQ ID NO: 91047 - protein, 32 aa, Artificial Sequence
  Description of Artificial Sequence: Synthetic polypeptide
SAEEIATTNPVATEQWGCVAGTNLQDESGNER

SEQ ID NO: 91048 - protein, 31 aa, Artificial Sequence
  Description of Artificial Sequence: Synthetic polypeptide
SAEEIATTNPVATEQWGCVAGTNLQEGDNQD

SEQ ID NO: 91049 - protein, 31 aa, Artificial Sequence
  Description of Artificial Sequence: Synthetic polypeptide
SAEEIATTNPVATEQWGCVAGTNLQEGDQRN

SEQ ID NO: 91050 - protein, 31 aa, Artificial Sequence
  Description of Artificial Sequence: Synthetic polypeptide
SAEEIATTNPVATEQWGCVAGTNLQEMGMRN

SEQ ID NO: 91051 - protein, 31 aa, Artificial Sequence
  Description of Artificial Sequence: Synthetic polypeptide
SAEEIATTNPVATEQWGCVAGTNLQNEMGER

SEQ ID NO: 91052 - protein, 32 aa, Artificial Sequence
  Description of Artificial Sequence: Synthetic polypeptide
SAEEIATTNPVATEQWGSVTGTNHLQTEGGTR

SEQ ID NO: 91053 - protein, 33 aa, Artificial Sequence
  Description of Artificial Sequence: Synthetic polypeptide
SAEEIATTNPVATEQYGSVAATANLQEAGNVDN

SEQ ID NO: 91054 - protein, 33 aa, Artificial Sequence
  Description of Artificial Sequence: Synthetic polypeptide
SAEEIATTNPVATEQYGSVCAANLQDSDGNPRE

SEQ ID NO: 91055 - protein, 36 aa, Artificial Sequence
  Description of Artificial Sequence: Synthetic polypeptide
AEEEIRTTNPVATEQYGSVSTVTNSNLNNEQAGNVE

SEQ ID NO: 91056 - protein, 36 aa, Artificial Sequence
  Description of Artificial Sequence: Synthetic polypeptide
AEEEIRTTNPVATEQYGSVSTVTNSNLNGEQAGNNV

SEQ ID NO: 91057 - protein, 36 aa, Artificial Sequence
  Description of Artificial Sequence: Synthetic polypeptide
AEEEIRTTNPVATEQYGSVSTVTNSNLGNEQAGNVD

SEQ ID NO: 91058 - protein, 31 aa, Artificial Sequence
  Description of Artificial Sequence: Synthetic polypeptide
SAEEIRATNPVATEQYGSASTNHQADPNSNN

SEQ ID NO: 91059 - protein, 33 aa, Artificial Sequence
  Description of Artificial Sequence: Synthetic polypeptide
SAEEIRSTNPVATEQYGSVSPTNDLETQFEQQR

SEQ ID NO: 91060 - protein, 33 aa, Artificial Sequence
  Description of Artificial Sequence: Synthetic polypeptide
DEEEIRTTNPVATEQYGSCGPTDELELGTDERE

SEQ ID NO: 91061 - protein, 33 aa, Artificial Sequence
  Description of Artificial Sequence: Synthetic polypeptide
DEEEIRCTNPVATEQYGCVCSDTELNQNFSSNQ

SEQ ID NO: 91062 - protein, 30 aa, Artificial Sequence
  Description of Artificial Sequence: Synthetic polypeptide
SAEEIATTNPVATAQWGSVSGTGLQHGTAH

SEQ ID NO: 91063 - protein, 30 aa, Artificial Sequence
  Description of Artificial Sequence: Synthetic polypeptide
SAEEIATTNPVATAQWGCVSTGLPAQGGNH

SEQ ID NO: 91064 - protein, 33 aa, Artificial Sequence
  Description of Artificial Sequence: Synthetic polypeptide
DEEEIRTTNPVATEQYGSCNNTTPLDEGMENEI

SEQ ID NO: 91065 - protein, 32 aa, Artificial Sequence
  Description of Artificial Sequence: Synthetic polypeptide
DEEEIRTTNPVATEQYGSCNNSNDSEGMNEIQ

SEQ ID NO: 91066 - protein, 32 aa, Artificial Sequence
  Description of Artificial Sequence: Synthetic polypeptide
DEEEIRTTNPVATEQYGSCNNSNDFEGNNEIQ

SEQ ID NO: 91067 - protein, 34 aa, Artificial Sequence
  Description of Artificial Sequence: Synthetic polypeptide
REEEIATTNPVATEQYGSVPTDNFLPEPRDGMLR

SEQ ID NO: 91068 - protein, 35 aa, Artificial Sequence
  Description of Artificial Sequence: Synthetic polypeptide
AEEEIRTTNPVATEQYGSVSTVTTNLQNENNNNTQ

SEQ ID NO: 91069 - protein, 36 aa, Artificial Sequence
  Description of Artificial Sequence: Synthetic polypeptide
AEEEIRTTNPVATEQYGSVSTVTSNLGNNNQAGNVD

SEQ ID NO: 91070 - protein, 33 aa, Artificial Sequence
  Description of Artificial Sequence: Synthetic polypeptide
AEEEIRTTNPVATEQYGSVSTVTQQQQTNNANQ

SEQ ID NO: 91071 - protein, 33 aa, Artificial Sequence
  Description of Artificial Sequence: Synthetic polypeptide
AEEEIRTTNPVATEQYGSVSTVTQQQNNIENEQ

SEQ ID NO: 91072 - protein, 28 aa, Artificial Sequence
  Description of Artificial Sequence: Synthetic peptide
REGEIAPTNPCSSEQYGIVSCNLQSGTR

SEQ ID NO: 91073 - protein, 30 aa, Artificial Sequence
  Description of Artificial Sequence: Synthetic polypeptide
RENEIACTNPVATEQYGEATANENLQRGGR

SEQ ID NO: 91074 - protein, 34 aa, Artificial Sequence
  Description of Artificial Sequence: Synthetic polypeptide
AEEEIRTTNPVATEQYGSVSTVTNQQQQQETNNQ

SEQ ID NO: 91075 - protein, 28 aa, Artificial Sequence
  Description of Artificial Sequence: Synthetic peptide
RENEIATTNPVATECYGDVSECLQHEEL

SEQ ID NO: 91076 - protein, 30 aa, Artificial Sequence
  Description of Artificial Sequence: Synthetic polypeptide
DEEEIRCTNPVATEQWGDVSEIEMNRAGDA

SEQ ID NO: 91077 - protein, 35 aa, Artificial Sequence
  Description of Artificial Sequence: Synthetic polypeptide
DEEEIRTTNPVATEQYGSCMPCNTQNLYGRGATTR

SEQ ID NO: 91078 - protein, 33 aa, Artificial Sequence
  Description of Artificial Sequence: Synthetic polypeptide
DEEEIRTTNPVATEQYGSCITVNELEVDGQLDG

SEQ ID NO: 91079 - protein, 32 aa, Artificial Sequence
  Description of Artificial Sequence: Synthetic polypeptide
REQEIRTTNPVATEQYGCVATALQPEGQDTRQ

SEQ ID NO: 91080 - protein, 33 aa, Artificial Sequence
  Description of Artificial Sequence: Synthetic polypeptide
DEEEIRCTNPVATEQWGSVSCINEPMDREGENG

SEQ ID NO: 91081 - protein, 30 aa, Artificial Sequence
  Description of Artificial Sequence: Synthetic polypeptide
DEEEIRCTNPVATEQWGSVSEILMNAAEDA

SEQ ID NO: 91082 - protein, 30 aa, Artificial Sequence
  Description of Artificial Sequence: Synthetic polypeptide
REQEIRTTNPVATEQYGCVATANQPEGQFY

SEQ ID NO: 91083 - protein, 33 aa, Artificial Sequence
  Description of Artificial Sequence: Synthetic polypeptide
RESEIRTTNPVATECWGSVSCTNEPQDREGENG

SEQ ID NO: 91084 - protein, 30 aa, Artificial Sequence
  Description of Artificial Sequence: Synthetic polypeptide
SAAEIACTNPVATEPYGSVATNLQMPGQRA

SEQ ID NO: 91085 - protein, 29 aa, Artificial Sequence
  Description of Artificial Sequence: Synthetic peptide
SAEEIATTNPVATAAWGSVAGTGLQNGNA

SEQ ID NO: 91086 - protein, 29 aa, Artificial Sequence
  Description of Artificial Sequence: Synthetic peptide
RENEIATTNPVATECYGDVSTECLQHEEL

SEQ ID NO: 91087 - protein, 33 aa, Artificial Sequence
  Description of Artificial Sequence: Synthetic polypeptide
DEEEIRTTNPVATEQYGSCNTFTVELERENFVN

SEQ ID NO: 91088 - protein, 35 aa, Artificial Sequence
  Description of Artificial Sequence: Synthetic polypeptide
AEEEIRTTNPVATEQYGSVSTVTNQQQQNGNIGNE

SEQ ID NO: 91089 - protein, 35 aa, Artificial Sequence
  Description of Artificial Sequence: Synthetic polypeptide
AEEEIRTTNPVATEQYGSVSTVTNQQQQGNDEEQD

SEQ ID NO: 91090 - protein, 35 aa, Artificial Sequence
  Description of Artificial Sequence: Synthetic polypeptide
AEEEIRTTNPVATEQYGSVSTVTNQLQQQNINTTE

SEQ ID NO: 91091 - protein, 35 aa, Artificial Sequence
  Description of Artificial Sequence: Synthetic polypeptide
DEEEIRTTNPVATEQYGSAVSTNEDEQQPGPDEEG

SEQ ID NO: 91092 - protein, 34 aa, Artificial Sequence
  Description of Artificial Sequence: Synthetic polypeptide
SEAEIATTNPVATEQYGSVCSTNPLQEAGENHWN

SEQ ID NO: 91093 - protein, 35 aa, Artificial Sequence
  Description of Artificial Sequence: Synthetic polypeptide
AEEEIRTTNPVATEQYGSVSTVTNQGQQGNNNQNQ

SEQ ID NO: 91094 - protein, 31 aa, Artificial Sequence
  Description of Artificial Sequence: Synthetic polypeptide
SEAEIATTNPVATESYGSVAGTNLARDGDQN

SEQ ID NO: 91095 - protein, 36 aa, Artificial Sequence
  Description of Artificial Sequence: Synthetic polypeptide
DEEEIRTTNPVATEQYGSAVSPTTNHNTQVGEENQG

SEQ ID NO: 91096 - protein, 31 aa, Artificial Sequence
  Description of Artificial Sequence: Synthetic polypeptide
SEAEIATTNPVAYEQYGSVAITNLQQHNDNE

SEQ ID NO: 91097 - protein, 31 aa, Artificial Sequence
  Description of Artificial Sequence: Synthetic polypeptide
SEAEIATTNPVAYEQYGSVAMNLNRNLNERN

SEQ ID NO: 91098 - protein, 33 aa, Artificial Sequence
  Description of Artificial Sequence: Synthetic polypeptide
SEAEIATTNPVAYEQYGSVATNLQGTPDGNDRN

SEQ ID NO: 91099 - protein, 31 aa, Artificial Sequence
  Description of Artificial Sequence: Synthetic polypeptide
SEAEIATTNPVAYEQYGSVATNLQTRNPEGL

SEQ ID NO: 91100 - protein, 31 aa, Artificial Sequence
  Description of Artificial Sequence: Synthetic polypeptide
DEEEIRCTNPVATEQYGCVCSSNHDNGSDTA

SEQ ID NO: 91101 - protein, 33 aa, Artificial Sequence
  Description of Artificial Sequence: Synthetic polypeptide
DEEEIRCTNPVATEQYGCVCSSNHDRFGSNSAS

SEQ ID NO: 91102 - protein, 34 aa, Artificial Sequence
  Description of Artificial Sequence: Synthetic polypeptide
DEEEIRTTNPVATEQYGSAVSATNEDFVENDEEQ

SEQ ID NO: 91103 - protein, 31 aa, Artificial Sequence
  Description of Artificial Sequence: Synthetic polypeptide
SEAEIATTNPVAYEQYGSVVATTNLQQNPNQ

SEQ ID NO: 91104 - protein, 32 aa, Artificial Sequence
  Description of Artificial Sequence: Synthetic polypeptide
DEEEIRCTNPVATEQYGCVCSSNHDYGSNNAS

SEQ ID NO: 91105 - protein, 35 aa, Artificial Sequence
  Description of Artificial Sequence: Synthetic polypeptide
AEEEIRTTNPVATEQYGSVSTVTNNQTNGDEENED

SEQ ID NO: 91106 - protein, 32 aa, Artificial Sequence
  Description of Artificial Sequence: Synthetic polypeptide
DEEEIRCTNPVATEQYGCVCSTEHQNFGSQQA

SEQ ID NO: 91107 - protein, 33 aa, Artificial Sequence
  Description of Artificial Sequence: Synthetic polypeptide
SEAEIRTTNPVATEQYGCVSPTNLENREGVIDE

SEQ ID NO: 91108 - protein, 33 aa, Artificial Sequence
  Description of Artificial Sequence: Synthetic polypeptide
SEAEIRTTNPVAYEQYGSCQNCTNLDQPEGNNR

SEQ ID NO: 91109 - protein, 32 aa, Artificial Sequence
  Description of Artificial Sequence: Synthetic polypeptide
SECEIATTNPVATEAWGSVSTNLQQGGDGGNW

SEQ ID NO: 91110 - protein, 32 aa, Artificial Sequence
  Description of Artificial Sequence: Synthetic polypeptide
SECEIATTNPVATEGWGSVSTNLQGDTGGNNS

SEQ ID NO: 91111 - protein, 31 aa, Artificial Sequence
  Description of Artificial Sequence: Synthetic polypeptide
SEAEIATTNPVATEQYGSVAMNLNRNNNENN

SEQ ID NO: 91112 - protein, 33 aa, Artificial Sequence
  Description of Artificial Sequence: Synthetic polypeptide
DEEEIRCTNPVATEQYGCVCSNTELQGFGSEQF

SEQ ID NO: 91113 - protein, 32 aa, Artificial Sequence
  Description of Artificial Sequence: Synthetic polypeptide
SEAEIATTNPVATEQYGCVATNLTAEGGNERE

SEQ ID NO: 91114 - protein, 28 aa, Artificial Sequence
  Description of Artificial Sequence: Synthetic peptide
SEAEIATTNPVATECYGEVSECLQHEEL

SEQ ID NO: 91115 - protein, 32 aa, Artificial Sequence
  Description of Artificial Sequence: Synthetic polypeptide
DEEEIRTTNPVATEQYGSCAATTDQDSDGSDN

SEQ ID NO: 91116 - protein, 35 aa, Artificial Sequence
  Description of Artificial Sequence: Synthetic polypeptide
AEEEIRTTNPVATEQYGSVSTVTNQQQQGEDENQD

SEQ ID NO: 91117 - protein, 35 aa, Artificial Sequence
  Description of Artificial Sequence: Synthetic polypeptide
DEEEIRTTNPVATEQYGSAYVSTYNEDVQVENDEQ

SEQ ID NO: 91118 - protein, 35 aa, Artificial Sequence
  Description of Artificial Sequence: Synthetic polypeptide
AEEEIRTTNPVATEQYGSVSTVTNQQLGNNLVEED

SEQ ID NO: 91119 - protein, 30 aa, Artificial Sequence
  Description of Artificial Sequence: Synthetic polypeptide
SDEEIRTTNPVATEQWGAVSTNLEEELQDV

SEQ ID NO: 91120 - protein, 30 aa, Artificial Sequence
  Description of Artificial Sequence: Synthetic polypeptide
SDEEIRTTNPVATEQWGAVSTNLEEELVMD

SEQ ID NO: 91121 - protein, 35 aa, Artificial Sequence
  Description of Artificial Sequence: Synthetic polypeptide
AEEEIRTTNPVATEQYGSVSTVTNQNQQEGNNDET

SEQ ID NO: 91122 - protein, 32 aa, Artificial Sequence
  Description of Artificial Sequence: Synthetic polypeptide
SDEEIRTTNPVATHQYGCVCSTELQSFGSNFA

SEQ ID NO: 91123 - protein, 29 aa, Artificial Sequence
  Description of Artificial Sequence: Synthetic peptide
SDSEIRSTNPIATEGYGSVAETLQRVGQR

SEQ ID NO: 91124 - protein, 34 aa, Artificial Sequence
  Description of Artificial Sequence: Synthetic polypeptide
DEEEIRTTNPVATEQYGSAYPTNLPETRGQEVET

SEQ ID NO: 91125 - protein, 35 aa, Artificial Sequence
  Description of Artificial Sequence: Synthetic polypeptide
AEEEIRTTNPVATEQYGSVSTVTNQQQQNGGNQNE

SEQ ID NO: 91126 - protein, 30 aa, Artificial Sequence
  Description of Artificial Sequence: Synthetic polypeptide
SDSEIRSTNPVATEGYGSVAANTIQRVGQR

SEQ ID NO: 91127 - protein, 31 aa, Artificial Sequence
  Description of Artificial Sequence: Synthetic polypeptide
SEAEIACTNPVATEPYGSVATNLQGAGMSNS

SEQ ID NO: 91128 - protein, 30 aa, Artificial Sequence
  Description of Artificial Sequence: Synthetic polypeptide
SEAEIACTNPVATEQYGCVATNLQAEDNED

SEQ ID NO: 91129 - protein, 30 aa, Artificial Sequence
  Description of Artificial Sequence: Synthetic polypeptide
SEAEIACTNPVATEQYGCVATNLQASENDE

SEQ ID NO: 91130 - protein, 30 aa, Artificial Sequence
  Description of Artificial Sequence: Synthetic polypeptide
SEAEIACTNPVATEQYGCVATNLQDGAEGN

SEQ ID NO: 91131 - protein, 30 aa, Artificial Sequence
  Description of Artificial Sequence: Synthetic polypeptide
SEAEIACTNPVATEQYGCVATNLQRDDQED

SEQ ID NO: 91132 - protein, 31 aa, Artificial Sequence
  Description of Artificial Sequence: Synthetic polypeptide
SEAEIACTNPVATEQYGSVAMNLQEAGNDPE

SEQ ID NO: 91133 - protein, 30 aa, Artificial Sequence
  Description of Artificial Sequence: Synthetic polypeptide
SEAEIACTNPVATEQYGSVATNLQATPTPD

SEQ ID NO: 91134 - protein, 32 aa, Artificial Sequence
  Description of Artificial Sequence: Synthetic polypeptide
SEAEIACTNPVATEQYGSVATNLQDAPGNAEE

SEQ ID NO: 91135 - protein, 32 aa, Artificial Sequence
  Description of Artificial Sequence: Synthetic polypeptide
SEAEIACTNPVATEQYGSVATNLQTPGDNAEE

SEQ ID NO: 91136 - protein, 36 aa, Artificial Sequence
  Description of Artificial Sequence: Synthetic polypeptide
AEEEIRTTNPVATEQYGSVSTVTNQNLQNQEAGNNM

SEQ ID NO: 91137 - protein, 31 aa, Artificial Sequence
  Description of Artificial Sequence: Synthetic polypeptide
SEAEIACTNPVATEAYGSVATNLQEAGNNPQ

SEQ ID NO: 91138 - protein, 28 aa, Artificial Sequence
  Description of Artificial Sequence: Synthetic peptide
QESEIATTNPVATECYGSASCVCQHENK

SEQ ID NO: 91139 - protein, 28 aa, Artificial Sequence
  Description of Artificial Sequence: Synthetic peptide
QESEIATTNPVATECYGDVSETLQHEEL

SEQ ID NO: 91140 - protein, 29 aa, Artificial Sequence
  Description of Artificial Sequence: Synthetic peptide
QESEIATTNPVATECYGDVSETELQHEEL

SEQ ID NO: 91141 - protein, 35 aa, Artificial Sequence
  Description of Artificial Sequence: Synthetic polypeptide
DEEEIGTTNPVATEQYGSTVSQNAFSQNRLGDNQW

SEQ ID NO: 91142 - protein, 34 aa, Artificial Sequence
  Description of Artificial Sequence: Synthetic polypeptide
DEEEIGTTNPVATEQYGSVCSTNDHQENMGSDLS

SEQ ID NO: 91143 - protein, 31 aa, Artificial Sequence
  Description of Artificial Sequence: Synthetic polypeptide
QENEIATTNPVATEQYGSVSEDLQDHEGEDL

SEQ ID NO: 91144 - protein, 37 aa, Artificial Sequence
  Description of Artificial Sequence: Synthetic polypeptide
DEEEIRTTNPVATEQYGSQVVSYTVNLYQERENTDQI

SEQ ID NO: 91145 - protein, 34 aa, Artificial Sequence
  Description of Artificial Sequence: Synthetic polypeptide
DEEEIRTTNPVATEQYGSQVVSTDSDNLFENSED

SEQ ID NO: 91146 - protein, 35 aa, Artificial Sequence
  Description of Artificial Sequence: Synthetic polypeptide
AEEEIRTTNPVATEQYGSVSTVVNNQLQNNTENSE

SEQ ID NO: 91147 - protein, 31 aa, Artificial Sequence
  Description of Artificial Sequence: Synthetic polypeptide
QENEIATTNPVATEQYGSVSTDLEDHEGEDL

SEQ ID NO: 91148 - protein, 34 aa, Artificial Sequence
  Description of Artificial Sequence: Synthetic polypeptide
DEEEIGTTNPVATEQYGSVSVENEGGGFRDGINH

SEQ ID NO: 91149 - protein, 28 aa, Artificial Sequence
  Description of Artificial Sequence: Synthetic peptide
QENEIATTNPVATERYGDVSECLQHEEH

SEQ ID NO: 91150 - protein, 28 aa, Artificial Sequence
  Description of Artificial Sequence: Synthetic peptide
QENEIATTNPVATERYGDVSECLQHEEL

SEQ ID NO: 91151 - protein, 28 aa, Artificial Sequence
  Description of Artificial Sequence: Synthetic peptide
QENEIATTNPVATESYGCVSEALQHNTL

SEQ ID NO: 91152 - protein, 28 aa, Artificial Sequence
  Description of Artificial Sequence: Synthetic peptide
QENEIATTNPVATESYGCVSNALQHEEM

SEQ ID NO: 91153 - protein, 28 aa, Artificial Sequence
  Description of Artificial Sequence: Synthetic peptide
QENEIATTNPVATESYGDVSECLQHEEL

SEQ ID NO: 91154 - protein, 28 aa, Artificial Sequence
  Description of Artificial Sequence: Synthetic peptide
QENEIATTNPVATESYGDVSSVLQHEEL

SEQ ID NO: 91155 - protein, 29 aa, Artificial Sequence
  Description of Artificial Sequence: Synthetic peptide
QENEIATTNPVATESYGISVSECLQHEES

SEQ ID NO: 91156 - protein, 28 aa, Artificial Sequence
  Description of Artificial Sequence: Synthetic peptide
QENEIATTNPVATESYGVVSAALQHDTM

SEQ ID NO: 91157 - protein, 28 aa, Artificial Sequence
  Description of Artificial Sequence: Synthetic peptide
QENEIATTNPVATESYGVVSEALQHHEA

SEQ ID NO: 91158 - protein, 29 aa, Artificial Sequence
  Description of Artificial Sequence: Synthetic peptide
QENEIATTNPVATESYGVVSEALQHNNEL

SEQ ID NO: 91159 - protein, 28 aa, Artificial Sequence
  Description of Artificial Sequence: Synthetic peptide
QENEIATTNPVATESYGVVSEGLQNEEL

SEQ ID NO: 91160 - protein, 33 aa, Artificial Sequence
  Description of Artificial Sequence: Synthetic polypeptide
DEEEIRTTNPVATEQYGSQPSVTSQPERMEERV

SEQ ID NO: 91161 - protein, 29 aa, Artificial Sequence
  Description of Artificial Sequence: Synthetic peptide
QENEIATTNPVATESYGVVSENALQHDTL

SEQ ID NO: 91162 - protein, 35 aa, Artificial Sequence
  Description of Artificial Sequence: Synthetic polypeptide
AEEEIRTTNPVATEQYGSVSTVVNNQNSNGTNQVE

SEQ ID NO: 91163 - protein, 28 aa, Artificial Sequence
  Description of Artificial Sequence: Synthetic peptide
QENEIATTNPVATETYGDVSCCLQHEEL

SEQ ID NO: 91164 - protein, 35 aa, Artificial Sequence
  Description of Artificial Sequence: Synthetic polypeptide
AEEEIRTTNPVATEQYGSVSTVVNNQQGNEENQDT

SEQ ID NO: 91165 - protein, 30 aa, Artificial Sequence
  Description of Artificial Sequence: Synthetic polypeptide
QENEIATTNPVATEQYGSVSECLQDHEEEL

SEQ ID NO: 91166 - protein, 29 aa, Artificial Sequence
  Description of Artificial Sequence: Synthetic peptide
QENEIATTNPVATEQYGDVSECLQHEEEL

SEQ ID NO: 91167 - protein, 34 aa, Artificial Sequence
  Description of Artificial Sequence: Synthetic polypeptide
DEEEIRTTNPVATEQYGSVSPIQDHLQIDNDFLI

SEQ ID NO: 91168 - protein, 35 aa, Artificial Sequence
  Description of Artificial Sequence: Synthetic polypeptide
AEEEIRTTNPVATEQYGSVSTVVNQGNQGGNNETE

SEQ ID NO: 91169 - protein, 29 aa, Artificial Sequence
  Description of Artificial Sequence: Synthetic peptide
QENEIATTNPVATEQYGDVSECLVQFEEL

SEQ ID NO: 91170 - protein, 30 aa, Artificial Sequence
  Description of Artificial Sequence: Synthetic polypeptide
QENEIATTNPVATEQYGDVSEDCLVQHGED

SEQ ID NO: 91171 - protein, 29 aa, Artificial Sequence
  Description of Artificial Sequence: Synthetic peptide
QENEIATTNPVATEQYGDVSEDLQDHEEL

SEQ ID NO: 91172 - protein, 28 aa, Artificial Sequence
  Description of Artificial Sequence: Synthetic peptide
QENEIATTNPVATEQYGDVSEIEQHEDL

SEQ ID NO: 91173 - protein, 29 aa, Artificial Sequence
  Description of Artificial Sequence: Synthetic peptide
QENEIATTNPVATEQYGDVSEILQHAEDA

SEQ ID NO: 91174 - protein, 29 aa, Artificial Sequence
  Description of Artificial Sequence: Synthetic peptide
QENEIATTNPVATEQYGDVSEPALQHEEL

SEQ ID NO: 91175 - protein, 28 aa, Artificial Sequence
  Description of Artificial Sequence: Synthetic peptide
QENEIATTNPVATEQYGDVSEVCQHEEL

SEQ ID NO: 91176 - protein, 31 aa, Artificial Sequence
  Description of Artificial Sequence: Synthetic polypeptide
QENEIATTNPVATEQYGDVSTCLQDHEGEDL

SEQ ID NO: 91177 - protein, 31 aa, Artificial Sequence
  Description of Artificial Sequence: Synthetic polypeptide
QENEIATTNPVATEQYGDVSTDLQDHEGEDL

SEQ ID NO: 91178 - protein, 35 aa, Artificial Sequence
  Description of Artificial Sequence: Synthetic polypeptide
AEEEIRTTNPVATEQYGSVSTVVNQEQGVNGEINT

SEQ ID NO: 91179 - protein, 28 aa, Artificial Sequence
  Description of Artificial Sequence: Synthetic peptide
QENEIATTNPVATEQYGEASEVCQREEK

SEQ ID NO: 91180 - protein, 28 aa, Artificial Sequence
  Description of Artificial Sequence: Synthetic peptide
QENEIATTNPVATEQYGEASEVLQHEEK

SEQ ID NO: 91181 - protein, 32 aa, Artificial Sequence
  Description of Artificial Sequence: Synthetic polypeptide
DEEEIRTTNPVATEQYGSSSLNIDPNGGEDGQ

SEQ ID NO: 91182 - protein, 34 aa, Artificial Sequence
  Description of Artificial Sequence: Synthetic polypeptide
AEEEIRTTNPVATEQYGSVSTVVNQAGTESGNNA

SEQ ID NO: 91183 - protein, 35 aa, Artificial Sequence
  Description of Artificial Sequence: Synthetic polypeptide
AEEEIRTTNPVATEQYGSVSTVVNNQQQEGEAGNF

SEQ ID NO: 91184 - protein, 34 aa, Artificial Sequence
  Description of Artificial Sequence: Synthetic polypeptide
DEEEIRTTNPVATEQYGSSLCQTNSFPTRGNSEM

SEQ ID NO: 91185 - protein, 32 aa, Artificial Sequence
  Description of Artificial Sequence: Synthetic polypeptide
QENEIATTNPVATEQYGSVSATDLQDHEGEDL

SEQ ID NO: 91186 - protein, 30 aa, Artificial Sequence
  Description of Artificial Sequence: Synthetic polypeptide
QENEIATTNPVATEQYGSVSEALQHNEMEV

SEQ ID NO: 91187 - protein, 34 aa, Artificial Sequence
  Description of Artificial Sequence: Synthetic polypeptide
DEEEIGTTNPVATEQYGSACSTYSDEERGDNDRI

SEQ ID NO: 91188 - protein, 28 aa, Artificial Sequence
  Description of Artificial Sequence: Synthetic peptide
QENEIATTNPVATETYGDVSECLQHEEL

SEQ ID NO: 91189 - protein, 28 aa, Artificial Sequence
  Description of Artificial Sequence: Synthetic peptide
QENEIATTNPVATETYGGVSEVLQHEEM

SEQ ID NO: 91190 - protein, 28 aa, Artificial Sequence
  Description of Artificial Sequence: Synthetic peptide
QENEIATTNPVATEVYGDVSECLQHEEL

SEQ ID NO: 91191 - protein, 28 aa, Artificial Sequence
  Description of Artificial Sequence: Synthetic peptide
QENEIHTTNPVATECYGMVSECLQHEEL

SEQ ID NO: 91192 - protein, 28 aa, Artificial Sequence
  Description of Artificial Sequence: Synthetic peptide
QENEIKTTNPVATECYGEVSEQLQHEEL

SEQ ID NO: 91193 - protein, 28 aa, Artificial Sequence
  Description of Artificial Sequence: Synthetic peptide
QENEIKTTNPVATECYGYVSECLQHEEL

SEQ ID NO: 91194 - protein, 28 aa, Artificial Sequence
  Description of Artificial Sequence: Synthetic peptide
QENEINTTNPVATECYGDVSECLQHEEL

SEQ ID NO: 91195 - protein, 36 aa, Artificial Sequence
  Description of Artificial Sequence: Synthetic polypeptide
AEEEIRTTNPVATEQYGSVSTVVNNLELQEGTTNQG

SEQ ID NO: 91196 - protein, 28 aa, Artificial Sequence
  Description of Artificial Sequence: Synthetic peptide
QENEIRSTNPVGTEGYGTIASTLQHGNI

SEQ ID NO: 91197 - protein, 29 aa, Artificial Sequence
  Description of Artificial Sequence: Synthetic peptide
QENEIRTTNPCATEQYGDVSCIEQNSGDA

SEQ ID NO: 91198 - protein, 28 aa, Artificial Sequence
  Description of Artificial Sequence: Synthetic peptide
QENEIRTTNPCSTEPYGIVSCNIQQGTH

SEQ ID NO: 91199 - protein, 30 aa, Artificial Sequence
  Description of Artificial Sequence: Synthetic polypeptide
QENEIRTTNPCSTEQYGIVSCDLQQQNGNH

SEQ ID NO: 91200 - protein, 33 aa, Artificial Sequence
  Description of Artificial Sequence: Synthetic polypeptide
DEEEIKTTNPVATEQYGCVCSTGNHQNFGSEQM

SEQ ID NO: 91201 - protein, 31 aa, Artificial Sequence
  Description of Artificial Sequence: Synthetic polypeptide
QENEIRTTNPVATECWGSVSEICLQDREGEL

SEQ ID NO: 91202 - protein, 28 aa, Artificial Sequence
  Description of Artificial Sequence: Synthetic peptide
QENEIRTTNPVATECYGAVSEDWQHEEL

SEQ ID NO: 91203 - protein, 28 aa, Artificial Sequence
  Description of Artificial Sequence: Synthetic peptide
QENEIRTTNPVATECYGAVSEDWQHEPL

SEQ ID NO: 91204 - protein, 28 aa, Artificial Sequence
  Description of Artificial Sequence: Synthetic peptide
QENEIRTTNPVATECYGDVSMCIQHEEL

SEQ ID NO: 91205 - protein, 30 aa, Artificial Sequence
  Description of Artificial Sequence: Synthetic polypeptide
QENEIRTTNPVATECYGDVSTCLQHNEEPL

SEQ ID NO: 91206 - protein, 35 aa, Artificial Sequence
  Description of Artificial Sequence: Synthetic polypeptide
AEEEIRTTNPVATEQYGSVSTVVNLQQQIGTEGGN

SEQ ID NO: 91207 - protein, 35 aa, Artificial Sequence
  Description of Artificial Sequence: Synthetic polypeptide
AEEEIRTTNPVATEQYGSVSTVVNLQQQEQGEEGT

SEQ ID NO: 91208 - protein, 35 aa, Artificial Sequence
  Description of Artificial Sequence: Synthetic polypeptide
DEEEIKTTNPVATEQYGIKVVSCTNMDSQRGTHRC

SEQ ID NO: 91209 - protein, 34 aa, Artificial Sequence
  Description of Artificial Sequence: Synthetic polypeptide
DEEEIRTTNPVATEQYGSMSTTPAGPNMRNGMNV

SEQ ID NO: 91210 - protein, 28 aa, Artificial Sequence
  Description of Artificial Sequence: Synthetic peptide
QENEIRTTNPVATECYGTISMCIQHENL

SEQ ID NO: 91211 - protein, 34 aa, Artificial Sequence
  Description of Artificial Sequence: Synthetic polypeptide
DEEEIKTTNPVATEQYGNVSGTDQNNGQGGTNGQ

SEQ ID NO: 91212 - protein, 28 aa, Artificial Sequence
  Description of Artificial Sequence: Synthetic peptide
QENEIGTTNPVATECYGDVSECLQHEEL

SEQ ID NO: 91213 - protein, 28 aa, Artificial Sequence
  Description of Artificial Sequence: Synthetic peptide
QENEIGTTNPVATECYGDVSECLQDEEL

SEQ ID NO: 91214 - protein, 28 aa, Artificial Sequence
  Description of Artificial Sequence: Synthetic peptide
QENEICTTNPVATECYGDVSECLQHEEL

SEQ ID NO: 91215 - protein, 28 aa, Artificial Sequence
  Description of Artificial Sequence: Synthetic peptide
QENEICTTNPVATECYGCVSACLQHEEL

SEQ ID NO: 91216 - protein, 28 aa, Artificial Sequence
  Description of Artificial Sequence: Synthetic peptide
QENEIATTNPVATEWYGDVSECLQHEEL

SEQ ID NO: 91217 - protein, 28 aa, Artificial Sequence
  Description of Artificial Sequence: Synthetic peptide
QENEIATTNPVATEYYGCVSWELQHIEQ

SEQ ID NO: 91218 - protein, 28 aa, Artificial Sequence
  Description of Artificial Sequence: Synthetic peptide
QENEIATTNPVATEYYGDVSECLQHEEL

SEQ ID NO: 91219 - protein, 28 aa, Artificial Sequence
  Description of Artificial Sequence: Synthetic peptide
QENEIATTNPVATEYYGDVSEDLQHEEL

SEQ ID NO: 91220 - protein, 28 aa, Artificial Sequence
  Description of Artificial Sequence: Synthetic peptide
QENEIATTNPVATEYYGDVSEELQHEEL

SEQ ID NO: 91221 - protein, 28 aa, Artificial Sequence
  Description of Artificial Sequence: Synthetic peptide
QENEIATTNPVATEYYGDVSKCLQHEEL

SEQ ID NO: 91222 - protein, 28 aa, Artificial Sequence
  Description of Artificial Sequence: Synthetic peptide
QENEIATTNPVATEYYGDVSWCLQHNEL

SEQ ID NO: 91223 - protein, 34 aa, Artificial Sequence
  Description of Artificial Sequence: Synthetic polypeptide
DEEEIRTTNPVATEQYGSNYVDTGNVDQEEDEER

SEQ ID NO: 91224 - protein, 33 aa, Artificial Sequence
  Description of Artificial Sequence: Synthetic polypeptide
DEEEIRTTNPVATEQYGSNVYNTPDSLVGNQIF

SEQ ID NO: 91225 - protein, 35 aa, Artificial Sequence
  Description of Artificial Sequence: Synthetic polypeptide
DEEEIRTTNPVATEQYGSNVVSPNTNDADQERNEG

SEQ ID NO: 91226 - protein, 35 aa, Artificial Sequence
  Description of Artificial Sequence: Synthetic polypeptide
DEEEIGTTNPVATEQYGCVCSTNDLQENFGSNTLA

SEQ ID NO: 91227 - protein, 32 aa, Artificial Sequence
  Description of Artificial Sequence: Synthetic polypeptide
QENEIATTNPVAYEQYGSVATNLQGNPTEGRN

SEQ ID NO: 91228 - protein, 35 aa, Artificial Sequence
  Description of Artificial Sequence: Synthetic polypeptide
AEEEIRTTNPVATEQYGSVSTVVNNNNLQQDENGN

SEQ ID NO: 91229 - protein, 28 aa, Artificial Sequence
  Description of Artificial Sequence: Synthetic peptide
QENEIATTNPVCTEQYGVVSECLQHEEQ

SEQ ID NO: 91230 - protein, 28 aa, Artificial Sequence
  Description of Artificial Sequence: Synthetic peptide
QENEIATTNPVGTECYGDVSECLQHEER

SEQ ID NO: 91231 - protein, 35 aa, Artificial Sequence
  Description of Artificial Sequence: Synthetic polypeptide
DEEEIRTTNPVATEQYGSNSTDWNGPQAGDGNESF

SEQ ID NO: 91232 - protein, 28 aa, Artificial Sequence
  Description of Artificial Sequence: Synthetic peptide
QENEIATTNPVSTECYGDVSENLQHEEL

SEQ ID NO: 91233 - protein, 32 aa, Artificial Sequence
  Description of Artificial Sequence: Synthetic polypeptide
DEEEIKTTNPVATEQYGCVCSTEHNQNFGSEQ

SEQ ID NO: 91234 - protein, 30 aa, Artificial Sequence
  Description of Artificial Sequence: Synthetic polypeptide
QENEIATTNPVSTEPYGTVSMNIQQQNGNR

SEQ ID NO: 91235 - protein, 28 aa, Artificial Sequence
  Description of Artificial Sequence: Synthetic peptide
QENEIATVNPVATECYGDVSECLQHGEL

SEQ ID NO: 91236 - protein, 28 aa, Artificial Sequence
  Description of Artificial Sequence: Synthetic peptide
QENEIATVNPVATEQYGDVSECLQHEEL

SEQ ID NO: 91237 - protein, 28 aa, Artificial Sequence
  Description of Artificial Sequence: Synthetic peptide
QENEIATVNPVCTEQYGVVSECLQHENQ

SEQ ID NO: 91238 - protein, 28 aa, Artificial Sequence
  Description of Artificial Sequence: Synthetic peptide
QENEIATTNPVCTEQYGVVSDCLQSEEL

SEQ ID NO: 91239 - protein, 28 aa, Artificial Sequence
  Description of Artificial Sequence: Synthetic peptide
QENEIATTNPVATEQYGDVSECLEHEEL

SEQ ID NO: 91240 - protein, 33 aa, Artificial Sequence
  Description of Artificial Sequence: Synthetic polypeptide
DEEEIGTTNPVATEQYGCVCSTNDHQENMGSDQ

SEQ ID NO: 91241 - protein, 28 aa, Artificial Sequence
  Description of Artificial Sequence: Synthetic peptide
QENEIATTNPVATEQYGDVSECEQHEEA

SEQ ID NO: 91242 - protein, 28 aa, Artificial Sequence
  Description of Artificial Sequence: Synthetic peptide
QENEIATTNPVATECYGVVSMHLQSEGL

SEQ ID NO: 91243 - protein, 28 aa, Artificial Sequence
  Description of Artificial Sequence: Synthetic peptide
QENEIATTNPVATECYGWVSEALQHNEL

SEQ ID NO: 91244 - protein, 28 aa, Artificial Sequence
  Description of Artificial Sequence: Synthetic peptide
QENEIATTNPVATECYGWVSECLQHEEL

SEQ ID NO: 91245 - protein, 28 aa, Artificial Sequence
  Description of Artificial Sequence: Synthetic peptide
QENEIATTNPVATECYGWVSECLQHNEL

SEQ ID NO: 91246 - protein, 28 aa, Artificial Sequence
  Description of Artificial Sequence: Synthetic peptide
QENEIATTNPVATECYGYVSECLQFEEL

SEQ ID NO: 91247 - protein, 35 aa, Artificial Sequence
  Description of Artificial Sequence: Synthetic polypeptide
DEEEIRTTNPVATEQYGSTSMTEWVLSQTIENNRD

SEQ ID NO: 91248 - protein, 28 aa, Artificial Sequence
  Description of Artificial Sequence: Synthetic peptide
QENEIATTNPVATECYGYVSECLQHEEL

SEQ ID NO: 91249 - protein, 29 aa, Artificial Sequence
  Description of Artificial Sequence: Synthetic peptide
QENEIATTNPVATECYGYVSTECLQHEEL

SEQ ID NO: 91250 - protein, 28 aa, Artificial Sequence
  Description of Artificial Sequence: Synthetic peptide
QENEIATTNPVATEEYGDVSECLQHEEL

SEQ ID NO: 91251 - protein, 28 aa, Artificial Sequence
  Description of Artificial Sequence: Synthetic peptide
QENEIATTNPVATEEYGHVSECLQIEEL

SEQ ID NO: 91252 - protein, 28 aa, Artificial Sequence
  Description of Artificial Sequence: Synthetic peptide
QENEIATTNPVATEEYGTVSWPLQHEEL

SEQ ID NO: 91253 - protein, 28 aa, Artificial Sequence
  Description of Artificial Sequence: Synthetic peptide
QENEIATTNPVATEFYGDVSECLQHEEL

SEQ ID NO: 91254 - protein, 28 aa, Artificial Sequence
  Description of Artificial Sequence: Synthetic peptide
QENEIATTNPVATEFYGDVSECLQHEES

SEQ ID NO: 91255 - protein, 28 aa, Artificial Sequence
  Description of Artificial Sequence: Synthetic peptide
QENEIATTNPVATEFYGDVSECLQHERL

SEQ ID NO: 91256 - protein, 28 aa, Artificial Sequence
  Description of Artificial Sequence: Synthetic peptide
QENEIATTNPVATEFYGDVSECLQHNEL

SEQ ID NO: 91257 - protein, 28 aa, Artificial Sequence
  Description of Artificial Sequence: Synthetic peptide
QENEIATTNPVATEFYGMVSEDLQHEEL

SEQ ID NO: 91258 - protein, 34 aa, Artificial Sequence
  Description of Artificial Sequence: Synthetic polypeptide
DEEEIGTTNPVATEQYGCVCSNTGELQHFGSNQG

SEQ ID NO: 91259 - protein, 34 aa, Artificial Sequence
  Description of Artificial Sequence: Synthetic polypeptide
DEEEIGTTNPVATEQYGCVCSNTNEHQNFGSNQP

SEQ ID NO: 91260 - protein, 28 aa, Artificial Sequence
  Description of Artificial Sequence: Synthetic peptide
QENEIATTNPVATEGYGDVSAPLQHIEL

SEQ ID NO: 91261 - protein, 28 aa, Artificial Sequence
  Description of Artificial Sequence: Synthetic peptide
QENEIATTNPVATEGYGDVSEALQHNEL

SEQ ID NO: 91262 - protein, 28 aa, Artificial Sequence
  Description of Artificial Sequence: Synthetic peptide
QENEIATTNPVATEGYGDVSECLQHEEL

SEQ ID NO: 91263 - protein, 28 aa, Artificial Sequence
  Description of Artificial Sequence: Synthetic peptide
QENEIATTNPVATECYGVVSETLQHEEI

SEQ ID NO: 91264 - protein, 28 aa, Artificial Sequence
  Description of Artificial Sequence: Synthetic peptide
QENEIATTNPVATECYGVVSEGLQHEEV

SEQ ID NO: 91265 - protein, 28 aa, Artificial Sequence
  Description of Artificial Sequence: Synthetic peptide
QENEIATTNPVATECYGVVSECLQWEEL

SEQ ID NO: 91266 - protein, 28 aa, Artificial Sequence
  Description of Artificial Sequence: Synthetic peptide
QENEIATTNPVATECYGVVSECLQHEEL

SEQ ID NO: 91267 - protein, 34 aa, Artificial Sequence
  Description of Artificial Sequence: Synthetic polypeptide
DEEEICTTNPVAYEQYGSVSCTNSLSQVSVGEDF

SEQ ID NO: 91268 - protein, 28 aa, Artificial Sequence
  Description of Artificial Sequence: Synthetic peptide
QENEIATTNPVATECYGTVSCCLQHEEL

SEQ ID NO: 91269 - protein, 28 aa, Artificial Sequence
  Description of Artificial Sequence: Synthetic peptide
QENEIATTNPVATECYGTVSEALQHEEH

SEQ ID NO: 91270 - protein, 28 aa, Artificial Sequence
  Description of Artificial Sequence: Synthetic peptide
QENEIATTNPVATECYGTVSECLQHEEH

SEQ ID NO: 91271 - protein, 28 aa, Artificial Sequence
  Description of Artificial Sequence: Synthetic peptide
QENEIATTNPVATECYGTVSECLQHEEL

SEQ ID NO: 91272 - protein, 34 aa, Artificial Sequence
  Description of Artificial Sequence: Synthetic polypeptide
DEEEICTTNPVAYEQYGSVSCTSSLSQVRGGEYF

SEQ ID NO: 91273 - protein, 32 aa, Artificial Sequence
  Description of Artificial Sequence: Synthetic polypeptide
DEEEICTTNPVAYEQYGWVAQYTNIETRMGNI

SEQ ID NO: 91274 - protein, 29 aa, Artificial Sequence
  Description of Artificial Sequence: Synthetic peptide
QENEIATTNPVATECYGTVSECLQHEGEL

SEQ ID NO: 91275 - protein, 28 aa, Artificial Sequence
  Description of Artificial Sequence: Synthetic peptide
QENEIATTNPVATECYGTVSECLQHESG

SEQ ID NO: 91276 - protein, 29 aa, Artificial Sequence
  Description of Artificial Sequence: Synthetic peptide
QENEIATTNPVATECYGTVSECLVQHGEL

SEQ ID NO: 91277 - protein, 28 aa, Artificial Sequence
  Description of Artificial Sequence: Synthetic peptide
QENEIATTNPVATEGYGDVSQCLQHEEL

SEQ ID NO: 91278 - protein, 28 aa, Artificial Sequence
  Description of Artificial Sequence: Synthetic peptide
QENEIATTNPVATECYGTVSECPQHGEL

SEQ ID NO: 91279 - protein, 28 aa, Artificial Sequence
  Description of Artificial Sequence: Synthetic peptide
QENEIATTNPVATECYGTVSEWLQHEEL

SEQ ID NO: 91280 - protein, 28 aa, Artificial Sequence
  Description of Artificial Sequence: Synthetic peptide
QENEIATTNPVATECYGTVSMCLQHEEH

SEQ ID NO: 91281 - protein, 29 aa, Artificial Sequence
  Description of Artificial Sequence: Synthetic peptide
QENEIATTNPVATECYGTVSMECLQHGEH

SEQ ID NO: 91282 - protein, 29 aa, Artificial Sequence
  Description of Artificial Sequence: Synthetic peptide
QENEIATTNPVATECYGTVSMECLQQGEH

SEQ ID NO: 91283 - protein, 28 aa, Artificial Sequence
  Description of Artificial Sequence: Synthetic peptide
QENEIATTNPVATECYGTVSNLLQNEEL

SEQ ID NO: 91284 - protein, 34 aa, Artificial Sequence
  Description of Artificial Sequence: Synthetic polypeptide
DEEEIGTTNPCATEQYGCVCPTNLNQERFGSNTQ

SEQ ID NO: 91285 - protein, 33 aa, Artificial Sequence
  Description of Artificial Sequence: Synthetic polypeptide
DEEEIGTTNPCATEQYGCVCPTNLQENGSNTQA

SEQ ID NO: 91286 - protein, 28 aa, Artificial Sequence
  Description of Artificial Sequence: Synthetic peptide
QENEIATTNPVATECYGVVASCLQHGEL

SEQ ID NO: 91287 - protein, 28 aa, Artificial Sequence
  Description of Artificial Sequence: Synthetic peptide
QENEIATTNPVATECYGVVSECLQEEEL

SEQ ID NO: 91288 - protein, 28 aa, Artificial Sequence
  Description of Artificial Sequence: Synthetic peptide
QENEIATTNPVATECYGVVSECLQHEEI

SEQ ID NO: 91289 - protein, 29 aa, Artificial Sequence
  Description of Artificial Sequence: Synthetic peptide
QENEIATTNPVATECYGTVSEDCLQHENL

SEQ ID NO: 91290 - protein, 28 aa, Artificial Sequence
  Description of Artificial Sequence: Synthetic peptide
QENEIRTTNPVATECYGTVSMCIQHEEL

SEQ ID NO: 91291 - protein, 28 aa, Artificial Sequence
  Description of Artificial Sequence: Synthetic peptide
QENEIATTNPVATEGYGDVSSCLQHEEL

SEQ ID NO: 91292 - protein, 28 aa, Artificial Sequence
  Description of Artificial Sequence: Synthetic peptide
QENEIATTNPVATEGYGEVSECLQHEEL

SEQ ID NO: 91293 - protein, 28 aa, Artificial Sequence
  Description of Artificial Sequence: Synthetic peptide
QENEIATTNPVATEPYGEVSEWLQHEEL

SEQ ID NO: 91294 - protein, 31 aa, Artificial Sequence
  Description of Artificial Sequence: Synthetic polypeptide
DEEEIGTTNPVATEQYGCVCSTEHQNNSQQS

SEQ ID NO: 91295 - protein, 33 aa, Artificial Sequence
  Description of Artificial Sequence: Synthetic polypeptide
DEEEIGTTNPVATEQYGCVCSTELQNFNSQTQS

SEQ ID NO: 91296 - protein, 28 aa, Artificial Sequence
  Description of Artificial Sequence: Synthetic peptide
QENEIATTNPVATEPYGNVSAHLQHWEL

SEQ ID NO: 91297 - protein, 29 aa, Artificial Sequence
  Description of Artificial Sequence: Synthetic peptide
QENEIATTNPVATEPYGTVSECLQHEENL

SEQ ID NO: 91298 - protein, 28 aa, Artificial Sequence
  Description of Artificial Sequence: Synthetic peptide
QENEIATTNPVATEQWGDVSECLQAEDA

SEQ ID NO: 91299 - protein, 28 aa, Artificial Sequence
  Description of Artificial Sequence: Synthetic peptide
QENEIATTNPVATEQWGDVSECLQHEEA

SEQ ID NO: 91300 - protein, 28 aa, Artificial Sequence
  Description of Artificial Sequence: Synthetic peptide
QENEIATTNPVATEQWGDVSECLQHEEL

SEQ ID NO: 91301 - protein, 36 aa, Artificial Sequence
  Description of Artificial Sequence: Synthetic polypeptide
DEEEIRTTNPVATEQYGSTGSPTNGLQNTQGNLIVS

SEQ ID NO: 91302 - protein, 28 aa, Artificial Sequence
  Description of Artificial Sequence: Synthetic peptide
QENEIATTNPVATEQWGDVSEILQHEDA

SEQ ID NO: 91303 - protein, 28 aa, Artificial Sequence
  Description of Artificial Sequence: Synthetic peptide
QENEIATTNPVATEQYGDASECLQHEEL

SEQ ID NO: 91304 - protein, 35 aa, Artificial Sequence
  Description of Artificial Sequence: Synthetic polypeptide
DEEEIRTTNPVATEQYGSTCSMWEELNQRIGSNQS

SEQ ID NO: 91305 - protein, 28 aa, Artificial Sequence
  Description of Artificial Sequence: Synthetic peptide
QENEIATTNPVATEQYGDASEVLQHEEK

SEQ ID NO: 91306 - protein, 34 aa, Artificial Sequence
  Description of Artificial Sequence: Synthetic polypeptide
DEEEIRTTNPVATEQYGSTCSMTENDNQNIGSEQ

SEQ ID NO: 91307 - protein, 28 aa, Artificial Sequence
  Description of Artificial Sequence: Synthetic peptide
QENEIATTNPVATEQYGDVPEVLQHEEK

SEQ ID NO: 91308 - protein, 35 aa, Artificial Sequence
  Description of Artificial Sequence: Synthetic polypeptide
DEEEIRTTNPVATEQYGSTCSMTEELNQENIGNQS

SEQ ID NO: 91309 - protein, 34 aa, Artificial Sequence
  Description of Artificial Sequence: Synthetic polypeptide
DEEEIRTTNPVATEQYGSTCSMSEELNQNIGSNQ

SEQ ID NO: 91310 - protein, 29 aa, Artificial Sequence
  Description of Artificial Sequence: Synthetic peptide
QENEIATTNPVATEQYGDVSAECLQHEEL

SEQ ID NO: 91311 - protein, 35 aa, Artificial Sequence
  Description of Artificial Sequence: Synthetic polypeptide
DEEEIGTTNPVATEQYGCVCSTGNDHQERMGSNQA

SEQ ID NO: 91312 - protein, 35 aa, Artificial Sequence
  Description of Artificial Sequence: Synthetic polypeptide
DEEEIGTTNPVATEQYGCVCSTGNDLQEHFGSNLS

SEQ ID NO: 91313 - protein, 28 aa, Artificial Sequence
  Description of Artificial Sequence: Synthetic peptide
QENEIATTNPVATEQYGDVSECCQHEEL

SEQ ID NO: 91314 - protein, 33 aa, Artificial Sequence
  Description of Artificial Sequence: Synthetic polypeptide
DEEEIGTTNPVATEQYGCVCSTEHNQNFGSNQA

SEQ ID NO: 91315 - protein, 29 aa, Artificial Sequence
  Description of Artificial Sequence: Synthetic peptide
QENEIATTNPVATEPYGDVSECLQRHEEL

SEQ ID NO: 91316 - protein, 28 aa, Artificial Sequence
  Description of Artificial Sequence: Synthetic peptide
QENEIATTNPVATEPYGDVSECLQHEEL

SEQ ID NO: 91317 - protein, 28 aa, Artificial Sequence
  Description of Artificial Sequence: Synthetic peptide
QENEIATTNPVATEPYGDVSECLQHDEL

SEQ ID NO: 91318 - protein, 35 aa, Artificial Sequence
  Description of Artificial Sequence: Synthetic polypeptide
AEEEIRTTNPVATEQYGSVSTVVNQNNQDEGNNED

SEQ ID NO: 91319 - protein, 28 aa, Artificial Sequence
  Description of Artificial Sequence: Synthetic peptide
QENEIATTNPVATEGYGVMASTLQHGDI

SEQ ID NO: 91320 - protein, 28 aa, Artificial Sequence
  Description of Artificial Sequence: Synthetic peptide
QENEIATTNPVATEGYGVVASCLQHGEL

SEQ ID NO: 91321 - protein, 28 aa, Artificial Sequence
  Description of Artificial Sequence: Synthetic peptide
QENEIATTNPVATEGYGVVSSTLQHEEL

SEQ ID NO: 91322 - protein, 28 aa, Artificial Sequence
  Description of Artificial Sequence: Synthetic peptide
QENEIATTNPVATEHYGDVSECLQHEEL

SEQ ID NO: 91323 - protein, 28 aa, Artificial Sequence
  Description of Artificial Sequence: Synthetic peptide
QENEIATTNPVATEHYGDVSWELQHMEL

SEQ ID NO: 91324 - protein, 28 aa, Artificial Sequence
  Description of Artificial Sequence: Synthetic peptide
QENEIATTNPVATEIYGDVSAPLQHEEL

SEQ ID NO: 91325 - protein, 28 aa, Artificial Sequence
  Description of Artificial Sequence: Synthetic peptide
QENEIATTNPVATEIYGDVSECLQHEEL

SEQ ID NO: 91326 - protein, 28 aa, Artificial Sequence
  Description of Artificial Sequence: Synthetic peptide
QENEIATTNPVATEKYGDVSECLQHEEL

SEQ ID NO: 91327 - protein, 28 aa, Artificial Sequence
  Description of Artificial Sequence: Synthetic peptide
QENEIATTNPVATEKYGDVSECLQHELL

SEQ ID NO: 91328 - protein, 28 aa, Artificial Sequence
  Description of Artificial Sequence: Synthetic peptide
QENEIATTNPVATEGYGDVSSTLQHEEL

SEQ ID NO: 91329 - protein, 28 aa, Artificial Sequence
  Description of Artificial Sequence: Synthetic peptide
QENEIATTNPVATELYGDVSECLQDEEL

SEQ ID NO: 91330 - protein, 28 aa, Artificial Sequence
  Description of Artificial Sequence: Synthetic peptide
QENEIATTNPVATEMYGDVSECLQHEEL

SEQ ID NO: 91331 - protein, 28 aa, Artificial Sequence
  Description of Artificial Sequence: Synthetic peptide
QENEIATTNPVATEMYGDVSECLQHHEL

SEQ ID NO: 91332 - protein, 28 aa, Artificial Sequence
  Description of Artificial Sequence: Synthetic peptide
QENEIATTNPVATENYGAVSEALQHEEL

SEQ ID NO: 91333 - protein, 28 aa, Artificial Sequence
  Description of Artificial Sequence: Synthetic peptide
QENEIATTNPVATENYGDVSECLQHEEL

SEQ ID NO: 91334 - protein, 28 aa, Artificial Sequence
  Description of Artificial Sequence: Synthetic peptide
QENEIATTNPVATENYGDVSECLQKEEL

SEQ ID NO: 91335 - protein, 28 aa, Artificial Sequence
  Description of Artificial Sequence: Synthetic peptide
QENEIATTNPVATENYGYVSECLQHEEL

SEQ ID NO: 91336 - protein, 28 aa, Artificial Sequence
  Description of Artificial Sequence: Synthetic peptide
QENEIATTNPVATEPYGCVSECLQHEEA

SEQ ID NO: 91337 - protein, 28 aa, Artificial Sequence
  Description of Artificial Sequence: Synthetic peptide
QENEIATTNPVATEPYGDVSAALQHEEH

SEQ ID NO: 91338 - protein, 28 aa, Artificial Sequence
  Description of Artificial Sequence: Synthetic peptide
QENEIATTNPVATEPYGDVSAPLQHPGL

SEQ ID NO: 91339 - protein, 28 aa, Artificial Sequence
  Description of Artificial Sequence: Synthetic peptide
QENEIATTNPVATEPYGDVSASLQHVEL

SEQ ID NO: 91340 - protein, 28 aa, Artificial Sequence
  Description of Artificial Sequence: Synthetic peptide
QENEIATTNPVATEMYGDVSECLQHDEL

SEQ ID NO: 91341 - protein, 29 aa, Artificial Sequence
  Description of Artificial Sequence: Synthetic peptide
QENEIRTTNPVATEPYGDISMCLQQHGEL

SEQ ID NO: 91342 - protein, 30 aa, Artificial Sequence
  Description of Artificial Sequence: Synthetic polypeptide
QENEIRTTNPVATEPYGDVSMECIQQHGNL

SEQ ID NO: 91343 - protein, 34 aa, Artificial Sequence
  Description of Artificial Sequence: Synthetic polypeptide
DEEEIRTTNPVATEQYGSMSSTTPALPNMHNGNV

SEQ ID NO: 91344 - protein, 30 aa, Artificial Sequence
  Description of Artificial Sequence: Synthetic polypeptide
QESEIASTNPVATEQYGTVCSTTLEFEGNI

SEQ ID NO: 91345 - protein, 28 aa, Artificial Sequence
  Description of Artificial Sequence: Synthetic peptide
QESEIASTNPVATEQYGVMASTLQHGDI

SEQ ID NO: 91346 - protein, 28 aa, Artificial Sequence
  Description of Artificial Sequence: Synthetic peptide
QESEIASTNPVCTEQYGVMSDNLQSGDI

SEQ ID NO: 91347 - protein, 28 aa, Artificial Sequence
  Description of Artificial Sequence: Synthetic peptide
QESEIASTNPVCTEQYGVVADNLQHGDQ

SEQ ID NO: 91348 - protein, 28 aa, Artificial Sequence
  Description of Artificial Sequence: Synthetic peptide
QESEIASTNPVGTEGYGEMASTLQRGDR

SEQ ID NO: 91349 - protein, 28 aa, Artificial Sequence
  Description of Artificial Sequence: Synthetic peptide
QESEIASTNPVGTEGYGEMSENLQRGDI

SEQ ID NO: 91350 - protein, 28 aa, Artificial Sequence
  Description of Artificial Sequence: Synthetic peptide
QESEIASTNPVGTEGYGEMSENLQRGGI

SEQ ID NO: 91351 - protein, 28 aa, Artificial Sequence
  Description of Artificial Sequence: Synthetic peptide
QESEIASTNPVGTEGYGEMSSNLQRGDI

SEQ ID NO: 91352 - protein, 28 aa, Artificial Sequence
  Description of Artificial Sequence: Synthetic peptide
QESEIASTNPVGTEGYGIVSCNLQHGDI

SEQ ID NO: 91353 - protein, 35 aa, Artificial Sequence
  Description of Artificial Sequence: Synthetic polypeptide
DEEEIRTTNPVATEQYGSGVYPTNLPEMRGQVVET

SEQ ID NO: 91354 - protein, 35 aa, Artificial Sequence
  Description of Artificial Sequence: Synthetic polypeptide
DEEEIRATNPVATEQYGAVCSGVNDQDNRQGSNSR

SEQ ID NO: 91355 - protein, 28 aa, Artificial Sequence
  Description of Artificial Sequence: Synthetic peptide
QESEIASTNPVGTEGYGVAAENLQRGGR

SEQ ID NO: 91356 - protein, 34 aa, Artificial Sequence
  Description of Artificial Sequence: Synthetic polypeptide
DEEEIRATNPVATEQYGCNVAITNNLEQTGEEGR

SEQ ID NO: 91357 - protein, 35 aa, Artificial Sequence
  Description of Artificial Sequence: Synthetic polypeptide
DEEEIRATNPVATEQYGCTVANCTGNLSQGGGNRL

SEQ ID NO: 91358 - protein, 34 aa, Artificial Sequence
  Description of Artificial Sequence: Synthetic polypeptide
DEEEIRATNPVATEQYGCVAITNHLEQTGGGNES

SEQ ID NO: 91359 - protein, 33 aa, Artificial Sequence
  Description of Artificial Sequence: Synthetic polypeptide
DEEEIRATNPVATEQYGCVAITNLEATGEGGQR

SEQ ID NO: 91360 - protein, 33 aa, Artificial Sequence
  Description of Artificial Sequence: Synthetic polypeptide
DEEEIRATNPVATEQYGCVAITNLEQTGEGGSN

SEQ ID NO: 91361 - protein, 32 aa, Artificial Sequence
  Description of Artificial Sequence: Synthetic polypeptide
DEEEIRATNPVATEQYGCVAITNNPEQGEEGR

SEQ ID NO: 91362 - protein, 28 aa, Artificial Sequence
  Description of Artificial Sequence: Synthetic peptide
QESEIASTNPVGTEGYGVMSDNLQHGNI

SEQ ID NO: 91363 - protein, 28 aa, Artificial Sequence
  Description of Artificial Sequence: Synthetic peptide
QESEIASTNPVGTEGYGVMSSNLQHGNI

SEQ ID NO: 91364 - protein, 28 aa, Artificial Sequence
  Description of Artificial Sequence: Synthetic peptide
QESEIASTNPVGTEGYGVMSSTLQRGGR

SEQ ID NO: 91365 - protein, 31 aa, Artificial Sequence
  Description of Artificial Sequence: Synthetic polypeptide
QESEIASTNPVATEQYGSVATSTLPQMHGNI

SEQ ID NO: 91366 - protein, 28 aa, Artificial Sequence
  Description of Artificial Sequence: Synthetic peptide
QESEIASTNPVATEQYGDMASTLQHGDI

SEQ ID NO: 91367 - protein, 28 aa, Artificial Sequence
  Description of Artificial Sequence: Synthetic peptide
QESEIASTNPVATEQYGDMASTLQHGDA

SEQ ID NO: 91368 - protein, 28 aa, Artificial Sequence
  Description of Artificial Sequence: Synthetic peptide
QESEIASTNPVATEGYGVVATDLQHGEI

SEQ ID NO: 91369 - protein, 32 aa, Artificial Sequence
  Description of Artificial Sequence: Synthetic polypeptide
QESEIAPTNPVASECYGSVSCINLPQDREGNR

SEQ ID NO: 91370 - protein, 28 aa, Artificial Sequence
  Description of Artificial Sequence: Synthetic peptide
QESEIAPTNPVGTEQYGVVACNLQSGTI

SEQ ID NO: 91371 - protein, 28 aa, Artificial Sequence
  Description of Artificial Sequence: Synthetic peptide
QESEIAPTNPVSSEQYGIVSCTLQSGTR

SEQ ID NO: 91372 - protein, 28 aa, Artificial Sequence
  Description of Artificial Sequence: Synthetic peptide
QESEIAPTNPVSSEQYGIVSNNIQSGTR

SEQ ID NO: 91373 - protein, 28 aa, Artificial Sequence
  Description of Artificial Sequence: Synthetic peptide
QESEIAPTNPVSSEQYGNVSNNIQSGTR

SEQ ID NO: 91374 - protein, 28 aa, Artificial Sequence
  Description of Artificial Sequence: Synthetic peptide
QESEIAPTNPVSTEGYGVVASNLQHGDR

SEQ ID NO: 91375 - protein, 28 aa, Artificial Sequence
  Description of Artificial Sequence: Synthetic peptide
QESEIASTNPCGTEQYGIVSSTLQSGTR

SEQ ID NO: 91376 - protein, 29 aa, Artificial Sequence
  Description of Artificial Sequence: Synthetic peptide
QESEIASTNPVATEGWGSMSCITLQRGNI

SEQ ID NO: 91377 - protein, 28 aa, Artificial Sequence
  Description of Artificial Sequence: Synthetic peptide
QESEIASTNPVATEGYGEASETLQHGDR

SEQ ID NO: 91378 - protein, 28 aa, Artificial Sequence
  Description of Artificial Sequence: Synthetic peptide
QESEIASTNPVATEGYGEMAENLQRGDI

SEQ ID NO: 91379 - protein, 28 aa, Artificial Sequence
  Description of Artificial Sequence: Synthetic peptide
QESEIASTNPVGTEGYGVMSSTLQRGNI

SEQ ID NO: 91380 - protein, 30 aa, Artificial Sequence
  Description of Artificial Sequence: Synthetic polypeptide
QESEIASTNPVATEGYGSMASPALQRGMNI

SEQ ID NO: 91381 - protein, 28 aa, Artificial Sequence
  Description of Artificial Sequence: Synthetic peptide
QESEIASTNPVATEGYGVASETLQHGDR

SEQ ID NO: 91382 - protein, 28 aa, Artificial Sequence
  Description of Artificial Sequence: Synthetic peptide
QESEIASTNPVATEGYGVMASALQRGNI

SEQ ID NO: 91383 - protein, 34 aa, Artificial Sequence
  Description of Artificial Sequence: Synthetic polypeptide
DEEEIRTTNPVATEQYGSIDLCNMLQQTGEEERT

SEQ ID NO: 91384 - protein, 28 aa, Artificial Sequence
  Description of Artificial Sequence: Synthetic peptide
QESEIASTNPVATEGYGVMASNLQHGDR

SEQ ID NO: 91385 - protein, 28 aa, Artificial Sequence
  Description of Artificial Sequence: Synthetic peptide
QESEIASTNPVATEGYGVMASTLQHGDR

SEQ ID NO: 91386 - protein, 28 aa, Artificial Sequence
  Description of Artificial Sequence: Synthetic peptide
QESEIASTNPVATEGYGVMASTLQHGNI

SEQ ID NO: 91387 - protein, 28 aa, Artificial Sequence
  Description of Artificial Sequence: Synthetic peptide
QESEIASTNPVATEGYGVMASTLQRGDG

SEQ ID NO: 91388 - protein, 28 aa, Artificial Sequence
  Description of Artificial Sequence: Synthetic peptide
QESEIASTNPVATEGYGVMSETLQHGDR

SEQ ID NO: 91389 - protein, 29 aa, Artificial Sequence
  Description of Artificial Sequence: Synthetic peptide
QESEIASTNPVATEGYGVMSSITLQRGNI

SEQ ID NO: 91390 - protein, 28 aa, Artificial Sequence
  Description of Artificial Sequence: Synthetic peptide
QESEIASTNPVATEGYGVVASTLQHGDI

SEQ ID NO: 91391 - protein, 28 aa, Artificial Sequence
  Description of Artificial Sequence: Synthetic peptide
QESEIASTNPVATEGYGVAASNLQHGDR

SEQ ID NO: 91392 - protein, 28 aa, Artificial Sequence
  Description of Artificial Sequence: Synthetic peptide
QESEIAPTNPCSSEQYGIVSSNLQSGTR

SEQ ID NO: 91393 - protein, 28 aa, Artificial Sequence
  Description of Artificial Sequence: Synthetic peptide
QESEIASTNPVGTEGYGVVASNLQSGNI

SEQ ID NO: 91394 - protein, 34 aa, Artificial Sequence
  Description of Artificial Sequence: Synthetic polypeptide
DEEEIRTTNPVATEQYGSFWPENNNLDERGENQN

SEQ ID NO: 91395 - protein, 33 aa, Artificial Sequence
  Description of Artificial Sequence: Synthetic polypeptide
DEEEIRATNPVATEQYGSTCAANENLEARDGDR

SEQ ID NO: 91396 - protein, 32 aa, Artificial Sequence
  Description of Artificial Sequence: Synthetic polypeptide
DEEEIRATNPVATEQYGSVAANNHDAPSGSRE

SEQ ID NO: 91397 - protein, 28 aa, Artificial Sequence
  Description of Artificial Sequence: Synthetic peptide
QESEIASTNPVSTEGYGIVSCNLQHGDI

SEQ ID NO: 91398 - protein, 28 aa, Artificial Sequence
  Description of Artificial Sequence: Synthetic peptide
QESEIASTNPVSTEGYGIVSCTLQSGTR

SEQ ID NO: 91399 - protein, 28 aa, Artificial Sequence
  Description of Artificial Sequence: Synthetic peptide
QESEIASTNPVSTEGYGVVASNLQHGDR

SEQ ID NO: 91400 - protein, 28 aa, Artificial Sequence
  Description of Artificial Sequence: Synthetic peptide
QESEIASTNPVSTEGYGVVASTLQSGDR

SEQ ID NO: 91401 - protein, 28 aa, Artificial Sequence
  Description of Artificial Sequence: Synthetic peptide
QESEIASTNPVSTEQYGIVACNLQHGTI

SEQ ID NO: 91402 - protein, 28 aa, Artificial Sequence
  Description of Artificial Sequence: Synthetic peptide
QESEIASVNPVCTEQYGVVSDNLQSGDQ

SEQ ID NO: 91403 - protein, 28 aa, Artificial Sequence
  Description of Artificial Sequence: Synthetic peptide
QESEIASVNPVGTEQYGVVASNLQSGNI

SEQ ID NO: 91404 - protein, 28 aa, Artificial Sequence
  Description of Artificial Sequence: Synthetic peptide
QESEIASVNPVGTEQYGVVSSNLQHGDI

SEQ ID NO: 91405 - protein, 28 aa, Artificial Sequence
  Description of Artificial Sequence: Synthetic peptide
QESEIASVNPVGTEQYGVVSSNLQHGDQ

SEQ ID NO: 91406 - protein, 32 aa, Artificial Sequence
  Description of Artificial Sequence: Synthetic polypeptide
QESEIATTNPVATECWGSVSCNEPQDREGENR

SEQ ID NO: 91407 - protein, 29 aa, Artificial Sequence
  Description of Artificial Sequence: Synthetic peptide
QESEIATTNPVATECWGSVSENLQDHEEL

SEQ ID NO: 91408 - protein, 28 aa, Artificial Sequence
  Description of Artificial Sequence: Synthetic peptide
QESEIATTNPVATECYGDMASTLQHGDI

SEQ ID NO: 91409 - protein, 29 aa, Artificial Sequence
  Description of Artificial Sequence: Synthetic peptide
QESEIATTNPVATECYGDVSAETLQHGEL

SEQ ID NO: 91410 - protein, 28 aa, Artificial Sequence
  Description of Artificial Sequence: Synthetic peptide
QESEIATTNPVATECYGDVSECLQHEDL

SEQ ID NO: 91411 - protein, 28 aa, Artificial Sequence
  Description of Artificial Sequence: Synthetic peptide
QESEIATTNPVATECYGDVSECLQHEEL

SEQ ID NO: 91412 - protein, 28 aa, Artificial Sequence
  Description of Artificial Sequence: Synthetic peptide
QESEIATTNPVATECYGDVSECLQHEQL

SEQ ID NO: 91413 - protein, 28 aa, Artificial Sequence
  Description of Artificial Sequence: Synthetic peptide
QESEIATTNPVATECYGDVSECLQHESL

SEQ ID NO: 91414 - protein, 28 aa, Artificial Sequence
  Description of Artificial Sequence: Synthetic peptide
QESEIATTNPVATECYGDVSENEQHEEL

SEQ ID NO: 91415 - protein, 29 aa, Artificial Sequence
  Description of Artificial Sequence: Synthetic peptide
QESEIATTNPVATECYGDVSENLQDHEEL

SEQ ID NO: 91416 - protein, 32 aa, Artificial Sequence
  Description of Artificial Sequence: Synthetic polypeptide
DEEEIRATNPVATEQYGSCSAGNPDEAPSGSR

SEQ ID NO: 91417 - protein, 28 aa, Artificial Sequence
  Description of Artificial Sequence: Synthetic peptide
QESEIASTNPVGTEQYGVVASNLQSGTI

SEQ ID NO: 91418 - protein, 28 aa, Artificial Sequence
  Description of Artificial Sequence: Synthetic peptide
QESEIASTNPVGTEQYGVVASNLQHGDI

SEQ ID NO: 91419 - protein, 28 aa, Artificial Sequence
  Description of Artificial Sequence: Synthetic peptide
QESEIASTNPVGTEQYGVVACNLQSGTI

SEQ ID NO: 91420 - protein, 28 aa, Artificial Sequence
  Description of Artificial Sequence: Synthetic peptide
QESEIASTNPVGTEGYGVVASTLQRGQI

SEQ ID NO: 91421 - protein, 28 aa, Artificial Sequence
  Description of Artificial Sequence: Synthetic peptide
QESEIASTNPVGTEGYGVVASTLQSGDR

SEQ ID NO: 91422 - protein, 29 aa, Artificial Sequence
  Description of Artificial Sequence: Synthetic peptide
QESEIASTNPVGTEGYGVVSSITLQRGNI

SEQ ID NO: 91423 - protein, 32 aa, Artificial Sequence
  Description of Artificial Sequence: Synthetic polypeptide
DEEEIRATNPVATEQYGDVVMTDGFQGGGNIQ

SEQ ID NO: 91424 - protein, 33 aa, Artificial Sequence
  Description of Artificial Sequence: Synthetic polypeptide
DEEEIRATNPVATEQYGDVVMTNGFQGGGNNTT

SEQ ID NO: 91425 - protein, 33 aa, Artificial Sequence
  Description of Artificial Sequence: Synthetic polypeptide
DEEEIRATNPVATEQYGDVVMTNGFQGGGTNEN

SEQ ID NO: 91426 - protein, 33 aa, Artificial Sequence
  Description of Artificial Sequence: Synthetic polypeptide
DEEEIRATNPVATEQYGDVVMTNGFQGGNGNTN

SEQ ID NO: 91427 - protein, 33 aa, Artificial Sequence
  Description of Artificial Sequence: Synthetic polypeptide
DEEEIRATNPVATEQYGDVVMTNTEFQGGGGNT

SEQ ID NO: 91428 - protein, 34 aa, Artificial Sequence
  Description of Artificial Sequence: Synthetic polypeptide
DEEEIRTTNPVATEQYGSFVSTGNVIEQWHDSEN

SEQ ID NO: 91429 - protein, 28 aa, Artificial Sequence
  Description of Artificial Sequence: Synthetic peptide
QESEIASTNPVGTEQYGEAASTLQRGDI

SEQ ID NO: 91430 - protein, 28 aa, Artificial Sequence
  Description of Artificial Sequence: Synthetic peptide
QESEIASTNPVGTEGYGVVASTLQHGDR

SEQ ID NO: 91431 - protein, 35 aa, Artificial Sequence
  Description of Artificial Sequence: Synthetic polypeptide
AEEEIRTTNPVATEQYGSVSTVVNEQQGTNGEINT

SEQ ID NO: 91432 - protein, 28 aa, Artificial Sequence
  Description of Artificial Sequence: Synthetic peptide
QESEIASTNPVGTEQYGIMASNLQHGDR

SEQ ID NO: 91433 - protein, 28 aa, Artificial Sequence
  Description of Artificial Sequence: Synthetic peptide
QESEIASTNPVGTEQYGIMASTLQSGTR

SEQ ID NO: 91434 - protein, 35 aa, Artificial Sequence
  Description of Artificial Sequence: Synthetic polypeptide
DEEEIRTTNPVATEQYGSFVNSENDQNGNNENMMD

SEQ ID NO: 91435 - protein, 28 aa, Artificial Sequence
  Description of Artificial Sequence: Synthetic peptide
QESEIASTNPVGTEQYGSMASTGQHGNI

SEQ ID NO: 91436 - protein, 28 aa, Artificial Sequence
  Description of Artificial Sequence: Synthetic peptide
QESEIASTNPVGTEQYGSMSSTLQHGDI

SEQ ID NO: 91437 - protein, 35 aa, Artificial Sequence
  Description of Artificial Sequence: Synthetic polypeptide
AEEEIRTTNPVATEQYGSVSTVVNEQQGDEEQIRE

SEQ ID NO: 91438 - protein, 28 aa, Artificial Sequence
  Description of Artificial Sequence: Synthetic peptide
QESEIASTNPVGTEQYGVMASNLQHGDR

SEQ ID NO: 91439 - protein, 28 aa, Artificial Sequence
  Description of Artificial Sequence: Synthetic peptide
QESEIASTNPVGTEQYGVMASTLQHGDR

SEQ ID NO: 91440 - protein, 28 aa, Artificial Sequence
  Description of Artificial Sequence: Synthetic peptide
QESEIASTNPVGTEQYGVMASTLQRGDI

SEQ ID NO: 91441 - protein, 28 aa, Artificial Sequence
  Description of Artificial Sequence: Synthetic peptide
QESEIASTNPVGTEQYGVMSDNLQSGDI

SEQ ID NO: 91442 - protein, 28 aa, Artificial Sequence
  Description of Artificial Sequence: Synthetic peptide
QESEIASTNPVGTEQYGEMAENLQHGGR

SEQ ID NO: 91443 - protein, 36 aa, Artificial Sequence
  Description of Artificial Sequence: Synthetic polypeptide
AEEEIRTTNPVATEQYGSVSTVTNNLNQNNGTNTDE

SEQ ID NO: 91444 - protein, 28 aa, Artificial Sequence
  Description of Artificial Sequence: Synthetic peptide
QESEIAPTNPCSSEQYGIVSCNLQSGTR

SEQ ID NO: 91445 - protein, 34 aa, Artificial Sequence
  Description of Artificial Sequence: Synthetic polypeptide
DEEEIRTTNPVATEQYGSILSTNLVHEPGQVVET

SEQ ID NO: 91446 - protein, 28 aa, Artificial Sequence
  Description of Artificial Sequence: Synthetic peptide
QEPEIATTNPVATECYGDVSECLQHEEL

SEQ ID NO: 91447 - protein, 31 aa, Artificial Sequence
  Description of Artificial Sequence: Synthetic polypeptide
QEPEIKTTNPVATEQYGSVSANAGMEGGNEG

SEQ ID NO: 91448 - protein, 31 aa, Artificial Sequence
  Description of Artificial Sequence: Synthetic polypeptide
QEPEIRATNPVATDQYGDVSTNGQGEGGGNE

SEQ ID NO: 91449 - protein, 32 aa, Artificial Sequence
  Description of Artificial Sequence: Synthetic polypeptide
DEEEIRTTNPVATEQYGSIYLWVLQRDLVEDG

SEQ ID NO: 91450 - protein, 28 aa, Artificial Sequence
  Description of Artificial Sequence: Synthetic peptide
QEQEIAPTNPCSSEQYGCVSCNLQSGTR

SEQ ID NO: 91451 - protein, 28 aa, Artificial Sequence
  Description of Artificial Sequence: Synthetic peptide
QEQEIAPTNPCSSEQYGIVSCNLQSGER

SEQ ID NO: 91452 - protein, 28 aa, Artificial Sequence
  Description of Artificial Sequence: Synthetic peptide
QEQEIAPTNPCSSEQYGIVSCNLQSGTR

SEQ ID NO: 91453 - protein, 29 aa, Artificial Sequence
  Description of Artificial Sequence: Synthetic peptide
QEQEIAPTNPCSTEQYGIVSTNLQSEGEL

SEQ ID NO: 91454 - protein, 36 aa, Artificial Sequence
  Description of Artificial Sequence: Synthetic polypeptide
AEEEIRTTNPVATEQYGSVSTVVNLQNQEQGNQQEE

SEQ ID NO: 91455 - protein, 34 aa, Artificial Sequence
  Description of Artificial Sequence: Synthetic polypeptide
DEEEINTTNPVATEIYGYSASATDNSLFQHRGEF

SEQ ID NO: 91456 - protein, 35 aa, Artificial Sequence
  Description of Artificial Sequence: Synthetic polypeptide
DEEEINTTNPVATEQWGSTVSTNELSQESNGGNQL

SEQ ID NO: 91457 - protein, 30 aa, Artificial Sequence
  Description of Artificial Sequence: Synthetic polypeptide
QEQEIAPTNPCSTEQYGSVSCNLQDSEGTR

SEQ ID NO: 91458 - protein, 30 aa, Artificial Sequence
  Description of Artificial Sequence: Synthetic polypeptide
QEQEIAPTNPVATEQYGIVSTDLQDSEGEL

SEQ ID NO: 91459 - protein, 30 aa, Artificial Sequence
  Description of Artificial Sequence: Synthetic polypeptide
QEQEIAPTNPVATEQYGSVSTDLEDSEGEL

SEQ ID NO: 91460 - protein, 35 aa, Artificial Sequence
  Description of Artificial Sequence: Synthetic polypeptide
DEEEINTTNPVATEQYGETVPSTNELSQESNSGNL

SEQ ID NO: 91461 - protein, 30 aa, Artificial Sequence
  Description of Artificial Sequence: Synthetic polypeptide
QEQEIAPTNPVSTEQYGIVSTNLQDSEGEL

SEQ ID NO: 91462 - protein, 30 aa, Artificial Sequence
  Description of Artificial Sequence: Synthetic polypeptide
QEQEIAPTNPVSTEQYGSVSCNLEDSEGTR

SEQ ID NO: 91463 - protein, 29 aa, Artificial Sequence
  Description of Artificial Sequence: Synthetic peptide
QEQEIASTNPVATEGYGSVASTLQDHGDI

SEQ ID NO: 91464 - protein, 35 aa, Artificial Sequence
  Description of Artificial Sequence: Synthetic polypeptide
AEEEIRTTNPVATEQYGSVSTVVNLQGQEAGEAGN

SEQ ID NO: 91465 - protein, 28 aa, Artificial Sequence
  Description of Artificial Sequence: Synthetic peptide
QEQEIATTNPCSSEQYGIVSCDLQSGTR

SEQ ID NO: 91466 - protein, 29 aa, Artificial Sequence
  Description of Artificial Sequence: Synthetic peptide
QEQEIATTNPVATECYGDVSATCLQHEEL

SEQ ID NO: 91467 - protein, 33 aa, Artificial Sequence
  Description of Artificial Sequence: Synthetic polypeptide
DEEEIKTTNPVAYERYGKVQSQNLFQSGGNNRD

SEQ ID NO: 91468 - protein, 28 aa, Artificial Sequence
  Description of Artificial Sequence: Synthetic peptide
QEPEIAPTNPCSSEQYGIVSCNLQSGTR

SEQ ID NO: 91469 - protein, 28 aa, Artificial Sequence
  Description of Artificial Sequence: Synthetic peptide
QEPEIAPTNPCSSEQYGIVSCNLQSGDR

SEQ ID NO: 91470 - protein, 28 aa, Artificial Sequence
  Description of Artificial Sequence: Synthetic peptide
QEPEIAPTNPCSSEQYGIVSANLQSGTR

SEQ ID NO: 91471 - protein, 29 aa, Artificial Sequence
  Description of Artificial Sequence: Synthetic peptide
QENEIRTTNPVATEPYGTISMCLQQHGEL

SEQ ID NO: 91472 - protein, 28 aa, Artificial Sequence
  Description of Artificial Sequence: Synthetic peptide
QENEIRTTNPVATEQWGDVSEILMAEDA

SEQ ID NO: 91473 - protein, 28 aa, Artificial Sequence
  Description of Artificial Sequence: Synthetic peptide
QENEIRTTNPVATEQWGDVSEILMHEDA

SEQ ID NO: 91474 - protein, 28 aa, Artificial Sequence
  Description of Artificial Sequence: Synthetic peptide
QENEIRTTNPVATEQWGEVSEICQAEEA

SEQ ID NO: 91475 - protein, 34 aa, Artificial Sequence
  Description of Artificial Sequence: Synthetic polypeptide
DEEEIRTTNPVATEQYGSMSATTAGPQRNGMDPI

SEQ ID NO: 91476 - protein, 34 aa, Artificial Sequence
  Description of Artificial Sequence: Synthetic polypeptide
DEEEIRTTNPVATEQYGSMSATSAGPQRNGMDPI

SEQ ID NO: 91477 - protein, 36 aa, Artificial Sequence
  Description of Artificial Sequence: Synthetic polypeptide
AEEEIRTTNPVATEQYGSVSTVVNLQQNEQGEEGNE

SEQ ID NO: 91478 - protein, 33 aa, Artificial Sequence
  Description of Artificial Sequence: Synthetic polypeptide
DEEEIRTTNPVATEQYGSMATSAGPQRNGMDPI

SEQ ID NO: 91479 - protein, 32 aa, Artificial Sequence
  Description of Artificial Sequence: Synthetic polypeptide
DEEEIRTTNPVATEQYGSMAEPTNMVIRLVGE

SEQ ID NO: 91480 - protein, 29 aa, Artificial Sequence
  Description of Artificial Sequence: Synthetic peptide
QENEIRTTNPVSTEQYGEISEEVCQQGNK

SEQ ID NO: 91481 - protein, 28 aa, Artificial Sequence
  Description of Artificial Sequence: Synthetic peptide
QEQEIATTNPVATECYGDVSECLQHEEL

SEQ ID NO: 91482 - protein, 28 aa, Artificial Sequence
  Description of Artificial Sequence: Synthetic peptide
QENEISTTNPVATECYGDVSECLQHEEL

SEQ ID NO: 91483 - protein, 35 aa, Artificial Sequence
  Description of Artificial Sequence: Synthetic polypeptide
DEEEIKTTNPVATEQYGSVSTGGQLQQEEMGNGEN

SEQ ID NO: 91484 - protein, 30 aa, Artificial Sequence
  Description of Artificial Sequence: Synthetic polypeptide
QENEIVTTNPVATEQYGTVCSTDCLEHENL

SEQ ID NO: 91485 - protein, 35 aa, Artificial Sequence
  Description of Artificial Sequence: Synthetic polypeptide
DEEEIKTTNPVATEQYGSVSTTGGQLQEEMGNGEV

SEQ ID NO: 91486 - protein, 33 aa, Artificial Sequence
  Description of Artificial Sequence: Synthetic polypeptide
DEEEIKTTNPVATERYGKVVSLTGNLSDAGGNS

SEQ ID NO: 91487 - protein, 34 aa, Artificial Sequence
  Description of Artificial Sequence: Synthetic polypeptide
DEEEIRTTNPVATEQYGSLSPTNIGLRFGQVQDE

SEQ ID NO: 91488 - protein, 35 aa, Artificial Sequence
  Description of Artificial Sequence: Synthetic polypeptide
DEEEIRTTNPVATEQYGSLSPTNIGLMRFGQSQFD

SEQ ID NO: 91489 - protein, 34 aa, Artificial Sequence
  Description of Artificial Sequence: Synthetic polypeptide
DEEEIRTTNPVATEQYGSLSPTNIGARFGQLQEE

SEQ ID NO: 91490 - protein, 34 aa, Artificial Sequence
  Description of Artificial Sequence: Synthetic polypeptide
DEEEIRTTNPVATEQYGSLSPTNEGERFGQVQFE

SEQ ID NO: 91491 - protein, 28 aa, Artificial Sequence
  Description of Artificial Sequence: Synthetic peptide
QENVIATTNPVATECYGSVSECLQHEEL

SEQ ID NO: 91492 - protein, 35 aa, Artificial Sequence
  Description of Artificial Sequence: Synthetic polypeptide
DEEEIRTTNPVATEQYGSLCASTNKDQQRDLNFQN

SEQ ID NO: 91493 - protein, 28 aa, Artificial Sequence
  Description of Artificial Sequence: Synthetic peptide
QENEISTTNPVATECYGGVSEFLQHEEG

SEQ ID NO: 91494 - protein, 28 aa, Artificial Sequence
  Description of Artificial Sequence: Synthetic peptide
QESEIAPTNPCSSEQYGIVSCNEQSGNR

SEQ ID NO: 91495 - protein, 28 aa, Artificial Sequence
  Description of Artificial Sequence: Synthetic peptide
QEQEIATTNPVATECYGDVSQCLQHEEL

SEQ ID NO: 91496 - protein, 29 aa, Artificial Sequence
  Description of Artificial Sequence: Synthetic peptide
QEQEIATTNPVATECYGSVSAEDLQHEEL

SEQ ID NO: 91497 - protein, 34 aa, Artificial Sequence
  Description of Artificial Sequence: Synthetic polypeptide
AEEEIRTTNPVATEQYGSVSTVVNLENADEQIRE

SEQ ID NO: 91498 - protein, 34 aa, Artificial Sequence
  Description of Artificial Sequence: Synthetic polypeptide
DEEEIRTTNPVATEQYGSISLTPNDQQNAGVQLV

SEQ ID NO: 91499 - protein, 28 aa, Artificial Sequence
  Description of Artificial Sequence: Synthetic peptide
QEREIAPTNPCSSEQYGIVSCNLQSGTR

SEQ ID NO: 91500 - protein, 28 aa, Artificial Sequence
  Description of Artificial Sequence: Synthetic peptide
QEREIAPTNPCSYEQYGIVSCNLQSGVR

SEQ ID NO: 91501 - protein, 33 aa, Artificial Sequence
  Description of Artificial Sequence: Synthetic polypeptide
DEEEIRATNPVATEPYGAVSTPNLQQESVNSMI

SEQ ID NO: 91502 - protein, 34 aa, Artificial Sequence
  Description of Artificial Sequence: Synthetic polypeptide
DEEEIRATNPVATEPYGSVCIVNDQHDRQGSNMR

SEQ ID NO: 91503 - protein, 28 aa, Artificial Sequence
  Description of Artificial Sequence: Synthetic peptide
QEREIATTNPVATECYGDVSECLQHEEL

SEQ ID NO: 91504 - protein, 28 aa, Artificial Sequence
  Description of Artificial Sequence: Synthetic peptide
QESEIACTNPVATEGYGVAAENLQHGDR

SEQ ID NO: 91505 - protein, 28 aa, Artificial Sequence
  Description of Artificial Sequence: Synthetic peptide
QESEIACTNPVATEGYGVMASNLQHGDR

SEQ ID NO: 91506 - protein, 34 aa, Artificial Sequence
  Description of Artificial Sequence: Synthetic polypeptide
AEEEIRTTNPVATEQYGSVSTVVNGNNDEGNNDD

SEQ ID NO: 91507 - protein, 28 aa, Artificial Sequence
  Description of Artificial Sequence: Synthetic peptide
QESEIACTNPVATEQYGEMAETLQRGDI

SEQ ID NO: 91508 - protein, 28 aa, Artificial Sequence
  Description of Artificial Sequence: Synthetic peptide
QESEIACTNPVATEQYGVAAETLQHGDR

SEQ ID NO: 91509 - protein, 28 aa, Artificial Sequence
  Description of Artificial Sequence: Synthetic peptide
QESEIACTNPVATEQYGVMAETLQHGDR

SEQ ID NO: 91510 - protein, 28 aa, Artificial Sequence
  Description of Artificial Sequence: Synthetic peptide
QESEIACTNPVATEQYGVMASTLQHGDI

SEQ ID NO: 91511 - protein, 28 aa, Artificial Sequence
  Description of Artificial Sequence: Synthetic peptide
QESEIACTNPVATEQYGVVASTLMHGDI

SEQ ID NO: 91512 - protein, 28 aa, Artificial Sequence
  Description of Artificial Sequence: Synthetic peptide
QESEIACTNPVGTEGYGEMAENLQRGDR

SEQ ID NO: 91513 - protein, 34 aa, Artificial Sequence
  Description of Artificial Sequence: Synthetic polypeptide
DEEEIRTTNPVATEQYGSIPSESPQMLQIQNDRT

SEQ ID NO: 91514 - protein, 28 aa, Artificial Sequence
  Description of Artificial Sequence: Synthetic peptide
QESEIACTNPVGTEGYGVASSNLQRGDI

SEQ ID NO: 91515 - protein, 28 aa, Artificial Sequence
  Description of Artificial Sequence: Synthetic peptide
QESEIACTNPVGTEQYGVASETLQHGGR

SEQ ID NO: 91516 - protein, 28 aa, Artificial Sequence
  Description of Artificial Sequence: Synthetic peptide
QESEIAPTNPCGTEQYGIVSCTLQSGTR

SEQ ID NO: 91517 - protein, 28 aa, Artificial Sequence
  Description of Artificial Sequence: Synthetic peptide
QESEIAPTNPCGTEQYGIVSSTLQSGTR

SEQ ID NO: 91518 - protein, 31 aa, Artificial Sequence
  Description of Artificial Sequence: Synthetic polypeptide
QEQEIATTNPVSTEQYGSVSTNLEDSEGEDL

SEQ ID NO: 91519 - protein, 31 aa, Artificial Sequence
  Description of Artificial Sequence: Synthetic polypeptide
QEQEIATTNPVSTEQYGSVSATDLEDHGEDR

SEQ ID NO: 91520 - protein, 30 aa, Artificial Sequence
  Description of Artificial Sequence: Synthetic polypeptide
QEQEIATTNPVSTEQYGSVSACDLQSGTDL

SEQ ID NO: 91521 - protein, 34 aa, Artificial Sequence
  Description of Artificial Sequence: Synthetic polypeptide
DEEEIRATNPVATDQYGFVSMTNLFQTGIGENQY

SEQ ID NO: 91522 - protein, 30 aa, Artificial Sequence
  Description of Artificial Sequence: Synthetic polypeptide
QEQEIATTNPVATECYGSVSATCLQHEEEL

SEQ ID NO: 91523 - protein, 28 aa, Artificial Sequence
  Description of Artificial Sequence: Synthetic peptide
QEQEIATTNPVATECYGSVSECLEHEEL

SEQ ID NO: 91524 - protein, 31 aa, Artificial Sequence
  Description of Artificial Sequence: Synthetic polypeptide
DEEEIRTTNPVATEQYGSITWTWLESYEEQE

SEQ ID NO: 91525 - protein, 31 aa, Artificial Sequence
  Description of Artificial Sequence: Synthetic polypeptide
QEQEIATTNPVATEQYGDVSATDLQDHEGEL

SEQ ID NO: 91526 - protein, 34 aa, Artificial Sequence
  Description of Artificial Sequence: Synthetic polypeptide
DEEEIRTTNPVATEQYGSISTTPLQVQRQMQELM

SEQ ID NO: 91527 - protein, 34 aa, Artificial Sequence
  Description of Artificial Sequence: Synthetic polypeptide
DEEEIRTTNPVATEQYGSISTTANLVQVEPMLFD

SEQ ID NO: 91528 - protein, 31 aa, Artificial Sequence
  Description of Artificial Sequence: Synthetic polypeptide
QEQEIATTNPVATEQYGSVSAEDLQDHEGEL

SEQ ID NO: 91529 - protein, 31 aa, Artificial Sequence
  Description of Artificial Sequence: Synthetic polypeptide
QEQEIATTNPVATEQYGSVSAEDLQHEGEDL

SEQ ID NO: 91530 - protein, 31 aa, Artificial Sequence
  Description of Artificial Sequence: Synthetic polypeptide
QEQEIATTNPVATEQYGSVSATCLEHEGEDL

SEQ ID NO: 91531 - protein, 31 aa, Artificial Sequence
  Description of Artificial Sequence: Synthetic polypeptide
QEQEIATTNPVATEQYGSVSATDLEDHGEDL

SEQ ID NO: 91532 - protein, 28 aa, Artificial Sequence
  Description of Artificial Sequence: Synthetic peptide
QEQEIATTNPVATECYGEVSECLQHEET

SEQ ID NO: 91533 - protein, 35 aa, Artificial Sequence
  Description of Artificial Sequence: Synthetic polypeptide
DEEEINTTNPVAYEQYGSTVPSTNELSQESNGGNL

SEQ ID NO: 91534 - protein, 34 aa, Artificial Sequence
  Description of Artificial Sequence: Synthetic polypeptide
DEEEIQCTNPVAYEQYGSVVQSYCNEQDRGGNNR

SEQ ID NO: 91535 - protein, 31 aa, Artificial Sequence
  Description of Artificial Sequence: Synthetic polypeptide
QEQEIATTNPVATEQYGSVSATDLQDHEEEL

SEQ ID NO: 91536 - protein, 32 aa, Artificial Sequence
  Description of Artificial Sequence: Synthetic polypeptide
QEQEIATTNPVATEQYGSVSATDLQDHEGEDL

SEQ ID NO: 91537 - protein, 36 aa, Artificial Sequence
  Description of Artificial Sequence: Synthetic polypeptide
AEEEIRTTNPVATEQYGSVSTVVNLNAQEQGTNNVE

SEQ ID NO: 91538 - protein, 31 aa, Artificial Sequence
  Description of Artificial Sequence: Synthetic polypeptide
QEQEIATTNPVATEQYGSVSTDLEDSEGEDL

SEQ ID NO: 91539 - protein, 35 aa, Artificial Sequence
  Description of Artificial Sequence: Synthetic polypeptide
AEEEIRTTNPVATEQYGSVSTVVNLGNQIGTEQGA

SEQ ID NO: 91540 - protein, 35 aa, Artificial Sequence
  Description of Artificial Sequence: Synthetic polypeptide
AEEEIRTTNPVATEQYGSVSTVVNLGNQADEEIRE

SEQ ID NO: 91541 - protein, 29 aa, Artificial Sequence
  Description of Artificial Sequence: Synthetic peptide
QEQEIATTNPVGTEGYGSVASTLQDHGDL

SEQ ID NO: 91542 - protein, 34 aa, Artificial Sequence
  Description of Artificial Sequence: Synthetic polypeptide
DEEEIRTTNPVATEQYGSISQVTNTLQVVEVMTD

SEQ ID NO: 91543 - protein, 32 aa, Artificial Sequence
  Description of Artificial Sequence: Synthetic polypeptide
DEEEIRATNPCTTEQYGSVSTNNATEIGTNDN

SEQ ID NO: 91544 - protein, 34 aa, Artificial Sequence
  Description of Artificial Sequence: Synthetic polypeptide
DEEEINTTNPVAYEQYGSVCCTGNVSYNRGGTNR

SEQ ID NO: 91545 - protein, 30 aa, Artificial Sequence
  Description of Artificial Sequence: Synthetic polypeptide
QENEIATTNPVATECYGTVSATCLVQFGEL

SEQ ID NO: 91546 - protein, 32 aa, Artificial Sequence
  Description of Artificial Sequence: Synthetic polypeptide
SEEEIACTNPVATEAYGSVATNLQDAGGDQNH

SEQ ID NO: 91547 - protein, 32 aa, Artificial Sequence
  Description of Artificial Sequence: Synthetic polypeptide
SEEEIACTNPVATEAYGSVATNLQNNGENAEN

SEQ ID NO: 91548 - protein, 35 aa, Artificial Sequence
  Description of Artificial Sequence: Synthetic polypeptide
AEEEIRTTNPVATEQYGSVSTTQNQGQIGTTNAEQ

SEQ ID NO: 91549 - protein, 34 aa, Artificial Sequence
  Description of Artificial Sequence: Synthetic polypeptide
AEEEIRTTNPVATEQYGSVSTTQNQEQQGTIATE

SEQ ID NO: 91550 - protein, 34 aa, Artificial Sequence
  Description of Artificial Sequence: Synthetic polypeptide
DEEEIRTTNPVATEQYGMVSTTDEGGQGEGGNQD

SEQ ID NO: 91551 - protein, 35 aa, Artificial Sequence
  Description of Artificial Sequence: Synthetic polypeptide
AEEEIRTTNPVATEQYGSVSTTQNNQQQTGTNNNE

SEQ ID NO: 91552 - protein, 35 aa, Artificial Sequence
  Description of Artificial Sequence: Synthetic polypeptide
AEEEIRTTNPVATEQYGSVSTTQNNNQQQIGNNEG

SEQ ID NO: 91553 - protein, 35 aa, Artificial Sequence
  Description of Artificial Sequence: Synthetic polypeptide
AEEEIRTTNPVATEQYGSVSTTQNNNEQGNGNNQD

SEQ ID NO: 91554 - protein, 32 aa, Artificial Sequence
  Description of Artificial Sequence: Synthetic polypeptide
DEEEIRSTNPVATEQYGSVQGNGQDEGGQIST

SEQ ID NO: 91555 - protein, 36 aa, Artificial Sequence
  Description of Artificial Sequence: Synthetic polypeptide
AEEEIRTTNPVATEQYGSVSTTQNLQQQIGNNNNTE

SEQ ID NO: 91556 - protein, 34 aa, Artificial Sequence
  Description of Artificial Sequence: Synthetic polypeptide
DEEEIRTTNPVATEQYGMVSTNMNGEMQEGGGED

SEQ ID NO: 91557 - protein, 36 aa, Artificial Sequence
  Description of Artificial Sequence: Synthetic polypeptide
AEEEIRTTNPVATEQYGSVSTTQNLNQQTIGTNNNE

SEQ ID NO: 91558 - protein, 34 aa, Artificial Sequence
  Description of Artificial Sequence: Synthetic polypeptide
DEEEIRSTNPVATEQYGSVSNVNLDVNFGENGQE

SEQ ID NO: 91559 - protein, 36 aa, Artificial Sequence
  Description of Artificial Sequence: Synthetic polypeptide
AEEEIRTTNPVATEQYGSVSTTQNLNQQGTNNNEAG

SEQ ID NO: 91560 - protein, 34 aa, Artificial Sequence
  Description of Artificial Sequence: Synthetic polypeptide
DEEEIRSTNPVATEQYGSVSSTTNGNMSNGMNPV

SEQ ID NO: 91561 - protein, 34 aa, Artificial Sequence
  Description of Artificial Sequence: Synthetic polypeptide
AEEEIRTTNPVATEQYGSVSTTQLQQGEQIGEGN

SEQ ID NO: 91562 - protein, 35 aa, Artificial Sequence
  Description of Artificial Sequence: Synthetic polypeptide
DEEEIRSTNPVATEQYGSVSSTTPALPNMRNGMNV

SEQ ID NO: 91563 - protein, 35 aa, Artificial Sequence
  Description of Artificial Sequence: Synthetic polypeptide
DEEEIRSTNPVATEQYGSVSTGGLGQGETGGNGNG

SEQ ID NO: 91564 - protein, 34 aa, Artificial Sequence
  Description of Artificial Sequence: Synthetic polypeptide
DEEEIRSTNPVATEQYGSVSTQDDGQQTGGGENT

SEQ ID NO: 91565 - protein, 33 aa, Artificial Sequence
  Description of Artificial Sequence: Synthetic polypeptide
DEEEIRSTNPVATEQYGSVSTQGVGDTGGQNGE

SEQ ID NO: 91566 - protein, 34 aa, Artificial Sequence
  Description of Artificial Sequence: Synthetic polypeptide
DEEEIRSTNPVATEQYGSVSTTGMGQEGGTNNGE

SEQ ID NO: 91567 - protein, 34 aa, Artificial Sequence
  Description of Artificial Sequence: Synthetic polypeptide
DEEEIRTTNPVATEQYGMVSTGNMQQNEGGQGGT

SEQ ID NO: 91568 - protein, 34 aa, Artificial Sequence
  Description of Artificial Sequence: Synthetic polypeptide
DEEEIRSTNPVATEQYGSVSTTPAGNMRNGMNPV

SEQ ID NO: 91569 - protein, 34 aa, Artificial Sequence
  Description of Artificial Sequence: Synthetic polypeptide
AEEEIRTTNPVATEQYGSVSTTQNQLQNEDEQEN

SEQ ID NO: 91570 - protein, 35 aa, Artificial Sequence
  Description of Artificial Sequence: Synthetic polypeptide
DEEEIRTTNPVATEQYGMVSTGNGGQGGNEGNGVS

SEQ ID NO: 91571 - protein, 35 aa, Artificial Sequence
  Description of Artificial Sequence: Synthetic polypeptide
AEEEIRTTNPVATEQYGSVSTTQNQQASEEGTNVE

SEQ ID NO: 91572 - protein, 34 aa, Artificial Sequence
  Description of Artificial Sequence: Synthetic polypeptide
DEEEIRSTNPVATEQYGNVSTTPAIQMRVGMNPV

SEQ ID NO: 91573 - protein, 34 aa, Artificial Sequence
  Description of Artificial Sequence: Synthetic polypeptide
DEEEIRTTNPVATEQYGNVMTTNMGQEGGGNQGE

SEQ ID NO: 91574 - protein, 34 aa, Artificial Sequence
  Description of Artificial Sequence: Synthetic polypeptide
DEEEIRTTNPVATEQYGNVMTTNMGQEGGGNNGE

SEQ ID NO: 91575 - protein, 33 aa, Artificial Sequence
  Description of Artificial Sequence: Synthetic polypeptide
AEEEIRTTNPVATEQYGSVSTTTDEQGNIDEQS

SEQ ID NO: 91576 - protein, 33 aa, Artificial Sequence
  Description of Artificial Sequence: Synthetic polypeptide
DEEEIRTTNPVATEQYGNVMTGIGNDQQENENV

SEQ ID NO: 91577 - protein, 36 aa, Artificial Sequence
  Description of Artificial Sequence: Synthetic polypeptide
AEEEIRTTNPVATEQYGSVSTTSTNLQQGSTNGETQ

SEQ ID NO: 91578 - protein, 35 aa, Artificial Sequence
  Description of Artificial Sequence: Synthetic polypeptide
DEEEIRTTNPVATEQYGNVMGTMNLNQEGGGENST

SEQ ID NO: 91579 - protein, 32 aa, Artificial Sequence
  Description of Artificial Sequence: Synthetic polypeptide
DEEEIRSTNPVATEQYGDVSSTQGTGGNGNGD

SEQ ID NO: 91580 - protein, 34 aa, Artificial Sequence
  Description of Artificial Sequence: Synthetic polypeptide
AEEEIRTTNPVATEQYGSVSTTSNQEQGTNNVTE

SEQ ID NO: 91581 - protein, 37 aa, Artificial Sequence
  Description of Artificial Sequence: Synthetic polypeptide
DEEEIRSTNPVATEQYGESMVTGTPNGLDTQRPGDNR

SEQ ID NO: 91582 - protein, 35 aa, Artificial Sequence
  Description of Artificial Sequence: Synthetic polypeptide
AEEEIRTTNPVATEQYGSVSTTSNLQQQEEGEAGN

SEQ ID NO: 91583 - protein, 35 aa, Artificial Sequence
  Description of Artificial Sequence: Synthetic polypeptide
AEEEIRTTNPVATEQYGSVSTTSNLGANNNGNNEG

SEQ ID NO: 91584 - protein, 33 aa, Artificial Sequence
  Description of Artificial Sequence: Synthetic polypeptide
DEEEIRTTNPVATEQYGMYTIMTNGGQEGGNQG

SEQ ID NO: 91585 - protein, 33 aa, Artificial Sequence
  Description of Artificial Sequence: Synthetic polypeptide
DEEEIRTTNPVATEQYGMYTIMTNGGQEGGENG

SEQ ID NO: 91586 - protein, 33 aa, Artificial Sequence
  Description of Artificial Sequence: Synthetic polypeptide
DEEEIRTTNPVATEQYGMVTVTGSGNSEIGGNG

SEQ ID NO: 91587 - protein, 33 aa, Artificial Sequence
  Description of Artificial Sequence: Synthetic polypeptide
DEEEIRSTNPVATEQYGNVATTPAIQMRVGNPV

SEQ ID NO: 91588 - protein, 34 aa, Artificial Sequence
  Description of Artificial Sequence: Synthetic polypeptide
DEEEIRTTNPVATEQYGMVTSNENFEQGGGGNQG

SEQ ID NO: 91589 - protein, 34 aa, Artificial Sequence
  Description of Artificial Sequence: Synthetic polypeptide
DEEEIRSTNPVATEQYGNVSTTPAIQMRNGMNPV

SEQ ID NO: 91590 - protein, 34 aa, Artificial Sequence
  Description of Artificial Sequence: Synthetic polypeptide
DEEEIRTTNPVATEQYGMVSVTGSGNFEIGGNDG

SEQ ID NO: 91591 - protein, 34 aa, Artificial Sequence
  Description of Artificial Sequence: Synthetic polypeptide
AEEEIRTTNPVATEQYGSVSTTQQQLNQIENNSE

SEQ ID NO: 91592 - protein, 34 aa, Artificial Sequence
  Description of Artificial Sequence: Synthetic polypeptide
AEEEIRTTNPVATEQYGSVSTTQQLQEISTENNN

SEQ ID NO: 91593 - protein, 33 aa, Artificial Sequence
  Description of Artificial Sequence: Synthetic polypeptide
AEEEIRTTNPVATEQYGSVSTTQQLQEDTETEV

SEQ ID NO: 91594 - protein, 35 aa, Artificial Sequence
  Description of Artificial Sequence: Synthetic polypeptide
DEEEIRTTNPVATEQYGMVSTVNLVGITGGNNGQG

SEQ ID NO: 91595 - protein, 34 aa, Artificial Sequence
  Description of Artificial Sequence: Synthetic polypeptide
DEEEIRTTNPVATEQYGMVSTGIGGQSGNGDEED

SEQ ID NO: 91596 - protein, 34 aa, Artificial Sequence
  Description of Artificial Sequence: Synthetic polypeptide
DEEEIRTTNPVATEQYGMVSTGIGGQNGGDENDD

SEQ ID NO: 91597 - protein, 33 aa, Artificial Sequence
  Description of Artificial Sequence: Synthetic polypeptide
DEEEIRTTNPVATEQYGMVSTGIGGQGNDNDVF

SEQ ID NO: 91598 - protein, 33 aa, Artificial Sequence
  Description of Artificial Sequence: Synthetic polypeptide
DEEEIRTTNPVATEQYGMVSISELNGQEGGGGE

SEQ ID NO: 91599 - protein, 34 aa, Artificial Sequence
  Description of Artificial Sequence: Synthetic polypeptide
DEEEIRTTNPVATEQYGMVSIMTVGQTGNGNNQG

SEQ ID NO: 91600 - protein, 34 aa, Artificial Sequence
  Description of Artificial Sequence: Synthetic polypeptide
DEEEIRTTNPVATEQYGMVSIMTVGQNGGNGNQN

SEQ ID NO: 91601 - protein, 33 aa, Artificial Sequence
  Description of Artificial Sequence: Synthetic polypeptide
DEEEIRTTNPVATEQYGMVSIMTGVGQTNNEQN

SEQ ID NO: 91602 - protein, 34 aa, Artificial Sequence
  Description of Artificial Sequence: Synthetic polypeptide
DEEEIRTTNPVATEQYGMVSIMTGVGQTGNNGEN

SEQ ID NO: 91603 - protein, 33 aa, Artificial Sequence
  Description of Artificial Sequence: Synthetic polypeptide
DEEEIRTTNPVATEQYGMVSIMTGVGQTENGQG

SEQ ID NO: 91604 - protein, 33 aa, Artificial Sequence
  Description of Artificial Sequence: Synthetic polypeptide
DEEEIRTTNPVATEQYGMVSIMTGIGQGTNGQN

SEQ ID NO: 91605 - protein, 34 aa, Artificial Sequence
  Description of Artificial Sequence: Synthetic polypeptide
DEEEIRTTNPVATEQYGMVSIMTDVGQTGNGGQN

SEQ ID NO: 91606 - protein, 34 aa, Artificial Sequence
  Description of Artificial Sequence: Synthetic polypeptide
DEEEIRTTNPVATEQYGMVSIMTDVGQTDNGNQN

SEQ ID NO: 91607 - protein, 35 aa, Artificial Sequence
  Description of Artificial Sequence: Synthetic polypeptide
AEEEIRTTNPVATEQYGSVSTTNSQQGNQQGNNDA

SEQ ID NO: 91608 - protein, 32 aa, Artificial Sequence
  Description of Artificial Sequence: Synthetic polypeptide
DEEEIRTTNPVATEQYGMVSIFTVGVGNNQQN

SEQ ID NO: 91609 - protein, 34 aa, Artificial Sequence
  Description of Artificial Sequence: Synthetic polypeptide
DEEEIRTTNPVATEQYGMVSIFTNGDQNEIEDNT

SEQ ID NO: 91610 - protein, 33 aa, Artificial Sequence
  Description of Artificial Sequence: Synthetic polypeptide
DEEEIRTTNPVATEQYGMVSIFTGVGQTNGEGN

SEQ ID NO: 91611 - protein, 36 aa, Artificial Sequence
  Description of Artificial Sequence: Synthetic polypeptide
AEEEIRTTNPVATEQYGSVSTTNSNLNNEQAGNNVE

SEQ ID NO: 91612 - protein, 34 aa, Artificial Sequence
  Description of Artificial Sequence: Synthetic polypeptide
DEEEIRTTNPVATEQYGMVSIFTGVGQTGNENEN

SEQ ID NO: 91613 - protein, 34 aa, Artificial Sequence
  Description of Artificial Sequence: Synthetic polypeptide
DEEEIRTTNPVATEQYGMVSIFTGVGQTGENIQN

SEQ ID NO: 91614 - protein, 33 aa, Artificial Sequence
  Description of Artificial Sequence: Synthetic polypeptide
DEEEIRTTNPVATEQYGMVSIFTGVGQTEINQN

SEQ ID NO: 91615 - protein, 33 aa, Artificial Sequence
  Description of Artificial Sequence: Synthetic polypeptide
DEEEIRTTNPVATEQYGMVSIFTGVGQTEGDQN

SEQ ID NO: 91616 - protein, 33 aa, Artificial Sequence
  Description of Artificial Sequence: Synthetic polypeptide
DEEEIRTTNPVATEQYGMVSIFTGVGQGNNGQN

SEQ ID NO: 91617 - protein, 33 aa, Artificial Sequence
  Description of Artificial Sequence: Synthetic polypeptide
DEEEIRTTNPVATEQYGMVSIFTGVGQGDENQN

SEQ ID NO: 91618 - protein, 33 aa, Artificial Sequence
  Description of Artificial Sequence: Synthetic polypeptide
DEEEIRTTNPVATEQYGMVSIFTGIGQGNEGQN

SEQ ID NO: 91619 - protein, 36 aa, Artificial Sequence
  Description of Artificial Sequence: Synthetic polypeptide
AEEEIRTTNPVATEQYGSVSTTNTNLQQGSTDGNTQ

SEQ ID NO: 91620 - protein, 33 aa, Artificial Sequence
  Description of Artificial Sequence: Synthetic polypeptide
DEEEIRTTNPVATEQYGMVSITVGMTGNGNEQN

SEQ ID NO: 91621 - protein, 34 aa, Artificial Sequence
  Description of Artificial Sequence: Synthetic polypeptide
DEEEIRTTNPVATEQYGMVSIVNLNLNEGENGQG

SEQ ID NO: 91622 - protein, 33 aa, Artificial Sequence
  Description of Artificial Sequence: Synthetic polypeptide
DEEEIRTTNPVATEQYGMVSNENFGDDEGNNEQ

SEQ ID NO: 91623 - protein, 34 aa, Artificial Sequence
  Description of Artificial Sequence: Synthetic polypeptide
DEEEIRTTNPVATEQYGMVSTGIGGQGGNDNGVS

SEQ ID NO: 91624 - protein, 34 aa, Artificial Sequence
  Description of Artificial Sequence: Synthetic polypeptide
DEEEIRTTNPVATEQYGMVSTGIGGQGGNDDNES

SEQ ID NO: 91625 - protein, 33 aa, Artificial Sequence
  Description of Artificial Sequence: Synthetic polypeptide
DEEEIRSTNPVATEQYGSVSVDEGQDEGGQNST

SEQ ID NO: 91626 - protein, 35 aa, Artificial Sequence
  Description of Artificial Sequence: Synthetic polypeptide
DEEEIRSTNPVATEQYGSVTDGTGNLNQTNGGNIQ

SEQ ID NO: 91627 - protein, 33 aa, Artificial Sequence
  Description of Artificial Sequence: Synthetic polypeptide
AEEEIRTTNPVATEQYGSVSTTQGVNQQGEEES

SEQ ID NO: 91628 - protein, 35 aa, Artificial Sequence
  Description of Artificial Sequence: Synthetic polypeptide
AEEEIRTTNPVATEQYGSVSTTQGGNNNQQGDNGS

SEQ ID NO: 91629 - protein, 35 aa, Artificial Sequence
  Description of Artificial Sequence: Synthetic polypeptide
DEEEIRSTNPVATEQYGTVSNTGNLQSDVGGNGGT

SEQ ID NO: 91630 - protein, 29 aa, Artificial Sequence
  Description of Artificial Sequence: Synthetic peptide
DEEEIRSTNPVATEQYGVVSDIEMNAEDA

SEQ ID NO: 91631 - protein, 33 aa, Artificial Sequence
  Description of Artificial Sequence: Synthetic polypeptide
DEEEIRTTNPVATEQYGMVSTDIMDDGNGGEID

SEQ ID NO: 91632 - protein, 34 aa, Artificial Sequence
  Description of Artificial Sequence: Synthetic polypeptide
DEEEIRSTNPVATEQYGVVSSTTPALPNMRGMNV

SEQ ID NO: 91633 - protein, 35 aa, Artificial Sequence
  Description of Artificial Sequence: Synthetic polypeptide
AEEEIRTTNPVATEQYGSVSTTTELGNQAGTTNTG

SEQ ID NO: 91634 - protein, 33 aa, Artificial Sequence
  Description of Artificial Sequence: Synthetic polypeptide
AEEEIRTTNPVATEQYGSVSTTNVNDNEETGTD

SEQ ID NO: 91635 - protein, 32 aa, Artificial Sequence
  Description of Artificial Sequence: Synthetic polypeptide
DEEEIRSTNPVATEQYGVVYGNGQDEGGQNST

SEQ ID NO: 91636 - protein, 34 aa, Artificial Sequence
  Description of Artificial Sequence: Synthetic polypeptide
DEEEIRTTNPVATEQYGMVSNMNNEGQIGGNGEG

SEQ ID NO: 91637 - protein, 34 aa, Artificial Sequence
  Description of Artificial Sequence: Synthetic polypeptide
DEEEIRTTNPVATEQYGMVSNMNLGQMTGGEGEI

SEQ ID NO: 91638 - protein, 34 aa, Artificial Sequence
  Description of Artificial Sequence: Synthetic polypeptide
DEEEIRTTNPVATEQYGMVSNMNLGQDIGGQGET

SEQ ID NO: 91639 - protein, 34 aa, Artificial Sequence
  Description of Artificial Sequence: Synthetic polypeptide
DEEEIRTTNPVATEQYGMVSNMNLEMQEGGGETD

SEQ ID NO: 91640 - protein, 35 aa, Artificial Sequence
  Description of Artificial Sequence: Synthetic polypeptide
AEEEIRTTNPVATEQYGSVSTTNTNQQGTENNEDN

SEQ ID NO: 91641 - protein, 34 aa, Artificial Sequence
  Description of Artificial Sequence: Synthetic polypeptide
DEEEIRTTNPVATEQYGMVSNMNFGQNIGGNGEN

SEQ ID NO: 91642 - protein, 33 aa, Artificial Sequence
  Description of Artificial Sequence: Synthetic polypeptide
DEEEIRTTNPVATEQYGMVSNMNFEDDGNNEQT

SEQ ID NO: 91643 - protein, 32 aa, Artificial Sequence
  Description of Artificial Sequence: Synthetic polypeptide
DEEEIRTTNPVATEQYGMVSNENFGEDGGGQE

SEQ ID NO: 91644 - protein, 33 aa, Artificial Sequence
  Description of Artificial Sequence: Synthetic polypeptide
DEEEIRTTNPVATEQYGMVSNENFGDEDGGGNE

SEQ ID NO: 91645 - protein, 35 aa, Artificial Sequence
  Description of Artificial Sequence: Synthetic polypeptide
AEEEIRTTNPVATEQYGSVSTTNTTNQLGGTNEEV

SEQ ID NO: 91646 - protein, 34 aa, Artificial Sequence
  Description of Artificial Sequence: Synthetic polypeptide
DEEEIRTTNPVATEQYGNVSATTAGPQSRNGMQV

SEQ ID NO: 91647 - protein, 34 aa, Artificial Sequence
  Description of Artificial Sequence: Synthetic polypeptide
DEEEIRTTNPVATEQYGNVSATTAIPQSRNGMQV

SEQ ID NO: 91648 - protein, 35 aa, Artificial Sequence
  Description of Artificial Sequence: Synthetic polypeptide
AEEEIRTTNPVATEQYGSVSTTTNDNQNDEGTNDE

SEQ ID NO: 91649 - protein, 34 aa, Artificial Sequence
  Description of Artificial Sequence: Synthetic polypeptide
SEEEIRCTNPIATEQYGSVPSCENMLSMRGGNNR

SEQ ID NO: 91650 - protein, 33 aa, Artificial Sequence
  Description of Artificial Sequence: Synthetic polypeptide
AEEEIRTTNPVATEQYGSVSTTTVTNQAGTSTG

SEQ ID NO: 91651 - protein, 33 aa, Artificial Sequence
  Description of Artificial Sequence: Synthetic polypeptide
AEEEIRTTNPVATEQYGSVSTTTVLNNAEGTTG

SEQ ID NO: 91652 - protein, 33 aa, Artificial Sequence
  Description of Artificial Sequence: Synthetic polypeptide
AEEEIRTTNPVATEQYGSVSTTTVLNANGTETG

SEQ ID NO: 91653 - protein, 36 aa, Artificial Sequence
  Description of Artificial Sequence: Synthetic polypeptide
AEEEIRTTNPVATEQYGSVSTTTTNLQAGDEAGNTE

SEQ ID NO: 91654 - protein, 32 aa, Artificial Sequence
  Description of Artificial Sequence: Synthetic polypeptide
SEEEIRCTNPIATEQYGSVSAEDLEDREGEDR

SEQ ID NO: 91655 - protein, 36 aa, Artificial Sequence
  Description of Artificial Sequence: Synthetic polypeptide
AEEEIRTTNPVATEQYGSVSTTTQNLQAGDEAGNEN

SEQ ID NO: 91656 - protein, 34 aa, Artificial Sequence
  Description of Artificial Sequence: Synthetic polypeptide
AEEEIRTTNPVATEQYGSVSTTTQLQQTTEIGEG

SEQ ID NO: 91657 - protein, 35 aa, Artificial Sequence
  Description of Artificial Sequence: Synthetic polypeptide
DEEEIRTTNPVATEQYGQCVCSDTELQNFGSENQP

SEQ ID NO: 91658 - protein, 34 aa, Artificial Sequence
  Description of Artificial Sequence: Synthetic polypeptide
DEEEIRTTNPVATEQYGQCVCSDSNLQGFGSEQS

SEQ ID NO: 91659 - protein, 35 aa, Artificial Sequence
  Description of Artificial Sequence: Synthetic polypeptide
AEEEIRTTNPVATEQYGSVSTTTNQQQQQNGTTNL

SEQ ID NO: 91660 - protein, 35 aa, Artificial Sequence
  Description of Artificial Sequence: Synthetic polypeptide
AEEEIRTTNPVATEQYGSVSTTTNQQQQGEENEEQ

SEQ ID NO: 91661 - protein, 35 aa, Artificial Sequence
  Description of Artificial Sequence: Synthetic polypeptide
AEEEIRTTNPVATEQYGSVSTTTNQQQGEQGNEEG

SEQ ID NO: 91662 - protein, 35 aa, Artificial Sequence
  Description of Artificial Sequence: Synthetic polypeptide
AEEEIRTTNPVATEQYGSVSTTTNQQQGEEENEEG

SEQ ID NO: 91663 - protein, 34 aa, Artificial Sequence
  Description of Artificial Sequence: Synthetic polypeptide
AEEEIRTTNPVATEQYGSVSTTTNQQQDEQGTED

SEQ ID NO: 91664 - protein, 35 aa, Artificial Sequence
  Description of Artificial Sequence: Synthetic polypeptide
AEEEIRTTNPVATEQYGSVSTTTNQNQQDEGNNET

SEQ ID NO: 91665 - protein, 35 aa, Artificial Sequence
  Description of Artificial Sequence: Synthetic polypeptide
AEEEIRTTNPVATEQYGSVSTTTNQNNQDEGNNEI

SEQ ID NO: 91666 - protein, 35 aa, Artificial Sequence
  Description of Artificial Sequence: Synthetic polypeptide
AEEEIRTTNPVATEQYGSVSTTTNQLNQNTEQGES

SEQ ID NO: 91667 - protein, 34 aa, Artificial Sequence
  Description of Artificial Sequence: Synthetic polypeptide
AEEEIRTTNPVATEQYGSVSTTTNNQQQTNNNVD

SEQ ID NO: 91668 - protein, 35 aa, Artificial Sequence
  Description of Artificial Sequence: Synthetic polypeptide
AEEEIRTTNPVATEQYGSVSTTTNNQQGEEQNEEG

SEQ ID NO: 91669 - protein, 35 aa, Artificial Sequence
  Description of Artificial Sequence: Synthetic polypeptide
AEEEIRTTNPVATEQYGSVSTTTNNQNNGEEANND

SEQ ID NO: 91670 - protein, 33 aa, Artificial Sequence
  Description of Artificial Sequence: Synthetic polypeptide
SEEEIRCTNPIATEQYGSVPSCEGLSMRTVGNR

SEQ ID NO: 91671 - protein, 36 aa, Artificial Sequence
  Description of Artificial Sequence: Synthetic polypeptide
AEEEIRTTNPVATEQYGSVSTTVGNLQEGTTEQNSE

SEQ ID NO: 91672 - protein, 35 aa, Artificial Sequence
  Description of Artificial Sequence: Synthetic polypeptide
AEEEIRTTNPVATEQYGSVSTTVNDNQGTVGTNNA

SEQ ID NO: 91673 - protein, 34 aa, Artificial Sequence
  Description of Artificial Sequence: Synthetic polypeptide
AEEEIRTTNPVATEQYGSVSTTVNDNQQNEENDT

SEQ ID NO: 91674 - protein, 36 aa, Artificial Sequence
  Description of Artificial Sequence: Synthetic polypeptide
AEEEIRTTNPVATEQYGSVSTTVNNLQQGNGNTTTQ

SEQ ID NO: 91675 - protein, 36 aa, Artificial Sequence
  Description of Artificial Sequence: Synthetic polypeptide
AEEEIRTTNPVATEQYGSVSTTVNNLQGNNGTNNEE

SEQ ID NO: 91676 - protein, 33 aa, Artificial Sequence
  Description of Artificial Sequence: Synthetic polypeptide
SEEEIRCTNPIATEQYGSVCSGENMDMRDGDNR

SEQ ID NO: 91677 - protein, 33 aa, Artificial Sequence
  Description of Artificial Sequence: Synthetic polypeptide
SEEEIRCTNPIATEQYGSVCSGENQDMRDGNGR

SEQ ID NO: 91678 - protein, 36 aa, Artificial Sequence
  Description of Artificial Sequence: Synthetic polypeptide
AEEEIRTTNPVATEQYGSVSTTVNNLQEGTTENSED

SEQ ID NO: 91679 - protein, 36 aa, Artificial Sequence
  Description of Artificial Sequence: Synthetic polypeptide
AEEEIRTTNPVATEQYGSVSTTVNNLQAGTTTNSEF

SEQ ID NO: 91680 - protein, 36 aa, Artificial Sequence
  Description of Artificial Sequence: Synthetic polypeptide
AEEEIRTTNPVATEQYGSVSTTVNNLQAGTTENQEI

SEQ ID NO: 91681 - protein, 35 aa, Artificial Sequence
  Description of Artificial Sequence: Synthetic polypeptide
AEEEIRTTNPVATEQYGSVSTTVNNLNNEQGTNAT

SEQ ID NO: 91682 - protein, 34 aa, Artificial Sequence
  Description of Artificial Sequence: Synthetic polypeptide
AEEEIRTTNPVATEQYGSVSTTVNNLLVTTENSE

SEQ ID NO: 91683 - protein, 34 aa, Artificial Sequence
  Description of Artificial Sequence: Synthetic polypeptide
AEEEIRTTNPVATEQYGSVSTTVNNINDEQGNVD

SEQ ID NO: 91684 - protein, 35 aa, Artificial Sequence
  Description of Artificial Sequence: Synthetic polypeptide
AEEEIRTTNPVATEQYGSVSTTTNNNQQQTGTNVD

SEQ ID NO: 91685 - protein, 36 aa, Artificial Sequence
  Description of Artificial Sequence: Synthetic polypeptide
AEEEIRTTNPVATEQYGSVSTTVNLQQNEQGNNTNE

SEQ ID NO: 91686 - protein, 36 aa, Artificial Sequence
  Description of Artificial Sequence: Synthetic polypeptide
AEEEIRTTNPVATEQYGSVSTTVNLQAGENNNNDEG

SEQ ID NO: 91687 - protein, 32 aa, Artificial Sequence
  Description of Artificial Sequence: Synthetic polypeptide
DEEEIRPTNPVASEQYGSVSSTTPAGNSGMTR

SEQ ID NO: 91688 - protein, 34 aa, Artificial Sequence
  Description of Artificial Sequence: Synthetic polypeptide
DEEEIRTTNPVATEQYGQCVCSMTNHQNFGSDQP

SEQ ID NO: 91689 - protein, 36 aa, Artificial Sequence
  Description of Artificial Sequence: Synthetic polypeptide
AEEEIRTTNPVATEQYGSVSTTVNLLQQGNGTTTTE

SEQ ID NO: 91690 - protein, 35 aa, Artificial Sequence
  Description of Artificial Sequence: Synthetic polypeptide
AEEEIRTTNPVATEQYGSVSTTVNLLAGNEENEES

SEQ ID NO: 91691 - protein, 35 aa, Artificial Sequence
  Description of Artificial Sequence: Synthetic polypeptide
AEEEIRTTNPVATEQYGSVSTTVNLLAGNDEENSE

SEQ ID NO: 91692 - protein, 36 aa, Artificial Sequence
  Description of Artificial Sequence: Synthetic polypeptide
AEEEIRTTNPVATEQYGSVSTTVNLGNQQGNNNQTD

SEQ ID NO: 91693 - protein, 35 aa, Artificial Sequence
  Description of Artificial Sequence: Synthetic polypeptide
AEEEIRTTNPVATEQYGSVSTTVNGNQQGTDENDG

SEQ ID NO: 91694 - protein, 36 aa, Artificial Sequence
  Description of Artificial Sequence: Synthetic polypeptide
AEEEIRTTNPVATEQYGSVSTTVNGLQSGTTEENSE

SEQ ID NO: 91695 - protein, 35 aa, Artificial Sequence
  Description of Artificial Sequence: Synthetic polypeptide
AEEEIRTTNPVATEQYGSVSTTVNEGNQQGNNTDE

SEQ ID NO: 91696 - protein, 35 aa, Artificial Sequence
  Description of Artificial Sequence: Synthetic polypeptide
AEEEIRTTNPVATEQYGSVSTTVNLQEGTTEESEE

SEQ ID NO: 91697 - protein, 32 aa, Artificial Sequence
  Description of Artificial Sequence: Synthetic polypeptide
DEEEIRTTNPVATEQYGMVSIFGVGQGNNEQE

SEQ ID NO: 91698 - protein, 35 aa, Artificial Sequence
  Description of Artificial Sequence: Synthetic polypeptide
AEEEIRTTNPVATEQYGSVSTTTNNNQQQIGNEGG

SEQ ID NO: 91699 - protein, 35 aa, Artificial Sequence
  Description of Artificial Sequence: Synthetic polypeptide
AEEEIRTTNPVATEQYGSVSTTTNNNNQQQIGTNG

SEQ ID NO: 91700 - protein, 35 aa, Artificial Sequence
  Description of Artificial Sequence: Synthetic polypeptide
AEEEIRTTNPVATEQYGSVSTTTNLNQNENGTESG

SEQ ID NO: 91701 - protein, 34 aa, Artificial Sequence
  Description of Artificial Sequence: Synthetic polypeptide
DEEEIRSTNPVATEGYGSVSAATAGQMRVGMQPR

SEQ ID NO: 91702 - protein, 34 aa, Artificial Sequence
  Description of Artificial Sequence: Synthetic polypeptide
DEEEIRSTNPVATEGYGSVSATTAGQMRVGMQPR

SEQ ID NO: 91703 - protein, 31 aa, Artificial Sequence
  Description of Artificial Sequence: Synthetic polypeptide
DEEEIRSTNPVATEGYGSVSSTAGNMHGMDV

SEQ ID NO: 91704 - protein, 34 aa, Artificial Sequence
  Description of Artificial Sequence: Synthetic polypeptide
DEEEIRSTNPVATEGYGSVSSTTAGQMRVGMQPR

SEQ ID NO: 91705 - protein, 30 aa, Artificial Sequence
  Description of Artificial Sequence: Synthetic polypeptide
DEEEIRSTNPVATEQWGDVSDILMNSAENA

SEQ ID NO: 91706 - protein, 29 aa, Artificial Sequence
  Description of Artificial Sequence: Synthetic peptide
DEEEIRSTNPVATEQWGDVSDNEMNAEDQ

SEQ ID NO: 91707 - protein, 36 aa, Artificial Sequence
  Description of Artificial Sequence: Synthetic polypeptide
AEEEIRTTNPVATEQYGSVSTTTNLGQEQIGTTNAE

SEQ ID NO: 91708 - protein, 36 aa, Artificial Sequence
  Description of Artificial Sequence: Synthetic polypeptide
AEEEIRTTNPVATEQYGSVSTTTNLGAGEQIGTNLE

SEQ ID NO: 91709 - protein, 30 aa, Artificial Sequence
  Description of Artificial Sequence: Synthetic polypeptide
DEEEIRSTNPVATEQWGDVSEILMNSAGDA

SEQ ID NO: 91710 - protein, 33 aa, Artificial Sequence
  Description of Artificial Sequence: Synthetic polypeptide
DEEEIRTTNPVATEQYGNVSTDLDGEMGEDEII

SEQ ID NO: 91711 - protein, 35 aa, Artificial Sequence
  Description of Artificial Sequence: Synthetic polypeptide
DEEEIRTTNPVATEQYGNVSSTVNMQDQTGEGNGT

SEQ ID NO: 91712 - protein, 35 aa, Artificial Sequence
  Description of Artificial Sequence: Synthetic polypeptide
DEEEIRTTNPVATEQYGNVSSTVNMQDQNGGENGN

SEQ ID NO: 91713 - protein, 35 aa, Artificial Sequence
  Description of Artificial Sequence: Synthetic polypeptide
DEEEIRTTNPVATEQYGNVSSTVNMQDQIGEGNEG

SEQ ID NO: 91714 - protein, 35 aa, Artificial Sequence
  Description of Artificial Sequence: Synthetic polypeptide
DEEEIRTTNPVATEQYGNVSSTVNMQDQGGENDGT

SEQ ID NO: 91715 - protein, 35 aa, Artificial Sequence
  Description of Artificial Sequence: Synthetic polypeptide
DEEEIRTTNPVATEQYGNVSSTVNMQDQGGEFNGN

SEQ ID NO: 91716 - protein, 35 aa, Artificial Sequence
  Description of Artificial Sequence: Synthetic polypeptide
DEEEIRTTNPVATEQYGNVSSTVNMQDQGGEENGN

SEQ ID NO: 91717 - protein, 35 aa, Artificial Sequence
  Description of Artificial Sequence: Synthetic polypeptide
AEEEIRTTNPVATEQYGSVSTTTNGEQGTEGGNTT

SEQ ID NO: 91718 - protein, 35 aa, Artificial Sequence
  Description of Artificial Sequence: Synthetic polypeptide
AEEEIRTTNPVATEQYGSVSTTTNDNQQGTEENTE

SEQ ID NO: 91719 - protein, 34 aa, Artificial Sequence
  Description of Artificial Sequence: Synthetic polypeptide
AEEEIRTTNPVATEQYGSVSTTTNDNQQDEENDT

SEQ ID NO: 91720 - protein, 33 aa, Artificial Sequence
  Description of Artificial Sequence: Synthetic polypeptide
DEEEIRTTNPVATEQYGNVSSDGDEDQGGGGNG

SEQ ID NO: 91721 - protein, 36 aa, Artificial Sequence
  Description of Artificial Sequence: Synthetic polypeptide
AEEEIRTTNPVATEQYGSVSTTTNLQAGDEAGNEEQ

SEQ ID NO: 91722 - protein, 36 aa, Artificial Sequence
  Description of Artificial Sequence: Synthetic polypeptide
AEEEIRTTNPVATEQYGSVSTTTNLQAGDEAGNNND

SEQ ID NO: 91723 - protein, 36 aa, Artificial Sequence
  Description of Artificial Sequence: Synthetic polypeptide
AEEEIRTTNPVATEQYGSVSTTTNLQAGDEQGNENA

SEQ ID NO: 91724 - protein, 36 aa, Artificial Sequence
  Description of Artificial Sequence: Synthetic polypeptide
AEEEIRTTNPVATEQYGSVSTTTNLQAGTEAGNENN

SEQ ID NO: 91725 - protein, 36 aa, Artificial Sequence
  Description of Artificial Sequence: Synthetic polypeptide
AEEEIRTTNPVATEQYGSVSTTTNNNLNNQQGNNVD

SEQ ID NO: 91726 - protein, 34 aa, Artificial Sequence
  Description of Artificial Sequence: Synthetic polypeptide
AEEEIRTTNPVATEQYGSVSTTTNNNDTELGNLI

SEQ ID NO: 91727 - protein, 35 aa, Artificial Sequence
  Description of Artificial Sequence: Synthetic polypeptide
DEEEIRTTNPVATEQYGQCQVCSTGNLQNFGSEQA

SEQ ID NO: 91728 - protein, 36 aa, Artificial Sequence
  Description of Artificial Sequence: Synthetic polypeptide
AEEEIRTTNPVATEQYGSVSTTTNNLQQGTNGTEDD

SEQ ID NO: 91729 - protein, 35 aa, Artificial Sequence
  Description of Artificial Sequence: Synthetic polypeptide
DEEEIRTTNPVATEQYGQCQVCSTELQNFGSENQS

SEQ ID NO: 91730 - protein, 36 aa, Artificial Sequence
  Description of Artificial Sequence: Synthetic polypeptide
AEEEIRTTNPVATEQYGSVSTTTNNLQNGEEGNNDE

SEQ ID NO: 91731 - protein, 36 aa, Artificial Sequence
  Description of Artificial Sequence: Synthetic polypeptide
AEEEIRTTNPVATEQYGSVSTTTNNLQLGNEGGNVE

SEQ ID NO: 91732 - protein, 35 aa, Artificial Sequence
  Description of Artificial Sequence: Synthetic polypeptide
AEEEIRTTNPVATEQYGSVSTTTNNGNQNNDGNNN

SEQ ID NO: 91733 - protein, 34 aa, Artificial Sequence
  Description of Artificial Sequence: Synthetic polypeptide
AEEEIRTTNPVATEQYGSVSTTTNNDEQNTENED

SEQ ID NO: 91734 - protein, 32 aa, Artificial Sequence
  Description of Artificial Sequence: Synthetic polypeptide
DEEEIRPTNPVATEQYGSVCSNDMMPQVQNNT

SEQ ID NO: 91735 - protein, 35 aa, Artificial Sequence
  Description of Artificial Sequence: Synthetic polypeptide
AEEEIRTTNPVATEQYGSVSTTTNNNQQIGTNEGS

SEQ ID NO: 91736 - protein, 36 aa, Artificial Sequence
  Description of Artificial Sequence: Synthetic polypeptide
AEEEIRTTNPVATEQYGSVSTTTNLQYGNQGNNNAE

SEQ ID NO: 91737 - protein, 34 aa, Artificial Sequence
  Description of Artificial Sequence: Synthetic polypeptide
DEEEIRTTNPVATEQYGNVVVSCTNDSQNQGGPT

SEQ ID NO: 91738 - protein, 35 aa, Artificial Sequence
  Description of Artificial Sequence: Synthetic polypeptide
DEEEIRTTNPVATEQYGNVVTSNVNLFEQNEGGNQ

SEQ ID NO: 91739 - protein, 35 aa, Artificial Sequence
  Description of Artificial Sequence: Synthetic polypeptide
DEEEIRTTNPVATEQYGNVVPSCTNLSQNQGGPVM

SEQ ID NO: 91740 - protein, 33 aa, Artificial Sequence
  Description of Artificial Sequence: Synthetic polypeptide
DEEEIRTTNPVATEQYGNVVNTDTGMGQGTGNI

SEQ ID NO: 91741 - protein, 36 aa, Artificial Sequence
  Description of Artificial Sequence: Synthetic polypeptide
AEEEIRTTNPVATEQYGSVSTTTNLQQGNNVDEDED

SEQ ID NO: 91742 - protein, 35 aa, Artificial Sequence
  Description of Artificial Sequence: Synthetic polypeptide
DEEEIRTTNPVATEQYGNVVGDTMNLDQEGGGNIP

SEQ ID NO: 91743 - protein, 33 aa, Artificial Sequence
  Description of Artificial Sequence: Synthetic polypeptide
DEEEIRTTNPVATEQYGNVVDGNAQTEQGNEDE

SEQ ID NO: 91744 - protein, 36 aa, Artificial Sequence
  Description of Artificial Sequence: Synthetic polypeptide
AEEEIRTTNPVATEQYGSVSTTTNLQLQQGNNNQNQ

SEQ ID NO: 91745 - protein, 36 aa, Artificial Sequence
  Description of Artificial Sequence: Synthetic polypeptide
AEEEIRTTNPVATEQYGSVSTTTNLQGNEQGNNANN

SEQ ID NO: 91746 - protein, 36 aa, Artificial Sequence
  Description of Artificial Sequence: Synthetic polypeptide
AEEEIRTTNPVATEQYGSVSTTTNLQAGTEQGNEAG

SEQ ID NO: 91747 - protein, 35 aa, Artificial Sequence
  Description of Artificial Sequence: Synthetic polypeptide
DEEEIRTTNPVATEQYGNVVVSCTNLSQNQGGPQV

SEQ ID NO: 91748 - protein, 36 aa, Artificial Sequence
  Description of Artificial Sequence: Synthetic polypeptide
AEEEIRTTNPVATEQYGSVSTTVNNLQQGTEGGNDD

SEQ ID NO: 91749 - protein, 32 aa, Artificial Sequence
  Description of Artificial Sequence: Synthetic polypeptide
DEEEIRTTNPVATEQYGMVSIFGMGGGNEEQD

SEQ ID NO: 91750 - protein, 33 aa, Artificial Sequence
  Description of Artificial Sequence: Synthetic polypeptide
DEEEIRTTNPVATEQYGMVSIFEGGQGGGGNID

SEQ ID NO: 91751 - protein, 33 aa, Artificial Sequence
  Description of Artificial Sequence: Synthetic polypeptide
SEEEIRCTNPIATEQYGSVSSENLPMMRGMNPV

SEQ ID NO: 91752 - protein, 34 aa, Artificial Sequence
  Description of Artificial Sequence: Synthetic polypeptide
DEEEIRTTNPAATEQYGSVVIADQNGQRGNNGAN

SEQ ID NO: 91753 - protein, 35 aa, Artificial Sequence
  Description of Artificial Sequence: Synthetic polypeptide
DEEEIRTTNPAATEQYGSVVIMTDNGQERGQNGAV

SEQ ID NO: 91754 - protein, 35 aa, Artificial Sequence
  Description of Artificial Sequence: Synthetic polypeptide
AEEEIRTTNPVATEQYGSVSTTNNQQQNEEGNTEG

SEQ ID NO: 91755 - protein, 35 aa, Artificial Sequence
  Description of Artificial Sequence: Synthetic polypeptide
AEEEIRTTNPVATEQYGSVSTTNNQQQGTNGTEDD

SEQ ID NO: 91756 - protein, 34 aa, Artificial Sequence
  Description of Artificial Sequence: Synthetic polypeptide
DEEEIRTTNPVATEQYGKVPSCTNSGSTGGNMTI

SEQ ID NO: 91757 - protein, 32 aa, Artificial Sequence
  Description of Artificial Sequence: Synthetic polypeptide
DEEEIRTTNPCATEAYGSVALELYHEVRGNEQ

SEQ ID NO: 91758 - protein, 35 aa, Artificial Sequence
  Description of Artificial Sequence: Synthetic polypeptide
AEEEIRTTNPVATEQYGSVSTTNNQQQGNQGTTEL

SEQ ID NO: 91759 - protein, 30 aa, Artificial Sequence
  Description of Artificial Sequence: Synthetic polypeptide
DEEEIRTTNPCATEAYGSVALTLHESSGVE

SEQ ID NO: 91760 - protein, 31 aa, Artificial Sequence
  Description of Artificial Sequence: Synthetic polypeptide
DEEEIRTTNPCATEAYGSVALTVEHERGVDE

SEQ ID NO: 91761 - protein, 33 aa, Artificial Sequence
  Description of Artificial Sequence: Synthetic polypeptide
DEEEIRTTNPCATEAYGSVATTNDNGNQQGNTD

SEQ ID NO: 91762 - protein, 35 aa, Artificial Sequence
  Description of Artificial Sequence: Synthetic polypeptide
AEEEIRTTNPVATEQYGSVSTTNNQQQGNDTNNED

SEQ ID NO: 91763 - protein, 35 aa, Artificial Sequence
  Description of Artificial Sequence: Synthetic polypeptide
AEEEIRTTNPVATEQYGSVSTTNNQQQGNDGNEEI

SEQ ID NO: 91764 - protein, 33 aa, Artificial Sequence
  Description of Artificial Sequence: Synthetic polypeptide
DEEEIRTTNPCATEAYGSVATTNNDQGNQGNAD

SEQ ID NO: 91765 - protein, 35 aa, Artificial Sequence
  Description of Artificial Sequence: Synthetic polypeptide
AEEEIRTTNPVATEQYGSVSTTNNQQQGNDEEQQD

SEQ ID NO: 91766 - protein, 35 aa, Artificial Sequence
  Description of Artificial Sequence: Synthetic polypeptide
AEEEIRTTNPVATEQYGSVSTTNNQQQANQGTNEQ

SEQ ID NO: 91767 - protein, 35 aa, Artificial Sequence
  Description of Artificial Sequence: Synthetic polypeptide
AEEEIRTTNPVATEQYGSVSTTNNQQQANNGNNSE

SEQ ID NO: 91768 - protein, 33 aa, Artificial Sequence
  Description of Artificial Sequence: Synthetic polypeptide
DEEEIRTTNPCATEAYGSVATTNNGQQQGTNAE

SEQ ID NO: 91769 - protein, 34 aa, Artificial Sequence
  Description of Artificial Sequence: Synthetic polypeptide
DEEEIRTTNPVATEQYGIVSTTAGPNMRNGMTPR

SEQ ID NO: 91770 - protein, 34 aa, Artificial Sequence
  Description of Artificial Sequence: Synthetic polypeptide
AEEEIRTTNPVATEQYGSVSTTNNQQNQQSTTNT

SEQ ID NO: 91771 - protein, 35 aa, Artificial Sequence
  Description of Artificial Sequence: Synthetic polypeptide
AEEEIRTTNPVATEQYGSVSTTNNQQNQQIGENDE

SEQ ID NO: 91772 - protein, 34 aa, Artificial Sequence
  Description of Artificial Sequence: Synthetic polypeptide
AEEEIRTTNPVATEQYGSVSTTNNQQQQATNDTA

SEQ ID NO: 91773 - protein, 33 aa, Artificial Sequence
  Description of Artificial Sequence: Synthetic polypeptide
DEEEIRTTNPCATEAYGSVATTNQQGNQQGNAD

SEQ ID NO: 91774 - protein, 35 aa, Artificial Sequence
  Description of Artificial Sequence: Synthetic polypeptide
AEEEIRTTNPVATEQYGSVSTTNNQQQQGNGNINT

SEQ ID NO: 91775 - protein, 31 aa, Artificial Sequence
  Description of Artificial Sequence: Synthetic polypeptide
DEEEIRTTNPAATEQYGSVPGDLANGGQGEE

SEQ ID NO: 91776 - protein, 35 aa, Artificial Sequence
  Description of Artificial Sequence: Synthetic polypeptide
AEEEIRTTNPVATEQYGSVSTTNNQQQTQGTNNVD

SEQ ID NO: 91777 - protein, 35 aa, Artificial Sequence
  Description of Artificial Sequence: Synthetic polypeptide
AEEEIRTTNPVATEQYGSVSTTNNQQQTQGTNDEE

SEQ ID NO: 91778 - protein, 35 aa, Artificial Sequence
  Description of Artificial Sequence: Synthetic polypeptide
AEEEIRTTNPVATEQYGSVSTTNNQQQTQGNNNVD

SEQ ID NO: 91779 - protein, 34 aa, Artificial Sequence
  Description of Artificial Sequence: Synthetic polypeptide
DEEEIRTTNPVATEQYGMSGINTNDGQTGGEGNI

SEQ ID NO: 91780 - protein, 33 aa, Artificial Sequence
  Description of Artificial Sequence: Synthetic polypeptide
DEEEIRTTNCVATEQYGVVSTGNGGNLNGEGGI

SEQ ID NO: 91781 - protein, 35 aa, Artificial Sequence
  Description of Artificial Sequence: Synthetic polypeptide
AEEEIRTTNPVATEQYGSVSTTNNQQQQTNGNDET

SEQ ID NO: 91782 - protein, 34 aa, Artificial Sequence
  Description of Artificial Sequence: Synthetic polypeptide
DEEEIRTTNPVATEQYGMISTVNLDVGVGNNDDD

SEQ ID NO: 91783 - protein, 35 aa, Artificial Sequence
  Description of Artificial Sequence: Synthetic polypeptide
AEEEIRTTNPVATEQYGSVSTTNNQQQQTGTNDEE

SEQ ID NO: 91784 - protein, 34 aa, Artificial Sequence
  Description of Artificial Sequence: Synthetic polypeptide
AEEEIRTTNPVATEQYGSVSTTNNQQQQSTNNTQ

SEQ ID NO: 91785 - protein, 34 aa, Artificial Sequence
  Description of Artificial Sequence: Synthetic polypeptide
AEEEIRTTNPVATEQYGSVSTTNNQQQQSTATNT

SEQ ID NO: 91786 - protein, 32 aa, Artificial Sequence
  Description of Artificial Sequence: Synthetic polypeptide
DEEEIRTTNPVATEQYGMATPSTLSQDRESAM

SEQ ID NO: 91787 - protein, 34 aa, Artificial Sequence
  Description of Artificial Sequence: Synthetic polypeptide
AEEEIRTTNPVATEQYGSVSTTNNQQQQQGTDEN

SEQ ID NO: 91788 - protein, 33 aa, Artificial Sequence
  Description of Artificial Sequence: Synthetic polypeptide
DEEEIRTTNPVATEQYGLVSWMNMLANPQMVQD

SEQ ID NO: 91789 - protein, 31 aa, Artificial Sequence
  Description of Artificial Sequence: Synthetic polypeptide
DEEEIRTTNPAATEAYGSVPGDLAGGQGGDT

SEQ ID NO: 91790 - protein, 33 aa, Artificial Sequence
  Description of Artificial Sequence: Synthetic polypeptide
DEEEIRTTNPAATEFYGSVCTDTNLAREGGDGE

SEQ ID NO: 91791 - protein, 35 aa, Artificial Sequence
  Description of Artificial Sequence: Synthetic polypeptide
AEEEIRTTNPVATEQYGSVSTTNNQQQQNGENQTQ

SEQ ID NO: 91792 - protein, 31 aa, Artificial Sequence
  Description of Artificial Sequence: Synthetic polypeptide
DEEEIRTTNPAATEQYGSVNLNIFDDGGQGD

SEQ ID NO: 91793 - protein, 34 aa, Artificial Sequence
  Description of Artificial Sequence: Synthetic polypeptide
AEEEIRTTNPVATEQYGSVSTTNNQQQQNATNTM

SEQ ID NO: 91794 - protein, 32 aa, Artificial Sequence
  Description of Artificial Sequence: Synthetic polypeptide
DEEEIRTTNPVATEQYGLVGELLDKGGNEEDQ

SEQ ID NO: 91795 - protein, 32 aa, Artificial Sequence
  Description of Artificial Sequence: Synthetic polypeptide
DEEEIRTTNPAATEQYGSVNNLNIFDDGGNDE

SEQ ID NO: 91796 - protein, 32 aa, Artificial Sequence
  Description of Artificial Sequence: Synthetic polypeptide
DEEEIRTTNPAATEQYGSVNNLNIFDDGGNND

SEQ ID NO: 91797 - protein, 32 aa, Artificial Sequence
  Description of Artificial Sequence: Synthetic polypeptide
DEEEIRTTNPAATEQYGSVPTDLANEGQGEGE

SEQ ID NO: 91798 - protein, 34 aa, Artificial Sequence
  Description of Artificial Sequence: Synthetic polypeptide
AEEEIRTTNPVATEQYGSVSTTNNQQLGGTETGS

SEQ ID NO: 91799 - protein, 35 aa, Artificial Sequence
  Description of Artificial Sequence: Synthetic polypeptide
AEEEIRTTNPVATEQYGSVSTTNNQQGSEGGNANT

SEQ ID NO: 91800 - protein, 31 aa, Artificial Sequence
  Description of Artificial Sequence: Synthetic polypeptide
DEEEIRTTNPCATEAYGSVATVEVHGRQVNA

SEQ ID NO: 91801 - protein, 34 aa, Artificial Sequence
  Description of Artificial Sequence: Synthetic polypeptide
DEEEIRTTNPVATEQYGICVCSTGELQNFGSEQS

SEQ ID NO: 91802 - protein, 34 aa, Artificial Sequence
  Description of Artificial Sequence: Synthetic polypeptide
DEEEIRTTNPVATEQYGICVCSTEHQNFGSENQA

SEQ ID NO: 91803 - protein, 34 aa, Artificial Sequence
  Description of Artificial Sequence: Synthetic polypeptide
DEEEIRTTNPVATEQYGICVCSNTEHQNFGSNQA

SEQ ID NO: 91804 - protein, 36 aa, Artificial Sequence
  Description of Artificial Sequence: Synthetic polypeptide
AEEEIRTTNPVATEQYGSVSTTNNQLQQGTEAGTNT

SEQ ID NO: 91805 - protein, 36 aa, Artificial Sequence
  Description of Artificial Sequence: Synthetic polypeptide
AEEEIRTTNPVATEQYGSVSTTNNQLQQGNNNNNEL

SEQ ID NO: 91806 - protein, 36 aa, Artificial Sequence
  Description of Artificial Sequence: Synthetic polypeptide
AEEEIRTTNPVATEQYGSVSTTNNQLQQGNNNNLND

SEQ ID NO: 91807 - protein, 36 aa, Artificial Sequence
  Description of Artificial Sequence: Synthetic polypeptide
AEEEIRTTNPVATEQYGSVSTTNNQLQQGNNEEQNF

SEQ ID NO: 91808 - protein, 32 aa, Artificial Sequence
  Description of Artificial Sequence: Synthetic polypeptide
SEEEIRCTNPIATEQYGTVCSAEDNLEREGND

SEQ ID NO: 91809 - protein, 36 aa, Artificial Sequence
  Description of Artificial Sequence: Synthetic polypeptide
AEEEIRTTNPVATEQYGSVSTTNNQLQQGNNANNTD

SEQ ID NO: 91810 - protein, 35 aa, Artificial Sequence
  Description of Artificial Sequence: Synthetic polypeptide
DEEEIRTTNPVATEQYGHVSVESAIHNGQRDNANV

SEQ ID NO: 91811 - protein, 36 aa, Artificial Sequence
  Description of Artificial Sequence: Synthetic polypeptide
AEEEIRTTNPVATEQYGSVSTTNNQLQQGNGTNNSE

SEQ ID NO: 91812 - protein, 35 aa, Artificial Sequence
  Description of Artificial Sequence: Synthetic polypeptide
AEEEIRTTNPVATEQYGSVSTTNNQLQQEGETEED

SEQ ID NO: 91813 - protein, 36 aa, Artificial Sequence
  Description of Artificial Sequence: Synthetic polypeptide
AEEEIRTTNPVATEQYGSVSTTNNQLQNGNGETNTD

SEQ ID NO: 91814 - protein, 36 aa, Artificial Sequence
  Description of Artificial Sequence: Synthetic polypeptide
AEEEIRTTNPVATEQYGSVSTTNNQLQNANEQGNDE

SEQ ID NO: 91815 - protein, 35 aa, Artificial Sequence
  Description of Artificial Sequence: Synthetic polypeptide
AEEEIRTTNPVATEQYGSVSTTNNQLQGNQDENET

SEQ ID NO: 91816 - protein, 36 aa, Artificial Sequence
  Description of Artificial Sequence: Synthetic polypeptide
AEEEIRTTNPVATEQYGSVSTTNNQLQGNNQGNIQD

SEQ ID NO: 91817 - protein, 34 aa, Artificial Sequence
  Description of Artificial Sequence: Synthetic polypeptide
DEEEIRTTNPCATECYGSVCSKTENQDDDRGGNA

SEQ ID NO: 91818 - protein, 35 aa, Artificial Sequence
  Description of Artificial Sequence: Synthetic polypeptide
AEEEIRTTNPVATEQYGSVSTTNNQLQDEQGTEDE

SEQ ID NO: 91819 - protein, 36 aa, Artificial Sequence
  Description of Artificial Sequence: Synthetic polypeptide
AEEEIRTTNPVATEQYGSVSTTNNQLQAGTTTNNDD

SEQ ID NO: 91820 - protein, 34 aa, Artificial Sequence
  Description of Artificial Sequence: Synthetic polypeptide
DEEEIRTTNPCATECYGSVSTGNLGNDGQQNNDS

SEQ ID NO: 91821 - protein, 35 aa, Artificial Sequence
  Description of Artificial Sequence: Synthetic polypeptide
AEEEIRTTNPVATEQYGSVSTTNNQLNQTIGEDEN

SEQ ID NO: 91822 - protein, 36 aa, Artificial Sequence
  Description of Artificial Sequence: Synthetic polypeptide
AEEEIRTTNPVATEQYGSVSTTNNQLQQGTENINTE

SEQ ID NO: 91823 - protein, 36 aa, Artificial Sequence
  Description of Artificial Sequence: Synthetic polypeptide
AEEEIRTTNPVATEQYGSVSTTNNQLQQGTENITET

SEQ ID NO: 91824 - protein, 36 aa, Artificial Sequence
  Description of Artificial Sequence: Synthetic polypeptide
AEEEIRTTNPVATEQYGSVSTTNNQLQQGTEQGNIN

SEQ ID NO: 91825 - protein, 36 aa, Artificial Sequence
  Description of Artificial Sequence: Synthetic polypeptide
AEEEIRTTNPVATEQYGSVSTTNNQLQQNEQGNNNE

SEQ ID NO: 91826 - protein, 33 aa, Artificial Sequence
  Description of Artificial Sequence: Synthetic polypeptide
DEEEIRTTNPCATEAYGSVATVNNDQGNQGNQD

SEQ ID NO: 91827 - protein, 35 aa, Artificial Sequence
  Description of Artificial Sequence: Synthetic polypeptide
AEEEIRTTNPVATEQYGSVSTTNNQNSEQGTNGEQ

SEQ ID NO: 91828 - protein, 36 aa, Artificial Sequence
  Description of Artificial Sequence: Synthetic polypeptide
DEEEIRTTNPVATEQYGISVYSCTGAHSHRDGGNNR

SEQ ID NO: 91829 - protein, 35 aa, Artificial Sequence
  Description of Artificial Sequence: Synthetic polypeptide
AEEEIRTTNPVATEQYGSVSTTNNQNQQTGNNDED

SEQ ID NO: 91830 - protein, 34 aa, Artificial Sequence
  Description of Artificial Sequence: Synthetic polypeptide
DEEEIRTTNPCATEAYGSVTVSTNLEAGNNNNST

SEQ ID NO: 91831 - protein, 34 aa, Artificial Sequence
  Description of Artificial Sequence: Synthetic polypeptide
DEEEIRTTNPCATEAYGSVTVSTNLEAGTNNNET

SEQ ID NO: 91832 - protein, 35 aa, Artificial Sequence
  Description of Artificial Sequence: Synthetic polypeptide
DEEEIRTTNPCATEAYGSVTVSTNLQAGTNNNTTT

SEQ ID NO: 91833 - protein, 36 aa, Artificial Sequence
  Description of Artificial Sequence: Synthetic polypeptide
DEEEIRTTNPVATEQYGISVSTGNELSQMPGGMESS

SEQ ID NO: 91834 - protein, 35 aa, Artificial Sequence
  Description of Artificial Sequence: Synthetic polypeptide
AEEEIRTTNPVATEQYGSVSTTNNQNQQGNGNNVD

SEQ ID NO: 91835 - protein, 35 aa, Artificial Sequence
  Description of Artificial Sequence: Synthetic polypeptide
AEEEIRTTNPVATEQYGSVSTTNNQNQQEGNNNET

SEQ ID NO: 91836 - protein, 31 aa, Artificial Sequence
  Description of Artificial Sequence: Synthetic polypeptide
DEEEIRTTNCVATEQYGTMVIANSDQDGGPE

SEQ ID NO: 91837 - protein, 34 aa, Artificial Sequence
  Description of Artificial Sequence: Synthetic polypeptide
DEEEIRTTNPCATEAYGSVTVSTTNLEAGNNNNT

SEQ ID NO: 91838 - protein, 35 aa, Artificial Sequence
  Description of Artificial Sequence: Synthetic polypeptide
AEEEIRTTNPVATEQYGSVSTTNNQNNQENGNNEI

SEQ ID NO: 91839 - protein, 35 aa, Artificial Sequence
  Description of Artificial Sequence: Synthetic polypeptide
DEEEIRTTNPCATEAYGSVTVSTTNLQAGTNNQTE

SEQ ID NO: 91840 - protein, 35 aa, Artificial Sequence
  Description of Artificial Sequence: Synthetic polypeptide
DEEEIRTTNPCATEAYGSVTVSTTNLQAGTTNETE

SEQ ID NO: 91841 - protein, 35 aa, Artificial Sequence
  Description of Artificial Sequence: Synthetic polypeptide
AEEEIRTTNPVATEQYGSVSTTNNQNNQEEGNNED

SEQ ID NO: 91842 - protein, 33 aa, Artificial Sequence
  Description of Artificial Sequence: Synthetic polypeptide
DEEEIRTTNPCATEAYGSVTVTTTNLEAGNNQT

SEQ ID NO: 91843 - protein, 35 aa, Artificial Sequence
  Description of Artificial Sequence: Synthetic polypeptide
AEEEIRTTNPVATEQYGSVSTTNNQNNNDEAGNED

SEQ ID NO: 91844 - protein, 35 aa, Artificial Sequence
  Description of Artificial Sequence: Synthetic polypeptide
AEEEIRTTNPVATEQYGSVSTTNNQNNLNVGTNEE

SEQ ID NO: 91845 - protein, 35 aa, Artificial Sequence
  Description of Artificial Sequence: Synthetic polypeptide
AEEEIRTTNPVATEQYGSVSTTNNQNLQETTTNSA

SEQ ID NO: 91846 - protein, 36 aa, Artificial Sequence
  Description of Artificial Sequence: Synthetic polypeptide
AEEEIRTTNPVATEQYGSVSTTNNQNLQEIGTNEET

SEQ ID NO: 91847 - protein, 35 aa, Artificial Sequence
  Description of Artificial Sequence: Synthetic polypeptide
AEEEIRTTNPVATEQYGSVSTTNNQNDEQGNNDTQ

SEQ ID NO: 91848 - protein, 34 aa, Artificial Sequence
  Description of Artificial Sequence: Synthetic polypeptide
DEEEIRTTNPCATEAYGSVTVSTTNLEAGNNQTN

SEQ ID NO: 91849 - protein, 35 aa, Artificial Sequence
  Description of Artificial Sequence: Synthetic polypeptide
AEEEIRTTNPVATEQYGSVSTTNNQQSGNGTNQED

SEQ ID NO: 91850 - protein, 34 aa, Artificial Sequence
  Description of Artificial Sequence: Synthetic polypeptide
DEEEIRTTNCVATEQYGSVSTSNLGLEFNNENEV

SEQ ID NO: 91851 - protein, 35 aa, Artificial Sequence
  Description of Artificial Sequence: Synthetic polypeptide
AEEEIRTTNPVATEQYGSVSTTNNTNLLGGNNEEV

SEQ ID NO: 91852 - protein, 36 aa, Artificial Sequence
  Description of Artificial Sequence: Synthetic polypeptide
AEEEIRTTNPVATEQYGSVSTTNQQLQQGNNANQND

SEQ ID NO: 91853 - protein, 31 aa, Artificial Sequence
  Description of Artificial Sequence: Synthetic polypeptide
DEEEIRSTNPVSTEPYGVVSMEDLQQSNGNH

SEQ ID NO: 91854 - protein, 33 aa, Artificial Sequence
  Description of Artificial Sequence: Synthetic polypeptide
DEEEIRSTNPVSTEQYGNVATTTIPQSRNGNPR

SEQ ID NO: 91855 - protein, 34 aa, Artificial Sequence
  Description of Artificial Sequence: Synthetic polypeptide
DEEEIRTTNPVATEQYGMVGSTGMGGQGEGNEGF

SEQ ID NO: 91856 - protein, 35 aa, Artificial Sequence
  Description of Artificial Sequence: Synthetic polypeptide
AEEEIRTTNPVATEQYGSVSTTNQQLQQEGEEEES

SEQ ID NO: 91857 - protein, 36 aa, Artificial Sequence
  Description of Artificial Sequence: Synthetic polypeptide
AEEEIRTTNPVATEQYGSVSTTNQQLQNGTEGGNED

SEQ ID NO: 91858 - protein, 34 aa, Artificial Sequence
  Description of Artificial Sequence: Synthetic polypeptide
DEEEIRTTNPVATEQYGMVGSNTNGQQGTGGEGG

SEQ ID NO: 91859 - protein, 35 aa, Artificial Sequence
  Description of Artificial Sequence: Synthetic polypeptide
AEEEIRTTNPVATEQYGSVSTTNQQLQGNDEDEEV

SEQ ID NO: 91860 - protein, 34 aa, Artificial Sequence
  Description of Artificial Sequence: Synthetic polypeptide
AEEEIRTTNPVATEQYGSVSTTNQQLQGEDEEEV

SEQ ID NO: 91861 - protein, 33 aa, Artificial Sequence
  Description of Artificial Sequence: Synthetic polypeptide
DEEEIRTTNPVATEQYGMVGSINENGEGNGNGV

SEQ ID NO: 91862 - protein, 33 aa, Artificial Sequence
  Description of Artificial Sequence: Synthetic polypeptide
DEEEIRTTNPVATEQYGMVGSINEGQGEGGEQN

SEQ ID NO: 91863 - protein, 34 aa, Artificial Sequence
  Description of Artificial Sequence: Synthetic polypeptide
DEEEIRTTNPVATEQYGMVGSIMNLGGGGNGNGD

SEQ ID NO: 91864 - protein, 34 aa, Artificial Sequence
  Description of Artificial Sequence: Synthetic polypeptide
DEEEIRTTNPVATEQYGMVGSIMNLGEGGNGNGD

SEQ ID NO: 91865 - protein, 36 aa, Artificial Sequence
  Description of Artificial Sequence: Synthetic polypeptide
AEEEIRTTNPVATEQYGSVSTTNQQLGNQTGTNTED

SEQ ID NO: 91866 - protein, 36 aa, Artificial Sequence
  Description of Artificial Sequence: Synthetic polypeptide
AEEEIRTTNPVATEQYGSVSTTNQQLGNQQGTNQSG

SEQ ID NO: 91867 - protein, 35 aa, Artificial Sequence
  Description of Artificial Sequence: Synthetic polypeptide
AEEEIRTTNPVATEQYGSVSTTNQQLGNNIGNIQE

SEQ ID NO: 91868 - protein, 34 aa, Artificial Sequence
  Description of Artificial Sequence: Synthetic polypeptide
DEEEIRTTNPVATEQYGMVGSILNQLEIGNGNGD

SEQ ID NO: 91869 - protein, 34 aa, Artificial Sequence
  Description of Artificial Sequence: Synthetic polypeptide
DEEEIRTTNPVATEQYGMVGSILNLNEGGNGNGD

SEQ ID NO: 91870 - protein, 34 aa, Artificial Sequence
  Description of Artificial Sequence: Synthetic polypeptide
DEEEIRTTNPVATEQYGMVGSILNLLEGGNGQGV

SEQ ID NO: 91871 - protein, 34 aa, Artificial Sequence
  Description of Artificial Sequence: Synthetic polypeptide
DEEEIRTTNPVATEQYGMVGSILNLFETGNGNGD

SEQ ID NO: 91872 - protein, 33 aa, Artificial Sequence
  Description of Artificial Sequence: Synthetic polypeptide
DEEEIRTTNPVATEQYGMVGSILNGPEGNGNGD

SEQ ID NO: 91873 - protein, 31 aa, Artificial Sequence
  Description of Artificial Sequence: Synthetic polypeptide
DEEEIRSTNPVSTEPYGVVSMEDLQQQNGNH

SEQ ID NO: 91874 - protein, 35 aa, Artificial Sequence
  Description of Artificial Sequence: Synthetic polypeptide
AEEEIRTTNPVATEQYGSVSTTNQQLQQNENDEEE

SEQ ID NO: 91875 - protein, 36 aa, Artificial Sequence
  Description of Artificial Sequence: Synthetic polypeptide
DEEEIRTTNPVATEQYGMVGSTNLVGIQTGGGNGQQ

SEQ ID NO: 91876 - protein, 33 aa, Artificial Sequence
  Description of Artificial Sequence: Synthetic polypeptide
DEEEIRSTNPVCTEQYGSVSSTALPNMSGMNPV

SEQ ID NO: 91877 - protein, 35 aa, Artificial Sequence
  Description of Artificial Sequence: Synthetic polypeptide
AEEEIRTTNPVATEQYGSVSTTNQQQQTIGTNDED

SEQ ID NO: 91878 - protein, 34 aa, Artificial Sequence
  Description of Artificial Sequence: Synthetic polypeptide
DEEEIRTTNPVATEQYGMVSATGNGGNLNGENGD

SEQ ID NO: 91879 - protein, 35 aa, Artificial Sequence
  Description of Artificial Sequence: Synthetic polypeptide
AEEEIRTTNPVATEQYGSVSTTNQQQQQQIGNTNE

SEQ ID NO: 91880 - protein, 34 aa, Artificial Sequence
  Description of Artificial Sequence: Synthetic polypeptide
AEEEIRTTNPVATEQYGSVSTTNQQQQQNGTQES

SEQ ID NO: 91881 - protein, 34 aa, Artificial Sequence
  Description of Artificial Sequence: Synthetic polypeptide
AEEEIRTTNPVATEQYGSVSTTNQQQQQNGTELG

SEQ ID NO: 91882 - protein, 35 aa, Artificial Sequence
  Description of Artificial Sequence: Synthetic polypeptide
AEEEIRTTNPVATEQYGSVSTTNQQQQQNGNTELG

SEQ ID NO: 91883 - protein, 35 aa, Artificial Sequence
  Description of Artificial Sequence: Synthetic polypeptide
AEEEIRTTNPVATEQYGSVSTTNQQQQQGNGNNDE

SEQ ID NO: 91884 - protein, 35 aa, Artificial Sequence
  Description of Artificial Sequence: Synthetic polypeptide
AEEEIRTTNPVATEQYGSVSTTNQQQQQGEQGNGD

SEQ ID NO: 91885 - protein, 31 aa, Artificial Sequence
  Description of Artificial Sequence: Synthetic polypeptide
DEEEIRTTNPVATEQYGMVNIGVGGQGQGED

SEQ ID NO: 91886 - protein, 33 aa, Artificial Sequence
  Description of Artificial Sequence: Synthetic polypeptide
DEEEIRTTNPVATEQYGMVNIGNGGQNGETNEF

SEQ ID NO: 91887 - protein, 34 aa, Artificial Sequence
  Description of Artificial Sequence: Synthetic polypeptide
DEEEIRTTNPVATEQYGMVGSILNELDEGNGNGN

SEQ ID NO: 91888 - protein, 34 aa, Artificial Sequence
  Description of Artificial Sequence: Synthetic polypeptide
AEEEIRTTNPVATEQYGSVSTTNQQQQQGEDEEQ

SEQ ID NO: 91889 - protein, 34 aa, Artificial Sequence
  Description of Artificial Sequence: Synthetic polypeptide
AEEEIRTTNPVATEQYGSVSTTNQQQQNANNQDT

SEQ ID NO: 91890 - protein, 35 aa, Artificial Sequence
  Description of Artificial Sequence: Synthetic polypeptide
AEEEIRTTNPVATEQYGSVSTTNQQQQGNNENGQD

SEQ ID NO: 91891 - protein, 35 aa, Artificial Sequence
  Description of Artificial Sequence: Synthetic polypeptide
AEEEIRTTNPVATEQYGSVSTTNQQQQGEEANEEG

SEQ ID NO: 91892 - protein, 34 aa, Artificial Sequence
  Description of Artificial Sequence: Synthetic polypeptide
AEEEIRTTNPVATEQYGSVSTTNQQQQANGTTEQ

SEQ ID NO: 91893 - protein, 33 aa, Artificial Sequence
  Description of Artificial Sequence: Synthetic polypeptide
DEEEIRTTNPVATEQYGMVNFENGQDEQGQNEQ

SEQ ID NO: 91894 - protein, 35 aa, Artificial Sequence
  Description of Artificial Sequence: Synthetic polypeptide
AEEEIRTTNPVATEQYGSVSTTNQQQLGNQQNEEE

SEQ ID NO: 91895 - protein, 33 aa, Artificial Sequence
  Description of Artificial Sequence: Synthetic polypeptide
DEEEIRTTNPVATEQYGMVNFEGNGQDEGENEQ

SEQ ID NO: 91896 - protein, 35 aa, Artificial Sequence
  Description of Artificial Sequence: Synthetic polypeptide
AEEEIRTTNPVATEQYGSVSTTNQQQGNEGNNNED

SEQ ID NO: 91897 - protein, 34 aa, Artificial Sequence
  Description of Artificial Sequence: Synthetic polypeptide
DEEEIRSTNPVAYEQYGSVSVSPNELSQKVGNTI

SEQ ID NO: 91898 - protein, 36 aa, Artificial Sequence
  Description of Artificial Sequence: Synthetic polypeptide
DEEEIRTTNPVATEQYGMVGSVTGIGNQLQEGGGND

SEQ ID NO: 91899 - protein, 35 aa, Artificial Sequence
  Description of Artificial Sequence: Synthetic polypeptide
AEEEIRTTNPVATEQYGSVSTTNQQQQQANGNNDE

SEQ ID NO: 91900 - protein, 35 aa, Artificial Sequence
  Description of Artificial Sequence: Synthetic polypeptide
AEEEIRTTNPVATEQYGSVSTTNQQQQTNGNNDEE

SEQ ID NO: 91901 - protein, 33 aa, Artificial Sequence
  Description of Artificial Sequence: Synthetic polypeptide
DEEEIRTTNPVATEQYGMVGSILNEGEGNGNGV

SEQ ID NO: 91902 - protein, 34 aa, Artificial Sequence
  Description of Artificial Sequence: Synthetic polypeptide
DEEEIRTTNPVATEQYGMVGSIDNLGEGGNGNGP

SEQ ID NO: 91903 - protein, 35 aa, Artificial Sequence
  Description of Artificial Sequence: Synthetic polypeptide
AEEEIRTTNPVATEQYGSVSTTNQNNQQEGNNEEI

SEQ ID NO: 91904 - protein, 35 aa, Artificial Sequence
  Description of Artificial Sequence: Synthetic polypeptide
AEEEIRTTNPVATEQYGSVSTTNQNNQEQGNNDEI

SEQ ID NO: 91905 - protein, 35 aa, Artificial Sequence
  Description of Artificial Sequence: Synthetic polypeptide
AEEEIRTTNPVATEQYGSVSTTNQNNQENGNNEEQ

SEQ ID NO: 91906 - protein, 35 aa, Artificial Sequence
  Description of Artificial Sequence: Synthetic polypeptide
AEEEIRTTNPVATEQYGSVSTTNQNNQEGTNNTED

SEQ ID NO: 91907 - protein, 35 aa, Artificial Sequence
  Description of Artificial Sequence: Synthetic polypeptide
DEEEIRTTNPVATEQYGMTVWETINIGQREGNGND

SEQ ID NO: 91908 - protein, 34 aa, Artificial Sequence
  Description of Artificial Sequence: Synthetic polypeptide
DEEEIRTTNPVATEQYGMTSNVAMLQTRNGSSMR

SEQ ID NO: 91909 - protein, 35 aa, Artificial Sequence
  Description of Artificial Sequence: Synthetic polypeptide
DEEEIRTCNPVATEQYGSVVSTGGLGQRFNDEGEE

SEQ ID NO: 91910 - protein, 35 aa, Artificial Sequence
  Description of Artificial Sequence: Synthetic polypeptide
DEEEIRTCNPVATEQYGSVVSTGGLGQRFNSDGET

SEQ ID NO: 91911 - protein, 33 aa, Artificial Sequence
  Description of Artificial Sequence: Synthetic polypeptide
AEEEIRTTNPVATEQYGSVSTTNQNDNEEGDTD

SEQ ID NO: 91912 - protein, 35 aa, Artificial Sequence
  Description of Artificial Sequence: Synthetic polypeptide
DEEEIRTCNPVAYEQYGSTVSCTGLSARTVGQNER

SEQ ID NO: 91913 - protein, 35 aa, Artificial Sequence
  Description of Artificial Sequence: Synthetic polypeptide
AEEEIRTTNPVATEQYGSVSTTNQLQQEISTENGN

SEQ ID NO: 91914 - protein, 35 aa, Artificial Sequence
  Description of Artificial Sequence: Synthetic polypeptide
AEEEIRTTNPVATEQYGSVSTTNQLQNQENGTEDE

SEQ ID NO: 91915 - protein, 35 aa, Artificial Sequence
  Description of Artificial Sequence: Synthetic polypeptide
AEEEIRTTNPVATEQYGSVSTTNQLQGNPNNNQNQ

SEQ ID NO: 91916 - protein, 35 aa, Artificial Sequence
  Description of Artificial Sequence: Synthetic polypeptide
AEEEIRTTNPVATEQYGSVSTTNQLQGNPNNNQNE

SEQ ID NO: 91917 - protein, 35 aa, Artificial Sequence
  Description of Artificial Sequence: Synthetic polypeptide
AEEEIRTTNPVATEQYGSVSTTNQLQDEEGGTEDE

SEQ ID NO: 91918 - protein, 34 aa, Artificial Sequence
  Description of Artificial Sequence: Synthetic polypeptide
DEEEIRTTNCVATEQYGSVSNTDNMNIIQGGGGE

SEQ ID NO: 91919 - protein, 36 aa, Artificial Sequence
  Description of Artificial Sequence: Synthetic polypeptide
AEEEIRTTNPVATEQYGSVSTTNQLNQNNIGNNETG

SEQ ID NO: 91920 - protein, 34 aa, Artificial Sequence
  Description of Artificial Sequence: Synthetic polypeptide
AEEEIRTTNPVATEQYGSVSTTNQLNGTNPNETA

SEQ ID NO: 91921 - protein, 35 aa, Artificial Sequence
  Description of Artificial Sequence: Synthetic polypeptide
AEEEIRTTNPVATEQYGSVSTTNQLNENTEGGNTN

SEQ ID NO: 91922 - protein, 34 aa, Artificial Sequence
  Description of Artificial Sequence: Synthetic polypeptide
AEEEIRTTNPVATEQYGSVSTTNQLNDNEELGTD

SEQ ID NO: 91923 - protein, 35 aa, Artificial Sequence
  Description of Artificial Sequence: Synthetic polypeptide
DEEEIRTTNPVATEQYGMSGTGMETGNLDQGGGNG

SEQ ID NO: 91924 - protein, 33 aa, Artificial Sequence
  Description of Artificial Sequence: Synthetic polypeptide
DEEEIRTTNPVATEQYGMVGDGNMNQGEGGNDG

SEQ ID NO: 91925 - protein, 33 aa, Artificial Sequence
  Description of Artificial Sequence: Synthetic polypeptide
DEEEIRTTNPVATEQYGMVGDGNMTQGGGEENS

SEQ ID NO: 91926 - protein, 31 aa, Artificial Sequence
  Description of Artificial Sequence: Synthetic polypeptide
DEEEIRTTNPVATEQYGMVGITGMGEEDGGG

SEQ ID NO: 91927 - protein, 35 aa, Artificial Sequence
  Description of Artificial Sequence: Synthetic polypeptide
AEEEIRTTNPVATEQYGSVSTTNQNQQEIGTNEED

SEQ ID NO: 91928 - protein, 34 aa, Artificial Sequence
  Description of Artificial Sequence: Synthetic polypeptide
DEEEIRTTNPVATEQYGMVGSIDNLDEGNNGNGN

SEQ ID NO: 91929 - protein, 34 aa, Artificial Sequence
  Description of Artificial Sequence: Synthetic polypeptide
DEEEIRTTNPVATEQYGMVGSIDNGGQGEEGNDF

SEQ ID NO: 91930 - protein, 34 aa, Artificial Sequence
  Description of Artificial Sequence: Synthetic polypeptide
DEEEIRTTNPVATEQYGMVGSIDNEGQGDGNEQN

SEQ ID NO: 91931 - protein, 35 aa, Artificial Sequence
  Description of Artificial Sequence: Synthetic polypeptide
AEEEIRTTNPVATEQYGSVSTTNQQGQQGNNNQNQ

SEQ ID NO: 91932 - protein, 35 aa, Artificial Sequence
  Description of Artificial Sequence: Synthetic polypeptide
AEEEIRTTNPVATEQYGSVSTTNQQDTEQGTNTNE

SEQ ID NO: 91933 - protein, 33 aa, Artificial Sequence
  Description of Artificial Sequence: Synthetic polypeptide
DEEEIRTTNPVATEQYGMVGSGNMNQNDIFNNE

SEQ ID NO: 91934 - protein, 34 aa, Artificial Sequence
  Description of Artificial Sequence: Synthetic polypeptide
DEEEIRTTNPVATEQYGMVGSGNMNQIEFGNDGG

SEQ ID NO: 91935 - protein, 34 aa, Artificial Sequence
  Description of Artificial Sequence: Synthetic polypeptide
AEEEIRTTNPVATEQYGSVSTTNQNQQQNANNED

SEQ ID NO: 91936 - protein, 34 aa, Artificial Sequence
  Description of Artificial Sequence: Synthetic polypeptide
AEEEIRTTNPVATEQYGSVSTTNQNQQQNANDED

SEQ ID NO: 91937 - protein, 34 aa, Artificial Sequence
  Description of Artificial Sequence: Synthetic polypeptide
AEEEIRTTNPVATEQYGSVSTTNQNQQQNAEEED

SEQ ID NO: 91938 - protein, 34 aa, Artificial Sequence
  Description of Artificial Sequence: Synthetic polypeptide
DEEEIRTTNPVATEQYGMVGSIGNDGQGEGNDTF

SEQ ID NO: 91939 - protein, 33 aa, Artificial Sequence
  Description of Artificial Sequence: Synthetic polypeptide
DEEEIRTCNPVATEGYGSVSFARLVRGNEQEEL

SEQ ID NO: 91940 - protein, 33 aa, Artificial Sequence
  Description of Artificial Sequence: Synthetic polypeptide
DEEEIRTCNPVATEQYGSVSTGGQSGGDGQEEQ

SEQ ID NO: 91941 - protein, 33 aa, Artificial Sequence
  Description of Artificial Sequence: Synthetic polypeptide
AEEEIRTTNPVATEQYGSVSTTNQNQQQATEED

SEQ ID NO: 91942 - protein, 34 aa, Artificial Sequence
  Description of Artificial Sequence: Synthetic polypeptide
DEEEIRTTNPVATEQYGMVGSGILNQGEGNGNGD

SEQ ID NO: 91943 - protein, 34 aa, Artificial Sequence
  Description of Artificial Sequence: Synthetic polypeptide
AEEEIRTTNPVATEQYGSVSTTNQNQQQANNEED

SEQ ID NO: 91944 - protein, 34 aa, Artificial Sequence
  Description of Artificial Sequence: Synthetic polypeptide
DEEEIRTTNPVATEQYGMVGSDTLNEGEGNGNGN

SEQ ID NO: 91945 - protein, 34 aa, Artificial Sequence
  Description of Artificial Sequence: Synthetic polypeptide
DEEEIRTTNPVATEQYGMVGSDTDNEGQGEGEQG

SEQ ID NO: 91946 - protein, 33 aa, Artificial Sequence
  Description of Artificial Sequence: Synthetic polypeptide
DEEEIRTTNPVATEQYGMVGSDTDIGQTEGEGG

SEQ ID NO: 91947 - protein, 32 aa, Artificial Sequence
  Description of Artificial Sequence: Synthetic polypeptide
DEEEIRTTNPVATEQYGMVGITGMGNGEDNGL

SEQ ID NO: 91948 - protein, 33 aa, Artificial Sequence
  Description of Artificial Sequence: Synthetic polypeptide
DEEEIRTTNPVATEQYGMVGITGMGNEQDNGGD

SEQ ID NO: 91949 - protein, 32 aa, Artificial Sequence
  Description of Artificial Sequence: Synthetic polypeptide
DEEEIRTTNPVATEQYGMVGITGMGNEEGNGG

SEQ ID NO: 91950 - protein, 35 aa, Artificial Sequence
  Description of Artificial Sequence: Synthetic polypeptide
AEEEIRTTNPVATEQYGSVSTTNQNQQQEGNNIET

SEQ ID NO: 91951 - protein, 36 aa, Artificial Sequence
  Description of Artificial Sequence: Synthetic polypeptide
AEEEIRTTNPVATEQYGSVSTTVNNLQSGTTENSED

SEQ ID NO: 91952 - protein, 36 aa, Artificial Sequence
  Description of Artificial Sequence: Synthetic polypeptide
AEEEIRTTNPVATEQYGSVSTTVNNLQTGNLGTTTE

SEQ ID NO: 91953 - protein, 36 aa, Artificial Sequence
  Description of Artificial Sequence: Synthetic polypeptide
AEEEIRTTNPVATEQYGSVSTTVNNLQTGNTNTATD

SEQ ID NO: 91954 - protein, 31 aa, Artificial Sequence
  Description of Artificial Sequence: Synthetic polypeptide
SEEEIATTNPVATEQYGSVANTALINDMNDW

SEQ ID NO: 91955 - protein, 34 aa, Artificial Sequence
  Description of Artificial Sequence: Synthetic polypeptide
SEEEIATTNPVATEQYGSVANTNNLPQEAGENDN

SEQ ID NO: 91956 - protein, 35 aa, Artificial Sequence
  Description of Artificial Sequence: Synthetic polypeptide
SEEEIATTNPVATEQYGSVANTNNLPQEAGENERD

SEQ ID NO: 91957 - protein, 34 aa, Artificial Sequence
  Description of Artificial Sequence: Synthetic polypeptide
DEEEIRTTNPVATEQYGQCVCSWGNLQNFNSDQA

SEQ ID NO: 91958 - protein, 33 aa, Artificial Sequence
  Description of Artificial Sequence: Synthetic polypeptide
DEEEIRTTNPVATEQYGQCVCSWGELQNFNSQQ

SEQ ID NO: 91959 - protein, 36 aa, Artificial Sequence
  Description of Artificial Sequence: Synthetic polypeptide
AEEEIRTTNPVATEQYGSVSTVQNLQQGIGNGNIGT

SEQ ID NO: 91960 - protein, 33 aa, Artificial Sequence
  Description of Artificial Sequence: Synthetic polypeptide
SEEEIATTNPVATEQYGSVATNLALDSMGDNQG

SEQ ID NO: 91961 - protein, 36 aa, Artificial Sequence
  Description of Artificial Sequence: Synthetic polypeptide
AEEEIRTTNPVATEQYGSVSTVQNLLNQDEQGNNVD

SEQ ID NO: 91962 - protein, 35 aa, Artificial Sequence
  Description of Artificial Sequence: Synthetic polypeptide
AEEEIRTTNPVATEQYGSVSTVQNLGTQGTNNQTE

SEQ ID NO: 91963 - protein, 33 aa, Artificial Sequence
  Description of Artificial Sequence: Synthetic polypeptide
SEEEIATTNPVATEQYGSVATNLPIEREENNED

SEQ ID NO: 91964 - protein, 35 aa, Artificial Sequence
  Description of Artificial Sequence: Synthetic polypeptide
AEEEIRTTNPVATEQYGSVSTVQNGTQGNGNNQTE

SEQ ID NO: 91965 - protein, 35 aa, Artificial Sequence
  Description of Artificial Sequence: Synthetic polypeptide
AEEEIRTTNPVATEQYGSVSTVQNGTQGGGNEQTE

SEQ ID NO: 91966 - protein, 34 aa, Artificial Sequence
  Description of Artificial Sequence: Synthetic polypeptide
AEEEIRTTNPVATEQYGSVSTVQNGNQQIGETQE

SEQ ID NO: 91967 - protein, 35 aa, Artificial Sequence
  Description of Artificial Sequence: Synthetic polypeptide
AEEEIRTTNPVATEQYGSVSTVQNGNQNTNGNNDD

SEQ ID NO: 91968 - protein, 35 aa, Artificial Sequence
  Description of Artificial Sequence: Synthetic polypeptide
AEEEIRTTNPVATEQYGSVSTVQNGNQEQGTNDTE

SEQ ID NO: 91969 - protein, 32 aa, Artificial Sequence
  Description of Artificial Sequence: Synthetic polypeptide
SEEEIATTNPVATEQYGSVATNNLNENLNEVN

SEQ ID NO: 91970 - protein, 33 aa, Artificial Sequence
  Description of Artificial Sequence: Synthetic polypeptide
SEEEIATTNPVATEQYGSVCATGGLDQDNDNRN

SEQ ID NO: 91971 - protein, 33 aa, Artificial Sequence
  Description of Artificial Sequence: Synthetic polypeptide
SEEEIATTNPVATEQYGSVCSATNNLHDSNDHE

SEQ ID NO: 91972 - protein, 33 aa, Artificial Sequence
  Description of Artificial Sequence: Synthetic polypeptide
SEEEIATTNPVATEQYGSVCSTNNLHDSNDNHD

SEQ ID NO: 91973 - protein, 33 aa, Artificial Sequence
  Description of Artificial Sequence: Synthetic polypeptide
SEEEIATTNPVATEQYGSVCSTNPLHDSNDHHM

SEQ ID NO: 91974 - protein, 33 aa, Artificial Sequence
  Description of Artificial Sequence: Synthetic polypeptide
SEEEIATTNPVATEQYGSVCSTNPLHNDSNDHE

SEQ ID NO: 91975 - protein, 32 aa, Artificial Sequence
  Description of Artificial Sequence: Synthetic polypeptide
SEEEIATTNPVATEQYGSVAMNNDQDGAGTER

SEQ ID NO: 91976 - protein, 35 aa, Artificial Sequence
  Description of Artificial Sequence: Synthetic polypeptide
SEEEIATTNPVATEQYGSVCSTNPLPQDSMGNPEE

SEQ ID NO: 91977 - protein, 32 aa, Artificial Sequence
  Description of Artificial Sequence: Synthetic polypeptide
SEEEIATTNPVATEQYGSVAMNLNTENPTVRQ

SEQ ID NO: 91978 - protein, 32 aa, Artificial Sequence
  Description of Artificial Sequence: Synthetic polypeptide
SEEEIATTNPVATEQYGSVAMNDNNGNLNERN

SEQ ID NO: 91979 - protein, 35 aa, Artificial Sequence
  Description of Artificial Sequence: Synthetic polypeptide
AEEEIRTTNPVATEQYGSVSTVSNNNQQQGTENQE

SEQ ID NO: 91980 - protein, 29 aa, Artificial Sequence
  Description of Artificial Sequence: Synthetic peptide
SEEEIATTNPVATASYGCIAATNDQRDNF

SEQ ID NO: 91981 - protein, 36 aa, Artificial Sequence
  Description of Artificial Sequence: Synthetic polypeptide
AEEEIRTTNPVATEQYGSVSTVSNLQQQNGNSEEGS

SEQ ID NO: 91982 - protein, 33 aa, Artificial Sequence
  Description of Artificial Sequence: Synthetic polypeptide
AEEEIRTTNPVATEQYGSVSTVQQQQQTNNQND

SEQ ID NO: 91983 - protein, 33 aa, Artificial Sequence
  Description of Artificial Sequence: Synthetic polypeptide
AEEEIRTTNPVATEQYGSVSTVQQQQQNTNQND

SEQ ID NO: 91984 - protein, 32 aa, Artificial Sequence
  Description of Artificial Sequence: Synthetic polypeptide
SEEEIATTNPVATEQYGCVATNLTAEGGNEEG

SEQ ID NO: 91985 - protein, 33 aa, Artificial Sequence
  Description of Artificial Sequence: Synthetic polypeptide
SEEEIATTNPVATEQYGCVATNNLENGMQENDR

SEQ ID NO: 91986 - protein, 28 aa, Artificial Sequence
  Description of Artificial Sequence: Synthetic peptide
SEEEIATTNPVATEQYGEAPEVCQHEER

SEQ ID NO: 91987 - protein, 32 aa, Artificial Sequence
  Description of Artificial Sequence: Synthetic polypeptide
DEEEIRGTNPVATEQYGSVSEPVGDRVSNSLN

SEQ ID NO: 91988 - protein, 32 aa, Artificial Sequence
  Description of Artificial Sequence: Synthetic polypeptide
DEEEIRGTNPVATEQYGSVSEVVGDRVDLSRG

SEQ ID NO: 91989 - protein, 33 aa, Artificial Sequence
  Description of Artificial Sequence: Synthetic polypeptide
DEEEIRGTNPVATEQYGSVSEVVTGDRVSNQRN

SEQ ID NO: 91990 - protein, 34 aa, Artificial Sequence
  Description of Artificial Sequence: Synthetic polypeptide
DEEEIRGTNPVATEQYGSVSIPNQLHELNQEVRD

SEQ ID NO: 91991 - protein, 33 aa, Artificial Sequence
  Description of Artificial Sequence: Synthetic polypeptide
DEEEIRGTNPVATEQYGSVSPVVHGDRNSNSRN

SEQ ID NO: 91992 - protein, 28 aa, Artificial Sequence
  Description of Artificial Sequence: Synthetic peptide
SEEEIATTNPVATEQYGEASEVCQHEEK

SEQ ID NO: 91993 - protein, 33 aa, Artificial Sequence
  Description of Artificial Sequence: Synthetic polypeptide
SEEEIATTNPVATEQYGSTCAMTENLEARDGDR

SEQ ID NO: 91994 - protein, 33 aa, Artificial Sequence
  Description of Artificial Sequence: Synthetic polypeptide
DEEEIRTTNPVATEQYGQCVSSEELQFFGSEQA

SEQ ID NO: 91995 - protein, 32 aa, Artificial Sequence
  Description of Artificial Sequence: Synthetic polypeptide
SEEEIATTNPVATEQYGSVAATGGQTQQGPNQ

SEQ ID NO: 91996 - protein, 33 aa, Artificial Sequence
  Description of Artificial Sequence: Synthetic polypeptide
DEEEIRGTNPVATEQYGSVSVVVQHDVGAVQRN

SEQ ID NO: 91997 - protein, 32 aa, Artificial Sequence
  Description of Artificial Sequence: Synthetic polypeptide
SEEEIATTNPVATEQYGSVAITNDQGEGGPQV

SEQ ID NO: 91998 - protein, 33 aa, Artificial Sequence
  Description of Artificial Sequence: Synthetic polypeptide
DEEEIRTTNPVATEQYGQCVCSWNPQNFNSDQS

SEQ ID NO: 91999 - protein, 33 aa, Artificial Sequence
  Description of Artificial Sequence: Synthetic polypeptide
DEEEIRTTNPVATEQYGQCVCSWNHQHFNSNQT

SEQ ID NO: 92000 - protein, 34 aa, Artificial Sequence
  Description of Artificial Sequence: Synthetic polypeptide
DEEEIRTTNPVATEQYGQCVCSWNHDQNFGSNQS

SEQ ID NO: 92001 - protein, 32 aa, Artificial Sequence
  Description of Artificial Sequence: Synthetic polypeptide
SEEEIATTNPVATEQYGSVSGTGPPQEADSRE

SEQ ID NO: 92002 - protein, 35 aa, Artificial Sequence
  Description of Artificial Sequence: Synthetic polypeptide
AEEEIRTTNPVATEQYGSVSTVNTNQQAIGTNNNI

SEQ ID NO: 92003 - protein, 36 aa, Artificial Sequence
  Description of Artificial Sequence: Synthetic polypeptide
AEEEIRTTNPVATEQYGSVSTVNTNLQSGTTDNEDD

SEQ ID NO: 92004 - protein, 34 aa, Artificial Sequence
  Description of Artificial Sequence: Synthetic polypeptide
AEEEIRTTNPVATEQYGSVSTVNQNNEQGENETD

SEQ ID NO: 92005 - protein, 35 aa, Artificial Sequence
  Description of Artificial Sequence: Synthetic polypeptide
AEEEIRTTNPVATEQYGSVSTVNQNGEQTGTNEQS

SEQ ID NO: 92006 - protein, 35 aa, Artificial Sequence
  Description of Artificial Sequence: Synthetic polypeptide
AEEEIRTTNPVATEQYGSVSTVNQLNENNQGTNVE

SEQ ID NO: 92007 - protein, 35 aa, Artificial Sequence
  Description of Artificial Sequence: Synthetic polypeptide
AEEEIRTTNPVATEQYGSVSTVNQLGNQQGTTEDE

SEQ ID NO: 92008 - protein, 35 aa, Artificial Sequence
  Description of Artificial Sequence: Synthetic polypeptide
AEEEIRTTNPVATEQYGSVSTVNNQTNDEGTNNNT

SEQ ID NO: 92009 - protein, 35 aa, Artificial Sequence
  Description of Artificial Sequence: Synthetic polypeptide
AEEEIRTTNPVATEQYGSVSTVNNQQQQGNGNITD

SEQ ID NO: 92010 - protein, 35 aa, Artificial Sequence
  Description of Artificial Sequence: Synthetic polypeptide
AEEEIRTTNPVATEQYGSVSTVNNQQQNDENNGNE

SEQ ID NO: 92011 - protein, 35 aa, Artificial Sequence
  Description of Artificial Sequence: Synthetic polypeptide
AEEEIRTTNPVATEQYGSVSTVNNQQQNDEGTNEE

SEQ ID NO: 92012 - protein, 35 aa, Artificial Sequence
  Description of Artificial Sequence: Synthetic polypeptide
AEEEIRTTNPVATEQYGSVSTVNNQQQNDEGNISE

SEQ ID NO: 92013 - protein, 35 aa, Artificial Sequence
  Description of Artificial Sequence: Synthetic polypeptide
AEEEIRTTNPVATEQYGSVSTVNNQQQGNANNQQD

SEQ ID NO: 92014 - protein, 35 aa, Artificial Sequence
  Description of Artificial Sequence: Synthetic polypeptide
AEEEIRTTNPVATEQYGSVSTVNNQQQGDEGNNND

SEQ ID NO: 92015 - protein, 35 aa, Artificial Sequence
  Description of Artificial Sequence: Synthetic polypeptide
AEEEIRTTNPVATEQYGSVSTVNNQQGEGEENEEE

SEQ ID NO: 92016 - protein, 35 aa, Artificial Sequence
  Description of Artificial Sequence: Synthetic polypeptide
AEEEIRTTNPVATEQYGSVSTVNNQQGEDEENDTG

SEQ ID NO: 92017 - protein, 35 aa, Artificial Sequence
  Description of Artificial Sequence: Synthetic polypeptide
AEEEIRTTNPVATEQYGSVSTVNNQNQEQGNQQTE

SEQ ID NO: 92018 - protein, 35 aa, Artificial Sequence
  Description of Artificial Sequence: Synthetic polypeptide
DEEEIRTTNPVATEQYGQCVCSTTELNQNFGSNQL

SEQ ID NO: 92019 - protein, 35 aa, Artificial Sequence
  Description of Artificial Sequence: Synthetic polypeptide
AEEEIRTTNPVATEQYGSVSTVNNQNQEEEGTNTQ

SEQ ID NO: 92020 - protein, 35 aa, Artificial Sequence
  Description of Artificial Sequence: Synthetic polypeptide
DEEEIRTTNPVATEQYGQCVCSTPNPQEGFNSEQS

SEQ ID NO: 92021 - protein, 35 aa, Artificial Sequence
  Description of Artificial Sequence: Synthetic polypeptide
AEEEIRTTNPVATEQYGSVSTVNNNQQGQEENDTG

SEQ ID NO: 92022 - protein, 34 aa, Artificial Sequence
  Description of Artificial Sequence: Synthetic polypeptide
DEEEIRTTNPVATEQYGQCVCSTNHQSFNSEPQG

SEQ ID NO: 92023 - protein, 35 aa, Artificial Sequence
  Description of Artificial Sequence: Synthetic polypeptide
AEEEIRTTNPVATEQYGSVSTVNNNQQGEEENEEG

SEQ ID NO: 92024 - protein, 34 aa, Artificial Sequence
  Description of Artificial Sequence: Synthetic polypeptide
DEEEIRTTNPVATEQYGQCVCSTNHQNFISNNQL

SEQ ID NO: 92025 - protein, 35 aa, Artificial Sequence
  Description of Artificial Sequence: Synthetic polypeptide
AEEEIRTTNPVATEQYGSVSTVNQNNQDTGEQGNQ

SEQ ID NO: 92026 - protein, 35 aa, Artificial Sequence
  Description of Artificial Sequence: Synthetic polypeptide
AEEEIRTTNPVATEQYGSVSTVNQNNQEAGNNTED

SEQ ID NO: 92027 - protein, 36 aa, Artificial Sequence
  Description of Artificial Sequence: Synthetic polypeptide
AEEEIRTTNPVATEQYGSVSTVNQNQLQSNDEGNNE

SEQ ID NO: 92028 - protein, 34 aa, Artificial Sequence
  Description of Artificial Sequence: Synthetic polypeptide
AEEEIRTTNPVATEQYGSVSTVNQNQQNANNEED

SEQ ID NO: 92029 - protein, 35 aa, Artificial Sequence
  Description of Artificial Sequence: Synthetic polypeptide
AEEEIRTTNPVATEQYGSVSTVNTNDGNQQGNNAE

SEQ ID NO: 92030 - protein, 36 aa, Artificial Sequence
  Description of Artificial Sequence: Synthetic polypeptide
AEEEIRTTNPVATEQYGSVSTVNTEQLGNQEEGNGN

SEQ ID NO: 92031 - protein, 31 aa, Artificial Sequence
  Description of Artificial Sequence: Synthetic polypeptide
SEEEIATTNPVATESYGSVAGTGLARDGDQD

SEQ ID NO: 92032 - protein, 31 aa, Artificial Sequence
  Description of Artificial Sequence: Synthetic polypeptide
SEEEIATTNPVATESYGSVAGTNLARNPDQG

SEQ ID NO: 92033 - protein, 32 aa, Artificial Sequence
  Description of Artificial Sequence: Synthetic polypeptide
SEEEIATTNPVATESYGVVAGTNLARDGDQRE

SEQ ID NO: 92034 - protein, 31 aa, Artificial Sequence
  Description of Artificial Sequence: Synthetic polypeptide
SEEEIATTNPVAYEPYGSVATNLQAGGQDEH

SEQ ID NO: 92035 - protein, 34 aa, Artificial Sequence
  Description of Artificial Sequence: Synthetic polypeptide
AEEEIRTTNPVATEQYGSVSTVNQQQQTGEIGTD

SEQ ID NO: 92036 - protein, 33 aa, Artificial Sequence
  Description of Artificial Sequence: Synthetic polypeptide
DEEEIRTTNPVATEQYGQCVCSWEPQRFGSEQN

SEQ ID NO: 92037 - protein, 35 aa, Artificial Sequence
  Description of Artificial Sequence: Synthetic polypeptide
AEEEIRTTNPVATEQYGSVSTVNQQQLEQGNQENN

SEQ ID NO: 92038 - protein, 33 aa, Artificial Sequence
  Description of Artificial Sequence: Synthetic polypeptide
DEEEIRTTNPVATEQYGQCVCSWELQNFNSEAQ

SEQ ID NO: 92039 - protein, 35 aa, Artificial Sequence
  Description of Artificial Sequence: Synthetic polypeptide
DEEEIRTTNPVATEQYGQSTCSMTENLNQSIGSDQ

SEQ ID NO: 92040 - protein, 34 aa, Artificial Sequence
  Description of Artificial Sequence: Synthetic polypeptide
DEEEIRTTNPVATEQYGQCVCSWELQESFGSNQL

SEQ ID NO: 92041 - protein, 30 aa, Artificial Sequence
  Description of Artificial Sequence: Synthetic polypeptide
SEEEICPTNPIATEQYGAVVEMNGMRGNAR

SEQ ID NO: 92042 - protein, 36 aa, Artificial Sequence
  Description of Artificial Sequence: Synthetic polypeptide
AEEEIRTTNPVATEQYGSVSTVNQQLQGQGNTNNAT

SEQ ID NO: 92043 - protein, 35 aa, Artificial Sequence
  Description of Artificial Sequence: Synthetic polypeptide
AEEEIRTTNPVATEQYGSVSTVNQQLGNDEGNNVD

SEQ ID NO: 92044 - protein, 35 aa, Artificial Sequence
  Description of Artificial Sequence: Synthetic polypeptide
AEEEIRTTNPVATEQYGSVSTVNQQGNQQGNEEDT

SEQ ID NO: 92045 - protein, 34 aa, Artificial Sequence
  Description of Artificial Sequence: Synthetic polypeptide
AEEEIRTTNPVATEQYGSVSTVNQNQQQQTNNND

SEQ ID NO: 92046 - protein, 31 aa, Artificial Sequence
  Description of Artificial Sequence: Synthetic polypeptide
SEEEICTTNPVATEMYGSVATNLQPTDDPAE

SEQ ID NO: 92047 - protein, 32 aa, Artificial Sequence
  Description of Artificial Sequence: Synthetic polypeptide
SEEEICTTNPVATEMYGSVATNLQPTGDPTEM

SEQ ID NO: 92048 - protein, 34 aa, Artificial Sequence
  Description of Artificial Sequence: Synthetic polypeptide
AEEEIRTTNPVATEQYGSVSTVNQNQQQNAEDED

SEQ ID NO: 92049 - protein, 34 aa, Artificial Sequence
  Description of Artificial Sequence: Synthetic polypeptide
AEEEIRTTNPVATEQYGSVSTVNQNQQQGEISTT

SEQ ID NO: 92050 - protein, 32 aa, Artificial Sequence
  Description of Artificial Sequence: Synthetic polypeptide
SEEEICTTNPVATEMYGSVATNLQRTPDPEAM

SEQ ID NO: 92051 - protein, 35 aa, Artificial Sequence
  Description of Artificial Sequence: Synthetic polypeptide
AEEEIRTTNPVATEQYGSVSTVNQQQGVQGNIGNN

SEQ ID NO: 92052 - protein, 34 aa, Artificial Sequence
  Description of Artificial Sequence: Synthetic polypeptide
AEEEIRTTNPVATEQYGSVSTVSNNQQQVEEINT

SEQ ID NO: 92053 - protein, 28 aa, Artificial Sequence
  Description of Artificial Sequence: Synthetic peptide
SEEEIATTNPIATEQYGEVSEVCMHEER

SEQ ID NO: 92054 - protein, 35 aa, Artificial Sequence
  Description of Artificial Sequence: Synthetic polypeptide
AEEEIRTTNPVATEQYGSVSTVSNQQQENGEAGND

SEQ ID NO: 92055 - protein, 32 aa, Artificial Sequence
  Description of Artificial Sequence: Synthetic polypeptide
SEEEIACTNPVATEQYGCVATNLQDAPDNERN

SEQ ID NO: 92056 - protein, 32 aa, Artificial Sequence
  Description of Artificial Sequence: Synthetic polypeptide
SEEEIACTNPVATEQYGCVATNLQDDGMDNQM

SEQ ID NO: 92057 - protein, 32 aa, Artificial Sequence
  Description of Artificial Sequence: Synthetic polypeptide
SEEEIACTNPVATEQYGCVATNLQEMPNEEGR

SEQ ID NO: 92058 - protein, 30 aa, Artificial Sequence
  Description of Artificial Sequence: Synthetic polypeptide
SEEEIACTNPVATEQYGCVATNLQGDDQID

SEQ ID NO: 92059 - protein, 32 aa, Artificial Sequence
  Description of Artificial Sequence: Synthetic polypeptide
SEEEIACTNPVATEQYGCVATNLQIDNIGNEN

SEQ ID NO: 92060 - protein, 32 aa, Artificial Sequence
  Description of Artificial Sequence: Synthetic polypeptide
SEEEIACTNPVATEQYGCVATNLQNPGENAAE

SEQ ID NO: 92061 - protein, 32 aa, Artificial Sequence
  Description of Artificial Sequence: Synthetic polypeptide
SEEEIACTNPVATEQYGCVATNLQRDDDNDID

SEQ ID NO: 92062 - protein, 31 aa, Artificial Sequence
  Description of Artificial Sequence: Synthetic polypeptide
SEEEIACTNPVATEQYGCVATNLQTPNPEHH

SEQ ID NO: 92063 - protein, 34 aa, Artificial Sequence
  Description of Artificial Sequence: Synthetic polypeptide
DEEEIRCTNPVATEQYGSVSTTPAGPNMRNGGPR

SEQ ID NO: 92064 - protein, 31 aa, Artificial Sequence
  Description of Artificial Sequence: Synthetic polypeptide
SEEEIACTNPVATEQYGCVATNLQVDDNDIQ

SEQ ID NO: 92065 - protein, 28 aa, Artificial Sequence
  Description of Artificial Sequence: Synthetic peptide
SEEEIACTNPVATEQYGEAPENCQHENK

SEQ ID NO: 92066 - protein, 28 aa, Artificial Sequence
  Description of Artificial Sequence: Synthetic peptide
SEEEIACTNPVATEQYGEAPEVLMRGEK

SEQ ID NO: 92067 - protein, 28 aa, Artificial Sequence
  Description of Artificial Sequence: Synthetic peptide
SEEEIACTNPVATEQYGEASEVLQHEEK

SEQ ID NO: 92068 - protein, 32 aa, Artificial Sequence
  Description of Artificial Sequence: Synthetic polypeptide
SEEEIACTNPVATEQYGSVAGNPLQDSGDTRM

SEQ ID NO: 92069 - protein, 32 aa, Artificial Sequence
  Description of Artificial Sequence: Synthetic polypeptide
DEEEIRCTNPVATEQYGTVCSAEDGPEREGND

SEQ ID NO: 92070 - protein, 31 aa, Artificial Sequence
  Description of Artificial Sequence: Synthetic polypeptide
SEEEIACTNPVATEQYGSVATNHDAEIGNDD

SEQ ID NO: 92071 - protein, 31 aa, Artificial Sequence
  Description of Artificial Sequence: Synthetic polypeptide
SEEEIACTNPVATEQYGSVATNLAEAANGTE

SEQ ID NO: 92072 - protein, 33 aa, Artificial Sequence
  Description of Artificial Sequence: Synthetic polypeptide
SEEEIACTNPVATEQYGSVATNLAEAGIGENRD

SEQ ID NO: 92073 - protein, 31 aa, Artificial Sequence
  Description of Artificial Sequence: Synthetic polypeptide
SEEEIACTNPVATEQYGSVATNLENADENDE

SEQ ID NO: 92074 - protein, 36 aa, Artificial Sequence
  Description of Artificial Sequence: Synthetic polypeptide
AEEEIRTTNPVATEQYGSVSTVTNLQEGTEGGNTAG

SEQ ID NO: 92075 - protein, 36 aa, Artificial Sequence
  Description of Artificial Sequence: Synthetic polypeptide
AEEEIRTTNPVATEQYGSVSTVTNLQAGDEAGNENG

SEQ ID NO: 92076 - protein, 33 aa, Artificial Sequence
  Description of Artificial Sequence: Synthetic polypeptide
DEEEIRTTNPVATEQYGSAASPTNDEQLVHLLD

SEQ ID NO: 92077 - protein, 31 aa, Artificial Sequence
  Description of Artificial Sequence: Synthetic polypeptide
SEEEIACTNPVATEQYGCVATNLQAEDDGRH

SEQ ID NO: 92078 - protein, 30 aa, Artificial Sequence
  Description of Artificial Sequence: Synthetic polypeptide
SEEEIACTNPVATEQYGCVATNLQAEAHMH

SEQ ID NO: 92079 - protein, 33 aa, Artificial Sequence
  Description of Artificial Sequence: Synthetic polypeptide
DEEEIRTTNPVATEQYGSAASYILDDDRSNEMM

SEQ ID NO: 92080 - protein, 32 aa, Artificial Sequence
  Description of Artificial Sequence: Synthetic polypeptide
SEEEIACTNPVATEAYGSVSTNLQDQAGGTEE

SEQ ID NO: 92081 - protein, 35 aa, Artificial Sequence
  Description of Artificial Sequence: Synthetic polypeptide
AEEEIRTTNPVATEQYGSVSTVTNNDEQGTETGND

SEQ ID NO: 92082 - protein, 31 aa, Artificial Sequence
  Description of Artificial Sequence: Synthetic polypeptide
SEEEIACTNPVATEIYGSVATNLQEAGGTPA

SEQ ID NO: 92083 - protein, 36 aa, Artificial Sequence
  Description of Artificial Sequence: Synthetic polypeptide
AEEEIRTTNPVATEQYGSVSTVTNLQQQGEQGTNSE

SEQ ID NO: 92084 - protein, 32 aa, Artificial Sequence
  Description of Artificial Sequence: Synthetic polypeptide
SEEEIACTNPVATEMYGSVATNLQDATGDQNE

SEQ ID NO: 92085 - protein, 33 aa, Artificial Sequence
  Description of Artificial Sequence: Synthetic polypeptide
DEEEIRTTNPVATEQYGSAFPTGNLEQVNILDN

SEQ ID NO: 92086 - protein, 32 aa, Artificial Sequence
  Description of Artificial Sequence: Synthetic polypeptide
SEEEIACTNPVATEMYGSVSTNLQDSTGTPTE

SEQ ID NO: 92087 - protein, 30 aa, Artificial Sequence
  Description of Artificial Sequence: Synthetic polypeptide
SEEEIACTNPVATEPYGNVATNLQSPMDRH

SEQ ID NO: 92088 - protein, 35 aa, Artificial Sequence
  Description of Artificial Sequence: Synthetic polypeptide
AEEEIRTTNPVATEQYGSVSTVTNLQQGTTEDEGN

SEQ ID NO: 92089 - protein, 33 aa, Artificial Sequence
  Description of Artificial Sequence: Synthetic polypeptide
DEEEIRCTNPVATEQYGSVSSTTAGNMRNGMGV

SEQ ID NO: 92090 - protein, 35 aa, Artificial Sequence
  Description of Artificial Sequence: Synthetic polypeptide
AEEEIRTTNPVATEQYGSVSTVTNLNSNQGTNQTT

SEQ ID NO: 92091 - protein, 36 aa, Artificial Sequence
  Description of Artificial Sequence: Synthetic polypeptide
AEEEIRTTNPVATEQYGSVSTVTNLQQGTNNQEDDT

SEQ ID NO: 92092 - protein, 32 aa, Artificial Sequence
  Description of Artificial Sequence: Synthetic polypeptide
SEEEIACTNPVATEPYGSVATNLQTGAGMNLE

SEQ ID NO: 92093 - protein, 36 aa, Artificial Sequence
  Description of Artificial Sequence: Synthetic polypeptide
AEEEIRTTNPVATEQYGSVSTVTNLQQGIGTTNQDG

SEQ ID NO: 92094 - protein, 35 aa, Artificial Sequence
  Description of Artificial Sequence: Synthetic polypeptide
AEEEIRTTNPVATEQYGSVSTVTNLQQANNEDEST

SEQ ID NO: 92095 - protein, 35 aa, Artificial Sequence
  Description of Artificial Sequence: Synthetic polypeptide
DEEEIRCTNPVATEQYGSVSSTTPALPNMRNGNPV

SEQ ID NO: 92096 - protein, 32 aa, Artificial Sequence
  Description of Artificial Sequence: Synthetic polypeptide
SEEEIACTNPVATEPYGVVSTNLQTGALMNSE

SEQ ID NO: 92097 - protein, 34 aa, Artificial Sequence
  Description of Artificial Sequence: Synthetic polypeptide
DEEEIRTTNPVATEQYGSACATNPELQEHDDNVG

SEQ ID NO: 92098 - protein, 32 aa, Artificial Sequence
  Description of Artificial Sequence: Synthetic polypeptide
SEEEIACTNPVATEQWGSVATNLQNDGMENQD

SEQ ID NO: 92099 - protein, 33 aa, Artificial Sequence
  Description of Artificial Sequence: Synthetic polypeptide
SEEEIACTNPVATEQYGCVATNLQAAADGNDRN

SEQ ID NO: 92100 - protein, 31 aa, Artificial Sequence
  Description of Artificial Sequence: Synthetic polypeptide
SEEEIACTNPVATEQYGCVATNLQADDNNDD

SEQ ID NO: 92101 - protein, 35 aa, Artificial Sequence
  Description of Artificial Sequence: Synthetic polypeptide
DEEEIRCTNPVATEQYGSVSTEPAGPNMRNGMNPR

SEQ ID NO: 92102 - protein, 36 aa, Artificial Sequence
  Description of Artificial Sequence: Synthetic polypeptide
AEEEIRTTNPVATEQYGSVSTVTNLQQGTNGTEDDE

SEQ ID NO: 92103 - protein, 34 aa, Artificial Sequence
  Description of Artificial Sequence: Synthetic polypeptide
DEEEIRTTNPVATEQYGQCVCSTNHQHSNSETQS

SEQ ID NO: 92104 - protein, 35 aa, Artificial Sequence
  Description of Artificial Sequence: Synthetic polypeptide
AEEEIRTTNPVATEQYGSVSTVTNLNSNNQGNNTA

SEQ ID NO: 92105 - protein, 34 aa, Artificial Sequence
  Description of Artificial Sequence: Synthetic polypeptide
DEEEIRTTNPVATEQYGQVSTMTNGQEGGGEDIT

SEQ ID NO: 92106 - protein, 32 aa, Artificial Sequence
  Description of Artificial Sequence: Synthetic polypeptide
SEEEIACTNPVATEQYGSVATPLQEAEGGNEY

SEQ ID NO: 92107 - protein, 35 aa, Artificial Sequence
  Description of Artificial Sequence: Synthetic polypeptide
AEEEIRTTNPVATEQYGSVSTVTNGEQQGTEAGNE

SEQ ID NO: 92108 - protein, 33 aa, Artificial Sequence
  Description of Artificial Sequence: Synthetic polypeptide
DEEEIRGTNPVATEQWGDSVSSTLLILGGGNDG

SEQ ID NO: 92109 - protein, 35 aa, Artificial Sequence
  Description of Artificial Sequence: Synthetic polypeptide
AEEEIRTTNPVATEQYGSVSTVTNDNQQGENNTTE

SEQ ID NO: 92110 - protein, 30 aa, Artificial Sequence
  Description of Artificial Sequence: Synthetic polypeptide
SEEEIACTNPVATESYGCVATNLQANPNDQ

SEQ ID NO: 92111 - protein, 32 aa, Artificial Sequence
  Description of Artificial Sequence: Synthetic polypeptide
SEEEIACTNPVAYEQYGSVATNDLQTRNPQNQ

SEQ ID NO: 92112 - protein, 29 aa, Artificial Sequence
  Description of Artificial Sequence: Synthetic peptide
SEEEIASTNPVATEGYGNVAENIMSRGQR

SEQ ID NO: 92113 - protein, 31 aa, Artificial Sequence
  Description of Artificial Sequence: Synthetic polypeptide
SEEEIASTNPVATEQYGFVNTANLDSRIGTH

SEQ ID NO: 92114 - protein, 28 aa, Artificial Sequence
  Description of Artificial Sequence: Synthetic peptide
SEEEIASVNPCCTEPYGVVSDNLQSGNN

SEQ ID NO: 92115 - protein, 34 aa, Artificial Sequence
  Description of Artificial Sequence: Synthetic polypeptide
DEEEIRGTNPVATEQWGTSVVSTLLIQGGGNDGD

SEQ ID NO: 92116 - protein, 32 aa, Artificial Sequence
  Description of Artificial Sequence: Synthetic polypeptide
DEEEIRGTNPVATEQWGTSVVTDLILGGGNDG

SEQ ID NO: 92117 - protein, 29 aa, Artificial Sequence
  Description of Artificial Sequence: Synthetic peptide
SEEEIASVNPVCTEAYGVVSCDNLQSGNQ

SEQ ID NO: 92118 - protein, 29 aa, Artificial Sequence
  Description of Artificial Sequence: Synthetic peptide
SEEEIASVNPVCTEIYGVVSDNLQNSGNM

SEQ ID NO: 92119 - protein, 28 aa, Artificial Sequence
  Description of Artificial Sequence: Synthetic peptide
SEEEIASVNPVCTENYGVVSDNLSSGNQ

SEQ ID NO: 92120 - protein, 34 aa, Artificial Sequence
  Description of Artificial Sequence: Synthetic polypeptide
DEEEIRGTNPVATEQYGAVNSDTNLIREGMGGGQ

SEQ ID NO: 92121 - protein, 29 aa, Artificial Sequence
  Description of Artificial Sequence: Synthetic peptide
SEEEIASVNPVCTEPYGVVSDNLQSGNQM

SEQ ID NO: 92122 - protein, 30 aa, Artificial Sequence
  Description of Artificial Sequence: Synthetic polypeptide
SEEEIASVNPVCTEQYGCVSWNLQESGNQA

SEQ ID NO: 92123 - protein, 35 aa, Artificial Sequence
  Description of Artificial Sequence: Synthetic polypeptide
AEEEIRTTNPVATEQYGSVSTVSNVNQQQGNNNND

SEQ ID NO: 92124 - protein, 28 aa, Artificial Sequence
  Description of Artificial Sequence: Synthetic peptide
SEEEIATTNPIATEQYGEAPEVCMRGER

SEQ ID NO: 92125 - protein, 28 aa, Artificial Sequence
  Description of Artificial Sequence: Synthetic peptide
SEEEIATTNPIATEQYGEAPEVCQHGER

SEQ ID NO: 92126 - protein, 28 aa, Artificial Sequence
  Description of Artificial Sequence: Synthetic peptide
SEEEIATTNPIATEQYGEASEVCQHENK

SEQ ID NO: 92127 - protein, 32 aa, Artificial Sequence
  Description of Artificial Sequence: Synthetic polypeptide
SEEEIACTNPVATEQYGSVATNPQAEAGNNLN

SEQ ID NO: 92128 - protein, 33 aa, Artificial Sequence
  Description of Artificial Sequence: Synthetic polypeptide
SEEEIACTNPVATEQYGSVATNNLENGMGENDR

SEQ ID NO: 92129 - protein, 34 aa, Artificial Sequence
  Description of Artificial Sequence: Synthetic polypeptide
AEEEIRTTNPVATEQYGSVSTVTNGNLGNEQANV

SEQ ID NO: 92130 - protein, 35 aa, Artificial Sequence
  Description of Artificial Sequence: Synthetic polypeptide
AEEEIRTTNPVATEQYGSVSTVTNGNNQEGNNESD

SEQ ID NO: 92131 - protein, 35 aa, Artificial Sequence
  Description of Artificial Sequence: Synthetic polypeptide
DEEEIRTTNPVATEQYGQVSTMTNGGQEGGENVII

SEQ ID NO: 92132 - protein, 35 aa, Artificial Sequence
  Description of Artificial Sequence: Synthetic polypeptide
AEEEIRTTNPVATEQYGSVSTVTNLNSNNNGNNTE

SEQ ID NO: 92133 - protein, 34 aa, Artificial Sequence
  Description of Artificial Sequence: Synthetic polypeptide
DEEEIRTTNPVATEQYGQVSTMTDDEQEGGENIG

SEQ ID NO: 92134 - protein, 30 aa, Artificial Sequence
  Description of Artificial Sequence: Synthetic polypeptide
DEEEIRCTNPVSTEPYGTISMDIQQRNGNH

SEQ ID NO: 92135 - protein, 34 aa, Artificial Sequence
  Description of Artificial Sequence: Synthetic polypeptide
DEEEIRTTNPVATEQYGQVSTDGMGNQGQGENEI

SEQ ID NO: 92136 - protein, 33 aa, Artificial Sequence
  Description of Artificial Sequence: Synthetic polypeptide
DEEEIRTTNPVATEQYGQVSTDGGGNDDQEQDG

SEQ ID NO: 92137 - protein, 31 aa, Artificial Sequence
  Description of Artificial Sequence: Synthetic polypeptide
DEEEIRCTNPVSTEPYGTISMENLQMQQGNH

SEQ ID NO: 92138 - protein, 35 aa, Artificial Sequence
  Description of Artificial Sequence: Synthetic polypeptide
AEEEIRTTNPVATEQYGSVSTVTNLNQQQNNNDED

SEQ ID NO: 92139 - protein, 32 aa, Artificial Sequence
  Description of Artificial Sequence: Synthetic polypeptide
SEEEIACTNPVATEQYGSVATNLQDPGEQAEE

SEQ ID NO: 92140 - protein, 32 aa, Artificial Sequence
  Description of Artificial Sequence: Synthetic polypeptide
SEEEIACTNPVATEQYGSVATNLQDTPWNAEE

SEQ ID NO: 92141 - protein, 34 aa, Artificial Sequence
  Description of Artificial Sequence: Synthetic polypeptide
DEEEIRCTNPVAYEQYGSVVQSVNEQSIRGGNNA

SEQ ID NO: 92142 - protein, 34 aa, Artificial Sequence
  Description of Artificial Sequence: Synthetic polypeptide
DEEEIRGTNPVAFEQYGQSGVSTGDDDQRGIRGD

SEQ ID NO: 92143 - protein, 35 aa, Artificial Sequence
  Description of Artificial Sequence: Synthetic polypeptide
AEEEIRTTNPVATEQYGSVSTVTNLNNEQQNNNDE

SEQ ID NO: 92144 - protein, 32 aa, Artificial Sequence
  Description of Artificial Sequence: Synthetic polypeptide
SEEEIACTNPVATEQYGSVATNLQGQEQDNTM

SEQ ID NO: 92145 - protein, 33 aa, Artificial Sequence
  Description of Artificial Sequence: Synthetic polypeptide
SEEEIACTNPVATEQYGSVATNLQGTPGENAEE

SEQ ID NO: 92146 - protein, 35 aa, Artificial Sequence
  Description of Artificial Sequence: Synthetic polypeptide
AEEEIRTTNPVATEQYGSVSTVTNLNEQGTNNVTE

SEQ ID NO: 92147 - protein, 33 aa, Artificial Sequence
  Description of Artificial Sequence: Synthetic polypeptide
SEEEIACTNPVATEQYGSVATNLQNGAGMENNH

SEQ ID NO: 92148 - protein, 33 aa, Artificial Sequence
  Description of Artificial Sequence: Synthetic polypeptide
SEEEIACTNPVATEQYGSVATNLQNPAGMENQI

SEQ ID NO: 92149 - protein, 31 aa, Artificial Sequence
  Description of Artificial Sequence: Synthetic polypeptide
DEEEIRGTNPVATECYGAMSTGNGEQGDTNF

SEQ ID NO: 92150 - protein, 36 aa, Artificial Sequence
  Description of Artificial Sequence: Synthetic polypeptide
AEEEIRTTNPVATEQYGSVSTVTNLLQGNDENGNVS

SEQ ID NO: 92151 - protein, 35 aa, Artificial Sequence
  Description of Artificial Sequence: Synthetic polypeptide
AEEEIRTTNPVATEQYGSVSTVTNGNQQQGNISNT

SEQ ID NO: 92152 - protein, 35 aa, Artificial Sequence
  Description of Artificial Sequence: Synthetic polypeptide
AEEEIRTTNPVATEQYGSVSTVTNGNQQGTEGNQQ

SEQ ID NO: 92153 - protein, 36 aa, Artificial Sequence
  Description of Artificial Sequence: Synthetic polypeptide
AEEEIRTTNPVATEQYGSVSTVTNLNNQDEGNNNVE

SEQ ID NO: 92154 - protein, 34 aa, Artificial Sequence
  Description of Artificial Sequence: Synthetic polypeptide
DEEEIRTTNPVATEQYGQCVCSTNHQENSNSDNQ

SEQ ID NO: 92155 - protein, 35 aa, Artificial Sequence
  Description of Artificial Sequence: Synthetic polypeptide
DEEEIRTTNPVATEQYGQCVCSTNHQENFGSNTQL

SEQ ID NO: 92156 - protein, 34 aa, Artificial Sequence
  Description of Artificial Sequence: Synthetic polypeptide
DEEEIRTTNPVATEQYGQCVCSTNHNQGFNSNQA

SEQ ID NO: 92157 - protein, 31 aa, Artificial Sequence
  Description of Artificial Sequence: Synthetic polypeptide
SEEEIRCTNPIATEQWGSVWGENDMDRGNER

SEQ ID NO: 92158 - protein, 32 aa, Artificial Sequence
  Description of Artificial Sequence: Synthetic polypeptide
SEEEIRCTNPIATEQWGSVYSGENDMRAGNAR

SEQ ID NO: 92159 - protein, 31 aa, Artificial Sequence
  Description of Artificial Sequence: Synthetic polypeptide
SEEEIRCTNPIATEQYGAAFVEMNGMRGNDR

SEQ ID NO: 92160 - protein, 34 aa, Artificial Sequence
  Description of Artificial Sequence: Synthetic polypeptide
AEEEIRTTNPVATEQYGSVSTVGNDQGNPNNNDE

SEQ ID NO: 92161 - protein, 36 aa, Artificial Sequence
  Description of Artificial Sequence: Synthetic polypeptide
AEEEIRTTNPVATEQYGSVSTVEQNNLQAGNTTNDT

SEQ ID NO: 92162 - protein, 34 aa, Artificial Sequence
  Description of Artificial Sequence: Synthetic polypeptide
AEEEIRTTNPVATEQYGSVSTVEGGNNNQGDNGV

SEQ ID NO: 92163 - protein, 31 aa, Artificial Sequence
  Description of Artificial Sequence: Synthetic polypeptide
SEEEIRCTNPIATEQYGAVVEMNGMRVGNER

SEQ ID NO: 92164 - protein, 35 aa, Artificial Sequence
  Description of Artificial Sequence: Synthetic polypeptide
AEEEIRTTNPVATEQYGSVSTVDQNNNQEEGNNQI

SEQ ID NO: 92165 - protein, 31 aa, Artificial Sequence
  Description of Artificial Sequence: Synthetic polypeptide
SEEEIRCTNPIATEQYGCVCSSNLMSGSNQS

SEQ ID NO: 92166 - protein, 31 aa, Artificial Sequence
  Description of Artificial Sequence: Synthetic polypeptide
SEEEIRCTNPIATEQYGCVCSWGELMRGSNQ

SEQ ID NO: 92167 - protein, 31 aa, Artificial Sequence
  Description of Artificial Sequence: Synthetic polypeptide
SEEEIRCTNPIATEQYGCVCSWGNLANGNQA

SEQ ID NO: 92168 - protein, 31 aa, Artificial Sequence
  Description of Artificial Sequence: Synthetic polypeptide
SEEEIRCTNPIATEQYGCVCSWNHAERFGNQ

SEQ ID NO: 92169 - protein, 32 aa, Artificial Sequence
  Description of Artificial Sequence: Synthetic polypeptide
SEEEIRCTNPIATEQYGCVCSWNLARFGSNQP

SEQ ID NO: 92170 - protein, 31 aa, Artificial Sequence
  Description of Artificial Sequence: Synthetic polypeptide
SEEEIRCTNPIATEQYGCVCSWNLIHSGSNQ

SEQ ID NO: 92171 - protein, 31 aa, Artificial Sequence
  Description of Artificial Sequence: Synthetic polypeptide
SEEEIRCTNPIATEQYGCVCSWNLMAGSNQA

SEQ ID NO: 92172 - protein, 30 aa, Artificial Sequence
  Description of Artificial Sequence: Synthetic polypeptide
SEEEIRCTNPIATEQYGCVCSWNLMHISNQ

SEQ ID NO: 92173 - protein, 31 aa, Artificial Sequence
  Description of Artificial Sequence: Synthetic polypeptide
SEEEIRCTNPIATEQYGCVCSWNLTRFGEQS

SEQ ID NO: 92174 - protein, 34 aa, Artificial Sequence
  Description of Artificial Sequence: Synthetic polypeptide
AEEEIRTTNPVATEQYGSVSTVDNNNNQGEENEE

SEQ ID NO: 92175 - protein, 35 aa, Artificial Sequence
  Description of Artificial Sequence: Synthetic polypeptide
DEEEIRTTNPVATEQYGQCVCSNTNLNQNFGSEQQ

SEQ ID NO: 92176 - protein, 34 aa, Artificial Sequence
  Description of Artificial Sequence: Synthetic polypeptide
DEEEIRTTNPVATEQYGQCVCSNTNHQNSNSNNQ

SEQ ID NO: 92177 - protein, 31 aa, Artificial Sequence
  Description of Artificial Sequence: Synthetic polypeptide
SEEEIRCTNPIATEQYGCVSWGNLMNGSNQA

SEQ ID NO: 92178 - protein, 36 aa, Artificial Sequence
  Description of Artificial Sequence: Synthetic polypeptide
AEEEIRTTNPVATEQYGSVSTVGNLQSGTTTNNAND

SEQ ID NO: 92179 - protein, 32 aa, Artificial Sequence
  Description of Artificial Sequence: Synthetic polypeptide
SEEEIRCTNPIATEQWGSVSGENDMNRHGNTR

SEQ ID NO: 92180 - protein, 32 aa, Artificial Sequence
  Description of Artificial Sequence: Synthetic polypeptide
SEEEIRCTNPIATEQWGSVSGENDDMRTGDNR

SEQ ID NO: 92181 - protein, 32 aa, Artificial Sequence
  Description of Artificial Sequence: Synthetic polypeptide
SEEEIRCTNPIATEQWGSVSGENDDMRREGNR

SEQ ID NO: 92182 - protein, 34 aa, Artificial Sequence
  Description of Artificial Sequence: Synthetic polypeptide
AEEEIRTTNPVATEQYGSVSTVNGNNQQEDENDT

SEQ ID NO: 92183 - protein, 36 aa, Artificial Sequence
  Description of Artificial Sequence: Synthetic polypeptide
AEEEIRTTNPVATEQYGSVSTVNGNLQQGTNGNEDD

SEQ ID NO: 92184 - protein, 35 aa, Artificial Sequence
  Description of Artificial Sequence: Synthetic polypeptide
AEEEIRTTNPVATEQYGSVSTVNGEQQGTEGGNVT

SEQ ID NO: 92185 - protein, 35 aa, Artificial Sequence
  Description of Artificial Sequence: Synthetic polypeptide
AEEEIRTTNPVATEQYGSVSTVNGEQQGNNGGNDT

SEQ ID NO: 92186 - protein, 35 aa, Artificial Sequence
  Description of Artificial Sequence: Synthetic polypeptide
AEEEIRTTNPVATEQYGSVSTVNDQQGETEENEEG

SEQ ID NO: 92187 - protein, 35 aa, Artificial Sequence
  Description of Artificial Sequence: Synthetic polypeptide
AEEEIRTTNPVATEQYGSVSTVNDNGNQQGNNVAE

SEQ ID NO: 92188 - protein, 33 aa, Artificial Sequence
  Description of Artificial Sequence: Synthetic polypeptide
SEEEIRCTNPIATEPYGSVSCENALSMRGGNNR

SEQ ID NO: 92189 - protein, 34 aa, Artificial Sequence
  Description of Artificial Sequence: Synthetic polypeptide
AEEEIRTTNPVATEQYGSVSTVGTNQQGNNNNVD

SEQ ID NO: 92190 - protein, 31 aa, Artificial Sequence
  Description of Artificial Sequence: Synthetic polypeptide
SEEEIRCTNPIATEPYGTISEEDLQMRNGNR

SEQ ID NO: 92191 - protein, 31 aa, Artificial Sequence
  Description of Artificial Sequence: Synthetic polypeptide
SEEEIRCTNPIATEPYGTISMEDLQMRNGNR

SEQ ID NO: 92192 - protein, 31 aa, Artificial Sequence
  Description of Artificial Sequence: Synthetic polypeptide
SEEEIRCTNPIATEQYGCVSWNHMRFGSNQS

SEQ ID NO: 92193 - protein, 34 aa, Artificial Sequence
  Description of Artificial Sequence: Synthetic polypeptide
AEEEIRTTNPVATEQYGSVSTVGNVNNQGTETNQ

SEQ ID NO: 92194 - protein, 29 aa, Artificial Sequence
  Description of Artificial Sequence: Synthetic peptide
SEEEIRCTNPIATEQWGDVSEIEMNRGDR

SEQ ID NO: 92195 - protein, 35 aa, Artificial Sequence
  Description of Artificial Sequence: Synthetic polypeptide
AEEEIRTTNPVATEQYGSVSTVGNNQQGNTTNEDE

SEQ ID NO: 92196 - protein, 32 aa, Artificial Sequence
  Description of Artificial Sequence: Synthetic polypeptide
SEEEIRCTNPIATEQWGSVCSGENDDMREGNR

SEQ ID NO: 92197 - protein, 31 aa, Artificial Sequence
  Description of Artificial Sequence: Synthetic polypeptide
SEEEIRCTNPIATEQWGSVFGENDMHRGNDR

SEQ ID NO: 92198 - protein, 32 aa, Artificial Sequence
  Description of Artificial Sequence: Synthetic polypeptide
SEEEIRCTNPIATEQWGSVFSWENDMTRGGNR

SEQ ID NO: 92199 - protein, 35 aa, Artificial Sequence
  Description of Artificial Sequence: Synthetic polypeptide
AEEEIRTTNPVATEQYGSVSTVGNNQQGNNVNEDE

SEQ ID NO: 92200 - protein, 31 aa, Artificial Sequence
  Description of Artificial Sequence: Synthetic polypeptide
SEEEIRCTNPIATEQWGSVSCNEPMDRGENG

SEQ ID NO: 92201 - protein, 35 aa, Artificial Sequence
  Description of Artificial Sequence: Synthetic polypeptide
AEEEIRTTNPVATEQYGSVSTVGNNNQQGSTNIGV

SEQ ID NO: 92202 - protein, 34 aa, Artificial Sequence
  Description of Artificial Sequence: Synthetic polypeptide
AEEEIRTTNPVATEQYGSVSTVGNNNQNQNNNDD

SEQ ID NO: 92203 - protein, 31 aa, Artificial Sequence
  Description of Artificial Sequence: Synthetic polypeptide
SEEEIRCTNPIATEQWGSVSGENDDDMRGER

SEQ ID NO: 92204 - protein, 34 aa, Artificial Sequence
  Description of Artificial Sequence: Synthetic polypeptide
AEEEIRTTNPVATEQYGSVSTVGNQQGNSNNTET

SEQ ID NO: 92205 - protein, 35 aa, Artificial Sequence
  Description of Artificial Sequence: Synthetic polypeptide
AEEEIRTTNPVATEQYGSVSTVNGNQAGNNNNEDQ

SEQ ID NO: 92206 - protein, 35 aa, Artificial Sequence
  Description of Artificial Sequence: Synthetic polypeptide
AEEEIRTTNPVATEQYGSVSTVDNGNQQQGNNQTD

SEQ ID NO: 92207 - protein, 35 aa, Artificial Sequence
  Description of Artificial Sequence: Synthetic polypeptide
DEEEIRTTNPVATEQYGQCVCSNTGNLQYFGSDQS

SEQ ID NO: 92208 - protein, 33 aa, Artificial Sequence
  Description of Artificial Sequence: Synthetic polypeptide
AEEEIRTTNPVATEQYGSVSTTVQQQQQETNNE

SEQ ID NO: 92209 - protein, 35 aa, Artificial Sequence
  Description of Artificial Sequence: Synthetic polypeptide
AEEEIRTTNPVATEQYGSVSTTVQLQQIGNNNNTE

SEQ ID NO: 92210 - protein, 34 aa, Artificial Sequence
  Description of Artificial Sequence: Synthetic polypeptide
DEEEIRTTNPVATEQYGQCVCSNTEELQGGSDQG

SEQ ID NO: 92211 - protein, 35 aa, Artificial Sequence
  Description of Artificial Sequence: Synthetic polypeptide
AEEEIRTTNPVATEQYGSVSTTVNQQNNSNGTNVE

SEQ ID NO: 92212 - protein, 34 aa, Artificial Sequence
  Description of Artificial Sequence: Synthetic polypeptide
DEEEIRTTNPVATEQYGQCVCSNTEDQFFGSNQP

SEQ ID NO: 92213 - protein, 35 aa, Artificial Sequence
  Description of Artificial Sequence: Synthetic polypeptide
AEEEIRTTNPVATEQYGSVSTTVNQNNQEGNNAEI

SEQ ID NO: 92214 - protein, 34 aa, Artificial Sequence
  Description of Artificial Sequence: Synthetic polypeptide
AEEEIRTTNPVATEQYGSVSTTVNQNGTVGNNNA

SEQ ID NO: 92215 - protein, 36 aa, Artificial Sequence
  Description of Artificial Sequence: Synthetic polypeptide
AEEEIRTTNPVATEQYGSVSTTVNQLQTGNNTTTTE

SEQ ID NO: 92216 - protein, 35 aa, Artificial Sequence
  Description of Artificial Sequence: Synthetic polypeptide
AEEEIRTTNPVATEQYGSVSTTVNQLQDEQGTTED

SEQ ID NO: 92217 - protein, 33 aa, Artificial Sequence
  Description of Artificial Sequence: Synthetic polypeptide
SEEEIRCTNPIATEQYGSTVPPCENLSTRGGNR

SEQ ID NO: 92218 - protein, 35 aa, Artificial Sequence
  Description of Artificial Sequence: Synthetic polypeptide
AEEEIRTTNPVATEQYGSVSTTVNNQQGNANNQQD

SEQ ID NO: 92219 - protein, 35 aa, Artificial Sequence
  Description of Artificial Sequence: Synthetic polypeptide
AEEEIRTTNPVATEQYGSVSTTVNNQNQQGNNDES

SEQ ID NO: 92220 - protein, 35 aa, Artificial Sequence
  Description of Artificial Sequence: Synthetic polypeptide
AEEEIRTTNPVATEQYGSVSTTVNNQLQGTENSEM

SEQ ID NO: 92221 - protein, 34 aa, Artificial Sequence
  Description of Artificial Sequence: Synthetic polypeptide
AEEEIRTTNPVATEQYGSVSTTVNNQLNVTENSE

SEQ ID NO: 92222 - protein, 32 aa, Artificial Sequence
  Description of Artificial Sequence: Synthetic polypeptide
SEEEIRCTNPIATEQYGSTVWSNAENLMPGPR

SEQ ID NO: 92223 - protein, 32 aa, Artificial Sequence
  Description of Artificial Sequence: Synthetic polypeptide
SEEEIRCTNPIATEQYGSTVWSNEENLMPGPR

SEQ ID NO: 92224 - protein, 31 aa, Artificial Sequence
  Description of Artificial Sequence: Synthetic polypeptide
SEEEIRCTNPIATEQYGSTWSNENLMERGPI

SEQ ID NO: 92225 - protein, 36 aa, Artificial Sequence
  Description of Artificial Sequence: Synthetic polypeptide
AEEEIRTTNPVATEQYGSVSTTVNNNLQAGTTENSE

SEQ ID NO: 92226 - protein, 35 aa, Artificial Sequence
  Description of Artificial Sequence: Synthetic polypeptide
AEEEIRTTNPVATEQYGSVSTTVNNNLEVGTENSE

SEQ ID NO: 92227 - protein, 34 aa, Artificial Sequence
  Description of Artificial Sequence: Synthetic polypeptide
AEEEIRTTNPVATEQYGSVSTTVNNLSVETENSE

SEQ ID NO: 92228 - protein, 36 aa, Artificial Sequence
  Description of Artificial Sequence: Synthetic polypeptide
AEEEIRTTNPVATEQYGSVSTTVNNLQVGTTENNSE

SEQ ID NO: 92229 - protein, 33 aa, Artificial Sequence
  Description of Artificial Sequence: Synthetic polypeptide
DEEEIRTTNPVATEQYGQCVCSNTEHQHFNSNQ

SEQ ID NO: 92230 - protein, 36 aa, Artificial Sequence
  Description of Artificial Sequence: Synthetic polypeptide
AEEEIRTTNPVATEQYGSVSTTVSNLQVGTTENSEE

SEQ ID NO: 92231 - protein, 34 aa, Artificial Sequence
  Description of Artificial Sequence: Synthetic polypeptide
DEEEIRTTNPVATEQYGQCVCSNTELQGFNSDQS

SEQ ID NO: 92232 - protein, 34 aa, Artificial Sequence
  Description of Artificial Sequence: Synthetic polypeptide
DEEEIRTTNPVATEQYGQCVCSNTELQHFGSEAF

SEQ ID NO: 92233 - protein, 35 aa, Artificial Sequence
  Description of Artificial Sequence: Synthetic polypeptide
DEEEIRTTNPVATEQYGQCVCSNTGNLQHFNSDQA

SEQ ID NO: 92234 - protein, 35 aa, Artificial Sequence
  Description of Artificial Sequence: Synthetic polypeptide
AEEEIRTTNPVATEQYGSVSTVDNGNQQQGENNTE

SEQ ID NO: 92235 - protein, 30 aa, Artificial Sequence
  Description of Artificial Sequence: Synthetic polypeptide
SEEEIRCTNPIATEQYGCVSWNPMSFGSNQ

SEQ ID NO: 92236 - protein, 32 aa, Artificial Sequence
  Description of Artificial Sequence: Synthetic polypeptide
SEEEIRCTNPIATEQYGCVTSSNLIRFGSNQS

SEQ ID NO: 92237 - protein, 35 aa, Artificial Sequence
  Description of Artificial Sequence: Synthetic polypeptide
AEEEIRTTNPVATEQYGSVSTVDNGNQQNGNNDQE

SEQ ID NO: 92238 - protein, 34 aa, Artificial Sequence
  Description of Artificial Sequence: Synthetic polypeptide
AEEEIRTTNPVATEQYGSVSTVDNGNQQNEENQE

SEQ ID NO: 92239 - protein, 35 aa, Artificial Sequence
  Description of Artificial Sequence: Synthetic polypeptide
AEEEIRTTNPVATEQYGSVSTVDNGNQQIGENEQE

SEQ ID NO: 92240 - protein, 28 aa, Artificial Sequence
  Description of Artificial Sequence: Synthetic peptide
SEEEIRCTNPIATEQYGEAPEVLQHGEK

SEQ ID NO: 92241 - protein, 35 aa, Artificial Sequence
  Description of Artificial Sequence: Synthetic polypeptide
AEEEIRTTNPVATEQYGSVSTVDNGNQQIGEETNQ

SEQ ID NO: 92242 - protein, 35 aa, Artificial Sequence
  Description of Artificial Sequence: Synthetic polypeptide
AEEEIRTTNPVATEQYGSVSTVDNGNQQGENNIQE

SEQ ID NO: 92243 - protein, 35 aa, Artificial Sequence
  Description of Artificial Sequence: Synthetic polypeptide
AEEEIRTTNPVATEQYGSVSTVDNGNQQQGNNNEE

SEQ ID NO: 92244 - protein, 35 aa, Artificial Sequence
  Description of Artificial Sequence: Synthetic polypeptide
AEEEIRTTNPVATEQYGSVSTVDNGNLEEGNNQEG

SEQ ID NO: 92245 - protein, 36 aa, Artificial Sequence
  Description of Artificial Sequence: Synthetic polypeptide
AEEEIRTTNPVATEQYGSVSTVANLTNQGEQGNNVD

SEQ ID NO: 92246 - protein, 36 aa, Artificial Sequence
  Description of Artificial Sequence: Synthetic polypeptide
AEEEIRTTNPVATEQYGSVSTVANLQNQEQGNNGVE

SEQ ID NO: 92247 - protein, 36 aa, Artificial Sequence
  Description of Artificial Sequence: Synthetic polypeptide
AEEEIRTTNPVATEQYGSVSTVANLQNQDEQGTNVE

SEQ ID NO: 92248 - protein, 36 aa, Artificial Sequence
  Description of Artificial Sequence: Synthetic polypeptide
AEEEIRTTNPVATEQYGSVSTVANLNQQGEEGNNVE

SEQ ID NO: 92249 - protein, 36 aa, Artificial Sequence
  Description of Artificial Sequence: Synthetic polypeptide
AEEEIRTTNPVATEQYGSVSTVANLNQQGEEGNNVD

SEQ ID NO: 92250 - protein, 36 aa, Artificial Sequence
  Description of Artificial Sequence: Synthetic polypeptide
AEEEIRTTNPVATEQYGSVSTVANLNQDEQGVTNVD

SEQ ID NO: 92251 - protein, 36 aa, Artificial Sequence
  Description of Artificial Sequence: Synthetic polypeptide
AEEEIRTTNPVATEQYGSVSTVANLNQDEQGNNNTD

SEQ ID NO: 92252 - protein, 36 aa, Artificial Sequence
  Description of Artificial Sequence: Synthetic polypeptide
AEEEIRTTNPVATEQYGSVSTVANLNQDELGTNNVT

SEQ ID NO: 92253 - protein, 36 aa, Artificial Sequence
  Description of Artificial Sequence: Synthetic polypeptide
AEEEIRTTNPVATEQYGSVSTTVTNLQSGTTENSEY

SEQ ID NO: 92254 - protein, 36 aa, Artificial Sequence
  Description of Artificial Sequence: Synthetic polypeptide
AEEEIRTTNPVATEQYGSVSTTVTNLQQGTQIGNGS

SEQ ID NO: 92255 - protein, 35 aa, Artificial Sequence
  Description of Artificial Sequence: Synthetic polypeptide
AEEEIRTTNPVATEQYGSVSTVDGNNQQGNQNNDD

SEQ ID NO: 92256 - protein, 32 aa, Artificial Sequence
  Description of Artificial Sequence: Synthetic polypeptide
SEEEIACTNPVATEAYGSVATNLQDAQGDQRE

SEQ ID NO: 92257 - protein, 31 aa, Artificial Sequence
  Description of Artificial Sequence: Synthetic polypeptide
SEEEIRCTNPIATECYGSTTWSEENLARGNI

SEQ ID NO: 92258 - protein, 31 aa, Artificial Sequence
  Description of Artificial Sequence: Synthetic polypeptide
SEEEIRCTNPIATECWGSVFSWENDMRDGNR

SEQ ID NO: 92259 - protein, 36 aa, Artificial Sequence
  Description of Artificial Sequence: Synthetic polypeptide
AEEEIRTTNPVATEQYGSVSTVNNLGNNQQGNNDTE

SEQ ID NO: 92260 - protein, 33 aa, Artificial Sequence
  Description of Artificial Sequence: Synthetic polypeptide
DEEEIRTTNPVATEQYGQCVCSTETQAFNSDQS

SEQ ID NO: 92261 - protein, 35 aa, Artificial Sequence
  Description of Artificial Sequence: Synthetic polypeptide
AEEEIRTTNPVATEQYGSVSTVNMQQGENEEEEEG

SEQ ID NO: 92262 - protein, 34 aa, Artificial Sequence
  Description of Artificial Sequence: Synthetic polypeptide
DEEEIRTTNPVATEQYGQCVCSTEPQNFGSNTQL

SEQ ID NO: 92263 - protein, 34 aa, Artificial Sequence
  Description of Artificial Sequence: Synthetic polypeptide
DEEEIRTTNPVATEQYGQCVCSTEPQGFGSNFQT

SEQ ID NO: 92264 - protein, 34 aa, Artificial Sequence
  Description of Artificial Sequence: Synthetic polypeptide
DEEEIRTTNPVATEQYGQCVCSTENHQEYFGSDQ

SEQ ID NO: 92265 - protein, 36 aa, Artificial Sequence
  Description of Artificial Sequence: Synthetic polypeptide
AEEEIRTTNPVATEQYGSVSTVNLQQQQGNGTTTTE

SEQ ID NO: 92266 - protein, 34 aa, Artificial Sequence
  Description of Artificial Sequence: Synthetic polypeptide
DEEEIRTTNPVATEQYGQCVCSTELQFFPSNNQS

SEQ ID NO: 92267 - protein, 34 aa, Artificial Sequence
  Description of Artificial Sequence: Synthetic polypeptide
DEEEIRTTNPVATEQYGQCVCSTELNQNFGSEQP

SEQ ID NO: 92268 - protein, 36 aa, Artificial Sequence
  Description of Artificial Sequence: Synthetic polypeptide
AEEEIRTTNPVATEQYGSVSTVNLQQQNGNGEEIGS

SEQ ID NO: 92269 - protein, 33 aa, Artificial Sequence
  Description of Artificial Sequence: Synthetic polypeptide
DEEEIRTTNPVATEQYGQCVCSTELENGSETQP

SEQ ID NO: 92270 - protein, 34 aa, Artificial Sequence
  Description of Artificial Sequence: Synthetic polypeptide
DEEEIRTTNPVATEQYGQCVCSTEHQRFNSNFQT

SEQ ID NO: 92271 - protein, 34 aa, Artificial Sequence
  Description of Artificial Sequence: Synthetic polypeptide
DEEEIRTTNPVATEQYGQCVCSTEHQRFGSDFQA

SEQ ID NO: 92272 - protein, 33 aa, Artificial Sequence
  Description of Artificial Sequence: Synthetic polypeptide
DEEEIRTTNPVATEQYGQCVCSTEHQNSNSNQQ

SEQ ID NO: 92273 - protein, 36 aa, Artificial Sequence
  Description of Artificial Sequence: Synthetic polypeptide
AEEEIRTTNPVATEQYGSVSTVNLQQQGENGNNQEN

SEQ ID NO: 92274 - protein, 33 aa, Artificial Sequence
  Description of Artificial Sequence: Synthetic polypeptide
DEEEIRTTNPVATEQYGQCVCSTEHQNFGSDQM

SEQ ID NO: 92275 - protein, 36 aa, Artificial Sequence
  Description of Artificial Sequence: Synthetic polypeptide
AEEEIRTTNPVATEQYGSVSTVNLQQQGEDEENEEG

SEQ ID NO: 92276 - protein, 33 aa, Artificial Sequence
  Description of Artificial Sequence: Synthetic polypeptide
DEEEIRTTNPVATEQYGQCVCSTEHQHGGSEQF

SEQ ID NO: 92277 - protein, 33 aa, Artificial Sequence
  Description of Artificial Sequence: Synthetic polypeptide
DEEEIRTTNPVATEQYGQCVCSTEHQHFGSDDA

SEQ ID NO: 92278 - protein, 34 aa, Artificial Sequence
  Description of Artificial Sequence: Synthetic polypeptide
DEEEIRTTNPVATEQYGQCVCSTEHQFFGSNNQY

SEQ ID NO: 92279 - protein, 34 aa, Artificial Sequence
  Description of Artificial Sequence: Synthetic polypeptide
DEEEIRTTNPVATEQYGQCVCSTEHNQNFGSNQS

SEQ ID NO: 92280 - protein, 36 aa, Artificial Sequence
  Description of Artificial Sequence: Synthetic polypeptide
AEEEIRTTNPVATEQYGSVSTVNNLNDNQQGTNTTE

SEQ ID NO: 92281 - protein, 33 aa, Artificial Sequence
  Description of Artificial Sequence: Synthetic polypeptide
DEEEIRTTNPVATEQYGQCVCSTGEDQNGSDQA

SEQ ID NO: 92282 - protein, 36 aa, Artificial Sequence
  Description of Artificial Sequence: Synthetic polypeptide
AEEEIRTTNPVATEQYGSVSTVNNLQNNNNGNNQQT

SEQ ID NO: 92283 - protein, 35 aa, Artificial Sequence
  Description of Artificial Sequence: Synthetic polypeptide
AEEEIRTTNPVATEQYGSVSTVNNLQQENGTTDTT

SEQ ID NO: 92284 - protein, 34 aa, Artificial Sequence
  Description of Artificial Sequence: Synthetic polypeptide
DEEEIRTTNPVATEQYGQCVCSTNHDQNFGSQQA

SEQ ID NO: 92285 - protein, 34 aa, Artificial Sequence
  Description of Artificial Sequence: Synthetic polypeptide
DEEEIRTTNPVATEQYGQCVCSTNDQNFNSNNQA

SEQ ID NO: 92286 - protein, 34 aa, Artificial Sequence
  Description of Artificial Sequence: Synthetic polypeptide
DEEEIRTTNPVATEQYGQCVCSTMELQNFGSQQT

SEQ ID NO: 92287 - protein, 34 aa, Artificial Sequence
  Description of Artificial Sequence: Synthetic polypeptide
DEEEIRTTNPVATEQYGQCVCSTMEHQSFGSNQL

SEQ ID NO: 92288 - protein, 30 aa, Artificial Sequence
  Description of Artificial Sequence: Synthetic polypeptide
SEEEIECTNPMATEQYGAVSEMNGMRPNDR

SEQ ID NO: 92289 - protein, 36 aa, Artificial Sequence
  Description of Artificial Sequence: Synthetic polypeptide
AEEEIRTTNPVATEQYGSVSTVNNNLQQQIGNQEND

SEQ ID NO: 92290 - protein, 35 aa, Artificial Sequence
  Description of Artificial Sequence: Synthetic polypeptide
DEEEIRTTNPVATEQYGQCVCSTGNPQEGFGSNQA

SEQ ID NO: 92291 - protein, 36 aa, Artificial Sequence
  Description of Artificial Sequence: Synthetic polypeptide
AEEEIRTTNPVATEQYGSVSTVNNNLQQGNGEDTSE

SEQ ID NO: 92292 - protein, 36 aa, Artificial Sequence
  Description of Artificial Sequence: Synthetic polypeptide
AEEEIRTTNPVATEQYGSVSTVNNNLQQGIGNNQES

SEQ ID NO: 92293 - protein, 36 aa, Artificial Sequence
  Description of Artificial Sequence: Synthetic polypeptide
AEEEIRTTNPVATEQYGSVSTVNNNLQQGEGNNQNT

SEQ ID NO: 92294 - protein, 36 aa, Artificial Sequence
  Description of Artificial Sequence: Synthetic polypeptide
AEEEIRTTNPVATEQYGSVSTVNLQNQTQQGTNATD

SEQ ID NO: 92295 - protein, 34 aa, Artificial Sequence
  Description of Artificial Sequence: Synthetic polypeptide
DEEEIRTTNPVATEQYGQCVCSTGNDQGFGSDQV

SEQ ID NO: 92296 - protein, 34 aa, Artificial Sequence
  Description of Artificial Sequence: Synthetic polypeptide
DEEEIRTTNPVATEQYGQCVCSTGELQHFGSEQA

SEQ ID NO: 92297 - protein, 36 aa, Artificial Sequence
  Description of Artificial Sequence: Synthetic polypeptide
AEEEIRTTNPVATEQYGSVSTVNNNLQEGIGTNSTQ

SEQ ID NO: 92298 - protein, 33 aa, Artificial Sequence
  Description of Artificial Sequence: Synthetic polypeptide
SEEEIKTTNPVATEQFGQVCSDTNALYGRGNAI

SEQ ID NO: 92299 - protein, 36 aa, Artificial Sequence
  Description of Artificial Sequence: Synthetic polypeptide
AEEEIRTTNPVATEQYGSVSTVNNNLGNQQGNNDTE

SEQ ID NO: 92300 - protein, 34 aa, Artificial Sequence
  Description of Artificial Sequence: Synthetic polypeptide
DEEEIRTTNPVATEQYGQCVCSTGEHQHGGSNDM

SEQ ID NO: 92301 - protein, 35 aa, Artificial Sequence
  Description of Artificial Sequence: Synthetic polypeptide
AEEEIRTTNPVATEQYGSVSTVNNNEQGTNGNETF

SEQ ID NO: 92302 - protein, 31 aa, Artificial Sequence
  Description of Artificial Sequence: Synthetic polypeptide
SEEEIRATNPAATEQYGSVVSENGMGGQNIG

SEQ ID NO: 92303 - protein, 35 aa, Artificial Sequence
  Description of Artificial Sequence: Synthetic polypeptide
AEEEIRTTNPVATEQYGSVSTVNNNDGQTGNVEEE

SEQ ID NO: 92304 - protein, 36 aa, Artificial Sequence
  Description of Artificial Sequence: Synthetic polypeptide
AEEEIRTTNPVATEQYGSVSTVNNLQQQQGNNNIGE

SEQ ID NO: 92305 - protein, 36 aa, Artificial Sequence
  Description of Artificial Sequence: Synthetic polypeptide
AEEEIRTTNPVATEQYGSVSTVNNLQQGENGVTENE

SEQ ID NO: 92306 - protein, 36 aa, Artificial Sequence
  Description of Artificial Sequence: Synthetic polypeptide
AEEEIRTTNPVATEQYGSVSTVNNNLQQGDEQQNDE

SEQ ID NO: 92307 - protein, 30 aa, Artificial Sequence
  Description of Artificial Sequence: Synthetic polypeptide
SEEEIRCTNPIATECYGATSNENLAERGPR

SEQ ID NO: 92308 - protein, 33 aa, Artificial Sequence
  Description of Artificial Sequence: Synthetic polypeptide
DEEEIRTTNPVATEQYGQCVCSTEHIYFGSNQL

SEQ ID NO: 92309 - protein, 34 aa, Artificial Sequence
  Description of Artificial Sequence: Synthetic polypeptide
DEEEIRTTNPVATEQYGQCVCSTEEHQHFGSNQA

SEQ ID NO: 92310 - protein, 36 aa, Artificial Sequence
  Description of Artificial Sequence: Synthetic polypeptide
AEEEIRTTNPVATEQYGSVSTVNLNQQGEGEENDEG

SEQ ID NO: 92311 - protein, 36 aa, Artificial Sequence
  Description of Artificial Sequence: Synthetic polypeptide
AEEEIRTTNPVATEQYGSVSTVNLNNQQGTNDTNNA

SEQ ID NO: 92312 - protein, 32 aa, Artificial Sequence
  Description of Artificial Sequence: Synthetic polypeptide
SEEEIRCTNPCATEQYGSVTRNEVLMRENQRI

SEQ ID NO: 92313 - protein, 32 aa, Artificial Sequence
  Description of Artificial Sequence: Synthetic polypeptide
SEEEIRCTNPCATEQYGSVTSNEWVLMRENQR

SEQ ID NO: 92314 - protein, 31 aa, Artificial Sequence
  Description of Artificial Sequence: Synthetic polypeptide
SEEEIRCTNPCATEQYGSVTSPERLERENQF

SEQ ID NO: 92315 - protein, 36 aa, Artificial Sequence
  Description of Artificial Sequence: Synthetic polypeptide
AEEEIRTTNPVATEQYGSVSTVNLNLQQGTNDTEEA

SEQ ID NO: 92316 - protein, 34 aa, Artificial Sequence
  Description of Artificial Sequence: Synthetic polypeptide
AEEEIRTTNPVATEQYGSVSTVNLNDNNNEENDE

SEQ ID NO: 92317 - protein, 35 aa, Artificial Sequence
  Description of Artificial Sequence: Synthetic polypeptide
AEEEIRTTNPVATEQYGSVSTVNLLQQNNGTTTTE

SEQ ID NO: 92318 - protein, 35 aa, Artificial Sequence
  Description of Artificial Sequence: Synthetic polypeptide
AEEEIRTTNPVATEQYGSVSTVNLLQQNNEEETTE

SEQ ID NO: 92319 - protein, 35 aa, Artificial Sequence
  Description of Artificial Sequence: Synthetic polypeptide
AEEEIRTTNPVATEQYGSVSTVNLLQQNNDETTTE

SEQ ID NO: 92320 - protein, 36 aa, Artificial Sequence
  Description of Artificial Sequence: Synthetic polypeptide
AEEEIRTTNPVATEQYGSVSTVNLLQQGNNNNTDTN

SEQ ID NO: 92321 - protein, 36 aa, Artificial Sequence
  Description of Artificial Sequence: Synthetic polypeptide
AEEEIRTTNPVATEQYGSVSTVNLLQQGNNNEQNTE

SEQ ID NO: 92322 - protein, 36 aa, Artificial Sequence
  Description of Artificial Sequence: Synthetic polypeptide
AEEEIRTTNPVATEQYGSVSTVNLLQENNQGTNTGE

SEQ ID NO: 92323 - protein, 35 aa, Artificial Sequence
  Description of Artificial Sequence: Synthetic polypeptide
AEEEIRTTNPVATEQYGSVSTVNLLIQNNNTTNTE

SEQ ID NO: 92324 - protein, 35 aa, Artificial Sequence
  Description of Artificial Sequence: Synthetic polypeptide
AEEEIRTTNPVATEQYGSVSTVNLGQQQNNNNNNA

SEQ ID NO: 92325 - protein, 35 aa, Artificial Sequence
  Description of Artificial Sequence: Synthetic polypeptide
AEEEIRTTNPVATEQYGSVSTVNGVNQQQGNNNND

SEQ ID NO: 92326 - protein, 35 aa, Artificial Sequence
  Description of Artificial Sequence: Synthetic polypeptide
AEEEIRTTNPVATEQYGSVSTVNGQQGENNENDTG

SEQ ID NO: 92327 - protein, 34 aa, Artificial Sequence
  Description of Artificial Sequence: Synthetic polypeptide
AEEEIRTTNPVATEQYGSVSTVNGNQQTNNNNVD

SEQ ID NO: 92328 - protein, 35 aa, Artificial Sequence
  Description of Artificial Sequence: Synthetic polypeptide
AEEEIRTTNPVATEQYGSVSTVNGNQQGEDETNDG

SEQ ID NO: 92329 - protein, 31 aa, Artificial Sequence
  Description of Artificial Sequence: Synthetic polypeptide
SEEEIRCTNPIATECWGSTVSNANWMERGNR

SEQ ID NO: 92330 - protein, 31 aa, Artificial Sequence
  Description of Artificial Sequence: Synthetic polypeptide
SEEEIRCTNPIATECWGSVASGENDMRHGNR

SEQ ID NO: 92331 - protein, 35 aa, Artificial Sequence
  Description of Artificial Sequence: Synthetic polypeptide
AEEEIRTTNPVATEQYGSVSTVNLNQQQNNTNNAD

SEQ ID NO: 92332 - protein, 33 aa, Artificial Sequence
  Description of Artificial Sequence: Synthetic polypeptide
SEEEIRCTNPCATEQYGSVRTNENWLERENQRH

SEQ ID NO: 92333 - protein, 34 aa, Artificial Sequence
  Description of Artificial Sequence: Synthetic polypeptide
DEEEIRTTNPVATEQYGQCVCSSEELQNFGSNQA

SEQ ID NO: 92334 - protein, 32 aa, Artificial Sequence
  Description of Artificial Sequence: Synthetic polypeptide
SEEEIRCTNPCATEQYGSVRTNENHLEREPQR

SEQ ID NO: 92335 - protein, 36 aa, Artificial Sequence
  Description of Artificial Sequence: Synthetic polypeptide
AEEEIRTTNPVATEQYGSVSTVNLQLQQGQNSTNAT

SEQ ID NO: 92336 - protein, 36 aa, Artificial Sequence
  Description of Artificial Sequence: Synthetic polypeptide
AEEEIRTTNPVATEQYGSVSTVNLQLQQGNTNQNAT

SEQ ID NO: 92337 - protein, 36 aa, Artificial Sequence
  Description of Artificial Sequence: Synthetic polypeptide
AEEEIRTTNPVATEQYGSVSTVNLQLQQGNTNNNNT

SEQ ID NO: 92338 - protein, 31 aa, Artificial Sequence
  Description of Artificial Sequence: Synthetic polypeptide
SEEEIRCTNPAATEQYGSVVSENGMGEGNGG

SEQ ID NO: 92339 - protein, 31 aa, Artificial Sequence
  Description of Artificial Sequence: Synthetic polypeptide
SEEEIRCTNPAATEQYGSVVSENGMGTGQNG

SEQ ID NO: 92340 - protein, 33 aa, Artificial Sequence
  Description of Artificial Sequence: Synthetic polypeptide
DEEEIRTTNPVATEQYGQCVCSTEDQNFGSDAA

SEQ ID NO: 92341 - protein, 34 aa, Artificial Sequence
  Description of Artificial Sequence: Synthetic polypeptide
DEEEIRTTNPVATEQYGQCVCSTEDQEYFGSNQP

SEQ ID NO: 92342 - protein, 36 aa, Artificial Sequence
  Description of Artificial Sequence: Synthetic polypeptide
AEEEIRTTNPVATEQYGSVSTVNLQLQQGNNNNNQT

SEQ ID NO: 92343 - protein, 36 aa, Artificial Sequence
  Description of Artificial Sequence: Synthetic polypeptide
AEEEIRTTNPVATEQYGSVSTVNLQLQQGENNENAT

SEQ ID NO: 92344 - protein, 31 aa, Artificial Sequence
  Description of Artificial Sequence: Synthetic polypeptide
SEEEIRCTNPCATEQYGCVCSWNHMRFGNQS

SEQ ID NO: 92345 - protein, 36 aa, Artificial Sequence
  Description of Artificial Sequence: Synthetic polypeptide
AEEEIRTTNPVATEQYGSVSTVNLQLQQGTTNTNAD

SEQ ID NO: 92346 - protein, 31 aa, Artificial Sequence
  Description of Artificial Sequence: Synthetic polypeptide
SEEEIRCTNPCATEQYGCVCSWNLIHGSNQA

SEQ ID NO: 92347 - protein, 32 aa, Artificial Sequence
  Description of Artificial Sequence: Synthetic polypeptide
SEEEIRCTNPCATEQYGCVRTENVLHRGENQD

SEQ ID NO: 92348 - protein, 36 aa, Artificial Sequence
  Description of Artificial Sequence: Synthetic polypeptide
AEEEIRTTNPVATEQYGSVSTVNLQLQGNTNGNNAT

SEQ ID NO: 92349 - protein, 35 aa, Artificial Sequence
  Description of Artificial Sequence: Synthetic polypeptide
AEEEIRTTNPVATEQYGSVSTVNLQLNNNDEQDED

SEQ ID NO: 92350 - protein, 33 aa, Artificial Sequence
  Description of Artificial Sequence: Synthetic polypeptide
SEEEIRCTNPCATEQYGRSVCSLENLERENQRA

SEQ ID NO: 92351 - protein, 35 aa, Artificial Sequence
  Description of Artificial Sequence: Synthetic polypeptide
AEEEIRTTNPVATEQYGSVSTVNLQGNNQQENDEQ

SEQ ID NO: 92352 - protein, 35 aa, Artificial Sequence
  Description of Artificial Sequence: Synthetic polypeptide
AEEEIRTTNPVATEQYGSVSTVNLQENNNNNNQQM

SEQ ID NO: 92353 - protein, 32 aa, Artificial Sequence
  Description of Artificial Sequence: Synthetic polypeptide
SEEEIRCTNPCATEQYGSVRTMENWLERENQI

SEQ ID NO: 92354 - protein, 33 aa, Artificial Sequence
  Description of Artificial Sequence: Synthetic polypeptide
DEEEIRTTNPVATEQYGQCVCSSELQYFGSEAS

SEQ ID NO: 92355 - protein, 33 aa, Artificial Sequence
  Description of Artificial Sequence: Synthetic polypeptide
SEEEIRCTNPCATEQYGSVRTNEETWLERENQR

SEQ ID NO: 92356 - protein, 33 aa, Artificial Sequence
  Description of Artificial Sequence: Synthetic polypeptide
DEEEIRTTNPVATEQYGQCVCSSEHQRFGSDQG

SEQ ID NO: 92357 - protein, 31 aa, Artificial Sequence
  Description of Artificial Sequence: Synthetic polypeptide
SEEEIRCTNPCATEQYGCVCSWNLNAHGSNQ

SEQ ID NO: 92358 - protein, 32 aa, Artificial Sequence
  Description of Artificial Sequence: Synthetic polypeptide
DEEEIRTTNPCATEEWGSVATTGNDHGGRGNA

SEQ ID NO: 92359 - protein, 34 aa, Artificial Sequence
  Description of Artificial Sequence: Synthetic polypeptide
DEEEICTTNPVAYEQYGSVSCTNSLSQSSGGEFK

SEQ ID NO: 92360 - protein, 28 aa, Artificial Sequence
  Description of Artificial Sequence: Synthetic peptide
QENEIATTNPVATECYGTVSAPLQHEEL

SEQ ID NO: 92361 - protein, 28 aa, Artificial Sequence
  Description of Artificial Sequence: Synthetic peptide
QEGEIAPTNPCATEQYGDVSCNLQHEEL

SEQ ID NO: 92362 - protein, 35 aa, Artificial Sequence
  Description of Artificial Sequence: Synthetic polypeptide
DEEEIRTTNPVATEQYGSVDSGTMNTDQGEGGGEG

SEQ ID NO: 92363 - protein, 35 aa, Artificial Sequence
  Description of Artificial Sequence: Synthetic polypeptide
DEEEIRTTNPVATEQYGSVDSGTDGDQEEGGNQDE

SEQ ID NO: 92364 - protein, 34 aa, Artificial Sequence
  Description of Artificial Sequence: Synthetic polypeptide
DEEEIRTTNPVATEQYGSVDSGMGGNQTIGNNFT

SEQ ID NO: 92365 - protein, 35 aa, Artificial Sequence
  Description of Artificial Sequence: Synthetic polypeptide
DEEEIRTTNPVATEQYGSVDSGFNNGLGQEFEGGQ

SEQ ID NO: 92366 - protein, 29 aa, Artificial Sequence
  Description of Artificial Sequence: Synthetic peptide
QEGEIAPTNPCATEQYGIVSCNLMSAGDR

SEQ ID NO: 92367 - protein, 29 aa, Artificial Sequence
  Description of Artificial Sequence: Synthetic peptide
QEGEIAPTNPCATEQYGIVSCNLNSGNPV

SEQ ID NO: 92368 - protein, 28 aa, Artificial Sequence
  Description of Artificial Sequence: Synthetic peptide
QEGEIAPTNPCATEQYGIVSCNLQHEEL

SEQ ID NO: 92369 - protein, 28 aa, Artificial Sequence
  Description of Artificial Sequence: Synthetic peptide
QEGEIAPTNPCATEQYGIVSCNLQSEEL

SEQ ID NO: 92370 - protein, 28 aa, Artificial Sequence
  Description of Artificial Sequence: Synthetic peptide
QEGEIAPTNPCATEQYGIVSCNLQSETL

SEQ ID NO: 92371 - protein, 34 aa, Artificial Sequence
  Description of Artificial Sequence: Synthetic polypeptide
DEEEIRTTNPVATEQYGSVDPVPNLMRDGVVQEI

SEQ ID NO: 92372 - protein, 28 aa, Artificial Sequence
  Description of Artificial Sequence: Synthetic peptide
QEGEIAPTNPCCSEQYGIVSCNLQSGTR

SEQ ID NO: 92373 - protein, 28 aa, Artificial Sequence
  Description of Artificial Sequence: Synthetic peptide
QEGEIAPTNPCCSEQYGVVSCNLQSGTR

SEQ ID NO: 92374 - protein, 28 aa, Artificial Sequence
  Description of Artificial Sequence: Synthetic peptide
QEGEIAPTNPCCTEQYGIVSCNLQSGTQ

SEQ ID NO: 92375 - protein, 28 aa, Artificial Sequence
  Description of Artificial Sequence: Synthetic peptide
QEGEIAPTNPCCTEQYGIVSDNLQSGTQ

SEQ ID NO: 92376 - protein, 34 aa, Artificial Sequence
  Description of Artificial Sequence: Synthetic polypeptide
DEEEIRTTNPVATEQYGSVDPIIILQERIGDEEI

SEQ ID NO: 92377 - protein, 28 aa, Artificial Sequence
  Description of Artificial Sequence: Synthetic peptide
QEGEIAPTNPCFSEQYGIVSCNLQSGTR

SEQ ID NO: 92378 - protein, 28 aa, Artificial Sequence
  Description of Artificial Sequence: Synthetic peptide
QEGEIAPTNPCGSEQYGIVSCNLQSGTR

SEQ ID NO: 92379 - protein, 28 aa, Artificial Sequence
  Description of Artificial Sequence: Synthetic peptide
QEGEIAPTNPCISEQYGIVSCNLQSGTR

SEQ ID NO: 92380 - protein, 28 aa, Artificial Sequence
  Description of Artificial Sequence: Synthetic peptide
QEGEIAPTNPCISEQYGTVSCNLQSGTR

SEQ ID NO: 92381 - protein, 34 aa, Artificial Sequence
  Description of Artificial Sequence: Synthetic polypeptide
DEEEIRTTNPVATEQYGSVDNPTNLTVLFVNEEI

SEQ ID NO: 92382 - protein, 30 aa, Artificial Sequence
  Description of Artificial Sequence: Synthetic polypeptide
QEGEIAPTNPCATEQYGAVSCNLQESGTYR

SEQ ID NO: 92383 - protein, 28 aa, Artificial Sequence
  Description of Artificial Sequence: Synthetic peptide
QEGEIAPTNPCSAEQYGIVSCNLQSGTR

SEQ ID NO: 92384 - protein, 28 aa, Artificial Sequence
  Description of Artificial Sequence: Synthetic peptide
QEGEIAPTNPCATEQWGIVSANWQSGPR

SEQ ID NO: 92385 - protein, 35 aa, Artificial Sequence
  Description of Artificial Sequence: Synthetic polypeptide
DEEEIRTTNPVATEQYGSVDSMENKLSQYLLNNNE

SEQ ID NO: 92386 - protein, 28 aa, Artificial Sequence
  Description of Artificial Sequence: Synthetic peptide
QEGEIAPTNPCASEQYGIVSCNCQSGTR

SEQ ID NO: 92387 - protein, 28 aa, Artificial Sequence
  Description of Artificial Sequence: Synthetic peptide
QEGEIAPTNPCASEQYGIVSCNLESGND

SEQ ID NO: 92388 - protein, 28 aa, Artificial Sequence
  Description of Artificial Sequence: Synthetic peptide
QEGEIAPTNPCASEQYGIVSCNLMSGTR

SEQ ID NO: 92389 - protein, 29 aa, Artificial Sequence
  Description of Artificial Sequence: Synthetic peptide
QEGEIAPTNPCASEQYGIVSCNLPQSGTR

SEQ ID NO: 92390 - protein, 29 aa, Artificial Sequence
  Description of Artificial Sequence: Synthetic peptide
QEGEIAPTNPCASEQYGIVSCNLQQSGTR

SEQ ID NO: 92391 - protein, 36 aa, Artificial Sequence
  Description of Artificial Sequence: Synthetic polypeptide
AEEEIRTTNPVATEQYGSVSVSVTNNLQQGTTNTQE

SEQ ID NO: 92392 - protein, 29 aa, Artificial Sequence
  Description of Artificial Sequence: Synthetic peptide
QEGEIAPTNPCASEQYGIVSCNLQSAGTR

SEQ ID NO: 92393 - protein, 28 aa, Artificial Sequence
  Description of Artificial Sequence: Synthetic peptide
QEGEIAPTNPCASEQYGIVSCNLQSETR

SEQ ID NO: 92394 - protein, 29 aa, Artificial Sequence
  Description of Artificial Sequence: Synthetic peptide
QEGEIAPTNPCASEQYGIVSCNLQSGNPV

SEQ ID NO: 92395 - protein, 35 aa, Artificial Sequence
  Description of Artificial Sequence: Synthetic polypeptide
DEEEIRTTNPVATEQYGSVDSPSWLLQRQGEEATT

SEQ ID NO: 92396 - protein, 36 aa, Artificial Sequence
  Description of Artificial Sequence: Synthetic polypeptide
DEEEIRTTNPVATEQYGSVDSPSVNLLQQRQGEETT

SEQ ID NO: 92397 - protein, 35 aa, Artificial Sequence
  Description of Artificial Sequence: Synthetic polypeptide
DEEEIRTTNPVATEQYGSVDSPSTGLLQQQGEETT

SEQ ID NO: 92398 - protein, 34 aa, Artificial Sequence
  Description of Artificial Sequence: Synthetic polypeptide
DEEEIRTTNPVATEQYGSVDSPSNLLIAQGEETT

SEQ ID NO: 92399 - protein, 35 aa, Artificial Sequence
  Description of Artificial Sequence: Synthetic polypeptide
DEEEIRTTNPVATEQYGSVDSPSNLLEQRQMEETT

SEQ ID NO: 92400 - protein, 35 aa, Artificial Sequence
  Description of Artificial Sequence: Synthetic polypeptide
DEEEIRTTNPVATEQYGSVDSPSMNLEQQMGEEQT

SEQ ID NO: 92401 - protein, 28 aa, Artificial Sequence
  Description of Artificial Sequence: Synthetic peptide
QEGEIAPTNPCASEQYGIVSCNLQSGTG

SEQ ID NO: 92402 - protein, 29 aa, Artificial Sequence
  Description of Artificial Sequence: Synthetic peptide
QEGEIAPTNPCASEQYGIVSCNLQSGTPR

SEQ ID NO: 92403 - protein, 29 aa, Artificial Sequence
  Description of Artificial Sequence: Synthetic peptide
QEGEIAPTNPCASEQYGIVSTDLQSEGER

SEQ ID NO: 92404 - protein, 29 aa, Artificial Sequence
  Description of Artificial Sequence: Synthetic peptide
QEGEIAPTNPCASEQYGSVSTCNGQSGTV

SEQ ID NO: 92405 - protein, 28 aa, Artificial Sequence
  Description of Artificial Sequence: Synthetic peptide
QEGEIAPTNPCASEQYGTVSCNLESGND

SEQ ID NO: 92406 - protein, 33 aa, Artificial Sequence
  Description of Artificial Sequence: Synthetic polypeptide
AEEEIRTTNPVATEQYGSVSVSVNQQQTNGTIL

SEQ ID NO: 92407 - protein, 28 aa, Artificial Sequence
  Description of Artificial Sequence: Synthetic peptide
QEGEIAPTNPCATECYGDVSENLQHEER

SEQ ID NO: 92408 - protein, 28 aa, Artificial Sequence
  Description of Artificial Sequence: Synthetic peptide
QEGEIAPTNPCSCEQYGIVSCNLQSGTR

SEQ ID NO: 92409 - protein, 28 aa, Artificial Sequence
  Description of Artificial Sequence: Synthetic peptide
QEGEIAPTNPCSCEQYGRVSCNLQSGTR

SEQ ID NO: 92410 - protein, 28 aa, Artificial Sequence
  Description of Artificial Sequence: Synthetic peptide
QEGEIAPTNPCSFEQYGIVSCNLQSGTR

SEQ ID NO: 92411 - protein, 28 aa, Artificial Sequence
  Description of Artificial Sequence: Synthetic peptide
QEGEIAPTNPCSSEQYGGVSCNLQSGTR

SEQ ID NO: 92412 - protein, 34 aa, Artificial Sequence
  Description of Artificial Sequence: Synthetic polypeptide
DEEEIRTTNPVATEQYGSVDEPHNLLQQGQEETD

SEQ ID NO: 92413 - protein, 28 aa, Artificial Sequence
  Description of Artificial Sequence: Synthetic peptide
QEGEIAPTNPCSSEQYGHVSCNLQSGTR

SEQ ID NO: 92414 - protein, 34 aa, Artificial Sequence
  Description of Artificial Sequence: Synthetic polypeptide
DEEEIRTTNPVATEQYGSVDDSDDDNGQGENGQT

SEQ ID NO: 92415 - protein, 28 aa, Artificial Sequence
  Description of Artificial Sequence: Synthetic peptide
QEGEIAPTNPCSSEQYGIVSANLQSGTR

SEQ ID NO: 92416 - protein, 35 aa, Artificial Sequence
  Description of Artificial Sequence: Synthetic polypeptide
DEEEIRTTNPVATEQYGSVDDPSMNLLQIQGEEQT

SEQ ID NO: 92417 - protein, 28 aa, Artificial Sequence
  Description of Artificial Sequence: Synthetic peptide
QEGEIAPTNPCSSEQYGIVSCNLQAGQR

SEQ ID NO: 92418 - protein, 34 aa, Artificial Sequence
  Description of Artificial Sequence: Synthetic polypeptide
DEEEIRTTNPVATEQYGSVCWPTGNLEGNEEQMD

SEQ ID NO: 92419 - protein, 28 aa, Artificial Sequence
  Description of Artificial Sequence: Synthetic peptide
QEGEIAPTNPCSSEQYGIVSCNLQAGTR

SEQ ID NO: 92420 - protein, 34 aa, Artificial Sequence
  Description of Artificial Sequence: Synthetic polypeptide
DEEEIRTTNPVATEQYGSVCVWPLEVLQTGEVRI

SEQ ID NO: 92421 - protein, 28 aa, Artificial Sequence
  Description of Artificial Sequence: Synthetic peptide
QEGEIAPTNPCSSEQYGIVSCNLQCGTR

SEQ ID NO: 92422 - protein, 36 aa, Artificial Sequence
  Description of Artificial Sequence: Synthetic polypeptide
DEEEIATTNPVATEQYGSVCAMTNGELQDNGQENRN

SEQ ID NO: 92423 - protein, 28 aa, Artificial Sequence
  Description of Artificial Sequence: Synthetic peptide
QEGEIAPTNPCSSEQYGIVSCNLQDGHR

SEQ ID NO: 92424 - protein, 28 aa, Artificial Sequence
  Description of Artificial Sequence: Synthetic peptide
QEGEIAPTNPCSSEQYGIVSCNLQDGMR

SEQ ID NO: 92425 - protein, 28 aa, Artificial Sequence
  Description of Artificial Sequence: Synthetic peptide
QEGEIAPTNPCSSEQYGIVSCNLQDGTR

SEQ ID NO: 92426 - protein, 28 aa, Artificial Sequence
  Description of Artificial Sequence: Synthetic peptide
QEGEIAPTNPCSSEQYGIVSCNLQEGTR

SEQ ID NO: 92427 - protein, 35 aa, Artificial Sequence
  Description of Artificial Sequence: Synthetic polypeptide
DEEEIRTTNPVATEQYGSVCVPTGNLEGGNMEQKN

SEQ ID NO: 92428 - protein, 28 aa, Artificial Sequence
  Description of Artificial Sequence: Synthetic peptide
QEGEIAPTNPCSSEQYGIVSCNLQGGTR

SEQ ID NO: 92429 - protein, 33 aa, Artificial Sequence
  Description of Artificial Sequence: Synthetic polypeptide
DEEEIRTTNPVATEQYGSVCVPPLEQAEAGGIE

SEQ ID NO: 92430 - protein, 33 aa, Artificial Sequence
  Description of Artificial Sequence: Synthetic polypeptide
DEEEIRTTNPVATEQYGSVCVPLLVQDEGEVTP

SEQ ID NO: 92431 - protein, 28 aa, Artificial Sequence
  Description of Artificial Sequence: Synthetic peptide
QEGEIAPTNPCSSEQYGIVSCNLQHGMR

SEQ ID NO: 92432 - protein, 28 aa, Artificial Sequence
  Description of Artificial Sequence: Synthetic peptide
QEGEIAPTNPCSSEQYGFVSCNLQSGTR

SEQ ID NO: 92433 - protein, 28 aa, Artificial Sequence
  Description of Artificial Sequence: Synthetic peptide
QEGEIAPTNPCSSEQYGEVSCNLQSGTR

SEQ ID NO: 92434 - protein, 28 aa, Artificial Sequence
  Description of Artificial Sequence: Synthetic peptide
QEGEIAPTNPCSSEQYGEVSCNLQSGGR

SEQ ID NO: 92435 - protein, 34 aa, Artificial Sequence
  Description of Artificial Sequence: Synthetic polypeptide
DEEEIRTTNPVATEQYGSVDGTNDDNNEGENEGT

SEQ ID NO: 92436 - protein, 28 aa, Artificial Sequence
  Description of Artificial Sequence: Synthetic peptide
QEGEIAPTNPCSHEQYGIVSCNLQSGTR

SEQ ID NO: 92437 - protein, 28 aa, Artificial Sequence
  Description of Artificial Sequence: Synthetic peptide
QEGEIAPTNPCSIEQYGIVSCNLQSGTR

SEQ ID NO: 92438 - protein, 28 aa, Artificial Sequence
  Description of Artificial Sequence: Synthetic peptide
QEGEIAPTNPCSIEQYGYVSCNLQSGTR

SEQ ID NO: 92439 - protein, 28 aa, Artificial Sequence
  Description of Artificial Sequence: Synthetic peptide
QEGEIAPTNPCSMEQYGIVSCNLQSGTR

SEQ ID NO: 92440 - protein, 28 aa, Artificial Sequence
  Description of Artificial Sequence: Synthetic peptide
QEGEIAPTNPCSNEQYGIVSCNLQSGTR

SEQ ID NO: 92441 - protein, 28 aa, Artificial Sequence
  Description of Artificial Sequence: Synthetic peptide
QEGEIAPTNPCSSEGYGSVSCNLQSGTR

SEQ ID NO: 92442 - protein, 28 aa, Artificial Sequence
  Description of Artificial Sequence: Synthetic peptide
QEGEIAPTNPCSSEIYGIVSTNLQSGTR

SEQ ID NO: 92443 - protein, 29 aa, Artificial Sequence
  Description of Artificial Sequence: Synthetic peptide
QEGEIAPTNPCSSEQWGIVSCNLQRGENR

SEQ ID NO: 92444 - protein, 28 aa, Artificial Sequence
  Description of Artificial Sequence: Synthetic peptide
QEGEIAPTNPCSSEQWGIVSCNLQSGNR

SEQ ID NO: 92445 - protein, 28 aa, Artificial Sequence
  Description of Artificial Sequence: Synthetic peptide
QEGEIAPTNPCSSEQYGAVSCNLQSGHR

SEQ ID NO: 92446 - protein, 28 aa, Artificial Sequence
  Description of Artificial Sequence: Synthetic peptide
QEGEIAPTNPCASEQYGIVPCNLQSGTR

SEQ ID NO: 92447 - protein, 28 aa, Artificial Sequence
  Description of Artificial Sequence: Synthetic peptide
QEGEIAPTNPCSSEQYGAVSCNLQSGTR

SEQ ID NO: 92448 - protein, 28 aa, Artificial Sequence
  Description of Artificial Sequence: Synthetic peptide
QEGEIAPTNPCSSEQYGDVSCNLQHGER

SEQ ID NO: 92449 - protein, 34 aa, Artificial Sequence
  Description of Artificial Sequence: Synthetic polypeptide
DEEEIRTTNPVATEQYGSVDLTPNQHQERDQDID

SEQ ID NO: 92450 - protein, 28 aa, Artificial Sequence
  Description of Artificial Sequence: Synthetic peptide
QEGEIAPTNPCSSEQYGDVSCNLQSGER

SEQ ID NO: 92451 - protein, 34 aa, Artificial Sequence
  Description of Artificial Sequence: Synthetic polypeptide
DEEEIRTTNPVATEQYGSVDLTNQTEQERDQMID

SEQ ID NO: 92452 - protein, 28 aa, Artificial Sequence
  Description of Artificial Sequence: Synthetic peptide
QEGEIAPTNPCSSEQYGDVSCNLQSGTR

SEQ ID NO: 92453 - protein, 28 aa, Artificial Sequence
  Description of Artificial Sequence: Synthetic peptide
QEGEIAPTNPCSSEQYGEASCNLQRGGR

SEQ ID NO: 92454 - protein, 34 aa, Artificial Sequence
  Description of Artificial Sequence: Synthetic polypeptide
DEEEIRTTNPVATEQYGSVDHPSNLLQQEQGETD

SEQ ID NO: 92455 - protein, 28 aa, Artificial Sequence
  Description of Artificial Sequence: Synthetic peptide
QEGEIAPTNPCSSEQYGEVSCNLQGGTR

SEQ ID NO: 92456 - protein, 35 aa, Artificial Sequence
  Description of Artificial Sequence: Synthetic polypeptide
DEEEIRTTNPVATEQYGSVDGTNDQGGGEDTNEGG

SEQ ID NO: 92457 - protein, 34 aa, Artificial Sequence
  Description of Artificial Sequence: Synthetic polypeptide
DEEEIRTTNPVATEQYGSVDGTNDDNNVGGNEGD

SEQ ID NO: 92458 - protein, 28 aa, Artificial Sequence
  Description of Artificial Sequence: Synthetic peptide
QEGEIAPTNPCSSEQYGCVSCNLQSGTR

SEQ ID NO: 92459 - protein, 34 aa, Artificial Sequence
  Description of Artificial Sequence: Synthetic polypeptide
DEEEIRTTNPVATEQYGSVDSQNPTSNIPELGFN

SEQ ID NO: 92460 - protein, 36 aa, Artificial Sequence
  Description of Artificial Sequence: Synthetic polypeptide
DEEEIRTTNPVATEQYGSVDSQTMNLQHELNEEEQQ

SEQ ID NO: 92461 - protein, 29 aa, Artificial Sequence
  Description of Artificial Sequence: Synthetic peptide
QEGEIAPTNPCASEQYGAVSCNLQESGTR

SEQ ID NO: 92462 - protein, 35 aa, Artificial Sequence
  Description of Artificial Sequence: Synthetic polypeptide
AEEEIRTTNPVATEQYGSVSVTNNENQQQGTNTDQ

SEQ ID NO: 92463 - protein, 35 aa, Artificial Sequence
  Description of Artificial Sequence: Synthetic polypeptide
DEEEIRTTNPVATEQYGSVDYPANLLQQRQGEQTD

SEQ ID NO: 92464 - protein, 33 aa, Artificial Sequence
  Description of Artificial Sequence: Synthetic polypeptide
QEEGIRTTNPVATEQYGSVSTDGQEGGGEGNGI

SEQ ID NO: 92465 - protein, 34 aa, Artificial Sequence
  Description of Artificial Sequence: Synthetic polypeptide
QEEGIRTTNPVATEQYGSVSTDNGLEDGLENDGD

SEQ ID NO: 92466 - protein, 31 aa, Artificial Sequence
  Description of Artificial Sequence: Synthetic polypeptide
QEEGIRTTNPVATEQYGSVSTGGGDNGQEDG

SEQ ID NO: 92467 - protein, 31 aa, Artificial Sequence
  Description of Artificial Sequence: Synthetic polypeptide
QEEGIRTTNPVATEQYGSVSTGGGDNNGQEG

SEQ ID NO: 92468 - protein, 33 aa, Artificial Sequence
  Description of Artificial Sequence: Synthetic polypeptide
QEEGIRTTNPVATEQYGSVSTNGDEEGQGNEGD

SEQ ID NO: 92469 - protein, 35 aa, Artificial Sequence
  Description of Artificial Sequence: Synthetic polypeptide
AEEEIRTTNPVATEQYGSVSVTNNDQANGNGTNNV

SEQ ID NO: 92470 - protein, 35 aa, Artificial Sequence
  Description of Artificial Sequence: Synthetic polypeptide
AEEEIRTTNPVATEQYGSVSVTNNDQAGNTTNQNV

SEQ ID NO: 92471 - protein, 34 aa, Artificial Sequence
  Description of Artificial Sequence: Synthetic polypeptide
DEEEIRTTNPVATEQYGSVDTTTDNNETGEGGNE

SEQ ID NO: 92472 - protein, 35 aa, Artificial Sequence
  Description of Artificial Sequence: Synthetic polypeptide
AEEEIRTTNPVATEQYGSVSVTNNDQAGNGGNDNG

SEQ ID NO: 92473 - protein, 33 aa, Artificial Sequence
  Description of Artificial Sequence: Synthetic polypeptide
DEEEIATTNPVATEQYGSVCAATNEEADTENRD

SEQ ID NO: 92474 - protein, 34 aa, Artificial Sequence
  Description of Artificial Sequence: Synthetic polypeptide
AEEEIRTTNPVATEQYGSVSVTNNDNAQGNNQNA

SEQ ID NO: 92475 - protein, 34 aa, Artificial Sequence
  Description of Artificial Sequence: Synthetic polypeptide
AEEEIRTTNPVATEQYGSVSVTNNDGAQGTNTNE

SEQ ID NO: 92476 - protein, 34 aa, Artificial Sequence
  Description of Artificial Sequence: Synthetic polypeptide
DEEEIRTTNPVATEQYGSVDTNQPDIGGNGGETF

SEQ ID NO: 92477 - protein, 34 aa, Artificial Sequence
  Description of Artificial Sequence: Synthetic polypeptide
DEEEIRTTNPVATEQYGSVDTNNMIEGGNEENEG

SEQ ID NO: 92478 - protein, 33 aa, Artificial Sequence
  Description of Artificial Sequence: Synthetic polypeptide
QEEGIRTTNPVATEQYGSVSTNGLGEGQDDVGG

SEQ ID NO: 92479 - protein, 33 aa, Artificial Sequence
  Description of Artificial Sequence: Synthetic polypeptide
QEEGIRTTNPVATEQYGSVSTNGLGGGQEDQGQ

SEQ ID NO: 92480 - protein, 34 aa, Artificial Sequence
  Description of Artificial Sequence: Synthetic polypeptide
QEEGIRTTNPVATEQYGSVSTNGQEEGGQGNEEE

SEQ ID NO: 92481 - protein, 33 aa, Artificial Sequence
  Description of Artificial Sequence: Synthetic polypeptide
DEEEIATTNPVATEQYGSVCAATQLQGAAENGN

SEQ ID NO: 92482 - protein, 34 aa, Artificial Sequence
  Description of Artificial Sequence: Synthetic polypeptide
DEEEIATTNPVATEQYGSVCAATSLQTEGPNQDA

SEQ ID NO: 92483 - protein, 35 aa, Artificial Sequence
  Description of Artificial Sequence: Synthetic polypeptide
AEEEIRTTNPVATEQYGSVSVTNNLEQGTTTNNNI

SEQ ID NO: 92484 - protein, 33 aa, Artificial Sequence
  Description of Artificial Sequence: Synthetic polypeptide
DEEEIRTTNPVATEQYGSVEAPILEQLTGEMQL

SEQ ID NO: 92485 - protein, 35 aa, Artificial Sequence
  Description of Artificial Sequence: Synthetic polypeptide
DEEEIRTTNPVATEQYGSVEAPNILVQRLGEQADV

SEQ ID NO: 92486 - protein, 35 aa, Artificial Sequence
  Description of Artificial Sequence: Synthetic polypeptide
DEEEIATTNPVATEQYGSVCAATMNLQNEDGGDRH

SEQ ID NO: 92487 - protein, 35 aa, Artificial Sequence
  Description of Artificial Sequence: Synthetic polypeptide
AEEEIRTTNPVATEQYGSVSVTNNNDQQGNNNNTE

SEQ ID NO: 92488 - protein, 32 aa, Artificial Sequence
  Description of Artificial Sequence: Synthetic polypeptide
DEEEIATTNPVATEQYGSVCAATMGEQPDGES

SEQ ID NO: 92489 - protein, 33 aa, Artificial Sequence
  Description of Artificial Sequence: Synthetic polypeptide
DEEEIRTTNPVATEQYGSVELTSQINEGENQEY

SEQ ID NO: 92490 - protein, 36 aa, Artificial Sequence
  Description of Artificial Sequence: Synthetic polypeptide
AEEEIRTTNPVATEQYGSVSVTNNLQQGNNQQGNTD

SEQ ID NO: 92491 - protein, 36 aa, Artificial Sequence
  Description of Artificial Sequence: Synthetic polypeptide
AEEEIRTTNPVATEQYGSVSVTNNLQQGNLGINTND

SEQ ID NO: 92492 - protein, 29 aa, Artificial Sequence
  Description of Artificial Sequence: Synthetic peptide
QEEEISTTNPVATEQYGVVATEVEQEEEG

SEQ ID NO: 92493 - protein, 28 aa, Artificial Sequence
  Description of Artificial Sequence: Synthetic peptide
QEEEIVTTNPVATEQYGEAPEVCQHGEK

SEQ ID NO: 92494 - protein, 28 aa, Artificial Sequence
  Description of Artificial Sequence: Synthetic peptide
QEEEIVTTNPVATEQYGEAPEVPQHGEK

SEQ ID NO: 92495 - protein, 33 aa, Artificial Sequence
  Description of Artificial Sequence: Synthetic polypeptide
QEEEIVTTNPVATEQYGSVSNNGLFQEGQGGET

SEQ ID NO: 92496 - protein, 34 aa, Artificial Sequence
  Description of Artificial Sequence: Synthetic polypeptide
DEEEIRTTNPVATEQYGSVEINMQEQVRTLNIDH

SEQ ID NO: 92497 - protein, 36 aa, Artificial Sequence
  Description of Artificial Sequence: Synthetic polypeptide
AEEEIRTTNPVATEQYGSVSVTNLGQQIGTTNAEEQ

SEQ ID NO: 92498 - protein, 29 aa, Artificial Sequence
  Description of Artificial Sequence: Synthetic peptide
QEEEIVTTNPVATEQYGTASEGPQFEEND

SEQ ID NO: 92499 - protein, 29 aa, Artificial Sequence
  Description of Artificial Sequence: Synthetic peptide
QEEEIVTTNPVATEQYGTASEVPQHEEND

SEQ ID NO: 92500 - protein, 30 aa, Artificial Sequence
  Description of Artificial Sequence: Synthetic polypeptide
QEEEIVTTNPVATEQYGTASTDGPQFEEND

SEQ ID NO: 92501 - protein, 31 aa, Artificial Sequence
  Description of Artificial Sequence: Synthetic polypeptide
QEEEIVTTNPVATEQYGTVCPATGPVQFGND

SEQ ID NO: 92502 - protein, 31 aa, Artificial Sequence
  Description of Artificial Sequence: Synthetic polypeptide
QEEEIVTTNPVATEQYGTVCPATGPVQFGNK

SEQ ID NO: 92503 - protein, 29 aa, Artificial Sequence
  Description of Artificial Sequence: Synthetic peptide
QEEEVASTNPVATEQYGEVPANVCQHGER

SEQ ID NO: 92504 - protein, 28 aa, Artificial Sequence
  Description of Artificial Sequence: Synthetic peptide
QEEEVATTNPVATEQYGEAPEVCQHGER

SEQ ID NO: 92505 - protein, 28 aa, Artificial Sequence
  Description of Artificial Sequence: Synthetic peptide
QEEEVATTNPVATEQYGEAPNVCQHGER

SEQ ID NO: 92506 - protein, 36 aa, Artificial Sequence
  Description of Artificial Sequence: Synthetic polypeptide
AEEEIRTTNPVATEQYGSVSVTNNLLQAGNIGNNND

SEQ ID NO: 92507 - protein, 35 aa, Artificial Sequence
  Description of Artificial Sequence: Synthetic polypeptide
DEEEIATTNPVATEQYGSVCAATMNLEAEDGNDRH

SEQ ID NO: 92508 - protein, 34 aa, Artificial Sequence
  Description of Artificial Sequence: Synthetic polypeptide
DEEEIRTTNPVATEQYGSVEATNVQQMSVSQPRS

SEQ ID NO: 92509 - protein, 29 aa, Artificial Sequence
  Description of Artificial Sequence: Synthetic peptide
QEEEIVTTNPVATEQYGTASEGPQHEEND

SEQ ID NO: 92510 - protein, 35 aa, Artificial Sequence
  Description of Artificial Sequence: Synthetic polypeptide
DEEEIATTNPVATEQYGSVCAMTNGLNQDAGNSED

SEQ ID NO: 92511 - protein, 32 aa, Artificial Sequence
  Description of Artificial Sequence: Synthetic polypeptide
DEEEIATTNPVATEQYGSVCADNNNLEMGQDQ

SEQ ID NO: 92512 - protein, 31 aa, Artificial Sequence
  Description of Artificial Sequence: Synthetic polypeptide
QEEIIRTTNPVATEQYGCVSTNGNTTFPENE

SEQ ID NO: 92513 - protein, 28 aa, Artificial Sequence
  Description of Artificial Sequence: Synthetic peptide
QEGEIACTNPCASEQYGEASCNLQSGTR

SEQ ID NO: 92514 - protein, 28 aa, Artificial Sequence
  Description of Artificial Sequence: Synthetic peptide
QEGEIACTNPCSIEQYGIVSCNLQSGTR

SEQ ID NO: 92515 - protein, 28 aa, Artificial Sequence
  Description of Artificial Sequence: Synthetic peptide
QEGEIACTNPCSSEQYGEVSCNLQSGTR

SEQ ID NO: 92516 - protein, 28 aa, Artificial Sequence
  Description of Artificial Sequence: Synthetic peptide
QEGEIACTNPCSSEQYGFVSCNLQSGTR

SEQ ID NO: 92517 - protein, 28 aa, Artificial Sequence
  Description of Artificial Sequence: Synthetic peptide
QEGEIACTNPCSSEQYGIVSCNLQSGTR

SEQ ID NO: 92518 - protein, 28 aa, Artificial Sequence
  Description of Artificial Sequence: Synthetic peptide
QEGEIACTNPCSSEQYGIVSENLQSGTR

SEQ ID NO: 92519 - protein, 28 aa, Artificial Sequence
  Description of Artificial Sequence: Synthetic peptide
QEGEIACTNPCSSEQYGTVSCNLQSGTR

SEQ ID NO: 92520 - protein, 28 aa, Artificial Sequence
  Description of Artificial Sequence: Synthetic peptide
QEGEIACTNPCSTEQYGIASCNLQSGTR

SEQ ID NO: 92521 - protein, 35 aa, Artificial Sequence
  Description of Artificial Sequence: Synthetic polypeptide
AEEEIRTTNPVATEQYGSVSVSVVNQLQAGNNTNE

SEQ ID NO: 92522 - protein, 28 aa, Artificial Sequence
  Description of Artificial Sequence: Synthetic peptide
QEGEIACTNPISSEQYGIVSCNLQSGTR

SEQ ID NO: 92523 - protein, 28 aa, Artificial Sequence
  Description of Artificial Sequence: Synthetic peptide
QEGEIAGTNPCSSEQYGIVSCNLQSGTR

SEQ ID NO: 92524 - protein, 28 aa, Artificial Sequence
  Description of Artificial Sequence: Synthetic peptide
QEGEIAGTNPCSWEQYGIVSCNLQSGTR

SEQ ID NO: 92525 - protein, 29 aa, Artificial Sequence
  Description of Artificial Sequence: Synthetic peptide
QEGEIAPTNPCASECWGIVSCNLQREGNR

SEQ ID NO: 92526 - protein, 28 aa, Artificial Sequence
  Description of Artificial Sequence: Synthetic peptide
QEGEIAPTNPCASECYGIVSCNLQSGTR

SEQ ID NO: 92527 - protein, 34 aa, Artificial Sequence
  Description of Artificial Sequence: Synthetic polypeptide
DEEEIRTTNPVATEQYGSVDSTDTGMQEGGETGG

SEQ ID NO: 92528 - protein, 36 aa, Artificial Sequence
  Description of Artificial Sequence: Synthetic polypeptide
DEEEIRTTNPVATEQYGSVDSTDLIFNQEGGEGNIQ

SEQ ID NO: 92529 - protein, 28 aa, Artificial Sequence
  Description of Artificial Sequence: Synthetic peptide
QEGEIAPTNPCASECYGIVSENLQSGTR

SEQ ID NO: 92530 - protein, 29 aa, Artificial Sequence
  Description of Artificial Sequence: Synthetic peptide
QEGEIAPTNPCASEQWGIVSCNLQREGNG

SEQ ID NO: 92531 - protein, 28 aa, Artificial Sequence
  Description of Artificial Sequence: Synthetic peptide
QEGEIAPTNPCASEQWGIVSCNLQSGNG

SEQ ID NO: 92532 - protein, 28 aa, Artificial Sequence
  Description of Artificial Sequence: Synthetic peptide
QEGEIAPTNPCASEQWGIVSCNLQSGPR

SEQ ID NO: 92533 - protein, 34 aa, Artificial Sequence
  Description of Artificial Sequence: Synthetic polypeptide
DEEEIRTTNPVATEQYGSVDSSMDEQERGELTGI

SEQ ID NO: 92534 - protein, 29 aa, Artificial Sequence
  Description of Artificial Sequence: Synthetic peptide
QEGEIAATNPCSSEQYGIVSTCNLQSGTR

SEQ ID NO: 92535 - protein, 34 aa, Artificial Sequence
  Description of Artificial Sequence: Synthetic polypeptide
DEEEIATTNPVATEQYGSVCAGTNLADDPGDNAE

SEQ ID NO: 92536 - protein, 28 aa, Artificial Sequence
  Description of Artificial Sequence: Synthetic peptide
QEGEIAATNPCSSEQYGIVSCNLQSGTR

SEQ ID NO: 92537 - protein, 28 aa, Artificial Sequence
  Description of Artificial Sequence: Synthetic peptide
QEGEIAATNPCSSEQYGIVSCNLQSGGR

SEQ ID NO: 92538 - protein, 34 aa, Artificial Sequence
  Description of Artificial Sequence: Synthetic polypeptide
DEEEIRTTNPVATEQYGSVDTGVNGQDEGEEDEG

SEQ ID NO: 92539 - protein, 33 aa, Artificial Sequence
  Description of Artificial Sequence: Synthetic polypeptide
DEEEIRTTNPVATEQYGSVDTGVGGGQGEQNEG

SEQ ID NO: 92540 - protein, 33 aa, Artificial Sequence
  Description of Artificial Sequence: Synthetic polypeptide
DEEEIRTTNPVATEQYGSVDTGNMDEDGGGEQG

SEQ ID NO: 92541 - protein, 30 aa, Artificial Sequence
  Description of Artificial Sequence: Synthetic polypeptide
QEEIIRTTNPVATEQYGCVSTTGETFPENE

SEQ ID NO: 92542 - protein, 32 aa, Artificial Sequence
  Description of Artificial Sequence: Synthetic polypeptide
QEEIIRTTNPVATEQYGCVSTTNEGQTFPENE

SEQ ID NO: 92543 - protein, 32 aa, Artificial Sequence
  Description of Artificial Sequence: Synthetic polypeptide
QEEIIRTTNPVAYEQYGCVSTNLGQQTFPENE

SEQ ID NO: 92544 - protein, 35 aa, Artificial Sequence
  Description of Artificial Sequence: Synthetic polypeptide
AEEEIRTTNPVATEQYGSVSVTGNNQQGSEGGNNT

SEQ ID NO: 92545 - protein, 35 aa, Artificial Sequence
  Description of Artificial Sequence: Synthetic polypeptide
DEEEIRTTNPVATEQYGSVDTDLSNGQAEEGNEET

SEQ ID NO: 92546 - protein, 32 aa, Artificial Sequence
  Description of Artificial Sequence: Synthetic polypeptide
QEETICTTNPVATEQYGSVSIMNGGQGGGNGG

SEQ ID NO: 92547 - protein, 35 aa, Artificial Sequence
  Description of Artificial Sequence: Synthetic polypeptide
AEEEIRTTNPVATEQYGSVSVTEQNGNQQGNNNDE

SEQ ID NO: 92548 - protein, 35 aa, Artificial Sequence
  Description of Artificial Sequence: Synthetic polypeptide
DEEEIRTTNPVATEQYGSVDTNIDFGQEGGNIEGE

SEQ ID NO: 92549 - protein, 33 aa, Artificial Sequence
  Description of Artificial Sequence: Synthetic polypeptide
DEEEIATTNPVATEQYGSVCAGEGLQNQDGQNH

SEQ ID NO: 92550 - protein, 28 aa, Artificial Sequence
  Description of Artificial Sequence: Synthetic peptide
QEEVICCTNPVAYEQWGSVAMNDQSGNS

SEQ ID NO: 92551 - protein, 30 aa, Artificial Sequence
  Description of Artificial Sequence: Synthetic polypeptide
QEEVICCTNPVAYEQYGSVAMNEQRGGNSF

SEQ ID NO: 92552 - protein, 28 aa, Artificial Sequence
  Description of Artificial Sequence: Synthetic peptide
QEFEIAPTNPCSSEQYGIVSCNLQSGTR

SEQ ID NO: 92553 - protein, 28 aa, Artificial Sequence
  Description of Artificial Sequence: Synthetic peptide
QEFEIATTNPVATECYGDVSECLQEEEL

SEQ ID NO: 92554 - protein, 28 aa, Artificial Sequence
  Description of Artificial Sequence: Synthetic peptide
QEFEIATTNPVATECYGDVSECLQHEED

SEQ ID NO: 92555 - protein, 28 aa, Artificial Sequence
  Description of Artificial Sequence: Synthetic peptide
QEFEIATTNPVATECYGDVSECLQHEEL

SEQ ID NO: 92556 - protein, 28 aa, Artificial Sequence
  Description of Artificial Sequence: Synthetic peptide
QEFEIATTNPVATECYGDVSECLQHEES

SEQ ID NO: 92557 - protein, 31 aa, Artificial Sequence
  Description of Artificial Sequence: Synthetic polypeptide
QEFEICTVNPVATEQYGSVAYTTMNLFEGNH

SEQ ID NO: 92558 - protein, 35 aa, Artificial Sequence
  Description of Artificial Sequence: Synthetic polypeptide
AEEEIRTTNPVATEQYGSVSVTENNGNQQGNNAED

SEQ ID NO: 92559 - protein, 34 aa, Artificial Sequence
  Description of Artificial Sequence: Synthetic polypeptide
DEEEIATTNPVATEQYGSVCAGTHLHQNSMGDNA

SEQ ID NO: 92560 - protein, 33 aa, Artificial Sequence
  Description of Artificial Sequence: Synthetic polypeptide
DEEEIATTNPVATEQYGSVCAGEGNGLQNDNGE

SEQ ID NO: 92561 - protein, 30 aa, Artificial Sequence
  Description of Artificial Sequence: Synthetic polypeptide
QEEEIRTTNPVGTEQYGSMATTGPQHNGDV

SEQ ID NO: 92562 - protein, 28 aa, Artificial Sequence
  Description of Artificial Sequence: Synthetic peptide
QEGEIAPTNPCSSEQYGIVSCNLQHGTR

SEQ ID NO: 92563 - protein, 28 aa, Artificial Sequence
  Description of Artificial Sequence: Synthetic peptide
QEGEIAPTNPCSSEQYGIVSCNLQMGTR

SEQ ID NO: 92564 - protein, 36 aa, Artificial Sequence
  Description of Artificial Sequence: Synthetic polypeptide
DEEEIRTTNPVATEQYGSVCSTTPADNANRFGMNPV

SEQ ID NO: 92565 - protein, 28 aa, Artificial Sequence
  Description of Artificial Sequence: Synthetic peptide
QEGEIAPTNPCSTEQYGIVSCNLQSEDR

SEQ ID NO: 92566 - protein, 28 aa, Artificial Sequence
  Description of Artificial Sequence: Synthetic peptide
QEGEIAPTNPCSTEQYGIVSCNLQSETR

SEQ ID NO: 92567 - protein, 29 aa, Artificial Sequence
  Description of Artificial Sequence: Synthetic peptide
QEGEIAPTNPCSTEQYGIVSCNLQSGTDR

SEQ ID NO: 92568 - protein, 28 aa, Artificial Sequence
  Description of Artificial Sequence: Synthetic peptide
QEGEIAPTNPCSTEQYGIVSCNLQSGTQ

SEQ ID NO: 92569 - protein, 28 aa, Artificial Sequence
  Description of Artificial Sequence: Synthetic peptide
QEGEIAPTNPCSTEQYGIVSCNWQSGTR

SEQ ID NO: 92570 - protein, 34 aa, Artificial Sequence
  Description of Artificial Sequence: Synthetic polypeptide
DEEEIATTNPVATEQYGSVCSVANLQEAGEMTDM

SEQ ID NO: 92571 - protein, 28 aa, Artificial Sequence
  Description of Artificial Sequence: Synthetic peptide
QEGEIAPTNPCSTEQYGIVSENLQSETR

SEQ ID NO: 92572 - protein, 30 aa, Artificial Sequence
  Description of Artificial Sequence: Synthetic polypeptide
QEGEIAPTNPCSTEQYGIVSTNLQDSEGER

SEQ ID NO: 92573 - protein, 36 aa, Artificial Sequence
  Description of Artificial Sequence: Synthetic polypeptide
DEEEIRTTNPVATEQYGSVCSTTGADNAERFGSNPV

SEQ ID NO: 92574 - protein, 33 aa, Artificial Sequence
  Description of Artificial Sequence: Synthetic polypeptide
AEEEIRTTNPVATEQYGSVSVNTNDTGNVNNTD

SEQ ID NO: 92575 - protein, 33 aa, Artificial Sequence
  Description of Artificial Sequence: Synthetic polypeptide
DEEEIATTNPVATEQYGSVCSVPDLQTEMGDDL

SEQ ID NO: 92576 - protein, 34 aa, Artificial Sequence
  Description of Artificial Sequence: Synthetic polypeptide
DEEEIRTTNPVATEQYGSVCSTTDGPVNFNGMNV

SEQ ID NO: 92577 - protein, 35 aa, Artificial Sequence
  Description of Artificial Sequence: Synthetic polypeptide
DEEEIRTTNPVATEQYGSVCSTTDAGVNREGMNPD

SEQ ID NO: 92578 - protein, 28 aa, Artificial Sequence
  Description of Artificial Sequence: Synthetic peptide
QEGEIAPTNPCSTEVYGIVSCNLQSGTR

SEQ ID NO: 92579 - protein, 28 aa, Artificial Sequence
  Description of Artificial Sequence: Synthetic peptide
QEGEIAPTNPCSVEQYGIVSCNLQSGTR

SEQ ID NO: 92580 - protein, 28 aa, Artificial Sequence
  Description of Artificial Sequence: Synthetic peptide
QEGEIAPTNPCSWEQYGIVSCNLQSGTR

SEQ ID NO: 92581 - protein, 28 aa, Artificial Sequence
  Description of Artificial Sequence: Synthetic peptide
QEGEIAPTNPCSWEQYGIVSINLQSGTR

SEQ ID NO: 92582 - protein, 28 aa, Artificial Sequence
  Description of Artificial Sequence: Synthetic peptide
QEGEIAPTNPCSYEQYGIVSCNLQGGDR

SEQ ID NO: 92583 - protein, 28 aa, Artificial Sequence
  Description of Artificial Sequence: Synthetic peptide
QEGEIAPTNPCSYEQYGIVSCNLQSGTR

SEQ ID NO: 92584 - protein, 29 aa, Artificial Sequence
  Description of Artificial Sequence: Synthetic peptide
DEEEIATTNPVATEQYGSVPEDCEHEEEL

SEQ ID NO: 92585 - protein, 28 aa, Artificial Sequence
  Description of Artificial Sequence: Synthetic peptide
QEGEIAPTNPCSTEQYGIVSCNLQHGTK

SEQ ID NO: 92586 - protein, 31 aa, Artificial Sequence
  Description of Artificial Sequence: Synthetic polypeptide
DEEEIATTNPVATEQYGSVPTVLEDHEEEDL

SEQ ID NO: 92587 - protein, 29 aa, Artificial Sequence
  Description of Artificial Sequence: Synthetic peptide
QEGEIAPTNPCSTEQYGIVSCNLQDSGER

SEQ ID NO: 92588 - protein, 28 aa, Artificial Sequence
  Description of Artificial Sequence: Synthetic peptide
QEGEIAPTNPCSTEQYGIVSCNLMSGTR

SEQ ID NO: 92589 - protein, 28 aa, Artificial Sequence
  Description of Artificial Sequence: Synthetic peptide
QEGEIAPTNPCSTEQWGIVSCNLQSGTR

SEQ ID NO: 92590 - protein, 36 aa, Artificial Sequence
  Description of Artificial Sequence: Synthetic polypeptide
DEEEIATTNPVATEQYGSVCSTNPLPQTEAEGEWNH

SEQ ID NO: 92591 - protein, 34 aa, Artificial Sequence
  Description of Artificial Sequence: Synthetic polypeptide
DEEEIATTNPVATEQYGSVCSTNPQNGMGMGTDN

SEQ ID NO: 92592 - protein, 34 aa, Artificial Sequence
  Description of Artificial Sequence: Synthetic polypeptide
DEEEIRTTNPVATEQYGSVCSTVLTFNDSLEEDN

SEQ ID NO: 92593 - protein, 35 aa, Artificial Sequence
  Description of Artificial Sequence: Synthetic polypeptide
DEEEIATTNPVATEQYGSVCSTNQDQDAGEGNEDD

SEQ ID NO: 92594 - protein, 34 aa, Artificial Sequence
  Description of Artificial Sequence: Synthetic polypeptide
DEEEIATTNPVATEQYGSVCSTPGAEAEIGNGRF

SEQ ID NO: 92595 - protein, 34 aa, Artificial Sequence
  Description of Artificial Sequence: Synthetic polypeptide
DEEEIATTNPVATEQYGSVCSTPPLPEHGENEAE

SEQ ID NO: 92596 - protein, 34 aa, Artificial Sequence
  Description of Artificial Sequence: Synthetic polypeptide
DEEEIATTNPVATEQYGSVCSTSNDSNDHGGRDT

SEQ ID NO: 92597 - protein, 28 aa, Artificial Sequence
  Description of Artificial Sequence: Synthetic peptide
QEGEIAPTNPCSTEQYGDVSENLQSETR

SEQ ID NO: 92598 - protein, 28 aa, Artificial Sequence
  Description of Artificial Sequence: Synthetic peptide
QEGEIAPTNPCSTEQYGIASCNLQSGTR

SEQ ID NO: 92599 - protein, 28 aa, Artificial Sequence
  Description of Artificial Sequence: Synthetic peptide
QEGEIAPTNPCSTEQYGIISCNLQQGTR

SEQ ID NO: 92600 - protein, 28 aa, Artificial Sequence
  Description of Artificial Sequence: Synthetic peptide
QEGEIAPTNPCSTEQYGIISCNLQSGTR

SEQ ID NO: 92601 - protein, 35 aa, Artificial Sequence
  Description of Artificial Sequence: Synthetic polypeptide
DEEEIRTTNPVATEQYGSVCSTTPAGVNRNGMNPD

SEQ ID NO: 92602 - protein, 35 aa, Artificial Sequence
  Description of Artificial Sequence: Synthetic polypeptide
DEEEIRTTNPVATEQYGSVCSTTPAGVNREGMNPD

SEQ ID NO: 92603 - protein, 28 aa, Artificial Sequence
  Description of Artificial Sequence: Synthetic peptide
QEGEIAPTNPCSTEQYGIISMNLQQGTR

SEQ ID NO: 92604 - protein, 28 aa, Artificial Sequence
  Description of Artificial Sequence: Synthetic peptide
QEGEIAPTNPCSTEQYGIVACNLQSGTR

SEQ ID NO: 92605 - protein, 36 aa, Artificial Sequence
  Description of Artificial Sequence: Synthetic polypeptide
DEEEIRTTNPVATEQYGSVCSTTPAGPNLRQGMNPV

SEQ ID NO: 92606 - protein, 29 aa, Artificial Sequence
  Description of Artificial Sequence: Synthetic peptide
QEGEIAPTNPCSTEQYGIVSANLQSGTYR

SEQ ID NO: 92607 - protein, 36 aa, Artificial Sequence
  Description of Artificial Sequence: Synthetic polypeptide
DEEEIRTTNPVATEQYGSVCSTTPAGNNNRNGSNPV

SEQ ID NO: 92608 - protein, 36 aa, Artificial Sequence
  Description of Artificial Sequence: Synthetic polypeptide
DEEEIRTTNPVATEQYGSVCSTTPAGNINRLGMNPV

SEQ ID NO: 92609 - protein, 29 aa, Artificial Sequence
  Description of Artificial Sequence: Synthetic peptide
QEGEIAPTNPCSTEQYGIVSCDNLQSGTR

SEQ ID NO: 92610 - protein, 28 aa, Artificial Sequence
  Description of Artificial Sequence: Synthetic peptide
QEGEIAPTNPCSTEQYGIVSCNLQAGTA

SEQ ID NO: 92611 - protein, 29 aa, Artificial Sequence
  Description of Artificial Sequence: Synthetic peptide
QEGEIAPTNPCSYEQYGKVSCNLQSGDNR

SEQ ID NO: 92612 - protein, 28 aa, Artificial Sequence
  Description of Artificial Sequence: Synthetic peptide
QEGEIAPTNPCSYEQYGTVSCNLQNGTR

SEQ ID NO: 92613 - protein, 32 aa, Artificial Sequence
  Description of Artificial Sequence: Synthetic polypeptide
DEEEIATTNPVATEQYGSVSANNDVRNPTPEE

SEQ ID NO: 92614 - protein, 34 aa, Artificial Sequence
  Description of Artificial Sequence: Synthetic polypeptide
DEEEIATTNPVATEQYGSVSPTNNHQENDMDIER

SEQ ID NO: 92615 - protein, 34 aa, Artificial Sequence
  Description of Artificial Sequence: Synthetic polypeptide
DEEEIATTNPVATEQYGSVSPVNQLQESQGQMLK

SEQ ID NO: 92616 - protein, 33 aa, Artificial Sequence
  Description of Artificial Sequence: Synthetic polypeptide
DEEEIATTNPVATEQYGSVSSATALEDHEGEPL

SEQ ID NO: 92617 - protein, 33 aa, Artificial Sequence
  Description of Artificial Sequence: Synthetic polypeptide
DEEEIATTNPVATEQYGSVSSEPAGPQRNGMEK

SEQ ID NO: 92618 - protein, 30 aa, Artificial Sequence
  Description of Artificial Sequence: Synthetic polypeptide
QEGEIAPTNPVASEQWGIVSCINLQREGNG

SEQ ID NO: 92619 - protein, 28 aa, Artificial Sequence
  Description of Artificial Sequence: Synthetic peptide
QEGEIAPTNPVASEQYGDVSCNEMAGTR

SEQ ID NO: 92620 - protein, 34 aa, Artificial Sequence
  Description of Artificial Sequence: Synthetic polypeptide
DEEEIATTNPVATEQYGSVSSTEALPNRNGMEPV

SEQ ID NO: 92621 - protein, 34 aa, Artificial Sequence
  Description of Artificial Sequence: Synthetic polypeptide
DEEEIATTNPVATEQYGSVSSTEPAGNMRNGMNV

SEQ ID NO: 92622 - protein, 33 aa, Artificial Sequence
  Description of Artificial Sequence: Synthetic polypeptide
AEEEIRTTNPVATEQYGSVSVNTNDNTNDNGTD

SEQ ID NO: 92623 - protein, 28 aa, Artificial Sequence
  Description of Artificial Sequence: Synthetic peptide
QEGEIAPTNPVATECYGDVSECLQSGEL

SEQ ID NO: 92624 - protein, 28 aa, Artificial Sequence
  Description of Artificial Sequence: Synthetic peptide
QEGEIAPTNPVATEQYGDVSCCLQHEEL

SEQ ID NO: 92625 - protein, 34 aa, Artificial Sequence
  Description of Artificial Sequence: Synthetic polypeptide
DEEEIATTNPVATEQYGSVSSTPAGPNMRNGNPV

SEQ ID NO: 92626 - protein, 34 aa, Artificial Sequence
  Description of Artificial Sequence: Synthetic polypeptide
DEEEIATTNPVATEQYGSVSSTPALNMSNGMTPR

SEQ ID NO: 92627 - protein, 34 aa, Artificial Sequence
  Description of Artificial Sequence: Synthetic polypeptide
DEEEIATTNPVATEQYGSVSSTPTGPNMRNGNPV

SEQ ID NO: 92628 - protein, 28 aa, Artificial Sequence
  Description of Artificial Sequence: Synthetic peptide
QEGEIAPTNPVATEQYGIVSCCLQHEEL

SEQ ID NO: 92629 - protein, 33 aa, Artificial Sequence
  Description of Artificial Sequence: Synthetic polypeptide
DEEEIATTNPVATEQYGSVSSTTAGEDREGEDL

SEQ ID NO: 92630 - protein, 33 aa, Artificial Sequence
  Description of Artificial Sequence: Synthetic polypeptide
DEEEIATTNPVATEQYGSVSSTTAGEDREGEPL

SEQ ID NO: 92631 - protein, 28 aa, Artificial Sequence
  Description of Artificial Sequence: Synthetic peptide
QEGEIAPTNPVATEQYGIVSCCLQHETL

SEQ ID NO: 92632 - protein, 33 aa, Artificial Sequence
  Description of Artificial Sequence: Synthetic polypeptide
DEEEIATTNPVATEQYGSVSSTTAGNDREGEPL

SEQ ID NO: 92633 - protein, 34 aa, Artificial Sequence
  Description of Artificial Sequence: Synthetic polypeptide
DEEEIATTNPVATEQYGSVSSTTAGNMHNGMNDV

SEQ ID NO: 92634 - protein, 28 aa, Artificial Sequence
  Description of Artificial Sequence: Synthetic peptide
QEGEIAPTNPVCSEQYGIVSCNLQSGTQ

SEQ ID NO: 92635 - protein, 28 aa, Artificial Sequence
  Description of Artificial Sequence: Synthetic peptide
QEGEIAPTNPTSSEQYGIVSCNLQSGTR

SEQ ID NO: 92636 - protein, 28 aa, Artificial Sequence
  Description of Artificial Sequence: Synthetic peptide
QEGEIAPTNPSSSEQYGIVSCNLQSGTR

SEQ ID NO: 92637 - protein, 28 aa, Artificial Sequence
  Description of Artificial Sequence: Synthetic peptide
QEGEIAPTNPMSSEQYGIVSCNLQSGTR

SEQ ID NO: 92638 - protein, 32 aa, Artificial Sequence
  Description of Artificial Sequence: Synthetic polypeptide
DEEEIATTNPVATEQYGSVSGTGPPQEADQEE

SEQ ID NO: 92639 - protein, 33 aa, Artificial Sequence
  Description of Artificial Sequence: Synthetic polypeptide
DEEEIATTNPVATEQYGSVSATAGPNDRNGEPL

SEQ ID NO: 92640 - protein, 35 aa, Artificial Sequence
  Description of Artificial Sequence: Synthetic polypeptide
DEEEIRTTNPVATEQYGSVCSTNPQLPIEHDDNAG

SEQ ID NO: 92641 - protein, 33 aa, Artificial Sequence
  Description of Artificial Sequence: Synthetic polypeptide
DEEEIATTNPVATEQYGSVSATPDLEDHEGEDV

SEQ ID NO: 92642 - protein, 28 aa, Artificial Sequence
  Description of Artificial Sequence: Synthetic peptide
QEGEIAPTNPCVSEQYGEVSCNLQSGQR

SEQ ID NO: 92643 - protein, 28 aa, Artificial Sequence
  Description of Artificial Sequence: Synthetic peptide
QEGEIAPTNPCVSEQYGIVSCNLQSGTR

SEQ ID NO: 92644 - protein, 28 aa, Artificial Sequence
  Description of Artificial Sequence: Synthetic peptide
QEGEIAPTNPCYSEQYGIVSCNLQSGTR

SEQ ID NO: 92645 - protein, 35 aa, Artificial Sequence
  Description of Artificial Sequence: Synthetic polypeptide
DEEEIRTTNPVATEQYGSVCSTNPEQPQEHDDNAG

SEQ ID NO: 92646 - protein, 28 aa, Artificial Sequence
  Description of Artificial Sequence: Synthetic peptide
QEGEIAPTNPCYYEQYGTVSCNLQSGMR

SEQ ID NO: 92647 - protein, 36 aa, Artificial Sequence
  Description of Artificial Sequence: Synthetic polypeptide
DEEEIRTTNPVATEQYGSVCSTNPELPNEHGDDNAG

SEQ ID NO: 92648 - protein, 28 aa, Artificial Sequence
  Description of Artificial Sequence: Synthetic peptide
QEGEIAPTNPFSWEQYGIVSCNLQSGTR

SEQ ID NO: 92649 - protein, 28 aa, Artificial Sequence
  Description of Artificial Sequence: Synthetic peptide
QEGEIAPTNPCSTEGYGIVACNLQRGTR

SEQ ID NO: 92650 - protein, 30 aa, Artificial Sequence
  Description of Artificial Sequence: Synthetic polypeptide
QEGEIAPTNPIATEQYGAVSCNLQEPGTYR

SEQ ID NO: 92651 - protein, 31 aa, Artificial Sequence
  Description of Artificial Sequence: Synthetic polypeptide
DEEEIATTNPVATEQYGSVSEVLEDHEEEDK

SEQ ID NO: 92652 - protein, 31 aa, Artificial Sequence
  Description of Artificial Sequence: Synthetic polypeptide
DEEEIATTNPVATEQYGSVSEVLEDHEEEDL

SEQ ID NO: 92653 - protein, 28 aa, Artificial Sequence
  Description of Artificial Sequence: Synthetic peptide
QEGEIAPTNPISSEQYGIVSCNLQSGTR

SEQ ID NO: 92654 - protein, 28 aa, Artificial Sequence
  Description of Artificial Sequence: Synthetic peptide
QEGEIAPTNPISSEQYGWVSCNLQSGTR

SEQ ID NO: 92655 - protein, 28 aa, Artificial Sequence
  Description of Artificial Sequence: Synthetic peptide
QEGEIAPTNPISTEQYGATSCNLQPGTR

SEQ ID NO: 92656 - protein, 33 aa, Artificial Sequence
  Description of Artificial Sequence: Synthetic polypeptide
DEEEIATTNPVATEQYGSVSGNGVPQEADTMRE

SEQ ID NO: 92657 - protein, 33 aa, Artificial Sequence
  Description of Artificial Sequence: Synthetic polypeptide
DEEEIATTNPVATEQYGSVSGTGNPDDDSGAQD

SEQ ID NO: 92658 - protein, 34 aa, Artificial Sequence
  Description of Artificial Sequence: Synthetic polypeptide
DEEEIATTNPVATEQYGSVSGTGNPDNNGENGQD

SEQ ID NO: 92659 - protein, 28 aa, Artificial Sequence
  Description of Artificial Sequence: Synthetic peptide
QEGEIAPTNPISTEQYGIVSENLMSGTR

SEQ ID NO: 92660 - protein, 34 aa, Artificial Sequence
  Description of Artificial Sequence: Synthetic polypeptide
DEEEIATTNPVATEQYGSVSGTGPPQEADGTVRW

SEQ ID NO: 92661 - protein, 36 aa, Artificial Sequence
  Description of Artificial Sequence: Synthetic polypeptide
DEEEIATTNPVATEQYGSVSETVNQLQPSQGQNQLM

SEQ ID NO: 92662 - protein, 36 aa, Artificial Sequence
  Description of Artificial Sequence: Synthetic polypeptide
DEEEIRTTNPVATEQYGSVCSTWPADNNERFGMNPQ

SEQ ID NO: 92663 - protein, 36 aa, Artificial Sequence
  Description of Artificial Sequence: Synthetic polypeptide
DEEEIATTNPVATEQYGSVCSTNPLPQEDAGEGTRE

SEQ ID NO: 92664 - protein, 33 aa, Artificial Sequence
  Description of Artificial Sequence: Synthetic polypeptide
DEEEIATTNPVATEQYGSVCSTNPLNDALAEDW

SEQ ID NO: 92665 - protein, 33 aa, Artificial Sequence
  Description of Artificial Sequence: Synthetic polypeptide
DEEEIATTNPVATEQYGSVCATGDGPQNHGENM

SEQ ID NO: 92666 - protein, 32 aa, Artificial Sequence
  Description of Artificial Sequence: Synthetic polypeptide
DEEEIATTNPVATEQYGSVCATGNGPGDAENG

SEQ ID NO: 92667 - protein, 33 aa, Artificial Sequence
  Description of Artificial Sequence: Synthetic polypeptide
DEEEIATTNPVATEQYGSVCATGPLPEDGENAE

SEQ ID NO: 92668 - protein, 34 aa, Artificial Sequence
  Description of Artificial Sequence: Synthetic polypeptide
DEEEIATTNPVATEQYGSVCATGQLPEDRGENYH

SEQ ID NO: 92669 - protein, 32 aa, Artificial Sequence
  Description of Artificial Sequence: Synthetic polypeptide
DEEEIATTNPVATEQYGSVCATNDEAEQGEDH

SEQ ID NO: 92670 - protein, 33 aa, Artificial Sequence
  Description of Artificial Sequence: Synthetic polypeptide
DEEEIATTNPVATEQYGSVCATNDPPTDDGNDP

SEQ ID NO: 92671 - protein, 28 aa, Artificial Sequence
  Description of Artificial Sequence: Synthetic peptide
QEGEIAPTNPCSSEQYGIVSCNLQTGTR

SEQ ID NO: 92672 - protein, 33 aa, Artificial Sequence
  Description of Artificial Sequence: Synthetic polypeptide
DEEEIATTNPVATEQYGSVCATNLAPDDGMGEM

SEQ ID NO: 92673 - protein, 33 aa, Artificial Sequence
  Description of Artificial Sequence: Synthetic polypeptide
DEEEIATTNPVATEQYGSVCATNLAPDNPMDGA

SEQ ID NO: 92674 - protein, 33 aa, Artificial Sequence
  Description of Artificial Sequence: Synthetic polypeptide
DEEEIATTNPVATEQYGSVCATNLAPDNQTEGA

SEQ ID NO: 92675 - protein, 33 aa, Artificial Sequence
  Description of Artificial Sequence: Synthetic polypeptide
DEEEIATTNPVATEQYGSVCATNLAPDSMDNLL

SEQ ID NO: 92676 - protein, 34 aa, Artificial Sequence
  Description of Artificial Sequence: Synthetic polypeptide
DEEEIATTNPVATEQYGSVCATNLAPRDGMDTLA

SEQ ID NO: 92677 - protein, 35 aa, Artificial Sequence
  Description of Artificial Sequence: Synthetic polypeptide
DEEEIATTNPVATEQYGSVCATNLPADRTGMDNSD

SEQ ID NO: 92678 - protein, 34 aa, Artificial Sequence
  Description of Artificial Sequence: Synthetic polypeptide
DEEEIATTNPVATEQYGSVCATNNLEAEAEENRN

SEQ ID NO: 92679 - protein, 34 aa, Artificial Sequence
  Description of Artificial Sequence: Synthetic polypeptide
DEEEIATTNPVATEQYGSVCATNPLQDAGEHTMN

SEQ ID NO: 92680 - protein, 35 aa, Artificial Sequence
  Description of Artificial Sequence: Synthetic polypeptide
DEEEIATTNPVATEQYGSVCATNPLQEHQDGNEHQ

SEQ ID NO: 92681 - protein, 29 aa, Artificial Sequence
  Description of Artificial Sequence: Synthetic peptide
QEGEIAPTNPCSSEQYGIVSCTNLQSGTR

SEQ ID NO: 92682 - protein, 28 aa, Artificial Sequence
  Description of Artificial Sequence: Synthetic peptide
QEGEIAPTNPCSSEQYGIVSDNLQSGTR

SEQ ID NO: 92683 - protein, 28 aa, Artificial Sequence
  Description of Artificial Sequence: Synthetic peptide
QEGEIAPTNPCSSEQYGIVSENLQSGTR

SEQ ID NO: 92684 - protein, 28 aa, Artificial Sequence
  Description of Artificial Sequence: Synthetic peptide
QEGEIAPTNPCSSEQYGIVSINLQSGTR

SEQ ID NO: 92685 - protein, 33 aa, Artificial Sequence
  Description of Artificial Sequence: Synthetic polypeptide
DEEEIATTNPVATEQYGSVCATNPQNQDAENGG

SEQ ID NO: 92686 - protein, 33 aa, Artificial Sequence
  Description of Artificial Sequence: Synthetic polypeptide
DEEEIATTNPVATEQYGSVCASNDLQEHGDTEA

SEQ ID NO: 92687 - protein, 28 aa, Artificial Sequence
  Description of Artificial Sequence: Synthetic peptide
QEGEIAPTNPCSSEQYGIVSCNLQSGYR

SEQ ID NO: 92688 - protein, 35 aa, Artificial Sequence
  Description of Artificial Sequence: Synthetic polypeptide
DEEEIATTNPVATEQYGSVCAPTNQLQEAAEGARQ

SEQ ID NO: 92689 - protein, 28 aa, Artificial Sequence
  Description of Artificial Sequence: Synthetic peptide
QEGEIAPTNPCSSEQYGIVSCNLQSGVR

SEQ ID NO: 92690 - protein, 34 aa, Artificial Sequence
  Description of Artificial Sequence: Synthetic polypeptide
DEEEIRTTNPVATEQYGSVCTWWESEQTQGSENE

SEQ ID NO: 92691 - protein, 28 aa, Artificial Sequence
  Description of Artificial Sequence: Synthetic peptide
QEGEIAPTNPCSSEQYGIVSCNLQNGTR

SEQ ID NO: 92692 - protein, 34 aa, Artificial Sequence
  Description of Artificial Sequence: Synthetic polypeptide
DEEEIRTTNPVATEQYGSVCTWITNLPQQDPMAD

SEQ ID NO: 92693 - protein, 28 aa, Artificial Sequence
  Description of Artificial Sequence: Synthetic peptide
QEGEIAPTNPCSSEQYGIVSCNLQQGTR

SEQ ID NO: 92694 - protein, 28 aa, Artificial Sequence
  Description of Artificial Sequence: Synthetic peptide
QEGEIAPTNPCSSEQYGIVSCNLQSGAR

SEQ ID NO: 92695 - protein, 29 aa, Artificial Sequence
  Description of Artificial Sequence: Synthetic peptide
QEGEIAPTNPCSSEQYGIVSCNLQSGDNR

SEQ ID NO: 92696 - protein, 28 aa, Artificial Sequence
  Description of Artificial Sequence: Synthetic peptide
QEGEIAPTNPCSSEQYGIVSCNLQSGDR

SEQ ID NO: 92697 - protein, 28 aa, Artificial Sequence
  Description of Artificial Sequence: Synthetic peptide
QEGEIAPTNPCSSEQYGIVSCNLQSGER

SEQ ID NO: 92698 - protein, 28 aa, Artificial Sequence
  Description of Artificial Sequence: Synthetic peptide
QEGEIAPTNPCSSEQYGIVSCNLQSGFR

SEQ ID NO: 92699 - protein, 28 aa, Artificial Sequence
  Description of Artificial Sequence: Synthetic peptide
QEGEIAPTNPCSSEQYGIVSCNLQSGGR

SEQ ID NO: 92700 - protein, 33 aa, Artificial Sequence
  Description of Artificial Sequence: Synthetic polypeptide
DEEEIATTNPVATEQYGSVCATNQLAEAAENDN

SEQ ID NO: 92701 - protein, 28 aa, Artificial Sequence
  Description of Artificial Sequence: Synthetic peptide
QEGEIAPTNPCSSEQYGIVSCNLQSGHR

SEQ ID NO: 92702 - protein, 28 aa, Artificial Sequence
  Description of Artificial Sequence: Synthetic peptide
QEGEIAPTNPCSSEQYGIVSCNLQSGKR

SEQ ID NO: 92703 - protein, 28 aa, Artificial Sequence
  Description of Artificial Sequence: Synthetic peptide
QEGEIAPTNPCSSEQYGIVSCNLQSGLR

SEQ ID NO: 92704 - protein, 28 aa, Artificial Sequence
  Description of Artificial Sequence: Synthetic peptide
QEGEIAPTNPCSSEQYGIVSCNLQSGMR

SEQ ID NO: 92705 - protein, 28 aa, Artificial Sequence
  Description of Artificial Sequence: Synthetic peptide
QEGEIAPTNPCSSEQYGIVSCNLQSGPR

SEQ ID NO: 92706 - protein, 28 aa, Artificial Sequence
  Description of Artificial Sequence: Synthetic peptide
QEGEIAPTNPCSSEQYGIVSCNLQSGQR

SEQ ID NO: 92707 - protein, 28 aa, Artificial Sequence
  Description of Artificial Sequence: Synthetic peptide
QEGEIAPTNPCSSEQYGIVSCNLQSGSR

SEQ ID NO: 92708 - protein, 33 aa, Artificial Sequence
  Description of Artificial Sequence: Synthetic polypeptide
DEEEIATTNPVATEQYGSVCANNLEQDDDQNAE

SEQ ID NO: 92709 - protein, 34 aa, Artificial Sequence
  Description of Artificial Sequence: Synthetic polypeptide
DEEEIRTTNPVATEQYGSVCTPLHDLERGGEEPQ

SEQ ID NO: 92710 - protein, 34 aa, Artificial Sequence
  Description of Artificial Sequence: Synthetic polypeptide
DEEEIATTNPVATEQYGSVCANPLEPTADGMNMR

SEQ ID NO: 92711 - protein, 33 aa, Artificial Sequence
  Description of Artificial Sequence: Synthetic polypeptide
DEEEIATTNPVATEQYGSVCAPDNLQPDQNEAA

SEQ ID NO: 92712 - protein, 28 aa, Artificial Sequence
  Description of Artificial Sequence: Synthetic peptide
QEGEIAPTNPCSSEQYGIVSCNLQSGIR

SEQ ID NO: 92713 - protein, 28 aa, Artificial Sequence
  Description of Artificial Sequence: Synthetic peptide
QEGEIAPTNPCSSEQYGIVSCNLQKGTR

SEQ ID NO: 92714 - protein, 34 aa, Artificial Sequence
  Description of Artificial Sequence: Synthetic polypeptide
DEEEIATTNPVATEQYGSVCATNQLQDDGVPTED

SEQ ID NO: 92715 - protein, 28 aa, Artificial Sequence
  Description of Artificial Sequence: Synthetic peptide
QEGEIAPTNPCSSEQYGIVSLNLQSGTR

SEQ ID NO: 92716 - protein, 29 aa, Artificial Sequence
  Description of Artificial Sequence: Synthetic peptide
QEGEIAPTNPCSSEQYGSVSCNLQDSGTR

SEQ ID NO: 92717 - protein, 32 aa, Artificial Sequence
  Description of Artificial Sequence: Synthetic polypeptide
DEEEIATTNPVATEQYGSVCSMNNDDSEIGDM

SEQ ID NO: 92718 - protein, 32 aa, Artificial Sequence
  Description of Artificial Sequence: Synthetic polypeptide
DEEEIATTNPVATEQYGSVCSMNNNDDSENGN

SEQ ID NO: 92719 - protein, 28 aa, Artificial Sequence
  Description of Artificial Sequence: Synthetic peptide
QEGEIAPTNPCSSEQYGTVSCNLEFGNR

SEQ ID NO: 92720 - protein, 34 aa, Artificial Sequence
  Description of Artificial Sequence: Synthetic polypeptide
DEEEIATTNPVATEQYGSVCSMPNLQNQMPDSRD

SEQ ID NO: 92721 - protein, 28 aa, Artificial Sequence
  Description of Artificial Sequence: Synthetic peptide
QEGEIAPTNPCSSEQYGTVSCNLQSGTR

SEQ ID NO: 92722 - protein, 34 aa, Artificial Sequence
  Description of Artificial Sequence: Synthetic polypeptide
DEEEIRTTNPVATEQYGSVCSWLELPQRNEEPQM

SEQ ID NO: 92723 - protein, 28 aa, Artificial Sequence
  Description of Artificial Sequence: Synthetic peptide
QEGEIAPTNPCSSEQYGVVSCNLQSGER

SEQ ID NO: 92724 - protein, 28 aa, Artificial Sequence
  Description of Artificial Sequence: Synthetic peptide
QEGEIAPTNPCSSEQYGVVSCNLQSGTR

SEQ ID NO: 92725 - protein, 28 aa, Artificial Sequence
  Description of Artificial Sequence: Synthetic peptide
QEGEIAPTNPCSSEQYGVVSDNLQSGTR

SEQ ID NO: 92726 - protein, 28 aa, Artificial Sequence
  Description of Artificial Sequence: Synthetic peptide
QEGEIAPTNPCSSEQYGWVSCNLQSGTR

SEQ ID NO: 92727 - protein, 34 aa, Artificial Sequence
  Description of Artificial Sequence: Synthetic polypeptide
DEEEIATTNPVATEQYGSVCSPGPGPLQHGENQM

SEQ ID NO: 92728 - protein, 34 aa, Artificial Sequence
  Description of Artificial Sequence: Synthetic polypeptide
DEEEIRTTNPVATEQYGSVCSWGEHQNFGSNTQL

SEQ ID NO: 92729 - protein, 28 aa, Artificial Sequence
  Description of Artificial Sequence: Synthetic peptide
QEGEIAPTNPCSSEQYGWVSCNLQSGVR

SEQ ID NO: 92730 - protein, 28 aa, Artificial Sequence
  Description of Artificial Sequence: Synthetic peptide
QEGEIAPTNPCSSEQYGYVSCNLQSGHR

SEQ ID NO: 92731 - protein, 28 aa, Artificial Sequence
  Description of Artificial Sequence: Synthetic peptide
QEGEIAPTNPCSSEQYGYVSCNLQSGTR

SEQ ID NO: 92732 - protein, 35 aa, Artificial Sequence
  Description of Artificial Sequence: Synthetic polypeptide
DEEEIATTNPVATEQYGSVCSTDNGNDNGRNGNSP

SEQ ID NO: 92733 - protein, 33 aa, Artificial Sequence
  Description of Artificial Sequence: Synthetic polypeptide
DEEEIATTNPVATEQYGSVCSTGPLPEDMEGFP

SEQ ID NO: 92734 - protein, 34 aa, Artificial Sequence
  Description of Artificial Sequence: Synthetic polypeptide
DEEEIATTNPVATEQYGSVCSTNDQQEAEDATRN

SEQ ID NO: 92735 - protein, 28 aa, Artificial Sequence
  Description of Artificial Sequence: Synthetic peptide
QEGEIAPTNPCSTECYGDVSCNLQHGER

SEQ ID NO: 92736 - protein, 34 aa, Artificial Sequence
  Description of Artificial Sequence: Synthetic polypeptide
DEEEIATTNPVATEQYGSVCSTNPGAEAEIGNMF

SEQ ID NO: 92737 - protein, 28 aa, Artificial Sequence
  Description of Artificial Sequence: Synthetic peptide
QEGEIAPTNPCSSEQYGRVSCNLQSGTR

SEQ ID NO: 92738 - protein, 34 aa, Artificial Sequence
  Description of Artificial Sequence: Synthetic polypeptide
DEEEIATTNPVATEQYGSVCSATNDQQEAEDGTN

SEQ ID NO: 92739 - protein, 35 aa, Artificial Sequence
  Description of Artificial Sequence: Synthetic polypeptide
DEEEIATTNPVATEQYGSVCSAPNLPQEHGNNDQH

SEQ ID NO: 92740 - protein, 28 aa, Artificial Sequence
  Description of Artificial Sequence: Synthetic peptide
QEGEIAPTNPCSSEQYGQVSCNLQSGTR

SEQ ID NO: 92741 - protein, 33 aa, Artificial Sequence
  Description of Artificial Sequence: Synthetic polypeptide
DEEEIATTNPVATEQYGSVCATPDLQDDQGAQE

SEQ ID NO: 92742 - protein, 34 aa, Artificial Sequence
  Description of Artificial Sequence: Synthetic polypeptide
DEEEIATTNPVATEQYGSVCATPEEADRGEENRD

SEQ ID NO: 92743 - protein, 28 aa, Artificial Sequence
  Description of Artificial Sequence: Synthetic peptide
QEGEIAPTNPCSSEQYGIVSMNLQSGTR

SEQ ID NO: 92744 - protein, 33 aa, Artificial Sequence
  Description of Artificial Sequence: Synthetic polypeptide
DEEEIATTNPVATEQYGSVCATPLADNPMDGNP

SEQ ID NO: 92745 - protein, 28 aa, Artificial Sequence
  Description of Artificial Sequence: Synthetic peptide
QEGEIAPTNPCSSEQYGIVSNNLQGGTR

SEQ ID NO: 92746 - protein, 33 aa, Artificial Sequence
  Description of Artificial Sequence: Synthetic polypeptide
DEEEIATTNPVATEQYGSVCATTNLTSVEENDN

SEQ ID NO: 92747 - protein, 28 aa, Artificial Sequence
  Description of Artificial Sequence: Synthetic peptide
QEGEIAPTNPCSSEQYGIVSNNLQSGTR

SEQ ID NO: 92748 - protein, 28 aa, Artificial Sequence
  Description of Artificial Sequence: Synthetic peptide
QEGEIAPTNPCSSEQYGIVSQNLQSGTR

SEQ ID NO: 92749 - protein, 28 aa, Artificial Sequence
  Description of Artificial Sequence: Synthetic peptide
QEGEIAPTNPCSSEQYGIVSSNLQEGTR

SEQ ID NO: 92750 - protein, 28 aa, Artificial Sequence
  Description of Artificial Sequence: Synthetic peptide
QEGEIAPTNPCSSEQYGIVSSNLQSGTR

SEQ ID NO: 92751 - protein, 28 aa, Artificial Sequence
  Description of Artificial Sequence: Synthetic peptide
QEGEIAPTNPCSSEQYGIVSKNLQSGTR

SEQ ID NO: 92752 - protein, 29 aa, Artificial Sequence
  Description of Artificial Sequence: Synthetic peptide
QEGEIAPTNPCSSEQYGIVSTNLQSEGTR

SEQ ID NO: 92753 - protein, 28 aa, Artificial Sequence
  Description of Artificial Sequence: Synthetic peptide
QEGEIAPTNPCSSEQYGIVSVNLQSGTR

SEQ ID NO: 92754 - protein, 28 aa, Artificial Sequence
  Description of Artificial Sequence: Synthetic peptide
QEGEIAPTNPCSSEQYGKVSCNLQSGTR

SEQ ID NO: 92755 - protein, 28 aa, Artificial Sequence
  Description of Artificial Sequence: Synthetic peptide
QEGEIAPTNPCSSEQYGKVSLNLQSGTR

SEQ ID NO: 92756 - protein, 33 aa, Artificial Sequence
  Description of Artificial Sequence: Synthetic polypeptide
DEEEIATTNPVATEQYGSVCGTPPQNHGENDNH

SEQ ID NO: 92757 - protein, 28 aa, Artificial Sequence
  Description of Artificial Sequence: Synthetic peptide
QEGEIAPTNPCSSEQYGLVSCNLQSGTR

SEQ ID NO: 92758 - protein, 28 aa, Artificial Sequence
  Description of Artificial Sequence: Synthetic peptide
QEGEIAPTNPCSSEQYGMVSCNLQSGTR

SEQ ID NO: 92759 - protein, 28 aa, Artificial Sequence
  Description of Artificial Sequence: Synthetic peptide
QEGEIAPTNPCSSEQYGNVSCNLQNGTR

SEQ ID NO: 92760 - protein, 28 aa, Artificial Sequence
  Description of Artificial Sequence: Synthetic peptide
QEGEIAPTNPCSSEQYGNVSCNLQSGDR

SEQ ID NO: 92761 - protein, 28 aa, Artificial Sequence
  Description of Artificial Sequence: Synthetic peptide
QEGEIAPTNPCSSEQYGNVSCNLQSGTR

SEQ ID NO: 92762 - protein, 28 aa, Artificial Sequence
  Description of Artificial Sequence: Synthetic peptide
QEGEIAPTNPCSSEQYGQVSCNLQSGDR

SEQ ID NO: 92763 - protein, 28 aa, Artificial Sequence
  Description of Artificial Sequence: Synthetic peptide
QEGEIAPTNPCSSEQYGIVSVNLQRGTV

SEQ ID NO: 92764 - protein, 30 aa, Artificial Sequence
  Description of Artificial Sequence: Synthetic polypeptide
QEEEIRTTNPVGTEGYGSVSSAGPNMRGDI

SEQ ID NO: 92765 - protein, 35 aa, Artificial Sequence
  Description of Artificial Sequence: Synthetic polypeptide
AEEEIRTTNPVATEQYGSVSVTNNNLEQGVTTNNI

SEQ ID NO: 92766 - protein, 36 aa, Artificial Sequence
  Description of Artificial Sequence: Synthetic polypeptide
AEEEIRTTNPVATEQYGSVSVTNNNLNQQGEEQNTE

SEQ ID NO: 92767 - protein, 33 aa, Artificial Sequence
  Description of Artificial Sequence: Synthetic polypeptide
DEEEIRTTNPVATEQYGSVGPTMWQQIGQILDT

SEQ ID NO: 92768 - protein, 32 aa, Artificial Sequence
  Description of Artificial Sequence: Synthetic polypeptide
DEEEIATTNPVATEQYGSVAMNLEEQGDTTDT

SEQ ID NO: 92769 - protein, 33 aa, Artificial Sequence
  Description of Artificial Sequence: Synthetic polypeptide
DEEEIATTNPVATEQYGSVAMNLNEAEDGNFGN

SEQ ID NO: 92770 - protein, 34 aa, Artificial Sequence
  Description of Artificial Sequence: Synthetic polypeptide
DEEEIRTTNPVATEQYGSVGPTGNERRMQVNEIP

SEQ ID NO: 92771 - protein, 35 aa, Artificial Sequence
  Description of Artificial Sequence: Synthetic polypeptide
DEEEIRTTNPVATEQYGSVGPTGNEQQEREVNEDF

SEQ ID NO: 92772 - protein, 36 aa, Artificial Sequence
  Description of Artificial Sequence: Synthetic polypeptide
AEEEIRTTNPVATEQYGSVSVTVNLQNGTEGGNTTD

SEQ ID NO: 92773 - protein, 32 aa, Artificial Sequence
  Description of Artificial Sequence: Synthetic polypeptide
DEEEIRTTNPVATEQYGSVGPSMKENQEVVVV

SEQ ID NO: 92774 - protein, 32 aa, Artificial Sequence
  Description of Artificial Sequence: Synthetic polypeptide
QEEEIRCTNPVATEQYGSVSGNGQDEGGQIST

SEQ ID NO: 92775 - protein, 33 aa, Artificial Sequence
  Description of Artificial Sequence: Synthetic polypeptide
DEEEIATTNPVATEQYGSVAMNLNNENPNTVRQ

SEQ ID NO: 92776 - protein, 32 aa, Artificial Sequence
  Description of Artificial Sequence: Synthetic polypeptide
DEEEIATTNPVATEQYGSVAMNLNNENPPVTQ

SEQ ID NO: 92777 - protein, 36 aa, Artificial Sequence
  Description of Artificial Sequence: Synthetic polypeptide
AEEEIRTTNPVATEQYGSVSVTVNLNQNEQGTNNAT

SEQ ID NO: 92778 - protein, 36 aa, Artificial Sequence
  Description of Artificial Sequence: Synthetic polypeptide
AEEEIRTTNPVATEQYGSVSVTVNLLQQIGNNNNTE

SEQ ID NO: 92779 - protein, 32 aa, Artificial Sequence
  Description of Artificial Sequence: Synthetic polypeptide
DEEEIATTNPVATEQYGSVANGNPPMNGSENL

SEQ ID NO: 92780 - protein, 32 aa, Artificial Sequence
  Description of Artificial Sequence: Synthetic polypeptide
DEEEIATTNPVATEQYGSVANNPPTASGNMEN

SEQ ID NO: 92781 - protein, 32 aa, Artificial Sequence
  Description of Artificial Sequence: Synthetic polypeptide
QEEEIRPTNPCATEQYGIVSTCPNGPNSGMNR

SEQ ID NO: 92782 - protein, 33 aa, Artificial Sequence
  Description of Artificial Sequence: Synthetic polypeptide
DEEEIATTNPVATEQYGSVANTGAGEYGREGGR

SEQ ID NO: 92783 - protein, 34 aa, Artificial Sequence
  Description of Artificial Sequence: Synthetic polypeptide
DEEEIRTTNPVATEQYGSVGNQDNGQEEDGGGNI

SEQ ID NO: 92784 - protein, 34 aa, Artificial Sequence
  Description of Artificial Sequence: Synthetic polypeptide
DEEEIRTTNPVATEQYGSVGNNMNLIFEGGNGGE

SEQ ID NO: 92785 - protein, 34 aa, Artificial Sequence
  Description of Artificial Sequence: Synthetic polypeptide
DEEEIRTTNPVATEQYGSVGNNMNLEFNGGNEGN

SEQ ID NO: 92786 - protein, 35 aa, Artificial Sequence
  Description of Artificial Sequence: Synthetic polypeptide
QEEEIRPTNPVATEQYGSVSTCPNGPNMRNGMNPR

SEQ ID NO: 92787 - protein, 29 aa, Artificial Sequence
  Description of Artificial Sequence: Synthetic peptide
QEEEIRSTNPVATEGYGSVASAGQHGMDV

SEQ ID NO: 92788 - protein, 33 aa, Artificial Sequence
  Description of Artificial Sequence: Synthetic polypeptide
DEEEIATTNPVATEQYGSVAMNDTNPDDGMGGR

SEQ ID NO: 92789 - protein, 29 aa, Artificial Sequence
  Description of Artificial Sequence: Synthetic peptide
QEEEIRSTNPVATEGYGSVSSAGNHGMDV

SEQ ID NO: 92790 - protein, 32 aa, Artificial Sequence
  Description of Artificial Sequence: Synthetic polypeptide
DEEEIATTNPVATEQYGSVAMNDQTENPTVHQ

SEQ ID NO: 92791 - protein, 34 aa, Artificial Sequence
  Description of Artificial Sequence: Synthetic polypeptide
DEEEIRTTNPVATEQYGSVGPTTTLQQPTQGEFE

SEQ ID NO: 92792 - protein, 33 aa, Artificial Sequence
  Description of Artificial Sequence: Synthetic polypeptide
DEEEIRTTNPVATEQYGSVGSGMGGQGDGEGET

SEQ ID NO: 92793 - protein, 31 aa, Artificial Sequence
  Description of Artificial Sequence: Synthetic polypeptide
QEEEIRCTNPAATEQYGSVVSENGMGGDNGE

SEQ ID NO: 92794 - protein, 33 aa, Artificial Sequence
  Description of Artificial Sequence: Synthetic polypeptide
DEEEIATTNPVATEQYGSVAGTNPQEADGTAQV

SEQ ID NO: 92795 - protein, 34 aa, Artificial Sequence
  Description of Artificial Sequence: Synthetic polypeptide
DEEEIRTTNPVATEQYGSVGSDGNGGQSEQENEG

SEQ ID NO: 92796 - protein, 34 aa, Artificial Sequence
  Description of Artificial Sequence: Synthetic polypeptide
AEEEIRTTNPVATEQYGSVSVTVNSNTESGNNNI

SEQ ID NO: 92797 - protein, 35 aa, Artificial Sequence
  Description of Artificial Sequence: Synthetic polypeptide
DEEEIRTTNPVATEQYGSVGSDDNFGQEEDGGGNG

SEQ ID NO: 92798 - protein, 34 aa, Artificial Sequence
  Description of Artificial Sequence: Synthetic polypeptide
AEEEIRTTNPVATEQYGSVSVTVNSNGTESGSNI

SEQ ID NO: 92799 - protein, 28 aa, Artificial Sequence
  Description of Artificial Sequence: Synthetic peptide
QEEEIRCTNPIATEQYGEAPENCQHEER

SEQ ID NO: 92800 - protein, 35 aa, Artificial Sequence
  Description of Artificial Sequence: Synthetic polypeptide
AEEEIRTTNPVATEQYGSVSVTVNQQQGTVNNNVD

SEQ ID NO: 92801 - protein, 28 aa, Artificial Sequence
  Description of Artificial Sequence: Synthetic peptide
QEEEIRCTNPIATEQYGEVPEVCQHEER

SEQ ID NO: 92802 - protein, 34 aa, Artificial Sequence
  Description of Artificial Sequence: Synthetic polypeptide
DEEEIATTNPVATEQYGSVAITHNEPQNNGNDQQ

SEQ ID NO: 92803 - protein, 35 aa, Artificial Sequence
  Description of Artificial Sequence: Synthetic polypeptide
AEEEIRTTNPVATEQYGSVSVTVNNQQAGNGNQND

SEQ ID NO: 92804 - protein, 35 aa, Artificial Sequence
  Description of Artificial Sequence: Synthetic polypeptide
AEEEIRTTNPVATEQYGSVSVTVNNQNQQQGTNTE

SEQ ID NO: 92805 - protein, 36 aa, Artificial Sequence
  Description of Artificial Sequence: Synthetic polypeptide
AEEEIRTTNPVATEQYGSVSVTVNNLQSNEEGTNND

SEQ ID NO: 92806 - protein, 36 aa, Artificial Sequence
  Description of Artificial Sequence: Synthetic polypeptide
AEEEIRTTNPVATEQYGSVSVTVNNLQQQNGTNNVE

SEQ ID NO: 92807 - protein, 36 aa, Artificial Sequence
  Description of Artificial Sequence: Synthetic polypeptide
AEEEIRTTNPVATEQYGSVSVTVNNLQQLQEGNNNE

SEQ ID NO: 92808 - protein, 36 aa, Artificial Sequence
  Description of Artificial Sequence: Synthetic polypeptide
AEEEIRTTNPVATEQYGSVSVTVNNLQQGDEQGNDE

SEQ ID NO: 92809 - protein, 33 aa, Artificial Sequence
  Description of Artificial Sequence: Synthetic polypeptide
DEEEIRTTNPVATEQYGSVGQGNSGDEGGNGGN

SEQ ID NO: 92810 - protein, 35 aa, Artificial Sequence
  Description of Artificial Sequence: Synthetic polypeptide
AEEEIRTTNPVATEQYGSVSVTVNNLEQGVTNQNI

SEQ ID NO: 92811 - protein, 33 aa, Artificial Sequence
  Description of Artificial Sequence: Synthetic polypeptide
DEEEIRTTNPVATEQYGSVGPVNGETRVVNEQT

SEQ ID NO: 92812 - protein, 35 aa, Artificial Sequence
  Description of Artificial Sequence: Synthetic polypeptide
DEEEIRTTNPVATEQYGSVGPVENLVQPQGEEMNG

SEQ ID NO: 92813 - protein, 35 aa, Artificial Sequence
  Description of Artificial Sequence: Synthetic polypeptide
AEEEIRTTNPVATEQYGSVSVTVNNGNQQGNNTDE

SEQ ID NO: 92814 - protein, 30 aa, Artificial Sequence
  Description of Artificial Sequence: Synthetic polypeptide
QEEEIRSTNPVATEGYGSVSTAGNMHGMDV

SEQ ID NO: 92815 - protein, 36 aa, Artificial Sequence
  Description of Artificial Sequence: Synthetic polypeptide
AEEEIRTTNPVATEQYGSVSVTVANLNQDEQGNNVD

SEQ ID NO: 92816 - protein, 32 aa, Artificial Sequence
  Description of Artificial Sequence: Synthetic polypeptide
QEEEIRTTNPAATEQYGSVPTILAIAGQGNEG

SEQ ID NO: 92817 - protein, 28 aa, Artificial Sequence
  Description of Artificial Sequence: Synthetic peptide
QEEEIRTTNPVATEQWGEVPEICQHEEK

SEQ ID NO: 92818 - protein, 28 aa, Artificial Sequence
  Description of Artificial Sequence: Synthetic peptide
QEEEIRTTNPVATEQWGEVPEVCQHEEK

SEQ ID NO: 92819 - protein, 28 aa, Artificial Sequence
  Description of Artificial Sequence: Synthetic peptide
QEEEIRTTNPVATEQWGEVPEVEQHEEK

SEQ ID NO: 92820 - protein, 30 aa, Artificial Sequence
  Description of Artificial Sequence: Synthetic polypeptide
QEEEIRTTNPVATEQWGSAPEIVEPQRENG

SEQ ID NO: 92821 - protein, 32 aa, Artificial Sequence
  Description of Artificial Sequence: Synthetic polypeptide
QEEEIRTTNPVATEQWGSASCINEPQDREGEG

SEQ ID NO: 92822 - protein, 34 aa, Artificial Sequence
  Description of Artificial Sequence: Synthetic polypeptide
DEEEIRTTNPVATEQYGSVGCPTPLLNQQIVLER

SEQ ID NO: 92823 - protein, 31 aa, Artificial Sequence
  Description of Artificial Sequence: Synthetic polypeptide
QEEEIRTTNPVATEQWGSASCIVEPQDRGEG

SEQ ID NO: 92824 - protein, 34 aa, Artificial Sequence
  Description of Artificial Sequence: Synthetic polypeptide
DEEEIRTTNPVATEQYGSVGCPTPLLDQSMVLER

SEQ ID NO: 92825 - protein, 36 aa, Artificial Sequence
  Description of Artificial Sequence: Synthetic polypeptide
AEEEIRTTNPVATEQYGSVSVTTNNQLQLQQGTTNT

SEQ ID NO: 92826 - protein, 34 aa, Artificial Sequence
  Description of Artificial Sequence: Synthetic polypeptide
QEEEIRTTNPVATEQYGAVVDTGNLQGGGNGGGN

SEQ ID NO: 92827 - protein, 35 aa, Artificial Sequence
  Description of Artificial Sequence: Synthetic polypeptide
AEEEIRTTNPVATEQYGSVSVTTNNNVQQGTNQGN

SEQ ID NO: 92828 - protein, 33 aa, Artificial Sequence
  Description of Artificial Sequence: Synthetic polypeptide
DEEEIRTTNPVATEQYGSVGCENLQQEQMELSI

SEQ ID NO: 92829 - protein, 35 aa, Artificial Sequence
  Description of Artificial Sequence: Synthetic polypeptide
AEEEIRTTNPVATEQYGSVSVTTNNNTEQLGNNAS

SEQ ID NO: 92830 - protein, 33 aa, Artificial Sequence
  Description of Artificial Sequence: Synthetic polypeptide
DEEEIRTTNPVATEQYGSVFYIEHSGRTGGHNS

SEQ ID NO: 92831 - protein, 35 aa, Artificial Sequence
  Description of Artificial Sequence: Synthetic polypeptide
AEEEIRTTNPVATEQYGSVSVTTNNNQQQIGTNGN

SEQ ID NO: 92832 - protein, 33 aa, Artificial Sequence
  Description of Artificial Sequence: Synthetic polypeptide
QEEEIRTTNPVATEQYGDVDTGIQNDGQGGGND

SEQ ID NO: 92833 - protein, 34 aa, Artificial Sequence
  Description of Artificial Sequence: Synthetic polypeptide
DEEEIRTTNPVATEQYGSVFVWINGEQERKSSDR

SEQ ID NO: 92834 - protein, 34 aa, Artificial Sequence
  Description of Artificial Sequence: Synthetic polypeptide
QEEEIRTTNPVATEQYGDVSDTGNGGGQNNNGNG

SEQ ID NO: 92835 - protein, 34 aa, Artificial Sequence
  Description of Artificial Sequence: Synthetic polypeptide
DEEEIRTTNPVATEQYGSVFVWINGEQDRQMNDV

SEQ ID NO: 92836 - protein, 34 aa, Artificial Sequence
  Description of Artificial Sequence: Synthetic polypeptide
DEEEIRTTNPVATEQYGSVFVWINEQDRKMNGDV

SEQ ID NO: 92837 - protein, 34 aa, Artificial Sequence
  Description of Artificial Sequence: Synthetic polypeptide
DEEEIRTTNPVATEQYGSVFVWINEQDRAMQGDH

SEQ ID NO: 92838 - protein, 32 aa, Artificial Sequence
  Description of Artificial Sequence: Synthetic polypeptide
DEEEIRTTNPVATEQYGSVGDDQGNNGQGDQG

SEQ ID NO: 92839 - protein, 34 aa, Artificial Sequence
  Description of Artificial Sequence: Synthetic polypeptide
DEEEIRTTNPVATEQYGSVGDDTNNDGQENINED

SEQ ID NO: 92840 - protein, 35 aa, Artificial Sequence
  Description of Artificial Sequence: Synthetic polypeptide
AEEEIRTTNPVATEQYGSVSVTTNNQQQQNGNNTE

SEQ ID NO: 92841 - protein, 33 aa, Artificial Sequence
  Description of Artificial Sequence: Synthetic polypeptide
QEEEIRTTNPVATEPYGKISYTNEASQNRVGNF

SEQ ID NO: 92842 - protein, 32 aa, Artificial Sequence
  Description of Artificial Sequence: Synthetic polypeptide
QEEEIRTTNPCATEQYGIVSSTTNGPNRGMTV

SEQ ID NO: 92843 - protein, 33 aa, Artificial Sequence
  Description of Artificial Sequence: Synthetic polypeptide
QEEEIRTTNPCATEQYGSVSSTTNGPNRGMTPV

SEQ ID NO: 92844 - protein, 36 aa, Artificial Sequence
  Description of Artificial Sequence: Synthetic polypeptide
AEEEIRTTNPVATEQYGSVSVTTVNLQQGTEGTNEG

SEQ ID NO: 92845 - protein, 33 aa, Artificial Sequence
  Description of Artificial Sequence: Synthetic polypeptide
QEEEIRTTNPCATEQYGSVSTCPAGPNMRGNPV

SEQ ID NO: 92846 - protein, 33 aa, Artificial Sequence
  Description of Artificial Sequence: Synthetic polypeptide
AEEEIRTTNPVATEQYGSVSVTTNSNNTESNNI

SEQ ID NO: 92847 - protein, 35 aa, Artificial Sequence
  Description of Artificial Sequence: Synthetic polypeptide
AEEEIRTTNPVATEQYGSVSVTTNQQQGENGNNED

SEQ ID NO: 92848 - protein, 35 aa, Artificial Sequence
  Description of Artificial Sequence: Synthetic polypeptide
AEEEIRTTNPVATEQYGSVSVTTNQQNQQQGTNND

SEQ ID NO: 92849 - protein, 30 aa, Artificial Sequence
  Description of Artificial Sequence: Synthetic polypeptide
QEEEIRTTNPVATECYGSVSEAGNMRNEEL

SEQ ID NO: 92850 - protein, 34 aa, Artificial Sequence
  Description of Artificial Sequence: Synthetic polypeptide
DEEEIRTTNPVATEQYGSVGGDGNNEQGEGNNGQ

SEQ ID NO: 92851 - protein, 35 aa, Artificial Sequence
  Description of Artificial Sequence: Synthetic polypeptide
DEEEIRTTNPVATEQYGSVGEPTVGLEQRGMQPQD

SEQ ID NO: 92852 - protein, 33 aa, Artificial Sequence
  Description of Artificial Sequence: Synthetic polypeptide
DEEEIRTTNPVATEQYGSVGSGMGGQGNENGDP

SEQ ID NO: 92853 - protein, 35 aa, Artificial Sequence
  Description of Artificial Sequence: Synthetic polypeptide
DEEEIRTTNPVATEQYGSVGEPTNVQPYTGLEENP

SEQ ID NO: 92854 - protein, 34 aa, Artificial Sequence
  Description of Artificial Sequence: Synthetic polypeptide
DEEEIRTTNPVATEQYGSVGENELDFGGNNEEMQ

SEQ ID NO: 92855 - protein, 33 aa, Artificial Sequence
  Description of Artificial Sequence: Synthetic polypeptide
DEEEIRTTNPVATEQYGSVGELELDQGRNEEDQ

SEQ ID NO: 92856 - protein, 35 aa, Artificial Sequence
  Description of Artificial Sequence: Synthetic polypeptide
AEEEIRTTNPVATEQYGSVSVTTNQNQGEQGNNTD

SEQ ID NO: 92857 - protein, 36 aa, Artificial Sequence
  Description of Artificial Sequence: Synthetic polypeptide
DEEEIRTTNPVATEQYGSVGDTVNGLGQDEGGNGGE

SEQ ID NO: 92858 - protein, 35 aa, Artificial Sequence
  Description of Artificial Sequence: Synthetic polypeptide
DEEEIRTTNPVATEQYGSVGDTNDGLEDEGGNNGQ

SEQ ID NO: 92859 - protein, 35 aa, Artificial Sequence
  Description of Artificial Sequence: Synthetic polypeptide
AEEEIRTTNPVATEQYGSVSVTTNQLGNENGTNPT

SEQ ID NO: 92860 - protein, 35 aa, Artificial Sequence
  Description of Artificial Sequence: Synthetic polypeptide
DEEEIRTTNPVATEQYGSVGDSDNTEGGNGQGNEG

SEQ ID NO: 92861 - protein, 32 aa, Artificial Sequence
  Description of Artificial Sequence: Synthetic polypeptide
QEEEIRTTNPVATEGYGSVSTSAGPNMRGDPI

SEQ ID NO: 92862 - protein, 32 aa, Artificial Sequence
  Description of Artificial Sequence: Synthetic polypeptide
QEEEIRTTNPVATEGYGSVSTTAGPNMRGDPI

SEQ ID NO: 92863 - protein, 35 aa, Artificial Sequence
  Description of Artificial Sequence: Synthetic polypeptide
AEEEIRTTNPVATEQYGSVSVTTNQGNQGEQGNND

SEQ ID NO: 92864 - protein, 34 aa, Artificial Sequence
  Description of Artificial Sequence: Synthetic polypeptide
QEEEIRTTNPVATECYGSVSTTPCGPQMRGMNPL

SEQ ID NO: 92865 - protein, 33 aa, Artificial Sequence
  Description of Artificial Sequence: Synthetic polypeptide
QEEEIRCTNPAATEQYGSVSIENMLMRGQNQAI

SEQ ID NO: 92866 - protein, 36 aa, Artificial Sequence
  Description of Artificial Sequence: Synthetic polypeptide
AEEEIRTTNPVATEQYGSVSVTVSTNLQQGNLQNGI

SEQ ID NO: 92867 - protein, 34 aa, Artificial Sequence
  Description of Artificial Sequence: Synthetic polypeptide
DEEEIRTTNPVATEQYGSVGSGMGGQNNDGNQDG

SEQ ID NO: 92868 - protein, 29 aa, Artificial Sequence
  Description of Artificial Sequence: Synthetic peptide
DEEEIATTNPVATEQYGSAPEDCQHEEEK

SEQ ID NO: 92869 - protein, 30 aa, Artificial Sequence
  Description of Artificial Sequence: Synthetic polypeptide
DEEEIATTNPVATEQYGSAPEDCQHEGEDK

SEQ ID NO: 92870 - protein, 29 aa, Artificial Sequence
  Description of Artificial Sequence: Synthetic peptide
DEEEIATTNPVATEQYGSAPEVCQHEEEK

SEQ ID NO: 92871 - protein, 35 aa, Artificial Sequence
  Description of Artificial Sequence: Synthetic polypeptide
DEEEIRTTNPVATEQYGSVGSTNNMTQGTEGEGGQ

SEQ ID NO: 92872 - protein, 30 aa, Artificial Sequence
  Description of Artificial Sequence: Synthetic polypeptide
DEEEIATTNPVATEQYGSAPTDLEDHEEEK

SEQ ID NO: 92873 - protein, 31 aa, Artificial Sequence
  Description of Artificial Sequence: Synthetic polypeptide
DEEEIATTNPVATEQYGSASATDCEHEGEDK

SEQ ID NO: 92874 - protein, 31 aa, Artificial Sequence
  Description of Artificial Sequence: Synthetic polypeptide
DEEEIATTNPVATEQYGSASATDCEHEGEDL

SEQ ID NO: 92875 - protein, 32 aa, Artificial Sequence
  Description of Artificial Sequence: Synthetic polypeptide
DEEEIATTNPVATEQYGSASATDCQDHEGEDL

SEQ ID NO: 92876 - protein, 32 aa, Artificial Sequence
  Description of Artificial Sequence: Synthetic polypeptide
DEEEIATTNPVATEQYGSASATDLEDHEGEDL

SEQ ID NO: 92877 - protein, 32 aa, Artificial Sequence
  Description of Artificial Sequence: Synthetic polypeptide
DEEEIATTNPVATEQYGSASATVLEDHEGEDL

SEQ ID NO: 92878 - protein, 34 aa, Artificial Sequence
  Description of Artificial Sequence: Synthetic polypeptide
AEEEIRTTNPVATEQYGSVTTTNLQQNDENTNNS

SEQ ID NO: 92879 - protein, 31 aa, Artificial Sequence
  Description of Artificial Sequence: Synthetic polypeptide
DEEEIATTNPVATEQYGSASEVGPQMHGEPV

SEQ ID NO: 92880 - protein, 32 aa, Artificial Sequence
  Description of Artificial Sequence: Synthetic polypeptide
DEEEIATTNPVATEQYGSASSEPAGPQRNGEK

SEQ ID NO: 92881 - protein, 33 aa, Artificial Sequence
  Description of Artificial Sequence: Synthetic polypeptide
DEEEIATTNPVATEQYGSASSTTPAGNMRGGPR

SEQ ID NO: 92882 - protein, 33 aa, Artificial Sequence
  Description of Artificial Sequence: Synthetic polypeptide
AEEEIRTTNPVATEQYGSVTTNNNQNGIGTDES

SEQ ID NO: 92883 - protein, 35 aa, Artificial Sequence
  Description of Artificial Sequence: Synthetic polypeptide
AEEEIRTTNPVATEQYGSVTNTNLQAGNNQIGNTD

SEQ ID NO: 92884 - protein, 36 aa, Artificial Sequence
  Description of Artificial Sequence: Synthetic polypeptide
AEEEIRTTNPVATEQYGSVSVVVTNLQQGSTEAGNE

SEQ ID NO: 92885 - protein, 35 aa, Artificial Sequence
  Description of Artificial Sequence: Synthetic polypeptide
AEEEIRTTNPVATEQYGSVSVVVTNGNQGGNNNQQ

SEQ ID NO: 92886 - protein, 33 aa, Artificial Sequence
  Description of Artificial Sequence: Synthetic polypeptide
AEEEIRTTNPVATEQYGSVSVVVNQQQTQGTIG

SEQ ID NO: 92887 - protein, 36 aa, Artificial Sequence
  Description of Artificial Sequence: Synthetic polypeptide
AEEEIRTTNPVATEQYGSVSVVTTNLQQGNLQNNGI

SEQ ID NO: 92888 - protein, 31 aa, Artificial Sequence
  Description of Artificial Sequence: Synthetic polypeptide
DEEEIATTNPVATEQYGSCAAGNNLDMDNNF

SEQ ID NO: 92889 - protein, 34 aa, Artificial Sequence
  Description of Artificial Sequence: Synthetic polypeptide
AEEEIRTTNPVATEQYGSVTTTNLQQNQENQNTE

SEQ ID NO: 92890 - protein, 33 aa, Artificial Sequence
  Description of Artificial Sequence: Synthetic polypeptide
AEEEIRTTNPVATEQYGSVTTTNMQGTNNVTTE

SEQ ID NO: 92891 - protein, 34 aa, Artificial Sequence
  Description of Artificial Sequence: Synthetic polypeptide
AEEEIRTTNPVATEQYGSVTTTNNLQQNQENNNT

SEQ ID NO: 92892 - protein, 35 aa, Artificial Sequence
  Description of Artificial Sequence: Synthetic polypeptide
DEEEIRTTNPVATEQYGSVGSTVNGFGQENIGQGG

SEQ ID NO: 92893 - protein, 28 aa, Artificial Sequence
  Description of Artificial Sequence: Synthetic peptide
QEEEIATVNPVATECYGDVSECLQSEEL

SEQ ID NO: 92894 - protein, 28 aa, Artificial Sequence
  Description of Artificial Sequence: Synthetic peptide
QEEEIATVNPVATEQYGEAPDVLQHGEK

SEQ ID NO: 92895 - protein, 28 aa, Artificial Sequence
  Description of Artificial Sequence: Synthetic peptide
QEEEIATVNPVATEQYGEAPEVLQHENK

SEQ ID NO: 92896 - protein, 33 aa, Artificial Sequence
  Description of Artificial Sequence: Synthetic polypeptide
AEEEIRTTNPVATEQYGSVVNTNDEAGTVNNTG

SEQ ID NO: 92897 - protein, 28 aa, Artificial Sequence
  Description of Artificial Sequence: Synthetic peptide
QEEEIATVNPVCTEQYGEVPENCQSENK

SEQ ID NO: 92898 - protein, 28 aa, Artificial Sequence
  Description of Artificial Sequence: Synthetic peptide
QEEEIATVNPVCTEQYGEVPENLQHEEQ

SEQ ID NO: 92899 - protein, 31 aa, Artificial Sequence
  Description of Artificial Sequence: Synthetic polypeptide
QEEEICTTNPTAYEQYGSVATNLQHAAGTGA

SEQ ID NO: 92900 - protein, 32 aa, Artificial Sequence
  Description of Artificial Sequence: Synthetic polypeptide
QEEEICTTNPTAYEQYGSVATNLQHAGGNGAE

SEQ ID NO: 92901 - protein, 33 aa, Artificial Sequence
  Description of Artificial Sequence: Synthetic polypeptide
DEEEIATTNPVATEQYGSACSANNDIPQDNGNN

SEQ ID NO: 92902 - protein, 35 aa, Artificial Sequence
  Description of Artificial Sequence: Synthetic polypeptide
DEEEIRTTNPVATEQYGSVGSVTNGMGQSQENENI

SEQ ID NO: 92903 - protein, 36 aa, Artificial Sequence
  Description of Artificial Sequence: Synthetic polypeptide
AEEEIRTTNPVATEQYGSVSVVTTNLQQGIQTNNVD

SEQ ID NO: 92904 - protein, 35 aa, Artificial Sequence
  Description of Artificial Sequence: Synthetic polypeptide
DEEEIRTTNPVATEQYGSVGSVTNGMGQGSEQNFT

SEQ ID NO: 92905 - protein, 35 aa, Artificial Sequence
  Description of Artificial Sequence: Synthetic polypeptide
AEEEIRTTNPVATEQYGSVTVVTNLQGNNGEENEE

SEQ ID NO: 92906 - protein, 33 aa, Artificial Sequence
  Description of Artificial Sequence: Synthetic polypeptide
DEEEIATTNPVATEQYGSACSAPLQDADGNDNH

SEQ ID NO: 92907 - protein, 32 aa, Artificial Sequence
  Description of Artificial Sequence: Synthetic polypeptide
AEEEIRTTNPVATEQYGSVTVTNNNNSEAGIF

SEQ ID NO: 92908 - protein, 34 aa, Artificial Sequence
  Description of Artificial Sequence: Synthetic polypeptide
DEEEIATTNPVATEQYGSACSAQNNDIPQDNGNR

SEQ ID NO: 92909 - protein, 33 aa, Artificial Sequence
  Description of Artificial Sequence: Synthetic polypeptide
AEEEIRTTNPVATEQYGSVTVTNMEQGTNVTED

SEQ ID NO: 92910 - protein, 33 aa, Artificial Sequence
  Description of Artificial Sequence: Synthetic polypeptide
DEEEIATTNPVATEQYGSACSATNDIPQDNENN

SEQ ID NO: 92911 - protein, 32 aa, Artificial Sequence
  Description of Artificial Sequence: Synthetic polypeptide
AEEEIRTTNPVATEQYGSVTVNTNDTGVNNNT

SEQ ID NO: 92912 - protein, 35 aa, Artificial Sequence
  Description of Artificial Sequence: Synthetic polypeptide
AEEEIRTTNPVATEQYGSVTTVTNNLQIGTTENSE

SEQ ID NO: 92913 - protein, 35 aa, Artificial Sequence
  Description of Artificial Sequence: Synthetic polypeptide
AEEEIRTTNPVATEQYGSVTTVTNLQVGTTEENNE

SEQ ID NO: 92914 - protein, 33 aa, Artificial Sequence
  Description of Artificial Sequence: Synthetic polypeptide
AEEEIRTTNPVATEQYGSVTTVNNLNVTTENSE

SEQ ID NO: 92915 - protein, 36 aa, Artificial Sequence
  Description of Artificial Sequence: Synthetic polypeptide
DEEEIRTTNPVATEQYGSVGSVTNGMGQGSEQGNEI

SEQ ID NO: 92916 - protein, 34 aa, Artificial Sequence
  Description of Artificial Sequence: Synthetic polypeptide
DEEEIRTTNPVATEQYGSVFVWINEDQDRQMNDS

SEQ ID NO: 92917 - protein, 35 aa, Artificial Sequence
  Description of Artificial Sequence: Synthetic polypeptide
AEEEIRTTNPVATEQYGSVSVVTTNGNQGGNNNDD

SEQ ID NO: 92918 - protein, 33 aa, Artificial Sequence
  Description of Artificial Sequence: Synthetic polypeptide
DEEEIATTNPVATEQYGSCASKHILENREGNAE

SEQ ID NO: 92919 - protein, 36 aa, Artificial Sequence
  Description of Artificial Sequence: Synthetic polypeptide
DEEEIRTTNPVATEQYGSVGSNTDGNNQGEFGNNGN

SEQ ID NO: 92920 - protein, 34 aa, Artificial Sequence
  Description of Artificial Sequence: Synthetic polypeptide
DEEEIRTTNPVATEQYGSVGSNTDEMQGEGQEES

SEQ ID NO: 92921 - protein, 34 aa, Artificial Sequence
  Description of Artificial Sequence: Synthetic polypeptide
DEEEIRTTNPVATEQYGSVGSNNDEMDNEGENDP

SEQ ID NO: 92922 - protein, 32 aa, Artificial Sequence
  Description of Artificial Sequence: Synthetic polypeptide
DEEEIATTNPVATEQYGSVAATPNDQDQVDGA

SEQ ID NO: 92923 - protein, 34 aa, Artificial Sequence
  Description of Artificial Sequence: Synthetic polypeptide
DEEEIATTNPVATEQYGSVAATPNDQTQANPNMR

SEQ ID NO: 92924 - protein, 35 aa, Artificial Sequence
  Description of Artificial Sequence: Synthetic polypeptide
DEEEIRTTNPVATEQYGSVGSNMNLIFNGGGNEGT

SEQ ID NO: 92925 - protein, 35 aa, Artificial Sequence
  Description of Artificial Sequence: Synthetic polypeptide
DEEEIRTTNPVATEQYGSVGSNMNLFINGGGNGDD

SEQ ID NO: 92926 - protein, 34 aa, Artificial Sequence
  Description of Artificial Sequence: Synthetic polypeptide
AEEEIRTTNPVATEQYGSVSVTVTQLQQTTIGEG

SEQ ID NO: 92927 - protein, 36 aa, Artificial Sequence
  Description of Artificial Sequence: Synthetic polypeptide
AEEEIRTTNPVATEQYGSVSVTVTNLQQQGTEAGND

SEQ ID NO: 92928 - protein, 34 aa, Artificial Sequence
  Description of Artificial Sequence: Synthetic polypeptide
DEEEIATTNPVATEQYGSVAGANGLTDSPGNDRF

SEQ ID NO: 92929 - protein, 33 aa, Artificial Sequence
  Description of Artificial Sequence: Synthetic polypeptide
DEEEIATTNPVATEQYGSVAGTGNPQNSGESQD

SEQ ID NO: 92930 - protein, 33 aa, Artificial Sequence
  Description of Artificial Sequence: Synthetic polypeptide
DEEEIATTNPVATEQYGSVAGTGNPTQNSEENQ

SEQ ID NO: 92931 - protein, 34 aa, Artificial Sequence
  Description of Artificial Sequence: Synthetic polypeptide
DEEEIRTTNPVATEQYGSVGSGQNVGNGQGNEQD

SEQ ID NO: 92932 - protein, 34 aa, Artificial Sequence
  Description of Artificial Sequence: Synthetic polypeptide
DEEEIRTTNPVATEQYGSVGSGNNDNGQTEGGEQ

SEQ ID NO: 92933 - protein, 34 aa, Artificial Sequence
  Description of Artificial Sequence: Synthetic polypeptide
DEEEIATTNPVATEQYGSVAGTNLQDPPGETVQE

SEQ ID NO: 92934 - protein, 33 aa, Artificial Sequence
  Description of Artificial Sequence: Synthetic polypeptide
QEEEIRCTNPAATEQYGSVSIENMLMREGGNQG

SEQ ID NO: 92935 - protein, 33 aa, Artificial Sequence
  Description of Artificial Sequence: Synthetic polypeptide
DEEEIRTTNPVATEQYGSVGSGMGGQNSEGEEV

SEQ ID NO: 92936 - protein, 33 aa, Artificial Sequence
  Description of Artificial Sequence: Synthetic polypeptide
DEEEIRTTNPVATEQYGSVGSGMGGQNNMNEGG

SEQ ID NO: 92937 - protein, 33 aa, Artificial Sequence
  Description of Artificial Sequence: Synthetic polypeptide
DEEEIRTTNPVATEQYGSVGSGMGGQNNMENGI

SEQ ID NO: 92938 - protein, 34 aa, Artificial Sequence
  Description of Artificial Sequence: Synthetic polypeptide
DEEEIRTTNPVATEQYGSVGSGMGGQNNGMENPG

SEQ ID NO: 92939 - protein, 33 aa, Artificial Sequence
  Description of Artificial Sequence: Synthetic polypeptide
QEEEIRCTNPAATEQYGSVSIENMLMREGNPGE

SEQ ID NO: 92940 - protein, 33 aa, Artificial Sequence
  Description of Artificial Sequence: Synthetic polypeptide
DEEEIATTNPVATEQYGSVAATANPQDNPQNPH

SEQ ID NO: 92941 - protein, 32 aa, Artificial Sequence
  Description of Artificial Sequence: Synthetic polypeptide
DEEEIATTNPVATEQYGSVAANLDNSDGHEDH

SEQ ID NO: 92942 - protein, 32 aa, Artificial Sequence
  Description of Artificial Sequence: Synthetic polypeptide
DEEEIATTNPVATEQYGSVAAANVLDEANNNE

SEQ ID NO: 92943 - protein, 34 aa, Artificial Sequence
  Description of Artificial Sequence: Synthetic polypeptide
DEEEIATTNPVATEQYGSVAAAGNLDQDADDGSR

SEQ ID NO: 92944 - protein, 35 aa, Artificial Sequence
  Description of Artificial Sequence: Synthetic polypeptide
AEEEIRTTNPVATEQYGSVSVVTNQLQAGTTAEQQ

SEQ ID NO: 92945 - protein, 32 aa, Artificial Sequence
  Description of Artificial Sequence: Synthetic polypeptide
DEEEIATTNPVATEQYGSCSAGNMIGQADNNN

SEQ ID NO: 92946 - protein, 35 aa, Artificial Sequence
  Description of Artificial Sequence: Synthetic polypeptide
AEEEIRTTNPVATEQYGSVSVVTNNQNGAQGNNNQ

SEQ ID NO: 92947 - protein, 35 aa, Artificial Sequence
  Description of Artificial Sequence: Synthetic polypeptide
AEEEIRTTNPVATEQYGSVSVVTNNQLNGGNNEGN

SEQ ID NO: 92948 - protein, 33 aa, Artificial Sequence
  Description of Artificial Sequence: Synthetic polypeptide
DEEEIATTNPVATEQYGSCSTGNEPQENMDNTE

SEQ ID NO: 92949 - protein, 33 aa, Artificial Sequence
  Description of Artificial Sequence: Synthetic polypeptide
DEEEIATTNPVATEQYGSCVAAGNNLDMEDNRN

SEQ ID NO: 92950 - protein, 35 aa, Artificial Sequence
  Description of Artificial Sequence: Synthetic polypeptide
AEEEIRTTNPVATEQYGSVSVVTNNNNQQIGNTTD

SEQ ID NO: 92951 - protein, 34 aa, Artificial Sequence
  Description of Artificial Sequence: Synthetic polypeptide
AEEEIRTTNPVATEQYGSVSVVTNNNNAQGNNDQ

SEQ ID NO: 92952 - protein, 35 aa, Artificial Sequence
  Description of Artificial Sequence: Synthetic polypeptide
AEEEIRTTNPVATEQYGSVSVVTNNNLNQGNNANQ

SEQ ID NO: 92953 - protein, 35 aa, Artificial Sequence
  Description of Artificial Sequence: Synthetic polypeptide
AEEEIRTTNPVATEQYGSVSVVTNNNLANQNNNNQ

SEQ ID NO: 92954 - protein, 34 aa, Artificial Sequence
  Description of Artificial Sequence: Synthetic polypeptide
AEEEIRTTNPVATEQYGSVSVVTSNSNQATNNAE

SEQ ID NO: 92955 - protein, 35 aa, Artificial Sequence
  Description of Artificial Sequence: Synthetic polypeptide
AEEEIRTTNPVATEQYGSVSVVTNNLNQQIQTNVT

SEQ ID NO: 92956 - protein, 35 aa, Artificial Sequence
  Description of Artificial Sequence: Synthetic polypeptide
AEEEIRTTNPVATEQYGSVSVVTNNLEQGNLQNGI

SEQ ID NO: 92957 - protein, 36 aa, Artificial Sequence
  Description of Artificial Sequence: Synthetic polypeptide
AEEEIRTTNPVATEQYGSVSVVTNLLNNQQGNNTDE

SEQ ID NO: 92958 - protein, 36 aa, Artificial Sequence
  Description of Artificial Sequence: Synthetic polypeptide
AEEEIRTTNPVATEQYGSVSVVSTNNLQAGNNQNGI

SEQ ID NO: 92959 - protein, 29 aa, Artificial Sequence
  Description of Artificial Sequence: Synthetic peptide
QEEEICTTNPVATEQYGVVATEVEQDEED

SEQ ID NO: 92960 - protein, 36 aa, Artificial Sequence
  Description of Artificial Sequence: Synthetic polypeptide
AEEEIRTTNPVATEQYGSVSVVNTNNLQQGNLQNGI

SEQ ID NO: 92961 - protein, 33 aa, Artificial Sequence
  Description of Artificial Sequence: Synthetic polypeptide
AEEEIRTTNPVATEQYGSVSVVNNNLQQNDEQG

SEQ ID NO: 92962 - protein, 34 aa, Artificial Sequence
  Description of Artificial Sequence: Synthetic polypeptide
AEEEIRTTNPVATEQYGSVSVVNNNGTQTGNNQD

SEQ ID NO: 92963 - protein, 34 aa, Artificial Sequence
  Description of Artificial Sequence: Synthetic polypeptide
AEEEIRTTNPVATEQYGSVSVVNNLQQQNDTNQQ

SEQ ID NO: 92964 - protein, 34 aa, Artificial Sequence
  Description of Artificial Sequence: Synthetic polypeptide
AEEEIRTTNPVATEQYGSVSVVNNLQQNDTNNQT

SEQ ID NO: 92965 - protein, 34 aa, Artificial Sequence
  Description of Artificial Sequence: Synthetic polypeptide
AEEEIRTTNPVATEQYGSVSVVNNLNQQNDTNQE

SEQ ID NO: 92966 - protein, 36 aa, Artificial Sequence
  Description of Artificial Sequence: Synthetic polypeptide
AEEEIRTTNPVATEQYGSVSVVTNNLNQAIGTNTDE

SEQ ID NO: 92967 - protein, 35 aa, Artificial Sequence
  Description of Artificial Sequence: Synthetic polypeptide
AEEEIRTTNPVATEQYGSVSVTTNNNQQQIGTNEG

SEQ ID NO: 92968 - protein, 34 aa, Artificial Sequence
  Description of Artificial Sequence: Synthetic polypeptide
QEEEIRTTNPVATEQYGDVSSTTGLQVGGGNEDE

SEQ ID NO: 92969 - protein, 34 aa, Artificial Sequence
  Description of Artificial Sequence: Synthetic polypeptide
DEEEIRTTNPVATEQYGSVFTPLNLEENGETEEN

SEQ ID NO: 92970 - protein, 31 aa, Artificial Sequence
  Description of Artificial Sequence: Synthetic polypeptide
DEEEIATTNPVATEQYGSVCAANNDDPENGN

SEQ ID NO: 92971 - protein, 32 aa, Artificial Sequence
  Description of Artificial Sequence: Synthetic polypeptide
DEEEIATTNPVATEQYGSVCAANNDNDGENDD

SEQ ID NO: 92972 - protein, 35 aa, Artificial Sequence
  Description of Artificial Sequence: Synthetic polypeptide
QEEEIRTTNPVATEQYGSVSPTTPAGQMRNGMNPV

SEQ ID NO: 92973 - protein, 33 aa, Artificial Sequence
  Description of Artificial Sequence: Synthetic polypeptide
QEEEIRTTNPVATEQYGSVSSTACPNMRNGMEV

SEQ ID NO: 92974 - protein, 34 aa, Artificial Sequence
  Description of Artificial Sequence: Synthetic polypeptide
QEEEIRTTNPVATEQYGSVSSTCAGNMRNGMNPV

SEQ ID NO: 92975 - protein, 34 aa, Artificial Sequence
  Description of Artificial Sequence: Synthetic polypeptide
AEEEIRTTNPVATEQYGSVSVTNQQQQTQIGTIS

SEQ ID NO: 92976 - protein, 34 aa, Artificial Sequence
  Description of Artificial Sequence: Synthetic polypeptide
QEEEIRTTNPVATEQYGSVSSTTAGNMRNGMNPV

SEQ ID NO: 92977 - protein, 34 aa, Artificial Sequence
  Description of Artificial Sequence: Synthetic polypeptide
QEEEIRTTNPVATEQYGSVSSTTAGPNMRGMNPV

SEQ ID NO: 92978 - protein, 34 aa, Artificial Sequence
  Description of Artificial Sequence: Synthetic polypeptide
AEEEIRTTNPVATEQYGSVSVTNQQQLQGTTEQG

SEQ ID NO: 92979 - protein, 33 aa, Artificial Sequence
  Description of Artificial Sequence: Synthetic polypeptide
QEEEIRTTNPVATEQYGSVSSTTPAGNRNENPV

SEQ ID NO: 92980 - protein, 35 aa, Artificial Sequence
  Description of Artificial Sequence: Synthetic polypeptide
QEEEIRTTNPVATEQYGSVSSTTPAGPQRNGMNPI

SEQ ID NO: 92981 - protein, 35 aa, Artificial Sequence
  Description of Artificial Sequence: Synthetic polypeptide
QEEEIRTTNPVATEQYGSVSSTTPAGPQRNGMNPV

SEQ ID NO: 92982 - protein, 35 aa, Artificial Sequence
  Description of Artificial Sequence: Synthetic polypeptide
QEEEIRTTNPVATEQYGSVSTCPAGPNMRNGMNPR

SEQ ID NO: 92983 - protein, 33 aa, Artificial Sequence
  Description of Artificial Sequence: Synthetic polypeptide
DEEEIATTNPVATEQYGSVCAANNLQDSDNNEH

SEQ ID NO: 92984 - protein, 34 aa, Artificial Sequence
  Description of Artificial Sequence: Synthetic polypeptide
DEEEIATTNPVATEQYGSVCAANNLQEAEDENGR

SEQ ID NO: 92985 - protein, 34 aa, Artificial Sequence
  Description of Artificial Sequence: Synthetic polypeptide
QEEEIRTTNPVATEQYGSVSTCPAGPNMRNGNPV

SEQ ID NO: 92986 - protein, 36 aa, Artificial Sequence
  Description of Artificial Sequence: Synthetic polypeptide
QEEEIRTTNPVATEQYGSVSTDGTGNLDQEGENDQN

SEQ ID NO: 92987 - protein, 34 aa, Artificial Sequence
  Description of Artificial Sequence: Synthetic polypeptide
QEEEIRTTNPVATEQYGSVSTDNGLEGGGGETGT

SEQ ID NO: 92988 - protein, 33 aa, Artificial Sequence
  Description of Artificial Sequence: Synthetic polypeptide
DEEEIRTTNPVATEQYGSVESNQEQVHTLNEDF

SEQ ID NO: 92989 - protein, 33 aa, Artificial Sequence
  Description of Artificial Sequence: Synthetic polypeptide
DEEEIATTNPVATEQYGSVCAANNLQEAPDTAR

SEQ ID NO: 92990 - protein, 34 aa, Artificial Sequence
  Description of Artificial Sequence: Synthetic polypeptide
QEEEIRTTNPVATEQYGSVSTGGQNDEGGGNEEQ

SEQ ID NO: 92991 - protein, 31 aa, Artificial Sequence
  Description of Artificial Sequence: Synthetic polypeptide
DEEEIATTNPVATEQYGSVCAANNDDGEEGD

SEQ ID NO: 92992 - protein, 32 aa, Artificial Sequence
  Description of Artificial Sequence: Synthetic polypeptide
QEEEIRTTNPVATEQYGSVSPTACNMRNEMEV

SEQ ID NO: 92993 - protein, 35 aa, Artificial Sequence
  Description of Artificial Sequence: Synthetic polypeptide
QEEEIRTTNPVATEQYGSVSNTDTGLQVEGGNDGG

SEQ ID NO: 92994 - protein, 33 aa, Artificial Sequence
  Description of Artificial Sequence: Synthetic polypeptide
DEEEIATTNPVATEQYGSVCAANMGEQPDGGNQ

SEQ ID NO: 92995 - protein, 34 aa, Artificial Sequence
  Description of Artificial Sequence: Synthetic polypeptide
QEEEIRTTNPVATEQYGSVLGDTNDQGEGEEGNI

SEQ ID NO: 92996 - protein, 34 aa, Artificial Sequence
  Description of Artificial Sequence: Synthetic polypeptide
QEEEIRTTNPVATEQYGSVMSDGNLDEFGQNIND

SEQ ID NO: 92997 - protein, 34 aa, Artificial Sequence
  Description of Artificial Sequence: Synthetic polypeptide
QEEEIRTTNPVATEQYGSVNDDTDNINQNEGENQ

SEQ ID NO: 92998 - protein, 33 aa, Artificial Sequence
  Description of Artificial Sequence: Synthetic polypeptide
QEEEIRTTNPVATEQYGSVNIMNNDDEGQGGNI

SEQ ID NO: 92999 - protein, 33 aa, Artificial Sequence
  Description of Artificial Sequence: Synthetic polypeptide
DEEEIATTNPVATEQYGSVCAAMNHGQDSDGNN

SEQ ID NO: 93000 - protein, 35 aa, Artificial Sequence
  Description of Artificial Sequence: Synthetic polypeptide
AEEEIRTTNPVATEQYGSVSVTTNDNQQQGTNNAN

SEQ ID NO: 93001 - protein, 32 aa, Artificial Sequence
  Description of Artificial Sequence: Synthetic polypeptide
QEEEIRTTNPVATEQYGSVPTPACPQMRNEEK

SEQ ID NO: 93002 - protein, 32 aa, Artificial Sequence
  Description of Artificial Sequence: Synthetic polypeptide
QEEEIRTTNPVATEQYGSVPTPACPQMRNEEV

SEQ ID NO: 93003 - protein, 33 aa, Artificial Sequence
  Description of Artificial Sequence: Synthetic polypeptide
DEEEIATTNPVATEQYGSVCAAMNLNMGGENTA

SEQ ID NO: 93004 - protein, 36 aa, Artificial Sequence
  Description of Artificial Sequence: Synthetic polypeptide
AEEEIRTTNPVATEQYGSVSVTSTNLQQQNGTNPVN

SEQ ID NO: 93005 - protein, 32 aa, Artificial Sequence
  Description of Artificial Sequence: Synthetic polypeptide
DEEEIRTTNPVATEQYGSVEQVNIPTVVEERV

SEQ ID NO: 93006 - protein, 34 aa, Artificial Sequence
  Description of Artificial Sequence: Synthetic polypeptide
DEEEIRTTNPVATEQYGSVETNGMQQLVNSEDEI

SEQ ID NO: 93007 - protein, 33 aa, Artificial Sequence
  Description of Artificial Sequence: Synthetic polypeptide
DEEEIRTTNPVATEQYGSVETMWLVPIEDGEVD

SEQ ID NO: 93008 - protein, 33 aa, Artificial Sequence
  Description of Artificial Sequence: Synthetic polypeptide
DEEEIATTNPVATEQYGSVCAAMTHGQDSDINR

SEQ ID NO: 93009 - protein, 34 aa, Artificial Sequence
  Description of Artificial Sequence: Synthetic polypeptide
QEEEIRTTNPVATEQYGSVSDDNNGQNEGGNGGE

SEQ ID NO: 93010 - protein, 32 aa, Artificial Sequence
  Description of Artificial Sequence: Synthetic polypeptide
DEEEIATTNPVATEQYGSVCAANDQDSGMFPM

SEQ ID NO: 93011 - protein, 33 aa, Artificial Sequence
  Description of Artificial Sequence: Synthetic polypeptide
DEEEIRTTNPVATEQYGSVETMLVSIEQGEEEI

SEQ ID NO: 93012 - protein, 34 aa, Artificial Sequence
  Description of Artificial Sequence: Synthetic polypeptide
AEEEIRTTNPVATEQYGSVSVTNSQQEATNNTTA

SEQ ID NO: 93013 - protein, 33 aa, Artificial Sequence
  Description of Artificial Sequence: Synthetic polypeptide
AEEEIRTTNPVATEQYGSVSVTNSNTESNNQNI

SEQ ID NO: 93014 - protein, 33 aa, Artificial Sequence
  Description of Artificial Sequence: Synthetic polypeptide
AEEEIRTTNPVATEQYGSVSVTNSNTDESNNNI

SEQ ID NO: 93015 - protein, 35 aa, Artificial Sequence
  Description of Artificial Sequence: Synthetic polypeptide
QEEEIRTTNPVATEQYGSVSGTVNNLIIGQGTNPD

SEQ ID NO: 93016 - protein, 34 aa, Artificial Sequence
  Description of Artificial Sequence: Synthetic polypeptide
AEEEIRTTNPVATEQYGSVSVTNSNGTESGNANI

SEQ ID NO: 93017 - protein, 35 aa, Artificial Sequence
  Description of Artificial Sequence: Synthetic polypeptide
AEEEIRTTNPVATEQYGSVSVTSNNGNQQGNNNDT

SEQ ID NO: 93018 - protein, 34 aa, Artificial Sequence
  Description of Artificial Sequence: Synthetic polypeptide
QEEEIRTTNPVATEQYGSVISNTDNMNIIGGGND

SEQ ID NO: 93019 - protein, 34 aa, Artificial Sequence
  Description of Artificial Sequence: Synthetic polypeptide
QEEEIRTTNPVATEQYGSVSTGNGGGDGEGNEID

SEQ ID NO: 93020 - protein, 35 aa, Artificial Sequence
  Description of Artificial Sequence: Synthetic polypeptide
QEEEIRTTNPVATEQYGSVSTNDGGQTQGQGNQDD

SEQ ID NO: 93021 - protein, 34 aa, Artificial Sequence
  Description of Artificial Sequence: Synthetic polypeptide
DEEEIATTNPVATEQYGSVCAATANDQDLPGGNH

SEQ ID NO: 93022 - protein, 33 aa, Artificial Sequence
  Description of Artificial Sequence: Synthetic polypeptide
DEEEIRTTNPVATEQYGSVEPSTIQPVFQNNEI

SEQ ID NO: 93023 - protein, 36 aa, Artificial Sequence
  Description of Artificial Sequence: Synthetic polypeptide
AEEEIRTTNPVATEQYGSVSVTNNNLQQNEGTNNVA

SEQ ID NO: 93024 - protein, 35 aa, Artificial Sequence
  Description of Artificial Sequence: Synthetic polypeptide
DEEEIRTTNPVATEQYGSVEPSETLSQDTQTNQRI

SEQ ID NO: 93025 - protein, 33 aa, Artificial Sequence
  Description of Artificial Sequence: Synthetic polypeptide
QEEEIRTTNPVATEQYGSYVSDTTGLTQGHTGH

SEQ ID NO: 93026 - protein, 33 aa, Artificial Sequence
  Description of Artificial Sequence: Synthetic polypeptide
DEEEIRTTNPVATEQYGSVEPQPMLGEAQPELR

SEQ ID NO: 93027 - protein, 31 aa, Artificial Sequence
  Description of Artificial Sequence: Synthetic polypeptide
QEEEIRTTNPVATEQYGVMASPALPNRGMDI

SEQ ID NO: 93028 - protein, 32 aa, Artificial Sequence
  Description of Artificial Sequence: Synthetic polypeptide
QEEEIRTTNPVATEQYGVMSASPALPNRGMDI

SEQ ID NO: 93029 - protein, 36 aa, Artificial Sequence
  Description of Artificial Sequence: Synthetic polypeptide
AEEEIRTTNPVATEQYGSVSVTNNNLQQGTNQNDED

SEQ ID NO: 93030 - protein, 36 aa, Artificial Sequence
  Description of Artificial Sequence: Synthetic polypeptide
AEEEIRTTNPVATEQYGSVSVTNNNLQQGTEGTNGT

SEQ ID NO: 93031 - protein, 33 aa, Artificial Sequence
  Description of Artificial Sequence: Synthetic polypeptide
DEEEIRTTNPVATEQYGSVEPMLEQQLMGEGQL

SEQ ID NO: 93032 - protein, 36 aa, Artificial Sequence
  Description of Artificial Sequence: Synthetic polypeptide
AEEEIRTTNPVATEQYGSVSVTNNNLQQGNIGTNVN

SEQ ID NO: 93033 - protein, 36 aa, Artificial Sequence
  Description of Artificial Sequence: Synthetic polypeptide
AEEEIRTTNPVATEQYGSVSVTNNNLQQGEQQNTED

SEQ ID NO: 93034 - protein, 36 aa, Artificial Sequence
  Description of Artificial Sequence: Synthetic polypeptide
AEEEIRTTNPVATEQYGSVSVTNNNLQQGEGTNTEE

SEQ ID NO: 93035 - protein, 36 aa, Artificial Sequence
  Description of Artificial Sequence: Synthetic polypeptide
AEEEIRTTNPVATEQYGSVSVTNNNLQQGEGNNEEG

SEQ ID NO: 93036 - protein, 36 aa, Artificial Sequence
  Description of Artificial Sequence: Synthetic polypeptide
AEEEIRTTNPVATEQYGSVSVTNNNLQQGEEQNEEA

SEQ ID NO: 93037 - protein, 32 aa, Artificial Sequence
  Description of Artificial Sequence: Synthetic polypeptide
DEEEIATTNPVATEQYGSVCAATGDQDMPGMN

SEQ ID NO: 93038 - protein, 34 aa, Artificial Sequence
  Description of Artificial Sequence: Synthetic polypeptide
DEEEIRTTNPVATEQYGSVEPANGMPQLVGNQWQ

SEQ ID NO: 93039 - protein, 34 aa, Artificial Sequence
  Description of Artificial Sequence: Synthetic polypeptide
DEEEIRTTNPVATEQYGSVEPAMNMLQENMIQNI

SEQ ID NO: 93040 - protein, 36 aa, Artificial Sequence
  Description of Artificial Sequence: Synthetic polypeptide
AEEEIRTTNPVATEQYGSVSVTNNNLQQGDETGNNE

SEQ ID NO: 93041 - protein, 36 aa, Artificial Sequence
  Description of Artificial Sequence: Synthetic polypeptide
AEEEIRTTNPVATEQYGSVSVTNNNLQAGEGGNDET

SEQ ID NO: 93042 - protein, 33 aa, Artificial Sequence
  Description of Artificial Sequence: Synthetic polypeptide
DEEEIATTNPVATEQYGSVCAATANDQDLPDGN

SEQ ID NO: 93043 - protein, 35 aa, Artificial Sequence
  Description of Artificial Sequence: Synthetic polypeptide
DEEEIRTTNPVATEQYGSVEPTGNELFTQMIPNEY

SEQ ID NO: 93044 - protein, 35 aa, Artificial Sequence
  Description of Artificial Sequence: Synthetic polypeptide
QEEEIRTTNPVATEQYGSVVGSTMNLEDPEGQGNE

SEQ ID NO: 93045 - protein, 32 aa, Artificial Sequence
  Description of Artificial Sequence: Synthetic polypeptide
QEEEIRTTNPVATEQYGSVTTDTMDNGIGGFD

SEQ ID NO: 93046 - protein, 35 aa, Artificial Sequence
  Description of Artificial Sequence: Synthetic polypeptide
DEEEIATTNPVATEQYGSVCAANNLQEAPGENARS

SEQ ID NO: 93047 - protein, 34 aa, Artificial Sequence
  Description of Artificial Sequence: Synthetic polypeptide
DEEEIATTNPVATEQYGSVCAANNLQEAPGENGN

SEQ ID NO: 93048 - protein, 34 aa, Artificial Sequence
  Description of Artificial Sequence: Synthetic polypeptide
DEEEIRTTNPVATEQYGSVEPTTTLQQPAQGEQM

SEQ ID NO: 93049 - protein, 34 aa, Artificial Sequence
  Description of Artificial Sequence: Synthetic polypeptide
DEEEIRTTNPVATEQYGSVEPTTNMVQVQDMNHE

SEQ ID NO: 93050 - protein, 34 aa, Artificial Sequence
  Description of Artificial Sequence: Synthetic polypeptide
DEEEIATTNPVATEQYGSVCAANNLQEHAGENQH

SEQ ID NO: 93051 - protein, 36 aa, Artificial Sequence
  Description of Artificial Sequence: Synthetic polypeptide
DEEEIRTTNPVATEQYGSVEPTTNGPQNRQGNELLI

SEQ ID NO: 93052 - protein, 35 aa, Artificial Sequence
  Description of Artificial Sequence: Synthetic polypeptide
AEEEIRTTNPVATEQYGSVSVTNNQNGQENGTNPT

SEQ ID NO: 93053 - protein, 36 aa, Artificial Sequence
  Description of Artificial Sequence: Synthetic polypeptide
AEEEIRTTNPVATEQYGSVSVTNNQLQQQNIGTNTN

SEQ ID NO: 93054 - protein, 36 aa, Artificial Sequence
  Description of Artificial Sequence: Synthetic polypeptide
AEEEIRTTNPVATEQYGSVSVTNNQLQAGNIGTNNG

SEQ ID NO: 93055 - protein, 35 aa, Artificial Sequence
  Description of Artificial Sequence: Synthetic polypeptide
DEEEIRTTNPVATEQYGSVEPTNVDETTQSGQDNQ

SEQ ID NO: 93056 - protein, 33 aa, Artificial Sequence
  Description of Artificial Sequence: Synthetic polypeptide
QEEEIRTTNPVATEQYGSVSTMGFELGEGGGEG

SEQ ID NO: 93057 - protein, 35 aa, Artificial Sequence
  Description of Artificial Sequence: Synthetic polypeptide
AEEEIRTTNPVATEQYGSVSVTNNQLNAGNGNGNV

SEQ ID NO: 93058 - protein, 34 aa, Artificial Sequence
  Description of Artificial Sequence: Synthetic polypeptide
DEEEIRTTNPVATEQYGSVEPTNMTTQRNIEHDQ

SEQ ID NO: 93059 - protein, 33 aa, Artificial Sequence
  Description of Artificial Sequence: Synthetic polypeptide
DEEEIATTNPVATEQYGSVCAANPLTEADNMRQ

SEQ ID NO: 93060 - protein, 33 aa, Artificial Sequence
  Description of Artificial Sequence: Synthetic polypeptide
DEEEIATTNPVATEQYGSVCAANPPQEADNQRQ

SEQ ID NO: 93061 - protein, 34 aa, Artificial Sequence
  Description of Artificial Sequence: Synthetic polypeptide
QEEEIRTTNPVATEQYGSVSTTPAGPNRNGMNPV

SEQ ID NO: 93062 - protein, 34 aa, Artificial Sequence
  Description of Artificial Sequence: Synthetic polypeptide
QEEEIRTTNPVATEQYGSVSTTPCGPNMRGMNPL

SEQ ID NO: 93063 - protein, 35 aa, Artificial Sequence
  Description of Artificial Sequence: Synthetic polypeptide
AEEEIRTTNPVATEQYGSVSVTNNNNVQNGTNEEN

SEQ ID NO: 93064 - protein, 35 aa, Artificial Sequence
  Description of Artificial Sequence: Synthetic polypeptide
QEEEIRTTNPVATEQYGSVTDGTGNLNQEMGGNIQ

SEQ ID NO: 93065 - protein, 33 aa, Artificial Sequence
  Description of Artificial Sequence: Synthetic polypeptide
DEEEIRTTNPVATEQYGSVEPTMNMEEENMQNI

SEQ ID NO: 93066 - protein, 34 aa, Artificial Sequence
  Description of Artificial Sequence: Synthetic polypeptide
DEEEIATTNPVATEQYGSVCAATANADQDDPGNN

SEQ ID NO: 93067 - protein, 32 aa, Artificial Sequence
  Description of Artificial Sequence: Synthetic polypeptide
QEEEIRTTNPVATEQYGSVTTDTMDNGGGGDG

SEQ ID NO: 93068 - protein, 35 aa, Artificial Sequence
  Description of Artificial Sequence: Synthetic polypeptide
AEEEIRTTNPVATEQYGSVSVTNNQLGNNQGTNPD

SEQ ID NO: 93069 - protein, 33 aa, Artificial Sequence
  Description of Artificial Sequence: Synthetic polypeptide
DEEEIATTNPVATEQYGSVSSTTALEDHEGEDL

SEQ ID NO: 93070 - protein, 32 aa, Artificial Sequence
  Description of Artificial Sequence: Synthetic polypeptide
QEEEIRTTNPVATEQYGSVGTTTVINGNGGFG

SEQ ID NO: 93071 - protein, 34 aa, Artificial Sequence
  Description of Artificial Sequence: Synthetic polypeptide
QEEEIRTTNPVATEQYGSVGTDNGQTEEGGNEGN

SEQ ID NO: 93072 - protein, 33 aa, Artificial Sequence
  Description of Artificial Sequence: Synthetic polypeptide
DEEEIRTTNPVATEQYGSVFGVTGLGNGGGQGE

SEQ ID NO: 93073 - protein, 33 aa, Artificial Sequence
  Description of Artificial Sequence: Synthetic polypeptide
DEEEIRTTNPVATEQYGSVFGVTDLPEDGGEFF

SEQ ID NO: 93074 - protein, 28 aa, Artificial Sequence
  Description of Artificial Sequence: Synthetic peptide
QEEEIRTTNPVATEQYGEAPEVCQHEEK

SEQ ID NO: 93075 - protein, 34 aa, Artificial Sequence
  Description of Artificial Sequence: Synthetic polypeptide
DEEEIRTTNPVATEQYGSVFGVIGVNGQGEGNIA

SEQ ID NO: 93076 - protein, 33 aa, Artificial Sequence
  Description of Artificial Sequence: Synthetic polypeptide
DEEEIRTTNPVATEQYGSVFGVFNGEGNGGNDG

SEQ ID NO: 93077 - protein, 28 aa, Artificial Sequence
  Description of Artificial Sequence: Synthetic peptide
QEEEIRTTNPVATEQYGEAPEVCQHPEK

SEQ ID NO: 93078 - protein, 34 aa, Artificial Sequence
  Description of Artificial Sequence: Synthetic polypeptide
DEEEIRTTNPVATEQYGSVFGTSNMQNIEGFGED

SEQ ID NO: 93079 - protein, 34 aa, Artificial Sequence
  Description of Artificial Sequence: Synthetic polypeptide
DEEEIATTNPVATEQYGSVCAADNHGQDSDGNPR

SEQ ID NO: 93080 - protein, 35 aa, Artificial Sequence
  Description of Artificial Sequence: Synthetic polypeptide
DEEEIRTTNPVATEQYGSVFGTSGNMQGIEGENED

SEQ ID NO: 93081 - protein, 34 aa, Artificial Sequence
  Description of Artificial Sequence: Synthetic polypeptide
DEEEIRTTNPVATEQYGSVFGTQNVGVGGDNGQT

SEQ ID NO: 93082 - protein, 28 aa, Artificial Sequence
  Description of Artificial Sequence: Synthetic peptide
QEEEIRTTNPVATEQYGEAPEVEQAEDK

SEQ ID NO: 93083 - protein, 28 aa, Artificial Sequence
  Description of Artificial Sequence: Synthetic peptide
QEEEIRTTNPVATEQYGEAPEVQQHEEK

SEQ ID NO: 93084 - protein, 28 aa, Artificial Sequence
  Description of Artificial Sequence: Synthetic peptide
QEEEIRTTNPVATEQYGEAPMDCQHEEK

SEQ ID NO: 93085 - protein, 28 aa, Artificial Sequence
  Description of Artificial Sequence: Synthetic peptide
QEEEIRTTNPVATEQYGEAPMVCQHEEK

SEQ ID NO: 93086 - protein, 35 aa, Artificial Sequence
  Description of Artificial Sequence: Synthetic polypeptide
DEEEIRTTNPVATEQYGSVFGSIQNVNNGQGGGNI

SEQ ID NO: 93087 - protein, 35 aa, Artificial Sequence
  Description of Artificial Sequence: Synthetic polypeptide
DEEEIRTTNPVATEQYGSVFGSIGVNEGQGDGENI

SEQ ID NO: 93088 - protein, 29 aa, Artificial Sequence
  Description of Artificial Sequence: Synthetic peptide
QEEEIRTTNPVATEQYGEAPTPVGNHGEK

SEQ ID NO: 93089 - protein, 31 aa, Artificial Sequence
  Description of Artificial Sequence: Synthetic polypeptide
QEEEIRTTNPVATEQYGEASEINEQHEGEEG

SEQ ID NO: 93090 - protein, 36 aa, Artificial Sequence
  Description of Artificial Sequence: Synthetic polypeptide
AEEEIRTTNPVATEQYGSVSVTTNNNQLQIGTNEGE

SEQ ID NO: 93091 - protein, 28 aa, Artificial Sequence
  Description of Artificial Sequence: Synthetic peptide
QEEEIRTTNPVATEQYGEASEVCMHEEK

SEQ ID NO: 93092 - protein, 29 aa, Artificial Sequence
  Description of Artificial Sequence: Synthetic peptide
QEEEIRTTNPVATEQYGEASEVCQNAEEK

SEQ ID NO: 93093 - protein, 28 aa, Artificial Sequence
  Description of Artificial Sequence: Synthetic peptide
QEEEIRTTNPVATEQYGEAPEVCQHEEA

SEQ ID NO: 93094 - protein, 28 aa, Artificial Sequence
  Description of Artificial Sequence: Synthetic peptide
QEEEIRTTNPVATEQYGEAPEVCQHDEK

SEQ ID NO: 93095 - protein, 28 aa, Artificial Sequence
  Description of Artificial Sequence: Synthetic peptide
QEEEIRTTNPVATEQYGEAPEVCQAEEK

SEQ ID NO: 93096 - protein, 28 aa, Artificial Sequence
  Description of Artificial Sequence: Synthetic peptide
QEEEIRTTNPVATEQYGEAPEVCQAEDK

SEQ ID NO: 93097 - protein, 33 aa, Artificial Sequence
  Description of Artificial Sequence: Synthetic polypeptide
DEEEIATTNPVATEQYGSVATNPTPDDGMNDEL

SEQ ID NO: 93098 - protein, 32 aa, Artificial Sequence
  Description of Artificial Sequence: Synthetic polypeptide
DEEEIATTNPVATEQYGSVATPAITQDGPTDE

SEQ ID NO: 93099 - protein, 34 aa, Artificial Sequence
  Description of Artificial Sequence: Synthetic polypeptide
QEEEIRTTNPVATEQYGDVSTGGLGQNEGGGNQG

SEQ ID NO: 93100 - protein, 33 aa, Artificial Sequence
  Description of Artificial Sequence: Synthetic polypeptide
QEEEIRTTNPVATEQYGDVVSTSNTQFEFEGGQ

SEQ ID NO: 93101 - protein, 33 aa, Artificial Sequence
  Description of Artificial Sequence: Synthetic polypeptide
QEEEIRTTNPVATEQYGDVVTGIQNDGQGGNDE

SEQ ID NO: 93102 - protein, 28 aa, Artificial Sequence
  Description of Artificial Sequence: Synthetic peptide
QEEEIRTTNPVATEQYGEAAEVCQHEEK

SEQ ID NO: 93103 - protein, 28 aa, Artificial Sequence
  Description of Artificial Sequence: Synthetic peptide
QEEEIRTTNPVATEQYGEANEVCQHEEK

SEQ ID NO: 93104 - protein, 29 aa, Artificial Sequence
  Description of Artificial Sequence: Synthetic peptide
QEEEIRTTNPVATEQYGEAPCIVEQHGEG

SEQ ID NO: 93105 - protein, 28 aa, Artificial Sequence
  Description of Artificial Sequence: Synthetic peptide
QEEEIRTTNPVATEQYGEAPCVCQHEEK

SEQ ID NO: 93106 - protein, 28 aa, Artificial Sequence
  Description of Artificial Sequence: Synthetic peptide
QEEEIRTTNPVATEQYGEAPCVEQHEEK

SEQ ID NO: 93107 - protein, 29 aa, Artificial Sequence
  Description of Artificial Sequence: Synthetic peptide
QEEEIRTTNPVATEQYGEASEVEQHAEDK

SEQ ID NO: 93108 - protein, 34 aa, Artificial Sequence
  Description of Artificial Sequence: Synthetic polypeptide
DEEEIATTNPVATEQYGSVATSNSLDQTAPGGEF

SEQ ID NO: 93109 - protein, 28 aa, Artificial Sequence
  Description of Artificial Sequence: Synthetic peptide
QEEEIRTTNPVATEQYGEAPEDCQHEEK

SEQ ID NO: 93110 - protein, 28 aa, Artificial Sequence
  Description of Artificial Sequence: Synthetic peptide
QEEEIRTTNPVATEQYGEAPEDIQHEEK

SEQ ID NO: 93111 - protein, 34 aa, Artificial Sequence
  Description of Artificial Sequence: Synthetic polypeptide
DEEEIATTNPVATEQYGSVCAAANGLNDMEGGNR

SEQ ID NO: 93112 - protein, 34 aa, Artificial Sequence
  Description of Artificial Sequence: Synthetic polypeptide
DEEEIATTNPVATEQYGSVCAAANGLNEMEGNER

SEQ ID NO: 93113 - protein, 33 aa, Artificial Sequence
  Description of Artificial Sequence: Synthetic polypeptide
DEEEIATTNPVATEQYGSVCAAANGLNIMEMNR

SEQ ID NO: 93114 - protein, 32 aa, Artificial Sequence
  Description of Artificial Sequence: Synthetic polypeptide
DEEEIATTNPVATEQYGSVCAAANGLNMEENH

SEQ ID NO: 93115 - protein, 30 aa, Artificial Sequence
  Description of Artificial Sequence: Synthetic polypeptide
QEEEIRTTNPVATEQYGEAPEINEQDHGEG

SEQ ID NO: 93116 - protein, 30 aa, Artificial Sequence
  Description of Artificial Sequence: Synthetic polypeptide
QEEEIRTTNPVATEQYGEAPEINEQDHGEK

SEQ ID NO: 93117 - protein, 30 aa, Artificial Sequence
  Description of Artificial Sequence: Synthetic polypeptide
QEEEIRTTNPVATEQYGEAPEINEQHEGEG

SEQ ID NO: 93118 - protein, 34 aa, Artificial Sequence
  Description of Artificial Sequence: Synthetic polypeptide
DEEEIRTTNPVATEQYGSVFPITNLQEVAQLEIP

SEQ ID NO: 93119 - protein, 28 aa, Artificial Sequence
  Description of Artificial Sequence: Synthetic peptide
QEEEIRTTNPVATEQYGEAPEACQHEEK

SEQ ID NO: 93120 - protein, 32 aa, Artificial Sequence
  Description of Artificial Sequence: Synthetic polypeptide
QEEEIRTTNPVATEQYGSVGTDTMDNGGDGFG

SEQ ID NO: 93121 - protein, 29 aa, Artificial Sequence
  Description of Artificial Sequence: Synthetic peptide
QEEEIRTTNPVATEQYGEASEVEQNAEEA

SEQ ID NO: 93122 - protein, 29 aa, Artificial Sequence
  Description of Artificial Sequence: Synthetic peptide
QEEEIRTTNPVATEQYGEASEVEQNHEEK

SEQ ID NO: 93123 - protein, 33 aa, Artificial Sequence
  Description of Artificial Sequence: Synthetic polypeptide
DEEEIATTNPVATEQYGSVCAADNNLQDMDGGN

SEQ ID NO: 93124 - protein, 34 aa, Artificial Sequence
  Description of Artificial Sequence: Synthetic polypeptide
DEEEIRTTNPVATEQYGSVEVVNTDLERYGVTSE

SEQ ID NO: 93125 - protein, 34 aa, Artificial Sequence
  Description of Artificial Sequence: Synthetic polypeptide
DEEEIRTTNPVATEQYGSVEVTWLVPIEDGNEED

SEQ ID NO: 93126 - protein, 36 aa, Artificial Sequence
  Description of Artificial Sequence: Synthetic polypeptide
AEEEIRTTNPVATEQYGSVSVTTNLQSGSEGGNNVD

SEQ ID NO: 93127 - protein, 35 aa, Artificial Sequence
  Description of Artificial Sequence: Synthetic polypeptide
AEEEIRTTNPVATEQYGSVSVTTNLQQQNNTNNQD

SEQ ID NO: 93128 - protein, 32 aa, Artificial Sequence
  Description of Artificial Sequence: Synthetic polypeptide
DEEEIRTTNPVATEQYGSVEVTMHDVSGVGDI

SEQ ID NO: 93129 - protein, 36 aa, Artificial Sequence
  Description of Artificial Sequence: Synthetic polypeptide
AEEEIRTTNPVATEQYGSVSVTTNLQQNQQGTNQEE

SEQ ID NO: 93130 - protein, 36 aa, Artificial Sequence
  Description of Artificial Sequence: Synthetic polypeptide
AEEEIRTTNPVATEQYGSVSVTTNLQQGQQGTNVES

SEQ ID NO: 93131 - protein, 34 aa, Artificial Sequence
  Description of Artificial Sequence: Synthetic polypeptide
DEEEIRTTNPVATEQYGSVETWNMMWQEEMGEEL

SEQ ID NO: 93132 - protein, 33 aa, Artificial Sequence
  Description of Artificial Sequence: Synthetic polypeptide
DEEEIRTTNPVATEQYGSVETWLVPPEQGEEEL

SEQ ID NO: 93133 - protein, 33 aa, Artificial Sequence
  Description of Artificial Sequence: Synthetic polypeptide
DEEEIRTTNPVATEQYGSVETWLVPIEQGVEEI

SEQ ID NO: 93134 - protein, 34 aa, Artificial Sequence
  Description of Artificial Sequence: Synthetic polypeptide
DEEEIRTTNPVATEQYGSVETWLVPIEQAEENEI

SEQ ID NO: 93135 - protein, 36 aa, Artificial Sequence
  Description of Artificial Sequence: Synthetic polypeptide
AEEEIRTTNPVATEQYGSVSVTTNLQNQEQGTNNDD

SEQ ID NO: 93136 - protein, 34 aa, Artificial Sequence
  Description of Artificial Sequence: Synthetic polypeptide
AEEEIRTTNPVATEQYGSVSVTTNLLQNTTTEDE

SEQ ID NO: 93137 - protein, 34 aa, Artificial Sequence
  Description of Artificial Sequence: Synthetic polypeptide
QEEEIRTTNPVATEQYGSVDTTDNINQNEGEGND

SEQ ID NO: 93138 - protein, 34 aa, Artificial Sequence
  Description of Artificial Sequence: Synthetic polypeptide
DEEEIRTTNPVATEQYGSVETTILQQVVVNELPV

SEQ ID NO: 93139 - protein, 32 aa, Artificial Sequence
  Description of Artificial Sequence: Synthetic polypeptide
DEEEIRTTNPVATEQYGSVETTGEIDPGLVFN

SEQ ID NO: 93140 - protein, 36 aa, Artificial Sequence
  Description of Artificial Sequence: Synthetic polypeptide
AEEEIRTTNPVATEQYGSVSVTTNLDNQQGNGNNTE

SEQ ID NO: 93141 - protein, 32 aa, Artificial Sequence
  Description of Artificial Sequence: Synthetic polypeptide
QEEEIRTTNPVATEQYGSVGNTTMDNGNGGFG

SEQ ID NO: 93142 - protein, 33 aa, Artificial Sequence
  Description of Artificial Sequence: Synthetic polypeptide
DEEEIRTTNPVATEQYGSVETQLVPIEQGEEEV

SEQ ID NO: 93143 - protein, 34 aa, Artificial Sequence
  Description of Artificial Sequence: Synthetic polypeptide
QEEEIRTTNPVATEQYGSVGSTVTDGQTGQGNIG

SEQ ID NO: 93144 - protein, 35 aa, Artificial Sequence
  Description of Artificial Sequence: Synthetic polypeptide
AEEEIRTTNPVATEQYGSVSVTTNNDQAGNGTNNG

SEQ ID NO: 93145 - protein, 34 aa, Artificial Sequence
  Description of Artificial Sequence: Synthetic polypeptide
DEEEIRTTNPVATEQYGSVFENTMNPLINNEENE

SEQ ID NO: 93146 - protein, 34 aa, Artificial Sequence
  Description of Artificial Sequence: Synthetic polypeptide
DEEEIRTTNPVATEQYGSVFETMLLIQVGEQEVQ

SEQ ID NO: 93147 - protein, 33 aa, Artificial Sequence
  Description of Artificial Sequence: Synthetic polypeptide
DEEEIRTTNPVATEQYGSVFETNQLNMEDQILD

SEQ ID NO: 93148 - protein, 30 aa, Artificial Sequence
  Description of Artificial Sequence: Synthetic polypeptide
QEEEIRTTNPVATEQYGEASMEVCQQHENH

SEQ ID NO: 93149 - protein, 30 aa, Artificial Sequence
  Description of Artificial Sequence: Synthetic polypeptide
QEEEIRTTNPVATEQYGEASTPAGNMHGEV

SEQ ID NO: 93150 - protein, 29 aa, Artificial Sequence
  Description of Artificial Sequence: Synthetic peptide
QEEEIRTTNPVATEQYGEVPEVCQHAEEA

SEQ ID NO: 93151 - protein, 31 aa, Artificial Sequence
  Description of Artificial Sequence: Synthetic polypeptide
QEEEIRTTNPVATEQYGEVPTEPVGQHGEPK

SEQ ID NO: 93152 - protein, 35 aa, Artificial Sequence
  Description of Artificial Sequence: Synthetic polypeptide
AEEEIRTTNPVATEQYGSVSVTTNNNLLAGNGNNV

SEQ ID NO: 93153 - protein, 29 aa, Artificial Sequence
  Description of Artificial Sequence: Synthetic peptide
QEEEIRTTNPVATEQYGEVSEVCMHAEEA

SEQ ID NO: 93154 - protein, 36 aa, Artificial Sequence
  Description of Artificial Sequence: Synthetic polypeptide
AEEEIRTTNPVATEQYGSVSVTTNNLQQGTEGTNTG

SEQ ID NO: 93155 - protein, 30 aa, Artificial Sequence
  Description of Artificial Sequence: Synthetic polypeptide
QEEEIRTTNPVATEQYGEVSPEVCQMHEEK

SEQ ID NO: 93156 - protein, 30 aa, Artificial Sequence
  Description of Artificial Sequence: Synthetic polypeptide
QEEEIRTTNPVATEQYGEVSPEVCQMHEEV

SEQ ID NO: 93157 - protein, 30 aa, Artificial Sequence
  Description of Artificial Sequence: Synthetic polypeptide
QEEEIRTTNPVATEQYGEVSPEVGQMHEEV

SEQ ID NO: 93158 - protein, 29 aa, Artificial Sequence
  Description of Artificial Sequence: Synthetic peptide
QEEEIRTTNPVATEQYGEASEVEQNAEEK

SEQ ID NO: 93159 - protein, 36 aa, Artificial Sequence
  Description of Artificial Sequence: Synthetic polypeptide
AEEEIRTTNPVATEQYGSVSVTTNNLQQGNEGNDEE

SEQ ID NO: 93160 - protein, 34 aa, Artificial Sequence
  Description of Artificial Sequence: Synthetic polypeptide
DEEEIRTTNPVATEQYGSVFGDINQNTGQGGNID

SEQ ID NO: 93161 - protein, 34 aa, Artificial Sequence
  Description of Artificial Sequence: Synthetic polypeptide
DEEEIRTTNPVATEQYGSVFGDINQNQGGEGNDN

SEQ ID NO: 93162 - protein, 34 aa, Artificial Sequence
  Description of Artificial Sequence: Synthetic polypeptide
DEEEIRTTNPVATEQYGSVFGDINQNFGQGGNNS

SEQ ID NO: 93163 - protein, 35 aa, Artificial Sequence
  Description of Artificial Sequence: Synthetic polypeptide
DEEEIRTTNPVATEQYGSVFGDINLNQGNEGNVNG

SEQ ID NO: 93164 - protein, 35 aa, Artificial Sequence
  Description of Artificial Sequence: Synthetic polypeptide
DEEEIRTTNPVATEQYGSVFGDINLNQGGEGNTNT

SEQ ID NO: 93165 - protein, 34 aa, Artificial Sequence
  Description of Artificial Sequence: Synthetic polypeptide
DEEEIRTTNPVATEQYGSVFGDINLEIGGGNGNN

SEQ ID NO: 93166 - protein, 35 aa, Artificial Sequence
  Description of Artificial Sequence: Synthetic polypeptide
DEEEIRTTNPVATEQYGSVFGDINDLEQGGGNGNG

SEQ ID NO: 93167 - protein, 33 aa, Artificial Sequence
  Description of Artificial Sequence: Synthetic polypeptide
DEEEIRTTNPVATEQYGSVFGDFNQGEIEGNQN

SEQ ID NO: 93168 - protein, 31 aa, Artificial Sequence
  Description of Artificial Sequence: Synthetic polypeptide
QEEEIRTTNPVATEQYGSAPCIVEPQDRGEG

SEQ ID NO: 93169 - protein, 31 aa, Artificial Sequence
  Description of Artificial Sequence: Synthetic polypeptide
QEEEIRTTNPVATEQYGSAPEINEQDHEGEG

SEQ ID NO: 93170 - protein, 33 aa, Artificial Sequence
  Description of Artificial Sequence: Synthetic polypeptide
QEEEIRTTNPVATEQYGMVSIGNDQQGIGNVGD

SEQ ID NO: 93171 - protein, 34 aa, Artificial Sequence
  Description of Artificial Sequence: Synthetic polypeptide
DEEEICTTNPVAYEQYGSVSCTNNSLSQVSDGEF

SEQ ID NO: 93172 - protein, 33 aa, Artificial Sequence
  Description of Artificial Sequence: Synthetic polypeptide
DEEEIATTNPVATEQYGSVSSTTDLEDHEGEDL

SEQ ID NO: 93173 - protein, 28 aa, Artificial Sequence
  Description of Artificial Sequence: Synthetic peptide
QEGEIAPTNPVSSECYGIVSCNLQSGTR

SEQ ID NO: 93174 - protein, 28 aa, Artificial Sequence
  Description of Artificial Sequence: Synthetic peptide
DEEEIATTNPVSTEQYGEAPEVCQREEK

SEQ ID NO: 93175 - protein, 29 aa, Artificial Sequence
  Description of Artificial Sequence: Synthetic peptide
QENEIATTNPVATECYGDVSECLQHENML

SEQ ID NO: 93176 - protein, 34 aa, Artificial Sequence
  Description of Artificial Sequence: Synthetic polypeptide
DEEEIATTNPVSTEQYGSVSSTTAGPNMRNGNPR

SEQ ID NO: 93177 - protein, 28 aa, Artificial Sequence
  Description of Artificial Sequence: Synthetic peptide
QENEIATTNPVATECYGDVSECLQHEPL

SEQ ID NO: 93178 - protein, 28 aa, Artificial Sequence
  Description of Artificial Sequence: Synthetic peptide
QENEIATTNPVATECYGDVSECLQHEQL

SEQ ID NO: 93179 - protein, 28 aa, Artificial Sequence
  Description of Artificial Sequence: Synthetic peptide
QENEIATTNPVATECYGDVSECLQHERL

SEQ ID NO: 93180 - protein, 28 aa, Artificial Sequence
  Description of Artificial Sequence: Synthetic peptide
QENEIATTNPVATECYGDVSECLQHESL

SEQ ID NO: 93181 - protein, 28 aa, Artificial Sequence
  Description of Artificial Sequence: Synthetic peptide
QENEIATTNPVATECYGDVSECLQHETC

SEQ ID NO: 93182 - protein, 28 aa, Artificial Sequence
  Description of Artificial Sequence: Synthetic peptide
QENEIATTNPVATECYGDVSECLQHETF

SEQ ID NO: 93183 - protein, 28 aa, Artificial Sequence
  Description of Artificial Sequence: Synthetic peptide
QENEIATTNPVATECYGDVSECLQHETL

SEQ ID NO: 93184 - protein, 28 aa, Artificial Sequence
  Description of Artificial Sequence: Synthetic peptide
QENEIATTNPVATECYGDVSECLQHEVL

SEQ ID NO: 93185 - protein, 28 aa, Artificial Sequence
  Description of Artificial Sequence: Synthetic peptide
QENEIATTNPVATECYGDVSECLQHEWL

SEQ ID NO: 93186 - protein, 28 aa, Artificial Sequence
  Description of Artificial Sequence: Synthetic peptide
QENEIATTNPVATECYGDVSECLQHEYL

SEQ ID NO: 93187 - protein, 28 aa, Artificial Sequence
  Description of Artificial Sequence: Synthetic peptide
QENEIATTNPVATECYGDVSECLQHFEL

SEQ ID NO: 93188 - protein, 30 aa, Artificial Sequence
  Description of Artificial Sequence: Synthetic polypeptide
DEEEIATVNPVATEQWGVVSDILMNAAGNQ

SEQ ID NO: 93189 - protein, 29 aa, Artificial Sequence
  Description of Artificial Sequence: Synthetic peptide
QENEIATTNPVATECYGDVSECLQHGEEL

SEQ ID NO: 93190 - protein, 29 aa, Artificial Sequence
  Description of Artificial Sequence: Synthetic peptide
QENEIATTNPVATECYGDVSECLQHGEQL

SEQ ID NO: 93191 - protein, 28 aa, Artificial Sequence
  Description of Artificial Sequence: Synthetic peptide
QENEIATTNPVATECYGDVSECLQHHEL

SEQ ID NO: 93192 - protein, 31 aa, Artificial Sequence
  Description of Artificial Sequence: Synthetic polypeptide
DEEEIATVNPVATEQYGCVAGTGLQENANQT

SEQ ID NO: 93193 - protein, 32 aa, Artificial Sequence
  Description of Artificial Sequence: Synthetic polypeptide
DEEEIATVNPVATEQYGCVATGLQNRMNNQEE

SEQ ID NO: 93194 - protein, 32 aa, Artificial Sequence
  Description of Artificial Sequence: Synthetic polypeptide
DEEEIATVNPVATEQYGCVATGLQSRANMSEN

SEQ ID NO: 93195 - protein, 29 aa, Artificial Sequence
  Description of Artificial Sequence: Synthetic peptide
QENEIATTNPVATECYGDVSECLQHENEL

SEQ ID NO: 93196 - protein, 28 aa, Artificial Sequence
  Description of Artificial Sequence: Synthetic peptide
QENEIATTNPVATECYGDVSECLQHIEL

SEQ ID NO: 93197 - protein, 28 aa, Artificial Sequence
  Description of Artificial Sequence: Synthetic peptide
QENEIATTNPVATECYGDVSECLQHEML

SEQ ID NO: 93198 - protein, 28 aa, Artificial Sequence
  Description of Artificial Sequence: Synthetic peptide
QENEIATTNPVATECYGDVSECLQHEKL

SEQ ID NO: 93199 - protein, 29 aa, Artificial Sequence
  Description of Artificial Sequence: Synthetic peptide
QENEIATTNPVATECYGDVSECLQHEENC

SEQ ID NO: 93200 - protein, 29 aa, Artificial Sequence
  Description of Artificial Sequence: Synthetic peptide
QENEIATTNPVATECYGDVSECLQHEENL

SEQ ID NO: 93201 - protein, 29 aa, Artificial Sequence
  Description of Artificial Sequence: Synthetic peptide
QENEIATTNPVATECYGDVSECLQHEEPR

SEQ ID NO: 93202 - protein, 28 aa, Artificial Sequence
  Description of Artificial Sequence: Synthetic peptide
QENEIATTNPVATECYGDVSECLQHEEQ

SEQ ID NO: 93203 - protein, 29 aa, Artificial Sequence
  Description of Artificial Sequence: Synthetic peptide
QENEIATTNPVATECYGDVSECLQHEERL

SEQ ID NO: 93204 - protein, 28 aa, Artificial Sequence
  Description of Artificial Sequence: Synthetic peptide
QENEIATTNPVATECYGDVSECLQHEES

SEQ ID NO: 93205 - protein, 28 aa, Artificial Sequence
  Description of Artificial Sequence: Synthetic peptide
QENEIATTNPVATECYGDVSECLQHEET

SEQ ID NO: 93206 - protein, 28 aa, Artificial Sequence
  Description of Artificial Sequence: Synthetic peptide
QENEIATTNPVATECYGDVSECLQHEEV

SEQ ID NO: 93207 - protein, 31 aa, Artificial Sequence
  Description of Artificial Sequence: Synthetic polypeptide
DEEEIATTNPVCTECYGVVSNDEDLQESGNI

SEQ ID NO: 93208 - protein, 30 aa, Artificial Sequence
  Description of Artificial Sequence: Synthetic polypeptide
DEEEIATTNPVCTEQYGCVAANLQGEMPMT

SEQ ID NO: 93209 - protein, 32 aa, Artificial Sequence
  Description of Artificial Sequence: Synthetic polypeptide
DEEEIATTNPVCTEQYGCVAANLQGMGNQFTD

SEQ ID NO: 93210 - protein, 31 aa, Artificial Sequence
  Description of Artificial Sequence: Synthetic polypeptide
DEEEIATTNPVCTEQYGCVAFNLQGMEDGFT

SEQ ID NO: 93211 - protein, 28 aa, Artificial Sequence
  Description of Artificial Sequence: Synthetic peptide
QENEIATTNPVATECYGDVSECLQHEEW

SEQ ID NO: 93212 - protein, 28 aa, Artificial Sequence
  Description of Artificial Sequence: Synthetic peptide
QENEIATTNPVATECYGDVSECLQHEEY

SEQ ID NO: 93213 - protein, 28 aa, Artificial Sequence
  Description of Artificial Sequence: Synthetic peptide
QENEIATTNPVATECYGDVSECLQHEFL

SEQ ID NO: 93214 - protein, 29 aa, Artificial Sequence
  Description of Artificial Sequence: Synthetic peptide
QENEIATTNPVATECYGDVSECLQHEGEL

SEQ ID NO: 93215 - protein, 28 aa, Artificial Sequence
  Description of Artificial Sequence: Synthetic peptide
QENEIATTNPVATECYGDVSECLQHEGL

SEQ ID NO: 93216 - protein, 32 aa, Artificial Sequence
  Description of Artificial Sequence: Synthetic polypeptide
DEEEIATTNPVCTEQYGVVSATDLEDHEGNDL

SEQ ID NO: 93217 - protein, 31 aa, Artificial Sequence
  Description of Artificial Sequence: Synthetic polypeptide
DEEEIATTNPVCTETYGSVANPNLQDMGGLA

SEQ ID NO: 93218 - protein, 28 aa, Artificial Sequence
  Description of Artificial Sequence: Synthetic peptide
QENEIATTNPVATECYGDVSECLQHEHL

SEQ ID NO: 93219 - protein, 28 aa, Artificial Sequence
  Description of Artificial Sequence: Synthetic peptide
QENEIATTNPVATECYGDVSECLQHEIL

SEQ ID NO: 93220 - protein, 28 aa, Artificial Sequence
  Description of Artificial Sequence: Synthetic peptide
QENEIATTNPVATECYGDVSECLQHELL

SEQ ID NO: 93221 - protein, 28 aa, Artificial Sequence
  Description of Artificial Sequence: Synthetic peptide
QENEIATTNPVATECYGDVSECLQHIML

SEQ ID NO: 93222 - protein, 28 aa, Artificial Sequence
  Description of Artificial Sequence: Synthetic peptide
QENEIATTNPVATECYGDVSECLQHKEL

SEQ ID NO: 93223 - protein, 32 aa, Artificial Sequence
  Description of Artificial Sequence: Synthetic polypeptide
DEEEIATVNPVATEQYGSVATGLQSANNASEE

SEQ ID NO: 93224 - protein, 28 aa, Artificial Sequence
  Description of Artificial Sequence: Synthetic peptide
QENEIATTNPVATECYGDVSECLQMEEL

SEQ ID NO: 93225 - protein, 28 aa, Artificial Sequence
  Description of Artificial Sequence: Synthetic peptide
QENEIATTNPVATECYGDVSECLQNEEL

SEQ ID NO: 93226 - protein, 28 aa, Artificial Sequence
  Description of Artificial Sequence: Synthetic peptide
QENEIATTNPVATECYGDVSECLQPEEL

SEQ ID NO: 93227 - protein, 28 aa, Artificial Sequence
  Description of Artificial Sequence: Synthetic peptide
QENEIATTNPVATECYGDVSECLQQEEH

SEQ ID NO: 93228 - protein, 35 aa, Artificial Sequence
  Description of Artificial Sequence: Synthetic polypeptide
DEEEIRTTNPVATEQYGSVASVTMMMLQTVEEARI

SEQ ID NO: 93229 - protein, 28 aa, Artificial Sequence
  Description of Artificial Sequence: Synthetic peptide
QENEIATTNPVATECYGDVSECLQQEEL

SEQ ID NO: 93230 - protein, 34 aa, Artificial Sequence
  Description of Artificial Sequence: Synthetic polypeptide
DEEEIRTTNPVATEQYGSVASVMNAGQNRTEVEL

SEQ ID NO: 93231 - protein, 34 aa, Artificial Sequence
  Description of Artificial Sequence: Synthetic polypeptide
DEEEICTTNPMATEQWGSVPCTNLSHHRTGGNNR

SEQ ID NO: 93232 - protein, 36 aa, Artificial Sequence
  Description of Artificial Sequence: Synthetic polypeptide
DEEEIRTTNPVATEQYGSVASTTLAGPNMRQGMNPV

SEQ ID NO: 93233 - protein, 36 aa, Artificial Sequence
  Description of Artificial Sequence: Synthetic polypeptide
DEEEIRTTNPVATEQYGSVASTTLAGPNMRNGMNPV

SEQ ID NO: 93234 - protein, 28 aa, Artificial Sequence
  Description of Artificial Sequence: Synthetic peptide
QENEIATTNPVATECYGDVSECLQSEEL

SEQ ID NO: 93235 - protein, 36 aa, Artificial Sequence
  Description of Artificial Sequence: Synthetic polypeptide
DEEEIRTTNPVATEQYGSVASTNPEGPNMRNGGNPV

SEQ ID NO: 93236 - protein, 36 aa, Artificial Sequence
  Description of Artificial Sequence: Synthetic polypeptide
DEEEIRTTNPVATEQYGSVASTNPDGPNMRGGMNPV

SEQ ID NO: 93237 - protein, 36 aa, Artificial Sequence
  Description of Artificial Sequence: Synthetic polypeptide
DEEEIRTTNPVATEQYGSVASTNPAGPNMRNGMNPV

SEQ ID NO: 93238 - protein, 33 aa, Artificial Sequence
  Description of Artificial Sequence: Synthetic polypeptide
DEEEICTTNPMATETYGSVPTENDLQHRSQNEE

SEQ ID NO: 93239 - protein, 28 aa, Artificial Sequence
  Description of Artificial Sequence: Synthetic peptide
QENEIATTNPVATECYGDVSECLQSEEQ

SEQ ID NO: 93240 - protein, 32 aa, Artificial Sequence
  Description of Artificial Sequence: Synthetic polypeptide
DEEEICTTNPMATETYGSVPTNDPQHAGQSKR

SEQ ID NO: 93241 - protein, 28 aa, Artificial Sequence
  Description of Artificial Sequence: Synthetic peptide
QENEIATTNPVATECYGDVSECLQSETL

SEQ ID NO: 93242 - protein, 29 aa, Artificial Sequence
  Description of Artificial Sequence: Synthetic peptide
QENEIATTNPVATECYGDVSECLQSREEL

SEQ ID NO: 93243 - protein, 33 aa, Artificial Sequence
  Description of Artificial Sequence: Synthetic polypeptide
DEEEICTTNPMATETYGSVPTWNDPQHAGENFR

SEQ ID NO: 93244 - protein, 28 aa, Artificial Sequence
  Description of Artificial Sequence: Synthetic peptide
QENEIATTNPVATECYGDVSECLQTEAL

SEQ ID NO: 93245 - protein, 28 aa, Artificial Sequence
  Description of Artificial Sequence: Synthetic peptide
QENEIATTNPVATECYGDVSECLQKEEL

SEQ ID NO: 93246 - protein, 28 aa, Artificial Sequence
  Description of Artificial Sequence: Synthetic peptide
QENEIATTNPVATECYGDVSECLQHYEL

SEQ ID NO: 93247 - protein, 28 aa, Artificial Sequence
  Description of Artificial Sequence: Synthetic peptide
QENEIATTNPVATECYGDVSECLQHWEL

SEQ ID NO: 93248 - protein, 28 aa, Artificial Sequence
  Description of Artificial Sequence: Synthetic peptide
QENEIATTNPVATECYGDVSECLQHVHL

SEQ ID NO: 93249 - protein, 28 aa, Artificial Sequence
  Description of Artificial Sequence: Synthetic peptide
QENEIATTNPVATECYGDVSECLQHLEL

SEQ ID NO: 93250 - protein, 32 aa, Artificial Sequence
  Description of Artificial Sequence: Synthetic polypeptide
DEEEIATVNPVATEQYGSVATGLQSNNNQMEW

SEQ ID NO: 93251 - protein, 35 aa, Artificial Sequence
  Description of Artificial Sequence: Synthetic polypeptide
DEEEIATVNPVATEQYGSVSSTTPALPQMRNGMNQ

SEQ ID NO: 93252 - protein, 33 aa, Artificial Sequence
  Description of Artificial Sequence: Synthetic polypeptide
DEEEIATVNPVAYEQYGSTVSCTRLSQRTNGTE

SEQ ID NO: 93253 - protein, 34 aa, Artificial Sequence
  Description of Artificial Sequence: Synthetic polypeptide
DEEEIATVNPVAYEQYGSTVSCTYLSQRTNGQER

SEQ ID NO: 93254 - protein, 28 aa, Artificial Sequence
  Description of Artificial Sequence: Synthetic peptide
QENEIATTNPVATECYGDVSECLQHMEL

SEQ ID NO: 93255 - protein, 32 aa, Artificial Sequence
  Description of Artificial Sequence: Synthetic polypeptide
DEEEIATVNPVCTEQYGSVSSDPALQMSNGNQ

SEQ ID NO: 93256 - protein, 28 aa, Artificial Sequence
  Description of Artificial Sequence: Synthetic peptide
QENEIATTNPVATECYGDVSECLQHNEL

SEQ ID NO: 93257 - protein, 28 aa, Artificial Sequence
  Description of Artificial Sequence: Synthetic peptide
QENEIATTNPVATECYGDVSECLQHPEL

SEQ ID NO: 93258 - protein, 28 aa, Artificial Sequence
  Description of Artificial Sequence: Synthetic peptide
QENEIATTNPVATECYGDVSECLQHPEQ

SEQ ID NO: 93259 - protein, 28 aa, Artificial Sequence
  Description of Artificial Sequence: Synthetic peptide
QENEIATTNPVATECYGDVSECLQHEEN

SEQ ID NO: 93260 - protein, 33 aa, Artificial Sequence
  Description of Artificial Sequence: Synthetic polypeptide
DEEEIATVNPVCTEQYGSVSTTALPQSNGMNPQ

SEQ ID NO: 93261 - protein, 30 aa, Artificial Sequence
  Description of Artificial Sequence: Synthetic polypeptide
DEEEIATVNPVSTEPYGTVSMDLQQQNGNQ

SEQ ID NO: 93262 - protein, 28 aa, Artificial Sequence
  Description of Artificial Sequence: Synthetic peptide
QENEIATTNPVATECYGDVSECLQHQEL

SEQ ID NO: 93263 - protein, 29 aa, Artificial Sequence
  Description of Artificial Sequence: Synthetic peptide
QENEIATTNPVATECYGDVSECLQHREEL

SEQ ID NO: 93264 - protein, 28 aa, Artificial Sequence
  Description of Artificial Sequence: Synthetic peptide
QENEIATTNPVATECYGDVSECLQHREL

SEQ ID NO: 93265 - protein, 28 aa, Artificial Sequence
  Description of Artificial Sequence: Synthetic peptide
QENEIATTNPVATECYGDVSECLQHSEL

SEQ ID NO: 93266 - protein, 28 aa, Artificial Sequence
  Description of Artificial Sequence: Synthetic peptide
QENEIATTNPVATECYGDVSECLQHTEL

SEQ ID NO: 93267 - protein, 34 aa, Artificial Sequence
  Description of Artificial Sequence: Synthetic polypeptide
DEEEICTTNPAATEQYGSVVPTGNLQMTGGNGDT

SEQ ID NO: 93268 - protein, 32 aa, Artificial Sequence
  Description of Artificial Sequence: Synthetic polypeptide
DEEEICTTNPCATEQYGCVCPTNHQEHGSNTQ

SEQ ID NO: 93269 - protein, 29 aa, Artificial Sequence
  Description of Artificial Sequence: Synthetic peptide
QENEIATTNPVATECYGDVSECLQHVEER

SEQ ID NO: 93270 - protein, 28 aa, Artificial Sequence
  Description of Artificial Sequence: Synthetic peptide
QENEIATTNPVATECYGDVSECLQHVEL

SEQ ID NO: 93271 - protein, 32 aa, Artificial Sequence
  Description of Artificial Sequence: Synthetic polypeptide
DEEEIATVNPVCTEQYGVVSTTALQSNGMNPQ

SEQ ID NO: 93272 - protein, 28 aa, Artificial Sequence
  Description of Artificial Sequence: Synthetic peptide
QENEIATTNPVATECYGDVSECLQHEEM

SEQ ID NO: 93273 - protein, 29 aa, Artificial Sequence
  Description of Artificial Sequence: Synthetic peptide
QENEIATTNPVATECYGDVSECLQHEELR

SEQ ID NO: 93274 - protein, 33 aa, Artificial Sequence
  Description of Artificial Sequence: Synthetic polypeptide
DEEEIATTNPVAYERYGVVSTTNPNQMMGDNER

SEQ ID NO: 93275 - protein, 30 aa, Artificial Sequence
  Description of Artificial Sequence: Synthetic polypeptide
QENEIATTNPVATECYGDVSATCLVQHGEL

SEQ ID NO: 93276 - protein, 28 aa, Artificial Sequence
  Description of Artificial Sequence: Synthetic peptide
QENEIATTNPVATECYGDVSCCLQHEEL

SEQ ID NO: 93277 - protein, 28 aa, Artificial Sequence
  Description of Artificial Sequence: Synthetic peptide
QENEIATTNPVATECYGDVSCCLQHETL

SEQ ID NO: 93278 - protein, 28 aa, Artificial Sequence
  Description of Artificial Sequence: Synthetic peptide
QENEIATTNPVATECYGDVSCELQHEEL

SEQ ID NO: 93279 - protein, 28 aa, Artificial Sequence
  Description of Artificial Sequence: Synthetic peptide
QENEIATTNPVATECYGDVSDCLQAEEL

SEQ ID NO: 93280 - protein, 28 aa, Artificial Sequence
  Description of Artificial Sequence: Synthetic peptide
QENEIATTNPVATECYGDVSDCLQHEEL

SEQ ID NO: 93281 - protein, 28 aa, Artificial Sequence
  Description of Artificial Sequence: Synthetic peptide
QENEIATTNPVATECYGDVSDCLQHERL

SEQ ID NO: 93282 - protein, 28 aa, Artificial Sequence
  Description of Artificial Sequence: Synthetic peptide
QENEIATTNPVATECYGDVSDGLQHEEL

SEQ ID NO: 93283 - protein, 28 aa, Artificial Sequence
  Description of Artificial Sequence: Synthetic peptide
QENEIATTNPVATECYGDVSEALQHEEL

SEQ ID NO: 93284 - protein, 35 aa, Artificial Sequence
  Description of Artificial Sequence: Synthetic polypeptide
DEEEIRTTNPVATEQYGSVAVENSLEQQPGVPERD

SEQ ID NO: 93285 - protein, 28 aa, Artificial Sequence
  Description of Artificial Sequence: Synthetic peptide
QENEIATTNPVATECYGDVSEALQWEEL

SEQ ID NO: 93286 - protein, 33 aa, Artificial Sequence
  Description of Artificial Sequence: Synthetic polypeptide
DEEEIRTTNPVATEQYGSVATYVMEEYGSNQDP

SEQ ID NO: 93287 - protein, 29 aa, Artificial Sequence
  Description of Artificial Sequence: Synthetic peptide
QENEIATTNPVATECYGDVSECDLQREEL

SEQ ID NO: 93288 - protein, 34 aa, Artificial Sequence
  Description of Artificial Sequence: Synthetic polypeptide
DEEEIRTTNPVATEQYGSVATVGNLEAGTEGTEN

SEQ ID NO: 93289 - protein, 35 aa, Artificial Sequence
  Description of Artificial Sequence: Synthetic polypeptide
DEEEIRTTNPVATEQYGSVATTTQNGNQEIGTNNQ

SEQ ID NO: 93290 - protein, 36 aa, Artificial Sequence
  Description of Artificial Sequence: Synthetic polypeptide
DEEEIRTTNPVATEQYGSVATTTNLQAGTEGNTDEQ

SEQ ID NO: 93291 - protein, 28 aa, Artificial Sequence
  Description of Artificial Sequence: Synthetic peptide
QENEIATTNPVATECYGDVSECIQHENL

SEQ ID NO: 93292 - protein, 33 aa, Artificial Sequence
  Description of Artificial Sequence: Synthetic polypeptide
DEEEIRTTNPVATEQYGSVATTNPNQQQSEDEE

SEQ ID NO: 93293 - protein, 29 aa, Artificial Sequence
  Description of Artificial Sequence: Synthetic peptide
QENEIATTNPVATECYGDVSECIQHVGER

SEQ ID NO: 93294 - protein, 29 aa, Artificial Sequence
  Description of Artificial Sequence: Synthetic peptide
QENEIATTNPVATECYGDVSECIQHVGQR

SEQ ID NO: 93295 - protein, 34 aa, Artificial Sequence
  Description of Artificial Sequence: Synthetic polypeptide
DEEEIRTTNPVATEQYGSVATTNNNQLNQAEDEE

SEQ ID NO: 93296 - protein, 30 aa, Artificial Sequence
  Description of Artificial Sequence: Synthetic polypeptide
QENEIATTNPVATECYGDVSATCLVQFGEL

SEQ ID NO: 93297 - protein, 33 aa, Artificial Sequence
  Description of Artificial Sequence: Synthetic polypeptide
DEEEIRTTNPVATEQYGSVAYPTYDQERVIVFT

SEQ ID NO: 93298 - protein, 28 aa, Artificial Sequence
  Description of Artificial Sequence: Synthetic peptide
QENEIATTNPVATECYGDVSAELQHEEL

SEQ ID NO: 93299 - protein, 34 aa, Artificial Sequence
  Description of Artificial Sequence: Synthetic polypeptide
DEEEIRTTNPVATEQYGSVCAADNNLAEADGNNN

SEQ ID NO: 93300 - protein, 34 aa, Artificial Sequence
  Description of Artificial Sequence: Synthetic polypeptide
DEEEIRTTNPVATEQYGSVCAMTNGLDQADPMES

SEQ ID NO: 93301 - protein, 28 aa, Artificial Sequence
  Description of Artificial Sequence: Synthetic peptide
QENEIATTNPVATECYGDASENLQHEEL

SEQ ID NO: 93302 - protein, 32 aa, Artificial Sequence
  Description of Artificial Sequence: Synthetic polypeptide
DEEEIRTTNPVATEQYGSVCAMNNNTDDAEND

SEQ ID NO: 93303 - protein, 34 aa, Artificial Sequence
  Description of Artificial Sequence: Synthetic polypeptide
AEEEIRTTNPVATEQYGSVSTVVNQQQQNTENNT

SEQ ID NO: 93304 - protein, 32 aa, Artificial Sequence
  Description of Artificial Sequence: Synthetic polypeptide
DEEEIRTTNPVATEQYGSVCAMANPLDTMPDN

SEQ ID NO: 93305 - protein, 33 aa, Artificial Sequence
  Description of Artificial Sequence: Synthetic polypeptide
DEEEIRTTNPVATEQYGSVCAGTDPATDDGNDD

SEQ ID NO: 93306 - protein, 32 aa, Artificial Sequence
  Description of Artificial Sequence: Synthetic polypeptide
DEEEIATTNPVAYEQYGSVCAPDNLQDDLGQM

SEQ ID NO: 93307 - protein, 28 aa, Artificial Sequence
  Description of Artificial Sequence: Synthetic peptide
QENEIATTNPVATECYGDVAETLQHGDL

SEQ ID NO: 93308 - protein, 28 aa, Artificial Sequence
  Description of Artificial Sequence: Synthetic peptide
QENEIATTNPVATECYGDVASCLQHGEL

SEQ ID NO: 93309 - protein, 35 aa, Artificial Sequence
  Description of Artificial Sequence: Synthetic polypeptide
DEEEIRTTNPVATEQYGSVCAATNTVDQDSDNARL

SEQ ID NO: 93310 - protein, 34 aa, Artificial Sequence
  Description of Artificial Sequence: Synthetic polypeptide
DEEEIRTTNPVATEQYGSVATTNNLEAGTEGTEM

SEQ ID NO: 93311 - protein, 33 aa, Artificial Sequence
  Description of Artificial Sequence: Synthetic polypeptide
DEEEIRTTNPVATEQYGSVCAATNEEGMNMPEG

SEQ ID NO: 93312 - protein, 29 aa, Artificial Sequence
  Description of Artificial Sequence: Synthetic peptide
QENEIATTNPVATECYGDVCSTCLQHEEL

SEQ ID NO: 93313 - protein, 32 aa, Artificial Sequence
  Description of Artificial Sequence: Synthetic polypeptide
DEEEIRTTNPVATEQYGSVCAATGEEPMMPNQ

SEQ ID NO: 93314 - protein, 33 aa, Artificial Sequence
  Description of Artificial Sequence: Synthetic polypeptide
DEEEIRTTNPVATEQYGSVCAATGDQDLPGGEN

SEQ ID NO: 93315 - protein, 34 aa, Artificial Sequence
  Description of Artificial Sequence: Synthetic polypeptide
DEEEIRTTNPVATEQYGSVCAANPLIEHDGNQMQ

SEQ ID NO: 93316 - protein, 33 aa, Artificial Sequence
  Description of Artificial Sequence: Synthetic polypeptide
DEEEIRTTNPVATEQYGSVCAANNPQEAENGDN

SEQ ID NO: 93317 - protein, 33 aa, Artificial Sequence
  Description of Artificial Sequence: Synthetic polypeptide
DEEEIRTTNPVATEQYGSVCAANNDQDSGMFDM

SEQ ID NO: 93318 - protein, 28 aa, Artificial Sequence
  Description of Artificial Sequence: Synthetic peptide
QENEIATTNPVATECYGDVSAALQHTEL

SEQ ID NO: 93319 - protein, 28 aa, Artificial Sequence
  Description of Artificial Sequence: Synthetic peptide
QENEIATTNPVATECYGDVSACLQHEEL

SEQ ID NO: 93320 - protein, 32 aa, Artificial Sequence
  Description of Artificial Sequence: Synthetic polypeptide
DEEEIRTTNPVATEQYGSVCAADPVTDDGGNH

SEQ ID NO: 93321 - protein, 32 aa, Artificial Sequence
  Description of Artificial Sequence: Synthetic polypeptide
DEEEIRTTNPVATEQYGSVCAADPPTDDGNDD

SEQ ID NO: 93322 - protein, 29 aa, Artificial Sequence
  Description of Artificial Sequence: Synthetic peptide
QENEIATTNPVATECYGDVCSEGLQHENL

SEQ ID NO: 93323 - protein, 28 aa, Artificial Sequence
  Description of Artificial Sequence: Synthetic peptide
QENEIATTNPVATECYGDVSECLQTEEL

SEQ ID NO: 93324 - protein, 33 aa, Artificial Sequence
  Description of Artificial Sequence: Synthetic polypeptide
DEEEIATTNPVAYEQYGSVCSVDNLQDDLDNQM

SEQ ID NO: 93325 - protein, 28 aa, Artificial Sequence
  Description of Artificial Sequence: Synthetic peptide
QENEIATTNPVATECYGDVSECLAHGEI

SEQ ID NO: 93326 - protein, 28 aa, Artificial Sequence
  Description of Artificial Sequence: Synthetic peptide
QENEIATTNPVATECYGDVSECLQHECL

SEQ ID NO: 93327 - protein, 35 aa, Artificial Sequence
  Description of Artificial Sequence: Synthetic polypeptide
DEEEIATTNPVAYEQYGVSVSANNDLLQRAGMGRP

SEQ ID NO: 93328 - protein, 28 aa, Artificial Sequence
  Description of Artificial Sequence: Synthetic peptide
QENEIATTNPVATECYGDVSECLQHEDL

SEQ ID NO: 93329 - protein, 34 aa, Artificial Sequence
  Description of Artificial Sequence: Synthetic polypeptide
DEEEIATTNPVAYEQYGVVVSTGNGGQDAGGNHR

SEQ ID NO: 93330 - protein, 28 aa, Artificial Sequence
  Description of Artificial Sequence: Synthetic peptide
QENEIATTNPVATECYGDVSECLQHEEA

SEQ ID NO: 93331 - protein, 28 aa, Artificial Sequence
  Description of Artificial Sequence: Synthetic peptide
QENEIATTNPVATECYGDVSECLQHEEC

SEQ ID NO: 93332 - protein, 28 aa, Artificial Sequence
  Description of Artificial Sequence: Synthetic peptide
QENEIATTNPVATECYGDVSECLQHEED

SEQ ID NO: 93333 - protein, 32 aa, Artificial Sequence
  Description of Artificial Sequence: Synthetic polypeptide
DEEEIATTNPVAYERDGSTVSLTGNLSQAVNS

SEQ ID NO: 93334 - protein, 28 aa, Artificial Sequence
  Description of Artificial Sequence: Synthetic peptide
QENEIATTNPVATECYGDVSECLQHEEE

SEQ ID NO: 93335 - protein, 28 aa, Artificial Sequence
  Description of Artificial Sequence: Synthetic peptide
QENEIATTNPVATECYGDVSECLQHEEF

SEQ ID NO: 93336 - protein, 28 aa, Artificial Sequence
  Description of Artificial Sequence: Synthetic peptide
QENEIATTNPVATECYGDVSECLQHEEG

SEQ ID NO: 93337 - protein, 28 aa, Artificial Sequence
  Description of Artificial Sequence: Synthetic peptide
QENEIATTNPVATECYGDVSECLQHEEH

SEQ ID NO: 93338 - protein, 28 aa, Artificial Sequence
  Description of Artificial Sequence: Synthetic peptide
QENEIATTNPVATECYGDVSECLQHEEI

SEQ ID NO: 93339 - protein, 29 aa, Artificial Sequence
  Description of Artificial Sequence: Synthetic peptide
QENEIATTNPVATECYGDVSECLQHEEIR

SEQ ID NO: 93340 - protein, 28 aa, Artificial Sequence
  Description of Artificial Sequence: Synthetic peptide
QENEIATTNPVATECYGDVSECLQHEEK

SEQ ID NO: 93341 - protein, 33 aa, Artificial Sequence
  Description of Artificial Sequence: Synthetic polypeptide
DEEEIATTNPVAYERYGSVSTGNGGQQQGDLDR

SEQ ID NO: 93342 - protein, 32 aa, Artificial Sequence
  Description of Artificial Sequence: Synthetic polypeptide
DEEEIATTNPVAYERYGSVVSLMGNLSQNVNS

SEQ ID NO: 93343 - protein, 33 aa, Artificial Sequence
  Description of Artificial Sequence: Synthetic polypeptide
DEEEIATTNPVAYERYGSVVSLTGNLSQAVNMD

SEQ ID NO: 93344 - protein, 33 aa, Artificial Sequence
  Description of Artificial Sequence: Synthetic polypeptide
DEEEIATTNPVAYERYGSVVSLTGNLSQMVQNS

SEQ ID NO: 93345 - protein, 32 aa, Artificial Sequence
  Description of Artificial Sequence: Synthetic polypeptide
DEEEIATTNPVAYERYGSVVSLTGNLSQWVDS

SEQ ID NO: 93346 - protein, 32 aa, Artificial Sequence
  Description of Artificial Sequence: Synthetic polypeptide
DEEEIATTNPVAYERYGSVVSWTGNLSQAVSS

SEQ ID NO: 93347 - protein, 28 aa, Artificial Sequence
  Description of Artificial Sequence: Synthetic peptide
QENEIATTNPVATECYGDVSECLQHEAL

SEQ ID NO: 93348 - protein, 28 aa, Artificial Sequence
  Description of Artificial Sequence: Synthetic peptide
QENEIATTNPVATECYGDVSECLQHDEL

SEQ ID NO: 93349 - protein, 28 aa, Artificial Sequence
  Description of Artificial Sequence: Synthetic peptide
QENEIATTNPVATECYGDVSECLQHCEL

SEQ ID NO: 93350 - protein, 33 aa, Artificial Sequence
  Description of Artificial Sequence: Synthetic polypeptide
DEEEIATTNPVAYEQYGTVVSGDNGNQNHGNER

SEQ ID NO: 93351 - protein, 29 aa, Artificial Sequence
  Description of Artificial Sequence: Synthetic peptide
QENEIATTNPVATECYGDVSECLGQREEL

SEQ ID NO: 93352 - protein, 34 aa, Artificial Sequence
  Description of Artificial Sequence: Synthetic polypeptide
DEEEIRTTNPVATEQYGSVATTAGPNMRNGMNPV

SEQ ID NO: 93353 - protein, 31 aa, Artificial Sequence
  Description of Artificial Sequence: Synthetic polypeptide
DEEEIATTNPVAYEQYGSVSAAGGQDQGGDY

SEQ ID NO: 93354 - protein, 34 aa, Artificial Sequence
  Description of Artificial Sequence: Synthetic polypeptide
DEEEIATTNPVAYEQYGSVSAGPLDQDRPGENQH

SEQ ID NO: 93355 - protein, 28 aa, Artificial Sequence
  Description of Artificial Sequence: Synthetic peptide
QENEIATTNPVATECYGDVSECLMHENL

SEQ ID NO: 93356 - protein, 28 aa, Artificial Sequence
  Description of Artificial Sequence: Synthetic peptide
QENEIATTNPVATECYGDVSECLMREEL

SEQ ID NO: 93357 - protein, 28 aa, Artificial Sequence
  Description of Artificial Sequence: Synthetic peptide
QENEIATTNPVATECYGDVSECLQAEEA

SEQ ID NO: 93358 - protein, 28 aa, Artificial Sequence
  Description of Artificial Sequence: Synthetic peptide
QENEIATTNPVATECYGDVSECLQAEEL

SEQ ID NO: 93359 - protein, 28 aa, Artificial Sequence
  Description of Artificial Sequence: Synthetic peptide
QENEIATTNPVATECYGDVSECLQCEEL

SEQ ID NO: 93360 - protein, 28 aa, Artificial Sequence
  Description of Artificial Sequence: Synthetic peptide
QENEIATTNPVATECYGDVSECLQCEFL

SEQ ID NO: 93361 - protein, 35 aa, Artificial Sequence
  Description of Artificial Sequence: Synthetic polypeptide
DEEEIRTTNPVATEQYGSVATTNLNQLQEGDEDED

SEQ ID NO: 93362 - protein, 28 aa, Artificial Sequence
  Description of Artificial Sequence: Synthetic peptide
QENEIATTNPVATECYGDVSECLQDEEL

SEQ ID NO: 93363 - protein, 28 aa, Artificial Sequence
  Description of Artificial Sequence: Synthetic peptide
QENEIATTNPVATECYGDVSECLQEEEL

SEQ ID NO: 93364 - protein, 28 aa, Artificial Sequence
  Description of Artificial Sequence: Synthetic peptide
QENEIATTNPVATECYGDVSECLQEESL

SEQ ID NO: 93365 - protein, 28 aa, Artificial Sequence
  Description of Artificial Sequence: Synthetic peptide
QENEIATTNPVATECYGDVSECLQFEEK

SEQ ID NO: 93366 - protein, 28 aa, Artificial Sequence
  Description of Artificial Sequence: Synthetic peptide
QENEIATTNPVATECYGDVSECLQFEEL

SEQ ID NO: 93367 - protein, 28 aa, Artificial Sequence
  Description of Artificial Sequence: Synthetic peptide
QENEIATTNPVATECYGDVSECLQFESL

SEQ ID NO: 93368 - protein, 34 aa, Artificial Sequence
  Description of Artificial Sequence: Synthetic polypeptide
DEEEIATTNPVAYEQYGSVTTDNSLFTVRGNEFN

SEQ ID NO: 93369 - protein, 28 aa, Artificial Sequence
  Description of Artificial Sequence: Synthetic peptide
QENEIATTNPVATECYGDVSECLQGEEL

SEQ ID NO: 93370 - protein, 28 aa, Artificial Sequence
  Description of Artificial Sequence: Synthetic peptide
QENEIATTNPVATECYGDVSECLQHAEL

SEQ ID NO: 93371 - protein, 33 aa, Artificial Sequence
  Description of Artificial Sequence: Synthetic polypeptide
DEEEIATTNPVAYEQYGTVSTTGNMGDLRGNAD

SEQ ID NO: 93372 - protein, 34 aa, Artificial Sequence
  Description of Artificial Sequence: Synthetic polypeptide
DEEEIATTNPVAYEQYGTVSWTELDNERNGMNTR

SEQ ID NO: 93373 - protein, 29 aa, Artificial Sequence
  Description of Artificial Sequence: Synthetic peptide
QENEIATTNPVATECYGDVSECLQDHERL

SEQ ID NO: 93374 - protein, 28 aa, Artificial Sequence
  Description of Artificial Sequence: Synthetic peptide
QENEIATTNPVATECYGCVSEPLQHMEL

SEQ ID NO: 93375 - protein, 34 aa, Artificial Sequence
  Description of Artificial Sequence: Synthetic polypeptide
DEEEICTTNPMAYEEYGSVHTNALSQHRPGGSNR

SEQ ID NO: 93376 - protein, 28 aa, Artificial Sequence
  Description of Artificial Sequence: Synthetic peptide
QENEIATTNPVATECYGDVSECLQVDEL

SEQ ID NO: 93377 - protein, 35 aa, Artificial Sequence
  Description of Artificial Sequence: Synthetic polypeptide
DEEEICTTNPVATEQYGEVSTGGPLQDHQGGNQGR

SEQ ID NO: 93378 - protein, 33 aa, Artificial Sequence
  Description of Artificial Sequence: Synthetic polypeptide
DEEEICTTNPVATEQYGEVSTGGQQDHGGGENE

SEQ ID NO: 93379 - protein, 34 aa, Artificial Sequence
  Description of Artificial Sequence: Synthetic polypeptide
DEEEICTTNPVATEQYGEVSTGNGQQDHGGGRRE

SEQ ID NO: 93380 - protein, 34 aa, Artificial Sequence
  Description of Artificial Sequence: Synthetic polypeptide
DEEEICTTNPVATEQYGEVSTGNTNGDQQGNGMT

SEQ ID NO: 93381 - protein, 33 aa, Artificial Sequence
  Description of Artificial Sequence: Synthetic polypeptide
DEEEIRTTNPVATEQYGSVAANGTDTRGETPDN

SEQ ID NO: 93382 - protein, 33 aa, Artificial Sequence
  Description of Artificial Sequence: Synthetic polypeptide
DEEEIRTTNPVATEQYGSVAAEVGNQVLGENET

SEQ ID NO: 93383 - protein, 35 aa, Artificial Sequence
  Description of Artificial Sequence: Synthetic polypeptide
AEEEIRTTNPVATEQYGSVSTVVNQQQGQETGNND

SEQ ID NO: 93384 - protein, 34 aa, Artificial Sequence
  Description of Artificial Sequence: Synthetic polypeptide
DEEEIRTTNPVATEQYGSTYMTENLSMYTIENNR

SEQ ID NO: 93385 - protein, 28 aa, Artificial Sequence
  Description of Artificial Sequence: Synthetic peptide
QENEIATTNPVATECYGEVSECLQHEEL

SEQ ID NO: 93386 - protein, 28 aa, Artificial Sequence
  Description of Artificial Sequence: Synthetic peptide
QENEIATTNPVATECYGEVSECLQHEES

SEQ ID NO: 93387 - protein, 35 aa, Artificial Sequence
  Description of Artificial Sequence: Synthetic polypeptide
DEEEIRTTNPVATEQYGSTVWQNAFSQNRPLGDNQ

SEQ ID NO: 93388 - protein, 28 aa, Artificial Sequence
  Description of Artificial Sequence: Synthetic peptide
QENEIATTNPVATECYGEVSECLQHEGL

SEQ ID NO: 93389 - protein, 35 aa, Artificial Sequence
  Description of Artificial Sequence: Synthetic polypeptide
DEEEIRTTNPVATEQYGSTVTSQNAFSGNRLGDNQ

SEQ ID NO: 93390 - protein, 28 aa, Artificial Sequence
  Description of Artificial Sequence: Synthetic peptide
QENEIATTNPVATECYGEVSEMLQHEEL

SEQ ID NO: 93391 - protein, 28 aa, Artificial Sequence
  Description of Artificial Sequence: Synthetic peptide
QENEIATTNPVATECYGFVSECLQHEEL

SEQ ID NO: 93392 - protein, 28 aa, Artificial Sequence
  Description of Artificial Sequence: Synthetic peptide
QENEIATTNPVATECYGFVSEFLQHEEL

SEQ ID NO: 93393 - protein, 28 aa, Artificial Sequence
  Description of Artificial Sequence: Synthetic peptide
QENEIATTNPVATECYGGVSECLQHEEL

SEQ ID NO: 93394 - protein, 28 aa, Artificial Sequence
  Description of Artificial Sequence: Synthetic peptide
QENEIATTNPVATECYGGVSECLQHETP

SEQ ID NO: 93395 - protein, 33 aa, Artificial Sequence
  Description of Artificial Sequence: Synthetic polypeptide
DEEEICTTNPVATEQYGSVSTGGNQGGHGDDTE

SEQ ID NO: 93396 - protein, 35 aa, Artificial Sequence
  Description of Artificial Sequence: Synthetic polypeptide
DEEEICTTNPVATEQYGTLIPSCTNEELSQQGGNR

SEQ ID NO: 93397 - protein, 33 aa, Artificial Sequence
  Description of Artificial Sequence: Synthetic polypeptide
DEEEICTTNPVATEQYGVVSTGGNQGGHGDNEH

SEQ ID NO: 93398 - protein, 34 aa, Artificial Sequence
  Description of Artificial Sequence: Synthetic polypeptide
DEEEICTTNPVATEQYGEVSTGGPLQDHQGGNMQ

SEQ ID NO: 93399 - protein, 35 aa, Artificial Sequence
  Description of Artificial Sequence: Synthetic polypeptide
DEEEICTTNPVATERYGQSVVSLTGNLSQAGGNSC

SEQ ID NO: 93400 - protein, 34 aa, Artificial Sequence
  Description of Artificial Sequence: Synthetic polypeptide
DEEEICTTNPVATEQYGEVSTGGPLQDHQGGNHD

SEQ ID NO: 93401 - protein, 34 aa, Artificial Sequence
  Description of Artificial Sequence: Synthetic polypeptide
DEEEICTTNPVATEQYGEVSTGGNPQDHQGGNTM

SEQ ID NO: 93402 - protein, 29 aa, Artificial Sequence
  Description of Artificial Sequence: Synthetic peptide
QENEIATTNPVATECYGDVSSECLQREEL

SEQ ID NO: 93403 - protein, 32 aa, Artificial Sequence
  Description of Artificial Sequence: Synthetic polypeptide
DEEEIRTTNPVATEQYGSVACVVNNDTERVIE

SEQ ID NO: 93404 - protein, 29 aa, Artificial Sequence
  Description of Artificial Sequence: Synthetic peptide
QENEIATTNPVATECYGDVSTCLQDHEEL

SEQ ID NO: 93405 - protein, 29 aa, Artificial Sequence
  Description of Artificial Sequence: Synthetic peptide
QENEIATTNPVATECYGDVSTCLQHEEEL

SEQ ID NO: 93406 - protein, 29 aa, Artificial Sequence
  Description of Artificial Sequence: Synthetic peptide
QENEIATTNPVATECYGDVSTCLQHNEEL

SEQ ID NO: 93407 - protein, 30 aa, Artificial Sequence
  Description of Artificial Sequence: Synthetic polypeptide
QENEIATTNPVATECYGDVSTCLQMHNGEL

SEQ ID NO: 93408 - protein, 36 aa, Artificial Sequence
  Description of Artificial Sequence: Synthetic polypeptide
DEEEIRTTNPVATEQYGSVACNTLNLQERESEQQGN

SEQ ID NO: 93409 - protein, 34 aa, Artificial Sequence
  Description of Artificial Sequence: Synthetic polypeptide
DEEEICTTNPVATEMWGSVSTPNGDRQGQGGNER

SEQ ID NO: 93410 - protein, 29 aa, Artificial Sequence
  Description of Artificial Sequence: Synthetic peptide
QENEIATTNPVATECYGDVSTECLQHEEL

SEQ ID NO: 93411 - protein, 28 aa, Artificial Sequence
  Description of Artificial Sequence: Synthetic peptide
QENEIATTNPVATECYGDVSVCLQHEEL

SEQ ID NO: 93412 - protein, 28 aa, Artificial Sequence
  Description of Artificial Sequence: Synthetic peptide
QENEIATTNPVATECYGDVSVCLQHEES

SEQ ID NO: 93413 - protein, 36 aa, Artificial Sequence
  Description of Artificial Sequence: Synthetic polypeptide
DEEEIRTTNPVATEQYGSVAATNPDGQNQRNGMNPV

SEQ ID NO: 93414 - protein, 34 aa, Artificial Sequence
  Description of Artificial Sequence: Synthetic polypeptide
DEEEICTTNPVATEQWGEVSTGGNLQDHQGGNEQ

SEQ ID NO: 93415 - protein, 28 aa, Artificial Sequence
  Description of Artificial Sequence: Synthetic peptide
QENEIATTNPVATECYGDVSWCLQHEEL

SEQ ID NO: 93416 - protein, 28 aa, Artificial Sequence
  Description of Artificial Sequence: Synthetic peptide
QENEIATTNPVATECYGDVSWCLQHIES

SEQ ID NO: 93417 - protein, 28 aa, Artificial Sequence
  Description of Artificial Sequence: Synthetic peptide
QENEIATTNPVATECYGDVSWELQHNEQ

SEQ ID NO: 93418 - protein, 32 aa, Artificial Sequence
  Description of Artificial Sequence: Synthetic polypeptide
DEEEICTTNPVATEQWGEVSTNDGNQGQGDAM

SEQ ID NO: 93419 - protein, 32 aa, Artificial Sequence
  Description of Artificial Sequence: Synthetic polypeptide
DEEEICTTNPVATEQYGCVCSTEEHQNNSNQS

SEQ ID NO: 93420 - protein, 28 aa, Artificial Sequence
  Description of Artificial Sequence: Synthetic peptide
QENEIATTNPVATECYGDVSYCLQHEEL

SEQ ID NO: 93421 - protein, 32 aa, Artificial Sequence
  Description of Artificial Sequence: Synthetic polypeptide
DEEEICTTNPVATEQYGEVSTGGDHGGDGRRE

SEQ ID NO: 93422 - protein, 34 aa, Artificial Sequence
  Description of Artificial Sequence: Synthetic polypeptide
DEEEICTTNPVATEQYGEVSTGGLPQDHQGGNMG

SEQ ID NO: 93423 - protein, 33 aa, Artificial Sequence
  Description of Artificial Sequence: Synthetic polypeptide
DEEEIRTTNPVATEQYGSVAATGIDDQPNNNTP

SEQ ID NO: 93424 - protein, 35 aa, Artificial Sequence
  Description of Artificial Sequence: Synthetic polypeptide
DEEEICTTNPVATERYGQSVVSLTGNLSQSPGGNS

SEQ ID NO: 93425 - protein, 35 aa, Artificial Sequence
  Description of Artificial Sequence: Synthetic polypeptide
DEEEICTTNPVATERYGQSVVSLTGNLSQYAGGNE

SEQ ID NO: 93426 - protein, 34 aa, Artificial Sequence
  Description of Artificial Sequence: Synthetic polypeptide
DEEEICTTNPVATERYGQSVVSLTGTLSQEGGNS

SEQ ID NO: 93427 - protein, 28 aa, Artificial Sequence
  Description of Artificial Sequence: Synthetic peptide
QENEIATTNPVATECYGRVSECLQHEEL

SEQ ID NO: 93428 - protein, 28 aa, Artificial Sequence
  Description of Artificial Sequence: Synthetic peptide
QENEIATTNPVATECYGSVIECLQHEEL

SEQ ID NO: 93429 - protein, 33 aa, Artificial Sequence
  Description of Artificial Sequence: Synthetic polypeptide
DEEEICTTNPVAYEQWGEVSTNDGNQGQAGNDR

SEQ ID NO: 93430 - protein, 32 aa, Artificial Sequence
  Description of Artificial Sequence: Synthetic polypeptide
DEEEICTTNPVAYEQWGEVSTNLNGEGDGNTG

SEQ ID NO: 93431 - protein, 28 aa, Artificial Sequence
  Description of Artificial Sequence: Synthetic peptide
QENEIATTNPVATECYGSVSECGQHEEL

SEQ ID NO: 93432 - protein, 32 aa, Artificial Sequence
  Description of Artificial Sequence: Synthetic polypeptide
DEEEICTTNPVAYEQWGSVATNLQGNMGGDGD

SEQ ID NO: 93433 - protein, 35 aa, Artificial Sequence
  Description of Artificial Sequence: Synthetic polypeptide
DEEEIRTTNPVATEQYGSTVPSYTVSSGRGGNMTI

SEQ ID NO: 93434 - protein, 29 aa, Artificial Sequence
  Description of Artificial Sequence: Synthetic peptide
QENEIATTNPVATECYGSVSECLQHEEEL

SEQ ID NO: 93435 - protein, 29 aa, Artificial Sequence
  Description of Artificial Sequence: Synthetic peptide
QENEIATTNPVATECYGSVSECLQHEMEL

SEQ ID NO: 93436 - protein, 29 aa, Artificial Sequence
  Description of Artificial Sequence: Synthetic peptide
QENEIATTNPVATECYGSVSECLQMHEEL

SEQ ID NO: 93437 - protein, 33 aa, Artificial Sequence
  Description of Artificial Sequence: Synthetic polypeptide
DEEEICTTNPVAYEQWGSVSTNLQGNEGGDMGD

SEQ ID NO: 93438 - protein, 33 aa, Artificial Sequence
  Description of Artificial Sequence: Synthetic polypeptide
DEEEICTTNPVAYEQWGSVSTNPNDQPDGMNAN

SEQ ID NO: 93439 - protein, 34 aa, Artificial Sequence
  Description of Artificial Sequence: Synthetic polypeptide
DEEEICTTNPVAYEQWGSVSTTGNLQGETGNGEE

SEQ ID NO: 93440 - protein, 34 aa, Artificial Sequence
  Description of Artificial Sequence: Synthetic polypeptide
DEEEICTTNPVAYEQWGSVSTTGNLQGETGNNEA

SEQ ID NO: 93441 - protein, 32 aa, Artificial Sequence
  Description of Artificial Sequence: Synthetic polypeptide
DEEEICTTNPVAYEQWGSVTTNLQGNSGGDDD

SEQ ID NO: 93442 - protein, 33 aa, Artificial Sequence
  Description of Artificial Sequence: Synthetic polypeptide
DEEEICTTNPVAYEQWGTVSTNNQLQPPDGNAN

SEQ ID NO: 93443 - protein, 36 aa, Artificial Sequence
  Description of Artificial Sequence: Synthetic polypeptide
DEEEIRTTNPVATEQYGSTVPSCTNSSGERGQNMEW

SEQ ID NO: 93444 - protein, 31 aa, Artificial Sequence
  Description of Artificial Sequence: Synthetic polypeptide
DEEEICTTNPVAYEQWGVVSTTNDEHEGNQV

SEQ ID NO: 93445 - protein, 29 aa, Artificial Sequence
  Description of Artificial Sequence: Synthetic peptide
QENEIATTNPVATECYGSVSTCLEHEEEL

SEQ ID NO: 93446 - protein, 30 aa, Artificial Sequence
  Description of Artificial Sequence: Synthetic polypeptide
QENEIATTNPVATECYGSVSTECLQHEMEL

SEQ ID NO: 93447 - protein, 33 aa, Artificial Sequence
  Description of Artificial Sequence: Synthetic polypeptide
DEEEIRTTNPVATEQYGSTVETGLEMPGVEGDI

SEQ ID NO: 93448 - protein, 28 aa, Artificial Sequence
  Description of Artificial Sequence: Synthetic peptide
QENEIATTNPVATECYGQVSNALQHEEL

SEQ ID NO: 93449 - protein, 28 aa, Artificial Sequence
  Description of Artificial Sequence: Synthetic peptide
QENEIATTNPVATECYGQVSEPLQHEEM

SEQ ID NO: 93450 - protein, 28 aa, Artificial Sequence
  Description of Artificial Sequence: Synthetic peptide
QENEIATTNPVATECYGQVSEFLQHEEM

SEQ ID NO: 93451 - protein, 28 aa, Artificial Sequence
  Description of Artificial Sequence: Synthetic peptide
QENEIATTNPVATECYGQVSECLQHEQD

SEQ ID NO: 93452 - protein, 35 aa, Artificial Sequence
  Description of Artificial Sequence: Synthetic polypeptide
DEEEICTTNPVATERYGQSVVSQTGNLSQAGGNFS

SEQ ID NO: 93453 - protein, 34 aa, Artificial Sequence
  Description of Artificial Sequence: Synthetic polypeptide
DEEEICTTNPVATERYGSVVSLTGNSSQAGGNQS

SEQ ID NO: 93454 - protein, 34 aa, Artificial Sequence
  Description of Artificial Sequence: Synthetic polypeptide
DEEEICTTNPVATERYGTVVSLTGNLSQAGGNYS

SEQ ID NO: 93455 - protein, 28 aa, Artificial Sequence
  Description of Artificial Sequence: Synthetic peptide
QENEIATTNPVATECYGGVSEFLQTTEH

SEQ ID NO: 93456 - protein, 28 aa, Artificial Sequence
  Description of Artificial Sequence: Synthetic peptide
QENEIATTNPVATECYGGVSMDLQHTEM

SEQ ID NO: 93457 - protein, 28 aa, Artificial Sequence
  Description of Artificial Sequence: Synthetic peptide
QENEIATTNPVATECYGHVSECLQHEEL

SEQ ID NO: 93458 - protein, 33 aa, Artificial Sequence
  Description of Artificial Sequence: Synthetic polypeptide
DEEEICTTNPVATESYGSVSTGGNTGADGGGMR

SEQ ID NO: 93459 - protein, 33 aa, Artificial Sequence
  Description of Artificial Sequence: Synthetic polypeptide
DEEEICTTNPVATESYGSVSTGNNDTGGDGGRR

SEQ ID NO: 93460 - protein, 34 aa, Artificial Sequence
  Description of Artificial Sequence: Synthetic polypeptide
DEEEIRTTNPVATEQYGSTVSTGNAFGESTGGMH

SEQ ID NO: 93461 - protein, 28 aa, Artificial Sequence
  Description of Artificial Sequence: Synthetic peptide
QENEIATTNPVATECYGHVSEVLQHEEL

SEQ ID NO: 93462 - protein, 28 aa, Artificial Sequence
  Description of Artificial Sequence: Synthetic peptide
QENEIATTNPVATECYGDVSSCLQHEEL

SEQ ID NO: 93463 - protein, 28 aa, Artificial Sequence
  Description of Artificial Sequence: Synthetic peptide
QENEIATTNPVATECYGIVSCCLQHEEL

SEQ ID NO: 93464 - protein, 36 aa, Artificial Sequence
  Description of Artificial Sequence: Synthetic polypeptide
DEEEIRTTNPVATEQYGSTVSQNAFSQTRPLGDNQY

SEQ ID NO: 93465 - protein, 28 aa, Artificial Sequence
  Description of Artificial Sequence: Synthetic peptide
QENEIATTNPVATECYGKVSECLQHEEL

SEQ ID NO: 93466 - protein, 34 aa, Artificial Sequence
  Description of Artificial Sequence: Synthetic polypeptide
DEEEICTTNPVATEYYGEVSTTNGLGQENGNNDG

SEQ ID NO: 93467 - protein, 35 aa, Artificial Sequence
  Description of Artificial Sequence: Synthetic polypeptide
DEEEICTTNPVATEYYGSVSTGNNLGQENGNNGGK

SEQ ID NO: 93468 - protein, 34 aa, Artificial Sequence
  Description of Artificial Sequence: Synthetic polypeptide
DEEEICTTNPVATEYYGVVSTTNGLGQENGNNGN

SEQ ID NO: 93469 - protein, 28 aa, Artificial Sequence
  Description of Artificial Sequence: Synthetic peptide
QENEIATTNPVATECYGLVSECLQHEEL

SEQ ID NO: 93470 - protein, 28 aa, Artificial Sequence
  Description of Artificial Sequence: Synthetic peptide
QENEIATTNPVATECYGMVSECLQHEEL

SEQ ID NO: 93471 - protein, 28 aa, Artificial Sequence
  Description of Artificial Sequence: Synthetic peptide
QENEIATTNPVATECYGNVSECLQHEEL

SEQ ID NO: 93472 - protein, 29 aa, Artificial Sequence
  Description of Artificial Sequence: Synthetic peptide
QENEIATTNPVATECYGNVSECLQSREEL

SEQ ID NO: 93473 - protein, 28 aa, Artificial Sequence
  Description of Artificial Sequence: Synthetic peptide
QENEIATTNPVATECYGQVSECLQHEEL

SEQ ID NO: 93474 - protein, 28 aa, Artificial Sequence
  Description of Artificial Sequence: Synthetic peptide
QENEIATTNPVATECYGIVSECLQHEEL

SEQ ID NO: 93475 - protein, 29 aa, Artificial Sequence
  Description of Artificial Sequence: Synthetic peptide
QENEIATTNPVATECYGDVSRECLQHENL

SEQ ID NO: 93476 - protein, 28 aa, Artificial Sequence
  Description of Artificial Sequence: Synthetic peptide
QENEIATTNPVATECYGDVSRCLQHEEL

SEQ ID NO: 93477 - protein, 33 aa, Artificial Sequence
  Description of Artificial Sequence: Synthetic polypeptide
DEEEICTTNPVATECYGVVSTGNGPQGGHGNND

SEQ ID NO: 93478 - protein, 33 aa, Artificial Sequence
  Description of Artificial Sequence: Synthetic polypeptide
DEEEIRTTNPVATEQYGSVAQMGLQQTNVELEL

SEQ ID NO: 93479 - protein, 33 aa, Artificial Sequence
  Description of Artificial Sequence: Synthetic polypeptide
DEEEIRTTNPVATEQYGSVAQMGLQQTGVELSI

SEQ ID NO: 93480 - protein, 34 aa, Artificial Sequence
  Description of Artificial Sequence: Synthetic polypeptide
DEEEICTTNPVATECYGSVSTGGLNQGGHGNGEQ

SEQ ID NO: 93481 - protein, 28 aa, Artificial Sequence
  Description of Artificial Sequence: Synthetic peptide
QENEIATTNPVATECYGDVSEKLQHEFL

SEQ ID NO: 93482 - protein, 28 aa, Artificial Sequence
  Description of Artificial Sequence: Synthetic peptide
QENEIATTNPVATECYGDVSEKLQHETL

SEQ ID NO: 93483 - protein, 28 aa, Artificial Sequence
  Description of Artificial Sequence: Synthetic peptide
QENEIATTNPVATECYGDVSELLQHEEL

SEQ ID NO: 93484 - protein, 33 aa, Artificial Sequence
  Description of Artificial Sequence: Synthetic polypeptide
DEEEICTTNPVATECYGSVSTGGNQGGHGDNES

SEQ ID NO: 93485 - protein, 28 aa, Artificial Sequence
  Description of Artificial Sequence: Synthetic peptide
QENEIATTNPVATECYGDVSEMLQGEEL

SEQ ID NO: 93486 - protein, 32 aa, Artificial Sequence
  Description of Artificial Sequence: Synthetic polypeptide
DEEEICTTNPVATECYGSVSTGGNTGADGGMM

SEQ ID NO: 93487 - protein, 34 aa, Artificial Sequence
  Description of Artificial Sequence: Synthetic polypeptide
DEEEICTTNPVATECYGSVSTGNAGNQGGGPNND

SEQ ID NO: 93488 - protein, 28 aa, Artificial Sequence
  Description of Artificial Sequence: Synthetic peptide
QENEIATTNPVATECYGDVSEMLQHEEL

SEQ ID NO: 93489 - protein, 28 aa, Artificial Sequence
  Description of Artificial Sequence: Synthetic peptide
QENEIATTNPVATECYGDVSEMLQHEQL

SEQ ID NO: 93490 - protein, 34 aa, Artificial Sequence
  Description of Artificial Sequence: Synthetic polypeptide
DEEEIRTTNPVATEQYGSVAPMNLQQATTPEENP

SEQ ID NO: 93491 - protein, 31 aa, Artificial Sequence
  Description of Artificial Sequence: Synthetic polypeptide
DEEEIRTTNPVATEQYGSVAPMNIVEDDDVE

SEQ ID NO: 93492 - protein, 28 aa, Artificial Sequence
  Description of Artificial Sequence: Synthetic peptide
QENEIATTNPVATECYGDVSEMLQHEYL

SEQ ID NO: 93493 - protein, 28 aa, Artificial Sequence
  Description of Artificial Sequence: Synthetic peptide
QENEIATTNPVATECYGDVSENEQHEEL

SEQ ID NO: 93494 - protein, 34 aa, Artificial Sequence
  Description of Artificial Sequence: Synthetic polypeptide
DEEEICTTNPVATECYGSVSTGNEGNQGGGGNNT

SEQ ID NO: 93495 - protein, 34 aa, Artificial Sequence
  Description of Artificial Sequence: Synthetic polypeptide
DEEEICTTNPVATECYGSVSTGNEGNQGGHQNND

SEQ ID NO: 93496 - protein, 34 aa, Artificial Sequence
  Description of Artificial Sequence: Synthetic polypeptide
AEEEIRTTNPVATEQYGSVSTVVNQQQQEGEDED

SEQ ID NO: 93497 - protein, 34 aa, Artificial Sequence
  Description of Artificial Sequence: Synthetic polypeptide
DEEEICTTNPVATECYGSVSTGNGAQGGHGNNED

SEQ ID NO: 93498 - protein, 33 aa, Artificial Sequence
  Description of Artificial Sequence: Synthetic polypeptide
DEEEIRTTNPVATEQYGSVANPNDPAEGNPEHN

SEQ ID NO: 93499 - protein, 28 aa, Artificial Sequence
  Description of Artificial Sequence: Synthetic peptide
QENEIATTNPVATECYGDVSEKLQHEEV

SEQ ID NO: 93500 - protein, 28 aa, Artificial Sequence
  Description of Artificial Sequence: Synthetic peptide
QENEIATTNPVATECYGDVSEKLQHEEL

SEQ ID NO: 93501 - protein, 34 aa, Artificial Sequence
  Description of Artificial Sequence: Synthetic polypeptide
DEEEICTTNPVATECYGSVSTGGLNQGGHGDNEM

SEQ ID NO: 93502 - protein, 28 aa, Artificial Sequence
  Description of Artificial Sequence: Synthetic peptide
QENEIATTNPVATECYGDVSEILQHEEL

SEQ ID NO: 93503 - protein, 34 aa, Artificial Sequence
  Description of Artificial Sequence: Synthetic polypeptide
DEEEICTTNPMAYEQWGSVPTNLSQHRTGGNNRP

SEQ ID NO: 93504 - protein, 28 aa, Artificial Sequence
  Description of Artificial Sequence: Synthetic peptide
QENEIATTNPVATECYGDVSECLQWEEL

SEQ ID NO: 93505 - protein, 28 aa, Artificial Sequence
  Description of Artificial Sequence: Synthetic peptide
QENEIATTNPVATECYGDVSECLQYEEL

SEQ ID NO: 93506 - protein, 36 aa, Artificial Sequence
  Description of Artificial Sequence: Synthetic polypeptide
DEEEIRTTNPVATEQYGSVASPTPALPNMRNGMNPV

SEQ ID NO: 93507 - protein, 29 aa, Artificial Sequence
  Description of Artificial Sequence: Synthetic peptide
QENEIATTNPVATECYGDVSECNLQHEEL

SEQ ID NO: 93508 - protein, 33 aa, Artificial Sequence
  Description of Artificial Sequence: Synthetic polypeptide
DEEEICTTNPVATECWGSVSTGNGQGGHGGNND

SEQ ID NO: 93509 - protein, 35 aa, Artificial Sequence
  Description of Artificial Sequence: Synthetic polypeptide
DEEEIRTTNPVATEQYGSVASPIGNLIQIDVDMRQ

SEQ ID NO: 93510 - protein, 31 aa, Artificial Sequence
  Description of Artificial Sequence: Synthetic polypeptide
DEEEICTTNPVATECYGEVSTGGDHGGGERE

SEQ ID NO: 93511 - protein, 28 aa, Artificial Sequence
  Description of Artificial Sequence: Synthetic peptide
QENEIATTNPVATECYGDVSEDLQHEEL

SEQ ID NO: 93512 - protein, 34 aa, Artificial Sequence
  Description of Artificial Sequence: Synthetic polypeptide
DEEEICTTNPVATECYGNVSTGNLDDRQNGNNDT

SEQ ID NO: 93513 - protein, 34 aa, Artificial Sequence
  Description of Artificial Sequence: Synthetic polypeptide
DEEEICTTNPVATECYGSVSTGNGAQGGHGNNNS

SEQ ID NO: 93514 - protein, 29 aa, Artificial Sequence
  Description of Artificial Sequence: Synthetic peptide
QENEIATTNPVATECYGDVSEDLQHEGEL

SEQ ID NO: 93515 - protein, 28 aa, Artificial Sequence
  Description of Artificial Sequence: Synthetic peptide
QENEIATTNPVATECYGDVSEDLQTEEL

SEQ ID NO: 93516 - protein, 28 aa, Artificial Sequence
  Description of Artificial Sequence: Synthetic peptide
QENEIATTNPVATECYGDVSEELQHEEL

SEQ ID NO: 93517 - protein, 28 aa, Artificial Sequence
  Description of Artificial Sequence: Synthetic peptide
QENEIATTNPVATECYGDVSEFLQHEEL

SEQ ID NO: 93518 - protein, 28 aa, Artificial Sequence
  Description of Artificial Sequence: Synthetic peptide
QENEIATTNPVATECYGDVSEGLQHEEL

SEQ ID NO: 93519 - protein, 34 aa, Artificial Sequence
  Description of Artificial Sequence: Synthetic polypeptide
DEEEICTTNPVATECYGSVSTDQGGGQNRGGNEN

SEQ ID NO: 93520 - protein, 34 aa, Artificial Sequence
  Description of Artificial Sequence: Synthetic polypeptide
DEEEICTTNPVATECYGSVSTGEGGGQNRGGNEE

SEQ ID NO: 93521 - protein, 28 aa, Artificial Sequence
  Description of Artificial Sequence: Synthetic peptide
QENEIATTNPVATECYGDVSEHLQHEEL

SEQ ID NO: 93522 - protein, 28 aa, Artificial Sequence
  Description of Artificial Sequence: Synthetic peptide
QENEIATTNPVATECYGDVSEHLQHEEP

SEQ ID NO: 93523 - protein, 33 aa, Artificial Sequence
  Description of Artificial Sequence: Synthetic polypeptide
DEEEIRTTNPVATEQYGSVAQPLLQQTGVELAG

SEQ ID NO: 93524 - protein, 28 aa, Artificial Sequence
  Description of Artificial Sequence: Synthetic peptide
QENEIATTNPVATECYGDVSEILQHDEL

SEQ ID NO: 93525 - protein, 28 aa, Artificial Sequence
  Description of Artificial Sequence: Synthetic peptide
QENEIATTNPVATECYGDVSEDLQHESL

SEQ ID NO: 93526 - protein, 34 aa, Artificial Sequence
  Description of Artificial Sequence: Synthetic polypeptide
DEEEICTTNPMAYEEYGSVPTNELSQPRTGGSNR

SEQ ID NO: 93527 - protein, 34 aa, Artificial Sequence
  Description of Artificial Sequence: Synthetic polypeptide
DEEEICTTNPVATECYGSVSTGNGESQGGGQNQD

SEQ ID NO: 93528 - protein, 34 aa, Artificial Sequence
  Description of Artificial Sequence: Synthetic polypeptide
DEEEICTTNPVATECYGSVSTGNGLGDAGGGNTY

SEQ ID NO: 93529 - protein, 28 aa, Artificial Sequence
  Description of Artificial Sequence: Synthetic peptide
QENEIATTNPVATECYGDVSGCLQHEEL

SEQ ID NO: 93530 - protein, 29 aa, Artificial Sequence
  Description of Artificial Sequence: Synthetic peptide
QENEIATTNPVATECYGDVSGECLQHENL

SEQ ID NO: 93531 - protein, 28 aa, Artificial Sequence
  Description of Artificial Sequence: Synthetic peptide
QENEIATTNPVATECYGDVSHCLQHEEL

SEQ ID NO: 93532 - protein, 28 aa, Artificial Sequence
  Description of Artificial Sequence: Synthetic peptide
QENEIATTNPVATECYGDVSHCLQHEGL

SEQ ID NO: 93533 - protein, 28 aa, Artificial Sequence
  Description of Artificial Sequence: Synthetic peptide
QENEIATTNPVATECYGDVSHSLQHEEL

SEQ ID NO: 93534 - protein, 28 aa, Artificial Sequence
  Description of Artificial Sequence: Synthetic peptide
QENEIATTNPVATECYGDVSICLQHEEL

SEQ ID NO: 93535 - protein, 28 aa, Artificial Sequence
  Description of Artificial Sequence: Synthetic peptide
QENEIATTNPVATECYGDVSICLQKEEL

SEQ ID NO: 93536 - protein, 28 aa, Artificial Sequence
  Description of Artificial Sequence: Synthetic peptide
QENEIATTNPVATECYGDVSICLQTEEL

SEQ ID NO: 93537 - protein, 28 aa, Artificial Sequence
  Description of Artificial Sequence: Synthetic peptide
QENEIATTNPVATECYGDVSKALQHEEL

SEQ ID NO: 93538 - protein, 28 aa, Artificial Sequence
  Description of Artificial Sequence: Synthetic peptide
QENEIATTNPVATECYGDVSKCLQHEEL

SEQ ID NO: 93539 - protein, 28 aa, Artificial Sequence
  Description of Artificial Sequence: Synthetic peptide
QENEIATTNPVATECYGDVSLCLQHEEL

SEQ ID NO: 93540 - protein, 28 aa, Artificial Sequence
  Description of Artificial Sequence: Synthetic peptide
QENEIATTNPVATECYGDVSLTLQHEEL

SEQ ID NO: 93541 - protein, 28 aa, Artificial Sequence
  Description of Artificial Sequence: Synthetic peptide
QENEIATTNPVATECYGDVSMCLQHEEL

SEQ ID NO: 93542 - protein, 28 aa, Artificial Sequence
  Description of Artificial Sequence: Synthetic peptide
QENEIATTNPVATECYGDVSMCLQHYEL

SEQ ID NO: 93543 - protein, 33 aa, Artificial Sequence
  Description of Artificial Sequence: Synthetic polypeptide
DEEEICTTNPVATECYGSVTTGNGQGGHQNGND

SEQ ID NO: 93544 - protein, 29 aa, Artificial Sequence
  Description of Artificial Sequence: Synthetic peptide
QENEIATTNPVATECYGDVSMCLQQHGEH

SEQ ID NO: 93545 - protein, 28 aa, Artificial Sequence
  Description of Artificial Sequence: Synthetic peptide
QENEIATTNPVATECYGDVSNCLQHEEL

SEQ ID NO: 93546 - protein, 28 aa, Artificial Sequence
  Description of Artificial Sequence: Synthetic peptide
QENEIATTNPVATECYGDVSNWLQHEEL

SEQ ID NO: 93547 - protein, 28 aa, Artificial Sequence
  Description of Artificial Sequence: Synthetic peptide
QENEIATTNPVATECYGDVSPCLQHEEL

SEQ ID NO: 93548 - protein, 28 aa, Artificial Sequence
  Description of Artificial Sequence: Synthetic peptide
QENEIATTNPVATECYGDVSPGLQHEEL

SEQ ID NO: 93549 - protein, 28 aa, Artificial Sequence
  Description of Artificial Sequence: Synthetic peptide
QENEIATTNPVATECYGDVSQCLQHEEL

SEQ ID NO: 93550 - protein, 34 aa, Artificial Sequence
  Description of Artificial Sequence: Synthetic polypeptide
DEEEIRTTNPVATEQYGSVAGDDQNEGQGNGNGN

SEQ ID NO: 93551 - protein, 34 aa, Artificial Sequence
  Description of Artificial Sequence: Synthetic polypeptide
DEEEICTTNPVATECYGSVSTGNTGNQGGGNEND

SEQ ID NO: 93552 - protein, 28 aa, Artificial Sequence
  Description of Artificial Sequence: Synthetic peptide
QENEIATTNPVATECYGDVSFCLQHEEL

SEQ ID NO: 93553 - protein, 34 aa, Artificial Sequence
  Description of Artificial Sequence: Synthetic polypeptide
DEEEICTTNPVATECYGSVSTGNQGNQGGTGNND

SEQ ID NO: 93554 - protein, 35 aa, Artificial Sequence
  Description of Artificial Sequence: Synthetic polypeptide
DEEEICTTNPVATECYGSVSTGNGLLQDAGGGNTH

SEQ ID NO: 93555 - protein, 35 aa, Artificial Sequence
  Description of Artificial Sequence: Synthetic polypeptide
DEEEICTTNPVATECYGSVSTGNGLPQDANGGNTY

SEQ ID NO: 93556 - protein, 34 aa, Artificial Sequence
  Description of Artificial Sequence: Synthetic polypeptide
DEEEICTTNPVATECYGSVSTGNGNQGGHGGGNS

SEQ ID NO: 93557 - protein, 34 aa, Artificial Sequence
  Description of Artificial Sequence: Synthetic polypeptide
DEEEICTTNPVATECYGSVSTGNGNQGGHGGNAD

SEQ ID NO: 93558 - protein, 34 aa, Artificial Sequence
  Description of Artificial Sequence: Synthetic polypeptide
DEEEICTTNPVATECYGSVSTGNGNQGGHGNDND

SEQ ID NO: 93559 - protein, 34 aa, Artificial Sequence
  Description of Artificial Sequence: Synthetic polypeptide
DEEEICTTNPVATECYGSVSTGNGPQGGHGQGND

SEQ ID NO: 93560 - protein, 33 aa, Artificial Sequence
  Description of Artificial Sequence: Synthetic polypeptide
DEEEICTTNPVATECYGSVSTGNGQGGHGGDSD

SEQ ID NO: 93561 - protein, 34 aa, Artificial Sequence
  Description of Artificial Sequence: Synthetic polypeptide
DEEEICTTNPVATECYGSVSTGNGQGGHGGGGND

SEQ ID NO: 93562 - protein, 34 aa, Artificial Sequence
  Description of Artificial Sequence: Synthetic polypeptide
DEEEICTTNPVATECYGSVSTGNGVQGGHGNGNY

SEQ ID NO: 93563 - protein, 28 aa, Artificial Sequence
  Description of Artificial Sequence: Synthetic peptide
QENEIATTNPVATECYGDVSEPLQHEEL

SEQ ID NO: 93564 - protein, 34 aa, Artificial Sequence
  Description of Artificial Sequence: Synthetic polypeptide
AEEEIRTTNPVATEQYGSVSTVVNQQQNQQTNNA

SEQ ID NO: 93565 - protein, 34 aa, Artificial Sequence
  Description of Artificial Sequence: Synthetic polypeptide
DEEEICTTNPVATECYGSVSTGNNGQDHQGGNTS

SEQ ID NO: 93566 - protein, 28 aa, Artificial Sequence
  Description of Artificial Sequence: Synthetic peptide
QENEIATTNPVATECYGDVSEQLQHEEL

SEQ ID NO: 93567 - protein, 34 aa, Artificial Sequence
  Description of Artificial Sequence: Synthetic polypeptide
DEEEICTTNPVATECYGSVSTGNPPQGGTGQNQD

SEQ ID NO: 93568 - protein, 28 aa, Artificial Sequence
  Description of Artificial Sequence: Synthetic peptide
QENEIATTNPVATECYGDVSERLQHEEL

SEQ ID NO: 93569 - protein, 34 aa, Artificial Sequence
  Description of Artificial Sequence: Synthetic polypeptide
DEEEICTTNPVATECYGSVSTGNQGNQGGDGNTD

SEQ ID NO: 93570 - protein, 28 aa, Artificial Sequence
  Description of Artificial Sequence: Synthetic peptide
QENEIATTNPVATECYGDVSESLQHEEL

SEQ ID NO: 93571 - protein, 28 aa, Artificial Sequence
  Description of Artificial Sequence: Synthetic peptide
QENEIATTNPVATECYGDVSETLQHEEL

SEQ ID NO: 93572 - protein, 29 aa, Artificial Sequence
  Description of Artificial Sequence: Synthetic peptide
QENEIATTNPVATECYGDVSETLQHENEL

SEQ ID NO: 93573 - protein, 28 aa, Artificial Sequence
  Description of Artificial Sequence: Synthetic peptide
QENEIATTNPVATECYGDVSEVLQHEEL

SEQ ID NO: 93574 - protein, 28 aa, Artificial Sequence
  Description of Artificial Sequence: Synthetic peptide
QENEIATTNPVATECYGDVSEWLQHEEL

SEQ ID NO: 93575 - protein, 28 aa, Artificial Sequence
  Description of Artificial Sequence: Synthetic peptide
QENEIATTNPVATECYGDVSEYLQHEEL

SEQ ID NO: 93576 - protein, 28 aa, Artificial Sequence
  Description of Artificial Sequence: Synthetic peptide
QENEIATTNPVATECYGDVSEQLQEEEL

SEQ ID NO: 93577 - protein, 28 aa, Artificial Sequence
  Description of Artificial Sequence: Synthetic peptide
QENEIATTNPVATECYGCVSEELQHPEL

SEQ ID NO: 93578 - protein, 28 aa, Artificial Sequence
  Description of Artificial Sequence: Synthetic peptide
QENEIATTNPVATECYGCVSECLQHMSE

SEQ ID NO: 93579 - protein, 28 aa, Artificial Sequence
  Description of Artificial Sequence: Synthetic peptide
QENEIATTNPVATECYGCVSECLQHEQL

SEQ ID NO: 93580 - protein, 31 aa, Artificial Sequence
  Description of Artificial Sequence: Synthetic polypeptide
QEGEIATTNPVATEQYGIVSATNLEDHEGTL

SEQ ID NO: 93581 - protein, 32 aa, Artificial Sequence
  Description of Artificial Sequence: Synthetic polypeptide
DEEEIATTNPVAYEQWGSITSAAGNLQQGQRQ

SEQ ID NO: 93582 - protein, 34 aa, Artificial Sequence
  Description of Artificial Sequence: Synthetic polypeptide
DEEEIATTNPVAYEQWGSTSPTENNDSQRDGNNR

SEQ ID NO: 93583 - protein, 35 aa, Artificial Sequence
  Description of Artificial Sequence: Synthetic polypeptide
AEEEIRTTNPVATEQYGSVSTVVTNQQEGTNDEQM

SEQ ID NO: 93584 - protein, 28 aa, Artificial Sequence
  Description of Artificial Sequence: Synthetic peptide
QEGEIATTNPVATEWYGHVSEELQHMEK

SEQ ID NO: 93585 - protein, 34 aa, Artificial Sequence
  Description of Artificial Sequence: Synthetic polypeptide
DEEEIATTNPVAYEQWGSVAKTNDLQEQRGGANK

SEQ ID NO: 93586 - protein, 28 aa, Artificial Sequence
  Description of Artificial Sequence: Synthetic peptide
QEGEIATTNPVSSECYGIVSENLQHETR

SEQ ID NO: 93587 - protein, 28 aa, Artificial Sequence
  Description of Artificial Sequence: Synthetic peptide
QEGEIATTNPVSSEQYGIVPCNLQSGEK

SEQ ID NO: 93588 - protein, 29 aa, Artificial Sequence
  Description of Artificial Sequence: Synthetic peptide
QEGEIATTNPVSSEQYGTVSACGLQSGTR

SEQ ID NO: 93589 - protein, 28 aa, Artificial Sequence
  Description of Artificial Sequence: Synthetic peptide
QEGEIATTNPVSTEQYGDVSECLQSEEL

SEQ ID NO: 93590 - protein, 29 aa, Artificial Sequence
  Description of Artificial Sequence: Synthetic peptide
QEGEIATTNPVSTEQYGIVSACNLEHGEL

SEQ ID NO: 93591 - protein, 30 aa, Artificial Sequence
  Description of Artificial Sequence: Synthetic polypeptide
QEGEIATTNPVSTEQYGIVSACNLQDSGTL

SEQ ID NO: 93592 - protein, 33 aa, Artificial Sequence
  Description of Artificial Sequence: Synthetic polypeptide
DEEEIATTNPVAYEQWGSVCNTFQNEGRGNTDR

SEQ ID NO: 93593 - protein, 33 aa, Artificial Sequence
  Description of Artificial Sequence: Synthetic polypeptide
DEEEIRTTNPVATEQYGSVCSTEHQESFFSDQS

SEQ ID NO: 93594 - protein, 32 aa, Artificial Sequence
  Description of Artificial Sequence: Synthetic polypeptide
DEEEIATTNPVAYEQWGSVCSTDLPDHGGNDI

SEQ ID NO: 93595 - protein, 33 aa, Artificial Sequence
  Description of Artificial Sequence: Synthetic polypeptide
DEEEIATTNPVAYEQWGSVCSTDNNDQDGSNDN

SEQ ID NO: 93596 - protein, 34 aa, Artificial Sequence
  Description of Artificial Sequence: Synthetic polypeptide
DEEEIRTTNPVATEQYGSVCSTEELQNFTSETQS

SEQ ID NO: 93597 - protein, 28 aa, Artificial Sequence
  Description of Artificial Sequence: Synthetic peptide
QEGEIQPTNPCSSEQYGTVSCNLQSGTR

SEQ ID NO: 93598 - protein, 36 aa, Artificial Sequence
  Description of Artificial Sequence: Synthetic polypeptide
AEEEIRTTNPVATEQYGSVSTVVTNLQSGSVQNGTQ

SEQ ID NO: 93599 - protein, 33 aa, Artificial Sequence
  Description of Artificial Sequence: Synthetic polypeptide
DEEEIATTNPVAYEQWGSVCSTNDQLDDGDNEL

SEQ ID NO: 93600 - protein, 35 aa, Artificial Sequence
  Description of Artificial Sequence: Synthetic polypeptide
AEEEIRTTNPVATEQYGSVSTVVTNLQNEENDEQM

SEQ ID NO: 93601 - protein, 28 aa, Artificial Sequence
  Description of Artificial Sequence: Synthetic peptide
QEGEIATTNPVATEQYGEVPENCQHETK

SEQ ID NO: 93602 - protein, 33 aa, Artificial Sequence
  Description of Artificial Sequence: Synthetic polypeptide
DEEEIATTNPVAYEQWGSVSGDNNDQGLQNGND

SEQ ID NO: 93603 - protein, 28 aa, Artificial Sequence
  Description of Artificial Sequence: Synthetic peptide
QEGEIATTNPVATEQYGEAPENCQHGEK

SEQ ID NO: 93604 - protein, 28 aa, Artificial Sequence
  Description of Artificial Sequence: Synthetic peptide
QEGEIATTNPVATEEYGDVSECLQHEEL

SEQ ID NO: 93605 - protein, 29 aa, Artificial Sequence
  Description of Artificial Sequence: Synthetic peptide
QEGEIATTNPCSSEQYGIVSCNLQSEGTR

SEQ ID NO: 93606 - protein, 29 aa, Artificial Sequence
  Description of Artificial Sequence: Synthetic peptide
QEGEIATTNPCSSEQYGIVSCNLQSGTSR

SEQ ID NO: 93607 - protein, 29 aa, Artificial Sequence
  Description of Artificial Sequence: Synthetic peptide
QEGEIATTNPCSSEQYGSVSTDLEDHGTR

SEQ ID NO: 93608 - protein, 28 aa, Artificial Sequence
  Description of Artificial Sequence: Synthetic peptide
QEGEIATTNPCSSEQYGTISCNIQQGNR

SEQ ID NO: 93609 - protein, 28 aa, Artificial Sequence
  Description of Artificial Sequence: Synthetic peptide
QEGEIATTNPCSSEQYGTVSCGLQSGTR

SEQ ID NO: 93610 - protein, 28 aa, Artificial Sequence
  Description of Artificial Sequence: Synthetic peptide
QEGEIATTNPCSTECWGIVSCNLQSGPR

SEQ ID NO: 93611 - protein, 28 aa, Artificial Sequence
  Description of Artificial Sequence: Synthetic peptide
QEGEIATTNPCSTECWGIVSCNLQSGTR

SEQ ID NO: 93612 - protein, 29 aa, Artificial Sequence
  Description of Artificial Sequence: Synthetic peptide
QEGEIATTNPCSTECYGIVSANLQPGTYR

SEQ ID NO: 93613 - protein, 28 aa, Artificial Sequence
  Description of Artificial Sequence: Synthetic peptide
QEGEIATTNPCSTEQYGIASCNLQSETR

SEQ ID NO: 93614 - protein, 29 aa, Artificial Sequence
  Description of Artificial Sequence: Synthetic peptide
QEGEIATTNPCSTEQYGIISCNLQSNGTR

SEQ ID NO: 93615 - protein, 30 aa, Artificial Sequence
  Description of Artificial Sequence: Synthetic polypeptide
QEGEIATTNPCSTEQYGSVSATDLEDHGTR

SEQ ID NO: 93616 - protein, 28 aa, Artificial Sequence
  Description of Artificial Sequence: Synthetic peptide
QEGEIATTNPVASECYGDVSCCLQHEER

SEQ ID NO: 93617 - protein, 28 aa, Artificial Sequence
  Description of Artificial Sequence: Synthetic peptide
QEGEIATTNPVASEQYGEAPENCQHGER

SEQ ID NO: 93618 - protein, 28 aa, Artificial Sequence
  Description of Artificial Sequence: Synthetic peptide
QEGEIATTNPVASEQYGIVPENLQHEEK

SEQ ID NO: 93619 - protein, 31 aa, Artificial Sequence
  Description of Artificial Sequence: Synthetic polypeptide
QEGEIATTNPVASEQYGIVSATGPVQSEGNR

SEQ ID NO: 93620 - protein, 28 aa, Artificial Sequence
  Description of Artificial Sequence: Synthetic peptide
QEGEIATTNPVATECYGDVSECLQHEEL

SEQ ID NO: 93621 - protein, 28 aa, Artificial Sequence
  Description of Artificial Sequence: Synthetic peptide
QEGEIATTNPVATECYGDVSECLQHEEW

SEQ ID NO: 93622 - protein, 32 aa, Artificial Sequence
  Description of Artificial Sequence: Synthetic polypeptide
DEEEIATTNPVAYEQWGQSVATNDLMQDGIGM

SEQ ID NO: 93623 - protein, 28 aa, Artificial Sequence
  Description of Artificial Sequence: Synthetic peptide
QEGEIATTNPVATECYGDVSESLQHEEL

SEQ ID NO: 93624 - protein, 28 aa, Artificial Sequence
  Description of Artificial Sequence: Synthetic peptide
QEGEIATTNPVATECYGHVSEELQHIEL

SEQ ID NO: 93625 - protein, 29 aa, Artificial Sequence
  Description of Artificial Sequence: Synthetic peptide
QEGEIATTNPVATECYGQVSEWLQHGEEL

SEQ ID NO: 93626 - protein, 31 aa, Artificial Sequence
  Description of Artificial Sequence: Synthetic polypeptide
QEGEIATTNPVATEQWGIVSCINEQDRGETR

SEQ ID NO: 93627 - protein, 28 aa, Artificial Sequence
  Description of Artificial Sequence: Synthetic peptide
QEGEIRPTNPCSSEPYGIVSCNLQSGTR

SEQ ID NO: 93628 - protein, 28 aa, Artificial Sequence
  Description of Artificial Sequence: Synthetic peptide
QEGEIRPTNPCSSEQYGIVSCNEQSGDR

SEQ ID NO: 93629 - protein, 29 aa, Artificial Sequence
  Description of Artificial Sequence: Synthetic peptide
QEGEIRTTNPCASECYGIVSCINLQSGTG

SEQ ID NO: 93630 - protein, 35 aa, Artificial Sequence
  Description of Artificial Sequence: Synthetic polypeptide
DEEEIRTTNPVATEQYGSVCSPTNSLERNDDTQEA

SEQ ID NO: 93631 - protein, 35 aa, Artificial Sequence
  Description of Artificial Sequence: Synthetic polypeptide
DEEEIRTTNPVATEQYGSVCSPTNSDIETLYEDNE

SEQ ID NO: 93632 - protein, 33 aa, Artificial Sequence
  Description of Artificial Sequence: Synthetic polypeptide
DEEEIRTTNPVATEQYGSVCSPTNSDIELEDHE

SEQ ID NO: 93633 - protein, 36 aa, Artificial Sequence
  Description of Artificial Sequence: Synthetic polypeptide
DEEEIRTTNPVATEQYGSVCSPTNPQPQEAGEGNDD

SEQ ID NO: 93634 - protein, 33 aa, Artificial Sequence
  Description of Artificial Sequence: Synthetic polypeptide
DEEEIATTNPVAYEQWGSVSTNLNGDAQGENMQ

SEQ ID NO: 93635 - protein, 35 aa, Artificial Sequence
  Description of Artificial Sequence: Synthetic polypeptide
DEEEIRTTNPVATEQYGSVCSPTNNLERNDDQQES

SEQ ID NO: 93636 - protein, 35 aa, Artificial Sequence
  Description of Artificial Sequence: Synthetic polypeptide
DEEEIRTTNPVATEQYGSVCSPTNNLERADDTQEM

SEQ ID NO: 93637 - protein, 36 aa, Artificial Sequence
  Description of Artificial Sequence: Synthetic polypeptide
DEEEIRTTNPVATEQYGSVCSPTNNLDQTRVEDITD

SEQ ID NO: 93638 - protein, 34 aa, Artificial Sequence
  Description of Artificial Sequence: Synthetic polypeptide
DEEEIRTTNPVATEQYGSVCSPTNLIDDTEIIDS

SEQ ID NO: 93639 - protein, 35 aa, Artificial Sequence
  Description of Artificial Sequence: Synthetic polypeptide
DEEEIRTTNPVATEQYGSVCSPTNGLERNDDTLES

SEQ ID NO: 93640 - protein, 34 aa, Artificial Sequence
  Description of Artificial Sequence: Synthetic polypeptide
DEEEIRTTNPVATEQYGSVCSPTNGERNDDTQEG

SEQ ID NO: 93641 - protein, 28 aa, Artificial Sequence
  Description of Artificial Sequence: Synthetic peptide
QEGQIAPTNPCSTEQYGIVSCNLQSGTR

SEQ ID NO: 93642 - protein, 32 aa, Artificial Sequence
  Description of Artificial Sequence: Synthetic polypeptide
DEEEIATTNPVAYEQWGSVSTNMQTGEGGDQG

SEQ ID NO: 93643 - protein, 35 aa, Artificial Sequence
  Description of Artificial Sequence: Synthetic polypeptide
DEEEIRTTNPVATEQYGSVCSPPLNMLQVTEEERL

SEQ ID NO: 93644 - protein, 32 aa, Artificial Sequence
  Description of Artificial Sequence: Synthetic polypeptide
DEEEIATTNPVAYEQWGSVSTQLNDGNGNGSG

SEQ ID NO: 93645 - protein, 31 aa, Artificial Sequence
  Description of Artificial Sequence: Synthetic polypeptide
DEEEIATTNPVAYEQWGSVSTSQGGQMGDSN

SEQ ID NO: 93646 - protein, 34 aa, Artificial Sequence
  Description of Artificial Sequence: Synthetic polypeptide
DEEEIRTTNPVATEQYGSVCSPNKLETFSQESID

SEQ ID NO: 93647 - protein, 33 aa, Artificial Sequence
  Description of Artificial Sequence: Synthetic polypeptide
DEEEIATTNPVAYEQWGSVSTTNDNAGEGGNAR

SEQ ID NO: 93648 - protein, 28 aa, Artificial Sequence
  Description of Artificial Sequence: Synthetic peptide
QEHEIAPTNPCSSEQYGIVSCNLQSGHR

SEQ ID NO: 93649 - protein, 28 aa, Artificial Sequence
  Description of Artificial Sequence: Synthetic peptide
QEHEIAPTNPCSSEQYGIVSCNLQSGTR

SEQ ID NO: 93650 - protein, 28 aa, Artificial Sequence
  Description of Artificial Sequence: Synthetic peptide
QEHEIAPTNPCSSEQYGKVSCNLQSGTR

SEQ ID NO: 93651 - protein, 28 aa, Artificial Sequence
  Description of Artificial Sequence: Synthetic peptide
QEGEIWPTNPCSSEQYGQVSCNLQSGTR

SEQ ID NO: 93652 - protein, 28 aa, Artificial Sequence
  Description of Artificial Sequence: Synthetic peptide
QEGEIWPTNPCSSEQYGIVSCNLQSGTR

SEQ ID NO: 93653 - protein, 28 aa, Artificial Sequence
  Description of Artificial Sequence: Synthetic peptide
QEGEIVPTNPCASEQYGTVSCNLQSGTD

SEQ ID NO: 93654 - protein, 28 aa, Artificial Sequence
  Description of Artificial Sequence: Synthetic peptide
QEGEISPTNPCSSEQYGIVSCNLQSGTR

SEQ ID NO: 93655 - protein, 31 aa, Artificial Sequence
  Description of Artificial Sequence: Synthetic polypeptide
QEGEIRTTNPCASEQWGSVSCINLQDREGTG

SEQ ID NO: 93656 - protein, 34 aa, Artificial Sequence
  Description of Artificial Sequence: Synthetic polypeptide
DEEEIRTTNPVATEQYGSVCSTDLTFNSSLEEKN

SEQ ID NO: 93657 - protein, 31 aa, Artificial Sequence
  Description of Artificial Sequence: Synthetic polypeptide
QEGEIRTTNPCATEQYGIVSCAGQMRGMTPR

SEQ ID NO: 93658 - protein, 31 aa, Artificial Sequence
  Description of Artificial Sequence: Synthetic polypeptide
QEGEIRTTNPCATEQYGIVSTAGNMRGMTPR

SEQ ID NO: 93659 - protein, 32 aa, Artificial Sequence
  Description of Artificial Sequence: Synthetic polypeptide
QEGEIRTTNPCATEQYGIVSTTAGNMRGMNPR

SEQ ID NO: 93660 - protein, 28 aa, Artificial Sequence
  Description of Artificial Sequence: Synthetic peptide
QEGEIRTTNPCSSEQYGIVSCDLQSGTH

SEQ ID NO: 93661 - protein, 29 aa, Artificial Sequence
  Description of Artificial Sequence: Synthetic peptide
QEGEIRTTNPCSSEQYGIVSCNIQQNGTR

SEQ ID NO: 93662 - protein, 29 aa, Artificial Sequence
  Description of Artificial Sequence: Synthetic peptide
QEGEIRTTNPCSSEQYGIVSCNIQSNGTR

SEQ ID NO: 93663 - protein, 34 aa, Artificial Sequence
  Description of Artificial Sequence: Synthetic polypeptide
DEEEIATTNPVAYEQWGSVSKNDEQLQERQGNDM

SEQ ID NO: 93664 - protein, 34 aa, Artificial Sequence
  Description of Artificial Sequence: Synthetic polypeptide
DEEEIATTNPVAYEQWGSVSKTDEDLQERQGENM

SEQ ID NO: 93665 - protein, 29 aa, Artificial Sequence
  Description of Artificial Sequence: Synthetic peptide
QEGEIATTNPCSSEQYGIVSCNLQQSGTR

SEQ ID NO: 93666 - protein, 33 aa, Artificial Sequence
  Description of Artificial Sequence: Synthetic polypeptide
DEEEIATTNPVAYEQWGSVSKTDQQLQEQMGNL

SEQ ID NO: 93667 - protein, 34 aa, Artificial Sequence
  Description of Artificial Sequence: Synthetic polypeptide
DEEEIATTNPVAYEQWGSVSKTNDLDQQRGEPKE

SEQ ID NO: 93668 - protein, 31 aa, Artificial Sequence
  Description of Artificial Sequence: Synthetic polypeptide
QEGEIRTTNPVASEQWGSVSCINEQDREGTG

SEQ ID NO: 93669 - protein, 34 aa, Artificial Sequence
  Description of Artificial Sequence: Synthetic polypeptide
DEEEIRTTNPVATEQYGSVCSSTPLEERELIPQF

SEQ ID NO: 93670 - protein, 31 aa, Artificial Sequence
  Description of Artificial Sequence: Synthetic polypeptide
QEGEIRTTNPVATECWGIVSCINEQDSEGNR

SEQ ID NO: 93671 - protein, 34 aa, Artificial Sequence
  Description of Artificial Sequence: Synthetic polypeptide
DEEEIATTNPVAYEQWGSVSKTNDLNQQRNGEEK

SEQ ID NO: 93672 - protein, 32 aa, Artificial Sequence
  Description of Artificial Sequence: Synthetic polypeptide
QEGEIRTTNPVATEQWGSVSCINEPQDREGTG

SEQ ID NO: 93673 - protein, 34 aa, Artificial Sequence
  Description of Artificial Sequence: Synthetic polypeptide
DEEEIATTNPVAYEQWGSVSTANLLQGDGGEGSR

SEQ ID NO: 93674 - protein, 32 aa, Artificial Sequence
  Description of Artificial Sequence: Synthetic polypeptide
DEEEIATTNPVAYEQWGSVSTGNDAHQNDSNQ

SEQ ID NO: 93675 - protein, 33 aa, Artificial Sequence
  Description of Artificial Sequence: Synthetic polypeptide
DEEEIATTNPVAYEQWGSVSTMNGGQDGGQPRG

SEQ ID NO: 93676 - protein, 31 aa, Artificial Sequence
  Description of Artificial Sequence: Synthetic polypeptide
QEGEIRTTNPVSTECWGIVSCINLQDSEGNR

SEQ ID NO: 93677 - protein, 34 aa, Artificial Sequence
  Description of Artificial Sequence: Synthetic polypeptide
DEEEIATTNPVAYEQWGSVSKTLEQLQERGGENL

SEQ ID NO: 93678 - protein, 28 aa, Artificial Sequence
  Description of Artificial Sequence: Synthetic peptide
QEGEIATTNPCSSEQYGIVSCNIQQGTR

SEQ ID NO: 93679 - protein, 28 aa, Artificial Sequence
  Description of Artificial Sequence: Synthetic peptide
QEGEIATTNPCSSEQYGIVSCDLQSGTR

SEQ ID NO: 93680 - protein, 28 aa, Artificial Sequence
  Description of Artificial Sequence: Synthetic peptide
QEGEIATTNPCSSEQYGIVSCCLQSGTR

SEQ ID NO: 93681 - protein, 28 aa, Artificial Sequence
  Description of Artificial Sequence: Synthetic peptide
QEGEIAPTNPVSTECYGIVSCCLQHGTR

SEQ ID NO: 93682 - protein, 33 aa, Artificial Sequence
  Description of Artificial Sequence: Synthetic polypeptide
DEEEIATTNPVATEQYGSVSTTPDGNDREGEDV

SEQ ID NO: 93683 - protein, 33 aa, Artificial Sequence
  Description of Artificial Sequence: Synthetic polypeptide
DEEEIATTNPVATEQYGSVSTTPDGNDRNGEDV

SEQ ID NO: 93684 - protein, 34 aa, Artificial Sequence
  Description of Artificial Sequence: Synthetic polypeptide
DEEEIATTNPVATEQYGSVSTTPDGNMRNGMNPV

SEQ ID NO: 93685 - protein, 33 aa, Artificial Sequence
  Description of Artificial Sequence: Synthetic polypeptide
DEEEIATTNPVATEQYGSVSTTPDLNDHEGEPL

SEQ ID NO: 93686 - protein, 33 aa, Artificial Sequence
  Description of Artificial Sequence: Synthetic polypeptide
DEEEIATTNPVATEQYGSVTGGNAGDQRNGDPP

SEQ ID NO: 93687 - protein, 35 aa, Artificial Sequence
  Description of Artificial Sequence: Synthetic polypeptide
DEEEIATTNPVATEQYGSVVITGNQGQDAGGGNHR

SEQ ID NO: 93688 - protein, 29 aa, Artificial Sequence
  Description of Artificial Sequence: Synthetic peptide
DEEEIATTNPVATEQYGTASEVCQQHEEK

SEQ ID NO: 93689 - protein, 34 aa, Artificial Sequence
  Description of Artificial Sequence: Synthetic polypeptide
DEEEIRTTNPVATEQYGSVCSTNGHQENFMSIQA

SEQ ID NO: 93690 - protein, 29 aa, Artificial Sequence
  Description of Artificial Sequence: Synthetic peptide
DEEEIATTNPVATEQYGTISEVCQQHEEK

SEQ ID NO: 93691 - protein, 34 aa, Artificial Sequence
  Description of Artificial Sequence: Synthetic polypeptide
DEEEIRTTNPVATEQYGSVCSTNDTMETMRVQDE

SEQ ID NO: 93692 - protein, 28 aa, Artificial Sequence
  Description of Artificial Sequence: Synthetic peptide
QEGEIAPTNPVSTEQYGIMASNLQHGDR

SEQ ID NO: 93693 - protein, 30 aa, Artificial Sequence
  Description of Artificial Sequence: Synthetic polypeptide
DEEEIATTNPVATEQYGTISEVCQQQQENH

SEQ ID NO: 93694 - protein, 35 aa, Artificial Sequence
  Description of Artificial Sequence: Synthetic polypeptide
DEEEIRTTNPVATEQYGSVCSTNDQQEHQDDTLRK

SEQ ID NO: 93695 - protein, 29 aa, Artificial Sequence
  Description of Artificial Sequence: Synthetic peptide
QEGEIAPTNPVSTEQYGIVSACNLQSGTL

SEQ ID NO: 93696 - protein, 34 aa, Artificial Sequence
  Description of Artificial Sequence: Synthetic polypeptide
DEEEIATTNPVATEQYGTVVPSCCNELQSSGGDR

SEQ ID NO: 93697 - protein, 30 aa, Artificial Sequence
  Description of Artificial Sequence: Synthetic polypeptide
QEGEIAPTNPVSTEQYGTVSCDLQQQNGNR

SEQ ID NO: 93698 - protein, 28 aa, Artificial Sequence
  Description of Artificial Sequence: Synthetic peptide
QEGEIASTNPCCSEQYGIVSCNLQSGTR

SEQ ID NO: 93699 - protein, 28 aa, Artificial Sequence
  Description of Artificial Sequence: Synthetic peptide
QEGEIASTNPCCSEQYGIVSDNLQSGTR

SEQ ID NO: 93700 - protein, 28 aa, Artificial Sequence
  Description of Artificial Sequence: Synthetic peptide
QEGEIASTNPCCSEQYGVVSDNLQSGTR

SEQ ID NO: 93701 - protein, 34 aa, Artificial Sequence
  Description of Artificial Sequence: Synthetic polypeptide
DEEEIATTNPVATESYGISVPTTMNLQDQIGERK

SEQ ID NO: 93702 - protein, 34 aa, Artificial Sequence
  Description of Artificial Sequence: Synthetic polypeptide
DEEEIATTNPVATEQYGSVSTTPAGPNRNGMNPV

SEQ ID NO: 93703 - protein, 34 aa, Artificial Sequence
  Description of Artificial Sequence: Synthetic polypeptide
DEEEIATTNPVATEQYGSVSTTPAGPNMRGMNPL

SEQ ID NO: 93704 - protein, 28 aa, Artificial Sequence
  Description of Artificial Sequence: Synthetic peptide
QEGEIAPTNPVSTECYGDVSECLQSGTR

SEQ ID NO: 93705 - protein, 28 aa, Artificial Sequence
  Description of Artificial Sequence: Synthetic peptide
QEGEIAPTNPVSSEQYGVVSCTLQSGTR

SEQ ID NO: 93706 - protein, 34 aa, Artificial Sequence
  Description of Artificial Sequence: Synthetic polypeptide
DEEEIATTNPVATEQYGSVSSTTPAGPNMRGGPR

SEQ ID NO: 93707 - protein, 28 aa, Artificial Sequence
  Description of Artificial Sequence: Synthetic peptide
QEGEIAPTNPVSSEGYGIVSCNLQSGTR

SEQ ID NO: 93708 - protein, 28 aa, Artificial Sequence
  Description of Artificial Sequence: Synthetic peptide
QEGEIAPTNPVSSEQYGDVSCNLQSEER

SEQ ID NO: 93709 - protein, 28 aa, Artificial Sequence
  Description of Artificial Sequence: Synthetic peptide
QEGEIAPTNPVSSEQYGDVSENLQSEER

SEQ ID NO: 93710 - protein, 28 aa, Artificial Sequence
  Description of Artificial Sequence: Synthetic peptide
QEGEIAPTNPVSSEQYGEASCNLQSGGR

SEQ ID NO: 93711 - protein, 28 aa, Artificial Sequence
  Description of Artificial Sequence: Synthetic peptide
QEGEIAPTNPVSSEQYGEASCNLQSGTR

SEQ ID NO: 93712 - protein, 28 aa, Artificial Sequence
  Description of Artificial Sequence: Synthetic peptide
QEGEIAPTNPVSSEQYGIVSCDLQSGTR

SEQ ID NO: 93713 - protein, 34 aa, Artificial Sequence
  Description of Artificial Sequence: Synthetic polypeptide
DEEEIATTNPVATEQYGSVSSTTPALEDHEGNDV

SEQ ID NO: 93714 - protein, 28 aa, Artificial Sequence
  Description of Artificial Sequence: Synthetic peptide
QEGEIAPTNPVSSEQYGIVSCNIQQGTR

SEQ ID NO: 93715 - protein, 35 aa, Artificial Sequence
  Description of Artificial Sequence: Synthetic polypeptide
DEEEIATTNPVATEQYGSVSSTTPALNMRNGMTPR

SEQ ID NO: 93716 - protein, 34 aa, Artificial Sequence
  Description of Artificial Sequence: Synthetic polypeptide
DEEEIATTNPVATETWGTVCSTNDLQGDGGDNER

SEQ ID NO: 93717 - protein, 29 aa, Artificial Sequence
  Description of Artificial Sequence: Synthetic peptide
QEGEIAPTNPVSSEQYGIVSCNLQDSGTR

SEQ ID NO: 93718 - protein, 29 aa, Artificial Sequence
  Description of Artificial Sequence: Synthetic peptide
QEGEIAPTNPVSSEQYGIVSCNLQSEGTR

SEQ ID NO: 93719 - protein, 28 aa, Artificial Sequence
  Description of Artificial Sequence: Synthetic peptide
QEGEIAPTNPVSSEQYGIVSCNLQSETR

SEQ ID NO: 93720 - protein, 35 aa, Artificial Sequence
  Description of Artificial Sequence: Synthetic polypeptide
DEEEIATTNPVATEQYGSVSSTTPALPNMRNGMNV

SEQ ID NO: 93721 - protein, 34 aa, Artificial Sequence
  Description of Artificial Sequence: Synthetic polypeptide
DEEEIATTNPVATEQYGSVSSTTPALPNMSGMNV

SEQ ID NO: 93722 - protein, 28 aa, Artificial Sequence
  Description of Artificial Sequence: Synthetic peptide
QEGEIAPTNPVSSEQYGIVSCNLQSGTI

SEQ ID NO: 93723 - protein, 28 aa, Artificial Sequence
  Description of Artificial Sequence: Synthetic peptide
QEGEIAPTNPVSSEQYGNVSCNIQSGTR

SEQ ID NO: 93724 - protein, 33 aa, Artificial Sequence
  Description of Artificial Sequence: Synthetic polypeptide
DEEEIATTNPVATEQYGSVSTGNPTDDDMDNTA

SEQ ID NO: 93725 - protein, 34 aa, Artificial Sequence
  Description of Artificial Sequence: Synthetic polypeptide
DEEEIATTNPVATEQYGSVSTPAGPNMHNGMNPL

SEQ ID NO: 93726 - protein, 35 aa, Artificial Sequence
  Description of Artificial Sequence: Synthetic polypeptide
DEEEIATTNPVATEQYGSVSTPNLGQPEAENNDQV

SEQ ID NO: 93727 - protein, 35 aa, Artificial Sequence
  Description of Artificial Sequence: Synthetic polypeptide
DEEEIATTNPVATEQYGSVSTPNPQQDHQDGNEHH

SEQ ID NO: 93728 - protein, 29 aa, Artificial Sequence
  Description of Artificial Sequence: Synthetic peptide
QEGEIAPTNPVSSEQYGIVSCNLQNSGDR

SEQ ID NO: 93729 - protein, 33 aa, Artificial Sequence
  Description of Artificial Sequence: Synthetic polypeptide
DEEEIRTTNPVATEQYGSVCSPLTLPQDTFLEE

SEQ ID NO: 93730 - protein, 32 aa, Artificial Sequence
  Description of Artificial Sequence: Synthetic polypeptide
DEEEIATTNPVATETYGCVSTGGAGLTGGDDR

SEQ ID NO: 93731 - protein, 33 aa, Artificial Sequence
  Description of Artificial Sequence: Synthetic polypeptide
DEEEIATTNPVATETYGSVFESINPGNTGNLRW

SEQ ID NO: 93732 - protein, 31 aa, Artificial Sequence
  Description of Artificial Sequence: Synthetic polypeptide
DEEEIATTNPVAYEAWGEVATNLQDGDNQEA

SEQ ID NO: 93733 - protein, 31 aa, Artificial Sequence
  Description of Artificial Sequence: Synthetic polypeptide
QEGEIATTNPCATECYGSVSCINLQDSGENG

SEQ ID NO: 93734 - protein, 30 aa, Artificial Sequence
  Description of Artificial Sequence: Synthetic polypeptide
QEGEIATTNPCATEQYGIVSCAGQRGMTPR

SEQ ID NO: 93735 - protein, 30 aa, Artificial Sequence
  Description of Artificial Sequence: Synthetic polypeptide
QEGEIATTNPCATEQYGIVSCALQSGMTPR

SEQ ID NO: 93736 - protein, 32 aa, Artificial Sequence
  Description of Artificial Sequence: Synthetic polypeptide
DEEEIATTNPVAYECWGTVSTNLQGDVGGGER

SEQ ID NO: 93737 - protein, 32 aa, Artificial Sequence
  Description of Artificial Sequence: Synthetic polypeptide
DEEEIATTNPVAYECYGVVSTPNQGGNVGNDR

SEQ ID NO: 93738 - protein, 32 aa, Artificial Sequence
  Description of Artificial Sequence: Synthetic polypeptide
DEEEIATTNPVAYEEWGVVSTNLQLGEDNGKD

SEQ ID NO: 93739 - protein, 32 aa, Artificial Sequence
  Description of Artificial Sequence: Synthetic polypeptide
DEEEIATTNPVAYEEWGVVSTNQQLGEDNGRQ

SEQ ID NO: 93740 - protein, 32 aa, Artificial Sequence
  Description of Artificial Sequence: Synthetic polypeptide
DEEEIATTNPVAYEEWGVVTTNLQLGEDNGRS

SEQ ID NO: 93741 - protein, 28 aa, Artificial Sequence
  Description of Artificial Sequence: Synthetic peptide
QEGEIATTNPCSSEQYGDVSCNLQSGTL

SEQ ID NO: 93742 - protein, 32 aa, Artificial Sequence
  Description of Artificial Sequence: Synthetic polypeptide
DEEEIATTNPVAYEHWGEVSTNLQGNDGQNAN

SEQ ID NO: 93743 - protein, 32 aa, Artificial Sequence
  Description of Artificial Sequence: Synthetic polypeptide
DEEEIATTNPVAYEHWGSVATNLQGNDQGNAN

SEQ ID NO: 93744 - protein, 30 aa, Artificial Sequence
  Description of Artificial Sequence: Synthetic polypeptide
DEEEIATTNPVAYEHWGSVATTNDGHMDNR

SEQ ID NO: 93745 - protein, 34 aa, Artificial Sequence
  Description of Artificial Sequence: Synthetic polypeptide
DEEEIATTNPVAYEHWGSVSTTNQLQGDVGGNVR

SEQ ID NO: 93746 - protein, 33 aa, Artificial Sequence
  Description of Artificial Sequence: Synthetic polypeptide
DEEEIATTNPVAYEHWGVVSTNLGQGDVGGNVR

SEQ ID NO: 93747 - protein, 28 aa, Artificial Sequence
  Description of Artificial Sequence: Synthetic peptide
QEGEIATTNPCSSEQYGIISCNIQQGNR

SEQ ID NO: 93748 - protein, 28 aa, Artificial Sequence
  Description of Artificial Sequence: Synthetic peptide
QEGEIATTNPCSSEQYGIISCNLQSGTR

SEQ ID NO: 93749 - protein, 28 aa, Artificial Sequence
  Description of Artificial Sequence: Synthetic peptide
QEGEIATTNPCSSEQYGIVPCNLQSGTR

SEQ ID NO: 93750 - protein, 30 aa, Artificial Sequence
  Description of Artificial Sequence: Synthetic polypeptide
QEGEIATTNPCSSEQYGIVSATNLQSEGTR

SEQ ID NO: 93751 - protein, 28 aa, Artificial Sequence
  Description of Artificial Sequence: Synthetic peptide
QEGEIATTNPCSSEQYGIVSCALQSGTR

SEQ ID NO: 93752 - protein, 34 aa, Artificial Sequence
  Description of Artificial Sequence: Synthetic polypeptide
DEEEIRTTNPVATEQYGSVCSTGETNQNFGSEQS

SEQ ID NO: 93753 - protein, 29 aa, Artificial Sequence
  Description of Artificial Sequence: Synthetic peptide
QEGEIATTNPCASEQYGIVSENLQSAGTA

SEQ ID NO: 93754 - protein, 30 aa, Artificial Sequence
  Description of Artificial Sequence: Synthetic polypeptide
QEGEIATTNPCASEQYGIVSCINLQSGENG

SEQ ID NO: 93755 - protein, 31 aa, Artificial Sequence
  Description of Artificial Sequence: Synthetic polypeptide
QEGEIATTNPCASEQYGIVSATNLQDSEGTR

SEQ ID NO: 93756 - protein, 35 aa, Artificial Sequence
  Description of Artificial Sequence: Synthetic polypeptide
DEEEIRTTNPVATEQYGSVCSTGVLDDTQNVEVNA

SEQ ID NO: 93757 - protein, 28 aa, Artificial Sequence
  Description of Artificial Sequence: Synthetic peptide
QEGEIASTNPCSSEQYGIVSCNLQSGNQ

SEQ ID NO: 93758 - protein, 33 aa, Artificial Sequence
  Description of Artificial Sequence: Synthetic polypeptide
DEEEIATTNPVATTQYGVVSTEDDLVGRIGEDR

SEQ ID NO: 93759 - protein, 28 aa, Artificial Sequence
  Description of Artificial Sequence: Synthetic peptide
QEGEIASTNPCSSEQYGIVSCNLQSGTR

SEQ ID NO: 93760 - protein, 28 aa, Artificial Sequence
  Description of Artificial Sequence: Synthetic peptide
QEGEIASTNPCSSEQYGIVSSNLQHGTR

SEQ ID NO: 93761 - protein, 28 aa, Artificial Sequence
  Description of Artificial Sequence: Synthetic peptide
QEGEIASTNPCSSEQYGIVSSNLQSGTR

SEQ ID NO: 93762 - protein, 28 aa, Artificial Sequence
  Description of Artificial Sequence: Synthetic peptide
QEGEIASTNPCSTEGYGIVACNLQRGTR

SEQ ID NO: 93763 - protein, 28 aa, Artificial Sequence
  Description of Artificial Sequence: Synthetic peptide
QEGEIASTNPCSTEQYGIVSCNLQHGTI

SEQ ID NO: 93764 - protein, 28 aa, Artificial Sequence
  Description of Artificial Sequence: Synthetic peptide
QEGEIASTNPCVSEQYGIVSCNLQSGIR

SEQ ID NO: 93765 - protein, 28 aa, Artificial Sequence
  Description of Artificial Sequence: Synthetic peptide
QEGEIASTNPVSSEGYGIVSCNLQSGTR

SEQ ID NO: 93766 - protein, 28 aa, Artificial Sequence
  Description of Artificial Sequence: Synthetic peptide
QEGEIASTNPVSTEGYGIVSCTLQSGTR

SEQ ID NO: 93767 - protein, 28 aa, Artificial Sequence
  Description of Artificial Sequence: Synthetic peptide
QEGEIASTNPCSSEQYGIVSCNLQEGTR

SEQ ID NO: 93768 - protein, 35 aa, Artificial Sequence
  Description of Artificial Sequence: Synthetic polypeptide
DEEEIRTTNPVATEQYGSVCSTLHAEQPELGNNEF

SEQ ID NO: 93769 - protein, 35 aa, Artificial Sequence
  Description of Artificial Sequence: Synthetic polypeptide
DEEEIRTTNPVATEQYGSVCSTLELPQQRVEEPQE

SEQ ID NO: 93770 - protein, 32 aa, Artificial Sequence
  Description of Artificial Sequence: Synthetic polypeptide
QEGEIATTNPCASECYGSVSCNLPQDREGENR

SEQ ID NO: 93771 - protein, 35 aa, Artificial Sequence
  Description of Artificial Sequence: Synthetic polypeptide
DEEEIRTTNPVATEQYGSVCSTGVLPDTRNVEENN

SEQ ID NO: 93772 - protein, 34 aa, Artificial Sequence
  Description of Artificial Sequence: Synthetic polypeptide
DEEEIRTTNPVATEQYGSVCSTGVLEDDRNVEEN

SEQ ID NO: 93773 - protein, 34 aa, Artificial Sequence
  Description of Artificial Sequence: Synthetic polypeptide
DEEEIRTTNPVATEQYGSVCSTGVLDTRHVVEFN

SEQ ID NO: 93774 - protein, 35 aa, Artificial Sequence
  Description of Artificial Sequence: Synthetic polypeptide
DEEEIRTTNPVATEQYGSVCSTGVLDTRENVEENA

SEQ ID NO: 93775 - protein, 35 aa, Artificial Sequence
  Description of Artificial Sequence: Synthetic polypeptide
DEEEIRTTNPVATEQYGSVCSTGVLDTRDVVEENQ

SEQ ID NO: 93776 - protein, 34 aa, Artificial Sequence
  Description of Artificial Sequence: Synthetic polypeptide
DEEEIRTTNPVATEQYGSVCSTGVLDTNMNVEEN

SEQ ID NO: 93777 - protein, 34 aa, Artificial Sequence
  Description of Artificial Sequence: Synthetic polypeptide
DEEEIRTTNPVATEQYGSVCSTGVLDTHNVLENQ

SEQ ID NO: 93778 - protein, 28 aa, Artificial Sequence
  Description of Artificial Sequence: Synthetic peptide
QEGEIATTNPCASEQYGEVPENLQHGTK

SEQ ID NO: 93779 - protein, 28 aa, Artificial Sequence
  Description of Artificial Sequence: Synthetic peptide
QEGEIASVNPCSSEQYGVVSCNLQSGNR

SEQ ID NO: 93780 - protein, 28 aa, Artificial Sequence
  Description of Artificial Sequence: Synthetic peptide
QEHEIAPTNPCSYEQYGEVSCNLQSGQR

SEQ ID NO: 93781 - protein, 28 aa, Artificial Sequence
  Description of Artificial Sequence: Synthetic peptide
QEHEIAPTNPMSSEQYGYVSCNLQSGTR

SEQ ID NO: 93782 - protein, 28 aa, Artificial Sequence
  Description of Artificial Sequence: Synthetic peptide
QEHEIASTNPCSYEQYGIVSCNLQSGMR

SEQ ID NO: 93783 - protein, 29 aa, Artificial Sequence
  Description of Artificial Sequence: Synthetic peptide
QENEIATTNPCATEQYGIVSCNLQNAEDA

SEQ ID NO: 93784 - protein, 32 aa, Artificial Sequence
  Description of Artificial Sequence: Synthetic polypeptide
DEEEIATTNPVAYEQYGSVATAGTQTRNNDTA

SEQ ID NO: 93785 - protein, 33 aa, Artificial Sequence
  Description of Artificial Sequence: Synthetic polypeptide
DEEEIATTNPVAYEQYGSVATAGTQTRNNQDER

SEQ ID NO: 93786 - protein, 34 aa, Artificial Sequence
  Description of Artificial Sequence: Synthetic polypeptide
DEEEIATTNPVAYEQYGSVATGNLQAAPGEIDNN

SEQ ID NO: 93787 - protein, 28 aa, Artificial Sequence
  Description of Artificial Sequence: Synthetic peptide
QENEIATTNPIATECYGDVSENLQHEEL

SEQ ID NO: 93788 - protein, 28 aa, Artificial Sequence
  Description of Artificial Sequence: Synthetic peptide
QENEIATTNPIATECYGSVSECLMHENL

SEQ ID NO: 93789 - protein, 33 aa, Artificial Sequence
  Description of Artificial Sequence: Synthetic polypeptide
DEEEIATTNPVAYEQYGSVATGPGEQRDGNSLM

SEQ ID NO: 93790 - protein, 34 aa, Artificial Sequence
  Description of Artificial Sequence: Synthetic polypeptide
AEEEIRTTNPVATEQYGSVSTVVNQQQQQTNNNE

SEQ ID NO: 93791 - protein, 32 aa, Artificial Sequence
  Description of Artificial Sequence: Synthetic polypeptide
DEEEIATTNPVAYEQYGSVATHLQDSGGDDEH

SEQ ID NO: 93792 - protein, 32 aa, Artificial Sequence
  Description of Artificial Sequence: Synthetic polypeptide
DEEEIATTNPVAYEQYGSVATHLQDSMGDDEL

SEQ ID NO: 93793 - protein, 28 aa, Artificial Sequence
  Description of Artificial Sequence: Synthetic peptide
QENEIATTNPLATECYGSVSECLQHEEL

SEQ ID NO: 93794 - protein, 32 aa, Artificial Sequence
  Description of Artificial Sequence: Synthetic polypeptide
DEEEIATTNPVAYEQYGSVATNGTAEGGNEDQ

SEQ ID NO: 93795 - protein, 32 aa, Artificial Sequence
  Description of Artificial Sequence: Synthetic polypeptide
DEEEIATTNPVAYEQYGSVATNGTQTANGDEE

SEQ ID NO: 93796 - protein, 32 aa, Artificial Sequence
  Description of Artificial Sequence: Synthetic polypeptide
DEEEIATTNPVAYEQYGSVATNLADSGEDAEG

SEQ ID NO: 93797 - protein, 28 aa, Artificial Sequence
  Description of Artificial Sequence: Synthetic peptide
QENEIATTNPSATECYGDVSTCLQHEEL

SEQ ID NO: 93798 - protein, 33 aa, Artificial Sequence
  Description of Artificial Sequence: Synthetic polypeptide
DEEEIATTNPVAYEQYGSVATNLADTGGGDNFA

SEQ ID NO: 93799 - protein, 33 aa, Artificial Sequence
  Description of Artificial Sequence: Synthetic polypeptide
DEEEIATTNPVAYEQYGSVATNLADTGGGDQDR

SEQ ID NO: 93800 - protein, 34 aa, Artificial Sequence
  Description of Artificial Sequence: Synthetic polypeptide
DEEEIRTTNPVATEQYGSVCINTNEDQSEGTTSI

SEQ ID NO: 93801 - protein, 32 aa, Artificial Sequence
  Description of Artificial Sequence: Synthetic polypeptide
DEEEIATTNPVAYEQYGSVATNLAPPGEDQDE

SEQ ID NO: 93802 - protein, 32 aa, Artificial Sequence
  Description of Artificial Sequence: Synthetic polypeptide
DEEEIATTNPVAYEQYGSVATNLDVIDGDDLH

SEQ ID NO: 93803 - protein, 33 aa, Artificial Sequence
  Description of Artificial Sequence: Synthetic polypeptide
DEEEIRTTNPVATEQYGSVCGNTPHQNFGSEQS

SEQ ID NO: 93804 - protein, 28 aa, Artificial Sequence
  Description of Artificial Sequence: Synthetic peptide
QENEIATTNPCATECYGIVSCNLQSEEL

SEQ ID NO: 93805 - protein, 29 aa, Artificial Sequence
  Description of Artificial Sequence: Synthetic peptide
QENEIATTNPCASEQWGIVSCNLQSAGTR

SEQ ID NO: 93806 - protein, 32 aa, Artificial Sequence
  Description of Artificial Sequence: Synthetic polypeptide
DEEEIATTNPVAYEQYGSVASNDTTAEGGNDD

SEQ ID NO: 93807 - protein, 34 aa, Artificial Sequence
  Description of Artificial Sequence: Synthetic polypeptide
DEEEIATTNPVAYEQYGSVASGNLQAAPGDIMNN

SEQ ID NO: 93808 - protein, 28 aa, Artificial Sequence
  Description of Artificial Sequence: Synthetic peptide
QENEIAPTNPVSSEQYGIVSCCLQSGTR

SEQ ID NO: 93809 - protein, 29 aa, Artificial Sequence
  Description of Artificial Sequence: Synthetic peptide
QENEIAPTNPVSSEQYGTVSMNIQQQGNR

SEQ ID NO: 93810 - protein, 31 aa, Artificial Sequence
  Description of Artificial Sequence: Synthetic polypeptide
DEEEIATTNPVAYEQYGSTTANNDQNRQNDQ

SEQ ID NO: 93811 - protein, 29 aa, Artificial Sequence
  Description of Artificial Sequence: Synthetic peptide
QENEIAPTNPVSTEPYGTVSMNIQQQGNR

SEQ ID NO: 93812 - protein, 33 aa, Artificial Sequence
  Description of Artificial Sequence: Synthetic polypeptide
DEEEIRTTNPVATEQYGSVCNTGNGEYGDEGGD

SEQ ID NO: 93813 - protein, 33 aa, Artificial Sequence
  Description of Artificial Sequence: Synthetic polypeptide
DEEEIATTNPVAYEQYGSVAATAGTQTRNNEER

SEQ ID NO: 93814 - protein, 33 aa, Artificial Sequence
  Description of Artificial Sequence: Synthetic polypeptide
DEEEIRTTNPVATEQYGSVCNTFNTYGRAQTQE

SEQ ID NO: 93815 - protein, 28 aa, Artificial Sequence
  Description of Artificial Sequence: Synthetic peptide
QENEIASTNPVATEGYGEASETLQHGDR

SEQ ID NO: 93816 - protein, 34 aa, Artificial Sequence
  Description of Artificial Sequence: Synthetic polypeptide
DEEEIATTNPVAYEQYGSVAATTNLQGTPDGSNN

SEQ ID NO: 93817 - protein, 28 aa, Artificial Sequence
  Description of Artificial Sequence: Synthetic peptide
QENEIASTNPVATEGYGEASETLQRGGI

SEQ ID NO: 93818 - protein, 32 aa, Artificial Sequence
  Description of Artificial Sequence: Synthetic polypeptide
DEEEIATTNPVAYEQYGSVATNLQANPSVDDN

SEQ ID NO: 93819 - protein, 33 aa, Artificial Sequence
  Description of Artificial Sequence: Synthetic polypeptide
DEEEIATTNPVAYEQYGSVAGEGLQNNQDGNRN

SEQ ID NO: 93820 - protein, 28 aa, Artificial Sequence
  Description of Artificial Sequence: Synthetic peptide
QENEIASTNPVATEGYGEMSETLQRGGI

SEQ ID NO: 93821 - protein, 32 aa, Artificial Sequence
  Description of Artificial Sequence: Synthetic polypeptide
DEEEIATTNPVAYEQYGSVAMNDGQRNPDTRM

SEQ ID NO: 93822 - protein, 28 aa, Artificial Sequence
  Description of Artificial Sequence: Synthetic peptide
QENEIASTNPVATEGYGEMSSTLQRGDI

SEQ ID NO: 93823 - protein, 28 aa, Artificial Sequence
  Description of Artificial Sequence: Synthetic peptide
QENEIASTNPVATEGYGVAASNLQHGDR

SEQ ID NO: 93824 - protein, 28 aa, Artificial Sequence
  Description of Artificial Sequence: Synthetic peptide
QENEIASTNPVATEGYGVMSSTLQRGDI

SEQ ID NO: 93825 - protein, 32 aa, Artificial Sequence
  Description of Artificial Sequence: Synthetic polypeptide
DEEEIRTTNPVATEQYGSVCNTFNHYGTETQN

SEQ ID NO: 93826 - protein, 34 aa, Artificial Sequence
  Description of Artificial Sequence: Synthetic polypeptide
DEEEIRTTNPVATEQYGSVCNTFNHYGRGSTQDG

SEQ ID NO: 93827 - protein, 28 aa, Artificial Sequence
  Description of Artificial Sequence: Synthetic peptide
QENEIASTNPVCTECYGDVSENLQHGEL

SEQ ID NO: 93828 - protein, 33 aa, Artificial Sequence
  Description of Artificial Sequence: Synthetic polypeptide
DEEEIRTTNPVATEQYGSVCNTFDMAYGRETQR

SEQ ID NO: 93829 - protein, 34 aa, Artificial Sequence
  Description of Artificial Sequence: Synthetic polypeptide
DEEEIRTTNPVATEQYGSVCNTFDLYGRYEESMR

SEQ ID NO: 93830 - protein, 28 aa, Artificial Sequence
  Description of Artificial Sequence: Synthetic peptide
QENEIASTNPVATEGYGEMSETLQRGDI

SEQ ID NO: 93831 - protein, 28 aa, Artificial Sequence
  Description of Artificial Sequence: Synthetic peptide
QENEIAPTNPVSSEQYGDVSENLQSEER

SEQ ID NO: 93832 - protein, 34 aa, Artificial Sequence
  Description of Artificial Sequence: Synthetic polypeptide
DEEEIRTTNPVATEQYGSVCFVYDLQTFEGQIND

SEQ ID NO: 93833 - protein, 33 aa, Artificial Sequence
  Description of Artificial Sequence: Synthetic polypeptide
DEEEIATTNPVAYEQYGSVATNLQATPDGMAGN

SEQ ID NO: 93834 - protein, 34 aa, Artificial Sequence
  Description of Artificial Sequence: Synthetic polypeptide
DEEEIRTTNPVATEQYGSVCATNPEPTGDSLENG

SEQ ID NO: 93835 - protein, 34 aa, Artificial Sequence
  Description of Artificial Sequence: Synthetic polypeptide
DEEEIRTTNPVATEQYGSVCATNPEPTGDLENDA

SEQ ID NO: 93836 - protein, 35 aa, Artificial Sequence
  Description of Artificial Sequence: Synthetic polypeptide
DEEEIRTTNPVATEQYGSVCATNPEPGQEHGNEAM

SEQ ID NO: 93837 - protein, 28 aa, Artificial Sequence
  Description of Artificial Sequence: Synthetic peptide
QENEIATTNPVATEAYGTVSEELQQEEL

SEQ ID NO: 93838 - protein, 28 aa, Artificial Sequence
  Description of Artificial Sequence: Synthetic peptide
QENEIATTNPVATEAYGVVSEALQHEEL

SEQ ID NO: 93839 - protein, 34 aa, Artificial Sequence
  Description of Artificial Sequence: Synthetic polypeptide
DEEEIRTTNPVATEQYGSVCATNPEADGNQTEGT

SEQ ID NO: 93840 - protein, 35 aa, Artificial Sequence
  Description of Artificial Sequence: Synthetic polypeptide
DEEEIRTTNPVATEQYGSVCATNNQDNPDDGGERA

SEQ ID NO: 93841 - protein, 33 aa, Artificial Sequence
  Description of Artificial Sequence: Synthetic polypeptide
DEEEIATTNPVAYEQYGSVATNNMTQTRNGDEQ

SEQ ID NO: 93842 - protein, 32 aa, Artificial Sequence
  Description of Artificial Sequence: Synthetic polypeptide
DEEEIATTNPVAYEQYGSVATPHLQDSDGSEH

SEQ ID NO: 93843 - protein, 28 aa, Artificial Sequence
  Description of Artificial Sequence: Synthetic peptide
QENEIATTNPVATECWGSVSCCLQHEEL

SEQ ID NO: 93844 - protein, 28 aa, Artificial Sequence
  Description of Artificial Sequence: Synthetic peptide
QENEIATTNPVATECWGSVSECLQHEEL

SEQ ID NO: 93845 - protein, 33 aa, Artificial Sequence
  Description of Artificial Sequence: Synthetic polypeptide
DEEEIATTNPVAYEQYGSVCAANPLQEADNMRN

SEQ ID NO: 93846 - protein, 28 aa, Artificial Sequence
  Description of Artificial Sequence: Synthetic peptide
QENEIATTNPVATECYGAVSEALQHEEL

SEQ ID NO: 93847 - protein, 28 aa, Artificial Sequence
  Description of Artificial Sequence: Synthetic peptide
QENEIATTNPVATECYGAVSECLQHEEL

SEQ ID NO: 93848 - protein, 28 aa, Artificial Sequence
  Description of Artificial Sequence: Synthetic peptide
QENEIATTNPVATECYGAVSECLQTEEL

SEQ ID NO: 93849 - protein, 28 aa, Artificial Sequence
  Description of Artificial Sequence: Synthetic peptide
QENEIATTNPVATECYGAVSPCLQHEEL

SEQ ID NO: 93850 - protein, 34 aa, Artificial Sequence
  Description of Artificial Sequence: Synthetic polypeptide
DEEEIRTTNPVATEQYGSVCATGLAPDNQMEGMD

SEQ ID NO: 93851 - protein, 33 aa, Artificial Sequence
  Description of Artificial Sequence: Synthetic polypeptide
DEEEIRTTNPVATEQYGSVCATDPPTDDGGENY

SEQ ID NO: 93852 - protein, 33 aa, Artificial Sequence
  Description of Artificial Sequence: Synthetic polypeptide
DEEEIRTTNPVATEQYGSVCATDPPTDDGDNDP

SEQ ID NO: 93853 - protein, 28 aa, Artificial Sequence
  Description of Artificial Sequence: Synthetic peptide
QENEIATTNPVATECYGCVSEALQHVEL

SEQ ID NO: 93854 - protein, 28 aa, Artificial Sequence
  Description of Artificial Sequence: Synthetic peptide
QENEIATTNPVATECYGCVSECLQHEEL

SEQ ID NO: 93855 - protein, 34 aa, Artificial Sequence
  Description of Artificial Sequence: Synthetic polypeptide
DEEEIRTTNPVATEQYGSVCATNPEQPMNQTEGT

SEQ ID NO: 93856 - protein, 34 aa, Artificial Sequence
  Description of Artificial Sequence: Synthetic polypeptide
DEEEIRTTNPVATEQYGSVCATNPEQQRDQTEGA

SEQ ID NO: 93857 - protein, 35 aa, Artificial Sequence
  Description of Artificial Sequence: Synthetic polypeptide
DEEEIRTTNPVATEQYGSVCATNPEQQRNQTEGTM

SEQ ID NO: 93858 - protein, 35 aa, Artificial Sequence
  Description of Artificial Sequence: Synthetic polypeptide
DEEEIRTTNPVATEQYGSVCATNPMQQRNQNQGTV

SEQ ID NO: 93859 - protein, 33 aa, Artificial Sequence
  Description of Artificial Sequence: Synthetic polypeptide
DEEEIRTTNPVATEQYGSVCFPNWESSQGENVQ

SEQ ID NO: 93860 - protein, 28 aa, Artificial Sequence
  Description of Artificial Sequence: Synthetic peptide
QENEIATTNPVASECYGIVSENLQSEEL

SEQ ID NO: 93861 - protein, 33 aa, Artificial Sequence
  Description of Artificial Sequence: Synthetic polypeptide
DEEEIATTNPVAYEQYGSVATNLQDAPDGSADN

SEQ ID NO: 93862 - protein, 35 aa, Artificial Sequence
  Description of Artificial Sequence: Synthetic polypeptide
DEEEIRTTNPVATEQYGSVCETNSLLIQVGEMEVQ

SEQ ID NO: 93863 - protein, 33 aa, Artificial Sequence
  Description of Artificial Sequence: Synthetic polypeptide
DEEEIATTNPVAYEQYGSVATNLQDGAPAEGKN

SEQ ID NO: 93864 - protein, 34 aa, Artificial Sequence
  Description of Artificial Sequence: Synthetic polypeptide
DEEEIRTTNPVATEQYGSVCETIILQDRVMEAEE

SEQ ID NO: 93865 - protein, 34 aa, Artificial Sequence
  Description of Artificial Sequence: Synthetic polypeptide
AEEEIRTTNPVATEQYGSVSTVVNQQQQQETNTN

SEQ ID NO: 93866 - protein, 34 aa, Artificial Sequence
  Description of Artificial Sequence: Synthetic polypeptide
DEEEIRTTNPVATEQYGSVCEESGLQRQLNTQIF

SEQ ID NO: 93867 - protein, 28 aa, Artificial Sequence
  Description of Artificial Sequence: Synthetic peptide
QENEIATTNPVATEAYGAVSETLQHEEL

SEQ ID NO: 93868 - protein, 28 aa, Artificial Sequence
  Description of Artificial Sequence: Synthetic peptide
QENEIATTNPVATEAYGCVSEHLQHEEL

SEQ ID NO: 93869 - protein, 35 aa, Artificial Sequence
  Description of Artificial Sequence: Synthetic polypeptide
DEEEIRTTNPVATEQYGSVCFTNLVIQQQGELSEL

SEQ ID NO: 93870 - protein, 32 aa, Artificial Sequence
  Description of Artificial Sequence: Synthetic polypeptide
DEEEIATTNPVAYEQYGSVATNLQGPDDSLEN

SEQ ID NO: 93871 - protein, 34 aa, Artificial Sequence
  Description of Artificial Sequence: Synthetic polypeptide
DEEEIRTTNPVATEQYGSVCCTLELPQRNEEPFE

SEQ ID NO: 93872 - protein, 33 aa, Artificial Sequence
  Description of Artificial Sequence: Synthetic polypeptide
DEEEIATTNPVAYEQYGSVATNLQGTPDGSAEN

SEQ ID NO: 93873 - protein, 33 aa, Artificial Sequence
  Description of Artificial Sequence: Synthetic polypeptide
DEEEIATTNPVAYEQYGSVATNLQGTPDGSMEN

SEQ ID NO: 93874 - protein, 33 aa, Artificial Sequence
  Description of Artificial Sequence: Synthetic polypeptide
DEEEIATTNPVAYEQYGSVATNLQMTPGEDQMG

SEQ ID NO: 93875 - protein, 28 aa, Artificial Sequence
  Description of Artificial Sequence: Synthetic peptide
QENEIATTNPVATEAYGCVSEPLQHIEL

SEQ ID NO: 93876 - protein, 28 aa, Artificial Sequence
  Description of Artificial Sequence: Synthetic peptide
QENEIATTNPVATEAYGDVSECLQHEEL

SEQ ID NO: 93877 - protein, 28 aa, Artificial Sequence
  Description of Artificial Sequence: Synthetic peptide
QENEIATTNPVATEAYGDVSECLQHVEL

SEQ ID NO: 93878 - protein, 28 aa, Artificial Sequence
  Description of Artificial Sequence: Synthetic peptide
QENEIATTNPVATEAYGDVSIPLQHMEL

SEQ ID NO: 93879 - protein, 33 aa, Artificial Sequence
  Description of Artificial Sequence: Synthetic polypeptide
DEEEIRTTNPVATEQYGSVCATNSEQLIILEIE

SEQ ID NO: 93880 - protein, 28 aa, Artificial Sequence
  Description of Artificial Sequence: Synthetic peptide
QENEIATTNPVATEAYGDVSPCLQHEEL

SEQ ID NO: 93881 - protein, 33 aa, Artificial Sequence
  Description of Artificial Sequence: Synthetic polypeptide
DEEEIATTNPVAYEQYGSVATNLQGTPDGQDVN

SEQ ID NO: 93882 - protein, 28 aa, Artificial Sequence
  Description of Artificial Sequence: Synthetic peptide
QEGEIAPTNPVGSEQYGIVSCNLQSGTI

SEQ ID NO: 93883 - protein, 28 aa, Artificial Sequence
  Description of Artificial Sequence: Synthetic peptide
QENEIAPTNPVATECYGIVSCCLQHGTL

SEQ ID NO: 93884 - protein, 33 aa, Artificial Sequence
  Description of Artificial Sequence: Synthetic polypeptide
DEEEIATTNPVAYEQYGSCATNLQDTPDGNDNH

SEQ ID NO: 93885 - protein, 30 aa, Artificial Sequence
  Description of Artificial Sequence: Synthetic polypeptide
QEMEIAPTNPVSTEQYGIVSACNLVQSGND

SEQ ID NO: 93886 - protein, 33 aa, Artificial Sequence
  Description of Artificial Sequence: Synthetic polypeptide
DEEEIATTNPVAYEQWGSVVSTGNSGNDAGNHR

SEQ ID NO: 93887 - protein, 34 aa, Artificial Sequence
  Description of Artificial Sequence: Synthetic polypeptide
DEEEIATTNPVAYEQWGSVVTTTNLPQGNSGNER

SEQ ID NO: 93888 - protein, 28 aa, Artificial Sequence
  Description of Artificial Sequence: Synthetic peptide
QEMEIASTNPCSYEQYGVVSANLQSGTR

SEQ ID NO: 93889 - protein, 29 aa, Artificial Sequence
  Description of Artificial Sequence: Synthetic peptide
QEMEIASTNPVATEGYGVVSASTLQFGNI

SEQ ID NO: 93890 - protein, 32 aa, Artificial Sequence
  Description of Artificial Sequence: Synthetic polypeptide
DEEEIATTNPVAYEQWGSYWSTINELQDENKQ

SEQ ID NO: 93891 - protein, 29 aa, Artificial Sequence
  Description of Artificial Sequence: Synthetic peptide
QEMEIASTNPVATEGYGVVSASTLQHGNI

SEQ ID NO: 93892 - protein, 30 aa, Artificial Sequence
  Description of Artificial Sequence: Synthetic polypeptide
QEMEIASTNPVATEQYGTVSASTLQFEGNI

SEQ ID NO: 93893 - protein, 29 aa, Artificial Sequence
  Description of Artificial Sequence: Synthetic peptide
QEMEIATTNPCSSEQYGIVSTGLQSEGTR

SEQ ID NO: 93894 - protein, 28 aa, Artificial Sequence
  Description of Artificial Sequence: Synthetic peptide
QEMEIATTNPVATECYGDVSECLQHEEL

SEQ ID NO: 93895 - protein, 28 aa, Artificial Sequence
  Description of Artificial Sequence: Synthetic peptide
QEMEIATTNPVATECYGDVSEGLQHEEL

SEQ ID NO: 93896 - protein, 29 aa, Artificial Sequence
  Description of Artificial Sequence: Synthetic peptide
QEMEIATTNPVATECYGTVSECLVQHGEL

SEQ ID NO: 93897 - protein, 32 aa, Artificial Sequence
  Description of Artificial Sequence: Synthetic polypeptide
DEEEIATTNPVAYEQWGTVSTNLQGDQGGDDH

SEQ ID NO: 93898 - protein, 30 aa, Artificial Sequence
  Description of Artificial Sequence: Synthetic polypeptide
QEMEIATTNPVATEQYGEVSTDGPEHEGNK

SEQ ID NO: 93899 - protein, 34 aa, Artificial Sequence
  Description of Artificial Sequence: Synthetic polypeptide
DEEEIRTTNPVATEQYGSVCSNTELTEFFNSNQP

SEQ ID NO: 93900 - protein, 31 aa, Artificial Sequence
  Description of Artificial Sequence: Synthetic polypeptide
QEMEIATTNPVATEQYGTVCSASTLQFEGNI

SEQ ID NO: 93901 - protein, 31 aa, Artificial Sequence
  Description of Artificial Sequence: Synthetic polypeptide
QEMEIATTNPVATEQYGTVCSTTLVEFEGNI

SEQ ID NO: 93902 - protein, 35 aa, Artificial Sequence
  Description of Artificial Sequence: Synthetic polypeptide
AEEEIRTTNPVATEQYGSVSTVVSNQQIGNNNATD

SEQ ID NO: 93903 - protein, 29 aa, Artificial Sequence
  Description of Artificial Sequence: Synthetic peptide
QEMEIVSTNPVATEGYGTVCSTGPQHGND

SEQ ID NO: 93904 - protein, 30 aa, Artificial Sequence
  Description of Artificial Sequence: Synthetic polypeptide
QEMEIVSTNPVATEQYGTVSSDGLVQFGND

SEQ ID NO: 93905 - protein, 29 aa, Artificial Sequence
  Description of Artificial Sequence: Synthetic peptide
QEMEIVSTNPVATEQYGVVSTGLVEHGDD

SEQ ID NO: 93906 - protein, 31 aa, Artificial Sequence
  Description of Artificial Sequence: Synthetic polypeptide
DEEEIATTNPVAYEQWGSVTTNHGGEDGNNK

SEQ ID NO: 93907 - protein, 32 aa, Artificial Sequence
  Description of Artificial Sequence: Synthetic polypeptide
DEEEIATTNPVAYEQWGSVTTENQGGEDGNNR

SEQ ID NO: 93908 - protein, 28 aa, Artificial Sequence
  Description of Artificial Sequence: Synthetic peptide
QEMEIAPTNPCSYEQYGTVSSNLQSGTR

SEQ ID NO: 93909 - protein, 29 aa, Artificial Sequence
  Description of Artificial Sequence: Synthetic peptide
QEMEIAPTNPCSTEQYGIVSCNLVQSGND

SEQ ID NO: 93910 - protein, 28 aa, Artificial Sequence
  Description of Artificial Sequence: Synthetic peptide
QEHEIATTNPVATECYGDVSECLQHEEL

SEQ ID NO: 93911 - protein, 33 aa, Artificial Sequence
  Description of Artificial Sequence: Synthetic polypeptide
DEEEIATTNPVAYEQWGSVSTTNGAGEGGDNSR

SEQ ID NO: 93912 - protein, 32 aa, Artificial Sequence
  Description of Artificial Sequence: Synthetic polypeptide
QEHEIATTNPVAYEQYGSVSGNLPQQTGNDLL

SEQ ID NO: 93913 - protein, 28 aa, Artificial Sequence
  Description of Artificial Sequence: Synthetic peptide
QEHEIVTTNPVATECYGDVSECLQHEEL

SEQ ID NO: 93914 - protein, 28 aa, Artificial Sequence
  Description of Artificial Sequence: Synthetic peptide
QEIEIAPTNPCSSEQYGIVSCNLQSGTR

SEQ ID NO: 93915 - protein, 28 aa, Artificial Sequence
  Description of Artificial Sequence: Synthetic peptide
QEIEIATTNPVATECYGDVSECLQHEEL

SEQ ID NO: 93916 - protein, 28 aa, Artificial Sequence
  Description of Artificial Sequence: Synthetic peptide
QEKEIAPTNPCSSEQYGIVSCNLQSGTR

SEQ ID NO: 93917 - protein, 35 aa, Artificial Sequence
  Description of Artificial Sequence: Synthetic polypeptide
DEEEIRTTNPVATEQYGSVCSPINNLERNEDTQER

SEQ ID NO: 93918 - protein, 28 aa, Artificial Sequence
  Description of Artificial Sequence: Synthetic peptide
QEKEIATTNPVATECYGDVSECLQHEEL

SEQ ID NO: 93919 - protein, 28 aa, Artificial Sequence
  Description of Artificial Sequence: Synthetic peptide
QELEIAPTNPCSSEQYGIVSCNLQSGTR

SEQ ID NO: 93920 - protein, 35 aa, Artificial Sequence
  Description of Artificial Sequence: Synthetic polypeptide
DEEEIRTTNPVATEQYGSVCSMTGPNGPPPGQENP

SEQ ID NO: 93921 - protein, 28 aa, Artificial Sequence
  Description of Artificial Sequence: Synthetic peptide
QELEIATTNPVATECYGDVSECLQHEEL

SEQ ID NO: 93922 - protein, 28 aa, Artificial Sequence
  Description of Artificial Sequence: Synthetic peptide
QELEIATTNPVATECYGWVSECLQHEEL

SEQ ID NO: 93923 - protein, 28 aa, Artificial Sequence
  Description of Artificial Sequence: Synthetic peptide
QEMEIACTNPCSSEQYGCVSANLQSGDR

SEQ ID NO: 93924 - protein, 32 aa, Artificial Sequence
  Description of Artificial Sequence: Synthetic polypeptide
DEEEIATTNPVAYEQWGSVSTTNGDNAGNGDL

SEQ ID NO: 93925 - protein, 32 aa, Artificial Sequence
  Description of Artificial Sequence: Synthetic polypeptide
DEEEIATTNPVAYEQWGSVSTTNGGQAGGDAV

SEQ ID NO: 93926 - protein, 34 aa, Artificial Sequence
  Description of Artificial Sequence: Synthetic polypeptide
DEEEIATTNPVAYEQWGSVSTTNGLAGEGGDNGR

SEQ ID NO: 93927 - protein, 28 aa, Artificial Sequence
  Description of Artificial Sequence: Synthetic peptide
QEMEIAGTNPCSYEQYGIVSCNLQSGQR

SEQ ID NO: 93928 - protein, 28 aa, Artificial Sequence
  Description of Artificial Sequence: Synthetic peptide
QEMEIAPTNPCSCEQYGCVSCNLQSGTR

SEQ ID NO: 93929 - protein, 32 aa, Artificial Sequence
  Description of Artificial Sequence: Synthetic polypeptide
DEEEIATTNPVAYEQWGSVTGDHNAQRGDNEQ

SEQ ID NO: 93930 - protein, 28 aa, Artificial Sequence
  Description of Artificial Sequence: Synthetic peptide
QEMEIAPTNPCSHEQYGIVSCNLQSGTR

SEQ ID NO: 93931 - protein, 28 aa, Artificial Sequence
  Description of Artificial Sequence: Synthetic peptide
QEMEIAPTNPCSSEQYGIVSCNLQSGTR

SEQ ID NO: 93932 - protein, 28 aa, Artificial Sequence
  Description of Artificial Sequence: Synthetic peptide
QELEIATTNPVATECYGGVSECLQHEEM

SEQ ID NO: 93933 - protein, 28 aa, Artificial Sequence
  Description of Artificial Sequence: Synthetic peptide
QENEIAPTNPVATECYGIVSCCLQHGEL

SEQ ID NO: 93934 - protein, 32 aa, Artificial Sequence
  Description of Artificial Sequence: Synthetic polypeptide
QEMEIVTTNPVATEQYGTVSATDGLVQFEGND

SEQ ID NO: 93935 - protein, 33 aa, Artificial Sequence
  Description of Artificial Sequence: Synthetic polypeptide
DEEEIATTNPVAYEQYGCVATNLQDTPDGNANN

SEQ ID NO: 93936 - protein, 35 aa, Artificial Sequence
  Description of Artificial Sequence: Synthetic polypeptide
DEEEIRTTNPVATEQYGSVCSANPEPAQEHGNEAM

SEQ ID NO: 93937 - protein, 33 aa, Artificial Sequence
  Description of Artificial Sequence: Synthetic polypeptide
DEEEIATTNPVAYEQYGSACSATNDIPQDNGNQ

SEQ ID NO: 93938 - protein, 33 aa, Artificial Sequence
  Description of Artificial Sequence: Synthetic polypeptide
DEEEIRTTNPVATEQYGSVCSADLESMIENVFN

SEQ ID NO: 93939 - protein, 28 aa, Artificial Sequence
  Description of Artificial Sequence: Synthetic peptide
QENEIACTNPVGTEGYGEMAENLQRGDR

SEQ ID NO: 93940 - protein, 28 aa, Artificial Sequence
  Description of Artificial Sequence: Synthetic peptide
QENEIACTNPVGTEGYGVMSENLQHGDR

SEQ ID NO: 93941 - protein, 34 aa, Artificial Sequence
  Description of Artificial Sequence: Synthetic polypeptide
DEEEIRTTNPVATEQYGSVCQTNDDINTGMQNLQ

SEQ ID NO: 93942 - protein, 33 aa, Artificial Sequence
  Description of Artificial Sequence: Synthetic polypeptide
DEEEIRTTNPVATEQYGSVCQTGEHQNFGSDQA

SEQ ID NO: 93943 - protein, 33 aa, Artificial Sequence
  Description of Artificial Sequence: Synthetic polypeptide
DEEEIRTTNPVATEQYGSVCQTEHQNFGSETQA

SEQ ID NO: 93944 - protein, 35 aa, Artificial Sequence
  Description of Artificial Sequence: Synthetic polypeptide
AEEEIRTTNPVATEQYGSVSTVVQNGNQGGNNETS

SEQ ID NO: 93945 - protein, 31 aa, Artificial Sequence
  Description of Artificial Sequence: Synthetic polypeptide
DEEEIRTTNPVATEQYGSVCPYDELTGAQSE

SEQ ID NO: 93946 - protein, 28 aa, Artificial Sequence
  Description of Artificial Sequence: Synthetic peptide
QENEIAPTNPCSSEQYGDVSCNLQSGTR

SEQ ID NO: 93947 - protein, 28 aa, Artificial Sequence
  Description of Artificial Sequence: Synthetic peptide
QENEIAPTNPCSSEQYGEVSCNLQSGGR

SEQ ID NO: 93948 - protein, 35 aa, Artificial Sequence
  Description of Artificial Sequence: Synthetic polypeptide
DEEEIRTTNPVATEQYGSVCPTNNLEFRNGDIESF

SEQ ID NO: 93949 - protein, 28 aa, Artificial Sequence
  Description of Artificial Sequence: Synthetic peptide
QENEIAPTNPCSSEQYGIVSCNLQAGTR

SEQ ID NO: 93950 - protein, 28 aa, Artificial Sequence
  Description of Artificial Sequence: Synthetic peptide
QENEIAPTNPCSSEQYGIVSCNLQSGTR

SEQ ID NO: 93951 - protein, 28 aa, Artificial Sequence
  Description of Artificial Sequence: Synthetic peptide
QENEIAPTNPCSSEQYGIVSENLQSGTR

SEQ ID NO: 93952 - protein, 28 aa, Artificial Sequence
  Description of Artificial Sequence: Synthetic peptide
QENEIAPTNPCSSEQYGMVSCNLQSGTR

SEQ ID NO: 93953 - protein, 28 aa, Artificial Sequence
  Description of Artificial Sequence: Synthetic peptide
QENEIAPTNPCSYEQYGIVSANLQSGTR

SEQ ID NO: 93954 - protein, 28 aa, Artificial Sequence
  Description of Artificial Sequence: Synthetic peptide
QENEIAPTNPESSEQYGIVSCNLQSGTR

SEQ ID NO: 93955 - protein, 28 aa, Artificial Sequence
  Description of Artificial Sequence: Synthetic peptide
QENEIAPTNPVASEQYGIVSENLQSETL

SEQ ID NO: 93956 - protein, 34 aa, Artificial Sequence
  Description of Artificial Sequence: Synthetic polypeptide
DEEEIRTTNPVATEQYGSVCPPANLEQVINALQE

SEQ ID NO: 93957 - protein, 35 aa, Artificial Sequence
  Description of Artificial Sequence: Synthetic polypeptide
AEEEIRTTNPVATEQYGSVSTVVSNGNQGGNNTTQ

SEQ ID NO: 93958 - protein, 33 aa, Artificial Sequence
  Description of Artificial Sequence: Synthetic polypeptide
DEEEIRTTNPVATEQYGSVCSATGLDTVFVEEN

SEQ ID NO: 93959 - protein, 36 aa, Artificial Sequence
  Description of Artificial Sequence: Synthetic polypeptide
DEEEIRTTNPVATEQYGSVCSATMNGEQTAEGPQNM

SEQ ID NO: 93960 - protein, 35 aa, Artificial Sequence
  Description of Artificial Sequence: Synthetic polypeptide
DEEEIRTTNPVATEQYGSVCSATNLLLMIVGDEEQ

SEQ ID NO: 93961 - protein, 31 aa, Artificial Sequence
  Description of Artificial Sequence: Synthetic polypeptide
QEMEIVTTNPVATEQYGTVSTDNPVEFEGND

SEQ ID NO: 93962 - protein, 33 aa, Artificial Sequence
  Description of Artificial Sequence: Synthetic polypeptide
DEEEIATTNPVAYEQYGQCVSCINFEQRTGGTR

SEQ ID NO: 93963 - protein, 35 aa, Artificial Sequence
  Description of Artificial Sequence: Synthetic polypeptide
DEEEIATTNPVAYEQYGQSTVSYQTNESSQRGIDR

SEQ ID NO: 93964 - protein, 34 aa, Artificial Sequence
  Description of Artificial Sequence: Synthetic polypeptide
DEEEIRTTNPVATEQYGSVCSLANLEVRVLDSLA

SEQ ID NO: 93965 - protein, 28 aa, Artificial Sequence
  Description of Artificial Sequence: Synthetic peptide
QENEIACTNPCASEQYGEASCNLQSGTR

SEQ ID NO: 93966 - protein, 28 aa, Artificial Sequence
  Description of Artificial Sequence: Synthetic peptide
QENEIACTNPCSSEQYGEVSCNLQSGGR

SEQ ID NO: 93967 - protein, 33 aa, Artificial Sequence
  Description of Artificial Sequence: Synthetic polypeptide
DEEEIRTTNPVATEQYGSVCSEYTLETADDNQI

SEQ ID NO: 93968 - protein, 28 aa, Artificial Sequence
  Description of Artificial Sequence: Synthetic peptide
QENEIACTNPCSYEQYGEVSSNLQSGTR

SEQ ID NO: 93969 - protein, 28 aa, Artificial Sequence
  Description of Artificial Sequence: Synthetic peptide
QENEIACTNPCSYEQYGVVSCNLQSGQR

SEQ ID NO: 93970 - protein, 29 aa, Artificial Sequence
  Description of Artificial Sequence: Synthetic peptide
QENEIACTNPCSYEQYGVVSWNLQSGTNR

SEQ ID NO: 93971 - protein, 31 aa, Artificial Sequence
  Description of Artificial Sequence: Synthetic polypeptide
QEMEIVTTNPVATEQYGTVSSDGLVQFEGND

SEQ ID NO: 93972 - protein, 35 aa, Artificial Sequence
  Description of Artificial Sequence: Synthetic polypeptide
DEEEIRTTNPVATEQYGSVCSETEGVLDTRGVEEN

SEQ ID NO: 93973 - protein, 28 aa, Artificial Sequence
  Description of Artificial Sequence: Synthetic peptide
QENEIACTNPVATECYGDVSENLMHGEL

SEQ ID NO: 93974 - protein, 28 aa, Artificial Sequence
  Description of Artificial Sequence: Synthetic peptide
QENEIACTNPVATECYGSVSECLMHEER

SEQ ID NO: 93975 - protein, 36 aa, Artificial Sequence
  Description of Artificial Sequence: Synthetic polypeptide
AEEEIRTTNPVATEQYGSVSTVVSNLGNQEGTNVTD

SEQ ID NO: 93976 - protein, 28 aa, Artificial Sequence
  Description of Artificial Sequence: Synthetic peptide
QENEIACTNPVATEQYGDASECLQREEL

SEQ ID NO: 93977 - protein, 28 aa, Artificial Sequence
  Description of Artificial Sequence: Synthetic peptide
QENEIACTNPVATEQYGDVSECLQHEEL

SEQ ID NO: 93978 - protein, 34 aa, Artificial Sequence
  Description of Artificial Sequence: Synthetic polypeptide
DEEEIRTTNPVATEQYGSVCSDTEDHQNFGSDQA

SEQ ID NO: 93979 - protein, 28 aa, Artificial Sequence
  Description of Artificial Sequence: Synthetic peptide
QENEIACTNPVATEQYGDVSECLQHEGL

SEQ ID NO: 93980 - protein, 28 aa, Artificial Sequence
  Description of Artificial Sequence: Synthetic peptide
QENEIACTNPVATEQYGEAPEVLQRGEK

SEQ ID NO: 93981 - protein, 36 aa, Artificial Sequence
  Description of Artificial Sequence: Synthetic polypeptide
DEEEIRTTNPVATEQYGSVCSAWPNGEQEMMGPENR

SEQ ID NO: 93982 - protein, 28 aa, Artificial Sequence
  Description of Artificial Sequence: Synthetic peptide
QENEIACTNPVATEQYGEASENLQHEGL

SEQ ID NO: 93983 - protein, 28 aa, Artificial Sequence
  Description of Artificial Sequence: Synthetic peptide
QENEIACTNPVATECYGDVSECLQREEL

SEQ ID NO: 93984 - protein, 31 aa, Artificial Sequence
  Description of Artificial Sequence: Synthetic polypeptide
DEEEIRTTNPCATEEYGCVCATNHARGSDAA

SEQ ID NO: 93985 - protein, 35 aa, Artificial Sequence
  Description of Artificial Sequence: Synthetic polypeptide
AEEEIRTTNPVATEQYGSVSTTNNQLGGNNGNIQE

SEQ ID NO: 93986 - protein, 35 aa, Artificial Sequence
  Description of Artificial Sequence: Synthetic polypeptide
AEEEIRTTNPVATEQYGSVSTTNNQLEQGNNNNNF

SEQ ID NO: 93987 - protein, 33 aa, Artificial Sequence
  Description of Artificial Sequence: Synthetic polypeptide
VEDEIRTTNPVATEQYGSVMSNGNLDEFGGNIG

SEQ ID NO: 93988 - protein, 32 aa, Artificial Sequence
  Description of Artificial Sequence: Synthetic polypeptide
VEDEVATTNPVATAQWGSVSTGNLDQDDGNRM

SEQ ID NO: 93989 - protein, 28 aa, Artificial Sequence
  Description of Artificial Sequence: Synthetic peptide
AEEEIACTNPVATEQYGEAPEVCQREER

SEQ ID NO: 93990 - protein, 28 aa, Artificial Sequence
  Description of Artificial Sequence: Synthetic peptide
AEEEIACTNPVATEQYGEAPENLQHEEK

SEQ ID NO: 93991 - protein, 34 aa, Artificial Sequence
  Description of Artificial Sequence: Synthetic polypeptide
VEDEVRTTNPVAYEQWGSVCSTWNHLDQREGNER

SEQ ID NO: 93992 - protein, 35 aa, Artificial Sequence
  Description of Artificial Sequence: Synthetic polypeptide
VEECIRTTNPVAYEQYGQHVVSCTENLSQRGTNNR

SEQ ID NO: 93993 - protein, 33 aa, Artificial Sequence
  Description of Artificial Sequence: Synthetic polypeptide
DEEEIRTTNPVATEAYGVVSTSNTNTEQGNNNF

SEQ ID NO: 93994 - protein, 35 aa, Artificial Sequence
  Description of Artificial Sequence: Synthetic polypeptide
VEECIRTTNPVAYEQYGQHVVSTNLSQERTGTNNR

SEQ ID NO: 93995 - protein, 31 aa, Artificial Sequence
  Description of Artificial Sequence: Synthetic polypeptide
VEEEIACTNPVATEQWGNVSVTMLNGAGENR

SEQ ID NO: 93996 - protein, 32 aa, Artificial Sequence
  Description of Artificial Sequence: Synthetic polypeptide
VEEEIACTNPVATEQYGSCSTHLQPDDQGGRM

SEQ ID NO: 93997 - protein, 30 aa, Artificial Sequence
  Description of Artificial Sequence: Synthetic polypeptide
VEEEIACTNPVATEQYGSVATALINMMTRD

SEQ ID NO: 93998 - protein, 34 aa, Artificial Sequence
  Description of Artificial Sequence: Synthetic polypeptide
DEEEIRTTNPVATEQYGCVAGTNGHQEPDMGIRD

SEQ ID NO: 93999 - protein, 32 aa, Artificial Sequence
  Description of Artificial Sequence: Synthetic polypeptide
DEEEIRTTNPVATEQYGCVAGTNGHGERDMIF

SEQ ID NO: 94000 - protein, 32 aa, Artificial Sequence
  Description of Artificial Sequence: Synthetic polypeptide
VEEEIACTNPVATEQYGSVATNLDNPGENAEE

SEQ ID NO: 94001 - protein, 34 aa, Artificial Sequence
  Description of Artificial Sequence: Synthetic polypeptide
DEEEIRTTNPVATEQYGCVAGTNEHQERDMDIGR

SEQ ID NO: 94002 - protein, 31 aa, Artificial Sequence
  Description of Artificial Sequence: Synthetic polypeptide
VEEEIACTNPVATEQYGSVATNLEQPSVEED

SEQ ID NO: 94003 - protein, 32 aa, Artificial Sequence
  Description of Artificial Sequence: Synthetic polypeptide
DEEEIRTTNPVATEQYGCVAGFNNHQEPDMIR

SEQ ID NO: 94004 - protein, 32 aa, Artificial Sequence
  Description of Artificial Sequence: Synthetic polypeptide
VEEEIACTNPVATEQYGSVATNLQGNPMEGDP

SEQ ID NO: 94005 - protein, 34 aa, Artificial Sequence
  Description of Artificial Sequence: Synthetic polypeptide
VEEEIACTNPVATEQYGSVATNNLPQEAGENERD

SEQ ID NO: 94006 - protein, 33 aa, Artificial Sequence
  Description of Artificial Sequence: Synthetic polypeptide
DEEEIRTTNPVATEQYGCVADTWHAQARSDNTA

SEQ ID NO: 94007 - protein, 29 aa, Artificial Sequence
  Description of Artificial Sequence: Synthetic peptide
VEEEIASVNPVCTEQYGVVSDNLQSHGDQ

SEQ ID NO: 94008 - protein, 33 aa, Artificial Sequence
  Description of Artificial Sequence: Synthetic polypeptide
VEDEIRTTNPVATEQYGSVDTMNLQNIGGGQGG

SEQ ID NO: 94009 - protein, 33 aa, Artificial Sequence
  Description of Artificial Sequence: Synthetic polypeptide
DEEEIRTTNPVATEQYGCVAATNDQATAENNTM

SEQ ID NO: 94010 - protein, 30 aa, Artificial Sequence
  Description of Artificial Sequence: Synthetic polypeptide
VEDEIATTNPVAYEQYGSVATNLTNGDIDQ

SEQ ID NO: 94011 - protein, 30 aa, Artificial Sequence
  Description of Artificial Sequence: Synthetic polypeptide
VEDEIATTNPVAYEQYGSVATNLQMNPEGE

SEQ ID NO: 94012 - protein, 31 aa, Artificial Sequence
  Description of Artificial Sequence: Synthetic polypeptide
VEDEIACTNPVATEQYGSVATNLQAEPEGGN

SEQ ID NO: 94013 - protein, 33 aa, Artificial Sequence
  Description of Artificial Sequence: Synthetic polypeptide
DEEEIRTTNPVATEQYGCVCGNTEHQNSGSNQG

SEQ ID NO: 94014 - protein, 32 aa, Artificial Sequence
  Description of Artificial Sequence: Synthetic polypeptide
VEDEIACTNPVAYEQYGSVATNLQDRGPNGEM

SEQ ID NO: 94015 - protein, 28 aa, Artificial Sequence
  Description of Artificial Sequence: Synthetic peptide
VEDEIASVNPVGTEQYGVVASNLQSGNQ

SEQ ID NO: 94016 - protein, 32 aa, Artificial Sequence
  Description of Artificial Sequence: Synthetic polypeptide
DEEEIRTTNPVATEQYGCVCFTEHQNFNSEQA

SEQ ID NO: 94017 - protein, 30 aa, Artificial Sequence
  Description of Artificial Sequence: Synthetic polypeptide
VEDEIATTNPVATEQYGCTATNLQGGDLSN

SEQ ID NO: 94018 - protein, 32 aa, Artificial Sequence
  Description of Artificial Sequence: Synthetic polypeptide
DEEEIRTTNPVATEQYGCVCETENHENFNSEQ

SEQ ID NO: 94019 - protein, 33 aa, Artificial Sequence
  Description of Artificial Sequence: Synthetic polypeptide
DEEEIRTTNPVATEQYGCVAWTTLNDDGMGDRH

SEQ ID NO: 94020 - protein, 30 aa, Artificial Sequence
  Description of Artificial Sequence: Synthetic polypeptide
VEDEIATTNPVAYEQYGSVAAANDDRGNPM

SEQ ID NO: 94021 - protein, 33 aa, Artificial Sequence
  Description of Artificial Sequence: Synthetic polypeptide
DEEEIRTTNPVATEAYGTVVVTVNLQQDEEENV

SEQ ID NO: 94022 - protein, 32 aa, Artificial Sequence
  Description of Artificial Sequence: Synthetic polypeptide
DEEEIRTTNPVATEQYGCVATNNGGVEERAAP

SEQ ID NO: 94023 - protein, 31 aa, Artificial Sequence
  Description of Artificial Sequence: Synthetic polypeptide
VEDEIATTNPVAYEQYGSVAANDQRGPNDQL

SEQ ID NO: 94024 - protein, 30 aa, Artificial Sequence
  Description of Artificial Sequence: Synthetic polypeptide
VEDEIATTNPVAYEQYGSVAATNDDQGNDD

SEQ ID NO: 94025 - protein, 29 aa, Artificial Sequence
  Description of Artificial Sequence: Synthetic peptide
VEDEIATTNPVAYEQYGSVAATNDTTGVD

SEQ ID NO: 94026 - protein, 32 aa, Artificial Sequence
  Description of Artificial Sequence: Synthetic polypeptide
VEDEIATTNPVAYEQYGSVATNLAQDSGDNDM

SEQ ID NO: 94027 - protein, 31 aa, Artificial Sequence
  Description of Artificial Sequence: Synthetic polypeptide
VEDEIATTNPVAYEQYGSVATNLQADPNDNN

SEQ ID NO: 94028 - protein, 32 aa, Artificial Sequence
  Description of Artificial Sequence: Synthetic polypeptide
DEEEIRTTNPVATEAYGVVDGTDQNQGGGNGG

SEQ ID NO: 94029 - protein, 31 aa, Artificial Sequence
  Description of Artificial Sequence: Synthetic polypeptide
VEDEIATTNPVAYEQYGSVATNLQANGTEHQ

SEQ ID NO: 94030 - protein, 32 aa, Artificial Sequence
  Description of Artificial Sequence: Synthetic polypeptide
VEDEIATTNPVAYEQYGSVATNLQDAGDNAEM

SEQ ID NO: 94031 - protein, 31 aa, Artificial Sequence
  Description of Artificial Sequence: Synthetic polypeptide
VEDEIATTNPVAYEQYGSVATNLQDNPEGMN

SEQ ID NO: 94032 - protein, 32 aa, Artificial Sequence
  Description of Artificial Sequence: Synthetic polypeptide
VEDEIATTNPVAYEQYGSVATNLQDRNPNGDM

SEQ ID NO: 94033 - protein, 28 aa, Artificial Sequence
  Description of Artificial Sequence: Synthetic peptide
AEEEIACTNPVATEQYGEASEVLQHEGK

SEQ ID NO: 94034 - protein, 34 aa, Artificial Sequence
  Description of Artificial Sequence: Synthetic polypeptide
DEEEIRTTNPVATEQYGCVAATALVQGEGTPDRV

SEQ ID NO: 94035 - protein, 32 aa, Artificial Sequence
  Description of Artificial Sequence: Synthetic polypeptide
VEEEIATTNPVATEQWGSVSAGNPDEAGNNRN

SEQ ID NO: 94036 - protein, 32 aa, Artificial Sequence
  Description of Artificial Sequence: Synthetic polypeptide
AEEEIACTNPVATEQYGCVATNLQNEMGNNQY

SEQ ID NO: 94037 - protein, 33 aa, Artificial Sequence
  Description of Artificial Sequence: Synthetic polypeptide
VEEEIRTTNPVATEQYGCVSTDNGQEEGGGEEG

SEQ ID NO: 94038 - protein, 31 aa, Artificial Sequence
  Description of Artificial Sequence: Synthetic polypeptide
AEEEIACTNPVATEAYGSVATNLFANPGQNY

SEQ ID NO: 94039 - protein, 34 aa, Artificial Sequence
  Description of Artificial Sequence: Synthetic polypeptide
VEEEIRTTNPVATEQYGCVSTDNNFEQGGGNDGE

SEQ ID NO: 94040 - protein, 34 aa, Artificial Sequence
  Description of Artificial Sequence: Synthetic polypeptide
VEEEIRTTNPVATEQYGDVGSNMNLEQGGEGNEQ

SEQ ID NO: 94041 - protein, 33 aa, Artificial Sequence
  Description of Artificial Sequence: Synthetic polypeptide
VEEEIRTTNPVATEQYGDVGSTDLIGGGDNQGE

SEQ ID NO: 94042 - protein, 33 aa, Artificial Sequence
  Description of Artificial Sequence: Synthetic polypeptide
VEEEIRTTNPVATEQYGDVSDGDNEQDEGGGND

SEQ ID NO: 94043 - protein, 33 aa, Artificial Sequence
  Description of Artificial Sequence: Synthetic polypeptide
VEEEIRTTNPVATEQYGDVSTGLTGFGGQNGGN

SEQ ID NO: 94044 - protein, 33 aa, Artificial Sequence
  Description of Artificial Sequence: Synthetic polypeptide
VEEEIRTTNPVATEQYGDVVSIDNEGQTGGGNI

SEQ ID NO: 94045 - protein, 33 aa, Artificial Sequence
  Description of Artificial Sequence: Synthetic polypeptide
VEEEIRTTNPVATEQYGDVVSSGFGNEGQGGNT

SEQ ID NO: 94046 - protein, 33 aa, Artificial Sequence
  Description of Artificial Sequence: Synthetic polypeptide
VEEEIRTTNPVATEQYGNVSSTGDEDQGGGGNE

SEQ ID NO: 94047 - protein, 34 aa, Artificial Sequence
  Description of Artificial Sequence: Synthetic polypeptide
VEEEIRTTNPVATEQYGNVVSGTMENGQGEGGND

SEQ ID NO: 94048 - protein, 33 aa, Artificial Sequence
  Description of Artificial Sequence: Synthetic polypeptide
VEEEIRTTNPVATEQYGSCQSTPNEIQEQEAIR

SEQ ID NO: 94049 - protein, 32 aa, Artificial Sequence
  Description of Artificial Sequence: Synthetic polypeptide
VEEEIRTTNPVATEQYGSTVSTETGMRTPEYL

SEQ ID NO: 94050 - protein, 34 aa, Artificial Sequence
  Description of Artificial Sequence: Synthetic polypeptide
VEEEIRTTNPVATEQYGSVDGTVNEGQTGGNGNI

SEQ ID NO: 94051 - protein, 34 aa, Artificial Sequence
  Description of Artificial Sequence: Synthetic polypeptide
VEEEIRTTNPVATEQYGSVDTNLIAGQEDGEGTT

SEQ ID NO: 94052 - protein, 34 aa, Artificial Sequence
  Description of Artificial Sequence: Synthetic polypeptide
DEEEIRTTNPVATEQYGCSCSWPEPLQRFDSNQS

SEQ ID NO: 94053 - protein, 33 aa, Artificial Sequence
  Description of Artificial Sequence: Synthetic polypeptide
DEEEIRTTNPVATEQYGCSCSWNEHQNFGSQQS

SEQ ID NO: 94054 - protein, 34 aa, Artificial Sequence
  Description of Artificial Sequence: Synthetic polypeptide
VEEEIRTTNPVATEQYGSVISTPDQQGENGQGEV

SEQ ID NO: 94055 - protein, 34 aa, Artificial Sequence
  Description of Artificial Sequence: Synthetic polypeptide
VEEEIRTTNPVATEQYGSVISTVDNGQGEFGAEE

SEQ ID NO: 94056 - protein, 34 aa, Artificial Sequence
  Description of Artificial Sequence: Synthetic polypeptide
VEEEIRTTNPVATEQYGSVNDTNDQQNGEGGNNT

SEQ ID NO: 94057 - protein, 32 aa, Artificial Sequence
  Description of Artificial Sequence: Synthetic polypeptide
VEEEIRTTNPVATEQYGSVNGDNGQGEGGETN

SEQ ID NO: 94058 - protein, 34 aa, Artificial Sequence
  Description of Artificial Sequence: Synthetic polypeptide
VEEEIRTTNPVATEQYGCVSTDNGFEQGGGNDGE

SEQ ID NO: 94059 - protein, 33 aa, Artificial Sequence
  Description of Artificial Sequence: Synthetic polypeptide
VEEEIRTTNPVATEQYGAVSGTNDGQIGGGEGQ

SEQ ID NO: 94060 - protein, 33 aa, Artificial Sequence
  Description of Artificial Sequence: Synthetic polypeptide
VEEEIRTTNPVATEQYGAVSGTLNGGQGTGGQG

SEQ ID NO: 94061 - protein, 33 aa, Artificial Sequence
  Description of Artificial Sequence: Synthetic polypeptide
VEEEIRTTNPVATEQYGAVSGTLNDQGGGEGQQ

SEQ ID NO: 94062 - protein, 33 aa, Artificial Sequence
  Description of Artificial Sequence: Synthetic polypeptide
VEEEIATTNPVATEQWGSVSTANGPDERGNMGE

SEQ ID NO: 94063 - protein, 31 aa, Artificial Sequence
  Description of Artificial Sequence: Synthetic polypeptide
AEEEIACTNPVATEQYGCVATNLQMNPDNGP

SEQ ID NO: 94064 - protein, 32 aa, Artificial Sequence
  Description of Artificial Sequence: Synthetic polypeptide
AEEEIACTNPVATEQYGCVATNLQMNPDNERM

SEQ ID NO: 94065 - protein, 32 aa, Artificial Sequence
  Description of Artificial Sequence: Synthetic polypeptide
VEEEIATTNPVATEQYGSCSTHLQPDDQMGDD

SEQ ID NO: 94066 - protein, 35 aa, Artificial Sequence
  Description of Artificial Sequence: Synthetic polypeptide
VEEEIATTNPVATEQYGSVAGTNNLPQEAGENARE

SEQ ID NO: 94067 - protein, 32 aa, Artificial Sequence
  Description of Artificial Sequence: Synthetic polypeptide
AEEEIACTNPVATEQYGCVATNLQGAGADVTR

SEQ ID NO: 94068 - protein, 35 aa, Artificial Sequence
  Description of Artificial Sequence: Synthetic polypeptide
DEEEIRTTNPVATEAYGVVSTTNNLNTQQGGNNTD

SEQ ID NO: 94069 - protein, 30 aa, Artificial Sequence
  Description of Artificial Sequence: Synthetic polypeptide
AEEEIACTNPVATEQYGCVATNLQDSMPSL

SEQ ID NO: 94070 - protein, 34 aa, Artificial Sequence
  Description of Artificial Sequence: Synthetic polypeptide
VEEEIATTNPVATEQYGSVCSAPNLPQEHGNDQL

SEQ ID NO: 94071 - protein, 34 aa, Artificial Sequence
  Description of Artificial Sequence: Synthetic polypeptide
VEEEIATTNPVAYEQWGQQVVSTNLSQRNGGNQR

SEQ ID NO: 94072 - protein, 31 aa, Artificial Sequence
  Description of Artificial Sequence: Synthetic polypeptide
VEDEIACTNPVATEQYGCVATNLQRNANMQE

SEQ ID NO: 94073 - protein, 35 aa, Artificial Sequence
  Description of Artificial Sequence: Synthetic polypeptide
VEEEIATTNPVAYEQYGVSVSATNDLGQMRMGIAR

SEQ ID NO: 94074 - protein, 33 aa, Artificial Sequence
  Description of Artificial Sequence: Synthetic polypeptide
DEEEIRTTNPVATEQYGCTCSTNEHQNFGSEQS

SEQ ID NO: 94075 - protein, 30 aa, Artificial Sequence
  Description of Artificial Sequence: Synthetic polypeptide
VEEEIATTNPVCTETYGSVANPNLQDGGQL

SEQ ID NO: 94076 - protein, 31 aa, Artificial Sequence
  Description of Artificial Sequence: Synthetic polypeptide
AEEEIACTNPVATEQYGCVATNDQDTGNEQG

SEQ ID NO: 94077 - protein, 35 aa, Artificial Sequence
  Description of Artificial Sequence: Synthetic polypeptide
DEEEIRTTNPVATEQYGCTCSTNEDLQNFGSDNQA

SEQ ID NO: 94078 - protein, 31 aa, Artificial Sequence
  Description of Artificial Sequence: Synthetic polypeptide
AEEEIACTNPVATEQWGSVASNLQDRIDNAH

SEQ ID NO: 94079 - protein, 33 aa, Artificial Sequence
  Description of Artificial Sequence: Synthetic polypeptide
VEEEIRTTNPVATECYGSVVQNNLVREGGDNGD

SEQ ID NO: 94080 - protein, 34 aa, Artificial Sequence
  Description of Artificial Sequence: Synthetic polypeptide
VEEEIRTTNPVATEGYGSVSGTNDQDQGGGNGGE

SEQ ID NO: 94081 - protein, 34 aa, Artificial Sequence
  Description of Artificial Sequence: Synthetic polypeptide
VEEEIRTTNPVATEGYGSVSGTNDQQGVEGNGNE

SEQ ID NO: 94082 - protein, 34 aa, Artificial Sequence
  Description of Artificial Sequence: Synthetic polypeptide
VEEEIRTTNPVATEGYGSVSNTQNGQDEGQTNIE

SEQ ID NO: 94083 - protein, 32 aa, Artificial Sequence
  Description of Artificial Sequence: Synthetic polypeptide
AEEEIACTNPVATEAYGSVATNLQDQGGGNDN

SEQ ID NO: 94084 - protein, 33 aa, Artificial Sequence
  Description of Artificial Sequence: Synthetic polypeptide
DEEEIRTTNPVATEQYGCTCSTNEHQYFNSQQS

SEQ ID NO: 94085 - protein, 31 aa, Artificial Sequence
  Description of Artificial Sequence: Synthetic polypeptide
VEDEIACTNPVATEQYGCVATNLQRANPNEN

SEQ ID NO: 94086 - protein, 33 aa, Artificial Sequence
  Description of Artificial Sequence: Synthetic polypeptide
DEEEIRTTNPVATEQYGCVCGNTGNLAEHGDQG

SEQ ID NO: 94087 - protein, 31 aa, Artificial Sequence
  Description of Artificial Sequence: Synthetic polypeptide
VEDEIACTNPVATEQYGCVATNLQPMGEGRN

SEQ ID NO: 94088 - protein, 33 aa, Artificial Sequence
  Description of Artificial Sequence: Synthetic polypeptide
TQEEIRTTNPVAYEQWGTTVSCTNLSQYQGNRH

SEQ ID NO: 94089 - protein, 33 aa, Artificial Sequence
  Description of Artificial Sequence: Synthetic polypeptide
TQEEIRTTNPVAYHQYGSVSCTNGVSQNGGNTR

SEQ ID NO: 94090 - protein, 32 aa, Artificial Sequence
  Description of Artificial Sequence: Synthetic polypeptide
TQEEIRTTNPVAYHQYGSVSTEGVSQNVGNNR

SEQ ID NO: 94091 - protein, 33 aa, Artificial Sequence
  Description of Artificial Sequence: Synthetic polypeptide
TQEEISTTNPVATEWYGVVQSTNLSTRTVGNRY

SEQ ID NO: 94092 - protein, 32 aa, Artificial Sequence
  Description of Artificial Sequence: Synthetic polypeptide
TSEEIASTNPVATEQYGSTISCTNMSQRGGNN

SEQ ID NO: 94093 - protein, 35 aa, Artificial Sequence
  Description of Artificial Sequence: Synthetic polypeptide
DEEEIRTTNPVATEQYGCVCSMTENPLQNFGSEQL

SEQ ID NO: 94094 - protein, 34 aa, Artificial Sequence
  Description of Artificial Sequence: Synthetic polypeptide
DEEEIRTTNPVATEQYGCVCSMTEHQNFGSNTQL

SEQ ID NO: 94095 - protein, 33 aa, Artificial Sequence
  Description of Artificial Sequence: Synthetic polypeptide
DEEEIRTTNPVATEQYGCVCSMTEHQHFISENQ

SEQ ID NO: 94096 - protein, 34 aa, Artificial Sequence
  Description of Artificial Sequence: Synthetic polypeptide
DEEEIRTTNPVATEQYGCVCSMTEDLQNSGSEQS

SEQ ID NO: 94097 - protein, 33 aa, Artificial Sequence
  Description of Artificial Sequence: Synthetic polypeptide
AEEEIACTNPVATEQYGSVATVNLEQDSGEPGR

SEQ ID NO: 94098 - protein, 33 aa, Artificial Sequence
  Description of Artificial Sequence: Synthetic polypeptide
AEEEIACTNPVATEQYGSVATPNLAQDNGGNTA

SEQ ID NO: 94099 - protein, 33 aa, Artificial Sequence
  Description of Artificial Sequence: Synthetic polypeptide
DEEEIRTTNPVATEQYGCVCSMSNHQNFGSQQP

SEQ ID NO: 94100 - protein, 34 aa, Artificial Sequence
  Description of Artificial Sequence: Synthetic polypeptide
DEEEIRTTNPVATEQYGCVCSMSGNHQNFGSNQA

SEQ ID NO: 94101 - protein, 33 aa, Artificial Sequence
  Description of Artificial Sequence: Synthetic polypeptide
AEEEIACTNPVATEQYGSVATNLQMAPGNDPVS

SEQ ID NO: 94102 - protein, 32 aa, Artificial Sequence
  Description of Artificial Sequence: Synthetic polypeptide
TSEEIRTTNPVATTQYGSVSTTLAQTTVGGFV

SEQ ID NO: 94103 - protein, 32 aa, Artificial Sequence
  Description of Artificial Sequence: Synthetic polypeptide
TSEEIRTTNPVAYEQYGSVSNGASQNRPGGSR

SEQ ID NO: 94104 - protein, 32 aa, Artificial Sequence
  Description of Artificial Sequence: Synthetic polypeptide
AEEEIACTNPVATEQYGSVATNLQEAPMNAEE

SEQ ID NO: 94105 - protein, 33 aa, Artificial Sequence
  Description of Artificial Sequence: Synthetic polypeptide
TSEEIRTTNPVAYHQYGSVVSTVLSQRGGNNFW

SEQ ID NO: 94106 - protein, 32 aa, Artificial Sequence
  Description of Artificial Sequence: Synthetic polypeptide
TSEEISTTNPVATTAYGSVVSTNPSMRGGNNR

SEQ ID NO: 94107 - protein, 33 aa, Artificial Sequence
  Description of Artificial Sequence: Synthetic polypeptide
TSWEIRTTNPVATEPYGTVPSTNHSQREGNERT

SEQ ID NO: 94108 - protein, 31 aa, Artificial Sequence
  Description of Artificial Sequence: Synthetic polypeptide
TTAEIATTNPVATEGYGSVSTNGDNMGGNPR

SEQ ID NO: 94109 - protein, 31 aa, Artificial Sequence
  Description of Artificial Sequence: Synthetic polypeptide
TQEEIRTTNPVAYEQWGTTVFTNLSQEGERH

SEQ ID NO: 94110 - protein, 34 aa, Artificial Sequence
  Description of Artificial Sequence: Synthetic polypeptide
TQEEIRTTNPVATEWYGCVQSTPNLSTRTVGNRC

SEQ ID NO: 94111 - protein, 33 aa, Artificial Sequence
  Description of Artificial Sequence: Synthetic polypeptide
TQEEIRTTNPVATERYGCVQSTNLSTRTVGNYY

SEQ ID NO: 94112 - protein, 34 aa, Artificial Sequence
  Description of Artificial Sequence: Synthetic polypeptide
TQEEIRTTNPVATEAYGCVQSTNLSTMRTVGNRH

SEQ ID NO: 94113 - protein, 29 aa, Artificial Sequence
  Description of Artificial Sequence: Synthetic peptide
AEEEIASVNPVCTEQYGVVSDNLQSGSQY

SEQ ID NO: 94114 - protein, 30 aa, Artificial Sequence
  Description of Artificial Sequence: Synthetic polypeptide
TGEEIATTNPVAYEQWGSVTHALDDQRGTR

SEQ ID NO: 94115 - protein, 29 aa, Artificial Sequence
  Description of Artificial Sequence: Synthetic peptide
TGEEIATTNPVAYEQWGSVTHTLDQHGTR

SEQ ID NO: 94116 - protein, 33 aa, Artificial Sequence
  Description of Artificial Sequence: Synthetic polypeptide
DEEEIRTTNPVATEQYGCVCSMTYHQNGGSEQP

SEQ ID NO: 94117 - protein, 33 aa, Artificial Sequence
  Description of Artificial Sequence: Synthetic polypeptide
DEEEIRTTNPVATEQYGCVCSMTYHQNFNSDQY

SEQ ID NO: 94118 - protein, 34 aa, Artificial Sequence
  Description of Artificial Sequence: Synthetic polypeptide
DEEEIRTTNPVATEQYGCVCSMTNHQEGFGSEFQ

SEQ ID NO: 94119 - protein, 33 aa, Artificial Sequence
  Description of Artificial Sequence: Synthetic polypeptide
DEEEIRTTNPVATEQYGCVCSMTNHENSGSDQG

SEQ ID NO: 94120 - protein, 33 aa, Artificial Sequence
  Description of Artificial Sequence: Synthetic polypeptide
TNEEIRTTNPVATEQYGCVSTTNLGADSGQDTR

SEQ ID NO: 94121 - protein, 34 aa, Artificial Sequence
  Description of Artificial Sequence: Synthetic polypeptide
DEEEIRTTNPVATEQYGCVCSMTNDHQYFGSEQG

SEQ ID NO: 94122 - protein, 34 aa, Artificial Sequence
  Description of Artificial Sequence: Synthetic polypeptide
DEEEIRTTNPVATEQYGCVCSMTNDHQNFGSIQP

SEQ ID NO: 94123 - protein, 33 aa, Artificial Sequence
  Description of Artificial Sequence: Synthetic polypeptide
DEEEIRTTNPVATEQYGCVCSDTPHQHFNSDQS

SEQ ID NO: 94124 - protein, 32 aa, Artificial Sequence
  Description of Artificial Sequence: Synthetic polypeptide
TNEEIRTTNPVATEQYGSVSTGPAGNTEGNDE

SEQ ID NO: 94125 - protein, 35 aa, Artificial Sequence
  Description of Artificial Sequence: Synthetic polypeptide
DEEEIRTTNPVATEQYGCVCSMTGNLQENFGSDQG

SEQ ID NO: 94126 - protein, 35 aa, Artificial Sequence
  Description of Artificial Sequence: Synthetic polypeptide
DEEEIRTTNPVATEQYGCVCSMTGNHQHFGSNNQA

SEQ ID NO: 94127 - protein, 31 aa, Artificial Sequence
  Description of Artificial Sequence: Synthetic polypeptide
TNEEISTTNPVATTQWGSVSGNPDMRDGNSR

SEQ ID NO: 94128 - protein, 34 aa, Artificial Sequence
  Description of Artificial Sequence: Synthetic polypeptide
DEEEIRTTNPVATEQYGCVCSMTGEPQRFNSNQS

SEQ ID NO: 94129 - protein, 34 aa, Artificial Sequence
  Description of Artificial Sequence: Synthetic polypeptide
DEEEIRTTNPVATEQYGCVCSMTGELQNFSSNQN

SEQ ID NO: 94130 - protein, 34 aa, Artificial Sequence
  Description of Artificial Sequence: Synthetic polypeptide
DEEEIRTTNPVATEQYGCVCSMTGELQGFGSQQS

SEQ ID NO: 94131 - protein, 29 aa, Artificial Sequence
  Description of Artificial Sequence: Synthetic peptide
AEEEIASVNPVCTEQYGCVSDNHQESGNQ

SEQ ID NO: 94132 - protein, 34 aa, Artificial Sequence
  Description of Artificial Sequence: Synthetic polypeptide
DEEEIRTTNPVATEQYGCVCSMTGEHQYGSENQA

SEQ ID NO: 94133 - protein, 32 aa, Artificial Sequence
  Description of Artificial Sequence: Synthetic polypeptide
TQAEIRTTNPVATEQYGCTCSTVLSQHGGNNR

SEQ ID NO: 94134 - protein, 32 aa, Artificial Sequence
  Description of Artificial Sequence: Synthetic polypeptide
TQEEIKTTNPVAYEHYGSVVACTNELSQFGNR

SEQ ID NO: 94135 - protein, 34 aa, Artificial Sequence
  Description of Artificial Sequence: Synthetic polypeptide
TNEEIRTTNPVATEQYGSVSTQGLNDERGGNQDK

SEQ ID NO: 94136 - protein, 35 aa, Artificial Sequence
  Description of Artificial Sequence: Synthetic polypeptide
DEEEIRTTNPVATEQYGCSCSTGNPLQHFNSDNQS

SEQ ID NO: 94137 - protein, 32 aa, Artificial Sequence
  Description of Artificial Sequence: Synthetic polypeptide
AEEEIACTNPVATEQYGSVATNLQATPGGEQP

SEQ ID NO: 94138 - protein, 35 aa, Artificial Sequence
  Description of Artificial Sequence: Synthetic polypeptide
DEEEIRTTNPVATEQYGCVCSDTGNHQNFGSDNQM

SEQ ID NO: 94139 - protein, 31 aa, Artificial Sequence
  Description of Artificial Sequence: Synthetic polypeptide
TTEEIRTTNPVATEQWGTVVNTNGQEGGNEG

SEQ ID NO: 94140 - protein, 31 aa, Artificial Sequence
  Description of Artificial Sequence: Synthetic polypeptide
TTEEIRTTNPVATEQWGTVVTNGQEGGGNGG

SEQ ID NO: 94141 - protein, 32 aa, Artificial Sequence
  Description of Artificial Sequence: Synthetic polypeptide
TTEEIRTTNPVATEQWGVVSNTNGQEEGGGNG

SEQ ID NO: 94142 - protein, 33 aa, Artificial Sequence
  Description of Artificial Sequence: Synthetic polypeptide
DEEEIRTTNPVATEQYGCVCQTELQENFGSEQG

SEQ ID NO: 94143 - protein, 33 aa, Artificial Sequence
  Description of Artificial Sequence: Synthetic polypeptide
DEEEIRTTNPVATEQYGCVCQTELQEGFGSEQM

SEQ ID NO: 94144 - protein, 33 aa, Artificial Sequence
  Description of Artificial Sequence: Synthetic polypeptide
DEEEIRTTNPVATEQYGCVCQTEHQERFGSEQS

SEQ ID NO: 94145 - protein, 34 aa, Artificial Sequence
  Description of Artificial Sequence: Synthetic polypeptide
VCEEVRTTNPVATEQYGSVSCAGNLSQDTVGNNR

SEQ ID NO: 94146 - protein, 28 aa, Artificial Sequence
  Description of Artificial Sequence: Synthetic peptide
VEDEIACTNPVATAQWGCVATALQHGNQ

SEQ ID NO: 94147 - protein, 34 aa, Artificial Sequence
  Description of Artificial Sequence: Synthetic polypeptide
DEEEIRTTNPVATEQYGCVCQNTGNLIERGSEQA

SEQ ID NO: 94148 - protein, 30 aa, Artificial Sequence
  Description of Artificial Sequence: Synthetic polypeptide
VEDEIACTNPVATEQYGCASANLQMPGQRV

SEQ ID NO: 94149 - protein, 33 aa, Artificial Sequence
  Description of Artificial Sequence: Synthetic polypeptide
DEEEIRTTNPVATEQYGCVCQNTEHQNFGSNAA

SEQ ID NO: 94150 - protein, 33 aa, Artificial Sequence
  Description of Artificial Sequence: Synthetic polypeptide
DEEEIRTTNPVATEAYGTVTVVVTNNEQAGNNF

SEQ ID NO: 94151 - protein, 33 aa, Artificial Sequence
  Description of Artificial Sequence: Synthetic polypeptide
DEEEIRTTNPVATEQYGCVCNTGNLIERNSEQA

SEQ ID NO: 94152 - protein, 30 aa, Artificial Sequence
  Description of Artificial Sequence: Synthetic polypeptide
VEDEIACTNPVATEQYGCVATNLQAEEGDF

SEQ ID NO: 94153 - protein, 34 aa, Artificial Sequence
  Description of Artificial Sequence: Synthetic polypeptide
DEEEIRTTNPVATEQYGCVCGTGELQEGFNSDQA

SEQ ID NO: 94154 - protein, 31 aa, Artificial Sequence
  Description of Artificial Sequence: Synthetic polypeptide
VEDEIACTNPVATEQYGCVATNLQAPLGNDD

SEQ ID NO: 94155 - protein, 29 aa, Artificial Sequence
  Description of Artificial Sequence: Synthetic peptide
VEDEIACTNPVATEQYGCVATNLQATEDH

SEQ ID NO: 94156 - protein, 32 aa, Artificial Sequence
  Description of Artificial Sequence: Synthetic polypeptide
AEEEIACTNPVATEQYGEASSTENGQRGMGPR

SEQ ID NO: 94157 - protein, 31 aa, Artificial Sequence
  Description of Artificial Sequence: Synthetic polypeptide
VEDEIACTNPVATEQYGCVATNLQGEGNPAD

SEQ ID NO: 94158 - protein, 30 aa, Artificial Sequence
  Description of Artificial Sequence: Synthetic polypeptide
VEDEIACTNPVATEQYGCVATNLQMGEEGN

SEQ ID NO: 94159 - protein, 31 aa, Artificial Sequence
  Description of Artificial Sequence: Synthetic polypeptide
VEDEIACTNPVATEQYGCVATNLQMSGEDRH

SEQ ID NO: 94160 - protein, 33 aa, Artificial Sequence
  Description of Artificial Sequence: Synthetic polypeptide
DEEEIRTTNPVATEQYGCVCQTNEHQHFNSEQP

SEQ ID NO: 94161 - protein, 32 aa, Artificial Sequence
  Description of Artificial Sequence: Synthetic polypeptide
AEEEIACTNPVATEQYGSASSEPALQMRGGPR

SEQ ID NO: 94162 - protein, 30 aa, Artificial Sequence
  Description of Artificial Sequence: Synthetic polypeptide
TTEEIRTTNPVATEQWGFVSTDGQDEGGEG

SEQ ID NO: 94163 - protein, 33 aa, Artificial Sequence
  Description of Artificial Sequence: Synthetic polypeptide
DEEEIRTTNPVATEAYGTVTVTVTNNEQAGNNF

SEQ ID NO: 94164 - protein, 30 aa, Artificial Sequence
  Description of Artificial Sequence: Synthetic polypeptide
TTAEIRTTNPVATEQYGTCTSTVDQDGNGQ

SEQ ID NO: 94165 - protein, 32 aa, Artificial Sequence
  Description of Artificial Sequence: Synthetic polypeptide
AEEEIACTNPVATEQYGSVATNLANGQGDNQM

SEQ ID NO: 94166 - protein, 34 aa, Artificial Sequence
  Description of Artificial Sequence: Synthetic polypeptide
DEEEIRTTNPVATEQYGCVCSDTGELNQRFSSEQ

SEQ ID NO: 94167 - protein, 31 aa, Artificial Sequence
  Description of Artificial Sequence: Synthetic polypeptide
AEEEIACTNPVATEQYGSVATNLAGQGDPTL

SEQ ID NO: 94168 - protein, 30 aa, Artificial Sequence
  Description of Artificial Sequence: Synthetic polypeptide
TTAEIRTTNPVATEQYGTVCTSTVDQHGEG

SEQ ID NO: 94169 - protein, 32 aa, Artificial Sequence
  Description of Artificial Sequence: Synthetic polypeptide
TTEEIRATNPVATEQYGSVVQGTNGLQNQGTT

SEQ ID NO: 94170 - protein, 33 aa, Artificial Sequence
  Description of Artificial Sequence: Synthetic polypeptide
DEEEIRTTNPVATEQYGCVCSDTEPERFNSEQS

SEQ ID NO: 94171 - protein, 32 aa, Artificial Sequence
  Description of Artificial Sequence: Synthetic polypeptide
TTEEIRGTNPVATEQYGSVVDTNEGQNGGNGE

SEQ ID NO: 94172 - protein, 34 aa, Artificial Sequence
  Description of Artificial Sequence: Synthetic polypeptide
DEEEIRTTNPVATEQYGCVCSDTELNQSFSSNNQ

SEQ ID NO: 94173 - protein, 31 aa, Artificial Sequence
  Description of Artificial Sequence: Synthetic polypeptide
TTEEIRGTNPVATEQYGSVVEQTNGQGGEGG

SEQ ID NO: 94174 - protein, 31 aa, Artificial Sequence
  Description of Artificial Sequence: Synthetic polypeptide
TTAEIRTTNPVATEQYGMTSTVLQHMGDNDD

SEQ ID NO: 94175 - protein, 31 aa, Artificial Sequence
  Description of Artificial Sequence: Synthetic polypeptide
TTEEIRGTNPVATEQYGSVVGETNGQGGQGG

SEQ ID NO: 94176 - protein, 31 aa, Artificial Sequence
  Description of Artificial Sequence: Synthetic polypeptide
TTEEIRGTNPVATEQYGSVVNDDNGQTGGNG

SEQ ID NO: 94177 - protein, 32 aa, Artificial Sequence
  Description of Artificial Sequence: Synthetic polypeptide
TTEEIRGTNPVATEQYGSVVNDTNGQEGGNGT

SEQ ID NO: 94178 - protein, 32 aa, Artificial Sequence
  Description of Artificial Sequence: Synthetic polypeptide
TTEEIRSTNPVATEQYGSVVGGTNGLQNDGTT

SEQ ID NO: 94179 - protein, 32 aa, Artificial Sequence
  Description of Artificial Sequence: Synthetic polypeptide
TTEEIRSTNPVATEQYGSVVGTNGLQNEGDTT

SEQ ID NO: 94180 - protein, 35 aa, Artificial Sequence
  Description of Artificial Sequence: Synthetic polypeptide
DEEEIRTTNPVATEQYGCVCSDTEDLNQRFSSNQS

SEQ ID NO: 94181 - protein, 34 aa, Artificial Sequence
  Description of Artificial Sequence: Synthetic polypeptide
DEEEIRTTNPVATEQYGCVCSDTEDHQRFNSDQS

SEQ ID NO: 94182 - protein, 32 aa, Artificial Sequence
  Description of Artificial Sequence: Synthetic polypeptide
TTEEIRTTNPVATEQWGAVSNTNGQGEGGNDG

SEQ ID NO: 94183 - protein, 34 aa, Artificial Sequence
  Description of Artificial Sequence: Synthetic polypeptide
DEEEIRTTNPVATEQYGCVCSCTNTNQYFGSDQS

SEQ ID NO: 94184 - protein, 34 aa, Artificial Sequence
  Description of Artificial Sequence: Synthetic polypeptide
DEEEIRTTNPVATEQYGCVCSCTNHNQHFGSQQS

SEQ ID NO: 94185 - protein, 34 aa, Artificial Sequence
  Description of Artificial Sequence: Synthetic polypeptide
DEEEIRTTNPVATEQYGCVCSCTEHNQRFGSDTF

SEQ ID NO: 94186 - protein, 33 aa, Artificial Sequence
  Description of Artificial Sequence: Synthetic polypeptide
DEEEIRTTNPVATEQYGCVCSDTEHQYFGSDQA

SEQ ID NO: 94187 - protein, 34 aa, Artificial Sequence
  Description of Artificial Sequence: Synthetic polypeptide
TEWEIRTTNPVATEPYGSVPSYTNHSQAEGNERT

SEQ ID NO: 94188 - protein, 35 aa, Artificial Sequence
  Description of Artificial Sequence: Synthetic polypeptide
DEEEIRTTNPVATEQYGCSCSTGNPLNQNFNSNQG

SEQ ID NO: 94189 - protein, 33 aa, Artificial Sequence
  Description of Artificial Sequence: Synthetic polypeptide
VEEEIRTTNPVATEQYGSVNMQSEEDQGGENGD

SEQ ID NO: 94190 - protein, 30 aa, Artificial Sequence
  Description of Artificial Sequence: Synthetic polypeptide
YEDEIATTNPVAVEQYGSVVTQNLQNSTSQ

SEQ ID NO: 94191 - protein, 30 aa, Artificial Sequence
  Description of Artificial Sequence: Synthetic polypeptide
YEDEIMTTNPVAMEQYGSVVTQNVQRSTFQ

SEQ ID NO: 94192 - protein, 34 aa, Artificial Sequence
  Description of Artificial Sequence: Synthetic polypeptide
DEEEIRTTNPVATEQYGAVSVTNGDEFNGGTNGD

SEQ ID NO: 94193 - protein, 35 aa, Artificial Sequence
  Description of Artificial Sequence: Synthetic polypeptide
AEDEIRTTNPVATEQYGSVSTVTNQLQEIGTSNVD

SEQ ID NO: 94194 - protein, 35 aa, Artificial Sequence
  Description of Artificial Sequence: Synthetic polypeptide
AEDEIRTTNPVATEQYGSVSTVTNQLLQIGTVNVD

SEQ ID NO: 94195 - protein, 35 aa, Artificial Sequence
  Description of Artificial Sequence: Synthetic polypeptide
AEDEIRTTNPVATEQYGSVSTVTNQLEQIGTSNVQ

SEQ ID NO: 94196 - protein, 29 aa, Artificial Sequence
  Description of Artificial Sequence: Synthetic peptide
YEEAIASVNPVCTEQYGVVSDNLNQSGNQ

SEQ ID NO: 94197 - protein, 29 aa, Artificial Sequence
  Description of Artificial Sequence: Synthetic peptide
YEEAIASVNPVCTEQYGVVSDNLQSGANQ

SEQ ID NO: 94198 - protein, 29 aa, Artificial Sequence
  Description of Artificial Sequence: Synthetic peptide
YEEAIASVNPVCTEQYGVVSDNLQSPGNQ

SEQ ID NO: 94199 - protein, 30 aa, Artificial Sequence
  Description of Artificial Sequence: Synthetic polypeptide
YEEAIKHTNPMATEQWGYSVSTNLEKRNNG

SEQ ID NO: 94200 - protein, 32 aa, Artificial Sequence
  Description of Artificial Sequence: Synthetic polypeptide
YEEAIQTTNPVATEQYGSTVSTNPFVRNDNQG

SEQ ID NO: 94201 - protein, 35 aa, Artificial Sequence
  Description of Artificial Sequence: Synthetic polypeptide
AEDEIRTTNPVATEQYGSVSTVTNNQLQGIGSNVN

SEQ ID NO: 94202 - protein, 34 aa, Artificial Sequence
  Description of Artificial Sequence: Synthetic polypeptide
AEDEIRTTNPVATEQYGSVSTVTNNLQQIGSTVE

SEQ ID NO: 94203 - protein, 34 aa, Artificial Sequence
  Description of Artificial Sequence: Synthetic polypeptide
DEEEIRTTNPVATEQYGAVSTPTDLNIGGDTNEQ

SEQ ID NO: 94204 - protein, 32 aa, Artificial Sequence
  Description of Artificial Sequence: Synthetic polypeptide
YEECIRTTNPVATEQYGCVSGNVWNTWRSGER

SEQ ID NO: 94205 - protein, 34 aa, Artificial Sequence
  Description of Artificial Sequence: Synthetic polypeptide
AEDEIRTTNPVATEQYGSVSTTVNQLNQIGSTVQ

SEQ ID NO: 94206 - protein, 28 aa, Artificial Sequence
  Description of Artificial Sequence: Synthetic peptide
YEEECASVNPVCTEQYGVVSDNMQSGNQ

SEQ ID NO: 94207 - protein, 34 aa, Artificial Sequence
  Description of Artificial Sequence: Synthetic polypeptide
AEDEIRTTNPVATEQYGSVSTTTNNQLQIGSTVQ

SEQ ID NO: 94208 - protein, 34 aa, Artificial Sequence
  Description of Artificial Sequence: Synthetic polypeptide
AEDEIRTTNPVATEQYGSVSTTNQQLLQIGSTVQ

SEQ ID NO: 94209 - protein, 32 aa, Artificial Sequence
  Description of Artificial Sequence: Synthetic polypeptide
AEDEIRSTNPVATEQYGYVCSNTPWLQNGQQR

SEQ ID NO: 94210 - protein, 33 aa, Artificial Sequence
  Description of Artificial Sequence: Synthetic polypeptide
AEDEIRATNPVATEQYGSVVTTNNLQSGTNAQT

SEQ ID NO: 94211 - protein, 33 aa, Artificial Sequence
  Description of Artificial Sequence: Synthetic polypeptide
DEEEIRTTNPVATEQYGAVSWMELANRSQMVVR

SEQ ID NO: 94212 - protein, 33 aa, Artificial Sequence
  Description of Artificial Sequence: Synthetic polypeptide
AEDEIRATNPVATEQYGSVTTTVNLQSGTNTQD

SEQ ID NO: 94213 - protein, 33 aa, Artificial Sequence
  Description of Artificial Sequence: Synthetic polypeptide
DEEEIRTTNPVATEQYGAVSWMNMNANRQMVRD

SEQ ID NO: 94214 - protein, 28 aa, Artificial Sequence
  Description of Artificial Sequence: Synthetic peptide
YEDEIASVNPVCTEQYGVVSDNLQSDNQ

SEQ ID NO: 94215 - protein, 35 aa, Artificial Sequence
  Description of Artificial Sequence: Synthetic polypeptide
DEEEIRTTNPVATEQYGAVVDTGNQLQGGGNGGGN

SEQ ID NO: 94216 - protein, 32 aa, Artificial Sequence
  Description of Artificial Sequence: Synthetic polypeptide
WEQEIRTTNPVATEQYGSVSATDLEDHEGEDL

SEQ ID NO: 94217 - protein, 33 aa, Artificial Sequence
  Description of Artificial Sequence: Synthetic polypeptide
YAEEIKTTNPVAFEHYGSVSTTENLQRQGHSRL

SEQ ID NO: 94218 - protein, 28 aa, Artificial Sequence
  Description of Artificial Sequence: Synthetic peptide
YCEEIASVCPVCTEQYGVVSDNLQSGNQ

SEQ ID NO: 94219 - protein, 33 aa, Artificial Sequence
  Description of Artificial Sequence: Synthetic polypeptide
DEEEIRTTNPVATEQYGAVVDGTVGQTGNGNGN

SEQ ID NO: 94220 - protein, 33 aa, Artificial Sequence
  Description of Artificial Sequence: Synthetic polypeptide
DEEEIRTTNPVATEQYGAVVDGTNMEDTGEGNI

SEQ ID NO: 94221 - protein, 35 aa, Artificial Sequence
  Description of Artificial Sequence: Synthetic polypeptide
DEEEIRTTNPVATEQYGAVVDGTGNLQGTEGGNGG

SEQ ID NO: 94222 - protein, 28 aa, Artificial Sequence
  Description of Artificial Sequence: Synthetic peptide
YCEEIASVNPVCTEPYGIVSDNLQSGNQ

SEQ ID NO: 94223 - protein, 28 aa, Artificial Sequence
  Description of Artificial Sequence: Synthetic peptide
YCEEIASVNPVCTEQYGVVSGNHQSGNQ

SEQ ID NO: 94224 - protein, 29 aa, Artificial Sequence
  Description of Artificial Sequence: Synthetic peptide
YDEEIASTNPVSTEGYGVVSNNIQSRGNQ

SEQ ID NO: 94225 - protein, 30 aa, Artificial Sequence
  Description of Artificial Sequence: Synthetic polypeptide
YDSEIASTNPVCTEQYGVVSDNLQSRVGNQ

SEQ ID NO: 94226 - protein, 28 aa, Artificial Sequence
  Description of Artificial Sequence: Synthetic peptide
YEAEIASVNPLCTEQYGVVSDNLQSGNQ

SEQ ID NO: 94227 - protein, 28 aa, Artificial Sequence
  Description of Artificial Sequence: Synthetic peptide
YEAEIASVNPVCTEQYGVVSDCLQSGNQ

SEQ ID NO: 94228 - protein, 28 aa, Artificial Sequence
  Description of Artificial Sequence: Synthetic peptide
YEAEIASVNPVCTEQYGVVSDNLQSMNQ

SEQ ID NO: 94229 - protein, 28 aa, Artificial Sequence
  Description of Artificial Sequence: Synthetic peptide
YEAEIASVNPVCTEQYGVVSDNLQSSNQ

SEQ ID NO: 94230 - protein, 32 aa, Artificial Sequence
  Description of Artificial Sequence: Synthetic polypeptide
DEEEIRTTNPVATEQYGAVVDDNNFNGEMNGQ

SEQ ID NO: 94231 - protein, 28 aa, Artificial Sequence
  Description of Artificial Sequence: Synthetic peptide
YEAMIASVNPVCTEQYGVVSSNLQSGNQ

SEQ ID NO: 94232 - protein, 28 aa, Artificial Sequence
  Description of Artificial Sequence: Synthetic peptide
YECEIASVNPVCTECYGVVSDNLQSGNQ

SEQ ID NO: 94233 - protein, 28 aa, Artificial Sequence
  Description of Artificial Sequence: Synthetic peptide
YECEIASVNPVCTEQYGVASDNLQSGNQ

SEQ ID NO: 94234 - protein, 28 aa, Artificial Sequence
  Description of Artificial Sequence: Synthetic peptide
YECEIASVNPVCTEQYGVVSDMLQSGNQ

SEQ ID NO: 94235 - protein, 28 aa, Artificial Sequence
  Description of Artificial Sequence: Synthetic peptide
YECEIASVNPVCTEQYGVVSDNLQSGEQ

SEQ ID NO: 94236 - protein, 29 aa, Artificial Sequence
  Description of Artificial Sequence: Synthetic peptide
YEDEIASVNPVCTEQYGVVSDNLQSSGNQ

SEQ ID NO: 94237 - protein, 32 aa, Artificial Sequence
  Description of Artificial Sequence: Synthetic polypeptide
AEDEIRATNPVATEQYGSVTTTNLQSGTQQQD

SEQ ID NO: 94238 - protein, 33 aa, Artificial Sequence
  Description of Artificial Sequence: Synthetic polypeptide
AEDEIRATNPVATEQYGSVTTTENLQSGTNQQT

SEQ ID NO: 94239 - protein, 34 aa, Artificial Sequence
  Description of Artificial Sequence: Synthetic polypeptide
DEEEIRTTNPVATEQYGAVSTDNGLEDEGGEDGE

SEQ ID NO: 94240 - protein, 30 aa, Artificial Sequence
  Description of Artificial Sequence: Synthetic polypeptide
YEEEIASTNPVCTEQYGVVSADNLQHGEDL

SEQ ID NO: 94241 - protein, 29 aa, Artificial Sequence
  Description of Artificial Sequence: Synthetic peptide
YEEEIASTNPVCTEQYGVVSDNEQAAGDQ

SEQ ID NO: 94242 - protein, 30 aa, Artificial Sequence
  Description of Artificial Sequence: Synthetic polypeptide
YEEEIASTNPVCTEQYGVVSDNIQQSNGNH

SEQ ID NO: 94243 - protein, 34 aa, Artificial Sequence
  Description of Artificial Sequence: Synthetic polypeptide
AEDEIRATNPVATEQYGSVSTNTQNLQSGTNQDD

SEQ ID NO: 94244 - protein, 33 aa, Artificial Sequence
  Description of Artificial Sequence: Synthetic polypeptide
DEEEIRTTNPVATEQYGAVQTDNMGEGNEGQGG

SEQ ID NO: 94245 - protein, 29 aa, Artificial Sequence
  Description of Artificial Sequence: Synthetic peptide
YEEEIASTNPVCTEQYGVVSENEQAAGDA

SEQ ID NO: 94246 - protein, 29 aa, Artificial Sequence
  Description of Artificial Sequence: Synthetic peptide
YEEEIASTNPVCTEQYGVVSENEQAAGDQ

SEQ ID NO: 94247 - protein, 34 aa, Artificial Sequence
  Description of Artificial Sequence: Synthetic polypeptide
DEEEIRTTNPVATEQYGAVNSTTLDFDRNNEDEN

SEQ ID NO: 94248 - protein, 30 aa, Artificial Sequence
  Description of Artificial Sequence: Synthetic polypeptide
YEEEIASTNPVCTEQYGVVSMNIQQSNGNH

SEQ ID NO: 94249 - protein, 28 aa, Artificial Sequence
  Description of Artificial Sequence: Synthetic peptide
YEEEIASTNPVGTEQYGVMADNLQHGDI

SEQ ID NO: 94250 - protein, 28 aa, Artificial Sequence
  Description of Artificial Sequence: Synthetic peptide
YEEEIASTNPVGTEQYGVMASNLQHGDI

SEQ ID NO: 94251 - protein, 29 aa, Artificial Sequence
  Description of Artificial Sequence: Synthetic peptide
YEEEIASTNPVSTEGYGVVSNNIQSSGNQ

SEQ ID NO: 94252 - protein, 34 aa, Artificial Sequence
  Description of Artificial Sequence: Synthetic polypeptide
DEEEIRTTNPVATEQYGAVMTVNFGEQGGNINGF

SEQ ID NO: 94253 - protein, 30 aa, Artificial Sequence
  Description of Artificial Sequence: Synthetic polypeptide
YEEEIASTNPVSTEPYGVVSMENLQSNGNH

SEQ ID NO: 94254 - protein, 32 aa, Artificial Sequence
  Description of Artificial Sequence: Synthetic polypeptide
DEEEIRTTNPVATEQYGAVMTGIGGNGQEEED

SEQ ID NO: 94255 - protein, 33 aa, Artificial Sequence
  Description of Artificial Sequence: Synthetic polypeptide
DEEEIRTTNPVATEQYGAVMSGMFNNEQGEVNI

SEQ ID NO: 94256 - protein, 28 aa, Artificial Sequence
  Description of Artificial Sequence: Synthetic peptide
YEEEIASVCPVCTEQYGVVSDNLQSGSQ

SEQ ID NO: 94257 - protein, 28 aa, Artificial Sequence
  Description of Artificial Sequence: Synthetic peptide
YEEEIASVNCVCTEQYGVVSDNWQSGNQ

SEQ ID NO: 94258 - protein, 28 aa, Artificial Sequence
  Description of Artificial Sequence: Synthetic peptide
YEEEIASVNPCCSEQYGVVSDNLQSGNQ

SEQ ID NO: 94259 - protein, 29 aa, Artificial Sequence
  Description of Artificial Sequence: Synthetic peptide
YEEEIASVNPCCTEQYGVVSDNQLQSGNQ

SEQ ID NO: 94260 - protein, 30 aa, Artificial Sequence
  Description of Artificial Sequence: Synthetic polypeptide
YEEEIASVNPCCTEQYGVVSTDMNLQSGNQ

SEQ ID NO: 94261 - protein, 31 aa, Artificial Sequence
  Description of Artificial Sequence: Synthetic polypeptide
YEEEIASTNPVCTEQYGVVSADDNLVQSGNQ

SEQ ID NO: 94262 - protein, 30 aa, Artificial Sequence
  Description of Artificial Sequence: Synthetic polypeptide
YEEEIASTNPVCTEQYGVVADNIQSRVGQR

SEQ ID NO: 94263 - protein, 34 aa, Artificial Sequence
  Description of Artificial Sequence: Synthetic polypeptide
DEEEIRTTNPVATEQYGAVSGDNNIQDEGGQNDD

SEQ ID NO: 94264 - protein, 30 aa, Artificial Sequence
  Description of Artificial Sequence: Synthetic polypeptide
YEEEIASTNPVCTEQYGVTSNDENLQSGNQ

SEQ ID NO: 94265 - protein, 34 aa, Artificial Sequence
  Description of Artificial Sequence: Synthetic polypeptide
AEDEIRATNPVATEQYGSVSTTVNSLQSGTNATD

SEQ ID NO: 94266 - protein, 34 aa, Artificial Sequence
  Description of Artificial Sequence: Synthetic polypeptide
AEDEIRATNPVATEQYGSVSTTTVNLQSGTNAQD

SEQ ID NO: 94267 - protein, 34 aa, Artificial Sequence
  Description of Artificial Sequence: Synthetic polypeptide
AEDEIRATNPVATEQYGSVSTTTNQLQSGTNQQT

SEQ ID NO: 94268 - protein, 30 aa, Artificial Sequence
  Description of Artificial Sequence: Synthetic polypeptide
YEEEIASTNPVATEQYGSVSDDLEDSEGEQ

SEQ ID NO: 94269 - protein, 28 aa, Artificial Sequence
  Description of Artificial Sequence: Synthetic peptide
YEEEIASTNPVATEQYGVVPDVLQSEEK

SEQ ID NO: 94270 - protein, 30 aa, Artificial Sequence
  Description of Artificial Sequence: Synthetic polypeptide
YEEEIASTNPVATEQYGVVSDDLQDSEGEQ

SEQ ID NO: 94271 - protein, 32 aa, Artificial Sequence
  Description of Artificial Sequence: Synthetic polypeptide
YEEEIASTNPVATEQYGVVSSTTNGQSGMNPQ

SEQ ID NO: 94272 - protein, 31 aa, Artificial Sequence
  Description of Artificial Sequence: Synthetic polypeptide
YEEEIASTNPVATEQYGVVSTTALPNSGMNQ

SEQ ID NO: 94273 - protein, 28 aa, Artificial Sequence
  Description of Artificial Sequence: Synthetic peptide
YEEEIASTNPVCTEGYGVVADTLQSGNQ

SEQ ID NO: 94274 - protein, 34 aa, Artificial Sequence
  Description of Artificial Sequence: Synthetic polypeptide
DEEEIRTTNPVATEQYGAVSNTNDQELEEGEGFD

SEQ ID NO: 94275 - protein, 28 aa, Artificial Sequence
  Description of Artificial Sequence: Synthetic peptide
WENEIATTNPVATECYGMVSECLQHEEL

SEQ ID NO: 94276 - protein, 34 aa, Artificial Sequence
  Description of Artificial Sequence: Synthetic polypeptide
DEEEIRTTNPVATEQYGAVSNNDNGQGGGGNDGQ

SEQ ID NO: 94277 - protein, 34 aa, Artificial Sequence
  Description of Artificial Sequence: Synthetic polypeptide
DEEEIRTTNPVATEQYGAVSIVDNLIGTGGNGGT

SEQ ID NO: 94278 - protein, 30 aa, Artificial Sequence
  Description of Artificial Sequence: Synthetic polypeptide
YEEEIASTNPVCTEPYGVVSMENLQSNGNH

SEQ ID NO: 94279 - protein, 34 aa, Artificial Sequence
  Description of Artificial Sequence: Synthetic polypeptide
DEEEIRTTNPVATEQYGAVSITNGDGFNEGTGND

SEQ ID NO: 94280 - protein, 30 aa, Artificial Sequence
  Description of Artificial Sequence: Synthetic polypeptide
YEEEIASTNPVCTEPYGVVSMENLQSNGNQ

SEQ ID NO: 94281 - protein, 34 aa, Artificial Sequence
  Description of Artificial Sequence: Synthetic polypeptide
DEEEIRTTNPVATEQYGAVSITNGDEFNDGGGNG

SEQ ID NO: 94282 - protein, 34 aa, Artificial Sequence
  Description of Artificial Sequence: Synthetic polypeptide
DEEEIRTTNPVATEQYGAVSITNGDEDNGGGNED

SEQ ID NO: 94283 - protein, 34 aa, Artificial Sequence
  Description of Artificial Sequence: Synthetic polypeptide
DEEEIRTTNPVATEQYGAVSITNGDDEFVGGNND

SEQ ID NO: 94284 - protein, 34 aa, Artificial Sequence
  Description of Artificial Sequence: Synthetic polypeptide
DEEEIRTTNPVATEQYGAVSITNDDEFNGTNEND

SEQ ID NO: 94285 - protein, 30 aa, Artificial Sequence
  Description of Artificial Sequence: Synthetic polypeptide
YEEEIASTNPVCTEQWGSVSDNEPQSEGNQ

SEQ ID NO: 94286 - protein, 29 aa, Artificial Sequence
  Description of Artificial Sequence: Synthetic peptide
YEEEIASTNPVCTEQYGVTSNDDLQPGNQ

SEQ ID NO: 94287 - protein, 33 aa, Artificial Sequence
  Description of Artificial Sequence: Synthetic polypeptide
DEEEIRTTNPVATEQYGAVSNGNGDEFNGGNND

SEQ ID NO: 94288 - protein, 28 aa, Artificial Sequence
  Description of Artificial Sequence: Synthetic peptide
WEGEIAPTNPCSSEQYGIVSCNLQSGTR

SEQ ID NO: 94289 - protein, 32 aa, Artificial Sequence
  Description of Artificial Sequence: Synthetic polypeptide
AEDEIRTTNPVAYEQWGSVSTDQGQHGGGNTR

SEQ ID NO: 94290 - protein, 33 aa, Artificial Sequence
  Description of Artificial Sequence: Synthetic polypeptide
AEDEIRTTNPVAYEQWGSVSTNLQLGQGEGQNN

SEQ ID NO: 94291 - protein, 34 aa, Artificial Sequence
  Description of Artificial Sequence: Synthetic polypeptide
VEEEIRTTNPVATEQYGSVSLTPWLNDERPELNI

SEQ ID NO: 94292 - protein, 33 aa, Artificial Sequence
  Description of Artificial Sequence: Synthetic polypeptide
VEEEIRTTNPVATEQYGSVSLTVLPSDGEEFVE

SEQ ID NO: 94293 - protein, 33 aa, Artificial Sequence
  Description of Artificial Sequence: Synthetic polypeptide
DEEEIRTTNPVATEQYGCQVCSSEHQRFGSEQS

SEQ ID NO: 94294 - protein, 34 aa, Artificial Sequence
  Description of Artificial Sequence: Synthetic polypeptide
DEEEIRTTNPVATEQYGCQVCSNTNHQNFNSNAS

SEQ ID NO: 94295 - protein, 34 aa, Artificial Sequence
  Description of Artificial Sequence: Synthetic polypeptide
DEEEIRTTNPVATEQYGCQVCSNTELQGFGSEQS

SEQ ID NO: 94296 - protein, 35 aa, Artificial Sequence
  Description of Artificial Sequence: Synthetic polypeptide
VEEEIRTTNPVATEQYGSVSNTAGNNQGEFGNNGN

SEQ ID NO: 94297 - protein, 33 aa, Artificial Sequence
  Description of Artificial Sequence: Synthetic polypeptide
VEEEIRTTNPVATEQYGSVSPSENLPVVMPNDI

SEQ ID NO: 94298 - protein, 35 aa, Artificial Sequence
  Description of Artificial Sequence: Synthetic polypeptide
VEEEIRTTNPVATEQYGSVSPTLNLLQQRIVDEDL

SEQ ID NO: 94299 - protein, 35 aa, Artificial Sequence
  Description of Artificial Sequence: Synthetic polypeptide
VEEEIRTTNPVATEQYGSVSPTPLMNQQQGIEMRL

SEQ ID NO: 94300 - protein, 33 aa, Artificial Sequence
  Description of Artificial Sequence: Synthetic polypeptide
VEEEIRTTNPVATEQYGSVSSNLIQNEVTVTEA

SEQ ID NO: 94301 - protein, 35 aa, Artificial Sequence
  Description of Artificial Sequence: Synthetic polypeptide
VEEEIRTTNPVATEQYGSVSSTGDNDQIGEGGNIG

SEQ ID NO: 94302 - protein, 34 aa, Artificial Sequence
  Description of Artificial Sequence: Synthetic polypeptide
VEEEIRTTNPVATEQYGSVSTDTGMGQNGNNTDG

SEQ ID NO: 94303 - protein, 33 aa, Artificial Sequence
  Description of Artificial Sequence: Synthetic polypeptide
VEEEIRTTNPVATEQYGSVSTDTSDDLGGNGDD

SEQ ID NO: 94304 - protein, 34 aa, Artificial Sequence
  Description of Artificial Sequence: Synthetic polypeptide
VEEEIRTTNPVATEQYGSVSTGDVGQNEGGNQGG

SEQ ID NO: 94305 - protein, 34 aa, Artificial Sequence
  Description of Artificial Sequence: Synthetic polypeptide
VEEEIRTTNPVATEQYGSVSTGFTDGQTGGTGNE

SEQ ID NO: 94306 - protein, 34 aa, Artificial Sequence
  Description of Artificial Sequence: Synthetic polypeptide
VEEEIRTTNPVATEQYGSVSTGGQSDQGGEGNEG

SEQ ID NO: 94307 - protein, 33 aa, Artificial Sequence
  Description of Artificial Sequence: Synthetic polypeptide
VEEEIRTTNPVATEQYGSVSTGMGDDEGGEGNI

SEQ ID NO: 94308 - protein, 33 aa, Artificial Sequence
  Description of Artificial Sequence: Synthetic polypeptide
VEEEIRTTNPVATEQYGSVSTGQGQNEGGEGGT

SEQ ID NO: 94309 - protein, 33 aa, Artificial Sequence
  Description of Artificial Sequence: Synthetic polypeptide
VEEEIRTTNPVATEQYGSVSTMELTDNDQGEGQ

SEQ ID NO: 94310 - protein, 31 aa, Artificial Sequence
  Description of Artificial Sequence: Synthetic polypeptide
AEECISTTNPVATEQYGCVCSWGNHQYGNQS

SEQ ID NO: 94311 - protein, 33 aa, Artificial Sequence
  Description of Artificial Sequence: Synthetic polypeptide
DEEEIRTTNPVATEQYGCGSTNADQNTGDSQQY

SEQ ID NO: 94312 - protein, 33 aa, Artificial Sequence
  Description of Artificial Sequence: Synthetic polypeptide
DEEEIRTTNPVATEQYGCQVCSTGELQNFISEQ

SEQ ID NO: 94313 - protein, 35 aa, Artificial Sequence
  Description of Artificial Sequence: Synthetic polypeptide
VEEEIRTTNPVATEQYGSVSITVDNDGQQNGGNEN

SEQ ID NO: 94314 - protein, 33 aa, Artificial Sequence
  Description of Artificial Sequence: Synthetic polypeptide
DEEEIRTTNPVATEQYGCQVCSTNHANFGSEQS

SEQ ID NO: 94315 - protein, 34 aa, Artificial Sequence
  Description of Artificial Sequence: Synthetic polypeptide
DEEEIRTTNPVATEQYGCQVCSTNHQEGFGSEQS

SEQ ID NO: 94316 - protein, 35 aa, Artificial Sequence
  Description of Artificial Sequence: Synthetic polypeptide
DEEEIRTTNPVATEQYGCSCSTGEPLNQRFISNQS

SEQ ID NO: 94317 - protein, 34 aa, Artificial Sequence
  Description of Artificial Sequence: Synthetic polypeptide
VEEEIRTTNPVATEQYGSVNMSDNDQTEGENEDG

SEQ ID NO: 94318 - protein, 32 aa, Artificial Sequence
  Description of Artificial Sequence: Synthetic polypeptide
VEEEIRTTNPVATEQYGSVNMSGMDEGGENID

SEQ ID NO: 94319 - protein, 33 aa, Artificial Sequence
  Description of Artificial Sequence: Synthetic polypeptide
VEEEIRTTNPVATEQYGSVNMTSGLDQIGETGD

SEQ ID NO: 94320 - protein, 33 aa, Artificial Sequence
  Description of Artificial Sequence: Synthetic polypeptide
VEEEIRTTNPVATEQYGSVNMTSGQDQQGENGD

SEQ ID NO: 94321 - protein, 33 aa, Artificial Sequence
  Description of Artificial Sequence: Synthetic polypeptide
DEEEIRTTNPVATEQYGCSCSTGAPLQNFISDQ

SEQ ID NO: 94322 - protein, 34 aa, Artificial Sequence
  Description of Artificial Sequence: Synthetic polypeptide
DEEEIRTTNPVATEQYGCSCSSPNMLQRFDSEQM

SEQ ID NO: 94323 - protein, 33 aa, Artificial Sequence
  Description of Artificial Sequence: Synthetic polypeptide
DEEEIRTTNPVATEQYGCSCSSPEDLQRFDSDQ

SEQ ID NO: 94324 - protein, 33 aa, Artificial Sequence
  Description of Artificial Sequence: Synthetic polypeptide
DEEEIRTTNPVATEQYGCSCSSGEMLQYFDSNQ

SEQ ID NO: 94325 - protein, 34 aa, Artificial Sequence
  Description of Artificial Sequence: Synthetic polypeptide
VEEEIRTTNPVATEQYGSVNTVNGMDQEEGENGD

SEQ ID NO: 94326 - protein, 34 aa, Artificial Sequence
  Description of Artificial Sequence: Synthetic polypeptide
VEEEIRTTNPVATEQYGSVSTTDGDEEQTGENED

SEQ ID NO: 94327 - protein, 34 aa, Artificial Sequence
  Description of Artificial Sequence: Synthetic polypeptide
VEEEIRTTNPVATEQYGSVPSVTPGLQVIVNANE

SEQ ID NO: 94328 - protein, 33 aa, Artificial Sequence
  Description of Artificial Sequence: Synthetic polypeptide
VEEEIRTTNPVATEQYGSVSDTGVGGQGNEEFD

SEQ ID NO: 94329 - protein, 34 aa, Artificial Sequence
  Description of Artificial Sequence: Synthetic polypeptide
VEEEIRTTNPVATEQYGSVSGDGDLEQRNQGEGQ

SEQ ID NO: 94330 - protein, 33 aa, Artificial Sequence
  Description of Artificial Sequence: Synthetic polypeptide
VEEEIRTTNPVATEQYGSVSGDGNGQNTQGEEQ

SEQ ID NO: 94331 - protein, 35 aa, Artificial Sequence
  Description of Artificial Sequence: Synthetic polypeptide
DEEEIRTTNPVATEQYGCSCSMTENLNQSIGSDQS

SEQ ID NO: 94332 - protein, 33 aa, Artificial Sequence
  Description of Artificial Sequence: Synthetic polypeptide
VEEEIRTTNPVATEQYGSVSGGMEGQTGGNVGQ

SEQ ID NO: 94333 - protein, 34 aa, Artificial Sequence
  Description of Artificial Sequence: Synthetic polypeptide
VEEEIRTTNPVATEQYGSVSIDDNEQGEGGGNGT

SEQ ID NO: 94334 - protein, 33 aa, Artificial Sequence
  Description of Artificial Sequence: Synthetic polypeptide
VEEEIRTTNPVATEQYGSVSINNMGMGGENTET

SEQ ID NO: 94335 - protein, 35 aa, Artificial Sequence
  Description of Artificial Sequence: Synthetic polypeptide
VEEEIRTTNPVATEQYGSVSINTNDLGNGNEENIP

SEQ ID NO: 94336 - protein, 34 aa, Artificial Sequence
  Description of Artificial Sequence: Synthetic polypeptide
VEEEIRTTNPVATEQYGSVSISNDQPGEGQNQED

SEQ ID NO: 94337 - protein, 35 aa, Artificial Sequence
  Description of Artificial Sequence: Synthetic polypeptide
VEEEIRTTNPVATEQYGSVSITDDENEGQNNGGNT

SEQ ID NO: 94338 - protein, 34 aa, Artificial Sequence
  Description of Artificial Sequence: Synthetic polypeptide
VEEEIRTTNPVATEQYGSVSDGITNEGGNIGGNP

SEQ ID NO: 94339 - protein, 34 aa, Artificial Sequence
  Description of Artificial Sequence: Synthetic polypeptide
DEEEIRTTNPVATEQYGCSCSTGNPLAYFNSNQS

SEQ ID NO: 94340 - protein, 34 aa, Artificial Sequence
  Description of Artificial Sequence: Synthetic polypeptide
VEEEIRTTNPVATEQYGSVSTTDGDGQEEEGNDG

SEQ ID NO: 94341 - protein, 34 aa, Artificial Sequence
  Description of Artificial Sequence: Synthetic polypeptide
VEEEIRTTNPVATEQYGSVSTVNGFGQENNGGGG

SEQ ID NO: 94342 - protein, 35 aa, Artificial Sequence
  Description of Artificial Sequence: Synthetic polypeptide
VEEEVRTTNPVATEPYGSVSCAGNLSQPRTVGNNR

SEQ ID NO: 94343 - protein, 35 aa, Artificial Sequence
  Description of Artificial Sequence: Synthetic polypeptide
VEEEVRTTNPVATEQYGSVCSTWNLDETRIGNNQE

SEQ ID NO: 94344 - protein, 34 aa, Artificial Sequence
  Description of Artificial Sequence: Synthetic polypeptide
VEEEVRTTNPVAYEQWGSVCSTWNHLDQNIGNNR

SEQ ID NO: 94345 - protein, 35 aa, Artificial Sequence
  Description of Artificial Sequence: Synthetic polypeptide
VEEEVRTTNPVAYEQYGSVSCTGNLDQHTGGNNRI

SEQ ID NO: 94346 - protein, 33 aa, Artificial Sequence
  Description of Artificial Sequence: Synthetic polypeptide
VEEGIRTTNPVATEQYGSVPSVTINLDTPVVNH

SEQ ID NO: 94347 - protein, 32 aa, Artificial Sequence
  Description of Artificial Sequence: Synthetic polypeptide
VEESISTTNPVATEQYGSVYSDHILVQHGNNG

SEQ ID NO: 94348 - protein, 34 aa, Artificial Sequence
  Description of Artificial Sequence: Synthetic polypeptide
DEEEIRTTNPVATEQYGAVVTDTDNGQEGGNGDT

SEQ ID NO: 94349 - protein, 34 aa, Artificial Sequence
  Description of Artificial Sequence: Synthetic polypeptide
VEESVRTTNPVATEQYGSVACAGNLSQRTVGNNR

SEQ ID NO: 94350 - protein, 33 aa, Artificial Sequence
  Description of Artificial Sequence: Synthetic polypeptide
VEEVVRTTNPVATEQYGSVSTWNLMQDTIDNQD

SEQ ID NO: 94351 - protein, 28 aa, Artificial Sequence
  Description of Artificial Sequence: Synthetic peptide
VEGEIAPTNPCSSEQYGIVSCNLQSGTR

SEQ ID NO: 94352 - protein, 33 aa, Artificial Sequence
  Description of Artificial Sequence: Synthetic polypeptide
DEEEIRTTNPVATEQYGAVVSTDTGMGQGNNNI

SEQ ID NO: 94353 - protein, 33 aa, Artificial Sequence
  Description of Artificial Sequence: Synthetic polypeptide
DEEEIRTTNPVATEQYGAVVSTDTGMGQGENIG

SEQ ID NO: 94354 - protein, 34 aa, Artificial Sequence
  Description of Artificial Sequence: Synthetic polypeptide
VEHEIRTTNPVAYEQYGQHVVPSTNLSQRGGNME

SEQ ID NO: 94355 - protein, 34 aa, Artificial Sequence
  Description of Artificial Sequence: Synthetic polypeptide
DEEEIRTTNPVATEQYGAVVSNDTVGQTGNGNGN

SEQ ID NO: 94356 - protein, 28 aa, Artificial Sequence
  Description of Artificial Sequence: Synthetic peptide
VENEIATTNPVATECYGDVSECLQHEEL

SEQ ID NO: 94357 - protein, 28 aa, Artificial Sequence
  Description of Artificial Sequence: Synthetic peptide
VENEIATTNPVATECYGDVSYCLQHEEL

SEQ ID NO: 94358 - protein, 28 aa, Artificial Sequence
  Description of Artificial Sequence: Synthetic peptide
VENEIATTNPVATECYGWVSECLQHEEL

SEQ ID NO: 94359 - protein, 32 aa, Artificial Sequence
  Description of Artificial Sequence: Synthetic polypeptide
VENEIRTTNPVATETYGSVSNNLQEVGDTTPT

SEQ ID NO: 94360 - protein, 30 aa, Artificial Sequence
  Description of Artificial Sequence: Synthetic polypeptide
WEDEIACTNPVATEQYGCASANLQDAGGQR

SEQ ID NO: 94361 - protein, 34 aa, Artificial Sequence
  Description of Artificial Sequence: Synthetic polypeptide
DEEEIRTTNPVATEQYGAVVGVNLQGEFFGNGEE

SEQ ID NO: 94362 - protein, 34 aa, Artificial Sequence
  Description of Artificial Sequence: Synthetic polypeptide
WEEEIATTNPVATEQYGSVATNNLPQEAPGENDN

SEQ ID NO: 94363 - protein, 32 aa, Artificial Sequence
  Description of Artificial Sequence: Synthetic polypeptide
VEEEVATTNPVATAQWGSVSATGELDQRDGND

SEQ ID NO: 94364 - protein, 32 aa, Artificial Sequence
  Description of Artificial Sequence: Synthetic polypeptide
VEEEVACTNPVATEQWGSVATPNLDQPDIGNR

SEQ ID NO: 94365 - protein, 34 aa, Artificial Sequence
  Description of Artificial Sequence: Synthetic polypeptide
VEEELRTTNPVAYEQWGSVCSTWNHLDQNIGNKR

SEQ ID NO: 94366 - protein, 34 aa, Artificial Sequence
  Description of Artificial Sequence: Synthetic polypeptide
VEEELRTTNPVAYEQWGSVCSTWEHLDQRDGGNR

SEQ ID NO: 94367 - protein, 33 aa, Artificial Sequence
  Description of Artificial Sequence: Synthetic polypeptide
VEEEIRTTNPVATEQYGSVSVTNDQPEVLVSGI

SEQ ID NO: 94368 - protein, 34 aa, Artificial Sequence
  Description of Artificial Sequence: Synthetic polypeptide
VEEEIRTTNPVATEQYGSVSVTTAEEELGQNVRD

SEQ ID NO: 94369 - protein, 32 aa, Artificial Sequence
  Description of Artificial Sequence: Synthetic polypeptide
DEEEIRTTNPVATEQYGCCSLDVLDERGEGIQ

SEQ ID NO: 94370 - protein, 34 aa, Artificial Sequence
  Description of Artificial Sequence: Synthetic polypeptide
DEEEIRTTNPVATEQYGCAVSTSNEDEQQENDEQ

SEQ ID NO: 94371 - protein, 34 aa, Artificial Sequence
  Description of Artificial Sequence: Synthetic polypeptide
VEEEIRTTNPVATEQYGSVTDTVGQNGQEGGGNA

SEQ ID NO: 94372 - protein, 33 aa, Artificial Sequence
  Description of Artificial Sequence: Synthetic polypeptide
DEEEIRTTNPVATEQYGCAVCSWNHQNFGSEAS

SEQ ID NO: 94373 - protein, 33 aa, Artificial Sequence
  Description of Artificial Sequence: Synthetic polypeptide
VEEEIRTTNPVATEQYGSVVGNGQEEGGGGGNG

SEQ ID NO: 94374 - protein, 34 aa, Artificial Sequence
  Description of Artificial Sequence: Synthetic polypeptide
VEEEIRTTNPVATEQYGSVYGTDGNNQGQGNIEE

SEQ ID NO: 94375 - protein, 35 aa, Artificial Sequence
  Description of Artificial Sequence: Synthetic polypeptide
DEEEIRTTNPVATEQYGCAVCSTGNLQNFNSENQQ

SEQ ID NO: 94376 - protein, 34 aa, Artificial Sequence
  Description of Artificial Sequence: Synthetic polypeptide
DEEEIRTTNPVATEQYGCAVCSTGELQNFGSDQA

SEQ ID NO: 94377 - protein, 35 aa, Artificial Sequence
  Description of Artificial Sequence: Synthetic polypeptide
VEEEIRTTNPVATEQYGSVSTTGGNDQLGEGGNIG

SEQ ID NO: 94378 - protein, 32 aa, Artificial Sequence
  Description of Artificial Sequence: Synthetic polypeptide
VEEEIRTTNPVATEQYGTVSDNMGMGGEGNTQ

SEQ ID NO: 94379 - protein, 33 aa, Artificial Sequence
  Description of Artificial Sequence: Synthetic polypeptide
VEEEIRTTNPVATEQYGTVSTDLQLEEGEGGGQ

SEQ ID NO: 94380 - protein, 33 aa, Artificial Sequence
  Description of Artificial Sequence: Synthetic polypeptide
VEEEIRTTNPVATEQYGVVSTGVGGQGNDGNMT

SEQ ID NO: 94381 - protein, 35 aa, Artificial Sequence
  Description of Artificial Sequence: Synthetic polypeptide
DEEEIRTTNPVATEQYGCAVCSNTENLQNFGSEQM

SEQ ID NO: 94382 - protein, 34 aa, Artificial Sequence
  Description of Artificial Sequence: Synthetic polypeptide
VEEEIRTTNPVAYEAYGQHVVQSTNSSQRGGNDR

SEQ ID NO: 94383 - protein, 34 aa, Artificial Sequence
  Description of Artificial Sequence: Synthetic polypeptide
VEEEIRTTNPVAYEAYGQHVVSTTNLSQHGGNDR

SEQ ID NO: 94384 - protein, 34 aa, Artificial Sequence
  Description of Artificial Sequence: Synthetic polypeptide
VEEEIRTTNPVAYEAYGQVVVQSTNLSQMGGNDR

SEQ ID NO: 94385 - protein, 34 aa, Artificial Sequence
  Description of Artificial Sequence: Synthetic polypeptide
VEEEIRTTNPVAYEQYGQHVVPSTNLSERGGNMQ

SEQ ID NO: 94386 - protein, 35 aa, Artificial Sequence
  Description of Artificial Sequence: Synthetic polypeptide
VEEEIRTTNPVAYEQYGQHVVPSTQNLSQRGGNDQ

SEQ ID NO: 94387 - protein, 35 aa, Artificial Sequence
  Description of Artificial Sequence: Synthetic polypeptide
VEEEIRTTNPVAYEQYGQHVVPSYLNLSQRGGNDR

SEQ ID NO: 94388 - protein, 31 aa, Artificial Sequence
  Description of Artificial Sequence: Synthetic polypeptide
VEEEIRTTNPVAYESYGSVSMAIFQQDGGNE

SEQ ID NO: 94389 - protein, 34 aa, Artificial Sequence
  Description of Artificial Sequence: Synthetic polypeptide
DEEEIRTTNPVATEQYGCAVCSTELNQNFGSEQS

SEQ ID NO: 94390 - protein, 33 aa, Artificial Sequence
  Description of Artificial Sequence: Synthetic polypeptide
TEWEIRTTNPVATEPWGSVPSTNHSDREGNERF

SEQ ID NO: 94391 - protein, 31 aa, Artificial Sequence
  Description of Artificial Sequence: Synthetic polypeptide
TEVEIATTNPVAYDQYGKVPSCTALSQQGNR

SEQ ID NO: 94392 - protein, 30 aa, Artificial Sequence
  Description of Artificial Sequence: Synthetic polypeptide
AEEEIASVNPVCTEQYGVVSNDNLGQSGNQ

SEQ ID NO: 94393 - protein, 32 aa, Artificial Sequence
  Description of Artificial Sequence: Synthetic polypeptide
TEEEIRTTNPVATEQYGSVTTTLGVREVASDG

SEQ ID NO: 94394 - protein, 34 aa, Artificial Sequence
  Description of Artificial Sequence: Synthetic polypeptide
TEEEIRTTNPVATEQYGSVVATGNGSQEIGTNHL

SEQ ID NO: 94395 - protein, 34 aa, Artificial Sequence
  Description of Artificial Sequence: Synthetic polypeptide
DEEEIRTTNPVATEQYGCVCSNTPTQNFGSNTQT

SEQ ID NO: 94396 - protein, 34 aa, Artificial Sequence
  Description of Artificial Sequence: Synthetic polypeptide
DEEEIRTTNPVATEQYGCVCSNTPPHQGFGSNQS

SEQ ID NO: 94397 - protein, 34 aa, Artificial Sequence
  Description of Artificial Sequence: Synthetic polypeptide
DEEEIRTTNPVATEQYGCVCSNTPLQENFISNQA

SEQ ID NO: 94398 - protein, 35 aa, Artificial Sequence
  Description of Artificial Sequence: Synthetic polypeptide
DEEEIRTTNPVATEQYGCVCSNTPLQENFGSNNQS

SEQ ID NO: 94399 - protein, 33 aa, Artificial Sequence
  Description of Artificial Sequence: Synthetic polypeptide
TEEEIRTTNPVATEQYGSVVTMNEGQGGDEQGD

SEQ ID NO: 94400 - protein, 34 aa, Artificial Sequence
  Description of Artificial Sequence: Synthetic polypeptide
TEEEIRTTNPVATEQYGSVVTNNMEGQGGDENND

SEQ ID NO: 94401 - protein, 32 aa, Artificial Sequence
  Description of Artificial Sequence: Synthetic polypeptide
DEEEIRTTNPVATEQYGCVCSNTPHQNFLSDQ

SEQ ID NO: 94402 - protein, 34 aa, Artificial Sequence
  Description of Artificial Sequence: Synthetic polypeptide
DEEEIRTTNPVATEQYGCVCSNTPHQNFGSNTQF

SEQ ID NO: 94403 - protein, 34 aa, Artificial Sequence
  Description of Artificial Sequence: Synthetic polypeptide
DEEEIRTTNPVATEQYGCVCSNTPHQEGSNSDQA

SEQ ID NO: 94404 - protein, 33 aa, Artificial Sequence
  Description of Artificial Sequence: Synthetic polypeptide
DEEEIRTTNPVATEQYGCVCSNTPELEGFGSDQ

SEQ ID NO: 94405 - protein, 34 aa, Artificial Sequence
  Description of Artificial Sequence: Synthetic polypeptide
DEEEIRTTNPVATEQYGCVCSNTNTNQNFNSEQG

SEQ ID NO: 94406 - protein, 34 aa, Artificial Sequence
  Description of Artificial Sequence: Synthetic polypeptide
DEEEIRTTNPVATEQYGCVCSNTNNNQHFGSQFS

SEQ ID NO: 94407 - protein, 33 aa, Artificial Sequence
  Description of Artificial Sequence: Synthetic polypeptide
TEEEIRTTNPVATEQYGTVVPSCCNMLNSGGDR

SEQ ID NO: 94408 - protein, 33 aa, Artificial Sequence
  Description of Artificial Sequence: Synthetic polypeptide
TEEEIRTTNPVATEQYGVVSSGFGNEGQGGNGT

SEQ ID NO: 94409 - protein, 32 aa, Artificial Sequence
  Description of Artificial Sequence: Synthetic polypeptide
TEEEIRTTNPVATEQYGVVSTDGQEEGGGEGG

SEQ ID NO: 94410 - protein, 33 aa, Artificial Sequence
  Description of Artificial Sequence: Synthetic polypeptide
TEEEIRTTNPVATERYGISVSYANDSQETVGNA

SEQ ID NO: 94411 - protein, 32 aa, Artificial Sequence
  Description of Artificial Sequence: Synthetic polypeptide
TEEEIRTTNPVATERYGKVVSCSALQRGGEYA

SEQ ID NO: 94412 - protein, 34 aa, Artificial Sequence
  Description of Artificial Sequence: Synthetic polypeptide
DEEEIRTTNPVATEQYGCVCSNTNHQHSNSNNQT

SEQ ID NO: 94413 - protein, 34 aa, Artificial Sequence
  Description of Artificial Sequence: Synthetic polypeptide
DEEEIRTTNPVATEQYGCVCSNTNHQHFNSQTQT

SEQ ID NO: 94414 - protein, 33 aa, Artificial Sequence
  Description of Artificial Sequence: Synthetic polypeptide
DEEEIRTTNPVATEQYGCVCSNTYDQSFGSEQG

SEQ ID NO: 94415 - protein, 34 aa, Artificial Sequence
  Description of Artificial Sequence: Synthetic polypeptide
TEEEIRTTNPVATERYGSVAVAGNLSQRTVGNPT

SEQ ID NO: 94416 - protein, 34 aa, Artificial Sequence
  Description of Artificial Sequence: Synthetic polypeptide
DEEEIRTTNPVATEQYGCVCSNTYHQENFGSNQF

SEQ ID NO: 94417 - protein, 33 aa, Artificial Sequence
  Description of Artificial Sequence: Synthetic polypeptide
DEEEIRTTNPVATEQYGCVCSNTYHQYFGSEQM

SEQ ID NO: 94418 - protein, 33 aa, Artificial Sequence
  Description of Artificial Sequence: Synthetic polypeptide
AEEEIRATNPCATEQYGSVSTENGLMEIGTNDM

SEQ ID NO: 94419 - protein, 34 aa, Artificial Sequence
  Description of Artificial Sequence: Synthetic polypeptide
TEEEIRTTNPVATEQYGSVSTGNGSTTIGTNNHL

SEQ ID NO: 94420 - protein, 33 aa, Artificial Sequence
  Description of Artificial Sequence: Synthetic polypeptide
AEEEIRATNPCATEQYGSVSTENALGMEIGTNM

SEQ ID NO: 94421 - protein, 34 aa, Artificial Sequence
  Description of Artificial Sequence: Synthetic polypeptide
AEEEIRATNPCATEQYGSVSTEGNQLEQIGTNVS

SEQ ID NO: 94422 - protein, 33 aa, Artificial Sequence
  Description of Artificial Sequence: Synthetic polypeptide
TEEEIRTTNPVATEQYGSVSTLGQELEGGGGET

SEQ ID NO: 94423 - protein, 33 aa, Artificial Sequence
  Description of Artificial Sequence: Synthetic polypeptide
AEEEIRATNPCATEQYGSVSTEENLMEIGTNMG

SEQ ID NO: 94424 - protein, 32 aa, Artificial Sequence
  Description of Artificial Sequence: Synthetic polypeptide
AEEEIRATNPCATEQYGSVSNENLMQGTNNVD

SEQ ID NO: 94425 - protein, 32 aa, Artificial Sequence
  Description of Artificial Sequence: Synthetic polypeptide
AEEEIRATNPCATEQYGSVSNENLLMQGNNVA

SEQ ID NO: 94426 - protein, 32 aa, Artificial Sequence
  Description of Artificial Sequence: Synthetic polypeptide
AEEEIRATNPCATEQYGSVSENNLMQGTNNVT

SEQ ID NO: 94427 - protein, 34 aa, Artificial Sequence
  Description of Artificial Sequence: Synthetic polypeptide
AEEEICTTNPVATEQYGVVSVTTNLQSGNNNEDD

SEQ ID NO: 94428 - protein, 34 aa, Artificial Sequence
  Description of Artificial Sequence: Synthetic polypeptide
AEEEICTTNPVATEQYGVVSVTTNLQQGGNNQAD

SEQ ID NO: 94429 - protein, 34 aa, Artificial Sequence
  Description of Artificial Sequence: Synthetic polypeptide
AEEEICTTNPVATEQYGVVSVTTNLQQGGNNEDD

SEQ ID NO: 94430 - protein, 33 aa, Artificial Sequence
  Description of Artificial Sequence: Synthetic polypeptide
DEEEIRTTNPVATEQYGCVCSNWEDQGFGSNQT

SEQ ID NO: 94431 - protein, 34 aa, Artificial Sequence
  Description of Artificial Sequence: Synthetic polypeptide
AEEEICTTNPVATEQYGVVSVTTNLQGGGNNEND

SEQ ID NO: 94432 - protein, 34 aa, Artificial Sequence
  Description of Artificial Sequence: Synthetic polypeptide
AEEEICTTNPVATEQYGVVSVTTNLQFGTNNEAD

SEQ ID NO: 94433 - protein, 34 aa, Artificial Sequence
  Description of Artificial Sequence: Synthetic polypeptide
TEEEIRTTNPVATEQYGSVSTTDLSDDNGGNNGQ

SEQ ID NO: 94434 - protein, 35 aa, Artificial Sequence
  Description of Artificial Sequence: Synthetic polypeptide
TEEEIRTTNPVATEQYGSVSTTLGFGTQTGGQNEG

SEQ ID NO: 94435 - protein, 35 aa, Artificial Sequence
  Description of Artificial Sequence: Synthetic polypeptide
TEEEIRTTNPVATEQYGSVSTTMNTDGQGEGENGT

SEQ ID NO: 94436 - protein, 33 aa, Artificial Sequence
  Description of Artificial Sequence: Synthetic polypeptide
DEEEIRTTNPVATEQYGCVCSNTYTQGFNSNQY

SEQ ID NO: 94437 - protein, 35 aa, Artificial Sequence
  Description of Artificial Sequence: Synthetic polypeptide
AEEEICTTNPVATEQYGVVSVTSTNLQAGNGNQQD

SEQ ID NO: 94438 - protein, 34 aa, Artificial Sequence
  Description of Artificial Sequence: Synthetic polypeptide
DEEEIRTTNPVATEQYGCVCSNTYLQENFGSDQS

SEQ ID NO: 94439 - protein, 34 aa, Artificial Sequence
  Description of Artificial Sequence: Synthetic polypeptide
AEEEICTTNPVATEQYGVVSVTATNLQQGNNEDD

SEQ ID NO: 94440 - protein, 33 aa, Artificial Sequence
  Description of Artificial Sequence: Synthetic polypeptide
DEEEIRTTNPVATEQYGCVCSNTNHQGFLSEQA

SEQ ID NO: 94441 - protein, 33 aa, Artificial Sequence
  Description of Artificial Sequence: Synthetic polypeptide
TEEEIRTTNPVATERYGSVAVANLSQTRTVGET

SEQ ID NO: 94442 - protein, 35 aa, Artificial Sequence
  Description of Artificial Sequence: Synthetic polypeptide
DEEEIRTTNPVATEQYGCVCSNTNHQESFGSENQE

SEQ ID NO: 94443 - protein, 34 aa, Artificial Sequence
  Description of Artificial Sequence: Synthetic polypeptide
DEEEIRTTNPVATEQYGCVCSNTGNHQNSGSDQE

SEQ ID NO: 94444 - protein, 35 aa, Artificial Sequence
  Description of Artificial Sequence: Synthetic polypeptide
DEEEIRTTNPVATEQYGCVCSNTGNHQNFGSDNQS

SEQ ID NO: 94445 - protein, 35 aa, Artificial Sequence
  Description of Artificial Sequence: Synthetic polypeptide
DEEEIRTTNPVATEQYGCVCSNTGNHQHFGSNNAS

SEQ ID NO: 94446 - protein, 34 aa, Artificial Sequence
  Description of Artificial Sequence: Synthetic polypeptide
DEEEIRTTNPVATEQYGCVCSNTGNHQHFGSEQS

SEQ ID NO: 94447 - protein, 34 aa, Artificial Sequence
  Description of Artificial Sequence: Synthetic polypeptide
DEEEIRTTNPVATEQYGCVCSNTGNHQFFGSVQG

SEQ ID NO: 94448 - protein, 35 aa, Artificial Sequence
  Description of Artificial Sequence: Synthetic polypeptide
DEEEIRTTNPVATEQYGCVCSNTGNHNQNGNSEQS

SEQ ID NO: 94449 - protein, 32 aa, Artificial Sequence
  Description of Artificial Sequence: Synthetic polypeptide
TEEEIRTTNPVAYEAYGSVPSNAELFQSGGNY

SEQ ID NO: 94450 - protein, 32 aa, Artificial Sequence
  Description of Artificial Sequence: Synthetic polypeptide
TEEEIRTTNPVAYEAYGSVPSNGELFQSGGSR

SEQ ID NO: 94451 - protein, 33 aa, Artificial Sequence
  Description of Artificial Sequence: Synthetic polypeptide
TEEEIRTTNPVAYEAYGSVPSNIHELFQSGGNR

SEQ ID NO: 94452 - protein, 33 aa, Artificial Sequence
  Description of Artificial Sequence: Synthetic polypeptide
TEEEIRTTNPVAYEAYGSVPSNLELFQSGGNTR

SEQ ID NO: 94453 - protein, 32 aa, Artificial Sequence
  Description of Artificial Sequence: Synthetic polypeptide
TEEEIRTTNPVAYEAYGSVPSQGEDFQSGGNR

SEQ ID NO: 94454 - protein, 33 aa, Artificial Sequence
  Description of Artificial Sequence: Synthetic polypeptide
DEEEIRTTNPVATEQYGCVCSNTGETQNFGSEQ

SEQ ID NO: 94455 - protein, 33 aa, Artificial Sequence
  Description of Artificial Sequence: Synthetic polypeptide
DEEEIRTTNPVATEQYGCVCSNTGETQHGSEQG

SEQ ID NO: 94456 - protein, 33 aa, Artificial Sequence
  Description of Artificial Sequence: Synthetic polypeptide
TEEEIRTTNPVAYEAYGSVVNNAMVQRGGNNLR

SEQ ID NO: 94457 - protein, 33 aa, Artificial Sequence
  Description of Artificial Sequence: Synthetic polypeptide
TEEEIRTTNPVAYEAYGSVVSCTNLHTGTDQNA

SEQ ID NO: 94458 - protein, 34 aa, Artificial Sequence
  Description of Artificial Sequence: Synthetic polypeptide
DEEEIRTTNPVATEQYGCVCSNTGELQYFGSDQY

SEQ ID NO: 94459 - protein, 34 aa, Artificial Sequence
  Description of Artificial Sequence: Synthetic polypeptide
DEEEIRTTNPVATEQYGCVCSNTGELQNFNSDQY

SEQ ID NO: 94460 - protein, 34 aa, Artificial Sequence
  Description of Artificial Sequence: Synthetic polypeptide
DEEEIRTTNPVATEQYGCVCSNTGELQNFNSDAG

SEQ ID NO: 94461 - protein, 34 aa, Artificial Sequence
  Description of Artificial Sequence: Synthetic polypeptide
DEEEIRTTNPVATEQYGCVCSNTGELQHFNSQQG

SEQ ID NO: 94462 - protein, 35 aa, Artificial Sequence
  Description of Artificial Sequence: Synthetic polypeptide
DEEEIRTTNPVATEQYGCVCSNTGELQESFGSDNQ

SEQ ID NO: 94463 - protein, 31 aa, Artificial Sequence
  Description of Artificial Sequence: Synthetic polypeptide
TEEEIRTTNPVAYEHYGEVPSNNEFQGGGNK

SEQ ID NO: 94464 - protein, 35 aa, Artificial Sequence
  Description of Artificial Sequence: Synthetic polypeptide
DEEEIRTTNPVATEQYGCVCSNTGNHQSFGSDNQS

SEQ ID NO: 94465 - protein, 35 aa, Artificial Sequence
  Description of Artificial Sequence: Synthetic polypeptide
DEEEIRTTNPVATEQYGCVCSNTGNLNQFFGSEQS

SEQ ID NO: 94466 - protein, 32 aa, Artificial Sequence
  Description of Artificial Sequence: Synthetic polypeptide
TEEEIRTTNPVAYEAWGSVVSCTNLHRGQDQN

SEQ ID NO: 94467 - protein, 34 aa, Artificial Sequence
  Description of Artificial Sequence: Synthetic polypeptide
TEEEIRTTNPVAWEQYGSTVPSAGNLSDNEGNNR

SEQ ID NO: 94468 - protein, 34 aa, Artificial Sequence
  Description of Artificial Sequence: Synthetic polypeptide
DEEEIRTTNPVATEQYGCVCSNTNHQENFPSNQS

SEQ ID NO: 94469 - protein, 34 aa, Artificial Sequence
  Description of Artificial Sequence: Synthetic polypeptide
DEEEIRTTNPVATEQYGCVCSNTNHQEHFNSQQA

SEQ ID NO: 94470 - protein, 34 aa, Artificial Sequence
  Description of Artificial Sequence: Synthetic polypeptide
DEEEIRTTNPVATEQYGCVCSNTNHNQYFNSDQA

SEQ ID NO: 94471 - protein, 34 aa, Artificial Sequence
  Description of Artificial Sequence: Synthetic polypeptide
DEEEIRTTNPVATEQYGCVCSNTNHNQNFNSNQM

SEQ ID NO: 94472 - protein, 34 aa, Artificial Sequence
  Description of Artificial Sequence: Synthetic polypeptide
TEEEIRTTNPVATERYGSVAVCADNLSQRTVGNT

SEQ ID NO: 94473 - protein, 33 aa, Artificial Sequence
  Description of Artificial Sequence: Synthetic polypeptide
TEEEIRTTNPVATERYGSVAVYANVSQRTVGNT

SEQ ID NO: 94474 - protein, 35 aa, Artificial Sequence
  Description of Artificial Sequence: Synthetic polypeptide
DEEEIRTTNPVATEQYGCVCSNTNHNQEGFGSNQA

SEQ ID NO: 94475 - protein, 33 aa, Artificial Sequence
  Description of Artificial Sequence: Synthetic polypeptide
DEEEIRTTNPVATEQYGCVCSNTNHAHFNSNQA

SEQ ID NO: 94476 - protein, 34 aa, Artificial Sequence
  Description of Artificial Sequence: Synthetic polypeptide
DEEEIRTTNPVATEQYGCVCSNTNGNQYFGSDQN

SEQ ID NO: 94477 - protein, 34 aa, Artificial Sequence
  Description of Artificial Sequence: Synthetic polypeptide
TEEEIRTTNPVATERYGSVSTGNELSQPPGGMSS

SEQ ID NO: 94478 - protein, 34 aa, Artificial Sequence
  Description of Artificial Sequence: Synthetic polypeptide
TEEEIRTTNPVATEQYGSVSTGNELSPTPGGMSS

SEQ ID NO: 94479 - protein, 34 aa, Artificial Sequence
  Description of Artificial Sequence: Synthetic polypeptide
TEEEIRTTNPVATERYGTVVQSTNEISQAGGNRF

SEQ ID NO: 94480 - protein, 34 aa, Artificial Sequence
  Description of Artificial Sequence: Synthetic polypeptide
DEEEIRTTNPVATEAYGTVSTSTNEQAGNNNQFG

SEQ ID NO: 94481 - protein, 33 aa, Artificial Sequence
  Description of Artificial Sequence: Synthetic polypeptide
TEEEIRTTNPVATERYGTVVSINELSQAGGDRF

SEQ ID NO: 94482 - protein, 34 aa, Artificial Sequence
  Description of Artificial Sequence: Synthetic polypeptide
DEEEIRTTNPVATEQYGCVCSNTNDQNFGSETQP

SEQ ID NO: 94483 - protein, 33 aa, Artificial Sequence
  Description of Artificial Sequence: Synthetic polypeptide
TEEEIRTTNPVATERYGTVVSKNELSQAGGNSN

SEQ ID NO: 94484 - protein, 34 aa, Artificial Sequence
  Description of Artificial Sequence: Synthetic polypeptide
DEEEIRTTNPVATEQYGCVCSNTNAHQNFNSDQA

SEQ ID NO: 94485 - protein, 33 aa, Artificial Sequence
  Description of Artificial Sequence: Synthetic polypeptide
DEEEIRTTNPVATEAYGTVSTSVTNTEQGNNTF

SEQ ID NO: 94486 - protein, 34 aa, Artificial Sequence
  Description of Artificial Sequence: Synthetic polypeptide
TEEEIRTTNPVATERYGTVVSTNNELSVAGGNRF

SEQ ID NO: 94487 - protein, 34 aa, Artificial Sequence
  Description of Artificial Sequence: Synthetic polypeptide
DEEEIRTTNPVATEQYGCVCSNTMELQFFNSDQE

SEQ ID NO: 94488 - protein, 34 aa, Artificial Sequence
  Description of Artificial Sequence: Synthetic polypeptide
TEEEIRTTNPVATEYYGSVSTGNELSQMPGGMES

SEQ ID NO: 94489 - protein, 34 aa, Artificial Sequence
  Description of Artificial Sequence: Synthetic polypeptide
DEEEIRTTNPVATEQYGCVCSNTGYLQHFNSNQS

SEQ ID NO: 94490 - protein, 35 aa, Artificial Sequence
  Description of Artificial Sequence: Synthetic polypeptide
TEEEIRTTNPVATERYGTVVSCTTNELSQAGGNRF

SEQ ID NO: 94491 - protein, 35 aa, Artificial Sequence
  Description of Artificial Sequence: Synthetic polypeptide
TEEEIRTTNPVATEQYGSVSTGNAGSQDIGTNNHL

SEQ ID NO: 94492 - protein, 33 aa, Artificial Sequence
  Description of Artificial Sequence: Synthetic polypeptide
AEEEIRATNPCATEQYGSVSTENLEMEIGTNMN

SEQ ID NO: 94493 - protein, 34 aa, Artificial Sequence
  Description of Artificial Sequence: Synthetic polypeptide
AEEEIRATNPCATEQYGSVSTENLLMEQIGTNVS

SEQ ID NO: 94494 - protein, 31 aa, Artificial Sequence
  Description of Artificial Sequence: Synthetic polypeptide
TEEEIRTTNPVATEQWGSVWPDHNNSNGNII

SEQ ID NO: 94495 - protein, 34 aa, Artificial Sequence
  Description of Artificial Sequence: Synthetic polypeptide
TEEEIRTTNPVATEQYGAVVGNSGNLNQEGGNIG

SEQ ID NO: 94496 - protein, 31 aa, Artificial Sequence
  Description of Artificial Sequence: Synthetic polypeptide
TEEEIRTTNPVATEQYGCVCGTAHQNFGSQQ

SEQ ID NO: 94497 - protein, 32 aa, Artificial Sequence
  Description of Artificial Sequence: Synthetic polypeptide
TEEEIRTTNPVATEQYGCVCGTALQNFNSDQA

SEQ ID NO: 94498 - protein, 33 aa, Artificial Sequence
  Description of Artificial Sequence: Synthetic polypeptide
TEEEIRTTNPVATEQYGCVCNTENHNQYGSNTQ

SEQ ID NO: 94499 - protein, 35 aa, Artificial Sequence
  Description of Artificial Sequence: Synthetic polypeptide
TEEEIRTTNPVATEQYGCVCQTGNLNQRFGSQNQA

SEQ ID NO: 94500 - protein, 34 aa, Artificial Sequence
  Description of Artificial Sequence: Synthetic polypeptide
TEEEIRTTNPVATEQYGCVNTGNHNQRFGSNTQS

SEQ ID NO: 94501 - protein, 34 aa, Artificial Sequence
  Description of Artificial Sequence: Synthetic polypeptide
TEEEIRTTNPVATEQYGEVSSTGDLQPTGDNHKL

SEQ ID NO: 94502 - protein, 32 aa, Artificial Sequence
  Description of Artificial Sequence: Synthetic polypeptide
TEEEIRTTNPVATEQYGQCVCGTALQNFGSDQ

SEQ ID NO: 94503 - protein, 34 aa, Artificial Sequence
  Description of Artificial Sequence: Synthetic polypeptide
TEEEIRTTNPVATEQYGQCVCNTGNLNQNGSNNQ

SEQ ID NO: 94504 - protein, 34 aa, Artificial Sequence
  Description of Artificial Sequence: Synthetic polypeptide
TEEEIRTTNPVATEQYGQSTVSTNLSDNVANNDI

SEQ ID NO: 94505 - protein, 33 aa, Artificial Sequence
  Description of Artificial Sequence: Synthetic polypeptide
TEEEIRTTNPVATEQYGQVTSTTDGQGGNTGNT

SEQ ID NO: 94506 - protein, 31 aa, Artificial Sequence
  Description of Artificial Sequence: Synthetic polypeptide
AEEEIRTTNCVATEGYGCTSIMNLGQGGGNI

SEQ ID NO: 94507 - protein, 33 aa, Artificial Sequence
  Description of Artificial Sequence: Synthetic polypeptide
AEEEIRCTNPVATEQYGSVSSTPAGPNMRNGNV

SEQ ID NO: 94508 - protein, 32 aa, Artificial Sequence
  Description of Artificial Sequence: Synthetic polypeptide
AEEEIRCTNPVATEQYGSASSENGPNMRGGPR

SEQ ID NO: 94509 - protein, 33 aa, Artificial Sequence
  Description of Artificial Sequence: Synthetic polypeptide
AEEEIRCTNPVATEQYGEASSTEPNGQRGMGPR

SEQ ID NO: 94510 - protein, 33 aa, Artificial Sequence
  Description of Artificial Sequence: Synthetic polypeptide
AEEEIRATNPVATEQYGSVSTGNPPGQHDENGH

SEQ ID NO: 94511 - protein, 34 aa, Artificial Sequence
  Description of Artificial Sequence: Synthetic polypeptide
AEEEIRATNPVATEQYGSVSTGNPLGQHDENGMN

SEQ ID NO: 94512 - protein, 34 aa, Artificial Sequence
  Description of Artificial Sequence: Synthetic polypeptide
AEEEIRATNPVATEQYGSVSHQNADDQLRGMNWS

SEQ ID NO: 94513 - protein, 35 aa, Artificial Sequence
  Description of Artificial Sequence: Synthetic polypeptide
TEEEIRTTNPVATEQYGSTVSTGNGSQPSTGTNHI

SEQ ID NO: 94514 - protein, 32 aa, Artificial Sequence
  Description of Artificial Sequence: Synthetic polypeptide
AEEEIRATNPVATEQYGCVAITNNLEPGEEGR

SEQ ID NO: 94515 - protein, 32 aa, Artificial Sequence
  Description of Artificial Sequence: Synthetic polypeptide
AEEEIRTTNPVACEPYGQAPSVTVLSQKGNRT

SEQ ID NO: 94516 - protein, 31 aa, Artificial Sequence
  Description of Artificial Sequence: Synthetic polypeptide
AEEEIRTTNPVATDQYGSVSNSDEQRSEEDH

SEQ ID NO: 94517 - protein, 34 aa, Artificial Sequence
  Description of Artificial Sequence: Synthetic polypeptide
AEEEIRTTNPVATEAYGSVSTNLQQQANQENEVE

SEQ ID NO: 94518 - protein, 34 aa, Artificial Sequence
  Description of Artificial Sequence: Synthetic polypeptide
TEEEIRTTNPVATEQWGSVCSKTMDDLQRNQNDA

SEQ ID NO: 94519 - protein, 33 aa, Artificial Sequence
  Description of Artificial Sequence: Synthetic polypeptide
DEEEIRTTNPVATEQYGCVCSNWGNHQHFNSNQ

SEQ ID NO: 94520 - protein, 34 aa, Artificial Sequence
  Description of Artificial Sequence: Synthetic polypeptide
TEEEIRTTNPVATECYGSVVWTYGLSQRTPGVNE

SEQ ID NO: 94521 - protein, 32 aa, Artificial Sequence
  Description of Artificial Sequence: Synthetic polypeptide
TEEEIRTTNPVATEGYGCYTSIMNLGQGGGNI

SEQ ID NO: 94522 - protein, 34 aa, Artificial Sequence
  Description of Artificial Sequence: Synthetic polypeptide
AEEEIRTTNPVATEAYGSVSTTNQQQQANGENGN

SEQ ID NO: 94523 - protein, 34 aa, Artificial Sequence
  Description of Artificial Sequence: Synthetic polypeptide
DEEEIRTTNPVATEQYGCVCSNWGELQNFGSENQ

SEQ ID NO: 94524 - protein, 34 aa, Artificial Sequence
  Description of Artificial Sequence: Synthetic polypeptide
TEEEIRTTNPVATEPYGQVASTTDLSQRTMGNNT

SEQ ID NO: 94525 - protein, 33 aa, Artificial Sequence
  Description of Artificial Sequence: Synthetic polypeptide
TEEEIRTTNPVATEPYGQVPSTHELSHSGNNER

SEQ ID NO: 94526 - protein, 34 aa, Artificial Sequence
  Description of Artificial Sequence: Synthetic polypeptide
AEEEIRTTNPVATEAYGSVSTTNQNGNQQGNQTN

SEQ ID NO: 94527 - protein, 34 aa, Artificial Sequence
  Description of Artificial Sequence: Synthetic polypeptide
AEEEIRTTNPVATEAYGSVSTTNNQNNQNGNQTQ

SEQ ID NO: 94528 - protein, 34 aa, Artificial Sequence
  Description of Artificial Sequence: Synthetic polypeptide
AEEEIRTTNPVATEAYGSVSTTNNNDEQLQGDNL

SEQ ID NO: 94529 - protein, 33 aa, Artificial Sequence
  Description of Artificial Sequence: Synthetic polypeptide
AEEEIRATNPVATEQYGCVAITNHLEQTGEEGR

SEQ ID NO: 94530 - protein, 34 aa, Artificial Sequence
  Description of Artificial Sequence: Synthetic polypeptide
AEEEIRTTNPVATEAYGSVSTTNNLQQQTTTNVA

SEQ ID NO: 94531 - protein, 35 aa, Artificial Sequence
  Description of Artificial Sequence: Synthetic polypeptide
AEEEIRTTNPVATEAYGSVSTTNNLNDNQNQGDNL

SEQ ID NO: 94532 - protein, 35 aa, Artificial Sequence
  Description of Artificial Sequence: Synthetic polypeptide
AEEEIRTTNPVATEAYGSVSTTNNLDGQNQGDTNL

SEQ ID NO: 94533 - protein, 33 aa, Artificial Sequence
  Description of Artificial Sequence: Synthetic polypeptide
TEEEIRTTNPVATEPYGTVVSTNELSLTGGNIL

SEQ ID NO: 94534 - protein, 33 aa, Artificial Sequence
  Description of Artificial Sequence: Synthetic polypeptide
TEEEIRTTNPVATEQFGQSVVSCTYQSLEGGNS

SEQ ID NO: 94535 - protein, 34 aa, Artificial Sequence
  Description of Artificial Sequence: Synthetic polypeptide
TEEEIRTTNPVATEQWGQSTVSYTNALSHRPGGF

SEQ ID NO: 94536 - protein, 33 aa, Artificial Sequence
  Description of Artificial Sequence: Synthetic polypeptide
TEEEIRTTNPVATEQWGQSTVVSCTNLSFHVNQ

SEQ ID NO: 94537 - protein, 33 aa, Artificial Sequence
  Description of Artificial Sequence: Synthetic polypeptide
TEEEIRTTNPVATEQWGQSTVVSTNLSPAVNNQ

SEQ ID NO: 94538 - protein, 33 aa, Artificial Sequence
  Description of Artificial Sequence: Synthetic polypeptide
TEEEIRTTNPVATEQWGQSTVVSTNMLSFAVGR

SEQ ID NO: 94539 - protein, 34 aa, Artificial Sequence
  Description of Artificial Sequence: Synthetic polypeptide
TEEEIRTTNPVATEQWGSVCSKTDDLDQRNMNDA

SEQ ID NO: 94540 - protein, 34 aa, Artificial Sequence
  Description of Artificial Sequence: Synthetic polypeptide
TEEEIRTTNPVATEQWGSVCSKTDDLQDRNANDA

SEQ ID NO: 94541 - protein, 35 aa, Artificial Sequence
  Description of Artificial Sequence: Synthetic polypeptide
AEEEIRTTNPVATEAYGSVSTTNNLQNNQEGTNND

SEQ ID NO: 94542 - protein, 33 aa, Artificial Sequence
  Description of Artificial Sequence: Synthetic polypeptide
TEEEIRTTNPVAYEHYGKVPSNNELVQGAGGNR

SEQ ID NO: 94543 - protein, 32 aa, Artificial Sequence
  Description of Artificial Sequence: Synthetic polypeptide
TEEEIRTTNPVATEQYGSVATAGQANEGEFDG

SEQ ID NO: 94544 - protein, 36 aa, Artificial Sequence
  Description of Artificial Sequence: Synthetic polypeptide
TEEEIRTTNPVATEQYGSVCSKTNDDLDQRNANDGD

SEQ ID NO: 94545 - protein, 34 aa, Artificial Sequence
  Description of Artificial Sequence: Synthetic polypeptide
AEEEIRATNPCATEQYGSVSTENNLLEQIGTNVS

SEQ ID NO: 94546 - protein, 33 aa, Artificial Sequence
  Description of Artificial Sequence: Synthetic polypeptide
AEEEIRATNPCATEQYGSVSTENNELMEIGTNM

SEQ ID NO: 94547 - protein, 34 aa, Artificial Sequence
  Description of Artificial Sequence: Synthetic polypeptide
AEEEIRATNPCATEQYGSVSTENLQNNQIGTNVD

SEQ ID NO: 94548 - protein, 34 aa, Artificial Sequence
  Description of Artificial Sequence: Synthetic polypeptide
AEEEIRATNPCATEQYGSVSTENLQMQIGTNNVS

SEQ ID NO: 94549 - protein, 34 aa, Artificial Sequence
  Description of Artificial Sequence: Synthetic polypeptide
AEEEIRATNPCATEQYGSVSTENLQANEIGTNEM

SEQ ID NO: 94550 - protein, 34 aa, Artificial Sequence
  Description of Artificial Sequence: Synthetic polypeptide
TEEEIRTTNPVATEQYGSVSGNFNIGQGGNQEDN

SEQ ID NO: 94551 - protein, 34 aa, Artificial Sequence
  Description of Artificial Sequence: Synthetic polypeptide
TEEEIRTTNPVATEQYGSVSGNGEGQGNFGTNGD

SEQ ID NO: 94552 - protein, 33 aa, Artificial Sequence
  Description of Artificial Sequence: Synthetic polypeptide
TEEEIRTTNPVATEQYGSVSGNPEGQGGGETGD

SEQ ID NO: 94553 - protein, 34 aa, Artificial Sequence
  Description of Artificial Sequence: Synthetic polypeptide
TEEEIRTTNPVATEQYGSVSGNVEGQGNQGENGQ

SEQ ID NO: 94554 - protein, 33 aa, Artificial Sequence
  Description of Artificial Sequence: Synthetic polypeptide
TEEEIRTTNPVATEQYGSVSGTVGVNGGGQTEN

SEQ ID NO: 94555 - protein, 34 aa, Artificial Sequence
  Description of Artificial Sequence: Synthetic polypeptide
TEEEIRTTNPVATEQYGSVSITNMGQGEDEGGED

SEQ ID NO: 94556 - protein, 33 aa, Artificial Sequence
  Description of Artificial Sequence: Synthetic polypeptide
AEEEIRATNPCATEQYGSVSTENLMEIGTNQNN

SEQ ID NO: 94557 - protein, 34 aa, Artificial Sequence
  Description of Artificial Sequence: Synthetic polypeptide
TEEEIRTTNPVATEQYGSVSNDNGEQDEGGNQQT

SEQ ID NO: 94558 - protein, 33 aa, Artificial Sequence
  Description of Artificial Sequence: Synthetic polypeptide
TEEEIRTTNPVATEQYGSVSNNDGEDEGQGGEE

SEQ ID NO: 94559 - protein, 33 aa, Artificial Sequence
  Description of Artificial Sequence: Synthetic polypeptide
AEEEIRATNPCATEQYGSVSTENLMEEIGTNNM

SEQ ID NO: 94560 - protein, 35 aa, Artificial Sequence
  Description of Artificial Sequence: Synthetic polypeptide
TEEEIRTTNPVATEQYGSVSNTNGNNQGENGNNGN

SEQ ID NO: 94561 - protein, 34 aa, Artificial Sequence
  Description of Artificial Sequence: Synthetic polypeptide
TEEEIRTTNPVATEQYGSVSPAINASDEFGNNRG

SEQ ID NO: 94562 - protein, 34 aa, Artificial Sequence
  Description of Artificial Sequence: Synthetic polypeptide
TEEEIRTTNPVATEQYGSVSPDVNLQQMHEEHPR

SEQ ID NO: 94563 - protein, 34 aa, Artificial Sequence
  Description of Artificial Sequence: Synthetic polypeptide
AEEEIRATNPCATEQYGSVSTENLLQMEIGTNEM

SEQ ID NO: 94564 - protein, 32 aa, Artificial Sequence
  Description of Artificial Sequence: Synthetic polypeptide
TEEEIRTTNPVATEQYGSVSPTPQNENINDQD

SEQ ID NO: 94565 - protein, 34 aa, Artificial Sequence
  Description of Artificial Sequence: Synthetic polypeptide
DEEEIRTTNPVATEQYGCVCSNWEELQNFGSNQQ

SEQ ID NO: 94566 - protein, 33 aa, Artificial Sequence
  Description of Artificial Sequence: Synthetic polypeptide
AEEEIRATNPCATEQYGSVSTENNLLQGTNTVD

SEQ ID NO: 94567 - protein, 34 aa, Artificial Sequence
  Description of Artificial Sequence: Synthetic polypeptide
DEEEIRTTNPVATEQYGCVCSNWELQERFGSEQA

SEQ ID NO: 94568 - protein, 34 aa, Artificial Sequence
  Description of Artificial Sequence: Synthetic polypeptide
DEEEIRTTNPVATEQYGCVCSNWENHQNFGSNQG

SEQ ID NO: 94569 - protein, 33 aa, Artificial Sequence
  Description of Artificial Sequence: Synthetic polypeptide
DEEEIRTTNPVATEQYGCVCSNWENLAGFGSQQ

SEQ ID NO: 94570 - protein, 36 aa, Artificial Sequence
  Description of Artificial Sequence: Synthetic polypeptide
TEEEIRTTNPVATEQYGSVCSKTNDDLQERNANDAQ

SEQ ID NO: 94571 - protein, 34 aa, Artificial Sequence
  Description of Artificial Sequence: Synthetic polypeptide
TEEEIRTTNPVATEQYGSVDNTNVGQEEGNGGNE

SEQ ID NO: 94572 - protein, 33 aa, Artificial Sequence
  Description of Artificial Sequence: Synthetic polypeptide
TEEEIRTTNPVATEQYGSVFETSNIDQQGEHYQ

SEQ ID NO: 94573 - protein, 32 aa, Artificial Sequence
  Description of Artificial Sequence: Synthetic polypeptide
TEEEIRTTNPVATEQYGSVIMTVLQTQPAMYT

SEQ ID NO: 94574 - protein, 32 aa, Artificial Sequence
  Description of Artificial Sequence: Synthetic polypeptide
TEEEIRTTNPVATEQYGSVLAVTLALINGETP

SEQ ID NO: 94575 - protein, 32 aa, Artificial Sequence
  Description of Artificial Sequence: Synthetic polypeptide
AEEEIRATNPCATEQYGSVSVENLLMQGTNVD

SEQ ID NO: 94576 - protein, 35 aa, Artificial Sequence
  Description of Artificial Sequence: Synthetic polypeptide
TEEEIRTTNPVATEQYGSVNETSNIDQTRTGENYQ

SEQ ID NO: 94577 - protein, 34 aa, Artificial Sequence
  Description of Artificial Sequence: Synthetic polypeptide
TEEEIRTTNPVATEQYGSVNTGNLSQKTVEPYRW

SEQ ID NO: 94578 - protein, 35 aa, Artificial Sequence
  Description of Artificial Sequence: Synthetic polypeptide
TEEEIRTTNPVATEQYGSVPNCTENALSQRVENYD

SEQ ID NO: 94579 - protein, 35 aa, Artificial Sequence
  Description of Artificial Sequence: Synthetic polypeptide
TEEEIRTTNPVATEQYGSVPNCTGNALSQPVENYR

SEQ ID NO: 94580 - protein, 35 aa, Artificial Sequence
  Description of Artificial Sequence: Synthetic polypeptide
TEEEIRTTNPVATEQYGSVCNTGNLNQHFGSNTQA

SEQ ID NO: 94581 - protein, 34 aa, Artificial Sequence
  Description of Artificial Sequence: Synthetic polypeptide
TEEEIRTTNPVATEQYGSVPSLGGAHQNSPGGNR

SEQ ID NO: 94582 - protein, 33 aa, Artificial Sequence
  Description of Artificial Sequence: Synthetic polypeptide
AEEEIRATNPCATEQYGSVSTEQNNLMQGTNVD

SEQ ID NO: 94583 - protein, 32 aa, Artificial Sequence
  Description of Artificial Sequence: Synthetic polypeptide
AEEEIRATNPCATEQYGSVSTEQLMEIGTNME

SEQ ID NO: 94584 - protein, 34 aa, Artificial Sequence
  Description of Artificial Sequence: Synthetic polypeptide
AEEEIRATNPCATEQYGSVSTENQLQMEIGTNGE

SEQ ID NO: 94585 - protein, 34 aa, Artificial Sequence
  Description of Artificial Sequence: Synthetic polypeptide
AEEEIRATNPCATEQYGSVSTENQLQMDEIGTNM

SEQ ID NO: 94586 - protein, 33 aa, Artificial Sequence
  Description of Artificial Sequence: Synthetic polypeptide
AEEEIRATNPCATEQYGSVSTENQLMEIGTNMM

SEQ ID NO: 94587 - protein, 34 aa, Artificial Sequence
  Description of Artificial Sequence: Synthetic polypeptide
AEEEIRATNPCATEQYGSVSTENQLLQQIGTNTD

SEQ ID NO: 94588 - protein, 34 aa, Artificial Sequence
  Description of Artificial Sequence: Synthetic polypeptide
TEEEIRTTNPVATEQYGSVSCTDDLSQMESEMRF

SEQ ID NO: 94589 - protein, 34 aa, Artificial Sequence
  Description of Artificial Sequence: Synthetic polypeptide
AEEEIRATNPCATEQYGSVSTENNNLMQIGTNTV

SEQ ID NO: 94590 - protein, 34 aa, Artificial Sequence
  Description of Artificial Sequence: Synthetic polypeptide
TEEEIRTTNPVATEQYGSVSCTNDLDQMNSVMQM

SEQ ID NO: 94591 - protein, 34 aa, Artificial Sequence
  Description of Artificial Sequence: Synthetic polypeptide
AEEEIRATNPCATEQYGSVSTENNLMQIGTNNVT

SEQ ID NO: 94592 - protein, 34 aa, Artificial Sequence
  Description of Artificial Sequence: Synthetic polypeptide
AEEEIRATNPCATEQYGSVSTVNNLQMEEIGTNM

SEQ ID NO: 94593 - protein, 34 aa, Artificial Sequence
  Description of Artificial Sequence: Synthetic polypeptide
TEEEIRTTNPVAYEHYGSTVPSNNELVQGGGNMR

SEQ ID NO: 94594 - protein, 33 aa, Artificial Sequence
  Description of Artificial Sequence: Synthetic polypeptide
TEEEIRTTNPVAYEHYGSVPSIGELFQQGGNQR

SEQ ID NO: 94595 - protein, 32 aa, Artificial Sequence
  Description of Artificial Sequence: Synthetic polypeptide
TEEEIRTTNPVAYEHYGSVPSNGELSQQGGNE

SEQ ID NO: 94596 - protein, 31 aa, Artificial Sequence
  Description of Artificial Sequence: Synthetic polypeptide
TEEQIRTTNPVAYEQYGSVWTHISTRGGNNT

SEQ ID NO: 94597 - protein, 29 aa, Artificial Sequence
  Description of Artificial Sequence: Synthetic peptide
TEESIACTNPVATEQYGCVATNLAMLDRE

SEQ ID NO: 94598 - protein, 29 aa, Artificial Sequence
  Description of Artificial Sequence: Synthetic peptide
TEESIACTNPVATEQYGSVATNLNMLEFH

SEQ ID NO: 94599 - protein, 34 aa, Artificial Sequence
  Description of Artificial Sequence: Synthetic polypeptide
DEEEIRTTNPVATEQYGCVCSNTEAHQNFGSNQS

SEQ ID NO: 94600 - protein, 32 aa, Artificial Sequence
  Description of Artificial Sequence: Synthetic polypeptide
TEESIATTNPVATEQYGSVSWNEGQDRQGGAQ

SEQ ID NO: 94601 - protein, 32 aa, Artificial Sequence
  Description of Artificial Sequence: Synthetic polypeptide
TEESIATTNPVATEQYGSVSWNEGQDRQTGSH

SEQ ID NO: 94602 - protein, 33 aa, Artificial Sequence
  Description of Artificial Sequence: Synthetic polypeptide
DEEEIRTTNPVATEQYGCVCSNTAHQNFGSEAF

SEQ ID NO: 94603 - protein, 30 aa, Artificial Sequence
  Description of Artificial Sequence: Synthetic polypeptide
TEEVIACTNPVATEQYGCVATNLAMNPENR

SEQ ID NO: 94604 - protein, 33 aa, Artificial Sequence
  Description of Artificial Sequence: Synthetic polypeptide
DEEEIRTTNPVATEQYGCVCSNSNTQNFNSDQA

SEQ ID NO: 94605 - protein, 34 aa, Artificial Sequence
  Description of Artificial Sequence: Synthetic polypeptide
DEEEIRTTNPVATEQYGCVCSNSNHQNFGSNNQL

SEQ ID NO: 94606 - protein, 33 aa, Artificial Sequence
  Description of Artificial Sequence: Synthetic polypeptide
DEEEIRTTNPVATEQYGCVCSNSNHQFFISNDY

SEQ ID NO: 94607 - protein, 32 aa, Artificial Sequence
  Description of Artificial Sequence: Synthetic polypeptide
TEEVICTTNPVAYEQYGSVSMGNMSSQRGNNS

SEQ ID NO: 94608 - protein, 34 aa, Artificial Sequence
  Description of Artificial Sequence: Synthetic polypeptide
DEEEIRTTNPVATEQYGCVCSNSNDHQFFGSNQA

SEQ ID NO: 94609 - protein, 30 aa, Artificial Sequence
  Description of Artificial Sequence: Synthetic polypeptide
TEEVIRVTNPVATEQYGAVSTNQNFQENPV

SEQ ID NO: 94610 - protein, 33 aa, Artificial Sequence
  Description of Artificial Sequence: Synthetic polypeptide
DEEEIRTTNPVATEQYGCVCSNSGELQNGSEQS

SEQ ID NO: 94611 - protein, 28 aa, Artificial Sequence
  Description of Artificial Sequence: Synthetic peptide
TEGEIAPTNPCSSEQYGIVSCNLQSGAR

SEQ ID NO: 94612 - protein, 33 aa, Artificial Sequence
  Description of Artificial Sequence: Synthetic polypeptide
DEEEIRTTNPVATEQYGCVCSNSGELQFFGSDQ

SEQ ID NO: 94613 - protein, 28 aa, Artificial Sequence
  Description of Artificial Sequence: Synthetic peptide
TEGEIAPTNPCSSEQYGIVSCNLQSGTR

SEQ ID NO: 94614 - protein, 32 aa, Artificial Sequence
  Description of Artificial Sequence: Synthetic polypeptide
TEHEIRTTNPVAYEAYGSVVSCTNLTRGTDQN

SEQ ID NO: 94615 - protein, 33 aa, Artificial Sequence
  Description of Artificial Sequence: Synthetic polypeptide
AEEEIATTNPVATEQWGSVSTTNPDPREGNDQV

SEQ ID NO: 94616 - protein, 31 aa, Artificial Sequence
  Description of Artificial Sequence: Synthetic polypeptide
TEMGICTTNPVATEQYGSVSTLNLSPEAQDR

SEQ ID NO: 94617 - protein, 33 aa, Artificial Sequence
  Description of Artificial Sequence: Synthetic polypeptide
TEENIATTNPVATEIYGQVATGNLQDRDGGNER

SEQ ID NO: 94618 - protein, 32 aa, Artificial Sequence
  Description of Artificial Sequence: Synthetic polypeptide
TEENIATTNPVATEIYGEVATGNMQDRQGSNR

SEQ ID NO: 94619 - protein, 32 aa, Artificial Sequence
  Description of Artificial Sequence: Synthetic polypeptide
TEEHICTTNPVATEAYGSVVSCENSSQRGNNS

SEQ ID NO: 94620 - protein, 34 aa, Artificial Sequence
  Description of Artificial Sequence: Synthetic polypeptide
DEEEIRTTNPVATEQYGCVCSNTEDLQHFGSEQF

SEQ ID NO: 94621 - protein, 33 aa, Artificial Sequence
  Description of Artificial Sequence: Synthetic polypeptide
DEEEIRTTNPVATEQYGCVCSNTEGNQYFNSDF

SEQ ID NO: 94622 - protein, 33 aa, Artificial Sequence
  Description of Artificial Sequence: Synthetic polypeptide
TEEGICTTNPVATEQYGSVSCMNMSQRTGGNNS

SEQ ID NO: 94623 - protein, 35 aa, Artificial Sequence
  Description of Artificial Sequence: Synthetic polypeptide
DEEEIRTTNPVATEQYGCVCSNTEELQERFGSEQF

SEQ ID NO: 94624 - protein, 33 aa, Artificial Sequence
  Description of Artificial Sequence: Synthetic polypeptide
TEEGICTTNPVATEQYGSVSMNESSQRTAGNNS

SEQ ID NO: 94625 - protein, 33 aa, Artificial Sequence
  Description of Artificial Sequence: Synthetic polypeptide
TEEGICTTNPVATEQYGSVSTLNDLLSPELQNR

SEQ ID NO: 94626 - protein, 32 aa, Artificial Sequence
  Description of Artificial Sequence: Synthetic polypeptide
TEEGICTTNPVATEQYGSVSTPNLSPELQNNM

SEQ ID NO: 94627 - protein, 34 aa, Artificial Sequence
  Description of Artificial Sequence: Synthetic polypeptide
DEEEIRTTNPVATEQYGCVCSNTEEHQGFGSNQS

SEQ ID NO: 94628 - protein, 32 aa, Artificial Sequence
  Description of Artificial Sequence: Synthetic polypeptide
AEEEIATTNPVATEQYGSASSTPAGNMRGGPR

SEQ ID NO: 94629 - protein, 34 aa, Artificial Sequence
  Description of Artificial Sequence: Synthetic polypeptide
TEEGIRTTNPVATEQYGSVPSYTNELSSMSGNID

SEQ ID NO: 94630 - protein, 35 aa, Artificial Sequence
  Description of Artificial Sequence: Synthetic polypeptide
AEEEIATTNPVATEQYGEVSSTTPNGPQMRNGMNR

SEQ ID NO: 94631 - protein, 32 aa, Artificial Sequence
  Description of Artificial Sequence: Synthetic polypeptide
TENEIACTNPVATEQYGEASCENLSQRVGGNR

SEQ ID NO: 94632 - protein, 29 aa, Artificial Sequence
  Description of Artificial Sequence: Synthetic peptide
AEEEIATTNPVATEQYGEVAVELEQGEET

SEQ ID NO: 94633 - protein, 29 aa, Artificial Sequence
  Description of Artificial Sequence: Synthetic peptide
AEEEIATTNPVATEQYGEVATQVGQEEET

SEQ ID NO: 94634 - protein, 29 aa, Artificial Sequence
  Description of Artificial Sequence: Synthetic peptide
AEEEIATTNPVATEQYGEVANNVGQEEEP

SEQ ID NO: 94635 - protein, 28 aa, Artificial Sequence
  Description of Artificial Sequence: Synthetic peptide
AEEEIATTNPVATEQYGEAPEVLQHEEK

SEQ ID NO: 94636 - protein, 28 aa, Artificial Sequence
  Description of Artificial Sequence: Synthetic peptide
AEEEIATTNPVATEQYGEAPENCQHEEK

SEQ ID NO: 94637 - protein, 33 aa, Artificial Sequence
  Description of Artificial Sequence: Synthetic polypeptide
DEEEIRTTNPVATEQYGCVCSNTEDTQGFNSDQ

SEQ ID NO: 94638 - protein, 33 aa, Artificial Sequence
  Description of Artificial Sequence: Synthetic polypeptide
DEEEIRTTNPVATEQYGCVCSNTEDQNSNSDDA

SEQ ID NO: 94639 - protein, 34 aa, Artificial Sequence
  Description of Artificial Sequence: Synthetic polypeptide
DEEEIRTTNPVATEQYGCVCSNTEDQEYFGSNQE

SEQ ID NO: 94640 - protein, 30 aa, Artificial Sequence
  Description of Artificial Sequence: Synthetic polypeptide
TEEGIRTTNPVAYEQWGKTVCTNSSMVGNR

SEQ ID NO: 94641 - protein, 34 aa, Artificial Sequence
  Description of Artificial Sequence: Synthetic polypeptide
DEEEIRTTNPVATEQYGCVCSNTEDLQSSGSEQE

SEQ ID NO: 94642 - protein, 34 aa, Artificial Sequence
  Description of Artificial Sequence: Synthetic polypeptide
DEEEIRTTNPVATEQYGCVCSNTEDLQHFNSNQA

SEQ ID NO: 94643 - protein, 32 aa, Artificial Sequence
  Description of Artificial Sequence: Synthetic polypeptide
TEEGIRTTNPVATEQYGSVSTLNLESPELQLY

SEQ ID NO: 94644 - protein, 33 aa, Artificial Sequence
  Description of Artificial Sequence: Synthetic polypeptide
DEEEIRTTNPVATEQYGCVCSNTEHAFFGSNQA

SEQ ID NO: 94645 - protein, 31 aa, Artificial Sequence
  Description of Artificial Sequence: Synthetic polypeptide
TENEIACTNPVATEQYGETASENMLQRGGGR

SEQ ID NO: 94646 - protein, 30 aa, Artificial Sequence
  Description of Artificial Sequence: Synthetic polypeptide
TENEIACTNPVAYEQYGEAPSENLQRVGGR

SEQ ID NO: 94647 - protein, 34 aa, Artificial Sequence
  Description of Artificial Sequence: Synthetic polypeptide
TESEIRTTNPVATEPYGSVVSCTNALMREGNEYK

SEQ ID NO: 94648 - protein, 36 aa, Artificial Sequence
  Description of Artificial Sequence: Synthetic polypeptide
TESEIRTTNPVATEPYGSVVSCTNALQVRAEGNERK

SEQ ID NO: 94649 - protein, 35 aa, Artificial Sequence
  Description of Artificial Sequence: Synthetic polypeptide
TESEIRTTNPVATEPYGSVVSCTPNANQREGNERK

SEQ ID NO: 94650 - protein, 35 aa, Artificial Sequence
  Description of Artificial Sequence: Synthetic polypeptide
TESEIRTTNPVATEPYGVSVVSCTNALQRNGDERK

SEQ ID NO: 94651 - protein, 34 aa, Artificial Sequence
  Description of Artificial Sequence: Synthetic polypeptide
TESEIRTTNPVATEPYGVVVSCTNALQRMGDERK

SEQ ID NO: 94652 - protein, 34 aa, Artificial Sequence
  Description of Artificial Sequence: Synthetic polypeptide
TESEIRTTNPVATEQYGSTVSTNHSDRGVTNNDS

SEQ ID NO: 94653 - protein, 34 aa, Artificial Sequence
  Description of Artificial Sequence: Synthetic polypeptide
TESEIRTTNPVATEQYGSVVSTNALSDRVANNDS

SEQ ID NO: 94654 - protein, 33 aa, Artificial Sequence
  Description of Artificial Sequence: Synthetic polypeptide
TESEIRTTNPVATEQYGSVVSTNLSDHVTNPDS

SEQ ID NO: 94655 - protein, 35 aa, Artificial Sequence
  Description of Artificial Sequence: Synthetic polypeptide
TESEIRTTNPVATERYGSVVSCTNALQPTEGNERK

SEQ ID NO: 94656 - protein, 33 aa, Artificial Sequence
  Description of Artificial Sequence: Synthetic polypeptide
TESEIRTTNPVATESYGKVQSTDNMLTAGGENR

SEQ ID NO: 94657 - protein, 34 aa, Artificial Sequence
  Description of Artificial Sequence: Synthetic polypeptide
TESEIRTTNPVATESYGSVVSCTNALPREGDERK

SEQ ID NO: 94658 - protein, 35 aa, Artificial Sequence
  Description of Artificial Sequence: Synthetic polypeptide
TESEIRTTNPVAWEPYGSVVSCTINALQREGNERK

SEQ ID NO: 94659 - protein, 35 aa, Artificial Sequence
  Description of Artificial Sequence: Synthetic polypeptide
TESEIRTTNPVAYEPYGSVVSCTNALQSREGNERK

SEQ ID NO: 94660 - protein, 33 aa, Artificial Sequence
  Description of Artificial Sequence: Synthetic polypeptide
TESEIRTTNPVAYEQYGSTVSANNELSQRTENM

SEQ ID NO: 94661 - protein, 33 aa, Artificial Sequence
  Description of Artificial Sequence: Synthetic polypeptide
TESEIRTTNPVAYEQYGSTVSTNLSTRVANNDS

SEQ ID NO: 94662 - protein, 31 aa, Artificial Sequence
  Description of Artificial Sequence: Synthetic polypeptide
AEEEIASVNPVCTEQYGVVSTDRNLQDSGNQ

SEQ ID NO: 94663 - protein, 31 aa, Artificial Sequence
  Description of Artificial Sequence: Synthetic polypeptide
TESEIRTTNPVAYHHYGSVPSTNEVSQRVNM

SEQ ID NO: 94664 - protein, 33 aa, Artificial Sequence
  Description of Artificial Sequence: Synthetic polypeptide
TESEIRTTNPVAYKHYGSVPSTNELSQRAVGNM

SEQ ID NO: 94665 - protein, 29 aa, Artificial Sequence
  Description of Artificial Sequence: Synthetic peptide
AEEEIASVNPVCTEQYGVVSNWELQSGNQ

SEQ ID NO: 94666 - protein, 33 aa, Artificial Sequence
  Description of Artificial Sequence: Synthetic polypeptide
TETEIRTTNPVATEPYGQTVQHCTNLQSEGNER

SEQ ID NO: 94667 - protein, 32 aa, Artificial Sequence
  Description of Artificial Sequence: Synthetic polypeptide
TETEIRTTNPVAYEAYGSVPSEGELFQSGGNR

SEQ ID NO: 94668 - protein, 35 aa, Artificial Sequence
  Description of Artificial Sequence: Synthetic polypeptide
TESEIRTTNPVATEPYGSVVSCTNAFQPREGNERK

SEQ ID NO: 94669 - protein, 35 aa, Artificial Sequence
  Description of Artificial Sequence: Synthetic polypeptide
TESEIRTTNPVATEPYGCVVSCTNALMQREGNERK

SEQ ID NO: 94670 - protein, 32 aa, Artificial Sequence
  Description of Artificial Sequence: Synthetic polypeptide
TESEICTVNPVATEQYGSVSCTNELSTEGNNH

SEQ ID NO: 94671 - protein, 30 aa, Artificial Sequence
  Description of Artificial Sequence: Synthetic polypeptide
TESEICTTNPVATEQYGHVRTNNNRNENGE

SEQ ID NO: 94672 - protein, 30 aa, Artificial Sequence
  Description of Artificial Sequence: Synthetic polypeptide
TENEIACTNPVAYEQYGEASENHQRGGGNR

SEQ ID NO: 94673 - protein, 31 aa, Artificial Sequence
  Description of Artificial Sequence: Synthetic polypeptide
TENEIACTNPVAYEQYGEISCENLQRGGGNR

SEQ ID NO: 94674 - protein, 30 aa, Artificial Sequence
  Description of Artificial Sequence: Synthetic polypeptide
TENEIACTNPVAYEQYGETISENLQRGGGR

SEQ ID NO: 94675 - protein, 30 aa, Artificial Sequence
  Description of Artificial Sequence: Synthetic polypeptide
TENEIACTNPVAYEQYGIEASENLQRGGGR

SEQ ID NO: 94676 - protein, 32 aa, Artificial Sequence
  Description of Artificial Sequence: Synthetic polypeptide
TENEIASTNPVAYEQYGEVASENLQRTGGGNR

SEQ ID NO: 94677 - protein, 28 aa, Artificial Sequence
  Description of Artificial Sequence: Synthetic peptide
TENEIATTNPVATEAYGDVSECLQHEEE

SEQ ID NO: 94678 - protein, 28 aa, Artificial Sequence
  Description of Artificial Sequence: Synthetic peptide
TENEIATTNPVATECYGDVSECLQHEEL

SEQ ID NO: 94679 - protein, 29 aa, Artificial Sequence
  Description of Artificial Sequence: Synthetic peptide
TENEIATTNPVATECYGDVSESLQHEENL

SEQ ID NO: 94680 - protein, 28 aa, Artificial Sequence
  Description of Artificial Sequence: Synthetic peptide
TENEIATTNPVATECYGVVSESLQHEEE

SEQ ID NO: 94681 - protein, 28 aa, Artificial Sequence
  Description of Artificial Sequence: Synthetic peptide
TENEIATTNPVATECYGWVSECLQHEHS

SEQ ID NO: 94682 - protein, 32 aa, Artificial Sequence
  Description of Artificial Sequence: Synthetic polypeptide
TENEIACTNPVATEQYGEVASENSLSQRGGGR

SEQ ID NO: 94683 - protein, 28 aa, Artificial Sequence
  Description of Artificial Sequence: Synthetic peptide
TENEIATTNPVATEHYGKVSECLQHEEL

SEQ ID NO: 94684 - protein, 31 aa, Artificial Sequence
  Description of Artificial Sequence: Synthetic polypeptide
TENEIRTTNPVATSMYGCVYATVNLDQGNRG

SEQ ID NO: 94685 - protein, 34 aa, Artificial Sequence
  Description of Artificial Sequence: Synthetic polypeptide
DEEEIRTTNPVATEQYGCVCSNSENHQRFNSDQT

SEQ ID NO: 94686 - protein, 34 aa, Artificial Sequence
  Description of Artificial Sequence: Synthetic polypeptide
DEEEIRTTNPVATEQYGCVCSNSELQSFGSENQE

SEQ ID NO: 94687 - protein, 33 aa, Artificial Sequence
  Description of Artificial Sequence: Synthetic polypeptide
DEEEIRTTNPVATEQYGCVCSNSELQHFNSEQF

SEQ ID NO: 94688 - protein, 34 aa, Artificial Sequence
  Description of Artificial Sequence: Synthetic polypeptide
DEEEIRTTNPVATEQYGCVCSNSELQEGFGSNQS

SEQ ID NO: 94689 - protein, 33 aa, Artificial Sequence
  Description of Artificial Sequence: Synthetic polypeptide
DEEEIRTTNPVATEQYGCVCSNSEHQRFGSQQT

SEQ ID NO: 94690 - protein, 32 aa, Artificial Sequence
  Description of Artificial Sequence: Synthetic polypeptide
DEEEIRTTNPVATEQYGCVCSNSEHQNGSDQE

SEQ ID NO: 94691 - protein, 33 aa, Artificial Sequence
  Description of Artificial Sequence: Synthetic polypeptide
TEQEIRTTNPVAYEQYGSTVSAANELSQRTENE

SEQ ID NO: 94692 - protein, 30 aa, Artificial Sequence
  Description of Artificial Sequence: Synthetic polypeptide
TESEIACTNPVAYEQYGEASENLSQRVGGR

SEQ ID NO: 94693 - protein, 28 aa, Artificial Sequence
  Description of Artificial Sequence: Synthetic peptide
TESEIATTNPVATECYGCVSECLQHEEL

SEQ ID NO: 94694 - protein, 28 aa, Artificial Sequence
  Description of Artificial Sequence: Synthetic peptide
TENEIATTNPVATEPYGDVSEHLQHEEL

SEQ ID NO: 94695 - protein, 28 aa, Artificial Sequence
  Description of Artificial Sequence: Synthetic peptide
YEEEIASVNPCCYEQYGVVSDNLQSGNQ

SEQ ID NO: 94696 - protein, 32 aa, Artificial Sequence
  Description of Artificial Sequence: Synthetic polypeptide
TEEGICTTNPVATEQYGSVSCIGNSSQRGGVS

SEQ ID NO: 94697 - protein, 32 aa, Artificial Sequence
  Description of Artificial Sequence: Synthetic polypeptide
TEEGICTTNPVATEQYGKVSCMNMSQRVGNNS

SEQ ID NO: 94698 - protein, 33 aa, Artificial Sequence
  Description of Artificial Sequence: Synthetic polypeptide
DEEEIRTTNPVATEQYGCVCSNTGEDQHFNSNQ

SEQ ID NO: 94699 - protein, 34 aa, Artificial Sequence
  Description of Artificial Sequence: Synthetic polypeptide
TEEEIRTTNPVAYEQYGSVVPSTNSGQELTEGKR

SEQ ID NO: 94700 - protein, 31 aa, Artificial Sequence
  Description of Artificial Sequence: Synthetic polypeptide
AEEEIATTNPVAYEHWGCFSIDNDLQRGGNR

SEQ ID NO: 94701 - protein, 35 aa, Artificial Sequence
  Description of Artificial Sequence: Synthetic polypeptide
DEEEIRTTNPVATEQYGCVCSNTGEDQERFGSNQT

SEQ ID NO: 94702 - protein, 35 aa, Artificial Sequence
  Description of Artificial Sequence: Synthetic polypeptide
TEEEIRTTNPVAYEQYGSVVVNTSNALSQRVENYR

SEQ ID NO: 94703 - protein, 34 aa, Artificial Sequence
  Description of Artificial Sequence: Synthetic polypeptide
TEEEIRTTNPVAYEQYGSVYSCTNAISQNKGSYR

SEQ ID NO: 94704 - protein, 31 aa, Artificial Sequence
  Description of Artificial Sequence: Synthetic polypeptide
AEEEIATTNPVATESYGCIIANNNLQDGDNR

SEQ ID NO: 94705 - protein, 34 aa, Artificial Sequence
  Description of Artificial Sequence: Synthetic polypeptide
DEEEIRTTNPVATEQYGCVCSNTGEDQAFGSNQE

SEQ ID NO: 94706 - protein, 34 aa, Artificial Sequence
  Description of Artificial Sequence: Synthetic polypeptide
TEEEIRTTNPVAYEQYSGQSVMETNDLLQRGIEQ

SEQ ID NO: 94707 - protein, 32 aa, Artificial Sequence
  Description of Artificial Sequence: Synthetic polypeptide
TEEEIRTTNPVAYERYGSVACTCVMQEVGNYR

SEQ ID NO: 94708 - protein, 31 aa, Artificial Sequence
  Description of Artificial Sequence: Synthetic polypeptide
TEEEIRTTNPVAYERYGSVACTCVQPVGNYV

SEQ ID NO: 94709 - protein, 33 aa, Artificial Sequence
  Description of Artificial Sequence: Synthetic polypeptide
TEEEIRTTNPVAYERYGSVACTCVVQRVGNTRE

SEQ ID NO: 94710 - protein, 33 aa, Artificial Sequence
  Description of Artificial Sequence: Synthetic polypeptide
TEEEIRTTNPVAYERYGSVACTIPVQRNVGNYR

SEQ ID NO: 94711 - protein, 32 aa, Artificial Sequence
  Description of Artificial Sequence: Synthetic polypeptide
TEEEIRTTNPVAYERYGSVACTIVPQGEGNYR

SEQ ID NO: 94712 - protein, 32 aa, Artificial Sequence
  Description of Artificial Sequence: Synthetic polypeptide
TEEEIRTTNPVAYERYGSVACTIVQQLVGNNR

SEQ ID NO: 94713 - protein, 33 aa, Artificial Sequence
  Description of Artificial Sequence: Synthetic polypeptide
TEEEIRTTNPVAYERYGSVACTPSVVQRVGNYR

SEQ ID NO: 94714 - protein, 30 aa, Artificial Sequence
  Description of Artificial Sequence: Synthetic polypeptide
AEEEIATTNPVATESYGCIAGNNLQDGDQR

SEQ ID NO: 94715 - protein, 32 aa, Artificial Sequence
  Description of Artificial Sequence: Synthetic polypeptide
TEEEIRTTNPVAYERYGSVAVTIVPQDVGNYR

SEQ ID NO: 94716 - protein, 33 aa, Artificial Sequence
  Description of Artificial Sequence: Synthetic polypeptide
TEEEIRTTNPVAYERYGSVAYTTGLSQRDGMRA

SEQ ID NO: 94717 - protein, 30 aa, Artificial Sequence
  Description of Artificial Sequence: Synthetic polypeptide
AEEEIATTNPVATESYGCIAGNGLQDGNDM

SEQ ID NO: 94718 - protein, 31 aa, Artificial Sequence
  Description of Artificial Sequence: Synthetic polypeptide
AEEEIATTNPVATESYGCIAGNGLQDDGNRQ

SEQ ID NO: 94719 - protein, 34 aa, Artificial Sequence
  Description of Artificial Sequence: Synthetic polypeptide
DEEEIRTTNPVATEQYGCVCSNTGEDQNFGSNAS

SEQ ID NO: 94720 - protein, 34 aa, Artificial Sequence
  Description of Artificial Sequence: Synthetic polypeptide
DEEEIRTTNPVATEQYGCVCSNTGEDQNFGSNQS

SEQ ID NO: 94721 - protein, 33 aa, Artificial Sequence
  Description of Artificial Sequence: Synthetic polypeptide
TEEEIRTTNPVAYEQYGSVVCACTALQNTGPRQ

SEQ ID NO: 94722 - protein, 32 aa, Artificial Sequence
  Description of Artificial Sequence: Synthetic polypeptide
TEEEIRTTNPVAYEQYGSVVACTALANTGPRF

SEQ ID NO: 94723 - protein, 35 aa, Artificial Sequence
  Description of Artificial Sequence: Synthetic polypeptide
DEEEIRTTNPVATEQYGCVCSNTGELFQNFGSNQG

SEQ ID NO: 94724 - protein, 32 aa, Artificial Sequence
  Description of Artificial Sequence: Synthetic polypeptide
TEEEIRTTNPVAYEHYGSVPSNNEFDGGGNTR

SEQ ID NO: 94725 - protein, 34 aa, Artificial Sequence
  Description of Artificial Sequence: Synthetic polypeptide
TEEEIRTTNPVAYEHYGSVPSNNELDQGPGGNER

SEQ ID NO: 94726 - protein, 33 aa, Artificial Sequence
  Description of Artificial Sequence: Synthetic polypeptide
TEEEIRTTNPVAYEHYGSVPSNNELSQGGGQER

SEQ ID NO: 94727 - protein, 33 aa, Artificial Sequence
  Description of Artificial Sequence: Synthetic polypeptide
TEEEIRTTNPVAYEHYGVVVPSNNELVQGGGNR

SEQ ID NO: 94728 - protein, 35 aa, Artificial Sequence
  Description of Artificial Sequence: Synthetic polypeptide
TEEEIRTTNPVAYEPYGSVASTLNSVSQRTGDPNR

SEQ ID NO: 94729 - protein, 32 aa, Artificial Sequence
  Description of Artificial Sequence: Synthetic polypeptide
TEEEIRTTNPVAYEPYGSVPSNNEFQGGGNYN

SEQ ID NO: 94730 - protein, 33 aa, Artificial Sequence
  Description of Artificial Sequence: Synthetic polypeptide
DEEEIRTTNPVATEQYGCVCSNTGEHQNFGDQE

SEQ ID NO: 94731 - protein, 34 aa, Artificial Sequence
  Description of Artificial Sequence: Synthetic polypeptide
TEEEIRTTNPVAYEQWGQHVVSINLSQRNGGNDR

SEQ ID NO: 94732 - protein, 33 aa, Artificial Sequence
  Description of Artificial Sequence: Synthetic polypeptide
TEEEIRTTNPVAYEQWGSTISHHLSQRQGGNRS

SEQ ID NO: 94733 - protein, 32 aa, Artificial Sequence
  Description of Artificial Sequence: Synthetic polypeptide
TEEEIRTTNPVAYERYGSVVATAWLQNNGGSR

SEQ ID NO: 94734 - protein, 30 aa, Artificial Sequence
  Description of Artificial Sequence: Synthetic polypeptide
AEEEICTTNPVATEQYGVVATELVEQTEED

SEQ ID NO: 94735 - protein, 34 aa, Artificial Sequence
  Description of Artificial Sequence: Synthetic polypeptide
TEEEIRTTNPVAYEQYGQSVSINAFFQRTGGTRD

SEQ ID NO: 94736 - protein, 34 aa, Artificial Sequence
  Description of Artificial Sequence: Synthetic polypeptide
AEEEICTTNPVATEQYGTVSVTVTNLEQGNGNNA

SEQ ID NO: 94737 - protein, 33 aa, Artificial Sequence
  Description of Artificial Sequence: Synthetic polypeptide
AEEEICTTNPVATEQYGTVSVTTQLQGGNNNAD

SEQ ID NO: 94738 - protein, 33 aa, Artificial Sequence
  Description of Artificial Sequence: Synthetic polypeptide
TEEEIRTTNPVAYEQYGSTVVSAGNLSDEFGNE

SEQ ID NO: 94739 - protein, 32 aa, Artificial Sequence
  Description of Artificial Sequence: Synthetic polypeptide
AEEEIATTNPVAYEQWGSVSTNNAPGGGDNDR

SEQ ID NO: 94740 - protein, 33 aa, Artificial Sequence
  Description of Artificial Sequence: Synthetic polypeptide
TEEEIRTTNPVAYEQYGSVSTGNGSQTIGTSHL

SEQ ID NO: 94741 - protein, 33 aa, Artificial Sequence
  Description of Artificial Sequence: Synthetic polypeptide
TEEEIRTTNPVAYEQYGSVSTGNIHSQMPGGMS

SEQ ID NO: 94742 - protein, 31 aa, Artificial Sequence
  Description of Artificial Sequence: Synthetic polypeptide
AEEEIATTNPVAYEQWGSTSTNNQGGDGGNN

SEQ ID NO: 94743 - protein, 33 aa, Artificial Sequence
  Description of Artificial Sequence: Synthetic polypeptide
TEEEIRTTNPVAYEQYGSVSTVNNTSQMPGGMS

SEQ ID NO: 94744 - protein, 33 aa, Artificial Sequence
  Description of Artificial Sequence: Synthetic polypeptide
TEEEIRTTNPVAYEQYGSVSTVRMLSQMPGGMS

SEQ ID NO: 94745 - protein, 36 aa, Artificial Sequence
  Description of Artificial Sequence: Synthetic polypeptide
TEEEIRTTNPVAYEQYGQSTVISTNEGPQRGGPNRR

SEQ ID NO: 94746 - protein, 32 aa, Artificial Sequence
  Description of Artificial Sequence: Synthetic polypeptide
DEEEIRTTNPVATEQYGCVCSNTEHANGSEQF

SEQ ID NO: 94747 - protein, 34 aa, Artificial Sequence
  Description of Artificial Sequence: Synthetic polypeptide
DEEEIRTTNPVATEQYGCVCSNTGALQNFGSDQT

SEQ ID NO: 94748 - protein, 34 aa, Artificial Sequence
  Description of Artificial Sequence: Synthetic polypeptide
TEEEIRTTNPVAYERYGSVVSDTWELSQRSQNNR

SEQ ID NO: 94749 - protein, 34 aa, Artificial Sequence
  Description of Artificial Sequence: Synthetic polypeptide
DEEEIRTTNPVATEQYGCVCSNTELQEFFNSNQE

SEQ ID NO: 94750 - protein, 34 aa, Artificial Sequence
  Description of Artificial Sequence: Synthetic polypeptide
DEEEIRTTNPVATEQYGCVCSNTELQANFGSDQS

SEQ ID NO: 94751 - protein, 34 aa, Artificial Sequence
  Description of Artificial Sequence: Synthetic polypeptide
DEEEIRTTNPVATEQYGCVCSNTELPQNFNSDQS

SEQ ID NO: 94752 - protein, 33 aa, Artificial Sequence
  Description of Artificial Sequence: Synthetic polypeptide
DEEEIRTTNPVATEQYGCVCSNTELAHFNSNQS

SEQ ID NO: 94753 - protein, 35 aa, Artificial Sequence
  Description of Artificial Sequence: Synthetic polypeptide
TEEEISTTNPVATEAYGSVVSCTGPLAQRGENYRM

SEQ ID NO: 94754 - protein, 33 aa, Artificial Sequence
  Description of Artificial Sequence: Synthetic polypeptide
DEEEIRTTNPVATEQYGCVCSNTEHQNFGSQQS

SEQ ID NO: 94755 - protein, 33 aa, Artificial Sequence
  Description of Artificial Sequence: Synthetic polypeptide
DEEEIRTTNPVATEQYGCVCSNTEHQNFGSQQA

SEQ ID NO: 94756 - protein, 33 aa, Artificial Sequence
  Description of Artificial Sequence: Synthetic polypeptide
DEEEIRTTNPVATEQYGCVCSNTEHQHFNSEQS

SEQ ID NO: 94757 - protein, 34 aa, Artificial Sequence
  Description of Artificial Sequence: Synthetic polypeptide
DEEEIRTTNPVATEQYGCVCSNTEHQEHFGSNNQ

SEQ ID NO: 94758 - protein, 33 aa, Artificial Sequence
  Description of Artificial Sequence: Synthetic polypeptide
TEEEISTTNPVAYEQYGQKVSQNELSQDEGENR

SEQ ID NO: 94759 - protein, 36 aa, Artificial Sequence
  Description of Artificial Sequence: Synthetic polypeptide
AEEEIATTNPVATEQYGSVSSTTPNGPQMRNGMNPR

SEQ ID NO: 94760 - protein, 34 aa, Artificial Sequence
  Description of Artificial Sequence: Synthetic polypeptide
DEEEIRTTNPVATEQYGCVCSNTEHNQYFGSNQS

SEQ ID NO: 94761 - protein, 32 aa, Artificial Sequence
  Description of Artificial Sequence: Synthetic polypeptide
TEEEISTTNPVAYEQYGTTPSTAEHSQRGGNR

SEQ ID NO: 94762 - protein, 29 aa, Artificial Sequence
  Description of Artificial Sequence: Synthetic peptide
TEEELASVNPVSTEQYGVVSVNLQQGPNG

SEQ ID NO: 94763 - protein, 34 aa, Artificial Sequence
  Description of Artificial Sequence: Synthetic polypeptide
DEEEIRTTNPVATEQYGCVCSNTEHNQGFGSNQS

SEQ ID NO: 94764 - protein, 33 aa, Artificial Sequence
  Description of Artificial Sequence: Synthetic polypeptide
TEEEVRTTNPVATEQYGCVCSTGNHDQNIGSNA

SEQ ID NO: 94765 - protein, 33 aa, Artificial Sequence
  Description of Artificial Sequence: Synthetic polypeptide
AEEEIATTNPVATEQYGSVATNNALNNRGTTEH

SEQ ID NO: 94766 - protein, 31 aa, Artificial Sequence
  Description of Artificial Sequence: Synthetic polypeptide
AEEEIATTNPVATEQYGSVATNLTDPMEEGA

SEQ ID NO: 94767 - protein, 33 aa, Artificial Sequence
  Description of Artificial Sequence: Synthetic polypeptide
AEEEIATTNPVATEQYGSVATNLQAEPGGEGVS

SEQ ID NO: 94768 - protein, 33 aa, Artificial Sequence
  Description of Artificial Sequence: Synthetic polypeptide
AEEEIATTNPVATEQYGSVATNLADTAGGNQTF

SEQ ID NO: 94769 - protein, 32 aa, Artificial Sequence
  Description of Artificial Sequence: Synthetic polypeptide
TEEGICTTNPVATEAYGSVVPSCMNSSQRGNS

SEQ ID NO: 94770 - protein, 35 aa, Artificial Sequence
  Description of Artificial Sequence: Synthetic polypeptide
DEEEIRTTNPVATEQYGCVCSNTELQENFGSQNQA

SEQ ID NO: 94771 - protein, 29 aa, Artificial Sequence
  Description of Artificial Sequence: Synthetic peptide
AEEEIATTNPVATEQYGVVATEGEQHEEF

SEQ ID NO: 94772 - protein, 35 aa, Artificial Sequence
  Description of Artificial Sequence: Synthetic polypeptide
DEEEIRTTNPVATEQYGCVCSNTELQERFGSETQA

SEQ ID NO: 94773 - protein, 35 aa, Artificial Sequence
  Description of Artificial Sequence: Synthetic polypeptide
DEEEIRTTNPVATEQYGCVCSNTELQESFGSQNQS

SEQ ID NO: 94774 - protein, 32 aa, Artificial Sequence
  Description of Artificial Sequence: Synthetic polypeptide
TEEEIRTTNPVAYERYGTVACTCVNQRVGNYR

SEQ ID NO: 94775 - protein, 33 aa, Artificial Sequence
  Description of Artificial Sequence: Synthetic polypeptide
DEEEIRTTNPVATEQYGCVCSNTETQNFNSDFE

SEQ ID NO: 94776 - protein, 34 aa, Artificial Sequence
  Description of Artificial Sequence: Synthetic polypeptide
DEEEIRTTNPVATEQYGCVCSNTETQEHFGSNNQ

SEQ ID NO: 94777 - protein, 33 aa, Artificial Sequence
  Description of Artificial Sequence: Synthetic polypeptide
TEEEIRTTNPVAYESYGQSTVSNTNLSHTGDNQ

SEQ ID NO: 94778 - protein, 34 aa, Artificial Sequence
  Description of Artificial Sequence: Synthetic polypeptide
DEEEIRTTNPVATEQYGCVCSNTESHQFFGSNQA

SEQ ID NO: 94779 - protein, 33 aa, Artificial Sequence
  Description of Artificial Sequence: Synthetic polypeptide
TEEEIRTTNPVAYESYGSTVSNTNLSHTQLDNQ

SEQ ID NO: 94780 - protein, 33 aa, Artificial Sequence
  Description of Artificial Sequence: Synthetic polypeptide
DEEEIRTTNPVATEQYGCVCSNTEPQHFGSETQ

SEQ ID NO: 94781 - protein, 35 aa, Artificial Sequence
  Description of Artificial Sequence: Synthetic polypeptide
DEEEIRTTNPVATEQYGCVCSNTEPLQNFGSDNQT

SEQ ID NO: 94782 - protein, 35 aa, Artificial Sequence
  Description of Artificial Sequence: Synthetic polypeptide
DEEEIRTTNPVATEQYGCVCSNTENLQENSGSDQE

SEQ ID NO: 94783 - protein, 35 aa, Artificial Sequence
  Description of Artificial Sequence: Synthetic polypeptide
DEEEIRTTNPVATEQYGCVCSNTENLQENFGSQQS

SEQ ID NO: 94784 - protein, 34 aa, Artificial Sequence
  Description of Artificial Sequence: Synthetic polypeptide
DEEEIRTTNPVATEQYGCVCSNTGAHQRFGSDQS

SEQ ID NO: 94785 - protein, 35 aa, Artificial Sequence
  Description of Artificial Sequence: Synthetic polypeptide
DEEEIRTTNPVATEQYGCVCSNTENLQENFGSDTQ

SEQ ID NO: 94786 - protein, 31 aa, Artificial Sequence
  Description of Artificial Sequence: Synthetic polypeptide
TEEEIRTTNPVGYEQWGSVPYTNMLGRGGSP

SEQ ID NO: 94787 - protein, 35 aa, Artificial Sequence
  Description of Artificial Sequence: Synthetic polypeptide
DEEEIRTTNPVATEQYGCVCSNTENHQERFGSDQS

SEQ ID NO: 94788 - protein, 35 aa, Artificial Sequence
  Description of Artificial Sequence: Synthetic polypeptide
TEEEIRYTNPVATEQYGSVASCVNAQSDRGGNNRS

SEQ ID NO: 94789 - protein, 34 aa, Artificial Sequence
  Description of Artificial Sequence: Synthetic polypeptide
TEEEIRYTNPVATEQYGSVSCVGAQSDRGGNNRL

SEQ ID NO: 94790 - protein, 33 aa, Artificial Sequence
  Description of Artificial Sequence: Synthetic polypeptide
TEEEIRYTNPVATEQYGSVSCVNAHSDEGGNNR

SEQ ID NO: 94791 - protein, 34 aa, Artificial Sequence
  Description of Artificial Sequence: Synthetic polypeptide
DEEEIRTTNPVATEQYGCVCSNTELQNFGSITQS

SEQ ID NO: 94792 - protein, 34 aa, Artificial Sequence
  Description of Artificial Sequence: Synthetic polypeptide
DEEEIRTTNPVATEQYGCVCSNTELQNFGSEFQP

SEQ ID NO: 94793 - protein, 34 aa, Artificial Sequence
  Description of Artificial Sequence: Synthetic polypeptide
DEEEIRTTNPVATEAYGTVSVSVTNDEQGNTNFD

SEQ ID NO: 94794 - protein, 34 aa, Artificial Sequence
  Description of Artificial Sequence: Synthetic polypeptide
DEEEIRTTNPVATEQYGCVCSNTELQHFGSDTQE

SEQ ID NO: 94795 - protein, 34 aa, Artificial Sequence
  Description of Artificial Sequence: Synthetic polypeptide
DEEEIRTTNPVATEQYGCVCSNTELQGFNSETQF

SEQ ID NO: 94796 - protein, 34 aa, Artificial Sequence
  Description of Artificial Sequence: Synthetic polypeptide
DEEEIRTTNPVATEQYGCVCSNTENHQHFGSEQS

SEQ ID NO: 94797 - protein, 33 aa, Artificial Sequence
  Description of Artificial Sequence: Synthetic polypeptide
AEEEIRTTNPVATEAYGSVSTTVNNTNNIGTNT

SEQ ID NO: 94798 - protein, 28 aa, Artificial Sequence
  Description of Artificial Sequence: Synthetic peptide
YEEEIASVNPCSSEQYGVVSCNLQSGNQ

SEQ ID NO: 94799 - protein, 34 aa, Artificial Sequence
  Description of Artificial Sequence: Synthetic polypeptide
DEEEIRTTNPVATEQYGAVMGTVNFGEQNGINGF

SEQ ID NO: 94800 - protein, 31 aa, Artificial Sequence
  Description of Artificial Sequence: Synthetic polypeptide
DEEEIRTTNPVATEFYGVVSGGNGGNGGEED

SEQ ID NO: 94801 - protein, 35 aa, Artificial Sequence
  Description of Artificial Sequence: Synthetic polypeptide
DEEEIRTTNPVATEPYGSVPSCTNGLSNDVVDENR

SEQ ID NO: 94802 - protein, 36 aa, Artificial Sequence
  Description of Artificial Sequence: Synthetic polypeptide
DEEEIRTTNPVATEPYGSVPSCTGNNLSNDVGQENR

SEQ ID NO: 94803 - protein, 32 aa, Artificial Sequence
  Description of Artificial Sequence: Synthetic polypeptide
DEEEIRTTNPVATEFYGVVSTMQTNEFTNENG

SEQ ID NO: 94804 - protein, 35 aa, Artificial Sequence
  Description of Artificial Sequence: Synthetic polypeptide
DEEEIRTTNPVATEPYGSVNDDTGNLGEEQGEGNT

SEQ ID NO: 94805 - protein, 35 aa, Artificial Sequence
  Description of Artificial Sequence: Synthetic polypeptide
DEEEIRTTNPVATEPYGSVCFVTNPLETPRGGNNM

SEQ ID NO: 94806 - protein, 34 aa, Artificial Sequence
  Description of Artificial Sequence: Synthetic polypeptide
DEEEIRTTNPVATEPYGSVCFTTNQHNWGGNVRN

SEQ ID NO: 94807 - protein, 34 aa, Artificial Sequence
  Description of Artificial Sequence: Synthetic polypeptide
DEEEIRTTNPVATEPYGSVCFTTNQHNRSGNVLV

SEQ ID NO: 94808 - protein, 34 aa, Artificial Sequence
  Description of Artificial Sequence: Synthetic polypeptide
YEEEIRTTNPVATEQYGGHGSTDLLVQNPGNEVR

SEQ ID NO: 94809 - protein, 33 aa, Artificial Sequence
  Description of Artificial Sequence: Synthetic polypeptide
DEEEIRTTNPVATEFYGYVSTVNDQDQGGDEDD

SEQ ID NO: 94810 - protein, 34 aa, Artificial Sequence
  Description of Artificial Sequence: Synthetic polypeptide
DEEEIRTTNPVATEFYGYVSTVNLQQGQGEEEDG

SEQ ID NO: 94811 - protein, 33 aa, Artificial Sequence
  Description of Artificial Sequence: Synthetic polypeptide
DEEEIRTTNPVATEFYGYVTDTANQDQGEGGNG

SEQ ID NO: 94812 - protein, 33 aa, Artificial Sequence
  Description of Artificial Sequence: Synthetic polypeptide
DEEEIRTTNPVATEGWGSPSNNQLQRVPTEERF

SEQ ID NO: 94813 - protein, 32 aa, Artificial Sequence
  Description of Artificial Sequence: Synthetic polypeptide
DEEEIRTTNPVATEGYGAVVDTVNMFDRIQNP

SEQ ID NO: 94814 - protein, 32 aa, Artificial Sequence
  Description of Artificial Sequence: Synthetic polypeptide
DEEEIRTTNPVATEGYGCCCSWNEQRFNSNFA

SEQ ID NO: 94815 - protein, 34 aa, Artificial Sequence
  Description of Artificial Sequence: Synthetic polypeptide
DEEEIRTTNPVATEPYGSVCFTNEDSTRTGGNPT

SEQ ID NO: 94816 - protein, 34 aa, Artificial Sequence
  Description of Artificial Sequence: Synthetic polypeptide
DEEEIRTTNPVATEPYGSVCFTNEDHHRGGDNQQ

SEQ ID NO: 94817 - protein, 33 aa, Artificial Sequence
  Description of Artificial Sequence: Synthetic polypeptide
DEEEIRTTNPVATEGYGCSCSNTNEQYFNSDQA

SEQ ID NO: 94818 - protein, 34 aa, Artificial Sequence
  Description of Artificial Sequence: Synthetic polypeptide
YEEEIRTTNPVATEQYGSIMCCPTLNAARGNTRS

SEQ ID NO: 94819 - protein, 33 aa, Artificial Sequence
  Description of Artificial Sequence: Synthetic polypeptide
YEEEIRTTNPVATEQYGSIVCRPVQGKRHNTRS

SEQ ID NO: 94820 - protein, 33 aa, Artificial Sequence
  Description of Artificial Sequence: Synthetic polypeptide
YEEEIRTTNPVATEQYGSVIDTVILQTQPAMYR

SEQ ID NO: 94821 - protein, 34 aa, Artificial Sequence
  Description of Artificial Sequence: Synthetic polypeptide
YEEEIRTTNPVATEQWYGSVDDYWPPNLARGFNV

SEQ ID NO: 94822 - protein, 32 aa, Artificial Sequence
  Description of Artificial Sequence: Synthetic polypeptide
DEEEIRTTNPVATEGYGCSCSTEEQNNSNTQA

SEQ ID NO: 94823 - protein, 32 aa, Artificial Sequence
  Description of Artificial Sequence: Synthetic polypeptide
DEEEIRTTNPVATEFYGTVVDTVNMFDRISGR

SEQ ID NO: 94824 - protein, 28 aa, Artificial Sequence
  Description of Artificial Sequence: Synthetic peptide
AECEIATTNPVATECYGVVSEQLQPEEL

SEQ ID NO: 94825 - protein, 32 aa, Artificial Sequence
  Description of Artificial Sequence: Synthetic polypeptide
YEEEIRSTNPVCTEQYGVVSSTPNGPNRNGNQ

SEQ ID NO: 94826 - protein, 28 aa, Artificial Sequence
  Description of Artificial Sequence: Synthetic peptide
DEEEIRTTNPVATEPYGTAPEDIQQEEK

SEQ ID NO: 94827 - protein, 29 aa, Artificial Sequence
  Description of Artificial Sequence: Synthetic peptide
AEDEIACTNPVAYEQWGEASENLQRGDER

SEQ ID NO: 94828 - protein, 33 aa, Artificial Sequence
  Description of Artificial Sequence: Synthetic polypeptide
DEEEIRTTNPVATEFYGSVSTDTEGFGGNGNEE

SEQ ID NO: 94829 - protein, 33 aa, Artificial Sequence
  Description of Artificial Sequence: Synthetic polypeptide
DEEEIRTTNPVATEFYGSVSTDTEGFGNGGNQE

SEQ ID NO: 94830 - protein, 33 aa, Artificial Sequence
  Description of Artificial Sequence: Synthetic polypeptide
DEEEIRTTNPVATEFYGSVSTMQDGFEGGNEGT

SEQ ID NO: 94831 - protein, 33 aa, Artificial Sequence
  Description of Artificial Sequence: Synthetic polypeptide
DEEEIRTTNPVATEFYGSVSTPGFGGGETGNIA

SEQ ID NO: 94832 - protein, 34 aa, Artificial Sequence
  Description of Artificial Sequence: Synthetic polypeptide
DEEEIRTTNPVATEPYGSVVGFGNLNNQGGGNDQ

SEQ ID NO: 94833 - protein, 33 aa, Artificial Sequence
  Description of Artificial Sequence: Synthetic polypeptide
DEEEIRTTNPVATEPYGSVVGFGNLNEGQGNDL

SEQ ID NO: 94834 - protein, 33 aa, Artificial Sequence
  Description of Artificial Sequence: Synthetic polypeptide
DEEEIRTTNPVATEPYGSVVGFGNLNEGGGNNI

SEQ ID NO: 94835 - protein, 34 aa, Artificial Sequence
  Description of Artificial Sequence: Synthetic polypeptide
DEEEIRTTNPVATEFYGSVSTSNLGLEFNNENGV

SEQ ID NO: 94836 - protein, 34 aa, Artificial Sequence
  Description of Artificial Sequence: Synthetic polypeptide
DEEEIRTTNPVATEFYGSVSTTGMGQEGGNNEQI

SEQ ID NO: 94837 - protein, 35 aa, Artificial Sequence
  Description of Artificial Sequence: Synthetic polypeptide
DEEEIRTTNPVATEPYGSVSTTPAIPQQRNGMNPV

SEQ ID NO: 94838 - protein, 35 aa, Artificial Sequence
  Description of Artificial Sequence: Synthetic polypeptide
DEEEIRTTNPVATEPYGSVSTTPAGPQQRNGMNPV

SEQ ID NO: 94839 - protein, 34 aa, Artificial Sequence
  Description of Artificial Sequence: Synthetic polypeptide
DEEEIRTTNPVATEPYGSVSTTPAGPNMRNGMNV

SEQ ID NO: 94840 - protein, 35 aa, Artificial Sequence
  Description of Artificial Sequence: Synthetic polypeptide
DEEEIRTTNPVATEFYGSVTSGTMNGEQTGGGGNG

SEQ ID NO: 94841 - protein, 30 aa, Artificial Sequence
  Description of Artificial Sequence: Synthetic polypeptide
AEDEIACTNPVATEQYGCQASANLQMPGQR

SEQ ID NO: 94842 - protein, 33 aa, Artificial Sequence
  Description of Artificial Sequence: Synthetic polypeptide
DEEEIRTTNPVATEFYGSVVGNFNGQQENGGNN

SEQ ID NO: 94843 - protein, 29 aa, Artificial Sequence
  Description of Artificial Sequence: Synthetic peptide
AEDEIAATNPVAYEQYGEASENLQGGGER

SEQ ID NO: 94844 - protein, 32 aa, Artificial Sequence
  Description of Artificial Sequence: Synthetic polypeptide
YEEEIRTTNPSATEISGSVSVCMQDQRSGNNR

SEQ ID NO: 94845 - protein, 35 aa, Artificial Sequence
  Description of Artificial Sequence: Synthetic polypeptide
DEEEIRTTNPVATEPYGSVSTDGDEGNGQTGNGGN

SEQ ID NO: 94846 - protein, 35 aa, Artificial Sequence
  Description of Artificial Sequence: Synthetic polypeptide
DEEEIRTTNPVATEPYGSVSSTPAGPQMRNGMNPV

SEQ ID NO: 94847 - protein, 32 aa, Artificial Sequence
  Description of Artificial Sequence: Synthetic polypeptide
DEEEIRTTNPVATEGYGCSCSTEEQYFNSDAA

SEQ ID NO: 94848 - protein, 32 aa, Artificial Sequence
  Description of Artificial Sequence: Synthetic polypeptide
DEEEIRTTNPVATEGYGCSCSTEEQYNSNNFA

SEQ ID NO: 94849 - protein, 35 aa, Artificial Sequence
  Description of Artificial Sequence: Synthetic polypeptide
YEEEIRTTNPVATEQYGSVISGHNYPPRMVGNPRQ

SEQ ID NO: 94850 - protein, 35 aa, Artificial Sequence
  Description of Artificial Sequence: Synthetic polypeptide
AEAEIRTTNPVATEQYGAVPSCTLNLQQAGPENRS

SEQ ID NO: 94851 - protein, 34 aa, Artificial Sequence
  Description of Artificial Sequence: Synthetic polypeptide
DEEEIRTTNPVATEGYGCVCSNTELQEGFGSNQS

SEQ ID NO: 94852 - protein, 30 aa, Artificial Sequence
  Description of Artificial Sequence: Synthetic polypeptide
AEAEIACTNPVAYEQYGEISENLSQRGGGR

SEQ ID NO: 94853 - protein, 33 aa, Artificial Sequence
  Description of Artificial Sequence: Synthetic polypeptide
DEEEIRTTNPVATEGYGCVCSNTNHQHFNSNQS

SEQ ID NO: 94854 - protein, 30 aa, Artificial Sequence
  Description of Artificial Sequence: Synthetic polypeptide
AEAEIACTNPVATEQYGCASANLQEGGGQR

SEQ ID NO: 94855 - protein, 31 aa, Artificial Sequence
  Description of Artificial Sequence: Synthetic polypeptide
YEEEIVSTNPVATEQYGTVSATNPVESEGND

SEQ ID NO: 94856 - protein, 29 aa, Artificial Sequence
  Description of Artificial Sequence: Synthetic peptide
YEEEIVSVNPVCTEQYGTVSTDNPESGND

SEQ ID NO: 94857 - protein, 32 aa, Artificial Sequence
  Description of Artificial Sequence: Synthetic polypeptide
DEEEIRTTNPVATEGYGCVCSSELQNFGSEQV

SEQ ID NO: 94858 - protein, 32 aa, Artificial Sequence
  Description of Artificial Sequence: Synthetic polypeptide
DEEEIRTTNPVATEGYGCVCSSNHQNFNSNQT

SEQ ID NO: 94859 - protein, 29 aa, Artificial Sequence
  Description of Artificial Sequence: Synthetic peptide
ADNMIACTNPVATEQYGEASENLQRGGLR

SEQ ID NO: 94860 - protein, 34 aa, Artificial Sequence
  Description of Artificial Sequence: Synthetic polypeptide
DEEEIRTTNPVATEPYGISVNTRVLQDRIKNSPM

SEQ ID NO: 94861 - protein, 33 aa, Artificial Sequence
  Description of Artificial Sequence: Synthetic polypeptide
DEEEIRTTNPVATEGYGCVCSTEELQFFGSDQL

SEQ ID NO: 94862 - protein, 31 aa, Artificial Sequence
  Description of Artificial Sequence: Synthetic polypeptide
YEEEIVTTNPVCTEQYGVVCSTNPVESEGNQ

SEQ ID NO: 94863 - protein, 32 aa, Artificial Sequence
  Description of Artificial Sequence: Synthetic polypeptide
DEEEIRTTNPVATEGYGCVCSTEPQSFGSEQA

SEQ ID NO: 94864 - protein, 33 aa, Artificial Sequence
  Description of Artificial Sequence: Synthetic polypeptide
DEEEIRTTNPVATEGYGCVCSTGAHQNFGSNQA

SEQ ID NO: 94865 - protein, 33 aa, Artificial Sequence
  Description of Artificial Sequence: Synthetic polypeptide
DEEEIRTTNPVATEGYGCVCSTGEDQFFGSNQP

SEQ ID NO: 94866 - protein, 34 aa, Artificial Sequence
  Description of Artificial Sequence: Synthetic polypeptide
DEEEIRTTNPVATEPYGICVCSTVNLQERISDQF

SEQ ID NO: 94867 - protein, 36 aa, Artificial Sequence
  Description of Artificial Sequence: Synthetic polypeptide
DEEEIRTTNPVATEPYGHVPSCWTNELSNRTGGNVR

SEQ ID NO: 94868 - protein, 30 aa, Artificial Sequence
  Description of Artificial Sequence: Synthetic polypeptide
YEEEIVTVNPVATEQYGTVCSADGPQSGND

SEQ ID NO: 94869 - protein, 30 aa, Artificial Sequence
  Description of Artificial Sequence: Synthetic polypeptide
YEEEIVTVNPVATEQYGVVSDDGPQSEGND

SEQ ID NO: 94870 - protein, 32 aa, Artificial Sequence
  Description of Artificial Sequence: Synthetic polypeptide
DEEEIRTTNPVATEGYGCVCSTGEHQYFGSEQ

SEQ ID NO: 94871 - protein, 33 aa, Artificial Sequence
  Description of Artificial Sequence: Synthetic polypeptide
DEEEIRTTNPVATEGYGCVCSNTEHQRFGSEQF

SEQ ID NO: 94872 - protein, 32 aa, Artificial Sequence
  Description of Artificial Sequence: Synthetic polypeptide
DEEEIRTTNPVATEPYGISVSWVVLADTIDNF

SEQ ID NO: 94873 - protein, 31 aa, Artificial Sequence
  Description of Artificial Sequence: Synthetic polypeptide
AEAEIRTTNPVAYEQYGCICSTNLENFPSNR

SEQ ID NO: 94874 - protein, 33 aa, Artificial Sequence
  Description of Artificial Sequence: Synthetic polypeptide
YEEEISPTNPVATEQYGSIVDDTNLGQNGNIMA

SEQ ID NO: 94875 - protein, 35 aa, Artificial Sequence
  Description of Artificial Sequence: Synthetic polypeptide
YEEEIRTTNPVATEQYGSVISTNSYPPDMVGNPRQ

SEQ ID NO: 94876 - protein, 35 aa, Artificial Sequence
  Description of Artificial Sequence: Synthetic polypeptide
YEEEIRTTNPVATEQYGSVSSTDALPNMRNGMNPV

SEQ ID NO: 94877 - protein, 33 aa, Artificial Sequence
  Description of Artificial Sequence: Synthetic polypeptide
DEEEIRTTNPVATEPYGSVCFQTVQHNRGGNVP

SEQ ID NO: 94878 - protein, 34 aa, Artificial Sequence
  Description of Artificial Sequence: Synthetic polypeptide
DEEEIRTTNPVATEPYGSVCFNQMLLTRGGQNEE

SEQ ID NO: 94879 - protein, 34 aa, Artificial Sequence
  Description of Artificial Sequence: Synthetic polypeptide
DEEEIRTTNPVATEPYGSVCFFTYVATQRGGQNE

SEQ ID NO: 94880 - protein, 35 aa, Artificial Sequence
  Description of Artificial Sequence: Synthetic polypeptide
DEEEIRTTNPVATEPYGSVCFFTYLTQRGMQNGEP

SEQ ID NO: 94881 - protein, 35 aa, Artificial Sequence
  Description of Artificial Sequence: Synthetic polypeptide
DEEEIRTTNPVATEPYGSVCFFTYLGTQRGGQNEW

SEQ ID NO: 94882 - protein, 34 aa, Artificial Sequence
  Description of Artificial Sequence: Synthetic polypeptide
DEEEIRTTNPVATEPYGSVCFFTYLETQPGGQNE

SEQ ID NO: 94883 - protein, 34 aa, Artificial Sequence
  Description of Artificial Sequence: Synthetic polypeptide
DEEEIRTTNPVATEPYGSVCFFTEYQTQRGMQNE

SEQ ID NO: 94884 - protein, 32 aa, Artificial Sequence
  Description of Artificial Sequence: Synthetic polypeptide
YEEEIRTTNPVATEQYGSVSTLVTNTRFDTHN

SEQ ID NO: 94885 - protein, 35 aa, Artificial Sequence
  Description of Artificial Sequence: Synthetic polypeptide
DEEEIRTTNPVATEFYGSVSNTDNMTDQEQGENGT

SEQ ID NO: 94886 - protein, 32 aa, Artificial Sequence
  Description of Artificial Sequence: Synthetic polypeptide
DEEEIRTTNPVATEGYGCVCFTELTRFGSDQS

SEQ ID NO: 94887 - protein, 34 aa, Artificial Sequence
  Description of Artificial Sequence: Synthetic polypeptide
DEEEIRTTNPVATEGYGCVCFTGNLNTRFGSNQS

SEQ ID NO: 94888 - protein, 33 aa, Artificial Sequence
  Description of Artificial Sequence: Synthetic polypeptide
DEEEIRTTNPVATEGYGCVCFTNLTHFGSDNQS

SEQ ID NO: 94889 - protein, 34 aa, Artificial Sequence
  Description of Artificial Sequence: Synthetic polypeptide
YEEEIRTTNPVAYEQYGESPSTNTLVQNYGMEVR

SEQ ID NO: 94890 - protein, 32 aa, Artificial Sequence
  Description of Artificial Sequence: Synthetic polypeptide
DEEEIRTTNPVATEPYGSSTMSGTLESNDTNR

SEQ ID NO: 94891 - protein, 34 aa, Artificial Sequence
  Description of Artificial Sequence: Synthetic polypeptide
DEEEIRTTNPVATEPYGSISTPAIPQQRNGMNPV

SEQ ID NO: 94892 - protein, 30 aa, Artificial Sequence
  Description of Artificial Sequence: Synthetic polypeptide
YEEEIRTTNPVCTEQWGVVSENEQNAAGDA

SEQ ID NO: 94893 - protein, 32 aa, Artificial Sequence
  Description of Artificial Sequence: Synthetic polypeptide
DEEEIRTTNPVATEPYGSISMEDIPNMRNGNH

SEQ ID NO: 94894 - protein, 33 aa, Artificial Sequence
  Description of Artificial Sequence: Synthetic polypeptide
DEEEIRTTNPVATEPYGSCCFTAMLLTRGGQNE

SEQ ID NO: 94895 - protein, 34 aa, Artificial Sequence
  Description of Artificial Sequence: Synthetic polypeptide
YEEEIRTTNPVCTEQYGSVSSTTPALNMRNGMNV

SEQ ID NO: 94896 - protein, 34 aa, Artificial Sequence
  Description of Artificial Sequence: Synthetic polypeptide
DEEEIRTTNPVATEPYGKVCCTNALSTRTGGNPE

SEQ ID NO: 94897 - protein, 32 aa, Artificial Sequence
  Description of Artificial Sequence: Synthetic polypeptide
DEEEIRTTNPVATEGYGCVCFTGELTYFGSNQ

SEQ ID NO: 94898 - protein, 33 aa, Artificial Sequence
  Description of Artificial Sequence: Synthetic polypeptide
DEEEIRTTNPVATEPYGTVSMPAGPQMRNGMNV

SEQ ID NO: 94899 - protein, 33 aa, Artificial Sequence
  Description of Artificial Sequence: Synthetic polypeptide
DEEEIRTTNPVATEPYGTVSMPDGPQMRNGMNV

SEQ ID NO: 94900 - protein, 33 aa, Artificial Sequence
  Description of Artificial Sequence: Synthetic polypeptide
DEEEIRTTNPVATEPYGTVSMPDGQQMRNGMNV

SEQ ID NO: 94901 - protein, 34 aa, Artificial Sequence
  Description of Artificial Sequence: Synthetic polypeptide
YEEEIKTTNPVAFEEYGSVVSTTYNLQRQGHSRE

SEQ ID NO: 94902 - protein, 33 aa, Artificial Sequence
  Description of Artificial Sequence: Synthetic polypeptide
YEEEIKTTNPVAFEFYGSVSTTENLDRQGHSRF

SEQ ID NO: 94903 - protein, 33 aa, Artificial Sequence
  Description of Artificial Sequence: Synthetic polypeptide
YEEEIKTTNPVAFEQTGSVSTTYNGQRQGHSRE

SEQ ID NO: 94904 - protein, 34 aa, Artificial Sequence
  Description of Artificial Sequence: Synthetic polypeptide
YEEEIKTTNPVAFEQYGCSASTTYNLQRQGHSRE

SEQ ID NO: 94905 - protein, 34 aa, Artificial Sequence
  Description of Artificial Sequence: Synthetic polypeptide
YEEEIKTTNPVAFEQYGSAVSTTYNLQRQSHSRE

SEQ ID NO: 94906 - protein, 33 aa, Artificial Sequence
  Description of Artificial Sequence: Synthetic polypeptide
DEEEIRTTNPVATEFYGSVDTDMEGQTGGEENN

SEQ ID NO: 94907 - protein, 35 aa, Artificial Sequence
  Description of Artificial Sequence: Synthetic polypeptide
YEEEIKTTNPVAFEQYGSCVPSTTYNLQRQGHSRE

SEQ ID NO: 94908 - protein, 34 aa, Artificial Sequence
  Description of Artificial Sequence: Synthetic polypeptide
YEEEIKTTNPVAFEQYGSTSTTYNLSQDQGNSRF

SEQ ID NO: 94909 - protein, 33 aa, Artificial Sequence
  Description of Artificial Sequence: Synthetic polypeptide
DEEEIRTTNPVATEFYGSVGDGNDDEQGTGNEI

SEQ ID NO: 94910 - protein, 34 aa, Artificial Sequence
  Description of Artificial Sequence: Synthetic polypeptide
YEEEIKTTNPVAFEQYGSTVSTTENLVRQGHSRL

SEQ ID NO: 94911 - protein, 33 aa, Artificial Sequence
  Description of Artificial Sequence: Synthetic polypeptide
YEEEIKTTNPVAFEQYGSVFTTYNLQRQGHSPE

SEQ ID NO: 94912 - protein, 34 aa, Artificial Sequence
  Description of Artificial Sequence: Synthetic polypeptide
DEEEIRTTNPVATEFYGSVISNTDNMNIIGGNGQ

SEQ ID NO: 94913 - protein, 34 aa, Artificial Sequence
  Description of Artificial Sequence: Synthetic polypeptide
YEEEIKTTNPVAFEQYGSVGSTTYNLQAQGHSRE

SEQ ID NO: 94914 - protein, 34 aa, Artificial Sequence
  Description of Artificial Sequence: Synthetic polypeptide
YEEEIKTTNPVAFEQYGSVQSTTYDLQRQGHSRE

SEQ ID NO: 94915 - protein, 33 aa, Artificial Sequence
  Description of Artificial Sequence: Synthetic polypeptide
YEEEIKTTNPVAFEQYGSVSTTEELERQGHSRL

SEQ ID NO: 94916 - protein, 33 aa, Artificial Sequence
  Description of Artificial Sequence: Synthetic polypeptide
YEEEIKTTNPVAFEQYGSVSTTENLERMGHSPF

SEQ ID NO: 94917 - protein, 33 aa, Artificial Sequence
  Description of Artificial Sequence: Synthetic polypeptide
YEEEIKTTNPVAFEQYGSVSTTENLEWQGHSRR

SEQ ID NO: 94918 - protein, 34 aa, Artificial Sequence
  Description of Artificial Sequence: Synthetic polypeptide
YEEEIKTTNPVAFEQYGSVSTTYILSQDQGNERE

SEQ ID NO: 94919 - protein, 33 aa, Artificial Sequence
  Description of Artificial Sequence: Synthetic polypeptide
YEEEIKTTNPVAFEQYGSVSTTYLLQDQGISRE

SEQ ID NO: 94920 - protein, 33 aa, Artificial Sequence
  Description of Artificial Sequence: Synthetic polypeptide
YEEEIKTTNPVAFEQYGSVSTTYNLQVQGGSKE

SEQ ID NO: 94921 - protein, 34 aa, Artificial Sequence
  Description of Artificial Sequence: Synthetic polypeptide
YEEEIKTTNPVAFEQYGSVSTTYNLSQDQGNPYE

SEQ ID NO: 94922 - protein, 34 aa, Artificial Sequence
  Description of Artificial Sequence: Synthetic polypeptide
YEEEIKTTNPVAFEEYGSVSGTYNLTQRQGHSRL

SEQ ID NO: 94923 - protein, 33 aa, Artificial Sequence
  Description of Artificial Sequence: Synthetic polypeptide
DEEEIRTTNPVATEFYGSVDGTSNEQGGETGGT

SEQ ID NO: 94924 - protein, 34 aa, Artificial Sequence
  Description of Artificial Sequence: Synthetic polypeptide
YEEEIKTTNPCAFEQYGSVSTTVNLSQDQGNSRE

SEQ ID NO: 94925 - protein, 33 aa, Artificial Sequence
  Description of Artificial Sequence: Synthetic polypeptide
YEEEIKQTNPVAFEQYGSVSTTYNLQDQGNSSE

SEQ ID NO: 94926 - protein, 34 aa, Artificial Sequence
  Description of Artificial Sequence: Synthetic polypeptide
DEEEIRTTNPVATEFYGAVWSTINPEMQDEQGNE

SEQ ID NO: 94927 - protein, 31 aa, Artificial Sequence
  Description of Artificial Sequence: Synthetic polypeptide
YEEEIGTGTNPVATEQYGTVNWDNLVRDEYR

SEQ ID NO: 94928 - protein, 32 aa, Artificial Sequence
  Description of Artificial Sequence: Synthetic polypeptide
DEEEIRTTNPVATEFYGDVSGDGGQEGNGNGD

SEQ ID NO: 94929 - protein, 33 aa, Artificial Sequence
  Description of Artificial Sequence: Synthetic polypeptide
DEEEIRTTNPVATEFYGDVVSGNNGQTGGNGGE

SEQ ID NO: 94930 - protein, 30 aa, Artificial Sequence
  Description of Artificial Sequence: Synthetic polypeptide
YEEEIGTTNPEATEQVASVHTNLTGRLNVA

SEQ ID NO: 94931 - protein, 32 aa, Artificial Sequence
  Description of Artificial Sequence: Synthetic polypeptide
YEEEIGTTNPPATEQYSGPSETNHEQRSGNFR

SEQ ID NO: 94932 - protein, 30 aa, Artificial Sequence
  Description of Artificial Sequence: Synthetic polypeptide
YEEEIGTTNPVATEQVADVSTNLTGPLNVD

SEQ ID NO: 94933 - protein, 31 aa, Artificial Sequence
  Description of Artificial Sequence: Synthetic polypeptide
YEEEIGTTNPVATEQVASVESTSLTGRLNVA

SEQ ID NO: 94934 - protein, 31 aa, Artificial Sequence
  Description of Artificial Sequence: Synthetic polypeptide
YEEEIGTTNPVATEQVMSVSTENLTGRLTVA

SEQ ID NO: 94935 - protein, 31 aa, Artificial Sequence
  Description of Artificial Sequence: Synthetic polypeptide
AEDEIATTNPVAYEGWGSVSTTNLQDGNLDS

SEQ ID NO: 94936 - protein, 34 aa, Artificial Sequence
  Description of Artificial Sequence: Synthetic polypeptide
YEEEIKTTNPVAFPEQYGSVSQTENLERQGHSRL

SEQ ID NO: 94937 - protein, 33 aa, Artificial Sequence
  Description of Artificial Sequence: Synthetic polypeptide
DEEEIRTTNPVATEFYGMVSIMQTNEFGNGNND

SEQ ID NO: 94938 - protein, 33 aa, Artificial Sequence
  Description of Artificial Sequence: Synthetic polypeptide
DEEEIRTTNPVATEFYGMVSITNGDEFNGGNND

SEQ ID NO: 94939 - protein, 31 aa, Artificial Sequence
  Description of Artificial Sequence: Synthetic polypeptide
AEDEIATTNPVAYECWGSVSTTNLQDGNLLQ

SEQ ID NO: 94940 - protein, 32 aa, Artificial Sequence
  Description of Artificial Sequence: Synthetic polypeptide
YEEEIGTTNPVATSEYGSIVSYSNINQMGENR

SEQ ID NO: 94941 - protein, 33 aa, Artificial Sequence
  Description of Artificial Sequence: Synthetic polypeptide
YEEEIGTTNPVATSEYGSVVSMNINQRFGENFR

SEQ ID NO: 94942 - protein, 32 aa, Artificial Sequence
  Description of Artificial Sequence: Synthetic polypeptide
YEEEIGTTNPVATSEYGSVVSYNIEKRGENFR

SEQ ID NO: 94943 - protein, 32 aa, Artificial Sequence
  Description of Artificial Sequence: Synthetic polypeptide
YEEEIGTTNPVATSEYGVIVSYNINQRGENRN

SEQ ID NO: 94944 - protein, 31 aa, Artificial Sequence
  Description of Artificial Sequence: Synthetic polypeptide
DEEEIRTTNPVATEFYGNVMGDGGQGGENEG

SEQ ID NO: 94945 - protein, 33 aa, Artificial Sequence
  Description of Artificial Sequence: Synthetic polypeptide
DEEEIRTTNPVATEFYGNVVDTVNMFDRISNRV

SEQ ID NO: 94946 - protein, 33 aa, Artificial Sequence
  Description of Artificial Sequence: Synthetic polypeptide
YEEEIKATNPVATEQYGKSIVCTINLQPKEGTR

SEQ ID NO: 94947 - protein, 34 aa, Artificial Sequence
  Description of Artificial Sequence: Synthetic polypeptide
YEEEIKCTNPVAFEQYGESVSTTYNLQRQGHSRL

SEQ ID NO: 94948 - protein, 31 aa, Artificial Sequence
  Description of Artificial Sequence: Synthetic polypeptide
YEEEIGTTNPVATEQYSGPSTHNMEQPDNFR

SEQ ID NO: 94949 - protein, 33 aa, Artificial Sequence
  Description of Artificial Sequence: Synthetic polypeptide
DEEEIRTTNPVATEGYGCVCSTGNHQNFGSDQS

SEQ ID NO: 94950 - protein, 34 aa, Artificial Sequence
  Description of Artificial Sequence: Synthetic polypeptide
YEEEIKTTNPVASEQYGSVSCTFNPQQARAGNCS

SEQ ID NO: 94951 - protein, 35 aa, Artificial Sequence
  Description of Artificial Sequence: Synthetic polypeptide
YEEEIKTTNPVATEQYGSVLYCTNDLNQDRGINFV

SEQ ID NO: 94952 - protein, 32 aa, Artificial Sequence
  Description of Artificial Sequence: Synthetic polypeptide
YEEEIQTTNPVATESYGSVSTNPFVCRNDNQG

SEQ ID NO: 94953 - protein, 33 aa, Artificial Sequence
  Description of Artificial Sequence: Synthetic polypeptide
DEEEIRTTNPVATEFYGSVMSGMFNNDQEEANI

SEQ ID NO: 94954 - protein, 32 aa, Artificial Sequence
  Description of Artificial Sequence: Synthetic polypeptide
YEEEIQTTNPVATEWYGSVSTNPFMVRNDNQG

SEQ ID NO: 94955 - protein, 32 aa, Artificial Sequence
  Description of Artificial Sequence: Synthetic polypeptide
YEEEIQTTNPVAYEQYGSVSTNPFVCRNDNQF

SEQ ID NO: 94956 - protein, 31 aa, Artificial Sequence
  Description of Artificial Sequence: Synthetic polypeptide
YEEEIQTTNPVAYEQYGSVSTNPFVRNDEQG

SEQ ID NO: 94957 - protein, 34 aa, Artificial Sequence
  Description of Artificial Sequence: Synthetic polypeptide
DEEEIRTTNPVATEFYGSVNSDGNLQEQGEGGEI

SEQ ID NO: 94958 - protein, 33 aa, Artificial Sequence
  Description of Artificial Sequence: Synthetic polypeptide
DEEEIRTTNPVATEPYGVVVVTVNLQQDETENG

SEQ ID NO: 94959 - protein, 30 aa, Artificial Sequence
  Description of Artificial Sequence: Synthetic polypeptide
YEEEIRSTNPIATEQWGAVWSNDNLQPGPQ

SEQ ID NO: 94960 - protein, 33 aa, Artificial Sequence
  Description of Artificial Sequence: Synthetic polypeptide
DEEEIRTTNPVATEPYGVVVVTVNLQDEETENN

SEQ ID NO: 94961 - protein, 30 aa, Artificial Sequence
  Description of Artificial Sequence: Synthetic polypeptide
YEEEIRSTNPIATEQWGVVWSNDNLQPGPQ

SEQ ID NO: 94962 - protein, 30 aa, Artificial Sequence
  Description of Artificial Sequence: Synthetic polypeptide
YEEEIRSTNPIATEQWGVVWSNDNLQSGPQ

SEQ ID NO: 94963 - protein, 28 aa, Artificial Sequence
  Description of Artificial Sequence: Synthetic peptide
YEEEIRSTNPVATEQWGVVSDNEMAEDQ

SEQ ID NO: 94964 - protein, 35 aa, Artificial Sequence
  Description of Artificial Sequence: Synthetic polypeptide
DEEEIRTTNPVATEFYGSVSGTGNDQEDEGGNGEE

SEQ ID NO: 94965 - protein, 33 aa, Artificial Sequence
  Description of Artificial Sequence: Synthetic polypeptide
DEEEIRTTNPVATEFYGSVSNGMGGQGEQEGNI

SEQ ID NO: 94966 - protein, 34 aa, Artificial Sequence
  Description of Artificial Sequence: Synthetic polypeptide
DEEEIRTTNPVATEFYGSVSNMNELGMEGGNNGD

SEQ ID NO: 94967 - protein, 33 aa, Artificial Sequence
  Description of Artificial Sequence: Synthetic polypeptide
DEEEIRTTNPVATEFYGSVSNNDEMQNFTGEGG

SEQ ID NO: 94968 - protein, 32 aa, Artificial Sequence
  Description of Artificial Sequence: Synthetic polypeptide
YEEEIRSTNPVATEQYGVVSSDPALNMRGMNV

SEQ ID NO: 94969 - protein, 34 aa, Artificial Sequence
  Description of Artificial Sequence: Synthetic polypeptide
DEEEIRTTNPVATEPYGTVSSTTEAGPNQRNGNV

SEQ ID NO: 94970 - protein, 33 aa, Artificial Sequence
  Description of Artificial Sequence: Synthetic polypeptide
YEEEIRSTNPVATEQYGVVSSTPALPNMRGMNV

SEQ ID NO: 94971 - protein, 33 aa, Artificial Sequence
  Description of Artificial Sequence: Synthetic polypeptide
YEEEIRSTNPVATEQYGVVSSTTNGNRNGMNPQ

SEQ ID NO: 94972 - protein, 30 aa, Artificial Sequence
  Description of Artificial Sequence: Synthetic polypeptide
YEEEIRSTNPVCTEQYGVISMNIQQSNGNQ

SEQ ID NO: 94973 - protein, 34 aa, Artificial Sequence
  Description of Artificial Sequence: Synthetic polypeptide
DEEEIRTTNPVATEFYGSVMSGMFNDDQEEGVNI

SEQ ID NO: 94974 - protein, 32 aa, Artificial Sequence
  Description of Artificial Sequence: Synthetic polypeptide
YEEEIQTTNPVATEQYGSVSTIPFVRNDNYQG

SEQ ID NO: 94975 - protein, 33 aa, Artificial Sequence
  Description of Artificial Sequence: Synthetic polypeptide
YEEEIQTTNPVATEQYGSVSNTNPFDVRNDNQG

SEQ ID NO: 94976 - protein, 31 aa, Artificial Sequence
  Description of Artificial Sequence: Synthetic polypeptide
YEEEIQTTNPVATEQYGSVLTNPFVTNDNQG

SEQ ID NO: 94977 - protein, 29 aa, Artificial Sequence
  Description of Artificial Sequence: Synthetic peptide
AEDEIACTNPVAYEQYGEASENLQMGEGR

SEQ ID NO: 94978 - protein, 31 aa, Artificial Sequence
  Description of Artificial Sequence: Synthetic polypeptide
YEEEIMSVNPVATEQYGVVSIDHNLQSGNQE

SEQ ID NO: 94979 - protein, 32 aa, Artificial Sequence
  Description of Artificial Sequence: Synthetic polypeptide
YEEEIMTTNPVAVEQYGSVCVTNLDQRSTSQP

SEQ ID NO: 94980 - protein, 31 aa, Artificial Sequence
  Description of Artificial Sequence: Synthetic polypeptide
YEEEIMTTNPVAVEQYGSVCVTNLEVRSTSQ

SEQ ID NO: 94981 - protein, 32 aa, Artificial Sequence
  Description of Artificial Sequence: Synthetic polypeptide
YEEEIMTTNPVAVEQYGSVCVTNLQARSTSQE

SEQ ID NO: 94982 - protein, 32 aa, Artificial Sequence
  Description of Artificial Sequence: Synthetic polypeptide
DEEEIRTTNPVATEQFGQCVCSTYLLHGSDTQ

SEQ ID NO: 94983 - protein, 30 aa, Artificial Sequence
  Description of Artificial Sequence: Synthetic polypeptide
YEEEINTTNPSATDHYGQVVTNLQQIGNQG

SEQ ID NO: 94984 - protein, 31 aa, Artificial Sequence
  Description of Artificial Sequence: Synthetic polypeptide
YEEEINTTNPSATDPYGSVVTNNLQQIGNQG

SEQ ID NO: 94985 - protein, 33 aa, Artificial Sequence
  Description of Artificial Sequence: Synthetic polypeptide
DEEEIRTTNPVATEQFGQCVCSTGYDLHFGSNQ

SEQ ID NO: 94986 - protein, 32 aa, Artificial Sequence
  Description of Artificial Sequence: Synthetic polypeptide
YEEEINTTNPSATDQYGSVCGTNLQQIQGNQI

SEQ ID NO: 94987 - protein, 34 aa, Artificial Sequence
  Description of Artificial Sequence: Synthetic polypeptide
YEEEIKTTNPVASEQYGSVSTFNDQVQARAGNCS

SEQ ID NO: 94988 - protein, 32 aa, Artificial Sequence
  Description of Artificial Sequence: Synthetic polypeptide
YEEEINTTNPSATDQYGSVEVFTNLQQIGNQG

SEQ ID NO: 94989 - protein, 32 aa, Artificial Sequence
  Description of Artificial Sequence: Synthetic polypeptide
YEEEINTTNPSATDQYGSVVITNLQQDQGNQG

SEQ ID NO: 94990 - protein, 31 aa, Artificial Sequence
  Description of Artificial Sequence: Synthetic polypeptide
YEEEINTTNPSATDQYGSVVTNLQQIGVPDG

SEQ ID NO: 94991 - protein, 30 aa, Artificial Sequence
  Description of Artificial Sequence: Synthetic polypeptide
YEEEINTTNPSATDWYGSVVTNLQQIINQG

SEQ ID NO: 94992 - protein, 31 aa, Artificial Sequence
  Description of Artificial Sequence: Synthetic polypeptide
YEEEIQSTNPVATEQYGSVLTNPFVRNDNVG

SEQ ID NO: 94993 - protein, 32 aa, Artificial Sequence
  Description of Artificial Sequence: Synthetic polypeptide
YEEEIQTTNPHATEQYGSVYSTNPFVRNDNQG

SEQ ID NO: 94994 - protein, 31 aa, Artificial Sequence
  Description of Artificial Sequence: Synthetic polypeptide
YEEEIQTTNPVAIEQYGSVSANPFVRNDNQG

SEQ ID NO: 94995 - protein, 31 aa, Artificial Sequence
  Description of Artificial Sequence: Synthetic polypeptide
YEEEIQTTNPVATEGYGSVSTNPFVRNDDQG

SEQ ID NO: 94996 - protein, 31 aa, Artificial Sequence
  Description of Artificial Sequence: Synthetic polypeptide
YEEEIQTTNPVATEGYGSVWTNPHVRNDNQG

SEQ ID NO: 94997 - protein, 32 aa, Artificial Sequence
  Description of Artificial Sequence: Synthetic polypeptide
YEEEIQTTNPVATEQYGSVASTNPFVDNDNQG

SEQ ID NO: 94998 - protein, 32 aa, Artificial Sequence
  Description of Artificial Sequence: Synthetic polypeptide
YEEEIQTTNPVATEQYGSVLTNPFVPRNDNGG

SEQ ID NO: 94999 - protein, 31 aa, Artificial Sequence
  Description of Artificial Sequence: Synthetic polypeptide
YEEEINTTNPSATDQYGSVVETFLQQIGNQG

SEQ ID NO: 95000 - protein, 32 aa, Artificial Sequence
  Description of Artificial Sequence: Synthetic polypeptide
AEDEIATTNPVAYEPWGSVSTNNNLQDGNLRQ

SEQ ID NO: 95001 - protein, 33 aa, Artificial Sequence
  Description of Artificial Sequence: Synthetic polypeptide
DEEEIRTTNPVATEGYGCVCSTMELQNFGSEQA

SEQ ID NO: 95002 - protein, 34 aa, Artificial Sequence
  Description of Artificial Sequence: Synthetic polypeptide
YEEELKTTNPVAFEQYGSVSDTYNLSQDQGNSRE

SEQ ID NO: 95003 - protein, 31 aa, Artificial Sequence
  Description of Artificial Sequence: Synthetic polypeptide
YEQEIATTNPVCTEQYGSVSADNLEDHGNDQ

SEQ ID NO: 95004 - protein, 30 aa, Artificial Sequence
  Description of Artificial Sequence: Synthetic polypeptide
YEQEIATVNPVCTEQYGVVSTNLEHEGNDL

SEQ ID NO: 95005 - protein, 31 aa, Artificial Sequence
  Description of Artificial Sequence: Synthetic polypeptide
YEQEIQTTNPVATEQYGSVLTNPNVRNDNQG

SEQ ID NO: 95006 - protein, 28 aa, Artificial Sequence
  Description of Artificial Sequence: Synthetic peptide
YESEIASTNPVATECWGVVSCNEQSGNG

SEQ ID NO: 95007 - protein, 28 aa, Artificial Sequence
  Description of Artificial Sequence: Synthetic peptide
YESEIASTNPVATECWGVVSCNEQSGNQ

SEQ ID NO: 95008 - protein, 28 aa, Artificial Sequence
  Description of Artificial Sequence: Synthetic peptide
YESEIASTNPVATECWGVVSDNEQSGNQ

SEQ ID NO: 95009 - protein, 28 aa, Artificial Sequence
  Description of Artificial Sequence: Synthetic peptide
YESEIASTNPVCTEGYGVVSDTLQHGNQ

SEQ ID NO: 95010 - protein, 28 aa, Artificial Sequence
  Description of Artificial Sequence: Synthetic peptide
YESEIASTNPVGTEQYGVMSDNLQHGDQ

SEQ ID NO: 95011 - protein, 28 aa, Artificial Sequence
  Description of Artificial Sequence: Synthetic peptide
YESEIASTNPVGTEQYGVMSDNLQSGDQ

SEQ ID NO: 95012 - protein, 29 aa, Artificial Sequence
  Description of Artificial Sequence: Synthetic peptide
YESEIASTNPVSTEQYGVVADNLQSSGQR

SEQ ID NO: 95013 - protein, 30 aa, Artificial Sequence
  Description of Artificial Sequence: Synthetic polypeptide
YESEIASVNPVATECYGVVSCINLQRGENG

SEQ ID NO: 95014 - protein, 28 aa, Artificial Sequence
  Description of Artificial Sequence: Synthetic peptide
YESEIASVNPVATECYGVVSDNEQSGNQ

SEQ ID NO: 95015 - protein, 28 aa, Artificial Sequence
  Description of Artificial Sequence: Synthetic peptide
YESEIASVNPVCTECYGVVSDNLQSGNQ

SEQ ID NO: 95016 - protein, 28 aa, Artificial Sequence
  Description of Artificial Sequence: Synthetic peptide
YESEIASVNPVCTEQWGVVSDNLQSGNG

SEQ ID NO: 95017 - protein, 34 aa, Artificial Sequence
  Description of Artificial Sequence: Synthetic polypeptide
DEEEIRTTNPVATEGYGSVCSTEEDHQNFGSNQS

SEQ ID NO: 95018 - protein, 29 aa, Artificial Sequence
  Description of Artificial Sequence: Synthetic peptide
YESEIASVNPVCTEQYGVVANNLQRVGNQ

SEQ ID NO: 95019 - protein, 28 aa, Artificial Sequence
  Description of Artificial Sequence: Synthetic peptide
YESEIASVNPVCTEQYGVVSDCLQSGNQ

SEQ ID NO: 95020 - protein, 28 aa, Artificial Sequence
  Description of Artificial Sequence: Synthetic peptide
YESEIASVNPVCTEQYGVVSDNEQSGNQ

SEQ ID NO: 95021 - protein, 29 aa, Artificial Sequence
  Description of Artificial Sequence: Synthetic peptide
YESEIASVNPVCTEQYGVVSDNLQDSGNQ

SEQ ID NO: 95022 - protein, 28 aa, Artificial Sequence
  Description of Artificial Sequence: Synthetic peptide
YESEIASVNPVCTEQYGVVSDNLQSGDQ

SEQ ID NO: 95023 - protein, 30 aa, Artificial Sequence
  Description of Artificial Sequence: Synthetic polypeptide
YESEIASVNPVCTEQYGVVSDNLQSRVGNQ

SEQ ID NO: 95024 - protein, 35 aa, Artificial Sequence
  Description of Artificial Sequence: Synthetic polypeptide
DEEEIRTTNPVATEGYGSTVSQNAFSQNRVLGSNQ

SEQ ID NO: 95025 - protein, 29 aa, Artificial Sequence
  Description of Artificial Sequence: Synthetic peptide
YESEIASVNPVCTEQYGVVSDNLQSSGNQ

SEQ ID NO: 95026 - protein, 31 aa, Artificial Sequence
  Description of Artificial Sequence: Synthetic polypeptide
YEQEIATTNPVCTEQYGSVSADNLEDHGNDL

SEQ ID NO: 95027 - protein, 30 aa, Artificial Sequence
  Description of Artificial Sequence: Synthetic polypeptide
YEQEIATTNPVATEQYGSVSDDLEDSEGEQ

SEQ ID NO: 95028 - protein, 30 aa, Artificial Sequence
  Description of Artificial Sequence: Synthetic polypeptide
YEQEIASTNPVATEQYGVVSDDLQDSGNDL

SEQ ID NO: 95029 - protein, 30 aa, Artificial Sequence
  Description of Artificial Sequence: Synthetic polypeptide
YEQEIASTNPVATEQYGVVSDDLQDSGNDQ

SEQ ID NO: 95030 - protein, 31 aa, Artificial Sequence
  Description of Artificial Sequence: Synthetic polypeptide
YEQEIASTNPVCTEQYGSVSADNLQDHGNDQ

SEQ ID NO: 95031 - protein, 30 aa, Artificial Sequence
  Description of Artificial Sequence: Synthetic polypeptide
YEQEIASTNPVCTEQYGSVSATDLQDHGEL

SEQ ID NO: 95032 - protein, 30 aa, Artificial Sequence
  Description of Artificial Sequence: Synthetic polypeptide
YEQEIASTNPVCTEQYGVVSDNLQDHGNDQ

SEQ ID NO: 95033 - protein, 28 aa, Artificial Sequence
  Description of Artificial Sequence: Synthetic peptide
YEQEIASVNGVCTEQYGVVSDNLQSGNQ

SEQ ID NO: 95034 - protein, 31 aa, Artificial Sequence
  Description of Artificial Sequence: Synthetic polypeptide
YEQEIASVNPVATEQYGSVSATNLQDSGEDL

SEQ ID NO: 95035 - protein, 29 aa, Artificial Sequence
  Description of Artificial Sequence: Synthetic peptide
YEQEIASVNPVCTEQYGVVSCDNLQSGNQ

SEQ ID NO: 95036 - protein, 29 aa, Artificial Sequence
  Description of Artificial Sequence: Synthetic peptide
YEQEIASVNPVCTEQYGVVSDNLQDSGNQ

SEQ ID NO: 95037 - protein, 28 aa, Artificial Sequence
  Description of Artificial Sequence: Synthetic peptide
YEQEIASVNPVCTEQYGVVSDNLQSGKQ

SEQ ID NO: 95038 - protein, 29 aa, Artificial Sequence
  Description of Artificial Sequence: Synthetic peptide
YEQEIASVNPVCTEQYGVVSTNLEHEGNL

SEQ ID NO: 95039 - protein, 33 aa, Artificial Sequence
  Description of Artificial Sequence: Synthetic polypeptide
DEEEIRTTNPVATEHYGCVCSTEPHQNFGSNQS

SEQ ID NO: 95040 - protein, 31 aa, Artificial Sequence
  Description of Artificial Sequence: Synthetic polypeptide
YEQEIATTNPVATEQYGSVSADDLEDHGNDL

SEQ ID NO: 95041 - protein, 31 aa, Artificial Sequence
  Description of Artificial Sequence: Synthetic polypeptide
DEEEIRTTNPVATEHYGAAHSENEIQPINAF

SEQ ID NO: 95042 - protein, 31 aa, Artificial Sequence
  Description of Artificial Sequence: Synthetic polypeptide
YEQEIATTNPVATEQYGSVSATDLEDHEGEL

SEQ ID NO: 95043 - protein, 31 aa, Artificial Sequence
  Description of Artificial Sequence: Synthetic polypeptide
YEQEIATTNPVATEQYGSVSATDLEDHEGEQ

SEQ ID NO: 95044 - protein, 34 aa, Artificial Sequence
  Description of Artificial Sequence: Synthetic polypeptide
DEEEIRTTNPVATEGYGSTVFINAFSQNRLGDNA

SEQ ID NO: 95045 - protein, 34 aa, Artificial Sequence
  Description of Artificial Sequence: Synthetic polypeptide
DEEEIRTTNPVATEGYGYTVSQNAQSQNRLGDNQ

SEQ ID NO: 95046 - protein, 36 aa, Artificial Sequence
  Description of Artificial Sequence: Synthetic polypeptide
DEEEIRTTNPVATEGYGSTVPSCTNAIDQNGGGNRG

SEQ ID NO: 95047 - protein, 34 aa, Artificial Sequence
  Description of Artificial Sequence: Synthetic polypeptide
DEEEIRTTNPVATEGYGVVVSNTVNMFDRISNRG

SEQ ID NO: 95048 - protein, 31 aa, Artificial Sequence
  Description of Artificial Sequence: Synthetic polypeptide
YEQEIATTNPVATEQYGSVSATDLEDHGEDL

SEQ ID NO: 95049 - protein, 30 aa, Artificial Sequence
  Description of Artificial Sequence: Synthetic polypeptide
YEQEIATTNPVATEQYGSVSDDLEDSGEDL

SEQ ID NO: 95050 - protein, 29 aa, Artificial Sequence
  Description of Artificial Sequence: Synthetic peptide
YESEIASVNPVCTEQYGVVSNNLQSVGNQ

SEQ ID NO: 95051 - protein, 29 aa, Artificial Sequence
  Description of Artificial Sequence: Synthetic peptide
YESEIASVNPVCTEQYGVVWSDNLQSGNQ

SEQ ID NO: 95052 - protein, 28 aa, Artificial Sequence
  Description of Artificial Sequence: Synthetic peptide
YESEIASVNPVGTEQYGVMSSNLQHGNQ

SEQ ID NO: 95053 - protein, 28 aa, Artificial Sequence
  Description of Artificial Sequence: Synthetic peptide
YETEIASVNPVCTEQYGVVSDNLQSGMQ

SEQ ID NO: 95054 - protein, 29 aa, Artificial Sequence
  Description of Artificial Sequence: Synthetic peptide
YETEIASVNPVCTEQYGVVSVNLQSGPNQ

SEQ ID NO: 95055 - protein, 29 aa, Artificial Sequence
  Description of Artificial Sequence: Synthetic peptide
YETEIATTNPICTEQYGAVADNLQSKGNQ

SEQ ID NO: 95056 - protein, 30 aa, Artificial Sequence
  Description of Artificial Sequence: Synthetic polypeptide
YETEIATTNPVCTEQYGVVSNDNLQESGPQ

SEQ ID NO: 95057 - protein, 28 aa, Artificial Sequence
  Description of Artificial Sequence: Synthetic peptide
YETEIATVNPVATEQWGVTSDDLQPGNQ

SEQ ID NO: 95058 - protein, 28 aa, Artificial Sequence
  Description of Artificial Sequence: Synthetic peptide
YETEIRSVNPVCTECYGAVAANLQSGNQ

SEQ ID NO: 95059 - protein, 35 aa, Artificial Sequence
  Description of Artificial Sequence: Synthetic polypeptide
DEEEIRTTNPVATEGYGSVSTMNLDQELEGGGGEI

SEQ ID NO: 95060 - protein, 35 aa, Artificial Sequence
  Description of Artificial Sequence: Synthetic polypeptide
DEEEIRTTNPVATEGYGSVSTMNIIGQSGGGGNTG

SEQ ID NO: 95061 - protein, 34 aa, Artificial Sequence
  Description of Artificial Sequence: Synthetic polypeptide
DEEEIRTTNPVATEGYGSVSTMGFGQDGEEGNTN

SEQ ID NO: 95062 - protein, 35 aa, Artificial Sequence
  Description of Artificial Sequence: Synthetic polypeptide
DEEEIRTTNPVATEGYGSVSTMGDLGQLEIGNDGE

SEQ ID NO: 95063 - protein, 28 aa, Artificial Sequence
  Description of Artificial Sequence: Synthetic peptide
YGEEIASVNPVCTEQYGVVSDNLQSGRQ

SEQ ID NO: 95064 - protein, 30 aa, Artificial Sequence
  Description of Artificial Sequence: Synthetic polypeptide
YMEEIASTNPVCTEQYGVVSTDNEQSGNQS

SEQ ID NO: 95065 - protein, 34 aa, Artificial Sequence
  Description of Artificial Sequence: Synthetic polypeptide
DEEEIRTTNPVATEGYGSVSTGNGGGDGEGNEGA

SEQ ID NO: 95066 - protein, 34 aa, Artificial Sequence
  Description of Artificial Sequence: Synthetic polypeptide
DEEEIRTTNPVATEGYGSVNSDGNLGQNEGGQGD

SEQ ID NO: 95067 - protein, 36 aa, Artificial Sequence
  Description of Artificial Sequence: Synthetic polypeptide
DEEEIRTTNPVATEGYGSVPSCTNAIDQNGGGNNRV

SEQ ID NO: 95068 - protein, 33 aa, Artificial Sequence
  Description of Artificial Sequence: Synthetic polypeptide
DEEEIRTTNPVATEGYGSVSTDTEGVGNGNEEQ

SEQ ID NO: 95069 - protein, 33 aa, Artificial Sequence
  Description of Artificial Sequence: Synthetic polypeptide
DEEEIRTTNPVATEGYGSVSGDNGGQDEGEDGE

SEQ ID NO: 95070 - protein, 35 aa, Artificial Sequence
  Description of Artificial Sequence: Synthetic polypeptide
DEEEIRTTNPVATEGYGSVSSTTAGPQMRVGMNPV

SEQ ID NO: 95071 - protein, 35 aa, Artificial Sequence
  Description of Artificial Sequence: Synthetic polypeptide
DEEEIRTTNPVATEGYGSVSSTTAGPQMRNGMNPV

SEQ ID NO: 95072 - protein, 33 aa, Artificial Sequence
  Description of Artificial Sequence: Synthetic polypeptide
DEEEIRTTNPVATEGYGSVSSTGGQGGGQEEGT

SEQ ID NO: 95073 - protein, 34 aa, Artificial Sequence
  Description of Artificial Sequence: Synthetic polypeptide
DEEEIRTTNPVATEGYGSVSSNNDEMQGEGNDGG

SEQ ID NO: 95074 - protein, 29 aa, Artificial Sequence
  Description of Artificial Sequence: Synthetic peptide
YETEIASVNPVCTEQYGVVSADNLQSGNQ

SEQ ID NO: 95075 - protein, 28 aa, Artificial Sequence
  Description of Artificial Sequence: Synthetic peptide
YETEIASVNPVCTEQYGVTSDNLQSGNQ

SEQ ID NO: 95076 - protein, 28 aa, Artificial Sequence
  Description of Artificial Sequence: Synthetic peptide
YETEIASVNPVCTECYGVVSDNLQSGNQ

SEQ ID NO: 95077 - protein, 29 aa, Artificial Sequence
  Description of Artificial Sequence: Synthetic peptide
YETEIASTNPICTEQYGVVSDNLQSKGNQ

SEQ ID NO: 95078 - protein, 28 aa, Artificial Sequence
  Description of Artificial Sequence: Synthetic peptide
YESEIASVNPVGTEQYGVVASNLQSGNI

SEQ ID NO: 95079 - protein, 34 aa, Artificial Sequence
  Description of Artificial Sequence: Synthetic polypeptide
DEEEIRTTNPVATEGYGSVVGFGNLNNQGGGNGD

SEQ ID NO: 95080 - protein, 34 aa, Artificial Sequence
  Description of Artificial Sequence: Synthetic polypeptide
DEEEIRTTNPVATEGYGSVDNSTGDEGQGGENTD

SEQ ID NO: 95081 - protein, 28 aa, Artificial Sequence
  Description of Artificial Sequence: Synthetic peptide
YESEIASVNPVSTEGYGVVSDNLQSGNQ

SEQ ID NO: 95082 - protein, 33 aa, Artificial Sequence
  Description of Artificial Sequence: Synthetic polypeptide
DEEEIRTTNPVATEGYGSVVDTVNMFDRISNVF

SEQ ID NO: 95083 - protein, 33 aa, Artificial Sequence
  Description of Artificial Sequence: Synthetic polypeptide
DEEEIRTTNPVATEGYGSVVDTVNMFDRISGRG

SEQ ID NO: 95084 - protein, 35 aa, Artificial Sequence
  Description of Artificial Sequence: Synthetic polypeptide
DEEEIRTTNPVATEGYGSVVDQTVNMFDRGISNTR

SEQ ID NO: 95085 - protein, 33 aa, Artificial Sequence
  Description of Artificial Sequence: Synthetic polypeptide
DEEEIRTTNPVATEGYGSVFGSTDDEGGNTTNI

SEQ ID NO: 95086 - protein, 32 aa, Artificial Sequence
  Description of Artificial Sequence: Synthetic polypeptide
DEEEIRTTNPVATEGYGSVGNNDEMQGEGGGG

SEQ ID NO: 95087 - protein, 34 aa, Artificial Sequence
  Description of Artificial Sequence: Synthetic polypeptide
DEEEIRTTNPVATEGYGSVINMTNLVGGGGNEGG

SEQ ID NO: 95088 - protein, 32 aa, Artificial Sequence
  Description of Artificial Sequence: Synthetic polypeptide
YEQEIASTNPVATEQYGSVSADNLQDHEGNDQ

SEQ ID NO: 95089 - protein, 34 aa, Artificial Sequence
  Description of Artificial Sequence: Synthetic polypeptide
DEEEIRTTNPVATEGYGSVISTGDGDQEDENGNV

SEQ ID NO: 95090 - protein, 32 aa, Artificial Sequence
  Description of Artificial Sequence: Synthetic polypeptide
YESEIRTTNPVATECWGSVSCNEPQDREGENG

SEQ ID NO: 95091 - protein, 31 aa, Artificial Sequence
  Description of Artificial Sequence: Synthetic polypeptide
YESEIRTTNPVATECWGVVSCINEPQREGNG

SEQ ID NO: 95092 - protein, 31 aa, Artificial Sequence
  Description of Artificial Sequence: Synthetic polypeptide
YESEIRTVNPVATECWGSVSCNEPQREGENG

SEQ ID NO: 95093 - protein, 31 aa, Artificial Sequence
  Description of Artificial Sequence: Synthetic polypeptide
YESEIRTVNPVATECWGSVSCNEPQREGENQ

SEQ ID NO: 95094 - protein, 30 aa, Artificial Sequence
  Description of Artificial Sequence: Synthetic polypeptide
YESEIRTVNPVATECWGVVSDINLPQSGNQ

SEQ ID NO: 95095 - protein, 31 aa, Artificial Sequence
  Description of Artificial Sequence: Synthetic polypeptide
YESEIRTVNPVATECYGVVSCNLPQSEGENQ

SEQ ID NO: 95096 - protein, 29 aa, Artificial Sequence
  Description of Artificial Sequence: Synthetic peptide
YESEVASTNPVCTEQYGVVAADNLQSGNR

SEQ ID NO: 95097 - protein, 29 aa, Artificial Sequence
  Description of Artificial Sequence: Synthetic peptide
YESEVASTNPVCTEQYGVVSADNLQSGNQ

SEQ ID NO: 95098 - protein, 33 aa, Artificial Sequence
  Description of Artificial Sequence: Synthetic polypeptide
DEEEIRTTNPVATEGYGSVSTMNNMTTGIGGEI

SEQ ID NO: 95099 - protein, 28 aa, Artificial Sequence
  Description of Artificial Sequence: Synthetic peptide
YESKIASVNPVCTEQYGVVSDNLQSGNQ

SEQ ID NO: 95100 - protein, 32 aa, Artificial Sequence
  Description of Artificial Sequence: Synthetic polypeptide
YESEIRTTNPVATECWGSVSCINEPQDRGENG

SEQ ID NO: 95101 - protein, 33 aa, Artificial Sequence
  Description of Artificial Sequence: Synthetic polypeptide
YEPEIGTTNPVATSEYGSIVSTNDINQRSGENR

SEQ ID NO: 95102 - protein, 28 aa, Artificial Sequence
  Description of Artificial Sequence: Synthetic peptide
YENELASVNPVCTEQYGVVSDNLQSGNQ

SEQ ID NO: 95103 - protein, 29 aa, Artificial Sequence
  Description of Artificial Sequence: Synthetic peptide
YENEIRTTNPVSTEQYGVISDDIQQQGNH

SEQ ID NO: 95104 - protein, 33 aa, Artificial Sequence
  Description of Artificial Sequence: Synthetic polypeptide
YEELIKTTNPVAWEQYGSVSWTENLERQGHSRF

SEQ ID NO: 95105 - protein, 33 aa, Artificial Sequence
  Description of Artificial Sequence: Synthetic polypeptide
DEEEIRTTNPVATEGYGICVCSTVNLQESISEQ

SEQ ID NO: 95106 - protein, 28 aa, Artificial Sequence
  Description of Artificial Sequence: Synthetic peptide
YEENIASVNPVCTEQYGVISDNLQSGNQ

SEQ ID NO: 95107 - protein, 28 aa, Artificial Sequence
  Description of Artificial Sequence: Synthetic peptide
YEEPIASVNPVCTEQYGVVSDNLQSGWQ

SEQ ID NO: 95108 - protein, 32 aa, Artificial Sequence
  Description of Artificial Sequence: Synthetic polypeptide
YEEPIQTTNPVATEQYGSVTSTNPFVRNDNQG

SEQ ID NO: 95109 - protein, 33 aa, Artificial Sequence
  Description of Artificial Sequence: Synthetic polypeptide
DEEEIRTTNPVATEGYGICVSTVNLQENISQQA

SEQ ID NO: 95110 - protein, 32 aa, Artificial Sequence
  Description of Artificial Sequence: Synthetic polypeptide
YEEPIRTTNPVATEQYGCVSVNVPNVWRSGER

SEQ ID NO: 95111 - protein, 32 aa, Artificial Sequence
  Description of Artificial Sequence: Synthetic polypeptide
YEEPIRTTNPVATEQYGCVSVPGLNTWRSGER

SEQ ID NO: 95112 - protein, 28 aa, Artificial Sequence
  Description of Artificial Sequence: Synthetic peptide
YEEQIASVNPSCTEQYGVVSDNLQSGNQ

SEQ ID NO: 95113 - protein, 35 aa, Artificial Sequence
  Description of Artificial Sequence: Synthetic polypeptide
YEESIRTTNPVATEQYGSHGSPTDNLVQNPGNEVR

SEQ ID NO: 95114 - protein, 28 aa, Artificial Sequence
  Description of Artificial Sequence: Synthetic peptide
YEETIASVNPVCTEQYGVVSDNLQSGGQ

SEQ ID NO: 95115 - protein, 35 aa, Artificial Sequence
  Description of Artificial Sequence: Synthetic polypeptide
DEEEIRTTNPVATEMYGSTVSQNAFSQNRLGDNQA

SEQ ID NO: 95116 - protein, 28 aa, Artificial Sequence
  Description of Artificial Sequence: Synthetic peptide
YEETIASVNPVCTEQYGVVSDNLQSYNQ

SEQ ID NO: 95117 - protein, 33 aa, Artificial Sequence
  Description of Artificial Sequence: Synthetic polypeptide
YEETICTTNPVATEQYGSVSIMGNDGQERGNSD

SEQ ID NO: 95118 - protein, 32 aa, Artificial Sequence
  Description of Artificial Sequence: Synthetic polypeptide
DEEEIRTTNPVATEMWGNTTTSNNELQGNGNA

SEQ ID NO: 95119 - protein, 32 aa, Artificial Sequence
  Description of Artificial Sequence: Synthetic polypeptide
YEETICTTNPVATEQYGSVSIMNDGQEDGENE

SEQ ID NO: 95120 - protein, 32 aa, Artificial Sequence
  Description of Artificial Sequence: Synthetic polypeptide
YEETICTTNPVATEQYGSVSIMNGSGQGGNNS

SEQ ID NO: 95121 - protein, 28 aa, Artificial Sequence
  Description of Artificial Sequence: Synthetic peptide
YEEVIASVNPSCTEQYGVVSDNLQSGNQ

SEQ ID NO: 95122 - protein, 29 aa, Artificial Sequence
  Description of Artificial Sequence: Synthetic peptide
YEEVIASVNPVCTEQYGVVSDNSLQSGNQ

SEQ ID NO: 95123 - protein, 33 aa, Artificial Sequence
  Description of Artificial Sequence: Synthetic polypeptide
YEEVIKTTNPVASEQYWGSVSTNQQARAGANAS

SEQ ID NO: 95124 - protein, 35 aa, Artificial Sequence
  Description of Artificial Sequence: Synthetic polypeptide
YEEVIRTTNPVATEQYGSSTSYTMNPLSQQEGNSR

SEQ ID NO: 95125 - protein, 34 aa, Artificial Sequence
  Description of Artificial Sequence: Synthetic polypeptide
DEEEIRTTNPVATEGYGICVCSTVNDDQERISNQ

SEQ ID NO: 95126 - protein, 35 aa, Artificial Sequence
  Description of Artificial Sequence: Synthetic polypeptide
DEEEIRTTNPVATEMYGSVYSTECIMQKTLGNNRH

SEQ ID NO: 95127 - protein, 35 aa, Artificial Sequence
  Description of Artificial Sequence: Synthetic polypeptide
DEEEIRTTNPVATEMYGSVYSTNCIMQKTLGVNND

SEQ ID NO: 95128 - protein, 34 aa, Artificial Sequence
  Description of Artificial Sequence: Synthetic polypeptide
DEEEIRTTNPVATEMYGSVYSTNCIMQKTLLNNQ

SEQ ID NO: 95129 - protein, 32 aa, Artificial Sequence
  Description of Artificial Sequence: Synthetic polypeptide
DEEEIRTTNPVATEPWGTIACTINELSQRVNN

SEQ ID NO: 95130 - protein, 31 aa, Artificial Sequence
  Description of Artificial Sequence: Synthetic polypeptide
YEEETQTTNPVATEQWGSVSTNPFVRNDNQG

SEQ ID NO: 95131 - protein, 31 aa, Artificial Sequence
  Description of Artificial Sequence: Synthetic polypeptide
DEEEIRTTNPVATEGYGCVCSWEHQNFGSEQ

SEQ ID NO: 95132 - protein, 28 aa, Artificial Sequence
  Description of Artificial Sequence: Synthetic peptide
YEEEVASVNPVCTEQYGVVSDNLQSGRQ

SEQ ID NO: 95133 - protein, 29 aa, Artificial Sequence
  Description of Artificial Sequence: Synthetic peptide
YEEEVASVNPVCTEQYGVVSVDNLQSGNQ

SEQ ID NO: 95134 - protein, 33 aa, Artificial Sequence
  Description of Artificial Sequence: Synthetic polypeptide
DEEEIRTTNPVATEPWGISVRTVNHQDDIKNRQ

SEQ ID NO: 95135 - protein, 32 aa, Artificial Sequence
  Description of Artificial Sequence: Synthetic polypeptide
DEEEIRTTNPVATEGYGCYCSTNEQRFFSDFA

SEQ ID NO: 95136 - protein, 34 aa, Artificial Sequence
  Description of Artificial Sequence: Synthetic polypeptide
DEEEIRTTNPVATEPWGESVRTWNDDQDRQEKNR

SEQ ID NO: 95137 - protein, 33 aa, Artificial Sequence
  Description of Artificial Sequence: Synthetic polypeptide
DEEEIRTTNPVATEGYGDVVSGDLNGEGQGGNT

SEQ ID NO: 95138 - protein, 28 aa, Artificial Sequence
  Description of Artificial Sequence: Synthetic peptide
YEEGIASVNPVCSEQYGVVSDNLQSGNQ

SEQ ID NO: 95139 - protein, 34 aa, Artificial Sequence
  Description of Artificial Sequence: Synthetic polypeptide
YEFEIRTTNPVATESYGSHGSTDNLVQNPGNEVR

SEQ ID NO: 95140 - protein, 29 aa, Artificial Sequence
  Description of Artificial Sequence: Synthetic peptide
YEEGIASVNPVCTEQYGVVSDNLQSPGNQ

SEQ ID NO: 95141 - protein, 29 aa, Artificial Sequence
  Description of Artificial Sequence: Synthetic peptide
ADNEIASTNPVATEQYGEVAENIQRVGGR

SEQ ID NO: 95142 - protein, 33 aa, Artificial Sequence
  Description of Artificial Sequence: Synthetic polypeptide
DEEEIRTTNPVATEGYGICVCSSVNLQENISNQ

SEQ ID NO: 95143 - protein, 28 aa, Artificial Sequence
  Description of Artificial Sequence: Synthetic peptide
ADNEIASTNPVATEQYGEAAENIQRGGR

SEQ ID NO: 95144 - protein, 28 aa, Artificial Sequence
  Description of Artificial Sequence: Synthetic peptide
ADNEIASTNPVATEGYGNVAETLQRGGR

SEQ ID NO: 95145 - protein, 28 aa, Artificial Sequence
  Description of Artificial Sequence: Synthetic peptide
ADNEIACTNPVATEQYGEAAENIQRGGR

SEQ ID NO: 95146 - protein, 32 aa, Artificial Sequence
  Description of Artificial Sequence: Synthetic polypeptide
YEEGICTTNPVATEQYGSVSMNVIAMRGVNDS

SEQ ID NO: 95147 - protein, 29 aa, Artificial Sequence
  Description of Artificial Sequence: Synthetic peptide
ADNEIACTNPVATEGYGEVSETLQSRGGR

SEQ ID NO: 95148 - protein, 29 aa, Artificial Sequence
  Description of Artificial Sequence: Synthetic peptide
ADNEIACTNPVATEGYGEVSAENIQRGGR

SEQ ID NO: 95149 - protein, 28 aa, Artificial Sequence
  Description of Artificial Sequence: Synthetic peptide
YEEHIASVNPVCTEQYGVVSDNLQSGWQ

SEQ ID NO: 95150 - protein, 33 aa, Artificial Sequence
  Description of Artificial Sequence: Synthetic polypeptide
YEEHIRTTNPVATEQYGSAVINHTEGLQEGNGV

SEQ ID NO: 95151 - protein, 29 aa, Artificial Sequence
  Description of Artificial Sequence: Synthetic peptide
ADNEIASTNPVATEQYGEVANNIQRVGGR

SEQ ID NO: 95152 - protein, 33 aa, Artificial Sequence
  Description of Artificial Sequence: Synthetic polypeptide
DEEEIRTTNPVATEGYGCVCSTTELQGFGSEDS

SEQ ID NO: 95153 - protein, 28 aa, Artificial Sequence
  Description of Artificial Sequence: Synthetic peptide
YEGEIAPTNPCSSEQYGIVSCNLQSGTR

SEQ ID NO: 95154 - protein, 28 aa, Artificial Sequence
  Description of Artificial Sequence: Synthetic peptide
YEGEIAPTNPVCSEQYGIVSCNLQSGTQ

SEQ ID NO: 95155 - protein, 33 aa, Artificial Sequence
  Description of Artificial Sequence: Synthetic polypeptide
DEEEIRTTNPVATEIYGCVCSTEHQNFGSNTQE

SEQ ID NO: 95156 - protein, 28 aa, Artificial Sequence
  Description of Artificial Sequence: Synthetic peptide
YENEIASVNPVATEQYGVVSDNLQSEDQ

SEQ ID NO: 95157 - protein, 28 aa, Artificial Sequence
  Description of Artificial Sequence: Synthetic peptide
YENEIASVNPVCTEQYGEASDNLQSGNQ

SEQ ID NO: 95158 - protein, 28 aa, Artificial Sequence
  Description of Artificial Sequence: Synthetic peptide
YENEIASVNPVCTEQYGVVSDKLQSGNQ

SEQ ID NO: 95159 - protein, 28 aa, Artificial Sequence
  Description of Artificial Sequence: Synthetic peptide
YENEIASVNPVCTEQYGVVSDNGQSGNQ

SEQ ID NO: 95160 - protein, 29 aa, Artificial Sequence
  Description of Artificial Sequence: Synthetic peptide
YENEIASVNPVCTEQYGVVSDNLQSAGNQ

SEQ ID NO: 95161 - protein, 33 aa, Artificial Sequence
  Description of Artificial Sequence: Synthetic polypeptide
DEEEIRTTNPVATEHYGTVVSYTGEESGVGGNR

SEQ ID NO: 95162 - protein, 28 aa, Artificial Sequence
  Description of Artificial Sequence: Synthetic peptide
YENEIASVNPVCTEQYGVVSDNLQSGDQ

SEQ ID NO: 95163 - protein, 28 aa, Artificial Sequence
  Description of Artificial Sequence: Synthetic peptide
YENEIASVNPVCTEQYGVVSDNRQSGNQ

SEQ ID NO: 95164 - protein, 30 aa, Artificial Sequence
  Description of Artificial Sequence: Synthetic polypeptide
YENEIATTNPVATEQWGDVSEILQNAAGNQ

SEQ ID NO: 95165 - protein, 29 aa, Artificial Sequence
  Description of Artificial Sequence: Synthetic peptide
YENEIATTNPVATEQYGVVSEILMNAENA

SEQ ID NO: 95166 - protein, 29 aa, Artificial Sequence
  Description of Artificial Sequence: Synthetic peptide
YENEIATTNPVATEQYGVVSEILMNAENQ

SEQ ID NO: 95167 - protein, 28 aa, Artificial Sequence
  Description of Artificial Sequence: Synthetic peptide
YENEIATVNPVATECYGDVSECLQSGEQ

SEQ ID NO: 95168 - protein, 28 aa, Artificial Sequence
  Description of Artificial Sequence: Synthetic peptide
YENEIATVNPVATECYGVVSECLQSGEQ

SEQ ID NO: 95169 - protein, 28 aa, Artificial Sequence
  Description of Artificial Sequence: Synthetic peptide
YENEIATVNPVATEQYGDVSDCLQHEEQ

SEQ ID NO: 95170 - protein, 28 aa, Artificial Sequence
  Description of Artificial Sequence: Synthetic peptide
YENEIATVNPVCTECYGVVSENLQSGEQ

SEQ ID NO: 95171 - protein, 28 aa, Artificial Sequence
  Description of Artificial Sequence: Synthetic peptide
YENEIATVNPVCTEQYGVVSDIEQSGNQ

SEQ ID NO: 95172 - protein, 29 aa, Artificial Sequence
  Description of Artificial Sequence: Synthetic peptide
YENEIRTTNPVATEQWGDVSEIEQAAENA

SEQ ID NO: 95173 - protein, 33 aa, Artificial Sequence
  Description of Artificial Sequence: Synthetic polypeptide
YENEIRTTNPVATEQWGSVSDYGNHQDRGTSRH

SEQ ID NO: 95174 - protein, 34 aa, Artificial Sequence
  Description of Artificial Sequence: Synthetic polypeptide
DEEEIRTTNPVATEHYGSVSTGNEISQMPGGMSS

SEQ ID NO: 95175 - protein, 34 aa, Artificial Sequence
  Description of Artificial Sequence: Synthetic polypeptide
YENEIRTTNPVATEQYGVSVCSTTDLQCRNHGGH

SEQ ID NO: 95176 - protein, 28 aa, Artificial Sequence
  Description of Artificial Sequence: Synthetic peptide
YENEIASVNPVATEQYGVASDNLQSGGQ

SEQ ID NO: 95177 - protein, 29 aa, Artificial Sequence
  Description of Artificial Sequence: Synthetic peptide
YENEIASTNPVSTEQYGVVSDENIQQGNH

SEQ ID NO: 95178 - protein, 28 aa, Artificial Sequence
  Description of Artificial Sequence: Synthetic peptide
YENEIACVNPVATEQYGVASDNLQSGGQ

SEQ ID NO: 95179 - protein, 31 aa, Artificial Sequence
  Description of Artificial Sequence: Synthetic polypeptide
YEMEIATTNPVATEQYGTVSATDGLESEGNQ

SEQ ID NO: 95180 - protein, 33 aa, Artificial Sequence
  Description of Artificial Sequence: Synthetic polypeptide
DEEEIRTTNPVATEGYGMVDTGNIGQEGGEGNE

SEQ ID NO: 95181 - protein, 33 aa, Artificial Sequence
  Description of Artificial Sequence: Synthetic polypeptide
DEEEIRTTNPVATEGYGMVGSTGNGQTGGEGGQ

SEQ ID NO: 95182 - protein, 28 aa, Artificial Sequence
  Description of Artificial Sequence: Synthetic peptide
YEGEIASTNPCCSEQYGVVSDNLQSGNQ

SEQ ID NO: 95183 - protein, 28 aa, Artificial Sequence
  Description of Artificial Sequence: Synthetic peptide
YEGEIASTNPCSSEQYGIVSCNLQSGTR

SEQ ID NO: 95184 - protein, 28 aa, Artificial Sequence
  Description of Artificial Sequence: Synthetic peptide
YEGEIASTNPCSSEQYGVVSCNLQSGTR

SEQ ID NO: 95185 - protein, 28 aa, Artificial Sequence
  Description of Artificial Sequence: Synthetic peptide
YEGEIASTNPCSSEQYGVVSDNLQSGTR

SEQ ID NO: 95186 - protein, 28 aa, Artificial Sequence
  Description of Artificial Sequence: Synthetic peptide
YEGEIASTNPVSSEQYGVVSDNLQSGTQ

SEQ ID NO: 95187 - protein, 28 aa, Artificial Sequence
  Description of Artificial Sequence: Synthetic peptide
YEGEIASVNPCCTEQYGVVSDNLQSGNQ

SEQ ID NO: 95188 - protein, 28 aa, Artificial Sequence
  Description of Artificial Sequence: Synthetic peptide
YEGEIASVNPCSTEQYGVVSDNLQSGTR

SEQ ID NO: 95189 - protein, 28 aa, Artificial Sequence
  Description of Artificial Sequence: Synthetic peptide
YEGEIASVNPVCSEQYGVVSDNLQSGNQ

SEQ ID NO: 95190 - protein, 28 aa, Artificial Sequence
  Description of Artificial Sequence: Synthetic peptide
YEGEIAPTNPCSSEQYGVVSDNLQSGTR

SEQ ID NO: 95191 - protein, 28 aa, Artificial Sequence
  Description of Artificial Sequence: Synthetic peptide
YEGEIASVNPVCTEQYGVVSCNLQSGTQ

SEQ ID NO: 95192 - protein, 28 aa, Artificial Sequence
  Description of Artificial Sequence: Synthetic peptide
YEGEIASVNPVSTEQYGVVSCNLQSGTQ

SEQ ID NO: 95193 - protein, 28 aa, Artificial Sequence
  Description of Artificial Sequence: Synthetic peptide
YEGEIASVNPVSTEQYGVVSDNLQSGTQ

SEQ ID NO: 95194 - protein, 28 aa, Artificial Sequence
  Description of Artificial Sequence: Synthetic peptide
YEHEIASVNPVCTEMYGVVSDNLQSGNQ

SEQ ID NO: 95195 - protein, 28 aa, Artificial Sequence
  Description of Artificial Sequence: Synthetic peptide
YEHEIASVNPVCTEPYGVVSDNLQSGNQ

SEQ ID NO: 95196 - protein, 28 aa, Artificial Sequence
  Description of Artificial Sequence: Synthetic peptide
YEKEIASVNPVCTEMYGVVSDNLQSGNQ

SEQ ID NO: 95197 - protein, 33 aa, Artificial Sequence
  Description of Artificial Sequence: Synthetic polypeptide
YELEINTTNPVAFEQYGSVSTTENLERQGHSRL

SEQ ID NO: 95198 - protein, 28 aa, Artificial Sequence
  Description of Artificial Sequence: Synthetic peptide
YEMEIASTNPVCTEQYGTVSDNPESGNQ

SEQ ID NO: 95199 - protein, 30 aa, Artificial Sequence
  Description of Artificial Sequence: Synthetic polypeptide
YEMEIASTNPVCTEQYGVVSADDNLQSGNQ

SEQ ID NO: 95200 - protein, 29 aa, Artificial Sequence
  Description of Artificial Sequence: Synthetic peptide
YEMEIASVNPVCTEQYGVVSADNLQSGNQ

SEQ ID NO: 95201 - protein, 31 aa, Artificial Sequence
  Description of Artificial Sequence: Synthetic polypeptide
YEMEIATTNPVATEQYGTVSATDGLESEGND

SEQ ID NO: 95202 - protein, 28 aa, Artificial Sequence
  Description of Artificial Sequence: Synthetic peptide
YEGEIASVNPVCTEQYGVVSDNLQSDNQ

SEQ ID NO: 95203 - protein, 33 aa, Artificial Sequence
  Description of Artificial Sequence: Synthetic polypeptide
YEEEICTTNPVAFERYGSVSTTENLERQGHSRL

SEQ ID NO: 95204 - protein, 34 aa, Artificial Sequence
  Description of Artificial Sequence: Synthetic polypeptide
DEEEIRTTNPVATEFYGATVMTENGLGQDIGNNG

SEQ ID NO: 95205 - protein, 33 aa, Artificial Sequence
  Description of Artificial Sequence: Synthetic polypeptide
DEEEIRTTNPVATEEYGWVSVIEGHNPIHGNPR

SEQ ID NO: 95206 - protein, 28 aa, Artificial Sequence
  Description of Artificial Sequence: Synthetic peptide
YEEEIASVNPVCTEQYGVVASNLQSGDI

SEQ ID NO: 95207 - protein, 30 aa, Artificial Sequence
  Description of Artificial Sequence: Synthetic polypeptide
DEEEIRTTNPVATEQWGVYSFMETDSHSNR

SEQ ID NO: 95208 - protein, 34 aa, Artificial Sequence
  Description of Artificial Sequence: Synthetic polypeptide
DEEEIRTTNPVATEQWGVVVVSTTNQLQEDTGGV

SEQ ID NO: 95209 - protein, 34 aa, Artificial Sequence
  Description of Artificial Sequence: Synthetic polypeptide
DEEEIRTTNPVATEQWGVVVVSTTNLLQSTTGGT

SEQ ID NO: 95210 - protein, 34 aa, Artificial Sequence
  Description of Artificial Sequence: Synthetic polypeptide
DEEEIRTTNPVATEQWGVVTVSVTNLQQSTTGGN

SEQ ID NO: 95211 - protein, 34 aa, Artificial Sequence
  Description of Artificial Sequence: Synthetic polypeptide
DEEEIRTTNPVATEQWGVVTVSTTNQLQEDEGGD

SEQ ID NO: 95212 - protein, 34 aa, Artificial Sequence
  Description of Artificial Sequence: Synthetic polypeptide
DEEEIRTTNPVATEQWGVVTVSNTNLLQSTTGGE

SEQ ID NO: 95213 - protein, 30 aa, Artificial Sequence
  Description of Artificial Sequence: Synthetic polypeptide
DEEEIRTTNPVATEQWGVVSDILMNAAEDA

SEQ ID NO: 95214 - protein, 34 aa, Artificial Sequence
  Description of Artificial Sequence: Synthetic polypeptide
DEEEIRTTNPVATEQWGVSNVSNTNYLGSTPGGF

SEQ ID NO: 95215 - protein, 29 aa, Artificial Sequence
  Description of Artificial Sequence: Synthetic peptide
YEEEIASVNPVCTEQYGVVCSDNLQSGTQ

SEQ ID NO: 95216 - protein, 33 aa, Artificial Sequence
  Description of Artificial Sequence: Synthetic polypeptide
DEEEIRTTNPVATEQWGTVVVTTTELQLQGTNS

SEQ ID NO: 95217 - protein, 32 aa, Artificial Sequence
  Description of Artificial Sequence: Synthetic polypeptide
DEEEIRTTNPVATEQWGTVVVTTTELLQGNNS

SEQ ID NO: 95218 - protein, 30 aa, Artificial Sequence
  Description of Artificial Sequence: Synthetic polypeptide
YEEEIASVNPVCTEQYGVVFSADNLQSGNQ

SEQ ID NO: 95219 - protein, 29 aa, Artificial Sequence
  Description of Artificial Sequence: Synthetic peptide
YEEEIASVNPVCTEQYGVVFSDNLQSGKQ

SEQ ID NO: 95220 - protein, 30 aa, Artificial Sequence
  Description of Artificial Sequence: Synthetic polypeptide
YEEEIASVNPVCTEQYGVVHSDNLQSGQNQ

SEQ ID NO: 95221 - protein, 30 aa, Artificial Sequence
  Description of Artificial Sequence: Synthetic polypeptide
YEEEIASVNPVCTEQYGVVSADDNLQSGNQ

SEQ ID NO: 95222 - protein, 29 aa, Artificial Sequence
  Description of Artificial Sequence: Synthetic peptide
YEEEIASVNPVCTEQYGVVSADGLQSGNQ

SEQ ID NO: 95223 - protein, 29 aa, Artificial Sequence
  Description of Artificial Sequence: Synthetic peptide
YEEEIASVNPVCTEQYGVVSADNLQHGEQ

SEQ ID NO: 95224 - protein, 30 aa, Artificial Sequence
  Description of Artificial Sequence: Synthetic polypeptide
YEEEIASVNPVCTEQYGVVSADNLQHGNDQ

SEQ ID NO: 95225 - protein, 30 aa, Artificial Sequence
  Description of Artificial Sequence: Synthetic polypeptide
YEEEIASVNPVCTEQYGVVSADNLQSGNDQ

SEQ ID NO: 95226 - protein, 34 aa, Artificial Sequence
  Description of Artificial Sequence: Synthetic polypeptide
DEEEIRTTNPVATEQWGTVVSCINMDSQGGTNRC

SEQ ID NO: 95227 - protein, 30 aa, Artificial Sequence
  Description of Artificial Sequence: Synthetic polypeptide
YEEEIASVNPVCTEQYGVVASDENLQSGNQ

SEQ ID NO: 95228 - protein, 35 aa, Artificial Sequence
  Description of Artificial Sequence: Synthetic polypeptide
DEEEIRTTNPVATEQWGTVTSCGFNELSQGTEGNR

SEQ ID NO: 95229 - protein, 29 aa, Artificial Sequence
  Description of Artificial Sequence: Synthetic peptide
YEEEIASVNPVCTEQYGVVALNLQSGNTQ

SEQ ID NO: 95230 - protein, 28 aa, Artificial Sequence
  Description of Artificial Sequence: Synthetic peptide
YEEEIASVNPVCTEQYGVVADNLQSGQQ

SEQ ID NO: 95231 - protein, 28 aa, Artificial Sequence
  Description of Artificial Sequence: Synthetic peptide
YEEEIASVNPVCTEQYGEVSDVLQHENQ

SEQ ID NO: 95232 - protein, 28 aa, Artificial Sequence
  Description of Artificial Sequence: Synthetic peptide
YEEEIASVNPVCTEQYGEVSENCQSENQ

SEQ ID NO: 95233 - protein, 28 aa, Artificial Sequence
  Description of Artificial Sequence: Synthetic peptide
YEEEIASVNPVCTEQYGEVSEVLQSENK

SEQ ID NO: 95234 - protein, 28 aa, Artificial Sequence
  Description of Artificial Sequence: Synthetic peptide
YEEEIASVNPVCTEQYGEVSEVLQSGEQ

SEQ ID NO: 95235 - protein, 29 aa, Artificial Sequence
  Description of Artificial Sequence: Synthetic peptide
YEEEIASVNPVCTEQYGEVSFDNLQSGSQ

SEQ ID NO: 95236 - protein, 29 aa, Artificial Sequence
  Description of Artificial Sequence: Synthetic peptide
YEEEIASVNPVCTEQYGEVVSDNDQSGNQ

SEQ ID NO: 95237 - protein, 30 aa, Artificial Sequence
  Description of Artificial Sequence: Synthetic polypeptide
YEEEIASVNPVCTEQYGSVSDPNGQSNGNQ

SEQ ID NO: 95238 - protein, 30 aa, Artificial Sequence
  Description of Artificial Sequence: Synthetic polypeptide
YEEEIASVNPVCTEQYGSVSDPNGQSNGNV

SEQ ID NO: 95239 - protein, 31 aa, Artificial Sequence
  Description of Artificial Sequence: Synthetic polypeptide
YEEEIASVNPVCTEQYGSVSTTNGQMSGMNV

SEQ ID NO: 95240 - protein, 29 aa, Artificial Sequence
  Description of Artificial Sequence: Synthetic peptide
YEEEIASVNPVCTEQYGTVSADNPQSGND

SEQ ID NO: 95241 - protein, 30 aa, Artificial Sequence
  Description of Artificial Sequence: Synthetic polypeptide
YEEEIASVNPVCTEQYGTVSATNLVESGNQ

SEQ ID NO: 95242 - protein, 35 aa, Artificial Sequence
  Description of Artificial Sequence: Synthetic polypeptide
DEEEIRTTNPVATEQWGYSNVSPTNNLQHVPGGQF

SEQ ID NO: 95243 - protein, 29 aa, Artificial Sequence
  Description of Artificial Sequence: Synthetic peptide
YEEEIASVNPVCTEQYGTVSDGLQSEGND

SEQ ID NO: 95244 - protein, 36 aa, Artificial Sequence
  Description of Artificial Sequence: Synthetic polypeptide
DEEEIRTTNPVATEQWGYSNVSATNGLQHQRPGVFA

SEQ ID NO: 95245 - protein, 36 aa, Artificial Sequence
  Description of Artificial Sequence: Synthetic polypeptide
DEEEIRTTNPVATEQWGYSNVSATNELQHRPMQGIL

SEQ ID NO: 95246 - protein, 36 aa, Artificial Sequence
  Description of Artificial Sequence: Synthetic polypeptide
DEEEIRTTNPVATEQWGYSNVSATNELQHRPGQGGN

SEQ ID NO: 95247 - protein, 29 aa, Artificial Sequence
  Description of Artificial Sequence: Synthetic peptide
YEEEIASVNPVCTEQYGTVSDNSLESGNQ

SEQ ID NO: 95248 - protein, 28 aa, Artificial Sequence
  Description of Artificial Sequence: Synthetic peptide
YEEEIASVNPVCTEQYGVCSDNLQSKNQ

SEQ ID NO: 95249 - protein, 28 aa, Artificial Sequence
  Description of Artificial Sequence: Synthetic peptide
YEEEIASVNPVCTEQYGVISDNFQSGNQ

SEQ ID NO: 95250 - protein, 29 aa, Artificial Sequence
  Description of Artificial Sequence: Synthetic peptide
YEEEIASVNPVCTEQYGVVADNIQSRGQR

SEQ ID NO: 95251 - protein, 28 aa, Artificial Sequence
  Description of Artificial Sequence: Synthetic peptide
YEEEIASVNPVCTEQYGVVADNLQSGPQ

SEQ ID NO: 95252 - protein, 28 aa, Artificial Sequence
  Description of Artificial Sequence: Synthetic peptide
YEEEIASVNPVCTEQYGVVADTLQSGNQ

SEQ ID NO: 95253 - protein, 30 aa, Artificial Sequence
  Description of Artificial Sequence: Synthetic polypeptide
YEEEIASVNPVCTEQYGVVSADNLQSVGNQ

SEQ ID NO: 95254 - protein, 30 aa, Artificial Sequence
  Description of Artificial Sequence: Synthetic polypeptide
YEEEIASVNPVCTEQYGVVSADNLVQFGNQ

SEQ ID NO: 95255 - protein, 30 aa, Artificial Sequence
  Description of Artificial Sequence: Synthetic polypeptide
YEEEIASVNPVCTEQYGVVSADTLQSVGNR

SEQ ID NO: 95256 - protein, 28 aa, Artificial Sequence
  Description of Artificial Sequence: Synthetic peptide
YEEEIASVNPVCTEQYGVVSDNGQSGEQ

SEQ ID NO: 95257 - protein, 28 aa, Artificial Sequence
  Description of Artificial Sequence: Synthetic peptide
YEEEIASVNPVCTEQYGVVSDNIQSQNM

SEQ ID NO: 95258 - protein, 28 aa, Artificial Sequence
  Description of Artificial Sequence: Synthetic peptide
YEEEIASVNPVCTEQYGVVSDNKQSDNQ

SEQ ID NO: 95259 - protein, 28 aa, Artificial Sequence
  Description of Artificial Sequence: Synthetic peptide
YEEEIASVNPVCTEQYGVVSDNLDSGSQ

SEQ ID NO: 95260 - protein, 30 aa, Artificial Sequence
  Description of Artificial Sequence: Synthetic polypeptide
YEEEIASVNPVCTEQYGVVSDNLIQSGNTQ

SEQ ID NO: 95261 - protein, 29 aa, Artificial Sequence
  Description of Artificial Sequence: Synthetic peptide
YEEEIASVNPVCTEQYGVVSDNLNSGKNQ

SEQ ID NO: 95262 - protein, 31 aa, Artificial Sequence
  Description of Artificial Sequence: Synthetic polypeptide
AEDEICATNPVATEQYGVVAVSETNLQLGGD

SEQ ID NO: 95263 - protein, 33 aa, Artificial Sequence
  Description of Artificial Sequence: Synthetic polypeptide
DEEEIRTTNPVATEAYGVVVVTVNLQDQNQNDT

SEQ ID NO: 95264 - protein, 30 aa, Artificial Sequence
  Description of Artificial Sequence: Synthetic polypeptide
YEEEIASVNPVCTEQYGVVSDNLQSDGNSQ

SEQ ID NO: 95265 - protein, 34 aa, Artificial Sequence
  Description of Artificial Sequence: Synthetic polypeptide
DEEEIRTTNPVATEQWGSVSTTPAEPNMRAGNPV

SEQ ID NO: 95266 - protein, 33 aa, Artificial Sequence
  Description of Artificial Sequence: Synthetic polypeptide
DEEEIRTTNPVATEQWGSVSTTPAENMRAGDPV

SEQ ID NO: 95267 - protein, 32 aa, Artificial Sequence
  Description of Artificial Sequence: Synthetic polypeptide
DEEEIRTTNPVATEQWGSVSTTAEMMANEMNA

SEQ ID NO: 95268 - protein, 28 aa, Artificial Sequence
  Description of Artificial Sequence: Synthetic peptide
YEEEIASVNPVCTEQYGVVSDNLQSEEQ

SEQ ID NO: 95269 - protein, 32 aa, Artificial Sequence
  Description of Artificial Sequence: Synthetic polypeptide
DEEEIRTTNPVATECWGKHSTNDEQDRRENDH

SEQ ID NO: 95270 - protein, 31 aa, Artificial Sequence
  Description of Artificial Sequence: Synthetic polypeptide
DEEEIRTTNPVATECWGKHSTNEGQDHRNDF

SEQ ID NO: 95271 - protein, 35 aa, Artificial Sequence
  Description of Artificial Sequence: Synthetic polypeptide
DEEEIRTTNPVATEQWGSVSSTTPNGPNMREGMNV

SEQ ID NO: 95272 - protein, 29 aa, Artificial Sequence
  Description of Artificial Sequence: Synthetic peptide
YEEEIASVNPVCTEQYGVVSDNLQSHNDQ

SEQ ID NO: 95273 - protein, 34 aa, Artificial Sequence
  Description of Artificial Sequence: Synthetic polypeptide
DEEEIRTTNPVATEQWGSVSSTTPIGMMRNGNPA

SEQ ID NO: 95274 - protein, 29 aa, Artificial Sequence
  Description of Artificial Sequence: Synthetic peptide
YEEEIASVNPVCTEQYGVVSDNLQSKNGQ

SEQ ID NO: 95275 - protein, 30 aa, Artificial Sequence
  Description of Artificial Sequence: Synthetic polypeptide
YEEEIASVNPVCTEQYGVVSDNLQSMGDNQ

SEQ ID NO: 95276 - protein, 29 aa, Artificial Sequence
  Description of Artificial Sequence: Synthetic peptide
YEEEIASVNPVCTEQYGVVSDNLQSNKNQ

SEQ ID NO: 95277 - protein, 28 aa, Artificial Sequence
  Description of Artificial Sequence: Synthetic peptide
YEEEIASVNPVCTEQYGVVSDNEQSVNQ

SEQ ID NO: 95278 - protein, 28 aa, Artificial Sequence
  Description of Artificial Sequence: Synthetic peptide
YEEEIASVNPVCTEQYGVVSDNEQSGDQ

SEQ ID NO: 95279 - protein, 32 aa, Artificial Sequence
  Description of Artificial Sequence: Synthetic polypeptide
DEEEIRTTNPVATEQWGTCVTSTYLLHFGSEQ

SEQ ID NO: 95280 - protein, 29 aa, Artificial Sequence
  Description of Artificial Sequence: Synthetic peptide
YEEEIASVNPVCTEQYGVVSDNCQSAGNQ

SEQ ID NO: 95281 - protein, 34 aa, Artificial Sequence
  Description of Artificial Sequence: Synthetic polypeptide
DEEEIRTTNPVATEQWGTVISCTINSLSQAVNNN

SEQ ID NO: 95282 - protein, 34 aa, Artificial Sequence
  Description of Artificial Sequence: Synthetic polypeptide
DEEEIRTTNPVATEQWGTVISCTINPFSQRVNNN

SEQ ID NO: 95283 - protein, 29 aa, Artificial Sequence
  Description of Artificial Sequence: Synthetic peptide
YEEEIASVNPVCTEQYGVVSCDHLQSGNQ

SEQ ID NO: 95284 - protein, 30 aa, Artificial Sequence
  Description of Artificial Sequence: Synthetic polypeptide
YEEEIASVNPVCTEQYGVVSCDNKLQSGNQ

SEQ ID NO: 95285 - protein, 30 aa, Artificial Sequence
  Description of Artificial Sequence: Synthetic polypeptide
YEEEIASVNPVCTEQYGVVSCDNLKQSGNQ

SEQ ID NO: 95286 - protein, 30 aa, Artificial Sequence
  Description of Artificial Sequence: Synthetic polypeptide
YEEEIASVNPVCTEQYGVVSCDNLQSGKNQ

SEQ ID NO: 95287 - protein, 28 aa, Artificial Sequence
  Description of Artificial Sequence: Synthetic peptide
YEEEIASVNPVCTEQYGVVSDCLQSENL

SEQ ID NO: 95288 - protein, 28 aa, Artificial Sequence
  Description of Artificial Sequence: Synthetic peptide
YEEEIASVNPVCTEQYGVVSDCLQSGEQ

SEQ ID NO: 95289 - protein, 29 aa, Artificial Sequence
  Description of Artificial Sequence: Synthetic peptide
YEEEIASVNPVCTEQYGVVSDDLQASGNQ

SEQ ID NO: 95290 - protein, 28 aa, Artificial Sequence
  Description of Artificial Sequence: Synthetic peptide
YEEEIASVNPVCTEQYGVVSDDLQSGEQ

SEQ ID NO: 95291 - protein, 28 aa, Artificial Sequence
  Description of Artificial Sequence: Synthetic peptide
YEEEIASVNPVCTEQYGEVSDVLQHENK

SEQ ID NO: 95292 - protein, 28 aa, Artificial Sequence
  Description of Artificial Sequence: Synthetic peptide
YEEEIASVNPVCTEQYGVVSDEFQSGNQ

SEQ ID NO: 95293 - protein, 28 aa, Artificial Sequence
  Description of Artificial Sequence: Synthetic peptide
YEEEIASVNPVCTEQYGVVSDEVQSGNQ

SEQ ID NO: 95294 - protein, 28 aa, Artificial Sequence
  Description of Artificial Sequence: Synthetic peptide
YEEEIASVNPVCTEQYGVVSDGKQSGNQ

SEQ ID NO: 95295 - protein, 29 aa, Artificial Sequence
  Description of Artificial Sequence: Synthetic peptide
YEEEIASVNPVCTEQYGVVSDGLQSGNTQ

SEQ ID NO: 95296 - protein, 29 aa, Artificial Sequence
  Description of Artificial Sequence: Synthetic peptide
YEEEIASVNPVCTEQYGVVSDGLVQFGND

SEQ ID NO: 95297 - protein, 29 aa, Artificial Sequence
  Description of Artificial Sequence: Synthetic peptide
YEEEIASVNPVCTEQYGVVSDGNLFSGNQ

SEQ ID NO: 95298 - protein, 29 aa, Artificial Sequence
  Description of Artificial Sequence: Synthetic peptide
YEEEIASVNPVCTEQYGVVSDGNLRSGNQ

SEQ ID NO: 95299 - protein, 29 aa, Artificial Sequence
  Description of Artificial Sequence: Synthetic peptide
YEEEIASVNPVCTEQYGVVSDGNTQSGNQ

SEQ ID NO: 95300 - protein, 28 aa, Artificial Sequence
  Description of Artificial Sequence: Synthetic peptide
YEEEIASVNPVCTEQYGVVSDILQSTNQ

SEQ ID NO: 95301 - protein, 28 aa, Artificial Sequence
  Description of Artificial Sequence: Synthetic peptide
YEEEIASVNPVCTEQYGVVSDKKQSGNQ

SEQ ID NO: 95302 - protein, 28 aa, Artificial Sequence
  Description of Artificial Sequence: Synthetic peptide
YEEEIASVNPVCTEQYGVVSDNAQSYNQ

SEQ ID NO: 95303 - protein, 28 aa, Artificial Sequence
  Description of Artificial Sequence: Synthetic peptide
YEEEIASVNPVCTEQYGVVSDELQSQNQ

SEQ ID NO: 95304 - protein, 28 aa, Artificial Sequence
  Description of Artificial Sequence: Synthetic peptide
YEEEIASVNPVCTEQYGEVPDVLQSGNQ

SEQ ID NO: 95305 - protein, 29 aa, Artificial Sequence
  Description of Artificial Sequence: Synthetic peptide
YEEEIASVNPVCTEQWGVVSDNLQSGNDQ

SEQ ID NO: 95306 - protein, 28 aa, Artificial Sequence
  Description of Artificial Sequence: Synthetic peptide
YEEEIASVNPVCTEQWGVVSDNLQSGDQ

SEQ ID NO: 95307 - protein, 32 aa, Artificial Sequence
  Description of Artificial Sequence: Synthetic polypeptide
DEEEIRTTNPVATEQYGAVFGDNEMGNQGNIG

SEQ ID NO: 95308 - protein, 32 aa, Artificial Sequence
  Description of Artificial Sequence: Synthetic polypeptide
DEEEIRTTNPVATEQYGAVFGDNDQDEGGGQG

SEQ ID NO: 95309 - protein, 32 aa, Artificial Sequence
  Description of Artificial Sequence: Synthetic polypeptide
DEEEIRTTNPVATEQYGAVFGDMEQGNQGNEN

SEQ ID NO: 95310 - protein, 31 aa, Artificial Sequence
  Description of Artificial Sequence: Synthetic polypeptide
DEEEIRTTNPVATEQYGAVFGDMEQGNQGEG

SEQ ID NO: 95311 - protein, 29 aa, Artificial Sequence
  Description of Artificial Sequence: Synthetic peptide
YEEEIASVNPTVCTEQYGVFSDNLQSGNQ

SEQ ID NO: 95312 - protein, 33 aa, Artificial Sequence
  Description of Artificial Sequence: Synthetic polypeptide
DEEEIRTTNPVATEQYGAVFGDLNGQTEQGGNA

SEQ ID NO: 95313 - protein, 32 aa, Artificial Sequence
  Description of Artificial Sequence: Synthetic polypeptide
DEEEIRTTNPVATEQYGAVFGDLEQDEEGGGQ

SEQ ID NO: 95314 - protein, 30 aa, Artificial Sequence
  Description of Artificial Sequence: Synthetic polypeptide
YEEEIASVNPVATECYGVVSDINLQSGENG

SEQ ID NO: 95315 - protein, 33 aa, Artificial Sequence
  Description of Artificial Sequence: Synthetic polypeptide
DEEEIRTTNPVATEQYGAVFGDFNGQTQNGNND

SEQ ID NO: 95316 - protein, 33 aa, Artificial Sequence
  Description of Artificial Sequence: Synthetic polypeptide
DEEEIRTTNPVATEQYGAVFGDFNGQTEQGNID

SEQ ID NO: 95317 - protein, 29 aa, Artificial Sequence
  Description of Artificial Sequence: Synthetic peptide
YEEEIASVNPVATEQWGVVSNDNLQSGPQ

SEQ ID NO: 95318 - protein, 30 aa, Artificial Sequence
  Description of Artificial Sequence: Synthetic polypeptide
YEEEIASVNPVATEQYGAVSDENLAESGNQ

SEQ ID NO: 95319 - protein, 33 aa, Artificial Sequence
  Description of Artificial Sequence: Synthetic polypeptide
DEEEIRTTNPVATEQYGAVFGDENGQTGGGNGG

SEQ ID NO: 95320 - protein, 33 aa, Artificial Sequence
  Description of Artificial Sequence: Synthetic polypeptide
DEEEIRTTNPVATEQYGAVFGDENGQTDGGNEG

SEQ ID NO: 95321 - protein, 31 aa, Artificial Sequence
  Description of Artificial Sequence: Synthetic polypeptide
YEEEIASVNPVATEQYGAVSDENLQSKGNYQ

SEQ ID NO: 95322 - protein, 34 aa, Artificial Sequence
  Description of Artificial Sequence: Synthetic polypeptide
DEEEIRTTNPVATEQYGAVDTDTDNNEQGEGNTN

SEQ ID NO: 95323 - protein, 31 aa, Artificial Sequence
  Description of Artificial Sequence: Synthetic polypeptide
YEEEIASVNPVATEQYGSVSADNLQDSGEDL

SEQ ID NO: 95324 - protein, 34 aa, Artificial Sequence
  Description of Artificial Sequence: Synthetic polypeptide
DEEEIRTTNPVATEQYGAVDSTGNNGQGEGETGE

SEQ ID NO: 95325 - protein, 28 aa, Artificial Sequence
  Description of Artificial Sequence: Synthetic peptide
YEEEIASVNPVATEQYGVVPDVLQSENK

SEQ ID NO: 95326 - protein, 28 aa, Artificial Sequence
  Description of Artificial Sequence: Synthetic peptide
YEEEIASVNPVATEQYGVVPDVLQSENQ

SEQ ID NO: 95327 - protein, 31 aa, Artificial Sequence
  Description of Artificial Sequence: Synthetic polypeptide
YEEEIASVNPVATEQYGVVSADNLQDSEGNQ

SEQ ID NO: 95328 - protein, 29 aa, Artificial Sequence
  Description of Artificial Sequence: Synthetic peptide
YEEEIASVNPTCTEQYGVVSDNLQSGNEQ

SEQ ID NO: 95329 - protein, 29 aa, Artificial Sequence
  Description of Artificial Sequence: Synthetic peptide
YEEEIASVNPTCTEQYGVVCSDNLQSGNQ

SEQ ID NO: 95330 - protein, 32 aa, Artificial Sequence
  Description of Artificial Sequence: Synthetic polypeptide
DEEEIRTTNPVATEQYGAVFGNIQDENGGGQG

SEQ ID NO: 95331 - protein, 33 aa, Artificial Sequence
  Description of Artificial Sequence: Synthetic polypeptide
DEEEIRTTNPVATEQYGAVFGNLQGEQGEGGGG

SEQ ID NO: 95332 - protein, 34 aa, Artificial Sequence
  Description of Artificial Sequence: Synthetic polypeptide
DEEEIRTTNPVATEQYGAVMGTNNMEQGEGGNTQ

SEQ ID NO: 95333 - protein, 34 aa, Artificial Sequence
  Description of Artificial Sequence: Synthetic polypeptide
DEEEIRTTNPVATEQYGAVMGTNLDMEGQGTNGQ

SEQ ID NO: 95334 - protein, 29 aa, Artificial Sequence
  Description of Artificial Sequence: Synthetic peptide
YEEEIASVNPDVCTEQYGVVSDNLQSDNQ

SEQ ID NO: 95335 - protein, 28 aa, Artificial Sequence
  Description of Artificial Sequence: Synthetic peptide
YEEEIASVNPECTESYGVVSDNLQSGNQ

SEQ ID NO: 95336 - protein, 28 aa, Artificial Sequence
  Description of Artificial Sequence: Synthetic peptide
YEEEIASVNPECTNQYGVVSDNLQSGNQ

SEQ ID NO: 95337 - protein, 30 aa, Artificial Sequence
  Description of Artificial Sequence: Synthetic polypeptide
YEEEIASVNPEVCTEQYGVVSDNLQSGNQK

SEQ ID NO: 95338 - protein, 32 aa, Artificial Sequence
  Description of Artificial Sequence: Synthetic polypeptide
DEEEIRTTNPVATEQYGAVMGLNMQEDQGGGG

SEQ ID NO: 95339 - protein, 29 aa, Artificial Sequence
  Description of Artificial Sequence: Synthetic peptide
YEEEIASVNPHCTEQYGVVSDNLQMSGNQ

SEQ ID NO: 95340 - protein, 34 aa, Artificial Sequence
  Description of Artificial Sequence: Synthetic polypeptide
DEEEIRTTNPVATEQYGAVMGETDNEQGGQGNEN

SEQ ID NO: 95341 - protein, 28 aa, Artificial Sequence
  Description of Artificial Sequence: Synthetic peptide
YEEEIASVNPMCTEQYGVVSDNLQSENQ

SEQ ID NO: 95342 - protein, 30 aa, Artificial Sequence
  Description of Artificial Sequence: Synthetic polypeptide
YEEEIASVNPVATEQYGVVSDDNLVESGNQ

SEQ ID NO: 95343 - protein, 28 aa, Artificial Sequence
  Description of Artificial Sequence: Synthetic peptide
YEEEIASVNPMCTEQYGVVSDNLQSGHQ

SEQ ID NO: 95344 - protein, 29 aa, Artificial Sequence
  Description of Artificial Sequence: Synthetic peptide
YEEEIASVNPMVCTEQYGVVSDNTQSGNQ

SEQ ID NO: 95345 - protein, 34 aa, Artificial Sequence
  Description of Artificial Sequence: Synthetic polypeptide
DEEEIRTTNPVATEQYGAVIVSDGENGQGGNDDT

SEQ ID NO: 95346 - protein, 33 aa, Artificial Sequence
  Description of Artificial Sequence: Synthetic polypeptide
DEEEIRTTNPVATEQYGAVITGNGQTGGQGETG

SEQ ID NO: 95347 - protein, 29 aa, Artificial Sequence
  Description of Artificial Sequence: Synthetic peptide
YEEEIASVNPPCTEAQYGVVSDNLQSGNQ

SEQ ID NO: 95348 - protein, 29 aa, Artificial Sequence
  Description of Artificial Sequence: Synthetic peptide
YEEEIASVNPPVCTEQYGVYSDNLQSGNQ

SEQ ID NO: 95349 - protein, 30 aa, Artificial Sequence
  Description of Artificial Sequence: Synthetic polypeptide
YEEEIASVNPPVCTEQYIGVVSDNLQSGNQ

SEQ ID NO: 95350 - protein, 29 aa, Artificial Sequence
  Description of Artificial Sequence: Synthetic peptide
YEEEIASVNPSCTEQYGVEVSDNLQSGNQ

SEQ ID NO: 95351 - protein, 35 aa, Artificial Sequence
  Description of Artificial Sequence: Synthetic polypeptide
DEEEIRTTNPVATEQYGAVGSGTMELQEEGGGNNQ

SEQ ID NO: 95352 - protein, 33 aa, Artificial Sequence
  Description of Artificial Sequence: Synthetic polypeptide
DEEEIRTTNPVATEQYGAVGSDDNGGQEEENGE

SEQ ID NO: 95353 - protein, 35 aa, Artificial Sequence
  Description of Artificial Sequence: Synthetic polypeptide
DEEEIRTTNPVATEQYGAVFGSTMELQEEGQGDNQ

SEQ ID NO: 95354 - protein, 29 aa, Artificial Sequence
  Description of Artificial Sequence: Synthetic peptide
YEEEIASVNPMCTEQYGVVSKDNLQSGNQ

SEQ ID NO: 95355 - protein, 29 aa, Artificial Sequence
  Description of Artificial Sequence: Synthetic peptide
YEEEIASVNPVCTEQYGVVSDNLQSSNVQ

SEQ ID NO: 95356 - protein, 34 aa, Artificial Sequence
  Description of Artificial Sequence: Synthetic polypeptide
DEEEIRTTNPVATEQYGAVDSDTNMQGDEFTANT

SEQ ID NO: 95357 - protein, 35 aa, Artificial Sequence
  Description of Artificial Sequence: Synthetic polypeptide
DEEEIRTTNPVATEQYGAVDSDTNMGQEGGENDTG

SEQ ID NO: 95358 - protein, 28 aa, Artificial Sequence
  Description of Artificial Sequence: Synthetic peptide
YEEEIASVNPVCTEGYGVVSNNLQSGQQ

SEQ ID NO: 95359 - protein, 28 aa, Artificial Sequence
  Description of Artificial Sequence: Synthetic peptide
YEEEIASVNPVCTEHYGVVSDNLQSRNQ

SEQ ID NO: 95360 - protein, 28 aa, Artificial Sequence
  Description of Artificial Sequence: Synthetic peptide
YEEEIASVNPVCTEHYGVVSDRLQSGNQ

SEQ ID NO: 95361 - protein, 28 aa, Artificial Sequence
  Description of Artificial Sequence: Synthetic peptide
YEEEIASVNPVCTEKYGVVSDNLNSGNQ

SEQ ID NO: 95362 - protein, 28 aa, Artificial Sequence
  Description of Artificial Sequence: Synthetic peptide
YEEEIASVNPVCTEKYGVVSDNLQSGMQ

SEQ ID NO: 95363 - protein, 29 aa, Artificial Sequence
  Description of Artificial Sequence: Synthetic peptide
YEEEIASVNPVCTEKYGVVSDNLQSGNDQ

SEQ ID NO: 95364 - protein, 28 aa, Artificial Sequence
  Description of Artificial Sequence: Synthetic peptide
YEEEIASVNPVCTEKYGVVSDNLQSGRQ

SEQ ID NO: 95365 - protein, 28 aa, Artificial Sequence
  Description of Artificial Sequence: Synthetic peptide
YEEEIASVNPVCTEKYGVVSDVLQSGNQ

SEQ ID NO: 95366 - protein, 29 aa, Artificial Sequence
  Description of Artificial Sequence: Synthetic peptide
YEEEIASVNPVCTEKYGVVSLDNLQSGNQ

SEQ ID NO: 95367 - protein, 32 aa, Artificial Sequence
  Description of Artificial Sequence: Synthetic polypeptide
DEEEIRTTNPVATEQYGAMGTVNGIGGGQNQQ

SEQ ID NO: 95368 - protein, 28 aa, Artificial Sequence
  Description of Artificial Sequence: Synthetic peptide
YEEEIASVNPVCTENYGVVSDNLQSMNQ

SEQ ID NO: 95369 - protein, 28 aa, Artificial Sequence
  Description of Artificial Sequence: Synthetic peptide
YEEEIASVNPVCTEPYGVVSDDLQSGNQ

SEQ ID NO: 95370 - protein, 34 aa, Artificial Sequence
  Description of Artificial Sequence: Synthetic polypeptide
DEEEIRTTNPVATEQYGAIWSLTINHGQGEGENT

SEQ ID NO: 95371 - protein, 29 aa, Artificial Sequence
  Description of Artificial Sequence: Synthetic peptide
YEEEIASVNPVCTEPYGVVSDNLQGSGNQ

SEQ ID NO: 95372 - protein, 29 aa, Artificial Sequence
  Description of Artificial Sequence: Synthetic peptide
YEEEIASVNPVCTEPYGVVSDNLQQSGNQ

SEQ ID NO: 95373 - protein, 29 aa, Artificial Sequence
  Description of Artificial Sequence: Synthetic peptide
YEEEIASVNPVCTEPYGVVSDNLQSGNVQ

SEQ ID NO: 95374 - protein, 28 aa, Artificial Sequence
  Description of Artificial Sequence: Synthetic peptide
YEEEIASVNPVCTEPYGVVSDNLQSWNQ

SEQ ID NO: 95375 - protein, 29 aa, Artificial Sequence
  Description of Artificial Sequence: Synthetic peptide
YEEEIASVNPVCTEPYGVVSDNWLQSGNQ

SEQ ID NO: 95376 - protein, 28 aa, Artificial Sequence
  Description of Artificial Sequence: Synthetic peptide
YEEEIASVNPVCTEPYGVVSMDLQSGNQ

SEQ ID NO: 95377 - protein, 29 aa, Artificial Sequence
  Description of Artificial Sequence: Synthetic peptide
YEEEIASVNPVCTEQWGVVGSDNLQSGNQ

SEQ ID NO: 95378 - protein, 29 aa, Artificial Sequence
  Description of Artificial Sequence: Synthetic peptide
YEEEIASVNPVCTEQWGVVSDNLQDSGNQ

SEQ ID NO: 95379 - protein, 28 aa, Artificial Sequence
  Description of Artificial Sequence: Synthetic peptide
YEEEIASVNPVCTEGYGVVSDNLQSGQQ

SEQ ID NO: 95380 - protein, 29 aa, Artificial Sequence
  Description of Artificial Sequence: Synthetic peptide
YEEEIASVNPVCTEGYGVVANNLQRVGNQ

SEQ ID NO: 95381 - protein, 28 aa, Artificial Sequence
  Description of Artificial Sequence: Synthetic peptide
YEEEIASVNPVCTEGYGVVADNLQSGNQ

SEQ ID NO: 95382 - protein, 30 aa, Artificial Sequence
  Description of Artificial Sequence: Synthetic polypeptide
YEEEIASVNPVCTEGYGVVAANNLQRVGNR

SEQ ID NO: 95383 - protein, 33 aa, Artificial Sequence
  Description of Artificial Sequence: Synthetic polypeptide
DEEEIRTTNPVATEQYGAVDSDTNMGDEFTNGS

SEQ ID NO: 95384 - protein, 29 aa, Artificial Sequence
  Description of Artificial Sequence: Synthetic peptide
YEEEIASVNPVATEQYGVVSSDAGQSGNV

SEQ ID NO: 95385 - protein, 31 aa, Artificial Sequence
  Description of Artificial Sequence: Synthetic polypeptide
YEEEIASVNPVATEQYGVVSTTNGQSGMNPQ

SEQ ID NO: 95386 - protein, 34 aa, Artificial Sequence
  Description of Artificial Sequence: Synthetic polypeptide
DEEEIRTTNPVATEQYGAVDSDNNQNEQAEGNGG

SEQ ID NO: 95387 - protein, 34 aa, Artificial Sequence
  Description of Artificial Sequence: Synthetic polypeptide
DEEEIRTTNPVATEQYGAVDSDNNNNEQAEGNTG

SEQ ID NO: 95388 - protein, 34 aa, Artificial Sequence
  Description of Artificial Sequence: Synthetic polypeptide
DEEEIRTTNPVATEQYGAVDSDELQEDNGNNEGT

SEQ ID NO: 95389 - protein, 28 aa, Artificial Sequence
  Description of Artificial Sequence: Synthetic peptide
YEEEIASVNPVCCEQFGVVSDNLQSGNQ

SEQ ID NO: 95390 - protein, 28 aa, Artificial Sequence
  Description of Artificial Sequence: Synthetic peptide
YEEEIASVNPVCCEQYGVVSDNLQSGWQ

SEQ ID NO: 95391 - protein, 28 aa, Artificial Sequence
  Description of Artificial Sequence: Synthetic peptide
YEEEIASVNPVCDEQYGVVADNLQSGNQ

SEQ ID NO: 95392 - protein, 28 aa, Artificial Sequence
  Description of Artificial Sequence: Synthetic peptide
YEEEIASVNPVCFEQYGVVCDNLQSGNQ

SEQ ID NO: 95393 - protein, 33 aa, Artificial Sequence
  Description of Artificial Sequence: Synthetic polypeptide
DEEEIRTTNPVATEQYGAVDSDTNMNEGGGETT

SEQ ID NO: 95394 - protein, 28 aa, Artificial Sequence
  Description of Artificial Sequence: Synthetic peptide
YEEEIASVNPVCFEQYGVVSDRLQSGNQ

SEQ ID NO: 95395 - protein, 28 aa, Artificial Sequence
  Description of Artificial Sequence: Synthetic peptide
YEEEIASVNPVCHEQYGVVSDNLQSCNQ

SEQ ID NO: 95396 - protein, 33 aa, Artificial Sequence
  Description of Artificial Sequence: Synthetic polypeptide
DEEEIRTTNPVATEQYGAVDGDTNDGTEQEGGI

SEQ ID NO: 95397 - protein, 33 aa, Artificial Sequence
  Description of Artificial Sequence: Synthetic polypeptide
DEEEIRTTNPVATEQYGAVCSPEAQLGNEMPQQ

SEQ ID NO: 95398 - protein, 28 aa, Artificial Sequence
  Description of Artificial Sequence: Synthetic peptide
YEEEIASVNPVCTAQYGVISDNLQSGNQ

SEQ ID NO: 95399 - protein, 28 aa, Artificial Sequence
  Description of Artificial Sequence: Synthetic peptide
YEEEIASVNPVCTEAYGVVSDNSQSGNQ

SEQ ID NO: 95400 - protein, 28 aa, Artificial Sequence
  Description of Artificial Sequence: Synthetic peptide
YEEEIASVNPVCTEAYGVVSDNVQSGNQ

SEQ ID NO: 95401 - protein, 28 aa, Artificial Sequence
  Description of Artificial Sequence: Synthetic peptide
YEEEIASVNPVCTECWGVVSDNLQSGNQ

SEQ ID NO: 95402 - protein, 30 aa, Artificial Sequence
  Description of Artificial Sequence: Synthetic polypeptide
YEEEIASVNPVCTECYGSVSCNLPQSEGNQ

SEQ ID NO: 95403 - protein, 28 aa, Artificial Sequence
  Description of Artificial Sequence: Synthetic peptide
YEEEIASVNPVCTECYGVVSDNLQHGEQ

SEQ ID NO: 95404 - protein, 28 aa, Artificial Sequence
  Description of Artificial Sequence: Synthetic peptide
YEEEIASVNPVCTECYGVVSDNWQSGNQ

SEQ ID NO: 95405 - protein, 28 aa, Artificial Sequence
  Description of Artificial Sequence: Synthetic peptide
YEEEIASVNPVCGEQYGVVSDNEQSGNQ

SEQ ID NO: 95406 - protein, 30 aa, Artificial Sequence
  Description of Artificial Sequence: Synthetic polypeptide
YEEEIASVNPVCTEQYGVVSDNLQSVGLNQ

SEQ ID NO: 95407 - protein, 28 aa, Artificial Sequence
  Description of Artificial Sequence: Synthetic peptide
YEEEIASVNPVCTEQYGVVSDNLQSVPQ

SEQ ID NO: 95408 - protein, 34 aa, Artificial Sequence
  Description of Artificial Sequence: Synthetic polypeptide
DEEEIRTTNPVATEQWGSVSSTPAGPNDRNGENG

SEQ ID NO: 95409 - protein, 29 aa, Artificial Sequence
  Description of Artificial Sequence: Synthetic peptide
YEEEIASVNPVSTEPYGVVSDENLQSGNQ

SEQ ID NO: 95410 - protein, 34 aa, Artificial Sequence
  Description of Artificial Sequence: Synthetic polypeptide
DEEEIRTTNPVATEQWGHVNVSGTNVLQHTPGGF

SEQ ID NO: 95411 - protein, 36 aa, Artificial Sequence
  Description of Artificial Sequence: Synthetic polypeptide
DEEEIRTTNPVATEQWGHSRVSITDNYLQENRPGEF

SEQ ID NO: 95412 - protein, 34 aa, Artificial Sequence
  Description of Artificial Sequence: Synthetic polypeptide
DEEEIRTTNPVATEQWGHSNVSYTNVLEDDDGGF

SEQ ID NO: 95413 - protein, 35 aa, Artificial Sequence
  Description of Artificial Sequence: Synthetic polypeptide
DEEEIRTTNPVATEQWGHSNVSYTNNLQHRPQDGF

SEQ ID NO: 95414 - protein, 28 aa, Artificial Sequence
  Description of Artificial Sequence: Synthetic peptide
YEEEIASVNPVSTEQYGVISDDLQSGNQ

SEQ ID NO: 95415 - protein, 36 aa, Artificial Sequence
  Description of Artificial Sequence: Synthetic polypeptide
DEEEIRTTNPVATEQWGHSNVSYTNELQHRGGDGQF

SEQ ID NO: 95416 - protein, 35 aa, Artificial Sequence
  Description of Artificial Sequence: Synthetic polypeptide
DEEEIRTTNPVATEQWGHSNVSYTNALQHGPGGQF

SEQ ID NO: 95417 - protein, 29 aa, Artificial Sequence
  Description of Artificial Sequence: Synthetic peptide
YEEEIASVNPVSYEQYGVVSDNLQSTGNQ

SEQ ID NO: 95418 - protein, 35 aa, Artificial Sequence
  Description of Artificial Sequence: Synthetic polypeptide
DEEEIRTTNPVATEQWGHSNVSIPNELQHRPGDGF

SEQ ID NO: 95419 - protein, 34 aa, Artificial Sequence
  Description of Artificial Sequence: Synthetic polypeptide
DEEEIRTTNPVATEQWGHSNVSIDNFLQHGPGGE

SEQ ID NO: 95420 - protein, 34 aa, Artificial Sequence
  Description of Artificial Sequence: Synthetic polypeptide
DEEEIRTTNPVATEQWGHSNVPRPNELQHRPGDF

SEQ ID NO: 95421 - protein, 34 aa, Artificial Sequence
  Description of Artificial Sequence: Synthetic polypeptide
DEEEIRTTNPVATEQWGHSNVAYTNNLQADPGGF

SEQ ID NO: 95422 - protein, 35 aa, Artificial Sequence
  Description of Artificial Sequence: Synthetic polypeptide
DEEEIRTTNPVATEQWGHSNVAATNQLQHARPGGF

SEQ ID NO: 95423 - protein, 34 aa, Artificial Sequence
  Description of Artificial Sequence: Synthetic polypeptide
DEEEIRTTNPVATEQWGHMNVSLTNDDQHRPGGF

SEQ ID NO: 95424 - protein, 34 aa, Artificial Sequence
  Description of Artificial Sequence: Synthetic polypeptide
DEEEIRTTNPVATEQWGHCNVSYTNPLQHRPDGF

SEQ ID NO: 95425 - protein, 35 aa, Artificial Sequence
  Description of Artificial Sequence: Synthetic polypeptide
DEEEIRTTNPVATEQWGHCNVSVTNGLQADRPGGF

SEQ ID NO: 95426 - protein, 35 aa, Artificial Sequence
  Description of Artificial Sequence: Synthetic polypeptide
DEEEIRTTNPVATEQWGFSNVSITNPLQHLEPGGF

SEQ ID NO: 95427 - protein, 33 aa, Artificial Sequence
  Description of Artificial Sequence: Synthetic polypeptide
YEEEIATTNPVATEQYGSVSSDNLPNMSNGMNV

SEQ ID NO: 95428 - protein, 29 aa, Artificial Sequence
  Description of Artificial Sequence: Synthetic peptide
DEEEIRTTNPVATEQWGEVPEIEQHAEEK

SEQ ID NO: 95429 - protein, 28 aa, Artificial Sequence
  Description of Artificial Sequence: Synthetic peptide
DEEEIRTTNPVATEQWGEVPEICMHEDK

SEQ ID NO: 95430 - protein, 28 aa, Artificial Sequence
  Description of Artificial Sequence: Synthetic peptide
YEEEIASVNPVSTEGYGVVSNNIQSGNQ

SEQ ID NO: 95431 - protein, 28 aa, Artificial Sequence
  Description of Artificial Sequence: Synthetic peptide
YEEEIASVNPVGTEQYGVVASNLQSGDI

SEQ ID NO: 95432 - protein, 28 aa, Artificial Sequence
  Description of Artificial Sequence: Synthetic peptide
YEEEIASVNPVGTEQYGVMSSNLQSGDQ

SEQ ID NO: 95433 - protein, 28 aa, Artificial Sequence
  Description of Artificial Sequence: Synthetic peptide
YEEEIASVNPVGTEQYGVMSSNLQHGDQ

SEQ ID NO: 95434 - protein, 29 aa, Artificial Sequence
  Description of Artificial Sequence: Synthetic peptide
YEEEIASVNPVCTERYGVVSDNGLQSGNQ

SEQ ID NO: 95435 - protein, 29 aa, Artificial Sequence
  Description of Artificial Sequence: Synthetic peptide
YEEEIASVNPVCTERYGVVSDNKLQSGNQ

SEQ ID NO: 95436 - protein, 35 aa, Artificial Sequence
  Description of Artificial Sequence: Synthetic polypeptide
DEEEIRTTNPVATEQWGQCNVCSYTNDLQHRFGQQ

SEQ ID NO: 95437 - protein, 28 aa, Artificial Sequence
  Description of Artificial Sequence: Synthetic peptide
YEEEIASVNPVCTEVYGVVSDNLQSGAQ

SEQ ID NO: 95438 - protein, 35 aa, Artificial Sequence
  Description of Artificial Sequence: Synthetic polypeptide
DEEEIRTTNPVATECYGSVSSTTPALPNRNGMNPV

SEQ ID NO: 95439 - protein, 35 aa, Artificial Sequence
  Description of Artificial Sequence: Synthetic polypeptide
DEEEIRTTNPVATEQWGNTTTSTNELTQGNGENGR

SEQ ID NO: 95440 - protein, 34 aa, Artificial Sequence
  Description of Artificial Sequence: Synthetic polypeptide
DEEEIRTTNPVATEQWGNTTTANNELTQGNGENR

SEQ ID NO: 95441 - protein, 28 aa, Artificial Sequence
  Description of Artificial Sequence: Synthetic peptide
YEEEIASVNPVCTFQYGVVADNLQSGNQ

SEQ ID NO: 95442 - protein, 33 aa, Artificial Sequence
  Description of Artificial Sequence: Synthetic polypeptide
DEEEIRTTNPVATEQWGNTIAATNPLQGMGGSR

SEQ ID NO: 95443 - protein, 33 aa, Artificial Sequence
  Description of Artificial Sequence: Synthetic polypeptide
DEEEIRTTNPVATECYGSVSTEPAGPNHNEMNL

SEQ ID NO: 95444 - protein, 32 aa, Artificial Sequence
  Description of Artificial Sequence: Synthetic polypeptide
DEEEIRTTNPVATEEYGCVCFTNHTHGGSNQS

SEQ ID NO: 95445 - protein, 35 aa, Artificial Sequence
  Description of Artificial Sequence: Synthetic polypeptide
DEEEIRTTNPVATECYGSVSTTPAEPQMRNGMNPG

SEQ ID NO: 95446 - protein, 32 aa, Artificial Sequence
  Description of Artificial Sequence: Synthetic polypeptide
DEEEIRTTNPVATECYGSVVGFGNLNEGGGQQ

SEQ ID NO: 95447 - protein, 34 aa, Artificial Sequence
  Description of Artificial Sequence: Synthetic polypeptide
DEEEIRTTNPVATECYGSVVGFGNLNVQGGGNGN

SEQ ID NO: 95448 - protein, 35 aa, Artificial Sequence
  Description of Artificial Sequence: Synthetic polypeptide
DEEEIRTTNPVATEQWGISTVSYTNSLSHRPGGGF

SEQ ID NO: 95449 - protein, 35 aa, Artificial Sequence
  Description of Artificial Sequence: Synthetic polypeptide
DEEEIRTTNPVATEQWGISTVSYTNALSHRDGTSF

SEQ ID NO: 95450 - protein, 28 aa, Artificial Sequence
  Description of Artificial Sequence: Synthetic peptide
YEEEIASVNPVCTNKYGVVSDNLQSGNQ

SEQ ID NO: 95451 - protein, 35 aa, Artificial Sequence
  Description of Artificial Sequence: Synthetic polypeptide
DEEEIRTTNPVATEQWGISLVSYTNALSHRPGGGH

SEQ ID NO: 95452 - protein, 28 aa, Artificial Sequence
  Description of Artificial Sequence: Synthetic peptide
YEEEIASVNPVCTNQYGVVSDNWQSGNQ

SEQ ID NO: 95453 - protein, 28 aa, Artificial Sequence
  Description of Artificial Sequence: Synthetic peptide
YEEEIASVNPVCTSWYGVVSDNLQSGNQ

SEQ ID NO: 95454 - protein, 28 aa, Artificial Sequence
  Description of Artificial Sequence: Synthetic peptide
YEEEIASVNPVCWECYGVVSDNLQSGNQ

SEQ ID NO: 95455 - protein, 30 aa, Artificial Sequence
  Description of Artificial Sequence: Synthetic polypeptide
YEEEIASVNPVCYEQYGVVSDNLQPSGNQR

SEQ ID NO: 95456 - protein, 35 aa, Artificial Sequence
  Description of Artificial Sequence: Synthetic polypeptide
DEEEIRTTNPVATECYGSVSTTPAEPQMRNGMNPV

SEQ ID NO: 95457 - protein, 29 aa, Artificial Sequence
  Description of Artificial Sequence: Synthetic peptide
YEEEIASVNPVCTEQYGVVYSDNLQSNNQ

SEQ ID NO: 95458 - protein, 28 aa, Artificial Sequence
  Description of Artificial Sequence: Synthetic peptide
YEEEIATTNPVATEQYGVAPEVLQHEEK

SEQ ID NO: 95459 - protein, 28 aa, Artificial Sequence
  Description of Artificial Sequence: Synthetic peptide
DEEEIRTTNPVATEQWGEASEICMAEEA

SEQ ID NO: 95460 - protein, 33 aa, Artificial Sequence
  Description of Artificial Sequence: Synthetic polypeptide
DEEEIRTTNPVATEEYGCVCSTELNQNFNSEQT

SEQ ID NO: 95461 - protein, 33 aa, Artificial Sequence
  Description of Artificial Sequence: Synthetic polypeptide
DEEEIRTTNPVATEQWGCVAMTNLNRDGMGDLE

SEQ ID NO: 95462 - protein, 34 aa, Artificial Sequence
  Description of Artificial Sequence: Synthetic polypeptide
DEEEIRTTNPVATEQWGCVAMTNLNPRDGMGDNH

SEQ ID NO: 95463 - protein, 34 aa, Artificial Sequence
  Description of Artificial Sequence: Synthetic polypeptide
DEEEIRTTNPVATEQWGCVAMTNLENRDGMNDLH

SEQ ID NO: 95464 - protein, 33 aa, Artificial Sequence
  Description of Artificial Sequence: Synthetic polypeptide
DEEEIRTTNPVATEQWGCVAMTALNRDGMGDRH

SEQ ID NO: 95465 - protein, 29 aa, Artificial Sequence
  Description of Artificial Sequence: Synthetic peptide
YEEEIATVNPVATEQYGVVSDNEMNSGDA

SEQ ID NO: 95466 - protein, 32 aa, Artificial Sequence
  Description of Artificial Sequence: Synthetic polypeptide
AEDEICATNPVATEQYGSVATSENLQRGEGED

SEQ ID NO: 95467 - protein, 31 aa, Artificial Sequence
  Description of Artificial Sequence: Synthetic polypeptide
DEEEIRTTNPVATEQWGAYIFDTNLMMTGEH

SEQ ID NO: 95468 - protein, 28 aa, Artificial Sequence
  Description of Artificial Sequence: Synthetic peptide
YEEEIATVNPVCTEQYGEVPENCQSENK

SEQ ID NO: 95469 - protein, 28 aa, Artificial Sequence
  Description of Artificial Sequence: Synthetic peptide
YEEEIATVNPVCTEQYGEVPEVLQSGEQ

SEQ ID NO: 95470 - protein, 31 aa, Artificial Sequence
  Description of Artificial Sequence: Synthetic polypeptide
AEDEICATNPVATEQYGSVATSENLQQSGGD

SEQ ID NO: 95471 - protein, 31 aa, Artificial Sequence
  Description of Artificial Sequence: Synthetic polypeptide
YEEEIATVNPVCTEQYGSVSSDPNGQSNGNV

SEQ ID NO: 95472 - protein, 30 aa, Artificial Sequence
  Description of Artificial Sequence: Synthetic polypeptide
YEEEIATVNPVCTEQYGTVCSDGLVQFGND

SEQ ID NO: 95473 - protein, 31 aa, Artificial Sequence
  Description of Artificial Sequence: Synthetic polypeptide
AEDEICATNPVATEQYGSVASVENLQSGEGD

SEQ ID NO: 95474 - protein, 28 aa, Artificial Sequence
  Description of Artificial Sequence: Synthetic peptide
YEEEIATVNPVCTEQYGVVSEVCQHGEQ

SEQ ID NO: 95475 - protein, 30 aa, Artificial Sequence
  Description of Artificial Sequence: Synthetic polypeptide
YEEEIATVNPVSTEQYGTVSMDLQQQNGNQ

SEQ ID NO: 95476 - protein, 33 aa, Artificial Sequence
  Description of Artificial Sequence: Synthetic polypeptide
DEEEIRTTNPVATEEYGSVFYITHSGRTGGNNS

SEQ ID NO: 95477 - protein, 30 aa, Artificial Sequence
  Description of Artificial Sequence: Synthetic polypeptide
YEEEIATVNPVSTEQYGTVSMDLQQSNGNQ

SEQ ID NO: 95478 - protein, 35 aa, Artificial Sequence
  Description of Artificial Sequence: Synthetic polypeptide
DEEEIRTTNPVATEEYGSVSTGNELSQMPGGMEES

SEQ ID NO: 95479 - protein, 35 aa, Artificial Sequence
  Description of Artificial Sequence: Synthetic polypeptide
DEEEIRTTNPVATEEYGSVVPWTYGLSQRTPGGNE

SEQ ID NO: 95480 - protein, 34 aa, Artificial Sequence
  Description of Artificial Sequence: Synthetic polypeptide
DEEEIRTTNPVATEEYGSVVWTYGLSNRTPGSNE

SEQ ID NO: 95481 - protein, 32 aa, Artificial Sequence
  Description of Artificial Sequence: Synthetic polypeptide
DEEEIRTTNPVATEEYGCVCSTEHQNFGSDQF

SEQ ID NO: 95482 - protein, 33 aa, Artificial Sequence
  Description of Artificial Sequence: Synthetic polypeptide
DEEEIRTTNPVATEQWGCVYSDEWGDGQRSQNR

SEQ ID NO: 95483 - protein, 34 aa, Artificial Sequence
  Description of Artificial Sequence: Synthetic polypeptide
DEEEIRTTNPVATEQWGCVYSDTWQDGQRSQNER

SEQ ID NO: 95484 - protein, 31 aa, Artificial Sequence
  Description of Artificial Sequence: Synthetic polypeptide
AEDEICATNPVATEQYGVVASENLNQAGNGD

SEQ ID NO: 95485 - protein, 31 aa, Artificial Sequence
  Description of Artificial Sequence: Synthetic polypeptide
DEEEIRTTNPVATEQWGDVSTTAEMMANEDA

SEQ ID NO: 95486 - protein, 32 aa, Artificial Sequence
  Description of Artificial Sequence: Synthetic polypeptide
DEEEIRTTNPVATEQWGDVSTPAENMAAGDPV

SEQ ID NO: 95487 - protein, 31 aa, Artificial Sequence
  Description of Artificial Sequence: Synthetic polypeptide
DEEEIRTTNPVATEQWGDVSTPAEMNAAGDV

SEQ ID NO: 95488 - protein, 31 aa, Artificial Sequence
  Description of Artificial Sequence: Synthetic polypeptide
YEEEIATTNPVCTEQYGTVCSDDGLVQFGND

SEQ ID NO: 95489 - protein, 31 aa, Artificial Sequence
  Description of Artificial Sequence: Synthetic polypeptide
YEEEIATTNPVCTEQYGVTTSNDEDLQSGNQ

SEQ ID NO: 95490 - protein, 30 aa, Artificial Sequence
  Description of Artificial Sequence: Synthetic polypeptide
YEEEIATTNPVCTEQYGVVSDILQNSAENQ

SEQ ID NO: 95491 - protein, 30 aa, Artificial Sequence
  Description of Artificial Sequence: Synthetic polypeptide
AEDEICATNPVATEQYGVVATENLQQGGTD

SEQ ID NO: 95492 - protein, 29 aa, Artificial Sequence
  Description of Artificial Sequence: Synthetic peptide
YEEEIATTNPVCTEQYGVVSEILMNAENQ

SEQ ID NO: 95493 - protein, 31 aa, Artificial Sequence
  Description of Artificial Sequence: Synthetic polypeptide
YEEEIATTNPVCTEQYGVVSTDLEDHEGNDL

SEQ ID NO: 95494 - protein, 31 aa, Artificial Sequence
  Description of Artificial Sequence: Synthetic polypeptide
AEDEICATNPVATEQYGVVASTENLLQLGGD

SEQ ID NO: 95495 - protein, 31 aa, Artificial Sequence
  Description of Artificial Sequence: Synthetic polypeptide
DEEEIRTTNPVATEQWGEASEINEQHEGEEG

SEQ ID NO: 95496 - protein, 31 aa, Artificial Sequence
  Description of Artificial Sequence: Synthetic polypeptide
AEDEICATNPVATEQYGVVASENQLQQGGND

SEQ ID NO: 95497 - protein, 30 aa, Artificial Sequence
  Description of Artificial Sequence: Synthetic polypeptide
DEEEIRTTNPVATEQWGDVSEIENNRAEDA

SEQ ID NO: 95498 - protein, 30 aa, Artificial Sequence
  Description of Artificial Sequence: Synthetic polypeptide
DEEEIRTTNPVATEQWGDVSEIEMNRAEDA

SEQ ID NO: 95499 - protein, 30 aa, Artificial Sequence
  Description of Artificial Sequence: Synthetic polypeptide
YEEEIATVNPVATEQWGVVSDNLMNAAGNQ

SEQ ID NO: 95500 - protein, 30 aa, Artificial Sequence
  Description of Artificial Sequence: Synthetic polypeptide
YEEEIATVNPVATEQWGVVSDNLMNSAGNQ

SEQ ID NO: 95501 - protein, 30 aa, Artificial Sequence
  Description of Artificial Sequence: Synthetic polypeptide
DEEEIRTTNPVATEQWGDVSEIEMNAAENA

SEQ ID NO: 95502 - protein, 30 aa, Artificial Sequence
  Description of Artificial Sequence: Synthetic polypeptide
DEEEIRTTNPVATEQWGDVSEAEMNANEDA

SEQ ID NO: 95503 - protein, 30 aa, Artificial Sequence
  Description of Artificial Sequence: Synthetic polypeptide
DEEEIRTTNPVATEQWGDVSEAEMMANEDA

SEQ ID NO: 95504 - protein, 30 aa, Artificial Sequence
  Description of Artificial Sequence: Synthetic polypeptide
DEEEIRTTNPVATEQWGDVSDILMNAAEDA

SEQ ID NO: 95505 - protein, 35 aa, Artificial Sequence
  Description of Artificial Sequence: Synthetic polypeptide
DEEEIRTTNPVATEQWGDSRVSYTDNYLGERPGEF

SEQ ID NO: 95506 - protein, 31 aa, Artificial Sequence
  Description of Artificial Sequence: Synthetic polypeptide
DEEEIRTTNPVATEQWGDHVSEIEMNQAGDA

SEQ ID NO: 95507 - protein, 30 aa, Artificial Sequence
  Description of Artificial Sequence: Synthetic polypeptide
DEEEIRTTNPVATEQWGDVSEILMNAAEDA

SEQ ID NO: 95508 - protein, 28 aa, Artificial Sequence
  Description of Artificial Sequence: Synthetic peptide
YEEEIASVNPDCTEQYGVVSDNLQSFNQ

SEQ ID NO: 95509 - protein, 30 aa, Artificial Sequence
  Description of Artificial Sequence: Synthetic polypeptide
YEEEIASVNPVCTEQYGVVYSDNLQSGHNQ

SEQ ID NO: 95510 - protein, 30 aa, Artificial Sequence
  Description of Artificial Sequence: Synthetic polypeptide
YEEEIASVNPVCTEQYGVVYSDNLMQSGNQ

SEQ ID NO: 95511 - protein, 28 aa, Artificial Sequence
  Description of Artificial Sequence: Synthetic peptide
YEEEIASVNPVCTEQYGVVSDVLQSENK

SEQ ID NO: 95512 - protein, 32 aa, Artificial Sequence
  Description of Artificial Sequence: Synthetic polypeptide
DEEEIRTTNPVATECWGSVSEINEPQREEEEK

SEQ ID NO: 95513 - protein, 29 aa, Artificial Sequence
  Description of Artificial Sequence: Synthetic peptide
YEEEIASVNPVCTEQYGVVSDVNGQSGNQ

SEQ ID NO: 95514 - protein, 34 aa, Artificial Sequence
  Description of Artificial Sequence: Synthetic polypeptide
DEEEIRTTNPVATECWGSVSSCPNGPQMRNGENG

SEQ ID NO: 95515 - protein, 28 aa, Artificial Sequence
  Description of Artificial Sequence: Synthetic peptide
YEEEIASVNPVCTEQYGVVSENEQSGDQ

SEQ ID NO: 95516 - protein, 35 aa, Artificial Sequence
  Description of Artificial Sequence: Synthetic polypeptide
DEEEIRTTNPVATECWGSVSTCINEPQDREGENPG

SEQ ID NO: 95517 - protein, 35 aa, Artificial Sequence
  Description of Artificial Sequence: Synthetic polypeptide
DEEEIRTTNPVATECWGSVSTCPNEPQDREGENPG

SEQ ID NO: 95518 - protein, 34 aa, Artificial Sequence
  Description of Artificial Sequence: Synthetic polypeptide
DEEEIRTTNPVATEQWGSVSEGPPQNQMGGNPRN

SEQ ID NO: 95519 - protein, 34 aa, Artificial Sequence
  Description of Artificial Sequence: Synthetic polypeptide
DEEEIRTTNPVATECWGSVSTIAEPQDREGMNPG

SEQ ID NO: 95520 - protein, 34 aa, Artificial Sequence
  Description of Artificial Sequence: Synthetic polypeptide
DEEEIRTTNPVATECWGSVSTPAEPQDREGMNPG

SEQ ID NO: 95521 - protein, 31 aa, Artificial Sequence
  Description of Artificial Sequence: Synthetic polypeptide
DEEEIRTTNPVATECYGAAHLNTNEQVINFY

SEQ ID NO: 95522 - protein, 31 aa, Artificial Sequence
  Description of Artificial Sequence: Synthetic polypeptide
DEEEIRTTNPVATECYGAAHLNTPNEQFINF

SEQ ID NO: 95523 - protein, 33 aa, Artificial Sequence
  Description of Artificial Sequence: Synthetic polypeptide
DEEEIRTTNPVATECYGAMSTGNEQGGDTDNDF

SEQ ID NO: 95524 - protein, 33 aa, Artificial Sequence
  Description of Artificial Sequence: Synthetic polypeptide
DEEEIRTTNPVATECYGAMSTGNEQGGDTDNGL

SEQ ID NO: 95525 - protein, 30 aa, Artificial Sequence
  Description of Artificial Sequence: Synthetic polypeptide
YEEEIASVNPVCTEQYGVVSFDNELQSGNQ

SEQ ID NO: 95526 - protein, 30 aa, Artificial Sequence
  Description of Artificial Sequence: Synthetic polypeptide
YEEEIASVNPVCTEQYGVVSFDNLQGGNNQ

SEQ ID NO: 95527 - protein, 33 aa, Artificial Sequence
  Description of Artificial Sequence: Synthetic polypeptide
DEEEIRTTNPVATECYGAMSTGNGQGGDTGNFI

SEQ ID NO: 95528 - protein, 33 aa, Artificial Sequence
  Description of Artificial Sequence: Synthetic polypeptide
DEEEIRTTNPVATECYGAMSTGNNGQGGDTDNF

SEQ ID NO: 95529 - protein, 30 aa, Artificial Sequence
  Description of Artificial Sequence: Synthetic polypeptide
YEEEIASVNPVCTEQYGVVSIDGNLQSGNQ

SEQ ID NO: 95530 - protein, 30 aa, Artificial Sequence
  Description of Artificial Sequence: Synthetic polypeptide
YEEEIASVNPVCTEQYGVVSIDNGLQSGNQ

SEQ ID NO: 95531 - protein, 29 aa, Artificial Sequence
  Description of Artificial Sequence: Synthetic peptide
YEEEIASVNPVCTEQYGVVSLDNLQSGKQ

SEQ ID NO: 95532 - protein, 33 aa, Artificial Sequence
  Description of Artificial Sequence: Synthetic polypeptide
DEEEIRTTNPVATECWGSVSCINEPQDREGESG

SEQ ID NO: 95533 - protein, 34 aa, Artificial Sequence
  Description of Artificial Sequence: Synthetic polypeptide
DEEEIRTTNPVATECWGSVSCINEPQDREGENWG

SEQ ID NO: 95534 - protein, 34 aa, Artificial Sequence
  Description of Artificial Sequence: Synthetic polypeptide
DEEEIRTTNPVATECWGSVSCINEPQDREGENPG

SEQ ID NO: 95535 - protein, 29 aa, Artificial Sequence
  Description of Artificial Sequence: Synthetic peptide
YEEEIASVNPVCTEQYGVVSDVELQSGNQ

SEQ ID NO: 95536 - protein, 29 aa, Artificial Sequence
  Description of Artificial Sequence: Synthetic peptide
YEEEIASVNPVCTEQYGVVSDNLVSGENQ

SEQ ID NO: 95537 - protein, 34 aa, Artificial Sequence
  Description of Artificial Sequence: Synthetic polypeptide
DEEEIRTTNPVATEQWGSVSSTEPIGMNRNGNPA

SEQ ID NO: 95538 - protein, 34 aa, Artificial Sequence
  Description of Artificial Sequence: Synthetic polypeptide
DEEEIRTTNPVATEQWGSVSSTEPIGMMRNGNPA

SEQ ID NO: 95539 - protein, 34 aa, Artificial Sequence
  Description of Artificial Sequence: Synthetic polypeptide
DEEEIRTTNPVATEQWGSVSSTEPIEMNRNGNPA

SEQ ID NO: 95540 - protein, 29 aa, Artificial Sequence
  Description of Artificial Sequence: Synthetic peptide
YEEEIASVNPVCTEQYGVVSDNMQSAGNQ

SEQ ID NO: 95541 - protein, 35 aa, Artificial Sequence
  Description of Artificial Sequence: Synthetic polypeptide
DEEEIRTTNPVATEQWGSVSSTCPNGPNMREGMNV

SEQ ID NO: 95542 - protein, 35 aa, Artificial Sequence
  Description of Artificial Sequence: Synthetic polypeptide
DEEEIRTTNPVATEQWGSVSSTCPNGPNDREGMNV

SEQ ID NO: 95543 - protein, 35 aa, Artificial Sequence
  Description of Artificial Sequence: Synthetic polypeptide
DEEEIRTTNPVATEQWGSVSSTCPNGPNDREGENV

SEQ ID NO: 95544 - protein, 30 aa, Artificial Sequence
  Description of Artificial Sequence: Synthetic polypeptide
YEEEIASVNPVCTEQYGVVSDNNLQSGNNQ

SEQ ID NO: 95545 - protein, 28 aa, Artificial Sequence
  Description of Artificial Sequence: Synthetic peptide
YEEEIASVNPVCTEQYGVVSDNNQSGVQ

SEQ ID NO: 95546 - protein, 30 aa, Artificial Sequence
  Description of Artificial Sequence: Synthetic polypeptide
YEEEIASVNPVCTEQYGVVSLDVNLQSGNQ

SEQ ID NO: 95547 - protein, 29 aa, Artificial Sequence
  Description of Artificial Sequence: Synthetic peptide
YEEEIASVNPVCTEQYGVVSDNNTQSGNQ

SEQ ID NO: 95548 - protein, 29 aa, Artificial Sequence
  Description of Artificial Sequence: Synthetic peptide
YEEEIASVNPVCTEQYGVVSDNQQSAGNQ

SEQ ID NO: 95549 - protein, 29 aa, Artificial Sequence
  Description of Artificial Sequence: Synthetic peptide
YEEEIASVNPVCTEQYGVVSDNRQSGNQN

SEQ ID NO: 95550 - protein, 29 aa, Artificial Sequence
  Description of Artificial Sequence: Synthetic peptide
YEEEIASVNPVCTEQYGVVSDNRSQSGNQ

SEQ ID NO: 95551 - protein, 29 aa, Artificial Sequence
  Description of Artificial Sequence: Synthetic peptide
YEEEIASVNPVCTEQYGVVSDPALQSGNQ

SEQ ID NO: 95552 - protein, 29 aa, Artificial Sequence
  Description of Artificial Sequence: Synthetic peptide
YEEEIASVNPVCTEQYGVVSDPALQSGNV

SEQ ID NO: 95553 - protein, 28 aa, Artificial Sequence
  Description of Artificial Sequence: Synthetic peptide
YEEEIASVNPVCTEQYGVVSDPLQSLNQ

SEQ ID NO: 95554 - protein, 30 aa, Artificial Sequence
  Description of Artificial Sequence: Synthetic polypeptide
YEEEIASVNPVCTEQYGVVSDPNLQMSGNQ

SEQ ID NO: 95555 - protein, 28 aa, Artificial Sequence
  Description of Artificial Sequence: Synthetic peptide
YEEEIASVNPVCTEQYGVVSDQLQSGFQ

SEQ ID NO: 95556 - protein, 29 aa, Artificial Sequence
  Description of Artificial Sequence: Synthetic peptide
YEEEIASVNPVCTEQYGVVSDSLQSGNGQ

SEQ ID NO: 95557 - protein, 28 aa, Artificial Sequence
  Description of Artificial Sequence: Synthetic peptide
YEEEIASVNPVCTEQYGVVSDVCQSGNQ

SEQ ID NO: 95558 - protein, 28 aa, Artificial Sequence
  Description of Artificial Sequence: Synthetic peptide
YEEEIASVNPVCTEQYGVVSDNQQAVNQ

SEQ ID NO: 95559 - protein, 29 aa, Artificial Sequence
  Description of Artificial Sequence: Synthetic peptide
YEEEIASVNPVCTEQYGVVYSDNLQSGEQ

SEQ ID NO: 95560 - protein, 33 aa, Artificial Sequence
  Description of Artificial Sequence: Synthetic polypeptide
DEEEIRTTNPVATEQWGSVSATGNGGQPPDAFT

SEQ ID NO: 95561 - protein, 32 aa, Artificial Sequence
  Description of Artificial Sequence: Synthetic polypeptide
DEEEIRTTNPVATEQWGSVSAEGNGGVPPGAT

SEQ ID NO: 95562 - protein, 30 aa, Artificial Sequence
  Description of Artificial Sequence: Synthetic polypeptide
YEEEIASVNPVCTEQYGVVSSDCNLQSGNQ

SEQ ID NO: 95563 - protein, 30 aa, Artificial Sequence
  Description of Artificial Sequence: Synthetic polypeptide
YEEEIASVNPVCTEQYGVVSSDNLPQSGNQ

SEQ ID NO: 95564 - protein, 30 aa, Artificial Sequence
  Description of Artificial Sequence: Synthetic polypeptide
YEEEIASVNPVCTEQYGVVSSDNLQSGNQS

SEQ ID NO: 95565 - protein, 29 aa, Artificial Sequence
  Description of Artificial Sequence: Synthetic peptide
YEEEIASVNPVCTEQYGVVSSDNLQSHNQ

SEQ ID NO: 95566 - protein, 33 aa, Artificial Sequence
  Description of Artificial Sequence: Synthetic polypeptide
DEEEIRTTNPVATECYGSVSCIAEPNDREGMNV

SEQ ID NO: 95567 - protein, 33 aa, Artificial Sequence
  Description of Artificial Sequence: Synthetic polypeptide
DEEEIRTTNPVATECYGSVSCIAEPNDRNGMNV

SEQ ID NO: 95568 - protein, 29 aa, Artificial Sequence
  Description of Artificial Sequence: Synthetic peptide
YEEEIASVNPVCTEQYGVVSSNLQSGDMQ

SEQ ID NO: 95569 - protein, 35 aa, Artificial Sequence
  Description of Artificial Sequence: Synthetic polypeptide
DEEEIRTTNPVATEQWGSTVPSGTNSSGRGGNYTI

SEQ ID NO: 95570 - protein, 31 aa, Artificial Sequence
  Description of Artificial Sequence: Synthetic polypeptide
YEEEIASVNPVCTEQYGVVSSTDNLQMSGNQ

SEQ ID NO: 95571 - protein, 31 aa, Artificial Sequence
  Description of Artificial Sequence: Synthetic polypeptide
YEEEIASVNPVCTEQYGVVSTDNDLQDSGNQ

SEQ ID NO: 95572 - protein, 32 aa, Artificial Sequence
  Description of Artificial Sequence: Synthetic polypeptide
DEEEIRTTNPVATECYGSVSGTMEGEGGEGGG

SEQ ID NO: 95573 - protein, 29 aa, Artificial Sequence
  Description of Artificial Sequence: Synthetic peptide
YEEEIASVNPVCTEQYGVVSVDNLQSSNQ

SEQ ID NO: 95574 - protein, 34 aa, Artificial Sequence
  Description of Artificial Sequence: Synthetic polypeptide
DEEEIRTTNPVATECYGSVSSCINGPNMREGENG

SEQ ID NO: 95575 - protein, 30 aa, Artificial Sequence
  Description of Artificial Sequence: Synthetic polypeptide
YEEEIASVNPVCTEQYGVVSVNLQSGPNQL

SEQ ID NO: 95576 - protein, 31 aa, Artificial Sequence
  Description of Artificial Sequence: Synthetic polypeptide
YEEEIASVNPVCTEQYGVVSVTNLQYSGQNQ

SEQ ID NO: 95577 - protein, 35 aa, Artificial Sequence
  Description of Artificial Sequence: Synthetic polypeptide
DEEEIRTTNPVATECYGSVSSTEPCLPNRNGMNPV

SEQ ID NO: 95578 - protein, 35 aa, Artificial Sequence
  Description of Artificial Sequence: Synthetic polypeptide
DEEEIRTTNPVATECYGSVSSTPNGPNMRNGMNPV

SEQ ID NO: 95579 - protein, 29 aa, Artificial Sequence
  Description of Artificial Sequence: Synthetic peptide
YEEEIASVNPVCTEQYGVVSYDNLQSGRE

SEQ ID NO: 95580 - protein, 28 aa, Artificial Sequence
  Description of Artificial Sequence: Synthetic peptide
YEEEIASVNPVCTEQYGVVVDNLQSANQ

SEQ ID NO: 95581 - protein, 29 aa, Artificial Sequence
  Description of Artificial Sequence: Synthetic peptide
YEEEIASVNPVCTEQYGVVWSDNLASGNQ

SEQ ID NO: 95582 - protein, 28 aa, Artificial Sequence
  Description of Artificial Sequence: Synthetic peptide
YEEEIASVNPVCTEQYGVVYDNQQSGNQ

SEQ ID NO: 95583 - protein, 30 aa, Artificial Sequence
  Description of Artificial Sequence: Synthetic polypeptide
YEEEIASVNPVCTEQYGVVSRDNNLQSGNQ

SEQ ID NO: 95584 - protein, 29 aa, Artificial Sequence
  Description of Artificial Sequence: Synthetic peptide
YEEEIASVNPVCTEQYGVVSPNLQSSGGQ

SEQ ID NO: 95585 - protein, 33 aa, Artificial Sequence
  Description of Artificial Sequence: Synthetic polypeptide
DEEEIRTTNPVATEQWGSVAITAPEQGGDNSAA

SEQ ID NO: 95586 - protein, 32 aa, Artificial Sequence
  Description of Artificial Sequence: Synthetic polypeptide
AEDEICATNPVATEQYGVVATSTENLQLGNGD

SEQ ID NO: 95587 - protein, 30 aa, Artificial Sequence
  Description of Artificial Sequence: Synthetic polypeptide
YEEEIASVNPVCTEQYGVVSLNLMQSQGNQ

SEQ ID NO: 95588 - protein, 33 aa, Artificial Sequence
  Description of Artificial Sequence: Synthetic polypeptide
DEEEIRTTNPVATECYGKCPSCTNEESQRVNNF

SEQ ID NO: 95589 - protein, 32 aa, Artificial Sequence
  Description of Artificial Sequence: Synthetic polypeptide
DEEEIRTTNPVATECYGKHSTRNEQQDSREFI

SEQ ID NO: 95590 - protein, 32 aa, Artificial Sequence
  Description of Artificial Sequence: Synthetic polypeptide
DEEEIRTTNPVATECYGKHSTWNAEQPPSNEF

SEQ ID NO: 95591 - protein, 32 aa, Artificial Sequence
  Description of Artificial Sequence: Synthetic polypeptide
DEEEIRTTNPVATECYGKHSTWNELQPPSEGD

SEQ ID NO: 95592 - protein, 31 aa, Artificial Sequence
  Description of Artificial Sequence: Synthetic polypeptide
DEEEIRTTNPVATECYGKHSTWNEQPNSEFE

SEQ ID NO: 95593 - protein, 31 aa, Artificial Sequence
  Description of Artificial Sequence: Synthetic polypeptide
DEEEIRTTNPVATECYGKHSTWNEQPPSEQN

SEQ ID NO: 95594 - protein, 34 aa, Artificial Sequence
  Description of Artificial Sequence: Synthetic polypeptide
DEEEIRTTNPVATEQWGSVNVTVTNNLQENEGGF

SEQ ID NO: 95595 - protein, 30 aa, Artificial Sequence
  Description of Artificial Sequence: Synthetic polypeptide
YEEEIASVNPVCTEQYGVVSMDNLQSGNQE

SEQ ID NO: 95596 - protein, 34 aa, Artificial Sequence
  Description of Artificial Sequence: Synthetic polypeptide
DEEEIRTTNPVATEQWGSVNVNNTNNLQEEEGGF

SEQ ID NO: 95597 - protein, 34 aa, Artificial Sequence
  Description of Artificial Sequence: Synthetic polypeptide
DEEEIRTTNPVATEQWGSVSATGNGGQPHAGGGF

SEQ ID NO: 95598 - protein, 34 aa, Artificial Sequence
  Description of Artificial Sequence: Synthetic polypeptide
DEEEIRTTNPVATEQWGSVHHEGILAQSFGNNRQ

SEQ ID NO: 95599 - protein, 35 aa, Artificial Sequence
  Description of Artificial Sequence: Synthetic polypeptide
DEEEIRTTNPVATECYGKTVSCTNMESNSRSGNRC

SEQ ID NO: 95600 - protein, 29 aa, Artificial Sequence
  Description of Artificial Sequence: Synthetic peptide
YEEEIASVNPVCTEQYGVVSMDNQQSGNQ

SEQ ID NO: 95601 - protein, 33 aa, Artificial Sequence
  Description of Artificial Sequence: Synthetic polypeptide
DEEEIRTTNPVATEQWGSVCWTANVMDQHMGDA

SEQ ID NO: 95602 - protein, 30 aa, Artificial Sequence
  Description of Artificial Sequence: Synthetic polypeptide
YEEEIASVNPVCTEQYGVVSNDNLQSGNQH

SEQ ID NO: 95603 - protein, 29 aa, Artificial Sequence
  Description of Artificial Sequence: Synthetic peptide
YEEEIASVNPVCTEQYGVVSNDNLQSMNQ

SEQ ID NO: 95604 - protein, 29 aa, Artificial Sequence
  Description of Artificial Sequence: Synthetic peptide
YEEEIASVNPVCTEQYGVVSNNIQSSGNQ

SEQ ID NO: 95605 - protein, 29 aa, Artificial Sequence
  Description of Artificial Sequence: Synthetic peptide
YEEEIASVNPVCTEQYGVVSNNLQSVGQQ

SEQ ID NO: 95606 - protein, 33 aa, Artificial Sequence
  Description of Artificial Sequence: Synthetic polypeptide
DEEEIRTTNPVATEQWGSVAPTWNDHQERDMQD

SEQ ID NO: 95607 - protein, 33 aa, Artificial Sequence
  Description of Artificial Sequence: Synthetic polypeptide
DEEEIRTTNPVATEQWGSVAPTWNDHQEQDHMR

SEQ ID NO: 95608 - protein, 32 aa, Artificial Sequence
  Description of Artificial Sequence: Synthetic polypeptide
DEEEIRTTNPVATEQWGSVANAGNLTGAATDR

SEQ ID NO: 95609 - protein, 29 aa, Artificial Sequence
  Description of Artificial Sequence: Synthetic peptide
YEEEIASVNPVCTEQYGVVSMDNLQSGYQ

SEQ ID NO: 95610 - protein, 34 aa, Artificial Sequence
  Description of Artificial Sequence: Synthetic polypeptide
TEEEIRTTNPVATEAYGSVSTGNGSQAIGTNNHL

SEQ ID NO: 95611 - protein, 33 aa, Artificial Sequence
  Description of Artificial Sequence: Synthetic polypeptide
DEEEIRTTNPVATEQYGCVCSNWNHQNFNSDQG

SEQ ID NO: 95612 - protein, 36 aa, Artificial Sequence
  Description of Artificial Sequence: Synthetic polypeptide
TEEEIRTTNPVATEAYGQSVVGTNLPQSRTVGNQRY

SEQ ID NO: 95613 - protein, 34 aa, Artificial Sequence
  Description of Artificial Sequence: Synthetic polypeptide
AEEEIRTTNPVATEQYGSVSTSTNQQQTEGEDED

SEQ ID NO: 95614 - protein, 34 aa, Artificial Sequence
  Description of Artificial Sequence: Synthetic polypeptide
AEEEIRTTNPVATEQYGSVSTSTNQQQQTEGTIS

SEQ ID NO: 95615 - protein, 34 aa, Artificial Sequence
  Description of Artificial Sequence: Synthetic polypeptide
AEEEIRTTNPVATEQYGSVSTSTNQQNQTEGEED

SEQ ID NO: 95616 - protein, 35 aa, Artificial Sequence
  Description of Artificial Sequence: Synthetic polypeptide
AEEEIRTTNPVATEQYGSVSTSTNQQLQGNDENQD

SEQ ID NO: 95617 - protein, 34 aa, Artificial Sequence
  Description of Artificial Sequence: Synthetic polypeptide
AEEEIRTTNPVATEQYGSVSTSTNQQGTEGEEDT

SEQ ID NO: 95618 - protein, 35 aa, Artificial Sequence
  Description of Artificial Sequence: Synthetic polypeptide
AEEEIRTTNPVATEQYGSVSTSTNNQNDESGNNND

SEQ ID NO: 95619 - protein, 34 aa, Artificial Sequence
  Description of Artificial Sequence: Synthetic polypeptide
AEEEIRTTNPVATEQYGSVSTSTNNNNDEAGNAD

SEQ ID NO: 95620 - protein, 34 aa, Artificial Sequence
  Description of Artificial Sequence: Synthetic polypeptide
AEEEIRTTNPVATEQYGSVSTSTNNNLDESTNLD

SEQ ID NO: 95621 - protein, 32 aa, Artificial Sequence
  Description of Artificial Sequence: Synthetic polypeptide
DEEEIRTTNPCAYEQWGSVCYNIENQRDGNDS

SEQ ID NO: 95622 - protein, 34 aa, Artificial Sequence
  Description of Artificial Sequence: Synthetic polypeptide
AEEEIRTTNPVATEQYGSVSTSTNNNDEYGTNSD

SEQ ID NO: 95623 - protein, 31 aa, Artificial Sequence
  Description of Artificial Sequence: Synthetic polypeptide
DEEEIRTTNPCAYEQWGSVPTWDLDDRKGVE

SEQ ID NO: 95624 - protein, 31 aa, Artificial Sequence
  Description of Artificial Sequence: Synthetic polypeptide
DEEEIRTTNPCAYEQWGSVPTWDLDLRGTEN

SEQ ID NO: 95625 - protein, 35 aa, Artificial Sequence
  Description of Artificial Sequence: Synthetic polypeptide
AEEEIRTTNPVATEQYGSVSTSTNNDQAGNGTNNV

SEQ ID NO: 95626 - protein, 30 aa, Artificial Sequence
  Description of Artificial Sequence: Synthetic polypeptide
DEEEIRTTNPCAYEQWGSVRTWDLADMGKE

SEQ ID NO: 95627 - protein, 35 aa, Artificial Sequence
  Description of Artificial Sequence: Synthetic polypeptide
AEEEIRTTNPVATEQYGSVSTSTNLQQGSTDEEDQ

SEQ ID NO: 95628 - protein, 33 aa, Artificial Sequence
  Description of Artificial Sequence: Synthetic polypeptide
DEEEIRTTNPVATEQYGCVSTGNAHQENFMSDQ

SEQ ID NO: 95629 - protein, 33 aa, Artificial Sequence
  Description of Artificial Sequence: Synthetic polypeptide
DEEEIRTTNPCAYEQWGSVYCTDNDQHREGNHA

SEQ ID NO: 95630 - protein, 33 aa, Artificial Sequence
  Description of Artificial Sequence: Synthetic polypeptide
DEEEIRTTNPCAYEQWGSVYCTDNDQHRGHNHM

SEQ ID NO: 95631 - protein, 34 aa, Artificial Sequence
  Description of Artificial Sequence: Synthetic polypeptide
DEEEIRTTNPCAYEQWGSVYCTDNEDLQREGNHA

SEQ ID NO: 95632 - protein, 35 aa, Artificial Sequence
  Description of Artificial Sequence: Synthetic polypeptide
AEEEIRTTNPVATEQYGSVSTSQNQDTQNGTNNDE

SEQ ID NO: 95633 - protein, 32 aa, Artificial Sequence
  Description of Artificial Sequence: Synthetic polypeptide
DEEEIRTTNPVATEQYGCVSTGEHIFFGSDQE

SEQ ID NO: 95634 - protein, 34 aa, Artificial Sequence
  Description of Artificial Sequence: Synthetic polypeptide
AEEEIRTTNPVATEQYGSVSTSTNQQQTEGTILN

SEQ ID NO: 95635 - protein, 32 aa, Artificial Sequence
  Description of Artificial Sequence: Synthetic polypeptide
DEEEIRTTNPVATEQYGCVSTGEHANFGSEQS

SEQ ID NO: 95636 - protein, 34 aa, Artificial Sequence
  Description of Artificial Sequence: Synthetic polypeptide
AEEEIRTTNPVATEQYGSVSTSTNQQQTENGETD

SEQ ID NO: 95637 - protein, 36 aa, Artificial Sequence
  Description of Artificial Sequence: Synthetic polypeptide
AEEEIRTTNPVATEQYGSVSTSTTNLQQGTNQQEDE

SEQ ID NO: 95638 - protein, 35 aa, Artificial Sequence
  Description of Artificial Sequence: Synthetic polypeptide
AEEEIRTTNPVATEQYGSVSTTDNLNNEENGNNQE

SEQ ID NO: 95639 - protein, 35 aa, Artificial Sequence
  Description of Artificial Sequence: Synthetic polypeptide
AEEEIRTTNPVATEQYGSVSTTDNLNNEEGNNQGN

SEQ ID NO: 95640 - protein, 35 aa, Artificial Sequence
  Description of Artificial Sequence: Synthetic polypeptide
AEEEIRTTNPVATEQYGSVSTTDGNNNNLQGTNDE

SEQ ID NO: 95641 - protein, 34 aa, Artificial Sequence
  Description of Artificial Sequence: Synthetic polypeptide
AEEEIRTTNPVATEQYGSVSTTDGNGTDGGNGTE

SEQ ID NO: 95642 - protein, 32 aa, Artificial Sequence
  Description of Artificial Sequence: Synthetic polypeptide
DEEEIRTTNPCAYAQYGQTVPCTDLSQRGGNF

SEQ ID NO: 95643 - protein, 33 aa, Artificial Sequence
  Description of Artificial Sequence: Synthetic polypeptide
DEEEIRTTNPCAYDQYGQVVACTNDLSQRGNNS

SEQ ID NO: 95644 - protein, 32 aa, Artificial Sequence
  Description of Artificial Sequence: Synthetic polypeptide
DEEEIRTTNPCAYEAYGCVACTNSHQGRGGNA

SEQ ID NO: 95645 - protein, 35 aa, Artificial Sequence
  Description of Artificial Sequence: Synthetic polypeptide
AEEEIRTTNPVATEQYGSVSTTANQNQEQGTNDET

SEQ ID NO: 95646 - protein, 31 aa, Artificial Sequence
  Description of Artificial Sequence: Synthetic polypeptide
DEEEIRTTNPCAYEAYGSVACTNHGRGGEAS

SEQ ID NO: 95647 - protein, 32 aa, Artificial Sequence
  Description of Artificial Sequence: Synthetic polypeptide
DEEEIRTTNPCAYEAYGSVQACTNGHGRGGNA

SEQ ID NO: 95648 - protein, 34 aa, Artificial Sequence
  Description of Artificial Sequence: Synthetic polypeptide
AEEEIRTTNPVATEQYGSVSTTANQNDEEGGNEG

SEQ ID NO: 95649 - protein, 36 aa, Artificial Sequence
  Description of Artificial Sequence: Synthetic polypeptide
AEEEIRTTNPVATEQYGSVSTTANLQQGNNNTNNSN

SEQ ID NO: 95650 - protein, 36 aa, Artificial Sequence
  Description of Artificial Sequence: Synthetic polypeptide
AEEEIRTTNPVATEQYGSVSTTANLQAGETNEEDEE

SEQ ID NO: 95651 - protein, 34 aa, Artificial Sequence
  Description of Artificial Sequence: Synthetic polypeptide
AEEEIRTTNPVATEQYGSVSTSVNQQQTNIGTIS

SEQ ID NO: 95652 - protein, 34 aa, Artificial Sequence
  Description of Artificial Sequence: Synthetic polypeptide
AEEEIRTTNPVATEQYGSVSTSVNQQQTNGTIID

SEQ ID NO: 95653 - protein, 33 aa, Artificial Sequence
  Description of Artificial Sequence: Synthetic polypeptide
DEEEIRTTNPVATEQYGCVSTNDHQEHFMSEQS

SEQ ID NO: 95654 - protein, 34 aa, Artificial Sequence
  Description of Artificial Sequence: Synthetic polypeptide
AEEEIRTTNPVATEQYGSVSTSVNQQQTETGEDE

SEQ ID NO: 95655 - protein, 34 aa, Artificial Sequence
  Description of Artificial Sequence: Synthetic polypeptide
AEEEIRTTNPVATEQYGSVSTSVNQQQTEQGTIA

SEQ ID NO: 95656 - protein, 33 aa, Artificial Sequence
  Description of Artificial Sequence: Synthetic polypeptide
DEEEIRTTNPVATEQYGCVSTNDEFGGITQFEC

SEQ ID NO: 95657 - protein, 33 aa, Artificial Sequence
  Description of Artificial Sequence: Synthetic polypeptide
AEEEIRTTNPVATEQYGSVSTSVNQQQTEDEIA

SEQ ID NO: 95658 - protein, 34 aa, Artificial Sequence
  Description of Artificial Sequence: Synthetic polypeptide
AEEEIRTTNPVATEQYGSVSTSVNQQGQTQGTID

SEQ ID NO: 95659 - protein, 35 aa, Artificial Sequence
  Description of Artificial Sequence: Synthetic polypeptide
AEEEIRTTNPVATEQYGSVSTSTQNLQNGEDEQEN

SEQ ID NO: 95660 - protein, 33 aa, Artificial Sequence
  Description of Artificial Sequence: Synthetic polypeptide
DEEEIRTTNPVATEQYGCVSTEWDLGAVNSDGD

SEQ ID NO: 95661 - protein, 33 aa, Artificial Sequence
  Description of Artificial Sequence: Synthetic polypeptide
DEEEIRTTNPCAYEQYGSVATNLQGTPAEDANL

SEQ ID NO: 95662 - protein, 32 aa, Artificial Sequence
  Description of Artificial Sequence: Synthetic polypeptide
DEEEIRTTNPCAYEQYGSVPCTHLSARGGSEP

SEQ ID NO: 95663 - protein, 32 aa, Artificial Sequence
  Description of Artificial Sequence: Synthetic polypeptide
DEEEIRTTNPEATCQYGCVCPTDLNQSFGSNQ

SEQ ID NO: 95664 - protein, 32 aa, Artificial Sequence
  Description of Artificial Sequence: Synthetic polypeptide
DEEEIRTTNPEATCQYGCVCPTELNQHGSNFS

SEQ ID NO: 95665 - protein, 33 aa, Artificial Sequence
  Description of Artificial Sequence: Synthetic polypeptide
DEEEIRTTNPVATEQYGCVSTEELTEFFGSEQS

SEQ ID NO: 95666 - protein, 33 aa, Artificial Sequence
  Description of Artificial Sequence: Synthetic polypeptide
SEEEIRTTNPVATEQYGSVSTTADAQEIGIQQE

SEQ ID NO: 95667 - protein, 34 aa, Artificial Sequence
  Description of Artificial Sequence: Synthetic polypeptide
AEEEIRTTNPVATEQYGSVSTSNQGANENGNEGG

SEQ ID NO: 95668 - protein, 34 aa, Artificial Sequence
  Description of Artificial Sequence: Synthetic polypeptide
AEEEIRTTNPVATEQYGSVSTSNQGANEGGNQGG

SEQ ID NO: 95669 - protein, 35 aa, Artificial Sequence
  Description of Artificial Sequence: Synthetic polypeptide
AEEEIRTTNPVATEQYGSVSTSNNTTEQYGNTNGV

SEQ ID NO: 95670 - protein, 31 aa, Artificial Sequence
  Description of Artificial Sequence: Synthetic polypeptide
DEEEIRTTNPEATEEYGCVCQTNHGNGSNAM

SEQ ID NO: 95671 - protein, 34 aa, Artificial Sequence
  Description of Artificial Sequence: Synthetic polypeptide
AEEEIRTTNPVATEQYGSVSTSNNQQQTTNNIGD

SEQ ID NO: 95672 - protein, 30 aa, Artificial Sequence
  Description of Artificial Sequence: Synthetic polypeptide
DEEEIRTTNPEATEQWGTVPTDLANPGDEQ

SEQ ID NO: 95673 - protein, 31 aa, Artificial Sequence
  Description of Artificial Sequence: Synthetic polypeptide
DEEEIRTTNPEATEQWGTVPTDLARGMDGEM

SEQ ID NO: 95674 - protein, 34 aa, Artificial Sequence
  Description of Artificial Sequence: Synthetic polypeptide
AEEEIRTTNPVATEQYGSVSTSNNQQQTNQGTEA

SEQ ID NO: 95675 - protein, 31 aa, Artificial Sequence
  Description of Artificial Sequence: Synthetic polypeptide
DEEEIRTTNPEATEQYGCVCPNTELAHGSEQ

SEQ ID NO: 95676 - protein, 32 aa, Artificial Sequence
  Description of Artificial Sequence: Synthetic polypeptide
DEEEIRTTNPVATEQYGCVSTDQDNFIENLQE

SEQ ID NO: 95677 - protein, 35 aa, Artificial Sequence
  Description of Artificial Sequence: Synthetic polypeptide
AEEEIRTTNPVATEQYGSVSTSNNQQQQGNGNIAE

SEQ ID NO: 95678 - protein, 31 aa, Artificial Sequence
  Description of Artificial Sequence: Synthetic polypeptide
DEEEIRTTNPEATEQYGCVCPTALANGSEQA

SEQ ID NO: 95679 - protein, 35 aa, Artificial Sequence
  Description of Artificial Sequence: Synthetic polypeptide
AEEEIRTTNPVATEQYGSVSTSNNQQGQTTNEQIG

SEQ ID NO: 95680 - protein, 32 aa, Artificial Sequence
  Description of Artificial Sequence: Synthetic polypeptide
DEEEIRTTNPEATEQYGCVCPTELAERFGSDA

SEQ ID NO: 95681 - protein, 34 aa, Artificial Sequence
  Description of Artificial Sequence: Synthetic polypeptide
SEEEIRTTNPVATEQYGSVSVPNLLDENPIEDQR

SEQ ID NO: 95682 - protein, 35 aa, Artificial Sequence
  Description of Artificial Sequence: Synthetic polypeptide
AEEEIRTTNPVATEQYGSVSTSNNQQGQTTGNIGE

SEQ ID NO: 95683 - protein, 35 aa, Artificial Sequence
  Description of Artificial Sequence: Synthetic polypeptide
AEEEIRTTNPVATEQYGSVSTSNNNQQQGNGNEGE

SEQ ID NO: 95684 - protein, 34 aa, Artificial Sequence
  Description of Artificial Sequence: Synthetic polypeptide
AEEEIRTTNPVATEQYGSVSTSNQGNANEGNNGG

SEQ ID NO: 95685 - protein, 34 aa, Artificial Sequence
  Description of Artificial Sequence: Synthetic polypeptide
AEEEIRTTNPVATEQYGSVSTSNQGNANENGNNG

SEQ ID NO: 95686 - protein, 34 aa, Artificial Sequence
  Description of Artificial Sequence: Synthetic polypeptide
AEEEIRTTNPVATEQYGSVSTSNQNANEEGTNGG

SEQ ID NO: 95687 - protein, 32 aa, Artificial Sequence
  Description of Artificial Sequence: Synthetic polypeptide
DEEEIRTTNPVATEQYGCVSTEHAEFFNSNQP

SEQ ID NO: 95688 - protein, 32 aa, Artificial Sequence
  Description of Artificial Sequence: Synthetic polypeptide
DEEEIRTTNPCAYEYYGSVAYTNEHSARGGNA

SEQ ID NO: 95689 - protein, 29 aa, Artificial Sequence
  Description of Artificial Sequence: Synthetic peptide
DEEEIRTTNPCAYMGYGQVPTDLQHGASF

SEQ ID NO: 95690 - protein, 34 aa, Artificial Sequence
  Description of Artificial Sequence: Synthetic polypeptide
AEEEIRTTNPVATEQYGSVSTSQNNDEQGNNQDT

SEQ ID NO: 95691 - protein, 35 aa, Artificial Sequence
  Description of Artificial Sequence: Synthetic polypeptide
AEEEIRTTNPVATEQYGSVSTSQNNDEQGIGTNQD

SEQ ID NO: 95692 - protein, 29 aa, Artificial Sequence
  Description of Artificial Sequence: Synthetic peptide
DEEEIRTTNPCAYMQYGQACPTDLQHGAF

SEQ ID NO: 95693 - protein, 29 aa, Artificial Sequence
  Description of Artificial Sequence: Synthetic peptide
DEEEIRTTNPCAYMQYGQCPTDLQHGDAF

SEQ ID NO: 95694 - protein, 36 aa, Artificial Sequence
  Description of Artificial Sequence: Synthetic polypeptide
AEEEIRTTNPVATEQYGSVSTSQNLQQGNGNGNIGN

SEQ ID NO: 95695 - protein, 31 aa, Artificial Sequence
  Description of Artificial Sequence: Synthetic polypeptide
DEEEIRTTNPCAYMQYGQVPTADLQRDANFH

SEQ ID NO: 95696 - protein, 29 aa, Artificial Sequence
  Description of Artificial Sequence: Synthetic peptide
DEEEIRTTNPCAYMQYGQVPTDIQPHGAF

SEQ ID NO: 95697 - protein, 31 aa, Artificial Sequence
  Description of Artificial Sequence: Synthetic polypeptide
DEEEIRTTNPCAYMQYGQVPTDLQRDGAQFH

SEQ ID NO: 95698 - protein, 33 aa, Artificial Sequence
  Description of Artificial Sequence: Synthetic polypeptide
DEEEIRTTNPCAVEQYGSCVCVNSDYGQGRNNR

SEQ ID NO: 95699 - protein, 34 aa, Artificial Sequence
  Description of Artificial Sequence: Synthetic polypeptide
AEEEIRTTNPVATEQYGSVSTSQNLQNQEDETED

SEQ ID NO: 95700 - protein, 35 aa, Artificial Sequence
  Description of Artificial Sequence: Synthetic polypeptide
AEEEIRTTNPVATEQYGSVSTSQNLNQNGEDEQTQ

SEQ ID NO: 95701 - protein, 34 aa, Artificial Sequence
  Description of Artificial Sequence: Synthetic polypeptide
AEEEIRTTNPVATEQYGSVSTSQNLGQNEDEQEN

SEQ ID NO: 95702 - protein, 35 aa, Artificial Sequence
  Description of Artificial Sequence: Synthetic polypeptide
AEEEIRTTNPVATEQYGSVSTSNTNNLNQQSTNQE

SEQ ID NO: 95703 - protein, 34 aa, Artificial Sequence
  Description of Artificial Sequence: Synthetic polypeptide
AEEEIRTTNPVATEQYGSVSTSNTNEQYGSTGGT

SEQ ID NO: 95704 - protein, 34 aa, Artificial Sequence
  Description of Artificial Sequence: Synthetic polypeptide
AEEEIRTTNPVATEQYGSVSTSNTAEQYGSTEGG

SEQ ID NO: 95705 - protein, 35 aa, Artificial Sequence
  Description of Artificial Sequence: Synthetic polypeptide
AEEEIRTTNPVATEQYGSVSTSNQQQQNGNEQIGN

SEQ ID NO: 95706 - protein, 35 aa, Artificial Sequence
  Description of Artificial Sequence: Synthetic polypeptide
AEEEIRTTNPVATEQYGSVSTSNQQQQIGNGNIGT

SEQ ID NO: 95707 - protein, 34 aa, Artificial Sequence
  Description of Artificial Sequence: Synthetic polypeptide
AEEEIRTTNPVATEQYGSVSTSNQQNQAGEIGTE

SEQ ID NO: 95708 - protein, 34 aa, Artificial Sequence
  Description of Artificial Sequence: Synthetic polypeptide
SEEEIRTTNPVATEQYGSVSTSNIEGQGGGEGED

SEQ ID NO: 95709 - protein, 34 aa, Artificial Sequence
  Description of Artificial Sequence: Synthetic polypeptide
DEEEIRTTNPDATEQYGSVCSTISLNQLTDNKEW

SEQ ID NO: 95710 - protein, 34 aa, Artificial Sequence
  Description of Artificial Sequence: Synthetic polypeptide
DEEEIRTTNPVATEQYGCVSTENDLPQPDVIDSF

SEQ ID NO: 95711 - protein, 30 aa, Artificial Sequence
  Description of Artificial Sequence: Synthetic polypeptide
DEEEIRTTNPCATTQYGTVATTQQGTTNNA

SEQ ID NO: 95712 - protein, 30 aa, Artificial Sequence
  Description of Artificial Sequence: Synthetic polypeptide
DEEEIRTTNPCATTQYGTVATTQQGTNNNG

SEQ ID NO: 95713 - protein, 30 aa, Artificial Sequence
  Description of Artificial Sequence: Synthetic polypeptide
DEEEIRTTNPCATTQYGTVATTQAGTNANN

SEQ ID NO: 95714 - protein, 33 aa, Artificial Sequence
  Description of Artificial Sequence: Synthetic polypeptide
DEEEIRTTNPCATEQYGSVSPVNGEQELIENVE

SEQ ID NO: 95715 - protein, 32 aa, Artificial Sequence
  Description of Artificial Sequence: Synthetic polypeptide
DEEEIRTTNPVATEQYGCVSTVDQHQSSMDEV

SEQ ID NO: 95716 - protein, 35 aa, Artificial Sequence
  Description of Artificial Sequence: Synthetic polypeptide
AEEEIRTTNPVATEQYGSVSTTNGENQGNQGGNGT

SEQ ID NO: 95717 - protein, 32 aa, Artificial Sequence
  Description of Artificial Sequence: Synthetic polypeptide
DEEEIRTTNPCATEQYGSVSPVNNIPIMVNDQ

SEQ ID NO: 95718 - protein, 31 aa, Artificial Sequence
  Description of Artificial Sequence: Synthetic polypeptide
DEEEIRTTNPCATEQYGSVSPVNWPIVSQDG

SEQ ID NO: 95719 - protein, 32 aa, Artificial Sequence
  Description of Artificial Sequence: Synthetic polypeptide
DEEEIRTTNPCATEQYGSVSPVNWPIVVASND

SEQ ID NO: 95720 - protein, 33 aa, Artificial Sequence
  Description of Artificial Sequence: Synthetic polypeptide
DEEEIRTTNPCATEQYGSVSQNIPFGHGDNSDD

SEQ ID NO: 95721 - protein, 34 aa, Artificial Sequence
  Description of Artificial Sequence: Synthetic polypeptide
AEEEIRTTNPVATEQYGSVSTTNGAEQQGTEEED

SEQ ID NO: 95722 - protein, 35 aa, Artificial Sequence
  Description of Artificial Sequence: Synthetic polypeptide
DEEEIRTTNPCATEQYGSVSSTTPALPNMRNGNPV

SEQ ID NO: 95723 - protein, 36 aa, Artificial Sequence
  Description of Artificial Sequence: Synthetic polypeptide
DEEEIRTTNPCATEQYGSVSTVNLQAGTEQGNNDDE

SEQ ID NO: 95724 - protein, 35 aa, Artificial Sequence
  Description of Artificial Sequence: Synthetic polypeptide
DEEEIRTTNPVATEQYGCVSTSNDLLQLGGMEEHQ

SEQ ID NO: 95725 - protein, 35 aa, Artificial Sequence
  Description of Artificial Sequence: Synthetic polypeptide
DEEEIRTTNPCATEQYGSVSTVVNNIQEQGNNVDE

SEQ ID NO: 95726 - protein, 33 aa, Artificial Sequence
  Description of Artificial Sequence: Synthetic polypeptide
DEEEIRTTNPCATEQYGSVSVTETTERGVLEDE

SEQ ID NO: 95727 - protein, 35 aa, Artificial Sequence
  Description of Artificial Sequence: Synthetic polypeptide
DEEEIRTTNPCATEQYGSVSVTNDIGFARVGDNGD

SEQ ID NO: 95728 - protein, 33 aa, Artificial Sequence
  Description of Artificial Sequence: Synthetic polypeptide
DEEEIRTTNPVATEQYGCVSTPDHQERFMSDQS

SEQ ID NO: 95729 - protein, 36 aa, Artificial Sequence
  Description of Artificial Sequence: Synthetic polypeptide
DEEEIRTTNPCATEQYGSVSVTTNNLQLQQGTNSAE

SEQ ID NO: 95730 - protein, 36 aa, Artificial Sequence
  Description of Artificial Sequence: Synthetic polypeptide
DEEEIRTTNPCATEQYGSVSVTTNNQLNQQGTNSAT

SEQ ID NO: 95731 - protein, 36 aa, Artificial Sequence
  Description of Artificial Sequence: Synthetic polypeptide
DEEEIRTTNPCATEQYGSVSVVTNLENLQQGTNSAE

SEQ ID NO: 95732 - protein, 36 aa, Artificial Sequence
  Description of Artificial Sequence: Synthetic polypeptide
DEEEIRTTNPCATEQYGSVSVVTNLNQLQQGTNVAT

SEQ ID NO: 95733 - protein, 36 aa, Artificial Sequence
  Description of Artificial Sequence: Synthetic polypeptide
DEEEIRTTNPCATEQYGSVSVVTNLQQLQQGTNSTN

SEQ ID NO: 95734 - protein, 36 aa, Artificial Sequence
  Description of Artificial Sequence: Synthetic polypeptide
DEEEIRTTNPCATEQYGSVSVVTNNNQLQQGTNSAN

SEQ ID NO: 95735 - protein, 32 aa, Artificial Sequence
  Description of Artificial Sequence: Synthetic polypeptide
DEEEIRTTNPCATEQYGSVSPVMNIGPIVNDL

SEQ ID NO: 95736 - protein, 32 aa, Artificial Sequence
  Description of Artificial Sequence: Synthetic polypeptide
DEEEIRTTNPCATEQYGSVSPVMNGWPIVSND

SEQ ID NO: 95737 - protein, 32 aa, Artificial Sequence
  Description of Artificial Sequence: Synthetic polypeptide
DEEEIRTTNPCATEQYGSVSPVLIPEIVSNDD

SEQ ID NO: 95738 - protein, 35 aa, Artificial Sequence
  Description of Artificial Sequence: Synthetic polypeptide
AEEEIRTTNPVATEQYGSVSTTNGEQGNENGNDTN

SEQ ID NO: 95739 - protein, 35 aa, Artificial Sequence
  Description of Artificial Sequence: Synthetic polypeptide
AEEEIRTTNPVATEQYGSVSTTNGNQQGNTNNDDG

SEQ ID NO: 95740 - protein, 35 aa, Artificial Sequence
  Description of Artificial Sequence: Synthetic polypeptide
AEEEIRTTNPVATEQYGSVSTTNGNQQGNQNNDEA

SEQ ID NO: 95741 - protein, 35 aa, Artificial Sequence
  Description of Artificial Sequence: Synthetic polypeptide
AEEEIRTTNPVATEQYGSVSTTNGNQQGNQGNIGD

SEQ ID NO: 95742 - protein, 35 aa, Artificial Sequence
  Description of Artificial Sequence: Synthetic polypeptide
AEEEIRTTNPVATEQYGSVSTTNGNQNQQGTNIGT

SEQ ID NO: 95743 - protein, 34 aa, Artificial Sequence
  Description of Artificial Sequence: Synthetic polypeptide
AEEEIRTTNPVATEQYGSVSTTNGNQGNNNNDDE

SEQ ID NO: 95744 - protein, 34 aa, Artificial Sequence
  Description of Artificial Sequence: Synthetic polypeptide
AEEEIRTTNPVATEQYGSVSTTNGNNQGNQNDDE

SEQ ID NO: 95745 - protein, 32 aa, Artificial Sequence
  Description of Artificial Sequence: Synthetic polypeptide
DEEEIRTTNPCATEQYGSVPEALQAEGLEIEC

SEQ ID NO: 95746 - protein, 32 aa, Artificial Sequence
  Description of Artificial Sequence: Synthetic polypeptide
DEEEIRTTNPCATEQYGSVPEALQAETGPVVN

SEQ ID NO: 95747 - protein, 32 aa, Artificial Sequence
  Description of Artificial Sequence: Synthetic polypeptide
DEEEIRTTNPCATEQYGSVPEALQALMGPVQN

SEQ ID NO: 95748 - protein, 35 aa, Artificial Sequence
  Description of Artificial Sequence: Synthetic polypeptide
AEEEIRTTNPVATEQYGSVSTTNGNLQQANTNNSE

SEQ ID NO: 95749 - protein, 36 aa, Artificial Sequence
  Description of Artificial Sequence: Synthetic polypeptide
DEEEIRTTNPCATEQYGSVSVVTTNLNLQQGTNSAT

SEQ ID NO: 95750 - protein, 35 aa, Artificial Sequence
  Description of Artificial Sequence: Synthetic polypeptide
AEEEIRTTNPVATEQYGSVSTTNGEQQGNQGGNTE

SEQ ID NO: 95751 - protein, 33 aa, Artificial Sequence
  Description of Artificial Sequence: Synthetic polypeptide
DEEEIRTTNPCATEQYGSVPVTALQGTGLDIES

SEQ ID NO: 95752 - protein, 36 aa, Artificial Sequence
  Description of Artificial Sequence: Synthetic polypeptide
AEEEIRTTNPVATEQYGSVSTTNGEQLGNQQGNETE

SEQ ID NO: 95753 - protein, 32 aa, Artificial Sequence
  Description of Artificial Sequence: Synthetic polypeptide
DEEEIRTTNPCATEQYGSVPVTALVAEGAQIE

SEQ ID NO: 95754 - protein, 35 aa, Artificial Sequence
  Description of Artificial Sequence: Synthetic polypeptide
AEEEIRTTNPVATEQYGSVSTTNGEQGNQQGNETE

SEQ ID NO: 95755 - protein, 32 aa, Artificial Sequence
  Description of Artificial Sequence: Synthetic polypeptide
DEEEIRTTNPCATEQYGSVSMVNIVTVMNLDE

SEQ ID NO: 95756 - protein, 33 aa, Artificial Sequence
  Description of Artificial Sequence: Synthetic polypeptide
SEEEIRTTNPVATEQYGSVCSDDNQGGQGGEGD

SEQ ID NO: 95757 - protein, 34 aa, Artificial Sequence
  Description of Artificial Sequence: Synthetic polypeptide
DEEEIRTTNPVATEQYGCVSTVTDGEQGEGGNET

SEQ ID NO: 95758 - protein, 32 aa, Artificial Sequence
  Description of Artificial Sequence: Synthetic polypeptide
DEEEIRTTNPVATEQYGCVSTVPAMPEVMNFE

SEQ ID NO: 95759 - protein, 33 aa, Artificial Sequence
  Description of Artificial Sequence: Synthetic polypeptide
SEEEIRTTNPVATEQYGSVCSPTNDELEDNDQV

SEQ ID NO: 95760 - protein, 35 aa, Artificial Sequence
  Description of Artificial Sequence: Synthetic polypeptide
AEEEIRTTNPVATEQYGSVSTTNGEQGNQGGNNTQ

SEQ ID NO: 95761 - protein, 34 aa, Artificial Sequence
  Description of Artificial Sequence: Synthetic polypeptide
DEEEIRTTNPVATEQYGCVSVSGNLNQNFVSQQS

SEQ ID NO: 95762 - protein, 33 aa, Artificial Sequence
  Description of Artificial Sequence: Synthetic polypeptide
SEEEIRTTNPVATEQYGSVSVTTQLGETQEDME

SEQ ID NO: 95763 - protein, 36 aa, Artificial Sequence
  Description of Artificial Sequence: Synthetic polypeptide
DEEEIRTTNPCATEQYGSVSVVTVNNNQLQQGTNSA

SEQ ID NO: 95764 - protein, 36 aa, Artificial Sequence
  Description of Artificial Sequence: Synthetic polypeptide
AEEEIRTTNPVATEQYGSVSTTNDNLQEGIGNNQIG

SEQ ID NO: 95765 - protein, 36 aa, Artificial Sequence
  Description of Artificial Sequence: Synthetic polypeptide
AEEEIRTTNPVATEQYGSVSTTGVNLQSGTTENSET

SEQ ID NO: 95766 - protein, 34 aa, Artificial Sequence
  Description of Artificial Sequence: Synthetic polypeptide
AEEEIRTTNPVATEQYGSVSTTGTDGNNNIGTNM

SEQ ID NO: 95767 - protein, 34 aa, Artificial Sequence
  Description of Artificial Sequence: Synthetic polypeptide
AEEEIRTTNPVATEQYGSVSTTGNQQGNTNNTED

SEQ ID NO: 95768 - protein, 35 aa, Artificial Sequence
  Description of Artificial Sequence: Synthetic polypeptide
AEEEIRTTNPVATEQYGSVSTTGNNQQGNQNNDES

SEQ ID NO: 95769 - protein, 34 aa, Artificial Sequence
  Description of Artificial Sequence: Synthetic polypeptide
SEEEIRTTNPVATEQYGSVSIMGDNDQRNQGEGD

SEQ ID NO: 95770 - protein, 34 aa, Artificial Sequence
  Description of Artificial Sequence: Synthetic polypeptide
AEEEIRTTNPVATEQYGSVSTTGNNNNNQDNNGS

SEQ ID NO: 95771 - protein, 36 aa, Artificial Sequence
  Description of Artificial Sequence: Synthetic polypeptide
AEEEIRTTNPVATEQYGSVSTTGNLQSGTDTGNTNE

SEQ ID NO: 95772 - protein, 34 aa, Artificial Sequence
  Description of Artificial Sequence: Synthetic polypeptide
AEEEIRTTNPVATEQYGSVSTTGNINDEQGTNDE

SEQ ID NO: 95773 - protein, 33 aa, Artificial Sequence
  Description of Artificial Sequence: Synthetic polypeptide
DEEEIRTTNPCATERYGKTVQSQNLSQNGGNND

SEQ ID NO: 95774 - protein, 32 aa, Artificial Sequence
  Description of Artificial Sequence: Synthetic polypeptide
SEEEIRTTNPVATEQYGSVSPTDLEEKDSQIM

SEQ ID NO: 95775 - protein, 33 aa, Artificial Sequence
  Description of Artificial Sequence: Synthetic polypeptide
SEEEIRTTNPVATEQYGSVSPTNKHSDEKSMSR

SEQ ID NO: 95776 - protein, 31 aa, Artificial Sequence
  Description of Artificial Sequence: Synthetic polypeptide
DEEEIRTTNPCATESYGSVALTNHPMRQVVD

SEQ ID NO: 95777 - protein, 32 aa, Artificial Sequence
  Description of Artificial Sequence: Synthetic polypeptide
DEEEIRTTNPCATESYGSVALTNHQPRQVVGL

SEQ ID NO: 95778 - protein, 30 aa, Artificial Sequence
  Description of Artificial Sequence: Synthetic polypeptide
DEEEIRTTNPCATTQYGNVATDQYGTTNNE

SEQ ID NO: 95779 - protein, 30 aa, Artificial Sequence
  Description of Artificial Sequence: Synthetic polypeptide
DEEEIRTTNPCATTQYGTVATEQYGTTNGE

SEQ ID NO: 95780 - protein, 34 aa, Artificial Sequence
  Description of Artificial Sequence: Synthetic polypeptide
SEEEIRTTNPVATEQYGSVSSTEPAGNMRNGNPV

SEQ ID NO: 95781 - protein, 35 aa, Artificial Sequence
  Description of Artificial Sequence: Synthetic polypeptide
AEEEIRTTNPVATEQYGSVSTTDQNQQIGNNNATE

SEQ ID NO: 95782 - protein, 35 aa, Artificial Sequence
  Description of Artificial Sequence: Synthetic polypeptide
AEEEIRTTNPVATEQYGSVSTTDQNNNQEEGNNQI

SEQ ID NO: 95783 - protein, 34 aa, Artificial Sequence
  Description of Artificial Sequence: Synthetic polypeptide
SEEEIRTTNPVATEQYGSVSSTTPAGPNRNGNPV

SEQ ID NO: 95784 - protein, 30 aa, Artificial Sequence
  Description of Artificial Sequence: Synthetic polypeptide
DEEEIRTTNPCATTQYGTVATTEQGTNANT

SEQ ID NO: 95785 - protein, 30 aa, Artificial Sequence
  Description of Artificial Sequence: Synthetic polypeptide
DEEEIRTTNPCATTQYGTVATTEQGTNNAT

SEQ ID NO: 95786 - protein, 33 aa, Artificial Sequence
  Description of Artificial Sequence: Synthetic polypeptide
AEEEIRTTNPVATEQYGSVSTTLENDNEEGTTD

SEQ ID NO: 95787 - protein, 33 aa, Artificial Sequence
  Description of Artificial Sequence: Synthetic polypeptide
AEEEIRTTNPVATEQYGSVSTTLGNDNEENGTD

SEQ ID NO: 95788 - protein, 33 aa, Artificial Sequence
  Description of Artificial Sequence: Synthetic polypeptide
AEEEIRTTNPVATEQYGSVSTTLGNNDNEEGQD

SEQ ID NO: 95789 - protein, 36 aa, Artificial Sequence
  Description of Artificial Sequence: Synthetic polypeptide
AEEEIRTTNPVATEQYGSVSTTLNLGQIGTTNTDEQ

SEQ ID NO: 95790 - protein, 35 aa, Artificial Sequence
  Description of Artificial Sequence: Synthetic polypeptide
DEEEIRTTNPCATEQYGSVVTVVTTNLQQGTNSAT

SEQ ID NO: 95791 - protein, 35 aa, Artificial Sequence
  Description of Artificial Sequence: Synthetic polypeptide
SEEEIRTTNPVATEQYGSVFSTSLDDQEGGIENFG

SEQ ID NO: 95792 - protein, 34 aa, Artificial Sequence
  Description of Artificial Sequence: Synthetic polypeptide
SEEEIRTTNPVATEQYGSVISDTNGGQGDGEGGV

SEQ ID NO: 95793 - protein, 34 aa, Artificial Sequence
  Description of Artificial Sequence: Synthetic polypeptide
SEEEIRTTNPVATEQYGSVIVTSNEGQGGGENGG

SEQ ID NO: 95794 - protein, 32 aa, Artificial Sequence
  Description of Artificial Sequence: Synthetic polypeptide
SEEEIRTTNPVATEQYGSVMSNTDSTDGQEES

SEQ ID NO: 95795 - protein, 33 aa, Artificial Sequence
  Description of Artificial Sequence: Synthetic polypeptide
SEEEIRTTNPVATEQYGSVNESNLDTRIGEGYQ

SEQ ID NO: 95796 - protein, 33 aa, Artificial Sequence
  Description of Artificial Sequence: Synthetic polypeptide
SEEEIRTTNPVATEQYGSVNESPLIQFGENMED

SEQ ID NO: 95797 - protein, 33 aa, Artificial Sequence
  Description of Artificial Sequence: Synthetic polypeptide
SEEEIRTTNPVATEQYGSVNESPLIQRIENIEN

SEQ ID NO: 95798 - protein, 34 aa, Artificial Sequence
  Description of Artificial Sequence: Synthetic polypeptide
SEEEIRTTNPVATEQYGSVNESPLIQRYGENSEN

SEQ ID NO: 95799 - protein, 32 aa, Artificial Sequence
  Description of Artificial Sequence: Synthetic polypeptide
SEEEIRTTNPVATEQYGSVNESVLEQRPEEKE

SEQ ID NO: 95800 - protein, 35 aa, Artificial Sequence
  Description of Artificial Sequence: Synthetic polypeptide
AEEEIRTTNPVATEQYGSVSTTNDQQGDEGNINEG

SEQ ID NO: 95801 - protein, 35 aa, Artificial Sequence
  Description of Artificial Sequence: Synthetic polypeptide
AEEEIRTTNPVATEQYGSVSTTNAQQGNTNNNDQA

SEQ ID NO: 95802 - protein, 35 aa, Artificial Sequence
  Description of Artificial Sequence: Synthetic polypeptide
SEEEIRTTNPVATEQYGSVNSTNTDDDQRGGEEIN

SEQ ID NO: 95803 - protein, 33 aa, Artificial Sequence
  Description of Artificial Sequence: Synthetic polypeptide
AEEEIRTTNPVATEQYGSVSTTLVNENEEGTTD

SEQ ID NO: 95804 - protein, 34 aa, Artificial Sequence
  Description of Artificial Sequence: Synthetic polypeptide
AEEEIRTTNPVATEQYGSVSTTLQPNDNEEGTED

SEQ ID NO: 95805 - protein, 35 aa, Artificial Sequence
  Description of Artificial Sequence: Synthetic polypeptide
AEEEIRTTNPVATEQYGSVSTTLQNDNEELGNTDE

SEQ ID NO: 95806 - protein, 34 aa, Artificial Sequence
  Description of Artificial Sequence: Synthetic polypeptide
AEEEIRTTNPVATEQYGSVSTTLQNDNEEIGETD

SEQ ID NO: 95807 - protein, 34 aa, Artificial Sequence
  Description of Artificial Sequence: Synthetic polypeptide
AEEEIRTTNPVATEQYGSVSTTLQLNDNEEGTTD

SEQ ID NO: 95808 - protein, 34 aa, Artificial Sequence
  Description of Artificial Sequence: Synthetic polypeptide
AEEEIRTTNPVATEQYGSVSTTLNQQANTTNNVE

SEQ ID NO: 95809 - protein, 35 aa, Artificial Sequence
  Description of Artificial Sequence: Synthetic polypeptide
AEEEIRTTNPVATEQYGSVSTTLNQNNQAEGNNEI

SEQ ID NO: 95810 - protein, 35 aa, Artificial Sequence
  Description of Artificial Sequence: Synthetic polypeptide
AEEEIRTTNPVATEQYGSVSTTLNQGNQEGNNTED

SEQ ID NO: 95811 - protein, 35 aa, Artificial Sequence
  Description of Artificial Sequence: Synthetic polypeptide
AEEEIRTTNPVATEQYGSVSTTLNQANEIGTNEEE

SEQ ID NO: 95812 - protein, 34 aa, Artificial Sequence
  Description of Artificial Sequence: Synthetic polypeptide
SEEEIRTTNPVATEQYGSVNNLTNHDEEGNNEIR

SEQ ID NO: 95813 - protein, 35 aa, Artificial Sequence
  Description of Artificial Sequence: Synthetic polypeptide
AEEEIRTTNPVATEQYGSVSTTNGNQQTIGTNNVD

SEQ ID NO: 95814 - protein, 34 aa, Artificial Sequence
  Description of Artificial Sequence: Synthetic polypeptide
SEEEIRTTNPVATEQYGSVSVTVDLHESGQNTDP

SEQ ID NO: 95815 - protein, 35 aa, Artificial Sequence
  Description of Artificial Sequence: Synthetic polypeptide
AEEEIRTTNPVATEQYGSVSTSNNNLGQQGTIQTE

SEQ ID NO: 95816 - protein, 32 aa, Artificial Sequence
  Description of Artificial Sequence: Synthetic polypeptide
SEEEIRTTNPVAYERYGSTNCTNLDQPEGNNP

SEQ ID NO: 95817 - protein, 36 aa, Artificial Sequence
  Description of Artificial Sequence: Synthetic polypeptide
AEEEIRTTNPVATEQYGSVSTNNQLGNTQQGTQENE

SEQ ID NO: 95818 - protein, 33 aa, Artificial Sequence
  Description of Artificial Sequence: Synthetic polypeptide
DEEEIRTTNPVATEQYGCVCSWGEHQAFGSNQS

SEQ ID NO: 95819 - protein, 34 aa, Artificial Sequence
  Description of Artificial Sequence: Synthetic polypeptide
AEEEIRTTNPVATEQYGSVSTNNNQQQETGTEAL

SEQ ID NO: 95820 - protein, 36 aa, Artificial Sequence
  Description of Artificial Sequence: Synthetic polypeptide
AEEEIRTTNPVATEQYGSVSTNNNQLGQEQGTTQNE

SEQ ID NO: 95821 - protein, 36 aa, Artificial Sequence
  Description of Artificial Sequence: Synthetic polypeptide
AEEEIRTTNPVATEQYGSVSTNNNQLGQEQGTNTAT

SEQ ID NO: 95822 - protein, 36 aa, Artificial Sequence
  Description of Artificial Sequence: Synthetic polypeptide
AEEEIRTTNPVATEQYGSVSTNNNQLGQEQGTNDTE

SEQ ID NO: 95823 - protein, 36 aa, Artificial Sequence
  Description of Artificial Sequence: Synthetic polypeptide
AEEEIRTTNPVATEQYGSVSTNNNQLGNQQGTNNNE

SEQ ID NO: 95824 - protein, 31 aa, Artificial Sequence
  Description of Artificial Sequence: Synthetic polypeptide
SEEEIVCTNPIATEQYGTVCSEGLVEREGNR

SEQ ID NO: 95825 - protein, 31 aa, Artificial Sequence
  Description of Artificial Sequence: Synthetic polypeptide
SEEEIVCTNPVATEQYGTVSAEDNPMREGND

SEQ ID NO: 95826 - protein, 35 aa, Artificial Sequence
  Description of Artificial Sequence: Synthetic polypeptide
AEEEIRTTNPVATEQYGSVSTNNNQAGSETGTNAE

SEQ ID NO: 95827 - protein, 33 aa, Artificial Sequence
  Description of Artificial Sequence: Synthetic polypeptide
SEEEIVTTNPVATESYGSVTSNTNLEQWGDQQQ

SEQ ID NO: 95828 - protein, 35 aa, Artificial Sequence
  Description of Artificial Sequence: Synthetic polypeptide
AEEEIRTTNPVATEQYGSVSTNNNNQNQDEGTNND

SEQ ID NO: 95829 - protein, 33 aa, Artificial Sequence
  Description of Artificial Sequence: Synthetic polypeptide
DEEEIRTTNPVATEQYGCVCSWGEDQNFGSNQP

SEQ ID NO: 95830 - protein, 35 aa, Artificial Sequence
  Description of Artificial Sequence: Synthetic polypeptide
AEEEIRTTNPVATEQYGSVSTNNNNNQEQGTEDNE

SEQ ID NO: 95831 - protein, 36 aa, Artificial Sequence
  Description of Artificial Sequence: Synthetic polypeptide
AEEEIRTTNPVATEQYGSVSTNNNNLQAGNSENLQG

SEQ ID NO: 95832 - protein, 36 aa, Artificial Sequence
  Description of Artificial Sequence: Synthetic polypeptide
AEEEIRTTNPVATEQYGSVSTNNNLQQGNDNGNVED

SEQ ID NO: 95833 - protein, 33 aa, Artificial Sequence
  Description of Artificial Sequence: Synthetic polypeptide
SEEEVRTTNPVATEQYGCVCSTGNLDQNFGSDQ

SEQ ID NO: 95834 - protein, 34 aa, Artificial Sequence
  Description of Artificial Sequence: Synthetic polypeptide
SEEEVRTTNPVATEQYGSVCSTGNHDQNIGSNQF

SEQ ID NO: 95835 - protein, 34 aa, Artificial Sequence
  Description of Artificial Sequence: Synthetic polypeptide
AEEEIRTTNPVATEQYGSVSTNNNENSETGTNTQ

SEQ ID NO: 95836 - protein, 35 aa, Artificial Sequence
  Description of Artificial Sequence: Synthetic polypeptide
AEEEIRTTNPVATEQYGSVSTNNNENQNETGNNTQ

SEQ ID NO: 95837 - protein, 33 aa, Artificial Sequence
  Description of Artificial Sequence: Synthetic polypeptide
SEEEIRTTNPVAYERYGSCNCTNLDQPNDGNNR

SEQ ID NO: 95838 - protein, 35 aa, Artificial Sequence
  Description of Artificial Sequence: Synthetic polypeptide
AEEEIRTTNPVATEQYGSVSTNNNENQETGTNNTE

SEQ ID NO: 95839 - protein, 32 aa, Artificial Sequence
  Description of Artificial Sequence: Synthetic polypeptide
SEEEIRTTNPVAYERYGSCNCQNLSQPEGNNR

SEQ ID NO: 95840 - protein, 35 aa, Artificial Sequence
  Description of Artificial Sequence: Synthetic polypeptide
AEEEIRTTNPVATEQYGSVSTNNQLGSETGGTNNA

SEQ ID NO: 95841 - protein, 33 aa, Artificial Sequence
  Description of Artificial Sequence: Synthetic polypeptide
DEEEIRTTNPVATEQYGCVCSWGNHQNFNSEQM

SEQ ID NO: 95842 - protein, 33 aa, Artificial Sequence
  Description of Artificial Sequence: Synthetic polypeptide
DEEEIRTTNPVATEQYGCVCSWGNHQNFNSDAS

SEQ ID NO: 95843 - protein, 34 aa, Artificial Sequence
  Description of Artificial Sequence: Synthetic polypeptide
DEEEIRTTNPVATEQYGCVCSWGNHQNFGSNFQL

SEQ ID NO: 95844 - protein, 33 aa, Artificial Sequence
  Description of Artificial Sequence: Synthetic polypeptide
DEEEIRTTNPVATEQYGCVCSWGNHQNFGSDQS

SEQ ID NO: 95845 - protein, 33 aa, Artificial Sequence
  Description of Artificial Sequence: Synthetic polypeptide
DEEEIRTTNPVATEQYGCVCSWGNHQHFNSDQG

SEQ ID NO: 95846 - protein, 33 aa, Artificial Sequence
  Description of Artificial Sequence: Synthetic polypeptide
DEEEIRTTNPVATEQYGCVCSWGNHQFFISNQE

SEQ ID NO: 95847 - protein, 34 aa, Artificial Sequence
  Description of Artificial Sequence: Synthetic polypeptide
DEEEIRTTNPLATEQYGCVVHITNLSGETGTNNR

SEQ ID NO: 95848 - protein, 32 aa, Artificial Sequence
  Description of Artificial Sequence: Synthetic polypeptide
SEEEIRTTNPVAYEAYGSVPSNGAGFQSGGNR

SEQ ID NO: 95849 - protein, 36 aa, Artificial Sequence
  Description of Artificial Sequence: Synthetic polypeptide
AEEEIRTTNPVATEQYGSVSTNNQQLGQEQGTNPEE

SEQ ID NO: 95850 - protein, 32 aa, Artificial Sequence
  Description of Artificial Sequence: Synthetic polypeptide
SEEEIRTTNPVAYEQWGSVSWGDDAQRGANQI

SEQ ID NO: 95851 - protein, 34 aa, Artificial Sequence
  Description of Artificial Sequence: Synthetic polypeptide
DEEEIRTTNPLATEQYGCVVSICNLSQTTSTNNR

SEQ ID NO: 95852 - protein, 33 aa, Artificial Sequence
  Description of Artificial Sequence: Synthetic polypeptide
DEEEIRTTNPVATEQYGCVCSWGELQSFNSNQM

SEQ ID NO: 95853 - protein, 32 aa, Artificial Sequence
  Description of Artificial Sequence: Synthetic polypeptide
SEEEIRTTNPVAYEQWGSVSWVDDHQRGMNEE

SEQ ID NO: 95854 - protein, 33 aa, Artificial Sequence
  Description of Artificial Sequence: Synthetic polypeptide
DEEEIRTTNPVATEQYGCVCSWGELQFFGSEDG

SEQ ID NO: 95855 - protein, 33 aa, Artificial Sequence
  Description of Artificial Sequence: Synthetic polypeptide
DEEEIRTTNPVATEQYGCVCSWGELQFFGSDQQ

SEQ ID NO: 95856 - protein, 34 aa, Artificial Sequence
  Description of Artificial Sequence: Synthetic polypeptide
SEEEIRTTNPVAYEQYGSCNCTLNALDQPEGNNR

SEQ ID NO: 95857 - protein, 33 aa, Artificial Sequence
  Description of Artificial Sequence: Synthetic polypeptide
DEEEIRTTNPVATEQYGCVCSWGEHQSFGSNQA

SEQ ID NO: 95858 - protein, 34 aa, Artificial Sequence
  Description of Artificial Sequence: Synthetic polypeptide
DEEEIRTTNPVATEQYGCVCSWGEHQRFGSNTQS

SEQ ID NO: 95859 - protein, 34 aa, Artificial Sequence
  Description of Artificial Sequence: Synthetic polypeptide
SEEEIRTTNPVAYEQYGSCNCTNLDQPTEGNNRW

SEQ ID NO: 95860 - protein, 36 aa, Artificial Sequence
  Description of Artificial Sequence: Synthetic polypeptide
AEEEIRTTNPVATEQYGSVSTNNQNLQNQEQGNNVE

SEQ ID NO: 95861 - protein, 33 aa, Artificial Sequence
  Description of Artificial Sequence: Synthetic polypeptide
DEEEIRTTNPVATEQYGCVCSWGEHQNGGSNQA

SEQ ID NO: 95862 - protein, 32 aa, Artificial Sequence
  Description of Artificial Sequence: Synthetic polypeptide
SEEEIRTTNPVAYERYGKCNCTNLDQAEGNNR

SEQ ID NO: 95863 - protein, 35 aa, Artificial Sequence
  Description of Artificial Sequence: Synthetic polypeptide
AEEEIRTTNPVATEQYGSVSTNNNDENQGETGNTT

SEQ ID NO: 95864 - protein, 33 aa, Artificial Sequence
  Description of Artificial Sequence: Synthetic polypeptide
DEEEIRTTNPVATEQYGCVCSWGAHQRFGSEQS

SEQ ID NO: 95865 - protein, 35 aa, Artificial Sequence
  Description of Artificial Sequence: Synthetic polypeptide
AEEEIRTTNPVATEQYGSVSTNNNDENQETGNNEQ

SEQ ID NO: 95866 - protein, 32 aa, Artificial Sequence
  Description of Artificial Sequence: Synthetic polypeptide
DEEEIRTTNPVATEQYGCVCSWEHQHSNSDQT

SEQ ID NO: 95867 - protein, 36 aa, Artificial Sequence
  Description of Artificial Sequence: Synthetic polypeptide
AEEEIRTTNPVATEQYGSVSTNLQLGNTQQGTNQNA

SEQ ID NO: 95868 - protein, 33 aa, Artificial Sequence
  Description of Artificial Sequence: Synthetic polypeptide
DEEEIRTTNPVATEQYGCVCSWEHQHFGSDNQA

SEQ ID NO: 95869 - protein, 32 aa, Artificial Sequence
  Description of Artificial Sequence: Synthetic polypeptide
DEEEIRTTNPVATEQYGCVCSWEHQGFNSNQM

SEQ ID NO: 95870 - protein, 32 aa, Artificial Sequence
  Description of Artificial Sequence: Synthetic polypeptide
DEEEIRTTNPVATEQYGCVCSWEHQFFNSDVS

SEQ ID NO: 95871 - protein, 30 aa, Artificial Sequence
  Description of Artificial Sequence: Synthetic polypeptide
SEESIRCTNPTATEQYGAVVEMNGMRGNDR

SEQ ID NO: 95872 - protein, 32 aa, Artificial Sequence
  Description of Artificial Sequence: Synthetic polypeptide
DEEEIRTTNPVATEQYGCVCSWEHQFFGSQQQ

SEQ ID NO: 95873 - protein, 33 aa, Artificial Sequence
  Description of Artificial Sequence: Synthetic polypeptide
DEEEIRTTNPVATEQYGCVCSWEHQESFGSNQS

SEQ ID NO: 95874 - protein, 35 aa, Artificial Sequence
  Description of Artificial Sequence: Synthetic polypeptide
AEEEIRTTNPVATEQYGSVSTNLNQQNQENGTEAL

SEQ ID NO: 95875 - protein, 29 aa, Artificial Sequence
  Description of Artificial Sequence: Synthetic peptide
SEEVICCTNPVAYEQYGSVSMNENVGGNS

SEQ ID NO: 95876 - protein, 33 aa, Artificial Sequence
  Description of Artificial Sequence: Synthetic polypeptide
DEEEIRTTNPVATEQYGCVCSWEHNQRFNSEQA

SEQ ID NO: 95877 - protein, 36 aa, Artificial Sequence
  Description of Artificial Sequence: Synthetic polypeptide
AEEEIRTTNPVATEQYGSVSTNLNQLGSETGTTNAV

SEQ ID NO: 95878 - protein, 33 aa, Artificial Sequence
  Description of Artificial Sequence: Synthetic polypeptide
DEEEIRTTNPVATEQYGCVCSWEHNQFFGSNQS

SEQ ID NO: 95879 - protein, 36 aa, Artificial Sequence
  Description of Artificial Sequence: Synthetic polypeptide
AEEEIRTTNPVATEQYGSVSTNLNQLENQEIGTNDQ

SEQ ID NO: 95880 - protein, 35 aa, Artificial Sequence
  Description of Artificial Sequence: Synthetic polypeptide
AEEEIRTTNPVATEQYGSVSTNLNQGQGEQGTEQL

SEQ ID NO: 95881 - protein, 36 aa, Artificial Sequence
  Description of Artificial Sequence: Synthetic polypeptide
AEEEIRTTNPVATEQYGSVSTNLNQGEEQGGNNQGT

SEQ ID NO: 95882 - protein, 36 aa, Artificial Sequence
  Description of Artificial Sequence: Synthetic polypeptide
AEEEIRTTNPVATEQYGSVSTNLNNQNQETGTNTET

SEQ ID NO: 95883 - protein, 35 aa, Artificial Sequence
  Description of Artificial Sequence: Synthetic polypeptide
AEEEIRTTNPVATEQYGSVSTNLNNQNQEEGTEAL

SEQ ID NO: 95884 - protein, 28 aa, Artificial Sequence
  Description of Artificial Sequence: Synthetic peptide
SEGEIAPTNPCSSEQYGIVSCNLQSGTR

SEQ ID NO: 95885 - protein, 36 aa, Artificial Sequence
  Description of Artificial Sequence: Synthetic polypeptide
AEEEIRTTNPVATEQYGSVSTNLNNLQQGTNTNTEQ

SEQ ID NO: 95886 - protein, 33 aa, Artificial Sequence
  Description of Artificial Sequence: Synthetic polypeptide
DEEEIRTTNPVATEQYGCVCSWEELARFGSQQF

SEQ ID NO: 95887 - protein, 32 aa, Artificial Sequence
  Description of Artificial Sequence: Synthetic polypeptide
DEEEIRTTNPVATEQYGCVCSWEHQHSNSNQL

SEQ ID NO: 95888 - protein, 32 aa, Artificial Sequence
  Description of Artificial Sequence: Synthetic polypeptide
DEEEIRTTNPVATEQYGCVCSWEHQNFGSEQE

SEQ ID NO: 95889 - protein, 33 aa, Artificial Sequence
  Description of Artificial Sequence: Synthetic polypeptide
DEEEIRTTNPVATEQYGCVCSWEHQNFGSNNAM

SEQ ID NO: 95890 - protein, 35 aa, Artificial Sequence
  Description of Artificial Sequence: Synthetic polypeptide
AEEEIRTTNPVATEQYGSVSTNLQQGEEQGTTQDD

SEQ ID NO: 95891 - protein, 33 aa, Artificial Sequence
  Description of Artificial Sequence: Synthetic polypeptide
DEEEIRTTNPVATEQYGCVCSWGAHQFFGSNQA

SEQ ID NO: 95892 - protein, 32 aa, Artificial Sequence
  Description of Artificial Sequence: Synthetic polypeptide
DEEEIRTTNPVATEQYGCVCSWEPQYFGSEQG

SEQ ID NO: 95893 - protein, 32 aa, Artificial Sequence
  Description of Artificial Sequence: Synthetic polypeptide
DEEEIRTTNPVATEQYGCVCSWEPQNFGSEQS

SEQ ID NO: 95894 - protein, 32 aa, Artificial Sequence
  Description of Artificial Sequence: Synthetic polypeptide
DEEEIRTTNPVATEQYGCVCSWEPQNFGSDQP

SEQ ID NO: 95895 - protein, 33 aa, Artificial Sequence
  Description of Artificial Sequence: Synthetic polypeptide
DEEEIRTTNPVATEQYGCVCSWEPHQNFGSNDG

SEQ ID NO: 95896 - protein, 33 aa, Artificial Sequence
  Description of Artificial Sequence: Synthetic polypeptide
DEEEIRTTNPVATEQYGCVCSWENHQNFNSQQL

SEQ ID NO: 95897 - protein, 33 aa, Artificial Sequence
  Description of Artificial Sequence: Synthetic polypeptide
DEEEIRTTNPVATEQYGCVCSWENHQNFGSEQD

SEQ ID NO: 95898 - protein, 33 aa, Artificial Sequence
  Description of Artificial Sequence: Synthetic polypeptide
DEEEIRTTNPVATEQYGCVCSWENHQHFNSNQS

SEQ ID NO: 95899 - protein, 33 aa, Artificial Sequence
  Description of Artificial Sequence: Synthetic polypeptide
DEEEIRTTNPVATEQYGCVCSWENHQHFNSNQA

SEQ ID NO: 95900 - protein, 33 aa, Artificial Sequence
  Description of Artificial Sequence: Synthetic polypeptide
DEEEIRTTNPVATEQYGCVCSWENHQGFGSDQA

SEQ ID NO: 95901 - protein, 35 aa, Artificial Sequence
  Description of Artificial Sequence: Synthetic polypeptide
AEEEIRTTNPVATEQYGSVSTNNTNNQQQGTNQDE

SEQ ID NO: 95902 - protein, 33 aa, Artificial Sequence
  Description of Artificial Sequence: Synthetic polypeptide
DEEEIRTTNPVATEQYGCVCSWENHQESFGSEQ

SEQ ID NO: 95903 - protein, 33 aa, Artificial Sequence
  Description of Artificial Sequence: Synthetic polypeptide
DEEEIRTTNPVATEQYGCVCSWELQNFNSDNQD

SEQ ID NO: 95904 - protein, 33 aa, Artificial Sequence
  Description of Artificial Sequence: Synthetic polypeptide
DEEEIRTTNPLAYEAYGSVVSYTNLSDPGGIVR

SEQ ID NO: 95905 - protein, 33 aa, Artificial Sequence
  Description of Artificial Sequence: Synthetic polypeptide
DEEEIRTTNPVATEQYGCVCSWELQHFGSEFQA

SEQ ID NO: 95906 - protein, 33 aa, Artificial Sequence
  Description of Artificial Sequence: Synthetic polypeptide
DEEEIRTTNPVATEQYGCVCSWELQGFGSETQS

SEQ ID NO: 95907 - protein, 32 aa, Artificial Sequence
  Description of Artificial Sequence: Synthetic polypeptide
DEEEIRTTNPVATEQYGCVCSWELQFFSSEQS

SEQ ID NO: 95908 - protein, 33 aa, Artificial Sequence
  Description of Artificial Sequence: Synthetic polypeptide
DEEEIRTTNPVATEQYGCVCSWELQESFGSEQS

SEQ ID NO: 95909 - protein, 33 aa, Artificial Sequence
  Description of Artificial Sequence: Synthetic polypeptide
DEEEIRTTNPVATEQYGCVCSWELQENFGSEQM

SEQ ID NO: 95910 - protein, 33 aa, Artificial Sequence
  Description of Artificial Sequence: Synthetic polypeptide
DEEEIRTTNPVATEQYGCVCSWELEEGFGSNQG

SEQ ID NO: 95911 - protein, 36 aa, Artificial Sequence
  Description of Artificial Sequence: Synthetic polypeptide
AEEEIRTTNPVATEQYGSVSTNLQQGTEQIGTNQDD

SEQ ID NO: 95912 - protein, 33 aa, Artificial Sequence
  Description of Artificial Sequence: Synthetic polypeptide
DEEEIRTTNPVATEQYGCVCSWEHQYFGSNTQS

SEQ ID NO: 95913 - protein, 33 aa, Artificial Sequence
  Description of Artificial Sequence: Synthetic polypeptide
SEENIRCTNPCATEQYGSVCSPENLLHRIGNRD

SEQ ID NO: 95914 - protein, 34 aa, Artificial Sequence
  Description of Artificial Sequence: Synthetic polypeptide
DEEEIRTTNPVATEQYGCVCSWGNLENFGSNNQS

SEQ ID NO: 95915 - protein, 35 aa, Artificial Sequence
  Description of Artificial Sequence: Synthetic polypeptide
DEEEIRTTNPLATEQYGCVVHITGNLSQTPGGNNR

SEQ ID NO: 95916 - protein, 33 aa, Artificial Sequence
  Description of Artificial Sequence: Synthetic polypeptide
DEEEIRTTNPVATEQYGCVCSWGNPQNFNSEQS

SEQ ID NO: 95917 - protein, 35 aa, Artificial Sequence
  Description of Artificial Sequence: Synthetic polypeptide
AEEEIRTTNPVATEQYGSVSTSNLGNANNIGNNEG

SEQ ID NO: 95918 - protein, 33 aa, Artificial Sequence
  Description of Artificial Sequence: Synthetic polypeptide
SEEEIRTTNPVATERYGSVNETSNIDQQGENYQ

SEQ ID NO: 95919 - protein, 33 aa, Artificial Sequence
  Description of Artificial Sequence: Synthetic polypeptide
SEEEIRTTNPVATESWGSVSNTNDEHERGGDQR

SEQ ID NO: 95920 - protein, 32 aa, Artificial Sequence
  Description of Artificial Sequence: Synthetic polypeptide
SEEEIRTTNPVATESYGCVSNTNLIYFGSDTQ

SEQ ID NO: 95921 - protein, 33 aa, Artificial Sequence
  Description of Artificial Sequence: Synthetic polypeptide
SEEEIRTTNPVATESYGESVASNTNQEWGDQRQ

SEQ ID NO: 95922 - protein, 35 aa, Artificial Sequence
  Description of Artificial Sequence: Synthetic polypeptide
AEEEIRTTNPVATEQYGSVSTSNLGANNNGTNTEG

SEQ ID NO: 95923 - protein, 33 aa, Artificial Sequence
  Description of Artificial Sequence: Synthetic polypeptide
SEEEIRTTNPVATESYGSVCSNQNDHERGDQRH

SEQ ID NO: 95924 - protein, 34 aa, Artificial Sequence
  Description of Artificial Sequence: Synthetic polypeptide
DEEEIRTTNPVATEQYGCVSCTNDGGQTTFGKQF

SEQ ID NO: 95925 - protein, 34 aa, Artificial Sequence
  Description of Artificial Sequence: Synthetic polypeptide
SEEEIRTTNPVATESYGSVCSNTMNDHERQGDQR

SEQ ID NO: 95926 - protein, 34 aa, Artificial Sequence
  Description of Artificial Sequence: Synthetic polypeptide
SEEEIRTTNPVATESYGSVCSNTNDEHERSGDQR

SEQ ID NO: 95927 - protein, 34 aa, Artificial Sequence
  Description of Artificial Sequence: Synthetic polypeptide
SEEEIRTTNPVATESYGSVCSNTNDHERPGDDQR

SEQ ID NO: 95928 - protein, 34 aa, Artificial Sequence
  Description of Artificial Sequence: Synthetic polypeptide
SEEEIRTTNPVATESYGSVCSNTWNLHRGSDQDD

SEQ ID NO: 95929 - protein, 34 aa, Artificial Sequence
  Description of Artificial Sequence: Synthetic polypeptide
SEEEIRTTNPVATESYGSVCSNTWNLHRIGDQID

SEQ ID NO: 95930 - protein, 33 aa, Artificial Sequence
  Description of Artificial Sequence: Synthetic polypeptide
SEEEIRTTNPVATESYGSVDNTNLIREGQDGGE

SEQ ID NO: 95931 - protein, 34 aa, Artificial Sequence
  Description of Artificial Sequence: Synthetic polypeptide
AEEEIRTTNPVATEQYGSVSTQNTNLEEATNVAE

SEQ ID NO: 95932 - protein, 34 aa, Artificial Sequence
  Description of Artificial Sequence: Synthetic polypeptide
AEEEIRTTNPVATEQYGSVSTQNQQQQNGEIGTE

SEQ ID NO: 95933 - protein, 35 aa, Artificial Sequence
  Description of Artificial Sequence: Synthetic polypeptide
AEEEIRTTNPVATEQYGSVSTQNQQGNNANGTNTD

SEQ ID NO: 95934 - protein, 31 aa, Artificial Sequence
  Description of Artificial Sequence: Synthetic polypeptide
DEEEIRTTNPVATEQYGCVQTDHDQEQIEDM

SEQ ID NO: 95935 - protein, 34 aa, Artificial Sequence
  Description of Artificial Sequence: Synthetic polypeptide
AEEEIRTTNPVATEQYGSVSTQNQNNNANGNNTD

SEQ ID NO: 95936 - protein, 33 aa, Artificial Sequence
  Description of Artificial Sequence: Synthetic polypeptide
SEEEIRTTNPVATESYGSVSNSNLVREGEGQGN

SEQ ID NO: 95937 - protein, 34 aa, Artificial Sequence
  Description of Artificial Sequence: Synthetic polypeptide
DEEEIRTTNPVATEQYGCVPTGVLQMQSTQNERQ

SEQ ID NO: 95938 - protein, 34 aa, Artificial Sequence
  Description of Artificial Sequence: Synthetic polypeptide
DEEEIRTTNPVATEQYGCVSILLNQAEGQNNEQE

SEQ ID NO: 95939 - protein, 35 aa, Artificial Sequence
  Description of Artificial Sequence: Synthetic polypeptide
DEEEIRTTNPVATEQYGCVSITDDLLQLGSEEERQ

SEQ ID NO: 95940 - protein, 34 aa, Artificial Sequence
  Description of Artificial Sequence: Synthetic polypeptide
SEEEIRTTNPVATEQYGSVYEPTHMYQEGTNDGR

SEQ ID NO: 95941 - protein, 34 aa, Artificial Sequence
  Description of Artificial Sequence: Synthetic polypeptide
SEEEIRTTNPVATEQYGSVWTVMLTDERGGEERN

SEQ ID NO: 95942 - protein, 36 aa, Artificial Sequence
  Description of Artificial Sequence: Synthetic polypeptide
DEEEIRTTNPVATEQYGCVSSTCNLDEGRYGVSGRM

SEQ ID NO: 95943 - protein, 36 aa, Artificial Sequence
  Description of Artificial Sequence: Synthetic polypeptide
AEEEIRTTNPVATEQYGSVSTSNNLQQQQGNGNIGT

SEQ ID NO: 95944 - protein, 36 aa, Artificial Sequence
  Description of Artificial Sequence: Synthetic polypeptide
AEEEIRTTNPVATEQYGSVSTSNNLQQQNGTGNIGE

SEQ ID NO: 95945 - protein, 32 aa, Artificial Sequence
  Description of Artificial Sequence: Synthetic polypeptide
DEEEIRTTNPEATEQYGSVPTTWLFSNGEKIE

SEQ ID NO: 95946 - protein, 36 aa, Artificial Sequence
  Description of Artificial Sequence: Synthetic polypeptide
AEEEIRTTNPVATEQYGSVSTSNNLQQQNGNNNING

SEQ ID NO: 95947 - protein, 32 aa, Artificial Sequence
  Description of Artificial Sequence: Synthetic polypeptide
SEEEIRTTNPVATEQYGSVTVTNNQEESEDDN

SEQ ID NO: 95948 - protein, 34 aa, Artificial Sequence
  Description of Artificial Sequence: Synthetic polypeptide
SEEEIRTTNPVATEQYGSVVPWVNLIEGQDGNQQ

SEQ ID NO: 95949 - protein, 36 aa, Artificial Sequence
  Description of Artificial Sequence: Synthetic polypeptide
AEEEIRTTNPVATEQYGSVSTSNNLQQQNGNLNIGN

SEQ ID NO: 95950 - protein, 36 aa, Artificial Sequence
  Description of Artificial Sequence: Synthetic polypeptide
AEEEIRTTNPVATEQYGSVSTSNNLQQQNGNGNQND

SEQ ID NO: 95951 - protein, 36 aa, Artificial Sequence
  Description of Artificial Sequence: Synthetic polypeptide
AEEEIRTTNPVATEQYGSVSTSNNLQQQNGNGNQGD

SEQ ID NO: 95952 - protein, 30 aa, Artificial Sequence
  Description of Artificial Sequence: Synthetic polypeptide
DEEEIRTTNPIATEQWGDVSEILMNAAEDR

SEQ ID NO: 95953 - protein, 32 aa, Artificial Sequence
  Description of Artificial Sequence: Synthetic polypeptide
DEEEIRTTNPEATQQYGEVCTIDQDQRQGTNM

SEQ ID NO: 95954 - protein, 32 aa, Artificial Sequence
  Description of Artificial Sequence: Synthetic polypeptide
DEEEIRTTNPEATQQYGEVCTIDQGQREGNAM

SEQ ID NO: 95955 - protein, 32 aa, Artificial Sequence
  Description of Artificial Sequence: Synthetic polypeptide
DEEEIRTTNPEATQQYGEVCTIDQGQRQGNMQ

SEQ ID NO: 95956 - protein, 36 aa, Artificial Sequence
  Description of Artificial Sequence: Synthetic polypeptide
AEEEIRTTNPVATEQYGSVSTSNNLQQQNGNGNIGE

SEQ ID NO: 95957 - protein, 36 aa, Artificial Sequence
  Description of Artificial Sequence: Synthetic polypeptide
AEEEIRTTNPVATEQYGSVSTSNNLQQQNGNEQIGE

SEQ ID NO: 95958 - protein, 31 aa, Artificial Sequence
  Description of Artificial Sequence: Synthetic polypeptide
DEEEIRTTNPEATRQYGQVPSDLTQRGGEFN

SEQ ID NO: 95959 - protein, 36 aa, Artificial Sequence
  Description of Artificial Sequence: Synthetic polypeptide
AEEEIRTTNPVATEQYGSVSTSNNLQQQGNGNQIGE

SEQ ID NO: 95960 - protein, 33 aa, Artificial Sequence
  Description of Artificial Sequence: Synthetic polypeptide
SEEEIRTTNPVATEQYGSVVTVMLLDRQEEERN

SEQ ID NO: 95961 - protein, 35 aa, Artificial Sequence
  Description of Artificial Sequence: Synthetic polypeptide
DEEEIRTTNPFAYEAWGSVVSVTNMLQRTGGNYRE

SEQ ID NO: 95962 - protein, 31 aa, Artificial Sequence
  Description of Artificial Sequence: Synthetic polypeptide
SEEEIRTTNPVATEQYGSVWAPALQEVQFDQ

SEQ ID NO: 95963 - protein, 30 aa, Artificial Sequence
  Description of Artificial Sequence: Synthetic polypeptide
DEEEIRTTNPIATECWGATSEEDLARGNYI

SEQ ID NO: 95964 - protein, 36 aa, Artificial Sequence
  Description of Artificial Sequence: Synthetic polypeptide
AEEEIRTTNPVATEQYGSVSTSNNLQQQNGNGNINQ

SEQ ID NO: 95965 - protein, 36 aa, Artificial Sequence
  Description of Artificial Sequence: Synthetic polypeptide
AEEEIRTTNPVATEQYGSVSTSNNNLQQGSNDQEDE

SEQ ID NO: 95966 - protein, 33 aa, Artificial Sequence
  Description of Artificial Sequence: Synthetic polypeptide
DEEEIRTTNPVATEQYGCVNTNDHQHRTSQEDE

SEQ ID NO: 95967 - protein, 32 aa, Artificial Sequence
  Description of Artificial Sequence: Synthetic polypeptide
DEEEIRTTNPIATEQWGSVPTWDLADRQGDDE

SEQ ID NO: 95968 - protein, 33 aa, Artificial Sequence
  Description of Artificial Sequence: Synthetic polypeptide
SEEEIRTTNPVATESYGSVSNWWGLHRGSDQRD

SEQ ID NO: 95969 - protein, 35 aa, Artificial Sequence
  Description of Artificial Sequence: Synthetic polypeptide
AEEEIRTTNPVATEQYGSVSTNSIGTNQTGTNTTE

SEQ ID NO: 95970 - protein, 31 aa, Artificial Sequence
  Description of Artificial Sequence: Synthetic polypeptide
DEEEIRTTNPIAYEQYGSVNCTGVSARGGSP

SEQ ID NO: 95971 - protein, 32 aa, Artificial Sequence
  Description of Artificial Sequence: Synthetic polypeptide
DEEEIRTTNPIAYEQYGSVPCTGLSTRGGSES

SEQ ID NO: 95972 - protein, 36 aa, Artificial Sequence
  Description of Artificial Sequence: Synthetic polypeptide
AEEEIRTTNPVATEQYGSVSTNQQNNLQAGNTTEDN

SEQ ID NO: 95973 - protein, 30 aa, Artificial Sequence
  Description of Artificial Sequence: Synthetic polypeptide
DEEEIRTTNPISTEIYGTVTFENLQGIGQT

SEQ ID NO: 95974 - protein, 33 aa, Artificial Sequence
  Description of Artificial Sequence: Synthetic polypeptide
DEEEIRTTNPKATECWGSVSCINEPQDREGENG

SEQ ID NO: 95975 - protein, 34 aa, Artificial Sequence
  Description of Artificial Sequence: Synthetic polypeptide
DEEEIRTTNPLATEAYGCVVHITNLSQHTGTNNR

SEQ ID NO: 95976 - protein, 32 aa, Artificial Sequence
  Description of Artificial Sequence: Synthetic polypeptide
DEEEIRTTNPVATEQYGCVCSWNHQNFFSDQA

SEQ ID NO: 95977 - protein, 33 aa, Artificial Sequence
  Description of Artificial Sequence: Synthetic polypeptide
DEEEIRTTNPVATEQYGCVCSWNHQFFNSENDY

SEQ ID NO: 95978 - protein, 33 aa, Artificial Sequence
  Description of Artificial Sequence: Synthetic polypeptide
DEEEIRTTNPVATEQYGCVCSWNHQFFGSDTQS

SEQ ID NO: 95979 - protein, 33 aa, Artificial Sequence
  Description of Artificial Sequence: Synthetic polypeptide
DEEEIRTTNPVATEQYGCVCSWNHQEYFNSEQS

SEQ ID NO: 95980 - protein, 33 aa, Artificial Sequence
  Description of Artificial Sequence: Synthetic polypeptide
DEEEIRTTNPVATEQYGCVCSWNHQENSGSEQN

SEQ ID NO: 95981 - protein, 33 aa, Artificial Sequence
  Description of Artificial Sequence: Synthetic polypeptide
DEEEIRTTNPVATEQYGCVCSWNHQEFFNSNDS

SEQ ID NO: 95982 - protein, 33 aa, Artificial Sequence
  Description of Artificial Sequence: Synthetic polypeptide
SEEEIRTTNPVATESYGSVVSNQNLVREGGQGQ

SEQ ID NO: 95983 - protein, 33 aa, Artificial Sequence
  Description of Artificial Sequence: Synthetic polypeptide
DEEEIRTTNPVATEQYGCVCSWNDHQNFGSDQE

SEQ ID NO: 95984 - protein, 34 aa, Artificial Sequence
  Description of Artificial Sequence: Synthetic polypeptide
SEEEIRTTNPVATESYGSVVSNTNLIRGGEDQDQ

SEQ ID NO: 95985 - protein, 33 aa, Artificial Sequence
  Description of Artificial Sequence: Synthetic polypeptide
DEEEIRTTNPVATEQYGCVCSWMELINFGSNQI

SEQ ID NO: 95986 - protein, 36 aa, Artificial Sequence
  Description of Artificial Sequence: Synthetic polypeptide
AEEEIRTTNPVATEQYGSVSTNQNLQQQISTEQGNE

SEQ ID NO: 95987 - protein, 36 aa, Artificial Sequence
  Description of Artificial Sequence: Synthetic polypeptide
AEEEIRTTNPVATEQYGSVSTNQNLQNNSEQGNNVE

SEQ ID NO: 95988 - protein, 36 aa, Artificial Sequence
  Description of Artificial Sequence: Synthetic polypeptide
AEEEIRTTNPVATEQYGSVSTNQANLQNTEQGNNVE

SEQ ID NO: 95989 - protein, 33 aa, Artificial Sequence
  Description of Artificial Sequence: Synthetic polypeptide
SEEEIRTTNPVATESYGSVSNVNLIREGEDGGE

SEQ ID NO: 95990 - protein, 33 aa, Artificial Sequence
  Description of Artificial Sequence: Synthetic polypeptide
DEEEIRTTNPIATEQYGTVCSATDNPVEFEGND

SEQ ID NO: 95991 - protein, 33 aa, Artificial Sequence
  Description of Artificial Sequence: Synthetic polypeptide
DEEEIRTTNPVATEQYGCVCSWPNHQNFGSDQS

SEQ ID NO: 95992 - protein, 32 aa, Artificial Sequence
  Description of Artificial Sequence: Synthetic polypeptide
DEEEIRTTNPVATEQYGCVCSWPPQNFNSEQA

SEQ ID NO: 95993 - protein, 34 aa, Artificial Sequence
  Description of Artificial Sequence: Synthetic polypeptide
AEEEIRTTNPVATEQYGSVSTQLYGNQIGTTGEQ

SEQ ID NO: 95994 - protein, 35 aa, Artificial Sequence
  Description of Artificial Sequence: Synthetic polypeptide
AEEEIRTTNPVATEQYGSVSTNYGTQIGTTNAEEQ

SEQ ID NO: 95995 - protein, 35 aa, Artificial Sequence
  Description of Artificial Sequence: Synthetic polypeptide
AEEEIRTTNPVATEQYGSVSTNTQNQNNQEGNNEI

SEQ ID NO: 95996 - protein, 33 aa, Artificial Sequence
  Description of Artificial Sequence: Synthetic polypeptide
DEEEIRTTNPVATEQYGCVITNDLDFGFGEEEA

SEQ ID NO: 95997 - protein, 34 aa, Artificial Sequence
  Description of Artificial Sequence: Synthetic polypeptide
DEEEIRTTNPVATEQYGCVISTNETEQESTQNEN

SEQ ID NO: 95998 - protein, 34 aa, Artificial Sequence
  Description of Artificial Sequence: Synthetic polypeptide
DEEEIRTTNPVATEQYGCVHTNKHSQERDMEINN

SEQ ID NO: 95999 - protein, 35 aa, Artificial Sequence
  Description of Artificial Sequence: Synthetic polypeptide
AEEEIRTTNPVATEQYGSVSTNTNQQGNQQGNGNE

SEQ ID NO: 96000 - protein, 35 aa, Artificial Sequence
  Description of Artificial Sequence: Synthetic polypeptide
AEEEIRTTNPVATEQYGSVSTNTNQNNQEGNNEED

SEQ ID NO: 96001 - protein, 35 aa, Artificial Sequence
  Description of Artificial Sequence: Synthetic polypeptide
AEEEIRTTNPVATEQYGSVSTNTNQNGNQQGNQNA

SEQ ID NO: 96002 - protein, 36 aa, Artificial Sequence
  Description of Artificial Sequence: Synthetic polypeptide
AEEEIRTTNPVATEQYGSVSTNTNQLGNNQQGNNNE

SEQ ID NO: 96003 - protein, 32 aa, Artificial Sequence
  Description of Artificial Sequence: Synthetic polypeptide
DEEEIRTTNPIATEQWGSVPTWDLADRGGKEE

SEQ ID NO: 96004 - protein, 32 aa, Artificial Sequence
  Description of Artificial Sequence: Synthetic polypeptide
DEEEIRTTNPVATEQYGCVGNTMNDIENGSDQ

SEQ ID NO: 96005 - protein, 35 aa, Artificial Sequence
  Description of Artificial Sequence: Synthetic polypeptide
AEEEIRTTNPVATEQYGSVSTNTNNQNQETGNNTQ

SEQ ID NO: 96006 - protein, 34 aa, Artificial Sequence
  Description of Artificial Sequence: Synthetic polypeptide
DEEEIRTTNPIATEQYGSVSATTPAGNMRNGNPV

SEQ ID NO: 96007 - protein, 34 aa, Artificial Sequence
  Description of Artificial Sequence: Synthetic polypeptide
AEEEIRTTNPVATEQYGSVSTNTNNMQGTNNVTE

SEQ ID NO: 96008 - protein, 35 aa, Artificial Sequence
  Description of Artificial Sequence: Synthetic polypeptide
AEEEIRTTNPVATEQYGSVSTNTNNENQTETGNNT

SEQ ID NO: 96009 - protein, 34 aa, Artificial Sequence
  Description of Artificial Sequence: Synthetic polypeptide
DEEEIRTTNPIATEQYGSVSSTTPAGPNRNGNPV

SEQ ID NO: 96010 - protein, 35 aa, Artificial Sequence
  Description of Artificial Sequence: Synthetic polypeptide
DEEEIRTTNPIATEQYGSVSSTTPALPNMRGMNPV

SEQ ID NO: 96011 - protein, 35 aa, Artificial Sequence
  Description of Artificial Sequence: Synthetic polypeptide
AEEEIRTTNPVATEQYGSVSTNTNNENQEQGNNNT

SEQ ID NO: 96012 - protein, 32 aa, Artificial Sequence
  Description of Artificial Sequence: Synthetic polypeptide
DEEEIRTTNPVATEQYGCVCVTEEHQNFGSEQ

SEQ ID NO: 96013 - protein, 34 aa, Artificial Sequence
  Description of Artificial Sequence: Synthetic polypeptide
DEEEIRTTNPVATEQYGCVCSYGELQNFGSENQV

SEQ ID NO: 96014 - protein, 33 aa, Artificial Sequence
  Description of Artificial Sequence: Synthetic polypeptide
DEEEIRTTNPVATEQYGCVCSWYHQNFGSNTDG

SEQ ID NO: 96015 - protein, 32 aa, Artificial Sequence
  Description of Artificial Sequence: Synthetic polypeptide
DEEEIRTTNPVATEQYGCVGNTGNLIEYISDQ

SEQ ID NO: 96016 - protein, 35 aa, Artificial Sequence
  Description of Artificial Sequence: Synthetic polypeptide
AEEEIRTTNPVATEQYGSVSTTNGNQTNNNIGTNM

SEQ ID NO: 96017 - protein, 33 aa, Artificial Sequence
  Description of Artificial Sequence: Synthetic polypeptide
DEEEIRTTNPVATEQYGCVTSTEHQNFNSNNQT

SEQ ID NO: 96018 - protein, 32 aa, Artificial Sequence
  Description of Artificial Sequence: Synthetic polypeptide
SEEEIRTTNPVATEQYGSVAPNALQEDQFDQQ

SEQ ID NO: 96019 - protein, 34 aa, Artificial Sequence
  Description of Artificial Sequence: Synthetic polypeptide
DEEEIRTTNPVATEQYGDVVSTVNNGQGEDDNED

SEQ ID NO: 96020 - protein, 36 aa, Artificial Sequence
  Description of Artificial Sequence: Synthetic polypeptide
AEEEIRTTNPVATEQYGSVSTTNNLQQQANQQGTNE

SEQ ID NO: 96021 - protein, 34 aa, Artificial Sequence
  Description of Artificial Sequence: Synthetic polypeptide
AEEEIRTTNPVATEQYGSVSTTNNLQQQAEEEED

SEQ ID NO: 96022 - protein, 34 aa, Artificial Sequence
  Description of Artificial Sequence: Synthetic polypeptide
DEEEIRTTNPVATEQYGDVVSTSNTQFEFGGQEE

SEQ ID NO: 96023 - protein, 34 aa, Artificial Sequence
  Description of Artificial Sequence: Synthetic polypeptide
DEEEIRTTNPVATEQYGDVVSTSNTQFEFDGGEQ

SEQ ID NO: 96024 - protein, 34 aa, Artificial Sequence
  Description of Artificial Sequence: Synthetic polypeptide
DEEEIRTTNPVATEQYGDVVSTNVVFGVGGNFGA

SEQ ID NO: 96025 - protein, 34 aa, Artificial Sequence
  Description of Artificial Sequence: Synthetic polypeptide
DEEEIRTTNPVATEQYGDVVSTMDLSNGPGENQT

SEQ ID NO: 96026 - protein, 36 aa, Artificial Sequence
  Description of Artificial Sequence: Synthetic polypeptide
AEEEIRTTNPVATEQYGSVSTTNNLQQNTETGNTNV

SEQ ID NO: 96027 - protein, 34 aa, Artificial Sequence
  Description of Artificial Sequence: Synthetic polypeptide
DEEEIRTTNPVATEQYGDVVSTDGFGQGEGNNEI

SEQ ID NO: 96028 - protein, 36 aa, Artificial Sequence
  Description of Artificial Sequence: Synthetic polypeptide
AEEEIRTTNPVATEQYGSVSTTNNLQQNQNGTTNAD

SEQ ID NO: 96029 - protein, 33 aa, Artificial Sequence
  Description of Artificial Sequence: Synthetic polypeptide
DEEEIRTTNPVATEQYGDVVSNSGDQNGGNEDG

SEQ ID NO: 96030 - protein, 33 aa, Artificial Sequence
  Description of Artificial Sequence: Synthetic polypeptide
DEEEIRTTNPVATEQYGDVVSNSGDQNEGGNEI

SEQ ID NO: 96031 - protein, 33 aa, Artificial Sequence
  Description of Artificial Sequence: Synthetic polypeptide
DEEEIRTTNPVATEQYGDVVSNADGDQNEGNNI

SEQ ID NO: 96032 - protein, 34 aa, Artificial Sequence
  Description of Artificial Sequence: Synthetic polypeptide
DEEEIRTTNPVATEQYGDVVSITSNTQFEFEGGF

SEQ ID NO: 96033 - protein, 34 aa, Artificial Sequence
  Description of Artificial Sequence: Synthetic polypeptide
DEEEIRTTNPVATEQYGDVVSITDNGGEDEGGNG

SEQ ID NO: 96034 - protein, 34 aa, Artificial Sequence
  Description of Artificial Sequence: Synthetic polypeptide
DEEEIRTTNPVATEQYGDVVSISNYGQTGGGNGQ

SEQ ID NO: 96035 - protein, 34 aa, Artificial Sequence
  Description of Artificial Sequence: Synthetic polypeptide
DEEEIRTTNPVATEQYGDVVSISNYGQTGGGNGD

SEQ ID NO: 96036 - protein, 34 aa, Artificial Sequence
  Description of Artificial Sequence: Synthetic polypeptide
DEEEIRTTNPVATEQYGDVVSISNGMGQTGGGNI

SEQ ID NO: 96037 - protein, 36 aa, Artificial Sequence
  Description of Artificial Sequence: Synthetic polypeptide
AEEEIRTTNPVATEQYGSVSTTNNLQQGTTENQGEM

SEQ ID NO: 96038 - protein, 36 aa, Artificial Sequence
  Description of Artificial Sequence: Synthetic polypeptide
AEEEIRTTNPVATEQYGSVSTTNNLQQGTEGGNEGT

SEQ ID NO: 96039 - protein, 36 aa, Artificial Sequence
  Description of Artificial Sequence: Synthetic polypeptide
AEEEIRTTNPVATEQYGSVSTTNNLQQGNNQQGTDE

SEQ ID NO: 96040 - protein, 33 aa, Artificial Sequence
  Description of Artificial Sequence: Synthetic polypeptide
DEEEIRTTNPVATEQYGDVVSVGNMTEGEGGNG

SEQ ID NO: 96041 - protein, 35 aa, Artificial Sequence
  Description of Artificial Sequence: Synthetic polypeptide
AEEEIRTTNPVATEQYGSVSTTNNLQQGATEQGEG

SEQ ID NO: 96042 - protein, 33 aa, Artificial Sequence
  Description of Artificial Sequence: Synthetic polypeptide
DEEEIRTTNPVATEQYGDVVTDDELQEQIGEGQ

SEQ ID NO: 96043 - protein, 33 aa, Artificial Sequence
  Description of Artificial Sequence: Synthetic polypeptide
DEEEIRTTNPVATEQYGDVVTDNTNGQSEDGEI

SEQ ID NO: 96044 - protein, 34 aa, Artificial Sequence
  Description of Artificial Sequence: Synthetic polypeptide
AEEEIRTTNPVATEQYGSVSTTNNNAITEAGNGT

SEQ ID NO: 96045 - protein, 32 aa, Artificial Sequence
  Description of Artificial Sequence: Synthetic polypeptide
DEEEIRTTNPVATEQYGEASSTTPAGNMHGNV

SEQ ID NO: 96046 - protein, 34 aa, Artificial Sequence
  Description of Artificial Sequence: Synthetic polypeptide
AEEEIRTTNPVATEQYGSVSTTNNMQGTNNVTEA

SEQ ID NO: 96047 - protein, 36 aa, Artificial Sequence
  Description of Artificial Sequence: Synthetic polypeptide
AEEEIRTTNPVATEQYGSVSTTNNLQSGTEQGNETN

SEQ ID NO: 96048 - protein, 33 aa, Artificial Sequence
  Description of Artificial Sequence: Synthetic polypeptide
DEEEIRTTNPVATEQYGDVYGTDEGQTEQGNGQ

SEQ ID NO: 96049 - protein, 33 aa, Artificial Sequence
  Description of Artificial Sequence: Synthetic polypeptide
DEEEIRTTNPVATEQYGDVYGTDEGQTEGNNQS

SEQ ID NO: 96050 - protein, 33 aa, Artificial Sequence
  Description of Artificial Sequence: Synthetic polypeptide
DEEEIRTTNPVATEQYGDVYGTDEGQNIGGNEQ

SEQ ID NO: 96051 - protein, 33 aa, Artificial Sequence
  Description of Artificial Sequence: Synthetic polypeptide
DEEEIRTTNPVATEQYGDVYGTDEGQGDGENEQ

SEQ ID NO: 96052 - protein, 36 aa, Artificial Sequence
  Description of Artificial Sequence: Synthetic polypeptide
AEEEIRTTNPVATEQYGSVSTTNNLQQQQTEGTNDE

SEQ ID NO: 96053 - protein, 32 aa, Artificial Sequence
  Description of Artificial Sequence: Synthetic polypeptide
DEEEIRTTNPVATEQYGDVYGNGGEDEGGNNG

SEQ ID NO: 96054 - protein, 32 aa, Artificial Sequence
  Description of Artificial Sequence: Synthetic polypeptide
DEEEIRTTNPVATEQYGDVYGDDEGQGEGNEQ

SEQ ID NO: 96055 - protein, 34 aa, Artificial Sequence
  Description of Artificial Sequence: Synthetic polypeptide
DEEEIRTTNPVATEQYGDVVTGIQNDGQTGGNEG

SEQ ID NO: 96056 - protein, 34 aa, Artificial Sequence
  Description of Artificial Sequence: Synthetic polypeptide
DEEEIRTTNPVATEQYGDVVTGIQNDGQGQGNGE

SEQ ID NO: 96057 - protein, 34 aa, Artificial Sequence
  Description of Artificial Sequence: Synthetic polypeptide
DEEEIRTTNPVATEQYGDVVTGIQNDGQGGNQDG

SEQ ID NO: 96058 - protein, 31 aa, Artificial Sequence
  Description of Artificial Sequence: Synthetic polypeptide
SEEEIRPTNPIATEQYGAVVDEMNGMRGNLR

SEQ ID NO: 96059 - protein, 30 aa, Artificial Sequence
  Description of Artificial Sequence: Synthetic polypeptide
SEEEIRPTNPIATEQYGAVVEMNGDRGNDN

SEQ ID NO: 96060 - protein, 31 aa, Artificial Sequence
  Description of Artificial Sequence: Synthetic polypeptide
SEEEIRPTNPIATEQYGAVVEMNGFPRGNDR

SEQ ID NO: 96061 - protein, 36 aa, Artificial Sequence
  Description of Artificial Sequence: Synthetic polypeptide
AEEEIRTTNPVATEQYGSVSTTNNLQQQGNGNTNTD

SEQ ID NO: 96062 - protein, 34 aa, Artificial Sequence
  Description of Artificial Sequence: Synthetic polypeptide
DEEEIRTTNPVATEQYGDVVTGIQNDDQGGNNEQ

SEQ ID NO: 96063 - protein, 32 aa, Artificial Sequence
  Description of Artificial Sequence: Synthetic polypeptide
DEEEIRTTNPVATEQYGDVVTGGGQTGGGEQE

SEQ ID NO: 96064 - protein, 33 aa, Artificial Sequence
  Description of Artificial Sequence: Synthetic polypeptide
DEEEIRTTNPVATEQYGDVVTDNTNIGQSEGSE

SEQ ID NO: 96065 - protein, 34 aa, Artificial Sequence
  Description of Artificial Sequence: Synthetic polypeptide
DEEEIRTTNPVATEQYGDVVTDNGQSEGGGNEEN

SEQ ID NO: 96066 - protein, 34 aa, Artificial Sequence
  Description of Artificial Sequence: Synthetic polypeptide
DEEEIRTTNPVATEQYGDVVSISNDGQTGGGGNG

SEQ ID NO: 96067 - protein, 34 aa, Artificial Sequence
  Description of Artificial Sequence: Synthetic polypeptide
DEEEIRTTNPVATEQYGDVVSINGSGDQNGGNTE

SEQ ID NO: 96068 - protein, 30 aa, Artificial Sequence
  Description of Artificial Sequence: Synthetic polypeptide
SEEEIRSTNPISTEQYGSVANNIMSRVGQR

SEQ ID NO: 96069 - protein, 36 aa, Artificial Sequence
  Description of Artificial Sequence: Synthetic polypeptide
AEEEIRTTNPVATEQYGSVSTTNNLQEGTEAGNQTN

SEQ ID NO: 96070 - protein, 36 aa, Artificial Sequence
  Description of Artificial Sequence: Synthetic polypeptide
AEEEIRTTNPVATEQYGSVSTTNNLQEGNEGNNNTN

SEQ ID NO: 96071 - protein, 35 aa, Artificial Sequence
  Description of Artificial Sequence: Synthetic polypeptide
AEEEIRTTNPVATEQYGSVSTTNNLQDEEGETEED

SEQ ID NO: 96072 - protein, 36 aa, Artificial Sequence
  Description of Artificial Sequence: Synthetic polypeptide
AEEEIRTTNPVATEQYGSVSTTNNLQAGTEEGNEGV

SEQ ID NO: 96073 - protein, 33 aa, Artificial Sequence
  Description of Artificial Sequence: Synthetic polypeptide
DEEEIRTTNPVATEQYGDVVGSNSGDQGNGGNT

SEQ ID NO: 96074 - protein, 35 aa, Artificial Sequence
  Description of Artificial Sequence: Synthetic polypeptide
DEEEIRTTNPVATEQYGDVVGSGTNGQSEGGGGNG

SEQ ID NO: 96075 - protein, 32 aa, Artificial Sequence
  Description of Artificial Sequence: Synthetic polypeptide
DEEEIRTTNPVATEQYGDVVGSGQGDQEGGED

SEQ ID NO: 96076 - protein, 33 aa, Artificial Sequence
  Description of Artificial Sequence: Synthetic polypeptide
DEEEIRTTNPVATEQYGDVVGSGNNDGQEGGTN

SEQ ID NO: 96077 - protein, 33 aa, Artificial Sequence
  Description of Artificial Sequence: Synthetic polypeptide
DEEEIRTTNPVATEQYGDVVGSGMGQGGGNDND

SEQ ID NO: 96078 - protein, 35 aa, Artificial Sequence
  Description of Artificial Sequence: Synthetic polypeptide
AEEEIRTTNPVATEQYGSVSTTNNLNYGNNGNNQV

SEQ ID NO: 96079 - protein, 35 aa, Artificial Sequence
  Description of Artificial Sequence: Synthetic polypeptide
AEEEIRTTNPVATEQYGSVSTTNNLNQQNDENATE

SEQ ID NO: 96080 - protein, 35 aa, Artificial Sequence
  Description of Artificial Sequence: Synthetic polypeptide
AEEEIRTTNPVATEQYGSVSTTNNLNQNQNQDEDE

SEQ ID NO: 96081 - protein, 32 aa, Artificial Sequence
  Description of Artificial Sequence: Synthetic polypeptide
SEEEIRTTNPIATEQYGSTTWSNENLAERGPI

SEQ ID NO: 96082 - protein, 34 aa, Artificial Sequence
  Description of Artificial Sequence: Synthetic polypeptide
DEEEIRTTNPVATEQYGDVVGFGNLGQGDGNGEE

SEQ ID NO: 96083 - protein, 33 aa, Artificial Sequence
  Description of Artificial Sequence: Synthetic polypeptide
DEEEIRTTNPVATEQYGDVVGDENLNGGGNGEQ

SEQ ID NO: 96084 - protein, 36 aa, Artificial Sequence
  Description of Artificial Sequence: Synthetic polypeptide
AEEEIRTTNPVATEQYGSVSTTNNLNNNQQGTNATE

SEQ ID NO: 96085 - protein, 36 aa, Artificial Sequence
  Description of Artificial Sequence: Synthetic polypeptide
AEEEIRTTNPVATEQYGSVSTTNNLNLQQGNNNQNQ

SEQ ID NO: 96086 - protein, 34 aa, Artificial Sequence
  Description of Artificial Sequence: Synthetic polypeptide
DEEEIRTTNPVATEQYGDVVDTNNTDQNIGGNEN

SEQ ID NO: 96087 - protein, 36 aa, Artificial Sequence
  Description of Artificial Sequence: Synthetic polypeptide
AEEEIRTTNPVATEQYGSVSTTNNLNEQDEGNNTTT

SEQ ID NO: 96088 - protein, 36 aa, Artificial Sequence
  Description of Artificial Sequence: Synthetic polypeptide
AEEEIRTTNPVATEQYGSVSTTNNLNDNQQGNNNTE

SEQ ID NO: 96089 - protein, 36 aa, Artificial Sequence
  Description of Artificial Sequence: Synthetic polypeptide
AEEEIRTTNPVATEQYGSVSTTNNLLQQGEQGGNQG

SEQ ID NO: 96090 - protein, 36 aa, Artificial Sequence
  Description of Artificial Sequence: Synthetic polypeptide
AEEEIRTTNPVATEQYGSVSTTNNLQEGTEQGNNTT

SEQ ID NO: 96091 - protein, 36 aa, Artificial Sequence
  Description of Artificial Sequence: Synthetic polypeptide
AEEEIRTTNPVATEQYGSVSTTNNLQENDNGNQGTN

SEQ ID NO: 96092 - protein, 36 aa, Artificial Sequence
  Description of Artificial Sequence: Synthetic polypeptide
AEEEIRTTNPVATEQYGSVSTTNNLQENNNGNNDTN

SEQ ID NO: 96093 - protein, 30 aa, Artificial Sequence
  Description of Artificial Sequence: Synthetic polypeptide
SEEEIRTTNPIATECYGSVANANWAEPGNI

SEQ ID NO: 96094 - protein, 36 aa, Artificial Sequence
  Description of Artificial Sequence: Synthetic polypeptide
AEEEIRTTNPVATEQYGSVSTTNNLQQANNGNNNVE

SEQ ID NO: 96095 - protein, 35 aa, Artificial Sequence
  Description of Artificial Sequence: Synthetic polypeptide
AEEEIRTTNPVATEQYGSVSTTNNLQNSNNANNQD

SEQ ID NO: 96096 - protein, 32 aa, Artificial Sequence
  Description of Artificial Sequence: Synthetic polypeptide
DEEEIRTTNPCATEQWGSVCYNIEKRDGNNDS

SEQ ID NO: 96097 - protein, 34 aa, Artificial Sequence
  Description of Artificial Sequence: Synthetic polypeptide
DEEEIRTTNPVATEQYGDVVSEMNNTQEGSGNEN

SEQ ID NO: 96098 - protein, 34 aa, Artificial Sequence
  Description of Artificial Sequence: Synthetic polypeptide
DEEEIRTTNPVATEQYGDVVSDNNTDQNEGGNNN

SEQ ID NO: 96099 - protein, 35 aa, Artificial Sequence
  Description of Artificial Sequence: Synthetic polypeptide
DEEEIRTTNPVATEQYGDVVSDNLFNQNEGGNGET

SEQ ID NO: 96100 - protein, 35 aa, Artificial Sequence
  Description of Artificial Sequence: Synthetic polypeptide
DEEEIRTTNPVATEQYGDVVSDGNLNQTIEGNFGE

SEQ ID NO: 96101 - protein, 36 aa, Artificial Sequence
  Description of Artificial Sequence: Synthetic polypeptide
AEEEIRTTNPVATEQYGSVSTTNNLQNQEQGNQQTE

SEQ ID NO: 96102 - protein, 36 aa, Artificial Sequence
  Description of Artificial Sequence: Synthetic polypeptide
AEEEIRTTNPVATEQYGSVSTTNNLQNNQQGTNTTN

SEQ ID NO: 96103 - protein, 36 aa, Artificial Sequence
  Description of Artificial Sequence: Synthetic polypeptide
AEEEIRTTNPVATEQYGSVSTTNNLQNNEQGNAQGE

SEQ ID NO: 96104 - protein, 31 aa, Artificial Sequence
  Description of Artificial Sequence: Synthetic polypeptide
DEEEIRTTNPVATEQYGEASSTVCNMRNEEK

SEQ ID NO: 96105 - protein, 36 aa, Artificial Sequence
  Description of Artificial Sequence: Synthetic polypeptide
AEEEIRTTNPVATEQYGSVSTTNNLQNGSTNGNNQD

SEQ ID NO: 96106 - protein, 36 aa, Artificial Sequence
  Description of Artificial Sequence: Synthetic polypeptide
AEEEIRTTNPVATEQYGSVSTTNNLQLQTNGNNNQG

SEQ ID NO: 96107 - protein, 35 aa, Artificial Sequence
  Description of Artificial Sequence: Synthetic polypeptide
AEEEIRTTNPVATEQYGSVSTTNNLQIGSTDEETE

SEQ ID NO: 96108 - protein, 36 aa, Artificial Sequence
  Description of Artificial Sequence: Synthetic polypeptide
AEEEIRTTNPVATEQYGSVSTTNNLQIGSTDEEQNE

SEQ ID NO: 96109 - protein, 36 aa, Artificial Sequence
  Description of Artificial Sequence: Synthetic polypeptide
AEEEIRTTNPVATEQYGSVSTTNNLQGNQQGTNTTE

SEQ ID NO: 96110 - protein, 35 aa, Artificial Sequence
  Description of Artificial Sequence: Synthetic polypeptide
AEEEIRTTNPVATEQYGSVSTTNNLQGNPNNNQNE

SEQ ID NO: 96111 - protein, 32 aa, Artificial Sequence
  Description of Artificial Sequence: Synthetic polypeptide
SEEEIRTTNPCAYEQYGSCATNLQESGNDNQM

SEQ ID NO: 96112 - protein, 34 aa, Artificial Sequence
  Description of Artificial Sequence: Synthetic polypeptide
DEEEIRTTNPVATEQYGDVVNGQTNEIQGGGGNE

SEQ ID NO: 96113 - protein, 31 aa, Artificial Sequence
  Description of Artificial Sequence: Synthetic polypeptide
SEEEIRTTNPIATECWGSTVSNADWMERGNR

SEQ ID NO: 96114 - protein, 30 aa, Artificial Sequence
  Description of Artificial Sequence: Synthetic polypeptide
SEEEIRTTNPIATECYGSTVAEDWMPGNYR

SEQ ID NO: 96115 - protein, 36 aa, Artificial Sequence
  Description of Artificial Sequence: Synthetic polypeptide
AEEEIRTTNPVATEQYGSVSTTNNLQGNDNGNNGTE

SEQ ID NO: 96116 - protein, 35 aa, Artificial Sequence
  Description of Artificial Sequence: Synthetic polypeptide
AEEEIRTTNPVATEQYGSVSTTNNLQNGEEEAEED

SEQ ID NO: 96117 - protein, 34 aa, Artificial Sequence
  Description of Artificial Sequence: Synthetic polypeptide
AEEEIRTTNPVATEQYGSVSTTNNNAITEEGTNG

SEQ ID NO: 96118 - protein, 31 aa, Artificial Sequence
  Description of Artificial Sequence: Synthetic polypeptide
DEEEIRTTNPVATEQYGEASTACQHNEMEPV

SEQ ID NO: 96119 - protein, 31 aa, Artificial Sequence
  Description of Artificial Sequence: Synthetic polypeptide
DEEEIRTTNPVATEQYGEASTVCQHNEMEPV

SEQ ID NO: 96120 - protein, 35 aa, Artificial Sequence
  Description of Artificial Sequence: Synthetic polypeptide
AEEEIRTTNPVATEQYGSVSTTNNNQQQIGNNDGE

SEQ ID NO: 96121 - protein, 36 aa, Artificial Sequence
  Description of Artificial Sequence: Synthetic polypeptide
AEEEIRTTNPVATEQYGSVSTTNNNQQLQEGTNQTN

SEQ ID NO: 96122 - protein, 35 aa, Artificial Sequence
  Description of Artificial Sequence: Synthetic polypeptide
AEEEIRTTNPVATEQYGSVSTTNNNQQGTQGTNSA

SEQ ID NO: 96123 - protein, 30 aa, Artificial Sequence
  Description of Artificial Sequence: Synthetic polypeptide
SEEEIRCTNPIGTEQYGAVSEMNGMRDNDR

SEQ ID NO: 96124 - protein, 35 aa, Artificial Sequence
  Description of Artificial Sequence: Synthetic polypeptide
AEEEIRTTNPVATEQYGSVSTTNNNQQGNDGINEE

SEQ ID NO: 96125 - protein, 28 aa, Artificial Sequence
  Description of Artificial Sequence: Synthetic peptide
SEEEIRCTNPISTEGYGNVAETIQRGQR

SEQ ID NO: 96126 - protein, 30 aa, Artificial Sequence
  Description of Artificial Sequence: Synthetic polypeptide
SEEEIRCTNPISTEPYGSISEENLMRNGNH

SEQ ID NO: 96127 - protein, 34 aa, Artificial Sequence
  Description of Artificial Sequence: Synthetic polypeptide
DEEEIRTTNPVATEQYGFCQSITNNEIQEQEANR

SEQ ID NO: 96128 - protein, 35 aa, Artificial Sequence
  Description of Artificial Sequence: Synthetic polypeptide
AEEEIRTTNPVATEQYGSVSTTNNNNQQQIGNNDG

SEQ ID NO: 96129 - protein, 34 aa, Artificial Sequence
  Description of Artificial Sequence: Synthetic polypeptide
DEEEIRTTNPVATEQYGEVVTGTNFGQEGGGNQA

SEQ ID NO: 96130 - protein, 34 aa, Artificial Sequence
  Description of Artificial Sequence: Synthetic polypeptide
DEEEIRTTNPVATEQYGEVVTGTNFGQEGGGNGG

SEQ ID NO: 96131 - protein, 35 aa, Artificial Sequence
  Description of Artificial Sequence: Synthetic polypeptide
AEEEIRTTNPVATEQYGSVSTTNNNNQQQGNNQSN

SEQ ID NO: 96132 - protein, 33 aa, Artificial Sequence
  Description of Artificial Sequence: Synthetic polypeptide
DEEEIRTTNPVATEQYGEVVGTANMGVGGGNDT

SEQ ID NO: 96133 - protein, 35 aa, Artificial Sequence
  Description of Artificial Sequence: Synthetic polypeptide
AEEEIRTTNPVATEQYGSVSTTNNNNQQIGTNQGS

SEQ ID NO: 96134 - protein, 35 aa, Artificial Sequence
  Description of Artificial Sequence: Synthetic polypeptide
AEEEIRTTNPVATEQYGSVSTTNNNNQQGEENATE

SEQ ID NO: 96135 - protein, 35 aa, Artificial Sequence
  Description of Artificial Sequence: Synthetic polypeptide
DEEEIRTTNPVATEQYGEVSTTPALPNMRNGMNPV

SEQ ID NO: 96136 - protein, 35 aa, Artificial Sequence
  Description of Artificial Sequence: Synthetic polypeptide
AEEEIRTTNPVATEQYGSVSTTNNNNNQQIGENGD

SEQ ID NO: 96137 - protein, 36 aa, Artificial Sequence
  Description of Artificial Sequence: Synthetic polypeptide
AEEEIRTTNPVATEQYGSVSTTNNNNLQQQQGTNNA

SEQ ID NO: 96138 - protein, 30 aa, Artificial Sequence
  Description of Artificial Sequence: Synthetic polypeptide
DEEEIRTTNPCATEGYGCCCSTNDAYGSQQ

SEQ ID NO: 96139 - protein, 35 aa, Artificial Sequence
  Description of Artificial Sequence: Synthetic polypeptide
AEEEIRTTNPVATEQYGSVSTTNNNNEQLGGNNNS

SEQ ID NO: 96140 - protein, 31 aa, Artificial Sequence
  Description of Artificial Sequence: Synthetic polypeptide
DEEEIRTTNPCATEGYGCCCSWENLASGSNQ

SEQ ID NO: 96141 - protein, 32 aa, Artificial Sequence
  Description of Artificial Sequence: Synthetic polypeptide
DEEEIRTTNPCATEEYGSVATGNDHGGRGDAA

SEQ ID NO: 96142 - protein, 33 aa, Artificial Sequence
  Description of Artificial Sequence: Synthetic polypeptide
DEEEIRTTNPVATEQYGFVSSATNYVTTHNTQG

SEQ ID NO: 96143 - protein, 35 aa, Artificial Sequence
  Description of Artificial Sequence: Synthetic polypeptide
AEEEIRTTNPVATEQYGSVSTTNNNQQQIGNNNVD

SEQ ID NO: 96144 - protein, 33 aa, Artificial Sequence
  Description of Artificial Sequence: Synthetic polypeptide
SEEEIRCTNPIAYEQYGSVSCENALSMRTGGNR

SEQ ID NO: 96145 - protein, 35 aa, Artificial Sequence
  Description of Artificial Sequence: Synthetic polypeptide
AEEEIRTTNPVATEQYGSVSTTNNQEQQIGTNTEE

SEQ ID NO: 96146 - protein, 35 aa, Artificial Sequence
  Description of Artificial Sequence: Synthetic polypeptide
DEEEIRTTNPVATEQYGGVVISEFNTLQIPAGNNA

SEQ ID NO: 96147 - protein, 34 aa, Artificial Sequence
  Description of Artificial Sequence: Synthetic polypeptide
AEEEIRTTNPVATEQYGSVSTTNNNSEQGTNTEN

SEQ ID NO: 96148 - protein, 34 aa, Artificial Sequence
  Description of Artificial Sequence: Synthetic polypeptide
AEEEIRTTNPVATEQYGSVSTTNNNQQTNNNELF

SEQ ID NO: 96149 - protein, 35 aa, Artificial Sequence
  Description of Artificial Sequence: Synthetic polypeptide
AEEEIRTTNPVATEQYGSVSTTNNNQQQTNGNNDE

SEQ ID NO: 96150 - protein, 30 aa, Artificial Sequence
  Description of Artificial Sequence: Synthetic polypeptide
DEEEIRTTNPCATEEYGCVCGTNHNGNGDA

SEQ ID NO: 96151 - protein, 35 aa, Artificial Sequence
  Description of Artificial Sequence: Synthetic polypeptide
AEEEIRTTNPVATEQYGSVSTTNNNQQQQQGTNEG

SEQ ID NO: 96152 - protein, 35 aa, Artificial Sequence
  Description of Artificial Sequence: Synthetic polypeptide
AEEEIRTTNPVATEQYGSVSTTNNNQQQQIGTNGT

SEQ ID NO: 96153 - protein, 35 aa, Artificial Sequence
  Description of Artificial Sequence: Synthetic polypeptide
AEEEIRTTNPVATEQYGSVSTTNNNQQQQIGNEGN

SEQ ID NO: 96154 - protein, 35 aa, Artificial Sequence
  Description of Artificial Sequence: Synthetic polypeptide
AEEEIRTTNPVATEQYGSVSTTNNNQQQQGNNEDN

SEQ ID NO: 96155 - protein, 33 aa, Artificial Sequence
  Description of Artificial Sequence: Synthetic polypeptide
DEEEIRTTNPCATEGYGCSCSTNLAYFGSDNQS

SEQ ID NO: 96156 - protein, 35 aa, Artificial Sequence
  Description of Artificial Sequence: Synthetic polypeptide
AEEEIRTTNPVATEQYGSVSTTNNNQQQQDEGNGV

SEQ ID NO: 96157 - protein, 31 aa, Artificial Sequence
  Description of Artificial Sequence: Synthetic polypeptide
SEEEIRCTNPIAYEQWGSVSGENDDHHRGNR

SEQ ID NO: 96158 - protein, 31 aa, Artificial Sequence
  Description of Artificial Sequence: Synthetic polypeptide
SEEEIRCTNPIAYEQWGSVSGENDMEREGNR

SEQ ID NO: 96159 - protein, 31 aa, Artificial Sequence
  Description of Artificial Sequence: Synthetic polypeptide
SEEEIRCTNPIAYEQWGSVSGENDMRNGANR

SEQ ID NO: 96160 - protein, 30 aa, Artificial Sequence
  Description of Artificial Sequence: Synthetic polypeptide
SEEEIRCTNPIAYEQWGSVWGENDMRSGNR

SEQ ID NO: 96161 - protein, 31 aa, Artificial Sequence
  Description of Artificial Sequence: Synthetic polypeptide
DEEEIRTTNPCATEEYGCVCQWNHGRGSNAM

SEQ ID NO: 96162 - protein, 31 aa, Artificial Sequence
  Description of Artificial Sequence: Synthetic polypeptide
DEEEIRTTNPCATEEYGCVTGTEHGRGSNAS

SEQ ID NO: 96163 - protein, 35 aa, Artificial Sequence
  Description of Artificial Sequence: Synthetic polypeptide
AEEEIRTTNPVATEQYGSVSTTNNNQQQIGTNEGD

SEQ ID NO: 96164 - protein, 32 aa, Artificial Sequence
  Description of Artificial Sequence: Synthetic polypeptide
SEEEIRCTNPIAYEQYGSTVSCENQSMRGGNR

SEQ ID NO: 96165 - protein, 33 aa, Artificial Sequence
  Description of Artificial Sequence: Synthetic polypeptide
SEEEIRCTNPIAYEQYGSTVSEGNLSMRGGNNR

SEQ ID NO: 96166 - protein, 32 aa, Artificial Sequence
  Description of Artificial Sequence: Synthetic polypeptide
SEEEIRCTNPIAYEQYGSVISENAHSTRGGNR

SEQ ID NO: 96167 - protein, 35 aa, Artificial Sequence
  Description of Artificial Sequence: Synthetic polypeptide
AEEEIRTTNPVATEQYGSVSTTNNNQQQIGTNETG

SEQ ID NO: 96168 - protein, 34 aa, Artificial Sequence
  Description of Artificial Sequence: Synthetic polypeptide
DEEEIRTTNPVATEQYGDVVDTNFTDQFNIGGNN

SEQ ID NO: 96169 - protein, 36 aa, Artificial Sequence
  Description of Artificial Sequence: Synthetic polypeptide
AEEEIRTTNPVATEQYGSVSTTNNNLQTGNGNTNTD

SEQ ID NO: 96170 - protein, 34 aa, Artificial Sequence
  Description of Artificial Sequence: Synthetic polypeptide
DEEEIRTTNPVATEQYGEVSTDNGLENGQGEIGE

SEQ ID NO: 96171 - protein, 35 aa, Artificial Sequence
  Description of Artificial Sequence: Synthetic polypeptide
AEEEIRTTNPVATEQYGSVSTTNNNLQGNTNNQNE

SEQ ID NO: 96172 - protein, 32 aa, Artificial Sequence
  Description of Artificial Sequence: Synthetic polypeptide
SEEEIRCTNPVATEQYGSVSAEDLEDHEGEDR

SEQ ID NO: 96173 - protein, 31 aa, Artificial Sequence
  Description of Artificial Sequence: Synthetic polypeptide
DEEEIRTTNPCATEPYGSCAATNLAAPGDDA

SEQ ID NO: 96174 - protein, 31 aa, Artificial Sequence
  Description of Artificial Sequence: Synthetic polypeptide
DEEEIRTTNPCATEPYGSCAATNLADGGEWY

SEQ ID NO: 96175 - protein, 36 aa, Artificial Sequence
  Description of Artificial Sequence: Synthetic polypeptide
AEEEIRTTNPVATEQYGSVSTTNNNLQAGIIGTNVD

SEQ ID NO: 96176 - protein, 36 aa, Artificial Sequence
  Description of Artificial Sequence: Synthetic polypeptide
AEEEIRTTNPVATEQYGSVSTTNNNLNQQGNNQNQD

SEQ ID NO: 96177 - protein, 35 aa, Artificial Sequence
  Description of Artificial Sequence: Synthetic polypeptide
AEEEIRTTNPVATEQYGSVSTTNNNLNQEQGETED

SEQ ID NO: 96178 - protein, 36 aa, Artificial Sequence
  Description of Artificial Sequence: Synthetic polypeptide
AEEEIRTTNPVATEQYGSVSTTNNNLNNQLNGNNVD

SEQ ID NO: 96179 - protein, 35 aa, Artificial Sequence
  Description of Artificial Sequence: Synthetic polypeptide
AEEEIRTTNPVATEQYGSVSTTNNNLNNGEEEAND

SEQ ID NO: 96180 - protein, 30 aa, Artificial Sequence
  Description of Artificial Sequence: Synthetic polypeptide
DEEEIRTTNPCATEPYGSCATNHMDQNEAM

SEQ ID NO: 96181 - protein, 35 aa, Artificial Sequence
  Description of Artificial Sequence: Synthetic polypeptide
AEEEIRTTNPVATEQYGSVSTTNNNLEQGTDEENE

SEQ ID NO: 96182 - protein, 32 aa, Artificial Sequence
  Description of Artificial Sequence: Synthetic polypeptide
DEEEIRTTNPCATEPYGSCATNLADAPGDNSW

SEQ ID NO: 96183 - protein, 32 aa, Artificial Sequence
  Description of Artificial Sequence: Synthetic polypeptide
DEEEIRTTNPCATEPYGSCATNLADAQGMNEW

SEQ ID NO: 96184 - protein, 35 aa, Artificial Sequence
  Description of Artificial Sequence: Synthetic polypeptide
AEEEIRTTNPVATEQYGSVSTTNNNGNQQIGENED

SEQ ID NO: 96185 - protein, 35 aa, Artificial Sequence
  Description of Artificial Sequence: Synthetic polypeptide
AEEEIRTTNPVATEQYGSVSTTNNNEQQIGTNEEQ

SEQ ID NO: 96186 - protein, 34 aa, Artificial Sequence
  Description of Artificial Sequence: Synthetic polypeptide
AEEEIRTTNPVATEQYGSVSTTNNNDTLGGTNLI

SEQ ID NO: 96187 - protein, 30 aa, Artificial Sequence
  Description of Artificial Sequence: Synthetic polypeptide
DEEEIRTTNPCATEPYGSTATNHGESPNAM

SEQ ID NO: 96188 - protein, 34 aa, Artificial Sequence
  Description of Artificial Sequence: Synthetic polypeptide
AEEEIRTTNPVATEQYGSVSTTNNNANTEQGENG

SEQ ID NO: 96189 - protein, 33 aa, Artificial Sequence
  Description of Artificial Sequence: Synthetic polypeptide
DEEEIRTTNPVATEQYGECQSTPNEIQEQEANY

SEQ ID NO: 96190 - protein, 34 aa, Artificial Sequence
  Description of Artificial Sequence: Synthetic polypeptide
AEEEIRTTNPVATEQYGSVSTTNNNAITETGNVG

SEQ ID NO: 96191 - protein, 34 aa, Artificial Sequence
  Description of Artificial Sequence: Synthetic polypeptide
AEEEIRTTNPVATEQYGSVSTTNNNAITETGNTG

SEQ ID NO: 96192 - protein, 36 aa, Artificial Sequence
  Description of Artificial Sequence: Synthetic polypeptide
AEEEIRTTNPVATEQYGSVSTTNNNLQLQIGTNQGE

SEQ ID NO: 96193 - protein, 35 aa, Artificial Sequence
  Description of Artificial Sequence: Synthetic polypeptide
AEEEIRTTNPVATEQYGSVSTTNNNLQNEEGETED

SEQ ID NO: 96194 - protein, 36 aa, Artificial Sequence
  Description of Artificial Sequence: Synthetic polypeptide
AEEEIRTTNPVATEQYGSVSTTNNNLQNGNGETTED

SEQ ID NO: 96195 - protein, 36 aa, Artificial Sequence
  Description of Artificial Sequence: Synthetic polypeptide
AEEEIRTTNPVATEQYGSVSTTNNNLQQGIGTNQSA

SEQ ID NO: 96196 - protein, 34 aa, Artificial Sequence
  Description of Artificial Sequence: Synthetic polypeptide
DEEEIRTTNPVATEQYGEVSTDNGGETGGNENGE

SEQ ID NO: 96197 - protein, 35 aa, Artificial Sequence
  Description of Artificial Sequence: Synthetic polypeptide
AEEEIRTTNPVATEQYGSVSTTNNNLQQQNENATD

SEQ ID NO: 96198 - protein, 36 aa, Artificial Sequence
  Description of Artificial Sequence: Synthetic polypeptide
AEEEIRTTNPVATEQYGSVSTTNNNLQQQIGTNQGQ

SEQ ID NO: 96199 - protein, 34 aa, Artificial Sequence
  Description of Artificial Sequence: Synthetic polypeptide
DEEEIRTTNPVATEQYGEVSSTTPAGNMRNGNPK

SEQ ID NO: 96200 - protein, 31 aa, Artificial Sequence
  Description of Artificial Sequence: Synthetic polypeptide
SEEEIRCTNPTAYEQWGSVSGENDHHRGDNR

SEQ ID NO: 96201 - protein, 35 aa, Artificial Sequence
  Description of Artificial Sequence: Synthetic polypeptide
DEEEIRTTNPVATEQYGEVSSTTNGPNMRNGMNPV

SEQ ID NO: 96202 - protein, 30 aa, Artificial Sequence
  Description of Artificial Sequence: Synthetic polypeptide
SEEEIRCTNPTAYEQWGSVSGENDMHMGNR

SEQ ID NO: 96203 - protein, 34 aa, Artificial Sequence
  Description of Artificial Sequence: Synthetic polypeptide
DEEEIRTTNPVATEQYGEVSSTPVGPNMRNGMNV

SEQ ID NO: 96204 - protein, 33 aa, Artificial Sequence
  Description of Artificial Sequence: Synthetic polypeptide
DEEEIRTTNPCATEGYGSCCSTNLNAYFGSNQA

SEQ ID NO: 96205 - protein, 31 aa, Artificial Sequence
  Description of Artificial Sequence: Synthetic polypeptide
DEEEIRTTNPVATEQYGEVSSEPACNMREEK

SEQ ID NO: 96206 - protein, 33 aa, Artificial Sequence
  Description of Artificial Sequence: Synthetic polypeptide
DEEEIRTTNPVATEQYGEVSTDNMNETEGGEVE

SEQ ID NO: 96207 - protein, 34 aa, Artificial Sequence
  Description of Artificial Sequence: Synthetic polypeptide
DEEEIRTTNPCATEHYGSVVSEGTMSSQHGGSNR

SEQ ID NO: 96208 - protein, 32 aa, Artificial Sequence
  Description of Artificial Sequence: Synthetic polypeptide
SEEEIRCTNPVATECWGSVSCINEPQREGENG

SEQ ID NO: 96209 - protein, 32 aa, Artificial Sequence
  Description of Artificial Sequence: Synthetic polypeptide
SEEEIRCTNPVATECWGSVSCINLPMDRGENG

SEQ ID NO: 96210 - protein, 36 aa, Artificial Sequence
  Description of Artificial Sequence: Synthetic polypeptide
AEEEIRTTNPVATEQYGSVSTTNNNLQQNEQIGNVD

SEQ ID NO: 96211 - protein, 29 aa, Artificial Sequence
  Description of Artificial Sequence: Synthetic peptide
SEEEIRCTNPVATEQWGDVSEIEMNRGDA

SEQ ID NO: 96212 - protein, 32 aa, Artificial Sequence
  Description of Artificial Sequence: Synthetic polypeptide
DEEEIRTTNPVATEQYGEVPTTPVGQHGMEPV

SEQ ID NO: 96213 - protein, 32 aa, Artificial Sequence
  Description of Artificial Sequence: Synthetic polypeptide
DEEEIRTTNPVATEQYGEVPTTPVGQHGMEPK

SEQ ID NO: 96214 - protein, 33 aa, Artificial Sequence
  Description of Artificial Sequence: Synthetic polypeptide
DEEEIRTTNPVATEQYGEVNSVTMQHQSAVTRF

SEQ ID NO: 96215 - protein, 36 aa, Artificial Sequence
  Description of Artificial Sequence: Synthetic polypeptide
AEEEIRTTNPVATEQYGSVSTTNNNLQQGNQQGNQE

SEQ ID NO: 96216 - protein, 36 aa, Artificial Sequence
  Description of Artificial Sequence: Synthetic polypeptide
AEEEIRTTNPVATEQYGSVSTTNNNLQQGNQNNDEQ

SEQ ID NO: 96217 - protein, 36 aa, Artificial Sequence
  Description of Artificial Sequence: Synthetic polypeptide
AEEEIRTTNPVATEQYGSVSTTNNNLQQGNNANQNF

SEQ ID NO: 96218 - protein, 31 aa, Artificial Sequence
  Description of Artificial Sequence: Synthetic polypeptide
DEEEIRTTNPVATEQYGEVSPEPACNMREEK

SEQ ID NO: 96219 - protein, 35 aa, Artificial Sequence
  Description of Artificial Sequence: Synthetic polypeptide
AEEEIRTTNPVATEQYGSVSTTNNLLQNENGTEGS

SEQ ID NO: 96220 - protein, 35 aa, Artificial Sequence
  Description of Artificial Sequence: Synthetic polypeptide
AEEEIRTTNPVATEQYGSVSTTNNLLQGTNDENDE

SEQ ID NO: 96221 - protein, 36 aa, Artificial Sequence
  Description of Artificial Sequence: Synthetic polypeptide
AEEEIRTTNPVATEQYGSVSTTNNLLQGNQGGNTEG

SEQ ID NO: 96222 - protein, 30 aa, Artificial Sequence
  Description of Artificial Sequence: Synthetic polypeptide
SEEEIRTTNPVATEQWGDVSEILMNAAGDA

SEQ ID NO: 96223 - protein, 33 aa, Artificial Sequence
  Description of Artificial Sequence: Synthetic polypeptide
DEEEIRTTNPVATEQYGDVNDTGDENQEGEGNN

SEQ ID NO: 96224 - protein, 35 aa, Artificial Sequence
  Description of Artificial Sequence: Synthetic polypeptide
AEEEIRTTNPVATEQYGSVSTTNLNQGQTGTTEDE

SEQ ID NO: 96225 - protein, 31 aa, Artificial Sequence
  Description of Artificial Sequence: Synthetic polypeptide
DEEEIRTTNPVATEQYGDVMGVGFGGGGNTS

SEQ ID NO: 96226 - protein, 34 aa, Artificial Sequence
  Description of Artificial Sequence: Synthetic polypeptide
DEEEIRTTNPVATEQYGDVMGSTQNEMTGGGGNE

SEQ ID NO: 96227 - protein, 34 aa, Artificial Sequence
  Description of Artificial Sequence: Synthetic polypeptide
DEEEIRTTNPVATEQYGDVMGSTPNETGTGNGGN

SEQ ID NO: 96228 - protein, 33 aa, Artificial Sequence
  Description of Artificial Sequence: Synthetic polypeptide
DEEEIRTTNPVATEQYGDVMGSDPNEMTGGNEG

SEQ ID NO: 96229 - protein, 33 aa, Artificial Sequence
  Description of Artificial Sequence: Synthetic polypeptide
DEEEIRTTNPVATEQYGDVMGNTDQGGGNGNIG

SEQ ID NO: 96230 - protein, 32 aa, Artificial Sequence
  Description of Artificial Sequence: Synthetic polypeptide
DEEEIRTTNPVATEQYGDVMGLNITGGGNDGF

SEQ ID NO: 96231 - protein, 31 aa, Artificial Sequence
  Description of Artificial Sequence: Synthetic polypeptide
SEEEIRTTNPVATEQYGCVCGTADQNFNSDQ

SEQ ID NO: 96232 - protein, 33 aa, Artificial Sequence
  Description of Artificial Sequence: Synthetic polypeptide
SEEEIRTTNPVATEQYGCVCSMTELQGFGSDQS

SEQ ID NO: 96233 - protein, 35 aa, Artificial Sequence
  Description of Artificial Sequence: Synthetic polypeptide
DEEEIRTTNPVATEQYGDVISTMNLIEGGNGNDQN

SEQ ID NO: 96234 - protein, 32 aa, Artificial Sequence
  Description of Artificial Sequence: Synthetic polypeptide
SEEEIRTTNPVATEQYGCVCSTAHQFFGSEQA

SEQ ID NO: 96235 - protein, 32 aa, Artificial Sequence
  Description of Artificial Sequence: Synthetic polypeptide
SEEEIRTTNPVATEQYGCVCSTEHANFGSNQA

SEQ ID NO: 96236 - protein, 33 aa, Artificial Sequence
  Description of Artificial Sequence: Synthetic polypeptide
SEEEIRTTNPVATEQYGCVCSTEHNQNFGSNQA

SEQ ID NO: 96237 - protein, 33 aa, Artificial Sequence
  Description of Artificial Sequence: Synthetic polypeptide
SEEEIRTTNPVATEQYGCVCSTEHQFFGSNTQY

SEQ ID NO: 96238 - protein, 32 aa, Artificial Sequence
  Description of Artificial Sequence: Synthetic polypeptide
SEEEIRTTNPVATEQYGCVCSTEHQFSGSDQS

SEQ ID NO: 96239 - protein, 36 aa, Artificial Sequence
  Description of Artificial Sequence: Synthetic polypeptide
DEEEIRTTNPVATEQYGDVGSTMNLNQGGNGGNDQT

SEQ ID NO: 96240 - protein, 35 aa, Artificial Sequence
  Description of Artificial Sequence: Synthetic polypeptide
DEEEIRTTNPVATEQYGDVGSTMNLIEGGNGDNDE

SEQ ID NO: 96241 - protein, 33 aa, Artificial Sequence
  Description of Artificial Sequence: Synthetic polypeptide
DEEEIRTTNPCATEQYGSVATVNLNAAGEEEED

SEQ ID NO: 96242 - protein, 34 aa, Artificial Sequence
  Description of Artificial Sequence: Synthetic polypeptide
DEEEIRTTNPVATEQYGDVGSTDLEVGVGGNGEI

SEQ ID NO: 96243 - protein, 34 aa, Artificial Sequence
  Description of Artificial Sequence: Synthetic polypeptide
DEEEIRTTNPVATEQYGDVNSDLDNGQEEDGNQS

SEQ ID NO: 96244 - protein, 32 aa, Artificial Sequence
  Description of Artificial Sequence: Synthetic polypeptide
DEEEIRTTNPVATEQYGDVNSNGDQGGGEGQG

SEQ ID NO: 96245 - protein, 34 aa, Artificial Sequence
  Description of Artificial Sequence: Synthetic polypeptide
DEEEIRTTNPVATEQYGDVNSNMNIGQSGGGNDE

SEQ ID NO: 96246 - protein, 29 aa, Artificial Sequence
  Description of Artificial Sequence: Synthetic peptide
DEEEIRTTNPVATEQYGDVPEICMNAEDA

SEQ ID NO: 96247 - protein, 33 aa, Artificial Sequence
  Description of Artificial Sequence: Synthetic polypeptide
DEEEIRTTNPVATEQYGDVSGNQIIESVGGNNT

SEQ ID NO: 96248 - protein, 33 aa, Artificial Sequence
  Description of Artificial Sequence: Synthetic polypeptide
DEEEIRTTNPCATEQYGSCAATNLQMHGDLDAV

SEQ ID NO: 96249 - protein, 33 aa, Artificial Sequence
  Description of Artificial Sequence: Synthetic polypeptide
DEEEIRTTNPVATEQYGDVSGEGQGGQGNGNGD

SEQ ID NO: 96250 - protein, 31 aa, Artificial Sequence
  Description of Artificial Sequence: Synthetic polypeptide
DEEEIRTTNPVATEQYGDVSEPIEMMAAENA

SEQ ID NO: 96251 - protein, 32 aa, Artificial Sequence
  Description of Artificial Sequence: Synthetic polypeptide
DEEEIRTTNPVATEQYGDVSEPAENMAAENPV

SEQ ID NO: 96252 - protein, 33 aa, Artificial Sequence
  Description of Artificial Sequence: Synthetic polypeptide
DEEEIRTTNPCATEQYGSCAATNLQMQGDEHAD

SEQ ID NO: 96253 - protein, 34 aa, Artificial Sequence
  Description of Artificial Sequence: Synthetic polypeptide
DEEEIRTTNPCATEQYGSCAATNLQTMGGDNAAE

SEQ ID NO: 96254 - protein, 32 aa, Artificial Sequence
  Description of Artificial Sequence: Synthetic polypeptide
DEEEIRTTNPCATEQYGSCSSGNIGFHGDNQD

SEQ ID NO: 96255 - protein, 33 aa, Artificial Sequence
  Description of Artificial Sequence: Synthetic polypeptide
DEEEIRTTNPCATEQYGSCSVTNIGFHGDNSDP

SEQ ID NO: 96256 - protein, 30 aa, Artificial Sequence
  Description of Artificial Sequence: Synthetic polypeptide
DEEEIRTTNPVATEQYGDVSEIEMNAAEDA

SEQ ID NO: 96257 - protein, 34 aa, Artificial Sequence
  Description of Artificial Sequence: Synthetic polypeptide
DEEEIRTTNPCATEQYGSVATVNLNLQAGEQEEE

SEQ ID NO: 96258 - protein, 32 aa, Artificial Sequence
  Description of Artificial Sequence: Synthetic polypeptide
DEEEIRTTNPCATEQYGSMVSPVNEPIDVVND

SEQ ID NO: 96259 - protein, 33 aa, Artificial Sequence
  Description of Artificial Sequence: Synthetic polypeptide
DEEEIRTTNPVATEQYGDVSDLMTMGQGEINET

SEQ ID NO: 96260 - protein, 30 aa, Artificial Sequence
  Description of Artificial Sequence: Synthetic polypeptide
DEEEIRTTNPVATEQYGDVSDIEMNAAEDA

SEQ ID NO: 96261 - protein, 33 aa, Artificial Sequence
  Description of Artificial Sequence: Synthetic polypeptide
DEEEIRTTNPVATEQYGDVSDGMTGQGDGENEG

SEQ ID NO: 96262 - protein, 34 aa, Artificial Sequence
  Description of Artificial Sequence: Synthetic polypeptide
DEEEIRTTNPVATEQYGDVSDEMNDLDEIGGNQE

SEQ ID NO: 96263 - protein, 35 aa, Artificial Sequence
  Description of Artificial Sequence: Synthetic polypeptide
DEEEIRTTNPCATEQYGSSVCMTDNLQQNMPSNRK

SEQ ID NO: 96264 - protein, 34 aa, Artificial Sequence
  Description of Artificial Sequence: Synthetic polypeptide
DEEEIRTTNPVATEQYGDVQGTFNNDQGGGENTE

SEQ ID NO: 96265 - protein, 36 aa, Artificial Sequence
  Description of Artificial Sequence: Synthetic polypeptide
AEEEIRTTNPVATEQYGSVSTTNLNQQQQIGNNNNA

SEQ ID NO: 96266 - protein, 35 aa, Artificial Sequence
  Description of Artificial Sequence: Synthetic polypeptide
AEEEIRTTNPVATEQYGSVSTTNLNQQQNNNNQDE

SEQ ID NO: 96267 - protein, 30 aa, Artificial Sequence
  Description of Artificial Sequence: Synthetic polypeptide
DEEEIRTTNPVATEQYGDVPEIEQNAAEDA

SEQ ID NO: 96268 - protein, 29 aa, Artificial Sequence
  Description of Artificial Sequence: Synthetic peptide
DEEEIRTTNPVATEQYGDVPEICMNAEEA

SEQ ID NO: 96269 - protein, 33 aa, Artificial Sequence
  Description of Artificial Sequence: Synthetic polypeptide
DEEEIRTTNPVATEQYGDVSDNTNMGMGGEGEG

SEQ ID NO: 96270 - protein, 33 aa, Artificial Sequence
  Description of Artificial Sequence: Synthetic polypeptide
DEEEIRTTNPCATEQYGSCAATNLQEHQDDNEA

SEQ ID NO: 96271 - protein, 33 aa, Artificial Sequence
  Description of Artificial Sequence: Synthetic polypeptide
SEEEIRTTNPVATEQYGCVCSTELQFFGSETQS

SEQ ID NO: 96272 - protein, 34 aa, Artificial Sequence
  Description of Artificial Sequence: Synthetic polypeptide
DEEEIRTTNPVATEQYGDVFGSDTNGQGEGGGQQ

SEQ ID NO: 96273 - protein, 34 aa, Artificial Sequence
  Description of Artificial Sequence: Synthetic polypeptide
DEEEIRTTNPVATEQYGCVYVWENGIQKHGGDNR

SEQ ID NO: 96274 - protein, 33 aa, Artificial Sequence
  Description of Artificial Sequence: Synthetic polypeptide
DEEEIRTTNPCATEQYGSVCYNIEKRDGDNGDS

SEQ ID NO: 96275 - protein, 36 aa, Artificial Sequence
  Description of Artificial Sequence: Synthetic polypeptide
AEEEIRTTNPVATEQYGSVSTTNLGNQIGTTNSAEQ

SEQ ID NO: 96276 - protein, 33 aa, Artificial Sequence
  Description of Artificial Sequence: Synthetic polypeptide
SEEEIRTTNPVATEQYGCVSVTNLLNENGEVEN

SEQ ID NO: 96277 - protein, 33 aa, Artificial Sequence
  Description of Artificial Sequence: Synthetic polypeptide
SEEEIRTTNPVATEQYGQCVCSTNHQNFGSDQS

SEQ ID NO: 96278 - protein, 33 aa, Artificial Sequence
  Description of Artificial Sequence: Synthetic polypeptide
SEEEIRTTNPVATEQYGQCVCSTNHQNFGSEQS

SEQ ID NO: 96279 - protein, 34 aa, Artificial Sequence
  Description of Artificial Sequence: Synthetic polypeptide
SEEEIRTTNPVATEQYGQCVCSTNLARFNSNFQG

SEQ ID NO: 96280 - protein, 34 aa, Artificial Sequence
  Description of Artificial Sequence: Synthetic polypeptide
SEEEIRTTNPVATEQYGSCNSTLNDLNQNSEEDR

SEQ ID NO: 96281 - protein, 35 aa, Artificial Sequence
  Description of Artificial Sequence: Synthetic polypeptide
AEEEIRTTNPVATEQYGSVSTTNGSNQQGNQNNTD

SEQ ID NO: 96282 - protein, 33 aa, Artificial Sequence
  Description of Artificial Sequence: Synthetic polypeptide
SEEEIRTTNPVATEQYGSCTTTNTLQTREDQIE

SEQ ID NO: 96283 - protein, 32 aa, Artificial Sequence
  Description of Artificial Sequence: Synthetic polypeptide
SEEEIRTTNPVATEQYGSSCIFSTNDHGRNDE

SEQ ID NO: 96284 - protein, 35 aa, Artificial Sequence
  Description of Artificial Sequence: Synthetic polypeptide
AEEEIRTTNPVATEQYGSVSTTNGQQGNQGGNTTN

SEQ ID NO: 96285 - protein, 35 aa, Artificial Sequence
  Description of Artificial Sequence: Synthetic polypeptide
AEEEIRTTNPVATEQYGSVSTTNGQNGNTEGNNQD

SEQ ID NO: 96286 - protein, 35 aa, Artificial Sequence
  Description of Artificial Sequence: Synthetic polypeptide
AEEEIRTTNPVATEQYGSVSTTNGQGNNNIGTNME

SEQ ID NO: 96287 - protein, 35 aa, Artificial Sequence
  Description of Artificial Sequence: Synthetic polypeptide
AEEEIRTTNPVATEQYGSVSTTNGQDGNNQIGTNM

SEQ ID NO: 96288 - protein, 34 aa, Artificial Sequence
  Description of Artificial Sequence: Synthetic polypeptide
DEEEIRTTNPCATEQYGSVIEPTNHHQVVGVNEA

SEQ ID NO: 96289 - protein, 34 aa, Artificial Sequence
  Description of Artificial Sequence: Synthetic polypeptide
DEEEIRTTNPCATEQYGSVIEPTNHQITGVNGAA

SEQ ID NO: 96290 - protein, 34 aa, Artificial Sequence
  Description of Artificial Sequence: Synthetic polypeptide
DEEEIRTTNPCATEQYGSVIEPTNHQITGVNPIP

SEQ ID NO: 96291 - protein, 31 aa, Artificial Sequence
  Description of Artificial Sequence: Synthetic polypeptide
SEEEIRTTNPVATEQYGSVAPALQEHQFDQN

SEQ ID NO: 96292 - protein, 34 aa, Artificial Sequence
  Description of Artificial Sequence: Synthetic polypeptide
DEEEIRTTNPCATEQYGSVIEPTNHQRDMVNLAG

SEQ ID NO: 96293 - protein, 33 aa, Artificial Sequence
  Description of Artificial Sequence: Synthetic polypeptide
DEEEIRTTNPCATEQYGSVIEPTNHQRMVTLAN

SEQ ID NO: 96294 - protein, 35 aa, Artificial Sequence
  Description of Artificial Sequence: Synthetic polypeptide
AEEEIRTTNPVATEQYGSVSTTNLLIGNEQGEGGG

SEQ ID NO: 96295 - protein, 32 aa, Artificial Sequence
  Description of Artificial Sequence: Synthetic polypeptide
DEEEIRTTNPCATEQYGSVCPVALQATGPVQN

SEQ ID NO: 96296 - protein, 34 aa, Artificial Sequence
  Description of Artificial Sequence: Synthetic polypeptide
AEEEIRTTNPVATEQYGSVSTTNLLIGTEGGEGG

SEQ ID NO: 96297 - protein, 34 aa, Artificial Sequence
  Description of Artificial Sequence: Synthetic polypeptide
AEEEIRTTNPVATEQYGSVSTTNLLIGTEGGTGG

SEQ ID NO: 96298 - protein, 36 aa, Artificial Sequence
  Description of Artificial Sequence: Synthetic polypeptide
AEEEIRTTNPVATEQYGSVSTTNLLQQNNQGTNVEG

SEQ ID NO: 96299 - protein, 35 aa, Artificial Sequence
  Description of Artificial Sequence: Synthetic polypeptide
DEEEIRTTNPVATEQYGDVDSGVNGLQEGGNGNGD

SEQ ID NO: 96300 - protein, 33 aa, Artificial Sequence
  Description of Artificial Sequence: Synthetic polypeptide
SEEEIRTTNPVATEQYGCVCSTGNHQNFGSQQA

SEQ ID NO: 96301 - protein, 33 aa, Artificial Sequence
  Description of Artificial Sequence: Synthetic polypeptide
SEEEIRTTNPVATEQYGCVCSTGNHQNNSNFAA

SEQ ID NO: 96302 - protein, 35 aa, Artificial Sequence
  Description of Artificial Sequence: Synthetic polypeptide
SEEEIRTTNPVATEQYGCVCSTGNLNQRFGSDTQA

SEQ ID NO: 96303 - protein, 34 aa, Artificial Sequence
  Description of Artificial Sequence: Synthetic polypeptide
DEEEIRTTNPCATEQYGSVATVNLNLQEGEQQED

SEQ ID NO: 96304 - protein, 36 aa, Artificial Sequence
  Description of Artificial Sequence: Synthetic polypeptide
AEEEIRTTNPVATEQYGSVSTTNLLQQNNQGTNDEG

SEQ ID NO: 96305 - protein, 34 aa, Artificial Sequence
  Description of Artificial Sequence: Synthetic polypeptide
DEEEIRTTNPCATEQYGSVATVNLNLQQGEQTEQ

SEQ ID NO: 96306 - protein, 35 aa, Artificial Sequence
  Description of Artificial Sequence: Synthetic polypeptide
DEEEIRTTNPCATEQYGSVATVNLQLLQEGNQEEE

SEQ ID NO: 96307 - protein, 34 aa, Artificial Sequence
  Description of Artificial Sequence: Synthetic polypeptide
DEEEIRTTNPCATEQYGSVATVNLQNLQQGQEED

SEQ ID NO: 96308 - protein, 34 aa, Artificial Sequence
  Description of Artificial Sequence: Synthetic polypeptide
SEEEIRTTNPVATEQYGCVCSTGEHDQRFGSNTQ

SEQ ID NO: 96309 - protein, 35 aa, Artificial Sequence
  Description of Artificial Sequence: Synthetic polypeptide
DEEEIRTTNPCATEQYGSVATVNTTALQQGTQNED

SEQ ID NO: 96310 - protein, 32 aa, Artificial Sequence
  Description of Artificial Sequence: Synthetic polypeptide
DEEEIRTTNPVATEQYGDMSYDTLEQQNHNEN

SEQ ID NO: 96311 - protein, 36 aa, Artificial Sequence
  Description of Artificial Sequence: Synthetic polypeptide
AEEEIRTTNPVATEQYGSVSTTNLLQQGNEQGTNTE

SEQ ID NO: 96312 - protein, 36 aa, Artificial Sequence
  Description of Artificial Sequence: Synthetic polypeptide
AEEEIRTTNPVATEQYGSVSTTNLLQQGEGGTNANN

SEQ ID NO: 96313 - protein, 33 aa, Artificial Sequence
  Description of Artificial Sequence: Synthetic polypeptide
SEEEIRTTNPVATEQYGCVCSTNLANFNSEFQG

SEQ ID NO: 96314 - protein, 36 aa, Artificial Sequence
  Description of Artificial Sequence: Synthetic polypeptide
AEEEIRTTNPVATEQYGSVSTTNLLQGTELGNNELI

SEQ ID NO: 96315 - protein, 32 aa, Artificial Sequence
  Description of Artificial Sequence: Synthetic polypeptide
DEEEIRTTNPVATEQYGCYSTVDERAGQEESF

SEQ ID NO: 96316 - protein, 32 aa, Artificial Sequence
  Description of Artificial Sequence: Synthetic polypeptide
DEEEIRTTNPVATEQYGCYNSTLDERGGEEHL

SEQ ID NO: 96317 - protein, 32 aa, Artificial Sequence
  Description of Artificial Sequence: Synthetic polypeptide
SEEEIRTTNPVATEQYGCVGTGALQENFGSDQ

SEQ ID NO: 96318 - protein, 35 aa, Artificial Sequence
  Description of Artificial Sequence: Synthetic polypeptide
AEEEIRTTNPVATEQYGSVSTTNLLNGTELGNNLE

SEQ ID NO: 96319 - protein, 33 aa, Artificial Sequence
  Description of Artificial Sequence: Synthetic polypeptide
DEEEIRTTNPVATEQYGCYCSWPNDLQYDSNQS

SEQ ID NO: 96320 - protein, 36 aa, Artificial Sequence
  Description of Artificial Sequence: Synthetic polypeptide
AEEEIRTTNPVATEQYGSVSTTNLLQQGNNGETNTE

SEQ ID NO: 96321 - protein, 28 aa, Artificial Sequence
  Description of Artificial Sequence: Synthetic peptide
SEGEIAPTNPCYSEQYGIVSCNLQSGTR

SEQ ID NO: 96322 - protein, 34 aa, Artificial Sequence
  Description of Artificial Sequence: Synthetic polypeptide
DEEEIRTTNPCATEQYGSCAATNLQDAHGDNEAM

SEQ ID NO: 96323 - protein, 34 aa, Artificial Sequence
  Description of Artificial Sequence: Synthetic polypeptide
DEEEIRTTNPVATEQYGDVSINIGDLGEGGGNGT

SEQ ID NO: 96324 - protein, 33 aa, Artificial Sequence
  Description of Artificial Sequence: Synthetic polypeptide
DEEEIRTTNPVATEQYGDVSVGNMDTGEGGNEG

SEQ ID NO: 96325 - protein, 33 aa, Artificial Sequence
  Description of Artificial Sequence: Synthetic polypeptide
DEEEIRTTNPVATEQYGDVSVGNIMTGDGGNGG

SEQ ID NO: 96326 - protein, 33 aa, Artificial Sequence
  Description of Artificial Sequence: Synthetic polypeptide
DEEEIRTTNPVATEQYGDVSVGNIMTDGGGNQG

SEQ ID NO: 96327 - protein, 35 aa, Artificial Sequence
  Description of Artificial Sequence: Synthetic polypeptide
DEEEIRTTNPVATEQYGDVSTVNGQQGEFTGNANE

SEQ ID NO: 96328 - protein, 34 aa, Artificial Sequence
  Description of Artificial Sequence: Synthetic polypeptide
DEEEIRTTNPVATEQYGDVSTTPAGPNMRNGMNV

SEQ ID NO: 96329 - protein, 35 aa, Artificial Sequence
  Description of Artificial Sequence: Synthetic polypeptide
DEEEIRTTNPVATEQYGDVSTTMNNQNGFEGGNEG

SEQ ID NO: 96330 - protein, 34 aa, Artificial Sequence
  Description of Artificial Sequence: Synthetic polypeptide
DEEEIRTTNPVATEQYGDVSTTGMGQGGGNTLNT

SEQ ID NO: 96331 - protein, 33 aa, Artificial Sequence
  Description of Artificial Sequence: Synthetic polypeptide
SEEEIRTTNPTATEQFGSVSTANLQLIEGETDI

SEQ ID NO: 96332 - protein, 32 aa, Artificial Sequence
  Description of Artificial Sequence: Synthetic polypeptide
DEEEIRTTNPCATEQYGCVCGTELQNGSDTAS

SEQ ID NO: 96333 - protein, 32 aa, Artificial Sequence
  Description of Artificial Sequence: Synthetic polypeptide
SEEEIRTTNPVATEAYGCVSNTNLANFGSDTQ

SEQ ID NO: 96334 - protein, 31 aa, Artificial Sequence
  Description of Artificial Sequence: Synthetic polypeptide
DEEEIRTTNPCATEQYGCVCPTELANGSDQS

SEQ ID NO: 96335 - protein, 36 aa, Artificial Sequence
  Description of Artificial Sequence: Synthetic polypeptide
AEEEIRTTNPVATEQYGSVSTTNLQQQQQIGTNTTD

SEQ ID NO: 96336 - protein, 33 aa, Artificial Sequence
  Description of Artificial Sequence: Synthetic polypeptide
DEEEIRTTNPCATEQYGCVCQTNLQNFNSNTAS

SEQ ID NO: 96337 - protein, 31 aa, Artificial Sequence
  Description of Artificial Sequence: Synthetic polypeptide
SEEEIRTTNPVATECWGKHSTNEGQDRNDFR

SEQ ID NO: 96338 - protein, 32 aa, Artificial Sequence
  Description of Artificial Sequence: Synthetic polypeptide
SEEEIRTTNPVATECWGSVSCINEPMDRGENG

SEQ ID NO: 96339 - protein, 33 aa, Artificial Sequence
  Description of Artificial Sequence: Synthetic polypeptide
DEEEIRTTNPVATEQYGDVSTPIGPNMANENPA

SEQ ID NO: 96340 - protein, 36 aa, Artificial Sequence
  Description of Artificial Sequence: Synthetic polypeptide
AEEEIRTTNPVATEQYGSVSTTNLQQQQGNGNNQDE

SEQ ID NO: 96341 - protein, 33 aa, Artificial Sequence
  Description of Artificial Sequence: Synthetic polypeptide
DEEEIRTTNPVATEQYGDVSTPIEPNMANENPA

SEQ ID NO: 96342 - protein, 32 aa, Artificial Sequence
  Description of Artificial Sequence: Synthetic polypeptide
DEEEIRTTNPVATEQYGDVSTPIEMMANENPA

SEQ ID NO: 96343 - protein, 33 aa, Artificial Sequence
  Description of Artificial Sequence: Synthetic polypeptide
SEEEIRTTNPVATEEWGSVLNRNNGDQTRGNVR

SEQ ID NO: 96344 - protein, 35 aa, Artificial Sequence
  Description of Artificial Sequence: Synthetic polypeptide
AEEEIRTTNPVATEQYGSVSTTNLQQQNNDENQDT

SEQ ID NO: 96345 - protein, 36 aa, Artificial Sequence
  Description of Artificial Sequence: Synthetic polypeptide
DEEEIRTTNPVATEQYGDVSVSTQNLPDNEVGGNQT

SEQ ID NO: 96346 - protein, 36 aa, Artificial Sequence
  Description of Artificial Sequence: Synthetic polypeptide
DEEEIRTTNPVATEQYGDVSVSTQNLPDNEVGVNGD

SEQ ID NO: 96347 - protein, 35 aa, Artificial Sequence
  Description of Artificial Sequence: Synthetic polypeptide
DEEEIRTTNPVATEQYGDVSVTGIQNDGQGGNQET

SEQ ID NO: 96348 - protein, 34 aa, Artificial Sequence
  Description of Artificial Sequence: Synthetic polypeptide
AEEEIRTTNPVATEQYGSVSTTNNDNGTVGNNAT

SEQ ID NO: 96349 - protein, 36 aa, Artificial Sequence
  Description of Artificial Sequence: Synthetic polypeptide
AEEEIRTTNPVATEQYGSVSTTNNLLGNQIGTEDNV

SEQ ID NO: 96350 - protein, 36 aa, Artificial Sequence
  Description of Artificial Sequence: Synthetic polypeptide
AEEEIRTTNPVATEQYGSVSTTNNLGNQEQGTNDTE

SEQ ID NO: 96351 - protein, 35 aa, Artificial Sequence
  Description of Artificial Sequence: Synthetic polypeptide
AEEEIRTTNPVATEQYGSVSTTNNLEQGTTEAGEE

SEQ ID NO: 96352 - protein, 34 aa, Artificial Sequence
  Description of Artificial Sequence: Synthetic polypeptide
AEEEIRTTNPVATEQYGSVSTTNNINDEQGTNTD

SEQ ID NO: 96353 - protein, 34 aa, Artificial Sequence
  Description of Artificial Sequence: Synthetic polypeptide
AEEEIRTTNPVATEQYGSVSTTNNINDEQGNNDE

SEQ ID NO: 96354 - protein, 34 aa, Artificial Sequence
  Description of Artificial Sequence: Synthetic polypeptide
AEEEIRTTNPVATEQYGSVSTTNNINDEEIGNTD

SEQ ID NO: 96355 - protein, 35 aa, Artificial Sequence
  Description of Artificial Sequence: Synthetic polypeptide
AEEEIRTTNPVATEQYGSVSTTNNGQNGDEAGNED

SEQ ID NO: 96356 - protein, 35 aa, Artificial Sequence
  Description of Artificial Sequence: Synthetic polypeptide
AEEEIRTTNPVATEQYGSVSTTNNGEQGNQGGNVT

SEQ ID NO: 96357 - protein, 34 aa, Artificial Sequence
  Description of Artificial Sequence: Synthetic polypeptide
SEEEIRTTNPIATEQYGSVSSEPNLPMMRGMNPV

SEQ ID NO: 96358 - protein, 35 aa, Artificial Sequence
  Description of Artificial Sequence: Synthetic polypeptide
SEEEIRTTNPIATEQYGSVSSTTNLPNMRNGMNPV

SEQ ID NO: 96359 - protein, 35 aa, Artificial Sequence
  Description of Artificial Sequence: Synthetic polypeptide
AEEEIRTTNPVATEQYGSVSTTNLQQNTNEQGTDE

SEQ ID NO: 96360 - protein, 32 aa, Artificial Sequence
  Description of Artificial Sequence: Synthetic polypeptide
DEEEIRTTNPVATEQYGDVTSVDNDTTGGQGN

SEQ ID NO: 96361 - protein, 34 aa, Artificial Sequence
  Description of Artificial Sequence: Synthetic polypeptide
DEEEIRTTNPVATEQYGDVTSTGNLNNMNNEEGM

SEQ ID NO: 96362 - protein, 33 aa, Artificial Sequence
  Description of Artificial Sequence: Synthetic polypeptide
DEEEIRTTNPVATEQYGDVTSTDNLNNMEMEGM

SEQ ID NO: 96363 - protein, 33 aa, Artificial Sequence
  Description of Artificial Sequence: Synthetic polypeptide
DEEEIRTTNPVATEQYGDVTSTDLNNMNNEDGM

SEQ ID NO: 96364 - protein, 33 aa, Artificial Sequence
  Description of Artificial Sequence: Synthetic polypeptide
DEEEIRTTNPVATEQYGDVTSTDLDNNMDGEGM

SEQ ID NO: 96365 - protein, 33 aa, Artificial Sequence
  Description of Artificial Sequence: Synthetic polypeptide
DEEEIRTTNPVATEQYGDVTDTGNLNNMNEIGM

SEQ ID NO: 96366 - protein, 35 aa, Artificial Sequence
  Description of Artificial Sequence: Synthetic polypeptide
AEEEIRTTNPVATEQYGSVSTTNNDQAGNQTNGNV

SEQ ID NO: 96367 - protein, 33 aa, Artificial Sequence
  Description of Artificial Sequence: Synthetic polypeptide
DEEEIRTTNPVATEQYGDVSYNQIHASVGGNNT

SEQ ID NO: 96368 - protein, 31 aa, Artificial Sequence
  Description of Artificial Sequence: Synthetic polypeptide
DEEEIRTTNPCATEQYGCVATWLTADPGDHQ

SEQ ID NO: 96369 - protein, 33 aa, Artificial Sequence
  Description of Artificial Sequence: Synthetic polypeptide
DEEEIRTTNPCATEQYGCVCGNTNLQNFGSDTA

SEQ ID NO: 96370 - protein, 35 aa, Artificial Sequence
  Description of Artificial Sequence: Synthetic polypeptide
AEEEIRTTNPVATEQYGSVSTTNNDNLQGTEEGTD

SEQ ID NO: 96371 - protein, 31 aa, Artificial Sequence
  Description of Artificial Sequence: Synthetic polypeptide
DEEEIRTTNPCATEQYGCVATWLTADGDTEQ

SEQ ID NO: 96372 - protein, 33 aa, Artificial Sequence
  Description of Artificial Sequence: Synthetic polypeptide
DEEEIRTTNPVATEQYGDVSGVGNMTDGGGNDG

SEQ ID NO: 96373 - protein, 33 aa, Artificial Sequence
  Description of Artificial Sequence: Synthetic polypeptide
DEEEIRTTNPCATEQYGCVCSWNIAERFGSNDS

SEQ ID NO: 96374 - protein, 32 aa, Artificial Sequence
  Description of Artificial Sequence: Synthetic polypeptide
DEEEIRTTNPCATEQYGCVCSYNHAHFGSNQS

SEQ ID NO: 96375 - protein, 34 aa, Artificial Sequence
  Description of Artificial Sequence: Synthetic polypeptide
DEEEIRTTNPVATEQYGDVSSTMDLNEGGEDNEG

SEQ ID NO: 96376 - protein, 35 aa, Artificial Sequence
  Description of Artificial Sequence: Synthetic polypeptide
DEEEIRTTNPVATEQYGDVSSTFNLINEGGQGNEI

SEQ ID NO: 96377 - protein, 36 aa, Artificial Sequence
  Description of Artificial Sequence: Synthetic polypeptide
AEEEIRTTNPVATEQYGSVSTTNLQQGNQQGTNQED

SEQ ID NO: 96378 - protein, 34 aa, Artificial Sequence
  Description of Artificial Sequence: Synthetic polypeptide
DEEEIRTTNPVATEQYGDVSSTAGPNMRNGMNPV

SEQ ID NO: 96379 - protein, 33 aa, Artificial Sequence
  Description of Artificial Sequence: Synthetic polypeptide
DEEEIRTTNPVATEQYGDVSSGNGGGDGEGNEG

SEQ ID NO: 96380 - protein, 36 aa, Artificial Sequence
  Description of Artificial Sequence: Synthetic polypeptide
AEEEIRTTNPVATEQYGSVSTTNLQQGNQQGNNQQG

SEQ ID NO: 96381 - protein, 36 aa, Artificial Sequence
  Description of Artificial Sequence: Synthetic polypeptide
AEEEIRTTNPVATEQYGSVSTTNLQQGNPNNNNQNQ

SEQ ID NO: 96382 - protein, 33 aa, Artificial Sequence
  Description of Artificial Sequence: Synthetic polypeptide
DEEEIRTTNPVATEQYGDVSSEPCLNMRNGEPL

SEQ ID NO: 96383 - protein, 32 aa, Artificial Sequence
  Description of Artificial Sequence: Synthetic polypeptide
DEEEIRTTNPVATEQYGDVSSEIGNMRAEMNV

SEQ ID NO: 96384 - protein, 35 aa, Artificial Sequence
  Description of Artificial Sequence: Synthetic polypeptide
AEEEIRTTNPVATEQYGSVSTTNLQNQQLANNEED

SEQ ID NO: 96385 - protein, 31 aa, Artificial Sequence
  Description of Artificial Sequence: Synthetic polypeptide
DEEEIRTTNPVATEQYGDVSSEIGNMRAEDV

SEQ ID NO: 96386 - protein, 31 aa, Artificial Sequence
  Description of Artificial Sequence: Synthetic polypeptide
DEEEIRTTNPVATEQYGDVSSEIENMRAEDA

SEQ ID NO: 96387 - protein, 32 aa, Artificial Sequence
  Description of Artificial Sequence: Synthetic polypeptide
DEEEIRTTNPVATEQYGDVSSECLNMRNEEPL

SEQ ID NO: 96388 - protein, 34 aa, Artificial Sequence
  Description of Artificial Sequence: Synthetic polypeptide
DEEEIRTTNPVATEQYGDVSSDTMDLNEIGEGNE

SEQ ID NO: 96389 - protein, 35 aa, Artificial Sequence
  Description of Artificial Sequence: Synthetic polypeptide
DEEEIRTTNPVATEQYGDVSNTFNLIGEGGQGNED

SEQ ID NO: 96390 - protein, 33 aa, Artificial Sequence
  Description of Artificial Sequence: Synthetic polypeptide
DEEEIRTTNPVATEQYGDVSNTDTNQEIINEGQ

SEQ ID NO: 96391 - protein, 35 aa, Artificial Sequence
  Description of Artificial Sequence: Synthetic polypeptide
DEEEIRTTNPVATEQYGDVSNNDLEMGQGGETNAG

SEQ ID NO: 96392 - protein, 35 aa, Artificial Sequence
  Description of Artificial Sequence: Synthetic polypeptide
DEEEIRTTNPVATEQYGDVSNMTNIGQSEGGNDGD

SEQ ID NO: 96393 - protein, 36 aa, Artificial Sequence
  Description of Artificial Sequence: Synthetic polypeptide
AEEEIRTTNPVATEQYGSVSTTNLQNGSEQGTNEEF

SEQ ID NO: 96394 - protein, 34 aa, Artificial Sequence
  Description of Artificial Sequence: Synthetic polypeptide
AEEEIRTTNPVATEQYGSVSTTNLQLQQEATETG

SEQ ID NO: 96395 - protein, 34 aa, Artificial Sequence
  Description of Artificial Sequence: Synthetic polypeptide
DEEEIRTTNPVATEQYGDVSITVDGQGTGGGNET

SEQ ID NO: 96396 - protein, 34 aa, Artificial Sequence
  Description of Artificial Sequence: Synthetic polypeptide
DEEEIRTTNPVATEQYGDVSSTMDLNEIGENTEE

SEQ ID NO: 96397 - protein, 33 aa, Artificial Sequence
  Description of Artificial Sequence: Synthetic polypeptide
DEEEIRTTNPVATEQYGDVSSTPAENMANENPV

SEQ ID NO: 96398 - protein, 33 aa, Artificial Sequence
  Description of Artificial Sequence: Synthetic polypeptide
SEEEIRTTNPVATEGYGSCSNTNLHRTISDQRD

SEQ ID NO: 96399 - protein, 35 aa, Artificial Sequence
  Description of Artificial Sequence: Synthetic polypeptide
AEEEIRTTNPVATEQYGSVSTTNLQQILENEEEET

SEQ ID NO: 96400 - protein, 32 aa, Artificial Sequence
  Description of Artificial Sequence: Synthetic polypeptide
DEEEIRTTNPCATEQYGCVCSYNHARFGSDDA

SEQ ID NO: 96401 - protein, 32 aa, Artificial Sequence
  Description of Artificial Sequence: Synthetic polypeptide
DEEEIRTTNPCATEQYGCVCSYNHFHFGSNDA

SEQ ID NO: 96402 - protein, 33 aa, Artificial Sequence
  Description of Artificial Sequence: Synthetic polypeptide
DEEEIRTTNPVATEQYGDVSTNGFGNDDQTEQD

SEQ ID NO: 96403 - protein, 35 aa, Artificial Sequence
  Description of Artificial Sequence: Synthetic polypeptide
AEEEIRTTNPVATEQYGSVSTTNLQQNNNQQNETE

SEQ ID NO: 96404 - protein, 34 aa, Artificial Sequence
  Description of Artificial Sequence: Synthetic polypeptide
DEEEIRTTNPVATEQYGDVSTGNGGGDGEGNELS

SEQ ID NO: 96405 - protein, 34 aa, Artificial Sequence
  Description of Artificial Sequence: Synthetic polypeptide
DEEEIRTTNPVATEQYGDVSTGNGGGDGEGNEFN

SEQ ID NO: 96406 - protein, 35 aa, Artificial Sequence
  Description of Artificial Sequence: Synthetic polypeptide
DEEEIRTTNPVATEQYGDVSTGNGDQDEGGGNGTG

SEQ ID NO: 96407 - protein, 31 aa, Artificial Sequence
  Description of Artificial Sequence: Synthetic polypeptide
SEEEIRTTNPVATEGYGCTSIMNGGQGGGNI

SEQ ID NO: 96408 - protein, 31 aa, Artificial Sequence
  Description of Artificial Sequence: Synthetic polypeptide
SEEEIRTTNPVATEGYGCTSIMNLGQGGGDT

SEQ ID NO: 96409 - protein, 31 aa, Artificial Sequence
  Description of Artificial Sequence: Synthetic polypeptide
SEEEIRTTNPVATEGYGCTSIMNLGQGGGET

SEQ ID NO: 96410 - protein, 32 aa, Artificial Sequence
  Description of Artificial Sequence: Synthetic polypeptide
DEEEIRTTNPCATEQYGCVCSWNITYFGSNDA

SEQ ID NO: 96411 - protein, 34 aa, Artificial Sequence
  Description of Artificial Sequence: Synthetic polypeptide
DEEEIRTTNPVATEQYGDVSTGGLGFNEGGGNGD

SEQ ID NO: 96412 - protein, 33 aa, Artificial Sequence
  Description of Artificial Sequence: Synthetic polypeptide
DEEEIRTTNPVATEQYGDVSTGDGEGQGEENAE

SEQ ID NO: 96413 - protein, 35 aa, Artificial Sequence
  Description of Artificial Sequence: Synthetic polypeptide
DEEEIRTTNPVATEQYGDVSTFGDLGQQEGGQGNE

SEQ ID NO: 96414 - protein, 36 aa, Artificial Sequence
  Description of Artificial Sequence: Synthetic polypeptide
AEEEIRTTNPVATEQYGSVSTTNLQQNNLGGNNEEV

SEQ ID NO: 96415 - protein, 32 aa, Artificial Sequence
  Description of Artificial Sequence: Synthetic polypeptide
DEEEIRTTNPVATEQYGDVSTDTMTEPINEGQ

SEQ ID NO: 96416 - protein, 33 aa, Artificial Sequence
  Description of Artificial Sequence: Synthetic polypeptide
DEEEIRTTNPVATEQYGDVSTDTLGEEFINEGQ

SEQ ID NO: 96417 - protein, 34 aa, Artificial Sequence
  Description of Artificial Sequence: Synthetic polypeptide
DEEEIRTTNPVATEQYGDVSTDTGLSDNGGGNQG

SEQ ID NO: 96418 - protein, 33 aa, Artificial Sequence
  Description of Artificial Sequence: Synthetic polypeptide
DEEEIRTTNPVATEQYGDVSTDTGLGELINEGQ

SEQ ID NO: 96419 - protein, 35 aa, Artificial Sequence
  Description of Artificial Sequence: Synthetic polypeptide
AEEEIRTTNPVATEQYGSVSTTNLQQLNQNTNNQN

SEQ ID NO: 96420 - protein, 32 aa, Artificial Sequence
  Description of Artificial Sequence: Synthetic polypeptide
SEEEIRTTNPVATEGYGCVSNTNLANFGDTQG

SEQ ID NO: 96421 - protein, 33 aa, Artificial Sequence
  Description of Artificial Sequence: Synthetic polypeptide
SEEEIRTTNPVATEGYGCVSNTNLNIRFGSDTQ

SEQ ID NO: 96422 - protein, 33 aa, Artificial Sequence
  Description of Artificial Sequence: Synthetic polypeptide
DEEEIRTTNPVATEQYGDVSTGDTGEGGGNEET

SEQ ID NO: 96423 - protein, 36 aa, Artificial Sequence
  Description of Artificial Sequence: Synthetic polypeptide
AEEEIRTTNPVATEQYGSVSTNLNNGNQEQGTNNTQ

SEQ ID NO: 96424 - protein, 33 aa, Artificial Sequence
  Description of Artificial Sequence: Synthetic polypeptide
DEEEIRTTNPVATEQYGCVCSWEEHQYFGSNQG

SEQ ID NO: 96425 - protein, 36 aa, Artificial Sequence
  Description of Artificial Sequence: Synthetic polypeptide
AEEEIRTTNPVATEQYGSVSTNLNNENQETGTNVAG

SEQ ID NO: 96426 - protein, 30 aa, Artificial Sequence
  Description of Artificial Sequence: Synthetic polypeptide
TEECIATTNPVAYEQYGTVSKNLEMTGNDA

SEQ ID NO: 96427 - protein, 33 aa, Artificial Sequence
  Description of Artificial Sequence: Synthetic polypeptide
DEEEIRTTNPVATEQYGCVCSTEHQANFGSDQN

SEQ ID NO: 96428 - protein, 33 aa, Artificial Sequence
  Description of Artificial Sequence: Synthetic polypeptide
DEEEIRTTNPVATEQYGCVCSTEHNQYFNSDQS

SEQ ID NO: 96429 - protein, 33 aa, Artificial Sequence
  Description of Artificial Sequence: Synthetic polypeptide
DEEEIRTTNPVATEQYGCVCSTEHNQYFGSDQS

SEQ ID NO: 96430 - protein, 33 aa, Artificial Sequence
  Description of Artificial Sequence: Synthetic polypeptide
DEEEIRTTNPVATEQYGCVCSTEHNQSFGSDQN

SEQ ID NO: 96431 - protein, 31 aa, Artificial Sequence
  Description of Artificial Sequence: Synthetic polypeptide
TEECIATVNPVAYEAYGSVSCDNLERGGNNR

SEQ ID NO: 96432 - protein, 34 aa, Artificial Sequence
  Description of Artificial Sequence: Synthetic polypeptide
AEEEIRTTNPVATEMWGHSNFSTGELQIRGDNNR

SEQ ID NO: 96433 - protein, 34 aa, Artificial Sequence
  Description of Artificial Sequence: Synthetic polypeptide
DEEEIRTTNPVATEQYGCVCSTEHNQNFGSNNIA

SEQ ID NO: 96434 - protein, 34 aa, Artificial Sequence
  Description of Artificial Sequence: Synthetic polypeptide
DEEEIRTTNPVATEQYGCVCSTEHNQNFGSENQE

SEQ ID NO: 96435 - protein, 32 aa, Artificial Sequence
  Description of Artificial Sequence: Synthetic polypeptide
DEEEIRTTNPVATEQYGCVCSTEHNQHNSEQL

SEQ ID NO: 96436 - protein, 33 aa, Artificial Sequence
  Description of Artificial Sequence: Synthetic polypeptide
DEEEIRTTNPVATEQYGCVCSTEHNQHFISNQE

SEQ ID NO: 96437 - protein, 34 aa, Artificial Sequence
  Description of Artificial Sequence: Synthetic polypeptide
DEEEIRTTNPVATEQYGCVCSTEHNQHFGSNTQA

SEQ ID NO: 96438 - protein, 34 aa, Artificial Sequence
  Description of Artificial Sequence: Synthetic polypeptide
AEEEIRTTNPVATEIYGSVSTTNNNQEAGTNATE

SEQ ID NO: 96439 - protein, 32 aa, Artificial Sequence
  Description of Artificial Sequence: Synthetic polypeptide
TEECIRCTNPVATEAYGSVSWGNEFSQRGGNL

SEQ ID NO: 96440 - protein, 30 aa, Artificial Sequence
  Description of Artificial Sequence: Synthetic polypeptide
TEECIRCTNPVATEQYGAVSWNNFETGNNQ

SEQ ID NO: 96441 - protein, 33 aa, Artificial Sequence
  Description of Artificial Sequence: Synthetic polypeptide
DEEEIRTTNPVATEQYGCVCSTEHNQENFGSDQ

SEQ ID NO: 96442 - protein, 33 aa, Artificial Sequence
  Description of Artificial Sequence: Synthetic polypeptide
TEECIRCTNPVATEQYGSTVPSWNFSQRGGNYL

SEQ ID NO: 96443 - protein, 34 aa, Artificial Sequence
  Description of Artificial Sequence: Synthetic polypeptide
AEEEIRTTNPVATEIYGSVSTTNNNQEAGNNATE

SEQ ID NO: 96444 - protein, 33 aa, Artificial Sequence
  Description of Artificial Sequence: Synthetic polypeptide
DEEEIRTTNPVATEQYGCVCSTEHNINFGSDQP

SEQ ID NO: 96445 - protein, 31 aa, Artificial Sequence
  Description of Artificial Sequence: Synthetic polypeptide
TEECIRCTNPVATEQYGSVSWNLFEEESNQY

SEQ ID NO: 96446 - protein, 34 aa, Artificial Sequence
  Description of Artificial Sequence: Synthetic polypeptide
DEEEIRTTNPVATEQYGCVCSTEHNIENFGSNQE

SEQ ID NO: 96447 - protein, 35 aa, Artificial Sequence
  Description of Artificial Sequence: Synthetic polypeptide
AEEEIRTTNPVATEPYGSVSTTNNQLNGNQIGNEG

SEQ ID NO: 96448 - protein, 33 aa, Artificial Sequence
  Description of Artificial Sequence: Synthetic polypeptide
DEEEIRTTNPVATEQYGCVCSTEHNENFGSDQA

SEQ ID NO: 96449 - protein, 30 aa, Artificial Sequence
  Description of Artificial Sequence: Synthetic polypeptide
TEECIATTNPVAYEQYGTVSKNLEDLGNDS

SEQ ID NO: 96450 - protein, 33 aa, Artificial Sequence
  Description of Artificial Sequence: Synthetic polypeptide
DEEEIRTTNPVATEQYGCVCSTEHQEHFGSEQE

SEQ ID NO: 96451 - protein, 32 aa, Artificial Sequence
  Description of Artificial Sequence: Synthetic polypeptide
DEEEIRTTNPVATEQYGCVCSTEHQNFTSDAA

SEQ ID NO: 96452 - protein, 32 aa, Artificial Sequence
  Description of Artificial Sequence: Synthetic polypeptide
DEEEIRTTNPVATEQYGCVCSTEHQNFPSDQG

SEQ ID NO: 96453 - protein, 33 aa, Artificial Sequence
  Description of Artificial Sequence: Synthetic polypeptide
DEEEIRTTNPVATEQYGCVCSTEHQNFNSNTQS

SEQ ID NO: 96454 - protein, 32 aa, Artificial Sequence
  Description of Artificial Sequence: Synthetic polypeptide
DEEEIRTTNPVATEQYGCVCSTEHQNFLSQQA

SEQ ID NO: 96455 - protein, 33 aa, Artificial Sequence
  Description of Artificial Sequence: Synthetic polypeptide
DEEEIRTTNPVATEQYGCVCSTEHQNFGSQFIA

SEQ ID NO: 96456 - protein, 33 aa, Artificial Sequence
  Description of Artificial Sequence: Synthetic polypeptide
DEEEIRTTNPVATEQYGCVCSTEHQNFGSETQI

SEQ ID NO: 96457 - protein, 31 aa, Artificial Sequence
  Description of Artificial Sequence: Synthetic polypeptide
TEDEIRTTNPVAYECWGEVSTNLQGNEGNEP

SEQ ID NO: 96458 - protein, 33 aa, Artificial Sequence
  Description of Artificial Sequence: Synthetic polypeptide
DEEEIRTTNPVATEQYGCVCSTEHQHSGSEDQS

SEQ ID NO: 96459 - protein, 33 aa, Artificial Sequence
  Description of Artificial Sequence: Synthetic polypeptide
DEEEIRTTNPVATEQYGCVCSTEHQHSGSDTQS

SEQ ID NO: 96460 - protein, 32 aa, Artificial Sequence
  Description of Artificial Sequence: Synthetic polypeptide
TEEAEIRTTNPVAYEAWGEVSTNLQGMGPNDA

SEQ ID NO: 96461 - protein, 33 aa, Artificial Sequence
  Description of Artificial Sequence: Synthetic polypeptide
DEEEIRTTNPVATEQYGCVCSTEHQGSGSDTQV

SEQ ID NO: 96462 - protein, 33 aa, Artificial Sequence
  Description of Artificial Sequence: Synthetic polypeptide
DEEEIRTTNPVATEQYGCVCSTEHQGFTSNTQS

SEQ ID NO: 96463 - protein, 33 aa, Artificial Sequence
  Description of Artificial Sequence: Synthetic polypeptide
DEEEIRTTNPVATEQYGCVCSTEHQGFNSDNQS

SEQ ID NO: 96464 - protein, 33 aa, Artificial Sequence
  Description of Artificial Sequence: Synthetic polypeptide
DEEEIRTTNPVATEQYGCVCSTEHQGFGSDTQS

SEQ ID NO: 96465 - protein, 33 aa, Artificial Sequence
  Description of Artificial Sequence: Synthetic polypeptide
DEEEIRTTNPVATEQYGCVCSTEHQFFISNTQA

SEQ ID NO: 96466 - protein, 32 aa, Artificial Sequence
  Description of Artificial Sequence: Synthetic polypeptide
TEEAICTTNPVAYEQYGSVSCMNMSQRGGLNQ

SEQ ID NO: 96467 - protein, 34 aa, Artificial Sequence
  Description of Artificial Sequence: Synthetic polypeptide
DEEEIRTTNPVATEQYGCVCSTEHQESFGSQNQD

SEQ ID NO: 96468 - protein, 33 aa, Artificial Sequence
  Description of Artificial Sequence: Synthetic polypeptide
DEEEIRTTNPVATEQYGCVCSTEHQENSGSDAP

SEQ ID NO: 96469 - protein, 29 aa, Artificial Sequence
  Description of Artificial Sequence: Synthetic peptide
TEECIASVNPVCTEQYGVVSDNALQSGNQ

SEQ ID NO: 96470 - protein, 33 aa, Artificial Sequence
  Description of Artificial Sequence: Synthetic polypeptide
DEEEIRTTNPVATEQYGCVCSTEHQENFGSQQE

SEQ ID NO: 96471 - protein, 34 aa, Artificial Sequence
  Description of Artificial Sequence: Synthetic polypeptide
DEEEIRTTNPVATEQYGCVCSTEHQENFGSNPQL

SEQ ID NO: 96472 - protein, 34 aa, Artificial Sequence
  Description of Artificial Sequence: Synthetic polypeptide
DEEEIRTTNPVATEQYGCVCSTEHQEGFISNNQD

SEQ ID NO: 96473 - protein, 32 aa, Artificial Sequence
  Description of Artificial Sequence: Synthetic polypeptide
TEECIRCTNPVATEQYGSVSWNLFEEGSNGQV

SEQ ID NO: 96474 - protein, 32 aa, Artificial Sequence
  Description of Artificial Sequence: Synthetic polypeptide
DEEEIRTTNPVATEQYGCVCSTEHINSGSDQP

SEQ ID NO: 96475 - protein, 33 aa, Artificial Sequence
  Description of Artificial Sequence: Synthetic polypeptide
TEECIRCTNPVATERYGQSVPSLNALSQQGGNR

SEQ ID NO: 96476 - protein, 34 aa, Artificial Sequence
  Description of Artificial Sequence: Synthetic polypeptide
TEECIRTTNPVATEQYGKVSTTNEHFQRTGGSRE

SEQ ID NO: 96477 - protein, 34 aa, Artificial Sequence
  Description of Artificial Sequence: Synthetic polypeptide
DEEEIRTTNPVATEQYGCVCSTEENQFFGSDNQA

SEQ ID NO: 96478 - protein, 34 aa, Artificial Sequence
  Description of Artificial Sequence: Synthetic polypeptide
DEEEIRTTNPVATEQYGCVCSTEEMLQNGGSEQS

SEQ ID NO: 96479 - protein, 35 aa, Artificial Sequence
  Description of Artificial Sequence: Synthetic polypeptide
TEECIRTTNPVATEQYGQSVPSLLNALSQQPGGNR

SEQ ID NO: 96480 - protein, 34 aa, Artificial Sequence
  Description of Artificial Sequence: Synthetic polypeptide
TEECIRTTNPVATEQYGQSVPSLNALSQQGGNFG

SEQ ID NO: 96481 - protein, 34 aa, Artificial Sequence
  Description of Artificial Sequence: Synthetic polypeptide
TEECIRTTNPVATEQYGQSVPSLNALSQQGGNVS

SEQ ID NO: 96482 - protein, 35 aa, Artificial Sequence
  Description of Artificial Sequence: Synthetic polypeptide
DEEEIRTTNPVATEQYGCVCSTEELNQFFGSNTQS

SEQ ID NO: 96483 - protein, 34 aa, Artificial Sequence
  Description of Artificial Sequence: Synthetic polypeptide
TEECIRTTNPVATEQYGQSVPSLNAVSQNQGGNR

SEQ ID NO: 96484 - protein, 33 aa, Artificial Sequence
  Description of Artificial Sequence: Synthetic polypeptide
DEEEIRTTNPVATEQYGCVCSTEEHQYSGSQQS

SEQ ID NO: 96485 - protein, 33 aa, Artificial Sequence
  Description of Artificial Sequence: Synthetic polypeptide
TEECIRTTNPVATEQYGSVPSLNALSQQVPNNT

SEQ ID NO: 96486 - protein, 33 aa, Artificial Sequence
  Description of Artificial Sequence: Synthetic polypeptide
DEEEIRTTNPVATEQYGCVCSTEEHQYSGSEQD

SEQ ID NO: 96487 - protein, 34 aa, Artificial Sequence
  Description of Artificial Sequence: Synthetic polypeptide
DEEEIRTTNPVATEQYGCVCSTEEHQYFGSDNQN

SEQ ID NO: 96488 - protein, 34 aa, Artificial Sequence
  Description of Artificial Sequence: Synthetic polypeptide
DEEEIRTTNPVATEQYGCVCSTEEHQYFGSDNAS

SEQ ID NO: 96489 - protein, 33 aa, Artificial Sequence
  Description of Artificial Sequence: Synthetic polypeptide
DEEEIRTTNPVATEQYGCVCSTEEHQSFGSEDI

SEQ ID NO: 96490 - protein, 33 aa, Artificial Sequence
  Description of Artificial Sequence: Synthetic polypeptide
DEEEIRTTNPVATEQYGCVCSTEEHQSFGSDQA

SEQ ID NO: 96491 - protein, 33 aa, Artificial Sequence
  Description of Artificial Sequence: Synthetic polypeptide
DEEEIRTTNPVATEQYGCVCSTEEHQNFTSNQN

SEQ ID NO: 96492 - protein, 33 aa, Artificial Sequence
  Description of Artificial Sequence: Synthetic polypeptide
DEEEIRTTNPVATEQYGCVCSTEEHQNFNSEQI

SEQ ID NO: 96493 - protein, 33 aa, Artificial Sequence
  Description of Artificial Sequence: Synthetic polypeptide
DEEEIRTTNPVATEQYGCVCSTEEHQNFNSDQA

SEQ ID NO: 96494 - protein, 33 aa, Artificial Sequence
  Description of Artificial Sequence: Synthetic polypeptide
AEEEIRTTNPVATEEYGQISCINLSTQRGGNNY

SEQ ID NO: 96495 - protein, 33 aa, Artificial Sequence
  Description of Artificial Sequence: Synthetic polypeptide
AEEEIRTTNPVATEEYGQCSCSSGNLQNFGSNQ

SEQ ID NO: 96496 - protein, 32 aa, Artificial Sequence
  Description of Artificial Sequence: Synthetic polypeptide
AEEEIRTTNPVATEEYGKISCINLSTRPGNNY

SEQ ID NO: 96497 - protein, 34 aa, Artificial Sequence
  Description of Artificial Sequence: Synthetic polypeptide
DEEEIRTTNPVATEQYGCVCSTEEPHQNFGSDNQ

SEQ ID NO: 96498 - protein, 34 aa, Artificial Sequence
  Description of Artificial Sequence: Synthetic polypeptide
DEEEIRTTNPVATEQYGCVCSTEEPQEHFGSNQA

SEQ ID NO: 96499 - protein, 33 aa, Artificial Sequence
  Description of Artificial Sequence: Synthetic polypeptide
DEEEIRTTNPVATEQYGCVCSTEEPTHFGSNQG

SEQ ID NO: 96500 - protein, 31 aa, Artificial Sequence
  Description of Artificial Sequence: Synthetic polypeptide
TEECIRTTNPVATEQYGCVCSTYLAYLSNQS

SEQ ID NO: 96501 - protein, 32 aa, Artificial Sequence
  Description of Artificial Sequence: Synthetic polypeptide
TEECIRCTNPVAYEQYGSVSWNFSQRTGGNNL

SEQ ID NO: 96502 - protein, 34 aa, Artificial Sequence
  Description of Artificial Sequence: Synthetic polypeptide
DEEEIRTTNPVATEQYGCVCSTEHEQYFGSDNQG

SEQ ID NO: 96503 - protein, 34 aa, Artificial Sequence
  Description of Artificial Sequence: Synthetic polypeptide
DEEEIRTTNPVATEQYGCVCSTEHEQSFGSDNQQ

SEQ ID NO: 96504 - protein, 33 aa, Artificial Sequence
  Description of Artificial Sequence: Synthetic polypeptide
DEEEIRTTNPVATEQYGCVCSTEHEQNFGSQQV

SEQ ID NO: 96505 - protein, 33 aa, Artificial Sequence
  Description of Artificial Sequence: Synthetic polypeptide
DEEEIRTTNPVATEQYGCVCSTEHEQGFGSEQG

SEQ ID NO: 96506 - protein, 33 aa, Artificial Sequence
  Description of Artificial Sequence: Synthetic polypeptide
DEEEIRTTNPVATEQYGCVCSTEHEHFGSNTQA

SEQ ID NO: 96507 - protein, 34 aa, Artificial Sequence
  Description of Artificial Sequence: Synthetic polypeptide
DEEEIRTTNPVATEQYGCVCSTEHDQHFGSNTQS

SEQ ID NO: 96508 - protein, 33 aa, Artificial Sequence
  Description of Artificial Sequence: Synthetic polypeptide
DEEEIRTTNPVATEQYGCVCSTEHDQFFNSDQG

SEQ ID NO: 96509 - protein, 34 aa, Artificial Sequence
  Description of Artificial Sequence: Synthetic polypeptide
TEECIRTTNPCATEQYGQSVPSLPNALSQQGGNR

SEQ ID NO: 96510 - protein, 32 aa, Artificial Sequence
  Description of Artificial Sequence: Synthetic polypeptide
TEECIRTTNPVATEAYGSVPSLNALSQQVPNE

SEQ ID NO: 96511 - protein, 32 aa, Artificial Sequence
  Description of Artificial Sequence: Synthetic polypeptide
DEEEIRTTNPVATEQYGCVCSTEHQNFTSVQG

SEQ ID NO: 96512 - protein, 33 aa, Artificial Sequence
  Description of Artificial Sequence: Synthetic polypeptide
TEECIRTTNPVATEPWGSVKSCLNALSQQGGNR

SEQ ID NO: 96513 - protein, 34 aa, Artificial Sequence
  Description of Artificial Sequence: Synthetic polypeptide
TEECIRTTNPVATEPYGQSVPSLDNALSQQGGNR

SEQ ID NO: 96514 - protein, 33 aa, Artificial Sequence
  Description of Artificial Sequence: Synthetic polypeptide
DEEEIRTTNPVATEQYGCVCSTEHANFGSNNQP

SEQ ID NO: 96515 - protein, 33 aa, Artificial Sequence
  Description of Artificial Sequence: Synthetic polypeptide
DEEEIRTTNPVATEQYGCVCSTEHANFGSDNQS

SEQ ID NO: 96516 - protein, 32 aa, Artificial Sequence
  Description of Artificial Sequence: Synthetic polypeptide
DEEEIRTTNPVATEQYGCVCSTEHAHFGSQQS

SEQ ID NO: 96517 - protein, 32 aa, Artificial Sequence
  Description of Artificial Sequence: Synthetic polypeptide
AEEEIRTTNPVATEGYGSVCCTLVTPRSGNHH

SEQ ID NO: 96518 - protein, 32 aa, Artificial Sequence
  Description of Artificial Sequence: Synthetic polypeptide
TEECIRTTNPVATEQYGCVCSTENLAEYLSNQ

SEQ ID NO: 96519 - protein, 31 aa, Artificial Sequence
  Description of Artificial Sequence: Synthetic polypeptide
TEECIRTTNPVATEQYGCVCSTNHAYLSNTQ

SEQ ID NO: 96520 - protein, 31 aa, Artificial Sequence
  Description of Artificial Sequence: Synthetic polypeptide
TEECIRTTNPVATEQYGCVCSTNLAYLSDQM

SEQ ID NO: 96521 - protein, 33 aa, Artificial Sequence
  Description of Artificial Sequence: Synthetic polypeptide
DEEEIRTTNPVATEQYGCVCSTEETQSFNSQQS

SEQ ID NO: 96522 - protein, 31 aa, Artificial Sequence
  Description of Artificial Sequence: Synthetic polypeptide
TEECIRTTNPVATEQYGCVCSTNLNASLSEQ

SEQ ID NO: 96523 - protein, 34 aa, Artificial Sequence
  Description of Artificial Sequence: Synthetic polypeptide
DEEEIRTTNPVATEQYGCVCSTEHDQEGFNSEQG

SEQ ID NO: 96524 - protein, 36 aa, Artificial Sequence
  Description of Artificial Sequence: Synthetic polypeptide
DEEEIRTTNPVATEAYGSVSTVTNNLSNQGGNNNTD

SEQ ID NO: 96525 - protein, 32 aa, Artificial Sequence
  Description of Artificial Sequence: Synthetic polypeptide
DEEEIRTTNPVATEQYGCVCSTEHTHFGSEAL

SEQ ID NO: 96526 - protein, 33 aa, Artificial Sequence
  Description of Artificial Sequence: Synthetic polypeptide
DEEEIRTTNPVATEQYGCVCSTEHTNFTSDNQS

SEQ ID NO: 96527 - protein, 33 aa, Artificial Sequence
  Description of Artificial Sequence: Synthetic polypeptide
DEEEIRTTNPVATEQYGCVCSTEPQHFNSENQG

SEQ ID NO: 96528 - protein, 33 aa, Artificial Sequence
  Description of Artificial Sequence: Synthetic polypeptide
DEEEIRTTNPVATEQYGCVCSTEPQESFGSEQM

SEQ ID NO: 96529 - protein, 34 aa, Artificial Sequence
  Description of Artificial Sequence: Synthetic polypeptide
DEEEIRTTNPVATEQYGCVCSTEPQENFGSNTQS

SEQ ID NO: 96530 - protein, 36 aa, Artificial Sequence
  Description of Artificial Sequence: Synthetic polypeptide
DEEEIRTTNPVATEAYGSVFYTNMLPQNRTGGNYQN

SEQ ID NO: 96531 - protein, 33 aa, Artificial Sequence
  Description of Artificial Sequence: Synthetic polypeptide
DEEEIRTTNPVATEQYGCVCSTEPNQNFGSDQA

SEQ ID NO: 96532 - protein, 33 aa, Artificial Sequence
  Description of Artificial Sequence: Synthetic polypeptide
DEEEIRTTNPVATEQYGCVCSTEPLESFGSEQA

SEQ ID NO: 96533 - protein, 33 aa, Artificial Sequence
  Description of Artificial Sequence: Synthetic polypeptide
DEEEIRTTNPVATEQYGCVCSTEPHQSFGSDQA

SEQ ID NO: 96534 - protein, 35 aa, Artificial Sequence
  Description of Artificial Sequence: Synthetic polypeptide
DEEEIRTTNPVATEAYGSVPSGTNSSGRTGGNMTI

SEQ ID NO: 96535 - protein, 32 aa, Artificial Sequence
  Description of Artificial Sequence: Synthetic polypeptide
DEEEIRTTNPVATEQYGCVCSTEPHENFGSQQ

SEQ ID NO: 96536 - protein, 35 aa, Artificial Sequence
  Description of Artificial Sequence: Synthetic polypeptide
DEEEIRTTNPVATEAYGSVPSYTNESSGRGGNMTI

SEQ ID NO: 96537 - protein, 33 aa, Artificial Sequence
  Description of Artificial Sequence: Synthetic polypeptide
AEEEIRTTNPVATEQYGCVCSTEHQNSGSENQS

SEQ ID NO: 96538 - protein, 34 aa, Artificial Sequence
  Description of Artificial Sequence: Synthetic polypeptide
DEEEIRTTNPVATEQYGCVCSTENPDQNFGSDQS

SEQ ID NO: 96539 - protein, 34 aa, Artificial Sequence
  Description of Artificial Sequence: Synthetic polypeptide
DEEEIRTTNPVATEAYGSVSGTNLDIDNGGGGGN

SEQ ID NO: 96540 - protein, 33 aa, Artificial Sequence
  Description of Artificial Sequence: Synthetic polypeptide
AEEEIRTTNPVATEQYGCVCSTEHQNFGSNTQF

SEQ ID NO: 96541 - protein, 33 aa, Artificial Sequence
  Description of Artificial Sequence: Synthetic polypeptide
DEEEIRTTNPVATEAYGSVSSTGMGQTQGGEFD

SEQ ID NO: 96542 - protein, 34 aa, Artificial Sequence
  Description of Artificial Sequence: Synthetic polypeptide
DEEEIRTTNPVATEAYGSVSTMGDGQFEGEGENN

SEQ ID NO: 96543 - protein, 36 aa, Artificial Sequence
  Description of Artificial Sequence: Synthetic polypeptide
DEEEIRTTNPVATEAYGSVSTNLQQGNNQNDEEEDE

SEQ ID NO: 96544 - protein, 33 aa, Artificial Sequence
  Description of Artificial Sequence: Synthetic polypeptide
TAEEEIATTNPVAYEQWGSVSTNLNQGGMGDGR

SEQ ID NO: 96545 - protein, 32 aa, Artificial Sequence
  Description of Artificial Sequence: Synthetic polypeptide
AEEEIRTTNPVATEQYGCVCSSEPQFFGSNQS

SEQ ID NO: 96546 - protein, 32 aa, Artificial Sequence
  Description of Artificial Sequence: Synthetic polypeptide
TAEEIASTNPVATEQYGSVSWNEQARNGTQSR

SEQ ID NO: 96547 - protein, 32 aa, Artificial Sequence
  Description of Artificial Sequence: Synthetic polypeptide
TAEEIASTNPVATEQYGSVSWNEQERNGMQER

SEQ ID NO: 96548 - protein, 33 aa, Artificial Sequence
  Description of Artificial Sequence: Synthetic polypeptide
DEEEIRTTNPVATEQYGCVCSTEPQHFNSETQL

SEQ ID NO: 96549 - protein, 35 aa, Artificial Sequence
  Description of Artificial Sequence: Synthetic polypeptide
DEEEIRTTNPVATEAYGSVCSNDNDLQRGGEDDML

SEQ ID NO: 96550 - protein, 33 aa, Artificial Sequence
  Description of Artificial Sequence: Synthetic polypeptide
DEEEIRTTNPVATEQYGCVCSTETQEGFDSEQL

SEQ ID NO: 96551 - protein, 32 aa, Artificial Sequence
  Description of Artificial Sequence: Synthetic polypeptide
SSEEIRTTNPVAYHQYGSVVSTVLSQFGGNNE

SEQ ID NO: 96552 - protein, 33 aa, Artificial Sequence
  Description of Artificial Sequence: Synthetic polypeptide
DEEEIRTTNPVATEQYGCVCSTGEDANFGSENQ

SEQ ID NO: 96553 - protein, 33 aa, Artificial Sequence
  Description of Artificial Sequence: Synthetic polypeptide
DEEEIRTTNPVATEQYGCVCSTGEDAGFGSNQS

SEQ ID NO: 96554 - protein, 34 aa, Artificial Sequence
  Description of Artificial Sequence: Synthetic polypeptide
DEEEIRTTNPVATEQYGCVCSTGALQFFNSEFQS

SEQ ID NO: 96555 - protein, 34 aa, Artificial Sequence
  Description of Artificial Sequence: Synthetic polypeptide
DEEEIRTTNPVATEQYGCVCSTGALQESFGSDQS

SEQ ID NO: 96556 - protein, 33 aa, Artificial Sequence
  Description of Artificial Sequence: Synthetic polypeptide
DEEEIRTTNPVATEQYGCVCSTGAHQSFNSNIS

SEQ ID NO: 96557 - protein, 33 aa, Artificial Sequence
  Description of Artificial Sequence: Synthetic polypeptide
DEEEIRTTNPVATEQYGCVCSTGAHQNFMSNQS

SEQ ID NO: 96558 - protein, 33 aa, Artificial Sequence
  Description of Artificial Sequence: Synthetic polypeptide
DEEEIRTTNPVATEQYGCVCSTGAHQNFISNQS

SEQ ID NO: 96559 - protein, 33 aa, Artificial Sequence
  Description of Artificial Sequence: Synthetic polypeptide
DEEEIRTTNPVATEQYGCVCSTGAHQNFGSDQG

SEQ ID NO: 96560 - protein, 33 aa, Artificial Sequence
  Description of Artificial Sequence: Synthetic polypeptide
DEEEIRTTNPVATEQYGCVCSTGAHQHFNSNQL

SEQ ID NO: 96561 - protein, 33 aa, Artificial Sequence
  Description of Artificial Sequence: Synthetic polypeptide
DEEEIRTTNPVATEQYGCVCSTGAHQHFNSDQA

SEQ ID NO: 96562 - protein, 34 aa, Artificial Sequence
  Description of Artificial Sequence: Synthetic polypeptide
DEEEIRTTNPVATEQYGCVCSTENHQYFGSDTDA

SEQ ID NO: 96563 - protein, 34 aa, Artificial Sequence
  Description of Artificial Sequence: Synthetic polypeptide
DEEEIRTTNPVATEQYGCVCSTGAHQHFGSNNQS

SEQ ID NO: 96564 - protein, 34 aa, Artificial Sequence
  Description of Artificial Sequence: Synthetic polypeptide
DEEEIRTTNPVATEQYGCVCSTGAHQEYFGSNQS

SEQ ID NO: 96565 - protein, 32 aa, Artificial Sequence
  Description of Artificial Sequence: Synthetic polypeptide
SSEEIRTTNPVAYHEYGSVVSTVLSQRVGNNF

SEQ ID NO: 96566 - protein, 31 aa, Artificial Sequence
  Description of Artificial Sequence: Synthetic polypeptide
SSEEIRTTNPVAYHQYGKVSTGLSDRGGNNF

SEQ ID NO: 96567 - protein, 35 aa, Artificial Sequence
  Description of Artificial Sequence: Synthetic polypeptide
DEEEIRTTNPVATEAYGSTISCLPNMLSDRDGNDR

SEQ ID NO: 96568 - protein, 32 aa, Artificial Sequence
  Description of Artificial Sequence: Synthetic polypeptide
SSEEIRTTNPVAYHQYGSVSCTWLSQPGGNNQ

SEQ ID NO: 96569 - protein, 33 aa, Artificial Sequence
  Description of Artificial Sequence: Synthetic polypeptide
AEEEIRTTNPVATEQYGCVCSTENHQNFGSDQS

SEQ ID NO: 96570 - protein, 33 aa, Artificial Sequence
  Description of Artificial Sequence: Synthetic polypeptide
DEEEIRTTNPVATEQYGCVCSTEVQFFNSENQY

SEQ ID NO: 96571 - protein, 33 aa, Artificial Sequence
  Description of Artificial Sequence: Synthetic polypeptide
DEEEIRTTNPVATEQYGCVCSTETTEHFGSNQA

SEQ ID NO: 96572 - protein, 33 aa, Artificial Sequence
  Description of Artificial Sequence: Synthetic polypeptide
AEEEIRTTNPVATEQYGCVCSTENHQNFGSDDA

SEQ ID NO: 96573 - protein, 33 aa, Artificial Sequence
  Description of Artificial Sequence: Synthetic polypeptide
DEEEIRTTNPVATEQYGCVCSTETQHFNSNNQL

SEQ ID NO: 96574 - protein, 34 aa, Artificial Sequence
  Description of Artificial Sequence: Synthetic polypeptide
DEEEIRTTNPVATEQYGCVCSTGAHQFFGSDNQY

SEQ ID NO: 96575 - protein, 33 aa, Artificial Sequence
  Description of Artificial Sequence: Synthetic polypeptide
DEEEIRTTNPVATEQYGCVCSTEEHQHFGSEQA

SEQ ID NO: 96576 - protein, 34 aa, Artificial Sequence
  Description of Artificial Sequence: Synthetic polypeptide
DEEEIRTTNPVATEQYGCVCSTENHQSFGSDTQS

SEQ ID NO: 96577 - protein, 31 aa, Artificial Sequence
  Description of Artificial Sequence: Synthetic polypeptide
TDEEIRTTNPVATDQYGSVSTPTLQTTVEFV

SEQ ID NO: 96578 - protein, 34 aa, Artificial Sequence
  Description of Artificial Sequence: Synthetic polypeptide
DEEEIRTTNPVATEQYGCVCSTELNQNFGSDTQS

SEQ ID NO: 96579 - protein, 34 aa, Artificial Sequence
  Description of Artificial Sequence: Synthetic polypeptide
DEEEIRTTNPVATEQYGCVCSTELNQEHFNSNQE

SEQ ID NO: 96580 - protein, 34 aa, Artificial Sequence
  Description of Artificial Sequence: Synthetic polypeptide
DEEEIRTTNPVATEQYGCVCSTELNQEHFNSEQS

SEQ ID NO: 96581 - protein, 31 aa, Artificial Sequence
  Description of Artificial Sequence: Synthetic polypeptide
TEDEIATTNPVATEHYGCVSTNLQGEGGMDP

SEQ ID NO: 96582 - protein, 34 aa, Artificial Sequence
  Description of Artificial Sequence: Synthetic polypeptide
DEEEIRTTNPVATEQYGCVCSTELNINFGSENQS

SEQ ID NO: 96583 - protein, 34 aa, Artificial Sequence
  Description of Artificial Sequence: Synthetic polypeptide
DEEEIRTTNPVATEQYGCVCSTELNENFGSNNDA

SEQ ID NO: 96584 - protein, 33 aa, Artificial Sequence
  Description of Artificial Sequence: Synthetic polypeptide
DEEEIRTTNPVATEQYGCVCSTELNEGFGSEQG

SEQ ID NO: 96585 - protein, 33 aa, Artificial Sequence
  Description of Artificial Sequence: Synthetic polypeptide
TEDEIRTTNPVATDQYGSVNCTAELSQRTGGND

SEQ ID NO: 96586 - protein, 33 aa, Artificial Sequence
  Description of Artificial Sequence: Synthetic polypeptide
DEEEIRTTNPVATEQYGCVCSTELIHFNSNNQV

SEQ ID NO: 96587 - protein, 33 aa, Artificial Sequence
  Description of Artificial Sequence: Synthetic polypeptide
DEEEIRTTNPVATEQYGCVCSTELIEHFGSDQE

SEQ ID NO: 96588 - protein, 34 aa, Artificial Sequence
  Description of Artificial Sequence: Synthetic polypeptide
DEEEIRTTNPVATEQYGCVCSTELIEGFGSNNQD

SEQ ID NO: 96589 - protein, 32 aa, Artificial Sequence
  Description of Artificial Sequence: Synthetic polypeptide
AEEEIRTTNPVATEQYGCVCQTGALQNSGSEQ

SEQ ID NO: 96590 - protein, 33 aa, Artificial Sequence
  Description of Artificial Sequence: Synthetic polypeptide
DEEEIRTTNPVATEQYGCVCSTELHQGFISDQS

SEQ ID NO: 96591 - protein, 35 aa, Artificial Sequence
  Description of Artificial Sequence: Synthetic polypeptide
DEEEIRTTNPVATEQYGCVCSTELHQEGFGSDNQS

SEQ ID NO: 96592 - protein, 33 aa, Artificial Sequence
  Description of Artificial Sequence: Synthetic polypeptide
DEEEIRTTNPVATEQYGCVCSTELEYFGSETQS

SEQ ID NO: 96593 - protein, 33 aa, Artificial Sequence
  Description of Artificial Sequence: Synthetic polypeptide
DEEEIRTTNPVATEQYGCVCSTELESFNSENQS

SEQ ID NO: 96594 - protein, 34 aa, Artificial Sequence
  Description of Artificial Sequence: Synthetic polypeptide
DEEEIRTTNPVATEQYGCVCSTELEQEFFGSDQI

SEQ ID NO: 96595 - protein, 33 aa, Artificial Sequence
  Description of Artificial Sequence: Synthetic polypeptide
DEEEIRTTNPVATEQYGCVCSTELEHFGSDTQG

SEQ ID NO: 96596 - protein, 34 aa, Artificial Sequence
  Description of Artificial Sequence: Synthetic polypeptide
DEEEIRTTNPVATEQYGCVCSTELEESFGSNNQA

SEQ ID NO: 96597 - protein, 33 aa, Artificial Sequence
  Description of Artificial Sequence: Synthetic polypeptide
DEEEIRTTNPVATEQYGCVCSTELEENSNSEQA

SEQ ID NO: 96598 - protein, 34 aa, Artificial Sequence
  Description of Artificial Sequence: Synthetic polypeptide
AEEEIRTTNPVATEQYGCVCNTENLNQSSGSNTQ

SEQ ID NO: 96599 - protein, 33 aa, Artificial Sequence
  Description of Artificial Sequence: Synthetic polypeptide
DEEEIRTTNPVATEQYGCVCSTELNQSFISEQS

SEQ ID NO: 96600 - protein, 35 aa, Artificial Sequence
  Description of Artificial Sequence: Synthetic polypeptide
AEEEIRTTNPVATEQYGCVCSNTENLQENFGSNQS

SEQ ID NO: 96601 - protein, 36 aa, Artificial Sequence
  Description of Artificial Sequence: Synthetic polypeptide
DEEEIRTTNPVATEAYGSVSTTTNNNLLQAGNNNTD

SEQ ID NO: 96602 - protein, 33 aa, Artificial Sequence
  Description of Artificial Sequence: Synthetic polypeptide
TEAEIRTTNPVATECYGSCPSCTPHELQRVGNH

SEQ ID NO: 96603 - protein, 34 aa, Artificial Sequence
  Description of Artificial Sequence: Synthetic polypeptide
DEEEIRTTNPVATEQYGCVCSTENHQNFQSQNQA

SEQ ID NO: 96604 - protein, 33 aa, Artificial Sequence
  Description of Artificial Sequence: Synthetic polypeptide
DEEEIRTTNPVATEQYGCVCSTENHQHFFSDQT

SEQ ID NO: 96605 - protein, 34 aa, Artificial Sequence
  Description of Artificial Sequence: Synthetic polypeptide
DEEEIRTTNPVATEQYGCVCSTENHQENFLSNQT

SEQ ID NO: 96606 - protein, 34 aa, Artificial Sequence
  Description of Artificial Sequence: Synthetic polypeptide
DEEEIRTTNPVATEQYGCVCSTENHQEAFGSDQP

SEQ ID NO: 96607 - protein, 34 aa, Artificial Sequence
  Description of Artificial Sequence: Synthetic polypeptide
DEEEIRTTNPVATEQYGCVCSTENHNQNFNSDQM

SEQ ID NO: 96608 - protein, 35 aa, Artificial Sequence
  Description of Artificial Sequence: Synthetic polypeptide
DEEEIRTTNPVATEQYGCVCSTENHNQNFGSNTQE

SEQ ID NO: 96609 - protein, 34 aa, Artificial Sequence
  Description of Artificial Sequence: Synthetic polypeptide
DEEEIRTTNPVATEQYGCVCSTENHNQHFGSEQS

SEQ ID NO: 96610 - protein, 31 aa, Artificial Sequence
  Description of Artificial Sequence: Synthetic polypeptide
TEAEIATTNPVAYDQYGMVSCTAEHSQRGNR

SEQ ID NO: 96611 - protein, 33 aa, Artificial Sequence
  Description of Artificial Sequence: Synthetic polypeptide
DEEEIRTTNPVATEQYGCVCSTENHASFGSEQG

SEQ ID NO: 96612 - protein, 34 aa, Artificial Sequence
  Description of Artificial Sequence: Synthetic polypeptide
DEEEIRTTNPVATEQYGCVCSTENHANFGSNNQL

SEQ ID NO: 96613 - protein, 34 aa, Artificial Sequence
  Description of Artificial Sequence: Synthetic polypeptide
DEEEIRTTNPVATEQYGCVCSTENHQSFGSDTAS

SEQ ID NO: 96614 - protein, 33 aa, Artificial Sequence
  Description of Artificial Sequence: Synthetic polypeptide
DEEEIRTTNPVATEQYGCVCSTENHANFGSDQA

SEQ ID NO: 96615 - protein, 32 aa, Artificial Sequence
  Description of Artificial Sequence: Synthetic polypeptide
TEAEIRTTNPCATEAYGSCPSCTHEEQRVGNR

SEQ ID NO: 96616 - protein, 34 aa, Artificial Sequence
  Description of Artificial Sequence: Synthetic polypeptide
DEEEIRTTNPVATEQYGCVCSTENDIQENFGSEQ

SEQ ID NO: 96617 - protein, 35 aa, Artificial Sequence
  Description of Artificial Sequence: Synthetic polypeptide
DEEEIRTTNPVATEQYGCVCSTENDHQFFGSNTQP

SEQ ID NO: 96618 - protein, 36 aa, Artificial Sequence
  Description of Artificial Sequence: Synthetic polypeptide
DEEEIRTTNPVATEAYGSVSTTNNNLLQQGGNNNTD

SEQ ID NO: 96619 - protein, 36 aa, Artificial Sequence
  Description of Artificial Sequence: Synthetic polypeptide
DEEEIRTTNPVATEAYGSVSTTNNQLNLQQGSNNTD

SEQ ID NO: 96620 - protein, 33 aa, Artificial Sequence
  Description of Artificial Sequence: Synthetic polypeptide
TEAEIRTTNPVATECWGSCPSCTHELQRNVGNR

SEQ ID NO: 96621 - protein, 33 aa, Artificial Sequence
  Description of Artificial Sequence: Synthetic polypeptide
TEAEIRTTNPVATECYGSCASCTHEEQRVGNNR

SEQ ID NO: 96622 - protein, 33 aa, Artificial Sequence
  Description of Artificial Sequence: Synthetic polypeptide
TEAEIRTTNPVATECYGSCPGCTHELQRVGNNR

SEQ ID NO: 96623 - protein, 32 aa, Artificial Sequence
  Description of Artificial Sequence: Synthetic polypeptide
TEAEIRTTNPVATECYGSCPSCTHEEQTVGNR

SEQ ID NO: 96624 - protein, 32 aa, Artificial Sequence
  Description of Artificial Sequence: Synthetic polypeptide
TEAEIRTTNPVATECYGSCPSCTHELPSVGNR

SEQ ID NO: 96625 - protein, 33 aa, Artificial Sequence
  Description of Artificial Sequence: Synthetic polypeptide
DEEEIRTTNPVATEQYGCVCSTENHAHFGSDQS

SEQ ID NO: 96626 - protein, 33 aa, Artificial Sequence
  Description of Artificial Sequence: Synthetic polypeptide
DEEEIRTTNPVATEQYGCVCSTEEHQHFGSDQQ

SEQ ID NO: 96627 - protein, 34 aa, Artificial Sequence
  Description of Artificial Sequence: Synthetic polypeptide
DEEEIRTTNPVATEQYGCVCSTEEHQFGNSDTQE

SEQ ID NO: 96628 - protein, 33 aa, Artificial Sequence
  Description of Artificial Sequence: Synthetic polypeptide
DEEEIRTTNPVATEQYGCVCSTEEHQFGGSDQS

SEQ ID NO: 96629 - protein, 34 aa, Artificial Sequence
  Description of Artificial Sequence: Synthetic polypeptide
DEEEIRTTNPVATEQYGCVCSSGNHQNFGSNTQA

SEQ ID NO: 96630 - protein, 33 aa, Artificial Sequence
  Description of Artificial Sequence: Synthetic polypeptide
DEEEIRTTNPVATEQYGCVCSSGNHQFFGSDQN

SEQ ID NO: 96631 - protein, 33 aa, Artificial Sequence
  Description of Artificial Sequence: Synthetic polypeptide
TEEEIATTNPVAYEQYGNVSVTMLSQGTGNNRN

SEQ ID NO: 96632 - protein, 35 aa, Artificial Sequence
  Description of Artificial Sequence: Synthetic polypeptide
AEEEIRTTNPVATEAYGVVSVSVTNLQLNGNEEQD

SEQ ID NO: 96633 - protein, 32 aa, Artificial Sequence
  Description of Artificial Sequence: Synthetic polypeptide
TEEEIATTNPVAYEQYGQTVSVTMLQGTGGNE

SEQ ID NO: 96634 - protein, 33 aa, Artificial Sequence
  Description of Artificial Sequence: Synthetic polypeptide
DEEEIRTTNPVATEQYGCVCSSGELQNFGSEQG

SEQ ID NO: 96635 - protein, 34 aa, Artificial Sequence
  Description of Artificial Sequence: Synthetic polypeptide
DEEEIRTTNPVATEQYGCVCSSGELQHFGSNNQS

SEQ ID NO: 96636 - protein, 34 aa, Artificial Sequence
  Description of Artificial Sequence: Synthetic polypeptide
DEEEIRTTNPVATEQYGCVCSSGELQHFGSENQA

SEQ ID NO: 96637 - protein, 33 aa, Artificial Sequence
  Description of Artificial Sequence: Synthetic polypeptide
DEEEIRTTNPVATEQYGCVCSSGELQGFGSQQA

SEQ ID NO: 96638 - protein, 34 aa, Artificial Sequence
  Description of Artificial Sequence: Synthetic polypeptide
DEEEIRTTNPVATEQYGCVCSSGELQFFGSNTQA

SEQ ID NO: 96639 - protein, 33 aa, Artificial Sequence
  Description of Artificial Sequence: Synthetic polypeptide
DEEEIRTTNPVATEQYGCVCSSGELQFFGSDQA

SEQ ID NO: 96640 - protein, 34 aa, Artificial Sequence
  Description of Artificial Sequence: Synthetic polypeptide
DEEEIRTTNPVATEQYGCVCSSGELQFFGSDNQS

SEQ ID NO: 96641 - protein, 32 aa, Artificial Sequence
  Description of Artificial Sequence: Synthetic polypeptide
TEEEIATTNPVAYEQYGSVATNLQTEGGTGPS

SEQ ID NO: 96642 - protein, 35 aa, Artificial Sequence
  Description of Artificial Sequence: Synthetic polypeptide
TEEEIATTNPVAYEQYGSVSSTANELSQNGGNYRN

SEQ ID NO: 96643 - protein, 35 aa, Artificial Sequence
  Description of Artificial Sequence: Synthetic polypeptide
TEEEIATTNPVAYEQYGSVSTANELSQQVGENNRN

SEQ ID NO: 96644 - protein, 34 aa, Artificial Sequence
  Description of Artificial Sequence: Synthetic polypeptide
TEEEIATTNPVAYEQYGTVSTANELSQPGENYRN

SEQ ID NO: 96645 - protein, 35 aa, Artificial Sequence
  Description of Artificial Sequence: Synthetic polypeptide
TEEEICTTNPVATERYGISTVASTNELSQERGSNT

SEQ ID NO: 96646 - protein, 33 aa, Artificial Sequence
  Description of Artificial Sequence: Synthetic polypeptide
TEEEICTTNPVATERYGTVVSKNELSQAGGNRF

SEQ ID NO: 96647 - protein, 34 aa, Artificial Sequence
  Description of Artificial Sequence: Synthetic polypeptide
TEEEIGTTNPVATEQYGSVVPSCTNESPHTGNRR

SEQ ID NO: 96648 - protein, 32 aa, Artificial Sequence
  Description of Artificial Sequence: Synthetic polypeptide
TEEEIGTTNPVAYERYGSVACTCVAQRVGNYR

SEQ ID NO: 96649 - protein, 33 aa, Artificial Sequence
  Description of Artificial Sequence: Synthetic polypeptide
DEEEIRTTNPVATEQYGCVCSSGEDQGFGSNQS

SEQ ID NO: 96650 - protein, 33 aa, Artificial Sequence
  Description of Artificial Sequence: Synthetic polypeptide
DEEEIRTTNPVATEQYGCVCSSGNHQNFNSEQT

SEQ ID NO: 96651 - protein, 35 aa, Artificial Sequence
  Description of Artificial Sequence: Synthetic polypeptide
AEEEIRTTNPVATEAYGVVSVSVTNLQLNQGNNQD

SEQ ID NO: 96652 - protein, 34 aa, Artificial Sequence
  Description of Artificial Sequence: Synthetic polypeptide
DEEEIRTTNPVATEQYGCVCSSGNPQNFGSNNQS

SEQ ID NO: 96653 - protein, 33 aa, Artificial Sequence
  Description of Artificial Sequence: Synthetic polypeptide
DEEEIRTTNPVATEQYGCVCSSGNPQNFNSDQA

SEQ ID NO: 96654 - protein, 33 aa, Artificial Sequence
  Description of Artificial Sequence: Synthetic polypeptide
DEEEIRTTNPVATEQYGCVCSTAHNQNFNSQQS

SEQ ID NO: 96655 - protein, 33 aa, Artificial Sequence
  Description of Artificial Sequence: Synthetic polypeptide
DEEEIRTTNPVATEQYGCVCSTAHNQGFNSDQS

SEQ ID NO: 96656 - protein, 32 aa, Artificial Sequence
  Description of Artificial Sequence: Synthetic polypeptide
DEEEIRTTNPVATEQYGCVCSTAHINFGSQQS

SEQ ID NO: 96657 - protein, 32 aa, Artificial Sequence
  Description of Artificial Sequence: Synthetic polypeptide
DEEEIRTTNPVATEQYGCVCSTAHANFNSDQS

SEQ ID NO: 96658 - protein, 32 aa, Artificial Sequence
  Description of Artificial Sequence: Synthetic polypeptide
DEEEIRTTNPVATEQYGCVCSTAHANFGSQQS

SEQ ID NO: 96659 - protein, 34 aa, Artificial Sequence
  Description of Artificial Sequence: Synthetic polypeptide
DEEEIRTTNPVATEQYGCVCSTADHQNFGSNNQL

SEQ ID NO: 96660 - protein, 34 aa, Artificial Sequence
  Description of Artificial Sequence: Synthetic polypeptide
TEEEIATTNPVATEQYGSVSTGNGSQNIGTNNHL

SEQ ID NO: 96661 - protein, 35 aa, Artificial Sequence
  Description of Artificial Sequence: Synthetic polypeptide
AEEEIRTTNPVATEAYGVVSVSVVTNLQQNNGNQD

SEQ ID NO: 96662 - protein, 35 aa, Artificial Sequence
  Description of Artificial Sequence: Synthetic polypeptide
AEEEIRTTNPVATEAYGVVSVSVVTNLQNQGTNQT

SEQ ID NO: 96663 - protein, 33 aa, Artificial Sequence
  Description of Artificial Sequence: Synthetic polypeptide
DEEEIRTTNPVATEQYGCVCSSNHTEFFGSNQP

SEQ ID NO: 96664 - protein, 32 aa, Artificial Sequence
  Description of Artificial Sequence: Synthetic polypeptide
DEEEIRTTNPVATEQYGCVCSSGEDQGFGSDQ

SEQ ID NO: 96665 - protein, 35 aa, Artificial Sequence
  Description of Artificial Sequence: Synthetic polypeptide
AEEEIRTTNPVATEAYGVVSVSVVTNLQGNGNTQQ

SEQ ID NO: 96666 - protein, 35 aa, Artificial Sequence
  Description of Artificial Sequence: Synthetic polypeptide
AEEEIRTTNPVATEAYGVVSVSVTNQLQNGNNNQE

SEQ ID NO: 96667 - protein, 32 aa, Artificial Sequence
  Description of Artificial Sequence: Synthetic polypeptide
DEEEIRTTNPVATEQYGCVCSSNHQFFISQQS

SEQ ID NO: 96668 - protein, 33 aa, Artificial Sequence
  Description of Artificial Sequence: Synthetic polypeptide
DEEEIRTTNPVATEQYGCVCSSNHQENFNSNQS

SEQ ID NO: 96669 - protein, 33 aa, Artificial Sequence
  Description of Artificial Sequence: Synthetic polypeptide
DEEEIRTTNPVATEQYGCVCSSNHQENFNSNQM

SEQ ID NO: 96670 - protein, 33 aa, Artificial Sequence
  Description of Artificial Sequence: Synthetic polypeptide
DEEEIRTTNPVATEQYGCVCSSNHNQNFGSDQS

SEQ ID NO: 96671 - protein, 32 aa, Artificial Sequence
  Description of Artificial Sequence: Synthetic polypeptide
TEEEIATTNPVAYEHYGSVSTGEPQNRPGGNQ

SEQ ID NO: 96672 - protein, 33 aa, Artificial Sequence
  Description of Artificial Sequence: Synthetic polypeptide
TEEEIATTNPVAYEQWGNVSQTNMQLQDGDGNR

SEQ ID NO: 96673 - protein, 33 aa, Artificial Sequence
  Description of Artificial Sequence: Synthetic polypeptide
DEEEIRTTNPVATEQYGCVCSSMNHQHFGSEQG

SEQ ID NO: 96674 - protein, 31 aa, Artificial Sequence
  Description of Artificial Sequence: Synthetic polypeptide
TEEEIATTNPVAYEQWGSVSKAWNLDEGGGR

SEQ ID NO: 96675 - protein, 33 aa, Artificial Sequence
  Description of Artificial Sequence: Synthetic polypeptide
DEEEIRTTNPVATEQYGCVCSSGPHQHFGSNQG

SEQ ID NO: 96676 - protein, 33 aa, Artificial Sequence
  Description of Artificial Sequence: Synthetic polypeptide
DEEEIRTTNPVATEQYGCVCSSNHQNFISDNQL

SEQ ID NO: 96677 - protein, 34 aa, Artificial Sequence
  Description of Artificial Sequence: Synthetic polypeptide
TEEEIATTNPVATEQYGSTVSTGNGSQDQGTNHW

SEQ ID NO: 96678 - protein, 32 aa, Artificial Sequence
  Description of Artificial Sequence: Synthetic polypeptide
TEEEIKTTNPVAYERYGSVACTDCVQRVGNYR

SEQ ID NO: 96679 - protein, 32 aa, Artificial Sequence
  Description of Artificial Sequence: Synthetic polypeptide
TEEEIQTTNPVATEQWGQSTVPSTNLSFAVNQ

SEQ ID NO: 96680 - protein, 31 aa, Artificial Sequence
  Description of Artificial Sequence: Synthetic polypeptide
TEEEIRCTNPIAYEQYGSVVSENHSHRGGER

SEQ ID NO: 96681 - protein, 33 aa, Artificial Sequence
  Description of Artificial Sequence: Synthetic polypeptide
TEEEIRPTNPVATEQYGHVNETSNIDQRGENYQ

SEQ ID NO: 96682 - protein, 34 aa, Artificial Sequence
  Description of Artificial Sequence: Synthetic polypeptide
TEEEIRPTNPVATEQYGSVSTGNELSQMPGGDSS

SEQ ID NO: 96683 - protein, 34 aa, Artificial Sequence
  Description of Artificial Sequence: Synthetic polypeptide
TEEEIRSTNPIATEQYGSTVSENELSMRTGGNRT

SEQ ID NO: 96684 - protein, 32 aa, Artificial Sequence
  Description of Artificial Sequence: Synthetic polypeptide
TEEEIRTCNPVAYEAYGSVSCTGELSQRVGQE

SEQ ID NO: 96685 - protein, 33 aa, Artificial Sequence
  Description of Artificial Sequence: Synthetic polypeptide
DEEEIRTTNPVATEQYGCVCSSEELQYFGSDQG

SEQ ID NO: 96686 - protein, 34 aa, Artificial Sequence
  Description of Artificial Sequence: Synthetic polypeptide
DEEEIRTTNPVATEQYGCVCSSEELNQFFGSNQA

SEQ ID NO: 96687 - protein, 33 aa, Artificial Sequence
  Description of Artificial Sequence: Synthetic polypeptide
DEEEIRTTNPVATEQYGCVCSSEEHQFFGSNQE

SEQ ID NO: 96688 - protein, 33 aa, Artificial Sequence
  Description of Artificial Sequence: Synthetic polypeptide
TEEEIRTTNPVACERYGSVVAVANLSQRTVGNT

SEQ ID NO: 96689 - protein, 34 aa, Artificial Sequence
  Description of Artificial Sequence: Synthetic polypeptide
TEEEIRTTNPVATEAYGKIVSTNLSDRDGGHNEP

SEQ ID NO: 96690 - protein, 34 aa, Artificial Sequence
  Description of Artificial Sequence: Synthetic polypeptide
TEEEIRTTNPVATEAYGKVVFQTNGLSQKGTNRS

SEQ ID NO: 96691 - protein, 33 aa, Artificial Sequence
  Description of Artificial Sequence: Synthetic polypeptide
DEEEIRTTNPVATEQYGCVCSSEDLQGFGSDQA

SEQ ID NO: 96692 - protein, 34 aa, Artificial Sequence
  Description of Artificial Sequence: Synthetic polypeptide
TEEEIRTTNPVATEAYGKVVSQTNGFSQKGTNRQ

SEQ ID NO: 96693 - protein, 34 aa, Artificial Sequence
  Description of Artificial Sequence: Synthetic polypeptide
TEEEIRTTNPVATEAYGKVVSQTNMLSQVGTNVK

SEQ ID NO: 96694 - protein, 34 aa, Artificial Sequence
  Description of Artificial Sequence: Synthetic polypeptide
TEEEIRTTNPVATEAYGKVVSQTSMLSQEGTNRK

SEQ ID NO: 96695 - protein, 35 aa, Artificial Sequence
  Description of Artificial Sequence: Synthetic polypeptide
TEEEIRTTNPVATEAYGKVVYSQTNALSQQGTNRK

SEQ ID NO: 96696 - protein, 34 aa, Artificial Sequence
  Description of Artificial Sequence: Synthetic polypeptide
TEEEIRTTNPVATEAYGNVVSQTNMLSQQGTNLK

SEQ ID NO: 96697 - protein, 32 aa, Artificial Sequence
  Description of Artificial Sequence: Synthetic polypeptide
DEEEIRTTNPVATEQYGCVCSSAHQNFGSQQA

SEQ ID NO: 96698 - protein, 32 aa, Artificial Sequence
  Description of Artificial Sequence: Synthetic polypeptide
DEEEIRTTNPVATEQYGCVCSSAHQNFGSDQP

SEQ ID NO: 96699 - protein, 35 aa, Artificial Sequence
  Description of Artificial Sequence: Synthetic polypeptide
TEEEIRTTNPVATEAYGQSVVGTNLPQDRVGNNLY

SEQ ID NO: 96700 - protein, 33 aa, Artificial Sequence
  Description of Artificial Sequence: Synthetic polypeptide
DEEEIRTTNPVATEQYGCVCSNWNTQNFGSEQM

SEQ ID NO: 96701 - protein, 33 aa, Artificial Sequence
  Description of Artificial Sequence: Synthetic polypeptide
DEEEIRTTNPVATEQYGCVCSSEHQHFGSNNDG

SEQ ID NO: 96702 - protein, 32 aa, Artificial Sequence
  Description of Artificial Sequence: Synthetic polypeptide
DEEEIRTTNPVATEQYGCVCSSEHQHFISNQG

SEQ ID NO: 96703 - protein, 32 aa, Artificial Sequence
  Description of Artificial Sequence: Synthetic polypeptide
DEEEIRTTNPVATEQYGCVCSSEHQNFTSNQF

SEQ ID NO: 96704 - protein, 32 aa, Artificial Sequence
  Description of Artificial Sequence: Synthetic polypeptide
DEEEIRTTNPVATEQYGCVCSSEHQSFGSDQA

SEQ ID NO: 96705 - protein, 31 aa, Artificial Sequence
  Description of Artificial Sequence: Synthetic polypeptide
TEEEIRATNPVAYEQWGCISFNLSQRPGGNQ

SEQ ID NO: 96706 - protein, 31 aa, Artificial Sequence
  Description of Artificial Sequence: Synthetic polypeptide
TEEEIRATNPVAYEQWGVVSGWNDHQQGGNR

SEQ ID NO: 96707 - protein, 32 aa, Artificial Sequence
  Description of Artificial Sequence: Synthetic polypeptide
TEEEIRATNPVAYERYGSVACTFVPQRVGNYR

SEQ ID NO: 96708 - protein, 33 aa, Artificial Sequence
  Description of Artificial Sequence: Synthetic polypeptide
TEEEIRCTNPIATEAYGSVVSEPNLSMRGGNNR

SEQ ID NO: 96709 - protein, 33 aa, Artificial Sequence
  Description of Artificial Sequence: Synthetic polypeptide
DEEEIRTTNPVATEQYGCVCSSEPQNFGSNFQS

SEQ ID NO: 96710 - protein, 32 aa, Artificial Sequence
  Description of Artificial Sequence: Synthetic polypeptide
DEEEIRTTNPVATEQYGCVCSSEPQFFGSEQM

SEQ ID NO: 96711 - protein, 33 aa, Artificial Sequence
  Description of Artificial Sequence: Synthetic polypeptide
DEEEIRTTNPVATEQYGCVCSSEPQEGFGSNQA

SEQ ID NO: 96712 - protein, 33 aa, Artificial Sequence
  Description of Artificial Sequence: Synthetic polypeptide
DEEEIRTTNPVATEQYGCVCSSEPLQYFGSEQS

SEQ ID NO: 96713 - protein, 33 aa, Artificial Sequence
  Description of Artificial Sequence: Synthetic polypeptide
DEEEIRTTNPVATEQYGCVCSSEPLENFGSNQA

SEQ ID NO: 96714 - protein, 33 aa, Artificial Sequence
  Description of Artificial Sequence: Synthetic polypeptide
TEEEIRCTNPIATEQYGSTVSENELSMRTEGNQ

SEQ ID NO: 96715 - protein, 34 aa, Artificial Sequence
  Description of Artificial Sequence: Synthetic polypeptide
TEEEINTTNPVATEQYGSVSTGNELSQMPGGMSA

SEQ ID NO: 96716 - protein, 35 aa, Artificial Sequence
  Description of Artificial Sequence: Synthetic polypeptide
DEEEIRTTNPVATEAYGTVSDNNMLSQQKAVGNNR

SEQ ID NO: 96717 - protein, 34 aa, Artificial Sequence
  Description of Artificial Sequence: Synthetic polypeptide
DEEEIRTTNPVATEQYGCVCSSENHQEHFGSNDG

SEQ ID NO: 96718 - protein, 34 aa, Artificial Sequence
  Description of Artificial Sequence: Synthetic polypeptide
TEEEIRCTNPIATEQYGSTVVSENELSARTGGNR

SEQ ID NO: 96719 - protein, 32 aa, Artificial Sequence
  Description of Artificial Sequence: Synthetic polypeptide
DEEEIRTTNPVATEQYGCVCSSELQGFQSEQA

SEQ ID NO: 96720 - protein, 31 aa, Artificial Sequence
  Description of Artificial Sequence: Synthetic polypeptide
TEEEIRCTNPIAYEAYGSVSENLSMTTGGNR

SEQ ID NO: 96721 - protein, 33 aa, Artificial Sequence
  Description of Artificial Sequence: Synthetic polypeptide
TEEEIRCTNPIAYEQYGCSVSENELSMRGGNNR

SEQ ID NO: 96722 - protein, 34 aa, Artificial Sequence
  Description of Artificial Sequence: Synthetic polypeptide
DEEEIRTTNPVATEQYGCVCSSELQEYFGSENQS

SEQ ID NO: 96723 - protein, 33 aa, Artificial Sequence
  Description of Artificial Sequence: Synthetic polypeptide
DEEEIRTTNPVATEQYGCVCSSELQENFGSDTQ

SEQ ID NO: 96724 - protein, 33 aa, Artificial Sequence
  Description of Artificial Sequence: Synthetic polypeptide
DEEEIRTTNPVATEQYGCVCSSELQEFFISNDY

SEQ ID NO: 96725 - protein, 31 aa, Artificial Sequence
  Description of Artificial Sequence: Synthetic polypeptide
DEEEIRTTNPVATEQYGCVCSSELENNSEQA

SEQ ID NO: 96726 - protein, 32 aa, Artificial Sequence
  Description of Artificial Sequence: Synthetic polypeptide
DEEEIRTTNPVATEQYGCVCSSEHQYFNSDQA

SEQ ID NO: 96727 - protein, 33 aa, Artificial Sequence
  Description of Artificial Sequence: Synthetic polypeptide
DEEEIRTTNPVATEQYGCVCSSENHQNFGSQQS

SEQ ID NO: 96728 - protein, 30 aa, Artificial Sequence
  Description of Artificial Sequence: Synthetic polypeptide
SSEEIRTTNPVATHQYGSVSWWNERMDNAF

SEQ ID NO: 96729 - protein, 34 aa, Artificial Sequence
  Description of Artificial Sequence: Synthetic polypeptide
TEEEIATTNPVATEQYGSTVSTGNGSQDPGTNGL

SEQ ID NO: 96730 - protein, 33 aa, Artificial Sequence
  Description of Artificial Sequence: Synthetic polypeptide
TEEEIATTNPVATEQYGQTVSAGNLSDEFGNNR

SEQ ID NO: 96731 - protein, 32 aa, Artificial Sequence
  Description of Artificial Sequence: Synthetic polypeptide
TEECIRTTNPVAYERYGSVPALNALSQQGPNR

SEQ ID NO: 96732 - protein, 33 aa, Artificial Sequence
  Description of Artificial Sequence: Synthetic polypeptide
DEEEIRTTNPVATEQYGCVCSTEEDQNFGSDII

SEQ ID NO: 96733 - protein, 30 aa, Artificial Sequence
  Description of Artificial Sequence: Synthetic polypeptide
TEECISTTNPVATEQYGCVSWNHQNFGSQQ

SEQ ID NO: 96734 - protein, 32 aa, Artificial Sequence
  Description of Artificial Sequence: Synthetic polypeptide
TEECLRTTNPIAYEAYGEVSTNLSQRGGNNRE

SEQ ID NO: 96735 - protein, 32 aa, Artificial Sequence
  Description of Artificial Sequence: Synthetic polypeptide
TEECSRTTNPIAYEQYGEVCSTNNLQRIGDNQ

SEQ ID NO: 96736 - protein, 32 aa, Artificial Sequence
  Description of Artificial Sequence: Synthetic polypeptide
TEECVRTTNPIAYEQYGETVSCTNLSQRGGTR

SEQ ID NO: 96737 - protein, 33 aa, Artificial Sequence
  Description of Artificial Sequence: Synthetic polypeptide
DEEEIRTTNPVATEQYGCVCSTEEDHQSFGSIQ

SEQ ID NO: 96738 - protein, 33 aa, Artificial Sequence
  Description of Artificial Sequence: Synthetic polypeptide
DEEEIRTTNPVATEQYGCVCSTEEDHQNGSQQS

SEQ ID NO: 96739 - protein, 33 aa, Artificial Sequence
  Description of Artificial Sequence: Synthetic polypeptide
DEEEIRTTNPVATEQYGCVCSTEEDHQFFGSDA

SEQ ID NO: 96740 - protein, 31 aa, Artificial Sequence
  Description of Artificial Sequence: Synthetic polypeptide
TEEEIACTNPIAYEAYGSVVSENLSMRGGNR

SEQ ID NO: 96741 - protein, 32 aa, Artificial Sequence
  Description of Artificial Sequence: Synthetic polypeptide
AEEEIRTTNPVATEEYGCSCSWNHQNFGSNAA

SEQ ID NO: 96742 - protein, 31 aa, Artificial Sequence
  Description of Artificial Sequence: Synthetic polypeptide
AEEEIRTTNPVATEEYGCSCSWNHQHGSEQS

SEQ ID NO: 96743 - protein, 30 aa, Artificial Sequence
  Description of Artificial Sequence: Synthetic polypeptide
TEEEIACTNPVATEQYGCVATNLQAADEDH

SEQ ID NO: 96744 - protein, 31 aa, Artificial Sequence
  Description of Artificial Sequence: Synthetic polypeptide
TEEEIACTNPVATEQYGCVATNLQAEAENDH

SEQ ID NO: 96745 - protein, 35 aa, Artificial Sequence
  Description of Artificial Sequence: Synthetic polypeptide
DEEEIRTTNPVATEQYGCVCSTEEDDQRFGSENQP

SEQ ID NO: 96746 - protein, 33 aa, Artificial Sequence
  Description of Artificial Sequence: Synthetic polypeptide
TEEEIACTNPVAYEQYGSVATNLEQTEGGNPRS

SEQ ID NO: 96747 - protein, 32 aa, Artificial Sequence
  Description of Artificial Sequence: Synthetic polypeptide
DEEEIRTTNPVATEQYGCVCSTEDTGFGSDQV

SEQ ID NO: 96748 - protein, 31 aa, Artificial Sequence
  Description of Artificial Sequence: Synthetic polypeptide
TEEEIACTNPVAYEQYGSVATNLQTEGGQPS

SEQ ID NO: 96749 - protein, 32 aa, Artificial Sequence
  Description of Artificial Sequence: Synthetic polypeptide
DEEEIRTTNPVATEQYGCVCSTEDQGFISDQA

SEQ ID NO: 96750 - protein, 32 aa, Artificial Sequence
  Description of Artificial Sequence: Synthetic polypeptide
DEEEIRTTNPVATEQYGCVCSTEDQFFISQQP

SEQ ID NO: 96751 - protein, 33 aa, Artificial Sequence
  Description of Artificial Sequence: Synthetic polypeptide
DEEEIRTTNPVATEQYGCVCSTEDQEYFGSDQA

SEQ ID NO: 96752 - protein, 35 aa, Artificial Sequence
  Description of Artificial Sequence: Synthetic polypeptide
DEEEIRTTNPVATEQYGCVCSTEEELQNFGSENQI

SEQ ID NO: 96753 - protein, 33 aa, Artificial Sequence
  Description of Artificial Sequence: Synthetic polypeptide
DEEEIRTTNPVATEQYGCVCSTEEEQNFGSDDN

SEQ ID NO: 96754 - protein, 31 aa, Artificial Sequence
  Description of Artificial Sequence: Synthetic polypeptide
AEEEIRTTNPVATEEYGCSSWNHQENFGSNQ

SEQ ID NO: 96755 - protein, 32 aa, Artificial Sequence
  Description of Artificial Sequence: Synthetic polypeptide
TEECIRTTNPVAYEQYGTVPSLNAHSQQGPNR

SEQ ID NO: 96756 - protein, 34 aa, Artificial Sequence
  Description of Artificial Sequence: Synthetic polypeptide
TEECIRTTNPVATEQYGSVVPSCLNALSQQVPNR

SEQ ID NO: 96757 - protein, 32 aa, Artificial Sequence
  Description of Artificial Sequence: Synthetic polypeptide
TEECIRTTNPVAYEAYGSVPSNGELEQSGGNR

SEQ ID NO: 96758 - protein, 32 aa, Artificial Sequence
  Description of Artificial Sequence: Synthetic polypeptide
TEECIRTTNPVAYECWGSVPSLNALSQQGPNR

SEQ ID NO: 96759 - protein, 32 aa, Artificial Sequence
  Description of Artificial Sequence: Synthetic polypeptide
TEECIRTTNPVAYEPYGQVSCTINAVQRGNNN

SEQ ID NO: 96760 - protein, 34 aa, Artificial Sequence
  Description of Artificial Sequence: Synthetic polypeptide
DEEEIRTTNPVATEQYGCVCSTEEHNQYFGSNQA

SEQ ID NO: 96761 - protein, 31 aa, Artificial Sequence
  Description of Artificial Sequence: Synthetic polypeptide
TEECIRTTNPVAYEQWGKVVSANETQRTVNR

SEQ ID NO: 96762 - protein, 34 aa, Artificial Sequence
  Description of Artificial Sequence: Synthetic polypeptide
DEEEIRTTNPVATEQYGCVCSTEEHNQSFGSNNQ

SEQ ID NO: 96763 - protein, 34 aa, Artificial Sequence
  Description of Artificial Sequence: Synthetic polypeptide
DEEEIRTTNPVATEQYGCVCSTEEHNQRSNSNQS

SEQ ID NO: 96764 - protein, 33 aa, Artificial Sequence
  Description of Artificial Sequence: Synthetic polypeptide
DEEEIRTTNPVATEQYGCVCSTEEHNQHNSNQT

SEQ ID NO: 96765 - protein, 32 aa, Artificial Sequence
  Description of Artificial Sequence: Synthetic polypeptide
TEECIRTTNPVAYEQYGKVSANELQRTVSTRQ

SEQ ID NO: 96766 - protein, 34 aa, Artificial Sequence
  Description of Artificial Sequence: Synthetic polypeptide
DEEEIRTTNPVATEQYGCVCSTEDQESFGSDNQS

SEQ ID NO: 96767 - protein, 32 aa, Artificial Sequence
  Description of Artificial Sequence: Synthetic polypeptide
TEECIRTTNPVAYEQYGKVSVANEHQQRTVNR

SEQ ID NO: 96768 - protein, 31 aa, Artificial Sequence
  Description of Artificial Sequence: Synthetic polypeptide
TEECIRTTNPVAYEQYGKVVSANELQKTVDR

SEQ ID NO: 96769 - protein, 31 aa, Artificial Sequence
  Description of Artificial Sequence: Synthetic polypeptide
TEECIRTTNPVAYEQYGKVVSLNELQATVER

SEQ ID NO: 96770 - protein, 33 aa, Artificial Sequence
  Description of Artificial Sequence: Synthetic polypeptide
TEECIRTTNPVAYEQYGQSVPSLNALSTQGPNR

SEQ ID NO: 96771 - protein, 33 aa, Artificial Sequence
  Description of Artificial Sequence: Synthetic polypeptide
TEECIRTTNPVAYEQYGQVSCTINVSQRGNNNA

SEQ ID NO: 96772 - protein, 33 aa, Artificial Sequence
  Description of Artificial Sequence: Synthetic polypeptide
TEECIRTTNPVAYEQYGSTVKSLNALSTNGGNR

SEQ ID NO: 96773 - protein, 33 aa, Artificial Sequence
  Description of Artificial Sequence: Synthetic polypeptide
TEECIRTTNPVAYEQYGSTVPSLNALSQQEPNR

SEQ ID NO: 96774 - protein, 34 aa, Artificial Sequence
  Description of Artificial Sequence: Synthetic polypeptide
TEECIRTTNPVAYEQYGSTVWSQLNALSQQGGNR

SEQ ID NO: 96775 - protein, 33 aa, Artificial Sequence
  Description of Artificial Sequence: Synthetic polypeptide
TEECIRTTNPVAYEQYGSVPSLNALSQQAVPNR

SEQ ID NO: 96776 - protein, 34 aa, Artificial Sequence
  Description of Artificial Sequence: Synthetic polypeptide
TEECIRTTNPVAYEQYGSVQSLNALSQQGPNNRT

SEQ ID NO: 96777 - protein, 33 aa, Artificial Sequence
  Description of Artificial Sequence: Synthetic polypeptide
DEEEIRTTNPVATEQYGCVCSTEEHARFGSQQS

SEQ ID NO: 96778 - protein, 32 aa, Artificial Sequence
  Description of Artificial Sequence: Synthetic polypeptide
TEECIRTTNPVAYEQYGKVVAANELQRTVNRS

SEQ ID NO: 96779 - protein, 33 aa, Artificial Sequence
  Description of Artificial Sequence: Synthetic polypeptide
DEEEIRTTNPVATEQYGCVCSTAHQHFNSDTQL

SEQ ID NO: 96780 - protein, 33 aa, Artificial Sequence
  Description of Artificial Sequence: Synthetic polypeptide
DEEEIRTTNPVATEQYGCVCSTEDQEHFNSDQE

SEQ ID NO: 96781 - protein, 33 aa, Artificial Sequence
  Description of Artificial Sequence: Synthetic polypeptide
DEEEIRTTNPVATEQYGCVCSTEDQEFFGSDQA

SEQ ID NO: 96782 - protein, 33 aa, Artificial Sequence
  Description of Artificial Sequence: Synthetic polypeptide
DEEEIRTTNPVATEQYGCVCSTEDHQEFFNSNQ

SEQ ID NO: 96783 - protein, 30 aa, Artificial Sequence
  Description of Artificial Sequence: Synthetic polypeptide
TEEEIASVNPVCTEQYGVVVSINALQSGNQ

SEQ ID NO: 96784 - protein, 34 aa, Artificial Sequence
  Description of Artificial Sequence: Synthetic polypeptide
DEEEIRTTNPVATEQYGCVCSTEDHNQGFGSNQV

SEQ ID NO: 96785 - protein, 30 aa, Artificial Sequence
  Description of Artificial Sequence: Synthetic polypeptide
TEEEIASVNPVSTEQYGVTVSDNLAQSGNQ

SEQ ID NO: 96786 - protein, 33 aa, Artificial Sequence
  Description of Artificial Sequence: Synthetic polypeptide
DEEEIRTTNPVATEQYGCVCSTEDHIFSGSNQP

SEQ ID NO: 96787 - protein, 30 aa, Artificial Sequence
  Description of Artificial Sequence: Synthetic polypeptide
TEEEIASVNPVSTEQYGVVSCDNLSQSGNQ

SEQ ID NO: 96788 - protein, 33 aa, Artificial Sequence
  Description of Artificial Sequence: Synthetic polypeptide
DEEEIRTTNPVATEQYGCVCSTEDHARFGSEQS

SEQ ID NO: 96789 - protein, 30 aa, Artificial Sequence
  Description of Artificial Sequence: Synthetic polypeptide
TEEEIASVNPVSTEQYGVVSINALSQSGNQ

SEQ ID NO: 96790 - protein, 33 aa, Artificial Sequence
  Description of Artificial Sequence: Synthetic polypeptide
DEEEIRTTNPVATEQYGCVCSTEDEQFFNSNQI

SEQ ID NO: 96791 - protein, 33 aa, Artificial Sequence
  Description of Artificial Sequence: Synthetic polypeptide
DEEEIRTTNPVATEQYGCVCSTEDDQYFGSEQG

SEQ ID NO: 96792 - protein, 34 aa, Artificial Sequence
  Description of Artificial Sequence: Synthetic polypeptide
DEEEIRTTNPVATEQYGCVCSTEDDQNFGSNTQS

SEQ ID NO: 96793 - protein, 32 aa, Artificial Sequence
  Description of Artificial Sequence: Synthetic polypeptide
DEEEIRTTNPVATEQYGCVCSTEDAFFGSEQP

SEQ ID NO: 96794 - protein, 34 aa, Artificial Sequence
  Description of Artificial Sequence: Synthetic polypeptide
DEEEIRTTNPVATEQYGCVCSTEAHQERFGSDQV

SEQ ID NO: 96795 - protein, 34 aa, Artificial Sequence
  Description of Artificial Sequence: Synthetic polypeptide
DEEEIRTTNPVATEQYGCVCSTEAHNQGFGSNQS

SEQ ID NO: 96796 - protein, 33 aa, Artificial Sequence
  Description of Artificial Sequence: Synthetic polypeptide
DEEEIRTTNPVATEQYGCVCSTEADQNFGSQQS

SEQ ID NO: 96797 - protein, 33 aa, Artificial Sequence
  Description of Artificial Sequence: Synthetic polypeptide
DEEEIRTTNPVATEQYGCVCSTEADQFFGSDQA

SEQ ID NO: 96798 - protein, 32 aa, Artificial Sequence
  Description of Artificial Sequence: Synthetic polypeptide
DEEEIRTTNPVATEQYGCVCSTDTENFGSEDG

SEQ ID NO: 96799 - protein, 33 aa, Artificial Sequence
  Description of Artificial Sequence: Synthetic polypeptide
DEEEIRTTNPVATEQYGCVCSTDHQEYFGSEQS

SEQ ID NO: 96800 - protein, 33 aa, Artificial Sequence
  Description of Artificial Sequence: Synthetic polypeptide
AEEEIRTTNPVATEEYGCISCINSSQRGGNNRY

SEQ ID NO: 96801 - protein, 33 aa, Artificial Sequence
  Description of Artificial Sequence: Synthetic polypeptide
TEEEIATTNPVATEQYGNTVSVTHALSQGGNEG

SEQ ID NO: 96802 - protein, 34 aa, Artificial Sequence
  Description of Artificial Sequence: Synthetic polypeptide
TEEEIATTNPVATEQYGNVVSVTMALSQGGTNNR

SEQ ID NO: 96803 - protein, 30 aa, Artificial Sequence
  Description of Artificial Sequence: Synthetic polypeptide
TEEEIASVNPVCTEQYGVVSINLSQSGNTQ

SEQ ID NO: 96804 - protein, 33 aa, Artificial Sequence
  Description of Artificial Sequence: Synthetic polypeptide
DEEEIRTTNPVATEQYGCVCSTEDHQENGSDQA

SEQ ID NO: 96805 - protein, 29 aa, Artificial Sequence
  Description of Artificial Sequence: Synthetic peptide
TEEEIASVNPVCTEQYGVVSINEHQSGNQ

SEQ ID NO: 96806 - protein, 33 aa, Artificial Sequence
  Description of Artificial Sequence: Synthetic polypeptide
DEEEIRTTNPVATEQYGCVCSTEDHQHSNSDQQ

SEQ ID NO: 96807 - protein, 33 aa, Artificial Sequence
  Description of Artificial Sequence: Synthetic polypeptide
DEEEIRTTNPVATEQYGCVCSTEDPQYFGSEQF

SEQ ID NO: 96808 - protein, 33 aa, Artificial Sequence
  Description of Artificial Sequence: Synthetic polypeptide
DEEEIRTTNPVATEQYGCVCSTEDPQSFGSETQ

SEQ ID NO: 96809 - protein, 30 aa, Artificial Sequence
  Description of Artificial Sequence: Synthetic polypeptide
TEEEIASVNPVCTEQYGCVTVSDNLQSGNQ

SEQ ID NO: 96810 - protein, 33 aa, Artificial Sequence
  Description of Artificial Sequence: Synthetic polypeptide
DEEEIRTTNPVATEQYGCVCSTEDNQSFGSEQG

SEQ ID NO: 96811 - protein, 30 aa, Artificial Sequence
  Description of Artificial Sequence: Synthetic polypeptide
TEEEIASVNPVCTEQYGIVVSDNLAQSGNQ

SEQ ID NO: 96812 - protein, 33 aa, Artificial Sequence
  Description of Artificial Sequence: Synthetic polypeptide
DEEEIRTTNPVATEQYGCVCSTEDNQNFGSDQA

SEQ ID NO: 96813 - protein, 34 aa, Artificial Sequence
  Description of Artificial Sequence: Synthetic polypeptide
DEEEIRTTNPVATEQYGCVCSTEDLQYFNSDNQD

SEQ ID NO: 96814 - protein, 30 aa, Artificial Sequence
  Description of Artificial Sequence: Synthetic polypeptide
TEEEIASVNPVCTEQYGVVPSDNLQSGGNS

SEQ ID NO: 96815 - protein, 29 aa, Artificial Sequence
  Description of Artificial Sequence: Synthetic peptide
TEEEIASVNPVCTEQYGVVSCDNLQSGMQ

SEQ ID NO: 96816 - protein, 29 aa, Artificial Sequence
  Description of Artificial Sequence: Synthetic peptide
TEEEIASVNPVCTEQYGVVSDHLQSTGNQ

SEQ ID NO: 96817 - protein, 33 aa, Artificial Sequence
  Description of Artificial Sequence: Synthetic polypeptide
DEEEIRTTNPVATEQYGCVCSTEDQEFFNSNQP

SEQ ID NO: 96818 - protein, 34 aa, Artificial Sequence
  Description of Artificial Sequence: Synthetic polypeptide
DEEEIRTTNPVATEQYGCVCSTEDLQHFGSETQS

SEQ ID NO: 96819 - protein, 34 aa, Artificial Sequence
  Description of Artificial Sequence: Synthetic polypeptide
DEEEIRTTNPVATEQYGCVCSTEDLENFGSDNQS

SEQ ID NO: 96820 - protein, 34 aa, Artificial Sequence
  Description of Artificial Sequence: Synthetic polypeptide
DEEEIRTTNPVATEQYGCVCSTEDLDQNFGSDQS

SEQ ID NO: 96821 - protein, 34 aa, Artificial Sequence
  Description of Artificial Sequence: Synthetic polypeptide
DEEEIRTTNPVATEQYGCVCSTEDLDQGFNSEQG

SEQ ID NO: 96822 - protein, 30 aa, Artificial Sequence
  Description of Artificial Sequence: Synthetic polypeptide
TEEEIASVNPVCTEQYGVVSDNLQSGNNQH

SEQ ID NO: 96823 - protein, 33 aa, Artificial Sequence
  Description of Artificial Sequence: Synthetic polypeptide
DEEEIRTTNPVATEQYGCVCSTEDLAHFNSNQL

SEQ ID NO: 96824 - protein, 30 aa, Artificial Sequence
  Description of Artificial Sequence: Synthetic polypeptide
TEEEIASVNPVCTEQYGVVSDNLQSNGTNQ

SEQ ID NO: 96825 - protein, 34 aa, Artificial Sequence
  Description of Artificial Sequence: Synthetic polypeptide
DEEEIRTTNPVATEQYGCVCSTEDHQYFGSDNQS

SEQ ID NO: 96826 - protein, 30 aa, Artificial Sequence
  Description of Artificial Sequence: Synthetic polypeptide
TEEEIASVNPVCTEQYGVVSDNLSQSGENQ

SEQ ID NO: 96827 - protein, 30 aa, Artificial Sequence
  Description of Artificial Sequence: Synthetic polypeptide
TEEEIASVNPVCTEQYGVVSDNMLQSGLNQ

SEQ ID NO: 96828 - protein, 33 aa, Artificial Sequence
  Description of Artificial Sequence: Synthetic polypeptide
DEEEIRTTNPVATEQYGCVCSTEDHQNFGSDQE

SEQ ID NO: 96829 - protein, 34 aa, Artificial Sequence
  Description of Artificial Sequence: Synthetic polypeptide
DEEEIRTTNPVATEQYGCVCSTEDLNQNFNSQQS

SEQ ID NO: 96830 - protein, 35 aa, Artificial Sequence
  Description of Artificial Sequence: Synthetic polypeptide
AEEEIRTTNPVATEQYGSVVTNANLQNQEQGNNAE

SEQ ID NO: 96831 - protein, 33 aa, Artificial Sequence
  Description of Artificial Sequence: Synthetic polypeptide
AEEEIRTTNPVATEQYGCVCSTGEHQNFGSNNQ

SEQ ID NO: 96832 - protein, 35 aa, Artificial Sequence
  Description of Artificial Sequence: Synthetic polypeptide
AEEEIRTTNPVATEQYGCVCSTGNLNQNFGSNTQM

SEQ ID NO: 96833 - protein, 34 aa, Artificial Sequence
  Description of Artificial Sequence: Synthetic polypeptide
AEEEIRTTNPVATEQYGSVSTEGNNNNQNDENGI

SEQ ID NO: 96834 - protein, 35 aa, Artificial Sequence
  Description of Artificial Sequence: Synthetic polypeptide
DEEEIRTTNPMATEQYGSVPACTNALSQRDGGPYA

SEQ ID NO: 96835 - protein, 33 aa, Artificial Sequence
  Description of Artificial Sequence: Synthetic polypeptide
DEEEIRTTNPVATEQYGCVCSTPTQENFGSQQT

SEQ ID NO: 96836 - protein, 33 aa, Artificial Sequence
  Description of Artificial Sequence: Synthetic polypeptide
DEEEIRTTNPVATEQYGCVCSTPPHQGFNSDQS

SEQ ID NO: 96837 - protein, 34 aa, Artificial Sequence
  Description of Artificial Sequence: Synthetic polypeptide
AEEEIRTTNPVATEQYGSVSTDQLQQINTNNATT

SEQ ID NO: 96838 - protein, 34 aa, Artificial Sequence
  Description of Artificial Sequence: Synthetic polypeptide
DEEEIRTTNPMATEQYGSVVPACTNAIQSGGNYA

SEQ ID NO: 96839 - protein, 32 aa, Artificial Sequence
  Description of Artificial Sequence: Synthetic polypeptide
DEEEIRTTNPMAYEGYGSCPSCTNLSATGGNE

SEQ ID NO: 96840 - protein, 35 aa, Artificial Sequence
  Description of Artificial Sequence: Synthetic polypeptide
DEEEIRTTNPMAYEQYGSVIANTDNLPQVRGENIQ

SEQ ID NO: 96841 - protein, 31 aa, Artificial Sequence
  Description of Artificial Sequence: Synthetic polypeptide
DEEEIRTTNPNAAECYGSVATNDHNGRGDAE

SEQ ID NO: 96842 - protein, 31 aa, Artificial Sequence
  Description of Artificial Sequence: Synthetic polypeptide
SEQEIRTTNPIATEQYGSVSAEDLMDHGNDL

SEQ ID NO: 96843 - protein, 33 aa, Artificial Sequence
  Description of Artificial Sequence: Synthetic polypeptide
DEEEIRTTNPVATEQYGCVCSTPEPEGFNSNQS

SEQ ID NO: 96844 - protein, 34 aa, Artificial Sequence
  Description of Artificial Sequence: Synthetic polypeptide
DEEEIRTTNPVATEQYGCVCSTPEHQFFGSDNQS

SEQ ID NO: 96845 - protein, 33 aa, Artificial Sequence
  Description of Artificial Sequence: Synthetic polypeptide
DEEEIRTTNPVATEQYGCVCSTPEHAFFGSNQP

SEQ ID NO: 96846 - protein, 33 aa, Artificial Sequence
  Description of Artificial Sequence: Synthetic polypeptide
DEEEIRTTNPVATEQYGCVCSTPEDQENFNSEQ

SEQ ID NO: 96847 - protein, 34 aa, Artificial Sequence
  Description of Artificial Sequence: Synthetic polypeptide
DEEEIRTTNPVATEQYGCVCSTPDHQENFGSNTQ

SEQ ID NO: 96848 - protein, 32 aa, Artificial Sequence
  Description of Artificial Sequence: Synthetic polypeptide
DEEEIRTTNPVATEQYGCVCSTPAHEGFGSEQ

SEQ ID NO: 96849 - protein, 31 aa, Artificial Sequence
  Description of Artificial Sequence: Synthetic polypeptide
SEQEIRTTNPVATEEYGCCWSIVLQRGDNQE

SEQ ID NO: 96850 - protein, 28 aa, Artificial Sequence
  Description of Artificial Sequence: Synthetic peptide
SEREIACTNPCSYEQYGIVSCNLQSGDR

SEQ ID NO: 96851 - protein, 32 aa, Artificial Sequence
  Description of Artificial Sequence: Synthetic polypeptide
DEEEIRTTNPTATEQYGEVSEMNEQCQGDDTF

SEQ ID NO: 96852 - protein, 34 aa, Artificial Sequence
  Description of Artificial Sequence: Synthetic polypeptide
DEEEIRTTNPTATEQYGSVCSYTNIDDGRGQGDS

SEQ ID NO: 96853 - protein, 28 aa, Artificial Sequence
  Description of Artificial Sequence: Synthetic peptide
SESEIACTNPIATEQYGVMSSNLMHGNI

SEQ ID NO: 96854 - protein, 31 aa, Artificial Sequence
  Description of Artificial Sequence: Synthetic polypeptide
SEQEIATTNPVATEQYGSVSTDLEDHEGEDL

SEQ ID NO: 96855 - protein, 28 aa, Artificial Sequence
  Description of Artificial Sequence: Synthetic peptide
SESEIACTNPIGTEGYGSVASTLQRGDI

SEQ ID NO: 96856 - protein, 31 aa, Artificial Sequence
  Description of Artificial Sequence: Synthetic polypeptide
SEQEIATTNPVATEQYGSVSEDLEDHEGNDL

SEQ ID NO: 96857 - protein, 31 aa, Artificial Sequence
  Description of Artificial Sequence: Synthetic polypeptide
SEQEIATTNPVATEQYGSVSATDLEDHGEDL

SEQ ID NO: 96858 - protein, 30 aa, Artificial Sequence
  Description of Artificial Sequence: Synthetic polypeptide
SENEIRTTNPVATEQYGTISEEDIQQNGNH

SEQ ID NO: 96859 - protein, 33 aa, Artificial Sequence
  Description of Artificial Sequence: Synthetic polypeptide
DEEEIRTTNPVATEQYGCVCSTTEHQNFGSQQS

SEQ ID NO: 96860 - protein, 34 aa, Artificial Sequence
  Description of Artificial Sequence: Synthetic polypeptide
DEEEIRTTNPVATEQYGCVCSTTEHQHFGSENQA

SEQ ID NO: 96861 - protein, 34 aa, Artificial Sequence
  Description of Artificial Sequence: Synthetic polypeptide
DEEEIRTTNPMATEQYGCVVACTNALSQRVGDYA

SEQ ID NO: 96862 - protein, 29 aa, Artificial Sequence
  Description of Artificial Sequence: Synthetic peptide
SENEIRTTNPVSTEPYGTVSEDIMQNGNH

SEQ ID NO: 96863 - protein, 36 aa, Artificial Sequence
  Description of Artificial Sequence: Synthetic polypeptide
AEEEIRTTNPVATEQYGSVSTENNLQQGNTNGNQEG

SEQ ID NO: 96864 - protein, 36 aa, Artificial Sequence
  Description of Artificial Sequence: Synthetic polypeptide
AEEEIRTTNPVATEQYGSVSTENNLQQGNNNGNNED

SEQ ID NO: 96865 - protein, 35 aa, Artificial Sequence
  Description of Artificial Sequence: Synthetic polypeptide
DEEEIRTTNPVATEQYGCVCSTTEELNQNFGSNQS

SEQ ID NO: 96866 - protein, 33 aa, Artificial Sequence
  Description of Artificial Sequence: Synthetic polypeptide
DEEEIRTTNPVATEQYGCVCSTTEEHQSGSDQS

SEQ ID NO: 96867 - protein, 34 aa, Artificial Sequence
  Description of Artificial Sequence: Synthetic polypeptide
DEEEIRTTNPVATEQYGCVCSTTEEHQRFGSDQV

SEQ ID NO: 96868 - protein, 34 aa, Artificial Sequence
  Description of Artificial Sequence: Synthetic polypeptide
DEEEIRTTNPVATEQYGCVCSTTEEHQNMGSNQS

SEQ ID NO: 96869 - protein, 35 aa, Artificial Sequence
  Description of Artificial Sequence: Synthetic polypeptide
AEEEIRTTNPVATEQYGSVSTENNLEQGENGTEEE

SEQ ID NO: 96870 - protein, 33 aa, Artificial Sequence
  Description of Artificial Sequence: Synthetic polypeptide
DEEEIRTTNPVATEQYGCVCSTTEDQFFNSDQS

SEQ ID NO: 96871 - protein, 36 aa, Artificial Sequence
  Description of Artificial Sequence: Synthetic polypeptide
AEEEIRTTNPVATEQYGSVSTENLGQQIGTTNAEES

SEQ ID NO: 96872 - protein, 30 aa, Artificial Sequence
  Description of Artificial Sequence: Synthetic polypeptide
SEQEIACTNPVATEQYGCASANLQGGGQRP

SEQ ID NO: 96873 - protein, 34 aa, Artificial Sequence
  Description of Artificial Sequence: Synthetic polypeptide
DEEEIRTTNPVATEQYGCVCSTSNHQEFFGSEQD

SEQ ID NO: 96874 - protein, 34 aa, Artificial Sequence
  Description of Artificial Sequence: Synthetic polypeptide
DEEEIRTTNPVATEQYGCVCSTSGELQFFGSDQA

SEQ ID NO: 96875 - protein, 30 aa, Artificial Sequence
  Description of Artificial Sequence: Synthetic polypeptide
SEQEIACTNPVATEQYGSVSAENLEHEGEL

SEQ ID NO: 96876 - protein, 35 aa, Artificial Sequence
  Description of Artificial Sequence: Synthetic polypeptide
AEEEIRTTNPVATEQYGSVSTEGNNNNQQGNNNGV

SEQ ID NO: 96877 - protein, 31 aa, Artificial Sequence
  Description of Artificial Sequence: Synthetic polypeptide
SEQEIATTNPVATEQYGSVSAENLEDHEGEL

SEQ ID NO: 96878 - protein, 31 aa, Artificial Sequence
  Description of Artificial Sequence: Synthetic polypeptide
SEQEIATTNPVATEQYGSVSATDLEDHEGEL

SEQ ID NO: 96879 - protein, 32 aa, Artificial Sequence
  Description of Artificial Sequence: Synthetic polypeptide
SEQEIATTNPVATEQYGSVSATDLEDREGEDL

SEQ ID NO: 96880 - protein, 28 aa, Artificial Sequence
  Description of Artificial Sequence: Synthetic peptide
SESEIACTNPIGTEQYGSVASNLQHGDI

SEQ ID NO: 96881 - protein, 32 aa, Artificial Sequence
  Description of Artificial Sequence: Synthetic polypeptide
DEEEIRTTNPTATQQYGEVCTIDQGQRGMNKS

SEQ ID NO: 96882 - protein, 28 aa, Artificial Sequence
  Description of Artificial Sequence: Synthetic peptide
SESEIACTNPIGTEQYGSVASTLQHGDI

SEQ ID NO: 96883 - protein, 33 aa, Artificial Sequence
  Description of Artificial Sequence: Synthetic polypeptide
AEEEIRTTNPVATEQYGSVSSVNQQQTQGTIGT

SEQ ID NO: 96884 - protein, 33 aa, Artificial Sequence
  Description of Artificial Sequence: Synthetic polypeptide
SESEIRCTNPVATEQYGSVVFTGNALSQHGGNQ

SEQ ID NO: 96885 - protein, 36 aa, Artificial Sequence
  Description of Artificial Sequence: Synthetic polypeptide
DEEEIRTTNPVAFEQYGSVVTNGENELGQRGQGDNQ

SEQ ID NO: 96886 - protein, 34 aa, Artificial Sequence
  Description of Artificial Sequence: Synthetic polypeptide
DEEEIRTTNPVAFEQYGVVVNGGNDLDQRGDRDD

SEQ ID NO: 96887 - protein, 34 aa, Artificial Sequence
  Description of Artificial Sequence: Synthetic polypeptide
DEEEIRTTNPVAFEQYGVVVSTGGDLGQRGEGEI

SEQ ID NO: 96888 - protein, 33 aa, Artificial Sequence
  Description of Artificial Sequence: Synthetic polypeptide
AEEEIRTTNPVATEQYGSVSSVNQQGQTNGTIG

SEQ ID NO: 96889 - protein, 34 aa, Artificial Sequence
  Description of Artificial Sequence: Synthetic polypeptide
DEEEIRTTNPVAHEQYGSVITTNLQPVFDVSTRD

SEQ ID NO: 96890 - protein, 33 aa, Artificial Sequence
  Description of Artificial Sequence: Synthetic polypeptide
DEEEIRTTNPVAHEQYGSVNTMGLQIGGDQDDG

SEQ ID NO: 96891 - protein, 34 aa, Artificial Sequence
  Description of Artificial Sequence: Synthetic polypeptide
DEEEIRTTNPVATEQYGCVCSTNHQEYFNSNNQS

SEQ ID NO: 96892 - protein, 32 aa, Artificial Sequence
  Description of Artificial Sequence: Synthetic polypeptide
DEEEIRTTNPVAHEQYGSVWLNLEPVFDVSTR

SEQ ID NO: 96893 - protein, 34 aa, Artificial Sequence
  Description of Artificial Sequence: Synthetic polypeptide
DEEEIRTTNPVAHEQYGSVWMTNLQPVFDVSERQ

SEQ ID NO: 96894 - protein, 33 aa, Artificial Sequence
  Description of Artificial Sequence: Synthetic polypeptide
DEEEIRTTNPVATEQYGCVCSTNHQENFFSQQT

SEQ ID NO: 96895 - protein, 36 aa, Artificial Sequence
  Description of Artificial Sequence: Synthetic polypeptide
AEEEIRTTNPVATEQYGSVSSTTPNGPQMRNGMNPV

SEQ ID NO: 96896 - protein, 34 aa, Artificial Sequence
  Description of Artificial Sequence: Synthetic polypeptide
DEEEIRTTNPVATEQYGCVCSTNHQEHFGSETQF

SEQ ID NO: 96897 - protein, 31 aa, Artificial Sequence
  Description of Artificial Sequence: Synthetic polypeptide
SESEIRSTNPVAYEAYGSVFTNELQPTGGNQ

SEQ ID NO: 96898 - protein, 33 aa, Artificial Sequence
  Description of Artificial Sequence: Synthetic polypeptide
DEEEIRTTNPVAHEQYGSVWVTNLQPVFDVSEQ

SEQ ID NO: 96899 - protein, 32 aa, Artificial Sequence
  Description of Artificial Sequence: Synthetic polypeptide
SESEIRSTNPVAYEQYGSVFCTNALQHPGGNQ

SEQ ID NO: 96900 - protein, 33 aa, Artificial Sequence
  Description of Artificial Sequence: Synthetic polypeptide
DEEEIRTTNPVATEQYGCVCSTNHNQNFISDQP

SEQ ID NO: 96901 - protein, 35 aa, Artificial Sequence
  Description of Artificial Sequence: Synthetic polypeptide
AEEEIRTTNPVATEQYGSVSSTTPNGPNMRNGMNV

SEQ ID NO: 96902 - protein, 34 aa, Artificial Sequence
  Description of Artificial Sequence: Synthetic polypeptide
DEEEIRTTNPVATEQYGCVCSTNHNQNFGSETQS

SEQ ID NO: 96903 - protein, 34 aa, Artificial Sequence
  Description of Artificial Sequence: Synthetic polypeptide
DEEEIRTTNPVATEQYGCVCSTNHNQESFGSEQS

SEQ ID NO: 96904 - protein, 33 aa, Artificial Sequence
  Description of Artificial Sequence: Synthetic polypeptide
AEEEIRTTNPVATEQYGSVSSVNQQQTQQGTIN

SEQ ID NO: 96905 - protein, 31 aa, Artificial Sequence
  Description of Artificial Sequence: Synthetic polypeptide
SESEIRCTNPVATEQYGSVEMPLQEYGNQQD

SEQ ID NO: 96906 - protein, 33 aa, Artificial Sequence
  Description of Artificial Sequence: Synthetic polypeptide
DEEEIRTTNPVATEQYGCVCSTNHTNFGSETQL

SEQ ID NO: 96907 - protein, 32 aa, Artificial Sequence
  Description of Artificial Sequence: Synthetic polypeptide
SESEIRCTNPVATEQYGSVEMNLQEHGGNQQS

SEQ ID NO: 96908 - protein, 28 aa, Artificial Sequence
  Description of Artificial Sequence: Synthetic peptide
SESEIACTNPVGTEGYGSMASTLQRGDI

SEQ ID NO: 96909 - protein, 28 aa, Artificial Sequence
  Description of Artificial Sequence: Synthetic peptide
SESEIACTNPVGTEQYGSMASTLQHGDI

SEQ ID NO: 96910 - protein, 28 aa, Artificial Sequence
  Description of Artificial Sequence: Synthetic peptide
SESEIASTNPVATEGYGVMASTLQHGNI

SEQ ID NO: 96911 - protein, 28 aa, Artificial Sequence
  Description of Artificial Sequence: Synthetic peptide
SESEIASTNPVGTEGYGVMASTLQRGNI

SEQ ID NO: 96912 - protein, 28 aa, Artificial Sequence
  Description of Artificial Sequence: Synthetic peptide
SESEIASTNPVGTEQYGVMSSTLQHGDR

SEQ ID NO: 96913 - protein, 35 aa, Artificial Sequence
  Description of Artificial Sequence: Synthetic polypeptide
DEEEIRTTNPVAFEQYGAVVEGQTNDLLQRGIRGA

SEQ ID NO: 96914 - protein, 33 aa, Artificial Sequence
  Description of Artificial Sequence: Synthetic polypeptide
SESEIRCTNPCATEQYGASVCSPENLHRGNQRD

SEQ ID NO: 96915 - protein, 34 aa, Artificial Sequence
  Description of Artificial Sequence: Synthetic polypeptide
DEEEIRTTNPVAFEQYGQVVITGDLDQQRGIRGD

SEQ ID NO: 96916 - protein, 34 aa, Artificial Sequence
  Description of Artificial Sequence: Synthetic polypeptide
AEEEIRTTNPVATEQYGSVSSVTNSNGTESGNNI

SEQ ID NO: 96917 - protein, 35 aa, Artificial Sequence
  Description of Artificial Sequence: Synthetic polypeptide
AEEEIRTTNPVATEQYGSVSSVTNNQNNQIGTNTE

SEQ ID NO: 96918 - protein, 35 aa, Artificial Sequence
  Description of Artificial Sequence: Synthetic polypeptide
DEEEIRTTNPVATEQYGCVCSTTELQEGFGSDNQD

SEQ ID NO: 96919 - protein, 34 aa, Artificial Sequence
  Description of Artificial Sequence: Synthetic polypeptide
DEEEIRTTNPVAFEQYGQVVNGQNDGLQRGDRDD

SEQ ID NO: 96920 - protein, 35 aa, Artificial Sequence
  Description of Artificial Sequence: Synthetic polypeptide
AEEEIRTTNPVATEQYGSVSSVTNNNNQQIGNNTQ

SEQ ID NO: 96921 - protein, 35 aa, Artificial Sequence
  Description of Artificial Sequence: Synthetic polypeptide
AEEEIRTTNPVATEQYGSVSSVTNNNNQLIGNNTE

SEQ ID NO: 96922 - protein, 35 aa, Artificial Sequence
  Description of Artificial Sequence: Synthetic polypeptide
AEEEIRTTNPVATEQYGSVSSVTNNNNQIGNNTTD

SEQ ID NO: 96923 - protein, 35 aa, Artificial Sequence
  Description of Artificial Sequence: Synthetic polypeptide
AEEEIRTTNPVATEQYGSVSSVTNNNNQEIGNTED

SEQ ID NO: 96924 - protein, 28 aa, Artificial Sequence
  Description of Artificial Sequence: Synthetic peptide
SESEIRCTNPIGTEGYGVVAETLMRGNR

SEQ ID NO: 96925 - protein, 35 aa, Artificial Sequence
  Description of Artificial Sequence: Synthetic polypeptide
AEEEIRTTNPVATEQYGSVSSVTNNNNNQQIGNTE

SEQ ID NO: 96926 - protein, 35 aa, Artificial Sequence
  Description of Artificial Sequence: Synthetic polypeptide
AEEEIRTTNPVATEQYGSVSSVTNNNNNQQGNTED

SEQ ID NO: 96927 - protein, 32 aa, Artificial Sequence
  Description of Artificial Sequence: Synthetic polypeptide
SESEIRCTNPVATEQWGSVSEINEMDREGENR

SEQ ID NO: 96928 - protein, 31 aa, Artificial Sequence
  Description of Artificial Sequence: Synthetic polypeptide
SESEIRCTNPVATEQYGSVEMNHQEHGNQQD

SEQ ID NO: 96929 - protein, 35 aa, Artificial Sequence
  Description of Artificial Sequence: Synthetic polypeptide
DEEEIRTTNPVAFEQYGSVVNGQLNDLLQRGDRDD

SEQ ID NO: 96930 - protein, 33 aa, Artificial Sequence
  Description of Artificial Sequence: Synthetic polypeptide
DEEEIRTTNPVAFEQYGQVVNQNDLDQRNDRDA

SEQ ID NO: 96931 - protein, 35 aa, Artificial Sequence
  Description of Artificial Sequence: Synthetic polypeptide
AEEEIRTTNPVATEQYGSVSTENQGQIGTTNATEQ

SEQ ID NO: 96932 - protein, 33 aa, Artificial Sequence
  Description of Artificial Sequence: Synthetic polypeptide
DEEEIRTTNPMATDQYGQVPCTDELSQRGGNNP

SEQ ID NO: 96933 - protein, 30 aa, Artificial Sequence
  Description of Artificial Sequence: Synthetic polypeptide
SENEIRTTNPVATEQYGTISEDIQQQNGNH

SEQ ID NO: 96934 - protein, 35 aa, Artificial Sequence
  Description of Artificial Sequence: Synthetic polypeptide
AEEEIRTTNPVATEQYGSVSTNGNNENQEEGTNTE

SEQ ID NO: 96935 - protein, 30 aa, Artificial Sequence
  Description of Artificial Sequence: Synthetic polypeptide
SEMEIRCTNPVATEQYGTVSENPVEFEGND

SEQ ID NO: 96936 - protein, 33 aa, Artificial Sequence
  Description of Artificial Sequence: Synthetic polypeptide
DEEEIRTTNPVATEQYGCVCSWAHQFFGSNNQS

SEQ ID NO: 96937 - protein, 32 aa, Artificial Sequence
  Description of Artificial Sequence: Synthetic polypeptide
DEEEIRTTNPVATEQYGCVCSVSMEHQHVSDI

SEQ ID NO: 96938 - protein, 35 aa, Artificial Sequence
  Description of Artificial Sequence: Synthetic polypeptide
DEEEIRTTNPVATEQYGCVCSVSGNLNQHSVSNQA

SEQ ID NO: 96939 - protein, 35 aa, Artificial Sequence
  Description of Artificial Sequence: Synthetic polypeptide
DEEEIRTTNPVATEQYGCVCSVSGELNQRFNSNQA

SEQ ID NO: 96940 - protein, 33 aa, Artificial Sequence
  Description of Artificial Sequence: Synthetic polypeptide
SEMEIRTTNPVATEQYGSVSSTVQLGETQEDNE

SEQ ID NO: 96941 - protein, 36 aa, Artificial Sequence
  Description of Artificial Sequence: Synthetic polypeptide
AEEEIRTTNPVATEQYGSVSTNGNLQNQEQGNNTVD

SEQ ID NO: 96942 - protein, 36 aa, Artificial Sequence
  Description of Artificial Sequence: Synthetic polypeptide
AEEEIRTTNPVATEQYGSVSTNGNLQNNQEQGNNVE

SEQ ID NO: 96943 - protein, 30 aa, Artificial Sequence
  Description of Artificial Sequence: Synthetic polypeptide
SEMEIVTTNPIATEQYGTVCSATGLMFGND

SEQ ID NO: 96944 - protein, 36 aa, Artificial Sequence
  Description of Artificial Sequence: Synthetic polypeptide
AEEEIRTTNPVATEQYGSVSTNGNLQNEGEQGNNVE

SEQ ID NO: 96945 - protein, 31 aa, Artificial Sequence
  Description of Artificial Sequence: Synthetic polypeptide
SENDIRCTNPCATEQYGSVNSWENLERGSNQ

SEQ ID NO: 96946 - protein, 32 aa, Artificial Sequence
  Description of Artificial Sequence: Synthetic polypeptide
SENEEIRTTNPVAYEPWGVVSTNMQGNEGNER

SEQ ID NO: 96947 - protein, 28 aa, Artificial Sequence
  Description of Artificial Sequence: Synthetic peptide
SENEIACTNPVATECYGDVSECLQREEL

SEQ ID NO: 96948 - protein, 32 aa, Artificial Sequence
  Description of Artificial Sequence: Synthetic polypeptide
DEEEIRTTNPLAYEQYGCVSQNIAFRTVGSND

SEQ ID NO: 96949 - protein, 32 aa, Artificial Sequence
  Description of Artificial Sequence: Synthetic polypeptide
DEEEIRTTNPLAYEQYGKVVSCNIFRTVGNND

SEQ ID NO: 96950 - protein, 33 aa, Artificial Sequence
  Description of Artificial Sequence: Synthetic polypeptide
DEEEIRTTNPVATEQYGCVCSTYDQNFGSETQL

SEQ ID NO: 96951 - protein, 35 aa, Artificial Sequence
  Description of Artificial Sequence: Synthetic polypeptide
DEEEIRTTNPLAYEQYGQSVSCLGNSLSQLRVGDR

SEQ ID NO: 96952 - protein, 36 aa, Artificial Sequence
  Description of Artificial Sequence: Synthetic polypeptide
AEEEIRTTNPVATEQYGSVSTNANLQNQGEQGNNVQ

SEQ ID NO: 96953 - protein, 36 aa, Artificial Sequence
  Description of Artificial Sequence: Synthetic polypeptide
AEEEIRTTNPVATEQYGSVSTNANLQNQEQGTNQVE

SEQ ID NO: 96954 - protein, 28 aa, Artificial Sequence
  Description of Artificial Sequence: Synthetic peptide
SENEIATTNPVATECYGCVSELLQHEEL

SEQ ID NO: 96955 - protein, 32 aa, Artificial Sequence
  Description of Artificial Sequence: Synthetic polypeptide
SEMEIRCTNPVATEQYGSVCSAEGPVEREGNR

SEQ ID NO: 96956 - protein, 29 aa, Artificial Sequence
  Description of Artificial Sequence: Synthetic peptide
SEMEIRCTNPIATEQYGTVCSEGLMFGND

SEQ ID NO: 96957 - protein, 35 aa, Artificial Sequence
  Description of Artificial Sequence: Synthetic polypeptide
AEEEIRTTNPVATEQYGSVSTNGQGQNNNIGTNGD

SEQ ID NO: 96958 - protein, 31 aa, Artificial Sequence
  Description of Artificial Sequence: Synthetic polypeptide
SEMEIRCTNPIATEQYGSVCSEGPVEREGNR

SEQ ID NO: 96959 - protein, 34 aa, Artificial Sequence
  Description of Artificial Sequence: Synthetic polypeptide
DEEEIRTTNPVATEQYGCVCSWEEHQRFGSDNQA

SEQ ID NO: 96960 - protein, 28 aa, Artificial Sequence
  Description of Artificial Sequence: Synthetic peptide
SEGEIAQTNPCSSEQYGIVSCNLQSGTR

SEQ ID NO: 96961 - protein, 33 aa, Artificial Sequence
  Description of Artificial Sequence: Synthetic polypeptide
DEEEIRTTNPVATEQYGCVCSWEEHQHFGSNQN

SEQ ID NO: 96962 - protein, 36 aa, Artificial Sequence
  Description of Artificial Sequence: Synthetic polypeptide
AEEEIRTTNPVATEQYGSVSTNLNNENQDEIGTNVE

SEQ ID NO: 96963 - protein, 36 aa, Artificial Sequence
  Description of Artificial Sequence: Synthetic polypeptide
AEEEIRTTNPVATEQYGSVSTNLNLQQQNGNGEEGS

SEQ ID NO: 96964 - protein, 35 aa, Artificial Sequence
  Description of Artificial Sequence: Synthetic polypeptide
AEEEIRTTNPVATEQYGSVSTNLNLQNQEEGTEAL

SEQ ID NO: 96965 - protein, 35 aa, Artificial Sequence
  Description of Artificial Sequence: Synthetic polypeptide
AEEEIRTTNPVATEQYGSVSTNLNLQGEEEGTEAL

SEQ ID NO: 96966 - protein, 36 aa, Artificial Sequence
  Description of Artificial Sequence: Synthetic polypeptide
AEEEIRTTNPVATEQYGSVSTNLNLQEEQIGTNEGT

SEQ ID NO: 96967 - protein, 36 aa, Artificial Sequence
  Description of Artificial Sequence: Synthetic polypeptide
AEEEIRTTNPVATEQYGSVSTNLNGSNQETGTNVEG

SEQ ID NO: 96968 - protein, 36 aa, Artificial Sequence
  Description of Artificial Sequence: Synthetic polypeptide
AEEEIRTTNPVATEQYGSVSTNLNGNNQEQGTNVEE

SEQ ID NO: 96969 - protein, 28 aa, Artificial Sequence
  Description of Artificial Sequence: Synthetic peptide
SENEIATTNPVATECYGDVSECLQHEEL

SEQ ID NO: 96970 - protein, 34 aa, Artificial Sequence
  Description of Artificial Sequence: Synthetic polypeptide
SEGEIRTTNPVATEQYGSVSTILEELRNGNEEVF

SEQ ID NO: 96971 - protein, 29 aa, Artificial Sequence
  Description of Artificial Sequence: Synthetic peptide
SEHEIACTNPVATEQYGEASENTLQVGGP

SEQ ID NO: 96972 - protein, 35 aa, Artificial Sequence
  Description of Artificial Sequence: Synthetic polypeptide
AEEEIRTTNPVATEQYGSVSTNLNENVETGTNVEG

SEQ ID NO: 96973 - protein, 36 aa, Artificial Sequence
  Description of Artificial Sequence: Synthetic polypeptide
AEEEIRTTNPVATEQYGSVSTNLIGTTQGTGTNNTE

SEQ ID NO: 96974 - protein, 34 aa, Artificial Sequence
  Description of Artificial Sequence: Synthetic polypeptide
SELEIRTTNPVATESYGSVTSNTPNLEQWGDQRQ

SEQ ID NO: 96975 - protein, 28 aa, Artificial Sequence
  Description of Artificial Sequence: Synthetic peptide
SEMEIAPTNPCSSEQYGCVSWNLQSGTR

SEQ ID NO: 96976 - protein, 32 aa, Artificial Sequence
  Description of Artificial Sequence: Synthetic polypeptide
DEEEIRTTNPVATEQYGCVCSWEDQSFGSEQA

SEQ ID NO: 96977 - protein, 28 aa, Artificial Sequence
  Description of Artificial Sequence: Synthetic peptide
SEMEIAPTNPCSYEQYGIVSSNLQSGDR

SEQ ID NO: 96978 - protein, 32 aa, Artificial Sequence
  Description of Artificial Sequence: Synthetic polypeptide
DEEEIRTTNPVATEQYGCVCSWEDQHFGSEQE

SEQ ID NO: 96979 - protein, 28 aa, Artificial Sequence
  Description of Artificial Sequence: Synthetic peptide
SEMEIAYTNPCSYEQYGCVSCNLQSGTR

SEQ ID NO: 96980 - protein, 33 aa, Artificial Sequence
  Description of Artificial Sequence: Synthetic polypeptide
DEEEIRTTNPVATEQYGCVCSWEDHQNFGSNAG

SEQ ID NO: 96981 - protein, 33 aa, Artificial Sequence
  Description of Artificial Sequence: Synthetic polypeptide
DEEEIRTTNPVATEQYGCVCSWEEDQNFGSNAS

SEQ ID NO: 96982 - protein, 34 aa, Artificial Sequence
  Description of Artificial Sequence: Synthetic polypeptide
DEEEIRTTNPVATEQYGCVCSTNHNQEFFGSDQA

SEQ ID NO: 96983 - protein, 28 aa, Artificial Sequence
  Description of Artificial Sequence: Synthetic peptide
SENEIATTNPVATECYGDVSECLQPEEL

SEQ ID NO: 96984 - protein, 28 aa, Artificial Sequence
  Description of Artificial Sequence: Synthetic peptide
SENEIATTNPVATECYGDVSWPLQHSEL

SEQ ID NO: 96985 - protein, 33 aa, Artificial Sequence
  Description of Artificial Sequence: Synthetic polypeptide
DEEEIRTTNPLAYEQYGTVVSYTNLSDPVGIRV

SEQ ID NO: 96986 - protein, 29 aa, Artificial Sequence
  Description of Artificial Sequence: Synthetic peptide
SENEIRTTNPIATEQWGDVSEILMNRGDA

SEQ ID NO: 96987 - protein, 34 aa, Artificial Sequence
  Description of Artificial Sequence: Synthetic polypeptide
DEEEIRTTNPLAYERYGQSVSTGNSLSQLYVGDR

SEQ ID NO: 96988 - protein, 34 aa, Artificial Sequence
  Description of Artificial Sequence: Synthetic polypeptide
DEEEIRTTNPLAYEWYGQSVSTGNEFSQLRVGDR

SEQ ID NO: 96989 - protein, 34 aa, Artificial Sequence
  Description of Artificial Sequence: Synthetic polypeptide
DEEEIRTTNPVATEQYGCVCSTTGNTQNFGSDQA

SEQ ID NO: 96990 - protein, 34 aa, Artificial Sequence
  Description of Artificial Sequence: Synthetic polypeptide
DEEEIRTTNPVATEQYGCVCSTTGNHQNFGSEQA

SEQ ID NO: 96991 - protein, 30 aa, Artificial Sequence
  Description of Artificial Sequence: Synthetic polypeptide
SENEIRTTNPIATEQYGSVSENEMNRAEDA

SEQ ID NO: 96992 - protein, 35 aa, Artificial Sequence
  Description of Artificial Sequence: Synthetic polypeptide
DEEEIRTTNPVATEQYGCVCSTTGELQSFGSDNQS

SEQ ID NO: 96993 - protein, 35 aa, Artificial Sequence
  Description of Artificial Sequence: Synthetic polypeptide
AEEEIRTTNPVATEQYGSVSTGNQNQNDEGNNNNE

SEQ ID NO: 96994 - protein, 34 aa, Artificial Sequence
  Description of Artificial Sequence: Synthetic polypeptide
DEEEIRTTNPVATEQYGCVCSTTGEHQGGGSNQS

SEQ ID NO: 96995 - protein, 35 aa, Artificial Sequence
  Description of Artificial Sequence: Synthetic polypeptide
AEEEIRTTNPVATEQYGSVSTGNNQQGNDEGTNNE

SEQ ID NO: 96996 - protein, 35 aa, Artificial Sequence
  Description of Artificial Sequence: Synthetic polypeptide
AEEEIRTTNPVATEQYGSVSTGNNQNQNDEGGNNE

SEQ ID NO: 96997 - protein, 35 aa, Artificial Sequence
  Description of Artificial Sequence: Synthetic polypeptide
AEEEIRTTNPVATEQYGSVSTGNNQNGNDEGNNNE

SEQ ID NO: 96998 - protein, 30 aa, Artificial Sequence
  Description of Artificial Sequence: Synthetic polypeptide
SENEIRTTNPVATEPYGTISMDIQMRNGNH

SEQ ID NO: 96999 - protein, 29 aa, Artificial Sequence
  Description of Artificial Sequence: Synthetic peptide
SENEIRTTNPVATEQWGDVSENEMAAEDR

SEQ ID NO: 97000 - protein, 30 aa, Artificial Sequence
  Description of Artificial Sequence: Synthetic polypeptide
SENEIRTTNPVATEQWGSVSEIEMNAAGNA

SEQ ID NO: 97001 - protein, 30 aa, Artificial Sequence
  Description of Artificial Sequence: Synthetic polypeptide
SENEIRTTNPVATEQWGSVSENEMNAAEDR

SEQ ID NO: 97002 - protein, 30 aa, Artificial Sequence
  Description of Artificial Sequence: Synthetic polypeptide
SENEIRTTNPVATEQYGDVSEIEMNAAGDR

SEQ ID NO: 97003 - protein, 30 aa, Artificial Sequence
  Description of Artificial Sequence: Synthetic polypeptide
SENEIRTTNPVATEQYGDVSEILMNAAEDR

SEQ ID NO: 97004 - protein, 34 aa, Artificial Sequence
  Description of Artificial Sequence: Synthetic polypeptide
AEEEIRTTNPVATEQYGSVSTEQNDTNNQGNNNQ

SEQ ID NO: 97005 - protein, 34 aa, Artificial Sequence
  Description of Artificial Sequence: Synthetic polypeptide
DEEEIRTTNPVATEQYGCVCSTTEPQYFGSENQS

SEQ ID NO: 97006 - protein, 30 aa, Artificial Sequence
  Description of Artificial Sequence: Synthetic polypeptide
SENEIRCTNPVSTEQYGTVSMDLMQQNGNH

SEQ ID NO: 97007 - protein, 33 aa, Artificial Sequence
  Description of Artificial Sequence: Synthetic polypeptide
DEEEIRTTNPLAYEQYGSVPSCNISFRTGGNND

SEQ ID NO: 97008 - protein, 32 aa, Artificial Sequence
  Description of Artificial Sequence: Synthetic polypeptide
DEEEIRTTNPLAYEQYGSVPSCLNEISFSGND

SEQ ID NO: 97009 - protein, 34 aa, Artificial Sequence
  Description of Artificial Sequence: Synthetic polypeptide
AEEEIRTTNPVATEQYGSVSTMNQNQQQGTIATE

SEQ ID NO: 97010 - protein, 28 aa, Artificial Sequence
  Description of Artificial Sequence: Synthetic peptide
SENEIATTNPVATECYGTVSWELQHEEL

SEQ ID NO: 97011 - protein, 28 aa, Artificial Sequence
  Description of Artificial Sequence: Synthetic peptide
SENEIATTNPVATEEYGCVSWELQHIEL

SEQ ID NO: 97012 - protein, 28 aa, Artificial Sequence
  Description of Artificial Sequence: Synthetic peptide
SENEIATTNPVATEGYGDVSWELQHEEQ

SEQ ID NO: 97013 - protein, 28 aa, Artificial Sequence
  Description of Artificial Sequence: Synthetic peptide
SENEIATTNPVATEPYGTVSECLQHEEL

SEQ ID NO: 97014 - protein, 36 aa, Artificial Sequence
  Description of Artificial Sequence: Synthetic polypeptide
AEEEIRTTNPVATEQYGSVSTNANLQNQEQGNNDDE

SEQ ID NO: 97015 - protein, 31 aa, Artificial Sequence
  Description of Artificial Sequence: Synthetic polypeptide
SENEIRCTNPIATEGWGQSVSEMNLMRGNDR

SEQ ID NO: 97016 - protein, 29 aa, Artificial Sequence
  Description of Artificial Sequence: Synthetic peptide
SENEIRCTNPIATEPYGSISEDIQMRGNH

SEQ ID NO: 97017 - protein, 34 aa, Artificial Sequence
  Description of Artificial Sequence: Synthetic polypeptide
DEEEIRTTNPVATEQYGCVCSTWENHQNFGSDDA

SEQ ID NO: 97018 - protein, 34 aa, Artificial Sequence
  Description of Artificial Sequence: Synthetic polypeptide
DEEEIRTTNPVATEQYGCVCSTWENHARFGSQQS

SEQ ID NO: 97019 - protein, 29 aa, Artificial Sequence
  Description of Artificial Sequence: Synthetic peptide
SENEIRCTNPIATEPYGSISMDIQMRGNH

SEQ ID NO: 97020 - protein, 28 aa, Artificial Sequence
  Description of Artificial Sequence: Synthetic peptide
SENEIATTNPVATECYGDVSECLQTEEL

SEQ ID NO: 97021 - protein, 30 aa, Artificial Sequence
  Description of Artificial Sequence: Synthetic polypeptide
SENEIRCTNPIATEQWGSVSENEMNAAGNR

SEQ ID NO: 97022 - protein, 36 aa, Artificial Sequence
  Description of Artificial Sequence: Synthetic polypeptide
AEEEIRTTNPVATEQYGSVSTNANLQNGNEQGNNVE

SEQ ID NO: 97023 - protein, 36 aa, Artificial Sequence
  Description of Artificial Sequence: Synthetic polypeptide
AEEEIRTTNPVATEQYGSVSTNANLQNAQEQGNNVA

SEQ ID NO: 97024 - protein, 35 aa, Artificial Sequence
  Description of Artificial Sequence: Synthetic polypeptide
DEEEIRTTNPLAYEQYGQSVSTGNSLSQLSVGDRW

SEQ ID NO: 97025 - protein, 34 aa, Artificial Sequence
  Description of Artificial Sequence: Synthetic polypeptide
DEEEIRTTNPLAYEQYGSVNTNGLSDRTGGINPV

SEQ ID NO: 97026 - protein, 33 aa, Artificial Sequence
  Description of Artificial Sequence: Synthetic polypeptide
DEEEIRTTNPVATEQYGCVCSTVEHQGFGSDQG

SEQ ID NO: 97027 - protein, 29 aa, Artificial Sequence
  Description of Artificial Sequence: Synthetic peptide
SENEIRCTNPISTEQYGTVSMDLMQNGNH

SEQ ID NO: 97028 - protein, 34 aa, Artificial Sequence
  Description of Artificial Sequence: Synthetic polypeptide
DEEEIRTTNPVATEQYGCVCSTTPEHQFFGSNQS

SEQ ID NO: 97029 - protein, 28 aa, Artificial Sequence
  Description of Artificial Sequence: Synthetic peptide
SENEIRCTNPVATEQWGDVSENEMAGDA

SEQ ID NO: 97030 - protein, 30 aa, Artificial Sequence
  Description of Artificial Sequence: Synthetic polypeptide
SENEIRCTNPVATEQWGSVSEIEMNAAGNR

SEQ ID NO: 97031 - protein, 30 aa, Artificial Sequence
  Description of Artificial Sequence: Synthetic polypeptide
SENEIRCTNPVATEQYGDVSEILMNAAGDR

SEQ ID NO: 97032 - protein, 36 aa, Artificial Sequence
  Description of Artificial Sequence: Synthetic polypeptide
AEEEIRTTNPVATEQYGSVSTNANLQNNEQGNNATE

SEQ ID NO: 97033 - protein, 33 aa, Artificial Sequence
  Description of Artificial Sequence: Synthetic polypeptide
DEEEIRTTNPVATEQYGCVCSTNHIENFNSQQP

SEQ ID NO: 97034 - protein, 34 aa, Artificial Sequence
  Description of Artificial Sequence: Synthetic polypeptide
DEEEIRTTNPVATEQYGCVCSTNHIENFGSNNQL

SEQ ID NO: 97035 - protein, 31 aa, Artificial Sequence
  Description of Artificial Sequence: Synthetic polypeptide
SESEIRSTNPVAYERYGSTVPCTNLQHGGNQ

SEQ ID NO: 97036 - protein, 33 aa, Artificial Sequence
  Description of Artificial Sequence: Synthetic polypeptide
DEEEIRTTNPVATEQYGCVCSTGELNINFGSEQ

SEQ ID NO: 97037 - protein, 31 aa, Artificial Sequence
  Description of Artificial Sequence: Synthetic polypeptide
SQEEIATTNPVAYEQWGVVTTNLQGEHGNDR

SEQ ID NO: 97038 - protein, 34 aa, Artificial Sequence
  Description of Artificial Sequence: Synthetic polypeptide
DEEEIRTTNPVATEQYGCVCSTGELENFGSDNQG

SEQ ID NO: 97039 - protein, 33 aa, Artificial Sequence
  Description of Artificial Sequence: Synthetic polypeptide
AEEEIRTTNPVATEQYGSVCSTGNDANFNSNFQ

SEQ ID NO: 97040 - protein, 33 aa, Artificial Sequence
  Description of Artificial Sequence: Synthetic polypeptide
DEEEIRTTNPVATEQYGCVCSTGEHQYFNSEQA

SEQ ID NO: 97041 - protein, 33 aa, Artificial Sequence
  Description of Artificial Sequence: Synthetic polypeptide
SQEEIRTTNPVATEQWGCVCSTGNLQNFGSDNQ

SEQ ID NO: 97042 - protein, 33 aa, Artificial Sequence
  Description of Artificial Sequence: Synthetic polypeptide
SQEEIRTTNPVATEQWGCVCSTGNLQNFGSNQM

SEQ ID NO: 97043 - protein, 33 aa, Artificial Sequence
  Description of Artificial Sequence: Synthetic polypeptide
AEEEIRTTNPVATEQYGSVCSTELANFNSNFQA

SEQ ID NO: 97044 - protein, 34 aa, Artificial Sequence
  Description of Artificial Sequence: Synthetic polypeptide
AEEEIRTTNPVATEQYGSVCSPTNLERNVDTQES

SEQ ID NO: 97045 - protein, 33 aa, Artificial Sequence
  Description of Artificial Sequence: Synthetic polypeptide
DEEEIRTTNPVATEQYGCVCSTGEHQNSGSEQS

SEQ ID NO: 97046 - protein, 32 aa, Artificial Sequence
  Description of Artificial Sequence: Synthetic polypeptide
SQEEIRTTNPVATEQWGCVSTNLLQEYGFDDS

SEQ ID NO: 97047 - protein, 31 aa, Artificial Sequence
  Description of Artificial Sequence: Synthetic polypeptide
SQEEIRTTNPVATEQWGCVSTNLQEYQFDSF

SEQ ID NO: 97048 - protein, 33 aa, Artificial Sequence
  Description of Artificial Sequence: Synthetic polypeptide
DEEEIRTTNPVATEQYGCVCSTGEHQNFGSVQS

SEQ ID NO: 97049 - protein, 33 aa, Artificial Sequence
  Description of Artificial Sequence: Synthetic polypeptide
DEEEIRTTNPVATEQYGCVCSTGEHQNFGSQQG

SEQ ID NO: 97050 - protein, 33 aa, Artificial Sequence
  Description of Artificial Sequence: Synthetic polypeptide
DEEEIRTTNPVATEQYGCVCSTGEHQNFGSDDP

SEQ ID NO: 97051 - protein, 29 aa, Artificial Sequence
  Description of Artificial Sequence: Synthetic peptide
SQEEIRTTNPVATEQWGCVSTNTWEIFDS

SEQ ID NO: 97052 - protein, 33 aa, Artificial Sequence
  Description of Artificial Sequence: Synthetic polypeptide
DEEEIRTTNPVATEQYGCVCSTGEHQIFGSDQA

SEQ ID NO: 97053 - protein, 32 aa, Artificial Sequence
  Description of Artificial Sequence: Synthetic polypeptide
DEEEIRTTNPVATEQYGCVCSTGEHQHNSQQT

SEQ ID NO: 97054 - protein, 33 aa, Artificial Sequence
  Description of Artificial Sequence: Synthetic polypeptide
SQEEIRTTNPVATEQWGCVTSTDNLNQEGQEER

SEQ ID NO: 97055 - protein, 34 aa, Artificial Sequence
  Description of Artificial Sequence: Synthetic polypeptide
DEEEIRTTNPVATEQYGCVCSTGEHQGFGSENQS

SEQ ID NO: 97056 - protein, 33 aa, Artificial Sequence
  Description of Artificial Sequence: Synthetic polypeptide
DEEEIRTTNPVATEQYGCVCSTGEHQGFGSEDA

SEQ ID NO: 97057 - protein, 31 aa, Artificial Sequence
  Description of Artificial Sequence: Synthetic polypeptide
SQEEIATTNPVAYEQWGTVSTNNQHEDGNPR

SEQ ID NO: 97058 - protein, 34 aa, Artificial Sequence
  Description of Artificial Sequence: Synthetic polypeptide
DEEEIRTTNPVATEQYGCVCSTGELNQGFGSDQA

SEQ ID NO: 97059 - protein, 34 aa, Artificial Sequence
  Description of Artificial Sequence: Synthetic polypeptide
DEEEIRTTNPVATEQYGCVCSTGELNQHFGSEQM

SEQ ID NO: 97060 - protein, 35 aa, Artificial Sequence
  Description of Artificial Sequence: Synthetic polypeptide
DEEEIRTTNPVATEQYGCVCSTGELNQNFGSENQG

SEQ ID NO: 97061 - protein, 34 aa, Artificial Sequence
  Description of Artificial Sequence: Synthetic polypeptide
AEEEIRTTNPVATEQYGSVSLTVNTEHRPAGGYP

SEQ ID NO: 97062 - protein, 33 aa, Artificial Sequence
  Description of Artificial Sequence: Synthetic polypeptide
DEEEIRTTNPVATEQYGCVCSTGETQNSNSDQQ

SEQ ID NO: 97063 - protein, 33 aa, Artificial Sequence
  Description of Artificial Sequence: Synthetic polypeptide
DEEEIRTTNPVATEQYGCVCSTGETQNGSETQS

SEQ ID NO: 97064 - protein, 33 aa, Artificial Sequence
  Description of Artificial Sequence: Synthetic polypeptide
DEEEIRTTNPVATEQYGCVCSTGETQGFGSQQN

SEQ ID NO: 97065 - protein, 31 aa, Artificial Sequence
  Description of Artificial Sequence: Synthetic polypeptide
SNEEIRTTNPVATEQWGCVSTLNTESEGQNP

SEQ ID NO: 97066 - protein, 33 aa, Artificial Sequence
  Description of Artificial Sequence: Synthetic polypeptide
DEEEIRTTNPVATEQYGCVCSTGEPQHFGSDQE

SEQ ID NO: 97067 - protein, 33 aa, Artificial Sequence
  Description of Artificial Sequence: Synthetic polypeptide
DEEEIRTTNPVATEQYGCVCSTGEPQEGGSEQS

SEQ ID NO: 97068 - protein, 34 aa, Artificial Sequence
  Description of Artificial Sequence: Synthetic polypeptide
DEEEIRTTNPVATEQYGCVCSTGEPQEGFNSDQN

SEQ ID NO: 97069 - protein, 31 aa, Artificial Sequence
  Description of Artificial Sequence: Synthetic polypeptide
SQAEIRTTNPVATEQYGCCSTVLQEGGNSKQ

SEQ ID NO: 97070 - protein, 32 aa, Artificial Sequence
  Description of Artificial Sequence: Synthetic polypeptide
SQEAEIATTNPVAYEQWGTVSTNLQGEDGDNR

SEQ ID NO: 97071 - protein, 33 aa, Artificial Sequence
  Description of Artificial Sequence: Synthetic polypeptide
DEEEIRTTNPVATEQYGCVCSTGEHQFFNSDQE

SEQ ID NO: 97072 - protein, 33 aa, Artificial Sequence
  Description of Artificial Sequence: Synthetic polypeptide
AEEEIRTTNPVATEQYGSVNVVNNNQQGNNVNE

SEQ ID NO: 97073 - protein, 34 aa, Artificial Sequence
  Description of Artificial Sequence: Synthetic polypeptide
DEEEIRTTNPVATEQYGCVCSTGELQYFISNNQS

SEQ ID NO: 97074 - protein, 33 aa, Artificial Sequence
  Description of Artificial Sequence: Synthetic polypeptide
DEEEIRTTNPVATEAYGKVSCNNLSQQKAVGVE

SEQ ID NO: 97075 - protein, 34 aa, Artificial Sequence
  Description of Artificial Sequence: Synthetic polypeptide
DEEEIRTTNPVATEQYGCVCSTGELQRFISETQS

SEQ ID NO: 97076 - protein, 34 aa, Artificial Sequence
  Description of Artificial Sequence: Synthetic polypeptide
DEEEIRTTNPVATEQYGCVCSTGELQNFISDNQS

SEQ ID NO: 97077 - protein, 34 aa, Artificial Sequence
  Description of Artificial Sequence: Synthetic polypeptide
DEEEIRTTNPVATEQYGCVCSTGELQHFSSENQS

SEQ ID NO: 97078 - protein, 34 aa, Artificial Sequence
  Description of Artificial Sequence: Synthetic polypeptide
DEEEIRTTNPVATEQYGCVCSTGELQEYFNSNQS

SEQ ID NO: 97079 - protein, 32 aa, Artificial Sequence
  Description of Artificial Sequence: Synthetic polypeptide
SQEEIATTNPVAYEQWGTVSTNLQGEHGNDGR

SEQ ID NO: 97080 - protein, 34 aa, Artificial Sequence
  Description of Artificial Sequence: Synthetic polypeptide
DEEEIRTTNPVATEQYGCVCSTGELNQSFNSDQA

SEQ ID NO: 97081 - protein, 32 aa, Artificial Sequence
  Description of Artificial Sequence: Synthetic polypeptide
SQEEIATTNPVAYEQWGTVSTNLQGENGMNDR

SEQ ID NO: 97082 - protein, 35 aa, Artificial Sequence
  Description of Artificial Sequence: Synthetic polypeptide
DEEEIRTTNPVATEQYGCVCSTGELNQNFGSNNQA

SEQ ID NO: 97083 - protein, 34 aa, Artificial Sequence
  Description of Artificial Sequence: Synthetic polypeptide
DEEEIRTTNPVATEQYGCVCSTGELQYFNSNTQM

SEQ ID NO: 97084 - protein, 33 aa, Artificial Sequence
  Description of Artificial Sequence: Synthetic polypeptide
DEEEIRTTNPVATEQYGCVCSTGNDHQNNSDQT

SEQ ID NO: 97085 - protein, 31 aa, Artificial Sequence
  Description of Artificial Sequence: Synthetic polypeptide
SQEEIRTTNPVATEQWGTVCSTELQYGSEQS

SEQ ID NO: 97086 - protein, 33 aa, Artificial Sequence
  Description of Artificial Sequence: Synthetic polypeptide
SQEEIRTTNPVATEQWGTVCSTTGNLQNFGSNQ

SEQ ID NO: 97087 - protein, 33 aa, Artificial Sequence
  Description of Artificial Sequence: Synthetic polypeptide
DEEEIRTTNPVATEQYGCVCSTGEDQSFGSDQA

SEQ ID NO: 97088 - protein, 33 aa, Artificial Sequence
  Description of Artificial Sequence: Synthetic polypeptide
DEEEIRTTNPVATEQYGCVCSTGEDQNFGSDQA

SEQ ID NO: 97089 - protein, 33 aa, Artificial Sequence
  Description of Artificial Sequence: Synthetic polypeptide
DEEEIRTTNPVATEQYGCVCSTGEDQHSNSNQL

SEQ ID NO: 97090 - protein, 32 aa, Artificial Sequence
  Description of Artificial Sequence: Synthetic polypeptide
DEEEIRTTNPVATEQYGCVCSTGEDQGFQSEQ

SEQ ID NO: 97091 - protein, 33 aa, Artificial Sequence
  Description of Artificial Sequence: Synthetic polypeptide
DEEEIRTTNPVATEQYGCVCSTGEDQFFNSDQA

SEQ ID NO: 97092 - protein, 34 aa, Artificial Sequence
  Description of Artificial Sequence: Synthetic polypeptide
DEEEIRTTNPVATEQYGCVCSTGEDQFFGSQNQA

SEQ ID NO: 97093 - protein, 34 aa, Artificial Sequence
  Description of Artificial Sequence: Synthetic polypeptide
DEEEIRTTNPVATEQYGCVCSTGEDQFFGSDNQA

SEQ ID NO: 97094 - protein, 33 aa, Artificial Sequence
  Description of Artificial Sequence: Synthetic polypeptide
DEEEIRTTNPVATEQYGCVCSTGEDQENGSEQS

SEQ ID NO: 97095 - protein, 34 aa, Artificial Sequence
  Description of Artificial Sequence: Synthetic polypeptide
DEEEIRTTNPVATEQYGCVCSTGEDQEGFNSDQS

SEQ ID NO: 97096 - protein, 32 aa, Artificial Sequence
  Description of Artificial Sequence: Synthetic polypeptide
SSEEIRTTNPVATDQYGSVVSTGGQRGQGAFG

SEQ ID NO: 97097 - protein, 35 aa, Artificial Sequence
  Description of Artificial Sequence: Synthetic polypeptide
DEEEIRTTNPVATEQYGCVCSTGEDLQNFGSENQS

SEQ ID NO: 97098 - protein, 34 aa, Artificial Sequence
  Description of Artificial Sequence: Synthetic polypeptide
DEEEIRTTNPVATEQYGCVCSTGEDLQNFGSDQE

SEQ ID NO: 97099 - protein, 33 aa, Artificial Sequence
  Description of Artificial Sequence: Synthetic polypeptide
DEEEIRTTNPVATEQYGCVCSTGEDINFGSNQM

SEQ ID NO: 97100 - protein, 32 aa, Artificial Sequence
  Description of Artificial Sequence: Synthetic polypeptide
SSEEIRTTNPVATHQYGCVCSTEDLQNFGSNQ

SEQ ID NO: 97101 - protein, 30 aa, Artificial Sequence
  Description of Artificial Sequence: Synthetic polypeptide
SSEEIRTTNPVATHQYGSVCWWNERMGNEF

SEQ ID NO: 97102 - protein, 33 aa, Artificial Sequence
  Description of Artificial Sequence: Synthetic polypeptide
SSEEIRTTNPVATHQYGSVPSCTPLSQEGGNNF

SEQ ID NO: 97103 - protein, 34 aa, Artificial Sequence
  Description of Artificial Sequence: Synthetic polypeptide
AEEEIRTTNPVATEQYGCVCSTTNHQNFGSENQA

SEQ ID NO: 97104 - protein, 33 aa, Artificial Sequence
  Description of Artificial Sequence: Synthetic polypeptide
AEEEIRTTNPVATEQYGCVCSTTEHQRFGSDQS

SEQ ID NO: 97105 - protein, 33 aa, Artificial Sequence
  Description of Artificial Sequence: Synthetic polypeptide
AEEEIRTTNPVATEQYGCVCSTPELQNFGSEQP

SEQ ID NO: 97106 - protein, 34 aa, Artificial Sequence
  Description of Artificial Sequence: Synthetic polypeptide
AEEEIRTTNPVATEQYGCVCSTNLAEGFNSQFQA

SEQ ID NO: 97107 - protein, 33 aa, Artificial Sequence
  Description of Artificial Sequence: Synthetic polypeptide
AEEEIRTTNPVATEQYGCVCSTNHNQNFGSEQS

SEQ ID NO: 97108 - protein, 33 aa, Artificial Sequence
  Description of Artificial Sequence: Synthetic polypeptide
DEEEIRTTNPVATEQYGCVCSTGEDQYFNSDQE

SEQ ID NO: 97109 - protein, 32 aa, Artificial Sequence
  Description of Artificial Sequence: Synthetic polypeptide
SSEEIRTTNPVATDQYGSVSPTWVEQRGEEFN

SEQ ID NO: 97110 - protein, 34 aa, Artificial Sequence
  Description of Artificial Sequence: Synthetic polypeptide
SSEEIRTTNPVATDQYGSVSPTSWLPQRSGNEFD

SEQ ID NO: 97111 - protein, 33 aa, Artificial Sequence
  Description of Artificial Sequence: Synthetic polypeptide
SSEEIRTTNPVATDQYGSVSATGDDQRGQGNGQ

SEQ ID NO: 97112 - protein, 32 aa, Artificial Sequence
  Description of Artificial Sequence: Synthetic polypeptide
SQEEIRTTNPVATEQWGTVSTGELQNFGSNQA

SEQ ID NO: 97113 - protein, 34 aa, Artificial Sequence
  Description of Artificial Sequence: Synthetic polypeptide
AEEEIRTTNPVATEQYGSVATTNNNQQEGNNNEI

SEQ ID NO: 97114 - protein, 31 aa, Artificial Sequence
  Description of Artificial Sequence: Synthetic polypeptide
AEEEIRTTNPVATEQYGSCSPSSEQFQGGFP

SEQ ID NO: 97115 - protein, 33 aa, Artificial Sequence
  Description of Artificial Sequence: Synthetic polypeptide
DEEEIRTTNPVATEQYGCVCSTGEHNQGGSEQS

SEQ ID NO: 97116 - protein, 30 aa, Artificial Sequence
  Description of Artificial Sequence: Synthetic polypeptide
SQEEIRTTNPVATEQWGTYFSWNLTEQNNR

SEQ ID NO: 97117 - protein, 29 aa, Artificial Sequence
  Description of Artificial Sequence: Synthetic peptide
SQEEIRTTNPVATEQWGTYSWNLNEENNY

SEQ ID NO: 97118 - protein, 30 aa, Artificial Sequence
  Description of Artificial Sequence: Synthetic polypeptide
SQEEIRTTNPVATEQWGTYSWNLTEAINRD

SEQ ID NO: 97119 - protein, 31 aa, Artificial Sequence
  Description of Artificial Sequence: Synthetic polypeptide
SQEEIRTTNPVATEQWGTYYSWNLTEQEINR

SEQ ID NO: 97120 - protein, 31 aa, Artificial Sequence
  Description of Artificial Sequence: Synthetic polypeptide
SQEEIRTTNPVATHQYGSVSSNGVQEGEHKD

SEQ ID NO: 97121 - protein, 32 aa, Artificial Sequence
  Description of Artificial Sequence: Synthetic polypeptide
SQEEIRTTNPVATHQYGSVSTNGVQEGFEHKM

SEQ ID NO: 97122 - protein, 32 aa, Artificial Sequence
  Description of Artificial Sequence: Synthetic polypeptide
SQEEIRTTNPVATEQWGTVCSTNLQNFGSQAS

SEQ ID NO: 97123 - protein, 30 aa, Artificial Sequence
  Description of Artificial Sequence: Synthetic polypeptide
SQQEIRTTNPVATEQWGCVSTNHLQEDFDS

SEQ ID NO: 97124 - protein, 30 aa, Artificial Sequence
  Description of Artificial Sequence: Synthetic polypeptide
SSEAICTTNPVAGEQYGVVSTNLQGTGQHG

SEQ ID NO: 97125 - protein, 31 aa, Artificial Sequence
  Description of Artificial Sequence: Synthetic polypeptide
SSEEIATTNPVATHQWGSVSTWDGGQRQGNH

SEQ ID NO: 97126 - protein, 33 aa, Artificial Sequence
  Description of Artificial Sequence: Synthetic polypeptide
SSEEIATTNPVATHQYGSVSPTWLEQRGQNDFG

SEQ ID NO: 97127 - protein, 30 aa, Artificial Sequence
  Description of Artificial Sequence: Synthetic polypeptide
SSEEIATTNPVATTQWGCVSTWDHDQRGNF

SEQ ID NO: 97128 - protein, 32 aa, Artificial Sequence
  Description of Artificial Sequence: Synthetic polypeptide
DEEEIRTTNPVATEQYGCVCSTGEHINNSDQV

SEQ ID NO: 97129 - protein, 31 aa, Artificial Sequence
  Description of Artificial Sequence: Synthetic polypeptide
SSEEIATTNPVATTQWGSVAHTWDLDQRGNF

SEQ ID NO: 97130 - protein, 31 aa, Artificial Sequence
  Description of Artificial Sequence: Synthetic polypeptide
SSEEIATTNPVATTQWGSVSGGWDLDQRGNF

SEQ ID NO: 97131 - protein, 31 aa, Artificial Sequence
  Description of Artificial Sequence: Synthetic polypeptide
SSEEIRTTNPVATCQYGCVCSTEDQNGSNFA

SEQ ID NO: 97132 - protein, 32 aa, Artificial Sequence
  Description of Artificial Sequence: Synthetic polypeptide
SSEEIRTTNPVATCQYGCVCSTELQSFGSNQA

SEQ ID NO: 97133 - protein, 33 aa, Artificial Sequence
  Description of Artificial Sequence: Synthetic polypeptide
SSEEIRTTNPVATCQYGCVCSTGELQRFGSNFA

SEQ ID NO: 97134 - protein, 32 aa, Artificial Sequence
  Description of Artificial Sequence: Synthetic polypeptide
SSAEIRTTNPVATHQYGSVSPTWLEQRGSQDP

SEQ ID NO: 97135 - protein, 34 aa, Artificial Sequence
  Description of Artificial Sequence: Synthetic polypeptide
AEEEIRTTNPVATEQYGCVCSTGELQEGFGSNQN

SEQ ID NO: 97136 - protein, 31 aa, Artificial Sequence
  Description of Artificial Sequence: Synthetic polypeptide
SGEEIRTTNPVATEQWGSYTTTLLQRGTQVM

SEQ ID NO: 97137 - protein, 34 aa, Artificial Sequence
  Description of Artificial Sequence: Synthetic polypeptide
DEEEIRTTNPVATEQYGCVCSTGNDQENFNSDQM

SEQ ID NO: 97138 - protein, 34 aa, Artificial Sequence
  Description of Artificial Sequence: Synthetic polypeptide
DEEEIRTTNPVATDQYGSVSTMNGFGQENIGGEG

SEQ ID NO: 97139 - protein, 34 aa, Artificial Sequence
  Description of Artificial Sequence: Synthetic polypeptide
DEEEIRTTNPVATDQYGSVSTMNLVEMTEENQED

SEQ ID NO: 97140 - protein, 34 aa, Artificial Sequence
  Description of Artificial Sequence: Synthetic polypeptide
DEEEIRTTNPVATDQYGSVSTVNGFGQENDTGGG

SEQ ID NO: 97141 - protein, 34 aa, Artificial Sequence
  Description of Artificial Sequence: Synthetic polypeptide
DEEEIRTTNPVATEQYGCVCSTNAHQENFMSDNQ

SEQ ID NO: 97142 - protein, 34 aa, Artificial Sequence
  Description of Artificial Sequence: Synthetic polypeptide
DEEEIRTTNPVATDQYGSVSTVNGFGQENIGGGE

SEQ ID NO: 97143 - protein, 33 aa, Artificial Sequence
  Description of Artificial Sequence: Synthetic polypeptide
DEEEIRTTNPVATDQYGSVSVDNLTRFEEEVDE

SEQ ID NO: 97144 - protein, 33 aa, Artificial Sequence
  Description of Artificial Sequence: Synthetic polypeptide
DEEEIRTTNPVATEQYGCVCSTMYHQNFGSEQL

SEQ ID NO: 97145 - protein, 33 aa, Artificial Sequence
  Description of Artificial Sequence: Synthetic polypeptide
DEEEIRTTNPVATEQYGCVCSTMPHQGFGSDQV

SEQ ID NO: 97146 - protein, 34 aa, Artificial Sequence
  Description of Artificial Sequence: Synthetic polypeptide
DEEEIRTTNPVATEQYGCVCSTMPHQFFGSNNQS

SEQ ID NO: 97147 - protein, 35 aa, Artificial Sequence
  Description of Artificial Sequence: Synthetic polypeptide
AEEEIRTTNPVATEQYGSVSSTNNNNNQAIGTNTE

SEQ ID NO: 97148 - protein, 31 aa, Artificial Sequence
  Description of Artificial Sequence: Synthetic polypeptide
SETEIRCTNPIATEQYGAVWSNENLMPGNYR

SEQ ID NO: 97149 - protein, 30 aa, Artificial Sequence
  Description of Artificial Sequence: Synthetic polypeptide
SETEIRCTNPIATEQYGSTTAEDLMRKGNR

SEQ ID NO: 97150 - protein, 31 aa, Artificial Sequence
  Description of Artificial Sequence: Synthetic polypeptide
SETEIRCTNPIATEQYGSTTANEDLMRKGNR

SEQ ID NO: 97151 - protein, 34 aa, Artificial Sequence
  Description of Artificial Sequence: Synthetic polypeptide
DEEEIRTTNPVATEQYGCVCSTMNHQNFNSQNQL

SEQ ID NO: 97152 - protein, 34 aa, Artificial Sequence
  Description of Artificial Sequence: Synthetic polypeptide
DEEEIRTTNPVATEQYGCVCSTMNHQEYFNSEQT

SEQ ID NO: 97153 - protein, 32 aa, Artificial Sequence
  Description of Artificial Sequence: Synthetic polypeptide
SETEIRCTNPVATEQYGSVYCTWNDQHQGNTG

SEQ ID NO: 97154 - protein, 33 aa, Artificial Sequence
  Description of Artificial Sequence: Synthetic polypeptide
DEEEIRTTNPVATEQYGCVCSTMEPQNFGSEQT

SEQ ID NO: 97155 - protein, 34 aa, Artificial Sequence
  Description of Artificial Sequence: Synthetic polypeptide
DEEEIRTTNPVATEQYGCVCSTMELQNFGSDTQA

SEQ ID NO: 97156 - protein, 34 aa, Artificial Sequence
  Description of Artificial Sequence: Synthetic polypeptide
DEEEIRTTNPVATEQYGCVCSTMELQFFGSDFQS

SEQ ID NO: 97157 - protein, 33 aa, Artificial Sequence
  Description of Artificial Sequence: Synthetic polypeptide
DEEEIRTTNPVATEQYGCVCSTMELENFGSQQG

SEQ ID NO: 97158 - protein, 34 aa, Artificial Sequence
  Description of Artificial Sequence: Synthetic polypeptide
DEEEIRTTNPVATEQYGCVCSTMEHQNFGSNNQT

SEQ ID NO: 97159 - protein, 34 aa, Artificial Sequence
  Description of Artificial Sequence: Synthetic polypeptide
DEEEIRTTNPVATDQYGSVSTMNGEGQENIGGGE

SEQ ID NO: 97160 - protein, 34 aa, Artificial Sequence
  Description of Artificial Sequence: Synthetic polypeptide
DEEEIRTTNPVATEQYGCVCSTNDDQENFGSDTQ

SEQ ID NO: 97161 - protein, 32 aa, Artificial Sequence
  Description of Artificial Sequence: Synthetic polypeptide
SETEIACTNPVATEQYGSVYCTWNDQHQGNQR

SEQ ID NO: 97162 - protein, 31 aa, Artificial Sequence
  Description of Artificial Sequence: Synthetic polypeptide
SETAEIATTNPVAYEPYGSVATNLQDGNNEN

SEQ ID NO: 97163 - protein, 34 aa, Artificial Sequence
  Description of Artificial Sequence: Synthetic polypeptide
DEEEIRTTNPVATEQYGCVCSTNHDQENFGSQQS

SEQ ID NO: 97164 - protein, 33 aa, Artificial Sequence
  Description of Artificial Sequence: Synthetic polypeptide
DEEEIRTTNPVATEQYGCVCSTNHAFFNSNTQE

SEQ ID NO: 97165 - protein, 33 aa, Artificial Sequence
  Description of Artificial Sequence: Synthetic polypeptide
DEEEIRTTNPVATEQYGCVCSTNHAEHFNSEDP

SEQ ID NO: 97166 - protein, 35 aa, Artificial Sequence
  Description of Artificial Sequence: Synthetic polypeptide
DEEEIRTTNPVATEQYGCVCSTNGHQERFMSDNQA

SEQ ID NO: 97167 - protein, 34 aa, Artificial Sequence
  Description of Artificial Sequence: Synthetic polypeptide
DEEEIRTTNPVATEQYGCVCSTNGHQENFGSDQA

SEQ ID NO: 97168 - protein, 32 aa, Artificial Sequence
  Description of Artificial Sequence: Synthetic polypeptide
SESEIRTTNPVATECWGSVSCNEPQDREGENG

SEQ ID NO: 97169 - protein, 34 aa, Artificial Sequence
  Description of Artificial Sequence: Synthetic polypeptide
DEEEIRTTNPVASEQYGSVSSTTAGPNMRGMNPV

SEQ ID NO: 97170 - protein, 32 aa, Artificial Sequence
  Description of Artificial Sequence: Synthetic polypeptide
SESEIRTTNPVATECYGSVSENEPMDREGENG

SEQ ID NO: 97171 - protein, 35 aa, Artificial Sequence
  Description of Artificial Sequence: Synthetic polypeptide
DEEEIRTTNPVATEQYGCVCSTNEHQEGFGSNTQS

SEQ ID NO: 97172 - protein, 33 aa, Artificial Sequence
  Description of Artificial Sequence: Synthetic polypeptide
SESEIRTTNPVATEQWGSVSCINEPQDREGENG

SEQ ID NO: 97173 - protein, 33 aa, Artificial Sequence
  Description of Artificial Sequence: Synthetic polypeptide
DEEEIRTTNPVATEQYGCVCSTMEHQNFGSDVA

SEQ ID NO: 97174 - protein, 33 aa, Artificial Sequence
  Description of Artificial Sequence: Synthetic polypeptide
DEEEIRTTNPVATACYGKTVSTPLSQTTVGDRF

SEQ ID NO: 97175 - protein, 33 aa, Artificial Sequence
  Description of Artificial Sequence: Synthetic polypeptide
DEEEIRTTNPVATCQYGEVSTNMGEVFGDARQR

SEQ ID NO: 97176 - protein, 34 aa, Artificial Sequence
  Description of Artificial Sequence: Synthetic polypeptide
DEEEIRTTNPVATEQYGCVCSTNDPQENFGSDQS

SEQ ID NO: 97177 - protein, 28 aa, Artificial Sequence
  Description of Artificial Sequence: Synthetic peptide
SESEVACTNPISTEQYGNVSETLQRGQR

SEQ ID NO: 97178 - protein, 29 aa, Artificial Sequence
  Description of Artificial Sequence: Synthetic peptide
SESEVASTNPVATEGYGSVAANTIQRGQR

SEQ ID NO: 97179 - protein, 28 aa, Artificial Sequence
  Description of Artificial Sequence: Synthetic peptide
SESEVASTNPVATEGYGSVANTIQRGQR

SEQ ID NO: 97180 - protein, 34 aa, Artificial Sequence
  Description of Artificial Sequence: Synthetic polypeptide
DEEEIRTTNPVATEQYGCVCSTNDHQHFNSNNQT

SEQ ID NO: 97181 - protein, 33 aa, Artificial Sequence
  Description of Artificial Sequence: Synthetic polypeptide
DEEEIRTTNPVATDQYGMVGSGNMNQGEGGNTG

SEQ ID NO: 97182 - protein, 34 aa, Artificial Sequence
  Description of Artificial Sequence: Synthetic polypeptide
DEEEIRTTNPVATEQYGCVCSTNDHQEYFNSDQT

SEQ ID NO: 97183 - protein, 29 aa, Artificial Sequence
  Description of Artificial Sequence: Synthetic peptide
SESEVRSTNPVATEQYGNVAETIMRVGNR

SEQ ID NO: 97184 - protein, 31 aa, Artificial Sequence
  Description of Artificial Sequence: Synthetic polypeptide
SETAEIACTNPVAYEQYGSVATNLQAPGERA

SEQ ID NO: 97185 - protein, 33 aa, Artificial Sequence
  Description of Artificial Sequence: Synthetic polypeptide
DEEEIRTTNPVATCQYGCVCSTGELQNFGSEQA

SEQ ID NO: 97186 - protein, 34 aa, Artificial Sequence
  Description of Artificial Sequence: Synthetic polypeptide
DEEEIRTTNPVATEQYGCVCSTGNDQENFGSDQP

SEQ ID NO: 97187 - protein, 34 aa, Artificial Sequence
  Description of Artificial Sequence: Synthetic polypeptide
DEEEIRTTNPVATEQYGCVCSTMEHQNFGSDNQE

SEQ ID NO: 97188 - protein, 30 aa, Artificial Sequence
  Description of Artificial Sequence: Synthetic polypeptide
SEVEIATTNPVAYEQYGSVATNLQMNPEGL

SEQ ID NO: 97189 - protein, 33 aa, Artificial Sequence
  Description of Artificial Sequence: Synthetic polypeptide
DEEEIRTTNPVATEQYGCVCSTGNHQNFTSDQI

SEQ ID NO: 97190 - protein, 34 aa, Artificial Sequence
  Description of Artificial Sequence: Synthetic polypeptide
DEEEIRTTNPVATEQYGCVCSTGNHQNFNSNPQL

SEQ ID NO: 97191 - protein, 34 aa, Artificial Sequence
  Description of Artificial Sequence: Synthetic polypeptide
DEEEIRTTNPVATEQYGCVCSTGNHQNFGSETQI

SEQ ID NO: 97192 - protein, 36 aa, Artificial Sequence
  Description of Artificial Sequence: Synthetic polypeptide
DEEEIRTTNPVATEAYGISVPSCTNEHSQERDMINR

SEQ ID NO: 97193 - protein, 34 aa, Artificial Sequence
  Description of Artificial Sequence: Synthetic polypeptide
DEEEIRTTNPVATEQYGCVCSTGNHQEYSNSNQT

SEQ ID NO: 97194 - protein, 33 aa, Artificial Sequence
  Description of Artificial Sequence: Synthetic polypeptide
DEEEIRTTNPVATEQYGCVCSTGNHQENISEQS

SEQ ID NO: 97195 - protein, 34 aa, Artificial Sequence
  Description of Artificial Sequence: Synthetic polypeptide
DEEEIRTTNPVATEQYGCVCSTGNHQENFGSEPQ

SEQ ID NO: 97196 - protein, 35 aa, Artificial Sequence
  Description of Artificial Sequence: Synthetic polypeptide
AEEEIRTTNPVATEQYGSVSNNNQLGNQQGTNENG

SEQ ID NO: 97197 - protein, 34 aa, Artificial Sequence
  Description of Artificial Sequence: Synthetic polypeptide
DEEEIRTTNPVATEQYGCVCSTGNHQEGSGSDQP

SEQ ID NO: 97198 - protein, 35 aa, Artificial Sequence
  Description of Artificial Sequence: Synthetic polypeptide
AEEEIRTTNPVATEQYGSVSNNNQLGNQQGNNANE

SEQ ID NO: 97199 - protein, 34 aa, Artificial Sequence
  Description of Artificial Sequence: Synthetic polypeptide
DEEEIRTTNPVATEQYGCVCSTGNHNQNFGSDQS

SEQ ID NO: 97200 - protein, 35 aa, Artificial Sequence
  Description of Artificial Sequence: Synthetic polypeptide
DEEEIRTTNPVATEQYGCVCSTGNHNQGFGSNFQS

SEQ ID NO: 97201 - protein, 34 aa, Artificial Sequence
  Description of Artificial Sequence: Synthetic polypeptide
DEEEIRTTNPVATEQYGCVCSTGNHNQFFGSDQM

SEQ ID NO: 97202 - protein, 35 aa, Artificial Sequence
  Description of Artificial Sequence: Synthetic polypeptide
DEEEIRTTNPVATEQYGCVCSTGNHNQEFFGSNQS

SEQ ID NO: 97203 - protein, 33 aa, Artificial Sequence
  Description of Artificial Sequence: Synthetic polypeptide
DEEEIRTTNPVATEQYGCVCSTGNHIGFQSEQS

SEQ ID NO: 97204 - protein, 35 aa, Artificial Sequence
  Description of Artificial Sequence: Synthetic polypeptide
DEEEIRTTNPVATEQYGCVCSTGNHEQNFGSNTQL

SEQ ID NO: 97205 - protein, 34 aa, Artificial Sequence
  Description of Artificial Sequence: Synthetic polypeptide
AEEEIRTTNPVATEQYGSVSNNNNQLGSETGTNA

SEQ ID NO: 97206 - protein, 34 aa, Artificial Sequence
  Description of Artificial Sequence: Synthetic polypeptide
DEEEIRTTNPVATEQYGCVCSTGNDTQFFGSEQS

SEQ ID NO: 97207 - protein, 34 aa, Artificial Sequence
  Description of Artificial Sequence: Synthetic polypeptide
DEEEIRTTNPVATEQYGCVCSTGNDQNFNSNNQM

SEQ ID NO: 97208 - protein, 34 aa, Artificial Sequence
  Description of Artificial Sequence: Synthetic polypeptide
DEEEIRTTNPVATEQYGCVCSTGNDQNFNSENQS

SEQ ID NO: 97209 - protein, 34 aa, Artificial Sequence
  Description of Artificial Sequence: Synthetic polypeptide
DEEEIRTTNPVATEQYGCVCSTGNDQNFNSDFQS

SEQ ID NO: 97210 - protein, 33 aa, Artificial Sequence
  Description of Artificial Sequence: Synthetic polypeptide
DEEEIRTTNPVATEQYGCVCSTGNHQNSISDQP

SEQ ID NO: 97211 - protein, 34 aa, Artificial Sequence
  Description of Artificial Sequence: Synthetic polypeptide
DEEEIRTTNPVATEAYGEVVSPANALSQDAGGDR

SEQ ID NO: 97212 - protein, 34 aa, Artificial Sequence
  Description of Artificial Sequence: Synthetic polypeptide
DEEEIRTTNPVATEAYGEVPSCTGDNQQMEEGNP

SEQ ID NO: 97213 - protein, 34 aa, Artificial Sequence
  Description of Artificial Sequence: Synthetic polypeptide
DEEEIRTTNPVATEQYGCVCSTGNLETNFGSEQA

SEQ ID NO: 97214 - protein, 34 aa, Artificial Sequence
  Description of Artificial Sequence: Synthetic polypeptide
DEEEIRTTNPVATEQYGCVCSTMEHNQNFGSNQM

SEQ ID NO: 97215 - protein, 32 aa, Artificial Sequence
  Description of Artificial Sequence: Synthetic polypeptide
SEVEISTTNPVATNQYGSVCTNQLQMSEGDRQ

SEQ ID NO: 97216 - protein, 35 aa, Artificial Sequence
  Description of Artificial Sequence: Synthetic polypeptide
DEEEIRTTNPVATEAWGISVRTWNDDDQDRRSGNR

SEQ ID NO: 97217 - protein, 33 aa, Artificial Sequence
  Description of Artificial Sequence: Synthetic polypeptide
DEEEIRTTNPVATEQYGCVCSTMAHQNFGSEQT

SEQ ID NO: 97218 - protein, 35 aa, Artificial Sequence
  Description of Artificial Sequence: Synthetic polypeptide
DEEEIRTTNPVATEQYGCVCSTLNLNEGEEESIRD

SEQ ID NO: 97219 - protein, 33 aa, Artificial Sequence
  Description of Artificial Sequence: Synthetic polypeptide
DEEEIRTTNPVATEQYGCVCSTGYPQYFGSEQL

SEQ ID NO: 97220 - protein, 33 aa, Artificial Sequence
  Description of Artificial Sequence: Synthetic polypeptide
DEEEIRTTNPVATEQYGCVCSTGYHQYFGSEQD

SEQ ID NO: 97221 - protein, 33 aa, Artificial Sequence
  Description of Artificial Sequence: Synthetic polypeptide
DEEEIRTTNPVATEQYGCVCSTGYDQGFNSDQD

SEQ ID NO: 97222 - protein, 31 aa, Artificial Sequence
  Description of Artificial Sequence: Synthetic polypeptide
SEYEIRCTNPVATEQYGCVCETGELQHGNQS

SEQ ID NO: 97223 - protein, 33 aa, Artificial Sequence
  Description of Artificial Sequence: Synthetic polypeptide
DEEEIRTTNPVATEQYGCVCSTGPLEGFGSDQS

SEQ ID NO: 97224 - protein, 34 aa, Artificial Sequence
  Description of Artificial Sequence: Synthetic polypeptide
DEEEIRTTNPVATEQYGCVCSTMEHQENGSNNQP

SEQ ID NO: 97225 - protein, 30 aa, Artificial Sequence
  Description of Artificial Sequence: Synthetic polypeptide
SEYEIRCTNPVATEQYGCVETELQHFGEQA

SEQ ID NO: 97226 - protein, 34 aa, Artificial Sequence
  Description of Artificial Sequence: Synthetic polypeptide
DEEEIRTTNPVATEQYGCVCSTGNTQNFNSQNQA

SEQ ID NO: 97227 - protein, 31 aa, Artificial Sequence
  Description of Artificial Sequence: Synthetic polypeptide
SEYEIRCTNPVATEQYGCVETELQHFGSNQN

SEQ ID NO: 97228 - protein, 30 aa, Artificial Sequence
  Description of Artificial Sequence: Synthetic polypeptide
SEYEIRCTNPVATEQYGCVETGELQHGSQQ

SEQ ID NO: 97229 - protein, 34 aa, Artificial Sequence
  Description of Artificial Sequence: Synthetic polypeptide
DEEEIRTTNPVATEQYGCVCSTGNTQFFGSETQF

SEQ ID NO: 97230 - protein, 33 aa, Artificial Sequence
  Description of Artificial Sequence: Synthetic polypeptide
DEEEIRTTNPVATEQYGCVCSTGNTAGFGSEQT

SEQ ID NO: 97231 - protein, 31 aa, Artificial Sequence
  Description of Artificial Sequence: Synthetic polypeptide
SEYEIRCTNPVATEQYGCVETGNLQHSGSDQ

SEQ ID NO: 97232 - protein, 34 aa, Artificial Sequence
  Description of Artificial Sequence: Synthetic polypeptide
DEEEIRTTNPVATEQYGCVCSTGNPHQNFGSDQL

SEQ ID NO: 97233 - protein, 32 aa, Artificial Sequence
  Description of Artificial Sequence: Synthetic polypeptide
DEEEIRTTNPVATEAYGCICSSNEQRFNSNFA

SEQ ID NO: 97234 - protein, 32 aa, Artificial Sequence
  Description of Artificial Sequence: Synthetic polypeptide
DEEEIRTTNPVATEAYGCICSTNEQNFNSQFA

SEQ ID NO: 97235 - protein, 33 aa, Artificial Sequence
  Description of Artificial Sequence: Synthetic polypeptide
DEEEIRTTNPVATEAYGCSCSTGNEQNFNSDQA

SEQ ID NO: 97236 - protein, 33 aa, Artificial Sequence
  Description of Artificial Sequence: Synthetic polypeptide
DEEEIRTTNPVATEQYGCVCSTGPDENFGSNQA

SEQ ID NO: 97237 - protein, 33 aa, Artificial Sequence
  Description of Artificial Sequence: Synthetic polypeptide
QEEEIATTNPVSTEQYGIVSTNLPNMRNGMTPR

SEQ ID NO: 97238 - protein, 36 aa, Artificial Sequence
  Description of Artificial Sequence: Synthetic polypeptide
AEEEIRTTNPVATEQYGSVSTVVNQLGNQEGNNVEM

SEQ ID NO: 97239 - protein, 33 aa, Artificial Sequence
  Description of Artificial Sequence: Synthetic polypeptide
AEEEIRTTNPVATEQYGSVVVTSNLNNTATNNE

SEQ ID NO: 97240 - protein, 35 aa, Artificial Sequence
  Description of Artificial Sequence: Synthetic polypeptide
DEEEIRTTNPVATEQYGSVNSTSDDQQYEGENDQD

SEQ ID NO: 97241 - protein, 33 aa, Artificial Sequence
  Description of Artificial Sequence: Synthetic polypeptide
QEEEIATTNPVATEQYGCVAATNLQERGGGDEL

SEQ ID NO: 97242 - protein, 31 aa, Artificial Sequence
  Description of Artificial Sequence: Synthetic polypeptide
QEEEIACTNPVATEPYGSVATNLNRGGPESL

SEQ ID NO: 97243 - protein, 32 aa, Artificial Sequence
  Description of Artificial Sequence: Synthetic polypeptide
DEEEIRTTNPVATEQYGSVQPMTGEADNPERE

SEQ ID NO: 97244 - protein, 32 aa, Artificial Sequence
  Description of Artificial Sequence: Synthetic polypeptide
DEEEIACTNPVAYEQYGSVATNDQTGTADERG

SEQ ID NO: 97245 - protein, 32 aa, Artificial Sequence
  Description of Artificial Sequence: Synthetic polypeptide
QEEEIATTNPVATEQYGCVAATNLQMEGGGTA

SEQ ID NO: 97246 - protein, 35 aa, Artificial Sequence
  Description of Artificial Sequence: Synthetic polypeptide
DEEEIRTTNPVATEQYGSVISPTTGLVPQYVSERD

SEQ ID NO: 97247 - protein, 32 aa, Artificial Sequence
  Description of Artificial Sequence: Synthetic polypeptide
DEEEIACTNPVAYEQYGSVATNLQANPSGETT

SEQ ID NO: 97248 - protein, 31 aa, Artificial Sequence
  Description of Artificial Sequence: Synthetic polypeptide
DEEEIACTNPVAYEQYGSVATNLQANPVEHQ

SEQ ID NO: 97249 - protein, 32 aa, Artificial Sequence
  Description of Artificial Sequence: Synthetic polypeptide
DEEEIRTTNPVATEQYGSVQPMNEIELAIMLN

SEQ ID NO: 97250 - protein, 32 aa, Artificial Sequence
  Description of Artificial Sequence: Synthetic polypeptide
QEEEIATTNPVATEQYGCVAATNLQQGGGDLL

SEQ ID NO: 97251 - protein, 32 aa, Artificial Sequence
  Description of Artificial Sequence: Synthetic polypeptide
QEEEIATTNPVATEQYGCVAATNLTRGGGDTL

SEQ ID NO: 97252 - protein, 36 aa, Artificial Sequence
  Description of Artificial Sequence: Synthetic polypeptide
DEEEIRTTNPVATEQYGSVISPTTNLVVTPGQNEDM

SEQ ID NO: 97253 - protein, 33 aa, Artificial Sequence
  Description of Artificial Sequence: Synthetic polypeptide
DEEEIACTNPVAYEQYGSVATNLQDGAPMEGNF

SEQ ID NO: 97254 - protein, 31 aa, Artificial Sequence
  Description of Artificial Sequence: Synthetic polypeptide
NEEEIACTNPVATEQYGSVATNLQAEEDTLM

SEQ ID NO: 97255 - protein, 34 aa, Artificial Sequence
  Description of Artificial Sequence: Synthetic polypeptide
DEEEIRTTNPVATEQYGSVSITEGDLTDLNDIDG

SEQ ID NO: 97256 - protein, 35 aa, Artificial Sequence
  Description of Artificial Sequence: Synthetic polypeptide
DEEEIRTTNPVATEQYGSVISPTTSLVPRELVSER

SEQ ID NO: 97257 - protein, 33 aa, Artificial Sequence
  Description of Artificial Sequence: Synthetic polypeptide
DEECIRTTNPVATEQWGSVIATNNLQLYDVNIE

SEQ ID NO: 97258 - protein, 33 aa, Artificial Sequence
  Description of Artificial Sequence: Synthetic polypeptide
DEEEIATTNPVATEQYGCVADTWLAQARSENGN

SEQ ID NO: 97259 - protein, 31 aa, Artificial Sequence
  Description of Artificial Sequence: Synthetic polypeptide
NEEEIACTNPVATEQYGSVATHLQDSGGETN

SEQ ID NO: 97260 - protein, 30 aa, Artificial Sequence
  Description of Artificial Sequence: Synthetic polypeptide
AEMEIATTNPVATEQYGTASTGPVEFEGNR

SEQ ID NO: 97261 - protein, 33 aa, Artificial Sequence
  Description of Artificial Sequence: Synthetic polypeptide
DEEEIACTNPVAYEQYGSVATNLQETPGEDQRE

SEQ ID NO: 97262 - protein, 31 aa, Artificial Sequence
  Description of Artificial Sequence: Synthetic polypeptide
MEEEIRCTNPAATEQYGSVVSENGMGGNGGG

SEQ ID NO: 97263 - protein, 30 aa, Artificial Sequence
  Description of Artificial Sequence: Synthetic polypeptide
QEEEIACTNPVATEQWGCVATNLQAEEDTR

SEQ ID NO: 97264 - protein, 29 aa, Artificial Sequence
  Description of Artificial Sequence: Synthetic peptide
NEEEIASVNPVCTEQYGVVSWNHQSFGNQ

SEQ ID NO: 97265 - protein, 30 aa, Artificial Sequence
  Description of Artificial Sequence: Synthetic polypeptide
QEEEIATTNPVATEQYGEASEVGQRNGEPK

SEQ ID NO: 97266 - protein, 34 aa, Artificial Sequence
  Description of Artificial Sequence: Synthetic polypeptide
DEEEIRTTNPVATEQYGSVISPTNPPQMISEDLT

SEQ ID NO: 97267 - protein, 33 aa, Artificial Sequence
  Description of Artificial Sequence: Synthetic polypeptide
FEEEIRTTNPVATEQYGDVANTGGNGQGGNENG

SEQ ID NO: 97268 - protein, 35 aa, Artificial Sequence
  Description of Artificial Sequence: Synthetic polypeptide
DEEEIRTTNPVATEQYGSVNSTSIDDIQRVGEHQQ

SEQ ID NO: 97269 - protein, 33 aa, Artificial Sequence
  Description of Artificial Sequence: Synthetic polypeptide
DEEEIATTNPVATEQYGCVADTWMLDGRSQNRD

SEQ ID NO: 97270 - protein, 34 aa, Artificial Sequence
  Description of Artificial Sequence: Synthetic polypeptide
DEEEIRTTNPVATEQYGSVQNTFNLEDGGGETIT

SEQ ID NO: 97271 - protein, 33 aa, Artificial Sequence
  Description of Artificial Sequence: Synthetic polypeptide
DEEEIRTTNPVATEQYGSVQNTGEQINTLEQGQ

SEQ ID NO: 97272 - protein, 33 aa, Artificial Sequence
  Description of Artificial Sequence: Synthetic polypeptide
QEEEIATTNPVATEQYGCVAATNDQTGTGDNRL

SEQ ID NO: 97273 - protein, 32 aa, Artificial Sequence
  Description of Artificial Sequence: Synthetic polypeptide
FEEEIRTTNPVATEQYGAVVNTVGQGQGNENG

SEQ ID NO: 97274 - protein, 31 aa, Artificial Sequence
  Description of Artificial Sequence: Synthetic polypeptide
NEEEIACTNPVAYEQYGSVATNLQGNPEGEH

SEQ ID NO: 97275 - protein, 36 aa, Artificial Sequence
  Description of Artificial Sequence: Synthetic polypeptide
DEEEIRTTNPVATEQYGSVNSTSGENQLQYDGQEEE

SEQ ID NO: 97276 - protein, 34 aa, Artificial Sequence
  Description of Artificial Sequence: Synthetic polypeptide
FEEEIRTTNPVATEQYGCVSTGDLDQNEGGGGNG

SEQ ID NO: 97277 - protein, 32 aa, Artificial Sequence
  Description of Artificial Sequence: Synthetic polypeptide
AEEEIRTTNPVATEQYGVVSSVNQQQTNGTIF

SEQ ID NO: 97278 - protein, 34 aa, Artificial Sequence
  Description of Artificial Sequence: Synthetic polypeptide
DEEEIRTTNPVATEQYGSVNSTSFDMPRGEIEGA

SEQ ID NO: 97279 - protein, 35 aa, Artificial Sequence
  Description of Artificial Sequence: Synthetic polypeptide
DEEEIRTTNPVATEQYGSVNMTNGIGQEDTGNQGE

SEQ ID NO: 97280 - protein, 34 aa, Artificial Sequence
  Description of Artificial Sequence: Synthetic polypeptide
FEEEIRTTNPVATEQYGCVCSTGELNQSFGSNTQ

SEQ ID NO: 97281 - protein, 34 aa, Artificial Sequence
  Description of Artificial Sequence: Synthetic polypeptide
QEEEIATTNPVATEQYGCVAATNLQENGGGDNRL

SEQ ID NO: 97282 - protein, 32 aa, Artificial Sequence
  Description of Artificial Sequence: Synthetic polypeptide
NEEEIACTNPVATEQYGSVATNLQEAEEDTRS

SEQ ID NO: 97283 - protein, 35 aa, Artificial Sequence
  Description of Artificial Sequence: Synthetic polypeptide
AEEEIRTTNPVATEQYGSVVTVNTNLQSGTDNGTE

SEQ ID NO: 97284 - protein, 34 aa, Artificial Sequence
  Description of Artificial Sequence: Synthetic polypeptide
DEEEIRTTNPVATEQYGSVISPTPMQIQMINEND

SEQ ID NO: 97285 - protein, 29 aa, Artificial Sequence
  Description of Artificial Sequence: Synthetic peptide
NEEEIASVNPVCTEQYGVVSYDNDQSGNQ

SEQ ID NO: 97286 - protein, 33 aa, Artificial Sequence
  Description of Artificial Sequence: Synthetic polypeptide
DEEEIRTTNPVATEQYGSVSITDTQQQTTEVVD

SEQ ID NO: 97287 - protein, 35 aa, Artificial Sequence
  Description of Artificial Sequence: Synthetic polypeptide
DEEEIRTTNPVATEQYGSVISPTTYLGVPQNVSER

SEQ ID NO: 97288 - protein, 34 aa, Artificial Sequence
  Description of Artificial Sequence: Synthetic polypeptide
DEEEIRTTNPVATEQYGSVISPWNTEIDREVNML

SEQ ID NO: 97289 - protein, 35 aa, Artificial Sequence
  Description of Artificial Sequence: Synthetic polypeptide
DEEEIRTTNPVATEQYGSVISPWPLTEQDRENEMN

SEQ ID NO: 97290 - protein, 33 aa, Artificial Sequence
  Description of Artificial Sequence: Synthetic polypeptide
AEEEIRTTNPVATEQYGSVVTVNTNDDEGVNNT

SEQ ID NO: 97291 - protein, 33 aa, Artificial Sequence
  Description of Artificial Sequence: Synthetic polypeptide
DTEEIRTTNPVATTQYGSVSTESGTTQNGNNGN

SEQ ID NO: 97292 - protein, 34 aa, Artificial Sequence
  Description of Artificial Sequence: Synthetic polypeptide
DEEEIATTNPVATEQYGCVAATNLATAGIGENRD

SEQ ID NO: 97293 - protein, 33 aa, Artificial Sequence
  Description of Artificial Sequence: Synthetic polypeptide
AEEEIRTTNPVATEQYGVVSTQNQLQINTTEDT

SEQ ID NO: 97294 - protein, 28 aa, Artificial Sequence
  Description of Artificial Sequence: Synthetic peptide
QEEEIATTNPVATEQYGEASEVCQHEEQ

SEQ ID NO: 97295 - protein, 31 aa, Artificial Sequence
  Description of Artificial Sequence: Synthetic polypeptide
DEEEIACTNPVAYEQYGSVATNLQVNDTAME

SEQ ID NO: 97296 - protein, 32 aa, Artificial Sequence
  Description of Artificial Sequence: Synthetic polypeptide
DEEEIATTNPVATEQYGCVAATNLAANPGSGD

SEQ ID NO: 97297 - protein, 36 aa, Artificial Sequence
  Description of Artificial Sequence: Synthetic polypeptide
DEEEIRTTNPVATEQYGSVSITDDLEQPVDVNQDRF

SEQ ID NO: 97298 - protein, 34 aa, Artificial Sequence
  Description of Artificial Sequence: Synthetic polypeptide
DEEEIRTTNPVATEQYGSVSITDDDTNEMGSNAG

SEQ ID NO: 97299 - protein, 31 aa, Artificial Sequence
  Description of Artificial Sequence: Synthetic polypeptide
DEEEIATTNPVATEQYGCVAATNDTDPQEND

SEQ ID NO: 97300 - protein, 35 aa, Artificial Sequence
  Description of Artificial Sequence: Synthetic polypeptide
DTEEIRTTNPVATTQYGSVSTQSGTNLQAGNNNDE

SEQ ID NO: 97301 - protein, 34 aa, Artificial Sequence
  Description of Artificial Sequence: Synthetic polypeptide
FEEEIRTTNPVATEQYGAVSGTMNNNEQGGGGNE

SEQ ID NO: 97302 - protein, 33 aa, Artificial Sequence
  Description of Artificial Sequence: Synthetic polypeptide
DEEEIRTTNPVATEQYGSVSENLPEVAILDTHM

SEQ ID NO: 97303 - protein, 35 aa, Artificial Sequence
  Description of Artificial Sequence: Synthetic polypeptide
DEEEIRTTNPVATEQYGSVNSTNPDDEGGGNEEIP

SEQ ID NO: 97304 - protein, 32 aa, Artificial Sequence
  Description of Artificial Sequence: Synthetic polypeptide
DEEEIACTNPVAYEQYGSVATNLTTPGEDTRG

SEQ ID NO: 97305 - protein, 31 aa, Artificial Sequence
  Description of Artificial Sequence: Synthetic polypeptide
NEEEIACTNPVATEQWGSVATNDQRGMDTVM

SEQ ID NO: 97306 - protein, 33 aa, Artificial Sequence
  Description of Artificial Sequence: Synthetic polypeptide
NNEEIRTTNPVATEQYGVVWTQNLEQDGGPNIM

SEQ ID NO: 97307 - protein, 32 aa, Artificial Sequence
  Description of Artificial Sequence: Synthetic polypeptide
NNEEIRTTNPVATEQYGVVWTQNLQDGGPETQ

SEQ ID NO: 97308 - protein, 34 aa, Artificial Sequence
  Description of Artificial Sequence: Synthetic polypeptide
DTEEIRTTNPVATTQYGSVSTNQNGNQNGTNGQV

SEQ ID NO: 97309 - protein, 28 aa, Artificial Sequence
  Description of Artificial Sequence: Synthetic peptide
QEEEIATTNPVATEQYGEASEVEQHEEK

SEQ ID NO: 97310 - protein, 28 aa, Artificial Sequence
  Description of Artificial Sequence: Synthetic peptide
QEEEIATTNPVATEQYGEASEVCQHEEV

SEQ ID NO: 97311 - protein, 31 aa, Artificial Sequence
  Description of Artificial Sequence: Synthetic polypeptide
QEEEIATTNPVATEQYGCVAGTALADNSENR

SEQ ID NO: 97312 - protein, 34 aa, Artificial Sequence
  Description of Artificial Sequence: Synthetic polypeptide
DEEEIRTTNPVATEQYGSVSITDQLTVDQGEIED

SEQ ID NO: 97313 - protein, 34 aa, Artificial Sequence
  Description of Artificial Sequence: Synthetic polypeptide
DEECIRTTNPVATEQWGSVSCTVNELSQMPGGMS

SEQ ID NO: 97314 - protein, 35 aa, Artificial Sequence
  Description of Artificial Sequence: Synthetic polypeptide
DEEEIRTTNPVATEQYGSVSITDNDTNEMGSNTGG

SEQ ID NO: 97315 - protein, 35 aa, Artificial Sequence
  Description of Artificial Sequence: Synthetic polypeptide
DEEEIRTTNPVATEQYGSVSITDNDTNEMGSNIND

SEQ ID NO: 97316 - protein, 32 aa, Artificial Sequence
  Description of Artificial Sequence: Synthetic polypeptide
DEEEIACTNPVAYEQYGSVATNLQGAPAEGGE

SEQ ID NO: 97317 - protein, 35 aa, Artificial Sequence
  Description of Artificial Sequence: Synthetic polypeptide
DEEEIRTTNPVATEQYGSVMGGTNDQEQEEGGGNG

SEQ ID NO: 97318 - protein, 28 aa, Artificial Sequence
  Description of Artificial Sequence: Synthetic peptide
QEEEIATTNPVATEQYGEASEVEQHEDK

SEQ ID NO: 97319 - protein, 32 aa, Artificial Sequence
  Description of Artificial Sequence: Synthetic polypeptide
DEEEIACTNPVAYEQYGSVATNLQGAPMEGTH

SEQ ID NO: 97320 - protein, 35 aa, Artificial Sequence
  Description of Artificial Sequence: Synthetic polypeptide
DEEEIRTTNPVATEQYGSVSITDNDTNEMGGNATV

SEQ ID NO: 97321 - protein, 33 aa, Artificial Sequence
  Description of Artificial Sequence: Synthetic polypeptide
DTEEIRTTNPVATTQYGSVSTENGTENGNNNDN

SEQ ID NO: 97322 - protein, 34 aa, Artificial Sequence
  Description of Artificial Sequence: Synthetic polypeptide
DEEEIRTTNPVATEQYGSVISPTVEIIERGQEQF

SEQ ID NO: 97323 - protein, 29 aa, Artificial Sequence
  Description of Artificial Sequence: Synthetic peptide
QEEEIATTNPVATEQYGEASEVCQREEEK

SEQ ID NO: 97324 - protein, 33 aa, Artificial Sequence
  Description of Artificial Sequence: Synthetic polypeptide
DEEEIRTTNPVATEQYGSVNNANDEQAEQNEKV

SEQ ID NO: 97325 - protein, 31 aa, Artificial Sequence
  Description of Artificial Sequence: Synthetic polypeptide
NEEEIACTNPVATEQYGCVATNLQADPNDND

SEQ ID NO: 97326 - protein, 28 aa, Artificial Sequence
  Description of Artificial Sequence: Synthetic peptide
QEEEIATTNPVATEQYGEASEVCQHETK

SEQ ID NO: 97327 - protein, 29 aa, Artificial Sequence
  Description of Artificial Sequence: Synthetic peptide
QEEEIATTNPVATEQYGEASEVCQHEGEK

SEQ ID NO: 97328 - protein, 35 aa, Artificial Sequence
  Description of Artificial Sequence: Synthetic polypeptide
DEEEIRTTNPVATEQYGSVISPWNGTEQDRENEMG

SEQ ID NO: 97329 - protein, 30 aa, Artificial Sequence
  Description of Artificial Sequence: Synthetic polypeptide
QEEEIATTNPVATEQYGCVAGTALADGEAH

SEQ ID NO: 97330 - protein, 32 aa, Artificial Sequence
  Description of Artificial Sequence: Synthetic polypeptide
DEEEIACTNPVAYEQYGSVATNLQGNPMEDNP

SEQ ID NO: 97331 - protein, 33 aa, Artificial Sequence
  Description of Artificial Sequence: Synthetic polypeptide
DEEEIACTNPVAYEQYGSVATNLQGTPGEDTRM

SEQ ID NO: 97332 - protein, 33 aa, Artificial Sequence
  Description of Artificial Sequence: Synthetic polypeptide
FEEEIRTTNPVATEQYGAVSNNDNGQGGGNDDD

SEQ ID NO: 97333 - protein, 31 aa, Artificial Sequence
  Description of Artificial Sequence: Synthetic polypeptide
DEEEIATTNPVATEQYGCVAATNDTADENNN

SEQ ID NO: 97334 - protein, 29 aa, Artificial Sequence
  Description of Artificial Sequence: Synthetic peptide
NEEEIASVNPVGTEQYGVVSDNLTSGNEQ

SEQ ID NO: 97335 - protein, 33 aa, Artificial Sequence
  Description of Artificial Sequence: Synthetic polypeptide
MEEEIRCTNPAATEQYGSVSIENMLMRGGNGQE

SEQ ID NO: 97336 - protein, 34 aa, Artificial Sequence
  Description of Artificial Sequence: Synthetic polypeptide
DTEEIRTTNPVATEQYGSVSGAMDLEQPHGMNQT

SEQ ID NO: 97337 - protein, 32 aa, Artificial Sequence
  Description of Artificial Sequence: Synthetic polypeptide
QEEEIACTNPVATEQYGCVATNLDERGDNMTP

SEQ ID NO: 97338 - protein, 34 aa, Artificial Sequence
  Description of Artificial Sequence: Synthetic polypeptide
AEEEIRTTNPVATEQYGVVSVTENGNQNGNNNDT

SEQ ID NO: 97339 - protein, 32 aa, Artificial Sequence
  Description of Artificial Sequence: Synthetic polypeptide
FEEEIRTTNPVATEQYGSVATGGQGNGEFTEG

SEQ ID NO: 97340 - protein, 32 aa, Artificial Sequence
  Description of Artificial Sequence: Synthetic polypeptide
MEEEIMTTNPVATEQYGNCSVGMLQGGQNDRF

SEQ ID NO: 97341 - protein, 34 aa, Artificial Sequence
  Description of Artificial Sequence: Synthetic polypeptide
DEEEIRTTNPVATEQYGSVQLTPLINRDGIMEES

SEQ ID NO: 97342 - protein, 31 aa, Artificial Sequence
  Description of Artificial Sequence: Synthetic polypeptide
QEEEIACTNPVATEQYGCVATNLARPGEDKA

SEQ ID NO: 97343 - protein, 32 aa, Artificial Sequence
  Description of Artificial Sequence: Synthetic polypeptide
DEEEIACTNPVAYEQYGCVATNLQDADGNAAE

SEQ ID NO: 97344 - protein, 31 aa, Artificial Sequence
  Description of Artificial Sequence: Synthetic polypeptide
NEEEIATTNPVATEQYGCTATHLQPDQEGGR

SEQ ID NO: 97345 - protein, 32 aa, Artificial Sequence
  Description of Artificial Sequence: Synthetic polypeptide
NEEEIATTNPVATEQYGCVAANNLQENGDNQM

SEQ ID NO: 97346 - protein, 34 aa, Artificial Sequence
  Description of Artificial Sequence: Synthetic polypeptide
FEEEIRTTNPVATEQYGNVVSGTMNNEQGGGGNE

SEQ ID NO: 97347 - protein, 35 aa, Artificial Sequence
  Description of Artificial Sequence: Synthetic polypeptide
DEEEIRTTNPVATEQYGSVMGNLQGGNGQTGNQGY

SEQ ID NO: 97348 - protein, 36 aa, Artificial Sequence
  Description of Artificial Sequence: Synthetic polypeptide
DTEEIRTTNPVATEQYGSVSTVTNLQAGNQEEEEDE

SEQ ID NO: 97349 - protein, 28 aa, Artificial Sequence
  Description of Artificial Sequence: Synthetic peptide
QEEEIATTNPVATEQYGEATNVTQEEEQ

SEQ ID NO: 97350 - protein, 33 aa, Artificial Sequence
  Description of Artificial Sequence: Synthetic polypeptide
DEEEIRTTNPVATEQYGSVISPPPIQQDTGILN

SEQ ID NO: 97351 - protein, 35 aa, Artificial Sequence
  Description of Artificial Sequence: Synthetic polypeptide
DEEEIRTTNPVATEQYGSVMGNLNGGNGQTGNQTG

SEQ ID NO: 97352 - protein, 33 aa, Artificial Sequence
  Description of Artificial Sequence: Synthetic polypeptide
AEEEIRTTNPVATEQYGSVVTVQNLQQEDEQET

SEQ ID NO: 97353 - protein, 33 aa, Artificial Sequence
  Description of Artificial Sequence: Synthetic polypeptide
FEEEIRTTNPVATEQYGNVVGTMNNGQGGGGNE

SEQ ID NO: 97354 - protein, 36 aa, Artificial Sequence
  Description of Artificial Sequence: Synthetic polypeptide
DEEEIRTTNPVATEQYGSVNSTTNFEDQASGEEERQ

SEQ ID NO: 97355 - protein, 35 aa, Artificial Sequence
  Description of Artificial Sequence: Synthetic polypeptide
DEEEIRTTNPVATEQYGSVMGNLIGGNGQTGNNQN

SEQ ID NO: 97356 - protein, 34 aa, Artificial Sequence
  Description of Artificial Sequence: Synthetic polypeptide
AEEEIRTTNPVATEQYGSVVVTNNNLNNTNGNND

SEQ ID NO: 97357 - protein, 32 aa, Artificial Sequence
  Description of Artificial Sequence: Synthetic polypeptide
NEEEIATTNPVATEQYGCIAGTNHLQPDNQGR

SEQ ID NO: 97358 - protein, 31 aa, Artificial Sequence
  Description of Artificial Sequence: Synthetic polypeptide
QEEEIACTNPVATEQYGCVATNLQADEDTRQ

SEQ ID NO: 97359 - protein, 32 aa, Artificial Sequence
  Description of Artificial Sequence: Synthetic polypeptide
DEECIRTTNPVATEIYGCVCGTPLQYFGSNQA

SEQ ID NO: 97360 - protein, 32 aa, Artificial Sequence
  Description of Artificial Sequence: Synthetic polypeptide
DTEEIRTTNPVATEQWGVVTVTNLLGQQGTEE

SEQ ID NO: 97361 - protein, 32 aa, Artificial Sequence
  Description of Artificial Sequence: Synthetic polypeptide
DTEEIRTTNPVATEQWGVVTVTNLLQQGTTDE

SEQ ID NO: 97362 - protein, 31 aa, Artificial Sequence
  Description of Artificial Sequence: Synthetic polypeptide
FEEEIRTTNPVATEQYGSVGDGNDDENINEG

SEQ ID NO: 97363 - protein, 35 aa, Artificial Sequence
  Description of Artificial Sequence: Synthetic polypeptide
DEEEIRTTNPVATEQYGSVISPEILLQVRETNQML

SEQ ID NO: 97364 - protein, 32 aa, Artificial Sequence
  Description of Artificial Sequence: Synthetic polypeptide
DTEEIRTTNPVATEQWGVVVTVTNLLQNQGTE

SEQ ID NO: 97365 - protein, 33 aa, Artificial Sequence
  Description of Artificial Sequence: Synthetic polypeptide
DTEEIRTTNPVATEQWGVVVTVTNLLQQNGNTE

SEQ ID NO: 97366 - protein, 33 aa, Artificial Sequence
  Description of Artificial Sequence: Synthetic polypeptide
DTEEIRTTNPVATEQWGVVVTVTNLNLQQGNTE

SEQ ID NO: 97367 - protein, 34 aa, Artificial Sequence
  Description of Artificial Sequence: Synthetic polypeptide
DEEEIRTTNPVATEQYGSVSATDGPEDRNGMEPV

SEQ ID NO: 97368 - protein, 32 aa, Artificial Sequence
  Description of Artificial Sequence: Synthetic polypeptide
QEEEIACTNPVATEQYGCVATNLQAIEEGTRM

SEQ ID NO: 97369 - protein, 35 aa, Artificial Sequence
  Description of Artificial Sequence: Synthetic polypeptide
DEEEIRTTNPVATEQYGSVMGNLTGGNGQTGNGNN

SEQ ID NO: 97370 - protein, 34 aa, Artificial Sequence
  Description of Artificial Sequence: Synthetic polypeptide
FEEEIRTTNPVATEQYGSVDTTTNDQQGGGNDET

SEQ ID NO: 97371 - protein, 34 aa, Artificial Sequence
  Description of Artificial Sequence: Synthetic polypeptide
FEEEIRTTNPVATEQYGSVDSGMTGEQEEEGGNE

SEQ ID NO: 97372 - protein, 34 aa, Artificial Sequence
  Description of Artificial Sequence: Synthetic polypeptide
AEEEIRTTNPVATEQYGVVSVTNLEQGVTNNDNI

SEQ ID NO: 97373 - protein, 32 aa, Artificial Sequence
  Description of Artificial Sequence: Synthetic polypeptide
QEEEIACTNPVATEQYGCVATNLQAEDSNERV

SEQ ID NO: 97374 - protein, 30 aa, Artificial Sequence
  Description of Artificial Sequence: Synthetic polypeptide
QEEEIACTNPVATEQYGCVATNLQAEDPGH

SEQ ID NO: 97375 - protein, 34 aa, Artificial Sequence
  Description of Artificial Sequence: Synthetic polypeptide
QEEEIATTNPVATEPYGSVAATPNLQDDGTGNRV

SEQ ID NO: 97376 - protein, 33 aa, Artificial Sequence
  Description of Artificial Sequence: Synthetic polypeptide
NEEEIATTNPVATEQYGCVATNNLENMGENDRH

SEQ ID NO: 97377 - protein, 33 aa, Artificial Sequence
  Description of Artificial Sequence: Synthetic polypeptide
DEECIRTTNPVATEIYGCVCGTENLQYFGSNQS

SEQ ID NO: 97378 - protein, 31 aa, Artificial Sequence
  Description of Artificial Sequence: Synthetic polypeptide
QEEEIACTNPVATEQYGCVATNLQAEDNEDE

SEQ ID NO: 97379 - protein, 33 aa, Artificial Sequence
  Description of Artificial Sequence: Synthetic polypeptide
DEECIRTTNPVATEIYGCVCGTGNLQSFGSNQA

SEQ ID NO: 97380 - protein, 33 aa, Artificial Sequence
  Description of Artificial Sequence: Synthetic polypeptide
DEEEIATTNPVATEQYGCVCSNTELQNFGSDQL

SEQ ID NO: 97381 - protein, 35 aa, Artificial Sequence
  Description of Artificial Sequence: Synthetic polypeptide
DEEEIRTTNPVATEQYGSVNMTNGIGQEDGGNQGF

SEQ ID NO: 97382 - protein, 34 aa, Artificial Sequence
  Description of Artificial Sequence: Synthetic polypeptide
DEEEIRTTNPVATEQYGSVMGNLDSGQGEITNEG

SEQ ID NO: 97383 - protein, 34 aa, Artificial Sequence
  Description of Artificial Sequence: Synthetic polypeptide
DEEEIRTTNPVATEQYGSVISPSQQLEQISNVES

SEQ ID NO: 97384 - protein, 34 aa, Artificial Sequence
  Description of Artificial Sequence: Synthetic polypeptide
FEEEIRTTNPVATEQYGNVSGTMNAGQGEGGNEQ

SEQ ID NO: 97385 - protein, 35 aa, Artificial Sequence
  Description of Artificial Sequence: Synthetic polypeptide
DEEEIRTTNPVATEQYGSVISPTNFMEGRINNNEI

SEQ ID NO: 97386 - protein, 33 aa, Artificial Sequence
  Description of Artificial Sequence: Synthetic polypeptide
FEEEIRTTNPVATEQYGNVMTGTNDQEEGGGNI

SEQ ID NO: 97387 - protein, 32 aa, Artificial Sequence
  Description of Artificial Sequence: Synthetic polypeptide
QEEEIATTNPVATEQWGSVSENLDQHIDNQDM

SEQ ID NO: 97388 - protein, 33 aa, Artificial Sequence
  Description of Artificial Sequence: Synthetic polypeptide
DEEEIRTTNPVATEQYGSVSEMPGLMPGVEGDI

SEQ ID NO: 97389 - protein, 33 aa, Artificial Sequence
  Description of Artificial Sequence: Synthetic polypeptide
FEEEIRTTNPVATEQYGDVVTGIQNDEGQGGNE

SEQ ID NO: 97390 - protein, 34 aa, Artificial Sequence
  Description of Artificial Sequence: Synthetic polypeptide
FEEEIRTTNPVATEQYGDVSTGQNGQQGEGGGNV

SEQ ID NO: 97391 - protein, 32 aa, Artificial Sequence
  Description of Artificial Sequence: Synthetic polypeptide
DEEEIATTNPVATEQYGCVATALTQENINEAP

SEQ ID NO: 97392 - protein, 35 aa, Artificial Sequence
  Description of Artificial Sequence: Synthetic polypeptide
DEEEIRTTNPVATEQYGSVQLTVNGLDQQEMMNDE

SEQ ID NO: 97393 - protein, 35 aa, Artificial Sequence
  Description of Artificial Sequence: Synthetic polypeptide
AEEEIRTTNPVATEQYGTVSTTNNLQQGNQGTIQE

SEQ ID NO: 97394 - protein, 32 aa, Artificial Sequence
  Description of Artificial Sequence: Synthetic polypeptide
FEEEIRTTNPVATEQYGDVSIVVNGTGTGENI

SEQ ID NO: 97395 - protein, 28 aa, Artificial Sequence
  Description of Artificial Sequence: Synthetic peptide
QEEEIATTNPVATEQYGEASTDCEHEEK

SEQ ID NO: 97396 - protein, 35 aa, Artificial Sequence
  Description of Artificial Sequence: Synthetic polypeptide
DEEEIRTTNPVATEQYGSVQLYDELQPRFNEQVRL

SEQ ID NO: 97397 - protein, 31 aa, Artificial Sequence
  Description of Artificial Sequence: Synthetic polypeptide
NEEEIATTNPVATEQWGAVATNLQDNPNGVE

SEQ ID NO: 97398 - protein, 31 aa, Artificial Sequence
  Description of Artificial Sequence: Synthetic polypeptide
NEEEIATTNPVATEMWGSVSANNLDENGENQ

SEQ ID NO: 97399 - protein, 34 aa, Artificial Sequence
  Description of Artificial Sequence: Synthetic polypeptide
AEEEIRTTNPVATEQYGSVVVTNNLGNEAGNNVG

SEQ ID NO: 97400 - protein, 31 aa, Artificial Sequence
  Description of Artificial Sequence: Synthetic polypeptide
QEEEIACTNPVATEQWGCVATNLQTEDGNEH

SEQ ID NO: 97401 - protein, 34 aa, Artificial Sequence
  Description of Artificial Sequence: Synthetic polypeptide
DEEEIRTTNPVATEQYGSVQNCNNLQIVGEDQGI

SEQ ID NO: 97402 - protein, 33 aa, Artificial Sequence
  Description of Artificial Sequence: Synthetic polypeptide
DEEEIATTNPVATEQYGCVAMTNLNIDGMEDRN

SEQ ID NO: 97403 - protein, 32 aa, Artificial Sequence
  Description of Artificial Sequence: Synthetic polypeptide
DEEEIATTNPVATEQYGCVAMNNLNGAGMGDR

SEQ ID NO: 97404 - protein, 34 aa, Artificial Sequence
  Description of Artificial Sequence: Synthetic polypeptide
DEEEIRTTNPVATEQYGSVNMTGLTGPGGEEDNI

SEQ ID NO: 97405 - protein, 33 aa, Artificial Sequence
  Description of Artificial Sequence: Synthetic polypeptide
DEECIRTTNPVATEIYGQVWTFTNLERFESNQR

SEQ ID NO: 97406 - protein, 34 aa, Artificial Sequence
  Description of Artificial Sequence: Synthetic polypeptide
FEEEIRTTNPVATEQYGNVSGTMNNEQGGGGNEE

SEQ ID NO: 97407 - protein, 35 aa, Artificial Sequence
  Description of Artificial Sequence: Synthetic polypeptide
DEEEIRTTNPVATEQYGSVISPTILLNVREDNQML

SEQ ID NO: 97408 - protein, 30 aa, Artificial Sequence
  Description of Artificial Sequence: Synthetic polypeptide
QEEEIATTNPVATEQYGEASTVCQHEGEDL

SEQ ID NO: 97409 - protein, 33 aa, Artificial Sequence
  Description of Artificial Sequence: Synthetic polypeptide
DEEEIRTTNPVATEQYGSVSAQDSVQDHEENQD

SEQ ID NO: 97410 - protein, 33 aa, Artificial Sequence
  Description of Artificial Sequence: Synthetic polypeptide
AEEEIRTTNPVATEQYGVVSVTATNLTQDEIQE

SEQ ID NO: 97411 - protein, 34 aa, Artificial Sequence
  Description of Artificial Sequence: Synthetic polypeptide
AEEEIRTTNPVATEQYGSVVVTNNLNNTAGNNNG

SEQ ID NO: 97412 - protein, 34 aa, Artificial Sequence
  Description of Artificial Sequence: Synthetic polypeptide
FEEEIRTTNPVATEQYGNVSGTMNNGQGEGGNGG

SEQ ID NO: 97413 - protein, 33 aa, Artificial Sequence
  Description of Artificial Sequence: Synthetic polypeptide
DEEEIATTNPVATEQYGCVAVANLQDQAEGNDD

SEQ ID NO: 97414 - protein, 33 aa, Artificial Sequence
  Description of Artificial Sequence: Synthetic polypeptide
DEEEIRTTNPVATEQYGSVMGNDFNTGEGNEGT

SEQ ID NO: 97415 - protein, 34 aa, Artificial Sequence
  Description of Artificial Sequence: Synthetic polypeptide
AEEEIRTTNPVATEQYGTSVPAVWDLEQREVPNR

SEQ ID NO: 97416 - protein, 36 aa, Artificial Sequence
  Description of Artificial Sequence: Synthetic polypeptide
DEECIRTTNPVATEPYGSVPSCTNNLSQDVGDENRE

SEQ ID NO: 97417 - protein, 29 aa, Artificial Sequence
  Description of Artificial Sequence: Synthetic peptide
QEEEIATTNPVATEQYGEASTDCQHEEDK

SEQ ID NO: 97418 - protein, 35 aa, Artificial Sequence
  Description of Artificial Sequence: Synthetic polypeptide
DEEEIRTTNPVATEQYGSVNMTGDNNGQGEGENEV

SEQ ID NO: 97419 - protein, 31 aa, Artificial Sequence
  Description of Artificial Sequence: Synthetic polypeptide
QEEEIATTNPVATEQYGEASTEVGNRNGNPK

SEQ ID NO: 97420 - protein, 35 aa, Artificial Sequence
  Description of Artificial Sequence: Synthetic polypeptide
AEEEIRTTNPVATEQYGSVVVTNNLNNQAGTNNDT

SEQ ID NO: 97421 - protein, 31 aa, Artificial Sequence
  Description of Artificial Sequence: Synthetic polypeptide
DEECIRTTNPVATEQWGCVATNNMQLIDVNQ

SEQ ID NO: 97422 - protein, 33 aa, Artificial Sequence
  Description of Artificial Sequence: Synthetic polypeptide
MEEEIMTTNPVATEQYGNVSVGMDLEQGGQNDR

SEQ ID NO: 97423 - protein, 35 aa, Artificial Sequence
  Description of Artificial Sequence: Synthetic polypeptide
DEEEIRTTNPVATEQYGSVISPTEVLDQQMVENED

SEQ ID NO: 97424 - protein, 34 aa, Artificial Sequence
  Description of Artificial Sequence: Synthetic polypeptide
DEEEIRTTNPVATEQYGSVMGMTGEQVGGGNNGQ

SEQ ID NO: 97425 - protein, 29 aa, Artificial Sequence
  Description of Artificial Sequence: Synthetic peptide
QEEEIATTNPVATEQYGEASTDVCQHEEK

SEQ ID NO: 97426 - protein, 35 aa, Artificial Sequence
  Description of Artificial Sequence: Synthetic polypeptide
DEEEIRTTNPVATEQYGSVISPTFNEIQYVENLQN

SEQ ID NO: 97427 - protein, 36 aa, Artificial Sequence
  Description of Artificial Sequence: Synthetic polypeptide
DEEEIRTTNPVATEQYGSVISPTFNELIQSPENLQT

SEQ ID NO: 97428 - protein, 34 aa, Artificial Sequence
  Description of Artificial Sequence: Synthetic polypeptide
AEEEIRTTNPVATEQYGSVVVTNNLNNTAGNNDE

SEQ ID NO: 97429 - protein, 34 aa, Artificial Sequence
  Description of Artificial Sequence: Synthetic polypeptide
DTEEIRTTNPVATTQYGSVSTQSGTNQQNGNNDE

SEQ ID NO: 97430 - protein, 34 aa, Artificial Sequence
  Description of Artificial Sequence: Synthetic polypeptide
AEEEIRTTNPVATEQYGSVVTVNSNEQAGTNEES

SEQ ID NO: 97431 - protein, 34 aa, Artificial Sequence
  Description of Artificial Sequence: Synthetic polypeptide
FEEEIRTTNPVATEQYGAVGSGTMELQEGGGNNQ

SEQ ID NO: 97432 - protein, 32 aa, Artificial Sequence
  Description of Artificial Sequence: Synthetic polypeptide
DEEEIRTTNPVATEQYGSVSIIGTAIPVNSET

SEQ ID NO: 97433 - protein, 33 aa, Artificial Sequence
  Description of Artificial Sequence: Synthetic polypeptide
DEEEIACTNPVATEQYGCVATNLTQEGIEDENP

SEQ ID NO: 97434 - protein, 33 aa, Artificial Sequence
  Description of Artificial Sequence: Synthetic polypeptide
DEEEIACTNPVATEQYGCVATNLTPADQAENRD

SEQ ID NO: 97435 - protein, 32 aa, Artificial Sequence
  Description of Artificial Sequence: Synthetic polypeptide
DEEEIACTNPVATEQYGCVATNLTEGGNDGDY

SEQ ID NO: 97436 - protein, 31 aa, Artificial Sequence
  Description of Artificial Sequence: Synthetic polypeptide
FEEEIRTTNPVATDQYGSVGNEQGNGQGNGQ

SEQ ID NO: 97437 - protein, 33 aa, Artificial Sequence
  Description of Artificial Sequence: Synthetic polypeptide
FEEEIRTTNCVATEQYGSVSTLDGDQGEGGNGG

SEQ ID NO: 97438 - protein, 33 aa, Artificial Sequence
  Description of Artificial Sequence: Synthetic polypeptide
DTTEIRTTNPVATEQYGSVSTTNTQQLQGEMEA

SEQ ID NO: 97439 - protein, 35 aa, Artificial Sequence
  Description of Artificial Sequence: Synthetic polypeptide
AEEEIRTTNPVATEQYGVVSTTNLNGQQGNNNQNQ

SEQ ID NO: 97440 - protein, 33 aa, Artificial Sequence
  Description of Artificial Sequence: Synthetic polypeptide
FEEEIRCTNPAATEQYGSVSIENMLMREGENGN

SEQ ID NO: 97441 - protein, 33 aa, Artificial Sequence
  Description of Artificial Sequence: Synthetic polypeptide
DEEEIASTNPVATEQYGNVSSTTAINSRNGNPR

SEQ ID NO: 97442 - protein, 33 aa, Artificial Sequence
  Description of Artificial Sequence: Synthetic polypeptide
FEEEIRCTNPAATEQYGSVSIENMLLREGGNEG

SEQ ID NO: 97443 - protein, 34 aa, Artificial Sequence
  Description of Artificial Sequence: Synthetic polypeptide
FEEEIRATNPVATEQYGSVSTGDLGQGEGENDED

SEQ ID NO: 97444 - protein, 32 aa, Artificial Sequence
  Description of Artificial Sequence: Synthetic polypeptide
DEEEIASTNPVATEQYGSVSATDLEDHEGEDL

SEQ ID NO: 97445 - protein, 34 aa, Artificial Sequence
  Description of Artificial Sequence: Synthetic polypeptide
MEEEIRTTNPVATEQYGAVISTMNEGQGGGENGD

SEQ ID NO: 97446 - protein, 34 aa, Artificial Sequence
  Description of Artificial Sequence: Synthetic polypeptide
DEEEIRTTNPVATEQYGSVSIEQLQNTQVDPTNY

SEQ ID NO: 97447 - protein, 35 aa, Artificial Sequence
  Description of Artificial Sequence: Synthetic polypeptide
DEEEIRTTNPVATEQYGSVSIEPTLSQVEGENPLA

SEQ ID NO: 97448 - protein, 32 aa, Artificial Sequence
  Description of Artificial Sequence: Synthetic polypeptide
DEEEIACTNPVATEQYGCVATNLQTGMEGEQE

SEQ ID NO: 97449 - protein, 32 aa, Artificial Sequence
  Description of Artificial Sequence: Synthetic polypeptide
DEEEIACTNPVATEQYGCVATNLQTEGGEEAM

SEQ ID NO: 97450 - protein, 35 aa, Artificial Sequence
  Description of Artificial Sequence: Synthetic polypeptide
DEEEIRTTNPVATEQYGSVQSHTINGQQENVNQEY

SEQ ID NO: 97451 - protein, 34 aa, Artificial Sequence
  Description of Artificial Sequence: Synthetic polypeptide
DEEEIRTTNPVATEQYGSVMGDTMNEDGSGNEET

SEQ ID NO: 97452 - protein, 32 aa, Artificial Sequence
  Description of Artificial Sequence: Synthetic polypeptide
MEEEIRTTNPVATEPYGSVVGFGNLNEGGGNT

SEQ ID NO: 97453 - protein, 35 aa, Artificial Sequence
  Description of Artificial Sequence: Synthetic polypeptide
AEEEIRTTNPVATEQYGSVVTVNNLQSNEQGTNTN

SEQ ID NO: 97454 - protein, 33 aa, Artificial Sequence
  Description of Artificial Sequence: Synthetic polypeptide
NEDEIRTTNPVATEQYGSLCSTHLQERDQGQQE

SEQ ID NO: 97455 - protein, 32 aa, Artificial Sequence
  Description of Artificial Sequence: Synthetic polypeptide
NEDEIRTTNPVATEQYGSLSTHLQEGDQSGQE

SEQ ID NO: 97456 - protein, 33 aa, Artificial Sequence
  Description of Artificial Sequence: Synthetic polypeptide
DEECIRTTNPVATEQYGCVCSTEEPQEFFGSNQ

SEQ ID NO: 97457 - protein, 35 aa, Artificial Sequence
  Description of Artificial Sequence: Synthetic polypeptide
AEEEIRTTNPVATEQYGVVSTSTNNLNQQGNNDGE

SEQ ID NO: 97458 - protein, 33 aa, Artificial Sequence
  Description of Artificial Sequence: Synthetic polypeptide
FEEEIRTTNPVATEAYGDVVNTNLVREGGDNGD

SEQ ID NO: 97459 - protein, 34 aa, Artificial Sequence
  Description of Artificial Sequence: Synthetic polypeptide
DEEEIRTTNPVATEQYGSVSANVNGDQIGEGEFG

SEQ ID NO: 97460 - protein, 35 aa, Artificial Sequence
  Description of Artificial Sequence: Synthetic polypeptide
AEEEIRTTNPVATEQYGVVSTTLNQLQLGNEEAQQ

SEQ ID NO: 97461 - protein, 32 aa, Artificial Sequence
  Description of Artificial Sequence: Synthetic polypeptide
DEECIRTTNPVATEQYGCVCSTELENFGSQQS

SEQ ID NO: 97462 - protein, 34 aa, Artificial Sequence
  Description of Artificial Sequence: Synthetic polypeptide
DEEEIRTTNPVATEQYGSVNNFETEDQGGGNEVT

SEQ ID NO: 97463 - protein, 33 aa, Artificial Sequence
  Description of Artificial Sequence: Synthetic polypeptide
NEDEIRTTNPVATEQYGSVDQTNLQNIGGGQGG

SEQ ID NO: 97464 - protein, 32 aa, Artificial Sequence
  Description of Artificial Sequence: Synthetic polypeptide
FEEEIRTTNPVATDQYGVVSTNNDDQEENNEF

SEQ ID NO: 97465 - protein, 33 aa, Artificial Sequence
  Description of Artificial Sequence: Synthetic polypeptide
DEEEIASTNPVATEQYGNVSSATTINSRVGNPR

SEQ ID NO: 97466 - protein, 33 aa, Artificial Sequence
  Description of Artificial Sequence: Synthetic polypeptide
DEEEIASTNPVATEQYGNVSSATAINSRNGNPR

SEQ ID NO: 97467 - protein, 34 aa, Artificial Sequence
  Description of Artificial Sequence: Synthetic polypeptide
DTTEIRTTNPVATEQYGSVSTTNTNNQQLGNMEA

SEQ ID NO: 97468 - protein, 33 aa, Artificial Sequence
  Description of Artificial Sequence: Synthetic polypeptide
DEEEIRTTNPVATEQYGSVSILPEEQLLVSQRI

SEQ ID NO: 97469 - protein, 33 aa, Artificial Sequence
  Description of Artificial Sequence: Synthetic polypeptide
DTTEIRTTNPVATEQYGSVSTTNTQQLNGEEAD

SEQ ID NO: 97470 - protein, 33 aa, Artificial Sequence
  Description of Artificial Sequence: Synthetic polypeptide
DEEEIASTNPVATEQYGNVSSATAINSRVGNPR

SEQ ID NO: 97471 - protein, 31 aa, Artificial Sequence
  Description of Artificial Sequence: Synthetic polypeptide
DEEEIACTNPVATEQYGCVATNLTSMGDDQM

SEQ ID NO: 97472 - protein, 34 aa, Artificial Sequence
  Description of Artificial Sequence: Synthetic polypeptide
DTTEIRTTNPVATEQYGSVSTTNTQQLNGNMTAE

SEQ ID NO: 97473 - protein, 33 aa, Artificial Sequence
  Description of Artificial Sequence: Synthetic polypeptide
MEEEIRTTNPVATEGYGSVSNNDEMQGLEGNGD

SEQ ID NO: 97474 - protein, 28 aa, Artificial Sequence
  Description of Artificial Sequence: Synthetic peptide
QEEEIATTNPVATEQYGDVPEVCQHEEL

SEQ ID NO: 97475 - protein, 34 aa, Artificial Sequence
  Description of Artificial Sequence: Synthetic polypeptide
DEEEIRTTNPVATEQYGSVQQTTSNLINGELPVL

SEQ ID NO: 97476 - protein, 35 aa, Artificial Sequence
  Description of Artificial Sequence: Synthetic polypeptide
DTTEIRTTNPVATEQYGSVSTTNQQQLQQGEEENE

SEQ ID NO: 97477 - protein, 30 aa, Artificial Sequence
  Description of Artificial Sequence: Synthetic polypeptide
DEEEIASTNPVATEQYGDVSEIEQNAAGDQ

SEQ ID NO: 97478 - protein, 34 aa, Artificial Sequence
  Description of Artificial Sequence: Synthetic polypeptide
DEEEIRTTNPVATEQYGSVSIENNLQNTQVDPVI

SEQ ID NO: 97479 - protein, 33 aa, Artificial Sequence
  Description of Artificial Sequence: Synthetic polypeptide
FEEEIRATNPVATEQYGSVISGNNNEGQGGNIG

SEQ ID NO: 97480 - protein, 34 aa, Artificial Sequence
  Description of Artificial Sequence: Synthetic polypeptide
DEEEIRTTNPVATEQYGSVSIEHNLQNTQVDPIN

SEQ ID NO: 97481 - protein, 32 aa, Artificial Sequence
  Description of Artificial Sequence: Synthetic polypeptide
MEEEIRTTNPVATEQYGCVCSTEDHQNFGSEQ

SEQ ID NO: 97482 - protein, 33 aa, Artificial Sequence
  Description of Artificial Sequence: Synthetic polypeptide
QEEEIATTNPVATEQYGDVSTTCLPNMRNGMNV

SEQ ID NO: 97483 - protein, 28 aa, Artificial Sequence
  Description of Artificial Sequence: Synthetic peptide
NEDEIAPTNPCSSEQYGIVSCNLQSGTR

SEQ ID NO: 97484 - protein, 33 aa, Artificial Sequence
  Description of Artificial Sequence: Synthetic polypeptide
DEEEIRTTNPVATEQYGSVSIEAGWLQIPVEPP

SEQ ID NO: 97485 - protein, 32 aa, Artificial Sequence
  Description of Artificial Sequence: Synthetic polypeptide
DEEEIASTNPVATEQYGSVSTTPAGPNSGMNV

SEQ ID NO: 97486 - protein, 36 aa, Artificial Sequence
  Description of Artificial Sequence: Synthetic polypeptide
DEEEIRTTNPVATEQYGSVNSTNIDDFQRGGEEIIN

SEQ ID NO: 97487 - protein, 35 aa, Artificial Sequence
  Description of Artificial Sequence: Synthetic polypeptide
DEEEIRTTNPVATEQYGSVNSTNIDDDQNSGEEIN

SEQ ID NO: 97488 - protein, 34 aa, Artificial Sequence
  Description of Artificial Sequence: Synthetic polypeptide
DEEEIRTTNPVATEQYGSVSIDQLGQEDEFTNEI

SEQ ID NO: 97489 - protein, 29 aa, Artificial Sequence
  Description of Artificial Sequence: Synthetic peptide
FEEEIGSVNPVSTEQYGVVSVNLQQGVSQ

SEQ ID NO: 97490 - protein, 35 aa, Artificial Sequence
  Description of Artificial Sequence: Synthetic polypeptide
DEEEIRTTNPVATEQYGSVNSTNIDDDQAGGEETI

SEQ ID NO: 97491 - protein, 31 aa, Artificial Sequence
  Description of Artificial Sequence: Synthetic polypeptide
DEECISTTNPVATEGYGCVCNTEGLQRGSQQ

SEQ ID NO: 97492 - protein, 35 aa, Artificial Sequence
  Description of Artificial Sequence: Synthetic polypeptide
DEEEIRTTNPVATEQYGSVNNLTNHDAEGNEEIRV

SEQ ID NO: 97493 - protein, 33 aa, Artificial Sequence
  Description of Artificial Sequence: Synthetic polypeptide
DTTEIRTTNPVATEQYGVVTNTTTVNLQAGNQS

SEQ ID NO: 97494 - protein, 30 aa, Artificial Sequence
  Description of Artificial Sequence: Synthetic polypeptide
FEEEIGSVNPVSTEQYGVVSVMNLQQGNQN

SEQ ID NO: 97495 - protein, 36 aa, Artificial Sequence
  Description of Artificial Sequence: Synthetic polypeptide
AEEEIRTTNPVATEQYGSVVVSVTTNNLQQGTTNVD

SEQ ID NO: 97496 - protein, 30 aa, Artificial Sequence
  Description of Artificial Sequence: Synthetic polypeptide
DEECNATTNPIAYEQWGEVSTNAQHQGENR

SEQ ID NO: 97497 - protein, 30 aa, Artificial Sequence
  Description of Artificial Sequence: Synthetic polypeptide
DEEEIASTNPVCTECWGSVSCNEPQSEGNQ

SEQ ID NO: 97498 - protein, 30 aa, Artificial Sequence
  Description of Artificial Sequence: Synthetic polypeptide
DEECNATTNPIAYEQWGEVSTNLQHDGDNA

SEQ ID NO: 97499 - protein, 30 aa, Artificial Sequence
  Description of Artificial Sequence: Synthetic polypeptide
DEEEIATTNPVATEQWGVVSDILMNAAENQ

SEQ ID NO: 97500 - protein, 33 aa, Artificial Sequence
  Description of Artificial Sequence: Synthetic polypeptide
DEEEIRTTNPVATEQYGSVSIDPDQNEMGEGEF

SEQ ID NO: 97501 - protein, 33 aa, Artificial Sequence
  Description of Artificial Sequence: Synthetic polypeptide
FEEEIRATNPVATEQYGSVSINNGQEGGGNGGN

SEQ ID NO: 97502 - protein, 33 aa, Artificial Sequence
  Description of Artificial Sequence: Synthetic polypeptide
MEEEIRTTNPVATEQYGCVCSTEAHQNFGSNQS

SEQ ID NO: 97503 - protein, 28 aa, Artificial Sequence
  Description of Artificial Sequence: Synthetic peptide
QEEEIATTNPVATEQYGEAPTVCQHEEK

SEQ ID NO: 97504 - protein, 35 aa, Artificial Sequence
  Description of Artificial Sequence: Synthetic polypeptide
DEEEIRTTNPVATEQYGSVQSIPNLQPTLAVEERI

SEQ ID NO: 97505 - protein, 31 aa, Artificial Sequence
  Description of Artificial Sequence: Synthetic polypeptide
DEECISTTNPVATEGYGCVCNTNGHQHGSNQ

SEQ ID NO: 97506 - protein, 33 aa, Artificial Sequence
  Description of Artificial Sequence: Synthetic polypeptide
DTTEIRTTNPVATEQYGVVNTTTNVNLQAGNQS

SEQ ID NO: 97507 - protein, 34 aa, Artificial Sequence
  Description of Artificial Sequence: Synthetic polypeptide
DEEEIRTTNPVATEQYGSVSIENLQNTQVVPFFY

SEQ ID NO: 97508 - protein, 34 aa, Artificial Sequence
  Description of Artificial Sequence: Synthetic polypeptide
AEEEIRTTNPVATEQYGSVVVSVTTNNQEQENAD

SEQ ID NO: 97509 - protein, 28 aa, Artificial Sequence
  Description of Artificial Sequence: Synthetic peptide
QEEEIATTNPVATEQYGEAPTVPQHEEK

SEQ ID NO: 97510 - protein, 28 aa, Artificial Sequence
  Description of Artificial Sequence: Synthetic peptide
QEEEIATTNPVATEQYGEAPTVLEHEEL

SEQ ID NO: 97511 - protein, 33 aa, Artificial Sequence
  Description of Artificial Sequence: Synthetic polypeptide
DEEEIASTNPVATEQYGSVSTTPAGPNRGMNPV

SEQ ID NO: 97512 - protein, 34 aa, Artificial Sequence
  Description of Artificial Sequence: Synthetic polypeptide
DEEEIRTTNPVATEQYGSVSIENLQNTQVDPLSV

SEQ ID NO: 97513 - protein, 35 aa, Artificial Sequence
  Description of Artificial Sequence: Synthetic polypeptide
AEEEIRTTNPVATEQYGSVVTVNNLQQNQEGTNGE

SEQ ID NO: 97514 - protein, 34 aa, Artificial Sequence
  Description of Artificial Sequence: Synthetic polypeptide
DEEEIRTTNPVATEQYGSVSIENLQNEQVDPTIA

SEQ ID NO: 97515 - protein, 35 aa, Artificial Sequence
  Description of Artificial Sequence: Synthetic polypeptide
DEEEIRTTNPVATEQYGSVSIENDTPQRQGQTAQT

SEQ ID NO: 97516 - protein, 33 aa, Artificial Sequence
  Description of Artificial Sequence: Synthetic polypeptide
DTTEIRTTNPVATEQYGVVNVTVNLQAGTNAQE

SEQ ID NO: 97517 - protein, 34 aa, Artificial Sequence
  Description of Artificial Sequence: Synthetic polypeptide
DEECIRTTNPVATEQYGCVCSTGNPQFFGSDNQA

SEQ ID NO: 97518 - protein, 33 aa, Artificial Sequence
  Description of Artificial Sequence: Synthetic polypeptide
DEEEIRTTNPVATEQYGSVSIELLPVMLGVDGL

SEQ ID NO: 97519 - protein, 31 aa, Artificial Sequence
  Description of Artificial Sequence: Synthetic polypeptide
NEDEIATTNPVAYEPWGSVSTTNLQDGNLDQ

SEQ ID NO: 97520 - protein, 33 aa, Artificial Sequence
  Description of Artificial Sequence: Synthetic polypeptide
MEEEIRTTNPVATEQYGCVCSTAHQNFGSNNQS

SEQ ID NO: 97521 - protein, 34 aa, Artificial Sequence
  Description of Artificial Sequence: Synthetic polypeptide
AEEEIRTTNPVATEQYGSVVVSVTDGNQIGTNGD

SEQ ID NO: 97522 - protein, 28 aa, Artificial Sequence
  Description of Artificial Sequence: Synthetic peptide
QEEEIATTNPVATEQYGEAPTVCQHEIK

SEQ ID NO: 97523 - protein, 28 aa, Artificial Sequence
  Description of Artificial Sequence: Synthetic peptide
QEEEIATTNPVATEQYGEAPTVCQHEEL

SEQ ID NO: 97524 - protein, 34 aa, Artificial Sequence
  Description of Artificial Sequence: Synthetic polypeptide
DEEEIRTTNPVATEQYGSVSIENLENTQVDPTID

SEQ ID NO: 97525 - protein, 33 aa, Artificial Sequence
  Description of Artificial Sequence: Synthetic polypeptide
DTTEIRTTNPVATEQYGSVSTNTNNQQLGMEEG

SEQ ID NO: 97526 - protein, 33 aa, Artificial Sequence
  Description of Artificial Sequence: Synthetic polypeptide
DEEEIRTTNPVATEQYGSVNNESEDNGEEENNQ

SEQ ID NO: 97527 - protein, 35 aa, Artificial Sequence
  Description of Artificial Sequence: Synthetic polypeptide
AEEEIRTTNPVATEQYGVVSTSTNLQQQNGNNNGD

SEQ ID NO: 97528 - protein, 34 aa, Artificial Sequence
  Description of Artificial Sequence: Synthetic polypeptide
DTEEIRTTNPVATTQYGSVSTTQNGNQNGTNNQE

SEQ ID NO: 97529 - protein, 33 aa, Artificial Sequence
  Description of Artificial Sequence: Synthetic polypeptide
AEEEIRTTNPVATEQYGSVVVTNDESGVNNNTE

SEQ ID NO: 97530 - protein, 30 aa, Artificial Sequence
  Description of Artificial Sequence: Synthetic polypeptide
DEEEIAPTNPCSSEQYGIVSTTNLQSGTPV

SEQ ID NO: 97531 - protein, 31 aa, Artificial Sequence
  Description of Artificial Sequence: Synthetic polypeptide
QEEEIATTNPVATEQYGCVATNLTTDDGDPM

SEQ ID NO: 97532 - protein, 32 aa, Artificial Sequence
  Description of Artificial Sequence: Synthetic polypeptide
DTEEIRTTNPVGTEQWGDMVSTNLEVIVGQVR

SEQ ID NO: 97533 - protein, 33 aa, Artificial Sequence
  Description of Artificial Sequence: Synthetic polypeptide
FEEEIRTTNPVATEPYGSVVGFGNLQGEGEEND

SEQ ID NO: 97534 - protein, 33 aa, Artificial Sequence
  Description of Artificial Sequence: Synthetic polypeptide
DEEEIRTTNPVATEQYGSVMGFGNGQEDGGGGN

SEQ ID NO: 97535 - protein, 29 aa, Artificial Sequence
  Description of Artificial Sequence: Synthetic peptide
QEEEIATTNPVATEQYGEASENCPQHEEK

SEQ ID NO: 97536 - protein, 28 aa, Artificial Sequence
  Description of Artificial Sequence: Synthetic peptide
AEMEIAQTNPCSYEQYGCVSSNLQSGDR

SEQ ID NO: 97537 - protein, 32 aa, Artificial Sequence
  Description of Artificial Sequence: Synthetic polypeptide
NNEEIRTTNPVATEYYGVVYTNLNEDFGQNLR

SEQ ID NO: 97538 - protein, 32 aa, Artificial Sequence
  Description of Artificial Sequence: Synthetic polypeptide
DEEEIATTNPVATEQYGCVAANNDTDPGENRN

SEQ ID NO: 97539 - protein, 29 aa, Artificial Sequence
  Description of Artificial Sequence: Synthetic peptide
DEEEIATTNPVATECWGDVSECLQHEYYL

SEQ ID NO: 97540 - protein, 29 aa, Artificial Sequence
  Description of Artificial Sequence: Synthetic peptide
AEMEIACTNPVATEQYGTASTGLVEFGGR

SEQ ID NO: 97541 - protein, 34 aa, Artificial Sequence
  Description of Artificial Sequence: Synthetic polypeptide
DEECIRTTNPVATEQYGCVCSNTGNDQEFFGSNQ

SEQ ID NO: 97542 - protein, 34 aa, Artificial Sequence
  Description of Artificial Sequence: Synthetic polypeptide
DEEEIATTNPVATEQYGCVAANGLQDNPGGDNRM

SEQ ID NO: 97543 - protein, 33 aa, Artificial Sequence
  Description of Artificial Sequence: Synthetic polypeptide
AEEEIRTTNPVATEQYGVVSTQNQLQISTTETN

SEQ ID NO: 97544 - protein, 32 aa, Artificial Sequence
  Description of Artificial Sequence: Synthetic polypeptide
DEEEIRTTNPVATEQYGSVNNATDERGETEEQ

SEQ ID NO: 97545 - protein, 34 aa, Artificial Sequence
  Description of Artificial Sequence: Synthetic polypeptide
DEEEIRTTNPVATEQYGSVMGENNDQGGGETNGG

SEQ ID NO: 97546 - protein, 31 aa, Artificial Sequence
  Description of Artificial Sequence: Synthetic polypeptide
DTEEIRYTNPVATEQYGCVVSTNLENYDTQQ

SEQ ID NO: 97547 - protein, 28 aa, Artificial Sequence
  Description of Artificial Sequence: Synthetic peptide
QEEEIATTNPVATEQYGEASDVCQSEEK

SEQ ID NO: 97548 - protein, 28 aa, Artificial Sequence
  Description of Artificial Sequence: Synthetic peptide
AEMEIAQTNPCSSEQYGCVSCNLQSGTR

SEQ ID NO: 97549 - protein, 31 aa, Artificial Sequence
  Description of Artificial Sequence: Synthetic polypeptide
AEMEIACTNPVATEQYGEVSATDGPQREGGR

SEQ ID NO: 97550 - protein, 33 aa, Artificial Sequence
  Description of Artificial Sequence: Synthetic polypeptide
NNEEIRTTNPVATEYYGVVSTNLNEEDFGQNER

SEQ ID NO: 97551 - protein, 35 aa, Artificial Sequence
  Description of Artificial Sequence: Synthetic polypeptide
AEEEIRTTNPVATEQYGSVVTVANLNQGEQGNNVT

SEQ ID NO: 97552 - protein, 31 aa, Artificial Sequence
  Description of Artificial Sequence: Synthetic polypeptide
DEEEIATTNPVATEQYGCVAATNDQQPEDTN

SEQ ID NO: 97553 - protein, 32 aa, Artificial Sequence
  Description of Artificial Sequence: Synthetic polypeptide
NNEEIRTTNPVATEQYGVVWTQNLQDGGPFMM

SEQ ID NO: 97554 - protein, 33 aa, Artificial Sequence
  Description of Artificial Sequence: Synthetic polypeptide
NNEEIRTTNPVATEQYGVVWTQNLQDGGPNPET

SEQ ID NO: 97555 - protein, 32 aa, Artificial Sequence
  Description of Artificial Sequence: Synthetic polypeptide
NNEEIRTTNPVATEQYGVVWTQNLQMDGMPEM

SEQ ID NO: 97556 - protein, 32 aa, Artificial Sequence
  Description of Artificial Sequence: Synthetic polypeptide
NNEEIRTTNPVATEQYGVVWTQNLTQDGGPEM

SEQ ID NO: 97557 - protein, 33 aa, Artificial Sequence
  Description of Artificial Sequence: Synthetic polypeptide
QEEEIATTNPVATEQYGCVATNLTQENMINERP

SEQ ID NO: 97558 - protein, 31 aa, Artificial Sequence
  Description of Artificial Sequence: Synthetic polypeptide
DEEEIATTNPVATEQYGCVAATNDNTRDPEG

SEQ ID NO: 97559 - protein, 34 aa, Artificial Sequence
  Description of Artificial Sequence: Synthetic polypeptide
DTEEIRTTNPVATTQYGSVSTTNGTNQNGNNEGD

SEQ ID NO: 97560 - protein, 28 aa, Artificial Sequence
  Description of Artificial Sequence: Synthetic peptide
QEEEIATTNPVATEQYGEASEVCQHEEK

SEQ ID NO: 97561 - protein, 33 aa, Artificial Sequence
  Description of Artificial Sequence: Synthetic polypeptide
DTEEIRTTNPVATTQYGSVSTTQNGNQNGTEGQ

SEQ ID NO: 97562 - protein, 35 aa, Artificial Sequence
  Description of Artificial Sequence: Synthetic polypeptide
DEEEIRTTNPVATEQYGSVSISDNDQTNEMGSNAG

SEQ ID NO: 97563 - protein, 31 aa, Artificial Sequence
  Description of Artificial Sequence: Synthetic polypeptide
AEMEIATTNPVATEQYGEVSATDGLEREGGD

SEQ ID NO: 97564 - protein, 28 aa, Artificial Sequence
  Description of Artificial Sequence: Synthetic peptide
QEEEIATTNPVATEQYGEASEVCQHEEA

SEQ ID NO: 97565 - protein, 28 aa, Artificial Sequence
  Description of Artificial Sequence: Synthetic peptide
QEEEIATTNPVATEQYGEASEVCQHEDK

SEQ ID NO: 97566 - protein, 28 aa, Artificial Sequence
  Description of Artificial Sequence: Synthetic peptide
QEEEIATTNPVATEQYGEASEVCQAEEK

SEQ ID NO: 97567 - protein, 32 aa, Artificial Sequence
  Description of Artificial Sequence: Synthetic polypeptide
DEEEIATTNPVATEQYGCVAATANDQDGVDTA

SEQ ID NO: 97568 - protein, 29 aa, Artificial Sequence
  Description of Artificial Sequence: Synthetic peptide
QEEEIATTNPVATEQYGEASEVCPQHENK

SEQ ID NO: 97569 - protein, 34 aa, Artificial Sequence
  Description of Artificial Sequence: Synthetic polypeptide
DEECIRTTNPVATEQYGCVCSMTELQNFGSNTQS

SEQ ID NO: 97570 - protein, 35 aa, Artificial Sequence
  Description of Artificial Sequence: Synthetic polypeptide
DEEEIRTTNPVATEQYGSVSIPPLELQRQGIFPVV

SEQ ID NO: 97571 - protein, 35 aa, Artificial Sequence
  Description of Artificial Sequence: Synthetic polypeptide
AEEEIRTTNPVATEQYGSVVTVANLNQGEQGNNVE

SEQ ID NO: 97572 - protein, 32 aa, Artificial Sequence
  Description of Artificial Sequence: Synthetic polypeptide
AEMEIATTNPVATEQYGEVSATDGPVQREGGR

SEQ ID NO: 97573 - protein, 30 aa, Artificial Sequence
  Description of Artificial Sequence: Synthetic polypeptide
AEMEIACTNPVATEQYGEVSAEGPQREGGR

SEQ ID NO: 97574 - protein, 32 aa, Artificial Sequence
  Description of Artificial Sequence: Synthetic polypeptide
NEEEIACTNPVATEMYGSVATNLQEAGSNDFV

SEQ ID NO: 97575 - protein, 33 aa, Artificial Sequence
  Description of Artificial Sequence: Synthetic polypeptide
DTEEIRYTNPVATEQYGSKVCVTNLENGSTQRE

SEQ ID NO: 97576 - protein, 32 aa, Artificial Sequence
  Description of Artificial Sequence: Synthetic polypeptide
NSEEIGTTNPVATEQWGVTVSCTNLSMDVGNR

SEQ ID NO: 97577 - protein, 35 aa, Artificial Sequence
  Description of Artificial Sequence: Synthetic polypeptide
DEEEIRTTNPVATEQYGSVMGDTMNLDGSGNEQGN

SEQ ID NO: 97578 - protein, 32 aa, Artificial Sequence
  Description of Artificial Sequence: Synthetic polypeptide
NEECIRCTNPVATEQYGSVSWNLFEFGSNLQH

SEQ ID NO: 97579 - protein, 32 aa, Artificial Sequence
  Description of Artificial Sequence: Synthetic polypeptide
DEEEIATTNPVATEQYGCTATNNGLQAPMENN

SEQ ID NO: 97580 - protein, 28 aa, Artificial Sequence
  Description of Artificial Sequence: Synthetic peptide
QEEEIATTNPVATEQYGDVPECCQHEEL

SEQ ID NO: 97581 - protein, 33 aa, Artificial Sequence
  Description of Artificial Sequence: Synthetic polypeptide
DEECIRTTNPVATEQYGCVCSTEDELNFGSNQS

SEQ ID NO: 97582 - protein, 35 aa, Artificial Sequence
  Description of Artificial Sequence: Synthetic polypeptide
DEEEIRTTNPVATEQYGSVNNDTGNLTGGNGNDDN

SEQ ID NO: 97583 - protein, 31 aa, Artificial Sequence
  Description of Artificial Sequence: Synthetic polypeptide
DEECIRTTNPVATEQYGCVCSTEDENFGSEQ

SEQ ID NO: 97584 - protein, 36 aa, Artificial Sequence
  Description of Artificial Sequence: Synthetic polypeptide
AEEEIRTTNPVATEQYGSVVVSTTNQLGNQAGTNND

SEQ ID NO: 97585 - protein, 33 aa, Artificial Sequence
  Description of Artificial Sequence: Synthetic polypeptide
NEECIRTTNPVATERYGTVVSTNELSQAGGNHC

SEQ ID NO: 97586 - protein, 32 aa, Artificial Sequence
  Description of Artificial Sequence: Synthetic polypeptide
DTQEIATTNPVATEQYGSVSATDLEQHEGEDL

SEQ ID NO: 97587 - protein, 33 aa, Artificial Sequence
  Description of Artificial Sequence: Synthetic polypeptide
DEEEIRTTNPVATEQYGSVNNENYDDRGEEEHT

SEQ ID NO: 97588 - protein, 32 aa, Artificial Sequence
  Description of Artificial Sequence: Synthetic polypeptide
DEECIRTTNPVATEQYGCVCSTEDQFFNSDQE

SEQ ID NO: 97589 - protein, 32 aa, Artificial Sequence
  Description of Artificial Sequence: Synthetic polypeptide
DEECIRTTNPVATEQYGCVCSTEDQSFGSDQM

SEQ ID NO: 97590 - protein, 31 aa, Artificial Sequence
  Description of Artificial Sequence: Synthetic polypeptide
DEECIRTTNPVATEQYGCVCSTEEAHGSDQS

SEQ ID NO: 97591 - protein, 32 aa, Artificial Sequence
  Description of Artificial Sequence: Synthetic polypeptide
NEEAEIRTTNPVAYERWGTVSTNLQHDQGNEQ

SEQ ID NO: 97592 - protein, 34 aa, Artificial Sequence
  Description of Artificial Sequence: Synthetic polypeptide
FEEEIRTTNPVATEFYGSVSTQNGFGQENQGNFE

SEQ ID NO: 97593 - protein, 32 aa, Artificial Sequence
  Description of Artificial Sequence: Synthetic polypeptide
DEECIRTTNPVATEQYGCVCSTEELNGSNTQS

SEQ ID NO: 97594 - protein, 31 aa, Artificial Sequence
  Description of Artificial Sequence: Synthetic polypeptide
DEEEIRTTNPVATEQYGSVNNESDDDNGEGA

SEQ ID NO: 97595 - protein, 35 aa, Artificial Sequence
  Description of Artificial Sequence: Synthetic polypeptide
DEEEIRTTNPVATEQYGSVMGDTMNLDGSGNDGEQ

SEQ ID NO: 97596 - protein, 32 aa, Artificial Sequence
  Description of Artificial Sequence: Synthetic polypeptide
DTQEIATTNPVATEQYGSVSATDLQDHEGEDL

SEQ ID NO: 97597 - protein, 30 aa, Artificial Sequence
  Description of Artificial Sequence: Synthetic polypeptide
NSEEIATTNPVATTQWGSVWTWDHDQRGNF

SEQ ID NO: 97598 - protein, 34 aa, Artificial Sequence
  Description of Artificial Sequence: Synthetic polypeptide
MEEEIRTTNPVACEQYGQVSNSDNWPQRFGNDRE

SEQ ID NO: 97599 - protein, 32 aa, Artificial Sequence
  Description of Artificial Sequence: Synthetic polypeptide
QEEEIACTNPVATEMYGSVATNLQDQGGNDDE

SEQ ID NO: 97600 - protein, 30 aa, Artificial Sequence
  Description of Artificial Sequence: Synthetic polypeptide
AEMEIACTNPVATEQYGEAYHENNLQRGGR

SEQ ID NO: 97601 - protein, 28 aa, Artificial Sequence
  Description of Artificial Sequence: Synthetic peptide
QEEEIATTNPVATEQYGEASCVCQSEEK

SEQ ID NO: 97602 - protein, 31 aa, Artificial Sequence
  Description of Artificial Sequence: Synthetic polypeptide
DEECISTTNPVATEGYGCVNTEALQNFGSNQ

SEQ ID NO: 97603 - protein, 31 aa, Artificial Sequence
  Description of Artificial Sequence: Synthetic polypeptide
AEMEIACTNPVATEQYGEACSEDNLEREGNR

SEQ ID NO: 97604 - protein, 34 aa, Artificial Sequence
  Description of Artificial Sequence: Synthetic polypeptide
DEEEIAQTNPVATEQYGSVSTTPQVELREGENDT

SEQ ID NO: 97605 - protein, 35 aa, Artificial Sequence
  Description of Artificial Sequence: Synthetic polypeptide
DEEEIRTTNPVATEQYGSVQPTLLEQAESGFNEPT

SEQ ID NO: 97606 - protein, 34 aa, Artificial Sequence
  Description of Artificial Sequence: Synthetic polypeptide
AEEEIRTTNPVATEQYGVVSTVVNLQQQEGEQGN

SEQ ID NO: 97607 - protein, 34 aa, Artificial Sequence
  Description of Artificial Sequence: Synthetic polypeptide
DEEEIRTTNPVATEQYGSVSAPDNDIQMTINVEG

SEQ ID NO: 97608 - protein, 33 aa, Artificial Sequence
  Description of Artificial Sequence: Synthetic polypeptide
DEEEIRTTNPVATEQYGSVMGDVNGQEDGGGQI

SEQ ID NO: 97609 - protein, 34 aa, Artificial Sequence
  Description of Artificial Sequence: Synthetic polypeptide
DEEEIRTTNPVATEQYGSVISTMNSNSTGGDGQT

SEQ ID NO: 97610 - protein, 34 aa, Artificial Sequence
  Description of Artificial Sequence: Synthetic polypeptide
FEEEIRTTNPVATEGYGSVSITDNNGQGEGGGNN

SEQ ID NO: 97611 - protein, 33 aa, Artificial Sequence
  Description of Artificial Sequence: Synthetic polypeptide
FEEEIRTTNPVATEGYGSVITVGNGDQEGGGNQ

SEQ ID NO: 97612 - protein, 28 aa, Artificial Sequence
  Description of Artificial Sequence: Synthetic peptide
QEEEIATTNPVATEQYGDAPECLQHEEK

SEQ ID NO: 97613 - protein, 34 aa, Artificial Sequence
  Description of Artificial Sequence: Synthetic polypeptide
DTEEIRYTNPVAYEQYGSVVSCMNLSQNVGTNRD

SEQ ID NO: 97614 - protein, 35 aa, Artificial Sequence
  Description of Artificial Sequence: Synthetic polypeptide
DTEEIRYTNPVAYEQYGSVVTSCTGNLSQNVGTNR

SEQ ID NO: 97615 - protein, 34 aa, Artificial Sequence
  Description of Artificial Sequence: Synthetic polypeptide
FEEEIRTTNPVATEGYGDVSTQNLQNEMGNQDTE

SEQ ID NO: 97616 - protein, 31 aa, Artificial Sequence
  Description of Artificial Sequence: Synthetic polypeptide
DEECIRTTNPVATEQYGCVCSSEELHGSNQS

SEQ ID NO: 97617 - protein, 32 aa, Artificial Sequence
  Description of Artificial Sequence: Synthetic polypeptide
NEEDIRTTNPVAYEQYGETVSTGPVQRGGPRV

SEQ ID NO: 97618 - protein, 29 aa, Artificial Sequence
  Description of Artificial Sequence: Synthetic peptide
QEEEIATTNPVATEQYGEASCIVCQHENK

SEQ ID NO: 97619 - protein, 33 aa, Artificial Sequence
  Description of Artificial Sequence: Synthetic polypeptide
DEEEIRTTNPVATEQYGSVSAPDMQQANSIDEV

SEQ ID NO: 97620 - protein, 30 aa, Artificial Sequence
  Description of Artificial Sequence: Synthetic polypeptide
DTETAEIATTNPVAYEQWGAVASNLQHGNE

SEQ ID NO: 97621 - protein, 33 aa, Artificial Sequence
  Description of Artificial Sequence: Synthetic polypeptide
DTEEIRTTNPVATEQWGSVSTGLTQPINQNNQN

SEQ ID NO: 97622 - protein, 31 aa, Artificial Sequence
  Description of Artificial Sequence: Synthetic polypeptide
DEECNATTNPIAYEQWGEVSTNLQHDGTNQR

SEQ ID NO: 97623 - protein, 34 aa, Artificial Sequence
  Description of Artificial Sequence: Synthetic polypeptide
DEEEIRTTNPVATEQYGSVSATDGPNDRNGMEPV

SEQ ID NO: 97624 - protein, 32 aa, Artificial Sequence
  Description of Artificial Sequence: Synthetic polypeptide
DTEEIRTTNPQATEHYGSVSFNLTQREETQIE

SEQ ID NO: 97625 - protein, 34 aa, Artificial Sequence
  Description of Artificial Sequence: Synthetic polypeptide
DEEEIRTTNPVATEQYGSVNTDTGNLNGENNEDN

SEQ ID NO: 97626 - protein, 35 aa, Artificial Sequence
  Description of Artificial Sequence: Synthetic polypeptide
DEEEIRTTNPVATEQYGSVSLTENANQELMGVLQM

SEQ ID NO: 97627 - protein, 35 aa, Artificial Sequence
  Description of Artificial Sequence: Synthetic polypeptide
DTEEIRATNPVATEQYGSVSTTNNLQAGNQNQQSD

SEQ ID NO: 97628 - protein, 31 aa, Artificial Sequence
  Description of Artificial Sequence: Synthetic polypeptide
NEEEIRTTNPDATECYGMVPSTGLQQPQGRI

SEQ ID NO: 97629 - protein, 35 aa, Artificial Sequence
  Description of Artificial Sequence: Synthetic polypeptide
DTEEIRATNPVATEQYGSVSTTNNLQQAGNGNQEF

SEQ ID NO: 97630 - protein, 28 aa, Artificial Sequence
  Description of Artificial Sequence: Synthetic peptide
QEEEIATTNPVATECYGEASECLQHEEL

SEQ ID NO: 97631 - protein, 35 aa, Artificial Sequence
  Description of Artificial Sequence: Synthetic polypeptide
DTEEIRATNPVATEQYGSVSTTNNNLQAGNGEQFE

SEQ ID NO: 97632 - protein, 36 aa, Artificial Sequence
  Description of Artificial Sequence: Synthetic polypeptide
DEEEIRTTNPVATEQYGSVSLSVFLVPQNRDGLVND

SEQ ID NO: 97633 - protein, 31 aa, Artificial Sequence
  Description of Artificial Sequence: Synthetic polypeptide
QEEEIACTNPVATEQYGCVATNLQEAEEDGR

SEQ ID NO: 97634 - protein, 35 aa, Artificial Sequence
  Description of Artificial Sequence: Synthetic polypeptide
AEEEIRTTNPVATEQYGSVVVTTNLLQQGNGNVTE

SEQ ID NO: 97635 - protein, 29 aa, Artificial Sequence
  Description of Artificial Sequence: Synthetic peptide
QEEEIATTNPVATEQYGEVPAEGCQHENK

SEQ ID NO: 97636 - protein, 35 aa, Artificial Sequence
  Description of Artificial Sequence: Synthetic polypeptide
DEEEIRTTNPVATEQYGSVSATPDGPNDRNGMNPV

SEQ ID NO: 97637 - protein, 28 aa, Artificial Sequence
  Description of Artificial Sequence: Synthetic peptide
QEEEIATTNPVATECYGEVPCNCQHEEK

SEQ ID NO: 97638 - protein, 35 aa, Artificial Sequence
  Description of Artificial Sequence: Synthetic polypeptide
DEEEIRTTNPVATEQYGSVNTDTGNLLTENGNEDG

SEQ ID NO: 97639 - protein, 33 aa, Artificial Sequence
  Description of Artificial Sequence: Synthetic polypeptide
AEEEIRTTNPVATEQYGSVVVTTNLLAGTDEEE

SEQ ID NO: 97640 - protein, 35 aa, Artificial Sequence
  Description of Artificial Sequence: Synthetic polypeptide
DEEEIRTTNPVATEQYGSVSATPAGPNMRNGMNPV

SEQ ID NO: 97641 - protein, 29 aa, Artificial Sequence
  Description of Artificial Sequence: Synthetic peptide
QEEEIATTNPVATEQYGEVCPTVCQHEEK

SEQ ID NO: 97642 - protein, 35 aa, Artificial Sequence
  Description of Artificial Sequence: Synthetic polypeptide
DEEEIRTTNPVATEQYGSVSLSPLLPNRDGLNDED

SEQ ID NO: 97643 - protein, 35 aa, Artificial Sequence
  Description of Artificial Sequence: Synthetic polypeptide
NEEEIATTNPVAYEQYGVSVSATNDLGQARAGIAR

SEQ ID NO: 97644 - protein, 35 aa, Artificial Sequence
  Description of Artificial Sequence: Synthetic polypeptide
AEEEIRTTNPVATEQYGSVVVTTNLGNQAGTNNDN

SEQ ID NO: 97645 - protein, 34 aa, Artificial Sequence
  Description of Artificial Sequence: Synthetic polypeptide
NEEEICTTNPVAYEQYGSVSCTNSSSQVRGGENF

SEQ ID NO: 97646 - protein, 35 aa, Artificial Sequence
  Description of Artificial Sequence: Synthetic polypeptide
DEEEIRTTNPVATEQYGSVSLSPGLLEEQVGVVRP

SEQ ID NO: 97647 - protein, 32 aa, Artificial Sequence
  Description of Artificial Sequence: Synthetic polypeptide
DEEEIATTNPVATECWGSVSTNLNGEDNNKEQ

SEQ ID NO: 97648 - protein, 35 aa, Artificial Sequence
  Description of Artificial Sequence: Synthetic polypeptide
DEEEIRTTNPVATEQYGSVSLTENGLQQEMMVLDE

SEQ ID NO: 97649 - protein, 34 aa, Artificial Sequence
  Description of Artificial Sequence: Synthetic polypeptide
DTEEIRATNPVATEQYGSVSTNNTQNQQQGTNTE

SEQ ID NO: 97650 - protein, 31 aa, Artificial Sequence
  Description of Artificial Sequence: Synthetic polypeptide
MEEEIATTNPVATEQYGCVATALQNDSEGRM

SEQ ID NO: 97651 - protein, 31 aa, Artificial Sequence
  Description of Artificial Sequence: Synthetic polypeptide
QEEEIACTNPVATEQYGCVATNLQLEEDTRH

SEQ ID NO: 97652 - protein, 31 aa, Artificial Sequence
  Description of Artificial Sequence: Synthetic polypeptide
NETEIRTTNPVATEYYGNVSTGNGEGPQGNF

SEQ ID NO: 97653 - protein, 34 aa, Artificial Sequence
  Description of Artificial Sequence: Synthetic polypeptide
DTEEIRATNPVATEQYGSVSTNTANNQQGNNNNE

SEQ ID NO: 97654 - protein, 34 aa, Artificial Sequence
  Description of Artificial Sequence: Synthetic polypeptide
NEEEIRTTNPVATEPYGSTVSAGNLSDEFTGGNR

SEQ ID NO: 97655 - protein, 34 aa, Artificial Sequence
  Description of Artificial Sequence: Synthetic polypeptide
DTEEIRATNPVATEQYGSVSTNTNGQQQGTNNNE

SEQ ID NO: 97656 - protein, 34 aa, Artificial Sequence
  Description of Artificial Sequence: Synthetic polypeptide
DTEEIRATNPVATEQYGSVSTNTNNEQQGNNDNE

SEQ ID NO: 97657 - protein, 35 aa, Artificial Sequence
  Description of Artificial Sequence: Synthetic polypeptide
DTEEIRATNPVATEQYGSVSTNTNNLQQQGTNANE

SEQ ID NO: 97658 - protein, 34 aa, Artificial Sequence
  Description of Artificial Sequence: Synthetic polypeptide
AEEEIRTTNPVATEQYGSVVVVVTTDNNQIGNNL

SEQ ID NO: 97659 - protein, 34 aa, Artificial Sequence
  Description of Artificial Sequence: Synthetic polypeptide
DEEEIRTTNPVATEQYGSVNTFEDVQMRVENEQL

SEQ ID NO: 97660 - protein, 33 aa, Artificial Sequence
  Description of Artificial Sequence: Synthetic polypeptide
DEEEIRTTNPVATEQYGSVNTEYDTEQADGGQK

SEQ ID NO: 97661 - protein, 35 aa, Artificial Sequence
  Description of Artificial Sequence: Synthetic polypeptide
DEEEIRTTNPVATEQYGSVSLTLGLLAITDGDNEE

SEQ ID NO: 97662 - protein, 35 aa, Artificial Sequence
  Description of Artificial Sequence: Synthetic polypeptide
DEEEIRTTNPVATEQYGSVSATPDGPNMRNGMNPV

SEQ ID NO: 97663 - protein, 34 aa, Artificial Sequence
  Description of Artificial Sequence: Synthetic polypeptide
DTEEIRATNPVATEQYGSVSTNTTNQQQGNNENE

SEQ ID NO: 97664 - protein, 32 aa, Artificial Sequence
  Description of Artificial Sequence: Synthetic polypeptide
NETEIRTTNPVAYEQYGKVVWTNALSQIGTSR

SEQ ID NO: 97665 - protein, 34 aa, Artificial Sequence
  Description of Artificial Sequence: Synthetic polypeptide
AEEEIRTTNPVATEQYGSVVVTTNLNNTNGNNED

SEQ ID NO: 97666 - protein, 29 aa, Artificial Sequence
  Description of Artificial Sequence: Synthetic peptide
QEEEIATTNPVATEQYGEVPEACQRNEEK

SEQ ID NO: 97667 - protein, 33 aa, Artificial Sequence
  Description of Artificial Sequence: Synthetic polypeptide
DEECIRCTNPVATEPYGSVVSCWNFSQRGGNNL

SEQ ID NO: 97668 - protein, 35 aa, Artificial Sequence
  Description of Artificial Sequence: Synthetic polypeptide
DTEEIRATNPVATEQYGSVSTTNNLQAGNGNQTQD

SEQ ID NO: 97669 - protein, 30 aa, Artificial Sequence
  Description of Artificial Sequence: Synthetic polypeptide
DEECIRATNPVAYEQWGVVTGWNDHQGGNR

SEQ ID NO: 97670 - protein, 35 aa, Artificial Sequence
  Description of Artificial Sequence: Synthetic polypeptide
DEEEIRTTNPVATEQYGSVSLTNGLQVTESMQAIG

SEQ ID NO: 97671 - protein, 34 aa, Artificial Sequence
  Description of Artificial Sequence: Synthetic polypeptide
DEEEIRTTNPVATEQYGSVSLSNNGLLIPPIVNP

SEQ ID NO: 97672 - protein, 35 aa, Artificial Sequence
  Description of Artificial Sequence: Synthetic polypeptide
DTEEIRATNPVATEQYGSVSTTNNQLQAGNGTENF

SEQ ID NO: 97673 - protein, 32 aa, Artificial Sequence
  Description of Artificial Sequence: Synthetic polypeptide
FEEEIRTTNPVATEQYGSVSDVGMGNQGFNEF

SEQ ID NO: 97674 - protein, 32 aa, Artificial Sequence
  Description of Artificial Sequence: Synthetic polypeptide
NEEEIATTNPVAYEQYGSVATNLQDNPTEGRN

SEQ ID NO: 97675 - protein, 28 aa, Artificial Sequence
  Description of Artificial Sequence: Synthetic peptide
AENEIACTNPCASEQYGEASCNLQSGTR

SEQ ID NO: 97676 - protein, 35 aa, Artificial Sequence
  Description of Artificial Sequence: Synthetic polypeptide
AEEEIRTTNPVATEQYGSVVVTTANLGNQEGTNVD

SEQ ID NO: 97677 - protein, 34 aa, Artificial Sequence
  Description of Artificial Sequence: Synthetic polypeptide
AEEEIRTTNPVATEQYGSVVVTSNQLGNTAGNND

SEQ ID NO: 97678 - protein, 35 aa, Artificial Sequence
  Description of Artificial Sequence: Synthetic polypeptide
AEEEIRTTNPVATEQYGSVVVVVTTNLQQGEGGNS

SEQ ID NO: 97679 - protein, 33 aa, Artificial Sequence
  Description of Artificial Sequence: Synthetic polypeptide
FEEEIRTTNPVATEQYGSVSDTGFGGGNEGNQG

SEQ ID NO: 97680 - protein, 33 aa, Artificial Sequence
  Description of Artificial Sequence: Synthetic polypeptide
NEEEIATTNPVAYEQYGSVATNLEQTRNPEPRN

SEQ ID NO: 97681 - protein, 35 aa, Artificial Sequence
  Description of Artificial Sequence: Synthetic polypeptide
AEEEIRTTNPVATEQYGSVVVTSNNLNNQAGTNND

SEQ ID NO: 97682 - protein, 32 aa, Artificial Sequence
  Description of Artificial Sequence: Synthetic polypeptide
QEEEIACTNPVATEQYGCVATNLQDRGDIFEN

SEQ ID NO: 97683 - protein, 32 aa, Artificial Sequence
  Description of Artificial Sequence: Synthetic polypeptide
NEEEIATTNPVAYEQYGSVATNLDTRNPEDRN

SEQ ID NO: 97684 - protein, 31 aa, Artificial Sequence
  Description of Artificial Sequence: Synthetic polypeptide
QEEEIACTNPVATEQYGCVATNLQDDQGDTM

SEQ ID NO: 97685 - protein, 35 aa, Artificial Sequence
  Description of Artificial Sequence: Synthetic polypeptide
AEEEIRTTNPVATEQYGSVVVTSNLQQGTEGTNDG

SEQ ID NO: 97686 - protein, 31 aa, Artificial Sequence
  Description of Artificial Sequence: Synthetic polypeptide
NEEEIATTNPVAYEQYGSVAMNGQQPDNDRQ

SEQ ID NO: 97687 - protein, 33 aa, Artificial Sequence
  Description of Artificial Sequence: Synthetic polypeptide
DTEEIRATNPVATEQYGSVVTVTNLEQGNEGTD

SEQ ID NO: 97688 - protein, 35 aa, Artificial Sequence
  Description of Artificial Sequence: Synthetic polypeptide
DEEEIRTTNPVATEQYGSVNSVTMTDIGQSGGNGT

SEQ ID NO: 97689 - protein, 33 aa, Artificial Sequence
  Description of Artificial Sequence: Synthetic polypeptide
QEEEIATTNPVATECYGSVSTPCLPQMRGMEPL

SEQ ID NO: 97690 - protein, 33 aa, Artificial Sequence
  Description of Artificial Sequence: Synthetic polypeptide
NEEEIATTNPVAYEQYGSVAITNLAEGEDINDR

SEQ ID NO: 97691 - protein, 31 aa, Artificial Sequence
  Description of Artificial Sequence: Synthetic polypeptide
DEECIRCTNPVATEQYGCVSWEDQGFGSNQS

SEQ ID NO: 97692 - protein, 31 aa, Artificial Sequence
  Description of Artificial Sequence: Synthetic polypeptide
QEEEIATTNPVATEQYGEVAANVCQSRVGEK

SEQ ID NO: 97693 - protein, 35 aa, Artificial Sequence
  Description of Artificial Sequence: Synthetic polypeptide
AEEEIRTTNPVATEQYGSVVVVVTTNLQTGEENDD

SEQ ID NO: 97694 - protein, 35 aa, Artificial Sequence
  Description of Artificial Sequence: Synthetic polypeptide
AEEEIRTTNPVATEQYGSVVVVVTTNLNEQGGNQA

SEQ ID NO: 97695 - protein, 31 aa, Artificial Sequence
  Description of Artificial Sequence: Synthetic polypeptide
NEEEIATTNPVAYEQYGSVATNLQMNPTEGD

SEQ ID NO: 97696 - protein, 32 aa, Artificial Sequence
  Description of Artificial Sequence: Synthetic polypeptide
DEECISTTNPVATEQYGCVCSTELQNFNSQQS

SEQ ID NO: 97697 - protein, 32 aa, Artificial Sequence
  Description of Artificial Sequence: Synthetic polypeptide
NEEEIATTNPVAYEQYGSVATNLQTEGGGMES

SEQ ID NO: 97698 - protein, 34 aa, Artificial Sequence
  Description of Artificial Sequence: Synthetic polypeptide
DEEEIRTTNPVATEQYGSVSATPAGPNMRNGEPV

SEQ ID NO: 97699 - protein, 34 aa, Artificial Sequence
  Description of Artificial Sequence: Synthetic polypeptide
AEEEIRTTNPVATEQYGSVVVTTNLGGNEQGNNT

SEQ ID NO: 97700 - protein, 35 aa, Artificial Sequence
  Description of Artificial Sequence: Synthetic polypeptide
DTEEIRATNPVATEQYGSVSTTNQLQQGNGNQEGT

SEQ ID NO: 97701 - protein, 36 aa, Artificial Sequence
  Description of Artificial Sequence: Synthetic polypeptide
DEEEIRTTNPVATEQYGSVNSYNNFLEAIQNGVPER

SEQ ID NO: 97702 - protein, 34 aa, Artificial Sequence
  Description of Artificial Sequence: Synthetic polypeptide
DEEEIRTTNPVATEQYGSVNSWTSQLDNQGQEDG

SEQ ID NO: 97703 - protein, 33 aa, Artificial Sequence
  Description of Artificial Sequence: Synthetic polypeptide
DEEEIRTTNPVATEQYGSVSDTVGHIETPGQLE

SEQ ID NO: 97704 - protein, 32 aa, Artificial Sequence
  Description of Artificial Sequence: Synthetic polypeptide
FEEEIRTTNPVATEQYGSVSEQNNLETMVVEV

SEQ ID NO: 97705 - protein, 29 aa, Artificial Sequence
  Description of Artificial Sequence: Synthetic peptide
QEEEIATTNPVATECYGSVPCNCQHEEEG

SEQ ID NO: 97706 - protein, 28 aa, Artificial Sequence
  Description of Artificial Sequence: Synthetic peptide
AENEIACTNPCASEQYGEASENLQSGTR

SEQ ID NO: 97707 - protein, 34 aa, Artificial Sequence
  Description of Artificial Sequence: Synthetic polypeptide
DEEEIRTTNPVATEQYGSVSATPAGPNMRNGEPL

SEQ ID NO: 97708 - protein, 32 aa, Artificial Sequence
  Description of Artificial Sequence: Synthetic polypeptide
QEEEIATTNPVATECYGSVSECLPQMRGMEPL

SEQ ID NO: 97709 - protein, 35 aa, Artificial Sequence
  Description of Artificial Sequence: Synthetic polypeptide
AEEEIRTTNPVATEQYGSVVTVTNLQQNDENGNSE

SEQ ID NO: 97710 - protein, 34 aa, Artificial Sequence
  Description of Artificial Sequence: Synthetic polypeptide
AEEEIRTTNPVATEQYGSVVVSTTNLELGTEAGT

SEQ ID NO: 97711 - protein, 28 aa, Artificial Sequence
  Description of Artificial Sequence: Synthetic peptide
AENEIACTNPCSSEQYGEASCNLQRGTR

SEQ ID NO: 97712 - protein, 34 aa, Artificial Sequence
  Description of Artificial Sequence: Synthetic polypeptide
DEEEIRTTNPVATEQYGSVSLPLNLEENGEEEFM

SEQ ID NO: 97713 - protein, 35 aa, Artificial Sequence
  Description of Artificial Sequence: Synthetic polypeptide
DEEEIRTTNPVATEQYGSVSDTVGMGGNGQTGGGV

SEQ ID NO: 97714 - protein, 33 aa, Artificial Sequence
  Description of Artificial Sequence: Synthetic polypeptide
FEEEIRTTNPVATEQYGSVSDVTLIGGQGQGED

SEQ ID NO: 97715 - protein, 34 aa, Artificial Sequence
  Description of Artificial Sequence: Synthetic polypeptide
DEEEIRTTNPVATEQYGSVSLNNGSQMTNENEEN

SEQ ID NO: 97716 - protein, 35 aa, Artificial Sequence
  Description of Artificial Sequence: Synthetic polypeptide
AEEEIRTTNPVATEQYGSVVVVVTTNLQEGNVTDE

SEQ ID NO: 97717 - protein, 29 aa, Artificial Sequence
  Description of Artificial Sequence: Synthetic peptide
DEEEIATTNPVATECWGSVPCNCQHEEEG

SEQ ID NO: 97718 - protein, 32 aa, Artificial Sequence
  Description of Artificial Sequence: Synthetic polypeptide
DEECIRCTNPVATEQYGCVSWENHQRFGSDQS

SEQ ID NO: 97719 - protein, 34 aa, Artificial Sequence
  Description of Artificial Sequence: Synthetic polypeptide
FEEEIRTTNPVATEQYGSVSGDENGQSEGGENIE

SEQ ID NO: 97720 - protein, 35 aa, Artificial Sequence
  Description of Artificial Sequence: Synthetic polypeptide
DEEEIRTTNPVATEQYGSVSLTNGQSINMLMNQHN

SEQ ID NO: 97721 - protein, 30 aa, Artificial Sequence
  Description of Artificial Sequence: Synthetic polypeptide
DTEEIATTNPCATEHWGSVYFVNDHQRENR

SEQ ID NO: 97722 - protein, 33 aa, Artificial Sequence
  Description of Artificial Sequence: Synthetic polypeptide
DEECIATVNPVATEAYGSVVSCDNLSERGGNNR

SEQ ID NO: 97723 - protein, 35 aa, Artificial Sequence
  Description of Artificial Sequence: Synthetic polypeptide
AEEEIRTTNPVATEQYGSVVVTTNLQQLQQGNTND

SEQ ID NO: 97724 - protein, 35 aa, Artificial Sequence
  Description of Artificial Sequence: Synthetic polypeptide
AEEEIRTTNPVATEQYGSVVVTTNLQQLQQGNNNN

SEQ ID NO: 97725 - protein, 33 aa, Artificial Sequence
  Description of Artificial Sequence: Synthetic polypeptide
NETEIRTTNPVATENYGCVSTGNGLIGENGNQR

SEQ ID NO: 97726 - protein, 33 aa, Artificial Sequence
  Description of Artificial Sequence: Synthetic polypeptide
NEEEIRTTNPVATEQYGCSCSTEDLQRFQSDQA

SEQ ID NO: 97727 - protein, 30 aa, Artificial Sequence
  Description of Artificial Sequence: Synthetic polypeptide
QEEEIATTNPVATECYGDVSTCLPQHEMEV

SEQ ID NO: 97728 - protein, 28 aa, Artificial Sequence
  Description of Artificial Sequence: Synthetic peptide
AENEIACTNPVATECYGEASENLQREGL

SEQ ID NO: 97729 - protein, 32 aa, Artificial Sequence
  Description of Artificial Sequence: Synthetic polypeptide
NETEIRTTNPVATENYGCVSTSNGNDIGEGNR

SEQ ID NO: 97730 - protein, 33 aa, Artificial Sequence
  Description of Artificial Sequence: Synthetic polypeptide
NETEIRTTNPVATEMWGSVSTNLQGNEGTNNDG

SEQ ID NO: 97731 - protein, 30 aa, Artificial Sequence
  Description of Artificial Sequence: Synthetic polypeptide
AENEIACTNPVATECYGEASENLPQDRGGR

SEQ ID NO: 97732 - protein, 34 aa, Artificial Sequence
  Description of Artificial Sequence: Synthetic polypeptide
FEEEIRTTNPVATEQYGSVSGTNGVNVNGGNGQD

SEQ ID NO: 97733 - protein, 32 aa, Artificial Sequence
  Description of Artificial Sequence: Synthetic polypeptide
DEEEIACTNPVATEQYGSVCATNLENHGDLDA

SEQ ID NO: 97734 - protein, 30 aa, Artificial Sequence
  Description of Artificial Sequence: Synthetic polypeptide
DTEEIATTNPCAYEHWGSVYFVDLQRDGNR

SEQ ID NO: 97735 - protein, 31 aa, Artificial Sequence
  Description of Artificial Sequence: Synthetic polypeptide
DEECIATVNPVATECYGSVVCIDNDERGNRD

SEQ ID NO: 97736 - protein, 30 aa, Artificial Sequence
  Description of Artificial Sequence: Synthetic polypeptide
AENEIACTNPVATECYGEASEINLQREGGR

SEQ ID NO: 97737 - protein, 32 aa, Artificial Sequence
  Description of Artificial Sequence: Synthetic polypeptide
DEECIATVNPVATECYGSVVCIDNDGEQRGNR

SEQ ID NO: 97738 - protein, 34 aa, Artificial Sequence
  Description of Artificial Sequence: Synthetic polypeptide
DEEEIACTNPVATEQYGSVCATNPLQDVGENGDP

SEQ ID NO: 97739 - protein, 29 aa, Artificial Sequence
  Description of Artificial Sequence: Synthetic peptide
AENEIACTNPVATECWGSASENLQDRGGG

SEQ ID NO: 97740 - protein, 29 aa, Artificial Sequence
  Description of Artificial Sequence: Synthetic peptide
AENEIACTNPVATECWGSASCNLQDRGGG

SEQ ID NO: 97741 - protein, 35 aa, Artificial Sequence
  Description of Artificial Sequence: Synthetic polypeptide
FEEEIRTTNPVATEQYGSVSGTVNAEGQTGGNGNG

SEQ ID NO: 97742 - protein, 32 aa, Artificial Sequence
  Description of Artificial Sequence: Synthetic polypeptide
DTEEIATTNPVATTQWGEVSTNGDAQDNGNHR

SEQ ID NO: 97743 - protein, 35 aa, Artificial Sequence
  Description of Artificial Sequence: Synthetic polypeptide
AEEEIRTTNPVATEQYGSVVTVTNNGNLQQGTNEI

SEQ ID NO: 97744 - protein, 34 aa, Artificial Sequence
  Description of Artificial Sequence: Synthetic polypeptide
FEEEIRTTNPVATEQYGSVSGTVNEGQTGGGGET

SEQ ID NO: 97745 - protein, 29 aa, Artificial Sequence
  Description of Artificial Sequence: Synthetic peptide
AENEIACTNPVATECYGETAEENLQRGGR

SEQ ID NO: 97746 - protein, 33 aa, Artificial Sequence
  Description of Artificial Sequence: Synthetic polypeptide
DTEAEIATTNPVAYEQYGSVATNLTQNPGDNSM

SEQ ID NO: 97747 - protein, 35 aa, Artificial Sequence
  Description of Artificial Sequence: Synthetic polypeptide
DEEEIRTTNPVATEQYGSVMGTDFENNQNEGGNIG

SEQ ID NO: 97748 - protein, 32 aa, Artificial Sequence
  Description of Artificial Sequence: Synthetic polypeptide
NEEEIRTTNPVATEQYGCSCSTELQEHFQSDQ

SEQ ID NO: 97749 - protein, 34 aa, Artificial Sequence
  Description of Artificial Sequence: Synthetic polypeptide
DEEEIRTTNPVATEQYGSVSLTTLLEQQSSSETV

SEQ ID NO: 97750 - protein, 33 aa, Artificial Sequence
  Description of Artificial Sequence: Synthetic polypeptide
FEEEIRTTNPVATEQYGSVSIGGLGIGDNGNIS

SEQ ID NO: 97751 - protein, 33 aa, Artificial Sequence
  Description of Artificial Sequence: Synthetic polypeptide
DEEEIATTNPVATECYGKTVSTPLSDRTVGDRF

SEQ ID NO: 97752 - protein, 30 aa, Artificial Sequence
  Description of Artificial Sequence: Synthetic polypeptide
AENEIACTNPVATECYGEASNENLQERGGR

SEQ ID NO: 97753 - protein, 34 aa, Artificial Sequence
  Description of Artificial Sequence: Synthetic polypeptide
DEEEIRTTNPVATEQYGSVSLTSSLITENLLIAD

SEQ ID NO: 97754 - protein, 34 aa, Artificial Sequence
  Description of Artificial Sequence: Synthetic polypeptide
DEEEIRTTNPVATEQYGSVSATPNHIQQTDSVEE

SEQ ID NO: 97755 - protein, 33 aa, Artificial Sequence
  Description of Artificial Sequence: Synthetic polypeptide
NETEIRTTNPVATEMWGSVCSTNLQGNDGNTDQ

SEQ ID NO: 97756 - protein, 35 aa, Artificial Sequence
  Description of Artificial Sequence: Synthetic polypeptide
DEEEIRTTNPVATEQYGSVSLTSLALQQADVNLNT

SEQ ID NO: 97757 - protein, 33 aa, Artificial Sequence
  Description of Artificial Sequence: Synthetic polypeptide
NETEIRTTNPVATEMWGSVSTNLNQGNEGGNTS

SEQ ID NO: 97758 - protein, 34 aa, Artificial Sequence
  Description of Artificial Sequence: Synthetic polypeptide
AEEEIRTTNPVATEQYGVVSVVTNNQLNQGNNNQ

SEQ ID NO: 97759 - protein, 34 aa, Artificial Sequence
  Description of Artificial Sequence: Synthetic polypeptide
FEEEIRTTNPVATEQYGSVSIDNDINGQGGGNGE

SEQ ID NO: 97760 - protein, 28 aa, Artificial Sequence
  Description of Artificial Sequence: Synthetic peptide
QEEEIATTNPVATECYGDVSECNQHEEL

SEQ ID NO: 97761 - protein, 32 aa, Artificial Sequence
  Description of Artificial Sequence: Synthetic polypeptide
NEEEIRTTNPVATEQYGCSCSTELIYFQSDQA

SEQ ID NO: 97762 - protein, 32 aa, Artificial Sequence
  Description of Artificial Sequence: Synthetic polypeptide
NEEEIRTTNPVATEQYGCSCSTELANFQSQQS

SEQ ID NO: 97763 - protein, 35 aa, Artificial Sequence
  Description of Artificial Sequence: Synthetic polypeptide
AEEEIRTTNPVATEQYGSVVTVTNNGNLQQGTNTA

SEQ ID NO: 97764 - protein, 32 aa, Artificial Sequence
  Description of Artificial Sequence: Synthetic polypeptide
QEEEIACTNPVATEQYGCVATNLQPDQGNNSE

SEQ ID NO: 97765 - protein, 35 aa, Artificial Sequence
  Description of Artificial Sequence: Synthetic polypeptide
DEEEIRTTNPVATEQYGSVSLTSNNEEHRPQEERQ

SEQ ID NO: 97766 - protein, 35 aa, Artificial Sequence
  Description of Artificial Sequence: Synthetic polypeptide
DTEEIRATNPVATEQYGSVSTNLTQNQQQGTNVNE

SEQ ID NO: 97767 - protein, 32 aa, Artificial Sequence
  Description of Artificial Sequence: Synthetic polypeptide
DTEEIATTNPVATTQWGSVATNNGDQDGGNHR

SEQ ID NO: 97768 - protein, 35 aa, Artificial Sequence
  Description of Artificial Sequence: Synthetic polypeptide
DEEEIRTTNPVATEQYGSVSLTPLLSEVEGENQIA

SEQ ID NO: 97769 - protein, 33 aa, Artificial Sequence
  Description of Artificial Sequence: Synthetic polypeptide
DEECIATVNPVATEPYGSVPSCDNLSERGGNNR

SEQ ID NO: 97770 - protein, 34 aa, Artificial Sequence
  Description of Artificial Sequence: Synthetic polypeptide
AEEEIRTTNPVATEQYGSVVVTTNLNNTTEGNNS

SEQ ID NO: 97771 - protein, 31 aa, Artificial Sequence
  Description of Artificial Sequence: Synthetic polypeptide
DEECIATVNPVATEWYGSVVCIDHNDERGNR

SEQ ID NO: 97772 - protein, 32 aa, Artificial Sequence
  Description of Artificial Sequence: Synthetic polypeptide
DEECIATVNPVAYERYGSTVSQNLSERTGGNR

SEQ ID NO: 97773 - protein, 31 aa, Artificial Sequence
  Description of Artificial Sequence: Synthetic polypeptide
DEECIETVNPVATEWYGSVSDPNLEGGGTRT

SEQ ID NO: 97774 - protein, 34 aa, Artificial Sequence
  Description of Artificial Sequence: Synthetic polypeptide
DEEEIACTNPVATEQYGSVCSTNPLNEAEGENNA

SEQ ID NO: 97775 - protein, 29 aa, Artificial Sequence
  Description of Artificial Sequence: Synthetic peptide
QEEEIATTNPVATEQYGEVPEPVCNRENV

SEQ ID NO: 97776 - protein, 33 aa, Artificial Sequence
  Description of Artificial Sequence: Synthetic polypeptide
FEEEIRTTNPVATEQYGSVSGDNVNVNGGNGQE

SEQ ID NO: 97777 - protein, 32 aa, Artificial Sequence
  Description of Artificial Sequence: Synthetic polypeptide
DTEEICTTNPVATTQYGSVSTNSAEGGTNQNN

SEQ ID NO: 97778 - protein, 33 aa, Artificial Sequence
  Description of Artificial Sequence: Synthetic polypeptide
DEECIATVNPVATEPYGSTVSCCNLSERGGNNR

SEQ ID NO: 97779 - protein, 32 aa, Artificial Sequence
  Description of Artificial Sequence: Synthetic polypeptide
NETEIRTTNPVATEYWGNVATNLQGQDGDNER

SEQ ID NO: 97780 - protein, 30 aa, Artificial Sequence
  Description of Artificial Sequence: Synthetic polypeptide
AENEIACTNPVATDQYGEASENLQNREGVR

SEQ ID NO: 97781 - protein, 32 aa, Artificial Sequence
  Description of Artificial Sequence: Synthetic polypeptide
NETEIRTTNPVATEYWGNVSTNLQGEEGNNES

SEQ ID NO: 97782 - protein, 34 aa, Artificial Sequence
  Description of Artificial Sequence: Synthetic polypeptide
DEECIKTTNPVGTEQYGSTVDTLNPLSQRGGNQE

SEQ ID NO: 97783 - protein, 33 aa, Artificial Sequence
  Description of Artificial Sequence: Synthetic polypeptide
FEEEIRTTNPVATEQYGSVSGDGNGQNTGGEES

SEQ ID NO: 97784 - protein, 30 aa, Artificial Sequence
  Description of Artificial Sequence: Synthetic polypeptide
DEECIKTVNPVATEWYGHSVSDPNHERVTR

SEQ ID NO: 97785 - protein, 30 aa, Artificial Sequence
  Description of Artificial Sequence: Synthetic polypeptide
AENEIACTNPVACEQYGEASENLDQYRGGR

SEQ ID NO: 97786 - protein, 31 aa, Artificial Sequence
  Description of Artificial Sequence: Synthetic polypeptide
DEEEIATTNPVATECYGDVSTPALQMHEEPV

SEQ ID NO: 97787 - protein, 30 aa, Artificial Sequence
  Description of Artificial Sequence: Synthetic polypeptide
AENEIACTNPQATEQYGECASENLQRGGPR

SEQ ID NO: 97788 - protein, 34 aa, Artificial Sequence
  Description of Artificial Sequence: Synthetic polypeptide
NEEEIRTTNPVATEPYGVVSCQTELSTEQGGNNR

SEQ ID NO: 97789 - protein, 30 aa, Artificial Sequence
  Description of Artificial Sequence: Synthetic polypeptide
QEEEIATTNPVATEQYGEVPEINEQHEENK

SEQ ID NO: 97790 - protein, 36 aa, Artificial Sequence
  Description of Artificial Sequence: Synthetic polypeptide
DEEEIRTTNPVATEQYGSVSLTPLLSQPEEGENELA

SEQ ID NO: 97791 - protein, 33 aa, Artificial Sequence
  Description of Artificial Sequence: Synthetic polypeptide
DTEEICTTNPVATTQYGSVSTNPATQGGNNVNM

SEQ ID NO: 97792 - protein, 34 aa, Artificial Sequence
  Description of Artificial Sequence: Synthetic polypeptide
DEECISTTNPVATEQYGCVCSTGNLQNFGSNNDS

SEQ ID NO: 97793 - protein, 33 aa, Artificial Sequence
  Description of Artificial Sequence: Synthetic polypeptide
NETEIRTTNPVATEQYGSVSTTQGMGERGNGDV

SEQ ID NO: 97794 - protein, 34 aa, Artificial Sequence
  Description of Artificial Sequence: Synthetic polypeptide
DEEEIRTTNPVATEQYGSVQEPTNNGIETDNVRT

SEQ ID NO: 97795 - protein, 32 aa, Artificial Sequence
  Description of Artificial Sequence: Synthetic polypeptide
DTEEIATTNPVATTQWGSVSGENGDRGNGNHR

SEQ ID NO: 97796 - protein, 30 aa, Artificial Sequence
  Description of Artificial Sequence: Synthetic polypeptide
AENEIACTNPVATECWGSASCNEQDREGNR

SEQ ID NO: 97797 - protein, 32 aa, Artificial Sequence
  Description of Artificial Sequence: Synthetic polypeptide
DTEEICTTNPCATEQYGSVSAIDLQSMGTLRS

SEQ ID NO: 97798 - protein, 34 aa, Artificial Sequence
  Description of Artificial Sequence: Synthetic polypeptide
DEEEIRTTNPVATEQYGSVSLTNVIIPTNVQLNE

SEQ ID NO: 97799 - protein, 32 aa, Artificial Sequence
  Description of Artificial Sequence: Synthetic polypeptide
DTEEICTTNPVATTQYGSVSTNNAEGGNNVNG

SEQ ID NO: 97800 - protein, 34 aa, Artificial Sequence
  Description of Artificial Sequence: Synthetic polypeptide
NETEIRTTNPVATEQYGSVSTTQGMGERNGQNDR

SEQ ID NO: 97801 - protein, 32 aa, Artificial Sequence
  Description of Artificial Sequence: Synthetic polypeptide
NEEEIRTTNPVATEQYGCFCSTELQRFQSDQS

SEQ ID NO: 97802 - protein, 35 aa, Artificial Sequence
  Description of Artificial Sequence: Synthetic polypeptide
NEEEIRTTNPVATEQWGSVCSKTNDDLDQRNSNDY

SEQ ID NO: 97803 - protein, 31 aa, Artificial Sequence
  Description of Artificial Sequence: Synthetic polypeptide
NEEEIRTTNPVATEQYGCFCSTELQHFQSQQ

SEQ ID NO: 97804 - protein, 32 aa, Artificial Sequence
  Description of Artificial Sequence: Synthetic polypeptide
DEEEIACTNPVATEQYGSVCATPLQADEDNDD

SEQ ID NO: 97805 - protein, 29 aa, Artificial Sequence
  Description of Artificial Sequence: Synthetic peptide
AENEIACTNPVATECWGEASCNEQREGNR

SEQ ID NO: 97806 - protein, 32 aa, Artificial Sequence
  Description of Artificial Sequence: Synthetic polypeptide
MEEEIATTNPVATEQYGCVAGNALQNNNSERQ

SEQ ID NO: 97807 - protein, 32 aa, Artificial Sequence
  Description of Artificial Sequence: Synthetic polypeptide
DTEEICTTNPVATTQYGSVSTNPAEGGNTDNS

SEQ ID NO: 97808 - protein, 32 aa, Artificial Sequence
  Description of Artificial Sequence: Synthetic polypeptide
MEEEIATTNPVATEQYGCVAGTALQNDSGEGR

SEQ ID NO: 97809 - protein, 32 aa, Artificial Sequence
  Description of Artificial Sequence: Synthetic polypeptide
DTEEICTTNPVATTQYGSVSTNPAENGGNENN

SEQ ID NO: 97810 - protein, 33 aa, Artificial Sequence
  Description of Artificial Sequence: Synthetic polypeptide
NETEIRTTNPVATEQYGSVSTTQMMGDRQGNDG

SEQ ID NO: 97811 - protein, 35 aa, Artificial Sequence
  Description of Artificial Sequence: Synthetic polypeptide
DEEEIACTNPVATEQYGSVCSTGNLDQTAGDNAQE

SEQ ID NO: 97812 - protein, 34 aa, Artificial Sequence
  Description of Artificial Sequence: Synthetic polypeptide
FEEEIRTTNPVATEQYGSVSGGLGGQNNGNGQDN

SEQ ID NO: 97813 - protein, 33 aa, Artificial Sequence
  Description of Artificial Sequence: Synthetic polypeptide
FEEEIRTTNPVATEQYGSVSGNNVNVNGGNGQG

SEQ ID NO: 97814 - protein, 31 aa, Artificial Sequence
  Description of Artificial Sequence: Synthetic polypeptide
DEECIRCTNPVATEQYGCVSWPHQHFGSNQS

SEQ ID NO: 97815 - protein, 33 aa, Artificial Sequence
  Description of Artificial Sequence: Synthetic polypeptide
FEEEIRTTNPVATEQYGSVSDGGQGEGEGENGM

SEQ ID NO: 97816 - protein, 34 aa, Artificial Sequence
  Description of Artificial Sequence: Synthetic polypeptide
DTEEIRATNPVATEQYGSVVVSVTTNLQNGTDEE

SEQ ID NO: 97817 - protein, 33 aa, Artificial Sequence
  Description of Artificial Sequence: Synthetic polypeptide
DEEEIRTTNPVATEQYGSVNSVENYDDNGEEHT

SEQ ID NO: 97818 - protein, 32 aa, Artificial Sequence
  Description of Artificial Sequence: Synthetic polypeptide
DTEEIRTTNPAATEHYGSVCMSFNLERETQRE

SEQ ID NO: 97819 - protein, 34 aa, Artificial Sequence
  Description of Artificial Sequence: Synthetic polypeptide
DEEEIRTTNPVATEQYGSVSEDGLAQTNPQVVID

SEQ ID NO: 97820 - protein, 34 aa, Artificial Sequence
  Description of Artificial Sequence: Synthetic polypeptide
AEEEIRTTNPVATEQYGSVVVTNQLGGNNQGNQD

SEQ ID NO: 97821 - protein, 34 aa, Artificial Sequence
  Description of Artificial Sequence: Synthetic polypeptide
DEEEIRTTNPVATEQYGSVSITVGPNMATGIDGD

SEQ ID NO: 97822 - protein, 35 aa, Artificial Sequence
  Description of Artificial Sequence: Synthetic polypeptide
FEEEIRTTNPVATEQYGSVNDATGNLGQGEGGNIP

SEQ ID NO: 97823 - protein, 33 aa, Artificial Sequence
  Description of Artificial Sequence: Synthetic polypeptide
FEEEIRTTNPVATEQYGSVNAGNMGQTGGNGDD

SEQ ID NO: 97824 - protein, 31 aa, Artificial Sequence
  Description of Artificial Sequence: Synthetic polypeptide
DTEEIRTTNPAATEHYGSVCPINNLEREPQR

SEQ ID NO: 97825 - protein, 31 aa, Artificial Sequence
  Description of Artificial Sequence: Synthetic polypeptide
DTEEIRTTNPAATEHYGSVPFVPLERENQRP

SEQ ID NO: 97826 - protein, 35 aa, Artificial Sequence
  Description of Artificial Sequence: Synthetic polypeptide
DEEEIRTTNPVATEQYGSVNSVETPELDQRSEIID

SEQ ID NO: 97827 - protein, 35 aa, Artificial Sequence
  Description of Artificial Sequence: Synthetic polypeptide
AEEEIRTTNPVATEQYGVVSVTNNLQQGNAGTNVN

SEQ ID NO: 97828 - protein, 33 aa, Artificial Sequence
  Description of Artificial Sequence: Synthetic polypeptide
DEEEIRTTNPVATEQYGSVSITTPEIEVMGVDN

SEQ ID NO: 97829 - protein, 32 aa, Artificial Sequence
  Description of Artificial Sequence: Synthetic polypeptide
DTEEIRTTNPAATEHYGSVSPFNPLERENQIM

SEQ ID NO: 97830 - protein, 34 aa, Artificial Sequence
  Description of Artificial Sequence: Synthetic polypeptide
DEECLRTTNPIAYEQYGEVPSVTGNLSQRGGNNR

SEQ ID NO: 97831 - protein, 35 aa, Artificial Sequence
  Description of Artificial Sequence: Synthetic polypeptide
DEEEIRTTNPVATEQYGSVSITTAGPNMRNGMNPV

SEQ ID NO: 97832 - protein, 34 aa, Artificial Sequence
  Description of Artificial Sequence: Synthetic polypeptide
AEEEIRTTNPVATEQYGSVVTVTNLGGNEEGNNQ

SEQ ID NO: 97833 - protein, 33 aa, Artificial Sequence
  Description of Artificial Sequence: Synthetic polypeptide
DTEEIRTTNPCATEAYGSVSTVNNNLQEAEENQ

SEQ ID NO: 97834 - protein, 34 aa, Artificial Sequence
  Description of Artificial Sequence: Synthetic polypeptide
FEEEIRTTNPVATEQYGSVMGTNDQGGGEQNNGG

SEQ ID NO: 97835 - protein, 35 aa, Artificial Sequence
  Description of Artificial Sequence: Synthetic polypeptide
AEEEIRTTNPVATEQYGSVVTVTNGNLQQGTNQTS

SEQ ID NO: 97836 - protein, 33 aa, Artificial Sequence
  Description of Artificial Sequence: Synthetic polypeptide
DTEEIRTTNPCATEAYGSVSTVNNNLQQQEENQ

SEQ ID NO: 97837 - protein, 35 aa, Artificial Sequence
  Description of Artificial Sequence: Synthetic polypeptide
DEEEIRTTNPVATEQYGSVNSTVQDDQRGGEEEGA

SEQ ID NO: 97838 - protein, 34 aa, Artificial Sequence
  Description of Artificial Sequence: Synthetic polypeptide
DTEEIRTTNPCATEAYGSVSTVTNLQGGTEENNE

SEQ ID NO: 97839 - protein, 34 aa, Artificial Sequence
  Description of Artificial Sequence: Synthetic polypeptide
DEEEIRTTNPVATEQYGSVNSVGMGQENDGENGS

SEQ ID NO: 97840 - protein, 34 aa, Artificial Sequence
  Description of Artificial Sequence: Synthetic polypeptide
DEEEIATTNPVATEQYGCVSGTNLGEAQGEGMSG

SEQ ID NO: 97841 - protein, 35 aa, Artificial Sequence
  Description of Artificial Sequence: Synthetic polypeptide
DEEEIRTTNPVATEQYGSVSATNALEMIVGVSEEY

SEQ ID NO: 97842 - protein, 31 aa, Artificial Sequence
  Description of Artificial Sequence: Synthetic polypeptide
NEEEIATTNPVATEQYGSVAAGNLDGMPNPD

SEQ ID NO: 97843 - protein, 35 aa, Artificial Sequence
  Description of Artificial Sequence: Synthetic polypeptide
DEEEIRTTNPVATEQYGSVSIVGNFTGQGEGENGG

SEQ ID NO: 97844 - protein, 32 aa, Artificial Sequence
  Description of Artificial Sequence: Synthetic polypeptide
DEECLRTTNPIAYEQYGCVSTGNLQNFGSNQS

SEQ ID NO: 97845 - protein, 31 aa, Artificial Sequence
  Description of Artificial Sequence: Synthetic polypeptide
NEEEIATTNPVATEQYGSVAAGNLDGMPNEH

SEQ ID NO: 97846 - protein, 35 aa, Artificial Sequence
  Description of Artificial Sequence: Synthetic polypeptide
DEEEIRTTNPVATEQYGSVISGSGNNGQGEGNQGN

SEQ ID NO: 97847 - protein, 32 aa, Artificial Sequence
  Description of Artificial Sequence: Synthetic polypeptide
NEEEIATTNPVATEQYGSVAAGNLDEAPPGAR

SEQ ID NO: 97848 - protein, 28 aa, Artificial Sequence
  Description of Artificial Sequence: Synthetic peptide
DEEEIATTNPVATEQYGDVPEICMAEEA

SEQ ID NO: 97849 - protein, 34 aa, Artificial Sequence
  Description of Artificial Sequence: Synthetic polypeptide
DEEEIRTTNPVATEQYGSVQLSPNGLMEDGHEVV

SEQ ID NO: 97850 - protein, 33 aa, Artificial Sequence
  Description of Artificial Sequence: Synthetic polypeptide
DEEEIATTNPVATEQYGCVSGTINGEHQGEGMS

SEQ ID NO: 97851 - protein, 34 aa, Artificial Sequence
  Description of Artificial Sequence: Synthetic polypeptide
DEEEIRTTNPVATEQYGSVQLTENALQLPQVLQM

SEQ ID NO: 97852 - protein, 30 aa, Artificial Sequence
  Description of Artificial Sequence: Synthetic polypeptide
DTEEIRTTNCCATEAYGSVSVNTAIATENR

SEQ ID NO: 97853 - protein, 33 aa, Artificial Sequence
  Description of Artificial Sequence: Synthetic polypeptide
FEEEIRTTNPVATEQYGSVNGTNMTNGGGENEG

SEQ ID NO: 97854 - protein, 34 aa, Artificial Sequence
  Description of Artificial Sequence: Synthetic polypeptide
FEEEIRTTNPVATEQYGSVNGTNGEQQEGGGNGN

SEQ ID NO: 97855 - protein, 33 aa, Artificial Sequence
  Description of Artificial Sequence: Synthetic polypeptide
NEEEIATTNPVATEQYGSCSTHLQPDDQAGDRA

SEQ ID NO: 97856 - protein, 28 aa, Artificial Sequence
  Description of Artificial Sequence: Synthetic peptide
QEEEIATTNPVATEGYGVMPSVLQHGEK

SEQ ID NO: 97857 - protein, 36 aa, Artificial Sequence
  Description of Artificial Sequence: Synthetic polypeptide
DEEEIRTTNPVATEQYGSVISGTMNDIGQEDDGNGD

SEQ ID NO: 97858 - protein, 28 aa, Artificial Sequence
  Description of Artificial Sequence: Synthetic peptide
QEEEIATTNPVATEQYGEIPEVCQHGEK

SEQ ID NO: 97859 - protein, 33 aa, Artificial Sequence
  Description of Artificial Sequence: Synthetic polypeptide
FEEEIRTTNPVATEQYGSVNDNSGQEEGGNIQD

SEQ ID NO: 97860 - protein, 30 aa, Artificial Sequence
  Description of Artificial Sequence: Synthetic polypeptide
QEEEIACTNPVATEQYGCVATNLQAPEDTA

SEQ ID NO: 97861 - protein, 32 aa, Artificial Sequence
  Description of Artificial Sequence: Synthetic polypeptide
NEEEIATTNPVATEQYGSCSTHLQPDMQGDFM

SEQ ID NO: 97862 - protein, 28 aa, Artificial Sequence
  Description of Artificial Sequence: Synthetic peptide
DEEEIATTNPVATEQYGDVPEICMAEEK

SEQ ID NO: 97863 - protein, 33 aa, Artificial Sequence
  Description of Artificial Sequence: Synthetic polypeptide
DTEEIRTTNPCATEAYGSVSTVTNLQGTDENDE

SEQ ID NO: 97864 - protein, 34 aa, Artificial Sequence
  Description of Artificial Sequence: Synthetic polypeptide
DEEEIRTTNPVATEQYGSVISLNPWIEERGQEQT

SEQ ID NO: 97865 - protein, 33 aa, Artificial Sequence
  Description of Artificial Sequence: Synthetic polypeptide
DEECIRTTNPVATEAYGETVSTASLSQRSGGQA

SEQ ID NO: 97866 - protein, 31 aa, Artificial Sequence
  Description of Artificial Sequence: Synthetic polypeptide
AEMEIVTTNPVATEQYGEVSATDGLEREGGD

SEQ ID NO: 97867 - protein, 34 aa, Artificial Sequence
  Description of Artificial Sequence: Synthetic polypeptide
DEEEIRTTNPVATEQYGSVSATENDIQQNISVEE

SEQ ID NO: 97868 - protein, 32 aa, Artificial Sequence
  Description of Artificial Sequence: Synthetic polypeptide
AEMEIVTTNPVATEQYGEVCSTDNPVEREGGR

SEQ ID NO: 97869 - protein, 32 aa, Artificial Sequence
  Description of Artificial Sequence: Synthetic polypeptide
NNEEIRTTNPVATEQYGVVSPNTQEQQQPPNR

SEQ ID NO: 97870 - protein, 33 aa, Artificial Sequence
  Description of Artificial Sequence: Synthetic polypeptide
DEEEIRTTNPVATEQYGSVSEEVYDIPRISENF

SEQ ID NO: 97871 - protein, 32 aa, Artificial Sequence
  Description of Artificial Sequence: Synthetic polypeptide
DEEEIRTTNPVATEQYGSVSEEVYDIRIVEDF

SEQ ID NO: 97872 - protein, 33 aa, Artificial Sequence
  Description of Artificial Sequence: Synthetic polypeptide
FEEEIRTTNPVATEQYGSVINTDEGGGQTGNQG

SEQ ID NO: 97873 - protein, 32 aa, Artificial Sequence
  Description of Artificial Sequence: Synthetic polypeptide
NNEEIRTTNPVATEQYGVVSPNTQEQWQGENC

SEQ ID NO: 97874 - protein, 31 aa, Artificial Sequence
  Description of Artificial Sequence: Synthetic polypeptide
QEEEIACTNPVATEQYGCVATNLQANDPNED

SEQ ID NO: 97875 - protein, 34 aa, Artificial Sequence
  Description of Artificial Sequence: Synthetic polypeptide
DEEEIRTTNPVATEQYGSVSEFVFLQERSEQDIL

SEQ ID NO: 97876 - protein, 32 aa, Artificial Sequence
  Description of Artificial Sequence: Synthetic polypeptide
AEMEIVTTNPVATEQYGEACSTDNLVEREGGR

SEQ ID NO: 97877 - protein, 35 aa, Artificial Sequence
  Description of Artificial Sequence: Synthetic polypeptide
FEEEIRTTNPVATEQYGSVGSTVNGMGQNNGGGNG

SEQ ID NO: 97878 - protein, 31 aa, Artificial Sequence
  Description of Artificial Sequence: Synthetic polypeptide
AEMEIVCTNPVATEQYGEACSEDNLEREGNR

SEQ ID NO: 97879 - protein, 34 aa, Artificial Sequence
  Description of Artificial Sequence: Synthetic polypeptide
FEEEIRTTNPVATEQYGSVGSNGNIGQNGGGNIG

SEQ ID NO: 97880 - protein, 34 aa, Artificial Sequence
  Description of Artificial Sequence: Synthetic polypeptide
FEEEIRTTNPVATEQYGSVGSNGNIGQEGGENEG

SEQ ID NO: 97881 - protein, 34 aa, Artificial Sequence
  Description of Artificial Sequence: Synthetic polypeptide
DEEEIRTTNPVATEQYGSVNMDTNGIGQEDGEQG

SEQ ID NO: 97882 - protein, 34 aa, Artificial Sequence
  Description of Artificial Sequence: Synthetic polypeptide
DEEEIRTTNPVATEQYGSVISPDDELQMIDENLV

SEQ ID NO: 97883 - protein, 32 aa, Artificial Sequence
  Description of Artificial Sequence: Synthetic polypeptide
DTEEIRTTNPQATEHYGSVCSFNPLEQRETFD

SEQ ID NO: 97884 - protein, 33 aa, Artificial Sequence
  Description of Artificial Sequence: Synthetic polypeptide
FEEEIRTTNPVATEQYGSVGNVDNIGQGEGENI

SEQ ID NO: 97885 - protein, 33 aa, Artificial Sequence
  Description of Artificial Sequence: Synthetic polypeptide
NNEEIRTTNPVATEQYGVVSPNTQEQWQGVNRT

SEQ ID NO: 97886 - protein, 35 aa, Artificial Sequence
  Description of Artificial Sequence: Synthetic polypeptide
AEEEIRTTNPVATEQYGSVVTVTNGNLQQGNNNIQ

SEQ ID NO: 97887 - protein, 34 aa, Artificial Sequence
  Description of Artificial Sequence: Synthetic polypeptide
DEEEIRTTNPVATEQYGSVISNSDGQQGEGENNV

SEQ ID NO: 97888 - protein, 34 aa, Artificial Sequence
  Description of Artificial Sequence: Synthetic polypeptide
DEEEIRTTNPVATEQYGSVISNMNVGQMEGMEEE

SEQ ID NO: 97889 - protein, 36 aa, Artificial Sequence
  Description of Artificial Sequence: Synthetic polypeptide
DEEEIRTTNPVATEQYGSVISLTNVLVTRVVETNPE

SEQ ID NO: 97890 - protein, 33 aa, Artificial Sequence
  Description of Artificial Sequence: Synthetic polypeptide
DTEEIRTTNPCATEAYGSVSTVTNLQQNDEEND

SEQ ID NO: 97891 - protein, 33 aa, Artificial Sequence
  Description of Artificial Sequence: Synthetic polypeptide
DTEEIRTTNPCATEAYGSVSTVTNNLQQNEENQ

SEQ ID NO: 97892 - protein, 35 aa, Artificial Sequence
  Description of Artificial Sequence: Synthetic polypeptide
FEEEIRTTNPVATEQYGSVITPLVNLLQQGENEGE

SEQ ID NO: 97893 - protein, 33 aa, Artificial Sequence
  Description of Artificial Sequence: Synthetic polypeptide
DEECLRTTNPIAYEQYGEVSCTNHSQRGGNNRM

SEQ ID NO: 97894 - protein, 34 aa, Artificial Sequence
  Description of Artificial Sequence: Synthetic polypeptide
DEEEIRTTNPVATEQYGSVISNGFGEQTGEGNEF

SEQ ID NO: 97895 - protein, 33 aa, Artificial Sequence
  Description of Artificial Sequence: Synthetic polypeptide
NNEEIRTTNPVATEQYGVVGSTDLNEDFGQNLR

SEQ ID NO: 97896 - protein, 34 aa, Artificial Sequence
  Description of Artificial Sequence: Synthetic polypeptide
DEECIRTTNPMATEQYGSVVACTNALSQTGGNYA

SEQ ID NO: 97897 - protein, 34 aa, Artificial Sequence
  Description of Artificial Sequence: Synthetic polypeptide
FEEEIRTTNPVATEQYGSVISSTDGQGQEGGGNT

SEQ ID NO: 97898 - protein, 31 aa, Artificial Sequence
  Description of Artificial Sequence: Synthetic polypeptide
DTEEIRTTNPCATEHWGSVYFNEQDQRENDR

SEQ ID NO: 97899 - protein, 36 aa, Artificial Sequence
  Description of Artificial Sequence: Synthetic polypeptide
DEEEIRTTNPVATEQYGSVSITNPAGPNMRNGMNPV

SEQ ID NO: 97900 - protein, 32 aa, Artificial Sequence
  Description of Artificial Sequence: Synthetic polypeptide
NNEEIRTTNPVATEQYGVVSPNTQEDWQGPPR

SEQ ID NO: 97901 - protein, 32 aa, Artificial Sequence
  Description of Artificial Sequence: Synthetic polypeptide
DEECIRTTNPVACEQYGVVCTIEVDQRGNGNS

SEQ ID NO: 97902 - protein, 31 aa, Artificial Sequence
  Description of Artificial Sequence: Synthetic polypeptide
DEECIRTTNPVAIEQYGQCDCTINVQGGNNN

SEQ ID NO: 97903 - protein, 33 aa, Artificial Sequence
  Description of Artificial Sequence: Synthetic polypeptide
FEEEIRTTNPVATEQYGSVISPTNLNEVIDQDL

SEQ ID NO: 97904 - protein, 33 aa, Artificial Sequence
  Description of Artificial Sequence: Synthetic polypeptide
FEEEIRTTNPVATEQYGSVISLANEEQPRDPQQ

SEQ ID NO: 97905 - protein, 32 aa, Artificial Sequence
  Description of Artificial Sequence: Synthetic polypeptide
DTEEIRTTNPCATEHWGSVYFENDHQEREGNR

SEQ ID NO: 97906 - protein, 33 aa, Artificial Sequence
  Description of Artificial Sequence: Synthetic polypeptide
DTEEIRTTNPCATEHWGSVYFINELDQRGENDR

SEQ ID NO: 97907 - protein, 34 aa, Artificial Sequence
  Description of Artificial Sequence: Synthetic polypeptide
DEEEIRTTNPVATEQYGSVISNMLIMRPEENQEL

SEQ ID NO: 97908 - protein, 33 aa, Artificial Sequence
  Description of Artificial Sequence: Synthetic polypeptide
FEEEIRTTNPVATEQYGSVIPTPEQQEPENNRF

SEQ ID NO: 97909 - protein, 36 aa, Artificial Sequence
  Description of Artificial Sequence: Synthetic polypeptide
DEEEIRTTNPVATEQYGSVSITNNMNQNNIGGNGQI

SEQ ID NO: 97910 - protein, 31 aa, Artificial Sequence
  Description of Artificial Sequence: Synthetic polypeptide
QEEEIATTNPVATEGYGNVAANVCQSRVGER

SEQ ID NO: 97911 - protein, 32 aa, Artificial Sequence
  Description of Artificial Sequence: Synthetic polypeptide
FEEEIRTTNPVATEQYGSVNMSDLDQTGEEGD

SEQ ID NO: 97912 - protein, 34 aa, Artificial Sequence
  Description of Artificial Sequence: Synthetic polypeptide
AEEEIRTTNPVATEQYGVVSVTSTNLQQLQQIGQ

SEQ ID NO: 97913 - protein, 33 aa, Artificial Sequence
  Description of Artificial Sequence: Synthetic polypeptide
DEECIRCTNPVATEQYGSVSWNEGEQEQQGNHL

SEQ ID NO: 97914 - protein, 34 aa, Artificial Sequence
  Description of Artificial Sequence: Synthetic polypeptide
DEECIRCTNPVATEQYGSVSWNEGEQERQGDTTR

SEQ ID NO: 97915 - protein, 34 aa, Artificial Sequence
  Description of Artificial Sequence: Synthetic polypeptide
DEECIRCTNPVATEQYGSVSWNEGEQERQGGNAK

SEQ ID NO: 97916 - protein, 31 aa, Artificial Sequence
  Description of Artificial Sequence: Synthetic polypeptide
DEECLRTTNPEAYEQYGCVSTNLQNFGSDQS

SEQ ID NO: 97917 - protein, 33 aa, Artificial Sequence
  Description of Artificial Sequence: Synthetic polypeptide
FEEEIRTTNPVATEQYGSVNTDDQQEGEGENET

SEQ ID NO: 97918 - protein, 33 aa, Artificial Sequence
  Description of Artificial Sequence: Synthetic polypeptide
DEEEIRTTNPVATEQYGSVSDVELTQETPEDIQ

SEQ ID NO: 97919 - protein, 31 aa, Artificial Sequence
  Description of Artificial Sequence: Synthetic polypeptide
QEEEIACTNPVATEQYGCVATNLQDAGDIED

SEQ ID NO: 97920 - protein, 34 aa, Artificial Sequence
  Description of Artificial Sequence: Synthetic polypeptide
DEEEIRTTNPVATEQYGSVSDVGMGGNGQTGGEI

SEQ ID NO: 97921 - protein, 31 aa, Artificial Sequence
  Description of Artificial Sequence: Synthetic polypeptide
NEEEIATTNPVAYEQWGSVRAWNDLDEQGNR

SEQ ID NO: 97922 - protein, 34 aa, Artificial Sequence
  Description of Artificial Sequence: Synthetic polypeptide
AEEEIRTTNPVATEQYGVVSVTTNTNQQTGNIQD

SEQ ID NO: 97923 - protein, 34 aa, Artificial Sequence
  Description of Artificial Sequence: Synthetic polypeptide
DEECIRCTNPVATEQYGSVSWNEGEQERQGNTDD

SEQ ID NO: 97924 - protein, 31 aa, Artificial Sequence
  Description of Artificial Sequence: Synthetic polypeptide
NEEEIATTNPVATESYGCIAGNNLQDSGDNR

SEQ ID NO: 97925 - protein, 33 aa, Artificial Sequence
  Description of Artificial Sequence: Synthetic polypeptide
DEEEIRTTNPVATEQYGSVSDVGMGLEDGGGGG

SEQ ID NO: 97926 - protein, 33 aa, Artificial Sequence
  Description of Artificial Sequence: Synthetic polypeptide
NEEEIATTNPVATERYGTVVSDTNELSQAGGNH

SEQ ID NO: 97927 - protein, 32 aa, Artificial Sequence
  Description of Artificial Sequence: Synthetic polypeptide
QEEEIACTNPVATEQYGCVATNLQAVGDNDQY

SEQ ID NO: 97928 - protein, 33 aa, Artificial Sequence
  Description of Artificial Sequence: Synthetic polypeptide
DEEEIRTTNPVATEQYGSVMGQNFTGGNGGGEE

SEQ ID NO: 97929 - protein, 34 aa, Artificial Sequence
  Description of Artificial Sequence: Synthetic polypeptide
DEEEIRTTNPVATEQYGSVISAELLQVRNFVPDN

SEQ ID NO: 97930 - protein, 28 aa, Artificial Sequence
  Description of Artificial Sequence: Synthetic peptide
QEEEIATTNPVATEGYGEAPEVCQRGEK

SEQ ID NO: 97931 - protein, 34 aa, Artificial Sequence
  Description of Artificial Sequence: Synthetic polypeptide
DEEEIRTTNPVATEQYGSVISCLPNMSSGHDGNH

SEQ ID NO: 97932 - protein, 30 aa, Artificial Sequence
  Description of Artificial Sequence: Synthetic polypeptide
DEEEIATTNPVATEQYGEAPEAGPQRNGEK

SEQ ID NO: 97933 - protein, 35 aa, Artificial Sequence
  Description of Artificial Sequence: Synthetic polypeptide
AEEEIRTTNPVATEQYGVVSVTTNQLQAGNNNQGE

SEQ ID NO: 97934 - protein, 30 aa, Artificial Sequence
  Description of Artificial Sequence: Synthetic polypeptide
DTEEIRATNPVAYEQWGCSYQSDNDQNGPR

SEQ ID NO: 97935 - protein, 33 aa, Artificial Sequence
  Description of Artificial Sequence: Synthetic polypeptide
FEEEIRTTNPVATEQYGSVNTMNGQQGGEGETQ

SEQ ID NO: 97936 - protein, 35 aa, Artificial Sequence
  Description of Artificial Sequence: Synthetic polypeptide
AEEEIRTTNPVATEQYGVVSVTTTNLQQGNQGNNY

SEQ ID NO: 97937 - protein, 33 aa, Artificial Sequence
  Description of Artificial Sequence: Synthetic polypeptide
DEECIRCTNPVATEQYGSVCSWNHNQRFGSDQS

SEQ ID NO: 97938 - protein, 34 aa, Artificial Sequence
  Description of Artificial Sequence: Synthetic polypeptide
AEEEIRTTNPVATEQYGSVVVSVTNNGQEQENND

SEQ ID NO: 97939 - protein, 33 aa, Artificial Sequence
  Description of Artificial Sequence: Synthetic polypeptide
DTEEIRATNPVATEQYGSVVVTTNLQNGTTTDD

SEQ ID NO: 97940 - protein, 35 aa, Artificial Sequence
  Description of Artificial Sequence: Synthetic polypeptide
DEEEIRTTNPVATEQYGSVSLMNSTPQRQIVEENV

SEQ ID NO: 97941 - protein, 35 aa, Artificial Sequence
  Description of Artificial Sequence: Synthetic polypeptide
DEEEIRTTNPVATEQYGSVNSVPEQLDQHDGNEQG

SEQ ID NO: 97942 - protein, 32 aa, Artificial Sequence
  Description of Artificial Sequence: Synthetic polypeptide
QEEEIATTNPVATECYGVVSTNLQNNNPNDNF

SEQ ID NO: 97943 - protein, 35 aa, Artificial Sequence
  Description of Artificial Sequence: Synthetic polypeptide
DEEEIRTTNPVATEQYGSVNSVPEEQLDQHGNEQM

SEQ ID NO: 97944 - protein, 34 aa, Artificial Sequence
  Description of Artificial Sequence: Synthetic polypeptide
DEEEIRTTNPVATEQYGSVIQTNDVQQFNEPEVQ

SEQ ID NO: 97945 - protein, 28 aa, Artificial Sequence
  Description of Artificial Sequence: Synthetic peptide
QEEEIATTNPVATEQYGETTNVQQHEEV

SEQ ID NO: 97946 - protein, 35 aa, Artificial Sequence
  Description of Artificial Sequence: Synthetic polypeptide
AEEEIRTTNPVATEQYGVVSVTTTNLQGNQGNNND

SEQ ID NO: 97947 - protein, 34 aa, Artificial Sequence
  Description of Artificial Sequence: Synthetic polypeptide
DTEEIRATNPVATEQYGSVVVTTNLQQGNGDTDD

SEQ ID NO: 97948 - protein, 34 aa, Artificial Sequence
  Description of Artificial Sequence: Synthetic polypeptide
FEEEIRTTNPVATEQYGSVSCPPLIEQRSTEEQR

SEQ ID NO: 97949 - protein, 31 aa, Artificial Sequence
  Description of Artificial Sequence: Synthetic polypeptide
NEEEIATTNPVAYEQYGSVAENLAPAGGPNN

SEQ ID NO: 97950 - protein, 35 aa, Artificial Sequence
  Description of Artificial Sequence: Synthetic polypeptide
DEEEIRTTNPVATEQYGSVSLMMALEQRENEDLED

SEQ ID NO: 97951 - protein, 35 aa, Artificial Sequence
  Description of Artificial Sequence: Synthetic polypeptide
AEEEIRTTNPVATEQYGVVSVTVTNLQQAGENVEE

SEQ ID NO: 97952 - protein, 31 aa, Artificial Sequence
  Description of Artificial Sequence: Synthetic polypeptide
QEEEIACTNPVATEQYGCVATNLQDAPGEEH

SEQ ID NO: 97953 - protein, 34 aa, Artificial Sequence
  Description of Artificial Sequence: Synthetic polypeptide
DEEEIRTTNPVATEQYGSVIQTNMLIVAQEVEYE

SEQ ID NO: 97954 - protein, 34 aa, Artificial Sequence
  Description of Artificial Sequence: Synthetic polypeptide
FEEEIRTTNPVATEQYGSVSAQGDLEQRNQGEDD

SEQ ID NO: 97955 - protein, 33 aa, Artificial Sequence
  Description of Artificial Sequence: Synthetic polypeptide
DTEEIRATNPVATEQYGSVVVTTNLQQNQGTDD

SEQ ID NO: 97956 - protein, 31 aa, Artificial Sequence
  Description of Artificial Sequence: Synthetic polypeptide
NEEEIATTNPVAYEQWGSVRWWNGDEQDGNR

SEQ ID NO: 97957 - protein, 34 aa, Artificial Sequence
  Description of Artificial Sequence: Synthetic polypeptide
DTEEIRATNPVATEQYGSVVVTTNLQQGNGNTTD

SEQ ID NO: 97958 - protein, 34 aa, Artificial Sequence
  Description of Artificial Sequence: Synthetic polypeptide
DEEEIRTTNPVATEQYGSVSLGMLNQIENENLVI

SEQ ID NO: 97959 - protein, 35 aa, Artificial Sequence
  Description of Artificial Sequence: Synthetic polypeptide
DEEEIRTTNPVATEQYGSVSLEPNGLAQQRLLVQQ

SEQ ID NO: 97960 - protein, 34 aa, Artificial Sequence
  Description of Artificial Sequence: Synthetic polypeptide
DEECIRCTNPVATEQYGSVSWNEGQQERQGHGQR

SEQ ID NO: 97961 - protein, 32 aa, Artificial Sequence
  Description of Artificial Sequence: Synthetic polypeptide
NEEEIATTNPVATEQYGSVCAANNNNQDGNQA

SEQ ID NO: 97962 - protein, 33 aa, Artificial Sequence
  Description of Artificial Sequence: Synthetic polypeptide
DTEEIRSTNPVATEQYGKVVSCTGNVSQNGGTR

SEQ ID NO: 97963 - protein, 28 aa, Artificial Sequence
  Description of Artificial Sequence: Synthetic peptide
AENCIACTNPVATEQYGEMSEVLQRGGQ

SEQ ID NO: 97964 - protein, 36 aa, Artificial Sequence
  Description of Artificial Sequence: Synthetic polypeptide
DEEEIRTTNPVATEQYGSVSDYTPAGPNMQNGMNPV

SEQ ID NO: 97965 - protein, 33 aa, Artificial Sequence
  Description of Artificial Sequence: Synthetic polypeptide
DEEEIRTTNPVATEQYGSVNSVGNFTGQELEGG

SEQ ID NO: 97966 - protein, 28 aa, Artificial Sequence
  Description of Artificial Sequence: Synthetic peptide
QEEEIATTNPVATEQYGEMPSTCQHEEK

SEQ ID NO: 97967 - protein, 33 aa, Artificial Sequence
  Description of Artificial Sequence: Synthetic polypeptide
DEEEIRTTNPVATEQYGSVNITGDEGQTGGEGN

SEQ ID NO: 97968 - protein, 28 aa, Artificial Sequence
  Description of Artificial Sequence: Synthetic peptide
QEEEIATTNPVATEQYGEMPSTCQHEDK

SEQ ID NO: 97969 - protein, 35 aa, Artificial Sequence
  Description of Artificial Sequence: Synthetic polypeptide
DEEEIRTTNPVATEQYGSVISEELLQVRPNSVPDP

SEQ ID NO: 97970 - protein, 34 aa, Artificial Sequence
  Description of Artificial Sequence: Synthetic polypeptide
FEEEIRTTNPVATEQYGSVNNTVNEGQTGGNGNE

SEQ ID NO: 97971 - protein, 33 aa, Artificial Sequence
  Description of Artificial Sequence: Synthetic polypeptide
DEECIRCTNPVAYEQYGSVVQSVNEQDRSGNNA

SEQ ID NO: 97972 - protein, 30 aa, Artificial Sequence
  Description of Artificial Sequence: Synthetic polypeptide
AENCIACTNPVATEQYGEASPEANLQRGGR

SEQ ID NO: 97973 - protein, 35 aa, Artificial Sequence
  Description of Artificial Sequence: Synthetic polypeptide
DEEEIRTTNPVATEQYGSVISEEMLDQVRPNSVDQ

SEQ ID NO: 97974 - protein, 33 aa, Artificial Sequence
  Description of Artificial Sequence: Synthetic polypeptide
FEEEIRTTNPVATEQYGSVNMSDLDQTTGENED

SEQ ID NO: 97975 - protein, 29 aa, Artificial Sequence
  Description of Artificial Sequence: Synthetic peptide
AENCIACTNPVATEQYGEASEVNLQRGGQ

SEQ ID NO: 97976 - protein, 33 aa, Artificial Sequence
  Description of Artificial Sequence: Synthetic polypeptide
DEEEIRTTNPVATEQYGSVSIVNNPPVTNENET

SEQ ID NO: 97977 - protein, 35 aa, Artificial Sequence
  Description of Artificial Sequence: Synthetic polypeptide
DEEEIRTTNPVATEQYGSVSIVNGLPNFQEVVNQN

SEQ ID NO: 97978 - protein, 35 aa, Artificial Sequence
  Description of Artificial Sequence: Synthetic polypeptide
DEEEIRTTNPVATEQYGSVSEAITEQELAIVGNQI

SEQ ID NO: 97979 - protein, 30 aa, Artificial Sequence
  Description of Artificial Sequence: Synthetic polypeptide
AENCIACTNPVATEQYGEASEENLQRIGGR

SEQ ID NO: 97980 - protein, 33 aa, Artificial Sequence
  Description of Artificial Sequence: Synthetic polypeptide
DEEEIRTTNPVATEQYGSVNSVGMGQGENVGDD

SEQ ID NO: 97981 - protein, 34 aa, Artificial Sequence
  Description of Artificial Sequence: Synthetic polypeptide
FEEEIRTTNPVATEQYGSVNMTNGIQEDEGQNGQ

SEQ ID NO: 97982 - protein, 32 aa, Artificial Sequence
  Description of Artificial Sequence: Synthetic polypeptide
DEECIRCTNPVAYEQWGSVVSWNEFSQRGGNL

SEQ ID NO: 97983 - protein, 30 aa, Artificial Sequence
  Description of Artificial Sequence: Synthetic polypeptide
DEEEIATTNPVATEQYGEAPEACPQRNGEK

SEQ ID NO: 97984 - protein, 34 aa, Artificial Sequence
  Description of Artificial Sequence: Synthetic polypeptide
DEECIRCTNPVAYEHYGSVCSCTNSSSQNRGSNR

SEQ ID NO: 97985 - protein, 33 aa, Artificial Sequence
  Description of Artificial Sequence: Synthetic polypeptide
AEEEIRTTNPVATEQYGSVVVTSNILNGTNNAN

SEQ ID NO: 97986 - protein, 31 aa, Artificial Sequence
  Description of Artificial Sequence: Synthetic polypeptide
DTEEIRATNPVAYEQWGCSYQSDNLQGQGTR

SEQ ID NO: 97987 - protein, 34 aa, Artificial Sequence
  Description of Artificial Sequence: Synthetic polypeptide
DEEEIRTTNPVATEQYGSVISDGSNMQGGPGGET

SEQ ID NO: 97988 - protein, 31 aa, Artificial Sequence
  Description of Artificial Sequence: Synthetic polypeptide
DTEEIRATNPVAYEQWGCSYQSDNLQNDGER

SEQ ID NO: 97989 - protein, 34 aa, Artificial Sequence
  Description of Artificial Sequence: Synthetic polypeptide
DEEEIRTTNPVATEQYGSVNSVGNMTAGELNEGG

SEQ ID NO: 97990 - protein, 34 aa, Artificial Sequence
  Description of Artificial Sequence: Synthetic polypeptide
DEEEIRTTNPVATEQYGSVSDVGMGLNGGNTGGI

SEQ ID NO: 97991 - protein, 35 aa, Artificial Sequence
  Description of Artificial Sequence: Synthetic polypeptide
DEEEIRTTNPVATEQYGSVSLENGLQVRQMPEAQA

SEQ ID NO: 97992 - protein, 31 aa, Artificial Sequence
  Description of Artificial Sequence: Synthetic polypeptide
DTEEIRATNPVAYEQWGCSYQSDNQQNGTNR

SEQ ID NO: 97993 - protein, 34 aa, Artificial Sequence
  Description of Artificial Sequence: Synthetic polypeptide
FEEEIRTTNPVATEQYGSVNSVDNPGQGEGNDEI

SEQ ID NO: 97994 - protein, 35 aa, Artificial Sequence
  Description of Artificial Sequence: Synthetic polypeptide
FEEEIRTTNPVATEQYGSVNSGTVENGQNGGGGNI

SEQ ID NO: 97995 - protein, 34 aa, Artificial Sequence
  Description of Artificial Sequence: Synthetic polypeptide
DEEEIRTTNPVATEQYGSVSDVTLLFNGGDGEGI

SEQ ID NO: 97996 - protein, 33 aa, Artificial Sequence
  Description of Artificial Sequence: Synthetic polypeptide
AEEEIRTTNPVATEQYGSVVVTSNGNNTAGNNL

SEQ ID NO: 97997 - protein, 34 aa, Artificial Sequence
  Description of Artificial Sequence: Synthetic polypeptide
DEEEIRTTNPVATEQYGSVSDWYTSETIGGNNMI

SEQ ID NO: 97998 - protein, 31 aa, Artificial Sequence
  Description of Artificial Sequence: Synthetic polypeptide
DTEEIRATNPVAYEQWGSSYYSDNLQDNGTR

SEQ ID NO: 97999 - protein, 32 aa, Artificial Sequence
  Description of Artificial Sequence: Synthetic polypeptide
AEEEISTTNPVATEQYGCVTSVTEHQGGSNQS

SEQ ID NO: 98000 - protein, 35 aa, Artificial Sequence
  Description of Artificial Sequence: Synthetic polypeptide
DEEEIRTTNPVATEQYGSVSLDTNLNENQSVAEDI

SEQ ID NO: 98001 - protein, 33 aa, Artificial Sequence
  Description of Artificial Sequence: Synthetic polypeptide
FEEEIRTTNPVATEQYGSVNSGNMDENGGNGDD

SEQ ID NO: 98002 - protein, 34 aa, Artificial Sequence
  Description of Artificial Sequence: Synthetic polypeptide
DEEEIRTTNPVATEQYGSVSLCPNDVEMGGQLRE

SEQ ID NO: 98003 - protein, 34 aa, Artificial Sequence
  Description of Artificial Sequence: Synthetic polypeptide
DEEEIRTTNPVATEQYGSVISDTSNSNNEGGEFT

SEQ ID NO: 98004 - protein, 32 aa, Artificial Sequence
  Description of Artificial Sequence: Synthetic polypeptide
DEECIRCTNPVATEQYGVVCSWNHQYFGSNQS

SEQ ID NO: 98005 - protein, 32 aa, Artificial Sequence
  Description of Artificial Sequence: Synthetic polypeptide
DTEEIRCTNPVATEQYGCVVSTNNLENFGTQD

SEQ ID NO: 98006 - protein, 34 aa, Artificial Sequence
  Description of Artificial Sequence: Synthetic polypeptide
DEEEIRTTNPVATEQYGSVISPDNDPQMILENLD

SEQ ID NO: 98007 - protein, 32 aa, Artificial Sequence
  Description of Artificial Sequence: Synthetic polypeptide
NEEEIRTTNPVATEQYGCSCSTEPQRFQSQQS

SEQ ID NO: 98008 - protein, 33 aa, Artificial Sequence
  Description of Artificial Sequence: Synthetic polypeptide
DEEEIACTNPVATEQYGCVATNLQTADGPNEEF

SEQ ID NO: 98009 - protein, 30 aa, Artificial Sequence
  Description of Artificial Sequence: Synthetic polypeptide
DEEEIASTNPVCTEQWGDVSDILQNSAGNQ

SEQ ID NO: 98010 - protein, 34 aa, Artificial Sequence
  Description of Artificial Sequence: Synthetic polypeptide
AEEEIRTTNPVATEQYGVVSTTNSNQQGNGNNSE

SEQ ID NO: 98011 - protein, 32 aa, Artificial Sequence
  Description of Artificial Sequence: Synthetic polypeptide
QAEEIATTNPVAYEQYGSVVATNLQNGDNSAA

SEQ ID NO: 98012 - protein, 31 aa, Artificial Sequence
  Description of Artificial Sequence: Synthetic polypeptide
MESEIRTTNPVATEQYGCCSTVLQEVNDVVF

SEQ ID NO: 98013 - protein, 33 aa, Artificial Sequence
  Description of Artificial Sequence: Synthetic polypeptide
MEEEIRTTNPVATERYGKTVQSQNLSENGGNNR

SEQ ID NO: 98014 - protein, 32 aa, Artificial Sequence
  Description of Artificial Sequence: Synthetic polypeptide
DEEEIRTTNPVATEQYGSVNNSELDVQDEEVS

SEQ ID NO: 98015 - protein, 35 aa, Artificial Sequence
  Description of Artificial Sequence: Synthetic polypeptide
DEEEIATTNPVATEQWGHSNVSATNGLQERPGGFP

SEQ ID NO: 98016 - protein, 30 aa, Artificial Sequence
  Description of Artificial Sequence: Synthetic polypeptide
QECEICTTNPVATEAYGVVSTELNLQEEEL

SEQ ID NO: 98017 - protein, 32 aa, Artificial Sequence
  Description of Artificial Sequence: Synthetic polypeptide
EESEIRSTNPVAYEQYGSVSCTNPSQGPGGNV

SEQ ID NO: 98018 - protein, 32 aa, Artificial Sequence
  Description of Artificial Sequence: Synthetic polypeptide
EEREIATTNPVATEGYGSCSTNSNGQHVGNRL

SEQ ID NO: 98019 - protein, 34 aa, Artificial Sequence
  Description of Artificial Sequence: Synthetic polypeptide
DEEEIRTTNPVATEQYGSVSGDGQGGQNTEGEEG

SEQ ID NO: 98020 - protein, 35 aa, Artificial Sequence
  Description of Artificial Sequence: Synthetic polypeptide
EEEEIRTTNPVATEQYGSVSTSNNNNQQQGENQNE

SEQ ID NO: 98021 - protein, 36 aa, Artificial Sequence
  Description of Artificial Sequence: Synthetic polypeptide
EEEEIRTTNPVATEQYGSVSTTLNQLQQQGTNVTEN

SEQ ID NO: 98022 - protein, 35 aa, Artificial Sequence
  Description of Artificial Sequence: Synthetic polypeptide
DEEEIRTTNPVATEQYGSVSGDFNGLGEDGEGNEE

SEQ ID NO: 98023 - protein, 34 aa, Artificial Sequence
  Description of Artificial Sequence: Synthetic polypeptide
DEEEIRTTNPVATEQYGSVSGDDQLTVTGGNGGG

SEQ ID NO: 98024 - protein, 35 aa, Artificial Sequence
  Description of Artificial Sequence: Synthetic polypeptide
EEEEIRTTNPVATEQYGSVSTTNNLNQLQNATESG

SEQ ID NO: 98025 - protein, 34 aa, Artificial Sequence
  Description of Artificial Sequence: Synthetic polypeptide
DEEEIRTTNPVATEQYGSVSETGNGPEARIVSTM

SEQ ID NO: 98026 - protein, 33 aa, Artificial Sequence
  Description of Artificial Sequence: Synthetic polypeptide
DEEEIRTTNPVATEQYGSVSETGNIPAEPETQV

SEQ ID NO: 98027 - protein, 33 aa, Artificial Sequence
  Description of Artificial Sequence: Synthetic polypeptide
DEEEIRTTNPVATEQYGSVNNSNDSEGPNEMQI

SEQ ID NO: 98028 - protein, 33 aa, Artificial Sequence
  Description of Artificial Sequence: Synthetic polypeptide
MESEICTTNPVATEQYGNTVSVTMLQGGQNDRF

SEQ ID NO: 98029 - protein, 34 aa, Artificial Sequence
  Description of Artificial Sequence: Synthetic polypeptide
AEEEIRTTNPVATEQYGVVSTTNSNQQGNNNQQG

SEQ ID NO: 98030 - protein, 35 aa, Artificial Sequence
  Description of Artificial Sequence: Synthetic polypeptide
EEEEIRTTNPVATEQYGSVSTSNNQNQQIGENQNE

SEQ ID NO: 98031 - protein, 35 aa, Artificial Sequence
  Description of Artificial Sequence: Synthetic polypeptide
EEEEIRTTNPVATEQYGSVSTTNNQNQQQGENQNE

SEQ ID NO: 98032 - protein, 32 aa, Artificial Sequence
  Description of Artificial Sequence: Synthetic polypeptide
DEEEIATTNPIATEQYGSVSVTNIGFHDDNQD

SEQ ID NO: 98033 - protein, 34 aa, Artificial Sequence
  Description of Artificial Sequence: Synthetic polypeptide
DEEEIRTTNPVATEQYGSVSGDLNGLGEGEGEEE

SEQ ID NO: 98034 - protein, 35 aa, Artificial Sequence
  Description of Artificial Sequence: Synthetic polypeptide
MEEEIRTTNPVATEQYGSVSTVNGFGQENQGENGV

SEQ ID NO: 98035 - protein, 28 aa, Artificial Sequence
  Description of Artificial Sequence: Synthetic peptide
QEEEIATTNPVATEQYGEAPEVCQHENK

SEQ ID NO: 98036 - protein, 35 aa, Artificial Sequence
  Description of Artificial Sequence: Synthetic polypeptide
MESEIRTTNPVATEQYGSVSPTSVLDQRIGENYQD

SEQ ID NO: 98037 - protein, 32 aa, Artificial Sequence
  Description of Artificial Sequence: Synthetic polypeptide
EESEIRTTNPTAYEQYGSVSCTNFSQGPGGNS

SEQ ID NO: 98038 - protein, 34 aa, Artificial Sequence
  Description of Artificial Sequence: Synthetic polypeptide
MESEIRTTNPVATEQYGSVSPTSPLDTRIGENQQ

SEQ ID NO: 98039 - protein, 36 aa, Artificial Sequence
  Description of Artificial Sequence: Synthetic polypeptide
DEEEIRTTNPVATEQYGSVLSGITMNDQGEGEFNED

SEQ ID NO: 98040 - protein, 33 aa, Artificial Sequence
  Description of Artificial Sequence: Synthetic polypeptide
MEEEIRTTNPVATEQYGSVSTYGMGNTGQENGE

SEQ ID NO: 98041 - protein, 35 aa, Artificial Sequence
  Description of Artificial Sequence: Synthetic polypeptide
MEEEIRTTNPVATEQYGSVSVTDGDLGQRNQNEQT

SEQ ID NO: 98042 - protein, 34 aa, Artificial Sequence
  Description of Artificial Sequence: Synthetic polypeptide
DEEEIRTTNPVATEQYGSVSGGNANGQGGGETIE

SEQ ID NO: 98043 - protein, 35 aa, Artificial Sequence
  Description of Artificial Sequence: Synthetic polypeptide
DEEEIRTTNPVATEQYGSVSGDLNGLGEGEDVNEE

SEQ ID NO: 98044 - protein, 33 aa, Artificial Sequence
  Description of Artificial Sequence: Synthetic polypeptide
AEEEVRTTNPVATEQYGSVCSTGELDQYIGSQQ

SEQ ID NO: 98045 - protein, 33 aa, Artificial Sequence
  Description of Artificial Sequence: Synthetic polypeptide
DEECIRTTNPVAYEQWGTVCSTNDLHDNGQNQR

SEQ ID NO: 98046 - protein, 34 aa, Artificial Sequence
  Description of Artificial Sequence: Synthetic polypeptide
DEECIRTTNPVAYEQWGTVCSTNDLHDQNGQNRG

SEQ ID NO: 98047 - protein, 33 aa, Artificial Sequence
  Description of Artificial Sequence: Synthetic polypeptide
DEEEIRTTNPVATEQYGSVNNSEHLDVQDEEHG

SEQ ID NO: 98048 - protein, 34 aa, Artificial Sequence
  Description of Artificial Sequence: Synthetic polypeptide
MESEIRTTNPVATEQYGSVSPTSNLDQRIDESMQ

SEQ ID NO: 98049 - protein, 31 aa, Artificial Sequence
  Description of Artificial Sequence: Synthetic polypeptide
DEEEIAATNPVAYEQYGFVVCTNLSTGVGNP

SEQ ID NO: 98050 - protein, 35 aa, Artificial Sequence
  Description of Artificial Sequence: Synthetic polypeptide
DEEEIATTNPVATEQWGHSNVSVTNGLQEGRPGGF

SEQ ID NO: 98051 - protein, 34 aa, Artificial Sequence
  Description of Artificial Sequence: Synthetic polypeptide
MESEIRTTNPVATEQYGSVSPTSNLDMSIGENYQ

SEQ ID NO: 98052 - protein, 34 aa, Artificial Sequence
  Description of Artificial Sequence: Synthetic polypeptide
MESEIRTTNPVATEQYGSVSPTSNLDHRIDENYQ

SEQ ID NO: 98053 - protein, 34 aa, Artificial Sequence
  Description of Artificial Sequence: Synthetic polypeptide
DEEEIATTNPVATEQWGHSNVSATNGLVERPGGH

SEQ ID NO: 98054 - protein, 28 aa, Artificial Sequence
  Description of Artificial Sequence: Synthetic peptide
AEEEVASVNPVCTEQYGVVSDNLQSMNQ

SEQ ID NO: 98055 - protein, 36 aa, Artificial Sequence
  Description of Artificial Sequence: Synthetic polypeptide
EEEEIRTTNPVATEQYGSVSTNLQELGTEAGTNTDD

SEQ ID NO: 98056 - protein, 33 aa, Artificial Sequence
  Description of Artificial Sequence: Synthetic polypeptide
EEPEIRTTNPVATEQYGETSTTNLEQFRQGDEV

SEQ ID NO: 98057 - protein, 35 aa, Artificial Sequence
  Description of Artificial Sequence: Synthetic polypeptide
AEEEIRTTNPVATEQYGVVSTVNNLQLGGNNSEDE

SEQ ID NO: 98058 - protein, 35 aa, Artificial Sequence
  Description of Artificial Sequence: Synthetic polypeptide
EEEEIRTTNPVATEQYGSVSTTSNNNQQQGENQTE

SEQ ID NO: 98059 - protein, 36 aa, Artificial Sequence
  Description of Artificial Sequence: Synthetic polypeptide
EEEEIRTTNPVATEQYGSVSTTTNLGQQQIGENNDD

SEQ ID NO: 98060 - protein, 36 aa, Artificial Sequence
  Description of Artificial Sequence: Synthetic polypeptide
EEEEIRTTNPVATEQYGSVSTTTNLQQQGTNVAETG

SEQ ID NO: 98061 - protein, 35 aa, Artificial Sequence
  Description of Artificial Sequence: Synthetic polypeptide
AEEEIRTTNPVATEQYGVVSTVNLNQQIGNNNGTE

SEQ ID NO: 98062 - protein, 33 aa, Artificial Sequence
  Description of Artificial Sequence: Synthetic polypeptide
DEEEIATTNPMATEQWGSVYCTDNEDQRGNGAD

SEQ ID NO: 98063 - protein, 34 aa, Artificial Sequence
  Description of Artificial Sequence: Synthetic polypeptide
DEEEIRTTNPVATEQYGSVNNTNDDEPSGNEEFS

SEQ ID NO: 98064 - protein, 35 aa, Artificial Sequence
  Description of Artificial Sequence: Synthetic polypeptide
EEEEIRTTNPVATEQYGSVSTVLQQGDEQGTNTDD

SEQ ID NO: 98065 - protein, 32 aa, Artificial Sequence
  Description of Artificial Sequence: Synthetic polypeptide
DEEEIATTNPMATEQYGSVPAVQEAHRQGNGR

SEQ ID NO: 98066 - protein, 36 aa, Artificial Sequence
  Description of Artificial Sequence: Synthetic polypeptide
EEEEIRTTNPVATEQYGSVSTVNLQAGTEQGTNQDD

SEQ ID NO: 98067 - protein, 33 aa, Artificial Sequence
  Description of Artificial Sequence: Synthetic polypeptide
DEEEIRTTNPVATEQYGSVSETGVLMPEVEFDE

SEQ ID NO: 98068 - protein, 32 aa, Artificial Sequence
  Description of Artificial Sequence: Synthetic polypeptide
MENEIRTTNPVATEQYGEVVDSAELQRTQNDG

SEQ ID NO: 98069 - protein, 36 aa, Artificial Sequence
  Description of Artificial Sequence: Synthetic polypeptide
EEEEIRTTNPVATEQYGSVSTVVTNLQLQGNQNGNE

SEQ ID NO: 98070 - protein, 34 aa, Artificial Sequence
  Description of Artificial Sequence: Synthetic polypeptide
EEEEIRTTNPVATEQYGSVSVTGLEMMQEGVLEM

SEQ ID NO: 98071 - protein, 32 aa, Artificial Sequence
  Description of Artificial Sequence: Synthetic polypeptide
DEECIRTTNPVAYEQYGCTVSTAQSQFGGNQM

SEQ ID NO: 98072 - protein, 32 aa, Artificial Sequence
  Description of Artificial Sequence: Synthetic polypeptide
DEEEIRTTNPVATEQYGSVNSESDDDNGEESM

SEQ ID NO: 98073 - protein, 35 aa, Artificial Sequence
  Description of Artificial Sequence: Synthetic polypeptide
MENEIRTTNPVATEQYGCSTISTNEALQRGQYPRL

SEQ ID NO: 98074 - protein, 28 aa, Artificial Sequence
  Description of Artificial Sequence: Synthetic peptide
QEEEIATTNPVATEQYGEAPEVCQHEER

SEQ ID NO: 98075 - protein, 32 aa, Artificial Sequence
  Description of Artificial Sequence: Synthetic polypeptide
DEEEIRTTNPVATEQYGSVIYNIVSLNDVLEE

SEQ ID NO: 98076 - protein, 35 aa, Artificial Sequence
  Description of Artificial Sequence: Synthetic polypeptide
EEEEIRTTNPVATEQYGSVTVSNNLQQGNQNGTEQ

SEQ ID NO: 98077 - protein, 35 aa, Artificial Sequence
  Description of Artificial Sequence: Synthetic polypeptide
EEEEIRTTNPVATEQYGSVTVSTNLGLQGNQNGEG

SEQ ID NO: 98078 - protein, 36 aa, Artificial Sequence
  Description of Artificial Sequence: Synthetic polypeptide
EEEEIRTTNPVATEQYGSVSTVTNQLNQQGNNVNEY

SEQ ID NO: 98079 - protein, 34 aa, Artificial Sequence
  Description of Artificial Sequence: Synthetic polypeptide
AEEEIRTTNPVATEQYGVVSTTNSNQQQNGNNQN

SEQ ID NO: 98080 - protein, 35 aa, Artificial Sequence
  Description of Artificial Sequence: Synthetic polypeptide
EEEEIRTTNPVATEQYGSVSTTSNGNQQQGNNTQE

SEQ ID NO: 98081 - protein, 36 aa, Artificial Sequence
  Description of Artificial Sequence: Synthetic polypeptide
EEEEIRTTNPVATEQYGSVSTTQNNLQQGNNVNEYG

SEQ ID NO: 98082 - protein, 34 aa, Artificial Sequence
  Description of Artificial Sequence: Synthetic polypeptide
AEEEIRTTNPVATEQYGVVSTVNNEQGNNQGNNP

SEQ ID NO: 98083 - protein, 36 aa, Artificial Sequence
  Description of Artificial Sequence: Synthetic polypeptide
DEEEIRTTNPVATEQYGSVQYNTMNLQTRNGVLAEI

SEQ ID NO: 98084 - protein, 34 aa, Artificial Sequence
  Description of Artificial Sequence: Synthetic polypeptide
AEEEIRTTNPVATEQYGVVSTVNLQQQNENNTTD

SEQ ID NO: 98085 - protein, 33 aa, Artificial Sequence
  Description of Artificial Sequence: Synthetic polypeptide
QAEEIATTNPVAYEQYGSVVATNLQRDGPNTEQ

SEQ ID NO: 98086 - protein, 33 aa, Artificial Sequence
  Description of Artificial Sequence: Synthetic polypeptide
DEEEIRTTNPVATEQYGSVLPTTNQINGELSVH

SEQ ID NO: 98087 - protein, 34 aa, Artificial Sequence
  Description of Artificial Sequence: Synthetic polypeptide
DEEEIRTTNPVATEQYGSVSFTVLNDGQVIQELM

SEQ ID NO: 98088 - protein, 31 aa, Artificial Sequence
  Description of Artificial Sequence: Synthetic polypeptide
QAEEIATTNPVAYMQYGSVSTNGVMPNGNHR

SEQ ID NO: 98089 - protein, 33 aa, Artificial Sequence
  Description of Artificial Sequence: Synthetic polypeptide
DEEEIRTTNPVATEQYGSVQWTPNLVIEASELI

SEQ ID NO: 98090 - protein, 32 aa, Artificial Sequence
  Description of Artificial Sequence: Synthetic polypeptide
DEEEIRTTNPVATEQYGSVNNTEEESMSGEDQ

SEQ ID NO: 98091 - protein, 32 aa, Artificial Sequence
  Description of Artificial Sequence: Synthetic polypeptide
MENEIRTTNPVATEQYGSVSNTNSENINSIQN

SEQ ID NO: 98092 - protein, 34 aa, Artificial Sequence
  Description of Artificial Sequence: Synthetic polypeptide
AEEEIRTTNPVATEQYGVVSTVNLQNQNQEENAE

SEQ ID NO: 98093 - protein, 33 aa, Artificial Sequence
  Description of Artificial Sequence: Synthetic polypeptide
DEEEIRTTNPVATEQYGSVLPTMNQISNELSQL

SEQ ID NO: 98094 - protein, 28 aa, Artificial Sequence
  Description of Artificial Sequence: Synthetic peptide
MEPEIATTNPVATECYGDVSECLQHEEL

SEQ ID NO: 98095 - protein, 33 aa, Artificial Sequence
  Description of Artificial Sequence: Synthetic polypeptide
DEEEIATTNPMATEQWGSVYCTDNDDGQRGNHA

SEQ ID NO: 98096 - protein, 31 aa, Artificial Sequence
  Description of Artificial Sequence: Synthetic polypeptide
MENEIRTTNPVATETYGSVSIMLQEVGDTVP

SEQ ID NO: 98097 - protein, 33 aa, Artificial Sequence
  Description of Artificial Sequence: Synthetic polypeptide
DEEEIRTTNPVATEQYGSVNNTNDDEGGGEELS

SEQ ID NO: 98098 - protein, 34 aa, Artificial Sequence
  Description of Artificial Sequence: Synthetic polypeptide
MEEEIRTTNPVAYEQWGQVVVSTNLSQVTGGNDR

SEQ ID NO: 98099 - protein, 31 aa, Artificial Sequence
  Description of Artificial Sequence: Synthetic polypeptide
MEEEIRTTNPVAYEQYGCVCSTEHQNFGSDQ

SEQ ID NO: 98100 - protein, 36 aa, Artificial Sequence
  Description of Artificial Sequence: Synthetic polypeptide
EEEEIRTTNPVATEQYGSVSTTNTNLGQQQGENQDD

SEQ ID NO: 98101 - protein, 36 aa, Artificial Sequence
  Description of Artificial Sequence: Synthetic polypeptide
EEEEIRTTNPVATEQYGSVSTTQNLQQQGTNVNEQG

SEQ ID NO: 98102 - protein, 31 aa, Artificial Sequence
  Description of Artificial Sequence: Synthetic polypeptide
EENEIRTTNPVATEGYGSVSANPLMEVGDTP

SEQ ID NO: 98103 - protein, 34 aa, Artificial Sequence
  Description of Artificial Sequence: Synthetic polypeptide
DEEEIRTTNPVATEQYGSVNSENYDDARGEQEHT

SEQ ID NO: 98104 - protein, 31 aa, Artificial Sequence
  Description of Artificial Sequence: Synthetic polypeptide
DEECIRTTNPVAYEQWGSVFQHEDLGRGNAP

SEQ ID NO: 98105 - protein, 31 aa, Artificial Sequence
  Description of Artificial Sequence: Synthetic polypeptide
DEECIRTTNPVAYEQWGSVFQHEDLGRGDNS

SEQ ID NO: 98106 - protein, 33 aa, Artificial Sequence
  Description of Artificial Sequence: Synthetic polypeptide
DEECIRTTNPVAYEQWGESYSVDNEQGRGDNRG

SEQ ID NO: 98107 - protein, 35 aa, Artificial Sequence
  Description of Artificial Sequence: Synthetic polypeptide
EEEEIRTTNPVATEQYGSVSTALNLGDEEGTNNNE

SEQ ID NO: 98108 - protein, 34 aa, Artificial Sequence
  Description of Artificial Sequence: Synthetic polypeptide
AEEEIRTTNPVATEQYGVVSTTNNSNQQGNGNNQ

SEQ ID NO: 98109 - protein, 33 aa, Artificial Sequence
  Description of Artificial Sequence: Synthetic polypeptide
DEEEIRTTNPVATEQYGSVQTEEDFGMNQNFEG

SEQ ID NO: 98110 - protein, 34 aa, Artificial Sequence
  Description of Artificial Sequence: Synthetic polypeptide
DEEEIRTTNPVATEQYGSVNSILQSDQGEDGNED

SEQ ID NO: 98111 - protein, 31 aa, Artificial Sequence
  Description of Artificial Sequence: Synthetic polypeptide
DEECIRTTNPVAYEQWGESYSVDNEQKGQNM

SEQ ID NO: 98112 - protein, 32 aa, Artificial Sequence
  Description of Artificial Sequence: Synthetic polypeptide
DEECIRTTNPVAYEQWGESYSVDNEQNGDNRN

SEQ ID NO: 98113 - protein, 34 aa, Artificial Sequence
  Description of Artificial Sequence: Synthetic polypeptide
DEEEIRTTNPVATEQYGSVNSILGQIGQGELNED

SEQ ID NO: 98114 - protein, 31 aa, Artificial Sequence
  Description of Artificial Sequence: Synthetic polypeptide
DEECIRTTNPVAYEQWGESYSVDTEQRGDNA

SEQ ID NO: 98115 - protein, 35 aa, Artificial Sequence
  Description of Artificial Sequence: Synthetic polypeptide
AEEQIRTTNPVATEQYGSVSTTNQLSQLNLGNTTE

SEQ ID NO: 98116 - protein, 34 aa, Artificial Sequence
  Description of Artificial Sequence: Synthetic polypeptide
DEEEIRTTNPVATEQYGSVQTENVQSFQGEELVD

SEQ ID NO: 98117 - protein, 35 aa, Artificial Sequence
  Description of Artificial Sequence: Synthetic polypeptide
AEEEIRTTNPVATEQYGVVSTVNQLQQGNTEQGEE

SEQ ID NO: 98118 - protein, 32 aa, Artificial Sequence
  Description of Artificial Sequence: Synthetic polypeptide
EESEIRTTNPVAYEQFGSVSCTNPSQNPGGNK

SEQ ID NO: 98119 - protein, 31 aa, Artificial Sequence
  Description of Artificial Sequence: Synthetic polypeptide
DEEEIACTNPVATEQWGSVATNLQAEDDTDV

SEQ ID NO: 98120 - protein, 32 aa, Artificial Sequence
  Description of Artificial Sequence: Synthetic polypeptide
EESEIRTTNPVAYEPYGSVSCTNPSQGPGGNK

SEQ ID NO: 98121 - protein, 34 aa, Artificial Sequence
  Description of Artificial Sequence: Synthetic polypeptide
DEEEIRTTNPVATEQYGSVQTIYLTNLESTQNDD

SEQ ID NO: 98122 - protein, 32 aa, Artificial Sequence
  Description of Artificial Sequence: Synthetic polypeptide
DEECIRTTNPVAYEQWGSSYSDTHDGQRSQNR

SEQ ID NO: 98123 - protein, 33 aa, Artificial Sequence
  Description of Artificial Sequence: Synthetic polypeptide
DEECIRTTNPVAYEQWGSVACNNLQQELDGVNR

SEQ ID NO: 98124 - protein, 35 aa, Artificial Sequence
  Description of Artificial Sequence: Synthetic polypeptide
EEEEIRTTNPVATEQYGSVSTALQAGTEAGTNTVD

SEQ ID NO: 98125 - protein, 34 aa, Artificial Sequence
  Description of Artificial Sequence: Synthetic polypeptide
EESEIRTTNPVATEQYGSVSVTQNEPSQGPGGNE

SEQ ID NO: 98126 - protein, 34 aa, Artificial Sequence
  Description of Artificial Sequence: Synthetic polypeptide
AEEEIRTTNPVATEQYGVVSTTNPLTQGNQEETQ

SEQ ID NO: 98127 - protein, 35 aa, Artificial Sequence
  Description of Artificial Sequence: Synthetic polypeptide
EEEEIRTTNPVATEQYGSVSTALQLGTEAGTNTDE

SEQ ID NO: 98128 - protein, 32 aa, Artificial Sequence
  Description of Artificial Sequence: Synthetic polypeptide
DEECIRTTNPVAYEQWGESYSVDNDHQRGDNI

SEQ ID NO: 98129 - protein, 34 aa, Artificial Sequence
  Description of Artificial Sequence: Synthetic polypeptide
DEEEIRTTNPVATEQYGSVSETEGTNTHIENEEM

SEQ ID NO: 98130 - protein, 33 aa, Artificial Sequence
  Description of Artificial Sequence: Synthetic polypeptide
DEECIRTTNPVAYEQWGESMSQRNDDLQRGHRR

SEQ ID NO: 98131 - protein, 32 aa, Artificial Sequence
  Description of Artificial Sequence: Synthetic polypeptide
QAEEIATTNPVAYEQYGSVATNLQDAGDPNNN

SEQ ID NO: 98132 - protein, 36 aa, Artificial Sequence
  Description of Artificial Sequence: Synthetic polypeptide
MEEEIRTTNPVATEQYGSVSTMNGLTGQGGEFNQQF

SEQ ID NO: 98133 - protein, 33 aa, Artificial Sequence
  Description of Artificial Sequence: Synthetic polypeptide
NDEEIRTTNPVATEQYGCVCSTNDQNFGSNTQS

SEQ ID NO: 98134 - protein, 34 aa, Artificial Sequence
  Description of Artificial Sequence: Synthetic polypeptide
EEEEIRTTNPVATEQYGSVSPVNLIQNRIMQEEY

SEQ ID NO: 98135 - protein, 34 aa, Artificial Sequence
  Description of Artificial Sequence: Synthetic polypeptide
DEEEIRTTNPVATEQYGSVSGQNEMTGDGGGNIT

SEQ ID NO: 98136 - protein, 35 aa, Artificial Sequence
  Description of Artificial Sequence: Synthetic polypeptide
DEEEIRTTNPVATEQYGSVSAEINYMQRENPIMDN

SEQ ID NO: 98137 - protein, 33 aa, Artificial Sequence
  Description of Artificial Sequence: Synthetic polypeptide
AEEEIRTTNPVATEQYGVVSTTNNQQQQQTGVQ

SEQ ID NO: 98138 - protein, 33 aa, Artificial Sequence
  Description of Artificial Sequence: Synthetic polypeptide
DEECIRTTNPVAYEQWGESVYIDNHQQRGDNDR

SEQ ID NO: 98139 - protein, 34 aa, Artificial Sequence
  Description of Artificial Sequence: Synthetic polypeptide
AEEEIRTTNPVATEQYGVVSTTNNSNQQGGNQQG

SEQ ID NO: 98140 - protein, 34 aa, Artificial Sequence
  Description of Artificial Sequence: Synthetic polypeptide
AEEEIRTTNPVATEQYGVVSTVNQQQNQEGTNPE

SEQ ID NO: 98141 - protein, 31 aa, Artificial Sequence
  Description of Artificial Sequence: Synthetic polypeptide
QAEEIATTNPVAYEQYGSVATNLQDAGPMEN

SEQ ID NO: 98142 - protein, 32 aa, Artificial Sequence
  Description of Artificial Sequence: Synthetic polypeptide
QAEEIATTNPVAYEQYGSVATNLQDAGPNVDN

SEQ ID NO: 98143 - protein, 35 aa, Artificial Sequence
  Description of Artificial Sequence: Synthetic polypeptide
DEEEIRTTNPVATEQYGSVSGPNTDQNEQGENEFT

SEQ ID NO: 98144 - protein, 32 aa, Artificial Sequence
  Description of Artificial Sequence: Synthetic polypeptide
DEEEIACTNPVATEQWGSVSEGNLQDQGGTDQ

SEQ ID NO: 98145 - protein, 33 aa, Artificial Sequence
  Description of Artificial Sequence: Synthetic polypeptide
EEEEIRTTNPVATEQYGSVSSNHLTEQLAESGD

SEQ ID NO: 98146 - protein, 31 aa, Artificial Sequence
  Description of Artificial Sequence: Synthetic polypeptide
DEEEIRTTNPVATEQYGSVQTDTTVTLEEEM

SEQ ID NO: 98147 - protein, 32 aa, Artificial Sequence
  Description of Artificial Sequence: Synthetic polypeptide
EESEIRTTNPVAYEQYGSVSCTEVSQGPGGNK

SEQ ID NO: 98148 - protein, 32 aa, Artificial Sequence
  Description of Artificial Sequence: Synthetic polypeptide
DEECIRTTNPVAYEQWGESYSSDNQEQKGDNR

SEQ ID NO: 98149 - protein, 34 aa, Artificial Sequence
  Description of Artificial Sequence: Synthetic polypeptide
AEEEIRTTNPVATEQYGVVSTVNQQLQEGEETEE

SEQ ID NO: 98150 - protein, 33 aa, Artificial Sequence
  Description of Artificial Sequence: Synthetic polypeptide
EESEIRTTNPVAYEQYGSVSCTINWSQGPGGNS

SEQ ID NO: 98151 - protein, 34 aa, Artificial Sequence
  Description of Artificial Sequence: Synthetic polypeptide
AEEEIRTTNPVATEQYGVVSTTNSNQQGNGENQA

SEQ ID NO: 98152 - protein, 33 aa, Artificial Sequence
  Description of Artificial Sequence: Synthetic polypeptide
DEEEIATTNPIATEQWGSVVPTNWDQHEGQNGR

SEQ ID NO: 98153 - protein, 35 aa, Artificial Sequence
  Description of Artificial Sequence: Synthetic polypeptide
EEEEIRTTNPVATEQYGSVSTATNNLGDEQGTNLQ

SEQ ID NO: 98154 - protein, 28 aa, Artificial Sequence
  Description of Artificial Sequence: Synthetic peptide
QEEEIATTNPVATEQYGEAPEVCQHGEH

SEQ ID NO: 98155 - protein, 33 aa, Artificial Sequence
  Description of Artificial Sequence: Synthetic polypeptide
DEECIRTTNPVAYEQWGSVACTNQGLQDHQDNR

SEQ ID NO: 98156 - protein, 28 aa, Artificial Sequence
  Description of Artificial Sequence: Synthetic peptide
QEEEIATTNPVATEQYGEAPENCQHEEK

SEQ ID NO: 98157 - protein, 32 aa, Artificial Sequence
  Description of Artificial Sequence: Synthetic polypeptide
MESEIRTTNPVAYEQYGSVSCTNPSDGPGGNK

SEQ ID NO: 98158 - protein, 30 aa, Artificial Sequence
  Description of Artificial Sequence: Synthetic polypeptide
DEECIRTTNPVAYEQWGSVFHIEDLRGNAS

SEQ ID NO: 98159 - protein, 34 aa, Artificial Sequence
  Description of Artificial Sequence: Synthetic polypeptide
DEEEIRTTNPVATEQYGSVSGNGNFQDEDNNEII

SEQ ID NO: 98160 - protein, 35 aa, Artificial Sequence
  Description of Artificial Sequence: Synthetic polypeptide
MEEEIRTTNPVATEQYGSVSTTGLPQSTGNGDDGN

SEQ ID NO: 98161 - protein, 30 aa, Artificial Sequence
  Description of Artificial Sequence: Synthetic polypeptide
DEECIRTTNPVAYEQWGSVFHWEDLRGMNA

SEQ ID NO: 98162 - protein, 31 aa, Artificial Sequence
  Description of Artificial Sequence: Synthetic polypeptide
MESEIRTTNPVATEQYGVVSAELIRPQNFDG

SEQ ID NO: 98163 - protein, 34 aa, Artificial Sequence
  Description of Artificial Sequence: Synthetic polypeptide
AEEEIRTTNPVATEQYGVVSTTNQSNQQGNGNNQ

SEQ ID NO: 98164 - protein, 33 aa, Artificial Sequence
  Description of Artificial Sequence: Synthetic polypeptide
DEEEIATTNPVATEQWGNTTSTNEGLAGMGGNR

SEQ ID NO: 98165 - protein, 30 aa, Artificial Sequence
  Description of Artificial Sequence: Synthetic polypeptide
DEECIRTTNPVAYEQWGSVFPHEDLDRGMT

SEQ ID NO: 98166 - protein, 34 aa, Artificial Sequence
  Description of Artificial Sequence: Synthetic polypeptide
DEEEIRTTNPVATEQYGSVSGNANDGNNEGNVPN

SEQ ID NO: 98167 - protein, 33 aa, Artificial Sequence
  Description of Artificial Sequence: Synthetic polypeptide
EEEEIRTTNPVATEQYGSVSTNLIVNTLIEVTD

SEQ ID NO: 98168 - protein, 35 aa, Artificial Sequence
  Description of Artificial Sequence: Synthetic polypeptide
EEEEIRTTNPVATEQYGSVSTNLNLGTEAGTNTTD

SEQ ID NO: 98169 - protein, 32 aa, Artificial Sequence
  Description of Artificial Sequence: Synthetic polypeptide
MESEIRTTNPVATEQYGSVSYNTQFNGQEDPN

SEQ ID NO: 98170 - protein, 34 aa, Artificial Sequence
  Description of Artificial Sequence: Synthetic polypeptide
DEEEIRTTNPVATEQYGSVITTQDGGQNGEGNND

SEQ ID NO: 98171 - protein, 33 aa, Artificial Sequence
  Description of Artificial Sequence: Synthetic polypeptide
MESEIRTTNPVATEQYGSVSVTGNLENINENQG

SEQ ID NO: 98172 - protein, 28 aa, Artificial Sequence
  Description of Artificial Sequence: Synthetic peptide
QEEEIATTNPVATEQYGEAPENEQHEEK

SEQ ID NO: 98173 - protein, 33 aa, Artificial Sequence
  Description of Artificial Sequence: Synthetic polypeptide
DEEEIRTTNPVATEQYGSVLSLKLNLEMSSEHN

SEQ ID NO: 98174 - protein, 30 aa, Artificial Sequence
  Description of Artificial Sequence: Synthetic polypeptide
DEECIRTTNPVAYEQWGSVFHWEDLRGNTE

SEQ ID NO: 98175 - protein, 35 aa, Artificial Sequence
  Description of Artificial Sequence: Synthetic polypeptide
DEEEIRTTNPVATEQYGSVSETETEQMRAIVVNQE

SEQ ID NO: 98176 - protein, 33 aa, Artificial Sequence
  Description of Artificial Sequence: Synthetic polypeptide
DEECIRTTNPVAYEQWGSVACTNNGWQDGGTNR

SEQ ID NO: 98177 - protein, 34 aa, Artificial Sequence
  Description of Artificial Sequence: Synthetic polypeptide
AEEEIRTTNPVATEQYGVVSTTNQQQQGNDEQQD

SEQ ID NO: 98178 - protein, 35 aa, Artificial Sequence
  Description of Artificial Sequence: Synthetic polypeptide
AEEEIRTTNPVATEQYGVVSTVNQLQNGNNENQAE

SEQ ID NO: 98179 - protein, 34 aa, Artificial Sequence
  Description of Artificial Sequence: Synthetic polypeptide
AEEQIRTTNPVATEQYGSVSTTNNLSNLQLQNTD

SEQ ID NO: 98180 - protein, 34 aa, Artificial Sequence
  Description of Artificial Sequence: Synthetic polypeptide
DEEEIRTTNPVATEQYGSVLSPTTVDQVENEELT

SEQ ID NO: 98181 - protein, 33 aa, Artificial Sequence
  Description of Artificial Sequence: Synthetic polypeptide
EESEIRTTNPVATEQYGSVSTNAPSNGPGGNNK

SEQ ID NO: 98182 - protein, 34 aa, Artificial Sequence
  Description of Artificial Sequence: Synthetic polypeptide
DEEEIRTTNPVATEQYGSVITTLALAEGSNEDVD

SEQ ID NO: 98183 - protein, 33 aa, Artificial Sequence
  Description of Artificial Sequence: Synthetic polypeptide
QAEEIATTNPVAYEQYGSVVATNLQGRGPNDEM

SEQ ID NO: 98184 - protein, 32 aa, Artificial Sequence
  Description of Artificial Sequence: Synthetic polypeptide
DEEEIACTNPVATEQWGSVAANLQEAGENGEE

SEQ ID NO: 98185 - protein, 34 aa, Artificial Sequence
  Description of Artificial Sequence: Synthetic polypeptide
EESEIRTTNPVATEQYGSTVSTTNEPSQGPGGNE

SEQ ID NO: 98186 - protein, 34 aa, Artificial Sequence
  Description of Artificial Sequence: Synthetic polypeptide
DEECIRTTNPVAYEQWGSVACTNNGLQDHGDNKR

SEQ ID NO: 98187 - protein, 36 aa, Artificial Sequence
  Description of Artificial Sequence: Synthetic polypeptide
MEEEIRTTNPVATEQYGSVSTTDNGLGQEDGEGGNE

SEQ ID NO: 98188 - protein, 34 aa, Artificial Sequence
  Description of Artificial Sequence: Synthetic polypeptide
AEEEIRTTNPVATEQYGVVSTTNQQANSEEGNTN

SEQ ID NO: 98189 - protein, 34 aa, Artificial Sequence
  Description of Artificial Sequence: Synthetic polypeptide
AEEQIRTTNPVATEQYGSVSTTNLSQLQNNNDTD

SEQ ID NO: 98190 - protein, 34 aa, Artificial Sequence
  Description of Artificial Sequence: Synthetic polypeptide
DEECIRTTNPVAYEQWGSVACTNNGLQDHGENRL

SEQ ID NO: 98191 - protein, 28 aa, Artificial Sequence
  Description of Artificial Sequence: Synthetic peptide
QEEEIATTNPVATEQYGEAPENCMHENK

SEQ ID NO: 98192 - protein, 33 aa, Artificial Sequence
  Description of Artificial Sequence: Synthetic polypeptide
DEEEIATTNPVATEQWGNTTTSTNELQGNGDNA

SEQ ID NO: 98193 - protein, 34 aa, Artificial Sequence
  Description of Artificial Sequence: Synthetic polypeptide
EESEIRTTNPVATEQYGQSVSTLNEPSQGPGGNE

SEQ ID NO: 98194 - protein, 28 aa, Artificial Sequence
  Description of Artificial Sequence: Synthetic peptide
QEEEIATTNPVATEQYGEAPEVCQHGGK

SEQ ID NO: 98195 - protein, 28 aa, Artificial Sequence
  Description of Artificial Sequence: Synthetic peptide
QEEEIATTNPVATEQYGEAPEVCQHGEV

SEQ ID NO: 98196 - protein, 33 aa, Artificial Sequence
  Description of Artificial Sequence: Synthetic polypeptide
AEEQIRTTNPVATEQYGSVSTTNLSLNLENETD

SEQ ID NO: 98197 - protein, 28 aa, Artificial Sequence
  Description of Artificial Sequence: Synthetic peptide
QEEEIATTNPVATEQYGEAPEVCQHGEK

SEQ ID NO: 98198 - protein, 34 aa, Artificial Sequence
  Description of Artificial Sequence: Synthetic polypeptide
DEEEIATTNPVATEQWGNVSVSGNLENTRGVNEA

SEQ ID NO: 98199 - protein, 35 aa, Artificial Sequence
  Description of Artificial Sequence: Synthetic polypeptide
DEEEIRTTNPVATEQYGSVQVTNNEQNRQLEILRM

SEQ ID NO: 98200 - protein, 30 aa, Artificial Sequence
  Description of Artificial Sequence: Synthetic polypeptide
MENEIRTTNPVATECYGSVADELQEVGEDL

SEQ ID NO: 98201 - protein, 33 aa, Artificial Sequence
  Description of Artificial Sequence: Synthetic polypeptide
DEEEIRTTNPVATEQYGSVLPTMNQINGELQPL

SEQ ID NO: 98202 - protein, 28 aa, Artificial Sequence
  Description of Artificial Sequence: Synthetic peptide
EENEIATTNPVATECYGDVSECLQHEEL

SEQ ID NO: 98203 - protein, 31 aa, Artificial Sequence
  Description of Artificial Sequence: Synthetic polypeptide
EEEEIRTTNPVAYEQWGSVVMNNLIQLPDFR

SEQ ID NO: 98204 - protein, 32 aa, Artificial Sequence
  Description of Artificial Sequence: Synthetic polypeptide
MEEEISTTNPVATEQYGCVSVTELQGFISNQM

SEQ ID NO: 98205 - protein, 32 aa, Artificial Sequence
  Description of Artificial Sequence: Synthetic polypeptide
MEEEISTTNPVATEQYGCVSVTGELQGGSEQM

SEQ ID NO: 98206 - protein, 34 aa, Artificial Sequence
  Description of Artificial Sequence: Synthetic polypeptide
DEEEIRTTNPVATEQYGSVSETNMVDIREEQEIE

SEQ ID NO: 98207 - protein, 29 aa, Artificial Sequence
  Description of Artificial Sequence: Synthetic peptide
QECEIATTNPVATECYGVVSTEALQGEEL

SEQ ID NO: 98208 - protein, 30 aa, Artificial Sequence
  Description of Artificial Sequence: Synthetic polypeptide
QDSEIATTNPVSTEGYGNVSANTLQSRGER

SEQ ID NO: 98209 - protein, 30 aa, Artificial Sequence
  Description of Artificial Sequence: Synthetic polypeptide
QDSEIATTNPVSTEGYGNVSANTLQSRGQR

SEQ ID NO: 98210 - protein, 32 aa, Artificial Sequence
  Description of Artificial Sequence: Synthetic polypeptide
EEIEISTTNPVATEQYGTCVDSWNAQRGNGSY

SEQ ID NO: 98211 - protein, 32 aa, Artificial Sequence
  Description of Artificial Sequence: Synthetic polypeptide
EEEEIRTTNPVAYEQWGSVSCTTPQGPGGNND

SEQ ID NO: 98212 - protein, 31 aa, Artificial Sequence
  Description of Artificial Sequence: Synthetic polypeptide
QEAEIACTNPVATEQYGSVATNLQAEDPGEN

SEQ ID NO: 98213 - protein, 33 aa, Artificial Sequence
  Description of Artificial Sequence: Synthetic polypeptide
EEEEIRTTNPVAYEQYGSVGCTNEPQGPGGNND

SEQ ID NO: 98214 - protein, 35 aa, Artificial Sequence
  Description of Artificial Sequence: Synthetic polypeptide
AEEEIRTTNPVATEQYGVVSTTVSNLQQEAEAGNE

SEQ ID NO: 98215 - protein, 32 aa, Artificial Sequence
  Description of Artificial Sequence: Synthetic polypeptide
MEGEIRTTNPVATEQYGCVSTNNNDNRDGFDQ

SEQ ID NO: 98216 - protein, 34 aa, Artificial Sequence
  Description of Artificial Sequence: Synthetic polypeptide
EEEEIRTTNPVAYEQYGSVSCTENEDQGPGGNND

SEQ ID NO: 98217 - protein, 28 aa, Artificial Sequence
  Description of Artificial Sequence: Synthetic peptide
QEAEIAPTNPCSSEQYGIVSCNLQSGTR

SEQ ID NO: 98218 - protein, 33 aa, Artificial Sequence
  Description of Artificial Sequence: Synthetic polypeptide
DEEEIRTTNPVATEQYGSVNNTNEMSEEEDSRE

SEQ ID NO: 98219 - protein, 33 aa, Artificial Sequence
  Description of Artificial Sequence: Synthetic polypeptide
EEEEIRTTNPVAYEQYGSVSCTNEPVYPGGNND

SEQ ID NO: 98220 - protein, 33 aa, Artificial Sequence
  Description of Artificial Sequence: Synthetic polypeptide
EEEEIRTTNPVAYEQYGSVSCTREPQTPGGNND

SEQ ID NO: 98221 - protein, 28 aa, Artificial Sequence
  Description of Artificial Sequence: Synthetic peptide
QECEIATTNPVATECYGQVSECLQHEEA

SEQ ID NO: 98222 - protein, 32 aa, Artificial Sequence
  Description of Artificial Sequence: Synthetic polypeptide
EEEEIRTTNPVAYEQYGSTVSTNAPTGPGGSK

SEQ ID NO: 98223 - protein, 28 aa, Artificial Sequence
  Description of Artificial Sequence: Synthetic peptide
QECEIATTNPVATECYGDVSECLQHEEL

SEQ ID NO: 98224 - protein, 28 aa, Artificial Sequence
  Description of Artificial Sequence: Synthetic peptide
EENEIATTNPVATECYGDVSECLQHEEP

SEQ ID NO: 98225 - protein, 33 aa, Artificial Sequence
  Description of Artificial Sequence: Synthetic polypeptide
DEEEIRTTNPVATEQYGSVSETMIVQVSTEELF

SEQ ID NO: 98226 - protein, 28 aa, Artificial Sequence
  Description of Artificial Sequence: Synthetic peptide
EENEIATTNPVATECYGDVSECLQHEQL

SEQ ID NO: 98227 - protein, 29 aa, Artificial Sequence
  Description of Artificial Sequence: Synthetic peptide
QDNEIATTNPVSTEGYGNVSANCLQRGEL

SEQ ID NO: 98228 - protein, 29 aa, Artificial Sequence
  Description of Artificial Sequence: Synthetic peptide
QDNEIATTNPVSTEGYGNVSANTLQRGEL

SEQ ID NO: 98229 - protein, 35 aa, Artificial Sequence
  Description of Artificial Sequence: Synthetic polypeptide
DEEEIRTTNPVATEQYGSVSETSNPQQFMGEEEDI

SEQ ID NO: 98230 - protein, 33 aa, Artificial Sequence
  Description of Artificial Sequence: Synthetic polypeptide
DEEEIRTTNPVATEQYGSVNSATVEEDNQTDGI

SEQ ID NO: 98231 - protein, 28 aa, Artificial Sequence
  Description of Artificial Sequence: Synthetic peptide
QECEIATTNPVATESYGVVSELLQDEEL

SEQ ID NO: 98232 - protein, 34 aa, Artificial Sequence
  Description of Artificial Sequence: Synthetic polypeptide
EEEEIRTTNPVATESYGVVSTTNLTNQGGNEQDE

SEQ ID NO: 98233 - protein, 28 aa, Artificial Sequence
  Description of Artificial Sequence: Synthetic peptide
QECEIATTNPVATEEYGVVSELLQHEEE

SEQ ID NO: 98234 - protein, 33 aa, Artificial Sequence
  Description of Artificial Sequence: Synthetic polypeptide
MEGEIRTTNPVATEQYGSVCSETNMLQETQEDY

SEQ ID NO: 98235 - protein, 35 aa, Artificial Sequence
  Description of Artificial Sequence: Synthetic polypeptide
DEEEIRTTNPVATEQYGSVSETNQVAPEVNGENVI

SEQ ID NO: 98236 - protein, 34 aa, Artificial Sequence
  Description of Artificial Sequence: Synthetic polypeptide
EEEEIRTTNPVATESYGVVSTTNNLTNQEGNDQD

SEQ ID NO: 98237 - protein, 35 aa, Artificial Sequence
  Description of Artificial Sequence: Synthetic polypeptide
DEEEIRTTNPVATEQYGSVSETPNMVDIRDEQSRE

SEQ ID NO: 98238 - protein, 33 aa, Artificial Sequence
  Description of Artificial Sequence: Synthetic polypeptide
DEECIRTTNPVAYEQYGCVSTTINVETRIGENQ

SEQ ID NO: 98239 - protein, 30 aa, Artificial Sequence
  Description of Artificial Sequence: Synthetic polypeptide
QDNEIATTNPVSTEGYGNVSANTLQSRGER

SEQ ID NO: 98240 - protein, 32 aa, Artificial Sequence
  Description of Artificial Sequence: Synthetic polypeptide
DEECIRTTNPVAYEQYGCVVQSTNQSQFGGIQ

SEQ ID NO: 98241 - protein, 34 aa, Artificial Sequence
  Description of Artificial Sequence: Synthetic polypeptide
DEEEIRTTNPVATEQYGSVNSANIDDQAGQEEQQ

SEQ ID NO: 98242 - protein, 33 aa, Artificial Sequence
  Description of Artificial Sequence: Synthetic polypeptide
DEEEIRTTNPVATEQYGSVNSANDHNQESEESQ

SEQ ID NO: 98243 - protein, 32 aa, Artificial Sequence
  Description of Artificial Sequence: Synthetic polypeptide
EEEEIRTTNPVAYEAYGSTVSTNAPTGPGGNG

SEQ ID NO: 98244 - protein, 33 aa, Artificial Sequence
  Description of Artificial Sequence: Synthetic polypeptide
EEEEIRTTNPVAYEHYGSVSCTNPPQGPGGNND

SEQ ID NO: 98245 - protein, 34 aa, Artificial Sequence
  Description of Artificial Sequence: Synthetic polypeptide
DEEEIRTTNPVATEQYGSVSETPGDMMRTIVNED

SEQ ID NO: 98246 - protein, 35 aa, Artificial Sequence
  Description of Artificial Sequence: Synthetic polypeptide
DEEEIRTTNPVATEQYGSVSETPNMVPVATLVNER

SEQ ID NO: 98247 - protein, 34 aa, Artificial Sequence
  Description of Artificial Sequence: Synthetic polypeptide
EEEEIRTTNPVATESYGSVSTTNNGLGTQGNDQD

SEQ ID NO: 98248 - protein, 35 aa, Artificial Sequence
  Description of Artificial Sequence: Synthetic polypeptide
DEEEIRTTNPVATEQYGSVSETNGLDQAAFVEPAP

SEQ ID NO: 98249 - protein, 34 aa, Artificial Sequence
  Description of Artificial Sequence: Synthetic polypeptide
DEEEIRTTNPVATEQYGSVNPTNDDERSMNEEFS

SEQ ID NO: 98250 - protein, 28 aa, Artificial Sequence
  Description of Artificial Sequence: Synthetic peptide
QECEIAPTNPCSAEQYGIVSCNLQSGTR

SEQ ID NO: 98251 - protein, 33 aa, Artificial Sequence
  Description of Artificial Sequence: Synthetic polypeptide
DEEEIRTTNPVATEQYGSVNNVSNFDSEGNEEQ

SEQ ID NO: 98252 - protein, 29 aa, Artificial Sequence
  Description of Artificial Sequence: Synthetic peptide
QEAVICCTNPVAYEQYGSVSMNEQHGNSL

SEQ ID NO: 98253 - protein, 32 aa, Artificial Sequence
  Description of Artificial Sequence: Synthetic polypeptide
EEETICTTNPVATEQYGSVSVVNNSQQGTNSN

SEQ ID NO: 98254 - protein, 33 aa, Artificial Sequence
  Description of Artificial Sequence: Synthetic polypeptide
EEETICTTNPVATEQYGSVSTSNNSQQGTNESA

SEQ ID NO: 98255 - protein, 33 aa, Artificial Sequence
  Description of Artificial Sequence: Synthetic polypeptide
EEETICTTNPVATEQYGSVSTNNNSEQLGTNAS

SEQ ID NO: 98256 - protein, 33 aa, Artificial Sequence
  Description of Artificial Sequence: Synthetic polypeptide
AEEEIRTTNPVATEQYGVVSTTTVLNAGTTNTG

SEQ ID NO: 98257 - protein, 29 aa, Artificial Sequence
  Description of Artificial Sequence: Synthetic peptide
QEAVICCTNPVAYEQYGSVAMNEQRGNDS

SEQ ID NO: 98258 - protein, 28 aa, Artificial Sequence
  Description of Artificial Sequence: Synthetic peptide
QEAEIATTNPVATECYGVVSECLQHEEL

SEQ ID NO: 98259 - protein, 28 aa, Artificial Sequence
  Description of Artificial Sequence: Synthetic peptide
QEEEIATTNPVATEQYGEAPEVCNRENV

SEQ ID NO: 98260 - protein, 31 aa, Artificial Sequence
  Description of Artificial Sequence: Synthetic polypeptide
MEEEITTTNPVATEQYGNVSVTGGQGGGEEE

SEQ ID NO: 98261 - protein, 33 aa, Artificial Sequence
  Description of Artificial Sequence: Synthetic polypeptide
QEAETRTTNPVATEQYGSVSTGDLGQNDIGNGD

SEQ ID NO: 98262 - protein, 33 aa, Artificial Sequence
  Description of Artificial Sequence: Synthetic polypeptide
EEETICTTNPVATEQYGSVSTNNSEQLGTNNSD

SEQ ID NO: 98263 - protein, 35 aa, Artificial Sequence
  Description of Artificial Sequence: Synthetic polypeptide
AEEEIRTTNPVATEQYGVVSTTVNLGQQGNNEQNQ

SEQ ID NO: 98264 - protein, 34 aa, Artificial Sequence
  Description of Artificial Sequence: Synthetic polypeptide
AEEEIRTTNPVATEQYGSVVVSVTNNNDQEQEND

SEQ ID NO: 98265 - protein, 32 aa, Artificial Sequence
  Description of Artificial Sequence: Synthetic polypeptide
DEECIRTTNPVAYEQYSEEVTTGGLQGGEGNR

SEQ ID NO: 98266 - protein, 31 aa, Artificial Sequence
  Description of Artificial Sequence: Synthetic polypeptide
DEECIRTTNPVAYEQYSEEVTTGGLQGGENK

SEQ ID NO: 98267 - protein, 35 aa, Artificial Sequence
  Description of Artificial Sequence: Synthetic polypeptide
AEEEIRTTNPVATEQYGSVVVSVTNNLQEQEGTED

SEQ ID NO: 98268 - protein, 32 aa, Artificial Sequence
  Description of Artificial Sequence: Synthetic polypeptide
DEECIRTTNPVAYEQYSEEVTTGNGQDNGNTR

SEQ ID NO: 98269 - protein, 32 aa, Artificial Sequence
  Description of Artificial Sequence: Synthetic polypeptide
QEAEIATTNPVAYEQYGSVATNLQDAGPNGNN

SEQ ID NO: 98270 - protein, 28 aa, Artificial Sequence
  Description of Artificial Sequence: Synthetic peptide
QEAEIATTNPVATEGYGDVSECLQHEEL

SEQ ID NO: 98271 - protein, 32 aa, Artificial Sequence
  Description of Artificial Sequence: Synthetic polypeptide
EEEEIRTTNPVAYEQYGTTVSTNAPTSPGGNK

SEQ ID NO: 98272 - protein, 35 aa, Artificial Sequence
  Description of Artificial Sequence: Synthetic polypeptide
AEEEIRTTNPVATEQYGVVSTTTNNLQQQNNGTND

SEQ ID NO: 98273 - protein, 34 aa, Artificial Sequence
  Description of Artificial Sequence: Synthetic polypeptide
DEECIRTTNPVAYEQYRWEVVSTNMLSQIGGNNR

SEQ ID NO: 98274 - protein, 35 aa, Artificial Sequence
  Description of Artificial Sequence: Synthetic polypeptide
DEEEIRTTNPVATEQYGSVNPTNATENQRSQDERP

SEQ ID NO: 98275 - protein, 35 aa, Artificial Sequence
  Description of Artificial Sequence: Synthetic polypeptide
AEEEIRTTNPVATEQYGVVSTTVNLQQQDEGNIAT

SEQ ID NO: 98276 - protein, 33 aa, Artificial Sequence
  Description of Artificial Sequence: Synthetic polypeptide
EEEEIRTTNPVAYEQYGTVSCTNMPQGPGGNND

SEQ ID NO: 98277 - protein, 28 aa, Artificial Sequence
  Description of Artificial Sequence: Synthetic peptide
QECEIATTNPVATEAYGVVSEQLQQEEL

SEQ ID NO: 98278 - protein, 32 aa, Artificial Sequence
  Description of Artificial Sequence: Synthetic polypeptide
MEEEITTTNPVATEQYGDVSVTDGEGQGGGNE

SEQ ID NO: 98279 - protein, 28 aa, Artificial Sequence
  Description of Artificial Sequence: Synthetic peptide
EEGEIAPTNPCSSEQYGIVSCNLQSGTR

SEQ ID NO: 98280 - protein, 34 aa, Artificial Sequence
  Description of Artificial Sequence: Synthetic polypeptide
DEEEIRTTNPVATEQYGSVKTVESPDVQAGEDNG

SEQ ID NO: 98281 - protein, 28 aa, Artificial Sequence
  Description of Artificial Sequence: Synthetic peptide
QECEIATTNPVATEAYGTVSELLQNEEL

SEQ ID NO: 98282 - protein, 33 aa, Artificial Sequence
  Description of Artificial Sequence: Synthetic polypeptide
EEEEIRTTNPVAYEVDGSTVSCTNLSATGNNRR

SEQ ID NO: 98283 - protein, 33 aa, Artificial Sequence
  Description of Artificial Sequence: Synthetic polypeptide
DEEEIRTTNPVATEQYGSVLMTPMLQPVEVETA

SEQ ID NO: 98284 - protein, 33 aa, Artificial Sequence
  Description of Artificial Sequence: Synthetic polypeptide
DEECIRTTNPVAYEQYGQTVCSCTQNVSQSGNN

SEQ ID NO: 98285 - protein, 32 aa, Artificial Sequence
  Description of Artificial Sequence: Synthetic polypeptide
DEECIRTTNPVAYEQYGQVSCTINVTRTVNNN

SEQ ID NO: 98286 - protein, 28 aa, Artificial Sequence
  Description of Artificial Sequence: Synthetic peptide
MEGEIAPTNPCSSEQYGIVSCNLQSGTR

SEQ ID NO: 98287 - protein, 32 aa, Artificial Sequence
  Description of Artificial Sequence: Synthetic polypeptide
MEEEITTTNPVATEQYGDVSVTGEGQGGGGNQ

SEQ ID NO: 98288 - protein, 34 aa, Artificial Sequence
  Description of Artificial Sequence: Synthetic polypeptide
DEECIRTTNPVAYEQYGQVVSYTINEVSQRTGNI

SEQ ID NO: 98289 - protein, 32 aa, Artificial Sequence
  Description of Artificial Sequence: Synthetic polypeptide
EEETICTTNPVATEQYGSVSVVVNGSQQGTNS

SEQ ID NO: 98290 - protein, 35 aa, Artificial Sequence
  Description of Artificial Sequence: Synthetic polypeptide
AEEEIRTTNPVATEQYGVVSTTTNNLQQGNNNQNY

SEQ ID NO: 98291 - protein, 34 aa, Artificial Sequence
  Description of Artificial Sequence: Synthetic polypeptide
DEECIRTTNPVAYEQYRWEVVSTNALSQITGGNR

SEQ ID NO: 98292 - protein, 35 aa, Artificial Sequence
  Description of Artificial Sequence: Synthetic polypeptide
AEEEIRTTNPVATEQYGVVSTTTNNLQQNNQGTNE

SEQ ID NO: 98293 - protein, 28 aa, Artificial Sequence
  Description of Artificial Sequence: Synthetic peptide
QECEIAPTNPCSSEQYGIVSCNLQSGTR

SEQ ID NO: 98294 - protein, 28 aa, Artificial Sequence
  Description of Artificial Sequence: Synthetic peptide
QEAEIATTNPVATECYGDVSECLQHEEL

SEQ ID NO: 98295 - protein, 34 aa, Artificial Sequence
  Description of Artificial Sequence: Synthetic polypeptide
DEEEIRTTNPVATEQYGSVNSCELEDERGGEEDE

SEQ ID NO: 98296 - protein, 31 aa, Artificial Sequence
  Description of Artificial Sequence: Synthetic polypeptide
MEGEIRTTNPVATEQYGSVQTAHLIEMNDEI

SEQ ID NO: 98297 - protein, 34 aa, Artificial Sequence
  Description of Artificial Sequence: Synthetic polypeptide
DEEEIRTTNPVATEQYGSVNSCELEDERGGGEES

SEQ ID NO: 98298 - protein, 32 aa, Artificial Sequence
  Description of Artificial Sequence: Synthetic polypeptide
DEEEIATTNPMATEQYGSVPTVQDHSQVVNIR

SEQ ID NO: 98299 - protein, 33 aa, Artificial Sequence
  Description of Artificial Sequence: Synthetic polypeptide
DEECIRTTNPVAYEQYGCVCSTGNPQYFGSNQG

SEQ ID NO: 98300 - protein, 31 aa, Artificial Sequence
  Description of Artificial Sequence: Synthetic polypeptide
DEEEIATTNPMATEQYGSVPTVQVHSQQNGR

SEQ ID NO: 98301 - protein, 28 aa, Artificial Sequence
  Description of Artificial Sequence: Synthetic peptide
QDEEIATTNPVSTEQYGEVPEVCQHGER

SEQ ID NO: 98302 - protein, 33 aa, Artificial Sequence
  Description of Artificial Sequence: Synthetic polypeptide
DEEEIRTTNPVATEQYGSVLPPTTHDQVENEEL

SEQ ID NO: 98303 - protein, 31 aa, Artificial Sequence
  Description of Artificial Sequence: Synthetic polypeptide
EEEEIRTTNPVATEQYGSVYATVQQVEEEAN

SEQ ID NO: 98304 - protein, 34 aa, Artificial Sequence
  Description of Artificial Sequence: Synthetic polypeptide
DEEEIRTTNPVATEQYGSVSFEPADQEVGEMFRQ

SEQ ID NO: 98305 - protein, 34 aa, Artificial Sequence
  Description of Artificial Sequence: Synthetic polypeptide
DEEEIRTTNPVATEQYGSVIYQPNLQIAENVELG

SEQ ID NO: 98306 - protein, 34 aa, Artificial Sequence
  Description of Artificial Sequence: Synthetic polypeptide
EEEEIRTTNPVATEQYGSVYPPENEQPRIGNNVF

SEQ ID NO: 98307 - protein, 35 aa, Artificial Sequence
  Description of Artificial Sequence: Synthetic polypeptide
EEEEIRTTNPVATEQYGSVVVTTNLGQQQGENQDD

SEQ ID NO: 98308 - protein, 32 aa, Artificial Sequence
  Description of Artificial Sequence: Synthetic polypeptide
DEEEIATTNPMATETYGSVPMNDLQHASGIKR

SEQ ID NO: 98309 - protein, 34 aa, Artificial Sequence
  Description of Artificial Sequence: Synthetic polypeptide
DEEEIRTTNPVATEQYGSVNSDQNDQLEFMEGGQ

SEQ ID NO: 98310 - protein, 33 aa, Artificial Sequence
  Description of Artificial Sequence: Synthetic polypeptide
DEEEIRTTNPVATEQYGSVNSDNVEPGTGGEFI

SEQ ID NO: 98311 - protein, 33 aa, Artificial Sequence
  Description of Artificial Sequence: Synthetic polypeptide
MEGEIRTTNPVATEQYGSVWTVDSLTQIGFSER

SEQ ID NO: 98312 - protein, 33 aa, Artificial Sequence
  Description of Artificial Sequence: Synthetic polypeptide
DEEEIRTTNPVATEQYGSVSFANNQFPIVELDG

SEQ ID NO: 98313 - protein, 34 aa, Artificial Sequence
  Description of Artificial Sequence: Synthetic polypeptide
DEEEIRTTNPVATEQYGSVSFANNLPQLLEVETQ

SEQ ID NO: 98314 - protein, 34 aa, Artificial Sequence
  Description of Artificial Sequence: Synthetic polypeptide
DEEEIRTTNPVATEQYGSVSFANNLPQGVTEVTQ

SEQ ID NO: 98315 - protein, 35 aa, Artificial Sequence
  Description of Artificial Sequence: Synthetic polypeptide
EEEEIRTTNPVATEQYGVVSTTNLQQNQQQGENTD

SEQ ID NO: 98316 - protein, 35 aa, Artificial Sequence
  Description of Artificial Sequence: Synthetic polypeptide
EEEEIRTTNPVATEQYGVVSTTTNLGQQQGENQTD

SEQ ID NO: 98317 - protein, 35 aa, Artificial Sequence
  Description of Artificial Sequence: Synthetic polypeptide
DEEEIRTTNPVATEQYGSVIYTPNGQQVRENVELL

SEQ ID NO: 98318 - protein, 34 aa, Artificial Sequence
  Description of Artificial Sequence: Synthetic polypeptide
DEEEIRTTNPVATEQYGSVSFEADQLPVGENVQV

SEQ ID NO: 98319 - protein, 35 aa, Artificial Sequence
  Description of Artificial Sequence: Synthetic polypeptide
DEEEIRTTNPVATEQYGSVIYTPNLQQQENVELYH

SEQ ID NO: 98320 - protein, 35 aa, Artificial Sequence
  Description of Artificial Sequence: Synthetic polypeptide
EEEEIRTTNPVATEQYGSVVTTTTNLGQQGENQDD

SEQ ID NO: 98321 - protein, 33 aa, Artificial Sequence
  Description of Artificial Sequence: Synthetic polypeptide
EEEEIRTTNPVATEQYGSVVTALQQNGGGFDET

SEQ ID NO: 98322 - protein, 34 aa, Artificial Sequence
  Description of Artificial Sequence: Synthetic polypeptide
DEEEIRTTNPVATEQYGSVIYPTEPQLERNDINV

SEQ ID NO: 98323 - protein, 28 aa, Artificial Sequence
  Description of Artificial Sequence: Synthetic peptide
MENEICTTNPVATEAYGCVSELLQHEEL

SEQ ID NO: 98324 - protein, 28 aa, Artificial Sequence
  Description of Artificial Sequence: Synthetic peptide
MENEIATTNPVATEGYGDVSECLQHEEL

SEQ ID NO: 98325 - protein, 35 aa, Artificial Sequence
  Description of Artificial Sequence: Synthetic polypeptide
DEEEIRTTNPVATEQYGSVIYPTNGQEQELVGENV

SEQ ID NO: 98326 - protein, 28 aa, Artificial Sequence
  Description of Artificial Sequence: Synthetic peptide
MENEIATTNPVATECYGTVSEALQHEEL

SEQ ID NO: 98327 - protein, 34 aa, Artificial Sequence
  Description of Artificial Sequence: Synthetic polypeptide
DEEEIRTTNPVATEQYGSVSFNTMVSEQDVNPET

SEQ ID NO: 98328 - protein, 35 aa, Artificial Sequence
  Description of Artificial Sequence: Synthetic polypeptide
DEEEIRTTNPVATEQYGSVQVTNIQEENRTLEFLD

SEQ ID NO: 98329 - protein, 28 aa, Artificial Sequence
  Description of Artificial Sequence: Synthetic peptide
MENEIATTNPVATECYGDVSECLQHEEL

SEQ ID NO: 98330 - protein, 33 aa, Artificial Sequence
  Description of Artificial Sequence: Synthetic polypeptide
DEEEIRTTNPVATEQYGSVSFNTMVFEASVNPE

SEQ ID NO: 98331 - protein, 34 aa, Artificial Sequence
  Description of Artificial Sequence: Synthetic polypeptide
DEEEIRTTNPVATEQYGSVIYQPGLQQRENVELY

SEQ ID NO: 98332 - protein, 35 aa, Artificial Sequence
  Description of Artificial Sequence: Synthetic polypeptide
EEEEIRTTNPVATEQYGSVTVTNLQLQNGNQNGNE

SEQ ID NO: 98333 - protein, 35 aa, Artificial Sequence
  Description of Artificial Sequence: Synthetic polypeptide
EEEEIRTTNPVATEQYGSVTVVTNLLQGNQNGNNV

SEQ ID NO: 98334 - protein, 28 aa, Artificial Sequence
  Description of Artificial Sequence: Synthetic peptide
EENEIATTNPVATERYGDVSECLQHEEL

SEQ ID NO: 98335 - protein, 33 aa, Artificial Sequence
  Description of Artificial Sequence: Synthetic polypeptide
DEEEIRTTNPVATEQYGSVNSEHSLDDNGEDGM

SEQ ID NO: 98336 - protein, 35 aa, Artificial Sequence
  Description of Artificial Sequence: Synthetic polypeptide
DEEEIRTTNPVATEQYGSVSFNMMQITRQDVNESP

SEQ ID NO: 98337 - protein, 28 aa, Artificial Sequence
  Description of Artificial Sequence: Synthetic peptide
QEEEIATTNPVATEQYGEAPETCQHGEK

SEQ ID NO: 98338 - protein, 32 aa, Artificial Sequence
  Description of Artificial Sequence: Synthetic polypeptide
DEECIRTTNPVAYEQYGCVCSTEEVQNGSNQG

SEQ ID NO: 98339 - protein, 33 aa, Artificial Sequence
  Description of Artificial Sequence: Synthetic polypeptide
DEECIRTTNPVAYEQYGCVCSTENDQYFGSNQM

SEQ ID NO: 98340 - protein, 29 aa, Artificial Sequence
  Description of Artificial Sequence: Synthetic peptide
QECEICTTNPVATEAYGVVSEQLQGGEEL

SEQ ID NO: 98341 - protein, 33 aa, Artificial Sequence
  Description of Artificial Sequence: Synthetic polypeptide
EEEEIRTTNPVATEQYGSVVTALDQNGGGFEEI

SEQ ID NO: 98342 - protein, 34 aa, Artificial Sequence
  Description of Artificial Sequence: Synthetic polypeptide
EEEEIRTTNPVATEQYGSVTVVTNLLNQGNQNGE

SEQ ID NO: 98343 - protein, 33 aa, Artificial Sequence
  Description of Artificial Sequence: Synthetic polypeptide
MEEEISTTNPVATEQYGCVCSNTELQGFGSNQL

SEQ ID NO: 98344 - protein, 28 aa, Artificial Sequence
  Description of Artificial Sequence: Synthetic peptide
DEEEIATTNPVATEQWGEASEICQAEEA

SEQ ID NO: 98345 - protein, 33 aa, Artificial Sequence
  Description of Artificial Sequence: Synthetic polypeptide
DEEEIRTTNPVATEQYGSVLPILNPLISVGEED

SEQ ID NO: 98346 - protein, 34 aa, Artificial Sequence
  Description of Artificial Sequence: Synthetic polypeptide
MEGEIRTTNPVATEQYGSVSTTNGLDDEEGEDNE

SEQ ID NO: 98347 - protein, 32 aa, Artificial Sequence
  Description of Artificial Sequence: Synthetic polypeptide
DEECIRTTNPVAYEQYGCVSTINVEDRIYENQ

SEQ ID NO: 98348 - protein, 28 aa, Artificial Sequence
  Description of Artificial Sequence: Synthetic peptide
QDGEIASTNPVSTEGYGIVACNLQRGTR

SEQ ID NO: 98349 - protein, 35 aa, Artificial Sequence
  Description of Artificial Sequence: Synthetic polypeptide
DEEEIRTTNPVATEQYGSVNSDGNLGPEQGEGFEI

SEQ ID NO: 98350 - protein, 34 aa, Artificial Sequence
  Description of Artificial Sequence: Synthetic polypeptide
DEEEIACTNPVATEAYGSVSVTNAGQPPGGNNRA

SEQ ID NO: 98351 - protein, 31 aa, Artificial Sequence
  Description of Artificial Sequence: Synthetic polypeptide
DEEEIATTNPNATEQYGSVPTVQDHRQENGE

SEQ ID NO: 98352 - protein, 28 aa, Artificial Sequence
  Description of Artificial Sequence: Synthetic peptide
EENEIATTNPVATECYGNVSECLQHEEK

SEQ ID NO: 98353 - protein, 34 aa, Artificial Sequence
  Description of Artificial Sequence: Synthetic polypeptide
DEEEIRTTNPVATEQYGSVIYTTLWLAEGINEQD

SEQ ID NO: 98354 - protein, 29 aa, Artificial Sequence
  Description of Artificial Sequence: Synthetic peptide
QECEIATTNPVATEYYGVVSTEQLQHEEL

SEQ ID NO: 98355 - protein, 32 aa, Artificial Sequence
  Description of Artificial Sequence: Synthetic polypeptide
DEEEIACTNPVATEPYGAVCATNLTDRGGNEQ

SEQ ID NO: 98356 - protein, 36 aa, Artificial Sequence
  Description of Artificial Sequence: Synthetic polypeptide
DEEEIRTTNPVATEQYGSVNSCTPNSGGQRFGDKYF

SEQ ID NO: 98357 - protein, 28 aa, Artificial Sequence
  Description of Artificial Sequence: Synthetic peptide
QDNEIATTNPVATECYGDVAETLQHGQR

SEQ ID NO: 98358 - protein, 34 aa, Artificial Sequence
  Description of Artificial Sequence: Synthetic polypeptide
DEEEIRTTNPVATEQYGSVSETWPGLQHETVLEL

SEQ ID NO: 98359 - protein, 32 aa, Artificial Sequence
  Description of Artificial Sequence: Synthetic polypeptide
DEEEIRTTNPVATEQYGSVQTTTTVPTGEEEF

SEQ ID NO: 98360 - protein, 34 aa, Artificial Sequence
  Description of Artificial Sequence: Synthetic polypeptide
MEGEIRTTNPVATEQYGSVSPTDDLEQRNSIDRG

SEQ ID NO: 98361 - protein, 33 aa, Artificial Sequence
  Description of Artificial Sequence: Synthetic polypeptide
EEEEIRTTNPVATESYGSVSNTVLTEHRVGFQN

SEQ ID NO: 98362 - protein, 34 aa, Artificial Sequence
  Description of Artificial Sequence: Synthetic polypeptide
EEEEIRTTNPVATESYGSVSNTVNEEHRVGTPGR

SEQ ID NO: 98363 - protein, 32 aa, Artificial Sequence
  Description of Artificial Sequence: Synthetic polypeptide
MEGEIRTTNPVATEQYGSVQTTALIERMNDES

SEQ ID NO: 98364 - protein, 35 aa, Artificial Sequence
  Description of Artificial Sequence: Synthetic polypeptide
AEEEIRTTNPVATEQYGVVSTTTNLQQNNQGTNYE

SEQ ID NO: 98365 - protein, 34 aa, Artificial Sequence
  Description of Artificial Sequence: Synthetic polypeptide
DEEEIATTNPSATEQYGSVPTVGQNDHRQGQNGR

SEQ ID NO: 98366 - protein, 34 aa, Artificial Sequence
  Description of Artificial Sequence: Synthetic polypeptide
EEEEIRTTNPVATESYGSVSNTVLEEHRVGEQRD

SEQ ID NO: 98367 - protein, 28 aa, Artificial Sequence
  Description of Artificial Sequence: Synthetic peptide
EENEIATTNPVATECYGQVSECLQHNEL

SEQ ID NO: 98368 - protein, 32 aa, Artificial Sequence
  Description of Artificial Sequence: Synthetic polypeptide
DEECIRTTNPVAYEQYGCVSTINDVQTIDDNQ

SEQ ID NO: 98369 - protein, 34 aa, Artificial Sequence
  Description of Artificial Sequence: Synthetic polypeptide
DEEEIRTTNPVATEQYGSVSEVPNLMGDGVVQEI

SEQ ID NO: 98370 - protein, 28 aa, Artificial Sequence
  Description of Artificial Sequence: Synthetic peptide
QDGEIAPTNPVSTEGYGIVACNLQRGTR

SEQ ID NO: 98371 - protein, 35 aa, Artificial Sequence
  Description of Artificial Sequence: Synthetic polypeptide
DEEEIRTTNPVATEQYGSVNSDNGELQQGEGEDGE

SEQ ID NO: 98372 - protein, 31 aa, Artificial Sequence
  Description of Artificial Sequence: Synthetic polypeptide
DEECIRTTNPVAYEQYGCVCSWGNHQHGSQQ

SEQ ID NO: 98373 - protein, 32 aa, Artificial Sequence
  Description of Artificial Sequence: Synthetic polypeptide
DEECIRTTNPVAYEQYGCVCSWGNPQRFGSQQ

SEQ ID NO: 98374 - protein, 33 aa, Artificial Sequence
  Description of Artificial Sequence: Synthetic polypeptide
DEEEIRTTNPVATEQYGSVSEYEYPNTHIENEM

SEQ ID NO: 98375 - protein, 28 aa, Artificial Sequence
  Description of Artificial Sequence: Synthetic peptide
EENEIATTNPVATEPYGDVSECLQHEES

SEQ ID NO: 98376 - protein, 32 aa, Artificial Sequence
  Description of Artificial Sequence: Synthetic polypeptide
DEEEIATTNPMAYEGYGSCSCTNELSARVGNT

SEQ ID NO: 98377 - protein, 33 aa, Artificial Sequence
  Description of Artificial Sequence: Synthetic polypeptide
MEEEISTTNPVATEQYGCVCSTNHQNFGSNTQS

SEQ ID NO: 98378 - protein, 34 aa, Artificial Sequence
  Description of Artificial Sequence: Synthetic polypeptide
DEEEIRTTNPVATEQYGSVIYTPNQFVRENVEVG

SEQ ID NO: 98379 - protein, 35 aa, Artificial Sequence
  Description of Artificial Sequence: Synthetic polypeptide
DEEEIRTTNPVATEQYGSVIYTPNQQVRENVETGE

SEQ ID NO: 98380 - protein, 34 aa, Artificial Sequence
  Description of Artificial Sequence: Synthetic polypeptide
DEEEIRTTNPVATEQYGSVQTTNLEQLEQMTQTL

SEQ ID NO: 98381 - protein, 34 aa, Artificial Sequence
  Description of Artificial Sequence: Synthetic polypeptide
DEEEIRTTNPVATEQYGSVNSDGNQGQEQGEGEQ

SEQ ID NO: 98382 - protein, 35 aa, Artificial Sequence
  Description of Artificial Sequence: Synthetic polypeptide
EEEEIRTTNPVATEQYGVVTTSTNLQQGNQNGTED

SEQ ID NO: 98383 - protein, 33 aa, Artificial Sequence
  Description of Artificial Sequence: Synthetic polypeptide
MEEEISTTNPVATEQYGCVCSVTELQGGSNFQL

SEQ ID NO: 98384 - protein, 34 aa, Artificial Sequence
  Description of Artificial Sequence: Synthetic polypeptide
DEEEIRTTNPVATEQYGSVIYTPNQTVRENVELN

SEQ ID NO: 98385 - protein, 34 aa, Artificial Sequence
  Description of Artificial Sequence: Synthetic polypeptide
DEEEIRTTNPVATEQYGSVSEWNLLPDRQMPEED

SEQ ID NO: 98386 - protein, 33 aa, Artificial Sequence
  Description of Artificial Sequence: Synthetic polypeptide
MEGEIRTTNPVATEQYGSVSVSSNLQEVQNDIV

SEQ ID NO: 98387 - protein, 33 aa, Artificial Sequence
  Description of Artificial Sequence: Synthetic polypeptide
EEEEIRTTNPVATESYGSVSNPVNEVHRVGFQR

SEQ ID NO: 98388 - protein, 34 aa, Artificial Sequence
  Description of Artificial Sequence: Synthetic polypeptide
MEGEIRTTNPVATEQYGSVSVSENMLQRVQNDIV

SEQ ID NO: 98389 - protein, 35 aa, Artificial Sequence
  Description of Artificial Sequence: Synthetic polypeptide
DEEEIRTTNPVATEQYGSVIYTPNTQQGRENVENG

SEQ ID NO: 98390 - protein, 34 aa, Artificial Sequence
  Description of Artificial Sequence: Synthetic polypeptide
DEEEIATTNPNATEQYGSVPTVLQAHRQANNGRM

SEQ ID NO: 98391 - protein, 32 aa, Artificial Sequence
  Description of Artificial Sequence: Synthetic polypeptide
NDEEIRTTNPVATEQYGCVCSWNHNQHFGSNQ

SEQ ID NO: 98392 - protein, 29 aa, Artificial Sequence
  Description of Artificial Sequence: Synthetic peptide
NEDEIACTNPVAYEQWGEASENLQRGGDR

SEQ ID NO: 98393 - protein, 34 aa, Artificial Sequence
  Description of Artificial Sequence: Synthetic polypeptide
EEEEIRTTNPVATEQYGSVSPTPNLPEPNLTPCQ

SEQ ID NO: 98394 - protein, 31 aa, Artificial Sequence
  Description of Artificial Sequence: Synthetic polypeptide
QAEEIATTNPVAYEQYGSVATNLQAAPYGEQ

SEQ ID NO: 98395 - protein, 30 aa, Artificial Sequence
  Description of Artificial Sequence: Synthetic polypeptide
NEAEIRTTNPVAYEQWGSVTTGNGDTNGAR

SEQ ID NO: 98396 - protein, 34 aa, Artificial Sequence
  Description of Artificial Sequence: Synthetic polypeptide
DEEEIRTTNPVATEQYGSVISTSNGSGNETGGGT

SEQ ID NO: 98397 - protein, 30 aa, Artificial Sequence
  Description of Artificial Sequence: Synthetic polypeptide
QEDVIRTTNPVATEQYGCVEVNPSQGGTNN

SEQ ID NO: 98398 - protein, 28 aa, Artificial Sequence
  Description of Artificial Sequence: Synthetic peptide
QEEEIATTNPVATEQYGEAAEVCQHGEK

SEQ ID NO: 98399 - protein, 35 aa, Artificial Sequence
  Description of Artificial Sequence: Synthetic polypeptide
DEEEIRTTNPVATEQYGSVISTTANQDGGEGGNEG

SEQ ID NO: 98400 - protein, 32 aa, Artificial Sequence
  Description of Artificial Sequence: Synthetic polypeptide
EEEEIATTNPVAYEQWGNVSGTGMLQGGDGNR

SEQ ID NO: 98401 - protein, 31 aa, Artificial Sequence
  Description of Artificial Sequence: Synthetic polypeptide
NEAEIRTTNPVAYEQWGSVTMDNQQGNGNAR

SEQ ID NO: 98402 - protein, 34 aa, Artificial Sequence
  Description of Artificial Sequence: Synthetic polypeptide
DEEEIATTNPVATEQWGSVSMSGNGQPRGENPMF

SEQ ID NO: 98403 - protein, 31 aa, Artificial Sequence
  Description of Artificial Sequence: Synthetic polypeptide
ENEEISTTNPVATTQYGEVSTNPMGNTGNDR

SEQ ID NO: 98404 - protein, 35 aa, Artificial Sequence
  Description of Artificial Sequence: Synthetic polypeptide
DEEEIRTTNPVATEQYGSVQSPWNLIQQNDVNTDI

SEQ ID NO: 98405 - protein, 28 aa, Artificial Sequence
  Description of Artificial Sequence: Synthetic peptide
QEDEIATTNPVATESYGHVSEELQHEEL

SEQ ID NO: 98406 - protein, 34 aa, Artificial Sequence
  Description of Artificial Sequence: Synthetic polypeptide
MEEEIRTTNPVATEQYGSVDSGSNFGQGEAGNGD

SEQ ID NO: 98407 - protein, 32 aa, Artificial Sequence
  Description of Artificial Sequence: Synthetic polypeptide
EEEEIATTNPVAYEQWGNVSGTMLQGDGDNDR

SEQ ID NO: 98408 - protein, 36 aa, Artificial Sequence
  Description of Artificial Sequence: Synthetic polypeptide
DEEEIRTTNPVATEQYGSVISTTPAGPNQRNGMNPV

SEQ ID NO: 98409 - protein, 32 aa, Artificial Sequence
  Description of Artificial Sequence: Synthetic polypeptide
EEEEIATTNPVAYEQWGNVSGTMLQNGDGNHR

SEQ ID NO: 98410 - protein, 34 aa, Artificial Sequence
  Description of Artificial Sequence: Synthetic polypeptide
DEEEIRTTNPVAYEQYGQVVCSTNDLNQYGSEQA

SEQ ID NO: 98411 - protein, 32 aa, Artificial Sequence
  Description of Artificial Sequence: Synthetic polypeptide
DEEEIACTNPVATEQYGCVATNLQLAEPMGSD

SEQ ID NO: 98412 - protein, 34 aa, Artificial Sequence
  Description of Artificial Sequence: Synthetic polypeptide
EEEEICTTNPVATEQYGSVISTTNGAQFEEANRS

SEQ ID NO: 98413 - protein, 31 aa, Artificial Sequence
  Description of Artificial Sequence: Synthetic polypeptide
EEEEIRTTNPIATEPYGSVMSVISLSERGVT

SEQ ID NO: 98414 - protein, 33 aa, Artificial Sequence
  Description of Artificial Sequence: Synthetic polypeptide
DEEEIRTTNPVATEQYGSVQSSTDVLHGMEIDS

SEQ ID NO: 98415 - protein, 31 aa, Artificial Sequence
  Description of Artificial Sequence: Synthetic polypeptide
MEEEIRTTNPVATEQYGSVDFPAIMQAEGDL

SEQ ID NO: 98416 - protein, 33 aa, Artificial Sequence
  Description of Artificial Sequence: Synthetic polypeptide
DEECIRTTNPVATEQYGSSCVCITPLQIESNVN

SEQ ID NO: 98417 - protein, 34 aa, Artificial Sequence
  Description of Artificial Sequence: Synthetic polypeptide
DEEEIRTTNPVATEQYGSVQSPVSDDQREENNED

SEQ ID NO: 98418 - protein, 31 aa, Artificial Sequence
  Description of Artificial Sequence: Synthetic polypeptide
QAEEIATTNPVATEQWGCVAATNLQDQGPNN

SEQ ID NO: 98419 - protein, 30 aa, Artificial Sequence
  Description of Artificial Sequence: Synthetic polypeptide
EEEEIASVNPVCTEQYGVVSCNLQSGGNAQ

SEQ ID NO: 98420 - protein, 34 aa, Artificial Sequence
  Description of Artificial Sequence: Synthetic polypeptide
DEEEIRTTNPVATEQYGSVSENSLQMLAVSLDGQ

SEQ ID NO: 98421 - protein, 32 aa, Artificial Sequence
  Description of Artificial Sequence: Synthetic polypeptide
ESEEICTTNPVAYEQYGSVSCTNPQGPGGNND

SEQ ID NO: 98422 - protein, 33 aa, Artificial Sequence
  Description of Artificial Sequence: Synthetic polypeptide
DEEEIATTNPVATEQWGSVSVSGNLNTAGVNES

SEQ ID NO: 98423 - protein, 33 aa, Artificial Sequence
  Description of Artificial Sequence: Synthetic polypeptide
DEEEIACTNPVATEQYGCVATNLQPDNQGNENN

SEQ ID NO: 98424 - protein, 29 aa, Artificial Sequence
  Description of Artificial Sequence: Synthetic peptide
EEEEIASVNPVCTEQYGVVSDNLQSGSEQ

SEQ ID NO: 98425 - protein, 31 aa, Artificial Sequence
  Description of Artificial Sequence: Synthetic polypeptide
NEAEIRTTNPVAYEQWGSVTTNQQGNGDMGR

SEQ ID NO: 98426 - protein, 31 aa, Artificial Sequence
  Description of Artificial Sequence: Synthetic polypeptide
QAEEIATTNPVATAQWGSVSGTNNPDRDGNA

SEQ ID NO: 98427 - protein, 30 aa, Artificial Sequence
  Description of Artificial Sequence: Synthetic polypeptide
DEEEIASVNPVCTEQYGSVSATDLEDHGEQ

SEQ ID NO: 98428 - protein, 29 aa, Artificial Sequence
  Description of Artificial Sequence: Synthetic peptide
DEEEIASVNPVCTEQYGVVSDDLQDSGEQ

SEQ ID NO: 98429 - protein, 30 aa, Artificial Sequence
  Description of Artificial Sequence: Synthetic polypeptide
DEEEIASVNPVCTEQYGSVSATDLEDSGEQ

SEQ ID NO: 98430 - protein, 31 aa, Artificial Sequence
  Description of Artificial Sequence: Synthetic polypeptide
DEEEIASVNPVCTEQYGSVSDINEPQSEGNQ

SEQ ID NO: 98431 - protein, 31 aa, Artificial Sequence
  Description of Artificial Sequence: Synthetic polypeptide
NEAEIRTTNPVAYEQWGSVTTNQDQGNDGAR

SEQ ID NO: 98432 - protein, 32 aa, Artificial Sequence
  Description of Artificial Sequence: Synthetic polypeptide
NEAEIRTTNPVAYEQWGSVTTNPQQGNMGAPR

SEQ ID NO: 98433 - protein, 32 aa, Artificial Sequence
  Description of Artificial Sequence: Synthetic polypeptide
EEEEIATTNPVAYEAYGSVVSLTGNLSQAVNS

SEQ ID NO: 98434 - protein, 30 aa, Artificial Sequence
  Description of Artificial Sequence: Synthetic polypeptide
QAEEIATTNPVATAQWGSVSTGNPDANGNN

SEQ ID NO: 98435 - protein, 31 aa, Artificial Sequence
  Description of Artificial Sequence: Synthetic polypeptide
NEAEIRTTNPVAYEQWGSVTTNIQGNDGDAR

SEQ ID NO: 98436 - protein, 34 aa, Artificial Sequence
  Description of Artificial Sequence: Synthetic polypeptide
DEEEIRTTNPVATEQYGSVISTPVGLGQGEDPSS

SEQ ID NO: 98437 - protein, 31 aa, Artificial Sequence
  Description of Artificial Sequence: Synthetic polypeptide
DEEEIATTNPVATEQWGSVSQGPLTHPMGMQ

SEQ ID NO: 98438 - protein, 36 aa, Artificial Sequence
  Description of Artificial Sequence: Synthetic polypeptide
DEEEIRTTNPVATEQYGSVQSPTSWSEQERSQNGRE

SEQ ID NO: 98439 - protein, 35 aa, Artificial Sequence
  Description of Artificial Sequence: Synthetic polypeptide
DEEEIRTTNPVATEQYGSVQSPTNPLFPTDENETL

SEQ ID NO: 98440 - protein, 32 aa, Artificial Sequence
  Description of Artificial Sequence: Synthetic polypeptide
EEEAEIRTTNPVAYEQWGSVSTTNQMEGGNNQ

SEQ ID NO: 98441 - protein, 28 aa, Artificial Sequence
  Description of Artificial Sequence: Synthetic peptide
QEDEIATTNPVATEKYGDVSECLQHEEL

SEQ ID NO: 98442 - protein, 28 aa, Artificial Sequence
  Description of Artificial Sequence: Synthetic peptide
QEDEIATTNPVATECYGDVSECLQHEEL

SEQ ID NO: 98443 - protein, 32 aa, Artificial Sequence
  Description of Artificial Sequence: Synthetic polypeptide
DEEEIACTNPVATEQYGCVATNLQEAPGTPEN

SEQ ID NO: 98444 - protein, 34 aa, Artificial Sequence
  Description of Artificial Sequence: Synthetic polypeptide
EEEEIRTTNPVATEPYGSVCFTNALSTRTGGNME

SEQ ID NO: 98445 - protein, 32 aa, Artificial Sequence
  Description of Artificial Sequence: Synthetic polypeptide
DEEEIACTNPVATEQYGCVATNLQEAGGTTEQ

SEQ ID NO: 98446 - protein, 32 aa, Artificial Sequence
  Description of Artificial Sequence: Synthetic polypeptide
ENEEISTTNPVATTQWGSVSHTNPDMREGENR

SEQ ID NO: 98447 - protein, 34 aa, Artificial Sequence
  Description of Artificial Sequence: Synthetic polypeptide
DEECIRTTNPVATEQYGSVVSTNAHSDNTVQNNR

SEQ ID NO: 98448 - protein, 28 aa, Artificial Sequence
  Description of Artificial Sequence: Synthetic peptide
DEEEIASVNPVSTEQYGVVADTIQSGNQ

SEQ ID NO: 98449 - protein, 32 aa, Artificial Sequence
  Description of Artificial Sequence: Synthetic polypeptide
DEEEIACTNPVATEQYGCVATNLQEAGETPEY

SEQ ID NO: 98450 - protein, 31 aa, Artificial Sequence
  Description of Artificial Sequence: Synthetic polypeptide
ENEEISTTNPVATTQWGSVPTNPMRDGDNDR

SEQ ID NO: 98451 - protein, 32 aa, Artificial Sequence
  Description of Artificial Sequence: Synthetic polypeptide
DEEEIACTNPVATEQYGCVATNLQEADDSERF

SEQ ID NO: 98452 - protein, 28 aa, Artificial Sequence
  Description of Artificial Sequence: Synthetic peptide
DEEEIASVNPVSTEQYGNVADTIQSGNQ

SEQ ID NO: 98453 - protein, 32 aa, Artificial Sequence
  Description of Artificial Sequence: Synthetic polypeptide
DEEEIACTNPVATEQYGCVATNLQEADDGPEF

SEQ ID NO: 98454 - protein, 33 aa, Artificial Sequence
  Description of Artificial Sequence: Synthetic polypeptide
DEEEIATTNPVATEQWGSVSGTGNPQDDLGDQD

SEQ ID NO: 98455 - protein, 31 aa, Artificial Sequence
  Description of Artificial Sequence: Synthetic polypeptide
DEEEIATTNPCASEQYGIVSTTAGPNRGNPV

SEQ ID NO: 98456 - protein, 34 aa, Artificial Sequence
  Description of Artificial Sequence: Synthetic polypeptide
MEEEIRTTNPVATEQYGSVISTVSQLERGETEDH

SEQ ID NO: 98457 - protein, 32 aa, Artificial Sequence
  Description of Artificial Sequence: Synthetic polypeptide
DEEEIATTNPCASEQYGSVSSTTAGNMRGMNV

SEQ ID NO: 98458 - protein, 32 aa, Artificial Sequence
  Description of Artificial Sequence: Synthetic polypeptide
DEEEIACTNPVATEQYGCVATNLQEAAGTDEQ

SEQ ID NO: 98459 - protein, 33 aa, Artificial Sequence
  Description of Artificial Sequence: Synthetic polypeptide
DEEEIATTNPCATECYGSVCSKTENQDDRGNAN

SEQ ID NO: 98460 - protein, 32 aa, Artificial Sequence
  Description of Artificial Sequence: Synthetic polypeptide
DEEEIACTNPVATEQYGCVATNLQDSGDGTDD

SEQ ID NO: 98461 - protein, 33 aa, Artificial Sequence
  Description of Artificial Sequence: Synthetic polypeptide
DEEEIACTNPVATEQYGCVATNLQDQGNDNNQD

SEQ ID NO: 98462 - protein, 32 aa, Artificial Sequence
  Description of Artificial Sequence: Synthetic polypeptide
DEEEIATTNPCATECYGSVCYKTNDARQGGNW

SEQ ID NO: 98463 - protein, 34 aa, Artificial Sequence
  Description of Artificial Sequence: Synthetic polypeptide
MEEEIRTTNPVATEQYGSVGSNNDEMQGQGENNA

SEQ ID NO: 98464 - protein, 32 aa, Artificial Sequence
  Description of Artificial Sequence: Synthetic polypeptide
DEEEIACTNPVATEQYGCVATNLQGAGAEDHH

SEQ ID NO: 98465 - protein, 34 aa, Artificial Sequence
  Description of Artificial Sequence: Synthetic polypeptide
DEEEIRTTNPVATEQYGSVNSTDTGMGQGNNEDG

SEQ ID NO: 98466 - protein, 32 aa, Artificial Sequence
  Description of Artificial Sequence: Synthetic polypeptide
DEEEIACTNPVATEQYGCVATNLQEMNPNEHQ

SEQ ID NO: 98467 - protein, 33 aa, Artificial Sequence
  Description of Artificial Sequence: Synthetic polypeptide
DEECIRTTNPVATEQYGSVFVWINEQDRKMNDS

SEQ ID NO: 98468 - protein, 33 aa, Artificial Sequence
  Description of Artificial Sequence: Synthetic polypeptide
EEEEIRTTNPVATEAYGVVSTTNLNQNQNDQDE

SEQ ID NO: 98469 - protein, 34 aa, Artificial Sequence
  Description of Artificial Sequence: Synthetic polypeptide
EEEEIRTTNPVATEAYGVVSTTNLNTQNGNDEDE

SEQ ID NO: 98470 - protein, 35 aa, Artificial Sequence
  Description of Artificial Sequence: Synthetic polypeptide
DEECIRTTNPVATEQYGSVQSTGNELSQMPGGMSS

SEQ ID NO: 98471 - protein, 34 aa, Artificial Sequence
  Description of Artificial Sequence: Synthetic polypeptide
EEEEIRTTNPVATEAYGVVSTTNLTNQNGNQQDE

SEQ ID NO: 98472 - protein, 32 aa, Artificial Sequence
  Description of Artificial Sequence: Synthetic polypeptide
DEEEIRTTNPVATEQYGSVSEPGVHAQDVESE

SEQ ID NO: 98473 - protein, 32 aa, Artificial Sequence
  Description of Artificial Sequence: Synthetic polypeptide
NEAEIRTTNPVAYEQWGSTVTTNQQGNMGANR

SEQ ID NO: 98474 - protein, 31 aa, Artificial Sequence
  Description of Artificial Sequence: Synthetic polypeptide
QAEEIATTNPVATEQWGSVSPNPQEAGNDLT

SEQ ID NO: 98475 - protein, 34 aa, Artificial Sequence
  Description of Artificial Sequence: Synthetic polypeptide
DEEEIRTTNPVATEQYGSVISVSQVLAQINPLNN

SEQ ID NO: 98476 - protein, 32 aa, Artificial Sequence
  Description of Artificial Sequence: Synthetic polypeptide
DEEEIACTNPVATEQYGCVATNLQEDAGEGQE

SEQ ID NO: 98477 - protein, 32 aa, Artificial Sequence
  Description of Artificial Sequence: Synthetic polypeptide
DEEEIACTNPVATEQYGCVATNLQESNENAHY

SEQ ID NO: 98478 - protein, 30 aa, Artificial Sequence
  Description of Artificial Sequence: Synthetic polypeptide
NEAEIRTTNPVAYEQWGSATTNQQGNGQDR

SEQ ID NO: 98479 - protein, 34 aa, Artificial Sequence
  Description of Artificial Sequence: Synthetic polypeptide
DEEEIRTTNPVATEQYGSVISVTLNLISEEEQDN

SEQ ID NO: 98480 - protein, 36 aa, Artificial Sequence
  Description of Artificial Sequence: Synthetic polypeptide
DEEEIRTTNPVATEQYGSVISWCQNLYQVEQSNARP

SEQ ID NO: 98481 - protein, 32 aa, Artificial Sequence
  Description of Artificial Sequence: Synthetic polypeptide
ENEEISTTNPVATTQWGSVSKTDNPDERGNSR

SEQ ID NO: 98482 - protein, 34 aa, Artificial Sequence
  Description of Artificial Sequence: Synthetic polypeptide
DEEEIRTTNPVATEQYGSVMEPQGNLQQDVNMIG

SEQ ID NO: 98483 - protein, 32 aa, Artificial Sequence
  Description of Artificial Sequence: Synthetic polypeptide
DEEEIRTTNPVATEQYGSVISWDLEHNFMSVE

SEQ ID NO: 98484 - protein, 34 aa, Artificial Sequence
  Description of Artificial Sequence: Synthetic polypeptide
DEEEIRTTNPVATEQYGSVISYTPVDTQQRPELL

SEQ ID NO: 98485 - protein, 31 aa, Artificial Sequence
  Description of Artificial Sequence: Synthetic polypeptide
DEEEIASVNPVCTEQYGVVSSTDALQMSGNQ

SEQ ID NO: 98486 - protein, 33 aa, Artificial Sequence
  Description of Artificial Sequence: Synthetic polypeptide
QAEEIATTNPVATEQWGSVTSTNHLQTRGGQDH

SEQ ID NO: 98487 - protein, 32 aa, Artificial Sequence
  Description of Artificial Sequence: Synthetic polypeptide
DEEEIACTNPVATEQYGCVATNLQENQDGDEM

SEQ ID NO: 98488 - protein, 33 aa, Artificial Sequence
  Description of Artificial Sequence: Synthetic polypeptide
DEECIRTTNPVATEQYSACVCSTELQEYFGSNQ

SEQ ID NO: 98489 - protein, 34 aa, Artificial Sequence
  Description of Artificial Sequence: Synthetic polypeptide
ESEEIRTTNPVATEQYGSVVSCTNSPQGPGGNNK

SEQ ID NO: 98490 - protein, 35 aa, Artificial Sequence
  Description of Artificial Sequence: Synthetic polypeptide
DEEEIRTTNPVATEQYGSVQSPTNEIQPNQLVERY

SEQ ID NO: 98491 - protein, 32 aa, Artificial Sequence
  Description of Artificial Sequence: Synthetic polypeptide
DEEEIRTTNPVATEQYGSVSHPAPQNTESQQY

SEQ ID NO: 98492 - protein, 31 aa, Artificial Sequence
  Description of Artificial Sequence: Synthetic polypeptide
EDEEICTTNPVATEQWGTVSTTNQQEQGTNE

SEQ ID NO: 98493 - protein, 32 aa, Artificial Sequence
  Description of Artificial Sequence: Synthetic polypeptide
NTDEHEIATTNPVAYEQWGTVSTNLQDGNNNI

SEQ ID NO: 98494 - protein, 34 aa, Artificial Sequence
  Description of Artificial Sequence: Synthetic polypeptide
DEEEIRTTNPVATEQYGSVQSPFLEQQAMVNTDQ

SEQ ID NO: 98495 - protein, 35 aa, Artificial Sequence
  Description of Artificial Sequence: Synthetic polypeptide
DEEEIRTTNPVATEQYGSVSHNMMQITREDVNESD

SEQ ID NO: 98496 - protein, 34 aa, Artificial Sequence
  Description of Artificial Sequence: Synthetic polypeptide
FEDEIRTTNPVATEQYGSVSTENGQEQNIGGGNG

SEQ ID NO: 98497 - protein, 33 aa, Artificial Sequence
  Description of Artificial Sequence: Synthetic polypeptide
DEEEIRTTNPVATEQYGSVSENNNHEPGVEEPA

SEQ ID NO: 98498 - protein, 33 aa, Artificial Sequence
  Description of Artificial Sequence: Synthetic polypeptide
MEEEIRTTNPVATEQYGCVCSTEHQFFGSENQA

SEQ ID NO: 98499 - protein, 32 aa, Artificial Sequence
  Description of Artificial Sequence: Synthetic polypeptide
DEECISTTNPVATEGYGCVCNTAPLQRFGSNQ

SEQ ID NO: 98500 - protein, 31 aa, Artificial Sequence
  Description of Artificial Sequence: Synthetic polypeptide
EDEEICTTNPVATEQWGTVSTTNLQNEQGEE

SEQ ID NO: 98501 - protein, 32 aa, Artificial Sequence
  Description of Artificial Sequence: Synthetic polypeptide
FEDEIRTTNPVATEQYGSVSSDNFGQGEGQGD

SEQ ID NO: 98502 - protein, 33 aa, Artificial Sequence
  Description of Artificial Sequence: Synthetic polypeptide
MEEEIRTTNPVATEQYGCVCSTEHQNSGSNNQS

SEQ ID NO: 98503 - protein, 30 aa, Artificial Sequence
  Description of Artificial Sequence: Synthetic polypeptide
DEEEIATTNPVATEQWGTNCSAGALLNGNS

SEQ ID NO: 98504 - protein, 33 aa, Artificial Sequence
  Description of Artificial Sequence: Synthetic polypeptide
DEEEIRTTNPVATEQYGSVSENPMADFESDQRY

SEQ ID NO: 98505 - protein, 28 aa, Artificial Sequence
  Description of Artificial Sequence: Synthetic peptide
QEEEIACTNPCSSEQYGIVSCNLMSGTR

SEQ ID NO: 98506 - protein, 32 aa, Artificial Sequence
  Description of Artificial Sequence: Synthetic polypeptide
EDEEICTTNPVATEQWGTVSTTTNLQEGNTDE

SEQ ID NO: 98507 - protein, 33 aa, Artificial Sequence
  Description of Artificial Sequence: Synthetic polypeptide
EDEEICTTNPVATEQYGVVSTTNLQQNDGDNGS

SEQ ID NO: 98508 - protein, 33 aa, Artificial Sequence
  Description of Artificial Sequence: Synthetic polypeptide
EDEEICTTNPVATEQYGVVSTTNLQQQLGQNDD

SEQ ID NO: 98509 - protein, 32 aa, Artificial Sequence
  Description of Artificial Sequence: Synthetic polypeptide
DEEEIRTTNPVATEQYGSVSHIIDNGGMEEEQ

SEQ ID NO: 98510 - protein, 33 aa, Artificial Sequence
  Description of Artificial Sequence: Synthetic polypeptide
QEEEIATTNPVATEQYGDVSTTCLPQMRNGMEV

SEQ ID NO: 98511 - protein, 32 aa, Artificial Sequence
  Description of Artificial Sequence: Synthetic polypeptide
DEECIRTTNPVATEQYGCVCSWENDQFFGSEQ

SEQ ID NO: 98512 - protein, 31 aa, Artificial Sequence
  Description of Artificial Sequence: Synthetic polypeptide
NEAEIRTTNPVSTEQYGSVYIIDNLQDGGQT

SEQ ID NO: 98513 - protein, 33 aa, Artificial Sequence
  Description of Artificial Sequence: Synthetic polypeptide
MEEEIRTTNPVATEQYGCVCSTEHQENFGSDNQ

SEQ ID NO: 98514 - protein, 31 aa, Artificial Sequence
  Description of Artificial Sequence: Synthetic polypeptide
EDEEICTTNPVATEQWGTVSTTNGQEQGNQE

SEQ ID NO: 98515 - protein, 32 aa, Artificial Sequence
  Description of Artificial Sequence: Synthetic polypeptide
DEECIRTTNPVATEQYGCVCSTYHQGFNSEDS

SEQ ID NO: 98516 - protein, 28 aa, Artificial Sequence
  Description of Artificial Sequence: Synthetic peptide
FEEEIASVNPVCTEQYGVVSWEHQSGNQ

SEQ ID NO: 98517 - protein, 34 aa, Artificial Sequence
  Description of Artificial Sequence: Synthetic polypeptide
DEEEIRTTNPVATEQYGSVSIANLQNTQVDPLIY

SEQ ID NO: 98518 - protein, 35 aa, Artificial Sequence
  Description of Artificial Sequence: Synthetic polypeptide
DEEEIRTTNPVATEQYGSVNSTNDVEQNSGQEEKT

SEQ ID NO: 98519 - protein, 30 aa, Artificial Sequence
  Description of Artificial Sequence: Synthetic polypeptide
DEEEIASTNPVCTEQYGVVSADNLEHGEDL

SEQ ID NO: 98520 - protein, 33 aa, Artificial Sequence
  Description of Artificial Sequence: Synthetic polypeptide
DEEEIRTTNPVATEQYGSVSIAEDDMQNETQND

SEQ ID NO: 98521 - protein, 31 aa, Artificial Sequence
  Description of Artificial Sequence: Synthetic polypeptide
DEEEIASTNPVCTEQYGVVSADNPVQFEGNQ

SEQ ID NO: 98522 - protein, 33 aa, Artificial Sequence
  Description of Artificial Sequence: Synthetic polypeptide
DEEEIRTTNPVATEQYGSVSHVPNNHNQTVVEN

SEQ ID NO: 98523 - protein, 32 aa, Artificial Sequence
  Description of Artificial Sequence: Synthetic polypeptide
EACEIATTNPVATEQYGEVSTNLQGMQGGNGP

SEQ ID NO: 98524 - protein, 32 aa, Artificial Sequence
  Description of Artificial Sequence: Synthetic polypeptide
DEEEIACTNPVATEQYGCVATNLQQDDQNDEQ

SEQ ID NO: 98525 - protein, 31 aa, Artificial Sequence
  Description of Artificial Sequence: Synthetic polypeptide
DEEEIASTNPVCTEQYGVVSADNPVQSEGNQ

SEQ ID NO: 98526 - protein, 34 aa, Artificial Sequence
  Description of Artificial Sequence: Synthetic polypeptide
DEEEIRTTNPVATEQYGSVQSNDNLDEQQNVVED

SEQ ID NO: 98527 - protein, 31 aa, Artificial Sequence
  Description of Artificial Sequence: Synthetic polypeptide
DEECNATTNPIAYEQWGEVSTNLQHQGQNDR

SEQ ID NO: 98528 - protein, 35 aa, Artificial Sequence
  Description of Artificial Sequence: Synthetic polypeptide
DEEEIRTTNPVATEQYGSVNNLTNHDEMGNTEIRI

SEQ ID NO: 98529 - protein, 33 aa, Artificial Sequence
  Description of Artificial Sequence: Synthetic polypeptide
DEEEIATTNPVATEQWGTVSAENPLQEHDNTRN

SEQ ID NO: 98530 - protein, 34 aa, Artificial Sequence
  Description of Artificial Sequence: Synthetic polypeptide
AEEEIRTTNPVATEQYGSVVVSVTDQNQIGTNNS

SEQ ID NO: 98531 - protein, 31 aa, Artificial Sequence
  Description of Artificial Sequence: Synthetic polypeptide
EDEEICTTNPVATEQWGTVSTNLQEQGTTTE

SEQ ID NO: 98532 - protein, 34 aa, Artificial Sequence
  Description of Artificial Sequence: Synthetic polypeptide
AEEEIRTTNPVATESYGSVSTTNNQQEDEGTNVE

SEQ ID NO: 98533 - protein, 30 aa, Artificial Sequence
  Description of Artificial Sequence: Synthetic polypeptide
DEEEIASTNPVCTEQYGVVSATDLEHGEDL

SEQ ID NO: 98534 - protein, 28 aa, Artificial Sequence
  Description of Artificial Sequence: Synthetic peptide
FEEEIASVNPVCTEQYGVVSDVLQSMNT

SEQ ID NO: 98535 - protein, 32 aa, Artificial Sequence
  Description of Artificial Sequence: Synthetic polypeptide
ECSEIRTTNPVAYEQYGSVSCTNPSQGNGGNS

SEQ ID NO: 98536 - protein, 34 aa, Artificial Sequence
  Description of Artificial Sequence: Synthetic polypeptide
DEEEIATTNPVATEQWGSVSVSGNPDQTRGVNED

SEQ ID NO: 98537 - protein, 29 aa, Artificial Sequence
  Description of Artificial Sequence: Synthetic peptide
DEEEIATTNPVATEQWGTNCSAALMRSDS

SEQ ID NO: 98538 - protein, 33 aa, Artificial Sequence
  Description of Artificial Sequence: Synthetic polypeptide
EDEEICTTNPVATEQYGVVSTTNNLQDNGDNSD

SEQ ID NO: 98539 - protein, 31 aa, Artificial Sequence
  Description of Artificial Sequence: Synthetic polypeptide
DEEEIASVNPVATEQYGSVSADDLQDSEGEL

SEQ ID NO: 98540 - protein, 33 aa, Artificial Sequence
  Description of Artificial Sequence: Synthetic polypeptide
DEECIRTTNPVATEQYGCVYVWENGIQKTGQNR

SEQ ID NO: 98541 - protein, 32 aa, Artificial Sequence
  Description of Artificial Sequence: Synthetic polypeptide
DEEEIASVNPVATEQYGTVCSATDGLQFEGND

SEQ ID NO: 98542 - protein, 32 aa, Artificial Sequence
  Description of Artificial Sequence: Synthetic polypeptide
DEEEIACTNPVATEQYGCVATNLQPDPQEGAA

SEQ ID NO: 98543 - protein, 36 aa, Artificial Sequence
  Description of Artificial Sequence: Synthetic polypeptide
DEEEIRTTNPVATEQYGSVSGTTPAGNNMRNGMNPV

SEQ ID NO: 98544 - protein, 33 aa, Artificial Sequence
  Description of Artificial Sequence: Synthetic polypeptide
EEAEICTTNPVATECYGSVSTNLNQGDTGGNEQ

SEQ ID NO: 98545 - protein, 36 aa, Artificial Sequence
  Description of Artificial Sequence: Synthetic polypeptide
DEEEIRTTNPVATEQYGSVSGTTNGGPNMRNGMNAD

SEQ ID NO: 98546 - protein, 32 aa, Artificial Sequence
  Description of Artificial Sequence: Synthetic polypeptide
DEECIRTTNPVATEQYGPCSIEEDGLMPRGNG

SEQ ID NO: 98547 - protein, 31 aa, Artificial Sequence
  Description of Artificial Sequence: Synthetic polypeptide
DEEEIATTNPVATEQWGTASTGNPLDNENNN

SEQ ID NO: 98548 - protein, 33 aa, Artificial Sequence
  Description of Artificial Sequence: Synthetic polypeptide
EDEEICTTNPVATTQYGSVSTTNLQQLGNEQGE

SEQ ID NO: 98549 - protein, 31 aa, Artificial Sequence
  Description of Artificial Sequence: Synthetic polypeptide
EEAEIRTTNPVAYEQWGSVRYWNLDEDTGNR

SEQ ID NO: 98550 - protein, 35 aa, Artificial Sequence
  Description of Artificial Sequence: Synthetic polypeptide
DEEEIRTTNPVATEQYGSVNSTNDDERGSGQEEIS

SEQ ID NO: 98551 - protein, 32 aa, Artificial Sequence
  Description of Artificial Sequence: Synthetic polypeptide
EEAEIRTTNPVAYEQWGSVSTNLNGEHGNQSS

SEQ ID NO: 98552 - protein, 29 aa, Artificial Sequence
  Description of Artificial Sequence: Synthetic peptide
DEEEIASVNPVCTEQWGVVSDNLQNSGDQ

SEQ ID NO: 98553 - protein, 34 aa, Artificial Sequence
  Description of Artificial Sequence: Synthetic polypeptide
DEEEIRTTNPVATEQYGSVNSTNDDENSYQEEIM

SEQ ID NO: 98554 - protein, 34 aa, Artificial Sequence
  Description of Artificial Sequence: Synthetic polypeptide
DEEEIRTTNPVATEQYGSVNSTNDDENSGQEADI

SEQ ID NO: 98555 - protein, 32 aa, Artificial Sequence
  Description of Artificial Sequence: Synthetic polypeptide
DEECISTTNPVATEGYGCVCGTNALQYGSNQA

SEQ ID NO: 98556 - protein, 32 aa, Artificial Sequence
  Description of Artificial Sequence: Synthetic polypeptide
EEAEIRTTNPVAYEQWGSVSTTNAGNHGEANR

SEQ ID NO: 98557 - protein, 36 aa, Artificial Sequence
  Description of Artificial Sequence: Synthetic polypeptide
DEEEIRTTNPVATEQYGSVQSPTMNLQQQPEGPEDF

SEQ ID NO: 98558 - protein, 35 aa, Artificial Sequence
  Description of Artificial Sequence: Synthetic polypeptide
DEEEIRTTNPVATEQYGSVNSTNDDDQGGGEEETN

SEQ ID NO: 98559 - protein, 35 aa, Artificial Sequence
  Description of Artificial Sequence: Synthetic polypeptide
DEEEIRTTNPVATEQYGSVQSPTGLLQQRIVDEEL

SEQ ID NO: 98560 - protein, 35 aa, Artificial Sequence
  Description of Artificial Sequence: Synthetic polypeptide
DEEEIRTTNPVATEQYGSVNNLTNQDEIGNMEERP

SEQ ID NO: 98561 - protein, 34 aa, Artificial Sequence
  Description of Artificial Sequence: Synthetic polypeptide
DEEEIRTTNPVATEQYGSVNNLTTHDEEGNQEIR

SEQ ID NO: 98562 - protein, 35 aa, Artificial Sequence
  Description of Artificial Sequence: Synthetic polypeptide
AEEEIRTTNPVATEQYGSVVVSVTNTNQEQGENGD

SEQ ID NO: 98563 - protein, 33 aa, Artificial Sequence
  Description of Artificial Sequence: Synthetic polypeptide
DEEEIRTTNPVATEQYGSVQSPIMSVEEIGVNS

SEQ ID NO: 98564 - protein, 31 aa, Artificial Sequence
  Description of Artificial Sequence: Synthetic polypeptide
NTEHEIATTNPVAYEQWGSVSTNLNGDGNET

SEQ ID NO: 98565 - protein, 31 aa, Artificial Sequence
  Description of Artificial Sequence: Synthetic polypeptide
NEAEIRTTNPVAYERWGEVSTNLQHDQGNEQ

SEQ ID NO: 98566 - protein, 31 aa, Artificial Sequence
  Description of Artificial Sequence: Synthetic polypeptide
NTEHEIATTNPVAYEQWGSVSTNLNGGGDNT

SEQ ID NO: 98567 - protein, 33 aa, Artificial Sequence
  Description of Artificial Sequence: Synthetic polypeptide
DEEEIRTTNPVATEQYGSVSGVTLDPENGGEIF

SEQ ID NO: 98568 - protein, 33 aa, Artificial Sequence
  Description of Artificial Sequence: Synthetic polypeptide
DEEEIRTTNPVATEQYGSVSGVTLDPEDEGEFT

SEQ ID NO: 98569 - protein, 34 aa, Artificial Sequence
  Description of Artificial Sequence: Synthetic polypeptide
AEEEIRTTNPVATEQYGSVVVSVTNANQEQSEND

SEQ ID NO: 98570 - protein, 32 aa, Artificial Sequence
  Description of Artificial Sequence: Synthetic polypeptide
EDEEICTTNPVATEQYGVVSTTNQLQDTNPNS

SEQ ID NO: 98571 - protein, 34 aa, Artificial Sequence
  Description of Artificial Sequence: Synthetic polypeptide
DEEEIRTTNPVATEQYGSVSGVNTVVGMGGNAGE

SEQ ID NO: 98572 - protein, 33 aa, Artificial Sequence
  Description of Artificial Sequence: Synthetic polypeptide
EDEEICTTNPVATEQYGVVSTTTNNLQDNGDNS

SEQ ID NO: 98573 - protein, 29 aa, Artificial Sequence
  Description of Artificial Sequence: Synthetic peptide
DEEEIATTNPVATEQWGTNCSAALLNDNN

SEQ ID NO: 98574 - protein, 34 aa, Artificial Sequence
  Description of Artificial Sequence: Synthetic polypeptide
DEEEIRTTNPVATEQYGSVQSPMNQQRPIVPIIQ

SEQ ID NO: 98575 - protein, 34 aa, Artificial Sequence
  Description of Artificial Sequence: Synthetic polypeptide
DEEEIRTTNPVATEQYGSVSGVNTTVGMGGNAGE

SEQ ID NO: 98576 - protein, 30 aa, Artificial Sequence
  Description of Artificial Sequence: Synthetic polypeptide
PCEEIRSTNPVATEQYGAVSTNQIAHNGQV

SEQ ID NO: 98577 - protein, 28 aa, Artificial Sequence
  Description of Artificial Sequence: Synthetic peptide
QEEEIATTNPVATEQYGEAAAVCQHGEK

SEQ ID NO: 98578 - protein, 34 aa, Artificial Sequence
  Description of Artificial Sequence: Synthetic polypeptide
DEEEIRTTNPVATEQYGSVSGVNTDVGMGQNDEF

SEQ ID NO: 98579 - protein, 36 aa, Artificial Sequence
  Description of Artificial Sequence: Synthetic polypeptide
DEEEIRTTNPVATEQYGSVQSPMTNDEQDTGPELRI

SEQ ID NO: 98580 - protein, 34 aa, Artificial Sequence
  Description of Artificial Sequence: Synthetic polypeptide
AEEEIRTTNPVATEQYGSVVVSVTTDNQIGTNGT

SEQ ID NO: 98581 - protein, 34 aa, Artificial Sequence
  Description of Artificial Sequence: Synthetic polypeptide
AEEEIRTTNPVATEQYGVVSTVTNSNQQGNGTNS

SEQ ID NO: 98582 - protein, 34 aa, Artificial Sequence
  Description of Artificial Sequence: Synthetic polypeptide
DEEEIRTTNPVATEQYGSVSGVNMTGMGGGNNGE

SEQ ID NO: 98583 - protein, 28 aa, Artificial Sequence
  Description of Artificial Sequence: Synthetic peptide
QEEEIATTNPVATEQYGEAPSTCQHEEK

SEQ ID NO: 98584 - protein, 32 aa, Artificial Sequence
  Description of Artificial Sequence: Synthetic polypeptide
DEECIRTTNPVATEQYSACVCSTELQIGSDQM

SEQ ID NO: 98585 - protein, 28 aa, Artificial Sequence
  Description of Artificial Sequence: Synthetic peptide
QEDEIAPTNPCSSEQYGIVSCNLQSGTR

SEQ ID NO: 98586 - protein, 33 aa, Artificial Sequence
  Description of Artificial Sequence: Synthetic polypeptide
DEEEIRTTNPVATEQYGSVITFTQAITVAENDD

SEQ ID NO: 98587 - protein, 28 aa, Artificial Sequence
  Description of Artificial Sequence: Synthetic peptide
QEEEIATTNPVATEQYGEAPEVCQSENK

SEQ ID NO: 98588 - protein, 30 aa, Artificial Sequence
  Description of Artificial Sequence: Synthetic polypeptide
AEESIATTNPVAYEPYGSVASNNDQNGNES

SEQ ID NO: 98589 - protein, 32 aa, Artificial Sequence
  Description of Artificial Sequence: Synthetic polypeptide
DEEEIATTNPVATEQWGSVSATGAGGQPGAFG

SEQ ID NO: 98590 - protein, 35 aa, Artificial Sequence
  Description of Artificial Sequence: Synthetic polypeptide
DEEEIRTTNPVATEQYGSVSGTMESGQSGGNTGDD

SEQ ID NO: 98591 - protein, 28 aa, Artificial Sequence
  Description of Artificial Sequence: Synthetic peptide
QEEEIATTNPVATEQYGEAPEVCQREEK

SEQ ID NO: 98592 - protein, 35 aa, Artificial Sequence
  Description of Artificial Sequence: Synthetic polypeptide
AEEEIRTTNPVATEQYGSVVVSVTNNQEQGENNDE

SEQ ID NO: 98593 - protein, 33 aa, Artificial Sequence
  Description of Artificial Sequence: Synthetic polypeptide
AEEEIRTTNPVATEQYGSVVVSVTNNQEQETTD

SEQ ID NO: 98594 - protein, 29 aa, Artificial Sequence
  Description of Artificial Sequence: Synthetic peptide
AEESIASVNPVCTEQYGVVSDNLQSGDNQ

SEQ ID NO: 98595 - protein, 34 aa, Artificial Sequence
  Description of Artificial Sequence: Synthetic polypeptide
DEEEIRTTNPVATEQYGSVSAGMGNNEGQGQNEI

SEQ ID NO: 98596 - protein, 34 aa, Artificial Sequence
  Description of Artificial Sequence: Synthetic polypeptide
AEEEIRTTNPVATEQYGSVVVSVTNNQEQNENED

SEQ ID NO: 98597 - protein, 31 aa, Artificial Sequence
  Description of Artificial Sequence: Synthetic polypeptide
EGEEIATTNPVAYEQWGSVSHTLDDQRGGDR

SEQ ID NO: 98598 - protein, 36 aa, Artificial Sequence
  Description of Artificial Sequence: Synthetic polypeptide
DEEEIRTTNPVATEQYGSVNSNETNLDQGNMDHEEI

SEQ ID NO: 98599 - protein, 32 aa, Artificial Sequence
  Description of Artificial Sequence: Synthetic polypeptide
DEEEIRTTNPVATEQYGSVNSNESDDDNGEGM

SEQ ID NO: 98600 - protein, 34 aa, Artificial Sequence
  Description of Artificial Sequence: Synthetic polypeptide
DEEEIATTNPVATEQWGSVHTNNGPWQHGSNTRW

SEQ ID NO: 98601 - protein, 34 aa, Artificial Sequence
  Description of Artificial Sequence: Synthetic polypeptide
DEEEIRTTNPVATEQYGSVQSWMLDSQFENEEHN

SEQ ID NO: 98602 - protein, 33 aa, Artificial Sequence
  Description of Artificial Sequence: Synthetic polypeptide
AEEEIRTTNPVATEQYGVVSTTNNQQGDTGVGQ

SEQ ID NO: 98603 - protein, 32 aa, Artificial Sequence
  Description of Artificial Sequence: Synthetic polypeptide
DEEEIATTNPVATEQWGSVCQTFEDYGRGDTR

SEQ ID NO: 98604 - protein, 33 aa, Artificial Sequence
  Description of Artificial Sequence: Synthetic polypeptide
DEECIRTTNPVAYEQWGCVATNNNLSQLGGNER

SEQ ID NO: 98605 - protein, 32 aa, Artificial Sequence
  Description of Artificial Sequence: Synthetic polypeptide
EEVEIATTNPVGTEQYGSVSWNEQEGQRGNAP

SEQ ID NO: 98606 - protein, 32 aa, Artificial Sequence
  Description of Artificial Sequence: Synthetic polypeptide
DEEEIATTNPVATEQWGSVCNTFNREGTGGTR

SEQ ID NO: 98607 - protein, 34 aa, Artificial Sequence
  Description of Artificial Sequence: Synthetic polypeptide
EEEEIRTTNPVATEQYGSVSITVNVEHFGEIERL

SEQ ID NO: 98608 - protein, 31 aa, Artificial Sequence
  Description of Artificial Sequence: Synthetic polypeptide
EETQIRTTNPVATEQYGSVSTVLQQEMALFS

SEQ ID NO: 98609 - protein, 33 aa, Artificial Sequence
  Description of Artificial Sequence: Synthetic polypeptide
EEEEIRTTNPVATEQYGSVSETPVLMPTVLENE

SEQ ID NO: 98610 - protein, 28 aa, Artificial Sequence
  Description of Artificial Sequence: Synthetic peptide
QEEEIATTNPVATEQYGEAPEDLQHEEK

SEQ ID NO: 98611 - protein, 28 aa, Artificial Sequence
  Description of Artificial Sequence: Synthetic peptide
QECEICTTNPVATECYGVVSELLQPEEV

SEQ ID NO: 98612 - protein, 34 aa, Artificial Sequence
  Description of Artificial Sequence: Synthetic polypeptide
DEEEIATTNPCSTEQYGSVSSTTPNLPNMSGMNR

SEQ ID NO: 98613 - protein, 31 aa, Artificial Sequence
  Description of Artificial Sequence: Synthetic polypeptide
NEAEIATTNPVATEQYGSVTGGNDQQNGGAR

SEQ ID NO: 98614 - protein, 32 aa, Artificial Sequence
  Description of Artificial Sequence: Synthetic polypeptide
NEAEIATTNPVATEQYGSVCWTDNTHQDIGSR

SEQ ID NO: 98615 - protein, 28 aa, Artificial Sequence
  Description of Artificial Sequence: Synthetic peptide
QEEEIATTNPVATEQYGEAPDVLQHEEK

SEQ ID NO: 98616 - protein, 34 aa, Artificial Sequence
  Description of Artificial Sequence: Synthetic polypeptide
AEEEIRTTNPVATEQYGSVVVSVTNNTQEQEEND

SEQ ID NO: 98617 - protein, 33 aa, Artificial Sequence
  Description of Artificial Sequence: Synthetic polypeptide
DEEEIRTTNPVATEQYGSVQSVTDEVDEGEEPI

SEQ ID NO: 98618 - protein, 31 aa, Artificial Sequence
  Description of Artificial Sequence: Synthetic polypeptide
EEEEIRTTNPVATEQYGSVPVSLVDRMILEE

SEQ ID NO: 98619 - protein, 34 aa, Artificial Sequence
  Description of Artificial Sequence: Synthetic polypeptide
DEEEIRTTNPVATEQYGSVNSNTMNGTNEFGQDG

SEQ ID NO: 98620 - protein, 34 aa, Artificial Sequence
  Description of Artificial Sequence: Synthetic polypeptide
DEEEIRTTNPVATEQYGSVNSNNDEMDNEGENGE

SEQ ID NO: 98621 - protein, 32 aa, Artificial Sequence
  Description of Artificial Sequence: Synthetic polypeptide
QAEEIATTNPVATEQYGSVATNDQTNGPNENL

SEQ ID NO: 98622 - protein, 33 aa, Artificial Sequence
  Description of Artificial Sequence: Synthetic polypeptide
EEEEIRTTNPVATEQYGSVQTNLEHNVPLENQG

SEQ ID NO: 98623 - protein, 34 aa, Artificial Sequence
  Description of Artificial Sequence: Synthetic polypeptide
EEEEIRTTNPVATEQYGSVQTNLVQVVANNNDIL

SEQ ID NO: 98624 - protein, 34 aa, Artificial Sequence
  Description of Artificial Sequence: Synthetic polypeptide
DEEEIRTTNPVATEQYGSVNSNTITPDQGREQEN

SEQ ID NO: 98625 - protein, 32 aa, Artificial Sequence
  Description of Artificial Sequence: Synthetic polypeptide
NEAEIATTNPVATEMWGSVSTNLNQGNEGNED

SEQ ID NO: 98626 - protein, 28 aa, Artificial Sequence
  Description of Artificial Sequence: Synthetic peptide
QEEEIATTNPVATEQYGEAPECLQHEEK

SEQ ID NO: 98627 - protein, 36 aa, Artificial Sequence
  Description of Artificial Sequence: Synthetic polypeptide
DEEEIRTTNPVATEQYGSVQSVTNLPQNVEGEEPDP

SEQ ID NO: 98628 - protein, 34 aa, Artificial Sequence
  Description of Artificial Sequence: Synthetic polypeptide
AEEEIRTTNPVATEQYGSVVVSVTNNQEQVENDT

SEQ ID NO: 98629 - protein, 28 aa, Artificial Sequence
  Description of Artificial Sequence: Synthetic peptide
QEEEIATTNPVATEQYGEAPEDCQHGEK

SEQ ID NO: 98630 - protein, 34 aa, Artificial Sequence
  Description of Artificial Sequence: Synthetic polypeptide
EEEEIRTTNPVATEQYGSVSETPDLMPIQMDNES

SEQ ID NO: 98631 - protein, 31 aa, Artificial Sequence
  Description of Artificial Sequence: Synthetic polypeptide
EGEEIATTNPVAYEQWGSVTHTDLDQRGGTR

SEQ ID NO: 98632 - protein, 35 aa, Artificial Sequence
  Description of Artificial Sequence: Synthetic polypeptide
EEEEIRTTNPVATEQYGSVNTTVNNLGQEQGENND

SEQ ID NO: 98633 - protein, 34 aa, Artificial Sequence
  Description of Artificial Sequence: Synthetic polypeptide
MEEEIRTTNPVATEQYGSVSNTDNMNIIGGGNDE

SEQ ID NO: 98634 - protein, 30 aa, Artificial Sequence
  Description of Artificial Sequence: Synthetic polypeptide
DEECIRTTNPVAYEQWGCVYINWNDQMGNS

SEQ ID NO: 98635 - protein, 33 aa, Artificial Sequence
  Description of Artificial Sequence: Synthetic polypeptide
EEEEIRTTNPVATEQYGSVSPTLTLEQTMLQVG

SEQ ID NO: 98636 - protein, 33 aa, Artificial Sequence
  Description of Artificial Sequence: Synthetic polypeptide
EEEEIRTTNPVATEQYGSVSPTNETQAPLVPTN

SEQ ID NO: 98637 - protein, 33 aa, Artificial Sequence
  Description of Artificial Sequence: Synthetic polypeptide
AEEQIRTTNPVATEQYGSVSTVNQLSNLLQNTD

SEQ ID NO: 98638 - protein, 33 aa, Artificial Sequence
  Description of Artificial Sequence: Synthetic polypeptide
AEEEIRTTNPVATEQYGVVSTTNNQQQDTIGVT

SEQ ID NO: 98639 - protein, 31 aa, Artificial Sequence
  Description of Artificial Sequence: Synthetic polypeptide
QAEEIATTNPVAYEPYGSVATNLQPGVNMEN

SEQ ID NO: 98640 - protein, 33 aa, Artificial Sequence
  Description of Artificial Sequence: Synthetic polypeptide
EEEEIRTTNPVATEQYGSVSPTNLEEYSLTPTI

SEQ ID NO: 98641 - protein, 35 aa, Artificial Sequence
  Description of Artificial Sequence: Synthetic polypeptide
DEEEIRTTNPVATEQYGSVSAEVNEMQRENPQHDT

SEQ ID NO: 98642 - protein, 34 aa, Artificial Sequence
  Description of Artificial Sequence: Synthetic polypeptide
AEEQIRTTNPVATEQYGSVSTVNLTQLQQQNTTD

SEQ ID NO: 98643 - protein, 32 aa, Artificial Sequence
  Description of Artificial Sequence: Synthetic polypeptide
NDEEIRTTNPVATEQYGVVCSTEDQENGSNQA

SEQ ID NO: 98644 - protein, 34 aa, Artificial Sequence
  Description of Artificial Sequence: Synthetic polypeptide
DEEEIRTTNPVATEQYGSVNSITNFGMGGDEIGT

SEQ ID NO: 98645 - protein, 33 aa, Artificial Sequence
  Description of Artificial Sequence: Synthetic polypeptide
DEEEIRTTNPVATEQYGSVNSIPQQNEMGEGEN

SEQ ID NO: 98646 - protein, 36 aa, Artificial Sequence
  Description of Artificial Sequence: Synthetic polypeptide
DEEEIRTTNPVATEQYGSVSGTDNEGQQEEGGGNGG

SEQ ID NO: 98647 - protein, 34 aa, Artificial Sequence
  Description of Artificial Sequence: Synthetic polypeptide
AEEEIRTTNPVATEQYGVVSTTNNQQQGTEGNVQ

SEQ ID NO: 98648 - protein, 32 aa, Artificial Sequence
  Description of Artificial Sequence: Synthetic polypeptide
DEEEIRTTNPVATEQYGSVQTDEYVPTGEEEL

SEQ ID NO: 98649 - protein, 30 aa, Artificial Sequence
  Description of Artificial Sequence: Synthetic polypeptide
DEECIRTTNPVAYEQWGCVYRDNDQQSGNS

SEQ ID NO: 98650 - protein, 33 aa, Artificial Sequence
  Description of Artificial Sequence: Synthetic polypeptide
EESEIRTTNPVAYEQYGSVSCTNNPSQGPGGNS

SEQ ID NO: 98651 - protein, 30 aa, Artificial Sequence
  Description of Artificial Sequence: Synthetic polypeptide
DEECIRTTNPVAYEQWGCVYRENDQQQGNV

SEQ ID NO: 98652 - protein, 33 aa, Artificial Sequence
  Description of Artificial Sequence: Synthetic polypeptide
AEEEIRTTNPVATEQYGVVSTTNNQQQQNDGVQ

SEQ ID NO: 98653 - protein, 33 aa, Artificial Sequence
  Description of Artificial Sequence: Synthetic polypeptide
AEEEIRTTNPVATEQYGSVVVSVTNNQEQEEDS

SEQ ID NO: 98654 - protein, 31 aa, Artificial Sequence
  Description of Artificial Sequence: Synthetic polypeptide
QAEEIATTNPVAYEQYGSVATNLQAAENNDD

SEQ ID NO: 98655 - protein, 31 aa, Artificial Sequence
  Description of Artificial Sequence: Synthetic polypeptide
DEEDIRTTNPCATEQYGSSVMSYHARGSNEY

SEQ ID NO: 98656 - protein, 33 aa, Artificial Sequence
  Description of Artificial Sequence: Synthetic polypeptide
DEECIRTTNPVAYEQWGCVCWTNNALSQLGGNR

SEQ ID NO: 98657 - protein, 36 aa, Artificial Sequence
  Description of Artificial Sequence: Synthetic polypeptide
DEEEIRTTNPVATEQYGSVNSITNMNQNNIGGNGQE

SEQ ID NO: 98658 - protein, 34 aa, Artificial Sequence
  Description of Artificial Sequence: Synthetic polypeptide
DEEEIRTTNPVATEQYGSVQSWTTTMEQRVVEVN

SEQ ID NO: 98659 - protein, 32 aa, Artificial Sequence
  Description of Artificial Sequence: Synthetic polypeptide
DEEEIATTNPVATEQWGSVATGAPQTGPMGRE

SEQ ID NO: 98660 - protein, 31 aa, Artificial Sequence
  Description of Artificial Sequence: Synthetic polypeptide
DEEEIATTNPVATEQWGSVATGALDTPGTES

SEQ ID NO: 98661 - protein, 34 aa, Artificial Sequence
  Description of Artificial Sequence: Synthetic polypeptide
EEEEIRTTNPVATEQYGSVSLTNDNEQELQSPVL

SEQ ID NO: 98662 - protein, 30 aa, Artificial Sequence
  Description of Artificial Sequence: Synthetic polypeptide
DEECIRTTNPVAYEQWGCVYKNDQDSQGNV

SEQ ID NO: 98663 - protein, 30 aa, Artificial Sequence
  Description of Artificial Sequence: Synthetic polypeptide
DEECIRTTNPVAYEQWGCVYNMNDQFEGNH

SEQ ID NO: 98664 - protein, 33 aa, Artificial Sequence
  Description of Artificial Sequence: Synthetic polypeptide
EEEEIRTTNPVATEQYGSVSNMNQEQEVGVPVL

SEQ ID NO: 98665 - protein, 32 aa, Artificial Sequence
  Description of Artificial Sequence: Synthetic polypeptide
NDEEIRTTNPVATEQYGVVSTGALQNFGSDQS

SEQ ID NO: 98666 - protein, 31 aa, Artificial Sequence
  Description of Artificial Sequence: Synthetic polypeptide
DEEEIATTNPVATEQWGSVAMNLNAANESLN

SEQ ID NO: 98667 - protein, 35 aa, Artificial Sequence
  Description of Artificial Sequence: Synthetic polypeptide
DEEEIRTTNPVATEQYGSVLSTPHLTQLNDVNQEL

SEQ ID NO: 98668 - protein, 32 aa, Artificial Sequence
  Description of Artificial Sequence: Synthetic polypeptide
EESEIRTTNPVAYEQYGSVSCTNYSQGPGGDS

SEQ ID NO: 98669 - protein, 33 aa, Artificial Sequence
  Description of Artificial Sequence: Synthetic polypeptide
EEEEIRTTNPVATEQYGSVSPPNLQINEIEVTD

SEQ ID NO: 98670 - protein, 35 aa, Artificial Sequence
  Description of Artificial Sequence: Synthetic polypeptide
AEEEIRTTNPVATEQYGVVSTVTNNLQQQTNGNAN

SEQ ID NO: 98671 - protein, 29 aa, Artificial Sequence
  Description of Artificial Sequence: Synthetic peptide
QEEEIATTNPVATEQYGEAPEEVCQHGNK

SEQ ID NO: 98672 - protein, 29 aa, Artificial Sequence
  Description of Artificial Sequence: Synthetic peptide
QEEEIATTNPVATEQYGEAPEEVCQQGNK

SEQ ID NO: 98673 - protein, 32 aa, Artificial Sequence
  Description of Artificial Sequence: Synthetic polypeptide
EESEISTTNPVAYEQYGSVSTNEPSQGPGGNE

SEQ ID NO: 98674 - protein, 34 aa, Artificial Sequence
  Description of Artificial Sequence: Synthetic polypeptide
DEEEIRTTNPVATEQYGSVSESTQNDNVPNVDEA

SEQ ID NO: 98675 - protein, 32 aa, Artificial Sequence
  Description of Artificial Sequence: Synthetic polypeptide
NDEEIRTTNPVATEQYGVVSNTNHQNFGSDQA

SEQ ID NO: 98676 - protein, 34 aa, Artificial Sequence
  Description of Artificial Sequence: Synthetic polypeptide
AEEEIRTTNPVATEQYGSVVVSVTNNQEQEGTDQ

SEQ ID NO: 98677 - protein, 34 aa, Artificial Sequence
  Description of Artificial Sequence: Synthetic polypeptide
DEEEIRTTNPVATEQYGSVNSITTNFGMGGEEGF

SEQ ID NO: 98678 - protein, 32 aa, Artificial Sequence
  Description of Artificial Sequence: Synthetic polypeptide
EESEIRTTNPVAYEQYGSVSCTVHSQGPGGNS

SEQ ID NO: 98679 - protein, 32 aa, Artificial Sequence
  Description of Artificial Sequence: Synthetic polypeptide
QAEEIATTNPVATEQYGSVATNLQGAEEDTRS

SEQ ID NO: 98680 - protein, 30 aa, Artificial Sequence
  Description of Artificial Sequence: Synthetic polypeptide
EGEEIATTNPVAYEQWGSVTRTLEDQRGTR

SEQ ID NO: 98681 - protein, 33 aa, Artificial Sequence
  Description of Artificial Sequence: Synthetic polypeptide
DEEEIRTTNPVATEQYGSVQSVEEEVDEGEERI

SEQ ID NO: 98682 - protein, 35 aa, Artificial Sequence
  Description of Artificial Sequence: Synthetic polypeptide
DEEEIRTTNPVATEQYGSVSESALGLQINTFGNEI

SEQ ID NO: 98683 - protein, 32 aa, Artificial Sequence
  Description of Artificial Sequence: Synthetic polypeptide
DEEEIATTNPCATEEYGSVATGNDHGGRGNAM

SEQ ID NO: 98684 - protein, 32 aa, Artificial Sequence
  Description of Artificial Sequence: Synthetic polypeptide
DEEEIACTNPVATEQYGCVATNLQAEGGEEDN

SEQ ID NO: 98685 - protein, 33 aa, Artificial Sequence
  Description of Artificial Sequence: Synthetic polypeptide
DEEEIATTNPCATEHWGSVSTNLNGDAQRNNDV

SEQ ID NO: 98686 - protein, 32 aa, Artificial Sequence
  Description of Artificial Sequence: Synthetic polypeptide
QAEEIATTNPVATEQYGCVAGTNLQADGPQNA

SEQ ID NO: 98687 - protein, 33 aa, Artificial Sequence
  Description of Artificial Sequence: Synthetic polypeptide
DEEEIRTTNPVATEQYGSVSEPNVGMERILVHI

SEQ ID NO: 98688 - protein, 31 aa, Artificial Sequence
  Description of Artificial Sequence: Synthetic polypeptide
DEEEIACTNPVATEQYGCVATNLQAEAEATG

SEQ ID NO: 98689 - protein, 33 aa, Artificial Sequence
  Description of Artificial Sequence: Synthetic polypeptide
MEEEIRTTNPVATEQYGSVNDTENVNANGGGNG

SEQ ID NO: 98690 - protein, 31 aa, Artificial Sequence
  Description of Artificial Sequence: Synthetic polypeptide
NEAEIRTTNPVAYEQWGAVSTNLQHQGGDAQ

SEQ ID NO: 98691 - protein, 32 aa, Artificial Sequence
  Description of Artificial Sequence: Synthetic polypeptide
DEEEIACTNPVATEQYGCVATNLQAAEDDGRE

SEQ ID NO: 98692 - protein, 32 aa, Artificial Sequence
  Description of Artificial Sequence: Synthetic polypeptide
DEEEIACTNPVATEQYGCVATNLQAEPMGSKA

SEQ ID NO: 98693 - protein, 33 aa, Artificial Sequence
  Description of Artificial Sequence: Synthetic polypeptide
DEEEIACTNPVATEQYGCVATNLQAAAGENDQH

SEQ ID NO: 98694 - protein, 31 aa, Artificial Sequence
  Description of Artificial Sequence: Synthetic polypeptide
NEAEIRTTNPVAYEQWGAVSTNLNHNGGNDA

SEQ ID NO: 98695 - protein, 32 aa, Artificial Sequence
  Description of Artificial Sequence: Synthetic polypeptide
NEAEIRTTNPVATEYWGNVSTNLQGQMGDNES

SEQ ID NO: 98696 - protein, 35 aa, Artificial Sequence
  Description of Artificial Sequence: Synthetic polypeptide
DEEEIATTNPCATEQYGSVCSCTNLLVRYGNNTQQ

SEQ ID NO: 98697 - protein, 32 aa, Artificial Sequence
  Description of Artificial Sequence: Synthetic polypeptide
DEEEIATTNPCATEQYGSVCYNIEKRDGMNDS

SEQ ID NO: 98698 - protein, 31 aa, Artificial Sequence
  Description of Artificial Sequence: Synthetic polypeptide
QAEEIATTNPVATEQYGCVATNLQADDPNGQ

SEQ ID NO: 98699 - protein, 33 aa, Artificial Sequence
  Description of Artificial Sequence: Synthetic polypeptide
DEEEIATTNPCATEQYGSVSSTTAGPNRGMNPV

SEQ ID NO: 98700 - protein, 32 aa, Artificial Sequence
  Description of Artificial Sequence: Synthetic polypeptide
NEAEIRTTNPVATEYWGNVSTNLQGQDDMNER

SEQ ID NO: 98701 - protein, 32 aa, Artificial Sequence
  Description of Artificial Sequence: Synthetic polypeptide
QAEEIATTNPVATEQYGCVATNLQADGPQDRA

SEQ ID NO: 98702 - protein, 31 aa, Artificial Sequence
  Description of Artificial Sequence: Synthetic polypeptide
ENEEIATTNPVAYEQWGVVSTNLQGDHQDNR

SEQ ID NO: 98703 - protein, 32 aa, Artificial Sequence
  Description of Artificial Sequence: Synthetic polypeptide
DEEEIACTNPVATEQYGCVATNLDTMPGNENA

SEQ ID NO: 98704 - protein, 33 aa, Artificial Sequence
  Description of Artificial Sequence: Synthetic polypeptide
MEEEIRTTNPVATEQYGSVPSTVTWWQMDGQVG

SEQ ID NO: 98705 - protein, 35 aa, Artificial Sequence
  Description of Artificial Sequence: Synthetic polypeptide
EEEEIRTTNPVATEQYGSVATTANLQQGNNNEQDT

SEQ ID NO: 98706 - protein, 35 aa, Artificial Sequence
  Description of Artificial Sequence: Synthetic polypeptide
DEEEIRTTNPVATEQYGSVQSTNLEAERMDPDELV

SEQ ID NO: 98707 - protein, 31 aa, Artificial Sequence
  Description of Artificial Sequence: Synthetic polypeptide
NEAEIRTTNPVAYEQWGSATTNPQQGNEGAR

SEQ ID NO: 98708 - protein, 32 aa, Artificial Sequence
  Description of Artificial Sequence: Synthetic polypeptide
DEEEIACTNPVATEQYGCVATNLQDGAGEEGE

SEQ ID NO: 98709 - protein, 31 aa, Artificial Sequence
  Description of Artificial Sequence: Synthetic polypeptide
NEAEIRTTNPVAYEQWGEVTTNQQGNMGNAR

SEQ ID NO: 98710 - protein, 31 aa, Artificial Sequence
  Description of Artificial Sequence: Synthetic polypeptide
DEEEIATTNPVATEQWGSVSGTGNPDADMPW

SEQ ID NO: 98711 - protein, 28 aa, Artificial Sequence
  Description of Artificial Sequence: Synthetic peptide
QEDEIAPTNPCSSEQYGIVSCNLQQGTR

SEQ ID NO: 98712 - protein, 28 aa, Artificial Sequence
  Description of Artificial Sequence: Synthetic peptide
QEEEIATTNPVATEQYGEAPEVLQHEEL

SEQ ID NO: 98713 - protein, 33 aa, Artificial Sequence
  Description of Artificial Sequence: Synthetic polypeptide
DEECIRTTNPVATEQYSACVCSTNDQSFGSNQM

SEQ ID NO: 98714 - protein, 34 aa, Artificial Sequence
  Description of Artificial Sequence: Synthetic polypeptide
EEEEIRTTNPVATEQYGSVATAQLQQGNTNIFED

SEQ ID NO: 98715 - protein, 35 aa, Artificial Sequence
  Description of Artificial Sequence: Synthetic polypeptide
DEEEIATTNPVATEQWGSVSGTDGPLGQHGDNSRM

SEQ ID NO: 98716 - protein, 34 aa, Artificial Sequence
  Description of Artificial Sequence: Synthetic polypeptide
DEEEIRTTNPVATEQYGSVITINMEQVNLVNDND

SEQ ID NO: 98717 - protein, 28 aa, Artificial Sequence
  Description of Artificial Sequence: Synthetic peptide
QEEEIATTNPVATEQYGEAPEVLQHEEK

SEQ ID NO: 98718 - protein, 28 aa, Artificial Sequence
  Description of Artificial Sequence: Synthetic peptide
AEGEIAPTNPCSSEQYGIVSCNLQSGTR

SEQ ID NO: 98719 - protein, 32 aa, Artificial Sequence
  Description of Artificial Sequence: Synthetic polypeptide
DEEEIACTNPVATEQYGCVATNLQDAEDDTNN

SEQ ID NO: 98720 - protein, 31 aa, Artificial Sequence
  Description of Artificial Sequence: Synthetic polypeptide
DEEEIACTNPVATEQYGCVATNLQDAAEAEQ

SEQ ID NO: 98721 - protein, 32 aa, Artificial Sequence
  Description of Artificial Sequence: Synthetic polypeptide
DEECIRTTNPVATEQYSACVCSTNPQYFGSDQ

SEQ ID NO: 98722 - protein, 33 aa, Artificial Sequence
  Description of Artificial Sequence: Synthetic polypeptide
DEEEIACTNPVATEQYGCVATNLQATMNDENRD

SEQ ID NO: 98723 - protein, 33 aa, Artificial Sequence
  Description of Artificial Sequence: Synthetic polypeptide
EEEEIRTTNPVATEQYGSVATQALQQNNNDEEE

SEQ ID NO: 98724 - protein, 33 aa, Artificial Sequence
  Description of Artificial Sequence: Synthetic polypeptide
DEEEIATTNPVATEPYGVVCATNLTDRGGNEMK

SEQ ID NO: 98725 - protein, 28 aa, Artificial Sequence
  Description of Artificial Sequence: Synthetic peptide
QEEEIATTNPVATEQYGEAPEVLMHEER

SEQ ID NO: 98726 - protein, 28 aa, Artificial Sequence
  Description of Artificial Sequence: Synthetic peptide
AEGEIAPTNPCSSEQYGIVSCNLQSGGR

SEQ ID NO: 98727 - protein, 34 aa, Artificial Sequence
  Description of Artificial Sequence: Synthetic polypeptide
DEEEIRTTNPVATEQYGSVNSTAEADMQNETQND

SEQ ID NO: 98728 - protein, 34 aa, Artificial Sequence
  Description of Artificial Sequence: Synthetic polypeptide
DEEEIRTTNPVATEQYGSVLVYTNMLDTVVNTND

SEQ ID NO: 98729 - protein, 28 aa, Artificial Sequence
  Description of Artificial Sequence: Synthetic peptide
QEEEIATTNPVATEQYGEAPEVEQHGEK

SEQ ID NO: 98730 - protein, 31 aa, Artificial Sequence
  Description of Artificial Sequence: Synthetic polypeptide
QAEEIATTNPVATEQYGCVATNLQDADGPWN

SEQ ID NO: 98731 - protein, 32 aa, Artificial Sequence
  Description of Artificial Sequence: Synthetic polypeptide
DEECIRTTNPVAWEQYGVVCTIEDGQRGNNEM

SEQ ID NO: 98732 - protein, 31 aa, Artificial Sequence
  Description of Artificial Sequence: Synthetic polypeptide
QAEEIATTNPVATEQYGSVAAGNLDEAGNNN

SEQ ID NO: 98733 - protein, 36 aa, Artificial Sequence
  Description of Artificial Sequence: Synthetic polypeptide
DEEEIRTTNPVATEQYGSVQSTTPAGNNMRMGSNPV

SEQ ID NO: 98734 - protein, 33 aa, Artificial Sequence
  Description of Artificial Sequence: Synthetic polypeptide
NEAEIRTTNPVATEMWGSVCSTNLQGNEGGNDS

SEQ ID NO: 98735 - protein, 32 aa, Artificial Sequence
  Description of Artificial Sequence: Synthetic polypeptide
DEECIRTTNPVAWEQYGVVCTIEDGQRGNNNE

SEQ ID NO: 98736 - protein, 33 aa, Artificial Sequence
  Description of Artificial Sequence: Synthetic polypeptide
DEECIRTTNPVAWEQYGVVCTIEDGQRMGDNNR

SEQ ID NO: 98737 - protein, 34 aa, Artificial Sequence
  Description of Artificial Sequence: Synthetic polypeptide
AEEEIRTTNPVATEQYGVVSTTNNNQQTEGNIQD

SEQ ID NO: 98738 - protein, 36 aa, Artificial Sequence
  Description of Artificial Sequence: Synthetic polypeptide
DEEEIRTTNPVATEQYGSVQSTTPAQPNMRNGMNPV

SEQ ID NO: 98739 - protein, 33 aa, Artificial Sequence
  Description of Artificial Sequence: Synthetic polypeptide
NEAEIRTTNPVATECWGNVSTNLNQGQDGGNER

SEQ ID NO: 98740 - protein, 32 aa, Artificial Sequence
  Description of Artificial Sequence: Synthetic polypeptide
DEECIRTTNPVAWEQYGVVCTIEDGQRGNGNH

SEQ ID NO: 98741 - protein, 32 aa, Artificial Sequence
  Description of Artificial Sequence: Synthetic polypeptide
DEECIRTTNPVAYEAYGKTVSQLNASQDGNQR

SEQ ID NO: 98742 - protein, 33 aa, Artificial Sequence
  Description of Artificial Sequence: Synthetic polypeptide
DEEEIRTTNPVATEQYGSVSEQNNDDMNGVEEP

SEQ ID NO: 98743 - protein, 32 aa, Artificial Sequence
  Description of Artificial Sequence: Synthetic polypeptide
DEEEIATTNPCAYEQYGSVPSCFNISFRGGND

SEQ ID NO: 98744 - protein, 33 aa, Artificial Sequence
  Description of Artificial Sequence: Synthetic polypeptide
DEEEIRTTNPVATEQYGSVSEQNNDMIQVAEDQ

SEQ ID NO: 98745 - protein, 28 aa, Artificial Sequence
  Description of Artificial Sequence: Synthetic peptide
AEGEIACTNPCSSEQYGIVSCNLQSGTR

SEQ ID NO: 98746 - protein, 35 aa, Artificial Sequence
  Description of Artificial Sequence: Synthetic polypeptide
DEEEIRTTNPVATEQYGSVSGTNELDVNEDGEGGT

SEQ ID NO: 98747 - protein, 33 aa, Artificial Sequence
  Description of Artificial Sequence: Synthetic polypeptide
ENEEIATTNPVATTQWGSVSKTDNLPMERGGNR

SEQ ID NO: 98748 - protein, 32 aa, Artificial Sequence
  Description of Artificial Sequence: Synthetic polypeptide
NEAEIATTNPVATEYWGNVSTNLQGQEGGNNR

SEQ ID NO: 98749 - protein, 34 aa, Artificial Sequence
  Description of Artificial Sequence: Synthetic polypeptide
EEEEIRTTNPVATEQYGSVIVTNLQNVPLENQGF

SEQ ID NO: 98750 - protein, 31 aa, Artificial Sequence
  Description of Artificial Sequence: Synthetic polypeptide
ENAEIATTNPVAYEQWGVVSTNLQGDHGNNR

SEQ ID NO: 98751 - protein, 31 aa, Artificial Sequence
  Description of Artificial Sequence: Synthetic polypeptide
QAEEIATTNPVATEQYGSVATALQANGDQGA

SEQ ID NO: 98752 - protein, 34 aa, Artificial Sequence
  Description of Artificial Sequence: Synthetic polypeptide
DEEEIRTTNPVATEQYGSVSEQNLQNTQVDPLIK

SEQ ID NO: 98753 - protein, 34 aa, Artificial Sequence
  Description of Artificial Sequence: Synthetic polypeptide
EEEEIRTTNPVATEQYGSVECTVLTPSFNGENNR

SEQ ID NO: 98754 - protein, 34 aa, Artificial Sequence
  Description of Artificial Sequence: Synthetic polypeptide
EEEEIRTTNPVATEQYGSVEATVLTPSFFGESNR

SEQ ID NO: 98755 - protein, 35 aa, Artificial Sequence
  Description of Artificial Sequence: Synthetic polypeptide
EEEEIRTTNPVATEQYGSVATTNLQQGQEGNNNQT

SEQ ID NO: 98756 - protein, 33 aa, Artificial Sequence
  Description of Artificial Sequence: Synthetic polypeptide
DEEEIRTTNPVATEQYGSVSEPWVGMERGQVEI

SEQ ID NO: 98757 - protein, 34 aa, Artificial Sequence
  Description of Artificial Sequence: Synthetic polypeptide
AEEEIRTTNPVATEQYGVVSTTNNLQQDTTNVTT

SEQ ID NO: 98758 - protein, 34 aa, Artificial Sequence
  Description of Artificial Sequence: Synthetic polypeptide
DEEEIRTTNPVATEQYGSVLVVTNMQNRNVPEQV

SEQ ID NO: 98759 - protein, 32 aa, Artificial Sequence
  Description of Artificial Sequence: Synthetic polypeptide
ENEEIATTNPVAYEQWGVVSTNLQGDHGPNDR

SEQ ID NO: 98760 - protein, 35 aa, Artificial Sequence
  Description of Artificial Sequence: Synthetic polypeptide
AEEEIRTTNPVATEQYGVVSTTNNLTNQQNGNNDG

SEQ ID NO: 98761 - protein, 33 aa, Artificial Sequence
  Description of Artificial Sequence: Synthetic polypeptide
QAEEIATTNPVATEQYGCVATNLQPADGPNNRD

SEQ ID NO: 98762 - protein, 28 aa, Artificial Sequence
  Description of Artificial Sequence: Synthetic peptide
QECEICTTNPVATESYGVVSEMLQEEEL

SEQ ID NO: 98763 - protein, 31 aa, Artificial Sequence
  Description of Artificial Sequence: Synthetic polypeptide
ENEEIATTNPVAYEQWGVVSTNLQGDHGGNG

SEQ ID NO: 98764 - protein, 28 aa, Artificial Sequence
  Description of Artificial Sequence: Synthetic peptide
QECEICTTNPVATESYGTVSELLQLEEL

SEQ ID NO: 98765 - protein, 28 aa, Artificial Sequence
  Description of Artificial Sequence: Synthetic peptide
QECEICTTNPVATEHYGVVSELLQMEEL

SEQ ID NO: 98766 - protein, 32 aa, Artificial Sequence
  Description of Artificial Sequence: Synthetic polypeptide
DEECVRTTNPIAYEQYGCVCSTNHQRFGSNQS

SEQ ID NO: 98767 - protein, 31 aa, Artificial Sequence
  Description of Artificial Sequence: Synthetic polypeptide
QAEEIATTNPVATEQYGCVATNLQPADNPNN

SEQ ID NO: 98768 - protein, 33 aa, Artificial Sequence
  Description of Artificial Sequence: Synthetic polypeptide
DEEEIRTTNPVATEQYGSVQSTSMGQPELAQVD

SEQ ID NO: 98769 - protein, 35 aa, Artificial Sequence
  Description of Artificial Sequence: Synthetic polypeptide
DEEEIRTTNPVATEQYGSVQSTSNGDHELAQVEDV

SEQ ID NO: 98770 - protein, 34 aa, Artificial Sequence
  Description of Artificial Sequence: Synthetic polypeptide
DEEEIRTTNPVATEQYGSVQSTSNGQHELAQVDG

SEQ ID NO: 98771 - protein, 35 aa, Artificial Sequence
  Description of Artificial Sequence: Synthetic polypeptide
EEEEIRTTNPVATEQYGSVATTTNLQQQEGENNQT

SEQ ID NO: 98772 - protein, 34 aa, Artificial Sequence
  Description of Artificial Sequence: Synthetic polypeptide
EEEEIRTTNPVATEQYGSVCTVLTPSFNSGENNR

SEQ ID NO: 98773 - protein, 32 aa, Artificial Sequence
  Description of Artificial Sequence: Synthetic polypeptide
DEEEIRTTNPVATEQYGSVSEQMSQQVEQEDE

SEQ ID NO: 98774 - protein, 32 aa, Artificial Sequence
  Description of Artificial Sequence: Synthetic polypeptide
EEEEIRTTNPVATEQYGSVDTAGQSNGGGFDE

SEQ ID NO: 98775 - protein, 29 aa, Artificial Sequence
  Description of Artificial Sequence: Synthetic peptide
QECEICTTNPVATECYGVVSEQNLQEEEL

SEQ ID NO: 98776 - protein, 37 aa, Artificial Sequence
  Description of Artificial Sequence: Synthetic polypeptide
DEEEIRTTNPVATEQYGSVSGSTNGLGQEGQGGNGGE

SEQ ID NO: 98777 - protein, 28 aa, Artificial Sequence
  Description of Artificial Sequence: Synthetic peptide
QEEEIATTNPVATEQYGEVPEVCQHEEK

SEQ ID NO: 98778 - protein, 32 aa, Artificial Sequence
  Description of Artificial Sequence: Synthetic polypeptide
DEECIRTTNPVAYEQYSEEVTTGNQQQDGNNR

SEQ ID NO: 98779 - protein, 33 aa, Artificial Sequence
  Description of Artificial Sequence: Synthetic polypeptide
DEEEIRTTNPVATEQYGSVSLTVEVIQSQPEEL

SEQ ID NO: 98780 - protein, 33 aa, Artificial Sequence
  Description of Artificial Sequence: Synthetic polypeptide
DEEAIRTTNPVATEQYGCVCSTEHQEHFGSNQG

SEQ ID NO: 98781 - protein, 28 aa, Artificial Sequence
  Description of Artificial Sequence: Synthetic peptide
HENEIATTNPVATECYGHVSEVLQHEEL

SEQ ID NO: 98782 - protein, 33 aa, Artificial Sequence
  Description of Artificial Sequence: Synthetic polypeptide
DEEEIRTTNPVATEQYGSVSPAADSEVEMGLRN

SEQ ID NO: 98783 - protein, 33 aa, Artificial Sequence
  Description of Artificial Sequence: Synthetic polypeptide
DEEEIATTNPVATEPYGSVCSGTDNDRDGGDLR

SEQ ID NO: 98784 - protein, 34 aa, Artificial Sequence
  Description of Artificial Sequence: Synthetic polypeptide
FEEEIRTTNPVATEQYGSVTSITGDGDQTGGGNG

SEQ ID NO: 98785 - protein, 33 aa, Artificial Sequence
  Description of Artificial Sequence: Synthetic polypeptide
DEEAIRTTNPVATEQYGCVCSTGEDQNFGSNAS

SEQ ID NO: 98786 - protein, 29 aa, Artificial Sequence
  Description of Artificial Sequence: Synthetic peptide
DSDSIACTNPVATEQYGCVATNHQRDSNS

SEQ ID NO: 98787 - protein, 28 aa, Artificial Sequence
  Description of Artificial Sequence: Synthetic peptide
AENEIACTNPVATEQYGEAPENCQREER

SEQ ID NO: 98788 - protein, 35 aa, Artificial Sequence
  Description of Artificial Sequence: Synthetic polypeptide
DEEEIRTTNPVATEQYGSVNCPTMGLIPRGQEIRN

SEQ ID NO: 98789 - protein, 34 aa, Artificial Sequence
  Description of Artificial Sequence: Synthetic polypeptide
DEEEIRTTNPVATEQYGSVSPAANQQLDVQSMMV

SEQ ID NO: 98790 - protein, 31 aa, Artificial Sequence
  Description of Artificial Sequence: Synthetic polypeptide
QEEEIATTNPVATEQYGSVCATTDQDGDQTA

SEQ ID NO: 98791 - protein, 32 aa, Artificial Sequence
  Description of Artificial Sequence: Synthetic polypeptide
DEEEIRTTNPVATEQYGSVMNGFNGGGFGTTE

SEQ ID NO: 98792 - protein, 35 aa, Artificial Sequence
  Description of Artificial Sequence: Synthetic polypeptide
AEEEIRTTNPVATEQYGSVVTTNNNLQQGNEGNDE

SEQ ID NO: 98793 - protein, 32 aa, Artificial Sequence
  Description of Artificial Sequence: Synthetic polypeptide
QEEEIATTNPVATEQYGSVATNLVETPADNNA

SEQ ID NO: 98794 - protein, 34 aa, Artificial Sequence
  Description of Artificial Sequence: Synthetic polypeptide
DEEEIRTTNPVATEQYGSVSPAANQVQLDQSMDV

SEQ ID NO: 98795 - protein, 33 aa, Artificial Sequence
  Description of Artificial Sequence: Synthetic polypeptide
DEEAIRTTNPVATEQYGCVCSTMEELYFGSNQS

SEQ ID NO: 98796 - protein, 32 aa, Artificial Sequence
  Description of Artificial Sequence: Synthetic polypeptide
GEEEIKTTNPVAWEEYGSVPFTILSQTRGGER

SEQ ID NO: 98797 - protein, 33 aa, Artificial Sequence
  Description of Artificial Sequence: Synthetic polypeptide
DEEEIRTTNPVATEQYGSVSNPMTGPENADNES

SEQ ID NO: 98798 - protein, 30 aa, Artificial Sequence
  Description of Artificial Sequence: Synthetic polypeptide
IEPEIRTTNPVATEQYGCVSTQTGETEDNE

SEQ ID NO: 98799 - protein, 28 aa, Artificial Sequence
  Description of Artificial Sequence: Synthetic peptide
AENEIACTNPVATEQYGEASENLQHEEK

SEQ ID NO: 98800 - protein, 33 aa, Artificial Sequence
  Description of Artificial Sequence: Synthetic polypeptide
DEEEIRTTNPVATEQYGSVNCPIPNLEPRTEVI

SEQ ID NO: 98801 - protein, 28 aa, Artificial Sequence
  Description of Artificial Sequence: Synthetic peptide
IENEIATTNPVATECYGDVSECLQHEEL

SEQ ID NO: 98802 - protein, 34 aa, Artificial Sequence
  Description of Artificial Sequence: Synthetic polypeptide
DSDEIRTTNPVATEQYGCVVCTINLSQTHGGNYR

SEQ ID NO: 98803 - protein, 30 aa, Artificial Sequence
  Description of Artificial Sequence: Synthetic polypeptide
QEEEIATTNPVATEQYGSVPATVCQDHEEK

SEQ ID NO: 98804 - protein, 34 aa, Artificial Sequence
  Description of Artificial Sequence: Synthetic polypeptide
DSDEIRTTNPVATEQYGCVVSTINHSQTAGGNTR

SEQ ID NO: 98805 - protein, 34 aa, Artificial Sequence
  Description of Artificial Sequence: Synthetic polypeptide
AEEEIRTTNPVATEQYGSVVTVVTNLQQNDENNS

SEQ ID NO: 98806 - protein, 29 aa, Artificial Sequence
  Description of Artificial Sequence: Synthetic peptide
GEEEIATTNPVATEQYGEAPTELMQHEEK

SEQ ID NO: 98807 - protein, 33 aa, Artificial Sequence
  Description of Artificial Sequence: Synthetic polypeptide
DEEEIRTTNPVATEQYGSVMNGFNGQGGFGTGT

SEQ ID NO: 98808 - protein, 33 aa, Artificial Sequence
  Description of Artificial Sequence: Synthetic polypeptide
AEEEIRTTNPVATEQYGSVVVVTTDGNQIGNLE

SEQ ID NO: 98809 - protein, 33 aa, Artificial Sequence
  Description of Artificial Sequence: Synthetic polypeptide
FEEEIRTTNPVATEQYGSVTGDNNGQGNGGNGQ

SEQ ID NO: 98810 - protein, 35 aa, Artificial Sequence
  Description of Artificial Sequence: Synthetic polypeptide
DSDEIRTTNPVATEQYGSVVSCIQNLSQHNGNTRT

SEQ ID NO: 98811 - protein, 33 aa, Artificial Sequence
  Description of Artificial Sequence: Synthetic polypeptide
DSDEIRTTNPVATEQYGSVVSTINPSQHGGSTP

SEQ ID NO: 98812 - protein, 32 aa, Artificial Sequence
  Description of Artificial Sequence: Synthetic polypeptide
DEEEIRTTNPVATEQYGSVPTPACPNMRNEEV

SEQ ID NO: 98813 - protein, 30 aa, Artificial Sequence
  Description of Artificial Sequence: Synthetic polypeptide
AENEIACTNPVATEQYGEASENLQGQGGER

SEQ ID NO: 98814 - protein, 34 aa, Artificial Sequence
  Description of Artificial Sequence: Synthetic polypeptide
NEEEIRTTNPVATEYYGSVSTMNPLQPPEFESSR

SEQ ID NO: 98815 - protein, 31 aa, Artificial Sequence
  Description of Artificial Sequence: Synthetic polypeptide
IENEIRTTNPVATEQYGSVSVNNQESFDDDI

SEQ ID NO: 98816 - protein, 34 aa, Artificial Sequence
  Description of Artificial Sequence: Synthetic polypeptide
DEEEIRTTNPVATEQYGSVSNPPTNQEVQGLEQA

SEQ ID NO: 98817 - protein, 32 aa, Artificial Sequence
  Description of Artificial Sequence: Synthetic polypeptide
DEEAIRTTNPVATEQYGCVCSSEHQRFGSEQM

SEQ ID NO: 98818 - protein, 32 aa, Artificial Sequence
  Description of Artificial Sequence: Synthetic polypeptide
QEEEIACTNPVATEQYGSVSTNDQTPGGEEAA

SEQ ID NO: 98819 - protein, 34 aa, Artificial Sequence
  Description of Artificial Sequence: Synthetic polypeptide
AEEEIRTTNPVATEQYGSVVVVTTDGNQQIGTNL

SEQ ID NO: 98820 - protein, 34 aa, Artificial Sequence
  Description of Artificial Sequence: Synthetic polypeptide
AEEEIRTTNPVATEQYGSVVVVTNQLGGNNGNND

SEQ ID NO: 98821 - protein, 28 aa, Artificial Sequence
  Description of Artificial Sequence: Synthetic peptide
IESEIATTNPVATECYGDVSEKLQHEEL

SEQ ID NO: 98822 - protein, 33 aa, Artificial Sequence
  Description of Artificial Sequence: Synthetic polypeptide
QEEEIACTNPVATEQYGSVATVNLEQDSGEPRE

SEQ ID NO: 98823 - protein, 34 aa, Artificial Sequence
  Description of Artificial Sequence: Synthetic polypeptide
DEEEIRTTNPVATEQYGSVIGPLVNLIREGEIED

SEQ ID NO: 98824 - protein, 33 aa, Artificial Sequence
  Description of Artificial Sequence: Synthetic polypeptide
DEEEIRTTNPVATEQYGSVSNNNDEFDEGGGEE

SEQ ID NO: 98825 - protein, 29 aa, Artificial Sequence
  Description of Artificial Sequence: Synthetic peptide
AENEIACTNPVATEQYGEAIERLQRGVRE

SEQ ID NO: 98826 - protein, 34 aa, Artificial Sequence
  Description of Artificial Sequence: Synthetic polypeptide
FEEEIRTTNPVATEQYGSVTDTINGDQGGGNEGI

SEQ ID NO: 98827 - protein, 33 aa, Artificial Sequence
  Description of Artificial Sequence: Synthetic polypeptide
FEEEIRTTNPVATEQYGSVTDNNGLEGDEGGNQ

SEQ ID NO: 98828 - protein, 33 aa, Artificial Sequence
  Description of Artificial Sequence: Synthetic polypeptide
DEEEIRTTNPVATEQYGSVSPAIAVQALMVNHE

SEQ ID NO: 98829 - protein, 34 aa, Artificial Sequence
  Description of Artificial Sequence: Synthetic polypeptide
DEEEIRTTNPVATEQYGSVIGPTLQEQEPENNRF

SEQ ID NO: 98830 - protein, 33 aa, Artificial Sequence
  Description of Artificial Sequence: Synthetic polypeptide
DEEEIACTNPVATEQYGSVATGNPDLSEHNTRV

SEQ ID NO: 98831 - protein, 30 aa, Artificial Sequence
  Description of Artificial Sequence: Synthetic polypeptide
IETEIACTNPVATEQYGCASANLQEDGGQR

SEQ ID NO: 98832 - protein, 33 aa, Artificial Sequence
  Description of Artificial Sequence: Synthetic polypeptide
AEEEIRTTNPVATEQYGSVVVVTTDTNQIGTNL

SEQ ID NO: 98833 - protein, 33 aa, Artificial Sequence
  Description of Artificial Sequence: Synthetic polypeptide
AEEEIRTTNPVATEQYGSVVTTTNMQGTNNVTE

SEQ ID NO: 98834 - protein, 33 aa, Artificial Sequence
  Description of Artificial Sequence: Synthetic polypeptide
DSEEIATTNPVAYEPYGQSIISTNLSQRVTNRN

SEQ ID NO: 98835 - protein, 30 aa, Artificial Sequence
  Description of Artificial Sequence: Synthetic polypeptide
AENEIACTNPVATEQYGEASENLQHTGEGR

SEQ ID NO: 98836 - protein, 33 aa, Artificial Sequence
  Description of Artificial Sequence: Synthetic polypeptide
NEEEIRTTNPVAYEQWGCSYNSRNDLDQRGHGR

SEQ ID NO: 98837 - protein, 28 aa, Artificial Sequence
  Description of Artificial Sequence: Synthetic peptide
QEEEIASTNPVATECYGDVSECLQHEEL

SEQ ID NO: 98838 - protein, 33 aa, Artificial Sequence
  Description of Artificial Sequence: Synthetic polypeptide
DEEAIRTTNPVATEQYGSCSPTYNEHTGNELDE

SEQ ID NO: 98839 - protein, 33 aa, Artificial Sequence
  Description of Artificial Sequence: Synthetic polypeptide
DEEAIRTTNPVATEQYGSGVPTMNEHTGNELDE

SEQ ID NO: 98840 - protein, 28 aa, Artificial Sequence
  Description of Artificial Sequence: Synthetic peptide
QEEEIASTNPVATECYGDVSDCLQHEEL

SEQ ID NO: 98841 - protein, 33 aa, Artificial Sequence
  Description of Artificial Sequence: Synthetic polypeptide
NEEEIRTTNPVAYEQFGSTISCTHLSQRQGGNA

SEQ ID NO: 98842 - protein, 32 aa, Artificial Sequence
  Description of Artificial Sequence: Synthetic polypeptide
DEEEIRTTNPVATEQYGSVMNGFNGDGGFGTG

SEQ ID NO: 98843 - protein, 34 aa, Artificial Sequence
  Description of Artificial Sequence: Synthetic polypeptide
DEEEIRTTNPVATEQYGSVSPAHLLQQRQVDEDL

SEQ ID NO: 98844 - protein, 33 aa, Artificial Sequence
  Description of Artificial Sequence: Synthetic polypeptide
AEEEIRTTNPVATEQYGSVVTTNQLGGNNQNDD

SEQ ID NO: 98845 - protein, 34 aa, Artificial Sequence
  Description of Artificial Sequence: Synthetic polypeptide
AEEEIRTTNPVATEQYGSVVTTNQLGGNQGTNDN

SEQ ID NO: 98846 - protein, 33 aa, Artificial Sequence
  Description of Artificial Sequence: Synthetic polypeptide
AEEEIRTTNPVATEQYGSVVVVTTDNQNIGTNL

SEQ ID NO: 98847 - protein, 30 aa, Artificial Sequence
  Description of Artificial Sequence: Synthetic polypeptide
DSEDIACTNPVATEQYGCVATNHQRDSNSM

SEQ ID NO: 98848 - protein, 35 aa, Artificial Sequence
  Description of Artificial Sequence: Synthetic polypeptide
DEEEIRTTNPVATEQYGSVMTDNEMTDIQGGGNGI

SEQ ID NO: 98849 - protein, 34 aa, Artificial Sequence
  Description of Artificial Sequence: Synthetic polypeptide
AEEEIRTTNPVATEQYGSVVVVTTDNQQIGNNLE

SEQ ID NO: 98850 - protein, 28 aa, Artificial Sequence
  Description of Artificial Sequence: Synthetic peptide
QEEEIASVNPVCTEQYGEASDNLQSGEK

SEQ ID NO: 98851 - protein, 34 aa, Artificial Sequence
  Description of Artificial Sequence: Synthetic polypeptide
AEEEIRTTNPVATEQYGSVVVVTTDNQQIGTNNL

SEQ ID NO: 98852 - protein, 34 aa, Artificial Sequence
  Description of Artificial Sequence: Synthetic polypeptide
AEEEIRTTNPVATEQYGSVVTTNQLGGNEEGNNE

SEQ ID NO: 98853 - protein, 33 aa, Artificial Sequence
  Description of Artificial Sequence: Synthetic polypeptide
DEEEIRTTNPVATEQYGSVSPAEEQEREEDTEM

SEQ ID NO: 98854 - protein, 34 aa, Artificial Sequence
  Description of Artificial Sequence: Synthetic polypeptide
AEEEIRTTNPVATEQYGSVVVVTTDNQQQGTNLG

SEQ ID NO: 98855 - protein, 34 aa, Artificial Sequence
  Description of Artificial Sequence: Synthetic polypeptide
DEEEIRTTNPVATEQYGSVIFTTTLQQPPQGEFA

SEQ ID NO: 98856 - protein, 33 aa, Artificial Sequence
  Description of Artificial Sequence: Synthetic polypeptide
DEEEIRTTNPVATEQYGSVPPANVQTYGFIEVT

SEQ ID NO: 98857 - protein, 34 aa, Artificial Sequence
  Description of Artificial Sequence: Synthetic polypeptide
AEEEIRTTNPVATEQYGSVVVVTTDQNQQIGNNL

SEQ ID NO: 98858 - protein, 35 aa, Artificial Sequence
  Description of Artificial Sequence: Synthetic polypeptide
AEEEIRTTNPVATEQYGSVVTTTNGNLQQGTNQIN

SEQ ID NO: 98859 - protein, 30 aa, Artificial Sequence
  Description of Artificial Sequence: Synthetic polypeptide
DSEDIATTNPVATEQYGCVATNHQPDSNED

SEQ ID NO: 98860 - protein, 32 aa, Artificial Sequence
  Description of Artificial Sequence: Synthetic polypeptide
DQAEIRTTNPVATEQYGCCSTPDLQHFGSNQS

SEQ ID NO: 98861 - protein, 32 aa, Artificial Sequence
  Description of Artificial Sequence: Synthetic polypeptide
DQAEIRTTNPVATEQYGCCSTMALQHFGSNQS

SEQ ID NO: 98862 - protein, 33 aa, Artificial Sequence
  Description of Artificial Sequence: Synthetic polypeptide
DEEEIRTTNPVATEQYGSVSNNTNDDIEMVVVV

SEQ ID NO: 98863 - protein, 31 aa, Artificial Sequence
  Description of Artificial Sequence: Synthetic polypeptide
DSEEIATTNPVAYTQWGSTVSTNPSMRGGNK

SEQ ID NO: 98864 - protein, 29 aa, Artificial Sequence
  Description of Artificial Sequence: Synthetic peptide
DEEEIATTNPVATEGYGEAAEVIQSREQR

SEQ ID NO: 98865 - protein, 28 aa, Artificial Sequence
  Description of Artificial Sequence: Synthetic peptide
IENEIATTNPVATECYGDVSDCLQHEEL

SEQ ID NO: 98866 - protein, 28 aa, Artificial Sequence
  Description of Artificial Sequence: Synthetic peptide
QEEEIASVNPCSSEQYGIVSCNLQSGTR

SEQ ID NO: 98867 - protein, 31 aa, Artificial Sequence
  Description of Artificial Sequence: Synthetic polypeptide
DEEEIRTTNPVATEQYGSVMYAEDHDEGEFP

SEQ ID NO: 98868 - protein, 32 aa, Artificial Sequence
  Description of Artificial Sequence: Synthetic polypeptide
NEEEIRTTNPVATEQYGSVSADVLDEFIFNQH

SEQ ID NO: 98869 - protein, 32 aa, Artificial Sequence
  Description of Artificial Sequence: Synthetic polypeptide
NETEIATTNPVATECWGSVSTNLQGNEGNEDS

SEQ ID NO: 98870 - protein, 36 aa, Artificial Sequence
  Description of Artificial Sequence: Synthetic polypeptide
DEEEIRTTNPVATEQYGSVSNTWLGMQEQVGENPNS

SEQ ID NO: 98871 - protein, 33 aa, Artificial Sequence
  Description of Artificial Sequence: Synthetic polypeptide
GCNEIATTNPVATEQYGSVSTTNLQDTMGGNED

SEQ ID NO: 98872 - protein, 32 aa, Artificial Sequence
  Description of Artificial Sequence: Synthetic polypeptide
NETEIATTNPVATECYGNVSTNLQGQMGGDDR

SEQ ID NO: 98873 - protein, 28 aa, Artificial Sequence
  Description of Artificial Sequence: Synthetic peptide
QEEEIASVNPVATECYGDVSDCLQSGEL

SEQ ID NO: 98874 - protein, 33 aa, Artificial Sequence
  Description of Artificial Sequence: Synthetic polypeptide
NETEIATTNPVATECYGSVSTNLNQGNEGGDDR

SEQ ID NO: 98875 - protein, 33 aa, Artificial Sequence
  Description of Artificial Sequence: Synthetic polypeptide
FEEEIRTTNPVATEQYGVVDGTTNGQGTGNENI

SEQ ID NO: 98876 - protein, 31 aa, Artificial Sequence
  Description of Artificial Sequence: Synthetic polypeptide
DQAEIRTTNPVATEQYGCSSTALQHFGSDQS

SEQ ID NO: 98877 - protein, 31 aa, Artificial Sequence
  Description of Artificial Sequence: Synthetic polypeptide
DQAEIRTTNPVATEQYGCCTSTPHQHFGSNQ

SEQ ID NO: 98878 - protein, 30 aa, Artificial Sequence
  Description of Artificial Sequence: Synthetic polypeptide
DSADIACTNPVATEQYGCVSTNHQRDSMND

SEQ ID NO: 98879 - protein, 29 aa, Artificial Sequence
  Description of Artificial Sequence: Synthetic peptide
AENEIACTNPVATEQYGEASENLQDLGGS

SEQ ID NO: 98880 - protein, 33 aa, Artificial Sequence
  Description of Artificial Sequence: Synthetic polypeptide
NETEIATTNPVATECYGSVSTNLNQGNEGGNSD

SEQ ID NO: 98881 - protein, 30 aa, Artificial Sequence
  Description of Artificial Sequence: Synthetic polypeptide
DSADIACTNPVATEQYGCVSTNHQRDSNGN

SEQ ID NO: 98882 - protein, 35 aa, Artificial Sequence
  Description of Artificial Sequence: Synthetic polypeptide
DEEEIRTTNPVATEQYGSVSNTYNLEEPAPQVEEE

SEQ ID NO: 98883 - protein, 29 aa, Artificial Sequence
  Description of Artificial Sequence: Synthetic peptide
AENEIACTNPVATEQYGEASENLQCGGVI

SEQ ID NO: 98884 - protein, 28 aa, Artificial Sequence
  Description of Artificial Sequence: Synthetic peptide
QEEEIASVNPCCTEQYGIVSDNLQSGTQ

SEQ ID NO: 98885 - protein, 31 aa, Artificial Sequence
  Description of Artificial Sequence: Synthetic polypeptide
QEEEIATTNPVATEQYGSVPATVLEDHGEDL

SEQ ID NO: 98886 - protein, 28 aa, Artificial Sequence
  Description of Artificial Sequence: Synthetic peptide
DEEEIATTNPVATEQYGEVPEICMHEEK

SEQ ID NO: 98887 - protein, 32 aa, Artificial Sequence
  Description of Artificial Sequence: Synthetic polypeptide
NEEEIRTTNPVATEQYGSVSADVLPDEFSFNQ

SEQ ID NO: 98888 - protein, 36 aa, Artificial Sequence
  Description of Artificial Sequence: Synthetic polypeptide
DEEEIRTTNPVATEQYGSVSNTDNMDQQGGGETNTT

SEQ ID NO: 98889 - protein, 33 aa, Artificial Sequence
  Description of Artificial Sequence: Synthetic polypeptide
DEEEIRTTNPVATEQYGSVMVTASMETGFENQD

SEQ ID NO: 98890 - protein, 33 aa, Artificial Sequence
  Description of Artificial Sequence: Synthetic polypeptide
DREEELIRTTNPVAYEQYGWVASTNELMSPNQE

SEQ ID NO: 98891 - protein, 36 aa, Artificial Sequence
  Description of Artificial Sequence: Synthetic polypeptide
DEEEIRTTNPVATEQYGSVSNTDNMDQEGGTTNQEE

SEQ ID NO: 98892 - protein, 33 aa, Artificial Sequence
  Description of Artificial Sequence: Synthetic polypeptide
DEEEIATTNPVATEQYGEVSSTPVGNMRNGMNV

SEQ ID NO: 98893 - protein, 30 aa, Artificial Sequence
  Description of Artificial Sequence: Synthetic polypeptide
DEEEIATTNPVATEQYGEVSEVEQNHAEDK

SEQ ID NO: 98894 - protein, 30 aa, Artificial Sequence
  Description of Artificial Sequence: Synthetic polypeptide
DEEEIATTNPVATEQYGEVSEVEQNAAEDA

SEQ ID NO: 98895 - protein, 32 aa, Artificial Sequence
  Description of Artificial Sequence: Synthetic polypeptide
DEEAIRTTNPVATEQWGCVCGTNNPQGGSNQA

SEQ ID NO: 98896 - protein, 34 aa, Artificial Sequence
  Description of Artificial Sequence: Synthetic polypeptide
DEEEIRTTNPVATEQYGSVIEPTTGHMQENGNLF

SEQ ID NO: 98897 - protein, 32 aa, Artificial Sequence
  Description of Artificial Sequence: Synthetic polypeptide
DEEAIRTTNPVATEQWGCVCGTNEPQSFGSNQ

SEQ ID NO: 98898 - protein, 28 aa, Artificial Sequence
  Description of Artificial Sequence: Synthetic peptide
DEEEIATTNPVATEQYGEVPEVCMHEEK

SEQ ID NO: 98899 - protein, 34 aa, Artificial Sequence
  Description of Artificial Sequence: Synthetic polypeptide
DEEEIRTTNPVATEQYGSVIETNMQIVANEVEFL

SEQ ID NO: 98900 - protein, 34 aa, Artificial Sequence
  Description of Artificial Sequence: Synthetic polypeptide
DEEEIRTTNPVATEQYGSVMSDDNEGQEEDNDQG

SEQ ID NO: 98901 - protein, 28 aa, Artificial Sequence
  Description of Artificial Sequence: Synthetic peptide
QEEEIATTNPVSTEQYGEAPEVCQHGER

SEQ ID NO: 98902 - protein, 33 aa, Artificial Sequence
  Description of Artificial Sequence: Synthetic polypeptide
AEEEIRTTNPVAYEAYGISVPLCTGNGSQRGNT

SEQ ID NO: 98903 - protein, 28 aa, Artificial Sequence
  Description of Artificial Sequence: Synthetic peptide
QEEEIAPTNPCATEQYGEVPEVLQHGTK

SEQ ID NO: 98904 - protein, 33 aa, Artificial Sequence
  Description of Artificial Sequence: Synthetic polypeptide
DEEEIATTNPVATEHYGCVVSGDNGENRGGNNR

SEQ ID NO: 98905 - protein, 32 aa, Artificial Sequence
  Description of Artificial Sequence: Synthetic polypeptide
DEEEIATTNPVATEQYGEVSATDLEDHEGEDL

SEQ ID NO: 98906 - protein, 36 aa, Artificial Sequence
  Description of Artificial Sequence: Synthetic polypeptide
NEEEIRTTNPVATEQYGSVNSSTMELDQRGQGGDNG

SEQ ID NO: 98907 - protein, 33 aa, Artificial Sequence
  Description of Artificial Sequence: Synthetic polypeptide
FEEEIRTTNPVATEQYGTVSGDDNGQSEGGENI

SEQ ID NO: 98908 - protein, 32 aa, Artificial Sequence
  Description of Artificial Sequence: Synthetic polypeptide
IEEEIRTTNPVATEQYGSVWTDDTNNGFENNM

SEQ ID NO: 98909 - protein, 35 aa, Artificial Sequence
  Description of Artificial Sequence: Synthetic polypeptide
DEEEIRTTNPVATEQYGSVPTNMMSLEPQNENDQV

SEQ ID NO: 98910 - protein, 31 aa, Artificial Sequence
  Description of Artificial Sequence: Synthetic polypeptide
DSAEIRTTNPVAYEQYGCCSTVLSQHTGGNE

SEQ ID NO: 98911 - protein, 32 aa, Artificial Sequence
  Description of Artificial Sequence: Synthetic polypeptide
FEEEIRTTNPVATEQYGSVVPTNLTEVIPQDN

SEQ ID NO: 98912 - protein, 34 aa, Artificial Sequence
  Description of Artificial Sequence: Synthetic polypeptide
DEEEIRTTNPVATEQYGSVSNSNLNENQSVAEDN

SEQ ID NO: 98913 - protein, 35 aa, Artificial Sequence
  Description of Artificial Sequence: Synthetic polypeptide
NEEEIRTTNPVATEQYGSVPSCAGNALSDEFGGNR

SEQ ID NO: 98914 - protein, 33 aa, Artificial Sequence
  Description of Artificial Sequence: Synthetic polypeptide
DSAEIRTTNPVAYEQYGSTVCNTNMLSQTGMRT

SEQ ID NO: 98915 - protein, 34 aa, Artificial Sequence
  Description of Artificial Sequence: Synthetic polypeptide
DEEEIRTTNPVATEQYGSVSNVNDIMQGGEEDEE

SEQ ID NO: 98916 - protein, 34 aa, Artificial Sequence
  Description of Artificial Sequence: Synthetic polypeptide
DEEEIRTTNPVATEQYGSVSCTMNMVPEVLENIE

SEQ ID NO: 98917 - protein, 35 aa, Artificial Sequence
  Description of Artificial Sequence: Synthetic polypeptide
DEEEIRTTNPVATEQYGSVSNSNFLGQVDFENAEE

SEQ ID NO: 98918 - protein, 28 aa, Artificial Sequence
  Description of Artificial Sequence: Synthetic peptide
QEEEIASVNPVCSEQYGIVSCNLQSGTQ

SEQ ID NO: 98919 - protein, 33 aa, Artificial Sequence
  Description of Artificial Sequence: Synthetic polypeptide
DEEEIRTTNPVATEQYGSVMNTFNNGGGFGTDG

SEQ ID NO: 98920 - protein, 31 aa, Artificial Sequence
  Description of Artificial Sequence: Synthetic polypeptide
DQAEIRTTNPVATEQYGCCSTVLQGDQNDEV

SEQ ID NO: 98921 - protein, 34 aa, Artificial Sequence
  Description of Artificial Sequence: Synthetic polypeptide
NEEEIRTTNPVATEQYGSVNYVTNHDRIGENNQH

SEQ ID NO: 98922 - protein, 33 aa, Artificial Sequence
  Description of Artificial Sequence: Synthetic polypeptide
DEEEIRTTNPVATEQYGSVMNTFNGGGFGVTSE

SEQ ID NO: 98923 - protein, 28 aa, Artificial Sequence
  Description of Artificial Sequence: Synthetic peptide
IENEIATTNPVATECYGCVSECLQHMEL

SEQ ID NO: 98924 - protein, 34 aa, Artificial Sequence
  Description of Artificial Sequence: Synthetic polypeptide
DEEAIRTTNPVATEQYGCVCSNTNLQENFGSEQL

SEQ ID NO: 98925 - protein, 29 aa, Artificial Sequence
  Description of Artificial Sequence: Synthetic peptide
DEEEIATTNPVATEGYGEAPEVIQSREQR

SEQ ID NO: 98926 - protein, 35 aa, Artificial Sequence
  Description of Artificial Sequence: Synthetic polypeptide
FEEEIRTTNPVATEQYGSVVQSTGDNGQRFQGQDQ

SEQ ID NO: 98927 - protein, 31 aa, Artificial Sequence
  Description of Artificial Sequence: Synthetic polypeptide
DSAEIRTTNPVAYEQWGCCSTVALQHGGNNR

SEQ ID NO: 98928 - protein, 34 aa, Artificial Sequence
  Description of Artificial Sequence: Synthetic polypeptide
DEEEIRTTNPVATEQYGSVPTNMEQATPGLEEMD

SEQ ID NO: 98929 - protein, 33 aa, Artificial Sequence
  Description of Artificial Sequence: Synthetic polypeptide
NEEEIRTTNPVATEQYGSVQTLLDSIESDQENR

SEQ ID NO: 98930 - protein, 33 aa, Artificial Sequence
  Description of Artificial Sequence: Synthetic polypeptide
FEEEIRTTNPVATEQYGSVYTGNMVDGLDEGGE

SEQ ID NO: 98931 - protein, 28 aa, Artificial Sequence
  Description of Artificial Sequence: Synthetic peptide
HENEIATTNPVATESYGDVSECLQHEEL

SEQ ID NO: 98932 - protein, 32 aa, Artificial Sequence
  Description of Artificial Sequence: Synthetic polypeptide
NETEIATTNPVATECYGSVSTNLQGNEQNEDH

SEQ ID NO: 98933 - protein, 32 aa, Artificial Sequence
  Description of Artificial Sequence: Synthetic polypeptide
DEEAIRTTNPVATEQWGCVCGWGNLQHGSNQS

SEQ ID NO: 98934 - protein, 31 aa, Artificial Sequence
  Description of Artificial Sequence: Synthetic polypeptide
AENEIACTNPVATEQYGEAPSENMLQRGGGR

SEQ ID NO: 98935 - protein, 28 aa, Artificial Sequence
  Description of Artificial Sequence: Synthetic peptide
DEEEIATTNPVATEQYGEVPEICMAEEK

SEQ ID NO: 98936 - protein, 35 aa, Artificial Sequence
  Description of Artificial Sequence: Synthetic polypeptide
AEEEIRTTNPVATEQYGSVVVTTTNGNLQQGTNID

SEQ ID NO: 98937 - protein, 35 aa, Artificial Sequence
  Description of Artificial Sequence: Synthetic polypeptide
DEEEIRTTNPVATEQYGSVSCTMPLVADVGQFSRN

SEQ ID NO: 98938 - protein, 33 aa, Artificial Sequence
  Description of Artificial Sequence: Synthetic polypeptide
DEEEIATTNPVATEHWGAVCSTNDNHQRGENDD

SEQ ID NO: 98939 - protein, 34 aa, Artificial Sequence
  Description of Artificial Sequence: Synthetic polypeptide
DEEEIRTTNPVATEQYGSVSNTDGDGQEEEENFG

SEQ ID NO: 98940 - protein, 34 aa, Artificial Sequence
  Description of Artificial Sequence: Synthetic polypeptide
FEEEIRTTNPVATEQYGSVYTGNGQQTGGNTGTG

SEQ ID NO: 98941 - protein, 33 aa, Artificial Sequence
  Description of Artificial Sequence: Synthetic polypeptide
DEEAIRTTNPVATEQWGYSTVSTGLIQDVGKED

SEQ ID NO: 98942 - protein, 33 aa, Artificial Sequence
  Description of Artificial Sequence: Synthetic polypeptide
DSAEIRTTNPVATEQYGCTCQSTVLSQHGGNNR

SEQ ID NO: 98943 - protein, 35 aa, Artificial Sequence
  Description of Artificial Sequence: Synthetic polypeptide
DEEEIRTTNPVATEQYGSVMGTDFNIQNEEGNEQG

SEQ ID NO: 98944 - protein, 34 aa, Artificial Sequence
  Description of Artificial Sequence: Synthetic polypeptide
DEEEIRTTNPVATEQYGSVSNVDDFQGQEGGNED

SEQ ID NO: 98945 - protein, 34 aa, Artificial Sequence
  Description of Artificial Sequence: Synthetic polypeptide
DEEEIRTTNPVATEQYGSVSNSNVQMVNGFVLQT

SEQ ID NO: 98946 - protein, 31 aa, Artificial Sequence
  Description of Artificial Sequence: Synthetic polypeptide
DQAEIRTTNPVATEQYGCCSTVLQMSQEDRV

SEQ ID NO: 98947 - protein, 28 aa, Artificial Sequence
  Description of Artificial Sequence: Synthetic peptide
QEEEIASVNPVATEQYGVVPEVLQHGEQ

SEQ ID NO: 98948 - protein, 33 aa, Artificial Sequence
  Description of Artificial Sequence: Synthetic polypeptide
DEEAIRTTNPVATEQWGSVVFSRTEAQWGMNMG

SEQ ID NO: 98949 - protein, 34 aa, Artificial Sequence
  Description of Artificial Sequence: Synthetic polypeptide
DEEEIRTTNPVATEQYGSVMSDDNGGQEEDNIGG

SEQ ID NO: 98950 - protein, 32 aa, Artificial Sequence
  Description of Artificial Sequence: Synthetic polypeptide
DEEEIACTNPVATEQYGSVATNDDTDAPPENR

SEQ ID NO: 98951 - protein, 32 aa, Artificial Sequence
  Description of Artificial Sequence: Synthetic polypeptide
DEEEIACTNPVATEQYGSVATNGLEATANQEF

SEQ ID NO: 98952 - protein, 35 aa, Artificial Sequence
  Description of Artificial Sequence: Synthetic polypeptide
DEEEIRTTNPVATEQYGSVSNNDVMDQDEMGNGDD

SEQ ID NO: 98953 - protein, 35 aa, Artificial Sequence
  Description of Artificial Sequence: Synthetic polypeptide
AEEEIRTTNPVATEQYGSVVVTVNLQSNEQGSNNN

SEQ ID NO: 98954 - protein, 33 aa, Artificial Sequence
  Description of Artificial Sequence: Synthetic polypeptide
DSEEIRSTNPVATEPYGSVVSTANLSQNTGGTQ

SEQ ID NO: 98955 - protein, 32 aa, Artificial Sequence
  Description of Artificial Sequence: Synthetic polypeptide
DEEAIRTTNPVATEQYRYCVSIEDLQRGDGQQ

SEQ ID NO: 98956 - protein, 31 aa, Artificial Sequence
  Description of Artificial Sequence: Synthetic polypeptide
NEEEIRTTNPVAYEQWGSVYKQLEQTNGDER

SEQ ID NO: 98957 - protein, 35 aa, Artificial Sequence
  Description of Artificial Sequence: Synthetic polypeptide
DEEEIRTTNPVATEQYGSVPSIPPPGLPERVGVNP

SEQ ID NO: 98958 - protein, 33 aa, Artificial Sequence
  Description of Artificial Sequence: Synthetic polypeptide
DEEEIRTTNPVATEQYGSVSNNDPDDTRVIDEY

SEQ ID NO: 98959 - protein, 31 aa, Artificial Sequence
  Description of Artificial Sequence: Synthetic polypeptide
NEEEIRTTNPVAYEQWGTYVYTDQLDREGNS

SEQ ID NO: 98960 - protein, 33 aa, Artificial Sequence
  Description of Artificial Sequence: Synthetic polypeptide
QEEEIACTNPVATEQYGSVATNLQEAPGGNVDF

SEQ ID NO: 98961 - protein, 35 aa, Artificial Sequence
  Description of Artificial Sequence: Synthetic polypeptide
DEEEIRTTNPVATEQYGSVSNNDNMDQGTGETNNG

SEQ ID NO: 98962 - protein, 30 aa, Artificial Sequence
  Description of Artificial Sequence: Synthetic polypeptide
AENEIACTNPVATEQYGEASEDNPQREGGR

SEQ ID NO: 98963 - protein, 28 aa, Artificial Sequence
  Description of Artificial Sequence: Synthetic peptide
QEEEIATTNPVATEQYGSAPEVCQHEEM

SEQ ID NO: 98964 - protein, 28 aa, Artificial Sequence
  Description of Artificial Sequence: Synthetic peptide
QEEEIATTNPVATEQYGSAPEVCQHEEK

SEQ ID NO: 98965 - protein, 29 aa, Artificial Sequence
  Description of Artificial Sequence: Synthetic peptide
QEEEIATTNPVATEQYGSAPEVCPQHENK

SEQ ID NO: 98966 - protein, 34 aa, Artificial Sequence
  Description of Artificial Sequence: Synthetic polypeptide
AEEEIRTTNPVATEQYGVVVVVTNLQQNEEGNQG

SEQ ID NO: 98967 - protein, 34 aa, Artificial Sequence
  Description of Artificial Sequence: Synthetic polypeptide
DEEAIRTTNPVATERYGKTVYSQNLSQNTGGNNR

SEQ ID NO: 98968 - protein, 30 aa, Artificial Sequence
  Description of Artificial Sequence: Synthetic polypeptide
AENEIACTNPVATEQYGDVSENEQNAAGGR

SEQ ID NO: 98969 - protein, 35 aa, Artificial Sequence
  Description of Artificial Sequence: Synthetic polypeptide
AEEEIRTTNPVATEQYGSVVTTVNNLQSNEQGNNT

SEQ ID NO: 98970 - protein, 32 aa, Artificial Sequence
  Description of Artificial Sequence: Synthetic polypeptide
DEEAIRTTNPVATEQYRYCVSEVLQREGDGEQ

SEQ ID NO: 98971 - protein, 31 aa, Artificial Sequence
  Description of Artificial Sequence: Synthetic polypeptide
DQAEIRTTNPVATEQYGCCCSNTELQHFGQQ

SEQ ID NO: 98972 - protein, 34 aa, Artificial Sequence
  Description of Artificial Sequence: Synthetic polypeptide
DEEEIRTTNPVATEQYGSVSNNENVESIGQENYE

SEQ ID NO: 98973 - protein, 30 aa, Artificial Sequence
  Description of Artificial Sequence: Synthetic polypeptide
DEECISTVNPVATEAYGCVSWNLEGFGSNQ

SEQ ID NO: 98974 - protein, 28 aa, Artificial Sequence
  Description of Artificial Sequence: Synthetic peptide
QEEEIASVNPVCTEQYGVVPDNLQHGEQ

SEQ ID NO: 98975 - protein, 35 aa, Artificial Sequence
  Description of Artificial Sequence: Synthetic polypeptide
FEEEIRTTNPVATEQYGSVSTTMNGQDQGGENGGE

SEQ ID NO: 98976 - protein, 30 aa, Artificial Sequence
  Description of Artificial Sequence: Synthetic polypeptide
AENEIACTNPVATEQYGEAASENNQRGQRG

SEQ ID NO: 98977 - protein, 34 aa, Artificial Sequence
  Description of Artificial Sequence: Synthetic polypeptide
DEEEIRTTNPVATEQYGSVNDTAMGDQGGNQGNN

SEQ ID NO: 98978 - protein, 31 aa, Artificial Sequence
  Description of Artificial Sequence: Synthetic polypeptide
QEEEIATTNPVATEQYGSASSEPAGQMRENK

SEQ ID NO: 98979 - protein, 34 aa, Artificial Sequence
  Description of Artificial Sequence: Synthetic polypeptide
DEEEIRTTNPVATEQYGSVNENMQTDQGEGGNDG

SEQ ID NO: 98980 - protein, 34 aa, Artificial Sequence
  Description of Artificial Sequence: Synthetic polypeptide
DEEEIRTTNPVATEQYGSVPWTNLEQATVLEESD

SEQ ID NO: 98981 - protein, 31 aa, Artificial Sequence
  Description of Artificial Sequence: Synthetic polypeptide
AENEIACTNPVATEQYGDASHENLQDRGMGR

SEQ ID NO: 98982 - protein, 30 aa, Artificial Sequence
  Description of Artificial Sequence: Synthetic polypeptide
AENEIACTNPVATEQYGEAAENLQRGGVRI

SEQ ID NO: 98983 - protein, 34 aa, Artificial Sequence
  Description of Artificial Sequence: Synthetic polypeptide
DEEEIRTTNPVATEQYGSVNEPTFLLIGEVGTLR

SEQ ID NO: 98984 - protein, 33 aa, Artificial Sequence
  Description of Artificial Sequence: Synthetic polypeptide
DEEAIRTTNPVATEQYNSSFVSINQQIQQDNRD

SEQ ID NO: 98985 - protein, 31 aa, Artificial Sequence
  Description of Artificial Sequence: Synthetic polypeptide
DEEAIRTTNPVATEQYRYACVSEVLQNGDGQ

SEQ ID NO: 98986 - protein, 35 aa, Artificial Sequence
  Description of Artificial Sequence: Synthetic polypeptide
AEEEIRTTNPVATEQYGSVVVVTTNLQQGIQTNVE

SEQ ID NO: 98987 - protein, 32 aa, Artificial Sequence
  Description of Artificial Sequence: Synthetic polypeptide
DEEAIRTTNPVATEQYRYCVKSEALQRGDGQQ

SEQ ID NO: 98988 - protein, 35 aa, Artificial Sequence
  Description of Artificial Sequence: Synthetic polypeptide
AEEEIRTTNPVATEQYGSVVVTVNLQSNEQGNVNE

SEQ ID NO: 98989 - protein, 32 aa, Artificial Sequence
  Description of Artificial Sequence: Synthetic polypeptide
DSEEIRSTNPVATEHWGSVVSTNLSQNTGGTQ

SEQ ID NO: 98990 - protein, 32 aa, Artificial Sequence
  Description of Artificial Sequence: Synthetic polypeptide
DEEEIRTTNPVATEQYGSVPWTPIQTLVEVVT

SEQ ID NO: 98991 - protein, 33 aa, Artificial Sequence
  Description of Artificial Sequence: Synthetic polypeptide
DEEEIRTTNPVATEQYGSVPPFGNEQIMQVLER

SEQ ID NO: 98992 - protein, 31 aa, Artificial Sequence
  Description of Artificial Sequence: Synthetic polypeptide
NETEIATTNPVATEMWGSVSTNLNGNDGNTD

SEQ ID NO: 98993 - protein, 28 aa, Artificial Sequence
  Description of Artificial Sequence: Synthetic peptide
GENEIATTNPVATECYGDVSECLQHEEL

SEQ ID NO: 98994 - protein, 28 aa, Artificial Sequence
  Description of Artificial Sequence: Synthetic peptide
QEEEIASVNPVCTEQYGVVPDNLQSGEQ

SEQ ID NO: 98995 - protein, 28 aa, Artificial Sequence
  Description of Artificial Sequence: Synthetic peptide
QEEEIASVNPVCTEQYGVVSECLQHENQ

SEQ ID NO: 98996 - protein, 33 aa, Artificial Sequence
  Description of Artificial Sequence: Synthetic polypeptide
DEEEIATTNPVATECYGSVSTPAGNMHNGMNPL

SEQ ID NO: 98997 - protein, 35 aa, Artificial Sequence
  Description of Artificial Sequence: Synthetic polypeptide
DEEEIRTTNPVATEQYGSVSNMNLLVNETGGENGD

SEQ ID NO: 98998 - protein, 33 aa, Artificial Sequence
  Description of Artificial Sequence: Synthetic polypeptide
DEEEIRTTNPVATEQYGSVIGPTVNLIPTEIED

SEQ ID NO: 98999 - protein, 33 aa, Artificial Sequence
  Description of Artificial Sequence: Synthetic polypeptide
DSEEIRSTNPVATEQYGSVVATNLSQYNTGGTQ

SEQ ID NO: 99000 - protein, 36 aa, Artificial Sequence
  Description of Artificial Sequence: Synthetic polypeptide
DEEEIRTTNPVATEQYGSVPSEPPPLQIRVGVNDPP

SEQ ID NO: 99001 - protein, 34 aa, Artificial Sequence
  Description of Artificial Sequence: Synthetic polypeptide
DEEEIRTTNPVATEQYGSVIGPTVNLIRDEIEVD

SEQ ID NO: 99002 - protein, 35 aa, Artificial Sequence
  Description of Artificial Sequence: Synthetic polypeptide
FEEEIRTTNPVATEQYGSVSTTDNGLGQEQGGGED

SEQ ID NO: 99003 - protein, 35 aa, Artificial Sequence
  Description of Artificial Sequence: Synthetic polypeptide
AEEEIRTTNPVATEQYGSVVVVTTNLQQGNGNGTE

SEQ ID NO: 99004 - protein, 34 aa, Artificial Sequence
  Description of Artificial Sequence: Synthetic polypeptide
DEEEIRTTNPVATEQYGSVIGPTVNLMIVGEIED

SEQ ID NO: 99005 - protein, 29 aa, Artificial Sequence
  Description of Artificial Sequence: Synthetic peptide
AENEIACTNPVATEQYGCYCSWNLQYGQQ

SEQ ID NO: 99006 - protein, 31 aa, Artificial Sequence
  Description of Artificial Sequence: Synthetic polypeptide
DQAEICTTNPVATEQYGSVSWNIERENTQFE

SEQ ID NO: 99007 - protein, 34 aa, Artificial Sequence
  Description of Artificial Sequence: Synthetic polypeptide
AEEEIRTTNPVATEQYGVVVVTTNLQQQEGNQQG

SEQ ID NO: 99008 - protein, 28 aa, Artificial Sequence
  Description of Artificial Sequence: Synthetic peptide
QEEEIASVNPVCTEQYGVVSECLQSENQ

SEQ ID NO: 99009 - protein, 30 aa, Artificial Sequence
  Description of Artificial Sequence: Synthetic polypeptide
AENEIACTNPVATEQYGCYCSWNLQRSGGQ

SEQ ID NO: 99010 - protein, 35 aa, Artificial Sequence
  Description of Artificial Sequence: Synthetic polypeptide
AEEEIRTTNPVATEQYGSVVVVTTNLQQGNGNNTD

SEQ ID NO: 99011 - protein, 31 aa, Artificial Sequence
  Description of Artificial Sequence: Synthetic polypeptide
AENEIACTNPVATEQYGCYCSWNLQRGSGNQ

SEQ ID NO: 99012 - protein, 36 aa, Artificial Sequence
  Description of Artificial Sequence: Synthetic polypeptide
FEEEIRTTNPVATEQYGSVSTTDNGLGQEQGQGGNE

SEQ ID NO: 99013 - protein, 28 aa, Artificial Sequence
  Description of Artificial Sequence: Synthetic peptide
QEEEIASVNPVCTEQYGVVSECLQHENL

SEQ ID NO: 99014 - protein, 33 aa, Artificial Sequence
  Description of Artificial Sequence: Synthetic polypeptide
FEEEIRTTNPVATEQYGSVSTTGLTGMGGQGIT

SEQ ID NO: 99015 - protein, 33 aa, Artificial Sequence
  Description of Artificial Sequence: Synthetic polypeptide
DEEEIRTTNPVATEQYGSVNEQPQLEAQAILRI

SEQ ID NO: 99016 - protein, 28 aa, Artificial Sequence
  Description of Artificial Sequence: Synthetic peptide
QEEEIASVNPVCTEQYGVVPENLQHGEQ

SEQ ID NO: 99017 - protein, 28 aa, Artificial Sequence
  Description of Artificial Sequence: Synthetic peptide
QEEEIATTNPVATEQYGSAPEDCQHEEK

SEQ ID NO: 99018 - protein, 36 aa, Artificial Sequence
  Description of Artificial Sequence: Synthetic polypeptide
DEEEIRTTNPVATEQYGSVSNMTNDGEFDQTGNATV

SEQ ID NO: 99019 - protein, 32 aa, Artificial Sequence
  Description of Artificial Sequence: Synthetic polypeptide
DQAEIRTTNPVATEQWGCCSCTVLSQHGGNNR

SEQ ID NO: 99020 - protein, 28 aa, Artificial Sequence
  Description of Artificial Sequence: Synthetic peptide
QEEEIATTNPVATEQYGSAPEACQHEEK

SEQ ID NO: 99021 - protein, 30 aa, Artificial Sequence
  Description of Artificial Sequence: Synthetic polypeptide
DEEAIRTTNPVAYEQWGSVFHMEDLRQGNT

SEQ ID NO: 99022 - protein, 28 aa, Artificial Sequence
  Description of Artificial Sequence: Synthetic peptide
GENEIATTNPVATECYGDVSECLQHEML

SEQ ID NO: 99023 - protein, 28 aa, Artificial Sequence
  Description of Artificial Sequence: Synthetic peptide
QEEEIASTNPVATEGYGEMASTLQHGEI

SEQ ID NO: 99024 - protein, 34 aa, Artificial Sequence
  Description of Artificial Sequence: Synthetic polypeptide
DEEEIRTTNPVATEQYGSVSNMTVGFEGGGQNDI

SEQ ID NO: 99025 - protein, 35 aa, Artificial Sequence
  Description of Artificial Sequence: Synthetic polypeptide
DEEAIRTTNPVAYEQWGSVQSETNLDQSREGIGRM

SEQ ID NO: 99026 - protein, 32 aa, Artificial Sequence
  Description of Artificial Sequence: Synthetic polypeptide
NEEEIRTTNPVAYERYGTVVSTNELSLAGGNH

SEQ ID NO: 99027 - protein, 33 aa, Artificial Sequence
  Description of Artificial Sequence: Synthetic polypeptide
KEEEIKTTNPVAFEQYGSVSTTENTERQGHSRF

SEQ ID NO: 99028 - protein, 33 aa, Artificial Sequence
  Description of Artificial Sequence: Synthetic polypeptide
DEDEIRTTNPVAYEQYGVSVSATNDLGQHDIAP

SEQ ID NO: 99029 - protein, 35 aa, Artificial Sequence
  Description of Artificial Sequence: Synthetic polypeptide
AEEEIRTTNPVATEQYGSVVTVTTNLQNQEGTNNG

SEQ ID NO: 99030 - protein, 33 aa, Artificial Sequence
  Description of Artificial Sequence: Synthetic polypeptide
FEEEIRTTNPVATEQYGSVSTTGMGQEEVEGQI

SEQ ID NO: 99031 - protein, 29 aa, Artificial Sequence
  Description of Artificial Sequence: Synthetic peptide
AENEIACTNPVATEQYGDASENLQAAGGA

SEQ ID NO: 99032 - protein, 28 aa, Artificial Sequence
  Description of Artificial Sequence: Synthetic peptide
QEEEIASVNPVCTEQYGVVSDCLQSENQ

SEQ ID NO: 99033 - protein, 29 aa, Artificial Sequence
  Description of Artificial Sequence: Synthetic peptide
DQAEIRTTNPVATEGYGCCSIVGQHGQDR

SEQ ID NO: 99034 - protein, 30 aa, Artificial Sequence
  Description of Artificial Sequence: Synthetic polypeptide
AENEIACTNPVATEQYGDASENLQNAAGGR

SEQ ID NO: 99035 - protein, 33 aa, Artificial Sequence
  Description of Artificial Sequence: Synthetic polypeptide
DSEEIATTNPVAYTQYGSTVSCTNNPSMRGGNR

SEQ ID NO: 99036 - protein, 28 aa, Artificial Sequence
  Description of Artificial Sequence: Synthetic peptide
GEGEIAPTNPCSSEQYGIVSCNLQSGTR

SEQ ID NO: 99037 - protein, 34 aa, Artificial Sequence
  Description of Artificial Sequence: Synthetic polypeptide
AEEEIRTTNPVATEQYGSVVVNTNNLNNTAGNNV

SEQ ID NO: 99038 - protein, 32 aa, Artificial Sequence
  Description of Artificial Sequence: Synthetic polypeptide
QEEEIATTNPVATEQYGSVAITNLPEQPEVGE

SEQ ID NO: 99039 - protein, 33 aa, Artificial Sequence
  Description of Artificial Sequence: Synthetic polypeptide
NEEEIRTTNPVATEQYGSVCSWWNLDEFGSDQS

SEQ ID NO: 99040 - protein, 35 aa, Artificial Sequence
  Description of Artificial Sequence: Synthetic polypeptide
DEEEIRTTNPVATEQYGSVPSPPPSLIRVGVNQLQ

SEQ ID NO: 99041 - protein, 33 aa, Artificial Sequence
  Description of Artificial Sequence: Synthetic polypeptide
DEEEIRTTNPVATEQYGSVPTVWLQEFFEDQAD

SEQ ID NO: 99042 - protein, 35 aa, Artificial Sequence
  Description of Artificial Sequence: Synthetic polypeptide
DEEEIRTTNPVATEQYGSVPTYLSLEQERGLEEED

SEQ ID NO: 99043 - protein, 33 aa, Artificial Sequence
  Description of Artificial Sequence: Synthetic polypeptide
INEEIRTTNPVATEQYGSVVDGTENGQDGGNTE

SEQ ID NO: 99044 - protein, 32 aa, Artificial Sequence
  Description of Artificial Sequence: Synthetic polypeptide
INEEIRTTNPVATEQYGVVNDDTNGQGGGNDG

SEQ ID NO: 99045 - protein, 31 aa, Artificial Sequence
  Description of Artificial Sequence: Synthetic polypeptide
NEEEIRTTNPVAYEQWGSVAWALEQQMGDAR

SEQ ID NO: 99046 - protein, 33 aa, Artificial Sequence
  Description of Artificial Sequence: Synthetic polypeptide
NEEEIRTTNPVATEQYGSVCSTDLEDRTESQES

SEQ ID NO: 99047 - protein, 33 aa, Artificial Sequence
  Description of Artificial Sequence: Synthetic polypeptide
DSEEICSTNPVATEQYGSVVSTNLSQNTGGTPQ

SEQ ID NO: 99048 - protein, 30 aa, Artificial Sequence
  Description of Artificial Sequence: Synthetic polypeptide
AENEIACTNPVATEQYGEAESEPNLARGGR

SEQ ID NO: 99049 - protein, 35 aa, Artificial Sequence
  Description of Artificial Sequence: Synthetic polypeptide
DEEEIRTTNPVATEQYGSVNCWTGLIVREGMEIRN

SEQ ID NO: 99050 - protein, 31 aa, Artificial Sequence
  Description of Artificial Sequence: Synthetic polypeptide
AENEIACTNPVATEQYGEACSTDNLEREGGR

SEQ ID NO: 99051 - protein, 33 aa, Artificial Sequence
  Description of Artificial Sequence: Synthetic polypeptide
DEEAIRTTNPVATEQYGSVSENNDDERGGEHEN

SEQ ID NO: 99052 - protein, 33 aa, Artificial Sequence
  Description of Artificial Sequence: Synthetic polypeptide
DEEEIRTTNPVATEQYGSVPSPPPGMIEVGVNL

SEQ ID NO: 99053 - protein, 32 aa, Artificial Sequence
  Description of Artificial Sequence: Synthetic polypeptide
INEEIRTTNPVATEQYGVVSTGGQGQDGGGNG

SEQ ID NO: 99054 - protein, 33 aa, Artificial Sequence
  Description of Artificial Sequence: Synthetic polypeptide
NEEEIRTTNPVATEQYGSVCSAEELNDEFGSNQ

SEQ ID NO: 99055 - protein, 31 aa, Artificial Sequence
  Description of Artificial Sequence: Synthetic polypeptide
NEEEIRTTNPVAYEQWGSVAKALEQNNGEDR

SEQ ID NO: 99056 - protein, 35 aa, Artificial Sequence
  Description of Artificial Sequence: Synthetic polypeptide
DEEEIRTTNPVATEQYGSVNCTPNLEPRVGEEVIP

SEQ ID NO: 99057 - protein, 33 aa, Artificial Sequence
  Description of Artificial Sequence: Synthetic polypeptide
DEEEIACTNPVATEQYGSASTEPNGPNMRGMNV

SEQ ID NO: 99058 - protein, 33 aa, Artificial Sequence
  Description of Artificial Sequence: Synthetic polypeptide
DSEEIATTNPVGTEQWGMVSRTNDLDQDRGDVR

SEQ ID NO: 99059 - protein, 28 aa, Artificial Sequence
  Description of Artificial Sequence: Synthetic peptide
QEEEIASVNPVCTEQYGEVSEVLQHGEQ

SEQ ID NO: 99060 - protein, 28 aa, Artificial Sequence
  Description of Artificial Sequence: Synthetic peptide
HENEIATTNPVATECYGDVSECLQHEKL

SEQ ID NO: 99061 - protein, 28 aa, Artificial Sequence
  Description of Artificial Sequence: Synthetic peptide
DEEEIATTNPVATEQYGETAEDCQHEEI

SEQ ID NO: 99062 - protein, 31 aa, Artificial Sequence
  Description of Artificial Sequence: Synthetic polypeptide
DSEEIATTNPVAYTQYGSVSCCNPSMGGGNR

SEQ ID NO: 99063 - protein, 34 aa, Artificial Sequence
  Description of Artificial Sequence: Synthetic polypeptide
AEEEIRTTNPVATEQYGSVVTVTTNLQEGTVEDE

SEQ ID NO: 99064 - protein, 28 aa, Artificial Sequence
  Description of Artificial Sequence: Synthetic peptide
HENEIATTNPVATECYGDVSECLQHEEL

SEQ ID NO: 99065 - protein, 35 aa, Artificial Sequence
  Description of Artificial Sequence: Synthetic polypeptide
FEEEIRTTNPVATEQYGSVTDGTGNLQDGEENQGN

SEQ ID NO: 99066 - protein, 33 aa, Artificial Sequence
  Description of Artificial Sequence: Synthetic polypeptide
AEEEIRTTNPVATESYGSVVTVTNNLNQGNDGN

SEQ ID NO: 99067 - protein, 33 aa, Artificial Sequence
  Description of Artificial Sequence: Synthetic polypeptide
DEEEIRTTNPVATEQYGSVPVSFAVQRVVEEIT

SEQ ID NO: 99068 - protein, 35 aa, Artificial Sequence
  Description of Artificial Sequence: Synthetic polypeptide
DEEEIRTTNPVATEQYGSVSCTEYLTNLESTQNDD

SEQ ID NO: 99069 - protein, 33 aa, Artificial Sequence
  Description of Artificial Sequence: Synthetic polypeptide
NEEEIRTTNPVAYEQWGSTISTHTSQRQGTNRS

SEQ ID NO: 99070 - protein, 34 aa, Artificial Sequence
  Description of Artificial Sequence: Synthetic polypeptide
DEEEIRTTNPVATEQYGSVSCVPLLAIRGVDPQT

SEQ ID NO: 99071 - protein, 34 aa, Artificial Sequence
  Description of Artificial Sequence: Synthetic polypeptide
DEEEIRTTNPVATEQYGSVPEPTPEEQAIGPEQR

SEQ ID NO: 99072 - protein, 35 aa, Artificial Sequence
  Description of Artificial Sequence: Synthetic polypeptide
NEEEIRTTNPVATEQYGSVDSPSSNLEQRQGEETT

SEQ ID NO: 99073 - protein, 34 aa, Artificial Sequence
  Description of Artificial Sequence: Synthetic polypeptide
AEEEIRTTNPVGTEQYGSVYSTEIAATQAGGANR

SEQ ID NO: 99074 - protein, 33 aa, Artificial Sequence
  Description of Artificial Sequence: Synthetic polypeptide
NEEEIRTTNPVATEQYGSVCYAWNNDEFDGGNR

SEQ ID NO: 99075 - protein, 31 aa, Artificial Sequence
  Description of Artificial Sequence: Synthetic polypeptide
HEHEIRTTNPVAYEAYGSVSQNSSFPVGNNR

SEQ ID NO: 99076 - protein, 35 aa, Artificial Sequence
  Description of Artificial Sequence: Synthetic polypeptide
DEEEIRTTNPVATEQYGSVPEPTNEAQAIVGPEQR

SEQ ID NO: 99077 - protein, 31 aa, Artificial Sequence
  Description of Artificial Sequence: Synthetic polypeptide
NETEIATTNPVATEMWGEVSTNLQGNEGNED

SEQ ID NO: 99078 - protein, 32 aa, Artificial Sequence
  Description of Artificial Sequence: Synthetic polypeptide
QEEEIATTNPVATEQYGSASSTEPACQRGMEV

SEQ ID NO: 99079 - protein, 33 aa, Artificial Sequence
  Description of Artificial Sequence: Synthetic polypeptide
DEEEIRTTNPVATEQYGSVNDDNMDNGGGENGI

SEQ ID NO: 99080 - protein, 34 aa, Artificial Sequence
  Description of Artificial Sequence: Synthetic polypeptide
AEEEIRTTNPVATEQYGSVVVVTTNLNNTAGNNS

SEQ ID NO: 99081 - protein, 33 aa, Artificial Sequence
  Description of Artificial Sequence: Synthetic polypeptide
DEEAIRTTNPVATEQYGSVSPTNMNEHTGELDE

SEQ ID NO: 99082 - protein, 31 aa, Artificial Sequence
  Description of Artificial Sequence: Synthetic polypeptide
QEEEIATTNPVATEQYGSASTVLEDHEGEDL

SEQ ID NO: 99083 - protein, 32 aa, Artificial Sequence
  Description of Artificial Sequence: Synthetic polypeptide
AEEEIRTTNPVATEQYGSVVVNTNDTGVNNTQ

SEQ ID NO: 99084 - protein, 34 aa, Artificial Sequence
  Description of Artificial Sequence: Synthetic polypeptide
DEEAIRTTNPVATEQYGSVSPYNEATEGNMNDRN

SEQ ID NO: 99085 - protein, 33 aa, Artificial Sequence
  Description of Artificial Sequence: Synthetic polypeptide
DEEEIRTTNPVATEQYGSVSCTDASQKESDQQD

SEQ ID NO: 99086 - protein, 35 aa, Artificial Sequence
  Description of Artificial Sequence: Synthetic polypeptide
AEEEIRTTNPVATEQYGSVVVVTTNLQNQEGQNTE

SEQ ID NO: 99087 - protein, 34 aa, Artificial Sequence
  Description of Artificial Sequence: Synthetic polypeptide
DEEEIRTTNPVATEQYGSVPPETPMMLQQQMDPR

SEQ ID NO: 99088 - protein, 32 aa, Artificial Sequence
  Description of Artificial Sequence: Synthetic polypeptide
AEEEIRTTNPVATEQYGSVVVNTNNDENTDNT

SEQ ID NO: 99089 - protein, 33 aa, Artificial Sequence
  Description of Artificial Sequence: Synthetic polypeptide
DEEEIRTTNPVATEQYGSVPWPGVLQRVMEEEQ

SEQ ID NO: 99090 - protein, 34 aa, Artificial Sequence
  Description of Artificial Sequence: Synthetic polypeptide
DEEEIRTTNPVATEQYGSVNDPGMNTQGGEFNTF

SEQ ID NO: 99091 - protein, 35 aa, Artificial Sequence
  Description of Artificial Sequence: Synthetic polypeptide
AEEEIRTTNPVATEQYGSVVVVTTNLQQGEGNTTE

SEQ ID NO: 99092 - protein, 29 aa, Artificial Sequence
  Description of Artificial Sequence: Synthetic peptide
AENEIACTNPVATEQYGEACENLQRGGDA

SEQ ID NO: 99093 - protein, 35 aa, Artificial Sequence
  Description of Artificial Sequence: Synthetic polypeptide
AEEEIRTTNPVATEQYGSVVVVTTNLQQGGNNQTE

SEQ ID NO: 99094 - protein, 31 aa, Artificial Sequence
  Description of Artificial Sequence: Synthetic polypeptide
QEEEIATTNPVATEQYGSASTVLEDHEGEDK

SEQ ID NO: 99095 - protein, 33 aa, Artificial Sequence
  Description of Artificial Sequence: Synthetic polypeptide
DEEEIRTTNPVATEQYGSVSPAMTLEVTNNVVG

SEQ ID NO: 99096 - protein, 28 aa, Artificial Sequence
  Description of Artificial Sequence: Synthetic peptide
QEEEIASVNPVCTEQYGVMASNLQHGNQ

SEQ ID NO: 99097 - protein, 29 aa, Artificial Sequence
  Description of Artificial Sequence: Synthetic peptide
QEEEIATTNPVATEQYGSASTDCEHEEEK

SEQ ID NO: 99098 - protein, 35 aa, Artificial Sequence
  Description of Artificial Sequence: Synthetic polypeptide
AEEEIRTTNPVATEQYGSVVTTVNLQSNEQGNNTN

SEQ ID NO: 99099 - protein, 34 aa, Artificial Sequence
  Description of Artificial Sequence: Synthetic polypeptide
DEEAIRTTNPVATEQYGSVSPTMTNEDTGNELDE

SEQ ID NO: 99100 - protein, 30 aa, Artificial Sequence
  Description of Artificial Sequence: Synthetic polypeptide
DEECISTVNPVATEAYGCVCSDNLENGSNQ

SEQ ID NO: 99101 - protein, 32 aa, Artificial Sequence
  Description of Artificial Sequence: Synthetic polypeptide
DEEEIACTNPVATEQYGSVATNLQDAEDDTDT

SEQ ID NO: 99102 - protein, 34 aa, Artificial Sequence
  Description of Artificial Sequence: Synthetic polypeptide
HEGEIRTTNPVATEQYGSVSTTLNDLQEFNQVFY

SEQ ID NO: 99103 - protein, 32 aa, Artificial Sequence
  Description of Artificial Sequence: Synthetic polypeptide
INEEIRTTNPVATEQYGVVSTGGQQDEGGNGG

SEQ ID NO: 99104 - protein, 34 aa, Artificial Sequence
  Description of Artificial Sequence: Synthetic polypeptide
DEEEIRTTNPVATEQYGSVMLTNMLIVTQEVEEE

SEQ ID NO: 99105 - protein, 30 aa, Artificial Sequence
  Description of Artificial Sequence: Synthetic polypeptide
AENEIACTNPVATEQYGEACSEDNLQFGGR

SEQ ID NO: 99106 - protein, 33 aa, Artificial Sequence
  Description of Artificial Sequence: Synthetic polypeptide
DEEEIRTTNPVATEQYGSVNDDNMTMEFDGENQ

SEQ ID NO: 99107 - protein, 31 aa, Artificial Sequence
  Description of Artificial Sequence: Synthetic polypeptide
INEEIRTTNPVATEQYGVVVNGFNGQGGGNG

SEQ ID NO: 99108 - protein, 32 aa, Artificial Sequence
  Description of Artificial Sequence: Synthetic polypeptide
INEEIRTTNPVATEQYGVVVTDNNGQGGGNEG

SEQ ID NO: 99109 - protein, 34 aa, Artificial Sequence
  Description of Artificial Sequence: Synthetic polypeptide
AEEEIRTTNPVATEQYGSVVTTVNLGGNEQGNNN

SEQ ID NO: 99110 - protein, 32 aa, Artificial Sequence
  Description of Artificial Sequence: Synthetic polypeptide
DEEEIRTTNPVATEQYGSVPVSFKENQEVVVD

SEQ ID NO: 99111 - protein, 34 aa, Artificial Sequence
  Description of Artificial Sequence: Synthetic polypeptide
DEEEIRTTNPVATEQYGSVSCTNGGVTTFGKQFT

SEQ ID NO: 99112 - protein, 35 aa, Artificial Sequence
  Description of Artificial Sequence: Synthetic polypeptide
AEEEIRTTNPVATEQYGSVVVTVNLQQGTEGTNGG

SEQ ID NO: 99113 - protein, 28 aa, Artificial Sequence
  Description of Artificial Sequence: Synthetic peptide
QEEEIASVNPVCTEQYGVASDNLQHENQ

SEQ ID NO: 99114 - protein, 31 aa, Artificial Sequence
  Description of Artificial Sequence: Synthetic polypeptide
DQAEIRTTNPVATEQYGCCSDVLEGGQNDRV

SEQ ID NO: 99115 - protein, 35 aa, Artificial Sequence
  Description of Artificial Sequence: Synthetic polypeptide
AEEEIRTTNPVATEQYGSVVVVTTNLQDQNGNNNG

SEQ ID NO: 99116 - protein, 35 aa, Artificial Sequence
  Description of Artificial Sequence: Synthetic polypeptide
AEEEIRTTNPVATEQYGSVVVVTTNLQELGNVEDE

SEQ ID NO: 99117 - protein, 34 aa, Artificial Sequence
  Description of Artificial Sequence: Synthetic polypeptide
DSEEIRATNPVAYEQWGCSVPSCTTELQRTGTNR

SEQ ID NO: 99118 - protein, 34 aa, Artificial Sequence
  Description of Artificial Sequence: Synthetic polypeptide
DEECISTTNPVAYEQYGQSTVSVGNELAQRSGER

SEQ ID NO: 99119 - protein, 33 aa, Artificial Sequence
  Description of Artificial Sequence: Synthetic polypeptide
DEEAIRTTNPVATEQYGSVSPTMNNEHTGELSE

SEQ ID NO: 99120 - protein, 34 aa, Artificial Sequence
  Description of Artificial Sequence: Synthetic polypeptide
DEEEIRTTNPVATEQYGSVPSPPPGLIRVGVDIP

SEQ ID NO: 99121 - protein, 31 aa, Artificial Sequence
  Description of Artificial Sequence: Synthetic polypeptide
DQAEIATTNPVATYQYGSVATNGVQNGNHHN

SEQ ID NO: 99122 - protein, 33 aa, Artificial Sequence
  Description of Artificial Sequence: Synthetic polypeptide
FEEEIRTTNPVATEQYGVVNDTNMGQDEGENIE

SEQ ID NO: 99123 - protein, 35 aa, Artificial Sequence
  Description of Artificial Sequence: Synthetic polypeptide
DEEEIRTTNPVATEQYGSVIEPTNGGQRVHNIVND

SEQ ID NO: 99124 - protein, 28 aa, Artificial Sequence
  Description of Artificial Sequence: Synthetic peptide
QEEEIATTNPVATEQYGVAPETCQHGEI

SEQ ID NO: 99125 - protein, 32 aa, Artificial Sequence
  Description of Artificial Sequence: Synthetic polypeptide
IEEEIRTTNPVATEQYGCVSTQLGEDTEDNEE

SEQ ID NO: 99126 - protein, 36 aa, Artificial Sequence
  Description of Artificial Sequence: Synthetic polypeptide
DEEEIRTTNPVATEQYGSVSNTMNNLEERDGEEAFY

SEQ ID NO: 99127 - protein, 33 aa, Artificial Sequence
  Description of Artificial Sequence: Synthetic polypeptide
AEEEIRTTNPVATEQYGVVVVVSTTNLGQGEGV

SEQ ID NO: 99128 - protein, 34 aa, Artificial Sequence
  Description of Artificial Sequence: Synthetic polypeptide
DEEEIRTTNPVATEQYGSVPSTTPLVITVNENTQ

SEQ ID NO: 99129 - protein, 35 aa, Artificial Sequence
  Description of Artificial Sequence: Synthetic polypeptide
AEEEIRTTNPVATEQYGSVVTVVNELQAGENQINE

SEQ ID NO: 99130 - protein, 36 aa, Artificial Sequence
  Description of Artificial Sequence: Synthetic polypeptide
AEEEIRTTNPVATEQYGSVVVVSTTNLQGNQAGNND

SEQ ID NO: 99131 - protein, 32 aa, Artificial Sequence
  Description of Artificial Sequence: Synthetic polypeptide
DEEAICTVNPVATEAYGSVSTDQNLQENNNNQ

SEQ ID NO: 99132 - protein, 34 aa, Artificial Sequence
  Description of Artificial Sequence: Synthetic polypeptide
DQEEIRTTNPVAYEAWGSVVQTNPLQRTGGNNRQ

SEQ ID NO: 99133 - protein, 36 aa, Artificial Sequence
  Description of Artificial Sequence: Synthetic polypeptide
AEEEIRTTNPVATEQYGSVVVVSTTNNLEQGGNTDE

SEQ ID NO: 99134 - protein, 33 aa, Artificial Sequence
  Description of Artificial Sequence: Synthetic polypeptide
DEEEIACTNPVATEQYGSVAAANNLQEAGNSEQ

SEQ ID NO: 99135 - protein, 36 aa, Artificial Sequence
  Description of Artificial Sequence: Synthetic polypeptide
DEEEIRTTNPVATEQYGSVPSTTPAGSNLRNGMNPV

SEQ ID NO: 99136 - protein, 34 aa, Artificial Sequence
  Description of Artificial Sequence: Synthetic polypeptide
DQEEIRTTNPVAYEAWGSVVSTNEEQRTGGNYRQ

SEQ ID NO: 99137 - protein, 28 aa, Artificial Sequence
  Description of Artificial Sequence: Synthetic peptide
QEEEIATTNPVGTEQYGEMPSVLQHGDK

SEQ ID NO: 99138 - protein, 34 aa, Artificial Sequence
  Description of Artificial Sequence: Synthetic polypeptide
DEEEIRTTNPVATEQYGSVSDLVLYQASSQNVGN

SEQ ID NO: 99139 - protein, 31 aa, Artificial Sequence
  Description of Artificial Sequence: Synthetic polypeptide
DEDVIRTTNPVATEQYGCNELTNNPQGGTNV

SEQ ID NO: 99140 - protein, 28 aa, Artificial Sequence
  Description of Artificial Sequence: Synthetic peptide
QEEEIATTNPVATEQYGTVPEVCQHEEK

SEQ ID NO: 99141 - protein, 32 aa, Artificial Sequence
  Description of Artificial Sequence: Synthetic polypeptide
DEEAICTVNPVATEAYGSVSTDNQLEDNGNNQ

SEQ ID NO: 99142 - protein, 31 aa, Artificial Sequence
  Description of Artificial Sequence: Synthetic polypeptide
IEEEIQTTNPVATEEYGSVLTNPFVRNDNQG

SEQ ID NO: 99143 - protein, 34 aa, Artificial Sequence
  Description of Artificial Sequence: Synthetic polypeptide
DEEEIACTNPVATEQYGSVCAANNLQEAGENARQ

SEQ ID NO: 99144 - protein, 33 aa, Artificial Sequence
  Description of Artificial Sequence: Synthetic polypeptide
DEEAICTVNPVATEAYGSVSTDNNQLQENGNQE

SEQ ID NO: 99145 - protein, 33 aa, Artificial Sequence
  Description of Artificial Sequence: Synthetic polypeptide
NEEEIRTTNPVATEQYGSVYPTPNVEERLEFRT

SEQ ID NO: 99146 - protein, 34 aa, Artificial Sequence
  Description of Artificial Sequence: Synthetic polypeptide
AEEEIRTTNPVATEQYGSVVVTTTNPNNQSGTNM

SEQ ID NO: 99147 - protein, 34 aa, Artificial Sequence
  Description of Artificial Sequence: Synthetic polypeptide
DEEEIRTTNPVATEQYGSVSDGVTGLDGNGGGQG

SEQ ID NO: 99148 - protein, 28 aa, Artificial Sequence
  Description of Artificial Sequence: Synthetic peptide
QEEEIATTNPVATEQYGVAPSTCQHEEK

SEQ ID NO: 99149 - protein, 34 aa, Artificial Sequence
  Description of Artificial Sequence: Synthetic polypeptide
AEEEIRTTNPVATEQYGSVVVVSTDQNQIGTNLN

SEQ ID NO: 99150 - protein, 34 aa, Artificial Sequence
  Description of Artificial Sequence: Synthetic polypeptide
DEEEIRTTNPVATEQYGSVSDGVTGLGGDTGGQG

SEQ ID NO: 99151 - protein, 30 aa, Artificial Sequence
  Description of Artificial Sequence: Synthetic polypeptide
AENEIACTNPVATEQYGEASEINEQREGGR

SEQ ID NO: 99152 - protein, 33 aa, Artificial Sequence
  Description of Artificial Sequence: Synthetic polypeptide
DEEAEIATTNPVAYECWGTVSTNLQGDVGDNSR

SEQ ID NO: 99153 - protein, 34 aa, Artificial Sequence
  Description of Artificial Sequence: Synthetic polypeptide
DEEEIRTTNPVATEQYGSVPMPPVGLQRQGGVTE

SEQ ID NO: 99154 - protein, 31 aa, Artificial Sequence
  Description of Artificial Sequence: Synthetic polypeptide
AEEEIRTTNPVAYEHWGCFSINDLDQRGNHQ

SEQ ID NO: 99155 - protein, 32 aa, Artificial Sequence
  Description of Artificial Sequence: Synthetic polypeptide
DEEEIRTTNPVATEQYGSVSDIGLIETPTQLV

SEQ ID NO: 99156 - protein, 33 aa, Artificial Sequence
  Description of Artificial Sequence: Synthetic polypeptide
NEEEIRTTNPVATEQYGSVSNAGNGEDEFGNGE

SEQ ID NO: 99157 - protein, 31 aa, Artificial Sequence
  Description of Artificial Sequence: Synthetic polypeptide
AEEEIRTTNPVAYEHWGCFSIPNDLQDGGNR

SEQ ID NO: 99158 - protein, 33 aa, Artificial Sequence
  Description of Artificial Sequence: Synthetic polypeptide
AEEEIRTTNPVAYEAYGISVPSCTGNGSQEGNN

SEQ ID NO: 99159 - protein, 33 aa, Artificial Sequence
  Description of Artificial Sequence: Synthetic polypeptide
DEEAICTVNPVATEAYGSVSTDNNLQENNEGNQ

SEQ ID NO: 99160 - protein, 28 aa, Artificial Sequence
  Description of Artificial Sequence: Synthetic peptide
QEEEIATTNPVATEQYGVAPEVCQHGEK

SEQ ID NO: 99161 - protein, 35 aa, Artificial Sequence
  Description of Artificial Sequence: Synthetic polypeptide
AEEEIRTTNPVATEQYGSVVVVSTNLLQAGTDEED

SEQ ID NO: 99162 - protein, 35 aa, Artificial Sequence
  Description of Artificial Sequence: Synthetic polypeptide
DEEEIRTTNPVATEQYGSVMTGNQNLQVENDENEG

SEQ ID NO: 99163 - protein, 33 aa, Artificial Sequence
  Description of Artificial Sequence: Synthetic polypeptide
DEEAICTVNPVATEAYGSVSTDNNLQENEGNNQ

SEQ ID NO: 99164 - protein, 33 aa, Artificial Sequence
  Description of Artificial Sequence: Synthetic polypeptide
DEEAICTVNPVATEAYGSVSTDNLQENNQGNNQ

SEQ ID NO: 99165 - protein, 28 aa, Artificial Sequence
  Description of Artificial Sequence: Synthetic peptide
QEEEIATTNPVGTEQYGVAASTCQHGDK

SEQ ID NO: 99166 - protein, 35 aa, Artificial Sequence
  Description of Artificial Sequence: Synthetic polypeptide
AEEEIRTTNPVATEQYGSVVTVVNLNQQGEEGNVE

SEQ ID NO: 99167 - protein, 32 aa, Artificial Sequence
  Description of Artificial Sequence: Synthetic polypeptide
DQEEIRTTNPVATCQYGCVSTNGVQNGSETQS

SEQ ID NO: 99168 - protein, 34 aa, Artificial Sequence
  Description of Artificial Sequence: Synthetic polypeptide
NEEEIRTTNPVATEQYGSYSGTMELNQREQGGGE

SEQ ID NO: 99169 - protein, 34 aa, Artificial Sequence
  Description of Artificial Sequence: Synthetic polypeptide
DQEEIRTTNPVAYEHYGSVCACTLNELSQFGNRI

SEQ ID NO: 99170 - protein, 29 aa, Artificial Sequence
  Description of Artificial Sequence: Synthetic peptide
DEDSCIACTNPVAYEPYGSVASNDQRGNL

SEQ ID NO: 99171 - protein, 33 aa, Artificial Sequence
  Description of Artificial Sequence: Synthetic polypeptide
DQEEIRTTNPVAYEHYGSVVACTCELSQFGNPR

SEQ ID NO: 99172 - protein, 32 aa, Artificial Sequence
  Description of Artificial Sequence: Synthetic polypeptide
DQEEIRTTNPVAYEQYGEVHCINHSQRTGEPR

SEQ ID NO: 99173 - protein, 30 aa, Artificial Sequence
  Description of Artificial Sequence: Synthetic polypeptide
AENEIACTNPVATEQYGEASAENLQDRGGL

SEQ ID NO: 99174 - protein, 35 aa, Artificial Sequence
  Description of Artificial Sequence: Synthetic polypeptide
DEEEIRTTNPVATEQYGSVSNTLDHTQMEGQNDQV

SEQ ID NO: 99175 - protein, 31 aa, Artificial Sequence
  Description of Artificial Sequence: Synthetic polypeptide
FEEEIRTTNPVAYEQYGSVFHNNDVQRNTAS

SEQ ID NO: 99176 - protein, 34 aa, Artificial Sequence
  Description of Artificial Sequence: Synthetic polypeptide
AEEEIRTTNPVATEQYGSVVTNLNNQQGIGTDES

SEQ ID NO: 99177 - protein, 34 aa, Artificial Sequence
  Description of Artificial Sequence: Synthetic polypeptide
DQEEIRTTNPVAYHQYGSTVSCTNGVSQNTGNNR

SEQ ID NO: 99178 - protein, 34 aa, Artificial Sequence
  Description of Artificial Sequence: Synthetic polypeptide
AEEEIRTTNPVATEQYGSVVVTVTTNLGGNEGND

SEQ ID NO: 99179 - protein, 33 aa, Artificial Sequence
  Description of Artificial Sequence: Synthetic polypeptide
DQEEIRTTNPVATCQYGCVCSTNGVQNFGSENQ

SEQ ID NO: 99180 - protein, 35 aa, Artificial Sequence
  Description of Artificial Sequence: Synthetic polypeptide
DEEEIRTTNPVATEQYGSVPSTTPAGPNMRGMNPV

SEQ ID NO: 99181 - protein, 32 aa, Artificial Sequence
  Description of Artificial Sequence: Synthetic polypeptide
NESEIATTNPVATECYGNVSTNLQGQMGGGDR

SEQ ID NO: 99182 - protein, 34 aa, Artificial Sequence
  Description of Artificial Sequence: Synthetic polypeptide
DQEEIRTTNPVAYHQYGSVPSYTNGVSQNSGNNR

SEQ ID NO: 99183 - protein, 32 aa, Artificial Sequence
  Description of Artificial Sequence: Synthetic polypeptide
DQEEIKTTNPVAYEHYGSVACTLNELSQFGNS

SEQ ID NO: 99184 - protein, 35 aa, Artificial Sequence
  Description of Artificial Sequence: Synthetic polypeptide
DEEEIRTTNPVATEQYGSVSNTMANLEERDEEEFY

SEQ ID NO: 99185 - protein, 34 aa, Artificial Sequence
  Description of Artificial Sequence: Synthetic polypeptide
DQEEIRTTNPVAYEHYGSVACTQNELSQQFGENR

SEQ ID NO: 99186 - protein, 30 aa, Artificial Sequence
  Description of Artificial Sequence: Synthetic polypeptide
QEEEIATTNPVATEQYGTVPATVPVQHGEK

SEQ ID NO: 99187 - protein, 35 aa, Artificial Sequence
  Description of Artificial Sequence: Synthetic polypeptide
DEEEIRTTNPVATEQYGSVSNTNNLQQLVEEVIIN

SEQ ID NO: 99188 - protein, 34 aa, Artificial Sequence
  Description of Artificial Sequence: Synthetic polypeptide
NEEEIRTTNPVATEQYGSYGVTMELDQRGQGGNG

SEQ ID NO: 99189 - protein, 34 aa, Artificial Sequence
  Description of Artificial Sequence: Synthetic polypeptide
DQEEIRTTNPVAYEAWGSVVSTNPLQMTGGNYRK

SEQ ID NO: 99190 - protein, 32 aa, Artificial Sequence
  Description of Artificial Sequence: Synthetic polypeptide
IEEEIRTTNPVATEQYGSCSTDMTEGNNNDEN

SEQ ID NO: 99191 - protein, 36 aa, Artificial Sequence
  Description of Artificial Sequence: Synthetic polypeptide
AEEEIRTTNPVATEQYGSVVVVSVTNNLQNGNQNAE

SEQ ID NO: 99192 - protein, 35 aa, Artificial Sequence
  Description of Artificial Sequence: Synthetic polypeptide
DQEEIRTTNPVAYEAWGSVVSTNPLSQRTGGNYRQ

SEQ ID NO: 99193 - protein, 35 aa, Artificial Sequence
  Description of Artificial Sequence: Synthetic polypeptide
AEEEIRTTNPVATEQYGSVVVTTTNLQQGNGNTTD

SEQ ID NO: 99194 - protein, 32 aa, Artificial Sequence
  Description of Artificial Sequence: Synthetic polypeptide
DQEEIRTTNPVAYEHFGKVVHCTNELSQFGNR

SEQ ID NO: 99195 - protein, 33 aa, Artificial Sequence
  Description of Artificial Sequence: Synthetic polypeptide
DQEEIRTTNPVAYEHWGSVACTLNELSQFGQNR

SEQ ID NO: 99196 - protein, 28 aa, Artificial Sequence
  Description of Artificial Sequence: Synthetic peptide
QEEEIASTNPVGTEQYGVVADTLQHGDI

SEQ ID NO: 99197 - protein, 33 aa, Artificial Sequence
  Description of Artificial Sequence: Synthetic polypeptide
DQEEIRTTNPVAYEHYGSVAACTLNELSQFGNI

SEQ ID NO: 99198 - protein, 33 aa, Artificial Sequence
  Description of Artificial Sequence: Synthetic polypeptide
DQEEIRTTNPVAYEHYGSVACTLNELSQFEGNN

SEQ ID NO: 99199 - protein, 34 aa, Artificial Sequence
  Description of Artificial Sequence: Synthetic polypeptide
DEEEIRTTNPVATEQYGSVSNTMGFGNENQGIAA

SEQ ID NO: 99200 - protein, 28 aa, Artificial Sequence
  Description of Artificial Sequence: Synthetic peptide
QEEEIATTNPVSSEQYGEVPCVCQSGER

SEQ ID NO: 99201 - protein, 32 aa, Artificial Sequence
  Description of Artificial Sequence: Synthetic polypeptide
DQEEIRTTNPVAYEHYGSVACTLNELSQFENV

SEQ ID NO: 99202 - protein, 28 aa, Artificial Sequence
  Description of Artificial Sequence: Synthetic peptide
QEEEIATTNPVSSEQYGEVPEVCQSGER

SEQ ID NO: 99203 - protein, 32 aa, Artificial Sequence
  Description of Artificial Sequence: Synthetic polypeptide
DQEEIRTTNPVATEQYGCVCSTEHQNFGSDQA

SEQ ID NO: 99204 - protein, 28 aa, Artificial Sequence
  Description of Artificial Sequence: Synthetic peptide
QEEEIASTNPVGTEQYGVVADTLQHGDQ

SEQ ID NO: 99205 - protein, 33 aa, Artificial Sequence
  Description of Artificial Sequence: Synthetic polypeptide
DQEEIRTTNPVAYEHYGSVACTNELSQFAGENG

SEQ ID NO: 99206 - protein, 28 aa, Artificial Sequence
  Description of Artificial Sequence: Synthetic peptide
AENEIACTNPVATEQYGEASENCQHGGK

SEQ ID NO: 99207 - protein, 35 aa, Artificial Sequence
  Description of Artificial Sequence: Synthetic polypeptide
DEEEIRTTNPVATEQYGSVSNTPNDMQAKIIGTQE

SEQ ID NO: 99208 - protein, 30 aa, Artificial Sequence
  Description of Artificial Sequence: Synthetic polypeptide
AENEIACTNPVATEQYGEASEGLVQREGGR

SEQ ID NO: 99209 - protein, 34 aa, Artificial Sequence
  Description of Artificial Sequence: Synthetic polypeptide
DEEEIRTTNPVATEQYGSVPTANLAESIGEIVQA

SEQ ID NO: 99210 - protein, 35 aa, Artificial Sequence
  Description of Artificial Sequence: Synthetic polypeptide
AEEEIRTTNPVATEQYGSVVVTTTTNLQSGVNNQQ

SEQ ID NO: 99211 - protein, 33 aa, Artificial Sequence
  Description of Artificial Sequence: Synthetic polypeptide
DQEEIRTTNPVATHQYGSVSTNGMTQEGMEHKN

SEQ ID NO: 99212 - protein, 34 aa, Artificial Sequence
  Description of Artificial Sequence: Synthetic polypeptide
DEEAEIRTTNPVAYEQWGSVSTNLNGDHGGNGTA

SEQ ID NO: 99213 - protein, 34 aa, Artificial Sequence
  Description of Artificial Sequence: Synthetic polypeptide
DQEEIRTTNPVATHQYGSVCSTNGHQNFGSNTQS

SEQ ID NO: 99214 - protein, 34 aa, Artificial Sequence
  Description of Artificial Sequence: Synthetic polypeptide
AEEEIRTTNPVAYEAYGISVPSCTGNGSQRGNMW

SEQ ID NO: 99215 - protein, 32 aa, Artificial Sequence
  Description of Artificial Sequence: Synthetic polypeptide
DQEEIRTTNPVATHQYGCVCSTEGTQNFGNNQ

SEQ ID NO: 99216 - protein, 29 aa, Artificial Sequence
  Description of Artificial Sequence: Synthetic peptide
QEEEIATTNPVATEQYGVVATEVEQQEEF

SEQ ID NO: 99217 - protein, 33 aa, Artificial Sequence
  Description of Artificial Sequence: Synthetic polypeptide
AEEEIRTTNPVAYEAYGSVCSAGGGSQRGGNYR

SEQ ID NO: 99218 - protein, 28 aa, Artificial Sequence
  Description of Artificial Sequence: Synthetic peptide
QEEEIAPTNPVATEQYGEAPEVLQHGTK

SEQ ID NO: 99219 - protein, 33 aa, Artificial Sequence
  Description of Artificial Sequence: Synthetic polypeptide
DEEAEIRTTNPVAYEQWGSVSTTNGDNAGGNQL

SEQ ID NO: 99220 - protein, 34 aa, Artificial Sequence
  Description of Artificial Sequence: Synthetic polypeptide
DEEAEIRTTNPVAYEQWGTVCSTNDLRDNHGQNR

SEQ ID NO: 99221 - protein, 34 aa, Artificial Sequence
  Description of Artificial Sequence: Synthetic polypeptide
DEEAEIRTTNPVAYEQWGTVSTNLGAGNAGEDSR

SEQ ID NO: 99222 - protein, 31 aa, Artificial Sequence
  Description of Artificial Sequence: Synthetic polypeptide
DEEAIATTNPVAYECYGSVATNELSMSGGNM

SEQ ID NO: 99223 - protein, 32 aa, Artificial Sequence
  Description of Artificial Sequence: Synthetic polypeptide
DEEEIRTTNPVATEQYGSVHPPMTGVEADNES

SEQ ID NO: 99224 - protein, 32 aa, Artificial Sequence
  Description of Artificial Sequence: Synthetic polypeptide
QEEEIATTNPVAYEEWGVVSTNLQLGEDNGRG

SEQ ID NO: 99225 - protein, 30 aa, Artificial Sequence
  Description of Artificial Sequence: Synthetic polypeptide
NESEIRTTNPVATEQYGCCSTEEQETQDRN

SEQ ID NO: 99226 - protein, 31 aa, Artificial Sequence
  Description of Artificial Sequence: Synthetic polypeptide
AENEIACTNPVATEQYGEASEENLQQRNGGR

SEQ ID NO: 99227 - protein, 36 aa, Artificial Sequence
  Description of Artificial Sequence: Synthetic polypeptide
DEEEIRTTNPVATEQYGSVSNTNLIQMMVFGEIGQQ

SEQ ID NO: 99228 - protein, 34 aa, Artificial Sequence
  Description of Artificial Sequence: Synthetic polypeptide
AEEEIRTTNPVAYEAYGISVPSYTGNGSQRSGNN

SEQ ID NO: 99229 - protein, 32 aa, Artificial Sequence
  Description of Artificial Sequence: Synthetic polypeptide
NESEIRTTNPVATEQYGSVSTDLEDRTESSQE

SEQ ID NO: 99230 - protein, 35 aa, Artificial Sequence
  Description of Artificial Sequence: Synthetic polypeptide
AEEEIRTTNPVATEQYGSVVVTTVNLGNQAGNNDG

SEQ ID NO: 99231 - protein, 37 aa, Artificial Sequence
  Description of Artificial Sequence: Synthetic polypeptide
DEEEIRTTNPVATEQYGSVHTNENVLEAQRANVEVRM

SEQ ID NO: 99232 - protein, 34 aa, Artificial Sequence
  Description of Artificial Sequence: Synthetic polypeptide
DEEEIRTTNPVATEQYGSVSDDNMTMEIGGNEGN

SEQ ID NO: 99233 - protein, 28 aa, Artificial Sequence
  Description of Artificial Sequence: Synthetic peptide
QEEEIATTNPVATEQYGVVPDVCQHEEQ

SEQ ID NO: 99234 - protein, 34 aa, Artificial Sequence
  Description of Artificial Sequence: Synthetic polypeptide
DEEEIRTTNPVATEQYGSVSDDNMTMEMGGGNEG

SEQ ID NO: 99235 - protein, 34 aa, Artificial Sequence
  Description of Artificial Sequence: Synthetic polypeptide
AEEEIRTTNPVATEQYGSVVTTNLGGEEQGTNNQ

SEQ ID NO: 99236 - protein, 35 aa, Artificial Sequence
  Description of Artificial Sequence: Synthetic polypeptide
DEEEIRTTNPVATEQYGSVMSGINMDTGQGEGNGD

SEQ ID NO: 99237 - protein, 35 aa, Artificial Sequence
  Description of Artificial Sequence: Synthetic polypeptide
DEEEIRTTNPVATEQYGSVMSGINMDLGEGEERGD

SEQ ID NO: 99238 - protein, 30 aa, Artificial Sequence
  Description of Artificial Sequence: Synthetic polypeptide
AENEIACTNPVATEQYGEASEDNLQFEGGR

SEQ ID NO: 99239 - protein, 34 aa, Artificial Sequence
  Description of Artificial Sequence: Synthetic polypeptide
DEEEIRTTNPVATEQYGSVHENVSLGQLVGEEAE

SEQ ID NO: 99240 - protein, 33 aa, Artificial Sequence
  Description of Artificial Sequence: Synthetic polypeptide
AEEEIRTTNPVAYEAYGQVCSTGGGSQERGGNR

SEQ ID NO: 99241 - protein, 35 aa, Artificial Sequence
  Description of Artificial Sequence: Synthetic polypeptide
DEEEIRTTNPVATEQYGSVPSVTPGDQSVSVNQRE

SEQ ID NO: 99242 - protein, 37 aa, Artificial Sequence
  Description of Artificial Sequence: Synthetic polypeptide
DEEEIRTTNPVATEQYGSVHTNENVLEQERVNVEVRF

SEQ ID NO: 99243 - protein, 29 aa, Artificial Sequence
  Description of Artificial Sequence: Synthetic peptide
QEEEIATTNPVATEQYGVVATEVEQQEES

SEQ ID NO: 99244 - protein, 33 aa, Artificial Sequence
  Description of Artificial Sequence: Synthetic polypeptide
DEEAEIRTTNPVAYEGWGSVATNLQGGGGNNTN

SEQ ID NO: 99245 - protein, 33 aa, Artificial Sequence
  Description of Artificial Sequence: Synthetic polypeptide
DEEEIATTNPVATEQYGSACAANNLQDSDGNAP

SEQ ID NO: 99246 - protein, 33 aa, Artificial Sequence
  Description of Artificial Sequence: Synthetic polypeptide
DEEEIATTNPVATEQYGSACAANNLQEAPGENM

SEQ ID NO: 99247 - protein, 34 aa, Artificial Sequence
  Description of Artificial Sequence: Synthetic polypeptide
DEEAEIRTTNPVAYEQWGEVSTATNQGDQGGTNR

SEQ ID NO: 99248 - protein, 28 aa, Artificial Sequence
  Description of Artificial Sequence: Synthetic peptide
FEGEIAPTNPCSSEQYGIVSCNLQSGTR

SEQ ID NO: 99249 - protein, 33 aa, Artificial Sequence
  Description of Artificial Sequence: Synthetic polypeptide
AEEEIRTTNPVATEQYGSVVVVNTNDDGGVENT

SEQ ID NO: 99250 - protein, 28 aa, Artificial Sequence
  Description of Artificial Sequence: Synthetic peptide
QEEEIATTNPVGTEQYGEAPSVLQHGDK

SEQ ID NO: 99251 - protein, 32 aa, Artificial Sequence
  Description of Artificial Sequence: Synthetic polypeptide
QEEEIATTNPVAYEQYGSVAMNLQPAPGPNNP

SEQ ID NO: 99252 - protein, 34 aa, Artificial Sequence
  Description of Artificial Sequence: Synthetic polypeptide
DEEAEIATTNPVAYEQWGSVSNTNDGQGERGGSR

SEQ ID NO: 99253 - protein, 28 aa, Artificial Sequence
  Description of Artificial Sequence: Synthetic peptide
FENEIATTNPVATECYGKVSECLQHEEL

SEQ ID NO: 99254 - protein, 28 aa, Artificial Sequence
  Description of Artificial Sequence: Synthetic peptide
QEEEIATTNPVGTEQYGEAASTCQHGDK

SEQ ID NO: 99255 - protein, 34 aa, Artificial Sequence
  Description of Artificial Sequence: Synthetic polypeptide
DEEEIATTNPVATEQYGSACAATANLQDDGDNDH

SEQ ID NO: 99256 - protein, 32 aa, Artificial Sequence
  Description of Artificial Sequence: Synthetic polypeptide
FEEGITTTNPVATEQYGSVSLMVNSQLGENES

SEQ ID NO: 99257 - protein, 35 aa, Artificial Sequence
  Description of Artificial Sequence: Synthetic polypeptide
AEEEIRTTNPVATEQYGSVVVTTTNQGNLQQGTNI

SEQ ID NO: 99258 - protein, 32 aa, Artificial Sequence
  Description of Artificial Sequence: Synthetic polypeptide
NEEEIRTTNPVATEQYGSVSWDVQDEFAFNQQ

SEQ ID NO: 99259 - protein, 32 aa, Artificial Sequence
  Description of Artificial Sequence: Synthetic polypeptide
NEEEIRTTNPVATEQYGSVSPADVLEDEFFNQ

SEQ ID NO: 99260 - protein, 32 aa, Artificial Sequence
  Description of Artificial Sequence: Synthetic polypeptide
NEEEIRTTNPVATEQYGSVWAWNLDEFFDNIQ

SEQ ID NO: 99261 - protein, 33 aa, Artificial Sequence
  Description of Artificial Sequence: Synthetic polypeptide
DQEEIRTTNPVATHQYGSVSTNGVTQNGSEDHY

SEQ ID NO: 99262 - protein, 32 aa, Artificial Sequence
  Description of Artificial Sequence: Synthetic polypeptide
NEEEIRTTNPVATEQYGSVWTTDMTQETENEY

SEQ ID NO: 99263 - protein, 28 aa, Artificial Sequence
  Description of Artificial Sequence: Synthetic peptide
QEEEIATTNPVGTEQYGEAPSTCQHGDK

SEQ ID NO: 99264 - protein, 28 aa, Artificial Sequence
  Description of Artificial Sequence: Synthetic peptide
QEEEIATTNPVGTEQYGEAPSTCQHGEK

SEQ ID NO: 99265 - protein, 30 aa, Artificial Sequence
  Description of Artificial Sequence: Synthetic polypeptide
AENEIACTNPVATEQYGEASATGLVQFGGR

SEQ ID NO: 99266 - protein, 33 aa, Artificial Sequence
  Description of Artificial Sequence: Synthetic polypeptide
DQEEIRTTNPVATHQYGSVSTNGVTTNGGIEHR

SEQ ID NO: 99267 - protein, 29 aa, Artificial Sequence
  Description of Artificial Sequence: Synthetic peptide
AENEIACTNPVATEQYGEASEGLVQFGGR

SEQ ID NO: 99268 - protein, 30 aa, Artificial Sequence
  Description of Artificial Sequence: Synthetic polypeptide
AENEIACTNPVATEQYGEASAENPQREGND

SEQ ID NO: 99269 - protein, 30 aa, Artificial Sequence
  Description of Artificial Sequence: Synthetic polypeptide
AENEIACTNPVATEQYGEASAENLVQRGGD

SEQ ID NO: 99270 - protein, 33 aa, Artificial Sequence
  Description of Artificial Sequence: Synthetic polypeptide
DQEEIRTTNPVATHQYGSVSTNGVTPEGSENHY

SEQ ID NO: 99271 - protein, 28 aa, Artificial Sequence
  Description of Artificial Sequence: Synthetic peptide
QEEEIATTNPVGTEGYGVMASTLQHGDI

SEQ ID NO: 99272 - protein, 30 aa, Artificial Sequence
  Description of Artificial Sequence: Synthetic polypeptide
IEEEIASVNPVSTEQYGTVVSVNLQQGNEQ

SEQ ID NO: 99273 - protein, 33 aa, Artificial Sequence
  Description of Artificial Sequence: Synthetic polypeptide
FEEGITTTNPVATEQYGSVSLMVNSQRGENNSE

SEQ ID NO: 99274 - protein, 29 aa, Artificial Sequence
  Description of Artificial Sequence: Synthetic peptide
QEEEIASTNPVGTEGYGVVATTTLQHGNI

SEQ ID NO: 99275 - protein, 36 aa, Artificial Sequence
  Description of Artificial Sequence: Synthetic polypeptide
AEEEIRTTNPVATEQYGSVVTSTNNLEQGTEGGNTT

SEQ ID NO: 99276 - protein, 31 aa, Artificial Sequence
  Description of Artificial Sequence: Synthetic polypeptide
FEETIATTNPVATEQYGSVSTNLEDYLMEFE

SEQ ID NO: 99277 - protein, 33 aa, Artificial Sequence
  Description of Artificial Sequence: Synthetic polypeptide
NEEEIRTTNPVATEQYGSVSPWIELPEFAMNRQ

SEQ ID NO: 99278 - protein, 31 aa, Artificial Sequence
  Description of Artificial Sequence: Synthetic polypeptide
AEEEIRTTNPVAYEHWGCFSINDDQRQGNDR

SEQ ID NO: 99279 - protein, 31 aa, Artificial Sequence
  Description of Artificial Sequence: Synthetic polypeptide
DEEAICTTNPMATETYGSVPTNDPQHRGIFE

SEQ ID NO: 99280 - protein, 34 aa, Artificial Sequence
  Description of Artificial Sequence: Synthetic polypeptide
DEEEIRTTNPVATEQYGSVSDGIENEMNDEGGNI

SEQ ID NO: 99281 - protein, 33 aa, Artificial Sequence
  Description of Artificial Sequence: Synthetic polypeptide
DEEEIACTNPVATEQYGSVCAANNLQDSDDGNH

SEQ ID NO: 99282 - protein, 28 aa, Artificial Sequence
  Description of Artificial Sequence: Synthetic peptide
QEEEIATTNPVATEQYGVATEVGQEEET

SEQ ID NO: 99283 - protein, 33 aa, Artificial Sequence
  Description of Artificial Sequence: Synthetic polypeptide
QEEEIATTNPVAYEQYGTSPVMSANKQRGEGRM

SEQ ID NO: 99284 - protein, 33 aa, Artificial Sequence
  Description of Artificial Sequence: Synthetic polypeptide
AEEEIRTTNPVATEQYGSVVTNQNLQEEDEQEE

SEQ ID NO: 99285 - protein, 28 aa, Artificial Sequence
  Description of Artificial Sequence: Synthetic peptide
QEEEIATTNPVCTEQYGEVPEVLQHEEK

SEQ ID NO: 99286 - protein, 34 aa, Artificial Sequence
  Description of Artificial Sequence: Synthetic polypeptide
AEEEIRTTNPVATEQYGVVVVVSTTNLQQGEDGV

SEQ ID NO: 99287 - protein, 31 aa, Artificial Sequence
  Description of Artificial Sequence: Synthetic polypeptide
DEEEIACTNPVATEQYGSVCAANDQDSGMFD

SEQ ID NO: 99288 - protein, 33 aa, Artificial Sequence
  Description of Artificial Sequence: Synthetic polypeptide
DEEEIRTTNPVATEQYGSVSDGMTGEENGGGGT

SEQ ID NO: 99289 - protein, 32 aa, Artificial Sequence
  Description of Artificial Sequence: Synthetic polypeptide
FEEGITTTNPVATEQYGSVSLMVNSQRNENSS

SEQ ID NO: 99290 - protein, 31 aa, Artificial Sequence
  Description of Artificial Sequence: Synthetic polypeptide
AENEIACTNPVATEQYGEASCENLQRPGGGR

SEQ ID NO: 99291 - protein, 34 aa, Artificial Sequence
  Description of Artificial Sequence: Synthetic polypeptide
AEEEIRTTNPVATEQYGSVVTNNNEQLGGNNNAS

SEQ ID NO: 99292 - protein, 30 aa, Artificial Sequence
  Description of Artificial Sequence: Synthetic polypeptide
AEEEIRTTNPVAYEHWGCFSINDHQGNGNR

SEQ ID NO: 99293 - protein, 32 aa, Artificial Sequence
  Description of Artificial Sequence: Synthetic polypeptide
DEEAIRTTNPVATEQWGCVCGTNELQGGSDQS

SEQ ID NO: 99294 - protein, 35 aa, Artificial Sequence
  Description of Artificial Sequence: Synthetic polypeptide
DEEEIRTTNPVATEQYGSVSNTPNDMQKIIGPQQE

SEQ ID NO: 99295 - protein, 32 aa, Artificial Sequence
  Description of Artificial Sequence: Synthetic polypeptide
DQEEIGTTNPVAYEHYGSVVACTNELSQFGNM

SEQ ID NO: 99296 - protein, 34 aa, Artificial Sequence
  Description of Artificial Sequence: Synthetic polypeptide
DEEEIRTTNPVATEQYGSVSNTDNVEMEFGGETF

SEQ ID NO: 99297 - protein, 34 aa, Artificial Sequence
  Description of Artificial Sequence: Synthetic polypeptide
DEEEIRTTNPVATEQYGSVIDTNDVQQFNVPEVE

SEQ ID NO: 99298 - protein, 34 aa, Artificial Sequence
  Description of Artificial Sequence: Synthetic polypeptide
DEEEIRTTNPVATEQYGSVSNTDNVEMEFGEGET

SEQ ID NO: 99299 - protein, 34 aa, Artificial Sequence
  Description of Artificial Sequence: Synthetic polypeptide
DEEEIRTTNPVATEQYGSVPSTPTLPLNRNETEL

SEQ ID NO: 99300 - protein, 34 aa, Artificial Sequence
  Description of Artificial Sequence: Synthetic polypeptide
DEEEIRTTNPVATEQYGSVSNTDNVEFTEFGEGF

SEQ ID NO: 99301 - protein, 33 aa, Artificial Sequence
  Description of Artificial Sequence: Synthetic polypeptide
QEEEIATTNPVATEQYGSVSSTTPAGPNRGMNV

SEQ ID NO: 99302 - protein, 32 aa, Artificial Sequence
  Description of Artificial Sequence: Synthetic polypeptide
FEEEIRTTNPVATEQYGVVSSTGGGQGGEEGT

SEQ ID NO: 99303 - protein, 31 aa, Artificial Sequence
  Description of Artificial Sequence: Synthetic polypeptide
DQAEIRTTNPVAYEGYGCCSVTVLQTHGNIR

SEQ ID NO: 99304 - protein, 34 aa, Artificial Sequence
  Description of Artificial Sequence: Synthetic polypeptide
DEEEIRTTNPVATEQYGSVPSTPSSLPQNMIPIE

SEQ ID NO: 99305 - protein, 32 aa, Artificial Sequence
  Description of Artificial Sequence: Synthetic polypeptide
QEEEIATTNPVATEQYGSVSSTTPAGNRGMEV

SEQ ID NO: 99306 - protein, 31 aa, Artificial Sequence
  Description of Artificial Sequence: Synthetic polypeptide
DEEAIRTTNPVATEIYGCVCGTELQYFGSDQ

SEQ ID NO: 99307 - protein, 32 aa, Artificial Sequence
  Description of Artificial Sequence: Synthetic polypeptide
DEEAIRTTNPVATEIYGCVCQTELQYFGSNQA

SEQ ID NO: 99308 - protein, 28 aa, Artificial Sequence
  Description of Artificial Sequence: Synthetic peptide
QEEEIASVNPCCSEQYGIVSCNLQSGTR

SEQ ID NO: 99309 - protein, 32 aa, Artificial Sequence
  Description of Artificial Sequence: Synthetic polypeptide
QEEEIATTNPVATEQYGSVSSTEPAGNRGMEV

SEQ ID NO: 99310 - protein, 34 aa, Artificial Sequence
  Description of Artificial Sequence: Synthetic polypeptide
NEEEIRTTNPVATEQYGSVSAGNLDDEFNGGNIG

SEQ ID NO: 99311 - protein, 34 aa, Artificial Sequence
  Description of Artificial Sequence: Synthetic polypeptide
AEEEIRTTNPVATEQYGSVVVVTNNLNNTEGNNS

SEQ ID NO: 99312 - protein, 33 aa, Artificial Sequence
  Description of Artificial Sequence: Synthetic polypeptide
DEEEIRTTNPVATEQYGSVPHPPVGLQVQGGTI

SEQ ID NO: 99313 - protein, 34 aa, Artificial Sequence
  Description of Artificial Sequence: Synthetic polypeptide
DEEEIRTTNPVATEQYGSVIDTNDVQLYANVPVQ

SEQ ID NO: 99314 - protein, 32 aa, Artificial Sequence
  Description of Artificial Sequence: Synthetic polypeptide
DQAEIRTTNPVAYEHYGSVACTLNELSQFGNL

SEQ ID NO: 99315 - protein, 34 aa, Artificial Sequence
  Description of Artificial Sequence: Synthetic polypeptide
DQSEIRTTNPVAYEQYGSTVSTGNLSQPVTVTNR

SEQ ID NO: 99316 - protein, 34 aa, Artificial Sequence
  Description of Artificial Sequence: Synthetic polypeptide
DQSEIRTTNPVATEQYGSVVSCTGNLSDPVVTNR

SEQ ID NO: 99317 - protein, 35 aa, Artificial Sequence
  Description of Artificial Sequence: Synthetic polypeptide
DEEEIRTTNPVATEQYGSVPSTPVEIEVMGENQRP

SEQ ID NO: 99318 - protein, 31 aa, Artificial Sequence
  Description of Artificial Sequence: Synthetic polypeptide
DQAEIRYTNPVATEQYGSVSVNQNDTGSNSD

SEQ ID NO: 99319 - protein, 32 aa, Artificial Sequence
  Description of Artificial Sequence: Synthetic polypeptide
QEEEIATTNPVATEQYGSVSTEALPNHNEMEV

SEQ ID NO: 99320 - protein, 33 aa, Artificial Sequence
  Description of Artificial Sequence: Synthetic polypeptide
QEEEIATTNPVATEQYGSVSSTTPAGQRNENPV

SEQ ID NO: 99321 - protein, 28 aa, Artificial Sequence
  Description of Artificial Sequence: Synthetic peptide
AENEIACTNPVATEQYGEASENLMAGGA

SEQ ID NO: 99322 - protein, 28 aa, Artificial Sequence
  Description of Artificial Sequence: Synthetic peptide
QEEEIASTNPVGTEGYGVMASTLQHGNQ

SEQ ID NO: 99323 - protein, 33 aa, Artificial Sequence
  Description of Artificial Sequence: Synthetic polypeptide
NEEEIRTTNPVATERYGTVVSTNELSQAGGEEH

SEQ ID NO: 99324 - protein, 32 aa, Artificial Sequence
  Description of Artificial Sequence: Synthetic polypeptide
QEEEIATTNPVATEQYGSVSSTTPAGQHNENL

SEQ ID NO: 99325 - protein, 35 aa, Artificial Sequence
  Description of Artificial Sequence: Synthetic polypeptide
AEEEIRTTNPVATEQYGSVVVVTNNLNQTGEENDD

SEQ ID NO: 99326 - protein, 35 aa, Artificial Sequence
  Description of Artificial Sequence: Synthetic polypeptide
DEEEIRTTNPVATEQYGSVIDSTDGDQGEGGNQDE

SEQ ID NO: 99327 - protein, 34 aa, Artificial Sequence
  Description of Artificial Sequence: Synthetic polypeptide
FEEEIRTTNPVATEQYGVVSTGDDLEQGGENTGN

SEQ ID NO: 99328 - protein, 35 aa, Artificial Sequence
  Description of Artificial Sequence: Synthetic polypeptide
DEEEIRTTNPVATEQYGSVSNTDTFLDSNFGNEGN

SEQ ID NO: 99329 - protein, 33 aa, Artificial Sequence
  Description of Artificial Sequence: Synthetic polypeptide
DEEEIRTTNPVATEQYGSVSNTDTDDSENFNDD

SEQ ID NO: 99330 - protein, 28 aa, Artificial Sequence
  Description of Artificial Sequence: Synthetic peptide
QEEEIAPTNPCSSEQYGIVSCNLMSGTR

SEQ ID NO: 99331 - protein, 35 aa, Artificial Sequence
  Description of Artificial Sequence: Synthetic polypeptide
AEEEIRTTNPVATEQYGSVVVVTNNLGQTGEENDD

SEQ ID NO: 99332 - protein, 32 aa, Artificial Sequence
  Description of Artificial Sequence: Synthetic polypeptide
FEEEIRTTNPVATEQYGVVSTDGQGENDNGGQ

SEQ ID NO: 99333 - protein, 31 aa, Artificial Sequence
  Description of Artificial Sequence: Synthetic polypeptide
DQAEIRTTNPVAYEQWGCVCSTVHSQHGGNR

SEQ ID NO: 99334 - protein, 33 aa, Artificial Sequence
  Description of Artificial Sequence: Synthetic polypeptide
FEEEIRTTNPVATEQYGVVSSTGGNGQGEENGM

SEQ ID NO: 99335 - protein, 35 aa, Artificial Sequence
  Description of Artificial Sequence: Synthetic polypeptide
AEEEIRTTNPVATEQYGSVVVVTNLQQGNGNNNTE

SEQ ID NO: 99336 - protein, 31 aa, Artificial Sequence
  Description of Artificial Sequence: Synthetic polypeptide
DQAEIRYTNPVATEQYGSVSVPNQDHGSNSG

SEQ ID NO: 99337 - protein, 34 aa, Artificial Sequence
  Description of Artificial Sequence: Synthetic polypeptide
DEEEIRTTNPVATEQYGSVMTGDFNGGETGNEDI

SEQ ID NO: 99338 - protein, 33 aa, Artificial Sequence
  Description of Artificial Sequence: Synthetic polypeptide
NESEIRTTNPVAYEQWGSVYKTDNLDQRGENQL

SEQ ID NO: 99339 - protein, 31 aa, Artificial Sequence
  Description of Artificial Sequence: Synthetic polypeptide
DEDEIRTTNPVAYEWWGVVSTNLQGDGDDGA

SEQ ID NO: 99340 - protein, 35 aa, Artificial Sequence
  Description of Artificial Sequence: Synthetic polypeptide
AEEEIRTTNPVATEQYGSVVVVTNNLQQTGEENDE

SEQ ID NO: 99341 - protein, 34 aa, Artificial Sequence
  Description of Artificial Sequence: Synthetic polypeptide
DEEEIRTTNPVATEQYGSVSNTTWHVQHDSSEDR

SEQ ID NO: 99342 - protein, 35 aa, Artificial Sequence
  Description of Artificial Sequence: Synthetic polypeptide
DEEEIRTTNPVATEQYGSVSNTDNMNIIGGNNQDD

SEQ ID NO: 99343 - protein, 28 aa, Artificial Sequence
  Description of Artificial Sequence: Synthetic peptide
QEEEIAPTNPCSSEQYGIVSCNCQSGTR

SEQ ID NO: 99344 - protein, 34 aa, Artificial Sequence
  Description of Artificial Sequence: Synthetic polypeptide
DEEEIRTTNPVATEQYGSVSNTVEQTDGDQGEGQ

SEQ ID NO: 99345 - protein, 33 aa, Artificial Sequence
  Description of Artificial Sequence: Synthetic polypeptide
DEEEIRTTNPVATEQYGSVSNTVHGELFNSQQE

SEQ ID NO: 99346 - protein, 33 aa, Artificial Sequence
  Description of Artificial Sequence: Synthetic polypeptide
DEEEIRTTNPVATEQYGSVSDNMNNVDIGGGEE

SEQ ID NO: 99347 - protein, 32 aa, Artificial Sequence
  Description of Artificial Sequence: Synthetic polypeptide
DQAEIRTTNPVATEQYGELSATNLQEEGQDSV

SEQ ID NO: 99348 - protein, 34 aa, Artificial Sequence
  Description of Artificial Sequence: Synthetic polypeptide
DQSEIRTTNPVAYEQYGSVVSTGNLSQPSVTNFR

SEQ ID NO: 99349 - protein, 34 aa, Artificial Sequence
  Description of Artificial Sequence: Synthetic polypeptide
AEEEIRTTNPVATEQYGSVVTTNNLNNEQGQNDE

SEQ ID NO: 99350 - protein, 32 aa, Artificial Sequence
  Description of Artificial Sequence: Synthetic polypeptide
DEEAIRTTNPVATEQWGCVCGTGELQHFGSNQ

SEQ ID NO: 99351 - protein, 35 aa, Artificial Sequence
  Description of Artificial Sequence: Synthetic polypeptide
DEEEIRTTNPVATEQYGSVIEPTMNTQPRMEGLEE

SEQ ID NO: 99352 - protein, 34 aa, Artificial Sequence
  Description of Artificial Sequence: Synthetic polypeptide
DEEEIRTTNPVATEQYGSVMSDENEGQEDDNIQD

SEQ ID NO: 99353 - protein, 33 aa, Artificial Sequence
  Description of Artificial Sequence: Synthetic polypeptide
NETEDEIRTTNPVAYEQWGTVSTNLQGTGENDG

SEQ ID NO: 99354 - protein, 34 aa, Artificial Sequence
  Description of Artificial Sequence: Synthetic polypeptide
AEEEIRTTNPVAYEAYGISVPSCTGNEGSQRGNE

SEQ ID NO: 99355 - protein, 31 aa, Artificial Sequence
  Description of Artificial Sequence: Synthetic polypeptide
DEEEIATTNPVATEQYGEVSTDCEDHEGEDL

SEQ ID NO: 99356 - protein, 35 aa, Artificial Sequence
  Description of Artificial Sequence: Synthetic polypeptide
DEEEIRTTNPVATEQYGSVIEPDTNNGQPRMQLER

SEQ ID NO: 99357 - protein, 28 aa, Artificial Sequence
  Description of Artificial Sequence: Synthetic peptide
QEEEIASVNPCCSEQYGVVSDNLQSGNQ

SEQ ID NO: 99358 - protein, 35 aa, Artificial Sequence
  Description of Artificial Sequence: Synthetic polypeptide
AEEEIRTTNPVATEQYGSVVTTNNLLGQEIGTNTE

SEQ ID NO: 99359 - protein, 35 aa, Artificial Sequence
  Description of Artificial Sequence: Synthetic polypeptide
AEEEIRTTNPVATEQYGSVVVTTTNGNLQQGTNTI

SEQ ID NO: 99360 - protein, 34 aa, Artificial Sequence
  Description of Artificial Sequence: Synthetic polypeptide
NEEEIRTTNPVATERYGTVVSTNELSQAGGNNHI

SEQ ID NO: 99361 - protein, 34 aa, Artificial Sequence
  Description of Artificial Sequence: Synthetic polypeptide
DEEEIRTTNPVATEQYGSVSDASGDEEQVAFVNR

SEQ ID NO: 99362 - protein, 35 aa, Artificial Sequence
  Description of Artificial Sequence: Synthetic polypeptide
AEEEIRTTNPVATEQYGSVVVVTNNLQQGNGTNTE

SEQ ID NO: 99363 - protein, 35 aa, Artificial Sequence
  Description of Artificial Sequence: Synthetic polypeptide
AEEEIRTTNPVAYEAYGISVPSCTGNGSQDRGNAR

SEQ ID NO: 99364 - protein, 34 aa, Artificial Sequence
  Description of Artificial Sequence: Synthetic polypeptide
NEEEIRTTNPVATERYGTVVSTPNELSQATGGNH

SEQ ID NO: 99365 - protein, 35 aa, Artificial Sequence
  Description of Artificial Sequence: Synthetic polypeptide
AEEEIRTTNPVATEQYGSVVTTNNLEQGNEGGNDE

SEQ ID NO: 99366 - protein, 34 aa, Artificial Sequence
  Description of Artificial Sequence: Synthetic polypeptide
AEEEIRTTNPVATEQYGSVVTTNNLGGNEQGNQN

SEQ ID NO: 99367 - protein, 31 aa, Artificial Sequence
  Description of Artificial Sequence: Synthetic polypeptide
NESEIYTTNPVATEQYGSVSAWNGDEEFGNQ

SEQ ID NO: 99368 - protein, 33 aa, Artificial Sequence
  Description of Artificial Sequence: Synthetic polypeptide
NESEIRTTNPVAYEQWGSVYKTDNLDQNGENYR

SEQ ID NO: 99369 - protein, 34 aa, Artificial Sequence
  Description of Artificial Sequence: Synthetic polypeptide
AEEEIRTTNPVATEQYGSVVVTTTNLGGNQGNDD

SEQ ID NO: 99370 - protein, 35 aa, Artificial Sequence
  Description of Artificial Sequence: Synthetic polypeptide
DEEEIRTTNPVATEQYGSVSNTDNMTIFNGNNENG

SEQ ID NO: 99371 - protein, 35 aa, Artificial Sequence
  Description of Artificial Sequence: Synthetic polypeptide
DEEEIRTTNPVATEQYGSVSNTDNMQEQTFGEGFN

SEQ ID NO: 99372 - protein, 31 aa, Artificial Sequence
  Description of Artificial Sequence: Synthetic polypeptide
DEDEIRTTNPVAYQQYGCVSTNDEHHGGNNP

SEQ ID NO: 99373 - protein, 32 aa, Artificial Sequence
  Description of Artificial Sequence: Synthetic polypeptide
NETEDEIATTNPVAYEQWGTVSTNLQGGENEG

SEQ ID NO: 99374 - protein, 32 aa, Artificial Sequence
  Description of Artificial Sequence: Synthetic polypeptide
QEEEIATTNPVATEQYGSVSATDLEDHEGEDL

SEQ ID NO: 99375 - protein, 34 aa, Artificial Sequence
  Description of Artificial Sequence: Synthetic polypeptide
DQSEIRTTNPVAYEQYGSVPSCTGNLSQPVVANR

SEQ ID NO: 99376 - protein, 34 aa, Artificial Sequence
  Description of Artificial Sequence: Synthetic polypeptide
DEEEIRTTNPVATEQYGSVSNTDNMNIIGGQEDN

SEQ ID NO: 99377 - protein, 34 aa, Artificial Sequence
  Description of Artificial Sequence: Synthetic polypeptide
DQAEIRTTNPVATEQYGSVSPTVTLERQGDNTQA

SEQ ID NO: 99378 - protein, 29 aa, Artificial Sequence
  Description of Artificial Sequence: Synthetic peptide
QEEEIATTNPVATEQYGSVSEVCPNHEEV

SEQ ID NO: 99379 - protein, 28 aa, Artificial Sequence
  Description of Artificial Sequence: Synthetic peptide
QEEEIASTNPCCSEQYGVVSDNLQSGTQ

SEQ ID NO: 99380 - protein, 34 aa, Artificial Sequence
  Description of Artificial Sequence: Synthetic polypeptide
DEEEIRTTNPVATEQYGSVPSTTELVHTVNENQV

SEQ ID NO: 99381 - protein, 35 aa, Artificial Sequence
  Description of Artificial Sequence: Synthetic polypeptide
DEEEIRTTNPVATEQYGSVSNTSNGVEQVGPIAAV

SEQ ID NO: 99382 - protein, 31 aa, Artificial Sequence
  Description of Artificial Sequence: Synthetic polypeptide
NEREIRTTNPVAYEQWGQTVWTNLSQNPGSR

SEQ ID NO: 99383 - protein, 32 aa, Artificial Sequence
  Description of Artificial Sequence: Synthetic polypeptide
DEECISTTNPVAYEQYGHSVDSANHTNVGNVR

SEQ ID NO: 99384 - protein, 34 aa, Artificial Sequence
  Description of Artificial Sequence: Synthetic polypeptide
DEEEIRTTNPVATEQYGSVHVTNGLEITPILNTQ

SEQ ID NO: 99385 - protein, 36 aa, Artificial Sequence
  Description of Artificial Sequence: Synthetic polypeptide
DEEEIRTTNPVATEQYGSVPSTTPAGPNMQNGMNPV

SEQ ID NO: 99386 - protein, 34 aa, Artificial Sequence
  Description of Artificial Sequence: Synthetic polypeptide
AEEEIRTTNPVATEQYGSVVVVTNLGGNNGENQD

SEQ ID NO: 99387 - protein, 32 aa, Artificial Sequence
  Description of Artificial Sequence: Synthetic polypeptide
DEEEIACTNPVATEQYGSCATNPPDDHGENDR

SEQ ID NO: 99388 - protein, 34 aa, Artificial Sequence
  Description of Artificial Sequence: Synthetic polypeptide
NEEEIRTTNPVATEQYGSYSTMEGDQRGQGGNNG

SEQ ID NO: 99389 - protein, 30 aa, Artificial Sequence
  Description of Artificial Sequence: Synthetic polypeptide
DEEAIRTTNPDATEGYGSCSTNLNDSTQIH

SEQ ID NO: 99390 - protein, 31 aa, Artificial Sequence
  Description of Artificial Sequence: Synthetic polypeptide
DEEAIRTTNPDATEGYGSCSTNPLADTQNHQ

SEQ ID NO: 99391 - protein, 33 aa, Artificial Sequence
  Description of Artificial Sequence: Synthetic polypeptide
FEQEIRTTNPVATEQYGDVSTDNGQEGGGNDDG

SEQ ID NO: 99392 - protein, 34 aa, Artificial Sequence
  Description of Artificial Sequence: Synthetic polypeptide
AEEEIRTTNPVATEQYGSVVVVTNLGGNQGTNEE

SEQ ID NO: 99393 - protein, 32 aa, Artificial Sequence
  Description of Artificial Sequence: Synthetic polypeptide
DEEEIACTNPVATEQYGSCATNLQTADPNEND

SEQ ID NO: 99394 - protein, 33 aa, Artificial Sequence
  Description of Artificial Sequence: Synthetic polypeptide
DEEEIRTTNPVATEQYGSVHYTDPYVEMEENRI

SEQ ID NO: 99395 - protein, 31 aa, Artificial Sequence
  Description of Artificial Sequence: Synthetic polypeptide
DQEEIATTNPVATTQWGSVSTDGDGPNGNHR

SEQ ID NO: 99396 - protein, 34 aa, Artificial Sequence
  Description of Artificial Sequence: Synthetic polypeptide
DEEEIRTTNPVATEQYGSVSDAVNDMQNETQNFD

SEQ ID NO: 99397 - protein, 31 aa, Artificial Sequence
  Description of Artificial Sequence: Synthetic polypeptide
DQEEIATTNPVATTQWGEVSTNGDGTNGNHR

SEQ ID NO: 99398 - protein, 35 aa, Artificial Sequence
  Description of Artificial Sequence: Synthetic polypeptide
AEEEIRTTNPVATEQYGSVVTVTNTNLQQGNNQSE

SEQ ID NO: 99399 - protein, 35 aa, Artificial Sequence
  Description of Artificial Sequence: Synthetic polypeptide
AEEEIRTTNPVAYEQWGSVNKTDNPLDQRGNGGDR

SEQ ID NO: 99400 - protein, 32 aa, Artificial Sequence
  Description of Artificial Sequence: Synthetic polypeptide
DEEAIRTTNCCATEGYGSVSNTNSQRTFNEEA

SEQ ID NO: 99401 - protein, 28 aa, Artificial Sequence
  Description of Artificial Sequence: Synthetic peptide
QEEEIAPTNPCSSEQYGIVSCNLQSGTK

SEQ ID NO: 99402 - protein, 32 aa, Artificial Sequence
  Description of Artificial Sequence: Synthetic polypeptide
DQEEIATTNPVAYEHYGSVACTLNETSQFGNR

SEQ ID NO: 99403 - protein, 34 aa, Artificial Sequence
  Description of Artificial Sequence: Synthetic polypeptide
DQEEICTTNPVAYEQYGSVSCTNSESQVRGGPNF

SEQ ID NO: 99404 - protein, 33 aa, Artificial Sequence
  Description of Artificial Sequence: Synthetic polypeptide
DQEEIRTTNPVAYHQYGSVVSCTNEVSDNGNNR

SEQ ID NO: 99405 - protein, 33 aa, Artificial Sequence
  Description of Artificial Sequence: Synthetic polypeptide
DQEEIRTTNPVAYMQYGSVCSTGEVSQNVGNNR

SEQ ID NO: 99406 - protein, 34 aa, Artificial Sequence
  Description of Artificial Sequence: Synthetic polypeptide
DEEEIRTTNPVATEQYGSVSNTGNMNNEEGEGGQ

SEQ ID NO: 99407 - protein, 31 aa, Artificial Sequence
  Description of Artificial Sequence: Synthetic polypeptide
DEEAICTVNPVATEAYGSVSVDNNLENGNQE

SEQ ID NO: 99408 - protein, 34 aa, Artificial Sequence
  Description of Artificial Sequence: Synthetic polypeptide
AEEEIRTTNPVATEQYGSVVVVTDTNQQIGTNLE

SEQ ID NO: 99409 - protein, 32 aa, Artificial Sequence
  Description of Artificial Sequence: Synthetic polypeptide
DQEEIRTTNPVAYMQYGTVSTGGGSQNVGNNR

SEQ ID NO: 99410 - protein, 33 aa, Artificial Sequence
  Description of Artificial Sequence: Synthetic polypeptide
FEEEIRTTNPVAYEQYGQSVSEQDALQTGVELR

SEQ ID NO: 99411 - protein, 34 aa, Artificial Sequence
  Description of Artificial Sequence: Synthetic polypeptide
NEEEIRTTNPVATERYGITVVSTNELSQAGGNHE

SEQ ID NO: 99412 - protein, 30 aa, Artificial Sequence
  Description of Artificial Sequence: Synthetic polypeptide
AENEIACTNPVATEQYGEASAENLQDHGGR

SEQ ID NO: 99413 - protein, 34 aa, Artificial Sequence
  Description of Artificial Sequence: Synthetic polypeptide
DEEEIRTTNPVATEQYGSVMTGDFNNGGEEGNES

SEQ ID NO: 99414 - protein, 33 aa, Artificial Sequence
  Description of Artificial Sequence: Synthetic polypeptide
DQEEIRTTNPVAYTQYGSVSCTNEVSDNGGNNR

SEQ ID NO: 99415 - protein, 32 aa, Artificial Sequence
  Description of Artificial Sequence: Synthetic polypeptide
DEEEIATTNPVATENYGSVATGNQDNGRNGED

SEQ ID NO: 99416 - protein, 31 aa, Artificial Sequence
  Description of Artificial Sequence: Synthetic polypeptide
AENEIACTNPVATEQYGEARSENLQRGDGQR

SEQ ID NO: 99417 - protein, 30 aa, Artificial Sequence
  Description of Artificial Sequence: Synthetic polypeptide
NEREISTTNPVATEQYGSVEVNGVITGSER

SEQ ID NO: 99418 - protein, 31 aa, Artificial Sequence
  Description of Artificial Sequence: Synthetic polypeptide
QEEEIATTNPVATEQYGTVCPATGPVQHGNK

SEQ ID NO: 99419 - protein, 32 aa, Artificial Sequence
  Description of Artificial Sequence: Synthetic polypeptide
DQGEIRTTNPVATEQYGSVTTVNKLENMMGQQ

SEQ ID NO: 99420 - protein, 31 aa, Artificial Sequence
  Description of Artificial Sequence: Synthetic polypeptide
QEEEIATTNPVATEQYGTVCPATGPVQFGNK

SEQ ID NO: 99421 - protein, 33 aa, Artificial Sequence
  Description of Artificial Sequence: Synthetic polypeptide
DEEEIATTNPVATENYGSVVTGPGLGQPGNGNV

SEQ ID NO: 99422 - protein, 35 aa, Artificial Sequence
  Description of Artificial Sequence: Synthetic polypeptide
DEEEIRTTNPVATEQYGSVSNTSNGVEQVNPIIRV

SEQ ID NO: 99423 - protein, 32 aa, Artificial Sequence
  Description of Artificial Sequence: Synthetic polypeptide
NESEIRTTNPVATESWGSVAWTDNLQQQDGSR

SEQ ID NO: 99424 - protein, 33 aa, Artificial Sequence
  Description of Artificial Sequence: Synthetic polypeptide
NEEEIRTTNPVATERYGTVVCNTNELSQAGGNH

SEQ ID NO: 99425 - protein, 33 aa, Artificial Sequence
  Description of Artificial Sequence: Synthetic polypeptide
FEEEIRTTNPVATEQYGVVSTGNGDDEGGENNF

SEQ ID NO: 99426 - protein, 35 aa, Artificial Sequence
  Description of Artificial Sequence: Synthetic polypeptide
DEEEIRTTNPVATEQYGSVICPTLGLYQQRVNNDN

SEQ ID NO: 99427 - protein, 33 aa, Artificial Sequence
  Description of Artificial Sequence: Synthetic polypeptide
QEEEIATTNPVATEQYGSVSTNLIENPEENNEN

SEQ ID NO: 99428 - protein, 32 aa, Artificial Sequence
  Description of Artificial Sequence: Synthetic polypeptide
FEEEIRTTNPVATEQYGVVSTGMGQGDGEIET

SEQ ID NO: 99429 - protein, 34 aa, Artificial Sequence
  Description of Artificial Sequence: Synthetic polypeptide
AEEEIRTTNPVATEQYGSVVVVTNLNNENGQNED

SEQ ID NO: 99430 - protein, 32 aa, Artificial Sequence
  Description of Artificial Sequence: Synthetic polypeptide
DEEAIRTTNPVATECYGGHSTWNELQPPSNEV

SEQ ID NO: 99431 - protein, 33 aa, Artificial Sequence
  Description of Artificial Sequence: Synthetic polypeptide
DEEAIRTTNPVATECYGQVATTGGDHQRGSNDR

SEQ ID NO: 99432 - protein, 33 aa, Artificial Sequence
  Description of Artificial Sequence: Synthetic polypeptide
DEEAIRTTNPVATECYGVVATTGGDHQRGGSNR

SEQ ID NO: 99433 - protein, 35 aa, Artificial Sequence
  Description of Artificial Sequence: Synthetic polypeptide
AEEEIRTTNPVATEQYGSVVVTVANLNNQEGNNVD

SEQ ID NO: 99434 - protein, 33 aa, Artificial Sequence
  Description of Artificial Sequence: Synthetic polypeptide
DEEEIATTNPVATEQYGNVSSTTAGNSRNGNPV

SEQ ID NO: 99435 - protein, 33 aa, Artificial Sequence
  Description of Artificial Sequence: Synthetic polypeptide
QEEEIATTNPVATEQYGSVSTEALPNRNGMEPV

SEQ ID NO: 99436 - protein, 28 aa, Artificial Sequence
  Description of Artificial Sequence: Synthetic peptide
QEEEIAPTNPCSSEQYGIVSCNLQHGTK

SEQ ID NO: 99437 - protein, 28 aa, Artificial Sequence
  Description of Artificial Sequence: Synthetic peptide
QEEEIASTNPVGTEGYGVVASNLQSGDI

SEQ ID NO: 99438 - protein, 32 aa, Artificial Sequence
  Description of Artificial Sequence: Synthetic polypeptide
QEEEIATTNPVATEQYGSVSTEALPNRNEMEV

SEQ ID NO: 99439 - protein, 35 aa, Artificial Sequence
  Description of Artificial Sequence: Synthetic polypeptide
AEEEIRTTNPVATEQYGSVVVTVANLNQNEQGNVE

SEQ ID NO: 99440 - protein, 34 aa, Artificial Sequence
  Description of Artificial Sequence: Synthetic polypeptide
DEEEIRTTNPVATEQYGSVSNTSNGVEQVDPIHV

SEQ ID NO: 99441 - protein, 34 aa, Artificial Sequence
  Description of Artificial Sequence: Synthetic polypeptide
NEEEIRTTNPVATERYGTVVQSTNELSGAGGNRV

SEQ ID NO: 99442 - protein, 33 aa, Artificial Sequence
  Description of Artificial Sequence: Synthetic polypeptide
AEEEIRTTNPVATEQYGSVVTTNMEQGTNNVTE

SEQ ID NO: 99443 - protein, 29 aa, Artificial Sequence
  Description of Artificial Sequence: Synthetic peptide
AENEIACTNPVATEQYGEASENLHGGGQR

SEQ ID NO: 99444 - protein, 33 aa, Artificial Sequence
  Description of Artificial Sequence: Synthetic polypeptide
IEEEIRTTNPVATEQYGSVSTANDMQNEVQDDN

SEQ ID NO: 99445 - protein, 33 aa, Artificial Sequence
  Description of Artificial Sequence: Synthetic polypeptide
DEEEIATTNPVATEQYGNVSSTTAINSRNGNPV

SEQ ID NO: 99446 - protein, 33 aa, Artificial Sequence
  Description of Artificial Sequence: Synthetic polypeptide
DEEEIACTNPVATEQYGSCATNLQESGNDSQEP

SEQ ID NO: 99447 - protein, 31 aa, Artificial Sequence
  Description of Artificial Sequence: Synthetic polypeptide
DEEEIACTNPVATEQYGSCATNGQDQGGDEQ

SEQ ID NO: 99448 - protein, 32 aa, Artificial Sequence
  Description of Artificial Sequence: Synthetic polypeptide
FEQEIRTTNPVATEQYGSCSTENSQQHEGETN

SEQ ID NO: 99449 - protein, 34 aa, Artificial Sequence
  Description of Artificial Sequence: Synthetic polypeptide
DEEEIRTTNPVATEQYGSVHYTIDNYVEVENDRI

SEQ ID NO: 99450 - protein, 30 aa, Artificial Sequence
  Description of Artificial Sequence: Synthetic polypeptide
NESEIRTTNPVAYEAYGKVWTNLSTIGGSR

SEQ ID NO: 99451 - protein, 34 aa, Artificial Sequence
  Description of Artificial Sequence: Synthetic polypeptide
DEEEIRTTNPVATEQYGSVPTNLEIARPVLEESD

SEQ ID NO: 99452 - protein, 34 aa, Artificial Sequence
  Description of Artificial Sequence: Synthetic polypeptide
DEEEIRTTNPVATEQYGSVSNTFLNVEREEEDSS

SEQ ID NO: 99453 - protein, 34 aa, Artificial Sequence
  Description of Artificial Sequence: Synthetic polypeptide
DEEEIRTTNPVATEQYGSVPTNLEQDTIMLEQMD

SEQ ID NO: 99454 - protein, 32 aa, Artificial Sequence
  Description of Artificial Sequence: Synthetic polypeptide
DEEAIRTTNPDAYEGYGSCSTTNLEFRSGQNE

SEQ ID NO: 99455 - protein, 34 aa, Artificial Sequence
  Description of Artificial Sequence: Synthetic polypeptide
FEEEIRTTNPVATESYGSVSTMDLDEQGGGNDGQ

SEQ ID NO: 99456 - protein, 33 aa, Artificial Sequence
  Description of Artificial Sequence: Synthetic polypeptide
AEEEIRTTNPVATEQYGSVVVVTNLGLGGEAET

SEQ ID NO: 99457 - protein, 32 aa, Artificial Sequence
  Description of Artificial Sequence: Synthetic polypeptide
IEEEIRTTNPVATEQYGSVSPTDMENRDTQEP

SEQ ID NO: 99458 - protein, 35 aa, Artificial Sequence
  Description of Artificial Sequence: Synthetic polypeptide
FEEEIRTTNPVATEQYGVVSTMNGLQEGGGQNDNG

SEQ ID NO: 99459 - protein, 34 aa, Artificial Sequence
  Description of Artificial Sequence: Synthetic polypeptide
AEEEIRTTNPVATEQYGSVVTTNLGGNEQGNNNA

SEQ ID NO: 99460 - protein, 32 aa, Artificial Sequence
  Description of Artificial Sequence: Synthetic polypeptide
DEEEIRTTNPVATEQYGSVIAPTMLGLAQIED

SEQ ID NO: 99461 - protein, 34 aa, Artificial Sequence
  Description of Artificial Sequence: Synthetic polypeptide
AEEEIRTTNPVATEQYGSVVTTNLQQQGEGIGTQ

SEQ ID NO: 99462 - protein, 33 aa, Artificial Sequence
  Description of Artificial Sequence: Synthetic polypeptide
DEEEIRTTNPVATEQYGSVIAPTTILGLSGIED

SEQ ID NO: 99463 - protein, 32 aa, Artificial Sequence
  Description of Artificial Sequence: Synthetic polypeptide
DEEEIRTTNPVATEQYGSVIAPVPLATGIEDQ

SEQ ID NO: 99464 - protein, 32 aa, Artificial Sequence
  Description of Artificial Sequence: Synthetic polypeptide
DEEEIATTNPVATEIYGSVATNQNMGEGNNEQ

SEQ ID NO: 99465 - protein, 29 aa, Artificial Sequence
  Description of Artificial Sequence: Synthetic peptide
QEEEIATTNPVATEQYGNVATEVEQEEEA

SEQ ID NO: 99466 - protein, 35 aa, Artificial Sequence
  Description of Artificial Sequence: Synthetic polypeptide
DEEEIRTTNPVATEQYGSVSNNDNMDQGIGETNGD

SEQ ID NO: 99467 - protein, 31 aa, Artificial Sequence
  Description of Artificial Sequence: Synthetic polypeptide
QEEEIATTNPVATEQYGNVAANVCQSRVGEK

SEQ ID NO: 99468 - protein, 35 aa, Artificial Sequence
  Description of Artificial Sequence: Synthetic polypeptide
DEEEIRTTNPVATEQYGSVSPGNNTQGRDILEERD

SEQ ID NO: 99469 - protein, 29 aa, Artificial Sequence
  Description of Artificial Sequence: Synthetic peptide
AENEIACTNPVATEQWGETSENLQHDGGR

SEQ ID NO: 99470 - protein, 31 aa, Artificial Sequence
  Description of Artificial Sequence: Synthetic polypeptide
DSEEIRTTNPVGTEQWGTVSTNLQHDDMSMK

SEQ ID NO: 99471 - protein, 29 aa, Artificial Sequence
  Description of Artificial Sequence: Synthetic peptide
QEEEIATTNPVATEQYGEVSEVEQHEEEK

SEQ ID NO: 99472 - protein, 35 aa, Artificial Sequence
  Description of Artificial Sequence: Synthetic polypeptide
AEEEIRTTNPVATEQYGSVVVVVTNLQQQGEGNTE

SEQ ID NO: 99473 - protein, 35 aa, Artificial Sequence
  Description of Artificial Sequence: Synthetic polypeptide
DEEEIRTTNPVATEQYGSVILTNMLVIDAGEEERL

SEQ ID NO: 99474 - protein, 30 aa, Artificial Sequence
  Description of Artificial Sequence: Synthetic polypeptide
DEECISTVNPVATEGYGSVCSWELEHGSNQ

SEQ ID NO: 99475 - protein, 34 aa, Artificial Sequence
  Description of Artificial Sequence: Synthetic polypeptide
DEEEIRTTNPVATEQYGSVILTNMYIQAQEEERL

SEQ ID NO: 99476 - protein, 35 aa, Artificial Sequence
  Description of Artificial Sequence: Synthetic polypeptide
DEEEIRTTNPVATEQYGSVNWTELDLWQYTSNEER

SEQ ID NO: 99477 - protein, 34 aa, Artificial Sequence
  Description of Artificial Sequence: Synthetic polypeptide
DEEEIRTTNPVATEQYGSVILTNNLVVAGEGEFL

SEQ ID NO: 99478 - protein, 34 aa, Artificial Sequence
  Description of Artificial Sequence: Synthetic polypeptide
AEEEIRTTNPVATEQYGSVVVTTNNNQQGNNGQD

SEQ ID NO: 99479 - protein, 34 aa, Artificial Sequence
  Description of Artificial Sequence: Synthetic polypeptide
DEEEIRTTNPVATEQYGSVILTNPLIVANEVEEL

SEQ ID NO: 99480 - protein, 30 aa, Artificial Sequence
  Description of Artificial Sequence: Synthetic polypeptide
DEEEIATTNPVATEQYGEASEVCQREEEEK

SEQ ID NO: 99481 - protein, 28 aa, Artificial Sequence
  Description of Artificial Sequence: Synthetic peptide
NENEIATTNPVATECYGIVSECLQHEEL

SEQ ID NO: 99482 - protein, 32 aa, Artificial Sequence
  Description of Artificial Sequence: Synthetic polypeptide
DSEEIRTTNPVGTEQWGTVSTNLQHGDDMQMW

SEQ ID NO: 99483 - protein, 32 aa, Artificial Sequence
  Description of Artificial Sequence: Synthetic polypeptide
NEHEIRTTNPVATEQYGSLTSTHLQHIQVGQE

SEQ ID NO: 99484 - protein, 35 aa, Artificial Sequence
  Description of Artificial Sequence: Synthetic polypeptide
AEEEIRTTNPVATEQYGSVVVTTNNNLQLIGNTEG

SEQ ID NO: 99485 - protein, 31 aa, Artificial Sequence
  Description of Artificial Sequence: Synthetic polypeptide
DEEEIATTNPVATEQYGEASPEAGPQRNGEK

SEQ ID NO: 99486 - protein, 35 aa, Artificial Sequence
  Description of Artificial Sequence: Synthetic polypeptide
DEEEIRTTNPVATEQYGSVILTWNMLIQATEEERL

SEQ ID NO: 99487 - protein, 32 aa, Artificial Sequence
  Description of Artificial Sequence: Synthetic polypeptide
DNEEIATTNPVATEQYGSVSATDLEDHEGEDL

SEQ ID NO: 99488 - protein, 32 aa, Artificial Sequence
  Description of Artificial Sequence: Synthetic polypeptide
DEEEIATTNPVATEQYGEASPTPAGNRNGMNV

SEQ ID NO: 99489 - protein, 33 aa, Artificial Sequence
  Description of Artificial Sequence: Synthetic polypeptide
DEEEIRTTNPVATEQYGSVSPFDLMLVPVEVRN

SEQ ID NO: 99490 - protein, 32 aa, Artificial Sequence
  Description of Artificial Sequence: Synthetic polypeptide
DEDEIRTTNPVAYEQWGVVSTNAQQGDGNANI

SEQ ID NO: 99491 - protein, 33 aa, Artificial Sequence
  Description of Artificial Sequence: Synthetic polypeptide
FEEEIRTTNPVATEQYGSVSPTNLYEVIVPIDN

SEQ ID NO: 99492 - protein, 35 aa, Artificial Sequence
  Description of Artificial Sequence: Synthetic polypeptide
DEEEIRTTNPVATEQYGSVQCTPPNLGFPQQDNEI

SEQ ID NO: 99493 - protein, 34 aa, Artificial Sequence
  Description of Artificial Sequence: Synthetic polypeptide
DEEEIRTTNPVATEQYGSVSPGNLEEPAMQVEEE

SEQ ID NO: 99494 - protein, 31 aa, Artificial Sequence
  Description of Artificial Sequence: Synthetic polypeptide
DSEEIRTTNPVGTEQWGTASTNLQHDGMQMN

SEQ ID NO: 99495 - protein, 31 aa, Artificial Sequence
  Description of Artificial Sequence: Synthetic polypeptide
DEECIACTNPVAYEEPYGYSVASNLQRGDND

SEQ ID NO: 99496 - protein, 35 aa, Artificial Sequence
  Description of Artificial Sequence: Synthetic polypeptide
AEEEIRTTNPVATEQYGSVVVVVTNLQQGNGNETE

SEQ ID NO: 99497 - protein, 28 aa, Artificial Sequence
  Description of Artificial Sequence: Synthetic peptide
QEEEIATTNPCSSEQYGIVPCNLQSETR

SEQ ID NO: 99498 - protein, 29 aa, Artificial Sequence
  Description of Artificial Sequence: Synthetic peptide
QEEEIATTNPVATEQYGEVSPEACQHEEK

SEQ ID NO: 99499 - protein, 35 aa, Artificial Sequence
  Description of Artificial Sequence: Synthetic polypeptide
FEEEIRTTNPVATEQYGSVSPAVNLQQNMGEQERD

SEQ ID NO: 99500 - protein, 35 aa, Artificial Sequence
  Description of Artificial Sequence: Synthetic polypeptide
FEEEIRTTNPVATEQYGSVSPAVNLQQMQGEEERG

SEQ ID NO: 99501 - protein, 32 aa, Artificial Sequence
  Description of Artificial Sequence: Synthetic polypeptide
DNEEIATTNPVATTQYGSVSTNNGPMVGQNQC

SEQ ID NO: 99502 - protein, 30 aa, Artificial Sequence
  Description of Artificial Sequence: Synthetic polypeptide
DEECIACTNPVAYEPYNYSSASNLQRGDNR

SEQ ID NO: 99503 - protein, 30 aa, Artificial Sequence
  Description of Artificial Sequence: Synthetic polypeptide
DEECIACTNPVAYEQYGQCSTANVQHGNDN

SEQ ID NO: 99504 - protein, 29 aa, Artificial Sequence
  Description of Artificial Sequence: Synthetic peptide
AENEIACTNPVATEQWGEVSENLQNREGA

SEQ ID NO: 99505 - protein, 30 aa, Artificial Sequence
  Description of Artificial Sequence: Synthetic polypeptide
DSEEIRTTNPVGTEQWGTVSTELQHDDMHN

SEQ ID NO: 99506 - protein, 28 aa, Artificial Sequence
  Description of Artificial Sequence: Synthetic peptide
QEEEIATTNPCSTEQYGEASCNLQSETK

SEQ ID NO: 99507 - protein, 33 aa, Artificial Sequence
  Description of Artificial Sequence: Synthetic polypeptide
DEEEIACTNPVATEQYGSVATNVLQEQMNNSLH

SEQ ID NO: 99508 - protein, 32 aa, Artificial Sequence
  Description of Artificial Sequence: Synthetic polypeptide
DEEEIRTTNPVATEQYGSVSMTDDTASVEEGH

SEQ ID NO: 99509 - protein, 35 aa, Artificial Sequence
  Description of Artificial Sequence: Synthetic polypeptide
AEEEIRTTNPVATEQYGSVVVTTNNLQQGNGNVTD

SEQ ID NO: 99510 - protein, 28 aa, Artificial Sequence
  Description of Artificial Sequence: Synthetic peptide
NENEIATTNPVATECYGDVSECLQHEEL

SEQ ID NO: 99511 - protein, 31 aa, Artificial Sequence
  Description of Artificial Sequence: Synthetic polypeptide
DEECISTVNPVATEGYGSVCSWNDERFGSNQ

SEQ ID NO: 99512 - protein, 34 aa, Artificial Sequence
  Description of Artificial Sequence: Synthetic polypeptide
AEEEIRTTNPVATEQYGSVVVTTNNLQLQEGTTE

SEQ ID NO: 99513 - protein, 30 aa, Artificial Sequence
  Description of Artificial Sequence: Synthetic polypeptide
DEEEIATTNPVATECYGSVSECGPQHEEPV

SEQ ID NO: 99514 - protein, 29 aa, Artificial Sequence
  Description of Artificial Sequence: Synthetic peptide
AENEIACTNPVATEQWGEASENLQDRGGG

SEQ ID NO: 99515 - protein, 28 aa, Artificial Sequence
  Description of Artificial Sequence: Synthetic peptide
HEGEIAPTNPCSCEQYGIVSCNLQSGTR

SEQ ID NO: 99516 - protein, 28 aa, Artificial Sequence
  Description of Artificial Sequence: Synthetic peptide
QEEEIATTNPVATEQYGEVSEVCNHEEV

SEQ ID NO: 99517 - protein, 30 aa, Artificial Sequence
  Description of Artificial Sequence: Synthetic polypeptide
AENEIACTNPVATEQWGEASENLPQDRGGR

SEQ ID NO: 99518 - protein, 28 aa, Artificial Sequence
  Description of Artificial Sequence: Synthetic peptide
QEEEIASTNPVATEQYGVAPSVLQHGEK

SEQ ID NO: 99519 - protein, 28 aa, Artificial Sequence
  Description of Artificial Sequence: Synthetic peptide
AENEIACTNPVATEQWGEASENEQREGR

SEQ ID NO: 99520 - protein, 30 aa, Artificial Sequence
  Description of Artificial Sequence: Synthetic polypeptide
QEEEIATTNPVATEQYGEVSEPACNRNENV

SEQ ID NO: 99521 - protein, 29 aa, Artificial Sequence
  Description of Artificial Sequence: Synthetic peptide
AENEIACTNPVATEQWGEASENEQRAGGR

SEQ ID NO: 99522 - protein, 33 aa, Artificial Sequence
  Description of Artificial Sequence: Synthetic polypeptide
DEECIATTNPVATEQYGTVHSITNMLQDRSSGM

SEQ ID NO: 99523 - protein, 33 aa, Artificial Sequence
  Description of Artificial Sequence: Synthetic polypeptide
DEEEIRTTNPVATEQYGSVSPHQLGQVVIMELS

SEQ ID NO: 99524 - protein, 35 aa, Artificial Sequence
  Description of Artificial Sequence: Synthetic polypeptide
FEEEIRTTNPVATEQYGSVSNMQTDNLDEFGENMD

SEQ ID NO: 99525 - protein, 30 aa, Artificial Sequence
  Description of Artificial Sequence: Synthetic polypeptide
DEEEIATTNPVATEQYGEAPTVCQMRNEEK

SEQ ID NO: 99526 - protein, 34 aa, Artificial Sequence
  Description of Artificial Sequence: Synthetic polypeptide
DEEEIRTTNPVATEQYGSVSMSGLQMNGGLEEQL

SEQ ID NO: 99527 - protein, 35 aa, Artificial Sequence
  Description of Artificial Sequence: Synthetic polypeptide
AEEEIRTTNPVATEQYGSVVTVTNNLQQNTENGNS

SEQ ID NO: 99528 - protein, 30 aa, Artificial Sequence
  Description of Artificial Sequence: Synthetic polypeptide
AENEIACTNPVATEQWGEASENLQREGEGR

SEQ ID NO: 99529 - protein, 35 aa, Artificial Sequence
  Description of Artificial Sequence: Synthetic polypeptide
AEEEIRTTNPVATEQYGSVVTVANLGNQEGTNNVT

SEQ ID NO: 99530 - protein, 32 aa, Artificial Sequence
  Description of Artificial Sequence: Synthetic polypeptide
QEEEIACTNPVATEQYGCVATNLQRDQMGTTA

SEQ ID NO: 99531 - protein, 29 aa, Artificial Sequence
  Description of Artificial Sequence: Synthetic peptide
DEEEIATTNPVATEQYGEASEICQNHEEK

SEQ ID NO: 99532 - protein, 32 aa, Artificial Sequence
  Description of Artificial Sequence: Synthetic polypeptide
DNEEIATTNPVAATQYGSVSTNNGPMLGHNDR

SEQ ID NO: 99533 - protein, 33 aa, Artificial Sequence
  Description of Artificial Sequence: Synthetic polypeptide
DEEEIRTTNPVATEQYGSVPPTPVEMQVMENDM

SEQ ID NO: 99534 - protein, 35 aa, Artificial Sequence
  Description of Artificial Sequence: Synthetic polypeptide
AEEEIRTTNPVATEQYGSVVVTTNNLQQGEEGGNT

SEQ ID NO: 99535 - protein, 33 aa, Artificial Sequence
  Description of Artificial Sequence: Synthetic polypeptide
FEEEIRTTNPVATEQYGSVSNTDNDNNEMGEGI

SEQ ID NO: 99536 - protein, 34 aa, Artificial Sequence
  Description of Artificial Sequence: Synthetic polypeptide
DEEEIRTTNPVATEQYGSVNVGTVNGLGENNTDN

SEQ ID NO: 99537 - protein, 28 aa, Artificial Sequence
  Description of Artificial Sequence: Synthetic peptide
HEGEIAPTNPCSSEQYGIVSCNLQSGTR

SEQ ID NO: 99538 - protein, 32 aa, Artificial Sequence
  Description of Artificial Sequence: Synthetic polypeptide
DEEEIACTNPVATEQYGSVATNVLEDNPEGAE

SEQ ID NO: 99539 - protein, 33 aa, Artificial Sequence
  Description of Artificial Sequence: Synthetic polypeptide
DSEEIRTTNPVGTEQWGMVSWTNDQQDRSGEVR

SEQ ID NO: 99540 - protein, 33 aa, Artificial Sequence
  Description of Artificial Sequence: Synthetic polypeptide
DEEEIRTTNPVATEQYGSVNGTLDDQGFGQDGA

SEQ ID NO: 99541 - protein, 32 aa, Artificial Sequence
  Description of Artificial Sequence: Synthetic polypeptide
DNECIRTTNPVATEIYGQVVTTYDLQRGSNQQ

SEQ ID NO: 99542 - protein, 29 aa, Artificial Sequence
  Description of Artificial Sequence: Synthetic peptide
DMWEICSTNPVAYEPYGSSAGTNDQRGND

SEQ ID NO: 99543 - protein, 32 aa, Artificial Sequence
  Description of Artificial Sequence: Synthetic polypeptide
AEEEISTTNPVATEQYGCVCSTELQHFNSDQI

SEQ ID NO: 99544 - protein, 32 aa, Artificial Sequence
  Description of Artificial Sequence: Synthetic polypeptide
NEEEIRTTNPVATEQYGCVSAGELDEFGSNQQ

SEQ ID NO: 99545 - protein, 28 aa, Artificial Sequence
  Description of Artificial Sequence: Synthetic peptide
QEEEIATTNPCSTEQYGIASCNLQSETK

SEQ ID NO: 99546 - protein, 28 aa, Artificial Sequence
  Description of Artificial Sequence: Synthetic peptide
NENEIATTNPVATECYGEVSECLQHEES

SEQ ID NO: 99547 - protein, 28 aa, Artificial Sequence
  Description of Artificial Sequence: Synthetic peptide
HEGEIAPTNPCSSEQYGIVSCNLQSGPR

SEQ ID NO: 99548 - protein, 33 aa, Artificial Sequence
  Description of Artificial Sequence: Synthetic polypeptide
DEEEIATTNPVATEPYGSVCADTNLTDAGGNEQ

SEQ ID NO: 99549 - protein, 29 aa, Artificial Sequence
  Description of Artificial Sequence: Synthetic peptide
DEEEIATTNPVATEQYGEASEICQNHEEA

SEQ ID NO: 99550 - protein, 35 aa, Artificial Sequence
  Description of Artificial Sequence: Synthetic polypeptide
DEEEIRTTNPVATEQYGSVSMTNGLEQADFVEEAQ

SEQ ID NO: 99551 - protein, 33 aa, Artificial Sequence
  Description of Artificial Sequence: Synthetic polypeptide
DSEEIRTTNPVGTEQWGMVSWNNDLQDRSGGVR

SEQ ID NO: 99552 - protein, 28 aa, Artificial Sequence
  Description of Artificial Sequence: Synthetic peptide
NENEIATTNPVATECYGIVSECLQHEES

SEQ ID NO: 99553 - protein, 35 aa, Artificial Sequence
  Description of Artificial Sequence: Synthetic polypeptide
DEEEIRTTNPVATEQYGSVPAPPNLQQSALGVERD

SEQ ID NO: 99554 - protein, 34 aa, Artificial Sequence
  Description of Artificial Sequence: Synthetic polypeptide
DEEEIRTTNPVATEQYGSVQCTNNLEQPEQVDEF

SEQ ID NO: 99555 - protein, 31 aa, Artificial Sequence
  Description of Artificial Sequence: Synthetic polypeptide
AENEIACTNPVATEQYGCEASECNLQRGGRR

SEQ ID NO: 99556 - protein, 32 aa, Artificial Sequence
  Description of Artificial Sequence: Synthetic polypeptide
DSEEIRTTNPVGTEQWGCVCSTNLQFFGSVAA

SEQ ID NO: 99557 - protein, 32 aa, Artificial Sequence
  Description of Artificial Sequence: Synthetic polypeptide
DSEEIRTTNPVGTEQWGCVCSTNTQRFGSVQP

SEQ ID NO: 99558 - protein, 32 aa, Artificial Sequence
  Description of Artificial Sequence: Synthetic polypeptide
DSEEIRTTNPVGTEQWGCVCSTPLQRFGSVQG

SEQ ID NO: 99559 - protein, 31 aa, Artificial Sequence
  Description of Artificial Sequence: Synthetic polypeptide
DSEEIRTTNPVGTEQWGCVSTNHQNFGSVQS

SEQ ID NO: 99560 - protein, 32 aa, Artificial Sequence
  Description of Artificial Sequence: Synthetic polypeptide
NEPEIRTTNPVATEQYGSVSTDNNNDNEGQDQ

SEQ ID NO: 99561 - protein, 32 aa, Artificial Sequence
  Description of Artificial Sequence: Synthetic polypeptide
DEEEIRTTNPVATEQYGSVSMVKDDPFPNELN

SEQ ID NO: 99562 - protein, 33 aa, Artificial Sequence
  Description of Artificial Sequence: Synthetic polypeptide
DEEEIRTTNPVATEQYGSVSMVGLIEITPGQLV

SEQ ID NO: 99563 - protein, 29 aa, Artificial Sequence
  Description of Artificial Sequence: Synthetic peptide
AENEIACTNPVATEQYGCASWNLQGGGQA

SEQ ID NO: 99564 - protein, 34 aa, Artificial Sequence
  Description of Artificial Sequence: Synthetic polypeptide
AEEEIRTTNPVATEQYGSVVVTTNQLGNTNGNNE

SEQ ID NO: 99565 - protein, 31 aa, Artificial Sequence
  Description of Artificial Sequence: Synthetic polypeptide
DSEEIRSTNPVAYEQWGSISCTNDQATGGNN

SEQ ID NO: 99566 - protein, 34 aa, Artificial Sequence
  Description of Artificial Sequence: Synthetic polypeptide
NETEIRTTNPVATECYGSVSTNGLQGNEGGDDDR

SEQ ID NO: 99567 - protein, 35 aa, Artificial Sequence
  Description of Artificial Sequence: Synthetic polypeptide
AEEEIRTTNPVATEQYGSVVVTVTNGNLQQGTNVN

SEQ ID NO: 99568 - protein, 30 aa, Artificial Sequence
  Description of Artificial Sequence: Synthetic polypeptide
DSEEIRTTNPVGTEQWGGCCATNLQMPGDH

SEQ ID NO: 99569 - protein, 34 aa, Artificial Sequence
  Description of Artificial Sequence: Synthetic polypeptide
DEEEIRTTNPVATEQYGSVNGSTDDEGGNDTTNI

SEQ ID NO: 99570 - protein, 33 aa, Artificial Sequence
  Description of Artificial Sequence: Synthetic polypeptide
DEEEIRTTNPVATEQYGSVSPESQLPERLSEMG

SEQ ID NO: 99571 - protein, 35 aa, Artificial Sequence
  Description of Artificial Sequence: Synthetic polypeptide
DNEEIRTTNPVATEQYGSVNSTNDDDQRGGEEDIN

SEQ ID NO: 99572 - protein, 34 aa, Artificial Sequence
  Description of Artificial Sequence: Synthetic polypeptide
FEEEIRTTNPVATEQYGSVSPTWLAEIEQQNARQ

SEQ ID NO: 99573 - protein, 28 aa, Artificial Sequence
  Description of Artificial Sequence: Synthetic peptide
QEEEIATTNPCATEQYGEAPENLQHEEK

SEQ ID NO: 99574 - protein, 34 aa, Artificial Sequence
  Description of Artificial Sequence: Synthetic polypeptide
DSEEIRTTNPVAYEQYGSTVVSCTDLSGRGTNSF

SEQ ID NO: 99575 - protein, 33 aa, Artificial Sequence
  Description of Artificial Sequence: Synthetic polypeptide
DEEEIRTTNPVATEQYGSVPATADLESIGEIPQ

SEQ ID NO: 99576 - protein, 33 aa, Artificial Sequence
  Description of Artificial Sequence: Synthetic polypeptide
DSEEIRTTNPVAYERYGKVQSQNLQSEGGNNRD

SEQ ID NO: 99577 - protein, 29 aa, Artificial Sequence
  Description of Artificial Sequence: Synthetic peptide
AENEIACTNPVATEQYGCMSEVLQRGDGQ

SEQ ID NO: 99578 - protein, 30 aa, Artificial Sequence
  Description of Artificial Sequence: Synthetic polypeptide
QEEEIATTNPVATEQYGEVSTDGPEHEGEK

SEQ ID NO: 99579 - protein, 34 aa, Artificial Sequence
  Description of Artificial Sequence: Synthetic polypeptide
AEEEIRTTNPVATEQYGSVVVTVTNLGGNQGNDD

SEQ ID NO: 99580 - protein, 34 aa, Artificial Sequence
  Description of Artificial Sequence: Synthetic polypeptide
DEEEIRTTNPVATEQYGSVSPENNLEEEVGEELD

SEQ ID NO: 99581 - protein, 34 aa, Artificial Sequence
  Description of Artificial Sequence: Synthetic polypeptide
DEEEIRTTNPVATEQYGSVILTNLAIVTQEVEFE

SEQ ID NO: 99582 - protein, 34 aa, Artificial Sequence
  Description of Artificial Sequence: Synthetic polypeptide
DSEEIRTTNPVGTEQWGKVPSCTNLSQRGGVDRF

SEQ ID NO: 99583 - protein, 35 aa, Artificial Sequence
  Description of Artificial Sequence: Synthetic polypeptide
DEEEIRTTNPVATEQYGSVSNCNTEEQRVGEDFGI

SEQ ID NO: 99584 - protein, 30 aa, Artificial Sequence
  Description of Artificial Sequence: Synthetic polypeptide
AENEIACTNPVATEQYGCFCSSNLQRGGQA

SEQ ID NO: 99585 - protein, 31 aa, Artificial Sequence
  Description of Artificial Sequence: Synthetic polypeptide
DSEEIRTTNPVGTEAWGQVSCTGLSQGGGVR

SEQ ID NO: 99586 - protein, 34 aa, Artificial Sequence
  Description of Artificial Sequence: Synthetic polypeptide
DEEEIRTTNPVATEQYGSVSNAYLDTRLVFVGGI

SEQ ID NO: 99587 - protein, 35 aa, Artificial Sequence
  Description of Artificial Sequence: Synthetic polypeptide
DEEEIRTTNPVATEQYGSVILTNLLIGQAGEVEEL

SEQ ID NO: 99588 - protein, 34 aa, Artificial Sequence
  Description of Artificial Sequence: Synthetic polypeptide
DEEEIRTTNPVATEQYGSVSCTPGEQNSSQEITL

SEQ ID NO: 99589 - protein, 34 aa, Artificial Sequence
  Description of Artificial Sequence: Synthetic polypeptide
FEEEIRTTNPVATEQYGSVSPTWLAEMESVNGRQ

SEQ ID NO: 99590 - protein, 28 aa, Artificial Sequence
  Description of Artificial Sequence: Synthetic peptide
QEEEIATTNPVSTEQYGEVPCVLQHETK

SEQ ID NO: 99591 - protein, 32 aa, Artificial Sequence
  Description of Artificial Sequence: Synthetic polypeptide
DSEEIRTTNPVGTEQWGCVCSTEHQRFGSVNQ

SEQ ID NO: 99592 - protein, 32 aa, Artificial Sequence
  Description of Artificial Sequence: Synthetic polypeptide
DSEEIRTTNPVGTEAWGMVSCTNMLSQGGGVR

SEQ ID NO: 99593 - protein, 30 aa, Artificial Sequence
  Description of Artificial Sequence: Synthetic polypeptide
AENEIACTNPVATEQWGEACSENLQRGGNA

SEQ ID NO: 99594 - protein, 31 aa, Artificial Sequence
  Description of Artificial Sequence: Synthetic polypeptide
AENEIACTNPVATEQYGCASANLQTRGEGQR

SEQ ID NO: 99595 - protein, 31 aa, Artificial Sequence
  Description of Artificial Sequence: Synthetic polypeptide
AENEIACTNPVATEQYGCASANLQRAGGQRA

SEQ ID NO: 99596 - protein, 33 aa, Artificial Sequence
  Description of Artificial Sequence: Synthetic polypeptide
DEEEIRTTNPVATEQYGSVPPTTLINIEVNHEI

SEQ ID NO: 99597 - protein, 28 aa, Artificial Sequence
  Description of Artificial Sequence: Synthetic peptide
QEEEIATTNPVSTEQYGIASCVLQHETK

SEQ ID NO: 99598 - protein, 31 aa, Artificial Sequence
  Description of Artificial Sequence: Synthetic polypeptide
DEDEIRTTNPVAYEQWGVVSVENPQGGNMNA

SEQ ID NO: 99599 - protein, 29 aa, Artificial Sequence
  Description of Artificial Sequence: Synthetic peptide
AENEIACTNPVATEQYGCACSWNDQRGEQ

SEQ ID NO: 99600 - protein, 30 aa, Artificial Sequence
  Description of Artificial Sequence: Synthetic polypeptide
AENEIACTNPVATEQYGCACSWNDLQRGGQ

SEQ ID NO: 99601 - protein, 31 aa, Artificial Sequence
  Description of Artificial Sequence: Synthetic polypeptide
DEECEATTNPIAYEQWGEVSTNLQGDGDNQR

SEQ ID NO: 99602 - protein, 34 aa, Artificial Sequence
  Description of Artificial Sequence: Synthetic polypeptide
HEEEIRTTNPVATEQYGCVSTGSLHQGRNANFAV

SEQ ID NO: 99603 - protein, 33 aa, Artificial Sequence
  Description of Artificial Sequence: Synthetic polypeptide
DEEEIATTNPVATEQYGSACATNPLQDDPGGHH

SEQ ID NO: 99604 - protein, 31 aa, Artificial Sequence
  Description of Artificial Sequence: Synthetic polypeptide
DEEEIATTNPVATEQYGEASSEAGPQRNGEK

SEQ ID NO: 99605 - protein, 29 aa, Artificial Sequence
  Description of Artificial Sequence: Synthetic peptide
QEEEIATTNPVATEQYGEVSPEVCQHEEK

SEQ ID NO: 99606 - protein, 33 aa, Artificial Sequence
  Description of Artificial Sequence: Synthetic polypeptide
DEEEIRTTNPVATEQYGSVNYTDQDRYQFEVRI

SEQ ID NO: 99607 - protein, 33 aa, Artificial Sequence
  Description of Artificial Sequence: Synthetic polypeptide
DEEEIRTTNPVATEQYGSVNYMDNLGETIDVNE

SEQ ID NO: 99608 - protein, 30 aa, Artificial Sequence
  Description of Artificial Sequence: Synthetic polypeptide
QEEEIATTNPVATEQYGEVSPEPACQREEK

SEQ ID NO: 99609 - protein, 35 aa, Artificial Sequence
  Description of Artificial Sequence: Synthetic polypeptide
AEEEIRTTNPVATESYGSVSTVTNNLNQQGNDGGN

SEQ ID NO: 99610 - protein, 34 aa, Artificial Sequence
  Description of Artificial Sequence: Synthetic polypeptide
DEEEIRTTNPVATEQYGSVSPEVGMLQITPELNI

SEQ ID NO: 99611 - protein, 28 aa, Artificial Sequence
  Description of Artificial Sequence: Synthetic peptide
QEEEIATTNPVSTEQYGIASCVLQSETK

SEQ ID NO: 99612 - protein, 34 aa, Artificial Sequence
  Description of Artificial Sequence: Synthetic polypeptide
AEEEIRTTNPVATESYGSVSTVTNNLNQGNDGGT

SEQ ID NO: 99613 - protein, 33 aa, Artificial Sequence
  Description of Artificial Sequence: Synthetic polypeptide
DEEEIRTTNPVATEQYGSVNGTLDDQGFGIEQH

SEQ ID NO: 99614 - protein, 35 aa, Artificial Sequence
  Description of Artificial Sequence: Synthetic polypeptide
DEEEIRTTNPVATEQYGSVQCTPNLVPRMLLEGIN

SEQ ID NO: 99615 - protein, 32 aa, Artificial Sequence
  Description of Artificial Sequence: Synthetic polypeptide
DEEEIRTTNPVATEQYGSVSCIGNEVMLEETE

SEQ ID NO: 99616 - protein, 34 aa, Artificial Sequence
  Description of Artificial Sequence: Synthetic polypeptide
AEEEIRTTNPVATEQYGSVVVTTNQLGGNNGNDD

SEQ ID NO: 99617 - protein, 30 aa, Artificial Sequence
  Description of Artificial Sequence: Synthetic polypeptide
AENEIACTNPVATEQYGCASANLQGEGGQR

SEQ ID NO: 99618 - protein, 30 aa, Artificial Sequence
  Description of Artificial Sequence: Synthetic polypeptide
AENEIACTNPVATEQYGCASANLQERGGQL

SEQ ID NO: 99619 - protein, 31 aa, Artificial Sequence
  Description of Artificial Sequence: Synthetic polypeptide
QEEEIACTNPVATEQYGCVATNLQTEDNELH

SEQ ID NO: 99620 - protein, 33 aa, Artificial Sequence
  Description of Artificial Sequence: Synthetic polypeptide
DNEEIRTTNPVATEQYGSTVSTWDEQETENDMD

SEQ ID NO: 99621 - protein, 36 aa, Artificial Sequence
  Description of Artificial Sequence: Synthetic polypeptide
DEEEIRTTNPVATEQYGSVSMTNPLMTTRVGLDVEM

SEQ ID NO: 99622 - protein, 32 aa, Artificial Sequence
  Description of Artificial Sequence: Synthetic polypeptide
LEESIACTNPVATEQYGSVCSPNLENHRGTQR

SEQ ID NO: 99623 - protein, 30 aa, Artificial Sequence
  Description of Artificial Sequence: Synthetic polypeptide
AENEIACTNPVATEQYGCASANLQEMGGMR

SEQ ID NO: 99624 - protein, 33 aa, Artificial Sequence
  Description of Artificial Sequence: Synthetic polypeptide
DSEEIRTTNPVGTEQWGMVAWTENDLQDRGVAR

SEQ ID NO: 99625 - protein, 31 aa, Artificial Sequence
  Description of Artificial Sequence: Synthetic polypeptide
AENEIACTNPVATEQYGCASANLQRGGMGQR

SEQ ID NO: 99626 - protein, 33 aa, Artificial Sequence
  Description of Artificial Sequence: Synthetic polypeptide
DSEEIRTTNPVGTEQWGMVCSTLNDGQDRGGVR

SEQ ID NO: 99627 - protein, 31 aa, Artificial Sequence
  Description of Artificial Sequence: Synthetic polypeptide
NEPEIRTTNPVATEQYGSLSTHLETYQGDQG

SEQ ID NO: 99628 - protein, 35 aa, Artificial Sequence
  Description of Artificial Sequence: Synthetic polypeptide
AEEEIRTTNPVATEQYGSVVVVVTNLQQGIGNNTE

SEQ ID NO: 99629 - protein, 33 aa, Artificial Sequence
  Description of Artificial Sequence: Synthetic polypeptide
FEEEIRTTNPVATEQYGSVSPTTVLIALGFVQD

SEQ ID NO: 99630 - protein, 35 aa, Artificial Sequence
  Description of Artificial Sequence: Synthetic polypeptide
DEEEIRTTNPVATEQYGSVNGTFVSDDQRMEDNRN

SEQ ID NO: 99631 - protein, 34 aa, Artificial Sequence
  Description of Artificial Sequence: Synthetic polypeptide
AEEEIRTTNPVATEQYGSVVVTTNQLGGNQGNEE

SEQ ID NO: 99632 - protein, 32 aa, Artificial Sequence
  Description of Artificial Sequence: Synthetic polypeptide
NEHEIRTTNPVATEQYGSLSTHLQGIQPGDQE

SEQ ID NO: 99633 - protein, 28 aa, Artificial Sequence
  Description of Artificial Sequence: Synthetic peptide
LEGEIAPTNPCSSEQYGIVSCNLQSGTR

SEQ ID NO: 99634 - protein, 32 aa, Artificial Sequence
  Description of Artificial Sequence: Synthetic polypeptide
NEPEIRTTNPVATEQYGSLSTHLESYQNGVQG

SEQ ID NO: 99635 - protein, 35 aa, Artificial Sequence
  Description of Artificial Sequence: Synthetic polypeptide
DEEEIRTTNPVATEQYGSVNYTTNWEDQAGEEERQ

SEQ ID NO: 99636 - protein, 33 aa, Artificial Sequence
  Description of Artificial Sequence: Synthetic polypeptide
DEEEIRTTNPVATEQYGSVSMQLMNNTIEVDNT

SEQ ID NO: 99637 - protein, 33 aa, Artificial Sequence
  Description of Artificial Sequence: Synthetic polypeptide
DEEEIACTNPVATEQYGSVATNLQTPNNDTPLN

SEQ ID NO: 99638 - protein, 32 aa, Artificial Sequence
  Description of Artificial Sequence: Synthetic polypeptide
NETEIRTTNPVATEFWGSVSTNLQGNEGGDAD

SEQ ID NO: 99639 - protein, 32 aa, Artificial Sequence
  Description of Artificial Sequence: Synthetic polypeptide
DEEEIRTTNPVATEQYGSVSPIMGIEEIGDFN

SEQ ID NO: 99640 - protein, 31 aa, Artificial Sequence
  Description of Artificial Sequence: Synthetic polypeptide
DTEAEIACTNPVAYEQYGSVATNLQNPGDEM

SEQ ID NO: 99641 - protein, 30 aa, Artificial Sequence
  Description of Artificial Sequence: Synthetic polypeptide
QEEEIATTNPVATEQYGEVPTPVCNREMNV

SEQ ID NO: 99642 - protein, 35 aa, Artificial Sequence
  Description of Artificial Sequence: Synthetic polypeptide
AEEEIRTTNPVATEQYGSVVVTTNNLNNQAGNNNE

SEQ ID NO: 99643 - protein, 31 aa, Artificial Sequence
  Description of Artificial Sequence: Synthetic polypeptide
DTEAEIATTNPVAYEPYGSVAAANDDRGNRS

SEQ ID NO: 99644 - protein, 32 aa, Artificial Sequence
  Description of Artificial Sequence: Synthetic polypeptide
DMEEIRSTNPVATEQYGSSSCVPNMQEGNENQ

SEQ ID NO: 99645 - protein, 31 aa, Artificial Sequence
  Description of Artificial Sequence: Synthetic polypeptide
DEECLRTTNPCAYEQYGCVCSTNLQGFGSDQ

SEQ ID NO: 99646 - protein, 29 aa, Artificial Sequence
  Description of Artificial Sequence: Synthetic peptide
MEEEIASVNPVCTEQYGVVCSDNHQSGNQ

SEQ ID NO: 99647 - protein, 31 aa, Artificial Sequence
  Description of Artificial Sequence: Synthetic polypeptide
DEECLRTTNPCAYEQYGCVCSTNLQYGSQQS

SEQ ID NO: 99648 - protein, 32 aa, Artificial Sequence
  Description of Artificial Sequence: Synthetic polypeptide
DTEAEIATTNPVAYEPYGVVASATNLQEGGQR

SEQ ID NO: 99649 - protein, 32 aa, Artificial Sequence
  Description of Artificial Sequence: Synthetic polypeptide
DEEEIRTTNPVATEQYGSVPPTGQIRQTQEET

SEQ ID NO: 99650 - protein, 32 aa, Artificial Sequence
  Description of Artificial Sequence: Synthetic polypeptide
DTEAEIATTNPVAYEQYGSVATNLANGGDNQM

SEQ ID NO: 99651 - protein, 28 aa, Artificial Sequence
  Description of Artificial Sequence: Synthetic peptide
DEEEIATTNPVATEQYGEAPEVCQHEDK

SEQ ID NO: 99652 - protein, 28 aa, Artificial Sequence
  Description of Artificial Sequence: Synthetic peptide
QEEEIATTNPIATEQYGEASEVCMHENR

SEQ ID NO: 99653 - protein, 31 aa, Artificial Sequence
  Description of Artificial Sequence: Synthetic polypeptide
DMEEIRSTNPVATEQYGSSSCVPNMGEEGNN

SEQ ID NO: 99654 - protein, 36 aa, Artificial Sequence
  Description of Artificial Sequence: Synthetic polypeptide
DEEEIRTTNPVATEQYGSVSPINSYLASQQGDLNEE

SEQ ID NO: 99655 - protein, 34 aa, Artificial Sequence
  Description of Artificial Sequence: Synthetic polypeptide
DEEEIATTNPVATEPYGSVCFTNEDHKREGQNDR

SEQ ID NO: 99656 - protein, 33 aa, Artificial Sequence
  Description of Artificial Sequence: Synthetic polypeptide
DTEAEIACTNPVAYEQYGSVATNLQNPDGDNRM

SEQ ID NO: 99657 - protein, 31 aa, Artificial Sequence
  Description of Artificial Sequence: Synthetic polypeptide
MEDEITTTNPVATEQYGNVSVTGGGQGGGNE

SEQ ID NO: 99658 - protein, 30 aa, Artificial Sequence
  Description of Artificial Sequence: Synthetic polypeptide
DEECIATTNPVAYEQYSEEVTTGGQDGNTR

SEQ ID NO: 99659 - protein, 33 aa, Artificial Sequence
  Description of Artificial Sequence: Synthetic polypeptide
DEEEIRTTNPVATEQYGSVSPILNPNISVGEED

SEQ ID NO: 99660 - protein, 34 aa, Artificial Sequence
  Description of Artificial Sequence: Synthetic polypeptide
DEEEIRTTNPVATEQYGSVPPTGNNEQRMQVLEH

SEQ ID NO: 99661 - protein, 35 aa, Artificial Sequence
  Description of Artificial Sequence: Synthetic polypeptide
FEEEIRTTNPVATEQYGSVSITNGGTQTGGGNNNT

SEQ ID NO: 99662 - protein, 34 aa, Artificial Sequence
  Description of Artificial Sequence: Synthetic polypeptide
DEEEIRTTNPVATEQYGSVMGTINQQGNEFGEGE

SEQ ID NO: 99663 - protein, 33 aa, Artificial Sequence
  Description of Artificial Sequence: Synthetic polypeptide
DSTEISTTNPVATEMYGSVVTTMNGQERGNMRE

SEQ ID NO: 99664 - protein, 33 aa, Artificial Sequence
  Description of Artificial Sequence: Synthetic polypeptide
DEEEIRTTNPVATEQYGSVSMEVEDEINGGQRS

SEQ ID NO: 99665 - protein, 30 aa, Artificial Sequence
  Description of Artificial Sequence: Synthetic polypeptide
DTAEIATTNPCAYEPYGSVSANLGQRENTM

SEQ ID NO: 99666 - protein, 30 aa, Artificial Sequence
  Description of Artificial Sequence: Synthetic polypeptide
DTAEIATTNPCAYEPYGSVSANLQREMGRM

SEQ ID NO: 99667 - protein, 29 aa, Artificial Sequence
  Description of Artificial Sequence: Synthetic peptide
DTAEIATTNPCAYYEPYGSVSANLQADNN

SEQ ID NO: 99668 - protein, 35 aa, Artificial Sequence
  Description of Artificial Sequence: Synthetic polypeptide
DEEEIRTTNPVATEQYGSVSATTPAGPNSRNGMNV

SEQ ID NO: 99669 - protein, 28 aa, Artificial Sequence
  Description of Artificial Sequence: Synthetic peptide
DEEEIATTNPVATEQYGEAPEVCQHEEK

SEQ ID NO: 99670 - protein, 33 aa, Artificial Sequence
  Description of Artificial Sequence: Synthetic polypeptide
DTAEIATTNPVATEQYGSVAINGLENQAGGNPR

SEQ ID NO: 99671 - protein, 35 aa, Artificial Sequence
  Description of Artificial Sequence: Synthetic polypeptide
DEEEIRTTNPVATEQYGSVSPIGNLQVIENPNIGN

SEQ ID NO: 99672 - protein, 34 aa, Artificial Sequence
  Description of Artificial Sequence: Synthetic polypeptide
DEEEIRTTNPVATEQYGSVSMDYLTNKEETQNDG

SEQ ID NO: 99673 - protein, 31 aa, Artificial Sequence
  Description of Artificial Sequence: Synthetic polypeptide
QEEEIACTNPVATEQYGCVATNLQQSEDTRE

SEQ ID NO: 99674 - protein, 34 aa, Artificial Sequence
  Description of Artificial Sequence: Synthetic polypeptide
DEEEIRTTNPVATEQYGSVSPILNLVISVGEEDP

SEQ ID NO: 99675 - protein, 32 aa, Artificial Sequence
  Description of Artificial Sequence: Synthetic polypeptide
DEEEIRTTNPVATEQYGSVSPILNNISVVEED

SEQ ID NO: 99676 - protein, 31 aa, Artificial Sequence
  Description of Artificial Sequence: Synthetic polypeptide
NEEEIRTTNPVATEQYGCSCSWELQNFQSEQ

SEQ ID NO: 99677 - protein, 34 aa, Artificial Sequence
  Description of Artificial Sequence: Synthetic polypeptide
AEEEIRTTNPVATESYGSVSTTNLNNNIGTDQRE

SEQ ID NO: 99678 - protein, 28 aa, Artificial Sequence
  Description of Artificial Sequence: Synthetic peptide
QEEEIATTNPVSTEQYGIVPCVLQHETK

SEQ ID NO: 99679 - protein, 36 aa, Artificial Sequence
  Description of Artificial Sequence: Synthetic polypeptide
DEEEIRTTNPVATEQYGSVMSNGITNDLGEGETNGD

SEQ ID NO: 99680 - protein, 28 aa, Artificial Sequence
  Description of Artificial Sequence: Synthetic peptide
QEEEIATTNPIATEQYGEASEVCQHENK

SEQ ID NO: 99681 - protein, 34 aa, Artificial Sequence
  Description of Artificial Sequence: Synthetic polypeptide
DEEEIRTTNPVATEQYGSVNGTNELDDNSGSEDF

SEQ ID NO: 99682 - protein, 34 aa, Artificial Sequence
  Description of Artificial Sequence: Synthetic polypeptide
DEEEIRTTNPVATEQYGSVMGTFDQGGGEDENGG

SEQ ID NO: 99683 - protein, 31 aa, Artificial Sequence
  Description of Artificial Sequence: Synthetic polypeptide
DTEAEIATTNPVAYEQYGSVATNLQAPPDDH

SEQ ID NO: 99684 - protein, 34 aa, Artificial Sequence
  Description of Artificial Sequence: Synthetic polypeptide
DEEEIRTTNPVATEQYGSVSLVPNGLQTMPQQLE

SEQ ID NO: 99685 - protein, 31 aa, Artificial Sequence
  Description of Artificial Sequence: Synthetic polypeptide
QEEEIACTNPVATEQYGCVATNLQQEEEDTR

SEQ ID NO: 99686 - protein, 35 aa, Artificial Sequence
  Description of Artificial Sequence: Synthetic polypeptide
AEEEIRTTNPVATEQYGSVVTVTNNLQNQEGTNTT

SEQ ID NO: 99687 - protein, 34 aa, Artificial Sequence
  Description of Artificial Sequence: Synthetic polypeptide
DEEEIRTTNPVATEQYGSVSLVLLEGGQENSEEA

SEQ ID NO: 99688 - protein, 33 aa, Artificial Sequence
  Description of Artificial Sequence: Synthetic polypeptide
DEEEIRTTNPVATEQYGSVIPTVMQPVGSQDEM

SEQ ID NO: 99689 - protein, 33 aa, Artificial Sequence
  Description of Artificial Sequence: Synthetic polypeptide
DEEEIRTTNPVATEQYGSVSLTVTQVTESTAID

SEQ ID NO: 99690 - protein, 30 aa, Artificial Sequence
  Description of Artificial Sequence: Synthetic polypeptide
AENEIACTNPVATECYGEVSCINEQREGGR

SEQ ID NO: 99691 - protein, 28 aa, Artificial Sequence
  Description of Artificial Sequence: Synthetic peptide
QEEEIATTNPVSTEQYGIVPCVLQSETK

SEQ ID NO: 99692 - protein, 35 aa, Artificial Sequence
  Description of Artificial Sequence: Synthetic polypeptide
DEEEIRTTNPVATEQYGSVMGTDNMEQEGGGGNNP

SEQ ID NO: 99693 - protein, 32 aa, Artificial Sequence
  Description of Artificial Sequence: Synthetic polypeptide
MEEEIATTNPVATEQWGCVAATHLQMMDGNGR

SEQ ID NO: 99694 - protein, 35 aa, Artificial Sequence
  Description of Artificial Sequence: Synthetic polypeptide
DEEEIRTTNPVATEQYGSVMGTDLGLEGQGGGNGN

SEQ ID NO: 99695 - protein, 34 aa, Artificial Sequence
  Description of Artificial Sequence: Synthetic polypeptide
DEEEIRTTNPVATEQYGSVIPTVMVPENGMNDRN

SEQ ID NO: 99696 - protein, 35 aa, Artificial Sequence
  Description of Artificial Sequence: Synthetic polypeptide
DEEEIRTTNPVATEQYGSVMGTDFNNNQNEFGGNE

SEQ ID NO: 99697 - protein, 32 aa, Artificial Sequence
  Description of Artificial Sequence: Synthetic polypeptide
DTEAEIATTNPVAYEQYGSVATNLQNPQDNAM

SEQ ID NO: 99698 - protein, 31 aa, Artificial Sequence
  Description of Artificial Sequence: Synthetic polypeptide
DTEAEIATTNPVAYEQYGSVATNLQNPSDDM

SEQ ID NO: 99699 - protein, 33 aa, Artificial Sequence
  Description of Artificial Sequence: Synthetic polypeptide
FEEEIRTTNPVATEQYGSVSINMGMGGGQGNTM

SEQ ID NO: 99700 - protein, 28 aa, Artificial Sequence
  Description of Artificial Sequence: Synthetic peptide
QEEEIATTNPVATEQYGEVPEVCQHEEL

SEQ ID NO: 99701 - protein, 34 aa, Artificial Sequence
  Description of Artificial Sequence: Synthetic polypeptide
DEEEIRTTNPVATEQYGSVSLVPNGLTQTLQQLE

SEQ ID NO: 99702 - protein, 28 aa, Artificial Sequence
  Description of Artificial Sequence: Synthetic peptide
DEEEIATTNPVATEQYGEAPEICQHEEK

SEQ ID NO: 99703 - protein, 34 aa, Artificial Sequence
  Description of Artificial Sequence: Synthetic polypeptide
DEEEIRTTNPVATEQYGSVIPPTLVLQQVGEQLM

SEQ ID NO: 99704 - protein, 32 aa, Artificial Sequence
  Description of Artificial Sequence: Synthetic polypeptide
QEEEIACTNPVATEQYGCVATNLQQGQEDNQM

SEQ ID NO: 99705 - protein, 34 aa, Artificial Sequence
  Description of Artificial Sequence: Synthetic polypeptide
DEEEIRTTNPVATEQYGSVMGTGMGSNTQGEGGQ

SEQ ID NO: 99706 - protein, 31 aa, Artificial Sequence
  Description of Artificial Sequence: Synthetic polypeptide
DEECIATTNPVAYESYGSVATNELSQSGGPM

SEQ ID NO: 99707 - protein, 35 aa, Artificial Sequence
  Description of Artificial Sequence: Synthetic polypeptide
DEEEIRTTNPVATEQYGSVSATTPAGPNMRNGMNV

SEQ ID NO: 99708 - protein, 32 aa, Artificial Sequence
  Description of Artificial Sequence: Synthetic polypeptide
DTEAEIATTNPVAYEQYGSVATNLDNRGDEQM

SEQ ID NO: 99709 - protein, 28 aa, Artificial Sequence
  Description of Artificial Sequence: Synthetic peptide
QEEEIASTNPVCTEQYGEVPDVLQSENK

SEQ ID NO: 99710 - protein, 28 aa, Artificial Sequence
  Description of Artificial Sequence: Synthetic peptide
QEEEIATTNPVATEQYGEVPEVCQSEEK

SEQ ID NO: 99711 - protein, 33 aa, Artificial Sequence
  Description of Artificial Sequence: Synthetic polypeptide
DEEEIRTTNPVATEQYGSVSMDAQQRSSQEEPN

SEQ ID NO: 99712 - protein, 34 aa, Artificial Sequence
  Description of Artificial Sequence: Synthetic polypeptide
DEEEIRTTNPVATEQYGSVSPIPDHLQIDNDNQI

SEQ ID NO: 99713 - protein, 29 aa, Artificial Sequence
  Description of Artificial Sequence: Synthetic peptide
AENEIACTNPVATEQYGEASENLQRNVGV

SEQ ID NO: 99714 - protein, 34 aa, Artificial Sequence
  Description of Artificial Sequence: Synthetic polypeptide
DEEEIRTTNPVATEQYGSVSLWLLPQRVPEIELL

SEQ ID NO: 99715 - protein, 33 aa, Artificial Sequence
  Description of Artificial Sequence: Synthetic polypeptide
DEEEIRTTNPVATEQYGSVIPTLEEMEPENERF

SEQ ID NO: 99716 - protein, 34 aa, Artificial Sequence
  Description of Artificial Sequence: Synthetic polypeptide
AEEEIRTTNPVATEQYGSVVVTTNNLGNTAGNNY

SEQ ID NO: 99717 - protein, 33 aa, Artificial Sequence
  Description of Artificial Sequence: Synthetic polypeptide
AEEEIRTTNPVATESYGSVSTVQSNNNVEEGNQ

SEQ ID NO: 99718 - protein, 28 aa, Artificial Sequence
  Description of Artificial Sequence: Synthetic peptide
AENEIACTNPVATECYGEVSECLQREGL

SEQ ID NO: 99719 - protein, 33 aa, Artificial Sequence
  Description of Artificial Sequence: Synthetic polypeptide
DEEEIRTTNPVATEQYGSVIPTLEINEPANERF

SEQ ID NO: 99720 - protein, 33 aa, Artificial Sequence
  Description of Artificial Sequence: Synthetic polypeptide
DEEEIRTTNPVATEQYGSVIPTLQQQEPDNIEF

SEQ ID NO: 99721 - protein, 28 aa, Artificial Sequence
  Description of Artificial Sequence: Synthetic peptide
QEEEIATTNPVASEQYGEVPEVCQHGEK

SEQ ID NO: 99722 - protein, 29 aa, Artificial Sequence
  Description of Artificial Sequence: Synthetic peptide
QEEEIATTNPVSTEQYGEISEEVCQQGNK

SEQ ID NO: 99723 - protein, 33 aa, Artificial Sequence
  Description of Artificial Sequence: Synthetic polypeptide
AEEEISTTNPVATEQYGCVCSTNHQHFGSENQS

SEQ ID NO: 99724 - protein, 35 aa, Artificial Sequence
  Description of Artificial Sequence: Synthetic polypeptide
FEEEIRTTNPVATEQYGSVSITNLFGEFTGGNQGQ

SEQ ID NO: 99725 - protein, 28 aa, Artificial Sequence
  Description of Artificial Sequence: Synthetic peptide
QEEEIASTNPVCTEQYGVASDNLQHEEQ

SEQ ID NO: 99726 - protein, 31 aa, Artificial Sequence
  Description of Artificial Sequence: Synthetic polypeptide
DSEEIRTTNPVSTEQWGQMVVSTPLQREVQI

SEQ ID NO: 99727 - protein, 31 aa, Artificial Sequence
  Description of Artificial Sequence: Synthetic polypeptide
DEEEIRTTNPVATEQYGSVNVEDADETENQD

SEQ ID NO: 99728 - protein, 35 aa, Artificial Sequence
  Description of Artificial Sequence: Synthetic polypeptide
AEEEIRTTNPVATEQYGSVVVTTNNLQAGEGNNDE

SEQ ID NO: 99729 - protein, 35 aa, Artificial Sequence
  Description of Artificial Sequence: Synthetic polypeptide
DEEEIRTTNPVATEQYGSVNVDSDNQNGQGEGNED

SEQ ID NO: 99730 - protein, 29 aa, Artificial Sequence
  Description of Artificial Sequence: Synthetic peptide
QEEEIATTNPVATEQYGEVSEDLEDHEEK

SEQ ID NO: 99731 - protein, 33 aa, Artificial Sequence
  Description of Artificial Sequence: Synthetic polypeptide
FEEEIRTTNPVATEQYGSVSNMNIMDEEGGNNQ

SEQ ID NO: 99732 - protein, 29 aa, Artificial Sequence
  Description of Artificial Sequence: Synthetic peptide
AENEIACTNPVATEPYGEISMNLQQQGGR

SEQ ID NO: 99733 - protein, 29 aa, Artificial Sequence
  Description of Artificial Sequence: Synthetic peptide
AENEIACTNPVATEPYGEASMDLQQQGNR

SEQ ID NO: 99734 - protein, 33 aa, Artificial Sequence
  Description of Artificial Sequence: Synthetic polypeptide
DEEEIRTTNPVATEQYGSVMGTLGTGGTGNGNE

SEQ ID NO: 99735 - protein, 29 aa, Artificial Sequence
  Description of Artificial Sequence: Synthetic peptide
QEEEIATTNPVATEQYGEVSEDCQDHEEK

SEQ ID NO: 99736 - protein, 33 aa, Artificial Sequence
  Description of Artificial Sequence: Synthetic polypeptide
HEEEIRTTNPVATEQYGSVSPAENTVERLAGSL

SEQ ID NO: 99737 - protein, 33 aa, Artificial Sequence
  Description of Artificial Sequence: Synthetic polypeptide
DEEEIRTTNPVATEQYGSVSPIALLEAPNGVEI

SEQ ID NO: 99738 - protein, 33 aa, Artificial Sequence
  Description of Artificial Sequence: Synthetic polypeptide
DEEEIRTTNPVATEQYGSVSPIALLELPLGVEQ

SEQ ID NO: 99739 - protein, 29 aa, Artificial Sequence
  Description of Artificial Sequence: Synthetic peptide
AENEIACTNPVATEPYGEASENLQQQGGR

SEQ ID NO: 99740 - protein, 34 aa, Artificial Sequence
  Description of Artificial Sequence: Synthetic polypeptide
DSENIRTTNPVATEPYGQVACTPNELSQRGGNRV

SEQ ID NO: 99741 - protein, 29 aa, Artificial Sequence
  Description of Artificial Sequence: Synthetic peptide
QEEEIATTNPVATEQYGEVSEACNRNEEK

SEQ ID NO: 99742 - protein, 30 aa, Artificial Sequence
  Description of Artificial Sequence: Synthetic polypeptide
AENEIACTNPVATEQWGAASNENLQRGGYR

SEQ ID NO: 99743 - protein, 35 aa, Artificial Sequence
  Description of Artificial Sequence: Synthetic polypeptide
DEEEIRTTNPVATEQYGSVSMNNNLEEMRGAEATH

SEQ ID NO: 99744 - protein, 34 aa, Artificial Sequence
  Description of Artificial Sequence: Synthetic polypeptide
FEEEIRTTNPVATEQYGSVSNMNLGQIIEGQEGG

SEQ ID NO: 99745 - protein, 34 aa, Artificial Sequence
  Description of Artificial Sequence: Synthetic polypeptide
DEEEIRTTNPVATEQYGSVSMNPLHVESNSQEKE

SEQ ID NO: 99746 - protein, 32 aa, Artificial Sequence
  Description of Artificial Sequence: Synthetic polypeptide
NEEEIRTTNPVATEQYGCVCSWGNHDEFGSNA

SEQ ID NO: 99747 - protein, 29 aa, Artificial Sequence
  Description of Artificial Sequence: Synthetic peptide
AENEIACTNPVATEQWGDVSEILMRAGDR

SEQ ID NO: 99748 - protein, 34 aa, Artificial Sequence
  Description of Artificial Sequence: Synthetic polypeptide
DEEEIRTTNPVATEQYGSVSMPNTVYPRMMQERD

SEQ ID NO: 99749 - protein, 28 aa, Artificial Sequence
  Description of Artificial Sequence: Synthetic peptide
AENEIACTNPVATEQWGDASENEQRGGA

SEQ ID NO: 99750 - protein, 30 aa, Artificial Sequence
  Description of Artificial Sequence: Synthetic polypeptide
QEEEIATTNPVATEQYGEVSENCPQDHEEK

SEQ ID NO: 99751 - protein, 30 aa, Artificial Sequence
  Description of Artificial Sequence: Synthetic polypeptide
DSEEIRTTNPVGTEWWGMVSTNLEREVQQD

SEQ ID NO: 99752 - protein, 30 aa, Artificial Sequence
  Description of Artificial Sequence: Synthetic polypeptide
DSEEIRTTNPVGTEWWGMVSTNLQTEVQQE

SEQ ID NO: 99753 - protein, 30 aa, Artificial Sequence
  Description of Artificial Sequence: Synthetic polypeptide
DEEEIATTNPVATECYGSVSECGPQHEEPL

SEQ ID NO: 99754 - protein, 31 aa, Artificial Sequence
  Description of Artificial Sequence: Synthetic polypeptide
AEEEISTTNPVATEQYGCVCSTETQHFNSNQ

SEQ ID NO: 99755 - protein, 32 aa, Artificial Sequence
  Description of Artificial Sequence: Synthetic polypeptide
DEECIATTNPVAYECYGSVATNALSQISGGNM

SEQ ID NO: 99756 - protein, 31 aa, Artificial Sequence
  Description of Artificial Sequence: Synthetic polypeptide
HEEEIRTTNPVATEQYGSVSESQDLSNEETY

SEQ ID NO: 99757 - protein, 29 aa, Artificial Sequence
  Description of Artificial Sequence: Synthetic peptide
AENEIACTNPVATEQWGDASENEQRAGGR

SEQ ID NO: 99758 - protein, 36 aa, Artificial Sequence
  Description of Artificial Sequence: Synthetic polypeptide
DEEEIRTTNPVATEQYGSVSMPENLHQMRSIVNNQI

SEQ ID NO: 99759 - protein, 32 aa, Artificial Sequence
  Description of Artificial Sequence: Synthetic polypeptide
DEEEIRTTNPVATEQYGSVNGTMPDFDRNQEI

SEQ ID NO: 99760 - protein, 34 aa, Artificial Sequence
  Description of Artificial Sequence: Synthetic polypeptide
AEEEIRTTNPVATESYGSVHSATNLDQPPGGSKI

SEQ ID NO: 99761 - protein, 36 aa, Artificial Sequence
  Description of Artificial Sequence: Synthetic polypeptide
DEEEIRTTNPVATEQYGSVINIVNDLMQTIDGENRY

SEQ ID NO: 99762 - protein, 28 aa, Artificial Sequence
  Description of Artificial Sequence: Synthetic peptide
LENEIATTNPVATECYGDVSECLQHEEL

SEQ ID NO: 99763 - protein, 28 aa, Artificial Sequence
  Description of Artificial Sequence: Synthetic peptide
QEEEIASTNPVATEQYGVASDNCQHEEQ

SEQ ID NO: 99764 - protein, 31 aa, Artificial Sequence
  Description of Artificial Sequence: Synthetic polypeptide
DEECIATTNPVAYECYGSVNTNELSQSGGQM

SEQ ID NO: 99765 - protein, 35 aa, Artificial Sequence
  Description of Artificial Sequence: Synthetic polypeptide
DEEEIRTTNPVATEQYGSVSPIENLYQDTNNVDQQ

SEQ ID NO: 99766 - protein, 28 aa, Artificial Sequence
  Description of Artificial Sequence: Synthetic peptide
QEEEIASTNPVATEQYGVMASTLMHGDI

SEQ ID NO: 99767 - protein, 33 aa, Artificial Sequence
  Description of Artificial Sequence: Synthetic polypeptide
LNDEIRTTNPVATEQYGVVGSTNLNEPFPGNLR

SEQ ID NO: 99768 - protein, 30 aa, Artificial Sequence
  Description of Artificial Sequence: Synthetic polypeptide
AENEIACTNPVATEGYGNASANNLQSRGGR

SEQ ID NO: 99769 - protein, 34 aa, Artificial Sequence
  Description of Artificial Sequence: Synthetic polypeptide
AEEEIRTTNPVATEQYGSVVVTVTNDQQGQGNLT

SEQ ID NO: 99770 - protein, 33 aa, Artificial Sequence
  Description of Artificial Sequence: Synthetic polypeptide
AEEEIRTTNPVATESYGSVSTVSTNNVEEGNTQ

SEQ ID NO: 99771 - protein, 30 aa, Artificial Sequence
  Description of Artificial Sequence: Synthetic polypeptide
QEEEIATTNPVATEQYGEVSAEVCQHEGEK

SEQ ID NO: 99772 - protein, 29 aa, Artificial Sequence
  Description of Artificial Sequence: Synthetic peptide
QEEEIATTNPVATEQYGEVPTVLEDHEEL

SEQ ID NO: 99773 - protein, 34 aa, Artificial Sequence
  Description of Artificial Sequence: Synthetic polypeptide
DEEEIRTTNPVATEQYGSVMSPTNSDIELYEDIE

SEQ ID NO: 99774 - protein, 35 aa, Artificial Sequence
  Description of Artificial Sequence: Synthetic polypeptide
DEEEIRTTNPVATEQYGSVIPNLVMEVHLQQLGNQ

SEQ ID NO: 99775 - protein, 34 aa, Artificial Sequence
  Description of Artificial Sequence: Synthetic polypeptide
DEEEIRTTNPVATEQYGSVSPIEMLQRMMEIEDT

SEQ ID NO: 99776 - protein, 32 aa, Artificial Sequence
  Description of Artificial Sequence: Synthetic polypeptide
DEEEIRTTNPVATEQYGSVSMMPMPIPMNEHS

SEQ ID NO: 99777 - protein, 34 aa, Artificial Sequence
  Description of Artificial Sequence: Synthetic polypeptide
DEEEIRTTNPVATEQYGSVSMMNMQQEIGSELIL

SEQ ID NO: 99778 - protein, 32 aa, Artificial Sequence
  Description of Artificial Sequence: Synthetic polypeptide
DEEEIRTTNPVATEQYGSVSMMLPEIPTVEQS

SEQ ID NO: 99779 - protein, 34 aa, Artificial Sequence
  Description of Artificial Sequence: Synthetic polypeptide
HEEEIRTTNPVATEQYGSVVGTNNGQERNANGDE

SEQ ID NO: 99780 - protein, 29 aa, Artificial Sequence
  Description of Artificial Sequence: Synthetic peptide
QEEEIATTNPVATEQYGEVPTVCQMHEEK

SEQ ID NO: 99781 - protein, 31 aa, Artificial Sequence
  Description of Artificial Sequence: Synthetic polypeptide
QEEEIATTNPVATEQYGEVPTPVGPNRGMNV

SEQ ID NO: 99782 - protein, 32 aa, Artificial Sequence
  Description of Artificial Sequence: Synthetic polypeptide
NEEEIRTTNPVATEQYGCVCSAGNLDEFISNA

SEQ ID NO: 99783 - protein, 34 aa, Artificial Sequence
  Description of Artificial Sequence: Synthetic polypeptide
DEEEIRTTNPVATEQYGSVPPTGNEQRMQVLEDG

SEQ ID NO: 99784 - protein, 34 aa, Artificial Sequence
  Description of Artificial Sequence: Synthetic polypeptide
DEEEIATTNPVATEQYGSACATNPLQNHDENQRQ

SEQ ID NO: 99785 - protein, 32 aa, Artificial Sequence
  Description of Artificial Sequence: Synthetic polypeptide
DEEEIATTNPVATECYGSVSATDLEIINGEDL

SEQ ID NO: 99786 - protein, 32 aa, Artificial Sequence
  Description of Artificial Sequence: Synthetic polypeptide
DSNEIRTTNPVAYEIYGQTVSNNLSQRGGTNQ

SEQ ID NO: 99787 - protein, 35 aa, Artificial Sequence
  Description of Artificial Sequence: Synthetic polypeptide
AEEEIRTTNPVATEQYGSVVVTVTNGNLQAGTNQI

SEQ ID NO: 99788 - protein, 33 aa, Artificial Sequence
  Description of Artificial Sequence: Synthetic polypeptide
FEEEIRTTNPVATEQYGSVSITNNVGFEGGGGT

SEQ ID NO: 99789 - protein, 34 aa, Artificial Sequence
  Description of Artificial Sequence: Synthetic polypeptide
FEEEIRTTNPVATEQYGSVSLTPLLYEVQEDNDD

SEQ ID NO: 99790 - protein, 30 aa, Artificial Sequence
  Description of Artificial Sequence: Synthetic polypeptide
AENEIACTNPVATEHYGEEASENLQRGGDR

SEQ ID NO: 99791 - protein, 33 aa, Artificial Sequence
  Description of Artificial Sequence: Synthetic polypeptide
DEEEIATTNPVATEPYGSVCATNGTDRGGPNEQ

SEQ ID NO: 99792 - protein, 33 aa, Artificial Sequence
  Description of Artificial Sequence: Synthetic polypeptide
DEEEIRTTNPVATEQYGSVNGTMTDFDRGQEQQ

SEQ ID NO: 99793 - protein, 34 aa, Artificial Sequence
  Description of Artificial Sequence: Synthetic polypeptide
AEEEIRTTNPVATESYGSVSNTNLLLNQQGTDQD

SEQ ID NO: 99794 - protein, 34 aa, Artificial Sequence
  Description of Artificial Sequence: Synthetic polypeptide
HEEEIRTTNPVATEQYGSVSPTENNVERLAGQYS

SEQ ID NO: 99795 - protein, 31 aa, Artificial Sequence
  Description of Artificial Sequence: Synthetic polypeptide
QEEEIATTNPVATEQYGEVSATDLEDHGEDL

SEQ ID NO: 99796 - protein, 32 aa, Artificial Sequence
  Description of Artificial Sequence: Synthetic polypeptide
DEEEIRTTNPVATEQYGSVNVDMEQRMSIMEP

SEQ ID NO: 99797 - protein, 35 aa, Artificial Sequence
  Description of Artificial Sequence: Synthetic polypeptide
HEEEIRTTNPVAYEAWGSVVSTNMLQDRTGGNYRE

SEQ ID NO: 99798 - protein, 28 aa, Artificial Sequence
  Description of Artificial Sequence: Synthetic peptide
QEEEIASTNPVATEQYGVMPSVLQHGEK

SEQ ID NO: 99799 - protein, 35 aa, Artificial Sequence
  Description of Artificial Sequence: Synthetic polypeptide
DEEEIRTTNPVATEQYGSVSAWPNGTQPLMGPEVR

SEQ ID NO: 99800 - protein, 33 aa, Artificial Sequence
  Description of Artificial Sequence: Synthetic polypeptide
AEEEIRTTNPVATESYGSVSTVSTNVNEEGTNQ

SEQ ID NO: 99801 - protein, 34 aa, Artificial Sequence
  Description of Artificial Sequence: Synthetic polypeptide
FEEEIRTTNPVATEQYGSVSLTNLGATNVEQTNT

SEQ ID NO: 99802 - protein, 30 aa, Artificial Sequence
  Description of Artificial Sequence: Synthetic polypeptide
QEEEIATTNPVATEQYGEVSAEVCQHEGEL

SEQ ID NO: 99803 - protein, 31 aa, Artificial Sequence
  Description of Artificial Sequence: Synthetic polypeptide
DEDEIRTTNPVAYEQWGVSWGLDNMEQRDNR

SEQ ID NO: 99804 - protein, 28 aa, Artificial Sequence
  Description of Artificial Sequence: Synthetic peptide
QEEEIASTNPVATEQYGVVPEVLQHEEK

SEQ ID NO: 99805 - protein, 34 aa, Artificial Sequence
  Description of Artificial Sequence: Synthetic polypeptide
DEEEIRTTNPVATEQYGSVNGTNDDERSGQEEIQ

SEQ ID NO: 99806 - protein, 36 aa, Artificial Sequence
  Description of Artificial Sequence: Synthetic polypeptide
DEEEIRTTNPVATEQYGSVSPIDNLVSFQQGMENNV

SEQ ID NO: 99807 - protein, 35 aa, Artificial Sequence
  Description of Artificial Sequence: Synthetic polypeptide
AEEEIRTTNPVATESYGSVSTVTNLNNQQGNDGGT

SEQ ID NO: 99808 - protein, 34 aa, Artificial Sequence
  Description of Artificial Sequence: Synthetic polypeptide
DSEEIRTTNPVAYEQYGSTVSCTDGLSGRGTNSA

SEQ ID NO: 99809 - protein, 28 aa, Artificial Sequence
  Description of Artificial Sequence: Synthetic peptide
AENEIACTNPVATEQYGCASWNHQNGGQ

SEQ ID NO: 99810 - protein, 33 aa, Artificial Sequence
  Description of Artificial Sequence: Synthetic polypeptide
NETEIRTTNPVATECWGSVSTNLNQGNEGGNAD

SEQ ID NO: 99811 - protein, 34 aa, Artificial Sequence
  Description of Artificial Sequence: Synthetic polypeptide
FEEEIRTTNPVATEQYGSVSTGGQGQGDGENGDI

SEQ ID NO: 99812 - protein, 28 aa, Artificial Sequence
  Description of Artificial Sequence: Synthetic peptide
QEEEIASTNPVCTEQYGVVPDVLQSENK

SEQ ID NO: 99813 - protein, 33 aa, Artificial Sequence
  Description of Artificial Sequence: Synthetic polypeptide
DEEEIRTTNPVATEQYGSVPQAGLQQTGVELAD

SEQ ID NO: 99814 - protein, 28 aa, Artificial Sequence
  Description of Artificial Sequence: Synthetic peptide
NEGEIAPTNPCSSEQYGEVSCNLQSGMR

SEQ ID NO: 99815 - protein, 33 aa, Artificial Sequence
  Description of Artificial Sequence: Synthetic polypeptide
DEEEIRTTNPVATEQYGSVNGMNLDGNIGIEID

SEQ ID NO: 99816 - protein, 35 aa, Artificial Sequence
  Description of Artificial Sequence: Synthetic polypeptide
DEEEIATTNPVATEQYGSACAAVATALQDSGDNRQ

SEQ ID NO: 99817 - protein, 28 aa, Artificial Sequence
  Description of Artificial Sequence: Synthetic peptide
QEEEIATTNPVSTEQYGEASCVCQHETR

SEQ ID NO: 99818 - protein, 30 aa, Artificial Sequence
  Description of Artificial Sequence: Synthetic polypeptide
DEEEIATTNPVATEQYGEISEEVCQQHGEK

SEQ ID NO: 99819 - protein, 28 aa, Artificial Sequence
  Description of Artificial Sequence: Synthetic peptide
NEGEIAPTNPCSSEQYGIVSCNLQSGTR

SEQ ID NO: 99820 - protein, 34 aa, Artificial Sequence
  Description of Artificial Sequence: Synthetic polypeptide
DEEEIRTTNPVATEQYGSVSPDHLTNPISTQNDG

SEQ ID NO: 99821 - protein, 33 aa, Artificial Sequence
  Description of Artificial Sequence: Synthetic polypeptide
DEDEIRTTNPVAYEQYGTVCSTNDQQMGQGNTD

SEQ ID NO: 99822 - protein, 34 aa, Artificial Sequence
  Description of Artificial Sequence: Synthetic polypeptide
DEEEIRTTNPVATEQYGSVSNHSLVEQVVGPMSD

SEQ ID NO: 99823 - protein, 33 aa, Artificial Sequence
  Description of Artificial Sequence: Synthetic polypeptide
DEEEIRTTNPVATEQYGSVPCWDNGGQQQGKDF

SEQ ID NO: 99824 - protein, 32 aa, Artificial Sequence
  Description of Artificial Sequence: Synthetic polypeptide
LDSEIRTTNPVATEQYGSVSDTTWDETRSQNR

SEQ ID NO: 99825 - protein, 33 aa, Artificial Sequence
  Description of Artificial Sequence: Synthetic polypeptide
DEEEIRTTNPVATEQYGSVMGTNTGGNGGEIGG

SEQ ID NO: 99826 - protein, 35 aa, Artificial Sequence
  Description of Artificial Sequence: Synthetic polypeptide
DSEEIRTTNPVATEQWGCSVPSCTTELQDTGSNRH

SEQ ID NO: 99827 - protein, 28 aa, Artificial Sequence
  Description of Artificial Sequence: Synthetic peptide
NEGEIAPTNPCSSEQYGIVSCNLQSGVR

SEQ ID NO: 99828 - protein, 33 aa, Artificial Sequence
  Description of Artificial Sequence: Synthetic polypeptide
KESEIRTTNPVAYEQYGSLVSCTNPSQGPGGNS

SEQ ID NO: 99829 - protein, 33 aa, Artificial Sequence
  Description of Artificial Sequence: Synthetic polypeptide
DNEEISTTNPVATWQYGSVSVSNPEVVRTGNRD

SEQ ID NO: 99830 - protein, 34 aa, Artificial Sequence
  Description of Artificial Sequence: Synthetic polypeptide
DEEEIRTTNPVATEQYGSVPCWDNHGGQRGEKDF

SEQ ID NO: 99831 - protein, 33 aa, Artificial Sequence
  Description of Artificial Sequence: Synthetic polypeptide
FEEEIRTTNPVATEQYGSVSTGGQGQGEEGGGD

SEQ ID NO: 99832 - protein, 31 aa, Artificial Sequence
  Description of Artificial Sequence: Synthetic polypeptide
AENEIACTNPVATEQYGCSCSWNLQYGSDNQ

SEQ ID NO: 99833 - protein, 28 aa, Artificial Sequence
  Description of Artificial Sequence: Synthetic peptide
QEEEIACTNPVATEQYGEAPENCQREEK

SEQ ID NO: 99834 - protein, 34 aa, Artificial Sequence
  Description of Artificial Sequence: Synthetic polypeptide
AEEEIRTTNPVATEQYGSVVVVTTNNQQEGTNIP

SEQ ID NO: 99835 - protein, 34 aa, Artificial Sequence
  Description of Artificial Sequence: Synthetic polypeptide
AEEEIRTTNPVATEQYGSVVVVTTNNQQENGNIP

SEQ ID NO: 99836 - protein, 35 aa, Artificial Sequence
  Description of Artificial Sequence: Synthetic polypeptide
DEEEIRTTNPVATEQYGSVQCMPLLEQNRVGNFMS

SEQ ID NO: 99837 - protein, 32 aa, Artificial Sequence
  Description of Artificial Sequence: Synthetic polypeptide
HEGEIRTTNPVATEQYGSVSTLNDLEFNQVDY

SEQ ID NO: 99838 - protein, 33 aa, Artificial Sequence
  Description of Artificial Sequence: Synthetic polypeptide
DEEEIRTTNPVATEQYGSVPQPPPGLIRVMVNP

SEQ ID NO: 99839 - protein, 35 aa, Artificial Sequence
  Description of Artificial Sequence: Synthetic polypeptide
AEEEIRTTNPVATEQYGVVVVSVTTNLQNGNENAE

SEQ ID NO: 99840 - protein, 35 aa, Artificial Sequence
  Description of Artificial Sequence: Synthetic polypeptide
DEEEIRTTNPVATEQYGSVMSGMFNNDQEEVGNIV

SEQ ID NO: 99841 - protein, 34 aa, Artificial Sequence
  Description of Artificial Sequence: Synthetic polypeptide
DEEEIRTTNPVATEQYGSVNGITNNMTNEGGGNG

SEQ ID NO: 99842 - protein, 34 aa, Artificial Sequence
  Description of Artificial Sequence: Synthetic polypeptide
DEEEIATTNPVATEQYGSACAATNPLQDSPMGER

SEQ ID NO: 99843 - protein, 32 aa, Artificial Sequence
  Description of Artificial Sequence: Synthetic polypeptide
NEREIRTTNPVATEQYGCVCWTGNLQNIGSEQ

SEQ ID NO: 99844 - protein, 33 aa, Artificial Sequence
  Description of Artificial Sequence: Synthetic polypeptide
KESEIRTTNPVAYEPYGSVSTGNLSQTGGGDRP

SEQ ID NO: 99845 - protein, 35 aa, Artificial Sequence
  Description of Artificial Sequence: Synthetic polypeptide
DEEEIRTTNPVATEQYGSVSDTDNNDTNEMGSNGN

SEQ ID NO: 99846 - protein, 34 aa, Artificial Sequence
  Description of Artificial Sequence: Synthetic polypeptide
DEEEIRTTNPVATEQYGSVIINTTTLQENGTEED

SEQ ID NO: 99847 - protein, 34 aa, Artificial Sequence
  Description of Artificial Sequence: Synthetic polypeptide
DEEEIRTTNPVATEQYGSVSNHSVGTELGQVNDP

SEQ ID NO: 99848 - protein, 28 aa, Artificial Sequence
  Description of Artificial Sequence: Synthetic peptide
QEEEIATTNPCASEQYGEVPENCQHGEK

SEQ ID NO: 99849 - protein, 34 aa, Artificial Sequence
  Description of Artificial Sequence: Synthetic polypeptide
DEEEIRTTNPVATEQYGSVMSGMFNNGQGEQVNI

SEQ ID NO: 99850 - protein, 34 aa, Artificial Sequence
  Description of Artificial Sequence: Synthetic polypeptide
AEEEIRTTNPVATEQYGSVVVTVNQLNNNAGNNQ

SEQ ID NO: 99851 - protein, 32 aa, Artificial Sequence
  Description of Artificial Sequence: Synthetic polypeptide
DNEEISTTNPVATWQYGSVSLTVNPVMTGNNE

SEQ ID NO: 99852 - protein, 32 aa, Artificial Sequence
  Description of Artificial Sequence: Synthetic polypeptide
DEDEIRTTNPVAYEQYGSVAMNDTQTGNGDEH

SEQ ID NO: 99853 - protein, 28 aa, Artificial Sequence
  Description of Artificial Sequence: Synthetic peptide
QEEEIASTNPVATEQYGEAPDVLQSENK

SEQ ID NO: 99854 - protein, 31 aa, Artificial Sequence
  Description of Artificial Sequence: Synthetic polypeptide
NEREIATTNPVATEQYGSVWSENVEVIGQSR

SEQ ID NO: 99855 - protein, 32 aa, Artificial Sequence
  Description of Artificial Sequence: Synthetic polypeptide
DSEEIRTTNPVATEQWGSCTTTLLQERGTQYM

SEQ ID NO: 99856 - protein, 32 aa, Artificial Sequence
  Description of Artificial Sequence: Synthetic polypeptide
DSEEIRTTNPVATEQWGSCTTTSLLQRGTQMM

SEQ ID NO: 99857 - protein, 32 aa, Artificial Sequence
  Description of Artificial Sequence: Synthetic polypeptide
DSEEIRTTNPVATEQWGSCTTYGLLQRGTQYA

SEQ ID NO: 99858 - protein, 28 aa, Artificial Sequence
  Description of Artificial Sequence: Synthetic peptide
NEREIACTNPCSYEQYGCVSCNLQSGTR

SEQ ID NO: 99859 - protein, 34 aa, Artificial Sequence
  Description of Artificial Sequence: Synthetic polypeptide
DEEEIRTTNPVATEQYGSVMGTNNMNDQGEFNND

SEQ ID NO: 99860 - protein, 33 aa, Artificial Sequence
  Description of Artificial Sequence: Synthetic polypeptide
DSEEIRTTNPVATEQWGSIPSCTLEHQRTVTNR

SEQ ID NO: 99861 - protein, 30 aa, Artificial Sequence
  Description of Artificial Sequence: Synthetic polypeptide
DEEEIATTNPVATEQYGEASTDCQDHEEDK

SEQ ID NO: 99862 - protein, 32 aa, Artificial Sequence
  Description of Artificial Sequence: Synthetic polypeptide
DEEEIATTNPVATEQYGEASSTVGNMRNGMNV

SEQ ID NO: 99863 - protein, 35 aa, Artificial Sequence
  Description of Artificial Sequence: Synthetic polypeptide
DEEEIRTTNPVATEQYGSVMGTNNMEQNIGGDENI

SEQ ID NO: 99864 - protein, 32 aa, Artificial Sequence
  Description of Artificial Sequence: Synthetic polypeptide
DEEEIRTTNPVATEQYGSVIITTTLETPPQPF

SEQ ID NO: 99865 - protein, 34 aa, Artificial Sequence
  Description of Artificial Sequence: Synthetic polypeptide
DEEEIRTTNPVATEQYGSVMGTNNIQQDIEQGQT

SEQ ID NO: 99866 - protein, 34 aa, Artificial Sequence
  Description of Artificial Sequence: Synthetic polypeptide
FEEEIRTTNPVATEQYGSVSTGGQGQDEGENGGM

SEQ ID NO: 99867 - protein, 34 aa, Artificial Sequence
  Description of Artificial Sequence: Synthetic polypeptide
DEEEIRTTNPVATEQYGSVSPEENTQILMVSLRQ

SEQ ID NO: 99868 - protein, 34 aa, Artificial Sequence
  Description of Artificial Sequence: Synthetic polypeptide
DEEEIRTTNPVATEQYGSVSNGNLEEVANAVEEE

SEQ ID NO: 99869 - protein, 36 aa, Artificial Sequence
  Description of Artificial Sequence: Synthetic polypeptide
DEEEIRTTNPVATEQYGSVSDTELELQNFQNETERD

SEQ ID NO: 99870 - protein, 32 aa, Artificial Sequence
  Description of Artificial Sequence: Synthetic polypeptide
DSEEIRTTNPVATEQWGSCTTPELGQRGTQYM

SEQ ID NO: 99871 - protein, 28 aa, Artificial Sequence
  Description of Artificial Sequence: Synthetic peptide
NEGEIAPTNPCSSEQYGIVSINLQSGTR

SEQ ID NO: 99872 - protein, 32 aa, Artificial Sequence
  Description of Artificial Sequence: Synthetic polypeptide
NEREICTVNPVATEQYGSVSTNLEFWQTGVVE

SEQ ID NO: 99873 - protein, 32 aa, Artificial Sequence
  Description of Artificial Sequence: Synthetic polypeptide
DSEEIRTTNPVATEQWGKVTSFLLQIGDTQRM

SEQ ID NO: 99874 - protein, 34 aa, Artificial Sequence
  Description of Artificial Sequence: Synthetic polypeptide
DEEEIRTTNPVATEQYGSVMSGMFNQQEEGVEGI

SEQ ID NO: 99875 - protein, 35 aa, Artificial Sequence
  Description of Artificial Sequence: Synthetic polypeptide
DEEEIRTTNPVATEQYGSVSPDNTNQFLNMEVNEF

SEQ ID NO: 99876 - protein, 28 aa, Artificial Sequence
  Description of Artificial Sequence: Synthetic peptide
QEEEIATTNPCASEQYGIVPENLQSETK

SEQ ID NO: 99877 - protein, 30 aa, Artificial Sequence
  Description of Artificial Sequence: Synthetic polypeptide
DEEEIATTNPVATEQYGEASTVCQHEMEPV

SEQ ID NO: 99878 - protein, 34 aa, Artificial Sequence
  Description of Artificial Sequence: Synthetic polypeptide
DEEEIRTTNPVATEQYGSVSPDTTLIEDEGSFLQ

SEQ ID NO: 99879 - protein, 31 aa, Artificial Sequence
  Description of Artificial Sequence: Synthetic polypeptide
NEREIRTTNPVATEQYGCVCFTNDQIGSQQA

SEQ ID NO: 99880 - protein, 33 aa, Artificial Sequence
  Description of Artificial Sequence: Synthetic polypeptide
AEEEIRTTNPVATEQYGVVVVSTTQLQNGEEGV

SEQ ID NO: 99881 - protein, 31 aa, Artificial Sequence
  Description of Artificial Sequence: Synthetic polypeptide
DEEEIATTNPVATEQYGEASTDCQDHEGEDL

SEQ ID NO: 99882 - protein, 35 aa, Artificial Sequence
  Description of Artificial Sequence: Synthetic polypeptide
DSEEIRTTNPVATEQWGCSVPSCTTELQRTGGTTR

SEQ ID NO: 99883 - protein, 32 aa, Artificial Sequence
  Description of Artificial Sequence: Synthetic polypeptide
GQEEIATTNPVAYEQWGCVSTNLQGEDGDNDR

SEQ ID NO: 99884 - protein, 30 aa, Artificial Sequence
  Description of Artificial Sequence: Synthetic polypeptide
QEEEIATTNPVATEQYGEVSTDLEDHEEDL

SEQ ID NO: 99885 - protein, 34 aa, Artificial Sequence
  Description of Artificial Sequence: Synthetic polypeptide
DEEEIRTTNPVATEQYGSVPCWDNDGGQRQGKDT

SEQ ID NO: 99886 - protein, 34 aa, Artificial Sequence
  Description of Artificial Sequence: Synthetic polypeptide
DEEEIRTTNPVATEQYGSVSPDWNGLETRFQDQD

SEQ ID NO: 99887 - protein, 34 aa, Artificial Sequence
  Description of Artificial Sequence: Synthetic polypeptide
AEEEIRTTNPVATEQYGSVVVVTTNQQQIGTNLE

SEQ ID NO: 99888 - protein, 34 aa, Artificial Sequence
  Description of Artificial Sequence: Synthetic polypeptide
DSEEIRTTNPVATEQWGCSVPSCTTELQSTGTNS

SEQ ID NO: 99889 - protein, 33 aa, Artificial Sequence
  Description of Artificial Sequence: Synthetic polypeptide
AEEEIRTTNPVATEQYGSVVVVTTTDNQIGNNL

SEQ ID NO: 99890 - protein, 34 aa, Artificial Sequence
  Description of Artificial Sequence: Synthetic polypeptide
DEEEIRTTNPVATEQYGSVSPDYLTNPPETQNDG

SEQ ID NO: 99891 - protein, 32 aa, Artificial Sequence
  Description of Artificial Sequence: Synthetic polypeptide
QEEEIACTNPVATEQYGCVATNNLQEAGNMEN

SEQ ID NO: 99892 - protein, 35 aa, Artificial Sequence
  Description of Artificial Sequence: Synthetic polypeptide
AEEEIRTTNPVATEQYGSVVVVTTTNLGEQGGNQQ

SEQ ID NO: 99893 - protein, 33 aa, Artificial Sequence
  Description of Artificial Sequence: Synthetic polypeptide
DEEEIRTTNPVATEQYGSVQCMNNEFPRGELVA

SEQ ID NO: 99894 - protein, 35 aa, Artificial Sequence
  Description of Artificial Sequence: Synthetic polypeptide
DEEEIRTTNPVATEQYGSVQCITNLEQRALPPELG

SEQ ID NO: 99895 - protein, 32 aa, Artificial Sequence
  Description of Artificial Sequence: Synthetic polypeptide
NETEIATTNPVATEMWGSVSTNLQGNEGNDDN

SEQ ID NO: 99896 - protein, 35 aa, Artificial Sequence
  Description of Artificial Sequence: Synthetic polypeptide
AEEEIRTTNPVATEQYGSVVVVTTNNLNNQAGNND

SEQ ID NO: 99897 - protein, 28 aa, Artificial Sequence
  Description of Artificial Sequence: Synthetic peptide
QEEEIATTNPVATEQYGNAAEVCQHGEK

SEQ ID NO: 99898 - protein, 28 aa, Artificial Sequence
  Description of Artificial Sequence: Synthetic peptide
QEEEIASVNPVGTEQYGVVASNLQSGDI

SEQ ID NO: 99899 - protein, 35 aa, Artificial Sequence
  Description of Artificial Sequence: Synthetic polypeptide
DEEEIRTTNPVATEQYGSVSPAQVLLQMNQGENQS

SEQ ID NO: 99900 - protein, 33 aa, Artificial Sequence
  Description of Artificial Sequence: Synthetic polypeptide
DEEEIACTNPVATEQYGSVATNLQNGALTEGAN

SEQ ID NO: 99901 - protein, 33 aa, Artificial Sequence
  Description of Artificial Sequence: Synthetic polypeptide
DEEEIRTTNPVATEQYGSVNGELDDQGSNQIDQ

SEQ ID NO: 99902 - protein, 32 aa, Artificial Sequence
  Description of Artificial Sequence: Synthetic polypeptide
NETEIATTNPVATEMWGSVSTNLQGNEGQNEQ

SEQ ID NO: 99903 - protein, 31 aa, Artificial Sequence
  Description of Artificial Sequence: Synthetic polypeptide
DSEEIRSTNPVAYEQYGSIATNDSQNGGNNN

SEQ ID NO: 99904 - protein, 35 aa, Artificial Sequence
  Description of Artificial Sequence: Synthetic polypeptide
AEEEIRTTNPVATEQYGSVVVTVNNLNNTQQGNNT

SEQ ID NO: 99905 - protein, 33 aa, Artificial Sequence
  Description of Artificial Sequence: Synthetic polypeptide
AEEEIRTTNPVATEQYGVVVVTNNLGNTAGNNV

SEQ ID NO: 99906 - protein, 34 aa, Artificial Sequence
  Description of Artificial Sequence: Synthetic polypeptide
KEEEIRTTNPVAYEQWGQVVVSTNLSQHNGGNDR

SEQ ID NO: 99907 - protein, 33 aa, Artificial Sequence
  Description of Artificial Sequence: Synthetic polypeptide
FEEEIRTTNPVATEQYGSVSTLMINGEGQGEDE

SEQ ID NO: 99908 - protein, 28 aa, Artificial Sequence
  Description of Artificial Sequence: Synthetic peptide
KEGEIAPTNPCSSEQYGIVSCNLQSGTR

SEQ ID NO: 99909 - protein, 29 aa, Artificial Sequence
  Description of Artificial Sequence: Synthetic peptide
DQAEIACTNPVATEQWGCCATVLQHGENR

SEQ ID NO: 99910 - protein, 33 aa, Artificial Sequence
  Description of Artificial Sequence: Synthetic polypeptide
DEEEIRTTNPVATEQYGSVNGELNDDQGSNNFQ

SEQ ID NO: 99911 - protein, 34 aa, Artificial Sequence
  Description of Artificial Sequence: Synthetic polypeptide
DSEEIRSTNPVAYEQYGSVSCTNELSTARNGTQR

SEQ ID NO: 99912 - protein, 33 aa, Artificial Sequence
  Description of Artificial Sequence: Synthetic polypeptide
FEEEIRTTNPVATEQYGSVSTMGMGQNIGDDGG

SEQ ID NO: 99913 - protein, 33 aa, Artificial Sequence
  Description of Artificial Sequence: Synthetic polypeptide
DEEEIRTTNPVATEQYGSVQATVNGEETVNEVT

SEQ ID NO: 99914 - protein, 35 aa, Artificial Sequence
  Description of Artificial Sequence: Synthetic polypeptide
AEEEIRTTNPVATEQYGSVVVVTTNLQTIGEENDT

SEQ ID NO: 99915 - protein, 35 aa, Artificial Sequence
  Description of Artificial Sequence: Synthetic polypeptide
AEEEIRTTNPVATEQYGSVVVVTTNLQQQGEGNQT

SEQ ID NO: 99916 - protein, 28 aa, Artificial Sequence
  Description of Artificial Sequence: Synthetic peptide
QEEEIATTNPVATEQYGNAPEVCQHGEK

SEQ ID NO: 99917 - protein, 34 aa, Artificial Sequence
  Description of Artificial Sequence: Synthetic polypeptide
DEEEIRTTNPVATEQYGSVMGTVFGSNGQGEGGQ

SEQ ID NO: 99918 - protein, 34 aa, Artificial Sequence
  Description of Artificial Sequence: Synthetic polypeptide
AEEEIRTTNPVATEQYGSVVVSNNNEQGGNNEES

SEQ ID NO: 99919 - protein, 35 aa, Artificial Sequence
  Description of Artificial Sequence: Synthetic polypeptide
AEEEIRTTNPVATEQYGSVVVVTTNLQQGNGNNTT

SEQ ID NO: 99920 - protein, 35 aa, Artificial Sequence
  Description of Artificial Sequence: Synthetic polypeptide
DEEEIRTTNPVATEQYGSVPYPTVLPETRGVNVET

SEQ ID NO: 99921 - protein, 31 aa, Artificial Sequence
  Description of Artificial Sequence: Synthetic polypeptide
NEEEIYTTNPVATEQYGSISAWWLDEEFGNQ

SEQ ID NO: 99922 - protein, 34 aa, Artificial Sequence
  Description of Artificial Sequence: Synthetic polypeptide
AEEEIRTTNPVATEQYGSVVVSNNNGEQGGNEES

SEQ ID NO: 99923 - protein, 33 aa, Artificial Sequence
  Description of Artificial Sequence: Synthetic polypeptide
DEEEIACTNPVATEQYGSVATNLQGAPIGEDAH

SEQ ID NO: 99924 - protein, 32 aa, Artificial Sequence
  Description of Artificial Sequence: Synthetic polypeptide
AEEEIRTTNPVATEQYGSVVVSNQLNNTNNAN

SEQ ID NO: 99925 - protein, 35 aa, Artificial Sequence
  Description of Artificial Sequence: Synthetic polypeptide
FEEEIRTTNPVATEQYGSVSTMNTGIQGEGENEDE

SEQ ID NO: 99926 - protein, 32 aa, Artificial Sequence
  Description of Artificial Sequence: Synthetic polypeptide
QEEEIACTNPVATEQYGSVATNLQAEDPGEDD

SEQ ID NO: 99927 - protein, 35 aa, Artificial Sequence
  Description of Artificial Sequence: Synthetic polypeptide
AEEEIRTTNPVATEQYGSVVVVTTNLQQGNGNQTD

SEQ ID NO: 99928 - protein, 31 aa, Artificial Sequence
  Description of Artificial Sequence: Synthetic polypeptide
QEEEIACTNPVATEQYGSVATNLEQPPSVVH

SEQ ID NO: 99929 - protein, 35 aa, Artificial Sequence
  Description of Artificial Sequence: Synthetic polypeptide
AEEEIRTTNPVATEQYGSVVVVTTNLQQGNGNQTE

SEQ ID NO: 99930 - protein, 33 aa, Artificial Sequence
  Description of Artificial Sequence: Synthetic polypeptide
FEEEIRTTNPVATEQYGSVSTMGMNGEGGGQEG

SEQ ID NO: 99931 - protein, 33 aa, Artificial Sequence
  Description of Artificial Sequence: Synthetic polypeptide
DEEEIRTTNPVATEQYGSVNGELDDDQGSNTIQ

SEQ ID NO: 99932 - protein, 32 aa, Artificial Sequence
  Description of Artificial Sequence: Synthetic polypeptide
DEEEIACTNPVATEQYGSVATNLQGAPLEEAW

SEQ ID NO: 99933 - protein, 34 aa, Artificial Sequence
  Description of Artificial Sequence: Synthetic polypeptide
AEEEIRTTNPVATEQYGVVVVTTNLQQNEGNEQG

SEQ ID NO: 99934 - protein, 28 aa, Artificial Sequence
  Description of Artificial Sequence: Synthetic peptide
QEEEIACTNPVATEQYGEAPENLMHGEK

SEQ ID NO: 99935 - protein, 34 aa, Artificial Sequence
  Description of Artificial Sequence: Synthetic polypeptide
AEEEISTTNPVATEQYGCVCSNTNLQNFGSENQS

SEQ ID NO: 99936 - protein, 32 aa, Artificial Sequence
  Description of Artificial Sequence: Synthetic polypeptide
DSEEIRTTNPLATEHYGSVSCDNESSQGEGDR

SEQ ID NO: 99937 - protein, 32 aa, Artificial Sequence
  Description of Artificial Sequence: Synthetic polypeptide
NEREIRTTNPVATEQYGCVWTNLQNFGSDTAS

SEQ ID NO: 99938 - protein, 28 aa, Artificial Sequence
  Description of Artificial Sequence: Synthetic peptide
KENEIATTNPVATECYGDVSECLQHEEL

SEQ ID NO: 99939 - protein, 34 aa, Artificial Sequence
  Description of Artificial Sequence: Synthetic polypeptide
DEEEIRTTNPVATEQYGSVSNMNDEMDNEGENIG

SEQ ID NO: 99940 - protein, 34 aa, Artificial Sequence
  Description of Artificial Sequence: Synthetic polypeptide
DEEEIRTTNPVATEQYGSVQCETNEQALMTQEAR

SEQ ID NO: 99941 - protein, 34 aa, Artificial Sequence
  Description of Artificial Sequence: Synthetic polypeptide
DEEEIRTTNPVATEQYGSVSNMDLVNFEGGENGN

SEQ ID NO: 99942 - protein, 29 aa, Artificial Sequence
  Description of Artificial Sequence: Synthetic peptide
AENEIACTNPVATEQYGCSSSNLQSFGGQ

SEQ ID NO: 99943 - protein, 30 aa, Artificial Sequence
  Description of Artificial Sequence: Synthetic polypeptide
AENEIACTNPVATEQYGCSSSNLQRIGSGQ

SEQ ID NO: 99944 - protein, 30 aa, Artificial Sequence
  Description of Artificial Sequence: Synthetic polypeptide
AENEIACTNPVATEQYGEASENLQQQRGGH

SEQ ID NO: 99945 - protein, 34 aa, Artificial Sequence
  Description of Artificial Sequence: Synthetic polypeptide
AEEEIRTTNPVATEQYGSVVVTTQNLGNEAGNND

SEQ ID NO: 99946 - protein, 34 aa, Artificial Sequence
  Description of Artificial Sequence: Synthetic polypeptide
DEEEIRTTNPVATEQYGSVSPCGPALQLSENEVQ

SEQ ID NO: 99947 - protein, 33 aa, Artificial Sequence
  Description of Artificial Sequence: Synthetic polypeptide
DEEEIRTTNPVATEQYGSVQCIERGFRGITNQV

SEQ ID NO: 99948 - protein, 31 aa, Artificial Sequence
  Description of Artificial Sequence: Synthetic polypeptide
NEREIRTTNPVATEQYGCVQTNDQIFGSDQA

SEQ ID NO: 99949 - protein, 35 aa, Artificial Sequence
  Description of Artificial Sequence: Synthetic polypeptide
DSEEIRTTNPVATEAYGSTCVSCLPNMLSQRDGNE

SEQ ID NO: 99950 - protein, 30 aa, Artificial Sequence
  Description of Artificial Sequence: Synthetic polypeptide
AENEIACTNPVATEQYGCSCSWNLQYSGDQ

SEQ ID NO: 99951 - protein, 31 aa, Artificial Sequence
  Description of Artificial Sequence: Synthetic polypeptide
NETEIATTNPVATEQYGEVSTTQMGDRGNDE

SEQ ID NO: 99952 - protein, 33 aa, Artificial Sequence
  Description of Artificial Sequence: Synthetic polypeptide
NEEEIRTTNPVATEQYGSLSPTVHLEVEQLQGR

SEQ ID NO: 99953 - protein, 36 aa, Artificial Sequence
  Description of Artificial Sequence: Synthetic polypeptide
DEEEIRTTNPVATEQYGSVSPCTMAGNNMRNGMNPV

SEQ ID NO: 99954 - protein, 30 aa, Artificial Sequence
  Description of Artificial Sequence: Synthetic polypeptide
AENEIACTNPVATEQYGEASENLQQQNGGR

SEQ ID NO: 99955 - protein, 34 aa, Artificial Sequence
  Description of Artificial Sequence: Synthetic polypeptide
FEEEIRTTNPVATEQYGSVSTGNMDNGGGENVGI

SEQ ID NO: 99956 - protein, 29 aa, Artificial Sequence
  Description of Artificial Sequence: Synthetic peptide
AENEIACTNPVATEQYGCSSWNLQNGGQS

SEQ ID NO: 99957 - protein, 28 aa, Artificial Sequence
  Description of Artificial Sequence: Synthetic peptide
QEEEIASVNPVGTEQYGVVSDTLQHGDQ

SEQ ID NO: 99958 - protein, 36 aa, Artificial Sequence
  Description of Artificial Sequence: Synthetic polypeptide
DEEEIRTTNPVATEQYGSVSNMNGGNLQSEFGNNGF

SEQ ID NO: 99959 - protein, 34 aa, Artificial Sequence
  Description of Artificial Sequence: Synthetic polypeptide
DEEEIRTTNPVATEQYGSVSCPNVQSFQNEEDVD

SEQ ID NO: 99960 - protein, 32 aa, Artificial Sequence
  Description of Artificial Sequence: Synthetic polypeptide
NETEIATTNPVATEMWGSVSTNLQGNMGNTDA

SEQ ID NO: 99961 - protein, 35 aa, Artificial Sequence
  Description of Artificial Sequence: Synthetic polypeptide
AEEEIRTTNPVATEQYGSVVVVTTNNLQQIGTNDE

SEQ ID NO: 99962 - protein, 34 aa, Artificial Sequence
  Description of Artificial Sequence: Synthetic polypeptide
DEEEIRTTNPVATEQYGSVSCTVNGPDHFGKQFM

SEQ ID NO: 99963 - protein, 33 aa, Artificial Sequence
  Description of Artificial Sequence: Synthetic polypeptide
DEEEIACTNPVATEQYGSVATNLQPAEDDTPRV

SEQ ID NO: 99964 - protein, 33 aa, Artificial Sequence
  Description of Artificial Sequence: Synthetic polypeptide
DEEEIACTNPVATEQYGSVATNLQQGAGAEGGD

SEQ ID NO: 99965 - protein, 28 aa, Artificial Sequence
  Description of Artificial Sequence: Synthetic peptide
QEEEIACTNPVATEQYGEVPEVCQHEER

SEQ ID NO: 99966 - protein, 34 aa, Artificial Sequence
  Description of Artificial Sequence: Synthetic polypeptide
NEEEVRTTNPVATEQYGCVCSTGNLDQGIGSNQA

SEQ ID NO: 99967 - protein, 35 aa, Artificial Sequence
  Description of Artificial Sequence: Synthetic polypeptide
AEEEIRTTNPVATEQYGSVVVTVTNNLQNGNQNAD

SEQ ID NO: 99968 - protein, 34 aa, Artificial Sequence
  Description of Artificial Sequence: Synthetic polypeptide
AEEEIRTTNPVATEQYGSVVVTVNNNEQLGNNAS

SEQ ID NO: 99969 - protein, 33 aa, Artificial Sequence
  Description of Artificial Sequence: Synthetic polypeptide
DSEEIRTTNPTAYEHYGEVCSCIVNLSQREGNR

SEQ ID NO: 99970 - protein, 32 aa, Artificial Sequence
  Description of Artificial Sequence: Synthetic polypeptide
NEEPIRTTNPVATEQYGCVSTANSQTFPENQC

SEQ ID NO: 99971 - protein, 32 aa, Artificial Sequence
  Description of Artificial Sequence: Synthetic polypeptide
DSEEIRTTNPTAYEHYGEVSCINLSQVEGNRY

SEQ ID NO: 99972 - protein, 32 aa, Artificial Sequence
  Description of Artificial Sequence: Synthetic polypeptide
GESCIRTTNPVAYEQYGSVSCTNPSQGPGGNK

SEQ ID NO: 99973 - protein, 28 aa, Artificial Sequence
  Description of Artificial Sequence: Synthetic peptide
QEEEIACTNPVATEQYGEASENCQHEEK

SEQ ID NO: 99974 - protein, 32 aa, Artificial Sequence
  Description of Artificial Sequence: Synthetic polypeptide
NEEPIRTTNPVAYEQYGCVSTINVETRIGENQ

SEQ ID NO: 99975 - protein, 33 aa, Artificial Sequence
  Description of Artificial Sequence: Synthetic polypeptide
HEGEIRTTNPVATEQYGSVSTLNDLTFNQVFEK

SEQ ID NO: 99976 - protein, 35 aa, Artificial Sequence
  Description of Artificial Sequence: Synthetic polypeptide
FEEEIRTTNPVATEQYGSVSTDNGNEQENEGGNTG

SEQ ID NO: 99977 - protein, 33 aa, Artificial Sequence
  Description of Artificial Sequence: Synthetic polypeptide
DEEAEIRTTNPVAYEAWGEVSTNLNRGEGQNGS

SEQ ID NO: 99978 - protein, 34 aa, Artificial Sequence
  Description of Artificial Sequence: Synthetic polypeptide
DEEEIRTTNPVATEQYGSVSNGNLEEPAPQPEEE

SEQ ID NO: 99979 - protein, 34 aa, Artificial Sequence
  Description of Artificial Sequence: Synthetic polypeptide
DSEEIRTTNPVATEQYGSVQCTTNLQNGDDEEII

SEQ ID NO: 99980 - protein, 34 aa, Artificial Sequence
  Description of Artificial Sequence: Synthetic polypeptide
DEEEIRTTNPVATEQYGSVSNENDLNQEAVLESS

SEQ ID NO: 99981 - protein, 34 aa, Artificial Sequence
  Description of Artificial Sequence: Synthetic polypeptide
DEEEIRTTNPVATEQYGSVSNENDAQEAVLESRG

SEQ ID NO: 99982 - protein, 32 aa, Artificial Sequence
  Description of Artificial Sequence: Synthetic polypeptide
AENEIACTNPVATEQYGCSCSTWNLQRFGSGQ

SEQ ID NO: 99983 - protein, 33 aa, Artificial Sequence
  Description of Artificial Sequence: Synthetic polypeptide
HEGEIRCTNPVATEQYGCVSTLNDLQRSINGYA

SEQ ID NO: 99984 - protein, 35 aa, Artificial Sequence
  Description of Artificial Sequence: Synthetic polypeptide
DEEEIRTTNPVATEQYGSVMGTNLVVENDGGNELG

SEQ ID NO: 99985 - protein, 30 aa, Artificial Sequence
  Description of Artificial Sequence: Synthetic polypeptide
DEECISTVNPVATEGYGCVCSWNLENSGNQ

SEQ ID NO: 99986 - protein, 35 aa, Artificial Sequence
  Description of Artificial Sequence: Synthetic polypeptide
DEEEIRTTNPVATEQYGSVMGTNIDQGGGEDNEGQ

SEQ ID NO: 99987 - protein, 33 aa, Artificial Sequence
  Description of Artificial Sequence: Synthetic polypeptide
DSEEIRTTNPVATEQYGSVSPPLVSQEGIEEAQ

SEQ ID NO: 99988 - protein, 36 aa, Artificial Sequence
  Description of Artificial Sequence: Synthetic polypeptide
DEEEIRTTNPVATEQYGSVSNDTDNMDQGGGQENTT

SEQ ID NO: 99989 - protein, 34 aa, Artificial Sequence
  Description of Artificial Sequence: Synthetic polypeptide
DEEEIRTTNPVATEQYGSVSNDSNTNENQSVAED

SEQ ID NO: 99990 - protein, 28 aa, Artificial Sequence
  Description of Artificial Sequence: Synthetic peptide
QEEEIASTNPVATEQYGEVPEVCQHGEK

SEQ ID NO: 99991 - protein, 31 aa, Artificial Sequence
  Description of Artificial Sequence: Synthetic polypeptide
AENEIACTNPVATEQYGCSCSSNLQRFGSQQ

SEQ ID NO: 99992 - protein, 35 aa, Artificial Sequence
  Description of Artificial Sequence: Synthetic polypeptide
DEEEIRTTNPVATEQYGSVILNMNFLQPGSGVENG

SEQ ID NO: 99993 - protein, 33 aa, Artificial Sequence
  Description of Artificial Sequence: Synthetic polypeptide
DSEEIRTTNPVATEQYGSVSPINVLQEVIEHAY

SEQ ID NO: 99994 - protein, 35 aa, Artificial Sequence
  Description of Artificial Sequence: Synthetic polypeptide
DEEEIRTTNPVATEQYGSVILANMGEQERTGPNQD

SEQ ID NO: 99995 - protein, 34 aa, Artificial Sequence
  Description of Artificial Sequence: Synthetic polypeptide
DEEEIRTTNPVATEQYGSVILANMDEQERGPSQD

SEQ ID NO: 99996 - protein, 35 aa, Artificial Sequence
  Description of Artificial Sequence: Synthetic polypeptide
DSEEIRTTNPVATEQYGSVPSCTGNEHQERTVFPR

SEQ ID NO: 99997 - protein, 35 aa, Artificial Sequence
  Description of Artificial Sequence: Synthetic polypeptide
DSEEIRTTNPVATEQYGCVCSTNELSGKTPGPNRG

SEQ ID NO: 99998 - protein, 33 aa, Artificial Sequence
  Description of Artificial Sequence: Synthetic polypeptide
DEEEIRTTNPVATEQYGSVMGTNNFEGEEGGEG

SEQ ID NO: 99999 - protein, 34 aa, Artificial Sequence
  Description of Artificial Sequence: Synthetic polypeptide
DSEEIRTTNPVATEQYGEVPSCINAHEQRGGEPR

SEQ ID NO: 100000 - protein, 28 aa, Artificial Sequence
  Description of Artificial Sequence: Synthetic peptide
QEEEIATTNPVSTEQYGEASEVCQHETR

SEQ ID NO: 100001 - protein, 35 aa, Artificial Sequence
  Description of Artificial Sequence: Synthetic polypeptide
DSEEIRTTNPVATEQYGQSVVSTINLSGHGGNTPW

SEQ ID NO: 100002 - protein, 35 aa, Artificial Sequence
  Description of Artificial Sequence: Synthetic polypeptide
AEEEIRTTNPVATEQYGSVVVVTTTNLQQGQENDE

SEQ ID NO: 100003 - protein, 33 aa, Artificial Sequence
  Description of Artificial Sequence: Synthetic polypeptide
DEEEIRTTNPVATEQYGSVSNFLDDIENVVVGN

SEQ ID NO: 100004 - protein, 34 aa, Artificial Sequence
  Description of Artificial Sequence: Synthetic polypeptide
DEEEIRTTNPVATEQYGSVSNETEEQESMIPLRN

SEQ ID NO: 100005 - protein, 34 aa, Artificial Sequence
  Description of Artificial Sequence: Synthetic polypeptide
DSEEIRTTNPVATEQYGSTVYQNAFSQNRLGDNQ

SEQ ID NO: 100006 - protein, 34 aa, Artificial Sequence
  Description of Artificial Sequence: Synthetic polypeptide
DEEEIRTTNPVATEQYGSVSNENSLQMLMVHLGQ

SEQ ID NO: 100007 - protein, 31 aa, Artificial Sequence
  Description of Artificial Sequence: Synthetic polypeptide
NETEIATTNPVAYEQWGSVSTNLNMGEGNNT

SEQ ID NO: 100008 - protein, 36 aa, Artificial Sequence
  Description of Artificial Sequence: Synthetic polypeptide
DEEEIRTTNPVATEQYGSVMGTNMELQNIGGENNNT

SEQ ID NO: 100009 - protein, 34 aa, Artificial Sequence
  Description of Artificial Sequence: Synthetic polypeptide
DEEEIRTTNPVATEQYGSVSPEMWVPQMRQNDEN

SEQ ID NO: 100010 - protein, 33 aa, Artificial Sequence
  Description of Artificial Sequence: Synthetic polypeptide
HEGEIRTTNPVATEQYGSVSALDDLQRNANFYI

SEQ ID NO: 100011 - protein, 32 aa, Artificial Sequence
  Description of Artificial Sequence: Synthetic polypeptide
DEEAISTTNPVATEQYGCVCSTNHQNFFSNQQ

SEQ ID NO: 100012 - protein, 33 aa, Artificial Sequence
  Description of Artificial Sequence: Synthetic polypeptide
NEQEIRTTNPVATEQYGSVSVTNEIINDGGNEM

SEQ ID NO: 100013 - protein, 33 aa, Artificial Sequence
  Description of Artificial Sequence: Synthetic polypeptide
FEEEIRTTNPVATEQYGSVSSTGGGQGQGEEGG

SEQ ID NO: 100014 - protein, 33 aa, Artificial Sequence
  Description of Artificial Sequence: Synthetic polypeptide
DEEEIRTTNPVATEQYGSVMGTNFENDEEGGEG

SEQ ID NO: 100015 - protein, 32 aa, Artificial Sequence
  Description of Artificial Sequence: Synthetic polypeptide
QEEEIATTNPVATEQYGEVSTTPVGPNRGMNV

SEQ ID NO: 100016 - protein, 34 aa, Artificial Sequence
  Description of Artificial Sequence: Synthetic polypeptide
DEEEIRTTNPVATEQYGSVSNDNLDESQNVALDL

SEQ ID NO: 100017 - protein, 34 aa, Artificial Sequence
  Description of Artificial Sequence: Synthetic polypeptide
DEEEIRTTNPVATEQYGSVSNDNLDEQSQSVAES

SEQ ID NO: 100018 - protein, 34 aa, Artificial Sequence
  Description of Artificial Sequence: Synthetic polypeptide
DEEEIRTTNPVATEQYGSVSNDNGQGQEFNNGET

SEQ ID NO: 100019 - protein, 35 aa, Artificial Sequence
  Description of Artificial Sequence: Synthetic polypeptide
DEEEIRTTNPVATEQYGSVMGTNDQFDEELEGNGT

SEQ ID NO: 100020 - protein, 35 aa, Artificial Sequence
  Description of Artificial Sequence: Synthetic polypeptide
DEEEIRTTNPVATEQYGSVSPENGLLQQRIVMEDE

SEQ ID NO: 100021 - protein, 35 aa, Artificial Sequence
  Description of Artificial Sequence: Synthetic polypeptide
AEEEIRTTNPVATEQYGSVVTVANLENQEQGNNVE

SEQ ID NO: 100022 - protein, 34 aa, Artificial Sequence
  Description of Artificial Sequence: Synthetic polypeptide
DSEEIRTTNPVAYEQWGWVPSTNIAQYRTVGNRM

SEQ ID NO: 100023 - protein, 32 aa, Artificial Sequence
  Description of Artificial Sequence: Synthetic polypeptide
DSEEIRTTNPVAYEQYGETVSCINHEQRVEPR

SEQ ID NO: 100024 - protein, 32 aa, Artificial Sequence
  Description of Artificial Sequence: Synthetic polypeptide
NEGEIRTTNPVATEQYGSVWTWPLQEIGFSDV

SEQ ID NO: 100025 - protein, 35 aa, Artificial Sequence
  Description of Artificial Sequence: Synthetic polypeptide
AEEEIRTTNPVATEQYGSVVTVTTNNNLQQGNEDG

SEQ ID NO: 100026 - protein, 31 aa, Artificial Sequence
  Description of Artificial Sequence: Synthetic polypeptide
AENEIACTNPVATEQYGCSCSNSNLQRGSGQ

SEQ ID NO: 100027 - protein, 31 aa, Artificial Sequence
  Description of Artificial Sequence: Synthetic polypeptide
QEEEIATTNPVATEQYGEVSTEPAGNRNENV

SEQ ID NO: 100028 - protein, 34 aa, Artificial Sequence
  Description of Artificial Sequence: Synthetic polypeptide
DSEEIRTTNPVAYEQYGQSVSINAFEQRTGGTYR

SEQ ID NO: 100029 - protein, 34 aa, Artificial Sequence
  Description of Artificial Sequence: Synthetic polypeptide
AEEEIRTTNPVATEQYGSVVVTTNQNQQEGTNFT

SEQ ID NO: 100030 - protein, 33 aa, Artificial Sequence
  Description of Artificial Sequence: Synthetic polypeptide
DEEEIRTTNPVATEQYGSVSNDNEDESQDVVED

SEQ ID NO: 100031 - protein, 33 aa, Artificial Sequence
  Description of Artificial Sequence: Synthetic polypeptide
DSEEIRTTNPVAYEQWGSVPSTLVSQRTGTTQR

SEQ ID NO: 100032 - protein, 32 aa, Artificial Sequence
  Description of Artificial Sequence: Synthetic polypeptide
NETEICTTNPVATEMWGSVSTNLQGNEGQNGD

SEQ ID NO: 100033 - protein, 30 aa, Artificial Sequence
  Description of Artificial Sequence: Synthetic polypeptide
QEEEIACTNPVATEQYGCVATNLTDDGDDQ

SEQ ID NO: 100034 - protein, 34 aa, Artificial Sequence
  Description of Artificial Sequence: Synthetic polypeptide
AEEEIRTTNPVATEQYGSVVVTVNVNNTQNGNND

SEQ ID NO: 100035 - protein, 35 aa, Artificial Sequence
  Description of Artificial Sequence: Synthetic polypeptide
DEEEIRTTNPVATEQYGSVSNDNVGDQDEGGNDEN

SEQ ID NO: 100036 - protein, 35 aa, Artificial Sequence
  Description of Artificial Sequence: Synthetic polypeptide
AEEEIRTTNPVATEQYGSVVVVTVNNLQQGNGNTE

SEQ ID NO: 100037 - protein, 30 aa, Artificial Sequence
  Description of Artificial Sequence: Synthetic polypeptide
AENEIACTNPVATEQYGCSCSSELQRFGGQ

SEQ ID NO: 100038 - protein, 32 aa, Artificial Sequence
  Description of Artificial Sequence: Synthetic polypeptide
QEEEIACTNPVATEQYGCVATNNLENMGENDR

SEQ ID NO: 100039 - protein, 33 aa, Artificial Sequence
  Description of Artificial Sequence: Synthetic polypeptide
NEEEIRTTNPVATEQYGSASPTSVELEVERQGR

SEQ ID NO: 100040 - protein, 28 aa, Artificial Sequence
  Description of Artificial Sequence: Synthetic peptide
HEGEIATTNPVATECYGEVSEELQHMEL

SEQ ID NO: 100041 - protein, 33 aa, Artificial Sequence
  Description of Artificial Sequence: Synthetic polypeptide
DEEEIRTTNPVATEQYGSVILPLEQQENIVNNV

SEQ ID NO: 100042 - protein, 35 aa, Artificial Sequence
  Description of Artificial Sequence: Synthetic polypeptide
NEEEIRTTNPVATEQYGQVTSCTETELSQPTGGNR

SEQ ID NO: 100043 - protein, 32 aa, Artificial Sequence
  Description of Artificial Sequence: Synthetic polypeptide
NETEICTTNPVATEMWGSVSTNLQGNEGNNDS

SEQ ID NO: 100044 - protein, 32 aa, Artificial Sequence
  Description of Artificial Sequence: Synthetic polypeptide
DSEEIRTTNPVAYEPYGKVSCINHEQRGTEPR

SEQ ID NO: 100045 - protein, 31 aa, Artificial Sequence
  Description of Artificial Sequence: Synthetic polypeptide
NEQEIATTNPVATEQYGSVSATDLEHEGEDL

SEQ ID NO: 100046 - protein, 36 aa, Artificial Sequence
  Description of Artificial Sequence: Synthetic polypeptide
DEEEIRTTNPVATEQYGSVMGTNDQRGEDEGNGQII

SEQ ID NO: 100047 - protein, 33 aa, Artificial Sequence
  Description of Artificial Sequence: Synthetic polypeptide
DEEEIRTTNPVATEQYGSVSNDNLNENMSVAEI

SEQ ID NO: 100048 - protein, 33 aa, Artificial Sequence
  Description of Artificial Sequence: Synthetic polypeptide
DNEEIRTTNPVATEQYGSVSTWPLQANSDQEEH

SEQ ID NO: 100049 - protein, 35 aa, Artificial Sequence
  Description of Artificial Sequence: Synthetic polypeptide
AEEEIRTTNPVATEQYGSVVVVTTTTNLQSGNNQQ

SEQ ID NO: 100050 - protein, 34 aa, Artificial Sequence
  Description of Artificial Sequence: Synthetic polypeptide
DEEEIRTTNPVATEQYGSVSPEMTLTQSNGDEEL

SEQ ID NO: 100051 - protein, 35 aa, Artificial Sequence
  Description of Artificial Sequence: Synthetic polypeptide
AEEEIRTTNPVATEQYGSVVVTVTNLQGSTGNNGE

SEQ ID NO: 100052 - protein, 35 aa, Artificial Sequence
  Description of Artificial Sequence: Synthetic polypeptide
DEEEIRTTNPVATEQYGSVILALMLEQERGPNQDT

SEQ ID NO: 100053 - protein, 28 aa, Artificial Sequence
  Description of Artificial Sequence: Synthetic peptide
QEEEIATTNPVATEQYGEYPEVQQREEK

SEQ ID NO: 100054 - protein, 34 aa, Artificial Sequence
  Description of Artificial Sequence: Synthetic polypeptide
DEEEIRTTNPVATEQYGSVSDTGQTGGGNEGNTG

SEQ ID NO: 100055 - protein, 33 aa, Artificial Sequence
  Description of Artificial Sequence: Synthetic polypeptide
AEEEIRTTNPVATEQYGVVVVSTTQLQGTEGGV

SEQ ID NO: 100056 - protein, 33 aa, Artificial Sequence
  Description of Artificial Sequence: Synthetic polypeptide
DEEEIRTTNPVATEQYGSVSPEGGLQALTELLE

SEQ ID NO: 100057 - protein, 33 aa, Artificial Sequence
  Description of Artificial Sequence: Synthetic polypeptide
DEEEIRTTNPVATEQYGSVSPEEYDAAQGDNQA

SEQ ID NO: 100058 - protein, 33 aa, Artificial Sequence
  Description of Artificial Sequence: Synthetic polypeptide
DEEEIRTTNPVATEQYGSVSNGLDDYENVVVNF

SEQ ID NO: 100059 - protein, 31 aa, Artificial Sequence
  Description of Artificial Sequence: Synthetic polypeptide
NEGEIRTTNPVATEQYGSVSWTLDLTEDEDQ

SEQ ID NO: 100060 - protein, 33 aa, Artificial Sequence
  Description of Artificial Sequence: Synthetic polypeptide
LEEEIRTTNPVATEQYGSVSSAELVEGGMNDLQ

SEQ ID NO: 100061 - protein, 34 aa, Artificial Sequence
  Description of Artificial Sequence: Synthetic polypeptide
DSEEIRTTNPVATEQWGSVVSTINLSNNGGNTPW

SEQ ID NO: 100062 - protein, 32 aa, Artificial Sequence
  Description of Artificial Sequence: Synthetic polypeptide
DEEEIRTTNPVATEQYGSVSNGLEVPAIVEDE

SEQ ID NO: 100063 - protein, 33 aa, Artificial Sequence
  Description of Artificial Sequence: Synthetic polypeptide
DEEEIRTTNPVATEQYGSVSNGLYLTQEVESEL

SEQ ID NO: 100064 - protein, 35 aa, Artificial Sequence
  Description of Artificial Sequence: Synthetic polypeptide
DEEEIRTTNPVATEQYGSVSNGNGNNQGENGNNAN

SEQ ID NO: 100065 - protein, 35 aa, Artificial Sequence
  Description of Artificial Sequence: Synthetic polypeptide
DEEEIRTTNPVATEQYGSVSDTGVTGQAEGGGNGE

SEQ ID NO: 100066 - protein, 32 aa, Artificial Sequence
  Description of Artificial Sequence: Synthetic polypeptide
DEEEIATTNPVATEQYGEASSTVCNMRNGMNV

SEQ ID NO: 100067 - protein, 35 aa, Artificial Sequence
  Description of Artificial Sequence: Synthetic polypeptide
DEEEIRTTNPVATEQYGSVILAFNMLEQEVGPNQD

SEQ ID NO: 100068 - protein, 35 aa, Artificial Sequence
  Description of Artificial Sequence: Synthetic polypeptide
DEEEIRTTNPVATEQYGSVPCNTQNLYGNVGATTR

SEQ ID NO: 100069 - protein, 34 aa, Artificial Sequence
  Description of Artificial Sequence: Synthetic polypeptide
LEEEIRTTNPVATEPYGKTVQSQNALSQNGGNNR

SEQ ID NO: 100070 - protein, 29 aa, Artificial Sequence
  Description of Artificial Sequence: Synthetic peptide
AENEIRTTNPVATEQWGDVSEIEMNREDA

SEQ ID NO: 100071 - protein, 36 aa, Artificial Sequence
  Description of Artificial Sequence: Synthetic polypeptide
AEEEIRTTNPVATEQYGSVSTNTNNENQETGNNNND

SEQ ID NO: 100072 - protein, 33 aa, Artificial Sequence
  Description of Artificial Sequence: Synthetic polypeptide
SEEEIRTTNPVAYEQYGSCNCTNNLAGPGGNNA

SEQ ID NO: 100073 - protein, 34 aa, Artificial Sequence
  Description of Artificial Sequence: Synthetic polypeptide
DEMEIRTTNPVATEQYGCVSVTVNHAEENNQHGN

SEQ ID NO: 100074 - protein, 32 aa, Artificial Sequence
  Description of Artificial Sequence: Synthetic polypeptide
DETEIRTTNPVAYESWGSVATNEQGDLGNGGS

SEQ ID NO: 100075 - protein, 33 aa, Artificial Sequence
  Description of Artificial Sequence: Synthetic polypeptide
SEEEIRTTNPVAYEQYGSCNCTNPDQPTGGNNA

SEQ ID NO: 100076 - protein, 33 aa, Artificial Sequence
  Description of Artificial Sequence: Synthetic polypeptide
MEEEISTTNPVATEQYGCVCSVTMEHQGGSNQL

SEQ ID NO: 100077 - protein, 31 aa, Artificial Sequence
  Description of Artificial Sequence: Synthetic polypeptide
HSEEIRTTNPVGTEQWGAVSTNGLVIGEVVI

SEQ ID NO: 100078 - protein, 33 aa, Artificial Sequence
  Description of Artificial Sequence: Synthetic polypeptide
SESEIRTTNPVATECWGSVSCENEPQDREGENG

SEQ ID NO: 100079 - protein, 32 aa, Artificial Sequence
  Description of Artificial Sequence: Synthetic polypeptide
DAEEIATTNPVATAQWGSVSTGNPDNANGNDN

SEQ ID NO: 100080 - protein, 30 aa, Artificial Sequence
  Description of Artificial Sequence: Synthetic polypeptide
AENEIRTTNPVATEQWGDVSEIEMNRAGDA

SEQ ID NO: 100081 - protein, 33 aa, Artificial Sequence
  Description of Artificial Sequence: Synthetic polypeptide
MEEEIRTTNPVATEQYGSVVTLVQYHFENSEEK

SEQ ID NO: 100082 - protein, 34 aa, Artificial Sequence
  Description of Artificial Sequence: Synthetic polypeptide
DEMEIRTTNPVATEQYGCVSTVNHMEEANTQDGN

SEQ ID NO: 100083 - protein, 30 aa, Artificial Sequence
  Description of Artificial Sequence: Synthetic polypeptide
DEMEIRTTNPVATEQYGDVCSEIPMAEEDA

SEQ ID NO: 100084 - protein, 34 aa, Artificial Sequence
  Description of Artificial Sequence: Synthetic polypeptide
AEEEIRTTNPVATEQYGVVSTVGNNNQGNPNEDE

SEQ ID NO: 100085 - protein, 36 aa, Artificial Sequence
  Description of Artificial Sequence: Synthetic polypeptide
AEEEIRTTNPVATEQYGSVSTNTNDENQETGTNVTE

SEQ ID NO: 100086 - protein, 32 aa, Artificial Sequence
  Description of Artificial Sequence: Synthetic polypeptide
MEEEISTTNPVATEQYGCVCSVWELQGGSQQL

SEQ ID NO: 100087 - protein, 34 aa, Artificial Sequence
  Description of Artificial Sequence: Synthetic polypeptide
DEMEIRTTNPVATEQYGSVCSNTNELTDDSQEHQ

SEQ ID NO: 100088 - protein, 30 aa, Artificial Sequence
  Description of Artificial Sequence: Synthetic polypeptide
HENEIATTNPVATECYGEVSEEALQHGEEL

SEQ ID NO: 100089 - protein, 33 aa, Artificial Sequence
  Description of Artificial Sequence: Synthetic polypeptide
SESEIRTTNPVATECWGSVSCINEPQFREGENG

SEQ ID NO: 100090 - protein, 33 aa, Artificial Sequence
  Description of Artificial Sequence: Synthetic polypeptide
HEGEIRCTNPVATEQYGCVSTLNDLQRNISAMA

SEQ ID NO: 100091 - protein, 33 aa, Artificial Sequence
  Description of Artificial Sequence: Synthetic polypeptide
DEHEIRTTNPVAYECWGSVSWTNDDDQQGQNDD

SEQ ID NO: 100092 - protein, 34 aa, Artificial Sequence
  Description of Artificial Sequence: Synthetic polypeptide
MEEEIRTTNPVATEQYGVVSTLGLGTGFGGNDDE

SEQ ID NO: 100093 - protein, 33 aa, Artificial Sequence
  Description of Artificial Sequence: Synthetic polypeptide
DEHEIRTTNPVAYECWGTVSTTNQGQDAGNNER

SEQ ID NO: 100094 - protein, 32 aa, Artificial Sequence
  Description of Artificial Sequence: Synthetic polypeptide
DEHEIRTTNPVAYECWGVVATNLNRGEGQNGS

SEQ ID NO: 100095 - protein, 37 aa, Artificial Sequence
  Description of Artificial Sequence: Synthetic polypeptide
AEEEIRTTNPVATEQYGSVSTNTQQLGNTQQGTETNE

SEQ ID NO: 100096 - protein, 33 aa, Artificial Sequence
  Description of Artificial Sequence: Synthetic polypeptide
DEHEIRTTNPVATETYGCVSTGGAGLTNGGNEM

SEQ ID NO: 100097 - protein, 31 aa, Artificial Sequence
  Description of Artificial Sequence: Synthetic polypeptide
SEEEIRTTNPVAYEQWGSLSCFEHNQRQGMT

SEQ ID NO: 100098 - protein, 32 aa, Artificial Sequence
  Description of Artificial Sequence: Synthetic polypeptide
HEGEIRTTNPVATEQYGSVSTLEDHTFNQVFY

SEQ ID NO: 100099 - protein, 32 aa, Artificial Sequence
  Description of Artificial Sequence: Synthetic polypeptide
DEMEIRTTNPVATEQYGSCTTLNVSESGQEDP

SEQ ID NO: 100100 - protein, 33 aa, Artificial Sequence
  Description of Artificial Sequence: Synthetic polypeptide
SESEIRCTNPVAYEQYGSVVPCTNELQHGGNYQ

SEQ ID NO: 100101 - protein, 34 aa, Artificial Sequence
  Description of Artificial Sequence: Synthetic polypeptide
DETEIRTTNPVAYEQWGSVSTTNGNDNHQGDGGR

SEQ ID NO: 100102 - protein, 32 aa, Artificial Sequence
  Description of Artificial Sequence: Synthetic polypeptide
DETEIRTTNPVAYEQWGSYWSTINETNQDHNN

SEQ ID NO: 100103 - protein, 35 aa, Artificial Sequence
  Description of Artificial Sequence: Synthetic polypeptide
AEEEIRTTNPVATESYGSVSTTNNNQQNQQGNGNE

SEQ ID NO: 100104 - protein, 34 aa, Artificial Sequence
  Description of Artificial Sequence: Synthetic polypeptide
MEEEIRTTNPVGTEGYGSVNIMDNLQREGGNDGN

SEQ ID NO: 100105 - protein, 36 aa, Artificial Sequence
  Description of Artificial Sequence: Synthetic polypeptide
AEEEIRTTNPVATEQYGSVSTNTQNGNDELGSTNLI

SEQ ID NO: 100106 - protein, 34 aa, Artificial Sequence
  Description of Artificial Sequence: Synthetic polypeptide
SEEEIRTTNPVATESYGSVNGVTNLVREGDGQGE

SEQ ID NO: 100107 - protein, 32 aa, Artificial Sequence
  Description of Artificial Sequence: Synthetic polypeptide
DEHEIRTTNPVAYECWGSVATNLNRGEGQDGE

SEQ ID NO: 100108 - protein, 32 aa, Artificial Sequence
  Description of Artificial Sequence: Synthetic polypeptide
DEHEIRTTNPVAYEGWGTVSTTNLGGDGDDER

SEQ ID NO: 100109 - protein, 34 aa, Artificial Sequence
  Description of Artificial Sequence: Synthetic polypeptide
DEMEIRTTNPVATEQYGSGSWTNGTQTFGSDQFE

SEQ ID NO: 100110 - protein, 36 aa, Artificial Sequence
  Description of Artificial Sequence: Synthetic polypeptide
AEEEIRTTNPVATEQYGVVSTVTNLQQQQGNGNIND

SEQ ID NO: 100111 - protein, 33 aa, Artificial Sequence
  Description of Artificial Sequence: Synthetic polypeptide
DEHEIRTTNPVAYEAWGVVSTTNLAQGDHGNKS

SEQ ID NO: 100112 - protein, 33 aa, Artificial Sequence
  Description of Artificial Sequence: Synthetic polypeptide
SESEIRCTNPVATEQYGSVCEMPNLQEHGNQQD

SEQ ID NO: 100113 - protein, 35 aa, Artificial Sequence
  Description of Artificial Sequence: Synthetic polypeptide
AEEEIRTTNPVATEQYGSVSTNQNQQQQNATNEEN

SEQ ID NO: 100114 - protein, 30 aa, Artificial Sequence
  Description of Artificial Sequence: Synthetic polypeptide
AENEIRTTNPVATEPYGTISMDIQQQNGNH

SEQ ID NO: 100115 - protein, 32 aa, Artificial Sequence
  Description of Artificial Sequence: Synthetic polypeptide
DAQEIATTNPVATEQYGSVSATDLEDHEGEDL

SEQ ID NO: 100116 - protein, 31 aa, Artificial Sequence
  Description of Artificial Sequence: Synthetic polypeptide
DEMEIRTTNPVATEQYGDVCSEIEMNAEENA

SEQ ID NO: 100117 - protein, 33 aa, Artificial Sequence
  Description of Artificial Sequence: Synthetic polypeptide
SESEIRPTNPVATEQYGSTVATGNMLSQHGGEQ

SEQ ID NO: 100118 - protein, 34 aa, Artificial Sequence
  Description of Artificial Sequence: Synthetic polypeptide
SEEEIRTTNPVATESYGSVCSNWNLDHERGGDDH

SEQ ID NO: 100119 - protein, 36 aa, Artificial Sequence
  Description of Artificial Sequence: Synthetic polypeptide
AEEEIRTTNPVATEQYGSVSTNTNQAGNQQGTNINE

SEQ ID NO: 100120 - protein, 35 aa, Artificial Sequence
  Description of Artificial Sequence: Synthetic polypeptide
DEMEIRTTNPVATEQYGSFSVTLNLEQNEQNNMVT

SEQ ID NO: 100121 - protein, 32 aa, Artificial Sequence
  Description of Artificial Sequence: Synthetic polypeptide
DAQEIATTNPVATEQYGSVSATDLSDHEGEDL

SEQ ID NO: 100122 - protein, 32 aa, Artificial Sequence
  Description of Artificial Sequence: Synthetic polypeptide
DAEEIACTNPVATEQYGSVSWNEGERNGKQES

SEQ ID NO: 100123 - protein, 33 aa, Artificial Sequence
  Description of Artificial Sequence: Synthetic polypeptide
SESEIRTTNPVATECWGSVSCINEPQDRRGENG

SEQ ID NO: 100124 - protein, 30 aa, Artificial Sequence
  Description of Artificial Sequence: Synthetic polypeptide
DAEEIATTNPVATAQWGSVSANNPMNSNDS

SEQ ID NO: 100125 - protein, 34 aa, Artificial Sequence
  Description of Artificial Sequence: Synthetic polypeptide
DAAEIATTNPVAYEQYGSVSTNPLQVHQGGMFHR

SEQ ID NO: 100126 - protein, 32 aa, Artificial Sequence
  Description of Artificial Sequence: Synthetic polypeptide
SEEEIRTTNPVAYERYGSCNCTNLDEPGGNNA

SEQ ID NO: 100127 - protein, 35 aa, Artificial Sequence
  Description of Artificial Sequence: Synthetic polypeptide
AEEEIRTTNPVATEQYGVVSTVNLNQQGTEEAEED

SEQ ID NO: 100128 - protein, 36 aa, Artificial Sequence
  Description of Artificial Sequence: Synthetic polypeptide
AEEEIRTTNPVATEQYGVVSTVNNQLQEGTEGGNAT

SEQ ID NO: 100129 - protein, 32 aa, Artificial Sequence
  Description of Artificial Sequence: Synthetic polypeptide
DEHEIRTTNPVAYEKYGSVFSTLSERFSNQSG

SEQ ID NO: 100130 - protein, 36 aa, Artificial Sequence
  Description of Artificial Sequence: Synthetic polypeptide
AEEEIRTTNPVATEQYGVVVVVSTTNLQNGNNNVAE

SEQ ID NO: 100131 - protein, 30 aa, Artificial Sequence
  Description of Artificial Sequence: Synthetic polypeptide
AENEIRTTNPVATECWGETANENLQPKGGR

SEQ ID NO: 100132 - protein, 32 aa, Artificial Sequence
  Description of Artificial Sequence: Synthetic polypeptide
DAQEIATTNPVATEQYGSVSATDLEDHEGEDS

SEQ ID NO: 100133 - protein, 33 aa, Artificial Sequence
  Description of Artificial Sequence: Synthetic polypeptide
SEEEIRTTNPVAYEQWGETVRMTNDHLQRGLMN

SEQ ID NO: 100134 - protein, 30 aa, Artificial Sequence
  Description of Artificial Sequence: Synthetic polypeptide
DEMEIRTTNPVATEQYGDVCSEIEMAEEDA

SEQ ID NO: 100135 - protein, 33 aa, Artificial Sequence
  Description of Artificial Sequence: Synthetic polypeptide
DEHEIRTTNPVAYEFWGTVATTNLGQDAGDNER

SEQ ID NO: 100136 - protein, 35 aa, Artificial Sequence
  Description of Artificial Sequence: Synthetic polypeptide
AEEEIRTTNPVATEQYGVVSTVNNNQQQNDEGNNE

SEQ ID NO: 100137 - protein, 34 aa, Artificial Sequence
  Description of Artificial Sequence: Synthetic polypeptide
MEEEIRTTNPVATEQYGSVTDTMTGLQAEGQEGI

SEQ ID NO: 100138 - protein, 33 aa, Artificial Sequence
  Description of Artificial Sequence: Synthetic polypeptide
DASEIRTTNPVATECWGSVSCINEPQDREGWNG

SEQ ID NO: 100139 - protein, 31 aa, Artificial Sequence
  Description of Artificial Sequence: Synthetic polypeptide
DAAEIATTNPVAYEQYGSVATHLQDSGDGEM

SEQ ID NO: 100140 - protein, 33 aa, Artificial Sequence
  Description of Artificial Sequence: Synthetic polypeptide
DEHEIRTTNPVATETYGCVSTGGAGLTGGQNGA

SEQ ID NO: 100141 - protein, 32 aa, Artificial Sequence
  Description of Artificial Sequence: Synthetic polypeptide
DEMEIRTTNPVATEQYGCVSTVLETSAPDPSP

SEQ ID NO: 100142 - protein, 33 aa, Artificial Sequence
  Description of Artificial Sequence: Synthetic polypeptide
HENEIRTTNPVATETYGSVSINNLQEVGDTVPC

SEQ ID NO: 100143 - protein, 32 aa, Artificial Sequence
  Description of Artificial Sequence: Synthetic polypeptide
HEQEIATTNPVATEQYGSVSATDLEDHEGEDL

SEQ ID NO: 100144 - protein, 36 aa, Artificial Sequence
  Description of Artificial Sequence: Synthetic polypeptide
AEEEIRTTNPVATEQYGSVSSTTPAGPQMRNGMNPV

SEQ ID NO: 100145 - protein, 31 aa, Artificial Sequence
  Description of Artificial Sequence: Synthetic polypeptide
DAAEIATTNPVAYEQYGSVATADQRENPNGD

SEQ ID NO: 100146 - protein, 32 aa, Artificial Sequence
  Description of Artificial Sequence: Synthetic polypeptide
DEMEIRTTNPVATEQYGCVSTVLEPTSLPDPS

SEQ ID NO: 100147 - protein, 36 aa, Artificial Sequence
  Description of Artificial Sequence: Synthetic polypeptide
AEEEIRTTNPVATEQYGSVSSTTPNGPNMRNGMNPV

SEQ ID NO: 100148 - protein, 33 aa, Artificial Sequence
  Description of Artificial Sequence: Synthetic polypeptide
DEMEIRTTNPVATEQYGSVCQTALINFMSNNQS

SEQ ID NO: 100149 - protein, 35 aa, Artificial Sequence
  Description of Artificial Sequence: Synthetic polypeptide
AEEEIRTTNPVATEQYGVVSTVNNQQQGDEGNNNQ

SEQ ID NO: 100150 - protein, 35 aa, Artificial Sequence
  Description of Artificial Sequence: Synthetic polypeptide
AEEEIRTTNPVATEQYGVVVVVTNNNLNNQAGNND

SEQ ID NO: 100151 - protein, 37 aa, Artificial Sequence
  Description of Artificial Sequence: Synthetic polypeptide
AEEEIRTTNPVATEQYGSVSTNQNLQNNNEQGNNAVE

SEQ ID NO: 100152 - protein, 35 aa, Artificial Sequence
  Description of Artificial Sequence: Synthetic polypeptide
MEEEIRTTNPVATEQYGSVTAGTMNLDQGGQGGEG

SEQ ID NO: 100153 - protein, 34 aa, Artificial Sequence
  Description of Artificial Sequence: Synthetic polypeptide
DEHEIRTTNPVAYECWGSVSTGNLAQGDTGGNKS

SEQ ID NO: 100154 - protein, 33 aa, Artificial Sequence
  Description of Artificial Sequence: Synthetic polypeptide
DEMEIRTTNPVATEQYGSVCSTDYEAIEGGETD

SEQ ID NO: 100155 - protein, 36 aa, Artificial Sequence
  Description of Artificial Sequence: Synthetic polypeptide
AEEEIRTTNPVATEQYGVVSTVNNLQNGNQEGNQAE

SEQ ID NO: 100156 - protein, 36 aa, Artificial Sequence
  Description of Artificial Sequence: Synthetic polypeptide
AEEEIRTTNPVATEQYGSVSTNTNQAGTESGNNTAN

SEQ ID NO: 100157 - protein, 33 aa, Artificial Sequence
  Description of Artificial Sequence: Synthetic polypeptide
DEHEIRTTNPVAYEAWGEVSTNLNQGDTGGNKS

SEQ ID NO: 100158 - protein, 32 aa, Artificial Sequence
  Description of Artificial Sequence: Synthetic polypeptide
DEMEIRTTNPVATEQYGSIRSTVYPIQGEHVP

SEQ ID NO: 100159 - protein, 33 aa, Artificial Sequence
  Description of Artificial Sequence: Synthetic polypeptide
DASEIRTTNPVATECWGSVSCINEPQDREGENG

SEQ ID NO: 100160 - protein, 33 aa, Artificial Sequence
  Description of Artificial Sequence: Synthetic polypeptide
DETEIRTTNPVAYESWGSVATNLNQGDVGQNQK

SEQ ID NO: 100161 - protein, 33 aa, Artificial Sequence
  Description of Artificial Sequence: Synthetic polypeptide
DEHEIRTTNPVAYEEWGSVATENLGGIDGGNER

SEQ ID NO: 100162 - protein, 33 aa, Artificial Sequence
  Description of Artificial Sequence: Synthetic polypeptide
DEMEIRTTNPVATEQYGCVSVEDVLQRAEITEM

SEQ ID NO: 100163 - protein, 36 aa, Artificial Sequence
  Description of Artificial Sequence: Synthetic polypeptide
AEEEIRTTNPVATEQYGVVSTVNNNLQQQIGTNQNG

SEQ ID NO: 100164 - protein, 35 aa, Artificial Sequence
  Description of Artificial Sequence: Synthetic polypeptide
AEEEIRTTNPVATEQYGVVSTVNLQNQNDEQNEAE

SEQ ID NO: 100165 - protein, 33 aa, Artificial Sequence
  Description of Artificial Sequence: Synthetic polypeptide
SESEIRCTNPVAYEQYGSVFCTNELSQAHPGNQ

SEQ ID NO: 100166 - protein, 37 aa, Artificial Sequence
  Description of Artificial Sequence: Synthetic polypeptide
AEEEIRTTNPVATEQYGSVSTNTANLQNSEQGTNSVE

SEQ ID NO: 100167 - protein, 34 aa, Artificial Sequence
  Description of Artificial Sequence: Synthetic polypeptide
DEMEIRTTNPVATEQYGCVTSTVNHMEENNQDGN

SEQ ID NO: 100168 - protein, 28 aa, Artificial Sequence
  Description of Artificial Sequence: Synthetic peptide
HEGEIAPTNPCSSEQYGIVSCTLQSGTR

SEQ ID NO: 100169 - protein, 33 aa, Artificial Sequence
  Description of Artificial Sequence: Synthetic polypeptide
DEMEIRTTNPVATEQYGSVCSAEDGPVEFEGND

SEQ ID NO: 100170 - protein, 32 aa, Artificial Sequence
  Description of Artificial Sequence: Synthetic polypeptide
DAEEIASTNPVATEQWGGSSATNDQRDGPNNQ

SEQ ID NO: 100171 - protein, 35 aa, Artificial Sequence
  Description of Artificial Sequence: Synthetic polypeptide
AEEEIRTTNPVATEQYGVVSTVNNNQQGTEENSED

SEQ ID NO: 100172 - protein, 36 aa, Artificial Sequence
  Description of Artificial Sequence: Synthetic polypeptide
AEEEIRTTNPVATEQYGVVSTVNLQQNQEQGNQQGE

SEQ ID NO: 100173 - protein, 36 aa, Artificial Sequence
  Description of Artificial Sequence: Synthetic polypeptide
AEEEIRTTNPVATEQYGVVSTVNLGNQQGTEENNED

SEQ ID NO: 100174 - protein, 33 aa, Artificial Sequence
  Description of Artificial Sequence: Synthetic polypeptide
SEEEIRTTNPVATHSYGSCSNTNLHRSNSDQID

SEQ ID NO: 100175 - protein, 29 aa, Artificial Sequence
  Description of Artificial Sequence: Synthetic peptide
AENEIRTTNPVATEQWGEVSEIEQNAEGA

SEQ ID NO: 100176 - protein, 33 aa, Artificial Sequence
  Description of Artificial Sequence: Synthetic polypeptide
DEHEIRTTNPVAYEEWGSVATTNLGGEDGQNER

SEQ ID NO: 100177 - protein, 31 aa, Artificial Sequence
  Description of Artificial Sequence: Synthetic polypeptide
DAEEIASTNPVATEQWGGSSAATNDQSDGNN

SEQ ID NO: 100178 - protein, 34 aa, Artificial Sequence
  Description of Artificial Sequence: Synthetic polypeptide
DEMEIRTTNPVATEQYGCVTTTNDDLQQEGEEDK

SEQ ID NO: 100179 - protein, 31 aa, Artificial Sequence
  Description of Artificial Sequence: Synthetic polypeptide
DAEEIASTNPVATEQYGSVSWNEGEDNGKQE

SEQ ID NO: 100180 - protein, 33 aa, Artificial Sequence
  Description of Artificial Sequence: Synthetic polypeptide
SESEIRTTNPVATECWGSVSRINEPQDREGENG

SEQ ID NO: 100181 - protein, 33 aa, Artificial Sequence
  Description of Artificial Sequence: Synthetic polypeptide
MEEEISTTNPVATEQYGCVSVTELQEGFGSDQM

SEQ ID NO: 100182 - protein, 36 aa, Artificial Sequence
  Description of Artificial Sequence: Synthetic polypeptide
AEEEIRTTNPVATEQYGSVSTQAGNNQQGNNQNNDD

SEQ ID NO: 100183 - protein, 35 aa, Artificial Sequence
  Description of Artificial Sequence: Synthetic polypeptide
AEEEIRTTNPVATEQYGVVSTVNQQQNDEGENNND

SEQ ID NO: 100184 - protein, 33 aa, Artificial Sequence
  Description of Artificial Sequence: Synthetic polypeptide
DEHEIRTTNPVAYDQWGSTVPNCTQLQRTGGND

SEQ ID NO: 100185 - protein, 33 aa, Artificial Sequence
  Description of Artificial Sequence: Synthetic polypeptide
DEMEIRTTNPVATEQYGCVSYLLYQFNGLQDDQ

SEQ ID NO: 100186 - protein, 36 aa, Artificial Sequence
  Description of Artificial Sequence: Synthetic polypeptide
AEEEIRTTNPVATEQYGVVVVVSTTNNLQNGNNVAE

SEQ ID NO: 100187 - protein, 33 aa, Artificial Sequence
  Description of Artificial Sequence: Synthetic polypeptide
DEMEIRTTNPVATEQYGSLSTNGVEGFESGQHV

SEQ ID NO: 100188 - protein, 34 aa, Artificial Sequence
  Description of Artificial Sequence: Synthetic polypeptide
DEMEIRTTNPVATEQYGSCSTMTNILQEEASDEE

SEQ ID NO: 100189 - protein, 36 aa, Artificial Sequence
  Description of Artificial Sequence: Synthetic polypeptide
AEEEIRTTNPVATEQYGVVSTVNQLQNGNQEGNETE

SEQ ID NO: 100190 - protein, 35 aa, Artificial Sequence
  Description of Artificial Sequence: Synthetic polypeptide
AEEEIRTTNPVATEQYGSVSTQAGQEQGIGNVTNA

SEQ ID NO: 100191 - protein, 35 aa, Artificial Sequence
  Description of Artificial Sequence: Synthetic polypeptide
AEEEIRTTNPVATEQYGSVSTQNNGNQIGTTTGEQ

SEQ ID NO: 100192 - protein, 36 aa, Artificial Sequence
  Description of Artificial Sequence: Synthetic polypeptide
AEEEIRTTNPVATEQYGVVSTVANLNNAQEQGTNVE

SEQ ID NO: 100193 - protein, 34 aa, Artificial Sequence
  Description of Artificial Sequence: Synthetic polypeptide
MEEEISTTNPVATEQYGSVSINGLFLVREGEGGT

SEQ ID NO: 100194 - protein, 33 aa, Artificial Sequence
  Description of Artificial Sequence: Synthetic polypeptide
SEEEIRTTNPVAYEQWGSVSWGDDTQRGMNQIL

SEQ ID NO: 100195 - protein, 32 aa, Artificial Sequence
  Description of Artificial Sequence: Synthetic polypeptide
DEMEIRTTNPVATEQYGSSSWYTFESIENNEI

SEQ ID NO: 100196 - protein, 34 aa, Artificial Sequence
  Description of Artificial Sequence: Synthetic polypeptide
DEMEIRTTNPVATEQYGCVSWTWNHMEENDQDGN

SEQ ID NO: 100197 - protein, 36 aa, Artificial Sequence
  Description of Artificial Sequence: Synthetic polypeptide
AEEEIRTTNPVATEQYGSVSTNNQSGNTQQGTNTNN

SEQ ID NO: 100198 - protein, 34 aa, Artificial Sequence
  Description of Artificial Sequence: Synthetic polypeptide
HEGEIRTTNPVATEQYGSVSTLFDLQDFANQNFY

SEQ ID NO: 100199 - protein, 34 aa, Artificial Sequence
  Description of Artificial Sequence: Synthetic polypeptide
DEMEIRTTNPVATEQYGSVCSATPGPVEFEGNPD

SEQ ID NO: 100200 - protein, 36 aa, Artificial Sequence
  Description of Artificial Sequence: Synthetic polypeptide
AEEEIRTTNPVATEQYGSVSTNQNNQNQEQGTNSTE

SEQ ID NO: 100201 - protein, 33 aa, Artificial Sequence
  Description of Artificial Sequence: Synthetic polypeptide
DEMEIRTTNPVATEQYGSLSDVNQQAETFENVN

SEQ ID NO: 100202 - protein, 33 aa, Artificial Sequence
  Description of Artificial Sequence: Synthetic polypeptide
DEVEIATTNPVATCQYGCVCSTTALQNFGSNQS

SEQ ID NO: 100203 - protein, 29 aa, Artificial Sequence
  Description of Artificial Sequence: Synthetic peptide
HENEIATTNPVATECYGEVSSEELQHEEL

SEQ ID NO: 100204 - protein, 32 aa, Artificial Sequence
  Description of Artificial Sequence: Synthetic polypeptide
DEHEIRTTNPVAYDQWGSVAPTWQDDDQRGND

SEQ ID NO: 100205 - protein, 33 aa, Artificial Sequence
  Description of Artificial Sequence: Synthetic polypeptide
SESEIRTTNPVATECWGSVSCINEPQDREGENG

SEQ ID NO: 100206 - protein, 35 aa, Artificial Sequence
  Description of Artificial Sequence: Synthetic polypeptide
AEEEIRTTNPVATEQYGVVSTTVNSNQQGNGNNQE

SEQ ID NO: 100207 - protein, 29 aa, Artificial Sequence
  Description of Artificial Sequence: Synthetic peptide
DETEIRTVNPIATEQWGATADDLQPKGNQ

SEQ ID NO: 100208 - protein, 33 aa, Artificial Sequence
  Description of Artificial Sequence: Synthetic polypeptide
DETEIVTTNPVATEQYGTVVSATDGNVEFEGND

SEQ ID NO: 100209 - protein, 34 aa, Artificial Sequence
  Description of Artificial Sequence: Synthetic polypeptide
MEEEIRTTNPVATEQYGVVSTGGQSDINGGGNEG

SEQ ID NO: 100210 - protein, 37 aa, Artificial Sequence
  Description of Artificial Sequence: Synthetic polypeptide
AEEEIRTTNPVATEQYGSVSTNTANLQNNEQGNNNVE

SEQ ID NO: 100211 - protein, 33 aa, Artificial Sequence
  Description of Artificial Sequence: Synthetic polypeptide
DEMEIRTTNPVATEQYGDVCSATDGPVMAEGND

SEQ ID NO: 100212 - protein, 33 aa, Artificial Sequence
  Description of Artificial Sequence: Synthetic polypeptide
SEEEIRTTNPVAYEQYGSCNCTNLATPGGNNAE

SEQ ID NO: 100213 - protein, 34 aa, Artificial Sequence
  Description of Artificial Sequence: Synthetic polypeptide
DEMEIRTTNPVATEQYGSSSCTNGTQTAGSKQFE

SEQ ID NO: 100214 - protein, 33 aa, Artificial Sequence
  Description of Artificial Sequence: Synthetic polypeptide
DETEIRTTNPVAYEQWGSVSTTSQGPDQNGNAP

SEQ ID NO: 100215 - protein, 29 aa, Artificial Sequence
  Description of Artificial Sequence: Synthetic peptide
AENEIRTTNPVATEQWGDVSEIEQNAEGA

SEQ ID NO: 100216 - protein, 31 aa, Artificial Sequence
  Description of Artificial Sequence: Synthetic polypeptide
DAAEIATTNPVAYMQYGSVSTNGVMNGGNHN

SEQ ID NO: 100217 - protein, 36 aa, Artificial Sequence
  Description of Artificial Sequence: Synthetic polypeptide
AEEEIRTTNPVATEQYGSVSTNNQQLGDEQGTNQST

SEQ ID NO: 100218 - protein, 33 aa, Artificial Sequence
  Description of Artificial Sequence: Synthetic polypeptide
DEMEIRTTNPVATEQYGSVCSLLLEEFSQNEKT

SEQ ID NO: 100219 - protein, 36 aa, Artificial Sequence
  Description of Artificial Sequence: Synthetic polypeptide
AEEEIRTTNPVATEQYGVVSTVNTNLQSGTVDNGTT

SEQ ID NO: 100220 - protein, 33 aa, Artificial Sequence
  Description of Artificial Sequence: Synthetic polypeptide
DEHEIRTTNPVAYECWGSVATNLNQGDTGGNKS

SEQ ID NO: 100221 - protein, 32 aa, Artificial Sequence
  Description of Artificial Sequence: Synthetic polypeptide
DEHEIRTTNPVAYEAWGEVSTNMNRGEGQNGS

SEQ ID NO: 100222 - protein, 32 aa, Artificial Sequence
  Description of Artificial Sequence: Synthetic polypeptide
HEQEIATTNPVATEQYGSVSATDLEDHEGMDL

SEQ ID NO: 100223 - protein, 35 aa, Artificial Sequence
  Description of Artificial Sequence: Synthetic polypeptide
AEEEIRTTNPVATEQYGVVVVVSTTNLQQGTEGSV

SEQ ID NO: 100224 - protein, 31 aa, Artificial Sequence
  Description of Artificial Sequence: Synthetic polypeptide
DEHEIRTTNPVAYEAWGCVSTNLNGDVNDTS

SEQ ID NO: 100225 - protein, 33 aa, Artificial Sequence
  Description of Artificial Sequence: Synthetic polypeptide
DEMEIRTTNPVATEQYGDVCSATDGPVMFEGND

SEQ ID NO: 100226 - protein, 36 aa, Artificial Sequence
  Description of Artificial Sequence: Synthetic polypeptide
AEEEIRTTNPVATEQYGVVSTVSNLNQQGNTEAGNE

SEQ ID NO: 100227 - protein, 36 aa, Artificial Sequence
  Description of Artificial Sequence: Synthetic polypeptide
AEEEIRTTNPVATEQYGVVSTVNLNQQGETEENDTG

SEQ ID NO: 100228 - protein, 34 aa, Artificial Sequence
  Description of Artificial Sequence: Synthetic polypeptide
AEEEIRTTNPVATESYGSVSNTNLNLEQGTDQST

SEQ ID NO: 100229 - protein, 32 aa, Artificial Sequence
  Description of Artificial Sequence: Synthetic polypeptide
DEMEIRTTNPVATEQYGSVCMDHLNRFESSQS

SEQ ID NO: 100230 - protein, 36 aa, Artificial Sequence
  Description of Artificial Sequence: Synthetic polypeptide
AEEEIRTTNPVATEQYGSVSTQNYGNQIGTTTTNEQ

SEQ ID NO: 100231 - protein, 34 aa, Artificial Sequence
  Description of Artificial Sequence: Synthetic polypeptide
DETEIRTTNPVAYESWGSVSGDNLNGDRQGDNGR

SEQ ID NO: 100232 - protein, 32 aa, Artificial Sequence
  Description of Artificial Sequence: Synthetic polypeptide
DEHEIRTTNPVAYDQWGSVCTWEDQERHGDND

SEQ ID NO: 100233 - protein, 35 aa, Artificial Sequence
  Description of Artificial Sequence: Synthetic polypeptide
AEEEIRTTNPVATEQYGVVSTVNLLQQQNQEGTTE

SEQ ID NO: 100234 - protein, 36 aa, Artificial Sequence
  Description of Artificial Sequence: Synthetic polypeptide
AEEEIRTTNPVATEQYGVVSTTVNLQNQEQGNQQGE

SEQ ID NO: 100235 - protein, 32 aa, Artificial Sequence
  Description of Artificial Sequence: Synthetic polypeptide
DEHEIRTTNPVAYEAYGSTSQNISFPVGNNRA

SEQ ID NO: 100236 - protein, 32 aa, Artificial Sequence
  Description of Artificial Sequence: Synthetic polypeptide
DAEEIACTNPVAYEQYGSVAATNLQNPGTDQQ

SEQ ID NO: 100237 - protein, 30 aa, Artificial Sequence
  Description of Artificial Sequence: Synthetic polypeptide
DETEIRTTNPVAYSQYGTVCSTHALRAAIN

SEQ ID NO: 100238 - protein, 33 aa, Artificial Sequence
  Description of Artificial Sequence: Synthetic polypeptide
DEHEIRTTNPVATSCWGSVSCINEPQDREGENG

SEQ ID NO: 100239 - protein, 36 aa, Artificial Sequence
  Description of Artificial Sequence: Synthetic polypeptide
MEEEIRTTNPVATEQYGSVSTTDNGLGLEINGGNEQ

SEQ ID NO: 100240 - protein, 33 aa, Artificial Sequence
  Description of Artificial Sequence: Synthetic polypeptide
HESEIRTTNPVATECWGSVSCINEPQDREGENG

SEQ ID NO: 100241 - protein, 34 aa, Artificial Sequence
  Description of Artificial Sequence: Synthetic polypeptide
AEEEIRTTNPVATEQYGVVVVVSTTNLQQTDEGV

SEQ ID NO: 100242 - protein, 34 aa, Artificial Sequence
  Description of Artificial Sequence: Synthetic polypeptide
MEEEISTTNPVATEQYGCVCSVTGELQGGSNTQM

SEQ ID NO: 100243 - protein, 36 aa, Artificial Sequence
  Description of Artificial Sequence: Synthetic polypeptide
AEEEIRTTNPVATEQYGSVSTNTNNQNQEEGNNNTD

SEQ ID NO: 100244 - protein, 32 aa, Artificial Sequence
  Description of Artificial Sequence: Synthetic polypeptide
DEMEIRTTNPVATEQYGSCSDVNQQAETFDVN

SEQ ID NO: 100245 - protein, 33 aa, Artificial Sequence
  Description of Artificial Sequence: Synthetic polypeptide
DEMEIRTTNPVATEQYGDVCSATDGPVEFEGND

SEQ ID NO: 100246 - protein, 32 aa, Artificial Sequence
  Description of Artificial Sequence: Synthetic polypeptide
DEMEIRTTNPVATEQYGSVASMDLNAIESSQS

SEQ ID NO: 100247 - protein, 31 aa, Artificial Sequence
  Description of Artificial Sequence: Synthetic polypeptide
DEMEIRTTNPVATEQYGDVCSEIEMNAAENA

SEQ ID NO: 100248 - protein, 34 aa, Artificial Sequence
  Description of Artificial Sequence: Synthetic polypeptide
SEEEIRTTNPVAYEQWGSVVCNTIQREGLGNTDR

SEQ ID NO: 100249 - protein, 32 aa, Artificial Sequence
  Description of Artificial Sequence: Synthetic polypeptide
DETEIRTTNPVAYEQWGTVSWNEHDNRGGGNA

SEQ ID NO: 100250 - protein, 36 aa, Artificial Sequence
  Description of Artificial Sequence: Synthetic polypeptide
AEEEIRTTNPVATEQYGSVSTNNQQGNTQQGTNENQ

SEQ ID NO: 100251 - protein, 32 aa, Artificial Sequence
  Description of Artificial Sequence: Synthetic polypeptide
DEHEIRTTNPVAYEAWGVVATNLGQGDAGNKS

SEQ ID NO: 100252 - protein, 33 aa, Artificial Sequence
  Description of Artificial Sequence: Synthetic polypeptide
SESEIRSTNPVAYEQYGSVFTNELVQHTGGNNQ

SEQ ID NO: 100253 - protein, 33 aa, Artificial Sequence
  Description of Artificial Sequence: Synthetic polypeptide
SEEEIRTTNPVAYEQYGCCNCTNLDQPPGGNNA

SEQ ID NO: 100254 - protein, 30 aa, Artificial Sequence
  Description of Artificial Sequence: Synthetic polypeptide
HENEIATTNPVATECYGDVASECNLQHEEL

SEQ ID NO: 100255 - protein, 35 aa, Artificial Sequence
  Description of Artificial Sequence: Synthetic polypeptide
AEEEIRTTNPVATEQYGVVSTVNNNQQNQEGTNPN

SEQ ID NO: 100256 - protein, 33 aa, Artificial Sequence
  Description of Artificial Sequence: Synthetic polypeptide
DETEIRTTNPVAYEQWGVVCSTNLIDDDHQGNA

SEQ ID NO: 100257 - protein, 33 aa, Artificial Sequence
  Description of Artificial Sequence: Synthetic polypeptide
DEHEIRTTNPVAYEAWGSVATNLNRGEGQNGGS

SEQ ID NO: 100258 - protein, 36 aa, Artificial Sequence
  Description of Artificial Sequence: Synthetic polypeptide
AEEEIRTTNPVATEQYGVVSTVANLNNQDEQGNNVD

SEQ ID NO: 100259 - protein, 34 aa, Artificial Sequence
  Description of Artificial Sequence: Synthetic polypeptide
DAGEIATTNPVATEQYGSVSWTEHDLQDTGGGMR

SEQ ID NO: 100260 - protein, 32 aa, Artificial Sequence
  Description of Artificial Sequence: Synthetic polypeptide
SEEEIRTTNPVAYESWGSVFSNENDHERGDQR

SEQ ID NO: 100261 - protein, 36 aa, Artificial Sequence
  Description of Artificial Sequence: Synthetic polypeptide
AEEEIRTTNPVATEQYGSVSTNLNLENAETGTNTET

SEQ ID NO: 100262 - protein, 33 aa, Artificial Sequence
  Description of Artificial Sequence: Synthetic polypeptide
DEMEIATTNPVATEQYGSMVSATDLEDHEGEYL

SEQ ID NO: 100263 - protein, 37 aa, Artificial Sequence
  Description of Artificial Sequence: Synthetic polypeptide
AEEEIRTTNPVATEQYGSVSTNLNLQNQDEQGTNPVE

SEQ ID NO: 100264 - protein, 32 aa, Artificial Sequence
  Description of Artificial Sequence: Synthetic polypeptide
DETSICTTNPCATEQWGTVSTNNNLQSGTNGN

SEQ ID NO: 100265 - protein, 33 aa, Artificial Sequence
  Description of Artificial Sequence: Synthetic polypeptide
DEMEIATTNPVATEQYGSVCSATDGPVEHEGND

SEQ ID NO: 100266 - protein, 33 aa, Artificial Sequence
  Description of Artificial Sequence: Synthetic polypeptide
DEMEIATTNPVATEQYGSVCSATDGPVEHEGNL

SEQ ID NO: 100267 - protein, 33 aa, Artificial Sequence
  Description of Artificial Sequence: Synthetic polypeptide
DEMEIATTNPVATEQYGSVCSATDLEDHEGEDL

SEQ ID NO: 100268 - protein, 32 aa, Artificial Sequence
  Description of Artificial Sequence: Synthetic polypeptide
DEHEIRTTNPVAYEQYGTVATSNGGQNGQTGE

SEQ ID NO: 100269 - protein, 37 aa, Artificial Sequence
  Description of Artificial Sequence: Synthetic polypeptide
AEEEIRTTNPVATEQYGSVSTNLNLQNSNDEQGNNVE

SEQ ID NO: 100270 - protein, 35 aa, Artificial Sequence
  Description of Artificial Sequence: Synthetic polypeptide
DAEEIATTNPVATEQYGSVCATNPLQEHGDENQHQ

SEQ ID NO: 100271 - protein, 36 aa, Artificial Sequence
  Description of Artificial Sequence: Synthetic polypeptide
AEEEIRTTNPVATEQYGSVSTNLNLQQQNETGTETL

SEQ ID NO: 100272 - protein, 28 aa, Artificial Sequence
  Description of Artificial Sequence: Synthetic peptide
LEEEIATTNPVATEQYGEAPEVCQHEEK

SEQ ID NO: 100273 - protein, 32 aa, Artificial Sequence
  Description of Artificial Sequence: Synthetic polypeptide
DEMEIATTNPVATEQYGSVSATDGPVEFEGED

SEQ ID NO: 100274 - protein, 32 aa, Artificial Sequence
  Description of Artificial Sequence: Synthetic polypeptide
DEMEIATTNPVATEQYGSVSATDGPVEHEGED

SEQ ID NO: 100275 - protein, 33 aa, Artificial Sequence
  Description of Artificial Sequence: Synthetic polypeptide
DEMEIATTNPVATEQYGEVCSATDGPVQREGGD

SEQ ID NO: 100276 - protein, 36 aa, Artificial Sequence
  Description of Artificial Sequence: Synthetic polypeptide
AEEEIRTTNPVATEQYGSVSTNLNNENNETGTNVEM

SEQ ID NO: 100277 - protein, 32 aa, Artificial Sequence
  Description of Artificial Sequence: Synthetic polypeptide
SEGEINTTNPVAYERYGTVSCEALSQRVGNRP

SEQ ID NO: 100278 - protein, 33 aa, Artificial Sequence
  Description of Artificial Sequence: Synthetic polypeptide
DEMEIATTNPVATEQYGSVSATDLVEDHEGEDL

SEQ ID NO: 100279 - protein, 33 aa, Artificial Sequence
  Description of Artificial Sequence: Synthetic polypeptide
DEMEIATTNPVATEQYGSVSATGLVEDFEGEDD

SEQ ID NO: 100280 - protein, 32 aa, Artificial Sequence
  Description of Artificial Sequence: Synthetic polypeptide
SEGEINTTNPVAYERYGSVSCEALSQRVGNES

SEQ ID NO: 100281 - protein, 33 aa, Artificial Sequence
  Description of Artificial Sequence: Synthetic polypeptide
SEGEINTTNPVAYERYGSVCSCEALSQRVGNRD

SEQ ID NO: 100282 - protein, 33 aa, Artificial Sequence
  Description of Artificial Sequence: Synthetic polypeptide
SEGEINTTNPVAYEHYGSVSCEAMLSQRVGNRD

SEQ ID NO: 100283 - protein, 32 aa, Artificial Sequence
  Description of Artificial Sequence: Synthetic polypeptide
SEGEIGTTNPVAYERYGSVSCEALSQRVGVRD

SEQ ID NO: 100284 - protein, 28 aa, Artificial Sequence
  Description of Artificial Sequence: Synthetic peptide
LANEIATTNPVATECYGDVSECLQHEEL

SEQ ID NO: 100285 - protein, 32 aa, Artificial Sequence
  Description of Artificial Sequence: Synthetic polypeptide
SEGEIATTNPVAYERYGSVSCEALSQRVGNVD

SEQ ID NO: 100286 - protein, 34 aa, Artificial Sequence
  Description of Artificial Sequence: Synthetic polypeptide
DEMEIATTNPVATEQYGSVSNTDLNEEHFGSENL

SEQ ID NO: 100287 - protein, 33 aa, Artificial Sequence
  Description of Artificial Sequence: Synthetic polypeptide
DEMEIATTNPVATEQYGSVSNTEHNEDHEGEDL

SEQ ID NO: 100288 - protein, 33 aa, Artificial Sequence
  Description of Artificial Sequence: Synthetic polypeptide
DETTICTTNPVATECYGSVNTNNMGQRGGENMQ

SEQ ID NO: 100289 - protein, 29 aa, Artificial Sequence
  Description of Artificial Sequence: Synthetic peptide
SENEIRTTNPVATEQWGDVSEIEMAAEDR

SEQ ID NO: 100290 - protein, 32 aa, Artificial Sequence
  Description of Artificial Sequence: Synthetic polypeptide
DEMEIATTNPVATEQYGSVSNWDLEEHEGETL

SEQ ID NO: 100291 - protein, 32 aa, Artificial Sequence
  Description of Artificial Sequence: Synthetic polypeptide
DAEEIATTNPVAYEQYGSVVATHLQNPGTDAQ

SEQ ID NO: 100292 - protein, 30 aa, Artificial Sequence
  Description of Artificial Sequence: Synthetic polypeptide
SENEIRTTNPVATEQWGDVSEIEMNAAGNA

SEQ ID NO: 100293 - protein, 28 aa, Artificial Sequence
  Description of Artificial Sequence: Synthetic peptide
LEEEIATTNPVATEQYGEATEVAQHEEK

SEQ ID NO: 100294 - protein, 35 aa, Artificial Sequence
  Description of Artificial Sequence: Synthetic polypeptide
AEEEIRTTNPVATEQYGVVSVTNNDQAGNGTNGNG

SEQ ID NO: 100295 - protein, 37 aa, Artificial Sequence
  Description of Artificial Sequence: Synthetic polypeptide
AEEEIRTTNPVATEQYGSVSTNLEQLGNTQQGTNTNV

SEQ ID NO: 100296 - protein, 32 aa, Artificial Sequence
  Description of Artificial Sequence: Synthetic polypeptide
SELEIRCTNPCATEQYGSVCSPENLHDGGNQD

SEQ ID NO: 100297 - protein, 31 aa, Artificial Sequence
  Description of Artificial Sequence: Synthetic polypeptide
SELEIRCTNPCATEQYGHVCSPENLHRGHQD

SEQ ID NO: 100298 - protein, 35 aa, Artificial Sequence
  Description of Artificial Sequence: Synthetic polypeptide
AEEEIRTTNPVATEQYGVVSVTNNNDQQGNGNNDE

SEQ ID NO: 100299 - protein, 32 aa, Artificial Sequence
  Description of Artificial Sequence: Synthetic polypeptide
DEMEIATTNPCSTEQYGIVCSATDGLESEGNR

SEQ ID NO: 100300 - protein, 34 aa, Artificial Sequence
  Description of Artificial Sequence: Synthetic polypeptide
LEEEIRTTNPVATEQYGSVYPWGDLQEGNMEEQD

SEQ ID NO: 100301 - protein, 30 aa, Artificial Sequence
  Description of Artificial Sequence: Synthetic polypeptide
SENEIRTTNPIATEQWGSVSENEMNRAEDA

SEQ ID NO: 100302 - protein, 30 aa, Artificial Sequence
  Description of Artificial Sequence: Synthetic polypeptide
DEHEIRTTNPVAYERWGNVTTNPGDGDNEA

SEQ ID NO: 100303 - protein, 33 aa, Artificial Sequence
  Description of Artificial Sequence: Synthetic polypeptide
AEEEIRTTNPVATEQYGVVVVNTNDESGVNNTT

SEQ ID NO: 100304 - protein, 32 aa, Artificial Sequence
  Description of Artificial Sequence: Synthetic polypeptide
SEGQIRTTNPVAYERYGSVSCEALSQMVGNRD

SEQ ID NO: 100305 - protein, 32 aa, Artificial Sequence
  Description of Artificial Sequence: Synthetic polypeptide
DEMEIATTNPVATCQYGCVCSTAHQHFGSNQG

SEQ ID NO: 100306 - protein, 30 aa, Artificial Sequence
  Description of Artificial Sequence: Synthetic polypeptide
DEHEIRTTNPVAYERWGETVTTNPDGDNER

SEQ ID NO: 100307 - protein, 33 aa, Artificial Sequence
  Description of Artificial Sequence: Synthetic polypeptide
SEGGEIRTTNPVAYERYGSVSCEALSQRVGNGD

SEQ ID NO: 100308 - protein, 32 aa, Artificial Sequence
  Description of Artificial Sequence: Synthetic polypeptide
SEGEIRTTNPVAYERYGSVSCEATSQRVGKRD

SEQ ID NO: 100309 - protein, 28 aa, Artificial Sequence
  Description of Artificial Sequence: Synthetic peptide
DEMEIATTNPVATEQYGEAPEVPEHGEK

SEQ ID NO: 100310 - protein, 33 aa, Artificial Sequence
  Description of Artificial Sequence: Synthetic polypeptide
SEGEIRTTNPVAYERYGSVSCEALSQTPVGNRD

SEQ ID NO: 100311 - protein, 34 aa, Artificial Sequence
  Description of Artificial Sequence: Synthetic polypeptide
SEGEIRTTNPVAYERYGQSVSCEAPLSQRVGNRD

SEQ ID NO: 100312 - protein, 34 aa, Artificial Sequence
  Description of Artificial Sequence: Synthetic polypeptide
SEGEIRTTNPVAYERYGISVSCEALSQRVGNERD

SEQ ID NO: 100313 - protein, 32 aa, Artificial Sequence
  Description of Artificial Sequence: Synthetic polypeptide
DEMEIATTNPVATECYGTVCSATDCLVEFGNL

SEQ ID NO: 100314 - protein, 33 aa, Artificial Sequence
  Description of Artificial Sequence: Synthetic polypeptide
DEHEIRTTNPVAYEQYGTVVSGDNDGNRQGEGR

SEQ ID NO: 100315 - protein, 32 aa, Artificial Sequence
  Description of Artificial Sequence: Synthetic polypeptide
SEGEIRTTNPVAYERYGAVSCEALSQRVGNKD

SEQ ID NO: 100316 - protein, 32 aa, Artificial Sequence
  Description of Artificial Sequence: Synthetic polypeptide
SEGEIRTTNPVAYERWGSVSCEDLSQRVGNMD

SEQ ID NO: 100317 - protein, 33 aa, Artificial Sequence
  Description of Artificial Sequence: Synthetic polypeptide
SEGEIRTTNPVAYERWGSVSCEALSQRIVGNRD

SEQ ID NO: 100318 - protein, 30 aa, Artificial Sequence
  Description of Artificial Sequence: Synthetic polypeptide
DEMEIATTNPVATECYGTVSTDCPEFEGEL

SEQ ID NO: 100319 - protein, 32 aa, Artificial Sequence
  Description of Artificial Sequence: Synthetic polypeptide
SEGEIRTTNPIAYERYGSVSCAALSQRVGNMD

SEQ ID NO: 100320 - protein, 33 aa, Artificial Sequence
  Description of Artificial Sequence: Synthetic polypeptide
DEMEIATTNPVATEQYGCVYVWENGIQHTGNMR

SEQ ID NO: 100321 - protein, 31 aa, Artificial Sequence
  Description of Artificial Sequence: Synthetic polypeptide
DEMEIATTNPVATEQYGDVCSTGLVEFEEEL

SEQ ID NO: 100322 - protein, 37 aa, Artificial Sequence
  Description of Artificial Sequence: Synthetic polypeptide
AEEEIRTTNPVATEQYGSVSTNLNGGNQGETGNNNTD

SEQ ID NO: 100323 - protein, 28 aa, Artificial Sequence
  Description of Artificial Sequence: Synthetic peptide
DEMEIATTNPVATEQYGEAPEVCEHGEK

SEQ ID NO: 100324 - protein, 30 aa, Artificial Sequence
  Description of Artificial Sequence: Synthetic polypeptide
AENEIGCTNPVATEQYGEMSEVLLQRGDGQ

SEQ ID NO: 100325 - protein, 33 aa, Artificial Sequence
  Description of Artificial Sequence: Synthetic polypeptide
SEGEIRTTNPVAYERYGSVHSCEALSQRVGNDD

SEQ ID NO: 100326 - protein, 32 aa, Artificial Sequence
  Description of Artificial Sequence: Synthetic polypeptide
SEGEIATTNPVATESYGSVAGTNNLARDPDQR

SEQ ID NO: 100327 - protein, 33 aa, Artificial Sequence
  Description of Artificial Sequence: Synthetic polypeptide
DEMEIATTNPVATEQYGSVSTTDLNEEHFGEDL

SEQ ID NO: 100328 - protein, 31 aa, Artificial Sequence
  Description of Artificial Sequence: Synthetic polypeptide
DAEEIATTNPVAYEQYGVVAASNLADNNNGR

SEQ ID NO: 100329 - protein, 34 aa, Artificial Sequence
  Description of Artificial Sequence: Synthetic polypeptide
DEHEIRTTNPVAYEQWGTVCSTNDLHEQDGGNAQ

SEQ ID NO: 100330 - protein, 31 aa, Artificial Sequence
  Description of Artificial Sequence: Synthetic polypeptide
MEEEIRCTNPAATEQYGSVVSEGGMGGGNGG

SEQ ID NO: 100331 - protein, 32 aa, Artificial Sequence
  Description of Artificial Sequence: Synthetic polypeptide
DEMEIATTNPVATEQYGTVCSATTPVEFEGNI

SEQ ID NO: 100332 - protein, 33 aa, Artificial Sequence
  Description of Artificial Sequence: Synthetic polypeptide
DETTIRGTNPVATEQYGSVSIDNTGQGGGQNDT

SEQ ID NO: 100333 - protein, 29 aa, Artificial Sequence
  Description of Artificial Sequence: Synthetic peptide
SEGEIAPTNPCSSEQYGIVSCNLQSGTTR

SEQ ID NO: 100334 - protein, 32 aa, Artificial Sequence
  Description of Artificial Sequence: Synthetic polypeptide
DETSICTTNPCATEQWGSVSTNNNTQSGTNPG

SEQ ID NO: 100335 - protein, 31 aa, Artificial Sequence
  Description of Artificial Sequence: Synthetic polypeptide
SENEIRTTNPVATEQYGTISEEDIQQQNGNH

SEQ ID NO: 100336 - protein, 31 aa, Artificial Sequence
  Description of Artificial Sequence: Synthetic polypeptide
DEMEIATTNPVATEQYGTVCSDDGPESEGND

SEQ ID NO: 100337 - protein, 32 aa, Artificial Sequence
  Description of Artificial Sequence: Synthetic polypeptide
DEMEIATTNPVATEQYGTVCSTDGLVEFEENL

SEQ ID NO: 100338 - protein, 28 aa, Artificial Sequence
  Description of Artificial Sequence: Synthetic peptide
SEGEIAPTNPCSSEQYGIVSCALQSGTR

SEQ ID NO: 100339 - protein, 33 aa, Artificial Sequence
  Description of Artificial Sequence: Synthetic polypeptide
DEHEIRTTNPVAYEQWGSVVTGNGNMGEGNGRS

SEQ ID NO: 100340 - protein, 31 aa, Artificial Sequence
  Description of Artificial Sequence: Synthetic polypeptide
SENEIRTTNPVATEQYGTISMEDIQQQNGNH

SEQ ID NO: 100341 - protein, 32 aa, Artificial Sequence
  Description of Artificial Sequence: Synthetic polypeptide
DEMEIATTNPVATEQYGTVCSTDGPVEFEGND

SEQ ID NO: 100342 - protein, 35 aa, Artificial Sequence
  Description of Artificial Sequence: Synthetic polypeptide
SENEIRTTNPVATEQYGVSVCSTTDDLQCRNGGPH

SEQ ID NO: 100343 - protein, 33 aa, Artificial Sequence
  Description of Artificial Sequence: Synthetic polypeptide
KEEEIRTTNPVATEQWGQKYVFELNAGQGMGNR

SEQ ID NO: 100344 - protein, 29 aa, Artificial Sequence
  Description of Artificial Sequence: Synthetic peptide
SENEIRTTNPVSTEPYGTISEDIMQNGNH

SEQ ID NO: 100345 - protein, 32 aa, Artificial Sequence
  Description of Artificial Sequence: Synthetic polypeptide
DEHEIRTTNPVAYEQWGSVTGGNMGGQEGGAR

SEQ ID NO: 100346 - protein, 31 aa, Artificial Sequence
  Description of Artificial Sequence: Synthetic polypeptide
DEMEIATTNPVATEQYGTVCSTGLVEFEEEL

SEQ ID NO: 100347 - protein, 33 aa, Artificial Sequence
  Description of Artificial Sequence: Synthetic polypeptide
DEHEIRTTNPVAYEQWGSVTGGDNLQGDGGNGP

SEQ ID NO: 100348 - protein, 37 aa, Artificial Sequence
  Description of Artificial Sequence: Synthetic polypeptide
AEEEIRTTNPVATEQYGSVSTNLNNQNQDETGTNVED

SEQ ID NO: 100349 - protein, 34 aa, Artificial Sequence
  Description of Artificial Sequence: Synthetic polypeptide
DEHEIRTTNPVAYEQWGSVSTTNNLPGEHQNNMR

SEQ ID NO: 100350 - protein, 33 aa, Artificial Sequence
  Description of Artificial Sequence: Synthetic polypeptide
DETSICTTNPCATEQWGSVSTNNNNLQSGTNDG

SEQ ID NO: 100351 - protein, 34 aa, Artificial Sequence
  Description of Artificial Sequence: Synthetic polypeptide
AEEEIRTTNPVATEQYGVVVVTTNNLNNTAGNND

SEQ ID NO: 100352 - protein, 33 aa, Artificial Sequence
  Description of Artificial Sequence: Synthetic polypeptide
DEHEIRTTNPVAYEQWGSVSTTNAGNQNDHNME

SEQ ID NO: 100353 - protein, 33 aa, Artificial Sequence
  Description of Artificial Sequence: Synthetic polypeptide
DETSICTTNPCATEQWGSVSTNNNNLQSGNEGD

SEQ ID NO: 100354 - protein, 33 aa, Artificial Sequence
  Description of Artificial Sequence: Synthetic polypeptide
DEHEIRTTNPVAYEQWGSVSTTGPQGNMGTNGH

SEQ ID NO: 100355 - protein, 33 aa, Artificial Sequence
  Description of Artificial Sequence: Synthetic polypeptide
DEHEIRTTNPVAYEQWGSVSTTGPQGLMGNDSQ

SEQ ID NO: 100356 - protein, 33 aa, Artificial Sequence
  Description of Artificial Sequence: Synthetic polypeptide
DEHEIRTTNPVAYEQWGSVSTTGPQGLMGGNTP

SEQ ID NO: 100357 - protein, 33 aa, Artificial Sequence
  Description of Artificial Sequence: Synthetic polypeptide
DEHEIRTTNPVAYEQWGSVSTQGEPQGNMGNGH

SEQ ID NO: 100358 - protein, 31 aa, Artificial Sequence
  Description of Artificial Sequence: Synthetic polypeptide
DEMEIATTNPVATEQYGTVSATDCPEFEGEL

SEQ ID NO: 100359 - protein, 36 aa, Artificial Sequence
  Description of Artificial Sequence: Synthetic polypeptide
AEEEIRTTNPVATEQYGSVSTNLNNLQQGTSTTTEE

SEQ ID NO: 100360 - protein, 32 aa, Artificial Sequence
  Description of Artificial Sequence: Synthetic polypeptide
DEHEIRTTNPVAYEQWGVSTTTGGNMGEGNER

SEQ ID NO: 100361 - protein, 35 aa, Artificial Sequence
  Description of Artificial Sequence: Synthetic polypeptide
AEEEIRTTNPVATEQYGVVVVTSTNNNQQQGENGS

SEQ ID NO: 100362 - protein, 32 aa, Artificial Sequence
  Description of Artificial Sequence: Synthetic polypeptide
DEMEIATTNPVATEQYGTVCSATDPVEFEGND

SEQ ID NO: 100363 - protein, 33 aa, Artificial Sequence
  Description of Artificial Sequence: Synthetic polypeptide
KESEIRTTNPVATECWGSVSCINEPQDREGENG

SEQ ID NO: 100364 - protein, 30 aa, Artificial Sequence
  Description of Artificial Sequence: Synthetic polypeptide
DAEEIATTNPVAYMQYGSVSTEGVMNSNHN

SEQ ID NO: 100365 - protein, 31 aa, Artificial Sequence
  Description of Artificial Sequence: Synthetic polypeptide
SENEIRTTNPVATEQYGCVSWVLGEDFNNEE

SEQ ID NO: 100366 - protein, 32 aa, Artificial Sequence
  Description of Artificial Sequence: Synthetic polypeptide
KEQEIATTNPVATEQYGSVSATDLEDHEGEDL

SEQ ID NO: 100367 - protein, 32 aa, Artificial Sequence
  Description of Artificial Sequence: Synthetic polypeptide
DEMEIATTNPVATEQYGSVSYTDHEDHEGEDL

SEQ ID NO: 100368 - protein, 33 aa, Artificial Sequence
  Description of Artificial Sequence: Synthetic polypeptide
DEMEIATTNPVATEQYGSVTSTTDLEDHEGETL

SEQ ID NO: 100369 - protein, 36 aa, Artificial Sequence
  Description of Artificial Sequence: Synthetic polypeptide
AEEEIRTTNPVATEQYGSVSTGNNNQNQNDEGTNNN

SEQ ID NO: 100370 - protein, 33 aa, Artificial Sequence
  Description of Artificial Sequence: Synthetic polypeptide
DEMEIATTNPVATEQYGTVCSATDAQVEFQGND

SEQ ID NO: 100371 - protein, 34 aa, Artificial Sequence
  Description of Artificial Sequence: Synthetic polypeptide
AEEEIRTTNPVATEQYGVVSVTATNLQQLQEIQE

SEQ ID NO: 100372 - protein, 33 aa, Artificial Sequence
  Description of Artificial Sequence: Synthetic polypeptide
DEMEIATTNPVATEQYGTVCSATDCPVQFEGNL

SEQ ID NO: 100373 - protein, 33 aa, Artificial Sequence
  Description of Artificial Sequence: Synthetic polypeptide
DEMEIATTNPVATEQYGTVCSATDDLEDHEGND

SEQ ID NO: 100374 - protein, 33 aa, Artificial Sequence
  Description of Artificial Sequence: Synthetic polypeptide
SENEIRTTNPVATEQYGSVSANDQIEGSDEEHS

SEQ ID NO: 100375 - protein, 33 aa, Artificial Sequence
  Description of Artificial Sequence: Synthetic polypeptide
DEMEIATTNPVATEQYGTVCSATDGEVEQEGND

SEQ ID NO: 100376 - protein, 34 aa, Artificial Sequence
  Description of Artificial Sequence: Synthetic polypeptide
AEEEIRTTNPVATEQYGVVSTVVTATNLTQDEIQ

SEQ ID NO: 100377 - protein, 33 aa, Artificial Sequence
  Description of Artificial Sequence: Synthetic polypeptide
DEMEIATTNPVATEQYGTVCSATDGLVEFEGND

SEQ ID NO: 100378 - protein, 33 aa, Artificial Sequence
  Description of Artificial Sequence: Synthetic polypeptide
DEMEIATTNPVATEQYGTVCSATDGNVEFEGND

SEQ ID NO: 100379 - protein, 32 aa, Artificial Sequence
  Description of Artificial Sequence: Synthetic polypeptide
DEMEIATTNPVATEQYGTVCSATDGPEFEGND

SEQ ID NO: 100380 - protein, 31 aa, Artificial Sequence
  Description of Artificial Sequence: Synthetic polypeptide
DAEEIATTNPVAYMQYGSVSTGVGVMNGNHN

SEQ ID NO: 100381 - protein, 32 aa, Artificial Sequence
  Description of Artificial Sequence: Synthetic polypeptide
SENEIRTTNPVATEQYGSVSWVLGEDFNNEDA

SEQ ID NO: 100382 - protein, 34 aa, Artificial Sequence
  Description of Artificial Sequence: Synthetic polypeptide
MEEEIRATNPVATEQYGSVSGGNGGQGNNDGNGG

SEQ ID NO: 100383 - protein, 33 aa, Artificial Sequence
  Description of Artificial Sequence: Synthetic polypeptide
DEMEIATTNPVATEQYGTVCSATDNPVEFEGND

SEQ ID NO: 100384 - protein, 32 aa, Artificial Sequence
  Description of Artificial Sequence: Synthetic polypeptide
DEMEIATTNPVATEQYGTVCSATDLVEFEGEL

SEQ ID NO: 100385 - protein, 37 aa, Artificial Sequence
  Description of Artificial Sequence: Synthetic polypeptide
AEEEIRTTNPVATEQYGSVSTNLNNENQGETGTNNTQ

SEQ ID NO: 100386 - protein, 36 aa, Artificial Sequence
  Description of Artificial Sequence: Synthetic polypeptide
AEEEIRTTNPVATEQYGVVSVTNNNLQQGENQNDEQ

SEQ ID NO: 100387 - protein, 32 aa, Artificial Sequence
  Description of Artificial Sequence: Synthetic polypeptide
DEMEIATTNPVATEQYGTVCSATDLEDHEGEL

SEQ ID NO: 100388 - protein, 33 aa, Artificial Sequence
  Description of Artificial Sequence: Synthetic polypeptide
DEMEIATTNPVATEQYGTVCSATDGQVEFEGND

SEQ ID NO: 100389 - protein, 33 aa, Artificial Sequence
  Description of Artificial Sequence: Synthetic polypeptide
DEMEIATTNPVATEQYGTVCSATDGPVQFEGNL

SEQ ID NO: 100390 - protein, 33 aa, Artificial Sequence
  Description of Artificial Sequence: Synthetic polypeptide
DEMEIATTNPVATEQYGTVCSATDGPVQFEGND

SEQ ID NO: 100391 - protein, 35 aa, Artificial Sequence
  Description of Artificial Sequence: Synthetic polypeptide
AEEEIRTTNPVATEQYGSVSTENYGNQIGTTTTEQ

SEQ ID NO: 100392 - protein, 32 aa, Artificial Sequence
  Description of Artificial Sequence: Synthetic polypeptide
DEMEIATTNPVATEQYGTVCSATDGPVESGND

SEQ ID NO: 100393 - protein, 33 aa, Artificial Sequence
  Description of Artificial Sequence: Synthetic polypeptide
DEMEIATTNPVATEQYGTVCSATDGPQEPEGND

SEQ ID NO: 100394 - protein, 32 aa, Artificial Sequence
  Description of Artificial Sequence: Synthetic polypeptide
DEMEIATTNPVATEQYGTVCSATDLEDHEGED

SEQ ID NO: 100395 - protein, 28 aa, Artificial Sequence
  Description of Artificial Sequence: Synthetic peptide
KEEEIATTNPVATEQYGEAPLVCQQEEK

SEQ ID NO: 100396 - protein, 28 aa, Artificial Sequence
  Description of Artificial Sequence: Synthetic peptide
SEMEIACTNPCSYEQYGVVSCNLQSGTQ

SEQ ID NO: 100397 - protein, 29 aa, Artificial Sequence
  Description of Artificial Sequence: Synthetic peptide
SEMEIACTNPCSYEQYGVVSWNLQSGSTR

SEQ ID NO: 100398 - protein, 32 aa, Artificial Sequence
  Description of Artificial Sequence: Synthetic polypeptide
DAEEIATTNPVAYEQYGSVAATNLQNPQTDMD

SEQ ID NO: 100399 - protein, 32 aa, Artificial Sequence
  Description of Artificial Sequence: Synthetic polypeptide
DEHHIRTTNPVATEGWGSGVYAVNNLQLGVER

SEQ ID NO: 100400 - protein, 37 aa, Artificial Sequence
  Description of Artificial Sequence: Synthetic polypeptide
AEEEIRTTNPVATEQYGSVSTNANLQQGNQEQGNNNE

SEQ ID NO: 100401 - protein, 36 aa, Artificial Sequence
  Description of Artificial Sequence: Synthetic polypeptide
AEEEIRTTNPVATEQYGSVSTNANQQGTETGTNVAE

SEQ ID NO: 100402 - protein, 33 aa, Artificial Sequence
  Description of Artificial Sequence: Synthetic polypeptide
DEHENSTTNPVAYEQWGSVSTNLNQGDAGQNDA

SEQ ID NO: 100403 - protein, 32 aa, Artificial Sequence
  Description of Artificial Sequence: Synthetic polypeptide
DEKEIATTNPVATEQYGSASATDLEDHEGEDL

SEQ ID NO: 100404 - protein, 33 aa, Artificial Sequence
  Description of Artificial Sequence: Synthetic polypeptide
DEKEIATTNPVATEQYGSVSATDELEDHEGEDL

SEQ ID NO: 100405 - protein, 37 aa, Artificial Sequence
  Description of Artificial Sequence: Synthetic polypeptide
AEEEIRTTNPVATEQYGSVSTNANLQNNSEQGNNEGE

SEQ ID NO: 100406 - protein, 34 aa, Artificial Sequence
  Description of Artificial Sequence: Synthetic polypeptide
AEEEIRTTNPVATEQYGVVSVVTATNLTQDEQIQ

SEQ ID NO: 100407 - protein, 36 aa, Artificial Sequence
  Description of Artificial Sequence: Synthetic polypeptide
AEEEIRTTNPVATEQYGSVSTNANQQNQEQGNNTVE

SEQ ID NO: 100408 - protein, 33 aa, Artificial Sequence
  Description of Artificial Sequence: Synthetic polypeptide
DEKEIATTNPVATEQYGSVVSATDLEDHEGEDL

SEQ ID NO: 100409 - protein, 32 aa, Artificial Sequence
  Description of Artificial Sequence: Synthetic polypeptide
DEKEIATVNPVATEQYGSVSATDLEDHEGEDL

SEQ ID NO: 100410 - protein, 33 aa, Artificial Sequence
  Description of Artificial Sequence: Synthetic polypeptide
MEAETRTTNPVATEQYGSVSTGDGDQRIGGEGD

SEQ ID NO: 100411 - protein, 33 aa, Artificial Sequence
  Description of Artificial Sequence: Synthetic polypeptide
DEKEIRTTNPVATECWGSVSCINEPEDREGENG

SEQ ID NO: 100412 - protein, 37 aa, Artificial Sequence
  Description of Artificial Sequence: Synthetic polypeptide
AEEEIRTTNPVATEQYGSVSTNANLQNQNEQGNNNNE

SEQ ID NO: 100413 - protein, 33 aa, Artificial Sequence
  Description of Artificial Sequence: Synthetic polypeptide
LNDEIRTTNPVATEQYGVVRSTPLNEPFGSNLR

SEQ ID NO: 100414 - protein, 34 aa, Artificial Sequence
  Description of Artificial Sequence: Synthetic polypeptide
LNDEIRTTNPVATEQYGVVGSTNSLNEVFGPNLR

SEQ ID NO: 100415 - protein, 33 aa, Artificial Sequence
  Description of Artificial Sequence: Synthetic polypeptide
DEKEIRTTNPVATECWGSVSCINEPQDREGELG

SEQ ID NO: 100416 - protein, 28 aa, Artificial Sequence
  Description of Artificial Sequence: Synthetic peptide
MEEEIATTNPVATEQYGEAPEVCQHEEK

SEQ ID NO: 100417 - protein, 29 aa, Artificial Sequence
  Description of Artificial Sequence: Synthetic peptide
MEEEIATTNPVATEQYGEVAPEVCQHEEK

SEQ ID NO: 100418 - protein, 33 aa, Artificial Sequence
  Description of Artificial Sequence: Synthetic polypeptide
DEHEISTTNPVAYEQWGSVSTTNTQGNMGGDGR

SEQ ID NO: 100419 - protein, 30 aa, Artificial Sequence
  Description of Artificial Sequence: Synthetic polypeptide
SENEIRCTNPIATEQWGSVSEIEMNAAGNR

SEQ ID NO: 100420 - protein, 33 aa, Artificial Sequence
  Description of Artificial Sequence: Synthetic polypeptide
LESEIRTTNPVATECWGSVSCINEPQDREGENG

SEQ ID NO: 100421 - protein, 33 aa, Artificial Sequence
  Description of Artificial Sequence: Synthetic polypeptide
DEHEISTTNPVAYEHWGSVSTGPLGDHQGGNQR

SEQ ID NO: 100422 - protein, 37 aa, Artificial Sequence
  Description of Artificial Sequence: Synthetic polypeptide
AEEEIRTTNPVATEQYGSVSTNANLQNNQGEQGTNVE

SEQ ID NO: 100423 - protein, 33 aa, Artificial Sequence
  Description of Artificial Sequence: Synthetic polypeptide
LESEIRTTNPVATECWGSVSCINEMQDREGENG

SEQ ID NO: 100424 - protein, 37 aa, Artificial Sequence
  Description of Artificial Sequence: Synthetic polypeptide
AEEEIRTTNPVATEQYGSVSTNANLQNNDEQGTNNVE

SEQ ID NO: 100425 - protein, 37 aa, Artificial Sequence
  Description of Artificial Sequence: Synthetic polypeptide
AEEEIRTTNPVATEQYGSVSTNANLQNGSEQGNNNVE

SEQ ID NO: 100426 - protein, 32 aa, Artificial Sequence
  Description of Artificial Sequence: Synthetic polypeptide
LEQEIATTNPVATEQYGSVSATDLEDHEGEDL

SEQ ID NO: 100427 - protein, 35 aa, Artificial Sequence
  Description of Artificial Sequence: Synthetic polypeptide
AEEEIRTTNPVATEQYGVVVTTVNNLQAGTTENSE

SEQ ID NO: 100428 - protein, 33 aa, Artificial Sequence
  Description of Artificial Sequence: Synthetic polypeptide
DEKEIRTTNPVATECWGSVSCINEPQDCEGENG

SEQ ID NO: 100429 - protein, 32 aa, Artificial Sequence
  Description of Artificial Sequence: Synthetic polypeptide
DELEIATTNPVATEQYGSVGATDLEDHEGEDL

SEQ ID NO: 100430 - protein, 31 aa, Artificial Sequence
  Description of Artificial Sequence: Synthetic polypeptide
MEEEIATTNPVATEQYGCVAGTMGLEHDDNP

SEQ ID NO: 100431 - protein, 32 aa, Artificial Sequence
  Description of Artificial Sequence: Synthetic polypeptide
DEHVIATTNPVAYEQWGTVSKTDDLDQRGDAR

SEQ ID NO: 100432 - protein, 33 aa, Artificial Sequence
  Description of Artificial Sequence: Synthetic polypeptide
DEIEIRTTNAVATECWGSVSCINEPQDREGENG

SEQ ID NO: 100433 - protein, 34 aa, Artificial Sequence
  Description of Artificial Sequence: Synthetic polypeptide
DEIEIRTTNPVATECWGSSVSCINEPQDREGENG

SEQ ID NO: 100434 - protein, 33 aa, Artificial Sequence
  Description of Artificial Sequence: Synthetic polypeptide
DEIEIRTTNPVATECWGSVSCINEPCDREGENG

SEQ ID NO: 100435 - protein, 31 aa, Artificial Sequence
  Description of Artificial Sequence: Synthetic polypeptide
DEIEICTVNPVATEQYGSVSDDQAFQVENEE

SEQ ID NO: 100436 - protein, 33 aa, Artificial Sequence
  Description of Artificial Sequence: Synthetic polypeptide
DEIEIRTTNPVATECWGSVSCINEPQDREGECG

SEQ ID NO: 100437 - protein, 29 aa, Artificial Sequence
  Description of Artificial Sequence: Synthetic peptide
SENEIATTNPVATECYGDVHSECLQHEEL

SEQ ID NO: 100438 - protein, 33 aa, Artificial Sequence
  Description of Artificial Sequence: Synthetic polypeptide
DEIEIRTTNPVATECWGSVSCINEPQDVEGENG

SEQ ID NO: 100439 - protein, 33 aa, Artificial Sequence
  Description of Artificial Sequence: Synthetic polypeptide
DEIEIRTTNPVATECWGSVSPIVEPQERVGENG

SEQ ID NO: 100440 - protein, 32 aa, Artificial Sequence
  Description of Artificial Sequence: Synthetic polypeptide
DAEEIATTNPVAYEQYGSVAAANDQRNPNTES

SEQ ID NO: 100441 - protein, 33 aa, Artificial Sequence
  Description of Artificial Sequence: Synthetic polypeptide
DEIEICTTNPVATEQYGDVVSATDGQGEFEGND

SEQ ID NO: 100442 - protein, 33 aa, Artificial Sequence
  Description of Artificial Sequence: Synthetic polypeptide
DEIEIRTTNPVATEGWGSVSPINEPQERVGEPG

SEQ ID NO: 100443 - protein, 35 aa, Artificial Sequence
  Description of Artificial Sequence: Synthetic polypeptide
DEIEIRTTNPVATEQYGSVSSTPAGPNKRNGMNPN

SEQ ID NO: 100444 - protein, 35 aa, Artificial Sequence
  Description of Artificial Sequence: Synthetic polypeptide
DEIEIRTTNPVATEQYGSVSSTTPAGPNRNGMNPV

SEQ ID NO: 100445 - protein, 32 aa, Artificial Sequence
  Description of Artificial Sequence: Synthetic polypeptide
DEIEIATTNPVATLQYGMVSTRACPDPGFNRD

SEQ ID NO: 100446 - protein, 33 aa, Artificial Sequence
  Description of Artificial Sequence: Synthetic polypeptide
DEHTIRTTNPVATECWGSVSCINEPQDREGENG

SEQ ID NO: 100447 - protein, 29 aa, Artificial Sequence
  Description of Artificial Sequence: Synthetic peptide
SENEIATTNPVATECYGCVSWPLQHISEL

SEQ ID NO: 100448 - protein, 29 aa, Artificial Sequence
  Description of Artificial Sequence: Synthetic peptide
SENEIATTNPVATEYYGCVSWELQHFEEL

SEQ ID NO: 100449 - protein, 34 aa, Artificial Sequence
  Description of Artificial Sequence: Synthetic polypeptide
DEIEIRTTNPVATEVWGSVSPINEPQDRVGENGE

SEQ ID NO: 100450 - protein, 33 aa, Artificial Sequence
  Description of Artificial Sequence: Synthetic polypeptide
DEIEIATTNPVATEQYGESVSATDLEDHEGEDL

SEQ ID NO: 100451 - protein, 31 aa, Artificial Sequence
  Description of Artificial Sequence: Synthetic polypeptide
DEIAIRTTNPVATECYGKHSTWNELQPNSEF

SEQ ID NO: 100452 - protein, 33 aa, Artificial Sequence
  Description of Artificial Sequence: Synthetic polypeptide
DEIAEIRTTNPVAYEAWGTVSTNLNRGEGQNGS

SEQ ID NO: 100453 - protein, 33 aa, Artificial Sequence
  Description of Artificial Sequence: Synthetic polypeptide
DEIADEISTTNPVAYEQWGTVSTNLQGDAGNDA

SEQ ID NO: 100454 - protein, 33 aa, Artificial Sequence
  Description of Artificial Sequence: Synthetic polypeptide
DAEEIATTNPVAYEQYGSVAAPNLQNETGTDRQ

SEQ ID NO: 100455 - protein, 31 aa, Artificial Sequence
  Description of Artificial Sequence: Synthetic polypeptide
DEHVISTTNPVAYEQWGTVSKTDDGQRGDAR

SEQ ID NO: 100456 - protein, 31 aa, Artificial Sequence
  Description of Artificial Sequence: Synthetic polypeptide
DEIEISTVNPVATEQYGSVSDDQAFQGVNEE

SEQ ID NO: 100457 - protein, 33 aa, Artificial Sequence
  Description of Artificial Sequence: Synthetic polypeptide
DEINEIATTNPVAYEQWGSVCSTNDQGEGNNNE

SEQ ID NO: 100458 - protein, 33 aa, Artificial Sequence
  Description of Artificial Sequence: Synthetic polypeptide
MEEEIATTNPVATEQYGCVAGTALQNNNSEGRP

SEQ ID NO: 100459 - protein, 37 aa, Artificial Sequence
  Description of Artificial Sequence: Synthetic polypeptide
AEEEIRTTNPVATEQYGSVSTNANLQNNTEQGNNTVE

SEQ ID NO: 100460 - protein, 33 aa, Artificial Sequence
  Description of Artificial Sequence: Synthetic polypeptide
DAEEIATTNPVAYEQYGSVAATNLQNPPGTDHQ

SEQ ID NO: 100461 - protein, 33 aa, Artificial Sequence
  Description of Artificial Sequence: Synthetic polypeptide
DEHVIATTNPVAYEQWGTVSKTNDDLQRRGDAR

SEQ ID NO: 100462 - protein, 34 aa, Artificial Sequence
  Description of Artificial Sequence: Synthetic polypeptide
DEIEIRTTNPVATETWGSVQSPINEPQERVGENG

SEQ ID NO: 100463 - protein, 29 aa, Artificial Sequence
  Description of Artificial Sequence: Synthetic peptide
LENEIATTNPVATECYGHVSECLEQHPEL

SEQ ID NO: 100464 - protein, 30 aa, Artificial Sequence
  Description of Artificial Sequence: Synthetic polypeptide
SENEIRCTNPIATEQYGTISEENIMQNGNH

SEQ ID NO: 100465 - protein, 33 aa, Artificial Sequence
  Description of Artificial Sequence: Synthetic polypeptide
DELEIATTNPVATEQYGSVSATDLEDHEGEDLY

SEQ ID NO: 100466 - protein, 32 aa, Artificial Sequence
  Description of Artificial Sequence: Synthetic polypeptide
DAEEIATTNPVATEQYGSVCSAPPDNDSGGEN

SEQ ID NO: 100467 - protein, 32 aa, Artificial Sequence
  Description of Artificial Sequence: Synthetic polypeptide
DEMCIATTNPVATEQYGSVSMTDLEDHEGEDL

SEQ ID NO: 100468 - protein, 31 aa, Artificial Sequence
  Description of Artificial Sequence: Synthetic polypeptide
DEMCIGTTNPVATEQWGCVCSTDDLQYGSDQ

SEQ ID NO: 100469 - protein, 32 aa, Artificial Sequence
  Description of Artificial Sequence: Synthetic polypeptide
DEMCIGTTNPVATEQWGCVCSTDLLQYGSNQA

SEQ ID NO: 100470 - protein, 36 aa, Artificial Sequence
  Description of Artificial Sequence: Synthetic polypeptide
AEEEIRTTNPVATEQYGSVSTNGNQLGNEQGTNNNE

SEQ ID NO: 100471 - protein, 28 aa, Artificial Sequence
  Description of Artificial Sequence: Synthetic peptide
SENEIRCTNPVATEQWGDVSENEMAEDA

SEQ ID NO: 100472 - protein, 36 aa, Artificial Sequence
  Description of Artificial Sequence: Synthetic polypeptide
AEEEIRTTNPVATEQYGSVSTNGNQQGSETGTTNAD

SEQ ID NO: 100473 - protein, 31 aa, Artificial Sequence
  Description of Artificial Sequence: Synthetic polypeptide
DEMEIAPTNPCASEQYGTVCSCDNLVQFGTR

SEQ ID NO: 100474 - protein, 33 aa, Artificial Sequence
  Description of Artificial Sequence: Synthetic polypeptide
AENEIRCTNPVATEQYGSASSTPAGPQMRNGNV

SEQ ID NO: 100475 - protein, 36 aa, Artificial Sequence
  Description of Artificial Sequence: Synthetic polypeptide
AEEEIRTTNPVATEQYGSVSTNGQQQNNNIGTNQDD

SEQ ID NO: 100476 - protein, 31 aa, Artificial Sequence
  Description of Artificial Sequence: Synthetic polypeptide
DEMEIAPTNPVASEQYGTVCSTNLVEFEGTD

SEQ ID NO: 100477 - protein, 36 aa, Artificial Sequence
  Description of Artificial Sequence: Synthetic polypeptide
AEEEIRTTNPVATEQYGVVSVTTNLQQLQGIGNNNE

SEQ ID NO: 100478 - protein, 29 aa, Artificial Sequence
  Description of Artificial Sequence: Synthetic peptide
DEMEIASTNPVCTEQYGTVCSDGPESGNQ

SEQ ID NO: 100479 - protein, 32 aa, Artificial Sequence
  Description of Artificial Sequence: Synthetic polypeptide
DETSIRTTNPLAYEQFGSVSCFNGSQSVGNNR

SEQ ID NO: 100480 - protein, 34 aa, Artificial Sequence
  Description of Artificial Sequence: Synthetic polypeptide
DAEEIATTNPVATEQYGSVCSDGTGNEADGTDNH

SEQ ID NO: 100481 - protein, 35 aa, Artificial Sequence
  Description of Artificial Sequence: Synthetic polypeptide
AEEEIRTTNPVATEQYGVVSVTTNLQQLEGEEEET

SEQ ID NO: 100482 - protein, 31 aa, Artificial Sequence
  Description of Artificial Sequence: Synthetic polypeptide
DEHEIRTTNPVAYERYGVVTGNPNAGDTNER

SEQ ID NO: 100483 - protein, 31 aa, Artificial Sequence
  Description of Artificial Sequence: Synthetic polypeptide
DEHEIRTTNPVAYERYGVVTGNPDAGGDNER

SEQ ID NO: 100484 - protein, 37 aa, Artificial Sequence
  Description of Artificial Sequence: Synthetic polypeptide
AEEEIRTTNPVATEQYGSVSTNLEQLGNTQQGTEENQ

SEQ ID NO: 100485 - protein, 35 aa, Artificial Sequence
  Description of Artificial Sequence: Synthetic polypeptide
AEEEIRTTNPVATEQYGVVVTVTNNGNLQQGTNIS

SEQ ID NO: 100486 - protein, 32 aa, Artificial Sequence
  Description of Artificial Sequence: Synthetic polypeptide
SEMEIRCTNPIATEQYGSVCSAEGPVEREGNR

SEQ ID NO: 100487 - protein, 30 aa, Artificial Sequence
  Description of Artificial Sequence: Synthetic polypeptide
DEMEIASVNPVATEQYGTVSADDNPEFGNQ

SEQ ID NO: 100488 - protein, 33 aa, Artificial Sequence
  Description of Artificial Sequence: Synthetic polypeptide
DETSIRTTNPLAYEQWGSTVSGCNALSQSGGNR

SEQ ID NO: 100489 - protein, 31 aa, Artificial Sequence
  Description of Artificial Sequence: Synthetic polypeptide
DEMEIASVNPVATEQYGTVSATDNPEFEGND

SEQ ID NO: 100490 - protein, 31 aa, Artificial Sequence
  Description of Artificial Sequence: Synthetic polypeptide
DEMEIASVNPVATEQYGTVSATDNPEFEGNQ

SEQ ID NO: 100491 - protein, 33 aa, Artificial Sequence
  Description of Artificial Sequence: Synthetic polypeptide
AEEEIRTTNPVATEQYGVVSVTTATNTQDEQEQ

SEQ ID NO: 100492 - protein, 34 aa, Artificial Sequence
  Description of Artificial Sequence: Synthetic polypeptide
LEEEIRTTNPVAYMQYGSTVQACTHELSTRSGNR

SEQ ID NO: 100493 - protein, 31 aa, Artificial Sequence
  Description of Artificial Sequence: Synthetic polypeptide
SENEIRCTNPVSTEQYGTVSMEDLMQQNGNH

SEQ ID NO: 100494 - protein, 32 aa, Artificial Sequence
  Description of Artificial Sequence: Synthetic polypeptide
DETSIRTTNPLAYEQWGSVSFNMQSQSGGNNR

SEQ ID NO: 100495 - protein, 36 aa, Artificial Sequence
  Description of Artificial Sequence: Synthetic polypeptide
AEEEIRTTNPVATEQYGVVSVTNNQLQQGNNGTNSN

SEQ ID NO: 100496 - protein, 30 aa, Artificial Sequence
  Description of Artificial Sequence: Synthetic polypeptide
DEMEIASTNPVCTEQYGTVCSTDGPESGNQ

SEQ ID NO: 100497 - protein, 32 aa, Artificial Sequence
  Description of Artificial Sequence: Synthetic polypeptide
SEMEIRCTNPVATEQYGCVCETELQHFGSNQF

SEQ ID NO: 100498 - protein, 36 aa, Artificial Sequence
  Description of Artificial Sequence: Synthetic polypeptide
AEEEIRTTNPVATEQYGSVSTNGNQAGTEQGTNNSE

SEQ ID NO: 100499 - protein, 32 aa, Artificial Sequence
  Description of Artificial Sequence: Synthetic polypeptide
DEMAIRTTNPVATEQYGCFCSTGNDINFGSNQ

SEQ ID NO: 100500 - protein, 31 aa, Artificial Sequence
  Description of Artificial Sequence: Synthetic polypeptide
SEMEIVTTNPIATEQYGTVCSATDGLMFGND

SEQ ID NO: 100501 - protein, 34 aa, Artificial Sequence
  Description of Artificial Sequence: Synthetic polypeptide
DELEIATTNPVATEQYGSVSVTDLQEDYEGAVDE

SEQ ID NO: 100502 - protein, 34 aa, Artificial Sequence
  Description of Artificial Sequence: Synthetic polypeptide
DELEIATTNPVATEQYGSVSVTDLQEDYENDEDE

SEQ ID NO: 100503 - protein, 32 aa, Artificial Sequence
  Description of Artificial Sequence: Synthetic polypeptide
DEHEIRTTNPVAYQQYGCVATNDEHRPGGNEP

SEQ ID NO: 100504 - protein, 35 aa, Artificial Sequence
  Description of Artificial Sequence: Synthetic polypeptide
DELEIATTNPVATEQYGSVSVTDNLQEDYEGLEDE

SEQ ID NO: 100505 - protein, 33 aa, Artificial Sequence
  Description of Artificial Sequence: Synthetic polypeptide
DELEIATTNPVATEQYGSVSVTDSQEVYEGEDE

SEQ ID NO: 100506 - protein, 34 aa, Artificial Sequence
  Description of Artificial Sequence: Synthetic polypeptide
DELEIATTNPVATEQYGSVSVTGLQEDYEGEDEQ

SEQ ID NO: 100507 - protein, 31 aa, Artificial Sequence
  Description of Artificial Sequence: Synthetic polypeptide
DEHEIRTTNPVAYQQYGCVATNDEHHGGGNP

SEQ ID NO: 100508 - protein, 36 aa, Artificial Sequence
  Description of Artificial Sequence: Synthetic polypeptide
AEEEIRTTNPVATEQYGVVSVVSTTNLQQGTDEGTV

SEQ ID NO: 100509 - protein, 35 aa, Artificial Sequence
  Description of Artificial Sequence: Synthetic polypeptide
DELEIRTTNPVATEAYGSVSCTNMLSHRTSTNNVD

SEQ ID NO: 100510 - protein, 37 aa, Artificial Sequence
  Description of Artificial Sequence: Synthetic polypeptide
AEEEIRTTNPVATEQYGSVSTNGNLQNQSEQGTNNVE

SEQ ID NO: 100511 - protein, 33 aa, Artificial Sequence
  Description of Artificial Sequence: Synthetic polypeptide
DELEIRTTNPVATECWGSVLCINEPQDREGENG

SEQ ID NO: 100512 - protein, 33 aa, Artificial Sequence
  Description of Artificial Sequence: Synthetic polypeptide
DELEIRTTNPVATECWGSVSCINEPADREGENG

SEQ ID NO: 100513 - protein, 33 aa, Artificial Sequence
  Description of Artificial Sequence: Synthetic polypeptide
DELEIRTTNPVATECWGSVSCINEPQDHEGENG

SEQ ID NO: 100514 - protein, 35 aa, Artificial Sequence
  Description of Artificial Sequence: Synthetic polypeptide
SEMEIRTTNPVATEQYGSVSVTALWNEIREGVENI

SEQ ID NO: 100515 - protein, 34 aa, Artificial Sequence
  Description of Artificial Sequence: Synthetic polypeptide
DELEIRTTNPVATECWGSVSCINFEPQDREGENG

SEQ ID NO: 100516 - protein, 32 aa, Artificial Sequence
  Description of Artificial Sequence: Synthetic polypeptide
DEHEIRTTNPVAYESYGSVSQDNISFHVGNNS

SEQ ID NO: 100517 - protein, 31 aa, Artificial Sequence
  Description of Artificial Sequence: Synthetic polypeptide
DEMAIRTTNPVATEQYGCFCSSNHINGSNQA

SEQ ID NO: 100518 - protein, 30 aa, Artificial Sequence
  Description of Artificial Sequence: Synthetic polypeptide
SENEIRCTNPISTEQYGTVSMDLMQQNGNH

SEQ ID NO: 100519 - protein, 33 aa, Artificial Sequence
  Description of Artificial Sequence: Synthetic polypeptide
DELVIQTTNPVATEIYGSVSTNGLDDGGHGQIR

SEQ ID NO: 100520 - protein, 31 aa, Artificial Sequence
  Description of Artificial Sequence: Synthetic polypeptide
SEMEIRCTNPVATEQYGTVSEDNPVEFEGND

SEQ ID NO: 100521 - protein, 33 aa, Artificial Sequence
  Description of Artificial Sequence: Synthetic polypeptide
LEGEIRTTNPVATEQYGSVQTYADLIDRFENQD

SEQ ID NO: 100522 - protein, 32 aa, Artificial Sequence
  Description of Artificial Sequence: Synthetic polypeptide
SEMEIRTTNPVATEQYGCTSTVPNDRIQENNE

SEQ ID NO: 100523 - protein, 30 aa, Artificial Sequence
  Description of Artificial Sequence: Synthetic polypeptide
SENEIRTTNPIATEQWGDVSEILMNRAGDA

SEQ ID NO: 100524 - protein, 33 aa, Artificial Sequence
  Description of Artificial Sequence: Synthetic polypeptide
MEEEICTTNPVATEQYGNVSVTGGGQGDGGNEN

SEQ ID NO: 100525 - protein, 36 aa, Artificial Sequence
  Description of Artificial Sequence: Synthetic polypeptide
AEEEIRTTNPVATEQYGVVSVTVTTNLQQGSTNTQE

SEQ ID NO: 100526 - protein, 35 aa, Artificial Sequence
  Description of Artificial Sequence: Synthetic polypeptide
DELEIRTTNPVATEQWGEVSCTNMLSHRTSTNNRD

SEQ ID NO: 100527 - protein, 29 aa, Artificial Sequence
  Description of Artificial Sequence: Synthetic peptide
DELEIRTTNPVATEQWGDVSEIEMAAEDA

SEQ ID NO: 100528 - protein, 32 aa, Artificial Sequence
  Description of Artificial Sequence: Synthetic polypeptide
DEHEIRTTNPVAYESYGQSVSQNDSFPVGNNS

SEQ ID NO: 100529 - protein, 36 aa, Artificial Sequence
  Description of Artificial Sequence: Synthetic polypeptide
AEEEIRTTNPVATEQYGVVSVVSTTNLEQGTEQGQV

SEQ ID NO: 100530 - protein, 34 aa, Artificial Sequence
  Description of Artificial Sequence: Synthetic polypeptide
DELEIRTTNPVATECWGSVSCINSEPQDREGENG

SEQ ID NO: 100531 - protein, 34 aa, Artificial Sequence
  Description of Artificial Sequence: Synthetic polypeptide
SEMEIRTTNPVATEQYGCVSTANLEQDGSEEQYL

SEQ ID NO: 100532 - protein, 28 aa, Artificial Sequence
  Description of Artificial Sequence: Synthetic peptide
KEEEIATTNPVATEQYGEAPEVPQHEEK

SEQ ID NO: 100533 - protein, 28 aa, Artificial Sequence
  Description of Artificial Sequence: Synthetic peptide
KEEEIATTNPVATEQYGEAPEVCQHEEK

SEQ ID NO: 100534 - protein, 33 aa, Artificial Sequence
  Description of Artificial Sequence: Synthetic polypeptide
DEMEIATTNPVATEQYGTVSATDDLVEDFEGNL

SEQ ID NO: 100535 - protein, 31 aa, Artificial Sequence
  Description of Artificial Sequence: Synthetic polypeptide
DETSIATTNPTAYEQWGSVYSVENDQQSGNR

SEQ ID NO: 100536 - protein, 34 aa, Artificial Sequence
  Description of Artificial Sequence: Synthetic polypeptide
SEEEVRTTNPVATEQYGCVCSTENHNQNIGSNQA

SEQ ID NO: 100537 - protein, 33 aa, Artificial Sequence
  Description of Artificial Sequence: Synthetic polypeptide
SEEEVRTTNPVATEQYGCVCSTENHDQNIISNQ

SEQ ID NO: 100538 - protein, 33 aa, Artificial Sequence
  Description of Artificial Sequence: Synthetic polypeptide
DEHEIRTTNPVAYEQWGSVCSTDNNDRAGQGDL

SEQ ID NO: 100539 - protein, 34 aa, Artificial Sequence
  Description of Artificial Sequence: Synthetic polypeptide
DEMEIRTTNPVATEQYGCLSTLDLTQFNGLQDNE

SEQ ID NO: 100540 - protein, 34 aa, Artificial Sequence
  Description of Artificial Sequence: Synthetic polypeptide
SEEEVRTTNPVATEQYGCVCSTENHDQNIGSDNQ

SEQ ID NO: 100541 - protein, 36 aa, Artificial Sequence
  Description of Artificial Sequence: Synthetic polypeptide
DEHEIRTTNPVAYEQWGSVCSTDNGGDLGQQGNGRN

SEQ ID NO: 100542 - protein, 33 aa, Artificial Sequence
  Description of Artificial Sequence: Synthetic polypeptide
SEEEVRTTNPVATEQYGCVCSTEELDQNIGSEQ

SEQ ID NO: 100543 - protein, 31 aa, Artificial Sequence
  Description of Artificial Sequence: Synthetic polypeptide
DETSIATTNPTAYEQWGSVYSFENDQHQGNR

SEQ ID NO: 100544 - protein, 33 aa, Artificial Sequence
  Description of Artificial Sequence: Synthetic polypeptide
DEMEIRTTNPVATEQYGCTCSTNHQEHFGSDQA

SEQ ID NO: 100545 - protein, 37 aa, Artificial Sequence
  Description of Artificial Sequence: Synthetic polypeptide
AEEEIRTTNPVATEQYGSVSTNNNNLNQEQIGTEDNE

SEQ ID NO: 100546 - protein, 31 aa, Artificial Sequence
  Description of Artificial Sequence: Synthetic polypeptide
DETSIATTNPTAYEQWGSVYSFDNDQSGNAR

SEQ ID NO: 100547 - protein, 35 aa, Artificial Sequence
  Description of Artificial Sequence: Synthetic polypeptide
MEEEIRTTNPVATEQYGSVNCTLNDMLQPEIQNDI

SEQ ID NO: 100548 - protein, 36 aa, Artificial Sequence
  Description of Artificial Sequence: Synthetic polypeptide
MEEEIRTTNPVATEQYGSVNCTLNDMLQPNGQNDIN

SEQ ID NO: 100549 - protein, 35 aa, Artificial Sequence
  Description of Artificial Sequence: Synthetic polypeptide
IEEEIRTTNPVATEQYGSVCSPTGNLERNDDTQES

SEQ ID NO: 100550 - protein, 37 aa, Artificial Sequence
  Description of Artificial Sequence: Synthetic polypeptide
AEEEIRTTNPVATEQYGSVSTNNNNQELQEIGTNTQQ

SEQ ID NO: 100551 - protein, 36 aa, Artificial Sequence
  Description of Artificial Sequence: Synthetic polypeptide
AEEEIRTTNPVATEQYGSVSSVTTNNNQQIGNNTTE

SEQ ID NO: 100552 - protein, 35 aa, Artificial Sequence
  Description of Artificial Sequence: Synthetic polypeptide
AEEEIRTTNPVATEQYGSVSTNNNNQQDEEGTEAL

SEQ ID NO: 100553 - protein, 33 aa, Artificial Sequence
  Description of Artificial Sequence: Synthetic polypeptide
MEEEIRTTNPVATEQYGSVNFGENVANGGNGGI

SEQ ID NO: 100554 - protein, 33 aa, Artificial Sequence
  Description of Artificial Sequence: Synthetic polypeptide
MEEEIRTTNPVATEQYGSVNQGENVANGGGNIG

SEQ ID NO: 100555 - protein, 31 aa, Artificial Sequence
  Description of Artificial Sequence: Synthetic polypeptide
DEMEIRTTNPVATEQYGCVCQTGALINMSEQ

SEQ ID NO: 100556 - protein, 33 aa, Artificial Sequence
  Description of Artificial Sequence: Synthetic polypeptide
DEHEIRTTNPVAYEQWGSVCSGENDQHDTNDRS

SEQ ID NO: 100557 - protein, 34 aa, Artificial Sequence
  Description of Artificial Sequence: Synthetic polypeptide
DEHEIRTTNPVAYEQWGSVCHGDNQGQDRGNGDR

SEQ ID NO: 100558 - protein, 34 aa, Artificial Sequence
  Description of Artificial Sequence: Synthetic polypeptide
DEMEIRTTNPVATEQYGCVCSNTGELQNFGSEQG

SEQ ID NO: 100559 - protein, 36 aa, Artificial Sequence
  Description of Artificial Sequence: Synthetic polypeptide
AEEEIRTTNPVATEQYGSVSTNNNQENQETGTNAEQ

SEQ ID NO: 100560 - protein, 36 aa, Artificial Sequence
  Description of Artificial Sequence: Synthetic polypeptide
AEEEIRTTNPVATEQYGSVSTNNNQENSETGTNNSQ

SEQ ID NO: 100561 - protein, 33 aa, Artificial Sequence
  Description of Artificial Sequence: Synthetic polypeptide
DEMEIRTTNPVATEQYGCVCSTEDHQNFGSEQA

SEQ ID NO: 100562 - protein, 31 aa, Artificial Sequence
  Description of Artificial Sequence: Synthetic polypeptide
SEEEIVCTNPVATEQYGTVSAEDNPMFEGND

SEQ ID NO: 100563 - protein, 36 aa, Artificial Sequence
  Description of Artificial Sequence: Synthetic polypeptide
AEEEIRTTNPVATEQYGSVSTNNNQLGNEQGTNPST

SEQ ID NO: 100564 - protein, 34 aa, Artificial Sequence
  Description of Artificial Sequence: Synthetic polypeptide
MEEEIRTTNPVATEQYGSVSDDVTEGLGNGGQTI

SEQ ID NO: 100565 - protein, 33 aa, Artificial Sequence
  Description of Artificial Sequence: Synthetic polypeptide
DEHEIRTTNPVAYEQWGSVCSTDNGDTAGNGDL

SEQ ID NO: 100566 - protein, 32 aa, Artificial Sequence
  Description of Artificial Sequence: Synthetic polypeptide
SEEEIVCTNPIATEQYGTVCSEDGLVEREGNR

SEQ ID NO: 100567 - protein, 34 aa, Artificial Sequence
  Description of Artificial Sequence: Synthetic polypeptide
DEHEIRTTNPVAYEQWGSVCSTMNNDQHHQGNPD

SEQ ID NO: 100568 - protein, 34 aa, Artificial Sequence
  Description of Artificial Sequence: Synthetic polypeptide
SEEEVRTTNPVATEQYGCVCSTGNLNQNIGSDQQ

SEQ ID NO: 100569 - protein, 30 aa, Artificial Sequence
  Description of Artificial Sequence: Synthetic polypeptide
DEMEIRTTNPVATEQWGTVSEGEMNAAGDA

SEQ ID NO: 100570 - protein, 28 aa, Artificial Sequence
  Description of Artificial Sequence: Synthetic peptide
SESEIASTNPVGTEGYGVMASTLQRGDI

SEQ ID NO: 100571 - protein, 34 aa, Artificial Sequence
  Description of Artificial Sequence: Synthetic polypeptide
MEEEIRTTNPVATEQYGSVGDGNDGQENDDGNNE

SEQ ID NO: 100572 - protein, 34 aa, Artificial Sequence
  Description of Artificial Sequence: Synthetic polypeptide
MEEEIRTTNPVATEQYGSVGNNMDQSEGGGNEGN

SEQ ID NO: 100573 - protein, 33 aa, Artificial Sequence
  Description of Artificial Sequence: Synthetic polypeptide
DEHEIRTTNPVAYEQWGSVSHELDDRQNMNGNE

SEQ ID NO: 100574 - protein, 33 aa, Artificial Sequence
  Description of Artificial Sequence: Synthetic polypeptide
DEMEIRTTNPVATEQYGAVCSPEVQLGNENQQQ

SEQ ID NO: 100575 - protein, 32 aa, Artificial Sequence
  Description of Artificial Sequence: Synthetic polypeptide
DEMEIRTTNPVATEQYGCICSSETQRFGSDTQ

SEQ ID NO: 100576 - protein, 33 aa, Artificial Sequence
  Description of Artificial Sequence: Synthetic polypeptide
DEMEIRTTNPVATEQYGCICSTENTQGFGSDTQ

SEQ ID NO: 100577 - protein, 32 aa, Artificial Sequence
  Description of Artificial Sequence: Synthetic polypeptide
DEMEIRTTNPVATEQYGCICSTETQNFGSDAS

SEQ ID NO: 100578 - protein, 36 aa, Artificial Sequence
  Description of Artificial Sequence: Synthetic polypeptide
AEEEIRTTNPVATEQYGSVSTNNNDENQETGTNNSE

SEQ ID NO: 100579 - protein, 33 aa, Artificial Sequence
  Description of Artificial Sequence: Synthetic polypeptide
DEMEIRTTNPVATEQYGCICSTETQSFGSDNQS

SEQ ID NO: 100580 - protein, 33 aa, Artificial Sequence
  Description of Artificial Sequence: Synthetic polypeptide
DEMEIRTTNPVATEQYGCICSTMNTQNFGSDQF

SEQ ID NO: 100581 - protein, 28 aa, Artificial Sequence
  Description of Artificial Sequence: Synthetic peptide
SESEIASTNPVGTEGYGVMSSTLQHGDR

SEQ ID NO: 100582 - protein, 34 aa, Artificial Sequence
  Description of Artificial Sequence: Synthetic polypeptide
AEEEIRTTNPVATEQYGVVVVVSTTLQQGTEGED

SEQ ID NO: 100583 - protein, 33 aa, Artificial Sequence
  Description of Artificial Sequence: Synthetic polypeptide
DAEEIATTNPVATEQWGSVTSTNHGQTEGGTPD

SEQ ID NO: 100584 - protein, 34 aa, Artificial Sequence
  Description of Artificial Sequence: Synthetic polypeptide
MEEEIRTTNPVATEQYGSVGNTMDNSEGGGNEGT

SEQ ID NO: 100585 - protein, 35 aa, Artificial Sequence
  Description of Artificial Sequence: Synthetic polypeptide
AEEEIRTTNPVATEQYGSVSTNNNDENSETGNTTT

SEQ ID NO: 100586 - protein, 34 aa, Artificial Sequence
  Description of Artificial Sequence: Synthetic polypeptide
DEHEIRTTNPVAYEQWGSVCSTVLNDQGEEGNES

SEQ ID NO: 100587 - protein, 33 aa, Artificial Sequence
  Description of Artificial Sequence: Synthetic polypeptide
MEEEIRTTNPVATEQYGSVMGNNGQEEDGGEGN

SEQ ID NO: 100588 - protein, 33 aa, Artificial Sequence
  Description of Artificial Sequence: Synthetic polypeptide
DEHEIRTTNPVAYEQWGSVCSTPNGNDMGNNEV

SEQ ID NO: 100589 - protein, 36 aa, Artificial Sequence
  Description of Artificial Sequence: Synthetic polypeptide
AEEEIRTTNPVATEQYGSVSTNNNLLGTEQGTNESN

SEQ ID NO: 100590 - protein, 31 aa, Artificial Sequence
  Description of Artificial Sequence: Synthetic polypeptide
DETSIATTNPTAYEQWGSVYSWENDQSGNHR

SEQ ID NO: 100591 - protein, 34 aa, Artificial Sequence
  Description of Artificial Sequence: Synthetic polypeptide
SEEEVRTTNPVATEQYGSVCSTGELDQNIGSDQA

SEQ ID NO: 100592 - protein, 34 aa, Artificial Sequence
  Description of Artificial Sequence: Synthetic polypeptide
DEHEIRTTNPVAYEQWGSVCSTNVNDQGEEGNEH

SEQ ID NO: 100593 - protein, 34 aa, Artificial Sequence
  Description of Artificial Sequence: Synthetic polypeptide
DAEEIATTNPVATEQWGSVTSTNHLDQTAGDTDD

SEQ ID NO: 100594 - protein, 34 aa, Artificial Sequence
  Description of Artificial Sequence: Synthetic polypeptide
DEHEIRTTNPVAYEQWGSVCSTNQNDQGETGNGS

SEQ ID NO: 100595 - protein, 34 aa, Artificial Sequence
  Description of Artificial Sequence: Synthetic polypeptide
DEHEIRTTNPVAYEQWGSVCSTNGPEQGDGNDGK

SEQ ID NO: 100596 - protein, 34 aa, Artificial Sequence
  Description of Artificial Sequence: Synthetic polypeptide
DEHEIRTTNPVAYEQWGSVCSTNENDQGEEGNPS

SEQ ID NO: 100597 - protein, 35 aa, Artificial Sequence
  Description of Artificial Sequence: Synthetic polypeptide
IEEEIRTTNPVATEQYGSVCSTTGVLDTRNVEENA

SEQ ID NO: 100598 - protein, 34 aa, Artificial Sequence
  Description of Artificial Sequence: Synthetic polypeptide
AEEEIRTTNPVATEQYGSVSTAGNNNNQNDEQGE

SEQ ID NO: 100599 - protein, 29 aa, Artificial Sequence
  Description of Artificial Sequence: Synthetic peptide
DAEEIATTNPVATEQWGTNCSAAEMRSNS

SEQ ID NO: 100600 - protein, 37 aa, Artificial Sequence
  Description of Artificial Sequence: Synthetic polypeptide
AEEEIRTTNPVATEQYGSVSTNNNQLGNNQQGTELNE

SEQ ID NO: 100601 - protein, 35 aa, Artificial Sequence
  Description of Artificial Sequence: Synthetic polypeptide
AEEEIRTTNPVATEQYGVVSTVTNNNNNQDNGNVE

SEQ ID NO: 100602 - protein, 37 aa, Artificial Sequence
  Description of Artificial Sequence: Synthetic polypeptide
AEEEIRTTNPVATEQYGSVSTNNNQLGNTQQGTNTEN

SEQ ID NO: 100603 - protein, 34 aa, Artificial Sequence
  Description of Artificial Sequence: Synthetic polypeptide
DEMEIRTTNPVATEQYGCVSTLDLTQPNGLQDSE

SEQ ID NO: 100604 - protein, 36 aa, Artificial Sequence
  Description of Artificial Sequence: Synthetic polypeptide
AEEEIRTTNPVATEQYGSVSTNNNQQNQGEIGTENL

SEQ ID NO: 100605 - protein, 34 aa, Artificial Sequence
  Description of Artificial Sequence: Synthetic polypeptide
DEMEIRTTNPVATEQYGCVSTLLLQFNGLQDVDT

SEQ ID NO: 100606 - protein, 32 aa, Artificial Sequence
  Description of Artificial Sequence: Synthetic polypeptide
DEHEIRTTNPVAYEQWGMTSHTDNHQNNGTER

SEQ ID NO: 100607 - protein, 35 aa, Artificial Sequence
  Description of Artificial Sequence: Synthetic polypeptide
DEMEIRTTNPVATEQYGCVSTLLLTQFNGLQDGES

SEQ ID NO: 100608 - protein, 31 aa, Artificial Sequence
  Description of Artificial Sequence: Synthetic polypeptide
DEHEIRTTNPVAYEQWGMISHTDNHQGEGHE

SEQ ID NO: 100609 - protein, 34 aa, Artificial Sequence
  Description of Artificial Sequence: Synthetic polypeptide
DEMEIRTTNPVATEQYGCVSTLLTTQFNGLQDHE

SEQ ID NO: 100610 - protein, 33 aa, Artificial Sequence
  Description of Artificial Sequence: Synthetic polypeptide
DEMEIRTTNPVATEQYGCVSTLMVQFNGLQDDQ

SEQ ID NO: 100611 - protein, 31 aa, Artificial Sequence
  Description of Artificial Sequence: Synthetic polypeptide
IEECIRTTNPVATEQWGCWATNNLQLYDENQ

SEQ ID NO: 100612 - protein, 35 aa, Artificial Sequence
  Description of Artificial Sequence: Synthetic polypeptide
AEEEIRTTNPVATEQYGSVSTNNNQQNQQEGTEAL

SEQ ID NO: 100613 - protein, 33 aa, Artificial Sequence
  Description of Artificial Sequence: Synthetic polypeptide
DEMEIRTTNPVATEQYGCVSTLVDETIGPNESG

SEQ ID NO: 100614 - protein, 32 aa, Artificial Sequence
  Description of Artificial Sequence: Synthetic polypeptide
DAEEIATTNPVATEQWGCVTSAAGLDQAGGER

SEQ ID NO: 100615 - protein, 33 aa, Artificial Sequence
  Description of Artificial Sequence: Synthetic polypeptide
SEEEIRTVNPVATEQYGSVSPTLLTVSENAQDQ

SEQ ID NO: 100616 - protein, 33 aa, Artificial Sequence
  Description of Artificial Sequence: Synthetic polypeptide
DEHEIRTTNPVAYEQWGEVSTNLNGNDEGGNTQ

SEQ ID NO: 100617 - protein, 35 aa, Artificial Sequence
  Description of Artificial Sequence: Synthetic polypeptide
DEMEIRTTNPVATEQYGCVSTLDLTQFNGLQDAER

SEQ ID NO: 100618 - protein, 35 aa, Artificial Sequence
  Description of Artificial Sequence: Synthetic polypeptide
AEEEIRTTNPVATEQYGSVSTNNNQQNTESGTEAL

SEQ ID NO: 100619 - protein, 29 aa, Artificial Sequence
  Description of Artificial Sequence: Synthetic peptide
AENEICCTNPVATEQYGEAREVLQRGDGQ

SEQ ID NO: 100620 - protein, 32 aa, Artificial Sequence
  Description of Artificial Sequence: Synthetic polypeptide
DEHEIRTTNPVAYEQWGEVSHPLDDRQNMETR

SEQ ID NO: 100621 - protein, 35 aa, Artificial Sequence
  Description of Artificial Sequence: Synthetic polypeptide
AEEEIRTTNPVATEQYGSVSTNNNQQQNQNGDEAN

SEQ ID NO: 100622 - protein, 36 aa, Artificial Sequence
  Description of Artificial Sequence: Synthetic polypeptide
AEEEIRTTNPVATEQYGSVSTNNQENATETGTNNTE

SEQ ID NO: 100623 - protein, 34 aa, Artificial Sequence
  Description of Artificial Sequence: Synthetic polypeptide
SEEEIRTTNPVGTEQWGSVSTNELGERGGDQTAE

SEQ ID NO: 100624 - protein, 33 aa, Artificial Sequence
  Description of Artificial Sequence: Synthetic polypeptide
SEEEIRTTNPVGTEQWGSVSTDGLGGRGDPDAQ

SEQ ID NO: 100625 - protein, 33 aa, Artificial Sequence
  Description of Artificial Sequence: Synthetic polypeptide
SEEEIRTTNPVGTEQWGSVSTANEPGERGDIAQ

SEQ ID NO: 100626 - protein, 34 aa, Artificial Sequence
  Description of Artificial Sequence: Synthetic polypeptide
SEEEIRTTNPVGTEQWGSVSTANELGERGDQMAQ

SEQ ID NO: 100627 - protein, 34 aa, Artificial Sequence
  Description of Artificial Sequence: Synthetic polypeptide
DEMEIRTTNPVATEQYGCVSTPLLTQFNGLQDQE

SEQ ID NO: 100628 - protein, 33 aa, Artificial Sequence
  Description of Artificial Sequence: Synthetic polypeptide
SEEEIRTTNPVAYESYGSVSGSDHGQFRDGNMF

SEQ ID NO: 100629 - protein, 35 aa, Artificial Sequence
  Description of Artificial Sequence: Synthetic polypeptide
MEEEIRTTNPVATEQYGSVSPTENTEIRDLAGPYP

SEQ ID NO: 100630 - protein, 33 aa, Artificial Sequence
  Description of Artificial Sequence: Synthetic polypeptide
SEEEIRTTNPVAYESYGCVVPSCANLHRGGDQR

SEQ ID NO: 100631 - protein, 34 aa, Artificial Sequence
  Description of Artificial Sequence: Synthetic polypeptide
DEMEIRTTNPVATEQYGCVSTVATHMEENNQHGN

SEQ ID NO: 100632 - protein, 36 aa, Artificial Sequence
  Description of Artificial Sequence: Synthetic polypeptide
AEEEIRTTNPVATEQYGSVSSVTNLEQGVTTTNNNI

SEQ ID NO: 100633 - protein, 33 aa, Artificial Sequence
  Description of Artificial Sequence: Synthetic polypeptide
DEHEIRTTNPVAYEQWGEVSTNLNGEDHGNNEQ

SEQ ID NO: 100634 - protein, 35 aa, Artificial Sequence
  Description of Artificial Sequence: Synthetic polypeptide
AEEEIRTTNPVATEQYGSVSTNNNQQNQEIGTEAG

SEQ ID NO: 100635 - protein, 35 aa, Artificial Sequence
  Description of Artificial Sequence: Synthetic polypeptide
AEEEIRTTNPVATEQYGVVVVVSTTNLQAGEEEGV

SEQ ID NO: 100636 - protein, 34 aa, Artificial Sequence
  Description of Artificial Sequence: Synthetic polypeptide
DEMEIRTTNPVATEQYGCVSTIMEELRNSQNENF

SEQ ID NO: 100637 - protein, 34 aa, Artificial Sequence
  Description of Artificial Sequence: Synthetic polypeptide
MEEEIRTTNPVATEQYGSVSNGFGELDEGGNDGI

SEQ ID NO: 100638 - protein, 35 aa, Artificial Sequence
  Description of Artificial Sequence: Synthetic polypeptide
MEEEIRTTNPVATEQYGSVSNNNEMDQNEGENIPN

SEQ ID NO: 100639 - protein, 36 aa, Artificial Sequence
  Description of Artificial Sequence: Synthetic polypeptide
AEEEIRTTNPVATEQYGSVSTNNNQLGSETGTNQAN

SEQ ID NO: 100640 - protein, 31 aa, Artificial Sequence
  Description of Artificial Sequence: Synthetic polypeptide
DEMEIRTTNPVATEQYGCVCSWEHFSFNSNQ

SEQ ID NO: 100641 - protein, 34 aa, Artificial Sequence
  Description of Artificial Sequence: Synthetic polypeptide
DAEEIATTNPVATEQWGSVTGTNHLQTEGGTPRN

SEQ ID NO: 100642 - protein, 33 aa, Artificial Sequence
  Description of Artificial Sequence: Synthetic polypeptide
DEMEIRTTNPVATEQYGCVISTLETEQETQNFN

SEQ ID NO: 100643 - protein, 36 aa, Artificial Sequence
  Description of Artificial Sequence: Synthetic polypeptide
AEEEIRTTNPVATEQYGSVSTNNNQQGSEQGTNTAE

SEQ ID NO: 100644 - protein, 32 aa, Artificial Sequence
  Description of Artificial Sequence: Synthetic polypeptide
DEMEIRTTNPVATEQYGCVNSEEHDERFLDER

SEQ ID NO: 100645 - protein, 36 aa, Artificial Sequence
  Description of Artificial Sequence: Synthetic polypeptide
AEEEIRTTNPVATEQYGSVSSVTNNNNQQIGTNTEQ

SEQ ID NO: 100646 - protein, 36 aa, Artificial Sequence
  Description of Artificial Sequence: Synthetic polypeptide
AEEEIRTTNPVATEQYGSVSSVTNNNNQQIGNNTQN

SEQ ID NO: 100647 - protein, 33 aa, Artificial Sequence
  Description of Artificial Sequence: Synthetic polypeptide
SEEEISTTNPVATEQYGCVCSTELQNFNSDNQS

SEQ ID NO: 100648 - protein, 32 aa, Artificial Sequence
  Description of Artificial Sequence: Synthetic polypeptide
DEHEIRTTNPVAYEQWGSTCPTDNGDQRQGQM

SEQ ID NO: 100649 - protein, 28 aa, Artificial Sequence
  Description of Artificial Sequence: Synthetic peptide
IEEEIATTNPVATEQYGEAPEVCQHEEK

SEQ ID NO: 100650 - protein, 28 aa, Artificial Sequence
  Description of Artificial Sequence: Synthetic peptide
IEEEIATTNPVATEQYGEAPEVCQHEEH

SEQ ID NO: 100651 - protein, 34 aa, Artificial Sequence
  Description of Artificial Sequence: Synthetic polypeptide
DEMEIRTTNPVATEQYGCVSCTLLLTQFNGLQDE

SEQ ID NO: 100652 - protein, 32 aa, Artificial Sequence
  Description of Artificial Sequence: Synthetic polypeptide
DEVEIATTNPCATEPYGSVATNLGGNAGEDAR

SEQ ID NO: 100653 - protein, 35 aa, Artificial Sequence
  Description of Artificial Sequence: Synthetic polypeptide
DEMEIRTTNPVATEQYGCVSCTQDLQDERSGEEKN

SEQ ID NO: 100654 - protein, 31 aa, Artificial Sequence
  Description of Artificial Sequence: Synthetic polypeptide
SEEEISCTNPIATEQYGCVCSWNLANFGSNQ

SEQ ID NO: 100655 - protein, 34 aa, Artificial Sequence
  Description of Artificial Sequence: Synthetic polypeptide
SEEEISCTNPIATEQYGSTVPSCENLSMRTGGNR

SEQ ID NO: 100656 - protein, 32 aa, Artificial Sequence
  Description of Artificial Sequence: Synthetic polypeptide
DAEEIATTNPVATEQWGSVSPNPDQADTNGLS

SEQ ID NO: 100657 - protein, 36 aa, Artificial Sequence
  Description of Artificial Sequence: Synthetic polypeptide
AEEEIRTTNPVATEQYGSVSTNNNQQGTEQGTNISE

SEQ ID NO: 100658 - protein, 36 aa, Artificial Sequence
  Description of Artificial Sequence: Synthetic polypeptide
AEEEIRTTNPVATEQYGSVSTNNNQQGSETGTNTVD

SEQ ID NO: 100659 - protein, 34 aa, Artificial Sequence
  Description of Artificial Sequence: Synthetic polypeptide
DEMEIRTTNPVATEQYGCVSPLDLTQFNGLQDGE

SEQ ID NO: 100660 - protein, 28 aa, Artificial Sequence
  Description of Artificial Sequence: Synthetic peptide
SESEIASTNPVGTEGYGVMASTLQHGDR

SEQ ID NO: 100661 - protein, 33 aa, Artificial Sequence
  Description of Artificial Sequence: Synthetic polypeptide
DEHEIRTTNPVAYEQWGSISHTDNMTQREGGMG

SEQ ID NO: 100662 - protein, 34 aa, Artificial Sequence
  Description of Artificial Sequence: Synthetic polypeptide
SEEEISTTNPVATEQYGCVCSNTGELQNFGSNQS

SEQ ID NO: 100663 - protein, 33 aa, Artificial Sequence
  Description of Artificial Sequence: Synthetic polypeptide
DEMEIRTTNPVATEQYGCVSLLLNTQFNGLQDD

SEQ ID NO: 100664 - protein, 33 aa, Artificial Sequence
  Description of Artificial Sequence: Synthetic polypeptide
DEMEIRTTNPVATEQYGCVSEVNLDERIDDAQE

SEQ ID NO: 100665 - protein, 34 aa, Artificial Sequence
  Description of Artificial Sequence: Synthetic polypeptide
DAEEIATTNPVATEQWGSVSVSGNLENTRGVNEH

SEQ ID NO: 100666 - protein, 36 aa, Artificial Sequence
  Description of Artificial Sequence: Synthetic polypeptide
DEMEIRTTNPVATEQYGCVSCTQNLQDNRSGEEEKN

SEQ ID NO: 100667 - protein, 35 aa, Artificial Sequence
  Description of Artificial Sequence: Synthetic polypeptide
DEMEIRTTNPVATEQYGCVSCTQNILQDDSGEEKN

SEQ ID NO: 100668 - protein, 32 aa, Artificial Sequence
  Description of Artificial Sequence: Synthetic polypeptide
SEEEISTTNPVATEQYGCVCGTALQNFGSDQA

SEQ ID NO: 100669 - protein, 35 aa, Artificial Sequence
  Description of Artificial Sequence: Synthetic polypeptide
MEEEIRTTNPVATEQYGSVGDFTNNGQGGGNGQGA

SEQ ID NO: 100670 - protein, 28 aa, Artificial Sequence
  Description of Artificial Sequence: Synthetic peptide
SESEIASTNPVGTEGYGSMASTLQHGDI

SEQ ID NO: 100671 - protein, 33 aa, Artificial Sequence
  Description of Artificial Sequence: Synthetic polypeptide
DEMEIRTTNPVATEQWGTVCSATIGPPEREGNG

SEQ ID NO: 100672 - protein, 36 aa, Artificial Sequence
  Description of Artificial Sequence: Synthetic polypeptide
AEEEIRTTNPVATEQYGSVSTNLNQQGTVEQGTEAG

SEQ ID NO: 100673 - protein, 36 aa, Artificial Sequence
  Description of Artificial Sequence: Synthetic polypeptide
AEEEIRTTNPVATEQYGSVSTEGGNNNQQGDENGGV

SEQ ID NO: 100674 - protein, 36 aa, Artificial Sequence
  Description of Artificial Sequence: Synthetic polypeptide
AEEEIRTTNPVATEQYGSVSTNLNQQNQEEIGTEQL

SEQ ID NO: 100675 - protein, 33 aa, Artificial Sequence
  Description of Artificial Sequence: Synthetic polypeptide
DAEEIRSTNPVATEQYGSVSPWNLETQNEQQHG

SEQ ID NO: 100676 - protein, 32 aa, Artificial Sequence
  Description of Artificial Sequence: Synthetic polypeptide
DEMEIATVNPVATEQYGTVSATDNPVEFEGND

SEQ ID NO: 100677 - protein, 33 aa, Artificial Sequence
  Description of Artificial Sequence: Synthetic polypeptide
IESEIRTTNPVATECWGSVSCINEPQDREGENG

SEQ ID NO: 100678 - protein, 33 aa, Artificial Sequence
  Description of Artificial Sequence: Synthetic polypeptide
DEMEICTTNPVATEQYGTVSTVTTGNVEEEGND

SEQ ID NO: 100679 - protein, 33 aa, Artificial Sequence
  Description of Artificial Sequence: Synthetic polypeptide
IESEIGTTNPVATECYGSVSCINEPQDREGENG

SEQ ID NO: 100680 - protein, 33 aa, Artificial Sequence
  Description of Artificial Sequence: Synthetic polypeptide
DEMEICTTNPVATEQYGTVSVATDGTNEEEGND

SEQ ID NO: 100681 - protein, 34 aa, Artificial Sequence
  Description of Artificial Sequence: Synthetic polypeptide
SEQEIRGTNPVATEQYGSVNDDTNLQDGGGNDQG

SEQ ID NO: 100682 - protein, 33 aa, Artificial Sequence
  Description of Artificial Sequence: Synthetic polypeptide
DEMEICTTNPVATEQYGVVSVATDGNVEEEGND

SEQ ID NO: 100683 - protein, 33 aa, Artificial Sequence
  Description of Artificial Sequence: Synthetic polypeptide
DEMEICTVNPVATEQYGCVCSTNLISFGSNNQS

SEQ ID NO: 100684 - protein, 33 aa, Artificial Sequence
  Description of Artificial Sequence: Synthetic polypeptide
DEMEIGTTNPVATEQYGTVCSATDEPNEFEGND

SEQ ID NO: 100685 - protein, 35 aa, Artificial Sequence
  Description of Artificial Sequence: Synthetic polypeptide
DAEEIRTTNPVATEQYGSVSSTTPAGPNRNGMNPV

SEQ ID NO: 100686 - protein, 35 aa, Artificial Sequence
  Description of Artificial Sequence: Synthetic polypeptide
AEEEIRTTNPVATEQYGVVVVTVANLENQEQGNVE

SEQ ID NO: 100687 - protein, 33 aa, Artificial Sequence
  Description of Artificial Sequence: Synthetic polypeptide
DEMEIKTTNPVATEQYGTVCSATDGPNEFEGND

SEQ ID NO: 100688 - protein, 30 aa, Artificial Sequence
  Description of Artificial Sequence: Synthetic polypeptide
SEETIRCTNPIATEQYGAVVEMNGMRGNDT

SEQ ID NO: 100689 - protein, 33 aa, Artificial Sequence
  Description of Artificial Sequence: Synthetic polypeptide
MEEEIRTTNPVATEPYGSVVGFGNLQGEGEGTD

SEQ ID NO: 100690 - protein, 33 aa, Artificial Sequence
  Description of Artificial Sequence: Synthetic polypeptide
DEMEIRCTNPVATEQYGSVSVTVDTQETNTEGN

SEQ ID NO: 100691 - protein, 34 aa, Artificial Sequence
  Description of Artificial Sequence: Synthetic polypeptide
SEQEIRGTNPVATEQYGSVVDTMNLQDGGGNDQG

SEQ ID NO: 100692 - protein, 32 aa, Artificial Sequence
  Description of Artificial Sequence: Synthetic polypeptide
DAEEIRTTNPVGTEQWGGCCATNLQRPEDNHW

SEQ ID NO: 100693 - protein, 33 aa, Artificial Sequence
  Description of Artificial Sequence: Synthetic polypeptide
MEEEIRTTNPVATEQYGCVCSNTEHQNFGSDQM

SEQ ID NO: 100694 - protein, 33 aa, Artificial Sequence
  Description of Artificial Sequence: Synthetic polypeptide
SEQEIRGTNPVATEQYGSVVDTNLQDEGGQDQQ

SEQ ID NO: 100695 - protein, 32 aa, Artificial Sequence
  Description of Artificial Sequence: Synthetic polypeptide
IEQEIATTNPVATEQYGSVSETDLEDHEGEDL

SEQ ID NO: 100696 - protein, 33 aa, Artificial Sequence
  Description of Artificial Sequence: Synthetic polypeptide
IEQEIATTNPVATEQYGSVSATDLEDHGGNEDL

SEQ ID NO: 100697 - protein, 32 aa, Artificial Sequence
  Description of Artificial Sequence: Synthetic polypeptide
DEMEIRTTNPVATCQYGCVCNTEHQENFGSNQ

SEQ ID NO: 100698 - protein, 34 aa, Artificial Sequence
  Description of Artificial Sequence: Synthetic polypeptide
MEEEIRTTNPVATEQYGCVCSNTEHQNFGSNTQS

SEQ ID NO: 100699 - protein, 32 aa, Artificial Sequence
  Description of Artificial Sequence: Synthetic polypeptide
DEMEIRTTNPVATCQYGCVCNTEHQNGSNNQA

SEQ ID NO: 100700 - protein, 34 aa, Artificial Sequence
  Description of Artificial Sequence: Synthetic polypeptide
MEEEIRTTNPVATEQYGCVCSNTMEHQNFGSNQS

SEQ ID NO: 100701 - protein, 35 aa, Artificial Sequence
  Description of Artificial Sequence: Synthetic polypeptide
MEEEIRTTNPVATEQYGCVCSNTNHQENFGSENQA

SEQ ID NO: 100702 - protein, 36 aa, Artificial Sequence
  Description of Artificial Sequence: Synthetic polypeptide
AEEEIRTTNPVATEQYGSVSTNLNQQQNNEEGTEAL

SEQ ID NO: 100703 - protein, 31 aa, Artificial Sequence
  Description of Artificial Sequence: Synthetic polypeptide
DEMEIATTNPVSTEQYGNVAATDGIQFEGQR

SEQ ID NO: 100704 - protein, 29 aa, Artificial Sequence
  Description of Artificial Sequence: Synthetic peptide
DEMEIATTNPVGTEQYGVMASGPEFEGND

SEQ ID NO: 100705 - protein, 33 aa, Artificial Sequence
  Description of Artificial Sequence: Synthetic polypeptide
DETTIRTTNPVATEQYGSAGDTVNLDIISGGNG

SEQ ID NO: 100706 - protein, 28 aa, Artificial Sequence
  Description of Artificial Sequence: Synthetic peptide
KEEEIATTNPVATEQYGEAPAVCQHEEK

SEQ ID NO: 100707 - protein, 32 aa, Artificial Sequence
  Description of Artificial Sequence: Synthetic polypeptide
DEMEIATTNPVATEQYGTVSATDGPVEFEGND

SEQ ID NO: 100708 - protein, 32 aa, Artificial Sequence
  Description of Artificial Sequence: Synthetic polypeptide
DEMEIATTNPVATEQYGTVSATDLVEDFEGEL

SEQ ID NO: 100709 - protein, 32 aa, Artificial Sequence
  Description of Artificial Sequence: Synthetic polypeptide
INEEIRTTNPVATEQYGVVVVGNIGQGGGNGS

SEQ ID NO: 100710 - protein, 36 aa, Artificial Sequence
  Description of Artificial Sequence: Synthetic polypeptide
AEEEIRTTNPVATEQYGSVSTNLNNQQQGEQGTEAL

SEQ ID NO: 100711 - protein, 33 aa, Artificial Sequence
  Description of Artificial Sequence: Synthetic polypeptide
INEEIRTTNPVATEQYGVVVTTDNNGQGGGNGD

SEQ ID NO: 100712 - protein, 37 aa, Artificial Sequence
  Description of Artificial Sequence: Synthetic polypeptide
AEEEIRTTNPVATEQYGSVSTNLNQAGNTEQGTNEDE

SEQ ID NO: 100713 - protein, 31 aa, Artificial Sequence
  Description of Artificial Sequence: Synthetic polypeptide
SEQEIACTNPVATEQYGSVSAENLEDHEGEL

SEQ ID NO: 100714 - protein, 34 aa, Artificial Sequence
  Description of Artificial Sequence: Synthetic polypeptide
MEEEIRSTNPVATEQYGSTVAPMTGNRDGRGGTR

SEQ ID NO: 100715 - protein, 37 aa, Artificial Sequence
  Description of Artificial Sequence: Synthetic polypeptide
AEEEIRTTNPVATEQYGSVSTNLNQLGNTEQGTNTNG

SEQ ID NO: 100716 - protein, 31 aa, Artificial Sequence
  Description of Artificial Sequence: Synthetic polypeptide
SEQEIATTNPVATEQYGSVSAEDLEDHEGEL

SEQ ID NO: 100717 - protein, 37 aa, Artificial Sequence
  Description of Artificial Sequence: Synthetic polypeptide
AEEEIRTTNPVATEQYGSVSTNLNQLGNTQQGNTTNE

SEQ ID NO: 100718 - protein, 32 aa, Artificial Sequence
  Description of Artificial Sequence: Synthetic polypeptide
SEQEIATTNPVATEQYGSVSATDLEDHEGEDL

SEQ ID NO: 100719 - protein, 32 aa, Artificial Sequence
  Description of Artificial Sequence: Synthetic polypeptide
SEEVIRYTNPVATEQYGSVSVPNQNDHGSNSH

SEQ ID NO: 100720 - protein, 34 aa, Artificial Sequence
  Description of Artificial Sequence: Synthetic polypeptide
INEEIRTTNPVATEQYGSVVDGTENGQDGGNDGG

SEQ ID NO: 100721 - protein, 29 aa, Artificial Sequence
  Description of Artificial Sequence: Synthetic peptide
DEMEIATTNPVATEQYGVMATDGPEHGDD

SEQ ID NO: 100722 - protein, 32 aa, Artificial Sequence
  Description of Artificial Sequence: Synthetic polypeptide
DEMEIATTNPVATEQYGVMCSATGPVQHEGND

SEQ ID NO: 100723 - protein, 28 aa, Artificial Sequence
  Description of Artificial Sequence: Synthetic peptide
DEMEIATTNPVGTEGYGVMASTLEHGDD

SEQ ID NO: 100724 - protein, 36 aa, Artificial Sequence
  Description of Artificial Sequence: Synthetic polypeptide
AEEEIRTTNPVATEQYGSVSTEGGNNNQQGSTNNGV

SEQ ID NO: 100725 - protein, 36 aa, Artificial Sequence
  Description of Artificial Sequence: Synthetic polypeptide
AEEEIRTTNPVATEQYGSVSTNLNQQGTEQGTEEAL

SEQ ID NO: 100726 - protein, 35 aa, Artificial Sequence
  Description of Artificial Sequence: Synthetic polypeptide
AEEEIRTTNPVATEQYGVVVVTTTNLQQNEQGNQG

SEQ ID NO: 100727 - protein, 35 aa, Artificial Sequence
  Description of Artificial Sequence: Synthetic polypeptide
AEEEIRTTNPVATEQYGSVSTEGNNNNNQNDNEGI

SEQ ID NO: 100728 - protein, 33 aa, Artificial Sequence
  Description of Artificial Sequence: Synthetic polypeptide
INEEIRTTNPVATEQYGSVVDGTENGQDGGEQG

SEQ ID NO: 100729 - protein, 32 aa, Artificial Sequence
  Description of Artificial Sequence: Synthetic polypeptide
DEMEIRTTNPVATCQYGCVCNTELQNSGSDQA

SEQ ID NO: 100730 - protein, 37 aa, Artificial Sequence
  Description of Artificial Sequence: Synthetic polypeptide
AEEEIRTTNPVATEQYGSVSTNLNQQGNTQQGTEENE

SEQ ID NO: 100731 - protein, 33 aa, Artificial Sequence
  Description of Artificial Sequence: Synthetic polypeptide
INEEIRTTNPVATEQYGSVVDGTENGQDGGGGG

SEQ ID NO: 100732 - protein, 33 aa, Artificial Sequence
  Description of Artificial Sequence: Synthetic polypeptide
MEEEIRTTNPVATEFYGSVSTMGFELGEGGDGE

SEQ ID NO: 100733 - protein, 32 aa, Artificial Sequence
  Description of Artificial Sequence: Synthetic polypeptide
DEMEIATTNPVATTQWGCVSRTNDENQQGNEP

SEQ ID NO: 100734 - protein, 36 aa, Artificial Sequence
  Description of Artificial Sequence: Synthetic polypeptide
AEEEIRTTNPVATEQYGSVSTNLNQQGATEQGTEAL

SEQ ID NO: 100735 - protein, 36 aa, Artificial Sequence
  Description of Artificial Sequence: Synthetic polypeptide
AEEEIRTTNPVATEQYGSVSTNLNQQGAEQGTEDAE

SEQ ID NO: 100736 - protein, 33 aa, Artificial Sequence
  Description of Artificial Sequence: Synthetic polypeptide
SEEVIRTTNPVAYEQYGSTCNCTNLAQPGGNNA

SEQ ID NO: 100737 - protein, 32 aa, Artificial Sequence
  Description of Artificial Sequence: Synthetic polypeptide
DEMEIATTNPVATTQWGCVSTWNDIERNGNSP

SEQ ID NO: 100738 - protein, 32 aa, Artificial Sequence
  Description of Artificial Sequence: Synthetic polypeptide
DEHEIRTTNPVAYEQWGCVSTMGPQGDGNDGK

SEQ ID NO: 100739 - protein, 32 aa, Artificial Sequence
  Description of Artificial Sequence: Synthetic polypeptide
IEQEIATTNPVATEQYGSVSATDLEDHEGEDL

SEQ ID NO: 100740 - protein, 33 aa, Artificial Sequence
  Description of Artificial Sequence: Synthetic polypeptide
DEMEIRTTNPVATCQYGCVCNTTELQNFGSNQA

SEQ ID NO: 100741 - protein, 32 aa, Artificial Sequence
  Description of Artificial Sequence: Synthetic polypeptide
MEEEIRTTNPVATEQYGDVTDGNMNTEGGNTG

SEQ ID NO: 100742 - protein, 34 aa, Artificial Sequence
  Description of Artificial Sequence: Synthetic polypeptide
MEEEIRTTNPVATEQYGDVVTGIQNDGEQGGNQE

SEQ ID NO: 100743 - protein, 34 aa, Artificial Sequence
  Description of Artificial Sequence: Synthetic polypeptide
MEEEIRTTNPVATEQYGMVGSILNLDEGGNGNGV

SEQ ID NO: 100744 - protein, 32 aa, Artificial Sequence
  Description of Artificial Sequence: Synthetic polypeptide
DEMEIRTTNPVATEPYGTVSMEDIQQQQNGND

SEQ ID NO: 100745 - protein, 28 aa, Artificial Sequence
  Description of Artificial Sequence: Synthetic peptide
SESEIACTNPVGTEGYGSMASTLQHGDI

SEQ ID NO: 100746 - protein, 33 aa, Artificial Sequence
  Description of Artificial Sequence: Synthetic polypeptide
IEEEIRTTNPVATEQYGSVVVTQLGEETQEDME

SEQ ID NO: 100747 - protein, 32 aa, Artificial Sequence
  Description of Artificial Sequence: Synthetic polypeptide
DEHEIRTTNPVAYEQWGSVSHQLDDRQNQNNN

SEQ ID NO: 100748 - protein, 34 aa, Artificial Sequence
  Description of Artificial Sequence: Synthetic polypeptide
IEEEIRTTNPVATEQYGSVSTMQDLGEFTEDNEM

SEQ ID NO: 100749 - protein, 35 aa, Artificial Sequence
  Description of Artificial Sequence: Synthetic polypeptide
AEEEIRTTNPVATEQYGSVSTAVNQAGTESGTNAA

SEQ ID NO: 100750 - protein, 32 aa, Artificial Sequence
  Description of Artificial Sequence: Synthetic polypeptide
DEMEIRTTNPVATEPYGTVSMEGIQQQQNGND

SEQ ID NO: 100751 - protein, 33 aa, Artificial Sequence
  Description of Artificial Sequence: Synthetic polypeptide
DEHEIRTTNPVAYEQWGSVSHPLDDRQNMGANG

SEQ ID NO: 100752 - protein, 33 aa, Artificial Sequence
  Description of Artificial Sequence: Synthetic polypeptide
MEEEIRTTNPVATEQYGMVGSIMNDEGGNGNGG

SEQ ID NO: 100753 - protein, 32 aa, Artificial Sequence
  Description of Artificial Sequence: Synthetic polypeptide
DEMEIRTTNPVATEQWGDVCSATDGPMAEGNA

SEQ ID NO: 100754 - protein, 36 aa, Artificial Sequence
  Description of Artificial Sequence: Synthetic polypeptide
AEEEIRTTNPVATEQYGSVSTNNEQLGTEQGTNQSE

SEQ ID NO: 100755 - protein, 36 aa, Artificial Sequence
  Description of Artificial Sequence: Synthetic polypeptide
AEEEIRTTNPVATEQYGVVSTVTQGNLQQIGTNSED

SEQ ID NO: 100756 - protein, 31 aa, Artificial Sequence
  Description of Artificial Sequence: Synthetic polypeptide
DEMEIRTTNPVATEQWGDVCSEDIEEAEGND

SEQ ID NO: 100757 - protein, 30 aa, Artificial Sequence
  Description of Artificial Sequence: Synthetic polypeptide
DEMEIRTTNPVATEQWGDVCSEIEEAEGDD

SEQ ID NO: 100758 - protein, 34 aa, Artificial Sequence
  Description of Artificial Sequence: Synthetic polypeptide
MEEEIRTTNPVATEQYGMVGSIMNLGGGNGNGDD

SEQ ID NO: 100759 - protein, 32 aa, Artificial Sequence
  Description of Artificial Sequence: Synthetic polypeptide
DEHEIRTTNPVAYEQWGSVSHPLDDRQEMNNL

SEQ ID NO: 100760 - protein, 30 aa, Artificial Sequence
  Description of Artificial Sequence: Synthetic polypeptide
DEMEIRTTNPVATEQWGDVSATGPEFAEDA

SEQ ID NO: 100761 - protein, 30 aa, Artificial Sequence
  Description of Artificial Sequence: Synthetic polypeptide
DEMEIRTTNPVATEQWGDVSEGEMNAAGDA

SEQ ID NO: 100762 - protein, 35 aa, Artificial Sequence
  Description of Artificial Sequence: Synthetic polypeptide
AEEEIRTTNPVATEQYGVVSTVTNQQQNDEGNNNE

SEQ ID NO: 100763 - protein, 30 aa, Artificial Sequence
  Description of Artificial Sequence: Synthetic polypeptide
DEMEIRTTNPVATEQWGDVSTGPENFAEDA

SEQ ID NO: 100764 - protein, 35 aa, Artificial Sequence
  Description of Artificial Sequence: Synthetic polypeptide
AEEEIRTTNPVATEQYGSVSTNNNDENNETGNVEQ

SEQ ID NO: 100765 - protein, 32 aa, Artificial Sequence
  Description of Artificial Sequence: Synthetic polypeptide
DEMEIRTTNPVATEQWGTVCSATDGPMAEGNA

SEQ ID NO: 100766 - protein, 28 aa, Artificial Sequence
  Description of Artificial Sequence: Synthetic peptide
SESEIASTNPVATEGYGVMASTLQHGDI

SEQ ID NO: 100767 - protein, 31 aa, Artificial Sequence
  Description of Artificial Sequence: Synthetic polypeptide
DETVIRVTNPVATEQYGAVSTNGQQFQEEPE

SEQ ID NO: 100768 - protein, 32 aa, Artificial Sequence
  Description of Artificial Sequence: Synthetic polypeptide
DEMEIRTTNPVATEQWGTVCSATDGPMFEGNA

SEQ ID NO: 100769 - protein, 32 aa, Artificial Sequence
  Description of Artificial Sequence: Synthetic polypeptide
DEMEIRTTNPVATEQWGTVCSATGEVEFEGND

SEQ ID NO: 100770 - protein, 33 aa, Artificial Sequence
  Description of Artificial Sequence: Synthetic polypeptide
DEMEIRTTNPVATEQWGTVCSATIGEPEREGNG

SEQ ID NO: 100771 - protein, 32 aa, Artificial Sequence
  Description of Artificial Sequence: Synthetic polypeptide
DEHEIRTTNPVAYEQWGSVSHPLDDRQNDNVH

SEQ ID NO: 100772 - protein, 33 aa, Artificial Sequence
  Description of Artificial Sequence: Synthetic polypeptide
SEENIATTNPVATEIYGQVATGNQQQDRDGSNR

SEQ ID NO: 100773 - protein, 32 aa, Artificial Sequence
  Description of Artificial Sequence: Synthetic polypeptide
DEMEIRTTNPVATECWGTVCSTDGEVEREGND

SEQ ID NO: 100774 - protein, 37 aa, Artificial Sequence
  Description of Artificial Sequence: Synthetic polypeptide
AEEEIRTTNPVATEQYGSVSTNNANLQNQEQGTNSDE

SEQ ID NO: 100775 - protein, 32 aa, Artificial Sequence
  Description of Artificial Sequence: Synthetic polypeptide
IENEIRTTNPVATEQYGSVSDANNQESLDDDF

SEQ ID NO: 100776 - protein, 32 aa, Artificial Sequence
  Description of Artificial Sequence: Synthetic polypeptide
IENEIRTTNPVATEQYGSVSADNNQESLDDQI

SEQ ID NO: 100777 - protein, 29 aa, Artificial Sequence
  Description of Artificial Sequence: Synthetic peptide
IENEIATTNPVATECYGQVSEWLQHYEEL

SEQ ID NO: 100778 - protein, 33 aa, Artificial Sequence
  Description of Artificial Sequence: Synthetic polypeptide
DETTIRTTNPVATEQYGSVSTGMGGDNNQEEGG

SEQ ID NO: 100779 - protein, 33 aa, Artificial Sequence
  Description of Artificial Sequence: Synthetic polypeptide
SEQEIRTTNPVATEQYGSVSSDDNGGQGGEGGD

SEQ ID NO: 100780 - protein, 33 aa, Artificial Sequence
  Description of Artificial Sequence: Synthetic polypeptide
DAEEIATTNPVATEQYGSVCAANPLQEADIQRQ

SEQ ID NO: 100781 - protein, 33 aa, Artificial Sequence
  Description of Artificial Sequence: Synthetic polypeptide
DEMEIRTTNPVATDQYGCVNSTNNLESIGEITP

SEQ ID NO: 100782 - protein, 28 aa, Artificial Sequence
  Description of Artificial Sequence: Synthetic peptide
SESEIACTNPIGTEGYGSMASTLQRGDI

SEQ ID NO: 100783 - protein, 34 aa, Artificial Sequence
  Description of Artificial Sequence: Synthetic polypeptide
DETTIRTTNPVATEQYGSVYDLTNLIGGGDNGDE

SEQ ID NO: 100784 - protein, 37 aa, Artificial Sequence
  Description of Artificial Sequence: Synthetic polypeptide
AEEEIRTTNPVATEQYGSVSTNLQQLNSTEQGTNNSE

SEQ ID NO: 100785 - protein, 34 aa, Artificial Sequence
  Description of Artificial Sequence: Synthetic polypeptide
MEEEIRTTNPVATEQYGCVCSTEEHQENFGSNQA

SEQ ID NO: 100786 - protein, 34 aa, Artificial Sequence
  Description of Artificial Sequence: Synthetic polypeptide
DAGEIATTNPVATEQYGSVSWTEGDLQDTKGMDR

SEQ ID NO: 100787 - protein, 32 aa, Artificial Sequence
  Description of Artificial Sequence: Synthetic polypeptide
MEEEIRTTNPVATEQYGCVCSTEHANFNSDQS

SEQ ID NO: 100788 - protein, 28 aa, Artificial Sequence
  Description of Artificial Sequence: Synthetic peptide
SESEIACTNPIGTEQYGSMASTLQHGDI

SEQ ID NO: 100789 - protein, 32 aa, Artificial Sequence
  Description of Artificial Sequence: Synthetic polypeptide
DEMEIRTTNPVATDQYGCVSMNVLEMIGEKHP

SEQ ID NO: 100790 - protein, 34 aa, Artificial Sequence
  Description of Artificial Sequence: Synthetic polypeptide
DAEEIATTNPVATEQYGSVCAANNLQDSDGNDHQ

SEQ ID NO: 100791 - protein, 32 aa, Artificial Sequence
  Description of Artificial Sequence: Synthetic polypeptide
DEMEIRTTNPVATDQYGCVSSEVVLERQQNNI

SEQ ID NO: 100792 - protein, 33 aa, Artificial Sequence
  Description of Artificial Sequence: Synthetic polypeptide
DEMEIRTTNPVATECWGSVSWENENQDHEGSNQ

SEQ ID NO: 100793 - protein, 34 aa, Artificial Sequence
  Description of Artificial Sequence: Synthetic polypeptide
MEEEIRTTNPVATEQYGCVISATNETEQETQNDN

SEQ ID NO: 100794 - protein, 37 aa, Artificial Sequence
  Description of Artificial Sequence: Synthetic polypeptide
AEEEIRTTNPVATEQYGSVSTNNANLQNNDEQGNNVE

SEQ ID NO: 100795 - protein, 37 aa, Artificial Sequence
  Description of Artificial Sequence: Synthetic polypeptide
AEEEIRTTNPVATEQYGSVSTNLQQYGNTQQGTNADE

SEQ ID NO: 100796 - protein, 34 aa, Artificial Sequence
  Description of Artificial Sequence: Synthetic polypeptide
DEHEIRTTNPVAYEQWGSVSSTNDNNNRDGDNTS

SEQ ID NO: 100797 - protein, 33 aa, Artificial Sequence
  Description of Artificial Sequence: Synthetic polypeptide
DEMEIRTTNPVATECWGSVSCINEPQDFEGENG

SEQ ID NO: 100798 - protein, 33 aa, Artificial Sequence
  Description of Artificial Sequence: Synthetic polypeptide
DEMEIRTTNPVATCQYGCVCNTGELQNFGSNDM

SEQ ID NO: 100799 - protein, 33 aa, Artificial Sequence
  Description of Artificial Sequence: Synthetic polypeptide
DEMEIRTTNPVATECWGSVSCIGEPQDREGENG

SEQ ID NO: 100800 - protein, 36 aa, Artificial Sequence
  Description of Artificial Sequence: Synthetic polypeptide
AEEEIRTTNPVATEQYGSVSTNLQQQNNNIGTEQGD

SEQ ID NO: 100801 - protein, 33 aa, Artificial Sequence
  Description of Artificial Sequence: Synthetic polypeptide
MEEEIRTTNPVATEQYGCVCSTGEHQNFGSDQI

SEQ ID NO: 100802 - protein, 33 aa, Artificial Sequence
  Description of Artificial Sequence: Synthetic polypeptide
DEHEIRTTNPVAYEQWGSVSSTNNTQGDVNGMN

SEQ ID NO: 100803 - protein, 32 aa, Artificial Sequence
  Description of Artificial Sequence: Synthetic polypeptide
MEEEIRTTNPVATEQYGCVCSTEHQNFISDQN

SEQ ID NO: 100804 - protein, 33 aa, Artificial Sequence
  Description of Artificial Sequence: Synthetic polypeptide
MEEEIRTTNPVATEQYGCVCSTEHQHFGSETQS

SEQ ID NO: 100805 - protein, 28 aa, Artificial Sequence
  Description of Artificial Sequence: Synthetic peptide
IEGEIAPTNPCSSEQYGIVSCNLQSGTQ

SEQ ID NO: 100806 - protein, 33 aa, Artificial Sequence
  Description of Artificial Sequence: Synthetic polypeptide
DEMEIRTTNPVATECWGDVSCINEPQDREGENG

SEQ ID NO: 100807 - protein, 33 aa, Artificial Sequence
  Description of Artificial Sequence: Synthetic polypeptide
QEEEIATTNPVSTEQYGIVSTALPNMRNGMTPR

SEQ ID NO: 100808 - protein, 32 aa, Artificial Sequence
  Description of Artificial Sequence: Synthetic polypeptide
AEQEIACTNPVATEQYGCVATNLQAMQGDNEM

SEQ ID NO: 100809 - protein, 33 aa, Artificial Sequence
  Description of Artificial Sequence: Synthetic polypeptide
MEEEITTTNPVATEQYGNVSVTGGGQGDGENIN

SEQ ID NO: 100810 - protein, 32 aa, Artificial Sequence
  Description of Artificial Sequence: Synthetic polypeptide
NEEEIRTTNPVATEQYGCYCSTELQYFQSEQS

SEQ ID NO: 100811 - protein, 33 aa, Artificial Sequence
  Description of Artificial Sequence: Synthetic polypeptide
DETEIATTNPVAYEQWGSVSTNLNQGAMGGDME

SEQ ID NO: 100812 - protein, 34 aa, Artificial Sequence
  Description of Artificial Sequence: Synthetic polypeptide
DETEIATTNPVAYEQWGSVSTNLNQGAMGGDNSY

SEQ ID NO: 100813 - protein, 36 aa, Artificial Sequence
  Description of Artificial Sequence: Synthetic polypeptide
AEEEIRTTNPVATEQYGSVSTTNNNLQQQNATETGS

SEQ ID NO: 100814 - protein, 36 aa, Artificial Sequence
  Description of Artificial Sequence: Synthetic polypeptide
AEEEIRTTNPVATEQYGSVSTTNNNLQQQIGTTEGG

SEQ ID NO: 100815 - protein, 32 aa, Artificial Sequence
  Description of Artificial Sequence: Synthetic polypeptide
DEMEIVTTNPVATEQYGTVSATDGEVEFEGND

SEQ ID NO: 100816 - protein, 32 aa, Artificial Sequence
  Description of Artificial Sequence: Synthetic polypeptide
DEMEIVTTNPVATEQYGTVSATDDPVEFEGND

SEQ ID NO: 100817 - protein, 32 aa, Artificial Sequence
  Description of Artificial Sequence: Synthetic polypeptide
DEMEIVTTNPVATEQYGTVSATDDIVEFNGND

SEQ ID NO: 100818 - protein, 31 aa, Artificial Sequence
  Description of Artificial Sequence: Synthetic polypeptide
DEMEIVTTNPVATEQYGTVSASGPVEFEGND

SEQ ID NO: 100819 - protein, 34 aa, Artificial Sequence
  Description of Artificial Sequence: Synthetic polypeptide
NEEEIRTTNPVATEQYGDYGTMENDQRGQGGGNG

SEQ ID NO: 100820 - protein, 32 aa, Artificial Sequence
  Description of Artificial Sequence: Synthetic polypeptide
SEEEIRCTNPTAYEQWGSVSGENDDMRAGNSR

SEQ ID NO: 100821 - protein, 32 aa, Artificial Sequence
  Description of Artificial Sequence: Synthetic polypeptide
DEMEIVTTNPVATEQYGTVSAMDDIQEQEGND

SEQ ID NO: 100822 - protein, 30 aa, Artificial Sequence
  Description of Artificial Sequence: Synthetic polypeptide
AESEIACTNPVAYEQWGEASENLQRGGGDR

SEQ ID NO: 100823 - protein, 36 aa, Artificial Sequence
  Description of Artificial Sequence: Synthetic polypeptide
AEEEIRTTNPVATEQYGSVVVVVTNLQQQDEGTNED

SEQ ID NO: 100824 - protein, 32 aa, Artificial Sequence
  Description of Artificial Sequence: Synthetic polypeptide
SEEEIRCTNPTAYEQWGSVSGENDMHRMGNDR

SEQ ID NO: 100825 - protein, 31 aa, Artificial Sequence
  Description of Artificial Sequence: Synthetic polypeptide
SEEEIRCTNPTAYEQWGSVWGENDMHRGNGR

SEQ ID NO: 100826 - protein, 32 aa, Artificial Sequence
  Description of Artificial Sequence: Synthetic polypeptide
DEMEIVTTNPVATEQYGTVSACDGLVEFEGTR

SEQ ID NO: 100827 - protein, 32 aa, Artificial Sequence
  Description of Artificial Sequence: Synthetic polypeptide
SEEEIRCTNPTAYEQWGSVYSGENDMHRGNHR

SEQ ID NO: 100828 - protein, 34 aa, Artificial Sequence
  Description of Artificial Sequence: Synthetic polypeptide
DETEIATTNPVAYEQWGSVSTTNDHQEGRGGNSP

SEQ ID NO: 100829 - protein, 31 aa, Artificial Sequence
  Description of Artificial Sequence: Synthetic polypeptide
DEMEIVTTNPVATEQYGTVPATDGPEFEGND

SEQ ID NO: 100830 - protein, 32 aa, Artificial Sequence
  Description of Artificial Sequence: Synthetic polypeptide
DEMEIVTTNPVATEQYGTVSAMEGIVQFNGND

SEQ ID NO: 100831 - protein, 33 aa, Artificial Sequence
  Description of Artificial Sequence: Synthetic polypeptide
DEMEIVTTNPVATEQYGTVISATDGPVLFEGND

SEQ ID NO: 100832 - protein, 37 aa, Artificial Sequence
  Description of Artificial Sequence: Synthetic polypeptide
AEEEIRTTNPVATEQYGSVSTTNNNLQSGSTNANNQD

SEQ ID NO: 100833 - protein, 33 aa, Artificial Sequence
  Description of Artificial Sequence: Synthetic polypeptide
DEMEIVTTNPVATEQYGTVSATDGLEDFEGNDD

SEQ ID NO: 100834 - protein, 37 aa, Artificial Sequence
  Description of Artificial Sequence: Synthetic polypeptide
AEEEIRTTNPVATEQYGSVSTTNNNNQLNQLQGTNVD

SEQ ID NO: 100835 - protein, 32 aa, Artificial Sequence
  Description of Artificial Sequence: Synthetic polypeptide
DEMEIVTTNPVATEQYGTVSATGPVMNFEGND

SEQ ID NO: 100836 - protein, 35 aa, Artificial Sequence
  Description of Artificial Sequence: Synthetic polypeptide
AEEEIRTTNPVATEQYGSVVVVTTTNNQQIGTNLD

SEQ ID NO: 100837 - protein, 32 aa, Artificial Sequence
  Description of Artificial Sequence: Synthetic polypeptide
DEMEIVTTNPVATEQYGTVSATGPVEFEGNDD

SEQ ID NO: 100838 - protein, 35 aa, Artificial Sequence
  Description of Artificial Sequence: Synthetic polypeptide
AEEEIRTTNPVATEQYGSVSTTNNNNQDEIGETED

SEQ ID NO: 100839 - protein, 36 aa, Artificial Sequence
  Description of Artificial Sequence: Synthetic polypeptide
AEEEIRTTNPVATEQYGSVSTTNNNNNQTQGTNNVD

SEQ ID NO: 100840 - protein, 34 aa, Artificial Sequence
  Description of Artificial Sequence: Synthetic polypeptide
AEEEIRTTNPVATEQYGSVVVVVTNAQGTDENED

SEQ ID NO: 100841 - protein, 37 aa, Artificial Sequence
  Description of Artificial Sequence: Synthetic polypeptide
AEEEIRTTNPVATEQYGSVSTTNNNNLQQQIGTNQEE

SEQ ID NO: 100842 - protein, 36 aa, Artificial Sequence
  Description of Artificial Sequence: Synthetic polypeptide
AEEEIRTTNPVATEQYGSVSTTNNNNENQNGNNETN

SEQ ID NO: 100843 - protein, 32 aa, Artificial Sequence
  Description of Artificial Sequence: Synthetic polypeptide
DEMEIVTTNPVATEQYGTVSATDGIVEFNGND

SEQ ID NO: 100844 - protein, 32 aa, Artificial Sequence
  Description of Artificial Sequence: Synthetic polypeptide
DEMEIVTTNPVATEQYGTVSATDIPVEFEGND

SEQ ID NO: 100845 - protein, 32 aa, Artificial Sequence
  Description of Artificial Sequence: Synthetic polypeptide
DEMEIVTTNPVATEQYGTVSATDGPVEFEGNM

SEQ ID NO: 100846 - protein, 32 aa, Artificial Sequence
  Description of Artificial Sequence: Synthetic polypeptide
DEMEIVTTNPVATEQYGTVSATDGPVEFEGND

SEQ ID NO: 100847 - protein, 32 aa, Artificial Sequence
  Description of Artificial Sequence: Synthetic polypeptide
DEMEIVTTNPVATEQYGTVSATDGPVEFAGND

SEQ ID NO: 100848 - protein, 33 aa, Artificial Sequence
  Description of Artificial Sequence: Synthetic polypeptide
DEMEIVTTNPVATEQYGTVSATDGPQEQFNGND

SEQ ID NO: 100849 - protein, 35 aa, Artificial Sequence
  Description of Artificial Sequence: Synthetic polypeptide
AEEEIRTTNPVATEQYGSVSTTNNNNATELGTNLI

SEQ ID NO: 100850 - protein, 35 aa, Artificial Sequence
  Description of Artificial Sequence: Synthetic polypeptide
AEEEIRTTNPVATEQYGSVSTTNNNNAITEEGNTG

SEQ ID NO: 100851 - protein, 33 aa, Artificial Sequence
  Description of Artificial Sequence: Synthetic polypeptide
DEMEIVTTNPVATEQYGTVSATDGLEDHEGNDD

SEQ ID NO: 100852 - protein, 36 aa, Artificial Sequence
  Description of Artificial Sequence: Synthetic polypeptide
AEEEIRTTNPVATEQYGSVVVVVTNLNQDQGTNNGG

SEQ ID NO: 100853 - protein, 35 aa, Artificial Sequence
  Description of Artificial Sequence: Synthetic polypeptide
AEEEIRTTNPVATEQYGSVSTTNNNMQGTNNVTTE

SEQ ID NO: 100854 - protein, 36 aa, Artificial Sequence
  Description of Artificial Sequence: Synthetic polypeptide
AEEEIRTTNPVATEQYGSVSTTNNNNDEQGNGNNEQ

SEQ ID NO: 100855 - protein, 36 aa, Artificial Sequence
  Description of Artificial Sequence: Synthetic polypeptide
AEEEIRTTNPVATEQYGSVSTTNNNNQNQQGTNGVD

SEQ ID NO: 100856 - protein, 33 aa, Artificial Sequence
  Description of Artificial Sequence: Synthetic polypeptide
DEMEIVTTNPVATEQYGTVCSYTDGPQEMEGNA

SEQ ID NO: 100857 - protein, 32 aa, Artificial Sequence
  Description of Artificial Sequence: Synthetic polypeptide
NEEEIRTTNPVATEQYGCVSAGNHDENGSDQA

SEQ ID NO: 100858 - protein, 32 aa, Artificial Sequence
  Description of Artificial Sequence: Synthetic polypeptide
DEMEIVTTNPVATEQYGTVCSTDGPVEFEGND

SEQ ID NO: 100859 - protein, 37 aa, Artificial Sequence
  Description of Artificial Sequence: Synthetic polypeptide
AEEEIRTTNPVATEQYGSVSTTNNNLQQGTDEQNEEE

SEQ ID NO: 100860 - protein, 34 aa, Artificial Sequence
  Description of Artificial Sequence: Synthetic polypeptide
DETEIATTNPVAYEQYGQSVSANNDLLQDAGMGR

SEQ ID NO: 100861 - protein, 37 aa, Artificial Sequence
  Description of Artificial Sequence: Synthetic polypeptide
AEEEIRTTNPVATEQYGSVSTTNNNLQQGTDEENVEQ

SEQ ID NO: 100862 - protein, 33 aa, Artificial Sequence
  Description of Artificial Sequence: Synthetic polypeptide
DETEIATTNPVAYEQYGSVAATNLQGTPDGSGN

SEQ ID NO: 100863 - protein, 37 aa, Artificial Sequence
  Description of Artificial Sequence: Synthetic polypeptide
AEEEIRTTNPVATEQYGSVSTTNNNLQQGNQQGNGTG

SEQ ID NO: 100864 - protein, 34 aa, Artificial Sequence
  Description of Artificial Sequence: Synthetic polypeptide
NEEEIRTTNPVATEQYGCVCSSGNLDEFFGSNQQ

SEQ ID NO: 100865 - protein, 37 aa, Artificial Sequence
  Description of Artificial Sequence: Synthetic polypeptide
AEEEIRTTNPVATEQYGSVSTTNNNLQQGNQGGNNEG

SEQ ID NO: 100866 - protein, 32 aa, Artificial Sequence
  Description of Artificial Sequence: Synthetic polypeptide
DETEIATTNPVAYEQYGSVAMNDTQTGNGTEH

SEQ ID NO: 100867 - protein, 32 aa, Artificial Sequence
  Description of Artificial Sequence: Synthetic polypeptide
DEMEIVTTNPVATEQYGTVCSTDGPVEFEGNH

SEQ ID NO: 100868 - protein, 37 aa, Artificial Sequence
  Description of Artificial Sequence: Synthetic polypeptide
AEEEIRTTNPVATEQYGSVSTTNNNLQQGNEQGNNQE

SEQ ID NO: 100869 - protein, 37 aa, Artificial Sequence
  Description of Artificial Sequence: Synthetic polypeptide
AEEEIRTTNPVATEQYGSVSTTNNNLQQGDEENEDEE

SEQ ID NO: 100870 - protein, 37 aa, Artificial Sequence
  Description of Artificial Sequence: Synthetic polypeptide
AEEEIRTTNPVATEQYGSVSTTNNNLQQGANEQGTDE

SEQ ID NO: 100871 - protein, 36 aa, Artificial Sequence
  Description of Artificial Sequence: Synthetic polypeptide
AEEEIRTTNPVATEQYGSVSTTNNNLQQEIGETEED

SEQ ID NO: 100872 - protein, 36 aa, Artificial Sequence
  Description of Artificial Sequence: Synthetic polypeptide
AEEEIRTTNPVATEQYGSVSTTNNNLQQANQQGTTE

SEQ ID NO: 100873 - protein, 37 aa, Artificial Sequence
  Description of Artificial Sequence: Synthetic polypeptide
AEEEIRTTNPVATEQYGSVSTTNNNLQNNDNGNNDTN

SEQ ID NO: 100874 - protein, 32 aa, Artificial Sequence
  Description of Artificial Sequence: Synthetic polypeptide
DEMEIVTTNPVATEQYGTVCSTDGLVEFEENL

SEQ ID NO: 100875 - protein, 32 aa, Artificial Sequence
  Description of Artificial Sequence: Synthetic polypeptide
DEMEIVTTNPVATEQYGTVCSTDGLVEFEEND

SEQ ID NO: 100876 - protein, 33 aa, Artificial Sequence
  Description of Artificial Sequence: Synthetic polypeptide
NEEEIRTTNPVATEQYGCVCSAGNLDEFFGSEA

SEQ ID NO: 100877 - protein, 35 aa, Artificial Sequence
  Description of Artificial Sequence: Synthetic polypeptide
AEEEIRTTNPVATEQYGSVSTTNNNLQNEEETEED

SEQ ID NO: 100878 - protein, 32 aa, Artificial Sequence
  Description of Artificial Sequence: Synthetic polypeptide
DETEIATTNPVAYEQYGSVANPNDPAEGNPER

SEQ ID NO: 100879 - protein, 32 aa, Artificial Sequence
  Description of Artificial Sequence: Synthetic polypeptide
DEMEIVTTNPVATEQYGTVCSVTDGPVEFGND

SEQ ID NO: 100880 - protein, 32 aa, Artificial Sequence
  Description of Artificial Sequence: Synthetic polypeptide
DEMEIVTTNPVATEQYGTVCSTDGPVEFEGNK

SEQ ID NO: 100881 - protein, 37 aa, Artificial Sequence
  Description of Artificial Sequence: Synthetic polypeptide
AEEEIRTTNPVATEQYGSVSTTNNNLQQGTEQGNNNQ

SEQ ID NO: 100882 - protein, 31 aa, Artificial Sequence
  Description of Artificial Sequence: Synthetic polypeptide
DEMEIVTTNPVATEQYGTVCSTGPVEFEGTD

SEQ ID NO: 100883 - protein, 37 aa, Artificial Sequence
  Description of Artificial Sequence: Synthetic polypeptide
AEEEIRTTNPVATEQYGSVSTTNNNLQQQGNIGNNNQ

SEQ ID NO: 100884 - protein, 32 aa, Artificial Sequence
  Description of Artificial Sequence: Synthetic polypeptide
DEMEIVTTNPVATEQYGTVCSTEGPVEFEGND

SEQ ID NO: 100885 - protein, 33 aa, Artificial Sequence
  Description of Artificial Sequence: Synthetic polypeptide
SEEEIRCTNPVATECWGSVSCINEPQDREGENG

SEQ ID NO: 100886 - protein, 32 aa, Artificial Sequence
  Description of Artificial Sequence: Synthetic polypeptide
DEMEIVTTNPVATEQYGTVCSTEGIVEFEGND

SEQ ID NO: 100887 - protein, 32 aa, Artificial Sequence
  Description of Artificial Sequence: Synthetic polypeptide
DEMEIVTTNPVATEQYGTVCSTDVPVEFEGND

SEQ ID NO: 100888 - protein, 35 aa, Artificial Sequence
  Description of Artificial Sequence: Synthetic polypeptide
AEEEIRTTNPVATEQYGSVVVVVTNNELQGEQGTG

SEQ ID NO: 100889 - protein, 34 aa, Artificial Sequence
  Description of Artificial Sequence: Synthetic polypeptide
NEEEIRTTNPVATEQYGCVCSWGNLNDEFFGSNA

SEQ ID NO: 100890 - protein, 31 aa, Artificial Sequence
  Description of Artificial Sequence: Synthetic polypeptide
DEMEIVTTNPVATEQYGTVCSTDVPEFEEND

SEQ ID NO: 100891 - protein, 31 aa, Artificial Sequence
  Description of Artificial Sequence: Synthetic polypeptide
DEMEIVTTNPVATEQYGTVCSTDGPVEFGGD

SEQ ID NO: 100892 - protein, 37 aa, Artificial Sequence
  Description of Artificial Sequence: Synthetic polypeptide
AEEEIRTTNPVATEQYGSVSTTNNNLQQNEQGNNSNN

SEQ ID NO: 100893 - protein, 36 aa, Artificial Sequence
  Description of Artificial Sequence: Synthetic polypeptide
AEEEIRTTNPVATEQYGSVSTTNNNLQQNEGEETED

SEQ ID NO: 100894 - protein, 37 aa, Artificial Sequence
  Description of Artificial Sequence: Synthetic polypeptide
AEEEIRTTNPVATEQYGSVSTTNNNLQQNEEGTTNED

SEQ ID NO: 100895 - protein, 32 aa, Artificial Sequence
  Description of Artificial Sequence: Synthetic polypeptide
DEMEIVTTNPVATEQYGTVCSTDGPVQFEGTD

SEQ ID NO: 100896 - protein, 36 aa, Artificial Sequence
  Description of Artificial Sequence: Synthetic polypeptide
AEEEIRTTNPVATEQYGSVSTTNNNLQQNEDEQNGD

SEQ ID NO: 100897 - protein, 36 aa, Artificial Sequence
  Description of Artificial Sequence: Synthetic polypeptide
AEEEIRTTNPVATEQYGSVSTTNNNLQQNDEGTEET

SEQ ID NO: 100898 - protein, 34 aa, Artificial Sequence
  Description of Artificial Sequence: Synthetic polypeptide
DETEIATTNPVAYEQWGSVSTTNQLNQSGPNEDE

SEQ ID NO: 100899 - protein, 34 aa, Artificial Sequence
  Description of Artificial Sequence: Synthetic polypeptide
NEEEIRTTNPVATEQYGCVCSWENLDEFFGSNAA

SEQ ID NO: 100900 - protein, 31 aa, Artificial Sequence
  Description of Artificial Sequence: Synthetic polypeptide
DETEIATTNPVAYEQWGSVVGDNDQDHGGDR

SEQ ID NO: 100901 - protein, 37 aa, Artificial Sequence
  Description of Artificial Sequence: Synthetic polypeptide
AEEEIRTTNPVATEQYGSVSTTNNNLQQGTETGTNTN

SEQ ID NO: 100902 - protein, 31 aa, Artificial Sequence
  Description of Artificial Sequence: Synthetic polypeptide
DEMEIVTTNPVATEQYGTVCSTDVCEFEEND

SEQ ID NO: 100903 - protein, 33 aa, Artificial Sequence
  Description of Artificial Sequence: Synthetic polypeptide
DEMEIVTTNPVATEQYGTVCSTDGIVEQFNGNH

SEQ ID NO: 100904 - protein, 31 aa, Artificial Sequence
  Description of Artificial Sequence: Synthetic polypeptide
DEMEIVTTNPVATEQYGTVSDDGPVEFEGND

SEQ ID NO: 100905 - protein, 32 aa, Artificial Sequence
  Description of Artificial Sequence: Synthetic polypeptide
DETEIATTNPVAYEQWGSVSGDNPQGEHNGRQ

SEQ ID NO: 100906 - protein, 36 aa, Artificial Sequence
  Description of Artificial Sequence: Synthetic polypeptide
AEEEIRTTNPVATEQYGSVSTTNNNQQQQIGTNEEA

SEQ ID NO: 100907 - protein, 35 aa, Artificial Sequence
  Description of Artificial Sequence: Synthetic polypeptide
DENEAEIRTTNPVAYECWGSVATNPLQGEDGDNQR

SEQ ID NO: 100908 - protein, 35 aa, Artificial Sequence
  Description of Artificial Sequence: Synthetic polypeptide
DENEAEIRTTNPVAYECWGSVATNLQGEDGQNGRS

SEQ ID NO: 100909 - protein, 36 aa, Artificial Sequence
  Description of Artificial Sequence: Synthetic polypeptide
AEEEIRTTNPVATEQYGSVVVVTTNLQQQGNGTNTD

SEQ ID NO: 100910 - protein, 36 aa, Artificial Sequence
  Description of Artificial Sequence: Synthetic polypeptide
AEEEIRTTNPVATEQYGSVSTTNNNQQQNNGNNDEE

SEQ ID NO: 100911 - protein, 32 aa, Artificial Sequence
  Description of Artificial Sequence: Synthetic polypeptide
SEEEIRCTNPIAYEPYGSVSENELSMDGGNNR

SEQ ID NO: 100912 - protein, 31 aa, Artificial Sequence
  Description of Artificial Sequence: Synthetic polypeptide
SEEEIRCTNPIAYEQWGSCSIENDMRAGGNR

SEQ ID NO: 100913 - protein, 32 aa, Artificial Sequence
  Description of Artificial Sequence: Synthetic polypeptide
SEEEIRCTNPIAYEQWGSVASGENDMHRDGNR

SEQ ID NO: 100914 - protein, 34 aa, Artificial Sequence
  Description of Artificial Sequence: Synthetic polypeptide
DENEAEIATTNPVAYEHWGEVSTNLQGEHGGNTR

SEQ ID NO: 100915 - protein, 36 aa, Artificial Sequence
  Description of Artificial Sequence: Synthetic polypeptide
AEEEIRTTNPVATEQYGSVSTTNNNQQQQNGNNNTD

SEQ ID NO: 100916 - protein, 32 aa, Artificial Sequence
  Description of Artificial Sequence: Synthetic polypeptide
SEEEIRCTNPIAYEQWGSVASGENDMRAGTNR

SEQ ID NO: 100917 - protein, 32 aa, Artificial Sequence
  Description of Artificial Sequence: Synthetic polypeptide
SEEEIRCTNPIAYEQWGSVSGENDDMERGQNR

SEQ ID NO: 100918 - protein, 31 aa, Artificial Sequence
  Description of Artificial Sequence: Synthetic polypeptide
SEEEIRCTNPIAYEQWGSVSGENDDMRAGNA

SEQ ID NO: 100919 - protein, 32 aa, Artificial Sequence
  Description of Artificial Sequence: Synthetic polypeptide
SEEEIRCTNPIAYEQWGSVSGENDDMRQGDNR

SEQ ID NO: 100920 - protein, 34 aa, Artificial Sequence
  Description of Artificial Sequence: Synthetic polypeptide
DENEAEIATTNPVAYECWGSVATNLQGEDGDNGR

SEQ ID NO: 100921 - protein, 34 aa, Artificial Sequence
  Description of Artificial Sequence: Synthetic polypeptide
DENDEIATTNPVAYEQWGSVCSTNLDQGEGNNNT

SEQ ID NO: 100922 - protein, 32 aa, Artificial Sequence
  Description of Artificial Sequence: Synthetic polypeptide
SEEEIRCTNPIAYEQWGSVSGENDMHRGGENR

SEQ ID NO: 100923 - protein, 32 aa, Artificial Sequence
  Description of Artificial Sequence: Synthetic polypeptide
SEEEIRCTNPIAYEQWGSVSGENDMHRGGNER

SEQ ID NO: 100924 - protein, 32 aa, Artificial Sequence
  Description of Artificial Sequence: Synthetic polypeptide
DENAIRTTNPVATEQYGSFSTLTLIEGTQISH

SEQ ID NO: 100925 - protein, 32 aa, Artificial Sequence
  Description of Artificial Sequence: Synthetic polypeptide
SEEEIRCTNPIAYEQWGSVSGENDMHRTGNQR

SEQ ID NO: 100926 - protein, 36 aa, Artificial Sequence
  Description of Artificial Sequence: Synthetic polypeptide
AEEEIRTTNPVATEQYGSVVVVTTNNLQQGNGNETD

SEQ ID NO: 100927 - protein, 35 aa, Artificial Sequence
  Description of Artificial Sequence: Synthetic polypeptide
AEEEIRTTNPVATEQYGSVVVVTTNNNQEQDEGNQ

SEQ ID NO: 100928 - protein, 35 aa, Artificial Sequence
  Description of Artificial Sequence: Synthetic polypeptide
AEEEIRTTNPVATEQYGSVSTTNNNQQQSATNATE

SEQ ID NO: 100929 - protein, 35 aa, Artificial Sequence
  Description of Artificial Sequence: Synthetic polypeptide
AEEEIRTTNPVATEQYGSVSTTNNNQQQSATNEEN

SEQ ID NO: 100930 - protein, 36 aa, Artificial Sequence
  Description of Artificial Sequence: Synthetic polypeptide
AEEEIRTTNPVATEQYGSVSTTNNQLGSEAGTTNEE

SEQ ID NO: 100931 - protein, 36 aa, Artificial Sequence
  Description of Artificial Sequence: Synthetic polypeptide
AEEEIRTTNPVATEQYGSVSTTNNQLGNNLGENIQE

SEQ ID NO: 100932 - protein, 36 aa, Artificial Sequence
  Description of Artificial Sequence: Synthetic polypeptide
AEEEIRTTNPVATEQYGSVSTTNNQLGNNIGNNQQE

SEQ ID NO: 100933 - protein, 36 aa, Artificial Sequence
  Description of Artificial Sequence: Synthetic polypeptide
AEEEIRTTNPVATEQYGSVSTTNNQLGNNAGTNTQE

SEQ ID NO: 100934 - protein, 36 aa, Artificial Sequence
  Description of Artificial Sequence: Synthetic polypeptide
AEEEIRTTNPVATEQYGSVSTTNNQLGNEGGNNIQE

SEQ ID NO: 100935 - protein, 28 aa, Artificial Sequence
  Description of Artificial Sequence: Synthetic peptide
AESEIACTNPVGTEGYGEAAETLQRGGR

SEQ ID NO: 100936 - protein, 36 aa, Artificial Sequence
  Description of Artificial Sequence: Synthetic polypeptide
AEEEIRTTNPVATEQYGSVSTTNNQLEQGTTEENTE

SEQ ID NO: 100937 - protein, 35 aa, Artificial Sequence
  Description of Artificial Sequence: Synthetic polypeptide
DENEAEIRTTNPVAYEHWGSVSTNLQGEDGRNDSQ

SEQ ID NO: 100938 - protein, 37 aa, Artificial Sequence
  Description of Artificial Sequence: Synthetic polypeptide
AEEEIRTTNPVATEQYGSVSTTNNQLEQGNQNGNNND

SEQ ID NO: 100939 - protein, 36 aa, Artificial Sequence
  Description of Artificial Sequence: Synthetic polypeptide
DENEAEIRTTNPVAYECYGSVSTGNGNTQRGENGGQ

SEQ ID NO: 100940 - protein, 32 aa, Artificial Sequence
  Description of Artificial Sequence: Synthetic polypeptide
DETEIATTNPVATWQYGMVSTALEFQQATSGR

SEQ ID NO: 100941 - protein, 36 aa, Artificial Sequence
  Description of Artificial Sequence: Synthetic polypeptide
AEEEIRTTNPVATEQYGSVSTTNNQGNSNNGNNQED

SEQ ID NO: 100942 - protein, 36 aa, Artificial Sequence
  Description of Artificial Sequence: Synthetic polypeptide
AEEEIRTTNPVATEQYGSVSTTNNQANQQIGTNEEN

SEQ ID NO: 100943 - protein, 36 aa, Artificial Sequence
  Description of Artificial Sequence: Synthetic polypeptide
AEEEIRTTNPVATEQYGSVSTTNNQAGTEAGTNDEE

SEQ ID NO: 100944 - protein, 36 aa, Artificial Sequence
  Description of Artificial Sequence: Synthetic polypeptide
AEEEIRTTNPVATEQYGSVSTTNNNTNQLNGNNEEV

SEQ ID NO: 100945 - protein, 35 aa, Artificial Sequence
  Description of Artificial Sequence: Synthetic polypeptide
DENEAEIRTTNPVAYEHWGSVSTNGNQGEHGGNTR

SEQ ID NO: 100946 - protein, 35 aa, Artificial Sequence
  Description of Artificial Sequence: Synthetic polypeptide
AEEEIRTTNPVATEQYGSVSTTNNNSNDEQGNNVD

SEQ ID NO: 100947 - protein, 31 aa, Artificial Sequence
  Description of Artificial Sequence: Synthetic polypeptide
DETEIATTNPVAYEAWGSVSTNLNGDTNDTS

SEQ ID NO: 100948 - protein, 36 aa, Artificial Sequence
  Description of Artificial Sequence: Synthetic polypeptide
AEEEIRTTNPVATEQYGSVSTTNNNQQQTIGTNPVD

SEQ ID NO: 100949 - protein, 32 aa, Artificial Sequence
  Description of Artificial Sequence: Synthetic polypeptide
DETEIATTNPVAYECWGSVATNLNRGEGQNGS

SEQ ID NO: 100950 - protein, 36 aa, Artificial Sequence
  Description of Artificial Sequence: Synthetic polypeptide
AEEEIRTTNPVATEQYGSVSTTNNQGQSGNGTNQET

SEQ ID NO: 100951 - protein, 31 aa, Artificial Sequence
  Description of Artificial Sequence: Synthetic polypeptide
DETEIATTNPVAYEQWGSVSNNDAGNHGNDS

SEQ ID NO: 100952 - protein, 33 aa, Artificial Sequence
  Description of Artificial Sequence: Synthetic polypeptide
DEMVIRTTNPVATEQYGSVSPTDMENRGSTQEI

SEQ ID NO: 100953 - protein, 33 aa, Artificial Sequence
  Description of Artificial Sequence: Synthetic polypeptide
CESEIRTTNPVATECWGSVSCINEPQDREGENG

SEQ ID NO: 100954 - protein, 35 aa, Artificial Sequence
  Description of Artificial Sequence: Synthetic polypeptide
AEEEIRTTNPVATEQYGSVVVVTTNQQQGEQGNED

SEQ ID NO: 100955 - protein, 32 aa, Artificial Sequence
  Description of Artificial Sequence: Synthetic polypeptide
DEMEIVTTNPVATEQYGVVSATDGPVEFEGND

SEQ ID NO: 100956 - protein, 32 aa, Artificial Sequence
  Description of Artificial Sequence: Synthetic polypeptide
DEMEIVTTNPVATEQYGVVCSATDGPVEFGND

SEQ ID NO: 100957 - protein, 33 aa, Artificial Sequence
  Description of Artificial Sequence: Synthetic polypeptide
DEMEIVTTNPVATEQYGVVCSATDGLVEFEGND

SEQ ID NO: 100958 - protein, 31 aa, Artificial Sequence
  Description of Artificial Sequence: Synthetic polypeptide
DEMEIVTTNPVATEQYGVVAASDGPVEFGND

SEQ ID NO: 100959 - protein, 36 aa, Artificial Sequence
  Description of Artificial Sequence: Synthetic polypeptide
AEEEIRTTNPVATEQYGSVSTTNNNQQGNDENNEEG

SEQ ID NO: 100960 - protein, 32 aa, Artificial Sequence
  Description of Artificial Sequence: Synthetic polypeptide
DEMEIVTTNPVATEQYGTVSTDGPVENAEGND

SEQ ID NO: 100961 - protein, 32 aa, Artificial Sequence
  Description of Artificial Sequence: Synthetic polypeptide
DETEIATTNPVAYEQWGSVCPNDLGQNGNNQI

SEQ ID NO: 100962 - protein, 36 aa, Artificial Sequence
  Description of Artificial Sequence: Synthetic polypeptide
AEEEIRTTNPVATEQYGSVSTTNNNNQQQQNGTNVD

SEQ ID NO: 100963 - protein, 35 aa, Artificial Sequence
  Description of Artificial Sequence: Synthetic polypeptide
AEEEIRTTNPVATEQYGSVVVVTTNQQGQEGNNIP

SEQ ID NO: 100964 - protein, 36 aa, Artificial Sequence
  Description of Artificial Sequence: Synthetic polypeptide
AEEEIRTTNPVATEQYGSVSTTNNNNQQQQGTNEED

SEQ ID NO: 100965 - protein, 32 aa, Artificial Sequence
  Description of Artificial Sequence: Synthetic polypeptide
DETEIATTNPVAYEQWGSVCSTLNDHEGQNDM

SEQ ID NO: 100966 - protein, 36 aa, Artificial Sequence
  Description of Artificial Sequence: Synthetic polypeptide
AEEEIRTTNPVATEQYGSVSTTNNNNQQQGTTNLSA

SEQ ID NO: 100967 - protein, 33 aa, Artificial Sequence
  Description of Artificial Sequence: Synthetic polypeptide
DETEIATTNPVAYEQWGSVCSTNDGQSGGDNEP

SEQ ID NO: 100968 - protein, 33 aa, Artificial Sequence
  Description of Artificial Sequence: Synthetic polypeptide
DEMEIVTTNPVATEQYGTVSSATPGPVNREGNV

SEQ ID NO: 100969 - protein, 33 aa, Artificial Sequence
  Description of Artificial Sequence: Synthetic polypeptide
DEMEIVTTNPVATEQYGTVSSATDGPVNREGNV

SEQ ID NO: 100970 - protein, 36 aa, Artificial Sequence
  Description of Artificial Sequence: Synthetic polypeptide
AEEEIRTTNPVATEQYGSVVVVTTTNLQQGNGANTE

SEQ ID NO: 100971 - protein, 33 aa, Artificial Sequence
  Description of Artificial Sequence: Synthetic polypeptide
DEMEIVTTNPVATEQYGTVSSATDGPQEFEGND

SEQ ID NO: 100972 - protein, 33 aa, Artificial Sequence
  Description of Artificial Sequence: Synthetic polypeptide
DEMEIVTTNPVATEQYGTVSSATDGPPEREGND

SEQ ID NO: 100973 - protein, 36 aa, Artificial Sequence
  Description of Artificial Sequence: Synthetic polypeptide
AEEEIRTTNPVATEQYGSVSTTNNNNQQQGEGTNTD

SEQ ID NO: 100974 - protein, 36 aa, Artificial Sequence
  Description of Artificial Sequence: Synthetic polypeptide
AEEEIRTTNPVATEQYGSVSTTNNNNQQQIGTNEGD

SEQ ID NO: 100975 - protein, 34 aa, Artificial Sequence
  Description of Artificial Sequence: Synthetic polypeptide
CESEIRTTNPVATEAYGKVSCNNLSQQKAGGNRP

SEQ ID NO: 100976 - protein, 36 aa, Artificial Sequence
  Description of Artificial Sequence: Synthetic polypeptide
AEEEIRTTNPVATEQYGSVSTTNNNQQGTNNNNQGN

SEQ ID NO: 100977 - protein, 32 aa, Artificial Sequence
  Description of Artificial Sequence: Synthetic polypeptide
DEMEIVTTNPVGTEQYGTVSATDGPVQHEGND

SEQ ID NO: 100978 - protein, 31 aa, Artificial Sequence
  Description of Artificial Sequence: Synthetic polypeptide
SEEEIRCTNPIAYEQWGSVWLENDMHRDGNR

SEQ ID NO: 100979 - protein, 32 aa, Artificial Sequence
  Description of Artificial Sequence: Synthetic polypeptide
DETEIATTNPVAYEGWGSVATDNGPQNDGNNR

SEQ ID NO: 100980 - protein, 32 aa, Artificial Sequence
  Description of Artificial Sequence: Synthetic polypeptide
SEEEIRCTNPIAYEQYGSTVAENAHSMRGGNR

SEQ ID NO: 100981 - protein, 35 aa, Artificial Sequence
  Description of Artificial Sequence: Synthetic polypeptide
AEEEIRTTNPVATEQYGSVSTTNNNQQQIGTDEGE

SEQ ID NO: 100982 - protein, 31 aa, Artificial Sequence
  Description of Artificial Sequence: Synthetic polypeptide
DETEIATTNPVAYEHWGSVATNPQGDLGNGS

SEQ ID NO: 100983 - protein, 32 aa, Artificial Sequence
  Description of Artificial Sequence: Synthetic polypeptide
DEMVIGTTNPVATEQWGCVCSTEALQYGSNQA

SEQ ID NO: 100984 - protein, 32 aa, Artificial Sequence
  Description of Artificial Sequence: Synthetic polypeptide
DEMEVVTTNPVATEQYGNVCSATGPVQREGQD

SEQ ID NO: 100985 - protein, 31 aa, Artificial Sequence
  Description of Artificial Sequence: Synthetic polypeptide
DEMEVATTNPVATEQYGNVCAATGPQREGQD

SEQ ID NO: 100986 - protein, 31 aa, Artificial Sequence
  Description of Artificial Sequence: Synthetic polypeptide
DEMEVATTNPVATEQYGNVCAANTPQREGQD

SEQ ID NO: 100987 - protein, 33 aa, Artificial Sequence
  Description of Artificial Sequence: Synthetic polypeptide
DEMEIVTTNPVATEQYGWVCSATDGQVEFEGND

SEQ ID NO: 100988 - protein, 31 aa, Artificial Sequence
  Description of Artificial Sequence: Synthetic polypeptide
DEMEVATTNPVATEQYGNVCAANGPQREGQD

SEQ ID NO: 100989 - protein, 35 aa, Artificial Sequence
  Description of Artificial Sequence: Synthetic polypeptide
AEEEIRTTNPVATEQYGSVVVVTTNNQQQGEGNIP

SEQ ID NO: 100990 - protein, 36 aa, Artificial Sequence
  Description of Artificial Sequence: Synthetic polypeptide
AEEEIRTTNPVATEQYGSVSTTNNNQQQGNGNTEQG

SEQ ID NO: 100991 - protein, 31 aa, Artificial Sequence
  Description of Artificial Sequence: Synthetic polypeptide
DEMEIVTTNPVSTEQYGTVSATGPVEFEGND

SEQ ID NO: 100992 - protein, 36 aa, Artificial Sequence
  Description of Artificial Sequence: Synthetic polypeptide
AEEEIRTTNPVATEQYGSVSTTNNNQQNEIGTNQGQ

SEQ ID NO: 100993 - protein, 32 aa, Artificial Sequence
  Description of Artificial Sequence: Synthetic polypeptide
SEEEIRCTNPIAYERWGSVSCENLMRTGGNNR

SEQ ID NO: 100994 - protein, 32 aa, Artificial Sequence
  Description of Artificial Sequence: Synthetic polypeptide
DETEIATTNPVAYEQWGCVSTNWQGNDMGGSR

SEQ ID NO: 100995 - protein, 33 aa, Artificial Sequence
  Description of Artificial Sequence: Synthetic polypeptide
DETEIATTNPVAYEQWGCVSTTNLQSGPNEDDE

SEQ ID NO: 100996 - protein, 31 aa, Artificial Sequence
  Description of Artificial Sequence: Synthetic polypeptide
DEMEIVTTNPVSTEQYGNVAATDGIQFEGQR

SEQ ID NO: 100997 - protein, 31 aa, Artificial Sequence
  Description of Artificial Sequence: Synthetic polypeptide
DEMEIVTTNPVGTEQYGVVAASDTPVEFGND

SEQ ID NO: 100998 - protein, 33 aa, Artificial Sequence
  Description of Artificial Sequence: Synthetic polypeptide
DEMEIWTTNPVATEQYGTVCSATDGPREFEGND

SEQ ID NO: 100999 - protein, 32 aa, Artificial Sequence
  Description of Artificial Sequence: Synthetic polypeptide
DEMEIVTTNPVATEQYGTVCSTDGEVEFEGND

SEQ ID NO: 101000 - protein, 36 aa, Artificial Sequence
  Description of Artificial Sequence: Synthetic polypeptide
AEEEIRTTNPVATEQYGSVSTTNNNLQNDEEGETED

SEQ ID NO: 101001 - protein, 36 aa, Artificial Sequence
  Description of Artificial Sequence: Synthetic polypeptide
AEEEIRTTNPVATEQYGSVVVVVTNNLNQEGNVEDE

SEQ ID NO: 101002 - protein, 36 aa, Artificial Sequence
  Description of Artificial Sequence: Synthetic polypeptide
AEEEIRTTNPVATEQYGSVVVVVTTNLQQGETGNIP

SEQ ID NO: 101003 - protein, 33 aa, Artificial Sequence
  Description of Artificial Sequence: Synthetic polypeptide
DETEICTTNPVAYEQWGSVSGTNDLGNSGNGDS

SEQ ID NO: 101004 - protein, 33 aa, Artificial Sequence
  Description of Artificial Sequence: Synthetic polypeptide
DETEICTTNPVAYEQWGSVSSTNDLPGNSGNDS

SEQ ID NO: 101005 - protein, 33 aa, Artificial Sequence
  Description of Artificial Sequence: Synthetic polypeptide
DEMEIVTTNPVATEQYGTVCSATDGPQEFEGND

SEQ ID NO: 101006 - protein, 33 aa, Artificial Sequence
  Description of Artificial Sequence: Synthetic polypeptide
DEMEIVTTNPVATEQYGTVCSATDGPPQFEGND

SEQ ID NO: 101007 - protein, 32 aa, Artificial Sequence
  Description of Artificial Sequence: Synthetic polypeptide
NEEEIATTNPVAYEQYGSVANNNLQPDPQENN

SEQ ID NO: 101008 - protein, 32 aa, Artificial Sequence
  Description of Artificial Sequence: Synthetic polypeptide
NEEEIATTNPVAYEQYGSVANGLQPDPGDQNH

SEQ ID NO: 101009 - protein, 33 aa, Artificial Sequence
  Description of Artificial Sequence: Synthetic polypeptide
DETEICTTNPVAYEQWGSVSTTNNDLGNSGNDS

SEQ ID NO: 101010 - protein, 33 aa, Artificial Sequence
  Description of Artificial Sequence: Synthetic polypeptide
DEMEIVTTNPVATEQYGTVCSATDGPPEREGND

SEQ ID NO: 101011 - protein, 33 aa, Artificial Sequence
  Description of Artificial Sequence: Synthetic polypeptide
DETEICTTNPVAYEHWGSVSTGPLGDHQGGNKR

SEQ ID NO: 101012 - protein, 31 aa, Artificial Sequence
  Description of Artificial Sequence: Synthetic polypeptide
DETEICTTNPVAYEQWGSVTTNDLGNGGDDS

SEQ ID NO: 101013 - protein, 33 aa, Artificial Sequence
  Description of Artificial Sequence: Synthetic polypeptide
DEMEIVTTNPVATEQYGTVCSATDGPNEFEGND

SEQ ID NO: 101014 - protein, 33 aa, Artificial Sequence
  Description of Artificial Sequence: Synthetic polypeptide
DEMEIVTTNPVATEQYGTVCSATDGPLEFEGND

SEQ ID NO: 101015 - protein, 33 aa, Artificial Sequence
  Description of Artificial Sequence: Synthetic polypeptide
NEEEIATTNPVAYEQYGSVAGTNLQTRNPEKPN

SEQ ID NO: 101016 - protein, 33 aa, Artificial Sequence
  Description of Artificial Sequence: Synthetic polypeptide
DEMEIVTTNPVATEQYGTVCSATDGPESRVGND

SEQ ID NO: 101017 - protein, 32 aa, Artificial Sequence
  Description of Artificial Sequence: Synthetic polypeptide
DEMEIVTTNPVATEQYGTVCSATDGPEFEGND

SEQ ID NO: 101018 - protein, 32 aa, Artificial Sequence
  Description of Artificial Sequence: Synthetic polypeptide
DEMEIVTTNPVATEQYGTVCSATDGPEFEGNA

SEQ ID NO: 101019 - protein, 32 aa, Artificial Sequence
  Description of Artificial Sequence: Synthetic polypeptide
DEMEIVTTNPVATEQYGTVCSATDGPEFAGND

SEQ ID NO: 101020 - protein, 33 aa, Artificial Sequence
  Description of Artificial Sequence: Synthetic polypeptide
DEMEIVTTNPVATEQYGTVCSATDGNVEFEGND

SEQ ID NO: 101021 - protein, 33 aa, Artificial Sequence
  Description of Artificial Sequence: Synthetic polypeptide
DEMEIVTTNPVATEQYGTVCSATDGLVEHEGND

SEQ ID NO: 101022 - protein, 36 aa, Artificial Sequence
  Description of Artificial Sequence: Synthetic polypeptide
AEEEIRTTNPVATEQYGSVSTTNNLQQNDEQGTTEQ

SEQ ID NO: 101023 - protein, 32 aa, Artificial Sequence
  Description of Artificial Sequence: Synthetic polypeptide
NEEEIATTNPVAYEQYGSVAANGLTGAPGNPE

SEQ ID NO: 101024 - protein, 32 aa, Artificial Sequence
  Description of Artificial Sequence: Synthetic polypeptide
SEEEIRPTNPIATEQYGMAVVEMNGMRGTNDR

SEQ ID NO: 101025 - protein, 32 aa, Artificial Sequence
  Description of Artificial Sequence: Synthetic polypeptide
AESEIACTNPVATEQYGEAPSENALSQRGGGR

SEQ ID NO: 101026 - protein, 33 aa, Artificial Sequence
  Description of Artificial Sequence: Synthetic polypeptide
DEMEIVTTNPVATEQYGTVCSATDGPVQFEGNG

SEQ ID NO: 101027 - protein, 32 aa, Artificial Sequence
  Description of Artificial Sequence: Synthetic polypeptide
NEEEIATTNPVSTEQYGSVYIIDNLQDGGQGT

SEQ ID NO: 101028 - protein, 33 aa, Artificial Sequence
  Description of Artificial Sequence: Synthetic polypeptide
DEMEIVTTNPVATEQYGTVCSATDGPVQFEGND

SEQ ID NO: 101029 - protein, 33 aa, Artificial Sequence
  Description of Artificial Sequence: Synthetic polypeptide
DEMEIVTTNPVATEQYGTVCSATDGPVNQEGND

SEQ ID NO: 101030 - protein, 33 aa, Artificial Sequence
  Description of Artificial Sequence: Synthetic polypeptide
DEMEIVTTNPVATEQYGTVCSATDGPVMFEGNR

SEQ ID NO: 101031 - protein, 31 aa, Artificial Sequence
  Description of Artificial Sequence: Synthetic polypeptide
SEEEIRPTNPIATEQYGAVVEMNGKMRGNDQ

SEQ ID NO: 101032 - protein, 33 aa, Artificial Sequence
  Description of Artificial Sequence: Synthetic polypeptide
DEMEIVTTNPVATEQYGTVCSATDGPVLFEGND

SEQ ID NO: 101033 - protein, 33 aa, Artificial Sequence
  Description of Artificial Sequence: Synthetic polypeptide
DEMEIVTTNPVATEQYGTVCSATDGPVERVGND

SEQ ID NO: 101034 - protein, 33 aa, Artificial Sequence
  Description of Artificial Sequence: Synthetic polypeptide
DEMEIVTTNPVATEQYGTVCSATDGPVEREGNT

SEQ ID NO: 101035 - protein, 36 aa, Artificial Sequence
  Description of Artificial Sequence: Synthetic polypeptide
AEEEIRTTNPVATEQYGSVVVVVTTNLQQGEENETE

SEQ ID NO: 101036 - protein, 32 aa, Artificial Sequence
  Description of Artificial Sequence: Synthetic polypeptide
SEEEIRPTNPIATEQYGAVVEMNGMWRGVNDR

SEQ ID NO: 101037 - protein, 33 aa, Artificial Sequence
  Description of Artificial Sequence: Synthetic polypeptide
DEMEIVTTNPVATEQYGTVCSATDGPVEQEGND

SEQ ID NO: 101038 - protein, 33 aa, Artificial Sequence
  Description of Artificial Sequence: Synthetic polypeptide
DEMEIVTTNPVATEQYGTVCSATDGPVEFRGND

SEQ ID NO: 101039 - protein, 32 aa, Artificial Sequence
  Description of Artificial Sequence: Synthetic polypeptide
DEMEIVTTNPVATEQYGTVCSATDGPVEFGNL

SEQ ID NO: 101040 - protein, 32 aa, Artificial Sequence
  Description of Artificial Sequence: Synthetic polypeptide
DEMEIVTTNPVATEQYGTVCSATDGPVEFGND

SEQ ID NO: 101041 - protein, 32 aa, Artificial Sequence
  Description of Artificial Sequence: Synthetic polypeptide
AESEIACTNPVATEQYGEASCENELSQRVGGR

SEQ ID NO: 101042 - protein, 36 aa, Artificial Sequence
  Description of Artificial Sequence: Synthetic polypeptide
AEEEIRTTNPVATEQYGSVVVVVTTNLNQTQGEEND

SEQ ID NO: 101043 - protein, 33 aa, Artificial Sequence
  Description of Artificial Sequence: Synthetic polypeptide
DEMEIVTTNPVATEQYGTVCSATDGPVEFEGNR

SEQ ID NO: 101044 - protein, 33 aa, Artificial Sequence
  Description of Artificial Sequence: Synthetic polypeptide
DEMEIVTTNPVATEQYGTVCSATDGPREFEGND

SEQ ID NO: 101045 - protein, 33 aa, Artificial Sequence
  Description of Artificial Sequence: Synthetic polypeptide
DEMEIVTTNPVATEQYGTVCSATDGPQEFNGND

SEQ ID NO: 101046 - protein, 33 aa, Artificial Sequence
  Description of Artificial Sequence: Synthetic polypeptide
DEMEIVTTNPVATEQYGTVCSATDGPVEREGND

SEQ ID NO: 101047 - protein, 36 aa, Artificial Sequence
  Description of Artificial Sequence: Synthetic polypeptide
AEEEIRTTNPVATEQYGSVVVVVTTNLGQEQGNNEG

SEQ ID NO: 101048 - protein, 33 aa, Artificial Sequence
  Description of Artificial Sequence: Synthetic polypeptide
DEMEIVTTNPVATEQYGTVCSATDGLVEFEGNI

SEQ ID NO: 101049 - protein, 33 aa, Artificial Sequence
  Description of Artificial Sequence: Synthetic polypeptide
NEEEIATTNPVAYEQWGSVYKTDNLDQQGENYI

SEQ ID NO: 101050 - protein, 31 aa, Artificial Sequence
  Description of Artificial Sequence: Synthetic polypeptide
DEMEIVTTNPVATEQYGTISMEDIQQQEGND

SEQ ID NO: 101051 - protein, 32 aa, Artificial Sequence
  Description of Artificial Sequence: Synthetic polypeptide
DEMEIVTTNPVATEQYGTICSTEGIVEQEGND

SEQ ID NO: 101052 - protein, 32 aa, Artificial Sequence
  Description of Artificial Sequence: Synthetic polypeptide
DETEIKTTNPAATEQYGSVPTGLIMGDGNGDT

SEQ ID NO: 101053 - protein, 36 aa, Artificial Sequence
  Description of Artificial Sequence: Synthetic polypeptide
AEEEIRTTNPVATEQYGSVVVVVTTNNLQQGIQNVE

SEQ ID NO: 101054 - protein, 32 aa, Artificial Sequence
  Description of Artificial Sequence: Synthetic polypeptide
DEMEIVTTNPVATEQYGTACSEDGLVQFEGND

SEQ ID NO: 101055 - protein, 36 aa, Artificial Sequence
  Description of Artificial Sequence: Synthetic polypeptide
AEEEIRTTNPVATEQYGSVVVVVTTNNLQQGNNAGE

SEQ ID NO: 101056 - protein, 31 aa, Artificial Sequence
  Description of Artificial Sequence: Synthetic polypeptide
NEEEIATTNPVATEQYGSVSANPGAMPPTEQ

SEQ ID NO: 101057 - protein, 32 aa, Artificial Sequence
  Description of Artificial Sequence: Synthetic polypeptide
DEMEIVTTNPVATEQYGTACSATDNPEFEGND

SEQ ID NO: 101058 - protein, 34 aa, Artificial Sequence
  Description of Artificial Sequence: Synthetic polypeptide
DEMEIVTTNPVATEQYGSVSSTTPAGVNREGMNV

SEQ ID NO: 101059 - protein, 31 aa, Artificial Sequence
  Description of Artificial Sequence: Synthetic polypeptide
DEMEIVTTNPVATEQYGTISMEDIVQQEGND

SEQ ID NO: 101060 - protein, 33 aa, Artificial Sequence
  Description of Artificial Sequence: Synthetic polypeptide
DEMEIVTTNPVATEQYGSVSSTTDGGVNFEGND

SEQ ID NO: 101061 - protein, 33 aa, Artificial Sequence
  Description of Artificial Sequence: Synthetic polypeptide
DEMEIVTTNPVATEQYGSVSATDLVEDHEGEDL

SEQ ID NO: 101062 - protein, 30 aa, Artificial Sequence
  Description of Artificial Sequence: Synthetic polypeptide
DETEIRCTNPIATECYGSTTSEDLMPGPYR

SEQ ID NO: 101063 - protein, 33 aa, Artificial Sequence
  Description of Artificial Sequence: Synthetic polypeptide
DEMEIVTTNPVATEQYGSVSATDGPVEFEGNDD

SEQ ID NO: 101064 - protein, 33 aa, Artificial Sequence
  Description of Artificial Sequence: Synthetic polypeptide
DEMEIVTTNPVATEQYGSVSATDGPVEDFEGND

SEQ ID NO: 101065 - protein, 34 aa, Artificial Sequence
  Description of Artificial Sequence: Synthetic polypeptide
NEEEIATTNPVATEQYGSVSAGNLDEAPGEQARE

SEQ ID NO: 101066 - protein, 34 aa, Artificial Sequence
  Description of Artificial Sequence: Synthetic polypeptide
DEMEIVTTNPVATEQYGSVSATDGLVEDHEGNDL

SEQ ID NO: 101067 - protein, 31 aa, Artificial Sequence
  Description of Artificial Sequence: Synthetic polypeptide
DETEIRCTNPIATECYGSVWSEDWAEPKGNR

SEQ ID NO: 101068 - protein, 34 aa, Artificial Sequence
  Description of Artificial Sequence: Synthetic polypeptide
DEMEIVTTNPVATEQYGSVSATDGLVEDFEGNDL

SEQ ID NO: 101069 - protein, 34 aa, Artificial Sequence
  Description of Artificial Sequence: Synthetic polypeptide
DEMEIVTTNPVATEQYGSVSATDDLVEDHEGNDL

SEQ ID NO: 101070 - protein, 33 aa, Artificial Sequence
  Description of Artificial Sequence: Synthetic polypeptide
DEMEIVTTNPVATEQYGSVSSATDGGVNFEGND

SEQ ID NO: 101071 - protein, 33 aa, Artificial Sequence
  Description of Artificial Sequence: Synthetic polypeptide
DEMEIVTTNPVATEQYGTVCSATDGLVEFEGND

SEQ ID NO: 101072 - protein, 31 aa, Artificial Sequence
  Description of Artificial Sequence: Synthetic polypeptide
DEMEIVTTNPVATEQYGTISMEGIVEQEGND

SEQ ID NO: 101073 - protein, 33 aa, Artificial Sequence
  Description of Artificial Sequence: Synthetic polypeptide
DEMEIVTTNPVATEQYGTVCSADDGLVQFEGND

SEQ ID NO: 101074 - protein, 31 aa, Artificial Sequence
  Description of Artificial Sequence: Synthetic polypeptide
NEEEIATTNPVAYEQWGSVSKAWNNDEGGLR

SEQ ID NO: 101075 - protein, 31 aa, Artificial Sequence
  Description of Artificial Sequence: Synthetic polypeptide
NEEEIATTNPVAYEQWGSVRPWNDDEQTGNH

SEQ ID NO: 101076 - protein, 32 aa, Artificial Sequence
  Description of Artificial Sequence: Synthetic polypeptide
DEMEIVTTNPVATEQYGTVCSATDGLEFEGGD

SEQ ID NO: 101077 - protein, 33 aa, Artificial Sequence
  Description of Artificial Sequence: Synthetic polypeptide
DEMEIVTTNPVATEQYGTVCSATDGLEEFEGND

SEQ ID NO: 101078 - protein, 33 aa, Artificial Sequence
  Description of Artificial Sequence: Synthetic polypeptide
DEMEIVTTNPVATEQYGTVCSATDGIVQFEGND

SEQ ID NO: 101079 - protein, 36 aa, Artificial Sequence
  Description of Artificial Sequence: Synthetic polypeptide
AEEEIRTTNPVATEQYGSVSTTNNLQQGQTQGTEDT

SEQ ID NO: 101080 - protein, 33 aa, Artificial Sequence
  Description of Artificial Sequence: Synthetic polypeptide
DEMEIVTTNPVATEQYGTVCSATDGIQEFEGND

SEQ ID NO: 101081 - protein, 33 aa, Artificial Sequence
  Description of Artificial Sequence: Synthetic polypeptide
DEMEIVTTNPVATEQYGTVCSATDGGVERNGND

SEQ ID NO: 101082 - protein, 33 aa, Artificial Sequence
  Description of Artificial Sequence: Synthetic polypeptide
DEMEIVTTNPVATEQYGTVCSATDDPVEQEGND

SEQ ID NO: 101083 - protein, 33 aa, Artificial Sequence
  Description of Artificial Sequence: Synthetic polypeptide
DEMEIVTTNPVATEQYGTVASATDGPVQFEGND

SEQ ID NO: 101084 - protein, 32 aa, Artificial Sequence
  Description of Artificial Sequence: Synthetic polypeptide
DEMEIVTTNPVATEQYGTVCSATDDPEFEGND

SEQ ID NO: 101085 - protein, 33 aa, Artificial Sequence
  Description of Artificial Sequence: Synthetic polypeptide
DEMEIVTTNPVATEQYGTVCSATDAGVERNGND

SEQ ID NO: 101086 - protein, 32 aa, Artificial Sequence
  Description of Artificial Sequence: Synthetic polypeptide
DEMEIVTTNPVATEQYGTVCSASDGLEFEGNI

SEQ ID NO: 101087 - protein, 31 aa, Artificial Sequence
  Description of Artificial Sequence: Synthetic polypeptide
AESEIACTNPVATEQWGEASENLPQDREGGR

SEQ ID NO: 101088 - protein, 30 aa, Artificial Sequence
  Description of Artificial Sequence: Synthetic polypeptide
NEEEIATTNPVAYEQWGSVRAWDLDEKGNQ

SEQ ID NO: 101089 - protein, 33 aa, Artificial Sequence
  Description of Artificial Sequence: Synthetic polypeptide
NEEEIATTNPVAYEQWGSVNKTDNLDQQGENGV

SEQ ID NO: 101090 - protein, 32 aa, Artificial Sequence
  Description of Artificial Sequence: Synthetic polypeptide
NEEEIATTNPVAYAQYGSVATNLQGNPTEGDN

SEQ ID NO: 101091 - protein, 33 aa, Artificial Sequence
  Description of Artificial Sequence: Synthetic polypeptide
DEMEIVTTNPVATEQYGTVCSANDGPESRVGND

SEQ ID NO: 101092 - protein, 32 aa, Artificial Sequence
  Description of Artificial Sequence: Synthetic polypeptide
DEMEIVTTNPVATEQYGTVCSANDGPEFEGND

SEQ ID NO: 101093 - protein, 32 aa, Artificial Sequence
  Description of Artificial Sequence: Synthetic polypeptide
DEMEIVTTNPVATEQYGTVCSAEDGPEFEGNR

SEQ ID NO: 101094 - protein, 36 aa, Artificial Sequence
  Description of Artificial Sequence: Synthetic polypeptide
AEEEIRTTNPVATEQYGSVSTTNNLQQGQTEGTEDT

SEQ ID NO: 101095 - protein, 33 aa, Artificial Sequence
  Description of Artificial Sequence: Synthetic polypeptide
DEMEIVTTNPVATEQYGTVCSATDGPVQSEGND

SEQ ID NO: 101096 - protein, 37 aa, Artificial Sequence
  Description of Artificial Sequence: Synthetic polypeptide
AEEEIRTTNPVATEQYGSVSTTNNLQQQQGNGTNQGT

SEQ ID NO: 101097 - protein, 33 aa, Artificial Sequence
  Description of Artificial Sequence: Synthetic polypeptide
DEMEIVTTNPVATEQYGTVCSATDGPVRFEGND

SEQ ID NO: 101098 - protein, 33 aa, Artificial Sequence
  Description of Artificial Sequence: Synthetic polypeptide
DEMEIVTTNPVATEQYGTVCSATMGPVEREGND

SEQ ID NO: 101099 - protein, 37 aa, Artificial Sequence
  Description of Artificial Sequence: Synthetic polypeptide
AEEEIRTTNPVATEQYGSVSTTNNNLNQNDEGNNTET

SEQ ID NO: 101100 - protein, 33 aa, Artificial Sequence
  Description of Artificial Sequence: Synthetic polypeptide
DEMEIVTTNPVATEQYGTVCSATKGPNEFEGND

SEQ ID NO: 101101 - protein, 33 aa, Artificial Sequence
  Description of Artificial Sequence: Synthetic polypeptide
DEMEIVTTNPVATEQYGTVCSATINPVEFEGNG

SEQ ID NO: 101102 - protein, 33 aa, Artificial Sequence
  Description of Artificial Sequence: Synthetic polypeptide
DEMEIVTTNPVATEQYGTVCSATINPVEFEGND

SEQ ID NO: 101103 - protein, 33 aa, Artificial Sequence
  Description of Artificial Sequence: Synthetic polypeptide
DEMEIVTTNPVATEQYGTVCSATIGPVQFEGND

SEQ ID NO: 101104 - protein, 36 aa, Artificial Sequence
  Description of Artificial Sequence: Synthetic polypeptide
AEEEIRTTNPVATEQYGSVSTTNNNLNQGEGETEED

SEQ ID NO: 101105 - protein, 32 aa, Artificial Sequence
  Description of Artificial Sequence: Synthetic polypeptide
DETEIATTNPVAYEQYGSVSNNPQNHAEMNQW

SEQ ID NO: 101106 - protein, 32 aa, Artificial Sequence
  Description of Artificial Sequence: Synthetic polypeptide
DEMEIVTTNPVATEQYGTVCSATGPVMFEGND

SEQ ID NO: 101107 - protein, 34 aa, Artificial Sequence
  Description of Artificial Sequence: Synthetic polypeptide
DEMEIVTTNPVATEQYGTVCSATNGLPVEFEGND

SEQ ID NO: 101108 - protein, 33 aa, Artificial Sequence
  Description of Artificial Sequence: Synthetic polypeptide
NEEEIRTTNPVATEQYGCSCSTGELQYFQSQQA

SEQ ID NO: 101109 - protein, 36 aa, Artificial Sequence
  Description of Artificial Sequence: Synthetic polypeptide
AEEEIRTTNPVATEQYGSVSTTNNNLNNGNQEANTD

SEQ ID NO: 101110 - protein, 32 aa, Artificial Sequence
  Description of Artificial Sequence: Synthetic polypeptide
DEMEIVTTNPVATEQYGTVCSATGPVEFEGND

SEQ ID NO: 101111 - protein, 35 aa, Artificial Sequence
  Description of Artificial Sequence: Synthetic polypeptide
AEEEIRTTNPVATEQYGSVSTTNNNLNNEGETDED

SEQ ID NO: 101112 - protein, 32 aa, Artificial Sequence
  Description of Artificial Sequence: Synthetic polypeptide
DEMEIVTTNPVATEQYGTVCSATGPPEFEGND

SEQ ID NO: 101113 - protein, 36 aa, Artificial Sequence
  Description of Artificial Sequence: Synthetic polypeptide
AEEEIRTTNPVATEQYGSVSTTNNNLGQEIGEEDED

SEQ ID NO: 101114 - protein, 31 aa, Artificial Sequence
  Description of Artificial Sequence: Synthetic polypeptide
DEMEIVTTNPVATEQYGTVCSATGPMAEEND

SEQ ID NO: 101115 - protein, 37 aa, Artificial Sequence
  Description of Artificial Sequence: Synthetic polypeptide
AEEEIRTTNPVATEQYGSVSTTNNNLEQGTTEQGNTE

SEQ ID NO: 101116 - protein, 37 aa, Artificial Sequence
  Description of Artificial Sequence: Synthetic polypeptide
AEEEIRTTNPVATEQYGSVSTTNNNLEQGTEQGNEET

SEQ ID NO: 101117 - protein, 31 aa, Artificial Sequence
  Description of Artificial Sequence: Synthetic polypeptide
DEMEIVTTNPVATEQYGTVCSATGPEAEEND

SEQ ID NO: 101118 - protein, 32 aa, Artificial Sequence
  Description of Artificial Sequence: Synthetic polypeptide
DEMEIVTTNPVATEQYGTVCSATGPVEHEGND

SEQ ID NO: 101119 - protein, 33 aa, Artificial Sequence
  Description of Artificial Sequence: Synthetic polypeptide
NEEEIRTTNPVATEQYGCSCSTEHQYFQSDNQA

SEQ ID NO: 101120 - protein, 33 aa, Artificial Sequence
  Description of Artificial Sequence: Synthetic polypeptide
DEMEIVTTNPVATEQYGTVCSATNGPVEFEGND

SEQ ID NO: 101121 - protein, 33 aa, Artificial Sequence
  Description of Artificial Sequence: Synthetic polypeptide
DETEIATTNPVAYEQYGSVSNGNPQQPRPGVDE

SEQ ID NO: 101122 - protein, 32 aa, Artificial Sequence
  Description of Artificial Sequence: Synthetic polypeptide
DEMEIVTTNPVATEQYGTVCSQTDGPEFEGND

SEQ ID NO: 101123 - protein, 37 aa, Artificial Sequence
  Description of Artificial Sequence: Synthetic polypeptide
AEEEIRTTNPVATEQYGSVSTTNNNLQLGNQGDGNGN

SEQ ID NO: 101124 - protein, 36 aa, Artificial Sequence
  Description of Artificial Sequence: Synthetic polypeptide
AEEEIRTTNPVATEQYGSVSTTNNNLQGTNNNNQLF

SEQ ID NO: 101125 - protein, 32 aa, Artificial Sequence
  Description of Artificial Sequence: Synthetic polypeptide
DEMEIVTTNPVATEQYGTVCSPTDGPVEFGND

SEQ ID NO: 101126 - protein, 33 aa, Artificial Sequence
  Description of Artificial Sequence: Synthetic polypeptide
DEMEIVTTNPVATEQYGTVCSNTMEPNAFFGND

SEQ ID NO: 101127 - protein, 36 aa, Artificial Sequence
  Description of Artificial Sequence: Synthetic polypeptide
AEEEIRTTNPVATEQYGSVSTTNNNLQGTNNNNQEF

SEQ ID NO: 101128 - protein, 33 aa, Artificial Sequence
  Description of Artificial Sequence: Synthetic polypeptide
DETEIATTNPVAYEQYGSVATNLQGTPDGMDGN

SEQ ID NO: 101129 - protein, 34 aa, Artificial Sequence
  Description of Artificial Sequence: Synthetic polypeptide
DETEIATTNPVAYEQYGSVSAANNLQEAGENMIE

SEQ ID NO: 101130 - protein, 33 aa, Artificial Sequence
  Description of Artificial Sequence: Synthetic polypeptide
DEMEIVTTNPVATEQYGTVCSNTGEPNEYEGNQ

SEQ ID NO: 101131 - protein, 35 aa, Artificial Sequence
  Description of Artificial Sequence: Synthetic polypeptide
AEEEIRTTNPVATEQYGSVSTTNNNLNQNETETED

SEQ ID NO: 101132 - protein, 33 aa, Artificial Sequence
  Description of Artificial Sequence: Synthetic polypeptide
DEMEIVTTNPVATEQYGTVCSMTDGPGEQEGND

SEQ ID NO: 101133 - protein, 32 aa, Artificial Sequence
  Description of Artificial Sequence: Synthetic polypeptide
DETEIATTNPVAYEQYGSVSAGNLDRNPPLDE

SEQ ID NO: 101134 - protein, 33 aa, Artificial Sequence
  Description of Artificial Sequence: Synthetic polypeptide
DEMEIVTTNPVATEQYGTVCSETDLPVEFEGND

SEQ ID NO: 101135 - protein, 32 aa, Artificial Sequence
  Description of Artificial Sequence: Synthetic polypeptide
DEMEIVTTNPVATEQYGTVCSEDGPVQFEGND

SEQ ID NO: 101136 - protein, 37 aa, Artificial Sequence
  Description of Artificial Sequence: Synthetic polypeptide
AEEEIRTTNPVATEQYGSVSTTNNNLQAGTDEGNNED

SEQ ID NO: 101137 - protein, 33 aa, Artificial Sequence
  Description of Artificial Sequence: Synthetic polypeptide
DEMEIVTTNPVATEQYGTVCSATWGPVEQEGND

SEQ ID NO: 101138 - protein, 33 aa, Artificial Sequence
  Description of Artificial Sequence: Synthetic polypeptide
DEMEIVTTNPVATEQYGTVCSATPAGVERNGND

SEQ ID NO: 101139 - protein, 33 aa, Artificial Sequence
  Description of Artificial Sequence: Synthetic polypeptide
DEMEIVTTNPVATEQYGTVCSATPAGPERNGND

SEQ ID NO: 101140 - protein, 33 aa, Artificial Sequence
  Description of Artificial Sequence: Synthetic polypeptide
NEEEIRTTNPVATEQYGCSCSTMELQHFQSDQS

SEQ ID NO: 101141 - protein, 37 aa, Artificial Sequence
  Description of Artificial Sequence: Synthetic polypeptide
AEEEIRTTNPVATEQYGSVSTTNNNLQAGEIGTNTDQ

SEQ ID NO: 101142 - protein, 37 aa, Artificial Sequence
  Description of Artificial Sequence: Synthetic polypeptide
AEEEIRTTNPVATEQYGSVSTTNNNLQGEEQGTTNDD

SEQ ID NO: 101143 - protein, 37 aa, Artificial Sequence
  Description of Artificial Sequence: Synthetic polypeptide
AEEEIRTTNPVATEQYGSVSTTNNNLEQGTDEAGNEE

SEQ ID NO: 101144 - protein, 35 aa, Artificial Sequence
  Description of Artificial Sequence: Synthetic polypeptide
AEEEIRTTNPVATEQYGSVSTTNNNINDEQGNNDQ

SEQ ID NO: 101145 - protein, 33 aa, Artificial Sequence
  Description of Artificial Sequence: Synthetic polypeptide
DEMEIVTTNPVATEQYGTVCSATGLVEDHEGND

SEQ ID NO: 101146 - protein, 34 aa, Artificial Sequence
  Description of Artificial Sequence: Synthetic polypeptide
AEEEIRTTNPVATEQYGSVVVVVTNNQQEDEEND

SEQ ID NO: 101147 - protein, 35 aa, Artificial Sequence
  Description of Artificial Sequence: Synthetic polypeptide
AEEEIRTTNPVATEQYGSVVVVVTNQLGGNQGNEE

SEQ ID NO: 101148 - protein, 35 aa, Artificial Sequence
  Description of Artificial Sequence: Synthetic polypeptide
AEEEIRTTNPVATEQYGSVSTTNNMEQGTNNVTEM

SEQ ID NO: 101149 - protein, 36 aa, Artificial Sequence
  Description of Artificial Sequence: Synthetic polypeptide
AEEEIRTTNPVATEQYGSVSTTNNLSQGNNNINTND

SEQ ID NO: 101150 - protein, 36 aa, Artificial Sequence
  Description of Artificial Sequence: Synthetic polypeptide
AEEEIRTTNPVATEQYGSVSTTNNLQYGTEQGTQTN

SEQ ID NO: 101151 - protein, 37 aa, Artificial Sequence
  Description of Artificial Sequence: Synthetic polypeptide
AEEEIRTTNPVATEQYGSVSTTNNLQSGTDQGTNEVE

SEQ ID NO: 101152 - protein, 33 aa, Artificial Sequence
  Description of Artificial Sequence: Synthetic polypeptide
DEMEIVTTNPVATEQYGTVCSATDLPVTFEGND

SEQ ID NO: 101153 - protein, 33 aa, Artificial Sequence
  Description of Artificial Sequence: Synthetic polypeptide
DEMEIVTTNPVATEQYGTVCSATDLPVEFEGND

SEQ ID NO: 101154 - protein, 33 aa, Artificial Sequence
  Description of Artificial Sequence: Synthetic polypeptide
DEMEIVTTNPVATEQYGTVCSATDKLVEFEGND

SEQ ID NO: 101155 - protein, 35 aa, Artificial Sequence
  Description of Artificial Sequence: Synthetic polypeptide
NEEEIRTTNPVATEQWGSTVSYAGNLSDEPGGNRS

SEQ ID NO: 101156 - protein, 32 aa, Artificial Sequence
  Description of Artificial Sequence: Synthetic polypeptide
DEMEIVTTNPVATEQYGTVCSATDIPEFEGND

SEQ ID NO: 101157 - protein, 33 aa, Artificial Sequence
  Description of Artificial Sequence: Synthetic polypeptide
DEMEIVTTNPVATEQYGTVCSATDGYVLFEGND

SEQ ID NO: 101158 - protein, 31 aa, Artificial Sequence
  Description of Artificial Sequence: Synthetic polypeptide
SEEEIRGTNPAATEQYGSVNSEGGMGGNGGG

SEQ ID NO: 101159 - protein, 33 aa, Artificial Sequence
  Description of Artificial Sequence: Synthetic polypeptide
AESEIACTNPVATEQYGETAPSENLSQRGGGNR

SEQ ID NO: 101160 - protein, 34 aa, Artificial Sequence
  Description of Artificial Sequence: Synthetic polypeptide
NEEEIRTTNPVATEAYGSVSTVGNGEDEFGNDTT

SEQ ID NO: 101161 - protein, 34 aa, Artificial Sequence
  Description of Artificial Sequence: Synthetic polypeptide
NEEEIRTTNPVATEAYGSVSTAGNGEDEFQGNTT

SEQ ID NO: 101162 - protein, 35 aa, Artificial Sequence
  Description of Artificial Sequence: Synthetic polypeptide
NEEEIRTTNPVATEAWGSVCSKTNDDLDQRNANDQ

SEQ ID NO: 101163 - protein, 33 aa, Artificial Sequence
  Description of Artificial Sequence: Synthetic polypeptide
DEMEIVTTNPVATEQYGTVCSATDGQVEFEGND

SEQ ID NO: 101164 - protein, 33 aa, Artificial Sequence
  Description of Artificial Sequence: Synthetic polypeptide
DEMEIVTTNPVATEQYGTVCSATDGQVEFEGNC

SEQ ID NO: 101165 - protein, 32 aa, Artificial Sequence
  Description of Artificial Sequence: Synthetic polypeptide
DEMEIVTTNPVATEQYGTVCSATDGPVWFGND

SEQ ID NO: 101166 - protein, 36 aa, Artificial Sequence
  Description of Artificial Sequence: Synthetic polypeptide
AEEEIRTTNPVATEQYGSVSTTNNLQSGTDQGSTVE

SEQ ID NO: 101167 - protein, 33 aa, Artificial Sequence
  Description of Artificial Sequence: Synthetic polypeptide
DEMEIVTTNPVATEQYGTVCSATDNPPEFEGND

SEQ ID NO: 101168 - protein, 33 aa, Artificial Sequence
  Description of Artificial Sequence: Synthetic polypeptide
DEMEIVTTNPVATEQYGTVCSATDNPVCFEGND

SEQ ID NO: 101169 - protein, 33 aa, Artificial Sequence
  Description of Artificial Sequence: Synthetic polypeptide
DEMEIVTTNPVATEQYGTVCSATDNPVEFEGND

SEQ ID NO: 101170 - protein, 33 aa, Artificial Sequence
  Description of Artificial Sequence: Synthetic polypeptide
DEMEIVTTNPVATEQYGTVCSATGLPVEFEGND

SEQ ID NO: 101171 - protein, 32 aa, Artificial Sequence
  Description of Artificial Sequence: Synthetic polypeptide
DEMEIVTTNPVATEQYGTVCSATGEVEFEGND

SEQ ID NO: 101172 - protein, 33 aa, Artificial Sequence
  Description of Artificial Sequence: Synthetic polypeptide
DEMEIVTTNPVATEQYGTVCSATEGPREFEGND

SEQ ID NO: 101173 - protein, 33 aa, Artificial Sequence
  Description of Artificial Sequence: Synthetic polypeptide
DEMEIVTTNPVATEQYGTVCSATEDPVQFEGND

SEQ ID NO: 101174 - protein, 33 aa, Artificial Sequence
  Description of Artificial Sequence: Synthetic polypeptide
DEMEIVTTNPVATEQYGTVCSATEDPQQFEGND

SEQ ID NO: 101175 - protein, 32 aa, Artificial Sequence
  Description of Artificial Sequence: Synthetic polypeptide
NEEEIRTTNPVATEQYGCSCSTEHQHFQSQQA

SEQ ID NO: 101176 - protein, 33 aa, Artificial Sequence
  Description of Artificial Sequence: Synthetic polypeptide
DEMEIVTTNPVATEQYGTVCSATDTPESFEGNR

SEQ ID NO: 101177 - protein, 32 aa, Artificial Sequence
  Description of Artificial Sequence: Synthetic polypeptide
DEMEIVTTNPVATEQYGTVCSATDPVEFEGND

SEQ ID NO: 101178 - protein, 33 aa, Artificial Sequence
  Description of Artificial Sequence: Synthetic polypeptide
NEEEIRTTNPVATEQYGCSCSNTEDQNFQSDQS

SEQ ID NO: 101179 - protein, 36 aa, Artificial Sequence
  Description of Artificial Sequence: Synthetic polypeptide
AEEEIRTTNPVATEQYGSVSTTNNNDQSGNNNNEQD

SEQ ID NO: 101180 - protein, 36 aa, Artificial Sequence
  Description of Artificial Sequence: Synthetic polypeptide
AEEEIRTTNPVATEQYGSVSTTNNNDQQGNGNNDEG

SEQ ID NO: 101181 - protein, 33 aa, Artificial Sequence
  Description of Artificial Sequence: Synthetic polypeptide
DEMEIVTTNPVATEQYGTVCSATDNPVMFEGND

SEQ ID NO: 101182 - protein, 33 aa, Artificial Sequence
  Description of Artificial Sequence: Synthetic polypeptide
DEMEIVTTNPVATEQYGTVCSATDNPVESEGND

SEQ ID NO: 101183 - protein, 36 aa, Artificial Sequence
  Description of Artificial Sequence: Synthetic polypeptide
AEEEIRTTNPVATEQYGSVVVVVTNNNLQAGNDEGQ

SEQ ID NO: 101184 - protein, 33 aa, Artificial Sequence
  Description of Artificial Sequence: Synthetic polypeptide
DEMEIVTTNPVATEQYGTVCSATDNPVEFNGND

SEQ ID NO: 101185 - protein, 32 aa, Artificial Sequence
  Description of Artificial Sequence: Synthetic polypeptide
DETEIATTNPVGTEQYGTVSWNELDNRAGDAP

SEQ ID NO: 101186 - protein, 36 aa, Artificial Sequence
  Description of Artificial Sequence: Synthetic polypeptide
AEEEIRTTNPVATEQYGSVVVVVTNNNLQTGEENDE

SEQ ID NO: 101187 - protein, 35 aa, Artificial Sequence
  Description of Artificial Sequence: Synthetic polypeptide
AEEEIRTTNPVATEQYGSVSTTNNNAITEQGNNGT

SEQ ID NO: 101188 - protein, 32 aa, Artificial Sequence
  Description of Artificial Sequence: Synthetic polypeptide
DETEIATTNPVSTEQYGSVSWNEMDRQGMDSP

SEQ ID NO: 101189 - protein, 35 aa, Artificial Sequence
  Description of Artificial Sequence: Synthetic polypeptide
AEEEIRTTNPVATEQYGSVSTTNNNAITEQGNNDG

SEQ ID NO: 101190 - protein, 29 aa, Artificial Sequence
  Description of Artificial Sequence: Synthetic peptide
DETEIATVNPVATEQWGATADDLQPKGNQ

SEQ ID NO: 101191 - protein, 36 aa, Artificial Sequence
  Description of Artificial Sequence: Synthetic polypeptide
AEEEIRTTNPVATEQYGSVSTTNNQLLGNSTGEETN

SEQ ID NO: 101192 - protein, 35 aa, Artificial Sequence
  Description of Artificial Sequence: Synthetic polypeptide
NEEEIATTNPVATEQYGSVCAADNNLADRDGNDRH

SEQ ID NO: 101193 - protein, 36 aa, Artificial Sequence
  Description of Artificial Sequence: Synthetic polypeptide
AEEEIRTTNPVATEQYGSVSTTNNQLNENDEGTNTN

SEQ ID NO: 101194 - protein, 33 aa, Artificial Sequence
  Description of Artificial Sequence: Synthetic polypeptide
DENEAEISTTNPVAYEQWGSVATNLQGEDREDA

SEQ ID NO: 101195 - protein, 37 aa, Artificial Sequence
  Description of Artificial Sequence: Synthetic polypeptide
AEEEIRTTNPVATEQYGSVSTTNQQLQQGNNNDNNND

SEQ ID NO: 101196 - protein, 32 aa, Artificial Sequence
  Description of Artificial Sequence: Synthetic polypeptide
DETEIACTNPVATEQYGCVATNLQMAEGGEED

SEQ ID NO: 101197 - protein, 32 aa, Artificial Sequence
  Description of Artificial Sequence: Synthetic polypeptide
DETEIACTNPVATEQYGCVATNLQQDDQNTEM

SEQ ID NO: 101198 - protein, 36 aa, Artificial Sequence
  Description of Artificial Sequence: Synthetic polypeptide
AEEEIRTTNPVATEQYGSVSTTNQQLQQGDEETEEV

SEQ ID NO: 101199 - protein, 37 aa, Artificial Sequence
  Description of Artificial Sequence: Synthetic polypeptide
AEEEIRTTNPVATEQYGSVSTTNQQLQNGTEGGNTED

SEQ ID NO: 101200 - protein, 33 aa, Artificial Sequence
  Description of Artificial Sequence: Synthetic polypeptide
DETEIACTNPVATEQYGSACSATNDIPQDNGNQ

SEQ ID NO: 101201 - protein, 36 aa, Artificial Sequence
  Description of Artificial Sequence: Synthetic polypeptide
AEEEIRTTNPVATEQYGSVSTTNQQLQGATNPNNTE

SEQ ID NO: 101202 - protein, 37 aa, Artificial Sequence
  Description of Artificial Sequence: Synthetic polypeptide
AEEEIRTTNPVATEQYGSVSTTNQQLNQQIGTNSEDE

SEQ ID NO: 101203 - protein, 37 aa, Artificial Sequence
  Description of Artificial Sequence: Synthetic polypeptide
AEEEIRTTNPVATEQYGSVSTTNQQLLQQIGTNSEES

SEQ ID NO: 101204 - protein, 32 aa, Artificial Sequence
  Description of Artificial Sequence: Synthetic polypeptide
DETEIACTNPVATEQYGCVATNLQGAAAENGA

SEQ ID NO: 101205 - protein, 32 aa, Artificial Sequence
  Description of Artificial Sequence: Synthetic polypeptide
DENEIATTNPVATECYGSVSCICLPQDHGEEG

SEQ ID NO: 101206 - protein, 33 aa, Artificial Sequence
  Description of Artificial Sequence: Synthetic polypeptide
DENEIATTNPVATECYGSVSCICLPQDHEGENG

SEQ ID NO: 101207 - protein, 30 aa, Artificial Sequence
  Description of Artificial Sequence: Synthetic polypeptide
DENEIATTNPVATECYGSVSCCEPQDHEEL

SEQ ID NO: 101208 - protein, 32 aa, Artificial Sequence
  Description of Artificial Sequence: Synthetic polypeptide
DENEIATTNPVATECYGSVSATDLEDHEGEDL

SEQ ID NO: 101209 - protein, 36 aa, Artificial Sequence
  Description of Artificial Sequence: Synthetic polypeptide
AEEEIRTTNPVATEQYGSVSTTNQQLGNEQGTNQVG

SEQ ID NO: 101210 - protein, 30 aa, Artificial Sequence
  Description of Artificial Sequence: Synthetic polypeptide
DENEIATTNPVATECYGSVSAECLEDHEEL

SEQ ID NO: 101211 - protein, 31 aa, Artificial Sequence
  Description of Artificial Sequence: Synthetic polypeptide
DENEIATTNPVATECYGDVSTPALQMHEEPV

SEQ ID NO: 101212 - protein, 34 aa, Artificial Sequence
  Description of Artificial Sequence: Synthetic polypeptide
NEEEIRTTNPVATEQYGSYGVMELNQRGQGGENE

SEQ ID NO: 101213 - protein, 34 aa, Artificial Sequence
  Description of Artificial Sequence: Synthetic polypeptide
NEEEIRTTNPVATEQYGSYGVDEMDQRGQGGENG

SEQ ID NO: 101214 - protein, 35 aa, Artificial Sequence
  Description of Artificial Sequence: Synthetic polypeptide
NEEEIRTTNPVATEQYGSVYSTVEDNQRSGQEDIF

SEQ ID NO: 101215 - protein, 36 aa, Artificial Sequence
  Description of Artificial Sequence: Synthetic polypeptide
AEEEIRTTNPVATEQYGSVVVTVTTNGNLQQGTNIS

SEQ ID NO: 101216 - protein, 36 aa, Artificial Sequence
  Description of Artificial Sequence: Synthetic polypeptide
AEEEIRTTNPVATEQYGSVSTTNQQGNSEQGTNQSE

SEQ ID NO: 101217 - protein, 32 aa, Artificial Sequence
  Description of Artificial Sequence: Synthetic polypeptide
DETEIACTNPVATEQYGCVATNLQDTDGMTAG

SEQ ID NO: 101218 - protein, 31 aa, Artificial Sequence
  Description of Artificial Sequence: Synthetic polypeptide
DETEIACTNPVATEQYGCVATNLQAEDDTGV

SEQ ID NO: 101219 - protein, 31 aa, Artificial Sequence
  Description of Artificial Sequence: Synthetic polypeptide
NEEEIRTTNPVAYEQWGSLSCFEHEHRQGDR

SEQ ID NO: 101220 - protein, 35 aa, Artificial Sequence
  Description of Artificial Sequence: Synthetic polypeptide
AEEEIRTTNPVATEQYGSVSTTNQQQQQNANNNVD

SEQ ID NO: 101221 - protein, 33 aa, Artificial Sequence
  Description of Artificial Sequence: Synthetic polypeptide
DETDEIATTNPVAYEQWGSVSTNLNMGEGNTND

SEQ ID NO: 101222 - protein, 30 aa, Artificial Sequence
  Description of Artificial Sequence: Synthetic polypeptide
DETDIRTTNPCAHEQWGSVSPVNEVSVGTR

SEQ ID NO: 101223 - protein, 29 aa, Artificial Sequence
  Description of Artificial Sequence: Synthetic peptide
DETEIACTNPIATEQWGEASEENWQPGGR

SEQ ID NO: 101224 - protein, 33 aa, Artificial Sequence
  Description of Artificial Sequence: Synthetic polypeptide
DENEIATTNPVATECYGSVSTPAGNMHNGMNPL

SEQ ID NO: 101225 - protein, 36 aa, Artificial Sequence
  Description of Artificial Sequence: Synthetic polypeptide
AEEEIRTTNPVATEQYGSVSTTNQQQQGTNGTNDED

SEQ ID NO: 101226 - protein, 36 aa, Artificial Sequence
  Description of Artificial Sequence: Synthetic polypeptide
AEEEIRTTNPVATEQYGSVSTTNQQQQGNNGTTEQG

SEQ ID NO: 101227 - protein, 33 aa, Artificial Sequence
  Description of Artificial Sequence: Synthetic polypeptide
DETEIACTNPVATEAYGSVATNLQNNPGENAEN

SEQ ID NO: 101228 - protein, 36 aa, Artificial Sequence
  Description of Artificial Sequence: Synthetic polypeptide
AEEEIRTTNPVATEQYGSVSTTNQQNNSEQGTNVDE

SEQ ID NO: 101229 - protein, 31 aa, Artificial Sequence
  Description of Artificial Sequence: Synthetic polypeptide
NEEEIRTTNPVAYEHWGCFSWINDSQRNGER

SEQ ID NO: 101230 - protein, 36 aa, Artificial Sequence
  Description of Artificial Sequence: Synthetic polypeptide
AEEEIRTTNPVATEQYGSVSTTNQQQLQQIGTDEQQ

SEQ ID NO: 101231 - protein, 37 aa, Artificial Sequence
  Description of Artificial Sequence: Synthetic polypeptide
AEEEIRTTNPVATEQYGSVSTTNQQQLQQGTEQGNTD

SEQ ID NO: 101232 - protein, 36 aa, Artificial Sequence
  Description of Artificial Sequence: Synthetic polypeptide
AEEEIRTTNPVATEQYGSVVVTVTNTGNLQQGTNIV

SEQ ID NO: 101233 - protein, 36 aa, Artificial Sequence
  Description of Artificial Sequence: Synthetic polypeptide
AEEEIRTTNPVATEQYGSVVVTVTQNGNLQQGTNNM

SEQ ID NO: 101234 - protein, 36 aa, Artificial Sequence
  Description of Artificial Sequence: Synthetic polypeptide
AEEEIRTTNPVATEQYGSVSTTNQQQGNEQGTEDED

SEQ ID NO: 101235 - protein, 32 aa, Artificial Sequence
  Description of Artificial Sequence: Synthetic polypeptide
DETEIACTNPVATEQWGSVAMNLQDQGNNTEN

SEQ ID NO: 101236 - protein, 32 aa, Artificial Sequence
  Description of Artificial Sequence: Synthetic polypeptide
DETEIACTNPVATEQWGSVASGALQTADGNES

SEQ ID NO: 101237 - protein, 35 aa, Artificial Sequence
  Description of Artificial Sequence: Synthetic polypeptide
AEEEIRTTNPVATEQYGSVVVTVTQNGNQQGTNGQ

SEQ ID NO: 101238 - protein, 34 aa, Artificial Sequence
  Description of Artificial Sequence: Synthetic polypeptide
NEEEIRTTNPVATERYGVVSCPTELSTTNGGNNR

SEQ ID NO: 101239 - protein, 29 aa, Artificial Sequence
  Description of Artificial Sequence: Synthetic peptide
DETEIACTNPVATEQWGAASANWAPGGYR

SEQ ID NO: 101240 - protein, 31 aa, Artificial Sequence
  Description of Artificial Sequence: Synthetic polypeptide
NEEEIRTTNPVAYEQWGSLSCFEHTQRQGED

SEQ ID NO: 101241 - protein, 36 aa, Artificial Sequence
  Description of Artificial Sequence: Synthetic polypeptide
AEEEIRTTNPVATEQYGSVSTTNQQGNQQIGNNNQD

SEQ ID NO: 101242 - protein, 34 aa, Artificial Sequence
  Description of Artificial Sequence: Synthetic polypeptide
NEEEIRTTNPVATEQYGSVSVAGNTGEDEFGNTG

SEQ ID NO: 101243 - protein, 30 aa, Artificial Sequence
  Description of Artificial Sequence: Synthetic polypeptide
DETEIATTNPIATEQWGETWSEENWQPGGR

SEQ ID NO: 101244 - protein, 36 aa, Artificial Sequence
  Description of Artificial Sequence: Synthetic polypeptide
AEEEIRTTNPVATEQYGSVSTTNQNQENQNGTNATN

SEQ ID NO: 101245 - protein, 30 aa, Artificial Sequence
  Description of Artificial Sequence: Synthetic polypeptide
DETEIATTNPICTECYGAVWADNLQPKGNQ

SEQ ID NO: 101246 - protein, 31 aa, Artificial Sequence
  Description of Artificial Sequence: Synthetic polypeptide
DETEIATTNPVATAQWGCVATALTQDGNTDM

SEQ ID NO: 101247 - protein, 36 aa, Artificial Sequence
  Description of Artificial Sequence: Synthetic polypeptide
NEEEIRTTNPVATEQYGSVSPNLNMMMQEEGEENVN

SEQ ID NO: 101248 - protein, 36 aa, Artificial Sequence
  Description of Artificial Sequence: Synthetic polypeptide
AEEEIRTTNPVATEQYGSVSTTNQNNQQENGNNTED

SEQ ID NO: 101249 - protein, 36 aa, Artificial Sequence
  Description of Artificial Sequence: Synthetic polypeptide
AEEEIRTTNPVATEQYGSVVVVSTDNNNQQIGTNNE

SEQ ID NO: 101250 - protein, 30 aa, Artificial Sequence
  Description of Artificial Sequence: Synthetic polypeptide
DENEIATTNPVATECYGDVSECLQDHEEEL

SEQ ID NO: 101251 - protein, 36 aa, Artificial Sequence
  Description of Artificial Sequence: Synthetic polypeptide
AEEEIRTTNPVATEQYGSVSTTNQNNQGEIGNNDED

SEQ ID NO: 101252 - protein, 30 aa, Artificial Sequence
  Description of Artificial Sequence: Synthetic polypeptide
DETEIATTNPIATEQWGEAWSEENWQPGGR

SEQ ID NO: 101253 - protein, 29 aa, Artificial Sequence
  Description of Artificial Sequence: Synthetic peptide
DENEIATTNPVATECYGDVSECLMAAEEL

SEQ ID NO: 101254 - protein, 29 aa, Artificial Sequence
  Description of Artificial Sequence: Synthetic peptide
DENEIATTNPVATECYGDVSECIQQHEEH

SEQ ID NO: 101255 - protein, 29 aa, Artificial Sequence
  Description of Artificial Sequence: Synthetic peptide
DENEIATTNPVATECYGDVSECIQHNEEL

SEQ ID NO: 101256 - protein, 36 aa, Artificial Sequence
  Description of Artificial Sequence: Synthetic polypeptide
AEEEIRTTNPVATEQYGSVVVVSTDQNQQGIGTNLQ

SEQ ID NO: 101257 - protein, 35 aa, Artificial Sequence
  Description of Artificial Sequence: Synthetic polypeptide
AEEEIRTTNPVATEQYGSVSTTNQNLQQNEDEQED

SEQ ID NO: 101258 - protein, 32 aa, Artificial Sequence
  Description of Artificial Sequence: Synthetic polypeptide
DETEIATTNPVATECYGSVSATDLEDHKGEDL

SEQ ID NO: 101259 - protein, 34 aa, Artificial Sequence
  Description of Artificial Sequence: Synthetic polypeptide
NEEEIRTTNPVATEQYGSVSNAWNLDEFDESQRE

SEQ ID NO: 101260 - protein, 31 aa, Artificial Sequence
  Description of Artificial Sequence: Synthetic polypeptide
DENEIATTNPVATECYGDVSCCLPQHEGEEL

SEQ ID NO: 101261 - protein, 36 aa, Artificial Sequence
  Description of Artificial Sequence: Synthetic polypeptide
AEEEIRTTNPVATEQYGSVSTTNQNGNQEQGTENDE

SEQ ID NO: 101262 - protein, 30 aa, Artificial Sequence
  Description of Artificial Sequence: Synthetic polypeptide
DENEIATTNPVATECYGDVSCCLPQHEEEG

SEQ ID NO: 101263 - protein, 29 aa, Artificial Sequence
  Description of Artificial Sequence: Synthetic peptide
DENEIATTNPVATECYGDVSECLMAAEEA

SEQ ID NO: 101264 - protein, 36 aa, Artificial Sequence
  Description of Artificial Sequence: Synthetic polypeptide
AEEEIRTTNPVATEQYGSVSTTNQQGNGDEAGNEDE

SEQ ID NO: 101265 - protein, 29 aa, Artificial Sequence
  Description of Artificial Sequence: Synthetic peptide
DETEIATTNPCSTEQYGIVAANWASKGTR

SEQ ID NO: 101266 - protein, 36 aa, Artificial Sequence
  Description of Artificial Sequence: Synthetic polypeptide
AEEEIRTTNPVATEQYGSVSTTNQNQQNQIGTNAND

SEQ ID NO: 101267 - protein, 36 aa, Artificial Sequence
  Description of Artificial Sequence: Synthetic polypeptide
AEEEIRTTNPVATEQYGSVSTTNQQAGTEIGTNEED

SEQ ID NO: 101268 - protein, 29 aa, Artificial Sequence
  Description of Artificial Sequence: Synthetic peptide
DENEIATTNPVATECYGDVSEILMAAEEA

SEQ ID NO: 101269 - protein, 29 aa, Artificial Sequence
  Description of Artificial Sequence: Synthetic peptide
DETEIACTNPVATEQYGSVATPDPAEPGF

SEQ ID NO: 101270 - protein, 32 aa, Artificial Sequence
  Description of Artificial Sequence: Synthetic polypeptide
DETEIACTNPVATEQYGSVATPLEDTPQEDNN

SEQ ID NO: 101271 - protein, 35 aa, Artificial Sequence
  Description of Artificial Sequence: Synthetic polypeptide
AEEEIRTTNPVATEQYGSVSTTNQNQQQQNAEEED

SEQ ID NO: 101272 - protein, 31 aa, Artificial Sequence
  Description of Artificial Sequence: Synthetic polypeptide
DENEIATTNPVATECYGDVSEEDLQQHNEEL

SEQ ID NO: 101273 - protein, 28 aa, Artificial Sequence
  Description of Artificial Sequence: Synthetic peptide
AESEIASTNPVGTEQYGEAAETLQRGDI

SEQ ID NO: 101274 - protein, 31 aa, Artificial Sequence
  Description of Artificial Sequence: Synthetic polypeptide
DENEIATTNPVATECYGDVSEECLQQHNEEL

SEQ ID NO: 101275 - protein, 31 aa, Artificial Sequence
  Description of Artificial Sequence: Synthetic polypeptide
DETEIACTNPVAYEQYGSVATNGTAEDGNPA

SEQ ID NO: 101276 - protein, 36 aa, Artificial Sequence
  Description of Artificial Sequence: Synthetic polypeptide
AEEEIRTTNPVATEQYGSVSTTNQNQQNELGNNDET

SEQ ID NO: 101277 - protein, 35 aa, Artificial Sequence
  Description of Artificial Sequence: Synthetic polypeptide
AEEEIRTTNPVATEQYGSVSTTNQNQQQNAENTED

SEQ ID NO: 101278 - protein, 31 aa, Artificial Sequence
  Description of Artificial Sequence: Synthetic polypeptide
DETEIACTNPVAYEQYGSVATNLAGAPMENN

SEQ ID NO: 101279 - protein, 36 aa, Artificial Sequence
  Description of Artificial Sequence: Synthetic polypeptide
AEEEIRTTNPVATEQYGSVVVTVTTNQGNLQQGTNQ

SEQ ID NO: 101280 - protein, 32 aa, Artificial Sequence
  Description of Artificial Sequence: Synthetic polypeptide
DETEIACTNPVAYEQYGSVATNLQGAPAEGKD

SEQ ID NO: 101281 - protein, 35 aa, Artificial Sequence
  Description of Artificial Sequence: Synthetic polypeptide
AEEEIRTTNPVATEQYGSVVVVNTNDNQQIGTNLE

SEQ ID NO: 101282 - protein, 31 aa, Artificial Sequence
  Description of Artificial Sequence: Synthetic polypeptide
DETEIACTNPVAYEQYGSVATNLTIDGDDLH

SEQ ID NO: 101283 - protein, 29 aa, Artificial Sequence
  Description of Artificial Sequence: Synthetic peptide
DETEIASVNPICTEQYGVVSANWQESGNQ

SEQ ID NO: 101284 - protein, 36 aa, Artificial Sequence
  Description of Artificial Sequence: Synthetic polypeptide
AEEEIRTTNPVATEQYGSVSTTNQNQQNQIGTNEGE

SEQ ID NO: 101285 - protein, 36 aa, Artificial Sequence
  Description of Artificial Sequence: Synthetic polypeptide
AEEEIRTTNPVATEQYGSVVVVNTNGTNLQNGTTNM

SEQ ID NO: 101286 - protein, 34 aa, Artificial Sequence
  Description of Artificial Sequence: Synthetic polypeptide
NEEEIRTTNPVATEQYGSVSSAGNGEDEFGENGF

SEQ ID NO: 101287 - protein, 30 aa, Artificial Sequence
  Description of Artificial Sequence: Synthetic polypeptide
DENEIATTNPVATECYGDVSEECLQEHEEL

SEQ ID NO: 101288 - protein, 35 aa, Artificial Sequence
  Description of Artificial Sequence: Synthetic polypeptide
AEEEIRTTNPVATEQYGSVSTTNQMEQGTNNVTEQ

SEQ ID NO: 101289 - protein, 35 aa, Artificial Sequence
  Description of Artificial Sequence: Synthetic polypeptide
AEEEIRTTNPVATEQYGSVSTTNQQQQQNGTTELG

SEQ ID NO: 101290 - protein, 36 aa, Artificial Sequence
  Description of Artificial Sequence: Synthetic polypeptide
AEEEIRTTNPVATEQYGSVSTTNQQQQQQNGNTETI

SEQ ID NO: 101291 - protein, 37 aa, Artificial Sequence
  Description of Artificial Sequence: Synthetic polypeptide
AEEEIRTTNPVATEQYGSVSTTQNNLQAGTEAGNEEG

SEQ ID NO: 101292 - protein, 29 aa, Artificial Sequence
  Description of Artificial Sequence: Synthetic peptide
DENEIATTNPVATEQWGDASEIEQNAEDR

SEQ ID NO: 101293 - protein, 30 aa, Artificial Sequence
  Description of Artificial Sequence: Synthetic polypeptide
DENEIATTNPVATEPYGTISMDLQQQNGGH

SEQ ID NO: 101294 - protein, 33 aa, Artificial Sequence
  Description of Artificial Sequence: Synthetic polypeptide
DESYIRTTNPVATECWGSVSCINEPQDREGENG

SEQ ID NO: 101295 - protein, 33 aa, Artificial Sequence
  Description of Artificial Sequence: Synthetic polypeptide
DESYIRTTNPVATEFWGSVSCHNEPQDREGENG

SEQ ID NO: 101296 - protein, 30 aa, Artificial Sequence
  Description of Artificial Sequence: Synthetic polypeptide
DENEIATTNPVATEPYGTISEDLQQQNGGH

SEQ ID NO: 101297 - protein, 32 aa, Artificial Sequence
  Description of Artificial Sequence: Synthetic polypeptide
DETAEIACTNPVATEQYGCVATNLQAEAPGEM

SEQ ID NO: 101298 - protein, 33 aa, Artificial Sequence
  Description of Artificial Sequence: Synthetic polypeptide
NEMEIRTTNPVATEQYGSLSVSHNLESYQGDHG

SEQ ID NO: 101299 - protein, 32 aa, Artificial Sequence
  Description of Artificial Sequence: Synthetic polypeptide
NEMEIRTTNPVATEQYGSCSVPNEQEGSEIKA

SEQ ID NO: 101300 - protein, 33 aa, Artificial Sequence
  Description of Artificial Sequence: Synthetic polypeptide
DESYIRTTNPVATECWGSVSCINEPQDREGEND

SEQ ID NO: 101301 - protein, 29 aa, Artificial Sequence
  Description of Artificial Sequence: Synthetic peptide
DENEIATTNPVATEPYGTISEDLQQQEEL

SEQ ID NO: 101302 - protein, 32 aa, Artificial Sequence
  Description of Artificial Sequence: Synthetic polypeptide
DENEIATTNPVATEPYGSVSATEDIQDHNGEL

SEQ ID NO: 101303 - protein, 32 aa, Artificial Sequence
  Description of Artificial Sequence: Synthetic polypeptide
DENEIATTNPVATEPYGSVSATEDIQDHEGEL

SEQ ID NO: 101304 - protein, 31 aa, Artificial Sequence
  Description of Artificial Sequence: Synthetic polypeptide
DETAEIACTNPVAYEQYGSVATNGTAEGGNE

SEQ ID NO: 101305 - protein, 32 aa, Artificial Sequence
  Description of Artificial Sequence: Synthetic polypeptide
DETAEIACTNPVAYEQYGSVATNLQRPAETLH

SEQ ID NO: 101306 - protein, 32 aa, Artificial Sequence
  Description of Artificial Sequence: Synthetic polypeptide
NEMEIRTTNPVATEQYGCVSTLNNNDNEGQDQ

SEQ ID NO: 101307 - protein, 33 aa, Artificial Sequence
  Description of Artificial Sequence: Synthetic polypeptide
DETAEIATTNPVAYEPWGVVASATNLQTEGNPR

SEQ ID NO: 101308 - protein, 31 aa, Artificial Sequence
  Description of Artificial Sequence: Synthetic polypeptide
DETAEIATTNPVAYEPYGSVAAAHDDRGNRQ

SEQ ID NO: 101309 - protein, 31 aa, Artificial Sequence
  Description of Artificial Sequence: Synthetic polypeptide
DETAEIATTNPVAYEPYGSVTAANDDRGNES

SEQ ID NO: 101310 - protein, 32 aa, Artificial Sequence
  Description of Artificial Sequence: Synthetic polypeptide
DENEIATTNPVATEPYGSVSATDLEDHEGEDL

SEQ ID NO: 101311 - protein, 37 aa, Artificial Sequence
  Description of Artificial Sequence: Synthetic polypeptide
AEEEIRTTNPVATEQYGSVSTTQNLGEQIGTTTQNTQ

SEQ ID NO: 101312 - protein, 32 aa, Artificial Sequence
  Description of Artificial Sequence: Synthetic polypeptide
DENEIATTNPVATEPYGSVSATDIQQDQEGEL

SEQ ID NO: 101313 - protein, 29 aa, Artificial Sequence
  Description of Artificial Sequence: Synthetic peptide
DENEIATTNPVATEQWGDVSECEQAAEDA

SEQ ID NO: 101314 - protein, 33 aa, Artificial Sequence
  Description of Artificial Sequence: Synthetic polypeptide
DESWIRTTNPVATECWGSVSCINEPQDREGENG

SEQ ID NO: 101315 - protein, 34 aa, Artificial Sequence
  Description of Artificial Sequence: Synthetic polypeptide
AEEEIRTTNPVATEQYGSVSTTQQLQNDEDEEEV

SEQ ID NO: 101316 - protein, 36 aa, Artificial Sequence
  Description of Artificial Sequence: Synthetic polypeptide
AEEEIRTTNPVATEQYGSVSTTQQLQLQIGTEQGNE

SEQ ID NO: 101317 - protein, 33 aa, Artificial Sequence
  Description of Artificial Sequence: Synthetic polypeptide
NEMEIRTTNPVATEQYGSVTTYVDLQDRDDVQM

SEQ ID NO: 101318 - protein, 30 aa, Artificial Sequence
  Description of Artificial Sequence: Synthetic polypeptide
DENEIATTNPVATEQWGEASENEQNAAGGA

SEQ ID NO: 101319 - protein, 33 aa, Artificial Sequence
  Description of Artificial Sequence: Synthetic polypeptide
NEMEIRTTNPVATEQYGSVSTLNNNDNEGQDGM

SEQ ID NO: 101320 - protein, 36 aa, Artificial Sequence
  Description of Artificial Sequence: Synthetic polypeptide
AEEEIRTTNPVATEQYGSVSTTQQLNQQIGTEEGNE

SEQ ID NO: 101321 - protein, 36 aa, Artificial Sequence
  Description of Artificial Sequence: Synthetic polypeptide
AEEEIRTTNPVATEQYGSVSTTQQLEQEISTEEGNQ

SEQ ID NO: 101322 - protein, 36 aa, Artificial Sequence
  Description of Artificial Sequence: Synthetic polypeptide
AEEEIRTTNPVATEQYGSVSTTQNYGNQIGTNSTEQ

SEQ ID NO: 101323 - protein, 33 aa, Artificial Sequence
  Description of Artificial Sequence: Synthetic polypeptide
AESEIRTTNPVATECWGSVSCINEPQDRRGENG

SEQ ID NO: 101324 - protein, 37 aa, Artificial Sequence
  Description of Artificial Sequence: Synthetic polypeptide
AEEEIRTTNPVATEQYGSVSTTQNNNLQQGTEAGNTD

SEQ ID NO: 101325 - protein, 30 aa, Artificial Sequence
  Description of Artificial Sequence: Synthetic polypeptide
DENEIATTNPVATEQWGDVSTIEENAAGDA

SEQ ID NO: 101326 - protein, 33 aa, Artificial Sequence
  Description of Artificial Sequence: Synthetic polypeptide
AESEIRTTNPVATECWGSVSCINEPQDREGENG

SEQ ID NO: 101327 - protein, 33 aa, Artificial Sequence
  Description of Artificial Sequence: Synthetic polypeptide
AESEIRTTNPVATECWGSVSCINEPQDREGCNG

SEQ ID NO: 101328 - protein, 33 aa, Artificial Sequence
  Description of Artificial Sequence: Synthetic polypeptide
NEMEIRTTNPVATEQYGSVSTLNANNDNEGQDD

SEQ ID NO: 101329 - protein, 29 aa, Artificial Sequence
  Description of Artificial Sequence: Synthetic peptide
DENEIATTNPVATEQWGDVSEILMAAEEA

SEQ ID NO: 101330 - protein, 30 aa, Artificial Sequence
  Description of Artificial Sequence: Synthetic polypeptide
DENEIATTNPVATEQWGDVSEIEQNAAENQ

SEQ ID NO: 101331 - protein, 32 aa, Artificial Sequence
  Description of Artificial Sequence: Synthetic polypeptide
NEMEIRTTNPVATEQYGSLSYQHNLEEYQGQG

SEQ ID NO: 101332 - protein, 33 aa, Artificial Sequence
  Description of Artificial Sequence: Synthetic polypeptide
NEMEIRTTNPVATEQYGSLSVTHNLENSYQGQG

SEQ ID NO: 101333 - protein, 28 aa, Artificial Sequence
  Description of Artificial Sequence: Synthetic peptide
DENEIATTNPVATEQWGDVSEIEMHEDA

SEQ ID NO: 101334 - protein, 29 aa, Artificial Sequence
  Description of Artificial Sequence: Synthetic peptide
DENEIATTNPVATEQWGDVSEIEMAAGDA

SEQ ID NO: 101335 - protein, 31 aa, Artificial Sequence
  Description of Artificial Sequence: Synthetic polypeptide
DESVIRTTNPVAYEQWGCYTIETNDQDGNHR

SEQ ID NO: 101336 - protein, 31 aa, Artificial Sequence
  Description of Artificial Sequence: Synthetic polypeptide
NEEEIRTTNPVAYEQWGSLSPFEDTQRQGMV

SEQ ID NO: 101337 - protein, 36 aa, Artificial Sequence
  Description of Artificial Sequence: Synthetic polypeptide
AEEEIRTTNPVATEQYGSVVVTVTNGNLQQGTNNIM

SEQ ID NO: 101338 - protein, 36 aa, Artificial Sequence
  Description of Artificial Sequence: Synthetic polypeptide
AEEEIRTTNPVATEQYGSVVVTVTNLEQGSEGGNQM

SEQ ID NO: 101339 - protein, 35 aa, Artificial Sequence
  Description of Artificial Sequence: Synthetic polypeptide
NEESIRTTNPVATEQYGSVSCILNHSHRTPGNNIR

SEQ ID NO: 101340 - protein, 36 aa, Artificial Sequence
  Description of Artificial Sequence: Synthetic polypeptide
AEEEIRTTNPVATEQYGSVSTTNTNNQQQGNDENQD

SEQ ID NO: 101341 - protein, 32 aa, Artificial Sequence
  Description of Artificial Sequence: Synthetic polypeptide
DENEIATTNPVATECYGTVCSATDCLVQFGEL

SEQ ID NO: 101342 - protein, 37 aa, Artificial Sequence
  Description of Artificial Sequence: Synthetic polypeptide
AEEEIRTTNPVATEQYGSVSTTNTNLQQGTEEGNNED

SEQ ID NO: 101343 - protein, 37 aa, Artificial Sequence
  Description of Artificial Sequence: Synthetic polypeptide
AEEEIRTTNPVATEQYGSVSTTNTNLEQGTDEGTNED

SEQ ID NO: 101344 - protein, 31 aa, Artificial Sequence
  Description of Artificial Sequence: Synthetic polypeptide
DETCIRTTNPCATEQFGCVCSFELQSFGSNQ

SEQ ID NO: 101345 - protein, 37 aa, Artificial Sequence
  Description of Artificial Sequence: Synthetic polypeptide
AEEEIRTTNPVATEQYGSVSTTNTNLEQGSNQGNNDT

SEQ ID NO: 101346 - protein, 35 aa, Artificial Sequence
  Description of Artificial Sequence: Synthetic polypeptide
AEEEIRTTNPVATEQYGSVVVTVTNNNQEQGSNGQ

SEQ ID NO: 101347 - protein, 35 aa, Artificial Sequence
  Description of Artificial Sequence: Synthetic polypeptide
AEEEIRTTNPVATEQYGSVVVTVTNNNQQGTNGQS

SEQ ID NO: 101348 - protein, 32 aa, Artificial Sequence
  Description of Artificial Sequence: Synthetic polypeptide
NEESIRTTNPVAYEWYGSVNTNWQRVVAEQRH

SEQ ID NO: 101349 - protein, 35 aa, Artificial Sequence
  Description of Artificial Sequence: Synthetic polypeptide
AEEEIRTTNPVATEQYGSVVVTVTNNQQQGTNGQQ

SEQ ID NO: 101350 - protein, 35 aa, Artificial Sequence
  Description of Artificial Sequence: Synthetic polypeptide
NEEEIRTTNPVAYEQYGESPSETDNLVQNPGMEVR

SEQ ID NO: 101351 - protein, 35 aa, Artificial Sequence
  Description of Artificial Sequence: Synthetic polypeptide
NEEEIRTTNPVAYEQYGCTVQACTAHLSQRLSGNR

SEQ ID NO: 101352 - protein, 36 aa, Artificial Sequence
  Description of Artificial Sequence: Synthetic polypeptide
AEEEIRTTNPVATEQYGSVSTTNSNGNNNEQAGNVE

SEQ ID NO: 101353 - protein, 36 aa, Artificial Sequence
  Description of Artificial Sequence: Synthetic polypeptide
AEEEIRTTNPVATEQYGSVSTTNQQYGNNNIGTNMD

SEQ ID NO: 101354 - protein, 33 aa, Artificial Sequence
  Description of Artificial Sequence: Synthetic polypeptide
DETCIRTTNPLATEQFGSVCSSGNLQSFGSNQS

SEQ ID NO: 101355 - protein, 31 aa, Artificial Sequence
  Description of Artificial Sequence: Synthetic polypeptide
AESEIRCTNPVATECWGSVSCNEPQDREGGG

SEQ ID NO: 101356 - protein, 36 aa, Artificial Sequence
  Description of Artificial Sequence: Synthetic polypeptide
AEEEIRTTNPVATEQYGSVSTTNQQQQQTNGNNTET

SEQ ID NO: 101357 - protein, 35 aa, Artificial Sequence
  Description of Artificial Sequence: Synthetic polypeptide
AEEEIRTTNPVATEQYGSVSTTNQQQQQQNGTEGN

SEQ ID NO: 101358 - protein, 30 aa, Artificial Sequence
  Description of Artificial Sequence: Synthetic polypeptide
DENEIATTNPVATECYGTISEECLQQHENL

SEQ ID NO: 101359 - protein, 37 aa, Artificial Sequence
  Description of Artificial Sequence: Synthetic polypeptide
AEEEIRTTNPVATEQYGSVSTTNSNLQAGTEAGNEDG

SEQ ID NO: 101360 - protein, 30 aa, Artificial Sequence
  Description of Artificial Sequence: Synthetic polypeptide
DETAEIATTNPVAYEQWGAVASNDQNGNEQ

SEQ ID NO: 101361 - protein, 30 aa, Artificial Sequence
  Description of Artificial Sequence: Synthetic polypeptide
NEGEIAPTNPCSSEQYGEVSCNLQSGGTNR

SEQ ID NO: 101362 - protein, 31 aa, Artificial Sequence
  Description of Artificial Sequence: Synthetic polypeptide
AESEIRCTNPVATEQWGSASENEPQDREGGG

SEQ ID NO: 101363 - protein, 33 aa, Artificial Sequence
  Description of Artificial Sequence: Synthetic polypeptide
DETAEIATTNPVAYEQYGSVAITNLQDTADGTH

SEQ ID NO: 101364 - protein, 31 aa, Artificial Sequence
  Description of Artificial Sequence: Synthetic polypeptide
DENEIATTNPVATEPYGSISTDIQEQQNGEL

SEQ ID NO: 101365 - protein, 31 aa, Artificial Sequence
  Description of Artificial Sequence: Synthetic polypeptide
DENEIATTNPVATEPYGSISATDIEQQNGEL

SEQ ID NO: 101366 - protein, 33 aa, Artificial Sequence
  Description of Artificial Sequence: Synthetic polypeptide
DENEIATTNPVATEIYGSVCCNENLQRDGMGEM

SEQ ID NO: 101367 - protein, 31 aa, Artificial Sequence
  Description of Artificial Sequence: Synthetic polypeptide
DENEIATTNPVATEIYGSVANNNLVDNGTHV

SEQ ID NO: 101368 - protein, 32 aa, Artificial Sequence
  Description of Artificial Sequence: Synthetic polypeptide
AESEIRTTNPVATECWGEVSCINEPQDRGENG

SEQ ID NO: 101369 - protein, 30 aa, Artificial Sequence
  Description of Artificial Sequence: Synthetic polypeptide
DENEIATTNPVATECYGTVSTDCPEFEGEL

SEQ ID NO: 101370 - protein, 31 aa, Artificial Sequence
  Description of Artificial Sequence: Synthetic polypeptide
DENEIATTNPVATECYGTVSMEDLQQHNEEL

SEQ ID NO: 101371 - protein, 31 aa, Artificial Sequence
  Description of Artificial Sequence: Synthetic polypeptide
DENEIATTNPVATECYGTVSEEDLQQHNEEL

SEQ ID NO: 101372 - protein, 32 aa, Artificial Sequence
  Description of Artificial Sequence: Synthetic polypeptide
DETAIRTTNPLATEQFGSVCSWNLQSFGSDQA

SEQ ID NO: 101373 - protein, 37 aa, Artificial Sequence
  Description of Artificial Sequence: Synthetic polypeptide
AEEEIRTTNPVATEQYGSVSTTQGNLQQGIGTTNNTG

SEQ ID NO: 101374 - protein, 36 aa, Artificial Sequence
  Description of Artificial Sequence: Synthetic polypeptide
AEEEIRTTNPVATEQYGSVSTTNYGNQIGTTNQGTQ

SEQ ID NO: 101375 - protein, 35 aa, Artificial Sequence
  Description of Artificial Sequence: Synthetic polypeptide
AEEEIRTTNPVATEQYGSVSTTNYGNQIGTTGTEQ

SEQ ID NO: 101376 - protein, 36 aa, Artificial Sequence
  Description of Artificial Sequence: Synthetic polypeptide
AEEEIRTTNPVATEQYGSVSTTNVNQQGNQEGNEEG

SEQ ID NO: 101377 - protein, 32 aa, Artificial Sequence
  Description of Artificial Sequence: Synthetic polypeptide
NEGEIRTTNPVATEQYGSVSWTLDFTEQEDQN

SEQ ID NO: 101378 - protein, 32 aa, Artificial Sequence
  Description of Artificial Sequence: Synthetic polypeptide
NEGEIRTTNPVATEQYGSVSWCLDLTEQEDQW

SEQ ID NO: 101379 - protein, 34 aa, Artificial Sequence
  Description of Artificial Sequence: Synthetic polypeptide
NEGEIRTTNPVATEQYGSVCSTPNDVQESQQNDI

SEQ ID NO: 101380 - protein, 34 aa, Artificial Sequence
  Description of Artificial Sequence: Synthetic polypeptide
AEEEIRTTNPVATEQYGSVSTTNVNDNEEGTTDD

SEQ ID NO: 101381 - protein, 36 aa, Artificial Sequence
  Description of Artificial Sequence: Synthetic polypeptide
AEEEIRTTNPVATEQYGSVSTTNVEQGNQAGTNVAN

SEQ ID NO: 101382 - protein, 31 aa, Artificial Sequence
  Description of Artificial Sequence: Synthetic polypeptide
DETAIRTTNPLATECFGSVSFNLEQPEGQQK

SEQ ID NO: 101383 - protein, 33 aa, Artificial Sequence
  Description of Artificial Sequence: Synthetic polypeptide
NEGEIRTTNPVATEQYGSVSWTSLDLTEQEDQY

SEQ ID NO: 101384 - protein, 31 aa, Artificial Sequence
  Description of Artificial Sequence: Synthetic polypeptide
DENEIATTNPVATECYGDVSATCLQDHEEEL

SEQ ID NO: 101385 - protein, 35 aa, Artificial Sequence
  Description of Artificial Sequence: Synthetic polypeptide
AEEEIRTTNPVATEQYGSVSTTNQLQQQTTEDEED

SEQ ID NO: 101386 - protein, 33 aa, Artificial Sequence
  Description of Artificial Sequence: Synthetic polypeptide
DETEIATTNPVATEFWGSVSTTGGPQDRGQNEM

SEQ ID NO: 101387 - protein, 36 aa, Artificial Sequence
  Description of Artificial Sequence: Synthetic polypeptide
AEEEIRTTNPVATEQYGSVSTTNNQQENQNGTNTTN

SEQ ID NO: 101388 - protein, 34 aa, Artificial Sequence
  Description of Artificial Sequence: Synthetic polypeptide
DETEIATTNPVATEQYGSVCATNNQENTRDGEQM

SEQ ID NO: 101389 - protein, 36 aa, Artificial Sequence
  Description of Artificial Sequence: Synthetic polypeptide
AEEEIRTTNPVATEQYGSVSTTNNQNQQQTEGTNVA

SEQ ID NO: 101390 - protein, 36 aa, Artificial Sequence
  Description of Artificial Sequence: Synthetic polypeptide
AEEEIRTTNPVATEQYGSVSTTNNQNQQQGEENATE

SEQ ID NO: 101391 - protein, 31 aa, Artificial Sequence
  Description of Artificial Sequence: Synthetic polypeptide
DENEIACTNPVATEQYGSVSAEDLEDHEGGL

SEQ ID NO: 101392 - protein, 31 aa, Artificial Sequence
  Description of Artificial Sequence: Synthetic polypeptide
DENEIACTNPVATEQYGSVSAEDLEDHEGEL

SEQ ID NO: 101393 - protein, 34 aa, Artificial Sequence
  Description of Artificial Sequence: Synthetic polypeptide
DETEIATTNPVATEQYGSVCYTQDNMDQGGNNTN

SEQ ID NO: 101394 - protein, 35 aa, Artificial Sequence
  Description of Artificial Sequence: Synthetic polypeptide
AEEEIRTTNPVATEQYGSVSTTNNQNQQIGEDEQG

SEQ ID NO: 101395 - protein, 32 aa, Artificial Sequence
  Description of Artificial Sequence: Synthetic polypeptide
DETEIATTNPVATEQYGSVSAADLEDHEGEDL

SEQ ID NO: 101396 - protein, 34 aa, Artificial Sequence
  Description of Artificial Sequence: Synthetic polypeptide
DETEIATTNPVATEQYGSVCAMTGVLQEDGENDQ

SEQ ID NO: 101397 - protein, 36 aa, Artificial Sequence
  Description of Artificial Sequence: Synthetic polypeptide
AEEEIRTTNPVATEQYGSVSTTNNQNQQGNGNNDET

SEQ ID NO: 101398 - protein, 36 aa, Artificial Sequence
  Description of Artificial Sequence: Synthetic polypeptide
AEEEIRTTNPVATEQYGSVSTTNNQNQEQGIGNDEE

SEQ ID NO: 101399 - protein, 36 aa, Artificial Sequence
  Description of Artificial Sequence: Synthetic polypeptide
AEEEIRTTNPVATEQYGSVSTTNNQNNQNEGNNDEI

SEQ ID NO: 101400 - protein, 35 aa, Artificial Sequence
  Description of Artificial Sequence: Synthetic polypeptide
AEEEIRTTNPVATEQYGSVVVVTTGTNLQQGSTEM

SEQ ID NO: 101401 - protein, 36 aa, Artificial Sequence
  Description of Artificial Sequence: Synthetic polypeptide
AEEEIRTTNPVATEQYGSVSTTNNQNNQETGTNNEA

SEQ ID NO: 101402 - protein, 33 aa, Artificial Sequence
  Description of Artificial Sequence: Synthetic polypeptide
DETEIATTNPVATEQYGSVSATDLLEDHEGEDL

SEQ ID NO: 101403 - protein, 31 aa, Artificial Sequence
  Description of Artificial Sequence: Synthetic polypeptide
DENEIACTNPVATEQYGSASATDLEDHGEDL

SEQ ID NO: 101404 - protein, 32 aa, Artificial Sequence
  Description of Artificial Sequence: Synthetic polypeptide
DENEIACTNPVATEQYGSASATDLEDHEGEDR

SEQ ID NO: 101405 - protein, 33 aa, Artificial Sequence
  Description of Artificial Sequence: Synthetic polypeptide
DETEIATTNPVATEQYGSVSATYDLEDHEGEDL

SEQ ID NO: 101406 - protein, 35 aa, Artificial Sequence
  Description of Artificial Sequence: Synthetic polypeptide
DETEIATTNPVATEQYGSVSGTGNPQPDDLMGNQD

SEQ ID NO: 101407 - protein, 35 aa, Artificial Sequence
  Description of Artificial Sequence: Synthetic polypeptide
AEEEIRTTNPVATEQYGSVVVVTTDQNQQIGTNLQ

SEQ ID NO: 101408 - protein, 35 aa, Artificial Sequence
  Description of Artificial Sequence: Synthetic polypeptide
NEEEIRTTNPVATEQYGSVFVWINGEQERKDNDAR

SEQ ID NO: 101409 - protein, 35 aa, Artificial Sequence
  Description of Artificial Sequence: Synthetic polypeptide
AEEEIRTTNPVATEQYGSVSTTNNQQGEQEEEEEG

SEQ ID NO: 101410 - protein, 35 aa, Artificial Sequence
  Description of Artificial Sequence: Synthetic polypeptide
AEEEIRTTNPVATEQYGSVVVVTTDGNQQIGTNLT

SEQ ID NO: 101411 - protein, 35 aa, Artificial Sequence
  Description of Artificial Sequence: Synthetic polypeptide
AEEEIRTTNPVATEQYGSVVVVTNNQNNQAGNNDN

SEQ ID NO: 101412 - protein, 32 aa, Artificial Sequence
  Description of Artificial Sequence: Synthetic polypeptide
DENEIACTNPVATEQYGTISMENLQQQRNGGH

SEQ ID NO: 101413 - protein, 31 aa, Artificial Sequence
  Description of Artificial Sequence: Synthetic polypeptide
DENEIACTNPVATEQYGTASENLQQQQNGGH

SEQ ID NO: 101414 - protein, 32 aa, Artificial Sequence
  Description of Artificial Sequence: Synthetic polypeptide
DETEIATTNPVATEQYGSVATPLEAPGTEDKN

SEQ ID NO: 101415 - protein, 30 aa, Artificial Sequence
  Description of Artificial Sequence: Synthetic polypeptide
DENEIACTNPVATEQYGTASEDGPQFEGGR

SEQ ID NO: 101416 - protein, 36 aa, Artificial Sequence
  Description of Artificial Sequence: Synthetic polypeptide
AEEEIRTTNPVATEQYGSVSTTNNQQNQTNGNNDED

SEQ ID NO: 101417 - protein, 36 aa, Artificial Sequence
  Description of Artificial Sequence: Synthetic polypeptide
AEEEIRTTNPVATEQYGSVSTTNNQQNQQTGTNDET

SEQ ID NO: 101418 - protein, 32 aa, Artificial Sequence
  Description of Artificial Sequence: Synthetic polypeptide
DENEIACTNPVATEQYGTACSATDNPVQRGGD

SEQ ID NO: 101419 - protein, 34 aa, Artificial Sequence
  Description of Artificial Sequence: Synthetic polypeptide
DETEIATTNPVATEQYGSVCAADNGDQDRSINRH

SEQ ID NO: 101420 - protein, 36 aa, Artificial Sequence
  Description of Artificial Sequence: Synthetic polypeptide
AEEEIRTTNPVATEQYGSVSTTNNQQGNDEGNNNTQ

SEQ ID NO: 101421 - protein, 36 aa, Artificial Sequence
  Description of Artificial Sequence: Synthetic polypeptide
AEEEIRTTNPVATEQYGSVSTTNNQQNQEQGNNDED

SEQ ID NO: 101422 - protein, 34 aa, Artificial Sequence
  Description of Artificial Sequence: Synthetic polypeptide
DETEIATTNPVATEQYGSVCAADNNDQGRMINER

SEQ ID NO: 101423 - protein, 36 aa, Artificial Sequence
  Description of Artificial Sequence: Synthetic polypeptide
AEEEIRTTNPVATEQYGSVSTTNNQQLQQSTNTNNT

SEQ ID NO: 101424 - protein, 37 aa, Artificial Sequence
  Description of Artificial Sequence: Synthetic polypeptide
AEEEIRTTNPVATEQYGSVSTTNNQQLQQGTATNNTT

SEQ ID NO: 101425 - protein, 33 aa, Artificial Sequence
  Description of Artificial Sequence: Synthetic polypeptide
DETEIATTNPVATEQYGSVCAAMHLQDSPDGNN

SEQ ID NO: 101426 - protein, 32 aa, Artificial Sequence
  Description of Artificial Sequence: Synthetic polypeptide
DETEIATTNPVATEQYGSVCAATAHLQDSPDY

SEQ ID NO: 101427 - protein, 36 aa, Artificial Sequence
  Description of Artificial Sequence: Synthetic polypeptide
AEEEIRTTNPVATEQYGSVSTTNNQQGQQEATNATE

SEQ ID NO: 101428 - protein, 36 aa, Artificial Sequence
  Description of Artificial Sequence: Synthetic polypeptide
AEEEIRTTNPVATEQYGSVSTTNNQQGQEIGTNQED

SEQ ID NO: 101429 - protein, 36 aa, Artificial Sequence
  Description of Artificial Sequence: Synthetic polypeptide
AEEEIRTTNPVATEQYGSVSTTNNQQGNTEQGTTDQ

SEQ ID NO: 101430 - protein, 36 aa, Artificial Sequence
  Description of Artificial Sequence: Synthetic polypeptide
AEEEIRTTNPVATEQYGSVSTTNNQQGNDNGNNATN

SEQ ID NO: 101431 - protein, 36 aa, Artificial Sequence
  Description of Artificial Sequence: Synthetic polypeptide
AEEEIRTTNPVATEQYGSVSTTNNQQNDEQGTNQDE

SEQ ID NO: 101432 - protein, 36 aa, Artificial Sequence
  Description of Artificial Sequence: Synthetic polypeptide
AEEEIRTTNPVATEQYGSVSTTNNQQQGNDEQGEED

SEQ ID NO: 101433 - protein, 35 aa, Artificial Sequence
  Description of Artificial Sequence: Synthetic polypeptide
AEEEIRTTNPVATEQYGSVVVVTTNDNQQIGTNLN

SEQ ID NO: 101434 - protein, 32 aa, Artificial Sequence
  Description of Artificial Sequence: Synthetic polypeptide
CEPEIRCTNPVATEQYGSVPPMNPQPEIMVNR

SEQ ID NO: 101435 - protein, 31 aa, Artificial Sequence
  Description of Artificial Sequence: Synthetic polypeptide
DENEIACTNPVATEQYGEASEENIQQRNGGH

SEQ ID NO: 101436 - protein, 36 aa, Artificial Sequence
  Description of Artificial Sequence: Synthetic polypeptide
AEEEIRTTNPVATEQYGSVSTTNNQLQGNNNNNQNE

SEQ ID NO: 101437 - protein, 30 aa, Artificial Sequence
  Description of Artificial Sequence: Synthetic polypeptide
DENEIACTNPVATEQYGDVSENEMNAAEDR

SEQ ID NO: 101438 - protein, 28 aa, Artificial Sequence
  Description of Artificial Sequence: Synthetic peptide
CESEIASTNPVGTEGYGVSASTLQDGDI

SEQ ID NO: 101439 - protein, 37 aa, Artificial Sequence
  Description of Artificial Sequence: Synthetic polypeptide
AEEEIRTTNPVATEQYGSVSTTNNQLQGNNNGNNINE

SEQ ID NO: 101440 - protein, 29 aa, Artificial Sequence
  Description of Artificial Sequence: Synthetic peptide
DENEIACTNPVATEQWGEVSEILMNREGA

SEQ ID NO: 101441 - protein, 30 aa, Artificial Sequence
  Description of Artificial Sequence: Synthetic polypeptide
DENEIACTNPVATEQWGEASENEQNAAGGR

SEQ ID NO: 101442 - protein, 37 aa, Artificial Sequence
  Description of Artificial Sequence: Synthetic polypeptide
AEEEIRTTNPVATEQYGSVSTTNNQLQGNNIGTNIQE

SEQ ID NO: 101443 - protein, 36 aa, Artificial Sequence
  Description of Artificial Sequence: Synthetic polypeptide
AEEEIRTTNPVATEQYGSVSTTNNQLQGNEQNENIY

SEQ ID NO: 101444 - protein, 37 aa, Artificial Sequence
  Description of Artificial Sequence: Synthetic polypeptide
AEEEIRTTNPVATEQYGSVSTTNNQLQNDENGNEQGE

SEQ ID NO: 101445 - protein, 30 aa, Artificial Sequence
  Description of Artificial Sequence: Synthetic polypeptide
DENEIACTNPVATEQWGDVSENEQNRAEGA

SEQ ID NO: 101446 - protein, 28 aa, Artificial Sequence
  Description of Artificial Sequence: Synthetic peptide
AESEIACTNPVGTEGYGVAAETLQRGGR

SEQ ID NO: 101447 - protein, 37 aa, Artificial Sequence
  Description of Artificial Sequence: Synthetic polypeptide
AEEEIRTTNPVATEQYGSVSTTNNQLQAGNLNNNEND

SEQ ID NO: 101448 - protein, 28 aa, Artificial Sequence
  Description of Artificial Sequence: Synthetic peptide
AESEIACTNPVGTEGYGVAAETLQRGDR

SEQ ID NO: 101449 - protein, 36 aa, Artificial Sequence
  Description of Artificial Sequence: Synthetic polypeptide
AEEEIRTTNPVATEQYGSVSTTNNQLNQQNATNVAE

SEQ ID NO: 101450 - protein, 37 aa, Artificial Sequence
  Description of Artificial Sequence: Synthetic polypeptide
AEEEIRTTNPVATEQYGSVSTTNNQLNQQGNNNNSEV

SEQ ID NO: 101451 - protein, 36 aa, Artificial Sequence
  Description of Artificial Sequence: Synthetic polypeptide
AEEEIRTTNPVATEQYGSVSTTNNQLNGNVGTNEEQ

SEQ ID NO: 101452 - protein, 36 aa, Artificial Sequence
  Description of Artificial Sequence: Synthetic polypeptide
AEEEIRTTNPVATEQYGSVVVVTTNLQQGNGENGTE

SEQ ID NO: 101453 - protein, 32 aa, Artificial Sequence
  Description of Artificial Sequence: Synthetic polypeptide
DENEIACTNPVATECYGETSNAENLQERKGPR

SEQ ID NO: 101454 - protein, 33 aa, Artificial Sequence
  Description of Artificial Sequence: Synthetic polypeptide
DETEIATTNPVATEVYGSVCYNNDHQDHGDNDR

SEQ ID NO: 101455 - protein, 29 aa, Artificial Sequence
  Description of Artificial Sequence: Synthetic peptide
DENEIACTNPVATEQWGDASEIEQNREDR

SEQ ID NO: 101456 - protein, 36 aa, Artificial Sequence
  Description of Artificial Sequence: Synthetic polypeptide
AEEEIRTTNPVATEQYGSVSTTNNQNNNLQGINESE

SEQ ID NO: 101457 - protein, 36 aa, Artificial Sequence
  Description of Artificial Sequence: Synthetic polypeptide
AEEEIRTTNPVATEQYGSVSTTNNQLQNGEEAGEDD

SEQ ID NO: 101458 - protein, 37 aa, Artificial Sequence
  Description of Artificial Sequence: Synthetic polypeptide
AEEEIRTTNPVATEQYGSVSTTNNQLQNNEQGNNNNL

SEQ ID NO: 101459 - protein, 32 aa, Artificial Sequence
  Description of Artificial Sequence: Synthetic polypeptide
CEQEIATTNPVATEQYGSVSATDLEDHEGEDL

SEQ ID NO: 101460 - protein, 36 aa, Artificial Sequence
  Description of Artificial Sequence: Synthetic polypeptide
AEEEIRTTNPVATEQYGSVSTTNNQNDNQQGTNDTE

SEQ ID NO: 101461 - protein, 35 aa, Artificial Sequence
  Description of Artificial Sequence: Synthetic polypeptide
CEQEIRTTNPVATEAYGCSVSSCHNLSQRTGGNNM

SEQ ID NO: 101462 - protein, 37 aa, Artificial Sequence
  Description of Artificial Sequence: Synthetic polypeptide
AEEEIRTTNPVATEQYGSVSTTNNQLQQGTETGTNSD

SEQ ID NO: 101463 - protein, 30 aa, Artificial Sequence
  Description of Artificial Sequence: Synthetic polypeptide
DENEIACTNPVATEQYGEISMEDIQQRGGH

SEQ ID NO: 101464 - protein, 36 aa, Artificial Sequence
  Description of Artificial Sequence: Synthetic polypeptide
AEEEIRTTNPVATEQYGSVSTTNNQLQQGTEQGEST

SEQ ID NO: 101465 - protein, 34 aa, Artificial Sequence
  Description of Artificial Sequence: Synthetic polypeptide
NEEEIRTTNPVATEQYGSVCSPTNSDIELYEDGE

SEQ ID NO: 101466 - protein, 31 aa, Artificial Sequence
  Description of Artificial Sequence: Synthetic polypeptide
DENEIACTNPVATEQYGEASEPNGPQRGGPV

SEQ ID NO: 101467 - protein, 32 aa, Artificial Sequence
  Description of Artificial Sequence: Synthetic polypeptide
DETEIATTNPVATEQYGSVSTTDTEDEEGEDL

SEQ ID NO: 101468 - protein, 36 aa, Artificial Sequence
  Description of Artificial Sequence: Synthetic polypeptide
AEEEIRTTNPVATEQYGSVSTTNNQLQNNEENNNDD

SEQ ID NO: 101469 - protein, 37 aa, Artificial Sequence
  Description of Artificial Sequence: Synthetic polypeptide
AEEEIRTTNPVATEQYGSVSTTNNQLQQGNQGTNAEG

SEQ ID NO: 101470 - protein, 37 aa, Artificial Sequence
  Description of Artificial Sequence: Synthetic polypeptide
AEEEIRTTNPVATEQYGSVSTTNNQLQQGNNNNNNED

SEQ ID NO: 101471 - protein, 36 aa, Artificial Sequence
  Description of Artificial Sequence: Synthetic polypeptide
AEEEIRTTNPVATEQYGSVVVVTTNLNQGTGEENDE

SEQ ID NO: 101472 - protein, 36 aa, Artificial Sequence
  Description of Artificial Sequence: Synthetic polypeptide
DETEIATTNPVATEQYGSVSWTELGDQDRQQGGGNQ

SEQ ID NO: 101473 - protein, 37 aa, Artificial Sequence
  Description of Artificial Sequence: Synthetic polypeptide
AEEEIRTTNPVATEQYGSVSTTNNQLQQGNNNNDEND

SEQ ID NO: 101474 - protein, 33 aa, Artificial Sequence
  Description of Artificial Sequence: Synthetic polypeptide
DETEIATTNPVATEQYGSVTGGNGDQRQGDMPP

SEQ ID NO: 101475 - protein, 36 aa, Artificial Sequence
  Description of Artificial Sequence: Synthetic polypeptide
AEEEIRTTNPVATEQYGSVVVVTTNLNQQGNGNTTD

SEQ ID NO: 101476 - protein, 33 aa, Artificial Sequence
  Description of Artificial Sequence: Synthetic polypeptide
DETEIATTNPVATETWGEVSTNLQGDLGNNGGS

SEQ ID NO: 101477 - protein, 37 aa, Artificial Sequence
  Description of Artificial Sequence: Synthetic polypeptide
AEEEIRTTNPVATEQYGSVSTTNNQLQQGENGTNNDT

SEQ ID NO: 101478 - protein, 35 aa, Artificial Sequence
  Description of Artificial Sequence: Synthetic polypeptide
NEEEIRTTNPVATEQYGSTVPSYAGNLSDEFGGSR

SEQ ID NO: 101479 - protein, 37 aa, Artificial Sequence
  Description of Artificial Sequence: Synthetic polypeptide
AEEEIRTTNPVATEQYGSVSTTNNQLQQGNNNSNNNQ

SEQ ID NO: 101480 - protein, 35 aa, Artificial Sequence
  Description of Artificial Sequence: Synthetic polypeptide
AEEEIRTTNPVATEQYGSVVVVTNNQLNNTAGNNE

SEQ ID NO: 101481 - protein, 31 aa, Artificial Sequence
  Description of Artificial Sequence: Synthetic polypeptide
DENEIACTNPVATEQYGTVCSENPVQFEGGD

SEQ ID NO: 101482 - protein, 33 aa, Artificial Sequence
  Description of Artificial Sequence: Synthetic polypeptide
DETEIATTNPVATEQYGSVAITNDARPANDVPQ

SEQ ID NO: 101483 - protein, 32 aa, Artificial Sequence
  Description of Artificial Sequence: Synthetic polypeptide
DETEIATTNPVATEQWGSVSATGEPQEATPRE

SEQ ID NO: 101484 - protein, 32 aa, Artificial Sequence
  Description of Artificial Sequence: Synthetic polypeptide
DETEIATTNPVATEQWGSVSATGLTDHQGEDL

SEQ ID NO: 101485 - protein, 32 aa, Artificial Sequence
  Description of Artificial Sequence: Synthetic polypeptide
DENEIATTNPVATECWGDVSCICLQDREGENL

SEQ ID NO: 101486 - protein, 31 aa, Artificial Sequence
  Description of Artificial Sequence: Synthetic polypeptide
DENEIATTNPVATECWGDVSCICLQDREGEL

SEQ ID NO: 101487 - protein, 33 aa, Artificial Sequence
  Description of Artificial Sequence: Synthetic polypeptide
DETEIATTNPVATEQWGSVSGEGPPANQGGNPR

SEQ ID NO: 101488 - protein, 35 aa, Artificial Sequence
  Description of Artificial Sequence: Synthetic polypeptide
AEEEIRTTNPVATEQYGSVSTTNNQQQQTQGTEDE

SEQ ID NO: 101489 - protein, 33 aa, Artificial Sequence
  Description of Artificial Sequence: Synthetic polypeptide
DENEIATTNPIATEQYGSVSVTNIGFGHGDNQD

SEQ ID NO: 101490 - protein, 36 aa, Artificial Sequence
  Description of Artificial Sequence: Synthetic polypeptide
AEEEIRTTNPVATEQYGSVSTTNNQQQQTIGNNNVD

SEQ ID NO: 101491 - protein, 35 aa, Artificial Sequence
  Description of Artificial Sequence: Synthetic polypeptide
AEEEIRTTNPVATEQYGSVVVVTNLLGGNNQGNDD

SEQ ID NO: 101492 - protein, 36 aa, Artificial Sequence
  Description of Artificial Sequence: Synthetic polypeptide
AEEEIRTTNPVATEQYGSVSTTNNTNQQTNGTNNVD

SEQ ID NO: 101493 - protein, 33 aa, Artificial Sequence
  Description of Artificial Sequence: Synthetic polypeptide
DETEIATTNPVATEQWGSVSGTGNPDNADGNPD

SEQ ID NO: 101494 - protein, 31 aa, Artificial Sequence
  Description of Artificial Sequence: Synthetic polypeptide
DENEIATTNPCAYGAHYGSVSTNLQHDENEM

SEQ ID NO: 101495 - protein, 33 aa, Artificial Sequence
  Description of Artificial Sequence: Synthetic polypeptide
DETEIATTNPVATEQWGSVSGTGNPDNAGNSDD

SEQ ID NO: 101496 - protein, 35 aa, Artificial Sequence
  Description of Artificial Sequence: Synthetic polypeptide
AEEEIRTTNPVATEQYGSVSTTNNQQQQSNANNTG

SEQ ID NO: 101497 - protein, 35 aa, Artificial Sequence
  Description of Artificial Sequence: Synthetic polypeptide
AEEEIRTTNPVATEQYGSVSTTNNQQQQSATNETG

SEQ ID NO: 101498 - protein, 36 aa, Artificial Sequence
  Description of Artificial Sequence: Synthetic polypeptide
AEEEIRTTNPVATEQYGSVSTTNNQQQQQNGTNTTD

SEQ ID NO: 101499 - protein, 30 aa, Artificial Sequence
  Description of Artificial Sequence: Synthetic polypeptide
DENEIATTNPCATEQWGIVSENLQNAAEDA

SEQ ID NO: 101500 - protein, 36 aa, Artificial Sequence
  Description of Artificial Sequence: Synthetic polypeptide
AEEEIRTTNPVATEQYGSVSTTNNQQQQQIGTNNDE

SEQ ID NO: 101501 - protein, 36 aa, Artificial Sequence
  Description of Artificial Sequence: Synthetic polypeptide
AEEEIRTTNPVATEQYGSVSTTNNQQQQQIGTNEGE

SEQ ID NO: 101502 - protein, 30 aa, Artificial Sequence
  Description of Artificial Sequence: Synthetic polypeptide
DENEIASVNPVSTEPYGVVSDENLQQSGNH

SEQ ID NO: 101503 - protein, 29 aa, Artificial Sequence
  Description of Artificial Sequence: Synthetic peptide
DENEIATTNPIATECYGATVSECLAHGEI

SEQ ID NO: 101504 - protein, 36 aa, Artificial Sequence
  Description of Artificial Sequence: Synthetic polypeptide
AEEEIRTTNPVATEQYGSVSTTNNQQQQQGTNDTQD

SEQ ID NO: 101505 - protein, 33 aa, Artificial Sequence
  Description of Artificial Sequence: Synthetic polypeptide
DENEIATTNPVATECWGSVSCICLPQDREGENG

SEQ ID NO: 101506 - protein, 33 aa, Artificial Sequence
  Description of Artificial Sequence: Synthetic polypeptide
DENEIATTNPVATECWGSVSCINEPQDREGENG

SEQ ID NO: 101507 - protein, 36 aa, Artificial Sequence
  Description of Artificial Sequence: Synthetic polypeptide
AEEEIRTTNPVATEQYGSVSTTNQLQQGTEQGTEGG

SEQ ID NO: 101508 - protein, 32 aa, Artificial Sequence
  Description of Artificial Sequence: Synthetic polypeptide
DETEIATTNPVATEQWGSVAAGNLFLHNMGSR

SEQ ID NO: 101509 - protein, 33 aa, Artificial Sequence
  Description of Artificial Sequence: Synthetic polypeptide
NEEEIRTTNPVATEQYGSVSDADVQPDEFAFNQ

SEQ ID NO: 101510 - protein, 32 aa, Artificial Sequence
  Description of Artificial Sequence: Synthetic polypeptide
DETEIATTNPVATEQWGSVAITADPQANGNPN

SEQ ID NO: 101511 - protein, 36 aa, Artificial Sequence
  Description of Artificial Sequence: Synthetic polypeptide
AEEEIRTTNPVATEQYGSVSTTNQLNQNNIGTTEMG

SEQ ID NO: 101512 - protein, 29 aa, Artificial Sequence
  Description of Artificial Sequence: Synthetic peptide
DENEIATTNPVATECYGDVSAECLEHEEL

SEQ ID NO: 101513 - protein, 31 aa, Artificial Sequence
  Description of Artificial Sequence: Synthetic polypeptide
DENEIATTNPVATECYGDVCSTGLVQFEEEL

SEQ ID NO: 101514 - protein, 31 aa, Artificial Sequence
  Description of Artificial Sequence: Synthetic polypeptide
DENEIATTNPVATECYGDVCSTCLVQFEEEL

SEQ ID NO: 101515 - protein, 30 aa, Artificial Sequence
  Description of Artificial Sequence: Synthetic polypeptide
DENEIATTNPVATECYGDVCSECLVQFEEL

SEQ ID NO: 101516 - protein, 36 aa, Artificial Sequence
  Description of Artificial Sequence: Synthetic polypeptide
AEEEIRTTNPVATEQYGSVSTTNNTQQGNDEEAEEG

SEQ ID NO: 101517 - protein, 36 aa, Artificial Sequence
  Description of Artificial Sequence: Synthetic polypeptide
AEEEIRTTNPVATEQYGSVSTTNQLNNNQGEENATE

SEQ ID NO: 101518 - protein, 29 aa, Artificial Sequence
  Description of Artificial Sequence: Synthetic peptide
DENEIATTNPVATECYGDVAECLQEHEEL

SEQ ID NO: 101519 - protein, 29 aa, Artificial Sequence
  Description of Artificial Sequence: Synthetic peptide
DENEIATTNPVATECYGDVAACLQHEEYL

SEQ ID NO: 101520 - protein, 35 aa, Artificial Sequence
  Description of Artificial Sequence: Synthetic polypeptide
AEEEIRTTNPVATEQYGSVVVVTNDNQQQIGTNLD

SEQ ID NO: 101521 - protein, 36 aa, Artificial Sequence
  Description of Artificial Sequence: Synthetic polypeptide
AEEEIRTTNPVATEQYGSVSTTNQLNENDEQGNNTN

SEQ ID NO: 101522 - protein, 36 aa, Artificial Sequence
  Description of Artificial Sequence: Synthetic polypeptide
AEEEIRTTNPVATEQYGSVSTTNQLNENDEGTNVTN

SEQ ID NO: 101523 - protein, 34 aa, Artificial Sequence
  Description of Artificial Sequence: Synthetic polypeptide
DETEIATTNPVATEQWGSVSATGELPQQTEPNRT

SEQ ID NO: 101524 - protein, 35 aa, Artificial Sequence
  Description of Artificial Sequence: Synthetic polypeptide
AEEEIRTTNPVATEQYGSVSTTNQLGNTEQGTEDE

SEQ ID NO: 101525 - protein, 35 aa, Artificial Sequence
  Description of Artificial Sequence: Synthetic polypeptide
AEEEIRTTNPVATEQYGSVSTTNQANDEIGTNEEE

SEQ ID NO: 101526 - protein, 34 aa, Artificial Sequence
  Description of Artificial Sequence: Synthetic polypeptide
AEEEIRTTNPVATEQYGSVSTTNQAGDEEGTTED

SEQ ID NO: 101527 - protein, 29 aa, Artificial Sequence
  Description of Artificial Sequence: Synthetic peptide
DENEIATTNPVATECYGDVAECLQHEEYL

SEQ ID NO: 101528 - protein, 36 aa, Artificial Sequence
  Description of Artificial Sequence: Synthetic polypeptide
AEEEIRTTNPVATEQYGSVSTTNNQQQQQGATNTTN

SEQ ID NO: 101529 - protein, 36 aa, Artificial Sequence
  Description of Artificial Sequence: Synthetic polypeptide
AEEEIRTTNPVATEQYGSVVVVTNLQQGTEGTNNGE

SEQ ID NO: 101530 - protein, 35 aa, Artificial Sequence
  Description of Artificial Sequence: Synthetic polypeptide
AEEEIRTTNPVATEQYGSVVVVTNNLNNTAGTNNV

SEQ ID NO: 101531 - protein, 30 aa, Artificial Sequence
  Description of Artificial Sequence: Synthetic polypeptide
DENEIAPTNPVSSEQYGIVSCDLQQQQGTR

SEQ ID NO: 101532 - protein, 36 aa, Artificial Sequence
  Description of Artificial Sequence: Synthetic polypeptide
AEEEIRTTNPVATEQYGSVSTTNNQQQNQTGTNDEM

SEQ ID NO: 101533 - protein, 29 aa, Artificial Sequence
  Description of Artificial Sequence: Synthetic peptide
DENEIAPTNPVSSEQWGIVSCNLMSAGTR

SEQ ID NO: 101534 - protein, 36 aa, Artificial Sequence
  Description of Artificial Sequence: Synthetic polypeptide
AEEEIRTTNPVATEQYGSVSTTNNQQQNQQGTDENE

SEQ ID NO: 101535 - protein, 29 aa, Artificial Sequence
  Description of Artificial Sequence: Synthetic peptide
DENEIAPTNPVSSEQWGDVSCNLMSAGTR

SEQ ID NO: 101536 - protein, 28 aa, Artificial Sequence
  Description of Artificial Sequence: Synthetic peptide
DENEIAPTNPVASEQYGDVSCIEMAGTA

SEQ ID NO: 101537 - protein, 33 aa, Artificial Sequence
  Description of Artificial Sequence: Synthetic polypeptide
DETEIATTNPVATEQYGCVAGTGQLQNRMGMGL

SEQ ID NO: 101538 - protein, 29 aa, Artificial Sequence
  Description of Artificial Sequence: Synthetic peptide
DENEIAPTNPVASEQWGDVSCNEMSAGTR

SEQ ID NO: 101539 - protein, 29 aa, Artificial Sequence
  Description of Artificial Sequence: Synthetic peptide
DENEIAPTNPCSSEQYGIVSCNIQQQGTR

SEQ ID NO: 101540 - protein, 36 aa, Artificial Sequence
  Description of Artificial Sequence: Synthetic polypeptide
AEEEIRTTNPVATEQYGSVSTTNNQQQQANIGNNVE

SEQ ID NO: 101541 - protein, 29 aa, Artificial Sequence
  Description of Artificial Sequence: Synthetic peptide
DENEIAPTNPCATEQWGIVSCNEMAAGDR

SEQ ID NO: 101542 - protein, 30 aa, Artificial Sequence
  Description of Artificial Sequence: Synthetic polypeptide
DENEIACTNPVSTEPYGTASENLQQQQGGR

SEQ ID NO: 101543 - protein, 36 aa, Artificial Sequence
  Description of Artificial Sequence: Synthetic polypeptide
AEEEIRTTNPVATEQYGSVVVVTNNNNLQQGSNGEQ

SEQ ID NO: 101544 - protein, 36 aa, Artificial Sequence
  Description of Artificial Sequence: Synthetic polypeptide
AEEEIRTTNPVATEQYGSVSTTNNQQQLNGNNNTTD

SEQ ID NO: 101545 - protein, 36 aa, Artificial Sequence
  Description of Artificial Sequence: Synthetic polypeptide
AEEEIRTTNPVATEQYGSVSTTNNQQQIGNNNNQQS

SEQ ID NO: 101546 - protein, 32 aa, Artificial Sequence
  Description of Artificial Sequence: Synthetic polypeptide
DETEIATTNPVATEQYGSTSATDLADHEGEDL

SEQ ID NO: 101547 - protein, 36 aa, Artificial Sequence
  Description of Artificial Sequence: Synthetic polypeptide
AEEEIRTTNPVATEQYGSVSTTNNQQQGTNGNNDEN

SEQ ID NO: 101548 - protein, 36 aa, Artificial Sequence
  Description of Artificial Sequence: Synthetic polypeptide
AEEEIRTTNPVATEQYGSVSTTNNQQQGNQGTNEDQ

SEQ ID NO: 101549 - protein, 36 aa, Artificial Sequence
  Description of Artificial Sequence: Synthetic polypeptide
AEEEIRTTNPVATEQYGSVSTTNNQQQGNEGNTEQG

SEQ ID NO: 101550 - protein, 34 aa, Artificial Sequence
  Description of Artificial Sequence: Synthetic polypeptide
DETEIATTNPVATEQYGSVACSGNNDIPQDNGNH

SEQ ID NO: 101551 - protein, 36 aa, Artificial Sequence
  Description of Artificial Sequence: Synthetic polypeptide
AEEEIRTTNPVATEQYGSVVVVTNNNLNNQAGNNND

SEQ ID NO: 101552 - protein, 30 aa, Artificial Sequence
  Description of Artificial Sequence: Synthetic polypeptide
DENEIAPTNPVSTEQYGTVSCDIQQQQGTR

SEQ ID NO: 101553 - protein, 28 aa, Artificial Sequence
  Description of Artificial Sequence: Synthetic peptide
DENEIASTNPVATEQWGDVSEIEMHGDI

SEQ ID NO: 101554 - protein, 36 aa, Artificial Sequence
  Description of Artificial Sequence: Synthetic polypeptide
AEEEIRTTNPVATEQYGSVSTTNNQQQQANQGTNVD

SEQ ID NO: 101555 - protein, 36 aa, Artificial Sequence
  Description of Artificial Sequence: Synthetic polypeptide
AEEEIRTTNPVATEQYGSVSTTNNQQQQNQNGNNDE

SEQ ID NO: 101556 - protein, 36 aa, Artificial Sequence
  Description of Artificial Sequence: Synthetic polypeptide
AEEEIRTTNPVATEQYGSVSTTNNQQQQNNGENNVE

SEQ ID NO: 101557 - protein, 36 aa, Artificial Sequence
  Description of Artificial Sequence: Synthetic polypeptide
AEEEIRTTNPVATEQYGSVSTTNNQQQQNIGNNTTD

SEQ ID NO: 101558 - protein, 35 aa, Artificial Sequence
  Description of Artificial Sequence: Synthetic polypeptide
AEEEIRTTNPVATEQYGSVSTTNNQQQQNGTTEQE

SEQ ID NO: 101559 - protein, 35 aa, Artificial Sequence
  Description of Artificial Sequence: Synthetic polypeptide
AEEEIRTTNPVATEQYGSVSTTNNQQQQNANNDTG

SEQ ID NO: 101560 - protein, 36 aa, Artificial Sequence
  Description of Artificial Sequence: Synthetic polypeptide
AEEEIRTTNPVATEQYGSVSTTNNQQQQGNQGNNDD

SEQ ID NO: 101561 - protein, 29 aa, Artificial Sequence
  Description of Artificial Sequence: Synthetic peptide
DENEIASVNPVATEQWGVVSENLQNSEDA

SEQ ID NO: 101562 - protein, 29 aa, Artificial Sequence
  Description of Artificial Sequence: Synthetic peptide
DENEIASVNPVATEQWGVVSDNLQNSEDA

SEQ ID NO: 101563 - protein, 35 aa, Artificial Sequence
  Description of Artificial Sequence: Synthetic polypeptide
DETEIATTNPVATEQWGSVSMTGELPQQTEGNNRE

SEQ ID NO: 101564 - protein, 36 aa, Artificial Sequence
  Description of Artificial Sequence: Synthetic polypeptide
AEEEIRTTNPVATEQYGSVSTTNNQQQQGNNNNDED

SEQ ID NO: 101565 - protein, 29 aa, Artificial Sequence
  Description of Artificial Sequence: Synthetic peptide
DENEIASTNPVSTEPYGTMSSETLQQGNH

SEQ ID NO: 101566 - protein, 29 aa, Artificial Sequence
  Description of Artificial Sequence: Synthetic peptide
DENEIASTNPVSTEGYGVISMTLQQQGNI

SEQ ID NO: 101567 - protein, 36 aa, Artificial Sequence
  Description of Artificial Sequence: Synthetic polypeptide
AEEEIRTTNPVATEQYGSVSTTNNQQQQGNGTNQNE

SEQ ID NO: 101568 - protein, 35 aa, Artificial Sequence
  Description of Artificial Sequence: Synthetic polypeptide
AEEEIRTTNPVATEQYGSVVVVTNNNLGNTAGNNV

SEQ ID NO: 101569 - protein, 30 aa, Artificial Sequence
  Description of Artificial Sequence: Synthetic polypeptide
DENEIASTNPVSTEGYGNAANNLQSRVGQR

SEQ ID NO: 101570 - protein, 33 aa, Artificial Sequence
  Description of Artificial Sequence: Synthetic polypeptide
DETEIATTNPVATEQWGSVSPTEGGQEQGNPEE

SEQ ID NO: 101571 - protein, 36 aa, Artificial Sequence
  Description of Artificial Sequence: Synthetic polypeptide
AEEEIRTTNPVATEQYGSVSTTNNQQQQGNGTNANT

SEQ ID NO: 101572 - protein, 28 aa, Artificial Sequence
  Description of Artificial Sequence: Synthetic peptide
DENEIASTNPVSTEGYGDVANCLQREQL

SEQ ID NO: 101573 - protein, 36 aa, Artificial Sequence
  Description of Artificial Sequence: Synthetic polypeptide
AEEEIRTTNPVATEQYGSVSTTNNQQQQEQNGTNAD

SEQ ID NO: 101574 - protein, 36 aa, Artificial Sequence
  Description of Artificial Sequence: Synthetic polypeptide
AEEEIRTTNPVATEQYGSVSTTNNQQQQEQGTNAED

SEQ ID NO: 101575 - protein, 32 aa, Artificial Sequence
  Description of Artificial Sequence: Synthetic polypeptide
DETEIATTNPVATEQYGCVAANGDTDTGGNPR

SEQ ID NO: 101576 - protein, 34 aa, Artificial Sequence
  Description of Artificial Sequence: Synthetic polypeptide
DENEAEIRTTNPVAYEQWGSVSTNLNQGEDQEDA

SEQ ID NO: 101577 - protein, 35 aa, Artificial Sequence
  Description of Artificial Sequence: Synthetic polypeptide
AEEEIRTTNPVATEQYGSVVVVVTTNQNQEGNNIP

SEQ ID NO: 101578 - protein, 35 aa, Artificial Sequence
  Description of Artificial Sequence: Synthetic polypeptide
AEEEIRTTNPVATEQYGSVVVVVTTNQQQNEGNED

SEQ ID NO: 101579 - protein, 36 aa, Artificial Sequence
  Description of Artificial Sequence: Synthetic polypeptide
AEEEIRTTNPVATEQYGSVYTNLNNQNGTEAGTNSQ

SEQ ID NO: 101580 - protein, 34 aa, Artificial Sequence
  Description of Artificial Sequence: Synthetic polypeptide
AEEEIRTTNPVATEQYGSVSTTLVNNDNEEGTQD

SEQ ID NO: 101581 - protein, 32 aa, Artificial Sequence
  Description of Artificial Sequence: Synthetic polypeptide
AENEIVTTNPVATEQYGEVCSATDGPVQFGND

SEQ ID NO: 101582 - protein, 34 aa, Artificial Sequence
  Description of Artificial Sequence: Synthetic polypeptide
AEEEIRTTNPVATEQYGSVSTTLVGNDNEEIGTD

SEQ ID NO: 101583 - protein, 36 aa, Artificial Sequence
  Description of Artificial Sequence: Synthetic polypeptide
AEEEIRTTNPVATEQYGSVSTTLQQGNSEQGTNVAE

SEQ ID NO: 101584 - protein, 34 aa, Artificial Sequence
  Description of Artificial Sequence: Synthetic polypeptide
DEMEIRTTNPVATEQYGSVSSTTPAPPNFEGNPD

SEQ ID NO: 101585 - protein, 36 aa, Artificial Sequence
  Description of Artificial Sequence: Synthetic polypeptide
AEEEIRTTNPVATEQYGVVSTTNNQLQQQNIGTNEY

SEQ ID NO: 101586 - protein, 31 aa, Artificial Sequence
  Description of Artificial Sequence: Synthetic polypeptide
SEEEIRTTNPVATEQYGSVQTDWVYEEEDIE

SEQ ID NO: 101587 - protein, 35 aa, Artificial Sequence
  Description of Artificial Sequence: Synthetic polypeptide
DEMEIRTTNPVATEQYGSVSSTTPAGPNMREGNPV

SEQ ID NO: 101588 - protein, 36 aa, Artificial Sequence
  Description of Artificial Sequence: Synthetic polypeptide
AEEEIRTTNPVATEQYGSVSTTLQNDGTEQGNNNNN

SEQ ID NO: 101589 - protein, 35 aa, Artificial Sequence
  Description of Artificial Sequence: Synthetic polypeptide
DEMEIRTTNPVATEQYGSVSSTTPAPPNREGMNPD

SEQ ID NO: 101590 - protein, 34 aa, Artificial Sequence
  Description of Artificial Sequence: Synthetic polypeptide
SEEEIRTTNPVATEQYGSVSAQGDLEQNNQGEGD

SEQ ID NO: 101591 - protein, 36 aa, Artificial Sequence
  Description of Artificial Sequence: Synthetic polypeptide
AEEEIRTTNPVATEQYGSVSTTLQLNGNEETGTTED

SEQ ID NO: 101592 - protein, 34 aa, Artificial Sequence
  Description of Artificial Sequence: Synthetic polypeptide
DEMEIRTTNPVATEQYGSVSSTTDAGVEFEGMNV

SEQ ID NO: 101593 - protein, 35 aa, Artificial Sequence
  Description of Artificial Sequence: Synthetic polypeptide
DEMEIRTTNPVATEQYGSVSSTTDAGPNREGMNPV

SEQ ID NO: 101594 - protein, 36 aa, Artificial Sequence
  Description of Artificial Sequence: Synthetic polypeptide
AEEEIRTTNPVATEQYGSVSTTLQLNGNEAGTTEDD

SEQ ID NO: 101595 - protein, 35 aa, Artificial Sequence
  Description of Artificial Sequence: Synthetic polypeptide
AEEEIRTTNPVATEQYGSVSTTLQLNDNEEQGTTD

SEQ ID NO: 101596 - protein, 35 aa, Artificial Sequence
  Description of Artificial Sequence: Synthetic polypeptide
AEEEIRTTNPVATEQYGSVSTTLQLNDNEEIGTDT

SEQ ID NO: 101597 - protein, 35 aa, Artificial Sequence
  Description of Artificial Sequence: Synthetic polypeptide
AEEEIRTTNPVATEQYGSVSTTLNQQQQANNNNNV

SEQ ID NO: 101598 - protein, 36 aa, Artificial Sequence
  Description of Artificial Sequence: Synthetic polypeptide
AEEEIRTTNPVATEQYGSVSTTLNQQGNTEQGTNND

SEQ ID NO: 101599 - protein, 34 aa, Artificial Sequence
  Description of Artificial Sequence: Synthetic polypeptide
DEMEIRTTNPVATEQYGSVSSATPGPVNFEGNPD

SEQ ID NO: 101600 - protein, 36 aa, Artificial Sequence
  Description of Artificial Sequence: Synthetic polypeptide
AEEEIRTTNPVATEQYGSVSTTLQLNGNSENGTTDD

SEQ ID NO: 101601 - protein, 34 aa, Artificial Sequence
  Description of Artificial Sequence: Synthetic polypeptide
DEMEIRTTNPVATEQYGSVSSATPGPVEFEGNPD

SEQ ID NO: 101602 - protein, 30 aa, Artificial Sequence
  Description of Artificial Sequence: Synthetic polypeptide
NDFVIGTTNPVATEQWGCHSTDNLERIGNQ

SEQ ID NO: 101603 - protein, 35 aa, Artificial Sequence
  Description of Artificial Sequence: Synthetic polypeptide
SEEEIRTTNPVATEQYGSVNSDMDLDQQRNDGEGD

SEQ ID NO: 101604 - protein, 34 aa, Artificial Sequence
  Description of Artificial Sequence: Synthetic polypeptide
SEEEIRTTNPVATEQYGSVMSIGNLDEFGGEVEG

SEQ ID NO: 101605 - protein, 35 aa, Artificial Sequence
  Description of Artificial Sequence: Synthetic polypeptide
SEEEIRTTNPVATEQYGSVMSIGNQLDEFGGQNEG

SEQ ID NO: 101606 - protein, 33 aa, Artificial Sequence
  Description of Artificial Sequence: Synthetic polypeptide
DAAEIATTNPVATEQYGSTCAMTENLEARDGDR

SEQ ID NO: 101607 - protein, 35 aa, Artificial Sequence
  Description of Artificial Sequence: Synthetic polypeptide
DEMEIRTTNPVATEQYGSVSTGDDDLQQLEGEEDH

SEQ ID NO: 101608 - protein, 33 aa, Artificial Sequence
  Description of Artificial Sequence: Synthetic polypeptide
DEMEIRTTNPVATEQYGSVSTEPYTQETQDTIG

SEQ ID NO: 101609 - protein, 34 aa, Artificial Sequence
  Description of Artificial Sequence: Synthetic polypeptide
DEMEIRTTNPVATEQYGSVSTENDYTQETQDTAG

SEQ ID NO: 101610 - protein, 34 aa, Artificial Sequence
  Description of Artificial Sequence: Synthetic polypeptide
DEMEIRTTNPVATEQYGSVSTDSPLENNNQNDDP

SEQ ID NO: 101611 - protein, 33 aa, Artificial Sequence
  Description of Artificial Sequence: Synthetic polypeptide
NEAEIATTNPVATEQYGSVCWTDNHHQIGDSER

SEQ ID NO: 101612 - protein, 33 aa, Artificial Sequence
  Description of Artificial Sequence: Synthetic polypeptide
SEEEIRTTNPVATEQYGSVNESPLIIRGEMYED

SEQ ID NO: 101613 - protein, 35 aa, Artificial Sequence
  Description of Artificial Sequence: Synthetic polypeptide
DEMEIRTTNPVATEQYGSVSSTTPAPPNREGMNPV

SEQ ID NO: 101614 - protein, 33 aa, Artificial Sequence
  Description of Artificial Sequence: Synthetic polypeptide
NEAEIATTNPVATEQYGSVCWTDNHDQIGGSTR

SEQ ID NO: 101615 - protein, 34 aa, Artificial Sequence
  Description of Artificial Sequence: Synthetic polypeptide
SEEEIRTTNPVATEQYGSVNESPVLIQFPENYED

SEQ ID NO: 101616 - protein, 31 aa, Artificial Sequence
  Description of Artificial Sequence: Synthetic polypeptide
NDFVIGTTNPVATEQWGCVSTHNLERIGNQV

SEQ ID NO: 101617 - protein, 32 aa, Artificial Sequence
  Description of Artificial Sequence: Synthetic polypeptide
AENEIVTTNPVATEQYGTVCSAEDGLVQFGND

SEQ ID NO: 101618 - protein, 34 aa, Artificial Sequence
  Description of Artificial Sequence: Synthetic polypeptide
DEMEIRTTNPVATEQYGSVSTANEDMIESENDNQ

SEQ ID NO: 101619 - protein, 36 aa, Artificial Sequence
  Description of Artificial Sequence: Synthetic polypeptide
DEMEIRTTNPVATEQYGSVSSTWNGLESRSGDDQEF

SEQ ID NO: 101620 - protein, 36 aa, Artificial Sequence
  Description of Artificial Sequence: Synthetic polypeptide
DEMEIRTTNPVATEQYGSVSSTTPWQPNMRNGMNVL

SEQ ID NO: 101621 - protein, 34 aa, Artificial Sequence
  Description of Artificial Sequence: Synthetic polypeptide
DEMEIRTTNPVATEQYGSVSSTTPAPVNFEGNPD

SEQ ID NO: 101622 - protein, 34 aa, Artificial Sequence
  Description of Artificial Sequence: Synthetic polypeptide
SEEEIRTTNPVATEQYGSVNNMSGTDQGTGENGQ

SEQ ID NO: 101623 - protein, 35 aa, Artificial Sequence
  Description of Artificial Sequence: Synthetic polypeptide
SEEEIRTTNPVATEQYGSVNNTNEIDDEWGMENRN

SEQ ID NO: 101624 - protein, 31 aa, Artificial Sequence
  Description of Artificial Sequence: Synthetic polypeptide
NDSVIGTTNPVATEQFGCVSTHNLERIGNQK

SEQ ID NO: 101625 - protein, 36 aa, Artificial Sequence
  Description of Artificial Sequence: Synthetic polypeptide
DEMEIRTTNPVATEQYGSVSTGNDDLQQMEGEEDKS

SEQ ID NO: 101626 - protein, 34 aa, Artificial Sequence
  Description of Artificial Sequence: Synthetic polypeptide
DEMEIRTTNPVATEQYGSVSSATPAPVNFEGNPD

SEQ ID NO: 101627 - protein, 32 aa, Artificial Sequence
  Description of Artificial Sequence: Synthetic polypeptide
DEMEIRTTNPVATEQYGSVSQSAVATENVNVF

SEQ ID NO: 101628 - protein, 33 aa, Artificial Sequence
  Description of Artificial Sequence: Synthetic polypeptide
DEMEIRTTNPVATEQYGSVSPTLAVQGDEQYQK

SEQ ID NO: 101629 - protein, 35 aa, Artificial Sequence
  Description of Artificial Sequence: Synthetic polypeptide
AEEEIRTTNPVATEQYGSVSTTEGTNNNNQDENGD

SEQ ID NO: 101630 - protein, 35 aa, Artificial Sequence
  Description of Artificial Sequence: Synthetic polypeptide
AEEEIRTTNPVATEQYGSVSTTEGNNNNQNDNNGD

SEQ ID NO: 101631 - protein, 30 aa, Artificial Sequence
  Description of Artificial Sequence: Synthetic polypeptide
AENEIVCTNPVATEQYGEASATGLVQFGGD

SEQ ID NO: 101632 - protein, 34 aa, Artificial Sequence
  Description of Artificial Sequence: Synthetic polypeptide
AEEEIRTTNPVATEQYGSVSTTEGGNNNNQDNGS

SEQ ID NO: 101633 - protein, 36 aa, Artificial Sequence
  Description of Artificial Sequence: Synthetic polypeptide
AEEEIRTTNPVATEQYGSVSTTDTNLQQGTEGGTTD

SEQ ID NO: 101634 - protein, 35 aa, Artificial Sequence
  Description of Artificial Sequence: Synthetic polypeptide
SEEEIRTTNPVATEQYGSVSSTEPAGNMRNGMNPV

SEQ ID NO: 101635 - protein, 35 aa, Artificial Sequence
  Description of Artificial Sequence: Synthetic polypeptide
DEMEIRTTNPVATEQYGSVSPTFNMLEFRTEEQIM

SEQ ID NO: 101636 - protein, 33 aa, Artificial Sequence
  Description of Artificial Sequence: Synthetic polypeptide
DEMEIRTTNPVATEQYGSVSPTDTENRMSTQEI

SEQ ID NO: 101637 - protein, 35 aa, Artificial Sequence
  Description of Artificial Sequence: Synthetic polypeptide
DEMEIRTTNPVATEQYGSVSPTLNELETRTEEQEM

SEQ ID NO: 101638 - protein, 36 aa, Artificial Sequence
  Description of Artificial Sequence: Synthetic polypeptide
AEEEIRTTNPVATEQYGSVSTTDNQQGQEIGTNQDE

SEQ ID NO: 101639 - protein, 34 aa, Artificial Sequence
  Description of Artificial Sequence: Synthetic polypeptide
DETEIRTTNPVAVEQYGSVIITNGLEEGGNGNGS

SEQ ID NO: 101640 - protein, 35 aa, Artificial Sequence
  Description of Artificial Sequence: Synthetic polypeptide
AEEEIRTTNPVATEQYGVVSTTNPNLQQNDEQGEQ

SEQ ID NO: 101641 - protein, 34 aa, Artificial Sequence
  Description of Artificial Sequence: Synthetic polypeptide
DETEIRTTNPVAVEQYGSVIITNGLEGGGNGNGE

SEQ ID NO: 101642 - protein, 35 aa, Artificial Sequence
  Description of Artificial Sequence: Synthetic polypeptide
AEEEIRTTNPVATEQYGVVSTTNQLGNNNGEENAD

SEQ ID NO: 101643 - protein, 36 aa, Artificial Sequence
  Description of Artificial Sequence: Synthetic polypeptide
AEEEIRTTNPVATEQYGSVSTTDNLNNEEQGNNQIG

SEQ ID NO: 101644 - protein, 35 aa, Artificial Sequence
  Description of Artificial Sequence: Synthetic polypeptide
AEEEIRTTNPVATEQYGVVSTTNQLNNSEEGTTNL

SEQ ID NO: 101645 - protein, 35 aa, Artificial Sequence
  Description of Artificial Sequence: Synthetic polypeptide
DEMEIRTTNPVATEQYGSVSPTDNNPQNINSNQQQ

SEQ ID NO: 101646 - protein, 36 aa, Artificial Sequence
  Description of Artificial Sequence: Synthetic polypeptide
AEEEIRTTNPVATEQYGVVSTTNQLQENENGTNQTN

SEQ ID NO: 101647 - protein, 36 aa, Artificial Sequence
  Description of Artificial Sequence: Synthetic polypeptide
AEEEIRTTNPVATEQYGVVSTTNQLQNGNNEGNNAD

SEQ ID NO: 101648 - protein, 36 aa, Artificial Sequence
  Description of Artificial Sequence: Synthetic polypeptide
AEEEIRTTNPVATEQYGSVSTTDNQLNNTEQGNNQI

SEQ ID NO: 101649 - protein, 36 aa, Artificial Sequence
  Description of Artificial Sequence: Synthetic polypeptide
AEEEIRTTNPVATEQYGSVSTTLNQQGEEQGTNNDE

SEQ ID NO: 101650 - protein, 35 aa, Artificial Sequence
  Description of Artificial Sequence: Synthetic polypeptide
AEEEIRTTNPVATEQYGVVSTTNNQQQQTNGNVTQ

SEQ ID NO: 101651 - protein, 34 aa, Artificial Sequence
  Description of Artificial Sequence: Synthetic polypeptide
AEEEIRTTNPVATEQYGVVSTTNNQQQQTIGEVQ

SEQ ID NO: 101652 - protein, 34 aa, Artificial Sequence
  Description of Artificial Sequence: Synthetic polypeptide
DEMEIRTTNPVATEQYGSVSPWNSDQTLPEDGIE

SEQ ID NO: 101653 - protein, 33 aa, Artificial Sequence
  Description of Artificial Sequence: Synthetic polypeptide
DEMEIRTTNPVATEQYGSVSPWNSDQELEDKIE

SEQ ID NO: 101654 - protein, 34 aa, Artificial Sequence
  Description of Artificial Sequence: Synthetic polypeptide
DEMEIRTTNPVATEQYGSVSPWANLEFRTEEQEN

SEQ ID NO: 101655 - protein, 35 aa, Artificial Sequence
  Description of Artificial Sequence: Synthetic polypeptide
DEMEIRTTNPVATEQYGSVSPTTNLETQTEVEQAK

SEQ ID NO: 101656 - protein, 37 aa, Artificial Sequence
  Description of Artificial Sequence: Synthetic polypeptide
AEEEIRTTNPVATEQYGSVSTTLNQLQAGTETGTNTE

SEQ ID NO: 101657 - protein, 34 aa, Artificial Sequence
  Description of Artificial Sequence: Synthetic polypeptide
DEMEIRTTNPVATEQYGSVSPTTDNQETMYANQS

SEQ ID NO: 101658 - protein, 32 aa, Artificial Sequence
  Description of Artificial Sequence: Synthetic polypeptide
NDEEIRTTNPVATEQYGVVCSWENHQNFGSQQ

SEQ ID NO: 101659 - protein, 33 aa, Artificial Sequence
  Description of Artificial Sequence: Synthetic polypeptide
NDEEIRTTNPVATEQYGVVCSTENDQNFGSDQS

SEQ ID NO: 101660 - protein, 35 aa, Artificial Sequence
  Description of Artificial Sequence: Synthetic polypeptide
AEEEIRTTNPVATEQYGSVSTTLLLQQNNNNNNIL

SEQ ID NO: 101661 - protein, 35 aa, Artificial Sequence
  Description of Artificial Sequence: Synthetic polypeptide
SEEEIRTTNPVATEQYGSVSPTNDIWEGRMENQME

SEQ ID NO: 101662 - protein, 34 aa, Artificial Sequence
  Description of Artificial Sequence: Synthetic polypeptide
AEEEIRTTNPVATEQYGSVSTTLGNDNEEQGTQD

SEQ ID NO: 101663 - protein, 33 aa, Artificial Sequence
  Description of Artificial Sequence: Synthetic polypeptide
NDEEIRTTNPVATEQYGVVCSNTEDQNFGSNQS

SEQ ID NO: 101664 - protein, 35 aa, Artificial Sequence
  Description of Artificial Sequence: Synthetic polypeptide
DEMEIRTTNPVATEQYGSVSPTNLMETRTEAEQEM

SEQ ID NO: 101665 - protein, 36 aa, Artificial Sequence
  Description of Artificial Sequence: Synthetic polypeptide
AEEEIRTTNPVATEQYGSVSTTGNYGNQIGTTNSEQ

SEQ ID NO: 101666 - protein, 35 aa, Artificial Sequence
  Description of Artificial Sequence: Synthetic polypeptide
AEEEIRTTNPVATEQYGSVSTTGNQQGSTNPNTTA

SEQ ID NO: 101667 - protein, 32 aa, Artificial Sequence
  Description of Artificial Sequence: Synthetic polypeptide
NDEEIRTTNPVATEQYGCVCSWELQYFGSQQA

SEQ ID NO: 101668 - protein, 29 aa, Artificial Sequence
  Description of Artificial Sequence: Synthetic peptide
AENEIVTTNPVATEQYGEACSEGPEFGGR

SEQ ID NO: 101669 - protein, 33 aa, Artificial Sequence
  Description of Artificial Sequence: Synthetic polypeptide
DETEIRTTNPVATERWGCVPWCTNGSQYEGNNR

SEQ ID NO: 101670 - protein, 35 aa, Artificial Sequence
  Description of Artificial Sequence: Synthetic polypeptide
AEEEIRTTNPVATEQYGSVSTTEQNGTEQGTNENE

SEQ ID NO: 101671 - protein, 35 aa, Artificial Sequence
  Description of Artificial Sequence: Synthetic polypeptide
SEEEIRTTNPVATEQYGSVSPDVNLAQMHGEPPQE

SEQ ID NO: 101672 - protein, 35 aa, Artificial Sequence
  Description of Artificial Sequence: Synthetic polypeptide
NDEEIRTTNPVATEQYGVVCSNTNLNQENFGSNQS

SEQ ID NO: 101673 - protein, 35 aa, Artificial Sequence
  Description of Artificial Sequence: Synthetic polypeptide
AEEEIRTTNPVATEQYGSVSTTDGNGTNGGNNGDE

SEQ ID NO: 101674 - protein, 36 aa, Artificial Sequence
  Description of Artificial Sequence: Synthetic polypeptide
AEEEIRTTNPVATEQYGSVSTTNDGQQIGTTNTDEQ

SEQ ID NO: 101675 - protein, 34 aa, Artificial Sequence
  Description of Artificial Sequence: Synthetic polypeptide
DEMEIRTTNPVATEQYGSVSTILEEFINMNNEVF

SEQ ID NO: 101676 - protein, 35 aa, Artificial Sequence
  Description of Artificial Sequence: Synthetic polypeptide
DEMEIRTTNPVATEQYGSVSTTTDDLQEFEGEEDK

SEQ ID NO: 101677 - protein, 36 aa, Artificial Sequence
  Description of Artificial Sequence: Synthetic polypeptide
AEEEIRTTNPVATEQYGSVSTTNGNQQGEQGGNGNN

SEQ ID NO: 101678 - protein, 36 aa, Artificial Sequence
  Description of Artificial Sequence: Synthetic polypeptide
AEEEIRTTNPVATEQYGSVSTTNGNQNQQQGNIATE

SEQ ID NO: 101679 - protein, 36 aa, Artificial Sequence
  Description of Artificial Sequence: Synthetic polypeptide
AEEEIRTTNPVATEQYGSVSTTNGNNQQGNQNNDDE

SEQ ID NO: 101680 - protein, 36 aa, Artificial Sequence
  Description of Artificial Sequence: Synthetic polypeptide
AEEEIRTTNPVATEQYGSVSTTNGNNNQQGSTNTGE

SEQ ID NO: 101681 - protein, 35 aa, Artificial Sequence
  Description of Artificial Sequence: Synthetic polypeptide
AEEEIRTTNPVATEQYGSVSTTNGNNNNQQDENGV

SEQ ID NO: 101682 - protein, 35 aa, Artificial Sequence
  Description of Artificial Sequence: Synthetic polypeptide
AEEEIRTTNPVATEQYGSVSTTNGNNNNQNDNNGV

SEQ ID NO: 101683 - protein, 37 aa, Artificial Sequence
  Description of Artificial Sequence: Synthetic polypeptide
AEEEIRTTNPVATEQYGSVSTTNGNLQQGTEQGNNEE

SEQ ID NO: 101684 - protein, 37 aa, Artificial Sequence
  Description of Artificial Sequence: Synthetic polypeptide
AEEEIRTTNPVATEQYGSVSTTNGNLQQGIGTNSETG

SEQ ID NO: 101685 - protein, 36 aa, Artificial Sequence
  Description of Artificial Sequence: Synthetic polypeptide
AEEEIRTTNPVATEQYGSVSTTNGNQQQNQNGNNDE

SEQ ID NO: 101686 - protein, 31 aa, Artificial Sequence
  Description of Artificial Sequence: Synthetic polypeptide
DAAEIACTNPVATEQWGGCSATNDQRDGNNS

SEQ ID NO: 101687 - protein, 33 aa, Artificial Sequence
  Description of Artificial Sequence: Synthetic polypeptide
NEAEIRTTNPVAYEQWGAVSTTPNLQGDSGNTP

SEQ ID NO: 101688 - protein, 37 aa, Artificial Sequence
  Description of Artificial Sequence: Synthetic polypeptide
AEEEIRTTNPVATEQYGSVSTTNGNLNLQQGSEEGNE

SEQ ID NO: 101689 - protein, 37 aa, Artificial Sequence
  Description of Artificial Sequence: Synthetic polypeptide
AEEEIRTTNPVATEQYGSVSTTNGNLNLEQGTETGNE

SEQ ID NO: 101690 - protein, 36 aa, Artificial Sequence
  Description of Artificial Sequence: Synthetic polypeptide
AEEEIRTTNPVATEQYGSVSTTNGNDQNGNIGTNNM

SEQ ID NO: 101691 - protein, 36 aa, Artificial Sequence
  Description of Artificial Sequence: Synthetic polypeptide
AEEEIRTTNPVATEQYGSVSTTNGLGNNEQGTENDE

SEQ ID NO: 101692 - protein, 36 aa, Artificial Sequence
  Description of Artificial Sequence: Synthetic polypeptide
AEEEIRTTNPVATEQYGSVSTTNGGNQQGNNNNNDD

SEQ ID NO: 101693 - protein, 36 aa, Artificial Sequence
  Description of Artificial Sequence: Synthetic polypeptide
AEEEIRTTNPVATEQYGSVSTTNGEQQGNQGGNVTE

SEQ ID NO: 101694 - protein, 36 aa, Artificial Sequence
  Description of Artificial Sequence: Synthetic polypeptide
AEEEIRTTNPVATEQYGSVSTTNGEQQGNEGGNTTQ

SEQ ID NO: 101695 - protein, 36 aa, Artificial Sequence
  Description of Artificial Sequence: Synthetic polypeptide
AEEEIRTTNPVATEQYGSVSTTNGEQQGEQGGNQNE

SEQ ID NO: 101696 - protein, 31 aa, Artificial Sequence
  Description of Artificial Sequence: Synthetic polypeptide
DAAEIACTNPVATEQWGGCSATNGQRDGHNN

SEQ ID NO: 101697 - protein, 35 aa, Artificial Sequence
  Description of Artificial Sequence: Synthetic polypeptide
SEEEIRTTNPVATEQYGSVCGSTGDLGQGGEQEGI

SEQ ID NO: 101698 - protein, 35 aa, Artificial Sequence
  Description of Artificial Sequence: Synthetic polypeptide
AEEEIRTTNPVATEQYGSVSTTNGNQQQTTTNNVD

SEQ ID NO: 101699 - protein, 34 aa, Artificial Sequence
  Description of Artificial Sequence: Synthetic polypeptide
DEMEIRTTNPVATEQYGSVSTVDMLDNESFQGHN

SEQ ID NO: 101700 - protein, 33 aa, Artificial Sequence
  Description of Artificial Sequence: Synthetic polypeptide
DEMEIRTTNPVATEQYGSVSVMDHLNRIESSQS

SEQ ID NO: 101701 - protein, 33 aa, Artificial Sequence
  Description of Artificial Sequence: Synthetic polypeptide
DEMEIRTTNPVATEQYGSVSVLTLGTESGGQQS

SEQ ID NO: 101702 - protein, 32 aa, Artificial Sequence
  Description of Artificial Sequence: Synthetic polypeptide
DEMEIRTTNPVATEQYGSVSVLNGMVFESEQD

SEQ ID NO: 101703 - protein, 33 aa, Artificial Sequence
  Description of Artificial Sequence: Synthetic polypeptide
CTGEIRTTNPVATEQYGSVSTQNNGQENGEMEG

SEQ ID NO: 101704 - protein, 36 aa, Artificial Sequence
  Description of Artificial Sequence: Synthetic polypeptide
AEEEIRTTNPVATEQYGSVSTTNGQSGNNNIGTNQD

SEQ ID NO: 101705 - protein, 36 aa, Artificial Sequence
  Description of Artificial Sequence: Synthetic polypeptide
AEEEIRTTNPVATEQYGSVSTTNGQQQNNNIGTNEE

SEQ ID NO: 101706 - protein, 32 aa, Artificial Sequence
  Description of Artificial Sequence: Synthetic polypeptide
SEEEIRTTNPVATEQYGSSNTSVLEQDPEEKE

SEQ ID NO: 101707 - protein, 37 aa, Artificial Sequence
  Description of Artificial Sequence: Synthetic polypeptide
AEEEIRTTNPVATEQYGSVSTTNGQLNQQIGTNTEDT

SEQ ID NO: 101708 - protein, 35 aa, Artificial Sequence
  Description of Artificial Sequence: Synthetic polypeptide
AEEEIRTTNPVATEQYGSVSTTNGQENQQGTEDET

SEQ ID NO: 101709 - protein, 35 aa, Artificial Sequence
  Description of Artificial Sequence: Synthetic polypeptide
AEEEIRTTNPVATEQYGSVSTTNGNTNNTEGNNQD

SEQ ID NO: 101710 - protein, 35 aa, Artificial Sequence
  Description of Artificial Sequence: Synthetic polypeptide
AEEEIRTTNPVATEQYGSVSTTNGQENQQGTEDED

SEQ ID NO: 101711 - protein, 32 aa, Artificial Sequence
  Description of Artificial Sequence: Synthetic polypeptide
SEEEIRTTNPVATEQYGSVAPALLQEVQFDQF

SEQ ID NO: 101712 - protein, 36 aa, Artificial Sequence
  Description of Artificial Sequence: Synthetic polypeptide
AEEEIRTTNPVATEQYGSVSTTNGQDENNNIGTNMT

SEQ ID NO: 101713 - protein, 31 aa, Artificial Sequence
  Description of Artificial Sequence: Synthetic polypeptide
NEAEIRTTNPVAYEQWGSATTNQQGNDGGAR

SEQ ID NO: 101714 - protein, 33 aa, Artificial Sequence
  Description of Artificial Sequence: Synthetic polypeptide
CTGEIRTTNPVATEQYGSVSTQNNGQSEGEGGT

SEQ ID NO: 101715 - protein, 32 aa, Artificial Sequence
  Description of Artificial Sequence: Synthetic polypeptide
SEEEIRTTNPVATEQYGSVAPWLQQEDQFDQF

SEQ ID NO: 101716 - protein, 34 aa, Artificial Sequence
  Description of Artificial Sequence: Synthetic polypeptide
DEMEIRTTNPVATEQYGSVSTVHEFIEGVENDFD

SEQ ID NO: 101717 - protein, 36 aa, Artificial Sequence
  Description of Artificial Sequence: Synthetic polypeptide
AEEEIRTTNPVATEQYGSVSTTNGQDENGNIGTNED

SEQ ID NO: 101718 - protein, 34 aa, Artificial Sequence
  Description of Artificial Sequence: Synthetic polypeptide
DEMEIRTTNPVATEQYGSVSTVHEEIEGGENDFN

SEQ ID NO: 101719 - protein, 36 aa, Artificial Sequence
  Description of Artificial Sequence: Synthetic polypeptide
AEEEIRTTNPVATEQYGSVSTTNGQAGNNNQGTNEM

SEQ ID NO: 101720 - protein, 36 aa, Artificial Sequence
  Description of Artificial Sequence: Synthetic polypeptide
AEEEIRTTNPVATEQYGSVSTTNGQDQNNNIGTNVD

SEQ ID NO: 101721 - protein, 36 aa, Artificial Sequence
  Description of Artificial Sequence: Synthetic polypeptide
SEEEIRTTNPVATEQYGSVISTGGSLSDSPGGMNRF

SEQ ID NO: 101722 - protein, 35 aa, Artificial Sequence
  Description of Artificial Sequence: Synthetic polypeptide
SEEEIRTTNPVATEQYGSVCNESPLIQNRGENYED

SEQ ID NO: 101723 - protein, 33 aa, Artificial Sequence
  Description of Artificial Sequence: Synthetic polypeptide
DEMEIRTTNPVATEQYGSVSTPDEQYTASPQTM

SEQ ID NO: 101724 - protein, 32 aa, Artificial Sequence
  Description of Artificial Sequence: Synthetic polypeptide
DAAEIATTNPVATEQWGSVSTDPLNHQDGMHH

SEQ ID NO: 101725 - protein, 32 aa, Artificial Sequence
  Description of Artificial Sequence: Synthetic polypeptide
SEEEIRTTNPVATEQYGSVEPALQQEHQFDQQ

SEQ ID NO: 101726 - protein, 34 aa, Artificial Sequence
  Description of Artificial Sequence: Synthetic polypeptide
AEEEIRTTNPVATEQYGVVSTTNNNQQQDTIGEQ

SEQ ID NO: 101727 - protein, 33 aa, Artificial Sequence
  Description of Artificial Sequence: Synthetic polypeptide
NEAEIRTTNPVATEMWGSVSTNLPQGNEGGDAD

SEQ ID NO: 101728 - protein, 33 aa, Artificial Sequence
  Description of Artificial Sequence: Synthetic polypeptide
DAAEIATTNPVATEQWGSVSTNPLQVHQDGMHN

SEQ ID NO: 101729 - protein, 34 aa, Artificial Sequence
  Description of Artificial Sequence: Synthetic polypeptide
DAAEIATTNPVATEQWGSVSTPNPLQEHQDGMNH

SEQ ID NO: 101730 - protein, 33 aa, Artificial Sequence
  Description of Artificial Sequence: Synthetic polypeptide
DAAEIATTNPVATEQWGSVSTPNPLTHQDGMHN

SEQ ID NO: 101731 - protein, 33 aa, Artificial Sequence
  Description of Artificial Sequence: Synthetic polypeptide
NEAEIRTTNPVATEMWGSVSTNLNQGNEGGDDS

SEQ ID NO: 101732 - protein, 35 aa, Artificial Sequence
  Description of Artificial Sequence: Synthetic polypeptide
DEMEIRTTNPVATEQYGSVSTMNDTQPEENQQETE

SEQ ID NO: 101733 - protein, 32 aa, Artificial Sequence
  Description of Artificial Sequence: Synthetic polypeptide
DAAEIATTNPVATEQWGSVSTDPLGEHQDGMH

SEQ ID NO: 101734 - protein, 31 aa, Artificial Sequence
  Description of Artificial Sequence: Synthetic polypeptide
NEAEIATTNPVAYEQWGSVSGGDNHQMGGNM

SEQ ID NO: 101735 - protein, 33 aa, Artificial Sequence
  Description of Artificial Sequence: Synthetic polypeptide
NEAEIATTNPVAYEQWGSVCSTNGLQWDGGNNQ

SEQ ID NO: 101736 - protein, 36 aa, Artificial Sequence
  Description of Artificial Sequence: Synthetic polypeptide
AEEEIRTTNPVATEQYGSVSTTNDNQQGGTEENETE

SEQ ID NO: 101737 - protein, 32 aa, Artificial Sequence
  Description of Artificial Sequence: Synthetic polypeptide
NEAEIATTNPVATEYWGNVSTNLQGNSGNTDS

SEQ ID NO: 101738 - protein, 35 aa, Artificial Sequence
  Description of Artificial Sequence: Synthetic polypeptide
AEEEIRTTNPVATEQYGSVSTTNDNGVTNGTNQAN

SEQ ID NO: 101739 - protein, 31 aa, Artificial Sequence
  Description of Artificial Sequence: Synthetic polypeptide
AENEIVTTNPVATEQYGTVCSTGPVEFEGND

SEQ ID NO: 101740 - protein, 36 aa, Artificial Sequence
  Description of Artificial Sequence: Synthetic polypeptide
AEEEIRTTNPVATEQYGSVSTTNDNGNQEQGNNQDD

SEQ ID NO: 101741 - protein, 36 aa, Artificial Sequence
  Description of Artificial Sequence: Synthetic polypeptide
AEEEIRTTNPVATEQYGSVSTTNDNGNQEIGNNQID

SEQ ID NO: 101742 - protein, 34 aa, Artificial Sequence
  Description of Artificial Sequence: Synthetic polypeptide
SEEEIRTTNPVATEQYGSVINPTSVLEQRPEEKE

SEQ ID NO: 101743 - protein, 34 aa, Artificial Sequence
  Description of Artificial Sequence: Synthetic polypeptide
SEEEIRTTNPVATEQYGSVISDTNGGEGDDEGFV

SEQ ID NO: 101744 - protein, 31 aa, Artificial Sequence
  Description of Artificial Sequence: Synthetic polypeptide
NEAEIATTNPVAYEQWGSVRWWNLDEQGNRN

SEQ ID NO: 101745 - protein, 30 aa, Artificial Sequence
  Description of Artificial Sequence: Synthetic polypeptide
AENEVASTNPVSTEQYGEASAENLQRVGQR

SEQ ID NO: 101746 - protein, 33 aa, Artificial Sequence
  Description of Artificial Sequence: Synthetic polypeptide
DAAEIATTNPVATEQWGSVSTANPLQHQDGMHG

SEQ ID NO: 101747 - protein, 36 aa, Artificial Sequence
  Description of Artificial Sequence: Synthetic polypeptide
AEEEIRTTNPVATEQYGVVSTTNNNQQLQNGTEEND

SEQ ID NO: 101748 - protein, 29 aa, Artificial Sequence
  Description of Artificial Sequence: Synthetic peptide
AENEVASTNPVATEQYGNAAANTIQRGQR

SEQ ID NO: 101749 - protein, 33 aa, Artificial Sequence
  Description of Artificial Sequence: Synthetic polypeptide
SEEEIRTTNPVATEQYGSVCSPENWDELEDEQY

SEQ ID NO: 101750 - protein, 34 aa, Artificial Sequence
  Description of Artificial Sequence: Synthetic polypeptide
DEMEIRTTNPVATEQYGSVSTPDDMNQQQQDSEV

SEQ ID NO: 101751 - protein, 35 aa, Artificial Sequence
  Description of Artificial Sequence: Synthetic polypeptide
SEEEIRTTNPVATEQYGSVCSPTIGLEMMGENGQE

SEQ ID NO: 101752 - protein, 35 aa, Artificial Sequence
  Description of Artificial Sequence: Synthetic polypeptide
SEEEIRTTNPVATEQYGSVCSPTLGLESEGENQQF

SEQ ID NO: 101753 - protein, 36 aa, Artificial Sequence
  Description of Artificial Sequence: Synthetic polypeptide
AEEEIRTTNPVATEQYGVVSTTNNLDNQQGNNNQNQ

SEQ ID NO: 101754 - protein, 35 aa, Artificial Sequence
  Description of Artificial Sequence: Synthetic polypeptide
SEEEIRTTNPVATEQYGSVCSPTNNDETLMEDNQY

SEQ ID NO: 101755 - protein, 36 aa, Artificial Sequence
  Description of Artificial Sequence: Synthetic polypeptide
AEEEIRTTNPVATEQYGVVSTTNNLQGNDNGTNTTN

SEQ ID NO: 101756 - protein, 36 aa, Artificial Sequence
  Description of Artificial Sequence: Synthetic polypeptide
AEEEIRTTNPVATEQYGVVSTTNNLQQNEQGNNANE

SEQ ID NO: 101757 - protein, 32 aa, Artificial Sequence
  Description of Artificial Sequence: Synthetic polypeptide
DAAEIATTNPVATEQWGSVSQNPLQHQDGMHH

SEQ ID NO: 101758 - protein, 35 aa, Artificial Sequence
  Description of Artificial Sequence: Synthetic polypeptide
AEEEIRTTNPVATEQYGVVSTTNNLTNLGNGTNND

SEQ ID NO: 101759 - protein, 30 aa, Artificial Sequence
  Description of Artificial Sequence: Synthetic polypeptide
AENEVASTNPVATEGYGEASNNLQSRVGGR

SEQ ID NO: 101760 - protein, 36 aa, Artificial Sequence
  Description of Artificial Sequence: Synthetic polypeptide
AEEEIRTTNPVATEQYGVVSTTNNNLQQGENGTNVD

SEQ ID NO: 101761 - protein, 30 aa, Artificial Sequence
  Description of Artificial Sequence: Synthetic polypeptide
AENEVASTNPVATEGYGEASENLQSRVGGR

SEQ ID NO: 101762 - protein, 30 aa, Artificial Sequence
  Description of Artificial Sequence: Synthetic polypeptide
AENEVACTNPVSTEQYGEASAENLQRVGQR

SEQ ID NO: 101763 - protein, 32 aa, Artificial Sequence
  Description of Artificial Sequence: Synthetic polypeptide
DAAEIACTNPVAYEQYGSVATNLQATEGNHSD

SEQ ID NO: 101764 - protein, 36 aa, Artificial Sequence
  Description of Artificial Sequence: Synthetic polypeptide
AEEEIRTTNPVATEQYGVVSTTNNNLQQGNNQNDEQ

SEQ ID NO: 101765 - protein, 36 aa, Artificial Sequence
  Description of Artificial Sequence: Synthetic polypeptide
AEEEIRTTNPVATEQYGSVSTTNGDQNGNIGTEGGS

SEQ ID NO: 101766 - protein, 36 aa, Artificial Sequence
  Description of Artificial Sequence: Synthetic polypeptide
AEEEIRTTNPVATEQYGVVSTTNNNLQQGNQGNNNQ

SEQ ID NO: 101767 - protein, 35 aa, Artificial Sequence
  Description of Artificial Sequence: Synthetic polypeptide
AEEEIRTTNPVATEQYGVVSTTNNNNDQGTEAGNQ

SEQ ID NO: 101768 - protein, 29 aa, Artificial Sequence
  Description of Artificial Sequence: Synthetic peptide
AENEVASTNPVATEQYGEAAANTIQRGQR

SEQ ID NO: 101769 - protein, 36 aa, Artificial Sequence
  Description of Artificial Sequence: Synthetic polypeptide
AEEEIRTTNPVATEQYGVVSTTNQLQNGNQEGNNAE

SEQ ID NO: 101770 - protein, 36 aa, Artificial Sequence
  Description of Artificial Sequence: Synthetic polypeptide
AEEEIRTTNPVATEQYGVVSTTNQLQNQENGNEQGE

SEQ ID NO: 101771 - protein, 35 aa, Artificial Sequence
  Description of Artificial Sequence: Synthetic polypeptide
AEEEIRTTNPVATEQYGSVSTTANQQQANNNTTTD

SEQ ID NO: 101772 - protein, 33 aa, Artificial Sequence
  Description of Artificial Sequence: Synthetic polypeptide
MEGEIRTTNPVATEQYGSVSWTLFGNDETENDP

SEQ ID NO: 101773 - protein, 34 aa, Artificial Sequence
  Description of Artificial Sequence: Synthetic polypeptide
DEMEIRTTNPVATEQYGSVSANADEHEGSQTNET

SEQ ID NO: 101774 - protein, 33 aa, Artificial Sequence
  Description of Artificial Sequence: Synthetic polypeptide
DETEIRTTNPVAYEQWGSVCSTMNIDGEGGNNA

SEQ ID NO: 101775 - protein, 35 aa, Artificial Sequence
  Description of Artificial Sequence: Synthetic polypeptide
MEGEIRTTNPVATEQYGSVSVSSNLQPRELQDDIR

SEQ ID NO: 101776 - protein, 34 aa, Artificial Sequence
  Description of Artificial Sequence: Synthetic polypeptide
SEEEIRTTNPVATEQYGSVSVTYPSPENILSNNE

SEQ ID NO: 101777 - protein, 37 aa, Artificial Sequence
  Description of Artificial Sequence: Synthetic polypeptide
AEEEIRTTNPVATEQYGSVSTSNNNQLQQGSTNQEDE

SEQ ID NO: 101778 - protein, 35 aa, Artificial Sequence
  Description of Artificial Sequence: Synthetic polypeptide
DEMEIRTTNPVATEQYGSVSADNDEHQEGSEENHT

SEQ ID NO: 101779 - protein, 33 aa, Artificial Sequence
  Description of Artificial Sequence: Synthetic polypeptide
DEMEIRTTNPVATEQYGSVSAADEAEGSEENLT

SEQ ID NO: 101780 - protein, 34 aa, Artificial Sequence
  Description of Artificial Sequence: Synthetic polypeptide
MEGEIRTTNPVATEQYGSVSTNNLDQINPVSIDI

SEQ ID NO: 101781 - protein, 34 aa, Artificial Sequence
  Description of Artificial Sequence: Synthetic polypeptide
DETEIRTTNPVAYEQWGSVCSTDNHLNDHGGNDT

SEQ ID NO: 101782 - protein, 34 aa, Artificial Sequence
  Description of Artificial Sequence: Synthetic polypeptide
MEGEIRTTNPVATEQYGSVSTNDNTSMEGENDGI

SEQ ID NO: 101783 - protein, 34 aa, Artificial Sequence
  Description of Artificial Sequence: Synthetic polypeptide
DETEIRTTNPVAYEQWGSVSNNNDHQEGRGENSE

SEQ ID NO: 101784 - protein, 32 aa, Artificial Sequence
  Description of Artificial Sequence: Synthetic polypeptide
DEMEIRTTNPVATEQYGSVPTTTLESTEQMQV

SEQ ID NO: 101785 - protein, 32 aa, Artificial Sequence
  Description of Artificial Sequence: Synthetic polypeptide
DEMEIRTTNPVATEQYGSVPTTTLESMEVQDG

SEQ ID NO: 101786 - protein, 32 aa, Artificial Sequence
  Description of Artificial Sequence: Synthetic polypeptide
DEMEIRTTNPVATEQYGSVPTETLESTEMMQQ

SEQ ID NO: 101787 - protein, 36 aa, Artificial Sequence
  Description of Artificial Sequence: Synthetic polypeptide
AEEEIRTTNPVATEQYGVVSTTTNLQQGSTNANDQA

SEQ ID NO: 101788 - protein, 35 aa, Artificial Sequence
  Description of Artificial Sequence: Synthetic polypeptide
AEEEIRTTNPVATEQYGVVSTTTNLQSGSTDEEQD

SEQ ID NO: 101789 - protein, 34 aa, Artificial Sequence
  Description of Artificial Sequence: Synthetic polypeptide
DEMEIRTTNPVATEQYGSVNVLNLGDDEGNNNIN

SEQ ID NO: 101790 - protein, 34 aa, Artificial Sequence
  Description of Artificial Sequence: Synthetic polypeptide
DEMEIRTTNPVATEQYGSVNVDNGLGDDEGNNNI

SEQ ID NO: 101791 - protein, 32 aa, Artificial Sequence
  Description of Artificial Sequence: Synthetic polypeptide
MEGEIRTTNPVATEQYGSVNNTDEDEYGEVRP

SEQ ID NO: 101792 - protein, 35 aa, Artificial Sequence
  Description of Artificial Sequence: Synthetic polypeptide
DEMEIRTTNPVATEQYGSVQSVDALQEPGNSQHEI

SEQ ID NO: 101793 - protein, 32 aa, Artificial Sequence
  Description of Artificial Sequence: Synthetic polypeptide
MEGEIRTTNPVATEQYGSVITPWNSDHGEEQN

SEQ ID NO: 101794 - protein, 34 aa, Artificial Sequence
  Description of Artificial Sequence: Synthetic polypeptide
DEMEIRTTNPVATEQYGSVSANNDEHEGSEENHT

SEQ ID NO: 101795 - protein, 36 aa, Artificial Sequence
  Description of Artificial Sequence: Synthetic polypeptide
AEEEIRTTNPVATEQYGVVSTTTNLQNGNQAGNNAE

SEQ ID NO: 101796 - protein, 33 aa, Artificial Sequence
  Description of Artificial Sequence: Synthetic polypeptide
DEMEIRTTNPVATEQYGSVSCSPALQMTQEDIF

SEQ ID NO: 101797 - protein, 29 aa, Artificial Sequence
  Description of Artificial Sequence: Synthetic peptide
MENEIATTNPVATECYGCVSEELQHEEEL

SEQ ID NO: 101798 - protein, 35 aa, Artificial Sequence
  Description of Artificial Sequence: Synthetic polypeptide
AEEEIRTTNPVATEQYGSVSTSNQGANNNGNNNEG

SEQ ID NO: 101799 - protein, 35 aa, Artificial Sequence
  Description of Artificial Sequence: Synthetic polypeptide
AEEEIRTTNPVATEQYGSVSTSNQGANEQGNNTGG

SEQ ID NO: 101800 - protein, 30 aa, Artificial Sequence
  Description of Artificial Sequence: Synthetic polypeptide
MENEIACTNPVATEQYGEFSEVLQRTDGQQ

SEQ ID NO: 101801 - protein, 30 aa, Artificial Sequence
  Description of Artificial Sequence: Synthetic polypeptide
MENEIACTNPVATEQYGECSPEVLQRGDGQ

SEQ ID NO: 101802 - protein, 30 aa, Artificial Sequence
  Description of Artificial Sequence: Synthetic polypeptide
MENEIACTNPVATEQYGEASEWVLQRGDGQ

SEQ ID NO: 101803 - protein, 33 aa, Artificial Sequence
  Description of Artificial Sequence: Synthetic polypeptide
MEKEIATVNPVATEQYGSVITNGLGGQEGGNNT

SEQ ID NO: 101804 - protein, 34 aa, Artificial Sequence
  Description of Artificial Sequence: Synthetic polypeptide
AEEEIRTTNPVATEQYGSVSTSNNQQQTTTEMIG

SEQ ID NO: 101805 - protein, 34 aa, Artificial Sequence
  Description of Artificial Sequence: Synthetic polypeptide
SEEEIRTTNPVATEQYGSVSVMGDLDNRNQGEAD

SEQ ID NO: 101806 - protein, 36 aa, Artificial Sequence
  Description of Artificial Sequence: Synthetic polypeptide
AEEEIRTTNPVATEQYGVVSTTTANLQAGDEAGNEE

SEQ ID NO: 101807 - protein, 32 aa, Artificial Sequence
  Description of Artificial Sequence: Synthetic polypeptide
MEGEIRTTNPVATGHYGSVSDTLNLTEGTDMP

SEQ ID NO: 101808 - protein, 34 aa, Artificial Sequence
  Description of Artificial Sequence: Synthetic polypeptide
AEEEIRTTNPVATEQYGSVSTSNNQQQTTEQIGE

SEQ ID NO: 101809 - protein, 35 aa, Artificial Sequence
  Description of Artificial Sequence: Synthetic polypeptide
AEEEIRTTNPVATEQYGSVSTSNNQQQTNNGTIAT

SEQ ID NO: 101810 - protein, 36 aa, Artificial Sequence
  Description of Artificial Sequence: Synthetic polypeptide
AEEEIRTTNPVATEQYGSVSTSNNQQQQNGNGNIEG

SEQ ID NO: 101811 - protein, 36 aa, Artificial Sequence
  Description of Artificial Sequence: Synthetic polypeptide
AEEEIRTTNPVATEQYGSVSTSNNQQQQNGNGNEGT

SEQ ID NO: 101812 - protein, 36 aa, Artificial Sequence
  Description of Artificial Sequence: Synthetic polypeptide
AEEEIRTTNPVATEQYGVVSTTTNLQNGNDEGNAEE

SEQ ID NO: 101813 - protein, 34 aa, Artificial Sequence
  Description of Artificial Sequence: Synthetic polypeptide
MEGEIRTTNPVATEQYGSVWTLVLEQGGGNNEDH

SEQ ID NO: 101814 - protein, 36 aa, Artificial Sequence
  Description of Artificial Sequence: Synthetic polypeptide
AEEEIRTTNPVATEQYGSVSTSNNQQQQGNGNQNGD

SEQ ID NO: 101815 - protein, 34 aa, Artificial Sequence
  Description of Artificial Sequence: Synthetic polypeptide
DETEIRTTNPVAYEQWGSVCSGDNNGDQRNGNGA

SEQ ID NO: 101816 - protein, 33 aa, Artificial Sequence
  Description of Artificial Sequence: Synthetic polypeptide
DETEIRTTNPVAYEQWGSVATTSNPQGNDGNAP

SEQ ID NO: 101817 - protein, 33 aa, Artificial Sequence
  Description of Artificial Sequence: Synthetic polypeptide
DETEIRTTNPVAYEQWGSSWSLDNDLQRNDQDR

SEQ ID NO: 101818 - protein, 32 aa, Artificial Sequence
  Description of Artificial Sequence: Synthetic polypeptide
MEGEIRTTNPVATEQYGSSSLVNEERGGDGQD

SEQ ID NO: 101819 - protein, 35 aa, Artificial Sequence
  Description of Artificial Sequence: Synthetic polypeptide
SEEEIRTTNPVATEQYGSVVSVMGDLDQRNQGEGD

SEQ ID NO: 101820 - protein, 34 aa, Artificial Sequence
  Description of Artificial Sequence: Synthetic polypeptide
DEMEIRTTNPVATEQYGSVFSPTGLEFRTEEQEN

SEQ ID NO: 101821 - protein, 35 aa, Artificial Sequence
  Description of Artificial Sequence: Synthetic polypeptide
AEEEIRTTNPVATEQYGSVSTSNLGNANNNNNNEG

SEQ ID NO: 101822 - protein, 34 aa, Artificial Sequence
  Description of Artificial Sequence: Synthetic polypeptide
DEMEIRTTNPVATEQYGSVETANDEHEGSEENHT

SEQ ID NO: 101823 - protein, 35 aa, Artificial Sequence
  Description of Artificial Sequence: Synthetic polypeptide
DEMEIRTTNPVATEQYGSVEDSTLLRQGNDENIQS

SEQ ID NO: 101824 - protein, 36 aa, Artificial Sequence
  Description of Artificial Sequence: Synthetic polypeptide
DEMEIRTTNPVATEQYGSVCYTTLCNQDRIDGNQIN

SEQ ID NO: 101825 - protein, 33 aa, Artificial Sequence
  Description of Artificial Sequence: Synthetic polypeptide
SEEEIRTTNPVATESWGSVYCNTNDHERGGDQR

SEQ ID NO: 101826 - protein, 34 aa, Artificial Sequence
  Description of Artificial Sequence: Synthetic polypeptide
SEEEIRTTNPVATESYGCVCSNTNLIRFGSDTQS

SEQ ID NO: 101827 - protein, 36 aa, Artificial Sequence
  Description of Artificial Sequence: Synthetic polypeptide
AEEEIRTTNPVATEQYGVVSTTTNNNLQQGNNGNNY

SEQ ID NO: 101828 - protein, 35 aa, Artificial Sequence
  Description of Artificial Sequence: Synthetic polypeptide
AEEEIRTTNPVATEQYGVVSTTTNNQQGEQENEEG

SEQ ID NO: 101829 - protein, 28 aa, Artificial Sequence
  Description of Artificial Sequence: Synthetic peptide
MEGEIAPTNPCSFEMYGIVSCNLQNGTR

SEQ ID NO: 101830 - protein, 33 aa, Artificial Sequence
  Description of Artificial Sequence: Synthetic polypeptide
SEEEIRTTNPVATESYGESVSNHNQEWWGDQRQ

SEQ ID NO: 101831 - protein, 36 aa, Artificial Sequence
  Description of Artificial Sequence: Synthetic polypeptide
AEEEIRTTNPVATEQYGSVSTSGSNNNQQGSTNSGV

SEQ ID NO: 101832 - protein, 35 aa, Artificial Sequence
  Description of Artificial Sequence: Synthetic polypeptide
SEEEIRTTNPVATESYGSVCSNTLNDHERSGGDQR

SEQ ID NO: 101833 - protein, 33 aa, Artificial Sequence
  Description of Artificial Sequence: Synthetic polypeptide
MEEEITTTNPVATEQYGNVSVTQGGGQGDGNEN

SEQ ID NO: 101834 - protein, 35 aa, Artificial Sequence
  Description of Artificial Sequence: Synthetic polypeptide
DEMEIRTTNPVATEQYGSVCSTTDAPVEREGMNPV

SEQ ID NO: 101835 - protein, 32 aa, Artificial Sequence
  Description of Artificial Sequence: Synthetic polypeptide
MEEEITTTNPVATEQYGNVSVTGGGQGGGEEG

SEQ ID NO: 101836 - protein, 35 aa, Artificial Sequence
  Description of Artificial Sequence: Synthetic polypeptide
DEMEIRTTNPVATEQYGSVCSTNNLEQEQMPLQSE

SEQ ID NO: 101837 - protein, 33 aa, Artificial Sequence
  Description of Artificial Sequence: Synthetic polypeptide
MEEEITTTNPVATEQYGNVSVTGGGQGDGNNEQ

SEQ ID NO: 101838 - protein, 33 aa, Artificial Sequence
  Description of Artificial Sequence: Synthetic polypeptide
MEEEITTTNPVATEQYGNVSVTGGGQGDGNGEV

SEQ ID NO: 101839 - protein, 34 aa, Artificial Sequence
  Description of Artificial Sequence: Synthetic polypeptide
DEMEIRTTNPVATEQYGSVCSTDYEAQHSGIETT

SEQ ID NO: 101840 - protein, 36 aa, Artificial Sequence
  Description of Artificial Sequence: Synthetic polypeptide
AEEEIRTTNPVATEQYGVVSTTTNQLQNGNNENNDD

SEQ ID NO: 101841 - protein, 36 aa, Artificial Sequence
  Description of Artificial Sequence: Synthetic polypeptide
AEEEIRTTNPVATEQYGVVSTTTNNLQQGNNGGNNY

SEQ ID NO: 101842 - protein, 33 aa, Artificial Sequence
  Description of Artificial Sequence: Synthetic polypeptide
DEMEIRTTNPVATEQYGSVGPMNLENRSEEDQE

SEQ ID NO: 101843 - protein, 33 aa, Artificial Sequence
  Description of Artificial Sequence: Synthetic polypeptide
SEEEIRTTNPVATEQYGSVYTPTHMGEGSEDER

SEQ ID NO: 101844 - protein, 30 aa, Artificial Sequence
  Description of Artificial Sequence: Synthetic polypeptide
AENEIRTTNPVSTEQYGTASMENIQQQGGH

SEQ ID NO: 101845 - protein, 35 aa, Artificial Sequence
  Description of Artificial Sequence: Synthetic polypeptide
DEMEIRTTNPVATEQYGSVNSTTDDQQYEGENENG

SEQ ID NO: 101846 - protein, 33 aa, Artificial Sequence
  Description of Artificial Sequence: Synthetic polypeptide
MEGEIRTTNPVATEQYGSCSVTNILIEEGEEQF

SEQ ID NO: 101847 - protein, 34 aa, Artificial Sequence
  Description of Artificial Sequence: Synthetic polypeptide
MEGEIRTTNPVATEQYGSCSPTNDIQNRDGDEQD

SEQ ID NO: 101848 - protein, 31 aa, Artificial Sequence
  Description of Artificial Sequence: Synthetic polypeptide
AENEIRTTNPVSTEQYGEISMEDIQQRNGGR

SEQ ID NO: 101849 - protein, 34 aa, Artificial Sequence
  Description of Artificial Sequence: Synthetic polypeptide
SEEEIRTTNPVATEQYGSVVWENQEQMGNNSNIE

SEQ ID NO: 101850 - protein, 32 aa, Artificial Sequence
  Description of Artificial Sequence: Synthetic polypeptide
MEGEIRTTNPVATEQYGCVSTVMLSDETGEGF

SEQ ID NO: 101851 - protein, 33 aa, Artificial Sequence
  Description of Artificial Sequence: Synthetic polypeptide
SEEEIRTTNPVATEQYGSVWMTDDMNNGFELNM

SEQ ID NO: 101852 - protein, 34 aa, Artificial Sequence
  Description of Artificial Sequence: Synthetic polypeptide
DEMEIRTTNPVATEQYGSVNSTNIENFNSNNNQG

SEQ ID NO: 101853 - protein, 35 aa, Artificial Sequence
  Description of Artificial Sequence: Synthetic polypeptide
DEMEIRTTNPVATEQYGSVISPNDLLERNDENVMT

SEQ ID NO: 101854 - protein, 33 aa, Artificial Sequence
  Description of Artificial Sequence: Synthetic polypeptide
SEEEIRTTNPVATEQYGSVWTDDKNNGFENNMD

SEQ ID NO: 101855 - protein, 33 aa, Artificial Sequence
  Description of Artificial Sequence: Synthetic polypeptide
SEEEIRTTNPVATEQYGSVWTEDDMNNGFEDNM

SEQ ID NO: 101856 - protein, 32 aa, Artificial Sequence
  Description of Artificial Sequence: Synthetic polypeptide
DEMEIRTTNPVATEQYGSVIVPLLDEYQDDRQ

SEQ ID NO: 101857 - protein, 34 aa, Artificial Sequence
  Description of Artificial Sequence: Synthetic polypeptide
DEMEIRTTNPVATEQYGSVISTPNNQSQETETQF

SEQ ID NO: 101858 - protein, 32 aa, Artificial Sequence
  Description of Artificial Sequence: Synthetic polypeptide
MEGEIRTTNPVATEQYGCVSDVTLGERGSTQN

SEQ ID NO: 101859 - protein, 33 aa, Artificial Sequence
  Description of Artificial Sequence: Synthetic polypeptide
SEEEIRTTNPVATEQYGSVYAVTHMNSEGTNDE

SEQ ID NO: 101860 - protein, 32 aa, Artificial Sequence
  Description of Artificial Sequence: Synthetic polypeptide
MEGEIMTTNPVATEQYGNVSVGMLQGGQNDEF

SEQ ID NO: 101861 - protein, 33 aa, Artificial Sequence
  Description of Artificial Sequence: Synthetic polypeptide
SEEEIRTTNPVATEQYGSVYFTGDLEGNMEEQD

SEQ ID NO: 101862 - protein, 34 aa, Artificial Sequence
  Description of Artificial Sequence: Synthetic polypeptide
SEEEIRTTNPVATEQYGSVYPTDDPLNNGFENNM

SEQ ID NO: 101863 - protein, 33 aa, Artificial Sequence
  Description of Artificial Sequence: Synthetic polypeptide
SEEEIRTTNPVATEQYGSVYPTDNMNNTFENNM

SEQ ID NO: 101864 - protein, 33 aa, Artificial Sequence
  Description of Artificial Sequence: Synthetic polypeptide
SEEEIRTTNPVATEQYGSVWTDDMNNGFEDNLM

SEQ ID NO: 101865 - protein, 34 aa, Artificial Sequence
  Description of Artificial Sequence: Synthetic polypeptide
MENEIRTTNPIATEQYGVSVCSTTDLQCRNGGPH

SEQ ID NO: 101866 - protein, 35 aa, Artificial Sequence
  Description of Artificial Sequence: Synthetic polypeptide
DEMEIRTTNPVATEQYGSVSCTNATQDTFGSKQFE

SEQ ID NO: 101867 - protein, 35 aa, Artificial Sequence
  Description of Artificial Sequence: Synthetic polypeptide
AEEEIRTTNPVATEQYGSVSTSNQNNLQNEDEQED

SEQ ID NO: 101868 - protein, 35 aa, Artificial Sequence
  Description of Artificial Sequence: Synthetic polypeptide
AEEEIRTTNPVATEQYGSVSTSTNQQQTENGTISE

SEQ ID NO: 101869 - protein, 35 aa, Artificial Sequence
  Description of Artificial Sequence: Synthetic polypeptide
AEEEIRTTNPVATEQYGSVSTSTNQQQTEIGEEDE

SEQ ID NO: 101870 - protein, 35 aa, Artificial Sequence
  Description of Artificial Sequence: Synthetic polypeptide
MESEIRTTNPVATEQYGSVSPTVNALDLSIGENYQ

SEQ ID NO: 101871 - protein, 34 aa, Artificial Sequence
  Description of Artificial Sequence: Synthetic polypeptide
MESEIRTTNPVATEQYGSVSPTSTLDQSIGEFYQ

SEQ ID NO: 101872 - protein, 35 aa, Artificial Sequence
  Description of Artificial Sequence: Synthetic polypeptide
DEMEIRTTNPVATEQYGSVSNTNESLTDDGSQEHQ

SEQ ID NO: 101873 - protein, 35 aa, Artificial Sequence
  Description of Artificial Sequence: Synthetic polypeptide
DEMEIRTTNPVATEQYGSVSNTNELTDVDSQESHQ

SEQ ID NO: 101874 - protein, 34 aa, Artificial Sequence
  Description of Artificial Sequence: Synthetic polypeptide
DEMEIRTTNPVATEQYGSVSNTNEALTDDSQEDQ

SEQ ID NO: 101875 - protein, 34 aa, Artificial Sequence
  Description of Artificial Sequence: Synthetic polypeptide
DAAEIATTNPVATEQYGSVSTNPLQAEMGGMGMN

SEQ ID NO: 101876 - protein, 31 aa, Artificial Sequence
  Description of Artificial Sequence: Synthetic polypeptide
DETEIRTTNPVAYEAWGTVSTNLNGDTQNET

SEQ ID NO: 101877 - protein, 35 aa, Artificial Sequence
  Description of Artificial Sequence: Synthetic polypeptide
AEEEIRTTNPVATEQYGSVSTSTNQQQTEQGEEQD

SEQ ID NO: 101878 - protein, 36 aa, Artificial Sequence
  Description of Artificial Sequence: Synthetic polypeptide
MESEIRTTNPVATEQYGSVSPTSNVLDQRIWGDYQD

SEQ ID NO: 101879 - protein, 35 aa, Artificial Sequence
  Description of Artificial Sequence: Synthetic polypeptide
AEEEIRTTNPVATEQYGSVSTSTNNNNDESNGNND

SEQ ID NO: 101880 - protein, 35 aa, Artificial Sequence
  Description of Artificial Sequence: Synthetic polypeptide
AEEEIRTTNPVATEQYGSVSTSTNNNNDESGNNQS

SEQ ID NO: 101881 - protein, 35 aa, Artificial Sequence
  Description of Artificial Sequence: Synthetic polypeptide
AEEEIRTTNPVATEQYGSVSTSTNNNNDEQGNNDA

SEQ ID NO: 101882 - protein, 35 aa, Artificial Sequence
  Description of Artificial Sequence: Synthetic polypeptide
AEEEIRTTNPVATEQYGSVSTSTNNNNDEEGSNND

SEQ ID NO: 101883 - protein, 35 aa, Artificial Sequence
  Description of Artificial Sequence: Synthetic polypeptide
MESEIRTTNPVATEQYGSVSPTSNMEDTRIGENYQ

SEQ ID NO: 101884 - protein, 34 aa, Artificial Sequence
  Description of Artificial Sequence: Synthetic polypeptide
DEMEIRTTNPVATEQYGSVSNTEDNLTTVDEMDN

SEQ ID NO: 101885 - protein, 36 aa, Artificial Sequence
  Description of Artificial Sequence: Synthetic polypeptide
MESEIRTTNPVATEQYGSVSPTSNLDTERIGENYQI

SEQ ID NO: 101886 - protein, 35 aa, Artificial Sequence
  Description of Artificial Sequence: Synthetic polypeptide
AEEEIRTTNPVATEQYGVVSTTNSNQQGNGGNNQT

SEQ ID NO: 101887 - protein, 35 aa, Artificial Sequence
  Description of Artificial Sequence: Synthetic polypeptide
DEMEIRTTNPVATEQYGSVSNTEDNLITTGEEEDN

SEQ ID NO: 101888 - protein, 36 aa, Artificial Sequence
  Description of Artificial Sequence: Synthetic polypeptide
MESEIRTTNPVATEQYGSVSPTSNVLDQRIMENNQK

SEQ ID NO: 101889 - protein, 34 aa, Artificial Sequence
  Description of Artificial Sequence: Synthetic polypeptide
DEMEIRTTNPVATEQYGSVSNTEDNDDTTGEMDN

SEQ ID NO: 101890 - protein, 34 aa, Artificial Sequence
  Description of Artificial Sequence: Synthetic polypeptide
AEEEIRTTNPVATEQYGSVSTSTNQQQTETEETD

SEQ ID NO: 101891 - protein, 35 aa, Artificial Sequence
  Description of Artificial Sequence: Synthetic polypeptide
AEEEIRTTNPVATEQYGSVSTSVNNDEQGNNNQDD

SEQ ID NO: 101892 - protein, 33 aa, Artificial Sequence
  Description of Artificial Sequence: Synthetic polypeptide
DETEIRTTNPVAVEQYGSVINTTGGERGNGNGD

SEQ ID NO: 101893 - protein, 34 aa, Artificial Sequence
  Description of Artificial Sequence: Synthetic polypeptide
DETEIRTTNPVAVEQYGSVISITNGMEGGNGNGQ

SEQ ID NO: 101894 - protein, 33 aa, Artificial Sequence
  Description of Artificial Sequence: Synthetic polypeptide
DETEIRTTNPVAVEQYGSVISTDGGEFGNGNGD

SEQ ID NO: 101895 - protein, 33 aa, Artificial Sequence
  Description of Artificial Sequence: Synthetic polypeptide
DAAEIATTNPVATEQYGSVSAGNLFDSNNDNRN

SEQ ID NO: 101896 - protein, 36 aa, Artificial Sequence
  Description of Artificial Sequence: Synthetic polypeptide
AEEEIRTTNPVATEQYGSVSTTANQNQEQGEENDEE

SEQ ID NO: 101897 - protein, 33 aa, Artificial Sequence
  Description of Artificial Sequence: Synthetic polypeptide
DEMEIRTTNPVATEQYGSVSPLNLMELFSDLQI

SEQ ID NO: 101898 - protein, 35 aa, Artificial Sequence
  Description of Artificial Sequence: Synthetic polypeptide
AEEEIRTTNPVATEQYGVVSTTNQLTNNEEGGNTN

SEQ ID NO: 101899 - protein, 35 aa, Artificial Sequence
  Description of Artificial Sequence: Synthetic polypeptide
AEEEIRTTNPVATEQYGVVSTTNQLTNSEAGTTNS

SEQ ID NO: 101900 - protein, 34 aa, Artificial Sequence
  Description of Artificial Sequence: Synthetic polypeptide
AEEEIRTTNPVATEQYGVVSTTNQNQQQEATNED

SEQ ID NO: 101901 - protein, 34 aa, Artificial Sequence
  Description of Artificial Sequence: Synthetic polypeptide
DAAEIATTNPVATEQYGSVSATNPLQAQMGGMLH

SEQ ID NO: 101902 - protein, 35 aa, Artificial Sequence
  Description of Artificial Sequence: Synthetic polypeptide
AEEEIRTTNPVATEQYGSVSTTANEQGSTNPNTTE

SEQ ID NO: 101903 - protein, 36 aa, Artificial Sequence
  Description of Artificial Sequence: Synthetic polypeptide
AEEEIRTTNPVATEQYGSVSTSVTNNNQQGSTNQQE

SEQ ID NO: 101904 - protein, 32 aa, Artificial Sequence
  Description of Artificial Sequence: Synthetic polypeptide
DEMEIRTTNPVATEQYGSVSPLDLHTPSDEDG

SEQ ID NO: 101905 - protein, 33 aa, Artificial Sequence
  Description of Artificial Sequence: Synthetic polypeptide
DAAEIATTNPVATEQYGSVSANPLQDHQDGMHN

SEQ ID NO: 101906 - protein, 35 aa, Artificial Sequence
  Description of Artificial Sequence: Synthetic polypeptide
AEEEIRTTNPVATEQYGVVSTTNQQLTNSEEGNTN

SEQ ID NO: 101907 - protein, 35 aa, Artificial Sequence
  Description of Artificial Sequence: Synthetic polypeptide
MSDEIRTTNPVATEQYGSVVPSCIANLSQHGGNTR

SEQ ID NO: 101908 - protein, 33 aa, Artificial Sequence
  Description of Artificial Sequence: Synthetic polypeptide
MNQEIRTTNPVATEQYGSVSTMLSIESDQENRI

SEQ ID NO: 101909 - protein, 28 aa, Artificial Sequence
  Description of Artificial Sequence: Synthetic peptide
METEICATNPISSEQYGVVSVNLQSGTF

SEQ ID NO: 101910 - protein, 34 aa, Artificial Sequence
  Description of Artificial Sequence: Synthetic polypeptide
AEEEIRTTNPVATEQYGSVSTSVNQQNQTETEDE

SEQ ID NO: 101911 - protein, 35 aa, Artificial Sequence
  Description of Artificial Sequence: Synthetic polypeptide
AEEEIRTTNPVATEQYGSVSTSVNQQGQTEGEDET

SEQ ID NO: 101912 - protein, 36 aa, Artificial Sequence
  Description of Artificial Sequence: Synthetic polypeptide
AEEEIRTTNPVATEQYGSVSTTALQAGSTTNNNDTA

SEQ ID NO: 101913 - protein, 35 aa, Artificial Sequence
  Description of Artificial Sequence: Synthetic polypeptide
AEEEIRTTNPVATEQYGSVSTSTNNNDESGTNVDE

SEQ ID NO: 101914 - protein, 37 aa, Artificial Sequence
  Description of Artificial Sequence: Synthetic polypeptide
AEEEIRTTNPVATEQYGSVSTSTNNLQGSEQGTNTED

SEQ ID NO: 101915 - protein, 37 aa, Artificial Sequence
  Description of Artificial Sequence: Synthetic polypeptide
AEEEIRTTNPVATEQYGSVSTSTNNLQGSEQGTNISE

SEQ ID NO: 101916 - protein, 32 aa, Artificial Sequence
  Description of Artificial Sequence: Synthetic polypeptide
MEQEIATTNPVATEQYGSVSATDLEPHYGEDT

SEQ ID NO: 101917 - protein, 32 aa, Artificial Sequence
  Description of Artificial Sequence: Synthetic polypeptide
MEQEIATTNPVATEQYGSVSATDLEDHGGEDQ

SEQ ID NO: 101918 - protein, 32 aa, Artificial Sequence
  Description of Artificial Sequence: Synthetic polypeptide
MEQEIATTNPVATEQYGSVSATDLEDHEGRDL

SEQ ID NO: 101919 - protein, 32 aa, Artificial Sequence
  Description of Artificial Sequence: Synthetic polypeptide
MEQEIATTNPVATEQYGSVSATDLEDHEGEDL

SEQ ID NO: 101920 - protein, 32 aa, Artificial Sequence
  Description of Artificial Sequence: Synthetic polypeptide
DETEIRTTNPVAYEKWGEVATNLQGDLGQNGS

SEQ ID NO: 101921 - protein, 34 aa, Artificial Sequence
  Description of Artificial Sequence: Synthetic polypeptide
DETEIRTTNPVAYEQWGCSYISRNDLDQRGHRER

SEQ ID NO: 101922 - protein, 33 aa, Artificial Sequence
  Description of Artificial Sequence: Synthetic polypeptide
MENEIRTTNPVATETYGSVSENPLQEVGDTVPC

SEQ ID NO: 101923 - protein, 32 aa, Artificial Sequence
  Description of Artificial Sequence: Synthetic polypeptide
MENEIRTTNPVATEQYGVVSPAELIRPQNDDG

SEQ ID NO: 101924 - protein, 35 aa, Artificial Sequence
  Description of Artificial Sequence: Synthetic polypeptide
AEEEIRTTNPVATEQYGSVSTSQAGNDELGNNVSE

SEQ ID NO: 101925 - protein, 33 aa, Artificial Sequence
  Description of Artificial Sequence: Synthetic polypeptide
DEMEIRTTNPVATEQYGSVSGPDDNQEQQDSEG

SEQ ID NO: 101926 - protein, 34 aa, Artificial Sequence
  Description of Artificial Sequence: Synthetic polypeptide
AEEEIRTTNPVATEQYGSVSTSQAGNANDEENNG

SEQ ID NO: 101927 - protein, 34 aa, Artificial Sequence
  Description of Artificial Sequence: Synthetic polypeptide
MENEIRTTNPVATEQYGSVINTDNDGEGQGGNQE

SEQ ID NO: 101928 - protein, 34 aa, Artificial Sequence
  Description of Artificial Sequence: Synthetic polypeptide
MENEIRTTNPVATEQYGSVCSVTWPLEDRQSNEM

SEQ ID NO: 101929 - protein, 34 aa, Artificial Sequence
  Description of Artificial Sequence: Synthetic polypeptide
AEEEIRTTNPVATEQYGVVSTTQNNLQISTTEDE

SEQ ID NO: 101930 - protein, 32 aa, Artificial Sequence
  Description of Artificial Sequence: Synthetic polypeptide
MENEIRTTNPVATEQYGEVVTSAELQRVQQDG

SEQ ID NO: 101931 - protein, 33 aa, Artificial Sequence
  Description of Artificial Sequence: Synthetic polypeptide
DEMEIRTTNPVATEQYGSVSDMANNTDMVQQGE

SEQ ID NO: 101932 - protein, 35 aa, Artificial Sequence
  Description of Artificial Sequence: Synthetic polypeptide
AEEEIRTTNPVATEQYGSVSTSNQNTANEQGNTGG

SEQ ID NO: 101933 - protein, 33 aa, Artificial Sequence
  Description of Artificial Sequence: Synthetic polypeptide
DEMEIRTTNPVATEQYGSVSCVELNQMTQEDIF

SEQ ID NO: 101934 - protein, 35 aa, Artificial Sequence
  Description of Artificial Sequence: Synthetic polypeptide
DEMEIRTTNPVATEQYGSVSCTNVGTQLFGSKQFE

SEQ ID NO: 101935 - protein, 34 aa, Artificial Sequence
  Description of Artificial Sequence: Synthetic polypeptide
DEMEIRTTNPVATEQYGSVSCTNNGTQTFMKQFE

SEQ ID NO: 101936 - protein, 31 aa, Artificial Sequence
  Description of Artificial Sequence: Synthetic polypeptide
MENEIRTTNPVATEQYGVVSAELIDPQNTDG

SEQ ID NO: 101937 - protein, 34 aa, Artificial Sequence
  Description of Artificial Sequence: Synthetic polypeptide
DEMEIRTTNPVATEQYGSVSITAMLFEGGDEDKN

SEQ ID NO: 101938 - protein, 34 aa, Artificial Sequence
  Description of Artificial Sequence: Synthetic polypeptide
DEMEIRTTNPVATEQYGSVSITENNTQETQDTEG

SEQ ID NO: 101939 - protein, 33 aa, Artificial Sequence
  Description of Artificial Sequence: Synthetic polypeptide
MEQEIRTTNPVATEQYGCVSTMLSIESDQENRN

SEQ ID NO: 101940 - protein, 35 aa, Artificial Sequence
  Description of Artificial Sequence: Synthetic polypeptide
AEEEIRTTNPVATEQYGSVSTSTNNANDESGTNVA

SEQ ID NO: 101941 - protein, 32 aa, Artificial Sequence
  Description of Artificial Sequence: Synthetic polypeptide
DEMEIRTTNPVATEQYGSVSMVLNMVMESEQA

SEQ ID NO: 101942 - protein, 31 aa, Artificial Sequence
  Description of Artificial Sequence: Synthetic polypeptide
MESEIRTTNPVATEQYGCCSTEDEQETQDER

SEQ ID NO: 101943 - protein, 33 aa, Artificial Sequence
  Description of Artificial Sequence: Synthetic polypeptide
MESEIRTTNPVATEQYGACVSPTNLLENEENQG

SEQ ID NO: 101944 - protein, 36 aa, Artificial Sequence
  Description of Artificial Sequence: Synthetic polypeptide
AEEEIRTTNPVATEQYGSVSTSQQLQQQIGNGNIGT

SEQ ID NO: 101945 - protein, 33 aa, Artificial Sequence
  Description of Artificial Sequence: Synthetic polypeptide
MESEIRTTNPVATEFWGSVSNINEPQDREGENG

SEQ ID NO: 101946 - protein, 33 aa, Artificial Sequence
  Description of Artificial Sequence: Synthetic polypeptide
MESEIRTTNPVATECWGSVSCINEPQDREGENG

SEQ ID NO: 101947 - protein, 33 aa, Artificial Sequence
  Description of Artificial Sequence: Synthetic polypeptide
MESEIRTTNPVATECWGSVSCINEPQDREGDNG

SEQ ID NO: 101948 - protein, 35 aa, Artificial Sequence
  Description of Artificial Sequence: Synthetic polypeptide
AEEEIRTTNPVATEQYGSVSTSQQGSEQGNNNDDQ

SEQ ID NO: 101949 - protein, 35 aa, Artificial Sequence
  Description of Artificial Sequence: Synthetic polypeptide
AEEEIRTTNPVATEQYGSVSTSQQGDEQGNNQNDD

SEQ ID NO: 101950 - protein, 34 aa, Artificial Sequence
  Description of Artificial Sequence: Synthetic polypeptide
DAAEIATTNPVATEQYGSVSTPNPLQAEMGGMIK

SEQ ID NO: 101951 - protein, 31 aa, Artificial Sequence
  Description of Artificial Sequence: Synthetic polypeptide
MESEIRTTNPVASEQYGSVASEFMIRDLENP

SEQ ID NO: 101952 - protein, 35 aa, Artificial Sequence
  Description of Artificial Sequence: Synthetic polypeptide
AEEEIRTTNPVATEQYGSVSTSQNNDTNNQGTNTD

SEQ ID NO: 101953 - protein, 35 aa, Artificial Sequence
  Description of Artificial Sequence: Synthetic polypeptide
AEEEIRTTNPVATEQYGSVSTSQNNDEQGTTNQDD

SEQ ID NO: 101954 - protein, 32 aa, Artificial Sequence
  Description of Artificial Sequence: Synthetic polypeptide
DETEIRTTNPVAYEHWGSVATNLQGDLGGMGS

SEQ ID NO: 101955 - protein, 35 aa, Artificial Sequence
  Description of Artificial Sequence: Synthetic polypeptide
MEQEIRTTNPVATEQYGSVSWPNGLNQFDNNEERG

SEQ ID NO: 101956 - protein, 35 aa, Artificial Sequence
  Description of Artificial Sequence: Synthetic polypeptide
AEEEIRTTNPVATEQYGSVSTSQNNDEQGNVNNDD

SEQ ID NO: 101957 - protein, 35 aa, Artificial Sequence
  Description of Artificial Sequence: Synthetic polypeptide
AEEEIRTTNPVATEQYGSVSTSQNNDEQGNTNQED

SEQ ID NO: 101958 - protein, 34 aa, Artificial Sequence
  Description of Artificial Sequence: Synthetic polypeptide
MEQEIRTTNPVATEQYGSVSTMLDSIEEDQENNN

SEQ ID NO: 101959 - protein, 32 aa, Artificial Sequence
  Description of Artificial Sequence: Synthetic polypeptide
MEQEIRTTNPVATEQYGSCSVTNNLIEEDEEQ

SEQ ID NO: 101960 - protein, 33 aa, Artificial Sequence
  Description of Artificial Sequence: Synthetic polypeptide
MEQEIRTTNPVATEQYGSCSTTNILVIEEGEEQ

SEQ ID NO: 101961 - protein, 34 aa, Artificial Sequence
  Description of Artificial Sequence: Synthetic polypeptide
CTGEIRTTNPVATEQYGSVSTQNNGQELGQEGGD

SEQ ID NO: 101962 - protein, 32 aa, Artificial Sequence
  Description of Artificial Sequence: Synthetic polypeptide
NEAEIRTTNPVAYEQWGSTVTTNQQGNMGGDR

SEQ ID NO: 101963 - protein, 34 aa, Artificial Sequence
  Description of Artificial Sequence: Synthetic polypeptide
DEMEIRTTNPVATEQYGSVSVPMLILDEYGDDRF

SEQ ID NO: 101964 - protein, 34 aa, Artificial Sequence
  Description of Artificial Sequence: Synthetic polypeptide
NEAEIRTTNPVAYEQWGSVCSTDNNDNHRGTNDR

SEQ ID NO: 101965 - protein, 32 aa, Artificial Sequence
  Description of Artificial Sequence: Synthetic polypeptide
DEMEIVSTNPVATEGYGNVSATDGIESREGNR

SEQ ID NO: 101966 - protein, 34 aa, Artificial Sequence
  Description of Artificial Sequence: Synthetic polypeptide
DETEIRTTNPVATECWGSVSCINEPQDREGENIG

SEQ ID NO: 101967 - protein, 32 aa, Artificial Sequence
  Description of Artificial Sequence: Synthetic polypeptide
DEMEIVPTNPVATEQYGTVCSATDGPVEFGNR

SEQ ID NO: 101968 - protein, 31 aa, Artificial Sequence
  Description of Artificial Sequence: Synthetic polypeptide
DEMEIVCTNPVATEQYGTVSEDNPVEFEGND

SEQ ID NO: 101969 - protein, 31 aa, Artificial Sequence
  Description of Artificial Sequence: Synthetic polypeptide
DEMEIVCTNPVATEQYGTVSATGPVEFEGND

SEQ ID NO: 101970 - protein, 32 aa, Artificial Sequence
  Description of Artificial Sequence: Synthetic polypeptide
DEMEIVCTNPVATEQYGTVSATDGPVEFEGNR

SEQ ID NO: 101971 - protein, 31 aa, Artificial Sequence
  Description of Artificial Sequence: Synthetic polypeptide
DEMEIVCTNPVATEQYGTVSAEDGPVEFGNR

SEQ ID NO: 101972 - protein, 33 aa, Artificial Sequence
  Description of Artificial Sequence: Synthetic polypeptide
DETEIRTTNPVATECWGSVSCINEPQDREMENG

SEQ ID NO: 101973 - protein, 31 aa, Artificial Sequence
  Description of Artificial Sequence: Synthetic polypeptide
DEMEIVCTNPVATEQYGTVCSEDGPVMFGNR

SEQ ID NO: 101974 - protein, 33 aa, Artificial Sequence
  Description of Artificial Sequence: Synthetic polypeptide
NEEEIATTNPVATEQYGCSAATHLQPDDQMGDR

SEQ ID NO: 101975 - protein, 32 aa, Artificial Sequence
  Description of Artificial Sequence: Synthetic polypeptide
DEMEIVCTNPVATEQYGTVCSEDGPVEREGNR

SEQ ID NO: 101976 - protein, 33 aa, Artificial Sequence
  Description of Artificial Sequence: Synthetic polypeptide
DETEIRTTNPVATECWGSVSCINEQDPKGENYG

SEQ ID NO: 101977 - protein, 33 aa, Artificial Sequence
  Description of Artificial Sequence: Synthetic polypeptide
DEMEIVCTNPVATEQYGTACSATDNPVQREGND

SEQ ID NO: 101978 - protein, 33 aa, Artificial Sequence
  Description of Artificial Sequence: Synthetic polypeptide
DETEIRTTNPVATECWGSVSCINEQDPKGENYI

SEQ ID NO: 101979 - protein, 34 aa, Artificial Sequence
  Description of Artificial Sequence: Synthetic polypeptide
DETEIRTTNPVATECWGSVSCINQEPQDREGENG

SEQ ID NO: 101980 - protein, 36 aa, Artificial Sequence
  Description of Artificial Sequence: Synthetic polypeptide
SEEEIRTTNPIATEQYGSVSSTTPNLPNMRNGMNPV

SEQ ID NO: 101981 - protein, 32 aa, Artificial Sequence
  Description of Artificial Sequence: Synthetic polypeptide
DEMEIVCTNPVATEQYGSVCSAEGPVEREGND

SEQ ID NO: 101982 - protein, 33 aa, Artificial Sequence
  Description of Artificial Sequence: Synthetic polypeptide
DETEIRTTNPVATECWGSVSNAEDEPQERKGNI

SEQ ID NO: 101983 - protein, 35 aa, Artificial Sequence
  Description of Artificial Sequence: Synthetic polypeptide
NEEEIATTNPVATEQWGSVSATENLAQDSGMGNQM

SEQ ID NO: 101984 - protein, 34 aa, Artificial Sequence
  Description of Artificial Sequence: Synthetic polypeptide
DETEIRTTNPVATECWGSVSNCENEPQEREGENG

SEQ ID NO: 101985 - protein, 33 aa, Artificial Sequence
  Description of Artificial Sequence: Synthetic polypeptide
DEMEIVCTNPVATEQYGTVCSATDGPVEREGNR

SEQ ID NO: 101986 - protein, 34 aa, Artificial Sequence
  Description of Artificial Sequence: Synthetic polypeptide
DETEIRTTNPVATECWGSVSNCENEPQEREGENI

SEQ ID NO: 101987 - protein, 32 aa, Artificial Sequence
  Description of Artificial Sequence: Synthetic polypeptide
DEMEIVSTNPVATEGYGTVCSANTIESRVGNR

SEQ ID NO: 101988 - protein, 31 aa, Artificial Sequence
  Description of Artificial Sequence: Synthetic polypeptide
DEMEIVSTNPVATEGYGTVCSATGPVQHGND

SEQ ID NO: 101989 - protein, 33 aa, Artificial Sequence
  Description of Artificial Sequence: Synthetic polypeptide
DEMEIVTTNPIATEQYGTVCSATDGLVEFEGNR

SEQ ID NO: 101990 - protein, 32 aa, Artificial Sequence
  Description of Artificial Sequence: Synthetic polypeptide
DEMEIVTTNPCSTEQYGIVCSATDGLESEGNR

SEQ ID NO: 101991 - protein, 31 aa, Artificial Sequence
  Description of Artificial Sequence: Synthetic polypeptide
DEMEIVTTNPCATEQYGTVSATDNPEFEGTD

SEQ ID NO: 101992 - protein, 31 aa, Artificial Sequence
  Description of Artificial Sequence: Synthetic polypeptide
DEMEIVTTNPCATEQYGTVCSTDGPVQFGTD

SEQ ID NO: 101993 - protein, 31 aa, Artificial Sequence
  Description of Artificial Sequence: Synthetic polypeptide
DEMEIVTTNPCATEQYGTVCSCDGPQFEGTR

SEQ ID NO: 101994 - protein, 32 aa, Artificial Sequence
  Description of Artificial Sequence: Synthetic polypeptide
DEMEIVTTNPCATEQYGTVCSATDNPEFEGND

SEQ ID NO: 101995 - protein, 35 aa, Artificial Sequence
  Description of Artificial Sequence: Synthetic polypeptide
AEEEIRTTNPVATEQYGSVSTTNNLEQGTDEEEEN

SEQ ID NO: 101996 - protein, 32 aa, Artificial Sequence
  Description of Artificial Sequence: Synthetic polypeptide
DEMEIVSTNPVATEQYGVVCAASDTLVQHGNI

SEQ ID NO: 101997 - protein, 36 aa, Artificial Sequence
  Description of Artificial Sequence: Synthetic polypeptide
AEEEIRTTNPVATEQYGSVSTTNNLEQGNTGGTEDT

SEQ ID NO: 101998 - protein, 31 aa, Artificial Sequence
  Description of Artificial Sequence: Synthetic polypeptide
DEMEIVSTNPVATEGYGTVCSATGPVQFGND

SEQ ID NO: 101999 - protein, 37 aa, Artificial Sequence
  Description of Artificial Sequence: Synthetic polypeptide
AEEEIRTTNPVATEQYGSVSTTNNLDQGIGNNNNQQS

SEQ ID NO: 102000 - protein, 32 aa, Artificial Sequence
  Description of Artificial Sequence: Synthetic polypeptide
DEMEIVSTNPVATEQYGTVCSTDGLVEFEGND

SEQ ID NO: 102001 - protein, 35 aa, Artificial Sequence
  Description of Artificial Sequence: Synthetic polypeptide
AEEEIRTTNPVATEQYGSVSTTNNINDEQGNNNDE

SEQ ID NO: 102002 - protein, 32 aa, Artificial Sequence
  Description of Artificial Sequence: Synthetic polypeptide
DETEIRTTNPVATECWGSVANCINWQDRKGPG

SEQ ID NO: 102003 - protein, 32 aa, Artificial Sequence
  Description of Artificial Sequence: Synthetic polypeptide
DEMEIVSTNPVATEQYGTVCSATGLVEFEGNQ

SEQ ID NO: 102004 - protein, 32 aa, Artificial Sequence
  Description of Artificial Sequence: Synthetic polypeptide
DEMEIVSTNPVATEQYGTVCSATGLVEFEGND

SEQ ID NO: 102005 - protein, 33 aa, Artificial Sequence
  Description of Artificial Sequence: Synthetic polypeptide
DETEIRTTNPVATECWGSVSCINEPQDPEGENG

SEQ ID NO: 102006 - protein, 32 aa, Artificial Sequence
  Description of Artificial Sequence: Synthetic polypeptide
DEMEIVSTNPVATEQYGTVCSATDGPEFVGNR

SEQ ID NO: 102007 - protein, 33 aa, Artificial Sequence
  Description of Artificial Sequence: Synthetic polypeptide
DETEIRTTNPVATECWGSVSCINEPQDPKGENG

SEQ ID NO: 102008 - protein, 34 aa, Artificial Sequence
  Description of Artificial Sequence: Synthetic polypeptide
SEEEIRTTNPIATEQYGSVSSEPALPMMRGMNPV

SEQ ID NO: 102009 - protein, 36 aa, Artificial Sequence
  Description of Artificial Sequence: Synthetic polypeptide
AEEEIRTTNPVATEQYGSVSTTNNLAGNQNQGEEED

SEQ ID NO: 102010 - protein, 35 aa, Artificial Sequence
  Description of Artificial Sequence: Synthetic polypeptide
AEEEIRTTNPVATEQYGSVSTTNNLEQGTEEAEEM

SEQ ID NO: 102011 - protein, 32 aa, Artificial Sequence
  Description of Artificial Sequence: Synthetic polypeptide
DETEIRTTNPVATECYGAMSTGNEGGGDTENF

SEQ ID NO: 102012 - protein, 30 aa, Artificial Sequence
  Description of Artificial Sequence: Synthetic polypeptide
DETEIRTTNPVATECYGATANEDLAPGGYR

SEQ ID NO: 102013 - protein, 33 aa, Artificial Sequence
  Description of Artificial Sequence: Synthetic polypeptide
DEMEIRTTNPVATQQYGCVCSTELAENFGSNQA

SEQ ID NO: 102014 - protein, 33 aa, Artificial Sequence
  Description of Artificial Sequence: Synthetic polypeptide
DEMEIRTTNPVATQQYGCVCSTEHNENFGSNQM

SEQ ID NO: 102015 - protein, 33 aa, Artificial Sequence
  Description of Artificial Sequence: Synthetic polypeptide
DEMEIRTTNPVATQQYGCVCSNTELERFGSDQA

SEQ ID NO: 102016 - protein, 37 aa, Artificial Sequence
  Description of Artificial Sequence: Synthetic polypeptide
AEEEIRTTNPVATEQYGSVSTTNLQQQGNLNGNNQDE

SEQ ID NO: 102017 - protein, 34 aa, Artificial Sequence
  Description of Artificial Sequence: Synthetic polypeptide
CSDEIRTTNPVATEQYGCVVSYINLSQTHGGNTR

SEQ ID NO: 102018 - protein, 30 aa, Artificial Sequence
  Description of Artificial Sequence: Synthetic polypeptide
DETEIRTTNPVATEQWGAASANWAEPGGYI

SEQ ID NO: 102019 - protein, 30 aa, Artificial Sequence
  Description of Artificial Sequence: Synthetic polypeptide
DETEIRTTNPVATEQWGDVSEIEANAAGDA

SEQ ID NO: 102020 - protein, 36 aa, Artificial Sequence
  Description of Artificial Sequence: Synthetic polypeptide
AEEEIRTTNPVATEQYGVVSTNLNNLQQGISTNEET

SEQ ID NO: 102021 - protein, 34 aa, Artificial Sequence
  Description of Artificial Sequence: Synthetic polypeptide
DETEIRTTNPVATEQWGSVAPTWNDHQERDMSDR

SEQ ID NO: 102022 - protein, 31 aa, Artificial Sequence
  Description of Artificial Sequence: Synthetic polypeptide
NEEEIACTNPVATEQYGSVCAAPLQDHGDQQ

SEQ ID NO: 102023 - protein, 33 aa, Artificial Sequence
  Description of Artificial Sequence: Synthetic polypeptide
SEEEIRTTNPVATEGYGATVSIMNLGQGGGGGT

SEQ ID NO: 102024 - protein, 30 aa, Artificial Sequence
  Description of Artificial Sequence: Synthetic polypeptide
CSEEIATTNPVGTEQWGMVWITNLEGGEIR

SEQ ID NO: 102025 - protein, 30 aa, Artificial Sequence
  Description of Artificial Sequence: Synthetic polypeptide
CSEEIATTNPVGTEQWGMVWITSNLQGGES

SEQ ID NO: 102026 - protein, 33 aa, Artificial Sequence
  Description of Artificial Sequence: Synthetic polypeptide
SEEEIRTTNPVATEGYGCCSNTNGHRTGSDQRD

SEQ ID NO: 102027 - protein, 34 aa, Artificial Sequence
  Description of Artificial Sequence: Synthetic polypeptide
AEEEIRTTNPVATEQYGVVSTNNNDQNQEGTEAL

SEQ ID NO: 102028 - protein, 33 aa, Artificial Sequence
  Description of Artificial Sequence: Synthetic polypeptide
SEEEIRTTNPVATEGYGCTSIMNDLGQGGGGNT

SEQ ID NO: 102029 - protein, 33 aa, Artificial Sequence
  Description of Artificial Sequence: Synthetic polypeptide
DEMEIRTTNPVATEQYGTVTSATDGPVEFEGND

SEQ ID NO: 102030 - protein, 35 aa, Artificial Sequence
  Description of Artificial Sequence: Synthetic polypeptide
AEEEIRTTNPVATEQYGVVSTNQGQQIGTTNAEEQ

SEQ ID NO: 102031 - protein, 36 aa, Artificial Sequence
  Description of Artificial Sequence: Synthetic polypeptide
AEEEIRTTNPVATEQYGVVSTNQQLQQQIGTEQGNE

SEQ ID NO: 102032 - protein, 33 aa, Artificial Sequence
  Description of Artificial Sequence: Synthetic polypeptide
DEMEIRTTNPVATEQYGTVSSATPAPPEFEGND

SEQ ID NO: 102033 - protein, 32 aa, Artificial Sequence
  Description of Artificial Sequence: Synthetic polypeptide
CSEEIATTNPVGTEQWGGMVWSITNLQGGLER

SEQ ID NO: 102034 - protein, 33 aa, Artificial Sequence
  Description of Artificial Sequence: Synthetic polypeptide
DEMEISTVNPVATEQYGCVCSTNLINFGSDNQS

SEQ ID NO: 102035 - protein, 31 aa, Artificial Sequence
  Description of Artificial Sequence: Synthetic polypeptide
NEEEIASVNPVCTEQYGCVVCSDNLQSGNVQ

SEQ ID NO: 102036 - protein, 30 aa, Artificial Sequence
  Description of Artificial Sequence: Synthetic polypeptide
NEEEIASVNPVCTEQYGVVSLDNGWQSGNQ

SEQ ID NO: 102037 - protein, 33 aa, Artificial Sequence
  Description of Artificial Sequence: Synthetic polypeptide
DEMEISTTNPVATEQYGTVWSATSGPVEQEGNF

SEQ ID NO: 102038 - protein, 33 aa, Artificial Sequence
  Description of Artificial Sequence: Synthetic polypeptide
DEMEISTTNPVATEQYGTVQSATLGPVEQEGND

SEQ ID NO: 102039 - protein, 33 aa, Artificial Sequence
  Description of Artificial Sequence: Synthetic polypeptide
DEMEISTTNPVATEQYGTVPSATDYQVEFQGND

SEQ ID NO: 102040 - protein, 33 aa, Artificial Sequence
  Description of Artificial Sequence: Synthetic polypeptide
DEMEISTTNPVATEQYGTVCSLTDFQVEFQGND

SEQ ID NO: 102041 - protein, 33 aa, Artificial Sequence
  Description of Artificial Sequence: Synthetic polypeptide
DEMEISTTNPVATEQYGTVCSATPAQVEMQGND

SEQ ID NO: 102042 - protein, 33 aa, Artificial Sequence
  Description of Artificial Sequence: Synthetic polypeptide
DEMEISTTNPVATEQYGTVCSATDIQVEFEGND

SEQ ID NO: 102043 - protein, 31 aa, Artificial Sequence
  Description of Artificial Sequence: Synthetic polypeptide
DETEIRTTNPVATECYGATWANEDLAPGGYR

SEQ ID NO: 102044 - protein, 30 aa, Artificial Sequence
  Description of Artificial Sequence: Synthetic polypeptide
DEMEISTTNPVATEQYGCVCQTAHINMSNQ

SEQ ID NO: 102045 - protein, 31 aa, Artificial Sequence
  Description of Artificial Sequence: Synthetic polypeptide
NEEEIATTNPVATEQWGSVSAGGPDEAGMRN

SEQ ID NO: 102046 - protein, 34 aa, Artificial Sequence
  Description of Artificial Sequence: Synthetic polypeptide
DETEIRTTNPVATEGWGSVSPINEPQERVGENGE

SEQ ID NO: 102047 - protein, 35 aa, Artificial Sequence
  Description of Artificial Sequence: Synthetic polypeptide
AEEEIRTTNPVATEQYGTVSTVTNLQQQNDEGTTE

SEQ ID NO: 102048 - protein, 32 aa, Artificial Sequence
  Description of Artificial Sequence: Synthetic polypeptide
DETEIRTTNPVATECYGDVWANACLQPKGEYI

SEQ ID NO: 102049 - protein, 31 aa, Artificial Sequence
  Description of Artificial Sequence: Synthetic polypeptide
DEMEIRTTNPVSTEQYGTISMEDIQQFNGND

SEQ ID NO: 102050 - protein, 35 aa, Artificial Sequence
  Description of Artificial Sequence: Synthetic polypeptide
AEEEIRTTNPVATEQYGSVSTTNNANQQQGTEEGS

SEQ ID NO: 102051 - protein, 36 aa, Artificial Sequence
  Description of Artificial Sequence: Synthetic polypeptide
AEEEIRTTNPVATEQYGSVSTTNNANLQQGTEEGQN

SEQ ID NO: 102052 - protein, 32 aa, Artificial Sequence
  Description of Artificial Sequence: Synthetic polypeptide
DETEIRTTNPVATECYGDVWANECLQPKGEYI

SEQ ID NO: 102053 - protein, 31 aa, Artificial Sequence
  Description of Artificial Sequence: Synthetic polypeptide
NEEEIATTNPVATEQWGSVAAGNPDEAGGRN

SEQ ID NO: 102054 - protein, 33 aa, Artificial Sequence
  Description of Artificial Sequence: Synthetic polypeptide
DETEIRTTNPVATEFWGSVSIINEPQDMEGENG

SEQ ID NO: 102055 - protein, 34 aa, Artificial Sequence
  Description of Artificial Sequence: Synthetic polypeptide
SEEEIRTTNPVATEAYGSVNVNTNLVPEGGDNGD

SEQ ID NO: 102056 - protein, 32 aa, Artificial Sequence
  Description of Artificial Sequence: Synthetic polypeptide
DEMEIRTTNPVATQQYGCVCSTNTENFGSDQS

SEQ ID NO: 102057 - protein, 30 aa, Artificial Sequence
  Description of Artificial Sequence: Synthetic polypeptide
DETEIRTTNPVATECYGDVANACWQEHGPI

SEQ ID NO: 102058 - protein, 32 aa, Artificial Sequence
  Description of Artificial Sequence: Synthetic polypeptide
DEMEIVTTNPIATEQYGTVCSATDNPVEFGND

SEQ ID NO: 102059 - protein, 34 aa, Artificial Sequence
  Description of Artificial Sequence: Synthetic polypeptide
NEEEIATTNPVATEQYGCVAANNLQERAGENGVE

SEQ ID NO: 102060 - protein, 37 aa, Artificial Sequence
  Description of Artificial Sequence: Synthetic polypeptide
AEEEIRTTNPVATEQYGSVSTTNNLGNQIGTTTQNDQ

SEQ ID NO: 102061 - protein, 33 aa, Artificial Sequence
  Description of Artificial Sequence: Synthetic polypeptide
DETEIRTTNPSATECWGSVSCINEPQDREGENG

SEQ ID NO: 102062 - protein, 33 aa, Artificial Sequence
  Description of Artificial Sequence: Synthetic polypeptide
NEEEIATTNPVATEQYGSCPATHLQPDMQGDRM

SEQ ID NO: 102063 - protein, 33 aa, Artificial Sequence
  Description of Artificial Sequence: Synthetic polypeptide
DEMEIVTTNPVATEQYGSVCSATDGPVEFEGND

SEQ ID NO: 102064 - protein, 33 aa, Artificial Sequence
  Description of Artificial Sequence: Synthetic polypeptide
DEMEIVTTNPVATEQYGSVCSATDGPAEFEGND

SEQ ID NO: 102065 - protein, 33 aa, Artificial Sequence
  Description of Artificial Sequence: Synthetic polypeptide
DEMEIVTTNPVATEQYGSVCSATDDPVEFEGNL

SEQ ID NO: 102066 - protein, 32 aa, Artificial Sequence
  Description of Artificial Sequence: Synthetic polypeptide
NEEEIATTNPVATEQYGSCPATHLEQPDDQGN

SEQ ID NO: 102067 - protein, 33 aa, Artificial Sequence
  Description of Artificial Sequence: Synthetic polypeptide
DEMEIVTTNPVATEQYGSVCSATCGPVEFEGND

SEQ ID NO: 102068 - protein, 33 aa, Artificial Sequence
  Description of Artificial Sequence: Synthetic polypeptide
DEMEIVTTNPVATEQYGSVCSACDGPVEREGND

SEQ ID NO: 102069 - protein, 36 aa, Artificial Sequence
  Description of Artificial Sequence: Synthetic polypeptide
AEEEIRTTNPVATEQYGSVSTTNNLNQQQGEEEATE

SEQ ID NO: 102070 - protein, 33 aa, Artificial Sequence
  Description of Artificial Sequence: Synthetic polypeptide
DEMEIVTTNPVATEQYGSVCSATDLEDFEGEDL

SEQ ID NO: 102071 - protein, 32 aa, Artificial Sequence
  Description of Artificial Sequence: Synthetic polypeptide
DEMEIVTTNPVATEQYGNVSATDGIESFEGND

SEQ ID NO: 102072 - protein, 32 aa, Artificial Sequence
  Description of Artificial Sequence: Synthetic polypeptide
DEMEIVTTNPVATEQYGKVCSATDGPEFEGND

SEQ ID NO: 102073 - protein, 32 aa, Artificial Sequence
  Description of Artificial Sequence: Synthetic polypeptide
DEMEIVTTNPVATEQYGIVSATDGPVEFEGND

SEQ ID NO: 102074 - protein, 36 aa, Artificial Sequence
  Description of Artificial Sequence: Synthetic polypeptide
AEEEIRTTNPVATEQYGSVSTTNNLNQNQNQDETED

SEQ ID NO: 102075 - protein, 33 aa, Artificial Sequence
  Description of Artificial Sequence: Synthetic polypeptide
DEMEIVTTNPVATEQYGIVCSATDGPVEFEGNR

SEQ ID NO: 102076 - protein, 32 aa, Artificial Sequence
  Description of Artificial Sequence: Synthetic polypeptide
DEMEIVTTNPVATEQYGIVCSACNPVEFEGND

SEQ ID NO: 102077 - protein, 33 aa, Artificial Sequence
  Description of Artificial Sequence: Synthetic polypeptide
DEMEIVTTNPVATEQYGHVCSATDGNVEFEGNS

SEQ ID NO: 102078 - protein, 34 aa, Artificial Sequence
  Description of Artificial Sequence: Synthetic polypeptide
NEEEIATTNPVATEQYGSCPATHLEAPDDQMGNR

SEQ ID NO: 102079 - protein, 32 aa, Artificial Sequence
  Description of Artificial Sequence: Synthetic polypeptide
DEMEIVTTNPVATEQYGEVCSATVCVEFEGNK

SEQ ID NO: 102080 - protein, 33 aa, Artificial Sequence
  Description of Artificial Sequence: Synthetic polypeptide
DEMEIVTTNPVATEQYGEVCSATDGPVEREGND

SEQ ID NO: 102081 - protein, 34 aa, Artificial Sequence
  Description of Artificial Sequence: Synthetic polypeptide
DETEIRTTNPVATDQYGSVNTFGLQGLEGGNGDT

SEQ ID NO: 102082 - protein, 33 aa, Artificial Sequence
  Description of Artificial Sequence: Synthetic polypeptide
SEEEIRTTNPIATEQYGSTTWSNEENLAERGPI

SEQ ID NO: 102083 - protein, 33 aa, Artificial Sequence
  Description of Artificial Sequence: Synthetic polypeptide
DETEIRTTNPLATERWGSVSCINELSDRGGERV

SEQ ID NO: 102084 - protein, 33 aa, Artificial Sequence
  Description of Artificial Sequence: Synthetic polypeptide
DEMEIVTTNPVATEQYGSVCSATDLVEFEGEDL

SEQ ID NO: 102085 - protein, 30 aa, Artificial Sequence
  Description of Artificial Sequence: Synthetic polypeptide
DETEIRCTNPVATECWGETTWAEDLQRGGR

SEQ ID NO: 102086 - protein, 33 aa, Artificial Sequence
  Description of Artificial Sequence: Synthetic polypeptide
SEEEIRTTNPAATEQYGSVISDDNGGQGGIGGT

SEQ ID NO: 102087 - protein, 32 aa, Artificial Sequence
  Description of Artificial Sequence: Synthetic polypeptide
SEEEIRTTNPCATEEWGSVATGNDHGGRGGNA

SEQ ID NO: 102088 - protein, 32 aa, Artificial Sequence
  Description of Artificial Sequence: Synthetic polypeptide
SEEEIRTTNPCATEQWGSVCYNIEEKRDGNDS

SEQ ID NO: 102089 - protein, 35 aa, Artificial Sequence
  Description of Artificial Sequence: Synthetic polypeptide
AEEEIRTTNPVATEQYGSVYTNNNNQNGDEAGNED

SEQ ID NO: 102090 - protein, 31 aa, Artificial Sequence
  Description of Artificial Sequence: Synthetic polypeptide
DETEIRGTNPVATEQYGSVMDGMIGMDGNGQ

SEQ ID NO: 102091 - protein, 29 aa, Artificial Sequence
  Description of Artificial Sequence: Synthetic peptide
DETEIRSTNPVATECWGATTAANWQPGNI

SEQ ID NO: 102092 - protein, 34 aa, Artificial Sequence
  Description of Artificial Sequence: Synthetic polypeptide
NEEEIATTNPVATEQYGSVAITNNLENGMGENDH

SEQ ID NO: 102093 - protein, 29 aa, Artificial Sequence
  Description of Artificial Sequence: Synthetic peptide
DETEIRSVNPVATECWGATTAANLQPGNQ

SEQ ID NO: 102094 - protein, 35 aa, Artificial Sequence
  Description of Artificial Sequence: Synthetic polypeptide
AEEEIRTTNPVATEQYGSVYTTNNQNGTEAGNEDT

SEQ ID NO: 102095 - protein, 32 aa, Artificial Sequence
  Description of Artificial Sequence: Synthetic polypeptide
SEEEIRTTNPIATECWGSTVSNADWMERGNYR

SEQ ID NO: 102096 - protein, 33 aa, Artificial Sequence
  Description of Artificial Sequence: Synthetic polypeptide
SEEEIRTTNPIATECYGSTTWSEENLARKGNYI

SEQ ID NO: 102097 - protein, 30 aa, Artificial Sequence
  Description of Artificial Sequence: Synthetic polypeptide
DETEIRSVNPVATEQWGATVANANLQPGPI

SEQ ID NO: 102098 - protein, 37 aa, Artificial Sequence
  Description of Artificial Sequence: Synthetic polypeptide
AEEEIRTTNPVATEQYGSVSTTNNLQEQQGNNNNDED

SEQ ID NO: 102099 - protein, 34 aa, Artificial Sequence
  Description of Artificial Sequence: Synthetic polypeptide
DEMEIVTTNPVATEQYGSVCSATINPVEFEGEND

SEQ ID NO: 102100 - protein, 33 aa, Artificial Sequence
  Description of Artificial Sequence: Synthetic polypeptide
DETEIRTTNPCATECYGSVSTGGNHNAGDGGSR

SEQ ID NO: 102101 - protein, 33 aa, Artificial Sequence
  Description of Artificial Sequence: Synthetic polypeptide
DEMEIVTTNPVATEQYGSVCSATDPVEDFEGND

SEQ ID NO: 102102 - protein, 34 aa, Artificial Sequence
  Description of Artificial Sequence: Synthetic polypeptide
DETEIRTTNPCATEQYGMSNDPSTRNNEQAGNNT

SEQ ID NO: 102103 - protein, 35 aa, Artificial Sequence
  Description of Artificial Sequence: Synthetic polypeptide
AEEEIRTTNPVATEQYGSVYTTNNQNGNEAGNEDG

SEQ ID NO: 102104 - protein, 32 aa, Artificial Sequence
  Description of Artificial Sequence: Synthetic polypeptide
DEMEIVTTNPVATEQYGSVCSATDPEDHEGED

SEQ ID NO: 102105 - protein, 30 aa, Artificial Sequence
  Description of Artificial Sequence: Synthetic polypeptide
SEEEIRTTNPIATECYGSTTAEDWMPGNYR

SEQ ID NO: 102106 - protein, 33 aa, Artificial Sequence
  Description of Artificial Sequence: Synthetic polypeptide
NEEEIATTNPVATEQYGSCATHLEQPDDQGQRN

SEQ ID NO: 102107 - protein, 28 aa, Artificial Sequence
  Description of Artificial Sequence: Synthetic peptide
NEEEIATTNPVATEQYGEAYEVCQHEEA

SEQ ID NO: 102108 - protein, 34 aa, Artificial Sequence
  Description of Artificial Sequence: Synthetic polypeptide
DETEIRTTNPVATEAWGSVSTNNNNLQDEEGEEG

SEQ ID NO: 102109 - protein, 32 aa, Artificial Sequence
  Description of Artificial Sequence: Synthetic polypeptide
DEMEIVTTNPVATEQWGSVSACDGPVEREGND

SEQ ID NO: 102110 - protein, 34 aa, Artificial Sequence
  Description of Artificial Sequence: Synthetic polypeptide
DEMEIVTTNPVATEQWGSVCSCDNPPQDREGEND

SEQ ID NO: 102111 - protein, 32 aa, Artificial Sequence
  Description of Artificial Sequence: Synthetic polypeptide
DEMEIVTTNPVATEPYGTVSATDDPVEQEGNH

SEQ ID NO: 102112 - protein, 32 aa, Artificial Sequence
  Description of Artificial Sequence: Synthetic polypeptide
DEMEIVTTNPVATEPYGTVSATDDPVEQEGND

SEQ ID NO: 102113 - protein, 32 aa, Artificial Sequence
  Description of Artificial Sequence: Synthetic polypeptide
DEMEIVTTNPVATEPYGTVSATDDPQEQEGNH

SEQ ID NO: 102114 - protein, 31 aa, Artificial Sequence
  Description of Artificial Sequence: Synthetic polypeptide
DEMEIVTTNPVATEPYGTISTDDPQEQEGNH

SEQ ID NO: 102115 - protein, 33 aa, Artificial Sequence
  Description of Artificial Sequence: Synthetic polypeptide
DEMEIVTTNPVATEGYGTVCSATDGPVQRVGND

SEQ ID NO: 102116 - protein, 32 aa, Artificial Sequence
  Description of Artificial Sequence: Synthetic polypeptide
DEMEIVTTNPVATEGYGTVCSATDGLVEFGND

SEQ ID NO: 102117 - protein, 28 aa, Artificial Sequence
  Description of Artificial Sequence: Synthetic peptide
NEEEIATTNPVATEQYGEAPEVCQHEEK

SEQ ID NO: 102118 - protein, 32 aa, Artificial Sequence
  Description of Artificial Sequence: Synthetic polypeptide
DEMEIVTTNPVATEQWGSVSCDNEPEDFEGNG

SEQ ID NO: 102119 - protein, 28 aa, Artificial Sequence
  Description of Artificial Sequence: Synthetic peptide
NEEEIATTNPVATEQYGEAPEVCQGEEK

SEQ ID NO: 102120 - protein, 30 aa, Artificial Sequence
  Description of Artificial Sequence: Synthetic polypeptide
DETEIRTTNPVATECWGETTWAEDLARGGR

SEQ ID NO: 102121 - protein, 31 aa, Artificial Sequence
  Description of Artificial Sequence: Synthetic polypeptide
DEMEIVTTNPVATEGYGTVCSANGPEFEGND

SEQ ID NO: 102122 - protein, 33 aa, Artificial Sequence
  Description of Artificial Sequence: Synthetic polypeptide
DEMEIVTTNPVATEGYGTVCSANDGPQSRVGND

SEQ ID NO: 102123 - protein, 33 aa, Artificial Sequence
  Description of Artificial Sequence: Synthetic polypeptide
DETEIRTTNPVATECWGSTSAINEPQDREGENG

SEQ ID NO: 102124 - protein, 33 aa, Artificial Sequence
  Description of Artificial Sequence: Synthetic polypeptide
DETEIRTTNPVATECWGSTSCINEPQDREGENG

SEQ ID NO: 102125 - protein, 36 aa, Artificial Sequence
  Description of Artificial Sequence: Synthetic polypeptide
AEEEIRTTNPVATEQYGSVSTTNNLLGNNIGTNEEV

SEQ ID NO: 102126 - protein, 32 aa, Artificial Sequence
  Description of Artificial Sequence: Synthetic polypeptide
DEMEIVTTNPVASEQYGTVCSATDNPVEFGTR

SEQ ID NO: 102127 - protein, 33 aa, Artificial Sequence
  Description of Artificial Sequence: Synthetic polypeptide
DEMEIVTTNPVASEQYGTVCSATDGLVEFEGNR

SEQ ID NO: 102128 - protein, 32 aa, Artificial Sequence
  Description of Artificial Sequence: Synthetic polypeptide
DEMEIVTTNPIATEQYGTVSATDGPVEREGND

SEQ ID NO: 102129 - protein, 37 aa, Artificial Sequence
  Description of Artificial Sequence: Synthetic polypeptide
AEEEIRTTNPVATEQYGSVSTTNNLLQNNEQGNEQGE

SEQ ID NO: 102130 - protein, 37 aa, Artificial Sequence
  Description of Artificial Sequence: Synthetic polypeptide
AEEEIRTTNPVATEQYGSVSTTNNLLQQNNNGETNTE

SEQ ID NO: 102131 - protein, 33 aa, Artificial Sequence
  Description of Artificial Sequence: Synthetic polypeptide
DEMEIVTTNPVATEQWGTVCSTDNPVQFEGEND

SEQ ID NO: 102132 - protein, 32 aa, Artificial Sequence
  Description of Artificial Sequence: Synthetic polypeptide
DEMEIVTTNPVATEQWGTVSATDGPVQFEGND

SEQ ID NO: 102133 - protein, 32 aa, Artificial Sequence
  Description of Artificial Sequence: Synthetic polypeptide
DEMEIVTTNPVATEQYGDVSATDGPVEFEGND

SEQ ID NO: 102134 - protein, 34 aa, Artificial Sequence
  Description of Artificial Sequence: Synthetic polypeptide
DETEIRTTNPVATEAWGSVSTVVNNNQAGEGENG

SEQ ID NO: 102135 - protein, 36 aa, Artificial Sequence
  Description of Artificial Sequence: Synthetic polypeptide
AEEEIRTTNPVATEQYGSVSTTNNLNNNENGNQQGD

SEQ ID NO: 102136 - protein, 31 aa, Artificial Sequence
  Description of Artificial Sequence: Synthetic polypeptide
DEMEIVTTNPVATEQYGDVCSATGPMAEEND

SEQ ID NO: 102137 - protein, 32 aa, Artificial Sequence
  Description of Artificial Sequence: Synthetic polypeptide
DEMEIVTTNPVATEQYGDVCSATDIPEFEGND

SEQ ID NO: 102138 - protein, 32 aa, Artificial Sequence
  Description of Artificial Sequence: Synthetic polypeptide
DEMEIVTTNPVATEQYGDVCSATDGPVEFGND

SEQ ID NO: 102139 - protein, 33 aa, Artificial Sequence
  Description of Artificial Sequence: Synthetic polypeptide
DEMEIVTTNPVATEQYGCVCSYTDEPNEFEGNQ

SEQ ID NO: 102140 - protein, 33 aa, Artificial Sequence
  Description of Artificial Sequence: Synthetic polypeptide
DEMEIVTTNPVATEQYGCVCSVTMEPNEFEGND

SEQ ID NO: 102141 - protein, 33 aa, Artificial Sequence
  Description of Artificial Sequence: Synthetic polypeptide
DEMEIVTTNPVATEQYGCVCSTWGEPNEFFGNQ

SEQ ID NO: 102142 - protein, 33 aa, Artificial Sequence
  Description of Artificial Sequence: Synthetic polypeptide
DEMEIVTTNPVATEQYGAVCSATDGPVEFRGND

SEQ ID NO: 102143 - protein, 33 aa, Artificial Sequence
  Description of Artificial Sequence: Synthetic polypeptide
DETEIRTTNPVATEAWGSVSVVNNNQLDEGENG

SEQ ID NO: 102144 - protein, 31 aa, Artificial Sequence
  Description of Artificial Sequence: Synthetic polypeptide
DEMEIVTTNPVATEQWGTVSTDGEVEFEGNG

SEQ ID NO: 102145 - protein, 31 aa, Artificial Sequence
  Description of Artificial Sequence: Synthetic polypeptide
DEMEIVTTNPVATEQWGTVSTDGEVEFEGND

SEQ ID NO: 102146 - protein, 31 aa, Artificial Sequence
  Description of Artificial Sequence: Synthetic polypeptide
DEMEIVTTNPVATEQWGTVSCDNEVEFEGNG

SEQ ID NO: 102147 - protein, 28 aa, Artificial Sequence
  Description of Artificial Sequence: Synthetic peptide
NEEEIATTNPVATEQYGEAPWVDQHMEQ

SEQ ID NO: 102148 - protein, 36 aa, Artificial Sequence
  Description of Artificial Sequence: Synthetic polypeptide
AEEEIRTTNPVATEQYGSVSTTNNLNGTESGNNNLI

SEQ ID NO: 102149 - protein, 36 aa, Artificial Sequence
  Description of Artificial Sequence: Synthetic polypeptide
AEEEIRTTNPVATEQYGSVSTTNNLNGTELGNNENI

SEQ ID NO: 102150 - protein, 33 aa, Artificial Sequence
  Description of Artificial Sequence: Synthetic polypeptide
DEMEIVTTNPVATEQWGTVSATINPVQFEGENG

SEQ ID NO: 102151 - protein, 33 aa, Artificial Sequence
  Description of Artificial Sequence: Synthetic polypeptide
DEMEIVTTNPVATEQWGTVSATINPVQFEGEND

SEQ ID NO: 102152 - protein, 30 aa, Artificial Sequence
  Description of Artificial Sequence: Synthetic polypeptide
DETEIRTTNPVATECWGATVSACLAPGPYI

SEQ ID NO: 102153 - protein, 28 aa, Artificial Sequence
  Description of Artificial Sequence: Synthetic peptide
NEEEIATTNPVATEQYGEAPEVGQHEEQ

SEQ ID NO: 102154 - protein, 32 aa, Artificial Sequence
  Description of Artificial Sequence: Synthetic polypeptide
NEEEIACTNPVATEQYGCVATNLTDPGENTHV

SEQ ID NO: 102155 - protein, 34 aa, Artificial Sequence
  Description of Artificial Sequence: Synthetic polypeptide
SEEEIRTTNPVATESYGSVCSNWNLDHERGDQDT

SEQ ID NO: 102156 - protein, 31 aa, Artificial Sequence
  Description of Artificial Sequence: Synthetic polypeptide
NEEEIACTNPVATEQYGCVATNLTDPGEDHQ

SEQ ID NO: 102157 - protein, 32 aa, Artificial Sequence
  Description of Artificial Sequence: Synthetic polypeptide
AEQEIATTNPVATEQYGSVSATDLEDKEGEDL

SEQ ID NO: 102158 - protein, 34 aa, Artificial Sequence
  Description of Artificial Sequence: Synthetic polypeptide
DEMEIRTTNPVATEQYGSVTLYVDLQERDNDQME

SEQ ID NO: 102159 - protein, 32 aa, Artificial Sequence
  Description of Artificial Sequence: Synthetic polypeptide
DEMEIRTTNPVATEQYGSVTCMELQMTQEDIF

SEQ ID NO: 102160 - protein, 35 aa, Artificial Sequence
  Description of Artificial Sequence: Synthetic polypeptide
DETEIRTTNPVATEQYGSVSNNDNMDQGGGETQND

SEQ ID NO: 102161 - protein, 34 aa, Artificial Sequence
  Description of Artificial Sequence: Synthetic polypeptide
DEMEIRTTNPVATEQYGSVSYTPMMNQQQQESHI

SEQ ID NO: 102162 - protein, 35 aa, Artificial Sequence
  Description of Artificial Sequence: Synthetic polypeptide
AEEEIRTTNPVATEQYGVVSTTNLQGNPNNNNQNE

SEQ ID NO: 102163 - protein, 31 aa, Artificial Sequence
  Description of Artificial Sequence: Synthetic polypeptide
NEDEIACTNPVATEQYGCVATNLQMLGDEGN

SEQ ID NO: 102164 - protein, 32 aa, Artificial Sequence
  Description of Artificial Sequence: Synthetic polypeptide
DETEIRTTNPVATEQYGSVSPQSAEATENVNF

SEQ ID NO: 102165 - protein, 32 aa, Artificial Sequence
  Description of Artificial Sequence: Synthetic polypeptide
SEEEIRTTNPVATEQYGCVCSTEHQGFQSEQA

SEQ ID NO: 102166 - protein, 31 aa, Artificial Sequence
  Description of Artificial Sequence: Synthetic polypeptide
AEQEIACTNPVATEQYGCASANLQNEMGGQR

SEQ ID NO: 102167 - protein, 33 aa, Artificial Sequence
  Description of Artificial Sequence: Synthetic polypeptide
SEEEIRTTNPVATEQYGCVCSSEHQNFGSNNQL

SEQ ID NO: 102168 - protein, 30 aa, Artificial Sequence
  Description of Artificial Sequence: Synthetic polypeptide
AEQEIACTNPVATEQYGCASANLQGVGQLP

SEQ ID NO: 102169 - protein, 30 aa, Artificial Sequence
  Description of Artificial Sequence: Synthetic polypeptide
NEDEIACTNPVATEQYGCASANLQEAPGQD

SEQ ID NO: 102170 - protein, 31 aa, Artificial Sequence
  Description of Artificial Sequence: Synthetic polypeptide
AEQEIACTNPVATEQYGCASANLQEMAGGQR

SEQ ID NO: 102171 - protein, 30 aa, Artificial Sequence
  Description of Artificial Sequence: Synthetic polypeptide
NEDEIACTNPVATEQWGCASANLQAPGQRN

SEQ ID NO: 102172 - protein, 33 aa, Artificial Sequence
  Description of Artificial Sequence: Synthetic polypeptide
DEMEIRTTNPVATEQYGSVSWDEPQSLYDNIMV

SEQ ID NO: 102173 - protein, 33 aa, Artificial Sequence
  Description of Artificial Sequence: Synthetic polypeptide
SEEEIRTTNPVATEQYGCVCSTGAHQNFNSNFA

SEQ ID NO: 102174 - protein, 33 aa, Artificial Sequence
  Description of Artificial Sequence: Synthetic polypeptide
NECEIATTNPVATENYGSVSTGNGPNAGNDNQR

SEQ ID NO: 102175 - protein, 33 aa, Artificial Sequence
  Description of Artificial Sequence: Synthetic polypeptide
SEEEIRTTNPVATEQYGCVCSTGEHQFFGSQQS

SEQ ID NO: 102176 - protein, 30 aa, Artificial Sequence
  Description of Artificial Sequence: Synthetic polypeptide
AEQEIACTNPVATEQWGHTASANLQRGGDV

SEQ ID NO: 102177 - protein, 34 aa, Artificial Sequence
  Description of Artificial Sequence: Synthetic polypeptide
SEEEIRTTNPVATEQYGCVCSTGEHQSFGSDNQS

SEQ ID NO: 102178 - protein, 32 aa, Artificial Sequence
  Description of Artificial Sequence: Synthetic polypeptide
DEMEIRTTNPVATEQYGSVSWLWWGQPELEQQ

SEQ ID NO: 102179 - protein, 34 aa, Artificial Sequence
  Description of Artificial Sequence: Synthetic polypeptide
DEMEIRTTNPVATEQYGSVSVYANNDDNIGNNQD

SEQ ID NO: 102180 - protein, 32 aa, Artificial Sequence
  Description of Artificial Sequence: Synthetic polypeptide
DEMEIRTTNPVATEQYGSVTPTTTLESTEEQG

SEQ ID NO: 102181 - protein, 34 aa, Artificial Sequence
  Description of Artificial Sequence: Synthetic polypeptide
DEMEIRTTNPVATEQYGSVTPWTNLESFPGDDFM

SEQ ID NO: 102182 - protein, 35 aa, Artificial Sequence
  Description of Artificial Sequence: Synthetic polypeptide
DEMEIRTTNPVATEQYGSVTWTYVDLQHRDNDQMV

SEQ ID NO: 102183 - protein, 35 aa, Artificial Sequence
  Description of Artificial Sequence: Synthetic polypeptide
DEMEIRTTNPVATEQYGSVTWTYVDLQETRDNDQM

SEQ ID NO: 102184 - protein, 35 aa, Artificial Sequence
  Description of Artificial Sequence: Synthetic polypeptide
DEMEIRTTNPVATEQYGSVTWTYVDLQERDNSQMG

SEQ ID NO: 102185 - protein, 34 aa, Artificial Sequence
  Description of Artificial Sequence: Synthetic polypeptide
DEMEIRTTNPVATEQYGSVTWTYVDLQERDLDLM

SEQ ID NO: 102186 - protein, 33 aa, Artificial Sequence
  Description of Artificial Sequence: Synthetic polypeptide
NEDEIATTNPVAYEPWGSVSTTNLNQGDGNLRQ

SEQ ID NO: 102187 - protein, 33 aa, Artificial Sequence
  Description of Artificial Sequence: Synthetic polypeptide
DEMEIRTTNPVATEQYGSVTVTMIQGNNNNIQE

SEQ ID NO: 102188 - protein, 33 aa, Artificial Sequence
  Description of Artificial Sequence: Synthetic polypeptide
DEMEIRTTNPVATEQYGSVTTYVDLVERDDVQM

SEQ ID NO: 102189 - protein, 34 aa, Artificial Sequence
  Description of Artificial Sequence: Synthetic polypeptide
DEMEIRTTNPVATEQYGSVTTYVDLQERDHDQMF

SEQ ID NO: 102190 - protein, 34 aa, Artificial Sequence
  Description of Artificial Sequence: Synthetic polypeptide
DEMEIRTTNPVATEQYGSVTTYVDLQELNDNDQM

SEQ ID NO: 102191 - protein, 35 aa, Artificial Sequence
  Description of Artificial Sequence: Synthetic polypeptide
SEEEIRTTNPVATEQYGCVCSNTGNHDQYFGSNTQ

SEQ ID NO: 102192 - protein, 33 aa, Artificial Sequence
  Description of Artificial Sequence: Synthetic polypeptide
DEMEIRTTNPVATEQYGSVTTYVDLQEEDDSQC

SEQ ID NO: 102193 - protein, 37 aa, Artificial Sequence
  Description of Artificial Sequence: Synthetic polypeptide
AEEEIRTTNPVATEQYGSVSTTNLNLQQGEQGTNEEN

SEQ ID NO: 102194 - protein, 32 aa, Artificial Sequence
  Description of Artificial Sequence: Synthetic polypeptide
SEEEIRTTNPVATEQYGCMNTEVLEQSPENKE

SEQ ID NO: 102195 - protein, 33 aa, Artificial Sequence
  Description of Artificial Sequence: Synthetic polypeptide
SEEEIRTTNPVATEQYGCSCSTEHNQYFQSDQA

SEQ ID NO: 102196 - protein, 31 aa, Artificial Sequence
  Description of Artificial Sequence: Synthetic polypeptide
AEQEIACTNPVATEQYGEASENLQDHEGGDR

SEQ ID NO: 102197 - protein, 37 aa, Artificial Sequence
  Description of Artificial Sequence: Synthetic polypeptide
AEEEIRTTNPVATEQYGSVSTTNLNLQQGEGGTQENN

SEQ ID NO: 102198 - protein, 33 aa, Artificial Sequence
  Description of Artificial Sequence: Synthetic polypeptide
DEMEIRTTNPVATEQYGSVTSVDHLNRIESSQS

SEQ ID NO: 102199 - protein, 31 aa, Artificial Sequence
  Description of Artificial Sequence: Synthetic polypeptide
NEDEIACTNPVAYEQYGSVATNLQMNPEGDD

SEQ ID NO: 102200 - protein, 34 aa, Artificial Sequence
  Description of Artificial Sequence: Synthetic polypeptide
DEMEIRTTNPVATEQYGSVTSPTNLEFITEEQEN

SEQ ID NO: 102201 - protein, 33 aa, Artificial Sequence
  Description of Artificial Sequence: Synthetic polypeptide
SEEEIRTTNPVATEQYGCVCGTELNQNFGSDQM

SEQ ID NO: 102202 - protein, 33 aa, Artificial Sequence
  Description of Artificial Sequence: Synthetic polypeptide
DEMEIRTTNPVATEQYGSVTTYVDGQERDSDQM

SEQ ID NO: 102203 - protein, 37 aa, Artificial Sequence
  Description of Artificial Sequence: Synthetic polypeptide
AEEEIRTTNPVATEQYGSVSTTNLNLQQGTQGTNTNN

SEQ ID NO: 102204 - protein, 35 aa, Artificial Sequence
  Description of Artificial Sequence: Synthetic polypeptide
SEEEIRTTNPVATEQYGCVCSTGELDQNSGSNTQA

SEQ ID NO: 102205 - protein, 35 aa, Artificial Sequence
  Description of Artificial Sequence: Synthetic polypeptide
SEEEIRTTNPVATEQYGCVCSTGNHDQNFGSNTQM

SEQ ID NO: 102206 - protein, 34 aa, Artificial Sequence
  Description of Artificial Sequence: Synthetic polypeptide
SEEEIRTTNPVATEQYGCVCSWGNLQNFNSEFAA

SEQ ID NO: 102207 - protein, 35 aa, Artificial Sequence
  Description of Artificial Sequence: Synthetic polypeptide
DEMEIRTTNPVATEQYGSVSVTNNLTEEEITQESR

SEQ ID NO: 102208 - protein, 33 aa, Artificial Sequence
  Description of Artificial Sequence: Synthetic polypeptide
DEMEIRTTNPVATEQYGSVSVTNNIDEYFDDDQ

SEQ ID NO: 102209 - protein, 32 aa, Artificial Sequence
  Description of Artificial Sequence: Synthetic polypeptide
NEAEIRTTNPVAYEQWGSVTTGNGQQDNGGAR

SEQ ID NO: 102210 - protein, 32 aa, Artificial Sequence
  Description of Artificial Sequence: Synthetic polypeptide
NEAEIRTTNPVAYEQWGSVTTGNDQDQDNGAR

SEQ ID NO: 102211 - protein, 32 aa, Artificial Sequence
  Description of Artificial Sequence: Synthetic polypeptide
NEAEIRTTNPVAYEQWGSVTTGGNQQDNGGAR

SEQ ID NO: 102212 - protein, 36 aa, Artificial Sequence
  Description of Artificial Sequence: Synthetic polypeptide
AEEEIRTTNPVATEQYGSVSTTNLGNANNNGNNNEG

SEQ ID NO: 102213 - protein, 37 aa, Artificial Sequence
  Description of Artificial Sequence: Synthetic polypeptide
AEEEIRTTNPVATEQYGSVSTTNLGGNNLQQGNNNSE

SEQ ID NO: 102214 - protein, 34 aa, Artificial Sequence
  Description of Artificial Sequence: Synthetic polypeptide
SEEEIRTTNPVATEQYGCVSVTTNLLNENQEVLN

SEQ ID NO: 102215 - protein, 32 aa, Artificial Sequence
  Description of Artificial Sequence: Synthetic polypeptide
AEPEIRTTNPVATEEYGCCCWSNIVLQRGNQE

SEQ ID NO: 102216 - protein, 35 aa, Artificial Sequence
  Description of Artificial Sequence: Synthetic polypeptide
DEMEIRTTNPVATEQYGSVSVTLNLEDNEYNQDPT

SEQ ID NO: 102217 - protein, 34 aa, Artificial Sequence
  Description of Artificial Sequence: Synthetic polypeptide
DEMEIRTTNPVATEQYGSVSVTLMTETFGSNNIY

SEQ ID NO: 102218 - protein, 32 aa, Artificial Sequence
  Description of Artificial Sequence: Synthetic polypeptide
SEEEIRTTNPVATEQYGCYSTSVDTNGNEDSI

SEQ ID NO: 102219 - protein, 36 aa, Artificial Sequence
  Description of Artificial Sequence: Synthetic polypeptide
DEMEIRTTNPVATEQYGSVSVTELDLEQNEGNADPT

SEQ ID NO: 102220 - protein, 34 aa, Artificial Sequence
  Description of Artificial Sequence: Synthetic polypeptide
SEEEIRTTNPVATEQYGDVNSDTNLIIEGMGGGQ

SEQ ID NO: 102221 - protein, 31 aa, Artificial Sequence
  Description of Artificial Sequence: Synthetic polypeptide
NEAEIRTTNPVAYEQWGSVSGGDNHQNGGAM

SEQ ID NO: 102222 - protein, 34 aa, Artificial Sequence
  Description of Artificial Sequence: Synthetic polypeptide
SEEEIRTTNPVATEQYGSCGSTGDLGQGGEFGQE

SEQ ID NO: 102223 - protein, 33 aa, Artificial Sequence
  Description of Artificial Sequence: Synthetic polypeptide
SEEEIRTTNPVATEQYGSCGSTGDTGQGGEQGE

SEQ ID NO: 102224 - protein, 33 aa, Artificial Sequence
  Description of Artificial Sequence: Synthetic polypeptide
SEEEIRTTNPVATEQYGSCGSVGDLGQGGEQGQ

SEQ ID NO: 102225 - protein, 34 aa, Artificial Sequence
  Description of Artificial Sequence: Synthetic polypeptide
DEMEIRTTNPVATEQYGSVSVSLSLDEYGSDDRF

SEQ ID NO: 102226 - protein, 33 aa, Artificial Sequence
  Description of Artificial Sequence: Synthetic polypeptide
SEEEIRTTNPVATEQYGCYSTSVDEERGNEESI

SEQ ID NO: 102227 - protein, 29 aa, Artificial Sequence
  Description of Artificial Sequence: Synthetic peptide
NECEIAPTNPCSSEQYGEVSCNLQSGMTR

SEQ ID NO: 102228 - protein, 36 aa, Artificial Sequence
  Description of Artificial Sequence: Synthetic polypeptide
AEEEIRTTNPVATEQYGSVSTTNLLQGNTNNNNQNE

SEQ ID NO: 102229 - protein, 36 aa, Artificial Sequence
  Description of Artificial Sequence: Synthetic polypeptide
DEMEIRTTNPVATEQYGSVSVTPNDHQETFNGTIRN

SEQ ID NO: 102230 - protein, 34 aa, Artificial Sequence
  Description of Artificial Sequence: Synthetic polypeptide
DEMEIRTTNPVATEQYGSVSVTYNNLEFIDVSMQ

SEQ ID NO: 102231 - protein, 35 aa, Artificial Sequence
  Description of Artificial Sequence: Synthetic polypeptide
SEEEIRTTNPVATEQYGCVCSTGNHDQRFGSQTQA

SEQ ID NO: 102232 - protein, 36 aa, Artificial Sequence
  Description of Artificial Sequence: Synthetic polypeptide
DEMEIRTTNPVATEQYGSVSVTYLDMTETFGNPNRH

SEQ ID NO: 102233 - protein, 34 aa, Artificial Sequence
  Description of Artificial Sequence: Synthetic polypeptide
DEMEIRTTNPVATEQYGSVSVTYEPEVTGDEMNE

SEQ ID NO: 102234 - protein, 36 aa, Artificial Sequence
  Description of Artificial Sequence: Synthetic polypeptide
DEMEIRTTNPVATEQYGSVSVTWNELNTRFMENSQN

SEQ ID NO: 102235 - protein, 36 aa, Artificial Sequence
  Description of Artificial Sequence: Synthetic polypeptide
DEMEIRTTNPVATEQYGSVSVTWLNIEQNEGNSDVN

SEQ ID NO: 102236 - protein, 35 aa, Artificial Sequence
  Description of Artificial Sequence: Synthetic polypeptide
DEMEIRTTNPVATEQYGSVSVTVEDNNLTTVEMGN

SEQ ID NO: 102237 - protein, 34 aa, Artificial Sequence
  Description of Artificial Sequence: Synthetic polypeptide
DEMEIRTTNPVATEQYGSVSVTTVHQEYFEEVRE

SEQ ID NO: 102238 - protein, 33 aa, Artificial Sequence
  Description of Artificial Sequence: Synthetic polypeptide
DEMEIRTTNPVATEQYGSVSVTPTHSEYEENDM

SEQ ID NO: 102239 - protein, 31 aa, Artificial Sequence
  Description of Artificial Sequence: Synthetic polypeptide
AEPEIRTTNPVATEEYGCCWQEVLQRGNDQE

SEQ ID NO: 102240 - protein, 33 aa, Artificial Sequence
  Description of Artificial Sequence: Synthetic polypeptide
DEMEIRTTNPVATEQYGSVSVTPTHQEYQEIVM

SEQ ID NO: 102241 - protein, 35 aa, Artificial Sequence
  Description of Artificial Sequence: Synthetic polypeptide
SEEEIRTTNPVATEQYGCVCSTMNHDQRFGSDTQS

SEQ ID NO: 102242 - protein, 30 aa, Artificial Sequence
  Description of Artificial Sequence: Synthetic polypeptide
AEQEIACTNPVATEQWGEASENLQHMGGIR

SEQ ID NO: 102243 - protein, 36 aa, Artificial Sequence
  Description of Artificial Sequence: Synthetic polypeptide
AEEEIRTTNPVATEQYGSVSTTNLLQQGTTEGTEDT

SEQ ID NO: 102244 - protein, 31 aa, Artificial Sequence
  Description of Artificial Sequence: Synthetic polypeptide
NEAEIRTTNPVAYEQWGSVVIENDQDGGNNE

SEQ ID NO: 102245 - protein, 31 aa, Artificial Sequence
  Description of Artificial Sequence: Synthetic polypeptide
NEAEIRTTNPVAYEQWGSVTTNQQGNMGDAS

SEQ ID NO: 102246 - protein, 31 aa, Artificial Sequence
  Description of Artificial Sequence: Synthetic polypeptide
NEAEIRTTNPVAYEQWGSVTTNQQGNMGAEK

SEQ ID NO: 102247 - protein, 34 aa, Artificial Sequence
  Description of Artificial Sequence: Synthetic polypeptide
DEMEIRTTNPVATEQYGSVSVTPTHQEYLQENDY

SEQ ID NO: 102248 - protein, 34 aa, Artificial Sequence
  Description of Artificial Sequence: Synthetic polypeptide
DEMEIRTTNPVATEQYGSVSVTPTHQEYFQTNDM

SEQ ID NO: 102249 - protein, 35 aa, Artificial Sequence
  Description of Artificial Sequence: Synthetic polypeptide
DEMEIRTTNPVATEQYGSVSVTPNHQETFNGTVMQ

SEQ ID NO: 102250 - protein, 33 aa, Artificial Sequence
  Description of Artificial Sequence: Synthetic polypeptide
DEMEIRTTNPVATEQYGSVSVTPTHQEYQEDDI

SEQ ID NO: 102251 - protein, 35 aa, Artificial Sequence
  Description of Artificial Sequence: Synthetic polypeptide
DEMEIRTTNPVATEQYGSVTWTYVPLQERSDNDQM

SEQ ID NO: 102252 - protein, 33 aa, Artificial Sequence
  Description of Artificial Sequence: Synthetic polypeptide
DEMEIRTTNPVATEQYGSVTWYVDLQERDDDQM

SEQ ID NO: 102253 - protein, 36 aa, Artificial Sequence
  Description of Artificial Sequence: Synthetic polypeptide
AEEEIRTTNPVATEQYGSVSTTNLNQGNQIGTEQGQ

SEQ ID NO: 102254 - protein, 33 aa, Artificial Sequence
  Description of Artificial Sequence: Synthetic polypeptide
SEEEIRTTNPVATEGYGSVCSNTELANFGSDQQ

SEQ ID NO: 102255 - protein, 33 aa, Artificial Sequence
  Description of Artificial Sequence: Synthetic polypeptide
DEMEIRTTNPVATEQYGTVCSATEDPVEFEGND

SEQ ID NO: 102256 - protein, 31 aa, Artificial Sequence
  Description of Artificial Sequence: Synthetic polypeptide
AEQEIATTNPVATEQYGSASAEDLEDREGEL

SEQ ID NO: 102257 - protein, 36 aa, Artificial Sequence
  Description of Artificial Sequence: Synthetic polypeptide
AEEEIRTTNPVATEQYGVVSTSNNLQQQLGNGNIGE

SEQ ID NO: 102258 - protein, 36 aa, Artificial Sequence
  Description of Artificial Sequence: Synthetic polypeptide
AEEEIRTTNPVATEQYGVVSTSNNLQQQNGNGQIGT

SEQ ID NO: 102259 - protein, 31 aa, Artificial Sequence
  Description of Artificial Sequence: Synthetic polypeptide
AEQEIATTNPVATEQYGEASAEDLQDHGGDR

SEQ ID NO: 102260 - protein, 33 aa, Artificial Sequence
  Description of Artificial Sequence: Synthetic polypeptide
AEQEIATTNPVATEQYGCVATNNLENGMGENDR

SEQ ID NO: 102261 - protein, 33 aa, Artificial Sequence
  Description of Artificial Sequence: Synthetic polypeptide
NEEEIACTNPVATEAYGSVATNLQDNPGENAGM

SEQ ID NO: 102262 - protein, 35 aa, Artificial Sequence
  Description of Artificial Sequence: Synthetic polypeptide
AEEEIRTTNPVATEQYGVVSTSNNQNNEQGTNSTD

SEQ ID NO: 102263 - protein, 33 aa, Artificial Sequence
  Description of Artificial Sequence: Synthetic polypeptide
DEMEIRTTNPVATEQYGTVCSATIGPPEFEGND

SEQ ID NO: 102264 - protein, 33 aa, Artificial Sequence
  Description of Artificial Sequence: Synthetic polypeptide
DEMEIRTTNPVATEQYGTVCSATDGPVNFEGNV

SEQ ID NO: 102265 - protein, 32 aa, Artificial Sequence
  Description of Artificial Sequence: Synthetic polypeptide
DETEIRTTNPVATEQYGSTSAADLEDHEGEDL

SEQ ID NO: 102266 - protein, 33 aa, Artificial Sequence
  Description of Artificial Sequence: Synthetic polypeptide
DEMEIRTTNPVATEQYGTVCSATDGPVEPEGND

SEQ ID NO: 102267 - protein, 33 aa, Artificial Sequence
  Description of Artificial Sequence: Synthetic polypeptide
DEMEIRTTNPVATEQYGTVCSATDGPVEFEGNV

SEQ ID NO: 102268 - protein, 32 aa, Artificial Sequence
  Description of Artificial Sequence: Synthetic polypeptide
NEECIRCTNPVATEQYGSVSWNLVHEIFSNQH

SEQ ID NO: 102269 - protein, 33 aa, Artificial Sequence
  Description of Artificial Sequence: Synthetic polypeptide
DEMEIRTTNPVATEQYGTVCSATDGPVEFEGND

SEQ ID NO: 102270 - protein, 33 aa, Artificial Sequence
  Description of Artificial Sequence: Synthetic polypeptide
DEMEIRTTNPVATEQYGTVCSATDGPPNFEGNV

SEQ ID NO: 102271 - protein, 33 aa, Artificial Sequence
  Description of Artificial Sequence: Synthetic polypeptide
NEEAIRTTNPVATEQYGSVWPTMNEHTGNELDE

SEQ ID NO: 102272 - protein, 33 aa, Artificial Sequence
  Description of Artificial Sequence: Synthetic polypeptide
DEMEIRTTNPVATEQYGTVCSATDGGVEFEGND

SEQ ID NO: 102273 - protein, 34 aa, Artificial Sequence
  Description of Artificial Sequence: Synthetic polypeptide
NEEAIRTTNPVATEQYGSVSPTVNEHTGNEMLDE

SEQ ID NO: 102274 - protein, 32 aa, Artificial Sequence
  Description of Artificial Sequence: Synthetic polypeptide
DETEIRTTNPVATEQYGSTSAADLEDHEGEDI

SEQ ID NO: 102275 - protein, 33 aa, Artificial Sequence
  Description of Artificial Sequence: Synthetic polypeptide
DEMEIRTTNPVATEQYGTVCSATDDPVEFEGND

SEQ ID NO: 102276 - protein, 33 aa, Artificial Sequence
  Description of Artificial Sequence: Synthetic polypeptide
DEMEIRTTNPVATEQYGTVCSATIGPPEFEGNG

SEQ ID NO: 102277 - protein, 34 aa, Artificial Sequence
  Description of Artificial Sequence: Synthetic polypeptide
SEEEIRTTNPVATEGYGSCFNTVNLEHRGSDQRD

SEQ ID NO: 102278 - protein, 32 aa, Artificial Sequence
  Description of Artificial Sequence: Synthetic polypeptide
AEQEIATTNPVATEQYGSVSATDLEDHEGGDL

SEQ ID NO: 102279 - protein, 33 aa, Artificial Sequence
  Description of Artificial Sequence: Synthetic polypeptide
SEEEIRTTNPVATEGYGCTSIMNLGQGGQGGNT

SEQ ID NO: 102280 - protein, 32 aa, Artificial Sequence
  Description of Artificial Sequence: Synthetic polypeptide
NEEEIACTNPVATEQYGCVATNLQAAEDDTRV

SEQ ID NO: 102281 - protein, 32 aa, Artificial Sequence
  Description of Artificial Sequence: Synthetic polypeptide
AEQEIATTNPVATEQYGSVSATDLEDHEGEDL

SEQ ID NO: 102282 - protein, 32 aa, Artificial Sequence
  Description of Artificial Sequence: Synthetic polypeptide
NEEEIACTNPVATEQYGCVATNLADAGGDTRN

SEQ ID NO: 102283 - protein, 34 aa, Artificial Sequence
  Description of Artificial Sequence: Synthetic polypeptide
DETEIRTTNPVATEQYGMVTIMTNGGQGGENEGE

SEQ ID NO: 102284 - protein, 33 aa, Artificial Sequence
  Description of Artificial Sequence: Synthetic polypeptide
DEMEIRTTNPVATEQYGTVSAMEDIVEQQNGNH

SEQ ID NO: 102285 - protein, 32 aa, Artificial Sequence
  Description of Artificial Sequence: Synthetic polypeptide
AEQEIATTNPVATEQYGSVSAENLEDHEGGDL

SEQ ID NO: 102286 - protein, 32 aa, Artificial Sequence
  Description of Artificial Sequence: Synthetic polypeptide
DEMEIRTTNPVATEQYGTVSAMEDIVEFNGNH

SEQ ID NO: 102287 - protein, 34 aa, Artificial Sequence
  Description of Artificial Sequence: Synthetic polypeptide
SEEEIRTTNPVATEGYGSCSNTNELHTIGSDQRD

SEQ ID NO: 102288 - protein, 33 aa, Artificial Sequence
  Description of Artificial Sequence: Synthetic polypeptide
DEMEIRTTNPVATEQYGTVCSTTDGPVEFEGND

SEQ ID NO: 102289 - protein, 33 aa, Artificial Sequence
  Description of Artificial Sequence: Synthetic polypeptide
DEMEIRTTNPVATEQYGTVCSTTDGGVEFEGND

SEQ ID NO: 102290 - protein, 34 aa, Artificial Sequence
  Description of Artificial Sequence: Synthetic polypeptide
CSEEIRTTNPVATEAYGSVSSCHGNLSQETGTNM

SEQ ID NO: 102291 - protein, 33 aa, Artificial Sequence
  Description of Artificial Sequence: Synthetic polypeptide
SEEEIRTTNPVATEGYGCVCSNTALIRFGSDTQ

SEQ ID NO: 102292 - protein, 34 aa, Artificial Sequence
  Description of Artificial Sequence: Synthetic polypeptide
SEEEIRTTNPVATEGYGCVCSNTENLIRFGSDQQ

SEQ ID NO: 102293 - protein, 33 aa, Artificial Sequence
  Description of Artificial Sequence: Synthetic polypeptide
SEEEIRTTNPVATEGYGCVCSNTNLTGFGSDTQ

SEQ ID NO: 102294 - protein, 32 aa, Artificial Sequence
  Description of Artificial Sequence: Synthetic polypeptide
NEEEIACTNPVATEQWGSIATNLQLRLHEGEN

SEQ ID NO: 102295 - protein, 32 aa, Artificial Sequence
  Description of Artificial Sequence: Synthetic polypeptide
AEQEIATTNPVATEQYGSASAEDLQDHEGGDR

SEQ ID NO: 102296 - protein, 34 aa, Artificial Sequence
  Description of Artificial Sequence: Synthetic polypeptide
SEEEIRTTNPVATEGYGSCCSNTNELHRGSDQCD

SEQ ID NO: 102297 - protein, 33 aa, Artificial Sequence
  Description of Artificial Sequence: Synthetic polypeptide
DEMEIRTTNPVATEQYGTVCSATIGPVEFEGND

SEQ ID NO: 102298 - protein, 33 aa, Artificial Sequence
  Description of Artificial Sequence: Synthetic polypeptide
DEMEIRTTNPVATEQYGTVCSTTDGGVNFEGND

SEQ ID NO: 102299 - protein, 32 aa, Artificial Sequence
  Description of Artificial Sequence: Synthetic polypeptide
DEMEIRTTNPVATEQYGTISMDDIQQQFNGNH

SEQ ID NO: 102300 - protein, 30 aa, Artificial Sequence
  Description of Artificial Sequence: Synthetic polypeptide
AEQEIACTNPVAYEQWGEASENLQRAGGER

SEQ ID NO: 102301 - protein, 35 aa, Artificial Sequence
  Description of Artificial Sequence: Synthetic polypeptide
AEEEIRTTNPVATEQYGVVSTSNNQQQQGNGNIGD

SEQ ID NO: 102302 - protein, 33 aa, Artificial Sequence
  Description of Artificial Sequence: Synthetic polypeptide
DEMEIRTTNPVATEQYGSVWVSNHQEVSSNDGS

SEQ ID NO: 102303 - protein, 33 aa, Artificial Sequence
  Description of Artificial Sequence: Synthetic polypeptide
DEMEIRTTNPVATEQYGSVWVSNHDQEPSSNDI

SEQ ID NO: 102304 - protein, 37 aa, Artificial Sequence
  Description of Artificial Sequence: Synthetic polypeptide
AEEEIRTTNPVATEQYGSVSTTNLQAGNTEQGTNEDQ

SEQ ID NO: 102305 - protein, 33 aa, Artificial Sequence
  Description of Artificial Sequence: Synthetic polypeptide
NEDEIRTTNPVATEQYGSLCSTHEEQERDQGQE

SEQ ID NO: 102306 - protein, 35 aa, Artificial Sequence
  Description of Artificial Sequence: Synthetic polypeptide
DEMEIRTTNPVATEQYGSVWTNHINNQRDGSIEEQ

SEQ ID NO: 102307 - protein, 34 aa, Artificial Sequence
  Description of Artificial Sequence: Synthetic polypeptide
DEMEIRTTNPVATEQYGSVWTNDINNQEDGSIEQ

SEQ ID NO: 102308 - protein, 33 aa, Artificial Sequence
  Description of Artificial Sequence: Synthetic polypeptide
NEDEIRTTNPVATEMWGSVSTNLQGNEGGDGDS

SEQ ID NO: 102309 - protein, 35 aa, Artificial Sequence
  Description of Artificial Sequence: Synthetic polypeptide
DEMEIRTTNPVATEQYGSVWSTTLDDLQQEGEEDK

SEQ ID NO: 102310 - protein, 32 aa, Artificial Sequence
  Description of Artificial Sequence: Synthetic polypeptide
NEDEIRTTNPCATECYGSVSTGNAGNAGENAE

SEQ ID NO: 102311 - protein, 36 aa, Artificial Sequence
  Description of Artificial Sequence: Synthetic polypeptide
AEEEIRTTNPVATEQYGSVSTTNLQAGSEGGTDEEQ

SEQ ID NO: 102312 - protein, 34 aa, Artificial Sequence
  Description of Artificial Sequence: Synthetic polypeptide
SEEEIRTTNPVATEPYGVVSCQTELSFENGGNNR

SEQ ID NO: 102313 - protein, 34 aa, Artificial Sequence
  Description of Artificial Sequence: Synthetic polypeptide
DEMEIRTTNPVATEQYGSVWSANDEHEGSEENYL

SEQ ID NO: 102314 - protein, 33 aa, Artificial Sequence
  Description of Artificial Sequence: Synthetic polypeptide
DEMEIRTTNPVATEQYGSVWPTMLSIESDQEND

SEQ ID NO: 102315 - protein, 36 aa, Artificial Sequence
  Description of Artificial Sequence: Synthetic polypeptide
AEEEIRTTNPVATEQYGVVSTTNLNLQQGEQGTNNN

SEQ ID NO: 102316 - protein, 30 aa, Artificial Sequence
  Description of Artificial Sequence: Synthetic polypeptide
SEEEIRTTNPVATEQWGDVSEIEMNAAGDA

SEQ ID NO: 102317 - protein, 35 aa, Artificial Sequence
  Description of Artificial Sequence: Synthetic polypeptide
DETEIRTTNPVATEQYGSVSANTPAGPNMRKGPPV

SEQ ID NO: 102318 - protein, 34 aa, Artificial Sequence
  Description of Artificial Sequence: Synthetic polypeptide
DEMEIRTTNPVATEQYGSVWPTELGLIRSSQNNM

SEQ ID NO: 102319 - protein, 32 aa, Artificial Sequence
  Description of Artificial Sequence: Synthetic polypeptide
DEMEIRTTNPVATEQYGSVWPMNLENSSEDQE

SEQ ID NO: 102320 - protein, 33 aa, Artificial Sequence
  Description of Artificial Sequence: Synthetic polypeptide
DEMEIRTTNPVATEQYGSVWPMNLENRSFSDQE

SEQ ID NO: 102321 - protein, 32 aa, Artificial Sequence
  Description of Artificial Sequence: Synthetic polypeptide
NEDEIATTNPVAYEQYGSVATNLQGNPTEGLN

SEQ ID NO: 102322 - protein, 31 aa, Artificial Sequence
  Description of Artificial Sequence: Synthetic polypeptide
NEDEIATTNPVAYESWGMVSTNLQGNEGNMP

SEQ ID NO: 102323 - protein, 37 aa, Artificial Sequence
  Description of Artificial Sequence: Synthetic polypeptide
AEEEIRTTNPVATEQYGSVSTTNLQDGNNNIGTNQMA

SEQ ID NO: 102324 - protein, 32 aa, Artificial Sequence
  Description of Artificial Sequence: Synthetic polypeptide
DEMEIRTTNPVATEQYGSVYPNVQIESDEDTQ

SEQ ID NO: 102325 - protein, 36 aa, Artificial Sequence
  Description of Artificial Sequence: Synthetic polypeptide
SEEEIRTTNPVATEPYGSVIASTGNLSDSPGGNNRF

SEQ ID NO: 102326 - protein, 31 aa, Artificial Sequence
  Description of Artificial Sequence: Synthetic polypeptide
NEDEIRTTNPVAYEQWGSVAKALEQTNGDTR

SEQ ID NO: 102327 - protein, 33 aa, Artificial Sequence
  Description of Artificial Sequence: Synthetic polypeptide
DEMEIRTTNPVATEQYGTISATDDIQQQFNGNH

SEQ ID NO: 102328 - protein, 32 aa, Artificial Sequence
  Description of Artificial Sequence: Synthetic polypeptide
NEDEIRTTNPVAYEQWGQVVWVTNLSQIGGSR

SEQ ID NO: 102329 - protein, 31 aa, Artificial Sequence
  Description of Artificial Sequence: Synthetic polypeptide
NEDEIRTTNPVAYEAWGQVVGTNLSQNGGSR

SEQ ID NO: 102330 - protein, 32 aa, Artificial Sequence
  Description of Artificial Sequence: Synthetic polypeptide
DEMEIRTTNPVATEQYGTISAMEDPQQQNGNH

SEQ ID NO: 102331 - protein, 32 aa, Artificial Sequence
  Description of Artificial Sequence: Synthetic polypeptide
DEMEIRTTNPVATEQYGTISAMEDPQQFNGND

SEQ ID NO: 102332 - protein, 32 aa, Artificial Sequence
  Description of Artificial Sequence: Synthetic polypeptide
DEMEIRTTNPVATEQYGTISAMEDIQQFNGND

SEQ ID NO: 102333 - protein, 33 aa, Artificial Sequence
  Description of Artificial Sequence: Synthetic polypeptide
DEMEIRTTNPVATEQYGSYSTNDQNQEQQDSEG

SEQ ID NO: 102334 - protein, 37 aa, Artificial Sequence
  Description of Artificial Sequence: Synthetic polypeptide
AEEEIRTTNPVATEQYGSVSTTNLQLQNSEQGTNTNE

SEQ ID NO: 102335 - protein, 33 aa, Artificial Sequence
  Description of Artificial Sequence: Synthetic polypeptide
DETEIRTTNPVATEQYGSVCTTPDYQFEGGDED

SEQ ID NO: 102336 - protein, 33 aa, Artificial Sequence
  Description of Artificial Sequence: Synthetic polypeptide
AEEEIRTTNPVATEQYGVVSTTATNSTQDEQSQ

SEQ ID NO: 102337 - protein, 36 aa, Artificial Sequence
  Description of Artificial Sequence: Synthetic polypeptide
AEEEIRTTNPVATEQYGVVSTTLNLQNGNQEGNNDE

SEQ ID NO: 102338 - protein, 35 aa, Artificial Sequence
  Description of Artificial Sequence: Synthetic polypeptide
DETEIRTTNPVATEQYGSVEPVVLDLGQMEGGNER

SEQ ID NO: 102339 - protein, 34 aa, Artificial Sequence
  Description of Artificial Sequence: Synthetic polypeptide
DETEIRTTNPVATEQYGSVETPQYDQEQGQNEDQ

SEQ ID NO: 102340 - protein, 35 aa, Artificial Sequence
  Description of Artificial Sequence: Synthetic polypeptide
AEEEIRTTNPVATEQYGVVSTTLQLNNQLGNEETN

SEQ ID NO: 102341 - protein, 35 aa, Artificial Sequence
  Description of Artificial Sequence: Synthetic polypeptide
AEEEIRTTNPVATEQYGVVSTTLQLNQLGNEEAND

SEQ ID NO: 102342 - protein, 35 aa, Artificial Sequence
  Description of Artificial Sequence: Synthetic polypeptide
AEEEIRTTNPVATEQYGVVSTTNGNQQGNQNNDDV

SEQ ID NO: 102343 - protein, 33 aa, Artificial Sequence
  Description of Artificial Sequence: Synthetic polypeptide
NEDEIRTTNPVATEQYGSVDDTNDQNIGGGQGQ

SEQ ID NO: 102344 - protein, 32 aa, Artificial Sequence
  Description of Artificial Sequence: Synthetic polypeptide
NEDEIRTTNPVATEQYGSVDDANGQGNDGGQG

SEQ ID NO: 102345 - protein, 32 aa, Artificial Sequence
  Description of Artificial Sequence: Synthetic polypeptide
SEEEIRTTNPVATENYGSCFNTWLHIGSDQRD

SEQ ID NO: 102346 - protein, 36 aa, Artificial Sequence
  Description of Artificial Sequence: Synthetic polypeptide
AEEEIRTTNPVATEQYGVVSTTNLLQQGNQGTNAEG

SEQ ID NO: 102347 - protein, 32 aa, Artificial Sequence
  Description of Artificial Sequence: Synthetic polypeptide
SEEEIRTTNPVATEGYGCTSIMNLGQGGGQGT

SEQ ID NO: 102348 - protein, 35 aa, Artificial Sequence
  Description of Artificial Sequence: Synthetic polypeptide
AEEEIRTTNPVATESYGSVSTVNQSNNQQGNGNNQ

SEQ ID NO: 102349 - protein, 34 aa, Artificial Sequence
  Description of Artificial Sequence: Synthetic polypeptide
DDEEIRTTNPVATDQYGSVSTEGGQNNVGGNGDT

SEQ ID NO: 102350 - protein, 35 aa, Artificial Sequence
  Description of Artificial Sequence: Synthetic polypeptide
SESEIRTTNPVATEQYGSVQSWTNVLQNGSDEDDI

SEQ ID NO: 102351 - protein, 33 aa, Artificial Sequence
  Description of Artificial Sequence: Synthetic polypeptide
DEEEVATTNPVATEGYGNVATTPTGPQMRVGNR

SEQ ID NO: 102352 - protein, 33 aa, Artificial Sequence
  Description of Artificial Sequence: Synthetic polypeptide
DEEEVATTNPVATEGYGNVATTPTGPQMRNGNR

SEQ ID NO: 102353 - protein, 30 aa, Artificial Sequence
  Description of Artificial Sequence: Synthetic polypeptide
AENEIACTNPVATEQYGTASEDNPQFEGGR

SEQ ID NO: 102354 - protein, 30 aa, Artificial Sequence
  Description of Artificial Sequence: Synthetic polypeptide
DEEEVATTNPVATEGYGNVAAEVIQSREQR

SEQ ID NO: 102355 - protein, 30 aa, Artificial Sequence
  Description of Artificial Sequence: Synthetic polypeptide
DEEEVATTNPVATEGYGEVAAEVIQSREQR

SEQ ID NO: 102356 - protein, 34 aa, Artificial Sequence
  Description of Artificial Sequence: Synthetic polypeptide
AEDEIRTTNPVAYEQWGSVNKTDNLDQRGGGNQS

SEQ ID NO: 102357 - protein, 30 aa, Artificial Sequence
  Description of Artificial Sequence: Synthetic polypeptide
DEEEVASTNPVSTEGYGNVANNIQSRVGQR

SEQ ID NO: 102358 - protein, 34 aa, Artificial Sequence
  Description of Artificial Sequence: Synthetic polypeptide
DEEEVASTNPVATEQYGSVSSATPTGNMRNGMNR

SEQ ID NO: 102359 - protein, 34 aa, Artificial Sequence
  Description of Artificial Sequence: Synthetic polypeptide
DEEEVASTNPVATEQYGSVSSANPTGNMRNGMNR

SEQ ID NO: 102360 - protein, 32 aa, Artificial Sequence
  Description of Artificial Sequence: Synthetic polypeptide
WEQEIATTNPVATEQYGSVSATDLEDHEGEDH

SEQ ID NO: 102361 - protein, 34 aa, Artificial Sequence
  Description of Artificial Sequence: Synthetic polypeptide
WEEEIATTNPVATEQYGSVANANNLPQEAGENTD

SEQ ID NO: 102362 - protein, 32 aa, Artificial Sequence
  Description of Artificial Sequence: Synthetic polypeptide
WEQEIATTNPVATEQYGSVSATDLEDHEGEDL

SEQ ID NO: 102363 - protein, 33 aa, Artificial Sequence
  Description of Artificial Sequence: Synthetic polypeptide
WESEIRTTNPVATECWGSVSCINEPQDREGENG

SEQ ID NO: 102364 - protein, 33 aa, Artificial Sequence
  Description of Artificial Sequence: Synthetic polypeptide
WESEIRTTNPVATECWGSVSCINERQDREGENG

SEQ ID NO: 102365 - protein, 32 aa, Artificial Sequence
  Description of Artificial Sequence: Synthetic polypeptide
WETEIATTNPVATEQYGSVSATDLEDHEGEDL

SEQ ID NO: 102366 - protein, 28 aa, Artificial Sequence
  Description of Artificial Sequence: Synthetic peptide
DDNEIATTNPVSTEGYGNVSETIQREQL

SEQ ID NO: 102367 - protein, 34 aa, Artificial Sequence
  Description of Artificial Sequence: Synthetic polypeptide
DTEEIRPTNPVATEQYGWVPSDTLHLSQRGSVGF

SEQ ID NO: 102368 - protein, 28 aa, Artificial Sequence
  Description of Artificial Sequence: Synthetic peptide
YDEEIASVNPVCTEQYGVVSNTIQSGNQ

SEQ ID NO: 102369 - protein, 29 aa, Artificial Sequence
  Description of Artificial Sequence: Synthetic peptide
YDSEIASTNPVSTEQYGVVADNLQSSGQR

SEQ ID NO: 102370 - protein, 31 aa, Artificial Sequence
  Description of Artificial Sequence: Synthetic polypeptide
DTEEIRATNPVAYEQWGSSYHSDNDQNQGTR

SEQ ID NO: 102371 - protein, 31 aa, Artificial Sequence
  Description of Artificial Sequence: Synthetic polypeptide
DTEEIRATNPVAYEQWGSSYHNDNDQRNGTR

SEQ ID NO: 102372 - protein, 32 aa, Artificial Sequence
  Description of Artificial Sequence: Synthetic polypeptide
DTEEIRATNPVAYEQWGCSYQVDNNLQNNGTR

SEQ ID NO: 102373 - protein, 33 aa, Artificial Sequence
  Description of Artificial Sequence: Synthetic polypeptide
WESEIRTTNPVATECWGSVSCINEFQDREGENG

SEQ ID NO: 102374 - protein, 32 aa, Artificial Sequence
  Description of Artificial Sequence: Synthetic polypeptide
YEAEIATTNPVATEQYGSVSATDLEDHEGEDL

SEQ ID NO: 102375 - protein, 32 aa, Artificial Sequence
  Description of Artificial Sequence: Synthetic polypeptide
DEEEVATTNPVATEGYGNVATTPTGQMRVGQR

SEQ ID NO: 102376 - protein, 33 aa, Artificial Sequence
  Description of Artificial Sequence: Synthetic polypeptide
DEEEVATTNPVATEQYGNVATTPTGPQMRNGNV

SEQ ID NO: 102377 - protein, 32 aa, Artificial Sequence
  Description of Artificial Sequence: Synthetic polypeptide
DTEEIRTTNPAATEHYGSVCPFNNLETEANQR

SEQ ID NO: 102378 - protein, 33 aa, Artificial Sequence
  Description of Artificial Sequence: Synthetic polypeptide
DEEGIRTTNPVATEQWGSVSYFDSQQQHYGQNK

SEQ ID NO: 102379 - protein, 31 aa, Artificial Sequence
  Description of Artificial Sequence: Synthetic polypeptide
DDMEIVTTNPVATEQYGTVAATDTPERVGND

SEQ ID NO: 102380 - protein, 29 aa, Artificial Sequence
  Description of Artificial Sequence: Synthetic peptide
AENEIACTNPVATEQYGTASENIQQNGGH

SEQ ID NO: 102381 - protein, 34 aa, Artificial Sequence
  Description of Artificial Sequence: Synthetic polypeptide
DEEGIETTNPVATEQYGSVSTGGLGDEGNQEEGD

SEQ ID NO: 102382 - protein, 32 aa, Artificial Sequence
  Description of Artificial Sequence: Synthetic polypeptide
VEQEIATTNPVATEQYGSVSATDLEDHDGEDL

SEQ ID NO: 102383 - protein, 35 aa, Artificial Sequence
  Description of Artificial Sequence: Synthetic polypeptide
DEEEVRTTNPVATEQYGSVSTTPAGPNMRNGMNPV

SEQ ID NO: 102384 - protein, 32 aa, Artificial Sequence
  Description of Artificial Sequence: Synthetic polypeptide
VEQEIATTNPVATEQYGSVSATDLEDHEGEDL

SEQ ID NO: 102385 - protein, 33 aa, Artificial Sequence
  Description of Artificial Sequence: Synthetic polypeptide
VESEIRTTNPVATECWGSVSCINEPQDREGENG

SEQ ID NO: 102386 - protein, 33 aa, Artificial Sequence
  Description of Artificial Sequence: Synthetic polypeptide
VESEIRTTNPVATECWGSVSCINEPQREGENGS

SEQ ID NO: 102387 - protein, 35 aa, Artificial Sequence
  Description of Artificial Sequence: Synthetic polypeptide
WEEEIATTNPVATEQYGSVANANNLPQEAGENPRD

SEQ ID NO: 102388 - protein, 33 aa, Artificial Sequence
  Description of Artificial Sequence: Synthetic polypeptide
VSEEIRTTNPVAYECYGSIVSCTNLSTDNGGGR

SEQ ID NO: 102389 - protein, 35 aa, Artificial Sequence
  Description of Artificial Sequence: Synthetic polypeptide
DEEEVRTTNPVATEQYGSVSSTTPAGPNMRNGMNV

SEQ ID NO: 102390 - protein, 36 aa, Artificial Sequence
  Description of Artificial Sequence: Synthetic polypeptide
DEEEVRTTNPVATEQYGSVSSATPAGPNMRNGMNPR

SEQ ID NO: 102391 - protein, 33 aa, Artificial Sequence
  Description of Artificial Sequence: Synthetic polypeptide
WEEEIATTNPVATEQYGCVATNNLENGDQENDD

SEQ ID NO: 102392 - protein, 33 aa, Artificial Sequence
  Description of Artificial Sequence: Synthetic polypeptide
WEEEIATTNPVATEQYGCVATNNLENGMMENEA

SEQ ID NO: 102393 - protein, 28 aa, Artificial Sequence
  Description of Artificial Sequence: Synthetic peptide
WEEEIATTNPVATEQYGEAPEKCQHEEK

SEQ ID NO: 102394 - protein, 28 aa, Artificial Sequence
  Description of Artificial Sequence: Synthetic peptide
WEEEIATTNPVATEQYGEAPEVCQHEEK

SEQ ID NO: 102395 - protein, 34 aa, Artificial Sequence
  Description of Artificial Sequence: Synthetic polypeptide
WEEEIATTNPVATEQYGSVAATNNLENGDGENDD

SEQ ID NO: 102396 - protein, 34 aa, Artificial Sequence
  Description of Artificial Sequence: Synthetic polypeptide
DEEEVRTTNPVATEGYGSVSSTTAGPNMRNGMNV

SEQ ID NO: 102397 - protein, 36 aa, Artificial Sequence
  Description of Artificial Sequence: Synthetic polypeptide
WEEEIATTNPVATEQYGSVAATNNLPQEAMGENARE

SEQ ID NO: 102398 - protein, 30 aa, Artificial Sequence
  Description of Artificial Sequence: Synthetic polypeptide
DDNEIASTNPVSTEGYGEASAENLQSRGGR

SEQ ID NO: 102399 - protein, 32 aa, Artificial Sequence
  Description of Artificial Sequence: Synthetic polypeptide
VSEEIRTTNPVAYECYGSIVSTNLSTDTGGGE

SEQ ID NO: 102400 - protein, 31 aa, Artificial Sequence
  Description of Artificial Sequence: Synthetic polypeptide
DTEEIRATNPVAYEQWGCSYQVDNLQNGEDR

SEQ ID NO: 102401 - protein, 33 aa, Artificial Sequence
  Description of Artificial Sequence: Synthetic polypeptide
DDNEIRTTNPVATEQYGSVSTDWQNEGMSSQEH

SEQ ID NO: 102402 - protein, 30 aa, Artificial Sequence
  Description of Artificial Sequence: Synthetic polypeptide
DTEEIRATNPVAYEQWGCSYQVDNGQNGTR

SEQ ID NO: 102403 - protein, 33 aa, Artificial Sequence
  Description of Artificial Sequence: Synthetic polypeptide
DEEEIVTTNPVATEQYGTVCSTTDGPVNFNGND

SEQ ID NO: 102404 - protein, 33 aa, Artificial Sequence
  Description of Artificial Sequence: Synthetic polypeptide
DEEEIVTTNPVATEQYGTVCSTTDGPVEFEGND

SEQ ID NO: 102405 - protein, 33 aa, Artificial Sequence
  Description of Artificial Sequence: Synthetic polypeptide
DEEEIVTTNPVATEQYGTVCSTTDGGVEFEGND

SEQ ID NO: 102406 - protein, 33 aa, Artificial Sequence
  Description of Artificial Sequence: Synthetic polypeptide
DEEEIVTTNPVATEQYGTVCSTTDAGVNFEGND

SEQ ID NO: 102407 - protein, 32 aa, Artificial Sequence
  Description of Artificial Sequence: Synthetic polypeptide
DDQEIASTNPVATEQYGSVSATTIEDRVGQDR

SEQ ID NO: 102408 - protein, 35 aa, Artificial Sequence
  Description of Artificial Sequence: Synthetic polypeptide
DTEEIRATNPVATEQYGSVVVTTTNLQQGNQGTDD

SEQ ID NO: 102409 - protein, 32 aa, Artificial Sequence
  Description of Artificial Sequence: Synthetic polypeptide
DEEEIVTTNPVATEQYGTVCSTDVPVEHEGED

SEQ ID NO: 102410 - protein, 33 aa, Artificial Sequence
  Description of Artificial Sequence: Synthetic polypeptide
DEEEIVTTNPVATEQYGTVCSATDVPVEHEGND

SEQ ID NO: 102411 - protein, 33 aa, Artificial Sequence
  Description of Artificial Sequence: Synthetic polypeptide
DEEEIVTTNPVATEQYGTVCSATDVPVEFEGND

SEQ ID NO: 102412 - protein, 33 aa, Artificial Sequence
  Description of Artificial Sequence: Synthetic polypeptide
DEEEIVTTNPVATEQYGTVCSATDGPVNFNGND

SEQ ID NO: 102413 - protein, 30 aa, Artificial Sequence
  Description of Artificial Sequence: Synthetic polypeptide
DEEEIVTTNPVATEQYGTVPAEDGPEFENK

SEQ ID NO: 102414 - protein, 36 aa, Artificial Sequence
  Description of Artificial Sequence: Synthetic polypeptide
AEDEIRTTNPVATEQYGSVSTVTNNQLQQQQGTNVE

SEQ ID NO: 102415 - protein, 33 aa, Artificial Sequence
  Description of Artificial Sequence: Synthetic polypeptide
DEEEIVTTNPVATEQYGTVCSATDGPVEFEGND

SEQ ID NO: 102416 - protein, 36 aa, Artificial Sequence
  Description of Artificial Sequence: Synthetic polypeptide
AEDEIRTTNPVATEQYGSVSTVTNNQLNQQQGSNVD

SEQ ID NO: 102417 - protein, 36 aa, Artificial Sequence
  Description of Artificial Sequence: Synthetic polypeptide
AEDEIRTTNPVATEQYGSVSTVTNNQLEQNIGSNVE

SEQ ID NO: 102418 - protein, 33 aa, Artificial Sequence
  Description of Artificial Sequence: Synthetic polypeptide
DEEEIVTTNPVATEQYGTVCSATDGPCEFEGND

SEQ ID NO: 102419 - protein, 33 aa, Artificial Sequence
  Description of Artificial Sequence: Synthetic polypeptide
DEEEIVTTNPVATEQYGTVCSATDGGVEFEGND

SEQ ID NO: 102420 - protein, 35 aa, Artificial Sequence
  Description of Artificial Sequence: Synthetic polypeptide
DTEEIRATNPVATEQYGSVVVTTNLQQGNNGTEDT

SEQ ID NO: 102421 - protein, 35 aa, Artificial Sequence
  Description of Artificial Sequence: Synthetic polypeptide
DTEEIRATNPVATEQYGSVVVTTNLQQGNNGDTQD

SEQ ID NO: 102422 - protein, 36 aa, Artificial Sequence
  Description of Artificial Sequence: Synthetic polypeptide
AEDEIRTTNPVATEQYGSVSTVNQNQLQQIGTVNVE

SEQ ID NO: 102423 - protein, 32 aa, Artificial Sequence
  Description of Artificial Sequence: Synthetic polypeptide
DEEEIVTTNPVATEQYGTVCSADDGPEFEGND

SEQ ID NO: 102424 - protein, 32 aa, Artificial Sequence
  Description of Artificial Sequence: Synthetic polypeptide
DEEEIVTTNPVATEQYGTVCPATGPVEFEGND

SEQ ID NO: 102425 - protein, 33 aa, Artificial Sequence
  Description of Artificial Sequence: Synthetic polypeptide
DEEEIVTTNPVATEQYGTVCSATDGPVEFNGND

SEQ ID NO: 102426 - protein, 34 aa, Artificial Sequence
  Description of Artificial Sequence: Synthetic polypeptide
DTEEIRATNPVATEQYGSVVVTVTNLQLNGTDDE

SEQ ID NO: 102427 - protein, 32 aa, Artificial Sequence
  Description of Artificial Sequence: Synthetic polypeptide
DEEEIVTTNPVATEQYGTVPATDGPVQFEGEK

SEQ ID NO: 102428 - protein, 31 aa, Artificial Sequence
  Description of Artificial Sequence: Synthetic polypeptide
DEEEIVTTNPVATEQYGTVPATGPVQFEEEK

SEQ ID NO: 102429 - protein, 29 aa, Artificial Sequence
  Description of Artificial Sequence: Synthetic peptide
DDNEVASTNPVSTEGYGNVSAENIQRGQR

SEQ ID NO: 102430 - protein, 36 aa, Artificial Sequence
  Description of Artificial Sequence: Synthetic polypeptide
DEEEIWTTNPVATEQYGSVSSTTLAGPNMRNGMNPV

SEQ ID NO: 102431 - protein, 29 aa, Artificial Sequence
  Description of Artificial Sequence: Synthetic peptide
DDNEVATTNPVATECYGNVAECLQRVEER

SEQ ID NO: 102432 - protein, 31 aa, Artificial Sequence
  Description of Artificial Sequence: Synthetic polypeptide
DEEEIVTVNPVATEQYGTVCSADDGPESGND

SEQ ID NO: 102433 - protein, 31 aa, Artificial Sequence
  Description of Artificial Sequence: Synthetic polypeptide
DEEEIVTVNPVATEQYGTVCSADDGPEFGND

SEQ ID NO: 102434 - protein, 33 aa, Artificial Sequence
  Description of Artificial Sequence: Synthetic polypeptide
DDPTIRTTNPVATEQYGAVSTNHQEVRVANNTF

SEQ ID NO: 102435 - protein, 34 aa, Artificial Sequence
  Description of Artificial Sequence: Synthetic polypeptide
DEEEIVTTNPVATEQYGTVSSTTPGGPEREGNPV

SEQ ID NO: 102436 - protein, 31 aa, Artificial Sequence
  Description of Artificial Sequence: Synthetic polypeptide
AENEIACTNPVATEQYGSASAEDLQDRGGDL

SEQ ID NO: 102437 - protein, 34 aa, Artificial Sequence
  Description of Artificial Sequence: Synthetic polypeptide
DEEEIVTTNPVATEQYGTVSSTTPAGPNREGNPV

SEQ ID NO: 102438 - protein, 34 aa, Artificial Sequence
  Description of Artificial Sequence: Synthetic polypeptide
DEEEIVTTNPVATEQYGTVSSTTPAGPEREGNPV

SEQ ID NO: 102439 - protein, 34 aa, Artificial Sequence
  Description of Artificial Sequence: Synthetic polypeptide
DEEEIVTTNPVATEQYGTVSSTTDGGPEREGNPV

SEQ ID NO: 102440 - protein, 32 aa, Artificial Sequence
  Description of Artificial Sequence: Synthetic polypeptide
DTEEIRATNPVAYEQWGCSYISDNLQDNGTTR

SEQ ID NO: 102441 - protein, 34 aa, Artificial Sequence
  Description of Artificial Sequence: Synthetic polypeptide
DEEEIVTTNPVATEQYGTVSSATPGPVNREGNPV

SEQ ID NO: 102442 - protein, 33 aa, Artificial Sequence
  Description of Artificial Sequence: Synthetic polypeptide
DEEEIVTTNPVATEQYGTVSSATPGPVNFEGNV

SEQ ID NO: 102443 - protein, 33 aa, Artificial Sequence
  Description of Artificial Sequence: Synthetic polypeptide
DEEEIVTTNPVATEQYGTVSSATPGPVNFEGND

SEQ ID NO: 102444 - protein, 34 aa, Artificial Sequence
  Description of Artificial Sequence: Synthetic polypeptide
DEEEIVTTNPVATEQYGTVSSATPAPVNREGNPV

SEQ ID NO: 102445 - protein, 32 aa, Artificial Sequence
  Description of Artificial Sequence: Synthetic polypeptide
YEDEIRTTNPVATEQYGELCPFNILQEGNDSA

SEQ ID NO: 102446 - protein, 34 aa, Artificial Sequence
  Description of Artificial Sequence: Synthetic polypeptide
DTEEIRATNPVAYEPYGSVVPSTNELSQNGGTRY

SEQ ID NO: 102447 - protein, 35 aa, Artificial Sequence
  Description of Artificial Sequence: Synthetic polypeptide
AEDEIRTTNPVATEQYGSVSTVTNQQQQEIGSNVD

SEQ ID NO: 102448 - protein, 33 aa, Artificial Sequence
  Description of Artificial Sequence: Synthetic polypeptide
DEEEIVTTNPVATEQYGTVSSATPAPPNFEGNV

SEQ ID NO: 102449 - protein, 35 aa, Artificial Sequence
  Description of Artificial Sequence: Synthetic polypeptide
DTEEIRATNPVATEQYGVVSTTNNLQAGNGNQQDT

SEQ ID NO: 102450 - protein, 34 aa, Artificial Sequence
  Description of Artificial Sequence: Synthetic polypeptide
DEEEIVTTNPVATEQYGTVSSATPAGVNREGNPV

SEQ ID NO: 102451 - protein, 35 aa, Artificial Sequence
  Description of Artificial Sequence: Synthetic polypeptide
DTEEIRATNPVATEQYGSVVVTVTNLQQGNNGTDD

SEQ ID NO: 102452 - protein, 32 aa, Artificial Sequence
  Description of Artificial Sequence: Synthetic polypeptide
DTEEIRTTNPAATEHYGSVCPFNNLETRETQR

SEQ ID NO: 102453 - protein, 34 aa, Artificial Sequence
  Description of Artificial Sequence: Synthetic polypeptide
DEEGIRTTNPVATEQYGSVSTGGLGDEGGQTEGD

SEQ ID NO: 102454 - protein, 35 aa, Artificial Sequence
  Description of Artificial Sequence: Synthetic polypeptide
DEEGIRTTNPVATEQYGSVSTGGLGDENEGQNEQG

SEQ ID NO: 102455 - protein, 35 aa, Artificial Sequence
  Description of Artificial Sequence: Synthetic polypeptide
DEEGIRTTNPVATEQYGSVSTGGLGDENNGQNDGD

SEQ ID NO: 102456 - protein, 35 aa, Artificial Sequence
  Description of Artificial Sequence: Synthetic polypeptide
VEEEIRTTNPVATEQYGSVSNNDNNDQGGGEDNND

SEQ ID NO: 102457 - protein, 33 aa, Artificial Sequence
  Description of Artificial Sequence: Synthetic polypeptide
DDETIRTTNPVATEQYGSVSTGGEGGDGGNTDN

SEQ ID NO: 102458 - protein, 35 aa, Artificial Sequence
  Description of Artificial Sequence: Synthetic polypeptide
VEEEIRTTNPVATEQYGSVSNNDSMDQGGGDTNND

SEQ ID NO: 102459 - protein, 34 aa, Artificial Sequence
  Description of Artificial Sequence: Synthetic polypeptide
DTEEIRTTNPVATEQYGCVSTTNQMTLEGNEDQD

SEQ ID NO: 102460 - protein, 34 aa, Artificial Sequence
  Description of Artificial Sequence: Synthetic polypeptide
DTEEIRTTNPVATEQWGVVVTVTTNLLQQGTNED

SEQ ID NO: 102461 - protein, 33 aa, Artificial Sequence
  Description of Artificial Sequence: Synthetic polypeptide
DDETIRTTNPVATEQYGSVSTGGQLGGGQGDGV

SEQ ID NO: 102462 - protein, 34 aa, Artificial Sequence
  Description of Artificial Sequence: Synthetic polypeptide
VEEEIRTTNPVATEQYGSVSPTWMAEIASQNGSQ

SEQ ID NO: 102463 - protein, 33 aa, Artificial Sequence
  Description of Artificial Sequence: Synthetic polypeptide
DDETIRTTNPVATEQYGSVSTTGDEGGGGQNDT

SEQ ID NO: 102464 - protein, 34 aa, Artificial Sequence
  Description of Artificial Sequence: Synthetic polypeptide
VEEEIRTTNPVATEQYGSVSQEVNGLGVVINELI

SEQ ID NO: 102465 - protein, 33 aa, Artificial Sequence
  Description of Artificial Sequence: Synthetic polypeptide
DTEEIRTTNPVATEQWGVVVTVTNLQLQQGTTE

SEQ ID NO: 102466 - protein, 35 aa, Artificial Sequence
  Description of Artificial Sequence: Synthetic polypeptide
VEEEIRTTNPVATEQYGSVSNNDNMDQGGGQTNIQ

SEQ ID NO: 102467 - protein, 34 aa, Artificial Sequence
  Description of Artificial Sequence: Synthetic polypeptide
VEEEIRTTNPVATEQYGSVSSTDGFGQGNNGETL

SEQ ID NO: 102468 - protein, 34 aa, Artificial Sequence
  Description of Artificial Sequence: Synthetic polypeptide
VEEEIRTTNPVATEQYGSVSSTDNGEGNEFGEGG

SEQ ID NO: 102469 - protein, 33 aa, Artificial Sequence
  Description of Artificial Sequence: Synthetic polypeptide
DEVEIRTTNPVATEQYGSVSILQNEMEGEGEQA

SEQ ID NO: 102470 - protein, 35 aa, Artificial Sequence
  Description of Artificial Sequence: Synthetic polypeptide
VEEEIRTTNPVATEQYGSVSTDDDDEQEGGGNDGQ

SEQ ID NO: 102471 - protein, 34 aa, Artificial Sequence
  Description of Artificial Sequence: Synthetic polypeptide
VEEEIRTTNPVATEQYGSVSTDGMENQTIEQDGG

SEQ ID NO: 102472 - protein, 29 aa, Artificial Sequence
  Description of Artificial Sequence: Synthetic peptide
DDGEIAPTNPVSSEQYGNVSCNIQSVGTR

SEQ ID NO: 102473 - protein, 28 aa, Artificial Sequence
  Description of Artificial Sequence: Synthetic peptide
DDGEIASTNPCSSEQYGNVSCNIQSGTR

SEQ ID NO: 102474 - protein, 35 aa, Artificial Sequence
  Description of Artificial Sequence: Synthetic polypeptide
VEEEIRTTNPVATEQYGSVSTDTGGQQEGEGNQGG

SEQ ID NO: 102475 - protein, 33 aa, Artificial Sequence
  Description of Artificial Sequence: Synthetic polypeptide
DTEEIRTTNPVATEQWGVVVTVTNLNLQQGTEN

SEQ ID NO: 102476 - protein, 34 aa, Artificial Sequence
  Description of Artificial Sequence: Synthetic polypeptide
DEENICTTNPVATEAYGVVSTVTTNLQQGSNNIG

SEQ ID NO: 102477 - protein, 34 aa, Artificial Sequence
  Description of Artificial Sequence: Synthetic polypeptide
DEENICTTNPVATEAYGVVSTTVNLQQAGTNQED

SEQ ID NO: 102478 - protein, 35 aa, Artificial Sequence
  Description of Artificial Sequence: Synthetic polypeptide
VEEEIRTTNPVATEQYGSVSSTDNDDQLNGEMGEG

SEQ ID NO: 102479 - protein, 35 aa, Artificial Sequence
  Description of Artificial Sequence: Synthetic polypeptide
VEEEIRTTNPVATEQYGSVSNNDNMDQGGGETTNS

SEQ ID NO: 102480 - protein, 35 aa, Artificial Sequence
  Description of Artificial Sequence: Synthetic polypeptide
VEEEIRTTNPVATEQYGSVSNNDNMDQGDGQTNND

SEQ ID NO: 102481 - protein, 36 aa, Artificial Sequence
  Description of Artificial Sequence: Synthetic polypeptide
DTEEIRTTNPVATEQYGSVSTDNQQQGTNPNNNQED

SEQ ID NO: 102482 - protein, 34 aa, Artificial Sequence
  Description of Artificial Sequence: Synthetic polypeptide
VEEEIRTTNPVATEQYGSVSINNDINGEGGGNEE

SEQ ID NO: 102483 - protein, 36 aa, Artificial Sequence
  Description of Artificial Sequence: Synthetic polypeptide
DTEEIRTTNPVATEQYGSVSTVTNLQNNEQGTDEDE

SEQ ID NO: 102484 - protein, 37 aa, Artificial Sequence
  Description of Artificial Sequence: Synthetic polypeptide
DTEEIRTTNPVATEQYGSVSTVTNLQAGNDEEEESEE

SEQ ID NO: 102485 - protein, 34 aa, Artificial Sequence
  Description of Artificial Sequence: Synthetic polypeptide
DDETIRTTNPVATEQYGAVVITENGQRGQENEGN

SEQ ID NO: 102486 - protein, 33 aa, Artificial Sequence
  Description of Artificial Sequence: Synthetic polypeptide
DDETIRTTNPVATEQYGAVVITNGQRGQEDEGQ

SEQ ID NO: 102487 - protein, 37 aa, Artificial Sequence
  Description of Artificial Sequence: Synthetic polypeptide
DTEEIRTTNPVATEQYGSVSTVNQLQNNDEQGNNNAE

SEQ ID NO: 102488 - protein, 34 aa, Artificial Sequence
  Description of Artificial Sequence: Synthetic polypeptide
VEEEIRTTNPVATEQYGSVSITNNVGINEGGGGT

SEQ ID NO: 102489 - protein, 36 aa, Artificial Sequence
  Description of Artificial Sequence: Synthetic polypeptide
VEEEIRTTNPVATEQYGSVSITSDNGLQEGEGGGQT

SEQ ID NO: 102490 - protein, 37 aa, Artificial Sequence
  Description of Artificial Sequence: Synthetic polypeptide
DTEEIRTTNPVATEQYGSVSTVNNLQQGNDEETENDQ

SEQ ID NO: 102491 - protein, 37 aa, Artificial Sequence
  Description of Artificial Sequence: Synthetic polypeptide
DTEEIRTTNPVATEQYGSVSTVNNLQQGNDEEEETDD

SEQ ID NO: 102492 - protein, 37 aa, Artificial Sequence
  Description of Artificial Sequence: Synthetic polypeptide
DTEEIRTTNPVATEQYGSVSTTNNLQQGNTEQGSNDE

SEQ ID NO: 102493 - protein, 33 aa, Artificial Sequence
  Description of Artificial Sequence: Synthetic polypeptide
VEEEIRTTNPVATEQYGSVSLNQGQNEVTEVEE

SEQ ID NO: 102494 - protein, 37 aa, Artificial Sequence
  Description of Artificial Sequence: Synthetic polypeptide
DTEEIRTTNPVATEQYGSVSTNLQSGNNNEQGTEEDT

SEQ ID NO: 102495 - protein, 34 aa, Artificial Sequence
  Description of Artificial Sequence: Synthetic polypeptide
VEEEIRTTNPVATEQYGSVSLTNNDEQEFVQESL

SEQ ID NO: 102496 - protein, 35 aa, Artificial Sequence
  Description of Artificial Sequence: Synthetic polypeptide
VEEEIRTTNPVATEQYGSVSLTPWLESQFVPENQI

SEQ ID NO: 102497 - protein, 37 aa, Artificial Sequence
  Description of Artificial Sequence: Synthetic polypeptide
DTEEIRTTNPVATEQYGSVSTNLQSGGNTEQGTEEQD

SEQ ID NO: 102498 - protein, 37 aa, Artificial Sequence
  Description of Artificial Sequence: Synthetic polypeptide
DTEEIRTTNPVATEQYGSVSTNLQAGNNNEQGNEEQD

SEQ ID NO: 102499 - protein, 34 aa, Artificial Sequence
  Description of Artificial Sequence: Synthetic polypeptide
VEEEIRTTNPVATEQYGSVSNGMGELQEGGGQEM

SEQ ID NO: 102500 - protein, 34 aa, Artificial Sequence
  Description of Artificial Sequence: Synthetic polypeptide
DEENIRTTNPVATEIYGQVTMDNWLQRFGSNQFE

SEQ ID NO: 102501 - protein, 34 aa, Artificial Sequence
  Description of Artificial Sequence: Synthetic polypeptide
VEEEIRTTNPVATEQYGSVSNGNLVEVAANVEEE

SEQ ID NO: 102502 - protein, 34 aa, Artificial Sequence
  Description of Artificial Sequence: Synthetic polypeptide
DDETIRTTNPVATEQYGAVVITNNGQRGQINEGN

SEQ ID NO: 102503 - protein, 36 aa, Artificial Sequence
  Description of Artificial Sequence: Synthetic polypeptide
VEEEIRTTNPVATEQYGSVSNMQTDNNLDEFGGNND

SEQ ID NO: 102504 - protein, 34 aa, Artificial Sequence
  Description of Artificial Sequence: Synthetic polypeptide
DEENIRTTNPVATEAYGSVCSYTDGEYQESLNHR

SEQ ID NO: 102505 - protein, 33 aa, Artificial Sequence
  Description of Artificial Sequence: Synthetic polypeptide
DTEEIRTTNPVATEQWGVVTVTTNLQLQQGTTE

SEQ ID NO: 102506 - protein, 33 aa, Artificial Sequence
  Description of Artificial Sequence: Synthetic polypeptide
DEEEIVTTNPVATEQYGTVASATDGPVEFEGND

SEQ ID NO: 102507 - protein, 34 aa, Artificial Sequence
  Description of Artificial Sequence: Synthetic polypeptide
DEENICTTNPVATEAYGVVSTTVNLNQQGSNQED

SEQ ID NO: 102508 - protein, 32 aa, Artificial Sequence
  Description of Artificial Sequence: Synthetic polypeptide
AEECISTTNPVATEQYGCVCSSGNDQRFGSDQ

SEQ ID NO: 102509 - protein, 33 aa, Artificial Sequence
  Description of Artificial Sequence: Synthetic polypeptide
DTEEIRTTNPCATEHWGSVYFENDDQRKEGNTR

SEQ ID NO: 102510 - protein, 36 aa, Artificial Sequence
  Description of Artificial Sequence: Synthetic polypeptide
DEEKIRTTNPVATEQYGSVSSTTPAGPNLRNGMNPV

SEQ ID NO: 102511 - protein, 30 aa, Artificial Sequence
  Description of Artificial Sequence: Synthetic polypeptide
AENEIACTNPVATEQYGTVSEDGLQFEGGD

SEQ ID NO: 102512 - protein, 34 aa, Artificial Sequence
  Description of Artificial Sequence: Synthetic polypeptide
VEEELRTTNPVAYEQWGSVCSTWEHEDQRNGHNR

SEQ ID NO: 102513 - protein, 34 aa, Artificial Sequence
  Description of Artificial Sequence: Synthetic polypeptide
DTEEIRTTNPCATEAYGSVSTVVNNLQQSEENNA

SEQ ID NO: 102514 - protein, 34 aa, Artificial Sequence
  Description of Artificial Sequence: Synthetic polypeptide
DTEEIRTTNPCATEAYGSVSTVVNNLQQEEENEQ

SEQ ID NO: 102515 - protein, 29 aa, Artificial Sequence
  Description of Artificial Sequence: Synthetic peptide
AENEIACTNPVATEQYGTISEDLQQNGGH

SEQ ID NO: 102516 - protein, 31 aa, Artificial Sequence
  Description of Artificial Sequence: Synthetic polypeptide
VEEEVAPTNPVATAQWGSVSQGNLDQDDGNH

SEQ ID NO: 102517 - protein, 34 aa, Artificial Sequence
  Description of Artificial Sequence: Synthetic polypeptide
DTEEIRTTNPCATEAYGSVSTVTNNLQDTEENDE

SEQ ID NO: 102518 - protein, 33 aa, Artificial Sequence
  Description of Artificial Sequence: Synthetic polypeptide
DDMEIATTNPVATEQYGTVCSATDTIVQREGND

SEQ ID NO: 102519 - protein, 32 aa, Artificial Sequence
  Description of Artificial Sequence: Synthetic polypeptide
DEVEIRTTNPVATEQYGSVSPLNQMDSIILQY

SEQ ID NO: 102520 - protein, 34 aa, Artificial Sequence
  Description of Artificial Sequence: Synthetic polypeptide
AEECIATTNPVATEQYGSVSWNEGQDRQRGLGNA

SEQ ID NO: 102521 - protein, 34 aa, Artificial Sequence
  Description of Artificial Sequence: Synthetic polypeptide
DEEHIRTTNPVATEGWGSGVYATNNLQLLGVEGR

SEQ ID NO: 102522 - protein, 34 aa, Artificial Sequence
  Description of Artificial Sequence: Synthetic polypeptide
DTEEIRTTNPCATEAYGSVSTVNNNLQGEEENNQ

SEQ ID NO: 102523 - protein, 30 aa, Artificial Sequence
  Description of Artificial Sequence: Synthetic polypeptide
AENEIACTNPVATEQYGTASTGLVEREGGD

SEQ ID NO: 102524 - protein, 33 aa, Artificial Sequence
  Description of Artificial Sequence: Synthetic polypeptide
DEEHINTTNPVATEGWGSGVYATNNLQLGVEIR

SEQ ID NO: 102525 - protein, 28 aa, Artificial Sequence
  Description of Artificial Sequence: Synthetic peptide
DEEHIATTNPVATEQYGEAPEVCQHEEK

SEQ ID NO: 102526 - protein, 34 aa, Artificial Sequence
  Description of Artificial Sequence: Synthetic polypeptide
VEEVVRTTNPVATEQYGSVSTWNLDETRIVPNQQ

SEQ ID NO: 102527 - protein, 35 aa, Artificial Sequence
  Description of Artificial Sequence: Synthetic polypeptide
DEEGIRTTNPVATEQYGSVSVTTNADDGNGGQNGQ

SEQ ID NO: 102528 - protein, 28 aa, Artificial Sequence
  Description of Artificial Sequence: Synthetic peptide
VEGEIAPTNPCSSEQYGIVSCNLQSQTR

SEQ ID NO: 102529 - protein, 35 aa, Artificial Sequence
  Description of Artificial Sequence: Synthetic polypeptide
DEEGIRTTNPVATEQYGSVSTTNADDGNGGQNDGT

SEQ ID NO: 102530 - protein, 28 aa, Artificial Sequence
  Description of Artificial Sequence: Synthetic peptide
VENEIATTNPVATECYGDVSECHQHEEL

SEQ ID NO: 102531 - protein, 34 aa, Artificial Sequence
  Description of Artificial Sequence: Synthetic polypeptide
VEEEVRTTNPVAYEQWGSVCSTWEHLDQDIGNER

SEQ ID NO: 102532 - protein, 33 aa, Artificial Sequence
  Description of Artificial Sequence: Synthetic polypeptide
VEEEIRTTNPVATEQYGYVSNMNFEGQGGEDGE

SEQ ID NO: 102533 - protein, 34 aa, Artificial Sequence
  Description of Artificial Sequence: Synthetic polypeptide
VEEEIRTTNPVATEQYGVVSTGFTDGQTGGNGEE

SEQ ID NO: 102534 - protein, 33 aa, Artificial Sequence
  Description of Artificial Sequence: Synthetic polypeptide
VEEEIRTTNPVATEQYGVVSSGFGNEGQGTGQT

SEQ ID NO: 102535 - protein, 34 aa, Artificial Sequence
  Description of Artificial Sequence: Synthetic polypeptide
DEENICTTNPVATEAYGVVSTSTQNLQQGSNQED

SEQ ID NO: 102536 - protein, 33 aa, Artificial Sequence
  Description of Artificial Sequence: Synthetic polypeptide
DEVEIRTTNPVATEQYGSVSNEVDLELFGSQQE

SEQ ID NO: 102537 - protein, 32 aa, Artificial Sequence
  Description of Artificial Sequence: Synthetic polypeptide
DTEEIRTTNPEATEHYGCVCSWGNLQNFNSNQ

SEQ ID NO: 102538 - protein, 31 aa, Artificial Sequence
  Description of Artificial Sequence: Synthetic polypeptide
AEMEIVCTNPVATEQYGEACSAENPQREGND

SEQ ID NO: 102539 - protein, 35 aa, Artificial Sequence
  Description of Artificial Sequence: Synthetic polypeptide
VEEEIRTTNPVATEQYGSVSTTQNGQADEGGGGET

SEQ ID NO: 102540 - protein, 31 aa, Artificial Sequence
  Description of Artificial Sequence: Synthetic polypeptide
AEMEIVCTNPVATEQYGTACSAENPQREGND

SEQ ID NO: 102541 - protein, 34 aa, Artificial Sequence
  Description of Artificial Sequence: Synthetic polypeptide
DEENICTTNPVATEAYGSVATTVNTNLQPGTNEM

SEQ ID NO: 102542 - protein, 34 aa, Artificial Sequence
  Description of Artificial Sequence: Synthetic polypeptide
VEEEIRTTNPVATEQYGSVSVVLTTELDAEANQS

SEQ ID NO: 102543 - protein, 31 aa, Artificial Sequence
  Description of Artificial Sequence: Synthetic polypeptide
AEMEIVTTNPVATEQYGEACSTDNPEFEGND

SEQ ID NO: 102544 - protein, 32 aa, Artificial Sequence
  Description of Artificial Sequence: Synthetic polypeptide
AEMEIVTTNPVATEQYGEACSTDNPVEREGGR

SEQ ID NO: 102545 - protein, 32 aa, Artificial Sequence
  Description of Artificial Sequence: Synthetic polypeptide
AEMEIVTTNPVATEQYGEVCSATDGLEREGGD

SEQ ID NO: 102546 - protein, 33 aa, Artificial Sequence
  Description of Artificial Sequence: Synthetic polypeptide
DEENICTTNPVATEAYGQVSTTNNLQQGSTEEQ

SEQ ID NO: 102547 - protein, 34 aa, Artificial Sequence
  Description of Artificial Sequence: Synthetic polypeptide
VEEEIRTTNPVATEQYGSVVGFGNLEDGEDTNGG

SEQ ID NO: 102548 - protein, 28 aa, Artificial Sequence
  Description of Artificial Sequence: Synthetic peptide
DDGEIASTNPVSSEGYGNVSNNIQSGTR

SEQ ID NO: 102549 - protein, 34 aa, Artificial Sequence
  Description of Artificial Sequence: Synthetic polypeptide
DEENIATTNPVATEPYGQVNCTNEASQRGGNTRV

SEQ ID NO: 102550 - protein, 34 aa, Artificial Sequence
  Description of Artificial Sequence: Synthetic polypeptide
VEEEIRTTNPVATEQYGSVVGFGNLEDGENVGIP

SEQ ID NO: 102551 - protein, 34 aa, Artificial Sequence
  Description of Artificial Sequence: Synthetic polypeptide
VEEEIRTTNPVATEQYGSVVGFGNLEDGEVTNID

SEQ ID NO: 102552 - protein, 33 aa, Artificial Sequence
  Description of Artificial Sequence: Synthetic polypeptide
AEMEIVTTNPVATEQYGEVCSATDNPVEREGGR

SEQ ID NO: 102553 - protein, 35 aa, Artificial Sequence
  Description of Artificial Sequence: Synthetic polypeptide
VEEEIRTTNPVATEQYGSVVSGTNMGQLEGGGEQT

SEQ ID NO: 102554 - protein, 33 aa, Artificial Sequence
  Description of Artificial Sequence: Synthetic polypeptide
VEEEIRTTNPVATEQYGTVDTDNGQGNGQTGEG

SEQ ID NO: 102555 - protein, 31 aa, Artificial Sequence
  Description of Artificial Sequence: Synthetic polypeptide
DTEEIRTTNPCATEHYGCVCSWELQYFNSNQ

SEQ ID NO: 102556 - protein, 30 aa, Artificial Sequence
  Description of Artificial Sequence: Synthetic polypeptide
DDGEIASTNPVSTEGYGNVSNNIQSRVGTR

SEQ ID NO: 102557 - protein, 34 aa, Artificial Sequence
  Description of Artificial Sequence: Synthetic polypeptide
DTEEIRTTNPCATEHWGSVYFNDLEQQRQEGNGR

SEQ ID NO: 102558 - protein, 32 aa, Artificial Sequence
  Description of Artificial Sequence: Synthetic polypeptide
AEECISTTNPVATEQYGCVCSWNDHQYGSNQS

SEQ ID NO: 102559 - protein, 34 aa, Artificial Sequence
  Description of Artificial Sequence: Synthetic polypeptide
DEENIRTTNPVATEPYGQVNCTNEASQRTGGNKV

SEQ ID NO: 102560 - protein, 36 aa, Artificial Sequence
  Description of Artificial Sequence: Synthetic polypeptide
AEDEIRTTNPVATEQYGSVSTTVNNLQQQIGTTNVE

SEQ ID NO: 102561 - protein, 33 aa, Artificial Sequence
  Description of Artificial Sequence: Synthetic polypeptide
AEDEIRTTNPCATECYGSVSTGNLGNAGENGSE

SEQ ID NO: 102562 - protein, 30 aa, Artificial Sequence
  Description of Artificial Sequence: Synthetic polypeptide
DDSEIASTNPVSTEQYGNVSNTIQSRVGQR

SEQ ID NO: 102563 - protein, 30 aa, Artificial Sequence
  Description of Artificial Sequence: Synthetic polypeptide
YEEEIASVNPVATEQYGAVSDENLAESGPQ

SEQ ID NO: 102564 - protein, 31 aa, Artificial Sequence
  Description of Artificial Sequence: Synthetic polypeptide
DDSEIATTNPVATECWGSVSCNEQDRVGEQG

SEQ ID NO: 102565 - protein, 31 aa, Artificial Sequence
  Description of Artificial Sequence: Synthetic polypeptide
DDSEIATTNPVATECYGSVSCTIQDRVGEQG

SEQ ID NO: 102566 - protein, 32 aa, Artificial Sequence
  Description of Artificial Sequence: Synthetic polypeptide
YEEEIASVNPVATEQYGAVSDENLQESKGNYQ

SEQ ID NO: 102567 - protein, 32 aa, Artificial Sequence
  Description of Artificial Sequence: Synthetic polypeptide
DDSEIATTNPVATEGYGNVAANTIVQSREGNR

SEQ ID NO: 102568 - protein, 32 aa, Artificial Sequence
  Description of Artificial Sequence: Synthetic polypeptide
DDSEIATTNPVATEGYGSVATNPAINSRNGQR

SEQ ID NO: 102569 - protein, 30 aa, Artificial Sequence
  Description of Artificial Sequence: Synthetic polypeptide
DDSEIATTNPVATEQYGNVPANTCQRVEQK

SEQ ID NO: 102570 - protein, 32 aa, Artificial Sequence
  Description of Artificial Sequence: Synthetic polypeptide
DDSEIATTNPVATEQYGNVSANTIQSHEGQDR

SEQ ID NO: 102571 - protein, 31 aa, Artificial Sequence
  Description of Artificial Sequence: Synthetic polypeptide
DDSEIATTNPVATEQYGNVSATDLEDHEGEL

SEQ ID NO: 102572 - protein, 33 aa, Artificial Sequence
  Description of Artificial Sequence: Synthetic polypeptide
DEEEISTTNPVATEQYGSVSSNGIEEENEEDEQ

SEQ ID NO: 102573 - protein, 32 aa, Artificial Sequence
  Description of Artificial Sequence: Synthetic polypeptide
DDSEIATTNPVATEQYGSVSATDLEDHEGEDL

SEQ ID NO: 102574 - protein, 32 aa, Artificial Sequence
  Description of Artificial Sequence: Synthetic polypeptide
YEEEIASVNPVATEQYGTVCSATDGLQFEGND

SEQ ID NO: 102575 - protein, 32 aa, Artificial Sequence
  Description of Artificial Sequence: Synthetic polypeptide
DTEEIATTNPCATEHWGSVYFVDLQRQEGNDR

SEQ ID NO: 102576 - protein, 34 aa, Artificial Sequence
  Description of Artificial Sequence: Synthetic polypeptide
DDSEIATTNPVATEQYGSVSATNPAINSRNGQPR

SEQ ID NO: 102577 - protein, 31 aa, Artificial Sequence
  Description of Artificial Sequence: Synthetic polypeptide
YEEEIASVNPVATEQYGTVCSDDNLVESGNQ

SEQ ID NO: 102578 - protein, 31 aa, Artificial Sequence
  Description of Artificial Sequence: Synthetic polypeptide
YEEEIASVNPVATEQYGVVCSDDNLVESGNQ

SEQ ID NO: 102579 - protein, 31 aa, Artificial Sequence
  Description of Artificial Sequence: Synthetic polypeptide
DTEEIATTNPCATEHWGCVYFNLDQDREDNR

SEQ ID NO: 102580 - protein, 31 aa, Artificial Sequence
  Description of Artificial Sequence: Synthetic polypeptide
AENEIACTNPVATEQYGEVSAENLEREGEDL

SEQ ID NO: 102581 - protein, 31 aa, Artificial Sequence
  Description of Artificial Sequence: Synthetic polypeptide
AENEIACTNPVATEQYGEVCSEDNLVEFGGR

SEQ ID NO: 102582 - protein, 33 aa, Artificial Sequence
  Description of Artificial Sequence: Synthetic polypeptide
DTEEIACTNPVATEQYGSVSWNETGERNGKQER

SEQ ID NO: 102583 - protein, 31 aa, Artificial Sequence
  Description of Artificial Sequence: Synthetic polypeptide
AENEIACTNPVATECYGEASNANLQERKGGR

SEQ ID NO: 102584 - protein, 32 aa, Artificial Sequence
  Description of Artificial Sequence: Synthetic polypeptide
AENEIACTNPVATEQYGEVSAENLQDHEGGDR

SEQ ID NO: 102585 - protein, 29 aa, Artificial Sequence
  Description of Artificial Sequence: Synthetic peptide
YEEEIASVNPVATEQYGVVSDNEMNSGDA

SEQ ID NO: 102586 - protein, 35 aa, Artificial Sequence
  Description of Artificial Sequence: Synthetic polypeptide
DEEEISTTNPVATEQYGSVSSTTPAGPNRNGMNPV

SEQ ID NO: 102587 - protein, 28 aa, Artificial Sequence
  Description of Artificial Sequence: Synthetic peptide
DDSEIASTNPVSTEGYGVVASTIQRGQI

SEQ ID NO: 102588 - protein, 33 aa, Artificial Sequence
  Description of Artificial Sequence: Synthetic polypeptide
DTEEICTTNPVATTQYGSVSTNPAEQGTNNQED

SEQ ID NO: 102589 - protein, 33 aa, Artificial Sequence
  Description of Artificial Sequence: Synthetic polypeptide
DTEEICTTNPVATTQYGSVSTNPAEQGNTNENN

SEQ ID NO: 102590 - protein, 29 aa, Artificial Sequence
  Description of Artificial Sequence: Synthetic peptide
YEEEIASVNPPLCTEQIGVVSDNLQSGNQ

SEQ ID NO: 102591 - protein, 31 aa, Artificial Sequence
  Description of Artificial Sequence: Synthetic polypeptide
YEEEIASVNPPVCTEQYGVVSDNLQSGENQT

SEQ ID NO: 102592 - protein, 33 aa, Artificial Sequence
  Description of Artificial Sequence: Synthetic polypeptide
DTEEICTTNPVATTQYGSVSTNPAENGGNNVNV

SEQ ID NO: 102593 - protein, 31 aa, Artificial Sequence
  Description of Artificial Sequence: Synthetic polypeptide
DDSEIASTNPVATEGYGSVAANTIQSRVGQR

SEQ ID NO: 102594 - protein, 31 aa, Artificial Sequence
  Description of Artificial Sequence: Synthetic polypeptide
DDSEIASTNPVATEGYGSVSATTIEDRVGQR

SEQ ID NO: 102595 - protein, 30 aa, Artificial Sequence
  Description of Artificial Sequence: Synthetic polypeptide
DDSEIASTNPVATEQYGEAANTLQSRVGGR

SEQ ID NO: 102596 - protein, 33 aa, Artificial Sequence
  Description of Artificial Sequence: Synthetic polypeptide
DTEEICTTNPVATTQYGSVSTNPAEEGGTNANG

SEQ ID NO: 102597 - protein, 30 aa, Artificial Sequence
  Description of Artificial Sequence: Synthetic polypeptide
YEEEIASVNPSCTEQYGVVSDNLQSQGVNQ

SEQ ID NO: 102598 - protein, 30 aa, Artificial Sequence
  Description of Artificial Sequence: Synthetic polypeptide
DTEEIATTNPCAYEEWGSVYFVDLQREGGR

SEQ ID NO: 102599 - protein, 35 aa, Artificial Sequence
  Description of Artificial Sequence: Synthetic polypeptide
DEEEISTTNPVATEQYGVVCSNTGELQNFGSNTQP

SEQ ID NO: 102600 - protein, 28 aa, Artificial Sequence
  Description of Artificial Sequence: Synthetic peptide
YEEEIASVNPTCTEQNGVDSDNLQSGNQ

SEQ ID NO: 102601 - protein, 33 aa, Artificial Sequence
  Description of Artificial Sequence: Synthetic polypeptide
DEEEISTTNPVATEQYGTVCSTEHQGFNSDNQS

SEQ ID NO: 102602 - protein, 30 aa, Artificial Sequence
  Description of Artificial Sequence: Synthetic polypeptide
AENEIACTNPVATECWGSASCINLQDRGGG

SEQ ID NO: 102603 - protein, 29 aa, Artificial Sequence
  Description of Artificial Sequence: Synthetic peptide
DDSEIASTNPVGTEGYGNVASTLQSRGDI

SEQ ID NO: 102604 - protein, 29 aa, Artificial Sequence
  Description of Artificial Sequence: Synthetic peptide
DDSEIASTNPVSTECYGDVANTLQSRGQR

SEQ ID NO: 102605 - protein, 29 aa, Artificial Sequence
  Description of Artificial Sequence: Synthetic peptide
DDSEIASTNPVSTEGYGNVAAETLQRGGR

SEQ ID NO: 102606 - protein, 29 aa, Artificial Sequence
  Description of Artificial Sequence: Synthetic peptide
DDSEIASTNPVSTEGYGNVAANTIQRGGR

SEQ ID NO: 102607 - protein, 31 aa, Artificial Sequence
  Description of Artificial Sequence: Synthetic polypeptide
DDSEIASTNPVSTEGYGNVSANTLQSRVGQR

SEQ ID NO: 102608 - protein, 30 aa, Artificial Sequence
  Description of Artificial Sequence: Synthetic polypeptide
DDSEIASTNPVSTEGYGVVAANTLQRVGQR

SEQ ID NO: 102609 - protein, 28 aa, Artificial Sequence
  Description of Artificial Sequence: Synthetic peptide
DDSEIASTNPVSTEGYGVVANTIQRGQR

SEQ ID NO: 102610 - protein, 35 aa, Artificial Sequence
  Description of Artificial Sequence: Synthetic polypeptide
DEEEISTTNPVATEQYGVTVSTNEFSQESNGGNEL

SEQ ID NO: 102611 - protein, 31 aa, Artificial Sequence
  Description of Artificial Sequence: Synthetic polypeptide
AENEIACTNPVATECYGEASNANLQERKGPR

SEQ ID NO: 102612 - protein, 30 aa, Artificial Sequence
  Description of Artificial Sequence: Synthetic polypeptide
YEEEIASVNPVATEQYGVVSSDAGQSGMNV

SEQ ID NO: 102613 - protein, 31 aa, Artificial Sequence
  Description of Artificial Sequence: Synthetic polypeptide
AENEIACTNPVATECYGEASNENLQERKGGR

SEQ ID NO: 102614 - protein, 34 aa, Artificial Sequence
  Description of Artificial Sequence: Synthetic polypeptide
DEEEISTTNPVATEQYGQCVCSNTPLQNFGSQQA

SEQ ID NO: 102615 - protein, 35 aa, Artificial Sequence
  Description of Artificial Sequence: Synthetic polypeptide
DEEEISTTNPVATEQYGQCVCSNTPLQNFGSNTQL

SEQ ID NO: 102616 - protein, 28 aa, Artificial Sequence
  Description of Artificial Sequence: Synthetic peptide
YEEEIASVNPVCTEHYGVVSDNDRSGNQ

SEQ ID NO: 102617 - protein, 34 aa, Artificial Sequence
  Description of Artificial Sequence: Synthetic polypeptide
DEEEISTTNPVATEQYGQCAVCSWNHQNFGSNQS

SEQ ID NO: 102618 - protein, 34 aa, Artificial Sequence
  Description of Artificial Sequence: Synthetic polypeptide
DEEEISTTNPVATEQYGICVCSTEHQNFGSENQS

SEQ ID NO: 102619 - protein, 29 aa, Artificial Sequence
  Description of Artificial Sequence: Synthetic peptide
YEEEIASVNPVCTEIYGVVWSDHLQSGNQ

SEQ ID NO: 102620 - protein, 32 aa, Artificial Sequence
  Description of Artificial Sequence: Synthetic polypeptide
DTEAEIACTNPVAYEQYGSVATNLQNPADNSM

SEQ ID NO: 102621 - protein, 33 aa, Artificial Sequence
  Description of Artificial Sequence: Synthetic polypeptide
DDSEIRTTNPVATECWGSVSCINEPQDREGENC

SEQ ID NO: 102622 - protein, 33 aa, Artificial Sequence
  Description of Artificial Sequence: Synthetic polypeptide
DTEAEIACTNPVAYEQYGSVATNLQNGQGDNQM

SEQ ID NO: 102623 - protein, 33 aa, Artificial Sequence
  Description of Artificial Sequence: Synthetic polypeptide
DTEAEIACTNPVAYEQYGSVATNLQGAGMNDDN

SEQ ID NO: 102624 - protein, 34 aa, Artificial Sequence
  Description of Artificial Sequence: Synthetic polypeptide
DEEEISTTNPVATEQYGQCVCSTEDNQNFGSNQA

SEQ ID NO: 102625 - protein, 31 aa, Artificial Sequence
  Description of Artificial Sequence: Synthetic polypeptide
DTEAEIACTNPVAYEQYGSVATNLQANPVEN

SEQ ID NO: 102626 - protein, 32 aa, Artificial Sequence
  Description of Artificial Sequence: Synthetic polypeptide
DTAEIRYTNPVATEQYGCVVSTNLENYGTQQH

SEQ ID NO: 102627 - protein, 35 aa, Artificial Sequence
  Description of Artificial Sequence: Synthetic polypeptide
DTAEIRTTNPVATEQWGSTPSCTNELQERSGDNEL

SEQ ID NO: 102628 - protein, 34 aa, Artificial Sequence
  Description of Artificial Sequence: Synthetic polypeptide
DDSEIRTTNPVATEGYGSVSACINIPQDREGENG

SEQ ID NO: 102629 - protein, 34 aa, Artificial Sequence
  Description of Artificial Sequence: Synthetic polypeptide
DDSEIRTTNPVATEGYGSVSACINIPQSREGENG

SEQ ID NO: 102630 - protein, 32 aa, Artificial Sequence
  Description of Artificial Sequence: Synthetic polypeptide
DTAEIACTNPVATEQYGSVATNLQQGGGEGVD

SEQ ID NO: 102631 - protein, 29 aa, Artificial Sequence
  Description of Artificial Sequence: Synthetic peptide
YEEEIASVNPVCTEPYGVVSMEDLQSGNQ

SEQ ID NO: 102632 - protein, 32 aa, Artificial Sequence
  Description of Artificial Sequence: Synthetic polypeptide
DSSEIRTTNPVAYEQYGTVISCLNAFQRENNA

SEQ ID NO: 102633 - protein, 33 aa, Artificial Sequence
  Description of Artificial Sequence: Synthetic polypeptide
DSSEIRTTNPVATECWGSVSCLNEPQDREGENG

SEQ ID NO: 102634 - protein, 31 aa, Artificial Sequence
  Description of Artificial Sequence: Synthetic polypeptide
DDSEIRTTNPVATEQYGCVVPDIQEGQDDNN

SEQ ID NO: 102635 - protein, 33 aa, Artificial Sequence
  Description of Artificial Sequence: Synthetic polypeptide
DSSEIRTTNPVATECWGSVSCINEPQDREGENG

SEQ ID NO: 102636 - protein, 33 aa, Artificial Sequence
  Description of Artificial Sequence: Synthetic polypeptide
DDSEIRTTNPVATECWGSVSCINEPQDREGENG

SEQ ID NO: 102637 - protein, 33 aa, Artificial Sequence
  Description of Artificial Sequence: Synthetic polypeptide
DEEEISTTNPVATEQYGQCVCSTEHQHSNSQQA

SEQ ID NO: 102638 - protein, 34 aa, Artificial Sequence
  Description of Artificial Sequence: Synthetic polypeptide
DEEEISTTNPVATEQYGQCVCSTENHQNFGSDQG

SEQ ID NO: 102639 - protein, 34 aa, Artificial Sequence
  Description of Artificial Sequence: Synthetic polypeptide
DEEEISTTNPVATEQYGQCVCSTEPNQNFGSNQL

SEQ ID NO: 102640 - protein, 32 aa, Artificial Sequence
  Description of Artificial Sequence: Synthetic polypeptide
DDSEIATTNPVSTEGYGSVATNPAIQSRVGQR

SEQ ID NO: 102641 - protein, 31 aa, Artificial Sequence
  Description of Artificial Sequence: Synthetic polypeptide
DDSEIATTNPVSTEQYGDVSANIEQSRVEQR

SEQ ID NO: 102642 - protein, 31 aa, Artificial Sequence
  Description of Artificial Sequence: Synthetic polypeptide
DDSEIATTNPVSTEQYGDVSANTEQSRVEQR

SEQ ID NO: 102643 - protein, 31 aa, Artificial Sequence
  Description of Artificial Sequence: Synthetic polypeptide
DDSEIATTNPVSTEQYGNVAATDGIQREGQR

SEQ ID NO: 102644 - protein, 31 aa, Artificial Sequence
  Description of Artificial Sequence: Synthetic polypeptide
DDSEIATTNPVSTEQYGNVAATGIQSREGQR

SEQ ID NO: 102645 - protein, 31 aa, Artificial Sequence
  Description of Artificial Sequence: Synthetic polypeptide
AENEIACTNPVATEQYGETTSEENLQPKGGR

SEQ ID NO: 102646 - protein, 31 aa, Artificial Sequence
  Description of Artificial Sequence: Synthetic polypeptide
DDSEICTTNPVATEQYGSVSWYNDIDDNVEE

SEQ ID NO: 102647 - protein, 32 aa, Artificial Sequence
  Description of Artificial Sequence: Synthetic polypeptide
DTEAEIATTNPVAYEQYGSVATNLQNPDPDQM

SEQ ID NO: 102648 - protein, 30 aa, Artificial Sequence
  Description of Artificial Sequence: Synthetic polypeptide
DDSEIRCTNPVSTEQYGNVANTIQSRVGQR

SEQ ID NO: 102649 - protein, 32 aa, Artificial Sequence
  Description of Artificial Sequence: Synthetic polypeptide
DTEAEIATTNPVAYEQYGSVATNLQNPADHTM

SEQ ID NO: 102650 - protein, 31 aa, Artificial Sequence
  Description of Artificial Sequence: Synthetic polypeptide
DDSEIRSTNPVATEGYGNVAANTIQSRVGQR

SEQ ID NO: 102651 - protein, 30 aa, Artificial Sequence
  Description of Artificial Sequence: Synthetic polypeptide
DDSEIRSTNPVATEGYGNVANTIQSRVGQR

SEQ ID NO: 102652 - protein, 32 aa, Artificial Sequence
  Description of Artificial Sequence: Synthetic polypeptide
DDSEIRSTNPVSTEGYGNVATNTIQSRNGNPR

SEQ ID NO: 102653 - protein, 29 aa, Artificial Sequence
  Description of Artificial Sequence: Synthetic peptide
YEEEIASVNPVCTECWGVVSDNLPQSGNQ

SEQ ID NO: 102654 - protein, 33 aa, Artificial Sequence
  Description of Artificial Sequence: Synthetic polypeptide
DEEEISTTNPVATEQYGQCVCSWELQSFGSEQP

SEQ ID NO: 102655 - protein, 30 aa, Artificial Sequence
  Description of Artificial Sequence: Synthetic polypeptide
YEEEIASVNPVCTECYGVVSCNLPQSEGNQ

SEQ ID NO: 102656 - protein, 28 aa, Artificial Sequence
  Description of Artificial Sequence: Synthetic peptide
YEEEIASVNPVCTECYGVVSDNLQSEEQ

SEQ ID NO: 102657 - protein, 34 aa, Artificial Sequence
  Description of Artificial Sequence: Synthetic polypeptide
DEEEISTTNPVATEQYGQCVCSTNHQNFGSDTQL

SEQ ID NO: 102658 - protein, 33 aa, Artificial Sequence
  Description of Artificial Sequence: Synthetic polypeptide
DTEAEIATTNPVAYEQYGSVATNLANPDGDNSM

SEQ ID NO: 102659 - protein, 28 aa, Artificial Sequence
  Description of Artificial Sequence: Synthetic peptide
YEEEIASVNPVCTEGYGVVADTLQSGNQ

SEQ ID NO: 102660 - protein, 35 aa, Artificial Sequence
  Description of Artificial Sequence: Synthetic polypeptide
DEEEISTTNPVATEQYGQCVCSTGNLNQNFGSDQS

SEQ ID NO: 102661 - protein, 33 aa, Artificial Sequence
  Description of Artificial Sequence: Synthetic polypeptide
DEEEISTTNPVATEQYGQCVCSTGEHQNGSDQF

SEQ ID NO: 102662 - protein, 33 aa, Artificial Sequence
  Description of Artificial Sequence: Synthetic polypeptide
DEEEISTTNPVATEQYGQCVCSTEPQFFNSQQA

SEQ ID NO: 102663 - protein, 29 aa, Artificial Sequence
  Description of Artificial Sequence: Synthetic peptide
DDSEIASTNPVATEGYGNVAENIMSRGQR

SEQ ID NO: 102664 - protein, 32 aa, Artificial Sequence
  Description of Artificial Sequence: Synthetic polypeptide
DEEEISTTNPVAYECWGTVSWTEHDNRGGGNR

SEQ ID NO: 102665 - protein, 30 aa, Artificial Sequence
  Description of Artificial Sequence: Synthetic polypeptide
YEEEIASVNPIATEQWGVTVSNDNLQSGNI

SEQ ID NO: 102666 - protein, 31 aa, Artificial Sequence
  Description of Artificial Sequence: Synthetic polypeptide
DDSEIASTNPVATEGYGNVAANTIQSREGNR

SEQ ID NO: 102667 - protein, 32 aa, Artificial Sequence
  Description of Artificial Sequence: Synthetic polypeptide
DDQEIATTNPVATEQYGSVSATTIQDHVGQDL

SEQ ID NO: 102668 - protein, 32 aa, Artificial Sequence
  Description of Artificial Sequence: Synthetic polypeptide
DDQEIATTNPVATEQYGSVSVTDLEDHGGEDL

SEQ ID NO: 102669 - protein, 30 aa, Artificial Sequence
  Description of Artificial Sequence: Synthetic polypeptide
AENEIACTNPVATEQYGMAPSENPKQLGGR

SEQ ID NO: 102670 - protein, 35 aa, Artificial Sequence
  Description of Artificial Sequence: Synthetic polypeptide
DEEEIVTTNPVATEQYGSVSSTTPAGVNMRNGNPV

SEQ ID NO: 102671 - protein, 35 aa, Artificial Sequence
  Description of Artificial Sequence: Synthetic polypeptide
DEEEIVTTNPVATEQYGSVSSTTPAGVNMREGNPD

SEQ ID NO: 102672 - protein, 35 aa, Artificial Sequence
  Description of Artificial Sequence: Synthetic polypeptide
DEEEIVTTNPVATEQYGSVSSTTPAGPNMRNGMNV

SEQ ID NO: 102673 - protein, 36 aa, Artificial Sequence
  Description of Artificial Sequence: Synthetic polypeptide
DEEEIVTTNPVATEQYGSVSSTTPAGPNMQNGMNPV

SEQ ID NO: 102674 - protein, 32 aa, Artificial Sequence
  Description of Artificial Sequence: Synthetic polypeptide
YEEEIASTNPVATEQYGVVSSTTNGNSGMNPQ

SEQ ID NO: 102675 - protein, 35 aa, Artificial Sequence
  Description of Artificial Sequence: Synthetic polypeptide
DEEEIVTTNPVATEQYGSVSSTTPAGPNMFNGMNV

SEQ ID NO: 102676 - protein, 35 aa, Artificial Sequence
  Description of Artificial Sequence: Synthetic polypeptide
DEEEIVTTNPVATEQYGSVSSTTDAGVNMFEGMND

SEQ ID NO: 102677 - protein, 32 aa, Artificial Sequence
  Description of Artificial Sequence: Synthetic polypeptide
DDQEIATTNPVATEQYGSVSATTIEDRVGQDL

SEQ ID NO: 102678 - protein, 35 aa, Artificial Sequence
  Description of Artificial Sequence: Synthetic polypeptide
DEEEIVTTNPVATEQYGSVSSTTDAGPNMFNGMND

SEQ ID NO: 102679 - protein, 34 aa, Artificial Sequence
  Description of Artificial Sequence: Synthetic polypeptide
DEEEIVTTNPVATEQYGSVSSATDAGVEMFNGND

SEQ ID NO: 102680 - protein, 34 aa, Artificial Sequence
  Description of Artificial Sequence: Synthetic polypeptide
DEEEIVTTNPVATEQYGSVSSATDAGVEMFEGND

SEQ ID NO: 102681 - protein, 36 aa, Artificial Sequence
  Description of Artificial Sequence: Synthetic polypeptide
DTEEIRATNPVATEQYGSVSTVVNNLQAGNQQQNTD

SEQ ID NO: 102682 - protein, 36 aa, Artificial Sequence
  Description of Artificial Sequence: Synthetic polypeptide
DTEEIRATNPVATEQYGSVSTVTNNLQAGNNQQGTD

SEQ ID NO: 102683 - protein, 29 aa, Artificial Sequence
  Description of Artificial Sequence: Synthetic peptide
YEEEIASTNPVCTEGYGVVADTLQSSGNQ

SEQ ID NO: 102684 - protein, 32 aa, Artificial Sequence
  Description of Artificial Sequence: Synthetic polypeptide
DDQEICTTNPVATEQYGSVSATDLEPHEGEDT

SEQ ID NO: 102685 - protein, 30 aa, Artificial Sequence
  Description of Artificial Sequence: Synthetic polypeptide
YEEEIASTNPVCTEGYGVVANTLQSRVGNQ

SEQ ID NO: 102686 - protein, 35 aa, Artificial Sequence
  Description of Artificial Sequence: Synthetic polypeptide
DEEEIVTTNPVATEQYGSVCSATPAGPEMREGNPV

SEQ ID NO: 102687 - protein, 36 aa, Artificial Sequence
  Description of Artificial Sequence: Synthetic polypeptide
DTEEIRATNPVATEQYGSVSTTVNNLQQGNNQQGTD

SEQ ID NO: 102688 - protein, 29 aa, Artificial Sequence
  Description of Artificial Sequence: Synthetic peptide
YEEEIASTNPVCTEGYGVVANTLQSSGNQ

SEQ ID NO: 102689 - protein, 35 aa, Artificial Sequence
  Description of Artificial Sequence: Synthetic polypeptide
DEEEIVTTNPVATEQYGSVSSATPAGVNMREGNPV

SEQ ID NO: 102690 - protein, 32 aa, Artificial Sequence
  Description of Artificial Sequence: Synthetic polypeptide
DDQEIATTNPVATEQYGSVSATDLESHVGQDL

SEQ ID NO: 102691 - protein, 35 aa, Artificial Sequence
  Description of Artificial Sequence: Synthetic polypeptide
AEDEIRATNPVATEQYGSVSTTNTNLLQSGTNQED

SEQ ID NO: 102692 - protein, 32 aa, Artificial Sequence
  Description of Artificial Sequence: Synthetic polypeptide
DDQEIATTNPVATEQYGSVSATDLEDHVGEDL

SEQ ID NO: 102693 - protein, 32 aa, Artificial Sequence
  Description of Artificial Sequence: Synthetic polypeptide
DEEEIVTTNPVATEQYGTASATDGPVEHEGND

SEQ ID NO: 102694 - protein, 34 aa, Artificial Sequence
  Description of Artificial Sequence: Synthetic polypeptide
AEDEIRATNPVATEQYGSVVTTTNNLQSGTNQQD

SEQ ID NO: 102695 - protein, 34 aa, Artificial Sequence
  Description of Artificial Sequence: Synthetic polypeptide
AEDEIRATNPVATEQYGSVTVTTVNLQSGTNQQD

SEQ ID NO: 102696 - protein, 31 aa, Artificial Sequence
  Description of Artificial Sequence: Synthetic polypeptide
DEEEIVTTNPVATEQYGTASATDGPEFEEND

SEQ ID NO: 102697 - protein, 30 aa, Artificial Sequence
  Description of Artificial Sequence: Synthetic polypeptide
DEEEIVTTNPVATEQYGTAPTGPVQFEEEK

SEQ ID NO: 102698 - protein, 35 aa, Artificial Sequence
  Description of Artificial Sequence: Synthetic polypeptide
AEDEIRATNPVATEQYGSVSVTTNQLQNQGTNQED

SEQ ID NO: 102699 - protein, 34 aa, Artificial Sequence
  Description of Artificial Sequence: Synthetic polypeptide
DTEEIRATNPVATEQYGSVVTVTNNLQNQGTTDD

SEQ ID NO: 102700 - protein, 35 aa, Artificial Sequence
  Description of Artificial Sequence: Synthetic polypeptide
AEDEIRATNPVATEQYGSVSVTTNQLEQQGTNNQD

SEQ ID NO: 102701 - protein, 35 aa, Artificial Sequence
  Description of Artificial Sequence: Synthetic polypeptide
DTEEIRATNPVATEQYGSVVTVTNLQQGNQGTTDD

SEQ ID NO: 102702 - protein, 30 aa, Artificial Sequence
  Description of Artificial Sequence: Synthetic polypeptide
DEEEIVTTNPVATEQYGTAPTDGPQHEEED

SEQ ID NO: 102703 - protein, 34 aa, Artificial Sequence
  Description of Artificial Sequence: Synthetic polypeptide
DTEEIRATNPVATEQYGSVVTTTNLEQGNQGTDD

SEQ ID NO: 102704 - protein, 35 aa, Artificial Sequence
  Description of Artificial Sequence: Synthetic polypeptide
AEDEIRATNPVATEQYGSVSTTTNNLNQQGTNQDD

SEQ ID NO: 102705 - protein, 30 aa, Artificial Sequence
  Description of Artificial Sequence: Synthetic polypeptide
DEEEIVTTNPVATEQYGTAPATGPVEHGEK

SEQ ID NO: 102706 - protein, 31 aa, Artificial Sequence
  Description of Artificial Sequence: Synthetic polypeptide
DEEEIVTTNPVATEQYGTAPATGPVEHEGNK

SEQ ID NO: 102707 - protein, 30 aa, Artificial Sequence
  Description of Artificial Sequence: Synthetic polypeptide
DEEEIVTTNPVATEQYGTAPATGCVEHGEK

SEQ ID NO: 102708 - protein, 31 aa, Artificial Sequence
  Description of Artificial Sequence: Synthetic polypeptide
DEEEIVTTNPVATEQYGTAPATDGPQFEEND

SEQ ID NO: 102709 - protein, 32 aa, Artificial Sequence
  Description of Artificial Sequence: Synthetic polypeptide
DDQEIATTNPVATEQYGSVSANDLEDHEGQDL

SEQ ID NO: 102710 - protein, 32 aa, Artificial Sequence
  Description of Artificial Sequence: Synthetic polypeptide
DDQEIATTNPVATEQYGSVSANTLEDHEGQDL

SEQ ID NO: 102711 - protein, 35 aa, Artificial Sequence
  Description of Artificial Sequence: Synthetic polypeptide
AEDEIRATNPVATEQYGSVSTTTNNLLQSGTNQDD

SEQ ID NO: 102712 - protein, 35 aa, Artificial Sequence
  Description of Artificial Sequence: Synthetic polypeptide
AEDEIRATNPVATEQYGSVSTTNTNLTQSGTNQQD

SEQ ID NO: 102713 - protein, 32 aa, Artificial Sequence
  Description of Artificial Sequence: Synthetic polypeptide
DDQEIATTNPVATEQYGSVSATDIEDRVGQDL

SEQ ID NO: 102714 - protein, 32 aa, Artificial Sequence
  Description of Artificial Sequence: Synthetic polypeptide
DDQEIATTNPVATEQYGSVSATDIQDHVGQDL

SEQ ID NO: 102715 - protein, 32 aa, Artificial Sequence
  Description of Artificial Sequence: Synthetic polypeptide
DDQEIATTNPVATEQYGSVSATDLEDHEGEDL

SEQ ID NO: 102716 - protein, 36 aa, Artificial Sequence
  Description of Artificial Sequence: Synthetic polypeptide
DTEEIRATNPVATEQYGSVSTTTNNLQAGNEQQQTG

SEQ ID NO: 102717 - protein, 36 aa, Artificial Sequence
  Description of Artificial Sequence: Synthetic polypeptide
AEDEIRTTNPVATEQYGSVSTTTNNNLNQQIGSNVE

SEQ ID NO: 102718 - protein, 33 aa, Artificial Sequence
  Description of Artificial Sequence: Synthetic polypeptide
DEEEIVTTNPVATEQYGQVCSATDGPVEFEGND

SEQ ID NO: 102719 - protein, 35 aa, Artificial Sequence
  Description of Artificial Sequence: Synthetic polypeptide
DTEEIRATNPVATEQYGSVSTTNNQQQGNNNQQSD

SEQ ID NO: 102720 - protein, 28 aa, Artificial Sequence
  Description of Artificial Sequence: Synthetic peptide
DDSEIAPTNPCSSEQYGIVANNIQRGTR

SEQ ID NO: 102721 - protein, 28 aa, Artificial Sequence
  Description of Artificial Sequence: Synthetic peptide
DDSEIAPTNPCSSEQYGNVANNIQRGTR

SEQ ID NO: 102722 - protein, 28 aa, Artificial Sequence
  Description of Artificial Sequence: Synthetic peptide
DDSEIAPTNPCSTEQYGNVANTIQRGTR

SEQ ID NO: 102723 - protein, 30 aa, Artificial Sequence
  Description of Artificial Sequence: Synthetic polypeptide
DDSEIASTNPIATEGYGSVAANTIQRVGQR

SEQ ID NO: 102724 - protein, 31 aa, Artificial Sequence
  Description of Artificial Sequence: Synthetic polypeptide
DEEEISTTNPVSTEQYGCVCQSELQGGSQQS

SEQ ID NO: 102725 - protein, 30 aa, Artificial Sequence
  Description of Artificial Sequence: Synthetic polypeptide
DEEEISTTNPVSTEIFGTVTFENLQGNAQT

SEQ ID NO: 102726 - protein, 30 aa, Artificial Sequence
  Description of Artificial Sequence: Synthetic polypeptide
AENEIACTNPVATEQYGEYCSWNPQRGSGQ

SEQ ID NO: 102727 - protein, 35 aa, Artificial Sequence
  Description of Artificial Sequence: Synthetic polypeptide
DTEEIRATNPVATEQYGSVSTNQNQNQQEQGTNNE

SEQ ID NO: 102728 - protein, 31 aa, Artificial Sequence
  Description of Artificial Sequence: Synthetic polypeptide
AENEIACTNPVATEQYGEYCSWNLQRGSEQS

SEQ ID NO: 102729 - protein, 32 aa, Artificial Sequence
  Description of Artificial Sequence: Synthetic polypeptide
DDSEIASTNPVATEGWGSVSCINEPQDRVGNR

SEQ ID NO: 102730 - protein, 35 aa, Artificial Sequence
  Description of Artificial Sequence: Synthetic polypeptide
DTEEIRATNPVATEQYGSVSTNTNNNTQQGVNNNE

SEQ ID NO: 102731 - protein, 29 aa, Artificial Sequence
  Description of Artificial Sequence: Synthetic peptide
YEEEIASVNPDCTEQYGVVSDNKLESGNQ

SEQ ID NO: 102732 - protein, 34 aa, Artificial Sequence
  Description of Artificial Sequence: Synthetic polypeptide
DEEEISTTNPVAYEQYGSVPFCTANAQAFGGGKR

SEQ ID NO: 102733 - protein, 30 aa, Artificial Sequence
  Description of Artificial Sequence: Synthetic polypeptide
DDSEIASTNPVATEGYGNVAAENIQSRGQR

SEQ ID NO: 102734 - protein, 35 aa, Artificial Sequence
  Description of Artificial Sequence: Synthetic polypeptide
DTEEIRATNPVATEQYGSVSTNDTNNEQQGTNNNE

SEQ ID NO: 102735 - protein, 33 aa, Artificial Sequence
  Description of Artificial Sequence: Synthetic polypeptide
DEEEISTTNPVAYEQYGCVCSTGEHQRFGSDQG

SEQ ID NO: 102736 - protein, 28 aa, Artificial Sequence
  Description of Artificial Sequence: Synthetic peptide
YEEEIASVNPECTEWYGVVSDMLQSGNQ

SEQ ID NO: 102737 - protein, 33 aa, Artificial Sequence
  Description of Artificial Sequence: Synthetic polypeptide
DEEEISTTNPVAYEQYGCVCSTELQESFGSDQS

SEQ ID NO: 102738 - protein, 32 aa, Artificial Sequence
  Description of Artificial Sequence: Synthetic polypeptide
DEEEISTTNPVAYEQYGCVCSTEHQNFLSNQA

SEQ ID NO: 102739 - protein, 32 aa, Artificial Sequence
  Description of Artificial Sequence: Synthetic polypeptide
DEEEISTTNPVAYEQYGCVCSSEHQHFGSNQD

SEQ ID NO: 102740 - protein, 34 aa, Artificial Sequence
  Description of Artificial Sequence: Synthetic polypeptide
DEEEISTTNPVAYEQYGCVCSNTGNLQNFGSEQA

SEQ ID NO: 102741 - protein, 33 aa, Artificial Sequence
  Description of Artificial Sequence: Synthetic polypeptide
DTEEICTTNPVATTQYGSVSTVNPNNNQGNNVE

SEQ ID NO: 102742 - protein, 34 aa, Artificial Sequence
  Description of Artificial Sequence: Synthetic polypeptide
DEEEISTTNPVAYEQYGSVPFCTNAEAFGGGKNR

SEQ ID NO: 102743 - protein, 30 aa, Artificial Sequence
  Description of Artificial Sequence: Synthetic polypeptide
YEEEIASTNPVSTEPYGVVSMEDLQSNGNH

SEQ ID NO: 102744 - protein, 30 aa, Artificial Sequence
  Description of Artificial Sequence: Synthetic polypeptide
DDSEIACTNPVSTEGYGNVSANTIQSRGGR

SEQ ID NO: 102745 - protein, 29 aa, Artificial Sequence
  Description of Artificial Sequence: Synthetic peptide
AENEIACTNPIATEQYGETSNEDLQRGGI

SEQ ID NO: 102746 - protein, 36 aa, Artificial Sequence
  Description of Artificial Sequence: Synthetic polypeptide
DTEEIRATNPVATEQYGSVSTTNNQLQAGNGTQNDT

SEQ ID NO: 102747 - protein, 33 aa, Artificial Sequence
  Description of Artificial Sequence: Synthetic polypeptide
DEEEIVTTNPVATEQYGEVCSATDGCVEFEGNK

SEQ ID NO: 102748 - protein, 29 aa, Artificial Sequence
  Description of Artificial Sequence: Synthetic peptide
DEEEIVTTNPVATEQYGEAPTVCVEHEEK

SEQ ID NO: 102749 - protein, 29 aa, Artificial Sequence
  Description of Artificial Sequence: Synthetic peptide
DEEEIVTTNPVATEQYGEAPTGCVEHEEK

SEQ ID NO: 102750 - protein, 36 aa, Artificial Sequence
  Description of Artificial Sequence: Synthetic polypeptide
DTEEIRATNPVATEQYGSVSTTNNNLQAGNNNQNAD

SEQ ID NO: 102751 - protein, 31 aa, Artificial Sequence
  Description of Artificial Sequence: Synthetic polypeptide
YEEEIASTNPVCTEQYGTVSATNPVESEGND

SEQ ID NO: 102752 - protein, 32 aa, Artificial Sequence
  Description of Artificial Sequence: Synthetic polypeptide
DEEEIVSTNPVCTEQYGVVCSADNPVQFEGNQ

SEQ ID NO: 102753 - protein, 34 aa, Artificial Sequence
  Description of Artificial Sequence: Synthetic polypeptide
DEEEIVRTTNPVAYEPWGSVSTQNAGGMGGNNRA

SEQ ID NO: 102754 - protein, 32 aa, Artificial Sequence
  Description of Artificial Sequence: Synthetic polypeptide
DEEEIVCTNPVATEQYGTVSAEDNPVMFEGND

SEQ ID NO: 102755 - protein, 36 aa, Artificial Sequence
  Description of Artificial Sequence: Synthetic polypeptide
DTEEIRATNPVATEQYGSVSTTNNNLQAGNGNQQND

SEQ ID NO: 102756 - protein, 31 aa, Artificial Sequence
  Description of Artificial Sequence: Synthetic polypeptide
DEEEIVCTNPVATEQYGTVCSEGPVMFEGND

SEQ ID NO: 102757 - protein, 32 aa, Artificial Sequence
  Description of Artificial Sequence: Synthetic polypeptide
DEEEIVCTNPVATEQYGTVCSATGPVMFEGND

SEQ ID NO: 102758 - protein, 33 aa, Artificial Sequence
  Description of Artificial Sequence: Synthetic polypeptide
DEEEIVCTNPVATEQYGTVCSATDGPVEREGND

SEQ ID NO: 102759 - protein, 36 aa, Artificial Sequence
  Description of Artificial Sequence: Synthetic polypeptide
DTEEIRATNPVATEQYGSVSTTNNNLNQAGNGEQSN

SEQ ID NO: 102760 - protein, 35 aa, Artificial Sequence
  Description of Artificial Sequence: Synthetic polypeptide
AEDEIRATNPVATEQYGSVSTTNQNQLQSGTNQQD

SEQ ID NO: 102761 - protein, 35 aa, Artificial Sequence
  Description of Artificial Sequence: Synthetic polypeptide
AEDEIRATNPVATEQYGSVSTTNQNNLQAGTNQQQ

SEQ ID NO: 102762 - protein, 35 aa, Artificial Sequence
  Description of Artificial Sequence: Synthetic polypeptide
AEDEIRATNPVATEQYGSVSTTNQNLNQSGTNQQQ

SEQ ID NO: 102763 - protein, 29 aa, Artificial Sequence
  Description of Artificial Sequence: Synthetic peptide
AENEIACTNPIATEQWGEASENLQPKGGR

SEQ ID NO: 102764 - protein, 31 aa, Artificial Sequence
  Description of Artificial Sequence: Synthetic polypeptide
DDSEIACTNPVATEGYGEVSAETLQSRVGGR

SEQ ID NO: 102765 - protein, 30 aa, Artificial Sequence
  Description of Artificial Sequence: Synthetic polypeptide
AENEIACTNPIATEQYGATTANENLQRGGR

SEQ ID NO: 102766 - protein, 30 aa, Artificial Sequence
  Description of Artificial Sequence: Synthetic polypeptide
YEEEIASTNPVCTEQYGVVSMDIQQSNGNH

SEQ ID NO: 102767 - protein, 31 aa, Artificial Sequence
  Description of Artificial Sequence: Synthetic polypeptide
YEEEIASTNPVCTEQYGVVSTDLEDHEGNDL

SEQ ID NO: 102768 - protein, 35 aa, Artificial Sequence
  Description of Artificial Sequence: Synthetic polypeptide
DTEEIRATNPVATEQYGSVSTNTTNNQQQGTNGNE

SEQ ID NO: 102769 - protein, 36 aa, Artificial Sequence
  Description of Artificial Sequence: Synthetic polypeptide
DTEEIRATNPVATEQYGSVSTTNNQQQLQQGTNANE

SEQ ID NO: 102770 - protein, 34 aa, Artificial Sequence
  Description of Artificial Sequence: Synthetic polypeptide
DDETIRTTNPVATEQYGAVSTTNHQQVRVSNNTT

SEQ ID NO: 102771 - protein, 35 aa, Artificial Sequence
  Description of Artificial Sequence: Synthetic polypeptide
VEEEIRTTNPVATEQYGSVSINDNLQQGEDEGQGG

SEQ ID NO: 102772 - protein, 37 aa, Artificial Sequence
  Description of Artificial Sequence: Synthetic polypeptide
DTEEIRTTNPVATEQYGSVSTVTNLQQGNDEEEEIGE

SEQ ID NO: 102773 - protein, 31 aa, Artificial Sequence
  Description of Artificial Sequence: Synthetic polypeptide
AENEIACTNPVATRQYGEAFMSFENLQRGGR

SEQ ID NO: 102774 - protein, 32 aa, Artificial Sequence
  Description of Artificial Sequence: Synthetic polypeptide
TTAEIRTTNPVATEQYGTVATSTVDQGDGGNI

SEQ ID NO: 102775 - protein, 32 aa, Artificial Sequence
  Description of Artificial Sequence: Synthetic polypeptide
TTAEIRTTNPVATEQYGTVCTSTVDQHGMNNI

SEQ ID NO: 102776 - protein, 32 aa, Artificial Sequence
  Description of Artificial Sequence: Synthetic polypeptide
AEEEIACTNPVATEQYGSVATNLAEAPGQAEE

SEQ ID NO: 102777 - protein, 33 aa, Artificial Sequence
  Description of Artificial Sequence: Synthetic polypeptide
DVSEIRTTNPVATECWGSVSCINEPQDREGENG

SEQ ID NO: 102778 - protein, 32 aa, Artificial Sequence
  Description of Artificial Sequence: Synthetic polypeptide
TTEEIRATNPVAYEPYGSVVPSTNELQNGGTM

SEQ ID NO: 102779 - protein, 33 aa, Artificial Sequence
  Description of Artificial Sequence: Synthetic polypeptide
DVSEIRTTNPVATECWGSVSCFNEPQDREGENG

SEQ ID NO: 102780 - protein, 32 aa, Artificial Sequence
  Description of Artificial Sequence: Synthetic polypeptide
DVQEIATTNPVATEQYGSVSATDLEMHEGEDL

SEQ ID NO: 102781 - protein, 34 aa, Artificial Sequence
  Description of Artificial Sequence: Synthetic polypeptide
DEVEIRTTNPVATEQYGDVVDGTNNLGNGNGNID

SEQ ID NO: 102782 - protein, 32 aa, Artificial Sequence
  Description of Artificial Sequence: Synthetic polypeptide
DVQEIATTNPVATEQYGSVSATDLEDHEGEDL

SEQ ID NO: 102783 - protein, 33 aa, Artificial Sequence
  Description of Artificial Sequence: Synthetic polypeptide
DYSEIRTTNPVATECWGSVSCINEPQDREGENG

SEQ ID NO: 102784 - protein, 34 aa, Artificial Sequence
  Description of Artificial Sequence: Synthetic polypeptide
DVESEIRTTNPVATEPWGSVSCINEPQDREGENG

SEQ ID NO: 102785 - protein, 33 aa, Artificial Sequence
  Description of Artificial Sequence: Synthetic polypeptide
TTEEIRGTNPVATEQYGSVVNDITNGQNGGNGQ

SEQ ID NO: 102786 - protein, 32 aa, Artificial Sequence
  Description of Artificial Sequence: Synthetic polypeptide
TTEEIRGTNPVATEQYGSVVNDTIGQNEGNGT

SEQ ID NO: 102787 - protein, 33 aa, Artificial Sequence
  Description of Artificial Sequence: Synthetic polypeptide
TTEEIRGTNPVATEQYGSVVSGTNGQEEGEGQG

SEQ ID NO: 102788 - protein, 34 aa, Artificial Sequence
  Description of Artificial Sequence: Synthetic polypeptide
DEESICTTNPVATEAYGSVNVTNNNLNQDEGTNM

SEQ ID NO: 102789 - protein, 33 aa, Artificial Sequence
  Description of Artificial Sequence: Synthetic polypeptide
TTEEIRSTNPVATEQYGSVVGTNGLQNDGQTTI

SEQ ID NO: 102790 - protein, 35 aa, Artificial Sequence
  Description of Artificial Sequence: Synthetic polypeptide
DTTEIRTTNPVATEQYGVVSTTNLQQQQQGNEEDE

SEQ ID NO: 102791 - protein, 34 aa, Artificial Sequence
  Description of Artificial Sequence: Synthetic polypeptide
DEESICTTNPVATEAYGSVATTNTNLQYGGNNDD

SEQ ID NO: 102792 - protein, 34 aa, Artificial Sequence
  Description of Artificial Sequence: Synthetic polypeptide
DEVEIRTTNPVATEQYGDVVTNNMGQQGEGNEDD

SEQ ID NO: 102793 - protein, 32 aa, Artificial Sequence
  Description of Artificial Sequence: Synthetic polypeptide
DEESIATVNPVATEPYGSVSNAGNLDMNGGNN

SEQ ID NO: 102794 - protein, 32 aa, Artificial Sequence
  Description of Artificial Sequence: Synthetic polypeptide
TTEEIRTTNPVATEQWGAVSTDGQQEEGGNTG

SEQ ID NO: 102795 - protein, 34 aa, Artificial Sequence
  Description of Artificial Sequence: Synthetic polypeptide
DTTEIRTTNPVATEQYGVVTTVTNVNLQAGNNQS

SEQ ID NO: 102796 - protein, 35 aa, Artificial Sequence
  Description of Artificial Sequence: Synthetic polypeptide
DTTEIRTTNPVATEQYGVVSNVTNVNLQAGNNEQS

SEQ ID NO: 102797 - protein, 32 aa, Artificial Sequence
  Description of Artificial Sequence: Synthetic polypeptide
EACEIATTNPVATEQWGEVSTNLPGEQGNGNP

SEQ ID NO: 102798 - protein, 34 aa, Artificial Sequence
  Description of Artificial Sequence: Synthetic polypeptide
DEESICTTNPVATEAYGSVVVTVNTLQQGNNQMT

SEQ ID NO: 102799 - protein, 35 aa, Artificial Sequence
  Description of Artificial Sequence: Synthetic polypeptide
DEESIRTTNPVATEQYGSVSYIANHSHNTPGNNLR

SEQ ID NO: 102800 - protein, 35 aa, Artificial Sequence
  Description of Artificial Sequence: Synthetic polypeptide
DEESIRTTNPVATEQYGSVSCIANHSHETTGNNLR

SEQ ID NO: 102801 - protein, 34 aa, Artificial Sequence
  Description of Artificial Sequence: Synthetic polypeptide
TSEEIRTTNPMATEHYGSVSCINNNLSQGEGNRE

SEQ ID NO: 102802 - protein, 36 aa, Artificial Sequence
  Description of Artificial Sequence: Synthetic polypeptide
TSEEIRTTNPVATEAYGQSVVAYTNLPQSRGGNQRY

SEQ ID NO: 102803 - protein, 36 aa, Artificial Sequence
  Description of Artificial Sequence: Synthetic polypeptide
TSEEIRTTNPVATEMYGQSVVHCTNLPQSRGGNNRY

SEQ ID NO: 102804 - protein, 30 aa, Artificial Sequence
  Description of Artificial Sequence: Synthetic polypeptide
AEEEIACTNPVATESYGCIAGNNLQDGDND

SEQ ID NO: 102805 - protein, 32 aa, Artificial Sequence
  Description of Artificial Sequence: Synthetic polypeptide
AEEEIACTNPVATEQYGSVSTTAGPNRNGMGV

SEQ ID NO: 102806 - protein, 32 aa, Artificial Sequence
  Description of Artificial Sequence: Synthetic polypeptide
EDEEICTTNPVATEQWGTVSTTQNGQEQGNNE

SEQ ID NO: 102807 - protein, 32 aa, Artificial Sequence
  Description of Artificial Sequence: Synthetic polypeptide
EDEEICTTNPVATEQWGTVSTTNLNNSEQGNE

SEQ ID NO: 102808 - protein, 33 aa, Artificial Sequence
  Description of Artificial Sequence: Synthetic polypeptide
DEESIMTTNPVATECYGSVNTANTLTQEGQFEG

SEQ ID NO: 102809 - protein, 33 aa, Artificial Sequence
  Description of Artificial Sequence: Synthetic polypeptide
EACEIATTNPVATEQYGEVSTNLPGEQGGNGPQ

SEQ ID NO: 102810 - protein, 33 aa, Artificial Sequence
  Description of Artificial Sequence: Synthetic polypeptide
TSEEIRTTNPVAYEQYGSTVSAGNELDEFGNNL

SEQ ID NO: 102811 - protein, 33 aa, Artificial Sequence
  Description of Artificial Sequence: Synthetic polypeptide
TSEEIRTTNPVAYEQYGSVVPFTNNPARGGNKT

SEQ ID NO: 102812 - protein, 32 aa, Artificial Sequence
  Description of Artificial Sequence: Synthetic polypeptide
EDEEICTTNPVATEQWGTVSTNQNLEQGTNEE

SEQ ID NO: 102813 - protein, 32 aa, Artificial Sequence
  Description of Artificial Sequence: Synthetic polypeptide
EDEEICTTNPVATEQWGTVSTNLQGNEQGTED

SEQ ID NO: 102814 - protein, 33 aa, Artificial Sequence
  Description of Artificial Sequence: Synthetic polypeptide
TSEEISTTNPVATTRYGSVVSTNEPSMRTGGNR

SEQ ID NO: 102815 - protein, 31 aa, Artificial Sequence
  Description of Artificial Sequence: Synthetic polypeptide
TSEEISTTNPVAYTQWGSTVSTNPSMAGGNR

SEQ ID NO: 102816 - protein, 32 aa, Artificial Sequence
  Description of Artificial Sequence: Synthetic polypeptide
TSTEIRTTNPVAYEQWGSVSTNLNGEDGNNGA

SEQ ID NO: 102817 - protein, 32 aa, Artificial Sequence
  Description of Artificial Sequence: Synthetic polypeptide
TSTEIRTTNPVAYEQWGSVSTNLNNEDGNNGS

SEQ ID NO: 102818 - protein, 32 aa, Artificial Sequence
  Description of Artificial Sequence: Synthetic polypeptide
EDEEICTTNPVATEQWGTVSTNLNNDEQGNVE

SEQ ID NO: 102819 - protein, 31 aa, Artificial Sequence
  Description of Artificial Sequence: Synthetic polypeptide
TTAEIATTNPVATECYGSVSGGLDREGNNDH

SEQ ID NO: 102820 - protein, 34 aa, Artificial Sequence
  Description of Artificial Sequence: Synthetic polypeptide
DDEEISTTNPVATEQYGCVCSMTGNHQNFGSDNQ

SEQ ID NO: 102821 - protein, 31 aa, Artificial Sequence
  Description of Artificial Sequence: Synthetic polypeptide
EDEEICTTNPVATEQWGTVSTNTNNEQGTNE

SEQ ID NO: 102822 - protein, 32 aa, Artificial Sequence
  Description of Artificial Sequence: Synthetic polypeptide
DEESIATVNPVATEPYGSVANAGNLGEMGGNR

SEQ ID NO: 102823 - protein, 32 aa, Artificial Sequence
  Description of Artificial Sequence: Synthetic polypeptide
TTEEIRTTNPVATEQWGAVVTNNGQEEGGNDG

SEQ ID NO: 102824 - protein, 33 aa, Artificial Sequence
  Description of Artificial Sequence: Synthetic polypeptide
DEVEIRTTNPVATEQYGEMTTTNGQGGGQGNGD

SEQ ID NO: 102825 - protein, 30 aa, Artificial Sequence
  Description of Artificial Sequence: Synthetic polypeptide
VEDEIACTNPVATEQYGCTATNLQGGEDES

SEQ ID NO: 102826 - protein, 34 aa, Artificial Sequence
  Description of Artificial Sequence: Synthetic polypeptide
DTTEIRTTNPVATEQYGSVSTTNTQQQLNGEDEA

SEQ ID NO: 102827 - protein, 30 aa, Artificial Sequence
  Description of Artificial Sequence: Synthetic polypeptide
VEDEIACTNPVATEQYGCTATNLQGNSDGS

SEQ ID NO: 102828 - protein, 30 aa, Artificial Sequence
  Description of Artificial Sequence: Synthetic polypeptide
VEDEIACTNPVATEQYGCTATNLQGNSESD

SEQ ID NO: 102829 - protein, 30 aa, Artificial Sequence
  Description of Artificial Sequence: Synthetic polypeptide
VEDEIACTNPVATEQYGCTATNLQQGGDQL

SEQ ID NO: 102830 - protein, 33 aa, Artificial Sequence
  Description of Artificial Sequence: Synthetic polypeptide
DEESIACTNPVATESYGGCVATNLQDRGDNNQM

SEQ ID NO: 102831 - protein, 32 aa, Artificial Sequence
  Description of Artificial Sequence: Synthetic polypeptide
DEESIACTNPVATESYGGCVATNLQDRGDIDM

SEQ ID NO: 102832 - protein, 33 aa, Artificial Sequence
  Description of Artificial Sequence: Synthetic polypeptide
DEESIACTNPVATESYGCVATNSLQERGGNDMQ

SEQ ID NO: 102833 - protein, 33 aa, Artificial Sequence
  Description of Artificial Sequence: Synthetic polypeptide
DEESIACTNPVATESYGCVATNSLQERAGGNPM

SEQ ID NO: 102834 - protein, 32 aa, Artificial Sequence
  Description of Artificial Sequence: Synthetic polypeptide
DEESIACTNPVATESYGCVATNSLQEAGGNEM

SEQ ID NO: 102835 - protein, 30 aa, Artificial Sequence
  Description of Artificial Sequence: Synthetic polypeptide
VEDEIACTNPVATEQYGCTATNLQGEDNDD

SEQ ID NO: 102836 - protein, 30 aa, Artificial Sequence
  Description of Artificial Sequence: Synthetic polypeptide
VEDEIACTNPVATEQYGCTATNLQVGGDEM

SEQ ID NO: 102837 - protein, 31 aa, Artificial Sequence
  Description of Artificial Sequence: Synthetic polypeptide
VEDEIACTNPVATEQYGCVATNLQAEAAGAD

SEQ ID NO: 102838 - protein, 31 aa, Artificial Sequence
  Description of Artificial Sequence: Synthetic polypeptide
VEDEIACTNPVATEQYGCVATNLQAEADGDS

SEQ ID NO: 102839 - protein, 31 aa, Artificial Sequence
  Description of Artificial Sequence: Synthetic polypeptide
VEDEIACTNPVATEQYGCVATNLQAEEGTTD

SEQ ID NO: 102840 - protein, 31 aa, Artificial Sequence
  Description of Artificial Sequence: Synthetic polypeptide
DEESIACTNPVATESYGCVATNELQDNSMNM

SEQ ID NO: 102841 - protein, 32 aa, Artificial Sequence
  Description of Artificial Sequence: Synthetic polypeptide
DEESIACTNPVATESYGCVAGTNLQATPDDNR

SEQ ID NO: 102842 - protein, 35 aa, Artificial Sequence
  Description of Artificial Sequence: Synthetic polypeptide
DEESIACTNPVATEQYGSVCSTNPLQEDAGEGTNE

SEQ ID NO: 102843 - protein, 31 aa, Artificial Sequence
  Description of Artificial Sequence: Synthetic polypeptide
VEDEIACTNPVATEQYGCVATNLQAEMANMD

SEQ ID NO: 102844 - protein, 31 aa, Artificial Sequence
  Description of Artificial Sequence: Synthetic polypeptide
VEDEIACTNPVATEQYGCVATNLQAENTGMD

SEQ ID NO: 102845 - protein, 31 aa, Artificial Sequence
  Description of Artificial Sequence: Synthetic polypeptide
VEDEIACTNPVATEQYGCVATNLQAEPAGQN

SEQ ID NO: 102846 - protein, 32 aa, Artificial Sequence
  Description of Artificial Sequence: Synthetic polypeptide
VEDEIACTNPVATEQYGCVATNLQAMLGGEGR

SEQ ID NO: 102847 - protein, 31 aa, Artificial Sequence
  Description of Artificial Sequence: Synthetic polypeptide
VEDEIACTNPVATEQYGCVATNLQADNIEHE

SEQ ID NO: 102848 - protein, 34 aa, Artificial Sequence
  Description of Artificial Sequence: Synthetic polypeptide
DEESIATTNPVATEAYGISTVQSCTDALQNVGTR

SEQ ID NO: 102849 - protein, 34 aa, Artificial Sequence
  Description of Artificial Sequence: Synthetic polypeptide
DTTEIRTTNPVATEQYGSVSTTNTQQQLQGEEDE

SEQ ID NO: 102850 - protein, 29 aa, Artificial Sequence
  Description of Artificial Sequence: Synthetic peptide
VEDEIACTNPVATEQYGCSATNLQGEDSL

SEQ ID NO: 102851 - protein, 32 aa, Artificial Sequence
  Description of Artificial Sequence: Synthetic polypeptide
DEESIATTNPVAYERWGSVNRTNDDQRQGNDM

SEQ ID NO: 102852 - protein, 32 aa, Artificial Sequence
  Description of Artificial Sequence: Synthetic polypeptide
TTEEIRTTNPVATEQWGAVVTTNGQEEGGNEG

SEQ ID NO: 102853 - protein, 34 aa, Artificial Sequence
  Description of Artificial Sequence: Synthetic polypeptide
DTTEIRTTNPVATEQYGVVNVTTVNLQAGENNQE

SEQ ID NO: 102854 - protein, 32 aa, Artificial Sequence
  Description of Artificial Sequence: Synthetic polypeptide
DEESIATTNPVAYECWGSVYRTNDDQDRGNDM

SEQ ID NO: 102855 - protein, 32 aa, Artificial Sequence
  Description of Artificial Sequence: Synthetic polypeptide
DEESIATTNPVAYECWGSVYNWTNDHQREGNM

SEQ ID NO: 102856 - protein, 32 aa, Artificial Sequence
  Description of Artificial Sequence: Synthetic polypeptide
DEESIATTNPVAYECWGSVYDWTNDTQRNGNM

SEQ ID NO: 102857 - protein, 32 aa, Artificial Sequence
  Description of Artificial Sequence: Synthetic polypeptide
AEEEIACTNPVATEQYGSASSEPAGQMRGGPR

SEQ ID NO: 102858 - protein, 34 aa, Artificial Sequence
  Description of Artificial Sequence: Synthetic polypeptide
AEEEIACTNPVATEQYGEASSTTPNGPQMRNGNR

SEQ ID NO: 102859 - protein, 31 aa, Artificial Sequence
  Description of Artificial Sequence: Synthetic polypeptide
TTEEIRTTNPVATEQWGVVVTNGQEEGGEED

SEQ ID NO: 102860 - protein, 33 aa, Artificial Sequence
  Description of Artificial Sequence: Synthetic polypeptide
AEEEIACTNPVATEQYGEASSTEPNGQRGMGPR

SEQ ID NO: 102861 - protein, 31 aa, Artificial Sequence
  Description of Artificial Sequence: Synthetic polypeptide
TTEHEIATTNPVAYEQWGSVSTNLNGGGETA

SEQ ID NO: 102862 - protein, 34 aa, Artificial Sequence
  Description of Artificial Sequence: Synthetic polypeptide
DTTEIRTTNPVATEQYGVVNTTNGNLQAGNNNQS

SEQ ID NO: 102863 - protein, 32 aa, Artificial Sequence
  Description of Artificial Sequence: Synthetic polypeptide
TTTEIRTTNPVAYEQWGSVSTNLNGEDGNTGS

SEQ ID NO: 102864 - protein, 34 aa, Artificial Sequence
  Description of Artificial Sequence: Synthetic polypeptide
DEESIATTNPVATEQWGSVAIANNLQEAGHNDRS

SEQ ID NO: 102865 - protein, 33 aa, Artificial Sequence
  Description of Artificial Sequence: Synthetic polypeptide
DEESIATTNPVATEQWGSVAGMNNLQEAGHNNS

SEQ ID NO: 102866 - protein, 32 aa, Artificial Sequence
  Description of Artificial Sequence: Synthetic polypeptide
DEESIATTNPVATEQWGCVAGMNGLQEAGHNV

SEQ ID NO: 102867 - protein, 32 aa, Artificial Sequence
  Description of Artificial Sequence: Synthetic polypeptide
VEAEIGTTNPVATEQYGQSHVHINGLQPHNYD

SEQ ID NO: 102868 - protein, 36 aa, Artificial Sequence
  Description of Artificial Sequence: Synthetic polypeptide
DTTEIRTTNPVATEQYGSVSVTTNLQQLQQGNEEDE

SEQ ID NO: 102869 - protein, 30 aa, Artificial Sequence
  Description of Artificial Sequence: Synthetic polypeptide
VEDEIACTNPVATEQYGCASANLQAPMGQL

SEQ ID NO: 102870 - protein, 30 aa, Artificial Sequence
  Description of Artificial Sequence: Synthetic polypeptide
VEDEIACTNPVATEQYGCASANLQDMPGQN

SEQ ID NO: 102871 - protein, 33 aa, Artificial Sequence
  Description of Artificial Sequence: Synthetic polypeptide
DEESIATTNPVATECYGSVYNWTNDHQEQGDNM

SEQ ID NO: 102872 - protein, 30 aa, Artificial Sequence
  Description of Artificial Sequence: Synthetic polypeptide
VEDEIACTNPVATEQYGCASAPLQAHPGQR

SEQ ID NO: 102873 - protein, 31 aa, Artificial Sequence
  Description of Artificial Sequence: Synthetic polypeptide
VEDEIACTNPVATEQYGCASVANLQEAGGQR

SEQ ID NO: 102874 - protein, 33 aa, Artificial Sequence
  Description of Artificial Sequence: Synthetic polypeptide
TSEEIRTTNPLATEHYGSVSCINMLSQEEGIRE

SEQ ID NO: 102875 - protein, 33 aa, Artificial Sequence
  Description of Artificial Sequence: Synthetic polypeptide
EDEEICTTNPVATEQWGTVSTTTNLNQEQGTNE

SEQ ID NO: 102876 - protein, 33 aa, Artificial Sequence
  Description of Artificial Sequence: Synthetic polypeptide
TSEEIRSTNPVAYEQYGSTVSTNLSQAHNGGQE

SEQ ID NO: 102877 - protein, 30 aa, Artificial Sequence
  Description of Artificial Sequence: Synthetic polypeptide
AEEEIASVNPVCTEQWGVVSGDNLQDSGNQ

SEQ ID NO: 102878 - protein, 35 aa, Artificial Sequence
  Description of Artificial Sequence: Synthetic polypeptide
DEETIRTTNPVATEQWGSVATTNNNLQLQGNNTEE

SEQ ID NO: 102879 - protein, 34 aa, Artificial Sequence
  Description of Artificial Sequence: Synthetic polypeptide
DEVEIRTTNPVATEQYGAVSGGGNIQDEGGQNDL

SEQ ID NO: 102880 - protein, 32 aa, Artificial Sequence
  Description of Artificial Sequence: Synthetic polypeptide
EEEEIATTNPVAYEQWGNVSGGNMQQEGDGNR

SEQ ID NO: 102881 - protein, 35 aa, Artificial Sequence
  Description of Artificial Sequence: Synthetic polypeptide
DEETIRTTNPVATEQWGSVATTNNNLQLGGNNGDT

SEQ ID NO: 102882 - protein, 31 aa, Artificial Sequence
  Description of Artificial Sequence: Synthetic polypeptide
AEEEIASVNPVSTEQYGCVVCSDNLQSKGNQ

SEQ ID NO: 102883 - protein, 32 aa, Artificial Sequence
  Description of Artificial Sequence: Synthetic polypeptide
AEEEIASVNPVSTEQYGCVVCSDNLDQRSGNQ

SEQ ID NO: 102884 - protein, 31 aa, Artificial Sequence
  Description of Artificial Sequence: Synthetic polypeptide
EEEEIATTNPVAYEQWGNVSGGMQDQGGGNR

SEQ ID NO: 102885 - protein, 31 aa, Artificial Sequence
  Description of Artificial Sequence: Synthetic polypeptide
EEEEIATTNPVAYEQWGNVSGGMNQGDGNVR

SEQ ID NO: 102886 - protein, 32 aa, Artificial Sequence
  Description of Artificial Sequence: Synthetic polypeptide
EEEEIATTNPVAYEQWGNVSGGMNEQHGDGNR

SEQ ID NO: 102887 - protein, 31 aa, Artificial Sequence
  Description of Artificial Sequence: Synthetic polypeptide
EEEEIATTNPVAYEQWGNVSGGMMQQGDQNR

SEQ ID NO: 102888 - protein, 35 aa, Artificial Sequence
  Description of Artificial Sequence: Synthetic polypeptide
DEETIRTTNPVATEQWGSVATTNNNLQQGNGNNND

SEQ ID NO: 102889 - protein, 32 aa, Artificial Sequence
  Description of Artificial Sequence: Synthetic polypeptide
TESEIRTTNPVAYECDGQVSPTHPSQRNVGNR

SEQ ID NO: 102890 - protein, 28 aa, Artificial Sequence
  Description of Artificial Sequence: Synthetic peptide
EEEEIATTNPVATEQYGEAPEVCQHEEK

SEQ ID NO: 102891 - protein, 29 aa, Artificial Sequence
  Description of Artificial Sequence: Synthetic peptide
AEEEIASVNPVCTEQYGVVSWELQSGEQS

SEQ ID NO: 102892 - protein, 30 aa, Artificial Sequence
  Description of Artificial Sequence: Synthetic polypeptide
AENEIACTNPVAYEQWGEASENLQRGGGNA

SEQ ID NO: 102893 - protein, 28 aa, Artificial Sequence
  Description of Artificial Sequence: Synthetic peptide
EEEEIATTNPVATEQYGEAPERCQHEEK

SEQ ID NO: 102894 - protein, 32 aa, Artificial Sequence
  Description of Artificial Sequence: Synthetic polypeptide
TESEIRTTNPVAYKAYGSVPSTNELSQRVSQM

SEQ ID NO: 102895 - protein, 34 aa, Artificial Sequence
  Description of Artificial Sequence: Synthetic polypeptide
DEVEIRTTNPVATEQYGAVSVGNGGQGGNDDNDD

SEQ ID NO: 102896 - protein, 33 aa, Artificial Sequence
  Description of Artificial Sequence: Synthetic polypeptide
DEETIRTTNPVATEQWGAVMECVENLQLQVNRP

SEQ ID NO: 102897 - protein, 30 aa, Artificial Sequence
  Description of Artificial Sequence: Synthetic polypeptide
AEEEIASVNPVCTEQYGVVSSNLASFGSNQ

SEQ ID NO: 102898 - protein, 33 aa, Artificial Sequence
  Description of Artificial Sequence: Synthetic polypeptide
DEVEIRTTNPVATEQYGAVVDDTNDQDIGGEQD

SEQ ID NO: 102899 - protein, 28 aa, Artificial Sequence
  Description of Artificial Sequence: Synthetic peptide
EEEEIATTNPVATEQYGEAPEACQHEEK

SEQ ID NO: 102900 - protein, 32 aa, Artificial Sequence
  Description of Artificial Sequence: Synthetic polypeptide
EEEEIATTNPVAYEQWGNVSGGMEDQRGDGNR

SEQ ID NO: 102901 - protein, 31 aa, Artificial Sequence
  Description of Artificial Sequence: Synthetic polypeptide
AEEEIASVNPVSTEQYGCVVCTDNKLQSGNQ

SEQ ID NO: 102902 - protein, 34 aa, Artificial Sequence
  Description of Artificial Sequence: Synthetic polypeptide
TESEIRTTNPVATEQYGSTVSYTNQSDRVAMNDS

SEQ ID NO: 102903 - protein, 34 aa, Artificial Sequence
  Description of Artificial Sequence: Synthetic polypeptide
TESEIRTTNPVATEQYGSTISGTNLSDRVTNNDS

SEQ ID NO: 102904 - protein, 36 aa, Artificial Sequence
  Description of Artificial Sequence: Synthetic polypeptide
DEETIRTTNPVATEQYGSVSALVLSTNLRQGPNNTI

SEQ ID NO: 102905 - protein, 35 aa, Artificial Sequence
  Description of Artificial Sequence: Synthetic polypeptide
EEEEIRTTNPVATEAYGVVSTTNLNGNQNGNTQDE

SEQ ID NO: 102906 - protein, 34 aa, Artificial Sequence
  Description of Artificial Sequence: Synthetic polypeptide
DEVEIRTTNPVATEPWGEVSTGNNLGGTAGENTR

SEQ ID NO: 102907 - protein, 29 aa, Artificial Sequence
  Description of Artificial Sequence: Synthetic peptide
TESEIAPTNPCSYEQYGIVSCNLQSGDTR

SEQ ID NO: 102908 - protein, 34 aa, Artificial Sequence
  Description of Artificial Sequence: Synthetic polypeptide
DEETIRTTNPVATEQYGQYSVVIMNGQGGGGDND

SEQ ID NO: 102909 - protein, 35 aa, Artificial Sequence
  Description of Artificial Sequence: Synthetic polypeptide
EEEEIRTTNPVATEAYGVVSTTNLDGNQNGNDQGE

SEQ ID NO: 102910 - protein, 31 aa, Artificial Sequence
  Description of Artificial Sequence: Synthetic polypeptide
TESEIATTNPVATECYGKVSECLSQHEGENL

SEQ ID NO: 102911 - protein, 32 aa, Artificial Sequence
  Description of Artificial Sequence: Synthetic polypeptide
TESEIATTNPVAYDHYGSVQSTNELSQRVLNM

SEQ ID NO: 102912 - protein, 35 aa, Artificial Sequence
  Description of Artificial Sequence: Synthetic polypeptide
EEEEIRTTNPVATEAYGSTVPSCTGDNGQHEGGNP

SEQ ID NO: 102913 - protein, 33 aa, Artificial Sequence
  Description of Artificial Sequence: Synthetic polypeptide
AEEEIATTNPVATEEYGCIPSINELSQSGGNRL

SEQ ID NO: 102914 - protein, 33 aa, Artificial Sequence
  Description of Artificial Sequence: Synthetic polypeptide
TESEIRCTNPVATEQYGSTVSTNLSDHVTNDDS

SEQ ID NO: 102915 - protein, 33 aa, Artificial Sequence
  Description of Artificial Sequence: Synthetic polypeptide
TESEIRTTNPVATECWGSVSCGNHPQDREGGNG

SEQ ID NO: 102916 - protein, 33 aa, Artificial Sequence
  Description of Artificial Sequence: Synthetic polypeptide
DDEEIRTTNPVGTEQWGCVCSTNLNQYFGSVQS

SEQ ID NO: 102917 - protein, 33 aa, Artificial Sequence
  Description of Artificial Sequence: Synthetic polypeptide
TESEIRTTNPVATECWGSVSCINEMQDREGENG

SEQ ID NO: 102918 - protein, 33 aa, Artificial Sequence
  Description of Artificial Sequence: Synthetic polypeptide
TESEIRTTNPVATECWGSVSCINEPQDREGENG

SEQ ID NO: 102919 - protein, 33 aa, Artificial Sequence
  Description of Artificial Sequence: Synthetic polypeptide
DEVEIRTTNPVATEQWGAVSTNGAGNTQAGDAS

SEQ ID NO: 102920 - protein, 31 aa, Artificial Sequence
  Description of Artificial Sequence: Synthetic polypeptide
AENEIACTNPVAYEQWGEISENLSQRGGGNR

SEQ ID NO: 102921 - protein, 34 aa, Artificial Sequence
  Description of Artificial Sequence: Synthetic polypeptide
DEETIRTTNPVATEQYGAVSTNQVQHFQLSNPCE

SEQ ID NO: 102922 - protein, 35 aa, Artificial Sequence
  Description of Artificial Sequence: Synthetic polypeptide
DEETIRTTNPVATEQWGSVATVNNNNLQLGNNQDE

SEQ ID NO: 102923 - protein, 35 aa, Artificial Sequence
  Description of Artificial Sequence: Synthetic polypeptide
DEETIRTTNPVATEQWGSVATTNNQQLQQGNNTDE

SEQ ID NO: 102924 - protein, 34 aa, Artificial Sequence
  Description of Artificial Sequence: Synthetic polypeptide
DEETIRTTNPVATEQWGSVATTNNNNQLGNNQDT

SEQ ID NO: 102925 - protein, 35 aa, Artificial Sequence
  Description of Artificial Sequence: Synthetic polypeptide
DEETIRTTNPVATEQWGSVATTNNNNLQQGNNEDE

SEQ ID NO: 102926 - protein, 35 aa, Artificial Sequence
  Description of Artificial Sequence: Synthetic polypeptide
DEETIRTTNPVATEQWGSVATTNNNLQQLGGNNNE

SEQ ID NO: 102927 - protein, 30 aa, Artificial Sequence
  Description of Artificial Sequence: Synthetic polypeptide
EEEEIASVNPVSTEQYGVVSVNTQQQGENQ

SEQ ID NO: 102928 - protein, 31 aa, Artificial Sequence
  Description of Artificial Sequence: Synthetic polypeptide
VEDEIACTNPVATEQYGCVATNLQANPNVDQ

SEQ ID NO: 102929 - protein, 31 aa, Artificial Sequence
  Description of Artificial Sequence: Synthetic polypeptide
EEEEIASVNPVSTEQYGCVVCSDHNLQSGNQ

SEQ ID NO: 102930 - protein, 32 aa, Artificial Sequence
  Description of Artificial Sequence: Synthetic polypeptide
TEVEIATTNPVAYDQYGKVPSCTLALSQRGNI

SEQ ID NO: 102931 - protein, 31 aa, Artificial Sequence
  Description of Artificial Sequence: Synthetic polypeptide
TNEGICTTNPVATEQYGSVSTLTNSPELQNP

SEQ ID NO: 102932 - protein, 32 aa, Artificial Sequence
  Description of Artificial Sequence: Synthetic polypeptide
TQEEIATTNPVAYEQYGKVSQNELSQDEGERK

SEQ ID NO: 102933 - protein, 33 aa, Artificial Sequence
  Description of Artificial Sequence: Synthetic polypeptide
TQEEICTTNPVAYEQYGSVICSNLSQYHPGMNR

SEQ ID NO: 102934 - protein, 34 aa, Artificial Sequence
  Description of Artificial Sequence: Synthetic polypeptide
DEETICTTNPVATEQYGQYSVSIGNGQGGGGDND

SEQ ID NO: 102935 - protein, 33 aa, Artificial Sequence
  Description of Artificial Sequence: Synthetic polypeptide
TQEEINTTNPVAYEPYGSVICTNLSQYHPGMNR

SEQ ID NO: 102936 - protein, 32 aa, Artificial Sequence
  Description of Artificial Sequence: Synthetic polypeptide
TQEEIRTTNPCAYEPWGTTVSCTNLSQEGNRH

SEQ ID NO: 102937 - protein, 34 aa, Artificial Sequence
  Description of Artificial Sequence: Synthetic polypeptide
EDEEICTTNPVATEQYGVVSTTNNLQQNDEGDNS

SEQ ID NO: 102938 - protein, 34 aa, Artificial Sequence
  Description of Artificial Sequence: Synthetic polypeptide
EDEEICTTNPVATEQYGVVSTTNNLQQLGGNSDD

SEQ ID NO: 102939 - protein, 34 aa, Artificial Sequence
  Description of Artificial Sequence: Synthetic polypeptide
EDEEICTTNPVATEQYGVVSTTNNLQNDNGDNSD

SEQ ID NO: 102940 - protein, 33 aa, Artificial Sequence
  Description of Artificial Sequence: Synthetic polypeptide
DEETICTTNPVATEFYGSVCTGNTGQGEGGGNI

SEQ ID NO: 102941 - protein, 31 aa, Artificial Sequence
  Description of Artificial Sequence: Synthetic polypeptide
DDEEISTTNPVATCQYGCVSTNPINFGSEQS

SEQ ID NO: 102942 - protein, 33 aa, Artificial Sequence
  Description of Artificial Sequence: Synthetic polypeptide
DEETICTTNPVATECYGSVVNDNTGQRGQNEGT

SEQ ID NO: 102943 - protein, 33 aa, Artificial Sequence
  Description of Artificial Sequence: Synthetic polypeptide
TQEEIRTTNPVAYEQWGTTVSCTRLSQNEGNRQ

SEQ ID NO: 102944 - protein, 34 aa, Artificial Sequence
  Description of Artificial Sequence: Synthetic polypeptide
DEETICTTNPVATECYGSVNTNNMGQDRGGENMD

SEQ ID NO: 102945 - protein, 34 aa, Artificial Sequence
  Description of Artificial Sequence: Synthetic polypeptide
EDEEICTTNPVATEQYGVVSTTNNLNQDQGDNGS

SEQ ID NO: 102946 - protein, 34 aa, Artificial Sequence
  Description of Artificial Sequence: Synthetic polypeptide
DEETICTTNPVATECYGSVINTDNGLGQEGQNGQ

SEQ ID NO: 102947 - protein, 34 aa, Artificial Sequence
  Description of Artificial Sequence: Synthetic polypeptide
DEETICTTNPVATEAYGSVNTTVNNLQQGTNQMT

SEQ ID NO: 102948 - protein, 32 aa, Artificial Sequence
  Description of Artificial Sequence: Synthetic polypeptide
TSEEIATTNPLATEHYGSVSCDNELSFGEGNR

SEQ ID NO: 102949 - protein, 33 aa, Artificial Sequence
  Description of Artificial Sequence: Synthetic polypeptide
TSEEICTTNPVATERYGISTVSTNELSQEVGST

SEQ ID NO: 102950 - protein, 34 aa, Artificial Sequence
  Description of Artificial Sequence: Synthetic polypeptide
DEETEIATTNPVAYEQWGSVSTNLNQGAMGGDDS

SEQ ID NO: 102951 - protein, 34 aa, Artificial Sequence
  Description of Artificial Sequence: Synthetic polypeptide
DEETEIATTNPVAYEQWGSVSTGIGLNAGEDNNR

SEQ ID NO: 102952 - protein, 33 aa, Artificial Sequence
  Description of Artificial Sequence: Synthetic polypeptide
TSEEINTTNPLATEHYGSVSCINMLSQSEGNRE

SEQ ID NO: 102953 - protein, 33 aa, Artificial Sequence
  Description of Artificial Sequence: Synthetic polypeptide
TQEEIRTTNPVAYEQWGTTVSCTNLSQNENNRA

SEQ ID NO: 102954 - protein, 34 aa, Artificial Sequence
  Description of Artificial Sequence: Synthetic polypeptide
EDEEICTTNPVATEQYGVVSTTNQLQNNDQGDNS

SEQ ID NO: 102955 - protein, 30 aa, Artificial Sequence
  Description of Artificial Sequence: Synthetic polypeptide
AEEEIASVNPVCTEQYGCVSDNLQSFGSDQ

SEQ ID NO: 102956 - protein, 32 aa, Artificial Sequence
  Description of Artificial Sequence: Synthetic polypeptide
DDEEISTTNPVATCQYGCVSTGNPTYFGSNQS

SEQ ID NO: 102957 - protein, 30 aa, Artificial Sequence
  Description of Artificial Sequence: Synthetic polypeptide
AEEEIASVNPVCTEQYGVVSLDNKQSGNQE

SEQ ID NO: 102958 - protein, 31 aa, Artificial Sequence
  Description of Artificial Sequence: Synthetic polypeptide
EECEIATTNPVAYEQWGNVSGGMLDQGDGNR

SEQ ID NO: 102959 - protein, 31 aa, Artificial Sequence
  Description of Artificial Sequence: Synthetic polypeptide
DDEEISTTNPQATEHYGCVCSWNLQNFNSNQ

SEQ ID NO: 102960 - protein, 31 aa, Artificial Sequence
  Description of Artificial Sequence: Synthetic polypeptide
DDEEISTTNPVATCGYGCVCSTNPINFGSNQ

SEQ ID NO: 102961 - protein, 30 aa, Artificial Sequence
  Description of Artificial Sequence: Synthetic polypeptide
AEEEIASVNPVCTEQYGVVSDNLQSFSSNQ

SEQ ID NO: 102962 - protein, 32 aa, Artificial Sequence
  Description of Artificial Sequence: Synthetic polypeptide
TGEEIATTNPVAYEQWGSVSHTLDVQERGGTR

SEQ ID NO: 102963 - protein, 31 aa, Artificial Sequence
  Description of Artificial Sequence: Synthetic polypeptide
TGEEIATTNPVAYEQWGSVTHDTQDQRNGTR

SEQ ID NO: 102964 - protein, 30 aa, Artificial Sequence
  Description of Artificial Sequence: Synthetic polypeptide
TGEEIATTNPVAYEQWGSVTHGLDQEDGTR

SEQ ID NO: 102965 - protein, 31 aa, Artificial Sequence
  Description of Artificial Sequence: Synthetic polypeptide
TGEEIATTNPVAYEQWGSVTHTDEDQRGGTR

SEQ ID NO: 102966 - protein, 35 aa, Artificial Sequence
  Description of Artificial Sequence: Synthetic polypeptide
DEETIRATNPVATEQYGSVSTVTNQENQLGNEQGD

SEQ ID NO: 102967 - protein, 32 aa, Artificial Sequence
  Description of Artificial Sequence: Synthetic polypeptide
TGEEIATTNPVAYERWGSVCRTDLDQRGNTER

SEQ ID NO: 102968 - protein, 31 aa, Artificial Sequence
  Description of Artificial Sequence: Synthetic polypeptide
TNEEIATTNPVAYEQWGTVYTNDQGEHGNDR

SEQ ID NO: 102969 - protein, 32 aa, Artificial Sequence
  Description of Artificial Sequence: Synthetic polypeptide
DDEEISTTNPVATCQYGCVCSTNPIRFGSQQN

SEQ ID NO: 102970 - protein, 31 aa, Artificial Sequence
  Description of Artificial Sequence: Synthetic polypeptide
EEAEIRTTNPVAYEQWGSVAKQLEQTNGDGR

SEQ ID NO: 102971 - protein, 35 aa, Artificial Sequence
  Description of Artificial Sequence: Synthetic polypeptide
DEETIRATNPVATEQYGSVSTVNNNEQQSNGNNQL

SEQ ID NO: 102972 - protein, 32 aa, Artificial Sequence
  Description of Artificial Sequence: Synthetic polypeptide
EEAEICTTNPCAYEQYGTVSTNLQGDHGNNTG

SEQ ID NO: 102973 - protein, 31 aa, Artificial Sequence
  Description of Artificial Sequence: Synthetic polypeptide
EEAEIATTNPVAYEQWGNVSTNLQGQDNNQP

SEQ ID NO: 102974 - protein, 35 aa, Artificial Sequence
  Description of Artificial Sequence: Synthetic polypeptide
DEETIRATNPVATEQYGSVSTVNNNEQQNGNNQLN

SEQ ID NO: 102975 - protein, 35 aa, Artificial Sequence
  Description of Artificial Sequence: Synthetic polypeptide
DEETIRATNPVATEQYGSVSTVNNNEQNIGNNQLG

SEQ ID NO: 102976 - protein, 35 aa, Artificial Sequence
  Description of Artificial Sequence: Synthetic polypeptide
DEETIRATNPVATEQYGSVSTVNAQQQQNGNNQGD

SEQ ID NO: 102977 - protein, 33 aa, Artificial Sequence
  Description of Artificial Sequence: Synthetic polypeptide
DDEEISTTNPVATCQYGCVCSTTNPIRFGSNQA

SEQ ID NO: 102978 - protein, 30 aa, Artificial Sequence
  Description of Artificial Sequence: Synthetic polypeptide
AEEEIASVNPVCTEQYGCVVCSENDQSGNQ

SEQ ID NO: 102979 - protein, 33 aa, Artificial Sequence
  Description of Artificial Sequence: Synthetic polypeptide
EDEEICTTNPVATEQYGVVSTTNQLQQNDEDNS

SEQ ID NO: 102980 - protein, 31 aa, Artificial Sequence
  Description of Artificial Sequence: Synthetic polypeptide
TEVEIATTNPVAYDQYGKVPSCTALSQRGPL

SEQ ID NO: 102981 - protein, 32 aa, Artificial Sequence
  Description of Artificial Sequence: Synthetic polypeptide
VEDEIACTNPVATEQYGCVATNLQAPEEGTRA

SEQ ID NO: 102982 - protein, 31 aa, Artificial Sequence
  Description of Artificial Sequence: Synthetic polypeptide
VEDEIACTNPVATEQYGCVATNLQAPEGDGE

SEQ ID NO: 102983 - protein, 29 aa, Artificial Sequence
  Description of Artificial Sequence: Synthetic peptide
DEESIACTNPVATEQYGSVAMHDQNPVDL

SEQ ID NO: 102984 - protein, 36 aa, Artificial Sequence
  Description of Artificial Sequence: Synthetic polypeptide
DEEPIRTTNPVATECYGSTVSCTNMISQSRGGNYEC

SEQ ID NO: 102985 - protein, 34 aa, Artificial Sequence
  Description of Artificial Sequence: Synthetic polypeptide
VEEEIRTTNPVATEQYGDVVTGIQNDGEQTGGNE

SEQ ID NO: 102986 - protein, 33 aa, Artificial Sequence
  Description of Artificial Sequence: Synthetic polypeptide
DDEEVRSTNPVATEQYGSVAANPAGPQSRNGQR

SEQ ID NO: 102987 - protein, 34 aa, Artificial Sequence
  Description of Artificial Sequence: Synthetic polypeptide
VEEEIRTTNPVATEQYGDVVTGIQNDGQEGGGNA

SEQ ID NO: 102988 - protein, 34 aa, Artificial Sequence
  Description of Artificial Sequence: Synthetic polypeptide
VEEEIRTTNPVATEQYGNVSSTGDEDQGEGGNTG

SEQ ID NO: 102989 - protein, 34 aa, Artificial Sequence
  Description of Artificial Sequence: Synthetic polypeptide
DDEEVRTTNPVATEQYGSVSAANPAGPQSRNGQV

SEQ ID NO: 102990 - protein, 34 aa, Artificial Sequence
  Description of Artificial Sequence: Synthetic polypeptide
DEVEIRTTNPVATEQYGSVITVDFGNQEGEGNQS

SEQ ID NO: 102991 - protein, 36 aa, Artificial Sequence
  Description of Artificial Sequence: Synthetic polypeptide
DTEEIRTTNPVATEQYGVVSTVVNLQAGNDEEEETD

SEQ ID NO: 102992 - protein, 36 aa, Artificial Sequence
  Description of Artificial Sequence: Synthetic polypeptide
DTEEIRTTNPVATEQYGVVSTVTNLQSGNNNNTTDD

SEQ ID NO: 102993 - protein, 36 aa, Artificial Sequence
  Description of Artificial Sequence: Synthetic polypeptide
DTEEIRTTNPVATEQYGVVSTVTNLQSGNDTEEEDE

SEQ ID NO: 102994 - protein, 30 aa, Artificial Sequence
  Description of Artificial Sequence: Synthetic polypeptide
DDEEVATTNPVATEGYGNVAANVIQSREQR

SEQ ID NO: 102995 - protein, 33 aa, Artificial Sequence
  Description of Artificial Sequence: Synthetic polypeptide
VEEEIRTTNPVATEQYGSVANTAGQNGGGEDEI

SEQ ID NO: 102996 - protein, 35 aa, Artificial Sequence
  Description of Artificial Sequence: Synthetic polypeptide
VEEEIRTTNPVATEQYGSVCTNLNAGEGEFGENGG

SEQ ID NO: 102997 - protein, 36 aa, Artificial Sequence
  Description of Artificial Sequence: Synthetic polypeptide
DTEEIRTTNPVATEQYGVVSTVTNLQQGNQEEEQDT

SEQ ID NO: 102998 - protein, 32 aa, Artificial Sequence
  Description of Artificial Sequence: Synthetic polypeptide
DEEPIATTNPVAYEQYSEEVTTGNQQDGGNGR

SEQ ID NO: 102999 - protein, 35 aa, Artificial Sequence
  Description of Artificial Sequence: Synthetic polypeptide
VEEEIRTTNPVATEQYGSVDNTDNGGQTNGEGNEG

SEQ ID NO: 103000 - protein, 35 aa, Artificial Sequence
  Description of Artificial Sequence: Synthetic polypeptide
VEEEIRTTNPVATEQYGSVDNTNTVGQVEGEGGNE

SEQ ID NO: 103001 - protein, 35 aa, Artificial Sequence
  Description of Artificial Sequence: Synthetic polypeptide
VEEEIRTTNPVATEQYGSVDNTNVDGQAEGEGGNE

SEQ ID NO: 103002 - protein, 36 aa, Artificial Sequence
  Description of Artificial Sequence: Synthetic polypeptide
DTEEIRTTNPVATEQYGVVSTVTNLQQGNNNQTEDD

SEQ ID NO: 103003 - protein, 34 aa, Artificial Sequence
  Description of Artificial Sequence: Synthetic polypeptide
VEEEIRTTNPVATEQYGSVGDDTTGNDGQGGQGV

SEQ ID NO: 103004 - protein, 34 aa, Artificial Sequence
  Description of Artificial Sequence: Synthetic polypeptide
VEEEIRTTNPVATEQYGSVGNTDNMDTGGIGNED

SEQ ID NO: 103005 - protein, 36 aa, Artificial Sequence
  Description of Artificial Sequence: Synthetic polypeptide
DTEEIRTTNPVATEQYGVVSTVTNLQQGNNNNQQED

SEQ ID NO: 103006 - protein, 34 aa, Artificial Sequence
  Description of Artificial Sequence: Synthetic polypeptide
VEEEIRTTNPVATEQYGSVCSTGVLDTTNVEENA

SEQ ID NO: 103007 - protein, 29 aa, Artificial Sequence
  Description of Artificial Sequence: Synthetic peptide
DDEEVASTNPVSTEGYGVVANNIQSRGQR

SEQ ID NO: 103008 - protein, 33 aa, Artificial Sequence
  Description of Artificial Sequence: Synthetic polypeptide
VEEEIRTTNPVATEQYGDVVTDNGQSEGGGGED

SEQ ID NO: 103009 - protein, 34 aa, Artificial Sequence
  Description of Artificial Sequence: Synthetic polypeptide
DEVEIRTTNPVATEQYGSVITVDFGNQEGEGNIT

SEQ ID NO: 103010 - protein, 35 aa, Artificial Sequence
  Description of Artificial Sequence: Synthetic polypeptide
DEEPIRTTNPVAYEQYRWETVSCTNELSQDGGNNR

SEQ ID NO: 103011 - protein, 34 aa, Artificial Sequence
  Description of Artificial Sequence: Synthetic polypeptide
VEEEIRTTNPVATEFYGSVSADGDNEQRNQGEGQ

SEQ ID NO: 103012 - protein, 33 aa, Artificial Sequence
  Description of Artificial Sequence: Synthetic polypeptide
AEEEIACTNPVATEAYGSVATNLQDQAGGNTEH

SEQ ID NO: 103013 - protein, 32 aa, Artificial Sequence
  Description of Artificial Sequence: Synthetic polypeptide
AEEEIACTNPVATEAYGSVATNLFDNPGDQRN

SEQ ID NO: 103014 - protein, 35 aa, Artificial Sequence
  Description of Artificial Sequence: Synthetic polypeptide
DTEEIRTTNPVATTQYGSVATQSGTNNQLGNQEDT

SEQ ID NO: 103015 - protein, 32 aa, Artificial Sequence
  Description of Artificial Sequence: Synthetic polypeptide
VEEEIRTTNPVATEQYGAVVNGDTGQGNDGND

SEQ ID NO: 103016 - protein, 34 aa, Artificial Sequence
  Description of Artificial Sequence: Synthetic polypeptide
VEEEIRTTNPVATEQYGCVSTDNDGEQGEGGDGE

SEQ ID NO: 103017 - protein, 35 aa, Artificial Sequence
  Description of Artificial Sequence: Synthetic polypeptide
DTEEIRTTNPVATTQYGSVATQSGTNNQAGTNNDT

SEQ ID NO: 103018 - protein, 32 aa, Artificial Sequence
  Description of Artificial Sequence: Synthetic polypeptide
DEEPIRTTNPVAYEQYGQEVSSIMNTQALANP

SEQ ID NO: 103019 - protein, 34 aa, Artificial Sequence
  Description of Artificial Sequence: Synthetic polypeptide
DEEPIRTTNPVAYEAYRWCVSCTNELSQIGGNNR

SEQ ID NO: 103020 - protein, 35 aa, Artificial Sequence
  Description of Artificial Sequence: Synthetic polypeptide
DTEEIRTTNPVATEQYGVVSTVVSNNQQGNEETSE

SEQ ID NO: 103021 - protein, 34 aa, Artificial Sequence
  Description of Artificial Sequence: Synthetic polypeptide
DEEPIRTTNPVATERYGVTVCSWTNDERKGNAQY

SEQ ID NO: 103022 - protein, 36 aa, Artificial Sequence
  Description of Artificial Sequence: Synthetic polypeptide
DTEEIRTTNPVATEQYGVVSTVVNLQQGNQDEEETD

SEQ ID NO: 103023 - protein, 36 aa, Artificial Sequence
  Description of Artificial Sequence: Synthetic polypeptide
DTEEIRTTNPVATEQYGVVSTVVNLQQGNDEEEEDE

SEQ ID NO: 103024 - protein, 36 aa, Artificial Sequence
  Description of Artificial Sequence: Synthetic polypeptide
DTEEIRTTNPVATEQYGVVSTVVNLQAGNTEQGTED

SEQ ID NO: 103025 - protein, 34 aa, Artificial Sequence
  Description of Artificial Sequence: Synthetic polypeptide
DEVEIRTTNPVATEQYGSVITGDGNQDTGGNGEI

SEQ ID NO: 103026 - protein, 34 aa, Artificial Sequence
  Description of Artificial Sequence: Synthetic polypeptide
VEEEIRTTNPVATEQYGDVSDTGNGGQGEGEEQG

SEQ ID NO: 103027 - protein, 34 aa, Artificial Sequence
  Description of Artificial Sequence: Synthetic polypeptide
DEVEIRTTNPVATEQYGSVITVDDGNQEEGGNDS

SEQ ID NO: 103028 - protein, 34 aa, Artificial Sequence
  Description of Artificial Sequence: Synthetic polypeptide
VEEEIRTTNPVATEQYGDVVGSNMNLEQGENNGQ

SEQ ID NO: 103029 - protein, 32 aa, Artificial Sequence
  Description of Artificial Sequence: Synthetic polypeptide
DDEEVASTNPVATEQYGSVAANAGPQSRVGQR

SEQ ID NO: 103030 - protein, 32 aa, Artificial Sequence
  Description of Artificial Sequence: Synthetic polypeptide
DDEEVASTNPVATEQYGSVAANAIPQSRVGQR

SEQ ID NO: 103031 - protein, 36 aa, Artificial Sequence
  Description of Artificial Sequence: Synthetic polypeptide
VEEEIRTTNPVATEQYGDVVGSNMNLEQRGENGGEG

SEQ ID NO: 103032 - protein, 34 aa, Artificial Sequence
  Description of Artificial Sequence: Synthetic polypeptide
DEVEIRTTNPVATEQYGSVITVDEGNQGGGENTS

SEQ ID NO: 103033 - protein, 33 aa, Artificial Sequence
  Description of Artificial Sequence: Synthetic polypeptide
VEEEIRTTNPVATEQYGSVGTTTMDNDGNGGFG

SEQ ID NO: 103034 - protein, 32 aa, Artificial Sequence
  Description of Artificial Sequence: Synthetic polypeptide
VEEEIRTTNPAATEQYGSVPTILAIAGQGDEQ

SEQ ID NO: 103035 - protein, 36 aa, Artificial Sequence
  Description of Artificial Sequence: Synthetic polypeptide
DTEEIRTTNPVATEQYGVVSTVTNLQQGNGNDTNQD

SEQ ID NO: 103036 - protein, 36 aa, Artificial Sequence
  Description of Artificial Sequence: Synthetic polypeptide
DTEEIRTTNPVATEQYGVVSTVTNLQQGNDETNEDT

SEQ ID NO: 103037 - protein, 34 aa, Artificial Sequence
  Description of Artificial Sequence: Synthetic polypeptide
VEEEIRTTNPVATEQYGSVNMSDLEQTGGENGDT

SEQ ID NO: 103038 - protein, 36 aa, Artificial Sequence
  Description of Artificial Sequence: Synthetic polypeptide
DEVEIRTTNPVATEQYGSVNNDTNPLTNAFNGNRTE

SEQ ID NO: 103039 - protein, 36 aa, Artificial Sequence
  Description of Artificial Sequence: Synthetic polypeptide
DTEEIRTTNPVATEQYGVVSTTTNLQAGNTEQGNED

SEQ ID NO: 103040 - protein, 36 aa, Artificial Sequence
  Description of Artificial Sequence: Synthetic polypeptide
DTEEIRTTNPVATEQYGVVSTTTNLQAGNTEAGEDD

SEQ ID NO: 103041 - protein, 30 aa, Artificial Sequence
  Description of Artificial Sequence: Synthetic polypeptide
AENEIACTNPVATEQYWGEAYETLQRGGTR

SEQ ID NO: 103042 - protein, 36 aa, Artificial Sequence
  Description of Artificial Sequence: Synthetic polypeptide
DTEEIRTTNPVATEQYGVVSTTTNLQAGNNQNEEED

SEQ ID NO: 103043 - protein, 35 aa, Artificial Sequence
  Description of Artificial Sequence: Synthetic polypeptide
VEEEIRTTNPVATEQYGSVNSITNNVGQEGGGGGT

SEQ ID NO: 103044 - protein, 34 aa, Artificial Sequence
  Description of Artificial Sequence: Synthetic polypeptide
VEEEIRTTNPVATEQYGSVNSVTMNNIGFGQEGD

SEQ ID NO: 103045 - protein, 36 aa, Artificial Sequence
  Description of Artificial Sequence: Synthetic polypeptide
DTEEIRTTNPVATEQYGVVSTTNLQQGNNNQDEEED

SEQ ID NO: 103046 - protein, 36 aa, Artificial Sequence
  Description of Artificial Sequence: Synthetic polypeptide
DTEEIRTTNPVATEQYGSVSTVVNNQQGNDEEEETD

SEQ ID NO: 103047 - protein, 36 aa, Artificial Sequence
  Description of Artificial Sequence: Synthetic polypeptide
DTEEIRTTNPVATEQYGVVSTTTNLQQGNQEQGTDD

SEQ ID NO: 103048 - protein, 37 aa, Artificial Sequence
  Description of Artificial Sequence: Synthetic polypeptide
DTEEIRTTNPVATEQYGSVSTVVNLQQGNDEEEETNG

SEQ ID NO: 103049 - protein, 34 aa, Artificial Sequence
  Description of Artificial Sequence: Synthetic polypeptide
VEEEIRTTNPVATEQYGSVSDGDMEGQTGGGNGQ

SEQ ID NO: 103050 - protein, 37 aa, Artificial Sequence
  Description of Artificial Sequence: Synthetic polypeptide
DTEEIRTTNPVATEQYGSVSTVVNLQQGNDEEEEEDE

SEQ ID NO: 103051 - protein, 35 aa, Artificial Sequence
  Description of Artificial Sequence: Synthetic polypeptide
VEEEIRTTNPVATEQYGSVSDNDNMDQGGGQENDD

SEQ ID NO: 103052 - protein, 37 aa, Artificial Sequence
  Description of Artificial Sequence: Synthetic polypeptide
DTEEIRTTNPVATEQYGSVSTVVNLQAGNDEEEEENQ

SEQ ID NO: 103053 - protein, 36 aa, Artificial Sequence
  Description of Artificial Sequence: Synthetic polypeptide
DTEEIRTTNPVATEQYGSVSTVVNDQQGNDEEEEEE

SEQ ID NO: 103054 - protein, 37 aa, Artificial Sequence
  Description of Artificial Sequence: Synthetic polypeptide
DTEEIRTTNPVATEQYGSVSTVTNLQQGNQEEEESED

SEQ ID NO: 103055 - protein, 37 aa, Artificial Sequence
  Description of Artificial Sequence: Synthetic polypeptide
DTEEIRTTNPVATEQYGSVSTVTNLQQGNNEEEEEDQ

SEQ ID NO: 103056 - protein, 33 aa, Artificial Sequence
  Description of Artificial Sequence: Synthetic polypeptide
VEEEIRTTNPVATEQYGSVSGGNDEGGEGEETS

SEQ ID NO: 103057 - protein, 34 aa, Artificial Sequence
  Description of Artificial Sequence: Synthetic polypeptide
VEEEIRTTNPVATEQYGSVSGTMESGNEGGNNDD

SEQ ID NO: 103058 - protein, 35 aa, Artificial Sequence
  Description of Artificial Sequence: Synthetic polypeptide
VEEEIRTTNPVATEQYGSVSIANLQVGEDEGQGGN

SEQ ID NO: 103059 - protein, 35 aa, Artificial Sequence
  Description of Artificial Sequence: Synthetic polypeptide
VEEEIRTTNPVATEQYGSVQAPTNLQPIVQPPERR

SEQ ID NO: 103060 - protein, 36 aa, Artificial Sequence
  Description of Artificial Sequence: Synthetic polypeptide
DTEEIRTTNPVATEQYGVVSTVNNLQQQGNNNTNTD

SEQ ID NO: 103061 - protein, 36 aa, Artificial Sequence
  Description of Artificial Sequence: Synthetic polypeptide
DTEEIRTTNPVATEQYGVVSTVTNLQAGNEEQEEDE

SEQ ID NO: 103062 - protein, 36 aa, Artificial Sequence
  Description of Artificial Sequence: Synthetic polypeptide
DTEEIRTTNPVATEQYGVVSTVTNLQAGNNEEEDED

SEQ ID NO: 103063 - protein, 34 aa, Artificial Sequence
  Description of Artificial Sequence: Synthetic polypeptide
VEEEIRTTNPVATEQYGSVISTSNDNSEGGEFTT

SEQ ID NO: 103064 - protein, 31 aa, Artificial Sequence
  Description of Artificial Sequence: Synthetic polypeptide
DEEPIATTNPVATEAMWCEVVATNLQQGNVD

SEQ ID NO: 103065 - protein, 30 aa, Artificial Sequence
  Description of Artificial Sequence: Synthetic polypeptide
DEEPIATTNPVATEAMWCEVVATNDQQGNM

SEQ ID NO: 103066 - protein, 31 aa, Artificial Sequence
  Description of Artificial Sequence: Synthetic polypeptide
DEEPIATTNPVATEAMWCEAVATNLQQGNPV

SEQ ID NO: 103067 - protein, 34 aa, Artificial Sequence
  Description of Artificial Sequence: Synthetic polypeptide
VEEEIRTTNPVATEQYGSVISTSNSNSTGGGETG

SEQ ID NO: 103068 - protein, 36 aa, Artificial Sequence
  Description of Artificial Sequence: Synthetic polypeptide
VEEEIRTTNPVATEQYGSVISTTDTGLGQEQGGGNE

SEQ ID NO: 103069 - protein, 33 aa, Artificial Sequence
  Description of Artificial Sequence: Synthetic polypeptide
DDENIRTTNPVATEQYGAVVITNGQRGQEGEGN

SEQ ID NO: 103070 - protein, 36 aa, Artificial Sequence
  Description of Artificial Sequence: Synthetic polypeptide
DTEEIRTTNPVATEQYGVVSTVTNLQAGNTEQGTTE

SEQ ID NO: 103071 - protein, 35 aa, Artificial Sequence
  Description of Artificial Sequence: Synthetic polypeptide
VEEEIRTTNPVATEQYGSVITTMNMEQGGGGNING

SEQ ID NO: 103072 - protein, 34 aa, Artificial Sequence
  Description of Artificial Sequence: Synthetic polypeptide
VEEEIRTTNPVATEQYGSVIVNPNLTIGSGNVGE

SEQ ID NO: 103073 - protein, 34 aa, Artificial Sequence
  Description of Artificial Sequence: Synthetic polypeptide
VEEEIRTTNPVATEQYGSVNDGGENLQDEGQGGE

SEQ ID NO: 103074 - protein, 33 aa, Artificial Sequence
  Description of Artificial Sequence: Synthetic polypeptide
VEEEIRTTNPVATEQYGSVNDTIDQMGGGEEEQ

SEQ ID NO: 103075 - protein, 36 aa, Artificial Sequence
  Description of Artificial Sequence: Synthetic polypeptide
DTEEIRTTNPVATEQYGVVSTVTNLQAGNNQTEEED

SEQ ID NO: 103076 - protein, 35 aa, Artificial Sequence
  Description of Artificial Sequence: Synthetic polypeptide
DEVEIRTTNPVATEQYGSVIVNSDDQNDQGEGNGT

SEQ ID NO: 103077 - protein, 31 aa, Artificial Sequence
  Description of Artificial Sequence: Synthetic polypeptide
DDETIRTTNPVATDAYGSVSTGGQGGGQGDV

SEQ ID NO: 103078 - protein, 32 aa, Artificial Sequence
  Description of Artificial Sequence: Synthetic polypeptide
DDETIRTTNPVATEFYGSVSTGGQDGEGQGGT

SEQ ID NO: 103079 - protein, 34 aa, Artificial Sequence
  Description of Artificial Sequence: Synthetic polypeptide
VEEEIRTTNPVATEQYGSVNGNGNLGNNEGGNIG

SEQ ID NO: 103080 - protein, 33 aa, Artificial Sequence
  Description of Artificial Sequence: Synthetic polypeptide
VEEEIRTTNPVATEQYGSVNGNNMDNGGGGNNG

SEQ ID NO: 103081 - protein, 35 aa, Artificial Sequence
  Description of Artificial Sequence: Synthetic polypeptide
DEVEIRTTNPVATEQYGSVMGNLFGGNGQTGNGGN

SEQ ID NO: 103082 - protein, 34 aa, Artificial Sequence
  Description of Artificial Sequence: Synthetic polypeptide
VEEEIRTTNPVATEQYGSVNGNTMDQEGGGNGGE

SEQ ID NO: 103083 - protein, 32 aa, Artificial Sequence
  Description of Artificial Sequence: Synthetic polypeptide
DDETIRTTNPVATEQYGAVSSNHQQVRIVQTT

SEQ ID NO: 103084 - protein, 32 aa, Artificial Sequence
  Description of Artificial Sequence: Synthetic polypeptide
DDETIRTTNPVATEQYGAVSSNHQQVRVAQLT

SEQ ID NO: 103085 - protein, 32 aa, Artificial Sequence
  Description of Artificial Sequence: Synthetic polypeptide
DDETIRTTNPVATEQYGAVSSNPHQQVRVDFT

SEQ ID NO: 103086 - protein, 34 aa, Artificial Sequence
  Description of Artificial Sequence: Synthetic polypeptide
VEEEIRTTNPVATEQYGSVINMSDLDQAGENEDD

SEQ ID NO: 103087 - protein, 33 aa, Artificial Sequence
  Description of Artificial Sequence: Synthetic polypeptide
DSSEIRTTNPVATECWGSVSCANEPQDREGENG

SEQ ID NO: 103088 - protein, 34 aa, Artificial Sequence
  Description of Artificial Sequence: Synthetic polypeptide
DEEPIRTTNPVAYEQYRWEVSCTNELSQQGGNNE

SEQ ID NO: 103089 - protein, 32 aa, Artificial Sequence
  Description of Artificial Sequence: Synthetic polypeptide
DEEPIRTTNPVAYGQYGSVFTGMEHQTMGNYK

SEQ ID NO: 103090 - protein, 31 aa, Artificial Sequence
  Description of Artificial Sequence: Synthetic polypeptide
VEDEIATTNPVATEQYGCVAGTMLQHDDNQP

SEQ ID NO: 103091 - protein, 29 aa, Artificial Sequence
  Description of Artificial Sequence: Synthetic peptide
VEDEIATTNPVATEQYGCVATHLAGPDQD

SEQ ID NO: 103092 - protein, 34 aa, Artificial Sequence
  Description of Artificial Sequence: Synthetic polypeptide
VEDEIATTNPVAYEQYGQSVATNDLTQDGMGNRN

SEQ ID NO: 103093 - protein, 31 aa, Artificial Sequence
  Description of Artificial Sequence: Synthetic polypeptide
VEDEIATTNPVAYEQYGSVAAANDQDDGNDH

SEQ ID NO: 103094 - protein, 31 aa, Artificial Sequence
  Description of Artificial Sequence: Synthetic polypeptide
VEDEIATTNPVAYEQYGSVAAANDQPQGNDN

SEQ ID NO: 103095 - protein, 30 aa, Artificial Sequence
  Description of Artificial Sequence: Synthetic polypeptide
VEDEIATTNPVAYEQYGSVAAANDTDSGND

SEQ ID NO: 103096 - protein, 29 aa, Artificial Sequence
  Description of Artificial Sequence: Synthetic peptide
VEDEIATTNPVAYEQYGSVAANNDTDNND

SEQ ID NO: 103097 - protein, 31 aa, Artificial Sequence
  Description of Artificial Sequence: Synthetic polypeptide
VEDEIATTNPVAYEQYGSVAATANDTATGNP

SEQ ID NO: 103098 - protein, 32 aa, Artificial Sequence
  Description of Artificial Sequence: Synthetic polypeptide
DTQEIATTNPVATEQYGSVSATDLEDHEGEDL

SEQ ID NO: 103099 - protein, 34 aa, Artificial Sequence
  Description of Artificial Sequence: Synthetic polypeptide
DEEQIRTTNPVAYEQYGSVASYTHESTRGGNNTE

SEQ ID NO: 103100 - protein, 31 aa, Artificial Sequence
  Description of Artificial Sequence: Synthetic polypeptide
VEDEIATTNPVATEQYGCNATNHQAEGPPRN

SEQ ID NO: 103101 - protein, 33 aa, Artificial Sequence
  Description of Artificial Sequence: Synthetic polypeptide
DEEQIRTTNPVAYEQYGSVASTHESTSPGGNNT

SEQ ID NO: 103102 - protein, 31 aa, Artificial Sequence
  Description of Artificial Sequence: Synthetic polypeptide
VEDEIATTNPVAYEQYGSVAATNDTATGNEN

SEQ ID NO: 103103 - protein, 31 aa, Artificial Sequence
  Description of Artificial Sequence: Synthetic polypeptide
VEDEIATTNPVAYEQYGSVAATNDTATGTNV

SEQ ID NO: 103104 - protein, 32 aa, Artificial Sequence
  Description of Artificial Sequence: Synthetic polypeptide
VEDEIATTNPVAYEQYGSVAATNDTDRGGNDD

SEQ ID NO: 103105 - protein, 32 aa, Artificial Sequence
  Description of Artificial Sequence: Synthetic polypeptide
VEDEIATTNPVAYEQYGSVAIANNLTQDNGND

SEQ ID NO: 103106 - protein, 33 aa, Artificial Sequence
  Description of Artificial Sequence: Synthetic polypeptide
DEEQIRTTNPVAYEAYGSVASTHESTRGGNNTS

SEQ ID NO: 103107 - protein, 35 aa, Artificial Sequence
  Description of Artificial Sequence: Synthetic polypeptide
DEVEIRTTNPVATEQYGSVATNNGADDRAGGNNTN

SEQ ID NO: 103108 - protein, 31 aa, Artificial Sequence
  Description of Artificial Sequence: Synthetic polypeptide
DTENLDTTNPVATEQWGSVTSTLLQGEGTED

SEQ ID NO: 103109 - protein, 33 aa, Artificial Sequence
  Description of Artificial Sequence: Synthetic polypeptide
DEEQIRTTNPVATEQYGCVCSTEENINFGSEQS

SEQ ID NO: 103110 - protein, 32 aa, Artificial Sequence
  Description of Artificial Sequence: Synthetic polypeptide
VEDEIATTNPVAYEQYGSVATNLQDDGPDGAM

SEQ ID NO: 103111 - protein, 28 aa, Artificial Sequence
  Description of Artificial Sequence: Synthetic peptide
AEMEIACTNPCSYEQYGCVSCELQSGDR

SEQ ID NO: 103112 - protein, 31 aa, Artificial Sequence
  Description of Artificial Sequence: Synthetic polypeptide
VEDEIATTNPVAYEQYGSVAATNDTATEGNM

SEQ ID NO: 103113 - protein, 31 aa, Artificial Sequence
  Description of Artificial Sequence: Synthetic polypeptide
DEESIACTNPVATASYGCVATNELQDNSGNH

SEQ ID NO: 103114 - protein, 33 aa, Artificial Sequence
  Description of Artificial Sequence: Synthetic polypeptide
DTSEIRTTNPVATECWGSVSCINEPQDREGENG

SEQ ID NO: 103115 - protein, 31 aa, Artificial Sequence
  Description of Artificial Sequence: Synthetic polypeptide
VEDEIATTNPVATEQYGCIATTNHQAEGPRE

SEQ ID NO: 103116 - protein, 31 aa, Artificial Sequence
  Description of Artificial Sequence: Synthetic polypeptide
VEDEIACTNPVATEQYGCVATNLQDNPTENN

SEQ ID NO: 103117 - protein, 33 aa, Artificial Sequence
  Description of Artificial Sequence: Synthetic polypeptide
DEVEIRTTNPVATEQYGSCSTWNDAAHSGSEHE

SEQ ID NO: 103118 - protein, 32 aa, Artificial Sequence
  Description of Artificial Sequence: Synthetic polypeptide
VEDEIACTNPVATEQYGCVATNLQMPGEEGRM

SEQ ID NO: 103119 - protein, 34 aa, Artificial Sequence
  Description of Artificial Sequence: Synthetic polypeptide
DTTEIRTTNPVATEQYGSVSTTNNQQQLQAEEEA

SEQ ID NO: 103120 - protein, 35 aa, Artificial Sequence
  Description of Artificial Sequence: Synthetic polypeptide
DTTEIRTTNPVATEQYGSVSTTNLQQQLQGEEEAE

SEQ ID NO: 103121 - protein, 31 aa, Artificial Sequence
  Description of Artificial Sequence: Synthetic polypeptide
VEDEIACTNPVATEQYGCVATNLQPMNANDN

SEQ ID NO: 103122 - protein, 32 aa, Artificial Sequence
  Description of Artificial Sequence: Synthetic polypeptide
DEESIACTNPVATEQYGCVAGTNDQDDHGNSL

SEQ ID NO: 103123 - protein, 32 aa, Artificial Sequence
  Description of Artificial Sequence: Synthetic polypeptide
VEDEIACTNPVATEQYGCVATNLQRANAEDNN

SEQ ID NO: 103124 - protein, 31 aa, Artificial Sequence
  Description of Artificial Sequence: Synthetic polypeptide
DEESIACTNPVATEQYGCVAGTNDADGNESL

SEQ ID NO: 103125 - protein, 32 aa, Artificial Sequence
  Description of Artificial Sequence: Synthetic polypeptide
DEESIACTNPVATEQWGSVATNNLENGMGVGR

SEQ ID NO: 103126 - protein, 31 aa, Artificial Sequence
  Description of Artificial Sequence: Synthetic polypeptide
DEESIACTNPVATEQWGSVAMNNLELPGVNV

SEQ ID NO: 103127 - protein, 32 aa, Artificial Sequence
  Description of Artificial Sequence: Synthetic polypeptide
VEDEIACTNPVATEQYGCVATNLQRANANPYN

SEQ ID NO: 103128 - protein, 31 aa, Artificial Sequence
  Description of Artificial Sequence: Synthetic polypeptide
DEESIACTNPVATEPYGVVGTAGLNRGNQMW

SEQ ID NO: 103129 - protein, 35 aa, Artificial Sequence
  Description of Artificial Sequence: Synthetic polypeptide
DTTEIRTTNPVATEQYGSVSTTNLQQLEQGTEEDE

SEQ ID NO: 103130 - protein, 32 aa, Artificial Sequence
  Description of Artificial Sequence: Synthetic polypeptide
VEDEIACTNPVATEQYGSVATNHQAEPPGENA

SEQ ID NO: 103131 - protein, 29 aa, Artificial Sequence
  Description of Artificial Sequence: Synthetic peptide
VEDEIACTNPVATESYGCIAGTNDQRDNF

SEQ ID NO: 103132 - protein, 32 aa, Artificial Sequence
  Description of Artificial Sequence: Synthetic polypeptide
VEDEIACTNPVAYEQYGSVATNLQANPQGENH

SEQ ID NO: 103133 - protein, 33 aa, Artificial Sequence
  Description of Artificial Sequence: Synthetic polypeptide
DTSEIRTTNPVATECWGSVSQINEPQDREGENG

SEQ ID NO: 103134 - protein, 32 aa, Artificial Sequence
  Description of Artificial Sequence: Synthetic polypeptide
VEDEIACTNPVAYEQYGSVATNLQANPVGERP

SEQ ID NO: 103135 - protein, 33 aa, Artificial Sequence
  Description of Artificial Sequence: Synthetic polypeptide
DTSEIRTTNPVATECWGSVSCINEPQDREGENP

SEQ ID NO: 103136 - protein, 32 aa, Artificial Sequence
  Description of Artificial Sequence: Synthetic polypeptide
VEDEIACTNPVAYEQYGSVATNLQRPGDEALH

SEQ ID NO: 103137 - protein, 32 aa, Artificial Sequence
  Description of Artificial Sequence: Synthetic polypeptide
DEESIACTNPVATEIYGCVAGTNLQDAGGDND

SEQ ID NO: 103138 - protein, 33 aa, Artificial Sequence
  Description of Artificial Sequence: Synthetic polypeptide
VEDEIATTNPVATEPYGSVCATNLDTDRGGNDF

SEQ ID NO: 103139 - protein, 28 aa, Artificial Sequence
  Description of Artificial Sequence: Synthetic peptide
AEMEIACTNPCSYEQYGVVSSNLQSGQQ

SEQ ID NO: 103140 - protein, 31 aa, Artificial Sequence
  Description of Artificial Sequence: Synthetic polypeptide
AEEEIACTNPVATEQWGSVASNLQTITNEAH

SEQ ID NO: 103141 - protein, 33 aa, Artificial Sequence
  Description of Artificial Sequence: Synthetic polypeptide
DEEQIRTTNPVATEQYGCVCSTEEAYFGSNNQS

SEQ ID NO: 103142 - protein, 31 aa, Artificial Sequence
  Description of Artificial Sequence: Synthetic polypeptide
AEMEIACTNPVATEQYGEACSAENPQREGND

SEQ ID NO: 103143 - protein, 28 aa, Artificial Sequence
  Description of Artificial Sequence: Synthetic peptide
VEEEIATTNPVATEQYGEAPEVYQHEEK

SEQ ID NO: 103144 - protein, 28 aa, Artificial Sequence
  Description of Artificial Sequence: Synthetic peptide
VEEEIATTNPVATEQYGEFPEVGQHEEK

SEQ ID NO: 103145 - protein, 32 aa, Artificial Sequence
  Description of Artificial Sequence: Synthetic polypeptide
DEEQIATTNPVATEQWGNVATNNLENGMGVGR

SEQ ID NO: 103146 - protein, 34 aa, Artificial Sequence
  Description of Artificial Sequence: Synthetic polypeptide
DTEEIRTTNPVATTQYGSVSTQSGTNQNGNNNDD

SEQ ID NO: 103147 - protein, 32 aa, Artificial Sequence
  Description of Artificial Sequence: Synthetic polypeptide
AEEEIACTNPVATEQYGCVATNLQMAPLNEAE

SEQ ID NO: 103148 - protein, 32 aa, Artificial Sequence
  Description of Artificial Sequence: Synthetic polypeptide
DEEQIACTNPVATEQYGSVSTHGPLGAPIGET

SEQ ID NO: 103149 - protein, 33 aa, Artificial Sequence
  Description of Artificial Sequence: Synthetic polypeptide
DEEQIACTNPVATEQYGSVSTHGPLGAPGGQNE

SEQ ID NO: 103150 - protein, 34 aa, Artificial Sequence
  Description of Artificial Sequence: Synthetic polypeptide
DTEEIRTTNPVATTQYGSVSTQSGTNNNQGNNDE

SEQ ID NO: 103151 - protein, 32 aa, Artificial Sequence
  Description of Artificial Sequence: Synthetic polypeptide
AEEEIACTNPVATEQYGCVATNLQGQEPDNQM

SEQ ID NO: 103152 - protein, 34 aa, Artificial Sequence
  Description of Artificial Sequence: Synthetic polypeptide
DTEEIRTTNPVATTQYGSVSTQSGTNNGNGNNDD

SEQ ID NO: 103153 - protein, 28 aa, Artificial Sequence
  Description of Artificial Sequence: Synthetic peptide
VEEEIATTNPVATEQYGEAPEVCQHEEK

SEQ ID NO: 103154 - protein, 32 aa, Artificial Sequence
  Description of Artificial Sequence: Synthetic polypeptide
DEEQIACTNPVATEQYGSVSTHEPLDNENNTP

SEQ ID NO: 103155 - protein, 32 aa, Artificial Sequence
  Description of Artificial Sequence: Synthetic polypeptide
VEEEIATTNPVATEQYGSVSANNPGNTMPPEE

SEQ ID NO: 103156 - protein, 32 aa, Artificial Sequence
  Description of Artificial Sequence: Synthetic polypeptide
AEEEIACTNPVATEQYGCVATNLQAHPDGEQP

SEQ ID NO: 103157 - protein, 32 aa, Artificial Sequence
  Description of Artificial Sequence: Synthetic polypeptide
AEEEIACTNPVATEQYGCVATNLQAAPSGEAP

SEQ ID NO: 103158 - protein, 31 aa, Artificial Sequence
  Description of Artificial Sequence: Synthetic polypeptide
DEEQIACTNPVATEQYGCVATHGLEAGGNFT

SEQ ID NO: 103159 - protein, 31 aa, Artificial Sequence
  Description of Artificial Sequence: Synthetic polypeptide
AEMEIATTNPVATEQYGTASTDGPVEFEGNR

SEQ ID NO: 103160 - protein, 35 aa, Artificial Sequence
  Description of Artificial Sequence: Synthetic polypeptide
DTEEIRTTNPVATTQYGSVATQSGTNTQTGVNNDT

SEQ ID NO: 103161 - protein, 32 aa, Artificial Sequence
  Description of Artificial Sequence: Synthetic polypeptide
AEEEIACTNPVATEQYGCVATNLQAAPGGEGD

SEQ ID NO: 103162 - protein, 35 aa, Artificial Sequence
  Description of Artificial Sequence: Synthetic polypeptide
DEVEIRTTNPVATEQYGSVIDNSTNTGQGEGQDGN

SEQ ID NO: 103163 - protein, 32 aa, Artificial Sequence
  Description of Artificial Sequence: Synthetic polypeptide
VEEEIGTTNPVATESYGQVSHCHINLQPHNYD

SEQ ID NO: 103164 - protein, 34 aa, Artificial Sequence
  Description of Artificial Sequence: Synthetic polypeptide
DTEEIRTTNPVATTQYGSVATQSGTNQQNENNDT

SEQ ID NO: 103165 - protein, 32 aa, Artificial Sequence
  Description of Artificial Sequence: Synthetic polypeptide
DEEQIACTNPVATEQYGSVSTHEAEAEGGNNT

SEQ ID NO: 103166 - protein, 31 aa, Artificial Sequence
  Description of Artificial Sequence: Synthetic polypeptide
VEEEIATTNPVATEQYGCVAGTGLINMEMRN

SEQ ID NO: 103167 - protein, 33 aa, Artificial Sequence
  Description of Artificial Sequence: Synthetic polypeptide
DEEQIATTNPVATEQWGSVSGTHGLASGEGNTA

SEQ ID NO: 103168 - protein, 33 aa, Artificial Sequence
  Description of Artificial Sequence: Synthetic polypeptide
VEEEIATTNPVATEQYGCVAATAHLQAMDGSRN

SEQ ID NO: 103169 - protein, 36 aa, Artificial Sequence
  Description of Artificial Sequence: Synthetic polypeptide
DEEQIRTTNPVATEPYGSYVCFTTNGQHNRGGNVRV

SEQ ID NO: 103170 - protein, 28 aa, Artificial Sequence
  Description of Artificial Sequence: Synthetic peptide
AEEEIACTNPVATEQYGEASEVCQHEEK

SEQ ID NO: 103171 - protein, 34 aa, Artificial Sequence
  Description of Artificial Sequence: Synthetic polypeptide
DEEQIRTTNPVATEPYGCSVADPEERQRGNNTRN

SEQ ID NO: 103172 - protein, 35 aa, Artificial Sequence
  Description of Artificial Sequence: Synthetic polypeptide
DEEQIRTTNPVATECYGSTVSCTNMESQSRGGSEC

SEQ ID NO: 103173 - protein, 33 aa, Artificial Sequence
  Description of Artificial Sequence: Synthetic polypeptide
VEDEIATTNPVAYEQYGSVCAATNPLAEAGNRF

SEQ ID NO: 103174 - protein, 31 aa, Artificial Sequence
  Description of Artificial Sequence: Synthetic polypeptide
VEDEIRTTNPVATEQYGELCPFNLQETNDSA

SEQ ID NO: 103175 - protein, 35 aa, Artificial Sequence
  Description of Artificial Sequence: Synthetic polypeptide
DEVEIRTTNPVATEQYGSVCTYDHNDERVEGNNQP

SEQ ID NO: 103176 - protein, 34 aa, Artificial Sequence
  Description of Artificial Sequence: Synthetic polypeptide
DEVEIRTTNPVATEQYGSVDTDLEQGNGQGTGEQ

SEQ ID NO: 103177 - protein, 35 aa, Artificial Sequence
  Description of Artificial Sequence: Synthetic polypeptide
DEVEIRTTNPVATEQYGSVDTSVNGQGQGGETNIS

SEQ ID NO: 103178 - protein, 33 aa, Artificial Sequence
  Description of Artificial Sequence: Synthetic polypeptide
DTEEIRYTNPVATEQYGCKVISTNLENIGTQIE

SEQ ID NO: 103179 - protein, 33 aa, Artificial Sequence
  Description of Artificial Sequence: Synthetic polypeptide
DTEEIRYTNPVATEQYGCKVISTDNLENGSTQI

SEQ ID NO: 103180 - protein, 31 aa, Artificial Sequence
  Description of Artificial Sequence: Synthetic polypeptide
VEEEIACTNPVATEQYGCVAGTGLINMMNRD

SEQ ID NO: 103181 - protein, 32 aa, Artificial Sequence
  Description of Artificial Sequence: Synthetic polypeptide
AEEEIACTNPVATEQYGCVATNPQNGQGDNEM

SEQ ID NO: 103182 - protein, 33 aa, Artificial Sequence
  Description of Artificial Sequence: Synthetic polypeptide
VEEEIACTNPVATEQYGSVATNLADAGGDNDQG

SEQ ID NO: 103183 - protein, 29 aa, Artificial Sequence
  Description of Artificial Sequence: Synthetic peptide
AEMEIASTNPCSYEQYGCVSCNLQSFGTR

SEQ ID NO: 103184 - protein, 34 aa, Artificial Sequence
  Description of Artificial Sequence: Synthetic polypeptide
DTEEIRTTNPVAYEPYGVVVSHTANLEQYRGAAE

SEQ ID NO: 103185 - protein, 35 aa, Artificial Sequence
  Description of Artificial Sequence: Synthetic polypeptide
DTEEIRTTNPVATTQYGVVATQSGTNLQAGTNQDE

SEQ ID NO: 103186 - protein, 33 aa, Artificial Sequence
  Description of Artificial Sequence: Synthetic polypeptide
AEEEIACTNPVATEQYGCVATNNLENGMPENDR

SEQ ID NO: 103187 - protein, 34 aa, Artificial Sequence
  Description of Artificial Sequence: Synthetic polypeptide
DTEEIRTTNPVATTQYGSVSTVIGTNQNGNNNDN

SEQ ID NO: 103188 - protein, 32 aa, Artificial Sequence
  Description of Artificial Sequence: Synthetic polypeptide
DEEQIATTNPVAYEQYGSVSTHGPLGAPGGET

SEQ ID NO: 103189 - protein, 31 aa, Artificial Sequence
  Description of Artificial Sequence: Synthetic polypeptide
AEEEIACTNPVATEQYGCVATNLTDPMENVG

SEQ ID NO: 103190 - protein, 33 aa, Artificial Sequence
  Description of Artificial Sequence: Synthetic polypeptide
AEEEIACTNPVATEQYGCVATNLQMRPLNDPVS

SEQ ID NO: 103191 - protein, 34 aa, Artificial Sequence
  Description of Artificial Sequence: Synthetic polypeptide
DTEEIRTTNPVATTQYGSVSTQSGTNQTNGNNET

SEQ ID NO: 103192 - protein, 29 aa, Artificial Sequence
  Description of Artificial Sequence: Synthetic peptide
AENEIACTNPVATEWYGEASSEVRQRGER

SEQ ID NO: 103193 - protein, 31 aa, Artificial Sequence
  Description of Artificial Sequence: Synthetic polypeptide
DSSCICTVNPVAYEQYGSVSTNELSTEGGNH

SEQ ID NO: 103194 - protein, 28 aa, Artificial Sequence
  Description of Artificial Sequence: Synthetic peptide
YEEEIASVNPVCTEQYGEVPENCQSENQ

SEQ ID NO: 103195 - protein, 32 aa, Artificial Sequence
  Description of Artificial Sequence: Synthetic polypeptide
DSQEIATTNPVATEQYGSVSATHLEDHEGEDL

SEQ ID NO: 103196 - protein, 33 aa, Artificial Sequence
  Description of Artificial Sequence: Synthetic polypeptide
DEEEIRTTNPVSTEPYGTVSTEAGQQMQNGNPH

SEQ ID NO: 103197 - protein, 34 aa, Artificial Sequence
  Description of Artificial Sequence: Synthetic polypeptide
DEEEIRTTNPVSTEPYGTVSSTTEAGPNQRNGNV

SEQ ID NO: 103198 - protein, 31 aa, Artificial Sequence
  Description of Artificial Sequence: Synthetic polypeptide
AENEIACTNPVATEQYGEASCENLSQRGGSQ

SEQ ID NO: 103199 - protein, 33 aa, Artificial Sequence
  Description of Artificial Sequence: Synthetic polypeptide
DEEEIRTTNPVSTEPYGTVSMPDIQQQRNGMNV

SEQ ID NO: 103200 - protein, 33 aa, Artificial Sequence
  Description of Artificial Sequence: Synthetic polypeptide
DEEEIRTTNPVSTEPYGTVSMPDIQQMRNGMNV

SEQ ID NO: 103201 - protein, 33 aa, Artificial Sequence
  Description of Artificial Sequence: Synthetic polypeptide
DEEEIRTTNPVSTEPYGTVSMPDGQQMRNGMNV

SEQ ID NO: 103202 - protein, 28 aa, Artificial Sequence
  Description of Artificial Sequence: Synthetic peptide
ADSEIASTNPVSTEGYGNVAETLQRGGR

SEQ ID NO: 103203 - protein, 29 aa, Artificial Sequence
  Description of Artificial Sequence: Synthetic peptide
ADSEIASTNPVATEQYGNVANTIQSRGQR

SEQ ID NO: 103204 - protein, 30 aa, Artificial Sequence
  Description of Artificial Sequence: Synthetic polypeptide
ADSEIACTNPVATEGYGEVSAETLQSRGGR

SEQ ID NO: 103205 - protein, 32 aa, Artificial Sequence
  Description of Artificial Sequence: Synthetic polypeptide
AENEIACTNPVATEQYGEASDEVNLLQRGQGR

SEQ ID NO: 103206 - protein, 31 aa, Artificial Sequence
  Description of Artificial Sequence: Synthetic polypeptide
AEAEIATTNPVAYERWGSVSTTNLGDGNLGQ

SEQ ID NO: 103207 - protein, 31 aa, Artificial Sequence
  Description of Artificial Sequence: Synthetic polypeptide
YEEEIVSTNPVCTEQYGTVSATNPVESEGND

SEQ ID NO: 103208 - protein, 31 aa, Artificial Sequence
  Description of Artificial Sequence: Synthetic polypeptide
YEEEIVSVNPVATEQYGTVCSDDNLVESGNQ

SEQ ID NO: 103209 - protein, 30 aa, Artificial Sequence
  Description of Artificial Sequence: Synthetic polypeptide
AENEIACTNPVATEQYGEASEAGPQRGGPR

SEQ ID NO: 103210 - protein, 31 aa, Artificial Sequence
  Description of Artificial Sequence: Synthetic polypeptide
DEEEIRTTNPVSTEPYGTISMEDIQQQQGNH

SEQ ID NO: 103211 - protein, 29 aa, Artificial Sequence
  Description of Artificial Sequence: Synthetic peptide
ADNEVASTNPVATEQYGNVANNIQRVGGR

SEQ ID NO: 103212 - protein, 29 aa, Artificial Sequence
  Description of Artificial Sequence: Synthetic peptide
ADNEVASTNPVATEQYGEVANNIQRVGGR

SEQ ID NO: 103213 - protein, 31 aa, Artificial Sequence
  Description of Artificial Sequence: Synthetic polypeptide
DEEEIRTTNPVSTEPYGTISMDIQQGQNGIH

SEQ ID NO: 103214 - protein, 30 aa, Artificial Sequence
  Description of Artificial Sequence: Synthetic polypeptide
DEEEIRTTNPVSTEPYGTISEDCQQQQENK

SEQ ID NO: 103215 - protein, 35 aa, Artificial Sequence
  Description of Artificial Sequence: Synthetic polypeptide
DEEEIRTTNPVSTEPYGSVSSTTPDGQQQRNGMNV

SEQ ID NO: 103216 - protein, 34 aa, Artificial Sequence
  Description of Artificial Sequence: Synthetic polypeptide
DEEEIRTTNPVSTEPYGSVSSMPAIPQQRNGNPH

SEQ ID NO: 103217 - protein, 32 aa, Artificial Sequence
  Description of Artificial Sequence: Synthetic polypeptide
DEEEIRTTNPVSTEPYGSISMEDIQQQQNGNH

SEQ ID NO: 103218 - protein, 30 aa, Artificial Sequence
  Description of Artificial Sequence: Synthetic polypeptide
YEEEIVSVNPVATEQYGTVCSADGPQSGND

SEQ ID NO: 103219 - protein, 34 aa, Artificial Sequence
  Description of Artificial Sequence: Synthetic polypeptide
DQEEIRTTNPVATHQYGSVSSNGVTQEGTQNSKN

SEQ ID NO: 103220 - protein, 31 aa, Artificial Sequence
  Description of Artificial Sequence: Synthetic polypeptide
YEEEISTTNPIADENYGEVSVINLQGMGNMP

SEQ ID NO: 103221 - protein, 32 aa, Artificial Sequence
  Description of Artificial Sequence: Synthetic polypeptide
DEEEIRTTNPVSTEQWGSCYTPDNHQNGGKET

SEQ ID NO: 103222 - protein, 35 aa, Artificial Sequence
  Description of Artificial Sequence: Synthetic polypeptide
YEEEIRTTNPVAYEQYGSVVPSCTNSHQEPTEGKR

SEQ ID NO: 103223 - protein, 30 aa, Artificial Sequence
  Description of Artificial Sequence: Synthetic polypeptide
YEEEIRTTNPVCTEQWGVVSDIEQNSAENQ

SEQ ID NO: 103224 - protein, 30 aa, Artificial Sequence
  Description of Artificial Sequence: Synthetic polypeptide
YEEEIRTTNPVCTEQWGVVSENEQNAAEDA

SEQ ID NO: 103225 - protein, 31 aa, Artificial Sequence
  Description of Artificial Sequence: Synthetic polypeptide
AENEIACTNPVATEQYGEASAENLVQREGGD

SEQ ID NO: 103226 - protein, 34 aa, Artificial Sequence
  Description of Artificial Sequence: Synthetic polypeptide
DEEEIRTTNPVSTEQYGIVSSTTNLNMSNGMTPV

SEQ ID NO: 103227 - protein, 34 aa, Artificial Sequence
  Description of Artificial Sequence: Synthetic polypeptide
DEEEIRTTNPVSTEQYGIVSSTTNGNMSNGMNPV

SEQ ID NO: 103228 - protein, 30 aa, Artificial Sequence
  Description of Artificial Sequence: Synthetic polypeptide
DEEEIRTTNPVSTEQYGEAPMEDCQQHENK

SEQ ID NO: 103229 - protein, 33 aa, Artificial Sequence
  Description of Artificial Sequence: Synthetic polypeptide
YEEEIRTTNPVCTEQYGSVSDPNGPNMSNGMNQ

SEQ ID NO: 103230 - protein, 33 aa, Artificial Sequence
  Description of Artificial Sequence: Synthetic polypeptide
DEEEIRTTNPVSTEQYGCVYIIDNLQDGHGQTM

SEQ ID NO: 103231 - protein, 35 aa, Artificial Sequence
  Description of Artificial Sequence: Synthetic polypeptide
YEEEIRTTNPVCTEQYGSVSSTTPALNMRNGMNPV

SEQ ID NO: 103232 - protein, 33 aa, Artificial Sequence
  Description of Artificial Sequence: Synthetic polypeptide
DEEEIRTTNPVSTEQWGSCYTFDNHQNGGRQDT

SEQ ID NO: 103233 - protein, 34 aa, Artificial Sequence
  Description of Artificial Sequence: Synthetic polypeptide
YEEEIRTTNPVGYEQYGESPSTMNLVQNPGMEVR

SEQ ID NO: 103234 - protein, 34 aa, Artificial Sequence
  Description of Artificial Sequence: Synthetic polypeptide
YEEEIRTTNPVLWEQYGSVSITNFPQTSGHNDFD

SEQ ID NO: 103235 - protein, 34 aa, Artificial Sequence
  Description of Artificial Sequence: Synthetic polypeptide
YEEEIRTTNPVSWEQYGSVDITNFEQTSGHNDRL

SEQ ID NO: 103236 - protein, 32 aa, Artificial Sequence
  Description of Artificial Sequence: Synthetic polypeptide
DEEEIRTTNPVSTEQYGCVCGSNTQGFGSQQA

SEQ ID NO: 103237 - protein, 33 aa, Artificial Sequence
  Description of Artificial Sequence: Synthetic polypeptide
YEEEIRTTNPWAHEMYGSPSTDNLVQNPGMEVR

SEQ ID NO: 103238 - protein, 34 aa, Artificial Sequence
  Description of Artificial Sequence: Synthetic polypeptide
YEEEIRTTVNPVATEQYGCVMITMMEVQRYVNDR

SEQ ID NO: 103239 - protein, 33 aa, Artificial Sequence
  Description of Artificial Sequence: Synthetic polypeptide
DEEEIRTTNPVSTEQYGCVCESNLQEGFGSQQS

SEQ ID NO: 103240 - protein, 34 aa, Artificial Sequence
  Description of Artificial Sequence: Synthetic polypeptide
YEEEIRTVNPVATEQYGSVSSTDAGPNMRGMNPV

SEQ ID NO: 103241 - protein, 34 aa, Artificial Sequence
  Description of Artificial Sequence: Synthetic polypeptide
YEEEIRTVNPVATEQYGSVSSTTAGPNMRGMNPV

SEQ ID NO: 103242 - protein, 34 aa, Artificial Sequence
  Description of Artificial Sequence: Synthetic polypeptide
DEEEIRTTNPVSTEQWGSVPTFDNDLQDGMGGKT

SEQ ID NO: 103243 - protein, 34 aa, Artificial Sequence
  Description of Artificial Sequence: Synthetic polypeptide
DEEEIRTTNPVSTEQWGSVPTFDNDLQDGGKQTG

SEQ ID NO: 103244 - protein, 34 aa, Artificial Sequence
  Description of Artificial Sequence: Synthetic polypeptide
YEEEIRTTNPVLWEQYGSVSIANHQQTSGHNDRL

SEQ ID NO: 103245 - protein, 30 aa, Artificial Sequence
  Description of Artificial Sequence: Synthetic polypeptide
YEEEIVTVNPVATEQYGTVCSADGPESGND

SEQ ID NO: 103246 - protein, 33 aa, Artificial Sequence
  Description of Artificial Sequence: Synthetic polypeptide
DEEEIRTTNPVSTEMYGSVSMVNTLQTEVEDLN

SEQ ID NO: 103247 - protein, 30 aa, Artificial Sequence
  Description of Artificial Sequence: Synthetic polypeptide
AENEIACTNPVATEQYGEASEDNPQFEGGR

SEQ ID NO: 103248 - protein, 28 aa, Artificial Sequence
  Description of Artificial Sequence: Synthetic peptide
AENEIACTNPVATEQYGEASENCQHEGK

SEQ ID NO: 103249 - protein, 33 aa, Artificial Sequence
  Description of Artificial Sequence: Synthetic polypeptide
DEEEIRTTNPVGYEAWGSVVSCTGENSARGNND

SEQ ID NO: 103250 - protein, 33 aa, Artificial Sequence
  Description of Artificial Sequence: Synthetic polypeptide
DQEEIRTTNPVATCQYGCVSTEGVQNFGSNNQS

SEQ ID NO: 103251 - protein, 35 aa, Artificial Sequence
  Description of Artificial Sequence: Synthetic polypeptide
DQEEINTTNPVATEQYGSTVATNELSQESNGGNNL

SEQ ID NO: 103252 - protein, 34 aa, Artificial Sequence
  Description of Artificial Sequence: Synthetic polypeptide
DEEEIRTTNPVGTEQYGVVSSTPAGPNMRGMNPV

SEQ ID NO: 103253 - protein, 32 aa, Artificial Sequence
  Description of Artificial Sequence: Synthetic polypeptide
DEEEIRTTNPVGTEQYGVVSSSAGPNRNGMDI

SEQ ID NO: 103254 - protein, 31 aa, Artificial Sequence
  Description of Artificial Sequence: Synthetic polypeptide
DQEEIATTNPVAYMQYGSVAGTGGVQNGNHH

SEQ ID NO: 103255 - protein, 34 aa, Artificial Sequence
  Description of Artificial Sequence: Synthetic polypeptide
DEEEIRTTNPVGTEQYGSVVSTMGLMGEGGQGET

SEQ ID NO: 103256 - protein, 35 aa, Artificial Sequence
  Description of Artificial Sequence: Synthetic polypeptide
DEEEIRTTNPVGTEQYGSVVSCTGYEPSARVGNGD

SEQ ID NO: 103257 - protein, 30 aa, Artificial Sequence
  Description of Artificial Sequence: Synthetic polypeptide
DDSEVASTNPVSTEGYGNVAANNLQSRGNR

SEQ ID NO: 103258 - protein, 28 aa, Artificial Sequence
  Description of Artificial Sequence: Synthetic peptide
AENEIACTNPVATEQYGEASENCQHEEK

SEQ ID NO: 103259 - protein, 33 aa, Artificial Sequence
  Description of Artificial Sequence: Synthetic polypeptide
DQEEIATTNPVATTQWGSVSTTNGDGNLGGNHR

SEQ ID NO: 103260 - protein, 33 aa, Artificial Sequence
  Description of Artificial Sequence: Synthetic polypeptide
DEEEIRTTNPVGTEQYGSVSTMGVMGEGGFGET

SEQ ID NO: 103261 - protein, 28 aa, Artificial Sequence
  Description of Artificial Sequence: Synthetic peptide
YEEPIASVNPVCTEQYGVVADNLQSVNQ

SEQ ID NO: 103262 - protein, 33 aa, Artificial Sequence
  Description of Artificial Sequence: Synthetic polypeptide
DEEEIRTTNPVGTEQYGSVSTMGGTGEGGQGET

SEQ ID NO: 103263 - protein, 32 aa, Artificial Sequence
  Description of Artificial Sequence: Synthetic polypeptide
DQEEIATTNPVATTQWGSVSGGNGDHGNGNHR

SEQ ID NO: 103264 - protein, 32 aa, Artificial Sequence
  Description of Artificial Sequence: Synthetic polypeptide
DQEEIATTNPVATTQWGEVSTENGDHGNGNHR

SEQ ID NO: 103265 - protein, 35 aa, Artificial Sequence
  Description of Artificial Sequence: Synthetic polypeptide
DEEEIRTTNPVGTEQYGSVSTGTQNGLGEGGFDEG

SEQ ID NO: 103266 - protein, 35 aa, Artificial Sequence
  Description of Artificial Sequence: Synthetic polypeptide
DEEEIRTTNPVGTEQYGSVSSTSPAGNMRNGMNPV

SEQ ID NO: 103267 - protein, 35 aa, Artificial Sequence
  Description of Artificial Sequence: Synthetic polypeptide
DEEEIRTTNPVGTEQYGSVSSTPAGPNMRNGMNPV

SEQ ID NO: 103268 - protein, 30 aa, Artificial Sequence
  Description of Artificial Sequence: Synthetic polypeptide
DQEDIACTNPVATEQYGCVATNHQRDSEGS

SEQ ID NO: 103269 - protein, 30 aa, Artificial Sequence
  Description of Artificial Sequence: Synthetic polypeptide
DQEDIACTNPVATEQYGCVATNHQRDSDSL

SEQ ID NO: 103270 - protein, 28 aa, Artificial Sequence
  Description of Artificial Sequence: Synthetic peptide
YEENIASVNPVCTEQYGVVSDNQQSTNQ

SEQ ID NO: 103271 - protein, 33 aa, Artificial Sequence
  Description of Artificial Sequence: Synthetic polypeptide
DEEEIRTTNPVGYEQYGSVVCCDNELGRVGTMP

SEQ ID NO: 103272 - protein, 35 aa, Artificial Sequence
  Description of Artificial Sequence: Synthetic polypeptide
DQEEIRTTNPVATEQYGSVCSPTNLIEDDTEIMGN

SEQ ID NO: 103273 - protein, 33 aa, Artificial Sequence
  Description of Artificial Sequence: Synthetic polypeptide
DEEEIRTTNPVGYEQYGSVVCCDNELGSRVGSM

SEQ ID NO: 103274 - protein, 31 aa, Artificial Sequence
  Description of Artificial Sequence: Synthetic polypeptide
YEEEIVTVNPVATEQYGTVCSDDGLVESGND

SEQ ID NO: 103275 - protein, 31 aa, Artificial Sequence
  Description of Artificial Sequence: Synthetic polypeptide
YEEEIVTVNPVATEQYGTVCSDDGLVESGNQ

SEQ ID NO: 103276 - protein, 31 aa, Artificial Sequence
  Description of Artificial Sequence: Synthetic polypeptide
YEEEIVTVNPVATEQYGTVSDDGPVQSEGND

SEQ ID NO: 103277 - protein, 30 aa, Artificial Sequence
  Description of Artificial Sequence: Synthetic polypeptide
DEEEIRTTNPVSTEIFGTVTFETLQGPGQT

SEQ ID NO: 103278 - protein, 31 aa, Artificial Sequence
  Description of Artificial Sequence: Synthetic polypeptide
DEEEIRTTNPVSTEIFGTVTFENLTQGGQTV

SEQ ID NO: 103279 - protein, 33 aa, Artificial Sequence
  Description of Artificial Sequence: Synthetic polypeptide
DEEEIRTTNPVSTEGYGSVSRYNFLERVTEFEP

SEQ ID NO: 103280 - protein, 33 aa, Artificial Sequence
  Description of Artificial Sequence: Synthetic polypeptide
DEEEIRTTNPVSTEGYGSVSRTPDLERVTFQPM

SEQ ID NO: 103281 - protein, 33 aa, Artificial Sequence
  Description of Artificial Sequence: Synthetic polypeptide
DEEEIRTTNPVSTEGYGSVSRTNFLESVTDQEK

SEQ ID NO: 103282 - protein, 34 aa, Artificial Sequence
  Description of Artificial Sequence: Synthetic polypeptide
DQEEIRTTNPVATHQYGCVCSTENGHQNFGSNNQ

SEQ ID NO: 103283 - protein, 31 aa, Artificial Sequence
  Description of Artificial Sequence: Synthetic polypeptide
AENEIACTNPVATEQYGEASEENLQQQNGGR

SEQ ID NO: 103284 - protein, 33 aa, Artificial Sequence
  Description of Artificial Sequence: Synthetic polypeptide
DQEEIRTTNPVATHGYGSVCSALNGVENGNHRG

SEQ ID NO: 103285 - protein, 30 aa, Artificial Sequence
  Description of Artificial Sequence: Synthetic polypeptide
YEEEVASTNPVSTEQYGNVSADTIQSVGNR

SEQ ID NO: 103286 - protein, 29 aa, Artificial Sequence
  Description of Artificial Sequence: Synthetic peptide
ADNEIASTNPVATEQYGNVANTIQSRGQR

SEQ ID NO: 103287 - protein, 32 aa, Artificial Sequence
  Description of Artificial Sequence: Synthetic polypeptide
DEEEIRTTNPVSTEAYGSVTPFNHLTQTEQQT

SEQ ID NO: 103288 - protein, 32 aa, Artificial Sequence
  Description of Artificial Sequence: Synthetic polypeptide
DEEEIRTTNPVSTEAYGSVTFNLTQTMEHQTA

SEQ ID NO: 103289 - protein, 32 aa, Artificial Sequence
  Description of Artificial Sequence: Synthetic polypeptide
DEEEIRTTNPVSTEAYGSVTFNLLTQTEQLTK

SEQ ID NO: 103290 - protein, 32 aa, Artificial Sequence
  Description of Artificial Sequence: Synthetic polypeptide
DEEEIRTTNPVSTEAYGSVTFNLHSGTVEQTK

SEQ ID NO: 103291 - protein, 32 aa, Artificial Sequence
  Description of Artificial Sequence: Synthetic polypeptide
DEEEIRTTNPVSTEAYGSVTFNLHSGMVQTTK

SEQ ID NO: 103292 - protein, 33 aa, Artificial Sequence
  Description of Artificial Sequence: Synthetic polypeptide
DQEEIRTTNPVATEQYGSVSTSDNTDGPMEDHG

SEQ ID NO: 103293 - protein, 32 aa, Artificial Sequence
  Description of Artificial Sequence: Synthetic polypeptide
DEEEIRTTNPVGYERYGSVVCCDNELGRVGSP

SEQ ID NO: 103294 - protein, 29 aa, Artificial Sequence
  Description of Artificial Sequence: Synthetic peptide
ADNEIASTNPVATEQYGNVAETIQSRGQR

SEQ ID NO: 103295 - protein, 34 aa, Artificial Sequence
  Description of Artificial Sequence: Synthetic polypeptide
DQEEIRTTNPVATEQYGSVCSTVFLENIGVSQQD

SEQ ID NO: 103296 - protein, 34 aa, Artificial Sequence
  Description of Artificial Sequence: Synthetic polypeptide
DEEEIRTTNPVGYEQYGSVVCCTNELGRYVGSPV

SEQ ID NO: 103297 - protein, 34 aa, Artificial Sequence
  Description of Artificial Sequence: Synthetic polypeptide
YEEEIRTTNPVAYEQYGSPSATDSLVQNPGMEVR

SEQ ID NO: 103298 - protein, 34 aa, Artificial Sequence
  Description of Artificial Sequence: Synthetic polypeptide
YEEEIRTTNPVAYEQYGESQSTDTLVQMPGMEVR

SEQ ID NO: 103299 - protein, 35 aa, Artificial Sequence
  Description of Artificial Sequence: Synthetic polypeptide
DEEEIRTTNPVSTEQYGSVSSMPAGPQQRNGMNPH

SEQ ID NO: 103300 - protein, 34 aa, Artificial Sequence
  Description of Artificial Sequence: Synthetic polypeptide
YEEEIRTTNPVAYEQYGESPSTEQLVQNPGMEVR

SEQ ID NO: 103301 - protein, 34 aa, Artificial Sequence
  Description of Artificial Sequence: Synthetic polypeptide
DEYVIATTNPVATEQYGSVSVTDLQEDYLGNEFE

SEQ ID NO: 103302 - protein, 30 aa, Artificial Sequence
  Description of Artificial Sequence: Synthetic polypeptide
DEYVIATTNPVATETVGSVSSDFQQIVGPR

SEQ ID NO: 103303 - protein, 31 aa, Artificial Sequence
  Description of Artificial Sequence: Synthetic polypeptide
YEEEIRSTNPVSTEPYGVVSMEDLQQSNGNH

SEQ ID NO: 103304 - protein, 30 aa, Artificial Sequence
  Description of Artificial Sequence: Synthetic polypeptide
AEDEIACTNPVAYEQWGEASGNLQRGEGDR

SEQ ID NO: 103305 - protein, 34 aa, Artificial Sequence
  Description of Artificial Sequence: Synthetic polypeptide
YEEEIRSVNPVATEQYGSVSSTDAGPQMRGMNPV

SEQ ID NO: 103306 - protein, 33 aa, Artificial Sequence
  Description of Artificial Sequence: Synthetic polypeptide
YEEEIRSVNPVATEQYGSVSSTDAGQMSGMNPV

SEQ ID NO: 103307 - protein, 34 aa, Artificial Sequence
  Description of Artificial Sequence: Synthetic polypeptide
DEEEIRTVNPVATEQYGSVSPALLLVSRNAQGDQ

SEQ ID NO: 103308 - protein, 32 aa, Artificial Sequence
  Description of Artificial Sequence: Synthetic polypeptide
YEEEIRSVNPVATEQYGVVSSDPALNMRGMNV

SEQ ID NO: 103309 - protein, 32 aa, Artificial Sequence
  Description of Artificial Sequence: Synthetic polypeptide
YEEEIRSVNPVATEQYGVVSSTDAGQSGMNPV

SEQ ID NO: 103310 - protein, 32 aa, Artificial Sequence
  Description of Artificial Sequence: Synthetic polypeptide
DEYVIRVTNPVATEQYGAVSTNGQQGQEEPDT

SEQ ID NO: 103311 - protein, 35 aa, Artificial Sequence
  Description of Artificial Sequence: Synthetic polypeptide
DEEEIRTVNPVATEQYGSVSSTPAGPNMRNGMNPV

SEQ ID NO: 103312 - protein, 31 aa, Artificial Sequence
  Description of Artificial Sequence: Synthetic polypeptide
DEYVIRVTNPVATEQYGAVSTNQQFQEMPDQ

SEQ ID NO: 103313 - protein, 33 aa, Artificial Sequence
  Description of Artificial Sequence: Synthetic polypeptide
DFSEIRTTNPVATECWGSVSCINEPQDRWGENG

SEQ ID NO: 103314 - protein, 33 aa, Artificial Sequence
  Description of Artificial Sequence: Synthetic polypeptide
DQSEIRTTNPVATECWGSVSCINEPQDRPGENG

SEQ ID NO: 103315 - protein, 34 aa, Artificial Sequence
  Description of Artificial Sequence: Synthetic polypeptide
DEEEIRTVNPVATEQYGCVCSTELQEYFNSQNQG

SEQ ID NO: 103316 - protein, 33 aa, Artificial Sequence
  Description of Artificial Sequence: Synthetic polypeptide
DQSEIRTTNPVATECWGSVSCINEPQDREGENG

SEQ ID NO: 103317 - protein, 34 aa, Artificial Sequence
  Description of Artificial Sequence: Synthetic polypeptide
DEEEIRTVNPVATEQYGCVCSTEELQYFNSQTQG

SEQ ID NO: 103318 - protein, 33 aa, Artificial Sequence
  Description of Artificial Sequence: Synthetic polypeptide
DEEEIRTVNPVATEQYGCVCSTEDNQHFNSDQS

SEQ ID NO: 103319 - protein, 35 aa, Artificial Sequence
  Description of Artificial Sequence: Synthetic polypeptide
YEEEIRTTNPAATEDQYGCVVYITMNLVQRYVNDR

SEQ ID NO: 103320 - protein, 32 aa, Artificial Sequence
  Description of Artificial Sequence: Synthetic polypeptide
DEEEIRTVNPVATEQYGCVCSSELANFNSQQS

SEQ ID NO: 103321 - protein, 34 aa, Artificial Sequence
  Description of Artificial Sequence: Synthetic polypeptide
DEEEIRTVNPVATEQYGCVCSNTELNQNFNSQQG

SEQ ID NO: 103322 - protein, 34 aa, Artificial Sequence
  Description of Artificial Sequence: Synthetic polypeptide
YEEEIRTTNPCAYEQYGESQSTDNLVQNPGMEVR

SEQ ID NO: 103323 - protein, 33 aa, Artificial Sequence
  Description of Artificial Sequence: Synthetic polypeptide
DFSEIRTTNPVATECWGSVSCINEPQDREGENG

SEQ ID NO: 103324 - protein, 35 aa, Artificial Sequence
  Description of Artificial Sequence: Synthetic polypeptide
DEEEIRTVNPVATEQYGSVSSTPAGPNMSNGMNPV

SEQ ID NO: 103325 - protein, 36 aa, Artificial Sequence
  Description of Artificial Sequence: Synthetic polypeptide
DEEEIRTVNPVATEQYGSVSSTTPALPNMRNGMNPV

SEQ ID NO: 103326 - protein, 33 aa, Artificial Sequence
  Description of Artificial Sequence: Synthetic polypeptide
YEEEIRSTNPVCTEQYGVVSSTPNGPNMRNGNQ

SEQ ID NO: 103327 - protein, 32 aa, Artificial Sequence
  Description of Artificial Sequence: Synthetic polypeptide
DSACIRTTNPVAYEQYGSTVSYFNELSTEGNA

SEQ ID NO: 103328 - protein, 32 aa, Artificial Sequence
  Description of Artificial Sequence: Synthetic polypeptide
DSACIRTTNPVAYEQYGSTVCYFNELSTAGNR

SEQ ID NO: 103329 - protein, 31 aa, Artificial Sequence
  Description of Artificial Sequence: Synthetic polypeptide
DDSEVASTNPVATEGYGNVSATDLQDRVGQR

SEQ ID NO: 103330 - protein, 34 aa, Artificial Sequence
  Description of Artificial Sequence: Synthetic polypeptide
DEEEIRVTNPVAYEQFGSCVQVTTNLDEHQGNNR

SEQ ID NO: 103331 - protein, 31 aa, Artificial Sequence
  Description of Artificial Sequence: Synthetic polypeptide
DDSEVASTNPVATEGYGNVSATDLQSRVGQR

SEQ ID NO: 103332 - protein, 29 aa, Artificial Sequence
  Description of Artificial Sequence: Synthetic peptide
DDSEVASTNPVATEQYGEVAETIQSRGER

SEQ ID NO: 103333 - protein, 30 aa, Artificial Sequence
  Description of Artificial Sequence: Synthetic polypeptide
DQTDIACTNPVATEQYGCVATNHQRSMNAE

SEQ ID NO: 103334 - protein, 31 aa, Artificial Sequence
  Description of Artificial Sequence: Synthetic polypeptide
DEEEIRTVNPVSTEPYGTISMEDLQQQNGNH

SEQ ID NO: 103335 - protein, 29 aa, Artificial Sequence
  Description of Artificial Sequence: Synthetic peptide
DDSEVASTNPVATEQYGEVAETIQSRGQR

SEQ ID NO: 103336 - protein, 30 aa, Artificial Sequence
  Description of Artificial Sequence: Synthetic polypeptide
DQTDIACTNPVATEQYGCVATNHQRDSPNS

SEQ ID NO: 103337 - protein, 35 aa, Artificial Sequence
  Description of Artificial Sequence: Synthetic polypeptide
DEEEIRTVNPVCTEQYGSVSSTDPALPNMRNGNPV

SEQ ID NO: 103338 - protein, 31 aa, Artificial Sequence
  Description of Artificial Sequence: Synthetic polypeptide
DEEEIRTVNPVCTEPYGTISDEDLQQSNGNH

SEQ ID NO: 103339 - protein, 31 aa, Artificial Sequence
  Description of Artificial Sequence: Synthetic polypeptide
DEEEIRTVNPVCTEPYGTISDEDLQQQNGNH

SEQ ID NO: 103340 - protein, 33 aa, Artificial Sequence
  Description of Artificial Sequence: Synthetic polypeptide
YEEEIRSTNPVATEQYGVVSSDPALPNMRGMNV

SEQ ID NO: 103341 - protein, 33 aa, Artificial Sequence
  Description of Artificial Sequence: Synthetic polypeptide
DEYNIRTTNPVATECWGSVSCINEPQDREGENG

SEQ ID NO: 103342 - protein, 33 aa, Artificial Sequence
  Description of Artificial Sequence: Synthetic polypeptide
DEYSIRTTNPVATECWGSVSCINEPQDREGENG

SEQ ID NO: 103343 - protein, 34 aa, Artificial Sequence
  Description of Artificial Sequence: Synthetic polypeptide
YEEEIRSTNPVATEQYGVVSSTTPNGNRNGMNPQ

SEQ ID NO: 103344 - protein, 31 aa, Artificial Sequence
  Description of Artificial Sequence: Synthetic polypeptide
DDSEVASTNPVATEQYGNVAANTIQSRVGNR

SEQ ID NO: 103345 - protein, 32 aa, Artificial Sequence
  Description of Artificial Sequence: Synthetic polypeptide
DDSEVASTNPVATEQYGNVSANTIQSRVGNPR

SEQ ID NO: 103346 - protein, 31 aa, Artificial Sequence
  Description of Artificial Sequence: Synthetic polypeptide
AEDEIACTNPVAYEQWGEASTENLQRPGGDR

SEQ ID NO: 103347 - protein, 31 aa, Artificial Sequence
  Description of Artificial Sequence: Synthetic polypeptide
DDSEVASTNPVATEQYGSVAANTIQSRVGQR

SEQ ID NO: 103348 - protein, 29 aa, Artificial Sequence
  Description of Artificial Sequence: Synthetic peptide
DDSEVASTNPVCTEGYGVVAADNLQSGNR

SEQ ID NO: 103349 - protein, 33 aa, Artificial Sequence
  Description of Artificial Sequence: Synthetic polypeptide
DEEEIRTVNPVATEQYGSVTPTLLLVERNAQDQ

SEQ ID NO: 103350 - protein, 30 aa, Artificial Sequence
  Description of Artificial Sequence: Synthetic polypeptide
AEDEIAATNPVAYEQWGYASENLQRGDGER

SEQ ID NO: 103351 - protein, 32 aa, Artificial Sequence
  Description of Artificial Sequence: Synthetic polypeptide
DQECIRTTNPVAYHPYGSVSCTNEVSDNGNNR

SEQ ID NO: 103352 - protein, 30 aa, Artificial Sequence
  Description of Artificial Sequence: Synthetic polypeptide
AEDEIAATNPVAYEQWGEASIENLQRGGER

SEQ ID NO: 103353 - protein, 34 aa, Artificial Sequence
  Description of Artificial Sequence: Synthetic polypeptide
YEEEIRTTNPMATEDQYGAVVITMNLYQRYVVDR

SEQ ID NO: 103354 - protein, 30 aa, Artificial Sequence
  Description of Artificial Sequence: Synthetic polypeptide
DEEEIRTTNPVSTEQYGTAPMEDIQQHENK

SEQ ID NO: 103355 - protein, 34 aa, Artificial Sequence
  Description of Artificial Sequence: Synthetic polypeptide
YEEEIRTTNPVATEQYGESIMCRPVLNKRGNTRS

SEQ ID NO: 103356 - protein, 31 aa, Artificial Sequence
  Description of Artificial Sequence: Synthetic polypeptide
AENEIACTNPVATEQYGEARSPENLQRGDGE

SEQ ID NO: 103357 - protein, 33 aa, Artificial Sequence
  Description of Artificial Sequence: Synthetic polypeptide
DEEEIRTTNPVSTEQYGSVTPWPNLQQQEMQQE

SEQ ID NO: 103358 - protein, 33 aa, Artificial Sequence
  Description of Artificial Sequence: Synthetic polypeptide
DEEEIRTTNPVSTEQYGSVTPWNNLQQQVMQVN

SEQ ID NO: 103359 - protein, 31 aa, Artificial Sequence
  Description of Artificial Sequence: Synthetic polypeptide
AENEIACTNPVATEQYGEASEPNGPQRGGPR

SEQ ID NO: 103360 - protein, 34 aa, Artificial Sequence
  Description of Artificial Sequence: Synthetic polypeptide
DQEEIRTTNPVAYMQYGSVSTGGVSQQNTVGNNR

SEQ ID NO: 103361 - protein, 35 aa, Artificial Sequence
  Description of Artificial Sequence: Synthetic polypeptide
YEEEIRTTNPVATEQYGHSIVCRPVGLGKRGNTRS

SEQ ID NO: 103362 - protein, 33 aa, Artificial Sequence
  Description of Artificial Sequence: Synthetic polypeptide
DQEEIRTTNPVAYHQYGSVSTGGVSANTVGNNR

SEQ ID NO: 103363 - protein, 34 aa, Artificial Sequence
  Description of Artificial Sequence: Synthetic polypeptide
YEEEIRTTNPVATEQYGSIVCCRPVLNKLGNTRS

SEQ ID NO: 103364 - protein, 32 aa, Artificial Sequence
  Description of Artificial Sequence: Synthetic polypeptide
DEEEIRTTNPVSTEQYGTISMEDIQQQQNGNH

SEQ ID NO: 103365 - protein, 34 aa, Artificial Sequence
  Description of Artificial Sequence: Synthetic polypeptide
YEEEIRTTNPVATEQYGSIVCNVPVLGKRHNTRS

SEQ ID NO: 103366 - protein, 33 aa, Artificial Sequence
  Description of Artificial Sequence: Synthetic polypeptide
DEEEIRTTNPVSTEQYGSVTDNNGQAGEGGQST

SEQ ID NO: 103367 - protein, 35 aa, Artificial Sequence
  Description of Artificial Sequence: Synthetic polypeptide
YEEEIRTTNPVATEQYGSVNTDNMEEEQGGGQNGG

SEQ ID NO: 103368 - protein, 36 aa, Artificial Sequence
  Description of Artificial Sequence: Synthetic polypeptide
YEEEIRTTNPVATEQYGSVSSTDPALPNMRNGMNPV

SEQ ID NO: 103369 - protein, 34 aa, Artificial Sequence
  Description of Artificial Sequence: Synthetic polypeptide
YEEEIRTTNPVATEQYGVSVCQTTDLIHRNGGPH

SEQ ID NO: 103370 - protein, 34 aa, Artificial Sequence
  Description of Artificial Sequence: Synthetic polypeptide
YEEEIRTTNPVAYEQYGESDSTDILVQNPGMEVR

SEQ ID NO: 103371 - protein, 35 aa, Artificial Sequence
  Description of Artificial Sequence: Synthetic polypeptide
DEEEIRTTNPVSTEQYGSVSSTTTGPNSRVGMNPV

SEQ ID NO: 103372 - protein, 35 aa, Artificial Sequence
  Description of Artificial Sequence: Synthetic polypeptide
DEEEIRTTNPVSTEQYGSVSSTTTGPNSRNGMNPV

SEQ ID NO: 103373 - protein, 34 aa, Artificial Sequence
  Description of Artificial Sequence: Synthetic polypeptide
YEEEIRTTNPVAYEQYGESPSTDNLVQNPGMEVG

SEQ ID NO: 103374 - protein, 35 aa, Artificial Sequence
  Description of Artificial Sequence: Synthetic polypeptide
DEEEIRTTNPVSTEQYGSVSSTTEDIPQMQNGMNH

SEQ ID NO: 103375 - protein, 36 aa, Artificial Sequence
  Description of Artificial Sequence: Synthetic polypeptide
DEEEIRTTNPVSTEQYGSVSSTTEAGPNMQNGMNPV

SEQ ID NO: 103376 - protein, 33 aa, Artificial Sequence
  Description of Artificial Sequence: Synthetic polypeptide
DQEEIRTTNPVAYHQYGCVCSTNGHQNFGSDNQ

SEQ ID NO: 103377 - protein, 32 aa, Artificial Sequence
  Description of Artificial Sequence: Synthetic polypeptide
DQQEIATTNPVATEQYGSVSATDLEDHEGEDL

SEQ ID NO: 103378 - protein, 33 aa, Artificial Sequence
  Description of Artificial Sequence: Synthetic polypeptide
DEEEIRTTNPVSTEQYGTISTEDIQQQQNGNPH

SEQ ID NO: 103379 - protein, 33 aa, Artificial Sequence
  Description of Artificial Sequence: Synthetic polypeptide
DEEEIRTTNPVSTEQYGTISTEDIQQQQNGNPV

SEQ ID NO: 103380 - protein, 32 aa, Artificial Sequence
  Description of Artificial Sequence: Synthetic polypeptide
YEEEIRTTNPNAHENYGEVSVINPLQGMGNMP

SEQ ID NO: 103381 - protein, 31 aa, Artificial Sequence
  Description of Artificial Sequence: Synthetic polypeptide
YEEEIRTTNPNATENYGEVSMIPLQGMGPMP

SEQ ID NO: 103382 - protein, 31 aa, Artificial Sequence
  Description of Artificial Sequence: Synthetic polypeptide
YEEEIRTTNPNATQNYGEVSVINLQGMNNMP

SEQ ID NO: 103383 - protein, 31 aa, Artificial Sequence
  Description of Artificial Sequence: Synthetic polypeptide
DEEEIRTTNPVSYEQWGSVTFNLPEGMGQTH

SEQ ID NO: 103384 - protein, 30 aa, Artificial Sequence
  Description of Artificial Sequence: Synthetic polypeptide
AENEIACTNPVATEQYGEASERKLQRDLGR

SEQ ID NO: 103385 - protein, 32 aa, Artificial Sequence
  Description of Artificial Sequence: Synthetic polypeptide
YEEEIRTTNPVAHEQYGSVWTGAHQNAFVSRS

SEQ ID NO: 103386 - protein, 30 aa, Artificial Sequence
  Description of Artificial Sequence: Synthetic polypeptide
AENEIACTNPVATEQYGEAQVEGLQRGPGR

SEQ ID NO: 103387 - protein, 33 aa, Artificial Sequence
  Description of Artificial Sequence: Synthetic polypeptide
DEEEIRTTNPVSTETYGSVSSVNQVQNEEVNLN

SEQ ID NO: 103388 - protein, 33 aa, Artificial Sequence
  Description of Artificial Sequence: Synthetic polypeptide
DEEEIRTTNPVSTETYGSVSMVNTVQNEDVGLN

SEQ ID NO: 103389 - protein, 33 aa, Artificial Sequence
  Description of Artificial Sequence: Synthetic polypeptide
DEEEIRTTNPVSTETYGSVSMVNTVQNEAVNLV

SEQ ID NO: 103390 - protein, 33 aa, Artificial Sequence
  Description of Artificial Sequence: Synthetic polypeptide
YEEEIRTTNPVATEHLGSVESPTNITQVGIEEA

SEQ ID NO: 103391 - protein, 34 aa, Artificial Sequence
  Description of Artificial Sequence: Synthetic polypeptide
DEEEIRTTNPVSTETYGSVSMVNEQTRTGVGSLI

SEQ ID NO: 103392 - protein, 32 aa, Artificial Sequence
  Description of Artificial Sequence: Synthetic polypeptide
DQSEIATTNPVATEQYGSVSATDLEDHEGEDL

SEQ ID NO: 103393 - protein, 34 aa, Artificial Sequence
  Description of Artificial Sequence: Synthetic polypeptide
YEEEIRTTNPVATEQIGEPVVIPTPLYRAGSNRP

SEQ ID NO: 103394 - protein, 34 aa, Artificial Sequence
  Description of Artificial Sequence: Synthetic polypeptide
YEEEIRTTNPVATEQLGSVESPTPNIWQHGIEEA

SEQ ID NO: 103395 - protein, 33 aa, Artificial Sequence
  Description of Artificial Sequence: Synthetic polypeptide
YEEEIRTTNPVATEQWGSNSWNQTINDRGDHPR

SEQ ID NO: 103396 - protein, 34 aa, Artificial Sequence
  Description of Artificial Sequence: Synthetic polypeptide
YEEEIRTTNPVATEQWYGSDDYWCPNLGARGFNV

SEQ ID NO: 103397 - protein, 32 aa, Artificial Sequence
  Description of Artificial Sequence: Synthetic polypeptide
DEEEIRTTNPVSTESWGCVYCMPNQDQRHGNL

SEQ ID NO: 103398 - protein, 34 aa, Artificial Sequence
  Description of Artificial Sequence: Synthetic polypeptide
DEEEIRTTNPVSTEQYGTVSTTEDIQQMQNGMNH

SEQ ID NO: 103399 - protein, 34 aa, Artificial Sequence
  Description of Artificial Sequence: Synthetic polypeptide
DEEEIRTTNPVSTEQYGTVSSTPAGQQMQNGNPV

SEQ ID NO: 103400 - protein, 35 aa, Artificial Sequence
  Description of Artificial Sequence: Synthetic polypeptide
DEEEIRTTNPVSTEQYGTVSSTPAGQNMRNGMNPV

SEQ ID NO: 103401 - protein, 31 aa, Artificial Sequence
  Description of Artificial Sequence: Synthetic polypeptide
DQQEIATTNPVAYMQYGSVSTNGVGNGQNHN

SEQ ID NO: 103402 - protein, 32 aa, Artificial Sequence
  Description of Artificial Sequence: Synthetic polypeptide
DQQEIATTNPVATEQYGSVSATDLEDHEGEDM

SEQ ID NO: 103403 - protein, 32 aa, Artificial Sequence
  Description of Artificial Sequence: Synthetic polypeptide
DEEEIRTTNPVSYEQYGSTVPCQNSSQGGGQT

SEQ ID NO: 103404 - protein, 35 aa, Artificial Sequence
  Description of Artificial Sequence: Synthetic polypeptide
DEEEIRTTNPVGTEQYGSVSGQTNGLGPEGGFDED

SEQ ID NO: 103405 - protein, 32 aa, Artificial Sequence
  Description of Artificial Sequence: Synthetic polypeptide
DQAEISTTNPVATEQYGCCCSTPLQHFGSNQS

SEQ ID NO: 103406 - protein, 33 aa, Artificial Sequence
  Description of Artificial Sequence: Synthetic polypeptide
YEETICTTNPVATEQYGSVSIMNGGGQGGGNGS

SEQ ID NO: 103407 - protein, 33 aa, Artificial Sequence
  Description of Artificial Sequence: Synthetic polypeptide
DLSEIRTTNPVATEPWGSVSCINEPQDREGENG

SEQ ID NO: 103408 - protein, 34 aa, Artificial Sequence
  Description of Artificial Sequence: Synthetic polypeptide
DNEEIRTTNPVATEQYGSVSTASGMDGIGENNQV

SEQ ID NO: 103409 - protein, 36 aa, Artificial Sequence
  Description of Artificial Sequence: Synthetic polypeptide
DNEEIRTTNPVATEQYGSVSSTTPNGPNMRNGMNPV

SEQ ID NO: 103410 - protein, 30 aa, Artificial Sequence
  Description of Artificial Sequence: Synthetic polypeptide
YESEIASVNPVCTEQYGVVSDNLQSSVGNQ

SEQ ID NO: 103411 - protein, 34 aa, Artificial Sequence
  Description of Artificial Sequence: Synthetic polypeptide
DNEEIRTTNPVATEQYGSVNSTNDDENSGQEEDS

SEQ ID NO: 103412 - protein, 28 aa, Artificial Sequence
  Description of Artificial Sequence: Synthetic peptide
YESEIASVNPVGTEGYGVVASNLQSGNI

SEQ ID NO: 103413 - protein, 37 aa, Artificial Sequence
  Description of Artificial Sequence: Synthetic polypeptide
DEEEIRTTNPVAYEQYGSVVASCTLNSLSHANGDNER

SEQ ID NO: 103414 - protein, 35 aa, Artificial Sequence
  Description of Artificial Sequence: Synthetic polypeptide
DEEEIRTTNPVAYEQYGSVVACTNAISQNKGSPRS

SEQ ID NO: 103415 - protein, 28 aa, Artificial Sequence
  Description of Artificial Sequence: Synthetic peptide
YESEIASVNPVGTEQYGVVSDTLQHGDQ

SEQ ID NO: 103416 - protein, 28 aa, Artificial Sequence
  Description of Artificial Sequence: Synthetic peptide
YESEIASVNPVGTEQYGVVSDTLQSGDQ

SEQ ID NO: 103417 - protein, 33 aa, Artificial Sequence
  Description of Artificial Sequence: Synthetic polypeptide
DEEEIRTTNPVAYEQYGSVWNTNIMQVFDSIPE

SEQ ID NO: 103418 - protein, 36 aa, Artificial Sequence
  Description of Artificial Sequence: Synthetic polypeptide
DEEEIRTTNPVAYEQYGSVQSCTLNALSHANGDGER

SEQ ID NO: 103419 - protein, 34 aa, Artificial Sequence
  Description of Artificial Sequence: Synthetic polypeptide
DNEEIRTTNPVATEQYGSLWSTPNENQMTDNEQD

SEQ ID NO: 103420 - protein, 28 aa, Artificial Sequence
  Description of Artificial Sequence: Synthetic peptide
YESEIASVNPVSTEGYGVVSDNIQSGNQ

SEQ ID NO: 103421 - protein, 32 aa, Artificial Sequence
  Description of Artificial Sequence: Synthetic polypeptide
DNEEIRTTNPVATEQYGSCSTPQQAIMPDVQQ

SEQ ID NO: 103422 - protein, 36 aa, Artificial Sequence
  Description of Artificial Sequence: Synthetic polypeptide
DEEEIRTTNPVAYEQYGSVPSCTPAGPNLRNGGNPV

SEQ ID NO: 103423 - protein, 35 aa, Artificial Sequence
  Description of Artificial Sequence: Synthetic polypeptide
DEEEIRTTNPVAYEQYGSVPSCTDVMLPPSGTNND

SEQ ID NO: 103424 - protein, 36 aa, Artificial Sequence
  Description of Artificial Sequence: Synthetic polypeptide
DEEEIRTTNPVAYEQYGSVPSCTDNMLRPTSGTNNE

SEQ ID NO: 103425 - protein, 36 aa, Artificial Sequence
  Description of Artificial Sequence: Synthetic polypeptide
DEEEIRTTNPVAYEQYGSVPSCTDNMLEPSGTNNDK

SEQ ID NO: 103426 - protein, 28 aa, Artificial Sequence
  Description of Artificial Sequence: Synthetic peptide
YESEIASVNPVSTEGYGVVSNNIQSGNQ

SEQ ID NO: 103427 - protein, 35 aa, Artificial Sequence
  Description of Artificial Sequence: Synthetic polypeptide
DEEEIRTTNPVAYEQYGSVPNCTDNMLNVSGGNND

SEQ ID NO: 103428 - protein, 33 aa, Artificial Sequence
  Description of Artificial Sequence: Synthetic polypeptide
YESEIRTTNPVATECWGSVSCINEPQDREGENG

SEQ ID NO: 103429 - protein, 36 aa, Artificial Sequence
  Description of Artificial Sequence: Synthetic polypeptide
DEEEIRTTNPVAYEQYGSVQSCELNSLSHANGGNTR

SEQ ID NO: 103430 - protein, 33 aa, Artificial Sequence
  Description of Artificial Sequence: Synthetic polypeptide
DEEEIRTTNPVAYEQYGSVWSNLMQWVFDSQGE

SEQ ID NO: 103431 - protein, 33 aa, Artificial Sequence
  Description of Artificial Sequence: Synthetic polypeptide
DLSEIRTTNPVATECWGSVSCINEPQDREGENG

SEQ ID NO: 103432 - protein, 29 aa, Artificial Sequence
  Description of Artificial Sequence: Synthetic peptide
YESEIASVNPVCTEQYGVVANNLQSVGNQ

SEQ ID NO: 103433 - protein, 32 aa, Artificial Sequence
  Description of Artificial Sequence: Synthetic polypeptide
DNQEIATTNPVATEQYGSVSATDLEDHEGEDL

SEQ ID NO: 103434 - protein, 32 aa, Artificial Sequence
  Description of Artificial Sequence: Synthetic polypeptide
YEQEIATTNPVATEQYGSVSATDLEDHSGEDL

SEQ ID NO: 103435 - protein, 34 aa, Artificial Sequence
  Description of Artificial Sequence: Synthetic polypeptide
DEEEIRTTNPVAYERWGCVPSCTFNGSQYEGNNR

SEQ ID NO: 103436 - protein, 33 aa, Artificial Sequence
  Description of Artificial Sequence: Synthetic polypeptide
DISEIRTTNPVATECWGSVSCINEPQDREGENG

SEQ ID NO: 103437 - protein, 33 aa, Artificial Sequence
  Description of Artificial Sequence: Synthetic polypeptide
DNEEISTTNPVATTQYGSVSVSNPEVVRTGNFG

SEQ ID NO: 103438 - protein, 33 aa, Artificial Sequence
  Description of Artificial Sequence: Synthetic polypeptide
DISEIRTTNPVATECWGSVSCINEPQDRYGENG

SEQ ID NO: 103439 - protein, 32 aa, Artificial Sequence
  Description of Artificial Sequence: Synthetic polypeptide
DITEIATTNPVATEQYGSVSATDLEDHEGEDL

SEQ ID NO: 103440 - protein, 28 aa, Artificial Sequence
  Description of Artificial Sequence: Synthetic peptide
YESEIASTNPVCTEGYGVVSDTLQHGDQ

SEQ ID NO: 103441 - protein, 30 aa, Artificial Sequence
  Description of Artificial Sequence: Synthetic polypeptide
YESEIASTNPVCTEQWGVVSDNLQDSGENQ

SEQ ID NO: 103442 - protein, 28 aa, Artificial Sequence
  Description of Artificial Sequence: Synthetic peptide
YESEIASTNPVCTEQYGVMSSTLQSGDQ

SEQ ID NO: 103443 - protein, 30 aa, Artificial Sequence
  Description of Artificial Sequence: Synthetic polypeptide
YESEIASTNPVCTEQYGVVADNIQSRVGQR

SEQ ID NO: 103444 - protein, 28 aa, Artificial Sequence
  Description of Artificial Sequence: Synthetic peptide
YESEIASTNPVGTEGYGVVSDTLQHGDI

SEQ ID NO: 103445 - protein, 30 aa, Artificial Sequence
  Description of Artificial Sequence: Synthetic polypeptide
DDSEVASTNPVSTEGYGNVAANTLQSRGNR

SEQ ID NO: 103446 - protein, 28 aa, Artificial Sequence
  Description of Artificial Sequence: Synthetic peptide
YESEIASTNPVGTEGYGVVSDTLQHGDQ

SEQ ID NO: 103447 - protein, 28 aa, Artificial Sequence
  Description of Artificial Sequence: Synthetic peptide
YESEIASTNPVGTEQYGVMADNLQHGDQ

SEQ ID NO: 103448 - protein, 35 aa, Artificial Sequence
  Description of Artificial Sequence: Synthetic polypeptide
DEEEIRTTNPVAYEQYGTTISCTINSLSQRTEENN

SEQ ID NO: 103449 - protein, 34 aa, Artificial Sequence
  Description of Artificial Sequence: Synthetic polypeptide
DNEEIRTTNPVATEQYGSVYTVYNMETTGNDMTE

SEQ ID NO: 103450 - protein, 28 aa, Artificial Sequence
  Description of Artificial Sequence: Synthetic peptide
YESEIASVNPVCTEGYGVVADNLQSGNQ

SEQ ID NO: 103451 - protein, 32 aa, Artificial Sequence
  Description of Artificial Sequence: Synthetic polypeptide
DLQEIATTNPVATEQYGSVSATDLEAHEGEDL

SEQ ID NO: 103452 - protein, 32 aa, Artificial Sequence
  Description of Artificial Sequence: Synthetic polypeptide
DLQEIATTNPVATEQYGSVSATDLEDHEGEDL

SEQ ID NO: 103453 - protein, 32 aa, Artificial Sequence
  Description of Artificial Sequence: Synthetic polypeptide
DLQEIATTNPVATEQYGSVSMTDLEDHEGEDL

SEQ ID NO: 103454 - protein, 33 aa, Artificial Sequence
  Description of Artificial Sequence: Synthetic polypeptide
DEEEIRTTNPVAYEQYGSVWTTNLTPVFDVSGD

SEQ ID NO: 103455 - protein, 29 aa, Artificial Sequence
  Description of Artificial Sequence: Synthetic peptide
YESEIASVNPVCTEQYGVVANNLQRVGQQ

SEQ ID NO: 103456 - protein, 32 aa, Artificial Sequence
  Description of Artificial Sequence: Synthetic polypeptide
DNEEIATTNPVAATQYGSVSTNNGPMLINDRY

SEQ ID NO: 103457 - protein, 32 aa, Artificial Sequence
  Description of Artificial Sequence: Synthetic polypeptide
DNQEIATTNPVATEQYGSVSATDLEDHEGEWL

SEQ ID NO: 103458 - protein, 32 aa, Artificial Sequence
  Description of Artificial Sequence: Synthetic polypeptide
YESEIRTTNPVATECWGVVSCINEPQDREGNG

SEQ ID NO: 103459 - protein, 33 aa, Artificial Sequence
  Description of Artificial Sequence: Synthetic polypeptide
DEEEIRTTNPVAYEQYGSVHCTLLGPQTFEKQF

SEQ ID NO: 103460 - protein, 32 aa, Artificial Sequence
  Description of Artificial Sequence: Synthetic polypeptide
DMQEIATTNPVATEQYGSVSATDLEMHEGEDL

SEQ ID NO: 103461 - protein, 32 aa, Artificial Sequence
  Description of Artificial Sequence: Synthetic polypeptide
DMQEIATTNPVATEQYGSVSATDLEDHEGELL

SEQ ID NO: 103462 - protein, 29 aa, Artificial Sequence
  Description of Artificial Sequence: Synthetic peptide
YETEIATTNPICTECYGAVADNLQSKGNQ

SEQ ID NO: 103463 - protein, 33 aa, Artificial Sequence
  Description of Artificial Sequence: Synthetic polypeptide
DEEEIRTTNPVAYEQYGSTVPYTFETSGRGSYS

SEQ ID NO: 103464 - protein, 30 aa, Artificial Sequence
  Description of Artificial Sequence: Synthetic polypeptide
YETEIATTNPICTEQYGVVSNDNLQESGPQ

SEQ ID NO: 103465 - protein, 32 aa, Artificial Sequence
  Description of Artificial Sequence: Synthetic polypeptide
DMQEIATTNPVATEQYGSVSATDLEDHEGEDL

SEQ ID NO: 103466 - protein, 32 aa, Artificial Sequence
  Description of Artificial Sequence: Synthetic polypeptide
DMEEISSTNPVATEQYGCSCSTEHQNFGSNQA

SEQ ID NO: 103467 - protein, 35 aa, Artificial Sequence
  Description of Artificial Sequence: Synthetic polypeptide
DMEEIRTTNPVATEQYGSVSVTNDNTDEELQFNVE

SEQ ID NO: 103468 - protein, 31 aa, Artificial Sequence
  Description of Artificial Sequence: Synthetic polypeptide
YEVEIRTTNPNATENYGEVSVIALQGMGNMP

SEQ ID NO: 103469 - protein, 33 aa, Artificial Sequence
  Description of Artificial Sequence: Synthetic polypeptide
ADAEIRTTNPVATEQYGCVCSTNDLQSFGSDQA

SEQ ID NO: 103470 - protein, 32 aa, Artificial Sequence
  Description of Artificial Sequence: Synthetic polypeptide
DMQEIATTNPVATEQYGSVSATDLEVHEGEDL

SEQ ID NO: 103471 - protein, 33 aa, Artificial Sequence
  Description of Artificial Sequence: Synthetic polypeptide
DMEEIRTTNPVATEQYGSVSSVPDLNPGDEDGN

SEQ ID NO: 103472 - protein, 35 aa, Artificial Sequence
  Description of Artificial Sequence: Synthetic polypeptide
YEYEIRTTNPVATEQYGESVCSTTDDLQCRNGGPH

SEQ ID NO: 103473 - protein, 34 aa, Artificial Sequence
  Description of Artificial Sequence: Synthetic polypeptide
DMEEIRTTNPVATEQYGSVCSTIMLTEEGDEEHI

SEQ ID NO: 103474 - protein, 28 aa, Artificial Sequence
  Description of Artificial Sequence: Synthetic peptide
YNGEIAPTNPCSSEQYGIVSCNLQSGTR

SEQ ID NO: 103475 - protein, 34 aa, Artificial Sequence
  Description of Artificial Sequence: Synthetic polypeptide
DEEEIRTTNPVAYEQYGQVVYSATNDLLQDSQIP

SEQ ID NO: 103476 - protein, 32 aa, Artificial Sequence
  Description of Artificial Sequence: Synthetic polypeptide
YTEEIDTTNPVATECYGAVSIENLPIVRGHRV

SEQ ID NO: 103477 - protein, 34 aa, Artificial Sequence
  Description of Artificial Sequence: Synthetic polypeptide
DEEEIRTTNPVAYEQYGQVVSVANDALQVRTVEV

SEQ ID NO: 103478 - protein, 36 aa, Artificial Sequence
  Description of Artificial Sequence: Synthetic polypeptide
DEEEIRTTNPVAYEQYGQVVSQMNDLLQPRGQIMRH

SEQ ID NO: 103479 - protein, 35 aa, Artificial Sequence
  Description of Artificial Sequence: Synthetic polypeptide
DEEEIRTTNPVAYEQYGQVVSQMNDLLQPLGQIER

SEQ ID NO: 103480 - protein, 35 aa, Artificial Sequence
  Description of Artificial Sequence: Synthetic polypeptide
DEEEIRTTNPVAYEQYGQVVSQMNDLLQPDNQIPR

SEQ ID NO: 103481 - protein, 35 aa, Artificial Sequence
  Description of Artificial Sequence: Synthetic polypeptide
DEEEIRTTNPVAYEQYGQVVNSQMNDLLQPEGQIR

SEQ ID NO: 103482 - protein, 33 aa, Artificial Sequence
  Description of Artificial Sequence: Synthetic polypeptide
DMEEIRTTNPVATEQYGSVSMNDNYDEELIDNE

SEQ ID NO: 103483 - protein, 33 aa, Artificial Sequence
  Description of Artificial Sequence: Synthetic polypeptide
DMEEIGTTNPVATEQYGSVWPNALQERMEVQQD

SEQ ID NO: 103484 - protein, 28 aa, Artificial Sequence
  Description of Artificial Sequence: Synthetic peptide
YETEIASVNPICTEQYGVVSDNWQSGNQ

SEQ ID NO: 103485 - protein, 30 aa, Artificial Sequence
  Description of Artificial Sequence: Synthetic polypeptide
YETEIASTNPVCTEQYGVVSNDNLQESGPQ

SEQ ID NO: 103486 - protein, 33 aa, Artificial Sequence
  Description of Artificial Sequence: Synthetic polypeptide
YESEIRTTNPVCTEQWGSVSDINLPQDSEGENG

SEQ ID NO: 103487 - protein, 32 aa, Artificial Sequence
  Description of Artificial Sequence: Synthetic polypeptide
YESEIRTVNPVATECWGSVSCINEQDREGENG

SEQ ID NO: 103488 - protein, 36 aa, Artificial Sequence
  Description of Artificial Sequence: Synthetic polypeptide
DEEEIRTTNPVAYEQYGSVCSTIDNNLTAAEGNDNE

SEQ ID NO: 103489 - protein, 29 aa, Artificial Sequence
  Description of Artificial Sequence: Synthetic peptide
DDSEVASTNPVSTEGYGVVAADNLQSGNR

SEQ ID NO: 103490 - protein, 35 aa, Artificial Sequence
  Description of Artificial Sequence: Synthetic polypeptide
DEEEIRTTNPVAYEQYGSVCHCTNAISQNKGSPRV

SEQ ID NO: 103491 - protein, 34 aa, Artificial Sequence
  Description of Artificial Sequence: Synthetic polypeptide
DEEEIRTTNPVAYEQYGSVCAAANGLQSEPVPNS

SEQ ID NO: 103492 - protein, 31 aa, Artificial Sequence
  Description of Artificial Sequence: Synthetic polypeptide
YESEIRTVNPVATECWGVVSCINEPQREGNG

SEQ ID NO: 103493 - protein, 31 aa, Artificial Sequence
  Description of Artificial Sequence: Synthetic polypeptide
YESEIRTVNPVATECWGVVSCINEPQREGNQ

SEQ ID NO: 103494 - protein, 31 aa, Artificial Sequence
  Description of Artificial Sequence: Synthetic polypeptide
YESEIRTVNPVATECWGVVSDINEPQREGNQ

SEQ ID NO: 103495 - protein, 30 aa, Artificial Sequence
  Description of Artificial Sequence: Synthetic polypeptide
YESEIRTVNPVATECWGVVSDINEPQSGNQ

SEQ ID NO: 103496 - protein, 33 aa, Artificial Sequence
  Description of Artificial Sequence: Synthetic polypeptide
DMSEIRTTNPVATECWGSVSCPNEPQDRNGENL

SEQ ID NO: 103497 - protein, 30 aa, Artificial Sequence
  Description of Artificial Sequence: Synthetic polypeptide
DDSEVASTNPVSTEQYGEASANNLQRVGGR

SEQ ID NO: 103498 - protein, 30 aa, Artificial Sequence
  Description of Artificial Sequence: Synthetic polypeptide
DDSEVASTNPVSTEQYGNVAANTIQSRGNR

SEQ ID NO: 103499 - protein, 30 aa, Artificial Sequence
  Description of Artificial Sequence: Synthetic polypeptide
DDSEVASTNPVSTEQYGNVAANTLQRVGGR

SEQ ID NO: 103500 - protein, 29 aa, Artificial Sequence
  Description of Artificial Sequence: Synthetic peptide
YESEVASTNPVCTEGYGVVAADNLQSGNR

SEQ ID NO: 103501 - protein, 30 aa, Artificial Sequence
  Description of Artificial Sequence: Synthetic polypeptide
DDSEVASTNPVSTEQYGNVAANTLQRVGQR

SEQ ID NO: 103502 - protein, 33 aa, Artificial Sequence
  Description of Artificial Sequence: Synthetic polypeptide
DMSEIRTTNPVATECWGSVSCINEPQDREGENQ

SEQ ID NO: 103503 - protein, 33 aa, Artificial Sequence
  Description of Artificial Sequence: Synthetic polypeptide
DMSEIRTTNPVATECWGSVSCINEPQDREGENG

SEQ ID NO: 103504 - protein, 34 aa, Artificial Sequence
  Description of Artificial Sequence: Synthetic polypeptide
DEEEIRTTNPVAYEQYGSTVVWCTNAAAQVTVSR

SEQ ID NO: 103505 - protein, 31 aa, Artificial Sequence
  Description of Artificial Sequence: Synthetic polypeptide
DDSEVASTNPVSTEQYGNVSTNTGNSRVGNR

SEQ ID NO: 103506 - protein, 29 aa, Artificial Sequence
  Description of Artificial Sequence: Synthetic peptide
YETEIASTNPICTEQYGAVADNLQSKGNQ

SEQ ID NO: 103507 - protein, 31 aa, Artificial Sequence
  Description of Artificial Sequence: Synthetic polypeptide
DDSEVASTNPVSTEQYGSVSANTINSRNGNR

SEQ ID NO: 103508 - protein, 32 aa, Artificial Sequence
  Description of Artificial Sequence: Synthetic polypeptide
DMQEIATTNPVATEQYGSVSATQLEDHEGEDL

SEQ ID NO: 103509 - protein, 35 aa, Artificial Sequence
  Description of Artificial Sequence: Synthetic polypeptide
DEEEIRTTNPVAYEQYGSVMSCPNPLSTYTNGHRG

SEQ ID NO: 103510 - protein, 30 aa, Artificial Sequence
  Description of Artificial Sequence: Synthetic polypeptide
YEEEIRSTNPIATEQWGATWSNDNLQPGPQ

SEQ ID NO: 103511 - protein, 32 aa, Artificial Sequence
  Description of Artificial Sequence: Synthetic polypeptide
DNQEIATTNPVATEQYGSVSATDLVDHEGEDL

SEQ ID NO: 103512 - protein, 33 aa, Artificial Sequence
  Description of Artificial Sequence: Synthetic polypeptide
DNSEIRTTNPVATECWGSVSCINEPQDRRGENG

SEQ ID NO: 103513 - protein, 31 aa, Artificial Sequence
  Description of Artificial Sequence: Synthetic polypeptide
YEMEIATTNPVCTEQYGVVSADDNLESEGNQ

SEQ ID NO: 103514 - protein, 31 aa, Artificial Sequence
  Description of Artificial Sequence: Synthetic polypeptide
YEMEIVSTNPVATEQYGTVCSTDNPEFEGND

SEQ ID NO: 103515 - protein, 34 aa, Artificial Sequence
  Description of Artificial Sequence: Synthetic polypeptide
DEEEIRTTNPVGTEFYGSVNAGPNGLGQEGGNGQ

SEQ ID NO: 103516 - protein, 29 aa, Artificial Sequence
  Description of Artificial Sequence: Synthetic peptide
YENEIASVNPVATEQYGVVSDNLQNSEDA

SEQ ID NO: 103517 - protein, 31 aa, Artificial Sequence
  Description of Artificial Sequence: Synthetic polypeptide
DGENLRTTNPVATEQWGSVVTSVLLQGEGTD

SEQ ID NO: 103518 - protein, 29 aa, Artificial Sequence
  Description of Artificial Sequence: Synthetic peptide
YENEIASVNPVCTEQWGVVSDNLQSAGNQ

SEQ ID NO: 103519 - protein, 33 aa, Artificial Sequence
  Description of Artificial Sequence: Synthetic polypeptide
DQAEIRTTNPVATEQYGCCSTGELQEHFGSNQS

SEQ ID NO: 103520 - protein, 33 aa, Artificial Sequence
  Description of Artificial Sequence: Synthetic polypeptide
DEEEIRTTNPVCYEPYGSVGCAPNLSQMGGNND

SEQ ID NO: 103521 - protein, 33 aa, Artificial Sequence
  Description of Artificial Sequence: Synthetic polypeptide
DEEEIRTTNPVCYEHYGSVSMPNALPQTPYNQM

SEQ ID NO: 103522 - protein, 32 aa, Artificial Sequence
  Description of Artificial Sequence: Synthetic polypeptide
DQAEIRTTNPVATEQYGCCSTEEHQHFGSNQS

SEQ ID NO: 103523 - protein, 31 aa, Artificial Sequence
  Description of Artificial Sequence: Synthetic polypeptide
YEMEIATTNPVCTEQYGTVSADDNLESEGNQ

SEQ ID NO: 103524 - protein, 34 aa, Artificial Sequence
  Description of Artificial Sequence: Synthetic polypeptide
DEEEIRTTNPVCYEHYGSVSMPNALPQTPGNQAG

SEQ ID NO: 103525 - protein, 33 aa, Artificial Sequence
  Description of Artificial Sequence: Synthetic polypeptide
DEEEIRTTNPVCYEHYGSVSMPNALPDGTPGNL

SEQ ID NO: 103526 - protein, 32 aa, Artificial Sequence
  Description of Artificial Sequence: Synthetic polypeptide
DGQEIATTNPVATEQYGSVSATDLEDHEGEDL

SEQ ID NO: 103527 - protein, 33 aa, Artificial Sequence
  Description of Artificial Sequence: Synthetic polypeptide
DEEEIRTTNPVCYEHYGSTVSCMPNLSQFGGSL

SEQ ID NO: 103528 - protein, 33 aa, Artificial Sequence
  Description of Artificial Sequence: Synthetic polypeptide
DGSEIRTTNPVATECWGSVSCINEPQDREGENA

SEQ ID NO: 103529 - protein, 33 aa, Artificial Sequence
  Description of Artificial Sequence: Synthetic polypeptide
DGSEIRTTNPVATECWGSVSCINEPQDREGENG

SEQ ID NO: 103530 - protein, 34 aa, Artificial Sequence
  Description of Artificial Sequence: Synthetic polypeptide
DEEEIRTTNPVCTEQYGVVSTDNGPNMSNGMNPV

SEQ ID NO: 103531 - protein, 29 aa, Artificial Sequence
  Description of Artificial Sequence: Synthetic peptide
YENEIASVNPVSTEPYGVVSDENLQSGNH

SEQ ID NO: 103532 - protein, 29 aa, Artificial Sequence
  Description of Artificial Sequence: Synthetic peptide
YENEIASVNPVSTEQYGVVSDENIQQGNH

SEQ ID NO: 103533 - protein, 29 aa, Artificial Sequence
  Description of Artificial Sequence: Synthetic peptide
YENEIASVNPVSTEQYGVVSDENIQSGNH

SEQ ID NO: 103534 - protein, 35 aa, Artificial Sequence
  Description of Artificial Sequence: Synthetic polypeptide
DEEEIRTTNPVCTEQYGSVSSTTPAGPNRNGMNPV

SEQ ID NO: 103535 - protein, 28 aa, Artificial Sequence
  Description of Artificial Sequence: Synthetic peptide
YENEIASVNPVCTEQYGVVSDNLQSEDQ

SEQ ID NO: 103536 - protein, 32 aa, Artificial Sequence
  Description of Artificial Sequence: Synthetic polypeptide
YEMEIATTNPVATEQYGTVCSATDGLESEGND

SEQ ID NO: 103537 - protein, 33 aa, Artificial Sequence
  Description of Artificial Sequence: Synthetic polypeptide
DEEEIRTTNPVGTEFYGVVNMANGLQDEGENGG

SEQ ID NO: 103538 - protein, 32 aa, Artificial Sequence
  Description of Artificial Sequence: Synthetic polypeptide
YEMEIATTNPVATEQYGTVCSATDGLEFEGND

SEQ ID NO: 103539 - protein, 28 aa, Artificial Sequence
  Description of Artificial Sequence: Synthetic peptide
YEEVIASVNPVCTEAYGVVSDNLISGNQ

SEQ ID NO: 103540 - protein, 34 aa, Artificial Sequence
  Description of Artificial Sequence: Synthetic polypeptide
DEEEIRTTNPVGTEQYGSVATTAGPNMRNGMNPV

SEQ ID NO: 103541 - protein, 34 aa, Artificial Sequence
  Description of Artificial Sequence: Synthetic polypeptide
DEEEIRTTNPVGTEQYGSVATSAGPNMRNGMNPV

SEQ ID NO: 103542 - protein, 33 aa, Artificial Sequence
  Description of Artificial Sequence: Synthetic polypeptide
DEEEIRTTNPVGTEQYGSVATSAGPNHNGMNPV

SEQ ID NO: 103543 - protein, 31 aa, Artificial Sequence
  Description of Artificial Sequence: Synthetic polypeptide
DQAEIRTTNPVAYEAYGCCSTVLSQHTGGND

SEQ ID NO: 103544 - protein, 31 aa, Artificial Sequence
  Description of Artificial Sequence: Synthetic polypeptide
DQAEIRTTNPVAYEAYGCCSCTVEQSQHGNR

SEQ ID NO: 103545 - protein, 34 aa, Artificial Sequence
  Description of Artificial Sequence: Synthetic polypeptide
DQAEIRTTNPVATHQYGSVSTQNGVTQEGGENHQ

SEQ ID NO: 103546 - protein, 32 aa, Artificial Sequence
  Description of Artificial Sequence: Synthetic polypeptide
DEEEIRTTNPVGTEQYGCVSWEDLTNFGSDQA

SEQ ID NO: 103547 - protein, 33 aa, Artificial Sequence
  Description of Artificial Sequence: Synthetic polypeptide
DEEEIRTTNPVGTEQYGCVCSWNDLANFGSQQG

SEQ ID NO: 103548 - protein, 33 aa, Artificial Sequence
  Description of Artificial Sequence: Synthetic polypeptide
DQAEIRTTNPVATHQYGSVSTNGVTTNGGENHY

SEQ ID NO: 103549 - protein, 33 aa, Artificial Sequence
  Description of Artificial Sequence: Synthetic polypeptide
DQAEIRTTNPVATEQYGCVSTDLIPENGEEMRL

SEQ ID NO: 103550 - protein, 33 aa, Artificial Sequence
  Description of Artificial Sequence: Synthetic polypeptide
DEEEIRTTNPVGTEQYGCVCSTNDHGNFNSDQA

SEQ ID NO: 103551 - protein, 28 aa, Artificial Sequence
  Description of Artificial Sequence: Synthetic peptide
YEGEIASVNPCCTEQYGVVSDNLQSGTQ

SEQ ID NO: 103552 - protein, 33 aa, Artificial Sequence
  Description of Artificial Sequence: Synthetic polypeptide
DEEEIRTTNPVGTEQYGCVCSTNDHANFGSFTQ

SEQ ID NO: 103553 - protein, 28 aa, Artificial Sequence
  Description of Artificial Sequence: Synthetic peptide
YEGEIASVNPCSTEQYGVVSDNLQSGTQ

SEQ ID NO: 103554 - protein, 28 aa, Artificial Sequence
  Description of Artificial Sequence: Synthetic peptide
YEGEIASVNPVCSEQYGVVSDNLQSGTQ

SEQ ID NO: 103555 - protein, 34 aa, Artificial Sequence
  Description of Artificial Sequence: Synthetic polypeptide
DEEEIRTTNPVGTEQWGSVVSCTGSEPSARGIND

SEQ ID NO: 103556 - protein, 28 aa, Artificial Sequence
  Description of Artificial Sequence: Synthetic peptide
YEGEIASVNPVSSEQYGVVSDNLQSGTQ

SEQ ID NO: 103557 - protein, 31 aa, Artificial Sequence
  Description of Artificial Sequence: Synthetic polypeptide
YEGEINTTNPNATENYGEVSVINLQGMGNMP

SEQ ID NO: 103558 - protein, 34 aa, Artificial Sequence
  Description of Artificial Sequence: Synthetic polypeptide
YELEIRTTNPVATEQYGVSVCSTTDAQCRNGGPH

SEQ ID NO: 103559 - protein, 30 aa, Artificial Sequence
  Description of Artificial Sequence: Synthetic polypeptide
YEMEIASTNPVCTEQYGVVSADDNLESGNQ

SEQ ID NO: 103560 - protein, 31 aa, Artificial Sequence
  Description of Artificial Sequence: Synthetic polypeptide
YEMEIASTNPVCTEQYGVVSADDNLVQSGNQ

SEQ ID NO: 103561 - protein, 30 aa, Artificial Sequence
  Description of Artificial Sequence: Synthetic polypeptide
YEMEIASVNPVATEQYGVVSADNLVEFGNQ

SEQ ID NO: 103562 - protein, 35 aa, Artificial Sequence
  Description of Artificial Sequence: Synthetic polypeptide
DEEEIRTTNPVCTEQYGSVSSTTPAGPNMRNGNPV

SEQ ID NO: 103563 - protein, 33 aa, Artificial Sequence
  Description of Artificial Sequence: Synthetic polypeptide
DNSEIRTTNPVATECWGSVSCINEPQDREGENG

SEQ ID NO: 103564 - protein, 29 aa, Artificial Sequence
  Description of Artificial Sequence: Synthetic peptide
YENEIASVNPVSTEQYGVVSDENIQSGNQ

SEQ ID NO: 103565 - protein, 30 aa, Artificial Sequence
  Description of Artificial Sequence: Synthetic polypeptide
YENEIATTNPVATEQWGDVSEILQNAAENQ

SEQ ID NO: 103566 - protein, 33 aa, Artificial Sequence
  Description of Artificial Sequence: Synthetic polypeptide
DHSEIRTTNPVATECWGSVSCANEPQDREGENG

SEQ ID NO: 103567 - protein, 34 aa, Artificial Sequence
  Description of Artificial Sequence: Synthetic polypeptide
DEEEIRTTNPVCTEHWGSVSMPNQGQERNGDNDL

SEQ ID NO: 103568 - protein, 31 aa, Artificial Sequence
  Description of Artificial Sequence: Synthetic polypeptide
YEQEIASTNPVCTEQYGSVSATDLQDHGEDL

SEQ ID NO: 103569 - protein, 33 aa, Artificial Sequence
  Description of Artificial Sequence: Synthetic polypeptide
DEEEIRTTNPVCTEHWGSVAMPNQGQERNGNEL

SEQ ID NO: 103570 - protein, 31 aa, Artificial Sequence
  Description of Artificial Sequence: Synthetic polypeptide
YEQEIASTNPVCTEQYGVVSADNLQDHGNDQ

SEQ ID NO: 103571 - protein, 33 aa, Artificial Sequence
  Description of Artificial Sequence: Synthetic polypeptide
DEEEIRTTNPVCTEHWGSVAMPDLDQREGGNTV

SEQ ID NO: 103572 - protein, 32 aa, Artificial Sequence
  Description of Artificial Sequence: Synthetic polypeptide
DEEEIRTTNPVCTEHWGSVAMPDLDQREGGDA

SEQ ID NO: 103573 - protein, 33 aa, Artificial Sequence
  Description of Artificial Sequence: Synthetic polypeptide
DHSEIRTTNPVATECWGSVSCINEPQDREGENG

SEQ ID NO: 103574 - protein, 35 aa, Artificial Sequence
  Description of Artificial Sequence: Synthetic polypeptide
DEEEIRTTNPVAYEVYGSTVSCTQNADSGNRSNNG

SEQ ID NO: 103575 - protein, 33 aa, Artificial Sequence
  Description of Artificial Sequence: Synthetic polypeptide
DPSEIRTTNPVATECWGSVSCINEPQDREGENG

SEQ ID NO: 103576 - protein, 32 aa, Artificial Sequence
  Description of Artificial Sequence: Synthetic polypeptide
DQAEIATTNPVATEQYGCTCSTVLSQHTGGNE

SEQ ID NO: 103577 - protein, 31 aa, Artificial Sequence
  Description of Artificial Sequence: Synthetic polypeptide
YEQEIASVNPVATEQYGSVSADNLQDSGEDL

SEQ ID NO: 103578 - protein, 34 aa, Artificial Sequence
  Description of Artificial Sequence: Synthetic polypeptide
DEEEIRTTNPVAYESWGSVSCCTGNHSPTRGGTR

SEQ ID NO: 103579 - protein, 31 aa, Artificial Sequence
  Description of Artificial Sequence: Synthetic polypeptide
YEQEIASVNPVATEQYGSVSATNLEDHGEDL

SEQ ID NO: 103580 - protein, 33 aa, Artificial Sequence
  Description of Artificial Sequence: Synthetic polypeptide
DHSEIRTTNPVATECWGSVSCINEPQDREGFNG

SEQ ID NO: 103581 - protein, 30 aa, Artificial Sequence
  Description of Artificial Sequence: Synthetic polypeptide
YEQEIASVNPVCTEQYGVVSDNLQDSGNDQ

SEQ ID NO: 103582 - protein, 30 aa, Artificial Sequence
  Description of Artificial Sequence: Synthetic polypeptide
YEQEIASVNPVCTEQYGVVSTNLEHEGNDL

SEQ ID NO: 103583 - protein, 32 aa, Artificial Sequence
  Description of Artificial Sequence: Synthetic polypeptide
DINEIATTNPVATEQYGSVSATDLEDHEGEDL

SEQ ID NO: 103584 - protein, 28 aa, Artificial Sequence
  Description of Artificial Sequence: Synthetic peptide
DPEEIATTNPVATEQYGEAPEVCQHEEK

SEQ ID NO: 103585 - protein, 32 aa, Artificial Sequence
  Description of Artificial Sequence: Synthetic polypeptide
YEQEIATTNPVATEQYGSVSATDLEDAEGEDL

SEQ ID NO: 103586 - protein, 32 aa, Artificial Sequence
  Description of Artificial Sequence: Synthetic polypeptide
DIQEIATTNPVATEQYGSVSATDLGDHEGEDL

SEQ ID NO: 103587 - protein, 32 aa, Artificial Sequence
  Description of Artificial Sequence: Synthetic polypeptide
YEQEIATTNPVATEQYGSVSATDLEDHEGEDL

SEQ ID NO: 103588 - protein, 34 aa, Artificial Sequence
  Description of Artificial Sequence: Synthetic polypeptide
DEEEIRTTNPVAYESYGSVCCTGNHSPSRNGGTR

SEQ ID NO: 103589 - protein, 30 aa, Artificial Sequence
  Description of Artificial Sequence: Synthetic polypeptide
YEQEIASTNPVATEQYGVVSDDLQDSGEDL

SEQ ID NO: 103590 - protein, 30 aa, Artificial Sequence
  Description of Artificial Sequence: Synthetic polypeptide
YEQEIASTNPVATEQYGSVSDDLEDSGEDL

SEQ ID NO: 103591 - protein, 32 aa, Artificial Sequence
  Description of Artificial Sequence: Synthetic polypeptide
DEEEIRTTNPVCTEHYGCVCSWGELQNGSDLS

SEQ ID NO: 103592 - protein, 33 aa, Artificial Sequence
  Description of Artificial Sequence: Synthetic polypeptide
DGSEIRTTNPVATECWGSVSCINEPQHREGENG

SEQ ID NO: 103593 - protein, 35 aa, Artificial Sequence
  Description of Artificial Sequence: Synthetic polypeptide
DEEEIRTTNPVCTEQYGSVSSTPNGPNMSNGMNPV

SEQ ID NO: 103594 - protein, 30 aa, Artificial Sequence
  Description of Artificial Sequence: Synthetic polypeptide
YENEIATTNPVATEQYGVVSEILMNAAENA

SEQ ID NO: 103595 - protein, 33 aa, Artificial Sequence
  Description of Artificial Sequence: Synthetic polypeptide
DGSEIRTTNPVATEMWGSVSCINEPQDREGENG

SEQ ID NO: 103596 - protein, 35 aa, Artificial Sequence
  Description of Artificial Sequence: Synthetic polypeptide
DHEEEIRTTNPVATEQYGVTVNCTQNQSFKTEGNR

SEQ ID NO: 103597 - protein, 28 aa, Artificial Sequence
  Description of Artificial Sequence: Synthetic peptide
YENEIATVNPVATECYGDVSECLQSEEQ

SEQ ID NO: 103598 - protein, 33 aa, Artificial Sequence
  Description of Artificial Sequence: Synthetic polypeptide
DQAEIRTTNPVATEQYGCCSCTGVLSQHTGGNE

SEQ ID NO: 103599 - protein, 30 aa, Artificial Sequence
  Description of Artificial Sequence: Synthetic polypeptide
DEEEIRTTNPVCTEQWGVVSEIEMNSAENQ

SEQ ID NO: 103600 - protein, 28 aa, Artificial Sequence
  Description of Artificial Sequence: Synthetic peptide
YENEIATVNPVCTECYGVVSECLQSGEQ

SEQ ID NO: 103601 - protein, 32 aa, Artificial Sequence
  Description of Artificial Sequence: Synthetic polypeptide
DQAEIRTTNPVATEQYGCCCSTEPQHFGSNQP

SEQ ID NO: 103602 - protein, 28 aa, Artificial Sequence
  Description of Artificial Sequence: Synthetic peptide
YENEIATVNPVCTEPYGVISMDLQQGNQ

SEQ ID NO: 103603 - protein, 30 aa, Artificial Sequence
  Description of Artificial Sequence: Synthetic polypeptide
YENEIATVNPVSTEQYGTVSMEDLQQSGNH

SEQ ID NO: 103604 - protein, 32 aa, Artificial Sequence
  Description of Artificial Sequence: Synthetic polypeptide
DHQEIATTNPVATEQYGSVSATDLEDHEGEDL

SEQ ID NO: 103605 - protein, 32 aa, Artificial Sequence
  Description of Artificial Sequence: Synthetic polypeptide
DHQEIATTNPVATEQYGSVSATDLEDHEGEDT

SEQ ID NO: 103606 - protein, 32 aa, Artificial Sequence
  Description of Artificial Sequence: Synthetic polypeptide
DHQEIATTNPVATEQYGSVSATDLEFHEGEDL

SEQ ID NO: 103607 - protein, 35 aa, Artificial Sequence
  Description of Artificial Sequence: Synthetic polypeptide
YENEIRTTNPVATEQYGHSVCSTTDLQCRNGGPHA

SEQ ID NO: 103608 - protein, 34 aa, Artificial Sequence
  Description of Artificial Sequence: Synthetic polypeptide
YENEIRTTNPVATEQYGVSCCSTTDLQCRNGGPH

SEQ ID NO: 103609 - protein, 34 aa, Artificial Sequence
  Description of Artificial Sequence: Synthetic polypeptide
YENEIRTTNPVATEQYGVSVGSTTDLACRNGGPH

SEQ ID NO: 103610 - protein, 30 aa, Artificial Sequence
  Description of Artificial Sequence: Synthetic polypeptide
YENEIRTTNPVATEQYGVVSEIEMNSAGDA

SEQ ID NO: 103611 - protein, 29 aa, Artificial Sequence
  Description of Artificial Sequence: Synthetic peptide
YENEIRTTNPVSTEPYGVISDDIQQQGNH

SEQ ID NO: 103612 - protein, 34 aa, Artificial Sequence
  Description of Artificial Sequence: Synthetic polypeptide
DEEEIRTTNPVCTEHYGCVCSWPNLQENFGSNQS

SEQ ID NO: 103613 - protein, 32 aa, Artificial Sequence
  Description of Artificial Sequence: Synthetic polypeptide
DEEEIRTTNPVCTEHYGCVCSWPEHQRFGSDQ

SEQ ID NO: 103614 - protein, 31 aa, Artificial Sequence
  Description of Artificial Sequence: Synthetic polypeptide
DEEEIRTTNPVCTEHYGCVCSWPEHQNGSDL

SEQ ID NO: 103615 - protein, 36 aa, Artificial Sequence
  Description of Artificial Sequence: Synthetic polypeptide
DEEEIRTTNPVCTEQYGSVSSTTPAGLNMRNGMNPV

SEQ ID NO: 103616 - protein, 33 aa, Artificial Sequence
  Description of Artificial Sequence: Synthetic polypeptide
TEQEIRTTNPVATEPYGSVTMKTDLPVQSGQNK

SEQ ID NO: 103617 - protein, 30 aa, Artificial Sequence
  Description of Artificial Sequence: Synthetic polypeptide
AEDEIACTNPVAYEQWGEAYTENLQRGGER

SEQ ID NO: 103618 - protein, 33 aa, Artificial Sequence
  Description of Artificial Sequence: Synthetic polypeptide
YEEEIRCTNPVATECQYGYSDSTSNGEVARDHR

SEQ ID NO: 103619 - protein, 35 aa, Artificial Sequence
  Description of Artificial Sequence: Synthetic polypeptide
DSEEIRTTNPVATEQYGCVCITNELSGKTVGNNRW

SEQ ID NO: 103620 - protein, 35 aa, Artificial Sequence
  Description of Artificial Sequence: Synthetic polypeptide
DEEEISTTNPVATEQYGCVCSTGNLNQNFNSNNQS

SEQ ID NO: 103621 - protein, 35 aa, Artificial Sequence
  Description of Artificial Sequence: Synthetic polypeptide
DSEEIRTTNPVATEQYGCVCITNELSGKTGGVNRI

SEQ ID NO: 103622 - protein, 30 aa, Artificial Sequence
  Description of Artificial Sequence: Synthetic polypeptide
YEEEIASVNPVCTEQYGVVSSDPALQSGNQ

SEQ ID NO: 103623 - protein, 34 aa, Artificial Sequence
  Description of Artificial Sequence: Synthetic polypeptide
DEEEISTTNPVATEQYGCVCSTGNHQNFGSQTQL

SEQ ID NO: 103624 - protein, 34 aa, Artificial Sequence
  Description of Artificial Sequence: Synthetic polypeptide
DEEEISTTNPVATEQYGCVCSTGNHNQGFGSDQV

SEQ ID NO: 103625 - protein, 31 aa, Artificial Sequence
  Description of Artificial Sequence: Synthetic polypeptide
YEEEIASVNPVCTEQYGVVSSTDALQMSGNQ

SEQ ID NO: 103626 - protein, 34 aa, Artificial Sequence
  Description of Artificial Sequence: Synthetic polypeptide
DEEEISTTNPVATEQYGCVCSTGNDQFFNSNFQS

SEQ ID NO: 103627 - protein, 33 aa, Artificial Sequence
  Description of Artificial Sequence: Synthetic polypeptide
DEVEIVTTNPVATEQYGTVNSATDGQGENEGND

SEQ ID NO: 103628 - protein, 37 aa, Artificial Sequence
  Description of Artificial Sequence: Synthetic polypeptide
DEVENRTTNHPVCATREQYPGKSVSTNLRQRDMMNLR

SEQ ID NO: 103629 - protein, 29 aa, Artificial Sequence
  Description of Artificial Sequence: Synthetic peptide
YEEEIASVNPVCTEQYGVVSSDAGQSGNV

SEQ ID NO: 103630 - protein, 31 aa, Artificial Sequence
  Description of Artificial Sequence: Synthetic polypeptide
YEEEIASVNPVCTEQYGVVSTDNGQMSGMNV

SEQ ID NO: 103631 - protein, 32 aa, Artificial Sequence
  Description of Artificial Sequence: Synthetic polypeptide
DEVNEIATTNPVAYEAWGEVSTNLQGADNDSR

SEQ ID NO: 103632 - protein, 31 aa, Artificial Sequence
  Description of Artificial Sequence: Synthetic polypeptide
YEEEIASVNPVCTEQYGVVSYDNLQESGNHQ

SEQ ID NO: 103633 - protein, 31 aa, Artificial Sequence
  Description of Artificial Sequence: Synthetic polypeptide
DEVVIATTNPVAYEQWGTYYSTDFLGQDGNR

SEQ ID NO: 103634 - protein, 35 aa, Artificial Sequence
  Description of Artificial Sequence: Synthetic polypeptide
DEEEISTTNPVATEQYGCVCSTGELQENFGSNTQA

SEQ ID NO: 103635 - protein, 35 aa, Artificial Sequence
  Description of Artificial Sequence: Synthetic polypeptide
DEEEISTTNPVATEQYGCVCSTGELNQNFGSNNDS

SEQ ID NO: 103636 - protein, 35 aa, Artificial Sequence
  Description of Artificial Sequence: Synthetic polypeptide
DEEEISTTNPVATEQYGCVCSTGELFQNFGSNTQS

SEQ ID NO: 103637 - protein, 35 aa, Artificial Sequence
  Description of Artificial Sequence: Synthetic polypeptide
DEEEISTTNPVATEQYGCVCSTGELFQNFGSDNQA

SEQ ID NO: 103638 - protein, 36 aa, Artificial Sequence
  Description of Artificial Sequence: Synthetic polypeptide
DSEEIRTTNPVATEQWGCSVPSCTTELQQTGGTNRH

SEQ ID NO: 103639 - protein, 34 aa, Artificial Sequence
  Description of Artificial Sequence: Synthetic polypeptide
DEEEISTTNPVATEQYGCVCSTGELANFGSENQS

SEQ ID NO: 103640 - protein, 33 aa, Artificial Sequence
  Description of Artificial Sequence: Synthetic polypeptide
DEEEISTTNPVATEQYGCVCSTGEHTRFGSDQA

SEQ ID NO: 103641 - protein, 32 aa, Artificial Sequence
  Description of Artificial Sequence: Synthetic polypeptide
AEDEICATNPVATEQYGVVATSNENLQRGTDD

SEQ ID NO: 103642 - protein, 32 aa, Artificial Sequence
  Description of Artificial Sequence: Synthetic polypeptide
DEEEISTTNPVATEQYGCVCSTGEHQNISDQG

SEQ ID NO: 103643 - protein, 36 aa, Artificial Sequence
  Description of Artificial Sequence: Synthetic polypeptide
DSEEIRTTNPVATEQYGCVCITNELSGQKTGGNNRG

SEQ ID NO: 103644 - protein, 35 aa, Artificial Sequence
  Description of Artificial Sequence: Synthetic polypeptide
DSEEIRTTNPVATEQYGCVCVTNELSGKTGGHNRG

SEQ ID NO: 103645 - protein, 28 aa, Artificial Sequence
  Description of Artificial Sequence: Synthetic peptide
YEEEIASVNPVCTEQYGVVSEVCQHGEQ

SEQ ID NO: 103646 - protein, 33 aa, Artificial Sequence
  Description of Artificial Sequence: Synthetic polypeptide
DEEEISTTNPVATEQYGCVCSTMEPQNFNSQQS

SEQ ID NO: 103647 - protein, 34 aa, Artificial Sequence
  Description of Artificial Sequence: Synthetic polypeptide
DEEEISTTNPVATEQYGCVCSTMELQNFSSENQS

SEQ ID NO: 103648 - protein, 34 aa, Artificial Sequence
  Description of Artificial Sequence: Synthetic polypeptide
DEVEIRTTNPVATESYGSVSTGLNGQEGGGEQGD

SEQ ID NO: 103649 - protein, 30 aa, Artificial Sequence
  Description of Artificial Sequence: Synthetic polypeptide
YEEEIASVNPVCTEQYGVVSFNLQNSQNGW

SEQ ID NO: 103650 - protein, 34 aa, Artificial Sequence
  Description of Artificial Sequence: Synthetic polypeptide
DEEEISTTNPVATEQYGCVCSTMELQESFGSDQG

SEQ ID NO: 103651 - protein, 33 aa, Artificial Sequence
  Description of Artificial Sequence: Synthetic polypeptide
DEEEISTTNPVATEQYGCVCSTMEHQYFGSEQQ

SEQ ID NO: 103652 - protein, 34 aa, Artificial Sequence
  Description of Artificial Sequence: Synthetic polypeptide
DEEEISTTNPVATEQYGCVCSTLHQEGFGSENQA

SEQ ID NO: 103653 - protein, 35 aa, Artificial Sequence
  Description of Artificial Sequence: Synthetic polypeptide
DSEEIRTTNPVAYEAYGESVSYTPTLSQRPGGNYV

SEQ ID NO: 103654 - protein, 31 aa, Artificial Sequence
  Description of Artificial Sequence: Synthetic polypeptide
AENEIACTNPVATEQYGECFSEANLQRGGQQ

SEQ ID NO: 103655 - protein, 36 aa, Artificial Sequence
  Description of Artificial Sequence: Synthetic polypeptide
DSEEIRTTNPVATEQYGCVCSTINELSGKTGGANRG

SEQ ID NO: 103656 - protein, 31 aa, Artificial Sequence
  Description of Artificial Sequence: Synthetic polypeptide
AENEIACTNPVATEQYGCSCSSELQRGSGQS

SEQ ID NO: 103657 - protein, 34 aa, Artificial Sequence
  Description of Artificial Sequence: Synthetic polypeptide
DSEEIRTTNPVATERYGKVGTNVSGQRTGGSERQ

SEQ ID NO: 103658 - protein, 31 aa, Artificial Sequence
  Description of Artificial Sequence: Synthetic polypeptide
AENEIACTNPVATEQYGCSCSSNLQENGSGQ

SEQ ID NO: 103659 - protein, 31 aa, Artificial Sequence
  Description of Artificial Sequence: Synthetic polypeptide
AENEIACTNPVATEQYGCSCSSNLQHGSQQA

SEQ ID NO: 103660 - protein, 31 aa, Artificial Sequence
  Description of Artificial Sequence: Synthetic polypeptide
AENEIACTNPVATEQYGEAYSENELQARGGL

SEQ ID NO: 103661 - protein, 34 aa, Artificial Sequence
  Description of Artificial Sequence: Synthetic polypeptide
DEEEISTTNPVATEQYGCVCSTGPLQENFGSDQP

SEQ ID NO: 103662 - protein, 37 aa, Artificial Sequence
  Description of Artificial Sequence: Synthetic polypeptide
DSEEIRTTNPVATEQYGSVSACTINSHSQTFGGNNRN

SEQ ID NO: 103663 - protein, 33 aa, Artificial Sequence
  Description of Artificial Sequence: Synthetic polypeptide
DEEEISTTNPVATEQYGCVCSTGPLANFNSEQF

SEQ ID NO: 103664 - protein, 30 aa, Artificial Sequence
  Description of Artificial Sequence: Synthetic polypeptide
AENEIACTNPVATEQYGEAYCENLQKGEGR

SEQ ID NO: 103665 - protein, 30 aa, Artificial Sequence
  Description of Artificial Sequence: Synthetic polypeptide
YEEEIASVNPVCTEQYGVVSNDNLQESGPQ

SEQ ID NO: 103666 - protein, 29 aa, Artificial Sequence
  Description of Artificial Sequence: Synthetic peptide
YEEEIASVNPVCTEQYGVVSNTIQSSGNQ

SEQ ID NO: 103667 - protein, 35 aa, Artificial Sequence
  Description of Artificial Sequence: Synthetic polypeptide
DSEEIRTTNPVATERYGKVSTNNVSMQRTGGSERQ

SEQ ID NO: 103668 - protein, 34 aa, Artificial Sequence
  Description of Artificial Sequence: Synthetic polypeptide
DEEEISTTNPVATEQYGCVCSTGEHQNFGSNQDA

SEQ ID NO: 103669 - protein, 34 aa, Artificial Sequence
  Description of Artificial Sequence: Synthetic polypeptide
DEEEISTTNPVATEQYGCVCSTGEHQHFGSNTIA

SEQ ID NO: 103670 - protein, 33 aa, Artificial Sequence
  Description of Artificial Sequence: Synthetic polypeptide
DEEEISTTNPVATEQYGCVCSTGEHQFFGSDQS

SEQ ID NO: 103671 - protein, 36 aa, Artificial Sequence
  Description of Artificial Sequence: Synthetic polypeptide
DSEEIRTTNPVATEAYGVSTCSCLPNMLSQRDGNMR

SEQ ID NO: 103672 - protein, 35 aa, Artificial Sequence
  Description of Artificial Sequence: Synthetic polypeptide
DSEEIRTTNPVATEAYGSTASCLPNMLSQIRDGNK

SEQ ID NO: 103673 - protein, 31 aa, Artificial Sequence
  Description of Artificial Sequence: Synthetic polypeptide
AENEIACTNPVATEQYGCSSSNLQNFGSGNQ

SEQ ID NO: 103674 - protein, 30 aa, Artificial Sequence
  Description of Artificial Sequence: Synthetic polypeptide
AENEIACTNPVATEQYGCSSSNLQNGSGQA

SEQ ID NO: 103675 - protein, 30 aa, Artificial Sequence
  Description of Artificial Sequence: Synthetic polypeptide
YEEEIASVNPVCYEQYGVVSINLSQSGTNQ

SEQ ID NO: 103676 - protein, 34 aa, Artificial Sequence
  Description of Artificial Sequence: Synthetic polypeptide
DEWEIRTTNPVAYEQYGKVPSCTDNMLPSGTNND

SEQ ID NO: 103677 - protein, 33 aa, Artificial Sequence
  Description of Artificial Sequence: Synthetic polypeptide
DEWEIRWTNPVATECWGSVSCINEPQDREGENG

SEQ ID NO: 103678 - protein, 29 aa, Artificial Sequence
  Description of Artificial Sequence: Synthetic peptide
YEEEIASVNPVSTEGYGVVSNNIQSSGNQ

SEQ ID NO: 103679 - protein, 31 aa, Artificial Sequence
  Description of Artificial Sequence: Synthetic polypeptide
AENEIACTNPVATEQYGCSTSWNLQNGSDQA

SEQ ID NO: 103680 - protein, 34 aa, Artificial Sequence
  Description of Artificial Sequence: Synthetic polypeptide
DEEEISTTNPVATEQYGCVCSTELNQENFGSDQG

SEQ ID NO: 103681 - protein, 36 aa, Artificial Sequence
  Description of Artificial Sequence: Synthetic polypeptide
DEWEIRTTNPVATEQYGSVSSTTPLGPNMRNGMNPV

SEQ ID NO: 103682 - protein, 32 aa, Artificial Sequence
  Description of Artificial Sequence: Synthetic polypeptide
DEYEIATTNPVATEQYGSQSATDLEDHEGEDL

SEQ ID NO: 103683 - protein, 34 aa, Artificial Sequence
  Description of Artificial Sequence: Synthetic polypeptide
DEEEISTTNPVATEQYGCVCSTELHNQNFGSEQS

SEQ ID NO: 103684 - protein, 34 aa, Artificial Sequence
  Description of Artificial Sequence: Synthetic polypeptide
DEEEISTTNPVATEQYGCVCSTELEQNFNSNTQS

SEQ ID NO: 103685 - protein, 33 aa, Artificial Sequence
  Description of Artificial Sequence: Synthetic polypeptide
DSEEIRTTNPLATEQWGSVSCTNELSDTGGEGV

SEQ ID NO: 103686 - protein, 31 aa, Artificial Sequence
  Description of Artificial Sequence: Synthetic polypeptide
YEEEIASVNPVSTEQYGVVSINELSQSGGNQ

SEQ ID NO: 103687 - protein, 34 aa, Artificial Sequence
  Description of Artificial Sequence: Synthetic polypeptide
DEEEISTTNPVATEQYGCVCSTELAENFGSENQA

SEQ ID NO: 103688 - protein, 33 aa, Artificial Sequence
  Description of Artificial Sequence: Synthetic polypeptide
DEEEISTTNPVATEQYGCVCSTEHTFFGSDNQT

SEQ ID NO: 103689 - protein, 33 aa, Artificial Sequence
  Description of Artificial Sequence: Synthetic polypeptide
DSEEIRSTNPVAYEQYGSTVSTNHSQAQNGGQE

SEQ ID NO: 103690 - protein, 34 aa, Artificial Sequence
  Description of Artificial Sequence: Synthetic polypeptide
DSEEIRSTNPVAYEQYGSTVSCTAELQDSNGQNS

SEQ ID NO: 103691 - protein, 33 aa, Artificial Sequence
  Description of Artificial Sequence: Synthetic polypeptide
DEEEISTTNPVATEQYGCVCSTEHQNIGSETQA

SEQ ID NO: 103692 - protein, 33 aa, Artificial Sequence
  Description of Artificial Sequence: Synthetic polypeptide
DEYEIATTNPVATEQYGSVSATDLFEDHEGEDL

SEQ ID NO: 103693 - protein, 33 aa, Artificial Sequence
  Description of Artificial Sequence: Synthetic polypeptide
DEEEISTTNPVATEQYGCVCSTELHQNFFSEQS

SEQ ID NO: 103694 - protein, 35 aa, Artificial Sequence
  Description of Artificial Sequence: Synthetic polypeptide
DSEEIRTTNPVATEEYGQSVPFTPNELQHPGGSYR

SEQ ID NO: 103695 - protein, 34 aa, Artificial Sequence
  Description of Artificial Sequence: Synthetic polypeptide
DSEEIRTTNPVATEHWGSTVPSTGLELSQYGTTR

SEQ ID NO: 103696 - protein, 36 aa, Artificial Sequence
  Description of Artificial Sequence: Synthetic polypeptide
DSEEIRTTNPVATEHYGSTAVSCLPNMLSQDRDGNL

SEQ ID NO: 103697 - protein, 36 aa, Artificial Sequence
  Description of Artificial Sequence: Synthetic polypeptide
DSEEIRTTNPVATEQWGCSTVPSCTTELPRTGTNRH

SEQ ID NO: 103698 - protein, 33 aa, Artificial Sequence
  Description of Artificial Sequence: Synthetic polypeptide
DEEEISTTNPVATEQYGCVCSTGEHNQNFGSDQ

SEQ ID NO: 103699 - protein, 32 aa, Artificial Sequence
  Description of Artificial Sequence: Synthetic polypeptide
DEWEIATTNPVATEQYGSVSATDLEDHEDEDL

SEQ ID NO: 103700 - protein, 32 aa, Artificial Sequence
  Description of Artificial Sequence: Synthetic polypeptide
DEEEISTTNPVATEQYGCVCSTGEDQNFSEQS

SEQ ID NO: 103701 - protein, 31 aa, Artificial Sequence
  Description of Artificial Sequence: Synthetic polypeptide
AEDEICATNPVATEQYGVVATSGNLQLGGTD

SEQ ID NO: 103702 - protein, 33 aa, Artificial Sequence
  Description of Artificial Sequence: Synthetic polypeptide
DEEEISTTNPVATEQYGCVCSTGEDNQNFGSDQ

SEQ ID NO: 103703 - protein, 35 aa, Artificial Sequence
  Description of Artificial Sequence: Synthetic polypeptide
DEEEISTTNPVATEQYGCVCSTGEDLQFFGSDNQT

SEQ ID NO: 103704 - protein, 34 aa, Artificial Sequence
  Description of Artificial Sequence: Synthetic polypeptide
DEEEISTTNPVATEQYGCVCSTGEDHQNMGSNQA

SEQ ID NO: 103705 - protein, 33 aa, Artificial Sequence
  Description of Artificial Sequence: Synthetic polypeptide
DEEEISTTNPVATEQYGCVCSTGEDERFNSEQA

SEQ ID NO: 103706 - protein, 33 aa, Artificial Sequence
  Description of Artificial Sequence: Synthetic polypeptide
DEWEIATTNPVATEQYGSVSATDLEDHEGAEDL

SEQ ID NO: 103707 - protein, 33 aa, Artificial Sequence
  Description of Artificial Sequence: Synthetic polypeptide
DEEEISTTNPVATEQYGCVCSTGAHQHFGSDQS

SEQ ID NO: 103708 - protein, 30 aa, Artificial Sequence
  Description of Artificial Sequence: Synthetic polypeptide
YEEEIASVNPVCTERYGVVSDRNLQTQGNQ

SEQ ID NO: 103709 - protein, 33 aa, Artificial Sequence
  Description of Artificial Sequence: Synthetic polypeptide
DEEEISTTNPVATEQYGCVCSTETQNFNSQNQS

SEQ ID NO: 103710 - protein, 34 aa, Artificial Sequence
  Description of Artificial Sequence: Synthetic polypeptide
DEEEISTTNPVATEQYGCVCSTETQENFGSNTQA

SEQ ID NO: 103711 - protein, 34 aa, Artificial Sequence
  Description of Artificial Sequence: Synthetic polypeptide
DEWEIATTNPVATEQYGSVSATVMLEDHEGEDLR

SEQ ID NO: 103712 - protein, 32 aa, Artificial Sequence
  Description of Artificial Sequence: Synthetic polypeptide
DEWEIATTNPVATEQYGTVSATDLHDHEGEDG

SEQ ID NO: 103713 - protein, 34 aa, Artificial Sequence
  Description of Artificial Sequence: Synthetic polypeptide
DSEEIRTTNPVATEQWGCQVPSCTAELERTGTNL

SEQ ID NO: 103714 - protein, 33 aa, Artificial Sequence
  Description of Artificial Sequence: Synthetic polypeptide
DSEEIRTTNPVATEQWGASCITTELLQRGTQYM

SEQ ID NO: 103715 - protein, 34 aa, Artificial Sequence
  Description of Artificial Sequence: Synthetic polypeptide
DEEEISTTNPVATEQYGCVCSTESHFQVRFGSEQ

SEQ ID NO: 103716 - protein, 31 aa, Artificial Sequence
  Description of Artificial Sequence: Synthetic polypeptide
AENEIACTNPVATEQYGCSCSWNHQRFGSEQ

SEQ ID NO: 103717 - protein, 31 aa, Artificial Sequence
  Description of Artificial Sequence: Synthetic polypeptide
AENEIACTNPVATEQYGCSCSWNLQHFGDQS

SEQ ID NO: 103718 - protein, 33 aa, Artificial Sequence
  Description of Artificial Sequence: Synthetic polypeptide
DEEEISTTNPVATEQYGCVCSTEPNQFFGSDQE

SEQ ID NO: 103719 - protein, 34 aa, Artificial Sequence
  Description of Artificial Sequence: Synthetic polypeptide
DEEEISTTNPVATEQYGCVCSTEPHQNFGSDNQS

SEQ ID NO: 103720 - protein, 30 aa, Artificial Sequence
  Description of Artificial Sequence: Synthetic polypeptide
AENEIACTNPVATEQYGEFSFEVLQRGDGQ

SEQ ID NO: 103721 - protein, 34 aa, Artificial Sequence
  Description of Artificial Sequence: Synthetic polypeptide
DSEEIRTTNPVAYEQYGSTVNYTFELSGRGNYSW

SEQ ID NO: 103722 - protein, 35 aa, Artificial Sequence
  Description of Artificial Sequence: Synthetic polypeptide
DEEEISTTNPVATEQYGCVCSTNDLFQVHFGSEQS

SEQ ID NO: 103723 - protein, 35 aa, Artificial Sequence
  Description of Artificial Sequence: Synthetic polypeptide
DSEEIRTTNPVAYEQYGSVPSCLNESQTSTGNYRE

SEQ ID NO: 103724 - protein, 31 aa, Artificial Sequence
  Description of Artificial Sequence: Synthetic polypeptide
DSEEIRTTNPVSYEAYGSVTCFNLSQGVGQT

SEQ ID NO: 103725 - protein, 33 aa, Artificial Sequence
  Description of Artificial Sequence: Synthetic polypeptide
DDSEIRTTNPVSTEGYGSVSSATAGNSRNGNPR

SEQ ID NO: 103726 - protein, 31 aa, Artificial Sequence
  Description of Artificial Sequence: Synthetic polypeptide
DDSEIRTTNPVSTEPYGNISMEDIQSRNGNR

SEQ ID NO: 103727 - protein, 28 aa, Artificial Sequence
  Description of Artificial Sequence: Synthetic peptide
YEEEIASVNPVCTEQYGVVCDPTQSGNQ

SEQ ID NO: 103728 - protein, 33 aa, Artificial Sequence
  Description of Artificial Sequence: Synthetic polypeptide
DEEEISTTNPVATEQYGCVSNTPHQENFGSDQL

SEQ ID NO: 103729 - protein, 28 aa, Artificial Sequence
  Description of Artificial Sequence: Synthetic peptide
AENEIACTNPVATEQWGDASENEMRGGA

SEQ ID NO: 103730 - protein, 31 aa, Artificial Sequence
  Description of Artificial Sequence: Synthetic polypeptide
YEEEIASVNPVCTEQYGVVCSGDNLQDSGNQ

SEQ ID NO: 103731 - protein, 32 aa, Artificial Sequence
  Description of Artificial Sequence: Synthetic polypeptide
DSEEIRTTNPVGYEQWGMVAHNDLQDRQGVDR

SEQ ID NO: 103732 - protein, 33 aa, Artificial Sequence
  Description of Artificial Sequence: Synthetic polypeptide
DSEEIRTTNPVGYECWGMVSRTNDLQDRGTGSR

SEQ ID NO: 103733 - protein, 30 aa, Artificial Sequence
  Description of Artificial Sequence: Synthetic polypeptide
AENEIACTNPVATEQWGEACENLQRGNGNA

SEQ ID NO: 103734 - protein, 32 aa, Artificial Sequence
  Description of Artificial Sequence: Synthetic polypeptide
DSEEIRTTNPVSYEQYGSTVPCFNLSQGGGEF

SEQ ID NO: 103735 - protein, 32 aa, Artificial Sequence
  Description of Artificial Sequence: Synthetic polypeptide
AEDEICATNPVATEQYGVVAVSTENLQQGVGD

SEQ ID NO: 103736 - protein, 29 aa, Artificial Sequence
  Description of Artificial Sequence: Synthetic peptide
AENEIACTNPVATEQWGEASENEQNREGR

SEQ ID NO: 103737 - protein, 33 aa, Artificial Sequence
  Description of Artificial Sequence: Synthetic polypeptide
DEEEISTTNPVATEQYGCVCSWGNHQNFNSDQA

SEQ ID NO: 103738 - protein, 33 aa, Artificial Sequence
  Description of Artificial Sequence: Synthetic polypeptide
DEEEISTTNPVATEQYGCVCSWEPQYFGSENQS

SEQ ID NO: 103739 - protein, 32 aa, Artificial Sequence
  Description of Artificial Sequence: Synthetic polypeptide
DEEEISTTNPVATEQYGCVCSWEPQNFNSDQA

SEQ ID NO: 103740 - protein, 28 aa, Artificial Sequence
  Description of Artificial Sequence: Synthetic peptide
YEEEIASVNPVCTEQYGVVSDCLQSEEL

SEQ ID NO: 103741 - protein, 34 aa, Artificial Sequence
  Description of Artificial Sequence: Synthetic polypeptide
DEEEISTTNPVATEQYGCVCSWENHNQNFGSNQS

SEQ ID NO: 103742 - protein, 30 aa, Artificial Sequence
  Description of Artificial Sequence: Synthetic polypeptide
AENEIACTNPVATEQWGEASENLQRGQGDK

SEQ ID NO: 103743 - protein, 33 aa, Artificial Sequence
  Description of Artificial Sequence: Synthetic polypeptide
DEEEISTTNPVATEQYGCVCSWELQENFGSDQD

SEQ ID NO: 103744 - protein, 30 aa, Artificial Sequence
  Description of Artificial Sequence: Synthetic polypeptide
AENEIACTNPVATEQWGEASENLQTGGGAR

SEQ ID NO: 103745 - protein, 33 aa, Artificial Sequence
  Description of Artificial Sequence: Synthetic polypeptide
DEEEISTTNPVATEQYGCVCSWELNQNFNSDQL

SEQ ID NO: 103746 - protein, 33 aa, Artificial Sequence
  Description of Artificial Sequence: Synthetic polypeptide
DEEEISTTNPVATEQYGCVCSWNHQNFGSDPQS

SEQ ID NO: 103747 - protein, 33 aa, Artificial Sequence
  Description of Artificial Sequence: Synthetic polypeptide
DDSEIRTTNPVSTEGYGSVSSATAGNMRNGNPR

SEQ ID NO: 103748 - protein, 31 aa, Artificial Sequence
  Description of Artificial Sequence: Synthetic polypeptide
DSEEISTTNPTAYEHYGEVWCINLSQSEGNR

SEQ ID NO: 103749 - protein, 29 aa, Artificial Sequence
  Description of Artificial Sequence: Synthetic peptide
AENEIACTNPVATEPYGEISMDLQQQGGR

SEQ ID NO: 103750 - protein, 32 aa, Artificial Sequence
  Description of Artificial Sequence: Synthetic polypeptide
DSQEIATTNPVATEQYGSVSATDLEDHYGEDL

SEQ ID NO: 103751 - protein, 32 aa, Artificial Sequence
  Description of Artificial Sequence: Synthetic polypeptide
DSQEIATTNPVATEQYGSVSATDLEDHEGEDL

SEQ ID NO: 103752 - protein, 35 aa, Artificial Sequence
  Description of Artificial Sequence: Synthetic polypeptide
DSPEIRTTNPVATEAYGSVVVSCIQNLSQHGGNTR

SEQ ID NO: 103753 - protein, 35 aa, Artificial Sequence
  Description of Artificial Sequence: Synthetic polypeptide
DSHEIRTTNPVATEQYGCVCSTNELSGKTEGNNRG

SEQ ID NO: 103754 - protein, 33 aa, Artificial Sequence
  Description of Artificial Sequence: Synthetic polypeptide
DDSEIRTTNPVATEQYGSVISAYHLNQNRVDDV

SEQ ID NO: 103755 - protein, 30 aa, Artificial Sequence
  Description of Artificial Sequence: Synthetic polypeptide
YEEEIASVNPVCTEQYGTVCSADNPQSGND

SEQ ID NO: 103756 - protein, 33 aa, Artificial Sequence
  Description of Artificial Sequence: Synthetic polypeptide
DSGEIRTTNPVAYEQYGSTVCATNMLSQTGMHL

SEQ ID NO: 103757 - protein, 31 aa, Artificial Sequence
  Description of Artificial Sequence: Synthetic polypeptide
YEEEIASVNPVCTEQYGTVSATNLVESEGNQ

SEQ ID NO: 103758 - protein, 34 aa, Artificial Sequence
  Description of Artificial Sequence: Synthetic polypeptide
DDSEIRTTNPVATEQYGSVISTYLNQNRVQDDVQ

SEQ ID NO: 103759 - protein, 35 aa, Artificial Sequence
  Description of Artificial Sequence: Synthetic polypeptide
DSGEIRTTNPVATEQYGSVVVSCIQNDSQHGGNTR

SEQ ID NO: 103760 - protein, 33 aa, Artificial Sequence
  Description of Artificial Sequence: Synthetic polypeptide
DSGEIRTTNPVATEQYGSVTTVNKLELMGDGQQ

SEQ ID NO: 103761 - protein, 31 aa, Artificial Sequence
  Description of Artificial Sequence: Synthetic polypeptide
AENEIACTNPVATEQYGETASEENLQERGPI

SEQ ID NO: 103762 - protein, 33 aa, Artificial Sequence
  Description of Artificial Sequence: Synthetic polypeptide
DSGEIRTTNPVATEQYGSVQCQASLSIRVGNNT

SEQ ID NO: 103763 - protein, 31 aa, Artificial Sequence
  Description of Artificial Sequence: Synthetic polypeptide
AENEIACTNPVATEQYGESSSNLQRFGSGQS

SEQ ID NO: 103764 - protein, 33 aa, Artificial Sequence
  Description of Artificial Sequence: Synthetic polypeptide
DSGEIRTTNPVATEAYGSVVSSNMLSDDGTMYR

SEQ ID NO: 103765 - protein, 35 aa, Artificial Sequence
  Description of Artificial Sequence: Synthetic polypeptide
DDSEIRTTNPVATEQYGSVSSATAGPNMRNGMNPR

SEQ ID NO: 103766 - protein, 33 aa, Artificial Sequence
  Description of Artificial Sequence: Synthetic polypeptide
DSGEIRSTNPVAYEQWGSIVSCTNDQRTGGNNN

SEQ ID NO: 103767 - protein, 32 aa, Artificial Sequence
  Description of Artificial Sequence: Synthetic polypeptide
DSEEISTTNPVAYTQWGSTVSTNPSMQGGNQI

SEQ ID NO: 103768 - protein, 29 aa, Artificial Sequence
  Description of Artificial Sequence: Synthetic peptide
YEEEIASVNPVCTEQYGVVADNLQSGPYQ

SEQ ID NO: 103769 - protein, 32 aa, Artificial Sequence
  Description of Artificial Sequence: Synthetic polypeptide
DDSEIRTTNPVATEQYGSVSYENEEDGSEQQS

SEQ ID NO: 103770 - protein, 32 aa, Artificial Sequence
  Description of Artificial Sequence: Synthetic polypeptide
DSEEISTTNPVAYTQWGSTVSTNPSGRGGNGS

SEQ ID NO: 103771 - protein, 32 aa, Artificial Sequence
  Description of Artificial Sequence: Synthetic polypeptide
DSEEISTTNPVAYTAWGISTVSTNPSMRGGNR

SEQ ID NO: 103772 - protein, 32 aa, Artificial Sequence
  Description of Artificial Sequence: Synthetic polypeptide
DSEEISTTNPVAYDQWGSTVSTNPSMRGGNEI

SEQ ID NO: 103773 - protein, 32 aa, Artificial Sequence
  Description of Artificial Sequence: Synthetic polypeptide
DEEEISTTNPVATEQYGCVCSWELINFGSDQS

SEQ ID NO: 103774 - protein, 33 aa, Artificial Sequence
  Description of Artificial Sequence: Synthetic polypeptide
DEYEIATTNPVATEQYGSVSATLDLEDHEGEDL

SEQ ID NO: 103775 - protein, 34 aa, Artificial Sequence
  Description of Artificial Sequence: Synthetic polypeptide
DEEEISTTNPVATEQYGCVCSWELDQNFGSENQS

SEQ ID NO: 103776 - protein, 32 aa, Artificial Sequence
  Description of Artificial Sequence: Synthetic polypeptide
DEEEISTTNPVATEQYGCVCSWEHQHFNSDQS

SEQ ID NO: 103777 - protein, 30 aa, Artificial Sequence
  Description of Artificial Sequence: Synthetic polypeptide
AEDEICATNPVATEQYGVVAVENLQQGDGD

SEQ ID NO: 103778 - protein, 30 aa, Artificial Sequence
  Description of Artificial Sequence: Synthetic polypeptide
AENEIACTNPVATEQYGCACSWNPQRFGGQ

SEQ ID NO: 103779 - protein, 31 aa, Artificial Sequence
  Description of Artificial Sequence: Synthetic polypeptide
AENEIACTNPVATEQYGCASANLQEAGGQRP

SEQ ID NO: 103780 - protein, 31 aa, Artificial Sequence
  Description of Artificial Sequence: Synthetic polypeptide
AENEIACTNPVATEQYGCASANLQEDDGGQR

SEQ ID NO: 103781 - protein, 33 aa, Artificial Sequence
  Description of Artificial Sequence: Synthetic polypeptide
DEEEISTTNPVATEQYGCVCSTNHQNFSSEPQS

SEQ ID NO: 103782 - protein, 34 aa, Artificial Sequence
  Description of Artificial Sequence: Synthetic polypeptide
DEVEIRTTNPVATEQYGSVTDDNNDQNEGGNDQE

SEQ ID NO: 103783 - protein, 30 aa, Artificial Sequence
  Description of Artificial Sequence: Synthetic polypeptide
DDSEVACTNPVATEGYGNVSANTIQRVGQR

SEQ ID NO: 103784 - protein, 30 aa, Artificial Sequence
  Description of Artificial Sequence: Synthetic polypeptide
DSEEIRTTNPVGTEQWGGCCATNLQDPDEH

SEQ ID NO: 103785 - protein, 31 aa, Artificial Sequence
  Description of Artificial Sequence: Synthetic polypeptide
DSEEIRTTNPVGTEQWGGCCATNLQDPDDNQ

SEQ ID NO: 103786 - protein, 29 aa, Artificial Sequence
  Description of Artificial Sequence: Synthetic peptide
AENEIACTNPVATEQYGCASWELQNFGGQ

SEQ ID NO: 103787 - protein, 32 aa, Artificial Sequence
  Description of Artificial Sequence: Synthetic polypeptide
AEDEICATNPVATEQYGVVAVSENLNQQGGND

SEQ ID NO: 103788 - protein, 32 aa, Artificial Sequence
  Description of Artificial Sequence: Synthetic polypeptide
AENEIACTNPVATEQYGEISCENSLSQRGGGR

SEQ ID NO: 103789 - protein, 35 aa, Artificial Sequence
  Description of Artificial Sequence: Synthetic polypeptide
DEVEIRTTNPVATEQYGSVYSDMDTGGQGGEQNEQ

SEQ ID NO: 103790 - protein, 34 aa, Artificial Sequence
  Description of Artificial Sequence: Synthetic polypeptide
DEEEISTTNPVATEQYGCVCSTNHNQFFISENQT

SEQ ID NO: 103791 - protein, 33 aa, Artificial Sequence
  Description of Artificial Sequence: Synthetic polypeptide
DSEEIRTTNPVGTEQWGCVCSTGNHQRFGSVQS

SEQ ID NO: 103792 - protein, 31 aa, Artificial Sequence
  Description of Artificial Sequence: Synthetic polypeptide
DSEEIRTTNPVGTEQWGCVCSTELQNFISVQ

SEQ ID NO: 103793 - protein, 34 aa, Artificial Sequence
  Description of Artificial Sequence: Synthetic polypeptide
DEEEISTTNPVATEQYGCVCSTNHNQENFGSEQI

SEQ ID NO: 103794 - protein, 31 aa, Artificial Sequence
  Description of Artificial Sequence: Synthetic polypeptide
DSEEIRTTNPVGTEQWGCVCSTEDQNFGSDQ

SEQ ID NO: 103795 - protein, 34 aa, Artificial Sequence
  Description of Artificial Sequence: Synthetic polypeptide
DEEEISTTNPVATEQYGCVCSTNHNENFGSNNQS

SEQ ID NO: 103796 - protein, 33 aa, Artificial Sequence
  Description of Artificial Sequence: Synthetic polypeptide
DSEEIRTTNPVGTEQWGCVARTIDLQDRNGDVR

SEQ ID NO: 103797 - protein, 30 aa, Artificial Sequence
  Description of Artificial Sequence: Synthetic polypeptide
AENEIACTNPVATEQYGCEASEVLQRGDGQ

SEQ ID NO: 103798 - protein, 31 aa, Artificial Sequence
  Description of Artificial Sequence: Synthetic polypeptide
AENEIACTNPVATEQYGCFCSWGNLQRFGGQ

SEQ ID NO: 103799 - protein, 34 aa, Artificial Sequence
  Description of Artificial Sequence: Synthetic polypeptide
DEVEIRTTNPVATEQYGSVVTNKHSSETPMGSRF

SEQ ID NO: 103800 - protein, 31 aa, Artificial Sequence
  Description of Artificial Sequence: Synthetic polypeptide
DDSEIVTTNPVSTEGYGTVSATDGPQRVGND

SEQ ID NO: 103801 - protein, 31 aa, Artificial Sequence
  Description of Artificial Sequence: Synthetic polypeptide
AEDEICATNPVATEQYGVVAVSENLQQGGDD

SEQ ID NO: 103802 - protein, 32 aa, Artificial Sequence
  Description of Artificial Sequence: Synthetic polypeptide
AEDEICATNPVATEQYGVVAVSENLQSGNGGD

SEQ ID NO: 103803 - protein, 33 aa, Artificial Sequence
  Description of Artificial Sequence: Synthetic polypeptide
DEEEISTTNPVATEQYGCVCSWEHQFFGSDNQS

SEQ ID NO: 103804 - protein, 33 aa, Artificial Sequence
  Description of Artificial Sequence: Synthetic polypeptide
DEEEISTTNPVATEQYGCVCSWEDLQNFNSNQS

SEQ ID NO: 103805 - protein, 28 aa, Artificial Sequence
  Description of Artificial Sequence: Synthetic peptide
YEEEIASVNPVCTEQYGVVSDDQQSGHQ

SEQ ID NO: 103806 - protein, 29 aa, Artificial Sequence
  Description of Artificial Sequence: Synthetic peptide
AENEIACTNPVATEQWGEAYENLDRGEGR

SEQ ID NO: 103807 - protein, 33 aa, Artificial Sequence
  Description of Artificial Sequence: Synthetic polypeptide
DEEEISTTNPVATEQYGCVCSTYDQENFGSEQG

SEQ ID NO: 103808 - protein, 30 aa, Artificial Sequence
  Description of Artificial Sequence: Synthetic polypeptide
AENEIACTNPVATEQWGEHSENLQAGGGAR

SEQ ID NO: 103809 - protein, 34 aa, Artificial Sequence
  Description of Artificial Sequence: Synthetic polypeptide
DEEEISTTNPVATEQYGCVCSTYDLQENFGSEQA

SEQ ID NO: 103810 - protein, 33 aa, Artificial Sequence
  Description of Artificial Sequence: Synthetic polypeptide
DEEEISTTNPVATEQYGCVCSTWEHQNFGSDQS

SEQ ID NO: 103811 - protein, 29 aa, Artificial Sequence
  Description of Artificial Sequence: Synthetic peptide
AENEIACTNPVATEQWGEVSENLMNREGA

SEQ ID NO: 103812 - protein, 34 aa, Artificial Sequence
  Description of Artificial Sequence: Synthetic polypeptide
DEEEISTTNPVATEQYGCVCSTTNHNQNFGSDQS

SEQ ID NO: 103813 - protein, 34 aa, Artificial Sequence
  Description of Artificial Sequence: Synthetic polypeptide
DEEEISTTNPVATEQYGCVCSTTGEDQSFGSNQS

SEQ ID NO: 103814 - protein, 33 aa, Artificial Sequence
  Description of Artificial Sequence: Synthetic polypeptide
DEEEISTTNPVATEQYGCVCSTTEHQNFGSQQV

SEQ ID NO: 103815 - protein, 33 aa, Artificial Sequence
  Description of Artificial Sequence: Synthetic polypeptide
DEEEISTTNPVATEQYGCVCSTTEDQGFNSNQS

SEQ ID NO: 103816 - protein, 35 aa, Artificial Sequence
  Description of Artificial Sequence: Synthetic polypeptide
DEEEISTTNPVATEQYGCVCSTTEDLQERFGSEQA

SEQ ID NO: 103817 - protein, 30 aa, Artificial Sequence
  Description of Artificial Sequence: Synthetic polypeptide
AENEIACTNPVATEQWGHASENLQGSGGAR

SEQ ID NO: 103818 - protein, 29 aa, Artificial Sequence
  Description of Artificial Sequence: Synthetic peptide
AENEIACTNPVATEQWGYASENLQHGGDK

SEQ ID NO: 103819 - protein, 28 aa, Artificial Sequence
  Description of Artificial Sequence: Synthetic peptide
YEEEIASVNPVCTEQYGVVSDNEMSGDQ

SEQ ID NO: 103820 - protein, 34 aa, Artificial Sequence
  Description of Artificial Sequence: Synthetic polypeptide
DEEEISTTNPVATEQYGCVCSTPEPQERFNSEQS

SEQ ID NO: 103821 - protein, 30 aa, Artificial Sequence
  Description of Artificial Sequence: Synthetic polypeptide
YEEEIASVNPVCTEQYGVVSDNIQQQNGNQ

SEQ ID NO: 103822 - protein, 35 aa, Artificial Sequence
  Description of Artificial Sequence: Synthetic polypeptide
DEEEISTTNPVATEQYGCVCSTNSLFQEHFGSEFM

SEQ ID NO: 103823 - protein, 31 aa, Artificial Sequence
  Description of Artificial Sequence: Synthetic polypeptide
AENEIACTNPVATEQYGCACSWNLNQRFGQQ

SEQ ID NO: 103824 - protein, 30 aa, Artificial Sequence
  Description of Artificial Sequence: Synthetic polypeptide
AENEIACTNPVATEQYGCACSWNLNQYGDQ

SEQ ID NO: 103825 - protein, 31 aa, Artificial Sequence
  Description of Artificial Sequence: Synthetic polypeptide
AENEIACTNPVATEQYGCACSWNLQRFGGDQ

SEQ ID NO: 103826 - protein, 33 aa, Artificial Sequence
  Description of Artificial Sequence: Synthetic polypeptide
DEEEISTTNPVATEQYGCVCSWEHQNFGSNTQL

SEQ ID NO: 103827 - protein, 33 aa, Artificial Sequence
  Description of Artificial Sequence: Synthetic polypeptide
DEEEISTTNPVATEQYGCVCSTEHQNFGSDTQA

SEQ ID NO: 103828 - protein, 28 aa, Artificial Sequence
  Description of Artificial Sequence: Synthetic peptide
YEEEIATTNPVATEQYGEAPEVCQHEDK

SEQ ID NO: 103829 - protein, 34 aa, Artificial Sequence
  Description of Artificial Sequence: Synthetic polypeptide
DEEEISTTNPVATEQYGCVCSTEHQEFFGSNNQT

SEQ ID NO: 103830 - protein, 35 aa, Artificial Sequence
  Description of Artificial Sequence: Synthetic polypeptide
DEEEISTTNPVATEQYGCVCSMTGNLQNFGSDFQA

SEQ ID NO: 103831 - protein, 35 aa, Artificial Sequence
  Description of Artificial Sequence: Synthetic polypeptide
DEEEISTTNPVATEQYGCVCSMTGNHQNFGSDNQN

SEQ ID NO: 103832 - protein, 30 aa, Artificial Sequence
  Description of Artificial Sequence: Synthetic polypeptide
AEDEIASTNPVAYEQWGEASENLQRGAGER

SEQ ID NO: 103833 - protein, 31 aa, Artificial Sequence
  Description of Artificial Sequence: Synthetic polypeptide
AEDEIACTNPVAYEQYGEISCENELQRVGGR

SEQ ID NO: 103834 - protein, 33 aa, Artificial Sequence
  Description of Artificial Sequence: Synthetic polypeptide
DEYEIRTTNPVATEQYGSVSGPTLGIEVENIVA

SEQ ID NO: 103835 - protein, 30 aa, Artificial Sequence
  Description of Artificial Sequence: Synthetic polypeptide
AENEIACTNPVATEQYGEASSEPNGQRGGV

SEQ ID NO: 103836 - protein, 33 aa, Artificial Sequence
  Description of Artificial Sequence: Synthetic polypeptide
DEEEISTTNPVATEQYGCVCSMTEHQYFGSQQV

SEQ ID NO: 103837 - protein, 36 aa, Artificial Sequence
  Description of Artificial Sequence: Synthetic polypeptide
DEYEIRTTNPVATEQYGSVSSTTPAGPNMRNGMNRV

SEQ ID NO: 103838 - protein, 36 aa, Artificial Sequence
  Description of Artificial Sequence: Synthetic polypeptide
DEYEIRTTNPVATEQYGSVSTDIMLEELRNGNEEQF

SEQ ID NO: 103839 - protein, 34 aa, Artificial Sequence
  Description of Artificial Sequence: Synthetic polypeptide
DEEEISTTNPVATEQYGCVCSMTEHQENFGSNLV

SEQ ID NO: 103840 - protein, 33 aa, Artificial Sequence
  Description of Artificial Sequence: Synthetic polypeptide
DEEEISTTNPVATEQYGCVCSNSNHQNFNSQQA

SEQ ID NO: 103841 - protein, 34 aa, Artificial Sequence
  Description of Artificial Sequence: Synthetic polypeptide
DEEEISTTNPVATEQYGCVCSMSNHQEFFGSNQD

SEQ ID NO: 103842 - protein, 35 aa, Artificial Sequence
  Description of Artificial Sequence: Synthetic polypeptide
DEEEISTTNPVATEQYGCVCSDTELQENFGSENQS

SEQ ID NO: 103843 - protein, 28 aa, Artificial Sequence
  Description of Artificial Sequence: Synthetic peptide
AENEIACTNPVATEQYGEAPENCQHGEK

SEQ ID NO: 103844 - protein, 33 aa, Artificial Sequence
  Description of Artificial Sequence: Synthetic polypeptide
DEEEISTTNPVATEQYGCVCSDTEHQYFNSDQS

SEQ ID NO: 103845 - protein, 34 aa, Artificial Sequence
  Description of Artificial Sequence: Synthetic polypeptide
DSECIATTNPVAYEQYGESVSTPTLSQRPGGNYV

SEQ ID NO: 103846 - protein, 35 aa, Artificial Sequence
  Description of Artificial Sequence: Synthetic polypeptide
DEYEIRTTNPVATEQYGSVSTISLEELDNGNEESF

SEQ ID NO: 103847 - protein, 32 aa, Artificial Sequence
  Description of Artificial Sequence: Synthetic polypeptide
DEEEISTTNPVATEQYGCVCQTEHQYFNSEQS

SEQ ID NO: 103848 - protein, 32 aa, Artificial Sequence
  Description of Artificial Sequence: Synthetic polypeptide
DEEEISTTNPVATEQYGCVCQTEHQENFGSQQ

SEQ ID NO: 103849 - protein, 33 aa, Artificial Sequence
  Description of Artificial Sequence: Synthetic polypeptide
DEEEISTTNPVATEQYGCVCQTEDQENFGSNQS

SEQ ID NO: 103850 - protein, 31 aa, Artificial Sequence
  Description of Artificial Sequence: Synthetic polypeptide
DEEEISTTNPVATEQYGCVCGTEHQHNSEQP

SEQ ID NO: 103851 - protein, 29 aa, Artificial Sequence
  Description of Artificial Sequence: Synthetic peptide
AENEIACTNPVATEQYGEASPTLQHSGGE

SEQ ID NO: 103852 - protein, 34 aa, Artificial Sequence
  Description of Artificial Sequence: Synthetic polypeptide
DEEEISTTNPVATEQYGCVCSMSELQNFGSNNQN

SEQ ID NO: 103853 - protein, 34 aa, Artificial Sequence
  Description of Artificial Sequence: Synthetic polypeptide
DEYEIRTTNPVATEQYGSVNSTEYNMNRSTQEPL

SEQ ID NO: 103854 - protein, 33 aa, Artificial Sequence
  Description of Artificial Sequence: Synthetic polypeptide
DEEEISTTNPVATEQYGCVCSNSPLQNFGSEQA

SEQ ID NO: 103855 - protein, 34 aa, Artificial Sequence
  Description of Artificial Sequence: Synthetic polypeptide
DEYEIRTTNPVATEQYGSVMTILEELHNGNEEVQ

SEQ ID NO: 103856 - protein, 32 aa, Artificial Sequence
  Description of Artificial Sequence: Synthetic polypeptide
DEYEIRTTNPVATEQYGCVSYDLVIFRTQDDQ

SEQ ID NO: 103857 - protein, 34 aa, Artificial Sequence
  Description of Artificial Sequence: Synthetic polypeptide
YEEEIDTTNPVLTEQYGSVSITNFQQTSGHVDRL

SEQ ID NO: 103858 - protein, 32 aa, Artificial Sequence
  Description of Artificial Sequence: Synthetic polypeptide
AEDEIATTNPVAYEKWGSVSTTNLQGDGGLRQ

SEQ ID NO: 103859 - protein, 35 aa, Artificial Sequence
  Description of Artificial Sequence: Synthetic polypeptide
DEEEISTTNPVATEQYGCVCSNTGELQHFGSENQS

SEQ ID NO: 103860 - protein, 35 aa, Artificial Sequence
  Description of Artificial Sequence: Synthetic polypeptide
DEEEISTTNPVATEQYGCVCSNTGELFQGFGSNQA

SEQ ID NO: 103861 - protein, 31 aa, Artificial Sequence
  Description of Artificial Sequence: Synthetic polypeptide
YEEEIGCTNPVATEQYGYSDSTSNSVAREHQ

SEQ ID NO: 103862 - protein, 34 aa, Artificial Sequence
  Description of Artificial Sequence: Synthetic polypeptide
DEEEISTTNPVATEQYGCVCSNTGEHQRGGSDQS

SEQ ID NO: 103863 - protein, 34 aa, Artificial Sequence
  Description of Artificial Sequence: Synthetic polypeptide
DEEEISTTNPVATEQYGCVCSNTEPQNFGSENQS

SEQ ID NO: 103864 - protein, 30 aa, Artificial Sequence
  Description of Artificial Sequence: Synthetic polypeptide
DSEEIATTNPVGTEQWGGCCATNLQDPDGR

SEQ ID NO: 103865 - protein, 34 aa, Artificial Sequence
  Description of Artificial Sequence: Synthetic polypeptide
DEYEIRTTNPVATEQYGSCSTNNLDTGHISMQEM

SEQ ID NO: 103866 - protein, 32 aa, Artificial Sequence
  Description of Artificial Sequence: Synthetic polypeptide
AENEIACTNPVATEQYGEASSTEALQRNGMNV

SEQ ID NO: 103867 - protein, 33 aa, Artificial Sequence
  Description of Artificial Sequence: Synthetic polypeptide
DEEEISTTNPVATEQYGCVCSNTELQSFFSEQA

SEQ ID NO: 103868 - protein, 33 aa, Artificial Sequence
  Description of Artificial Sequence: Synthetic polypeptide
DEYEIRTTNPVATEQYGSSSSYNDLEQNSEDGI

SEQ ID NO: 103869 - protein, 33 aa, Artificial Sequence
  Description of Artificial Sequence: Synthetic polypeptide
DSEEIATTNPVGTEQWGCVARTNDLQDRNGSVR

SEQ ID NO: 103870 - protein, 34 aa, Artificial Sequence
  Description of Artificial Sequence: Synthetic polypeptide
DEEEISTTNPVATEQYGCVCSNTELQNFNSQTQS

SEQ ID NO: 103871 - protein, 36 aa, Artificial Sequence
  Description of Artificial Sequence: Synthetic polypeptide
DEYEIRTTNPVATEQYGSVCSTIALEELRNGNEEVF

SEQ ID NO: 103872 - protein, 33 aa, Artificial Sequence
  Description of Artificial Sequence: Synthetic polypeptide
DEEEISTTNPVATEQYGCVCSNTELINFGSEQQ

SEQ ID NO: 103873 - protein, 35 aa, Artificial Sequence
  Description of Artificial Sequence: Synthetic polypeptide
DEEEISTTNPVATEQYGCVCSNTELDQENFGSNQD

SEQ ID NO: 103874 - protein, 33 aa, Artificial Sequence
  Description of Artificial Sequence: Synthetic polypeptide
DEEEISTTNPVATEQYGCVCSNTEHQYFGSQQT

SEQ ID NO: 103875 - protein, 34 aa, Artificial Sequence
  Description of Artificial Sequence: Synthetic polypeptide
DEEEISTTNPVATEQYGCVCSNTEHNQNFGSERA

SEQ ID NO: 103876 - protein, 35 aa, Artificial Sequence
  Description of Artificial Sequence: Synthetic polypeptide
DEEEISTTNPVATEQYGCVCSNTEDLQAFGSENQD

SEQ ID NO: 103877 - protein, 35 aa, Artificial Sequence
  Description of Artificial Sequence: Synthetic polypeptide
DEYEIRTTNPVATEQYGSVISVTHDLQTGFEEQYE

SEQ ID NO: 103878 - protein, 36 aa, Artificial Sequence
  Description of Artificial Sequence: Synthetic polypeptide
DEYEIRTTNPVATEQYGSVISVTWHDLQTGESEQRV

SEQ ID NO: 103879 - protein, 33 aa, Artificial Sequence
  Description of Artificial Sequence: Synthetic polypeptide
DEEEISTTNPVATEQYGCTCSWNELQNFGSDQS

SEQ ID NO: 103880 - protein, 32 aa, Artificial Sequence
  Description of Artificial Sequence: Synthetic polypeptide
AEDEIATTNPVAYEPWGSVSTTNGAQDGNLRQ

SEQ ID NO: 103881 - protein, 34 aa, Artificial Sequence
  Description of Artificial Sequence: Synthetic polypeptide
DEEEISTTNPVATEQYGCSCSWPNDLQYFDSNQS

SEQ ID NO: 103882 - protein, 35 aa, Artificial Sequence
  Description of Artificial Sequence: Synthetic polypeptide
DSDEIRTTNPVATEQYGSVVVSCIQNPSQHGGNYR

SEQ ID NO: 103883 - protein, 33 aa, Artificial Sequence
  Description of Artificial Sequence: Synthetic polypeptide
DEEEISTTNPCATEQYGQCVCSTELQGFGSEQS

SEQ ID NO: 103884 - protein, 33 aa, Artificial Sequence
  Description of Artificial Sequence: Synthetic polypeptide
DEEEISTTNPCATEQYGCVCPTNTQENFGSDNQ

SEQ ID NO: 103885 - protein, 35 aa, Artificial Sequence
  Description of Artificial Sequence: Synthetic polypeptide
DEYEIRTTNPVATEQYGSVSWTYLDGEQNSNEDGW

SEQ ID NO: 103886 - protein, 33 aa, Artificial Sequence
  Description of Artificial Sequence: Synthetic polypeptide
DEEEISTTNPCATEQYGCVCPTNLQEYFGSETQ

SEQ ID NO: 103887 - protein, 28 aa, Artificial Sequence
  Description of Artificial Sequence: Synthetic peptide
AENEIACTNPVATEQYGEAPEVCQHGER

SEQ ID NO: 103888 - protein, 28 aa, Artificial Sequence
  Description of Artificial Sequence: Synthetic peptide
AENEIACTNPVATEQYGEAPEVCQHGGR

SEQ ID NO: 103889 - protein, 35 aa, Artificial Sequence
  Description of Artificial Sequence: Synthetic polypeptide
DEYEIRTTNPVATEQYGSVTWTYNDLEQNSNEDGP

SEQ ID NO: 103890 - protein, 34 aa, Artificial Sequence
  Description of Artificial Sequence: Synthetic polypeptide
DEYEIRTTNPVATEQYGSVWVTPDTQDSGQIHRI

SEQ ID NO: 103891 - protein, 33 aa, Artificial Sequence
  Description of Artificial Sequence: Synthetic polypeptide
DEEEISTTNPCATEQYGCVCPTNLAENFGSNNQ

SEQ ID NO: 103892 - protein, 35 aa, Artificial Sequence
  Description of Artificial Sequence: Synthetic polypeptide
DEEEISTTNPCATEQYGCVCPTNDLQERFGSNTQA

SEQ ID NO: 103893 - protein, 34 aa, Artificial Sequence
  Description of Artificial Sequence: Synthetic polypeptide
DEEEISTTNPIAYEQYGSVVCTGNELSGQGDNQR

SEQ ID NO: 103894 - protein, 33 aa, Artificial Sequence
  Description of Artificial Sequence: Synthetic polypeptide
DSAEIRSTNPVAYEQYGSTVSTGLSQARNGGQE

SEQ ID NO: 103895 - protein, 32 aa, Artificial Sequence
  Description of Artificial Sequence: Synthetic polypeptide
DEYEIRTTNPVATERWGCVPSCTNGSDLGNNL

SEQ ID NO: 103896 - protein, 32 aa, Artificial Sequence
  Description of Artificial Sequence: Synthetic polypeptide
DEEEISTTNPCATEGYGCCCSTNLAYFGSNQS

SEQ ID NO: 103897 - protein, 34 aa, Artificial Sequence
  Description of Artificial Sequence: Synthetic polypeptide
DEYEIRTTNPVATERWGCVPSCTNGSQEGENNRE

SEQ ID NO: 103898 - protein, 31 aa, Artificial Sequence
  Description of Artificial Sequence: Synthetic polypeptide
DSAEIRSTNPVAYEQWGSISYTNHQRTGGKE

SEQ ID NO: 103899 - protein, 33 aa, Artificial Sequence
  Description of Artificial Sequence: Synthetic polypeptide
DEEEISCTNPVATEQYGCVCSTGELQNFNSNQS

SEQ ID NO: 103900 - protein, 33 aa, Artificial Sequence
  Description of Artificial Sequence: Synthetic polypeptide
DEYEIRTTNPVATEVWGSCSCINEPQDREGENG

SEQ ID NO: 103901 - protein, 30 aa, Artificial Sequence
  Description of Artificial Sequence: Synthetic polypeptide
DSADIACTNPVATEQYGCVATNHQRSMNDL

SEQ ID NO: 103902 - protein, 32 aa, Artificial Sequence
  Description of Artificial Sequence: Synthetic polypeptide
YEEEIRCTNPAATEQYGSVSSENGMGGGQNIG

SEQ ID NO: 103903 - protein, 36 aa, Artificial Sequence
  Description of Artificial Sequence: Synthetic polypeptide
DEEEISATTNPVATEQYMSVVTSMTPNPQRSGSEPR

SEQ ID NO: 103904 - protein, 31 aa, Artificial Sequence
  Description of Artificial Sequence: Synthetic polypeptide
YEEEIRCTNPAATEQYGSVVSEGGMGGNGEE

SEQ ID NO: 103905 - protein, 32 aa, Artificial Sequence
  Description of Artificial Sequence: Synthetic polypeptide
DEYEIRTTNPVATERWGCVPNCTNGSHEGNNR

SEQ ID NO: 103906 - protein, 33 aa, Artificial Sequence
  Description of Artificial Sequence: Synthetic polypeptide
DEEEISTTNPMATETYGSVPYTPDPQHAGENFR

SEQ ID NO: 103907 - protein, 33 aa, Artificial Sequence
  Description of Artificial Sequence: Synthetic polypeptide
DEEEISTTNPMATETYGSVVTPDPQHAGENFRY

SEQ ID NO: 103908 - protein, 30 aa, Artificial Sequence
  Description of Artificial Sequence: Synthetic polypeptide
DDSEVACTNPVSTEQYGSVAAETIQSRGNR

SEQ ID NO: 103909 - protein, 35 aa, Artificial Sequence
  Description of Artificial Sequence: Synthetic polypeptide
DSDEIRTTNPVATEQYGSVVVSCIQNLSQHGTNTL

SEQ ID NO: 103910 - protein, 36 aa, Artificial Sequence
  Description of Artificial Sequence: Synthetic polypeptide
DSDEIRTTNPVATEQYGSVVVSCIANSLSQHGGNTR

SEQ ID NO: 103911 - protein, 31 aa, Artificial Sequence
  Description of Artificial Sequence: Synthetic polypeptide
AENEIACTNPVATEQYGEASNENLQPKGGYR

SEQ ID NO: 103912 - protein, 33 aa, Artificial Sequence
  Description of Artificial Sequence: Synthetic polypeptide
DEEEISTTNPVATEQYGCAVCSWELQNFNSDQS

SEQ ID NO: 103913 - protein, 34 aa, Artificial Sequence
  Description of Artificial Sequence: Synthetic polypeptide
DSDEIRTTNPVATEQYGSVVSCIQNLSAHGGQTR

SEQ ID NO: 103914 - protein, 36 aa, Artificial Sequence
  Description of Artificial Sequence: Synthetic polypeptide
DSDEIRTTNPVATEQYGSVVPSCIQNLSQHDGGNQR

SEQ ID NO: 103915 - protein, 36 aa, Artificial Sequence
  Description of Artificial Sequence: Synthetic polypeptide
DEEEISTTNPVATEQWGHSNVSYTDNYLQERPGETF

SEQ ID NO: 103916 - protein, 33 aa, Artificial Sequence
  Description of Artificial Sequence: Synthetic polypeptide
DEEEISTTNPVATEQWGCVCSNTELQNFGSEQA

SEQ ID NO: 103917 - protein, 33 aa, Artificial Sequence
  Description of Artificial Sequence: Synthetic polypeptide
DSDEIRTTNPVATEQYGETTSCTNWHSQRGGDS

SEQ ID NO: 103918 - protein, 34 aa, Artificial Sequence
  Description of Artificial Sequence: Synthetic polypeptide
DSDEIRTTNPVATEGYGSVVSCIQNLSQHGGNTH

SEQ ID NO: 103919 - protein, 32 aa, Artificial Sequence
  Description of Artificial Sequence: Synthetic polypeptide
DEEEISTTNPVATEGYGCVCSTEHQNFISNQS

SEQ ID NO: 103920 - protein, 33 aa, Artificial Sequence
  Description of Artificial Sequence: Synthetic polypeptide
DEEEISTTNPVATEGYGCVCSTEEPQHFGSNQS

SEQ ID NO: 103921 - protein, 34 aa, Artificial Sequence
  Description of Artificial Sequence: Synthetic polypeptide
DEEEISTTNPVATEGYGCVCSNTNHQNFGSENQA

SEQ ID NO: 103922 - protein, 33 aa, Artificial Sequence
  Description of Artificial Sequence: Synthetic polypeptide
DEEEISTTNPVATEGYGCVCSNTELQNFNSNQS

SEQ ID NO: 103923 - protein, 32 aa, Artificial Sequence
  Description of Artificial Sequence: Synthetic polypeptide
DEEEISTTNPVATEGYGCVCSNTEHQNGSDQS

SEQ ID NO: 103924 - protein, 32 aa, Artificial Sequence
  Description of Artificial Sequence: Synthetic polypeptide
DEEEISTTNPVATEGYGCVCFTNLTNGGSDQS

SEQ ID NO: 103925 - protein, 34 aa, Artificial Sequence
  Description of Artificial Sequence: Synthetic polypeptide
YEEEIKTTNPVLWEQYGSVSITNFQQTSGHNDRG

SEQ ID NO: 103926 - protein, 29 aa, Artificial Sequence
  Description of Artificial Sequence: Synthetic peptide
AEDEIACTNPVAYEQWGYASENLQFGGER

SEQ ID NO: 103927 - protein, 36 aa, Artificial Sequence
  Description of Artificial Sequence: Synthetic polypeptide
DEYEIRTTNPVATEQYGSVSTPIMLEELRNGNEEVG

SEQ ID NO: 103928 - protein, 34 aa, Artificial Sequence
  Description of Artificial Sequence: Synthetic polypeptide
DSDEIRATNPVATEQYGSVVSCIQNASQHGGNTR

SEQ ID NO: 103929 - protein, 34 aa, Artificial Sequence
  Description of Artificial Sequence: Synthetic polypeptide
DSAEIRTTNPVAYEQYGSTVCSTNMLSQTGMLGL

SEQ ID NO: 103930 - protein, 34 aa, Artificial Sequence
  Description of Artificial Sequence: Synthetic polypeptide
DSAEIRTTNPVAYEQYGSTVCSTGNMGSQTGMRL

SEQ ID NO: 103931 - protein, 33 aa, Artificial Sequence
  Description of Artificial Sequence: Synthetic polypeptide
DEEEISTTNPVATCQYGCVCSNTELQNFNSNQA

SEQ ID NO: 103932 - protein, 35 aa, Artificial Sequence
  Description of Artificial Sequence: Synthetic polypeptide
DSDEIRTTNPVATESYGSVVPSVIQNLSQHGGNTR

SEQ ID NO: 103933 - protein, 29 aa, Artificial Sequence
  Description of Artificial Sequence: Synthetic peptide
DDSEVASTNPVATEGYGNVAANTIQRGQR

SEQ ID NO: 103934 - protein, 34 aa, Artificial Sequence
  Description of Artificial Sequence: Synthetic polypeptide
DEEEISTTNPVATEQYGCVCSNTGELQSFGSDQQ

SEQ ID NO: 103935 - protein, 34 aa, Artificial Sequence
  Description of Artificial Sequence: Synthetic polypeptide
DEEEISTTNPVATEQYGCVCSNTGNTQNFNSEQA

SEQ ID NO: 103936 - protein, 33 aa, Artificial Sequence
  Description of Artificial Sequence: Synthetic polypeptide
DEEEISTTNPVATEQYGCVCSTEDQEHFGSQQL

SEQ ID NO: 103937 - protein, 33 aa, Artificial Sequence
  Description of Artificial Sequence: Synthetic polypeptide
DEEEISTTNPVATEQYGCVCSTEDNQNFNSDQS

SEQ ID NO: 103938 - protein, 34 aa, Artificial Sequence
  Description of Artificial Sequence: Synthetic polypeptide
DEEEISTTNPVATEQYGCVCSTEDNQFFGSNNQS

SEQ ID NO: 103939 - protein, 34 aa, Artificial Sequence
  Description of Artificial Sequence: Synthetic polypeptide
DEEEISTTNPVATEQYGCVCSTEDLQEHFGSDQF

SEQ ID NO: 103940 - protein, 33 aa, Artificial Sequence
  Description of Artificial Sequence: Synthetic polypeptide
DEEEISTTNPVATEQYGCVCSTEDHQYFGSDQG

SEQ ID NO: 103941 - protein, 29 aa, Artificial Sequence
  Description of Artificial Sequence: Synthetic peptide
AENEIACTNPVATEQYGDASENEQNREGA

SEQ ID NO: 103942 - protein, 34 aa, Artificial Sequence
  Description of Artificial Sequence: Synthetic polypeptide
YEEEIATTNPVAYEQYGSVVPSTNSHQEDTEGKR

SEQ ID NO: 103943 - protein, 34 aa, Artificial Sequence
  Description of Artificial Sequence: Synthetic polypeptide
DEEEISTTNPVATEQYGCVCSTEDHQEHSGSNQV

SEQ ID NO: 103944 - protein, 33 aa, Artificial Sequence
  Description of Artificial Sequence: Synthetic polypeptide
DEEEISTTNPVATEQYGCVCSTEDDQNFNSQQS

SEQ ID NO: 103945 - protein, 33 aa, Artificial Sequence
  Description of Artificial Sequence: Synthetic polypeptide
DEEEISTTNPVATEQYGCVCSTEDANFNSDNQS

SEQ ID NO: 103946 - protein, 33 aa, Artificial Sequence
  Description of Artificial Sequence: Synthetic polypeptide
DEYEIGTTNPVATEQYGSVCTGNAGMEGGGNGT

SEQ ID NO: 103947 - protein, 32 aa, Artificial Sequence
  Description of Artificial Sequence: Synthetic polypeptide
DEEEISTTNPVATEQYGCVCSTEDANFGSDQL

SEQ ID NO: 103948 - protein, 31 aa, Artificial Sequence
  Description of Artificial Sequence: Synthetic polypeptide
AEDEICATNPVATEQYGVVATSEDNLQQGTD

SEQ ID NO: 103949 - protein, 30 aa, Artificial Sequence
  Description of Artificial Sequence: Synthetic polypeptide
AENEIACTNPVATEQYGDASENLQNAAGGA

SEQ ID NO: 103950 - protein, 32 aa, Artificial Sequence
  Description of Artificial Sequence: Synthetic polypeptide
DEEEISTTNPVATEQYGCVCSTAHQNFPSDQG

SEQ ID NO: 103951 - protein, 33 aa, Artificial Sequence
  Description of Artificial Sequence: Synthetic polypeptide
DEEEISTTNPVATEQYGCVCSTAHQESSNSDQS

SEQ ID NO: 103952 - protein, 32 aa, Artificial Sequence
  Description of Artificial Sequence: Synthetic polypeptide
YEEEIATTNPVCTEQYGVVSATDLEDHEGNDL

SEQ ID NO: 103953 - protein, 31 aa, Artificial Sequence
  Description of Artificial Sequence: Synthetic polypeptide
AEDEICATNPVATEQYGVVASVENLQQGSGD

SEQ ID NO: 103954 - protein, 34 aa, Artificial Sequence
  Description of Artificial Sequence: Synthetic polypeptide
DEYEIGTTNPVATEQYGSVSTGNAGDEGGQNGTA

SEQ ID NO: 103955 - protein, 34 aa, Artificial Sequence
  Description of Artificial Sequence: Synthetic polypeptide
DEEEISTTNPVATEQYGCVCSTADHQNFGSDNQA

SEQ ID NO: 103956 - protein, 35 aa, Artificial Sequence
  Description of Artificial Sequence: Synthetic polypeptide
DEYEIGTTNPVATEQYGSVSTLGQLGQEEMGENGD

SEQ ID NO: 103957 - protein, 31 aa, Artificial Sequence
  Description of Artificial Sequence: Synthetic polypeptide
AEDEICATNPVATEQYGVVASENLQQLGGGD

SEQ ID NO: 103958 - protein, 31 aa, Artificial Sequence
  Description of Artificial Sequence: Synthetic polypeptide
YEEEIATTNPVCTEQYGATTSNDEDLQSGNQ

SEQ ID NO: 103959 - protein, 34 aa, Artificial Sequence
  Description of Artificial Sequence: Synthetic polypeptide
DEYEIGTTNPVATEQYGSVCSTTNAGMEGGQNGT

SEQ ID NO: 103960 - protein, 33 aa, Artificial Sequence
  Description of Artificial Sequence: Synthetic polypeptide
DEEEISTTNPVATEQYGCVCSTEDQNFGSDTQA

SEQ ID NO: 103961 - protein, 34 aa, Artificial Sequence
  Description of Artificial Sequence: Synthetic polypeptide
DEEEISTTNPVATEQYGCVCSTEEDNQFFGSNQP

SEQ ID NO: 103962 - protein, 33 aa, Artificial Sequence
  Description of Artificial Sequence: Synthetic polypeptide
DEEEISTTNPVATEQYGCVCSTEHNQYSGSEQG

SEQ ID NO: 103963 - protein, 33 aa, Artificial Sequence
  Description of Artificial Sequence: Synthetic polypeptide
DEEEISTTNPVATEQYGCVCSTEHNQYFGSQQS

SEQ ID NO: 103964 - protein, 33 aa, Artificial Sequence
  Description of Artificial Sequence: Synthetic polypeptide
DEEEISTTNPVATEQYGCVCSTEHNQYFGSDQA

SEQ ID NO: 103965 - protein, 34 aa, Artificial Sequence
  Description of Artificial Sequence: Synthetic polypeptide
DEEEISTTNPVATEQYGCVCSTEHNQSFGSNTQA

SEQ ID NO: 103966 - protein, 34 aa, Artificial Sequence
  Description of Artificial Sequence: Synthetic polypeptide
DEEEISTTNPVATEQYGCVCSTEHNQNFGSQNQT

SEQ ID NO: 103967 - protein, 32 aa, Artificial Sequence
  Description of Artificial Sequence: Synthetic polypeptide
DEYEIATTNPVATEQYGSYSSAHQIEQALANR

SEQ ID NO: 103968 - protein, 34 aa, Artificial Sequence
  Description of Artificial Sequence: Synthetic polypeptide
DEEEISTTNPVATEQYGCVCSTEHNQEGFGSENQ

SEQ ID NO: 103969 - protein, 28 aa, Artificial Sequence
  Description of Artificial Sequence: Synthetic peptide
YEEEIATTNPVATEQYGEAPEVCQHEEK

SEQ ID NO: 103970 - protein, 33 aa, Artificial Sequence
  Description of Artificial Sequence: Synthetic polypeptide
DEEEISTTNPVATEQYGCVCSTEHEQYFGSDQP

SEQ ID NO: 103971 - protein, 32 aa, Artificial Sequence
  Description of Artificial Sequence: Synthetic polypeptide
DEEEISTTNPVATEQYGCVCSTEHANFGSELA

SEQ ID NO: 103972 - protein, 32 aa, Artificial Sequence
  Description of Artificial Sequence: Synthetic polypeptide
DEYEIATTNPVATEQYGVVSATDLEDHEGEYL

SEQ ID NO: 103973 - protein, 28 aa, Artificial Sequence
  Description of Artificial Sequence: Synthetic peptide
YEEEIATTNPVATEQYGEAPEVCQHEEN

SEQ ID NO: 103974 - protein, 33 aa, Artificial Sequence
  Description of Artificial Sequence: Synthetic polypeptide
DEEEISTTNPVATEQYGCVCSTEGHQNFNSNQS

SEQ ID NO: 103975 - protein, 34 aa, Artificial Sequence
  Description of Artificial Sequence: Synthetic polypeptide
DEEEISTTNPVATEQYGCVCSTEETQNFGSENQA

SEQ ID NO: 103976 - protein, 30 aa, Artificial Sequence
  Description of Artificial Sequence: Synthetic polypeptide
AENEIACTNPVATEQYGCYCSWNLQNGGQA

SEQ ID NO: 103977 - protein, 28 aa, Artificial Sequence
  Description of Artificial Sequence: Synthetic peptide
YEEEIATTNPVATEQYGEAYEVCQHEEK

SEQ ID NO: 103978 - protein, 30 aa, Artificial Sequence
  Description of Artificial Sequence: Synthetic polypeptide
AENEIACTNPVATEQYGEASWNLNQHGSEQ

SEQ ID NO: 103979 - protein, 34 aa, Artificial Sequence
  Description of Artificial Sequence: Synthetic polypeptide
DEEEISTTNPVATEQYGCVCSTEELQHFGSDTQA

SEQ ID NO: 103980 - protein, 34 aa, Artificial Sequence
  Description of Artificial Sequence: Synthetic polypeptide
DEEEISTTNPVATEQYGCVCSTEELQENFGSELQ

SEQ ID NO: 103981 - protein, 33 aa, Artificial Sequence
  Description of Artificial Sequence: Synthetic polypeptide
DEYEICTTNPAATEQYGSVVPGNLQMGGGNEDD

SEQ ID NO: 103982 - protein, 33 aa, Artificial Sequence
  Description of Artificial Sequence: Synthetic polypeptide
DSEEIRSTNPVAYEQWGSISCTNNHQRTGGNEN

SEQ ID NO: 103983 - protein, 33 aa, Artificial Sequence
  Description of Artificial Sequence: Synthetic polypeptide
DEEEISTTNPVATEQYGCVCSTEEHQSFGSDQG

SEQ ID NO: 103984 - protein, 34 aa, Artificial Sequence
  Description of Artificial Sequence: Synthetic polypeptide
DEEEISTTNPVATEQYGCVCSTEEHQGFGSDNQS

SEQ ID NO: 103985 - protein, 31 aa, Artificial Sequence
  Description of Artificial Sequence: Synthetic polypeptide
AEDEICATNPVATEQYGVVASENLQQGIGDE

SEQ ID NO: 103986 - protein, 32 aa, Artificial Sequence
  Description of Artificial Sequence: Synthetic polypeptide
AEDEIATTNPVAYEPWGSVSTTNLNGDGNLRQ

SEQ ID NO: 103987 - protein, 31 aa, Artificial Sequence
  Description of Artificial Sequence: Synthetic polypeptide
AEDEICATNPVATEQYGVVASENLQLQGGTD

SEQ ID NO: 103988 - protein, 34 aa, Artificial Sequence
  Description of Artificial Sequence: Synthetic polypeptide
DEEEISTTNPVATEQYGCVCSSMELQNFGSNNQP

SEQ ID NO: 103989 - protein, 32 aa, Artificial Sequence
  Description of Artificial Sequence: Synthetic polypeptide
AEDEICATNPVATEQYGSVATSENLLQSGDGD

SEQ ID NO: 103990 - protein, 28 aa, Artificial Sequence
  Description of Artificial Sequence: Synthetic peptide
AEDEICATNPISSEQYGVVSVNLQSGTL

SEQ ID NO: 103991 - protein, 34 aa, Artificial Sequence
  Description of Artificial Sequence: Synthetic polypeptide
DEEEISTTNPVATEQYGCVCSNTNHQSFGSDTQG

SEQ ID NO: 103992 - protein, 32 aa, Artificial Sequence
  Description of Artificial Sequence: Synthetic polypeptide
AEDEIATTNPVAYERWGVVSTTNLGQDGNLRQ

SEQ ID NO: 103993 - protein, 32 aa, Artificial Sequence
  Description of Artificial Sequence: Synthetic polypeptide
AEDEIATTNPVAYERWGSVSTTNMLQDGNLGQ

SEQ ID NO: 103994 - protein, 32 aa, Artificial Sequence
  Description of Artificial Sequence: Synthetic polypeptide
AEDEIATTNPVAYERWGSVSTTNGGQDGNGRQ

SEQ ID NO: 103995 - protein, 35 aa, Artificial Sequence
  Description of Artificial Sequence: Synthetic polypeptide
DEEEISTTNPVATEQYGCVCSNTNHQEYFGSDNQS

SEQ ID NO: 103996 - protein, 28 aa, Artificial Sequence
  Description of Artificial Sequence: Synthetic peptide
YEEEIATVNPVCTEQYGVVSEIEQAEDQ

SEQ ID NO: 103997 - protein, 28 aa, Artificial Sequence
  Description of Artificial Sequence: Synthetic peptide
YEEEIATVNPVCTEQYGVVSEIEQSEDQ

SEQ ID NO: 103998 - protein, 31 aa, Artificial Sequence
  Description of Artificial Sequence: Synthetic polypeptide
AENEIACTNPVATEQYGEACSAENPQREGND

SEQ ID NO: 103999 - protein, 30 aa, Artificial Sequence
  Description of Artificial Sequence: Synthetic polypeptide
DDSEVACTNPVSTEGYGNVAANNLQSRGNR

SEQ ID NO: 104000 - protein, 34 aa, Artificial Sequence
  Description of Artificial Sequence: Synthetic polypeptide
DEEEISTTNPVATEQYGCVCSNTNHQENFGSEAA

SEQ ID NO: 104001 - protein, 34 aa, Artificial Sequence
  Description of Artificial Sequence: Synthetic polypeptide
DEYEIRTTNPVATECWGSVSFCINEPQDREGENG

SEQ ID NO: 104002 - protein, 34 aa, Artificial Sequence
  Description of Artificial Sequence: Synthetic polypeptide
DEEEISTTNPVATEQYGCVCSNTNDQNFNSENQA

SEQ ID NO: 104003 - protein, 33 aa, Artificial Sequence
  Description of Artificial Sequence: Synthetic polypeptide
DEYEIRTTNPVATEGWGAVSPINEPQERVGENG

SEQ ID NO: 104004 - protein, 32 aa, Artificial Sequence
  Description of Artificial Sequence: Synthetic polypeptide
AEDEIATTNPVAYEPWGSVSTTNLQQDGNLHQ

SEQ ID NO: 104005 - protein, 32 aa, Artificial Sequence
  Description of Artificial Sequence: Synthetic polypeptide
AEDEIATTNPVAYEPWGSVSTTNLQDDGNLGQ

SEQ ID NO: 104006 - protein, 35 aa, Artificial Sequence
  Description of Artificial Sequence: Synthetic polypeptide
DEEEISTTNPVATEQYGCVCSNTMELQNFGSENQA

SEQ ID NO: 104007 - protein, 34 aa, Artificial Sequence
  Description of Artificial Sequence: Synthetic polypeptide
DEEEISTTNPVATEQYGCVCSNTMALQNFNSEQA

SEQ ID NO: 104008 - protein, 29 aa, Artificial Sequence
  Description of Artificial Sequence: Synthetic peptide
AENEIACTNPVATEQYGEACSWNHQYGDQ

SEQ ID NO: 104009 - protein, 34 aa, Artificial Sequence
  Description of Artificial Sequence: Synthetic polypeptide
DSEEIATTNPVGTEQWGMVSRTNDLDQDRNGVGR

SEQ ID NO: 104010 - protein, 34 aa, Artificial Sequence
  Description of Artificial Sequence: Synthetic polypeptide
DEEEISTTNPVATEQYGCVCSNTGPLQNFNSDQL

SEQ ID NO: 104011 - protein, 35 aa, Artificial Sequence
  Description of Artificial Sequence: Synthetic polypeptide
DEEEISTTNPVATEQYGCVCSNTNHNQFFGSNNQS

SEQ ID NO: 104012 - protein, 34 aa, Artificial Sequence
  Description of Artificial Sequence: Synthetic polypeptide
DEEEISTTNPVATEQYGCVCSNTNTQNFGSETQQ

SEQ ID NO: 104013 - protein, 33 aa, Artificial Sequence
  Description of Artificial Sequence: Synthetic polypeptide
DEYEILTTNPVATECWGSVSCINEPQDREGENG

SEQ ID NO: 104014 - protein, 32 aa, Artificial Sequence
  Description of Artificial Sequence: Synthetic polypeptide
AEDEICATNPVATEQYGSVATSENLQQSGTGD

SEQ ID NO: 104015 - protein, 32 aa, Artificial Sequence
  Description of Artificial Sequence: Synthetic polypeptide
DEEEISTTNPVATEQYGCVCSSGPHQNFGSDQ

SEQ ID NO: 104016 - protein, 31 aa, Artificial Sequence
  Description of Artificial Sequence: Synthetic polypeptide
AEDEICATNPVATEQYGVVASENLNQQNGGD

SEQ ID NO: 104017 - protein, 34 aa, Artificial Sequence
  Description of Artificial Sequence: Synthetic polypeptide
DEEEISTTNPVATEQYGCVCSSGELNQNFGSNQS

SEQ ID NO: 104018 - protein, 32 aa, Artificial Sequence
  Description of Artificial Sequence: Synthetic polypeptide
DEEEISTTNPVATEQYGCVCSSETQNFGSEQS

SEQ ID NO: 104019 - protein, 33 aa, Artificial Sequence
  Description of Artificial Sequence: Synthetic polypeptide
YEEEIATVNPVATEQYGSVSSDNLPNMSNGMNV

SEQ ID NO: 104020 - protein, 33 aa, Artificial Sequence
  Description of Artificial Sequence: Synthetic polypeptide
DEYEIGTTNPVATEQYGSVSVTNAGMEGGETTT

SEQ ID NO: 104021 - protein, 32 aa, Artificial Sequence
  Description of Artificial Sequence: Synthetic polypeptide
DEYEIGTTNPVATEQYGSVTVNAGMEEGGNGT

SEQ ID NO: 104022 - protein, 33 aa, Artificial Sequence
  Description of Artificial Sequence: Synthetic polypeptide
DEEEISTTNPVATEQYGCVCSSELQNFNSNNQS

SEQ ID NO: 104023 - protein, 31 aa, Artificial Sequence
  Description of Artificial Sequence: Synthetic polypeptide
DSEEIRSTNPLAYEQWGSISCTNDQRTGGSN

SEQ ID NO: 104024 - protein, 29 aa, Artificial Sequence
  Description of Artificial Sequence: Synthetic peptide
YEEEIATVNPVATEQYGVVSDIEMNSGDA

SEQ ID NO: 104025 - protein, 33 aa, Artificial Sequence
  Description of Artificial Sequence: Synthetic polypeptide
AEDEICATNPVATEQYGSVATSLENLQSGTGND

SEQ ID NO: 104026 - protein, 33 aa, Artificial Sequence
  Description of Artificial Sequence: Synthetic polypeptide
DEEEISTTNPVATEQYGCVCSSELQENFGSEQQ

SEQ ID NO: 104027 - protein, 32 aa, Artificial Sequence
  Description of Artificial Sequence: Synthetic polypeptide
AEDEICATNPVATEQYGSVATSENNLQSGQGD

SEQ ID NO: 104028 - protein, 33 aa, Artificial Sequence
  Description of Artificial Sequence: Synthetic polypeptide
DEEEISTTNPVATEQYGCVCSSELNQHFNSEQL

SEQ ID NO: 104029 - protein, 32 aa, Artificial Sequence
  Description of Artificial Sequence: Synthetic polypeptide
DEEEISTTNPVATEQYGCVCSSEHQSFGSQQG

SEQ ID NO: 104030 - protein, 32 aa, Artificial Sequence
  Description of Artificial Sequence: Synthetic polypeptide
AEDEICATNPVATEQYGSVATSENLQSGIGED

SEQ ID NO: 104031 - protein, 33 aa, Artificial Sequence
  Description of Artificial Sequence: Synthetic polypeptide
DEEEISTTNPVATEQYGCVCSSEHQFFGSQNQT

SEQ ID NO: 104032 - protein, 33 aa, Artificial Sequence
  Description of Artificial Sequence: Synthetic polypeptide
DEEEISTTNPVATEQYGCVCSSEEHQRFGSDQV

SEQ ID NO: 104033 - protein, 33 aa, Artificial Sequence
  Description of Artificial Sequence: Synthetic polypeptide
DEEEISTTNPVATEQYGCVCSSEDLQEHFGSEQ

SEQ ID NO: 104034 - protein, 33 aa, Artificial Sequence
  Description of Artificial Sequence: Synthetic polypeptide
DEEEISTTNPVATEQYGCVCSNWELQNFGSDQS

SEQ ID NO: 104035 - protein, 32 aa, Artificial Sequence
  Description of Artificial Sequence: Synthetic polypeptide
DEEEISTTNPVATEQYGCVCSNWELQNFFSEQ

SEQ ID NO: 104036 - protein, 33 aa, Artificial Sequence
  Description of Artificial Sequence: Synthetic polypeptide
DEEEISTTNPVATEQYGCVCSNTYHQYFGSDQT

SEQ ID NO: 104037 - protein, 34 aa, Artificial Sequence
  Description of Artificial Sequence: Synthetic polypeptide
DEYEIKTTNPVATDAWGSVSCTNMLSQEPGGPNR

SEQ ID NO: 104038 - protein, 32 aa, Artificial Sequence
  Description of Artificial Sequence: Synthetic polypeptide
AEDEICATNPVATEQYGVVASENLQAGNGNDE

SEQ ID NO: 104039 - protein, 34 aa, Artificial Sequence
  Description of Artificial Sequence: Synthetic polypeptide
DEHEIRTTNPVATESYGSVSGGNLGNAGGDNGGA

SEQ ID NO: 104040 - protein, 35 aa, Artificial Sequence
  Description of Artificial Sequence: Synthetic polypeptide
EEEEIRTTNPVATEAYGVVSTTTNLNTQNGNQQDE

SEQ ID NO: 104041 - protein, 32 aa, Artificial Sequence
  Description of Artificial Sequence: Synthetic polypeptide
TEQEIATTNPVATEQYGSVSATDLEDHEGEDL

SEQ ID NO: 104042 - protein, 34 aa, Artificial Sequence
  Description of Artificial Sequence: Synthetic polypeptide
DEGEIRTTNPVATEQYGSVSFTTASVTQEDNDDE

SEQ ID NO: 104043 - protein, 28 aa, Artificial Sequence
  Description of Artificial Sequence: Synthetic peptide
AENEIATTNPVATEQYGEAPENCQHEEK

SEQ ID NO: 104044 - protein, 35 aa, Artificial Sequence
  Description of Artificial Sequence: Synthetic polypeptide
FEEEIRTTNPVATEQYGSVISITDNGIQGQGGGQG

SEQ ID NO: 104045 - protein, 35 aa, Artificial Sequence
  Description of Artificial Sequence: Synthetic polypeptide
FEEEIRTTNPVATEQYGSVISIMNFGQSGGGNEET

SEQ ID NO: 104046 - protein, 33 aa, Artificial Sequence
  Description of Artificial Sequence: Synthetic polypeptide
DEGEIRTTNPVATEQYGSVSATTVWEEIDTNQQ

SEQ ID NO: 104047 - protein, 34 aa, Artificial Sequence
  Description of Artificial Sequence: Synthetic polypeptide
DEGEIRTTNPVATEQYGSVSANDLTQEFAFEDGD

SEQ ID NO: 104048 - protein, 33 aa, Artificial Sequence
  Description of Artificial Sequence: Synthetic polypeptide
DEGEIRTTNPVATEQYGSVSALDLTQEIFEDGD

SEQ ID NO: 104049 - protein, 33 aa, Artificial Sequence
  Description of Artificial Sequence: Synthetic polypeptide
DEGEIRTTNPVATEQYGSVSAEDSGQEGFEDGD

SEQ ID NO: 104050 - protein, 33 aa, Artificial Sequence
  Description of Artificial Sequence: Synthetic polypeptide
DEGEIRTTNPVATEQYGSVSAAELTQEQFEDGD

SEQ ID NO: 104051 - protein, 30 aa, Artificial Sequence
  Description of Artificial Sequence: Synthetic polypeptide
AENEIATTNPVATEQYGDVSENEMNAAGGA

SEQ ID NO: 104052 - protein, 36 aa, Artificial Sequence
  Description of Artificial Sequence: Synthetic polypeptide
FEEEIRTTNPVATEQYGSVISTMNIGDQGGGENIGE

SEQ ID NO: 104053 - protein, 34 aa, Artificial Sequence
  Description of Artificial Sequence: Synthetic polypeptide
FEEEIRTTNPVATEQYGSVINDTPDQTDNGNQDQ

SEQ ID NO: 104054 - protein, 35 aa, Artificial Sequence
  Description of Artificial Sequence: Synthetic polypeptide
FEEEIRTTNPVATEQYGSVGSNTNDEMQGEGQEEF

SEQ ID NO: 104055 - protein, 34 aa, Artificial Sequence
  Description of Artificial Sequence: Synthetic polypeptide
DDEEIRTTNPVATDQYGSVMSGGNGGQNNGNNDD

SEQ ID NO: 104056 - protein, 33 aa, Artificial Sequence
  Description of Artificial Sequence: Synthetic polypeptide
DDEEIRTTNPVATDQYGSVSDGMGGQNTGNDDG

SEQ ID NO: 104057 - protein, 34 aa, Artificial Sequence
  Description of Artificial Sequence: Synthetic polypeptide
FEEEIRTTNPVATEQYGSVGSGTGQQDEGGGEIF

SEQ ID NO: 104058 - protein, 35 aa, Artificial Sequence
  Description of Artificial Sequence: Synthetic polypeptide
DEGEIRTTNPVATEQYGSVPDTLNLHVIEGSNEDV

SEQ ID NO: 104059 - protein, 33 aa, Artificial Sequence
  Description of Artificial Sequence: Synthetic polypeptide
FEEEIRTTNPVATEQYGSVESQVNEIQVSMVEN

SEQ ID NO: 104060 - protein, 32 aa, Artificial Sequence
  Description of Artificial Sequence: Synthetic polypeptide
TEECIRTTNPVATEQYGCVCSTNDAGFLSNQA

SEQ ID NO: 104061 - protein, 33 aa, Artificial Sequence
  Description of Artificial Sequence: Synthetic polypeptide
DEGEIRTTNPVATEQYGSVNTLNEHVEGSIEDQ

SEQ ID NO: 104062 - protein, 31 aa, Artificial Sequence
  Description of Artificial Sequence: Synthetic polypeptide
TEECIRTTNPVATEQYGCVCSTNHAHLSDQS

SEQ ID NO: 104063 - protein, 34 aa, Artificial Sequence
  Description of Artificial Sequence: Synthetic polypeptide
DEGEIRTTNPVATEQYGSVNNLTNHDEEGNTEIQ

SEQ ID NO: 104064 - protein, 36 aa, Artificial Sequence
  Description of Artificial Sequence: Synthetic polypeptide
FEEEIRTTNPVATEQYGSVIDGSTNVGQGEGGNQEE

SEQ ID NO: 104065 - protein, 33 aa, Artificial Sequence
  Description of Artificial Sequence: Synthetic polypeptide
FEEEIRTTNPVATEQYGSVDGEDNNGQGENEDG

SEQ ID NO: 104066 - protein, 35 aa, Artificial Sequence
  Description of Artificial Sequence: Synthetic polypeptide
FEEEIRTTNPVATEQYGSVISTMNIGQSGGGGEED

SEQ ID NO: 104067 - protein, 28 aa, Artificial Sequence
  Description of Artificial Sequence: Synthetic peptide
AENEIATTNPVATEQYGEAPEVCQHEER

SEQ ID NO: 104068 - protein, 30 aa, Artificial Sequence
  Description of Artificial Sequence: Synthetic polypeptide
TEECIATTNPVAYEQWGSVSKELEMNGGGR

SEQ ID NO: 104069 - protein, 34 aa, Artificial Sequence
  Description of Artificial Sequence: Synthetic polypeptide
TEECIATTNPVAYEQYGISTVSWLNLQNAGGNRM

SEQ ID NO: 104070 - protein, 33 aa, Artificial Sequence
  Description of Artificial Sequence: Synthetic polypeptide
DEGEIRTTNPVATEQYGSVSTPETQAQSDQEEH

SEQ ID NO: 104071 - protein, 33 aa, Artificial Sequence
  Description of Artificial Sequence: Synthetic polypeptide
TEECIATTNPVAYEQYGQSVFWLNLSQNGGNRM

SEQ ID NO: 104072 - protein, 34 aa, Artificial Sequence
  Description of Artificial Sequence: Synthetic polypeptide
FEEEIRTTNPVATEQYGSVNMSDLDQTEGENGDT

SEQ ID NO: 104073 - protein, 35 aa, Artificial Sequence
  Description of Artificial Sequence: Synthetic polypeptide
FEEEIRTTNPVATEQYGSVNMSDFNNGQGEEGNEE

SEQ ID NO: 104074 - protein, 30 aa, Artificial Sequence
  Description of Artificial Sequence: Synthetic polypeptide
AENEIATTNPVATEQYGEASENLMNAAGGA

SEQ ID NO: 104075 - protein, 34 aa, Artificial Sequence
  Description of Artificial Sequence: Synthetic polypeptide
DEGEIRTTNPVATEQYGSVSTNDVTAEIFLQDMI

SEQ ID NO: 104076 - protein, 34 aa, Artificial Sequence
  Description of Artificial Sequence: Synthetic polypeptide
FEEEIRTTNPVATEQYGSVNMGTNDEMGGDENGD

SEQ ID NO: 104077 - protein, 34 aa, Artificial Sequence
  Description of Artificial Sequence: Synthetic polypeptide
DEGEIRTTNPVATEQYGSVSTNDTMEIFILQDMI

SEQ ID NO: 104078 - protein, 35 aa, Artificial Sequence
  Description of Artificial Sequence: Synthetic polypeptide
AEEEIRTTNPVATEIYGSVSTTNNNNQEAGTNNTE

SEQ ID NO: 104079 - protein, 35 aa, Artificial Sequence
  Description of Artificial Sequence: Synthetic polypeptide
FEEEIRTTNPVATEQYGSVNFTDNIGDQENGENEF

SEQ ID NO: 104080 - protein, 34 aa, Artificial Sequence
  Description of Artificial Sequence: Synthetic polypeptide
FEEEIRTTNPVATEQYGSVNDNSGMEQTGGGNQG

SEQ ID NO: 104081 - protein, 34 aa, Artificial Sequence
  Description of Artificial Sequence: Synthetic polypeptide
DEGEIRTTNPVATEQYGSVSTNANNARDMVQEGT

SEQ ID NO: 104082 - protein, 34 aa, Artificial Sequence
  Description of Artificial Sequence: Synthetic polypeptide
FEEEIRTTNPVATEQYGSVNDNSGDQEEGQNIQN

SEQ ID NO: 104083 - protein, 31 aa, Artificial Sequence
  Description of Artificial Sequence: Synthetic polypeptide
DDEEIRTTNPCATEHYGCVCSWELQNFNSDQ

SEQ ID NO: 104084 - protein, 36 aa, Artificial Sequence
  Description of Artificial Sequence: Synthetic polypeptide
DEGEIRTTNPVATEQYGSVSSTTPANPNMRNGMNPV

SEQ ID NO: 104085 - protein, 33 aa, Artificial Sequence
  Description of Artificial Sequence: Synthetic polypeptide
DEGEIRTTNPVATEQYGSVSSTPDQANSDQEEH

SEQ ID NO: 104086 - protein, 34 aa, Artificial Sequence
  Description of Artificial Sequence: Synthetic polypeptide
FEEEIRTTNPVATEQYGSVMGNMNLDIGGQENDG

SEQ ID NO: 104087 - protein, 36 aa, Artificial Sequence
  Description of Artificial Sequence: Synthetic polypeptide
DEGEIRTTNPVATEQYGSVSPWGDNLEQRFGGEEVN

SEQ ID NO: 104088 - protein, 34 aa, Artificial Sequence
  Description of Artificial Sequence: Synthetic polypeptide
FEEEIRTTNPVATEQYGSVMGLDNGQEEGEGNNG

SEQ ID NO: 104089 - protein, 31 aa, Artificial Sequence
  Description of Artificial Sequence: Synthetic polypeptide
AENEIATTNPVATEQYGEASAENLQDHGGDL

SEQ ID NO: 104090 - protein, 35 aa, Artificial Sequence
  Description of Artificial Sequence: Synthetic polypeptide
FEEEIRTTNPVATEQYGSVNDTSGLQEEEGGNQGA

SEQ ID NO: 104091 - protein, 33 aa, Artificial Sequence
  Description of Artificial Sequence: Synthetic polypeptide
DEGEIRTTNPVATEQYGSVITPDDDLNRFEMFE

SEQ ID NO: 104092 - protein, 30 aa, Artificial Sequence
  Description of Artificial Sequence: Synthetic polypeptide
AENEIATTNPVATEQYGDASEILQNAAGGA

SEQ ID NO: 104093 - protein, 34 aa, Artificial Sequence
  Description of Artificial Sequence: Synthetic polypeptide
DEGEIRTTNPVATEQYGSVISTLSVEGQFGGEMI

SEQ ID NO: 104094 - protein, 35 aa, Artificial Sequence
  Description of Artificial Sequence: Synthetic polypeptide
DDEEIRTTNPVATDQYGSVSVTNNGGEQNEGGNDE

SEQ ID NO: 104095 - protein, 33 aa, Artificial Sequence
  Description of Artificial Sequence: Synthetic polypeptide
FEEEIRTTNPVATEQYGNVVDTMNMNQGNFNDD

SEQ ID NO: 104096 - protein, 35 aa, Artificial Sequence
  Description of Artificial Sequence: Synthetic polypeptide
TEECIRTTNPVATEQYGSVPSYTPNELSSEMLGNI

SEQ ID NO: 104097 - protein, 33 aa, Artificial Sequence
  Description of Artificial Sequence: Synthetic polypeptide
DEVEIATTNPVATEQYGSVTGGNGDQRQGMDGP

SEQ ID NO: 104098 - protein, 35 aa, Artificial Sequence
  Description of Artificial Sequence: Synthetic polypeptide
DEVEIATTNPVATEQYGSVYCTNLDQDPDGQRNDV

SEQ ID NO: 104099 - protein, 34 aa, Artificial Sequence
  Description of Artificial Sequence: Synthetic polypeptide
DEGEIRTTNPVATEQYGSGVMWTYANLIGFENQE

SEQ ID NO: 104100 - protein, 34 aa, Artificial Sequence
  Description of Artificial Sequence: Synthetic polypeptide
DEGEIRTTNPVATEQYGSFVSITEDLVTEQNEDQ

SEQ ID NO: 104101 - protein, 34 aa, Artificial Sequence
  Description of Artificial Sequence: Synthetic polypeptide
DEVEIATTNPVATEQYGVVSPTDNQGIQQGNGGV

SEQ ID NO: 104102 - protein, 34 aa, Artificial Sequence
  Description of Artificial Sequence: Synthetic polypeptide
DEGEIRTTNPVATEQYGSCVQVTYDNMIRFENQE

SEQ ID NO: 104103 - protein, 35 aa, Artificial Sequence
  Description of Artificial Sequence: Synthetic polypeptide
DEGEIRTTNPVATEQYGSCTSPTDEDVQRGDNDEN

SEQ ID NO: 104104 - protein, 34 aa, Artificial Sequence
  Description of Artificial Sequence: Synthetic polypeptide
DDEEIRTTNPVATDQYGSVSVNNGGEQNEGGGNG

SEQ ID NO: 104105 - protein, 29 aa, Artificial Sequence
  Description of Artificial Sequence: Synthetic peptide
AENEIATTNPVATEGYGCVSWELQHFIEL

SEQ ID NO: 104106 - protein, 33 aa, Artificial Sequence
  Description of Artificial Sequence: Synthetic polypeptide
DEGEIRTTNPVATEQYGSCSPDILQYEGEEDQG

SEQ ID NO: 104107 - protein, 33 aa, Artificial Sequence
  Description of Artificial Sequence: Synthetic polypeptide
DEGEIRTTNPVATEQYGSCSPDGTLQEGEEDQG

SEQ ID NO: 104108 - protein, 33 aa, Artificial Sequence
  Description of Artificial Sequence: Synthetic polypeptide
DEGEIRTTNPVATEQYGSCFVTYDNDIRFENQE

SEQ ID NO: 104109 - protein, 34 aa, Artificial Sequence
  Description of Artificial Sequence: Synthetic polypeptide
DEGEIRTTNPVATEQYGSAASPVNINQHYGPTRL

SEQ ID NO: 104110 - protein, 34 aa, Artificial Sequence
  Description of Artificial Sequence: Synthetic polypeptide
FEEEIRTTNPVATEQYGDVVSTTGFGQGEIGNIE

SEQ ID NO: 104111 - protein, 34 aa, Artificial Sequence
  Description of Artificial Sequence: Synthetic polypeptide
FEEEIRTTNPVATEQYGDVSTTMDLGQGGGEGQG

SEQ ID NO: 104112 - protein, 34 aa, Artificial Sequence
  Description of Artificial Sequence: Synthetic polypeptide
FEEEIRTTNPVATEQYGDVSSTMNIGQSDEGGQG

SEQ ID NO: 104113 - protein, 33 aa, Artificial Sequence
  Description of Artificial Sequence: Synthetic polypeptide
DEGEIRTTNPVATEQYGCWSTITPLNENRESNN

SEQ ID NO: 104114 - protein, 32 aa, Artificial Sequence
  Description of Artificial Sequence: Synthetic polypeptide
TEECIRTTNPVAYEAWGKTVSQTNASQDGNRH

SEQ ID NO: 104115 - protein, 34 aa, Artificial Sequence
  Description of Artificial Sequence: Synthetic polypeptide
FEEEIRTTNPVATEQYGDVSITDNMGEGGGNDDE

SEQ ID NO: 104116 - protein, 33 aa, Artificial Sequence
  Description of Artificial Sequence: Synthetic polypeptide
DEGEIRTTNPVATEQYGSCSPDNNVQEGEEDQG

SEQ ID NO: 104117 - protein, 34 aa, Artificial Sequence
  Description of Artificial Sequence: Synthetic polypeptide
DDEEIRTTNPVATDQYGSVSTQEGGQNVGGNDDG

SEQ ID NO: 104118 - protein, 34 aa, Artificial Sequence
  Description of Artificial Sequence: Synthetic polypeptide
FEEEIRTTNPVATEQYGNVVNGTMNNEQGEGGNE

SEQ ID NO: 104119 - protein, 36 aa, Artificial Sequence
  Description of Artificial Sequence: Synthetic polypeptide
DEVEIATTNPVATEQYGSVSWTDNHQQQDRQGNGDA

SEQ ID NO: 104120 - protein, 33 aa, Artificial Sequence
  Description of Artificial Sequence: Synthetic polypeptide
TEECIRTTNPVATEQYGCVCSTNLNAYFISNQA

SEQ ID NO: 104121 - protein, 33 aa, Artificial Sequence
  Description of Artificial Sequence: Synthetic polypeptide
FEEEIRTTNPVATEQYGSVDDGTTGEGGGGNTS

SEQ ID NO: 104122 - protein, 34 aa, Artificial Sequence
  Description of Artificial Sequence: Synthetic polypeptide
DEGEIRTTNPVATEQYGSVGTPDDDNLNRFEMQE

SEQ ID NO: 104123 - protein, 33 aa, Artificial Sequence
  Description of Artificial Sequence: Synthetic polypeptide
DEGEIRTTNPVATEQYGSVFSWVELTDEQQETQ

SEQ ID NO: 104124 - protein, 35 aa, Artificial Sequence
  Description of Artificial Sequence: Synthetic polypeptide
DEGEIRTTNPVATEQYGSVFNTLNLHVEGSNEDVQ

SEQ ID NO: 104125 - protein, 35 aa, Artificial Sequence
  Description of Artificial Sequence: Synthetic polypeptide
DEGEIRTTNPVATEQYGSVFDTLNLDVIEGANEDV

SEQ ID NO: 104126 - protein, 36 aa, Artificial Sequence
  Description of Artificial Sequence: Synthetic polypeptide
AEEEIRTTNPVATEQYGSVSTTQQLQQEISTEQGNA

SEQ ID NO: 104127 - protein, 33 aa, Artificial Sequence
  Description of Artificial Sequence: Synthetic polypeptide
DEGEIRTTNPVATEQYGSVEWVNNDRDNNNSPI

SEQ ID NO: 104128 - protein, 33 aa, Artificial Sequence
  Description of Artificial Sequence: Synthetic polypeptide
DEGEIRTTNPVATEQYGSVETYWNQNISDNHQS

SEQ ID NO: 104129 - protein, 33 aa, Artificial Sequence
  Description of Artificial Sequence: Synthetic polypeptide
FEEEIRTTNPVATEQYGSVCLPNGEERQANTVG

SEQ ID NO: 104130 - protein, 34 aa, Artificial Sequence
  Description of Artificial Sequence: Synthetic polypeptide
DEGEIRTTNPVATEQYGSVETLYLHDEGSNEDVQ

SEQ ID NO: 104131 - protein, 34 aa, Artificial Sequence
  Description of Artificial Sequence: Synthetic polypeptide
DEGEIRTTNPVATEQYGSVETLLTEHDEGSNEDV

SEQ ID NO: 104132 - protein, 33 aa, Artificial Sequence
  Description of Artificial Sequence: Synthetic polypeptide
TEECIRTTNPVATEQYGCVSCTNECSQIFGGSD

SEQ ID NO: 104133 - protein, 35 aa, Artificial Sequence
  Description of Artificial Sequence: Synthetic polypeptide
DEGEIRTTNPVATEQYGSVEPLNTLHDQEGSNEDV

SEQ ID NO: 104134 - protein, 34 aa, Artificial Sequence
  Description of Artificial Sequence: Synthetic polypeptide
DEGEIRTTNPVATEQYGSVDSWTWPAEQDTNEQA

SEQ ID NO: 104135 - protein, 34 aa, Artificial Sequence
  Description of Artificial Sequence: Synthetic polypeptide
DEGEIRTTNPVATEQYGSVCTVDPDLNREENNQH

SEQ ID NO: 104136 - protein, 35 aa, Artificial Sequence
  Description of Artificial Sequence: Synthetic polypeptide
FEEEIRTTNPVATEQYGSVASSTDGGEQEEGGNQD

SEQ ID NO: 104137 - protein, 35 aa, Artificial Sequence
  Description of Artificial Sequence: Synthetic polypeptide
DEVEIATTNPVATEQYGSVSTPNPQQDHQDGNDNH

SEQ ID NO: 104138 - protein, 35 aa, Artificial Sequence
  Description of Artificial Sequence: Synthetic polypeptide
FEEEIRTTNPVATEQYGSVASSTDDQTQEGGGNGQ

SEQ ID NO: 104139 - protein, 33 aa, Artificial Sequence
  Description of Artificial Sequence: Synthetic polypeptide
FEEEIRTTNPVATEQYGSVANTFGFGGNGNIGG

SEQ ID NO: 104140 - protein, 34 aa, Artificial Sequence
  Description of Artificial Sequence: Synthetic polypeptide
FEEEIRTTNPVATEQYGNVVSTTMNINQGNFNDD

SEQ ID NO: 104141 - protein, 29 aa, Artificial Sequence
  Description of Artificial Sequence: Synthetic peptide
AENEIATTNPVATEQWGDASEILQRAEDA

SEQ ID NO: 104142 - protein, 34 aa, Artificial Sequence
  Description of Artificial Sequence: Synthetic polypeptide
FEEEIRTTNPVATEQYGNVVSIDDLDQGEGDNEE

SEQ ID NO: 104143 - protein, 35 aa, Artificial Sequence
  Description of Artificial Sequence: Synthetic polypeptide
AEEEIRTTNPVATEPYGSVSTTNNQQQGNIGNEGN

SEQ ID NO: 104144 - protein, 32 aa, Artificial Sequence
  Description of Artificial Sequence: Synthetic polypeptide
TEECIATTNPVATECYGSVSWNEMQDRQGDTS

SEQ ID NO: 104145 - protein, 34 aa, Artificial Sequence
  Description of Artificial Sequence: Synthetic polypeptide
DEGEIRTTNPVATEQYGSVSTVEDLLTFEEQNEA

SEQ ID NO: 104146 - protein, 35 aa, Artificial Sequence
  Description of Artificial Sequence: Synthetic polypeptide
FEEEIRTTNPVATEQYGSVNNTDNTEGQGEFGGNE

SEQ ID NO: 104147 - protein, 33 aa, Artificial Sequence
  Description of Artificial Sequence: Synthetic polypeptide
TEAEIRTTNPVATEPYGSVSCTANASHDVGGER

SEQ ID NO: 104148 - protein, 35 aa, Artificial Sequence
  Description of Artificial Sequence: Synthetic polypeptide
TEAEIRTTNPVATEPYGSVSCTANELSQDVTGGPR

SEQ ID NO: 104149 - protein, 33 aa, Artificial Sequence
  Description of Artificial Sequence: Synthetic polypeptide
DDEEIRSTNPVATEQYGCSCSTEHQENFGSNQA

SEQ ID NO: 104150 - protein, 32 aa, Artificial Sequence
  Description of Artificial Sequence: Synthetic polypeptide
DEGEIRTTNPVAYEQWGSVQTAGLIGEMNNGR

SEQ ID NO: 104151 - protein, 34 aa, Artificial Sequence
  Description of Artificial Sequence: Synthetic polypeptide
TEAEIRTTNPVATEPYGSVSCTANHSQDVGGERC

SEQ ID NO: 104152 - protein, 33 aa, Artificial Sequence
  Description of Artificial Sequence: Synthetic polypeptide
TEAEIRTTNPVATEPYGSVSCTANLSPDVGGED

SEQ ID NO: 104153 - protein, 35 aa, Artificial Sequence
  Description of Artificial Sequence: Synthetic polypeptide
TEAEIRTTNPVATEPYGSVSCTANLSQDVEGGEDR

SEQ ID NO: 104154 - protein, 35 aa, Artificial Sequence
  Description of Artificial Sequence: Synthetic polypeptide
TEAEIRTTNPVATEPYGSVSCTANLSQDVGGETRK

SEQ ID NO: 104155 - protein, 34 aa, Artificial Sequence
  Description of Artificial Sequence: Synthetic polypeptide
TEAEIRTTNPVATEPYGSVSCTANLSQDVTGGVS

SEQ ID NO: 104156 - protein, 34 aa, Artificial Sequence
  Description of Artificial Sequence: Synthetic polypeptide
AEEEIRTTNPVATEQYGCVCSNTNHNQYFGSDFA

SEQ ID NO: 104157 - protein, 34 aa, Artificial Sequence
  Description of Artificial Sequence: Synthetic polypeptide
TEAEIRTTNPVATEPYGSVSCTAALSQDVTGGER

SEQ ID NO: 104158 - protein, 35 aa, Artificial Sequence
  Description of Artificial Sequence: Synthetic polypeptide
FEEEIRTTNPVATEQYGSVSFTNTLEYRTFEEEDL

SEQ ID NO: 104159 - protein, 35 aa, Artificial Sequence
  Description of Artificial Sequence: Synthetic polypeptide
TEAEIRTTNPVAYEQYGSVSCTNMLSHRTSFNNRD

SEQ ID NO: 104160 - protein, 33 aa, Artificial Sequence
  Description of Artificial Sequence: Synthetic polypeptide
TEAEIRTTNPVAYESYGSTVSNTNLSHTGADNN

SEQ ID NO: 104161 - protein, 34 aa, Artificial Sequence
  Description of Artificial Sequence: Synthetic polypeptide
DEGEIRTTNPVAYEQWGETVRMTNDHLQRGDRRQ

SEQ ID NO: 104162 - protein, 34 aa, Artificial Sequence
  Description of Artificial Sequence: Synthetic polypeptide
TEAEISTTNPVATEAYGSVVSCTGPLAQRGENYS

SEQ ID NO: 104163 - protein, 33 aa, Artificial Sequence
  Description of Artificial Sequence: Synthetic polypeptide
TEAVEIATTNPVAYEQWGSVSTNLQGDTGGNNM

SEQ ID NO: 104164 - protein, 34 aa, Artificial Sequence
  Description of Artificial Sequence: Synthetic polypeptide
DEVEIATTNPVATEQYGSVCPTDNQGEQQGQNGV

SEQ ID NO: 104165 - protein, 33 aa, Artificial Sequence
  Description of Artificial Sequence: Synthetic polypeptide
TECEIATTNPVGTEQYGSVSWNEKEGQRNGNAP

SEQ ID NO: 104166 - protein, 34 aa, Artificial Sequence
  Description of Artificial Sequence: Synthetic polypeptide
DEVEIATTNPVATEQYGSVCPTDNQGQQNGHNGV

SEQ ID NO: 104167 - protein, 30 aa, Artificial Sequence
  Description of Artificial Sequence: Synthetic polypeptide
TEDEIATTNPVAYEHWGEVSTNLQGEHNEP

SEQ ID NO: 104168 - protein, 33 aa, Artificial Sequence
  Description of Artificial Sequence: Synthetic polypeptide
DEGEIRTTNPVAYEGYGETVSICNLSQRSTVNE

SEQ ID NO: 104169 - protein, 32 aa, Artificial Sequence
  Description of Artificial Sequence: Synthetic polypeptide
DEVEIATTNPVATEQYGSVCAAGPLQDHGDQQ

SEQ ID NO: 104170 - protein, 35 aa, Artificial Sequence
  Description of Artificial Sequence: Synthetic polypeptide
TEAEIRTTNPVATEPYGSVCSCTANALSQDVGGER

SEQ ID NO: 104171 - protein, 34 aa, Artificial Sequence
  Description of Artificial Sequence: Synthetic polypeptide
DEGEIRTTNPVAYEQWGYTISPNEGLQDRDGNKR

SEQ ID NO: 104172 - protein, 34 aa, Artificial Sequence
  Description of Artificial Sequence: Synthetic polypeptide
TEAEIRTTNPVATEPYGEVSCTANLSQDVGGEQR

SEQ ID NO: 104173 - protein, 32 aa, Artificial Sequence
  Description of Artificial Sequence: Synthetic polypeptide
DEGEIVPTNPVATEQYGTVCSACDGLVQSGND

SEQ ID NO: 104174 - protein, 31 aa, Artificial Sequence
  Description of Artificial Sequence: Synthetic polypeptide
DEGEIRTTNPVSTEQYGTVSCDIQQQQNGTH

SEQ ID NO: 104175 - protein, 33 aa, Artificial Sequence
  Description of Artificial Sequence: Synthetic polypeptide
DEGEIRTTNPVSTEQYGIVSTTNLNMSNGMTPV

SEQ ID NO: 104176 - protein, 31 aa, Artificial Sequence
  Description of Artificial Sequence: Synthetic polypeptide
DEGEIRTTNPVSTEQYGIVSCDIQQQQNGTH

SEQ ID NO: 104177 - protein, 29 aa, Artificial Sequence
  Description of Artificial Sequence: Synthetic peptide
DEGEIRTTNPVSTEQWGIVSEILMSAETA

SEQ ID NO: 104178 - protein, 31 aa, Artificial Sequence
  Description of Artificial Sequence: Synthetic polypeptide
DEGEIRTTNPVSTEPYGTVSMDIQQQQNGNH

SEQ ID NO: 104179 - protein, 32 aa, Artificial Sequence
  Description of Artificial Sequence: Synthetic polypeptide
DEGEIRTTNPVSTEPYGTVSCENIQQQSNGNH

SEQ ID NO: 104180 - protein, 31 aa, Artificial Sequence
  Description of Artificial Sequence: Synthetic polypeptide
DEGEIRTTNPVSTEPYGTVSCDIQQQQNGNH

SEQ ID NO: 104181 - protein, 33 aa, Artificial Sequence
  Description of Artificial Sequence: Synthetic polypeptide
TEAEICTTNPVATERYGISTVSTNELSEERGET

SEQ ID NO: 104182 - protein, 33 aa, Artificial Sequence
  Description of Artificial Sequence: Synthetic polypeptide
DEGEIRTTNPVSTECWGSVSCINEPQDREGENG

SEQ ID NO: 104183 - protein, 34 aa, Artificial Sequence
  Description of Artificial Sequence: Synthetic polypeptide
FEEEIRTTNPVATEQYGSVSGQENGQSEDGEGGD

SEQ ID NO: 104184 - protein, 35 aa, Artificial Sequence
  Description of Artificial Sequence: Synthetic polypeptide
TEAEIRTTNPVATEAWGISVVGTNLSQSRGGNQRY

SEQ ID NO: 104185 - protein, 32 aa, Artificial Sequence
  Description of Artificial Sequence: Synthetic polypeptide
AENEIATTNPVATEQYGEVSAENLEDHEGGDR

SEQ ID NO: 104186 - protein, 29 aa, Artificial Sequence
  Description of Artificial Sequence: Synthetic peptide
DEGEIRTTNPVSSEPYGIISMDIQSNGNH

SEQ ID NO: 104187 - protein, 35 aa, Artificial Sequence
  Description of Artificial Sequence: Synthetic polypeptide
TEAEIRTTNPVATEAYGQTVVGTNLSQSRGGNQRY

SEQ ID NO: 104188 - protein, 34 aa, Artificial Sequence
  Description of Artificial Sequence: Synthetic polypeptide
AEEEIRTTNPVATEQYGCVCSNWELQNFGSENQS

SEQ ID NO: 104189 - protein, 35 aa, Artificial Sequence
  Description of Artificial Sequence: Synthetic polypeptide
FEEEIRTTNPVATEQYGSVSGGLGGQNNNGNGQQT

SEQ ID NO: 104190 - protein, 31 aa, Artificial Sequence
  Description of Artificial Sequence: Synthetic polypeptide
AENEIATTNPVATEQYGEISENIQQQQNGNH

SEQ ID NO: 104191 - protein, 32 aa, Artificial Sequence
  Description of Artificial Sequence: Synthetic polypeptide
AENEIATTNPVATEQYGEASTEPALNMRGMGR

SEQ ID NO: 104192 - protein, 34 aa, Artificial Sequence
  Description of Artificial Sequence: Synthetic polypeptide
DEVEIATTNPVATEQYGSVATNNDLDQDGTTDDP

SEQ ID NO: 104193 - protein, 34 aa, Artificial Sequence
  Description of Artificial Sequence: Synthetic polypeptide
DEGEIRTTNPVAYEQYGETVSYCNLSQRNATVNE

SEQ ID NO: 104194 - protein, 34 aa, Artificial Sequence
  Description of Artificial Sequence: Synthetic polypeptide
TEAEIRTTNPVATEPYGCSVVSVNQSQKTMGNRC

SEQ ID NO: 104195 - protein, 33 aa, Artificial Sequence
  Description of Artificial Sequence: Synthetic polypeptide
DEGEIRTTNPVAYEQWGYTISPNELQDHGGNNR

SEQ ID NO: 104196 - protein, 33 aa, Artificial Sequence
  Description of Artificial Sequence: Synthetic polypeptide
DDEEIRSTNPVATEQYGCSCSTEPNQNFGSNQA

SEQ ID NO: 104197 - protein, 33 aa, Artificial Sequence
  Description of Artificial Sequence: Synthetic polypeptide
DEGEIRTTNPVATEQYGCWSTIHPLENRNENNN

SEQ ID NO: 104198 - protein, 36 aa, Artificial Sequence
  Description of Artificial Sequence: Synthetic polypeptide
FEEEIRTTNPVATEQYGSVSEPFMLEEEQPGFNVRY

SEQ ID NO: 104199 - protein, 31 aa, Artificial Sequence
  Description of Artificial Sequence: Synthetic polypeptide
AENEIATTNPVATEQYGEASEPALNMRGMGR

SEQ ID NO: 104200 - protein, 34 aa, Artificial Sequence
  Description of Artificial Sequence: Synthetic polypeptide
AEEEIRTTNPVATEQYGCSCSTGEPLQYFNSDQS

SEQ ID NO: 104201 - protein, 32 aa, Artificial Sequence
  Description of Artificial Sequence: Synthetic polypeptide
TEDEIRTTNPVAYEPWGEVSTNLNQGNEGNMP

SEQ ID NO: 104202 - protein, 33 aa, Artificial Sequence
  Description of Artificial Sequence: Synthetic polypeptide
AEEEIRTTNPVATEQYGCAVNTMTEGPLRTGIR

SEQ ID NO: 104203 - protein, 33 aa, Artificial Sequence
  Description of Artificial Sequence: Synthetic polypeptide
DEGEIRTTNPVATEQYGSVSWVEVTDEWQQERQ

SEQ ID NO: 104204 - protein, 34 aa, Artificial Sequence
  Description of Artificial Sequence: Synthetic polypeptide
DEVEIATTNPVATEQYGSVSATGDDLEDGQGGDQ

SEQ ID NO: 104205 - protein, 34 aa, Artificial Sequence
  Description of Artificial Sequence: Synthetic polypeptide
DEGEIRTTNPVATEQYGSVSWTWPLQIDTTFESQ

SEQ ID NO: 104206 - protein, 33 aa, Artificial Sequence
  Description of Artificial Sequence: Synthetic polypeptide
DEVEIATTNPVATEQYGSVSATGLEDGEGEDEG

SEQ ID NO: 104207 - protein, 31 aa, Artificial Sequence
  Description of Artificial Sequence: Synthetic polypeptide
TEDVINTTNPVATEQYGCVEVTNNEQGGCNN

SEQ ID NO: 104208 - protein, 32 aa, Artificial Sequence
  Description of Artificial Sequence: Synthetic polypeptide
TEEAEIATTNPVAYECWGVVSTNLQGMGPNDA

SEQ ID NO: 104209 - protein, 33 aa, Artificial Sequence
  Description of Artificial Sequence: Synthetic polypeptide
DEGEIRTTNPVATEQYGSVSWPWTEQEDTNEQA

SEQ ID NO: 104210 - protein, 33 aa, Artificial Sequence
  Description of Artificial Sequence: Synthetic polypeptide
DEVEIATTNPVATEQYGSVSATDLEGGEGQEDT

SEQ ID NO: 104211 - protein, 33 aa, Artificial Sequence
  Description of Artificial Sequence: Synthetic polypeptide
DEGEIRTTNPVATEQYGSVSWPWLEASDTNEQA

SEQ ID NO: 104212 - protein, 35 aa, Artificial Sequence
  Description of Artificial Sequence: Synthetic polypeptide
DEGEIRTTNPVATEQYGSVSVVTAETQQEGNEIDQ

SEQ ID NO: 104213 - protein, 34 aa, Artificial Sequence
  Description of Artificial Sequence: Synthetic polypeptide
DEGEIRTTNPVATEQYGSVSVTYEVDEHGSEVRE

SEQ ID NO: 104214 - protein, 34 aa, Artificial Sequence
  Description of Artificial Sequence: Synthetic polypeptide
DEGEIRTTNPVATEQYGSVSVTWEVDEHGSNVFE

SEQ ID NO: 104215 - protein, 35 aa, Artificial Sequence
  Description of Artificial Sequence: Synthetic polypeptide
DEGEIRTTNPVATEQYGSVSVTWDVNLEEPQNQIQ

SEQ ID NO: 104216 - protein, 34 aa, Artificial Sequence
  Description of Artificial Sequence: Synthetic polypeptide
DEGEIRTTNPVATEQYGSVSVTWDNTEEPQDQFQ

SEQ ID NO: 104217 - protein, 34 aa, Artificial Sequence
  Description of Artificial Sequence: Synthetic polypeptide
DEGEIRTTNPVATEQYGSVSVTNSVDEHPSNVSE

SEQ ID NO: 104218 - protein, 33 aa, Artificial Sequence
  Description of Artificial Sequence: Synthetic polypeptide
TEEAEIRTTNPVAYECWGVVSTTNLQGDGQNDA

SEQ ID NO: 104219 - protein, 33 aa, Artificial Sequence
  Description of Artificial Sequence: Synthetic polypeptide
TEEAEIRTTNPVAYEQWGSVCSTNDGNQGGQSQ

SEQ ID NO: 104220 - protein, 34 aa, Artificial Sequence
  Description of Artificial Sequence: Synthetic polypeptide
DEGEIRTTNPVATEQYGSVSVLSNSQEGTQSPFS

SEQ ID NO: 104221 - protein, 34 aa, Artificial Sequence
  Description of Artificial Sequence: Synthetic polypeptide
AEEEIRTTNPVATEQWGSVYHWTNDHQKTDGHER

SEQ ID NO: 104222 - protein, 33 aa, Artificial Sequence
  Description of Artificial Sequence: Synthetic polypeptide
DEGEIRTTNPVATEQYGSVSWPDIELRDTDDRQ

SEQ ID NO: 104223 - protein, 34 aa, Artificial Sequence
  Description of Artificial Sequence: Synthetic polypeptide
DDEEIRSTNPVATEQYGQCVCSTNLQENSGSQQA

SEQ ID NO: 104224 - protein, 33 aa, Artificial Sequence
  Description of Artificial Sequence: Synthetic polypeptide
DEGEIRTTNPVATEQYGSVWNTPTLQENIEDGD

SEQ ID NO: 104225 - protein, 34 aa, Artificial Sequence
  Description of Artificial Sequence: Synthetic polypeptide
FEEEIRTTNPVATEQYGSVNTGTGDGQEQGNEGT

SEQ ID NO: 104226 - protein, 34 aa, Artificial Sequence
  Description of Artificial Sequence: Synthetic polypeptide
FEEEIRTTNPVATEQYGSVSDVNGTGGGNEGNIG

SEQ ID NO: 104227 - protein, 35 aa, Artificial Sequence
  Description of Artificial Sequence: Synthetic polypeptide
FEEEIRTTNPVATEQYGSVSDTPWETQQRVVENNF

SEQ ID NO: 104228 - protein, 33 aa, Artificial Sequence
  Description of Artificial Sequence: Synthetic polypeptide
DEGEIRTTNPVATGHYGSVSDTLNLTEGTEDMM

SEQ ID NO: 104229 - protein, 33 aa, Artificial Sequence
  Description of Artificial Sequence: Synthetic polypeptide
AEEEIRTTNPVATEQYGCVCQTALQENFGSEQS

SEQ ID NO: 104230 - protein, 32 aa, Artificial Sequence
  Description of Artificial Sequence: Synthetic polypeptide
DDEEIRSTNPVATEQYGCVCSTEHQESSGSQQ

SEQ ID NO: 104231 - protein, 33 aa, Artificial Sequence
  Description of Artificial Sequence: Synthetic polypeptide
DDEEIRSTNPVATEQYGCVCSTELQESSNSQQA

SEQ ID NO: 104232 - protein, 33 aa, Artificial Sequence
  Description of Artificial Sequence: Synthetic polypeptide
DDEEIRSTNPVATEQYGCVCSTENHQENSGSQQ

SEQ ID NO: 104233 - protein, 35 aa, Artificial Sequence
  Description of Artificial Sequence: Synthetic polypeptide
FEEEIRTTNPVATEQYGSVSDNGGGQTEDNGNEDA

SEQ ID NO: 104234 - protein, 35 aa, Artificial Sequence
  Description of Artificial Sequence: Synthetic polypeptide
FEEEIRTTNPVATEQYGSVSDGNGEGQGNQGENGD

SEQ ID NO: 104235 - protein, 36 aa, Artificial Sequence
  Description of Artificial Sequence: Synthetic polypeptide
FEEEIRTTNPVATEQYGSVSDGITNVGQGEGGNQIT

SEQ ID NO: 104236 - protein, 32 aa, Artificial Sequence
  Description of Artificial Sequence: Synthetic polypeptide
DEVEIATTNPVATEQYGSVSATDGEDNEGEDL

SEQ ID NO: 104237 - protein, 33 aa, Artificial Sequence
  Description of Artificial Sequence: Synthetic polypeptide
DEGEIRTTNPVATEQYGSYWVLDSMLERDNQQD

SEQ ID NO: 104238 - protein, 35 aa, Artificial Sequence
  Description of Artificial Sequence: Synthetic polypeptide
DEGEIRTTNPVATEQYGSYWSQLDNMLEERDNQRP

SEQ ID NO: 104239 - protein, 33 aa, Artificial Sequence
  Description of Artificial Sequence: Synthetic polypeptide
DEVEIATTNPVATEQYGSVSATDLEDGEGEDTM

SEQ ID NO: 104240 - protein, 33 aa, Artificial Sequence
  Description of Artificial Sequence: Synthetic polypeptide
FEEEIRTTNPVATEQYGSVSDGGGGDGENDEDD

SEQ ID NO: 104241 - protein, 34 aa, Artificial Sequence
  Description of Artificial Sequence: Synthetic polypeptide
FEEEIRTTNPVATEQYGSVSDANGTGGGNEGNEF

SEQ ID NO: 104242 - protein, 34 aa, Artificial Sequence
  Description of Artificial Sequence: Synthetic polypeptide
AEEEIRTTNPVATEQYGCVCNTEELNQSGSNTQS

SEQ ID NO: 104243 - protein, 34 aa, Artificial Sequence
  Description of Artificial Sequence: Synthetic polypeptide
FEEEIRTTNPVATEQYGSVSCPLIEQERSLEEIA

SEQ ID NO: 104244 - protein, 33 aa, Artificial Sequence
  Description of Artificial Sequence: Synthetic polypeptide
DEGEIRTTNPVATEQYGSVYPPDYDLNREENIQ

SEQ ID NO: 104245 - protein, 34 aa, Artificial Sequence
  Description of Artificial Sequence: Synthetic polypeptide
DEGEIRTTNPVATEQYGSVWTLSLETGGINQEDH

SEQ ID NO: 104246 - protein, 34 aa, Artificial Sequence
  Description of Artificial Sequence: Synthetic polypeptide
FEEEIRTTNPVATEQYGSVSAVNGFGENGGNIEE

SEQ ID NO: 104247 - protein, 33 aa, Artificial Sequence
  Description of Artificial Sequence: Synthetic polypeptide
DEGEIRTTNPVATEQYGSVWSDWPTLQENIEDG

SEQ ID NO: 104248 - protein, 35 aa, Artificial Sequence
  Description of Artificial Sequence: Synthetic polypeptide
DEGEIRTTNPVATEQYGSVWPTLNLNVIEGSNEDN

SEQ ID NO: 104249 - protein, 32 aa, Artificial Sequence
  Description of Artificial Sequence: Synthetic polypeptide
DEVEIATTNPVATEQYGSVGATDLEDGEGEDQ

SEQ ID NO: 104250 - protein, 33 aa, Artificial Sequence
  Description of Artificial Sequence: Synthetic polypeptide
FEEEIRTTNPVATEQYGSVSIDNGGNDNIQDQG

SEQ ID NO: 104251 - protein, 33 aa, Artificial Sequence
  Description of Artificial Sequence: Synthetic polypeptide
FEEEIRTTNPVATEQYGDVSIDIMNGEDDEGNG

SEQ ID NO: 104252 - protein, 31 aa, Artificial Sequence
  Description of Artificial Sequence: Synthetic polypeptide
TEECIRTTNPVAYEEYGKTVSYLNCSQDVNR

SEQ ID NO: 104253 - protein, 31 aa, Artificial Sequence
  Description of Artificial Sequence: Synthetic polypeptide
TEEEIASVNPVSTEQYGVVSIGNLSQSGGNQ

SEQ ID NO: 104254 - protein, 33 aa, Artificial Sequence
  Description of Artificial Sequence: Synthetic polypeptide
DEGEIATTNPVAYEQYGSVAGTNLQAAPDGSHN

SEQ ID NO: 104255 - protein, 33 aa, Artificial Sequence
  Description of Artificial Sequence: Synthetic polypeptide
AEEEIRTTNPVATEEYGCSCSSGELQYFGSNQF

SEQ ID NO: 104256 - protein, 33 aa, Artificial Sequence
  Description of Artificial Sequence: Synthetic polypeptide
DEGEIATTNPVAYEQYGSVAATAHLQAEPGENN

SEQ ID NO: 104257 - protein, 32 aa, Artificial Sequence
  Description of Artificial Sequence: Synthetic polypeptide
DEGEIATTNPVAYEQYGSVAASLQRENPNTEK

SEQ ID NO: 104258 - protein, 35 aa, Artificial Sequence
  Description of Artificial Sequence: Synthetic polypeptide
TEEEIATTNPVATEPYGQSVVGTNLSQSRTVNQRY

SEQ ID NO: 104259 - protein, 32 aa, Artificial Sequence
  Description of Artificial Sequence: Synthetic polypeptide
ENSNEIATTNPVAYEQWGVVSTNLQGDHGPNR

SEQ ID NO: 104260 - protein, 34 aa, Artificial Sequence
  Description of Artificial Sequence: Synthetic polypeptide
DEGEIATTNPVAYEQYGSTVCAANNLQEADGNRD

SEQ ID NO: 104261 - protein, 28 aa, Artificial Sequence
  Description of Artificial Sequence: Synthetic peptide
TEEEIATTNPVATEQYGEAPEHCQHEEK

SEQ ID NO: 104262 - protein, 32 aa, Artificial Sequence
  Description of Artificial Sequence: Synthetic polypeptide
ENETEIATTNPVAYEQWGSVSTNLNGGPNDSS

SEQ ID NO: 104263 - protein, 32 aa, Artificial Sequence
  Description of Artificial Sequence: Synthetic polypeptide
FEDEIRTTNPVATEQYGMTSTNGGQGGGGDEG

SEQ ID NO: 104264 - protein, 34 aa, Artificial Sequence
  Description of Artificial Sequence: Synthetic polypeptide
DEGEIATTNPVAYEQYGSNVSANAGLQDSGGNDP

SEQ ID NO: 104265 - protein, 32 aa, Artificial Sequence
  Description of Artificial Sequence: Synthetic polypeptide
DEGEIATTNPVAYEQYGSCATNLQNPQEQTRQ

SEQ ID NO: 104266 - protein, 32 aa, Artificial Sequence
  Description of Artificial Sequence: Synthetic polypeptide
ENEEISTTNPVATTQWGSVSKTNEMERGGDSR

SEQ ID NO: 104267 - protein, 34 aa, Artificial Sequence
  Description of Artificial Sequence: Synthetic polypeptide
DEGEIATTNPVAYEQYGQSVSTNDLMQDGIGDDQ

SEQ ID NO: 104268 - protein, 34 aa, Artificial Sequence
  Description of Artificial Sequence: Synthetic polypeptide
DEGEIATTNPVAYEQYGQSTVATNDLMQDGIGDR

SEQ ID NO: 104269 - protein, 32 aa, Artificial Sequence
  Description of Artificial Sequence: Synthetic polypeptide
DEVEIATTNPVAYEAWGSVSTNLQGADNDGLM

SEQ ID NO: 104270 - protein, 32 aa, Artificial Sequence
  Description of Artificial Sequence: Synthetic polypeptide
DEGEIATTNPVAYEQYGCVATNLQGPQEQTRQ

SEQ ID NO: 104271 - protein, 33 aa, Artificial Sequence
  Description of Artificial Sequence: Synthetic polypeptide
DEGEIATTNPVAYEQYGCVATNLQARPQEQTNQ

SEQ ID NO: 104272 - protein, 33 aa, Artificial Sequence
  Description of Artificial Sequence: Synthetic polypeptide
DEGEIATTNPVAYEQWGYTISPNELQDRDGNDR

SEQ ID NO: 104273 - protein, 28 aa, Artificial Sequence
  Description of Artificial Sequence: Synthetic peptide
TEEEIATTNPVATEQYGEAPEVCQHEEK

SEQ ID NO: 104274 - protein, 32 aa, Artificial Sequence
  Description of Artificial Sequence: Synthetic polypeptide
ENEEISTTNPVATTQWGSVSKTDNPMERGDTR

SEQ ID NO: 104275 - protein, 32 aa, Artificial Sequence
  Description of Artificial Sequence: Synthetic polypeptide
DEVEIATTNPVAYEAWGSVSTNIQGADNDGRS

SEQ ID NO: 104276 - protein, 28 aa, Artificial Sequence
  Description of Artificial Sequence: Synthetic peptide
TEEEIATTNPVATEQYGEAPEVCQPEEK

SEQ ID NO: 104277 - protein, 33 aa, Artificial Sequence
  Description of Artificial Sequence: Synthetic polypeptide
DEVEIATTNPVAYEAWGSVSNTNNLQGADNDGR

SEQ ID NO: 104278 - protein, 32 aa, Artificial Sequence
  Description of Artificial Sequence: Synthetic polypeptide
DEVEIATTNPVAYEAWGSVATNLQGDAGNNSN

SEQ ID NO: 104279 - protein, 34 aa, Artificial Sequence
  Description of Artificial Sequence: Synthetic polypeptide
FEDEIRTTNPVATEQYGSVSTMDLIGQGEGGEEG

SEQ ID NO: 104280 - protein, 31 aa, Artificial Sequence
  Description of Artificial Sequence: Synthetic polypeptide
TEEEIASVNPVCTEQYGVVSINALSQSVGNQ

SEQ ID NO: 104281 - protein, 31 aa, Artificial Sequence
  Description of Artificial Sequence: Synthetic polypeptide
TEEEIASVNPVCTEQYGVVSINELQSGGNYQ

SEQ ID NO: 104282 - protein, 31 aa, Artificial Sequence
  Description of Artificial Sequence: Synthetic polypeptide
DEVEIATTNPVAYEAWGEVSGNLQGNDNDGR

SEQ ID NO: 104283 - protein, 30 aa, Artificial Sequence
  Description of Artificial Sequence: Synthetic polypeptide
TEEEIASVNPVCTEQYGVVSINELSQSGSQ

SEQ ID NO: 104284 - protein, 30 aa, Artificial Sequence
  Description of Artificial Sequence: Synthetic polypeptide
TEEEIASVNPVCTEQYGVVSINLSTSGGNQ

SEQ ID NO: 104285 - protein, 33 aa, Artificial Sequence
  Description of Artificial Sequence: Synthetic polypeptide
FEDEIRTTNPVATEQYGSVNVNGMEQNIGGGNA

SEQ ID NO: 104286 - protein, 33 aa, Artificial Sequence
  Description of Artificial Sequence: Synthetic polypeptide
AEEEIRTTNPVATEEYGCSCSSGNLQHFGSQQS

SEQ ID NO: 104287 - protein, 31 aa, Artificial Sequence
  Description of Artificial Sequence: Synthetic polypeptide
TEEEIASVNPVCTEQYGVVVSDNLSQSGNQA

SEQ ID NO: 104288 - protein, 34 aa, Artificial Sequence
  Description of Artificial Sequence: Synthetic polypeptide
FEDEIRTTNPVATEQYGSVNTNGMEQDEIGGGNG

SEQ ID NO: 104289 - protein, 34 aa, Artificial Sequence
  Description of Artificial Sequence: Synthetic polypeptide
FEDEIRTTNPVATEQYGSVNTMNGEQTGGGNTND

SEQ ID NO: 104290 - protein, 31 aa, Artificial Sequence
  Description of Artificial Sequence: Synthetic polypeptide
DEVEIATTNPVAYEAWGSVATNLQGADMDGR

SEQ ID NO: 104291 - protein, 30 aa, Artificial Sequence
  Description of Artificial Sequence: Synthetic polypeptide
TEEEIASVNPVCYEQYGKVSINLSQSVGNQ

SEQ ID NO: 104292 - protein, 30 aa, Artificial Sequence
  Description of Artificial Sequence: Synthetic polypeptide
TEEEIASVNPVCYEQYGVVSCDNLQSGNQV

SEQ ID NO: 104293 - protein, 30 aa, Artificial Sequence
  Description of Artificial Sequence: Synthetic polypeptide
TEEEIASVNPVSTEAYGVVSDNLSQSTGNQ

SEQ ID NO: 104294 - protein, 31 aa, Artificial Sequence
  Description of Artificial Sequence: Synthetic polypeptide
TEEEIASVNPVSTEQYGCVVCSDNLEQSGNQ

SEQ ID NO: 104295 - protein, 33 aa, Artificial Sequence
  Description of Artificial Sequence: Synthetic polypeptide
DEGEIATTNPVAYEQYGSVATNGQAAQGDNNDN

SEQ ID NO: 104296 - protein, 32 aa, Artificial Sequence
  Description of Artificial Sequence: Synthetic polypeptide
DEGEIATTNPVAYEQYGSVATHLQESGDSDEG

SEQ ID NO: 104297 - protein, 32 aa, Artificial Sequence
  Description of Artificial Sequence: Synthetic polypeptide
DEGEIATTNPVAYEQYGSVATHLQDSDGSVVH

SEQ ID NO: 104298 - protein, 32 aa, Artificial Sequence
  Description of Artificial Sequence: Synthetic polypeptide
DEGEIATTNPVAYEQYGSVASNLADDPGGNHH

SEQ ID NO: 104299 - protein, 31 aa, Artificial Sequence
  Description of Artificial Sequence: Synthetic polypeptide
TEEEIASVNPVSTEQYGCVVSDNLSQSGNNQ

SEQ ID NO: 104300 - protein, 33 aa, Artificial Sequence
  Description of Artificial Sequence: Synthetic polypeptide
DEGEIATTNPVAYEQYGSVANANNTLDERDNRN

SEQ ID NO: 104301 - protein, 29 aa, Artificial Sequence
  Description of Artificial Sequence: Synthetic peptide
TEEEIASVNPVCYEQWGVVSINLSQSGNQ

SEQ ID NO: 104302 - protein, 31 aa, Artificial Sequence
  Description of Artificial Sequence: Synthetic polypeptide
DEGEIATTNPVAYEQWGSCWTDLIREMNEGR

SEQ ID NO: 104303 - protein, 32 aa, Artificial Sequence
  Description of Artificial Sequence: Synthetic polypeptide
DEGEIATTNPVAYEPYGSVCATNGTDRGGNEQ

SEQ ID NO: 104304 - protein, 28 aa, Artificial Sequence
  Description of Artificial Sequence: Synthetic peptide
TEEEIATTNPVATEQYGEQPEVCQHEEK

SEQ ID NO: 104305 - protein, 33 aa, Artificial Sequence
  Description of Artificial Sequence: Synthetic polypeptide
DEGEIATTNPVATEQYGSVCAATNDTMGGENHQ

SEQ ID NO: 104306 - protein, 32 aa, Artificial Sequence
  Description of Artificial Sequence: Synthetic polypeptide
DEVEIATTNPVAYEGWGSVATNLQGDAGNNEP

SEQ ID NO: 104307 - protein, 36 aa, Artificial Sequence
  Description of Artificial Sequence: Synthetic polypeptide
TEEEIATTNPVATEQYGSVCSKTNDDLDQRNANDQE

SEQ ID NO: 104308 - protein, 34 aa, Artificial Sequence
  Description of Artificial Sequence: Synthetic polypeptide
DEGEIATTNPVATEQYGSVCAATANDQDPGENDN

SEQ ID NO: 104309 - protein, 31 aa, Artificial Sequence
  Description of Artificial Sequence: Synthetic polypeptide
DEGEIATTNPVATEQYGSVCAAPLQDHMDQQ

SEQ ID NO: 104310 - protein, 33 aa, Artificial Sequence
  Description of Artificial Sequence: Synthetic polypeptide
DEGEIATTNPVATEQYGSVCAANPLQEADNMDN

SEQ ID NO: 104311 - protein, 33 aa, Artificial Sequence
  Description of Artificial Sequence: Synthetic polypeptide
DEGEIATTNPVATEQYGSVCAANPLQEADNAEQ

SEQ ID NO: 104312 - protein, 33 aa, Artificial Sequence
  Description of Artificial Sequence: Synthetic polypeptide
TEEEIATTNPVATEQYGSVNYIFLSGRTGGNNS

SEQ ID NO: 104313 - protein, 36 aa, Artificial Sequence
  Description of Artificial Sequence: Synthetic polypeptide
AEEEIRTTNPVATEAYGVVSVVVSTNLQQGNNGNQD

SEQ ID NO: 104314 - protein, 32 aa, Artificial Sequence
  Description of Artificial Sequence: Synthetic polypeptide
ENEEIRTTNPVAYEQWGCVSTTNNADSGQGNR

SEQ ID NO: 104315 - protein, 34 aa, Artificial Sequence
  Description of Artificial Sequence: Synthetic polypeptide
DEGEIATTNPVATEQYGSVCAATNGLEETNDNRN

SEQ ID NO: 104316 - protein, 34 aa, Artificial Sequence
  Description of Artificial Sequence: Synthetic polypeptide
DEGEIATTNPVATEQYGSVCAANNLQEAGENADD

SEQ ID NO: 104317 - protein, 32 aa, Artificial Sequence
  Description of Artificial Sequence: Synthetic polypeptide
ENEEIRTTNPVAYEQWGCVSTTNGADDGQMNR

SEQ ID NO: 104318 - protein, 35 aa, Artificial Sequence
  Description of Artificial Sequence: Synthetic polypeptide
TEEEIATTNPVATEQYGTVVSVTDMMLSQGTGNNR

SEQ ID NO: 104319 - protein, 32 aa, Artificial Sequence
  Description of Artificial Sequence: Synthetic polypeptide
ENEEIATTNPVAYEQWGVVSTTNLQGDHGPNP

SEQ ID NO: 104320 - protein, 31 aa, Artificial Sequence
  Description of Artificial Sequence: Synthetic polypeptide
DEVEIATTNPVAYEGWGSVVTNPGNDGENSR

SEQ ID NO: 104321 - protein, 31 aa, Artificial Sequence
  Description of Artificial Sequence: Synthetic polypeptide
DEVEIATTNPVAYEHWGEATTNLQGNDSGNR

SEQ ID NO: 104322 - protein, 32 aa, Artificial Sequence
  Description of Artificial Sequence: Synthetic polypeptide
DEVEIATTNPVAYEHWGEVATNLQGNDSGNNR

SEQ ID NO: 104323 - protein, 32 aa, Artificial Sequence
  Description of Artificial Sequence: Synthetic polypeptide
ENEEIATTNPVAYEQWGVVSTNLQGDHGPQMR

SEQ ID NO: 104324 - protein, 33 aa, Artificial Sequence
  Description of Artificial Sequence: Synthetic polypeptide
DEVEIATTNPVAYEHWGEVSTNLQGNDMGGNNR

SEQ ID NO: 104325 - protein, 36 aa, Artificial Sequence
  Description of Artificial Sequence: Synthetic polypeptide
AEEEIRTTNPVATEAYGVVSVSVTNLQQLENGTNQD

SEQ ID NO: 104326 - protein, 34 aa, Artificial Sequence
  Description of Artificial Sequence: Synthetic polypeptide
TEEEIATTNPVAYEQDGSVSTPNELSPQGENYRN

SEQ ID NO: 104327 - protein, 36 aa, Artificial Sequence
  Description of Artificial Sequence: Synthetic polypeptide
AEEEIRTTNPVATEAYGVVSVSVVTNLQQNNGNNQD

SEQ ID NO: 104328 - protein, 33 aa, Artificial Sequence
  Description of Artificial Sequence: Synthetic polypeptide
DEGEIATTNPVATEQYGSVCAATNNLEETNDNN

SEQ ID NO: 104329 - protein, 32 aa, Artificial Sequence
  Description of Artificial Sequence: Synthetic polypeptide
DEVEIATTNPVAYEGWGSVATNLNQGADNDGR

SEQ ID NO: 104330 - protein, 33 aa, Artificial Sequence
  Description of Artificial Sequence: Synthetic polypeptide
DEGEIATTNPVATEQYGSVCAGENGADGLGDNR

SEQ ID NO: 104331 - protein, 29 aa, Artificial Sequence
  Description of Artificial Sequence: Synthetic peptide
TEEEIATTNPVATEQYGEVAPEVSQHEEK

SEQ ID NO: 104332 - protein, 32 aa, Artificial Sequence
  Description of Artificial Sequence: Synthetic polypeptide
AEEEIRTTNPVATEEYGCISCIPLSTRGGNNQ

SEQ ID NO: 104333 - protein, 31 aa, Artificial Sequence
  Description of Artificial Sequence: Synthetic polypeptide
DEVEIATTNPVAYEAWGVTSTNLQGADNDSR

SEQ ID NO: 104334 - protein, 33 aa, Artificial Sequence
  Description of Artificial Sequence: Synthetic polypeptide
DDEEIRTTNPVATEQWGAVVTSGLRLQREGQTF

SEQ ID NO: 104335 - protein, 33 aa, Artificial Sequence
  Description of Artificial Sequence: Synthetic polypeptide
DEGEIATTNPVATEQYGTCSTIEPLQMRMENNN

SEQ ID NO: 104336 - protein, 32 aa, Artificial Sequence
  Description of Artificial Sequence: Synthetic polypeptide
ENEEISTTNPVATTQWGSVSKTDNPMERGDSR

SEQ ID NO: 104337 - protein, 31 aa, Artificial Sequence
  Description of Artificial Sequence: Synthetic polypeptide
DDEEIRTTNPVATEQWGCVTSSEHQHFGSDA

SEQ ID NO: 104338 - protein, 33 aa, Artificial Sequence
  Description of Artificial Sequence: Synthetic polypeptide
DEGEIATTNPVATEQYGSVSTATDLEPHEGEDT

SEQ ID NO: 104339 - protein, 35 aa, Artificial Sequence
  Description of Artificial Sequence: Synthetic polypeptide
TEEEIATTNPVATEQYGNVVSVTMMLSQGTGNNRI

SEQ ID NO: 104340 - protein, 34 aa, Artificial Sequence
  Description of Artificial Sequence: Synthetic polypeptide
ENEEIRTTNPVAYEQWGCVSTTNQLADSGQGGNR

SEQ ID NO: 104341 - protein, 33 aa, Artificial Sequence
  Description of Artificial Sequence: Synthetic polypeptide
DEGEIATTNPVATEQYGSVSATDILEPHEGEDL

SEQ ID NO: 104342 - protein, 32 aa, Artificial Sequence
  Description of Artificial Sequence: Synthetic polypeptide
DEVEIATTNPVAYEEWGVVSTNLNQGADNDGR

SEQ ID NO: 104343 - protein, 33 aa, Artificial Sequence
  Description of Artificial Sequence: Synthetic polypeptide
DEGEIATTNPVATEQYGSVSANGNLPPMNMPQE

SEQ ID NO: 104344 - protein, 33 aa, Artificial Sequence
  Description of Artificial Sequence: Synthetic polypeptide
DEGEIATTNPVATEQYGSVPSATDLEDHEGEDL

SEQ ID NO: 104345 - protein, 30 aa, Artificial Sequence
  Description of Artificial Sequence: Synthetic polypeptide
DEVEIATTNPVAYEGWGSTVTNLQGGMDGA

SEQ ID NO: 104346 - protein, 34 aa, Artificial Sequence
  Description of Artificial Sequence: Synthetic polypeptide
TEEEIATTNPVATEQYGSTVSTNLSDDNVANNDS

SEQ ID NO: 104347 - protein, 34 aa, Artificial Sequence
  Description of Artificial Sequence: Synthetic polypeptide
DEGEIATTNPVATEQYGSVCSMNNQNEAMPDGNN

SEQ ID NO: 104348 - protein, 33 aa, Artificial Sequence
  Description of Artificial Sequence: Synthetic polypeptide
DEGEIATTNPVATEQYGSVCATPLTQPDQGEAM

SEQ ID NO: 104349 - protein, 34 aa, Artificial Sequence
  Description of Artificial Sequence: Synthetic polypeptide
DEGEIATTNPVATEQYGSVCATNPEQDGNQTEGT

SEQ ID NO: 104350 - protein, 32 aa, Artificial Sequence
  Description of Artificial Sequence: Synthetic polypeptide
DEVEIATTNPVAYEGWGSVATNEQGNDDGNNR

SEQ ID NO: 104351 - protein, 33 aa, Artificial Sequence
  Description of Artificial Sequence: Synthetic polypeptide
DEGEIATTNPVATEQYGSVCATNLTAPDNQEAM

SEQ ID NO: 104352 - protein, 31 aa, Artificial Sequence
  Description of Artificial Sequence: Synthetic polypeptide
DEVEIATTNPVAYEGWGSVATNIQGNDMGNS

SEQ ID NO: 104353 - protein, 34 aa, Artificial Sequence
  Description of Artificial Sequence: Synthetic polypeptide
DEGEIATTNPVATEQYGSVCATNLQDDPLMGDLH

SEQ ID NO: 104354 - protein, 35 aa, Artificial Sequence
  Description of Artificial Sequence: Synthetic polypeptide
FEDEIRTTNPVATEQYGSVSTTNGMEQQNIGGGNG

SEQ ID NO: 104355 - protein, 32 aa, Artificial Sequence
  Description of Artificial Sequence: Synthetic polypeptide
DEGEIATTNPVAYEQYGSVATNLTRPQEQTDD

SEQ ID NO: 104356 - protein, 33 aa, Artificial Sequence
  Description of Artificial Sequence: Synthetic polypeptide
DEGEIATTNPVAYEQYGSVCAAANNLQEAGNFF

SEQ ID NO: 104357 - protein, 33 aa, Artificial Sequence
  Description of Artificial Sequence: Synthetic polypeptide
DEGEIATTNPVAYEQYGSVCAANDLQDSDGNFH

SEQ ID NO: 104358 - protein, 33 aa, Artificial Sequence
  Description of Artificial Sequence: Synthetic polypeptide
FEEEIRTTNPVATEPYGSVVGFGNLEGGGEGND

SEQ ID NO: 104359 - protein, 34 aa, Artificial Sequence
  Description of Artificial Sequence: Synthetic polypeptide
DEGEIRTTNPVATEQYGCVISTVETLQEITQNFN

SEQ ID NO: 104360 - protein, 35 aa, Artificial Sequence
  Description of Artificial Sequence: Synthetic polypeptide
FEEEIRTTNPVATEGYGSVSTMNEMQEGGGQNDNV

SEQ ID NO: 104361 - protein, 32 aa, Artificial Sequence
  Description of Artificial Sequence: Synthetic polypeptide
DEGEIRTTNPVATEQWGKVSETESMNAAEGDA

SEQ ID NO: 104362 - protein, 29 aa, Artificial Sequence
  Description of Artificial Sequence: Synthetic peptide
DEGEIRTTNPVATEQWGDVSEIEMSAETA

SEQ ID NO: 104363 - protein, 30 aa, Artificial Sequence
  Description of Artificial Sequence: Synthetic polypeptide
DEGEIRTTNPVATEQWGDVSEIEMNAAEDR

SEQ ID NO: 104364 - protein, 29 aa, Artificial Sequence
  Description of Artificial Sequence: Synthetic peptide
DEGEIRTTNPVATEQWGDVSEIEMAAETA

SEQ ID NO: 104365 - protein, 30 aa, Artificial Sequence
  Description of Artificial Sequence: Synthetic polypeptide
DEGEIRTTNPVATEQWGDVSCIEQNAAEDA

SEQ ID NO: 104366 - protein, 32 aa, Artificial Sequence
  Description of Artificial Sequence: Synthetic polypeptide
TEECISTTNPVATEQYGCVCSWGNHQNFGSNQ

SEQ ID NO: 104367 - protein, 34 aa, Artificial Sequence
  Description of Artificial Sequence: Synthetic polypeptide
FEEEIRTTNPVATEGYGDVSTQNLQNEMGVGDGE

SEQ ID NO: 104368 - protein, 31 aa, Artificial Sequence
  Description of Artificial Sequence: Synthetic polypeptide
DEGEIRTTNPVATEQYGCVSSLLAEEPQEPM

SEQ ID NO: 104369 - protein, 31 aa, Artificial Sequence
  Description of Artificial Sequence: Synthetic polypeptide
AEEEIRTTNPVATEEYGCSSWEHQNFGSNQI

SEQ ID NO: 104370 - protein, 29 aa, Artificial Sequence
  Description of Artificial Sequence: Synthetic peptide
AENEIATTNPVATECYGVVSECLQHEHES

SEQ ID NO: 104371 - protein, 33 aa, Artificial Sequence
  Description of Artificial Sequence: Synthetic polypeptide
DEGEIRTTNPVATECWGSVSCINEPQDPEGENG

SEQ ID NO: 104372 - protein, 34 aa, Artificial Sequence
  Description of Artificial Sequence: Synthetic polypeptide
DEGEIRTTNPVATECWGSVSACINEPQDREGENG

SEQ ID NO: 104373 - protein, 33 aa, Artificial Sequence
  Description of Artificial Sequence: Synthetic polypeptide
TEECVRTTNPIAYEQYGETVSTNLSQASGGNNR

SEQ ID NO: 104374 - protein, 33 aa, Artificial Sequence
  Description of Artificial Sequence: Synthetic polypeptide
TEEEIACTNPIATEQYGSTVSENELSMRTGGNA

SEQ ID NO: 104375 - protein, 36 aa, Artificial Sequence
  Description of Artificial Sequence: Synthetic polypeptide
DEGEIRTTNPLAYEQYGQSVSGTGNSLSQLRVGDNF

SEQ ID NO: 104376 - protein, 33 aa, Artificial Sequence
  Description of Artificial Sequence: Synthetic polypeptide
FEEEIRTTNPVATEGYGCTSIMNLGQEGGGQNI

SEQ ID NO: 104377 - protein, 28 aa, Artificial Sequence
  Description of Artificial Sequence: Synthetic peptide
DEGEIRTTNPCSTEQWGIVSEILMSETA

SEQ ID NO: 104378 - protein, 33 aa, Artificial Sequence
  Description of Artificial Sequence: Synthetic polypeptide
FEEEIRTTNPVATEGYGCTSIMNDLGQTGGGNI

SEQ ID NO: 104379 - protein, 31 aa, Artificial Sequence
  Description of Artificial Sequence: Synthetic polypeptide
DEGEIRTTNPCSSEQYGIVSCENLQQQNGTH

SEQ ID NO: 104380 - protein, 33 aa, Artificial Sequence
  Description of Artificial Sequence: Synthetic polypeptide
DEGEIRTTNPVATECWGSVSCINEPQDREPENG

SEQ ID NO: 104381 - protein, 34 aa, Artificial Sequence
  Description of Artificial Sequence: Synthetic polypeptide
FEEEIRTTNPVATEPYGSVVGFGNLQGNGGEGNG

SEQ ID NO: 104382 - protein, 34 aa, Artificial Sequence
  Description of Artificial Sequence: Synthetic polypeptide
FEEEIRTTNPVATEQYGAVISTGDDQDEGGNTEQ

SEQ ID NO: 104383 - protein, 34 aa, Artificial Sequence
  Description of Artificial Sequence: Synthetic polypeptide
FEEEIRTTNPVATEQYGAVSITNGDEFNGGGGNN

SEQ ID NO: 104384 - protein, 32 aa, Artificial Sequence
  Description of Artificial Sequence: Synthetic polypeptide
TEECIRTTNPVAYEEYGKTVSYLNISQDGNFR

SEQ ID NO: 104385 - protein, 33 aa, Artificial Sequence
  Description of Artificial Sequence: Synthetic polypeptide
DEGEIRTTNPVATEQYGCVSWTWPEDQETNEQD

SEQ ID NO: 104386 - protein, 33 aa, Artificial Sequence
  Description of Artificial Sequence: Synthetic polypeptide
DEGEIRTTNPVATEQYGCVSWQMNNQRSIQIVE

SEQ ID NO: 104387 - protein, 33 aa, Artificial Sequence
  Description of Artificial Sequence: Synthetic polypeptide
DEGEIRTTNPVATEQYGCVSTVPLEMPDMQQRP

SEQ ID NO: 104388 - protein, 34 aa, Artificial Sequence
  Description of Artificial Sequence: Synthetic polypeptide
FEEEIRTTNPVATEQYGDVSGTMESGQSGGNNDD

SEQ ID NO: 104389 - protein, 34 aa, Artificial Sequence
  Description of Artificial Sequence: Synthetic polypeptide
FEEEIRTTNPVATEQYGDVNTDNMGQDETGNANT

SEQ ID NO: 104390 - protein, 34 aa, Artificial Sequence
  Description of Artificial Sequence: Synthetic polypeptide
FEEEIRTTNPVATEQYGDVDTNLDMEGQENGQED

SEQ ID NO: 104391 - protein, 31 aa, Artificial Sequence
  Description of Artificial Sequence: Synthetic polypeptide
TEECIRTTNPVAYEQWGSVSKNLEDLGGGSN

SEQ ID NO: 104392 - protein, 33 aa, Artificial Sequence
  Description of Artificial Sequence: Synthetic polypeptide
TEECIRTTNPVAYEQWGSVSKTNPESGQGKGNQ

SEQ ID NO: 104393 - protein, 32 aa, Artificial Sequence
  Description of Artificial Sequence: Synthetic polypeptide
DEGEIRTTNPVATEQYGCVSTNDNTEIFLDMI

SEQ ID NO: 104394 - protein, 32 aa, Artificial Sequence
  Description of Artificial Sequence: Synthetic polypeptide
TEECIRTTNPVAYEQYGGTVSCTQNQSQSGEN

SEQ ID NO: 104395 - protein, 33 aa, Artificial Sequence
  Description of Artificial Sequence: Synthetic polypeptide
FEEEIRTTNPVATEQYGAVVIVNGEGQGGGGNE

SEQ ID NO: 104396 - protein, 33 aa, Artificial Sequence
  Description of Artificial Sequence: Synthetic polypeptide
FEEEIRTTNPVATEQYGAVSVNGDTGQSEGGET

SEQ ID NO: 104397 - protein, 29 aa, Artificial Sequence
  Description of Artificial Sequence: Synthetic peptide
AENEIATTNPVATEGYGCVCSWALQHSEL

SEQ ID NO: 104398 - protein, 34 aa, Artificial Sequence
  Description of Artificial Sequence: Synthetic polypeptide
FEEEIRTTNPVATEQYGAVSVGDLGQRFNINEQA

SEQ ID NO: 104399 - protein, 35 aa, Artificial Sequence
  Description of Artificial Sequence: Synthetic polypeptide
FEEEIRTTNPVATEQYGAVSTDGDNDQIGEGENGG

SEQ ID NO: 104400 - protein, 33 aa, Artificial Sequence
  Description of Artificial Sequence: Synthetic polypeptide
TEECIRTTNPVAYEQYGQTVSCTQNNSQSGLNN

SEQ ID NO: 104401 - protein, 32 aa, Artificial Sequence
  Description of Artificial Sequence: Synthetic polypeptide
TEECIRTTNPVAYEQYGQTVSCTQNQSHSGNN

SEQ ID NO: 104402 - protein, 33 aa, Artificial Sequence
  Description of Artificial Sequence: Synthetic polypeptide
TEECIRTTNPVAYEQYGQTVSCTQNVSQFSGNM

SEQ ID NO: 104403 - protein, 33 aa, Artificial Sequence
  Description of Artificial Sequence: Synthetic polypeptide
DEGEIRTTNPVATEQYGCVSTEIVDEWQEDNFM

SEQ ID NO: 104404 - protein, 34 aa, Artificial Sequence
  Description of Artificial Sequence: Synthetic polypeptide
DEGEIRTTNPVATEQYGCVSTEDWFQESGQNESN

SEQ ID NO: 104405 - protein, 33 aa, Artificial Sequence
  Description of Artificial Sequence: Synthetic polypeptide
DEGEIRTTNPVATEQYGCVSTEAVDERFEDNFV

SEQ ID NO: 104406 - protein, 34 aa, Artificial Sequence
  Description of Artificial Sequence: Synthetic polypeptide
FEEEIRTTNPVATEQYGAVSIVTGEGQGGGGNQN

SEQ ID NO: 104407 - protein, 30 aa, Artificial Sequence
  Description of Artificial Sequence: Synthetic polypeptide
DEGEIRTTNPCSSEQYGIISCENIQQNGTR

SEQ ID NO: 104408 - protein, 32 aa, Artificial Sequence
  Description of Artificial Sequence: Synthetic polypeptide
TEECIRTTNPVAYEEYGKTVQSYLNDSQDGNR

SEQ ID NO: 104409 - protein, 34 aa, Artificial Sequence
  Description of Artificial Sequence: Synthetic polypeptide
FEEEIRTTNPVATEFYGSVSTMDFQIDQGGENGD

SEQ ID NO: 104410 - protein, 28 aa, Artificial Sequence
  Description of Artificial Sequence: Synthetic peptide
DEGEIRTTNPCSSEPYGIISMDLQSGTH

SEQ ID NO: 104411 - protein, 31 aa, Artificial Sequence
  Description of Artificial Sequence: Synthetic polypeptide
TEEEIASVNPVCTEQYGCVVPSDNLSQSGNQ

SEQ ID NO: 104412 - protein, 31 aa, Artificial Sequence
  Description of Artificial Sequence: Synthetic polypeptide
AENEIATTNPVATECYGEASENLPQDRGEGG

SEQ ID NO: 104413 - protein, 31 aa, Artificial Sequence
  Description of Artificial Sequence: Synthetic polypeptide
FEEEIGSVNPVSTEQYGVVSVTNTLQQGSQD

SEQ ID NO: 104414 - protein, 30 aa, Artificial Sequence
  Description of Artificial Sequence: Synthetic polypeptide
FEEEIGSVNPVSTEQYGVVSVNTQQQGPND

SEQ ID NO: 104415 - protein, 31 aa, Artificial Sequence
  Description of Artificial Sequence: Synthetic polypeptide
DEGEIATTNPVSTECYGIVSCINEQDREGTG

SEQ ID NO: 104416 - protein, 31 aa, Artificial Sequence
  Description of Artificial Sequence: Synthetic polypeptide
TEEEIASVNPVCTEQYGKVSINELSQSGGNQ

SEQ ID NO: 104417 - protein, 31 aa, Artificial Sequence
  Description of Artificial Sequence: Synthetic polypeptide
FEEEIGSVNPVSTEQYGVVSVNTLQQTGNQD

SEQ ID NO: 104418 - protein, 28 aa, Artificial Sequence
  Description of Artificial Sequence: Synthetic peptide
AENEIATTNPVATECYGEASECLQHEGL

SEQ ID NO: 104419 - protein, 31 aa, Artificial Sequence
  Description of Artificial Sequence: Synthetic polypeptide
FEEEIGSVNPVSTEQYGVVSVNTLQQGNGQN

SEQ ID NO: 104420 - protein, 31 aa, Artificial Sequence
  Description of Artificial Sequence: Synthetic polypeptide
TEEEIASVNPVCTEQYGVVSCNLSQSGGNQV

SEQ ID NO: 104421 - protein, 31 aa, Artificial Sequence
  Description of Artificial Sequence: Synthetic polypeptide
TEEEIASVNPVCTEQYGCVVCTDNLQQSGNQ

SEQ ID NO: 104422 - protein, 32 aa, Artificial Sequence
  Description of Artificial Sequence: Synthetic polypeptide
DEGEIATTNPVSSEQWGSVSCINEQDREGETR

SEQ ID NO: 104423 - protein, 28 aa, Artificial Sequence
  Description of Artificial Sequence: Synthetic peptide
FEEEIATTNPVATEQYGEPPEVGQHEEH

SEQ ID NO: 104424 - protein, 35 aa, Artificial Sequence
  Description of Artificial Sequence: Synthetic polypeptide
DEGEIATTNPVAYEQYGVSVSATNPLGQMHAGIAR

SEQ ID NO: 104425 - protein, 28 aa, Artificial Sequence
  Description of Artificial Sequence: Synthetic peptide
FEEEIATTNPVATEQYGEIPEVAQHEEK

SEQ ID NO: 104426 - protein, 34 aa, Artificial Sequence
  Description of Artificial Sequence: Synthetic polypeptide
DEGEIATTNPVAYEQYGSVVATNLQGRPQEQTNQ

SEQ ID NO: 104427 - protein, 28 aa, Artificial Sequence
  Description of Artificial Sequence: Synthetic peptide
FEEEIATTNPVATEQYGEAPEVCQHEEK

SEQ ID NO: 104428 - protein, 32 aa, Artificial Sequence
  Description of Artificial Sequence: Synthetic polypeptide
DEVEIATTNPVATWQYGSVSATDLEDHEGEDL

SEQ ID NO: 104429 - protein, 33 aa, Artificial Sequence
  Description of Artificial Sequence: Synthetic polypeptide
DEGEIATTNPVAYEQYGSVCAATNPLAEAGNNF

SEQ ID NO: 104430 - protein, 34 aa, Artificial Sequence
  Description of Artificial Sequence: Synthetic polypeptide
DEGEIATTNPVAYEQYGSVCAATNDLNQREDNDM

SEQ ID NO: 104431 - protein, 33 aa, Artificial Sequence
  Description of Artificial Sequence: Synthetic polypeptide
DEGEIATTNPVAYEQYGSVCAANPLQEADNQRQ

SEQ ID NO: 104432 - protein, 34 aa, Artificial Sequence
  Description of Artificial Sequence: Synthetic polypeptide
DEGEIATTNPVAYEQYGSVCAANNLQEAPGENGR

SEQ ID NO: 104433 - protein, 30 aa, Artificial Sequence
  Description of Artificial Sequence: Synthetic polypeptide
TEEEIASVNPVCTEQYGVVSDNLAQSVNNQ

SEQ ID NO: 104434 - protein, 31 aa, Artificial Sequence
  Description of Artificial Sequence: Synthetic polypeptide
DEVEIATTNPVATTQWGCVRTIEDQHQGNER

SEQ ID NO: 104435 - protein, 31 aa, Artificial Sequence
  Description of Artificial Sequence: Synthetic polypeptide
DEVEIATTNPVATTQWGCVRTIDNRQGQNER

SEQ ID NO: 104436 - protein, 31 aa, Artificial Sequence
  Description of Artificial Sequence: Synthetic polypeptide
DEVEIATTNPVATTQWGCVRTADQHQQGNER

SEQ ID NO: 104437 - protein, 30 aa, Artificial Sequence
  Description of Artificial Sequence: Synthetic polypeptide
DEGEIRTTNPCATEQYGDVSENEMNAAEDA

SEQ ID NO: 104438 - protein, 33 aa, Artificial Sequence
  Description of Artificial Sequence: Synthetic polypeptide
FEEEIRTTNPVATEFYGSVSTGVGDDEGGEGNI

SEQ ID NO: 104439 - protein, 35 aa, Artificial Sequence
  Description of Artificial Sequence: Synthetic polypeptide
FEEEIRTTNPVATEAYGSVSTVNGFGQENQGNVGG

SEQ ID NO: 104440 - protein, 35 aa, Artificial Sequence
  Description of Artificial Sequence: Synthetic polypeptide
FEEEIRTTNPVATEAYGSVISTNLVIGNEGNQTGN

SEQ ID NO: 104441 - protein, 33 aa, Artificial Sequence
  Description of Artificial Sequence: Synthetic polypeptide
AEEEIRTTNPVATEEYGCSCSWGNHQRFGSQQA

SEQ ID NO: 104442 - protein, 32 aa, Artificial Sequence
  Description of Artificial Sequence: Synthetic polypeptide
TEEEIACTNPVATEQYGSVATNNQEAGGEPDE

SEQ ID NO: 104443 - protein, 34 aa, Artificial Sequence
  Description of Artificial Sequence: Synthetic polypeptide
DDEEIRTTNPVATEFYGSVSTGMGQSDITGNNEG

SEQ ID NO: 104444 - protein, 34 aa, Artificial Sequence
  Description of Artificial Sequence: Synthetic polypeptide
DDEEIRTTNPVATEFYGSVSTMDQEGGGGNEEQE

SEQ ID NO: 104445 - protein, 33 aa, Artificial Sequence
  Description of Artificial Sequence: Synthetic polypeptide
DEGEIRPTNPVATEEYGSVSPTVNIQDQEPVNA

SEQ ID NO: 104446 - protein, 33 aa, Artificial Sequence
  Description of Artificial Sequence: Synthetic polypeptide
AEEEIRTTNPVATEEYGCSCSWGNDQGFGSNQA

SEQ ID NO: 104447 - protein, 31 aa, Artificial Sequence
  Description of Artificial Sequence: Synthetic polypeptide
DEGEIRPTNPCSTEQYGIVSTTNLNMSGMTV

SEQ ID NO: 104448 - protein, 30 aa, Artificial Sequence
  Description of Artificial Sequence: Synthetic polypeptide
DEGEIRPTNPCSSEPYGTVSCENLQQQGNH

SEQ ID NO: 104449 - protein, 33 aa, Artificial Sequence
  Description of Artificial Sequence: Synthetic polypeptide
DEGEIRMTNPVATECWGSVSCINEPQDREGENG

SEQ ID NO: 104450 - protein, 34 aa, Artificial Sequence
  Description of Artificial Sequence: Synthetic polypeptide
DEGEIRATNPVATEQYGSVCIVNDQHDRQGSNDS

SEQ ID NO: 104451 - protein, 33 aa, Artificial Sequence
  Description of Artificial Sequence: Synthetic polypeptide
DEGEIKTTNPVATSAWGQVSCTNLSQEPGGPNR

SEQ ID NO: 104452 - protein, 31 aa, Artificial Sequence
  Description of Artificial Sequence: Synthetic polypeptide
AEEEIRTTNPVATEEYGCSCSWEHQYGSQQS

SEQ ID NO: 104453 - protein, 32 aa, Artificial Sequence
  Description of Artificial Sequence: Synthetic polypeptide
DEGEIATVNPVATEQYGSVAGTGLQSNNSHQE

SEQ ID NO: 104454 - protein, 31 aa, Artificial Sequence
  Description of Artificial Sequence: Synthetic polypeptide
TEEEIACTNPVATESYGSVATNLQANPEKHN

SEQ ID NO: 104455 - protein, 34 aa, Artificial Sequence
  Description of Artificial Sequence: Synthetic polypeptide
DEGEIATTNPVSTEQYGSVSSTTAGPNMRNGNPR

SEQ ID NO: 104456 - protein, 31 aa, Artificial Sequence
  Description of Artificial Sequence: Synthetic polypeptide
DEGEIATTNPVSTEQYGIVSCDLQQQQNGTH

SEQ ID NO: 104457 - protein, 29 aa, Artificial Sequence
  Description of Artificial Sequence: Synthetic peptide
TEEEIASVNPVCTEAYGVVSDNALQSVNQ

SEQ ID NO: 104458 - protein, 34 aa, Artificial Sequence
  Description of Artificial Sequence: Synthetic polypeptide
FEEEIRATNPVATEQYGSVSTQGLTGEQGEGGDE

SEQ ID NO: 104459 - protein, 32 aa, Artificial Sequence
  Description of Artificial Sequence: Synthetic polypeptide
DEVEIATTNPVATTQWGCVARTIDQNRQGNER

SEQ ID NO: 104460 - protein, 31 aa, Artificial Sequence
  Description of Artificial Sequence: Synthetic polypeptide
TEEEIACTNPVATEPYGNVATNLQRNPAEHP

SEQ ID NO: 104461 - protein, 34 aa, Artificial Sequence
  Description of Artificial Sequence: Synthetic polypeptide
FEEEIRTTNPVATEQYGSVSIDNMGDTGEGENGQ

SEQ ID NO: 104462 - protein, 30 aa, Artificial Sequence
  Description of Artificial Sequence: Synthetic polypeptide
DEGEIVTTNPCASEQYGTVSTDGPQFEGTD

SEQ ID NO: 104463 - protein, 33 aa, Artificial Sequence
  Description of Artificial Sequence: Synthetic polypeptide
DEGEIVTTNPVATEQYGIVCSATDGPVEFEGNR

SEQ ID NO: 104464 - protein, 33 aa, Artificial Sequence
  Description of Artificial Sequence: Synthetic polypeptide
DEHEIRTTNPVATENYGCVATTGMQQDRQGDNA

SEQ ID NO: 104465 - protein, 32 aa, Artificial Sequence
  Description of Artificial Sequence: Synthetic polypeptide
DEHEIRTTNPVATENYGCVATTGMQQDRGGDA

SEQ ID NO: 104466 - protein, 31 aa, Artificial Sequence
  Description of Artificial Sequence: Synthetic polypeptide
DEHEIRTTNPVATENYGCVATTGMNDDGGDP

SEQ ID NO: 104467 - protein, 32 aa, Artificial Sequence
  Description of Artificial Sequence: Synthetic polypeptide
DEHEIRTTNPVATENYGCVATTGDQQDRGDHP

SEQ ID NO: 104468 - protein, 34 aa, Artificial Sequence
  Description of Artificial Sequence: Synthetic polypeptide
DDECIRTTNPVATEPYGKVPSATNHQRTVGNNLQ

SEQ ID NO: 104469 - protein, 32 aa, Artificial Sequence
  Description of Artificial Sequence: Synthetic polypeptide
SQAEIRTTNPVATEQYGCCPSTVLQQGQNSKQ

SEQ ID NO: 104470 - protein, 34 aa, Artificial Sequence
  Description of Artificial Sequence: Synthetic polypeptide
DEHEIRTTNPVATEHYGSVSTTGPEQGLTGNDGS

SEQ ID NO: 104471 - protein, 32 aa, Artificial Sequence
  Description of Artificial Sequence: Synthetic polypeptide
DDECIRTTNPVATEQYGCVCSSNHNQNFNSDL

SEQ ID NO: 104472 - protein, 31 aa, Artificial Sequence
  Description of Artificial Sequence: Synthetic polypeptide
SQAEIRTTNPVATEQYGCCSIVLQHGQDTNQ

SEQ ID NO: 104473 - protein, 31 aa, Artificial Sequence
  Description of Artificial Sequence: Synthetic polypeptide
SQAEIRTTNPVATEQYGCCSTVTQHGQNSDQ

SEQ ID NO: 104474 - protein, 34 aa, Artificial Sequence
  Description of Artificial Sequence: Synthetic polypeptide
DEHEIRTTNPVATEPYGSVCFTNEDHERGGQNDS

SEQ ID NO: 104475 - protein, 31 aa, Artificial Sequence
  Description of Artificial Sequence: Synthetic polypeptide
SQAEIRTTNPVATEQYGCCSYVLQEGQNSKQ

SEQ ID NO: 104476 - protein, 33 aa, Artificial Sequence
  Description of Artificial Sequence: Synthetic polypeptide
DDECIRTTNPVATEQYGCVCSTNHNQYFNSDQA

SEQ ID NO: 104477 - protein, 32 aa, Artificial Sequence
  Description of Artificial Sequence: Synthetic polypeptide
DDECIRTTNPVATEQYGCVCSTNHQGFVSDQA

SEQ ID NO: 104478 - protein, 35 aa, Artificial Sequence
  Description of Artificial Sequence: Synthetic polypeptide
DEHEIRTTNPVATEHYGSVCQTNDLQDGQQQNNHG

SEQ ID NO: 104479 - protein, 35 aa, Artificial Sequence
  Description of Artificial Sequence: Synthetic polypeptide
DEHEIRTTNPVATEHYGSVCQTNDLQDGQQGNNGE

SEQ ID NO: 104480 - protein, 32 aa, Artificial Sequence
  Description of Artificial Sequence: Synthetic polypeptide
SQAEIRTTNPVATEQYGTCCSTVLQHGMNSKQ

SEQ ID NO: 104481 - protein, 30 aa, Artificial Sequence
  Description of Artificial Sequence: Synthetic polypeptide
SQDEIRTTNPVATEQWGETYSWNLTEEINR

SEQ ID NO: 104482 - protein, 35 aa, Artificial Sequence
  Description of Artificial Sequence: Synthetic polypeptide
FEEEIRTTNPVATESYGSVSGTNVIGQGEGGENEE

SEQ ID NO: 104483 - protein, 33 aa, Artificial Sequence
  Description of Artificial Sequence: Synthetic polypeptide
FEEEIRTTNPVATEQYGVVVGDTNQSEDGGGNG

SEQ ID NO: 104484 - protein, 35 aa, Artificial Sequence
  Description of Artificial Sequence: Synthetic polypeptide
FEEEIRTTNPVATEQYGVVSTMNGLDQNEGQEGGE

SEQ ID NO: 104485 - protein, 34 aa, Artificial Sequence
  Description of Artificial Sequence: Synthetic polypeptide
FEEEIRTTNPVATEQYGVVSTGNGGNLNGEQGQE

SEQ ID NO: 104486 - protein, 32 aa, Artificial Sequence
  Description of Artificial Sequence: Synthetic polypeptide
DDECIRTTNPVATEQYGCVCSTGNHQNFVSDQ

SEQ ID NO: 104487 - protein, 31 aa, Artificial Sequence
  Description of Artificial Sequence: Synthetic polypeptide
DDECIRTTNPVATEQYGCVCSWEHQNVSNQS

SEQ ID NO: 104488 - protein, 34 aa, Artificial Sequence
  Description of Artificial Sequence: Synthetic polypeptide
DEHEIRTTNPVATEPYGSVCFTNEDHMRGGGDKR

SEQ ID NO: 104489 - protein, 33 aa, Artificial Sequence
  Description of Artificial Sequence: Synthetic polypeptide
DEHEIRTTNPVATEPYGSVVTGPHLENDGPGER

SEQ ID NO: 104490 - protein, 34 aa, Artificial Sequence
  Description of Artificial Sequence: Synthetic polypeptide
DEHEIRTTNPVATEQYGSVISTDMTNRQEVSEHD

SEQ ID NO: 104491 - protein, 34 aa, Artificial Sequence
  Description of Artificial Sequence: Synthetic polypeptide
DEVEIATTNPVATECYGCVYCTNLDQHDGNRGME

SEQ ID NO: 104492 - protein, 32 aa, Artificial Sequence
  Description of Artificial Sequence: Synthetic polypeptide
FEETIRTTNPVATEQYGSVSSELEDYAGMEFI

SEQ ID NO: 104493 - protein, 35 aa, Artificial Sequence
  Description of Artificial Sequence: Synthetic polypeptide
DEHEIRTTNPVATEQYGMTISTNEFSGQREGGSNQ

SEQ ID NO: 104494 - protein, 34 aa, Artificial Sequence
  Description of Artificial Sequence: Synthetic polypeptide
DEHEIRTTNPVATEQYGLCSATNLQVTDEDDNQE

SEQ ID NO: 104495 - protein, 35 aa, Artificial Sequence
  Description of Artificial Sequence: Synthetic polypeptide
DEHEIRTTNPVATEQYGKTIWTNETSQREGGSNRL

SEQ ID NO: 104496 - protein, 32 aa, Artificial Sequence
  Description of Artificial Sequence: Synthetic polypeptide
FEETIRTTNPVATEQWGAVEVGNLVIPGVNRA

SEQ ID NO: 104497 - protein, 34 aa, Artificial Sequence
  Description of Artificial Sequence: Synthetic polypeptide
DEVEIATTNPVATECYGSVATGDLQDRIGQNGEG

SEQ ID NO: 104498 - protein, 33 aa, Artificial Sequence
  Description of Artificial Sequence: Synthetic polypeptide
DDCEIRTTNPVATEQYGVVSTKLENRMPSMNDD

SEQ ID NO: 104499 - protein, 33 aa, Artificial Sequence
  Description of Artificial Sequence: Synthetic polypeptide
DEHEIRTTNPVATEQYGCVSTDMTNRDEVSERD

SEQ ID NO: 104500 - protein, 30 aa, Artificial Sequence
  Description of Artificial Sequence: Synthetic polypeptide
AEEEIRTTNPVAYEHWGCFSWINDTQQGNH

SEQ ID NO: 104501 - protein, 31 aa, Artificial Sequence
  Description of Artificial Sequence: Synthetic polypeptide
SGEEIRTTNPVATEQWGSCTTTLLQIDTQRP

SEQ ID NO: 104502 - protein, 35 aa, Artificial Sequence
  Description of Artificial Sequence: Synthetic polypeptide
AEEEIRTTNPVATEQYGSVSLTVNTEHRHSAGPYP

SEQ ID NO: 104503 - protein, 33 aa, Artificial Sequence
  Description of Artificial Sequence: Synthetic polypeptide
DEHEIRTTNPVATEQWGSVCNTFNREGTGGETR

SEQ ID NO: 104504 - protein, 34 aa, Artificial Sequence
  Description of Artificial Sequence: Synthetic polypeptide
DEHEIRTTNPVATEQWGSVAPTWNDHQERDMIRG

SEQ ID NO: 104505 - protein, 34 aa, Artificial Sequence
  Description of Artificial Sequence: Synthetic polypeptide
AEEEIRTTNPVATEQYGSVSETHIGDQTRSEDDN

SEQ ID NO: 104506 - protein, 30 aa, Artificial Sequence
  Description of Artificial Sequence: Synthetic polypeptide
SNEEIRTTNPVATEQWGCCALNIEQEGQNP

SEQ ID NO: 104507 - protein, 31 aa, Artificial Sequence
  Description of Artificial Sequence: Synthetic polypeptide
SNEEIRTTNPVATEQWGCVSLDTEQEGVQNP

SEQ ID NO: 104508 - protein, 35 aa, Artificial Sequence
  Description of Artificial Sequence: Synthetic polypeptide
DEHEIRTTNPVATEQWGKTISTNEFSQNREGGSNR

SEQ ID NO: 104509 - protein, 30 aa, Artificial Sequence
  Description of Artificial Sequence: Synthetic polypeptide
DEHEIRTTNPVATEQWGDVSWIEMRDAEDA

SEQ ID NO: 104510 - protein, 33 aa, Artificial Sequence
  Description of Artificial Sequence: Synthetic polypeptide
DEHEIRTTNPVATEQWGCVSTTGPQGLMGNDGQ

SEQ ID NO: 104511 - protein, 32 aa, Artificial Sequence
  Description of Artificial Sequence: Synthetic polypeptide
SNEEIRTTNPVATEQWGCVSLLNMYQEGVQNP

SEQ ID NO: 104512 - protein, 33 aa, Artificial Sequence
  Description of Artificial Sequence: Synthetic polypeptide
DDCEIRTTNPVATEQYGVVVSTKLENTFPGNND

SEQ ID NO: 104513 - protein, 34 aa, Artificial Sequence
  Description of Artificial Sequence: Synthetic polypeptide
AEEEIRTTNPVATEQYGSVNTNDTNGTEQGTNGA

SEQ ID NO: 104514 - protein, 34 aa, Artificial Sequence
  Description of Artificial Sequence: Synthetic polypeptide
DEHEIRTTNPVATEDWGKTISTNETSQREGGSNR

SEQ ID NO: 104515 - protein, 33 aa, Artificial Sequence
  Description of Artificial Sequence: Synthetic polypeptide
FEEEIRTTNPVATEQYGVVSTGGQGIQEDGEGN

SEQ ID NO: 104516 - protein, 31 aa, Artificial Sequence
  Description of Artificial Sequence: Synthetic polypeptide
DEHEIRTTNPVATDQWGCVYNEQDGQRGNED

SEQ ID NO: 104517 - protein, 35 aa, Artificial Sequence
  Description of Artificial Sequence: Synthetic polypeptide
FEEEIRTTNPVATEQYGSVVGTMNVGQGEGGNQET

SEQ ID NO: 104518 - protein, 34 aa, Artificial Sequence
  Description of Artificial Sequence: Synthetic polypeptide
FEEEIRTTNPVATEQYGSVVGNTMDQEGGGNEGE

SEQ ID NO: 104519 - protein, 35 aa, Artificial Sequence
  Description of Artificial Sequence: Synthetic polypeptide
FEEEIRTTNPVATEQYGSVVGNSDILQGEQGNGNT

SEQ ID NO: 104520 - protein, 31 aa, Artificial Sequence
  Description of Artificial Sequence: Synthetic polypeptide
DEHEIRTTNPMAYEAYGSVSQNISFPVGNNM

SEQ ID NO: 104521 - protein, 32 aa, Artificial Sequence
  Description of Artificial Sequence: Synthetic polypeptide
DEHEIRTTNPEATQQYGEVCTIDQGQRGMNKE

SEQ ID NO: 104522 - protein, 34 aa, Artificial Sequence
  Description of Artificial Sequence: Synthetic polypeptide
FEEEIRTTNPVATEQYGSVVGNGNNLNNEGGNIG

SEQ ID NO: 104523 - protein, 34 aa, Artificial Sequence
  Description of Artificial Sequence: Synthetic polypeptide
FEEEIRTTNPVATEQYGSVVGFGNELEDGEDNNI

SEQ ID NO: 104524 - protein, 33 aa, Artificial Sequence
  Description of Artificial Sequence: Synthetic polypeptide
DEHEIRTTNPCAYEQWGSVCSTWDNLDQHGEGG

SEQ ID NO: 104525 - protein, 35 aa, Artificial Sequence
  Description of Artificial Sequence: Synthetic polypeptide
FEEEIRTTNPVATEQYGSVVGDTNEQDQEGGNNNP

SEQ ID NO: 104526 - protein, 34 aa, Artificial Sequence
  Description of Artificial Sequence: Synthetic polypeptide
FEEEIRTTNPVATEQYGSVVSGVNQNGQGEFGDG

SEQ ID NO: 104527 - protein, 30 aa, Artificial Sequence
  Description of Artificial Sequence: Synthetic polypeptide
SQEEIRTTNPVATEQWGCVTFNHLQEIFDS

SEQ ID NO: 104528 - protein, 33 aa, Artificial Sequence
  Description of Artificial Sequence: Synthetic polypeptide
FEEEIRTTNPVATEQYGSVVDGTIDEGGGENTD

SEQ ID NO: 104529 - protein, 32 aa, Artificial Sequence
  Description of Artificial Sequence: Synthetic polypeptide
DEHEIRTTNPCAYDQWGSTVNTSELSQRVGND

SEQ ID NO: 104530 - protein, 33 aa, Artificial Sequence
  Description of Artificial Sequence: Synthetic polypeptide
FEEEIRTTNPVATEQYGSVVDGTGQEGNGENTN

SEQ ID NO: 104531 - protein, 35 aa, Artificial Sequence
  Description of Artificial Sequence: Synthetic polypeptide
SQEEIRTTNPVATEQWGCWVTSTDNLNQEEGQNDR

SEQ ID NO: 104532 - protein, 33 aa, Artificial Sequence
  Description of Artificial Sequence: Synthetic polypeptide
DEVEIATTNPVATEIYGCVSTNGDAQGADGDSR

SEQ ID NO: 104533 - protein, 35 aa, Artificial Sequence
  Description of Artificial Sequence: Synthetic polypeptide
AEEEIRTTNPVATEQYGSVATVNQQQGNNQIGNNA

SEQ ID NO: 104534 - protein, 32 aa, Artificial Sequence
  Description of Artificial Sequence: Synthetic polypeptide
SQEEIRTTNPVATEQWGTVCSTGNPQNFGSDQ

SEQ ID NO: 104535 - protein, 32 aa, Artificial Sequence
  Description of Artificial Sequence: Synthetic polypeptide
SQEEIRTTNPVATEQWGTVCSTNHQYFGSEQS

SEQ ID NO: 104536 - protein, 35 aa, Artificial Sequence
  Description of Artificial Sequence: Synthetic polypeptide
FEEEIRTTNPVATEQYGSVTQTNGQGQEEGGGNIQ

SEQ ID NO: 104537 - protein, 35 aa, Artificial Sequence
  Description of Artificial Sequence: Synthetic polypeptide
FEEEIRTTNPVATEQYGSVTGFGNNLNQNEGGNNV

SEQ ID NO: 104538 - protein, 35 aa, Artificial Sequence
  Description of Artificial Sequence: Synthetic polypeptide
FEEEIRTTNPVATEQYGSVVGDTNAQGQEGNEENI

SEQ ID NO: 104539 - protein, 36 aa, Artificial Sequence
  Description of Artificial Sequence: Synthetic polypeptide
FEEEIRTTNPVATEQYGSVVSTTDTGLGQEQGGGNE

SEQ ID NO: 104540 - protein, 29 aa, Artificial Sequence
  Description of Artificial Sequence: Synthetic peptide
DEHEIRTTNPVATDQYGCVNMQEQGSISP

SEQ ID NO: 104541 - protein, 31 aa, Artificial Sequence
  Description of Artificial Sequence: Synthetic polypeptide
SQEEIRTTNPVATEQWGCVSLTNHIQEIFDS

SEQ ID NO: 104542 - protein, 35 aa, Artificial Sequence
  Description of Artificial Sequence: Synthetic polypeptide
FEEEIRTTNPVATEQYGVVSTGDGNLDENVGGNDD

SEQ ID NO: 104543 - protein, 32 aa, Artificial Sequence
  Description of Artificial Sequence: Synthetic polypeptide
SQEEIATTNPVAYEQWGTVSTNLQGEHGQNEQ

SEQ ID NO: 104544 - protein, 32 aa, Artificial Sequence
  Description of Artificial Sequence: Synthetic polypeptide
SQEEIATTNPVAYEQWGTVSTNLQGEHQGMDR

SEQ ID NO: 104545 - protein, 34 aa, Artificial Sequence
  Description of Artificial Sequence: Synthetic polypeptide
DDECIRTTNPVATEQYGKVPSTNHIQTTVGNNLY

SEQ ID NO: 104546 - protein, 34 aa, Artificial Sequence
  Description of Artificial Sequence: Synthetic polypeptide
DEHEIRTTNPVATECWGSVSRCINEPQDREGENG

SEQ ID NO: 104547 - protein, 34 aa, Artificial Sequence
  Description of Artificial Sequence: Synthetic polypeptide
FEEEIRTTNPVATEQYGVVSGTNGDDEGGENTGN

SEQ ID NO: 104548 - protein, 35 aa, Artificial Sequence
  Description of Artificial Sequence: Synthetic polypeptide
FEEEIRTTNPVATEQYGVVSDNTDNGGQEDGGGNN

SEQ ID NO: 104549 - protein, 35 aa, Artificial Sequence
  Description of Artificial Sequence: Synthetic polypeptide
DEHEIRTTNPVATECWGSVCSTGNNDMQRDGDNND

SEQ ID NO: 104550 - protein, 34 aa, Artificial Sequence
  Description of Artificial Sequence: Synthetic polypeptide
DEHEIRTTNPVATEAYGSVCYTQDNHDQGGNNTA

SEQ ID NO: 104551 - protein, 35 aa, Artificial Sequence
  Description of Artificial Sequence: Synthetic polypeptide
DEHEIRTTNPVATEAYGSTVPSCCGDNLQHEGGNQ

SEQ ID NO: 104552 - protein, 34 aa, Artificial Sequence
  Description of Artificial Sequence: Synthetic polypeptide
DEHEIRTTNPVATEAYGKVSCNNLSQQKAGGNEH

SEQ ID NO: 104553 - protein, 33 aa, Artificial Sequence
  Description of Artificial Sequence: Synthetic polypeptide
DEHEIRTTNPVATEAWGSVCYNNDDDHRGNGQR

SEQ ID NO: 104554 - protein, 33 aa, Artificial Sequence
  Description of Artificial Sequence: Synthetic polypeptide
FEEEIRTTNPVATEQYGVVNTDVGQGQEGGNNG

SEQ ID NO: 104555 - protein, 32 aa, Artificial Sequence
  Description of Artificial Sequence: Synthetic polypeptide
DEHEIRTTNPVATDQYGTSVNTQDKEQPPGED

SEQ ID NO: 104556 - protein, 34 aa, Artificial Sequence
  Description of Artificial Sequence: Synthetic polypeptide
AEEEIRTTNPVATEQYGSVETNNNNQQGTEGGDE

SEQ ID NO: 104557 - protein, 34 aa, Artificial Sequence
  Description of Artificial Sequence: Synthetic polypeptide
FEEEIRTTNPVATEQYGVVGNNGNLEDQEGGGNI

SEQ ID NO: 104558 - protein, 34 aa, Artificial Sequence
  Description of Artificial Sequence: Synthetic polypeptide
AEEEIRTTNPVATEQYGSVETNNNNQGIGTDESE

SEQ ID NO: 104559 - protein, 31 aa, Artificial Sequence
  Description of Artificial Sequence: Synthetic polypeptide
DEHEIRTTNPVATDQYGSVNMQSQRFSIFDN

SEQ ID NO: 104560 - protein, 31 aa, Artificial Sequence
  Description of Artificial Sequence: Synthetic polypeptide
DEHEIRTTNPVATDQYGSVNMQLTNSIQVPK

SEQ ID NO: 104561 - protein, 34 aa, Artificial Sequence
  Description of Artificial Sequence: Synthetic polypeptide
FEEEIRTTNPVATEQYGSVYTGNMVDGPDINGGE

SEQ ID NO: 104562 - protein, 32 aa, Artificial Sequence
  Description of Artificial Sequence: Synthetic polypeptide
DEHEIRTTNPVATDQYGSVNMQLQQGSIQDPN

SEQ ID NO: 104563 - protein, 32 aa, Artificial Sequence
  Description of Artificial Sequence: Synthetic polypeptide
DEHEIRTTNPVATDQYGSVNMQLHQRSIFSDN

SEQ ID NO: 104564 - protein, 32 aa, Artificial Sequence
  Description of Artificial Sequence: Synthetic polypeptide
SQEEIRTTNPVATEQWGCVCSTNHNQNGSQQA

SEQ ID NO: 104565 - protein, 28 aa, Artificial Sequence
  Description of Artificial Sequence: Synthetic peptide
FEGEIAPTNPCSSEQYGIVSCNLQSATR

SEQ ID NO: 104566 - protein, 35 aa, Artificial Sequence
  Description of Artificial Sequence: Synthetic polypeptide
DEHEIRTTNPVATEQYGSVISVTHDLQTGETEQEE

SEQ ID NO: 104567 - protein, 35 aa, Artificial Sequence
  Description of Artificial Sequence: Synthetic polypeptide
DEHEIRTTNPVATEQYGSVISVTWHDLQTGEEQQD

SEQ ID NO: 104568 - protein, 36 aa, Artificial Sequence
  Description of Artificial Sequence: Synthetic polypeptide
DEHEIRTTNPVATEQYGSVISVTYHDLTQTGEEQRE

SEQ ID NO: 104569 - protein, 33 aa, Artificial Sequence
  Description of Artificial Sequence: Synthetic polypeptide
DEHEIRTTNPVATEQYGSVSVTPMTETIELERD

SEQ ID NO: 104570 - protein, 32 aa, Artificial Sequence
  Description of Artificial Sequence: Synthetic polypeptide
DEVEIATTNPVATDQYGVVSTDGEQGGQGNET

SEQ ID NO: 104571 - protein, 32 aa, Artificial Sequence
  Description of Artificial Sequence: Synthetic polypeptide
DEVEIATTNPVATDQYGVVSTDGEQGGQGNGQ

SEQ ID NO: 104572 - protein, 33 aa, Artificial Sequence
  Description of Artificial Sequence: Synthetic polypeptide
DEHEIRTTNPVATEQYGSVSVSNNLDEDSILID

SEQ ID NO: 104573 - protein, 36 aa, Artificial Sequence
  Description of Artificial Sequence: Synthetic polypeptide
DEHEIRTTNPVATEQYGSVSVPYRDLDQPRLHENER

SEQ ID NO: 104574 - protein, 35 aa, Artificial Sequence
  Description of Artificial Sequence: Synthetic polypeptide
AEEEIRTTNPVATESYGSVSTVTNNLNNQQGEDGG

SEQ ID NO: 104575 - protein, 34 aa, Artificial Sequence
  Description of Artificial Sequence: Synthetic polypeptide
AEEEIRTTNPVATESYGSVSTVTNNNNNQQGDGG

SEQ ID NO: 104576 - protein, 31 aa, Artificial Sequence
  Description of Artificial Sequence: Synthetic polypeptide
SETEIRCTNPIATEQWGAVWSNENLMPGNYR

SEQ ID NO: 104577 - protein, 35 aa, Artificial Sequence
  Description of Artificial Sequence: Synthetic polypeptide
HEEEIKTTNPVATEQYGCIVSTNLHQGRANANMYV

SEQ ID NO: 104578 - protein, 31 aa, Artificial Sequence
  Description of Artificial Sequence: Synthetic polypeptide
HEEEICTTNPVATKQYGAVSSNISAQRIQDN

SEQ ID NO: 104579 - protein, 32 aa, Artificial Sequence
  Description of Artificial Sequence: Synthetic polypeptide
DEVEIATTNPVATDQYGVVSTDGEQGGGGNTG

SEQ ID NO: 104580 - protein, 32 aa, Artificial Sequence
  Description of Artificial Sequence: Synthetic polypeptide
DCEEIRSTNPVAYEQWGCSTGDTNMQRGENNG

SEQ ID NO: 104581 - protein, 32 aa, Artificial Sequence
  Description of Artificial Sequence: Synthetic polypeptide
SETEIRCTNPIATEQYGSTTANEDLMRKGNYR

SEQ ID NO: 104582 - protein, 29 aa, Artificial Sequence
  Description of Artificial Sequence: Synthetic peptide
HEEEIATTNPVATEQYGEAPEVNCQHEEK

SEQ ID NO: 104583 - protein, 28 aa, Artificial Sequence
  Description of Artificial Sequence: Synthetic peptide
HEEEIATTNPVATEQYGEAPEVCQHEEK

SEQ ID NO: 104584 - protein, 36 aa, Artificial Sequence
  Description of Artificial Sequence: Synthetic polypeptide
AEEEIRTTNPVATESYGSVSTVTNQLGNNQQGNDGG

SEQ ID NO: 104585 - protein, 34 aa, Artificial Sequence
  Description of Artificial Sequence: Synthetic polypeptide
HEDEIKTTNPVATEQYGCVSTNLHQGRNNANFYV

SEQ ID NO: 104586 - protein, 32 aa, Artificial Sequence
  Description of Artificial Sequence: Synthetic polypeptide
DCEEIRSTNPVAYEQWGSSTSNDNMGQRNGNN

SEQ ID NO: 104587 - protein, 35 aa, Artificial Sequence
  Description of Artificial Sequence: Synthetic polypeptide
AEEEIRTTNPVATEQYGSVSPTNMGGQTPGFQAET

SEQ ID NO: 104588 - protein, 34 aa, Artificial Sequence
  Description of Artificial Sequence: Synthetic polypeptide
DEHEIRTTNPVATEQYGSVSTTNNENSFMDSIRE

SEQ ID NO: 104589 - protein, 33 aa, Artificial Sequence
  Description of Artificial Sequence: Synthetic polypeptide
DCEEIRSTNPVAYEQWGSTSTGDTNMQRGENNA

SEQ ID NO: 104590 - protein, 35 aa, Artificial Sequence
  Description of Artificial Sequence: Synthetic polypeptide
AEEEIRTTNPVATESYGSVSTVVNNLNQIGTDGGT

SEQ ID NO: 104591 - protein, 36 aa, Artificial Sequence
  Description of Artificial Sequence: Synthetic polypeptide
AEEEIRTTNPVATESYGSVSTVTNNQLGNQAGNDGG

SEQ ID NO: 104592 - protein, 33 aa, Artificial Sequence
  Description of Artificial Sequence: Synthetic polypeptide
DEHEIRTTNPVATEQYGSVSVTPTMESIELERD

SEQ ID NO: 104593 - protein, 33 aa, Artificial Sequence
  Description of Artificial Sequence: Synthetic polypeptide
DCEEIRGTNPVATEQYGATPSTNLQQPNGSTGV

SEQ ID NO: 104594 - protein, 33 aa, Artificial Sequence
  Description of Artificial Sequence: Synthetic polypeptide
DEHEIRTTNPVATEQYGSVTGPNNGNHGEGNLM

SEQ ID NO: 104595 - protein, 34 aa, Artificial Sequence
  Description of Artificial Sequence: Synthetic polypeptide
DEHEIRTTNPVATESWGSVCSTDNQGDRQGDNGK

SEQ ID NO: 104596 - protein, 34 aa, Artificial Sequence
  Description of Artificial Sequence: Synthetic polypeptide
DEHEIRTTNPVATESWGSVCSGENLGDQDGDNGK

SEQ ID NO: 104597 - protein, 31 aa, Artificial Sequence
  Description of Artificial Sequence: Synthetic polypeptide
SESEIRTTNPVATEQYGSVSPEYYTEQEESQ

SEQ ID NO: 104598 - protein, 35 aa, Artificial Sequence
  Description of Artificial Sequence: Synthetic polypeptide
DCDEIRTTNPVATEQYGSVVPSCIQNLSPHGGNTR

SEQ ID NO: 104599 - protein, 32 aa, Artificial Sequence
  Description of Artificial Sequence: Synthetic polypeptide
DCEDIRSTNPVATEQYGAVSTNQIAHNQQMRA

SEQ ID NO: 104600 - protein, 34 aa, Artificial Sequence
  Description of Artificial Sequence: Synthetic polypeptide
AEEEIRTTNPVATESYGSVSTVQSNNVEEGTNQD

SEQ ID NO: 104601 - protein, 34 aa, Artificial Sequence
  Description of Artificial Sequence: Synthetic polypeptide
AEEEIRTTNPVATESYGSVSTVSNNNSEEGTNVQ

SEQ ID NO: 104602 - protein, 31 aa, Artificial Sequence
  Description of Artificial Sequence: Synthetic polypeptide
DCEEIMTTNPVATEQYGSVSTAGTGAVVEHQ

SEQ ID NO: 104603 - protein, 33 aa, Artificial Sequence
  Description of Artificial Sequence: Synthetic polypeptide
AEEEIRTTNPVATESYGSVSTVSNNNVEEGTTQ

SEQ ID NO: 104604 - protein, 34 aa, Artificial Sequence
  Description of Artificial Sequence: Synthetic polypeptide
AEEEIRTTNPVATESYGSVSTVSNNNVEEIGTNQ

SEQ ID NO: 104605 - protein, 34 aa, Artificial Sequence
  Description of Artificial Sequence: Synthetic polypeptide
AEEEIRTTNPVATESYGSVSTVSNNVVEEGTNQE

SEQ ID NO: 104606 - protein, 34 aa, Artificial Sequence
  Description of Artificial Sequence: Synthetic polypeptide
AEEEIRTTNPVATESYGSVSTVSTNNVEEGTNTQ

SEQ ID NO: 104607 - protein, 30 aa, Artificial Sequence
  Description of Artificial Sequence: Synthetic polypeptide
SETAEIACTNPVAYEQWGSVATNDERTGDR

SEQ ID NO: 104608 - protein, 32 aa, Artificial Sequence
  Description of Artificial Sequence: Synthetic polypeptide
DCEEIRATNPVAYEQWGSSTGDTNMQRGENNM

SEQ ID NO: 104609 - protein, 32 aa, Artificial Sequence
  Description of Artificial Sequence: Synthetic polypeptide
SETEIACTNPVATEQYGSVYCTWNDQHHGNQS

SEQ ID NO: 104610 - protein, 33 aa, Artificial Sequence
  Description of Artificial Sequence: Synthetic polypeptide
DEHEIRTTNPVATEQYGTTTVDRGLVQYTGEQR

SEQ ID NO: 104611 - protein, 35 aa, Artificial Sequence
  Description of Artificial Sequence: Synthetic polypeptide
DEHEIRTTNPVATEQYGSVYSDWNLQDERHFDDQQ

SEQ ID NO: 104612 - protein, 33 aa, Artificial Sequence
  Description of Artificial Sequence: Synthetic polypeptide
DEHEIRTTNPVATEQYGSVWVEAYESRGDLNQE

SEQ ID NO: 104613 - protein, 29 aa, Artificial Sequence
  Description of Artificial Sequence: Synthetic peptide
SETEIRCTNPIATECWGATAENLMRGNYR

SEQ ID NO: 104614 - protein, 32 aa, Artificial Sequence
  Description of Artificial Sequence: Synthetic polypeptide
DCEEIRCTNPVAYEQWGSSTGDTNMQRGNGNQ

SEQ ID NO: 104615 - protein, 31 aa, Artificial Sequence
  Description of Artificial Sequence: Synthetic polypeptide
DEHEIRTTNPVATEQYGSVVIVSHFENSEEK

SEQ ID NO: 104616 - protein, 35 aa, Artificial Sequence
  Description of Artificial Sequence: Synthetic polypeptide
AEEEIRTTNPVATESYGSVSTVTNNLNEQNGTDGG

SEQ ID NO: 104617 - protein, 34 aa, Artificial Sequence
  Description of Artificial Sequence: Synthetic polypeptide
DCEEIRGTNPVATEQYGAAVSTNLQQPNSGSTGV

SEQ ID NO: 104618 - protein, 34 aa, Artificial Sequence
  Description of Artificial Sequence: Synthetic polypeptide
DCEEIRTTNPVATDQWGEVSTGNGDHQHGGGNHR

SEQ ID NO: 104619 - protein, 35 aa, Artificial Sequence
  Description of Artificial Sequence: Synthetic polypeptide
FEEEIRTTNPVATEQYGSVTGDNLQQGEGGGENVQ

SEQ ID NO: 104620 - protein, 32 aa, Artificial Sequence
  Description of Artificial Sequence: Synthetic polypeptide
GQEEIATTNPVAYEQWGTVATNLNQGEDGDNR

SEQ ID NO: 104621 - protein, 30 aa, Artificial Sequence
  Description of Artificial Sequence: Synthetic polypeptide
DEVEIATTNPVATDQYGVVVGDEGQGGGNT

SEQ ID NO: 104622 - protein, 34 aa, Artificial Sequence
  Description of Artificial Sequence: Synthetic polypeptide
DEHEIRTTNPVATEQYGSVSTISQKWRDAPIAIH

SEQ ID NO: 104623 - protein, 32 aa, Artificial Sequence
  Description of Artificial Sequence: Synthetic polypeptide
DDAEIRTTNPVATEQYGCVCSTEHQNFGSDQA

SEQ ID NO: 104624 - protein, 32 aa, Artificial Sequence
  Description of Artificial Sequence: Synthetic polypeptide
DDAEIRTTNPVATEQYGCVCSTGEDHQSGSDQ

SEQ ID NO: 104625 - protein, 28 aa, Artificial Sequence
  Description of Artificial Sequence: Synthetic peptide
GEEEIATTNPVATEQYGEAPEVCQHEEK

SEQ ID NO: 104626 - protein, 33 aa, Artificial Sequence
  Description of Artificial Sequence: Synthetic polypeptide
DDAEIRTTNPVATEQYGCVCSTNAHQGFGSDQS

SEQ ID NO: 104627 - protein, 30 aa, Artificial Sequence
  Description of Artificial Sequence: Synthetic polypeptide
AEEEIRTTNPVAYEAWGCFCINDDQRGNNA

SEQ ID NO: 104628 - protein, 33 aa, Artificial Sequence
  Description of Artificial Sequence: Synthetic polypeptide
DEHEIRTTNPVATEQYGSVSTDMTNREEVSEKD

SEQ ID NO: 104629 - protein, 32 aa, Artificial Sequence
  Description of Artificial Sequence: Synthetic polypeptide
DDAEIRTTNPVATEQYGICSTVVQVHQGVGRD

SEQ ID NO: 104630 - protein, 33 aa, Artificial Sequence
  Description of Artificial Sequence: Synthetic polypeptide
FESEIRTTNPVATECWGSVSCINEPQDREGNNG

SEQ ID NO: 104631 - protein, 33 aa, Artificial Sequence
  Description of Artificial Sequence: Synthetic polypeptide
FESEIRTTNPVATECWGSVSCINEPQDREGENG

SEQ ID NO: 104632 - protein, 34 aa, Artificial Sequence
  Description of Artificial Sequence: Synthetic polypeptide
DDAEIRTTNPVATEQYGCVCSTEDLQSFGSDNQA

SEQ ID NO: 104633 - protein, 33 aa, Artificial Sequence
  Description of Artificial Sequence: Synthetic polypeptide
SEYEIRCTNPVAYEQYGQSVACTNMLSQHGGNQ

SEQ ID NO: 104634 - protein, 36 aa, Artificial Sequence
  Description of Artificial Sequence: Synthetic polypeptide
DEHEIRTTNPVATEQYGSVSPPTNNLIETGDDNQIQ

SEQ ID NO: 104635 - protein, 32 aa, Artificial Sequence
  Description of Artificial Sequence: Synthetic polypeptide
FEQEIATTNPVATEQYGSVSATDLEDHEGEDL

SEQ ID NO: 104636 - protein, 35 aa, Artificial Sequence
  Description of Artificial Sequence: Synthetic polypeptide
DEHEIRTTNPVATEQYGSVSMTDMTNSRQEVSERD

SEQ ID NO: 104637 - protein, 34 aa, Artificial Sequence
  Description of Artificial Sequence: Synthetic polypeptide
DEHEIRTTNPVATEQYGSVSMDMTNYRQEVSEFD

SEQ ID NO: 104638 - protein, 32 aa, Artificial Sequence
  Description of Artificial Sequence: Synthetic polypeptide
FEPEIRTTNPVATEQYGSVMSNTDSTERQEES

SEQ ID NO: 104639 - protein, 34 aa, Artificial Sequence
  Description of Artificial Sequence: Synthetic polypeptide
DEHEIRTTNPVATEQYGSVSESPEQDRITDNGQE

SEQ ID NO: 104640 - protein, 34 aa, Artificial Sequence
  Description of Artificial Sequence: Synthetic polypeptide
FENEIRTTNPVATQFYGYSASCTHNLALRLGNQR

SEQ ID NO: 104641 - protein, 35 aa, Artificial Sequence
  Description of Artificial Sequence: Synthetic polypeptide
DEHEIRTTNPVATEQYGSVSDTHNNNGGANGGNAL

SEQ ID NO: 104642 - protein, 35 aa, Artificial Sequence
  Description of Artificial Sequence: Synthetic polypeptide
DEHEIRTTNPVATEQYGSVSCTMNVLTQELQEEHN

SEQ ID NO: 104643 - protein, 33 aa, Artificial Sequence
  Description of Artificial Sequence: Synthetic polypeptide
DEHEIRTTNPVATEQYGSVNWTDMTQESNQNDN

SEQ ID NO: 104644 - protein, 34 aa, Artificial Sequence
  Description of Artificial Sequence: Synthetic polypeptide
DEHEIRTTNPVATEQYGSVSPTPNGSEINESLEN

SEQ ID NO: 104645 - protein, 28 aa, Artificial Sequence
  Description of Artificial Sequence: Synthetic peptide
GEEEIATTNPVATEQYGECPEVCQHEEK

SEQ ID NO: 104646 - protein, 32 aa, Artificial Sequence
  Description of Artificial Sequence: Synthetic polypeptide
DDAEIRTTNPVATEQYGCCTSTEHQHFGSNTQ

SEQ ID NO: 104647 - protein, 35 aa, Artificial Sequence
  Description of Artificial Sequence: Synthetic polypeptide
DEHEIRTTNPVATEQYGSVSTNDVEEIFVLQDHPI

SEQ ID NO: 104648 - protein, 33 aa, Artificial Sequence
  Description of Artificial Sequence: Synthetic polypeptide
GESEIRTTNPVATEPWGSVSCINEPQDREGENG

SEQ ID NO: 104649 - protein, 33 aa, Artificial Sequence
  Description of Artificial Sequence: Synthetic polypeptide
GESEIRTTNPVATECWGSVSCINEPQYREGENG

SEQ ID NO: 104650 - protein, 33 aa, Artificial Sequence
  Description of Artificial Sequence: Synthetic polypeptide
GESEIRTTNPVATECWGSVSCINEPQDREGENG

SEQ ID NO: 104651 - protein, 35 aa, Artificial Sequence
  Description of Artificial Sequence: Synthetic polypeptide
DEHEIRTTNPVATEQYGSVSTTGQPNQGLAGDNGS

SEQ ID NO: 104652 - protein, 32 aa, Artificial Sequence
  Description of Artificial Sequence: Synthetic polypeptide
GEQEIATTNPVATEQYGSVSATDLEDHEGEDL

SEQ ID NO: 104653 - protein, 36 aa, Artificial Sequence
  Description of Artificial Sequence: Synthetic polypeptide
AEEEIRTTNPVATEQYGSVSNTNQQQQIGTTNAEEQ

SEQ ID NO: 104654 - protein, 32 aa, Artificial Sequence
  Description of Artificial Sequence: Synthetic polypeptide
GEQEIATTNPVATEQYGSVSATDLADHEGEDL

SEQ ID NO: 104655 - protein, 35 aa, Artificial Sequence
  Description of Artificial Sequence: Synthetic polypeptide
DCEEIRTTNPVATEQYGSVSDWWNIETTLEYGNES

SEQ ID NO: 104656 - protein, 32 aa, Artificial Sequence
  Description of Artificial Sequence: Synthetic polypeptide
SEYEIRCTNPCATEQYGSVRTNENNLERENQM

SEQ ID NO: 104657 - protein, 28 aa, Artificial Sequence
  Description of Artificial Sequence: Synthetic peptide
GEGCIAPTNPCSSEQYGIVSCNLQSGTR

SEQ ID NO: 104658 - protein, 31 aa, Artificial Sequence
  Description of Artificial Sequence: Synthetic polypeptide
SEYEIRCTNPVATEQYGCVCETELQHFISNQ

SEQ ID NO: 104659 - protein, 34 aa, Artificial Sequence
  Description of Artificial Sequence: Synthetic polypeptide
AEEEIRTTNPVATESYGSVSTVVSNNNVEEGNTD

SEQ ID NO: 104660 - protein, 33 aa, Artificial Sequence
  Description of Artificial Sequence: Synthetic polypeptide
DCEEISTTNPVATEQWGKVSCTPPASQESGNTR

SEQ ID NO: 104661 - protein, 33 aa, Artificial Sequence
  Description of Artificial Sequence: Synthetic polypeptide
SEYEIRCTNPVATEQYGCVCETNLQEHSGSNQS

SEQ ID NO: 104662 - protein, 33 aa, Artificial Sequence
  Description of Artificial Sequence: Synthetic polypeptide
SEYEIRCTNPVATEQYGCVCETNLQHFGSQNQA

SEQ ID NO: 104663 - protein, 32 aa, Artificial Sequence
  Description of Artificial Sequence: Synthetic polypeptide
DCQEIATTNPVATEQYGSVSATDLADHEGEDL

SEQ ID NO: 104664 - protein, 32 aa, Artificial Sequence
  Description of Artificial Sequence: Synthetic polypeptide
DCQEIATTNPVATEQYGSVSATDLEDHEGEDL

SEQ ID NO: 104665 - protein, 30 aa, Artificial Sequence
  Description of Artificial Sequence: Synthetic polypeptide
SEYEIRCTNPVATEQYGCVESNHQHFGSDQ

SEQ ID NO: 104666 - protein, 33 aa, Artificial Sequence
  Description of Artificial Sequence: Synthetic polypeptide
DCSEIRTTNPVATECWGSVSCINEPQDREGENG

SEQ ID NO: 104667 - protein, 30 aa, Artificial Sequence
  Description of Artificial Sequence: Synthetic polypeptide
SEYEIRCTNPVATEQYGCVETEHQHGSDQA

SEQ ID NO: 104668 - protein, 32 aa, Artificial Sequence
  Description of Artificial Sequence: Synthetic polypeptide
DDACIRTTNPVATEQYGCVCSTNDHQSFGSDQ

SEQ ID NO: 104669 - protein, 32 aa, Artificial Sequence
  Description of Artificial Sequence: Synthetic polypeptide
DDAEIRTTNPVATEQWGSCTTTHLLQRGTQDM

SEQ ID NO: 104670 - protein, 35 aa, Artificial Sequence
  Description of Artificial Sequence: Synthetic polypeptide
DEHEIRTTNPVATEQYGSVSTNDVTEIFELQDHEI

SEQ ID NO: 104671 - protein, 34 aa, Artificial Sequence
  Description of Artificial Sequence: Synthetic polypeptide
AEEEIRTTNPVATEQYGSVSPEPVTEVLLEVGRE

SEQ ID NO: 104672 - protein, 34 aa, Artificial Sequence
  Description of Artificial Sequence: Synthetic polypeptide
AEEEIRTTNPVATEQYGSVATNNNQQGEAGTTDD

SEQ ID NO: 104673 - protein, 31 aa, Artificial Sequence
  Description of Artificial Sequence: Synthetic polypeptide
DDEEIASTNPISTEQYGSVAANNIQSRVGQR

SEQ ID NO: 104674 - protein, 34 aa, Artificial Sequence
  Description of Artificial Sequence: Synthetic polypeptide
AEEEIRTTNPVATEQYGSVATNNNQNGTEAGGDE

SEQ ID NO: 104675 - protein, 34 aa, Artificial Sequence
  Description of Artificial Sequence: Synthetic polypeptide
DEHEIATTNPVATEAYGISTVQCCTDALQRAGSR

SEQ ID NO: 104676 - protein, 34 aa, Artificial Sequence
  Description of Artificial Sequence: Synthetic polypeptide
FEEEIRTTNPVATEQYGSVSPTWGAEIESQNQRQ

SEQ ID NO: 104677 - protein, 34 aa, Artificial Sequence
  Description of Artificial Sequence: Synthetic polypeptide
FEEEIRTTNPVATEQYGSVSPTWEAEIEMQNGRQ

SEQ ID NO: 104678 - protein, 35 aa, Artificial Sequence
  Description of Artificial Sequence: Synthetic polypeptide
FEEEIRTTNPVATEQYGSVSPTVNGLENNINQFMT

SEQ ID NO: 104679 - protein, 35 aa, Artificial Sequence
  Description of Artificial Sequence: Synthetic polypeptide
FEEEIRTTNPVATEQYGSVSPTTWVAQIESQNGRQ

SEQ ID NO: 104680 - protein, 34 aa, Artificial Sequence
  Description of Artificial Sequence: Synthetic polypeptide
DDEEIRATNPVATEQYGSVDDTNLQANNGGQDGI

SEQ ID NO: 104681 - protein, 34 aa, Artificial Sequence
  Description of Artificial Sequence: Synthetic polypeptide
FEEEIRTTNPVATEQYGSVSPTPVDQAFQDEVVR

SEQ ID NO: 104682 - protein, 34 aa, Artificial Sequence
  Description of Artificial Sequence: Synthetic polypeptide
SSEEIRTTNPVAYHQYGSVVPSTVLSQRGGNNIQ

SEQ ID NO: 104683 - protein, 36 aa, Artificial Sequence
  Description of Artificial Sequence: Synthetic polypeptide
FEEEIRTTNPVATEQYGSVSPTPSYLASQQGDNNEE

SEQ ID NO: 104684 - protein, 36 aa, Artificial Sequence
  Description of Artificial Sequence: Synthetic polypeptide
FEEEIRTTNPVATEQYGSVSPTNPQQLSIRNGVILD

SEQ ID NO: 104685 - protein, 35 aa, Artificial Sequence
  Description of Artificial Sequence: Synthetic polypeptide
DEHEIATTNPVATEAYGISTVQSCTDALQQAGNRI

SEQ ID NO: 104686 - protein, 34 aa, Artificial Sequence
  Description of Artificial Sequence: Synthetic polypeptide
FEEEIRTTNPVATEQYGSVSPTNMGVQVTPVQMT

SEQ ID NO: 104687 - protein, 30 aa, Artificial Sequence
  Description of Artificial Sequence: Synthetic polypeptide
DEHEIATTNPVATAQWGCVATALTARGDDD

SEQ ID NO: 104688 - protein, 35 aa, Artificial Sequence
  Description of Artificial Sequence: Synthetic polypeptide
FEEEIRTTNPVATEQYGSVSNTNLIPETNVEIENT

SEQ ID NO: 104689 - protein, 33 aa, Artificial Sequence
  Description of Artificial Sequence: Synthetic polypeptide
AEEEISTTNPVATEQYGCVCSSELQNFGSENQS

SEQ ID NO: 104690 - protein, 35 aa, Artificial Sequence
  Description of Artificial Sequence: Synthetic polypeptide
DDEEIRATNPVATEQYGSVIDLTNLQARNGGQGEE

SEQ ID NO: 104691 - protein, 31 aa, Artificial Sequence
  Description of Artificial Sequence: Synthetic polypeptide
AENEIATTNPVATEQYGTACSTGPVEREGND

SEQ ID NO: 104692 - protein, 32 aa, Artificial Sequence
  Description of Artificial Sequence: Synthetic polypeptide
STEEIRTTNCVATDQYGSVSTGDGQRGQGAGD

SEQ ID NO: 104693 - protein, 34 aa, Artificial Sequence
  Description of Artificial Sequence: Synthetic polypeptide
DEHCIRTTNPVAYEQYGSVVPSTNSHQELTEGKR

SEQ ID NO: 104694 - protein, 36 aa, Artificial Sequence
  Description of Artificial Sequence: Synthetic polypeptide
FEEEIRTTNPVATEQYGSVSNMQTDNNLDEFGENGE

SEQ ID NO: 104695 - protein, 32 aa, Artificial Sequence
  Description of Artificial Sequence: Synthetic polypeptide
DEHAIRTTNPVATEQYGSFSTLTLIEIGQISD

SEQ ID NO: 104696 - protein, 36 aa, Artificial Sequence
  Description of Artificial Sequence: Synthetic polypeptide
FEEEIRTTNPVATEQYGSVSNMQTDNLDEFGETNQE

SEQ ID NO: 104697 - protein, 31 aa, Artificial Sequence
  Description of Artificial Sequence: Synthetic polypeptide
DEHEIATTNPVATAQWGSVAAGNLFAADNNR

SEQ ID NO: 104698 - protein, 35 aa, Artificial Sequence
  Description of Artificial Sequence: Synthetic polypeptide
DEHEIATTNPVATEAYGISTVQSCTDALQVAGNNR

SEQ ID NO: 104699 - protein, 32 aa, Artificial Sequence
  Description of Artificial Sequence: Synthetic polypeptide
SSEEIRTTNPVAYHQWGSVVSTVLSQNGGNNF

SEQ ID NO: 104700 - protein, 34 aa, Artificial Sequence
  Description of Artificial Sequence: Synthetic polypeptide
DEHEIATTNPVATECYGEVSCTNLQLNDMGNSGA

SEQ ID NO: 104701 - protein, 34 aa, Artificial Sequence
  Description of Artificial Sequence: Synthetic polypeptide
DEVEIATTNPVATEPYGSVSTTNMLGGNAGEDSR

SEQ ID NO: 104702 - protein, 33 aa, Artificial Sequence
  Description of Artificial Sequence: Synthetic polypeptide
AEEEIRTTNPVATEQYGCVCSTNHAYFNSNFAA

SEQ ID NO: 104703 - protein, 33 aa, Artificial Sequence
  Description of Artificial Sequence: Synthetic polypeptide
AEEEIRTTNPVATEQYGCVCSTNDASFNSNFQG

SEQ ID NO: 104704 - protein, 33 aa, Artificial Sequence
  Description of Artificial Sequence: Synthetic polypeptide
DEHEIATTNPVATEQYGSVCVTDNWIDVGNNAD

SEQ ID NO: 104705 - protein, 32 aa, Artificial Sequence
  Description of Artificial Sequence: Synthetic polypeptide
AEEEIRTTNPVATEQYGCVCSTNDANNSEFQG

SEQ ID NO: 104706 - protein, 35 aa, Artificial Sequence
  Description of Artificial Sequence: Synthetic polypeptide
DEHEIATTNPVATEQYGSVCSATNSQVTDDGGDNP

SEQ ID NO: 104707 - protein, 34 aa, Artificial Sequence
  Description of Artificial Sequence: Synthetic polypeptide
AEEEIRTTNPVATEQYGCVCSTGPHQNFGSENQS

SEQ ID NO: 104708 - protein, 33 aa, Artificial Sequence
  Description of Artificial Sequence: Synthetic polypeptide
DEVEIATTNPVATEQWGCVSTNLNGDANGHSER

SEQ ID NO: 104709 - protein, 33 aa, Artificial Sequence
  Description of Artificial Sequence: Synthetic polypeptide
FEEEIRTTNPVATEQYGSVSTDGFGQNEEEVFG

SEQ ID NO: 104710 - protein, 34 aa, Artificial Sequence
  Description of Artificial Sequence: Synthetic polypeptide
SSEEIRTTNPVAYDQYGSVVASTVLSQRGGNNFQ

SEQ ID NO: 104711 - protein, 31 aa, Artificial Sequence
  Description of Artificial Sequence: Synthetic polypeptide
DEVEIATTNPVATEQWGTNCSAALMRNGNDS

SEQ ID NO: 104712 - protein, 31 aa, Artificial Sequence
  Description of Artificial Sequence: Synthetic polypeptide
AENEIATTNPVATEQYGTISENIQQQQNGNH

SEQ ID NO: 104713 - protein, 32 aa, Artificial Sequence
  Description of Artificial Sequence: Synthetic polypeptide
DEHEIATTNPVATEQYGCVAGTNLATMNPEDQ

SEQ ID NO: 104714 - protein, 35 aa, Artificial Sequence
  Description of Artificial Sequence: Synthetic polypeptide
FEEEIRTTNPVATEQYGSVSSTDNANEDEGGNENT

SEQ ID NO: 104715 - protein, 32 aa, Artificial Sequence
  Description of Artificial Sequence: Synthetic polypeptide
SSEEIRTTNPVAYEQYGSCNCTALAQPGGNNA

SEQ ID NO: 104716 - protein, 34 aa, Artificial Sequence
  Description of Artificial Sequence: Synthetic polypeptide
FEEEIRTTNPVATEQYGSVSSDDLDQNEGGEDGE

SEQ ID NO: 104717 - protein, 34 aa, Artificial Sequence
  Description of Artificial Sequence: Synthetic polypeptide
FEEEIRTTNPVATEQYGSVSPVPQGGVMTVASNE

SEQ ID NO: 104718 - protein, 33 aa, Artificial Sequence
  Description of Artificial Sequence: Synthetic polypeptide
DEVEIATTNPVATEQYGCVCSNDNLGDADDNER

SEQ ID NO: 104719 - protein, 34 aa, Artificial Sequence
  Description of Artificial Sequence: Synthetic polypeptide
FEEEIRTTNPVATEQYGSVSPTWMEEIESQEGRQ

SEQ ID NO: 104720 - protein, 34 aa, Artificial Sequence
  Description of Artificial Sequence: Synthetic polypeptide
DEVEIATTNPVATEQYGCVCSNDNLGDANGMNER

SEQ ID NO: 104721 - protein, 33 aa, Artificial Sequence
  Description of Artificial Sequence: Synthetic polypeptide
DEVEIATTNPVATEQYGCVCSNDNLGDATGEER

SEQ ID NO: 104722 - protein, 33 aa, Artificial Sequence
  Description of Artificial Sequence: Synthetic polypeptide
DEHEIATTNPVATEIYGSVCCNENLQRDGMTTM

SEQ ID NO: 104723 - protein, 32 aa, Artificial Sequence
  Description of Artificial Sequence: Synthetic polypeptide
DDEEIKTTNPVATEQYGTVSTVPTDGGNGQQE

SEQ ID NO: 104724 - protein, 33 aa, Artificial Sequence
  Description of Artificial Sequence: Synthetic polypeptide
AEEEIRTTNPVATEQYGCVCSTELAEYFNSDTQ

SEQ ID NO: 104725 - protein, 33 aa, Artificial Sequence
  Description of Artificial Sequence: Synthetic polypeptide
DEVEIATTNPVATEPYGSVCYNNDHQQQGMNDR

SEQ ID NO: 104726 - protein, 34 aa, Artificial Sequence
  Description of Artificial Sequence: Synthetic polypeptide
DDEEIRATNPVATEQYGSVSTQGDQGQGGGGNET

SEQ ID NO: 104727 - protein, 35 aa, Artificial Sequence
  Description of Artificial Sequence: Synthetic polypeptide
DDEEIRATNPVATEQYGSVVDGTNLQARTGGQTGQ

SEQ ID NO: 104728 - protein, 35 aa, Artificial Sequence
  Description of Artificial Sequence: Synthetic polypeptide
FEEEIRTTNPVATEQYGSVSIPSLIEQERSGEEQT

SEQ ID NO: 104729 - protein, 35 aa, Artificial Sequence
  Description of Artificial Sequence: Synthetic polypeptide
FEEEIRTTNPVATEQYGSVSINNDINQEGGENGEE

SEQ ID NO: 104730 - protein, 35 aa, Artificial Sequence
  Description of Artificial Sequence: Synthetic polypeptide
FEEEIRTTNPVATEQYGSVSINNDINGLEGGNGET

SEQ ID NO: 104731 - protein, 29 aa, Artificial Sequence
  Description of Artificial Sequence: Synthetic peptide
DEGEVASTNPVSTEGYGNVSCTIQSRGQR

SEQ ID NO: 104732 - protein, 32 aa, Artificial Sequence
  Description of Artificial Sequence: Synthetic polypeptide
DEVEIATTNPVATEQYGSVAGTAPQADPTGAE

SEQ ID NO: 104733 - protein, 28 aa, Artificial Sequence
  Description of Artificial Sequence: Synthetic peptide
DEGEVASTNPVSSEGYGNVSCNIQSGQR

SEQ ID NO: 104734 - protein, 28 aa, Artificial Sequence
  Description of Artificial Sequence: Synthetic peptide
DEGEVASTNPCSTEGYGIVANNIQRGQR

SEQ ID NO: 104735 - protein, 28 aa, Artificial Sequence
  Description of Artificial Sequence: Synthetic peptide
DEGEVASTNPCSTEGYGIVACNIQRGQR

SEQ ID NO: 104736 - protein, 28 aa, Artificial Sequence
  Description of Artificial Sequence: Synthetic peptide
DEGEVAPTNPCSSEQYGNVSCNIQSGTR

SEQ ID NO: 104737 - protein, 28 aa, Artificial Sequence
  Description of Artificial Sequence: Synthetic peptide
DEGEVAPTNPCSSEQYGNVSCNIQSGQR

SEQ ID NO: 104738 - protein, 33 aa, Artificial Sequence
  Description of Artificial Sequence: Synthetic polypeptide
DEGNIRTTNPVATECWGSVSCINEPQDREGENG

SEQ ID NO: 104739 - protein, 33 aa, Artificial Sequence
  Description of Artificial Sequence: Synthetic polypeptide
TDEPIRTTNPVAYEQYGKVSTNEHQRAVGNNPF

SEQ ID NO: 104740 - protein, 32 aa, Artificial Sequence
  Description of Artificial Sequence: Synthetic polypeptide
DEGEIVTTNPVATEQYGTVCSTDGPVEFEGND

SEQ ID NO: 104741 - protein, 33 aa, Artificial Sequence
  Description of Artificial Sequence: Synthetic polypeptide
FEEEIRTTNPVATEQYGSVSINNDINGEGGEET

SEQ ID NO: 104742 - protein, 31 aa, Artificial Sequence
  Description of Artificial Sequence: Synthetic polypeptide
DEGEIVTTNPVATEQYGTVCSTDGPEFEGTD

SEQ ID NO: 104743 - protein, 29 aa, Artificial Sequence
  Description of Artificial Sequence: Synthetic peptide
TEAEIACTNPCSYEQYGCVSWNLQSGQRA

SEQ ID NO: 104744 - protein, 33 aa, Artificial Sequence
  Description of Artificial Sequence: Synthetic polypeptide
DEGEIVTTNPVATEQYGTVCSATDGPVQSEGND

SEQ ID NO: 104745 - protein, 33 aa, Artificial Sequence
  Description of Artificial Sequence: Synthetic polypeptide
DEGEIVTTNPVATEQYGTVCSATDGPVQFEGND

SEQ ID NO: 104746 - protein, 33 aa, Artificial Sequence
  Description of Artificial Sequence: Synthetic polypeptide
DEGEIVTTNPVATEQYGTVCSATDGPVEFEGNR

SEQ ID NO: 104747 - protein, 31 aa, Artificial Sequence
  Description of Artificial Sequence: Synthetic polypeptide
TEAEIACTNPVAYEQYGECSCENLSQRVGGR

SEQ ID NO: 104748 - protein, 33 aa, Artificial Sequence
  Description of Artificial Sequence: Synthetic polypeptide
DEGEIVTTNPVATEQYGTVCSACDGLVQSEGND

SEQ ID NO: 104749 - protein, 32 aa, Artificial Sequence
  Description of Artificial Sequence: Synthetic polypeptide
DEGEIVTTNPVATEQYGIVSATDGPVEFEGND

SEQ ID NO: 104750 - protein, 34 aa, Artificial Sequence
  Description of Artificial Sequence: Synthetic polypeptide
FEEEIRTTNPVATEQYGSVSINNDINGEGNEDGE

SEQ ID NO: 104751 - protein, 33 aa, Artificial Sequence
  Description of Artificial Sequence: Synthetic polypeptide
FEEEIRTTNPVATEQYGSVSISDGTAEGGGGGT

SEQ ID NO: 104752 - protein, 35 aa, Artificial Sequence
  Description of Artificial Sequence: Synthetic polypeptide
TAEEIRSTNPVAYEQYGSTVSCTNELSQARNGGQR

SEQ ID NO: 104753 - protein, 33 aa, Artificial Sequence
  Description of Artificial Sequence: Synthetic polypeptide
TAEEIASTNPVATEQYGSVSWNEVQERNGKQDR

SEQ ID NO: 104754 - protein, 36 aa, Artificial Sequence
  Description of Artificial Sequence: Synthetic polypeptide
FEEEIRTTNPVATEQYGSVSNMQTDNLDEEFGENNE

SEQ ID NO: 104755 - protein, 32 aa, Artificial Sequence
  Description of Artificial Sequence: Synthetic polypeptide
DEGVINTTNPVATEQYGCFVCLTNNERGGCNN

SEQ ID NO: 104756 - protein, 35 aa, Artificial Sequence
  Description of Artificial Sequence: Synthetic polypeptide
DEVEIATTNPVATEQYGEVSHTMNDTNQQRGNGMT

SEQ ID NO: 104757 - protein, 29 aa, Artificial Sequence
  Description of Artificial Sequence: Synthetic peptide
DEGVIATVNPVAYEPYGSVAAGNLEMGNN

SEQ ID NO: 104758 - protein, 34 aa, Artificial Sequence
  Description of Artificial Sequence: Synthetic polypeptide
AEEEIRTTNPVATEQYGCVCSTEHQEYFGSENQA

SEQ ID NO: 104759 - protein, 35 aa, Artificial Sequence
  Description of Artificial Sequence: Synthetic polypeptide
FEEEIRTTNPVATEQYGSVSMTPWLAEIESQNGRQ

SEQ ID NO: 104760 - protein, 33 aa, Artificial Sequence
  Description of Artificial Sequence: Synthetic polypeptide
AEEEIRTTNPVATEQYGCVCSTEHNQNFGSDQS

SEQ ID NO: 104761 - protein, 33 aa, Artificial Sequence
  Description of Artificial Sequence: Synthetic polypeptide
STEEIRTTNPVATDQYGSVSVTGMGQRGQGFFD

SEQ ID NO: 104762 - protein, 34 aa, Artificial Sequence
  Description of Artificial Sequence: Synthetic polypeptide
AEEEIRTTNPVATEQYGCVCSTEHNAERFNSNFQ

SEQ ID NO: 104763 - protein, 33 aa, Artificial Sequence
  Description of Artificial Sequence: Synthetic polypeptide
AEEEIRTTNPVATEQYGCVCSTEEHQYFNSDQI

SEQ ID NO: 104764 - protein, 33 aa, Artificial Sequence
  Description of Artificial Sequence: Synthetic polypeptide
AEEEIRTTNPVATEQYGCVCSTEEHQHFGSDQA

SEQ ID NO: 104765 - protein, 34 aa, Artificial Sequence
  Description of Artificial Sequence: Synthetic polypeptide
AEEEIRTTNPVATEQYGCVCSTEEHNQNFGSNQA

SEQ ID NO: 104766 - protein, 34 aa, Artificial Sequence
  Description of Artificial Sequence: Synthetic polypeptide
AEEEIRTTNPVATEQYGCVCSTEDHQEFFGSNQS

SEQ ID NO: 104767 - protein, 31 aa, Artificial Sequence
  Description of Artificial Sequence: Synthetic polypeptide
DEGVIASTNPVATEQYGCVAGTNPAADGNRN

SEQ ID NO: 104768 - protein, 32 aa, Artificial Sequence
  Description of Artificial Sequence: Synthetic polypeptide
STVEIRTTNPVATDQYGSVSTGDGQRGQGFGQ

SEQ ID NO: 104769 - protein, 34 aa, Artificial Sequence
  Description of Artificial Sequence: Synthetic polypeptide
DDEEIRCTNPVATEQYGCSCSTNHNQENFGSNQA

SEQ ID NO: 104770 - protein, 33 aa, Artificial Sequence
  Description of Artificial Sequence: Synthetic polypeptide
DDEEIRCTNPVATEQYGCVCSTELQANSGSQQS

SEQ ID NO: 104771 - protein, 33 aa, Artificial Sequence
  Description of Artificial Sequence: Synthetic polypeptide
DEGTIRSTNPVATEQYGSVSINGGQGGMGENGQ

SEQ ID NO: 104772 - protein, 32 aa, Artificial Sequence
  Description of Artificial Sequence: Synthetic polypeptide
DEGTIGTTNPVATEQYGSADTLNLIGGGNGDG

SEQ ID NO: 104773 - protein, 32 aa, Artificial Sequence
  Description of Artificial Sequence: Synthetic polypeptide
AEEEIRTTNPVATEQYGCVCSSEHQNFGSDQS

SEQ ID NO: 104774 - protein, 33 aa, Artificial Sequence
  Description of Artificial Sequence: Synthetic polypeptide
DDEEIRCTNPVATEQYGCVCSTNDQESSGSQQS

SEQ ID NO: 104775 - protein, 33 aa, Artificial Sequence
  Description of Artificial Sequence: Synthetic polypeptide
DEGSEIATTNPVAYEQWGSVCSTNDQGEGNNNG

SEQ ID NO: 104776 - protein, 33 aa, Artificial Sequence
  Description of Artificial Sequence: Synthetic polypeptide
DEGSEIATTNPVAYEPWGSVSTNLGGNAGENAR

SEQ ID NO: 104777 - protein, 36 aa, Artificial Sequence
  Description of Artificial Sequence: Synthetic polypeptide
FEEEIRTTNPVATEQYGSVSNMQTDNLDEFGEDNNE

SEQ ID NO: 104778 - protein, 32 aa, Artificial Sequence
  Description of Artificial Sequence: Synthetic polypeptide
DEVEIATTNPVAYEHWGEVSTNLQGNDSGGNN

SEQ ID NO: 104779 - protein, 28 aa, Artificial Sequence
  Description of Artificial Sequence: Synthetic peptide
AENEIATTNPVATEYYGCVSWEHQHEEL

SEQ ID NO: 104780 - protein, 34 aa, Artificial Sequence
  Description of Artificial Sequence: Synthetic polypeptide
AEEEIRTTNPVATEQYGCVCSTTELQENFGSEQA

SEQ ID NO: 104781 - protein, 35 aa, Artificial Sequence
  Description of Artificial Sequence: Synthetic polypeptide
AEEEIRTTNPVGYEQYGQSVVASCTNASQRTGNNT

SEQ ID NO: 104782 - protein, 34 aa, Artificial Sequence
  Description of Artificial Sequence: Synthetic polypeptide
AEEEIRTTNPVGYEQYGQSVVSCTNASQQTGGNM

SEQ ID NO: 104783 - protein, 35 aa, Artificial Sequence
  Description of Artificial Sequence: Synthetic polypeptide
FEEEIRTTNPVATEQYGSVSTVNGFGQENQGEEQG

SEQ ID NO: 104784 - protein, 34 aa, Artificial Sequence
  Description of Artificial Sequence: Synthetic polypeptide
FEEEIRTTNPVATEQYGSVSTVMDQIENFVPETL

SEQ ID NO: 104785 - protein, 34 aa, Artificial Sequence
  Description of Artificial Sequence: Synthetic polypeptide
AEEEIRTTNPVATEQYGQCVCSTNHQNFGSETQM

SEQ ID NO: 104786 - protein, 35 aa, Artificial Sequence
  Description of Artificial Sequence: Synthetic polypeptide
FEEEIRTTNPVATEQYGSVSTVLADQGENFVPETL

SEQ ID NO: 104787 - protein, 31 aa, Artificial Sequence
  Description of Artificial Sequence: Synthetic polypeptide
SSEEIATTNPVATTQWGSCSTWDHDQRQGNF

SEQ ID NO: 104788 - protein, 34 aa, Artificial Sequence
  Description of Artificial Sequence: Synthetic polypeptide
FEEEIRTTNPVATEQYGSVSTVADQGPNGVEEYL

SEQ ID NO: 104789 - protein, 32 aa, Artificial Sequence
  Description of Artificial Sequence: Synthetic polypeptide
DEHEIRTTNPCATECYGNVSTGNAGNAGENAE

SEQ ID NO: 104790 - protein, 33 aa, Artificial Sequence
  Description of Artificial Sequence: Synthetic polypeptide
DEHEIRTTNPCATECYGEVSTGNGQERQNENVE

SEQ ID NO: 104791 - protein, 33 aa, Artificial Sequence
  Description of Artificial Sequence: Synthetic polypeptide
DEHEIRTTNPCATECYGSVSTGNDEMNGGGGMR

SEQ ID NO: 104792 - protein, 34 aa, Artificial Sequence
  Description of Artificial Sequence: Synthetic polypeptide
FEEEIRTTNPVATEQYGSVSTTQDIGENGVPESN

SEQ ID NO: 104793 - protein, 31 aa, Artificial Sequence
  Description of Artificial Sequence: Synthetic polypeptide
SSEEIATTNPVATTQWGSVRTWDHDQRGDNS

SEQ ID NO: 104794 - protein, 31 aa, Artificial Sequence
  Description of Artificial Sequence: Synthetic polypeptide
SSEEIATTNPVATTQWGSVRTWDQDQRGNFD

SEQ ID NO: 104795 - protein, 31 aa, Artificial Sequence
  Description of Artificial Sequence: Synthetic polypeptide
SSEEIATTNPVATTQWGSVWTWDHDQRGNDQ

SEQ ID NO: 104796 - protein, 34 aa, Artificial Sequence
  Description of Artificial Sequence: Synthetic polypeptide
DEHEICTTNPVATECYGSVSTGNTGNQGGNGNND

SEQ ID NO: 104797 - protein, 34 aa, Artificial Sequence
  Description of Artificial Sequence: Synthetic polypeptide
DEHEICTTNPVATECYGSVSTGNNGQGGHGNTND

SEQ ID NO: 104798 - protein, 33 aa, Artificial Sequence
  Description of Artificial Sequence: Synthetic polypeptide
SSEEIATTNPVAYHQYGSVVSTVLSQRGGNNVQ

SEQ ID NO: 104799 - protein, 32 aa, Artificial Sequence
  Description of Artificial Sequence: Synthetic polypeptide
SSEEIATTNPVAYHQYGSVVSTVLSQVGGSNF

SEQ ID NO: 104800 - protein, 33 aa, Artificial Sequence
  Description of Artificial Sequence: Synthetic polypeptide
DEHEICTTNPVATEAYGSVSTGNNGGDVGGNMM

SEQ ID NO: 104801 - protein, 32 aa, Artificial Sequence
  Description of Artificial Sequence: Synthetic polypeptide
DEHEIATVNPVATEQYGSVSWTEDLMDEGGDH

SEQ ID NO: 104802 - protein, 33 aa, Artificial Sequence
  Description of Artificial Sequence: Synthetic polypeptide
AEEEIRTTNPVATEQYGQCVCSTEHQNFGSDTQ

SEQ ID NO: 104803 - protein, 34 aa, Artificial Sequence
  Description of Artificial Sequence: Synthetic polypeptide
DEHEIRCTNPVATECYGSVSTDNNGGNHAGDNLR

SEQ ID NO: 104804 - protein, 29 aa, Artificial Sequence
  Description of Artificial Sequence: Synthetic peptide
AENEIATTNPVSTEPYGEASMNIQQQGNH

SEQ ID NO: 104805 - protein, 33 aa, Artificial Sequence
  Description of Artificial Sequence: Synthetic polypeptide
SQEELRTTNPVAYEAWGSVVSCTNLSQNRGGNI

SEQ ID NO: 104806 - protein, 34 aa, Artificial Sequence
  Description of Artificial Sequence: Synthetic polypeptide
SQEELRTTNPVATEQWGSVSCTNMLSTNRTGGNG

SEQ ID NO: 104807 - protein, 35 aa, Artificial Sequence
  Description of Artificial Sequence: Synthetic polypeptide
DEHEIRTTNPCATEHYGSVSTGNLDQDRQNEGQEP

SEQ ID NO: 104808 - protein, 34 aa, Artificial Sequence
  Description of Artificial Sequence: Synthetic polypeptide
DEHEIRTTNPCATEHYGSVSTGNLDDRQNEGQEM

SEQ ID NO: 104809 - protein, 34 aa, Artificial Sequence
  Description of Artificial Sequence: Synthetic polypeptide
DEHEIRTTNPCATEHYGSVSTGNIQDRQNEGQED

SEQ ID NO: 104810 - protein, 31 aa, Artificial Sequence
  Description of Artificial Sequence: Synthetic polypeptide
SQEEIRTTNPVATEQWGTVYSWNLTEEPINK

SEQ ID NO: 104811 - protein, 33 aa, Artificial Sequence
  Description of Artificial Sequence: Synthetic polypeptide
DEHEIRTTNPCATEEWGSVSTGNGAQLEGDHGR

SEQ ID NO: 104812 - protein, 34 aa, Artificial Sequence
  Description of Artificial Sequence: Synthetic polypeptide
DEVEIATTNPVATEIYGCVSTPNGLQAGADGDSR

SEQ ID NO: 104813 - protein, 33 aa, Artificial Sequence
  Description of Artificial Sequence: Synthetic polypeptide
DDEEIASTNPVATEQYGNVSSANTINSRVGNPR

SEQ ID NO: 104814 - protein, 34 aa, Artificial Sequence
  Description of Artificial Sequence: Synthetic polypeptide
DEHEIRTTNPCATECYGSVSTTGDLNDQKGDQDR

SEQ ID NO: 104815 - protein, 33 aa, Artificial Sequence
  Description of Artificial Sequence: Synthetic polypeptide
DDEEIASTNPVATEQYGNVSSATTINSRVGNPR

SEQ ID NO: 104816 - protein, 30 aa, Artificial Sequence
  Description of Artificial Sequence: Synthetic polypeptide
SQEEIRTTNPVATEQWGTYHDWNLTEEINR

SEQ ID NO: 104817 - protein, 31 aa, Artificial Sequence
  Description of Artificial Sequence: Synthetic polypeptide
AENEIATTNPVSTEQYGEASEEDLQQQRGNH

SEQ ID NO: 104818 - protein, 36 aa, Artificial Sequence
  Description of Artificial Sequence: Synthetic polypeptide
FEEEIRTTNPVATEQYGSVTDGTGNLQDTGEENGGT

SEQ ID NO: 104819 - protein, 33 aa, Artificial Sequence
  Description of Artificial Sequence: Synthetic polypeptide
DEHEIRTTNPCATECYGSVSTGNTGNAGEHDNE

SEQ ID NO: 104820 - protein, 32 aa, Artificial Sequence
  Description of Artificial Sequence: Synthetic polypeptide
DEHEIRTTNPCATECYGSVSTGNTGNAGEDAE

SEQ ID NO: 104821 - protein, 31 aa, Artificial Sequence
  Description of Artificial Sequence: Synthetic polypeptide
SQEEIRTTNPVATEQYGSVAPADLQEHQFDQ

SEQ ID NO: 104822 - protein, 34 aa, Artificial Sequence
  Description of Artificial Sequence: Synthetic polypeptide
DEHEIRTTNPCATECYGSVSTGNLGGNAGEGNTE

SEQ ID NO: 104823 - protein, 29 aa, Artificial Sequence
  Description of Artificial Sequence: Synthetic peptide
AENEIATTNPVSTEPYGEASMNIQQRGGH

SEQ ID NO: 104824 - protein, 35 aa, Artificial Sequence
  Description of Artificial Sequence: Synthetic polypeptide
DEHEIRTTNPCATECYGSVSTGNLDQDRQNEGDES

SEQ ID NO: 104825 - protein, 33 aa, Artificial Sequence
  Description of Artificial Sequence: Synthetic polypeptide
SQEEISTTNPVATEQWGTVCSTGNLQNFGSNQA

SEQ ID NO: 104826 - protein, 33 aa, Artificial Sequence
  Description of Artificial Sequence: Synthetic polypeptide
SQEELRTTNPVATEAWGSVPSCTNLSQNTGGNL

SEQ ID NO: 104827 - protein, 34 aa, Artificial Sequence
  Description of Artificial Sequence: Synthetic polypeptide
DEHEIRTTNPCATECYGSVSTGNGQERQNENDEH

SEQ ID NO: 104828 - protein, 34 aa, Artificial Sequence
  Description of Artificial Sequence: Synthetic polypeptide
DEHEIRTTNPCATECYGSVSTGNGQERQNEDMED

SEQ ID NO: 104829 - protein, 34 aa, Artificial Sequence
  Description of Artificial Sequence: Synthetic polypeptide
SQEELRTTNPVATEQWGKVPSCTNLSQNREGGNQ

SEQ ID NO: 104830 - protein, 30 aa, Artificial Sequence
  Description of Artificial Sequence: Synthetic polypeptide
DDEEIASTNPVSTEQYGNVAADNIQRVGQQ

SEQ ID NO: 104831 - protein, 33 aa, Artificial Sequence
  Description of Artificial Sequence: Synthetic polypeptide
DEVEIATTNPVATENYGSVATGDLQDRQMNGGD

SEQ ID NO: 104832 - protein, 32 aa, Artificial Sequence
  Description of Artificial Sequence: Synthetic polypeptide
SSEEIRGTNPVATWQYGSVSTVLAQHMGPQEY

SEQ ID NO: 104833 - protein, 32 aa, Artificial Sequence
  Description of Artificial Sequence: Synthetic polypeptide
DEHEIATTNPVGTECYGVVSWNEKEGQRGNAP

SEQ ID NO: 104834 - protein, 33 aa, Artificial Sequence
  Description of Artificial Sequence: Synthetic polypeptide
SSEEIRTTNPVATDQYGSVVTEGDGQRGQGNGQ

SEQ ID NO: 104835 - protein, 33 aa, Artificial Sequence
  Description of Artificial Sequence: Synthetic polypeptide
DEHEIATTNPVAYDQYGQSTVNCTQLQRTGGND

SEQ ID NO: 104836 - protein, 31 aa, Artificial Sequence
  Description of Artificial Sequence: Synthetic polypeptide
AEEEIRTTNPVATEQYGECSPEHEQFQGGFN

SEQ ID NO: 104837 - protein, 34 aa, Artificial Sequence
  Description of Artificial Sequence: Synthetic polypeptide
DDEEIATTNPVSTEQYGNVSATNPAGQSRNGMNV

SEQ ID NO: 104838 - protein, 34 aa, Artificial Sequence
  Description of Artificial Sequence: Synthetic polypeptide
DDEEIATTNPVSTEQYGNVSATNPAIQSRNGMNV

SEQ ID NO: 104839 - protein, 34 aa, Artificial Sequence
  Description of Artificial Sequence: Synthetic polypeptide
DEHEIATTNPVATEVWGSVCYTNDLGDQGGQNDR

SEQ ID NO: 104840 - protein, 34 aa, Artificial Sequence
  Description of Artificial Sequence: Synthetic polypeptide
DDEEIATTNPVSTEQYGNVSSTNPAGQSRNGMNV

SEQ ID NO: 104841 - protein, 34 aa, Artificial Sequence
  Description of Artificial Sequence: Synthetic polypeptide
FEEEIRTTNPVATEQYGSVSTGMGQQGIGDQEEA

SEQ ID NO: 104842 - protein, 34 aa, Artificial Sequence
  Description of Artificial Sequence: Synthetic polypeptide
SSEEIRTTNPVATEQYGSVSPLDDVSINFQEGVR

SEQ ID NO: 104843 - protein, 32 aa, Artificial Sequence
  Description of Artificial Sequence: Synthetic polypeptide
DEHEIATTNPVATEQYGSYSATDLEDHEGEDL

SEQ ID NO: 104844 - protein, 31 aa, Artificial Sequence
  Description of Artificial Sequence: Synthetic polypeptide
DEHEIATTNPVAYEEWGVVSTNLQGEMNGAN

SEQ ID NO: 104845 - protein, 33 aa, Artificial Sequence
  Description of Artificial Sequence: Synthetic polypeptide
DEHEIATTNPVATEQYGSVYSATDLEDHEGEDL

SEQ ID NO: 104846 - protein, 33 aa, Artificial Sequence
  Description of Artificial Sequence: Synthetic polypeptide
SSEEIRTTNPVATHQYGCVCSNTEHQRFGSNQA

SEQ ID NO: 104847 - protein, 32 aa, Artificial Sequence
  Description of Artificial Sequence: Synthetic polypeptide
DDEEICTTNPVATEQYGSVSWYNGDHDDNVEV

SEQ ID NO: 104848 - protein, 34 aa, Artificial Sequence
  Description of Artificial Sequence: Synthetic polypeptide
FEEEIRTTNPVATEQYGSVSTGMGDQGIGQGIIQ

SEQ ID NO: 104849 - protein, 31 aa, Artificial Sequence
  Description of Artificial Sequence: Synthetic polypeptide
SSEEIRTTNPVATHQYGCVCSTEHQNFGSEF

SEQ ID NO: 104850 - protein, 32 aa, Artificial Sequence
  Description of Artificial Sequence: Synthetic polypeptide
SSEEIRTTNPVATHQYGCVCSTELQHFGSEQA

SEQ ID NO: 104851 - protein, 34 aa, Artificial Sequence
  Description of Artificial Sequence: Synthetic polypeptide
DDEEIKTTNPVATEQWGSVVTRGLRLQREGQTRE

SEQ ID NO: 104852 - protein, 32 aa, Artificial Sequence
  Description of Artificial Sequence: Synthetic polypeptide
SSEEIRTTNPVATHQYGCVCSTGELQNFGSQQ

SEQ ID NO: 104853 - protein, 33 aa, Artificial Sequence
  Description of Artificial Sequence: Synthetic polypeptide
SSEEIRTTNPVATHQYGCVCSTTELQNFGSNQS

SEQ ID NO: 104854 - protein, 34 aa, Artificial Sequence
  Description of Artificial Sequence: Synthetic polypeptide
DEHEIATTNPVATEQYGSVSDTHNNNGDANGNAL

SEQ ID NO: 104855 - protein, 32 aa, Artificial Sequence
  Description of Artificial Sequence: Synthetic polypeptide
AEEEIRTTNPVATEQYGCVCSWEHQHFNSNQT

SEQ ID NO: 104856 - protein, 31 aa, Artificial Sequence
  Description of Artificial Sequence: Synthetic polypeptide
SSEEIRTTNPVATGQWGSVCTWEHGQRQGDF

SEQ ID NO: 104857 - protein, 33 aa, Artificial Sequence
  Description of Artificial Sequence: Synthetic polypeptide
AEEEISTTNPVATEQYGCVCSNTELQNFGSDQS

SEQ ID NO: 104858 - protein, 34 aa, Artificial Sequence
  Description of Artificial Sequence: Synthetic polypeptide
SSEEIRTTNPVATDQYGSVVSTGGGQQRGQGNGQ

SEQ ID NO: 104859 - protein, 34 aa, Artificial Sequence
  Description of Artificial Sequence: Synthetic polypeptide
AEEEISTTNPVATEQYGCVCSNTEHQRFGSNTQS

SEQ ID NO: 104860 - protein, 33 aa, Artificial Sequence
  Description of Artificial Sequence: Synthetic polypeptide
DEHEIATTNPVCTEQYGSVSTGNQGEAGNGNAN

SEQ ID NO: 104861 - protein, 34 aa, Artificial Sequence
  Description of Artificial Sequence: Synthetic polypeptide
FEEEIRTTNPVATEQYGSVSTTMDQEENGVPETL

SEQ ID NO: 104862 - protein, 34 aa, Artificial Sequence
  Description of Artificial Sequence: Synthetic polypeptide
FEEEIRTTNPVATEQYGSVSTTMDQAFNGVPESN

SEQ ID NO: 104863 - protein, 33 aa, Artificial Sequence
  Description of Artificial Sequence: Synthetic polypeptide
DEHEIATTNPVAYERYGVVSTNQQMGGPNGNTR

SEQ ID NO: 104864 - protein, 31 aa, Artificial Sequence
  Description of Artificial Sequence: Synthetic polypeptide
DEHEIATTNPVAYERYGEVTTNNPAGDTNER

SEQ ID NO: 104865 - protein, 32 aa, Artificial Sequence
  Description of Artificial Sequence: Synthetic polypeptide
SSEEIRTTNPVATDQYGSVHPTWLEQRSEEFN

SEQ ID NO: 104866 - protein, 33 aa, Artificial Sequence
  Description of Artificial Sequence: Synthetic polypeptide
SSEEIRTTNPVATDQYGSVPPTWMLEQRDQNDF

SEQ ID NO: 104867 - protein, 32 aa, Artificial Sequence
  Description of Artificial Sequence: Synthetic polypeptide
DEHEIATTNPVAYEQYGSVSANNPQGNGVPDD

SEQ ID NO: 104868 - protein, 28 aa, Artificial Sequence
  Description of Artificial Sequence: Synthetic peptide
DDEEIASVNPVSTEQYGNVADTIQSGNQ

SEQ ID NO: 104869 - protein, 33 aa, Artificial Sequence
  Description of Artificial Sequence: Synthetic polypeptide
SSEEIRTTNPVATDQYGSVSTGDGQQDGQGNED

SEQ ID NO: 104870 - protein, 28 aa, Artificial Sequence
  Description of Artificial Sequence: Synthetic peptide
DDEEIASVNPVSTEQYGNVANTIQSGNQ

SEQ ID NO: 104871 - protein, 35 aa, Artificial Sequence
  Description of Artificial Sequence: Synthetic polypeptide
FEEEIRTTNPVATEQYGSVSTPSVTLEQLIVGTPT

SEQ ID NO: 104872 - protein, 29 aa, Artificial Sequence
  Description of Artificial Sequence: Synthetic peptide
AENEIATTNPVSTEPYGEASENIQQRGGH

SEQ ID NO: 104873 - protein, 34 aa, Artificial Sequence
  Description of Artificial Sequence: Synthetic polypeptide
FEEEIRTTNPVATEQYGSVSTPDDQAENGVPEST

SEQ ID NO: 104874 - protein, 33 aa, Artificial Sequence
  Description of Artificial Sequence: Synthetic polypeptide
DEHEIATTNPVAYEQWGSVSTNLNQGAMGGGMS

SEQ ID NO: 104875 - protein, 29 aa, Artificial Sequence
  Description of Artificial Sequence: Synthetic peptide
DDEEIATTNPVSTEGYGEVPAEVCQHGER

SEQ ID NO: 104876 - protein, 35 aa, Artificial Sequence
  Description of Artificial Sequence: Synthetic polypeptide
FEEEIRTTNPVATEQYGSVSTMNGFGQENQGDEGG

SEQ ID NO: 104877 - protein, 33 aa, Artificial Sequence
  Description of Artificial Sequence: Synthetic polypeptide
DEHEIATTNPVAYEQWGSVSGDNDNNRGDNETR

SEQ ID NO: 104878 - protein, 34 aa, Artificial Sequence
  Description of Artificial Sequence: Synthetic polypeptide
DEHEIATTNPVAYEQWGSVCSGMDNDDQRGDANR

SEQ ID NO: 104879 - protein, 33 aa, Artificial Sequence
  Description of Artificial Sequence: Synthetic polypeptide
DEHEIATTNPVAYEQWGSISHTDNTQREGNDGG

SEQ ID NO: 104880 - protein, 31 aa, Artificial Sequence
  Description of Artificial Sequence: Synthetic polypeptide
DEHEIATTNPVAYEQWGCVSTNNDHGGDDER

SEQ ID NO: 104881 - protein, 34 aa, Artificial Sequence
  Description of Artificial Sequence: Synthetic polypeptide
FEEEIRTTNPVATEQYGSVSTMDFEQQEQGEGDG

SEQ ID NO: 104882 - protein, 29 aa, Artificial Sequence
  Description of Artificial Sequence: Synthetic peptide
DDEEIATTNPVSTEGYGEVPAEVCQHGQR

SEQ ID NO: 104883 - protein, 34 aa, Artificial Sequence
  Description of Artificial Sequence: Synthetic polypeptide
AEEEIRTTNPVATEQYGQCVCSTEDHQNFGSNQM

SEQ ID NO: 104884 - protein, 36 aa, Artificial Sequence
  Description of Artificial Sequence: Synthetic polypeptide
AEEEIRTTNPVATEAYGVVSVSVTNLQQGNLGNNQD

SEQ ID NO: 104885 - protein, 31 aa, Artificial Sequence
  Description of Artificial Sequence: Synthetic polypeptide
TEEEIATTNPVAYEQWGSVAKALEQTNGDGR

SEQ ID NO: 104886 - protein, 32 aa, Artificial Sequence
  Description of Artificial Sequence: Synthetic polypeptide
DEVEIATTNPVAYEHWGEVSTNMQGNDMGNTR

SEQ ID NO: 104887 - protein, 33 aa, Artificial Sequence
  Description of Artificial Sequence: Synthetic polypeptide
TEEEIRTTNPVAYERYGTISCDTNSLSQRTENP

SEQ ID NO: 104888 - protein, 30 aa, Artificial Sequence
  Description of Artificial Sequence: Synthetic polypeptide
AENEIACTNPVSTEQYGEASEENLQQRGGH

SEQ ID NO: 104889 - protein, 33 aa, Artificial Sequence
  Description of Artificial Sequence: Synthetic polypeptide
TEEEIRTTNPVAYESYGCTVVSNTNLSITGDNY

SEQ ID NO: 104890 - protein, 32 aa, Artificial Sequence
  Description of Artificial Sequence: Synthetic polypeptide
DEVEICTTNPVAYEQWGSVSTDNHGAAGENSQ

SEQ ID NO: 104891 - protein, 33 aa, Artificial Sequence
  Description of Artificial Sequence: Synthetic polypeptide
TEEEIRTTNPVAYESYGSTVSNTCLSHTGGDNQ

SEQ ID NO: 104892 - protein, 34 aa, Artificial Sequence
  Description of Artificial Sequence: Synthetic polypeptide
DDEEIRTTNPVATEQYGSVGSTMNGGNDGQGEET

SEQ ID NO: 104893 - protein, 32 aa, Artificial Sequence
  Description of Artificial Sequence: Synthetic polypeptide
AEEEIATTNPVATESYGCIAGANLQDDPGGNR

SEQ ID NO: 104894 - protein, 30 aa, Artificial Sequence
  Description of Artificial Sequence: Synthetic polypeptide
AEEEIATTNPVATEQYGVVSVEVSEQHEET

SEQ ID NO: 104895 - protein, 30 aa, Artificial Sequence
  Description of Artificial Sequence: Synthetic polypeptide
AEEEIATTNPVATEQYGVVAVTEVEQQEEE

SEQ ID NO: 104896 - protein, 29 aa, Artificial Sequence
  Description of Artificial Sequence: Synthetic peptide
AEEEIATTNPVATEQYGVVAVEVNQHEET

SEQ ID NO: 104897 - protein, 33 aa, Artificial Sequence
  Description of Artificial Sequence: Synthetic polypeptide
TEEEIRTTNPVAYERYGSVVATNALEENGGSDR

SEQ ID NO: 104898 - protein, 30 aa, Artificial Sequence
  Description of Artificial Sequence: Synthetic polypeptide
AENEIACTNPVSTEGYGNASANNLQSRGGR

SEQ ID NO: 104899 - protein, 34 aa, Artificial Sequence
  Description of Artificial Sequence: Synthetic polypeptide
DDEEIRTTNPVATEQYGSVISDTSNGGNETGGGT

SEQ ID NO: 104900 - protein, 35 aa, Artificial Sequence
  Description of Artificial Sequence: Synthetic polypeptide
DEVEIGTTNPVATEQYGSVSTLGQLGQEEMGENLT

SEQ ID NO: 104901 - protein, 34 aa, Artificial Sequence
  Description of Artificial Sequence: Synthetic polypeptide
DDEEIRTTNPVATEQYGSVISGTLEGEGGNGNTT

SEQ ID NO: 104902 - protein, 36 aa, Artificial Sequence
  Description of Artificial Sequence: Synthetic polypeptide
DDEEIRTTNPVATEQYGSVISINTNDLGNNEGNVPE

SEQ ID NO: 104903 - protein, 35 aa, Artificial Sequence
  Description of Artificial Sequence: Synthetic polypeptide
TEEEIRTTNPVGYEQYGQSVVSITNVDQRTGGNNT

SEQ ID NO: 104904 - protein, 35 aa, Artificial Sequence
  Description of Artificial Sequence: Synthetic polypeptide
DDEEIRTTNPVATEQYGSVISSTDQGQNGQGEGQE

SEQ ID NO: 104905 - protein, 36 aa, Artificial Sequence
  Description of Artificial Sequence: Synthetic polypeptide
DDEEIRTTNPVATEQYGSVISTDLDLEQNEGGNDEG

SEQ ID NO: 104906 - protein, 34 aa, Artificial Sequence
  Description of Artificial Sequence: Synthetic polypeptide
DDEEIRTTNPVATEQYGSVISTLTGQGGGQGGEQ

SEQ ID NO: 104907 - protein, 30 aa, Artificial Sequence
  Description of Artificial Sequence: Synthetic polypeptide
AEEEIATTNPVATEQYGVVATVEVEQMEEE

SEQ ID NO: 104908 - protein, 34 aa, Artificial Sequence
  Description of Artificial Sequence: Synthetic polypeptide
EEEEIRTTNPVATEQYGSVSSENGTNTQVDPDIY

SEQ ID NO: 104909 - protein, 33 aa, Artificial Sequence
  Description of Artificial Sequence: Synthetic polypeptide
DEVEIGTTNPVATEQYGDVVSATDGQGEFGGND

SEQ ID NO: 104910 - protein, 35 aa, Artificial Sequence
  Description of Artificial Sequence: Synthetic polypeptide
DDEEIRTTNPVATEQYGSVMGNLNGGNGQTGNQFN

SEQ ID NO: 104911 - protein, 35 aa, Artificial Sequence
  Description of Artificial Sequence: Synthetic polypeptide
DEEVIRTTNPVSTEQYGQSTVVSCIENHSQSGGNR

SEQ ID NO: 104912 - protein, 36 aa, Artificial Sequence
  Description of Artificial Sequence: Synthetic polypeptide
EEEEIRTTNPVATEQYGSVSTALNQLGNEEIGTNNE

SEQ ID NO: 104913 - protein, 34 aa, Artificial Sequence
  Description of Artificial Sequence: Synthetic polypeptide
TEEEIRTTNPVAYERYGQSVATCSVSQSRPGGNR

SEQ ID NO: 104914 - protein, 32 aa, Artificial Sequence
  Description of Artificial Sequence: Synthetic polypeptide
TEEEIRTTNPVAYERYGQSVATCSVSTSGGNR

SEQ ID NO: 104915 - protein, 34 aa, Artificial Sequence
  Description of Artificial Sequence: Synthetic polypeptide
TEEEIRTTNPVAYERYGQSVVGATCSVSQRGGNR

SEQ ID NO: 104916 - protein, 34 aa, Artificial Sequence
  Description of Artificial Sequence: Synthetic polypeptide
DEVEICTTNPVATEPYGCVSTGNNLGGTAGENMR

SEQ ID NO: 104917 - protein, 35 aa, Artificial Sequence
  Description of Artificial Sequence: Synthetic polypeptide
DDEEIRTTNPVATEQYGSVGDDTVNLIQNIGQGGT

SEQ ID NO: 104918 - protein, 35 aa, Artificial Sequence
  Description of Artificial Sequence: Synthetic polypeptide
DEVEICTTNPVATEPYGSVSTGNQLGGTAGENDRS

SEQ ID NO: 104919 - protein, 33 aa, Artificial Sequence
  Description of Artificial Sequence: Synthetic polypeptide
DEVEICTTNPVATEQYGSVSATDLEDGEGQEDQ

SEQ ID NO: 104920 - protein, 36 aa, Artificial Sequence
  Description of Artificial Sequence: Synthetic polypeptide
EEEEIRTTNPVATEQYGSVSTANQQQGDEQGTNTDD

SEQ ID NO: 104921 - protein, 35 aa, Artificial Sequence
  Description of Artificial Sequence: Synthetic polypeptide
DDEEIRTTNPVATEQYGSVGNDQNLIQENGGQGNT

SEQ ID NO: 104922 - protein, 34 aa, Artificial Sequence
  Description of Artificial Sequence: Synthetic polypeptide
DEVEICTTNPVATEQYGSVSINGLFGERGQGGEE

SEQ ID NO: 104923 - protein, 35 aa, Artificial Sequence
  Description of Artificial Sequence: Synthetic polypeptide
EEEEIRTTNPVATEQYGSVSTALNNDEEIGTNNNE

SEQ ID NO: 104924 - protein, 35 aa, Artificial Sequence
  Description of Artificial Sequence: Synthetic polypeptide
DEVEICTTNPVATEQYGSVSIVNGQRGERGQEGEE

SEQ ID NO: 104925 - protein, 34 aa, Artificial Sequence
  Description of Artificial Sequence: Synthetic polypeptide
TEEEIRTTNPVAYERYGSVAYTQTGLSQRSGGMR

SEQ ID NO: 104926 - protein, 33 aa, Artificial Sequence
  Description of Artificial Sequence: Synthetic polypeptide
DDEEIRTTNPVATEQYGSVGNVDNGEEDGGNGG

SEQ ID NO: 104927 - protein, 36 aa, Artificial Sequence
  Description of Artificial Sequence: Synthetic polypeptide
DDEEIRTTNPVATEQYGSVGSDTNLIQNNIGQGGGT

SEQ ID NO: 104928 - protein, 31 aa, Artificial Sequence
  Description of Artificial Sequence: Synthetic polypeptide
DEEVVIATVNPVAYEPYGSVSAGNLEMGNNQ

SEQ ID NO: 104929 - protein, 32 aa, Artificial Sequence
  Description of Artificial Sequence: Synthetic polypeptide
TEEEIRTTNPVAYERYGSVVATALEENGGSRC

SEQ ID NO: 104930 - protein, 32 aa, Artificial Sequence
  Description of Artificial Sequence: Synthetic polypeptide
TEEEIRTTNPVAYERYGSVVATALMENTGGAR

SEQ ID NO: 104931 - protein, 34 aa, Artificial Sequence
  Description of Artificial Sequence: Synthetic polypeptide
DEEVISTTNPVATEQYGCVCSTNLNDENFGSNQS

SEQ ID NO: 104932 - protein, 32 aa, Artificial Sequence
  Description of Artificial Sequence: Synthetic polypeptide
TEEEIRTTNPVAYERYGSVVATALTQENGGSS

SEQ ID NO: 104933 - protein, 35 aa, Artificial Sequence
  Description of Artificial Sequence: Synthetic polypeptide
EEEEIRTTNPVATEQYGSVSTALQAGTEAGTDEDD

SEQ ID NO: 104934 - protein, 34 aa, Artificial Sequence
  Description of Artificial Sequence: Synthetic polypeptide
DDEEIRTTNPVATEQYGSVGSNGQGGDENGEEDA

SEQ ID NO: 104935 - protein, 35 aa, Artificial Sequence
  Description of Artificial Sequence: Synthetic polypeptide
DDEEIRTTNPVATEQYGSVGNNDQLIQNEGQENIT

SEQ ID NO: 104936 - protein, 34 aa, Artificial Sequence
  Description of Artificial Sequence: Synthetic polypeptide
DDEEIRTTNPVATEQYGSVNDTAGNQETGGGNGD

SEQ ID NO: 104937 - protein, 34 aa, Artificial Sequence
  Description of Artificial Sequence: Synthetic polypeptide
DDEEIRTTNPVATEQYGSVNDTTGDQNTGGGNGD

SEQ ID NO: 104938 - protein, 36 aa, Artificial Sequence
  Description of Artificial Sequence: Synthetic polypeptide
DDEEIRTTNPVATEQYGSVNSDTNLIQNNEGEGEGT

SEQ ID NO: 104939 - protein, 32 aa, Artificial Sequence
  Description of Artificial Sequence: Synthetic polypeptide
TEEEISTTNPVATERYGSVVSTFELSASVENP

SEQ ID NO: 104940 - protein, 31 aa, Artificial Sequence
  Description of Artificial Sequence: Synthetic polypeptide
TEEEISTTNPVAYEAYGKVSQNELSQDEEER

SEQ ID NO: 104941 - protein, 32 aa, Artificial Sequence
  Description of Artificial Sequence: Synthetic polypeptide
TEEEISTTNPVAYEQYGKTSQGNELSQDEGER

SEQ ID NO: 104942 - protein, 33 aa, Artificial Sequence
  Description of Artificial Sequence: Synthetic polypeptide
TEEEISTTNPVAYEQYGKVASQNELSQDTGELR

SEQ ID NO: 104943 - protein, 33 aa, Artificial Sequence
  Description of Artificial Sequence: Synthetic polypeptide
TEEEISTTNPVAYEQYGKVSQNELSQDEGTHRK

SEQ ID NO: 104944 - protein, 33 aa, Artificial Sequence
  Description of Artificial Sequence: Synthetic polypeptide
TEEEISTTNPVAYEQYGKVSQNNELSQDGEGER

SEQ ID NO: 104945 - protein, 33 aa, Artificial Sequence
  Description of Artificial Sequence: Synthetic polypeptide
TEEEISTTNPVAYEQYGKVVSQNELSQSEGERK

SEQ ID NO: 104946 - protein, 34 aa, Artificial Sequence
  Description of Artificial Sequence: Synthetic polypeptide
EEEEIRTTNPVATEQYGSVSPTENHARQDEMQVQ

SEQ ID NO: 104947 - protein, 35 aa, Artificial Sequence
  Description of Artificial Sequence: Synthetic polypeptide
DDEEIRTTNPVATEQYGSVSSTTPTGPNMRNGNPV

SEQ ID NO: 104948 - protein, 32 aa, Artificial Sequence
  Description of Artificial Sequence: Synthetic polypeptide
TEEEISTTNPVAYEQYGKVWCQNELSQDEGER

SEQ ID NO: 104949 - protein, 35 aa, Artificial Sequence
  Description of Artificial Sequence: Synthetic polypeptide
DDEEIRTTNPVATEQYGSVSPTNMMMQESGEEEVN

SEQ ID NO: 104950 - protein, 35 aa, Artificial Sequence
  Description of Artificial Sequence: Synthetic polypeptide
EEEEIRTTNPVATEQYGSVSPTDVLLLTPENLVRN

SEQ ID NO: 104951 - protein, 33 aa, Artificial Sequence
  Description of Artificial Sequence: Synthetic polypeptide
DEVEIRTTNPVATDQYGSVNMTGLQEEGGDEDT

SEQ ID NO: 104952 - protein, 33 aa, Artificial Sequence
  Description of Artificial Sequence: Synthetic polypeptide
DEVEIRTTNPVATDQYGSVNTGGQQEEGGNEDT

SEQ ID NO: 104953 - protein, 34 aa, Artificial Sequence
  Description of Artificial Sequence: Synthetic polypeptide
DDEEIRTTNPVATEQYGSVSTGDITQGGGGEEEQ

SEQ ID NO: 104954 - protein, 35 aa, Artificial Sequence
  Description of Artificial Sequence: Synthetic polypeptide
TEEELATTNPVAYEQWGSVCSTWNHLDQRIGENMR

SEQ ID NO: 104955 - protein, 32 aa, Artificial Sequence
  Description of Artificial Sequence: Synthetic polypeptide
TEEELCTTNPVATKQYGAVSTNISAQRGCQDN

SEQ ID NO: 104956 - protein, 34 aa, Artificial Sequence
  Description of Artificial Sequence: Synthetic polypeptide
EEEEIRTTNPVATEQYGSVSPLVVTNETNLSLQN

SEQ ID NO: 104957 - protein, 35 aa, Artificial Sequence
  Description of Artificial Sequence: Synthetic polypeptide
DDEEIRTTNPVATEQYGSVSTGMQDGQGEEGENGE

SEQ ID NO: 104958 - protein, 32 aa, Artificial Sequence
  Description of Artificial Sequence: Synthetic polypeptide
AEEEIATTNPVATEQYGSVCAAMHLQDSNNDM

SEQ ID NO: 104959 - protein, 34 aa, Artificial Sequence
  Description of Artificial Sequence: Synthetic polypeptide
EEEEIRTTNPVATEQYGSVSLTPWLIVSGPEEQL

SEQ ID NO: 104960 - protein, 33 aa, Artificial Sequence
  Description of Artificial Sequence: Synthetic polypeptide
TEEGICTTNPVATEQYGSTVSMNSSQQTGGNNS

SEQ ID NO: 104961 - protein, 34 aa, Artificial Sequence
  Description of Artificial Sequence: Synthetic polypeptide
EEEEIRTTNPVATEQYGSVSPTANLHINLIEVTD

SEQ ID NO: 104962 - protein, 34 aa, Artificial Sequence
  Description of Artificial Sequence: Synthetic polypeptide
DDEEIRTTNPVATEQYGSVSNTDNVEMGEFGEFI

SEQ ID NO: 104963 - protein, 36 aa, Artificial Sequence
  Description of Artificial Sequence: Synthetic polypeptide
AEEEIATTNPVATEQYGSVSSTTPNGPQMRNGMNPV

SEQ ID NO: 104964 - protein, 28 aa, Artificial Sequence
  Description of Artificial Sequence: Synthetic peptide
AEEEIATTNPVATEQYGTATEVGQEEEA

SEQ ID NO: 104965 - protein, 36 aa, Artificial Sequence
  Description of Artificial Sequence: Synthetic polypeptide
DDEEIRTTNPVATEQYGSVNSTDLDLEQEGGGNDEG

SEQ ID NO: 104966 - protein, 35 aa, Artificial Sequence
  Description of Artificial Sequence: Synthetic polypeptide
DDEEIRTTNPVATEQYGSVNSTTIHNLESGQEVKK

SEQ ID NO: 104967 - protein, 34 aa, Artificial Sequence
  Description of Artificial Sequence: Synthetic polypeptide
DDEEIRTTNPVATEQYGSVNTDNGLEGGGGETGT

SEQ ID NO: 104968 - protein, 33 aa, Artificial Sequence
  Description of Artificial Sequence: Synthetic polypeptide
DDEEIRTTNPVATEQYGSVNTDTMTLGQEDEGT

SEQ ID NO: 104969 - protein, 35 aa, Artificial Sequence
  Description of Artificial Sequence: Synthetic polypeptide
EEEEIRTTNPVATEQYGSVSPVNLIQNRIMQEEHQ

SEQ ID NO: 104970 - protein, 35 aa, Artificial Sequence
  Description of Artificial Sequence: Synthetic polypeptide
DDEEIRTTNPVATEQYGSVSATTAIPNMRNGMNPV

SEQ ID NO: 104971 - protein, 35 aa, Artificial Sequence
  Description of Artificial Sequence: Synthetic polypeptide
DDEEIRTTNPVATEQYGSVSDGGTGLGGNQEGGQE

SEQ ID NO: 104972 - protein, 34 aa, Artificial Sequence
  Description of Artificial Sequence: Synthetic polypeptide
DDEEIRTTNPVATEQYGSVSDGVTGLGENGGGQT

SEQ ID NO: 104973 - protein, 34 aa, Artificial Sequence
  Description of Artificial Sequence: Synthetic polypeptide
DDEEIRTTNPVATEQYGSVSDVGMGLNGGNGGGN

SEQ ID NO: 104974 - protein, 30 aa, Artificial Sequence
  Description of Artificial Sequence: Synthetic polypeptide
AEEEIATTNPVATEQYGVVATPEVEQEEED

SEQ ID NO: 104975 - protein, 35 aa, Artificial Sequence
  Description of Artificial Sequence: Synthetic polypeptide
AEEQIRTTNPVATEQYGSVSTTNQQLNQLQQNETE

SEQ ID NO: 104976 - protein, 35 aa, Artificial Sequence
  Description of Artificial Sequence: Synthetic polypeptide
AEEQIRTTNPVATEQYGSVSTTQNLNQLQLQNTTD

SEQ ID NO: 104977 - protein, 35 aa, Artificial Sequence
  Description of Artificial Sequence: Synthetic polypeptide
AEEQIRTTNPVATEQYGSVSTTTNLSNLQLQNATD

SEQ ID NO: 104978 - protein, 34 aa, Artificial Sequence
  Description of Artificial Sequence: Synthetic polypeptide
DEVEIRSTNPVATEQYGSVITDNNGNDEGQGGNG

SEQ ID NO: 104979 - protein, 29 aa, Artificial Sequence
  Description of Artificial Sequence: Synthetic peptide
AEEEIATTNPVATEQYGVVAPEVGQEEET

SEQ ID NO: 104980 - protein, 35 aa, Artificial Sequence
  Description of Artificial Sequence: Synthetic polypeptide
TEEEISTTNPVATEAYGSTVSSCHNELSQRTGDNM

SEQ ID NO: 104981 - protein, 35 aa, Artificial Sequence
  Description of Artificial Sequence: Synthetic polypeptide
DDEEIRTTNPVATEQYGSVSILELDQNGEEGEGNI

SEQ ID NO: 104982 - protein, 35 aa, Artificial Sequence
  Description of Artificial Sequence: Synthetic polypeptide
DDEEIRTTNPVATEQYGSVSILELDQQTEEGEGNT

SEQ ID NO: 104983 - protein, 35 aa, Artificial Sequence
  Description of Artificial Sequence: Synthetic polypeptide
DDEEIRTTNPVATEQYGSVSILELDQSTEEGGGNG

SEQ ID NO: 104984 - protein, 34 aa, Artificial Sequence
  Description of Artificial Sequence: Synthetic polypeptide
DDEEIRTTNPVATEQYGSVSINNDIMTNGQEDGI

SEQ ID NO: 104985 - protein, 36 aa, Artificial Sequence
  Description of Artificial Sequence: Synthetic polypeptide
DDEEIRTTNPVATEQYGSVSITDNGLQEGQGGGEGV

SEQ ID NO: 104986 - protein, 29 aa, Artificial Sequence
  Description of Artificial Sequence: Synthetic peptide
AEEEIATTNPVATEQYGVVAEEVEQLEEQ

SEQ ID NO: 104987 - protein, 29 aa, Artificial Sequence
  Description of Artificial Sequence: Synthetic peptide
AEEEIATTNPVATEQYGTVANEVGQEEEN

SEQ ID NO: 104988 - protein, 34 aa, Artificial Sequence
  Description of Artificial Sequence: Synthetic polypeptide
DDEEIRTTNPVATEQYGSVDSTMDIQGGGQEEEQ

SEQ ID NO: 104989 - protein, 33 aa, Artificial Sequence
  Description of Artificial Sequence: Synthetic polypeptide
TEEEIRTTNPVAYERYGQSVAATCSVSQQGGNR

SEQ ID NO: 104990 - protein, 35 aa, Artificial Sequence
  Description of Artificial Sequence: Synthetic polypeptide
AEEQIRTTNPVATEQYGSVSTTNNLEQLQLNNDTD

SEQ ID NO: 104991 - protein, 31 aa, Artificial Sequence
  Description of Artificial Sequence: Synthetic polypeptide
AEEEIATTNPVATESYGCIIAGNNLQDSGNQ

SEQ ID NO: 104992 - protein, 32 aa, Artificial Sequence
  Description of Artificial Sequence: Synthetic polypeptide
TEEEIRTTNPVAYEAYGQVVNTAMVQRGSNLD

SEQ ID NO: 104993 - protein, 31 aa, Artificial Sequence
  Description of Artificial Sequence: Synthetic polypeptide
DEVEIATTNPVAYERWGVVATNLQLGEDNGS

SEQ ID NO: 104994 - protein, 33 aa, Artificial Sequence
  Description of Artificial Sequence: Synthetic polypeptide
DDEEIRTTNPVATEQYGDVSINMGMGIGNGDEG

SEQ ID NO: 104995 - protein, 36 aa, Artificial Sequence
  Description of Artificial Sequence: Synthetic polypeptide
EEEEIRTTNPVATEQYGSVSTTNNQQNNQQIGENND

SEQ ID NO: 104996 - protein, 36 aa, Artificial Sequence
  Description of Artificial Sequence: Synthetic polypeptide
EEEEIRTTNPVATEQYGSVSTTNNNLQQLQNATETG

SEQ ID NO: 104997 - protein, 33 aa, Artificial Sequence
  Description of Artificial Sequence: Synthetic polypeptide
TEEEIRTTNPVAYEAYGSVINTAMIQRGGNNLT

SEQ ID NO: 104998 - protein, 35 aa, Artificial Sequence
  Description of Artificial Sequence: Synthetic polypeptide
DDEEIRTTNPVATEQYGDVSVTMNIGQNEGGEGNT

SEQ ID NO: 104999 - protein, 35 aa, Artificial Sequence
  Description of Artificial Sequence: Synthetic polypeptide
EEEEIRTTNPVATEQYGSVSTTNNLQQLQEATEQG

SEQ ID NO: 105000 - protein, 35 aa, Artificial Sequence
  Description of Artificial Sequence: Synthetic polypeptide
EEEEIRTTNPVATEQYGSVSTTNNLQQLETATEYG

SEQ ID NO: 105001 - protein, 32 aa, Artificial Sequence
  Description of Artificial Sequence: Synthetic polypeptide
DEFEISTVNPVATEQYGCVCSTNLANFGGDQA

SEQ ID NO: 105002 - protein, 32 aa, Artificial Sequence
  Description of Artificial Sequence: Synthetic polypeptide
DEVEIATTNPVAYERWGVTSTNLQGNDMGGNR

SEQ ID NO: 105003 - protein, 34 aa, Artificial Sequence
  Description of Artificial Sequence: Synthetic polypeptide
DEFEIRTTNPVAYLAWGSVVSCTNALSQEPGPNR

SEQ ID NO: 105004 - protein, 32 aa, Artificial Sequence
  Description of Artificial Sequence: Synthetic polypeptide
DDEEIRTTNPVATEQYGDVTSTDLNNMDEMGM

SEQ ID NO: 105005 - protein, 33 aa, Artificial Sequence
  Description of Artificial Sequence: Synthetic polypeptide
DEFEIRTTNPVATTAWGSVSCINLSTEPGGPNR

SEQ ID NO: 105006 - protein, 34 aa, Artificial Sequence
  Description of Artificial Sequence: Synthetic polypeptide
DDEEIRTTNPVATEQYGDVVTSNMNLEQGENGQG

SEQ ID NO: 105007 - protein, 33 aa, Artificial Sequence
  Description of Artificial Sequence: Synthetic polypeptide
TEEEIRTTNPVAYEAYGSVVSCTNLDHTGTDQV

SEQ ID NO: 105008 - protein, 34 aa, Artificial Sequence
  Description of Artificial Sequence: Synthetic polypeptide
DEFEIRTTNPVATEQYGSVSFTVDLTQETSEDIQ

SEQ ID NO: 105009 - protein, 36 aa, Artificial Sequence
  Description of Artificial Sequence: Synthetic polypeptide
EEEEIRTTNPVATEQYGSVSTQNQQAGTEQGTNQDE

SEQ ID NO: 105010 - protein, 32 aa, Artificial Sequence
  Description of Artificial Sequence: Synthetic polypeptide
DEFEIRTTNPVATEQWGSDVSEIQEYNGMNEA

SEQ ID NO: 105011 - protein, 33 aa, Artificial Sequence
  Description of Artificial Sequence: Synthetic polypeptide
DEFEIRTTNPVATEQWGSDVSCEIQEGNGMEEA

SEQ ID NO: 105012 - protein, 30 aa, Artificial Sequence
  Description of Artificial Sequence: Synthetic polypeptide
DEFEIRTTNPVATEQWGDVSEIEMNAGEDA

SEQ ID NO: 105013 - protein, 37 aa, Artificial Sequence
  Description of Artificial Sequence: Synthetic polypeptide
EEEEIRTTNPVATEQYGSVSTQNLQAGTEQGGTNTDD

SEQ ID NO: 105014 - protein, 32 aa, Artificial Sequence
  Description of Artificial Sequence: Synthetic polypeptide
DEFEIRTTNPVAYHAWGSVSCTNHSQEPGPNE

SEQ ID NO: 105015 - protein, 33 aa, Artificial Sequence
  Description of Artificial Sequence: Synthetic polypeptide
DEFETCTVNPVATEQYGSVSWNIDQDERGGNHH

SEQ ID NO: 105016 - protein, 33 aa, Artificial Sequence
  Description of Artificial Sequence: Synthetic polypeptide
DEFEVRTTNPVATECWGSVSCINEPQDREGENG

SEQ ID NO: 105017 - protein, 36 aa, Artificial Sequence
  Description of Artificial Sequence: Synthetic polypeptide
EEEEIRTTNPVATEQYGSVSTTNNQQNQQQGENTNN

SEQ ID NO: 105018 - protein, 36 aa, Artificial Sequence
  Description of Artificial Sequence: Synthetic polypeptide
EEEEIRTTNPVATEQYGSVSTTQNNNNQQGNNVNEY

SEQ ID NO: 105019 - protein, 34 aa, Artificial Sequence
  Description of Artificial Sequence: Synthetic polypeptide
TEEEIRTTNPVATHQYGSVNETSNGIDQQGENYQ

SEQ ID NO: 105020 - protein, 35 aa, Artificial Sequence
  Description of Artificial Sequence: Synthetic polypeptide
TEEEIRTTNPVATREWSGYIVGSNTNEGQRGNERE

SEQ ID NO: 105021 - protein, 32 aa, Artificial Sequence
  Description of Artificial Sequence: Synthetic polypeptide
TEEEIRTTNPVATSMWGSVYATINLDQGMRGQ

SEQ ID NO: 105022 - protein, 33 aa, Artificial Sequence
  Description of Artificial Sequence: Synthetic polypeptide
TEEEIRTTNPVATSMYGCVTYATVNLDQGGHRG

SEQ ID NO: 105023 - protein, 31 aa, Artificial Sequence
  Description of Artificial Sequence: Synthetic polypeptide
TEEEIRTTNPVATSMYGMVYATVALDQGDRG

SEQ ID NO: 105024 - protein, 32 aa, Artificial Sequence
  Description of Artificial Sequence: Synthetic polypeptide
TEEEIRTTNPVATSMYGNVYATVALDQGGRNG

SEQ ID NO: 105025 - protein, 36 aa, Artificial Sequence
  Description of Artificial Sequence: Synthetic polypeptide
EEEEIRTTNPVATEQYGSVSTTNQQAGNQQGTTTTD

SEQ ID NO: 105026 - protein, 32 aa, Artificial Sequence
  Description of Artificial Sequence: Synthetic polypeptide
TEEEIRTTNPVATSMYGQVYATEWLDQQGGRG

SEQ ID NO: 105027 - protein, 32 aa, Artificial Sequence
  Description of Artificial Sequence: Synthetic polypeptide
TEEEIRTTNPVATSMYGQVYATVNLDYGGRGD

SEQ ID NO: 105028 - protein, 33 aa, Artificial Sequence
  Description of Artificial Sequence: Synthetic polypeptide
TEEEIRTTNPVATSMYGQVYATVNLEQQGGARG

SEQ ID NO: 105029 - protein, 33 aa, Artificial Sequence
  Description of Artificial Sequence: Synthetic polypeptide
DEFVIGTTNPVATEQHGNSIVISTDFLQGGNNA

SEQ ID NO: 105030 - protein, 32 aa, Artificial Sequence
  Description of Artificial Sequence: Synthetic polypeptide
TEEEIRTTNPVATSMYGSCYATVNLDPGVGRG

SEQ ID NO: 105031 - protein, 31 aa, Artificial Sequence
  Description of Artificial Sequence: Synthetic polypeptide
TEEEIRTTNPVATSMYGSVYAIVNDDPGGRG

SEQ ID NO: 105032 - protein, 33 aa, Artificial Sequence
  Description of Artificial Sequence: Synthetic polypeptide
TEEEIRTTNPVATSMYGSVYATVNLDPQGGRIG

SEQ ID NO: 105033 - protein, 31 aa, Artificial Sequence
  Description of Artificial Sequence: Synthetic polypeptide
TEEEIRTTNPVATSRYGCVGATVHLDQGNQG

SEQ ID NO: 105034 - protein, 32 aa, Artificial Sequence
  Description of Artificial Sequence: Synthetic polypeptide
TEEEIRTTNPVATSRYGCVGATVWLDQGGQNG

SEQ ID NO: 105035 - protein, 31 aa, Artificial Sequence
  Description of Artificial Sequence: Synthetic polypeptide
DEFVICTTNPVATEQYGCVETDPQTFGGNQF

SEQ ID NO: 105036 - protein, 35 aa, Artificial Sequence
  Description of Artificial Sequence: Synthetic polypeptide
TEEEIRTTNPVAYEAWGQSVVLTNLSQSRGGNQRY

SEQ ID NO: 105037 - protein, 35 aa, Artificial Sequence
  Description of Artificial Sequence: Synthetic polypeptide
EEEEIRTTNPVATEQYGSVSTTNNQQQQQNATEQG

SEQ ID NO: 105038 - protein, 34 aa, Artificial Sequence
  Description of Artificial Sequence: Synthetic polypeptide
DDEEIRTTNPVATEQYGDVISTDLNGGNGENGQE

SEQ ID NO: 105039 - protein, 32 aa, Artificial Sequence
  Description of Artificial Sequence: Synthetic polypeptide
DEVEIATTNPVAYERWGTVSTNLNRGDTNDSS

SEQ ID NO: 105040 - protein, 36 aa, Artificial Sequence
  Description of Artificial Sequence: Synthetic polypeptide
EEEEIRTTNPVATEQYGSVSTTNNQQNQQQGTEENE

SEQ ID NO: 105041 - protein, 34 aa, Artificial Sequence
  Description of Artificial Sequence: Synthetic polypeptide
DEFEIRTTNPVATCAWGSVSCTNMLSDEPGGPNR

SEQ ID NO: 105042 - protein, 33 aa, Artificial Sequence
  Description of Artificial Sequence: Synthetic polypeptide
DEEVIRTTNPVATEQYGCVCSTEPNDNFGSEQS

SEQ ID NO: 105043 - protein, 33 aa, Artificial Sequence
  Description of Artificial Sequence: Synthetic polypeptide
DEFEIGTVNPVATEQYGCVCSTNLTEFGSNNQS

SEQ ID NO: 105044 - protein, 33 aa, Artificial Sequence
  Description of Artificial Sequence: Synthetic polypeptide
DEFEICTVNPVAYEQYGSVPSTNELSTSGGNYH

SEQ ID NO: 105045 - protein, 28 aa, Artificial Sequence
  Description of Artificial Sequence: Synthetic peptide
AEEEICTTNPVATEQYGETTEVGQEEEM

SEQ ID NO: 105046 - protein, 31 aa, Artificial Sequence
  Description of Artificial Sequence: Synthetic polypeptide
AEEEICTTNPQATKQYGAVSTNISAQRIQDN

SEQ ID NO: 105047 - protein, 32 aa, Artificial Sequence
  Description of Artificial Sequence: Synthetic polypeptide
AEEEIATTNPVAYEQYGSTVAGAGNDQRQNMQ

SEQ ID NO: 105048 - protein, 34 aa, Artificial Sequence
  Description of Artificial Sequence: Synthetic polypeptide
TEEEIRTTNPVAYEQYGSVSCTDNMANPSGTNND

SEQ ID NO: 105049 - protein, 33 aa, Artificial Sequence
  Description of Artificial Sequence: Synthetic polypeptide
AEEEIATTNPVAYEQYGSTVAGAGNDQRMNDRQ

SEQ ID NO: 105050 - protein, 32 aa, Artificial Sequence
  Description of Artificial Sequence: Synthetic polypeptide
AEEEIATTNPVAYEQYGSTVAGAGNDQNGNTQ

SEQ ID NO: 105051 - protein, 35 aa, Artificial Sequence
  Description of Artificial Sequence: Synthetic polypeptide
DEVEICTTNPVATECYGSVSTGNQNQQRDDEGHGR

SEQ ID NO: 105052 - protein, 32 aa, Artificial Sequence
  Description of Artificial Sequence: Synthetic polypeptide
AEEEIATTNPVAYEHWGCFSIQNDLQRGQNGR

SEQ ID NO: 105053 - protein, 32 aa, Artificial Sequence
  Description of Artificial Sequence: Synthetic polypeptide
DEFEIATVNPVATEQYGSVSWTEDLDEGGGQH

SEQ ID NO: 105054 - protein, 32 aa, Artificial Sequence
  Description of Artificial Sequence: Synthetic polypeptide
DEFEIATVNPVATEQYGSVSWTEDLDEGGDDH

SEQ ID NO: 105055 - protein, 34 aa, Artificial Sequence
  Description of Artificial Sequence: Synthetic polypeptide
TEEEIRTTNPVAYEQYGSTVVWCTNALQVTDSRM

SEQ ID NO: 105056 - protein, 34 aa, Artificial Sequence
  Description of Artificial Sequence: Synthetic polypeptide
TEEEIRTTNPVAYEQYGSVVPSTNNIAGGGNYKT

SEQ ID NO: 105057 - protein, 32 aa, Artificial Sequence
  Description of Artificial Sequence: Synthetic polypeptide
AEEEIATTNPVAYEHWGCFSIQNDLQRGGDNR

SEQ ID NO: 105058 - protein, 33 aa, Artificial Sequence
  Description of Artificial Sequence: Synthetic polypeptide
DDEEIRTTNPVATEQYGSVCSWEEHQGFNSEQA

SEQ ID NO: 105059 - protein, 33 aa, Artificial Sequence
  Description of Artificial Sequence: Synthetic polypeptide
DEFEIATVNPVATEQYGCVCSTNLINFGSNNQS

SEQ ID NO: 105060 - protein, 33 aa, Artificial Sequence
  Description of Artificial Sequence: Synthetic polypeptide
DEFEIATTNPVATEQYGSWVSTTDLEDHEGEDL

SEQ ID NO: 105061 - protein, 33 aa, Artificial Sequence
  Description of Artificial Sequence: Synthetic polypeptide
DEFEIATTNPVATEQYGSVSATDSLEDHEGEDL

SEQ ID NO: 105062 - protein, 32 aa, Artificial Sequence
  Description of Artificial Sequence: Synthetic polypeptide
AENEIACTNPVSTEQYGEASMENLQQQRNGNR

SEQ ID NO: 105063 - protein, 33 aa, Artificial Sequence
  Description of Artificial Sequence: Synthetic polypeptide
DEVEICTTNPVATECYGSVTTGNNQNDEGHGRP

SEQ ID NO: 105064 - protein, 32 aa, Artificial Sequence
  Description of Artificial Sequence: Synthetic polypeptide
DEFEIATTNPVATEQYGSVSATDLEDHEKEDL

SEQ ID NO: 105065 - protein, 33 aa, Artificial Sequence
  Description of Artificial Sequence: Synthetic polypeptide
DEFEIATTNPVATEQYGSAVSATDLEDHEGEDL

SEQ ID NO: 105066 - protein, 33 aa, Artificial Sequence
  Description of Artificial Sequence: Synthetic polypeptide
DEFDIRTTNPVATECWGSVSCINEPQDREGENG

SEQ ID NO: 105067 - protein, 34 aa, Artificial Sequence
  Description of Artificial Sequence: Synthetic polypeptide
AEEQIRTTNPVATEQYGSVSTTNLNSNLLQNTTD

SEQ ID NO: 105068 - protein, 35 aa, Artificial Sequence
  Description of Artificial Sequence: Synthetic polypeptide
TEEEIRTTNPVAYEQYGSTVPSAWNALSDEFGGNR

SEQ ID NO: 105069 - protein, 36 aa, Artificial Sequence
  Description of Artificial Sequence: Synthetic polypeptide
EEEEIRTTNPVATEQYGSVSTNLNLLNDEAGTNNDT

SEQ ID NO: 105070 - protein, 33 aa, Artificial Sequence
  Description of Artificial Sequence: Synthetic polypeptide
DEFEICTVNPVATEQYGSVRSTTMNHEFEQGNN

SEQ ID NO: 105071 - protein, 34 aa, Artificial Sequence
  Description of Artificial Sequence: Synthetic polypeptide
TEEEIRTTNPVAYEAYGSVVTNTAMVQRGGNTLD

SEQ ID NO: 105072 - protein, 29 aa, Artificial Sequence
  Description of Artificial Sequence: Synthetic peptide
AENEIACTNPVSTEQYGTASMNLQQQGGH

SEQ ID NO: 105073 - protein, 36 aa, Artificial Sequence
  Description of Artificial Sequence: Synthetic polypeptide
EEEEIRTTNPVATEQYGSVSTQLQQAGTEQGTNTDD

SEQ ID NO: 105074 - protein, 36 aa, Artificial Sequence
  Description of Artificial Sequence: Synthetic polypeptide
EEEEIRTTNPVATEQYGSVSTNSNNQNQQQGENQNE

SEQ ID NO: 105075 - protein, 33 aa, Artificial Sequence
  Description of Artificial Sequence: Synthetic polypeptide
DEVEICTTNPVATECYGEVSTGNGNQQLDDGHR

SEQ ID NO: 105076 - protein, 36 aa, Artificial Sequence
  Description of Artificial Sequence: Synthetic polypeptide
EEEEIRTTNPVATEQYGSVSTNNNQLGNEAGGNNDD

SEQ ID NO: 105077 - protein, 30 aa, Artificial Sequence
  Description of Artificial Sequence: Synthetic polypeptide
AEEEISTTNPVSTEIFGTVCTFENLQGGQT

SEQ ID NO: 105078 - protein, 36 aa, Artificial Sequence
  Description of Artificial Sequence: Synthetic polypeptide
DEVEICTTNPVATECYGSVSTGNGLLQDDRGQNGEN

SEQ ID NO: 105079 - protein, 34 aa, Artificial Sequence
  Description of Artificial Sequence: Synthetic polypeptide
TEEEIRTTNPVAYEPYGQVASTHELSQSGVNNRR

SEQ ID NO: 105080 - protein, 35 aa, Artificial Sequence
  Description of Artificial Sequence: Synthetic polypeptide
DEVEICTTNPVATECYGSVSTGNGNQQEDREGGMR

SEQ ID NO: 105081 - protein, 36 aa, Artificial Sequence
  Description of Artificial Sequence: Synthetic polypeptide
EEEEIRTTNPVATEQYGSVSTNLQQYGTEEGTTTDD

SEQ ID NO: 105082 - protein, 34 aa, Artificial Sequence
  Description of Artificial Sequence: Synthetic polypeptide
TEEEIRTTNPVAYEQWGCYVWQTNDHLQRGHGDR

SEQ ID NO: 105083 - protein, 34 aa, Artificial Sequence
  Description of Artificial Sequence: Synthetic polypeptide
DEFEICTVNPVATEQYGSVSTLNLEFPEGFNYNQ

SEQ ID NO: 105084 - protein, 32 aa, Artificial Sequence
  Description of Artificial Sequence: Synthetic polypeptide
AEEEICTTNPVATEQYGVVATEVNELQEEEED

SEQ ID NO: 105085 - protein, 33 aa, Artificial Sequence
  Description of Artificial Sequence: Synthetic polypeptide
AEEGIRTTNPVATEQYGSVPSVNINLVSPVVNG

SEQ ID NO: 105086 - protein, 30 aa, Artificial Sequence
  Description of Artificial Sequence: Synthetic polypeptide
AEEEICTTNPVATEQYGVVATEVEQEDEED

SEQ ID NO: 105087 - protein, 34 aa, Artificial Sequence
  Description of Artificial Sequence: Synthetic polypeptide
DEVEICTTNPVATECYGSVSTGNNGGTAGENDRQ

SEQ ID NO: 105088 - protein, 33 aa, Artificial Sequence
  Description of Artificial Sequence: Synthetic polypeptide
TEEEIRTTNPVAYEQWGVSVWWQNDLDQDGIRR

SEQ ID NO: 105089 - protein, 33 aa, Artificial Sequence
  Description of Artificial Sequence: Synthetic polypeptide
TEEEIRTTNPVAYEQYGEVVPSCNNLAGGGNKT

SEQ ID NO: 105090 - protein, 31 aa, Artificial Sequence
  Description of Artificial Sequence: Synthetic polypeptide
AEEEICTTNPVATEQYGVVATENVEQNEEED

SEQ ID NO: 105091 - protein, 35 aa, Artificial Sequence
  Description of Artificial Sequence: Synthetic polypeptide
DEVEICTTNPVATECYGSVSTGNNLGGTAGENDRN

SEQ ID NO: 105092 - protein, 33 aa, Artificial Sequence
  Description of Artificial Sequence: Synthetic polypeptide
TEEEIRTTNPVAYEQYGITTPSTAEHSQRGGNM

SEQ ID NO: 105093 - protein, 35 aa, Artificial Sequence
  Description of Artificial Sequence: Synthetic polypeptide
AEENIRTTNPVATEQYGSVSTVNNQLNQLQQGTTE

SEQ ID NO: 105094 - protein, 34 aa, Artificial Sequence
  Description of Artificial Sequence: Synthetic polypeptide
TEEEIRTTNPVAYEAYGSVVSNTAMGQRGGNNLD

SEQ ID NO: 105095 - protein, 34 aa, Artificial Sequence
  Description of Artificial Sequence: Synthetic polypeptide
DEEVIRTTNPVATEQYGCVCSTEPLNDNFGSNQS

SEQ ID NO: 105096 - protein, 34 aa, Artificial Sequence
  Description of Artificial Sequence: Synthetic polypeptide
DEEVIRTTNPVATEQYGCVCSTEHNDNFGSNNQS

SEQ ID NO: 105097 - protein, 34 aa, Artificial Sequence
  Description of Artificial Sequence: Synthetic polypeptide
DEEVIRTTNPVATEQYGCVCSTEDLNDNFGSNQS

SEQ ID NO: 105098 - protein, 32 aa, Artificial Sequence
  Description of Artificial Sequence: Synthetic polypeptide
TEGEIRTTNPVAYEQYGCVSVGNQQKTVGLRP

SEQ ID NO: 105099 - protein, 35 aa, Artificial Sequence
  Description of Artificial Sequence: Synthetic polypeptide
DDEEIRTTNPVATEQYGSVVSGVTEDQGTGNGNGD

SEQ ID NO: 105100 - protein, 36 aa, Artificial Sequence
  Description of Artificial Sequence: Synthetic polypeptide
DEETIRTTNPVATEQYGTVSVVVSTNNNQLQQGDED

SEQ ID NO: 105101 - protein, 32 aa, Artificial Sequence
  Description of Artificial Sequence: Synthetic polypeptide
TEGEIRTTNPVAYEQYGCVSVGNQQMTVGNGC

SEQ ID NO: 105102 - protein, 35 aa, Artificial Sequence
  Description of Artificial Sequence: Synthetic polypeptide
DEETIRTTNPVATEQYGTVSVVVSNNNLQQGDEEN

SEQ ID NO: 105103 - protein, 33 aa, Artificial Sequence
  Description of Artificial Sequence: Synthetic polypeptide
TEGEIRTTNPVAYERYGAVVSCEALSQRVGNRD

SEQ ID NO: 105104 - protein, 32 aa, Artificial Sequence
  Description of Artificial Sequence: Synthetic polypeptide
TEGPIRTTNPVAYEQYGSVSVGNQQKTVGNEC

SEQ ID NO: 105105 - protein, 37 aa, Artificial Sequence
  Description of Artificial Sequence: Synthetic polypeptide
DEETIRTTNPVATEQYGTVSTVVSTNNNNLQQGDEQR

SEQ ID NO: 105106 - protein, 36 aa, Artificial Sequence
  Description of Artificial Sequence: Synthetic polypeptide
DEETIRTTNPVATEQYGTVSTVVNQNQLQQGNEEEE

SEQ ID NO: 105107 - protein, 36 aa, Artificial Sequence
  Description of Artificial Sequence: Synthetic polypeptide
DEETIRTTNPVATEQYGTVSTVSNTNNLQQGDEEED

SEQ ID NO: 105108 - protein, 33 aa, Artificial Sequence
  Description of Artificial Sequence: Synthetic polypeptide
TEGEIRTTNPVAYEQYGCVSVGNQQAKTVGNRT

SEQ ID NO: 105109 - protein, 33 aa, Artificial Sequence
  Description of Artificial Sequence: Synthetic polypeptide
TEHEICTTNPVATERYGISTVSTNELSQEEGST

SEQ ID NO: 105110 - protein, 36 aa, Artificial Sequence
  Description of Artificial Sequence: Synthetic polypeptide
DEETIRTTNPVATEQYGSVSTVVNTQSGNNQQDEED

SEQ ID NO: 105111 - protein, 37 aa, Artificial Sequence
  Description of Artificial Sequence: Synthetic polypeptide
DEETIRTTNPVATEQYGSVSTVVNNLQSGNNEQNEQD

SEQ ID NO: 105112 - protein, 28 aa, Artificial Sequence
  Description of Artificial Sequence: Synthetic peptide
AEEEIATTNPVATEQYGAATEVGQTEET

SEQ ID NO: 105113 - protein, 37 aa, Artificial Sequence
  Description of Artificial Sequence: Synthetic polypeptide
DEETIRTTNPVATEQYGSVSTVTNNLQSGNNQNDEDE

SEQ ID NO: 105114 - protein, 35 aa, Artificial Sequence
  Description of Artificial Sequence: Synthetic polypeptide
EEEEIRTTNPVATEQYGSVATTAQLQQGNNNEQGN

SEQ ID NO: 105115 - protein, 36 aa, Artificial Sequence
  Description of Artificial Sequence: Synthetic polypeptide
DEETIRTTNPVATEQYGSVSTVSSNNQLQQGDEEEE

SEQ ID NO: 105116 - protein, 36 aa, Artificial Sequence
  Description of Artificial Sequence: Synthetic polypeptide
DEETIRTTNPVATEQYGSVSTVSNLQQLQQGTEEEE

SEQ ID NO: 105117 - protein, 36 aa, Artificial Sequence
  Description of Artificial Sequence: Synthetic polypeptide
DEETIRTTNPVATEQYGSVSTVNTNQSGNNEQNEQD

SEQ ID NO: 105118 - protein, 35 aa, Artificial Sequence
  Description of Artificial Sequence: Synthetic polypeptide
DEETIRTTNPVATEQYGSVSTVNNNNDNLGQNSED

SEQ ID NO: 105119 - protein, 31 aa, Artificial Sequence
  Description of Artificial Sequence: Synthetic polypeptide
TENEIACTNPVATEQYGEASCENALQRGGGE

SEQ ID NO: 105120 - protein, 34 aa, Artificial Sequence
  Description of Artificial Sequence: Synthetic polypeptide
TEHEIRTTNPVATDQYGSVPVCTQELSQRTGGND

SEQ ID NO: 105121 - protein, 33 aa, Artificial Sequence
  Description of Artificial Sequence: Synthetic polypeptide
TEGEIRTTNPVAYEQYGCVQSIGNQQKTVGNRC

SEQ ID NO: 105122 - protein, 36 aa, Artificial Sequence
  Description of Artificial Sequence: Synthetic polypeptide
DEETIRTTNPVATEQYGTVVTVVSTNLEQIGTNMEE

SEQ ID NO: 105123 - protein, 33 aa, Artificial Sequence
  Description of Artificial Sequence: Synthetic polypeptide
TEGEIRTTNPVATEQYGEVAYCNELSQRATVNQ

SEQ ID NO: 105124 - protein, 30 aa, Artificial Sequence
  Description of Artificial Sequence: Synthetic polypeptide
TEEVIACTNPVATEQYGCVATNLAMNPNEH

SEQ ID NO: 105125 - protein, 34 aa, Artificial Sequence
  Description of Artificial Sequence: Synthetic polypeptide
EEEEIRTTNPVATEQYGSVATTQAQLQGNNDEQM

SEQ ID NO: 105126 - protein, 34 aa, Artificial Sequence
  Description of Artificial Sequence: Synthetic polypeptide
EEEEIRTTNPVATEQYGSVATTQAQLQANNDEEE

SEQ ID NO: 105127 - protein, 33 aa, Artificial Sequence
  Description of Artificial Sequence: Synthetic polypeptide
DEVEIRTTNPVATECYGSVSTGNPNPQDEHDGA

SEQ ID NO: 105128 - protein, 32 aa, Artificial Sequence
  Description of Artificial Sequence: Synthetic polypeptide
TEFEICTVNPVAYEQYGSVSCTNELSTEGTNH

SEQ ID NO: 105129 - protein, 28 aa, Artificial Sequence
  Description of Artificial Sequence: Synthetic peptide
TEGEIAPTNPCSSEMYGIVSCNLQSGTR

SEQ ID NO: 105130 - protein, 29 aa, Artificial Sequence
  Description of Artificial Sequence: Synthetic peptide
TEGEIAPTNPCSSEQYGCVSCNLQSGDTR

SEQ ID NO: 105131 - protein, 35 aa, Artificial Sequence
  Description of Artificial Sequence: Synthetic polypeptide
EEEEIRTTNPVATEQYGSVATTNANLQQNTNDEGE

SEQ ID NO: 105132 - protein, 29 aa, Artificial Sequence
  Description of Artificial Sequence: Synthetic peptide
TEGEIAPTNPCSSEQYGCVSCNLQSGGTR

SEQ ID NO: 105133 - protein, 31 aa, Artificial Sequence
  Description of Artificial Sequence: Synthetic polypeptide
AENEIACTNPVAYEQYGEISENELSQRGGSR

SEQ ID NO: 105134 - protein, 30 aa, Artificial Sequence
  Description of Artificial Sequence: Synthetic polypeptide
AENEIACTNPVAYEQYGEISCENLQRGGGE

SEQ ID NO: 105135 - protein, 36 aa, Artificial Sequence
  Description of Artificial Sequence: Synthetic polypeptide
DEETIRTTNPVATEQYGVVSTTNQNQLQAGGNNQTE

SEQ ID NO: 105136 - protein, 35 aa, Artificial Sequence
  Description of Artificial Sequence: Synthetic polypeptide
EEEEIRTTNPVATEQYGSVATTAQLQYGNNNEQNT

SEQ ID NO: 105137 - protein, 30 aa, Artificial Sequence
  Description of Artificial Sequence: Synthetic polypeptide
TEGEIAPTNPCSYEQYGCVSCNELQSGTNR

SEQ ID NO: 105138 - protein, 29 aa, Artificial Sequence
  Description of Artificial Sequence: Synthetic peptide
TEGEIAPTNPCSYEQYGETVSCNLQSGTR

SEQ ID NO: 105139 - protein, 28 aa, Artificial Sequence
  Description of Artificial Sequence: Synthetic peptide
TEGEIAPTNPCSYEQYGIVSCNLDSGTR

SEQ ID NO: 105140 - protein, 30 aa, Artificial Sequence
  Description of Artificial Sequence: Synthetic polypeptide
TEGEIASVNPVCTEQYGVVSDNLSQSTGNQ

SEQ ID NO: 105141 - protein, 32 aa, Artificial Sequence
  Description of Artificial Sequence: Synthetic polypeptide
TEGEIATTNPVAYEDYGSTVSTSAHSQRGGND

SEQ ID NO: 105142 - protein, 36 aa, Artificial Sequence
  Description of Artificial Sequence: Synthetic polypeptide
DEETIRTTNPVATEQYGTVVTVVSVTNLQQIGTNEE

SEQ ID NO: 105143 - protein, 32 aa, Artificial Sequence
  Description of Artificial Sequence: Synthetic polypeptide
TEGEIATTNPVAYEGYGSTVSTPAEDQRGGND

SEQ ID NO: 105144 - protein, 36 aa, Artificial Sequence
  Description of Artificial Sequence: Synthetic polypeptide
DEETIRTTNPVATEQYGTVVTVVSTTNLTQQIGTNE

SEQ ID NO: 105145 - protein, 34 aa, Artificial Sequence
  Description of Artificial Sequence: Synthetic polypeptide
TEGEIRTTNPVATEPYGESVVSVNQSQKTDGNRC

SEQ ID NO: 105146 - protein, 36 aa, Artificial Sequence
  Description of Artificial Sequence: Synthetic polypeptide
DEETIRTTNPVATEQYGTVVTVVSTNLQQIGTNDEQ

SEQ ID NO: 105147 - protein, 32 aa, Artificial Sequence
  Description of Artificial Sequence: Synthetic polypeptide
TENEIACTNPVATEQYGEASEGNALSQRGGGR

SEQ ID NO: 105148 - protein, 36 aa, Artificial Sequence
  Description of Artificial Sequence: Synthetic polypeptide
DEETIRTTNPVATEQYGVVSTTNQQNQLQSGNNEEG

SEQ ID NO: 105149 - protein, 31 aa, Artificial Sequence
  Description of Artificial Sequence: Synthetic polypeptide
TENEIACTNPVATEQYGEASENELSQRGGGQ

SEQ ID NO: 105150 - protein, 28 aa, Artificial Sequence
  Description of Artificial Sequence: Synthetic peptide
AEGEIAPTNPCSSEQYGIVSCNLQSGTL

SEQ ID NO: 105151 - protein, 29 aa, Artificial Sequence
  Description of Artificial Sequence: Synthetic peptide
TENEIATTNPVATECYGVVSECLQHTEEL

SEQ ID NO: 105152 - protein, 33 aa, Artificial Sequence
  Description of Artificial Sequence: Synthetic polypeptide
EEEEIRTTNPVATEQYGCVCSTGEHQNFGSDQV

SEQ ID NO: 105153 - protein, 36 aa, Artificial Sequence
  Description of Artificial Sequence: Synthetic polypeptide
DEETIRTTNPVATEQYGSVSTTNNLNGNNLGQNTES

SEQ ID NO: 105154 - protein, 31 aa, Artificial Sequence
  Description of Artificial Sequence: Synthetic polypeptide
AENEIACTNPVAYEQYGEASCENLSQRVGSR

SEQ ID NO: 105155 - protein, 36 aa, Artificial Sequence
  Description of Artificial Sequence: Synthetic polypeptide
DEETIRTTNPVATEQYGSVSTTNNLNDNNLGNNTEE

SEQ ID NO: 105156 - protein, 28 aa, Artificial Sequence
  Description of Artificial Sequence: Synthetic peptide
TENEIATTNPVATEPWGDVSECLQHEEQ

SEQ ID NO: 105157 - protein, 34 aa, Artificial Sequence
  Description of Artificial Sequence: Synthetic polypeptide
DDEEIRTTNPVATEQYGTVSTDNGGQGNEEEGEI

SEQ ID NO: 105158 - protein, 34 aa, Artificial Sequence
  Description of Artificial Sequence: Synthetic polypeptide
DDEEIRTTNPVATEQYGTVSTTLNGQGLGEQGFE

SEQ ID NO: 105159 - protein, 36 aa, Artificial Sequence
  Description of Artificial Sequence: Synthetic polypeptide
DEETIRTTNPVATEQYGSVSTTNLLQGNNNQQNEQD

SEQ ID NO: 105160 - protein, 33 aa, Artificial Sequence
  Description of Artificial Sequence: Synthetic polypeptide
DDEEIRTTNPVATEQYGVVDGTNGQGGGETTQA

SEQ ID NO: 105161 - protein, 36 aa, Artificial Sequence
  Description of Artificial Sequence: Synthetic polypeptide
DEETIRTTNPVATEQYGSVSTTNNLQDTNNQQNEQD

SEQ ID NO: 105162 - protein, 34 aa, Artificial Sequence
  Description of Artificial Sequence: Synthetic polypeptide
DDEEIRTTNPVATEQYGVVGNDDQTNGQGGGNGT

SEQ ID NO: 105163 - protein, 35 aa, Artificial Sequence
  Description of Artificial Sequence: Synthetic polypeptide
EEEEIRTTNPVATEAYGVVSTTVNLGQQNGNDTDE

SEQ ID NO: 105164 - protein, 32 aa, Artificial Sequence
  Description of Artificial Sequence: Synthetic polypeptide
DDEEIRTTNPVATEQYGVVNTDTGMGNQGNNI

SEQ ID NO: 105165 - protein, 35 aa, Artificial Sequence
  Description of Artificial Sequence: Synthetic polypeptide
DDEEIRTTNPVATEQYGVVSTGNVDQTGEGGNDGE

SEQ ID NO: 105166 - protein, 31 aa, Artificial Sequence
  Description of Artificial Sequence: Synthetic polypeptide
TEPEICTTNPVATKQYGAVVTTNISAQRGQN

SEQ ID NO: 105167 - protein, 34 aa, Artificial Sequence
  Description of Artificial Sequence: Synthetic polypeptide
DDEEIRTTNPVATEQYGVVVGTQNMGQGEGGGNT

SEQ ID NO: 105168 - protein, 29 aa, Artificial Sequence
  Description of Artificial Sequence: Synthetic peptide
TEQEIACTNPCSSEQYGIVSCNLQSGDTR

SEQ ID NO: 105169 - protein, 34 aa, Artificial Sequence
  Description of Artificial Sequence: Synthetic polypeptide
DDEEIRTTNPVATESYGCVNVNSTLQLQRGSTTT

SEQ ID NO: 105170 - protein, 32 aa, Artificial Sequence
  Description of Artificial Sequence: Synthetic polypeptide
TEQEIATTNPVAFEQYGSVSATDLERHEGEDL

SEQ ID NO: 105171 - protein, 28 aa, Artificial Sequence
  Description of Artificial Sequence: Synthetic peptide
TEQEIATTNPVATECWGDVSECLQHESL

SEQ ID NO: 105172 - protein, 32 aa, Artificial Sequence
  Description of Artificial Sequence: Synthetic polypeptide
TEQEIATTNPVATEQYGSVSATDLEDHEGEDA

SEQ ID NO: 105173 - protein, 29 aa, Artificial Sequence
  Description of Artificial Sequence: Synthetic peptide
TENEIATTNPVATEYYGCVSWELQHESEL

SEQ ID NO: 105174 - protein, 30 aa, Artificial Sequence
  Description of Artificial Sequence: Synthetic polypeptide
TENEIATTNPVATECYGVVSCECLQHEENL

SEQ ID NO: 105175 - protein, 30 aa, Artificial Sequence
  Description of Artificial Sequence: Synthetic polypeptide
TENEIATTNPVATECYGTVSEPLSQHEGEL

SEQ ID NO: 105176 - protein, 29 aa, Artificial Sequence
  Description of Artificial Sequence: Synthetic peptide
TENEIATTNPVATECYGQVSECSLQHEEL

SEQ ID NO: 105177 - protein, 30 aa, Artificial Sequence
  Description of Artificial Sequence: Synthetic polypeptide
TENEIACTNPVAYEAYGEISENLSQREGGR

SEQ ID NO: 105178 - protein, 37 aa, Artificial Sequence
  Description of Artificial Sequence: Synthetic polypeptide
DEETIRTTNPVATEQYGSVSTTVNNLQAGNNQQDEQD

SEQ ID NO: 105179 - protein, 37 aa, Artificial Sequence
  Description of Artificial Sequence: Synthetic polypeptide
DEETIRTTNPVATEQYGSVSTTTNLLQAGNNQEDEND

SEQ ID NO: 105180 - protein, 31 aa, Artificial Sequence
  Description of Artificial Sequence: Synthetic polypeptide
TENEIACTNPVAYEQYGEASCENLQRTVGGR

SEQ ID NO: 105181 - protein, 35 aa, Artificial Sequence
  Description of Artificial Sequence: Synthetic polypeptide
DEETIRTTNPVATEQYGSVSTTQQEQLNGGNNQTD

SEQ ID NO: 105182 - protein, 36 aa, Artificial Sequence
  Description of Artificial Sequence: Synthetic polypeptide
DEETIRTTNPVATEQYGSVSTTNQQQLGGNGNNQTE

SEQ ID NO: 105183 - protein, 36 aa, Artificial Sequence
  Description of Artificial Sequence: Synthetic polypeptide
DEETIRTTNPVATEQYGSVSTTNQQQLGGNGGNDTD

SEQ ID NO: 105184 - protein, 36 aa, Artificial Sequence
  Description of Artificial Sequence: Synthetic polypeptide
DEETIRTTNPVATEQYGSVSTTNQQNLNGNGNNDTD

SEQ ID NO: 105185 - protein, 30 aa, Artificial Sequence
  Description of Artificial Sequence: Synthetic polypeptide
TENEIACTNPVAYEQYGEISENLSQRGGGE

SEQ ID NO: 105186 - protein, 32 aa, Artificial Sequence
  Description of Artificial Sequence: Synthetic polypeptide
TENEIACTNPVAYEQYGETAPSENLQRGGGNR

SEQ ID NO: 105187 - protein, 31 aa, Artificial Sequence
  Description of Artificial Sequence: Synthetic polypeptide
TENEIACTNPVAYEQYGKASENSLSQRGGGR

SEQ ID NO: 105188 - protein, 31 aa, Artificial Sequence
  Description of Artificial Sequence: Synthetic polypeptide
TENEIACTNPVAYEQYGYISENELSQRVGGR

SEQ ID NO: 105189 - protein, 33 aa, Artificial Sequence
  Description of Artificial Sequence: Synthetic polypeptide
EEEEIRTTNPVATEQYGSVANTDGEQENGGGFE

SEQ ID NO: 105190 - protein, 28 aa, Artificial Sequence
  Description of Artificial Sequence: Synthetic peptide
TENEIATTNPIATECYGDVSECLQHEEL

SEQ ID NO: 105191 - protein, 34 aa, Artificial Sequence
  Description of Artificial Sequence: Synthetic polypeptide
DDEEIRTTNPVATEQYGSVYTDTGDQQGGNGGNQ

SEQ ID NO: 105192 - protein, 32 aa, Artificial Sequence
  Description of Artificial Sequence: Synthetic polypeptide
DEVEIRTTNPVATEFYGSVGDNDNGQGGGGET

SEQ ID NO: 105193 - protein, 29 aa, Artificial Sequence
  Description of Artificial Sequence: Synthetic peptide
TENEIATTNPVATECYGDVSEACLQLEEL

SEQ ID NO: 105194 - protein, 36 aa, Artificial Sequence
  Description of Artificial Sequence: Synthetic polypeptide
DEETIRTTNPVATEQYGSVSTTNNQLQGNNQQNEQD

SEQ ID NO: 105195 - protein, 37 aa, Artificial Sequence
  Description of Artificial Sequence: Synthetic polypeptide
DEETIRTTNPVATEQYGSVSTTNNNLQEGNNQQNEQD

SEQ ID NO: 105196 - protein, 36 aa, Artificial Sequence
  Description of Artificial Sequence: Synthetic polypeptide
DEETIRTTNPVATEQYGSVSTTNNNLNDNLGGNTEN

SEQ ID NO: 105197 - protein, 34 aa, Artificial Sequence
  Description of Artificial Sequence: Synthetic polypeptide
DEVEIRTTNPVATEFYGSVSSTNGDEEEGGNQGG

SEQ ID NO: 105198 - protein, 28 aa, Artificial Sequence
  Description of Artificial Sequence: Synthetic peptide
AEGSIAPTNPCSSEQYGIVSCNLQSGTR

SEQ ID NO: 105199 - protein, 29 aa, Artificial Sequence
  Description of Artificial Sequence: Synthetic peptide
TENEIATTNPVATECYGDVSWELQHNSEL

SEQ ID NO: 105200 - protein, 33 aa, Artificial Sequence
  Description of Artificial Sequence: Synthetic polypeptide
AEEEIATTNPVATEPYGEVVSTTNEQDGGMDRN

SEQ ID NO: 105201 - protein, 33 aa, Artificial Sequence
  Description of Artificial Sequence: Synthetic polypeptide
DDEEIRTTNPVATEQYGCVCSTWEHQNFNSDQN

SEQ ID NO: 105202 - protein, 36 aa, Artificial Sequence
  Description of Artificial Sequence: Synthetic polypeptide
DEETIRTTNPVATEQYGVVSTTNQQQLQAGNGNQTE

SEQ ID NO: 105203 - protein, 35 aa, Artificial Sequence
  Description of Artificial Sequence: Synthetic polypeptide
EEEEIRTTNPVATEQYGSVATTQQLQQGNNNQQDT

SEQ ID NO: 105204 - protein, 33 aa, Artificial Sequence
  Description of Artificial Sequence: Synthetic polypeptide
TEEGICTTNPVAYERYGISTVSTNELSQERGET

SEQ ID NO: 105205 - protein, 35 aa, Artificial Sequence
  Description of Artificial Sequence: Synthetic polypeptide
EEEEIRTTNPVATEQYGSVSETNQHEHRITNEEVL

SEQ ID NO: 105206 - protein, 31 aa, Artificial Sequence
  Description of Artificial Sequence: Synthetic polypeptide
TEEGIRTTNPCATEQYGSVPSVPQPLTVVNQ

SEQ ID NO: 105207 - protein, 32 aa, Artificial Sequence
  Description of Artificial Sequence: Synthetic polypeptide
DEEVICCTNPTATAQYGSVATNLQHRDQEGRM

SEQ ID NO: 105208 - protein, 30 aa, Artificial Sequence
  Description of Artificial Sequence: Synthetic polypeptide
AEEEIATTNPVATEQYGQVATEVGQENEET

SEQ ID NO: 105209 - protein, 35 aa, Artificial Sequence
  Description of Artificial Sequence: Synthetic polypeptide
EEEEIRTTNPVATEQYGSVSETGVSLDQAIIMERD

SEQ ID NO: 105210 - protein, 35 aa, Artificial Sequence
  Description of Artificial Sequence: Synthetic polypeptide
TEEGIRTTNPVATEQYGSVPSYTPNELSSTMSGNI

SEQ ID NO: 105211 - protein, 28 aa, Artificial Sequence
  Description of Artificial Sequence: Synthetic peptide
AEEEIATTNPVATEQYGEYPWVDQHEEV

SEQ ID NO: 105212 - protein, 34 aa, Artificial Sequence
  Description of Artificial Sequence: Synthetic polypeptide
DDEEIRTTNPVATEQYGSVSVGVNGDEGGETNID

SEQ ID NO: 105213 - protein, 33 aa, Artificial Sequence
  Description of Artificial Sequence: Synthetic polypeptide
EEEEIRTTNPVATEQYGSVSEPPVESPLETNNE

SEQ ID NO: 105214 - protein, 33 aa, Artificial Sequence
  Description of Artificial Sequence: Synthetic polypeptide
AEEEIATTNPVATEQYGSASSTTPAGNMRGGPR

SEQ ID NO: 105215 - protein, 36 aa, Artificial Sequence
  Description of Artificial Sequence: Synthetic polypeptide
AEEEIATTNPVATEQYGEVSSTTPNGPQMRNGMNPR

SEQ ID NO: 105216 - protein, 33 aa, Artificial Sequence
  Description of Artificial Sequence: Synthetic polypeptide
DEEVIATTNPVAYEQWGTVCSTNDLHDQQGQNS

SEQ ID NO: 105217 - protein, 33 aa, Artificial Sequence
  Description of Artificial Sequence: Synthetic polypeptide
DEEVIATTNPVATEQYWGAVSTNGDQGHNNKSS

SEQ ID NO: 105218 - protein, 33 aa, Artificial Sequence
  Description of Artificial Sequence: Synthetic polypeptide
DDEEIRTTNPVATEQYGSVSVTVTQDNFDEDHE

SEQ ID NO: 105219 - protein, 34 aa, Artificial Sequence
  Description of Artificial Sequence: Synthetic polypeptide
DDEEIRTTNPVATEQYGSVTDDGNLEPNTGNVQI

SEQ ID NO: 105220 - protein, 33 aa, Artificial Sequence
  Description of Artificial Sequence: Synthetic polypeptide
EEEEIRTTNPVATEQYGSVQGTAGQNGGGDDET

SEQ ID NO: 105221 - protein, 30 aa, Artificial Sequence
  Description of Artificial Sequence: Synthetic polypeptide
AEEEIATTNPVATEQYGEVATEAGTQEEET

SEQ ID NO: 105222 - protein, 29 aa, Artificial Sequence
  Description of Artificial Sequence: Synthetic peptide
AEEEIATTNPVATEQYGEVANETGQEEED

SEQ ID NO: 105223 - protein, 34 aa, Artificial Sequence
  Description of Artificial Sequence: Synthetic polypeptide
DDEEIRTTNPVATEQYGSVTDTGDEQEGGNGGNI

SEQ ID NO: 105224 - protein, 28 aa, Artificial Sequence
  Description of Artificial Sequence: Synthetic peptide
AEEEIATTNPVATEQYGETVEVQQHEEV

SEQ ID NO: 105225 - protein, 28 aa, Artificial Sequence
  Description of Artificial Sequence: Synthetic peptide
AEEEIATTNPVATEQYGETPEVGQEEET

SEQ ID NO: 105226 - protein, 35 aa, Artificial Sequence
  Description of Artificial Sequence: Synthetic polypeptide
DDEEIRTTNPVATEQYGSVSVTDEGNDEQGQGGEI

SEQ ID NO: 105227 - protein, 33 aa, Artificial Sequence
  Description of Artificial Sequence: Synthetic polypeptide
TEEGICTTNPVAYEQYGSVPSCMTMSQRGGNNK

SEQ ID NO: 105228 - protein, 33 aa, Artificial Sequence
  Description of Artificial Sequence: Synthetic polypeptide
TEEGICTTNPVATEQYGSVWSTLTLSPELQNRM

SEQ ID NO: 105229 - protein, 36 aa, Artificial Sequence
  Description of Artificial Sequence: Synthetic polypeptide
DDEEIRTTNPVATEQYGSVSTTAMNEDGQGEEGENG

SEQ ID NO: 105230 - protein, 34 aa, Artificial Sequence
  Description of Artificial Sequence: Synthetic polypeptide
DEEVIRTTNPVATEQYGCVCSNTNPNDNFGSNQS

SEQ ID NO: 105231 - protein, 34 aa, Artificial Sequence
  Description of Artificial Sequence: Synthetic polypeptide
DDEEIRTTNPVATEQYGSVSTMDGTNEFTGEGED

SEQ ID NO: 105232 - protein, 36 aa, Artificial Sequence
  Description of Artificial Sequence: Synthetic polypeptide
DEEVIRTTNPVATEQYGCSVISTNAHSDNTGQNNRE

SEQ ID NO: 105233 - protein, 34 aa, Artificial Sequence
  Description of Artificial Sequence: Synthetic polypeptide
DDEEIRTTNPVATEQYGSVSTMDIEGEGGNEEQT

SEQ ID NO: 105234 - protein, 34 aa, Artificial Sequence
  Description of Artificial Sequence: Synthetic polypeptide
DDEEIRTTNPVATEQYGSVSTMDIEGNGGENEEQ

SEQ ID NO: 105235 - protein, 34 aa, Artificial Sequence
  Description of Artificial Sequence: Synthetic polypeptide
DEVEIRTTNPVATEAYGSVSTVGGDQGGQENEQG

SEQ ID NO: 105236 - protein, 35 aa, Artificial Sequence
  Description of Artificial Sequence: Synthetic polypeptide
DDEEIRTTNPVATEQYGSVSTMDIEQGQGGGNEEQ

SEQ ID NO: 105237 - protein, 35 aa, Artificial Sequence
  Description of Artificial Sequence: Synthetic polypeptide
DDEEIRTTNPVATEQYGSVSTMDIGNGQGGEEGGG

SEQ ID NO: 105238 - protein, 33 aa, Artificial Sequence
  Description of Artificial Sequence: Synthetic polypeptide
DEVEIRTTNPVATECWGEVSCINEPQDREGENG

SEQ ID NO: 105239 - protein, 33 aa, Artificial Sequence
  Description of Artificial Sequence: Synthetic polypeptide
DEVEIRTTNPVATECWGSVNCINEPQDREGENG

SEQ ID NO: 105240 - protein, 35 aa, Artificial Sequence
  Description of Artificial Sequence: Synthetic polypeptide
DDEEIRTTNPVATEQYGSVSTMDIQNGGGGEEENG

SEQ ID NO: 105241 - protein, 33 aa, Artificial Sequence
  Description of Artificial Sequence: Synthetic polypeptide
DEEVIRTTNPVATECYGKHSMTWNELQPPSNEF

SEQ ID NO: 105242 - protein, 35 aa, Artificial Sequence
  Description of Artificial Sequence: Synthetic polypeptide
DEEVIRTTNPVATEAYGSVVSTNNAHSDNTGQNNR

SEQ ID NO: 105243 - protein, 33 aa, Artificial Sequence
  Description of Artificial Sequence: Synthetic polypeptide
TEEGICTTNPVATEQYGSVSTLNDLGPELQNMN

SEQ ID NO: 105244 - protein, 34 aa, Artificial Sequence
  Description of Artificial Sequence: Synthetic polypeptide
DEEVIRSTNPVATEQYGKVVSTNAHSDNTGQNNR

SEQ ID NO: 105245 - protein, 31 aa, Artificial Sequence
  Description of Artificial Sequence: Synthetic polypeptide
DEEVIRMTNPVATEQYGAVSTEMEFGSGKSD

SEQ ID NO: 105246 - protein, 34 aa, Artificial Sequence
  Description of Artificial Sequence: Synthetic polypeptide
DDEEIRTTNPVATEQYGSVSTMGDEGQGGGEEQE

SEQ ID NO: 105247 - protein, 34 aa, Artificial Sequence
  Description of Artificial Sequence: Synthetic polypeptide
DDEEIRTTNPVATEQYGSVSTMGIEEGQGGGEEQ

SEQ ID NO: 105248 - protein, 32 aa, Artificial Sequence
  Description of Artificial Sequence: Synthetic polypeptide
TEEGICTTNPVATEQYGSVSTLTLSPEYLQSR

SEQ ID NO: 105249 - protein, 33 aa, Artificial Sequence
  Description of Artificial Sequence: Synthetic polypeptide
TEEGICTTNPVATEQYGSVSTLTYLSPELQNRF

SEQ ID NO: 105250 - protein, 34 aa, Artificial Sequence
  Description of Artificial Sequence: Synthetic polypeptide
DEEVIQTTNPVATEIYGISVSTNNLDDAGHGQIR

SEQ ID NO: 105251 - protein, 34 aa, Artificial Sequence
  Description of Artificial Sequence: Synthetic polypeptide
DEEVIQTTNPVATEIYGISVSTNLEDGGHGQIMR

SEQ ID NO: 105252 - protein, 34 aa, Artificial Sequence
  Description of Artificial Sequence: Synthetic polypeptide
DEEVINTTNPVATEWYGYSVSATDNSEPQHRGEF

SEQ ID NO: 105253 - protein, 29 aa, Artificial Sequence
  Description of Artificial Sequence: Synthetic peptide
AEEEIATTNPVATEQYGESCPWADQHSEQ

SEQ ID NO: 105254 - protein, 36 aa, Artificial Sequence
  Description of Artificial Sequence: Synthetic polypeptide
DEETIRTTNPVATEQYGVVSTTNQQQLQAGNNDQEE

SEQ ID NO: 105255 - protein, 28 aa, Artificial Sequence
  Description of Artificial Sequence: Synthetic peptide
AEEEIATTNPVATEQYGEAVEVCQHEEK

SEQ ID NO: 105256 - protein, 28 aa, Artificial Sequence
  Description of Artificial Sequence: Synthetic peptide
AEEEIATTNPVATEQYGEATETGQEEEM

SEQ ID NO: 105257 - protein, 32 aa, Artificial Sequence
  Description of Artificial Sequence: Synthetic polypeptide
TEESIATTNPVATEQYGSVSWNEGIDRQMGTS

SEQ ID NO: 105258 - protein, 36 aa, Artificial Sequence
  Description of Artificial Sequence: Synthetic polypeptide
DEETIRTTNPVATEQYGVVSTVVSNNQLQQIGNNVT

SEQ ID NO: 105259 - protein, 36 aa, Artificial Sequence
  Description of Artificial Sequence: Synthetic polypeptide
DEETIRTTNPVATEQYGVVSTVVSNNNLQQIGDNVE

SEQ ID NO: 105260 - protein, 34 aa, Artificial Sequence
  Description of Artificial Sequence: Synthetic polypeptide
TEESIATTNPVATEQYGSVSWNEGQDRQRGLGNH

SEQ ID NO: 105261 - protein, 31 aa, Artificial Sequence
  Description of Artificial Sequence: Synthetic polypeptide
TEETIRTTNPCATEQYGSVPSVPPLLSVVNQ

SEQ ID NO: 105262 - protein, 31 aa, Artificial Sequence
  Description of Artificial Sequence: Synthetic polypeptide
TEEVIACTNPVATEQYGCVAATNLAMNPNMR

SEQ ID NO: 105263 - protein, 36 aa, Artificial Sequence
  Description of Artificial Sequence: Synthetic polypeptide
DEETIRTTNPVATEQYGVVSTVNTLQSGNNQTDEED

SEQ ID NO: 105264 - protein, 36 aa, Artificial Sequence
  Description of Artificial Sequence: Synthetic polypeptide
DEETIRTTNPVATEQYGVVSTVNQQQLQQGNNQQEE

SEQ ID NO: 105265 - protein, 36 aa, Artificial Sequence
  Description of Artificial Sequence: Synthetic polypeptide
DEETIRTTNPVATEQYGVVSTVNQQQLQQGNNNDDE

SEQ ID NO: 105266 - protein, 36 aa, Artificial Sequence
  Description of Artificial Sequence: Synthetic polypeptide
DEETIRTTNPVATEQYGVVSTVNQQQLQAGNNQTNE

SEQ ID NO: 105267 - protein, 32 aa, Artificial Sequence
  Description of Artificial Sequence: Synthetic polypeptide
AEEEIATTNPVATEQYGCVCSVTEHQGGSDQM

SEQ ID NO: 105268 - protein, 36 aa, Artificial Sequence
  Description of Artificial Sequence: Synthetic polypeptide
DEETIRTTNPVATEQYGVVSTVNQQLQQGTNNEEED

SEQ ID NO: 105269 - protein, 35 aa, Artificial Sequence
  Description of Artificial Sequence: Synthetic polypeptide
EEEEIRTTNPVATEQYGSVATTQQLQQNNNNEQRE

SEQ ID NO: 105270 - protein, 36 aa, Artificial Sequence
  Description of Artificial Sequence: Synthetic polypeptide
DEETIRTTNPVATEQYGVVSTVNNLQSGNQQQDEED

SEQ ID NO: 105271 - protein, 35 aa, Artificial Sequence
  Description of Artificial Sequence: Synthetic polypeptide
DEETIRTTNPVATEQYGVVSTTNQQQQQLGNQEED

SEQ ID NO: 105272 - protein, 36 aa, Artificial Sequence
  Description of Artificial Sequence: Synthetic polypeptide
DEETIRTTNPVATEQYGVVSTTNQQQQLQQGNQEDE

SEQ ID NO: 105273 - protein, 35 aa, Artificial Sequence
  Description of Artificial Sequence: Synthetic polypeptide
DEETIRTTNPVATEQYGVVSTTNQQQQLGGNNEED

SEQ ID NO: 105274 - protein, 36 aa, Artificial Sequence
  Description of Artificial Sequence: Synthetic polypeptide
DEETIRTTNPVATEQYGVVSTTNQQQLQQGTNQEED

SEQ ID NO: 105275 - protein, 36 aa, Artificial Sequence
  Description of Artificial Sequence: Synthetic polypeptide
DEETIRTTNPVATEQYGVVSTTNQQQLQAGNQQQNE

SEQ ID NO: 105276 - protein, 36 aa, Artificial Sequence
  Description of Artificial Sequence: Synthetic polypeptide
DEETIRTTNPVATEQYGVVSTTNQQQLQAGNNQDTE

SEQ ID NO: 105277 - protein, 36 aa, Artificial Sequence
  Description of Artificial Sequence: Synthetic polypeptide
DEETIRTTNPVATEQYGVVSTTNQQQLQAGNNNTTD

SEQ ID NO: 105278 - protein, 36 aa, Artificial Sequence
  Description of Artificial Sequence: Synthetic polypeptide
DEETIRTTNPVATEQYGVVSTTNQQQLQAGNNNQGN

SEQ ID NO: 105279 - protein, 35 aa, Artificial Sequence
  Description of Artificial Sequence: Synthetic polypeptide
EEEEIRTTNPVATEQYGSVATTQQQLQQGNNDEQD

SEQ ID NO: 105280 - protein, 31 aa, Artificial Sequence
  Description of Artificial Sequence: Synthetic polypeptide
TEENIATTNPVAYEQWGSVSKNLEQMTGGES

SEQ ID NO: 105281 - protein, 34 aa, Artificial Sequence
  Description of Artificial Sequence: Synthetic polypeptide
TEENIATTNPVATEQYGSVSWNEGQDRQDQRGND

SEQ ID NO: 105282 - protein, 32 aa, Artificial Sequence
  Description of Artificial Sequence: Synthetic polypeptide
TEENIATTNPVATEQYGSVSWNEGIDRQGGES

SEQ ID NO: 105283 - protein, 35 aa, Artificial Sequence
  Description of Artificial Sequence: Synthetic polypeptide
AEEEIATTNPVATEQYGEASSTTPNGPQMRNGMNR

SEQ ID NO: 105284 - protein, 28 aa, Artificial Sequence
  Description of Artificial Sequence: Synthetic peptide
AEEEIATTNPVATEQYGEAPWADQHIEQ

SEQ ID NO: 105285 - protein, 28 aa, Artificial Sequence
  Description of Artificial Sequence: Synthetic peptide
AEEEIATTNPVATEQYGEAPEVNQEEEI

SEQ ID NO: 105286 - protein, 28 aa, Artificial Sequence
  Description of Artificial Sequence: Synthetic peptide
AEEEIATTNPVATEQYGEAPEVMQHEEK

SEQ ID NO: 105287 - protein, 34 aa, Artificial Sequence
  Description of Artificial Sequence: Synthetic polypeptide
DDEEIRTTNPVATEQYGSVTSMWNVIERFGEGQQ

SEQ ID NO: 105288 - protein, 28 aa, Artificial Sequence
  Description of Artificial Sequence: Synthetic peptide
AEEEIATTNPVATEQYGEAPEVCQHEEK

SEQ ID NO: 105289 - protein, 32 aa, Artificial Sequence
  Description of Artificial Sequence: Synthetic polypeptide
EEEEIRTTNPVATEQYGSVLPTPQINGELSVL

SEQ ID NO: 105290 - protein, 28 aa, Artificial Sequence
  Description of Artificial Sequence: Synthetic peptide
AEEEIATTNPVATEQYGEAPEEGQEEEA

SEQ ID NO: 105291 - protein, 28 aa, Artificial Sequence
  Description of Artificial Sequence: Synthetic peptide
AEEEIATTNPVATEQYGEAPAVDQHEEQ

SEQ ID NO: 105292 - protein, 28 aa, Artificial Sequence
  Description of Artificial Sequence: Synthetic peptide
AEEEIATTNPVATEQYGEADEVGQGEET

SEQ ID NO: 105293 - protein, 31 aa, Artificial Sequence
  Description of Artificial Sequence: Synthetic polypeptide
DEEVIACTNPVAYEQYGSVATNLQANPSVDD

SEQ ID NO: 105294 - protein, 34 aa, Artificial Sequence
  Description of Artificial Sequence: Synthetic polypeptide
TEEGIRTTNPVATEQYGSVSTSLLASMMQLNQRE

SEQ ID NO: 105295 - protein, 32 aa, Artificial Sequence
  Description of Artificial Sequence: Synthetic polypeptide
DEEVIACTNPVATEQYGSVAITNLPDNEQNTQ

SEQ ID NO: 105296 - protein, 34 aa, Artificial Sequence
  Description of Artificial Sequence: Synthetic polypeptide
DDEEIRTTNPVATEQYGSVTTTGDEQEGGNGNNG

SEQ ID NO: 105297 - protein, 35 aa, Artificial Sequence
  Description of Artificial Sequence: Synthetic polypeptide
EEEEIRTTNPVATEQYGSVILTPNTQLQPGQELED

SEQ ID NO: 105298 - protein, 32 aa, Artificial Sequence
  Description of Artificial Sequence: Synthetic polypeptide
TEEGIRTTNPVAYEQWGKTVSTGNLSMVGSGR

SEQ ID NO: 105299 - protein, 32 aa, Artificial Sequence
  Description of Artificial Sequence: Synthetic polypeptide
TEEGIRTTNPVAYEQYGKTVACLTLLEVGNDR

SEQ ID NO: 105300 - protein, 31 aa, Artificial Sequence
  Description of Artificial Sequence: Synthetic polypeptide
DEEVIACTNPVATEQYGCVATNGLPDNEQNH

SEQ ID NO: 105301 - protein, 34 aa, Artificial Sequence
  Description of Artificial Sequence: Synthetic polypeptide
EEEEIRTTNPVATEQYGSVFMTNLEQNVPLFEQG

SEQ ID NO: 105302 - protein, 34 aa, Artificial Sequence
  Description of Artificial Sequence: Synthetic polypeptide
EEEEIRTTNPVATEQYGSVETMVQPQRPNENPET

SEQ ID NO: 105303 - protein, 33 aa, Artificial Sequence
  Description of Artificial Sequence: Synthetic polypeptide
DEEVEIATTNPVAYEHWGSVATNLQGNDGQNAN

SEQ ID NO: 105304 - protein, 30 aa, Artificial Sequence
  Description of Artificial Sequence: Synthetic polypeptide
AEGEIACTNPVATEQYGCASANLQEAGGQF

SEQ ID NO: 105305 - protein, 32 aa, Artificial Sequence
  Description of Artificial Sequence: Synthetic polypeptide
TEENIATTNPVATEIYGQVATGNMQDRDGSQR

SEQ ID NO: 105306 - protein, 28 aa, Artificial Sequence
  Description of Artificial Sequence: Synthetic peptide
AEEEIATTNPVATEQYGEATEVCQHEEK

SEQ ID NO: 105307 - protein, 32 aa, Artificial Sequence
  Description of Artificial Sequence: Synthetic polypeptide
TEQEIATTNPVATEQYGSVSATDLEDHEGEYL

SEQ ID NO: 105308 - protein, 36 aa, Artificial Sequence
  Description of Artificial Sequence: Synthetic polypeptide
EEEEIRTTNPVATEQYGSVSTTSNNNNQEQGNNQEE

SEQ ID NO: 105309 - protein, 36 aa, Artificial Sequence
  Description of Artificial Sequence: Synthetic polypeptide
EEEEIRTTNPVATEQYGSVSTTSNQNNQQQGTNATE

SEQ ID NO: 105310 - protein, 34 aa, Artificial Sequence
  Description of Artificial Sequence: Synthetic polypeptide
TEEEIRTTNPVATEAYGELIVSTELSDRSGGNNE

SEQ ID NO: 105311 - protein, 35 aa, Artificial Sequence
  Description of Artificial Sequence: Synthetic polypeptide
TEEEIRTTNPVATEAYGIWTVSDNNLSQQKAGGNR

SEQ ID NO: 105312 - protein, 32 aa, Artificial Sequence
  Description of Artificial Sequence: Synthetic polypeptide
DEGEIATTNPVATEQWGSVANAGNLFPNNMGR

SEQ ID NO: 105313 - protein, 32 aa, Artificial Sequence
  Description of Artificial Sequence: Synthetic polypeptide
TEEEIRTTNPVATEAYGKIQTNLSDEDGGLNE

SEQ ID NO: 105314 - protein, 33 aa, Artificial Sequence
  Description of Artificial Sequence: Synthetic polypeptide
DEGEIATTNPVATEQWGSVAMNNLQDQGNNNDE

SEQ ID NO: 105315 - protein, 33 aa, Artificial Sequence
  Description of Artificial Sequence: Synthetic polypeptide
TEEEIRTTNPVATEAYGKISTENLSDEDGGDNE

SEQ ID NO: 105316 - protein, 34 aa, Artificial Sequence
  Description of Artificial Sequence: Synthetic polypeptide
DDEEIRTTNPVATEQWGSVVTSGLRLQREGQTTE

SEQ ID NO: 105317 - protein, 30 aa, Artificial Sequence
  Description of Artificial Sequence: Synthetic polypeptide
AENEIATTNPVATECYGCVCSWELQHIGEL

SEQ ID NO: 105318 - protein, 32 aa, Artificial Sequence
  Description of Artificial Sequence: Synthetic polypeptide
DEGEIATTNPVATEQWGCVATNLDATPGDNEQ

SEQ ID NO: 105319 - protein, 32 aa, Artificial Sequence
  Description of Artificial Sequence: Synthetic polypeptide
EEQEIATTNPVATEQYGSVSATDLEDHEGEDL

SEQ ID NO: 105320 - protein, 34 aa, Artificial Sequence
  Description of Artificial Sequence: Synthetic polypeptide
TEEEIRTTNPVATEAYGEIVSTPWLSDRSGGNNE

SEQ ID NO: 105321 - protein, 32 aa, Artificial Sequence
  Description of Artificial Sequence: Synthetic polypeptide
DEGEIATTNPVATEQWGCVAATNLTDPGENNN

SEQ ID NO: 105322 - protein, 31 aa, Artificial Sequence
  Description of Artificial Sequence: Synthetic polypeptide
DEGEIATTNPVATEPYGVVCANNLATGGNQD

SEQ ID NO: 105323 - protein, 35 aa, Artificial Sequence
  Description of Artificial Sequence: Synthetic polypeptide
DDEEIRTTNPVATEQWGSVVTSNGLRLQREGQGEQ

SEQ ID NO: 105324 - protein, 35 aa, Artificial Sequence
  Description of Artificial Sequence: Synthetic polypeptide
TEEEIRTTNPVATEAYGQSVVATNLPTSRGGNQDY

SEQ ID NO: 105325 - protein, 32 aa, Artificial Sequence
  Description of Artificial Sequence: Synthetic polypeptide
DEGEIATTNPVATEMWGSVATNLQNPDEEGAQ

SEQ ID NO: 105326 - protein, 30 aa, Artificial Sequence
  Description of Artificial Sequence: Synthetic polypeptide
EENEIRTTNPVATWHYGTVSTNLEVVTEMD

SEQ ID NO: 105327 - protein, 31 aa, Artificial Sequence
  Description of Artificial Sequence: Synthetic polypeptide
AENEIATTNPVATECWGSVSCINEQDRGEGG

SEQ ID NO: 105328 - protein, 36 aa, Artificial Sequence
  Description of Artificial Sequence: Synthetic polypeptide
TEEEIRTTNPVATEAYGQSVVGCTNLPQSTGGNQRY

SEQ ID NO: 105329 - protein, 36 aa, Artificial Sequence
  Description of Artificial Sequence: Synthetic polypeptide
TEEEIRTTNPVATEAYGQSVVGTGNLSHSRGGNQRY

SEQ ID NO: 105330 - protein, 28 aa, Artificial Sequence
  Description of Artificial Sequence: Synthetic peptide
DEGEIATTNPVATASWGCIAANDQRDNF

SEQ ID NO: 105331 - protein, 31 aa, Artificial Sequence
  Description of Artificial Sequence: Synthetic polypeptide
EENEIRTTNPVATEGYGSVSNNPLTEVIDTP

SEQ ID NO: 105332 - protein, 31 aa, Artificial Sequence
  Description of Artificial Sequence: Synthetic polypeptide
EENNIRTTNPVATWSYGSVSTNLEEHRTEDQ

SEQ ID NO: 105333 - protein, 32 aa, Artificial Sequence
  Description of Artificial Sequence: Synthetic polypeptide
AENEIATTNPVATECWGSVSCINEPQDRGENG

SEQ ID NO: 105334 - protein, 34 aa, Artificial Sequence
  Description of Artificial Sequence: Synthetic polypeptide
TEEEIRTTNPVATEAYGEIVSTELSDRYGGNNEW

SEQ ID NO: 105335 - protein, 32 aa, Artificial Sequence
  Description of Artificial Sequence: Synthetic polypeptide
TEEEIRTTNPVATEAYGEISTALSDTSGGQNE

SEQ ID NO: 105336 - protein, 32 aa, Artificial Sequence
  Description of Artificial Sequence: Synthetic polypeptide
DEGEIATTNPVATEQYGCVAATNDTDPGEDNN

SEQ ID NO: 105337 - protein, 31 aa, Artificial Sequence
  Description of Artificial Sequence: Synthetic polypeptide
DEGEIATTNPVATEQYGCVAATANGTDSGDD

SEQ ID NO: 105338 - protein, 32 aa, Artificial Sequence
  Description of Artificial Sequence: Synthetic polypeptide
DEGEIATTNPVATEQYGCVAANGDTTGGNPRE

SEQ ID NO: 105339 - protein, 35 aa, Artificial Sequence
  Description of Artificial Sequence: Synthetic polypeptide
TEEEIRTTNPLATEAWGQSVVGTNLSQSRGGNQRP

SEQ ID NO: 105340 - protein, 34 aa, Artificial Sequence
  Description of Artificial Sequence: Synthetic polypeptide
TEEEIRTTNPLATEQWGSVSCTNALSHAAGGERV

SEQ ID NO: 105341 - protein, 34 aa, Artificial Sequence
  Description of Artificial Sequence: Synthetic polypeptide
TEEEIRTTNPLATEQWGSVSCTNELSDTVGGERV

SEQ ID NO: 105342 - protein, 34 aa, Artificial Sequence
  Description of Artificial Sequence: Synthetic polypeptide
TEEEIRTTNPLAYEPYGSVSCATENGQTGTNYRA

SEQ ID NO: 105343 - protein, 34 aa, Artificial Sequence
  Description of Artificial Sequence: Synthetic polypeptide
DDEEIRTTNPVATEQWGSVVTRGLRMQREGQTQD

SEQ ID NO: 105344 - protein, 33 aa, Artificial Sequence
  Description of Artificial Sequence: Synthetic polypeptide
TEEEIRTTNPLAYEQYGSVPSYCNGFRTGGNND

SEQ ID NO: 105345 - protein, 34 aa, Artificial Sequence
  Description of Artificial Sequence: Synthetic polypeptide
DDEEIRTTNPVATEQWGSVVTSGLRLQREGDTDQ

SEQ ID NO: 105346 - protein, 33 aa, Artificial Sequence
  Description of Artificial Sequence: Synthetic polypeptide
TEEEIRTTNPVATEAYGEISTNLSDDSGGQNEP

SEQ ID NO: 105347 - protein, 33 aa, Artificial Sequence
  Description of Artificial Sequence: Synthetic polypeptide
TEEEIRTTNPLAYEQYGSVVSYTNLSDPGGVVV

SEQ ID NO: 105348 - protein, 35 aa, Artificial Sequence
  Description of Artificial Sequence: Synthetic polypeptide
TEEEIRTTNPVATEAWGQSVVGTALSQSRGGNQRY

SEQ ID NO: 105349 - protein, 33 aa, Artificial Sequence
  Description of Artificial Sequence: Synthetic polypeptide
DEGEIATTNPVATEQWGSVSGTGNPQNSGEMQE

SEQ ID NO: 105350 - protein, 35 aa, Artificial Sequence
  Description of Artificial Sequence: Synthetic polypeptide
TEEEIRTTNPVATEAWGQSVVGTNLSASRGGNQRW

SEQ ID NO: 105351 - protein, 32 aa, Artificial Sequence
  Description of Artificial Sequence: Synthetic polypeptide
DEGEIATTNPVATEQWGSVSEGNNPQAGPPDE

SEQ ID NO: 105352 - protein, 36 aa, Artificial Sequence
  Description of Artificial Sequence: Synthetic polypeptide
TEEEIRTTNPVATEAWGQSVVPITNLSQSRGGNDRQ

SEQ ID NO: 105353 - protein, 35 aa, Artificial Sequence
  Description of Artificial Sequence: Synthetic polypeptide
TEEEIRTTNPVATEAWGSVCSKTNDDLDQRDAGDT

SEQ ID NO: 105354 - protein, 35 aa, Artificial Sequence
  Description of Artificial Sequence: Synthetic polypeptide
TEEEIRTTNPVATEAWGSVCSKTNDDLDQRNSGDV

SEQ ID NO: 105355 - protein, 35 aa, Artificial Sequence
  Description of Artificial Sequence: Synthetic polypeptide
TEEEIRTTNPVATEAWGSVCSKTNDDLDQRNTNDK

SEQ ID NO: 105356 - protein, 30 aa, Artificial Sequence
  Description of Artificial Sequence: Synthetic polypeptide
DEGEIATTNPVATEQWGSVATAPIGNMNGM

SEQ ID NO: 105357 - protein, 33 aa, Artificial Sequence
  Description of Artificial Sequence: Synthetic polypeptide
TEEEIRTTNPVATEAYGEISITNLSDDSMGNNE

SEQ ID NO: 105358 - protein, 33 aa, Artificial Sequence
  Description of Artificial Sequence: Synthetic polypeptide
DEVEIATTNPVAYEQWGSVSTNLPGDTGGGNMP

SEQ ID NO: 105359 - protein, 33 aa, Artificial Sequence
  Description of Artificial Sequence: Synthetic polypeptide
EENEIRTTNPVATEGYGSVSLNNLQEEVGDTPQ

SEQ ID NO: 105360 - protein, 33 aa, Artificial Sequence
  Description of Artificial Sequence: Synthetic polypeptide
DEGEIATTNPVASEQYGTVCSATDGLVEFEGNR

SEQ ID NO: 105361 - protein, 32 aa, Artificial Sequence
  Description of Artificial Sequence: Synthetic polypeptide
DEGEIATTNPVASEQYGIVSATDGPVESEGNR

SEQ ID NO: 105362 - protein, 35 aa, Artificial Sequence
  Description of Artificial Sequence: Synthetic polypeptide
AEEEIRTTNPVATEAYGSVSTTNQQLGNENGNIQE

SEQ ID NO: 105363 - protein, 36 aa, Artificial Sequence
  Description of Artificial Sequence: Synthetic polypeptide
TEEEIRTTNPVATEPYGQSVVACTANLPQERVNQRL

SEQ ID NO: 105364 - protein, 35 aa, Artificial Sequence
  Description of Artificial Sequence: Synthetic polypeptide
TEEEIRTTNPVATEPYGQSVVACTNGPQSRVNQRM

SEQ ID NO: 105365 - protein, 33 aa, Artificial Sequence
  Description of Artificial Sequence: Synthetic polypeptide
DEGEIATTNPCATECWGIVSCINLPQDREGENR

SEQ ID NO: 105366 - protein, 36 aa, Artificial Sequence
  Description of Artificial Sequence: Synthetic polypeptide
TEEEIRTTNPVATEPYGQSVVGTNLSQSSTGGNQRY

SEQ ID NO: 105367 - protein, 37 aa, Artificial Sequence
  Description of Artificial Sequence: Synthetic polypeptide
TEEEIRTTNPVATEPYGQSVVPGVTNLSQSRTGNQRY

SEQ ID NO: 105368 - protein, 28 aa, Artificial Sequence
  Description of Artificial Sequence: Synthetic peptide
EENEIATTNPVATEPWGWVSECLQHEEL

SEQ ID NO: 105369 - protein, 31 aa, Artificial Sequence
  Description of Artificial Sequence: Synthetic polypeptide
DEVEIATTNPVAYEQWGSVVTNPGLGENNMA

SEQ ID NO: 105370 - protein, 34 aa, Artificial Sequence
  Description of Artificial Sequence: Synthetic polypeptide
TEEEIRTTNPVATEPYGQVVYSIHELSQSGNNRR

SEQ ID NO: 105371 - protein, 29 aa, Artificial Sequence
  Description of Artificial Sequence: Synthetic peptide
DEGEIATTNPCASEQWGIVSENLMNSGTA

SEQ ID NO: 105372 - protein, 32 aa, Artificial Sequence
  Description of Artificial Sequence: Synthetic polypeptide
TEEEIRTTNPVATEPYGKISFHEESQNRVGNF

SEQ ID NO: 105373 - protein, 31 aa, Artificial Sequence
  Description of Artificial Sequence: Synthetic polypeptide
DEVEIATTNPVAYEQWGSVVTNPGLGETDRT

SEQ ID NO: 105374 - protein, 35 aa, Artificial Sequence
  Description of Artificial Sequence: Synthetic polypeptide
AEEEIRTTNPVATEAYGSVSTTNNQLQGTEENTEG

SEQ ID NO: 105375 - protein, 35 aa, Artificial Sequence
  Description of Artificial Sequence: Synthetic polypeptide
AEEEIRTTNPVATEAYGSVSTTNNQLNGNQENEED

SEQ ID NO: 105376 - protein, 31 aa, Artificial Sequence
  Description of Artificial Sequence: Synthetic polypeptide
DEVEIATTNPVAYEQWGTVATNLNMGDDGRH

SEQ ID NO: 105377 - protein, 31 aa, Artificial Sequence
  Description of Artificial Sequence: Synthetic polypeptide
DEGEIAPTNPVSTEQYGSVSTDLEDHEGEDL

SEQ ID NO: 105378 - protein, 36 aa, Artificial Sequence
  Description of Artificial Sequence: Synthetic polypeptide
AEEEIRTTNPVATEAYGSVSTTNNLQQNNEEGTNGD

SEQ ID NO: 105379 - protein, 31 aa, Artificial Sequence
  Description of Artificial Sequence: Synthetic polypeptide
DEVEIATTNPVAYEQWGTVSTNLNMGDDGHD

SEQ ID NO: 105380 - protein, 35 aa, Artificial Sequence
  Description of Artificial Sequence: Synthetic polypeptide
AEEEIRTTNPVATEAYGSVSTTNNLNTNQQGTIAE

SEQ ID NO: 105381 - protein, 29 aa, Artificial Sequence
  Description of Artificial Sequence: Synthetic peptide
EENEIATTNPVATECYGDVSNECLQHIEN

SEQ ID NO: 105382 - protein, 35 aa, Artificial Sequence
  Description of Artificial Sequence: Synthetic polypeptide
AEEEIRTTNPVATEAYGSVSTTNLEQGSTNEDEDE

SEQ ID NO: 105383 - protein, 36 aa, Artificial Sequence
  Description of Artificial Sequence: Synthetic polypeptide
AEEEIRTTNPVATEAYGSVSTTNLDNQQEGTNVATE

SEQ ID NO: 105384 - protein, 35 aa, Artificial Sequence
  Description of Artificial Sequence: Synthetic polypeptide
AEEEIRTTNPVATEAYGSVSTTNQNGNQAGTNETE

SEQ ID NO: 105385 - protein, 35 aa, Artificial Sequence
  Description of Artificial Sequence: Synthetic polypeptide
TEEEIRTTNPVATEPYGITVSTITLSTRNGGNTRN

SEQ ID NO: 105386 - protein, 34 aa, Artificial Sequence
  Description of Artificial Sequence: Synthetic polypeptide
TEEEIRTTNPVATEPYGITVSSITHSTRNGGNTR

SEQ ID NO: 105387 - protein, 35 aa, Artificial Sequence
  Description of Artificial Sequence: Synthetic polypeptide
AEEEIRTTNPVATEAYGSVSTTNQQLNGNQGNIQE

SEQ ID NO: 105388 - protein, 35 aa, Artificial Sequence
  Description of Artificial Sequence: Synthetic polypeptide
TEEEIRTTNPVATEAYGQSVVGTNLSQSGGGSQRY

SEQ ID NO: 105389 - protein, 36 aa, Artificial Sequence
  Description of Artificial Sequence: Synthetic polypeptide
TEEEIRTTNPVATEAYGSVSSCHNELSQNRTGDNNM

SEQ ID NO: 105390 - protein, 29 aa, Artificial Sequence
  Description of Artificial Sequence: Synthetic peptide
DEGEIATTNPVASEQWGIVSEILMNSGTA

SEQ ID NO: 105391 - protein, 34 aa, Artificial Sequence
  Description of Artificial Sequence: Synthetic polypeptide
TEEEIRTTNPVATEAYGSVSTAGNEGEDEFGNTT

SEQ ID NO: 105392 - protein, 28 aa, Artificial Sequence
  Description of Artificial Sequence: Synthetic peptide
EENEIATTNPVAYECYGTVSECLQHEEA

SEQ ID NO: 105393 - protein, 35 aa, Artificial Sequence
  Description of Artificial Sequence: Synthetic polypeptide
AEEEIRTTNPVATEAYGSVSTTVNNLQQNTTTNVA

SEQ ID NO: 105394 - protein, 32 aa, Artificial Sequence
  Description of Artificial Sequence: Synthetic polypeptide
DEVEIATTNPVAYEQWGSVTSPNLGDNHGNTQ

SEQ ID NO: 105395 - protein, 32 aa, Artificial Sequence
  Description of Artificial Sequence: Synthetic polypeptide
DEVEIATTNPVAYEQWGSVTSTNLGDNHGDTV

SEQ ID NO: 105396 - protein, 34 aa, Artificial Sequence
  Description of Artificial Sequence: Synthetic polypeptide
DDEEIRTTNPVATEQYGAVVNDDQTNGQTGGGNG

SEQ ID NO: 105397 - protein, 33 aa, Artificial Sequence
  Description of Artificial Sequence: Synthetic polypeptide
DEVEIATTNPVAYEQWGSVTSTNLGDNHGNTDG

SEQ ID NO: 105398 - protein, 33 aa, Artificial Sequence
  Description of Artificial Sequence: Synthetic polypeptide
AEEEIRTTNPVATEAYGSVSTTQQQQANVNNGN

SEQ ID NO: 105399 - protein, 31 aa, Artificial Sequence
  Description of Artificial Sequence: Synthetic polypeptide
DEGEIATTNPCSTEQYGIVSATDLEDHEGER

SEQ ID NO: 105400 - protein, 31 aa, Artificial Sequence
  Description of Artificial Sequence: Synthetic polypeptide
DEGEIATTNPCSTECYGIVSCINEQDREGTR

SEQ ID NO: 105401 - protein, 35 aa, Artificial Sequence
  Description of Artificial Sequence: Synthetic polypeptide
AEEEIRTTNPVATEAYGSVSTTNQQQQANNQNGNT

SEQ ID NO: 105402 - protein, 32 aa, Artificial Sequence
  Description of Artificial Sequence: Synthetic polypeptide
DEGEIATTNPCSSEQYGTVCSTDNLVQSEGTR

SEQ ID NO: 105403 - protein, 30 aa, Artificial Sequence
  Description of Artificial Sequence: Synthetic polypeptide
DEGEIATTNPCSSEQYGSVSCNLEDSGEDL

SEQ ID NO: 105404 - protein, 29 aa, Artificial Sequence
  Description of Artificial Sequence: Synthetic peptide
DEGEIATTNPCSSEQYGIVSCNPVQSGTD

SEQ ID NO: 105405 - protein, 30 aa, Artificial Sequence
  Description of Artificial Sequence: Synthetic polypeptide
DEGEIATTNPCSSEQYGIVSCENLQSNGTH

SEQ ID NO: 105406 - protein, 30 aa, Artificial Sequence
  Description of Artificial Sequence: Synthetic polypeptide
DEGEIATTNPCSSEQYGIVSCENLQQNGTH

SEQ ID NO: 105407 - protein, 32 aa, Artificial Sequence
  Description of Artificial Sequence: Synthetic polypeptide
TEEEIRTTNPVATEPYGCVWYCENIIQGGGNM

SEQ ID NO: 105408 - protein, 35 aa, Artificial Sequence
  Description of Artificial Sequence: Synthetic polypeptide
AEEEIRTTNPVATEAYGSVSTTNQQLNNNEGNTQE

SEQ ID NO: 105409 - protein, 30 aa, Artificial Sequence
  Description of Artificial Sequence: Synthetic polypeptide
DEGEIATTNPCSSECYGIVSCINEQREGTR

SEQ ID NO: 105410 - protein, 34 aa, Artificial Sequence
  Description of Artificial Sequence: Synthetic polypeptide
AEEEIRTTNPVATEAYGSVSTTNQQLNNDENIQE

SEQ ID NO: 105411 - protein, 33 aa, Artificial Sequence
  Description of Artificial Sequence: Synthetic polypeptide
DEGEIATTNPVATEQYGCVAATNLADDPGGNHL

SEQ ID NO: 105412 - protein, 31 aa, Artificial Sequence
  Description of Artificial Sequence: Synthetic polypeptide
TEEEIRTTNPIAYEQYGSVPCSGLSARGGSE

SEQ ID NO: 105413 - protein, 33 aa, Artificial Sequence
  Description of Artificial Sequence: Synthetic polypeptide
EESEIRTTNPVATECWGSVSCINEPQDREGENG

SEQ ID NO: 105414 - protein, 32 aa, Artificial Sequence
  Description of Artificial Sequence: Synthetic polypeptide
DEGEIATTNPVATEQYGCVAATNLADPGEEGN

SEQ ID NO: 105415 - protein, 33 aa, Artificial Sequence
  Description of Artificial Sequence: Synthetic polypeptide
TEEEICTTNPVATERYGISTVCTNELSQTGEET

SEQ ID NO: 105416 - protein, 33 aa, Artificial Sequence
  Description of Artificial Sequence: Synthetic polypeptide
TEEEICTTNPVATERYGISTVPNTNELSQTGET

SEQ ID NO: 105417 - protein, 34 aa, Artificial Sequence
  Description of Artificial Sequence: Synthetic polypeptide
TEEEICTTNPVATERYGISTVQSTNELSTERGST

SEQ ID NO: 105418 - protein, 34 aa, Artificial Sequence
  Description of Artificial Sequence: Synthetic polypeptide
TEEEICTTNPVATERYGISTVSTNEHSQERGSYT

SEQ ID NO: 105419 - protein, 34 aa, Artificial Sequence
  Description of Artificial Sequence: Synthetic polypeptide
TEEEICTTNPVATERYGISTVSTNELSQEEGEDN

SEQ ID NO: 105420 - protein, 34 aa, Artificial Sequence
  Description of Artificial Sequence: Synthetic polypeptide
TEEEICTTNPVATERYGISTVSTNELSQETNGET

SEQ ID NO: 105421 - protein, 34 aa, Artificial Sequence
  Description of Artificial Sequence: Synthetic polypeptide
TEEEICTTNPVATERYGISTVSTPNELSQEEGES

SEQ ID NO: 105422 - protein, 34 aa, Artificial Sequence
  Description of Artificial Sequence: Synthetic polypeptide
TEEEICTTNPVATERYGISTVSTRELSQERNGST

SEQ ID NO: 105423 - protein, 34 aa, Artificial Sequence
  Description of Artificial Sequence: Synthetic polypeptide
TEEEICTTNPVATERYGISTVSYTNELSQEWGST

SEQ ID NO: 105424 - protein, 31 aa, Artificial Sequence
  Description of Artificial Sequence: Synthetic polypeptide
EGEEIATTNPVAYEQWGSVTHDLDDQRGSDR

SEQ ID NO: 105425 - protein, 32 aa, Artificial Sequence
  Description of Artificial Sequence: Synthetic polypeptide
DDEEIRTTNPVATEQWGQCVTSTEDQNFGSDA

SEQ ID NO: 105426 - protein, 32 aa, Artificial Sequence
  Description of Artificial Sequence: Synthetic polypeptide
TEEEICTTNPVATKQYGAVSTNISAQRCQQDN

SEQ ID NO: 105427 - protein, 31 aa, Artificial Sequence
  Description of Artificial Sequence: Synthetic polypeptide
TEEEICTTNPVATKQYGAVVHTNISAQQGQN

SEQ ID NO: 105428 - protein, 32 aa, Artificial Sequence
  Description of Artificial Sequence: Synthetic polypeptide
TEEEICTTNPVATKQYGAVVTNISAQRPGQIN

SEQ ID NO: 105429 - protein, 31 aa, Artificial Sequence
  Description of Artificial Sequence: Synthetic polypeptide
DEGEIATTNPVATEQYGSVASSDPTGEDNEN

SEQ ID NO: 105430 - protein, 32 aa, Artificial Sequence
  Description of Artificial Sequence: Synthetic polypeptide
DEGEIATTNPVATEQYGSVASNPANPNPGAQP

SEQ ID NO: 105431 - protein, 33 aa, Artificial Sequence
  Description of Artificial Sequence: Synthetic polypeptide
DEGEIATTNPVATEQYGSVASNDTANDNPGAQP

SEQ ID NO: 105432 - protein, 33 aa, Artificial Sequence
  Description of Artificial Sequence: Synthetic polypeptide
TEEEICTTNPVAYEQYGSVVACTALIQNTGPRE

SEQ ID NO: 105433 - protein, 31 aa, Artificial Sequence
  Description of Artificial Sequence: Synthetic polypeptide
EGEEIATTNPVAYEQWGSTVHTLDDQRGQDR

SEQ ID NO: 105434 - protein, 30 aa, Artificial Sequence
  Description of Artificial Sequence: Synthetic polypeptide
DEVEIATTNPVAYEQWGCVATNPGLGENDS

SEQ ID NO: 105435 - protein, 30 aa, Artificial Sequence
  Description of Artificial Sequence: Synthetic polypeptide
DEVEIATTNPVAYEQWGCVVTNPGLGENEH

SEQ ID NO: 105436 - protein, 33 aa, Artificial Sequence
  Description of Artificial Sequence: Synthetic polypeptide
EGEEIACTNPVATEQYGSVSWNEQGERNGKQER

SEQ ID NO: 105437 - protein, 32 aa, Artificial Sequence
  Description of Artificial Sequence: Synthetic polypeptide
TEEEICTTNPVATKQYGAVSTNISSQRIPQDN

SEQ ID NO: 105438 - protein, 33 aa, Artificial Sequence
  Description of Artificial Sequence: Synthetic polypeptide
TEEEICTTNPVATERYGICTVSTNELSQEEGET

SEQ ID NO: 105439 - protein, 33 aa, Artificial Sequence
  Description of Artificial Sequence: Synthetic polypeptide
TEEEICTTNPVATEAYGISTVSTNELSQETQST

SEQ ID NO: 105440 - protein, 32 aa, Artificial Sequence
  Description of Artificial Sequence: Synthetic polypeptide
TEEEICTTNPNATKQYGAVSTNISAQRGQDYV

SEQ ID NO: 105441 - protein, 32 aa, Artificial Sequence
  Description of Artificial Sequence: Synthetic polypeptide
DEVEIATTNPVAYEHWGSVATNEQGNDSGDNR

SEQ ID NO: 105442 - protein, 34 aa, Artificial Sequence
  Description of Artificial Sequence: Synthetic polypeptide
TEEEIATTNPVAYEQWGSVSTANELSQQGENYTN

SEQ ID NO: 105443 - protein, 33 aa, Artificial Sequence
  Description of Artificial Sequence: Synthetic polypeptide
TEEEIATTNPVAYEQYGNTVSVTMLDGTGGNYR

SEQ ID NO: 105444 - protein, 32 aa, Artificial Sequence
  Description of Artificial Sequence: Synthetic polypeptide
DEVEIATTNPVAYEHWGSVATNLQGDAGNGSP

SEQ ID NO: 105445 - protein, 32 aa, Artificial Sequence
  Description of Artificial Sequence: Synthetic polypeptide
ENEEIATTNPVAYEQWGVSTTNLQGDHGPNAR

SEQ ID NO: 105446 - protein, 32 aa, Artificial Sequence
  Description of Artificial Sequence: Synthetic polypeptide
TEEEIATTNPVAYEQYGNTVSVTMLQGTGGDN

SEQ ID NO: 105447 - protein, 32 aa, Artificial Sequence
  Description of Artificial Sequence: Synthetic polypeptide
TEEEIATTNPVAYEQYGNTVSYIMLQGTGGNE

SEQ ID NO: 105448 - protein, 33 aa, Artificial Sequence
  Description of Artificial Sequence: Synthetic polypeptide
ENEEIATTNPVAYEQWGSVSTNLNGDAGGGNGR

SEQ ID NO: 105449 - protein, 32 aa, Artificial Sequence
  Description of Artificial Sequence: Synthetic polypeptide
DEVEIATTNPVAYEHWGSVATNLQGNDSGGHR

SEQ ID NO: 105450 - protein, 32 aa, Artificial Sequence
  Description of Artificial Sequence: Synthetic polypeptide
DEVEIATTNPVAYEHWGSVATNLQGNDSGGNS

SEQ ID NO: 105451 - protein, 31 aa, Artificial Sequence
  Description of Artificial Sequence: Synthetic polypeptide
ENEEIATTNPVAYEQWGNVSGTMWQDGDGNR

SEQ ID NO: 105452 - protein, 33 aa, Artificial Sequence
  Description of Artificial Sequence: Synthetic polypeptide
DDEEIRTTNPVATEQWGCVTSTLLQNFNSQNQS

SEQ ID NO: 105453 - protein, 32 aa, Artificial Sequence
  Description of Artificial Sequence: Synthetic polypeptide
ENEEIATTNPVAYEAWGVVSTNLQGDHGPNPR

SEQ ID NO: 105454 - protein, 33 aa, Artificial Sequence
  Description of Artificial Sequence: Synthetic polypeptide
ENEEIATTNPVATTQWGSVSKTDNPMERGDNHR

SEQ ID NO: 105455 - protein, 33 aa, Artificial Sequence
  Description of Artificial Sequence: Synthetic polypeptide
EITEIATTNPVATENYGCVSTSNGLQDTEGNER

SEQ ID NO: 105456 - protein, 32 aa, Artificial Sequence
  Description of Artificial Sequence: Synthetic polypeptide
DEVEIATTNPVAYEKWGSTVTNLQGNDSGNNR

SEQ ID NO: 105457 - protein, 35 aa, Artificial Sequence
  Description of Artificial Sequence: Synthetic polypeptide
TEEEIATTNPVAYEQYGSVSPTANELSQQGEDYRN

SEQ ID NO: 105458 - protein, 34 aa, Artificial Sequence
  Description of Artificial Sequence: Synthetic polypeptide
TEEEIATTNPVAYEQYGSVSTAAELSDNGENYRN

SEQ ID NO: 105459 - protein, 32 aa, Artificial Sequence
  Description of Artificial Sequence: Synthetic polypeptide
DEVEIATTNPVAYEPWGSATTNLQGNAGENNR

SEQ ID NO: 105460 - protein, 34 aa, Artificial Sequence
  Description of Artificial Sequence: Synthetic polypeptide
TEEEIATTNPVAYEQYGSVVPSTNNLAGGGNPKT

SEQ ID NO: 105461 - protein, 33 aa, Artificial Sequence
  Description of Artificial Sequence: Synthetic polypeptide
DEVEIATTNPVAYEPWGSVSTNLGGNAGENGRR

SEQ ID NO: 105462 - protein, 31 aa, Artificial Sequence
  Description of Artificial Sequence: Synthetic polypeptide
TEEEICTTNPIATKQYGAVVTNISAQRGMQN

SEQ ID NO: 105463 - protein, 34 aa, Artificial Sequence
  Description of Artificial Sequence: Synthetic polypeptide
TEEEICTTNPMATEQYGSTVPCTPALSQQRVNNR

SEQ ID NO: 105464 - protein, 31 aa, Artificial Sequence
  Description of Artificial Sequence: Synthetic polypeptide
DEVEIATTNPVAYEQWGEVSTTNAQGDIQRE

SEQ ID NO: 105465 - protein, 35 aa, Artificial Sequence
  Description of Artificial Sequence: Synthetic polypeptide
AEEEIRTTNPVATEAYGSVSTTLQVGTEAGTNTDT

SEQ ID NO: 105466 - protein, 33 aa, Artificial Sequence
  Description of Artificial Sequence: Synthetic polypeptide
DEGEIATTNPVATEQYGSVAITNLPTNGEPTEG

SEQ ID NO: 105467 - protein, 33 aa, Artificial Sequence
  Description of Artificial Sequence: Synthetic polypeptide
DEGEIATTNPVATEQYGSVAITNETNPGENTEG

SEQ ID NO: 105468 - protein, 32 aa, Artificial Sequence
  Description of Artificial Sequence: Synthetic polypeptide
DEGEIATTNPVATEQYGCVATALTIGRPMNGM

SEQ ID NO: 105469 - protein, 30 aa, Artificial Sequence
  Description of Artificial Sequence: Synthetic polypeptide
DEGEIATTNPVATEQYGCVATALISNMMGM

SEQ ID NO: 105470 - protein, 33 aa, Artificial Sequence
  Description of Artificial Sequence: Synthetic polypeptide
DEVEIATTNPVAYEQWGSVSKTDEQTQERQGNN

SEQ ID NO: 105471 - protein, 35 aa, Artificial Sequence
  Description of Artificial Sequence: Synthetic polypeptide
AEEEIRTTNPVATEAYGSVSVTVNNEQQGNNEEVE

SEQ ID NO: 105472 - protein, 35 aa, Artificial Sequence
  Description of Artificial Sequence: Synthetic polypeptide
AEEEIRTTNPVATEAYGSVSVTTNNNNQQAGTNNY

SEQ ID NO: 105473 - protein, 35 aa, Artificial Sequence
  Description of Artificial Sequence: Synthetic polypeptide
AEEEIRTTNPVATEAYGSVSVTTNNNNQAGGNNND

SEQ ID NO: 105474 - protein, 33 aa, Artificial Sequence
  Description of Artificial Sequence: Synthetic polypeptide
DEGEIATTNPVATEQYGCVAITNLTDNGENTEG

SEQ ID NO: 105475 - protein, 33 aa, Artificial Sequence
  Description of Artificial Sequence: Synthetic polypeptide
DEGEIATTNPVATEQYGCVAITGLQENGENTEG

SEQ ID NO: 105476 - protein, 34 aa, Artificial Sequence
  Description of Artificial Sequence: Synthetic polypeptide
DEGEIATTNPVATEQYGCVAGTNQLQNRMGGPLA

SEQ ID NO: 105477 - protein, 32 aa, Artificial Sequence
  Description of Artificial Sequence: Synthetic polypeptide
DEGEIATTNPVATEQYGCVAATPLADPGGNHI

SEQ ID NO: 105478 - protein, 33 aa, Artificial Sequence
  Description of Artificial Sequence: Synthetic polypeptide
DEVEIATTNPVAYEQWGSVSKPDEQLQERQGNL

SEQ ID NO: 105479 - protein, 34 aa, Artificial Sequence
  Description of Artificial Sequence: Synthetic polypeptide
DEGEIATTNPVATEQYGCVAATNLTDRPGPNPQN

SEQ ID NO: 105480 - protein, 33 aa, Artificial Sequence
  Description of Artificial Sequence: Synthetic polypeptide
EESEIRTTNPVATEYWGSVSCINEPQDREGENG

SEQ ID NO: 105481 - protein, 32 aa, Artificial Sequence
  Description of Artificial Sequence: Synthetic polypeptide
DEVEIATTNPVAYEQWGSVSNPNGQGMGNNEE

SEQ ID NO: 105482 - protein, 33 aa, Artificial Sequence
  Description of Artificial Sequence: Synthetic polypeptide
DEGEIATTNPVATEQYGCVAATNLTADPGENPE

SEQ ID NO: 105483 - protein, 36 aa, Artificial Sequence
  Description of Artificial Sequence: Synthetic polypeptide
AEEEIRTTNPVATEAYGSVSVTTNNLQNGNQQLGTD

SEQ ID NO: 105484 - protein, 32 aa, Artificial Sequence
  Description of Artificial Sequence: Synthetic polypeptide
DEVEIATTNPVAYEQWGSVSTDNHGAAGDNSS

SEQ ID NO: 105485 - protein, 32 aa, Artificial Sequence
  Description of Artificial Sequence: Synthetic polypeptide
DEGEIATTNPVATEQYGCVAATNLELNHLNNL

SEQ ID NO: 105486 - protein, 31 aa, Artificial Sequence
  Description of Artificial Sequence: Synthetic polypeptide
DEGEIATTNPVATEQYGCVAATNLAPPPEED

SEQ ID NO: 105487 - protein, 33 aa, Artificial Sequence
  Description of Artificial Sequence: Synthetic polypeptide
DEGEIATTNPVATEQYGCVAATNLADPNPADRH

SEQ ID NO: 105488 - protein, 32 aa, Artificial Sequence
  Description of Artificial Sequence: Synthetic polypeptide
DEVEIATTNPVAYEQWGSVSTDNHGPAGDNSI

SEQ ID NO: 105489 - protein, 33 aa, Artificial Sequence
  Description of Artificial Sequence: Synthetic polypeptide
TEEEIRTCNPVAYEAYGSVSCTRMLSQRVGQEI

SEQ ID NO: 105490 - protein, 33 aa, Artificial Sequence
  Description of Artificial Sequence: Synthetic polypeptide
DEGEIATTNPVATEQYGCVAATNLTDPGENAHV

SEQ ID NO: 105491 - protein, 31 aa, Artificial Sequence
  Description of Artificial Sequence: Synthetic polypeptide
DEVEIATTNPVAYEQWGSVSGENGEDRNGDS

SEQ ID NO: 105492 - protein, 31 aa, Artificial Sequence
  Description of Artificial Sequence: Synthetic polypeptide
DEGEIATTNPVATEQYGCVATNGLEAMAQEF

SEQ ID NO: 105493 - protein, 33 aa, Artificial Sequence
  Description of Artificial Sequence: Synthetic polypeptide
DEGEIATTNPVATEQYGCVATNLATAGIGENDD

SEQ ID NO: 105494 - protein, 34 aa, Artificial Sequence
  Description of Artificial Sequence: Synthetic polypeptide
TEEEIRATNPVAYEQYGSVVPSTNNLAGTGGNKT

SEQ ID NO: 105495 - protein, 31 aa, Artificial Sequence
  Description of Artificial Sequence: Synthetic polypeptide
DEVEIATTNPVAYEQWGMTSTNLQGDGDDSN

SEQ ID NO: 105496 - protein, 31 aa, Artificial Sequence
  Description of Artificial Sequence: Synthetic polypeptide
DEVEIATTNPVAYEQWGSTVTNPGNDGQNSR

SEQ ID NO: 105497 - protein, 33 aa, Artificial Sequence
  Description of Artificial Sequence: Synthetic polypeptide
DEGEIATTNPVATEQYGSVAATTPTQNGLMNDD

SEQ ID NO: 105498 - protein, 35 aa, Artificial Sequence
  Description of Artificial Sequence: Synthetic polypeptide
AEEEIRTTNPVATEAYGSVVVVVTNLQQGEENEDE

SEQ ID NO: 105499 - protein, 34 aa, Artificial Sequence
  Description of Artificial Sequence: Synthetic polypeptide
TEEEIRCTNPIATEQYGSTVPSENELSMHTGGNR

SEQ ID NO: 105500 - protein, 34 aa, Artificial Sequence
  Description of Artificial Sequence: Synthetic polypeptide
EETEIRTTNPVATEQYGSVSPTNNEIRQNSEFDQ

SEQ ID NO: 105501 - protein, 34 aa, Artificial Sequence
  Description of Artificial Sequence: Synthetic polypeptide
DDEEIRTTNPVATEQWGSVVNSGLRLQREGQTEQ

SEQ ID NO: 105502 - protein, 34 aa, Artificial Sequence
  Description of Artificial Sequence: Synthetic polypeptide
TEEEIRCTNPIATEQYGSTVSENELSMATGGNRG

SEQ ID NO: 105503 - protein, 32 aa, Artificial Sequence
  Description of Artificial Sequence: Synthetic polypeptide
DEVEIATTNPVAYEQWGSVCSTIDQHTGGNVS

SEQ ID NO: 105504 - protein, 32 aa, Artificial Sequence
  Description of Artificial Sequence: Synthetic polypeptide
DEGEIATTNPVATEQYGCVSATGLEDHQGEDF

SEQ ID NO: 105505 - protein, 32 aa, Artificial Sequence
  Description of Artificial Sequence: Synthetic polypeptide
DEGEIATTNPVATEQYGCVAWTTLNDGMNDLH

SEQ ID NO: 105506 - protein, 34 aa, Artificial Sequence
  Description of Artificial Sequence: Synthetic polypeptide
TEEEIRCTNPIATEQYGSTVSVNELSMRTGGDRT

SEQ ID NO: 105507 - protein, 34 aa, Artificial Sequence
  Description of Artificial Sequence: Synthetic polypeptide
DEVEIATTNPVAYEQWGSVCSTNDDHQGGNQHRE

SEQ ID NO: 105508 - protein, 33 aa, Artificial Sequence
  Description of Artificial Sequence: Synthetic polypeptide
DEGEIATTNPVATEQYGCVATNLQPDDQDGSDI

SEQ ID NO: 105509 - protein, 33 aa, Artificial Sequence
  Description of Artificial Sequence: Synthetic polypeptide
DEVEIATTNPVAYEQWGSVCSTNDLGHPMGDHR

SEQ ID NO: 105510 - protein, 35 aa, Artificial Sequence
  Description of Artificial Sequence: Synthetic polypeptide
TEEEIRCTNPIATEQYGSTVSYENELSMRTGGNYR

SEQ ID NO: 105511 - protein, 35 aa, Artificial Sequence
  Description of Artificial Sequence: Synthetic polypeptide
DDEEIRTTNPVATEQWGSVVTRGLRLQREGQTNQA

SEQ ID NO: 105512 - protein, 33 aa, Artificial Sequence
  Description of Artificial Sequence: Synthetic polypeptide
DEGEIATTNPVATEQYGCVATNLQAEPGGDTHS

SEQ ID NO: 105513 - protein, 33 aa, Artificial Sequence
  Description of Artificial Sequence: Synthetic polypeptide
DEVEIATTNPVAYEQWGSVCSTNIDQSGDGNVS

SEQ ID NO: 105514 - protein, 33 aa, Artificial Sequence
  Description of Artificial Sequence: Synthetic polypeptide
TEEEIRCTNPIATERYGKTVSENELSMRTGGNR

SEQ ID NO: 105515 - protein, 33 aa, Artificial Sequence
  Description of Artificial Sequence: Synthetic polypeptide
DEVEIATTNPVAYEQWGSVCSTPNGQTDGMNEV

SEQ ID NO: 105516 - protein, 33 aa, Artificial Sequence
  Description of Artificial Sequence: Synthetic polypeptide
DEGEIATTNPVATEQYGCVATNLDATAGDNEDA

SEQ ID NO: 105517 - protein, 30 aa, Artificial Sequence
  Description of Artificial Sequence: Synthetic polypeptide
EEVEIATTNPVATTQWGCVRTADQHQGNER

SEQ ID NO: 105518 - protein, 35 aa, Artificial Sequence
  Description of Artificial Sequence: Synthetic polypeptide
AEEEIRTTNPVATEAYGSVSTTLQQLGNEQGEIGE

SEQ ID NO: 105519 - protein, 31 aa, Artificial Sequence
  Description of Artificial Sequence: Synthetic polypeptide
DEVEIATTNPVAYEQWGTVSTNLNMGGDDGS

SEQ ID NO: 105520 - protein, 28 aa, Artificial Sequence
  Description of Artificial Sequence: Synthetic peptide
DEGEIAPTNPISSECYGAVSCDLQSGTR

SEQ ID NO: 105521 - protein, 34 aa, Artificial Sequence
  Description of Artificial Sequence: Synthetic polypeptide
TEEEIRTTNPVATEQYGSVSPSVNQANMTGEHYR

SEQ ID NO: 105522 - protein, 34 aa, Artificial Sequence
  Description of Artificial Sequence: Synthetic polypeptide
EEEEIRTTNPVATESYGSVSNTVLEEHRNGEFQN

SEQ ID NO: 105523 - protein, 35 aa, Artificial Sequence
  Description of Artificial Sequence: Synthetic polypeptide
TEEEIRTTNPVATEQYGSVSPTNMQMNENIVDQDN

SEQ ID NO: 105524 - protein, 34 aa, Artificial Sequence
  Description of Artificial Sequence: Synthetic polypeptide
DEGAIRTTNPVATEQYGSTTSCTNAPSIITGGNR

SEQ ID NO: 105525 - protein, 34 aa, Artificial Sequence
  Description of Artificial Sequence: Synthetic polypeptide
DDEEIRTTNPVATEQYGCVCSNWGELQNFGSNQD

SEQ ID NO: 105526 - protein, 32 aa, Artificial Sequence
  Description of Artificial Sequence: Synthetic polypeptide
DDEEIRTTNPVATEQYGCVCSSEDQNFGSEQA

SEQ ID NO: 105527 - protein, 32 aa, Artificial Sequence
  Description of Artificial Sequence: Synthetic polypeptide
DEVEIATTNPVAYEQYGTVATNLQGEDQNKEE

SEQ ID NO: 105528 - protein, 36 aa, Artificial Sequence
  Description of Artificial Sequence: Synthetic polypeptide
TEEEIRTTNPVATEQYGSVSSTTPAGPNMRNGMNRV

SEQ ID NO: 105529 - protein, 34 aa, Artificial Sequence
  Description of Artificial Sequence: Synthetic polypeptide
AEEEIRATNPCATEQYGSVSTENLLMGEIGTNME

SEQ ID NO: 105530 - protein, 34 aa, Artificial Sequence
  Description of Artificial Sequence: Synthetic polypeptide
AEEEIRATNPCATEQYGSVSTENLGMEIGTNNME

SEQ ID NO: 105531 - protein, 33 aa, Artificial Sequence
  Description of Artificial Sequence: Synthetic polypeptide
DEGAIRTTNPVAYEAYGSFPSTNLSIITEGNNR

SEQ ID NO: 105532 - protein, 34 aa, Artificial Sequence
  Description of Artificial Sequence: Synthetic polypeptide
TEEEIRTTNPVATEQYGSVSTGMGDQGNGQGEQT

SEQ ID NO: 105533 - protein, 35 aa, Artificial Sequence
  Description of Artificial Sequence: Synthetic polypeptide
EEEEIRTTNPVATESYGSVSNTVLEEHMRVGPFQR

SEQ ID NO: 105534 - protein, 33 aa, Artificial Sequence
  Description of Artificial Sequence: Synthetic polypeptide
EEEEIRTTNPVATESYGSVSFTVLEEEAVGFQN

SEQ ID NO: 105535 - protein, 35 aa, Artificial Sequence
  Description of Artificial Sequence: Synthetic polypeptide
AEEEIRATNPCATEQYGSVSTELNQLNQQIGTNVE

SEQ ID NO: 105536 - protein, 32 aa, Artificial Sequence
  Description of Artificial Sequence: Synthetic polypeptide
DEGAIRTTNPVATEQYGSFSTLTLIEGQIVGV

SEQ ID NO: 105537 - protein, 34 aa, Artificial Sequence
  Description of Artificial Sequence: Synthetic polypeptide
AEEEIRATNPCATEQYGSVSTELNLMNEIGTNME

SEQ ID NO: 105538 - protein, 33 aa, Artificial Sequence
  Description of Artificial Sequence: Synthetic polypeptide
DEGAIRTTNPVATEQYGSFSTLELNIEGGQISR

SEQ ID NO: 105539 - protein, 35 aa, Artificial Sequence
  Description of Artificial Sequence: Synthetic polypeptide
DEGAIRTTNPVATEQYGSFSETPNLIEIPGSNQRN

SEQ ID NO: 105540 - protein, 35 aa, Artificial Sequence
  Description of Artificial Sequence: Synthetic polypeptide
TEEEIRTTNPVATEQYGSVSTGVGVNQGGGQTGEG

SEQ ID NO: 105541 - protein, 36 aa, Artificial Sequence
  Description of Artificial Sequence: Synthetic polypeptide
EEEEIRTTNPVATEQYGVVSTTTTNLGNQQGENQDD

SEQ ID NO: 105542 - protein, 35 aa, Artificial Sequence
  Description of Artificial Sequence: Synthetic polypeptide
AEEEIRATNPCATEQYGSVSTEGNNLEQIGTNTTD

SEQ ID NO: 105543 - protein, 33 aa, Artificial Sequence
  Description of Artificial Sequence: Synthetic polypeptide
DEVEIATTNPVAYEQYGTVATNLQMEGGGNNGS

SEQ ID NO: 105544 - protein, 35 aa, Artificial Sequence
  Description of Artificial Sequence: Synthetic polypeptide
TEEEIRTTNPVATEQYGSVSPNVSLQQMHGEHPPI

SEQ ID NO: 105545 - protein, 33 aa, Artificial Sequence
  Description of Artificial Sequence: Synthetic polypeptide
TEEEIRTTNPVATEQYGSVSPEPVVQALLVVER

SEQ ID NO: 105546 - protein, 35 aa, Artificial Sequence
  Description of Artificial Sequence: Synthetic polypeptide
TEEEIRTTNPVATEQYGSVSPDVNTLAQMHELHPR

SEQ ID NO: 105547 - protein, 32 aa, Artificial Sequence
  Description of Artificial Sequence: Synthetic polypeptide
DEGEIACTNPVATEQYGCVATNLQPAEDDTRP

SEQ ID NO: 105548 - protein, 35 aa, Artificial Sequence
  Description of Artificial Sequence: Synthetic polypeptide
AEEEIRATNPCATEQYGSVSTENLQMGEIGTNEMG

SEQ ID NO: 105549 - protein, 35 aa, Artificial Sequence
  Description of Artificial Sequence: Synthetic polypeptide
EEEEIRTTNPVATESYGVVSTTNNLNTQNGNDTDE

SEQ ID NO: 105550 - protein, 34 aa, Artificial Sequence
  Description of Artificial Sequence: Synthetic polypeptide
TEEEIRTTNPVATEQYGSVSGNGEGQGNDQENGD

SEQ ID NO: 105551 - protein, 33 aa, Artificial Sequence
  Description of Artificial Sequence: Synthetic polypeptide
DEGEIACTNPVATEQYGCVATNLQEAPGNQPPA

SEQ ID NO: 105552 - protein, 32 aa, Artificial Sequence
  Description of Artificial Sequence: Synthetic polypeptide
DEGEIACTNPVATEQYGCVATNLQEAGHQTPE

SEQ ID NO: 105553 - protein, 32 aa, Artificial Sequence
  Description of Artificial Sequence: Synthetic polypeptide
DEGEIACTNPVATEQYGCVATNLQDAGDIEEE

SEQ ID NO: 105554 - protein, 32 aa, Artificial Sequence
  Description of Artificial Sequence: Synthetic polypeptide
DEGEIACTNPVATEQYGCVATNLQAHNPQEEA

SEQ ID NO: 105555 - protein, 34 aa, Artificial Sequence
  Description of Artificial Sequence: Synthetic polypeptide
TEEEIRTTNPVATEQYGSVSGNGEGQGNQGETGN

SEQ ID NO: 105556 - protein, 32 aa, Artificial Sequence
  Description of Artificial Sequence: Synthetic polypeptide
DEGEIACTNPVATEQYGCVATNLQAEDDTGEN

SEQ ID NO: 105557 - protein, 34 aa, Artificial Sequence
  Description of Artificial Sequence: Synthetic polypeptide
EEEEIRTTNPVATESYGSVSNTVWEEHRVGVFQR

SEQ ID NO: 105558 - protein, 32 aa, Artificial Sequence
  Description of Artificial Sequence: Synthetic polypeptide
DEVEIATTNPVAYEQYGTVATGDLNQGDINRE

SEQ ID NO: 105559 - protein, 32 aa, Artificial Sequence
  Description of Artificial Sequence: Synthetic polypeptide
DEGEIACTNPVATEQYGCVATNLQADDNPTVQ

SEQ ID NO: 105560 - protein, 32 aa, Artificial Sequence
  Description of Artificial Sequence: Synthetic polypeptide
DEGEIACTNPVATEQWGCVATNLQAATPGNEM

SEQ ID NO: 105561 - protein, 34 aa, Artificial Sequence
  Description of Artificial Sequence: Synthetic polypeptide
EEEEIRTTNPVATESYGSVSNTVNEEHRVQTFER

SEQ ID NO: 105562 - protein, 33 aa, Artificial Sequence
  Description of Artificial Sequence: Synthetic polypeptide
DEVEIATTNPVAYEQYGTVATGNLQLGEDQNEE

SEQ ID NO: 105563 - protein, 32 aa, Artificial Sequence
  Description of Artificial Sequence: Synthetic polypeptide
DEVEIATTNPVAYEQYGTVATNLNMGGDDGRG

SEQ ID NO: 105564 - protein, 34 aa, Artificial Sequence
  Description of Artificial Sequence: Synthetic polypeptide
DDEEIRTTNPVATEQYGCVCSNTMELQNFGSEQA

SEQ ID NO: 105565 - protein, 34 aa, Artificial Sequence
  Description of Artificial Sequence: Synthetic polypeptide
TEEEIRTTNPVATEQYGSVSNTDNDNNEEGEGGQ

SEQ ID NO: 105566 - protein, 31 aa, Artificial Sequence
  Description of Artificial Sequence: Synthetic polypeptide
DEVEIATTNPVAYEQYGTVATNLNQGDIDGE

SEQ ID NO: 105567 - protein, 30 aa, Artificial Sequence
  Description of Artificial Sequence: Synthetic polypeptide
DEGCIATTNPVAYEQWGCFSWDNLDIGNNR

SEQ ID NO: 105568 - protein, 34 aa, Artificial Sequence
  Description of Artificial Sequence: Synthetic polypeptide
TEEEIRTTNPVATEQYGSVSPDVNLAQMTEEHYP

SEQ ID NO: 105569 - protein, 35 aa, Artificial Sequence
  Description of Artificial Sequence: Synthetic polypeptide
TEEEIRTTNPVATEQYGSVSPDVNQLAQMMIEHPR

SEQ ID NO: 105570 - protein, 34 aa, Artificial Sequence
  Description of Artificial Sequence: Synthetic polypeptide
AEEEIRATNPCATEQYGSVSTEGNNLEEIGTNMD

SEQ ID NO: 105571 - protein, 32 aa, Artificial Sequence
  Description of Artificial Sequence: Synthetic polypeptide
DEGEIACTNPVATEQYGCVATNLQPDPINAQD

SEQ ID NO: 105572 - protein, 35 aa, Artificial Sequence
  Description of Artificial Sequence: Synthetic polypeptide
AEEEIRATNPCATEQYGSVSTEENQLNQEIGTNVD

SEQ ID NO: 105573 - protein, 34 aa, Artificial Sequence
  Description of Artificial Sequence: Synthetic polypeptide
AEEEIRATNPCATEQYGSVSTDQQNLLEQGTNVD

SEQ ID NO: 105574 - protein, 34 aa, Artificial Sequence
  Description of Artificial Sequence: Synthetic polypeptide
TEEEIRTTNPVATEQYGTTVSTNPSGDRVANNSS

SEQ ID NO: 105575 - protein, 31 aa, Artificial Sequence
  Description of Artificial Sequence: Synthetic polypeptide
DEVEIATTNPVAYEQYGTVVTNPGLGENNGN

SEQ ID NO: 105576 - protein, 33 aa, Artificial Sequence
  Description of Artificial Sequence: Synthetic polypeptide
TEEEIRTTNPVATERWGCVPSCLNGSQYEGNNR

SEQ ID NO: 105577 - protein, 34 aa, Artificial Sequence
  Description of Artificial Sequence: Synthetic polypeptide
TEEEIRTTNPVATERYGKVISTNLSDMVDGGNNE

SEQ ID NO: 105578 - protein, 32 aa, Artificial Sequence
  Description of Artificial Sequence: Synthetic polypeptide
DEGAIATTNPVAYEQWGCSFSTNGLDIDGNNR

SEQ ID NO: 105579 - protein, 31 aa, Artificial Sequence
  Description of Artificial Sequence: Synthetic polypeptide
DEGAIATTNPVAYEQWGCSFSTNGIDIDGNR

SEQ ID NO: 105580 - protein, 31 aa, Artificial Sequence
  Description of Artificial Sequence: Synthetic polypeptide
DEGAIATTNPVAYEQWGCSFSTNDIENGNTR

SEQ ID NO: 105581 - protein, 31 aa, Artificial Sequence
  Description of Artificial Sequence: Synthetic polypeptide
DEVEIATTNPVAYEQYGTVVTNPGLGENSEE

SEQ ID NO: 105582 - protein, 36 aa, Artificial Sequence
  Description of Artificial Sequence: Synthetic polypeptide
TEEEIRTTNPVATERYGQSVVGCTNLPQSSGGNNRY

SEQ ID NO: 105583 - protein, 35 aa, Artificial Sequence
  Description of Artificial Sequence: Synthetic polypeptide
TEEEIRTTNPVATERYGSTVPSNAGNLSDEFGNNR

SEQ ID NO: 105584 - protein, 29 aa, Artificial Sequence
  Description of Artificial Sequence: Synthetic peptide
AEEEICTTNPVATEQYGVVAVEQEQDEEE

SEQ ID NO: 105585 - protein, 32 aa, Artificial Sequence
  Description of Artificial Sequence: Synthetic polypeptide
DEFVIRTTNPVATEQYGCVPTPDWPQTFGNQF

SEQ ID NO: 105586 - protein, 34 aa, Artificial Sequence
  Description of Artificial Sequence: Synthetic polypeptide
DEVEIATTNPVAYEQYGVSVSATNDLGQMNDIAR

SEQ ID NO: 105587 - protein, 33 aa, Artificial Sequence
  Description of Artificial Sequence: Synthetic polypeptide
DDEEIRTTNPVATEQYGCVCSTGNHQNFISEQD

SEQ ID NO: 105588 - protein, 36 aa, Artificial Sequence
  Description of Artificial Sequence: Synthetic polypeptide
EEEEIRTTNPVATEQYGSVTTVVTNLNQQGNQNGNE

SEQ ID NO: 105589 - protein, 34 aa, Artificial Sequence
  Description of Artificial Sequence: Synthetic polypeptide
DDEEIRTTNPVATEQYGCVCSTMEDHQNFGSNQD

SEQ ID NO: 105590 - protein, 33 aa, Artificial Sequence
  Description of Artificial Sequence: Synthetic polypeptide
DDEEIRTTNPVATEQYGCVCSTMEHQNFGSDQA

SEQ ID NO: 105591 - protein, 36 aa, Artificial Sequence
  Description of Artificial Sequence: Synthetic polypeptide
EEEEIRTTNPVATEQYGSVSTVNNQQGNQQGENTDT

SEQ ID NO: 105592 - protein, 32 aa, Artificial Sequence
  Description of Artificial Sequence: Synthetic polypeptide
DEVEIATTNPVAYERWGEVSTNLPQGNDNDER

SEQ ID NO: 105593 - protein, 32 aa, Artificial Sequence
  Description of Artificial Sequence: Synthetic polypeptide
DEVEIATTNPVAYERWGSVATNMQGNDMGNER

SEQ ID NO: 105594 - protein, 35 aa, Artificial Sequence
  Description of Artificial Sequence: Synthetic polypeptide
EEEEIRTTNPVATEQYGSVSTTVNNQQLQNATETG

SEQ ID NO: 105595 - protein, 36 aa, Artificial Sequence
  Description of Artificial Sequence: Synthetic polypeptide
EEEEIRTTNPVATEQYGSVSTTTNQQGQQQGENQDD

SEQ ID NO: 105596 - protein, 31 aa, Artificial Sequence
  Description of Artificial Sequence: Synthetic polypeptide
DEVEIATTNPVAYEQYGTVVTNPGNLGENEQ

SEQ ID NO: 105597 - protein, 36 aa, Artificial Sequence
  Description of Artificial Sequence: Synthetic polypeptide
EEEEIRTTNPVATEQYGSVTVVTNLQLQQGNQNGNE

SEQ ID NO: 105598 - protein, 34 aa, Artificial Sequence
  Description of Artificial Sequence: Synthetic polypeptide
TEEEIRTTNPVATEQYGSVYTPTHNYSLEGTNDD

SEQ ID NO: 105599 - protein, 36 aa, Artificial Sequence
  Description of Artificial Sequence: Synthetic polypeptide
EEEEIRTTNPVATEQYGSVTVVTTNLGQQQGNNQQD

SEQ ID NO: 105600 - protein, 35 aa, Artificial Sequence
  Description of Artificial Sequence: Synthetic polypeptide
AEEEIRATNPCATEQYGSVSTDNNQLLEQIGTNVD

SEQ ID NO: 105601 - protein, 35 aa, Artificial Sequence
  Description of Artificial Sequence: Synthetic polypeptide
AEEEICTTNPVATEQYGVVSVTVTNLQQGNGNNAD

SEQ ID NO: 105602 - protein, 33 aa, Artificial Sequence
  Description of Artificial Sequence: Synthetic polypeptide
DDEEIRTTNPVATEQYGCVCSTEHTEHFGSNQT

SEQ ID NO: 105603 - protein, 35 aa, Artificial Sequence
  Description of Artificial Sequence: Synthetic polypeptide
AEEEICTTNPVATEQYGVVSVTTTNLQSGNNNQQD

SEQ ID NO: 105604 - protein, 35 aa, Artificial Sequence
  Description of Artificial Sequence: Synthetic polypeptide
AEEEICTTNPVATEQYGVVSVTTTNLQEGGNNEDD

SEQ ID NO: 105605 - protein, 34 aa, Artificial Sequence
  Description of Artificial Sequence: Synthetic polypeptide
DDEEIRTTNPVATEQYGCVCSTELNQENFGSEQS

SEQ ID NO: 105606 - protein, 36 aa, Artificial Sequence
  Description of Artificial Sequence: Synthetic polypeptide
EEEEIRTTNPVATEQYGVVSTTTNLGQQQGTNNQDD

SEQ ID NO: 105607 - protein, 36 aa, Artificial Sequence
  Description of Artificial Sequence: Synthetic polypeptide
EEEEIRTTNPVATEQYGVVSTTNLQQGNQQGNEEDD

SEQ ID NO: 105608 - protein, 35 aa, Artificial Sequence
  Description of Artificial Sequence: Synthetic polypeptide
EEEEIRTTNPVATEQYGVVSTSNNNNQQQGENTDE

SEQ ID NO: 105609 - protein, 36 aa, Artificial Sequence
  Description of Artificial Sequence: Synthetic polypeptide
EEEEIRTTNPVATEQYGVVSTNLQAGTETGSTNTDD

SEQ ID NO: 105610 - protein, 36 aa, Artificial Sequence
  Description of Artificial Sequence: Synthetic polypeptide
AEEEICTTNPVATEQYGVVSVTSTNLQAGNTNNQED

SEQ ID NO: 105611 - protein, 35 aa, Artificial Sequence
  Description of Artificial Sequence: Synthetic polypeptide
EEEEIRTTNPVATEQYGVVSTNLNAGTEAGTNTDD

SEQ ID NO: 105612 - protein, 35 aa, Artificial Sequence
  Description of Artificial Sequence: Synthetic polypeptide
TEEEIRTTNPVATEQYGSVSVANGEGQGGQGENGD

SEQ ID NO: 105613 - protein, 36 aa, Artificial Sequence
  Description of Artificial Sequence: Synthetic polypeptide
EEEEIRTTNPVATEQYGSVVVVVTTNLGQQGENQDD

SEQ ID NO: 105614 - protein, 36 aa, Artificial Sequence
  Description of Artificial Sequence: Synthetic polypeptide
EEEEIRTTNPVATEQYGSVVVVTTNLLGQQGTNQDD

SEQ ID NO: 105615 - protein, 35 aa, Artificial Sequence
  Description of Artificial Sequence: Synthetic polypeptide
TEEEIRTTNPVATEQYGSVTTDNDQGGEGEEGNIE

SEQ ID NO: 105616 - protein, 33 aa, Artificial Sequence
  Description of Artificial Sequence: Synthetic polypeptide
TEEEIRTTNPVATEQYGSVVATAGQNNGEFTEI

SEQ ID NO: 105617 - protein, 36 aa, Artificial Sequence
  Description of Artificial Sequence: Synthetic polypeptide
EEEEIRTTNPVATEQYGSVVVVTTNLGLQQGENQDD

SEQ ID NO: 105618 - protein, 29 aa, Artificial Sequence
  Description of Artificial Sequence: Synthetic peptide
AEEEICTTNPVATEQYGVVAVEVQQEEEE

SEQ ID NO: 105619 - protein, 35 aa, Artificial Sequence
  Description of Artificial Sequence: Synthetic polypeptide
TEEEIRTTNPVATEQYGSVVSVGDLGQRFNNNFQF

SEQ ID NO: 105620 - protein, 36 aa, Artificial Sequence
  Description of Artificial Sequence: Synthetic polypeptide
EEEEIRTTNPVATEQYGSVTVVVTNLLQGNQNGNEE

SEQ ID NO: 105621 - protein, 34 aa, Artificial Sequence
  Description of Artificial Sequence: Synthetic polypeptide
DDEEIRTTNPVATEQYGCVCSTENHQNFGSDTQD

SEQ ID NO: 105622 - protein, 33 aa, Artificial Sequence
  Description of Artificial Sequence: Synthetic polypeptide
DEGAIRCTNPVATEQYGCSVSTLEELRGGQNTM

SEQ ID NO: 105623 - protein, 36 aa, Artificial Sequence
  Description of Artificial Sequence: Synthetic polypeptide
EEEEIRTTNPVATEQYGVVSTTTNNLGNQQGNNQDD

SEQ ID NO: 105624 - protein, 36 aa, Artificial Sequence
  Description of Artificial Sequence: Synthetic polypeptide
EEEEIRTTNPVATEQYGSVSTTSNNNNQQQGENQEE

SEQ ID NO: 105625 - protein, 32 aa, Artificial Sequence
  Description of Artificial Sequence: Synthetic polypeptide
DEGEIACTNPVATEQYGCVATNLQTDNNTTSN

SEQ ID NO: 105626 - protein, 32 aa, Artificial Sequence
  Description of Artificial Sequence: Synthetic polypeptide
DEGEIACTNPVATEQYGCVATNLTSPGDNTQM

SEQ ID NO: 105627 - protein, 32 aa, Artificial Sequence
  Description of Artificial Sequence: Synthetic polypeptide
TEEEIRTTNPVATEQYGDVVGVGNMTGGGGNT

SEQ ID NO: 105628 - protein, 34 aa, Artificial Sequence
  Description of Artificial Sequence: Synthetic polypeptide
TEEEIRTTNPVATEQYGETIFCHNMLSDRGGNPR

SEQ ID NO: 105629 - protein, 35 aa, Artificial Sequence
  Description of Artificial Sequence: Synthetic polypeptide
TEEEIRTTNPVATEQYGHVPNATQNELSQRVTNYE

SEQ ID NO: 105630 - protein, 34 aa, Artificial Sequence
  Description of Artificial Sequence: Synthetic polypeptide
EEETICTTNPVATEQYGSVSTNNQQQLQGTNQSD

SEQ ID NO: 105631 - protein, 34 aa, Artificial Sequence
  Description of Artificial Sequence: Synthetic polypeptide
EEETICTTNPVATEQYGSVSTNNNSEQYGTNESG

SEQ ID NO: 105632 - protein, 30 aa, Artificial Sequence
  Description of Artificial Sequence: Synthetic polypeptide
DEGEIAPTNPCSSEQYGIVSTTNLQSGTPV

SEQ ID NO: 105633 - protein, 31 aa, Artificial Sequence
  Description of Artificial Sequence: Synthetic polypeptide
DEVEIATTNPVAYEQWGTVSTNMNMGDDGRQ

SEQ ID NO: 105634 - protein, 30 aa, Artificial Sequence
  Description of Artificial Sequence: Synthetic polypeptide
DEVEIATTNPVAYEQWGTVVTNPGLGENSE

SEQ ID NO: 105635 - protein, 33 aa, Artificial Sequence
  Description of Artificial Sequence: Synthetic polypeptide
TEEEIRTTNPVATEQYGSIMCRPVLNKDGNTRS

SEQ ID NO: 105636 - protein, 32 aa, Artificial Sequence
  Description of Artificial Sequence: Synthetic polypeptide
DEVEIATTNPVAYEQWGVVCSTNDQSGGENEP

SEQ ID NO: 105637 - protein, 35 aa, Artificial Sequence
  Description of Artificial Sequence: Synthetic polypeptide
TEEEIRTTNPVATEQYGCVPNCTSNALSQRNTNYE

SEQ ID NO: 105638 - protein, 34 aa, Artificial Sequence
  Description of Artificial Sequence: Synthetic polypeptide
AEEEIRCTNPVATEQYGSVSSTPAGPNMRNGNPV

SEQ ID NO: 105639 - protein, 34 aa, Artificial Sequence
  Description of Artificial Sequence: Synthetic polypeptide
EEETICTTNPVATEQYGSVSTNNNSEQLNGTNSG

SEQ ID NO: 105640 - protein, 32 aa, Artificial Sequence
  Description of Artificial Sequence: Synthetic polypeptide
DEVEIATTNPVAYEQYGSVAATANDMTADGNE

SEQ ID NO: 105641 - protein, 35 aa, Artificial Sequence
  Description of Artificial Sequence: Synthetic polypeptide
AEEEIRATNPVATEQYGSVAGTPNPLPDNQGGNQN

SEQ ID NO: 105642 - protein, 29 aa, Artificial Sequence
  Description of Artificial Sequence: Synthetic peptide
DEGEIAPTNPCSSEQYGIVSCNLQQSGTH

SEQ ID NO: 105643 - protein, 29 aa, Artificial Sequence
  Description of Artificial Sequence: Synthetic peptide
DEGEIAPTNPCSSEQYGIVSCNLQQQGTH

SEQ ID NO: 105644 - protein, 32 aa, Artificial Sequence
  Description of Artificial Sequence: Synthetic polypeptide
DEVEIATTNPVAYEQYGSVAIANNDTQDGNDM

SEQ ID NO: 105645 - protein, 29 aa, Artificial Sequence
  Description of Artificial Sequence: Synthetic peptide
DEGEIAPTNPCSSEQYGIVSCNLQDSGTL

SEQ ID NO: 105646 - protein, 29 aa, Artificial Sequence
  Description of Artificial Sequence: Synthetic peptide
DEGEIAPTNPCSSEQYGIVSCNLQDHGTL

SEQ ID NO: 105647 - protein, 29 aa, Artificial Sequence
  Description of Artificial Sequence: Synthetic peptide
DEGEIAPTNPCSSEQYGIVSCNLQDHGEL

SEQ ID NO: 105648 - protein, 29 aa, Artificial Sequence
  Description of Artificial Sequence: Synthetic peptide
DEGEIAPTNPCSSEQYGIVSCNIQQQGTR

SEQ ID NO: 105649 - protein, 34 aa, Artificial Sequence
  Description of Artificial Sequence: Synthetic polypeptide
AEEEIRCTNPVATEQYGEASSTEPNGQRNGMGPR

SEQ ID NO: 105650 - protein, 34 aa, Artificial Sequence
  Description of Artificial Sequence: Synthetic polypeptide
TEEEIRTTNPVATEQYGCVCNTGNPNQNGSNNQA

SEQ ID NO: 105651 - protein, 35 aa, Artificial Sequence
  Description of Artificial Sequence: Synthetic polypeptide
TEEEIRTTNPVATEQYGCVCNTGNLNQSFGSENQA

SEQ ID NO: 105652 - protein, 34 aa, Artificial Sequence
  Description of Artificial Sequence: Synthetic polypeptide
TEEEIRTTNPVATEQYGCVCNTGNLNINFGSNNQ

SEQ ID NO: 105653 - protein, 32 aa, Artificial Sequence
  Description of Artificial Sequence: Synthetic polypeptide
DEVEIATTNPVAYEQWGTVSTNLNMNGDDGRG

SEQ ID NO: 105654 - protein, 28 aa, Artificial Sequence
  Description of Artificial Sequence: Synthetic peptide
EENEIATTNPVATECYGCVSECMQHEEA

SEQ ID NO: 105655 - protein, 28 aa, Artificial Sequence
  Description of Artificial Sequence: Synthetic peptide
EENEIATTNPVATECWGDVSECLQHEHE

SEQ ID NO: 105656 - protein, 28 aa, Artificial Sequence
  Description of Artificial Sequence: Synthetic peptide
EENEIAATNPVATECYGDVSECLQHEEL

SEQ ID NO: 105657 - protein, 34 aa, Artificial Sequence
  Description of Artificial Sequence: Synthetic polypeptide
TEEEIRTTNPVATEQWGSVCSKTDDQDQRNANDY

SEQ ID NO: 105658 - protein, 35 aa, Artificial Sequence
  Description of Artificial Sequence: Synthetic polypeptide
TEEEIRTTNPVATEQWGSVCSKTNDDLDDRNANDQ

SEQ ID NO: 105659 - protein, 30 aa, Artificial Sequence
  Description of Artificial Sequence: Synthetic polypeptide
DEGEIAPTNPCSTEQYGIVSCNLEDSEGER

SEQ ID NO: 105660 - protein, 30 aa, Artificial Sequence
  Description of Artificial Sequence: Synthetic polypeptide
DEGEIAPTNPCSTEQYGIVSCNLEDHEGER

SEQ ID NO: 105661 - protein, 35 aa, Artificial Sequence
  Description of Artificial Sequence: Synthetic polypeptide
TEEEIRTTNPVATEQWGSVCSKTPDDLDQRNQNDS

SEQ ID NO: 105662 - protein, 30 aa, Artificial Sequence
  Description of Artificial Sequence: Synthetic polypeptide
DEGEIAPTNPCSSEQYGTVCSTNLVESGTR

SEQ ID NO: 105663 - protein, 30 aa, Artificial Sequence
  Description of Artificial Sequence: Synthetic polypeptide
DEGEIAPTNPCSSEQYGTVCSTNLVEFGTR

SEQ ID NO: 105664 - protein, 32 aa, Artificial Sequence
  Description of Artificial Sequence: Synthetic polypeptide
DEVEIATTNPVAYEQWGTVSTNLQGEEGGQGP

SEQ ID NO: 105665 - protein, 31 aa, Artificial Sequence
  Description of Artificial Sequence: Synthetic polypeptide
DEGEIAPTNPCSSEQYGTVCSTDNLVQSGTR

SEQ ID NO: 105666 - protein, 35 aa, Artificial Sequence
  Description of Artificial Sequence: Synthetic polypeptide
AEEEIRTTNPVATEAWGSVCSKTNDDLDQRNAGDG

SEQ ID NO: 105667 - protein, 31 aa, Artificial Sequence
  Description of Artificial Sequence: Synthetic polypeptide
EEIEIATTNPVSTEIYGIVSTHNQNDQDPNR

SEQ ID NO: 105668 - protein, 33 aa, Artificial Sequence
  Description of Artificial Sequence: Synthetic polypeptide
DEVEIATTNPVAYEQWGTVSTNLQGEHGGNTGP

SEQ ID NO: 105669 - protein, 34 aa, Artificial Sequence
  Description of Artificial Sequence: Synthetic polypeptide
TEEEIRTTNPVATEQYGAVMGDGTNGQGEGNNGT

SEQ ID NO: 105670 - protein, 29 aa, Artificial Sequence
  Description of Artificial Sequence: Synthetic peptide
EEGEIAATNPCSSEQYGEVSCNLQSGGTR

SEQ ID NO: 105671 - protein, 35 aa, Artificial Sequence
  Description of Artificial Sequence: Synthetic polypeptide
EEEVIRTTNPVATEQYGCSVVSTNAHSDNTGTNNR

SEQ ID NO: 105672 - protein, 34 aa, Artificial Sequence
  Description of Artificial Sequence: Synthetic polypeptide
TEEEIRTTNPVATEQYGCVCGTGELNQNGSDNQA

SEQ ID NO: 105673 - protein, 34 aa, Artificial Sequence
  Description of Artificial Sequence: Synthetic polypeptide
TEEEIRTTNPVATEQYGCVCNTGELNQNFGSENQ

SEQ ID NO: 105674 - protein, 34 aa, Artificial Sequence
  Description of Artificial Sequence: Synthetic polypeptide
TEEEIRTTNPVATEQYGCVCNTGEPNQRFGSNTQ

SEQ ID NO: 105675 - protein, 34 aa, Artificial Sequence
  Description of Artificial Sequence: Synthetic polypeptide
TEEEIRTTNPVATEQYGCVCNTGNHNQNGSDNQS

SEQ ID NO: 105676 - protein, 31 aa, Artificial Sequence
  Description of Artificial Sequence: Synthetic polypeptide
AEEEIRATNPVATEQYGSVAAGNHDAPSGSN

SEQ ID NO: 105677 - protein, 32 aa, Artificial Sequence
  Description of Artificial Sequence: Synthetic polypeptide
DEGEIACTNPVATEQYGCVATNLQTENNTPQV

SEQ ID NO: 105678 - protein, 34 aa, Artificial Sequence
  Description of Artificial Sequence: Synthetic polypeptide
EEETICTTNPVATEQYGSVSTNNNSEQLGTNLEG

SEQ ID NO: 105679 - protein, 28 aa, Artificial Sequence
  Description of Artificial Sequence: Synthetic peptide
DEGEIAPTNPCSSEPYGTVSCNLQQGTH

SEQ ID NO: 105680 - protein, 35 aa, Artificial Sequence
  Description of Artificial Sequence: Synthetic polypeptide
TEEEIRTTNPVATEQYGSVPNCVENALSQRVENPE

SEQ ID NO: 105681 - protein, 35 aa, Artificial Sequence
  Description of Artificial Sequence: Synthetic polypeptide
AEEEIRATNPCATEQYGSVSTVGNQLNQQIGTNTD

SEQ ID NO: 105682 - protein, 34 aa, Artificial Sequence
  Description of Artificial Sequence: Synthetic polypeptide
AEEEIRATNPCATEQYGSVSTVGNNLEQGTNTQD

SEQ ID NO: 105683 - protein, 34 aa, Artificial Sequence
  Description of Artificial Sequence: Synthetic polypeptide
AEEEIRATNPCATEQYGSVSTSLQLNQQIGTNVD

SEQ ID NO: 105684 - protein, 34 aa, Artificial Sequence
  Description of Artificial Sequence: Synthetic polypeptide
TEEEIRTTNPVATEQYGSVQVTLAVIDNGQFYNS

SEQ ID NO: 105685 - protein, 34 aa, Artificial Sequence
  Description of Artificial Sequence: Synthetic polypeptide
DDEEIRTTNPVATEQYGCVCSNTELQNFGSDTQP

SEQ ID NO: 105686 - protein, 35 aa, Artificial Sequence
  Description of Artificial Sequence: Synthetic polypeptide
AEEEIRATNPCATEQYGSVSTEQNNLMEQIGTNVT

SEQ ID NO: 105687 - protein, 34 aa, Artificial Sequence
  Description of Artificial Sequence: Synthetic polypeptide
AEEEIRATNPCATEQYGSVSTEQNLMEIGTNNDT

SEQ ID NO: 105688 - protein, 33 aa, Artificial Sequence
  Description of Artificial Sequence: Synthetic polypeptide
DEGEIACTNPVAYEQYGSVATNNLQSEGPNEQV

SEQ ID NO: 105689 - protein, 28 aa, Artificial Sequence
  Description of Artificial Sequence: Synthetic peptide
AENEIASTNPVGTEGYGEMASNLQRGDI

SEQ ID NO: 105690 - protein, 35 aa, Artificial Sequence
  Description of Artificial Sequence: Synthetic polypeptide
TEEEIRTTNPVATEQYGSVPNCTSNALSQFVTNYE

SEQ ID NO: 105691 - protein, 35 aa, Artificial Sequence
  Description of Artificial Sequence: Synthetic polypeptide
AEEEIRATNPCATEQYGSVSTENQLNQQIGTNDED

SEQ ID NO: 105692 - protein, 33 aa, Artificial Sequence
  Description of Artificial Sequence: Synthetic polypeptide
EEEEIRTTNPVAYEQWGYATISPNEGDQRGGNR

SEQ ID NO: 105693 - protein, 35 aa, Artificial Sequence
  Description of Artificial Sequence: Synthetic polypeptide
AEEEIRATNPCATEQYGSVSTENQLLNQIGTNNVN

SEQ ID NO: 105694 - protein, 35 aa, Artificial Sequence
  Description of Artificial Sequence: Synthetic polypeptide
TEEEIRTTNPVATEQYGSVSCPNDLDQMNSEVMRM

SEQ ID NO: 105695 - protein, 35 aa, Artificial Sequence
  Description of Artificial Sequence: Synthetic polypeptide
TEEEIRTTNPVATEQYGSVSCTDDLEQMESEEMRM

SEQ ID NO: 105696 - protein, 35 aa, Artificial Sequence
  Description of Artificial Sequence: Synthetic polypeptide
AEEEIRATNPCATEQYGSVSTENNQLQGEIGTNME

SEQ ID NO: 105697 - protein, 35 aa, Artificial Sequence
  Description of Artificial Sequence: Synthetic polypeptide
AEEEIRATNPCATEQYGSVSTENNNLQNEEIGTNM

SEQ ID NO: 105698 - protein, 35 aa, Artificial Sequence
  Description of Artificial Sequence: Synthetic polypeptide
AEEEIRATNPCATEQYGSVSTENNNLLQIGTNNVN

SEQ ID NO: 105699 - protein, 35 aa, Artificial Sequence
  Description of Artificial Sequence: Synthetic polypeptide
AEEEIRATNPCATEQYGSVSTENNLNQQIGTNTVD

SEQ ID NO: 105700 - protein, 35 aa, Artificial Sequence
  Description of Artificial Sequence: Synthetic polypeptide
DDEEIRTTNPVATEQYGCVCSNTGNHQENFGSNQD

SEQ ID NO: 105701 - protein, 34 aa, Artificial Sequence
  Description of Artificial Sequence: Synthetic polypeptide
AEEEIRATNPCATEQYGSVSTENNLMEIGTNEMN

SEQ ID NO: 105702 - protein, 32 aa, Artificial Sequence
  Description of Artificial Sequence: Synthetic polypeptide
EEEEIRTTNPVAYEQWGYTISPNEGDQRNGNG

SEQ ID NO: 105703 - protein, 28 aa, Artificial Sequence
  Description of Artificial Sequence: Synthetic peptide
AENEIASTNPVGTEQYGEMSETLQHGDI

SEQ ID NO: 105704 - protein, 34 aa, Artificial Sequence
  Description of Artificial Sequence: Synthetic polypeptide
TEEEIRTTNPVATEQYGSVPLTNNLERNVSDQQM

SEQ ID NO: 105705 - protein, 30 aa, Artificial Sequence
  Description of Artificial Sequence: Synthetic polypeptide
DEGEIAPTNPCASEQYGTVCSTNPVEFGTR

SEQ ID NO: 105706 - protein, 28 aa, Artificial Sequence
  Description of Artificial Sequence: Synthetic peptide
DEGEIAPTNPCSSEPYGIVSCNLQSGTH

SEQ ID NO: 105707 - protein, 28 aa, Artificial Sequence
  Description of Artificial Sequence: Synthetic peptide
DEGEIAPTNPCSSEPYGIVSCNLQQGTH

SEQ ID NO: 105708 - protein, 28 aa, Artificial Sequence
  Description of Artificial Sequence: Synthetic peptide
DEGEIAPTNPCSSECYGAVSCNLQSGTI

SEQ ID NO: 105709 - protein, 34 aa, Artificial Sequence
  Description of Artificial Sequence: Synthetic polypeptide
AEEEIRATNPVATEQYGCVAITNHALEQGEGGNH

SEQ ID NO: 105710 - protein, 32 aa, Artificial Sequence
  Description of Artificial Sequence: Synthetic polypeptide
AEEEIRATNPVATEQYGCVAITHDEQTGEGGR

SEQ ID NO: 105711 - protein, 34 aa, Artificial Sequence
  Description of Artificial Sequence: Synthetic polypeptide
AEEEIRATNPVATEQYGCNVAITNHDEQAGMENR

SEQ ID NO: 105712 - protein, 33 aa, Artificial Sequence
  Description of Artificial Sequence: Synthetic polypeptide
AEEEIRATNPVATEQWGCVAITNLEQTGEGGSR

SEQ ID NO: 105713 - protein, 33 aa, Artificial Sequence
  Description of Artificial Sequence: Synthetic polypeptide
TEEEIRTTNPVATEQYGSVAAVTLALINGQQFP

SEQ ID NO: 105714 - protein, 33 aa, Artificial Sequence
  Description of Artificial Sequence: Synthetic polypeptide
TEEEIRTTNPVATEQYGSVADTAGQNGGGQGEQ

SEQ ID NO: 105715 - protein, 28 aa, Artificial Sequence
  Description of Artificial Sequence: Synthetic peptide
DEGEIAPTNPCSSECYGAVSCDLQSGTR

SEQ ID NO: 105716 - protein, 33 aa, Artificial Sequence
  Description of Artificial Sequence: Synthetic polypeptide
TEEEIRTTNPVATEQYGSVAVTLALINGQQQEP

SEQ ID NO: 105717 - protein, 33 aa, Artificial Sequence
  Description of Artificial Sequence: Synthetic polypeptide
TEEEIRTTNPVATEQYGSVAVTLALPINGQQLP

SEQ ID NO: 105718 - protein, 35 aa, Artificial Sequence
  Description of Artificial Sequence: Synthetic polypeptide
EEETICTTNPVATEQYGSVSTNLNNSEQLGTNGNG

SEQ ID NO: 105719 - protein, 33 aa, Artificial Sequence
  Description of Artificial Sequence: Synthetic polypeptide
DEVEIATTNPVAYEQYGSVCGATNVLNREDNDS

SEQ ID NO: 105720 - protein, 34 aa, Artificial Sequence
  Description of Artificial Sequence: Synthetic polypeptide
EEETICTTNPVATEQYGSVSTMNNNQNQIGTNSA

SEQ ID NO: 105721 - protein, 36 aa, Artificial Sequence
  Description of Artificial Sequence: Synthetic polypeptide
TEEEIRTTNPVATEQYGSVGDFTNDGQEGGNTQGDR

SEQ ID NO: 105722 - protein, 29 aa, Artificial Sequence
  Description of Artificial Sequence: Synthetic peptide
DEGEIAPTNPCATEQYGTVSCDNPEFGTD

SEQ ID NO: 105723 - protein, 30 aa, Artificial Sequence
  Description of Artificial Sequence: Synthetic polypeptide
DEGEIAPTNPCATEQYGTVSATDNPEFGTD

SEQ ID NO: 105724 - protein, 29 aa, Artificial Sequence
  Description of Artificial Sequence: Synthetic peptide
DEGEIAPTNPCATEQWGIVSCNEMSAGDR

SEQ ID NO: 105725 - protein, 28 aa, Artificial Sequence
  Description of Artificial Sequence: Synthetic peptide
AENEIASTNPVGTEQYGEMSSTLQHGDI

SEQ ID NO: 105726 - protein, 29 aa, Artificial Sequence
  Description of Artificial Sequence: Synthetic peptide
DEGEIAPTNPCATEQWGIVSCNEMAAGDR

SEQ ID NO: 105727 - protein, 34 aa, Artificial Sequence
  Description of Artificial Sequence: Synthetic polypeptide
TEEEIRTTNPVATEQYGSVNETSNWIDWQGENYQ

SEQ ID NO: 105728 - protein, 35 aa, Artificial Sequence
  Description of Artificial Sequence: Synthetic polypeptide
AEEEIRATNPCATEQYGSVSTVNQLSNQQIGTNAD

SEQ ID NO: 105729 - protein, 29 aa, Artificial Sequence
  Description of Artificial Sequence: Synthetic peptide
DEGEIAPTNPCSSEQWGIVSCNLQNSGTR

SEQ ID NO: 105730 - protein, 30 aa, Artificial Sequence
  Description of Artificial Sequence: Synthetic polypeptide
DENEIATTNPVATEQWGSVSEDEENHEGDA

SEQ ID NO: 105731 - protein, 31 aa, Artificial Sequence
  Description of Artificial Sequence: Synthetic polypeptide
DENEIATVNPVSTEQYGVVSMENIQQQQGNH

SEQ ID NO: 105732 - protein, 30 aa, Artificial Sequence
  Description of Artificial Sequence: Synthetic polypeptide
DENEIATTNPVATEQWGSVSEILMNHAEEA

SEQ ID NO: 105733 - protein, 34 aa, Artificial Sequence
  Description of Artificial Sequence: Synthetic polypeptide
DESEIRTTNPVATECWGSVSCQNEPQDREGENGT

SEQ ID NO: 105734 - protein, 34 aa, Artificial Sequence
  Description of Artificial Sequence: Synthetic polypeptide
DEQEIATTNPVATEQYGSVSSATDLEDHNGMNDV

SEQ ID NO: 105735 - protein, 34 aa, Artificial Sequence
  Description of Artificial Sequence: Synthetic polypeptide
DEQEIATTNPVATEQYGSVSSATDLEDHEGMNDV

SEQ ID NO: 105736 - protein, 33 aa, Artificial Sequence
  Description of Artificial Sequence: Synthetic polypeptide
DEQEIATTNPVATEQYGSVSSATDLEDHEGEPL

SEQ ID NO: 105737 - protein, 33 aa, Artificial Sequence
  Description of Artificial Sequence: Synthetic polypeptide
DEQEIATTNPVATEQYGSVSSATDLEDHEGEDV

SEQ ID NO: 105738 - protein, 33 aa, Artificial Sequence
  Description of Artificial Sequence: Synthetic polypeptide
DEQEIATTNPVATEQYGSVSSATDLEDHEGEDL

SEQ ID NO: 105739 - protein, 33 aa, Artificial Sequence
  Description of Artificial Sequence: Synthetic polypeptide
DEQEIATTNPVATEQYGSVSSATDGNDHEGEDV

SEQ ID NO: 105740 - protein, 34 aa, Artificial Sequence
  Description of Artificial Sequence: Synthetic polypeptide
DEQEIATTNPVATEQYGSVSSATALEDHNGMNDV

SEQ ID NO: 105741 - protein, 30 aa, Artificial Sequence
  Description of Artificial Sequence: Synthetic polypeptide
QEHEIRTTNGVAYCQYGSVSLTNENVDGEQ

SEQ ID NO: 105742 - protein, 29 aa, Artificial Sequence
  Description of Artificial Sequence: Synthetic peptide
QEEEIATTNPVATEQYGEAPEVLCQHEEK

SEQ ID NO: 105743 - protein, 33 aa, Artificial Sequence
  Description of Artificial Sequence: Synthetic polypeptide
DESEIRTTNPVATECWGSVSCQNEPQDREIENG

SEQ ID NO: 105744 - protein, 28 aa, Artificial Sequence
  Description of Artificial Sequence: Synthetic peptide
QEEEIATTNPVATEQYGEAPEVKQHEEK

SEQ ID NO: 105745 - protein, 28 aa, Artificial Sequence
  Description of Artificial Sequence: Synthetic peptide
QEEEIATTNPVATEQYGEAPEVIQHEEK

SEQ ID NO: 105746 - protein, 28 aa, Artificial Sequence
  Description of Artificial Sequence: Synthetic peptide
QEEEIATTNPVATEQYGEAPEVIQHEEI

SEQ ID NO: 105747 - protein, 33 aa, Artificial Sequence
  Description of Artificial Sequence: Synthetic polypeptide
DEQEIATTNPVATEQYGSVSPTDLMEDHNGEDL

SEQ ID NO: 105748 - protein, 29 aa, Artificial Sequence
  Description of Artificial Sequence: Synthetic peptide
QEEEIATTNPVATEQYGEAPEVICQHGEK

SEQ ID NO: 105749 - protein, 29 aa, Artificial Sequence
  Description of Artificial Sequence: Synthetic peptide
QEEEIATTNPVATEQYGEAPEVHQHEENV

SEQ ID NO: 105750 - protein, 32 aa, Artificial Sequence
  Description of Artificial Sequence: Synthetic polypeptide
DEQEIATTNPVATEQYGSVSPKDLEDHEGEDL

SEQ ID NO: 105751 - protein, 28 aa, Artificial Sequence
  Description of Artificial Sequence: Synthetic peptide
QEEEIATTNPVATEQYGEAPEVHQHEEK

SEQ ID NO: 105752 - protein, 28 aa, Artificial Sequence
  Description of Artificial Sequence: Synthetic peptide
QEEEIATTNPVATEQYGEAPEVGQSNEK

SEQ ID NO: 105753 - protein, 33 aa, Artificial Sequence
  Description of Artificial Sequence: Synthetic polypeptide
DEQEIATTNPVATEQYGSVSNTDQLEDHEGEDL

SEQ ID NO: 105754 - protein, 33 aa, Artificial Sequence
  Description of Artificial Sequence: Synthetic polypeptide
DEQEIATTNPVATEQYGSVSNTDLEDHEGEDLW

SEQ ID NO: 105755 - protein, 28 aa, Artificial Sequence
  Description of Artificial Sequence: Synthetic peptide
QEMEIACTNPCSWEQYGCVSSNLQSGDA

SEQ ID NO: 105756 - protein, 32 aa, Artificial Sequence
  Description of Artificial Sequence: Synthetic polypeptide
DEQEIATTNPVATEQYGSVSMVDLEPHEGEDL

SEQ ID NO: 105757 - protein, 29 aa, Artificial Sequence
  Description of Artificial Sequence: Synthetic peptide
QEMEIACTNPCSWEQYGCVSSNLQSGTRA

SEQ ID NO: 105758 - protein, 33 aa, Artificial Sequence
  Description of Artificial Sequence: Synthetic polypeptide
DEQEIATTNPVATEQYGSVSSATDLMDHEGEDL

SEQ ID NO: 105759 - protein, 33 aa, Artificial Sequence
  Description of Artificial Sequence: Synthetic polypeptide
DEQEIATTNPVATEQYGSVSMTSDLEDHEGEDL

SEQ ID NO: 105760 - protein, 34 aa, Artificial Sequence
  Description of Artificial Sequence: Synthetic polypeptide
DEQEIATTNPVATEQYGSVSSATDLPEMREGEPL

SEQ ID NO: 105761 - protein, 32 aa, Artificial Sequence
  Description of Artificial Sequence: Synthetic polypeptide
CEEEIATTNPVAYEQYGSACSTNPPQEHGTEM

SEQ ID NO: 105762 - protein, 28 aa, Artificial Sequence
  Description of Artificial Sequence: Synthetic peptide
QEEEIATTNPVATEQYGEAPEVMQHEEK

SEQ ID NO: 105763 - protein, 34 aa, Artificial Sequence
  Description of Artificial Sequence: Synthetic polypeptide
DESEIRTTNPVATECWGSVSCPNEPQDREGENGH

SEQ ID NO: 105764 - protein, 28 aa, Artificial Sequence
  Description of Artificial Sequence: Synthetic peptide
QEGTIAPTNPCSSEQYGIVSSNLQSGTR

SEQ ID NO: 105765 - protein, 34 aa, Artificial Sequence
  Description of Artificial Sequence: Synthetic polypeptide
DEQEIATTNPVATEQYGSVSSTTPDLEMREGEDL

SEQ ID NO: 105766 - protein, 34 aa, Artificial Sequence
  Description of Artificial Sequence: Synthetic polypeptide
DEQEIATTNPVATEQYGSVSSTTPDGEMREGNDL

SEQ ID NO: 105767 - protein, 34 aa, Artificial Sequence
  Description of Artificial Sequence: Synthetic polypeptide
DEQEIATTNPVATEQYGSVSSTTPAGNMREGNPV

SEQ ID NO: 105768 - protein, 34 aa, Artificial Sequence
  Description of Artificial Sequence: Synthetic polypeptide
DEQEIATTNPVATEQYGSVSSTTPAGNMREGNPL

SEQ ID NO: 105769 - protein, 34 aa, Artificial Sequence
  Description of Artificial Sequence: Synthetic polypeptide
DEQEIATTNPVATEQYGSVSSTTPAGEMREGNPL

SEQ ID NO: 105770 - protein, 34 aa, Artificial Sequence
  Description of Artificial Sequence: Synthetic polypeptide
DEQEIATTNPVATEQYGSVSSTTPAGEMREGNDL

SEQ ID NO: 105771 - protein, 33 aa, Artificial Sequence
  Description of Artificial Sequence: Synthetic polypeptide
DEQEIATTNPVATEQYGSVSSTTDGEDHNGNDV

SEQ ID NO: 105772 - protein, 34 aa, Artificial Sequence
  Description of Artificial Sequence: Synthetic polypeptide
DEQEIATTNPVATEQYGSVSSTTALEDHNGMNDV

SEQ ID NO: 105773 - protein, 34 aa, Artificial Sequence
  Description of Artificial Sequence: Synthetic polypeptide
DEQEIATTNPVATEQYGSVSSTTALEDHNGMNDL

SEQ ID NO: 105774 - protein, 33 aa, Artificial Sequence
  Description of Artificial Sequence: Synthetic polypeptide
DEQEIATTNPVATEQYGSVSSTTALEDHNGEDL

SEQ ID NO: 105775 - protein, 33 aa, Artificial Sequence
  Description of Artificial Sequence: Synthetic polypeptide
DEQEIATTNPVATEQYGSVSSTTAGEDHNGNDV

SEQ ID NO: 105776 - protein, 33 aa, Artificial Sequence
  Description of Artificial Sequence: Synthetic polypeptide
DEQEIATTNPVATEQYGSVSSTMDLEDHEGEDL

SEQ ID NO: 105777 - protein, 28 aa, Artificial Sequence
  Description of Artificial Sequence: Synthetic peptide
QEGVIAATNPCSSEQYGIVSCNLQSGTR

SEQ ID NO: 105778 - protein, 29 aa, Artificial Sequence
  Description of Artificial Sequence: Synthetic peptide
QEEEIATTNPVATEQYGEAPEVLQYHEEK

SEQ ID NO: 105779 - protein, 28 aa, Artificial Sequence
  Description of Artificial Sequence: Synthetic peptide
QEGVIAPTNPCSSEQYGIVSCNLQSGTR

SEQ ID NO: 105780 - protein, 30 aa, Artificial Sequence
  Description of Artificial Sequence: Synthetic polypeptide
QEHEIAPTNPCSSEQYGCVSCNLQSGDTNR

SEQ ID NO: 105781 - protein, 33 aa, Artificial Sequence
  Description of Artificial Sequence: Synthetic polypeptide
DESEIRTTNPVATECWGSVSCPNEPQGREGEGG

SEQ ID NO: 105782 - protein, 33 aa, Artificial Sequence
  Description of Artificial Sequence: Synthetic polypeptide
DESEIRTTNPVATECWGSVSCPNESQDREVENG

SEQ ID NO: 105783 - protein, 36 aa, Artificial Sequence
  Description of Artificial Sequence: Synthetic polypeptide
AEEEIRTTNPVATEQYGSVVTVANLQNQDEQGTNVT

SEQ ID NO: 105784 - protein, 33 aa, Artificial Sequence
  Description of Artificial Sequence: Synthetic polypeptide
DEQEIATTNPVATEQYGSVSSTDLEDLEGEDLD

SEQ ID NO: 105785 - protein, 33 aa, Artificial Sequence
  Description of Artificial Sequence: Synthetic polypeptide
DESEIRTTNPVATECWGSVSCQNEDQDREGECG

SEQ ID NO: 105786 - protein, 33 aa, Artificial Sequence
  Description of Artificial Sequence: Synthetic polypeptide
DESEIRTTNPVATECWGSVSCQNEPQDEYGENQ

SEQ ID NO: 105787 - protein, 34 aa, Artificial Sequence
  Description of Artificial Sequence: Synthetic polypeptide
DEQEIATTNPVATEQYGSVSSATDLPEMREGEPV

SEQ ID NO: 105788 - protein, 28 aa, Artificial Sequence
  Description of Artificial Sequence: Synthetic peptide
QEGTIAPTNPCSSEQYGIVSCNLQSGTR

SEQ ID NO: 105789 - protein, 32 aa, Artificial Sequence
  Description of Artificial Sequence: Synthetic polypeptide
DEQEIATTNPVATEQYGSVSMTDLEDHEKEDL

SEQ ID NO: 105790 - protein, 29 aa, Artificial Sequence
  Description of Artificial Sequence: Synthetic peptide
QEMEIACTNPCSWEQYGCVSWNLNQSGDR

SEQ ID NO: 105791 - protein, 33 aa, Artificial Sequence
  Description of Artificial Sequence: Synthetic polypeptide
DEQEIATTNPVATEQYGSVSFTDLEDHEGDEDL

SEQ ID NO: 105792 - protein, 33 aa, Artificial Sequence
  Description of Artificial Sequence: Synthetic polypeptide
DEQEIATTNPVATEQYGSVSETDYLEDHEGEDL

SEQ ID NO: 105793 - protein, 29 aa, Artificial Sequence
  Description of Artificial Sequence: Synthetic peptide
QEMEIASTNPCSYEQYGCVCSSNLQSGER

SEQ ID NO: 105794 - protein, 29 aa, Artificial Sequence
  Description of Artificial Sequence: Synthetic peptide
QEMEIASTNPCSYEQYGCVSCNLQSGERA

SEQ ID NO: 105795 - protein, 28 aa, Artificial Sequence
  Description of Artificial Sequence: Synthetic peptide
QEEEIATTNPVATEQYGEAPEVEQHEEK

SEQ ID NO: 105796 - protein, 33 aa, Artificial Sequence
  Description of Artificial Sequence: Synthetic polypeptide
DEQEIATTNPVATEQYGSVSETDLEDHEGVEDL

SEQ ID NO: 105797 - protein, 33 aa, Artificial Sequence
  Description of Artificial Sequence: Synthetic polypeptide
DEQEIATTNPVATEQYGSVSETDLEDHEGEDLS

SEQ ID NO: 105798 - protein, 28 aa, Artificial Sequence
  Description of Artificial Sequence: Synthetic peptide
QEEEIATTNPVATEQYGEAPEVEQHEEG

SEQ ID NO: 105799 - protein, 29 aa, Artificial Sequence
  Description of Artificial Sequence: Synthetic peptide
QEMEIASTNPCSYEQYGCVSWNLNQSGER

SEQ ID NO: 105800 - protein, 32 aa, Artificial Sequence
  Description of Artificial Sequence: Synthetic polypeptide
DEQEIATTNPVATEQYGSVSETDFEDHEGEDL

SEQ ID NO: 105801 - protein, 29 aa, Artificial Sequence
  Description of Artificial Sequence: Synthetic peptide
QEMEIASTNPCSYEQYGCVSWNLQSFGQR

SEQ ID NO: 105802 - protein, 31 aa, Artificial Sequence
  Description of Artificial Sequence: Synthetic polypeptide
DEQEIATTNPVATEQYGSVSEIEMDHEGEDL

SEQ ID NO: 105803 - protein, 28 aa, Artificial Sequence
  Description of Artificial Sequence: Synthetic peptide
QEEEIATTNPVATEQYGEAPEVDQHPEK

SEQ ID NO: 105804 - protein, 34 aa, Artificial Sequence
  Description of Artificial Sequence: Synthetic polypeptide
DESEIRTTNPVATECWGSVSDCINEPQDREGENG

SEQ ID NO: 105805 - protein, 34 aa, Artificial Sequence
  Description of Artificial Sequence: Synthetic polypeptide
DESEIRTTNPVATECWGSVSDCINEPQDREGENH

SEQ ID NO: 105806 - protein, 28 aa, Artificial Sequence
  Description of Artificial Sequence: Synthetic peptide
QEEEIATTNPVATEQYGEAPEVDQHEIK

SEQ ID NO: 105807 - protein, 34 aa, Artificial Sequence
  Description of Artificial Sequence: Synthetic polypeptide
DESEIRTTNPVATECWGSVSDINCPQDREGENIG

SEQ ID NO: 105808 - protein, 33 aa, Artificial Sequence
  Description of Artificial Sequence: Synthetic polypeptide
DESEIRTTNPVATECWGSVSDINEPQDGEGENG

SEQ ID NO: 105809 - protein, 30 aa, Artificial Sequence
  Description of Artificial Sequence: Synthetic polypeptide
QEMEIATTNPVATECYGDVCSAECLQFENL

SEQ ID NO: 105810 - protein, 28 aa, Artificial Sequence
  Description of Artificial Sequence: Synthetic peptide
QEEEIATTNPVATEQYGEAPEVDQHEEK

SEQ ID NO: 105811 - protein, 33 aa, Artificial Sequence
  Description of Artificial Sequence: Synthetic polypeptide
DEQEIATTNPVATEQYGSVSDTDILEDHEGEDL

SEQ ID NO: 105812 - protein, 29 aa, Artificial Sequence
  Description of Artificial Sequence: Synthetic peptide
QEEEIATTNPVATEQYGEAPEVCVQHENK

SEQ ID NO: 105813 - protein, 29 aa, Artificial Sequence
  Description of Artificial Sequence: Synthetic peptide
QEMEIATTNPVATECYGTVSAECPQFGEL

SEQ ID NO: 105814 - protein, 29 aa, Artificial Sequence
  Description of Artificial Sequence: Synthetic peptide
QEMEIATTNPVATECYGTVSAECPQHGEL

SEQ ID NO: 105815 - protein, 34 aa, Artificial Sequence
  Description of Artificial Sequence: Synthetic polypeptide
DEQEIATTNPVATEQYGSVSCTGLSEDHEGGENL

SEQ ID NO: 105816 - protein, 29 aa, Artificial Sequence
  Description of Artificial Sequence: Synthetic peptide
QEMEIAQTNPCSYEQYGCVCSWNLQSGDR

SEQ ID NO: 105817 - protein, 28 aa, Artificial Sequence
  Description of Artificial Sequence: Synthetic peptide
QEEEIATTNPVATEQYGEAPEVGQSEEK

SEQ ID NO: 105818 - protein, 29 aa, Artificial Sequence
  Description of Artificial Sequence: Synthetic peptide
QEEEIATTNPVATEQYGEAPEVEQHEGEG

SEQ ID NO: 105819 - protein, 32 aa, Artificial Sequence
  Description of Artificial Sequence: Synthetic polypeptide
DEQEIATTNPVATEQYGSVSFTDLETHEHEDL

SEQ ID NO: 105820 - protein, 33 aa, Artificial Sequence
  Description of Artificial Sequence: Synthetic polypeptide
DEQEIATTNPVATEQYGSVSLTDLNDHEGQEDL

SEQ ID NO: 105821 - protein, 33 aa, Artificial Sequence
  Description of Artificial Sequence: Synthetic polypeptide
DEQEIATTNPVATEQYGSVSLTDLEDHEGFEDL

SEQ ID NO: 105822 - protein, 28 aa, Artificial Sequence
  Description of Artificial Sequence: Synthetic peptide
QEEEIATTNPVATEQYGEAPEVGQMEEK

SEQ ID NO: 105823 - protein, 28 aa, Artificial Sequence
  Description of Artificial Sequence: Synthetic peptide
QEEEIATTNPVATEQYGEAPEVGQHQEK

SEQ ID NO: 105824 - protein, 29 aa, Artificial Sequence
  Description of Artificial Sequence: Synthetic peptide
QEMEIACTNPCSYEQYGVVSNSNLQSGTR

SEQ ID NO: 105825 - protein, 29 aa, Artificial Sequence
  Description of Artificial Sequence: Synthetic peptide
QEMEIACTNPCSYEQYGVVSSNLQSGQRA

SEQ ID NO: 105826 - protein, 34 aa, Artificial Sequence
  Description of Artificial Sequence: Synthetic polypeptide
DESEIRTTNPVATECWGSVSCSNSEPQDREGENG

SEQ ID NO: 105827 - protein, 33 aa, Artificial Sequence
  Description of Artificial Sequence: Synthetic polypeptide
DEQEIATTNPVATEQYGSVSLTDILMDHEGEDL

SEQ ID NO: 105828 - protein, 28 aa, Artificial Sequence
  Description of Artificial Sequence: Synthetic peptide
QEEEIATTNPVATEQYGEAPEVGQHEEK

SEQ ID NO: 105829 - protein, 28 aa, Artificial Sequence
  Description of Artificial Sequence: Synthetic peptide
QEEEIATTNPVATEQYGEAPEVFQHMEK

SEQ ID NO: 105830 - protein, 28 aa, Artificial Sequence
  Description of Artificial Sequence: Synthetic peptide
QEEEIATTNPVATEQYGEAPEVFQHEMK

SEQ ID NO: 105831 - protein, 28 aa, Artificial Sequence
  Description of Artificial Sequence: Synthetic peptide
QEMEIAPTNPCSSCQYGIVSCNLQSGTR

SEQ ID NO: 105832 - protein, 28 aa, Artificial Sequence
  Description of Artificial Sequence: Synthetic peptide
QEEEIATTNPVATEQYGEAPEVFQHEEK

SEQ ID NO: 105833 - protein, 33 aa, Artificial Sequence
  Description of Artificial Sequence: Synthetic polypeptide
DEQEIATTNPVATEQYGSVSITDLREDEEGEDL

SEQ ID NO: 105834 - protein, 33 aa, Artificial Sequence
  Description of Artificial Sequence: Synthetic polypeptide
DEQEIATTNPVATEQYGSVSITDLEPHEGEEDL

SEQ ID NO: 105835 - protein, 30 aa, Artificial Sequence
  Description of Artificial Sequence: Synthetic polypeptide
QEMEIAPTNPCSTEQYGIVSACNLVQSGND

SEQ ID NO: 105836 - protein, 28 aa, Artificial Sequence
  Description of Artificial Sequence: Synthetic peptide
QEEEIATTNPVATEQYGEAPEVEQHVEK

SEQ ID NO: 105837 - protein, 32 aa, Artificial Sequence
  Description of Artificial Sequence: Synthetic polypeptide
DEQEIATTNPVATEQYGSVSHTLPEDHEGEDL

SEQ ID NO: 105838 - protein, 33 aa, Artificial Sequence
  Description of Artificial Sequence: Synthetic polypeptide
DEQEIATTNPVATEQYGSVSHTDQLSDHEGEDL

SEQ ID NO: 105839 - protein, 29 aa, Artificial Sequence
  Description of Artificial Sequence: Synthetic peptide
QEMEIAPTNPCSTEQYGIVSCNLVQSGTD

SEQ ID NO: 105840 - protein, 33 aa, Artificial Sequence
  Description of Artificial Sequence: Synthetic polypeptide
DESEIRTTNPVATECWGSVSCVNEPQDPEGENG

SEQ ID NO: 105841 - protein, 31 aa, Artificial Sequence
  Description of Artificial Sequence: Synthetic polypeptide
QEMEIAPTNPVATEQYGIVCSTDNLEFEGTD

SEQ ID NO: 105842 - protein, 32 aa, Artificial Sequence
  Description of Artificial Sequence: Synthetic polypeptide
DEQEIATTNPVATEQYGSVSGTDPEDHEGEDL

SEQ ID NO: 105843 - protein, 28 aa, Artificial Sequence
  Description of Artificial Sequence: Synthetic peptide
QEEEIATTNPVATEQYGEAPEVEQHSEQ

SEQ ID NO: 105844 - protein, 31 aa, Artificial Sequence
  Description of Artificial Sequence: Synthetic polypeptide
QEMEIAPTNPVSTEQYGIVCSACNLVQSGND

SEQ ID NO: 105845 - protein, 33 aa, Artificial Sequence
  Description of Artificial Sequence: Synthetic polypeptide
DEQEIATTNPVATEQYGSVSFTDLEEDHIGEDL

SEQ ID NO: 105846 - protein, 28 aa, Artificial Sequence
  Description of Artificial Sequence: Synthetic peptide
QEEEIATTNPVATEQYGEAPEVMQHEEL

SEQ ID NO: 105847 - protein, 28 aa, Artificial Sequence
  Description of Artificial Sequence: Synthetic peptide
QEGSIAPTNPCSSEQYGIVSCNLQSGTR

SEQ ID NO: 105848 - protein, 28 aa, Artificial Sequence
  Description of Artificial Sequence: Synthetic peptide
QEGSIAPTNPCSSEQYGIVSCNLQSGDR

SEQ ID NO: 105849 - protein, 28 aa, Artificial Sequence
  Description of Artificial Sequence: Synthetic peptide
QEEEIATTNPVATEQYGEAPLVCQHEEK

SEQ ID NO: 105850 - protein, 34 aa, Artificial Sequence
  Description of Artificial Sequence: Synthetic polypeptide
DEQEIATTNPVATEQYGSVSTTPDGNMRNGMNPV

SEQ ID NO: 105851 - protein, 33 aa, Artificial Sequence
  Description of Artificial Sequence: Synthetic polypeptide
DEQEIATTNPVATEQYGSVSTTPDGNMRNGEPV

SEQ ID NO: 105852 - protein, 33 aa, Artificial Sequence
  Description of Artificial Sequence: Synthetic polypeptide
DEQEIATTNPVATEQYGSVSTTPDGNDRNGEPV

SEQ ID NO: 105853 - protein, 33 aa, Artificial Sequence
  Description of Artificial Sequence: Synthetic polypeptide
DEQEIATTNPVATEQYGSVSTTPDGNDRNGEDV

SEQ ID NO: 105854 - protein, 28 aa, Artificial Sequence
  Description of Artificial Sequence: Synthetic peptide
QEEEIATTNPVATEQYGEAPKVCQQEEK

SEQ ID NO: 105855 - protein, 33 aa, Artificial Sequence
  Description of Artificial Sequence: Synthetic polypeptide
DEQEIATTNPVATEQYGSVSTTPDGEDRNGEDL

SEQ ID NO: 105856 - protein, 28 aa, Artificial Sequence
  Description of Artificial Sequence: Synthetic peptide
QEEEIATTNPVATEQYGEAPKVCQHEEK

SEQ ID NO: 105857 - protein, 28 aa, Artificial Sequence
  Description of Artificial Sequence: Synthetic peptide
QEEEIATTNPVATEQYGEAPKECQHEEK

SEQ ID NO: 105858 - protein, 36 aa, Artificial Sequence
  Description of Artificial Sequence: Synthetic polypeptide
AEEEIRTTNPVATEQYGSVSTVVTNLQSGTVDDGTT

SEQ ID NO: 105859 - protein, 37 aa, Artificial Sequence
  Description of Artificial Sequence: Synthetic polypeptide
AEEEIRTTNPVATEQYGSVSTVVTNLQQQGTNGEDDE

SEQ ID NO: 105860 - protein, 37 aa, Artificial Sequence
  Description of Artificial Sequence: Synthetic polypeptide
AEEEIRTTNPVATEQYGSVSTVVTNLQQNDENGNESQ

SEQ ID NO: 105861 - protein, 33 aa, Artificial Sequence
  Description of Artificial Sequence: Synthetic polypeptide
DEQEIATTNPVATEQYGSVSTTDLPEDHEGEDL

SEQ ID NO: 105862 - protein, 33 aa, Artificial Sequence
  Description of Artificial Sequence: Synthetic polypeptide
DEQEIATTNPVATEQYGSVSTTDLNEEHEGEDQ

SEQ ID NO: 105863 - protein, 37 aa, Artificial Sequence
  Description of Artificial Sequence: Synthetic polypeptide
AEEEIRTTNPVATEQYGSVSTVVTNLQQGTEGTNDGN

SEQ ID NO: 105864 - protein, 28 aa, Artificial Sequence
  Description of Artificial Sequence: Synthetic peptide
QEEEIATTNPVATEQYGEAPIVCQHEEK

SEQ ID NO: 105865 - protein, 32 aa, Artificial Sequence
  Description of Artificial Sequence: Synthetic polypeptide
DEQEIATTNPVATEQYGSVSTTDLEDTEEEDL

SEQ ID NO: 105866 - protein, 37 aa, Artificial Sequence
  Description of Artificial Sequence: Synthetic polypeptide
AEEEIRTTNPVATEQYGSVSTVVTNLLQQGNTEAGNE

SEQ ID NO: 105867 - protein, 32 aa, Artificial Sequence
  Description of Artificial Sequence: Synthetic polypeptide
DEQEIATTNPVATEQYGSVSTTDLEDHETEDL

SEQ ID NO: 105868 - protein, 36 aa, Artificial Sequence
  Description of Artificial Sequence: Synthetic polypeptide
AEEEIRTTNPVATEQYGSVSTVVTNGTQNGTNNQTD

SEQ ID NO: 105869 - protein, 36 aa, Artificial Sequence
  Description of Artificial Sequence: Synthetic polypeptide
AEEEIRTTNPVATEQYGSVSTVVTNGNQTGNTNQTD

SEQ ID NO: 105870 - protein, 28 aa, Artificial Sequence
  Description of Artificial Sequence: Synthetic peptide
QEEEIATTNPVATEQYGEAPHVCQHEEK

SEQ ID NO: 105871 - protein, 30 aa, Artificial Sequence
  Description of Artificial Sequence: Synthetic polypeptide
QEGEIRPTNPCSSEQWGSVSCNEQDREGTR

SEQ ID NO: 105872 - protein, 30 aa, Artificial Sequence
  Description of Artificial Sequence: Synthetic polypeptide
QEGEIRPTNPVSSEPYGTVSCENLQQSGTR

SEQ ID NO: 105873 - protein, 31 aa, Artificial Sequence
  Description of Artificial Sequence: Synthetic polypeptide
QEGEIRPTNPVSSEPYGTVSCENLQQSNGNR

SEQ ID NO: 105874 - protein, 33 aa, Artificial Sequence
  Description of Artificial Sequence: Synthetic polypeptide
DEQEIATTNPVATEQYGSVSTTTDLEDHEGEDL

SEQ ID NO: 105875 - protein, 30 aa, Artificial Sequence
  Description of Artificial Sequence: Synthetic polypeptide
QEGEIRTTNPCASECYGIVSCINLPQSGTG

SEQ ID NO: 105876 - protein, 28 aa, Artificial Sequence
  Description of Artificial Sequence: Synthetic peptide
QEGEICATNPISYEQYGVVSVNLQSGTQ

SEQ ID NO: 105877 - protein, 37 aa, Artificial Sequence
  Description of Artificial Sequence: Synthetic polypeptide
AEEEIRTTNPVATEQYGSVSTVVTNNLQSGSTDNGTQ

SEQ ID NO: 105878 - protein, 28 aa, Artificial Sequence
  Description of Artificial Sequence: Synthetic peptide
QEGEIATTNPVATEQYGIASCVCQHETK

SEQ ID NO: 105879 - protein, 31 aa, Artificial Sequence
  Description of Artificial Sequence: Synthetic polypeptide
QEGEIATTNPVATEQYGIVSATDLEDHEGEL

SEQ ID NO: 105880 - protein, 28 aa, Artificial Sequence
  Description of Artificial Sequence: Synthetic peptide
QEEEIATTNPVATEQYGEAPQVCQHEEK

SEQ ID NO: 105881 - protein, 28 aa, Artificial Sequence
  Description of Artificial Sequence: Synthetic peptide
QEEEIATTNPVATEQYGEAPPVCQHEEK

SEQ ID NO: 105882 - protein, 33 aa, Artificial Sequence
  Description of Artificial Sequence: Synthetic polypeptide
DESEIRTTNPVATECWGSVSCIWEPQDREGENG

SEQ ID NO: 105883 - protein, 36 aa, Artificial Sequence
  Description of Artificial Sequence: Synthetic polypeptide
AEEEIRTTNPVATEQYGSVSTVVTNNQNGDEANEDQ

SEQ ID NO: 105884 - protein, 29 aa, Artificial Sequence
  Description of Artificial Sequence: Synthetic peptide
QEGEIATTNPVATEWYGHVSEELQHEEEL

SEQ ID NO: 105885 - protein, 28 aa, Artificial Sequence
  Description of Artificial Sequence: Synthetic peptide
QEEEIATTNPVATEQYGEAPNVFQHEEK

SEQ ID NO: 105886 - protein, 28 aa, Artificial Sequence
  Description of Artificial Sequence: Synthetic peptide
QEEEIATTNPVATEQYGEAPNVCQHEEK

SEQ ID NO: 105887 - protein, 34 aa, Artificial Sequence
  Description of Artificial Sequence: Synthetic polypeptide
DESEIRTTNPVATECWGSVSCIWTEPQDREGENG

SEQ ID NO: 105888 - protein, 33 aa, Artificial Sequence
  Description of Artificial Sequence: Synthetic polypeptide
DEQEIATTNPVATEQYGSVSVTDLEVHEGAEDL

SEQ ID NO: 105889 - protein, 33 aa, Artificial Sequence
  Description of Artificial Sequence: Synthetic polypeptide
DESEIRTTNPVATECWGSVSCIYEPQDREGENG

SEQ ID NO: 105890 - protein, 33 aa, Artificial Sequence
  Description of Artificial Sequence: Synthetic polypeptide
DESEIRTTNPVATECWGSVSCIYEPQDREGSNG

SEQ ID NO: 105891 - protein, 28 aa, Artificial Sequence
  Description of Artificial Sequence: Synthetic peptide
QEGEIATTNPVSTECYGDVSECLQHEEL

SEQ ID NO: 105892 - protein, 33 aa, Artificial Sequence
  Description of Artificial Sequence: Synthetic polypeptide
DEQEIATTNPVATEQYGSVSVTDLEVAEGELLF

SEQ ID NO: 105893 - protein, 28 aa, Artificial Sequence
  Description of Artificial Sequence: Synthetic peptide
QEGEIATTNPVSTECYGDVSECLQSEEL

SEQ ID NO: 105894 - protein, 33 aa, Artificial Sequence
  Description of Artificial Sequence: Synthetic polypeptide
DEQEIATTNPVATEQYGSVSVTDLEDHEGSEDQ

SEQ ID NO: 105895 - protein, 33 aa, Artificial Sequence
  Description of Artificial Sequence: Synthetic polypeptide
DEQEIATTNPVATEQYGSVSVTDLEDHEGIEDL

SEQ ID NO: 105896 - protein, 33 aa, Artificial Sequence
  Description of Artificial Sequence: Synthetic polypeptide
DEQEIATTNPVATEQYGSVSVTDLEDHEGETLA

SEQ ID NO: 105897 - protein, 36 aa, Artificial Sequence
  Description of Artificial Sequence: Synthetic polypeptide
AEEEIRTTNPVATEQYGSVSTVVTNNNNQAGNQQQA

SEQ ID NO: 105898 - protein, 33 aa, Artificial Sequence
  Description of Artificial Sequence: Synthetic polypeptide
DEQEIATTNPVATEQYGSVSVTDLAEDHEGEDL

SEQ ID NO: 105899 - protein, 32 aa, Artificial Sequence
  Description of Artificial Sequence: Synthetic polypeptide
DEQEIATTNPVATEQYGSVSVTDEEDTEGEDL

SEQ ID NO: 105900 - protein, 28 aa, Artificial Sequence
  Description of Artificial Sequence: Synthetic peptide
QEEEIATTNPVATEQYGEAPNCCQHEEK

SEQ ID NO: 105901 - protein, 28 aa, Artificial Sequence
  Description of Artificial Sequence: Synthetic peptide
QEEEIATTNPVATEQYGEAPMVCQHYEK

SEQ ID NO: 105902 - protein, 30 aa, Artificial Sequence
  Description of Artificial Sequence: Synthetic polypeptide
QEGEIATTNPVSTEQYGIVSCDLEHEGEDR

SEQ ID NO: 105903 - protein, 28 aa, Artificial Sequence
  Description of Artificial Sequence: Synthetic peptide
QEEEIATTNPVATEQYGEAPMVCQHEEK

SEQ ID NO: 105904 - protein, 31 aa, Artificial Sequence
  Description of Artificial Sequence: Synthetic polypeptide
QEGEIRTTNPCASEQWGSVSCINEQDREGTG

SEQ ID NO: 105905 - protein, 28 aa, Artificial Sequence
  Description of Artificial Sequence: Synthetic peptide
QEEEIATTNPVATEQYGEAPGVFQHEEK

SEQ ID NO: 105906 - protein, 35 aa, Artificial Sequence
  Description of Artificial Sequence: Synthetic polypeptide
AEEEIRTTNPVATEQYGSVSTVVTDGNNLGGNDDQ

SEQ ID NO: 105907 - protein, 29 aa, Artificial Sequence
  Description of Artificial Sequence: Synthetic peptide
QEEEIATTNPVATEQYGEAPEVSQHEEKR

SEQ ID NO: 105908 - protein, 31 aa, Artificial Sequence
  Description of Artificial Sequence: Synthetic polypeptide
QEGEIRTTNPVSTECWGIVSCINEQDSEGNR

SEQ ID NO: 105909 - protein, 33 aa, Artificial Sequence
  Description of Artificial Sequence: Synthetic polypeptide
DESEIRTTNPVATECWGSVSCMNEPNDREGENG

SEQ ID NO: 105910 - protein, 30 aa, Artificial Sequence
  Description of Artificial Sequence: Synthetic polypeptide
QEGEIRTTNPVSTEQYGTISMDIQQQNGNH

SEQ ID NO: 105911 - protein, 28 aa, Artificial Sequence
  Description of Artificial Sequence: Synthetic peptide
QEEEIATTNPVATEQYGEAPEVSQHEEK

SEQ ID NO: 105912 - protein, 28 aa, Artificial Sequence
  Description of Artificial Sequence: Synthetic peptide
QEEEIATTNPVATEQYGEAPEVRQHEEK

SEQ ID NO: 105913 - protein, 28 aa, Artificial Sequence
  Description of Artificial Sequence: Synthetic peptide
QEEEIATTNPVATEQYGEAPEVQQIEEK

SEQ ID NO: 105914 - protein, 33 aa, Artificial Sequence
  Description of Artificial Sequence: Synthetic polypeptide
QEGETRTTNPVATEQYGSVSATGDDGDQEGGNF

SEQ ID NO: 105915 - protein, 28 aa, Artificial Sequence
  Description of Artificial Sequence: Synthetic peptide
QEEEIATTNPVATEQYGEAPEVQQHEEK

SEQ ID NO: 105916 - protein, 28 aa, Artificial Sequence
  Description of Artificial Sequence: Synthetic peptide
QEEEIATTNPVATEQYGEAPEVPQHEEK

SEQ ID NO: 105917 - protein, 28 aa, Artificial Sequence
  Description of Artificial Sequence: Synthetic peptide
QEEEIATTNPVATEQYGEAPEVPQGEEK

SEQ ID NO: 105918 - protein, 33 aa, Artificial Sequence
  Description of Artificial Sequence: Synthetic polypeptide
QEGETRTTNPVATEQYGSVSTGDLDQEIGQGGD

SEQ ID NO: 105919 - protein, 28 aa, Artificial Sequence
  Description of Artificial Sequence: Synthetic peptide
QEEEIATTNPVATEQYGEAPEVNQHEEK

SEQ ID NO: 105920 - protein, 35 aa, Artificial Sequence
  Description of Artificial Sequence: Synthetic polypeptide
QEGETRTTNPVATEQYGSVSTGDNGDQRNGDRGGD

SEQ ID NO: 105921 - protein, 29 aa, Artificial Sequence
  Description of Artificial Sequence: Synthetic peptide
QEEEIATTNPVATEQYGEAPEVNCQHEEK

SEQ ID NO: 105922 - protein, 28 aa, Artificial Sequence
  Description of Artificial Sequence: Synthetic peptide
QEEEIATTNPVATEQYGEAPEVMQHEIK

SEQ ID NO: 105923 - protein, 28 aa, Artificial Sequence
  Description of Artificial Sequence: Synthetic peptide
QEGLIAPTNPCSSEQYGIVSCNLQSGTR

SEQ ID NO: 105924 - protein, 33 aa, Artificial Sequence
  Description of Artificial Sequence: Synthetic polypeptide
DESEIRTTNPVATECWGSVSCNNEPWGREGENG

SEQ ID NO: 105925 - protein, 28 aa, Artificial Sequence
  Description of Artificial Sequence: Synthetic peptide
QEGNIAPTNPCSNEQYGIVSCNLQSGTR

SEQ ID NO: 105926 - protein, 33 aa, Artificial Sequence
  Description of Artificial Sequence: Synthetic polypeptide
DEQEIATTNPVATEQYGSVSTNEPEDHEGEEDL

SEQ ID NO: 105927 - protein, 28 aa, Artificial Sequence
  Description of Artificial Sequence: Synthetic peptide
QEGNIAPTNPCSSEQYGIVSCNLQSGTR

SEQ ID NO: 105928 - protein, 28 aa, Artificial Sequence
  Description of Artificial Sequence: Synthetic peptide
QEGPIAPTNPCSSEQYGIVSCNLQSGTR

SEQ ID NO: 105929 - protein, 28 aa, Artificial Sequence
  Description of Artificial Sequence: Synthetic peptide
QEGQIAPTNPCSSEQYGIVSCNLQSGTR

SEQ ID NO: 105930 - protein, 34 aa, Artificial Sequence
  Description of Artificial Sequence: Synthetic polypeptide
DESEIRTTNPVATECWGSVSCNNNEPQDREGENG

SEQ ID NO: 105931 - protein, 28 aa, Artificial Sequence
  Description of Artificial Sequence: Synthetic peptide
QEGQIAPTNPCSWEQYGIVSCNLQSGTR

SEQ ID NO: 105932 - protein, 28 aa, Artificial Sequence
  Description of Artificial Sequence: Synthetic peptide
CEEEIATTNPVATEQYGVAPEVDQAEIK

SEQ ID NO: 105933 - protein, 33 aa, Artificial Sequence
  Description of Artificial Sequence: Synthetic polypeptide
DESEIRTTNPVATECWGSVSCLNEPQDREGESG

SEQ ID NO: 105934 - protein, 33 aa, Artificial Sequence
  Description of Artificial Sequence: Synthetic polypeptide
DEQEIATTNPVATEQYGSVSTTAGPEDHEGNPL

SEQ ID NO: 105935 - protein, 28 aa, Artificial Sequence
  Description of Artificial Sequence: Synthetic peptide
QEEEIATTNPVATEQYGEAPEVTQHEEK

SEQ ID NO: 105936 - protein, 28 aa, Artificial Sequence
  Description of Artificial Sequence: Synthetic peptide
QEEEIATTNPVATEQYGEAPGVCQHEEK

SEQ ID NO: 105937 - protein, 31 aa, Artificial Sequence
  Description of Artificial Sequence: Synthetic polypeptide
QEGEIRTTNPCATEQYGIVSCAGNMRGMTPR

SEQ ID NO: 105938 - protein, 28 aa, Artificial Sequence
  Description of Artificial Sequence: Synthetic peptide
QEEEIATTNPVATEQYGEAPFVCQHKEK

SEQ ID NO: 105939 - protein, 28 aa, Artificial Sequence
  Description of Artificial Sequence: Synthetic peptide
QEEEIATTNPVATEQYGEAPFVCQHEEK

SEQ ID NO: 105940 - protein, 32 aa, Artificial Sequence
  Description of Artificial Sequence: Synthetic polypeptide
QEGEIRTTNPCATEQYGIVSTTAGNMRGMTPR

SEQ ID NO: 105941 - protein, 31 aa, Artificial Sequence
  Description of Artificial Sequence: Synthetic polypeptide
QEGEIRTTNPCSSEQWGSVSCINLQDREGTG

SEQ ID NO: 105942 - protein, 28 aa, Artificial Sequence
  Description of Artificial Sequence: Synthetic peptide
QEGEIRTTNPCSSEQYGIISCDLQSGTH

SEQ ID NO: 105943 - protein, 34 aa, Artificial Sequence
  Description of Artificial Sequence: Synthetic polypeptide
DESEIRTTNPVATECWGSVSCKNEPQDREGENMG

SEQ ID NO: 105944 - protein, 29 aa, Artificial Sequence
  Description of Artificial Sequence: Synthetic peptide
QEEEIATTNPVATEQYGEAPFEVCQHENK

SEQ ID NO: 105945 - protein, 29 aa, Artificial Sequence
  Description of Artificial Sequence: Synthetic peptide
QEEEIATTNPVATEQYGEAPEYCQHEEKR

SEQ ID NO: 105946 - protein, 28 aa, Artificial Sequence
  Description of Artificial Sequence: Synthetic peptide
QEEEIATTNPVATEQYGEAPEYCQHEEK

SEQ ID NO: 105947 - protein, 28 aa, Artificial Sequence
  Description of Artificial Sequence: Synthetic peptide
QEEEIATTNPVATEQYGEAPEWCQHQEK

SEQ ID NO: 105948 - protein, 33 aa, Artificial Sequence
  Description of Artificial Sequence: Synthetic polypeptide
DEQEIATTNPVATEQYGSVSCTDLSMDHEGEDL

SEQ ID NO: 105949 - protein, 30 aa, Artificial Sequence
  Description of Artificial Sequence: Synthetic polypeptide
QEGEIRTTNPCSTEQYGIISCDLQQSNGTR

SEQ ID NO: 105950 - protein, 28 aa, Artificial Sequence
  Description of Artificial Sequence: Synthetic peptide
QEEEIATTNPVATEQYGEAPEVYQHEEK

SEQ ID NO: 105951 - protein, 30 aa, Artificial Sequence
  Description of Artificial Sequence: Synthetic polypeptide
QEGEIRTTNPCSTEQYGIISMDLQQSNGTR

SEQ ID NO: 105952 - protein, 33 aa, Artificial Sequence
  Description of Artificial Sequence: Synthetic polypeptide
DEQEIATTNPVATEQYGSVSTTDGPEDHEGNPL

SEQ ID NO: 105953 - protein, 28 aa, Artificial Sequence
  Description of Artificial Sequence: Synthetic peptide
QEEEIATTNPVATEQYGEAPEVWQHIEK

SEQ ID NO: 105954 - protein, 29 aa, Artificial Sequence
  Description of Artificial Sequence: Synthetic peptide
QEEEIATTNPVATEQYGEAPEVWQHGEEK

SEQ ID NO: 105955 - protein, 32 aa, Artificial Sequence
  Description of Artificial Sequence: Synthetic polypeptide
QEGEIRTTNPVATECWGIVSCINEPQDSEGNR

SEQ ID NO: 105956 - protein, 32 aa, Artificial Sequence
  Description of Artificial Sequence: Synthetic polypeptide
DEQEIATTNPVATEQYGSVSTTDGEDHEGEDL

SEQ ID NO: 105957 - protein, 28 aa, Artificial Sequence
  Description of Artificial Sequence: Synthetic peptide
QEEEIATTNPVATEQYGEAPEVWQHEEK

SEQ ID NO: 105958 - protein, 33 aa, Artificial Sequence
  Description of Artificial Sequence: Synthetic polypeptide
DEQEIATTNPVATEQYGSVSTTALPNDHEGEDV

SEQ ID NO: 105959 - protein, 28 aa, Artificial Sequence
  Description of Artificial Sequence: Synthetic peptide
QEEEIATTNPVATEQYGEAPEVVQHEEW

SEQ ID NO: 105960 - protein, 28 aa, Artificial Sequence
  Description of Artificial Sequence: Synthetic peptide
QEEEIATTNPVATEQYGEAPEVVQHEEK

SEQ ID NO: 105961 - protein, 28 aa, Artificial Sequence
  Description of Artificial Sequence: Synthetic peptide
QEEEIATTNPVATEQYGEAPEVTQHPEK

SEQ ID NO: 105962 - protein, 28 aa, Artificial Sequence
  Description of Artificial Sequence: Synthetic peptide
QEEEIATTNPVATEQYGEAPEWCQHEEK

SEQ ID NO: 105963 - protein, 33 aa, Artificial Sequence
  Description of Artificial Sequence: Synthetic polypeptide
DESEIRTTNPVATECWGSVSCIVEPQDREGENG

SEQ ID NO: 105964 - protein, 32 aa, Artificial Sequence
  Description of Artificial Sequence: Synthetic polypeptide
DEQEIATTNPVATEQYGSVSCTDLEDHEPEDL

SEQ ID NO: 105965 - protein, 33 aa, Artificial Sequence
  Description of Artificial Sequence: Synthetic polypeptide
DEQEIATTNPVATEQYGSVSCTDLEDHEGGMDL

SEQ ID NO: 105966 - protein, 29 aa, Artificial Sequence
  Description of Artificial Sequence: Synthetic peptide
QENEIAPTNPCSTEQYGDVSCNEQNSGTR

SEQ ID NO: 105967 - protein, 34 aa, Artificial Sequence
  Description of Artificial Sequence: Synthetic polypeptide
DESEIRTTNPVATECWGSVSHINEQQDREGENGQ

SEQ ID NO: 105968 - protein, 28 aa, Artificial Sequence
  Description of Artificial Sequence: Synthetic peptide
QEEEIATTNPVATEQYGEAPEVCQHTEK

SEQ ID NO: 105969 - protein, 36 aa, Artificial Sequence
  Description of Artificial Sequence: Synthetic polypeptide
AEEEIRTTNPVATEQYGSVSTVVQNGNQEQGNNQTD

SEQ ID NO: 105970 - protein, 28 aa, Artificial Sequence
  Description of Artificial Sequence: Synthetic peptide
QEEEIATTNPVATEQYGEAPEVCQHSEK

SEQ ID NO: 105971 - protein, 28 aa, Artificial Sequence
  Description of Artificial Sequence: Synthetic peptide
QENEIAPTNPVATECYGDVSECLQHEEL

SEQ ID NO: 105972 - protein, 28 aa, Artificial Sequence
  Description of Artificial Sequence: Synthetic peptide
QEEEIATTNPVATEQYGEAPEVCQHREK

SEQ ID NO: 105973 - protein, 29 aa, Artificial Sequence
  Description of Artificial Sequence: Synthetic peptide
QEEEIATTNPVATEQYGEAPEVCQHREEK

SEQ ID NO: 105974 - protein, 28 aa, Artificial Sequence
  Description of Artificial Sequence: Synthetic peptide
QENEIAPTNPVATECYGIVSCCLQHEEL

SEQ ID NO: 105975 - protein, 33 aa, Artificial Sequence
  Description of Artificial Sequence: Synthetic polypeptide
DESEIRTTNPVATECWGSVSHINNPQDREGESG

SEQ ID NO: 105976 - protein, 34 aa, Artificial Sequence
  Description of Artificial Sequence: Synthetic polypeptide
DESEIRTTNPVATECWGSVSICINEPQDRDGENG

SEQ ID NO: 105977 - protein, 28 aa, Artificial Sequence
  Description of Artificial Sequence: Synthetic peptide
QENEIAPTNPVSSECYGDVSENLQSEER

SEQ ID NO: 105978 - protein, 28 aa, Artificial Sequence
  Description of Artificial Sequence: Synthetic peptide
QENEIAPTNPVSSECYGDVSENLQSETR

SEQ ID NO: 105979 - protein, 34 aa, Artificial Sequence
  Description of Artificial Sequence: Synthetic polypeptide
DESEIRTTNPVATECWGSVSICINEPQDREGENG

SEQ ID NO: 105980 - protein, 33 aa, Artificial Sequence
  Description of Artificial Sequence: Synthetic polypeptide
DESEIRTTNPVATECWGSVSIDGEPQDRGGENG

SEQ ID NO: 105981 - protein, 28 aa, Artificial Sequence
  Description of Artificial Sequence: Synthetic peptide
QEEEIATTNPVATEQYGEAPEVCQHQEK

SEQ ID NO: 105982 - protein, 28 aa, Artificial Sequence
  Description of Artificial Sequence: Synthetic peptide
QEEEIATTNPVATEQYGEAPEVCQHPEK

SEQ ID NO: 105983 - protein, 33 aa, Artificial Sequence
  Description of Artificial Sequence: Synthetic polypeptide
DESEIRTTNPVATECWGSVSIINEPQDAEGENG

SEQ ID NO: 105984 - protein, 30 aa, Artificial Sequence
  Description of Artificial Sequence: Synthetic polypeptide
QENEIAPTNPVSTEPYGTVSMNIQQQNGNR

SEQ ID NO: 105985 - protein, 28 aa, Artificial Sequence
  Description of Artificial Sequence: Synthetic peptide
QENEIASTNPVATECYGDVAETLQHGDL

SEQ ID NO: 105986 - protein, 28 aa, Artificial Sequence
  Description of Artificial Sequence: Synthetic peptide
QENEIASTNPVATECYGDVASCLQHGDI

SEQ ID NO: 105987 - protein, 28 aa, Artificial Sequence
  Description of Artificial Sequence: Synthetic peptide
QENEIASTNPVATECYGDVASCLQHGDL

SEQ ID NO: 105988 - protein, 28 aa, Artificial Sequence
  Description of Artificial Sequence: Synthetic peptide
QENEIASTNPVATECYGDVSECLQHEEL

SEQ ID NO: 105989 - protein, 28 aa, Artificial Sequence
  Description of Artificial Sequence: Synthetic peptide
QENEIASTNPVATECYGDVSECLQHESL

SEQ ID NO: 105990 - protein, 28 aa, Artificial Sequence
  Description of Artificial Sequence: Synthetic peptide
QENEIASTNPVATECYGDVSETLQHEDI

SEQ ID NO: 105991 - protein, 34 aa, Artificial Sequence
  Description of Artificial Sequence: Synthetic polypeptide
DESEIRTTNPVATECWGSVSHINEPQDREGENMG

SEQ ID NO: 105992 - protein, 28 aa, Artificial Sequence
  Description of Artificial Sequence: Synthetic peptide
QENEIASTNPVATECYGDVSETLQHEDL

SEQ ID NO: 105993 - protein, 28 aa, Artificial Sequence
  Description of Artificial Sequence: Synthetic peptide
QEEEIATTNPVATEQYGEAPEVCQHVEK

SEQ ID NO: 105994 - protein, 28 aa, Artificial Sequence
  Description of Artificial Sequence: Synthetic peptide
QEEEIATTNPVATEQYGEAPEVCQHWEK

SEQ ID NO: 105995 - protein, 36 aa, Artificial Sequence
  Description of Artificial Sequence: Synthetic polypeptide
AEEEIRTTNPVATEQYGSVSTVVSNGNQAGTTNQTD

SEQ ID NO: 105996 - protein, 34 aa, Artificial Sequence
  Description of Artificial Sequence: Synthetic polypeptide
DESEIRTTNPVATECWGSVSGCINEPQDREGENG

SEQ ID NO: 105997 - protein, 35 aa, Artificial Sequence
  Description of Artificial Sequence: Synthetic polypeptide
AEEEIRTTNPVATEQYGSVSTVVSNGEQGNTNQTD

SEQ ID NO: 105998 - protein, 35 aa, Artificial Sequence
  Description of Artificial Sequence: Synthetic polypeptide
AEEEIRTTNPVATEQYGSVSTVVSNEQQGDEQIDE

SEQ ID NO: 105999 - protein, 36 aa, Artificial Sequence
  Description of Artificial Sequence: Synthetic polypeptide
AEEEIRTTNPVATEQYGSVSTVVSNDGEQGGNNQTD

SEQ ID NO: 106000 - protein, 36 aa, Artificial Sequence
  Description of Artificial Sequence: Synthetic polypeptide
AEEEIRTTNPVATEQYGSVSTVVSNAGNQGTGNQTD

SEQ ID NO: 106001 - protein, 35 aa, Artificial Sequence
  Description of Artificial Sequence: Synthetic polypeptide
AEEEIRTTNPVATEQYGSVSTVVSELGNTEAGNQM

SEQ ID NO: 106002 - protein, 36 aa, Artificial Sequence
  Description of Artificial Sequence: Synthetic polypeptide
AEEEIRTTNPVATEQYGSVSTVVQNGTQTGNNNQTD

SEQ ID NO: 106003 - protein, 35 aa, Artificial Sequence
  Description of Artificial Sequence: Synthetic polypeptide
AEEEIRTTNPVATEQYGSVSTVVQNGNQGTNNQTD

SEQ ID NO: 106004 - protein, 34 aa, Artificial Sequence
  Description of Artificial Sequence: Synthetic polypeptide
DESEIRTTNPVATECWGSVSGINEEPQDRKGENG

SEQ ID NO: 106005 - protein, 28 aa, Artificial Sequence
  Description of Artificial Sequence: Synthetic peptide
QEEEIATTNPVATEQYGEAPEVCQMEPK

SEQ ID NO: 106006 - protein, 28 aa, Artificial Sequence
  Description of Artificial Sequence: Synthetic peptide
QEEEIATTNPVATEQYGEAPEVCQMEEK

SEQ ID NO: 106007 - protein, 28 aa, Artificial Sequence
  Description of Artificial Sequence: Synthetic peptide
QEEEIATTNPVATEQYGEAPEVCQLEEK

SEQ ID NO: 106008 - protein, 28 aa, Artificial Sequence
  Description of Artificial Sequence: Synthetic peptide
QEEEIATTNPVATEQYGEAPEVCQKEEK

SEQ ID NO: 106009 - protein, 33 aa, Artificial Sequence
  Description of Artificial Sequence: Synthetic polypeptide
DESEIRTTNPVATECWGSVSGINEPQDREMENG

SEQ ID NO: 106010 - protein, 28 aa, Artificial Sequence
  Description of Artificial Sequence: Synthetic peptide
QENEIAGTNPVATECYGDVSECLQHEEL

SEQ ID NO: 106011 - protein, 28 aa, Artificial Sequence
  Description of Artificial Sequence: Synthetic peptide
QEEEIATTNPVATEQYGEAPEVCQIEEK

SEQ ID NO: 106012 - protein, 28 aa, Artificial Sequence
  Description of Artificial Sequence: Synthetic peptide
QENEIAPTNPCASECYGIVSENLQSGTL

SEQ ID NO: 106013 - protein, 28 aa, Artificial Sequence
  Description of Artificial Sequence: Synthetic peptide
QENEIAPTNPCSSEQWGIVSCNLQSGTR

SEQ ID NO: 106014 - protein, 28 aa, Artificial Sequence
  Description of Artificial Sequence: Synthetic peptide
QEEEIATTNPVATEQYGEAPEVCQHYPK

SEQ ID NO: 106015 - protein, 33 aa, Artificial Sequence
  Description of Artificial Sequence: Synthetic polypeptide
DESEIRTTNPVATECWGSVSGINEPSDREGENG

SEQ ID NO: 106016 - protein, 34 aa, Artificial Sequence
  Description of Artificial Sequence: Synthetic polypeptide
DESEIRTTNPVATECWGSVSHCINEPQDREGENG

SEQ ID NO: 106017 - protein, 28 aa, Artificial Sequence
  Description of Artificial Sequence: Synthetic peptide
QENEIAPTNPCSSEQYGIISCNLQSGTR

SEQ ID NO: 106018 - protein, 28 aa, Artificial Sequence
  Description of Artificial Sequence: Synthetic peptide
QENEIAPTNPCSSEQYGIVSCNLASGTR

SEQ ID NO: 106019 - protein, 28 aa, Artificial Sequence
  Description of Artificial Sequence: Synthetic peptide
QEEEIATTNPVATEQYGEAPEVCQHYEK

SEQ ID NO: 106020 - protein, 29 aa, Artificial Sequence
  Description of Artificial Sequence: Synthetic peptide
QENEIAPTNPCSSEQYGIVSCNLQSNGTR

SEQ ID NO: 106021 - protein, 34 aa, Artificial Sequence
  Description of Artificial Sequence: Synthetic polypeptide
DESEIRTTNPVATECWGSVSGCINEPQAREGENG

SEQ ID NO: 106022 - protein, 28 aa, Artificial Sequence
  Description of Artificial Sequence: Synthetic peptide
QENEIASTNPVATECYGDVSETLQHEEL

SEQ ID NO: 106023 - protein, 28 aa, Artificial Sequence
  Description of Artificial Sequence: Synthetic peptide
QENEIASTNPVATECYGVMASTLQHGDL

SEQ ID NO: 106024 - protein, 28 aa, Artificial Sequence
  Description of Artificial Sequence: Synthetic peptide
QENEIASTNPVGTEGYGEMSSNLQHGGI

SEQ ID NO: 106025 - protein, 33 aa, Artificial Sequence
  Description of Artificial Sequence: Synthetic polypeptide
DEQEIATTNPVATEQYGSVSATNEEDHEGEEDL

SEQ ID NO: 106026 - protein, 28 aa, Artificial Sequence
  Description of Artificial Sequence: Synthetic peptide
QENEIASTNPVGTEGYGTIASTLQHGNI

SEQ ID NO: 106027 - protein, 28 aa, Artificial Sequence
  Description of Artificial Sequence: Synthetic peptide
QENEIASTNPVGTEGYGVIASTLQHGNI

SEQ ID NO: 106028 - protein, 28 aa, Artificial Sequence
  Description of Artificial Sequence: Synthetic peptide
QENEIASTNPVGTEGYGVVASTLQHGDI

SEQ ID NO: 106029 - protein, 28 aa, Artificial Sequence
  Description of Artificial Sequence: Synthetic peptide
QEEEIATTNPVATEQYGEAPEVCQHIMK

SEQ ID NO: 106030 - protein, 33 aa, Artificial Sequence
  Description of Artificial Sequence: Synthetic polypeptide
DESEIRTTNPVATECWGSVSLINEPQDREGEWG

SEQ ID NO: 106031 - protein, 28 aa, Artificial Sequence
  Description of Artificial Sequence: Synthetic peptide
QENEIASTNPVGTEGYGVVSECLQHGDI

SEQ ID NO: 106032 - protein, 28 aa, Artificial Sequence
  Description of Artificial Sequence: Synthetic peptide
QENEIASTNPVGTEGYGVVSSCLQHGDI

SEQ ID NO: 106033 - protein, 33 aa, Artificial Sequence
  Description of Artificial Sequence: Synthetic polypeptide
DEQEIATTNPVATEQYGSVSATMDLTDHEGEDL

SEQ ID NO: 106034 - protein, 33 aa, Artificial Sequence
  Description of Artificial Sequence: Synthetic polypeptide
DEQEIATTNPVATEQYGSVSATMDLEDHEGEQL

SEQ ID NO: 106035 - protein, 34 aa, Artificial Sequence
  Description of Artificial Sequence: Synthetic polypeptide
DESEIRTTNPVATECWGSVSMCINEPQDREGENG

SEQ ID NO: 106036 - protein, 33 aa, Artificial Sequence
  Description of Artificial Sequence: Synthetic polypeptide
DEQEIATTNPVATEQYGSVSATMDLEDHEGEDL

SEQ ID NO: 106037 - protein, 32 aa, Artificial Sequence
  Description of Artificial Sequence: Synthetic polypeptide
DEQEIATTNPVATEQYGSVSATLMEDGEGEDL

SEQ ID NO: 106038 - protein, 34 aa, Artificial Sequence
  Description of Artificial Sequence: Synthetic polypeptide
DESEIRTTNPVATECWGSVSMCINTPQDREGENG

SEQ ID NO: 106039 - protein, 34 aa, Artificial Sequence
  Description of Artificial Sequence: Synthetic polypeptide
AEEEIRTTNPVATEQYGSVSTVVNQQQTEDEEDE

SEQ ID NO: 106040 - protein, 28 aa, Artificial Sequence
  Description of Artificial Sequence: Synthetic peptide
QENEIASTNPVSTEPYGTMSSTLQHGNH

SEQ ID NO: 106041 - protein, 28 aa, Artificial Sequence
  Description of Artificial Sequence: Synthetic peptide
QENEIATTNPCASECYGIVSENLQSEEL

SEQ ID NO: 106042 - protein, 33 aa, Artificial Sequence
  Description of Artificial Sequence: Synthetic polypeptide
DEQEIATTNPVATEQYGSVSATLDLPDHEGEDL

SEQ ID NO: 106043 - protein, 33 aa, Artificial Sequence
  Description of Artificial Sequence: Synthetic polypeptide
DEQEIATTNPVATEQYGSVSATLDLEMHEGEDL

SEQ ID NO: 106044 - protein, 33 aa, Artificial Sequence
  Description of Artificial Sequence: Synthetic polypeptide
DEQEIATTNPVATEQYGSVSATLDLEDHFGEDL

SEQ ID NO: 106045 - protein, 33 aa, Artificial Sequence
  Description of Artificial Sequence: Synthetic polypeptide
DEQEIATTNPVATEQYGSVSATLDLEDHEGEDL

SEQ ID NO: 106046 - protein, 33 aa, Artificial Sequence
  Description of Artificial Sequence: Synthetic polypeptide
DEQEIATTNPVATEQYGSVSATKLPEDHEGEDL

SEQ ID NO: 106047 - protein, 33 aa, Artificial Sequence
  Description of Artificial Sequence: Synthetic polypeptide
DEQEIATTNPVATEQYGSVSATKLEEDHEGEDL

SEQ ID NO: 106048 - protein, 30 aa, Artificial Sequence
  Description of Artificial Sequence: Synthetic polypeptide
QENEIATTNPCASEQWGDVSCNLQNSAGTR

SEQ ID NO: 106049 - protein, 29 aa, Artificial Sequence
  Description of Artificial Sequence: Synthetic peptide
QEEEIATTNPVATEQYGEAPEVCQHINEK

SEQ ID NO: 106050 - protein, 28 aa, Artificial Sequence
  Description of Artificial Sequence: Synthetic peptide
QENEIASTNPVATECYGNVSETLQHEEL

SEQ ID NO: 106051 - protein, 34 aa, Artificial Sequence
  Description of Artificial Sequence: Synthetic polypeptide
AEEEIRTTNPVATEQYGSVSTVVNQQQTEMTEEE

SEQ ID NO: 106052 - protein, 28 aa, Artificial Sequence
  Description of Artificial Sequence: Synthetic peptide
QENEIASTNPVATEGYGVVSECLQHEDL

SEQ ID NO: 106053 - protein, 33 aa, Artificial Sequence
  Description of Artificial Sequence: Synthetic polypeptide
DEQEIATTNPVATEQYGSVSATPDLEDHEGEDL

SEQ ID NO: 106054 - protein, 33 aa, Artificial Sequence
  Description of Artificial Sequence: Synthetic polypeptide
DEQEIATTNPVATEQYGSVSATPDLEDHAGEDL

SEQ ID NO: 106055 - protein, 28 aa, Artificial Sequence
  Description of Artificial Sequence: Synthetic peptide
QENEIASTNPVATECYGVVSECLQHEEQ

SEQ ID NO: 106056 - protein, 28 aa, Artificial Sequence
  Description of Artificial Sequence: Synthetic peptide
QENEIASTNPVATEGWGVVASTLQAGDI

SEQ ID NO: 106057 - protein, 28 aa, Artificial Sequence
  Description of Artificial Sequence: Synthetic peptide
QENEIASTNPVATEGWGVVASTLQHGDI

SEQ ID NO: 106058 - protein, 28 aa, Artificial Sequence
  Description of Artificial Sequence: Synthetic peptide
QENEIASTNPVATEGYGDVSECLQHEDL

SEQ ID NO: 106059 - protein, 28 aa, Artificial Sequence
  Description of Artificial Sequence: Synthetic peptide
QEEEIATTNPVATEQYGEAPEVCQHNWK

SEQ ID NO: 106060 - protein, 29 aa, Artificial Sequence
  Description of Artificial Sequence: Synthetic peptide
QEEEIATTNPVATEQYGEAPEVCQHNGEK

SEQ ID NO: 106061 - protein, 29 aa, Artificial Sequence
  Description of Artificial Sequence: Synthetic peptide
QEEEIATTNPVATEQYGEAPEVCQHNENK

SEQ ID NO: 106062 - protein, 28 aa, Artificial Sequence
  Description of Artificial Sequence: Synthetic peptide
QENEIASTNPVATEGYGDVSECLQHEEL

SEQ ID NO: 106063 - protein, 28 aa, Artificial Sequence
  Description of Artificial Sequence: Synthetic peptide
QEEEIATTNPVATEQYGEAPEVCQHNEK

SEQ ID NO: 106064 - protein, 33 aa, Artificial Sequence
  Description of Artificial Sequence: Synthetic polypeptide
DESEIRTTNPVATECWGSVSIINEPQDREYENG

SEQ ID NO: 106065 - protein, 28 aa, Artificial Sequence
  Description of Artificial Sequence: Synthetic peptide
QEEEIATTNPVATEQYGEAPEVCQHNEH

SEQ ID NO: 106066 - protein, 28 aa, Artificial Sequence
  Description of Artificial Sequence: Synthetic peptide
QEEEIATTNPVATEQYGEAPEVCQHMEK

SEQ ID NO: 106067 - protein, 34 aa, Artificial Sequence
  Description of Artificial Sequence: Synthetic polypeptide
DESEIRTTNPVATECWGSVSIINIEPQDREGENG

SEQ ID NO: 106068 - protein, 34 aa, Artificial Sequence
  Description of Artificial Sequence: Synthetic polypeptide
DESEIRTTNPVATECWGSVSKCINEPQDREGENG

SEQ ID NO: 106069 - protein, 34 aa, Artificial Sequence
  Description of Artificial Sequence: Synthetic polypeptide
DESEIRTTNPVATECWGSVSKIINEPQDREGENG

SEQ ID NO: 106070 - protein, 28 aa, Artificial Sequence
  Description of Artificial Sequence: Synthetic peptide
QEEEIATTNPVATEQYGEAPEVCQHLEK

SEQ ID NO: 106071 - protein, 34 aa, Artificial Sequence
  Description of Artificial Sequence: Synthetic polypeptide
DESEIRTTNPVATECWGSVSKINEPQDREGENSG

SEQ ID NO: 106072 - protein, 28 aa, Artificial Sequence
  Description of Artificial Sequence: Synthetic peptide
QENEIASTNPVATEGYGVMASTLQHGDI

SEQ ID NO: 106073 - protein, 28 aa, Artificial Sequence
  Description of Artificial Sequence: Synthetic peptide
QENEIASTNPVATEGYGVMASTLQHGEI

SEQ ID NO: 106074 - protein, 28 aa, Artificial Sequence
  Description of Artificial Sequence: Synthetic peptide
QENEIASTNPVATEGYGVMSSTLQHGEI

SEQ ID NO: 106075 - protein, 34 aa, Artificial Sequence
  Description of Artificial Sequence: Synthetic polypeptide
DESEIRTTNPVATECWGSVSLCINEPQDREGENG

SEQ ID NO: 106076 - protein, 34 aa, Artificial Sequence
  Description of Artificial Sequence: Synthetic polypeptide
DESEIRTTNPVATECWGSVSLINEEPQDREGENG

SEQ ID NO: 106077 - protein, 28 aa, Artificial Sequence
  Description of Artificial Sequence: Synthetic peptide
QEEEIATTNPVATEQYGEAPEVCQHKEK

SEQ ID NO: 106078 - protein, 34 aa, Artificial Sequence
  Description of Artificial Sequence: Synthetic polypeptide
AEEEIRTTNPVATEQYGSVSTVVNQQQTETEDEE

SEQ ID NO: 106079 - protein, 28 aa, Artificial Sequence
  Description of Artificial Sequence: Synthetic peptide
QENEIACTNPVATEQYGEASEVCQREEK

SEQ ID NO: 106080 - protein, 36 aa, Artificial Sequence
  Description of Artificial Sequence: Synthetic polypeptide
AEEEIRTTNPVATEQYGSVSTVVSNGNQEGTTNQTD

SEQ ID NO: 106081 - protein, 28 aa, Artificial Sequence
  Description of Artificial Sequence: Synthetic peptide
QEEEIATTNPVATEQYGEAPEVCQNEEK

SEQ ID NO: 106082 - protein, 33 aa, Artificial Sequence
  Description of Artificial Sequence: Synthetic polypeptide
DEQEIATTNPVATEQYGSVSATYDLETHEGEDL

SEQ ID NO: 106083 - protein, 33 aa, Artificial Sequence
  Description of Artificial Sequence: Synthetic polypeptide
DEQEIATTNPVATEQYGSVSATYDLEDHEGEDL

SEQ ID NO: 106084 - protein, 31 aa, Artificial Sequence
  Description of Artificial Sequence: Synthetic polypeptide
QEMEIVSTNPVATEQYGTVSSDGLVQFEGND

SEQ ID NO: 106085 - protein, 28 aa, Artificial Sequence
  Description of Artificial Sequence: Synthetic peptide
QEEEIATTNPVATEQYGEAPEVCQYEEK

SEQ ID NO: 106086 - protein, 31 aa, Artificial Sequence
  Description of Artificial Sequence: Synthetic polypeptide
QEMEIVSTNPVATEQYGVVCSTDGLVEHGND

SEQ ID NO: 106087 - protein, 32 aa, Artificial Sequence
  Description of Artificial Sequence: Synthetic polypeptide
DEQEIATTNPVATEQYGSVSATWLEDHEVEDL

SEQ ID NO: 106088 - protein, 28 aa, Artificial Sequence
  Description of Artificial Sequence: Synthetic peptide
QEEEIATTNPVATEQYGEAPEVCQWTEK

SEQ ID NO: 106089 - protein, 33 aa, Artificial Sequence
  Description of Artificial Sequence: Synthetic polypeptide
DEQEIATTNPVATEQYGSVSATWDLEDHEGEDL

SEQ ID NO: 106090 - protein, 29 aa, Artificial Sequence
  Description of Artificial Sequence: Synthetic peptide
QEMEIVTTNPVATECYGTVSAECPQFGEL

SEQ ID NO: 106091 - protein, 35 aa, Artificial Sequence
  Description of Artificial Sequence: Synthetic polypeptide
AEEEIRTTNPVATEQYGSVSTVVSNQGNADEQIRE

SEQ ID NO: 106092 - protein, 32 aa, Artificial Sequence
  Description of Artificial Sequence: Synthetic polypeptide
QEMEIVTTNPVATEQYGIVCSACNLVEFEGND

SEQ ID NO: 106093 - protein, 32 aa, Artificial Sequence
  Description of Artificial Sequence: Synthetic polypeptide
QEMEIVTTNPVATEQYGTVCSASDGLQFEGNI

SEQ ID NO: 106094 - protein, 31 aa, Artificial Sequence
  Description of Artificial Sequence: Synthetic polypeptide
QEMEIVTTNPVATEQYGTVCSTDCLEHEEND

SEQ ID NO: 106095 - protein, 31 aa, Artificial Sequence
  Description of Artificial Sequence: Synthetic polypeptide
QEMEIVTTNPVATEQYGTVCSTDCLEHEENL

SEQ ID NO: 106096 - protein, 31 aa, Artificial Sequence
  Description of Artificial Sequence: Synthetic polypeptide
QEMEIVTTNPVATEQYGTVCSTDGLEFEEND

SEQ ID NO: 106097 - protein, 32 aa, Artificial Sequence
  Description of Artificial Sequence: Synthetic polypeptide
QEMEIVTTNPVATEQYGTVCSTDGLVEFEGND

SEQ ID NO: 106098 - protein, 31 aa, Artificial Sequence
  Description of Artificial Sequence: Synthetic polypeptide
QEMEIVTTNPVATEQYGTVPATDVPQHEGND

SEQ ID NO: 106099 - protein, 32 aa, Artificial Sequence
  Description of Artificial Sequence: Synthetic polypeptide
DEQEIATTNPVATEQYGSVSATVLEDHEFEDL

SEQ ID NO: 106100 - protein, 29 aa, Artificial Sequence
  Description of Artificial Sequence: Synthetic peptide
QEMEIVTTNPVATEQYGTVSAECPEFGEL

SEQ ID NO: 106101 - protein, 31 aa, Artificial Sequence
  Description of Artificial Sequence: Synthetic polypeptide
QEMEIVTTNPVATEQYGTVSAEDCLVQFGED

SEQ ID NO: 106102 - protein, 33 aa, Artificial Sequence
  Description of Artificial Sequence: Synthetic polypeptide
DESEIRTTNPVATECWGSVSEINEPMDREGENG

SEQ ID NO: 106103 - protein, 32 aa, Artificial Sequence
  Description of Artificial Sequence: Synthetic polypeptide
QEMEIVTTNPVATEQYGTVSASDGLVQFEGND

SEQ ID NO: 106104 - protein, 28 aa, Artificial Sequence
  Description of Artificial Sequence: Synthetic peptide
QEEEIATTNPVATEQYGEAPEVCQWEEK

SEQ ID NO: 106105 - protein, 32 aa, Artificial Sequence
  Description of Artificial Sequence: Synthetic polypeptide
QEMEIVTTNPVATEQYGTVSATDGPVQFEGND

SEQ ID NO: 106106 - protein, 28 aa, Artificial Sequence
  Description of Artificial Sequence: Synthetic peptide
QEEEIATTNPVATEQYGEAPEVCQVEEK

SEQ ID NO: 106107 - protein, 31 aa, Artificial Sequence
  Description of Artificial Sequence: Synthetic polypeptide
QEMEIVSTNPVATEQYGTVCSTDGLVEFGND

SEQ ID NO: 106108 - protein, 33 aa, Artificial Sequence
  Description of Artificial Sequence: Synthetic polypeptide
DEQEIATTNPVATEQYGSVSATVDNEDEEGEDL

SEQ ID NO: 106109 - protein, 37 aa, Artificial Sequence
  Description of Artificial Sequence: Synthetic polypeptide
AEEEIRTTNPVATEQYGSVSTVVSNQLGNQQGNNNGD

SEQ ID NO: 106110 - protein, 31 aa, Artificial Sequence
  Description of Artificial Sequence: Synthetic polypeptide
DESEIRTTNPVATECWGSVSEIEQNAAGEDA

SEQ ID NO: 106111 - protein, 29 aa, Artificial Sequence
  Description of Artificial Sequence: Synthetic peptide
QEMEIATTNPVATEGYGTMAASTLQFGDI

SEQ ID NO: 106112 - protein, 29 aa, Artificial Sequence
  Description of Artificial Sequence: Synthetic peptide
QEMEIATTNPVATEQYGEASTDVCQHEEK

SEQ ID NO: 106113 - protein, 31 aa, Artificial Sequence
  Description of Artificial Sequence: Synthetic polypeptide
QEMEIATTNPVATEQYGEVCSTDGPEHEGNK

SEQ ID NO: 106114 - protein, 34 aa, Artificial Sequence
  Description of Artificial Sequence: Synthetic polypeptide
DESEIRTTNPVATECWGSVSECINEPQDREGENG

SEQ ID NO: 106115 - protein, 30 aa, Artificial Sequence
  Description of Artificial Sequence: Synthetic polypeptide
QEMEIATTNPVATEQYGEVSTDGPEHEGEK

SEQ ID NO: 106116 - protein, 34 aa, Artificial Sequence
  Description of Artificial Sequence: Synthetic polypeptide
DESEIRTTNPVATECWGSVSECINEPQDREGENV

SEQ ID NO: 106117 - protein, 32 aa, Artificial Sequence
  Description of Artificial Sequence: Synthetic polypeptide
QEMEIATTNPVATEQYGIVCSACNLVEFEGND

SEQ ID NO: 106118 - protein, 33 aa, Artificial Sequence
  Description of Artificial Sequence: Synthetic polypeptide
DEQEIATTNPVATEQYGSVSCTDELEDHEGEDQ

SEQ ID NO: 106119 - protein, 32 aa, Artificial Sequence
  Description of Artificial Sequence: Synthetic polypeptide
QEMEIATTNPVATEQYGIVCSACNLVESEGND

SEQ ID NO: 106120 - protein, 33 aa, Artificial Sequence
  Description of Artificial Sequence: Synthetic polypeptide
DEQEIATTNPVATEQYGSVSCTDALEDHEVENL

SEQ ID NO: 106121 - protein, 32 aa, Artificial Sequence
  Description of Artificial Sequence: Synthetic polypeptide
QEMEIATTNPVATEQYGTVCSASDGLQFEGNI

SEQ ID NO: 106122 - protein, 34 aa, Artificial Sequence
  Description of Artificial Sequence: Synthetic polypeptide
DESEIRTTNPVATECWGSVSECINEPQDRWGENG

SEQ ID NO: 106123 - protein, 32 aa, Artificial Sequence
  Description of Artificial Sequence: Synthetic polypeptide
DEQEIATTNPVATEQYGSVSAYDLYDHEGEDL

SEQ ID NO: 106124 - protein, 32 aa, Artificial Sequence
  Description of Artificial Sequence: Synthetic polypeptide
DEQEIATTNPVATEQYGSVSAYDLEPHEGEDT

SEQ ID NO: 106125 - protein, 32 aa, Artificial Sequence
  Description of Artificial Sequence: Synthetic polypeptide
DEQEIATTNPVATEQYGSVSAYDLEDHEGEDL

SEQ ID NO: 106126 - protein, 32 aa, Artificial Sequence
  Description of Artificial Sequence: Synthetic polypeptide
DEQEIATTNPVATEQYGSVSAWDTEDHEGEDL

SEQ ID NO: 106127 - protein, 32 aa, Artificial Sequence
  Description of Artificial Sequence: Synthetic polypeptide
QEMEIATTNPVATEQYGTVCSASDTLQFEGNI

SEQ ID NO: 106128 - protein, 28 aa, Artificial Sequence
  Description of Artificial Sequence: Synthetic peptide
QEEEIATTNPVATEQYGEAPEVCQYEEY

SEQ ID NO: 106129 - protein, 32 aa, Artificial Sequence
  Description of Artificial Sequence: Synthetic polypeptide
DEQEIATTNPVATEQYGSVSAWDLEIHEREDN

SEQ ID NO: 106130 - protein, 32 aa, Artificial Sequence
  Description of Artificial Sequence: Synthetic polypeptide
DEQEIATTNPVATEQYGSVSAWDLEDHEGEDL

SEQ ID NO: 106131 - protein, 32 aa, Artificial Sequence
  Description of Artificial Sequence: Synthetic polypeptide
DEQEIATTNPVATEQYGSVSAVDLEDHEGEDL

SEQ ID NO: 106132 - protein, 31 aa, Artificial Sequence
  Description of Artificial Sequence: Synthetic polypeptide
QEMEIATTNPVATEQYGTVCSTDGPEHEGNK

SEQ ID NO: 106133 - protein, 33 aa, Artificial Sequence
  Description of Artificial Sequence: Synthetic polypeptide
DESEIRTTNPVATECWGSVSEICLPQDREEENG

SEQ ID NO: 106134 - protein, 32 aa, Artificial Sequence
  Description of Artificial Sequence: Synthetic polypeptide
DESEIRTTNPVATECWGSVSEIEPQDRAGEDA

SEQ ID NO: 106135 - protein, 28 aa, Artificial Sequence
  Description of Artificial Sequence: Synthetic peptide
QEMEIATTNPVGTEGYGVVATTPQHGDI

SEQ ID NO: 106136 - protein, 30 aa, Artificial Sequence
  Description of Artificial Sequence: Synthetic polypeptide
QEMEIVSTNPVATEGYGTVCSTGPVQHGND

SEQ ID NO: 106137 - protein, 34 aa, Artificial Sequence
  Description of Artificial Sequence: Synthetic polypeptide
DESEIRTTNPVATECWGSVSEINEPQDREGENGD

SEQ ID NO: 106138 - protein, 33 aa, Artificial Sequence
  Description of Artificial Sequence: Synthetic polypeptide
DEQEIATTNPVATEQYGSVSATVDLEDHEGEDL

SEQ ID NO: 106139 - protein, 33 aa, Artificial Sequence
  Description of Artificial Sequence: Synthetic polypeptide
DEQEIATTNPVATEQYGSVSATVDLEDHEGEDF

SEQ ID NO: 106140 - protein, 28 aa, Artificial Sequence
  Description of Artificial Sequence: Synthetic peptide
QENEIACTNPIATECYGDVSECLQHENL

SEQ ID NO: 106141 - protein, 28 aa, Artificial Sequence
  Description of Artificial Sequence: Synthetic peptide
QENEIACTNPVATECYGDVSECLQHEEL

SEQ ID NO: 106142 - protein, 29 aa, Artificial Sequence
  Description of Artificial Sequence: Synthetic peptide
QEEEIATTNPVATEQYGEAPEVCQQNENK

SEQ ID NO: 106143 - protein, 33 aa, Artificial Sequence
  Description of Artificial Sequence: Synthetic polypeptide
DEQEIATTNPVATEQYGSVSATQDLEDHEGEDL

SEQ ID NO: 106144 - protein, 33 aa, Artificial Sequence
  Description of Artificial Sequence: Synthetic polypeptide
DEQEIATTNPVATEQYGSVSATPLEDHEGKEDL

SEQ ID NO: 106145 - protein, 29 aa, Artificial Sequence
  Description of Artificial Sequence: Synthetic peptide
QEEEIATTNPVATEQYGEAPEVCQQHGEH

SEQ ID NO: 106146 - protein, 36 aa, Artificial Sequence
  Description of Artificial Sequence: Synthetic polypeptide
AEEEIRTTNPVATEQYGSVSTVVSNNGNQIGTNQDD

SEQ ID NO: 106147 - protein, 28 aa, Artificial Sequence
  Description of Artificial Sequence: Synthetic peptide
QENEIACTNPVATECYGDVSEPLQHEEL

SEQ ID NO: 106148 - protein, 33 aa, Artificial Sequence
  Description of Artificial Sequence: Synthetic polypeptide
DEQEIATTNPVATEQYGSVSATPDLEMHEGEDL

SEQ ID NO: 106149 - protein, 33 aa, Artificial Sequence
  Description of Artificial Sequence: Synthetic polypeptide
DEQEIATTNPVATEQYGSVSATPDLEDLEGEDL

SEQ ID NO: 106150 - protein, 37 aa, Artificial Sequence
  Description of Artificial Sequence: Synthetic polypeptide
AEEEIRTTNPVATEQYGSVSTVVSNLGQLGGNNNQND

SEQ ID NO: 106151 - protein, 28 aa, Artificial Sequence
  Description of Artificial Sequence: Synthetic peptide
QEEEIATTNPVATEQYGEAPEVCQQEEK

SEQ ID NO: 106152 - protein, 33 aa, Artificial Sequence
  Description of Artificial Sequence: Synthetic polypeptide
DEQEIATTNPVATEQYGSVSATPDLEDHGEDLQ

SEQ ID NO: 106153 - protein, 34 aa, Artificial Sequence
  Description of Artificial Sequence: Synthetic polypeptide
DESEIRTTNPVATECWGSVSFCINENQDREGENG

SEQ ID NO: 106154 - protein, 34 aa, Artificial Sequence
  Description of Artificial Sequence: Synthetic polypeptide
DESEIRTTNPVATECWGSVSFCINEPQDREGENG

SEQ ID NO: 106155 - protein, 34 aa, Artificial Sequence
  Description of Artificial Sequence: Synthetic polypeptide
DESEIRTTNPVATECWGSVSFCINEVQDREGENG

SEQ ID NO: 106156 - protein, 36 aa, Artificial Sequence
  Description of Artificial Sequence: Synthetic polypeptide
AEEEIRTTNPVATEQYGSVSTVVSNGTQGGNNNQQD

SEQ ID NO: 106157 - protein, 28 aa, Artificial Sequence
  Description of Artificial Sequence: Synthetic peptide
QENEIACTNPVATEQYGEAPEVLQREEK

SEQ ID NO: 106158 - protein, 28 aa, Artificial Sequence
  Description of Artificial Sequence: Synthetic peptide
QENEIACTNPVATEQYGEASENCQHEEK

SEQ ID NO: 106159 - protein, 28 aa, Artificial Sequence
  Description of Artificial Sequence: Synthetic peptide
QEEEIATTNPVATEQYGEAPEVCQQEEH

SEQ ID NO: 106160 - protein, 36 aa, Artificial Sequence
  Description of Artificial Sequence: Synthetic polypeptide
AEEEIRTTNPVATEQYGSVSTVVSNGQEGTNNNQTD

SEQ ID NO: 106161 - protein, 36 aa, Artificial Sequence
  Description of Artificial Sequence: Synthetic polypeptide
AEEEIRTTNPVATEQYGSVSTVVSNGNQSGNQNQTD

SEQ ID NO: 106162 - protein, 28 aa, Artificial Sequence
  Description of Artificial Sequence: Synthetic peptide
QEEEIATTNPVATEQYGEAPEVCQPEEK

SEQ ID NO: 106163 - protein, 36 aa, Artificial Sequence
  Description of Artificial Sequence: Synthetic polypeptide
AEEEIRTTNPVATEQYGSVSTVVSNGNQQGNGNNTD

SEQ ID NO: 106164 - protein, 28 aa, Artificial Sequence
  Description of Artificial Sequence: Synthetic peptide
QEEEIATTNPVATEQYGEAPEVCQPEED

SEQ ID NO: 106165 - protein, 29 aa, Artificial Sequence
  Description of Artificial Sequence: Synthetic peptide
QEEEIATTNPVATEQYGEAPEVCQQREEK

SEQ ID NO: 106166 - protein, 33 aa, Artificial Sequence
  Description of Artificial Sequence: Synthetic polypeptide
DEQEIATTNPVATEQYGSVSATRDLEDHEGEDL

SEQ ID NO: 106167 - protein, 29 aa, Artificial Sequence
  Description of Artificial Sequence: Synthetic peptide
QEEEIATTNPVATEQYGEAPEVCQREEQK

SEQ ID NO: 106168 - protein, 33 aa, Artificial Sequence
  Description of Artificial Sequence: Synthetic polypeptide
DEQEIATTNPVATEQYGSVSATRLREDHEGEDL

SEQ ID NO: 106169 - protein, 31 aa, Artificial Sequence
  Description of Artificial Sequence: Synthetic polypeptide
QEMEIVTTNPVATEQYGTVSTDGPVEFEGND

SEQ ID NO: 106170 - protein, 33 aa, Artificial Sequence
  Description of Artificial Sequence: Synthetic polypeptide
DEQEIATTNPVATEQYGSVSATTPLNDHGGEDN

SEQ ID NO: 106171 - protein, 28 aa, Artificial Sequence
  Description of Artificial Sequence: Synthetic peptide
QEEEIATTNPVATEQYGEAPEVCQTEEK

SEQ ID NO: 106172 - protein, 28 aa, Artificial Sequence
  Description of Artificial Sequence: Synthetic peptide
QEMEIVTTNPVGTEGYGTVATTPQHGDI

SEQ ID NO: 106173 - protein, 28 aa, Artificial Sequence
  Description of Artificial Sequence: Synthetic peptide
QEMEIVTTNPVGTEGYGVVATTPQHGDI

SEQ ID NO: 106174 - protein, 28 aa, Artificial Sequence
  Description of Artificial Sequence: Synthetic peptide
QEMEIVTTNPVGTEQYGTVATTPEHGDI

SEQ ID NO: 106175 - protein, 34 aa, Artificial Sequence
  Description of Artificial Sequence: Synthetic polypeptide
DESEIRTTNPVATECWGSVSEINEPQDREGENWG

SEQ ID NO: 106176 - protein, 28 aa, Artificial Sequence
  Description of Artificial Sequence: Synthetic peptide
QENAIATTNPVATECYGDVSECLQHEEL

SEQ ID NO: 106177 - protein, 30 aa, Artificial Sequence
  Description of Artificial Sequence: Synthetic polypeptide
QEEEIATTNPVATEQYGEAPEVCQSRVEER

SEQ ID NO: 106178 - protein, 32 aa, Artificial Sequence
  Description of Artificial Sequence: Synthetic polypeptide
DEQEIATTNPVATEQYGSVSATTLEDHEDEDL

SEQ ID NO: 106179 - protein, 29 aa, Artificial Sequence
  Description of Artificial Sequence: Synthetic peptide
QEEEIATTNPVATEQYGEAPEVCQSHEER

SEQ ID NO: 106180 - protein, 33 aa, Artificial Sequence
  Description of Artificial Sequence: Synthetic polypeptide
DEQEIATTNPVATEQYGSVSATTDLEDHMGEDL

SEQ ID NO: 106181 - protein, 28 aa, Artificial Sequence
  Description of Artificial Sequence: Synthetic peptide
QEEEIATTNPVATEQYGEAPEVCQYEWK

SEQ ID NO: 106182 - protein, 30 aa, Artificial Sequence
  Description of Artificial Sequence: Synthetic polypeptide
QENAIATTNPVATECYGDVSECLQNREENL

SEQ ID NO: 106183 - protein, 33 aa, Artificial Sequence
  Description of Artificial Sequence: Synthetic polypeptide
DEQEIATTNPVATEQYGSVSATTDLEDHEGEDL

SEQ ID NO: 106184 - protein, 28 aa, Artificial Sequence
  Description of Artificial Sequence: Synthetic peptide
QENAIATTNPVATECYGDVSSCLQHEEL

SEQ ID NO: 106185 - protein, 28 aa, Artificial Sequence
  Description of Artificial Sequence: Synthetic peptide
QENCIATTNPVATECYGDVSECLQHEEL

SEQ ID NO: 106186 - protein, 28 aa, Artificial Sequence
  Description of Artificial Sequence: Synthetic peptide
QENCIATTNPVATECYGDVSECLQHQEL

SEQ ID NO: 106187 - protein, 28 aa, Artificial Sequence
  Description of Artificial Sequence: Synthetic peptide
QENDIATTNPVATECYGDVSECLQHETL

SEQ ID NO: 106188 - protein, 33 aa, Artificial Sequence
  Description of Artificial Sequence: Synthetic polypeptide
DEQEIATTNPVATEQYGSVSATSLAEDHEGEDL

SEQ ID NO: 106189 - protein, 33 aa, Artificial Sequence
  Description of Artificial Sequence: Synthetic polypeptide
DEQEIATTNPVATEQYGSVSATSDLEDHWGEDL

SEQ ID NO: 106190 - protein, 28 aa, Artificial Sequence
  Description of Artificial Sequence: Synthetic peptide
QENEIAATNPVATECYGDVSECLQHEEL

SEQ ID NO: 106191 - protein, 28 aa, Artificial Sequence
  Description of Artificial Sequence: Synthetic peptide
QEEEIATTNPVATEQYGEAPEVCQSEEK

SEQ ID NO: 106192 - protein, 29 aa, Artificial Sequence
  Description of Artificial Sequence: Synthetic peptide
QEEEIATTNPVATEQYGEAPEVCQRHEEK

SEQ ID NO: 106193 - protein, 33 aa, Artificial Sequence
  Description of Artificial Sequence: Synthetic polypeptide
DEQEIATTNPVATEQYGSVSATSDLEDHEGSDL

SEQ ID NO: 106194 - protein, 33 aa, Artificial Sequence
  Description of Artificial Sequence: Synthetic polypeptide
DEQEIATTNPVATEQYGSVSATSDLEDHEGEDL

SEQ ID NO: 106195 - protein, 33 aa, Artificial Sequence
  Description of Artificial Sequence: Synthetic polypeptide
DEQEIATTNPVATEQYGSVSATTDLEDHEGEWL

SEQ ID NO: 106196 - protein, 28 aa, Artificial Sequence
  Description of Artificial Sequence: Synthetic peptide
QEGEIATTNPVATEQYGEAPEVCQHGEK

SEQ ID NO: 106197 - protein, 33 aa, Artificial Sequence
  Description of Artificial Sequence: Synthetic polypeptide
DESEIRTTNPVATECWGSVSCIVEKQDREGENG

SEQ ID NO: 106198 - protein, 34 aa, Artificial Sequence
  Description of Artificial Sequence: Synthetic polypeptide
DEQEIATTNPVATEQYGSVSVTKLQEDYEGLEDE

SEQ ID NO: 106199 - protein, 31 aa, Artificial Sequence
  Description of Artificial Sequence: Synthetic polypeptide
DEQEIATTNPVGTEQYGSVSASTLEHEGEDL

SEQ ID NO: 106200 - protein, 31 aa, Artificial Sequence
  Description of Artificial Sequence: Synthetic polypeptide
DEQEIATTNPVGTEQYGSVSASDLEHEGEDL

SEQ ID NO: 106201 - protein, 34 aa, Artificial Sequence
  Description of Artificial Sequence: Synthetic polypeptide
DESEIRTTNPVATECWGSVSCINNGPQDREGENG

SEQ ID NO: 106202 - protein, 32 aa, Artificial Sequence
  Description of Artificial Sequence: Synthetic polypeptide
DEQEIATTNPVGTEQYGSVAATDLQDHEGEDL

SEQ ID NO: 106203 - protein, 34 aa, Artificial Sequence
  Description of Artificial Sequence: Synthetic polypeptide
DESEIRTTNPVATECWGSVSCINNPPQDREGENG

SEQ ID NO: 106204 - protein, 31 aa, Artificial Sequence
  Description of Artificial Sequence: Synthetic polypeptide
DEQEIATTNPVCTETYGSVANPNLQTDEGGL

SEQ ID NO: 106205 - protein, 28 aa, Artificial Sequence
  Description of Artificial Sequence: Synthetic peptide
QEGEIAPTNPVSTEGYGIMASNLQHGDR

SEQ ID NO: 106206 - protein, 32 aa, Artificial Sequence
  Description of Artificial Sequence: Synthetic polypeptide
DEQEIATTNPVCTEQYGVVSATDLEDHEGNDL

SEQ ID NO: 106207 - protein, 29 aa, Artificial Sequence
  Description of Artificial Sequence: Synthetic peptide
QEGEIAPTNPVSTEGYGIVACNIQSRGQR

SEQ ID NO: 106208 - protein, 29 aa, Artificial Sequence
  Description of Artificial Sequence: Synthetic peptide
QEGEIAPTNPVSTEGYGIVACNIQSRGTR

SEQ ID NO: 106209 - protein, 32 aa, Artificial Sequence
  Description of Artificial Sequence: Synthetic polypeptide
DEQEIATTNPVCTEQYGSVSATDLEDHEGEDL

SEQ ID NO: 106210 - protein, 32 aa, Artificial Sequence
  Description of Artificial Sequence: Synthetic polypeptide
DEQEIATTNPVCTEQYGSVSATDLEDCEGEDL

SEQ ID NO: 106211 - protein, 32 aa, Artificial Sequence
  Description of Artificial Sequence: Synthetic polypeptide
DEQEIATTNPVCTEQYGCVAANNLQGMGNQFT

SEQ ID NO: 106212 - protein, 33 aa, Artificial Sequence
  Description of Artificial Sequence: Synthetic polypeptide
DEQEIATTNPVAYTEQYGSVSATDLEDHEGEDL

SEQ ID NO: 106213 - protein, 32 aa, Artificial Sequence
  Description of Artificial Sequence: Synthetic polypeptide
DEQEIATTNPVAYETWGTVSTNLNGDHGDNER

SEQ ID NO: 106214 - protein, 32 aa, Artificial Sequence
  Description of Artificial Sequence: Synthetic polypeptide
DEQEIATTNPVAYERWGTVSTSNNSNQDGMNR

SEQ ID NO: 106215 - protein, 33 aa, Artificial Sequence
  Description of Artificial Sequence: Synthetic polypeptide
DEQEIATTNPVAYERWGTVSTNLNQGDVGDNTR

SEQ ID NO: 106216 - protein, 29 aa, Artificial Sequence
  Description of Artificial Sequence: Synthetic peptide
QEEEIATTNPVATEQYGEASEVCQHEEEK

SEQ ID NO: 106217 - protein, 34 aa, Artificial Sequence
  Description of Artificial Sequence: Synthetic polypeptide
DESEIRTTNPVATECWGSVSCINNPQDREGENGS

SEQ ID NO: 106218 - protein, 33 aa, Artificial Sequence
  Description of Artificial Sequence: Synthetic polypeptide
DESEIRTTNPVATECWGSVSCINNPQDREYENG

SEQ ID NO: 106219 - protein, 34 aa, Artificial Sequence
  Description of Artificial Sequence: Synthetic polypeptide
DESEIRTTNPVATECWGSVSCINPEPQDRDGENG

SEQ ID NO: 106220 - protein, 33 aa, Artificial Sequence
  Description of Artificial Sequence: Synthetic polypeptide
DEQEIATTNPVAYEQYGSVVSVTDLEDHEGENL

SEQ ID NO: 106221 - protein, 28 aa, Artificial Sequence
  Description of Artificial Sequence: Synthetic peptide
QEGEIASTNPCCSEQYGVVSDNLQSGTQ

SEQ ID NO: 106222 - protein, 35 aa, Artificial Sequence
  Description of Artificial Sequence: Synthetic polypeptide
CEEEIATTNPVATEQYGSVAIANNLPQEAPGENAR

SEQ ID NO: 106223 - protein, 34 aa, Artificial Sequence
  Description of Artificial Sequence: Synthetic polypeptide
CEEEIATTNPVATEQYGSVAITNPDQNESGNTEE

SEQ ID NO: 106224 - protein, 32 aa, Artificial Sequence
  Description of Artificial Sequence: Synthetic polypeptide
DEQEIATTNPVGTEQYGSVSATDLEDHEGDDL

SEQ ID NO: 106225 - protein, 32 aa, Artificial Sequence
  Description of Artificial Sequence: Synthetic polypeptide
DEQEIATTNPVAYEQYGSVSCTDLEDHEGEDS

SEQ ID NO: 106226 - protein, 32 aa, Artificial Sequence
  Description of Artificial Sequence: Synthetic polypeptide
DEQEIATTNPVGTEQYGSVSATDLEDHEGEDL

SEQ ID NO: 106227 - protein, 29 aa, Artificial Sequence
  Description of Artificial Sequence: Synthetic peptide
QEEEIATTNPVATEQYGEASEVCQHEEKK

SEQ ID NO: 106228 - protein, 29 aa, Artificial Sequence
  Description of Artificial Sequence: Synthetic peptide
QEEEIATTNPVATEQYGEASEVEQHEEEK

SEQ ID NO: 106229 - protein, 32 aa, Artificial Sequence
  Description of Artificial Sequence: Synthetic polypeptide
DEQEIATTNPWATEQYGSVSATDLEDHEGEDL

SEQ ID NO: 106230 - protein, 31 aa, Artificial Sequence
  Description of Artificial Sequence: Synthetic polypeptide
DEQEIATTNPWATEQYGSVGATWLEDNEGEL

SEQ ID NO: 106231 - protein, 32 aa, Artificial Sequence
  Description of Artificial Sequence: Synthetic polypeptide
DEQEIATTNPVTTEQYGSVSATDLEDHEGEHL

SEQ ID NO: 106232 - protein, 32 aa, Artificial Sequence
  Description of Artificial Sequence: Synthetic polypeptide
DEQEIATTNPVTTEQYGSVSATDLEDHEGEDL

SEQ ID NO: 106233 - protein, 29 aa, Artificial Sequence
  Description of Artificial Sequence: Synthetic peptide
CEEEIATTNPVATEQYGEMPEVEQMSNEG

SEQ ID NO: 106234 - protein, 28 aa, Artificial Sequence
  Description of Artificial Sequence: Synthetic peptide
CEEEIATTNPVATEQYGEPPEPGQHEED

SEQ ID NO: 106235 - protein, 29 aa, Artificial Sequence
  Description of Artificial Sequence: Synthetic peptide
QEEEIATTNPVATEQYGEASEVEQHAEDK

SEQ ID NO: 106236 - protein, 32 aa, Artificial Sequence
  Description of Artificial Sequence: Synthetic polypeptide
DEQEIATTNPVSTEQYGSVSATDLEDHEGEDL

SEQ ID NO: 106237 - protein, 29 aa, Artificial Sequence
  Description of Artificial Sequence: Synthetic peptide
QEEEIATTNPVATEQYGEASEVCQNAEEK

SEQ ID NO: 106238 - protein, 28 aa, Artificial Sequence
  Description of Artificial Sequence: Synthetic peptide
QEGEIAPTNPVSSEQYGIVSENLQSETK

SEQ ID NO: 106239 - protein, 32 aa, Artificial Sequence
  Description of Artificial Sequence: Synthetic polypeptide
DEQEIATTNPVSTEQYGIVSATDLEDHEGEDR

SEQ ID NO: 106240 - protein, 32 aa, Artificial Sequence
  Description of Artificial Sequence: Synthetic polypeptide
DEQEIATTNPVSTEPYGTVSATDLEQHNGNDH

SEQ ID NO: 106241 - protein, 32 aa, Artificial Sequence
  Description of Artificial Sequence: Synthetic polypeptide
DEQEIATTNPVSTEPYGTVSATDLEQHEGNDH

SEQ ID NO: 106242 - protein, 32 aa, Artificial Sequence
  Description of Artificial Sequence: Synthetic polypeptide
DEQEIATTNPVSTEPYGSVSATDLEQHEGEDL

SEQ ID NO: 106243 - protein, 31 aa, Artificial Sequence
  Description of Artificial Sequence: Synthetic polypeptide
DEQEIATTNPVSTEGYGSVSATDLESHEGEL

SEQ ID NO: 106244 - protein, 31 aa, Artificial Sequence
  Description of Artificial Sequence: Synthetic polypeptide
DEQEIATTNPVSTEGYGSVSATDLEDHEGEL

SEQ ID NO: 106245 - protein, 31 aa, Artificial Sequence
  Description of Artificial Sequence: Synthetic polypeptide
DEQEIATTNPVSTEGYGNVAANDLQDREGQL

SEQ ID NO: 106246 - protein, 28 aa, Artificial Sequence
  Description of Artificial Sequence: Synthetic peptide
CEEEIATTNPVATEQYGEPPVVGQHMEK

SEQ ID NO: 106247 - protein, 34 aa, Artificial Sequence
  Description of Artificial Sequence: Synthetic polypeptide
DESEIRTTNPVATECWGSVSCINMEPQDREGENG

SEQ ID NO: 106248 - protein, 34 aa, Artificial Sequence
  Description of Artificial Sequence: Synthetic polypeptide
DESEIRTTNPVATECWGSVSCINMHSQDRTGGNG

SEQ ID NO: 106249 - protein, 31 aa, Artificial Sequence
  Description of Artificial Sequence: Synthetic polypeptide
DEQEIATTNPVGTEQYGVVSTDLEDHEGDDL

SEQ ID NO: 106250 - protein, 28 aa, Artificial Sequence
  Description of Artificial Sequence: Synthetic peptide
QEGEIAPTNPVSTECYGIVSCCLQHGTL

SEQ ID NO: 106251 - protein, 29 aa, Artificial Sequence
  Description of Artificial Sequence: Synthetic peptide
DEQEIATTNPVGTEQYGVMSSTLEHGEDL

SEQ ID NO: 106252 - protein, 29 aa, Artificial Sequence
  Description of Artificial Sequence: Synthetic peptide
DEQEIATTNPVGTEQYGVMASTLEHGEDL

SEQ ID NO: 106253 - protein, 34 aa, Artificial Sequence
  Description of Artificial Sequence: Synthetic polypeptide
DESEIRTTNPVATECWGSVSCINNEPQDREGENG

SEQ ID NO: 106254 - protein, 29 aa, Artificial Sequence
  Description of Artificial Sequence: Synthetic peptide
QEGEIAPTNPVSSEQYGIVSCGPQSEGNR

SEQ ID NO: 106255 - protein, 33 aa, Artificial Sequence
  Description of Artificial Sequence: Synthetic polypeptide
DEQEIATTNPVAYEQYGSVSATDLEDHEGGMNL

SEQ ID NO: 106256 - protein, 32 aa, Artificial Sequence
  Description of Artificial Sequence: Synthetic polypeptide
DEQEIATTNPVAYEQYGSVSATDLEDHCGEDL

SEQ ID NO: 106257 - protein, 28 aa, Artificial Sequence
  Description of Artificial Sequence: Synthetic peptide
QEGEIASTNPVSSEGYGIVSCTLQSGTR

SEQ ID NO: 106258 - protein, 28 aa, Artificial Sequence
  Description of Artificial Sequence: Synthetic peptide
QEGEIASTNPVSSEQYGVMASTLQSGTR

SEQ ID NO: 106259 - protein, 33 aa, Artificial Sequence
  Description of Artificial Sequence: Synthetic polypeptide
CEEEIATTNPVATEQYGSVCATLQESGNDNAQV

SEQ ID NO: 106260 - protein, 32 aa, Artificial Sequence
  Description of Artificial Sequence: Synthetic polypeptide
CEEEIATTNPVATEQYGSVCATNNLHDSLDHH

SEQ ID NO: 106261 - protein, 34 aa, Artificial Sequence
  Description of Artificial Sequence: Synthetic polypeptide
DESEIRTTNPVATECWGSVSCINQEPQDREGENG

SEQ ID NO: 106262 - protein, 28 aa, Artificial Sequence
  Description of Artificial Sequence: Synthetic peptide
QEGEIASVNPCCTEQYGIVSDNLQSGTQ

SEQ ID NO: 106263 - protein, 34 aa, Artificial Sequence
  Description of Artificial Sequence: Synthetic polypeptide
DESEIRTTNPVATECWGSVSCINQEYQDREGENG

SEQ ID NO: 106264 - protein, 33 aa, Artificial Sequence
  Description of Artificial Sequence: Synthetic polypeptide
DESEIRTTNPVATECWGSVSCINQPQDREGECG

SEQ ID NO: 106265 - protein, 33 aa, Artificial Sequence
  Description of Artificial Sequence: Synthetic polypeptide
DEQEIATTNPVAYEQWGSVSTNLNMDGQGDNED

SEQ ID NO: 106266 - protein, 34 aa, Artificial Sequence
  Description of Artificial Sequence: Synthetic polypeptide
DESEIRTTNPVATECWGSVSCINREPQDREGENG

SEQ ID NO: 106267 - protein, 28 aa, Artificial Sequence
  Description of Artificial Sequence: Synthetic peptide
QEGEIATTNPCASEQYGEAPCNCQHGER

SEQ ID NO: 106268 - protein, 28 aa, Artificial Sequence
  Description of Artificial Sequence: Synthetic peptide
QEGEIATTNPCASEQYGEAPENCQHGER

SEQ ID NO: 106269 - protein, 34 aa, Artificial Sequence
  Description of Artificial Sequence: Synthetic polypeptide
DESEIRTTNPVATECWGSVSCINRPQDREGENAG

SEQ ID NO: 106270 - protein, 33 aa, Artificial Sequence
  Description of Artificial Sequence: Synthetic polypeptide
DEQEIATTNPVAYEQWGSVSTNLNGDGGDQRND

SEQ ID NO: 106271 - protein, 31 aa, Artificial Sequence
  Description of Artificial Sequence: Synthetic polypeptide
DEQEIATTNPVAYEQWGSVSTGNVPGDVNDV

SEQ ID NO: 106272 - protein, 28 aa, Artificial Sequence
  Description of Artificial Sequence: Synthetic peptide
QEEEIATTNPVATEQYGEAQEVCQHEQK

SEQ ID NO: 106273 - protein, 28 aa, Artificial Sequence
  Description of Artificial Sequence: Synthetic peptide
QEEEIATTNPVATEQYGEAPYVDQHEED

SEQ ID NO: 106274 - protein, 32 aa, Artificial Sequence
  Description of Artificial Sequence: Synthetic polypeptide
DEQEIATTNPVAYEQWGSVSTGNDNPQDVNDV

SEQ ID NO: 106275 - protein, 32 aa, Artificial Sequence
  Description of Artificial Sequence: Synthetic polypeptide
DEQEIATTNPVAYEQWGSVSTGNAPQDVNDVD

SEQ ID NO: 106276 - protein, 32 aa, Artificial Sequence
  Description of Artificial Sequence: Synthetic polypeptide
DEQEIATTNPVAYEQWGSVATNPTQTGNGDEQ

SEQ ID NO: 106277 - protein, 34 aa, Artificial Sequence
  Description of Artificial Sequence: Synthetic polypeptide
DESEIRTTNPVATECWGSVSCINSEPQDREGENG

SEQ ID NO: 106278 - protein, 28 aa, Artificial Sequence
  Description of Artificial Sequence: Synthetic peptide
QEEEIATTNPVATEQYGEAPYVCQHEPK

SEQ ID NO: 106279 - protein, 34 aa, Artificial Sequence
  Description of Artificial Sequence: Synthetic polypeptide
DESEIRTTNPVATECWGSVSCINSPQDREGENVG

SEQ ID NO: 106280 - protein, 34 aa, Artificial Sequence
  Description of Artificial Sequence: Synthetic polypeptide
DESEIRTTNPVATECWGSVSCINTEPQDREGENG

SEQ ID NO: 106281 - protein, 32 aa, Artificial Sequence
  Description of Artificial Sequence: Synthetic polypeptide
DEQEIATTNPVAYEPWGSVSTNLGGNAGEDAR

SEQ ID NO: 106282 - protein, 28 aa, Artificial Sequence
  Description of Artificial Sequence: Synthetic peptide
QEGEIASTNPVGTEGYGVMSCTLQSGTR

SEQ ID NO: 106283 - protein, 32 aa, Artificial Sequence
  Description of Artificial Sequence: Synthetic polypeptide
DEQEIATTNPVAYEQYGSVSATDLEDHEGEDL

SEQ ID NO: 106284 - protein, 32 aa, Artificial Sequence
  Description of Artificial Sequence: Synthetic polypeptide
DEQEIATTNPVAYEQWGSVTTNPNGNGDGNVR

SEQ ID NO: 106285 - protein, 33 aa, Artificial Sequence
  Description of Artificial Sequence: Synthetic polypeptide
DEQEIATTNPVAYEQWGTVSTNLQVGGGHNDGS

SEQ ID NO: 106286 - protein, 32 aa, Artificial Sequence
  Description of Artificial Sequence: Synthetic polypeptide
DEQEIATTNPVAYEQYGSVSATDHEDHRGEDL

SEQ ID NO: 106287 - protein, 35 aa, Artificial Sequence
  Description of Artificial Sequence: Synthetic polypeptide
DEQEIATTNPVAYEQYGSVCSATNNLAEPPGGENR

SEQ ID NO: 106288 - protein, 36 aa, Artificial Sequence
  Description of Artificial Sequence: Synthetic polypeptide
AEEEIRTTNPVATEQYGSVVTVANLNQQGETGNNVE

SEQ ID NO: 106289 - protein, 30 aa, Artificial Sequence
  Description of Artificial Sequence: Synthetic polypeptide
QEEEIATTNPVATEQYGEASENCPQDHEEK

SEQ ID NO: 106290 - protein, 28 aa, Artificial Sequence
  Description of Artificial Sequence: Synthetic peptide
QEGEIASTNPCSSEGYGIVSSNLQHGTR

SEQ ID NO: 106291 - protein, 29 aa, Artificial Sequence
  Description of Artificial Sequence: Synthetic peptide
QEEEIATTNPVATEQYGEASEGCQYTEEK

SEQ ID NO: 106292 - protein, 32 aa, Artificial Sequence
  Description of Artificial Sequence: Synthetic polypeptide
DEQEIATTNPVAYEQYGSVATHLQDSMINDEM

SEQ ID NO: 106293 - protein, 31 aa, Artificial Sequence
  Description of Artificial Sequence: Synthetic polypeptide
DEQEIATTNPVAYEQYGSVASSLQAENPGTE

SEQ ID NO: 106294 - protein, 33 aa, Artificial Sequence
  Description of Artificial Sequence: Synthetic polypeptide
DEQEIATTNPVAYEQYGSVANTNLQTTPADNPY

SEQ ID NO: 106295 - protein, 28 aa, Artificial Sequence
  Description of Artificial Sequence: Synthetic peptide
QEGEIASTNPCSSEQYGIVSCNLQHGTI

SEQ ID NO: 106296 - protein, 29 aa, Artificial Sequence
  Description of Artificial Sequence: Synthetic peptide
QEEEIATTNPVATEQYGEASEDCQHEEDK

SEQ ID NO: 106297 - protein, 32 aa, Artificial Sequence
  Description of Artificial Sequence: Synthetic polypeptide
DEQEIATTNPVAYEQYGSVAIANNDTQQGNDT

SEQ ID NO: 106298 - protein, 34 aa, Artificial Sequence
  Description of Artificial Sequence: Synthetic polypeptide
DESEIRTTNPVATECWGSVSCINPEPQDREGENG

SEQ ID NO: 106299 - protein, 36 aa, Artificial Sequence
  Description of Artificial Sequence: Synthetic polypeptide
AEEEIRTTNPVATEQYGSVVTVANLNQQGTNGTNNM

SEQ ID NO: 106300 - protein, 29 aa, Artificial Sequence
  Description of Artificial Sequence: Synthetic peptide
QEEEIATTNPVATEQYGEASDEVCQHEEK

SEQ ID NO: 106301 - protein, 28 aa, Artificial Sequence
  Description of Artificial Sequence: Synthetic peptide
QEGEIASTNPCSTEGYGIVACNIQRGTR

SEQ ID NO: 106302 - protein, 33 aa, Artificial Sequence
  Description of Artificial Sequence: Synthetic polypeptide
DEQEIATTNPVAYEQYGSVAANTNLQTPANNPY

SEQ ID NO: 106303 - protein, 33 aa, Artificial Sequence
  Description of Artificial Sequence: Synthetic polypeptide
DESEIRTTNPVATECWGSVSCINPPQYRELENG

SEQ ID NO: 106304 - protein, 30 aa, Artificial Sequence
  Description of Artificial Sequence: Synthetic polypeptide
DEQEIATTNPVAYEQYGSVAAANDAAMNNS

SEQ ID NO: 106305 - protein, 29 aa, Artificial Sequence
  Description of Artificial Sequence: Synthetic peptide
QEGEIASTNPCSYEQYGEVSCNLQSHGTR

SEQ ID NO: 106306 - protein, 30 aa, Artificial Sequence
  Description of Artificial Sequence: Synthetic polypeptide
QEGEIASTNPCSYEQYGIVPSCNLQSGTNR

SEQ ID NO: 106307 - protein, 31 aa, Artificial Sequence
  Description of Artificial Sequence: Synthetic polypeptide
DEQEIATTNPVAYEQYGEVSTNPQNDDTMQH

SEQ ID NO: 106308 - protein, 34 aa, Artificial Sequence
  Description of Artificial Sequence: Synthetic polypeptide
DESEIRTTNPVATECWGSVSCINQEGQDREGENG

SEQ ID NO: 106309 - protein, 28 aa, Artificial Sequence
  Description of Artificial Sequence: Synthetic peptide
QEGEIASTNPVGSEQYGIMASNLQSGDR

SEQ ID NO: 106310 - protein, 28 aa, Artificial Sequence
  Description of Artificial Sequence: Synthetic peptide
QEGEIASTNPVGTEGYGVMASNLQHGDR

SEQ ID NO: 106311 - protein, 34 aa, Artificial Sequence
  Description of Artificial Sequence: Synthetic polypeptide
DEQEIATTNPVAYEQWGSVVCTDNLDQRDGNTNS

SEQ ID NO: 106312 - protein, 32 aa, Artificial Sequence
  Description of Artificial Sequence: Synthetic polypeptide
DEQEIATTNPYATEQYGSVSATDLEDHEGEDL

SEQ ID NO: 106313 - protein, 28 aa, Artificial Sequence
  Description of Artificial Sequence: Synthetic peptide
QEGEIAPTNPVSSEQYGIVSCDLQSGTL

SEQ ID NO: 106314 - protein, 28 aa, Artificial Sequence
  Description of Artificial Sequence: Synthetic peptide
QEGEIAPTNPVSSEQYGIVPCNLQSGTK

SEQ ID NO: 106315 - protein, 32 aa, Artificial Sequence
  Description of Artificial Sequence: Synthetic polypeptide
DEQEIRTTNPIATEQYGSVSAEDLEDHEGEDL

SEQ ID NO: 106316 - protein, 33 aa, Artificial Sequence
  Description of Artificial Sequence: Synthetic polypeptide
DEQEIRMTNPVATECWGSVSCINEPQDREGENG

SEQ ID NO: 106317 - protein, 31 aa, Artificial Sequence
  Description of Artificial Sequence: Synthetic polypeptide
QEEEIATTNPVATEQYGEASTEVGNRNGEPK

SEQ ID NO: 106318 - protein, 30 aa, Artificial Sequence
  Description of Artificial Sequence: Synthetic polypeptide
QEEEIATTNPVATEQYGEASTDCQDHEEDK

SEQ ID NO: 106319 - protein, 34 aa, Artificial Sequence
  Description of Artificial Sequence: Synthetic polypeptide
DESEIRTTNPVATECWGSVSCINGEPQDREGENG

SEQ ID NO: 106320 - protein, 28 aa, Artificial Sequence
  Description of Artificial Sequence: Synthetic peptide
CEEEIATTNPVATEQYGCAPWVDQHEEK

SEQ ID NO: 106321 - protein, 28 aa, Artificial Sequence
  Description of Artificial Sequence: Synthetic peptide
QEGEIAPTNPLSSEQYGIVSCNLQSGTT

SEQ ID NO: 106322 - protein, 32 aa, Artificial Sequence
  Description of Artificial Sequence: Synthetic polypeptide
CEEEIATTNPVATEQYGCVAGTMLQHQDDNPP

SEQ ID NO: 106323 - protein, 30 aa, Artificial Sequence
  Description of Artificial Sequence: Synthetic polypeptide
QEEEIATTNPVATEQYGEASTDCEHEGEDL

SEQ ID NO: 106324 - protein, 32 aa, Artificial Sequence
  Description of Artificial Sequence: Synthetic polypeptide
DEQEIQTTNPVATVQYGSVSATDLEKHEGEDL

SEQ ID NO: 106325 - protein, 34 aa, Artificial Sequence
  Description of Artificial Sequence: Synthetic polypeptide
DESEIRTTNPVATECWGSVSCINHEPQDREGENG

SEQ ID NO: 106326 - protein, 32 aa, Artificial Sequence
  Description of Artificial Sequence: Synthetic polypeptide
DEQEIQTTNPVATEQYGSVSATDLEDHEHEDL

SEQ ID NO: 106327 - protein, 33 aa, Artificial Sequence
  Description of Artificial Sequence: Synthetic polypeptide
DEQEIQTTNPVATEQYGSVSATDLEDHEGSEDL

SEQ ID NO: 106328 - protein, 34 aa, Artificial Sequence
  Description of Artificial Sequence: Synthetic polypeptide
DESEIRTTNPVATECWGSVSCINHEPQDREGWNG

SEQ ID NO: 106329 - protein, 32 aa, Artificial Sequence
  Description of Artificial Sequence: Synthetic polypeptide
DEQEIQTTNPVATEQYGSVSATDLEDHEAEDL

SEQ ID NO: 106330 - protein, 32 aa, Artificial Sequence
  Description of Artificial Sequence: Synthetic polypeptide
DEQEIQTTNPVATENYGSVSATDLEDHEGEDL

SEQ ID NO: 106331 - protein, 33 aa, Artificial Sequence
  Description of Artificial Sequence: Synthetic polypeptide
DESEIRTTNPVATECWGSVSCINHPQDREGEAG

SEQ ID NO: 106332 - protein, 32 aa, Artificial Sequence
  Description of Artificial Sequence: Synthetic polypeptide
DEQEINTTNPVATEQYGSVSATDPEDHEGEDL

SEQ ID NO: 106333 - protein, 32 aa, Artificial Sequence
  Description of Artificial Sequence: Synthetic polypeptide
DEQEINTTNPVATEQYGSCSMTDLEDHEGEVL

SEQ ID NO: 106334 - protein, 33 aa, Artificial Sequence
  Description of Artificial Sequence: Synthetic polypeptide
DEQEIMTTNPVATEQYGSVSATDLEDHEGEDLL

SEQ ID NO: 106335 - protein, 34 aa, Artificial Sequence
  Description of Artificial Sequence: Synthetic polypeptide
DESEIRTTNPVATECWGSVSCINHPQDREGENNG

SEQ ID NO: 106336 - protein, 32 aa, Artificial Sequence
  Description of Artificial Sequence: Synthetic polypeptide
DEQEIMTTNPVACEQYGSVSATDLEDHEGEDL

SEQ ID NO: 106337 - protein, 33 aa, Artificial Sequence
  Description of Artificial Sequence: Synthetic polypeptide
DESEIRTTNPVATECWGSVSCINHPQDREQENG

SEQ ID NO: 106338 - protein, 28 aa, Artificial Sequence
  Description of Artificial Sequence: Synthetic peptide
QEGEIAPTNPVASEQYGDVSCNEMAGTA

SEQ ID NO: 106339 - protein, 33 aa, Artificial Sequence
  Description of Artificial Sequence: Synthetic polypeptide
DESEIRTTNPVATECWGSVSCINHPRDREGENG

SEQ ID NO: 106340 - protein, 33 aa, Artificial Sequence
  Description of Artificial Sequence: Synthetic polypeptide
DEQEIRTTNPIATEQYGSVSATEDLADHEGEDL

SEQ ID NO: 106341 - protein, 33 aa, Artificial Sequence
  Description of Artificial Sequence: Synthetic polypeptide
DEQEIKTTNPVATEQYGSVSATMDLEDDEGEDL

SEQ ID NO: 106342 - protein, 33 aa, Artificial Sequence
  Description of Artificial Sequence: Synthetic polypeptide
DEQEIRTTNPIATEQYGSVSATEDLEEHEGEDL

SEQ ID NO: 106343 - protein, 33 aa, Artificial Sequence
  Description of Artificial Sequence: Synthetic polypeptide
DEQEIRTTNPVATECWGSCSCINEPQDREGENG

SEQ ID NO: 106344 - protein, 28 aa, Artificial Sequence
  Description of Artificial Sequence: Synthetic peptide
QEEEIATTNPVATEQYGEAVEVCQHEEK

SEQ ID NO: 106345 - protein, 30 aa, Artificial Sequence
  Description of Artificial Sequence: Synthetic polypeptide
QEGEIAPTNPCSYEQYGTVSCNLQSTGTNR

SEQ ID NO: 106346 - protein, 31 aa, Artificial Sequence
  Description of Artificial Sequence: Synthetic polypeptide
DEQEIRTTNPVATEQWGDVSEDLMNHAGEDL

SEQ ID NO: 106347 - protein, 30 aa, Artificial Sequence
  Description of Artificial Sequence: Synthetic polypeptide
DEQEIRTTNPVATEQWGDVSEDEMNAEGDL

SEQ ID NO: 106348 - protein, 31 aa, Artificial Sequence
  Description of Artificial Sequence: Synthetic polypeptide
DEQEIRTTNPVATEQWGDVSATDLEDAAEDA

SEQ ID NO: 106349 - protein, 29 aa, Artificial Sequence
  Description of Artificial Sequence: Synthetic peptide
QEGEIAPTNPCSYEQYGVVSCNLQSGTRE

SEQ ID NO: 106350 - protein, 28 aa, Artificial Sequence
  Description of Artificial Sequence: Synthetic peptide
QEEEIATTNPVATEQYGEATEVNQMEED

SEQ ID NO: 106351 - protein, 28 aa, Artificial Sequence
  Description of Artificial Sequence: Synthetic peptide
QEEEIATTNPVATEQYGEATEVCQHEEK

SEQ ID NO: 106352 - protein, 33 aa, Artificial Sequence
  Description of Artificial Sequence: Synthetic polypeptide
DEQEIRTTNPVATEPYGTISATEDLQDHEGNDL

SEQ ID NO: 106353 - protein, 34 aa, Artificial Sequence
  Description of Artificial Sequence: Synthetic polypeptide
DESEIRTTNPVATECWGSVSCINFEPQDREGENG

SEQ ID NO: 106354 - protein, 34 aa, Artificial Sequence
  Description of Artificial Sequence: Synthetic polypeptide
DESEIRTTNPVATECWGSVSCINFEPQDREGRNG

SEQ ID NO: 106355 - protein, 33 aa, Artificial Sequence
  Description of Artificial Sequence: Synthetic polypeptide
DEQEIRTTNPVATEPYGSISATEDLQDQNGEDL

SEQ ID NO: 106356 - protein, 33 aa, Artificial Sequence
  Description of Artificial Sequence: Synthetic polypeptide
DEQEIRTTNPVATEPYGSISATEDLQDHNGEDL

SEQ ID NO: 106357 - protein, 34 aa, Artificial Sequence
  Description of Artificial Sequence: Synthetic polypeptide
DESEIRTTNPVATECWGSVSCINFEPQNREGENG

SEQ ID NO: 106358 - protein, 33 aa, Artificial Sequence
  Description of Artificial Sequence: Synthetic polypeptide
DESEIRTTNPVATECWGSVSCINFPNDREGENG

SEQ ID NO: 106359 - protein, 28 aa, Artificial Sequence
  Description of Artificial Sequence: Synthetic peptide
QEGEIAPTNPGSSEQYGIVSCNLQSGTD

SEQ ID NO: 106360 - protein, 28 aa, Artificial Sequence
  Description of Artificial Sequence: Synthetic peptide
QEGEIAPTNPIASEQYGITACNLQSGTR

SEQ ID NO: 106361 - protein, 34 aa, Artificial Sequence
  Description of Artificial Sequence: Synthetic polypeptide
DEQEIRTTNPVATECYGSVSATIDLPQDHEGEDG

SEQ ID NO: 106362 - protein, 32 aa, Artificial Sequence
  Description of Artificial Sequence: Synthetic polypeptide
DEQEIRTTNPVATECYGSVSATDWEDHKGEYI

SEQ ID NO: 106363 - protein, 30 aa, Artificial Sequence
  Description of Artificial Sequence: Synthetic polypeptide
QEEEIATTNPVATEQYGEASTVCQHEEEDL

SEQ ID NO: 106364 - protein, 33 aa, Artificial Sequence
  Description of Artificial Sequence: Synthetic polypeptide
DEQEIRTTNPVATECYGSVSACIDEPQDREGEG

SEQ ID NO: 106365 - protein, 34 aa, Artificial Sequence
  Description of Artificial Sequence: Synthetic polypeptide
DEQEIRTTNPVATECWGSVSCINEPQDREGENGP

SEQ ID NO: 106366 - protein, 33 aa, Artificial Sequence
  Description of Artificial Sequence: Synthetic polypeptide
DESEIRTTNPVATECWGSVSCINFPQIREGEHG

SEQ ID NO: 106367 - protein, 34 aa, Artificial Sequence
  Description of Artificial Sequence: Synthetic polypeptide
DEQEIRTTNPVATECWGSRVSCINEPQDREGENG

SEQ ID NO: 106368 - protein, 33 aa, Artificial Sequence
  Description of Artificial Sequence: Synthetic polypeptide
DEQEIRTTNPVATECWGSESCINEPQDREGENG

SEQ ID NO: 106369 - protein, 32 aa, Artificial Sequence
  Description of Artificial Sequence: Synthetic polypeptide
DEQEIRTTNPVATDQYGSVNTGLEHPRQEQAD

SEQ ID NO: 106370 - protein, 32 aa, Artificial Sequence
  Description of Artificial Sequence: Synthetic polypeptide
DEQEIKTTNPVATEQYGSVSATDWEDHEGEDL

SEQ ID NO: 106371 - protein, 34 aa, Artificial Sequence
  Description of Artificial Sequence: Synthetic polypeptide
DESEIRTTNPVATECWGSVSCINIEPQDREGENG

SEQ ID NO: 106372 - protein, 33 aa, Artificial Sequence
  Description of Artificial Sequence: Synthetic polypeptide
DEQEIKTTNPVATEQYGSVSATDDEDQEGEDGD

SEQ ID NO: 106373 - protein, 33 aa, Artificial Sequence
  Description of Artificial Sequence: Synthetic polypeptide
DEQEICTTNPVATEQYGSVSATDTLEDHEGEDL

SEQ ID NO: 106374 - protein, 32 aa, Artificial Sequence
  Description of Artificial Sequence: Synthetic polypeptide
DEQEICTTNPVATEQYGSVSATDLNDHESEDL

SEQ ID NO: 106375 - protein, 28 aa, Artificial Sequence
  Description of Artificial Sequence: Synthetic peptide
QEGEIAPTNPVGTEGYGVMSCNLQHGTI

SEQ ID NO: 106376 - protein, 32 aa, Artificial Sequence
  Description of Artificial Sequence: Synthetic polypeptide
DEQEICTTNPVATEQYGSFSATDLEDHEGEDL

SEQ ID NO: 106377 - protein, 28 aa, Artificial Sequence
  Description of Artificial Sequence: Synthetic peptide
CEEEIATTNPVATEQYGEAPEVGQHEMK

SEQ ID NO: 106378 - protein, 28 aa, Artificial Sequence
  Description of Artificial Sequence: Synthetic peptide
CEEEIATTNPVATEQYGEAPEVHQHEEV

SEQ ID NO: 106379 - protein, 29 aa, Artificial Sequence
  Description of Artificial Sequence: Synthetic peptide
QEGEIAPTNPVSSECYGIVSCNLQDSGTR

SEQ ID NO: 106380 - protein, 28 aa, Artificial Sequence
  Description of Artificial Sequence: Synthetic peptide
CEEEIATTNPVATEQYGEFPEGGQSEEM

SEQ ID NO: 106381 - protein, 29 aa, Artificial Sequence
  Description of Artificial Sequence: Synthetic peptide
QEGEIAPTNPVSSECYGIVSCNLQSEGTR

SEQ ID NO: 106382 - protein, 32 aa, Artificial Sequence
  Description of Artificial Sequence: Synthetic polypeptide
DEQEICTTNPAATEQYGSVSATDLEDHEGEDL

SEQ ID NO: 106383 - protein, 32 aa, Artificial Sequence
  Description of Artificial Sequence: Synthetic polypeptide
DEQEICTTNPAATEQYGSVPGNLIMGGGNGDD

SEQ ID NO: 106384 - protein, 32 aa, Artificial Sequence
  Description of Artificial Sequence: Synthetic polypeptide
DEQEIAVTNPVATEQYGSVSATDLEDHEGEDL

SEQ ID NO: 106385 - protein, 28 aa, Artificial Sequence
  Description of Artificial Sequence: Synthetic peptide
QEGEIAPTNPVSSEGYGIVACNLQSGTR

SEQ ID NO: 106386 - protein, 30 aa, Artificial Sequence
  Description of Artificial Sequence: Synthetic polypeptide
QEEEIATTNPVATEQYGEASEVGNRNGEPK

SEQ ID NO: 106387 - protein, 29 aa, Artificial Sequence
  Description of Artificial Sequence: Synthetic peptide
QEGEIAPTNPVSSEGYGIVACNLQSRGTR

SEQ ID NO: 106388 - protein, 33 aa, Artificial Sequence
  Description of Artificial Sequence: Synthetic polypeptide
DESEIRTTNPVATECWGSVSCINKPYDREGENG

SEQ ID NO: 106389 - protein, 29 aa, Artificial Sequence
  Description of Artificial Sequence: Synthetic peptide
QEGEIAPTNPVSSEQWGIVSCNLQSAGTR

SEQ ID NO: 106390 - protein, 31 aa, Artificial Sequence
  Description of Artificial Sequence: Synthetic polypeptide
DEQEIATVNPVATEQYGVVSATDLEDSEGEL

SEQ ID NO: 106391 - protein, 31 aa, Artificial Sequence
  Description of Artificial Sequence: Synthetic polypeptide
DEQEIATVNPVATEQYGVVSATDLEDHEGEL

SEQ ID NO: 106392 - protein, 32 aa, Artificial Sequence
  Description of Artificial Sequence: Synthetic polypeptide
DEQEIATVNPVATEQYGSVSATDLEDHEGEDQ

SEQ ID NO: 106393 - protein, 32 aa, Artificial Sequence
  Description of Artificial Sequence: Synthetic polypeptide
DEQEIATVNPVATEQYGSVSATDLEDHEGEDL

SEQ ID NO: 106394 - protein, 34 aa, Artificial Sequence
  Description of Artificial Sequence: Synthetic polypeptide
DESEIRTTNPVATECWGSVSCINLEPQDLEGENG

SEQ ID NO: 106395 - protein, 32 aa, Artificial Sequence
  Description of Artificial Sequence: Synthetic polypeptide
DEQEIATTNVVATEQYGSVSATDLEDHEGPDL

SEQ ID NO: 106396 - protein, 32 aa, Artificial Sequence
  Description of Artificial Sequence: Synthetic polypeptide
DEQEIATTNVVATEQYGSVSATDLEDHEGEDL

SEQ ID NO: 106397 - protein, 28 aa, Artificial Sequence
  Description of Artificial Sequence: Synthetic peptide
QEGEIAPTNPVSSEQYGIISCNLQSGTH

SEQ ID NO: 106398 - protein, 33 aa, Artificial Sequence
  Description of Artificial Sequence: Synthetic polypeptide
DEQEICTTNPVATEQYGSVSATDYLEDHEGEDL

SEQ ID NO: 106399 - protein, 28 aa, Artificial Sequence
  Description of Artificial Sequence: Synthetic peptide
QEGEIAPTNPVGTEGYGVMSCNLQHGDI

SEQ ID NO: 106400 - protein, 28 aa, Artificial Sequence
  Description of Artificial Sequence: Synthetic peptide
QEGEIAPTNPVGTEGYGIMASNLQHGDR

SEQ ID NO: 106401 - protein, 28 aa, Artificial Sequence
  Description of Artificial Sequence: Synthetic peptide
CEEEIATTNPVATEQYGEAPEVCQLEEK

SEQ ID NO: 106402 - protein, 33 aa, Artificial Sequence
  Description of Artificial Sequence: Synthetic polypeptide
DEQEIKTTNPVATDAWGSVSCTNLSQEPGGPNY

SEQ ID NO: 106403 - protein, 33 aa, Artificial Sequence
  Description of Artificial Sequence: Synthetic polypeptide
DEQEIITTNPVATEQYGSVSATDLIEDHEGEDL

SEQ ID NO: 106404 - protein, 33 aa, Artificial Sequence
  Description of Artificial Sequence: Synthetic polypeptide
DESEIRTTNPVATECWGSVSCINIPQDQEGENG

SEQ ID NO: 106405 - protein, 35 aa, Artificial Sequence
  Description of Artificial Sequence: Synthetic polypeptide
AEEEIRTTNPVATEQYGSVSVNTNDESGTVNNATE

SEQ ID NO: 106406 - protein, 33 aa, Artificial Sequence
  Description of Artificial Sequence: Synthetic polypeptide
DEQEIHTTNPVATEQYGSVSATDLEEDHEGEDL

SEQ ID NO: 106407 - protein, 29 aa, Artificial Sequence
  Description of Artificial Sequence: Synthetic peptide
QEEEIATTNPVATEQYGEASTDCEHEEEK

SEQ ID NO: 106408 - protein, 32 aa, Artificial Sequence
  Description of Artificial Sequence: Synthetic polypeptide
DEQEIHTTNPVATEQYGSVSATDLEDHEAEDL

SEQ ID NO: 106409 - protein, 32 aa, Artificial Sequence
  Description of Artificial Sequence: Synthetic polypeptide
QEEEIATTNPVATEQYGEASSTEVGNRNGNPK

SEQ ID NO: 106410 - protein, 35 aa, Artificial Sequence
  Description of Artificial Sequence: Synthetic polypeptide
AEEEIRTTNPVATEQYGSVVTVANLNGTEEGTNVD

SEQ ID NO: 106411 - protein, 32 aa, Artificial Sequence
  Description of Artificial Sequence: Synthetic polypeptide
DEQEIGTTNPVATEPYGSVSATDLEDHEGEDL

SEQ ID NO: 106412 - protein, 36 aa, Artificial Sequence
  Description of Artificial Sequence: Synthetic polypeptide
AEEEIRTTNPVATEQYGSVVTVANLNNQDENGTNVT

SEQ ID NO: 106413 - protein, 33 aa, Artificial Sequence
  Description of Artificial Sequence: Synthetic polypeptide
DESEIRTTNPVATECWGSVSCINIPQDYEGENG

SEQ ID NO: 106414 - protein, 32 aa, Artificial Sequence
  Description of Artificial Sequence: Synthetic polypeptide
DEQEIATTNPVAYEKWGEVSTNLNQGEDNDGR

SEQ ID NO: 106415 - protein, 33 aa, Artificial Sequence
  Description of Artificial Sequence: Synthetic polypeptide
DEQEIETTNPVATEQYGSVSATDPLEDHEGEDL

SEQ ID NO: 106416 - protein, 34 aa, Artificial Sequence
  Description of Artificial Sequence: Synthetic polypeptide
DESEIRTTNPVATECWGSVSCINKEPQDREGENG

SEQ ID NO: 106417 - protein, 28 aa, Artificial Sequence
  Description of Artificial Sequence: Synthetic peptide
CEEEIATTNPVATEQYGEALEVDQAEMK

SEQ ID NO: 106418 - protein, 28 aa, Artificial Sequence
  Description of Artificial Sequence: Synthetic peptide
CEEEIATTNPVATEQYGEAPEDIQHEEK

SEQ ID NO: 106419 - protein, 29 aa, Artificial Sequence
  Description of Artificial Sequence: Synthetic peptide
CEEEIATTNPVATEQYGEAPEPGQHGEEK

SEQ ID NO: 106420 - protein, 28 aa, Artificial Sequence
  Description of Artificial Sequence: Synthetic peptide
CEEEIATTNPVATEQYGEAPEVAQHEET

SEQ ID NO: 106421 - protein, 33 aa, Artificial Sequence
  Description of Artificial Sequence: Synthetic polypeptide
DEQEICTVNPVATEQYGSVITNGLGGGEDGNEE

SEQ ID NO: 106422 - protein, 28 aa, Artificial Sequence
  Description of Artificial Sequence: Synthetic peptide
CEEEIATTNPVATEQYGEAPEVCQHEEK

SEQ ID NO: 106423 - protein, 30 aa, Artificial Sequence
  Description of Artificial Sequence: Synthetic polypeptide
QEEEIATTNPVATEQYGEASEVGQHNGEPK

SEQ ID NO: 106424 - protein, 28 aa, Artificial Sequence
  Description of Artificial Sequence: Synthetic peptide
QEGEIAPTNPVGSEGYGIVSCNLQSGTI

SEQ ID NO: 106425 - protein, 28 aa, Artificial Sequence
  Description of Artificial Sequence: Synthetic peptide
QEGEIAPTNPVGSEGYGVVSCNLQHGTI

SEQ ID NO: 106426 - protein, 33 aa, Artificial Sequence
  Description of Artificial Sequence: Synthetic polypeptide
DEQEICTTNPVATEQYGSVSTTVNNEDTEGEDL

SEQ ID NO: 106427 - protein, 34 aa, Artificial Sequence
  Description of Artificial Sequence: Synthetic polypeptide
DESEIRTTNPVATECWGSVSCINKEPQDREGLNG

SEQ ID NO: 106428 - protein, 34 aa, Artificial Sequence
  Description of Artificial Sequence: Synthetic polypeptide
DESEIRTTNPVATECWGSVSCINKECQDREGENG

SEQ ID NO: 106429 - protein, 28 aa, Artificial Sequence
  Description of Artificial Sequence: Synthetic peptide
QEEEIATTNPVATEQYGEAPYVCQHEEK

SEQ ID NO: 106430 - protein, 32 aa, Artificial Sequence
  Description of Artificial Sequence: Synthetic polypeptide
DEQEIATTNPVAYEGWGSVATNLQGDLGNGGI

SEQ ID NO: 106431 - protein, 32 aa, Artificial Sequence
  Description of Artificial Sequence: Synthetic polypeptide
DEQEIATTNPVAYEGWGSVATNLQGDHGNGQA

SEQ ID NO: 106432 - protein, 30 aa, Artificial Sequence
  Description of Artificial Sequence: Synthetic polypeptide
QEEEIATTNPVATEQYGEAPTEVCPQHENK

SEQ ID NO: 106433 - protein, 29 aa, Artificial Sequence
  Description of Artificial Sequence: Synthetic peptide
QEEEIATTNPVATEQYGEAPTEVAQHEEY

SEQ ID NO: 106434 - protein, 32 aa, Artificial Sequence
  Description of Artificial Sequence: Synthetic polypeptide
DEQEIATTNPVATEQYGTVCSATDLEDHEGEL

SEQ ID NO: 106435 - protein, 33 aa, Artificial Sequence
  Description of Artificial Sequence: Synthetic polypeptide
DEQEIATTNPVATEQYGTVCSATDGLEDFEGND

SEQ ID NO: 106436 - protein, 33 aa, Artificial Sequence
  Description of Artificial Sequence: Synthetic polypeptide
DEQEIATTNPVATEQYGTVCSATDDLEDHEGNL

SEQ ID NO: 106437 - protein, 33 aa, Artificial Sequence
  Description of Artificial Sequence: Synthetic polypeptide
DEQEIATTNPVATEQYGTVCSATDDLEDFEGND

SEQ ID NO: 106438 - protein, 33 aa, Artificial Sequence
  Description of Artificial Sequence: Synthetic polypeptide
DEQEIATTNPVATEQYGTSVSATDLEDHEGEDL

SEQ ID NO: 106439 - protein, 31 aa, Artificial Sequence
  Description of Artificial Sequence: Synthetic polypeptide
DEQEIATTNPVATEQYGTISTDIQQDHEGEL

SEQ ID NO: 106440 - protein, 33 aa, Artificial Sequence
  Description of Artificial Sequence: Synthetic polypeptide
DEQEIATTNPVATEQYGSYVSATDLEDHEGEDL

SEQ ID NO: 106441 - protein, 33 aa, Artificial Sequence
  Description of Artificial Sequence: Synthetic polypeptide
DEQEIATTNPVATEQYGSYSATNDLEDHEGEDL

SEQ ID NO: 106442 - protein, 32 aa, Artificial Sequence
  Description of Artificial Sequence: Synthetic polypeptide
DEQEIATTNPVATEQYGSYSATDLEDHEGEDL

SEQ ID NO: 106443 - protein, 33 aa, Artificial Sequence
  Description of Artificial Sequence: Synthetic polypeptide
DEQEIATTNPVATEQYGSWVSATDLEDHNGEDL

SEQ ID NO: 106444 - protein, 32 aa, Artificial Sequence
  Description of Artificial Sequence: Synthetic polypeptide
DEQEIATTNPVATEQYGSWSATDLEDHEGEDL

SEQ ID NO: 106445 - protein, 32 aa, Artificial Sequence
  Description of Artificial Sequence: Synthetic polypeptide
DEQEIATTNPVATEQYGSWSATDLEDHEGEDF

SEQ ID NO: 106446 - protein, 33 aa, Artificial Sequence
  Description of Artificial Sequence: Synthetic polypeptide
DEQEIATTNPVATEQYGSVYSATDLEDHVGEDL

SEQ ID NO: 106447 - protein, 33 aa, Artificial Sequence
  Description of Artificial Sequence: Synthetic polypeptide
DEQEIATTNPVATEQYGSVYSATDLEDHEGEDL

SEQ ID NO: 106448 - protein, 33 aa, Artificial Sequence
  Description of Artificial Sequence: Synthetic polypeptide
DESEIRTTNPVATECWGSVSCIREPQDREGENG

SEQ ID NO: 106449 - protein, 32 aa, Artificial Sequence
  Description of Artificial Sequence: Synthetic polypeptide
DEQEIATTNPVATEQYGSVYATDLEDHEGEDL

SEQ ID NO: 106450 - protein, 33 aa, Artificial Sequence
  Description of Artificial Sequence: Synthetic polypeptide
DEQEIATTNPVATEQYGSVWSNTDLEDHEGEDL

SEQ ID NO: 106451 - protein, 33 aa, Artificial Sequence
  Description of Artificial Sequence: Synthetic polypeptide
DEQEIATTNPVATEQYGSVWSATDLLDHEGEDL

SEQ ID NO: 106452 - protein, 33 aa, Artificial Sequence
  Description of Artificial Sequence: Synthetic polypeptide
DEQEIATTNPVATEQYGSVWSATDLEDHEGEDV

SEQ ID NO: 106453 - protein, 33 aa, Artificial Sequence
  Description of Artificial Sequence: Synthetic polypeptide
DEQEIATTNPVATEQYGSVWSATDLEDHEGEDL

SEQ ID NO: 106454 - protein, 28 aa, Artificial Sequence
  Description of Artificial Sequence: Synthetic peptide
QEGEIATTNPCSTECYGIVSECLQSGTL

SEQ ID NO: 106455 - protein, 32 aa, Artificial Sequence
  Description of Artificial Sequence: Synthetic polypeptide
DEQEIATTNPVATEQYGSVWATDLEDHEGEDL

SEQ ID NO: 106456 - protein, 31 aa, Artificial Sequence
  Description of Artificial Sequence: Synthetic polypeptide
QEGEIATTNPCSTEQYGATVSNCENLQSGPR

SEQ ID NO: 106457 - protein, 32 aa, Artificial Sequence
  Description of Artificial Sequence: Synthetic polypeptide
DEQEIATTNPVATEQYGTVSAMDLQQDHNGEH

SEQ ID NO: 106458 - protein, 31 aa, Artificial Sequence
  Description of Artificial Sequence: Synthetic polypeptide
QEGEIATTNPCSTEQYGATVSNCENLQSGTR

SEQ ID NO: 106459 - protein, 32 aa, Artificial Sequence
  Description of Artificial Sequence: Synthetic polypeptide
DEQEIATTNPVATEQYGTVSATDGLEFEGEDL

SEQ ID NO: 106460 - protein, 32 aa, Artificial Sequence
  Description of Artificial Sequence: Synthetic polypeptide
DEQEIATTNPVATEQYGTVSATDLCDHEGEDL

SEQ ID NO: 106461 - protein, 29 aa, Artificial Sequence
  Description of Artificial Sequence: Synthetic peptide
QEEEIATTNPVATEQYGEAPTVCQHEEEL

SEQ ID NO: 106462 - protein, 28 aa, Artificial Sequence
  Description of Artificial Sequence: Synthetic peptide
QEGEIATTNPCSSEQYGIVSCNLESGEL

SEQ ID NO: 106463 - protein, 30 aa, Artificial Sequence
  Description of Artificial Sequence: Synthetic polypeptide
QEGEIATTNPCSSEQYGIVSCNLQDSEGTR

SEQ ID NO: 106464 - protein, 28 aa, Artificial Sequence
  Description of Artificial Sequence: Synthetic peptide
QEGEIATTNPCSSEQYGIVSCNLQHETL

SEQ ID NO: 106465 - protein, 31 aa, Artificial Sequence
  Description of Artificial Sequence: Synthetic polypeptide
DEQEIATTNPVATEQYGVVATDLEDHEGEDL

SEQ ID NO: 106466 - protein, 33 aa, Artificial Sequence
  Description of Artificial Sequence: Synthetic polypeptide
DEQEIATTNPVATEQYGVSVSWTDLEDHEGEDL

SEQ ID NO: 106467 - protein, 33 aa, Artificial Sequence
  Description of Artificial Sequence: Synthetic polypeptide
DEQEIATTNPVATEQYGVSVSATDLEDHEGEDL

SEQ ID NO: 106468 - protein, 29 aa, Artificial Sequence
  Description of Artificial Sequence: Synthetic peptide
QEEEIATTNPVATEQYGEAPTEVCQHEEL

SEQ ID NO: 106469 - protein, 31 aa, Artificial Sequence
  Description of Artificial Sequence: Synthetic polypeptide
DEQEIATTNPVATEQYGVMSTTLEDHEGDDL

SEQ ID NO: 106470 - protein, 33 aa, Artificial Sequence
  Description of Artificial Sequence: Synthetic polypeptide
CEEEIATTNPVATEQYGSVCSTNPEPQEHITEM

SEQ ID NO: 106471 - protein, 29 aa, Artificial Sequence
  Description of Artificial Sequence: Synthetic peptide
QEEEIATTNPVATEQYGEAPTEVCQHEEK

SEQ ID NO: 106472 - protein, 33 aa, Artificial Sequence
  Description of Artificial Sequence: Synthetic polypeptide
DESEIRTTNPVATECWGSVSCIQEPQDREGENG

SEQ ID NO: 106473 - protein, 28 aa, Artificial Sequence
  Description of Artificial Sequence: Synthetic peptide
QEGEIATTNPCSSEQYGIVSMDLQSGTH

SEQ ID NO: 106474 - protein, 32 aa, Artificial Sequence
  Description of Artificial Sequence: Synthetic polypeptide
DEQEIATTNPVATEQYGTVSTTDLEDHFGEDL

SEQ ID NO: 106475 - protein, 29 aa, Artificial Sequence
  Description of Artificial Sequence: Synthetic peptide
QEGEIATTNPCSSEQYGSVSCNLESGEDL

SEQ ID NO: 106476 - protein, 31 aa, Artificial Sequence
  Description of Artificial Sequence: Synthetic polypeptide
QEEEIATTNPVATEQYGEAPTEVCPQREMNK

SEQ ID NO: 106477 - protein, 32 aa, Artificial Sequence
  Description of Artificial Sequence: Synthetic polypeptide
DEQEIATTNPVATEQYGTVSATGLEDHEGEDL

SEQ ID NO: 106478 - protein, 31 aa, Artificial Sequence
  Description of Artificial Sequence: Synthetic polypeptide
DEQEIATTNPVATEQYGTVSATDPEHEGEDD

SEQ ID NO: 106479 - protein, 32 aa, Artificial Sequence
  Description of Artificial Sequence: Synthetic polypeptide
DEQEIATTNPVATEQYGTVSATDLEYHEGEDL

SEQ ID NO: 106480 - protein, 32 aa, Artificial Sequence
  Description of Artificial Sequence: Synthetic polypeptide
DEQEIATTNPVATEQYGTVSATDLEMHEGEDL

SEQ ID NO: 106481 - protein, 29 aa, Artificial Sequence
  Description of Artificial Sequence: Synthetic peptide
QEGEIATTNPCSSEQYGTISCNIQQNGNR

SEQ ID NO: 106482 - protein, 32 aa, Artificial Sequence
  Description of Artificial Sequence: Synthetic polypeptide
DEQEIATTNPVATEQYGTVSATDLEDHTGEDL

SEQ ID NO: 106483 - protein, 29 aa, Artificial Sequence
  Description of Artificial Sequence: Synthetic peptide
QEGEIATTNPCSSEQYGTVSACGLQSGTR

SEQ ID NO: 106484 - protein, 32 aa, Artificial Sequence
  Description of Artificial Sequence: Synthetic polypeptide
DEQEIATTNPVATEQYGTVSATDLEDHEGEDL

SEQ ID NO: 106485 - protein, 32 aa, Artificial Sequence
  Description of Artificial Sequence: Synthetic polypeptide
DEQEIATTNPVATEQYGTVSATDLEDHEGEDD

SEQ ID NO: 106486 - protein, 32 aa, Artificial Sequence
  Description of Artificial Sequence: Synthetic polypeptide
DEQEIATTNPVATEQYGTVSATDGLEHEGEDL

SEQ ID NO: 106487 - protein, 33 aa, Artificial Sequence
  Description of Artificial Sequence: Synthetic polypeptide
DEQEIATTNPVATEQYGSVVVTDLQEDYEGEDE

SEQ ID NO: 106488 - protein, 33 aa, Artificial Sequence
  Description of Artificial Sequence: Synthetic polypeptide
DEQEIATTNPVATEQYGSVVSWTDLEDHEGEDL

SEQ ID NO: 106489 - protein, 28 aa, Artificial Sequence
  Description of Artificial Sequence: Synthetic peptide
QEGEIATTNPCSTEQYGDVSCCLQHETL

SEQ ID NO: 106490 - protein, 29 aa, Artificial Sequence
  Description of Artificial Sequence: Synthetic peptide
QEGEIATTNPVASEQYGIVSCDLEDSGTL

SEQ ID NO: 106491 - protein, 34 aa, Artificial Sequence
  Description of Artificial Sequence: Synthetic polypeptide
DEQEIATTNPVATEQYGSVSWTNDNLEDHNGKDL

SEQ ID NO: 106492 - protein, 28 aa, Artificial Sequence
  Description of Artificial Sequence: Synthetic peptide
QEGEIATTNPVATECWGNVSECLQHEEL

SEQ ID NO: 106493 - protein, 34 aa, Artificial Sequence
  Description of Artificial Sequence: Synthetic polypeptide
DEQEIATTNPVATEQYGSVSWTNDLEEDHNGEDK

SEQ ID NO: 106494 - protein, 29 aa, Artificial Sequence
  Description of Artificial Sequence: Synthetic peptide
QEGEIATTNPVATECYGCVSEPELQHEEL

SEQ ID NO: 106495 - protein, 34 aa, Artificial Sequence
  Description of Artificial Sequence: Synthetic polypeptide
DEQEIATTNPVATEQYGSVSWTIDLQEDHNGEDH

SEQ ID NO: 106496 - protein, 34 aa, Artificial Sequence
  Description of Artificial Sequence: Synthetic polypeptide
DEQEIATTNPVATEQYGSVSWTEQLQEDHNGEDT

SEQ ID NO: 106497 - protein, 34 aa, Artificial Sequence
  Description of Artificial Sequence: Synthetic polypeptide
DEQEIATTNPVATEQYGSVSWTELEDHEQREDAH

SEQ ID NO: 106498 - protein, 29 aa, Artificial Sequence
  Description of Artificial Sequence: Synthetic peptide
QEEEIATTNPVATEQYGEAPSEVCQHEEK

SEQ ID NO: 106499 - protein, 33 aa, Artificial Sequence
  Description of Artificial Sequence: Synthetic polypeptide
DEQEIATTNPVATEQYGSVSWTDLREDHEGEDL

SEQ ID NO: 106500 - protein, 34 aa, Artificial Sequence
  Description of Artificial Sequence: Synthetic polypeptide
DEQEIATTNPVATEQYGSVSWTDLQEDHQQEDDR

SEQ ID NO: 106501 - protein, 33 aa, Artificial Sequence
  Description of Artificial Sequence: Synthetic polypeptide
DESEIRTTNPVATECWGSVSCITEPQDREGEWG

SEQ ID NO: 106502 - protein, 34 aa, Artificial Sequence
  Description of Artificial Sequence: Synthetic polypeptide
DEQEIATTNPVATEQYGSVSWTDLLQEDHNGEDL

SEQ ID NO: 106503 - protein, 29 aa, Artificial Sequence
  Description of Artificial Sequence: Synthetic peptide
QEGEIATTNPVATECYGDVSNECLQHEEL

SEQ ID NO: 106504 - protein, 28 aa, Artificial Sequence
  Description of Artificial Sequence: Synthetic peptide
QEEEIATTNPVATEQYGEAPRVCQHYEK

SEQ ID NO: 106505 - protein, 29 aa, Artificial Sequence
  Description of Artificial Sequence: Synthetic peptide
QEGEIATTNPVATECYGQVSECLQHEDEL

SEQ ID NO: 106506 - protein, 29 aa, Artificial Sequence
  Description of Artificial Sequence: Synthetic peptide
QEGEIATTNPVATECYGQVSEELQHNELY

SEQ ID NO: 106507 - protein, 29 aa, Artificial Sequence
  Description of Artificial Sequence: Synthetic peptide
QEGEIATTNPVATECYGQVSEETLQHEEL

SEQ ID NO: 106508 - protein, 28 aa, Artificial Sequence
  Description of Artificial Sequence: Synthetic peptide
QEEEIATTNPVATEQYGEAPRVCQHEEK

SEQ ID NO: 106509 - protein, 33 aa, Artificial Sequence
  Description of Artificial Sequence: Synthetic polypeptide
DEQEIATTNPVATEQYGSVSWTDLEDHEGYEDL

SEQ ID NO: 106510 - protein, 28 aa, Artificial Sequence
  Description of Artificial Sequence: Synthetic peptide
QEEEIATTNPVATEQYGEAPQVSQHEEK

SEQ ID NO: 106511 - protein, 32 aa, Artificial Sequence
  Description of Artificial Sequence: Synthetic polypeptide
QEGEIATTNPVATEQWGIVSCINEPQDRGETR

SEQ ID NO: 106512 - protein, 33 aa, Artificial Sequence
  Description of Artificial Sequence: Synthetic polypeptide
DESEIRTTNPVATECWGSVSCIVEAQDREGENG

SEQ ID NO: 106513 - protein, 33 aa, Artificial Sequence
  Description of Artificial Sequence: Synthetic polypeptide
DEQEIATTNPVATEQYGSVSVTTDLEDHEGEDL

SEQ ID NO: 106514 - protein, 33 aa, Artificial Sequence
  Description of Artificial Sequence: Synthetic polypeptide
QEGEIATTNPVATEQWGSVSCINEPQDREGETR

SEQ ID NO: 106515 - protein, 32 aa, Artificial Sequence
  Description of Artificial Sequence: Synthetic polypeptide
DEQEIATTNPVATEQYGSVSYTDDEDHEGEDL

SEQ ID NO: 106516 - protein, 31 aa, Artificial Sequence
  Description of Artificial Sequence: Synthetic polypeptide
QEGEIATTNPVASEQYGIVSATNLEDHEGTL

SEQ ID NO: 106517 - protein, 33 aa, Artificial Sequence
  Description of Artificial Sequence: Synthetic polypeptide
DEQEIATTNPVATEQYGSVSYTDELTDHEGEDL

SEQ ID NO: 106518 - protein, 33 aa, Artificial Sequence
  Description of Artificial Sequence: Synthetic polypeptide
DESEIRTTNPVATECWGSVSCISEPQDREGENG

SEQ ID NO: 106519 - protein, 28 aa, Artificial Sequence
  Description of Artificial Sequence: Synthetic peptide
QEEEIATTNPVATEQYGEAPSVYQHEEK

SEQ ID NO: 106520 - protein, 28 aa, Artificial Sequence
  Description of Artificial Sequence: Synthetic peptide
QEEEIATTNPVATEQYGEAPSVCQHEEK

SEQ ID NO: 106521 - protein, 34 aa, Artificial Sequence
  Description of Artificial Sequence: Synthetic polypeptide
DEQEIATTNPVATEQYGSVVSATGLEDHEGGENL

SEQ ID NO: 106522 - protein, 33 aa, Artificial Sequence
  Description of Artificial Sequence: Synthetic polypeptide
DEQEIATTNPVATEQYGSVVSATDLEDHMGEDL

SEQ ID NO: 106523 - protein, 33 aa, Artificial Sequence
  Description of Artificial Sequence: Synthetic polypeptide
DEQEIATTNPVATEQYGSVVSATDLEDHGGEDL

SEQ ID NO: 106524 - protein, 28 aa, Artificial Sequence
  Description of Artificial Sequence: Synthetic peptide
QEGEIATTNPCSTEQYGIVPENCQHGTK

SEQ ID NO: 106525 - protein, 33 aa, Artificial Sequence
  Description of Artificial Sequence: Synthetic polypeptide
DEQEIATTNPVATEQYGSVVSATDLEDHEGEML

SEQ ID NO: 106526 - protein, 33 aa, Artificial Sequence
  Description of Artificial Sequence: Synthetic polypeptide
DEQEIATTNPVATEQYGSVVSATDLEDHEGEDL

SEQ ID NO: 106527 - protein, 33 aa, Artificial Sequence
  Description of Artificial Sequence: Synthetic polypeptide
DEQEIATTNPVATEQYGSVVSATDLDDHEGEDL

SEQ ID NO: 106528 - protein, 32 aa, Artificial Sequence
  Description of Artificial Sequence: Synthetic polypeptide
DEQEIATTNPVATEQYGSVVATPLEDHEGEDL

SEQ ID NO: 106529 - protein, 32 aa, Artificial Sequence
  Description of Artificial Sequence: Synthetic polypeptide
DEQEIATTNPVATEQYGSVVATDLEDHEGEDL

SEQ ID NO: 106530 - protein, 33 aa, Artificial Sequence
  Description of Artificial Sequence: Synthetic polypeptide
DEQEIATTNPVATEQYGSVTSATDLEDHEGEDL

SEQ ID NO: 106531 - protein, 30 aa, Artificial Sequence
  Description of Artificial Sequence: Synthetic polypeptide
QEGEIATTNPCSSEQYGIVSCINLQSGETR

SEQ ID NO: 106532 - protein, 33 aa, Artificial Sequence
  Description of Artificial Sequence: Synthetic polypeptide
DEQEIATTNPVATEQYGSVTSATDLDDHEGEDL

SEQ ID NO: 106533 - protein, 28 aa, Artificial Sequence
  Description of Artificial Sequence: Synthetic peptide
QEGEIATTNPVASECYGDVSCCLQHEEL

SEQ ID NO: 106534 - protein, 32 aa, Artificial Sequence
  Description of Artificial Sequence: Synthetic polypeptide
DEQEIATTNPVATEQYGSVTATDLEDHTGEDL

SEQ ID NO: 106535 - protein, 32 aa, Artificial Sequence
  Description of Artificial Sequence: Synthetic polypeptide
DEQEIATTNPVATEQYGSVTATDLEDHEGEDL

SEQ ID NO: 106536 - protein, 33 aa, Artificial Sequence
  Description of Artificial Sequence: Synthetic polypeptide
DESEIRTTNPVATECWGSVSCIREPQMREGENG

SEQ ID NO: 106537 - protein, 31 aa, Artificial Sequence
  Description of Artificial Sequence: Synthetic polypeptide
QEGEIATTNPVASEQWGIVSCINEQDRGETR

SEQ ID NO: 106538 - protein, 33 aa, Artificial Sequence
  Description of Artificial Sequence: Synthetic polypeptide
DESEIRTTNPVATECWGSVSCIREPQWREGENG

SEQ ID NO: 106539 - protein, 33 aa, Artificial Sequence
  Description of Artificial Sequence: Synthetic polypeptide
DEQEIATTNPVATEQYGSVSYTGELEDHEGEDL

SEQ ID NO: 106540 - protein, 31 aa, Artificial Sequence
  Description of Artificial Sequence: Synthetic polypeptide
QEGEIATTNPVASEQYGIVSACGPVQSEGNR

SEQ ID NO: 106541 - protein, 33 aa, Artificial Sequence
  Description of Artificial Sequence: Synthetic polypeptide
DEQEIATTNPVATEQYGSVSYTDLEDHFGEDLN

SEQ ID NO: 106542 - protein, 32 aa, Artificial Sequence
  Description of Artificial Sequence: Synthetic polypeptide
DEQEIATTNPVATEQYGSVSYTDLEDHEIEDL

SEQ ID NO: 106543 - protein, 33 aa, Artificial Sequence
  Description of Artificial Sequence: Synthetic polypeptide
DEQEIATTNPVATEQYGSVSYTDLEDHEGEDLF

SEQ ID NO: 106544 - protein, 31 aa, Artificial Sequence
  Description of Artificial Sequence: Synthetic polypeptide
QEGEIATTNPVASEQYGIVSATGPVESEGNR

SEQ ID NO: 106545 - protein, 32 aa, Artificial Sequence
  Description of Artificial Sequence: Synthetic polypeptide
DEQEIATTNPVATEQYGSVTATDLEHHEGEDT

SEQ ID NO: 106546 - protein, 30 aa, Artificial Sequence
  Description of Artificial Sequence: Synthetic polypeptide
QENEIATTNPCASEQWGIVSCNLQNSAGTR

SEQ ID NO: 106547 - protein, 32 aa, Artificial Sequence
  Description of Artificial Sequence: Synthetic polypeptide
DEQEIATTNPVATEQYGVVSATDLEDHEGEDL

SEQ ID NO: 106548 - protein, 29 aa, Artificial Sequence
  Description of Artificial Sequence: Synthetic peptide
QEGEIATTNPCSSEQYGIVSCENLQSGTH

SEQ ID NO: 106549 - protein, 32 aa, Artificial Sequence
  Description of Artificial Sequence: Synthetic polypeptide
DEQEIATTNPVATVQYGSVSATDLEDHEGEDL

SEQ ID NO: 106550 - protein, 33 aa, Artificial Sequence
  Description of Artificial Sequence: Synthetic polypeptide
DESEIRTTNPVATECWGSVSCINVPRDREGENG

SEQ ID NO: 106551 - protein, 32 aa, Artificial Sequence
  Description of Artificial Sequence: Synthetic polypeptide
DEQEIATTNPVATVQYGSVSATDLEAHEGEDM

SEQ ID NO: 106552 - protein, 32 aa, Artificial Sequence
  Description of Artificial Sequence: Synthetic polypeptide
DEQEIATTNPVATTQYGSVSATDLEPHEGEDL

SEQ ID NO: 106553 - protein, 32 aa, Artificial Sequence
  Description of Artificial Sequence: Synthetic polypeptide
DEQEIATTNPVATTQYGSVSATDLEDHEGEDL

SEQ ID NO: 106554 - protein, 32 aa, Artificial Sequence
  Description of Artificial Sequence: Synthetic polypeptide
DEQEIATTNPVATSQYGSVSATDLEDHEGGDL

SEQ ID NO: 106555 - protein, 32 aa, Artificial Sequence
  Description of Artificial Sequence: Synthetic polypeptide
DEQEIATTNPVATSQYGSVSATDLEDHEGEDL

SEQ ID NO: 106556 - protein, 32 aa, Artificial Sequence
  Description of Artificial Sequence: Synthetic polypeptide
DEQEIATTNPVATRQYGSVSATDLEDHLGELL

SEQ ID NO: 106557 - protein, 32 aa, Artificial Sequence
  Description of Artificial Sequence: Synthetic polypeptide
DEQEIATTNPVATRQYGSVSATDLEDHEGEDL

SEQ ID NO: 106558 - protein, 32 aa, Artificial Sequence
  Description of Artificial Sequence: Synthetic polypeptide
DEQEIATTNPVATQQYGSVSATDLSDHEGEDL

SEQ ID NO: 106559 - protein, 29 aa, Artificial Sequence
  Description of Artificial Sequence: Synthetic peptide
QEEEIATTNPVATEQYGEAPWENCQHEEK

SEQ ID NO: 106560 - protein, 28 aa, Artificial Sequence
  Description of Artificial Sequence: Synthetic peptide
QEGEIATTNPCSSECYGIVSCNLQSGTL

SEQ ID NO: 106561 - protein, 32 aa, Artificial Sequence
  Description of Artificial Sequence: Synthetic polypeptide
DEQEIATTNPVATQQYGSVSATDLEDHEGEKL

SEQ ID NO: 106562 - protein, 34 aa, Artificial Sequence
  Description of Artificial Sequence: Synthetic polypeptide
DESEIRTTNPVATECWGSVSCINWEPQDREGENG

SEQ ID NO: 106563 - protein, 32 aa, Artificial Sequence
  Description of Artificial Sequence: Synthetic polypeptide
DEQEIATTNPVATQQYGSVSATDLEDHEGEDL

SEQ ID NO: 106564 - protein, 32 aa, Artificial Sequence
  Description of Artificial Sequence: Synthetic polypeptide
DEQEIATTNPVATNQYGSVSATDLEDHEGEDL

SEQ ID NO: 106565 - protein, 32 aa, Artificial Sequence
  Description of Artificial Sequence: Synthetic polypeptide
DEQEIATTNPVATNQYGSVSATDLEDHEGEDE

SEQ ID NO: 106566 - protein, 32 aa, Artificial Sequence
  Description of Artificial Sequence: Synthetic polypeptide
DEQEIATTNPVATMQYGSVSATDLEGHEGEDL

SEQ ID NO: 106567 - protein, 32 aa, Artificial Sequence
  Description of Artificial Sequence: Synthetic polypeptide
DEQEIATTNPVATMQYGSVSATDLEDHEGEDL

SEQ ID NO: 106568 - protein, 28 aa, Artificial Sequence
  Description of Artificial Sequence: Synthetic peptide
QEGEIATTNPCSSECYGIVSENLQHETR

SEQ ID NO: 106569 - protein, 28 aa, Artificial Sequence
  Description of Artificial Sequence: Synthetic peptide
QEGEIATTNPCSSEQYGDVSCCLQSGEL

SEQ ID NO: 106570 - protein, 34 aa, Artificial Sequence
  Description of Artificial Sequence: Synthetic polypeptide
DESEIRTTNPVATECWGSVSCINWEPQPREGENG

SEQ ID NO: 106571 - protein, 32 aa, Artificial Sequence
  Description of Artificial Sequence: Synthetic polypeptide
DEQEIATTNPVATLQYGSVSMTDLEDHEGEDL

SEQ ID NO: 106572 - protein, 32 aa, Artificial Sequence
  Description of Artificial Sequence: Synthetic polypeptide
DEQEIATTNPVATLQYGSVSATDLEDHVGEDL

SEQ ID NO: 106573 - protein, 32 aa, Artificial Sequence
  Description of Artificial Sequence: Synthetic polypeptide
DEQEIATTNPVATLQYGSVSATDLEDHEGEDL

SEQ ID NO: 106574 - protein, 32 aa, Artificial Sequence
  Description of Artificial Sequence: Synthetic polypeptide
DEQEIATTNPVATVQYGSVSATDLEDHEGEDV

SEQ ID NO: 106575 - protein, 32 aa, Artificial Sequence
  Description of Artificial Sequence: Synthetic polypeptide
DEQEIATTNPVATKQYGSVSATDLEDHEGEDL

SEQ ID NO: 106576 - protein, 32 aa, Artificial Sequence
  Description of Artificial Sequence: Synthetic polypeptide
DEQEIATTNPVATWQYGSVSATDLEDHEGEDL

SEQ ID NO: 106577 - protein, 32 aa, Artificial Sequence
  Description of Artificial Sequence: Synthetic polypeptide
DEQEIATTNPVATYQYGSVSATDLEDHEGEDF

SEQ ID NO: 106578 - protein, 32 aa, Artificial Sequence
  Description of Artificial Sequence: Synthetic polypeptide
DEQEIATTNPVAYEGWGSVATNLQGDAGQNEQ

SEQ ID NO: 106579 - protein, 33 aa, Artificial Sequence
  Description of Artificial Sequence: Synthetic polypeptide
DEQEIATTNPVAYEGWGSVATNLQGDAGNRGQA

SEQ ID NO: 106580 - protein, 32 aa, Artificial Sequence
  Description of Artificial Sequence: Synthetic polypeptide
DEQEIATTNPVAYEGWGSVATNLQGDAGNNDG

SEQ ID NO: 106581 - protein, 31 aa, Artificial Sequence
  Description of Artificial Sequence: Synthetic polypeptide
QEGEIATTNPCASEQYGIVSATNLQDSEGTL

SEQ ID NO: 106582 - protein, 32 aa, Artificial Sequence
  Description of Artificial Sequence: Synthetic polypeptide
DEQEIATTNPVAYEGWGSVATNLQGDAGNGSD

SEQ ID NO: 106583 - protein, 32 aa, Artificial Sequence
  Description of Artificial Sequence: Synthetic polypeptide
DEQEIATTNPVAYEGWGSVATNLQGDAGEGNQ

SEQ ID NO: 106584 - protein, 34 aa, Artificial Sequence
  Description of Artificial Sequence: Synthetic polypeptide
DESEIRTTNPVATECWGSVSCINTPQDREGENGT

SEQ ID NO: 106585 - protein, 32 aa, Artificial Sequence
  Description of Artificial Sequence: Synthetic polypeptide
DEQEIATTNPVAYEEWGVVSTNLQLGEDNGNG

SEQ ID NO: 106586 - protein, 31 aa, Artificial Sequence
  Description of Artificial Sequence: Synthetic polypeptide
QEGEIATTNPCASEQYGIVSCINEQDRGETR

SEQ ID NO: 106587 - protein, 31 aa, Artificial Sequence
  Description of Artificial Sequence: Synthetic polypeptide
DEQEIATTNPVAYECWGVVTSGDNDQRDGNH

SEQ ID NO: 106588 - protein, 31 aa, Artificial Sequence
  Description of Artificial Sequence: Synthetic polypeptide
DEQEIATTNPVAYECWGSVTTNHGGEDGNNR

SEQ ID NO: 106589 - protein, 28 aa, Artificial Sequence
  Description of Artificial Sequence: Synthetic peptide
QEEEIATTNPVATEQYGEAPYVCQHDEK

SEQ ID NO: 106590 - protein, 30 aa, Artificial Sequence
  Description of Artificial Sequence: Synthetic polypeptide
QEGEIATTNPCASEQYGIVSCINLQSGETG

SEQ ID NO: 106591 - protein, 31 aa, Artificial Sequence
  Description of Artificial Sequence: Synthetic polypeptide
DEQEIATTNPVAYEAWGEVSTNLQGADNDGS

SEQ ID NO: 106592 - protein, 32 aa, Artificial Sequence
  Description of Artificial Sequence: Synthetic polypeptide
DEQEIATTNPVAWEQYGSVSATDLKDHEGEDL

SEQ ID NO: 106593 - protein, 33 aa, Artificial Sequence
  Description of Artificial Sequence: Synthetic polypeptide
DEQEIATTNPVAWEQYGSVSATDLEDHEGEDLR

SEQ ID NO: 106594 - protein, 32 aa, Artificial Sequence
  Description of Artificial Sequence: Synthetic polypeptide
DEQEIATTNPVAWEQYGSVSATDLEDHEGEDL

SEQ ID NO: 106595 - protein, 32 aa, Artificial Sequence
  Description of Artificial Sequence: Synthetic polypeptide
DEQEIATTNPVAWEQYGSVSATDLEDGEGEDL

SEQ ID NO: 106596 - protein, 32 aa, Artificial Sequence
  Description of Artificial Sequence: Synthetic polypeptide
DEQEIATTNPVAVEQYGSVSATDLEDHEGEDL

SEQ ID NO: 106597 - protein, 34 aa, Artificial Sequence
  Description of Artificial Sequence: Synthetic polypeptide
DESEIRTTNPVATECWGSVSCINVEPQDREGENG

SEQ ID NO: 106598 - protein, 34 aa, Artificial Sequence
  Description of Artificial Sequence: Synthetic polypeptide
DESEIRTTNPVATECWGSVSCINVEPQDREGENT

SEQ ID NO: 106599 - protein, 32 aa, Artificial Sequence
  Description of Artificial Sequence: Synthetic polypeptide
DEQEIATTNPVATYQYGSVSATDLEDHEGEDL

SEQ ID NO: 106600 - protein, 28 aa, Artificial Sequence
  Description of Artificial Sequence: Synthetic peptide
QEGEIATTNPCATECYGDVSECLQHEEL

SEQ ID NO: 106601 - protein, 28 aa, Artificial Sequence
  Description of Artificial Sequence: Synthetic peptide
QEEEIATTNPVATEQYGEAPWVCQHEEK

SEQ ID NO: 106602 - protein, 33 aa, Artificial Sequence
  Description of Artificial Sequence: Synthetic polypeptide
DESEIRTTNPVATECWGSVSCINVPQDREVENG

SEQ ID NO: 106603 - protein, 32 aa, Artificial Sequence
  Description of Artificial Sequence: Synthetic polypeptide
DEQEIATTNPVATWQYGSVSATDLEDHEGEIL

SEQ ID NO: 106604 - protein, 32 aa, Artificial Sequence
  Description of Artificial Sequence: Synthetic polypeptide
DEQEIATTNPVATIQYGSVSATILEDHEGEDL

SEQ ID NO: 106605 - protein, 28 aa, Artificial Sequence
  Description of Artificial Sequence: Synthetic peptide
QEEEIATTNPVATEQYGEAPVVVQHEEK

SEQ ID NO: 106606 - protein, 33 aa, Artificial Sequence
  Description of Artificial Sequence: Synthetic polypeptide
DESEIRTTNPVATECWGSVSCINWPQDREGEPG

SEQ ID NO: 106607 - protein, 28 aa, Artificial Sequence
  Description of Artificial Sequence: Synthetic peptide
QEEEIATTNPVATEQYGEAPVVCQHEEE

SEQ ID NO: 106608 - protein, 28 aa, Artificial Sequence
  Description of Artificial Sequence: Synthetic peptide
QEEEIATTNPVATEQYGEAPVVCQHECK

SEQ ID NO: 106609 - protein, 32 aa, Artificial Sequence
  Description of Artificial Sequence: Synthetic polypeptide
DEQEIATTNPVATEQYYSVSATDLEDHNGEDL

SEQ ID NO: 106610 - protein, 32 aa, Artificial Sequence
  Description of Artificial Sequence: Synthetic polypeptide
DEQEIATTNPVATEQYWSVSATDLEDHEGEDL

SEQ ID NO: 106611 - protein, 33 aa, Artificial Sequence
  Description of Artificial Sequence: Synthetic polypeptide
DEQEIATTNPVATEQYGYVVSATNLEDHEGEDL

SEQ ID NO: 106612 - protein, 32 aa, Artificial Sequence
  Description of Artificial Sequence: Synthetic polypeptide
DEQEIATTNPVATEQYGYVSATDLEGHEGADL

SEQ ID NO: 106613 - protein, 32 aa, Artificial Sequence
  Description of Artificial Sequence: Synthetic polypeptide
DEQEIATTNPVATEQYGYVSATDLEDHEGEDL

SEQ ID NO: 106614 - protein, 33 aa, Artificial Sequence
  Description of Artificial Sequence: Synthetic polypeptide
DEQEIATTNPVATEQYGYSVSATDLEDHEGEDL

SEQ ID NO: 106615 - protein, 32 aa, Artificial Sequence
  Description of Artificial Sequence: Synthetic polypeptide
DEQEIATTNPVATEQYGWVSATDLEDHEGEDL

SEQ ID NO: 106616 - protein, 33 aa, Artificial Sequence
  Description of Artificial Sequence: Synthetic polypeptide
DEQEIATTNPVATEQYGWSVSGTDLEDHEGEDL

SEQ ID NO: 106617 - protein, 33 aa, Artificial Sequence
  Description of Artificial Sequence: Synthetic polypeptide
DEQEIATTNPVATEQYGWSVSATLLEDHEGEDL

SEQ ID NO: 106618 - protein, 30 aa, Artificial Sequence
  Description of Artificial Sequence: Synthetic polypeptide
QEGEIATTNPCSSEQYGIISCNLQQSNGNR

SEQ ID NO: 106619 - protein, 33 aa, Artificial Sequence
  Description of Artificial Sequence: Synthetic polypeptide
DEQEIATTNPVATEQYGWSVSATDLEDHEGEDL

SEQ ID NO: 106620 - protein, 33 aa, Artificial Sequence
  Description of Artificial Sequence: Synthetic polypeptide
DESEIRTTNPVATECWGSVSCIPEPQDREGENG

SEQ ID NO: 106621 - protein, 28 aa, Artificial Sequence
  Description of Artificial Sequence: Synthetic peptide
QEGEIATTNPCSSEQYGIVPCNCQSGTR

SEQ ID NO: 106622 - protein, 33 aa, Artificial Sequence
  Description of Artificial Sequence: Synthetic polypeptide
DEQEIATTNPVATEQYGWSVSATDLEDGEGEDL

SEQ ID NO: 106623 - protein, 29 aa, Artificial Sequence
  Description of Artificial Sequence: Synthetic peptide
QEEEIATTNPVATEQYGEAPTVCQMHEEK

SEQ ID NO: 106624 - protein, 33 aa, Artificial Sequence
  Description of Artificial Sequence: Synthetic polypeptide
CEEEIATTNPVATEQYGSVCSQNPPQEHAGTEM

SEQ ID NO: 106625 - protein, 29 aa, Artificial Sequence
  Description of Artificial Sequence: Synthetic peptide
QEGEIATTNPCSSEQYGIVSACNLESGTR

SEQ ID NO: 106626 - protein, 31 aa, Artificial Sequence
  Description of Artificial Sequence: Synthetic polypeptide
QEGEIATTNPCSSEQYGIVSATNLQDSEGTR

SEQ ID NO: 106627 - protein, 32 aa, Artificial Sequence
  Description of Artificial Sequence: Synthetic polypeptide
DEQEIATTNPVATEQYGVVSATTLEDHEGEDL

SEQ ID NO: 106628 - protein, 32 aa, Artificial Sequence
  Description of Artificial Sequence: Synthetic polypeptide
DEQEIATTNPVATEQYGVVSATTLEDHEGDDL

SEQ ID NO: 106629 - protein, 33 aa, Artificial Sequence
  Description of Artificial Sequence: Synthetic polypeptide
DESEIRTTNPVATECWGSVSCIPEPQDREGHNG

SEQ ID NO: 106630 - protein, 28 aa, Artificial Sequence
  Description of Artificial Sequence: Synthetic peptide
QEGEIATTNPCSSEQYGIVSCDLQSGTH

SEQ ID NO: 106631 - protein, 33 aa, Artificial Sequence
  Description of Artificial Sequence: Synthetic polypeptide
DESEIRTTNPVATECWGSVSCIQEFQDREGENG

SEQ ID NO: 106632 - protein, 32 aa, Artificial Sequence
  Description of Artificial Sequence: Synthetic polypeptide
DEQEIATTNPVATERYGSVSATDLEDHEGEDL

SEQ ID NO: 106633 - protein, 28 aa, Artificial Sequence
  Description of Artificial Sequence: Synthetic peptide
QEEEIATTNPVATEQYGEAPVVCQHEEK

SEQ ID NO: 106634 - protein, 34 aa, Artificial Sequence
  Description of Artificial Sequence: Synthetic polypeptide
DEQEIATTNPVATESYGISVPTTMNLQDQIGEVR

SEQ ID NO: 106635 - protein, 32 aa, Artificial Sequence
  Description of Artificial Sequence: Synthetic polypeptide
DEQEIATTNPVATESYGSVSATDLEDHEGEDL

SEQ ID NO: 106636 - protein, 32 aa, Artificial Sequence
  Description of Artificial Sequence: Synthetic polypeptide
DEQEIATTNPVATIQYGSVSATDLEDHEGEDL

SEQ ID NO: 106637 - protein, 32 aa, Artificial Sequence
  Description of Artificial Sequence: Synthetic polypeptide
DEQEIATTNPVATIQYGSVSATDLEAHEGEDL

SEQ ID NO: 106638 - protein, 32 aa, Artificial Sequence
  Description of Artificial Sequence: Synthetic polypeptide
DEQEIATTNPVATHQYGSVSATDLEDHEGEDL

SEQ ID NO: 106639 - protein, 32 aa, Artificial Sequence
  Description of Artificial Sequence: Synthetic polypeptide
DEQEIATTNPVATGQYGSVSMTDLEDHEGEDL

SEQ ID NO: 106640 - protein, 32 aa, Artificial Sequence
  Description of Artificial Sequence: Synthetic polypeptide
DEQEIATTNPVATGQYGSVSATDLEDHLGEDL

SEQ ID NO: 106641 - protein, 32 aa, Artificial Sequence
  Description of Artificial Sequence: Synthetic polypeptide
DEQEIATTNPVATGQYGSVSATDLEDHEGEDL

SEQ ID NO: 106642 - protein, 32 aa, Artificial Sequence
  Description of Artificial Sequence: Synthetic polypeptide
DEQEIATTNPVATGQYGSVSATDLEDHEGEDI

SEQ ID NO: 106643 - protein, 28 aa, Artificial Sequence
  Description of Artificial Sequence: Synthetic peptide
QEGEIATTNPCSSEQYGDVSCCLQSGTL

SEQ ID NO: 106644 - protein, 32 aa, Artificial Sequence
  Description of Artificial Sequence: Synthetic polypeptide
DEQEIATTNPVATFQYGSVSATDLEDHEGEDL

SEQ ID NO: 106645 - protein, 34 aa, Artificial Sequence
  Description of Artificial Sequence: Synthetic polypeptide
DESEIRTTNPVATECWGSVSCINYEPQDREGENG

SEQ ID NO: 106646 - protein, 32 aa, Artificial Sequence
  Description of Artificial Sequence: Synthetic polypeptide
DEQEIATTNPVATEYYGSVSATDLEDHEGEDS

SEQ ID NO: 106647 - protein, 32 aa, Artificial Sequence
  Description of Artificial Sequence: Synthetic polypeptide
DEQEIATTNPVATEYYGSVSATDLEDHEGEDL

SEQ ID NO: 106648 - protein, 30 aa, Artificial Sequence
  Description of Artificial Sequence: Synthetic polypeptide
QEGEIATTNPCSSEQYGIVSCINEQREGTR

SEQ ID NO: 106649 - protein, 32 aa, Artificial Sequence
  Description of Artificial Sequence: Synthetic polypeptide
DEQEIATTNPVATEWYGSVSATDLEDHEGEDW

SEQ ID NO: 106650 - protein, 28 aa, Artificial Sequence
  Description of Artificial Sequence: Synthetic peptide
QEGEIATTNPCSSEQYGDVSENLQSEEL

SEQ ID NO: 106651 - protein, 32 aa, Artificial Sequence
  Description of Artificial Sequence: Synthetic polypeptide
DEQEIATTNPVATEVYGSVSATDLEDHEGEPL

SEQ ID NO: 106652 - protein, 32 aa, Artificial Sequence
  Description of Artificial Sequence: Synthetic polypeptide
DEQEIATTNPVATEVYGSVSATDLEDHEGEDL

SEQ ID NO: 106653 - protein, 32 aa, Artificial Sequence
  Description of Artificial Sequence: Synthetic polypeptide
DEQEIATTNPVATETYGSVSATDLEDPEGEDL

SEQ ID NO: 106654 - protein, 32 aa, Artificial Sequence
  Description of Artificial Sequence: Synthetic polypeptide
DEQEIATTNPVATETYGSVSATDLEDHYGEDL

SEQ ID NO: 106655 - protein, 28 aa, Artificial Sequence
  Description of Artificial Sequence: Synthetic peptide
QEGEIATTNPCSSEQYGEVPCNCQHGER

SEQ ID NO: 106656 - protein, 32 aa, Artificial Sequence
  Description of Artificial Sequence: Synthetic polypeptide
DEQEIATTNPVATETYGSVSATDLEDHEGEDL

SEQ ID NO: 106657 - protein, 28 aa, Artificial Sequence
  Description of Artificial Sequence: Synthetic peptide
QEEEIATTNPVATEQYGEAPVVCQHEEY

SEQ ID NO: 106658 - protein, 28 aa, Artificial Sequence
  Description of Artificial Sequence: Synthetic peptide
QEGEIATTNPCSSEQYGEVPCNCQSGER

SEQ ID NO: 106659 - protein, 28 aa, Artificial Sequence
  Description of Artificial Sequence: Synthetic peptide
QEGEIATTNPCSSEQYGIASCNLQSETR

SEQ ID NO: 106660 - protein, 32 aa, Artificial Sequence
  Description of Artificial Sequence: Synthetic polypeptide
DEQEIATTNPVATESYGSVSCTDLEDHEGEDL

SEQ ID NO: 106661 - protein, 32 aa, Artificial Sequence
  Description of Artificial Sequence: Synthetic polypeptide
DEQEIATTNPVATESYGSVSATDLEDHEGGDL

SEQ ID NO: 106662 - protein, 32 aa, Artificial Sequence
  Description of Artificial Sequence: Synthetic polypeptide
DEQEIATTNPVATEWYGSVSATDLEDHEGEDL

SEQ ID NO: 106663 - protein, 30 aa, Artificial Sequence
  Description of Artificial Sequence: Synthetic polypeptide
DEQEIRTTNPVATEQWGDVSTIEMNHEEEA

SEQ ID NO: 106664 - protein, 34 aa, Artificial Sequence
  Description of Artificial Sequence: Synthetic polypeptide
DESEIRTTNPVATECWGSVSMCINYPQDREGENG

SEQ ID NO: 106665 - protein, 33 aa, Artificial Sequence
  Description of Artificial Sequence: Synthetic polypeptide
DEQEIATTNPVATEQYGSVSATKGLEDHEGEDL

SEQ ID NO: 106666 - protein, 28 aa, Artificial Sequence
  Description of Artificial Sequence: Synthetic peptide
QEEEIATTNPVATEQYGEAPEHCQHEGK

SEQ ID NO: 106667 - protein, 28 aa, Artificial Sequence
  Description of Artificial Sequence: Synthetic peptide
QEEEIATTNPVATEQYGEAPEHCQHEEK

SEQ ID NO: 106668 - protein, 28 aa, Artificial Sequence
  Description of Artificial Sequence: Synthetic peptide
QENEIATTNPVATECYGDVSECLSHEEG

SEQ ID NO: 106669 - protein, 28 aa, Artificial Sequence
  Description of Artificial Sequence: Synthetic peptide
QENEIATTNPVATECYGDVSECLSHEEL

SEQ ID NO: 106670 - protein, 28 aa, Artificial Sequence
  Description of Artificial Sequence: Synthetic peptide
QENEIATTNPVATECYGDVSECLSHEEM

SEQ ID NO: 106671 - protein, 28 aa, Artificial Sequence
  Description of Artificial Sequence: Synthetic peptide
QENEIATTNPVATECYGDVSECLTHEEY

SEQ ID NO: 106672 - protein, 33 aa, Artificial Sequence
  Description of Artificial Sequence: Synthetic polypeptide
DEQEIATTNPVATEQYGSVSATDLEDHEGEEDL

SEQ ID NO: 106673 - protein, 30 aa, Artificial Sequence
  Description of Artificial Sequence: Synthetic polypeptide
QENEIATTNPVATECYGDVSECLVQHEGEL

SEQ ID NO: 106674 - protein, 28 aa, Artificial Sequence
  Description of Artificial Sequence: Synthetic peptide
QEEEIATTNPVATEQYGEAPEGCQHEEK

SEQ ID NO: 106675 - protein, 28 aa, Artificial Sequence
  Description of Artificial Sequence: Synthetic peptide
QENEIATTNPVATECYGDVSECMQHEEL

SEQ ID NO: 106676 - protein, 28 aa, Artificial Sequence
  Description of Artificial Sequence: Synthetic peptide
QEEEIATTNPVATEQYGEAPEFCQHEEK

SEQ ID NO: 106677 - protein, 28 aa, Artificial Sequence
  Description of Artificial Sequence: Synthetic peptide
QENEIATTNPVATECYGDVSECNQHEEL

SEQ ID NO: 106678 - protein, 29 aa, Artificial Sequence
  Description of Artificial Sequence: Synthetic peptide
QENEIATTNPVATECYGDVSECPLQHAEL

SEQ ID NO: 106679 - protein, 28 aa, Artificial Sequence
  Description of Artificial Sequence: Synthetic peptide
QENEIATTNPVATECYGDVSECPQHEEL

SEQ ID NO: 106680 - protein, 28 aa, Artificial Sequence
  Description of Artificial Sequence: Synthetic peptide
QENEIATTNPVATECYGDVSECQQHEEL

SEQ ID NO: 106681 - protein, 28 aa, Artificial Sequence
  Description of Artificial Sequence: Synthetic peptide
QENEIATTNPVATECYGDVSECRQHEEL

SEQ ID NO: 106682 - protein, 28 aa, Artificial Sequence
  Description of Artificial Sequence: Synthetic peptide
QENEIATTNPVATECYGDVSECSQHEEL

SEQ ID NO: 106683 - protein, 28 aa, Artificial Sequence
  Description of Artificial Sequence: Synthetic peptide
QENEIATTNPVATECYGDVSECSQHEWL

SEQ ID NO: 106684 - protein, 28 aa, Artificial Sequence
  Description of Artificial Sequence: Synthetic peptide
QENEIATTNPVATECYGDVSECTQHEEL

SEQ ID NO: 106685 - protein, 30 aa, Artificial Sequence
  Description of Artificial Sequence: Synthetic polypeptide
QENEIATTNPVATECYGDVSECVLQHEELR

SEQ ID NO: 106686 - protein, 28 aa, Artificial Sequence
  Description of Artificial Sequence: Synthetic peptide
QENEIATTNPVATECYGDVSECVQHEEL

SEQ ID NO: 106687 - protein, 29 aa, Artificial Sequence
  Description of Artificial Sequence: Synthetic peptide
QENEIATTNPVATECYGDVSECWLQHEEL

SEQ ID NO: 106688 - protein, 28 aa, Artificial Sequence
  Description of Artificial Sequence: Synthetic peptide
QENEIATTNPVATECYGDVSECWQHEAL

SEQ ID NO: 106689 - protein, 28 aa, Artificial Sequence
  Description of Artificial Sequence: Synthetic peptide
QENEIATTNPVATECYGDVSECWQHEEL

SEQ ID NO: 106690 - protein, 33 aa, Artificial Sequence
  Description of Artificial Sequence: Synthetic polypeptide
DEQEIATTNPVATEQYGSVSATDLEDHEGEDLY

SEQ ID NO: 106691 - protein, 29 aa, Artificial Sequence
  Description of Artificial Sequence: Synthetic peptide
QENEIATTNPVATECYGDVSECLQVHEEL

SEQ ID NO: 106692 - protein, 33 aa, Artificial Sequence
  Description of Artificial Sequence: Synthetic polypeptide
DEQEIATTNPVATEQYGSVSATDLEDHEGEDLW

SEQ ID NO: 106693 - protein, 28 aa, Artificial Sequence
  Description of Artificial Sequence: Synthetic peptide
QEEEIATTNPVATEQYGEAPEHCQHEVK

SEQ ID NO: 106694 - protein, 29 aa, Artificial Sequence
  Description of Artificial Sequence: Synthetic peptide
QENEIATTNPVATECYGDVSECLQTVEEL

SEQ ID NO: 106695 - protein, 28 aa, Artificial Sequence
  Description of Artificial Sequence: Synthetic peptide
QEEEIATTNPVATEQYGEAPELCQKEEK

SEQ ID NO: 106696 - protein, 30 aa, Artificial Sequence
  Description of Artificial Sequence: Synthetic polypeptide
QENEIATTNPVATECYGDVSECLQQQNENL

SEQ ID NO: 106697 - protein, 35 aa, Artificial Sequence
  Description of Artificial Sequence: Synthetic polypeptide
AEEEIRTTNPVATEQYGSVSTVVNQQQQETTNTND

SEQ ID NO: 106698 - protein, 29 aa, Artificial Sequence
  Description of Artificial Sequence: Synthetic peptide
QEEEIATTNPVATEQYGEAPELCQHEGEK

SEQ ID NO: 106699 - protein, 30 aa, Artificial Sequence
  Description of Artificial Sequence: Synthetic polypeptide
QENEIATTNPVATECYGDVSECLQRNEMEL

SEQ ID NO: 106700 - protein, 33 aa, Artificial Sequence
  Description of Artificial Sequence: Synthetic polypeptide
DESEIRTTNPVATECYGSVSACIDLEDHEGNDG

SEQ ID NO: 106701 - protein, 29 aa, Artificial Sequence
  Description of Artificial Sequence: Synthetic peptide
QENEIATTNPVATECYGDVSECLQSEELT

SEQ ID NO: 106702 - protein, 34 aa, Artificial Sequence
  Description of Artificial Sequence: Synthetic polypeptide
DESEIRTTNPVATECYGSVSACINEPQDFEGENG

SEQ ID NO: 106703 - protein, 28 aa, Artificial Sequence
  Description of Artificial Sequence: Synthetic peptide
QEEEIATTNPVATEQYGEAPELCQHEEK

SEQ ID NO: 106704 - protein, 28 aa, Artificial Sequence
  Description of Artificial Sequence: Synthetic peptide
QEEEIATTNPVATEQYGEAPEKYQHEEK

SEQ ID NO: 106705 - protein, 28 aa, Artificial Sequence
  Description of Artificial Sequence: Synthetic peptide
QEEEIATTNPVATEQYGEAPEKRQHEEK

SEQ ID NO: 106706 - protein, 28 aa, Artificial Sequence
  Description of Artificial Sequence: Synthetic peptide
QEEEIATTNPVATEQYGEAPEKCQHEEK

SEQ ID NO: 106707 - protein, 29 aa, Artificial Sequence
  Description of Artificial Sequence: Synthetic peptide
QENEIATTNPVATECYGDVSECLQSEEQL

SEQ ID NO: 106708 - protein, 28 aa, Artificial Sequence
  Description of Artificial Sequence: Synthetic peptide
QEEEIATTNPVATEQYGEAPEKCQCEEK

SEQ ID NO: 106709 - protein, 29 aa, Artificial Sequence
  Description of Artificial Sequence: Synthetic peptide
QEEEIATTNPVATEQYGEAPEIVEQHGEK

SEQ ID NO: 106710 - protein, 29 aa, Artificial Sequence
  Description of Artificial Sequence: Synthetic peptide
QENEIATTNPVATECYGDVSECLQSFEEL

SEQ ID NO: 106711 - protein, 29 aa, Artificial Sequence
  Description of Artificial Sequence: Synthetic peptide
QENEIATTNPVATECYGDVSECLQSHEEL

SEQ ID NO: 106712 - protein, 29 aa, Artificial Sequence
  Description of Artificial Sequence: Synthetic peptide
QENEIATTNPVATECYGDVSECLQSHEEP

SEQ ID NO: 106713 - protein, 30 aa, Artificial Sequence
  Description of Artificial Sequence: Synthetic polypeptide
QEEEIATTNPVATEQYGEAPEINEQHEENK

SEQ ID NO: 106714 - protein, 29 aa, Artificial Sequence
  Description of Artificial Sequence: Synthetic peptide
QEEEIATTNPVATEQYGEAPEINEQHEEK

SEQ ID NO: 106715 - protein, 32 aa, Artificial Sequence
  Description of Artificial Sequence: Synthetic polypeptide
DESEIRTTNPVATECYGSVSCDGPPEFEGENG

SEQ ID NO: 106716 - protein, 30 aa, Artificial Sequence
  Description of Artificial Sequence: Synthetic polypeptide
QEEEIATTNPVATEQYGEAPEINCQHEENK

SEQ ID NO: 106717 - protein, 29 aa, Artificial Sequence
  Description of Artificial Sequence: Synthetic peptide
QENEIATTNPVATECYGDVSECLQTHEEL

SEQ ID NO: 106718 - protein, 28 aa, Artificial Sequence
  Description of Artificial Sequence: Synthetic peptide
QEEEIATTNPVATEQYGEAPEICQHEEL

SEQ ID NO: 106719 - protein, 28 aa, Artificial Sequence
  Description of Artificial Sequence: Synthetic peptide
QEEEIATTNPVATEQYGEAPEICQHEEK

SEQ ID NO: 106720 - protein, 28 aa, Artificial Sequence
  Description of Artificial Sequence: Synthetic peptide
QEEEIATTNPVATEQYGEAPEHGQSEED

SEQ ID NO: 106721 - protein, 28 aa, Artificial Sequence
  Description of Artificial Sequence: Synthetic peptide
QEEEIATTNPVATEQYGEAPEMCQHEEK

SEQ ID NO: 106722 - protein, 33 aa, Artificial Sequence
  Description of Artificial Sequence: Synthetic polypeptide
DEQEIATTNPVATEQYGSVSATDLEDHEGEDLV

SEQ ID NO: 106723 - protein, 33 aa, Artificial Sequence
  Description of Artificial Sequence: Synthetic polypeptide
DEQEIATTNPVATEQYGSVSATDLEDHEGEDLS

SEQ ID NO: 106724 - protein, 28 aa, Artificial Sequence
  Description of Artificial Sequence: Synthetic peptide
QENEIATTNPVATECYGDVSEGYQHEEL

SEQ ID NO: 106725 - protein, 28 aa, Artificial Sequence
  Description of Artificial Sequence: Synthetic peptide
QEEEIATTNPVATEQYGEAPEACQQEEK

SEQ ID NO: 106726 - protein, 28 aa, Artificial Sequence
  Description of Artificial Sequence: Synthetic peptide
QEEEIATTNPVATEQYGEAPEACQHEEK

SEQ ID NO: 106727 - protein, 29 aa, Artificial Sequence
  Description of Artificial Sequence: Synthetic peptide
QENEIATTNPVATECYGDVSEHCLQHEEC

SEQ ID NO: 106728 - protein, 29 aa, Artificial Sequence
  Description of Artificial Sequence: Synthetic peptide
QENEIATTNPVATECYGDVSEHCLQHEEL

SEQ ID NO: 106729 - protein, 28 aa, Artificial Sequence
  Description of Artificial Sequence: Synthetic peptide
QEEEIATTNPVATEQYGEAPDVCQSEEK

SEQ ID NO: 106730 - protein, 33 aa, Artificial Sequence
  Description of Artificial Sequence: Synthetic polypeptide
DEQEIATTNPVATEQYGSVSATDLEDHEGDEDL

SEQ ID NO: 106731 - protein, 28 aa, Artificial Sequence
  Description of Artificial Sequence: Synthetic peptide
QEEEIATTNPVATEQYGEAPDVCQHEEK

SEQ ID NO: 106732 - protein, 33 aa, Artificial Sequence
  Description of Artificial Sequence: Synthetic polypeptide
DEQEIATTNPVATEQYGSVSATDLEDHEGCEDL

SEQ ID NO: 106733 - protein, 28 aa, Artificial Sequence
  Description of Artificial Sequence: Synthetic peptide
QENEIATTNPVATECYGDVSEHLSHEEL

SEQ ID NO: 106734 - protein, 33 aa, Artificial Sequence
  Description of Artificial Sequence: Synthetic polypeptide
DEQEIATTNPVATEQYGSVSATDLEDHEGAEDL

SEQ ID NO: 106735 - protein, 33 aa, Artificial Sequence
  Description of Artificial Sequence: Synthetic polypeptide
DESEIRTTNPVATECYGSVSCINPPEDFEGENG

SEQ ID NO: 106736 - protein, 28 aa, Artificial Sequence
  Description of Artificial Sequence: Synthetic peptide
QEEEIATTNPVATEQYGEAPCVCQSEEK

SEQ ID NO: 106737 - protein, 32 aa, Artificial Sequence
  Description of Artificial Sequence: Synthetic polypeptide
DEQEIATTNPVATEQYGSVSATDLEDHEFEDL

SEQ ID NO: 106738 - protein, 29 aa, Artificial Sequence
  Description of Artificial Sequence: Synthetic peptide
QENEIATTNPVATECYGDVSEILQNHEEA

SEQ ID NO: 106739 - protein, 32 aa, Artificial Sequence
  Description of Artificial Sequence: Synthetic polypeptide
DEQEIATTNPVATEQYGSVSATDLEDHEEEDL

SEQ ID NO: 106740 - protein, 32 aa, Artificial Sequence
  Description of Artificial Sequence: Synthetic polypeptide
DEQEIATTNPVATEQYGSVSATDLEDHEEEDA

SEQ ID NO: 106741 - protein, 28 aa, Artificial Sequence
  Description of Artificial Sequence: Synthetic peptide
QEEEIATTNPVATEQYGEAPCVCQHEEK

SEQ ID NO: 106742 - protein, 32 aa, Artificial Sequence
  Description of Artificial Sequence: Synthetic polypeptide
DEQEIATTNPVATEQYGSVSATDLEDHEDTDL

SEQ ID NO: 106743 - protein, 31 aa, Artificial Sequence
  Description of Artificial Sequence: Synthetic polypeptide
QENEIATTNPVATECYGDVSEINLPQDHENL

SEQ ID NO: 106744 - protein, 34 aa, Artificial Sequence
  Description of Artificial Sequence: Synthetic polypeptide
AEEEIRTTNPVATEQYGSVVTVNNLNQNEDEQED

SEQ ID NO: 106745 - protein, 28 aa, Artificial Sequence
  Description of Artificial Sequence: Synthetic peptide
QEEEIATTNPVATEQYGEAPCFCQHEEK

SEQ ID NO: 106746 - protein, 32 aa, Artificial Sequence
  Description of Artificial Sequence: Synthetic polypeptide
DEQEIATTNPVATEQYGSVSATDLEDHEDEDL

SEQ ID NO: 106747 - protein, 28 aa, Artificial Sequence
  Description of Artificial Sequence: Synthetic peptide
QEEEIATTNPVATEQYGEAPAVCQHEEK

SEQ ID NO: 106748 - protein, 32 aa, Artificial Sequence
  Description of Artificial Sequence: Synthetic polypeptide
DEQEIATTNPVATEQYGSVSATDLEDHECQDL

SEQ ID NO: 106749 - protein, 28 aa, Artificial Sequence
  Description of Artificial Sequence: Synthetic peptide
QENEIATTNPVATECYGDVSEGQQHEEL

SEQ ID NO: 106750 - protein, 33 aa, Artificial Sequence
  Description of Artificial Sequence: Synthetic polypeptide
DEQEIATTNPVATEQYGSVSATDLEDHEGEDLT

SEQ ID NO: 106751 - protein, 28 aa, Artificial Sequence
  Description of Artificial Sequence: Synthetic peptide
QENEIATTNPVATECYGDVSEGLYHEEL

SEQ ID NO: 106752 - protein, 29 aa, Artificial Sequence
  Description of Artificial Sequence: Synthetic peptide
QENEIATTNPVATECYGDVSEGCLQHEEL

SEQ ID NO: 106753 - protein, 28 aa, Artificial Sequence
  Description of Artificial Sequence: Synthetic peptide
QENEIATTNPVATECYGDVSECWQHFEL

SEQ ID NO: 106754 - protein, 33 aa, Artificial Sequence
  Description of Artificial Sequence: Synthetic polypeptide
DEQEIATTNPVATEQYGSVSATDLEDHEGEDLQ

SEQ ID NO: 106755 - protein, 33 aa, Artificial Sequence
  Description of Artificial Sequence: Synthetic polypeptide
DEQEIATTNPVATEQYGSVSATDLEDHEGEDLP

SEQ ID NO: 106756 - protein, 28 aa, Artificial Sequence
  Description of Artificial Sequence: Synthetic peptide
QENEIATTNPVATECYGDVSECYQHEEL

SEQ ID NO: 106757 - protein, 33 aa, Artificial Sequence
  Description of Artificial Sequence: Synthetic polypeptide
DEQEIATTNPVATEQYGSVSATDLEDHEGEDLN

SEQ ID NO: 106758 - protein, 33 aa, Artificial Sequence
  Description of Artificial Sequence: Synthetic polypeptide
DEQEIATTNPVATEQYGSVSATDLEDHEGEDLM

SEQ ID NO: 106759 - protein, 29 aa, Artificial Sequence
  Description of Artificial Sequence: Synthetic peptide
QEEEIATTNPVATEQYGEAPEEDCQHGEH

SEQ ID NO: 106760 - protein, 33 aa, Artificial Sequence
  Description of Artificial Sequence: Synthetic polypeptide
DEQEIATTNPVATEQYGSVSATDLEDHEGEDLL

SEQ ID NO: 106761 - protein, 33 aa, Artificial Sequence
  Description of Artificial Sequence: Synthetic polypeptide
DEQEIATTNPVATEQYGSVSATDLEDHEGEDLK

SEQ ID NO: 106762 - protein, 33 aa, Artificial Sequence
  Description of Artificial Sequence: Synthetic polypeptide
DEQEIATTNPVATEQYGSVSATDLEDHEGEDLI

SEQ ID NO: 106763 - protein, 33 aa, Artificial Sequence
  Description of Artificial Sequence: Synthetic polypeptide
DEQEIATTNPVATEQYGSVSATDLEDHEGEDLH

SEQ ID NO: 106764 - protein, 33 aa, Artificial Sequence
  Description of Artificial Sequence: Synthetic polypeptide
DEQEIATTNPVATEQYGSVSATDLEDHEGEDLG

SEQ ID NO: 106765 - protein, 29 aa, Artificial Sequence
  Description of Artificial Sequence: Synthetic peptide
QENEIATTNPVATECYGDVSEDLQHEELK

SEQ ID NO: 106766 - protein, 33 aa, Artificial Sequence
  Description of Artificial Sequence: Synthetic polypeptide
DEQEIATTNPVATEQYGSVSATDLEDHEGEDLF

SEQ ID NO: 106767 - protein, 33 aa, Artificial Sequence
  Description of Artificial Sequence: Synthetic polypeptide
DEQEIATTNPVATEQYGSVSATDLEDHEGEDLE

SEQ ID NO: 106768 - protein, 33 aa, Artificial Sequence
  Description of Artificial Sequence: Synthetic polypeptide
DEQEIATTNPVATEQYGSVSATDLEDHEGEDLD

SEQ ID NO: 106769 - protein, 33 aa, Artificial Sequence
  Description of Artificial Sequence: Synthetic polypeptide
DEQEIATTNPVATEQYGSVSATDLEDHEGEDLC

SEQ ID NO: 106770 - protein, 33 aa, Artificial Sequence
  Description of Artificial Sequence: Synthetic polypeptide
DEQEIATTNPVATEQYGSVSATDLEDHEGEDLA

SEQ ID NO: 106771 - protein, 30 aa, Artificial Sequence
  Description of Artificial Sequence: Synthetic polypeptide
QENEIATTNPVATECYGDVSEDLQHEGEDL

SEQ ID NO: 106772 - protein, 28 aa, Artificial Sequence
  Description of Artificial Sequence: Synthetic peptide
QEEEIATTNPVATEQYGEAPEECQHEEK

SEQ ID NO: 106773 - protein, 28 aa, Artificial Sequence
  Description of Artificial Sequence: Synthetic peptide
QEEEIATTNPVATEQYGEAPEDCQHEEK

SEQ ID NO: 106774 - protein, 29 aa, Artificial Sequence
  Description of Artificial Sequence: Synthetic peptide
QENEIATTNPVATECYGDVSEECIQHENL

SEQ ID NO: 106775 - protein, 33 aa, Artificial Sequence
  Description of Artificial Sequence: Synthetic polypeptide
DEQEIATTNPVATEQYGSVSATDLEDHEGEDEK

SEQ ID NO: 106776 - protein, 28 aa, Artificial Sequence
  Description of Artificial Sequence: Synthetic peptide
QEEEIATTNPVATEQYGEAPEDCQHECK

SEQ ID NO: 106777 - protein, 29 aa, Artificial Sequence
  Description of Artificial Sequence: Synthetic peptide
QENEIATTNPVATECYGDVSEGCLQHEEE

SEQ ID NO: 106778 - protein, 28 aa, Artificial Sequence
  Description of Artificial Sequence: Synthetic peptide
QEEEIATTNPVATEQYGEAPECCQHEEK

SEQ ID NO: 106779 - protein, 30 aa, Artificial Sequence
  Description of Artificial Sequence: Synthetic polypeptide
QENEIATTNPVATECYGDVSECLQQQNEEL

SEQ ID NO: 106780 - protein, 30 aa, Artificial Sequence
  Description of Artificial Sequence: Synthetic polypeptide
QENEIATTNPVATECYGDVSECLQQHNEEL

SEQ ID NO: 106781 - protein, 29 aa, Artificial Sequence
  Description of Artificial Sequence: Synthetic peptide
QEEEIATTNPVATEQYGEAPEMCQHEGEK

SEQ ID NO: 106782 - protein, 28 aa, Artificial Sequence
  Description of Artificial Sequence: Synthetic peptide
QEEEIATTNPVATEQYGEAPETCQHEEK

SEQ ID NO: 106783 - protein, 32 aa, Artificial Sequence
  Description of Artificial Sequence: Synthetic polypeptide
DEQEIATTNPVATEQYGSVSATDLEDHETEDL

SEQ ID NO: 106784 - protein, 32 aa, Artificial Sequence
  Description of Artificial Sequence: Synthetic polypeptide
DEQEIATTNPVATEQYGSVSATDLEDHESEDL

SEQ ID NO: 106785 - protein, 32 aa, Artificial Sequence
  Description of Artificial Sequence: Synthetic polypeptide
DEQEIATTNPVATEQYGSVSATDLEDHESEDA

SEQ ID NO: 106786 - protein, 32 aa, Artificial Sequence
  Description of Artificial Sequence: Synthetic polypeptide
DEQEIATTNPVATEQYGSVSATDLEDHEQEDL

SEQ ID NO: 106787 - protein, 32 aa, Artificial Sequence
  Description of Artificial Sequence: Synthetic polypeptide
DEQEIATTNPVATEQYGSVSATDLEDHEPEDL

SEQ ID NO: 106788 - protein, 28 aa, Artificial Sequence
  Description of Artificial Sequence: Synthetic peptide
QEEEIATTNPVATEQYGEAPETCQHEEI

SEQ ID NO: 106789 - protein, 32 aa, Artificial Sequence
  Description of Artificial Sequence: Synthetic polypeptide
DEQEIATTNPVATEQYGSVSATDLEDHEMEDL

SEQ ID NO: 106790 - protein, 32 aa, Artificial Sequence
  Description of Artificial Sequence: Synthetic polypeptide
DEQEIATTNPVATEQYGSVSATDLEDHEMEDK

SEQ ID NO: 106791 - protein, 32 aa, Artificial Sequence
  Description of Artificial Sequence: Synthetic polypeptide
DEQEIATTNPVATEQYGSVSATDLEDHELEDL

SEQ ID NO: 106792 - protein, 32 aa, Artificial Sequence
  Description of Artificial Sequence: Synthetic polypeptide
DEQEIATTNPVATEQYGSVSATDLEDHEKPDL

SEQ ID NO: 106793 - protein, 32 aa, Artificial Sequence
  Description of Artificial Sequence: Synthetic polypeptide
DEQEIATTNPVATEQYGSVSATDLEDHEKEDL

SEQ ID NO: 106794 - protein, 32 aa, Artificial Sequence
  Description of Artificial Sequence: Synthetic polypeptide
DEQEIATTNPVATEQYGSVSATDLEDHEIEDL

SEQ ID NO: 106795 - protein, 32 aa, Artificial Sequence
  Description of Artificial Sequence: Synthetic polypeptide
DEQEIATTNPVATEQYGSVSATDLEDHEHEKL

SEQ ID NO: 106796 - protein, 32 aa, Artificial Sequence
  Description of Artificial Sequence: Synthetic polypeptide
DEQEIATTNPVATEQYGSVSATDLEDHEHEDL

SEQ ID NO: 106797 - protein, 33 aa, Artificial Sequence
  Description of Artificial Sequence: Synthetic polypeptide
DEQEIATTNPVATEQYGSVSATDLEDHEGYEFL

SEQ ID NO: 106798 - protein, 33 aa, Artificial Sequence
  Description of Artificial Sequence: Synthetic polypeptide
DEQEIATTNPVATEQYGSVSATDLEDHEGYEDL

SEQ ID NO: 106799 - protein, 29 aa, Artificial Sequence
  Description of Artificial Sequence: Synthetic peptide
QENEIATTNPVATECYGDVSECLQHKEEL

SEQ ID NO: 106800 - protein, 32 aa, Artificial Sequence
  Description of Artificial Sequence: Synthetic polypeptide
DESEIRTTNPVATECYGDVSCCLPQDHEGEEL

SEQ ID NO: 106801 - protein, 33 aa, Artificial Sequence
  Description of Artificial Sequence: Synthetic polypeptide
DEQEIATTNPVATEQYGSVSATDLEDHEGYDLK

SEQ ID NO: 106802 - protein, 33 aa, Artificial Sequence
  Description of Artificial Sequence: Synthetic polypeptide
DEQEIATTNPVATEQYGSVSATDLEDHEGWEQL

SEQ ID NO: 106803 - protein, 33 aa, Artificial Sequence
  Description of Artificial Sequence: Synthetic polypeptide
DEQEIATTNPVATEQYGSVSATDLEDHEGWEKL

SEQ ID NO: 106804 - protein, 33 aa, Artificial Sequence
  Description of Artificial Sequence: Synthetic polypeptide
DEQEIATTNPVATEQYGSVSATDLEDHEGWEDL

SEQ ID NO: 106805 - protein, 33 aa, Artificial Sequence
  Description of Artificial Sequence: Synthetic polypeptide
DEQEIATTNPVATEQYGSVSATDLEDHEGWDLL

SEQ ID NO: 106806 - protein, 28 aa, Artificial Sequence
  Description of Artificial Sequence: Synthetic peptide
QEEEIATTNPVATEQYGEAPESCQHWEK

SEQ ID NO: 106807 - protein, 32 aa, Artificial Sequence
  Description of Artificial Sequence: Synthetic polypeptide
DEQEIATTNPVATEQYGSVSATDLEDHEVEDL

SEQ ID NO: 106808 - protein, 28 aa, Artificial Sequence
  Description of Artificial Sequence: Synthetic peptide
QEEEIATTNPVATEQYGEAPESCQHEEK

SEQ ID NO: 106809 - protein, 32 aa, Artificial Sequence
  Description of Artificial Sequence: Synthetic polypeptide
DEQEIATTNPVATEQYGSVSATDLEDHEVEDS

SEQ ID NO: 106810 - protein, 32 aa, Artificial Sequence
  Description of Artificial Sequence: Synthetic polypeptide
DEQEIATTNPVATEQYGSVSATDLEDHEYEDL

SEQ ID NO: 106811 - protein, 34 aa, Artificial Sequence
  Description of Artificial Sequence: Synthetic polypeptide
DESEIRTTNPVATECWQGSVSCINEPQDREGING

SEQ ID NO: 106812 - protein, 34 aa, Artificial Sequence
  Description of Artificial Sequence: Synthetic polypeptide
DESEIRTTNPVATECWSGSVSCINEPQDREGENG

SEQ ID NO: 106813 - protein, 29 aa, Artificial Sequence
  Description of Artificial Sequence: Synthetic peptide
QENEIATTNPVATECYGDVSECLQHEQEL

SEQ ID NO: 106814 - protein, 34 aa, Artificial Sequence
  Description of Artificial Sequence: Synthetic polypeptide
DESEIRTTNPVATECWSGSVSCINEPQDREGMNG

SEQ ID NO: 106815 - protein, 29 aa, Artificial Sequence
  Description of Artificial Sequence: Synthetic peptide
QENEIATTNPVATECYGDVSECLQHEREL

SEQ ID NO: 106816 - protein, 34 aa, Artificial Sequence
  Description of Artificial Sequence: Synthetic polypeptide
DESEIRTTNPVATECWSGSVSCINEPQPREGENG

SEQ ID NO: 106817 - protein, 29 aa, Artificial Sequence
  Description of Artificial Sequence: Synthetic peptide
QENEIATTNPVATECYGDVSECLQHESEL

SEQ ID NO: 106818 - protein, 29 aa, Artificial Sequence
  Description of Artificial Sequence: Synthetic peptide
QEEEIATTNPVATEQYGEAPETVCQHETK

SEQ ID NO: 106819 - protein, 34 aa, Artificial Sequence
  Description of Artificial Sequence: Synthetic polypeptide
DESEIRTTNPVATECWSGSVSCINEPQVREGENG

SEQ ID NO: 106820 - protein, 33 aa, Artificial Sequence
  Description of Artificial Sequence: Synthetic polypeptide
DEQEIATTNPVATEQYGSVSATDLEDHLGPEDL

SEQ ID NO: 106821 - protein, 29 aa, Artificial Sequence
  Description of Artificial Sequence: Synthetic peptide
QENEIATTNPVATECYGDVSECLQHETEL

SEQ ID NO: 106822 - protein, 34 aa, Artificial Sequence
  Description of Artificial Sequence: Synthetic polypeptide
DESEIRTTNPVATECWTGSVSCINEPQDREGENG

SEQ ID NO: 106823 - protein, 33 aa, Artificial Sequence
  Description of Artificial Sequence: Synthetic polypeptide
DEQEIATTNPVATEQYGSVSATDLEDHLGKEDL

SEQ ID NO: 106824 - protein, 33 aa, Artificial Sequence
  Description of Artificial Sequence: Synthetic polypeptide
DESEIRTTNPVATECWTSVSCINEMQDREGENG

SEQ ID NO: 106825 - protein, 33 aa, Artificial Sequence
  Description of Artificial Sequence: Synthetic polypeptide
DESEIRTTNPVATECWTSVSCINEPQDREGENG

SEQ ID NO: 106826 - protein, 29 aa, Artificial Sequence
  Description of Artificial Sequence: Synthetic peptide
QEEEIATTNPVATEQYGEAPETVCQHEEK

SEQ ID NO: 106827 - protein, 34 aa, Artificial Sequence
  Description of Artificial Sequence: Synthetic polypeptide
DESEIRTTNPVATECWWGSVSCINEPQDREGENG

SEQ ID NO: 106828 - protein, 34 aa, Artificial Sequence
  Description of Artificial Sequence: Synthetic polypeptide
DESEIRTTNPVATECWWGSVSCINEPQQREGENG

SEQ ID NO: 106829 - protein, 33 aa, Artificial Sequence
  Description of Artificial Sequence: Synthetic polypeptide
DEQEIATTNPVATEQYGSVSATDLEDHHGGEDS

SEQ ID NO: 106830 - protein, 30 aa, Artificial Sequence
  Description of Artificial Sequence: Synthetic polypeptide
QENEIATTNPVATECYGDVSECLQHGEELG

SEQ ID NO: 106831 - protein, 32 aa, Artificial Sequence
  Description of Artificial Sequence: Synthetic polypeptide
DEQEIATTNPVATEQYGSVSATDLEDHHFFDL

SEQ ID NO: 106832 - protein, 33 aa, Artificial Sequence
  Description of Artificial Sequence: Synthetic polypeptide
DESEIRTTNPVATECWWSVSCINEPQDREGENG

SEQ ID NO: 106833 - protein, 29 aa, Artificial Sequence
  Description of Artificial Sequence: Synthetic peptide
QEEEIATTNPVATEQYGEAPETCQHVGEK

SEQ ID NO: 106834 - protein, 29 aa, Artificial Sequence
  Description of Artificial Sequence: Synthetic peptide
QENEIATTNPVATECYGDVSECLQHIEEN

SEQ ID NO: 106835 - protein, 32 aa, Artificial Sequence
  Description of Artificial Sequence: Synthetic polypeptide
DEQEIATTNPVATEQYGSVSATDLEDHEYIDL

SEQ ID NO: 106836 - protein, 32 aa, Artificial Sequence
  Description of Artificial Sequence: Synthetic polypeptide
DEQEIATTNPVATEQYGSVSATDLEDHEWEDL

SEQ ID NO: 106837 - protein, 33 aa, Artificial Sequence
  Description of Artificial Sequence: Synthetic polypeptide
DEQEIATTNPVATEQYGSVSATDLEDHEGVEDL

SEQ ID NO: 106838 - protein, 28 aa, Artificial Sequence
  Description of Artificial Sequence: Synthetic peptide
QEEEIATTNPVATEQYGEAPERCQHEEQ

SEQ ID NO: 106839 - protein, 33 aa, Artificial Sequence
  Description of Artificial Sequence: Synthetic polypeptide
DEQEIATTNPVATEQYGSVSATDLEDHEGTEML

SEQ ID NO: 106840 - protein, 33 aa, Artificial Sequence
  Description of Artificial Sequence: Synthetic polypeptide
DEQEIATTNPVATEQYGSVSATDLEDHEGMEDL

SEQ ID NO: 106841 - protein, 29 aa, Artificial Sequence
  Description of Artificial Sequence: Synthetic peptide
QENEIATTNPVATECYGDVSECLQHTEEL

SEQ ID NO: 106842 - protein, 33 aa, Artificial Sequence
  Description of Artificial Sequence: Synthetic polypeptide
DEQEIATTNPVATEQYGSVSATDLEDHEGLEDL

SEQ ID NO: 106843 - protein, 33 aa, Artificial Sequence
  Description of Artificial Sequence: Synthetic polypeptide
DESEIRTTNPVATECYGIVSCINEPQDREGMHG

SEQ ID NO: 106844 - protein, 28 aa, Artificial Sequence
  Description of Artificial Sequence: Synthetic peptide
QEEEIATTNPVATEQYGEAPEPDQHNEK

SEQ ID NO: 106845 - protein, 33 aa, Artificial Sequence
  Description of Artificial Sequence: Synthetic polypeptide
DEQEIATTNPVATEQYGSVSATDLEDHEGKEDL

SEQ ID NO: 106846 - protein, 35 aa, Artificial Sequence
  Description of Artificial Sequence: Synthetic polypeptide
DESEIRTTNPVATECYGKTVSCTNMESNYRGGNRC

SEQ ID NO: 106847 - protein, 28 aa, Artificial Sequence
  Description of Artificial Sequence: Synthetic peptide
QEEEIATTNPVATEQYGEAPEPCQHEES

SEQ ID NO: 106848 - protein, 33 aa, Artificial Sequence
  Description of Artificial Sequence: Synthetic polypeptide
DEQEIATTNPVATEQYGSVSATDLEDHEGIEDL

SEQ ID NO: 106849 - protein, 28 aa, Artificial Sequence
  Description of Artificial Sequence: Synthetic peptide
QEEEIATTNPVATEQYGEAPEPCQHEEK

SEQ ID NO: 106850 - protein, 29 aa, Artificial Sequence
  Description of Artificial Sequence: Synthetic peptide
QEEEIATTNPVATEQYGEAPENVCQHEEK

SEQ ID NO: 106851 - protein, 29 aa, Artificial Sequence
  Description of Artificial Sequence: Synthetic peptide
QEEEIATTNPVATEQYGEAPENVCQHEEF

SEQ ID NO: 106852 - protein, 33 aa, Artificial Sequence
  Description of Artificial Sequence: Synthetic polypeptide
DEQEIATTNPVATEQYGSVSATDLEDHEGHEDL

SEQ ID NO: 106853 - protein, 33 aa, Artificial Sequence
  Description of Artificial Sequence: Synthetic polypeptide
DEQEIATTNPVATEQYGSVSATDLEDHEGHEDF

SEQ ID NO: 106854 - protein, 30 aa, Artificial Sequence
  Description of Artificial Sequence: Synthetic polypeptide
QENEIATTNPVATECYGDVSECLQMHNGEL

SEQ ID NO: 106855 - protein, 29 aa, Artificial Sequence
  Description of Artificial Sequence: Synthetic peptide
QENEIATTNPVATECYGDVSECLQNAEEA

SEQ ID NO: 106856 - protein, 33 aa, Artificial Sequence
  Description of Artificial Sequence: Synthetic polypeptide
DEQEIATTNPVATEQYGSVSATDLEDHEGGEDL

SEQ ID NO: 106857 - protein, 29 aa, Artificial Sequence
  Description of Artificial Sequence: Synthetic peptide
QENEIATTNPVATECYGDVSECLQNHEDL

SEQ ID NO: 106858 - protein, 33 aa, Artificial Sequence
  Description of Artificial Sequence: Synthetic polypeptide
DEQEIATTNPVATEQYGSVSATDLEDHEGFMDL

SEQ ID NO: 106859 - protein, 33 aa, Artificial Sequence
  Description of Artificial Sequence: Synthetic polypeptide
DEQEIATTNPVATEQYGSVSATDLEDHEGFELL

SEQ ID NO: 106860 - protein, 33 aa, Artificial Sequence
  Description of Artificial Sequence: Synthetic polypeptide
DEQEIATTNPVATEQYGSVSATDLEDHEGFEDL

SEQ ID NO: 106861 - protein, 29 aa, Artificial Sequence
  Description of Artificial Sequence: Synthetic peptide
QENEIATTNPVATECYGDVSECLQNHEEA

SEQ ID NO: 106862 - protein, 29 aa, Artificial Sequence
  Description of Artificial Sequence: Synthetic peptide
QENEIATTNPVATECYGDVSECLQNHEEL

SEQ ID NO: 106863 - protein, 29 aa, Artificial Sequence
  Description of Artificial Sequence: Synthetic peptide
QEEEIATTNPVATEQYGEAPENCQHEEEK

SEQ ID NO: 106864 - protein, 28 aa, Artificial Sequence
  Description of Artificial Sequence: Synthetic peptide
QEEEIATTNPVATEQYGEAPEMNQHEEK

SEQ ID NO: 106865 - protein, 33 aa, Artificial Sequence
  Description of Artificial Sequence: Synthetic polypeptide
DEQEIATTNPVATEQYGSVSATDLEDHEGMEPL

SEQ ID NO: 106866 - protein, 33 aa, Artificial Sequence
  Description of Artificial Sequence: Synthetic polypeptide
DESEIRTTNPVATECYGEVSCIVEPQDREGENG

SEQ ID NO: 106867 - protein, 29 aa, Artificial Sequence
  Description of Artificial Sequence: Synthetic peptide
QENEIATTNPVATECYGDVSECLQHSEEY

SEQ ID NO: 106868 - protein, 29 aa, Artificial Sequence
  Description of Artificial Sequence: Synthetic peptide
QENEIATTNPVATECYGDVSECLQHSEEL

SEQ ID NO: 106869 - protein, 33 aa, Artificial Sequence
  Description of Artificial Sequence: Synthetic polypeptide
DEQEIATTNPVATEQYGSVSATDLEDHEGTEEL

SEQ ID NO: 106870 - protein, 33 aa, Artificial Sequence
  Description of Artificial Sequence: Synthetic polypeptide
DEQEIATTNPVATEQYGSVSATDLEDHEGTEDL

SEQ ID NO: 106871 - protein, 33 aa, Artificial Sequence
  Description of Artificial Sequence: Synthetic polypeptide
DEQEIATTNPVATEQYGSVSATDLEDHEGSEDL

SEQ ID NO: 106872 - protein, 32 aa, Artificial Sequence
  Description of Artificial Sequence: Synthetic polypeptide
DESEIRTTNPVATECYGDVSCINEPQDHEENG

SEQ ID NO: 106873 - protein, 32 aa, Artificial Sequence
  Description of Artificial Sequence: Synthetic polypeptide
DESEIRTTNPVATECYGDVSCINEPQDHEENL

SEQ ID NO: 106874 - protein, 33 aa, Artificial Sequence
  Description of Artificial Sequence: Synthetic polypeptide
DEQEIATTNPVATEQYGSVSATDLEDHEGRIDL

SEQ ID NO: 106875 - protein, 29 aa, Artificial Sequence
  Description of Artificial Sequence: Synthetic peptide
QEEEIATTNPVATEQYGEAPERCQHEEKR

SEQ ID NO: 106876 - protein, 33 aa, Artificial Sequence
  Description of Artificial Sequence: Synthetic polypeptide
DEQEIATTNPVATEQYGSVSATDLEDHEGREEL

SEQ ID NO: 106877 - protein, 33 aa, Artificial Sequence
  Description of Artificial Sequence: Synthetic polypeptide
DEQEIATTNPVATEQYGSVSATDLEDHEGREDL

SEQ ID NO: 106878 - protein, 29 aa, Artificial Sequence
  Description of Artificial Sequence: Synthetic peptide
QENEIATTNPVATECYGDVSECLQHNEEL

SEQ ID NO: 106879 - protein, 33 aa, Artificial Sequence
  Description of Artificial Sequence: Synthetic polypeptide
DEQEIATTNPVATEQYGSVSATDLEDHEGRDLH

SEQ ID NO: 106880 - protein, 32 aa, Artificial Sequence
  Description of Artificial Sequence: Synthetic polypeptide
DESEIRTTNPVATECYGDVSECLPQDHEEENL

SEQ ID NO: 106881 - protein, 28 aa, Artificial Sequence
  Description of Artificial Sequence: Synthetic peptide
QEEEIATTNPVATEQYGEAPASCQHEEK

SEQ ID NO: 106882 - protein, 29 aa, Artificial Sequence
  Description of Artificial Sequence: Synthetic peptide
QENEIATTNPVATECYGDVSECLQHPECL

SEQ ID NO: 106883 - protein, 28 aa, Artificial Sequence
  Description of Artificial Sequence: Synthetic peptide
QEEEIATTNPVATEQYGEAPERCQHEEK

SEQ ID NO: 106884 - protein, 28 aa, Artificial Sequence
  Description of Artificial Sequence: Synthetic peptide
QEEEIATTNPVATEQYGEAPEQCQHEEK

SEQ ID NO: 106885 - protein, 30 aa, Artificial Sequence
  Description of Artificial Sequence: Synthetic polypeptide
DESEIRTTNPVATECYGEASCIVCQHEGEK

SEQ ID NO: 106886 - protein, 29 aa, Artificial Sequence
  Description of Artificial Sequence: Synthetic peptide
QENEIATTNPVATECYGDVSECLQHQEED

SEQ ID NO: 106887 - protein, 29 aa, Artificial Sequence
  Description of Artificial Sequence: Synthetic peptide
QEEEIATTNPVATEQYGEAPEPVCQHGEK

SEQ ID NO: 106888 - protein, 33 aa, Artificial Sequence
  Description of Artificial Sequence: Synthetic polypeptide
DEQEIATTNPVATEQYGSVSATDLEDHEGQEDL

SEQ ID NO: 106889 - protein, 30 aa, Artificial Sequence
  Description of Artificial Sequence: Synthetic polypeptide
DESEIRTTNPVATECYGEASEIVCQHEGEK

SEQ ID NO: 106890 - protein, 33 aa, Artificial Sequence
  Description of Artificial Sequence: Synthetic polypeptide
DEQEIATTNPVATEQYGSVSATDLEDHEGPEDL

SEQ ID NO: 106891 - protein, 29 aa, Artificial Sequence
  Description of Artificial Sequence: Synthetic peptide
QEEEIATTNPVATEQYGEAPEPVCNRENV

SEQ ID NO: 106892 - protein, 29 aa, Artificial Sequence
  Description of Artificial Sequence: Synthetic peptide
QEEEIATTNPVATEQYGEAPEPLCQHEEK

SEQ ID NO: 106893 - protein, 28 aa, Artificial Sequence
  Description of Artificial Sequence: Synthetic peptide
QEEEIATTNPVATEQYGEAPEPFQHEEK

SEQ ID NO: 106894 - protein, 29 aa, Artificial Sequence
  Description of Artificial Sequence: Synthetic peptide
QENEIATTNPVATECYGDVSECLQHSAEL

SEQ ID NO: 106895 - protein, 29 aa, Artificial Sequence
  Description of Artificial Sequence: Synthetic peptide
QENEIATTNPVATECYGDVSECLQHPEEL

SEQ ID NO: 106896 - protein, 35 aa, Artificial Sequence
  Description of Artificial Sequence: Synthetic polypeptide
AEEEIRTTNPVATEQYGSVSTVVNQQQQNETEDEE

SEQ ID NO: 106897 - protein, 29 aa, Artificial Sequence
  Description of Artificial Sequence: Synthetic peptide
QEEEIATTNPVATEQYGEAPAEVCQHENK

SEQ ID NO: 106898 - protein, 32 aa, Artificial Sequence
  Description of Artificial Sequence: Synthetic polypeptide
DEQEIATTNPVATEQYGSVSATDLEDHECEPL

SEQ ID NO: 106899 - protein, 32 aa, Artificial Sequence
  Description of Artificial Sequence: Synthetic polypeptide
DEQEIATTNPVATEQYGSVSATDAEDHEGEDL

SEQ ID NO: 106900 - protein, 29 aa, Artificial Sequence
  Description of Artificial Sequence: Synthetic peptide
QENEIATTNPVATECYGDVSKECLQHEEL

SEQ ID NO: 106901 - protein, 32 aa, Artificial Sequence
  Description of Artificial Sequence: Synthetic polypeptide
DESEIRTTNPVATEFYGVVDTDLQEGPEGGDE

SEQ ID NO: 106902 - protein, 29 aa, Artificial Sequence
  Description of Artificial Sequence: Synthetic peptide
QENEIATTNPVATECYGDVSLECLQHEEL

SEQ ID NO: 106903 - protein, 29 aa, Artificial Sequence
  Description of Artificial Sequence: Synthetic peptide
QENEIATTNPVATECYGDVSMACLQHEEL

SEQ ID NO: 106904 - protein, 33 aa, Artificial Sequence
  Description of Artificial Sequence: Synthetic polypeptide
DESEIRTTNPVATEGWGCVSWINENQEREGSNA

SEQ ID NO: 106905 - protein, 33 aa, Artificial Sequence
  Description of Artificial Sequence: Synthetic polypeptide
DEQEIATTNPVATEQYGSVSATCDLEDHEGEDL

SEQ ID NO: 106906 - protein, 29 aa, Artificial Sequence
  Description of Artificial Sequence: Synthetic peptide
QENEIATTNPVATECYGDVSMCLQQHEEL

SEQ ID NO: 106907 - protein, 30 aa, Artificial Sequence
  Description of Artificial Sequence: Synthetic polypeptide
DESEIRTTNPVATEGWGDVSSTEMNAAGDA

SEQ ID NO: 106908 - protein, 30 aa, Artificial Sequence
  Description of Artificial Sequence: Synthetic polypeptide
DESEIRTTNPVATEGWGDVSSTLMNAAGDA

SEQ ID NO: 106909 - protein, 29 aa, Artificial Sequence
  Description of Artificial Sequence: Synthetic peptide
QENEIATTNPVATECYGDVSMECLQHEEH

SEQ ID NO: 106910 - protein, 29 aa, Artificial Sequence
  Description of Artificial Sequence: Synthetic peptide
QENEIATTNPVATECYGDVSMECLQHEEL

SEQ ID NO: 106911 - protein, 29 aa, Artificial Sequence
  Description of Artificial Sequence: Synthetic peptide
QENEIATTNPVATECYGDVSNCCLQHEEL

SEQ ID NO: 106912 - protein, 28 aa, Artificial Sequence
  Description of Artificial Sequence: Synthetic peptide
QENEIATTNPVATECYGDVSNCIQHEQL

SEQ ID NO: 106913 - protein, 36 aa, Artificial Sequence
  Description of Artificial Sequence: Synthetic polypeptide
AEEEIRTTNPVATEQYGSVVTVNNLQSNEQGNNENE

SEQ ID NO: 106914 - protein, 29 aa, Artificial Sequence
  Description of Artificial Sequence: Synthetic peptide
QENEIATTNPVATECYGDVSNECLQEEEL

SEQ ID NO: 106915 - protein, 29 aa, Artificial Sequence
  Description of Artificial Sequence: Synthetic peptide
QENEIATTNPVATECYGDVSNECLQHEEL

SEQ ID NO: 106916 - protein, 29 aa, Artificial Sequence
  Description of Artificial Sequence: Synthetic peptide
QENEIATTNPVATECYGDVSNECLQHEPL

SEQ ID NO: 106917 - protein, 33 aa, Artificial Sequence
  Description of Artificial Sequence: Synthetic polypeptide
DEQEIATTNPVATEQYGSVSATADLEDTEGEDL

SEQ ID NO: 106918 - protein, 33 aa, Artificial Sequence
  Description of Artificial Sequence: Synthetic polypeptide
DEQEIATTNPVATEQYGSVSATADLEDHEGEVL

SEQ ID NO: 106919 - protein, 33 aa, Artificial Sequence
  Description of Artificial Sequence: Synthetic polypeptide
DEQEIATTNPVATEQYGSVSATADLEDHEGEDL

SEQ ID NO: 106920 - protein, 34 aa, Artificial Sequence
  Description of Artificial Sequence: Synthetic polypeptide
DESEIRTTNPVATEGWGSVCSWGNENQDRFGSNG

SEQ ID NO: 106921 - protein, 32 aa, Artificial Sequence
  Description of Artificial Sequence: Synthetic polypeptide
DEQEIATTNPVATEQYGSVSASDLKDHEGEDL

SEQ ID NO: 106922 - protein, 32 aa, Artificial Sequence
  Description of Artificial Sequence: Synthetic polypeptide
DEQEIATTNPVATEQYGSVSASDLEDHEGEDL

SEQ ID NO: 106923 - protein, 34 aa, Artificial Sequence
  Description of Artificial Sequence: Synthetic polypeptide
DESEIRTTNPVATEGWGSVCSWGNENQEREGSNV

SEQ ID NO: 106924 - protein, 33 aa, Artificial Sequence
  Description of Artificial Sequence: Synthetic polypeptide
DEQEIATTNPVATEQYGSVSATDALEDHEGEDL

SEQ ID NO: 106925 - protein, 32 aa, Artificial Sequence
  Description of Artificial Sequence: Synthetic polypeptide
DEQEIATTNPVATEQYGSVSARDLEDHEGEDL

SEQ ID NO: 106926 - protein, 29 aa, Artificial Sequence
  Description of Artificial Sequence: Synthetic peptide
QENEIATTNPVATECYGDVSKCLQHEELL

SEQ ID NO: 106927 - protein, 32 aa, Artificial Sequence
  Description of Artificial Sequence: Synthetic polypeptide
DEQEIATTNPVATEQYGSVSATDCEDHEGEDL

SEQ ID NO: 106928 - protein, 33 aa, Artificial Sequence
  Description of Artificial Sequence: Synthetic polypeptide
DEQEIATTNPVATEQYGSVSATDFLEDHVGEDL

SEQ ID NO: 106929 - protein, 33 aa, Artificial Sequence
  Description of Artificial Sequence: Synthetic polypeptide
DEQEIATTNPVATEQYGSVSATDFLEDHEGETL

SEQ ID NO: 106930 - protein, 33 aa, Artificial Sequence
  Description of Artificial Sequence: Synthetic polypeptide
DEQEIATTNPVATEQYGSVSATDFLEDHEGEDL

SEQ ID NO: 106931 - protein, 33 aa, Artificial Sequence
  Description of Artificial Sequence: Synthetic polypeptide
DEQEIATTNPVATEQYGSVSATDFLEDAEGEDL

SEQ ID NO: 106932 - protein, 32 aa, Artificial Sequence
  Description of Artificial Sequence: Synthetic polypeptide
DEQEIATTNPVATEQYGSVSATDFEDHEGEDL

SEQ ID NO: 106933 - protein, 29 aa, Artificial Sequence
  Description of Artificial Sequence: Synthetic peptide
QENEIATTNPVATECYGDVSICKLQHEEL

SEQ ID NO: 106934 - protein, 28 aa, Artificial Sequence
  Description of Artificial Sequence: Synthetic peptide
QENEIATTNPVATECYGDVSICLDHEEL

SEQ ID NO: 106935 - protein, 33 aa, Artificial Sequence
  Description of Artificial Sequence: Synthetic polypeptide
DESEIRTTNPVATEFWGSVSIINEPQDREGEIG

SEQ ID NO: 106936 - protein, 33 aa, Artificial Sequence
  Description of Artificial Sequence: Synthetic polypeptide
DESEIRTTNPVATEFWGSVSNINEMQDREGEGG

SEQ ID NO: 106937 - protein, 32 aa, Artificial Sequence
  Description of Artificial Sequence: Synthetic polypeptide
DEQEIATTNPVATEQYGSVSATDEMDHAGEDL

SEQ ID NO: 106938 - protein, 34 aa, Artificial Sequence
  Description of Artificial Sequence: Synthetic polypeptide
DEQEIATTNPVATEQYGSVSATDELSETHEGENL

SEQ ID NO: 106939 - protein, 33 aa, Artificial Sequence
  Description of Artificial Sequence: Synthetic polypeptide
DESEIRTTNPVATEFWGSVSSINEPQDHEGENG

SEQ ID NO: 106940 - protein, 29 aa, Artificial Sequence
  Description of Artificial Sequence: Synthetic peptide
QENEIATTNPVATECYGDVSIECLQHEEL

SEQ ID NO: 106941 - protein, 33 aa, Artificial Sequence
  Description of Artificial Sequence: Synthetic polypeptide
DEQEIATTNPVATEQYGSVSATDELEDHEGEDL

SEQ ID NO: 106942 - protein, 32 aa, Artificial Sequence
  Description of Artificial Sequence: Synthetic polypeptide
DEQEIATTNPVATEQYGSVSATDEEEHEGELL

SEQ ID NO: 106943 - protein, 32 aa, Artificial Sequence
  Description of Artificial Sequence: Synthetic polypeptide
DEQEIATTNPVATEQYGSVSATDEEDHEGEDL

SEQ ID NO: 106944 - protein, 32 aa, Artificial Sequence
  Description of Artificial Sequence: Synthetic polypeptide
DEQEIATTNPVATEQYGSVSATDEEDHAGEDL

SEQ ID NO: 106945 - protein, 34 aa, Artificial Sequence
  Description of Artificial Sequence: Synthetic polypeptide
DEQEIATTNPVATEQYGSVSATDDLEDHEGNDLQ

SEQ ID NO: 106946 - protein, 33 aa, Artificial Sequence
  Description of Artificial Sequence: Synthetic polypeptide
DEQEIATTNPVATEQYGSVSATDDLEDHEGEDL

SEQ ID NO: 106947 - protein, 33 aa, Artificial Sequence
  Description of Artificial Sequence: Synthetic polypeptide
QEEEIATTNPVATEQYGDVSTTCLPQMHNGMEV

SEQ ID NO: 106948 - protein, 32 aa, Artificial Sequence
  Description of Artificial Sequence: Synthetic polypeptide
DEQEIATTNPVATEQYGSVSATDDEDHEGEDL

SEQ ID NO: 106949 - protein, 33 aa, Artificial Sequence
  Description of Artificial Sequence: Synthetic polypeptide
DEQEIATTNPVATEQYGSVSATDCLEDHEGEDV

SEQ ID NO: 106950 - protein, 33 aa, Artificial Sequence
  Description of Artificial Sequence: Synthetic polypeptide
DEQEIATTNPVATEQYGSVSATDCLEDHEGEDL

SEQ ID NO: 106951 - protein, 33 aa, Artificial Sequence
  Description of Artificial Sequence: Synthetic polypeptide
QEEEIATTNPVATEQYGDVSTTCLPQMHNEMEV

SEQ ID NO: 106952 - protein, 31 aa, Artificial Sequence
  Description of Artificial Sequence: Synthetic polypeptide
DEQEIATTNPVATEQYGSVSATDCEHEEEDL

SEQ ID NO: 106953 - protein, 33 aa, Artificial Sequence
  Description of Artificial Sequence: Synthetic polypeptide
DEQEIATTNPVATEQYGSVSATDALEDHEGETL

SEQ ID NO: 106954 - protein, 33 aa, Artificial Sequence
  Description of Artificial Sequence: Synthetic polypeptide
DEQEIATTNPVATEQYGSVSATDFLVDHEGEDL

SEQ ID NO: 106955 - protein, 32 aa, Artificial Sequence
  Description of Artificial Sequence: Synthetic polypeptide
DEQEIATTNPVATEQYGSVSAQDLEDHEGEDL

SEQ ID NO: 106956 - protein, 32 aa, Artificial Sequence
  Description of Artificial Sequence: Synthetic polypeptide
DEQEIATTNPVATEQYGSVSAPDLEDHEGEDL

SEQ ID NO: 106957 - protein, 32 aa, Artificial Sequence
  Description of Artificial Sequence: Synthetic polypeptide
DEQEIATTNPVATEQYGSVSAHDLCDHEGEDL

SEQ ID NO: 106958 - protein, 32 aa, Artificial Sequence
  Description of Artificial Sequence: Synthetic polypeptide
DEQEIATTNPVATEQYGSVSAGDLEDHEGEDL

SEQ ID NO: 106959 - protein, 32 aa, Artificial Sequence
  Description of Artificial Sequence: Synthetic polypeptide
DEQEIATTNPVATEQYGSVSAGDLDDHMGEDL

SEQ ID NO: 106960 - protein, 32 aa, Artificial Sequence
  Description of Artificial Sequence: Synthetic polypeptide
DEQEIATTNPVATEQYGSVSAFDLEDHEGEDL

SEQ ID NO: 106961 - protein, 32 aa, Artificial Sequence
  Description of Artificial Sequence: Synthetic polypeptide
DEQEIATTNPVATEQYGSVSAFALEDHEGEDL

SEQ ID NO: 106962 - protein, 30 aa, Artificial Sequence
  Description of Artificial Sequence: Synthetic polypeptide
QENEIATTNPVATECYGDVSTCLQDHEEEL

SEQ ID NO: 106963 - protein, 33 aa, Artificial Sequence
  Description of Artificial Sequence: Synthetic polypeptide
DESEIRTTNPVATEGWGSVSCINEPQDRVGEQG

SEQ ID NO: 106964 - protein, 33 aa, Artificial Sequence
  Description of Artificial Sequence: Synthetic polypeptide
DESEIRTTNPVATEGWGSVSCINEPQSRVGEQG

SEQ ID NO: 106965 - protein, 32 aa, Artificial Sequence
  Description of Artificial Sequence: Synthetic polypeptide
DEQEIATTNPVATEQYGSVSAEVLEDHEGEDL

SEQ ID NO: 106966 - protein, 30 aa, Artificial Sequence
  Description of Artificial Sequence: Synthetic polypeptide
QENEIATTNPVATECYGDVSTCLQHNEEPL

SEQ ID NO: 106967 - protein, 28 aa, Artificial Sequence
  Description of Artificial Sequence: Synthetic peptide
QEEEIATTNPVATEQYGDAPEVCQHEEL

SEQ ID NO: 106968 - protein, 30 aa, Artificial Sequence
  Description of Artificial Sequence: Synthetic polypeptide
QENEIATTNPVATECYGDVSTDLEDHEGEL

SEQ ID NO: 106969 - protein, 29 aa, Artificial Sequence
  Description of Artificial Sequence: Synthetic peptide
QENEIATTNPVATECYGDVSTECLKHEEL

SEQ ID NO: 106970 - protein, 29 aa, Artificial Sequence
  Description of Artificial Sequence: Synthetic peptide
QENEIATTNPVATECYGDVSTECLNHEEL

SEQ ID NO: 106971 - protein, 34 aa, Artificial Sequence
  Description of Artificial Sequence: Synthetic polypeptide
DESEIRTTNPVATEGWGSVSCINPEPQDREGENG

SEQ ID NO: 106972 - protein, 28 aa, Artificial Sequence
  Description of Artificial Sequence: Synthetic peptide
QEEEIATTNPVATEQYGDAPECCQHEEL

SEQ ID NO: 106973 - protein, 29 aa, Artificial Sequence
  Description of Artificial Sequence: Synthetic peptide
QENEIATTNPVATECYGDVSVCLQHEELK

SEQ ID NO: 106974 - protein, 33 aa, Artificial Sequence
  Description of Artificial Sequence: Synthetic polypeptide
DESEIRTTNPVATEGWGSVSIINEPDDREGENE

SEQ ID NO: 106975 - protein, 29 aa, Artificial Sequence
  Description of Artificial Sequence: Synthetic peptide
QENEIATTNPVATECYGDVSVCLQYHEEL

SEQ ID NO: 106976 - protein, 29 aa, Artificial Sequence
  Description of Artificial Sequence: Synthetic peptide
QENEIATTNPVATECYGDVSVECLQHEEE

SEQ ID NO: 106977 - protein, 28 aa, Artificial Sequence
  Description of Artificial Sequence: Synthetic peptide
QEEEIATTNPVATEQYGDAPECCQHEEK

SEQ ID NO: 106978 - protein, 29 aa, Artificial Sequence
  Description of Artificial Sequence: Synthetic peptide
QENEIATTNPVATECYGDVSVECLQHEEL

SEQ ID NO: 106979 - protein, 29 aa, Artificial Sequence
  Description of Artificial Sequence: Synthetic peptide
QENEIATTNPVATECYGDVSWCLHQHEEL

SEQ ID NO: 106980 - protein, 28 aa, Artificial Sequence
  Description of Artificial Sequence: Synthetic peptide
QENEIATTNPVATECYGDVSWCLKHEEL

SEQ ID NO: 106981 - protein, 28 aa, Artificial Sequence
  Description of Artificial Sequence: Synthetic peptide
QEEEIATTNPVATEQYGCYPWVEQHEEK

SEQ ID NO: 106982 - protein, 32 aa, Artificial Sequence
  Description of Artificial Sequence: Synthetic polypeptide
DEQEIATTNPVATEQYGSVSAHDLEDHEGEDL

SEQ ID NO: 106983 - protein, 32 aa, Artificial Sequence
  Description of Artificial Sequence: Synthetic polypeptide
DEQEIATTNPVATEQYGSVSAPDLEYHEGEDL

SEQ ID NO: 106984 - protein, 30 aa, Artificial Sequence
  Description of Artificial Sequence: Synthetic polypeptide
QENEIATTNPVATECYGDVSTCLEDHEGEL

SEQ ID NO: 106985 - protein, 29 aa, Artificial Sequence
  Description of Artificial Sequence: Synthetic peptide
QENEIATTNPVATECYGDVSSELQHEVEL

SEQ ID NO: 106986 - protein, 32 aa, Artificial Sequence
  Description of Artificial Sequence: Synthetic polypeptide
DEQEIATTNPVATEQYGSVSAPDLEDHEGEDH

SEQ ID NO: 106987 - protein, 32 aa, Artificial Sequence
  Description of Artificial Sequence: Synthetic polypeptide
DEQEIATTNPVATEQYGSVSAPDLEDAEGEDL

SEQ ID NO: 106988 - protein, 29 aa, Artificial Sequence
  Description of Artificial Sequence: Synthetic peptide
QENEIATTNPVATECYGDVSQECLQHEEL

SEQ ID NO: 106989 - protein, 34 aa, Artificial Sequence
  Description of Artificial Sequence: Synthetic polypeptide
DESEIRTTNPVATEGWGSVCSWMNEPQDRSGSNQ

SEQ ID NO: 106990 - protein, 36 aa, Artificial Sequence
  Description of Artificial Sequence: Synthetic polypeptide
AEEEIRTTNPVATEQYGSVVTVNNLQSNEQGTTNND

SEQ ID NO: 106991 - protein, 29 aa, Artificial Sequence
  Description of Artificial Sequence: Synthetic peptide
QENEIATTNPVATECYGDVSRCLQHEREL

SEQ ID NO: 106992 - protein, 29 aa, Artificial Sequence
  Description of Artificial Sequence: Synthetic peptide
QENEIATTNPVATECYGDVSRECLQHEEL

SEQ ID NO: 106993 - protein, 29 aa, Artificial Sequence
  Description of Artificial Sequence: Synthetic peptide
QENEIATTNPVATECYGDVSRECLQHEES

SEQ ID NO: 106994 - protein, 29 aa, Artificial Sequence
  Description of Artificial Sequence: Synthetic peptide
QENEIATTNPVATECYGDVSSCLQHEAEL

SEQ ID NO: 106995 - protein, 34 aa, Artificial Sequence
  Description of Artificial Sequence: Synthetic polypeptide
DESEIRTTNPVATEGWGSVSCINEPQDREGENGP

SEQ ID NO: 106996 - protein, 32 aa, Artificial Sequence
  Description of Artificial Sequence: Synthetic polypeptide
DEQEIATTNPVATEQYGSVSANDIEDHEGEDL

SEQ ID NO: 106997 - protein, 29 aa, Artificial Sequence
  Description of Artificial Sequence: Synthetic peptide
QENEIATTNPVATECYGDVSSCLQHEQEL

SEQ ID NO: 106998 - protein, 29 aa, Artificial Sequence
  Description of Artificial Sequence: Synthetic peptide
QENEIATTNPVATECYGDVSSECLQHEEA

SEQ ID NO: 106999 - protein, 33 aa, Artificial Sequence
  Description of Artificial Sequence: Synthetic polypeptide
DEQEIATTNPVATEQYGSVSAMDLQQDHNGEDL

SEQ ID NO: 107000 - protein, 32 aa, Artificial Sequence
  Description of Artificial Sequence: Synthetic polypeptide
DEQEIATTNPVATEQYGSVSAMDLEDNEGEDL

SEQ ID NO: 107001 - protein, 32 aa, Artificial Sequence
  Description of Artificial Sequence: Synthetic polypeptide
DEQEIATTNPVATEQYGSVSAMDLEDHEGPDL

SEQ ID NO: 107002 - protein, 29 aa, Artificial Sequence
  Description of Artificial Sequence: Synthetic peptide
QENEIATTNPVATECYGDVSSECLQHEEL

SEQ ID NO: 107003 - protein, 32 aa, Artificial Sequence
  Description of Artificial Sequence: Synthetic polypeptide
DEQEIATTNPVATEQYGSVSAMDLEDHEGEDL

SEQ ID NO: 107004 - protein, 32 aa, Artificial Sequence
  Description of Artificial Sequence: Synthetic polypeptide
DEQEIATTNPVATEQYGSVSALDNEDNEGEDL

SEQ ID NO: 107005 - protein, 32 aa, Artificial Sequence
  Description of Artificial Sequence: Synthetic polypeptide
DEQEIATTNPVATEQYGSVSALDLEDHEGEDL

SEQ ID NO: 107006 - protein, 30 aa, Artificial Sequence
  Description of Artificial Sequence: Synthetic polypeptide
QENEIATTNPVATECYGDVSSECLQHEMNL

SEQ ID NO: 107007 - protein, 32 aa, Artificial Sequence
  Description of Artificial Sequence: Synthetic polypeptide
DEQEIATTNPVATEQYGSVSAKDLEDHEGEDL

SEQ ID NO: 107008 - protein, 32 aa, Artificial Sequence
  Description of Artificial Sequence: Synthetic polypeptide
DEQEIATTNPVATEQYGSVSAKDLCDHEGEDL

SEQ ID NO: 107009 - protein, 32 aa, Artificial Sequence
  Description of Artificial Sequence: Synthetic polypeptide
DEQEIATTNPVATEQYGSVSAIDLEDHEGEDL

SEQ ID NO: 107010 - protein, 32 aa, Artificial Sequence
  Description of Artificial Sequence: Synthetic polypeptide
DEQEIATTNPVATEQYGSVSAIDLEDHEGADL

SEQ ID NO: 107011 - protein, 32 aa, Artificial Sequence
  Description of Artificial Sequence: Synthetic polypeptide
DEQEIATTNPVATEQYGSVSAHNIEDHEGEDL

SEQ ID NO: 107012 - protein, 32 aa, Artificial Sequence
  Description of Artificial Sequence: Synthetic polypeptide
DEQEIATTNPVATEQYGSVSATDGCDHEGEDL

SEQ ID NO: 107013 - protein, 29 aa, Artificial Sequence
  Description of Artificial Sequence: Synthetic peptide
QENEIATTNPVATECYGDVSHPCLQHEEL

SEQ ID NO: 107014 - protein, 33 aa, Artificial Sequence
  Description of Artificial Sequence: Synthetic polypeptide
DEQEIATTNPVATEQYGSVSATDGEAGEGNEDG

SEQ ID NO: 107015 - protein, 32 aa, Artificial Sequence
  Description of Artificial Sequence: Synthetic polypeptide
DESEIRTTNPVATECYGTISMINIQQQQNGNH

SEQ ID NO: 107016 - protein, 29 aa, Artificial Sequence
  Description of Artificial Sequence: Synthetic peptide
QENEIATTNPVATECYGDVSEPALQHEEL

SEQ ID NO: 107017 - protein, 32 aa, Artificial Sequence
  Description of Artificial Sequence: Synthetic polypeptide
DEQEIATTNPVATEQYGSVSATDLEDCEMEDL

SEQ ID NO: 107018 - protein, 34 aa, Artificial Sequence
  Description of Artificial Sequence: Synthetic polypeptide
DESEIRTTNPVATECYGTVSATINEPQDFEGENG

SEQ ID NO: 107019 - protein, 33 aa, Artificial Sequence
  Description of Artificial Sequence: Synthetic polypeptide
DESEIRTTNPVATECYGTVSCINEQQDQEGENH

SEQ ID NO: 107020 - protein, 33 aa, Artificial Sequence
  Description of Artificial Sequence: Synthetic polypeptide
DESEIRTTNPVATECYGTVSCINEQQDQNGENH

SEQ ID NO: 107021 - protein, 28 aa, Artificial Sequence
  Description of Artificial Sequence: Synthetic peptide
QEEEIATTNPVATEQYGEAGEGCQHEEK

SEQ ID NO: 107022 - protein, 28 aa, Artificial Sequence
  Description of Artificial Sequence: Synthetic peptide
QEEEIATTNPVATEQYGEAGDAFQHEEG

SEQ ID NO: 107023 - protein, 30 aa, Artificial Sequence
  Description of Artificial Sequence: Synthetic polypeptide
QENEIATTNPVATECYGDVSEPCGQRGEPL

SEQ ID NO: 107024 - protein, 33 aa, Artificial Sequence
  Description of Artificial Sequence: Synthetic polypeptide
DEQEIATTNPVATEQYGSVSATDLECHEGQEDL

SEQ ID NO: 107025 - protein, 29 aa, Artificial Sequence
  Description of Artificial Sequence: Synthetic peptide
QENEIATTNPVATECYGDVSEPCLQHEDL

SEQ ID NO: 107026 - protein, 29 aa, Artificial Sequence
  Description of Artificial Sequence: Synthetic peptide
QENEIATTNPVATECYGDVSEPGLQHEEL

SEQ ID NO: 107027 - protein, 28 aa, Artificial Sequence
  Description of Artificial Sequence: Synthetic peptide
QEEEIATTNPVATEQYGEAGAVHQHEEK

SEQ ID NO: 107028 - protein, 28 aa, Artificial Sequence
  Description of Artificial Sequence: Synthetic peptide
QEEEIATTNPVATEQYGEAFWVDQHEEA

SEQ ID NO: 107029 - protein, 28 aa, Artificial Sequence
  Description of Artificial Sequence: Synthetic peptide
QEEEIATTNPVATEQYGEAFEVCQHEEK

SEQ ID NO: 107030 - protein, 33 aa, Artificial Sequence
  Description of Artificial Sequence: Synthetic polypeptide
DEQEIATTNPVATEQYGSVSATDLEAHEGEDLT

SEQ ID NO: 107031 - protein, 29 aa, Artificial Sequence
  Description of Artificial Sequence: Synthetic peptide
QENEIATTNPVATECYGDVSEPLQHCEEL

SEQ ID NO: 107032 - protein, 29 aa, Artificial Sequence
  Description of Artificial Sequence: Synthetic peptide
QEEEIATTNPVATEQYGEACPEVCQHGEK

SEQ ID NO: 107033 - protein, 33 aa, Artificial Sequence
  Description of Artificial Sequence: Synthetic polypeptide
DEQEIATTNPVATEQYGSVSATDLEAGEGGEDL

SEQ ID NO: 107034 - protein, 33 aa, Artificial Sequence
  Description of Artificial Sequence: Synthetic polypeptide
DEQEIATTNPVATEQYGSVSATDLDGDHEGEDL

SEQ ID NO: 107035 - protein, 28 aa, Artificial Sequence
  Description of Artificial Sequence: Synthetic peptide
QEEEIATTNPVATEQYGEACEVCQQEEK

SEQ ID NO: 107036 - protein, 35 aa, Artificial Sequence
  Description of Artificial Sequence: Synthetic polypeptide
DESEIRTTNPVATECYWGISVSCINEPQDREGENG

SEQ ID NO: 107037 - protein, 33 aa, Artificial Sequence
  Description of Artificial Sequence: Synthetic polypeptide
DEQEIATTNPVATEQYGSVSATDLDEDHEGEDS

SEQ ID NO: 107038 - protein, 33 aa, Artificial Sequence
  Description of Artificial Sequence: Synthetic polypeptide
DEQEIATTNPVATEQYGSVSATDLDEDHEGEDL

SEQ ID NO: 107039 - protein, 28 aa, Artificial Sequence
  Description of Artificial Sequence: Synthetic peptide
QENEIATTNPVATECYGDVSEPRQHEEL

SEQ ID NO: 107040 - protein, 32 aa, Artificial Sequence
  Description of Artificial Sequence: Synthetic polypeptide
DESEIRTTNPVATECYGTISMENIQQQQNGNH

SEQ ID NO: 107041 - protein, 34 aa, Artificial Sequence
  Description of Artificial Sequence: Synthetic polypeptide
DESEIRTTNPVATECYWGSLSCINEPQDREGENG

SEQ ID NO: 107042 - protein, 28 aa, Artificial Sequence
  Description of Artificial Sequence: Synthetic peptide
QEEEIATTNPVATEQYGEAGEVCQHEEK

SEQ ID NO: 107043 - protein, 28 aa, Artificial Sequence
  Description of Artificial Sequence: Synthetic peptide
QEEEIATTNPVATEQYGEAHEVCQHEEK

SEQ ID NO: 107044 - protein, 32 aa, Artificial Sequence
  Description of Artificial Sequence: Synthetic polypeptide
DEQEIATTNPVATEQYGSVSATDLEDHECEDL

SEQ ID NO: 107045 - protein, 32 aa, Artificial Sequence
  Description of Artificial Sequence: Synthetic polypeptide
DEQEIATTNPVATEQYGSVSATDLEDHEAWDL

SEQ ID NO: 107046 - protein, 33 aa, Artificial Sequence
  Description of Artificial Sequence: Synthetic polypeptide
DEQEIATTNPVATEQYGSVSATDLEDHEANEDL

SEQ ID NO: 107047 - protein, 29 aa, Artificial Sequence
  Description of Artificial Sequence: Synthetic peptide
QEEEIATTNPVATEQYGEAPAEGCQHENK

SEQ ID NO: 107048 - protein, 32 aa, Artificial Sequence
  Description of Artificial Sequence: Synthetic polypeptide
DEQEIATTNPVATEQYGSVSATDLEDHEAEDL

SEQ ID NO: 107049 - protein, 28 aa, Artificial Sequence
  Description of Artificial Sequence: Synthetic peptide
QEEEIATTNPVATEQYGEANFVCQHEEK

SEQ ID NO: 107050 - protein, 28 aa, Artificial Sequence
  Description of Artificial Sequence: Synthetic peptide
QENEIATTNPVATECYGDVSELSQHNEL

SEQ ID NO: 107051 - protein, 29 aa, Artificial Sequence
  Description of Artificial Sequence: Synthetic peptide
QEEEIATTNPVATEQYGEANEVCQHEENK

SEQ ID NO: 107052 - protein, 35 aa, Artificial Sequence
  Description of Artificial Sequence: Synthetic polypeptide
DESEIRTTNPVATECYGSVSSTPNEPNMRNGENPV

SEQ ID NO: 107053 - protein, 35 aa, Artificial Sequence
  Description of Artificial Sequence: Synthetic polypeptide
DESEIRTTNPVATECYGSVSSTPNEPNMRNGMNPV

SEQ ID NO: 107054 - protein, 28 aa, Artificial Sequence
  Description of Artificial Sequence: Synthetic peptide
QEEEIATTNPVATEQYGEANEVCQHEEK

SEQ ID NO: 107055 - protein, 28 aa, Artificial Sequence
  Description of Artificial Sequence: Synthetic peptide
QEEEIATTNPVATEQYGEAMEVCQHEEK

SEQ ID NO: 107056 - protein, 28 aa, Artificial Sequence
  Description of Artificial Sequence: Synthetic peptide
QEEEIATTNPVATEQYGEAMECCQHEEK

SEQ ID NO: 107057 - protein, 28 aa, Artificial Sequence
  Description of Artificial Sequence: Synthetic peptide
QEEEIATTNPVATEQYGEALEVCQHEEK

SEQ ID NO: 107058 - protein, 28 aa, Artificial Sequence
  Description of Artificial Sequence: Synthetic peptide
QEEEIATTNPVATEQYGEAIEVCQIEEK

SEQ ID NO: 107059 - protein, 30 aa, Artificial Sequence
  Description of Artificial Sequence: Synthetic polypeptide
QENEIATTNPVATECYGDVSENCLQHEELC

SEQ ID NO: 107060 - protein, 30 aa, Artificial Sequence
  Description of Artificial Sequence: Synthetic polypeptide
QENEIATTNPVATECYGDVSENCLQHEELN

SEQ ID NO: 107061 - protein, 28 aa, Artificial Sequence
  Description of Artificial Sequence: Synthetic peptide
QEEEIATTNPVATEQYGEAIEVCQHEEY

SEQ ID NO: 107062 - protein, 28 aa, Artificial Sequence
  Description of Artificial Sequence: Synthetic peptide
QEEEIATTNPVATEQYGEAIEVCQHEEK

SEQ ID NO: 107063 - protein, 34 aa, Artificial Sequence
  Description of Artificial Sequence: Synthetic polypeptide
DESEIRTTNPVATECYGSVSTINEPEDREGEEDG

SEQ ID NO: 107064 - protein, 33 aa, Artificial Sequence
  Description of Artificial Sequence: Synthetic polypeptide
DEQEIATTNPVATEQYGSVSATDLEDEEGVEDL

SEQ ID NO: 107065 - protein, 34 aa, Artificial Sequence
  Description of Artificial Sequence: Synthetic polypeptide
AEEEIRTTNPVATEQYGSVSTVVNQQQQEATEDE

SEQ ID NO: 107066 - protein, 29 aa, Artificial Sequence
  Description of Artificial Sequence: Synthetic peptide
QEEEIATTNPVATEQYGEAHEVCQHREEK

SEQ ID NO: 107067 - protein, 35 aa, Artificial Sequence
  Description of Artificial Sequence: Synthetic polypeptide
AEEEIRTTNPVATEQYGSVSTVVNQQQNQTTNNNQ

SEQ ID NO: 107068 - protein, 33 aa, Artificial Sequence
  Description of Artificial Sequence: Synthetic polypeptide
DEQEIATTNPVATEQYGSVSATDLEDDEGFEDL

SEQ ID NO: 107069 - protein, 33 aa, Artificial Sequence
  Description of Artificial Sequence: Synthetic polypeptide
DEQEIATTNPVATEQYGSVSATDLEDDEGEDLN

SEQ ID NO: 107070 - protein, 28 aa, Artificial Sequence
  Description of Artificial Sequence: Synthetic peptide
QEEEIATTNPVATEQYGEACEVCQHEEK

SEQ ID NO: 107071 - protein, 34 aa, Artificial Sequence
  Description of Artificial Sequence: Synthetic polypeptide
DESEIRTTNPVATECYWGSVSCINEPQDREGEVG

SEQ ID NO: 107072 - protein, 29 aa, Artificial Sequence
  Description of Artificial Sequence: Synthetic peptide
QENEIATTNPVATECYGDVSERCLQHEET

SEQ ID NO: 107073 - protein, 32 aa, Artificial Sequence
  Description of Artificial Sequence: Synthetic polypeptide
DEQEIATTNPVATEQYGSVSATDIEDHEGEDL

SEQ ID NO: 107074 - protein, 33 aa, Artificial Sequence
  Description of Artificial Sequence: Synthetic polypeptide
DEQEIATTNPVATEQYGSVSATDHLEDHEGWDL

SEQ ID NO: 107075 - protein, 28 aa, Artificial Sequence
  Description of Artificial Sequence: Synthetic peptide
QEEEIATTNPVATEQYGEAAEVCQHEEM

SEQ ID NO: 107076 - protein, 33 aa, Artificial Sequence
  Description of Artificial Sequence: Synthetic polypeptide
DEQEIATTNPVATEQYGSVSATDHLEDHEGEKL

SEQ ID NO: 107077 - protein, 33 aa, Artificial Sequence
  Description of Artificial Sequence: Synthetic polypeptide
DEQEIATTNPVATEQYGSVSATDHLEDHEGEDV

SEQ ID NO: 107078 - protein, 33 aa, Artificial Sequence
  Description of Artificial Sequence: Synthetic polypeptide
DEQEIATTNPVATEQYGSVSATDHLEDHEGEDL

SEQ ID NO: 107079 - protein, 32 aa, Artificial Sequence
  Description of Artificial Sequence: Synthetic polypeptide
DEQEIATTNPVATEQYGSVSATDHEDHIGEDL

SEQ ID NO: 107080 - protein, 28 aa, Artificial Sequence
  Description of Artificial Sequence: Synthetic peptide
QEEEIATTNPVATEQYGEAAEVCQHEEK

SEQ ID NO: 107081 - protein, 32 aa, Artificial Sequence
  Description of Artificial Sequence: Synthetic polypeptide
DEQEIATTNPVATEQYGSVSATDHEDHEGEDL

SEQ ID NO: 107082 - protein, 29 aa, Artificial Sequence
  Description of Artificial Sequence: Synthetic peptide
QENEIATTNPVATECYGDVSGECLQHEEL

SEQ ID NO: 107083 - protein, 28 aa, Artificial Sequence
  Description of Artificial Sequence: Synthetic peptide
QEEEIATTNPVATEQYGEAAEICQHEEK

SEQ ID NO: 107084 - protein, 29 aa, Artificial Sequence
  Description of Artificial Sequence: Synthetic peptide
QENEIATTNPVATECYGDVSHACLQHEEL

SEQ ID NO: 107085 - protein, 28 aa, Artificial Sequence
  Description of Artificial Sequence: Synthetic peptide
QEEEIATTNPVATEQYGEAAEDWQHEPK

SEQ ID NO: 107086 - protein, 29 aa, Artificial Sequence
  Description of Artificial Sequence: Synthetic peptide
QENEIATTNPVATECYGDVSHCLQHEELQ

SEQ ID NO: 107087 - protein, 34 aa, Artificial Sequence
  Description of Artificial Sequence: Synthetic polypeptide
DEQEIATTNPVATEQYGSVSATDGLVEDFEGNDD

SEQ ID NO: 107088 - protein, 33 aa, Artificial Sequence
  Description of Artificial Sequence: Synthetic polypeptide
DEQEIATTNPVATEQYGSVSATDGLEMHEGEDL

SEQ ID NO: 107089 - protein, 33 aa, Artificial Sequence
  Description of Artificial Sequence: Synthetic polypeptide
DEQEIATTNPVATEQYGSVSATDGLEGHEGEDL

SEQ ID NO: 107090 - protein, 33 aa, Artificial Sequence
  Description of Artificial Sequence: Synthetic polypeptide
DEQEIATTNPVATEQYGSVSATDGLEDHEGWDL

SEQ ID NO: 107091 - protein, 33 aa, Artificial Sequence
  Description of Artificial Sequence: Synthetic polypeptide
DEQEIATTNPVATEQYGSVSATDGLEDHEGETL

SEQ ID NO: 107092 - protein, 29 aa, Artificial Sequence
  Description of Artificial Sequence: Synthetic peptide
QENEIATTNPVATECYGDVSHCLQHEWEL

SEQ ID NO: 107093 - protein, 33 aa, Artificial Sequence
  Description of Artificial Sequence: Synthetic polypeptide
DEQEIATTNPVATEQYGSVSATDGLEDHEGEDL

SEQ ID NO: 107094 - protein, 29 aa, Artificial Sequence
  Description of Artificial Sequence: Synthetic peptide
QENEIATTNPVATECYGDVSHECLQHEEL

SEQ ID NO: 107095 - protein, 32 aa, Artificial Sequence
  Description of Artificial Sequence: Synthetic polypeptide
DEQEIATTNPVATEQYGSVSATDGEDHEGEPL

SEQ ID NO: 107096 - protein, 32 aa, Artificial Sequence
  Description of Artificial Sequence: Synthetic polypeptide
DEQEIATTNPVATEQYGSVSATDGEDHEGEDL

SEQ ID NO: 107097 - protein, 29 aa, Artificial Sequence
  Description of Artificial Sequence: Synthetic peptide
QENEIATTNPVATECYGDVSHEDLQHEEL

SEQ ID NO: 107098 - protein, 32 aa, Artificial Sequence
  Description of Artificial Sequence: Synthetic polypeptide
DEQEIATTNPVATEQYGSVSATDIEDHEGQDL

SEQ ID NO: 107099 - protein, 29 aa, Artificial Sequence
  Description of Artificial Sequence: Synthetic peptide
QENEIATTNPVATECYGDVSFECLQHERL

SEQ ID NO: 107100 - protein, 32 aa, Artificial Sequence
  Description of Artificial Sequence: Synthetic polypeptide
DEQEIATTNPVATEQYGSVSATDIEDHVGQDL

SEQ ID NO: 107101 - protein, 29 aa, Artificial Sequence
  Description of Artificial Sequence: Synthetic peptide
QENEIATTNPVATECYGDVSFECLQHEEL

SEQ ID NO: 107102 - protein, 33 aa, Artificial Sequence
  Description of Artificial Sequence: Synthetic polypeptide
DEQEIATTNPVATEQYGSVSATDLDDHEGEDLL

SEQ ID NO: 107103 - protein, 29 aa, Artificial Sequence
  Description of Artificial Sequence: Synthetic peptide
QENEIATTNPVATECYGDVSESCLQHEEL

SEQ ID NO: 107104 - protein, 33 aa, Artificial Sequence
  Description of Artificial Sequence: Synthetic polypeptide
DEQEIATTNPVATEQYGSVSATDLCEDHEGEDL

SEQ ID NO: 107105 - protein, 28 aa, Artificial Sequence
  Description of Artificial Sequence: Synthetic peptide
QEEEIATTNPVATEQYGEACEVAQHEEK

SEQ ID NO: 107106 - protein, 28 aa, Artificial Sequence
  Description of Artificial Sequence: Synthetic peptide
QEEEIATTNPVATEQYGEAASVCQHEEI

SEQ ID NO: 107107 - protein, 33 aa, Artificial Sequence
  Description of Artificial Sequence: Synthetic polypeptide
DESEIRTTNPVATEEWGSVSWMNENQDREGSEQ

SEQ ID NO: 107108 - protein, 29 aa, Artificial Sequence
  Description of Artificial Sequence: Synthetic peptide
QEEEIATTNPVATEQYGEAAPNVCQHEEK

SEQ ID NO: 107109 - protein, 29 aa, Artificial Sequence
  Description of Artificial Sequence: Synthetic peptide
QENEIATTNPVATECYGDVSEVCLQGEEL

SEQ ID NO: 107110 - protein, 33 aa, Artificial Sequence
  Description of Artificial Sequence: Synthetic polypeptide
DEQEIATTNPVATEQYGSVSATDLAEDHEGMDL

SEQ ID NO: 107111 - protein, 28 aa, Artificial Sequence
  Description of Artificial Sequence: Synthetic peptide
QENEIATTNPVATECYGDVSEVCQHEEL

SEQ ID NO: 107112 - protein, 33 aa, Artificial Sequence
  Description of Artificial Sequence: Synthetic polypeptide
DEQEIATTNPVATEQYGSVSATDLAEDHEGEDL

SEQ ID NO: 107113 - protein, 33 aa, Artificial Sequence
  Description of Artificial Sequence: Synthetic polypeptide
DESEIRTTNPVATEFWGCVSCINEPQDREGENG

SEQ ID NO: 107114 - protein, 28 aa, Artificial Sequence
  Description of Artificial Sequence: Synthetic peptide
QEEEIATTNPVATEQYGEAPAEGQHEEK

SEQ ID NO: 107115 - protein, 29 aa, Artificial Sequence
  Description of Artificial Sequence: Synthetic peptide
QENEIATTNPVATECYGDVSEVLQHEELT

SEQ ID NO: 107116 - protein, 33 aa, Artificial Sequence
  Description of Artificial Sequence: Synthetic polypeptide
DEQEIATTNPVATEQYGSVSATDLADHEGCEDL

SEQ ID NO: 107117 - protein, 28 aa, Artificial Sequence
  Description of Artificial Sequence: Synthetic peptide
QEEEIATTNPVATEQYGEAAMVCQHEEK

SEQ ID NO: 107118 - protein, 33 aa, Artificial Sequence
  Description of Artificial Sequence: Synthetic polypeptide
DEQEIATTNPVATEQYGSVSATDKLEDHEGEDL

SEQ ID NO: 107119 - protein, 32 aa, Artificial Sequence
  Description of Artificial Sequence: Synthetic polypeptide
DEQEIATTNPVATEQYGSVSATDKEYHEGEDL

SEQ ID NO: 107120 - protein, 32 aa, Artificial Sequence
  Description of Artificial Sequence: Synthetic polypeptide
DEQEIATTNPVATEQYGSVSATDKEDHSGEDL

SEQ ID NO: 107121 - protein, 32 aa, Artificial Sequence
  Description of Artificial Sequence: Synthetic polypeptide
DEQEIATTNPVATEQYGSVSATDKEDHIGEDL

SEQ ID NO: 107122 - protein, 32 aa, Artificial Sequence
  Description of Artificial Sequence: Synthetic polypeptide
DEQEIATTNPVATEQYGSVSATDKEDHEGEDL

SEQ ID NO: 107123 - protein, 28 aa, Artificial Sequence
  Description of Artificial Sequence: Synthetic peptide
QEEEIATTNPVATEQYGEAAEVWQHEPK

SEQ ID NO: 107124 - protein, 33 aa, Artificial Sequence
  Description of Artificial Sequence: Synthetic polypeptide
DESEIRTTNPVATEFWGSVSCINEPQDREGEPG

SEQ ID NO: 107125 - protein, 33 aa, Artificial Sequence
  Description of Artificial Sequence: Synthetic polypeptide
DEQEIATTNPVATEQYGSVSATDILETHEGEDL

SEQ ID NO: 107126 - protein, 33 aa, Artificial Sequence
  Description of Artificial Sequence: Synthetic polypeptide
DEQEIATTNPVATEQYGSVSATDILEDHEGEDL

SEQ ID NO: 107127 - protein, 29 aa, Artificial Sequence
  Description of Artificial Sequence: Synthetic peptide
QENEIATTNPVATECYGDVSFCLQHEELQ

SEQ ID NO: 107128 - protein, 34 aa, Artificial Sequence
  Description of Artificial Sequence: Synthetic polypeptide
DESEIRTTNPVATEFWGSVFSCINEPQAREGENG

SEQ ID NO: 107129 - protein, 34 aa, Artificial Sequence
  Description of Artificial Sequence: Synthetic polypeptide
DESEIRTTNPVATECWNGSVSCINEPQDREGENG

SEQ ID NO: 107130 - protein, 28 aa, Artificial Sequence
  Description of Artificial Sequence: Synthetic peptide
QEEEIATTNPVATEQYGEAPEVAQHEEK

SEQ ID NO: 107131 - protein, 33 aa, Artificial Sequence
  Description of Artificial Sequence: Synthetic polypeptide
DESEIRTTNPVATECWMSVSCINEPQDRLGENG

SEQ ID NO: 107132 - protein, 33 aa, Artificial Sequence
  Description of Artificial Sequence: Synthetic polypeptide
DEQEIATTNPVATEQYGSVSATDLWEDHEGEDL

SEQ ID NO: 107133 - protein, 34 aa, Artificial Sequence
  Description of Artificial Sequence: Synthetic polypeptide
DESEIRTTNPVATECWGSVSSCINEPQDRNGENG

SEQ ID NO: 107134 - protein, 28 aa, Artificial Sequence
  Description of Artificial Sequence: Synthetic peptide
QENEIATTNPVATECWGCVSECLQHEEQ

SEQ ID NO: 107135 - protein, 28 aa, Artificial Sequence
  Description of Artificial Sequence: Synthetic peptide
QENEIATTNPVATECWGDVSCCLQHEEL

SEQ ID NO: 107136 - protein, 33 aa, Artificial Sequence
  Description of Artificial Sequence: Synthetic polypeptide
DEQEIATTNPVATEQYGSVSATDLWDDHEGEDL

SEQ ID NO: 107137 - protein, 33 aa, Artificial Sequence
  Description of Artificial Sequence: Synthetic polypeptide
DEQEIATTNPVATEQYGSVSATDLVEDHEGEDL

SEQ ID NO: 107138 - protein, 33 aa, Artificial Sequence
  Description of Artificial Sequence: Synthetic polypeptide
DEQEIATTNPVATEQYGSVSATDLVEDHEGEDF

SEQ ID NO: 107139 - protein, 34 aa, Artificial Sequence
  Description of Artificial Sequence: Synthetic polypeptide
DESEIRTTNPVATECWGSVSSCINEPQPREGENG

SEQ ID NO: 107140 - protein, 28 aa, Artificial Sequence
  Description of Artificial Sequence: Synthetic peptide
QENEIATTNPVATECWGDVSECLQAEEL

SEQ ID NO: 107141 - protein, 28 aa, Artificial Sequence
  Description of Artificial Sequence: Synthetic peptide
QEEEIATTNPVATEQYGEAPEVCQHEES

SEQ ID NO: 107142 - protein, 28 aa, Artificial Sequence
  Description of Artificial Sequence: Synthetic peptide
QENEIATTNPVATECWGDVSECLQHEEL

SEQ ID NO: 107143 - protein, 33 aa, Artificial Sequence
  Description of Artificial Sequence: Synthetic polypeptide
DEQEIATTNPVATEQYGSVSATDLTEHEGGEDL

SEQ ID NO: 107144 - protein, 33 aa, Artificial Sequence
  Description of Artificial Sequence: Synthetic polypeptide
DEQEIATTNPVATEQYGSVSATDLTEEHEGEDL

SEQ ID NO: 107145 - protein, 28 aa, Artificial Sequence
  Description of Artificial Sequence: Synthetic peptide
QENEIATTNPVATECWGDVSECLQHEST

SEQ ID NO: 107146 - protein, 33 aa, Artificial Sequence
  Description of Artificial Sequence: Synthetic polypeptide
DEQEIATTNPVATEQYGSVSATDLTEDHEGEDL

SEQ ID NO: 107147 - protein, 32 aa, Artificial Sequence
  Description of Artificial Sequence: Synthetic polypeptide
DEQEIATTNPVATEQYGSVSATDLTDHEHEDL

SEQ ID NO: 107148 - protein, 28 aa, Artificial Sequence
  Description of Artificial Sequence: Synthetic peptide
QENEIATTNPVATECWGDVSEWLQHEEL

SEQ ID NO: 107149 - protein, 34 aa, Artificial Sequence
  Description of Artificial Sequence: Synthetic polypeptide
DESEIRTTNPVATECWGSVSSCINGPQDRNGENG

SEQ ID NO: 107150 - protein, 33 aa, Artificial Sequence
  Description of Artificial Sequence: Synthetic polypeptide
DEQEIATTNPVATEQYGSVSATDLSEDHEGEDL

SEQ ID NO: 107151 - protein, 35 aa, Artificial Sequence
  Description of Artificial Sequence: Synthetic polypeptide
AEEEIRTTNPVATEQYGSVSTVVNQQQQNTNNQNQ

SEQ ID NO: 107152 - protein, 34 aa, Artificial Sequence
  Description of Artificial Sequence: Synthetic polypeptide
DESEIRTTNPVATECWGSVSSCINGPQDRNGMNG

SEQ ID NO: 107153 - protein, 33 aa, Artificial Sequence
  Description of Artificial Sequence: Synthetic polypeptide
DEQEIATTNPVATEQYGSVSATDLSDHEGREDL

SEQ ID NO: 107154 - protein, 28 aa, Artificial Sequence
  Description of Artificial Sequence: Synthetic peptide
QENEIATTNPVATECYGATSECLQHEEL

SEQ ID NO: 107155 - protein, 33 aa, Artificial Sequence
  Description of Artificial Sequence: Synthetic polypeptide
DEQEIATTNPVATEQYGSVSATDLREDHEGEDL

SEQ ID NO: 107156 - protein, 33 aa, Artificial Sequence
  Description of Artificial Sequence: Synthetic polypeptide
DEQEIATTNPVATEQYGSVSATDLREDHEGDDL

SEQ ID NO: 107157 - protein, 33 aa, Artificial Sequence
  Description of Artificial Sequence: Synthetic polypeptide
DEQEIATTNPVATEQYGSVSATDLWEDHYGEDL

SEQ ID NO: 107158 - protein, 32 aa, Artificial Sequence
  Description of Artificial Sequence: Synthetic polypeptide
DEQEIATTNPVATEQYGSVSATDLRDHEIEDL

SEQ ID NO: 107159 - protein, 33 aa, Artificial Sequence
  Description of Artificial Sequence: Synthetic polypeptide
DEQEIATTNPVATEQYGSVSATDLWWDHEGEDL

SEQ ID NO: 107160 - protein, 28 aa, Artificial Sequence
  Description of Artificial Sequence: Synthetic peptide
QENEIATTNPVATECFGDVSECLQHEEL

SEQ ID NO: 107161 - protein, 33 aa, Artificial Sequence
  Description of Artificial Sequence: Synthetic polypeptide
DEQEIATTNPVATEQYGSVSATDQLEDHEGEDL

SEQ ID NO: 107162 - protein, 32 aa, Artificial Sequence
  Description of Artificial Sequence: Synthetic polypeptide
DEQEIATTNPVATEQYGSVSATDQEDHEGEDL

SEQ ID NO: 107163 - protein, 32 aa, Artificial Sequence
  Description of Artificial Sequence: Synthetic polypeptide
DEQEIATTNPVATEQYGSVSATDPVEHEGEDL

SEQ ID NO: 107164 - protein, 28 aa, Artificial Sequence
  Description of Artificial Sequence: Synthetic peptide
QEEEIATTNPVATEQYGEAPEVCQHEGK

SEQ ID NO: 107165 - protein, 32 aa, Artificial Sequence
  Description of Artificial Sequence: Synthetic polypeptide
DEQEIATTNPVATEQYGSVSATDPVEFEGEDL

SEQ ID NO: 107166 - protein, 33 aa, Artificial Sequence
  Description of Artificial Sequence: Synthetic polypeptide
DEQEIATTNPVATEQYGSVSATDPLEDHEGGDL

SEQ ID NO: 107167 - protein, 33 aa, Artificial Sequence
  Description of Artificial Sequence: Synthetic polypeptide
DEQEIATTNPVATEQYGSVSATDPLEDHEGEDL

SEQ ID NO: 107168 - protein, 32 aa, Artificial Sequence
  Description of Artificial Sequence: Synthetic polypeptide
DEQEIATTNPVATEQYGSVSATDPEDHEGEDL

SEQ ID NO: 107169 - protein, 33 aa, Artificial Sequence
  Description of Artificial Sequence: Synthetic polypeptide
DEQEIATTNPVATEQYGSVSATDNSEDHEGEDL

SEQ ID NO: 107170 - protein, 34 aa, Artificial Sequence
  Description of Artificial Sequence: Synthetic polypeptide
DESEIRTTNPVATECWGSVSRCINEPQDREGENG

SEQ ID NO: 107171 - protein, 34 aa, Artificial Sequence
  Description of Artificial Sequence: Synthetic polypeptide
DESEIRTTNPVATECWGSVSRINEEPQDREGENG

SEQ ID NO: 107172 - protein, 29 aa, Artificial Sequence
  Description of Artificial Sequence: Synthetic peptide
QEEEIATTNPVATEQYGEAPEVCQHEGEK

SEQ ID NO: 107173 - protein, 29 aa, Artificial Sequence
  Description of Artificial Sequence: Synthetic peptide
QEEEIATTNPVATEQYGEAPEVCQHEFKR

SEQ ID NO: 107174 - protein, 28 aa, Artificial Sequence
  Description of Artificial Sequence: Synthetic peptide
QEEEIATTNPVATEQYGEAPEVCQHEFK

SEQ ID NO: 107175 - protein, 28 aa, Artificial Sequence
  Description of Artificial Sequence: Synthetic peptide
QEEEIATTNPVATEQYGEAPEVCQHEEY

SEQ ID NO: 107176 - protein, 28 aa, Artificial Sequence
  Description of Artificial Sequence: Synthetic peptide
QEEEIATTNPVATEQYGEAPEVCQHEEW

SEQ ID NO: 107177 - protein, 29 aa, Artificial Sequence
  Description of Artificial Sequence: Synthetic peptide
QENEIATTNPVATEAYGKVSESLSQHEEL

SEQ ID NO: 107178 - protein, 28 aa, Artificial Sequence
  Description of Artificial Sequence: Synthetic peptide
QEEEIATTNPVATEQYGEAPEVCQHEEV

SEQ ID NO: 107179 - protein, 33 aa, Artificial Sequence
  Description of Artificial Sequence: Synthetic polypeptide
DEQEIATTNPVATEQYGSVSATDMLEDHEGEDL

SEQ ID NO: 107180 - protein, 32 aa, Artificial Sequence
  Description of Artificial Sequence: Synthetic polypeptide
DEQEIATTNPVATEQYGSVSATDMEYHEGEDL

SEQ ID NO: 107181 - protein, 28 aa, Artificial Sequence
  Description of Artificial Sequence: Synthetic peptide
QEEEIATTNPVATEQYGEAPEVCQHEET

SEQ ID NO: 107182 - protein, 32 aa, Artificial Sequence
  Description of Artificial Sequence: Synthetic polypeptide
DEQEIATTNPVATEQYGSVSATDMEDHEGESL

SEQ ID NO: 107183 - protein, 32 aa, Artificial Sequence
  Description of Artificial Sequence: Synthetic polypeptide
DEQEIATTNPVATEQYGSVSATDMEDHEGEDL

SEQ ID NO: 107184 - protein, 33 aa, Artificial Sequence
  Description of Artificial Sequence: Synthetic polypeptide
DEQEIATTNPVATEQYGSVSATDLYEDHEGESL

SEQ ID NO: 107185 - protein, 33 aa, Artificial Sequence
  Description of Artificial Sequence: Synthetic polypeptide
DEQEIATTNPVATEQYGSVSATDLYEDHEGEDL

SEQ ID NO: 107186 - protein, 34 aa, Artificial Sequence
  Description of Artificial Sequence: Synthetic polypeptide
DESEIRTTNPVATECWGSVSSCINEPQDREGENG

SEQ ID NO: 107187 - protein, 33 aa, Artificial Sequence
  Description of Artificial Sequence: Synthetic polypeptide
DEQEIATTNPVATEQYGSVSATDQLEDHEGLDL

SEQ ID NO: 107188 - protein, 29 aa, Artificial Sequence
  Description of Artificial Sequence: Synthetic peptide
QENEIATTNPVATECYGATSECLQHGEYL

SEQ ID NO: 107189 - protein, 31 aa, Artificial Sequence
  Description of Artificial Sequence: Synthetic polypeptide
CEEEIATTNPVAYEQYGSVASGNTDNDNMNN

SEQ ID NO: 107190 - protein, 28 aa, Artificial Sequence
  Description of Artificial Sequence: Synthetic peptide
QENEIATTNPVATECYGDVAECLQHEQL

SEQ ID NO: 107191 - protein, 28 aa, Artificial Sequence
  Description of Artificial Sequence: Synthetic peptide
QEEEIATTNPVATEQYGEAPEVCQHEEE

SEQ ID NO: 107192 - protein, 28 aa, Artificial Sequence
  Description of Artificial Sequence: Synthetic peptide
QENEIATTNPVATECYGDVAETLQHEQL

SEQ ID NO: 107193 - protein, 33 aa, Artificial Sequence
  Description of Artificial Sequence: Synthetic polypeptide
DEQEIATTNPVATEQYGSVSATDLPEDHQMEDT

SEQ ID NO: 107194 - protein, 33 aa, Artificial Sequence
  Description of Artificial Sequence: Synthetic polypeptide
DEQEIATTNPVATEQYGSVSATDLPEDHEGEDL

SEQ ID NO: 107195 - protein, 34 aa, Artificial Sequence
  Description of Artificial Sequence: Synthetic polypeptide
DESEIRTTNPVATECWGSVSVCINEPQDREGENG

SEQ ID NO: 107196 - protein, 28 aa, Artificial Sequence
  Description of Artificial Sequence: Synthetic peptide
QENEIATTNPVATECYGDVASCLQHEEL

SEQ ID NO: 107197 - protein, 33 aa, Artificial Sequence
  Description of Artificial Sequence: Synthetic polypeptide
DEQEIATTNPVATEQYGSVSATDLNEDHEGEDL

SEQ ID NO: 107198 - protein, 34 aa, Artificial Sequence
  Description of Artificial Sequence: Synthetic polypeptide
DESEIRTTNPVATECWGSVSVCINEPQEREGENG

SEQ ID NO: 107199 - protein, 29 aa, Artificial Sequence
  Description of Artificial Sequence: Synthetic peptide
QENEIATTNPVATECYGDVASECLQHEEL

SEQ ID NO: 107200 - protein, 33 aa, Artificial Sequence
  Description of Artificial Sequence: Synthetic polypeptide
DEQEIATTNPVATEQYGSVSATDLNDHEGMEPL

SEQ ID NO: 107201 - protein, 29 aa, Artificial Sequence
  Description of Artificial Sequence: Synthetic peptide
QENEIATTNPVATECYGDVASECLQHEVL

SEQ ID NO: 107202 - protein, 33 aa, Artificial Sequence
  Description of Artificial Sequence: Synthetic polypeptide
DESEIRTTNPVATECWGSVSVINEPQDEEGENG

SEQ ID NO: 107203 - protein, 29 aa, Artificial Sequence
  Description of Artificial Sequence: Synthetic peptide
QENEIATTNPVATECYGDVASECLQPEEL

SEQ ID NO: 107204 - protein, 28 aa, Artificial Sequence
  Description of Artificial Sequence: Synthetic peptide
QENEIATTNPVATECYGDVCECLQHEEL

SEQ ID NO: 107205 - protein, 28 aa, Artificial Sequence
  Description of Artificial Sequence: Synthetic peptide
QENEIATTNPVATECYGDVCECLQQEEL

SEQ ID NO: 107206 - protein, 29 aa, Artificial Sequence
  Description of Artificial Sequence: Synthetic peptide
QENEIATTNPVATECYGDVCSECLQHEEL

SEQ ID NO: 107207 - protein, 33 aa, Artificial Sequence
  Description of Artificial Sequence: Synthetic polypeptide
DEQEIATTNPVATEQYGSVSATDLNDHEGEDLL

SEQ ID NO: 107208 - protein, 28 aa, Artificial Sequence
  Description of Artificial Sequence: Synthetic peptide
QEEEIATTNPVATEQYGEAPEVCQHEED

SEQ ID NO: 107209 - protein, 33 aa, Artificial Sequence
  Description of Artificial Sequence: Synthetic polypeptide
DEQEIATTNPVATEQYGSVSATDLNDHEGAEDL

SEQ ID NO: 107210 - protein, 33 aa, Artificial Sequence
  Description of Artificial Sequence: Synthetic polypeptide
DEQEIATTNPVATEQYGSVSATDLNCDHEGEDL

SEQ ID NO: 107211 - protein, 28 aa, Artificial Sequence
  Description of Artificial Sequence: Synthetic peptide
QEEEIATTNPVATEQYGEAPEVCQHEEC

SEQ ID NO: 107212 - protein, 33 aa, Artificial Sequence
  Description of Artificial Sequence: Synthetic polypeptide
DEQEIATTNPVATEQYGSVSATDLMEDHEGEDL

SEQ ID NO: 107213 - protein, 28 aa, Artificial Sequence
  Description of Artificial Sequence: Synthetic peptide
QEEEIATTNPVATEQYGEAPEVCQHEEA

SEQ ID NO: 107214 - protein, 29 aa, Artificial Sequence
  Description of Artificial Sequence: Synthetic peptide
QENEIATTNPVATECYGDVFSECLQHEEL

SEQ ID NO: 107215 - protein, 28 aa, Artificial Sequence
  Description of Artificial Sequence: Synthetic peptide
QENEIATTNPVATECYGDVAECLQHEEL

SEQ ID NO: 107216 - protein, 29 aa, Artificial Sequence
  Description of Artificial Sequence: Synthetic peptide
QEEEIATTNPVATEQYGEAPEVCQHEERK

SEQ ID NO: 107217 - protein, 28 aa, Artificial Sequence
  Description of Artificial Sequence: Synthetic peptide
QEEEIATTNPVATEQYGEAPEVCQHEEF

SEQ ID NO: 107218 - protein, 28 aa, Artificial Sequence
  Description of Artificial Sequence: Synthetic peptide
QENEIATTNPVATECYGDVAECLQHEDL

SEQ ID NO: 107219 - protein, 34 aa, Artificial Sequence
  Description of Artificial Sequence: Synthetic polypeptide
DEQEIATTNPVATEQYGSVSATDLQEDYQGEDEV

SEQ ID NO: 107220 - protein, 33 aa, Artificial Sequence
  Description of Artificial Sequence: Synthetic polypeptide
DEQEIATTNPVATEQYGSVSATDLQEDYETEDE

SEQ ID NO: 107221 - protein, 34 aa, Artificial Sequence
  Description of Artificial Sequence: Synthetic polypeptide
DESEIRTTNPVATECWGSVSSCPNGPQDRNGMNG

SEQ ID NO: 107222 - protein, 28 aa, Artificial Sequence
  Description of Artificial Sequence: Synthetic peptide
QENEIATTNPVATECYGAVSECWQHEEL

SEQ ID NO: 107223 - protein, 28 aa, Artificial Sequence
  Description of Artificial Sequence: Synthetic peptide
QEEEIATTNPVATEQYGEAPEVCQHEEQ

SEQ ID NO: 107224 - protein, 34 aa, Artificial Sequence
  Description of Artificial Sequence: Synthetic polypeptide
DEQEIATTNPVATEQYGSVSATDLQEDHEGEDLY

SEQ ID NO: 107225 - protein, 28 aa, Artificial Sequence
  Description of Artificial Sequence: Synthetic peptide
QEEEIATTNPVATEQYGEAPEVCQHEEP

SEQ ID NO: 107226 - protein, 29 aa, Artificial Sequence
  Description of Artificial Sequence: Synthetic peptide
QEEEIATTNPVATEQYGEAPEVCQHEENK

SEQ ID NO: 107227 - protein, 33 aa, Artificial Sequence
  Description of Artificial Sequence: Synthetic polypeptide
CEEEIATTNPVAYEQYGSVATNLAGTPGEDQRG

SEQ ID NO: 107228 - protein, 28 aa, Artificial Sequence
  Description of Artificial Sequence: Synthetic peptide
QEEEIATTNPVATEQYGEAPEVCQHEEN

SEQ ID NO: 107229 - protein, 28 aa, Artificial Sequence
  Description of Artificial Sequence: Synthetic peptide
QEEEIATTNPVATEQYGEAPEVCQHEEM

SEQ ID NO: 107230 - protein, 29 aa, Artificial Sequence
  Description of Artificial Sequence: Synthetic peptide
QENEIATTNPVATECYGCVSECLQHEETE

SEQ ID NO: 107231 - protein, 28 aa, Artificial Sequence
  Description of Artificial Sequence: Synthetic peptide
QEEEIATTNPVATEQYGEAPEVCQHEEL

SEQ ID NO: 107232 - protein, 29 aa, Artificial Sequence
  Description of Artificial Sequence: Synthetic peptide
QEEEIATTNPVATEQYGEAPEVCQHEEKR

SEQ ID NO: 107233 - protein, 28 aa, Artificial Sequence
  Description of Artificial Sequence: Synthetic peptide
QEEEIATTNPVATEQYGEAPEVCQHEEI

SEQ ID NO: 107234 - protein, 29 aa, Artificial Sequence
  Description of Artificial Sequence: Synthetic peptide
QENEIATTNPVATECYGCVSETLQHEELH

SEQ ID NO: 107235 - protein, 28 aa, Artificial Sequence
  Description of Artificial Sequence: Synthetic peptide
QEEEIATTNPVATEQYGEAPEVCQHEEH

SEQ ID NO: 107236 - protein, 28 aa, Artificial Sequence
  Description of Artificial Sequence: Synthetic peptide
QENEIATTNPVATECYGDASECLQNEEL

SEQ ID NO: 107237 - protein, 28 aa, Artificial Sequence
  Description of Artificial Sequence: Synthetic peptide
QEEEIATTNPVATEQYGEAPEVCQHEEG

SEQ ID NO: 107238 - protein, 33 aa, Artificial Sequence
  Description of Artificial Sequence: Synthetic polypeptide
CEDEIATTNPVATEQYGSVCAANNLQDSDGNEH

SEQ ID NO: 107239 - protein, 35 aa, Artificial Sequence
  Description of Artificial Sequence: Synthetic polypeptide
DESEIRTTNPVATECWGSVSTTINEPQDREGENPG

SEQ ID NO: 107240 - protein, 28 aa, Artificial Sequence
  Description of Artificial Sequence: Synthetic peptide
QENEIATTNPVATECYGDCSECLQHEEL

SEQ ID NO: 107241 - protein, 28 aa, Artificial Sequence
  Description of Artificial Sequence: Synthetic peptide
QENEIATTNPVATECYGDISECLQHEEI

SEQ ID NO: 107242 - protein, 28 aa, Artificial Sequence
  Description of Artificial Sequence: Synthetic peptide
QENEIATTNPVATECYGDISECLQHEEL

SEQ ID NO: 107243 - protein, 28 aa, Artificial Sequence
  Description of Artificial Sequence: Synthetic peptide
QENEIATTNPVATECYGDISEDLQHEEL

SEQ ID NO: 107244 - protein, 28 aa, Artificial Sequence
  Description of Artificial Sequence: Synthetic peptide
QENEIATTNPVATECYGDVAECLQHEEI

SEQ ID NO: 107245 - protein, 32 aa, Artificial Sequence
  Description of Artificial Sequence: Synthetic polypeptide
DEQEIATTNPVATEQYGSVSATDREDHEGEDL

SEQ ID NO: 107246 - protein, 32 aa, Artificial Sequence
  Description of Artificial Sequence: Synthetic polypeptide
DEQEIATTNPVATEQYGSVSATDREDHEGEFL

SEQ ID NO: 107247 - protein, 29 aa, Artificial Sequence
  Description of Artificial Sequence: Synthetic peptide
QENEIATTNPVATEAYGDVSMECLQHEEL

SEQ ID NO: 107248 - protein, 34 aa, Artificial Sequence
  Description of Artificial Sequence: Synthetic polypeptide
DESEIRTTNPVATECWGSVSNCQNEPQDREGENG

SEQ ID NO: 107249 - protein, 33 aa, Artificial Sequence
  Description of Artificial Sequence: Synthetic polypeptide
DEQEIATTNPVATEQYGSVSATIDLEDHEGEDL

SEQ ID NO: 107250 - protein, 33 aa, Artificial Sequence
  Description of Artificial Sequence: Synthetic polypeptide
DEQEIATTNPVATEQYGSVSATIDLEDHEGEDG

SEQ ID NO: 107251 - protein, 33 aa, Artificial Sequence
  Description of Artificial Sequence: Synthetic polypeptide
DEQEIATTNPVATEQYGSVSATHLLEDHEGEDL

SEQ ID NO: 107252 - protein, 28 aa, Artificial Sequence
  Description of Artificial Sequence: Synthetic peptide
QENEIATTNPTATECYGDVSECLQHEEL

SEQ ID NO: 107253 - protein, 33 aa, Artificial Sequence
  Description of Artificial Sequence: Synthetic polypeptide
DEQEIATTNPVATEQYGSVSATHLHEDHEGEDL

SEQ ID NO: 107254 - protein, 29 aa, Artificial Sequence
  Description of Artificial Sequence: Synthetic peptide
QEEEIATTNPVATEQYGEAPEVCQHGEEK

SEQ ID NO: 107255 - protein, 28 aa, Artificial Sequence
  Description of Artificial Sequence: Synthetic peptide
QEEEIATTNPVATEQYGEAPEVCQHFEK

SEQ ID NO: 107256 - protein, 28 aa, Artificial Sequence
  Description of Artificial Sequence: Synthetic peptide
QEEEIATTNPVATEQYGEAPEVCQHEWK

SEQ ID NO: 107257 - protein, 28 aa, Artificial Sequence
  Description of Artificial Sequence: Synthetic peptide
QEEEIATTNPVATEQYGEAPEVCQHEVK

SEQ ID NO: 107258 - protein, 32 aa, Artificial Sequence
  Description of Artificial Sequence: Synthetic polypeptide
DEQEIATTNPVATEQYGSVSATHLEDHEWEDL

SEQ ID NO: 107259 - protein, 28 aa, Artificial Sequence
  Description of Artificial Sequence: Synthetic peptide
QENEIATTNPVACECYGMVSECLQHEEL

SEQ ID NO: 107260 - protein, 33 aa, Artificial Sequence
  Description of Artificial Sequence: Synthetic polypeptide
DEQEIATTNPVATEQYGSVSATHILEDHEGEDL

SEQ ID NO: 107261 - protein, 33 aa, Artificial Sequence
  Description of Artificial Sequence: Synthetic polypeptide
DEQEIATTNPVATEQYGSVSATHDLEYHEGEDL

SEQ ID NO: 107262 - protein, 33 aa, Artificial Sequence
  Description of Artificial Sequence: Synthetic polypeptide
DESEIRTTNPVATECWGSVSNINEPQDREEENG

SEQ ID NO: 107263 - protein, 33 aa, Artificial Sequence
  Description of Artificial Sequence: Synthetic polypeptide
DEQEIATTNPVATEQYGSVSATHDLEDHEGEDL

SEQ ID NO: 107264 - protein, 28 aa, Artificial Sequence
  Description of Artificial Sequence: Synthetic peptide
QEEEIATTNPVATEQYGEAPEVCQHETK

SEQ ID NO: 107265 - protein, 28 aa, Artificial Sequence
  Description of Artificial Sequence: Synthetic peptide
QENEIATTNPVAFECYGDVSECLQHEEL

SEQ ID NO: 107266 - protein, 28 aa, Artificial Sequence
  Description of Artificial Sequence: Synthetic peptide
QENEIATTNPVAHECYGAVSECLQHEEL

SEQ ID NO: 107267 - protein, 33 aa, Artificial Sequence
  Description of Artificial Sequence: Synthetic polypeptide
DEQEIATTNPVATEQYGSVSATGLVEDFEGEDD

SEQ ID NO: 107268 - protein, 33 aa, Artificial Sequence
  Description of Artificial Sequence: Synthetic polypeptide
DEQEIATTNPVATEQYGSVSATGLIEDHEGEDL

SEQ ID NO: 107269 - protein, 28 aa, Artificial Sequence
  Description of Artificial Sequence: Synthetic peptide
QENEIATTNPVASECYGIVSECLQHEEL

SEQ ID NO: 107270 - protein, 28 aa, Artificial Sequence
  Description of Artificial Sequence: Synthetic peptide
QEEEIATTNPVATEQYGEAPEVCQHESK

SEQ ID NO: 107271 - protein, 32 aa, Artificial Sequence
  Description of Artificial Sequence: Synthetic polypeptide
CEEEIATTNPVAYEQYGSVAITNDGDRGDIHQ

SEQ ID NO: 107272 - protein, 31 aa, Artificial Sequence
  Description of Artificial Sequence: Synthetic polypeptide
CEEEIATTNPVAYEQYGSVAITNDQGPMEQG

SEQ ID NO: 107273 - protein, 33 aa, Artificial Sequence
  Description of Artificial Sequence: Synthetic polypeptide
DESEIRTTNPVATECWGSVSNCINEPQEREGPG

SEQ ID NO: 107274 - protein, 36 aa, Artificial Sequence
  Description of Artificial Sequence: Synthetic polypeptide
AEEEIRTTNPVATEQYGSVSTVVNQQQQQGTTETNE

SEQ ID NO: 107275 - protein, 34 aa, Artificial Sequence
  Description of Artificial Sequence: Synthetic polypeptide
DESEIRTTNPVATECWGSVSNCINEPQDREGVNG

SEQ ID NO: 107276 - protein, 33 aa, Artificial Sequence
  Description of Artificial Sequence: Synthetic polypeptide
DEQEIATTNPVATEQYGSVSATIDLEDIEGEDL

SEQ ID NO: 107277 - protein, 33 aa, Artificial Sequence
  Description of Artificial Sequence: Synthetic polypeptide
DEQEIATTNPVATEQYGSVSATKDLEDHEGEDL

SEQ ID NO: 107278 - protein, 32 aa, Artificial Sequence
  Description of Artificial Sequence: Synthetic polypeptide
DEQEIATTNPVATEQYGSVSATISEDHEGEDL

SEQ ID NO: 107279 - protein, 33 aa, Artificial Sequence
  Description of Artificial Sequence: Synthetic polypeptide
DEQEIATTNPVATEQYGSVSATILWEDHEGEDL

SEQ ID NO: 107280 - protein, 28 aa, Artificial Sequence
  Description of Artificial Sequence: Synthetic peptide
QENEIATTNPCATECYGDVSECLQHEEL

SEQ ID NO: 107281 - protein, 33 aa, Artificial Sequence
  Description of Artificial Sequence: Synthetic polypeptide
DESEIRTTNPVATECWGSVSMEDEQQQRNGENG

SEQ ID NO: 107282 - protein, 28 aa, Artificial Sequence
  Description of Artificial Sequence: Synthetic peptide
QENEIATTNPCATECYGIVSECLQHETL

SEQ ID NO: 107283 - protein, 34 aa, Artificial Sequence
  Description of Artificial Sequence: Synthetic polypeptide
DESEIRTTNPVATECWGSVSMEINEPQDREGENG

SEQ ID NO: 107284 - protein, 29 aa, Artificial Sequence
  Description of Artificial Sequence: Synthetic peptide
QENEIATTNPCSSEQWGIVSCNLQSAGTR

SEQ ID NO: 107285 - protein, 32 aa, Artificial Sequence
  Description of Artificial Sequence: Synthetic polypeptide
DEQEIATTNPVATEQYGSVSATILEDHEEEDL

SEQ ID NO: 107286 - protein, 28 aa, Artificial Sequence
  Description of Artificial Sequence: Synthetic peptide
QEEEIATTNPVATEQYGEAPEVCQHIEK

SEQ ID NO: 107287 - protein, 28 aa, Artificial Sequence
  Description of Artificial Sequence: Synthetic peptide
QENEIATTNPCSTEQYGDVSCCLQHETL

SEQ ID NO: 107288 - protein, 32 aa, Artificial Sequence
  Description of Artificial Sequence: Synthetic polypeptide
DEQEIATTNPVATEQYGSVSATIEEDAEGEDL

SEQ ID NO: 107289 - protein, 32 aa, Artificial Sequence
  Description of Artificial Sequence: Synthetic polypeptide
DEQEIATTNPVATEQYGSVSATIEEDAEGDDL

SEQ ID NO: 107290 - protein, 28 aa, Artificial Sequence
  Description of Artificial Sequence: Synthetic peptide
QEEEIATTNPVATEQYGEAPEVCQHHEK

SEQ ID NO: 107291 - protein, 29 aa, Artificial Sequence
  Description of Artificial Sequence: Synthetic peptide
QENEIATTNPCSTEQYGIVSCNLQNAEDA

SEQ ID NO: 107292 - protein, 28 aa, Artificial Sequence
  Description of Artificial Sequence: Synthetic peptide
QENEIATTNPIATECYGDVSACLQHEEL

SEQ ID NO: 107293 - protein, 28 aa, Artificial Sequence
  Description of Artificial Sequence: Synthetic peptide
QENEIATTNPIATECYGDVSEALQHVEL

SEQ ID NO: 107294 - protein, 28 aa, Artificial Sequence
  Description of Artificial Sequence: Synthetic peptide
QENEIATTNPIATECYGDVSECLQHEDL

SEQ ID NO: 107295 - protein, 28 aa, Artificial Sequence
  Description of Artificial Sequence: Synthetic peptide
QENEIATTNPIATECYGDVSECLQHEEL

SEQ ID NO: 107296 - protein, 33 aa, Artificial Sequence
  Description of Artificial Sequence: Synthetic polypeptide
DESEIRTTNPVATECWGSVSMIDIPQDREGENG

SEQ ID NO: 107297 - protein, 33 aa, Artificial Sequence
  Description of Artificial Sequence: Synthetic polypeptide
DESEIRTTNPVATECWGSVSMIDIQQDREGENG

SEQ ID NO: 107298 - protein, 33 aa, Artificial Sequence
  Description of Artificial Sequence: Synthetic polypeptide
DESEIRTTNPVATECWGSVSMINEPMDREGENG

SEQ ID NO: 107299 - protein, 28 aa, Artificial Sequence
  Description of Artificial Sequence: Synthetic peptide
QENEIATTNPLATECYGDVSECLQNEEL

SEQ ID NO: 107300 - protein, 34 aa, Artificial Sequence
  Description of Artificial Sequence: Synthetic polypeptide
DESEIRTTNPVATECWGSVSMINGPDQDREGENG

SEQ ID NO: 107301 - protein, 33 aa, Artificial Sequence
  Description of Artificial Sequence: Synthetic polypeptide
DEQEIATTNPVATEQYGSVSATIDLEDNEGEDL

SEQ ID NO: 107302 - protein, 34 aa, Artificial Sequence
  Description of Artificial Sequence: Synthetic polypeptide
DESEIRTTNPVATECWGSVSNCINEPQDREGENG

SEQ ID NO: 107303 - protein, 31 aa, Artificial Sequence
  Description of Artificial Sequence: Synthetic polypeptide
CEDEIATTNPVATESYGSVANNNLQDAGGHN

SEQ ID NO: 107304 - protein, 28 aa, Artificial Sequence
  Description of Artificial Sequence: Synthetic peptide
QEEEIATTNPVATEQYGEAPEVCQHEQW

SEQ ID NO: 107305 - protein, 28 aa, Artificial Sequence
  Description of Artificial Sequence: Synthetic peptide
QEEEIATTNPVATEQYGEAPEVCQHEQK

SEQ ID NO: 107306 - protein, 32 aa, Artificial Sequence
  Description of Artificial Sequence: Synthetic polypeptide
DEQEIATTNPVATEQYGSVSATDWAEHEGEDL

SEQ ID NO: 107307 - protein, 32 aa, Artificial Sequence
  Description of Artificial Sequence: Synthetic polypeptide
DEQEIATTNPVATEQYGSVSATDWAEHEGEDI

SEQ ID NO: 107308 - protein, 32 aa, Artificial Sequence
  Description of Artificial Sequence: Synthetic polypeptide
DEQEIATTNPVATEQYGSVSATDWADHEGEYL

SEQ ID NO: 107309 - protein, 33 aa, Artificial Sequence
  Description of Artificial Sequence: Synthetic polypeptide
DEQEIATTNPVATEQYGSVSATDVLEDHEGEDP

SEQ ID NO: 107310 - protein, 34 aa, Artificial Sequence
  Description of Artificial Sequence: Synthetic polypeptide
DESEIRTTNPVATECWGSVSQCINEPQDREGENG

SEQ ID NO: 107311 - protein, 30 aa, Artificial Sequence
  Description of Artificial Sequence: Synthetic polypeptide
QENEIATTNPVATEAYGCVSGENPLQHWEL

SEQ ID NO: 107312 - protein, 29 aa, Artificial Sequence
  Description of Artificial Sequence: Synthetic peptide
QENEIATTNPVATEAYGCVSWELQHESEQ

SEQ ID NO: 107313 - protein, 33 aa, Artificial Sequence
  Description of Artificial Sequence: Synthetic polypeptide
DEQEIATTNPVATEQYGSVSATDVLEDHEGEDL

SEQ ID NO: 107314 - protein, 32 aa, Artificial Sequence
  Description of Artificial Sequence: Synthetic polypeptide
DEQEIATTNPVATEQYGSVSATDVEDHMGEDL

SEQ ID NO: 107315 - protein, 32 aa, Artificial Sequence
  Description of Artificial Sequence: Synthetic polypeptide
DEQEIATTNPVATEQYGSVSATDVEDHEGEDL

SEQ ID NO: 107316 - protein, 32 aa, Artificial Sequence
  Description of Artificial Sequence: Synthetic polypeptide
DEQEIATTNPVATEQYGSVSATDVEDFEGEDL

SEQ ID NO: 107317 - protein, 33 aa, Artificial Sequence
  Description of Artificial Sequence: Synthetic polypeptide
DEQEIATTNPVATEQYGSVSATDTLEVHEGVDL

SEQ ID NO: 107318 - protein, 33 aa, Artificial Sequence
  Description of Artificial Sequence: Synthetic polypeptide
DEQEIATTNPVATEQYGSVSATDTLEPHEGEDV

SEQ ID NO: 107319 - protein, 33 aa, Artificial Sequence
  Description of Artificial Sequence: Synthetic polypeptide
DEQEIATTNPVATEQYGSVSATDTLEDNEGEDL

SEQ ID NO: 107320 - protein, 34 aa, Artificial Sequence
  Description of Artificial Sequence: Synthetic polypeptide
DESEIRTTNPVATECWGSVSQCINEPQDRYGENG

SEQ ID NO: 107321 - protein, 29 aa, Artificial Sequence
  Description of Artificial Sequence: Synthetic peptide
QENEIATTNPVATEAYGDVSECLSQHEES

SEQ ID NO: 107322 - protein, 28 aa, Artificial Sequence
  Description of Artificial Sequence: Synthetic peptide
QENEIATTNPVATEAYGDVSGVDQHEEL

SEQ ID NO: 107323 - protein, 28 aa, Artificial Sequence
  Description of Artificial Sequence: Synthetic peptide
QEEEIATTNPVATEQYGEAPEVCQHEIK

SEQ ID NO: 107324 - protein, 28 aa, Artificial Sequence
  Description of Artificial Sequence: Synthetic peptide
QEEEIATTNPVATEQYGEAPEVCQHEHK

SEQ ID NO: 107325 - protein, 33 aa, Artificial Sequence
  Description of Artificial Sequence: Synthetic polypeptide
DEQEIATTNPVATEQYGSVSATDTLEDHEGEDL

SEQ ID NO: 107326 - protein, 32 aa, Artificial Sequence
  Description of Artificial Sequence: Synthetic polypeptide
DEQEIATTNPVATEQYGSVSATDTEDHEGEDL

SEQ ID NO: 107327 - protein, 33 aa, Artificial Sequence
  Description of Artificial Sequence: Synthetic polypeptide
DEQEIATTNPVATEQYGSVSATDSLEDHEGEDL

SEQ ID NO: 107328 - protein, 32 aa, Artificial Sequence
  Description of Artificial Sequence: Synthetic polypeptide
DEQEIATTNPVATEQYGSVSATDSEDHEGEDL

SEQ ID NO: 107329 - protein, 33 aa, Artificial Sequence
  Description of Artificial Sequence: Synthetic polypeptide
DEQEIATTNPVATEQYGSVSATDRLEDHEGEDL

SEQ ID NO: 107330 - protein, 32 aa, Artificial Sequence
  Description of Artificial Sequence: Synthetic polypeptide
DEQEIATTNPVATEQYGSVSATDRIDHEGEDL

SEQ ID NO: 107331 - protein, 32 aa, Artificial Sequence
  Description of Artificial Sequence: Synthetic polypeptide
DEQEIATTNPVATEQYGSVSATDWEDHEGEDL

SEQ ID NO: 107332 - protein, 32 aa, Artificial Sequence
  Description of Artificial Sequence: Synthetic polypeptide
DEQEIATTNPVATEQYGSVSATDWEDHEGEYL

SEQ ID NO: 107333 - protein, 33 aa, Artificial Sequence
  Description of Artificial Sequence: Synthetic polypeptide
DEQEIATTNPVATEQYGSVSATDWLEDHEGEDL

SEQ ID NO: 107334 - protein, 33 aa, Artificial Sequence
  Description of Artificial Sequence: Synthetic polypeptide
DEQEIATTNPVATEQYGSVSATDWLEDHEGFDL

SEQ ID NO: 107335 - protein, 28 aa, Artificial Sequence
  Description of Artificial Sequence: Synthetic peptide
QEEEIATTNPVATEQYGEAPEVCQHEPK

SEQ ID NO: 107336 - protein, 29 aa, Artificial Sequence
  Description of Artificial Sequence: Synthetic peptide
QEEEIATTNPVATEQYGEAPEVCQHENEK

SEQ ID NO: 107337 - protein, 33 aa, Artificial Sequence
  Description of Artificial Sequence: Synthetic polypeptide
DEQEIATTNPVATEQYGSVSATGDLEIHEGEDL

SEQ ID NO: 107338 - protein, 33 aa, Artificial Sequence
  Description of Artificial Sequence: Synthetic polypeptide
DEQEIATTNPVATEQYGSVSATGDLEDHEGEDL

SEQ ID NO: 107339 - protein, 34 aa, Artificial Sequence
  Description of Artificial Sequence: Synthetic polypeptide
DEQEIATTNPVATEQYGSVSATGDDNEDQEGEDG

SEQ ID NO: 107340 - protein, 33 aa, Artificial Sequence
  Description of Artificial Sequence: Synthetic polypeptide
DEQEIATTNPVATEQYGSVSATFQLEDHEGEDL

SEQ ID NO: 107341 - protein, 28 aa, Artificial Sequence
  Description of Artificial Sequence: Synthetic peptide
QENEIATTNPVATACYGDVSECLQHEEL

SEQ ID NO: 107342 - protein, 28 aa, Artificial Sequence
  Description of Artificial Sequence: Synthetic peptide
QENEIATTNPVATCCYGDVSECLQHEEL

SEQ ID NO: 107343 - protein, 28 aa, Artificial Sequence
  Description of Artificial Sequence: Synthetic peptide
QENEIATTNPVATCCYGDVSLCLQHEEL

SEQ ID NO: 107344 - protein, 28 aa, Artificial Sequence
  Description of Artificial Sequence: Synthetic peptide
QENEIATTNPVATDCYGDVSECLQHEEL

SEQ ID NO: 107345 - protein, 34 aa, Artificial Sequence
  Description of Artificial Sequence: Synthetic polypeptide
DESEIRTTNPVATECWGSVSPCINEPQDREGENG

SEQ ID NO: 107346 - protein, 33 aa, Artificial Sequence
  Description of Artificial Sequence: Synthetic polypeptide
DEQEIATTNPVATEQYGSVSATFDQEDHEGEDL

SEQ ID NO: 107347 - protein, 34 aa, Artificial Sequence
  Description of Artificial Sequence: Synthetic polypeptide
DESEIRTTNPVATECWGSVSWCINEPQDREGENG

SEQ ID NO: 107348 - protein, 33 aa, Artificial Sequence
  Description of Artificial Sequence: Synthetic polypeptide
DEQEIATTNPVATEQYGSVSATFDLEDHEGEDL

SEQ ID NO: 107349 - protein, 34 aa, Artificial Sequence
  Description of Artificial Sequence: Synthetic polypeptide
DESEIRTTNPVATECWGSVSPCINEPQHREGENG

SEQ ID NO: 107350 - protein, 33 aa, Artificial Sequence
  Description of Artificial Sequence: Synthetic polypeptide
DEQEIATTNPVATEQYGSVSATEDLEDHEGEDL

SEQ ID NO: 107351 - protein, 33 aa, Artificial Sequence
  Description of Artificial Sequence: Synthetic polypeptide
DESEIRTTNPVATECWGSVSPIHEPQDREGENG

SEQ ID NO: 107352 - protein, 33 aa, Artificial Sequence
  Description of Artificial Sequence: Synthetic polypeptide
DEQEIATTNPVATEQYGSVSATEDLADHEGEDL

SEQ ID NO: 107353 - protein, 33 aa, Artificial Sequence
  Description of Artificial Sequence: Synthetic polypeptide
DEQEIATTNPVATEQYGSVSATDYLTDHEGEDL

SEQ ID NO: 107354 - protein, 33 aa, Artificial Sequence
  Description of Artificial Sequence: Synthetic polypeptide
DEQEIATTNPVATEQYGSVSATDYLEVHEGEDL

SEQ ID NO: 107355 - protein, 33 aa, Artificial Sequence
  Description of Artificial Sequence: Synthetic polypeptide
DEQEIATTNPVATEQYGSVSATDYLEDHEGEDL

SEQ ID NO: 107356 - protein, 28 aa, Artificial Sequence
  Description of Artificial Sequence: Synthetic peptide
QEEEIATTNPVATEQYGEAPEVCQHELK

SEQ ID NO: 107357 - protein, 32 aa, Artificial Sequence
  Description of Artificial Sequence: Synthetic polypeptide
DEQEIATTNPVATEQYGSVSATDYEDIEGEDL

SEQ ID NO: 107358 - protein, 32 aa, Artificial Sequence
  Description of Artificial Sequence: Synthetic polypeptide
DEQEIATTNPVATEQYGSVSATDYEDHEGEDN

SEQ ID NO: 107359 - protein, 32 aa, Artificial Sequence
  Description of Artificial Sequence: Synthetic polypeptide
DEQEIATTNPVATEQYGSVSATDYEDHEGEDL

SEQ ID NO: 107360 - protein, 28 aa, Artificial Sequence
  Description of Artificial Sequence: Synthetic peptide
QEEEIATTNPVATEQYGEAPEVCQHEKK

SEQ ID NO: 107361 - protein, 28 aa, Artificial Sequence
  Description of Artificial Sequence: Synthetic peptide
QEEEIATTNPVATEQYGEAPEVCQHEMK

SEQ ID NO: 107362 - protein, 29 aa, Artificial Sequence
  Description of Artificial Sequence: Synthetic peptide
QENEIATTNPVATECYGDVFSECLQHFEL

SEQ ID NO: 107363 - protein, 29 aa, Artificial Sequence
  Description of Artificial Sequence: Synthetic peptide
QENEIATTNPVATECYGDVFSEWLQHEEL

SEQ ID NO: 107364 - protein, 29 aa, Artificial Sequence
  Description of Artificial Sequence: Synthetic peptide
QENEIATTNPVATECYGDVHSECLQHEEL

SEQ ID NO: 107365 - protein, 32 aa, Artificial Sequence
  Description of Artificial Sequence: Synthetic polypeptide
DEQEIATTNPVATEQYGSVSATDLEDWEFEDL

SEQ ID NO: 107366 - protein, 29 aa, Artificial Sequence
  Description of Artificial Sequence: Synthetic peptide
QENEIATTNPVATECYGDVSECLQHCEEL

SEQ ID NO: 107367 - protein, 33 aa, Artificial Sequence
  Description of Artificial Sequence: Synthetic polypeptide
DESEIRTTNPVATECWGSYSCINEPQYREGENG

SEQ ID NO: 107368 - protein, 34 aa, Artificial Sequence
  Description of Artificial Sequence: Synthetic polypeptide
DESEIRTTNPVATECWGSYVSCINEPQDREGENG

SEQ ID NO: 107369 - protein, 29 aa, Artificial Sequence
  Description of Artificial Sequence: Synthetic peptide
QENEIATTNPVATECYGDVSECLQHDEEL

SEQ ID NO: 107370 - protein, 28 aa, Artificial Sequence
  Description of Artificial Sequence: Synthetic peptide
QEEEIATTNPVATEQYGEAPEVCQDLEK

SEQ ID NO: 107371 - protein, 29 aa, Artificial Sequence
  Description of Artificial Sequence: Synthetic peptide
QEEEIATTNPVATEQYGEAPEVCQDHENK

SEQ ID NO: 107372 - protein, 29 aa, Artificial Sequence
  Description of Artificial Sequence: Synthetic peptide
QENEIATTNPVATECYGDVSECLQHECEL

SEQ ID NO: 107373 - protein, 34 aa, Artificial Sequence
  Description of Artificial Sequence: Synthetic polypeptide
DESEIRTTNPVATECWGSYVSCINEPQDREGENM

SEQ ID NO: 107374 - protein, 29 aa, Artificial Sequence
  Description of Artificial Sequence: Synthetic peptide
QENEIATTNPVATECYGDVSECLQHEDEL

SEQ ID NO: 107375 - protein, 32 aa, Artificial Sequence
  Description of Artificial Sequence: Synthetic polypeptide
DEQEIATTNPVATEQYGSVSATDLEDTEQEDL

SEQ ID NO: 107376 - protein, 28 aa, Artificial Sequence
  Description of Artificial Sequence: Synthetic peptide
QEEEIATTNPVATEQYGEAPEVCQDEVK

SEQ ID NO: 107377 - protein, 28 aa, Artificial Sequence
  Description of Artificial Sequence: Synthetic peptide
QEEEIATTNPVATEQYGEAPEVCQDEEK

SEQ ID NO: 107378 - protein, 28 aa, Artificial Sequence
  Description of Artificial Sequence: Synthetic peptide
QEEEIATTNPVATEQYGEAPEVCQCEEK

SEQ ID NO: 107379 - protein, 33 aa, Artificial Sequence
  Description of Artificial Sequence: Synthetic polypeptide
DEQEIATTNPVATEQYGSVSATDLEDSQGDEDL

SEQ ID NO: 107380 - protein, 34 aa, Artificial Sequence
  Description of Artificial Sequence: Synthetic polypeptide
DESEIRTTNPVATECWGSYVSCINEPQDRQGENG

SEQ ID NO: 107381 - protein, 33 aa, Artificial Sequence
  Description of Artificial Sequence: Synthetic polypeptide
CEEEIATTNPVAYEQYGSVATNLQQGTPDGSEN

SEQ ID NO: 107382 - protein, 29 aa, Artificial Sequence
  Description of Artificial Sequence: Synthetic peptide
QENEIATTNPVATECYGDVSECLQHEEAL

SEQ ID NO: 107383 - protein, 34 aa, Artificial Sequence
  Description of Artificial Sequence: Synthetic polypeptide
DESEIRTTNPVATECWGTSVSCINEPQDREGENG

SEQ ID NO: 107384 - protein, 29 aa, Artificial Sequence
  Description of Artificial Sequence: Synthetic peptide
QENEIATTNPVATECYGDVSECLQHEECL

SEQ ID NO: 107385 - protein, 34 aa, Artificial Sequence
  Description of Artificial Sequence: Synthetic polypeptide
DESEIRTTNPVATECWGTSVSWINEPQDRMGENG

SEQ ID NO: 107386 - protein, 33 aa, Artificial Sequence
  Description of Artificial Sequence: Synthetic polypeptide
DESEIRTTNPVATECWGTVSCENEPQDREGENH

SEQ ID NO: 107387 - protein, 33 aa, Artificial Sequence
  Description of Artificial Sequence: Synthetic polypeptide
DESEIRTTNPVATECWGTVSCENEPQDRNGENH

SEQ ID NO: 107388 - protein, 33 aa, Artificial Sequence
  Description of Artificial Sequence: Synthetic polypeptide
DESEIRTTNPVATECWGTVSCENEPQQRNGENH

SEQ ID NO: 107389 - protein, 32 aa, Artificial Sequence
  Description of Artificial Sequence: Synthetic polypeptide
DESEIRTTNPVATECWGTVSCINEPEREGENG

SEQ ID NO: 107390 - protein, 33 aa, Artificial Sequence
  Description of Artificial Sequence: Synthetic polypeptide
DEQEIATTNPVATEQYGSVSATDLEDWEGAEDL

SEQ ID NO: 107391 - protein, 29 aa, Artificial Sequence
  Description of Artificial Sequence: Synthetic peptide
QENEIATTNPVATECYGDVSECLQHEEGL

SEQ ID NO: 107392 - protein, 33 aa, Artificial Sequence
  Description of Artificial Sequence: Synthetic polypeptide
DESEIRTTNPVATECWGSYSCINEPQDREGENG

SEQ ID NO: 107393 - protein, 28 aa, Artificial Sequence
  Description of Artificial Sequence: Synthetic peptide
QEEEIATTNPVATEQYGEAPEVCQEEEK

SEQ ID NO: 107394 - protein, 28 aa, Artificial Sequence
  Description of Artificial Sequence: Synthetic peptide
QENEIATTNPVATECYGDVSECLNHEEN

SEQ ID NO: 107395 - protein, 29 aa, Artificial Sequence
  Description of Artificial Sequence: Synthetic peptide
QENEIATTNPVATECYGDVSECLNQHEEL

SEQ ID NO: 107396 - protein, 28 aa, Artificial Sequence
  Description of Artificial Sequence: Synthetic peptide
QENEIATTNPVATECYGDVSECLPHEEL

SEQ ID NO: 107397 - protein, 28 aa, Artificial Sequence
  Description of Artificial Sequence: Synthetic peptide
QEEEIATTNPVATEQYGEAPEVCQGEEK

SEQ ID NO: 107398 - protein, 29 aa, Artificial Sequence
  Description of Artificial Sequence: Synthetic peptide
QEEEIATTNPVATEQYGEAPEVCQFYNEK

SEQ ID NO: 107399 - protein, 28 aa, Artificial Sequence
  Description of Artificial Sequence: Synthetic peptide
QEEEIATTNPVATEQYGEAPEVCQFLEK

SEQ ID NO: 107400 - protein, 28 aa, Artificial Sequence
  Description of Artificial Sequence: Synthetic peptide
QEEEIATTNPVATEQYGEAPEVCQFEEK

SEQ ID NO: 107401 - protein, 33 aa, Artificial Sequence
  Description of Artificial Sequence: Synthetic polypeptide
DEQEIATTNPVATEQYGSVSATDLEFEEGEDLE

SEQ ID NO: 107402 - protein, 29 aa, Artificial Sequence
  Description of Artificial Sequence: Synthetic peptide
QENEIATTNPVATECYGDVSECLQCHEEL

SEQ ID NO: 107403 - protein, 32 aa, Artificial Sequence
  Description of Artificial Sequence: Synthetic polypeptide
DEQEIATTNPVATEQYGSVSATDLEEHELEIL

SEQ ID NO: 107404 - protein, 33 aa, Artificial Sequence
  Description of Artificial Sequence: Synthetic polypeptide
DESEIRTTNPVATECWGSWSCANEPQDREGENG

SEQ ID NO: 107405 - protein, 29 aa, Artificial Sequence
  Description of Artificial Sequence: Synthetic peptide
QENEIATTNPVATECYGDVSECLQDHEEL

SEQ ID NO: 107406 - protein, 28 aa, Artificial Sequence
  Description of Artificial Sequence: Synthetic peptide
QEEEIATTNPVATEQYGEAPEVCQFDEK

SEQ ID NO: 107407 - protein, 33 aa, Artificial Sequence
  Description of Artificial Sequence: Synthetic polypeptide
DESEIRTTNPVATECWGSWSCINEPQDREGENG

SEQ ID NO: 107408 - protein, 33 aa, Artificial Sequence
  Description of Artificial Sequence: Synthetic polypeptide
DESEIRTTNPVATECWGSWSCKNEPQDREGENG

SEQ ID NO: 107409 - protein, 34 aa, Artificial Sequence
  Description of Artificial Sequence: Synthetic polypeptide
DESEIRTTNPVATECWGSWVSCINEPQDREGENG

SEQ ID NO: 107410 - protein, 34 aa, Artificial Sequence
  Description of Artificial Sequence: Synthetic polypeptide
DESEIRTTNPVATECWGSWVSCINEPQDREGENQ

SEQ ID NO: 107411 - protein, 28 aa, Artificial Sequence
  Description of Artificial Sequence: Synthetic peptide
QEEEIATTNPVATEQYGEAPEVCQEMEK

SEQ ID NO: 107412 - protein, 34 aa, Artificial Sequence
  Description of Artificial Sequence: Synthetic polypeptide
DESEIRTTNPVATECWGSWVSCINEPQDRKGENG

SEQ ID NO: 107413 - protein, 29 aa, Artificial Sequence
  Description of Artificial Sequence: Synthetic peptide
QENEIATTNPVATECYGDVSECLQGHEEL

SEQ ID NO: 107414 - protein, 33 aa, Artificial Sequence
  Description of Artificial Sequence: Synthetic polypeptide
DEQEIATTNPVATEQYGSVSATDLEEDHEGEDL

SEQ ID NO: 107415 - protein, 29 aa, Artificial Sequence
  Description of Artificial Sequence: Synthetic peptide
QENEIATTNPVATECYGDVSECLQHAEDA

SEQ ID NO: 107416 - protein, 29 aa, Artificial Sequence
  Description of Artificial Sequence: Synthetic peptide
QENEIATTNPVATECYGDVSECLQHAEDL

SEQ ID NO: 107417 - protein, 29 aa, Artificial Sequence
  Description of Artificial Sequence: Synthetic peptide
QENEIATTNPVATECYGDVSECLQHAEEA

SEQ ID NO: 107418 - protein, 29 aa, Artificial Sequence
  Description of Artificial Sequence: Synthetic peptide
QENEIATTNPVATECYGDVSECLQHAEEL

SEQ ID NO: 107419 - protein, 28 aa, Artificial Sequence
  Description of Artificial Sequence: Synthetic peptide
QEEEIATTNPVATEQYGEAPEVCQEEEE

SEQ ID NO: 107420 - protein, 33 aa, Artificial Sequence
  Description of Artificial Sequence: Synthetic polypeptide
DESEIRTTNPVATECWGTVSCINEPQDREGENG

SEQ ID NO: 107421 - protein, 29 aa, Artificial Sequence
  Description of Artificial Sequence: Synthetic peptide
QENEIATTNPVATECYGDVSECLQHEEHL

SEQ ID NO: 107422 - protein, 33 aa, Artificial Sequence
  Description of Artificial Sequence: Synthetic polypeptide
DESEIRTTNPVATECWGTVSCINEPQDREGENH

SEQ ID NO: 107423 - protein, 33 aa, Artificial Sequence
  Description of Artificial Sequence: Synthetic polypeptide
DESEIRTTNPVATECWGVVSCQNEPQDRYGENG

SEQ ID NO: 107424 - protein, 34 aa, Artificial Sequence
  Description of Artificial Sequence: Synthetic polypeptide
DESEIRTTNPVATECWGWSVSCANEPQDREGENG

SEQ ID NO: 107425 - protein, 33 aa, Artificial Sequence
  Description of Artificial Sequence: Synthetic polypeptide
DEQEIATTNPVATEQYGSVSATDLEDIVGEDLN

SEQ ID NO: 107426 - protein, 34 aa, Artificial Sequence
  Description of Artificial Sequence: Synthetic polypeptide
DESEIRTTNPVATECWGWSVSCINEPQDREGENG

SEQ ID NO: 107427 - protein, 33 aa, Artificial Sequence
  Description of Artificial Sequence: Synthetic polypeptide
DEQEIATTNPVATEQYGSVSATDLEDIEGAEDL

SEQ ID NO: 107428 - protein, 34 aa, Artificial Sequence
  Description of Artificial Sequence: Synthetic polypeptide
DESEIRTTNPVATECWGWSVSCINHPQDREGENG

SEQ ID NO: 107429 - protein, 33 aa, Artificial Sequence
  Description of Artificial Sequence: Synthetic polypeptide
DESEIRTTNPVATECWGWVSCINEPQDREGENG

SEQ ID NO: 107430 - protein, 34 aa, Artificial Sequence
  Description of Artificial Sequence: Synthetic polypeptide
DESEIRTTNPVATECWGYSVSCINEPQDREGENG

SEQ ID NO: 107431 - protein, 29 aa, Artificial Sequence
  Description of Artificial Sequence: Synthetic peptide
QENEIATTNPVATECYGDVSECLQHEEYA

SEQ ID NO: 107432 - protein, 34 aa, Artificial Sequence
  Description of Artificial Sequence: Synthetic polypeptide
DESEIRTTNPVATECWGYSVSCINEPQDREGENI

SEQ ID NO: 107433 - protein, 28 aa, Artificial Sequence
  Description of Artificial Sequence: Synthetic peptide
QEEEIATTNPVATEQYGEAPEVCAHEER

SEQ ID NO: 107434 - protein, 34 aa, Artificial Sequence
  Description of Artificial Sequence: Synthetic polypeptide
DESEIRTTNPVATECWGYSVSCINHPQDREGENG

SEQ ID NO: 107435 - protein, 33 aa, Artificial Sequence
  Description of Artificial Sequence: Synthetic polypeptide
DESEIRTTNPVATECWGYVSCENEPQDREGENG

SEQ ID NO: 107436 - protein, 30 aa, Artificial Sequence
  Description of Artificial Sequence: Synthetic polypeptide
QENEIATTNPVATECYGDVSECLQHEGPLV

SEQ ID NO: 107437 - protein, 29 aa, Artificial Sequence
  Description of Artificial Sequence: Synthetic peptide
QENEIATTNPVATECYGDVSECLQHEHEL

SEQ ID NO: 107438 - protein, 33 aa, Artificial Sequence
  Description of Artificial Sequence: Synthetic polypeptide
DESEIRTTNPVATECWGYVSCINEPQDREGENG

SEQ ID NO: 107439 - protein, 28 aa, Artificial Sequence
  Description of Artificial Sequence: Synthetic peptide
QEEEIATTNPVATEQYGEAPEVAQSEEE

SEQ ID NO: 107440 - protein, 29 aa, Artificial Sequence
  Description of Artificial Sequence: Synthetic peptide
QENEIATTNPVATECYGDVSECLQHEIGL

SEQ ID NO: 107441 - protein, 28 aa, Artificial Sequence
  Description of Artificial Sequence: Synthetic peptide
QEEEIATTNPVATEQYGEAPEVAQHEWK

SEQ ID NO: 107442 - protein, 29 aa, Artificial Sequence
  Description of Artificial Sequence: Synthetic peptide
QENEIATTNPVATECYGDVSECLQHEKEL

SEQ ID NO: 107443 - protein, 33 aa, Artificial Sequence
  Description of Artificial Sequence: Synthetic polypeptide
DEQEIATTNPVATEQYGSVSATDLEDHQMMEDL

SEQ ID NO: 107444 - protein, 34 aa, Artificial Sequence
  Description of Artificial Sequence: Synthetic polypeptide
DESEIRTTNPVATECWHGSVSNINEPQDREGENG

SEQ ID NO: 107445 - protein, 33 aa, Artificial Sequence
  Description of Artificial Sequence: Synthetic polypeptide
DESEIRTTNPVATECWLSVSCINEPQDREGENG

SEQ ID NO: 107446 - protein, 33 aa, Artificial Sequence
  Description of Artificial Sequence: Synthetic polypeptide
DESEIRTTNPVATECWMSVSCINEPQDREGENG

SEQ ID NO: 107447 - protein, 32 aa, Artificial Sequence
  Description of Artificial Sequence: Synthetic polypeptide
DEQEIATTNPVATEQYGSVSATDLEDHPVEDL

SEQ ID NO: 107448 - protein, 32 aa, Artificial Sequence
  Description of Artificial Sequence: Synthetic polypeptide
DESEIRTTNPVATECWGVVSCNEPQDSEGENG

SEQ ID NO: 107449 - protein, 29 aa, Artificial Sequence
  Description of Artificial Sequence: Synthetic peptide
QENEIATTNPVATECYGDVSECLQHEETL

SEQ ID NO: 107450 - protein, 29 aa, Artificial Sequence
  Description of Artificial Sequence: Synthetic peptide
QENEIATTNPVATECYGDVSECLQHEETK

SEQ ID NO: 107451 - protein, 29 aa, Artificial Sequence
  Description of Artificial Sequence: Synthetic peptide
QEEEIATTNPVATEQYGEAPEVCLQHEEK

SEQ ID NO: 107452 - protein, 28 aa, Artificial Sequence
  Description of Artificial Sequence: Synthetic peptide
QEEEIATTNPVATEQYGEAPEVCQAHEK

SEQ ID NO: 107453 - protein, 33 aa, Artificial Sequence
  Description of Artificial Sequence: Synthetic polypeptide
DESEIRTTNPVATECWGTVSCINGPQDREGENG

SEQ ID NO: 107454 - protein, 29 aa, Artificial Sequence
  Description of Artificial Sequence: Synthetic peptide
QENEIATTNPVATECYGDVSECLQHEEKL

SEQ ID NO: 107455 - protein, 29 aa, Artificial Sequence
  Description of Artificial Sequence: Synthetic peptide
QENEIATTNPVATECYGDVSECLQHEELC

SEQ ID NO: 107456 - protein, 29 aa, Artificial Sequence
  Description of Artificial Sequence: Synthetic peptide
QENEIATTNPVATECYGDVSECLQHEELG

SEQ ID NO: 107457 - protein, 33 aa, Artificial Sequence
  Description of Artificial Sequence: Synthetic polypeptide
DESEIRTTNPVATECWGTVSTINEPEDREGENG

SEQ ID NO: 107458 - protein, 28 aa, Artificial Sequence
  Description of Artificial Sequence: Synthetic peptide
QEEEIATTNPVATEQYGEAPEVCQAEQK

SEQ ID NO: 107459 - protein, 28 aa, Artificial Sequence
  Description of Artificial Sequence: Synthetic peptide
QEEEIATTNPVATEQYGEAPEVCQAEEK

SEQ ID NO: 107460 - protein, 34 aa, Artificial Sequence
  Description of Artificial Sequence: Synthetic polypeptide
DESEIRTTNPVATECWGVSVSCINEPQDREGENG

SEQ ID NO: 107461 - protein, 35 aa, Artificial Sequence
  Description of Artificial Sequence: Synthetic polypeptide
DESEIRTTNPVATECWGVSVSTCINEPQDREGENG

SEQ ID NO: 107462 - protein, 32 aa, Artificial Sequence
  Description of Artificial Sequence: Synthetic polypeptide
DESEIRTTNPVATECWGVVACINEPQDREGNG

SEQ ID NO: 107463 - protein, 28 aa, Artificial Sequence
  Description of Artificial Sequence: Synthetic peptide
QEEEIATTNPVATEQYGEAPEVCQAEEA

SEQ ID NO: 107464 - protein, 28 aa, Artificial Sequence
  Description of Artificial Sequence: Synthetic peptide
QENEIATTNPVATECYGDVSECLNHEEL

SEQ ID NO: 107465 - protein, 29 aa, Artificial Sequence
  Description of Artificial Sequence: Synthetic peptide
QENEIATTNPVATECYGDVSECLQHEELH

SEQ ID NO: 107466 - protein, 29 aa, Artificial Sequence
  Description of Artificial Sequence: Synthetic peptide
QENEIATTNPVATECYGDVSECLQHEELN

SEQ ID NO: 107467 - protein, 29 aa, Artificial Sequence
  Description of Artificial Sequence: Synthetic peptide
QENEIATTNPVATECYGDVSECLQHEELP

SEQ ID NO: 107468 - protein, 29 aa, Artificial Sequence
  Description of Artificial Sequence: Synthetic peptide
QENEIATTNPVATECYGDVSECLQHEELQ

SEQ ID NO: 107469 - protein, 29 aa, Artificial Sequence
  Description of Artificial Sequence: Synthetic peptide
QEEEIATTNPVATEQYGEAPEVCPQHENK

SEQ ID NO: 107470 - protein, 28 aa, Artificial Sequence
  Description of Artificial Sequence: Synthetic peptide
QEEEIATTNPVATEQYGEAPEVCNREEV

SEQ ID NO: 107471 - protein, 28 aa, Artificial Sequence
  Description of Artificial Sequence: Synthetic peptide
QEEEIATTNPVATEQYGEAPEVCNREEK

SEQ ID NO: 107472 - protein, 33 aa, Artificial Sequence
  Description of Artificial Sequence: Synthetic polypeptide
DESEIRTTNPVATECWGVVSCINEPQDREGEND

SEQ ID NO: 107473 - protein, 33 aa, Artificial Sequence
  Description of Artificial Sequence: Synthetic polypeptide
DESEIRTTNPVATECWGVVSCINEPQDREGENG

SEQ ID NO: 107474 - protein, 28 aa, Artificial Sequence
  Description of Artificial Sequence: Synthetic peptide
QEEEIATTNPVATEQYGEAPEVCMHGEK

SEQ ID NO: 107475 - protein, 33 aa, Artificial Sequence
  Description of Artificial Sequence: Synthetic polypeptide
DESEIRTTNPVATECWGVVSCINFPQDREGENW

SEQ ID NO: 107476 - protein, 29 aa, Artificial Sequence
  Description of Artificial Sequence: Synthetic peptide
QENEIATTNPVATECYGDVSECLQHEESD

SEQ ID NO: 107477 - protein, 29 aa, Artificial Sequence
  Description of Artificial Sequence: Synthetic peptide
QENEIATTNPVATECYGDVSECLQHEESL

SEQ ID NO: 107478 - protein, 29 aa, Artificial Sequence
  Description of Artificial Sequence: Synthetic peptide
QENEIATTNPVATECYGDVSECLQHEELK

SEQ ID NO: 107479 - protein, 28 aa, Artificial Sequence
  Description of Artificial Sequence: Synthetic peptide
QENEIATTNPCATECYGDVSCCLQHETL

SEQ ID NO: 107480 - protein, 34 aa, Artificial Sequence
  Description of Artificial Sequence: Synthetic polypeptide
DESEIRTTNPVATECWGSVYTCINEPQDREGENG

SEQ ID NO: 107481 - protein, 34 aa, Artificial Sequence
  Description of Artificial Sequence: Synthetic polypeptide
DESEIRTTNPVATECWGSVYSCINERQDREGENG

SEQ ID NO: 107482 - protein, 33 aa, Artificial Sequence
  Description of Artificial Sequence: Synthetic polypeptide
DEQEIATTNPVATEQYGSVSATDLIEDHEGEDL

SEQ ID NO: 107483 - protein, 33 aa, Artificial Sequence
  Description of Artificial Sequence: Synthetic polypeptide
DEQEIATTNPVATEQYGSVSATDLIEDHEGEDD

SEQ ID NO: 107484 - protein, 29 aa, Artificial Sequence
  Description of Artificial Sequence: Synthetic peptide
QENEIATTNPVATECYGDVSCEWLQHEEL

SEQ ID NO: 107485 - protein, 29 aa, Artificial Sequence
  Description of Artificial Sequence: Synthetic peptide
QENEIATTNPVATECYGDVSCEYLQHVEL

SEQ ID NO: 107486 - protein, 29 aa, Artificial Sequence
  Description of Artificial Sequence: Synthetic peptide
QENEIATTNPVATECYGDVSCICLQHEEG

SEQ ID NO: 107487 - protein, 33 aa, Artificial Sequence
  Description of Artificial Sequence: Synthetic polypeptide
DESEIRTTNPVATECWGSVTCINEPQDREGENG

SEQ ID NO: 107488 - protein, 33 aa, Artificial Sequence
  Description of Artificial Sequence: Synthetic polypeptide
DEQEIATTNPVATEQYGSVSATDLICDHEGEDL

SEQ ID NO: 107489 - protein, 33 aa, Artificial Sequence
  Description of Artificial Sequence: Synthetic polypeptide
DEQEIATTNPVATEQYGSVSATDLHEDHEGEDL

SEQ ID NO: 107490 - protein, 34 aa, Artificial Sequence
  Description of Artificial Sequence: Synthetic polypeptide
DESEIRTTNPVATECWGSVTSCINEPQDREGENG

SEQ ID NO: 107491 - protein, 28 aa, Artificial Sequence
  Description of Artificial Sequence: Synthetic peptide
QEEEIATTNPVATEQYGEAPEVCQHECI

SEQ ID NO: 107492 - protein, 33 aa, Artificial Sequence
  Description of Artificial Sequence: Synthetic polypeptide
DEQEIATTNPVATEQYGSVSATDLHEDHEGADL

SEQ ID NO: 107493 - protein, 29 aa, Artificial Sequence
  Description of Artificial Sequence: Synthetic peptide
QENEIATTNPVATECYGDVSDCTLQHEEL

SEQ ID NO: 107494 - protein, 34 aa, Artificial Sequence
  Description of Artificial Sequence: Synthetic polypeptide
DESEIRTTNPVATECWGSVTSCINEPQHREGENG

SEQ ID NO: 107495 - protein, 29 aa, Artificial Sequence
  Description of Artificial Sequence: Synthetic peptide
QENEIATTNPVATECYGDVSEACLQHEEL

SEQ ID NO: 107496 - protein, 33 aa, Artificial Sequence
  Description of Artificial Sequence: Synthetic polypeptide
DESEIRTTNPVATECWGSVVCINEPQDREGEND

SEQ ID NO: 107497 - protein, 33 aa, Artificial Sequence
  Description of Artificial Sequence: Synthetic polypeptide
DEQEIATTNPVATEQYGSVSATDLGEDHEGEDL

SEQ ID NO: 107498 - protein, 33 aa, Artificial Sequence
  Description of Artificial Sequence: Synthetic polypeptide
DEQEIATTNPVATEQYGSVSATDLFEDHEGEDL

SEQ ID NO: 107499 - protein, 32 aa, Artificial Sequence
  Description of Artificial Sequence: Synthetic polypeptide
DEQEIATTNPVATEQYGSVSATDLFDHEWEDL

SEQ ID NO: 107500 - protein, 33 aa, Artificial Sequence
  Description of Artificial Sequence: Synthetic polypeptide
DESEIRTTNPVATECWGSVVCINEPQDREGENG

SEQ ID NO: 107501 - protein, 32 aa, Artificial Sequence
  Description of Artificial Sequence: Synthetic polypeptide
DEQEIATTNPVATEQYGSVSATDLEYHEHEDL

SEQ ID NO: 107502 - protein, 34 aa, Artificial Sequence
  Description of Artificial Sequence: Synthetic polypeptide
DESEIRTTNPVATECWGSVVSCINEPQDREGENG

SEQ ID NO: 107503 - protein, 28 aa, Artificial Sequence
  Description of Artificial Sequence: Synthetic peptide
QENEIATTNPVATECYGDVSECAQHEEL

SEQ ID NO: 107504 - protein, 28 aa, Artificial Sequence
  Description of Artificial Sequence: Synthetic peptide
QENEIATTNPVATECYGDVSECAQHYEL

SEQ ID NO: 107505 - protein, 29 aa, Artificial Sequence
  Description of Artificial Sequence: Synthetic peptide
QENEIATTNPVATECYGDVSECCLQHTEL

SEQ ID NO: 107506 - protein, 28 aa, Artificial Sequence
  Description of Artificial Sequence: Synthetic peptide
QENEIATTNPVATECYGDVSECCQHEEL

SEQ ID NO: 107507 - protein, 29 aa, Artificial Sequence
  Description of Artificial Sequence: Synthetic peptide
QENEIATTNPVATECYGDVSCECLQHEEL

SEQ ID NO: 107508 - protein, 29 aa, Artificial Sequence
  Description of Artificial Sequence: Synthetic peptide
QENEIATTNPVATECYGDVSECDLQHEEL

SEQ ID NO: 107509 - protein, 33 aa, Artificial Sequence
  Description of Artificial Sequence: Synthetic polypeptide
DEQEIATTNPVATEQYGSVSATDLIEDHEGSDL

SEQ ID NO: 107510 - protein, 29 aa, Artificial Sequence
  Description of Artificial Sequence: Synthetic peptide
QENEIATTNPVATECYGDVSCCLQHEEQL

SEQ ID NO: 107511 - protein, 29 aa, Artificial Sequence
  Description of Artificial Sequence: Synthetic peptide
QENEIATTNPVATECYGDVHSECLQHETL

SEQ ID NO: 107512 - protein, 32 aa, Artificial Sequence
  Description of Artificial Sequence: Synthetic polypeptide
DEQEIATTNPVATEQYGSVSATDLMDHEEEDA

SEQ ID NO: 107513 - protein, 33 aa, Artificial Sequence
  Description of Artificial Sequence: Synthetic polypeptide
DEQEIATTNPVATEQYGSVSATDLLEDVEGEDL

SEQ ID NO: 107514 - protein, 29 aa, Artificial Sequence
  Description of Artificial Sequence: Synthetic peptide
QENEIATTNPVATECYGDVMSEVLQHEEL

SEQ ID NO: 107515 - protein, 33 aa, Artificial Sequence
  Description of Artificial Sequence: Synthetic polypeptide
DESEIRTTNPVATECWGSVSWINEDQDREGESG

SEQ ID NO: 107516 - protein, 28 aa, Artificial Sequence
  Description of Artificial Sequence: Synthetic peptide
QENEIATTNPVATECYGDVPECLQHEEL

SEQ ID NO: 107517 - protein, 28 aa, Artificial Sequence
  Description of Artificial Sequence: Synthetic peptide
QENEIATTNPVATECYGDVPECLQHEEY

SEQ ID NO: 107518 - protein, 29 aa, Artificial Sequence
  Description of Artificial Sequence: Synthetic peptide
QENEIATTNPVATECYGDVPSECLQEEEL

SEQ ID NO: 107519 - protein, 29 aa, Artificial Sequence
  Description of Artificial Sequence: Synthetic peptide
QENEIATTNPVATECYGDVPSECLQHEEL

SEQ ID NO: 107520 - protein, 33 aa, Artificial Sequence
  Description of Artificial Sequence: Synthetic polypeptide
DEQEIATTNPVATEQYGSVSATDLLEDHEGEDL

SEQ ID NO: 107521 - protein, 33 aa, Artificial Sequence
  Description of Artificial Sequence: Synthetic polypeptide
DEQEIATTNPVATEQYGSVSATDLLEDHEGEDK

SEQ ID NO: 107522 - protein, 28 aa, Artificial Sequence
  Description of Artificial Sequence: Synthetic peptide
QENEIATTNPVATECYGDVPYCLQHEEL

SEQ ID NO: 107523 - protein, 33 aa, Artificial Sequence
  Description of Artificial Sequence: Synthetic polypeptide
DEQEIATTNPVATEQYGSVSATDLLDHEGEDLS

SEQ ID NO: 107524 - protein, 33 aa, Artificial Sequence
  Description of Artificial Sequence: Synthetic polypeptide
DESEIRTTNPVATECWGSVSWINEPQDREGEHG

SEQ ID NO: 107525 - protein, 33 aa, Artificial Sequence
  Description of Artificial Sequence: Synthetic polypeptide
DEQEIATTNPVATEQYGSVSATDLKEDHEGEDL

SEQ ID NO: 107526 - protein, 29 aa, Artificial Sequence
  Description of Artificial Sequence: Synthetic peptide
QENEIATTNPVATECYGDVSACLVQHEEL

SEQ ID NO: 107527 - protein, 34 aa, Artificial Sequence
  Description of Artificial Sequence: Synthetic polypeptide
DESEIRTTNPVATECWGSVSWINEPQDREGENGK

SEQ ID NO: 107528 - protein, 33 aa, Artificial Sequence
  Description of Artificial Sequence: Synthetic polypeptide
DESEIRTTNPVATECWGSVSWMNENQDHFGSNQ

SEQ ID NO: 107529 - protein, 29 aa, Artificial Sequence
  Description of Artificial Sequence: Synthetic peptide
QENEIATTNPVATECYGDVSAECLQHAEL

SEQ ID NO: 107530 - protein, 29 aa, Artificial Sequence
  Description of Artificial Sequence: Synthetic peptide
QENEIATTNPVATECYGDVSAECLQHEEL

SEQ ID NO: 107531 - protein, 33 aa, Artificial Sequence
  Description of Artificial Sequence: Synthetic polypeptide
DESEIRTTNPVATECWGSVSWMNENQDRSGSDQ

SEQ ID NO: 107532 - protein, 29 aa, Artificial Sequence
  Description of Artificial Sequence: Synthetic peptide
QENEIATTNPVATECYGDVSATCLEHEEL

SEQ ID NO: 107533 - protein, 28 aa, Artificial Sequence
  Description of Artificial Sequence: Synthetic peptide
QEEEIATTNPVATEQYGEAPEVCQHEDK

SEQ ID NO: 107534 - protein, 28 aa, Artificial Sequence
  Description of Artificial Sequence: Synthetic peptide
QEEEIATTNPVATEQYGEAPEVCQHECK

SEQ ID NO: 107535 - protein, 34 aa, Artificial Sequence
  Description of Artificial Sequence: Synthetic polypeptide
DESEIRTTNPVATECWGSVSYCGNESQDREGENG

SEQ ID NO: 107536 - protein, 34 aa, Artificial Sequence
  Description of Artificial Sequence: Synthetic polypeptide
DESEIRTTNPVATECWGSVSYCINEPQDREGENG

SEQ ID NO: 107537 - protein, 30 aa, Artificial Sequence
  Description of Artificial Sequence: Synthetic polypeptide
QENEIATTNPVATECYGDVSECDLQHGEEL

SEQ ID NO: 107538 - protein, 34 aa, Artificial Sequence
  Description of Artificial Sequence: Synthetic polypeptide
DESEIRTTNPVATECWGSVVSCINEPQDRNGENG

SEQ ID NO: 107539 - protein, 28 aa, Artificial Sequence
  Description of Artificial Sequence: Synthetic peptide
QENEIATTNPVATECYGDVSECDQHEEL

SEQ ID NO: 107540 - protein, 28 aa, Artificial Sequence
  Description of Artificial Sequence: Synthetic peptide
QENEIATTNPVATECYGDVSECKQHEEL

SEQ ID NO: 107541 - protein, 34 aa, Artificial Sequence
  Description of Artificial Sequence: Synthetic polypeptide
DESEIRTTNPVATECWGSVWSGINEPQDREGHNG

SEQ ID NO: 107542 - protein, 33 aa, Artificial Sequence
  Description of Artificial Sequence: Synthetic polypeptide
DEQEIATTNPVATEQYGSVSATDLERHEEEDLW

SEQ ID NO: 107543 - protein, 34 aa, Artificial Sequence
  Description of Artificial Sequence: Synthetic polypeptide
DESEIRTTNPVATECWGSVWSYINEPQDREGENG

SEQ ID NO: 107544 - protein, 28 aa, Artificial Sequence
  Description of Artificial Sequence: Synthetic peptide
QENEIATTNPVATECYGDVSECLAHEEL

SEQ ID NO: 107545 - protein, 33 aa, Artificial Sequence
  Description of Artificial Sequence: Synthetic polypeptide
DESEIRTTNPVATECWGSVYCINEPQDREGENG

SEQ ID NO: 107546 - protein, 29 aa, Artificial Sequence
  Description of Artificial Sequence: Synthetic peptide
QENEIATTNPVATECYGDVSECLAQHEEL

SEQ ID NO: 107547 - protein, 28 aa, Artificial Sequence
  Description of Artificial Sequence: Synthetic peptide
QENEIATTNPVATECYGDVSECLDGEEL

SEQ ID NO: 107548 - protein, 28 aa, Artificial Sequence
  Description of Artificial Sequence: Synthetic peptide
QENEIATTNPVATECYGDVSECLDHECL

SEQ ID NO: 107549 - protein, 28 aa, Artificial Sequence
  Description of Artificial Sequence: Synthetic peptide
QENEIATTNPVATECYGDVSECLDHSEL

SEQ ID NO: 107550 - protein, 32 aa, Artificial Sequence
  Description of Artificial Sequence: Synthetic polypeptide
DEQEIATTNPVATEQYGSVSATDLENHEAEYL

SEQ ID NO: 107551 - protein, 34 aa, Artificial Sequence
  Description of Artificial Sequence: Synthetic polypeptide
DESEIRTTNPVATECWGSVYSCGNEPQDREGENG

SEQ ID NO: 107552 - protein, 28 aa, Artificial Sequence
  Description of Artificial Sequence: Synthetic peptide
QENEIATTNPVATECYGDVSECLKHEEL

SEQ ID NO: 107553 - protein, 29 aa, Artificial Sequence
  Description of Artificial Sequence: Synthetic peptide
QENEIATTNPVATECYGDVSECLKQHEEL

SEQ ID NO: 107554 - protein, 32 aa, Artificial Sequence
  Description of Artificial Sequence: Synthetic polypeptide
DEQEIATTNPVATEQYGSVSATDLEMHEDEDL

SEQ ID NO: 107555 - protein, 29 aa, Artificial Sequence
  Description of Artificial Sequence: Synthetic peptide
QENEIATTNPVATECYGDVSECLKQHEEY

SEQ ID NO: 107556 - protein, 33 aa, Artificial Sequence
  Description of Artificial Sequence: Synthetic polypeptide
DEQEIATTNPVATEQYGSVSATDLELHEGEDLL

SEQ ID NO: 107557 - protein, 28 aa, Artificial Sequence
  Description of Artificial Sequence: Synthetic peptide
QENEIATTNPVATECYGDVSECLMAEEL

SEQ ID NO: 107558 - protein, 33 aa, Artificial Sequence
  Description of Artificial Sequence: Synthetic polypeptide
DEQEIATTNPVATEQYGSVSATDLEKHEGQEDL

SEQ ID NO: 107559 - protein, 28 aa, Artificial Sequence
  Description of Artificial Sequence: Synthetic peptide
QENEIATTNPVATECYGDVSECLMHEEA

SEQ ID NO: 107560 - protein, 33 aa, Artificial Sequence
  Description of Artificial Sequence: Synthetic polypeptide
DEQEIATTNPVATEQYGSVSATDLEIHEGEDLA

SEQ ID NO: 107561 - protein, 34 aa, Artificial Sequence
  Description of Artificial Sequence: Synthetic polypeptide
DESEIRTTNPVATECWGSVYSCINEPQDREGENG

SEQ ID NO: 107562 - protein, 34 aa, Artificial Sequence
  Description of Artificial Sequence: Synthetic polypeptide
DESEIRTTNPVATECWGSVYSCINEPQDREGGNG

SEQ ID NO: 107563 - protein, 28 aa, Artificial Sequence
  Description of Artificial Sequence: Synthetic peptide
QENEIATTNPVATECYGDVSECLMHEEL

SEQ ID NO: 107564 - protein, 28 aa, Artificial Sequence
  Description of Artificial Sequence: Synthetic peptide
QEEEIATTNPVATEQYGEAPEVCQGEYK

SEQ ID NO: 107565 - protein, 34 aa, Artificial Sequence
  Description of Artificial Sequence: Synthetic polypeptide
DESEIRTTNPVATECWGSVWSCINEPQDREGENG

SEQ ID NO: 107566 - protein, 29 aa, Artificial Sequence
  Description of Artificial Sequence: Synthetic peptide
QENEIATTNPVATECYGDVSECKLQHPEL

SEQ ID NO: 107567 - protein, 29 aa, Artificial Sequence
  Description of Artificial Sequence: Synthetic peptide
QENEIATTNPVATECYGDVSECKLQCEEL

SEQ ID NO: 107568 - protein, 33 aa, Artificial Sequence
  Description of Artificial Sequence: Synthetic polypeptide
DEQEIATTNPVATEQYGSVSATDLETHEGMEDE

SEQ ID NO: 107569 - protein, 28 aa, Artificial Sequence
  Description of Artificial Sequence: Synthetic peptide
QENEIATTNPVATECYGDVSECEQAEEL

SEQ ID NO: 107570 - protein, 28 aa, Artificial Sequence
  Description of Artificial Sequence: Synthetic peptide
QENEIATTNPVATECYGDVSECEQHEEA

SEQ ID NO: 107571 - protein, 32 aa, Artificial Sequence
  Description of Artificial Sequence: Synthetic polypeptide
DEQEIATTNPVATEQYGSVSATDLEVHEYEDL

SEQ ID NO: 107572 - protein, 33 aa, Artificial Sequence
  Description of Artificial Sequence: Synthetic polypeptide
DEQEIATTNPVATEQYGSVSATDLEVHENWEML

SEQ ID NO: 107573 - protein, 28 aa, Artificial Sequence
  Description of Artificial Sequence: Synthetic peptide
QENEIATTNPVATECYGDVSECEQHEEL

SEQ ID NO: 107574 - protein, 28 aa, Artificial Sequence
  Description of Artificial Sequence: Synthetic peptide
QENEIATTNPVATECYGDVSECEQHNEL

SEQ ID NO: 107575 - protein, 28 aa, Artificial Sequence
  Description of Artificial Sequence: Synthetic peptide
QENEIATTNPVATECYGDVSECFQHEEG

SEQ ID NO: 107576 - protein, 33 aa, Artificial Sequence
  Description of Artificial Sequence: Synthetic polypeptide
DESEIRTTNPVATECWGSVWCINEPQDREGENG

SEQ ID NO: 107577 - protein, 28 aa, Artificial Sequence
  Description of Artificial Sequence: Synthetic peptide
QENEIATTNPVATECYGDVSECFQHEEL

SEQ ID NO: 107578 - protein, 28 aa, Artificial Sequence
  Description of Artificial Sequence: Synthetic peptide
QENEIATTNPVATECYGDVSECGQHEEL

SEQ ID NO: 107579 - protein, 33 aa, Artificial Sequence
  Description of Artificial Sequence: Synthetic polypeptide
DEQEIATTNPVATEQYGSVSATDLEVHEGVELL

SEQ ID NO: 107580 - protein, 28 aa, Artificial Sequence
  Description of Artificial Sequence: Synthetic peptide
QEEEIATTNPVATEQYGEAPEVCQHEAK

SEQ ID NO: 107581 - protein, 33 aa, Artificial Sequence
  Description of Artificial Sequence: Synthetic polypeptide
DEQEIATTNPVATEQYGSVSATDLEHHEGFEDL

SEQ ID NO: 107582 - protein, 29 aa, Artificial Sequence
  Description of Artificial Sequence: Synthetic peptide
QENEIATTNPVATECYGDVSECHLQHEEL

SEQ ID NO: 107583 - protein, 28 aa, Artificial Sequence
  Description of Artificial Sequence: Synthetic peptide
QENEIATTNPVATECYGDVSECHQHEEL

SEQ ID NO: 107584 - protein, 28 aa, Artificial Sequence
  Description of Artificial Sequence: Synthetic peptide
QENEIATTNPVATECYGDVSECIQHEEL

SEQ ID NO: 107585 - protein, 33 aa, Artificial Sequence
  Description of Artificial Sequence: Synthetic polypeptide
DEQEIATTNPVATEQYGSVSATDLETHEGSEDL

SEQ ID NO: 107586 - protein, 33 aa, Artificial Sequence
  Description of Artificial Sequence: Synthetic polypeptide
DESEIRTTNPVATECWGSVWCLNEPQDREGENG

SEQ ID NO: 107587 - protein, 29 aa, Artificial Sequence
  Description of Artificial Sequence: Synthetic peptide
QENEIATTNPVATECYGDVSECIQHVEER

SEQ ID NO: 107588 - protein, 33 aa, Artificial Sequence
  Description of Artificial Sequence: Synthetic polypeptide
DESEIRTTNPVATECWGSVWEINEPQDREGENG

SEQ ID NO: 107589 - protein, 29 aa, Artificial Sequence
  Description of Artificial Sequence: Synthetic peptide
QENEIATTNPVATECYGDVSECIQHVEQR

SEQ ID NO: 107590 - protein, 28 aa, Artificial Sequence
  Description of Artificial Sequence: Synthetic peptide
QEEEIATTNPVATEQYGEAPEVCQHCEK

SEQ ID NO: 107591 - protein, 28 aa, Artificial Sequence
  Description of Artificial Sequence: Synthetic peptide
QEEEIATTNPVATEQYGEAPEVCQHAEK

SEQ ID NO: 107592 - protein, 34 aa, Artificial Sequence
  Description of Artificial Sequence: Synthetic polypeptide
DESEIRTTNPVATECWGSVWSCENEPQDREGENG

SEQ ID NO: 107593 - protein, 29 aa, Artificial Sequence
  Description of Artificial Sequence: Synthetic peptide
QENEIATTNPVATECYGDVSECIQQHENL

SEQ ID NO: 107594 - protein, 28 aa, Artificial Sequence
  Description of Artificial Sequence: Synthetic peptide
QENEIATTNPVATECYGDVSECIQYEEL

SEQ ID NO: 107595 - protein, 28 aa, Artificial Sequence
  Description of Artificial Sequence: Synthetic peptide
QEEEIATTNPVATEQYGEAPEVCQHDEK

SEQ ID NO: 107596 - protein, 29 aa, Artificial Sequence
  Description of Artificial Sequence: Synthetic peptide
QEEEIATTNPVATEQYGCYPWEDQHNGEQ

SEQ ID NO: 107597 - protein, 31 aa, Artificial Sequence
  Description of Artificial Sequence: Synthetic polypeptide
DEQEIRTTNPVATEQWGSVSATDEMDHEEEA

SEQ ID NO: 107598 - protein, 32 aa, Artificial Sequence
  Description of Artificial Sequence: Synthetic polypeptide
DEQEIRTTNPVATEQWGSVSATDLEDHEEEDA

SEQ ID NO: 107599 - protein, 32 aa, Artificial Sequence
  Description of Artificial Sequence: Synthetic polypeptide
DESEIRGTNPVATDAYGSVSINGQGQTGNGDT

SEQ ID NO: 107600 - protein, 33 aa, Artificial Sequence
  Description of Artificial Sequence: Synthetic polypeptide
DESEIRGTNPVATDAYGSVISITNGQGTGNGQG

SEQ ID NO: 107601 - protein, 31 aa, Artificial Sequence
  Description of Artificial Sequence: Synthetic polypeptide
DESEIRGTNPVATDAYGAVSINGQGTGNGDG

SEQ ID NO: 107602 - protein, 33 aa, Artificial Sequence
  Description of Artificial Sequence: Synthetic polypeptide
DESEIRFTNPVATECWGSVSCINEPQSREGENG

SEQ ID NO: 107603 - protein, 33 aa, Artificial Sequence
  Description of Artificial Sequence: Synthetic polypeptide
DESEIRFTNPVATECWGSVSCINEPQDREGENG

SEQ ID NO: 107604 - protein, 33 aa, Artificial Sequence
  Description of Artificial Sequence: Synthetic polypeptide
DESEIRETNPVATECWGSVSCINEPQDREGENG

SEQ ID NO: 107605 - protein, 33 aa, Artificial Sequence
  Description of Artificial Sequence: Synthetic polypeptide
DESEIRETNPVATECWGSVSCCNEPQDREGENG

SEQ ID NO: 107606 - protein, 33 aa, Artificial Sequence
  Description of Artificial Sequence: Synthetic polypeptide
DESEIRCTNPVATETWGSVSCINEPQDREGENG

SEQ ID NO: 107607 - protein, 32 aa, Artificial Sequence
  Description of Artificial Sequence: Synthetic polypeptide
CEECICTTNPVATEQYGSVSWNEGERQGMGSG

SEQ ID NO: 107608 - protein, 33 aa, Artificial Sequence
  Description of Artificial Sequence: Synthetic polypeptide
DESEIRTTNPVATECWGSVSCHNEPQDCEGENG

SEQ ID NO: 107609 - protein, 29 aa, Artificial Sequence
  Description of Artificial Sequence: Synthetic peptide
QEEEIRTTNPVATEQYGEAPEVCQMHEEK

SEQ ID NO: 107610 - protein, 33 aa, Artificial Sequence
  Description of Artificial Sequence: Synthetic polypeptide
DESEIRCTNPVATECYGSVSEINEPMDREGENG

SEQ ID NO: 107611 - protein, 33 aa, Artificial Sequence
  Description of Artificial Sequence: Synthetic polypeptide
DESEIRTTNPVATECWGSVSCIAEPQDREGENG

SEQ ID NO: 107612 - protein, 29 aa, Artificial Sequence
  Description of Artificial Sequence: Synthetic peptide
QEEEIRTTNPVATEQYGEAPMDCQQHEEK

SEQ ID NO: 107613 - protein, 33 aa, Artificial Sequence
  Description of Artificial Sequence: Synthetic polypeptide
DESEIRTTNPVATECWGSVSCIAEPQDRIGENG

SEQ ID NO: 107614 - protein, 33 aa, Artificial Sequence
  Description of Artificial Sequence: Synthetic polypeptide
DESEIRTTNPVATECWGSVSCIAEPQDRNGENG

SEQ ID NO: 107615 - protein, 29 aa, Artificial Sequence
  Description of Artificial Sequence: Synthetic peptide
QEEEIRTTNPVATEQYGEAPNEVCQHEEK

SEQ ID NO: 107616 - protein, 33 aa, Artificial Sequence
  Description of Artificial Sequence: Synthetic polypeptide
DESEIRTTNPVATECWGSVSCIAESQDRKGENG

SEQ ID NO: 107617 - protein, 29 aa, Artificial Sequence
  Description of Artificial Sequence: Synthetic peptide
QEEEIRTTNPVATEQYGEAPNEVWQHEEK

SEQ ID NO: 107618 - protein, 30 aa, Artificial Sequence
  Description of Artificial Sequence: Synthetic polypeptide
QEEEIRTTNPVATEQYGEAPTPAGNMHGEK

SEQ ID NO: 107619 - protein, 33 aa, Artificial Sequence
  Description of Artificial Sequence: Synthetic polypeptide
DESEIRTTNPVATECWGSVSCICEPQDREGENG

SEQ ID NO: 107620 - protein, 32 aa, Artificial Sequence
  Description of Artificial Sequence: Synthetic polypeptide
DESEIRTTNPVATECWGSVSCICEPQREGEEL

SEQ ID NO: 107621 - protein, 33 aa, Artificial Sequence
  Description of Artificial Sequence: Synthetic polypeptide
DESEIRTTNPVATECWGSVSCIDEPQDREGENG

SEQ ID NO: 107622 - protein, 32 aa, Artificial Sequence
  Description of Artificial Sequence: Synthetic polypeptide
DESEIRCTNPVATECWGSVSCINEPQDREGGG

SEQ ID NO: 107623 - protein, 33 aa, Artificial Sequence
  Description of Artificial Sequence: Synthetic polypeptide
DESEIRTTNPVATECWGSVSCIDEPQDREGENI

SEQ ID NO: 107624 - protein, 32 aa, Artificial Sequence
  Description of Artificial Sequence: Synthetic polypeptide
DESEIRGTNPVATDQYGDVSDGNGQGEGGNQE

SEQ ID NO: 107625 - protein, 33 aa, Artificial Sequence
  Description of Artificial Sequence: Synthetic polypeptide
DESEIRCTNPVATECWGSVSCINEPQDREGENG

SEQ ID NO: 107626 - protein, 33 aa, Artificial Sequence
  Description of Artificial Sequence: Synthetic polypeptide
DESEIRGTNPVATDQYGSVNMTMGLQEEGGNDG

SEQ ID NO: 107627 - protein, 33 aa, Artificial Sequence
  Description of Artificial Sequence: Synthetic polypeptide
DESEIRHTNPVATECWGSVSCINEPQDREGENG

SEQ ID NO: 107628 - protein, 33 aa, Artificial Sequence
  Description of Artificial Sequence: Synthetic polypeptide
DESEIRPTNPVATECWGSVSCINEPQDRDGENG

SEQ ID NO: 107629 - protein, 28 aa, Artificial Sequence
  Description of Artificial Sequence: Synthetic peptide
QEEEIRTTNPVATEQYGEAPEICMAEDK

SEQ ID NO: 107630 - protein, 32 aa, Artificial Sequence
  Description of Artificial Sequence: Synthetic polypeptide
DESEIRPTNPVATECWGIVSCNEPQDREGENG

SEQ ID NO: 107631 - protein, 28 aa, Artificial Sequence
  Description of Artificial Sequence: Synthetic peptide
QEEEIRTTNPVATEQYGEAPEICMHEDK

SEQ ID NO: 107632 - protein, 32 aa, Artificial Sequence
  Description of Artificial Sequence: Synthetic polypeptide
DESEIRPTNPVATECWGIVSCINLPQREGETG

SEQ ID NO: 107633 - protein, 34 aa, Artificial Sequence
  Description of Artificial Sequence: Synthetic polypeptide
DESEIRTTNPVATECWGSVSCGNGEPQDREGENG

SEQ ID NO: 107634 - protein, 31 aa, Artificial Sequence
  Description of Artificial Sequence: Synthetic polypeptide
QEEEIATTNPVATEQYGSVSEVLEDHEEEDK

SEQ ID NO: 107635 - protein, 31 aa, Artificial Sequence
  Description of Artificial Sequence: Synthetic polypeptide
QEEEIRTTNPVATEQYGEAPEINEQDHEGEG

SEQ ID NO: 107636 - protein, 35 aa, Artificial Sequence
  Description of Artificial Sequence: Synthetic polypeptide
AEEEIRTTNPVATEQYGSVVTTNNLGGTEQGTNNS

SEQ ID NO: 107637 - protein, 35 aa, Artificial Sequence
  Description of Artificial Sequence: Synthetic polypeptide
AEEEIRTTNPVATEQYGSVVTTNNLLGGTEQGNNQ

SEQ ID NO: 107638 - protein, 30 aa, Artificial Sequence
  Description of Artificial Sequence: Synthetic polypeptide
QEEEIRTTNPVATEQYGEAPEIVEQDHGEK

SEQ ID NO: 107639 - protein, 29 aa, Artificial Sequence
  Description of Artificial Sequence: Synthetic peptide
QEEEIRTTNPVATEQYGEAPEVACQHEEK

SEQ ID NO: 107640 - protein, 28 aa, Artificial Sequence
  Description of Artificial Sequence: Synthetic peptide
QEEEIRTTNPVATEQYGEAPEVCIHEEK

SEQ ID NO: 107641 - protein, 28 aa, Artificial Sequence
  Description of Artificial Sequence: Synthetic peptide
QEEEIRTTNPVATEQYGEAPEVCKHEEK

SEQ ID NO: 107642 - protein, 28 aa, Artificial Sequence
  Description of Artificial Sequence: Synthetic peptide
QEEEIRTTNPVATEQYGEAPEVCNHEEK

SEQ ID NO: 107643 - protein, 31 aa, Artificial Sequence
  Description of Artificial Sequence: Synthetic polypeptide
DESEIRPTNPVASEQWGIVSCNLPQSEGETG

SEQ ID NO: 107644 - protein, 31 aa, Artificial Sequence
  Description of Artificial Sequence: Synthetic polypeptide
DESEIRPTNPVASECWGIVSCNLPQREGETG

SEQ ID NO: 107645 - protein, 30 aa, Artificial Sequence
  Description of Artificial Sequence: Synthetic polypeptide
DESEIRPTNPCSSEQWGIVSCNLPQSGETR

SEQ ID NO: 107646 - protein, 33 aa, Artificial Sequence
  Description of Artificial Sequence: Synthetic polypeptide
DESEIRNTNPVATECWGSVSCINEPQDREGENG

SEQ ID NO: 107647 - protein, 33 aa, Artificial Sequence
  Description of Artificial Sequence: Synthetic polypeptide
DESEIRMTNPVATECWGSVSCINEPQDREGENG

SEQ ID NO: 107648 - protein, 32 aa, Artificial Sequence
  Description of Artificial Sequence: Synthetic polypeptide
DESEIRMTNPVATECWGSVSCINEPQDHEGNG

SEQ ID NO: 107649 - protein, 33 aa, Artificial Sequence
  Description of Artificial Sequence: Synthetic polypeptide
DESEIRMTNPVATECWGSVSCINECQDREGENG

SEQ ID NO: 107650 - protein, 33 aa, Artificial Sequence
  Description of Artificial Sequence: Synthetic polypeptide
DESEIRLTNPVATECWGSVSCINEYQDREGENG

SEQ ID NO: 107651 - protein, 33 aa, Artificial Sequence
  Description of Artificial Sequence: Synthetic polypeptide
DESEIRLTNPVATECWGSVSCINEPQDREGENG

SEQ ID NO: 107652 - protein, 33 aa, Artificial Sequence
  Description of Artificial Sequence: Synthetic polypeptide
DESEIRHTNPVATECWGSVSCINEPQDREGENQ

SEQ ID NO: 107653 - protein, 33 aa, Artificial Sequence
  Description of Artificial Sequence: Synthetic polypeptide
DESEIRGTNPVATECWGSVSCINEPQDREGENG

SEQ ID NO: 107654 - protein, 33 aa, Artificial Sequence
  Description of Artificial Sequence: Synthetic polypeptide
DESEIRPTNPVATECWGSVSCINEPQDREGENG

SEQ ID NO: 107655 - protein, 33 aa, Artificial Sequence
  Description of Artificial Sequence: Synthetic polypeptide
DESEIRTTNPVATECWGSVSCIDEPQHRGGENG

SEQ ID NO: 107656 - protein, 33 aa, Artificial Sequence
  Description of Artificial Sequence: Synthetic polypeptide
DESEIRTTNPVATECWGSVSCIEEPQDREGENG

SEQ ID NO: 107657 - protein, 33 aa, Artificial Sequence
  Description of Artificial Sequence: Synthetic polypeptide
DESEIKTTNPVATECWGSVSCINYPQDREGENG

SEQ ID NO: 107658 - protein, 36 aa, Artificial Sequence
  Description of Artificial Sequence: Synthetic polypeptide
AEEEIRTTNPVATEQYGSVSVTTNNLQQGVTEQGEM

SEQ ID NO: 107659 - protein, 33 aa, Artificial Sequence
  Description of Artificial Sequence: Synthetic polypeptide
DESEIKTTNPVATECWGSVSCINEPQDREGGNG

SEQ ID NO: 107660 - protein, 33 aa, Artificial Sequence
  Description of Artificial Sequence: Synthetic polypeptide
DESEIKTTNPVATECWGSVSCINEPQDREGENG

SEQ ID NO: 107661 - protein, 33 aa, Artificial Sequence
  Description of Artificial Sequence: Synthetic polypeptide
DESEIITTNPVATECWGSVSCINYPQDREGENG

SEQ ID NO: 107662 - protein, 33 aa, Artificial Sequence
  Description of Artificial Sequence: Synthetic polypeptide
DESEIITTNPVATECWGSVSCINEPQDREGFNG

SEQ ID NO: 107663 - protein, 33 aa, Artificial Sequence
  Description of Artificial Sequence: Synthetic polypeptide
DESEIITTNPVATECWGSVSCINEPQDREGENG

SEQ ID NO: 107664 - protein, 34 aa, Artificial Sequence
  Description of Artificial Sequence: Synthetic polypeptide
DESEIIRTTNPVATECWGSVSCSNEPQDREGENG

SEQ ID NO: 107665 - protein, 34 aa, Artificial Sequence
  Description of Artificial Sequence: Synthetic polypeptide
DESEIIRTTNPVATECWGSVSCINMPQDREGENG

SEQ ID NO: 107666 - protein, 34 aa, Artificial Sequence
  Description of Artificial Sequence: Synthetic polypeptide
DESEIIRTTNPVATECWGSVSCINEPQDREGENG

SEQ ID NO: 107667 - protein, 33 aa, Artificial Sequence
  Description of Artificial Sequence: Synthetic polypeptide
DESEIHTTNPVATEGWGSVSCINEPQDREGENG

SEQ ID NO: 107668 - protein, 33 aa, Artificial Sequence
  Description of Artificial Sequence: Synthetic polypeptide
DESEIHTTNPVATECWGSVSCINEPQDREGENG

SEQ ID NO: 107669 - protein, 32 aa, Artificial Sequence
  Description of Artificial Sequence: Synthetic polypeptide
DESEIGTTNPVAYESYGSVSCTNEFSGRGGSE

SEQ ID NO: 107670 - protein, 31 aa, Artificial Sequence
  Description of Artificial Sequence: Synthetic polypeptide
DESEIGTTNPVAYESYGSVCSTNFSGKGGSE

SEQ ID NO: 107671 - protein, 31 aa, Artificial Sequence
  Description of Artificial Sequence: Synthetic polypeptide
DESEIGTTNPVAYEHYGSVVTGNFSGRGGSE

SEQ ID NO: 107672 - protein, 32 aa, Artificial Sequence
  Description of Artificial Sequence: Synthetic polypeptide
QEEEIATTNPVATEQYGSVPATVLEDHEGEDL

SEQ ID NO: 107673 - protein, 37 aa, Artificial Sequence
  Description of Artificial Sequence: Synthetic polypeptide
AEEEIRTTNPVATEQYGSVSVTTNNLQQGTEQGNTGT

SEQ ID NO: 107674 - protein, 31 aa, Artificial Sequence
  Description of Artificial Sequence: Synthetic polypeptide
QEEEIRTTNPVATEQYGEVSPEPVGNMHEEV

SEQ ID NO: 107675 - protein, 31 aa, Artificial Sequence
  Description of Artificial Sequence: Synthetic polypeptide
QEEEIRTTNPVATEQYGEVSPEPVGQMHEEV

SEQ ID NO: 107676 - protein, 34 aa, Artificial Sequence
  Description of Artificial Sequence: Synthetic polypeptide
DESEIGTTNPVATEPYGSVSTTLNEPSGRGGSYR

SEQ ID NO: 107677 - protein, 33 aa, Artificial Sequence
  Description of Artificial Sequence: Synthetic polypeptide
DESEIRTTNPVATECWGSVSCIHEPQRREGENG

SEQ ID NO: 107678 - protein, 33 aa, Artificial Sequence
  Description of Artificial Sequence: Synthetic polypeptide
DESEIGTTNPVATECWGSVSCINEPQVREGENG

SEQ ID NO: 107679 - protein, 33 aa, Artificial Sequence
  Description of Artificial Sequence: Synthetic polypeptide
DESEIGTTNPVATECWGSVSCINEPQDREGENG

SEQ ID NO: 107680 - protein, 33 aa, Artificial Sequence
  Description of Artificial Sequence: Synthetic polypeptide
DESEIRTTNPVATECWGSVSCIIEPQDRAGENA

SEQ ID NO: 107681 - protein, 33 aa, Artificial Sequence
  Description of Artificial Sequence: Synthetic polypeptide
DESEIFTTNPVATECWGSVSCINIEPQDREGNG

SEQ ID NO: 107682 - protein, 33 aa, Artificial Sequence
  Description of Artificial Sequence: Synthetic polypeptide
DESEIKTTNPVATECWGSVSRINEPQDREGENG

SEQ ID NO: 107683 - protein, 32 aa, Artificial Sequence
  Description of Artificial Sequence: Synthetic polypeptide
DESEIRTTNPVATECWGSVSCIDLPEDHEGNG

SEQ ID NO: 107684 - protein, 33 aa, Artificial Sequence
  Description of Artificial Sequence: Synthetic polypeptide
DESEIRTTNPVATECWGSVSCIHEPQDREGENG

SEQ ID NO: 107685 - protein, 33 aa, Artificial Sequence
  Description of Artificial Sequence: Synthetic polypeptide
DESEIKTTNPVATEQYGSVSATGDGEDQEGGDG

SEQ ID NO: 107686 - protein, 33 aa, Artificial Sequence
  Description of Artificial Sequence: Synthetic polypeptide
DESEIRTTNPVATECWGSVSCIEEPQDREGENQ

SEQ ID NO: 107687 - protein, 33 aa, Artificial Sequence
  Description of Artificial Sequence: Synthetic polypeptide
DESEIRCTNPVATEAYGKVSCNNLSQQKAGGNE

SEQ ID NO: 107688 - protein, 33 aa, Artificial Sequence
  Description of Artificial Sequence: Synthetic polypeptide
DESEIRTTNPVATECWGSVSCIEEPQWRDGENE

SEQ ID NO: 107689 - protein, 33 aa, Artificial Sequence
  Description of Artificial Sequence: Synthetic polypeptide
DESEIRTTNPVATECWGSVSCIFEPQDREGENG

SEQ ID NO: 107690 - protein, 31 aa, Artificial Sequence
  Description of Artificial Sequence: Synthetic polypeptide
QEEEIRTTNPVATEQYGEASSTPAGNMHGEV

SEQ ID NO: 107691 - protein, 33 aa, Artificial Sequence
  Description of Artificial Sequence: Synthetic polypeptide
DESEIRTTNPVATECWGSVSCIGEMQDREGENG

SEQ ID NO: 107692 - protein, 33 aa, Artificial Sequence
  Description of Artificial Sequence: Synthetic polypeptide
DESEIRTTNPVATECWGSVSCIGEPQDREGENG

SEQ ID NO: 107693 - protein, 32 aa, Artificial Sequence
  Description of Artificial Sequence: Synthetic polypeptide
QEEEIRTTNPVATEQYGEVPTPACPQMHNEEK

SEQ ID NO: 107694 - protein, 32 aa, Artificial Sequence
  Description of Artificial Sequence: Synthetic polypeptide
DESEIRCTNPIATECYGSVSEINEPMREGENG

SEQ ID NO: 107695 - protein, 32 aa, Artificial Sequence
  Description of Artificial Sequence: Synthetic polypeptide
DESEIRCTNPIATECWGSVSENEPQDREGENG

SEQ ID NO: 107696 - protein, 33 aa, Artificial Sequence
  Description of Artificial Sequence: Synthetic polypeptide
DESEIRATNPVATECWGSVSCKNEPQDREGENG

SEQ ID NO: 107697 - protein, 33 aa, Artificial Sequence
  Description of Artificial Sequence: Synthetic polypeptide
DESEIRATNPVATECWGSVSCINEPQDREGENG

SEQ ID NO: 107698 - protein, 33 aa, Artificial Sequence
  Description of Artificial Sequence: Synthetic polypeptide
DESEIQTTNPVATECWGSVSCINEPQDREGENG

SEQ ID NO: 107699 - protein, 33 aa, Artificial Sequence
  Description of Artificial Sequence: Synthetic polypeptide
DESEINTTNPVATECWGSVSCINEPQDREGENG

SEQ ID NO: 107700 - protein, 33 aa, Artificial Sequence
  Description of Artificial Sequence: Synthetic polypeptide
DESEIMTTNPVATECWGSVSCINEPQKREGENG

SEQ ID NO: 107701 - protein, 33 aa, Artificial Sequence
  Description of Artificial Sequence: Synthetic polypeptide
DESEIMTTNPVATECWGSVSCINEPQDREGENG

SEQ ID NO: 107702 - protein, 33 aa, Artificial Sequence
  Description of Artificial Sequence: Synthetic polypeptide
DESEILTTNPVATECWGSVSCINEPQDREGKNG

SEQ ID NO: 107703 - protein, 33 aa, Artificial Sequence
  Description of Artificial Sequence: Synthetic polypeptide
DESEILTTNPVATECWGSVSCINEPQDREGENY

SEQ ID NO: 107704 - protein, 33 aa, Artificial Sequence
  Description of Artificial Sequence: Synthetic polypeptide
DESEILTTNPVATECWGSVSCINEPQDREGENG

SEQ ID NO: 107705 - protein, 33 aa, Artificial Sequence
  Description of Artificial Sequence: Synthetic polypeptide
DESEILTTNPVATECWGSVSCENEPQDREGENG

SEQ ID NO: 107706 - protein, 34 aa, Artificial Sequence
  Description of Artificial Sequence: Synthetic polypeptide
DESEILRTTNPVATECWGSVSCINEPQDREGENG

SEQ ID NO: 107707 - protein, 34 aa, Artificial Sequence
  Description of Artificial Sequence: Synthetic polypeptide
DESEIKTTNPVATEQYGSVSVNGLRGEFGQGGEE

SEQ ID NO: 107708 - protein, 34 aa, Artificial Sequence
  Description of Artificial Sequence: Synthetic polypeptide
DESEIKTTNPVATEQYGSVSINGLSGELGQGGEI

SEQ ID NO: 107709 - protein, 34 aa, Artificial Sequence
  Description of Artificial Sequence: Synthetic polypeptide
DESEIKTTNPVATEQYGSVSINGLNGQDGQGGEE

SEQ ID NO: 107710 - protein, 32 aa, Artificial Sequence
  Description of Artificial Sequence: Synthetic polypeptide
QEEEIRTTNPVATEQYGEVPTPACPQMRNEEK

SEQ ID NO: 107711 - protein, 32 aa, Artificial Sequence
  Description of Artificial Sequence: Synthetic polypeptide
QEEEIRTTNPVATEQYGEVPTTPVGQHGMEPK

SEQ ID NO: 107712 - protein, 34 aa, Artificial Sequence
  Description of Artificial Sequence: Synthetic polypeptide
QEEEIATTNPVATEQYGSVSSTEPAGNMRNGMNV

SEQ ID NO: 107713 - protein, 32 aa, Artificial Sequence
  Description of Artificial Sequence: Synthetic polypeptide
DESEIRPTNPVATECYGIVSCNEPQDREGETG

SEQ ID NO: 107714 - protein, 29 aa, Artificial Sequence
  Description of Artificial Sequence: Synthetic peptide
QEEEIRTTNPVATEQYGEAPEACQMHEEK

SEQ ID NO: 107715 - protein, 31 aa, Artificial Sequence
  Description of Artificial Sequence: Synthetic polypeptide
QEEEIRTTNPVATEQWGEASEINEQHEGEEG

SEQ ID NO: 107716 - protein, 33 aa, Artificial Sequence
  Description of Artificial Sequence: Synthetic polypeptide
DESEIRTTNPAATECWGSVSCINEPQDREGENG

SEQ ID NO: 107717 - protein, 33 aa, Artificial Sequence
  Description of Artificial Sequence: Synthetic polypeptide
DESEIRTTNPAATECWGSVSCINEPQAREGHNG

SEQ ID NO: 107718 - protein, 33 aa, Artificial Sequence
  Description of Artificial Sequence: Synthetic polypeptide
DESEIRTTNNVATECWGSVSCINEPQDREGENG

SEQ ID NO: 107719 - protein, 33 aa, Artificial Sequence
  Description of Artificial Sequence: Synthetic polypeptide
DESEIRTTNMVATECWGSVSCINEPQDREGENG

SEQ ID NO: 107720 - protein, 33 aa, Artificial Sequence
  Description of Artificial Sequence: Synthetic polypeptide
DESEIRTTNIVATECWGSVSCINEPQDREGENG

SEQ ID NO: 107721 - protein, 29 aa, Artificial Sequence
  Description of Artificial Sequence: Synthetic peptide
QEEEIRTTNPVATEQWGEASEVCQNAEEK

SEQ ID NO: 107722 - protein, 33 aa, Artificial Sequence
  Description of Artificial Sequence: Synthetic polypeptide
DESEIRTTNGVATECWGSVSCLNEPQDREGENG

SEQ ID NO: 107723 - protein, 33 aa, Artificial Sequence
  Description of Artificial Sequence: Synthetic polypeptide
DESEIRTTNGVATECWGSVSCINEPQDRLGENG

SEQ ID NO: 107724 - protein, 33 aa, Artificial Sequence
  Description of Artificial Sequence: Synthetic polypeptide
DESEIRTTNGVATECWGSVSCINEPQDREGENG

SEQ ID NO: 107725 - protein, 33 aa, Artificial Sequence
  Description of Artificial Sequence: Synthetic polypeptide
DESEIRTTNGVATECWGSVSCINEPQDREGCNG

SEQ ID NO: 107726 - protein, 31 aa, Artificial Sequence
  Description of Artificial Sequence: Synthetic polypeptide
QEEEIATTNPVATEQYGTVCPATVPVQHGEK

SEQ ID NO: 107727 - protein, 33 aa, Artificial Sequence
  Description of Artificial Sequence: Synthetic polypeptide
DESEIRTTNCVATECWGSVSCINEPQDREGENG

SEQ ID NO: 107728 - protein, 33 aa, Artificial Sequence
  Description of Artificial Sequence: Synthetic polypeptide
DESEIRTTNAVATECWGSVSCINEPQDREGENG

SEQ ID NO: 107729 - protein, 33 aa, Artificial Sequence
  Description of Artificial Sequence: Synthetic polypeptide
DESEIRTSNPVATECWGSVSCNEPQDREGENFG

SEQ ID NO: 107730 - protein, 33 aa, Artificial Sequence
  Description of Artificial Sequence: Synthetic polypeptide
DESEIRTSNPVATECWGSVSCINEPQLREGENG

SEQ ID NO: 107731 - protein, 33 aa, Artificial Sequence
  Description of Artificial Sequence: Synthetic polypeptide
DESEIRTSNPVATECWGSVSCINEPQDREGENG

SEQ ID NO: 107732 - protein, 33 aa, Artificial Sequence
  Description of Artificial Sequence: Synthetic polypeptide
DESEIRTSNPVATECWGSVSCINAPQDREGENG

SEQ ID NO: 107733 - protein, 33 aa, Artificial Sequence
  Description of Artificial Sequence: Synthetic polypeptide
DESEIRTINPVATECWGSVSCINEPQDREGENG

SEQ ID NO: 107734 - protein, 33 aa, Artificial Sequence
  Description of Artificial Sequence: Synthetic polypeptide
DESEIRTCNPVATECWGSVSCINEPQDREGENG

SEQ ID NO: 107735 - protein, 31 aa, Artificial Sequence
  Description of Artificial Sequence: Synthetic polypeptide
QEEEIATTNPVATEQYGTVCPATGPVQHGEK

SEQ ID NO: 107736 - protein, 29 aa, Artificial Sequence
  Description of Artificial Sequence: Synthetic peptide
QEEEIRTTNPVATEQWGEVPEVEQHAEEA

SEQ ID NO: 107737 - protein, 31 aa, Artificial Sequence
  Description of Artificial Sequence: Synthetic polypeptide
DESEIRSTNPVSTEQYGNVAANTIQSAVGQR

SEQ ID NO: 107738 - protein, 29 aa, Artificial Sequence
  Description of Artificial Sequence: Synthetic peptide
DESEIRSTNPVSTEGYGTISMETIQQGNH

SEQ ID NO: 107739 - protein, 29 aa, Artificial Sequence
  Description of Artificial Sequence: Synthetic peptide
DESEIRSTNPVSTEGYGTISMETIQHGNI

SEQ ID NO: 107740 - protein, 33 aa, Artificial Sequence
  Description of Artificial Sequence: Synthetic polypeptide
DESEIRTTNPCATECWGSVSCINEPQDREGENG

SEQ ID NO: 107741 - protein, 29 aa, Artificial Sequence
  Description of Artificial Sequence: Synthetic peptide
DESEIRSTNPVSTEGYGTISMETIQHGNH

SEQ ID NO: 107742 - protein, 33 aa, Artificial Sequence
  Description of Artificial Sequence: Synthetic polypeptide
DESEIRTTNPCATECWGSVSCINEPQDREGSNG

SEQ ID NO: 107743 - protein, 33 aa, Artificial Sequence
  Description of Artificial Sequence: Synthetic polypeptide
DESEIRTTNPCATECWGSVSCINFPQDREGENG

SEQ ID NO: 107744 - protein, 33 aa, Artificial Sequence
  Description of Artificial Sequence: Synthetic polypeptide
DESEIRTTNPHATECWGSVSCINEPQDREGENG

SEQ ID NO: 107745 - protein, 34 aa, Artificial Sequence
  Description of Artificial Sequence: Synthetic polypeptide
QEEEIRTTNPVATEGYGSVSTMNGFGQENIGGGG

SEQ ID NO: 107746 - protein, 30 aa, Artificial Sequence
  Description of Artificial Sequence: Synthetic polypeptide
QEEEIATTNPVATEQYGTVSTDVCVEFEEK

SEQ ID NO: 107747 - protein, 34 aa, Artificial Sequence
  Description of Artificial Sequence: Synthetic polypeptide
DESEIRTTNPVATECWGSVSCDNEPQDREGENSG

SEQ ID NO: 107748 - protein, 33 aa, Artificial Sequence
  Description of Artificial Sequence: Synthetic polypeptide
DESEIRTTNPHATECWGSVSCINENQDREGENG

SEQ ID NO: 107749 - protein, 33 aa, Artificial Sequence
  Description of Artificial Sequence: Synthetic polypeptide
DESEIRTTNPGATEYWGSVSCINEPQDREGENG

SEQ ID NO: 107750 - protein, 29 aa, Artificial Sequence
  Description of Artificial Sequence: Synthetic peptide
QEEEIATTNPVATEQYGTVPEDVCQHEEK

SEQ ID NO: 107751 - protein, 33 aa, Artificial Sequence
  Description of Artificial Sequence: Synthetic polypeptide
DESEIRTTNPGATECWGSVSCINEPQDREGENG

SEQ ID NO: 107752 - protein, 33 aa, Artificial Sequence
  Description of Artificial Sequence: Synthetic polypeptide
DESEIRTTNPFATECWGSVSCINEPQDREGENG

SEQ ID NO: 107753 - protein, 28 aa, Artificial Sequence
  Description of Artificial Sequence: Synthetic peptide
QEEEIRTTNPVATEPYGEAPEDCQQEEK

SEQ ID NO: 107754 - protein, 33 aa, Artificial Sequence
  Description of Artificial Sequence: Synthetic polypeptide
DESEIRTTNPEATECWGSVSQINEPQDREGENG

SEQ ID NO: 107755 - protein, 33 aa, Artificial Sequence
  Description of Artificial Sequence: Synthetic polypeptide
DESEIRTTNPEATECWGSVSCINEVQDREGENG

SEQ ID NO: 107756 - protein, 33 aa, Artificial Sequence
  Description of Artificial Sequence: Synthetic polypeptide
DESEIRTTNPEATECWGSVSCINEPQDREGQNG

SEQ ID NO: 107757 - protein, 33 aa, Artificial Sequence
  Description of Artificial Sequence: Synthetic polypeptide
DESEIRTTNPEATECWGSVSCINEPQDREGENG

SEQ ID NO: 107758 - protein, 33 aa, Artificial Sequence
  Description of Artificial Sequence: Synthetic polypeptide
DESEIRTTNPDATECWGSVSCINEPQFREGENG

SEQ ID NO: 107759 - protein, 33 aa, Artificial Sequence
  Description of Artificial Sequence: Synthetic polypeptide
DESEIRTTNPDATECWGSVSCINEPQDRSGENG

SEQ ID NO: 107760 - protein, 33 aa, Artificial Sequence
  Description of Artificial Sequence: Synthetic polypeptide
DESEIRTTNPDATECWGSVSCINEPQDREGENG

SEQ ID NO: 107761 - protein, 33 aa, Artificial Sequence
  Description of Artificial Sequence: Synthetic polypeptide
DESEIRTTNPCAYEQWGEVSTNLNQGDTGQNDE

SEQ ID NO: 107762 - protein, 28 aa, Artificial Sequence
  Description of Artificial Sequence: Synthetic peptide
QEEEIRTTNPVATEPYGEAPEDIQHEEK

SEQ ID NO: 107763 - protein, 29 aa, Artificial Sequence
  Description of Artificial Sequence: Synthetic peptide
QEEEIATTNPVATEQYGTVCPEVPQHEEK

SEQ ID NO: 107764 - protein, 28 aa, Artificial Sequence
  Description of Artificial Sequence: Synthetic peptide
QEEEIRTTNPVATEPYGTAPEDCQQEEK

SEQ ID NO: 107765 - protein, 34 aa, Artificial Sequence
  Description of Artificial Sequence: Synthetic polypeptide
DESEIRTTNPCATEQWGSVYCTDNMDQRNGGNHA

SEQ ID NO: 107766 - protein, 33 aa, Artificial Sequence
  Description of Artificial Sequence: Synthetic polypeptide
DESEIRTTNPCATEQWGSVAATNLSQSTGGTST

SEQ ID NO: 107767 - protein, 28 aa, Artificial Sequence
  Description of Artificial Sequence: Synthetic peptide
QEEEIRTTNPVATEPYGTAPEDIQQEEK

SEQ ID NO: 107768 - protein, 29 aa, Artificial Sequence
  Description of Artificial Sequence: Synthetic peptide
QEEEIRTTNPVATEPYGTASEDCQQQEEK

SEQ ID NO: 107769 - protein, 33 aa, Artificial Sequence
  Description of Artificial Sequence: Synthetic polypeptide
DESEIRTTNPCATECWGSVSCINEPQIREGENG

SEQ ID NO: 107770 - protein, 32 aa, Artificial Sequence
  Description of Artificial Sequence: Synthetic polypeptide
DESEIRSTNPVSTEGYGNVATTTIQSRNGNPR

SEQ ID NO: 107771 - protein, 29 aa, Artificial Sequence
  Description of Artificial Sequence: Synthetic peptide
QEEEIRTTNPVATEQWGEVSEVCMHAEEA

SEQ ID NO: 107772 - protein, 31 aa, Artificial Sequence
  Description of Artificial Sequence: Synthetic polypeptide
QEEEIRTTNPVATEQWGSAPCIVEPQDRGEG

SEQ ID NO: 107773 - protein, 33 aa, Artificial Sequence
  Description of Artificial Sequence: Synthetic polypeptide
DESEIRTTNPVATECWGSVSCGNEPQDGEGGNG

SEQ ID NO: 107774 - protein, 31 aa, Artificial Sequence
  Description of Artificial Sequence: Synthetic polypeptide
CEEAIRTTNPVSTEQYGSVCTPNKAVRQIDN

SEQ ID NO: 107775 - protein, 33 aa, Artificial Sequence
  Description of Artificial Sequence: Synthetic polypeptide
DESEIRSTNPVATEGYGSVSATSPALPQHGDPI

SEQ ID NO: 107776 - protein, 34 aa, Artificial Sequence
  Description of Artificial Sequence: Synthetic polypeptide
DESEIRSTNPVATEGYGSVSAATAGQMRVGMQPR

SEQ ID NO: 107777 - protein, 35 aa, Artificial Sequence
  Description of Artificial Sequence: Synthetic polypeptide
QEEEIRTTNPVATEQYGDVSTFTDLGQDEGGGENE

SEQ ID NO: 107778 - protein, 33 aa, Artificial Sequence
  Description of Artificial Sequence: Synthetic polypeptide
QEEEIATTNPVATEQYGSVSTEALPNRNEMEPV

SEQ ID NO: 107779 - protein, 35 aa, Artificial Sequence
  Description of Artificial Sequence: Synthetic polypeptide
QEEEIRTTNPVATEQYGDVSTGGLGQNEGGEGNGV

SEQ ID NO: 107780 - protein, 34 aa, Artificial Sequence
  Description of Artificial Sequence: Synthetic polypeptide
QEEEIRTTNPVATEQYGDVVSISNGFGQTGGNII

SEQ ID NO: 107781 - protein, 32 aa, Artificial Sequence
  Description of Artificial Sequence: Synthetic polypeptide
DESEIRSTNPVATEGWGVVASITEPQDREGNI

SEQ ID NO: 107782 - protein, 35 aa, Artificial Sequence
  Description of Artificial Sequence: Synthetic polypeptide
QEEEIATTNPVATEQYGSVSSTTPAGPQRNGMNPI

SEQ ID NO: 107783 - protein, 31 aa, Artificial Sequence
  Description of Artificial Sequence: Synthetic polypeptide
QEEEIRTTNPVATEQYGEAPCIVEPQDRGEG

SEQ ID NO: 107784 - protein, 30 aa, Artificial Sequence
  Description of Artificial Sequence: Synthetic polypeptide
QEEEIRTTNPVATEQYGEAPCIVEPQHGEG

SEQ ID NO: 107785 - protein, 29 aa, Artificial Sequence
  Description of Artificial Sequence: Synthetic peptide
QEEEIRTTNPVATEQYGEAPCIVEQHEEG

SEQ ID NO: 107786 - protein, 32 aa, Artificial Sequence
  Description of Artificial Sequence: Synthetic polypeptide
DESEIRSTNPVATECWGVVSCINEPQDREGNQ

SEQ ID NO: 107787 - protein, 33 aa, Artificial Sequence
  Description of Artificial Sequence: Synthetic polypeptide
DESEIRSTNPVATECWGSVSSINEPQDREGENG

SEQ ID NO: 107788 - protein, 29 aa, Artificial Sequence
  Description of Artificial Sequence: Synthetic peptide
QEEEIRTTNPVATEQYGEAPCIVEQHEEK

SEQ ID NO: 107789 - protein, 33 aa, Artificial Sequence
  Description of Artificial Sequence: Synthetic polypeptide
DESEIRSTNPVATECWGSVSCINFPQDREGENG

SEQ ID NO: 107790 - protein, 33 aa, Artificial Sequence
  Description of Artificial Sequence: Synthetic polypeptide
DESEIRSTNPVATECWGSVSCINEPQDREGENS

SEQ ID NO: 107791 - protein, 33 aa, Artificial Sequence
  Description of Artificial Sequence: Synthetic polypeptide
DESEIRSTNPVATECWGSVSCINEPQDREGENG

SEQ ID NO: 107792 - protein, 33 aa, Artificial Sequence
  Description of Artificial Sequence: Synthetic polypeptide
DESEIRSTNPVATECWGSVASINEPQDREGENG

SEQ ID NO: 107793 - protein, 33 aa, Artificial Sequence
  Description of Artificial Sequence: Synthetic polypeptide
DESEIRSTNPVATECWGNVSANINEPQDREGNR

SEQ ID NO: 107794 - protein, 32 aa, Artificial Sequence
  Description of Artificial Sequence: Synthetic polypeptide
DESEIRSTNPVATDAYGSVSINGIQGTGNGDG

SEQ ID NO: 107795 - protein, 33 aa, Artificial Sequence
  Description of Artificial Sequence: Synthetic polypeptide
DESEIRRTNPVATECWGSVSCINEPQDREGENG

SEQ ID NO: 107796 - protein, 33 aa, Artificial Sequence
  Description of Artificial Sequence: Synthetic polypeptide
DESEIRQTNPVATECWGSVSCINEPQDREGENG

SEQ ID NO: 107797 - protein, 34 aa, Artificial Sequence
  Description of Artificial Sequence: Synthetic polypeptide
QEEEIATTNPVATEQYGSVSSTPALNMSNGMTPR

SEQ ID NO: 107798 - protein, 33 aa, Artificial Sequence
  Description of Artificial Sequence: Synthetic polypeptide
DESEIRTTNPVATECWGSVSCGNEPQDAEGENG

SEQ ID NO: 107799 - protein, 32 aa, Artificial Sequence
  Description of Artificial Sequence: Synthetic polypeptide
DESEIRSTNPVATEGYGVMASITEPQDREGNI

SEQ ID NO: 107800 - protein, 34 aa, Artificial Sequence
  Description of Artificial Sequence: Synthetic polypeptide
DESEIRTTNPVATECWGSVSCGNEESQDRTGENG

SEQ ID NO: 107801 - protein, 34 aa, Artificial Sequence
  Description of Artificial Sequence: Synthetic polypeptide
AEEEIRTTNPVATEQYGSVVTTNMEQGTNNVTTE

SEQ ID NO: 107802 - protein, 29 aa, Artificial Sequence
  Description of Artificial Sequence: Synthetic peptide
DESEIRSTNPVGTEPYGTMSSTLQQQGDI

SEQ ID NO: 107803 - protein, 29 aa, Artificial Sequence
  Description of Artificial Sequence: Synthetic peptide
DESEIRSTNPVGTEPYGTMSMDLQQQGDI

SEQ ID NO: 107804 - protein, 30 aa, Artificial Sequence
  Description of Artificial Sequence: Synthetic polypeptide
QEEEIATTNPVATEQYGTVCPAEVPQHENK

SEQ ID NO: 107805 - protein, 30 aa, Artificial Sequence
  Description of Artificial Sequence: Synthetic polypeptide
QEEEIATTNPVATEQYGTIPEEVIQQHGNH

SEQ ID NO: 107806 - protein, 31 aa, Artificial Sequence
  Description of Artificial Sequence: Synthetic polypeptide
DESEIRSTNPVGTEGYGVVSSPTLQRNGDPV

SEQ ID NO: 107807 - protein, 32 aa, Artificial Sequence
  Description of Artificial Sequence: Synthetic polypeptide
QEEEIRTTNPVATEQWGSASCIVEPQDREGEG

SEQ ID NO: 107808 - protein, 34 aa, Artificial Sequence
  Description of Artificial Sequence: Synthetic polypeptide
DESEIRSTNPVGTEGYGSVSSTSPTLQMRNGNPV

SEQ ID NO: 107809 - protein, 29 aa, Artificial Sequence
  Description of Artificial Sequence: Synthetic peptide
DESEIRSTNPVGTEGYGDVASTLQAAEDI

SEQ ID NO: 107810 - protein, 29 aa, Artificial Sequence
  Description of Artificial Sequence: Synthetic peptide
DESEIRSTNPVGTEGYGDVASTLQAAEDA

SEQ ID NO: 107811 - protein, 28 aa, Artificial Sequence
  Description of Artificial Sequence: Synthetic peptide
QEEEIATTNPVATEQYGTAPEVPQHEEK

SEQ ID NO: 107812 - protein, 30 aa, Artificial Sequence
  Description of Artificial Sequence: Synthetic polypeptide
DESEIRSTNPVGTEGWGVMSCTLPQRGENG

SEQ ID NO: 107813 - protein, 29 aa, Artificial Sequence
  Description of Artificial Sequence: Synthetic peptide
DESEIRSTNPVGTEGWGVMSCTLPQHGNG

SEQ ID NO: 107814 - protein, 33 aa, Artificial Sequence
  Description of Artificial Sequence: Synthetic polypeptide
DESEIFTTNPVATECWGSVSCINEPQDREGENG

SEQ ID NO: 107815 - protein, 36 aa, Artificial Sequence
  Description of Artificial Sequence: Synthetic polypeptide
AEEEIRTTNPVATEQYGSVSVTTNNQQQGNGNNDEL

SEQ ID NO: 107816 - protein, 28 aa, Artificial Sequence
  Description of Artificial Sequence: Synthetic peptide
QEEEIATTNPVATEQYGTAPEVCQHEEK

SEQ ID NO: 107817 - protein, 31 aa, Artificial Sequence
  Description of Artificial Sequence: Synthetic polypeptide
DESEIRSTNPVGTECWGVVSSITLQDRGENG

SEQ ID NO: 107818 - protein, 36 aa, Artificial Sequence
  Description of Artificial Sequence: Synthetic polypeptide
AEEEIRTTNPVATEQYGSVSVTTNNQLAGNIGTNNE

SEQ ID NO: 107819 - protein, 32 aa, Artificial Sequence
  Description of Artificial Sequence: Synthetic polypeptide
QEEEIRTTNPVATEQYGAVGTDTMDNGGGGGG

SEQ ID NO: 107820 - protein, 34 aa, Artificial Sequence
  Description of Artificial Sequence: Synthetic polypeptide
QEEEIRTTNPVATEQYGAVMSAGNLDEFGQNING

SEQ ID NO: 107821 - protein, 36 aa, Artificial Sequence
  Description of Artificial Sequence: Synthetic polypeptide
AEEEIRTTNPVATEQYGSVSVTTNNQEQGIGTNVED

SEQ ID NO: 107822 - protein, 34 aa, Artificial Sequence
  Description of Artificial Sequence: Synthetic polypeptide
QEEEIRTTNPVATEQYGAVSIDGNGGQNGGNENI

SEQ ID NO: 107823 - protein, 30 aa, Artificial Sequence
  Description of Artificial Sequence: Synthetic polypeptide
DESEIRSTNPVATEQYGVMASTGQHNGDPI

SEQ ID NO: 107824 - protein, 28 aa, Artificial Sequence
  Description of Artificial Sequence: Synthetic peptide
QEEEIATTNPVATEQYGTAPEVCQHEAK

SEQ ID NO: 107825 - protein, 34 aa, Artificial Sequence
  Description of Artificial Sequence: Synthetic polypeptide
DESEIRSTNPVATEQYGSVSTPAGPNMRNGMNPI

SEQ ID NO: 107826 - protein, 35 aa, Artificial Sequence
  Description of Artificial Sequence: Synthetic polypeptide
DESEIRSTNPVATEQYGSVSSTSAGPQMRNGMNPI

SEQ ID NO: 107827 - protein, 34 aa, Artificial Sequence
  Description of Artificial Sequence: Synthetic polypeptide
QEEEIRTTNPVATEQYGDVDTGIQNDGQTGGNED

SEQ ID NO: 107828 - protein, 36 aa, Artificial Sequence
  Description of Artificial Sequence: Synthetic polypeptide
AEEEIRTTNPVATEQYGSVSVTTNNQNQQQGNNTEQ

SEQ ID NO: 107829 - protein, 30 aa, Artificial Sequence
  Description of Artificial Sequence: Synthetic polypeptide
QEEEIATTNPVATEQYGTVSTDVCVEHEEK

SEQ ID NO: 107830 - protein, 33 aa, Artificial Sequence
  Description of Artificial Sequence: Synthetic polypeptide
DESEIETTNPVATECWGSVSCNNEPQDREGENG

SEQ ID NO: 107831 - protein, 33 aa, Artificial Sequence
  Description of Artificial Sequence: Synthetic polypeptide
DESEIETTNPVATECWGSVSCINEPQDRNGENG

SEQ ID NO: 107832 - protein, 30 aa, Artificial Sequence
  Description of Artificial Sequence: Synthetic polypeptide
QEEEIATTNPVATEQYGSAPTEVCQHEMEK

SEQ ID NO: 107833 - protein, 32 aa, Artificial Sequence
  Description of Artificial Sequence: Synthetic polypeptide
DESEIATTNPVAYEQYGSVATADQRENPNTNQ

SEQ ID NO: 107834 - protein, 32 aa, Artificial Sequence
  Description of Artificial Sequence: Synthetic polypeptide
DESEIATTNPVAYEQYGSVATADQNRENPNTD

SEQ ID NO: 107835 - protein, 32 aa, Artificial Sequence
  Description of Artificial Sequence: Synthetic polypeptide
DESEIRTTNPVATECWGSVSCINEMNRAEENG

SEQ ID NO: 107836 - protein, 31 aa, Artificial Sequence
  Description of Artificial Sequence: Synthetic polypeptide
QEEEIATTNPVATEQYGSAPTEPVCQHGMEV

SEQ ID NO: 107837 - protein, 31 aa, Artificial Sequence
  Description of Artificial Sequence: Synthetic polypeptide
QEEEIATTNPVATEQYGSAPTEPVCQHGMEK

SEQ ID NO: 107838 - protein, 35 aa, Artificial Sequence
  Description of Artificial Sequence: Synthetic polypeptide
QEEEIRTTNPVATEQYGSVSPTTPACQMHNGMNPV

SEQ ID NO: 107839 - protein, 35 aa, Artificial Sequence
  Description of Artificial Sequence: Synthetic polypeptide
QEEEIRTTNPVATEQYGSVSPTTPAGNMRNGMNPV

SEQ ID NO: 107840 - protein, 31 aa, Artificial Sequence
  Description of Artificial Sequence: Synthetic polypeptide
DESEIATTNPVAYEQYGSVASSDQRENGTEE

SEQ ID NO: 107841 - protein, 33 aa, Artificial Sequence
  Description of Artificial Sequence: Synthetic polypeptide
DESEIATTNPVAYEQYGSVANTALQREAMGAEM

SEQ ID NO: 107842 - protein, 33 aa, Artificial Sequence
  Description of Artificial Sequence: Synthetic polypeptide
DESEIRTTNPVATECWGSVSCINEMYDREGENG

SEQ ID NO: 107843 - protein, 35 aa, Artificial Sequence
  Description of Artificial Sequence: Synthetic polypeptide
QEEEIRTTNPVATEQYGSVSSTCPAGNMRNGMNPV

SEQ ID NO: 107844 - protein, 35 aa, Artificial Sequence
  Description of Artificial Sequence: Synthetic polypeptide
QEEEIRTTNPVATEQYGSVSSTPAGPNMRNGMNPV

SEQ ID NO: 107845 - protein, 33 aa, Artificial Sequence
  Description of Artificial Sequence: Synthetic polypeptide
DESEIRTTNPVATECWGSVSCINENQDFEGENG

SEQ ID NO: 107846 - protein, 34 aa, Artificial Sequence
  Description of Artificial Sequence: Synthetic polypeptide
QEEEIRTTNPVATEQYGSVSSTTAGPNMRGMDPI

SEQ ID NO: 107847 - protein, 30 aa, Artificial Sequence
  Description of Artificial Sequence: Synthetic polypeptide
QEEEIATTNPVATEQYGSAPEIVCPQHENK

SEQ ID NO: 107848 - protein, 35 aa, Artificial Sequence
  Description of Artificial Sequence: Synthetic polypeptide
QEEEIRTTNPVATEQYGSVSSTTAGPNMRNGMNPV

SEQ ID NO: 107849 - protein, 35 aa, Artificial Sequence
  Description of Artificial Sequence: Synthetic polypeptide
AEEEIRTTNPVATEQYGSVSVTNQQNGTQQGTIGT

SEQ ID NO: 107850 - protein, 36 aa, Artificial Sequence
  Description of Artificial Sequence: Synthetic polypeptide
QEEEIRTTNPVATEQYGSVSSTTPAGPNMRNGMNPR

SEQ ID NO: 107851 - protein, 36 aa, Artificial Sequence
  Description of Artificial Sequence: Synthetic polypeptide
QEEEIRTTNPVATEQYGSVSSTTPAGPNMRNGMNRV

SEQ ID NO: 107852 - protein, 35 aa, Artificial Sequence
  Description of Artificial Sequence: Synthetic polypeptide
QEEEIRTTNPVATEQYGSVSSTTPAGPNRNGMNPV

SEQ ID NO: 107853 - protein, 36 aa, Artificial Sequence
  Description of Artificial Sequence: Synthetic polypeptide
QEEEIRTTNPVATEQYGSVSSTTPAGPQMRNGMNPV

SEQ ID NO: 107854 - protein, 33 aa, Artificial Sequence
  Description of Artificial Sequence: Synthetic polypeptide
DESEIRTTNPVATECWGSVSCINEPADREGENG

SEQ ID NO: 107855 - protein, 33 aa, Artificial Sequence
  Description of Artificial Sequence: Synthetic polypeptide
DESEIATTNPVAYEQYGSVAITDGDQSMGNDRL

SEQ ID NO: 107856 - protein, 33 aa, Artificial Sequence
  Description of Artificial Sequence: Synthetic polypeptide
DESEIRTTNPVATECWGSVSCINEPADRIGENG

SEQ ID NO: 107857 - protein, 32 aa, Artificial Sequence
  Description of Artificial Sequence: Synthetic polypeptide
DESEIATTNPVAYEQYGSVATALQREAMATEM

SEQ ID NO: 107858 - protein, 35 aa, Artificial Sequence
  Description of Artificial Sequence: Synthetic polypeptide
QEEEIRTTNPVATEQYGSVSSTTPCGPNMRGMNPL

SEQ ID NO: 107859 - protein, 33 aa, Artificial Sequence
  Description of Artificial Sequence: Synthetic polypeptide
DESEIRTTNPVATECWGSVSCINEKSDREGENG

SEQ ID NO: 107860 - protein, 35 aa, Artificial Sequence
  Description of Artificial Sequence: Synthetic polypeptide
QEEEIRTTNPVATEQYGSVSNNDNMDQGGGETNND

SEQ ID NO: 107861 - protein, 31 aa, Artificial Sequence
  Description of Artificial Sequence: Synthetic polypeptide
DESEIATTNPVGTECYGVVSCNEPQDHEGNG

SEQ ID NO: 107862 - protein, 32 aa, Artificial Sequence
  Description of Artificial Sequence: Synthetic polypeptide
DESEIATTNPVGTECYGSVSCINEPQDHEGNG

SEQ ID NO: 107863 - protein, 36 aa, Artificial Sequence
  Description of Artificial Sequence: Synthetic polypeptide
AEEEIRTTNPVATEQYGSVSVTSNNNQQQNIGTNVN

SEQ ID NO: 107864 - protein, 36 aa, Artificial Sequence
  Description of Artificial Sequence: Synthetic polypeptide
AEEEIRTTNPVATEQYGSVVTTVNNLQAGTTENSES

SEQ ID NO: 107865 - protein, 32 aa, Artificial Sequence
  Description of Artificial Sequence: Synthetic polypeptide
QEEEIATTNPVATEQYGSASSTEPAGNRGMEV

SEQ ID NO: 107866 - protein, 29 aa, Artificial Sequence
  Description of Artificial Sequence: Synthetic peptide
DESEIATTNPVGTECWGVMACNLQREGDI

SEQ ID NO: 107867 - protein, 33 aa, Artificial Sequence
  Description of Artificial Sequence: Synthetic polypeptide
QEEEIRTTNPVATEQYGSVSDMDMIQRIDDDGG

SEQ ID NO: 107868 - protein, 34 aa, Artificial Sequence
  Description of Artificial Sequence: Synthetic polypeptide
DESEIRTTNPVATECWGSVSCINEHQDREGENGL

SEQ ID NO: 107869 - protein, 29 aa, Artificial Sequence
  Description of Artificial Sequence: Synthetic peptide
DESEIATTNPVGTECWGVMACNEQREGNI

SEQ ID NO: 107870 - protein, 32 aa, Artificial Sequence
  Description of Artificial Sequence: Synthetic polypeptide
QEEEIATTNPVATEQYGSASSEPAGQMRENPK

SEQ ID NO: 107871 - protein, 33 aa, Artificial Sequence
  Description of Artificial Sequence: Synthetic polypeptide
QEEEIRTTNPVATEQYGSVSDVGMGLNGGGEGG

SEQ ID NO: 107872 - protein, 36 aa, Artificial Sequence
  Description of Artificial Sequence: Synthetic polypeptide
AEEEIRTTNPVATEQYGSVSVTSNLEQGVTTNNNNI

SEQ ID NO: 107873 - protein, 31 aa, Artificial Sequence
  Description of Artificial Sequence: Synthetic polypeptide
QEEEIATTNPVATEQYGSASSEPAGQMREEK

SEQ ID NO: 107874 - protein, 34 aa, Artificial Sequence
  Description of Artificial Sequence: Synthetic polypeptide
DESEIRTTNPVATECWGSVSCINEHSQDREGGNT

SEQ ID NO: 107875 - protein, 34 aa, Artificial Sequence
  Description of Artificial Sequence: Synthetic polypeptide
QEEEIRTTNPVATEQYGSVSGGNGGGDGETGNEA

SEQ ID NO: 107876 - protein, 34 aa, Artificial Sequence
  Description of Artificial Sequence: Synthetic polypeptide
QEEEIRTTNPVATEQYGSVSGLGNIGQGNDGEEG

SEQ ID NO: 107877 - protein, 35 aa, Artificial Sequence
  Description of Artificial Sequence: Synthetic polypeptide
QEEEIRTTNPVATEQYGSVSGTDGQTGDGNGNEDQ

SEQ ID NO: 107878 - protein, 31 aa, Artificial Sequence
  Description of Artificial Sequence: Synthetic polypeptide
DESEIATTNPVCTECYGVVSCNEPQDSEGNG

SEQ ID NO: 107879 - protein, 32 aa, Artificial Sequence
  Description of Artificial Sequence: Synthetic polypeptide
DESEIATTNPVCTECWGSVSDNLPQDSEGENQ

SEQ ID NO: 107880 - protein, 30 aa, Artificial Sequence
  Description of Artificial Sequence: Synthetic polypeptide
QEEEIATTNPVATEQYGSASEVLEHEEEDK

SEQ ID NO: 107881 - protein, 35 aa, Artificial Sequence
  Description of Artificial Sequence: Synthetic polypeptide
QEEEIRTTNPVATEQYGSVSIDNNGIQEGEGENEE

SEQ ID NO: 107882 - protein, 31 aa, Artificial Sequence
  Description of Artificial Sequence: Synthetic polypeptide
DESEIATTNPVCTECWGSVSCNEPQSEGENG

SEQ ID NO: 107883 - protein, 32 aa, Artificial Sequence
  Description of Artificial Sequence: Synthetic polypeptide
DESEIATTNPVAYEQYGSVSATDLDDHEGEDL

SEQ ID NO: 107884 - protein, 32 aa, Artificial Sequence
  Description of Artificial Sequence: Synthetic polypeptide
QEEEIATTNPVATEQYGSASATVLEDHEGEDL

SEQ ID NO: 107885 - protein, 31 aa, Artificial Sequence
  Description of Artificial Sequence: Synthetic polypeptide
DESEIATTNPVAYEQYGSVATSDIRENPNTE

SEQ ID NO: 107886 - protein, 35 aa, Artificial Sequence
  Description of Artificial Sequence: Synthetic polypeptide
QEEEIRTTNPVATEQYGSVSNNDVMNQGEMGNGDN

SEQ ID NO: 107887 - protein, 30 aa, Artificial Sequence
  Description of Artificial Sequence: Synthetic polypeptide
DESEIATTNPVGTEGWGSMACNLQREGEDI

SEQ ID NO: 107888 - protein, 33 aa, Artificial Sequence
  Description of Artificial Sequence: Synthetic polypeptide
DESEIATTNPVAYEQYGSVAITDGDQRNGNDSL

SEQ ID NO: 107889 - protein, 33 aa, Artificial Sequence
  Description of Artificial Sequence: Synthetic polypeptide
DESEIATTNPVAYEQYGSVAIANNDQQAGNDRL

SEQ ID NO: 107890 - protein, 28 aa, Artificial Sequence
  Description of Artificial Sequence: Synthetic peptide
QEEEIATTNPVATEQYGNAPEVCQHEEK

SEQ ID NO: 107891 - protein, 33 aa, Artificial Sequence
  Description of Artificial Sequence: Synthetic polypeptide
DESEIRTTNPVATECWGSVSCINEPMDREGCNG

SEQ ID NO: 107892 - protein, 33 aa, Artificial Sequence
  Description of Artificial Sequence: Synthetic polypeptide
DESEIRTTNPVATECWGSVSCINEPMDREGENG

SEQ ID NO: 107893 - protein, 36 aa, Artificial Sequence
  Description of Artificial Sequence: Synthetic polypeptide
AEEEIRTTNPVATEQYGSVSVTNNNQQQGNGNNTEM

SEQ ID NO: 107894 - protein, 36 aa, Artificial Sequence
  Description of Artificial Sequence: Synthetic polypeptide
QEEEIRTTNPVATEQYGSVSTTDNGLGLEINGANIQ

SEQ ID NO: 107895 - protein, 29 aa, Artificial Sequence
  Description of Artificial Sequence: Synthetic peptide
QEEEIATTNPVATEQYGNAPETCQSHGEK

SEQ ID NO: 107896 - protein, 32 aa, Artificial Sequence
  Description of Artificial Sequence: Synthetic polypeptide
DESEIATTNPVATTHWGSVSWTENDDQRTSNM

SEQ ID NO: 107897 - protein, 28 aa, Artificial Sequence
  Description of Artificial Sequence: Synthetic peptide
QEEEIATTNPVATEQYGNAPETCQHEEK

SEQ ID NO: 107898 - protein, 34 aa, Artificial Sequence
  Description of Artificial Sequence: Synthetic polypeptide
DESEIRTTNPVATECWGSVSCINEPMDREGENRG

SEQ ID NO: 107899 - protein, 37 aa, Artificial Sequence
  Description of Artificial Sequence: Synthetic polypeptide
AEEEIRTTNPVATEQYGSVSVTNNNNQQLQNGNNQDE

SEQ ID NO: 107900 - protein, 29 aa, Artificial Sequence
  Description of Artificial Sequence: Synthetic peptide
DESEIATTNPVATEQYGVMATTPVEHGDD

SEQ ID NO: 107901 - protein, 33 aa, Artificial Sequence
  Description of Artificial Sequence: Synthetic polypeptide
DESEIRTTNPVATECWGSVSCINEPMNRAGENG

SEQ ID NO: 107902 - protein, 34 aa, Artificial Sequence
  Description of Artificial Sequence: Synthetic polypeptide
QEEEIRTTNPVATEQYGSVTDTDNIGQSGEQGGT

SEQ ID NO: 107903 - protein, 33 aa, Artificial Sequence
  Description of Artificial Sequence: Synthetic polypeptide
DESEIRTTNPVATECWGSVSCINEPMNREGENG

SEQ ID NO: 107904 - protein, 30 aa, Artificial Sequence
  Description of Artificial Sequence: Synthetic polypeptide
DESEIATTNPVATEQYGTVSSGPVEFEGDD

SEQ ID NO: 107905 - protein, 36 aa, Artificial Sequence
  Description of Artificial Sequence: Synthetic polypeptide
AEEEIRTTNPVATEQYGSVSVTNNNNQQLQGNNQDE

SEQ ID NO: 107906 - protein, 36 aa, Artificial Sequence
  Description of Artificial Sequence: Synthetic polypeptide
AEEEIRTTNPVATEQYGSVSVTNNNNQQGNGNNDEV

SEQ ID NO: 107907 - protein, 33 aa, Artificial Sequence
  Description of Artificial Sequence: Synthetic polypeptide
DESEIATTNPVATEQYGTVCSATDGPVQFEGND

SEQ ID NO: 107908 - protein, 33 aa, Artificial Sequence
  Description of Artificial Sequence: Synthetic polypeptide
QEEEIRTTNPVATEQYGSVTTDIMDNGGNGGQG

SEQ ID NO: 107909 - protein, 28 aa, Artificial Sequence
  Description of Artificial Sequence: Synthetic peptide
QEEEIATTNPVATEQYGMAVEVQQHEEK

SEQ ID NO: 107910 - protein, 33 aa, Artificial Sequence
  Description of Artificial Sequence: Synthetic polypeptide
DESEIRTTNPVATECWGSVSCINEPNDREGENG

SEQ ID NO: 107911 - protein, 33 aa, Artificial Sequence
  Description of Artificial Sequence: Synthetic polypeptide
DESEIRTTNPVATECWGSVSCINEPNDRNGENG

SEQ ID NO: 107912 - protein, 33 aa, Artificial Sequence
  Description of Artificial Sequence: Synthetic polypeptide
QEEEIRTTNPVATEQYGSVVGTTTMDNDGGGQG

SEQ ID NO: 107913 - protein, 34 aa, Artificial Sequence
  Description of Artificial Sequence: Synthetic polypeptide
QEEEIRTTNPVATEQYGSVVGTTTVLNGLGEGFG

SEQ ID NO: 107914 - protein, 33 aa, Artificial Sequence
  Description of Artificial Sequence: Synthetic polypeptide
DESEIATTNPVATEQYGSVVSATDLEDHEGEDL

SEQ ID NO: 107915 - protein, 33 aa, Artificial Sequence
  Description of Artificial Sequence: Synthetic polypeptide
DESEIRTTNPVATECWGSVSCINEPKDREGENQ

SEQ ID NO: 107916 - protein, 33 aa, Artificial Sequence
  Description of Artificial Sequence: Synthetic polypeptide
DESEIRTTNPVATECWGSVSCINEPADRTGENG

SEQ ID NO: 107917 - protein, 33 aa, Artificial Sequence
  Description of Artificial Sequence: Synthetic polypeptide
DESEIRTTNPVATECWGSVSCINEPKDREGENG

SEQ ID NO: 107918 - protein, 33 aa, Artificial Sequence
  Description of Artificial Sequence: Synthetic polypeptide
DESEIRTTNPVATECWGSVSCINEPIDRCGENG

SEQ ID NO: 107919 - protein, 32 aa, Artificial Sequence
  Description of Artificial Sequence: Synthetic polypeptide
DESEIATTNPVAYEQYGSVAGTADQRENPNGD

SEQ ID NO: 107920 - protein, 32 aa, Artificial Sequence
  Description of Artificial Sequence: Synthetic polypeptide
DESEIATTNPVAYEQYGSVAATSLPRENPNTE

SEQ ID NO: 107921 - protein, 33 aa, Artificial Sequence
  Description of Artificial Sequence: Synthetic polypeptide
DESEIRTTNPVATECWGSVSCINEPCDREGENG

SEQ ID NO: 107922 - protein, 31 aa, Artificial Sequence
  Description of Artificial Sequence: Synthetic polypeptide
DESEIATTNPVAYEQYGSVAATNEQAQTLTD

SEQ ID NO: 107923 - protein, 33 aa, Artificial Sequence
  Description of Artificial Sequence: Synthetic polypeptide
DESEIATTNPVAYEQYGSVAATALQREAMNAEM

SEQ ID NO: 107924 - protein, 33 aa, Artificial Sequence
  Description of Artificial Sequence: Synthetic polypeptide
DESEIRTTNPVATECWGSVSCINEPDDREGENG

SEQ ID NO: 107925 - protein, 33 aa, Artificial Sequence
  Description of Artificial Sequence: Synthetic polypeptide
DESEIRTTNPVATECWGSVSCINEPEDREGENG

SEQ ID NO: 107926 - protein, 31 aa, Artificial Sequence
  Description of Artificial Sequence: Synthetic polypeptide
DESEIATTNPVAYEQYGSVAASLPREAGTED

SEQ ID NO: 107927 - protein, 29 aa, Artificial Sequence
  Description of Artificial Sequence: Synthetic peptide
QEEEIATTNPVATEQYGSAPAEVCQHEEK

SEQ ID NO: 107928 - protein, 34 aa, Artificial Sequence
  Description of Artificial Sequence: Synthetic polypeptide
DESEIATTNPVAYEQYGSIVCAANNLQDSDGNRN

SEQ ID NO: 107929 - protein, 28 aa, Artificial Sequence
  Description of Artificial Sequence: Synthetic peptide
QEEEIATTNPVATEQYGRAPEVCQHEEK

SEQ ID NO: 107930 - protein, 28 aa, Artificial Sequence
  Description of Artificial Sequence: Synthetic peptide
QEEEIATTNPVATEQYGQAPEVCQHEKK

SEQ ID NO: 107931 - protein, 32 aa, Artificial Sequence
  Description of Artificial Sequence: Synthetic polypeptide
DESEIATTNPVAYEQWGSVCQTNDQGEGNNNL

SEQ ID NO: 107932 - protein, 33 aa, Artificial Sequence
  Description of Artificial Sequence: Synthetic polypeptide
DESEIRTTNPVATECWGSVSCINEPFDREGENG

SEQ ID NO: 107933 - protein, 34 aa, Artificial Sequence
  Description of Artificial Sequence: Synthetic polypeptide
QEEEIRTTNPVATEQYGSVSTGVGDDEGGEGNIP

SEQ ID NO: 107934 - protein, 31 aa, Artificial Sequence
  Description of Artificial Sequence: Synthetic polypeptide
DESEIATTNPVAYEQWGEVSTNVNGDINGRE

SEQ ID NO: 107935 - protein, 28 aa, Artificial Sequence
  Description of Artificial Sequence: Synthetic peptide
QEEEIATTNPVATEQYGQAPEVCQHEEK

SEQ ID NO: 107936 - protein, 30 aa, Artificial Sequence
  Description of Artificial Sequence: Synthetic polypeptide
QEEEIATTNPVATEQYGNVPEVCQSHVGQK

SEQ ID NO: 107937 - protein, 33 aa, Artificial Sequence
  Description of Artificial Sequence: Synthetic polypeptide
DESEIRTTNPVATECWGSVSCINEPGDREGENG

SEQ ID NO: 107938 - protein, 33 aa, Artificial Sequence
  Description of Artificial Sequence: Synthetic polypeptide
DESEIRTTNPVATECWGSVSCINEPGDREGKNG

SEQ ID NO: 107939 - protein, 33 aa, Artificial Sequence
  Description of Artificial Sequence: Synthetic polypeptide
DESEIRTTNPVATECWGSVSCINEPGDREGQNG

SEQ ID NO: 107940 - protein, 36 aa, Artificial Sequence
  Description of Artificial Sequence: Synthetic polypeptide
AEEEIRTTNPVATEQYGSVSVTNNQNGTEQGTNEEQ

SEQ ID NO: 107941 - protein, 33 aa, Artificial Sequence
  Description of Artificial Sequence: Synthetic polypeptide
DESEIRTTNPVATECWGSVSCINEPGDRQGENG

SEQ ID NO: 107942 - protein, 33 aa, Artificial Sequence
  Description of Artificial Sequence: Synthetic polypeptide
DESEIRTTNPVATECWGSVSCINEPHDREGENG

SEQ ID NO: 107943 - protein, 30 aa, Artificial Sequence
  Description of Artificial Sequence: Synthetic polypeptide
DESEIATTNPVAYDPHYGSASANLQDTGDM

SEQ ID NO: 107944 - protein, 33 aa, Artificial Sequence
  Description of Artificial Sequence: Synthetic polypeptide
DESEIRTTNPVATECWGSVSCINEPIDREGENG

SEQ ID NO: 107945 - protein, 32 aa, Artificial Sequence
  Description of Artificial Sequence: Synthetic polypeptide
DESEIATTNPVGTEGWGSVACNLPQDREGENI

SEQ ID NO: 107946 - protein, 33 aa, Artificial Sequence
  Description of Artificial Sequence: Synthetic polypeptide
DESEIRTTNPVATECWGSVSCINEHQDMEGENG

SEQ ID NO: 107947 - protein, 34 aa, Artificial Sequence
  Description of Artificial Sequence: Synthetic polypeptide
AEEEIRTTNPVATEQYGSVSVTTADEQGNDENQS

SEQ ID NO: 107948 - protein, 33 aa, Artificial Sequence
  Description of Artificial Sequence: Synthetic polypeptide
QEEEIRTTNPVATEQYGSCVSPEHAEEVQGTRW

SEQ ID NO: 107949 - protein, 33 aa, Artificial Sequence
  Description of Artificial Sequence: Synthetic polypeptide
DESEICTTNPVATEPWGSVSTGDNHQQSGGNTI

SEQ ID NO: 107950 - protein, 35 aa, Artificial Sequence
  Description of Artificial Sequence: Synthetic polypeptide
AEEEIRTTNPVATEQYGSVSVTTNNDNAQGTNVNQ

SEQ ID NO: 107951 - protein, 33 aa, Artificial Sequence
  Description of Artificial Sequence: Synthetic polypeptide
DESEIRTTNPVATECWGSVSCIMEPQDREGENG

SEQ ID NO: 107952 - protein, 34 aa, Artificial Sequence
  Description of Artificial Sequence: Synthetic polypeptide
DESEIRTTNPVATECWGSVSCINAEPQDREGENG

SEQ ID NO: 107953 - protein, 35 aa, Artificial Sequence
  Description of Artificial Sequence: Synthetic polypeptide
DESEIRTTNPVATECWGSVSCINAEPQDREGENRG

SEQ ID NO: 107954 - protein, 33 aa, Artificial Sequence
  Description of Artificial Sequence: Synthetic polypeptide
DESEIRTTNPVATECWGSVSCINAPQDREGECG

SEQ ID NO: 107955 - protein, 33 aa, Artificial Sequence
  Description of Artificial Sequence: Synthetic polypeptide
DESEICTTNPVATEPWGSVSTGDNHQQSGGNTH

SEQ ID NO: 107956 - protein, 34 aa, Artificial Sequence
  Description of Artificial Sequence: Synthetic polypeptide
DESEIRTTNPVATECWGSVSCINCEPQDREGDNG

SEQ ID NO: 107957 - protein, 34 aa, Artificial Sequence
  Description of Artificial Sequence: Synthetic polypeptide
DESEIRTTNPVATECWGSVSCINCEPQDREGENG

SEQ ID NO: 107958 - protein, 32 aa, Artificial Sequence
  Description of Artificial Sequence: Synthetic polypeptide
DESEIRTTNPVATECWGSVSCINCPQDREEEG

SEQ ID NO: 107959 - protein, 33 aa, Artificial Sequence
  Description of Artificial Sequence: Synthetic polypeptide
DESEICTTNPVATEHYGEVSTGQLGDIGGGNQR

SEQ ID NO: 107960 - protein, 33 aa, Artificial Sequence
  Description of Artificial Sequence: Synthetic polypeptide
DESEIRTTNPVATECWGSVSCINCPQDREGEEK

SEQ ID NO: 107961 - protein, 33 aa, Artificial Sequence
  Description of Artificial Sequence: Synthetic polypeptide
DESEICTTNPVATECWGSVSCINEPQERMGENG

SEQ ID NO: 107962 - protein, 33 aa, Artificial Sequence
  Description of Artificial Sequence: Synthetic polypeptide
DESEICTTNPVATECWGSVSCINEPQDREGGNG

SEQ ID NO: 107963 - protein, 33 aa, Artificial Sequence
  Description of Artificial Sequence: Synthetic polypeptide
DESEICTTNPVATECWGSVSCINEPQDREGENG

SEQ ID NO: 107964 - protein, 33 aa, Artificial Sequence
  Description of Artificial Sequence: Synthetic polypeptide
DESEICTTNPAATEQYGSVPGNNLQGGGGNGDD

SEQ ID NO: 107965 - protein, 35 aa, Artificial Sequence
  Description of Artificial Sequence: Synthetic polypeptide
AEEEIRTTNPVATEQYGSVVTTTNNLAGTEGGNTD

SEQ ID NO: 107966 - protein, 37 aa, Artificial Sequence
  Description of Artificial Sequence: Synthetic polypeptide
AEEEIRTTNPVATEQYGSVSVTTNLLNNNQQGTNQTE

SEQ ID NO: 107967 - protein, 35 aa, Artificial Sequence
  Description of Artificial Sequence: Synthetic polypeptide
QEEEIRTTNPVATEQYGSVDNTDNINQNEGEGNIT

SEQ ID NO: 107968 - protein, 35 aa, Artificial Sequence
  Description of Artificial Sequence: Synthetic polypeptide
QEEEIRTTNPVATEQYGSVDSTMDFQQDIGGNNGD

SEQ ID NO: 107969 - protein, 30 aa, Artificial Sequence
  Description of Artificial Sequence: Synthetic polypeptide
DESEIATVNPVCTECWGVVSDINEQREGNQ

SEQ ID NO: 107970 - protein, 30 aa, Artificial Sequence
  Description of Artificial Sequence: Synthetic polypeptide
DESEIATVNPVCTECWGVVSCINEQREGNQ

SEQ ID NO: 107971 - protein, 35 aa, Artificial Sequence
  Description of Artificial Sequence: Synthetic polypeptide
QEEEIRTTNPVATEQYGSVDTDDNTDQGEGGNDQG

SEQ ID NO: 107972 - protein, 34 aa, Artificial Sequence
  Description of Artificial Sequence: Synthetic polypeptide
DESEIRTTNPVATECWGSVSCINDEPQDREGENG

SEQ ID NO: 107973 - protein, 33 aa, Artificial Sequence
  Description of Artificial Sequence: Synthetic polypeptide
DESEIRTTNPVATECWGSVSCIMENQDREGENG

SEQ ID NO: 107974 - protein, 32 aa, Artificial Sequence
  Description of Artificial Sequence: Synthetic polypeptide
DESEIATVNPVATEQYGVVSDINEPQDSEGNQ

SEQ ID NO: 107975 - protein, 36 aa, Artificial Sequence
  Description of Artificial Sequence: Synthetic polypeptide
AEEEIRTTNPVATEQYGSVSVTTNNDQAGNIGTNNQ

SEQ ID NO: 107976 - protein, 36 aa, Artificial Sequence
  Description of Artificial Sequence: Synthetic polypeptide
AEEEIRTTNPVATEQYGSVSVTTNNDQQGNNNNDET

SEQ ID NO: 107977 - protein, 32 aa, Artificial Sequence
  Description of Artificial Sequence: Synthetic polypeptide
QEEEIRTTNPVATEQYGEVSPTPACQMHEEPV

SEQ ID NO: 107978 - protein, 33 aa, Artificial Sequence
  Description of Artificial Sequence: Synthetic polypeptide
DESEIETTNPVATECWGSVSCINEPQDREGENG

SEQ ID NO: 107979 - protein, 33 aa, Artificial Sequence
  Description of Artificial Sequence: Synthetic polypeptide
QEEEIRTTNPVATEQYGEVSPTPACQMHNEEPV

SEQ ID NO: 107980 - protein, 33 aa, Artificial Sequence
  Description of Artificial Sequence: Synthetic polypeptide
DESEIDTTNPVATECWGSVSCINEPQDREGENG

SEQ ID NO: 107981 - protein, 33 aa, Artificial Sequence
  Description of Artificial Sequence: Synthetic polypeptide
DESEIRTTNPVATECWGSVSCIIEPQDREGENG

SEQ ID NO: 107982 - protein, 33 aa, Artificial Sequence
  Description of Artificial Sequence: Synthetic polypeptide
DESEICTVNPVAYEQYGSVPSTNELSTEGGNNH

SEQ ID NO: 107983 - protein, 37 aa, Artificial Sequence
  Description of Artificial Sequence: Synthetic polypeptide
AEEEIRTTNPVATEQYGSVSVTTNNLQQGDEGTNNEE

SEQ ID NO: 107984 - protein, 34 aa, Artificial Sequence
  Description of Artificial Sequence: Synthetic polypeptide
QEEEIRTTNPVATEQYGMVGSILNLNEGGNGNGV

SEQ ID NO: 107985 - protein, 35 aa, Artificial Sequence
  Description of Artificial Sequence: Synthetic polypeptide
QEEEIATTNPVATEQYGSVCSTNPLPQDSGGSMEE

SEQ ID NO: 107986 - protein, 32 aa, Artificial Sequence
  Description of Artificial Sequence: Synthetic polypeptide
DESEIRTTNPVATECWGSVSCIIEQDAAGENA

SEQ ID NO: 107987 - protein, 32 aa, Artificial Sequence
  Description of Artificial Sequence: Synthetic polypeptide
DESEIRTTNPVATECWGSVSCIIEQDAEGENA

SEQ ID NO: 107988 - protein, 33 aa, Artificial Sequence
  Description of Artificial Sequence: Synthetic polypeptide
DESEICTTNPVATEQYGTVSTVTDGPNENEGND

SEQ ID NO: 107989 - protein, 33 aa, Artificial Sequence
  Description of Artificial Sequence: Synthetic polypeptide
DESEICTTNPVATEQYGTVSTATDGGVEQEGND

SEQ ID NO: 107990 - protein, 33 aa, Artificial Sequence
  Description of Artificial Sequence: Synthetic polypeptide
DESEICTTNPVATEQYGTVCSATDGNVEFGGND

SEQ ID NO: 107991 - protein, 34 aa, Artificial Sequence
  Description of Artificial Sequence: Synthetic polypeptide
DESEICTTNPVATEQYGSVSINGLMGERGQEGEI

SEQ ID NO: 107992 - protein, 34 aa, Artificial Sequence
  Description of Artificial Sequence: Synthetic polypeptide
DESEICTTNPVATEQYGSVSINGLGGEDGQGGEE

SEQ ID NO: 107993 - protein, 32 aa, Artificial Sequence
  Description of Artificial Sequence: Synthetic polypeptide
QEEEIATTNPVATEQYGSVCATNNEFDGDQTN

SEQ ID NO: 107994 - protein, 33 aa, Artificial Sequence
  Description of Artificial Sequence: Synthetic polypeptide
DESEIRTTNPVATECWGSVSCIKEPQDREGANG

SEQ ID NO: 107995 - protein, 33 aa, Artificial Sequence
  Description of Artificial Sequence: Synthetic polypeptide
DESEIRTTNPVATECWGSVSCIKEPQDREGENG

SEQ ID NO: 107996 - protein, 33 aa, Artificial Sequence
  Description of Artificial Sequence: Synthetic polypeptide
QEEEIRTTNPVATEQYGNVMTDDDDQEEGIGNI

SEQ ID NO: 107997 - protein, 34 aa, Artificial Sequence
  Description of Artificial Sequence: Synthetic polypeptide
AEEEIRTTNPVATEQYGSVVTTNQGGTEQGNNQN

SEQ ID NO: 107998 - protein, 32 aa, Artificial Sequence
  Description of Artificial Sequence: Synthetic polypeptide
CEEEIACTNPVATEPYGSVATNLQTRNPAEAH

SEQ ID NO: 107999 - protein, 33 aa, Artificial Sequence
  Description of Artificial Sequence: Synthetic polypeptide
DESEIRTTNPVATECWGSVSCILEPQDVEGENG

SEQ ID NO: 108000 - protein, 35 aa, Artificial Sequence
  Description of Artificial Sequence: Synthetic polypeptide
AEEEIRTTNPVATEQYGSVSVTTNNGNQQQGEEQD

SEQ ID NO: 108001 - protein, 36 aa, Artificial Sequence
  Description of Artificial Sequence: Synthetic polypeptide
AEEEIRTTNPVATEQYGSVSVTTNNGNGNQQGNNQD

SEQ ID NO: 108002 - protein, 35 aa, Artificial Sequence
  Description of Artificial Sequence: Synthetic polypeptide
QEEEIRTTNPVATEQYGSCGSTGDLGQGGEQEDIR

SEQ ID NO: 108003 - protein, 36 aa, Artificial Sequence
  Description of Artificial Sequence: Synthetic polypeptide
AEEEIRTTNPVATEQYGSVVTTTNNLEQGTEGGNTN

SEQ ID NO: 108004 - protein, 32 aa, Artificial Sequence
  Description of Artificial Sequence: Synthetic polypeptide
DESEIATVNPVATEQWGSVSDINEPQDSEGNG

SEQ ID NO: 108005 - protein, 31 aa, Artificial Sequence
  Description of Artificial Sequence: Synthetic polypeptide
DESEIATVNPVATECWGVVSCINEQDREGNQ

SEQ ID NO: 108006 - protein, 34 aa, Artificial Sequence
  Description of Artificial Sequence: Synthetic polypeptide
DESEIRTTNPVATECWGSVSCINEDQDREGENGA

SEQ ID NO: 108007 - protein, 33 aa, Artificial Sequence
  Description of Artificial Sequence: Synthetic polypeptide
QEEEIRTTNPVATEQYGSVGTTTVLNNNGQTFG

SEQ ID NO: 108008 - protein, 34 aa, Artificial Sequence
  Description of Artificial Sequence: Synthetic polypeptide
DESEIRTTNPVATECWGSVSCINEDQDREGENGE

SEQ ID NO: 108009 - protein, 34 aa, Artificial Sequence
  Description of Artificial Sequence: Synthetic polypeptide
QEEEIRTTNPVATEQYGSVISTGGNGQGEEDEFQ

SEQ ID NO: 108010 - protein, 34 aa, Artificial Sequence
  Description of Artificial Sequence: Synthetic polypeptide
DESEIRTTNPVATECWGSVSCINEEPQDREGENG

SEQ ID NO: 108011 - protein, 33 aa, Artificial Sequence
  Description of Artificial Sequence: Synthetic polypeptide
QEEEIATTNPVATEQYGSVAATANLDEANNNVY

SEQ ID NO: 108012 - protein, 33 aa, Artificial Sequence
  Description of Artificial Sequence: Synthetic polypeptide
QEEEIRTTNPVATEQYGSVMSGMFNNGQGEVGI

SEQ ID NO: 108013 - protein, 35 aa, Artificial Sequence
  Description of Artificial Sequence: Synthetic polypeptide
QEEEIRTTNPVATEQYGSVMSGMNNDNQEEGFNIF

SEQ ID NO: 108014 - protein, 33 aa, Artificial Sequence
  Description of Artificial Sequence: Synthetic polypeptide
DESEIRTTNPVATECWGSVSCINEEQDTEGENG

SEQ ID NO: 108015 - protein, 35 aa, Artificial Sequence
  Description of Artificial Sequence: Synthetic polypeptide
QEEEIRTTNPVATEQYGSVNSDGSGNLEDDGENGG

SEQ ID NO: 108016 - protein, 30 aa, Artificial Sequence
  Description of Artificial Sequence: Synthetic polypeptide
DESEIATTNPVGTEGYGVVSSTAGNHGMNV

SEQ ID NO: 108017 - protein, 29 aa, Artificial Sequence
  Description of Artificial Sequence: Synthetic peptide
DESEIATTNPVGTEGYGVMSSTLQQQGDI

SEQ ID NO: 108018 - protein, 35 aa, Artificial Sequence
  Description of Artificial Sequence: Synthetic polypeptide
QEEEIRTTNPVATEQYGSVNTDNMDGQGEGENEGE

SEQ ID NO: 108019 - protein, 34 aa, Artificial Sequence
  Description of Artificial Sequence: Synthetic polypeptide
QEEEIRTTNPVATEQYGSVNTDNMIETGGGNQTG

SEQ ID NO: 108020 - protein, 34 aa, Artificial Sequence
  Description of Artificial Sequence: Synthetic polypeptide
QEEEIRTTNPVATEQYGSVNTDNMVETGGNEEQG

SEQ ID NO: 108021 - protein, 32 aa, Artificial Sequence
  Description of Artificial Sequence: Synthetic polypeptide
QEEEIRTTNPVATEQYGSVNTDTMDGGGGGQG

SEQ ID NO: 108022 - protein, 36 aa, Artificial Sequence
  Description of Artificial Sequence: Synthetic polypeptide
AEEEIRTTNPVATEQYGSVVTTVNLQSNEEGTNNND

SEQ ID NO: 108023 - protein, 34 aa, Artificial Sequence
  Description of Artificial Sequence: Synthetic polypeptide
QEEEIATTNPVATEQYGSMSSTTPAGPQRGMNPI

SEQ ID NO: 108024 - protein, 28 aa, Artificial Sequence
  Description of Artificial Sequence: Synthetic peptide
DESEIATTNPVGTEGYGVMASTLEHGDD

SEQ ID NO: 108025 - protein, 33 aa, Artificial Sequence
  Description of Artificial Sequence: Synthetic polypeptide
DESEIRTTNPVATECWGSVSCINEFWDREGENG

SEQ ID NO: 108026 - protein, 29 aa, Artificial Sequence
  Description of Artificial Sequence: Synthetic peptide
DESEIATTNPVGTEGYGVISSTLQQQGDI

SEQ ID NO: 108027 - protein, 32 aa, Artificial Sequence
  Description of Artificial Sequence: Synthetic polypeptide
DESEIATTNPVGTEGYGSMSCINEQDREGENG

SEQ ID NO: 108028 - protein, 30 aa, Artificial Sequence
  Description of Artificial Sequence: Synthetic polypeptide
DESEIATTNPVGTEGYGSMACTLQREGEDI

SEQ ID NO: 108029 - protein, 29 aa, Artificial Sequence
  Description of Artificial Sequence: Synthetic peptide
DESEIATTNPVGTEGYGSMACTLQHGEDI

SEQ ID NO: 108030 - protein, 35 aa, Artificial Sequence
  Description of Artificial Sequence: Synthetic polypeptide
QEEEIRTTNPVATEQYGSVQTDNDQVGEGEEGNIE

SEQ ID NO: 108031 - protein, 29 aa, Artificial Sequence
  Description of Artificial Sequence: Synthetic peptide
DESEIATTNPVGTEQYGVMASDLQHEGDL

SEQ ID NO: 108032 - protein, 32 aa, Artificial Sequence
  Description of Artificial Sequence: Synthetic polypeptide
QEEEIRTTNPVATEQYGSVGTTTVDNGGQTFG

SEQ ID NO: 108033 - protein, 33 aa, Artificial Sequence
  Description of Artificial Sequence: Synthetic polypeptide
QEEEIRTTNPVATEQYGSVGTTTVDNEGEGGFG

SEQ ID NO: 108034 - protein, 32 aa, Artificial Sequence
  Description of Artificial Sequence: Synthetic polypeptide
QEEEIRTTNPVATEQYGSVGTTTMDNGGGDGG

SEQ ID NO: 108035 - protein, 31 aa, Artificial Sequence
  Description of Artificial Sequence: Synthetic polypeptide
DESEIATVNPVATECWGVVSCINEQDREGNG

SEQ ID NO: 108036 - protein, 33 aa, Artificial Sequence
  Description of Artificial Sequence: Synthetic polypeptide
DESEIRTTNPVATECWGSVSCINDPQDREGETG

SEQ ID NO: 108037 - protein, 32 aa, Artificial Sequence
  Description of Artificial Sequence: Synthetic polypeptide
QEEEIATTNPVATEQYGSVATGPPDNPGGGPD

SEQ ID NO: 108038 - protein, 34 aa, Artificial Sequence
  Description of Artificial Sequence: Synthetic polypeptide
QEEEIRTTNPVATEQYGSVGSGMGGGQNEDGEIR

SEQ ID NO: 108039 - protein, 32 aa, Artificial Sequence
  Description of Artificial Sequence: Synthetic polypeptide
DESEIATTNPVSTEQWGSVSCINEPQREGETG

SEQ ID NO: 108040 - protein, 34 aa, Artificial Sequence
  Description of Artificial Sequence: Synthetic polypeptide
DESEIRTTNPVATECWGSVSCINEAQDREGENGQ

SEQ ID NO: 108041 - protein, 35 aa, Artificial Sequence
  Description of Artificial Sequence: Synthetic polypeptide
QEEEIRTTNPVATEQYGSVGSNNDEMQGQGENNDA

SEQ ID NO: 108042 - protein, 29 aa, Artificial Sequence
  Description of Artificial Sequence: Synthetic peptide
DESEIATTNPVSTEPYGVISSDLQQQGDI

SEQ ID NO: 108043 - protein, 30 aa, Artificial Sequence
  Description of Artificial Sequence: Synthetic polypeptide
DESEIATTNPVSTEPYGVISMTIQQQNGNH

SEQ ID NO: 108044 - protein, 35 aa, Artificial Sequence
  Description of Artificial Sequence: Synthetic polypeptide
QEEEIRTTNPVATEQYGSVGSTVNGMGQNEEGGQG

SEQ ID NO: 108045 - protein, 29 aa, Artificial Sequence
  Description of Artificial Sequence: Synthetic peptide
DESEIATTNPVSTEGYGVISSDLQQQGDI

SEQ ID NO: 108046 - protein, 30 aa, Artificial Sequence
  Description of Artificial Sequence: Synthetic polypeptide
DESEIATTNPVSTEGYGTMSSTIQQHNGNH

SEQ ID NO: 108047 - protein, 33 aa, Artificial Sequence
  Description of Artificial Sequence: Synthetic polypeptide
DESEIRTTNPVATECWGSVSCIIEPQDREGENA

SEQ ID NO: 108048 - protein, 36 aa, Artificial Sequence
  Description of Artificial Sequence: Synthetic polypeptide
AEEEIRTTNPVATEQYGSVVTTTNNLQQGTEQGNDT

SEQ ID NO: 108049 - protein, 31 aa, Artificial Sequence
  Description of Artificial Sequence: Synthetic polypeptide
DESEIATTNPVSTEGYGSVANITEQSRVGQR

SEQ ID NO: 108050 - protein, 32 aa, Artificial Sequence
  Description of Artificial Sequence: Synthetic polypeptide
DESEIATTNPVSTEGYGSVAATDLQDHEGQDR

SEQ ID NO: 108051 - protein, 31 aa, Artificial Sequence
  Description of Artificial Sequence: Synthetic polypeptide
DESEIATTNPVSTEGYGSVAATDIQSRVGQL

SEQ ID NO: 108052 - protein, 31 aa, Artificial Sequence
  Description of Artificial Sequence: Synthetic polypeptide
DESEIATTNPVSTEGYGSVAANDIQSRVGQL

SEQ ID NO: 108053 - protein, 31 aa, Artificial Sequence
  Description of Artificial Sequence: Synthetic polypeptide
DESEIATTNPVSTEGYGNVSANDIQSHEGER

SEQ ID NO: 108054 - protein, 33 aa, Artificial Sequence
  Description of Artificial Sequence: Synthetic polypeptide
QEEEIATTNPVATEQYGSVAATDLQTAPGPQHS

SEQ ID NO: 108055 - protein, 33 aa, Artificial Sequence
  Description of Artificial Sequence: Synthetic polypeptide
QEEEIRTTNPVATEQYGSVGTDTMDNGGNGGFG

SEQ ID NO: 108056 - protein, 34 aa, Artificial Sequence
  Description of Artificial Sequence: Synthetic polypeptide
QEEEIRTTNPVATEQYGSVGTTGNMDNGGGENGE

SEQ ID NO: 108057 - protein, 32 aa, Artificial Sequence
  Description of Artificial Sequence: Synthetic polypeptide
DESEIATTNPVSSEQWGSVSCINEPQDREGTR

SEQ ID NO: 108058 - protein, 33 aa, Artificial Sequence
  Description of Artificial Sequence: Synthetic polypeptide
QEEEIRTTNPVATEQYGSVGTTMTVGNGGEGFG

SEQ ID NO: 108059 - protein, 33 aa, Artificial Sequence
  Description of Artificial Sequence: Synthetic polypeptide
QEEEIRTTNPVATEQYGSVGTTTMDNDGGGEEG

SEQ ID NO: 108060 - protein, 30 aa, Artificial Sequence
  Description of Artificial Sequence: Synthetic polypeptide
DESEIATTNPVGTEQYGVMATDLQDHEGDI

SEQ ID NO: 108061 - protein, 34 aa, Artificial Sequence
  Description of Artificial Sequence: Synthetic polypeptide
QEEEIRTTNPVATEQYGSVGTDNMTVLNGGGGFG

SEQ ID NO: 108062 - protein, 36 aa, Artificial Sequence
  Description of Artificial Sequence: Synthetic polypeptide
AEEEIRTTNPVATEQYGSVSVTTNQLQGNNDENEED

SEQ ID NO: 108063 - protein, 33 aa, Artificial Sequence
  Description of Artificial Sequence: Synthetic polypeptide
DESEIRTTNPVATECWGSVSCDNEPQDMEGENG

SEQ ID NO: 108064 - protein, 33 aa, Artificial Sequence
  Description of Artificial Sequence: Synthetic polypeptide
DESEIRTTNPIATECWGSVSCINEPLDREGENG

SEQ ID NO: 108065 - protein, 28 aa, Artificial Sequence
  Description of Artificial Sequence: Synthetic peptide
QEEEIATTNPVSTEQYGEASCVCQSEEK

SEQ ID NO: 108066 - protein, 34 aa, Artificial Sequence
  Description of Artificial Sequence: Synthetic polypeptide
DESEIRTTNPVATECWGSVCSCLNEPQDREGENG

SEQ ID NO: 108067 - protein, 33 aa, Artificial Sequence
  Description of Artificial Sequence: Synthetic polypeptide
DESEIRTTNPVATECWGIVSCINEPQEREGENG

SEQ ID NO: 108068 - protein, 33 aa, Artificial Sequence
  Description of Artificial Sequence: Synthetic polypeptide
DESEIRTTNPVATECWGIVSCINEPQDRGGENG

SEQ ID NO: 108069 - protein, 33 aa, Artificial Sequence
  Description of Artificial Sequence: Synthetic polypeptide
DESEIRTTNPVATECWGIVSCINEPQDREGENG

SEQ ID NO: 108070 - protein, 33 aa, Artificial Sequence
  Description of Artificial Sequence: Synthetic polypeptide
DESEIRTTNPVATECWGIVSCILEPQDREGENG

SEQ ID NO: 108071 - protein, 34 aa, Artificial Sequence
  Description of Artificial Sequence: Synthetic polypeptide
DESEIRTTNPVATECWGISVSCINESQDREGGNG

SEQ ID NO: 108072 - protein, 28 aa, Artificial Sequence
  Description of Artificial Sequence: Synthetic peptide
QEEEIATTNPVSTEQYGEAPEVLQHETK

SEQ ID NO: 108073 - protein, 34 aa, Artificial Sequence
  Description of Artificial Sequence: Synthetic polypeptide
DESEIRTTNPVATECWGISVSCINEPQDREGENG

SEQ ID NO: 108074 - protein, 37 aa, Artificial Sequence
  Description of Artificial Sequence: Synthetic polypeptide
AEEEIRTTNPVATEQYGSVSVVVTTNLNQQGTTNEQT

SEQ ID NO: 108075 - protein, 34 aa, Artificial Sequence
  Description of Artificial Sequence: Synthetic polypeptide
DESEIRTTNPVATECWGSVCSWMNEEQDREGSNQ

SEQ ID NO: 108076 - protein, 33 aa, Artificial Sequence
  Description of Artificial Sequence: Synthetic polypeptide
DESEIRTTNPVATECWGHVSCINEPQDREGENT

SEQ ID NO: 108077 - protein, 34 aa, Artificial Sequence
  Description of Artificial Sequence: Synthetic polypeptide
DESEIRTTNPVATECWGSVCSWNNENQDRFGSNQ

SEQ ID NO: 108078 - protein, 33 aa, Artificial Sequence
  Description of Artificial Sequence: Synthetic polypeptide
DESEIRTTNPVATECWGHVSCINEPQDREGENG

SEQ ID NO: 108079 - protein, 33 aa, Artificial Sequence
  Description of Artificial Sequence: Synthetic polypeptide
DESEIRTTNPVATECWGHVSCINAPQDREGENG

SEQ ID NO: 108080 - protein, 34 aa, Artificial Sequence
  Description of Artificial Sequence: Synthetic polypeptide
DESEIRTTNPVATECWGHSVSDINEPQDREGENG

SEQ ID NO: 108081 - protein, 34 aa, Artificial Sequence
  Description of Artificial Sequence: Synthetic polypeptide
DESEIRTTNPVATECWGHSVSCINEPQDREGENG

SEQ ID NO: 108082 - protein, 37 aa, Artificial Sequence
  Description of Artificial Sequence: Synthetic polypeptide
AEEEIRTTNPVATEQYGSVSVVVSTNLEQGSEGGNNL

SEQ ID NO: 108083 - protein, 34 aa, Artificial Sequence
  Description of Artificial Sequence: Synthetic polypeptide
DESEIRTTNPVATECWGHSVSCINEDQDREGENG

SEQ ID NO: 108084 - protein, 33 aa, Artificial Sequence
  Description of Artificial Sequence: Synthetic polypeptide
DESEIRTTNPVATECWGGVSCINPPQDREGENG

SEQ ID NO: 108085 - protein, 33 aa, Artificial Sequence
  Description of Artificial Sequence: Synthetic polypeptide
DESEIRTTNPVATECWGGVSCINEPQMREGENG

SEQ ID NO: 108086 - protein, 33 aa, Artificial Sequence
  Description of Artificial Sequence: Synthetic polypeptide
DESEIRTTNPVATECWGGVSCINEPQDREGENG

SEQ ID NO: 108087 - protein, 34 aa, Artificial Sequence
  Description of Artificial Sequence: Synthetic polypeptide
DESEIRTTNPVATECWGGSVSCINESQDREGENG

SEQ ID NO: 108088 - protein, 34 aa, Artificial Sequence
  Description of Artificial Sequence: Synthetic polypeptide
DESEIRTTNPVATECWGGSVSCINEPQNREGENG

SEQ ID NO: 108089 - protein, 34 aa, Artificial Sequence
  Description of Artificial Sequence: Synthetic polypeptide
DESEIRTTNPVATECWGGSVSCINEPQDREGENI

SEQ ID NO: 108090 - protein, 32 aa, Artificial Sequence
  Description of Artificial Sequence: Synthetic polypeptide
DESEIRTTNPVATECWGIVSCINEPQREGETG

SEQ ID NO: 108091 - protein, 34 aa, Artificial Sequence
  Description of Artificial Sequence: Synthetic polypeptide
DESEIRTTNPVATECWGGSVSCINEPQDREGENG

SEQ ID NO: 108092 - protein, 34 aa, Artificial Sequence
  Description of Artificial Sequence: Synthetic polypeptide
DESEIRTTNPVATECWGSVCSCINPPQDREGENG

SEQ ID NO: 108093 - protein, 34 aa, Artificial Sequence
  Description of Artificial Sequence: Synthetic polypeptide
DESEIRTTNPVATECWGKSVSCINEPQDREGENG

SEQ ID NO: 108094 - protein, 33 aa, Artificial Sequence
  Description of Artificial Sequence: Synthetic polypeptide
DESEIRTTNPVATECWGNVSCINEPQWREGENG

SEQ ID NO: 108095 - protein, 33 aa, Artificial Sequence
  Description of Artificial Sequence: Synthetic polypeptide
DESEIRTTNPVATECWGNVSCINEPQQREGENG

SEQ ID NO: 108096 - protein, 33 aa, Artificial Sequence
  Description of Artificial Sequence: Synthetic polypeptide
DESEIRTTNPVATECWGNVSCINEPQDREGENG

SEQ ID NO: 108097 - protein, 34 aa, Artificial Sequence
  Description of Artificial Sequence: Synthetic polypeptide
DESEIRTTNPVATECWGSVASCINEPQDREGENG

SEQ ID NO: 108098 - protein, 34 aa, Artificial Sequence
  Description of Artificial Sequence: Synthetic polypeptide
DESEIRTTNPVATECWGSVASCINEVQDREGENG

SEQ ID NO: 108099 - protein, 33 aa, Artificial Sequence
  Description of Artificial Sequence: Synthetic polypeptide
DESEIRTTNPVATECWGSVCCINEPQDREGENG

SEQ ID NO: 108100 - protein, 33 aa, Artificial Sequence
  Description of Artificial Sequence: Synthetic polypeptide
DESEIRTTNPVATECWGSVCCINEPQDREGYNG

SEQ ID NO: 108101 - protein, 33 aa, Artificial Sequence
  Description of Artificial Sequence: Synthetic polypeptide
DESEIRTTNPVATECWGSVCCINEPQDRNGENG

SEQ ID NO: 108102 - protein, 34 aa, Artificial Sequence
  Description of Artificial Sequence: Synthetic polypeptide
DESEIRTTNPVATECWGNSVSQINEPQDREGENG

SEQ ID NO: 108103 - protein, 28 aa, Artificial Sequence
  Description of Artificial Sequence: Synthetic peptide
QEEEIATTNPVSTEQYGEASEVCQHETK

SEQ ID NO: 108104 - protein, 34 aa, Artificial Sequence
  Description of Artificial Sequence: Synthetic polypeptide
DESEIRTTNPVATECWGNSVSCINEPQDREGENG

SEQ ID NO: 108105 - protein, 33 aa, Artificial Sequence
  Description of Artificial Sequence: Synthetic polypeptide
DESEIRTTNPVATECWGMVSCLNEPQDREGENG

SEQ ID NO: 108106 - protein, 33 aa, Artificial Sequence
  Description of Artificial Sequence: Synthetic polypeptide
DESEIRTTNPVATECWGMVSCINFPQDREGENG

SEQ ID NO: 108107 - protein, 33 aa, Artificial Sequence
  Description of Artificial Sequence: Synthetic polypeptide
DESEIRTTNPVATECWGMVSCINEPQDREGENG

SEQ ID NO: 108108 - protein, 34 aa, Artificial Sequence
  Description of Artificial Sequence: Synthetic polypeptide
DESEIRTTNPVATECWGMSVSCINEPQDREGENG

SEQ ID NO: 108109 - protein, 34 aa, Artificial Sequence
  Description of Artificial Sequence: Synthetic polypeptide
DESEIRTTNPVATECWGMSVSCINEPLDREGENG

SEQ ID NO: 108110 - protein, 34 aa, Artificial Sequence
  Description of Artificial Sequence: Synthetic polypeptide
DESEIRTTNPVATECWGSVCSCINEPQDREGEND

SEQ ID NO: 108111 - protein, 33 aa, Artificial Sequence
  Description of Artificial Sequence: Synthetic polypeptide
DESEIRTTNPVATECWGLVSCINEPQDRMGENG

SEQ ID NO: 108112 - protein, 33 aa, Artificial Sequence
  Description of Artificial Sequence: Synthetic polypeptide
DESEIRTTNPVATECWGLVSCINEPQDREGENG

SEQ ID NO: 108113 - protein, 34 aa, Artificial Sequence
  Description of Artificial Sequence: Synthetic polypeptide
DESEIRTTNPVATECWGLSVSCYNEPQDREGENG

SEQ ID NO: 108114 - protein, 34 aa, Artificial Sequence
  Description of Artificial Sequence: Synthetic polypeptide
DESEIRTTNPVATECWGLSVSCINEPQDREGENG

SEQ ID NO: 108115 - protein, 33 aa, Artificial Sequence
  Description of Artificial Sequence: Synthetic polypeptide
DESEIRTTNPVATECWGKVSDINEPQDREGENG

SEQ ID NO: 108116 - protein, 33 aa, Artificial Sequence
  Description of Artificial Sequence: Synthetic polypeptide
DESEIRTTNPVATECWGKVSCINEPQDREGENG

SEQ ID NO: 108117 - protein, 34 aa, Artificial Sequence
  Description of Artificial Sequence: Synthetic polypeptide
DESEIRTTNPVATECWGKSVSLINEPQDREGENG

SEQ ID NO: 108118 - protein, 34 aa, Artificial Sequence
  Description of Artificial Sequence: Synthetic polypeptide
DESEIRTTNPVATECWGSVCSCINEPQDREGENG

SEQ ID NO: 108119 - protein, 33 aa, Artificial Sequence
  Description of Artificial Sequence: Synthetic polypeptide
DESEIRTTNPVATECWGSVCSCINPPQDFEGNG

SEQ ID NO: 108120 - protein, 32 aa, Artificial Sequence
  Description of Artificial Sequence: Synthetic polypeptide
DESEIRTTNPVATECWGSVACINWQDPEGENG

SEQ ID NO: 108121 - protein, 33 aa, Artificial Sequence
  Description of Artificial Sequence: Synthetic polypeptide
DESEIRTTNPVATECWGFVSCINEPQDREGENG

SEQ ID NO: 108122 - protein, 34 aa, Artificial Sequence
  Description of Artificial Sequence: Synthetic polypeptide
DESEIRTTNPVATECWGFSVSCINEPQDREGENG

SEQ ID NO: 108123 - protein, 36 aa, Artificial Sequence
  Description of Artificial Sequence: Synthetic polypeptide
AEEEIRTTNPVATEQYGSVSVVTNNNNNNQEGNNNQ

SEQ ID NO: 108124 - protein, 33 aa, Artificial Sequence
  Description of Artificial Sequence: Synthetic polypeptide
DESEIRTTNPVATECWGSVGCINDPQDREGENG

SEQ ID NO: 108125 - protein, 33 aa, Artificial Sequence
  Description of Artificial Sequence: Synthetic polypeptide
DESEIRTTNPVATECWGDVSCINEPQDREGENL

SEQ ID NO: 108126 - protein, 33 aa, Artificial Sequence
  Description of Artificial Sequence: Synthetic polypeptide
DESEIRTTNPVATECWGSVGCINEPQDREGENG

SEQ ID NO: 108127 - protein, 37 aa, Artificial Sequence
  Description of Artificial Sequence: Synthetic polypeptide
AEEEIRTTNPVATEQYGSVSVVTNNNLNNQAGNNNNQ

SEQ ID NO: 108128 - protein, 37 aa, Artificial Sequence
  Description of Artificial Sequence: Synthetic polypeptide
AEEEIRTTNPVATEQYGSVSVVTNNNLNNNQQGNNNQ

SEQ ID NO: 108129 - protein, 34 aa, Artificial Sequence
  Description of Artificial Sequence: Synthetic polypeptide
DESEIRTTNPVATECWGSVGPSINEPQAREGENG

SEQ ID NO: 108130 - protein, 33 aa, Artificial Sequence
  Description of Artificial Sequence: Synthetic polypeptide
DESEIRTTNPVATECWGDVSCINEPQDREGENG

SEQ ID NO: 108131 - protein, 34 aa, Artificial Sequence
  Description of Artificial Sequence: Synthetic polypeptide
DESEIRTTNPVATECWGSVGSCINEPQDREGENG

SEQ ID NO: 108132 - protein, 34 aa, Artificial Sequence
  Description of Artificial Sequence: Synthetic polypeptide
DESEIRTTNPVATECWGSVGSCINEPQDREGFNG

SEQ ID NO: 108133 - protein, 36 aa, Artificial Sequence
  Description of Artificial Sequence: Synthetic polypeptide
AEEEIRTTNPVATEQYGSVSVVTNNLGNQAGEETDE

SEQ ID NO: 108134 - protein, 33 aa, Artificial Sequence
  Description of Artificial Sequence: Synthetic polypeptide
DESEIRTTNPVATECWGSVHCINEPQDREGENC

SEQ ID NO: 108135 - protein, 33 aa, Artificial Sequence
  Description of Artificial Sequence: Synthetic polypeptide
DESEIRTTNPVATECWGSVHCINEPQDREGENG

SEQ ID NO: 108136 - protein, 34 aa, Artificial Sequence
  Description of Artificial Sequence: Synthetic polypeptide
DESEIRTTNPVATECWGDSVSCINEPQDREGENG

SEQ ID NO: 108137 - protein, 36 aa, Artificial Sequence
  Description of Artificial Sequence: Synthetic polypeptide
AEEEIRTTNPVATEQYGSVSVVSTNQQQGTTTNNQD

SEQ ID NO: 108138 - protein, 34 aa, Artificial Sequence
  Description of Artificial Sequence: Synthetic polypeptide
DESEIRTTNPVATECWGSVHSCINEPQDREGENG

SEQ ID NO: 108139 - protein, 37 aa, Artificial Sequence
  Description of Artificial Sequence: Synthetic polypeptide
AEEEIRTTNPVATEQYGSVSVVSTNLQQGTQGNNNQD

SEQ ID NO: 108140 - protein, 33 aa, Artificial Sequence
  Description of Artificial Sequence: Synthetic polypeptide
DESEIRTTNPVATECWGCVSSMNEPQDRFGSNA

SEQ ID NO: 108141 - protein, 33 aa, Artificial Sequence
  Description of Artificial Sequence: Synthetic polypeptide
DESEIRTTNPVATECWGCVSCINEPQDREGENG

SEQ ID NO: 108142 - protein, 34 aa, Artificial Sequence
  Description of Artificial Sequence: Synthetic polypeptide
DESEIRTTNPVATECWGCSVSCINEPQDREGENG

SEQ ID NO: 108143 - protein, 35 aa, Artificial Sequence
  Description of Artificial Sequence: Synthetic polypeptide
AEEEIRTTNPVATEQYGSVSVVSNNQQGTDGGNQD

SEQ ID NO: 108144 - protein, 33 aa, Artificial Sequence
  Description of Artificial Sequence: Synthetic polypeptide
DESEIRTTNPVATECWGAVSCPNEPQDREGENG

SEQ ID NO: 108145 - protein, 33 aa, Artificial Sequence
  Description of Artificial Sequence: Synthetic polypeptide
DESEIRTTNPVATECWGAVSCINEPQDREGENG

SEQ ID NO: 108146 - protein, 33 aa, Artificial Sequence
  Description of Artificial Sequence: Synthetic polypeptide
DESEIRTTNPVATECWGSVICINEPQDREGENG

SEQ ID NO: 108147 - protein, 33 aa, Artificial Sequence
  Description of Artificial Sequence: Synthetic polypeptide
DESEIRTTNPVATECWGAVSCINEEQDREGENG

SEQ ID NO: 108148 - protein, 34 aa, Artificial Sequence
  Description of Artificial Sequence: Synthetic polypeptide
DESEIRTTNPVATECWGSVFSCINEPQDREGENG

SEQ ID NO: 108149 - protein, 33 aa, Artificial Sequence
  Description of Artificial Sequence: Synthetic polypeptide
DESEIRTTNPVATECWGFVSCINEPQDREGENC

SEQ ID NO: 108150 - protein, 32 aa, Artificial Sequence
  Description of Artificial Sequence: Synthetic polypeptide
DESEIRTTNPVATECWGDVSCINEPQREGEEL

SEQ ID NO: 108151 - protein, 32 aa, Artificial Sequence
  Description of Artificial Sequence: Synthetic polypeptide
DESEIRTTNPVATECWGDVSCINEQDREGEDG

SEQ ID NO: 108152 - protein, 34 aa, Artificial Sequence
  Description of Artificial Sequence: Synthetic polypeptide
DESEIRTTNPVATECWGEVSTCINEPQDREGENG

SEQ ID NO: 108153 - protein, 32 aa, Artificial Sequence
  Description of Artificial Sequence: Synthetic polypeptide
DESEIRTTNPVATECWGEVSCNEPQDREGMWG

SEQ ID NO: 108154 - protein, 33 aa, Artificial Sequence
  Description of Artificial Sequence: Synthetic polypeptide
DESEIRTTNPVATECWGSVDCINEPQDREGENG

SEQ ID NO: 108155 - protein, 34 aa, Artificial Sequence
  Description of Artificial Sequence: Synthetic polypeptide
DESEIRTTNPVATECWGSVDSCINEPQDREGENG

SEQ ID NO: 108156 - protein, 34 aa, Artificial Sequence
  Description of Artificial Sequence: Synthetic polypeptide
DESEIRTTNPVATECWGSVDSCINEPQDREGPNG

SEQ ID NO: 108157 - protein, 33 aa, Artificial Sequence
  Description of Artificial Sequence: Synthetic polypeptide
DESEIRTTNPVATECWGEVSCINEPQDREGENG

SEQ ID NO: 108158 - protein, 33 aa, Artificial Sequence
  Description of Artificial Sequence: Synthetic polypeptide
DESEIRTTNPVATECWGEVSCINEPQDREGEGR

SEQ ID NO: 108159 - protein, 32 aa, Artificial Sequence
  Description of Artificial Sequence: Synthetic polypeptide
DESEIRTTNPVATECWGEVPCINEPQDREGNG

SEQ ID NO: 108160 - protein, 34 aa, Artificial Sequence
  Description of Artificial Sequence: Synthetic polypeptide
DESEIRTTNPVATECWGESVSCINEPQDREGENG

SEQ ID NO: 108161 - protein, 34 aa, Artificial Sequence
  Description of Artificial Sequence: Synthetic polypeptide
DESEIRTTNPVATECWGESVSCINEPQDREGANG

SEQ ID NO: 108162 - protein, 33 aa, Artificial Sequence
  Description of Artificial Sequence: Synthetic polypeptide
DESEIRTTNPVATECWGSVECINEMQDREGENG

SEQ ID NO: 108163 - protein, 33 aa, Artificial Sequence
  Description of Artificial Sequence: Synthetic polypeptide
DESEIRTTNPVATECWGSVECINEPQDREGENG

SEQ ID NO: 108164 - protein, 34 aa, Artificial Sequence
  Description of Artificial Sequence: Synthetic polypeptide
DESEIRTTNPVATECWGSVESCINAPQDREGENG

SEQ ID NO: 108165 - protein, 34 aa, Artificial Sequence
  Description of Artificial Sequence: Synthetic polypeptide
DESEIRTTNPVATECWGSVESCINEPQDREGENG

SEQ ID NO: 108166 - protein, 34 aa, Artificial Sequence
  Description of Artificial Sequence: Synthetic polypeptide
DESEIRTTNPVATECWGSVETCINEPQDREGENG

SEQ ID NO: 108167 - protein, 36 aa, Artificial Sequence
  Description of Artificial Sequence: Synthetic polypeptide
AEEEIRTTNPVATEQYGSVSVVTNNQNQQQGTNNSE

SEQ ID NO: 108168 - protein, 28 aa, Artificial Sequence
  Description of Artificial Sequence: Synthetic peptide
QEEEIATTNPVSTEQYGEAPEVLQHEEK

SEQ ID NO: 108169 - protein, 30 aa, Artificial Sequence
  Description of Artificial Sequence: Synthetic polypeptide
DESEIRTTNPVATECWGEASCINCQHEGEK

SEQ ID NO: 108170 - protein, 28 aa, Artificial Sequence
  Description of Artificial Sequence: Synthetic peptide
QEEEIATTNPVSTEQYGEAPEVIQHENK

SEQ ID NO: 108171 - protein, 32 aa, Artificial Sequence
  Description of Artificial Sequence: Synthetic polypeptide
DESEIRTTNPVATECWGDVSCNLPQDHEGEEL

SEQ ID NO: 108172 - protein, 33 aa, Artificial Sequence
  Description of Artificial Sequence: Synthetic polypeptide
DESEIRTTNPVATECWGSVFCINEPQDREGENG

SEQ ID NO: 108173 - protein, 32 aa, Artificial Sequence
  Description of Artificial Sequence: Synthetic polypeptide
DESEIRTTNPVATECWGDVSCNEPQDREGEEG

SEQ ID NO: 108174 - protein, 32 aa, Artificial Sequence
  Description of Artificial Sequence: Synthetic polypeptide
DESEIRTTNPVATECWGDVSCNEPQDREGEDG

SEQ ID NO: 108175 - protein, 33 aa, Artificial Sequence
  Description of Artificial Sequence: Synthetic polypeptide
DESEIRTTNPVATECWGSVFCWNEPQDREGENG

SEQ ID NO: 108176 - protein, 34 aa, Artificial Sequence
  Description of Artificial Sequence: Synthetic polypeptide
DESEIRTTNPVATECWGSVFSAINEPQDREGENG

SEQ ID NO: 108177 - protein, 36 aa, Artificial Sequence
  Description of Artificial Sequence: Synthetic polypeptide
AEEEIRTTNPVATEQYGSVSVVTNNNNTQQGNNDNQ

SEQ ID NO: 108178 - protein, 36 aa, Artificial Sequence
  Description of Artificial Sequence: Synthetic polypeptide
AEEEIRTTNPVATEQYGSVTTTNNLQQGNNGIGETD

SEQ ID NO: 108179 - protein, 31 aa, Artificial Sequence
  Description of Artificial Sequence: Synthetic polypeptide
DESEIRTTNPVATECWGSVACINWADPEGNG

SEQ ID NO: 108180 - protein, 34 aa, Artificial Sequence
  Description of Artificial Sequence: Synthetic polypeptide
DESEIRTTNPVATECWGPSVSCINEPQDREGENG

SEQ ID NO: 108181 - protein, 33 aa, Artificial Sequence
  Description of Artificial Sequence: Synthetic polypeptide
DESEIRTTNPVATECWGSNSCINGPQDREGENG

SEQ ID NO: 108182 - protein, 33 aa, Artificial Sequence
  Description of Artificial Sequence: Synthetic polypeptide
DESEIRTTNPVATECWGSNSCINEPQDREGENG

SEQ ID NO: 108183 - protein, 34 aa, Artificial Sequence
  Description of Artificial Sequence: Synthetic polypeptide
DESEIRTTNPVATECWGSMVSCINEPQDREGENG

SEQ ID NO: 108184 - protein, 32 aa, Artificial Sequence
  Description of Artificial Sequence: Synthetic polypeptide
QEEEICTTNPTAYAQYGSVATNLQHAGGNDMN

SEQ ID NO: 108185 - protein, 33 aa, Artificial Sequence
  Description of Artificial Sequence: Synthetic polypeptide
DESEIRTTNPVATECWGSMSCINPPQDREGENG

SEQ ID NO: 108186 - protein, 33 aa, Artificial Sequence
  Description of Artificial Sequence: Synthetic polypeptide
DESEIRTTNPVATECWGSTSCINEPQDRKGENG

SEQ ID NO: 108187 - protein, 33 aa, Artificial Sequence
  Description of Artificial Sequence: Synthetic polypeptide
DESEIRTTNPVATECWGSMSCINEPQDREGENG

SEQ ID NO: 108188 - protein, 34 aa, Artificial Sequence
  Description of Artificial Sequence: Synthetic polypeptide
DESEIRTTNPVATECWGSTVSAINEPQDREGENG

SEQ ID NO: 108189 - protein, 35 aa, Artificial Sequence
  Description of Artificial Sequence: Synthetic polypeptide
DESEIRTTNPVATECWGSLVSCINEPQDREGENRG

SEQ ID NO: 108190 - protein, 36 aa, Artificial Sequence
  Description of Artificial Sequence: Synthetic polypeptide
AEEEIRTTNPVATEQYGSVTVVVTNLQQGNAEEDEE

SEQ ID NO: 108191 - protein, 34 aa, Artificial Sequence
  Description of Artificial Sequence: Synthetic polypeptide
DESEIRTTNPVATECWGSLVSCINEPQDREGENG

SEQ ID NO: 108192 - protein, 33 aa, Artificial Sequence
  Description of Artificial Sequence: Synthetic polypeptide
DESEIRTTNPVATECWGSLSCINEPQNREGENG

SEQ ID NO: 108193 - protein, 33 aa, Artificial Sequence
  Description of Artificial Sequence: Synthetic polypeptide
DESEIRTTNPVATECWGSLSCINEPQDREGENG

SEQ ID NO: 108194 - protein, 34 aa, Artificial Sequence
  Description of Artificial Sequence: Synthetic polypeptide
DESEIRTTNPVATECWGSKVSCINEPQGREGENG

SEQ ID NO: 108195 - protein, 34 aa, Artificial Sequence
  Description of Artificial Sequence: Synthetic polypeptide
DESEIRTTNPVATECWGSKVSCINEPQDREGENT

SEQ ID NO: 108196 - protein, 34 aa, Artificial Sequence
  Description of Artificial Sequence: Synthetic polypeptide
DESEIRTTNPVATECWGSKVSCINEPQDREGENG

SEQ ID NO: 108197 - protein, 28 aa, Artificial Sequence
  Description of Artificial Sequence: Synthetic peptide
QEEEICTTNPVATEQYGEAPEVCQHEEK

SEQ ID NO: 108198 - protein, 33 aa, Artificial Sequence
  Description of Artificial Sequence: Synthetic polypeptide
DESEIRTTNPVATECWGSKSCINEPQDREGENG

SEQ ID NO: 108199 - protein, 33 aa, Artificial Sequence
  Description of Artificial Sequence: Synthetic polypeptide
DESEIRTTNPVATECWGSKSCINEPQDRDGENG

SEQ ID NO: 108200 - protein, 33 aa, Artificial Sequence
  Description of Artificial Sequence: Synthetic polypeptide
DESEIRTTNPVATECWGSKSCINDPQDREGENG

SEQ ID NO: 108201 - protein, 35 aa, Artificial Sequence
  Description of Artificial Sequence: Synthetic polypeptide
DESEIRTTNPVATECWGSIVSTINEPQDREGENMG

SEQ ID NO: 108202 - protein, 34 aa, Artificial Sequence
  Description of Artificial Sequence: Synthetic polypeptide
DESEIRTTNPVATECWGSIVSCINEPQDREGENG

SEQ ID NO: 108203 - protein, 33 aa, Artificial Sequence
  Description of Artificial Sequence: Synthetic polypeptide
DESEIRTTNPVATECWGSISCINEPQDREGPNG

SEQ ID NO: 108204 - protein, 28 aa, Artificial Sequence
  Description of Artificial Sequence: Synthetic peptide
QEEEICTTNPVATEQYGEAPEVCQHEEN

SEQ ID NO: 108205 - protein, 33 aa, Artificial Sequence
  Description of Artificial Sequence: Synthetic polypeptide
DESEIRTTNPVATECWGSISCINEPQDREGENS

SEQ ID NO: 108206 - protein, 28 aa, Artificial Sequence
  Description of Artificial Sequence: Synthetic peptide
QEEEIATVNPVCTEQYGEVPEVLQHEEQ

SEQ ID NO: 108207 - protein, 33 aa, Artificial Sequence
  Description of Artificial Sequence: Synthetic polypeptide
DESEIRTTNPVATECWGSISCINEPQDREGENG

SEQ ID NO: 108208 - protein, 33 aa, Artificial Sequence
  Description of Artificial Sequence: Synthetic polypeptide
DESEIRTTNPVATECWGSNSCMNEPQDREGENG

SEQ ID NO: 108209 - protein, 28 aa, Artificial Sequence
  Description of Artificial Sequence: Synthetic peptide
QEEEIATVNPVCTEQYGEVPEVLQHEEK

SEQ ID NO: 108210 - protein, 34 aa, Artificial Sequence
  Description of Artificial Sequence: Synthetic polypeptide
DESEIRTTNPVATECWGSSVSCINEPQDREGENG

SEQ ID NO: 108211 - protein, 33 aa, Artificial Sequence
  Description of Artificial Sequence: Synthetic polypeptide
DESEIRTTNPVATECWGSSSCINEPQDREGENG

SEQ ID NO: 108212 - protein, 34 aa, Artificial Sequence
  Description of Artificial Sequence: Synthetic polypeptide
DESEIRTTNPVATECWGSSVSCINERQDREGENG

SEQ ID NO: 108213 - protein, 33 aa, Artificial Sequence
  Description of Artificial Sequence: Synthetic polypeptide
DESEIRTTNPVATECWGSSSCINEPQDREGENC

SEQ ID NO: 108214 - protein, 36 aa, Artificial Sequence
  Description of Artificial Sequence: Synthetic polypeptide
AEEEIRTTNPVATEQYGSVVNTTNLQQGNNQIGNTD

SEQ ID NO: 108215 - protein, 34 aa, Artificial Sequence
  Description of Artificial Sequence: Synthetic polypeptide
DESEIRTTNPVATECWGSRVSCYNEPQDREGENG

SEQ ID NO: 108216 - protein, 36 aa, Artificial Sequence
  Description of Artificial Sequence: Synthetic polypeptide
AEEEIRTTNPVATEQYGSVVNTTNLQQGNNQAGNTD

SEQ ID NO: 108217 - protein, 34 aa, Artificial Sequence
  Description of Artificial Sequence: Synthetic polypeptide
DESEIRTTNPVATECWGSRVSCINEPQDREGENG

SEQ ID NO: 108218 - protein, 33 aa, Artificial Sequence
  Description of Artificial Sequence: Synthetic polypeptide
DESEIRTTNPVATECWGSRSCINEPQDREGENG

SEQ ID NO: 108219 - protein, 34 aa, Artificial Sequence
  Description of Artificial Sequence: Synthetic polypeptide
DESEIRTTNPVATECWGSQVSCINEPQRREGENG

SEQ ID NO: 108220 - protein, 34 aa, Artificial Sequence
  Description of Artificial Sequence: Synthetic polypeptide
DESEIRTTNPVATECWGSQVSCINEPQDREGENY

SEQ ID NO: 108221 - protein, 34 aa, Artificial Sequence
  Description of Artificial Sequence: Synthetic polypeptide
DESEIRTTNPVATECWGSQVSCINEPQDREGENG

SEQ ID NO: 108222 - protein, 34 aa, Artificial Sequence
  Description of Artificial Sequence: Synthetic polypeptide
DESEIRTTNPVATECWGSQVSAINEPQDREGENG

SEQ ID NO: 108223 - protein, 33 aa, Artificial Sequence
  Description of Artificial Sequence: Synthetic polypeptide
DESEIRTTNPVATECWGSQSCINEPQDREGENS

SEQ ID NO: 108224 - protein, 33 aa, Artificial Sequence
  Description of Artificial Sequence: Synthetic polypeptide
DESEIRTTNPVATECWGSTSAINEPQDREGENG

SEQ ID NO: 108225 - protein, 33 aa, Artificial Sequence
  Description of Artificial Sequence: Synthetic polypeptide
DESEIRTTNPVATECWGSQSCINEPQDREGENG

SEQ ID NO: 108226 - protein, 33 aa, Artificial Sequence
  Description of Artificial Sequence: Synthetic polypeptide
DESEIRTTNPVATECWGSTSCINAPQDREGENG

SEQ ID NO: 108227 - protein, 36 aa, Artificial Sequence
  Description of Artificial Sequence: Synthetic polypeptide
AEEEIRTTNPVATEQYGSVVNTNNLQAGNNQIGNTD

SEQ ID NO: 108228 - protein, 34 aa, Artificial Sequence
  Description of Artificial Sequence: Synthetic polypeptide
DESEIRTTNPVATECWGSPVSCINEPQDREGENG

SEQ ID NO: 108229 - protein, 33 aa, Artificial Sequence
  Description of Artificial Sequence: Synthetic polypeptide
DESEIRTTNPVATECWGSPSCINEPQDREGENG

SEQ ID NO: 108230 - protein, 28 aa, Artificial Sequence
  Description of Artificial Sequence: Synthetic peptide
QEEEIATVNPVCTEQYGEAPENCQSENK

SEQ ID NO: 108231 - protein, 33 aa, Artificial Sequence
  Description of Artificial Sequence: Synthetic polypeptide
DESEIRTTNPVATECWGSTSCINEPQDREGENG

SEQ ID NO: 108232 - protein, 34 aa, Artificial Sequence
  Description of Artificial Sequence: Synthetic polypeptide
DESEIRTTNPVATECWGSNVSCINEPQDREGENG

SEQ ID NO: 108233 - protein, 34 aa, Artificial Sequence
  Description of Artificial Sequence: Synthetic polypeptide
DESEIRTTNPVATECWGSNVSCINEPQDREGCNG

SEQ ID NO: 108234 - protein, 33 aa, Artificial Sequence
  Description of Artificial Sequence: Synthetic polypeptide
DESEIRTTNPVATECWGSNSPINEPQDREGENG

SEQ ID NO: 108235 - protein, 33 aa, Artificial Sequence
  Description of Artificial Sequence: Synthetic polypeptide
DESEIRTTNPVATECWGSNSIINEPQDREGENG

SEQ ID NO: 108236 - protein, 34 aa, Artificial Sequence
  Description of Artificial Sequence: Synthetic polypeptide
DESEIRTTNPVATECWGSTVSAINEPQEREGENG

SEQ ID NO: 108237 - protein, 34 aa, Artificial Sequence
  Description of Artificial Sequence: Synthetic polypeptide
DESEIRTTNPVATECWGSHVSCINEPQDREGENQ

SEQ ID NO: 108238 - protein, 34 aa, Artificial Sequence
  Description of Artificial Sequence: Synthetic polypeptide
DESEIRTTNPVATECWGSHVSCINEPQDREGENG

SEQ ID NO: 108239 - protein, 36 aa, Artificial Sequence
  Description of Artificial Sequence: Synthetic polypeptide
AEEEIRTTNPVATEQYGSVTTVTTNLQAGTTENSET

SEQ ID NO: 108240 - protein, 28 aa, Artificial Sequence
  Description of Artificial Sequence: Synthetic peptide
QEEEIATTNPVSTEQYGIASCVCQHETK

SEQ ID NO: 108241 - protein, 32 aa, Artificial Sequence
  Description of Artificial Sequence: Synthetic polypeptide
DESEIRTTNPVATECWGSVACINEQDPEGENG

SEQ ID NO: 108242 - protein, 33 aa, Artificial Sequence
  Description of Artificial Sequence: Synthetic polypeptide
DESEIRTTNPVATECWGSDSCINEPQDREGENG

SEQ ID NO: 108243 - protein, 35 aa, Artificial Sequence
  Description of Artificial Sequence: Synthetic polypeptide
AEEEIRTTNPVATEQYGSVTTVTNLQQNQENNTTE

SEQ ID NO: 108244 - protein, 33 aa, Artificial Sequence
  Description of Artificial Sequence: Synthetic polypeptide
DESEIRTTNPVATECWGSDSCINEFQDREGENG

SEQ ID NO: 108245 - protein, 35 aa, Artificial Sequence
  Description of Artificial Sequence: Synthetic polypeptide
AEEEIRTTNPVATEQYGSVTTVTDGNNNNLQGNDE

SEQ ID NO: 108246 - protein, 36 aa, Artificial Sequence
  Description of Artificial Sequence: Synthetic polypeptide
AEEEIRTTNPVATEQYGSVTTVNNNLQAGTTENNED

SEQ ID NO: 108247 - protein, 36 aa, Artificial Sequence
  Description of Artificial Sequence: Synthetic polypeptide
AEEEIRTTNPVATEQYGSVTTVNNLQAGTTEGNSED

SEQ ID NO: 108248 - protein, 35 aa, Artificial Sequence
  Description of Artificial Sequence: Synthetic polypeptide
AEEEIRTTNPVATEQYGSVTTVNNLQAGTTEESEV

SEQ ID NO: 108249 - protein, 34 aa, Artificial Sequence
  Description of Artificial Sequence: Synthetic polypeptide
DESEIRTTNPVATECWGSCVSCINEPQDREGENG

SEQ ID NO: 108250 - protein, 33 aa, Artificial Sequence
  Description of Artificial Sequence: Synthetic polypeptide
DESEIRTTNPVATECWGSCSCINEPQDREGENG

SEQ ID NO: 108251 - protein, 33 aa, Artificial Sequence
  Description of Artificial Sequence: Synthetic polypeptide
DESEIRTTNPVATECWGSCSCINEPQDREGEND

SEQ ID NO: 108252 - protein, 34 aa, Artificial Sequence
  Description of Artificial Sequence: Synthetic polypeptide
DESEIRTTNPVATECWGSAVSCINQPQDREGENG

SEQ ID NO: 108253 - protein, 34 aa, Artificial Sequence
  Description of Artificial Sequence: Synthetic polypeptide
AEEEIRTTNPVATEQYGSVTTVNMEQGTNNVTEE

SEQ ID NO: 108254 - protein, 34 aa, Artificial Sequence
  Description of Artificial Sequence: Synthetic polypeptide
DESEIRTTNPVATECWGSAVSCINEPQDREGENG

SEQ ID NO: 108255 - protein, 36 aa, Artificial Sequence
  Description of Artificial Sequence: Synthetic polypeptide
AEEEIRTTNPVATEQYGSVTTVANLNNQGENGTNVE

SEQ ID NO: 108256 - protein, 33 aa, Artificial Sequence
  Description of Artificial Sequence: Synthetic polypeptide
DESEIRTTNPVATECWGSASCINEPQDREGENG

SEQ ID NO: 108257 - protein, 33 aa, Artificial Sequence
  Description of Artificial Sequence: Synthetic polypeptide
DESEIRTTNPVATECWGSASCINCPQDREGENG

SEQ ID NO: 108258 - protein, 33 aa, Artificial Sequence
  Description of Artificial Sequence: Synthetic polypeptide
DESEIRTTNPVATECWGRVSCINEPQDREGENG

SEQ ID NO: 108259 - protein, 34 aa, Artificial Sequence
  Description of Artificial Sequence: Synthetic polypeptide
DESEIRTTNPVATECWGRSVSCINEPQYRHGENP

SEQ ID NO: 108260 - protein, 34 aa, Artificial Sequence
  Description of Artificial Sequence: Synthetic polypeptide
DESEIRTTNPVATECWGRSVSCINEPQDREGENG

SEQ ID NO: 108261 - protein, 33 aa, Artificial Sequence
  Description of Artificial Sequence: Synthetic polypeptide
DESEIRTTNPVATECWGQVSCINEPQDREGENG

SEQ ID NO: 108262 - protein, 34 aa, Artificial Sequence
  Description of Artificial Sequence: Synthetic polypeptide
DESEIRTTNPVATECWGQSVSCINEPQDREGENG

SEQ ID NO: 108263 - protein, 33 aa, Artificial Sequence
  Description of Artificial Sequence: Synthetic polypeptide
DESEIRTTNPVATECWGPVSCINEPQDREGENG

SEQ ID NO: 108264 - protein, 36 aa, Artificial Sequence
  Description of Artificial Sequence: Synthetic polypeptide
AEEEIRTTNPVATEQYGSVTTVTTNLQQGNNEENEL

SEQ ID NO: 108265 - protein, 34 aa, Artificial Sequence
  Description of Artificial Sequence: Synthetic polypeptide
DESEIRTTNPVATECWGSVACINEPQDREGENGR

SEQ ID NO: 108266 - protein, 33 aa, Artificial Sequence
  Description of Artificial Sequence: Synthetic polypeptide
DESEIRTTNPVATECWGSVACINEPQDREGENG

SEQ ID NO: 108267 - protein, 33 aa, Artificial Sequence
  Description of Artificial Sequence: Synthetic polypeptide
DESEIRTTNPVATECWGSDSCINEPQVREGENG

SEQ ID NO: 108268 - protein, 33 aa, Artificial Sequence
  Description of Artificial Sequence: Synthetic polypeptide
DESEIRTTNPVATECWGSHSCINEPQDRQGENG

SEQ ID NO: 108269 - protein, 34 aa, Artificial Sequence
  Description of Artificial Sequence: Synthetic polypeptide
DESEIRTTNPVATECWGSTVSCANESQDREGGNG

SEQ ID NO: 108270 - protein, 33 aa, Artificial Sequence
  Description of Artificial Sequence: Synthetic polypeptide
DESEIRTTNPVATECWGSHSCINEPQDREGENG

SEQ ID NO: 108271 - protein, 34 aa, Artificial Sequence
  Description of Artificial Sequence: Synthetic polypeptide
DESEIRTTNPVATECWGSGVSCINEPQDREGENG

SEQ ID NO: 108272 - protein, 34 aa, Artificial Sequence
  Description of Artificial Sequence: Synthetic polypeptide
DESEIRTTNPVATECWGSTVSCENEPQDREGENG

SEQ ID NO: 108273 - protein, 34 aa, Artificial Sequence
  Description of Artificial Sequence: Synthetic polypeptide
DESEIRTTNPVATECWGSTVSCINEPQDREGENG

SEQ ID NO: 108274 - protein, 36 aa, Artificial Sequence
  Description of Artificial Sequence: Synthetic polypeptide
AEEEIRTTNPVATEQYGSVTVVTTNLQQGNNEQNES

SEQ ID NO: 108275 - protein, 36 aa, Artificial Sequence
  Description of Artificial Sequence: Synthetic polypeptide
AEEEIRTTNPVATEQYGSVTVVTTNLQQGNNEEEET

SEQ ID NO: 108276 - protein, 33 aa, Artificial Sequence
  Description of Artificial Sequence: Synthetic polypeptide
DESEIRTTNPVATECWGSGSCINETQDREGENG

SEQ ID NO: 108277 - protein, 33 aa, Artificial Sequence
  Description of Artificial Sequence: Synthetic polypeptide
DESEIRTTNPVATECWGSGSCINEPQDRTGENG

SEQ ID NO: 108278 - protein, 34 aa, Artificial Sequence
  Description of Artificial Sequence: Synthetic polypeptide
DESEIRTTNPVATECWGSTVSCINEPQDRKGENG

SEQ ID NO: 108279 - protein, 33 aa, Artificial Sequence
  Description of Artificial Sequence: Synthetic polypeptide
DESEIRTTNPVATECWGSGSCINEPQDRKGENG

SEQ ID NO: 108280 - protein, 34 aa, Artificial Sequence
  Description of Artificial Sequence: Synthetic polypeptide
DESEIRTTNPVATECWGSVISCINEPQDREGENG

SEQ ID NO: 108281 - protein, 33 aa, Artificial Sequence
  Description of Artificial Sequence: Synthetic polypeptide
DESEIRTTNPVATECWGSGSCINEPQDREGENG

SEQ ID NO: 108282 - protein, 34 aa, Artificial Sequence
  Description of Artificial Sequence: Synthetic polypeptide
DESEIRTTNPVATECWGSFVSCINEPQDREGENG

SEQ ID NO: 108283 - protein, 33 aa, Artificial Sequence
  Description of Artificial Sequence: Synthetic polypeptide
DESEIRTTNPVATECWGSFSCINEPQQREGENG

SEQ ID NO: 108284 - protein, 33 aa, Artificial Sequence
  Description of Artificial Sequence: Synthetic polypeptide
DESEIRTTNPVATECWGSFSCINEPQDREGENG

SEQ ID NO: 108285 - protein, 34 aa, Artificial Sequence
  Description of Artificial Sequence: Synthetic polypeptide
DESEIRTTNPVATECWGSEVSCINEPQDREGENG

SEQ ID NO: 108286 - protein, 33 aa, Artificial Sequence
  Description of Artificial Sequence: Synthetic polypeptide
DESEIRTTNPVATECWGSESCINEPQDREGENG

SEQ ID NO: 108287 - protein, 35 aa, Artificial Sequence
  Description of Artificial Sequence: Synthetic polypeptide
AEEEIRTTNPVATEQYGSVTVVTNLLQGNNEENEL

SEQ ID NO: 108288 - protein, 34 aa, Artificial Sequence
  Description of Artificial Sequence: Synthetic polypeptide
DESEIRTTNPVATECWGSDVSCINEPQDREGENQ

SEQ ID NO: 108289 - protein, 36 aa, Artificial Sequence
  Description of Artificial Sequence: Synthetic polypeptide
AEEEIRTTNPVATEQYGSVTVTVTTNLQNQIGTNPE

SEQ ID NO: 108290 - protein, 32 aa, Artificial Sequence
  Description of Artificial Sequence: Synthetic polypeptide
QEEEICTTNPVATEQYGSVATNLIEPEDETEM

SEQ ID NO: 108291 - protein, 34 aa, Artificial Sequence
  Description of Artificial Sequence: Synthetic polypeptide
AEEEIRTTNPVATEQYGSVTVTTDGGNNLGGNDD

SEQ ID NO: 108292 - protein, 34 aa, Artificial Sequence
  Description of Artificial Sequence: Synthetic polypeptide
DESEIRTTNPVATECWGSDVSCINEPQDREGENG

SEQ ID NO: 108293 - protein, 32 aa, Artificial Sequence
  Description of Artificial Sequence: Synthetic polypeptide
DESEIRTTNPVATECWGSVACENWPQDPEGNI

SEQ ID NO: 108294 - protein, 34 aa, Artificial Sequence
  Description of Artificial Sequence: Synthetic polypeptide
DESEIRTTNPVATECWGSFVSYINEPQDREGENG

SEQ ID NO: 108295 - protein, 32 aa, Artificial Sequence
  Description of Artificial Sequence: Synthetic polypeptide
QEEEICTTNPVAYEQYGSVATNLIEHNDETAM

SEQ ID NO: 108296 - protein, 34 aa, Artificial Sequence
  Description of Artificial Sequence: Synthetic polypeptide
DESEIRTTNPVATECWGSVISCINEPQNREGENA

SEQ ID NO: 108297 - protein, 35 aa, Artificial Sequence
  Description of Artificial Sequence: Synthetic polypeptide
AEEEIRTTNPVATEQYGSVSVVNNNLNQQNNDENQ

SEQ ID NO: 108298 - protein, 32 aa, Artificial Sequence
  Description of Artificial Sequence: Synthetic polypeptide
DESEIRTTNPVATCHYGCVCSTNPQHFTSNQG

SEQ ID NO: 108299 - protein, 33 aa, Artificial Sequence
  Description of Artificial Sequence: Synthetic polypeptide
DESEIRTTNPVATCHYGCVCSTNHQERFTSNNQ

SEQ ID NO: 108300 - protein, 32 aa, Artificial Sequence
  Description of Artificial Sequence: Synthetic polypeptide
DESEIRTTNPVATCHYGCVCSTELNQYFNSDQ

SEQ ID NO: 108301 - protein, 29 aa, Artificial Sequence
  Description of Artificial Sequence: Synthetic peptide
QEEEIATTNPVATEQYGVVAVEVEQEEEE

SEQ ID NO: 108302 - protein, 30 aa, Artificial Sequence
  Description of Artificial Sequence: Synthetic polypeptide
QEEEIRSTNPVATEGYGSVSSAGNMHGMDV

SEQ ID NO: 108303 - protein, 33 aa, Artificial Sequence
  Description of Artificial Sequence: Synthetic polypeptide
DESEIRTTNPVATCCWGSVSCINEPQDREGENG

SEQ ID NO: 108304 - protein, 34 aa, Artificial Sequence
  Description of Artificial Sequence: Synthetic polypeptide
QEEEIRSTNPVATEQYGSVNSDTDDQGQEGGNEG

SEQ ID NO: 108305 - protein, 37 aa, Artificial Sequence
  Description of Artificial Sequence: Synthetic polypeptide
AEEEIRTTNPVATEQYGSVSVTVATNLQGGNLQNEGI

SEQ ID NO: 108306 - protein, 32 aa, Artificial Sequence
  Description of Artificial Sequence: Synthetic polypeptide
DESEIRTTNPVATAHWGSVCTWEDQQRGTNTM

SEQ ID NO: 108307 - protein, 32 aa, Artificial Sequence
  Description of Artificial Sequence: Synthetic polypeptide
DESEIRTTNPVATAHWGSVCTWEDQQRGMNDS

SEQ ID NO: 108308 - protein, 33 aa, Artificial Sequence
  Description of Artificial Sequence: Synthetic polypeptide
DESEIRTTNPVATACWGSVSFINEPQDREGPNG

SEQ ID NO: 108309 - protein, 33 aa, Artificial Sequence
  Description of Artificial Sequence: Synthetic polypeptide
DESEIRTTNPVATACWGSVSCINEPQDRTGENG

SEQ ID NO: 108310 - protein, 33 aa, Artificial Sequence
  Description of Artificial Sequence: Synthetic polypeptide
DESEIRTTNPVATACWGSVSCINEPQDREGENG

SEQ ID NO: 108311 - protein, 33 aa, Artificial Sequence
  Description of Artificial Sequence: Synthetic polypeptide
DESEIRTTNPVATACWGSVSCINEIQDREGENG

SEQ ID NO: 108312 - protein, 33 aa, Artificial Sequence
  Description of Artificial Sequence: Synthetic polypeptide
DESEIRTTNPVASECWGSVSCINEPQDREGENG

SEQ ID NO: 108313 - protein, 33 aa, Artificial Sequence
  Description of Artificial Sequence: Synthetic polypeptide
DESEIRTTNPVAQECWGSVSCWNEPQDREGENG

SEQ ID NO: 108314 - protein, 33 aa, Artificial Sequence
  Description of Artificial Sequence: Synthetic polypeptide
DESEIRTTNPVAQECWGSVSCINEPQDREGENG

SEQ ID NO: 108315 - protein, 33 aa, Artificial Sequence
  Description of Artificial Sequence: Synthetic polypeptide
DESEIRTTNPVANECWGSVSHINEPQDREGENG

SEQ ID NO: 108316 - protein, 33 aa, Artificial Sequence
  Description of Artificial Sequence: Synthetic polypeptide
DESEIRTTNPVANECWGSVSCINQPQDREGENG

SEQ ID NO: 108317 - protein, 33 aa, Artificial Sequence
  Description of Artificial Sequence: Synthetic polypeptide
DESEIRTTNPVANECWGSVSCINEPQDRRGENG

SEQ ID NO: 108318 - protein, 33 aa, Artificial Sequence
  Description of Artificial Sequence: Synthetic polypeptide
DESEIRTTNPVANECWGSVSCINEPQDREGENG

SEQ ID NO: 108319 - protein, 33 aa, Artificial Sequence
  Description of Artificial Sequence: Synthetic polypeptide
DESEIRTTNPVAMECWGSVSCINEPQDREGENG

SEQ ID NO: 108320 - protein, 35 aa, Artificial Sequence
  Description of Artificial Sequence: Synthetic polypeptide
QEEEIRTTNPCATEQYGIVSSTPNGPQMRNGMNPV

SEQ ID NO: 108321 - protein, 33 aa, Artificial Sequence
  Description of Artificial Sequence: Synthetic polypeptide
DESEIRTTNPVALECWGSVSCINEPQDREGENG

SEQ ID NO: 108322 - protein, 33 aa, Artificial Sequence
  Description of Artificial Sequence: Synthetic polypeptide
DESEIRTTNPVAIECWGSVSCINEPQDREGENG

SEQ ID NO: 108323 - protein, 33 aa, Artificial Sequence
  Description of Artificial Sequence: Synthetic polypeptide
DESEIRTTNPVATECWGSVSCANEPQDREEENG

SEQ ID NO: 108324 - protein, 29 aa, Artificial Sequence
  Description of Artificial Sequence: Synthetic peptide
QEEEIATTNPVATEQYGVVAQEVEQTEET

SEQ ID NO: 108325 - protein, 28 aa, Artificial Sequence
  Description of Artificial Sequence: Synthetic peptide
QEEEIATTNPVATEQYGWAPEVCQHEEK

SEQ ID NO: 108326 - protein, 28 aa, Artificial Sequence
  Description of Artificial Sequence: Synthetic peptide
QEEEIATTNPVATEQYGYAPEVCQHEEK

SEQ ID NO: 108327 - protein, 36 aa, Artificial Sequence
  Description of Artificial Sequence: Synthetic polypeptide
AEEEIRTTNPVATEQYGSVSVTVNQNQQQIGTNTEE

SEQ ID NO: 108328 - protein, 34 aa, Artificial Sequence
  Description of Artificial Sequence: Synthetic polypeptide
DESEIRTTNPVATDQYGSVNPTGLQQEEGGNEDT

SEQ ID NO: 108329 - protein, 36 aa, Artificial Sequence
  Description of Artificial Sequence: Synthetic polypeptide
AEEEIRTTNPVATEQYGSVSVTVNNQQQGNGNNNQE

SEQ ID NO: 108330 - protein, 33 aa, Artificial Sequence
  Description of Artificial Sequence: Synthetic polypeptide
DESEIRTTNPVATDDWGSVSCINEPQDREGENG

SEQ ID NO: 108331 - protein, 33 aa, Artificial Sequence
  Description of Artificial Sequence: Synthetic polypeptide
DESEIRTTNPVATDCWGSVSCINEPQDREGENG

SEQ ID NO: 108332 - protein, 32 aa, Artificial Sequence
  Description of Artificial Sequence: Synthetic polypeptide
DESEIRTTNPVATDAYGSVVINGQQGTGNGDG

SEQ ID NO: 108333 - protein, 28 aa, Artificial Sequence
  Description of Artificial Sequence: Synthetic peptide
QEEEIATTNPVGTEQYGEMAEVLQHEDK

SEQ ID NO: 108334 - protein, 33 aa, Artificial Sequence
  Description of Artificial Sequence: Synthetic polypeptide
DESEIRTTNPVATDAYGSVSINGGQGETGNGDG

SEQ ID NO: 108335 - protein, 34 aa, Artificial Sequence
  Description of Artificial Sequence: Synthetic polypeptide
DESEIRTTNPVATECWGSVSAINEPQDRKGENYG

SEQ ID NO: 108336 - protein, 36 aa, Artificial Sequence
  Description of Artificial Sequence: Synthetic polypeptide
AEEEIRTTNPVATEQYGSVSVTVNNNNQLQGTDTNE

SEQ ID NO: 108337 - protein, 28 aa, Artificial Sequence
  Description of Artificial Sequence: Synthetic peptide
QEEEIATTNPVGTEQYGEAPSVCQHGEK

SEQ ID NO: 108338 - protein, 35 aa, Artificial Sequence
  Description of Artificial Sequence: Synthetic polypeptide
AEEEIRTTNPVATEQYGSVSVTVNNLQGTTTTEDT

SEQ ID NO: 108339 - protein, 28 aa, Artificial Sequence
  Description of Artificial Sequence: Synthetic peptide
QEEEIATTNPVGTEQYGEAPEVCQHGEK

SEQ ID NO: 108340 - protein, 28 aa, Artificial Sequence
  Description of Artificial Sequence: Synthetic peptide
QEEEIRCTNPVATEQYGEAPEVCQHEEK

SEQ ID NO: 108341 - protein, 34 aa, Artificial Sequence
  Description of Artificial Sequence: Synthetic polypeptide
DESEIRTTNPVATECWGSVSANINEPQDREGENG

SEQ ID NO: 108342 - protein, 36 aa, Artificial Sequence
  Description of Artificial Sequence: Synthetic polypeptide
AEEEIRTTNPVATEQYGSVSVTVNNDQQGNGTNDET

SEQ ID NO: 108343 - protein, 36 aa, Artificial Sequence
  Description of Artificial Sequence: Synthetic polypeptide
AEEEIRTTNPVATEQYGSVSVTVNNDQAGNVTNNQE

SEQ ID NO: 108344 - protein, 32 aa, Artificial Sequence
  Description of Artificial Sequence: Synthetic polypeptide
QEEEIATTNPVAYEQYGSVSANNPQPTSPNEE

SEQ ID NO: 108345 - protein, 31 aa, Artificial Sequence
  Description of Artificial Sequence: Synthetic polypeptide
QEEEIATTNPVAYEQYGSVANGLQPDPQENN

SEQ ID NO: 108346 - protein, 34 aa, Artificial Sequence
  Description of Artificial Sequence: Synthetic polypeptide
DESEIRTTNPVATECWGSVSANITEPQDREGENG

SEQ ID NO: 108347 - protein, 33 aa, Artificial Sequence
  Description of Artificial Sequence: Synthetic polypeptide
QEEEIATTNPVAYEPYGSVANPNLQDDGTGNRV

SEQ ID NO: 108348 - protein, 35 aa, Artificial Sequence
  Description of Artificial Sequence: Synthetic polypeptide
QEEEIRCTNPVATEQYGSVSGTGNDQEDEGGNGEE

SEQ ID NO: 108349 - protein, 36 aa, Artificial Sequence
  Description of Artificial Sequence: Synthetic polypeptide
AEEEIRTTNPVATEQYGSVVTTANLNNQEQGTNNVD

SEQ ID NO: 108350 - protein, 36 aa, Artificial Sequence
  Description of Artificial Sequence: Synthetic polypeptide
AEEEIRTTNPVATEQYGSVVTTANLQNNTEQGTNVD

SEQ ID NO: 108351 - protein, 28 aa, Artificial Sequence
  Description of Artificial Sequence: Synthetic peptide
QEEEIATTNPVATEQYGYAPEVIQHEEK

SEQ ID NO: 108352 - protein, 28 aa, Artificial Sequence
  Description of Artificial Sequence: Synthetic peptide
QEEEIATTNPVATEQYGYAPEVCQHEEH

SEQ ID NO: 108353 - protein, 33 aa, Artificial Sequence
  Description of Artificial Sequence: Synthetic polypeptide
DESEIRTTNPVAHECWGSVSCINEPQDREGENQ

SEQ ID NO: 108354 - protein, 34 aa, Artificial Sequence
  Description of Artificial Sequence: Synthetic polypeptide
QEEEIRTTNPCATEQYGSVSSTTPNGPNRGMTPV

SEQ ID NO: 108355 - protein, 33 aa, Artificial Sequence
  Description of Artificial Sequence: Synthetic polypeptide
DESEIRTTNPVAHECWGSVSCINEPQDREGENG

SEQ ID NO: 108356 - protein, 34 aa, Artificial Sequence
  Description of Artificial Sequence: Synthetic polypeptide
QEEEIRTTNPVATEAYGEVLSNTEEHSQAGGNRS

SEQ ID NO: 108357 - protein, 33 aa, Artificial Sequence
  Description of Artificial Sequence: Synthetic polypeptide
DESEIRTTNPNATECWGSVSCINEPQDREGENG

SEQ ID NO: 108358 - protein, 34 aa, Artificial Sequence
  Description of Artificial Sequence: Synthetic polypeptide
QEEEIRTTNPVATEAYGVSVCSETDLVCRNGGPH

SEQ ID NO: 108359 - protein, 28 aa, Artificial Sequence
  Description of Artificial Sequence: Synthetic peptide
QEEEIATTNPVATEQYGVAPEVGQSEES

SEQ ID NO: 108360 - protein, 33 aa, Artificial Sequence
  Description of Artificial Sequence: Synthetic polypeptide
DESEIRTTNPMATECWGSVSCINEPQDREGENG

SEQ ID NO: 108361 - protein, 30 aa, Artificial Sequence
  Description of Artificial Sequence: Synthetic polypeptide
CEDVIACTNPVATEQYGCVATNLAMNPSNR

SEQ ID NO: 108362 - protein, 34 aa, Artificial Sequence
  Description of Artificial Sequence: Synthetic polypeptide
DESEIRTTNPVATECWGSVSCCINEPQQREGENG

SEQ ID NO: 108363 - protein, 33 aa, Artificial Sequence
  Description of Artificial Sequence: Synthetic polypeptide
DESEIRTTNPLATECWGSVSCINEPQDRSGENG

SEQ ID NO: 108364 - protein, 33 aa, Artificial Sequence
  Description of Artificial Sequence: Synthetic polypeptide
DESEIRTTNPLATECWGSVSCINEPQDREGENG

SEQ ID NO: 108365 - protein, 33 aa, Artificial Sequence
  Description of Artificial Sequence: Synthetic polypeptide
DESEIRTTNPKATECWGSVSCINEPQPREGENG

SEQ ID NO: 108366 - protein, 33 aa, Artificial Sequence
  Description of Artificial Sequence: Synthetic polypeptide
DESEIRTTNPKATECWGSVSCINEPQDREGENG

SEQ ID NO: 108367 - protein, 34 aa, Artificial Sequence
  Description of Artificial Sequence: Synthetic polypeptide
DESEIRTTNPIAYERYGSVVCTGNEFSQRGGNQR

SEQ ID NO: 108368 - protein, 29 aa, Artificial Sequence
  Description of Artificial Sequence: Synthetic peptide
QEEEIATTNPVATEQYGVAPEVGQHENEK

SEQ ID NO: 108369 - protein, 34 aa, Artificial Sequence
  Description of Artificial Sequence: Synthetic polypeptide
QEEEIRTTNPVATECYGSVSTTPCGPNMRGMNPL

SEQ ID NO: 108370 - protein, 33 aa, Artificial Sequence
  Description of Artificial Sequence: Synthetic polypeptide
DESEIRTTNPVATECWGSVSCCNEPMDREGENG

SEQ ID NO: 108371 - protein, 33 aa, Artificial Sequence
  Description of Artificial Sequence: Synthetic polypeptide
DESEIRTTNPIATECWGSVSCINWPQEREGENG

SEQ ID NO: 108372 - protein, 33 aa, Artificial Sequence
  Description of Artificial Sequence: Synthetic polypeptide
DESEIRTTNPIATECWGSVSCINWPQDREGENG

SEQ ID NO: 108373 - protein, 28 aa, Artificial Sequence
  Description of Artificial Sequence: Synthetic peptide
QEEEIATTNPVATEQYGVAPEVCQHEEK

SEQ ID NO: 108374 - protein, 36 aa, Artificial Sequence
  Description of Artificial Sequence: Synthetic polypeptide
AEEEIRTTNPVATEQYGSVSVTTNQQAGNEQGTNVA

SEQ ID NO: 108375 - protein, 33 aa, Artificial Sequence
  Description of Artificial Sequence: Synthetic polypeptide
DESEIRTTNPIATECWGSVSCINEPQDREGNYG

SEQ ID NO: 108376 - protein, 33 aa, Artificial Sequence
  Description of Artificial Sequence: Synthetic polypeptide
DESEIRTTNPVATECWGSVSCDNEPDDREGENG

SEQ ID NO: 108377 - protein, 33 aa, Artificial Sequence
  Description of Artificial Sequence: Synthetic polypeptide
QEEEIRTTNPVATEFYGSVVTGGFNGDQTGEGT

SEQ ID NO: 108378 - protein, 28 aa, Artificial Sequence
  Description of Artificial Sequence: Synthetic peptide
QEEEIATTNPVATEQYGVAPDVCQHEEK

SEQ ID NO: 108379 - protein, 33 aa, Artificial Sequence
  Description of Artificial Sequence: Synthetic polypeptide
DESEIRTTNPVATECWGSVSCDNEPQDFEGENG

SEQ ID NO: 108380 - protein, 33 aa, Artificial Sequence
  Description of Artificial Sequence: Synthetic polypeptide
DESEIRTTNPIATECWGSVSCINEPQDREGENG

SEQ ID NO: 108381 - protein, 33 aa, Artificial Sequence
  Description of Artificial Sequence: Synthetic polypeptide
DESEIRTTNPNATECWGSVSKINEPQDREGENG

SEQ ID NO: 108382 - protein, 33 aa, Artificial Sequence
  Description of Artificial Sequence: Synthetic polypeptide
DESEIRTTNPQATECWGSVSCINEPQDREGENG

SEQ ID NO: 108383 - protein, 33 aa, Artificial Sequence
  Description of Artificial Sequence: Synthetic polypeptide
DESEIRTTNPQATEGWGSVSCINEPQDREGENG

SEQ ID NO: 108384 - protein, 34 aa, Artificial Sequence
  Description of Artificial Sequence: Synthetic polypeptide
QEEEIRTTNPMATEQYGSIPACTNALSQRGGPYT

SEQ ID NO: 108385 - protein, 28 aa, Artificial Sequence
  Description of Artificial Sequence: Synthetic peptide
QEEEIATTNPVATEQYGVCPEVCQHEEK

SEQ ID NO: 108386 - protein, 33 aa, Artificial Sequence
  Description of Artificial Sequence: Synthetic polypeptide
DESEIRTTNPVAGECWGSVSCINEPQRREGENG

SEQ ID NO: 108387 - protein, 33 aa, Artificial Sequence
  Description of Artificial Sequence: Synthetic polypeptide
DESEIRTTNPVAGECWGSVSCINEPQDREGENG

SEQ ID NO: 108388 - protein, 34 aa, Artificial Sequence
  Description of Artificial Sequence: Synthetic polypeptide
QEEEIRTTNPCSTEQYGSVSSTPAGPQMRNGTPR

SEQ ID NO: 108389 - protein, 29 aa, Artificial Sequence
  Description of Artificial Sequence: Synthetic peptide
QEEEIRTTNPIATEQYGAAANAVWQHGPK

SEQ ID NO: 108390 - protein, 33 aa, Artificial Sequence
  Description of Artificial Sequence: Synthetic polypeptide
DESEIRTTNPVAFECWGSVSCINEPQDREGENG

SEQ ID NO: 108391 - protein, 33 aa, Artificial Sequence
  Description of Artificial Sequence: Synthetic polypeptide
DESEIRTTNPVAFECWGSVSCCNEPQDREGENG

SEQ ID NO: 108392 - protein, 35 aa, Artificial Sequence
  Description of Artificial Sequence: Synthetic polypeptide
AEEEIRTTNPVATEQYGSVSVTTQAGNQVGTNNDT

SEQ ID NO: 108393 - protein, 33 aa, Artificial Sequence
  Description of Artificial Sequence: Synthetic polypeptide
DESEIRTTNPVAEECWGSVSCINEPQDRTGENG

SEQ ID NO: 108394 - protein, 33 aa, Artificial Sequence
  Description of Artificial Sequence: Synthetic polypeptide
DESEIRTTNPVAEECWGSVSCINEPQDREGENG

SEQ ID NO: 108395 - protein, 33 aa, Artificial Sequence
  Description of Artificial Sequence: Synthetic polypeptide
DESEIRTTNPVADECWGSVSCINEPQDREGFNG

SEQ ID NO: 108396 - protein, 33 aa, Artificial Sequence
  Description of Artificial Sequence: Synthetic polypeptide
DESEIRTTNPVADECWGSVSCINEPQDREGENG

SEQ ID NO: 108397 - protein, 28 aa, Artificial Sequence
  Description of Artificial Sequence: Synthetic peptide
QEEEIATTNPVGTEQYGVAASTCQHEDK

SEQ ID NO: 108398 - protein, 33 aa, Artificial Sequence
  Description of Artificial Sequence: Synthetic polypeptide
DESEIRTTNPVADECWGSVSCINEPQDRDGENG

SEQ ID NO: 108399 - protein, 33 aa, Artificial Sequence
  Description of Artificial Sequence: Synthetic polypeptide
DESEIRTTNPVACECWGSVSCINEPQDREGENG

SEQ ID NO: 108400 - protein, 33 aa, Artificial Sequence
  Description of Artificial Sequence: Synthetic polypeptide
DESEIRTTNPVAAEMWGSVSWINEPQDREGENG

SEQ ID NO: 108401 - protein, 33 aa, Artificial Sequence
  Description of Artificial Sequence: Synthetic polypeptide
DESEIRTTNPVAAECWGSVSCINEPQWREGENG

SEQ ID NO: 108402 - protein, 33 aa, Artificial Sequence
  Description of Artificial Sequence: Synthetic polypeptide
DESEIRTTNPVAAECWGSVSCINEPQDREGENG

SEQ ID NO: 108403 - protein, 33 aa, Artificial Sequence
  Description of Artificial Sequence: Synthetic polypeptide
DESEIRTTNPVAAEAWGSVSCINEPQDREGENG

SEQ ID NO: 108404 - protein, 28 aa, Artificial Sequence
  Description of Artificial Sequence: Synthetic peptide
QEEEIRTTNPIATEQYGEAPEVCQHEEK

SEQ ID NO: 108405 - protein, 34 aa, Artificial Sequence
  Description of Artificial Sequence: Synthetic polypeptide
DESEIRTTNPVATECWGSVSCCINEPQDREGENG

SEQ ID NO: 108406 - protein, 33 aa, Artificial Sequence
  Description of Artificial Sequence: Synthetic polypeptide
DESEIRTTNPTATECWGSVSCINEPQDREGENN

SEQ ID NO: 108407 - protein, 33 aa, Artificial Sequence
  Description of Artificial Sequence: Synthetic polypeptide
DESEIRTTNPTATECWGSVSCINEPQDREGENG

SEQ ID NO: 108408 - protein, 33 aa, Artificial Sequence
  Description of Artificial Sequence: Synthetic polypeptide
DESEIRTTNPSATECWGSVSCINEPQTREGENG

SEQ ID NO: 108409 - protein, 33 aa, Artificial Sequence
  Description of Artificial Sequence: Synthetic polypeptide
DESEIRTTNPSATECWGSVSCINEPQDREGENG

SEQ ID NO: 108410 - protein, 33 aa, Artificial Sequence
  Description of Artificial Sequence: Synthetic polypeptide
DESEIRTTNPRATECWGSVSCINEPQDREGENG

SEQ ID NO: 108411 - protein, 33 aa, Artificial Sequence
  Description of Artificial Sequence: Synthetic polypeptide
DESEIRTTNPVACECWGSVSCINEPQHREGENG

SEQ ID NO: 108412 - protein, 34 aa, Artificial Sequence
  Description of Artificial Sequence: Synthetic polypeptide
QEEEIRTTNPVATEQYGSVVTDTMDNQGGNGGFG

SEQ ID NO: 108413 - protein, 35 aa, Artificial Sequence
  Description of Artificial Sequence: Synthetic polypeptide
DESEIRTTNPVATDQYGSVSCTGNQSQWTGTGNGW

SEQ ID NO: 108414 - protein, 28 aa, Artificial Sequence
  Description of Artificial Sequence: Synthetic peptide
QEEEIATTNPVGTEQYGVAPSTCQHEDK

SEQ ID NO: 108415 - protein, 28 aa, Artificial Sequence
  Description of Artificial Sequence: Synthetic peptide
QEEEIKTTNPVATEQYGMTPEVDQHEEQ

SEQ ID NO: 108416 - protein, 29 aa, Artificial Sequence
  Description of Artificial Sequence: Synthetic peptide
QEEEIKTTNPVATEQYGVVAPEVGQHEEK

SEQ ID NO: 108417 - protein, 28 aa, Artificial Sequence
  Description of Artificial Sequence: Synthetic peptide
QEEEINTTNPVATEQYGEAPEVCQHEEK

SEQ ID NO: 108418 - protein, 34 aa, Artificial Sequence
  Description of Artificial Sequence: Synthetic polypeptide
DESEIRTTNPVATECMGSVSCINEPQDREGENGK

SEQ ID NO: 108419 - protein, 34 aa, Artificial Sequence
  Description of Artificial Sequence: Synthetic polypeptide
DESEIRTTNPVATECWGSVMSCINEPQDREGFNG

SEQ ID NO: 108420 - protein, 34 aa, Artificial Sequence
  Description of Artificial Sequence: Synthetic polypeptide
DESEIRTTNPVATECWGSVMSCINEPQRREGENG

SEQ ID NO: 108421 - protein, 34 aa, Artificial Sequence
  Description of Artificial Sequence: Synthetic polypeptide
DESEIRTTNPVATECMGSVSCINEEPQDREGENG

SEQ ID NO: 108422 - protein, 28 aa, Artificial Sequence
  Description of Artificial Sequence: Synthetic peptide
QEEEIQTTNPVATEQYGEAPEVCQHEEK

SEQ ID NO: 108423 - protein, 28 aa, Artificial Sequence
  Description of Artificial Sequence: Synthetic peptide
QEEEIQTTNPVATEQYGEAPEVCQHIEK

SEQ ID NO: 108424 - protein, 28 aa, Artificial Sequence
  Description of Artificial Sequence: Synthetic peptide
QEEEIQTTNPVATEQYGEAPEVCQHPEK

SEQ ID NO: 108425 - protein, 33 aa, Artificial Sequence
  Description of Artificial Sequence: Synthetic polypeptide
DESEIRTTNPVATECFWSVSCINEPQDREGENG

SEQ ID NO: 108426 - protein, 34 aa, Artificial Sequence
  Description of Artificial Sequence: Synthetic polypeptide
DESEIRTTNPVATECFWGSVSCINEPQDREGENM

SEQ ID NO: 108427 - protein, 34 aa, Artificial Sequence
  Description of Artificial Sequence: Synthetic polypeptide
DESEIRTTNPVATECFWGSVSCINEPQDREGENG

SEQ ID NO: 108428 - protein, 33 aa, Artificial Sequence
  Description of Artificial Sequence: Synthetic polypeptide
DESEIRTTNPVATECFGWVSCINEPQDREGENG

SEQ ID NO: 108429 - protein, 33 aa, Artificial Sequence
  Description of Artificial Sequence: Synthetic polypeptide
DESEIRTTNPVATECFGVVSCINEPQDREGENG

SEQ ID NO: 108430 - protein, 34 aa, Artificial Sequence
  Description of Artificial Sequence: Synthetic polypeptide
DESEIRTTNPVATECFGSVSCINEPQDREGENVG

SEQ ID NO: 108431 - protein, 33 aa, Artificial Sequence
  Description of Artificial Sequence: Synthetic polypeptide
DESEIRTTNPVATECWGSVNCINEPQDREGENG

SEQ ID NO: 108432 - protein, 28 aa, Artificial Sequence
  Description of Artificial Sequence: Synthetic peptide
QEEEIATTNPVSTEQYGEAPEVCQHGEK

SEQ ID NO: 108433 - protein, 34 aa, Artificial Sequence
  Description of Artificial Sequence: Synthetic polypeptide
DESEIRTTNPVATECWGSVNSCINEHQDREGENG

SEQ ID NO: 108434 - protein, 33 aa, Artificial Sequence
  Description of Artificial Sequence: Synthetic polypeptide
DESEIRTTNPVATECAGSVSCINEPTDREGENG

SEQ ID NO: 108435 - protein, 34 aa, Artificial Sequence
  Description of Artificial Sequence: Synthetic polypeptide
DESEIRTTNPVATECWGSVNSCINEPQDREGENG

SEQ ID NO: 108436 - protein, 37 aa, Artificial Sequence
  Description of Artificial Sequence: Synthetic polypeptide
AEEEIRTTNPVATEQYGSVSVTVTTTNLQQGSTNPQE

SEQ ID NO: 108437 - protein, 37 aa, Artificial Sequence
  Description of Artificial Sequence: Synthetic polypeptide
AEEEIRTTNPVATEQYGSVSVTVTTNNLQQGSNNEQE

SEQ ID NO: 108438 - protein, 34 aa, Artificial Sequence
  Description of Artificial Sequence: Synthetic polypeptide
DESEIRTTNPVATEAYGSVQSINMHSHMNGDNNR

SEQ ID NO: 108439 - protein, 34 aa, Artificial Sequence
  Description of Artificial Sequence: Synthetic polypeptide
DESEIRTTNPVATEAYGKVSCENLSQQEAGGNKP

SEQ ID NO: 108440 - protein, 28 aa, Artificial Sequence
  Description of Artificial Sequence: Synthetic peptide
QEEEIKTTNPVATEQYGEAPEVEQHEEK

SEQ ID NO: 108441 - protein, 36 aa, Artificial Sequence
  Description of Artificial Sequence: Synthetic polypeptide
AEEEIRTTNPVATEQYGSVSVTVTTNLQQGSTDEQE

SEQ ID NO: 108442 - protein, 28 aa, Artificial Sequence
  Description of Artificial Sequence: Synthetic peptide
QEEEIKTTNPVATEQYGEAPEVCQHEEK

SEQ ID NO: 108443 - protein, 28 aa, Artificial Sequence
  Description of Artificial Sequence: Synthetic peptide
QEEEIKTTNPVATEQYGEAPEVCQEEWK

SEQ ID NO: 108444 - protein, 33 aa, Artificial Sequence
  Description of Artificial Sequence: Synthetic polypeptide
DESEIRTTNPVATECWGSVKCINEPQDREGENG

SEQ ID NO: 108445 - protein, 33 aa, Artificial Sequence
  Description of Artificial Sequence: Synthetic polypeptide
DESEIRTTNPVATECWGSVKCINEPQDRNGENG

SEQ ID NO: 108446 - protein, 33 aa, Artificial Sequence
  Description of Artificial Sequence: Synthetic polypeptide
DESEIRTTNPVATECWGSVKHINEPQDREGENG

SEQ ID NO: 108447 - protein, 33 aa, Artificial Sequence
  Description of Artificial Sequence: Synthetic polypeptide
DESEIRTTNPVATECWGAVSAINEQDRKGENYG

SEQ ID NO: 108448 - protein, 34 aa, Artificial Sequence
  Description of Artificial Sequence: Synthetic polypeptide
DESEIRTTNPVATECWGSVKSCINEPQDREGENG

SEQ ID NO: 108449 - protein, 33 aa, Artificial Sequence
  Description of Artificial Sequence: Synthetic polypeptide
DESEIRTTNPVATECWGAVSAINEQDREGENYG

SEQ ID NO: 108450 - protein, 35 aa, Artificial Sequence
  Description of Artificial Sequence: Synthetic polypeptide
AEEEIRTTNPVATEQYGSVSVVNNDQAGNGTNDNV

SEQ ID NO: 108451 - protein, 33 aa, Artificial Sequence
  Description of Artificial Sequence: Synthetic polypeptide
DESEIRTTNPVATECWGSVLCINEPQDREGENG

SEQ ID NO: 108452 - protein, 34 aa, Artificial Sequence
  Description of Artificial Sequence: Synthetic polypeptide
DESEIRTTNPVATECWGSVLSCINEPQDREGENG

SEQ ID NO: 108453 - protein, 28 aa, Artificial Sequence
  Description of Artificial Sequence: Synthetic peptide
QEEEIGTTNPVATEQYGEAAEVCQPHEK

SEQ ID NO: 108454 - protein, 32 aa, Artificial Sequence
  Description of Artificial Sequence: Synthetic polypeptide
DESEIRTTNPVATECWGAVACINEPQDRKGNG

SEQ ID NO: 108455 - protein, 32 aa, Artificial Sequence
  Description of Artificial Sequence: Synthetic polypeptide
DESEIRTTNPVATECWGAVACINEPQDREGNG

SEQ ID NO: 108456 - protein, 34 aa, Artificial Sequence
  Description of Artificial Sequence: Synthetic polypeptide
DESEIRTTNPVATECWGASVSCINEPQDREGENG

SEQ ID NO: 108457 - protein, 34 aa, Artificial Sequence
  Description of Artificial Sequence: Synthetic polypeptide
DESEIRTTNPVATECWFGSVSCINEPQDREGENG

SEQ ID NO: 108458 - protein, 34 aa, Artificial Sequence
  Description of Artificial Sequence: Synthetic polypeptide
DESEIRTTNPVATECWCGSVSCINEPQDREGENG

SEQ ID NO: 108459 - protein, 28 aa, Artificial Sequence
  Description of Artificial Sequence: Synthetic peptide
QEEEIGTTNPVATEQYGEAPEVCQHEEK

SEQ ID NO: 108460 - protein, 33 aa, Artificial Sequence
  Description of Artificial Sequence: Synthetic polypeptide
DESEIRTTNPVATECWASVSCINEPQDREGSNG

SEQ ID NO: 108461 - protein, 33 aa, Artificial Sequence
  Description of Artificial Sequence: Synthetic polypeptide
DESEIRTTNPVATECWASVSCINEPQDREGENG

SEQ ID NO: 108462 - protein, 33 aa, Artificial Sequence
  Description of Artificial Sequence: Synthetic polypeptide
DESEIRTTNPVATECSGTVSCINEPQDREGVNG

SEQ ID NO: 108463 - protein, 28 aa, Artificial Sequence
  Description of Artificial Sequence: Synthetic peptide
QEEEIGTTNPVATEQYGEAPHVCQHEEK

SEQ ID NO: 108464 - protein, 33 aa, Artificial Sequence
  Description of Artificial Sequence: Synthetic polypeptide
DESEIRTTNPVATECWGSVMCINEPQDREGENG

SEQ ID NO: 108465 - protein, 33 aa, Artificial Sequence
  Description of Artificial Sequence: Synthetic polypeptide
DESEIRTTNPVATECRGFVSCINEPQDREGENG

SEQ ID NO: 108466 - protein, 28 aa, Artificial Sequence
  Description of Artificial Sequence: Synthetic peptide
QEEEIGTTNPVATEQYGEAPPVCQHEEK

SEQ ID NO: 108467 - protein, 28 aa, Artificial Sequence
  Description of Artificial Sequence: Synthetic peptide
QEEEIHTTNPVATEQYGEAPEVCQHEEK

SEQ ID NO: 108468 - protein, 34 aa, Artificial Sequence
  Description of Artificial Sequence: Synthetic polypeptide
DESEIRTTNPVATECMGSVSCINEPQDREGENGQ

SEQ ID NO: 108469 - protein, 34 aa, Artificial Sequence
  Description of Artificial Sequence: Synthetic polypeptide
DESEIRTTNPVATECWGSVMSCINEPQDREGENG

SEQ ID NO: 108470 - protein, 33 aa, Artificial Sequence
  Description of Artificial Sequence: Synthetic polypeptide
DESEIRTTNPVATECWGSVPCINEPQDREGENG

SEQ ID NO: 108471 - protein, 33 aa, Artificial Sequence
  Description of Artificial Sequence: Synthetic polypeptide
DESEIRTTNPVATEAWGSVSWMAENQDREGSNQ

SEQ ID NO: 108472 - protein, 36 aa, Artificial Sequence
  Description of Artificial Sequence: Synthetic polypeptide
AEEEIRTTNPVATEQYGSVSVTVTNNQNGTEAGNED

SEQ ID NO: 108473 - protein, 33 aa, Artificial Sequence
  Description of Artificial Sequence: Synthetic polypeptide
DESEIRTTNPVATEAWGSVSCINEPGDREGENG

SEQ ID NO: 108474 - protein, 34 aa, Artificial Sequence
  Description of Artificial Sequence: Synthetic polypeptide
DESEIRTTNPVATECWGSVPSCINEPQDREGQNG

SEQ ID NO: 108475 - protein, 34 aa, Artificial Sequence
  Description of Artificial Sequence: Synthetic polypeptide
DESEIRTTNPVATECWGSVPSCINEPQHREGENG

SEQ ID NO: 108476 - protein, 34 aa, Artificial Sequence
  Description of Artificial Sequence: Synthetic polypeptide
DESEIRTTNPVATECWGSVPSCINHSQDREGENG

SEQ ID NO: 108477 - protein, 34 aa, Artificial Sequence
  Description of Artificial Sequence: Synthetic polypeptide
DESEIRTTNPVATECWGSVPSYINEPQDREGENG

SEQ ID NO: 108478 - protein, 33 aa, Artificial Sequence
  Description of Artificial Sequence: Synthetic polypeptide
DESEIRTTNPVATECWGSVQCINEPQDREGENG

SEQ ID NO: 108479 - protein, 34 aa, Artificial Sequence
  Description of Artificial Sequence: Synthetic polypeptide
DESEIRTTNPVATECWGSVQSCINEPQDREGENG

SEQ ID NO: 108480 - protein, 34 aa, Artificial Sequence
  Description of Artificial Sequence: Synthetic polypeptide
DESEIRTTNPVATECWGSVQSCINEWQDREGENG

SEQ ID NO: 108481 - protein, 34 aa, Artificial Sequence
  Description of Artificial Sequence: Synthetic polypeptide
DESEIRTTNPVATEAWGSVSCCPNHSQDREGENG

SEQ ID NO: 108482 - protein, 34 aa, Artificial Sequence
  Description of Artificial Sequence: Synthetic polypeptide
DESEIRTTNPVATEAWGSVSCCINESQDREGGNG

SEQ ID NO: 108483 - protein, 34 aa, Artificial Sequence
  Description of Artificial Sequence: Synthetic polypeptide
DESEIRTTNPVATEAWGSSVSCINEPQDREGENG

SEQ ID NO: 108484 - protein, 33 aa, Artificial Sequence
  Description of Artificial Sequence: Synthetic polypeptide
DESEIRTTNPVATEAWGCVSWENENQDREGSNA

SEQ ID NO: 108485 - protein, 33 aa, Artificial Sequence
  Description of Artificial Sequence: Synthetic polypeptide
DESEIRTTNPVATEAWGCVSCINEPQDREGENG

SEQ ID NO: 108486 - protein, 33 aa, Artificial Sequence
  Description of Artificial Sequence: Synthetic polypeptide
DESEIRTTNPVATDWWGSVSCINEPQDREGENG

SEQ ID NO: 108487 - protein, 33 aa, Artificial Sequence
  Description of Artificial Sequence: Synthetic polypeptide
DESEIRTTNPVATECWGSVRCINEPQDREGENG

SEQ ID NO: 108488 - protein, 33 aa, Artificial Sequence
  Description of Artificial Sequence: Synthetic polypeptide
DESEIRTTNPVATECWGSVRRINEPQDREGENG

SEQ ID NO: 108489 - protein, 34 aa, Artificial Sequence
  Description of Artificial Sequence: Synthetic polypeptide
DESEIRTTNPVATECWGSVRSCINEPQDREGENG

SEQ ID NO: 108490 - protein, 30 aa, Artificial Sequence
  Description of Artificial Sequence: Synthetic polypeptide
CEDEIATTNPVAYEQYGSVATNLNMNPEGD

SEQ ID NO: 108491 - protein, 29 aa, Artificial Sequence
  Description of Artificial Sequence: Synthetic peptide
QEEEIATTNPVSTEPYGEASMDIQHNGNH

SEQ ID NO: 108492 - protein, 32 aa, Artificial Sequence
  Description of Artificial Sequence: Synthetic polypeptide
CEDEIATTNPVAYEQYGSVATNLQDALAEANV

SEQ ID NO: 108493 - protein, 31 aa, Artificial Sequence
  Description of Artificial Sequence: Synthetic polypeptide
QEEEIRCTNPAATEQYGSVVSIGGMEGGNGG

SEQ ID NO: 108494 - protein, 36 aa, Artificial Sequence
  Description of Artificial Sequence: Synthetic polypeptide
AEEEIRTTNPVATEQYGSVSVTVNTQNQEQGNQQGE

SEQ ID NO: 108495 - protein, 33 aa, Artificial Sequence
  Description of Artificial Sequence: Synthetic polypeptide
DESEIRTTNPVATECWGSVSACIDEQDREGENG

SEQ ID NO: 108496 - protein, 33 aa, Artificial Sequence
  Description of Artificial Sequence: Synthetic polypeptide
CEDEIATTNPVAYEQYGSVSAGNLPQDAGDNAQ

SEQ ID NO: 108497 - protein, 34 aa, Artificial Sequence
  Description of Artificial Sequence: Synthetic polypeptide
DESEIRTTNPVATECWGSVSACINEPQDREGENG

SEQ ID NO: 108498 - protein, 33 aa, Artificial Sequence
  Description of Artificial Sequence: Synthetic polypeptide
DESEIRTTNPVATEAWGSVSCINEPQDREGEMG

SEQ ID NO: 108499 - protein, 34 aa, Artificial Sequence
  Description of Artificial Sequence: Synthetic polypeptide
DESEIRTTNPVATECWGSVPSCINEPQDREGENG

SEQ ID NO: 108500 - protein, 34 aa, Artificial Sequence
  Description of Artificial Sequence: Synthetic polypeptide
DESEIRTTNPVATECWGSVPSCGNEPQDREGENG

SEQ ID NO: 108501 - protein, 32 aa, Artificial Sequence
  Description of Artificial Sequence: Synthetic polypeptide
QEEEIRATNPVATEQYGTVVTGDGQGGGQENN

SEQ ID NO: 108502 - protein, 33 aa, Artificial Sequence
  Description of Artificial Sequence: Synthetic polypeptide
DESEIRTTNPVATECWGSVPCINEPQDRMGENG

SEQ ID NO: 108503 - protein, 33 aa, Artificial Sequence
  Description of Artificial Sequence: Synthetic polypeptide
DESEIRTTNPVATEAWGSVSVVNNNQTGEGENG

SEQ ID NO: 108504 - protein, 33 aa, Artificial Sequence
  Description of Artificial Sequence: Synthetic polypeptide
DESEIRTTNPVATEAWGSVSVVNNNQQDEGENQ

SEQ ID NO: 108505 - protein, 33 aa, Artificial Sequence
  Description of Artificial Sequence: Synthetic polypeptide
DESEIRTTNPVATEAWGSVSVVNNNQDQEGTNG

SEQ ID NO: 108506 - protein, 33 aa, Artificial Sequence
  Description of Artificial Sequence: Synthetic polypeptide
DESEIRTTNPVATEAWGSVSVVNNNQDEIGENG

SEQ ID NO: 108507 - protein, 33 aa, Artificial Sequence
  Description of Artificial Sequence: Synthetic polypeptide
DESEIRTTNPVATEAWGSVSVVNEEQGEEGENM

SEQ ID NO: 108508 - protein, 34 aa, Artificial Sequence
  Description of Artificial Sequence: Synthetic polypeptide
QEEEIRATNPVATEQYGSVSDTDNMDNGGGGEND

SEQ ID NO: 108509 - protein, 33 aa, Artificial Sequence
  Description of Artificial Sequence: Synthetic polypeptide
DESEIRTTNPVATEAWGSVSVNNTQQDEEGTNG

SEQ ID NO: 108510 - protein, 33 aa, Artificial Sequence
  Description of Artificial Sequence: Synthetic polypeptide
DESEIRTTNPVATEAWGSVSVNNNNQNEEGENG

SEQ ID NO: 108511 - protein, 33 aa, Artificial Sequence
  Description of Artificial Sequence: Synthetic polypeptide
DESEIRTTNPVATEAWGSVSVNNNNQDDEGEND

SEQ ID NO: 108512 - protein, 36 aa, Artificial Sequence
  Description of Artificial Sequence: Synthetic polypeptide
AEEEIRTTNPVATEQYGSVSVTVTNLQQGGTEAGAE

SEQ ID NO: 108513 - protein, 34 aa, Artificial Sequence
  Description of Artificial Sequence: Synthetic polypeptide
DESEIRTTNPVATEAWGSVSTVNNNNQQGEGENT

SEQ ID NO: 108514 - protein, 33 aa, Artificial Sequence
  Description of Artificial Sequence: Synthetic polypeptide
DESEIRTTNPVATECWGSVSAIDEPQEREGENI

SEQ ID NO: 108515 - protein, 28 aa, Artificial Sequence
  Description of Artificial Sequence: Synthetic peptide
QEEEIATTNPVSTEQYGEAPEVCQHENK

SEQ ID NO: 108516 - protein, 34 aa, Artificial Sequence
  Description of Artificial Sequence: Synthetic polypeptide
DESEIRTTNPVATEAWGSVSTNTNNLQDEETENG

SEQ ID NO: 108517 - protein, 34 aa, Artificial Sequence
  Description of Artificial Sequence: Synthetic polypeptide
DESEIRTTNPVATEAWGSVSTNNNNNQSGEGENG

SEQ ID NO: 108518 - protein, 34 aa, Artificial Sequence
  Description of Artificial Sequence: Synthetic polypeptide
DESEIRTTNPVATEAWGSVSTNNNNNQDNIGENG

SEQ ID NO: 108519 - protein, 34 aa, Artificial Sequence
  Description of Artificial Sequence: Synthetic polypeptide
DESEIRTTNPVATEAWGSVSTNNNNLQDNEGEQG

SEQ ID NO: 108520 - protein, 28 aa, Artificial Sequence
  Description of Artificial Sequence: Synthetic peptide
QEEEIATTNPVSTEQYGEAPEVCQHEER

SEQ ID NO: 108521 - protein, 31 aa, Artificial Sequence
  Description of Artificial Sequence: Synthetic polypeptide
DESEIRTTNPVATECWGSVPEINEQDHEGEG

SEQ ID NO: 108522 - protein, 33 aa, Artificial Sequence
  Description of Artificial Sequence: Synthetic polypeptide
DESEIRTTNPVATEAWGSVSNNNTNQTDEGENG

SEQ ID NO: 108523 - protein, 33 aa, Artificial Sequence
  Description of Artificial Sequence: Synthetic polypeptide
DESEIRTTNPVATEAWGSVSNNNNQQEDEGENG

SEQ ID NO: 108524 - protein, 33 aa, Artificial Sequence
  Description of Artificial Sequence: Synthetic polypeptide
DESEIRTTNPVATEAWGSVSNNNNNQQLEGENG

SEQ ID NO: 108525 - protein, 33 aa, Artificial Sequence
  Description of Artificial Sequence: Synthetic polypeptide
DESEIRTTNPVATEAWGSVSNNNNNQNDEGNNG

SEQ ID NO: 108526 - protein, 33 aa, Artificial Sequence
  Description of Artificial Sequence: Synthetic polypeptide
DESEIRTTNPVATEAWGSVSNNNEQQSEEGENG

SEQ ID NO: 108527 - protein, 28 aa, Artificial Sequence
  Description of Artificial Sequence: Synthetic peptide
QEEEIATTNPVSTEQYGEAPCVLQHETK

SEQ ID NO: 108528 - protein, 34 aa, Artificial Sequence
  Description of Artificial Sequence: Synthetic polypeptide
DESEIRTTNPVATEAWGSVSTVNNENQNDEGTNG

SEQ ID NO: 108529 - protein, 31 aa, Artificial Sequence
  Description of Artificial Sequence: Synthetic polypeptide
DEQEIRTTNPVATEQWGSVSATDEMNHEEEA

SEQ ID NO: 108530 - protein, 34 aa, Artificial Sequence
  Description of Artificial Sequence: Synthetic polypeptide
QEEEIRTTNPVATEQYGSVWELPQMLQRDINGEQ

SEQ ID NO: 108531 - protein, 33 aa, Artificial Sequence
  Description of Artificial Sequence: Synthetic polypeptide
DESEIRTTNPVATECWGSVSCINEPQAPEGENG

SEQ ID NO: 108532 - protein, 32 aa, Artificial Sequence
  Description of Artificial Sequence: Synthetic polypeptide
DEQEISTTNPVATEQYGSSSATDLEDHEGEDL

SEQ ID NO: 108533 - protein, 28 aa, Artificial Sequence
  Description of Artificial Sequence: Synthetic peptide
QEGEIAPTNPCSSEQYGIVSCNLQSGTN

SEQ ID NO: 108534 - protein, 32 aa, Artificial Sequence
  Description of Artificial Sequence: Synthetic polypeptide
DEQEISTCNPVATEQYGSVSATDLFDHEGEDL

SEQ ID NO: 108535 - protein, 31 aa, Artificial Sequence
  Description of Artificial Sequence: Synthetic polypeptide
DEQEIRTTNPVSTEQYGTISTDIQQQHEGEL

SEQ ID NO: 108536 - protein, 31 aa, Artificial Sequence
  Description of Artificial Sequence: Synthetic polypeptide
DEQEIRTTNPVSTEQYGTISTDIQQDHEGEL

SEQ ID NO: 108537 - protein, 28 aa, Artificial Sequence
  Description of Artificial Sequence: Synthetic peptide
QEGEIAPTNPCSSEQYGIVSCNLQSGTQ

SEQ ID NO: 108538 - protein, 28 aa, Artificial Sequence
  Description of Artificial Sequence: Synthetic peptide
QEGEIAPTNPCSSEQYGIVSCNLQSGTS

SEQ ID NO: 108539 - protein, 28 aa, Artificial Sequence
  Description of Artificial Sequence: Synthetic peptide
QEGEIAPTNPCSSEQYGIVSCNLQSGTT

SEQ ID NO: 108540 - protein, 31 aa, Artificial Sequence
  Description of Artificial Sequence: Synthetic polypeptide
DEQEIRTTNPVSTEPYGSVSMDLEDHEGEDL

SEQ ID NO: 108541 - protein, 31 aa, Artificial Sequence
  Description of Artificial Sequence: Synthetic polypeptide
DEQEIRTTNPVSTEPYGSVSMDLEDHEGEDH

SEQ ID NO: 108542 - protein, 28 aa, Artificial Sequence
  Description of Artificial Sequence: Synthetic peptide
QEGEIAPTNPCSSEQYGIVSCNLQSGTV

SEQ ID NO: 108543 - protein, 28 aa, Artificial Sequence
  Description of Artificial Sequence: Synthetic peptide
QEGEIAPTNPCSSEQYGIVSCNLQSGTW

SEQ ID NO: 108544 - protein, 28 aa, Artificial Sequence
  Description of Artificial Sequence: Synthetic peptide
QEGEIAPTNPCSSEQYGIVSCNLQSGTY

SEQ ID NO: 108545 - protein, 31 aa, Artificial Sequence
  Description of Artificial Sequence: Synthetic polypeptide
DEQEIRTTNPVSTEPYGSVSMDIEQQNGEDH

SEQ ID NO: 108546 - protein, 33 aa, Artificial Sequence
  Description of Artificial Sequence: Synthetic polypeptide
DEQEIRTTNPVSTEPYGSVSATDLQEDQEGEDL

SEQ ID NO: 108547 - protein, 33 aa, Artificial Sequence
  Description of Artificial Sequence: Synthetic polypeptide
DEQEIRTTNPVSTEPYGSVSATDLQEDHEGEDL

SEQ ID NO: 108548 - protein, 32 aa, Artificial Sequence
  Description of Artificial Sequence: Synthetic polypeptide
DEQEIRTTNPVSTEPYGSVSATDLEDHEGEDL

SEQ ID NO: 108549 - protein, 30 aa, Artificial Sequence
  Description of Artificial Sequence: Synthetic polypeptide
QEEEIATTNPVATEQYGEVAEVCQSRVEEK

SEQ ID NO: 108550 - protein, 32 aa, Artificial Sequence
  Description of Artificial Sequence: Synthetic polypeptide
DEQEIRTTNPVSTEPYGSISATDLEQHEGEDH

SEQ ID NO: 108551 - protein, 34 aa, Artificial Sequence
  Description of Artificial Sequence: Synthetic polypeptide
DESEIRTTNPVATECWGSVSCINEPQDRQGENGA

SEQ ID NO: 108552 - protein, 32 aa, Artificial Sequence
  Description of Artificial Sequence: Synthetic polypeptide
DEQEIRTTNPVAYEQWGSVTTNPNGNGMGNVD

SEQ ID NO: 108553 - protein, 33 aa, Artificial Sequence
  Description of Artificial Sequence: Synthetic polypeptide
DESEIRTTNPVATECWGSVSCINEPQDRRGECG

SEQ ID NO: 108554 - protein, 28 aa, Artificial Sequence
  Description of Artificial Sequence: Synthetic peptide
QEGEIAPTNPCSSEQYGIVSCNLQSHTR

SEQ ID NO: 108555 - protein, 28 aa, Artificial Sequence
  Description of Artificial Sequence: Synthetic peptide
QEGEIAPTNPCSSEQYGIVSCNLQSITR

SEQ ID NO: 108556 - protein, 28 aa, Artificial Sequence
  Description of Artificial Sequence: Synthetic peptide
QEGEIAPTNPCSSEQYGIVSCNLQSKTR

SEQ ID NO: 108557 - protein, 28 aa, Artificial Sequence
  Description of Artificial Sequence: Synthetic peptide
QEGEIAPTNPCSSEQYGIVSCNLQSGTM

SEQ ID NO: 108558 - protein, 28 aa, Artificial Sequence
  Description of Artificial Sequence: Synthetic peptide
QEGEIAPTNPCSSEQYGIVSCNLQSLTR

SEQ ID NO: 108559 - protein, 32 aa, Artificial Sequence
  Description of Artificial Sequence: Synthetic polypeptide
DEQEISTTNPVATEQYGSVKATDLEDHEGEDL

SEQ ID NO: 108560 - protein, 28 aa, Artificial Sequence
  Description of Artificial Sequence: Synthetic peptide
QEGEIAPTNPCSSEQYGIVSCNLQSGTK

SEQ ID NO: 108561 - protein, 32 aa, Artificial Sequence
  Description of Artificial Sequence: Synthetic polypeptide
DEQEIVTTNPVATEQYGTVSATDGLEFEGEDL

SEQ ID NO: 108562 - protein, 32 aa, Artificial Sequence
  Description of Artificial Sequence: Synthetic polypeptide
DEQEIVTTNPVATEQYGTVSATDGLEFEGEDD

SEQ ID NO: 108563 - protein, 33 aa, Artificial Sequence
  Description of Artificial Sequence: Synthetic polypeptide
DEQEIVTTNPVATEQYGTVCSATGLVEDHEGND

SEQ ID NO: 108564 - protein, 33 aa, Artificial Sequence
  Description of Artificial Sequence: Synthetic polypeptide
DEQEIVTTNPVATEQYGTVCSATDGLVEFEGND

SEQ ID NO: 108565 - protein, 28 aa, Artificial Sequence
  Description of Artificial Sequence: Synthetic peptide
QEGEIAPTNPCSSEQYGIVSCNLQSGTA

SEQ ID NO: 108566 - protein, 33 aa, Artificial Sequence
  Description of Artificial Sequence: Synthetic polypeptide
DEQEIVTTNPVATEQYGTVCSATDGLEFEGNDD

SEQ ID NO: 108567 - protein, 33 aa, Artificial Sequence
  Description of Artificial Sequence: Synthetic polypeptide
DEQEIVTTNPVATEQYGSVYSATDLEDHEGEDL

SEQ ID NO: 108568 - protein, 33 aa, Artificial Sequence
  Description of Artificial Sequence: Synthetic polypeptide
DEQEIVTTNPVATEQYGSVSATDLREDHEGEDL

SEQ ID NO: 108569 - protein, 28 aa, Artificial Sequence
  Description of Artificial Sequence: Synthetic peptide
QEGEIAPTNPCSSEQYGIVSCNLQSGTC

SEQ ID NO: 108570 - protein, 28 aa, Artificial Sequence
  Description of Artificial Sequence: Synthetic peptide
QEGEIAPTNPCSSEQYGIVSCNLQSGTD

SEQ ID NO: 108571 - protein, 34 aa, Artificial Sequence
  Description of Artificial Sequence: Synthetic polypeptide
DESEIRTTNPVATECWGSVSCINEPQDRPGENGA

SEQ ID NO: 108572 - protein, 29 aa, Artificial Sequence
  Description of Artificial Sequence: Synthetic peptide
QEGEIAPTNPCSSEQYGIVSCNLQSGTDR

SEQ ID NO: 108573 - protein, 28 aa, Artificial Sequence
  Description of Artificial Sequence: Synthetic peptide
QEGEIAPTNPCSSEQYGIVSCNLQSGTE

SEQ ID NO: 108574 - protein, 29 aa, Artificial Sequence
  Description of Artificial Sequence: Synthetic peptide
QEEEIATTNPVATEQYGEVAPEVCQHEEK

SEQ ID NO: 108575 - protein, 29 aa, Artificial Sequence
  Description of Artificial Sequence: Synthetic peptide
QEEEIATTNPVATEQYGEVAPESCQHEEK

SEQ ID NO: 108576 - protein, 29 aa, Artificial Sequence
  Description of Artificial Sequence: Synthetic peptide
QEGEIAPTNPCSSEQYGIVSCNLQSGTER

SEQ ID NO: 108577 - protein, 28 aa, Artificial Sequence
  Description of Artificial Sequence: Synthetic peptide
QEGEIAPTNPCSSEQYGIVSCNLQSGTF

SEQ ID NO: 108578 - protein, 33 aa, Artificial Sequence
  Description of Artificial Sequence: Synthetic polypeptide
DEQEIVTTNPVATEQYGSVLSATDLEDHEGEDL

SEQ ID NO: 108579 - protein, 32 aa, Artificial Sequence
  Description of Artificial Sequence: Synthetic polypeptide
DEQEIVTTNPVATEQYGCVSATDLEDHEGEDL

SEQ ID NO: 108580 - protein, 28 aa, Artificial Sequence
  Description of Artificial Sequence: Synthetic peptide
QEGEIAPTNPCSSEQYGIVSCNLQSGTG

SEQ ID NO: 108581 - protein, 29 aa, Artificial Sequence
  Description of Artificial Sequence: Synthetic peptide
QEGEIAPTNPCSSEQYGIVSCNLQSGTGR

SEQ ID NO: 108582 - protein, 33 aa, Artificial Sequence
  Description of Artificial Sequence: Synthetic polypeptide
DEQEITTTNPVATEQYGSVSATDLEDHEGDEDL

SEQ ID NO: 108583 - protein, 32 aa, Artificial Sequence
  Description of Artificial Sequence: Synthetic polypeptide
DEQEITTTNPVATEQYGSVCATDLEDHEGEDL

SEQ ID NO: 108584 - protein, 28 aa, Artificial Sequence
  Description of Artificial Sequence: Synthetic peptide
QEGEIAPTNPCSSEQYGIVSCNLQSGTH

SEQ ID NO: 108585 - protein, 28 aa, Artificial Sequence
  Description of Artificial Sequence: Synthetic peptide
QEGEIAPTNPCSSEQYGIVSCNLQSGTI

SEQ ID NO: 108586 - protein, 28 aa, Artificial Sequence
  Description of Artificial Sequence: Synthetic peptide
QEGEIAPTNPCSSEQYGIVSCNLQSGTL

SEQ ID NO: 108587 - protein, 29 aa, Artificial Sequence
  Description of Artificial Sequence: Synthetic peptide
QEEEIATTNPVATEQYGEVAPEVCQHFEK

SEQ ID NO: 108588 - protein, 28 aa, Artificial Sequence
  Description of Artificial Sequence: Synthetic peptide
QEGEIAPTNPCSSEQYGIVSCNLQSMSR

SEQ ID NO: 108589 - protein, 28 aa, Artificial Sequence
  Description of Artificial Sequence: Synthetic peptide
QEGEIAPTNPCSSEQYGIVSCNLQSNHR

SEQ ID NO: 108590 - protein, 33 aa, Artificial Sequence
  Description of Artificial Sequence: Synthetic polypeptide
DEQEIRTTNPVATEQYGTISATEDIEQQEGNDL

SEQ ID NO: 108591 - protein, 28 aa, Artificial Sequence
  Description of Artificial Sequence: Synthetic peptide
QEEEIATTNPVATEQYGETPEVEQHEEK

SEQ ID NO: 108592 - protein, 34 aa, Artificial Sequence
  Description of Artificial Sequence: Synthetic polypeptide
DESEIRTTNPVATECWGSVSCINEPQDRYGENGT

SEQ ID NO: 108593 - protein, 33 aa, Artificial Sequence
  Description of Artificial Sequence: Synthetic polypeptide
DESEIRTTNPVATECWGSVSCINEPQDSEGENG

SEQ ID NO: 108594 - protein, 28 aa, Artificial Sequence
  Description of Artificial Sequence: Synthetic peptide
QEGEIAPTNPCSSEQYGIVSCNMQSGTR

SEQ ID NO: 108595 - protein, 33 aa, Artificial Sequence
  Description of Artificial Sequence: Synthetic polypeptide
DESEIRTTNPVATECWGSVSCINEPQDTEGENG

SEQ ID NO: 108596 - protein, 33 aa, Artificial Sequence
  Description of Artificial Sequence: Synthetic polypeptide
DESEIRTTNPVATECWGSVSCINEPQDVEGENG

SEQ ID NO: 108597 - protein, 28 aa, Artificial Sequence
  Description of Artificial Sequence: Synthetic peptide
QEGEIAPTNPCSSEQYGIVSCNNQSGTR

SEQ ID NO: 108598 - protein, 28 aa, Artificial Sequence
  Description of Artificial Sequence: Synthetic peptide
QEGEIAPTNPCSSEQYGIVSCNPQSGTR

SEQ ID NO: 108599 - protein, 28 aa, Artificial Sequence
  Description of Artificial Sequence: Synthetic peptide
QEGEIAPTNPCSSEQYGIVSCNQQSGTR

SEQ ID NO: 108600 - protein, 37 aa, Artificial Sequence
  Description of Artificial Sequence: Synthetic polypeptide
DEQEIRTTNPVATEQYGSVVSTNHMLEELRNGNEEVF

SEQ ID NO: 108601 - protein, 28 aa, Artificial Sequence
  Description of Artificial Sequence: Synthetic peptide
QEGEIAPTNPCSSEQYGIVSCNRQSGTR

SEQ ID NO: 108602 - protein, 28 aa, Artificial Sequence
  Description of Artificial Sequence: Synthetic peptide
QEGEIAPTNPCSSEQYGIVSCNSQSGTR

SEQ ID NO: 108603 - protein, 28 aa, Artificial Sequence
  Description of Artificial Sequence: Synthetic peptide
QEGEIAPTNPCSSEQYGIVSCNTQSGTR

SEQ ID NO: 108604 - protein, 28 aa, Artificial Sequence
  Description of Artificial Sequence: Synthetic peptide
QEGEIAPTNPCSSEQYGIVSCNVQSGTR

SEQ ID NO: 108605 - protein, 32 aa, Artificial Sequence
  Description of Artificial Sequence: Synthetic polypeptide
DEQEIRTTNPVATEQYGSVTTPTQANSDQEEH

SEQ ID NO: 108606 - protein, 28 aa, Artificial Sequence
  Description of Artificial Sequence: Synthetic peptide
QEGEIAPTNPCSSEQYGIVSCNWQSGTR

SEQ ID NO: 108607 - protein, 28 aa, Artificial Sequence
  Description of Artificial Sequence: Synthetic peptide
QEGEIAPTNPCSSEQYGIVSCNYQSGTR

SEQ ID NO: 108608 - protein, 28 aa, Artificial Sequence
  Description of Artificial Sequence: Synthetic peptide
QEGEIAPTNPCSSEQYGIVSCQLQSGTR

SEQ ID NO: 108609 - protein, 33 aa, Artificial Sequence
  Description of Artificial Sequence: Synthetic polypeptide
DESEIRTTNPVATECWGSVSCINEPQDVEGING

SEQ ID NO: 108610 - protein, 33 aa, Artificial Sequence
  Description of Artificial Sequence: Synthetic polypeptide
DESEIRTTNPVATECWGSVSCINEPQDWEGENG

SEQ ID NO: 108611 - protein, 33 aa, Artificial Sequence
  Description of Artificial Sequence: Synthetic polypeptide
CEEEIACTNPVATEQYGSVATNLQGNPGEEAEE

SEQ ID NO: 108612 - protein, 28 aa, Artificial Sequence
  Description of Artificial Sequence: Synthetic peptide
QEGEIAPTNPCSSEQYGIVSCSLQSGTR

SEQ ID NO: 108613 - protein, 28 aa, Artificial Sequence
  Description of Artificial Sequence: Synthetic peptide
QEGEIAPTNPCSSEQYGIVSCTLQSGTR

SEQ ID NO: 108614 - protein, 29 aa, Artificial Sequence
  Description of Artificial Sequence: Synthetic peptide
QEGEIAPTNPCSSEQYGIVSCTNLQSGTM

SEQ ID NO: 108615 - protein, 33 aa, Artificial Sequence
  Description of Artificial Sequence: Synthetic polypeptide
DEQEIRTTNPVATEQYGTISATEDLQEDHEGEL

SEQ ID NO: 108616 - protein, 28 aa, Artificial Sequence
  Description of Artificial Sequence: Synthetic peptide
QEGEIAPTNPCSSEQYGIVSCNLQSMTR

SEQ ID NO: 108617 - protein, 33 aa, Artificial Sequence
  Description of Artificial Sequence: Synthetic polypeptide
DEQEIRTTNPVATEQYGTISATEDLQEDQEGEL

SEQ ID NO: 108618 - protein, 33 aa, Artificial Sequence
  Description of Artificial Sequence: Synthetic polypeptide
DEQEIRTTNPVATEQYGTVSAMEDIQQDQNGNH

SEQ ID NO: 108619 - protein, 33 aa, Artificial Sequence
  Description of Artificial Sequence: Synthetic polypeptide
DEQEIRTTNPVAYEQWGSVATNPNGNGMGGNTR

SEQ ID NO: 108620 - protein, 28 aa, Artificial Sequence
  Description of Artificial Sequence: Synthetic peptide
QEGEIAPTNPCSSEQYGIVSCNLQSNTR

SEQ ID NO: 108621 - protein, 28 aa, Artificial Sequence
  Description of Artificial Sequence: Synthetic peptide
QEGEIAPTNPCSSEQYGIVSCNLQSPTR

SEQ ID NO: 108622 - protein, 33 aa, Artificial Sequence
  Description of Artificial Sequence: Synthetic polypeptide
CEEEIACTNPVATEQYGSVAITNDDQTAGNTEN

SEQ ID NO: 108623 - protein, 28 aa, Artificial Sequence
  Description of Artificial Sequence: Synthetic peptide
QEGEIAPTNPCSSEQYGIVSCNLQSQTR

SEQ ID NO: 108624 - protein, 29 aa, Artificial Sequence
  Description of Artificial Sequence: Synthetic peptide
QEGEIAPTNPCSSEQYGIVSCNLQSRGTN

SEQ ID NO: 108625 - protein, 28 aa, Artificial Sequence
  Description of Artificial Sequence: Synthetic peptide
QEGEIAPTNPCSSEQYGIVSCNLQSRTR

SEQ ID NO: 108626 - protein, 29 aa, Artificial Sequence
  Description of Artificial Sequence: Synthetic peptide
QEGEIAPTNPCSSEQYGIVSCNLQSSGQR

SEQ ID NO: 108627 - protein, 29 aa, Artificial Sequence
  Description of Artificial Sequence: Synthetic peptide
QEGEIAPTNPCSSEQYGIVSCNLQSSGTR

SEQ ID NO: 108628 - protein, 33 aa, Artificial Sequence
  Description of Artificial Sequence: Synthetic polypeptide
CEEEIACTNPVATEQYGSVATGNLDQTAPGEHF

SEQ ID NO: 108629 - protein, 33 aa, Artificial Sequence
  Description of Artificial Sequence: Synthetic polypeptide
CEEEIACTNPVATEQYGSVATGNPEQTADGNTE

SEQ ID NO: 108630 - protein, 28 aa, Artificial Sequence
  Description of Artificial Sequence: Synthetic peptide
QEGEIAPTNPCSSEQYGIVSCNLQSSTR

SEQ ID NO: 108631 - protein, 28 aa, Artificial Sequence
  Description of Artificial Sequence: Synthetic peptide
QEGEIAPTNPCSSEQYGIVSCNLQSTTR

SEQ ID NO: 108632 - protein, 32 aa, Artificial Sequence
  Description of Artificial Sequence: Synthetic polypeptide
CEEEIACTNPVATEQYGSVATNLADAIGEHAD

SEQ ID NO: 108633 - protein, 31 aa, Artificial Sequence
  Description of Artificial Sequence: Synthetic polypeptide
QEEEIATTNPVATEQYGEVAANVCQSRVEEK

SEQ ID NO: 108634 - protein, 34 aa, Artificial Sequence
  Description of Artificial Sequence: Synthetic polypeptide
DESEIRTTNPVATECWGSVSCINEPQDRSGENGE

SEQ ID NO: 108635 - protein, 28 aa, Artificial Sequence
  Description of Artificial Sequence: Synthetic peptide
QEGEIAPTNPCSSEQYGIVSCNLQSVTR

SEQ ID NO: 108636 - protein, 28 aa, Artificial Sequence
  Description of Artificial Sequence: Synthetic peptide
QEEEIATTNPVATEQYGETPEVTQHEEQ

SEQ ID NO: 108637 - protein, 32 aa, Artificial Sequence
  Description of Artificial Sequence: Synthetic polypeptide
CEEEIACTNPVATEQYGSVATNLQAEDDTPDV

SEQ ID NO: 108638 - protein, 34 aa, Artificial Sequence
  Description of Artificial Sequence: Synthetic polypeptide
DESEIRTTNPVATECWGSVSCINEPQDRVGENFG

SEQ ID NO: 108639 - protein, 28 aa, Artificial Sequence
  Description of Artificial Sequence: Synthetic peptide
QEGEIAPTNPCSSEQYGIVSCNLQSYTR

SEQ ID NO: 108640 - protein, 28 aa, Artificial Sequence
  Description of Artificial Sequence: Synthetic peptide
QEGEIAPTNPCSSEQYGIVSCNLQTGTM

SEQ ID NO: 108641 - protein, 28 aa, Artificial Sequence
  Description of Artificial Sequence: Synthetic peptide
QEEEIATTNPVATEQYGETPEVFQHEEE

SEQ ID NO: 108642 - protein, 28 aa, Artificial Sequence
  Description of Artificial Sequence: Synthetic peptide
QEGEIAPTNPCSSEQYGIVSCNLQVGTV

SEQ ID NO: 108643 - protein, 28 aa, Artificial Sequence
  Description of Artificial Sequence: Synthetic peptide
QEGEIAPTNPCSSEQYGIVSCNLSDGTR

SEQ ID NO: 108644 - protein, 33 aa, Artificial Sequence
  Description of Artificial Sequence: Synthetic polypeptide
DESEIRTTNPVATECWGSVSCINEPQDRVGEQG

SEQ ID NO: 108645 - protein, 34 aa, Artificial Sequence
  Description of Artificial Sequence: Synthetic polypeptide
DESEIRTTNPVATECWGSVSCINEPQDRNGMNPG

SEQ ID NO: 108646 - protein, 28 aa, Artificial Sequence
  Description of Artificial Sequence: Synthetic peptide
QEGEIAPTNPCSSEQYGIVSCNLQSGQV

SEQ ID NO: 108647 - protein, 32 aa, Artificial Sequence
  Description of Artificial Sequence: Synthetic polypeptide
DEQEIYTTNPVATEQYGSVSAHDLEDHEGEDL

SEQ ID NO: 108648 - protein, 28 aa, Artificial Sequence
  Description of Artificial Sequence: Synthetic peptide
QEGEIAPTNPCSSEQYGIVSCNLQHGTI

SEQ ID NO: 108649 - protein, 32 aa, Artificial Sequence
  Description of Artificial Sequence: Synthetic polypeptide
DEQYIATTNPVATEQYGSVSATDLEDHEGEDL

SEQ ID NO: 108650 - protein, 33 aa, Artificial Sequence
  Description of Artificial Sequence: Synthetic polypeptide
DESEIRTTNPVATECWGSVSCINEPQDREWENG

SEQ ID NO: 108651 - protein, 32 aa, Artificial Sequence
  Description of Artificial Sequence: Synthetic polypeptide
DEQYIATTNPVATEQYGSVSATDLEDDEGEDL

SEQ ID NO: 108652 - protein, 32 aa, Artificial Sequence
  Description of Artificial Sequence: Synthetic polypeptide
DEQWIATTNPVATEQYGSVSATDLEMHEGEDL

SEQ ID NO: 108653 - protein, 32 aa, Artificial Sequence
  Description of Artificial Sequence: Synthetic polypeptide
DEQWIATTNPVATEQYGSVSATDLEDHEGEDV

SEQ ID NO: 108654 - protein, 32 aa, Artificial Sequence
  Description of Artificial Sequence: Synthetic polypeptide
DEQWIATTNPVATEQYGSVSATDLEDHEGEDL

SEQ ID NO: 108655 - protein, 32 aa, Artificial Sequence
  Description of Artificial Sequence: Synthetic polypeptide
DEQVIATTNPVATEQYGSVSATDLKDHEGEDL

SEQ ID NO: 108656 - protein, 33 aa, Artificial Sequence
  Description of Artificial Sequence: Synthetic polypeptide
DESEIRTTNPVATECWGSVSCINEPQDREYENE

SEQ ID NO: 108657 - protein, 32 aa, Artificial Sequence
  Description of Artificial Sequence: Synthetic polypeptide
DEQVIATTNPVATEQYGSVSATDLEDHEGEDL

SEQ ID NO: 108658 - protein, 33 aa, Artificial Sequence
  Description of Artificial Sequence: Synthetic polypeptide
DESEIRTTNPVATECWGSVSCINEPQDREYENG

SEQ ID NO: 108659 - protein, 33 aa, Artificial Sequence
  Description of Artificial Sequence: Synthetic polypeptide
DEQTIRGTNPVATEQYGSVSVNNGQGGGNDNGD

SEQ ID NO: 108660 - protein, 30 aa, Artificial Sequence
  Description of Artificial Sequence: Synthetic polypeptide
QEEEIATTNPVATEQYGEVPEPVCNREMNV

SEQ ID NO: 108661 - protein, 29 aa, Artificial Sequence
  Description of Artificial Sequence: Synthetic peptide
QEEEIATTNPVATEQYGEVPEKVCQHEEK

SEQ ID NO: 108662 - protein, 32 aa, Artificial Sequence
  Description of Artificial Sequence: Synthetic polypeptide
DEQTIFTTNPVATEQYGSVSATDLEDHEGEDL

SEQ ID NO: 108663 - protein, 29 aa, Artificial Sequence
  Description of Artificial Sequence: Synthetic peptide
QEGEIAPTNPCSSEQYGIVSCNLQNSGDR

SEQ ID NO: 108664 - protein, 28 aa, Artificial Sequence
  Description of Artificial Sequence: Synthetic peptide
QEGEIAPTNPCSSEQYGIVSCNLQNYTR

SEQ ID NO: 108665 - protein, 33 aa, Artificial Sequence
  Description of Artificial Sequence: Synthetic polypeptide
DESEIRTTNPVATECWGSVSCINEPQDRHQENG

SEQ ID NO: 108666 - protein, 29 aa, Artificial Sequence
  Description of Artificial Sequence: Synthetic peptide
QEGEIAPTNPCSSEQYGIVSCNLQSAGKR

SEQ ID NO: 108667 - protein, 29 aa, Artificial Sequence
  Description of Artificial Sequence: Synthetic peptide
QEGEIAPTNPCSSEQYGIVSCNLQSAGTR

SEQ ID NO: 108668 - protein, 28 aa, Artificial Sequence
  Description of Artificial Sequence: Synthetic peptide
QEGEIAPTNPCSSEQYGIVSCNLQSATR

SEQ ID NO: 108669 - protein, 32 aa, Artificial Sequence
  Description of Artificial Sequence: Synthetic polypeptide
DEQTIATTNPVATEQYGSVSATDLEDHEGEDL

SEQ ID NO: 108670 - protein, 33 aa, Artificial Sequence
  Description of Artificial Sequence: Synthetic polypeptide
DEQSIATTNPVATEQYGSVSATDLQEDHEGEDL

SEQ ID NO: 108671 - protein, 32 aa, Artificial Sequence
  Description of Artificial Sequence: Synthetic polypeptide
DEQSIATTNPVATEQYGSVSATDLEDHEGEHL

SEQ ID NO: 108672 - protein, 32 aa, Artificial Sequence
  Description of Artificial Sequence: Synthetic polypeptide
DEQSIATTNPVATEQYGSVSATDLEDHEGEDL

SEQ ID NO: 108673 - protein, 32 aa, Artificial Sequence
  Description of Artificial Sequence: Synthetic polypeptide
DERCIRTTNPVAYEHYGCTVSTNQSQFGGNQS

SEQ ID NO: 108674 - protein, 33 aa, Artificial Sequence
  Description of Artificial Sequence: Synthetic polypeptide
DEQRIATTNPVATEQYGSVSATDNLEDHEGEDL

SEQ ID NO: 108675 - protein, 32 aa, Artificial Sequence
  Description of Artificial Sequence: Synthetic polypeptide
DEREIATTNAVATEQYGSVSATDLEDHEGEDL

SEQ ID NO: 108676 - protein, 28 aa, Artificial Sequence
  Description of Artificial Sequence: Synthetic peptide
QEGEIAPTNPCSSEQYGIVSCNLQHETR

SEQ ID NO: 108677 - protein, 34 aa, Artificial Sequence
  Description of Artificial Sequence: Synthetic polypeptide
DEREISTTNPVATEQYGCVCSNTNHQENFGSNQS

SEQ ID NO: 108678 - protein, 33 aa, Artificial Sequence
  Description of Artificial Sequence: Synthetic polypeptide
DEREIRTTNPVCYEHYGSVSMPNALTQTPGDNL

SEQ ID NO: 108679 - protein, 34 aa, Artificial Sequence
  Description of Artificial Sequence: Synthetic polypeptide
DEREIRTTNPVATEQYGSVSTNKHSQESPMDDIV

SEQ ID NO: 108680 - protein, 29 aa, Artificial Sequence
  Description of Artificial Sequence: Synthetic peptide
QEGEIAPTNPCSSEQYGIVSCNLQDGGTR

SEQ ID NO: 108681 - protein, 33 aa, Artificial Sequence
  Description of Artificial Sequence: Synthetic polypeptide
DESEIRTTNPVATECWGSVSCINEPQDREQENG

SEQ ID NO: 108682 - protein, 33 aa, Artificial Sequence
  Description of Artificial Sequence: Synthetic polypeptide
DESEIRTTNPVATECWGSVSCINEPQDRERENG

SEQ ID NO: 108683 - protein, 34 aa, Artificial Sequence
  Description of Artificial Sequence: Synthetic polypeptide
DEREIRTTNPVATEQYGSVSTNKHSDERPMIMMV

SEQ ID NO: 108684 - protein, 33 aa, Artificial Sequence
  Description of Artificial Sequence: Synthetic polypeptide
DESEIRTTNPVATECWGSVSCINEPQDRERENL

SEQ ID NO: 108685 - protein, 29 aa, Artificial Sequence
  Description of Artificial Sequence: Synthetic peptide
QEGEIAPTNPCSSEQYGIVSCNLQDQGTR

SEQ ID NO: 108686 - protein, 29 aa, Artificial Sequence
  Description of Artificial Sequence: Synthetic peptide
QEGEIAPTNPCSSEQYGIVSCNLQDSGER

SEQ ID NO: 108687 - protein, 33 aa, Artificial Sequence
  Description of Artificial Sequence: Synthetic polypeptide
DEREIRTTNPVATEQYGCVCSTPEHQHFNSEQG

SEQ ID NO: 108688 - protein, 29 aa, Artificial Sequence
  Description of Artificial Sequence: Synthetic peptide
QEGEIAPTNPCSSEQYGIVSCNLQDSGTR

SEQ ID NO: 108689 - protein, 30 aa, Artificial Sequence
  Description of Artificial Sequence: Synthetic polypeptide
DEREIRTTNPVATEQWGDVSEIEMNAQYDA

SEQ ID NO: 108690 - protein, 33 aa, Artificial Sequence
  Description of Artificial Sequence: Synthetic polypeptide
DESEIRTTNPVATECWGSVSCINEPQDRESENG

SEQ ID NO: 108691 - protein, 28 aa, Artificial Sequence
  Description of Artificial Sequence: Synthetic peptide
QEGEIAPTNPCSSEQYGIVSCNLQEPTR

SEQ ID NO: 108692 - protein, 29 aa, Artificial Sequence
  Description of Artificial Sequence: Synthetic peptide
QEGEIAPTNPCSSEQYGIVSCNLQESGTR

SEQ ID NO: 108693 - protein, 33 aa, Artificial Sequence
  Description of Artificial Sequence: Synthetic polypeptide
CEEEIACTNPVATEQYGSACSTNPLQDALDGDQ

SEQ ID NO: 108694 - protein, 28 aa, Artificial Sequence
  Description of Artificial Sequence: Synthetic peptide
QEEEIATTNPVATEQYGEVPEVCMHEEK

SEQ ID NO: 108695 - protein, 30 aa, Artificial Sequence
  Description of Artificial Sequence: Synthetic polypeptide
QEEEIATTNPVATEQYGEVPEPVCQHGEPK

SEQ ID NO: 108696 - protein, 33 aa, Artificial Sequence
  Description of Artificial Sequence: Synthetic polypeptide
DESEIRTTNPVATECWGSVSCINEPQDRESWNG

SEQ ID NO: 108697 - protein, 28 aa, Artificial Sequence
  Description of Artificial Sequence: Synthetic peptide
QEGEIAPTNPCSSEQYGIVSCNLQGHTR

SEQ ID NO: 108698 - protein, 33 aa, Artificial Sequence
  Description of Artificial Sequence: Synthetic polypeptide
DESEIRTTNPVATECWGSVSCINEPQDRETENG

SEQ ID NO: 108699 - protein, 30 aa, Artificial Sequence
  Description of Artificial Sequence: Synthetic polypeptide
DEREIATTNPVAYEQWGSTSKNLEDHKNIG

SEQ ID NO: 108700 - protein, 33 aa, Artificial Sequence
  Description of Artificial Sequence: Synthetic polypeptide
DEREIATTNPVATEQYGSVSATTDLEDHEGEDL

SEQ ID NO: 108701 - protein, 29 aa, Artificial Sequence
  Description of Artificial Sequence: Synthetic peptide
QEGEIAPTNPCSSEQYGIVSCNLQGSGTR

SEQ ID NO: 108702 - protein, 33 aa, Artificial Sequence
  Description of Artificial Sequence: Synthetic polypeptide
DESEIRTTNPVATECWGSVSCINEPQDREVENG

SEQ ID NO: 108703 - protein, 32 aa, Artificial Sequence
  Description of Artificial Sequence: Synthetic polypeptide
DEQRIATTNPVATEQYGSVSATDLEDHGGEDL

SEQ ID NO: 108704 - protein, 32 aa, Artificial Sequence
  Description of Artificial Sequence: Synthetic polypeptide
DEQRIATTNPVATEQYGSVSATDLEDHEGESL

SEQ ID NO: 108705 - protein, 28 aa, Artificial Sequence
  Description of Artificial Sequence: Synthetic peptide
QEGEIAPTNPCSSEQYGIVSCNLQSCTR

SEQ ID NO: 108706 - protein, 32 aa, Artificial Sequence
  Description of Artificial Sequence: Synthetic polypeptide
DEQFIATTNPVATEQYGSVSATDLEDHEGVDL

SEQ ID NO: 108707 - protein, 32 aa, Artificial Sequence
  Description of Artificial Sequence: Synthetic polypeptide
DEQFIATTNPVATEQYGSVSATDLEDHEGEDL

SEQ ID NO: 108708 - protein, 32 aa, Artificial Sequence
  Description of Artificial Sequence: Synthetic polypeptide
DEQFIATTNPVATEQYGSVSAKDLQDHEGEDL

SEQ ID NO: 108709 - protein, 34 aa, Artificial Sequence
  Description of Artificial Sequence: Synthetic polypeptide
DESEIRTTNPVATECWGSVSCINEPQDRKGENGK

SEQ ID NO: 108710 - protein, 32 aa, Artificial Sequence
  Description of Artificial Sequence: Synthetic polypeptide
DEQEVATTNPVATEQYGSVSATDLEDHEGEDL

SEQ ID NO: 108711 - protein, 29 aa, Artificial Sequence
  Description of Artificial Sequence: Synthetic peptide
QEGEIAPTNPCSSEQYGIVSCNLQSGDTR

SEQ ID NO: 108712 - protein, 28 aa, Artificial Sequence
  Description of Artificial Sequence: Synthetic peptide
QEGEIAPTNPCSSEQYGIVSCNLQSGEL

SEQ ID NO: 108713 - protein, 34 aa, Artificial Sequence
  Description of Artificial Sequence: Synthetic polypeptide
DESEIRTTNPVATECWGSVSCINEPQDRKGENYG

SEQ ID NO: 108714 - protein, 32 aa, Artificial Sequence
  Description of Artificial Sequence: Synthetic polypeptide
DEQEVASTNPVATEQYGSVSATDLEDHVGEDR

SEQ ID NO: 108715 - protein, 29 aa, Artificial Sequence
  Description of Artificial Sequence: Synthetic peptide
QEGEIAPTNPCSSEQYGIVSCNLQSGETR

SEQ ID NO: 108716 - protein, 33 aa, Artificial Sequence
  Description of Artificial Sequence: Synthetic polypeptide
DESEIRTTNPVATECWGSVSCINEPQDRKPENG

SEQ ID NO: 108717 - protein, 29 aa, Artificial Sequence
  Description of Artificial Sequence: Synthetic peptide
QEEEIATTNPVATEQYGEVPEACQHNEEK

SEQ ID NO: 108718 - protein, 28 aa, Artificial Sequence
  Description of Artificial Sequence: Synthetic peptide
QEGEIAPTNPCSSEQYGIVSCNLQSGHD

SEQ ID NO: 108719 - protein, 33 aa, Artificial Sequence
  Description of Artificial Sequence: Synthetic polypeptide
DESEIRTTNPVATECWGSVSCINEPQDRLGEGG

SEQ ID NO: 108720 - protein, 35 aa, Artificial Sequence
  Description of Artificial Sequence: Synthetic polypeptide
AEEEIRTTNPVATEQYGSVVTVANLNANEQGTNVE

SEQ ID NO: 108721 - protein, 29 aa, Artificial Sequence
  Description of Artificial Sequence: Synthetic peptide
QEEEIATTNPVATEQYGEVPAEVCQHEEK

SEQ ID NO: 108722 - protein, 28 aa, Artificial Sequence
  Description of Artificial Sequence: Synthetic peptide
QEGEIAPTNPCSSEQYGIVSCNLQSGMF

SEQ ID NO: 108723 - protein, 32 aa, Artificial Sequence
  Description of Artificial Sequence: Synthetic polypeptide
DEQETATTNPVATEQYGSVSATDLEDHEGEDL

SEQ ID NO: 108724 - protein, 32 aa, Artificial Sequence
  Description of Artificial Sequence: Synthetic polypeptide
DEQELATTNPVATEQYGSVSATDLPDHEGEDL

SEQ ID NO: 108725 - protein, 32 aa, Artificial Sequence
  Description of Artificial Sequence: Synthetic polypeptide
DEQELATTNPVATEQYGSVSATDLEDHEGEDL

SEQ ID NO: 108726 - protein, 33 aa, Artificial Sequence
  Description of Artificial Sequence: Synthetic polypeptide
DEQEIYTTNPVATEQYGSVTSATDLEDHEGEDL

SEQ ID NO: 108727 - protein, 30 aa, Artificial Sequence
  Description of Artificial Sequence: Synthetic polypeptide
QEEEIATTNPVATEQYGEVCPTVCVQHEEK

SEQ ID NO: 108728 - protein, 29 aa, Artificial Sequence
  Description of Artificial Sequence: Synthetic peptide
QEEEIATTNPVATEQYGEVCPEVCQHEEK

SEQ ID NO: 108729 - protein, 33 aa, Artificial Sequence
  Description of Artificial Sequence: Synthetic polypeptide
DEQEIYTTNPVATEQYGSVSATDLEDHEGEDLS

SEQ ID NO: 108730 - protein, 28 aa, Artificial Sequence
  Description of Artificial Sequence: Synthetic peptide
QEGEIAPTNPCSSEQYGIVSCNLQSGQT

SEQ ID NO: 108731 - protein, 32 aa, Artificial Sequence
  Description of Artificial Sequence: Synthetic polypeptide
DEQFIATTNPVATEQYGSVSATDLEDSFGEDL

SEQ ID NO: 108732 - protein, 32 aa, Artificial Sequence
  Description of Artificial Sequence: Synthetic polypeptide
DEQFIATTNPVATEQYGSVSSTDLEDHEGEDL

SEQ ID NO: 108733 - protein, 32 aa, Artificial Sequence
  Description of Artificial Sequence: Synthetic polypeptide
DEQGIATTNPVATEQYGSVSATDLEDHEGEDL

SEQ ID NO: 108734 - protein, 32 aa, Artificial Sequence
  Description of Artificial Sequence: Synthetic polypeptide
DEQGIVTTNPVATEQYGSVSATDLEDHEGEDL

SEQ ID NO: 108735 - protein, 32 aa, Artificial Sequence
  Description of Artificial Sequence: Synthetic polypeptide
DEQRIATTNPVATEQYGSVSATDLEDHEGEDL

SEQ ID NO: 108736 - protein, 28 aa, Artificial Sequence
  Description of Artificial Sequence: Synthetic peptide
QEGEIAPTNPCSSEQYGIVSCNLQSDLR

SEQ ID NO: 108737 - protein, 32 aa, Artificial Sequence
  Description of Artificial Sequence: Synthetic polypeptide
DEQQIATTNPVATEQYGSVSATDLEDHEGEDL

SEQ ID NO: 108738 - protein, 28 aa, Artificial Sequence
  Description of Artificial Sequence: Synthetic peptide
QEGEIAPTNPCSSEQYGIVSCNLQSDTR

SEQ ID NO: 108739 - protein, 32 aa, Artificial Sequence
  Description of Artificial Sequence: Synthetic polypeptide
DEQPIATTNPVATEQYGSVSATDLLDHEGEDL

SEQ ID NO: 108740 - protein, 32 aa, Artificial Sequence
  Description of Artificial Sequence: Synthetic polypeptide
DEQPIATTNPVATEQYGSVSATDLEDHEGEDL

SEQ ID NO: 108741 - protein, 28 aa, Artificial Sequence
  Description of Artificial Sequence: Synthetic peptide
QEGEIAPTNPCSSEQYGIVSCNLQSETR

SEQ ID NO: 108742 - protein, 28 aa, Artificial Sequence
  Description of Artificial Sequence: Synthetic peptide
QEGEIAPTNPCSSEQYGIVSCNLQSFTR

SEQ ID NO: 108743 - protein, 32 aa, Artificial Sequence
  Description of Artificial Sequence: Synthetic polypeptide
DEQNIATTNPVATEQYGSVSATDLEDHEGEDL

SEQ ID NO: 108744 - protein, 32 aa, Artificial Sequence
  Description of Artificial Sequence: Synthetic polypeptide
DEQMIATTNPVATEQYGSVSTYDLEDHEGPDL

SEQ ID NO: 108745 - protein, 29 aa, Artificial Sequence
  Description of Artificial Sequence: Synthetic peptide
QEEEIATTNPVATEQYGEVPEDVCQHEEK

SEQ ID NO: 108746 - protein, 32 aa, Artificial Sequence
  Description of Artificial Sequence: Synthetic polypeptide
DEQMIATTNPVATEQYGSVSATDLEDHEGEDL

SEQ ID NO: 108747 - protein, 33 aa, Artificial Sequence
  Description of Artificial Sequence: Synthetic polypeptide
DESEIRTTNPVATECWGSVSCINEPQDYEGENG

SEQ ID NO: 108748 - protein, 32 aa, Artificial Sequence
  Description of Artificial Sequence: Synthetic polypeptide
DEQLIATTNPVATEQYGSVSATDLEDWEGEDL

SEQ ID NO: 108749 - protein, 32 aa, Artificial Sequence
  Description of Artificial Sequence: Synthetic polypeptide
DEQLIATTNPVATEQYGSVSATDLECHEGEDL

SEQ ID NO: 108750 - protein, 32 aa, Artificial Sequence
  Description of Artificial Sequence: Synthetic polypeptide
DEQKIATTNPVATEQYGSVSATDLEDHEGEDV

SEQ ID NO: 108751 - protein, 32 aa, Artificial Sequence
  Description of Artificial Sequence: Synthetic polypeptide
DEQKIATTNPVATEQYGSVSATDLEDHEGEDL

SEQ ID NO: 108752 - protein, 28 aa, Artificial Sequence
  Description of Artificial Sequence: Synthetic peptide
QEGEIAPTNPCSSEQYGIVSCNLQSGDA

SEQ ID NO: 108753 - protein, 32 aa, Artificial Sequence
  Description of Artificial Sequence: Synthetic polypeptide
DEQIIATTNPVATEQYGSVSATGLEDHEGEDL

SEQ ID NO: 108754 - protein, 32 aa, Artificial Sequence
  Description of Artificial Sequence: Synthetic polypeptide
DEQIIATTNPVATEQYGSVSATDLEDHNGEDL

SEQ ID NO: 108755 - protein, 28 aa, Artificial Sequence
  Description of Artificial Sequence: Synthetic peptide
QEGEIAPTNPCSSEQYGIVSCNLQSGDI

SEQ ID NO: 108756 - protein, 32 aa, Artificial Sequence
  Description of Artificial Sequence: Synthetic polypeptide
DEQIIATTNPVATEQYGSVSATDLEDHEGEDY

SEQ ID NO: 108757 - protein, 32 aa, Artificial Sequence
  Description of Artificial Sequence: Synthetic polypeptide
DEQIIATTNPVATEQYGSVSATDLEDHEGEDL

SEQ ID NO: 108758 - protein, 32 aa, Artificial Sequence
  Description of Artificial Sequence: Synthetic polypeptide
DEQHIATTNPVATEQYGSVSLTDLEDHEGSDL

SEQ ID NO: 108759 - protein, 32 aa, Artificial Sequence
  Description of Artificial Sequence: Synthetic polypeptide
DEQHIATTNPVATEQYGSVSATDLEDHEGEDL

SEQ ID NO: 108760 - protein, 32 aa, Artificial Sequence
  Description of Artificial Sequence: Synthetic polypeptide
DEQHIATTNPVATEQYGSVSATDLEDHEGEDE

SEQ ID NO: 108761 - protein, 32 aa, Artificial Sequence
  Description of Artificial Sequence: Synthetic polypeptide
DEQLIATTNPVATEQYGSVSATDLEDHEGEDL

SEQ ID NO: 108762 - protein, 33 aa, Artificial Sequence
  Description of Artificial Sequence: Synthetic polypeptide
DESEIRTTNPVATECWGSVSCINEPQDREPENG

SEQ ID NO: 108763 - protein, 28 aa, Artificial Sequence
  Description of Artificial Sequence: Synthetic peptide
QEGEIAPTNPCSSEQYGIVSCVLQSGTR

SEQ ID NO: 108764 - protein, 34 aa, Artificial Sequence
  Description of Artificial Sequence: Synthetic polypeptide
DESEIRTTNPVATECWGSVSCINEPQEREGENMG

SEQ ID NO: 108765 - protein, 35 aa, Artificial Sequence
  Description of Artificial Sequence: Synthetic polypeptide
DEQEIRTTNPVATEQYGSVITANALQTVFIVENEN

SEQ ID NO: 108766 - protein, 34 aa, Artificial Sequence
  Description of Artificial Sequence: Synthetic polypeptide
DEQEIRTTNPVATEQYGSVFWTQSQNLQEQFEFD

SEQ ID NO: 108767 - protein, 29 aa, Artificial Sequence
  Description of Artificial Sequence: Synthetic peptide
QEGEIAPTNPCSTEQYGIVSCDGLQSGTR

SEQ ID NO: 108768 - protein, 32 aa, Artificial Sequence
  Description of Artificial Sequence: Synthetic polypeptide
DEQEIRTTNPVATEQYGSVEWWDNVQEDEQEI

SEQ ID NO: 108769 - protein, 28 aa, Artificial Sequence
  Description of Artificial Sequence: Synthetic peptide
QEEEIATTNPVATEQYGECGEVFQHEEK

SEQ ID NO: 108770 - protein, 29 aa, Artificial Sequence
  Description of Artificial Sequence: Synthetic peptide
QEGEIAPTNPCSTEQYGIVSCNLEDSGER

SEQ ID NO: 108771 - protein, 33 aa, Artificial Sequence
  Description of Artificial Sequence: Synthetic polypeptide
DEQEIRTTNPVATEQYGSVEVPDLTDERPNEHM

SEQ ID NO: 108772 - protein, 34 aa, Artificial Sequence
  Description of Artificial Sequence: Synthetic polypeptide
DEQEIRTTNPVATEQYGSVEVLQLGQMEGGNEST

SEQ ID NO: 108773 - protein, 29 aa, Artificial Sequence
  Description of Artificial Sequence: Synthetic peptide
QEGEIAPTNPCSTEQYGIVSCNLMSAGDR

SEQ ID NO: 108774 - protein, 29 aa, Artificial Sequence
  Description of Artificial Sequence: Synthetic peptide
QEGEIAPTNPCSTEQYGIVSCNLMSAGTR

SEQ ID NO: 108775 - protein, 29 aa, Artificial Sequence
  Description of Artificial Sequence: Synthetic peptide
QEEEIATTNPVATEQYGECAPNVCQHEEK

SEQ ID NO: 108776 - protein, 35 aa, Artificial Sequence
  Description of Artificial Sequence: Synthetic polypeptide
DEQEIRTTNPVATEQYGSVCSPTNSDIELYEDNSE

SEQ ID NO: 108777 - protein, 28 aa, Artificial Sequence
  Description of Artificial Sequence: Synthetic peptide
QEEEIATTNPVATEQYGECAEVCQHEEK

SEQ ID NO: 108778 - protein, 33 aa, Artificial Sequence
  Description of Artificial Sequence: Synthetic polypeptide
DEQEIRTTNPVATEQYGSVCSPDLDEDIENSQT

SEQ ID NO: 108779 - protein, 30 aa, Artificial Sequence
  Description of Artificial Sequence: Synthetic polypeptide
QEGEIAPTNPCSTEQYGIVSCNLQDSEGER

SEQ ID NO: 108780 - protein, 34 aa, Artificial Sequence
  Description of Artificial Sequence: Synthetic polypeptide
DEQEIRTTNPVATEQYGSVCPSEMVQRQLLEVNI

SEQ ID NO: 108781 - protein, 29 aa, Artificial Sequence
  Description of Artificial Sequence: Synthetic peptide
QEEEIATTNPVATEQYGEAYYVWQHGEDK

SEQ ID NO: 108782 - protein, 28 aa, Artificial Sequence
  Description of Artificial Sequence: Synthetic peptide
QEEEIATTNPVATEQYGEAYYMCQHEDK

SEQ ID NO: 108783 - protein, 29 aa, Artificial Sequence
  Description of Artificial Sequence: Synthetic peptide
QEGEIAPTNPCSTEQYGIVSCNLQNAGTA

SEQ ID NO: 108784 - protein, 28 aa, Artificial Sequence
  Description of Artificial Sequence: Synthetic peptide
QEEEIATTNPVATEQYGEAYFVDQHEEA

SEQ ID NO: 108785 - protein, 29 aa, Artificial Sequence
  Description of Artificial Sequence: Synthetic peptide
QEGEIAPTNPCSTEQYGIVSCNLQSAEDR

SEQ ID NO: 108786 - protein, 28 aa, Artificial Sequence
  Description of Artificial Sequence: Synthetic peptide
QEEEIATTNPVATEQYGEAYEVCQHEEN

SEQ ID NO: 108787 - protein, 33 aa, Artificial Sequence
  Description of Artificial Sequence: Synthetic polypeptide
DEQEIRTTNPVATEQYGSSSTGTTSQQHEGEFA

SEQ ID NO: 108788 - protein, 33 aa, Artificial Sequence
  Description of Artificial Sequence: Synthetic polypeptide
DEQEIRTTNPVATEQYGSSSTETSQQHEGLETN

SEQ ID NO: 108789 - protein, 28 aa, Artificial Sequence
  Description of Artificial Sequence: Synthetic peptide
QEEEIATTNPVATEQYGEAYEVCQHEEK

SEQ ID NO: 108790 - protein, 34 aa, Artificial Sequence
  Description of Artificial Sequence: Synthetic polypeptide
DEQEIRTTNPVATEQYGSVITANALTEVFNVEND

SEQ ID NO: 108791 - protein, 33 aa, Artificial Sequence
  Description of Artificial Sequence: Synthetic polypeptide
DEQEIRTTNPVATEQYGSLCSTETSQQHEGETN

SEQ ID NO: 108792 - protein, 28 aa, Artificial Sequence
  Description of Artificial Sequence: Synthetic peptide
QEGEIAPTNPCSTEQYGIVSCCLQSGTL

SEQ ID NO: 108793 - protein, 28 aa, Artificial Sequence
  Description of Artificial Sequence: Synthetic peptide
QEGEIAPTNPCSTEQYGIVSCCLQHGTL

SEQ ID NO: 108794 - protein, 28 aa, Artificial Sequence
  Description of Artificial Sequence: Synthetic peptide
QEEEIATTNPVATEQYGEHPEVCQHEEL

SEQ ID NO: 108795 - protein, 33 aa, Artificial Sequence
  Description of Artificial Sequence: Synthetic polypeptide
DESEIRTTNPVATECWGSVSCINEPQVGDGENI

SEQ ID NO: 108796 - protein, 33 aa, Artificial Sequence
  Description of Artificial Sequence: Synthetic polypeptide
DESEIRTTNPVATECWGSVSCINEPQVREHENG

SEQ ID NO: 108797 - protein, 28 aa, Artificial Sequence
  Description of Artificial Sequence: Synthetic peptide
QEEEIATTNPVATEQYGEHPEVCQHEEK

SEQ ID NO: 108798 - protein, 33 aa, Artificial Sequence
  Description of Artificial Sequence: Synthetic polypeptide
DESEIRTTNPVATECWGSVSCINEPQWREGETG

SEQ ID NO: 108799 - protein, 28 aa, Artificial Sequence
  Description of Artificial Sequence: Synthetic peptide
QEEEIATTNPVATEQYGEGPEVCQHEEK

SEQ ID NO: 108800 - protein, 28 aa, Artificial Sequence
  Description of Artificial Sequence: Synthetic peptide
QEEEIATTNPVATEQYGEFPEVCQHLEK

SEQ ID NO: 108801 - protein, 34 aa, Artificial Sequence
  Description of Artificial Sequence: Synthetic polypeptide
DEQEIRTTNPVATEQYGSVSATDGPEDRNGMEPV

SEQ ID NO: 108802 - protein, 33 aa, Artificial Sequence
  Description of Artificial Sequence: Synthetic polypeptide
DESEIRTTNPVATECWGSVSCINEPRDREGENG

SEQ ID NO: 108803 - protein, 28 aa, Artificial Sequence
  Description of Artificial Sequence: Synthetic peptide
QEEEIATTNPVATEQYGEFPEVCQHEEK

SEQ ID NO: 108804 - protein, 28 aa, Artificial Sequence
  Description of Artificial Sequence: Synthetic peptide
QEEEIATTNPVATEQYGECPEVIQHEEK

SEQ ID NO: 108805 - protein, 28 aa, Artificial Sequence
  Description of Artificial Sequence: Synthetic peptide
QEGEIAPTNPCSTEQYGIAPCNLQSGTR

SEQ ID NO: 108806 - protein, 33 aa, Artificial Sequence
  Description of Artificial Sequence: Synthetic polypeptide
DESEIRTTNPVATECWGSVSCINEPSDREGENG

SEQ ID NO: 108807 - protein, 30 aa, Artificial Sequence
  Description of Artificial Sequence: Synthetic polypeptide
CEEEIASVNPVGTEQYGVVSDNGQVSGNMQ

SEQ ID NO: 108808 - protein, 33 aa, Artificial Sequence
  Description of Artificial Sequence: Synthetic polypeptide
DESEIRTTNPVATECWGSVSCINEPTDREGENG

SEQ ID NO: 108809 - protein, 33 aa, Artificial Sequence
  Description of Artificial Sequence: Synthetic polypeptide
DESEIRTTNPVATECWGSVSCINEPTFREGENG

SEQ ID NO: 108810 - protein, 33 aa, Artificial Sequence
  Description of Artificial Sequence: Synthetic polypeptide
DESEIRTTNPVATECWGSVSCINEPVDREGENG

SEQ ID NO: 108811 - protein, 33 aa, Artificial Sequence
  Description of Artificial Sequence: Synthetic polypeptide
DESEIRTTNPVATECWGSVSCINEPWDREGENG

SEQ ID NO: 108812 - protein, 33 aa, Artificial Sequence
  Description of Artificial Sequence: Synthetic polypeptide
DESEIRTTNPVATECWGSVSCINEPWDREGRNG

SEQ ID NO: 108813 - protein, 28 aa, Artificial Sequence
  Description of Artificial Sequence: Synthetic peptide
QEGEIAPTNPCSTEQYGIMASNLQSGDR

SEQ ID NO: 108814 - protein, 28 aa, Artificial Sequence
  Description of Artificial Sequence: Synthetic peptide
QEGEIAPTNPCSTEQYGIMASNLQSGTR

SEQ ID NO: 108815 - protein, 33 aa, Artificial Sequence
  Description of Artificial Sequence: Synthetic polypeptide
DESEIRTTNPVATECWGSVSCINEPYDREGENG

SEQ ID NO: 108816 - protein, 30 aa, Artificial Sequence
  Description of Artificial Sequence: Synthetic polypeptide
QEGEIAPTNPCSTEQYGIVSACNLQDSGTR

SEQ ID NO: 108817 - protein, 29 aa, Artificial Sequence
  Description of Artificial Sequence: Synthetic peptide
QEGEIAPTNPCSTEQYGIVSACNLQSGTL

SEQ ID NO: 108818 - protein, 28 aa, Artificial Sequence
  Description of Artificial Sequence: Synthetic peptide
QEEEIATTNPVATEQYGECPEVCQHEEK

SEQ ID NO: 108819 - protein, 32 aa, Artificial Sequence
  Description of Artificial Sequence: Synthetic polypeptide
DEQEIRTTNPVATEQYGSVSACDEEDHEGEEG

SEQ ID NO: 108820 - protein, 31 aa, Artificial Sequence
  Description of Artificial Sequence: Synthetic polypeptide
CEEEIASVNPVGTEQYGVVISDNLQDSGNMQ

SEQ ID NO: 108821 - protein, 28 aa, Artificial Sequence
  Description of Artificial Sequence: Synthetic peptide
QEEEIATTNPVATEQYGEAYESCQHEEK

SEQ ID NO: 108822 - protein, 29 aa, Artificial Sequence
  Description of Artificial Sequence: Synthetic peptide
QEGEIAPTNPCSTEQYGIVSENLQNAGTA

SEQ ID NO: 108823 - protein, 33 aa, Artificial Sequence
  Description of Artificial Sequence: Synthetic polypeptide
DEQEIRTTNPVATEQYGCVSVDTLQEHEINSGQ

SEQ ID NO: 108824 - protein, 29 aa, Artificial Sequence
  Description of Artificial Sequence: Synthetic peptide
QEGEIAPTNPCSYEQYGIVSCNDLQHGTR

SEQ ID NO: 108825 - protein, 28 aa, Artificial Sequence
  Description of Artificial Sequence: Synthetic peptide
QEGEIAPTNPCSYEQYGIVSCNDQSGTR

SEQ ID NO: 108826 - protein, 29 aa, Artificial Sequence
  Description of Artificial Sequence: Synthetic peptide
QEGEIAPTNPCSYEQYGIVSCNELQSGTR

SEQ ID NO: 108827 - protein, 28 aa, Artificial Sequence
  Description of Artificial Sequence: Synthetic peptide
QEGEIAPTNPCSYEQYGIVSCNLQDGTL

SEQ ID NO: 108828 - protein, 28 aa, Artificial Sequence
  Description of Artificial Sequence: Synthetic peptide
QEEEIATTNPVATEQYGEAWEVCQHEEK

SEQ ID NO: 108829 - protein, 32 aa, Artificial Sequence
  Description of Artificial Sequence: Synthetic polypeptide
DEQEIRTTNPVATEQYGCVSNVQQENQEVEEI

SEQ ID NO: 108830 - protein, 31 aa, Artificial Sequence
  Description of Artificial Sequence: Synthetic polypeptide
DEQEIRTTNPVATEQYGCVSMVIENPEGVEI

SEQ ID NO: 108831 - protein, 30 aa, Artificial Sequence
  Description of Artificial Sequence: Synthetic polypeptide
DEQEIRTTNPVATEQYGCVSMVDENVEVEI

SEQ ID NO: 108832 - protein, 29 aa, Artificial Sequence
  Description of Artificial Sequence: Synthetic peptide
QEGEIAPTNPCSYEQYGIVSCNLQIGTRR

SEQ ID NO: 108833 - protein, 29 aa, Artificial Sequence
  Description of Artificial Sequence: Synthetic peptide
QEGEIAPTNPCSYEQYGIVSCNLQQGTTR

SEQ ID NO: 108834 - protein, 28 aa, Artificial Sequence
  Description of Artificial Sequence: Synthetic peptide
QEGEIAPTNPCSYEQYGIVSCNLQSGAP

SEQ ID NO: 108835 - protein, 32 aa, Artificial Sequence
  Description of Artificial Sequence: Synthetic polypeptide
DEQEIRTTNPVATEQYGAVSATDWEDHEGEDL

SEQ ID NO: 108836 - protein, 29 aa, Artificial Sequence
  Description of Artificial Sequence: Synthetic peptide
QEGEIAPTNPCSYEQYGIVSCNLQSGPRM

SEQ ID NO: 108837 - protein, 29 aa, Artificial Sequence
  Description of Artificial Sequence: Synthetic peptide
QEEEIATTNPVATEQYGEAVPEVQQHEEK

SEQ ID NO: 108838 - protein, 29 aa, Artificial Sequence
  Description of Artificial Sequence: Synthetic peptide
QEEEIATTNPVATEQYGEAVPEVCQHEEQ

SEQ ID NO: 108839 - protein, 29 aa, Artificial Sequence
  Description of Artificial Sequence: Synthetic peptide
QEEEIATTNPVATEQYGEAVPEVCQHEEK

SEQ ID NO: 108840 - protein, 33 aa, Artificial Sequence
  Description of Artificial Sequence: Synthetic polypeptide
DEQEIRTTNPVATEQWGSVSTIDEQDHEGEEDG

SEQ ID NO: 108841 - protein, 29 aa, Artificial Sequence
  Description of Artificial Sequence: Synthetic peptide
QEEEIATTNPVATEQYGEAVEVICQHEEK

SEQ ID NO: 108842 - protein, 29 aa, Artificial Sequence
  Description of Artificial Sequence: Synthetic peptide
QEGEIAPTNPCSYEQYGQVSCNLQSVTNR

SEQ ID NO: 108843 - protein, 29 aa, Artificial Sequence
  Description of Artificial Sequence: Synthetic peptide
QEGEIAPTNPCSYEQYGRIVSCNLQSGTR

SEQ ID NO: 108844 - protein, 33 aa, Artificial Sequence
  Description of Artificial Sequence: Synthetic polypeptide
DESEIRTTNPVATECWGSVSCINEVQDREMENG

SEQ ID NO: 108845 - protein, 29 aa, Artificial Sequence
  Description of Artificial Sequence: Synthetic peptide
QEGEIAPTNPCSYEQYGTVSCNLQSGWTR

SEQ ID NO: 108846 - protein, 31 aa, Artificial Sequence
  Description of Artificial Sequence: Synthetic polypeptide
DEQEIRTTNPVATEQWGSVSATIEMNHEEEA

SEQ ID NO: 108847 - protein, 33 aa, Artificial Sequence
  Description of Artificial Sequence: Synthetic polypeptide
DEQEIRTTNPVATEQWGSVSATIDEQDHEGEDG

SEQ ID NO: 108848 - protein, 32 aa, Artificial Sequence
  Description of Artificial Sequence: Synthetic polypeptide
DEQEIRTTNPVATEQYGCWSVDTLDEHINDGQ

SEQ ID NO: 108849 - protein, 29 aa, Artificial Sequence
  Description of Artificial Sequence: Synthetic peptide
QEGEIAPTNPCSTEQYGIVSCNLVQSGTD

SEQ ID NO: 108850 - protein, 29 aa, Artificial Sequence
  Description of Artificial Sequence: Synthetic peptide
QEGEIAPTNPCSYEPYGHVSCNLQSGTNR

SEQ ID NO: 108851 - protein, 31 aa, Artificial Sequence
  Description of Artificial Sequence: Synthetic polypeptide
DEQEIRTTNPVATEQYGDVSAEDEENHEGDA

SEQ ID NO: 108852 - protein, 28 aa, Artificial Sequence
  Description of Artificial Sequence: Synthetic peptide
QEEEIATTNPVATEQYGEAYEHCQHEEG

SEQ ID NO: 108853 - protein, 29 aa, Artificial Sequence
  Description of Artificial Sequence: Synthetic peptide
QEGEIAPTNPCSTEQYGIVSENLQSAEDR

SEQ ID NO: 108854 - protein, 29 aa, Artificial Sequence
  Description of Artificial Sequence: Synthetic peptide
QEEEIATTNPVATEQYGEAWPEVWQHGEK

SEQ ID NO: 108855 - protein, 33 aa, Artificial Sequence
  Description of Artificial Sequence: Synthetic polypeptide
DESEIRTTNPVATECWGSVSCINETQDNEGENG

SEQ ID NO: 108856 - protein, 35 aa, Artificial Sequence
  Description of Artificial Sequence: Synthetic polypeptide
AEEEIRTTNPVATEQYGSVSVNTNNDESGTVNNTD

SEQ ID NO: 108857 - protein, 29 aa, Artificial Sequence
  Description of Artificial Sequence: Synthetic peptide
QEEEIATTNPVATEQYGEAWPEVCQHGEK

SEQ ID NO: 108858 - protein, 33 aa, Artificial Sequence
  Description of Artificial Sequence: Synthetic polypeptide
DEQEIRTTNPVATEQYGSCYTNNLETGISMQEM

SEQ ID NO: 108859 - protein, 33 aa, Artificial Sequence
  Description of Artificial Sequence: Synthetic polypeptide
DESEIRTTNPVATECWGSVSCINEVQDFEGENG

SEQ ID NO: 108860 - protein, 28 aa, Artificial Sequence
  Description of Artificial Sequence: Synthetic peptide
QEEEIATTNPVATEQYGEAWEVWQHEEK

SEQ ID NO: 108861 - protein, 28 aa, Artificial Sequence
  Description of Artificial Sequence: Synthetic peptide
QEEEIATTNPVATEQYGEAWEVNQHEEK

SEQ ID NO: 108862 - protein, 34 aa, Artificial Sequence
  Description of Artificial Sequence: Synthetic polypeptide
DESEIRTTNPVATECWGSVSCINEVQDREGENGG

SEQ ID NO: 108863 - protein, 29 aa, Artificial Sequence
  Description of Artificial Sequence: Synthetic peptide
QEGEIAPTNPCSVEQYGIVSCDNLQSGTR

SEQ ID NO: 108864 - protein, 28 aa, Artificial Sequence
  Description of Artificial Sequence: Synthetic peptide
QEGEIAPTNPCSWEQYGIVGCNLQSGTR

SEQ ID NO: 108865 - protein, 28 aa, Artificial Sequence
  Description of Artificial Sequence: Synthetic peptide
QEEEIATTNPVATEQYGEAWEVCQHMEK

SEQ ID NO: 108866 - protein, 29 aa, Artificial Sequence
  Description of Artificial Sequence: Synthetic peptide
QEGEIAPTNPCSWEQYGIVSCNLQSGTRC

SEQ ID NO: 108867 - protein, 29 aa, Artificial Sequence
  Description of Artificial Sequence: Synthetic peptide
QEGEIAPTNPCSWEQYGIVSCNLQSGTVR

SEQ ID NO: 108868 - protein, 29 aa, Artificial Sequence
  Description of Artificial Sequence: Synthetic peptide
QEGEIAPTNPCSWEQYGIVSCNLQSHGTR

SEQ ID NO: 108869 - protein, 28 aa, Artificial Sequence
  Description of Artificial Sequence: Synthetic peptide
QEEEIATTNPVATEQYGEAWEVCQHIEK

SEQ ID NO: 108870 - protein, 29 aa, Artificial Sequence
  Description of Artificial Sequence: Synthetic peptide
QEGEIAPTNPCSWEQYGNTVSCNLQSGTR

SEQ ID NO: 108871 - protein, 29 aa, Artificial Sequence
  Description of Artificial Sequence: Synthetic peptide
QEGEIAPTNPCSWEQYGQIVSCNLQSGTR

SEQ ID NO: 108872 - protein, 29 aa, Artificial Sequence
  Description of Artificial Sequence: Synthetic peptide
QEGEIAPTNPCSYEAYGIVSCNLQSGSNR

SEQ ID NO: 108873 - protein, 31 aa, Artificial Sequence
  Description of Artificial Sequence: Synthetic polypeptide
DEQEIRTTNPVATEQYGDVSAEIEENHEGDA

SEQ ID NO: 108874 - protein, 31 aa, Artificial Sequence
  Description of Artificial Sequence: Synthetic polypeptide
DEQEIRTTNPVATEQYGDVSAEIEENAEGDA

SEQ ID NO: 108875 - protein, 32 aa, Artificial Sequence
  Description of Artificial Sequence: Synthetic polypeptide
DEQEIRTTNPVATEQYGDVSAEDLMNHEGEDL

SEQ ID NO: 108876 - protein, 31 aa, Artificial Sequence
  Description of Artificial Sequence: Synthetic polypeptide
DEQEIRTTNPVATEQYGDVSAEDEENHEGDL

SEQ ID NO: 108877 - protein, 31 aa, Artificial Sequence
  Description of Artificial Sequence: Synthetic polypeptide
DEQEIRTTNPVATEQYGDVSAEDEEDHEGEL

SEQ ID NO: 108878 - protein, 34 aa, Artificial Sequence
  Description of Artificial Sequence: Synthetic polypeptide
DESEIRTTNPVATECWGSVSCINEPQTREGFNGV

SEQ ID NO: 108879 - protein, 28 aa, Artificial Sequence
  Description of Artificial Sequence: Synthetic peptide
QEGEIAPTNPCSTECYGDVSENLQHETR

SEQ ID NO: 108880 - protein, 29 aa, Artificial Sequence
  Description of Artificial Sequence: Synthetic peptide
QEEEIATTNPVATEQYGEIAPEVCQHENK

SEQ ID NO: 108881 - protein, 28 aa, Artificial Sequence
  Description of Artificial Sequence: Synthetic peptide
QEEEIATTNPVATEQYGERPEVCQDEEV

SEQ ID NO: 108882 - protein, 33 aa, Artificial Sequence
  Description of Artificial Sequence: Synthetic polypeptide
DESEIRTTNPVATECWGSVSCINEPQMREGEHG

SEQ ID NO: 108883 - protein, 28 aa, Artificial Sequence
  Description of Artificial Sequence: Synthetic peptide
QEEEIATTNPVATEQYGEQPEVCQCEEK

SEQ ID NO: 108884 - protein, 28 aa, Artificial Sequence
  Description of Artificial Sequence: Synthetic peptide
QEGEIAPTNPCSSEQYGKVSCNLQSPTR

SEQ ID NO: 108885 - protein, 28 aa, Artificial Sequence
  Description of Artificial Sequence: Synthetic peptide
QEEEIATTNPVATEQYGEMPSVCQHEEK

SEQ ID NO: 108886 - protein, 34 aa, Artificial Sequence
  Description of Artificial Sequence: Synthetic polypeptide
DEQEIRTTNPVATEQYGSVSTLNDMEQFEEQDEM

SEQ ID NO: 108887 - protein, 28 aa, Artificial Sequence
  Description of Artificial Sequence: Synthetic peptide
QEEEIATTNPVATEQYGEMPSVCQHEDK

SEQ ID NO: 108888 - protein, 28 aa, Artificial Sequence
  Description of Artificial Sequence: Synthetic peptide
QEGEIAPTNPCSSEQYGLVSCNLQSGTT

SEQ ID NO: 108889 - protein, 28 aa, Artificial Sequence
  Description of Artificial Sequence: Synthetic peptide
QEGEIAPTNPCSSEQYGMVSCGLQSGTR

SEQ ID NO: 108890 - protein, 29 aa, Artificial Sequence
  Description of Artificial Sequence: Synthetic peptide
QEGEIAPTNPCSSEQYGNVSCINLQSGTR

SEQ ID NO: 108891 - protein, 28 aa, Artificial Sequence
  Description of Artificial Sequence: Synthetic peptide
QEGEIAPTNPCSSEQYGNVSCKLQSGTR

SEQ ID NO: 108892 - protein, 34 aa, Artificial Sequence
  Description of Artificial Sequence: Synthetic polypeptide
DEQEIRTTNPVATEQYGSVSSTTPDLNMHNGEPV

SEQ ID NO: 108893 - protein, 34 aa, Artificial Sequence
  Description of Artificial Sequence: Synthetic polypeptide
DEQEIRTTNPVATEQYGSVSSTTPDLNDHNGEPV

SEQ ID NO: 108894 - protein, 34 aa, Artificial Sequence
  Description of Artificial Sequence: Synthetic polypeptide
DEQEIRTTNPVATEQYGSVSSTTPDLNDHNGEDV

SEQ ID NO: 108895 - protein, 34 aa, Artificial Sequence
  Description of Artificial Sequence: Synthetic polypeptide
DEQEIRTTNPVATEQYGSVSSTTPALNMHNGEPV

SEQ ID NO: 108896 - protein, 35 aa, Artificial Sequence
  Description of Artificial Sequence: Synthetic polypeptide
DEQEIRTTNPVATEQYGSVSSTTPAGPNMHNGNDV

SEQ ID NO: 108897 - protein, 35 aa, Artificial Sequence
  Description of Artificial Sequence: Synthetic polypeptide
DEQEIRTTNPVATEQYGSVSSTTPAGPNMHEGNDV

SEQ ID NO: 108898 - protein, 35 aa, Artificial Sequence
  Description of Artificial Sequence: Synthetic polypeptide
DEQEIRTTNPVATEQYGSVSSTTPAGEMREGMNPV

SEQ ID NO: 108899 - protein, 28 aa, Artificial Sequence
  Description of Artificial Sequence: Synthetic peptide
QEGEIAPTNPCSSEQYGQNSCNLQSGTR

SEQ ID NO: 108900 - protein, 28 aa, Artificial Sequence
  Description of Artificial Sequence: Synthetic peptide
QEGEIAPTNPCSSEQYGQVSCNLDSGTR

SEQ ID NO: 108901 - protein, 28 aa, Artificial Sequence
  Description of Artificial Sequence: Synthetic peptide
QEGEIAPTNPCSSEQYGQVSCNLMSGTR

SEQ ID NO: 108902 - protein, 34 aa, Artificial Sequence
  Description of Artificial Sequence: Synthetic polypeptide
DEQEIRTTNPVATEQYGSVSSTTAGPEDHEGNPL

SEQ ID NO: 108903 - protein, 34 aa, Artificial Sequence
  Description of Artificial Sequence: Synthetic polypeptide
DEQEIRTTNPVATEQYGSVSSTTAGEDHNGMNDV

SEQ ID NO: 108904 - protein, 33 aa, Artificial Sequence
  Description of Artificial Sequence: Synthetic polypeptide
DEQEIRTTNPVATEQYGSVSSTTAGEDHEGEPL

SEQ ID NO: 108905 - protein, 29 aa, Artificial Sequence
  Description of Artificial Sequence: Synthetic peptide
QEGEIAPTNPCSSEQYGQVSCNLQSGTKR

SEQ ID NO: 108906 - protein, 34 aa, Artificial Sequence
  Description of Artificial Sequence: Synthetic polypeptide
CEEEIACTNPVATEQYGSVCTDNLPQNQGGNVAQ

SEQ ID NO: 108907 - protein, 28 aa, Artificial Sequence
  Description of Artificial Sequence: Synthetic peptide
QEEEIATTNPVATEQYGEMPEVCQHEEK

SEQ ID NO: 108908 - protein, 28 aa, Artificial Sequence
  Description of Artificial Sequence: Synthetic peptide
QEEEIATTNPVATEQYGERPEVCQHEDK

SEQ ID NO: 108909 - protein, 30 aa, Artificial Sequence
  Description of Artificial Sequence: Synthetic polypeptide
QEGEIAPTNPCSSEQYGIVSTNLQDSGEDR

SEQ ID NO: 108910 - protein, 34 aa, Artificial Sequence
  Description of Artificial Sequence: Synthetic polypeptide
DEQEIRTTNPVATEQYGSVSWDDDLEQMDQNDSF

SEQ ID NO: 108911 - protein, 28 aa, Artificial Sequence
  Description of Artificial Sequence: Synthetic peptide
QEGEIAPTNPCSSEQYGIVSENLQSLTR

SEQ ID NO: 108912 - protein, 28 aa, Artificial Sequence
  Description of Artificial Sequence: Synthetic peptide
QEEEIATTNPVATEQYGETPEVCQHEEK

SEQ ID NO: 108913 - protein, 33 aa, Artificial Sequence
  Description of Artificial Sequence: Synthetic polypeptide
DESEIRTTNPVATECWGSVSCINEPQEREGEPG

SEQ ID NO: 108914 - protein, 28 aa, Artificial Sequence
  Description of Artificial Sequence: Synthetic peptide
QEEEIATTNPVATEQYGETPEQCQHEEK

SEQ ID NO: 108915 - protein, 28 aa, Artificial Sequence
  Description of Artificial Sequence: Synthetic peptide
QEEEIATTNPVATEQYGETPEDCQHEEK

SEQ ID NO: 108916 - protein, 28 aa, Artificial Sequence
  Description of Artificial Sequence: Synthetic peptide
QEEEIATTNPVATEQYGETAEDCQHEEI

SEQ ID NO: 108917 - protein, 28 aa, Artificial Sequence
  Description of Artificial Sequence: Synthetic peptide
QEGEIAPTNPCSSEQYGIVSMNLQSGTH

SEQ ID NO: 108918 - protein, 33 aa, Artificial Sequence
  Description of Artificial Sequence: Synthetic polypeptide
CEEEIACTNPVATEQYGSVATNPTQNHQGNTEE

SEQ ID NO: 108919 - protein, 32 aa, Artificial Sequence
  Description of Artificial Sequence: Synthetic polypeptide
CEEEIACTNPVATEQYGSVATPLTGAEGGNED

SEQ ID NO: 108920 - protein, 35 aa, Artificial Sequence
  Description of Artificial Sequence: Synthetic polypeptide
DEQEIRTTNPVATEQYGSVSVTALLETGNGDEIDG

SEQ ID NO: 108921 - protein, 33 aa, Artificial Sequence
  Description of Artificial Sequence: Synthetic polypeptide
DESEIRTTNPVATECWGSVSCINEPQHREGEGG

SEQ ID NO: 108922 - protein, 34 aa, Artificial Sequence
  Description of Artificial Sequence: Synthetic polypeptide
DESEIRTTNPVATECWGSVSCINEPQHREGENDG

SEQ ID NO: 108923 - protein, 28 aa, Artificial Sequence
  Description of Artificial Sequence: Synthetic peptide
QEGEIAPTNPCSSEQYGIVSMNVQSGTR

SEQ ID NO: 108924 - protein, 34 aa, Artificial Sequence
  Description of Artificial Sequence: Synthetic polypeptide
QEEEIATTNPVATEQYGESVSCNPLRIQGEDHRI

SEQ ID NO: 108925 - protein, 34 aa, Artificial Sequence
  Description of Artificial Sequence: Synthetic polypeptide
DEQEIRTTNPVATEQYGSVSVMALANVEGGQNEI

SEQ ID NO: 108926 - protein, 34 aa, Artificial Sequence
  Description of Artificial Sequence: Synthetic polypeptide
DEQEIRTTNPVATEQYGSVSVLNDTENFEGNTEM

SEQ ID NO: 108927 - protein, 34 aa, Artificial Sequence
  Description of Artificial Sequence: Synthetic polypeptide
DEQEIRTTNPVATEQYGSVSVDNNQFEEGSEEGL

SEQ ID NO: 108928 - protein, 33 aa, Artificial Sequence
  Description of Artificial Sequence: Synthetic polypeptide
DESEIRTTNPVATECWGSVSCINEPQKREFENG

SEQ ID NO: 108929 - protein, 34 aa, Artificial Sequence
  Description of Artificial Sequence: Synthetic polypeptide
DEQEIRTTNPVATEQYGSVSVDNENQEEGMEETG

SEQ ID NO: 108930 - protein, 28 aa, Artificial Sequence
  Description of Artificial Sequence: Synthetic peptide
QEGEIAPTNPCSSEQYGIVSNNQQSGTR

SEQ ID NO: 108931 - protein, 28 aa, Artificial Sequence
  Description of Artificial Sequence: Synthetic peptide
QEEEIATTNPVATEQYGESPFVDQHEEQ

SEQ ID NO: 108932 - protein, 28 aa, Artificial Sequence
  Description of Artificial Sequence: Synthetic peptide
QEEEIATTNPVATEQYGESPEVCQHEEK

SEQ ID NO: 108933 - protein, 28 aa, Artificial Sequence
  Description of Artificial Sequence: Synthetic peptide
QEEEIATTNPVATEQYGERPEVCQHEEK

SEQ ID NO: 108934 - protein, 28 aa, Artificial Sequence
  Description of Artificial Sequence: Synthetic peptide
QEGEIAPTNPCSSEQYGIVSSNNQSGTR

SEQ ID NO: 108935 - protein, 36 aa, Artificial Sequence
  Description of Artificial Sequence: Synthetic polypeptide
DEQEIRTTNPVATEQYGSVSTPLHLNSEEIQGNSRQ

SEQ ID NO: 108936 - protein, 35 aa, Artificial Sequence
  Description of Artificial Sequence: Synthetic polypeptide
DEQEIRTTNPVATEQYGSVSSNWNSLPEFHGDLNQ

SEQ ID NO: 108937 - protein, 35 aa, Artificial Sequence
  Description of Artificial Sequence: Synthetic polypeptide
DEQEIRTTNPVATEQYGSVSSATPDLPNMREGEPV

SEQ ID NO: 108938 - protein, 35 aa, Artificial Sequence
  Description of Artificial Sequence: Synthetic polypeptide
DEQEIRTTNPVATEQYGSVSSATPDLPEMREGEPV

SEQ ID NO: 108939 - protein, 28 aa, Artificial Sequence
  Description of Artificial Sequence: Synthetic peptide
QEGEIAPTNPCSSERYGIVSCNLQSGTR

SEQ ID NO: 108940 - protein, 28 aa, Artificial Sequence
  Description of Artificial Sequence: Synthetic peptide
QEGEIAPTNPCSSESYGIVSCNLQSGTR

SEQ ID NO: 108941 - protein, 28 aa, Artificial Sequence
  Description of Artificial Sequence: Synthetic peptide
QEGEIAPTNPCSSESYGMVSCNLQSGTR

SEQ ID NO: 108942 - protein, 28 aa, Artificial Sequence
  Description of Artificial Sequence: Synthetic peptide
QEGEIAPTNPCSSETYGIVSCNLQSGTR

SEQ ID NO: 108943 - protein, 28 aa, Artificial Sequence
  Description of Artificial Sequence: Synthetic peptide
QEGEIAPTNPCSSEVYGIVSCNLQSGTR

SEQ ID NO: 108944 - protein, 28 aa, Artificial Sequence
  Description of Artificial Sequence: Synthetic peptide
QEGEIAPTNPCSSEWYGIVSCNLQSGTR

SEQ ID NO: 108945 - protein, 28 aa, Artificial Sequence
  Description of Artificial Sequence: Synthetic peptide
QEGEIAPTNPCSSEYYGIVSCNLQSGTR

SEQ ID NO: 108946 - protein, 28 aa, Artificial Sequence
  Description of Artificial Sequence: Synthetic peptide
QEGEIAPTNPCSSFQYGIVSCNLQSGTR

SEQ ID NO: 108947 - protein, 30 aa, Artificial Sequence
  Description of Artificial Sequence: Synthetic polypeptide
CEEEIASVNPVCTEQYGVVSWNLQSGSDQA

SEQ ID NO: 108948 - protein, 28 aa, Artificial Sequence
  Description of Artificial Sequence: Synthetic peptide
QEGEIAPTNPCSSGQYGIVSCNLQSGTR

SEQ ID NO: 108949 - protein, 28 aa, Artificial Sequence
  Description of Artificial Sequence: Synthetic peptide
QEGEIAPTNPCSSHQYGIVSCNLQSGTR

SEQ ID NO: 108950 - protein, 28 aa, Artificial Sequence
  Description of Artificial Sequence: Synthetic peptide
QEGEIAPTNPCSSLQYGIVSCNLQSGTR

SEQ ID NO: 108951 - protein, 28 aa, Artificial Sequence
  Description of Artificial Sequence: Synthetic peptide
QEGEIAPTNPCSSMQYGIVSCNLQSGTR

SEQ ID NO: 108952 - protein, 28 aa, Artificial Sequence
  Description of Artificial Sequence: Synthetic peptide
QEGEIAPTNPCSSNQYGIVSCNLQSGTR

SEQ ID NO: 108953 - protein, 28 aa, Artificial Sequence
  Description of Artificial Sequence: Synthetic peptide
QEGEIAPTNPCSSQQYGIVSCNLQSGTR

SEQ ID NO: 108954 - protein, 28 aa, Artificial Sequence
  Description of Artificial Sequence: Synthetic peptide
QEEEIATTNPVATEQYGEIPEDCQQEEK

SEQ ID NO: 108955 - protein, 28 aa, Artificial Sequence
  Description of Artificial Sequence: Synthetic peptide
QEEEIATTNPVATEQYGEIPEDCQHEEK

SEQ ID NO: 108956 - protein, 28 aa, Artificial Sequence
  Description of Artificial Sequence: Synthetic peptide
QEGEIAPTNPCSSRQYGIVSCNLQSGTR

SEQ ID NO: 108957 - protein, 28 aa, Artificial Sequence
  Description of Artificial Sequence: Synthetic peptide
QEGEIAPTNPCSSSQYGIVSCNLQSGTR

SEQ ID NO: 108958 - protein, 28 aa, Artificial Sequence
  Description of Artificial Sequence: Synthetic peptide
QEGEIAPTNPCSSTQYGIVSCNLQGGTR

SEQ ID NO: 108959 - protein, 28 aa, Artificial Sequence
  Description of Artificial Sequence: Synthetic peptide
QEGEIAPTNPCSSTQYGIVSCNLQSGTR

SEQ ID NO: 108960 - protein, 28 aa, Artificial Sequence
  Description of Artificial Sequence: Synthetic peptide
QEGEIAPTNPCSSWQYGIVSCNLQSGTR

SEQ ID NO: 108961 - protein, 28 aa, Artificial Sequence
  Description of Artificial Sequence: Synthetic peptide
QEGEIAPTNPCSSYQYGIVSCNLQSGTR

SEQ ID NO: 108962 - protein, 28 aa, Artificial Sequence
  Description of Artificial Sequence: Synthetic peptide
QEEEIATTNPVATEQYGEIPDVCQHEEK

SEQ ID NO: 108963 - protein, 28 aa, Artificial Sequence
  Description of Artificial Sequence: Synthetic peptide
QEGEIAPTNPCSTECYGDVSCCLQHGER

SEQ ID NO: 108964 - protein, 28 aa, Artificial Sequence
  Description of Artificial Sequence: Synthetic peptide
QEEEIATTNPVATEQYGEIPESCQHEEK

SEQ ID NO: 108965 - protein, 33 aa, Artificial Sequence
  Description of Artificial Sequence: Synthetic polypeptide
DESEIRTTNPVATECWGSVSCINEPQRREGESG

SEQ ID NO: 108966 - protein, 28 aa, Artificial Sequence
  Description of Artificial Sequence: Synthetic peptide
QEEEIATTNPVATEQYGEIPEVCQHEEK

SEQ ID NO: 108967 - protein, 29 aa, Artificial Sequence
  Description of Artificial Sequence: Synthetic peptide
QEEEIATTNPVATEQYGEIPEVCQQHGEH

SEQ ID NO: 108968 - protein, 35 aa, Artificial Sequence
  Description of Artificial Sequence: Synthetic polypeptide
DEQEIRTTNPVATEQYGSVSSATPDLNMHEGMNPL

SEQ ID NO: 108969 - protein, 28 aa, Artificial Sequence
  Description of Artificial Sequence: Synthetic peptide
QEEEIATTNPVATEQYGEMPEVCQHEEI

SEQ ID NO: 108970 - protein, 35 aa, Artificial Sequence
  Description of Artificial Sequence: Synthetic polypeptide
DEQEIRTTNPVATEQYGSVSSATPAGEMREGMNPV

SEQ ID NO: 108971 - protein, 35 aa, Artificial Sequence
  Description of Artificial Sequence: Synthetic polypeptide
DEQEIRTTNPVATEQYGSVSSATPAGEDREGMNPV

SEQ ID NO: 108972 - protein, 33 aa, Artificial Sequence
  Description of Artificial Sequence: Synthetic polypeptide
DESEIRTTNPVATECWGSVSCINEPQQQEGENG

SEQ ID NO: 108973 - protein, 30 aa, Artificial Sequence
  Description of Artificial Sequence: Synthetic polypeptide
CEEEIASVNPVCTEQYGVVCSWNLQSSGDQ

SEQ ID NO: 108974 - protein, 28 aa, Artificial Sequence
  Description of Artificial Sequence: Synthetic peptide
QEEEIATTNPVATEQYGEMPETCQHEEK

SEQ ID NO: 108975 - protein, 28 aa, Artificial Sequence
  Description of Artificial Sequence: Synthetic peptide
QEEEIATTNPVATEQYGELPRVCQHEEK

SEQ ID NO: 108976 - protein, 29 aa, Artificial Sequence
  Description of Artificial Sequence: Synthetic peptide
QEGEIAPTNPCSSEQYGSVSTDLEDHGTR

SEQ ID NO: 108977 - protein, 28 aa, Artificial Sequence
  Description of Artificial Sequence: Synthetic peptide
QEEEIATTNPVATEQYGELPEVCQHEEK

SEQ ID NO: 108978 - protein, 28 aa, Artificial Sequence
  Description of Artificial Sequence: Synthetic peptide
QEEEIATTNPVATEQYGELPEVCQHEEG

SEQ ID NO: 108979 - protein, 28 aa, Artificial Sequence
  Description of Artificial Sequence: Synthetic peptide
QEGEIAPTNPCSSEQYGTVSCNLQHGTT

SEQ ID NO: 108980 - protein, 28 aa, Artificial Sequence
  Description of Artificial Sequence: Synthetic peptide
QEEEIATTNPVATEQYGETPEVCQHEET

SEQ ID NO: 108981 - protein, 29 aa, Artificial Sequence
  Description of Artificial Sequence: Synthetic peptide
QEGEIAPTNPCSSEQYGTVSCNLQMSGTR

SEQ ID NO: 108982 - protein, 28 aa, Artificial Sequence
  Description of Artificial Sequence: Synthetic peptide
QEGEIAPTNPCSSEQYGTVSCNLQSGMM

SEQ ID NO: 108983 - protein, 35 aa, Artificial Sequence
  Description of Artificial Sequence: Synthetic polypeptide
DEQEIRTTNPVATEQYGSVSMTMLSSIESDQENRM

SEQ ID NO: 108984 - protein, 30 aa, Artificial Sequence
  Description of Artificial Sequence: Synthetic polypeptide
QEEEIATTNPVATEQYGEISEEVCQQHGEK

SEQ ID NO: 108985 - protein, 29 aa, Artificial Sequence
  Description of Artificial Sequence: Synthetic peptide
QEGEIAPTNPCSSEQYGTVSCNLQSGTRP

SEQ ID NO: 108986 - protein, 28 aa, Artificial Sequence
  Description of Artificial Sequence: Synthetic peptide
QEGEIAPTNPCSSEQYGVVSCNLMSGTR

SEQ ID NO: 108987 - protein, 35 aa, Artificial Sequence
  Description of Artificial Sequence: Synthetic polypeptide
DEQEIRTTNPVATEQYGSVSLTNELEVTEEDNLVI

SEQ ID NO: 108988 - protein, 34 aa, Artificial Sequence
  Description of Artificial Sequence: Synthetic polypeptide
DEQEIRTTNPVATEQYGSVSITNQEVRVVEVPGA

SEQ ID NO: 108989 - protein, 29 aa, Artificial Sequence
  Description of Artificial Sequence: Synthetic peptide
QEGEIAPTNPCSSEQYGVVSCNLPQSGTR

SEQ ID NO: 108990 - protein, 28 aa, Artificial Sequence
  Description of Artificial Sequence: Synthetic peptide
QEEEIATTNPVATEQYGEIPEVGQHEEV

SEQ ID NO: 108991 - protein, 29 aa, Artificial Sequence
  Description of Artificial Sequence: Synthetic peptide
QEGEIAPTNPCSSEQYGVVSCNLQSGETR

SEQ ID NO: 108992 - protein, 28 aa, Artificial Sequence
  Description of Artificial Sequence: Synthetic peptide
QEGEIAPTNPCSSEQYGVVSCNLQSGTN

SEQ ID NO: 108993 - protein, 34 aa, Artificial Sequence
  Description of Artificial Sequence: Synthetic polypeptide
DEQEIRTTNPVATEQYGSVSFDTASVTQENNNDE

SEQ ID NO: 108994 - protein, 29 aa, Artificial Sequence
  Description of Artificial Sequence: Synthetic peptide
QEGEIAPTNPCSSEQYGTVSCNLQSEGTR

SEQ ID NO: 108995 - protein, 33 aa, Artificial Sequence
  Description of Artificial Sequence: Synthetic polypeptide
DESEIRTTNPVATECWGSVSCINEPQDRENENG

SEQ ID NO: 108996 - protein, 29 aa, Artificial Sequence
  Description of Artificial Sequence: Synthetic peptide
QEGEIAPTNPCSSEQYGIVSCNLQASGTR

SEQ ID NO: 108997 - protein, 33 aa, Artificial Sequence
  Description of Artificial Sequence: Synthetic polypeptide
DESEIRTTNPVATECWGSVSCINEPQDREMENG

SEQ ID NO: 108998 - protein, 29 aa, Artificial Sequence
  Description of Artificial Sequence: Synthetic peptide
DESEIATTNPVATEGWGVVSETLMNAGDA

SEQ ID NO: 108999 - protein, 29 aa, Artificial Sequence
  Description of Artificial Sequence: Synthetic peptide
DESEIATTNPVATEGWGVVSETEMNAGDA

SEQ ID NO: 109000 - protein, 33 aa, Artificial Sequence
  Description of Artificial Sequence: Synthetic polypeptide
DESEIATTNPVATEGWGSVSCINEPQSREGENG

SEQ ID NO: 109001 - protein, 33 aa, Artificial Sequence
  Description of Artificial Sequence: Synthetic polypeptide
DESEIRTTNPVATECWGSVSCINEPQDREGEMG

SEQ ID NO: 109002 - protein, 33 aa, Artificial Sequence
  Description of Artificial Sequence: Synthetic polypeptide
DESEIATTNPVATECYGSVSTNLPEDHEGEEDL

SEQ ID NO: 109003 - protein, 29 aa, Artificial Sequence
  Description of Artificial Sequence: Synthetic peptide
QEEVACCTNPVAYEQWGSVAMNEQRAGNS

SEQ ID NO: 109004 - protein, 34 aa, Artificial Sequence
  Description of Artificial Sequence: Synthetic polypeptide
DESEIRTTNPVATECWGSVSCINEPQDREGENAG

SEQ ID NO: 109005 - protein, 33 aa, Artificial Sequence
  Description of Artificial Sequence: Synthetic polypeptide
DESEIATTNPVATECYGSVSCINEPQDREGEEG

SEQ ID NO: 109006 - protein, 33 aa, Artificial Sequence
  Description of Artificial Sequence: Synthetic polypeptide
DESEIATTNPVATECYGSVSCINEPQDHEGENG

SEQ ID NO: 109007 - protein, 34 aa, Artificial Sequence
  Description of Artificial Sequence: Synthetic polypeptide
DESEIRTTNPVATECWGSVSCINEPQDREGENCG

SEQ ID NO: 109008 - protein, 34 aa, Artificial Sequence
  Description of Artificial Sequence: Synthetic polypeptide
DESEIATTNPVATECYGSVSATIDLEDREGENDG

SEQ ID NO: 109009 - protein, 30 aa, Artificial Sequence
  Description of Artificial Sequence: Synthetic polypeptide
QEEVICCTNPVAYEQYGSVAMNEQVGGNDS

SEQ ID NO: 109010 - protein, 33 aa, Artificial Sequence
  Description of Artificial Sequence: Synthetic polypeptide
DESEIATTNPVATECYGSVSACITEQDRVGENG

SEQ ID NO: 109011 - protein, 34 aa, Artificial Sequence
  Description of Artificial Sequence: Synthetic polypeptide
DESEIRTTNPVATECWGSVSCINEPQDREGENDC

SEQ ID NO: 109012 - protein, 34 aa, Artificial Sequence
  Description of Artificial Sequence: Synthetic polypeptide
DESEIATTNPVATECYGSVSACINEPQDRVGENG

SEQ ID NO: 109013 - protein, 34 aa, Artificial Sequence
  Description of Artificial Sequence: Synthetic polypeptide
DESEIRTTNPVATECWGSVSCINEPQDREGENDG

SEQ ID NO: 109014 - protein, 29 aa, Artificial Sequence
  Description of Artificial Sequence: Synthetic peptide
QEFEIATTNPVATECYGDVSECLQHEEKL

SEQ ID NO: 109015 - protein, 34 aa, Artificial Sequence
  Description of Artificial Sequence: Synthetic polypeptide
DESEIRTTNPVATECWGSVSCINEPQDREGENEG

SEQ ID NO: 109016 - protein, 33 aa, Artificial Sequence
  Description of Artificial Sequence: Synthetic polypeptide
DESEIATTNPVATECYGSVSACIDEPQDREGNG

SEQ ID NO: 109017 - protein, 29 aa, Artificial Sequence
  Description of Artificial Sequence: Synthetic peptide
QEFEIATTNPVATECYGHVSWECLQTEEL

SEQ ID NO: 109018 - protein, 32 aa, Artificial Sequence
  Description of Artificial Sequence: Synthetic polypeptide
CEEEIACTNPVATEQYGCVATNLQHADGEPDN

SEQ ID NO: 109019 - protein, 32 aa, Artificial Sequence
  Description of Artificial Sequence: Synthetic polypeptide
CEEEIACTNPVATEQYGCVATNLQPDNQDGEL

SEQ ID NO: 109020 - protein, 32 aa, Artificial Sequence
  Description of Artificial Sequence: Synthetic polypeptide
DESEIATTNPVATECYGNVSACITIQDRVGNG

SEQ ID NO: 109021 - protein, 34 aa, Artificial Sequence
  Description of Artificial Sequence: Synthetic polypeptide
DESEIRTTNPVATECWGSVSCINEPQDREGENFG

SEQ ID NO: 109022 - protein, 32 aa, Artificial Sequence
  Description of Artificial Sequence: Synthetic polypeptide
DESEIATTNPVATECYGNVSACITEQDRVGNG

SEQ ID NO: 109023 - protein, 33 aa, Artificial Sequence
  Description of Artificial Sequence: Synthetic polypeptide
DESEIRTTNPVATECWGSVSCINEPQDREGELG

SEQ ID NO: 109024 - protein, 28 aa, Artificial Sequence
  Description of Artificial Sequence: Synthetic peptide
QEFKIAPTNPCSSEQYGIVSCNLQSGTR

SEQ ID NO: 109025 - protein, 30 aa, Artificial Sequence
  Description of Artificial Sequence: Synthetic polypeptide
DESEIATTNPVATEGYGDVSSTLMNAAGDA

SEQ ID NO: 109026 - protein, 33 aa, Artificial Sequence
  Description of Artificial Sequence: Synthetic polypeptide
DESEIRTTNPVATECWGSVSCINEPQDREGEKG

SEQ ID NO: 109027 - protein, 30 aa, Artificial Sequence
  Description of Artificial Sequence: Synthetic polypeptide
DESEIATTNPVATEQWGDVSEILQNAAEDI

SEQ ID NO: 109028 - protein, 28 aa, Artificial Sequence
  Description of Artificial Sequence: Synthetic peptide
QEEEIATTNPVATEQYGEYPEVCQHEEK

SEQ ID NO: 109029 - protein, 34 aa, Artificial Sequence
  Description of Artificial Sequence: Synthetic polypeptide
DESEIATTNPVATEIYGSVCSNWNDGQDRGGTER

SEQ ID NO: 109030 - protein, 33 aa, Artificial Sequence
  Description of Artificial Sequence: Synthetic polypeptide
DESEIRTTNPVATECWGSVSCINEPQDREFNNG

SEQ ID NO: 109031 - protein, 34 aa, Artificial Sequence
  Description of Artificial Sequence: Synthetic polypeptide
DESEIRTTNPVATECWGSVSCINEPQDREGANDG

SEQ ID NO: 109032 - protein, 28 aa, Artificial Sequence
  Description of Artificial Sequence: Synthetic peptide
QEEEIATTNPVATEQYGEWPEVCQHEEK

SEQ ID NO: 109033 - protein, 32 aa, Artificial Sequence
  Description of Artificial Sequence: Synthetic polypeptide
DESEIATTNPVATEHYGSVSQSENSSQKRLSP

SEQ ID NO: 109034 - protein, 35 aa, Artificial Sequence
  Description of Artificial Sequence: Synthetic polypeptide
DESEIATTNPVATEHYGSVCSTNDTGQTQGGGNAR

SEQ ID NO: 109035 - protein, 34 aa, Artificial Sequence
  Description of Artificial Sequence: Synthetic polypeptide
QEEGIRTTNPVATEQYGSVSTNGQDEGGQGQEGE

SEQ ID NO: 109036 - protein, 29 aa, Artificial Sequence
  Description of Artificial Sequence: Synthetic peptide
DESEIATTNPVATEGYGVMATDGLEHGDI

SEQ ID NO: 109037 - protein, 33 aa, Artificial Sequence
  Description of Artificial Sequence: Synthetic polypeptide
DESEIATTNPVATEGYGSVSSTSPTGPNRNGNV

SEQ ID NO: 109038 - protein, 33 aa, Artificial Sequence
  Description of Artificial Sequence: Synthetic polypeptide
DESEIRTTNPVATECWGSVSCINEPQDREGDDG

SEQ ID NO: 109039 - protein, 33 aa, Artificial Sequence
  Description of Artificial Sequence: Synthetic polypeptide
DESEIRTTNPVATECWGSVSCINEPQDREGEAG

SEQ ID NO: 109040 - protein, 33 aa, Artificial Sequence
  Description of Artificial Sequence: Synthetic polypeptide
DESEIRTTNPVATECWGSVSCINEPQDREGECG

SEQ ID NO: 109041 - protein, 32 aa, Artificial Sequence
  Description of Artificial Sequence: Synthetic polypeptide
CEEEIACTNPVATEQYGCVATNLQDAPGEVDN

SEQ ID NO: 109042 - protein, 33 aa, Artificial Sequence
  Description of Artificial Sequence: Synthetic polypeptide
DESEIRTTNPVATECWGSVSCINEPQDREGEDG

SEQ ID NO: 109043 - protein, 33 aa, Artificial Sequence
  Description of Artificial Sequence: Synthetic polypeptide
DESEIRTTNPVATECWGSVSCINEPQDREGEEG

SEQ ID NO: 109044 - protein, 32 aa, Artificial Sequence
  Description of Artificial Sequence: Synthetic polypeptide
QEEIIRTTNPVATEQYGCVSTNGQQTFPESME

SEQ ID NO: 109045 - protein, 33 aa, Artificial Sequence
  Description of Artificial Sequence: Synthetic polypeptide
DESEIRTTNPVATECWGSVSCINEPQDREGEFG

SEQ ID NO: 109046 - protein, 33 aa, Artificial Sequence
  Description of Artificial Sequence: Synthetic polypeptide
DESEIRTTNPVATECWGSVSCINEPQDREGEGG

SEQ ID NO: 109047 - protein, 32 aa, Artificial Sequence
  Description of Artificial Sequence: Synthetic polypeptide
DESEIATTNPVATEGYGSVSANTLEDHEGQDL

SEQ ID NO: 109048 - protein, 33 aa, Artificial Sequence
  Description of Artificial Sequence: Synthetic polypeptide
QEEIIRTTNPVATEQYGCVSTNTGQLTFPENLE

SEQ ID NO: 109049 - protein, 33 aa, Artificial Sequence
  Description of Artificial Sequence: Synthetic polypeptide
DESEIRTTNPVATECWGSVSCINEPQDREGEHG

SEQ ID NO: 109050 - protein, 33 aa, Artificial Sequence
  Description of Artificial Sequence: Synthetic polypeptide
DESEIRTTNPVATECWGSVSCINEPQDREGEIG

SEQ ID NO: 109051 - protein, 33 aa, Artificial Sequence
  Description of Artificial Sequence: Synthetic polypeptide
DESEIRTTNPVATECWGSVSCINEPQDREGEIV

SEQ ID NO: 109052 - protein, 32 aa, Artificial Sequence
  Description of Artificial Sequence: Synthetic polypeptide
DESEIATTNPVATEGYGNVAANTIVQSREGND

SEQ ID NO: 109053 - protein, 29 aa, Artificial Sequence
  Description of Artificial Sequence: Synthetic peptide
DESEIATTNPVATEQWGEASCIVCQHENK

SEQ ID NO: 109054 - protein, 28 aa, Artificial Sequence
  Description of Artificial Sequence: Synthetic peptide
QEGAIAPTNPCSSEQYGIVSCNLQAGTR

SEQ ID NO: 109055 - protein, 32 aa, Artificial Sequence
  Description of Artificial Sequence: Synthetic polypeptide
DESEIATTNPVATECWGSVSEINEPQHEGENG

SEQ ID NO: 109056 - protein, 32 aa, Artificial Sequence
  Description of Artificial Sequence: Synthetic polypeptide
DESEIATTNPVATECWGSVSCINEPQDRGEGG

SEQ ID NO: 109057 - protein, 29 aa, Artificial Sequence
  Description of Artificial Sequence: Synthetic peptide
QEGEIACTNPCSYEQYGIVSCNLQSGGTR

SEQ ID NO: 109058 - protein, 33 aa, Artificial Sequence
  Description of Artificial Sequence: Synthetic polypeptide
DESEIATTNPVATECWGSVSCINEPQDREGETR

SEQ ID NO: 109059 - protein, 36 aa, Artificial Sequence
  Description of Artificial Sequence: Synthetic polypeptide
AEEEIRTTNPVATEQYGSVSVSVTTNLQQGTTQEQE

SEQ ID NO: 109060 - protein, 34 aa, Artificial Sequence
  Description of Artificial Sequence: Synthetic polypeptide
DESEIRTTNPVATECWGSVSCINEPQDREGENGQ

SEQ ID NO: 109061 - protein, 33 aa, Artificial Sequence
  Description of Artificial Sequence: Synthetic polypeptide
DESEIATTNPVATECWGSVSCINEPQDREGENL

SEQ ID NO: 109062 - protein, 33 aa, Artificial Sequence
  Description of Artificial Sequence: Synthetic polypeptide
DESEIATTNPVATECWGSVSCINEPQDREGENG

SEQ ID NO: 109063 - protein, 32 aa, Artificial Sequence
  Description of Artificial Sequence: Synthetic polypeptide
DESEIATTNPVATECWGSVSCIDEPQDREGNG

SEQ ID NO: 109064 - protein, 36 aa, Artificial Sequence
  Description of Artificial Sequence: Synthetic polypeptide
AEEEIRTTNPVATEQYGSVSVSVTTNLQQGSTEEQT

SEQ ID NO: 109065 - protein, 28 aa, Artificial Sequence
  Description of Artificial Sequence: Synthetic peptide
QEGEIACTNPVGTEGYGCSASTLQGGDI

SEQ ID NO: 109066 - protein, 33 aa, Artificial Sequence
  Description of Artificial Sequence: Synthetic polypeptide
QEEEIATTNPVATEQYGEVSSTTAGNMRNGNPK

SEQ ID NO: 109067 - protein, 28 aa, Artificial Sequence
  Description of Artificial Sequence: Synthetic peptide
QEGEIAGTNPCSSEQYGIVSCNLQSGTT

SEQ ID NO: 109068 - protein, 33 aa, Artificial Sequence
  Description of Artificial Sequence: Synthetic polypeptide
QEEEIATTNPVATEQYGEVSSTEAGNMRNGNPK

SEQ ID NO: 109069 - protein, 34 aa, Artificial Sequence
  Description of Artificial Sequence: Synthetic polypeptide
DESEIRTTNPVATECWGSVSCINEPQDREGENGS

SEQ ID NO: 109070 - protein, 32 aa, Artificial Sequence
  Description of Artificial Sequence: Synthetic polypeptide
DESEIATTNPVATECWGSVSCCEPQDREGENL

SEQ ID NO: 109071 - protein, 29 aa, Artificial Sequence
  Description of Artificial Sequence: Synthetic peptide
DESEIATTNPVATECWGSVPEVCQREEEK

SEQ ID NO: 109072 - protein, 36 aa, Artificial Sequence
  Description of Artificial Sequence: Synthetic polypeptide
AEEEIRTTNPVATEQYGSVSVSVTTNLEQGSTENQE

SEQ ID NO: 109073 - protein, 28 aa, Artificial Sequence
  Description of Artificial Sequence: Synthetic peptide
QEGEIAPTNPCASECYGIVSENLQSGTL

SEQ ID NO: 109074 - protein, 31 aa, Artificial Sequence
  Description of Artificial Sequence: Synthetic polypeptide
DESEIATTNPVATECWGSVPCINEQDRGEEK

SEQ ID NO: 109075 - protein, 34 aa, Artificial Sequence
  Description of Artificial Sequence: Synthetic polypeptide
DESEIRTTNPVATECWGSVSCINEPQDREGENGT

SEQ ID NO: 109076 - protein, 30 aa, Artificial Sequence
  Description of Artificial Sequence: Synthetic polypeptide
QEGEIAPTNPCASEQWGIVSCINLQREGNG

SEQ ID NO: 109077 - protein, 31 aa, Artificial Sequence
  Description of Artificial Sequence: Synthetic polypeptide
DESEIATTNPVATECWGSASCNEPQDRGEGG

SEQ ID NO: 109078 - protein, 28 aa, Artificial Sequence
  Description of Artificial Sequence: Synthetic peptide
QEGEIAPTNPCASEQWGIVSCNLASGPR

SEQ ID NO: 109079 - protein, 34 aa, Artificial Sequence
  Description of Artificial Sequence: Synthetic polypeptide
DESEIRTTNPVATECWGSVSCINEPQDREGENGV

SEQ ID NO: 109080 - protein, 29 aa, Artificial Sequence
  Description of Artificial Sequence: Synthetic peptide
QEGEIAPTNPCASEQWGIVSCNLQSEGNG

SEQ ID NO: 109081 - protein, 34 aa, Artificial Sequence
  Description of Artificial Sequence: Synthetic polypeptide
DESEIRTTNPVATECWGSVSCINEPQDREGENGP

SEQ ID NO: 109082 - protein, 32 aa, Artificial Sequence
  Description of Artificial Sequence: Synthetic polypeptide
DESEIATTNPVATECWGSVSEINEPQHEGENL

SEQ ID NO: 109083 - protein, 33 aa, Artificial Sequence
  Description of Artificial Sequence: Synthetic polypeptide
DESEIATTNPVATECWGSVSCINEPQDRLGENG

SEQ ID NO: 109084 - protein, 34 aa, Artificial Sequence
  Description of Artificial Sequence: Synthetic polypeptide
DESEIRTTNPVATECWGSVSCINEPQDREGENGN

SEQ ID NO: 109085 - protein, 28 aa, Artificial Sequence
  Description of Artificial Sequence: Synthetic peptide
QEGAIAPTNPCSSEQYGIVSCNLQSGTR

SEQ ID NO: 109086 - protein, 33 aa, Artificial Sequence
  Description of Artificial Sequence: Synthetic polypeptide
DESEIATTNPVATECWGSVSEINEPQDREGENG

SEQ ID NO: 109087 - protein, 28 aa, Artificial Sequence
  Description of Artificial Sequence: Synthetic peptide
QEGCIAPTNPCSSEQYGIVSCNLQSGTR

SEQ ID NO: 109088 - protein, 34 aa, Artificial Sequence
  Description of Artificial Sequence: Synthetic polypeptide
DESEIRTTNPVATECWGSVSCINEPQDREGENGA

SEQ ID NO: 109089 - protein, 34 aa, Artificial Sequence
  Description of Artificial Sequence: Synthetic polypeptide
DESEIRTTNPVATECWGSVSCINEPQDREGENGC

SEQ ID NO: 109090 - protein, 34 aa, Artificial Sequence
  Description of Artificial Sequence: Synthetic polypeptide
DESEIRTTNPVATECWGSVSCINEPQDREGENGD

SEQ ID NO: 109091 - protein, 34 aa, Artificial Sequence
  Description of Artificial Sequence: Synthetic polypeptide
DESEIRTTNPVATECWGSVSCINEPQDREGENGE

SEQ ID NO: 109092 - protein, 31 aa, Artificial Sequence
  Description of Artificial Sequence: Synthetic polypeptide
QEEEIATTNPVATEQYGEVSTDCEDHEGEDL

SEQ ID NO: 109093 - protein, 32 aa, Artificial Sequence
  Description of Artificial Sequence: Synthetic polypeptide
DESEIATTNPVATECWGSVSCNEPQDSEGETR

SEQ ID NO: 109094 - protein, 29 aa, Artificial Sequence
  Description of Artificial Sequence: Synthetic peptide
QEGEIAATNPCSYEQYGIVSCNLQSGAMR

SEQ ID NO: 109095 - protein, 29 aa, Artificial Sequence
  Description of Artificial Sequence: Synthetic peptide
QEGEIAATNPCSYEQYGKTVSCNLQSGTR

SEQ ID NO: 109096 - protein, 34 aa, Artificial Sequence
  Description of Artificial Sequence: Synthetic polypeptide
DESEIRTTNPVATECWGSVSCINEPQDREGENGF

SEQ ID NO: 109097 - protein, 34 aa, Artificial Sequence
  Description of Artificial Sequence: Synthetic polypeptide
DESEIRTTNPVATECWGSVSCINEPQDREGENGG

SEQ ID NO: 109098 - protein, 28 aa, Artificial Sequence
  Description of Artificial Sequence: Synthetic peptide
QEGEIACTNPCSSEQYGEASCNLQSGTR

SEQ ID NO: 109099 - protein, 34 aa, Artificial Sequence
  Description of Artificial Sequence: Synthetic polypeptide
DESEIRTTNPVATECWGSVSCINEPQDREGENGH

SEQ ID NO: 109100 - protein, 32 aa, Artificial Sequence
  Description of Artificial Sequence: Synthetic polypeptide
DESEIATTNPVATECWGSVSCINEQDRVGEQG

SEQ ID NO: 109101 - protein, 34 aa, Artificial Sequence
  Description of Artificial Sequence: Synthetic polypeptide
DESEIRTTNPVATECWGSVSCINEPQDREGENGI

SEQ ID NO: 109102 - protein, 28 aa, Artificial Sequence
  Description of Artificial Sequence: Synthetic peptide
QEGEIACTNPCSSEQYGIASCNLQSGTR

SEQ ID NO: 109103 - protein, 29 aa, Artificial Sequence
  Description of Artificial Sequence: Synthetic peptide
QEGEIACTNPCSSEQYGIVSCCNLQSGTR

SEQ ID NO: 109104 - protein, 34 aa, Artificial Sequence
  Description of Artificial Sequence: Synthetic polypeptide
DESEIRTTNPVATECWGSVSCINEPQDREGENGK

SEQ ID NO: 109105 - protein, 34 aa, Artificial Sequence
  Description of Artificial Sequence: Synthetic polypeptide
DESEIRTTNPVATECWGSVSCINEPQDREGENGL

SEQ ID NO: 109106 - protein, 34 aa, Artificial Sequence
  Description of Artificial Sequence: Synthetic polypeptide
DESEIRTTNPVATECWGSVSCINEPQDREGENGM

SEQ ID NO: 109107 - protein, 32 aa, Artificial Sequence
  Description of Artificial Sequence: Synthetic polypeptide
DESEIATTNPVATECWGSVSCINEQDREGEEL

SEQ ID NO: 109108 - protein, 33 aa, Artificial Sequence
  Description of Artificial Sequence: Synthetic polypeptide
DESEIATTNPVATECWGSVSCINEPQSREGENG

SEQ ID NO: 109109 - protein, 32 aa, Artificial Sequence
  Description of Artificial Sequence: Synthetic polypeptide
DESEIATTNPVATECWGSVSCINEPQSEGENG

SEQ ID NO: 109110 - protein, 32 aa, Artificial Sequence
  Description of Artificial Sequence: Synthetic polypeptide
DESEIATTNPVATECWGSVSCINEPQHEGENG

SEQ ID NO: 109111 - protein, 33 aa, Artificial Sequence
  Description of Artificial Sequence: Synthetic polypeptide
DESEIRTTNPVATECWGSVSCINEPQDREFENG

SEQ ID NO: 109112 - protein, 30 aa, Artificial Sequence
  Description of Artificial Sequence: Synthetic polypeptide
DESEIATTNPVATEQWGEASCIVCQREENK

SEQ ID NO: 109113 - protein, 28 aa, Artificial Sequence
  Description of Artificial Sequence: Synthetic peptide
QEEEIATTNPVATEQYGEYPEVCQHEES

SEQ ID NO: 109114 - protein, 28 aa, Artificial Sequence
  Description of Artificial Sequence: Synthetic peptide
QEEEIATTNPVATEQYGGAPEVCQHETK

SEQ ID NO: 109115 - protein, 33 aa, Artificial Sequence
  Description of Artificial Sequence: Synthetic polypeptide
DESEIRTTNPVATECWGSVSCINEPQDFEGENG

SEQ ID NO: 109116 - protein, 28 aa, Artificial Sequence
  Description of Artificial Sequence: Synthetic peptide
QEEEIATTNPVATEQYGFAPEVCQHEEK

SEQ ID NO: 109117 - protein, 34 aa, Artificial Sequence
  Description of Artificial Sequence: Synthetic polypeptide
DESEIATTNPVATEQYGSVCATNLTQPDGQAEEA

SEQ ID NO: 109118 - protein, 35 aa, Artificial Sequence
  Description of Artificial Sequence: Synthetic polypeptide
DESEIATTNPVATEQYGSVCADTNPLQTQAGDNAM

SEQ ID NO: 109119 - protein, 33 aa, Artificial Sequence
  Description of Artificial Sequence: Synthetic polypeptide
QEEEIRTTNPVATSMYGQVYATVNLDQQGGQRG

SEQ ID NO: 109120 - protein, 35 aa, Artificial Sequence
  Description of Artificial Sequence: Synthetic polypeptide
DESEIATTNPVATEQYGSVCAADNNLADRDGNDRM

SEQ ID NO: 109121 - protein, 36 aa, Artificial Sequence
  Description of Artificial Sequence: Synthetic polypeptide
AEEEIRTTNPVATEQYGSVSVTNNNLQQGEEQGTES

SEQ ID NO: 109122 - protein, 34 aa, Artificial Sequence
  Description of Artificial Sequence: Synthetic polypeptide
QEEEIRTTNPVAYEQWGSVAWTELDQRDFDGSNM

SEQ ID NO: 109123 - protein, 28 aa, Artificial Sequence
  Description of Artificial Sequence: Synthetic peptide
QEEEIATTNPVATEQYGFAAEVCQHEEK

SEQ ID NO: 109124 - protein, 33 aa, Artificial Sequence
  Description of Artificial Sequence: Synthetic polypeptide
DESEIRTTNPVATECWGSVSCINEPQDGEGENE

SEQ ID NO: 109125 - protein, 33 aa, Artificial Sequence
  Description of Artificial Sequence: Synthetic polypeptide
DESEIRTTNPVATECWGSVSCINEPQDGEGENG

SEQ ID NO: 109126 - protein, 37 aa, Artificial Sequence
  Description of Artificial Sequence: Synthetic polypeptide
AEEEIRTTNPVATEQYGSVSVTNNNLQQGDEGTNTET

SEQ ID NO: 109127 - protein, 33 aa, Artificial Sequence
  Description of Artificial Sequence: Synthetic polypeptide
DESEIRTTNPVATECWGSVSCINEPQDGMGENG

SEQ ID NO: 109128 - protein, 35 aa, Artificial Sequence
  Description of Artificial Sequence: Synthetic polypeptide
DESEIATTNPVATEQYGSVAATNNLPQTMAGDNAM

SEQ ID NO: 109129 - protein, 36 aa, Artificial Sequence
  Description of Artificial Sequence: Synthetic polypeptide
AEEEIRTTNPVATEQYGSVSVTNNNLEQGVTTNNNI

SEQ ID NO: 109130 - protein, 33 aa, Artificial Sequence
  Description of Artificial Sequence: Synthetic polypeptide
DESEIRTTNPVATECWGSVSCINEPQDHEGENG

SEQ ID NO: 109131 - protein, 32 aa, Artificial Sequence
  Description of Artificial Sequence: Synthetic polypeptide
DESEIATTNPVATEQYGSVAATDLEDHEGEDL

SEQ ID NO: 109132 - protein, 36 aa, Artificial Sequence
  Description of Artificial Sequence: Synthetic polypeptide
AEEEIRTTNPVATEQYGSVSVTNNNLAGNIGTNANA

SEQ ID NO: 109133 - protein, 33 aa, Artificial Sequence
  Description of Artificial Sequence: Synthetic polypeptide
DESEIRTTNPVATECWGSVSCINEPQDHEGENI

SEQ ID NO: 109134 - protein, 32 aa, Artificial Sequence
  Description of Artificial Sequence: Synthetic polypeptide
QEEEIRTTNPVGTEGYGSVSTSAGPNMRGDPI

SEQ ID NO: 109135 - protein, 29 aa, Artificial Sequence
  Description of Artificial Sequence: Synthetic peptide
QEEEIATTNPVATEQYGEYPWVDQEHNEQ

SEQ ID NO: 109136 - protein, 32 aa, Artificial Sequence
  Description of Artificial Sequence: Synthetic polypeptide
QEEEIRTTNPVGTEQYGSVATSAGNHNGMNPV

SEQ ID NO: 109137 - protein, 32 aa, Artificial Sequence
  Description of Artificial Sequence: Synthetic polypeptide
DESEIATTNPVATEQYGSSSATDLEDHEGEDL

SEQ ID NO: 109138 - protein, 36 aa, Artificial Sequence
  Description of Artificial Sequence: Synthetic polypeptide
AEEEIRTTNPVATEQYGSVSVTNNNDQQGNQNNDEQ

SEQ ID NO: 109139 - protein, 33 aa, Artificial Sequence
  Description of Artificial Sequence: Synthetic polypeptide
DESEIRTTNPVATECWGSVSCINEPQDEEGNNG

SEQ ID NO: 109140 - protein, 36 aa, Artificial Sequence
  Description of Artificial Sequence: Synthetic polypeptide
AEEEIRTTNPVATEQYGSVSVTNNNDQAGNTTNNQQ

SEQ ID NO: 109141 - protein, 28 aa, Artificial Sequence
  Description of Artificial Sequence: Synthetic peptide
QEEEIATTNPVATEQYGHAPEVCQHEEK

SEQ ID NO: 109142 - protein, 32 aa, Artificial Sequence
  Description of Artificial Sequence: Synthetic polypeptide
DESEIATTNPVATEQYGSVSAHDLEDHEGEDL

SEQ ID NO: 109143 - protein, 34 aa, Artificial Sequence
  Description of Artificial Sequence: Synthetic polypeptide
DESEIATTNPVATEQYGSVSTINEPEDREGEEDL

SEQ ID NO: 109144 - protein, 34 aa, Artificial Sequence
  Description of Artificial Sequence: Synthetic polypeptide
DESEIATTNPVATEQYGSVSSTTPAGNMRGMNPV

SEQ ID NO: 109145 - protein, 34 aa, Artificial Sequence
  Description of Artificial Sequence: Synthetic polypeptide
DESEIATTNPVATEQYGSVSSTSPTGPNMRNGNV

SEQ ID NO: 109146 - protein, 35 aa, Artificial Sequence
  Description of Artificial Sequence: Synthetic polypeptide
QEEEIRTTNPVATEQYGSVYGDTNDQEGEGEEGNI

SEQ ID NO: 109147 - protein, 37 aa, Artificial Sequence
  Description of Artificial Sequence: Synthetic polypeptide
AEEEIRTTNPVATEQYGSVSVTNNNLQQQNIGTNNSN

SEQ ID NO: 109148 - protein, 28 aa, Artificial Sequence
  Description of Artificial Sequence: Synthetic peptide
QEEEIATTNPVATEQYGMAPEVVQHEEK

SEQ ID NO: 109149 - protein, 28 aa, Artificial Sequence
  Description of Artificial Sequence: Synthetic peptide
QEEEIATTNPVATEQYGMAPEVCQHEEK

SEQ ID NO: 109150 - protein, 34 aa, Artificial Sequence
  Description of Artificial Sequence: Synthetic polypeptide
DESEIATTNPVATEQYGSVSATTPAINSRNGNPV

SEQ ID NO: 109151 - protein, 28 aa, Artificial Sequence
  Description of Artificial Sequence: Synthetic peptide
QEEEIATTNPVATEQYGKAPQVCQHEEK

SEQ ID NO: 109152 - protein, 33 aa, Artificial Sequence
  Description of Artificial Sequence: Synthetic polypeptide
DESEIRTTNPVATECWGSVSCINEPQDAAGENG

SEQ ID NO: 109153 - protein, 33 aa, Artificial Sequence
  Description of Artificial Sequence: Synthetic polypeptide
DESEIRTTNPVATECWGSVSCINEPQDAEGENG

SEQ ID NO: 109154 - protein, 28 aa, Artificial Sequence
  Description of Artificial Sequence: Synthetic peptide
QEEEIATTNPVATEQYGKAPEVCQHEEK

SEQ ID NO: 109155 - protein, 28 aa, Artificial Sequence
  Description of Artificial Sequence: Synthetic peptide
QEEEIATTNPVATEQYGKAPEMCQHEEK

SEQ ID NO: 109156 - protein, 32 aa, Artificial Sequence
  Description of Artificial Sequence: Synthetic polypeptide
QEEEIRTTNPVATEQYGVMSASPAGPNRGMDI

SEQ ID NO: 109157 - protein, 28 aa, Artificial Sequence
  Description of Artificial Sequence: Synthetic peptide
QEEEIATTNPVATEQYGHAPEVCQHIEK

SEQ ID NO: 109158 - protein, 32 aa, Artificial Sequence
  Description of Artificial Sequence: Synthetic polypeptide
QEEEIRTTNPVATEQYGVMSATPAGPNRGMDI

SEQ ID NO: 109159 - protein, 33 aa, Artificial Sequence
  Description of Artificial Sequence: Synthetic polypeptide
DESEIATTNPVATEQYGSVSATDLEDHEGEEDL

SEQ ID NO: 109160 - protein, 32 aa, Artificial Sequence
  Description of Artificial Sequence: Synthetic polypeptide
QEEEIRTTNPVATEQYGVMSSTPAGPNRGMDI

SEQ ID NO: 109161 - protein, 32 aa, Artificial Sequence
  Description of Artificial Sequence: Synthetic polypeptide
QEEEIRTTNPVATEQYGVMSSTPAGPNRGMDV

SEQ ID NO: 109162 - protein, 29 aa, Artificial Sequence
  Description of Artificial Sequence: Synthetic peptide
QEEEIATTNPVATEQYGHAPEVCQHEENK

SEQ ID NO: 109163 - protein, 35 aa, Artificial Sequence
  Description of Artificial Sequence: Synthetic polypeptide
QEEEIRTTNPVATEQYGVVSSGDGNLQDEGGQNDD

SEQ ID NO: 109164 - protein, 35 aa, Artificial Sequence
  Description of Artificial Sequence: Synthetic polypeptide
QEEEIRTTNPVATEQYGYVSTQNLNQDGGQEDDDE

SEQ ID NO: 109165 - protein, 33 aa, Artificial Sequence
  Description of Artificial Sequence: Synthetic polypeptide
DESEIRTTNPVATECWGSVSCINEPQDCEGENG

SEQ ID NO: 109166 - protein, 33 aa, Artificial Sequence
  Description of Artificial Sequence: Synthetic polypeptide
DESEIRTTNPVATECWGSVSCINEPQDDEGENG

SEQ ID NO: 109167 - protein, 33 aa, Artificial Sequence
  Description of Artificial Sequence: Synthetic polypeptide
DESEIRTTNPVATECWGSVSCINEPQDEEGENG

SEQ ID NO: 109168 - protein, 34 aa, Artificial Sequence
  Description of Artificial Sequence: Synthetic polypeptide
DESEIATTNPVATEQYGSVSACINLPQDHEGEDG

SEQ ID NO: 109169 - protein, 36 aa, Artificial Sequence
  Description of Artificial Sequence: Synthetic polypeptide
QEEEIRTTNPVSTEQYGSVVGSPTNAPTQNREGNLS

SEQ ID NO: 109170 - protein, 32 aa, Artificial Sequence
  Description of Artificial Sequence: Synthetic polypeptide
DESEIATTNPVATEQYGNVSANTIQSHEGQDL

SEQ ID NO: 109171 - protein, 32 aa, Artificial Sequence
  Description of Artificial Sequence: Synthetic polypeptide
DESEIATTNPVATEQYGNVSANTIQDHEGQDL

SEQ ID NO: 109172 - protein, 33 aa, Artificial Sequence
  Description of Artificial Sequence: Synthetic polypeptide
DESEIRTTNPVATECWGSVSCINEPQDRAEENG

SEQ ID NO: 109173 - protein, 33 aa, Artificial Sequence
  Description of Artificial Sequence: Synthetic polypeptide
DESEIATTNPVATEQWGSVSCIDEPQDREGENG

SEQ ID NO: 109174 - protein, 32 aa, Artificial Sequence
  Description of Artificial Sequence: Synthetic polypeptide
DESEIATTNPVATEQWGSVSATIDEQDHEGEG

SEQ ID NO: 109175 - protein, 28 aa, Artificial Sequence
  Description of Artificial Sequence: Synthetic peptide
QEEEIATTNPVATEQYGEYPWADQHEEA

SEQ ID NO: 109176 - protein, 33 aa, Artificial Sequence
  Description of Artificial Sequence: Synthetic polypeptide
DESEIRTTNPVATECWGSVSCINEPQDRCGEGG

SEQ ID NO: 109177 - protein, 36 aa, Artificial Sequence
  Description of Artificial Sequence: Synthetic polypeptide
AEEEIRTTNPVATEQYGSVSVTNNLEQGVTTNNQNI

SEQ ID NO: 109178 - protein, 34 aa, Artificial Sequence
  Description of Artificial Sequence: Synthetic polypeptide
DESEIRTTNPVATECWGSVSCINEPQDRCGENGN

SEQ ID NO: 109179 - protein, 33 aa, Artificial Sequence
  Description of Artificial Sequence: Synthetic polypeptide
DESEIATTNPVATEQWGSVSATIDEPQDREGEG

SEQ ID NO: 109180 - protein, 33 aa, Artificial Sequence
  Description of Artificial Sequence: Synthetic polypeptide
DESEIRTTNPVATECWGSVSCINEPQDRDGEDG

SEQ ID NO: 109181 - protein, 36 aa, Artificial Sequence
  Description of Artificial Sequence: Synthetic polypeptide
AEEEIRTTNPVATEQYGSVSVTNNELNAGNIGTNNE

SEQ ID NO: 109182 - protein, 28 aa, Artificial Sequence
  Description of Artificial Sequence: Synthetic peptide
QEEEIATTNPVATEQYGEYPEVGQHMEK

SEQ ID NO: 109183 - protein, 34 aa, Artificial Sequence
  Description of Artificial Sequence: Synthetic polypeptide
QEEGIRTTNPVATEQYGSVSTDNGLGEGQEDDGQ

SEQ ID NO: 109184 - protein, 33 aa, Artificial Sequence
  Description of Artificial Sequence: Synthetic polypeptide
DESEIRTTNPVATECWGSVSCINEPQDREAENG

SEQ ID NO: 109185 - protein, 33 aa, Artificial Sequence
  Description of Artificial Sequence: Synthetic polypeptide
DESEIRTTNPVATECWGSVSCINEPQDRECENG

SEQ ID NO: 109186 - protein, 33 aa, Artificial Sequence
  Description of Artificial Sequence: Synthetic polypeptide
QEEGIRTTNPVATEQYGSVSTGGGDQNDGGEDD

SEQ ID NO: 109187 - protein, 34 aa, Artificial Sequence
  Description of Artificial Sequence: Synthetic polypeptide
QEEGIRTTNPVATEQYGSVSTGGLGDENGQNEGD

SEQ ID NO: 109188 - protein, 33 aa, Artificial Sequence
  Description of Artificial Sequence: Synthetic polypeptide
DESEIRTTNPVATECWGSVSCINEPQDREDENG

SEQ ID NO: 109189 - protein, 33 aa, Artificial Sequence
  Description of Artificial Sequence: Synthetic polypeptide
DESEIATTNPVATEQWGSVSATDLQDHEGEEDL

SEQ ID NO: 109190 - protein, 32 aa, Artificial Sequence
  Description of Artificial Sequence: Synthetic polypeptide
DESEIATTNPVATEQWGSVSATDLEDHEGEDL

SEQ ID NO: 109191 - protein, 33 aa, Artificial Sequence
  Description of Artificial Sequence: Synthetic polypeptide
DESEIRTTNPVATECWGSVSCINEPQDREDSNG

SEQ ID NO: 109192 - protein, 33 aa, Artificial Sequence
  Description of Artificial Sequence: Synthetic polypeptide
DESEIRTTNPVATECWGSVSCINEPQDREEENA

SEQ ID NO: 109193 - protein, 34 aa, Artificial Sequence
  Description of Artificial Sequence: Synthetic polypeptide
QEEGIRTTNPVATEQYGSVSTNGGEEGGQGNENT

SEQ ID NO: 109194 - protein, 34 aa, Artificial Sequence
  Description of Artificial Sequence: Synthetic polypeptide
QEEGIRTTNPVATEQYGSVSTNGLEEGGQGDEGE

SEQ ID NO: 109195 - protein, 36 aa, Artificial Sequence
  Description of Artificial Sequence: Synthetic polypeptide
AEEEIRTTNPVATEQYGSVSVTNNDQAGNIGTNQNS

SEQ ID NO: 109196 - protein, 33 aa, Artificial Sequence
  Description of Artificial Sequence: Synthetic polypeptide
DESEIRTTNPVATECWGSVSCINEPQDREEENG

SEQ ID NO: 109197 - protein, 33 aa, Artificial Sequence
  Description of Artificial Sequence: Synthetic polypeptide
DESEIRTTNPVATECWGSVSCINEPQDQNGENG

SEQ ID NO: 109198 - protein, 33 aa, Artificial Sequence
  Description of Artificial Sequence: Synthetic polypeptide
DESEIRTTNPVATECWGSVSCINEPQDQEGENG

SEQ ID NO: 109199 - protein, 33 aa, Artificial Sequence
  Description of Artificial Sequence: Synthetic polypeptide
DESEIRTTNPVATECWGSVSCINEPQDPEGENG

SEQ ID NO: 109200 - protein, 28 aa, Artificial Sequence
  Description of Artificial Sequence: Synthetic peptide
QEEEVATTNPVATEQYGEAPEVCQHEER

SEQ ID NO: 109201 - protein, 33 aa, Artificial Sequence
  Description of Artificial Sequence: Synthetic polypeptide
DESEIRTTNPVATECWGSVSCINEPQDHEGENL

SEQ ID NO: 109202 - protein, 28 aa, Artificial Sequence
  Description of Artificial Sequence: Synthetic peptide
QEEEISTTNPVATEQYGEAPEVCQHEEK

SEQ ID NO: 109203 - protein, 28 aa, Artificial Sequence
  Description of Artificial Sequence: Synthetic peptide
QEEEISTTNPVATEQYGEAPWVDQHEEK

SEQ ID NO: 109204 - protein, 33 aa, Artificial Sequence
  Description of Artificial Sequence: Synthetic polypeptide
DESEIRTTNPVATECWGSVSCINEPQDHEGENS

SEQ ID NO: 109205 - protein, 30 aa, Artificial Sequence
  Description of Artificial Sequence: Synthetic polypeptide
DESEIATTNPVATEQYGEVPEIVCQHGEEK

SEQ ID NO: 109206 - protein, 28 aa, Artificial Sequence
  Description of Artificial Sequence: Synthetic peptide
QEEEIATTNPVATEQYGEYPWEDQHIEK

SEQ ID NO: 109207 - protein, 30 aa, Artificial Sequence
  Description of Artificial Sequence: Synthetic polypeptide
DESEIATTNPVATEQYGDVSETIMNAAEDA

SEQ ID NO: 109208 - protein, 29 aa, Artificial Sequence
  Description of Artificial Sequence: Synthetic peptide
QEEEISTTNPVATEQYGVVAVEVEQAEEA

SEQ ID NO: 109209 - protein, 28 aa, Artificial Sequence
  Description of Artificial Sequence: Synthetic peptide
QEEEITTTNPVATEQYGEAPEVCQHEEK

SEQ ID NO: 109210 - protein, 28 aa, Artificial Sequence
  Description of Artificial Sequence: Synthetic peptide
QEEEIVTTNPVATEQYGEAPEVCQHEEK

SEQ ID NO: 109211 - protein, 33 aa, Artificial Sequence
  Description of Artificial Sequence: Synthetic polypeptide
DESEIRTTNPVATECWGSVSCINEPQDIEGENG

SEQ ID NO: 109212 - protein, 29 aa, Artificial Sequence
  Description of Artificial Sequence: Synthetic peptide
DESEIATTNPVATEQWGVVSEIEMNAGDA

SEQ ID NO: 109213 - protein, 34 aa, Artificial Sequence
  Description of Artificial Sequence: Synthetic polypeptide
DESEIRTTNPVATECWGSVSCINEPQDREGENGW

SEQ ID NO: 109214 - protein, 33 aa, Artificial Sequence
  Description of Artificial Sequence: Synthetic polypeptide
DESEIRTTNPVATECWGSVSCINEPQDKEGENG

SEQ ID NO: 109215 - protein, 30 aa, Artificial Sequence
  Description of Artificial Sequence: Synthetic polypeptide
QEEEIVTTNPVATEQYGEAPTDGCVQHENK

SEQ ID NO: 109216 - protein, 30 aa, Artificial Sequence
  Description of Artificial Sequence: Synthetic polypeptide
QEEEIVTTNPVATEQYGEAPTDVCVQHENK

SEQ ID NO: 109217 - protein, 29 aa, Artificial Sequence
  Description of Artificial Sequence: Synthetic peptide
QEEEIATTNPVATEQYGEYPWEDQHEENQ

SEQ ID NO: 109218 - protein, 33 aa, Artificial Sequence
  Description of Artificial Sequence: Synthetic polypeptide
DESEIRTTNPVATECWGSVSCINEPQDLEGENE

SEQ ID NO: 109219 - protein, 29 aa, Artificial Sequence
  Description of Artificial Sequence: Synthetic peptide
QEEEIVTTNPVATEQYGTAPTGCQHEEEK

SEQ ID NO: 109220 - protein, 31 aa, Artificial Sequence
  Description of Artificial Sequence: Synthetic polypeptide
QEEEIVTTNPVATEQYGTASATDGPQFEEND

SEQ ID NO: 109221 - protein, 33 aa, Artificial Sequence
  Description of Artificial Sequence: Synthetic polypeptide
DESEIRTTNPVATECWGSVSCINEPQDLEGENG

SEQ ID NO: 109222 - protein, 33 aa, Artificial Sequence
  Description of Artificial Sequence: Synthetic polypeptide
DESEIRTTNPVATECWGSVSCINEPQDMEGENG

SEQ ID NO: 109223 - protein, 34 aa, Artificial Sequence
  Description of Artificial Sequence: Synthetic polypeptide
DESEIRTTNPVATECWGSVSCINEPQDMEGENRG

SEQ ID NO: 109224 - protein, 28 aa, Artificial Sequence
  Description of Artificial Sequence: Synthetic peptide
QEEEIWTTNPVATEQYGEAPEVCQHEEK

SEQ ID NO: 109225 - protein, 28 aa, Artificial Sequence
  Description of Artificial Sequence: Synthetic peptide
QEEEIWTTNPVATEQYGEAPEVCQHEET

SEQ ID NO: 109226 - protein, 33 aa, Artificial Sequence
  Description of Artificial Sequence: Synthetic polypeptide
DESEIRTTNPVATECWGSVSCINEPQDNEGENG

SEQ ID NO: 109227 - protein, 35 aa, Artificial Sequence
  Description of Artificial Sequence: Synthetic polypeptide
DESEIATTNPVATEQWGSVSGTGNPLDARGEENQD

SEQ ID NO: 109228 - protein, 34 aa, Artificial Sequence
  Description of Artificial Sequence: Synthetic polypeptide
DESEIRTTNPVATECWGSVSCINEPQDREGENGY

SEQ ID NO: 109229 - protein, 30 aa, Artificial Sequence
  Description of Artificial Sequence: Synthetic polypeptide
QEEEIATTNPVATEQYGEVSPEPACQHEEK

SEQ ID NO: 109230 - protein, 34 aa, Artificial Sequence
  Description of Artificial Sequence: Synthetic polypeptide
DESEIRTTNPVATECWGSVSCINEPQDREGENHG

SEQ ID NO: 109231 - protein, 34 aa, Artificial Sequence
  Description of Artificial Sequence: Synthetic polypeptide
DESEIRTTNPVATECWGSVSCINEPQDREGKNGY

SEQ ID NO: 109232 - protein, 29 aa, Artificial Sequence
  Description of Artificial Sequence: Synthetic peptide
QEGEIAPTNPCSSEQYGAVSCNLQSMGTR

SEQ ID NO: 109233 - protein, 29 aa, Artificial Sequence
  Description of Artificial Sequence: Synthetic peptide
QEGEIAPTNPCSSEQYGCVSCNLQQSGTR

SEQ ID NO: 109234 - protein, 32 aa, Artificial Sequence
  Description of Artificial Sequence: Synthetic polypeptide
DESEIAPTNPVATEQWGSVSCINLPQDSGETG

SEQ ID NO: 109235 - protein, 33 aa, Artificial Sequence
  Description of Artificial Sequence: Synthetic polypeptide
DESEIAPTNPVATECWGSVSCINLPQDREGENG

SEQ ID NO: 109236 - protein, 29 aa, Artificial Sequence
  Description of Artificial Sequence: Synthetic peptide
QEGEIAPTNPCSSEQYGCVSCVNLQSGTR

SEQ ID NO: 109237 - protein, 31 aa, Artificial Sequence
  Description of Artificial Sequence: Synthetic polypeptide
DESEIAPTNPVASEQWGSVSCINLPQDSGTG

SEQ ID NO: 109238 - protein, 31 aa, Artificial Sequence
  Description of Artificial Sequence: Synthetic polypeptide
QEEEIATTNPVATEQYGEVPTEPVGQHGEPK

SEQ ID NO: 109239 - protein, 31 aa, Artificial Sequence
  Description of Artificial Sequence: Synthetic polypeptide
QEEEIATTNPVATEQYGEVPTEPVCQHGEPK

SEQ ID NO: 109240 - protein, 29 aa, Artificial Sequence
  Description of Artificial Sequence: Synthetic peptide
QEEEIATTNPVATEQYGEVPMEVCQHEEK

SEQ ID NO: 109241 - protein, 30 aa, Artificial Sequence
  Description of Artificial Sequence: Synthetic polypeptide
DESEIAPTNPCSSEQYGIVSCNLPQSGETR

SEQ ID NO: 109242 - protein, 28 aa, Artificial Sequence
  Description of Artificial Sequence: Synthetic peptide
QEGEIAPTNPCSSEQYGDVSCNLQSGTL

SEQ ID NO: 109243 - protein, 29 aa, Artificial Sequence
  Description of Artificial Sequence: Synthetic peptide
QEEEIATTNPVATEQYGEVPEVCQHNEEK

SEQ ID NO: 109244 - protein, 30 aa, Artificial Sequence
  Description of Artificial Sequence: Synthetic polypeptide
DESEIACTNPVSTEQYGNVANTIMSRVGQR

SEQ ID NO: 109245 - protein, 30 aa, Artificial Sequence
  Description of Artificial Sequence: Synthetic polypeptide
DESEIACTNPVSTEQYGNVAETIQSRVGQR

SEQ ID NO: 109246 - protein, 28 aa, Artificial Sequence
  Description of Artificial Sequence: Synthetic peptide
QEGEIAPTNPCSSEQYGEVSCHLQSGTR

SEQ ID NO: 109247 - protein, 34 aa, Artificial Sequence
  Description of Artificial Sequence: Synthetic polypeptide
DESEIRTTNPVATECWGSVSCINEPQDREGTNDG

SEQ ID NO: 109248 - protein, 33 aa, Artificial Sequence
  Description of Artificial Sequence: Synthetic polypeptide
DESEIRTTNPVATECWGSVSCINEPQDREGTYG

SEQ ID NO: 109249 - protein, 29 aa, Artificial Sequence
  Description of Artificial Sequence: Synthetic peptide
QEGEIAPTNPCSSEQYGEVSCNLQSGQTR

SEQ ID NO: 109250 - protein, 31 aa, Artificial Sequence
  Description of Artificial Sequence: Synthetic polypeptide
DESEIACTNPVATEQWGSASENEPQDREGGG

SEQ ID NO: 109251 - protein, 28 aa, Artificial Sequence
  Description of Artificial Sequence: Synthetic peptide
QEGEIAPTNPCSSEQYGEVSCNLQSGTG

SEQ ID NO: 109252 - protein, 33 aa, Artificial Sequence
  Description of Artificial Sequence: Synthetic polypeptide
DESEIRTTNPVATECWGSVSCINEPQDREGVFG

SEQ ID NO: 109253 - protein, 33 aa, Artificial Sequence
  Description of Artificial Sequence: Synthetic polypeptide
DESEHRTTNPVATECWGSVSCINEPQDREGENG

SEQ ID NO: 109254 - protein, 34 aa, Artificial Sequence
  Description of Artificial Sequence: Synthetic polypeptide
DESEGIRTTNPVATECWGSVSCINEPQDRIGENG

SEQ ID NO: 109255 - protein, 34 aa, Artificial Sequence
  Description of Artificial Sequence: Synthetic polypeptide
DESEGIRTTNPVATECWGSVSCINEPQDREGENG

SEQ ID NO: 109256 - protein, 28 aa, Artificial Sequence
  Description of Artificial Sequence: Synthetic peptide
QEGEIAPTNPCSSEQYGAVSCNLQSGTD

SEQ ID NO: 109257 - protein, 34 aa, Artificial Sequence
  Description of Artificial Sequence: Synthetic polypeptide
DESEGIRTTNPVATECWGSVSCINEGQDREGENG

SEQ ID NO: 109258 - protein, 31 aa, Artificial Sequence
  Description of Artificial Sequence: Synthetic polypeptide
DESEIAPTNPVSTEQYGIVAANTIQSRVGQR

SEQ ID NO: 109259 - protein, 28 aa, Artificial Sequence
  Description of Artificial Sequence: Synthetic peptide
QEGEIAPTNPCSSEQYGAVSCNLDSGTR

SEQ ID NO: 109260 - protein, 28 aa, Artificial Sequence
  Description of Artificial Sequence: Synthetic peptide
QEGEIAPTNPCSSEHYGIVSCNLQSGTR

SEQ ID NO: 109261 - protein, 33 aa, Artificial Sequence
  Description of Artificial Sequence: Synthetic polypeptide
DESEIASTNPVATEQWGSVSDINEPQDREGENG

SEQ ID NO: 109262 - protein, 30 aa, Artificial Sequence
  Description of Artificial Sequence: Synthetic polypeptide
DESEIASTNPVATEQWGDVSEILQNAAGDI

SEQ ID NO: 109263 - protein, 28 aa, Artificial Sequence
  Description of Artificial Sequence: Synthetic peptide
QEGEIAPTNPCSSEIYGIVSCNLQSGTR

SEQ ID NO: 109264 - protein, 29 aa, Artificial Sequence
  Description of Artificial Sequence: Synthetic peptide
DESEIASTNPVATEQWGDMASTLQHAGDI

SEQ ID NO: 109265 - protein, 30 aa, Artificial Sequence
  Description of Artificial Sequence: Synthetic polypeptide
DESEIASTNPVATEGYGVVASTLQDHGEDI

SEQ ID NO: 109266 - protein, 28 aa, Artificial Sequence
  Description of Artificial Sequence: Synthetic peptide
QEGEIAPTNPCSSEKYGIVSCNLQSGTR

SEQ ID NO: 109267 - protein, 30 aa, Artificial Sequence
  Description of Artificial Sequence: Synthetic polypeptide
DESEIASTNPVATEGYGVVASTLQDHGEDG

SEQ ID NO: 109268 - protein, 28 aa, Artificial Sequence
  Description of Artificial Sequence: Synthetic peptide
QEGEIAPTNPCSSELYGIVSCNLQSGTR

SEQ ID NO: 109269 - protein, 28 aa, Artificial Sequence
  Description of Artificial Sequence: Synthetic peptide
QEGEIAPTNPCSSEMYGIVSCNLQSGTR

SEQ ID NO: 109270 - protein, 28 aa, Artificial Sequence
  Description of Artificial Sequence: Synthetic peptide
QEGEIAPTNPCSSENYGIVSCNLQHGTR

SEQ ID NO: 109271 - protein, 28 aa, Artificial Sequence
  Description of Artificial Sequence: Synthetic peptide
QEGEIAPTNPCSSENYGIVSCNLQSGTR

SEQ ID NO: 109272 - protein, 29 aa, Artificial Sequence
  Description of Artificial Sequence: Synthetic peptide
DESEIASTNPVATEGYGVMATTLVQHGDD

SEQ ID NO: 109273 - protein, 28 aa, Artificial Sequence
  Description of Artificial Sequence: Synthetic peptide
QEGEIAPTNPCSSEPYGEVSCNLQSGTR

SEQ ID NO: 109274 - protein, 29 aa, Artificial Sequence
  Description of Artificial Sequence: Synthetic peptide
DESEIASTNPVATEGYGVMATDTLQHGDI

SEQ ID NO: 109275 - protein, 28 aa, Artificial Sequence
  Description of Artificial Sequence: Synthetic peptide
QEGEIAPTNPCSSEPYGIVSCNLQSGTR

SEQ ID NO: 109276 - protein, 32 aa, Artificial Sequence
  Description of Artificial Sequence: Synthetic polypeptide
DESEIASTNPVATEGYGSVSANTLEDREGQDL

SEQ ID NO: 109277 - protein, 28 aa, Artificial Sequence
  Description of Artificial Sequence: Synthetic peptide
QEGEIAPTNPCSSEQFGIVSCNLQSGTR

SEQ ID NO: 109278 - protein, 30 aa, Artificial Sequence
  Description of Artificial Sequence: Synthetic polypeptide
DESEIASTNPVATEGYGSVACTLQDHGEDG

SEQ ID NO: 109279 - protein, 29 aa, Artificial Sequence
  Description of Artificial Sequence: Synthetic peptide
QEGEIAPTNPCSSEQWGIVSCNLQSGENR

SEQ ID NO: 109280 - protein, 33 aa, Artificial Sequence
  Description of Artificial Sequence: Synthetic polypeptide
DESEIRTTNPVATECWGSVSCINEPQDREGITG

SEQ ID NO: 109281 - protein, 28 aa, Artificial Sequence
  Description of Artificial Sequence: Synthetic peptide
QEGEIAPTNPCSSEQWGIVSCNLQSGPR

SEQ ID NO: 109282 - protein, 28 aa, Artificial Sequence
  Description of Artificial Sequence: Synthetic peptide
QEGEIAPTNPCSSEQWGIVSCNLQSGTR

SEQ ID NO: 109283 - protein, 28 aa, Artificial Sequence
  Description of Artificial Sequence: Synthetic peptide
QEGEIAPTNPCSSEQYGAVSADLQSGTR

SEQ ID NO: 109284 - protein, 30 aa, Artificial Sequence
  Description of Artificial Sequence: Synthetic polypeptide
DESEIASTNPVATEGYGDVSSTLQNAAGDA

SEQ ID NO: 109285 - protein, 29 aa, Artificial Sequence
  Description of Artificial Sequence: Synthetic peptide
QEGEIAPTNPCSSEQYGAVSCNLQESGTR

SEQ ID NO: 109286 - protein, 33 aa, Artificial Sequence
  Description of Artificial Sequence: Synthetic polypeptide
DESECRTTNPVATECWGSVSCINIPQDREGENG

SEQ ID NO: 109287 - protein, 33 aa, Artificial Sequence
  Description of Artificial Sequence: Synthetic polypeptide
DESECRTTNPVATECWGSVSCINEPQDREGENG

SEQ ID NO: 109288 - protein, 34 aa, Artificial Sequence
  Description of Artificial Sequence: Synthetic polypeptide
DESECIRTTNPVATECWGSVSCINEPQDREGENG

SEQ ID NO: 109289 - protein, 28 aa, Artificial Sequence
  Description of Artificial Sequence: Synthetic peptide
QEGEIAPTNPCSSEQYGIVSCNAQSGKR

SEQ ID NO: 109290 - protein, 28 aa, Artificial Sequence
  Description of Artificial Sequence: Synthetic peptide
QEGEIAPTNPCSSEQYGIVSCNAQSGTR

SEQ ID NO: 109291 - protein, 28 aa, Artificial Sequence
  Description of Artificial Sequence: Synthetic peptide
QEGEIAPTNPCSSEQYGIVSCNCQSGER

SEQ ID NO: 109292 - protein, 28 aa, Artificial Sequence
  Description of Artificial Sequence: Synthetic peptide
QEGEIAPTNPCSSEQYGIVSCNCQSGTR

SEQ ID NO: 109293 - protein, 28 aa, Artificial Sequence
  Description of Artificial Sequence: Synthetic peptide
QEGEIAPTNPCSSEQYGIVSCNDQSGTR

SEQ ID NO: 109294 - protein, 28 aa, Artificial Sequence
  Description of Artificial Sequence: Synthetic peptide
QEGEIAPTNPCSSEQYGIVSCNEQSGDR

SEQ ID NO: 109295 - protein, 28 aa, Artificial Sequence
  Description of Artificial Sequence: Synthetic peptide
QEGEIAPTNPCSSEQYGIVSCNEQSGTR

SEQ ID NO: 109296 - protein, 28 aa, Artificial Sequence
  Description of Artificial Sequence: Synthetic peptide
QEGEIAPTNPCSSEQYGIVSCNFQSGTR

SEQ ID NO: 109297 - protein, 28 aa, Artificial Sequence
  Description of Artificial Sequence: Synthetic peptide
QEGEIAPTNPCSSEQYGIVSCNGQSGSR

SEQ ID NO: 109298 - protein, 28 aa, Artificial Sequence
  Description of Artificial Sequence: Synthetic peptide
QEGEIAPTNPCSSEQYGIVSCNGQSGTR

SEQ ID NO: 109299 - protein, 28 aa, Artificial Sequence
  Description of Artificial Sequence: Synthetic peptide
QEGEIAPTNPCSSEQYGIVSCNHQSGTR

SEQ ID NO: 109300 - protein, 28 aa, Artificial Sequence
  Description of Artificial Sequence: Synthetic peptide
QEGEIAPTNPCSSEQYGIVSCNIQQGTR

SEQ ID NO: 109301 - protein, 28 aa, Artificial Sequence
  Description of Artificial Sequence: Synthetic peptide
QEGEIAPTNPCSSEQYGIVSCNIQSGTR

SEQ ID NO: 109302 - protein, 28 aa, Artificial Sequence
  Description of Artificial Sequence: Synthetic peptide
QEGEIAPTNPCSSEQYGIVSCNKQSGTR

SEQ ID NO: 109303 - protein, 28 aa, Artificial Sequence
  Description of Artificial Sequence: Synthetic peptide
QEGEIAPTNPCSSEQYGIVSCNLASGTR

SEQ ID NO: 109304 - protein, 28 aa, Artificial Sequence
  Description of Artificial Sequence: Synthetic peptide
QEGEIAPTNPCSSEQYGIVSCNLMSGTR

SEQ ID NO: 109305 - protein, 32 aa, Artificial Sequence
  Description of Artificial Sequence: Synthetic polypeptide
DESAIATTNPVAYEQWGCSFSTNHQIEDGNNR

SEQ ID NO: 109306 - protein, 34 aa, Artificial Sequence
  Description of Artificial Sequence: Synthetic polypeptide
DESAEIRTTNPVATECWGSVSWINEPQDREGENG

SEQ ID NO: 109307 - protein, 34 aa, Artificial Sequence
  Description of Artificial Sequence: Synthetic polypeptide
DESAEIRTTNPVATECWGSVSCINFPQDREGENG

SEQ ID NO: 109308 - protein, 34 aa, Artificial Sequence
  Description of Artificial Sequence: Synthetic polypeptide
DESAEIRTTNPVATECWGSVSCINEPQDREGENG

SEQ ID NO: 109309 - protein, 33 aa, Artificial Sequence
  Description of Artificial Sequence: Synthetic polypeptide
DESEIRTTNPVATECWGSVSCINEPQDREIENG

SEQ ID NO: 109310 - protein, 33 aa, Artificial Sequence
  Description of Artificial Sequence: Synthetic polypeptide
DESEIRTTNPVATECWGSVSCINEPQDREKENG

SEQ ID NO: 109311 - protein, 28 aa, Artificial Sequence
  Description of Artificial Sequence: Synthetic peptide
QEGEIAPTNPCSSEQYGIVSCNLQAGTA

SEQ ID NO: 109312 - protein, 33 aa, Artificial Sequence
  Description of Artificial Sequence: Synthetic polypeptide
DESEIRTTNPVATECWGSVSCINEPQDRELENG

SEQ ID NO: 109313 - protein, 33 aa, Artificial Sequence
  Description of Artificial Sequence: Synthetic polypeptide
DEREISTTNPVATEQYGSVVSAGDLQQQGTYVW

SEQ ID NO: 109314 - protein, 29 aa, Artificial Sequence
  Description of Artificial Sequence: Synthetic peptide
QEGEIAPTNPCSSEQYGIVSCGNLQSGTR

SEQ ID NO: 109315 - protein, 28 aa, Artificial Sequence
  Description of Artificial Sequence: Synthetic peptide
QEGEIAPTNPCSSEQYGIVSCGLQSGTR

SEQ ID NO: 109316 - protein, 29 aa, Artificial Sequence
  Description of Artificial Sequence: Synthetic peptide
QEGEIAPTNPCSSEQYGIVSCENLQSGTR

SEQ ID NO: 109317 - protein, 33 aa, Artificial Sequence
  Description of Artificial Sequence: Synthetic polypeptide
DESCIRTTNPVATECWGSVSCINEPQDREGENG

SEQ ID NO: 109318 - protein, 29 aa, Artificial Sequence
  Description of Artificial Sequence: Synthetic peptide
QEEEIATTNPVATEQYGEVPEVCQHEEKV

SEQ ID NO: 109319 - protein, 33 aa, Artificial Sequence
  Description of Artificial Sequence: Synthetic polypeptide
DESEARTTNPVATECWGSVSIINEPQDREGENG

SEQ ID NO: 109320 - protein, 33 aa, Artificial Sequence
  Description of Artificial Sequence: Synthetic polypeptide
DESEARTTNPVATECWGSVSCINEPQDREGENG

SEQ ID NO: 109321 - protein, 28 aa, Artificial Sequence
  Description of Artificial Sequence: Synthetic peptide
QEGEIAPTNPCSSEQYGGVSCNLQSRTR

SEQ ID NO: 109322 - protein, 28 aa, Artificial Sequence
  Description of Artificial Sequence: Synthetic peptide
QEGEIAPTNPCSSEQYGHVSCNIQSGTR

SEQ ID NO: 109323 - protein, 28 aa, Artificial Sequence
  Description of Artificial Sequence: Synthetic peptide
QEGEIAPTNPCSSEQYGIASCNLQSGTR

SEQ ID NO: 109324 - protein, 28 aa, Artificial Sequence
  Description of Artificial Sequence: Synthetic peptide
QEGEIAPTNPCSSEQYGICSCNLQSGTR

SEQ ID NO: 109325 - protein, 28 aa, Artificial Sequence
  Description of Artificial Sequence: Synthetic peptide
QEGEIAPTNPCSSEQYGIISCNLQSGTR

SEQ ID NO: 109326 - protein, 33 aa, Artificial Sequence
  Description of Artificial Sequence: Synthetic polypeptide
DESEARTTNPVATECWGSVSCILEPQDREGENG

SEQ ID NO: 109327 - protein, 28 aa, Artificial Sequence
  Description of Artificial Sequence: Synthetic peptide
QEGEIAPTNPCSSEQYGITSCNLQSGTR

SEQ ID NO: 109328 - protein, 28 aa, Artificial Sequence
  Description of Artificial Sequence: Synthetic peptide
QEGEIAPTNPCSSEQYGIVACNLQSGTR

SEQ ID NO: 109329 - protein, 28 aa, Artificial Sequence
  Description of Artificial Sequence: Synthetic peptide
QEGEIAPTNPCSSEQYGIVCCNLQSGTR

SEQ ID NO: 109330 - protein, 34 aa, Artificial Sequence
  Description of Artificial Sequence: Synthetic polypeptide
DESEIRTTNPVATECWGSVSCINEPQDREGINGS

SEQ ID NO: 109331 - protein, 28 aa, Artificial Sequence
  Description of Artificial Sequence: Synthetic peptide
QEGEIAPTNPCSSEQYGIVGCNLQSGTR

SEQ ID NO: 109332 - protein, 34 aa, Artificial Sequence
  Description of Artificial Sequence: Synthetic polypeptide
DESEIRTTNPVATECWGSVSCINEPQDREGYNGY

SEQ ID NO: 109333 - protein, 33 aa, Artificial Sequence
  Description of Artificial Sequence: Synthetic polypeptide
DESDIRTTNPVATECWGSVSCINEPQDREGSNG

SEQ ID NO: 109334 - protein, 33 aa, Artificial Sequence
  Description of Artificial Sequence: Synthetic polypeptide
DESDIRTTNPVATECWGSVSCINEPQDREGENG

SEQ ID NO: 109335 - protein, 35 aa, Artificial Sequence
  Description of Artificial Sequence: Synthetic polypeptide
DESCIRTTNPVATEQYGSVSCTGNDSQWTGTKNGV

SEQ ID NO: 109336 - protein, 33 aa, Artificial Sequence
  Description of Artificial Sequence: Synthetic polypeptide
DESEIRTTNPVATECWGSVSCINEPQDREHENG

SEQ ID NO: 109337 - protein, 28 aa, Artificial Sequence
  Description of Artificial Sequence: Synthetic peptide
QEGEIAPTNPCSSEQYGIVSCALQSGTR

SEQ ID NO: 109338 - protein, 33 aa, Artificial Sequence
  Description of Artificial Sequence: Synthetic polypeptide
DESEIRTTNPVATECWGSVSCINEPQDREHHNG

SEQ ID NO: 109339 - protein, 29 aa, Artificial Sequence
  Description of Artificial Sequence: Synthetic peptide
QEGEIAPTNPCSSEQYGIVSCANLQSGTR

SEQ ID NO: 109340 - protein, 28 aa, Artificial Sequence
  Description of Artificial Sequence: Synthetic peptide
QEGEIAPTNPCSSEQYGIVSCCLQSGTR

SEQ ID NO: 109341 - protein, 28 aa, Artificial Sequence
  Description of Artificial Sequence: Synthetic peptide
QEGEIAPTNPCSSEQYGIVSCDLQSGTR

SEQ ID NO: 109342 - protein, 33 aa, Artificial Sequence
  Description of Artificial Sequence: Synthetic polypeptide
DESCIRTTNPVATECWGSVSCKNEPQDREGENG

SEQ ID NO: 109343 - protein, 33 aa, Artificial Sequence
  Description of Artificial Sequence: Synthetic polypeptide
DESCIRTTNPVATECWGSVSCINEPQNREGENG

SEQ ID NO: 109344 - protein, 34 aa, Artificial Sequence
  Description of Artificial Sequence: Synthetic polypeptide
DESEAIRTTNPVATECWGSVSCINEPQDREGENG

SEQ ID NO: 109345 - protein, 33 aa, Artificial Sequence
  Description of Artificial Sequence: Synthetic polypeptide
DESEIRTTNPVATECWGSVSCINEPPDREGENG

SEQ ID NO: 109346 - protein, 28 aa, Artificial Sequence
  Description of Artificial Sequence: Synthetic peptide
QEGEIAPTNPCSSEGYGIVSCNLQSGTR

SEQ ID NO: 109347 - protein, 28 aa, Artificial Sequence
  Description of Artificial Sequence: Synthetic peptide
QEGEIAPTNPCSSEEYGIVSCNLQSGTR

SEQ ID NO: 109348 - protein, 28 aa, Artificial Sequence
  Description of Artificial Sequence: Synthetic peptide
QEGEIAPTNPCATECWGIVSANWQSGPR

SEQ ID NO: 109349 - protein, 32 aa, Artificial Sequence
  Description of Artificial Sequence: Synthetic polypeptide
DESEIATTNPCAYEQWGEVSTNLQGDHGNDTD

SEQ ID NO: 109350 - protein, 29 aa, Artificial Sequence
  Description of Artificial Sequence: Synthetic peptide
QEEEIATTNPVATEQYGEVSEVCPNHEEV

SEQ ID NO: 109351 - protein, 34 aa, Artificial Sequence
  Description of Artificial Sequence: Synthetic polypeptide
DESEIRTTNPVATECWGSVSCINEPQDREGENSG

SEQ ID NO: 109352 - protein, 33 aa, Artificial Sequence
  Description of Artificial Sequence: Synthetic polypeptide
DESEIATTNPCATECWGIVSCINLPQDREGENR

SEQ ID NO: 109353 - protein, 33 aa, Artificial Sequence
  Description of Artificial Sequence: Synthetic polypeptide
DESEIATTNPCASECWGSVSCINLPQDREGENR

SEQ ID NO: 109354 - protein, 29 aa, Artificial Sequence
  Description of Artificial Sequence: Synthetic peptide
DESEIASVNPVSTEGYGNVANNLQRVGQQ

SEQ ID NO: 109355 - protein, 34 aa, Artificial Sequence
  Description of Artificial Sequence: Synthetic polypeptide
DESEIRTTNPVATECWGSVSCINEPQDREGENTG

SEQ ID NO: 109356 - protein, 34 aa, Artificial Sequence
  Description of Artificial Sequence: Synthetic polypeptide
DESEIRTTNPVATECWGSVSCINEPQDREGENVG

SEQ ID NO: 109357 - protein, 30 aa, Artificial Sequence
  Description of Artificial Sequence: Synthetic polypeptide
DESEIASVNPVCTEGYGVVSDTIQSRVGNR

SEQ ID NO: 109358 - protein, 30 aa, Artificial Sequence
  Description of Artificial Sequence: Synthetic polypeptide
DESEIASVNPVCTEGYGVVSDNIQSRVGNQ

SEQ ID NO: 109359 - protein, 28 aa, Artificial Sequence
  Description of Artificial Sequence: Synthetic peptide
QEGEIAPTNPCATEQYGDVSECLQHEEL

SEQ ID NO: 109360 - protein, 31 aa, Artificial Sequence
  Description of Artificial Sequence: Synthetic polypeptide
DESEIASTNPVSTEQYGNVAANTIQNRVGQR

SEQ ID NO: 109361 - protein, 31 aa, Artificial Sequence
  Description of Artificial Sequence: Synthetic polypeptide
DESEIASTNPVSTEQYGIVAANTIQSRVGQR

SEQ ID NO: 109362 - protein, 31 aa, Artificial Sequence
  Description of Artificial Sequence: Synthetic polypeptide
DESEIASTNPVSTEQYGDVAANTIQNRVGQR

SEQ ID NO: 109363 - protein, 34 aa, Artificial Sequence
  Description of Artificial Sequence: Synthetic polypeptide
DESEIRTTNPVATECWGSVSCINEPQDREGENWG

SEQ ID NO: 109364 - protein, 29 aa, Artificial Sequence
  Description of Artificial Sequence: Synthetic peptide
QEGEIAPTNPCATEQYGIVSCDNPEFGTR

SEQ ID NO: 109365 - protein, 28 aa, Artificial Sequence
  Description of Artificial Sequence: Synthetic peptide
DESEIASTNPVSTEGYGTMASTLQHGDI

SEQ ID NO: 109366 - protein, 29 aa, Artificial Sequence
  Description of Artificial Sequence: Synthetic peptide
DESEIASTNPVSTEGYGTMASETLQHGNI

SEQ ID NO: 109367 - protein, 32 aa, Artificial Sequence
  Description of Artificial Sequence: Synthetic polypeptide
DESEIASTNPVSTEGYGNVCSANGIQSRVGNR

SEQ ID NO: 109368 - protein, 28 aa, Artificial Sequence
  Description of Artificial Sequence: Synthetic peptide
DESEIASTNPVSTEGYGNVANTLQREQL

SEQ ID NO: 109369 - protein, 28 aa, Artificial Sequence
  Description of Artificial Sequence: Synthetic peptide
DESEIASTNPVSTEGYGNVANTIQREQR

SEQ ID NO: 109370 - protein, 34 aa, Artificial Sequence
  Description of Artificial Sequence: Synthetic polypeptide
DESEIRTTNPVATECWGSVSCINEPQDREGENYG

SEQ ID NO: 109371 - protein, 33 aa, Artificial Sequence
  Description of Artificial Sequence: Synthetic polypeptide
DESEIRTTNPVATECWGSVSCINEPQDREGEPG

SEQ ID NO: 109372 - protein, 30 aa, Artificial Sequence
  Description of Artificial Sequence: Synthetic polypeptide
QEGEIAPTNPCATEQYGIVSCNLNMSGNPV

SEQ ID NO: 109373 - protein, 31 aa, Artificial Sequence
  Description of Artificial Sequence: Synthetic polypeptide
DESEIATTNPVASECWGSVSCNEPQDSGETR

SEQ ID NO: 109374 - protein, 33 aa, Artificial Sequence
  Description of Artificial Sequence: Synthetic polypeptide
DESEIRTTNPVATECWGSVSCINEPQDREGEQG

SEQ ID NO: 109375 - protein, 33 aa, Artificial Sequence
  Description of Artificial Sequence: Synthetic polypeptide
CEEEIACTNPVATEQYGCVATNNLENMGEENRW

SEQ ID NO: 109376 - protein, 29 aa, Artificial Sequence
  Description of Artificial Sequence: Synthetic peptide
QEGEIAPTNPCASEQYGTVSCDNLESGND

SEQ ID NO: 109377 - protein, 34 aa, Artificial Sequence
  Description of Artificial Sequence: Synthetic polypeptide
DESEIRTTNPVATECWGSVSCINEPQDREGENIG

SEQ ID NO: 109378 - protein, 30 aa, Artificial Sequence
  Description of Artificial Sequence: Synthetic polypeptide
QEGEIAPTNPCASEQYGAVSCNLQESGTYR

SEQ ID NO: 109379 - protein, 28 aa, Artificial Sequence
  Description of Artificial Sequence: Synthetic peptide
QEGEIAPTNPCASEQYGEVPCNLQHGTK

SEQ ID NO: 109380 - protein, 31 aa, Artificial Sequence
  Description of Artificial Sequence: Synthetic polypeptide
DESEIATTNPVATECWGNVSANNIQDREGQG

SEQ ID NO: 109381 - protein, 31 aa, Artificial Sequence
  Description of Artificial Sequence: Synthetic polypeptide
DESEIATTNPVATECWGNVSANNEQDREGQG

SEQ ID NO: 109382 - protein, 31 aa, Artificial Sequence
  Description of Artificial Sequence: Synthetic polypeptide
DESEIATTNPVATECWGNVAANTIQDREGQR

SEQ ID NO: 109383 - protein, 28 aa, Artificial Sequence
  Description of Artificial Sequence: Synthetic peptide
QEGEIAPTNPCASEQYGEVPENLQHGTK

SEQ ID NO: 109384 - protein, 29 aa, Artificial Sequence
  Description of Artificial Sequence: Synthetic peptide
QEGEIAPTNPCASEQYGIVSCDNPQFGTR

SEQ ID NO: 109385 - protein, 28 aa, Artificial Sequence
  Description of Artificial Sequence: Synthetic peptide
QEGEIAPTNPCASEQYGIVSCNEQSGDA

SEQ ID NO: 109386 - protein, 34 aa, Artificial Sequence
  Description of Artificial Sequence: Synthetic polypeptide
DESEIRTTNPVATECWGSVSCINEPQDREGENKG

SEQ ID NO: 109387 - protein, 34 aa, Artificial Sequence
  Description of Artificial Sequence: Synthetic polypeptide
DESEIRTTNPVATECWGSVSCINEPQDREGENLG

SEQ ID NO: 109388 - protein, 34 aa, Artificial Sequence
  Description of Artificial Sequence: Synthetic polypeptide
DESEIRTTNPVATECWGSVSCINEPQDREGENMG

SEQ ID NO: 109389 - protein, 34 aa, Artificial Sequence
  Description of Artificial Sequence: Synthetic polypeptide
DESEIRTTNPVATECWGSVSCINEPQDREGENMH

SEQ ID NO: 109390 - protein, 34 aa, Artificial Sequence
  Description of Artificial Sequence: Synthetic polypeptide
DESEIRTTNPVATECWGSVSCINEPQDREGENNG

SEQ ID NO: 109391 - protein, 34 aa, Artificial Sequence
  Description of Artificial Sequence: Synthetic polypeptide
DESEIRTTNPVATECWGSVSCINEPQDREGENPG

SEQ ID NO: 109392 - protein, 34 aa, Artificial Sequence
  Description of Artificial Sequence: Synthetic polypeptide
DESEIRTTNPVATECWGSVSCINEPQDREGENPT

SEQ ID NO: 109393 - protein, 32 aa, Artificial Sequence
  Description of Artificial Sequence: Synthetic polypeptide
DESEIATTNPVATECWGEVSCINEPQREGENG

SEQ ID NO: 109394 - protein, 34 aa, Artificial Sequence
  Description of Artificial Sequence: Synthetic polypeptide
DESEIRTTNPVATECWGSVSCINEPQDREGENQC

SEQ ID NO: 109395 - protein, 34 aa, Artificial Sequence
  Description of Artificial Sequence: Synthetic polypeptide
DESEIRTTNPVATECWGSVSCINEPQDREGENQG

SEQ ID NO: 109396 - protein, 37 aa, Artificial Sequence
  Description of Artificial Sequence: Synthetic polypeptide
AEEEIRTTNPVATEQYGSVSVSVTNLQAGSEGGNNQN

SEQ ID NO: 109397 - protein, 30 aa, Artificial Sequence
  Description of Artificial Sequence: Synthetic polypeptide
DESEIATTNPVATECWGEASCINCQREENK

SEQ ID NO: 109398 - protein, 37 aa, Artificial Sequence
  Description of Artificial Sequence: Synthetic polypeptide
AEEEIRTTNPVATEQYGSVSVSVSTNNLQQGSTNAQE

SEQ ID NO: 109399 - protein, 30 aa, Artificial Sequence
  Description of Artificial Sequence: Synthetic polypeptide
QEGEIAPTNPCASEQYGSVSTCNGQSGTPV

SEQ ID NO: 109400 - protein, 31 aa, Artificial Sequence
  Description of Artificial Sequence: Synthetic polypeptide
DESEIATTNPVATECWGDVSCCLPQDRGEEL

SEQ ID NO: 109401 - protein, 33 aa, Artificial Sequence
  Description of Artificial Sequence: Synthetic polypeptide
DESEIATTNPVATEAYGSTVSCINSLSMYGGNT

SEQ ID NO: 109402 - protein, 33 aa, Artificial Sequence
  Description of Artificial Sequence: Synthetic polypeptide
DESEIATTNPVATDQYGSTVSCINLSMYGGNTT

SEQ ID NO: 109403 - protein, 29 aa, Artificial Sequence
  Description of Artificial Sequence: Synthetic peptide
DESEIASTNPVSTEGYGNVAAECLQREQR

SEQ ID NO: 109404 - protein, 28 aa, Artificial Sequence
  Description of Artificial Sequence: Synthetic peptide
DESEIASTNPVSTEGYGDVANTLQREQL

SEQ ID NO: 109405 - protein, 28 aa, Artificial Sequence
  Description of Artificial Sequence: Synthetic peptide
DESEIASTNPVSTEGYGDVANCLQREQL

SEQ ID NO: 109406 - protein, 29 aa, Artificial Sequence
  Description of Artificial Sequence: Synthetic peptide
DESEIASTNPVGTEGYGVMASTLQMHGNI

SEQ ID NO: 109407 - protein, 28 aa, Artificial Sequence
  Description of Artificial Sequence: Synthetic peptide
DESEIASTNPVGTEGYGVMASTLQHGQI

SEQ ID NO: 109408 - protein, 32 aa, Artificial Sequence
  Description of Artificial Sequence: Synthetic polypeptide
QEEEIATTNPVATEQYGEVSATDLEDHEGEDL

SEQ ID NO: 109409 - protein, 28 aa, Artificial Sequence
  Description of Artificial Sequence: Synthetic peptide
DESEIASTNPVGTEGYGVMASTLQHGDI

SEQ ID NO: 109410 - protein, 28 aa, Artificial Sequence
  Description of Artificial Sequence: Synthetic peptide
DESEIASTNPVGTEGYGVMASTLQAGDI

SEQ ID NO: 109411 - protein, 29 aa, Artificial Sequence
  Description of Artificial Sequence: Synthetic peptide
DESEIASTNPVGTEGYGVMASTLLQHGDQ

SEQ ID NO: 109412 - protein, 29 aa, Artificial Sequence
  Description of Artificial Sequence: Synthetic peptide
DESEIASTNPVGTEGYGTMSSTLQQHGNH

SEQ ID NO: 109413 - protein, 28 aa, Artificial Sequence
  Description of Artificial Sequence: Synthetic peptide
DESEIASTNPVGTEGYGTMASTLQHGDI

SEQ ID NO: 109414 - protein, 29 aa, Artificial Sequence
  Description of Artificial Sequence: Synthetic peptide
DESEIASTNPVGTEGYGSMASTLQHGEDI

SEQ ID NO: 109415 - protein, 28 aa, Artificial Sequence
  Description of Artificial Sequence: Synthetic peptide
QEGEIAPTNPCSFEQYGIVSCQLQSGTR

SEQ ID NO: 109416 - protein, 29 aa, Artificial Sequence
  Description of Artificial Sequence: Synthetic peptide
QEGEIAPTNPCSFEQYGQVSCMNLQSGTR

SEQ ID NO: 109417 - protein, 28 aa, Artificial Sequence
  Description of Artificial Sequence: Synthetic peptide
QEGEIAPTNPCSHEIYGIVSCNLQSGTR

SEQ ID NO: 109418 - protein, 28 aa, Artificial Sequence
  Description of Artificial Sequence: Synthetic peptide
DESEIASTNPVGTEGWGVMACNLQRGDI

SEQ ID NO: 109419 - protein, 30 aa, Artificial Sequence
  Description of Artificial Sequence: Synthetic polypeptide
DESEIASTNPVCTECWGSVSDNEPQDSGNG

SEQ ID NO: 109420 - protein, 31 aa, Artificial Sequence
  Description of Artificial Sequence: Synthetic polypeptide
DESEIASTNPVATEQYGVVATPAGQMRGDPI

SEQ ID NO: 109421 - protein, 28 aa, Artificial Sequence
  Description of Artificial Sequence: Synthetic peptide
QEGEIAPTNPCSMEQYGIVSCNLQSGTG

SEQ ID NO: 109422 - protein, 28 aa, Artificial Sequence
  Description of Artificial Sequence: Synthetic peptide
DESEIASTNPVATEQYGVVASIEMHGDI

SEQ ID NO: 109423 - protein, 28 aa, Artificial Sequence
  Description of Artificial Sequence: Synthetic peptide
QEGEIAPTNPCSSAQYGIVSCNLQSGTR

SEQ ID NO: 109424 - protein, 28 aa, Artificial Sequence
  Description of Artificial Sequence: Synthetic peptide
QEGEIAPTNPCSSCQYGIVSCNLQSGTR

SEQ ID NO: 109425 - protein, 28 aa, Artificial Sequence
  Description of Artificial Sequence: Synthetic peptide
QEGEIAPTNPCSSDQYGIVSCNLQSGTR

SEQ ID NO: 109426 - protein, 28 aa, Artificial Sequence
  Description of Artificial Sequence: Synthetic peptide
DESEIASTNPVATEQYGVMASIEQHGDI

SEQ ID NO: 109427 - protein, 28 aa, Artificial Sequence
  Description of Artificial Sequence: Synthetic peptide
QEGEIAPTNPCSSEAYGIVSCNLQSGTR

SEQ ID NO: 109428 - protein, 28 aa, Artificial Sequence
  Description of Artificial Sequence: Synthetic peptide
QEGEIAPTNPCSSEAYGIVSNNLQSGTR

SEQ ID NO: 109429 - protein, 28 aa, Artificial Sequence
  Description of Artificial Sequence: Synthetic peptide
QEGEIAPTNPCSSEAYGNVSCNLQSGTR

SEQ ID NO: 109430 - protein, 28 aa, Artificial Sequence
  Description of Artificial Sequence: Synthetic peptide
QEGEIAPTNPCSSECYGIVSCNLQSGTR

SEQ ID NO: 109431 - protein, 29 aa, Artificial Sequence
  Description of Artificial Sequence: Synthetic peptide
QEGEIAPTNPCSCEQYGIVSCNLQSGGTR

SEQ ID NO: 109432 - protein, 29 aa, Artificial Sequence
  Description of Artificial Sequence: Synthetic peptide
QEGEIAPTNPCSCEQYGEVSCNLSQSGTR

SEQ ID NO: 109433 - protein, 28 aa, Artificial Sequence
  Description of Artificial Sequence: Synthetic peptide
QEGEIAPTNPCSAEQYGIVSCNLQSSTR

SEQ ID NO: 109434 - protein, 29 aa, Artificial Sequence
  Description of Artificial Sequence: Synthetic peptide
DESEIASTNPVGTEGYGVMASTLQSRGDI

SEQ ID NO: 109435 - protein, 33 aa, Artificial Sequence
  Description of Artificial Sequence: Synthetic polypeptide
DESEIRTTNPVATECWGSVSCINEPQDREGESG

SEQ ID NO: 109436 - protein, 33 aa, Artificial Sequence
  Description of Artificial Sequence: Synthetic polypeptide
DESEIRTTNPVATECWGSVSCINEPQDREGETG

SEQ ID NO: 109437 - protein, 28 aa, Artificial Sequence
  Description of Artificial Sequence: Synthetic peptide
QEGEIAPTNPCATEQYGIVSCVCQHGTK

SEQ ID NO: 109438 - protein, 29 aa, Artificial Sequence
  Description of Artificial Sequence: Synthetic peptide
QEGEIAPTNPCATEQYGTVSCDNPEFGTR

SEQ ID NO: 109439 - protein, 33 aa, Artificial Sequence
  Description of Artificial Sequence: Synthetic polypeptide
DESEIRTTNPVATECWGSVSCINEPQDREGEVG

SEQ ID NO: 109440 - protein, 28 aa, Artificial Sequence
  Description of Artificial Sequence: Synthetic peptide
QEGEIAPTNPCCSEQYGIVSCNLQSGTQ

SEQ ID NO: 109441 - protein, 33 aa, Artificial Sequence
  Description of Artificial Sequence: Synthetic polypeptide
DESEIRTTNPVATECWGSVSCINEPQDREGEWG

SEQ ID NO: 109442 - protein, 28 aa, Artificial Sequence
  Description of Artificial Sequence: Synthetic peptide
DESEIASTNPVGTEQYGVMSSTLEHGDI

SEQ ID NO: 109443 - protein, 30 aa, Artificial Sequence
  Description of Artificial Sequence: Synthetic polypeptide
DESEIASTNPVGTEQYGVMCSTGLQHEGDI

SEQ ID NO: 109444 - protein, 28 aa, Artificial Sequence
  Description of Artificial Sequence: Synthetic peptide
DESEIASTNPVGTEQYGVMASTLEHGDI

SEQ ID NO: 109445 - protein, 28 aa, Artificial Sequence
  Description of Artificial Sequence: Synthetic peptide
DESEIASTNPVGTEQYGVMASTEQHGDI

SEQ ID NO: 109446 - protein, 33 aa, Artificial Sequence
  Description of Artificial Sequence: Synthetic polypeptide
DESEIRTTNPVATECWGSVSCINEPQDREGEYG

SEQ ID NO: 109447 - protein, 28 aa, Artificial Sequence
  Description of Artificial Sequence: Synthetic peptide
QEGEIAPTNPCSSEFYGIVSCNLQSGTR

SEQ ID NO: 109448 - protein, 30 aa, Artificial Sequence
  Description of Artificial Sequence: Synthetic polypeptide
QEEEIATTNPVATEQYGEVSEDLEDHEEDL

SEQ ID NO: 109449 - protein, 30 aa, Artificial Sequence
  Description of Artificial Sequence: Synthetic polypeptide
QEEEIATTNPVATEQYGEVSEDLEDHEEDK

SEQ ID NO: 109450 - protein, 34 aa, Artificial Sequence
  Description of Artificial Sequence: Synthetic polypeptide
DESEIRTTNPVATECWGSVSCINEPQDREGFNGP

SEQ ID NO: 109451 - protein, 28 aa, Artificial Sequence
  Description of Artificial Sequence: Synthetic peptide
QEGEIAPTNPCGSEQYGIVSCNLQSETR

SEQ ID NO: 109452 - protein, 28 aa, Artificial Sequence
  Description of Artificial Sequence: Synthetic peptide
QEGEIAPTNPCGSEQYGIVSCNLQSGTF

SEQ ID NO: 109453 - protein, 28 aa, Artificial Sequence
  Description of Artificial Sequence: Synthetic peptide
QEGEIAPTNPCGSEQYGIVSCNLQSGTI

SEQ ID NO: 109454 - protein, 30 aa, Artificial Sequence
  Description of Artificial Sequence: Synthetic polypeptide
DESEIASTNPVGTEGYGVVASPTLQMHGNV

SEQ ID NO: 109455 - protein, 29 aa, Artificial Sequence
  Description of Artificial Sequence: Synthetic peptide
QEEEIATTNPVATEQYGEVSEDCEDHEEK

SEQ ID NO: 109456 - protein, 28 aa, Artificial Sequence
  Description of Artificial Sequence: Synthetic peptide
QEGEIAPTNPCISEQYGIVSCNQQSGTR

SEQ ID NO: 109457 - protein, 34 aa, Artificial Sequence
  Description of Artificial Sequence: Synthetic polypeptide
DESEIRTTNPVATECWGSVSCINEPQDREGGNFG

SEQ ID NO: 109458 - protein, 29 aa, Artificial Sequence
  Description of Artificial Sequence: Synthetic peptide
DESEIASTNPVGTEGYGVMSASTLQHGDI

SEQ ID NO: 109459 - protein, 34 aa, Artificial Sequence
  Description of Artificial Sequence: Synthetic polypeptide
DESEIRTTNPVATECWGSVSCINEPQDREGGNGI

SEQ ID NO: 109460 - protein, 29 aa, Artificial Sequence
  Description of Artificial Sequence: Synthetic peptide
DESEIASTNPVGTEGYGVMSASTLNRGDI

SEQ ID NO: 109461 - protein, 28 aa, Artificial Sequence
  Description of Artificial Sequence: Synthetic peptide
DESEIASTNPVGTEQWGDMASTLQHGDI

SEQ ID NO: 109462 - protein, 30 aa, Artificial Sequence
  Description of Artificial Sequence: Synthetic polypeptide
DENEIATTNPVATEQWGSVSEILMNHAEDA

SEQ ID NO: 109463 - protein, 33 aa, Artificial Sequence
  Description of Artificial Sequence: Synthetic polypeptide
DESEIRTTNPVATEGWGSVSWMNENADREGSNQ

SEQ ID NO: 109464 - protein, 29 aa, Artificial Sequence
  Description of Artificial Sequence: Synthetic peptide
QENEIATTNPVATECYGDVSYCLQHEEWL

SEQ ID NO: 109465 - protein, 31 aa, Artificial Sequence
  Description of Artificial Sequence: Synthetic polypeptide
DENEIRTTNPVATEQWGDVSEPAEMMANGNV

SEQ ID NO: 109466 - protein, 31 aa, Artificial Sequence
  Description of Artificial Sequence: Synthetic polypeptide
DENEIRTTNPVATEQWGDVSEPAEMMAAGNV

SEQ ID NO: 109467 - protein, 32 aa, Artificial Sequence
  Description of Artificial Sequence: Synthetic polypeptide
SEEEIACTNPVATEAYGSVSANLQDQAGTGDE

SEQ ID NO: 109468 - protein, 36 aa, Artificial Sequence
  Description of Artificial Sequence: Synthetic polypeptide
AEEEIRTTNPVATEQYGSVSTVTNNDEQIGTEENND

SEQ ID NO: 109469 - protein, 33 aa, Artificial Sequence
  Description of Artificial Sequence: Synthetic polypeptide
CEEEISTTNPVATEQYGCVCSNTEPQNSGSNQS

SEQ ID NO: 109470 - protein, 33 aa, Artificial Sequence
  Description of Artificial Sequence: Synthetic polypeptide
SEEEIACTNPVATEAYGSVSTNLQDQAGTTDHE

SEQ ID NO: 109471 - protein, 36 aa, Artificial Sequence
  Description of Artificial Sequence: Synthetic polypeptide
AEEEIRTTNPVATEQYGSVSTVTNMQQGTNNVTEES

SEQ ID NO: 109472 - protein, 36 aa, Artificial Sequence
  Description of Artificial Sequence: Synthetic polypeptide
AEEEIRTTNPVATEQYGSVSTVTNLQSGSTDGEEQD

SEQ ID NO: 109473 - protein, 35 aa, Artificial Sequence
  Description of Artificial Sequence: Synthetic polypeptide
AEEEIRTTNPVATEQYGSVVVSVTVNNQEQAENDE

SEQ ID NO: 109474 - protein, 31 aa, Artificial Sequence
  Description of Artificial Sequence: Synthetic polypeptide
DENEIRTTNPVATEQWGDVSENEPMDAAGDG

SEQ ID NO: 109475 - protein, 30 aa, Artificial Sequence
  Description of Artificial Sequence: Synthetic polypeptide
DENEIRTTNPVATEQWGDVSENEMNSAEDA

SEQ ID NO: 109476 - protein, 33 aa, Artificial Sequence
  Description of Artificial Sequence: Synthetic polypeptide
CEEEISTTNPVATEQYGCVCSNTEPQRFGSEQS

SEQ ID NO: 109477 - protein, 30 aa, Artificial Sequence
  Description of Artificial Sequence: Synthetic polypeptide
DENEIRTTNPVATEQWGDVSENEMNAAEGA

SEQ ID NO: 109478 - protein, 34 aa, Artificial Sequence
  Description of Artificial Sequence: Synthetic polypeptide
AEEEIRTTNPVATEQYGSVVVSVTVNNQEQETTD

SEQ ID NO: 109479 - protein, 30 aa, Artificial Sequence
  Description of Artificial Sequence: Synthetic polypeptide
DENEIRTTNPVATEQWGDVSENEMNAAEDA

SEQ ID NO: 109480 - protein, 34 aa, Artificial Sequence
  Description of Artificial Sequence: Synthetic polypeptide
AEEEIRTTNPVATEQYGSVVVTATNLENGTEAGT

SEQ ID NO: 109481 - protein, 29 aa, Artificial Sequence
  Description of Artificial Sequence: Synthetic peptide
AEVEIACTNPVATEQYGEAKVENSQRPGR

SEQ ID NO: 109482 - protein, 32 aa, Artificial Sequence
  Description of Artificial Sequence: Synthetic polypeptide
SEEEIACTNPVATEMYGSVATNLQDATGTPDE

SEQ ID NO: 109483 - protein, 37 aa, Artificial Sequence
  Description of Artificial Sequence: Synthetic polypeptide
AEEEIRTTNPVATEQYGSVSTVTNLQQNGDEAGNVDE

SEQ ID NO: 109484 - protein, 30 aa, Artificial Sequence
  Description of Artificial Sequence: Synthetic polypeptide
DENEIRTTNPVATEQWGDVSEIWMNAKGPA

SEQ ID NO: 109485 - protein, 30 aa, Artificial Sequence
  Description of Artificial Sequence: Synthetic polypeptide
DENEIRTTNPVATEQWGDVSEIWMNAAGDA

SEQ ID NO: 109486 - protein, 30 aa, Artificial Sequence
  Description of Artificial Sequence: Synthetic polypeptide
DENEIRTTNPVATEQWGDVSEITMNSAEDA

SEQ ID NO: 109487 - protein, 30 aa, Artificial Sequence
  Description of Artificial Sequence: Synthetic polypeptide
DENEIRTTNPVATEQWGDVSEITMNRAEDA

SEQ ID NO: 109488 - protein, 31 aa, Artificial Sequence
  Description of Artificial Sequence: Synthetic polypeptide
DENEIRTTNPVATEQWGDVSEITMNAAEIDA

SEQ ID NO: 109489 - protein, 31 aa, Artificial Sequence
  Description of Artificial Sequence: Synthetic polypeptide
DENEIRTTNPVATEQWGDVSEITMNAAEDAE

SEQ ID NO: 109490 - protein, 32 aa, Artificial Sequence
  Description of Artificial Sequence: Synthetic polypeptide
DENEIRTTNPVATEQWGDVSEPAEPNMANGNV

SEQ ID NO: 109491 - protein, 30 aa, Artificial Sequence
  Description of Artificial Sequence: Synthetic polypeptide
DENEIRTTNPVATEQWGDVSEITMNAAEDA

SEQ ID NO: 109492 - protein, 30 aa, Artificial Sequence
  Description of Artificial Sequence: Synthetic polypeptide
DENEIRTTNPVATEQWGDVSEPEMNGAEDA

SEQ ID NO: 109493 - protein, 31 aa, Artificial Sequence
  Description of Artificial Sequence: Synthetic polypeptide
DENEIRTTNPVATEQWGDVSEPIEMMAAGNV

SEQ ID NO: 109494 - protein, 30 aa, Artificial Sequence
  Description of Artificial Sequence: Synthetic polypeptide
DENEIRTTNPVATEQWGDVSSIEMNAAGDA

SEQ ID NO: 109495 - protein, 30 aa, Artificial Sequence
  Description of Artificial Sequence: Synthetic polypeptide
DENEIRTTNPVATEQWGDVSSEETNALEDA

SEQ ID NO: 109496 - protein, 36 aa, Artificial Sequence
  Description of Artificial Sequence: Synthetic polypeptide
AEEEIRTTNPVATEQYGSVSTVTNNDNQQIGNNEDE

SEQ ID NO: 109497 - protein, 30 aa, Artificial Sequence
  Description of Artificial Sequence: Synthetic polypeptide
DENEIRTTNPVATEQWGDVSSAEMNAENDA

SEQ ID NO: 109498 - protein, 30 aa, Artificial Sequence
  Description of Artificial Sequence: Synthetic polypeptide
DENEIRTTNPVATEQWGDVSRIEMNGAEDA

SEQ ID NO: 109499 - protein, 31 aa, Artificial Sequence
  Description of Artificial Sequence: Synthetic polypeptide
DENEIRTTNPVATEQWGDVSPREMNAAEGDA

SEQ ID NO: 109500 - protein, 30 aa, Artificial Sequence
  Description of Artificial Sequence: Synthetic polypeptide
DENEIRTTNPVATEQWGDVSNIRMNAAEDA

SEQ ID NO: 109501 - protein, 30 aa, Artificial Sequence
  Description of Artificial Sequence: Synthetic polypeptide
DENEIRTTNPVATEQWGDVSNIEMNAANDA

SEQ ID NO: 109502 - protein, 32 aa, Artificial Sequence
  Description of Artificial Sequence: Synthetic polypeptide
SEEEIACTNPVATEAYGSVATNLQDIAETGRE

SEQ ID NO: 109503 - protein, 31 aa, Artificial Sequence
  Description of Artificial Sequence: Synthetic polypeptide
DENEIRTTNPVATEQWGDVSNEIEGNAAEDA

SEQ ID NO: 109504 - protein, 31 aa, Artificial Sequence
  Description of Artificial Sequence: Synthetic polypeptide
DENEIRTTNPVATEQWGDVSNAEMNDAEGDA

SEQ ID NO: 109505 - protein, 33 aa, Artificial Sequence
  Description of Artificial Sequence: Synthetic polypeptide
SEEEIACTNPVATEAYGSVATNLQDNPGENAMD

SEQ ID NO: 109506 - protein, 30 aa, Artificial Sequence
  Description of Artificial Sequence: Synthetic polypeptide
DENEIRTTNPVATEQWGDVSKIETNAAEDA

SEQ ID NO: 109507 - protein, 30 aa, Artificial Sequence
  Description of Artificial Sequence: Synthetic polypeptide
DENEIRTTNPVATEQWGDVSKIEMNAQEDA

SEQ ID NO: 109508 - protein, 31 aa, Artificial Sequence
  Description of Artificial Sequence: Synthetic polypeptide
DENEIRTTNPVATEQWGDVSIIHMNAAEGDA

SEQ ID NO: 109509 - protein, 31 aa, Artificial Sequence
  Description of Artificial Sequence: Synthetic polypeptide
DENEIRTTNPVATEQWGDVSGNIEMNAGEDA

SEQ ID NO: 109510 - protein, 30 aa, Artificial Sequence
  Description of Artificial Sequence: Synthetic polypeptide
DENEIRTTNPVATEQWGDVSEVEQNAAEDK

SEQ ID NO: 109511 - protein, 30 aa, Artificial Sequence
  Description of Artificial Sequence: Synthetic polypeptide
DENEIRTTNPVATEQWGDVSETEQNAVEDA

SEQ ID NO: 109512 - protein, 30 aa, Artificial Sequence
  Description of Artificial Sequence: Synthetic polypeptide
DENEIRTTNPVATEQWGDVSETEMNAAESA

SEQ ID NO: 109513 - protein, 30 aa, Artificial Sequence
  Description of Artificial Sequence: Synthetic polypeptide
DENEIRTTNPVATEQWGDVSETEMNAAEDA

SEQ ID NO: 109514 - protein, 30 aa, Artificial Sequence
  Description of Artificial Sequence: Synthetic polypeptide
DENEIRTTNPVATEQWGDVSESEMNLAEDA

SEQ ID NO: 109515 - protein, 30 aa, Artificial Sequence
  Description of Artificial Sequence: Synthetic polypeptide
DENEIRTTNPVATEQWGDVSESEMNAARDA

SEQ ID NO: 109516 - protein, 30 aa, Artificial Sequence
  Description of Artificial Sequence: Synthetic polypeptide
DENEIRTTNPVATEQWGDVSESEMNAANDA

SEQ ID NO: 109517 - protein, 30 aa, Artificial Sequence
  Description of Artificial Sequence: Synthetic polypeptide
DENEIRTTNPVATEQWGDVSEQLMNAAEDA

SEQ ID NO: 109518 - protein, 30 aa, Artificial Sequence
  Description of Artificial Sequence: Synthetic polypeptide
DENEIRTTNPVATEQWGDVSEQEMNAANDA

SEQ ID NO: 109519 - protein, 30 aa, Artificial Sequence
  Description of Artificial Sequence: Synthetic polypeptide
DENEIRTTNPVATEQWGDVSEPETNAMEDA

SEQ ID NO: 109520 - protein, 29 aa, Artificial Sequence
  Description of Artificial Sequence: Synthetic peptide
DENEIRTTNPVATEQWGDVSSIEMNAEDA

SEQ ID NO: 109521 - protein, 30 aa, Artificial Sequence
  Description of Artificial Sequence: Synthetic polypeptide
DENEIRTTNPVATEQWGDVSEISMNANEDA

SEQ ID NO: 109522 - protein, 30 aa, Artificial Sequence
  Description of Artificial Sequence: Synthetic polypeptide
DENEIRTTNPVATEQWGDVSEIQMNAAEGP

SEQ ID NO: 109523 - protein, 30 aa, Artificial Sequence
  Description of Artificial Sequence: Synthetic polypeptide
DENEIRTTNPVATEQWGDVSEIETNAADDA

SEQ ID NO: 109524 - protein, 33 aa, Artificial Sequence
  Description of Artificial Sequence: Synthetic polypeptide
DESEIRTTNPVCTECWGSVSCINEPQDREGENG

SEQ ID NO: 109525 - protein, 30 aa, Artificial Sequence
  Description of Artificial Sequence: Synthetic polypeptide
DENEIRTTNPVATEQWGDVSEIEQQQAEDA

SEQ ID NO: 109526 - protein, 30 aa, Artificial Sequence
  Description of Artificial Sequence: Synthetic polypeptide
DENEIRTTNPVATEQWGDVSEIEQNQAEDA

SEQ ID NO: 109527 - protein, 33 aa, Artificial Sequence
  Description of Artificial Sequence: Synthetic polypeptide
SEEEIACTNPVATEQYGCVATNLTGAEGGNERQ

SEQ ID NO: 109528 - protein, 30 aa, Artificial Sequence
  Description of Artificial Sequence: Synthetic polypeptide
DENEIRTTNPVATEQWGDVSEIEQNHAEDA

SEQ ID NO: 109529 - protein, 30 aa, Artificial Sequence
  Description of Artificial Sequence: Synthetic polypeptide
DENEIRTTNPVATEQWGDVSEIEQNAVEDA

SEQ ID NO: 109530 - protein, 28 aa, Artificial Sequence
  Description of Artificial Sequence: Synthetic peptide
SEEEIACTNPVATEQYGEAPENCQHEEK

SEQ ID NO: 109531 - protein, 28 aa, Artificial Sequence
  Description of Artificial Sequence: Synthetic peptide
SEEEIACTNPVATEQYGEAPEVCQHGEK

SEQ ID NO: 109532 - protein, 33 aa, Artificial Sequence
  Description of Artificial Sequence: Synthetic polypeptide
DESEIRTTNPVCTECWGSVSCINWPQDREGENG

SEQ ID NO: 109533 - protein, 33 aa, Artificial Sequence
  Description of Artificial Sequence: Synthetic polypeptide
DESEIRTTNPVCTECWGSVSCINYPQDREGENG

SEQ ID NO: 109534 - protein, 30 aa, Artificial Sequence
  Description of Artificial Sequence: Synthetic polypeptide
DENEIRTTNPVATEQWGDVSEIEQNAAEDK

SEQ ID NO: 109535 - protein, 30 aa, Artificial Sequence
  Description of Artificial Sequence: Synthetic polypeptide
DENEIRTTNPVATEQWGDVSEIEQNAAEDA

SEQ ID NO: 109536 - protein, 36 aa, Artificial Sequence
  Description of Artificial Sequence: Synthetic polypeptide
AEEEIRTTNPVATEQYGSVSTVTNLQLQQANNEEDE

SEQ ID NO: 109537 - protein, 31 aa, Artificial Sequence
  Description of Artificial Sequence: Synthetic polypeptide
SEEEIACTNPVATEQYGSVASIDQAGPEPGR

SEQ ID NO: 109538 - protein, 33 aa, Artificial Sequence
  Description of Artificial Sequence: Synthetic polypeptide
SEEEIACTNPVATEQYGSVATHLQDNPGENAEE

SEQ ID NO: 109539 - protein, 30 aa, Artificial Sequence
  Description of Artificial Sequence: Synthetic polypeptide
DENEIRTTNPVATEQWGDVSEIENNAHEDA

SEQ ID NO: 109540 - protein, 30 aa, Artificial Sequence
  Description of Artificial Sequence: Synthetic polypeptide
DENEIRTTNPVATEQWGDVSEIENNAAIDA

SEQ ID NO: 109541 - protein, 37 aa, Artificial Sequence
  Description of Artificial Sequence: Synthetic polypeptide
AEEEIRTTNPVATEQYGSVSTVTNLQLNSENGNNETD

SEQ ID NO: 109542 - protein, 30 aa, Artificial Sequence
  Description of Artificial Sequence: Synthetic polypeptide
DENEIRTTNPVATEQWGDVSEIENNAAEDA

SEQ ID NO: 109543 - protein, 32 aa, Artificial Sequence
  Description of Artificial Sequence: Synthetic polypeptide
DESEIRTTNPVCTECWGVVSCINEPQDREGNQ

SEQ ID NO: 109544 - protein, 31 aa, Artificial Sequence
  Description of Artificial Sequence: Synthetic polypeptide
DENEIRTTNPVATEQWGDVSEIENMAAENPA

SEQ ID NO: 109545 - protein, 32 aa, Artificial Sequence
  Description of Artificial Sequence: Synthetic polypeptide
SEEEIACTNPVATEQYGSVATNLADASQGDQG

SEQ ID NO: 109546 - protein, 31 aa, Artificial Sequence
  Description of Artificial Sequence: Synthetic polypeptide
DESEIRTTNPVCTECWGVVSCINEPQDSGNQ

SEQ ID NO: 109547 - protein, 30 aa, Artificial Sequence
  Description of Artificial Sequence: Synthetic polypeptide
DENEIRTTNPVATEQWGDVSEIEMSAAGQA

SEQ ID NO: 109548 - protein, 30 aa, Artificial Sequence
  Description of Artificial Sequence: Synthetic polypeptide
DENEIRTTNPVATEQWGDVSEIETNAAEDA

SEQ ID NO: 109549 - protein, 30 aa, Artificial Sequence
  Description of Artificial Sequence: Synthetic polypeptide
AETEIRTTNPVATEQYGEAWAENLAEPGGI

SEQ ID NO: 109550 - protein, 33 aa, Artificial Sequence
  Description of Artificial Sequence: Synthetic polypeptide
SEEEIACTNPVATEQYGCVATNLQPDSGMENDD

SEQ ID NO: 109551 - protein, 30 aa, Artificial Sequence
  Description of Artificial Sequence: Synthetic polypeptide
DENEIRTTNPVATEQWGDVSEIFMNAAEDN

SEQ ID NO: 109552 - protein, 31 aa, Artificial Sequence
  Description of Artificial Sequence: Synthetic polypeptide
DENEIRTTNPVATEQWGDVSEIQMNAAEDNA

SEQ ID NO: 109553 - protein, 32 aa, Artificial Sequence
  Description of Artificial Sequence: Synthetic polypeptide
NNQEIRTTNPVATEQYGVVWVTQNLTDGGPNM

SEQ ID NO: 109554 - protein, 31 aa, Artificial Sequence
  Description of Artificial Sequence: Synthetic polypeptide
AETEIRTTNPVATEQWGETWANEDLQRKGPI

SEQ ID NO: 109555 - protein, 30 aa, Artificial Sequence
  Description of Artificial Sequence: Synthetic polypeptide
DENEIRTTNPVATEQWGDVSEINMNAAEDA

SEQ ID NO: 109556 - protein, 31 aa, Artificial Sequence
  Description of Artificial Sequence: Synthetic polypeptide
DENEIRTTNPVATEQWGDVSEINGMNAGEDA

SEQ ID NO: 109557 - protein, 31 aa, Artificial Sequence
  Description of Artificial Sequence: Synthetic polypeptide
DENEIRTTNPVATEQWGDVSEINEMDAEENG

SEQ ID NO: 109558 - protein, 33 aa, Artificial Sequence
  Description of Artificial Sequence: Synthetic polypeptide
SEEEIACTNPVATEPYGSVSTNLPTGAGMNLSE

SEQ ID NO: 109559 - protein, 32 aa, Artificial Sequence
  Description of Artificial Sequence: Synthetic polypeptide
DESEIRTTNPVAYESWGSVSTTNGPHSGGGNF

SEQ ID NO: 109560 - protein, 33 aa, Artificial Sequence
  Description of Artificial Sequence: Synthetic polypeptide
SEEEIACTNPVATEQYGCVATNGLQAANEGIER

SEQ ID NO: 109561 - protein, 32 aa, Artificial Sequence
  Description of Artificial Sequence: Synthetic polypeptide
SEEEIACTNPVATEQYGCVATNLADAQGENDM

SEQ ID NO: 109562 - protein, 30 aa, Artificial Sequence
  Description of Artificial Sequence: Synthetic polypeptide
DENEIRTTNPVATEQWGDVSEILMNHAEDA

SEQ ID NO: 109563 - protein, 32 aa, Artificial Sequence
  Description of Artificial Sequence: Synthetic polypeptide
NNEEIRTTNPVATEQYGVVWTQDLQDGGPEIM

SEQ ID NO: 109564 - protein, 30 aa, Artificial Sequence
  Description of Artificial Sequence: Synthetic polypeptide
DENEIRTTNPVATEQWGDVSEILMNAEEDA

SEQ ID NO: 109565 - protein, 30 aa, Artificial Sequence
  Description of Artificial Sequence: Synthetic polypeptide
DENEIRTTNPVATEQWGDVSEILMNADEDA

SEQ ID NO: 109566 - protein, 32 aa, Artificial Sequence
  Description of Artificial Sequence: Synthetic polypeptide
NNEEIRTTNPVATEQYGVVWDQNLQDGGPEMI

SEQ ID NO: 109567 - protein, 32 aa, Artificial Sequence
  Description of Artificial Sequence: Synthetic polypeptide
SEEEIACTNPVATEQYGCVATNLQAEDSNEDN

SEQ ID NO: 109568 - protein, 33 aa, Artificial Sequence
  Description of Artificial Sequence: Synthetic polypeptide
SEEEIACTNPVATEQYGCVATNLQAMANENNRW

SEQ ID NO: 109569 - protein, 30 aa, Artificial Sequence
  Description of Artificial Sequence: Synthetic polypeptide
DENEIRTTNPVATEQWGDVSEILMNAAEGA

SEQ ID NO: 109570 - protein, 30 aa, Artificial Sequence
  Description of Artificial Sequence: Synthetic polypeptide
DENEIRTTNPVATEQWGDVSEILMNAAEDA

SEQ ID NO: 109571 - protein, 30 aa, Artificial Sequence
  Description of Artificial Sequence: Synthetic polypeptide
DENEIRTTNPVATEQWGDVSEILENAAEDA

SEQ ID NO: 109572 - protein, 30 aa, Artificial Sequence
  Description of Artificial Sequence: Synthetic polypeptide
DENEIRTTNPVATEQWGDVSEIIMNAAENA

SEQ ID NO: 109573 - protein, 33 aa, Artificial Sequence
  Description of Artificial Sequence: Synthetic polypeptide
SEEEIACTNPVATEQYGCVATNLQDNPGENAEN

SEQ ID NO: 109574 - protein, 32 aa, Artificial Sequence
  Description of Artificial Sequence: Synthetic polypeptide
SEEEIACTNPVATEQYGCVATNLQEAGHTPEQ

SEQ ID NO: 109575 - protein, 30 aa, Artificial Sequence
  Description of Artificial Sequence: Synthetic polypeptide
DENEIRTTNPVATEQWGDVSEIGMNANEDA

SEQ ID NO: 109576 - protein, 30 aa, Artificial Sequence
  Description of Artificial Sequence: Synthetic polypeptide
DENEIRTTNPVATEQWGDVSEIGMNAAENA

SEQ ID NO: 109577 - protein, 30 aa, Artificial Sequence
  Description of Artificial Sequence: Synthetic polypeptide
AETEIRCTNPVATEQYGEAWAENLQEPGGI

SEQ ID NO: 109578 - protein, 36 aa, Artificial Sequence
  Description of Artificial Sequence: Synthetic polypeptide
AEEEIRTTNPVATEQYGSVSTVTNNLEQGENDTTEE

SEQ ID NO: 109579 - protein, 31 aa, Artificial Sequence
  Description of Artificial Sequence: Synthetic polypeptide
DENEIRTTNPVATEQWGDVSTDEMNAAEEDA

SEQ ID NO: 109580 - protein, 36 aa, Artificial Sequence
  Description of Artificial Sequence: Synthetic polypeptide
AEEEIRTTNPVATEQYGSVSTVTNNLEQGENGTTEE

SEQ ID NO: 109581 - protein, 31 aa, Artificial Sequence
  Description of Artificial Sequence: Synthetic polypeptide
SEECIRTTNPMAWEQYGQVCTINVNQGGINV

SEQ ID NO: 109582 - protein, 33 aa, Artificial Sequence
  Description of Artificial Sequence: Synthetic polypeptide
DESEIRTTNPVAYEQWGSTVPTDNDGDQRQSQR

SEQ ID NO: 109583 - protein, 31 aa, Artificial Sequence
  Description of Artificial Sequence: Synthetic polypeptide
SEECIRTTNPVAWEMYGQVMTINVNQGGNNV

SEQ ID NO: 109584 - protein, 32 aa, Artificial Sequence
  Description of Artificial Sequence: Synthetic polypeptide
SEECIRTTNPVAWEQYGQVCGTINVNQGGNIV

SEQ ID NO: 109585 - protein, 31 aa, Artificial Sequence
  Description of Artificial Sequence: Synthetic polypeptide
NTEAEIATTNPVAYEQWGSVSTNLNHEGGET

SEQ ID NO: 109586 - protein, 32 aa, Artificial Sequence
  Description of Artificial Sequence: Synthetic polypeptide
SEECISTTNPVATEQYGCVCSNWNPQNGSNQS

SEQ ID NO: 109587 - protein, 31 aa, Artificial Sequence
  Description of Artificial Sequence: Synthetic polypeptide
NTEAEIATTNPVAYEQWGSVSTNLNGDTGET

SEQ ID NO: 109588 - protein, 31 aa, Artificial Sequence
  Description of Artificial Sequence: Synthetic polypeptide
NTEAEIATTNPVAYEQWGSVSTNLNDGGETG

SEQ ID NO: 109589 - protein, 31 aa, Artificial Sequence
  Description of Artificial Sequence: Synthetic polypeptide
SEECISTTNPVATEQYGCVCSWGEPQNGSNQ

SEQ ID NO: 109590 - protein, 30 aa, Artificial Sequence
  Description of Artificial Sequence: Synthetic polypeptide
DENEIRTTNPVATEQWGRVSLIENNAAEDA

SEQ ID NO: 109591 - protein, 30 aa, Artificial Sequence
  Description of Artificial Sequence: Synthetic polypeptide
DENEIRTTNPVATEQWGQVSEIELNAAEDA

SEQ ID NO: 109592 - protein, 33 aa, Artificial Sequence
  Description of Artificial Sequence: Synthetic polypeptide
DENEIRTTNPVATEQWGNVSTNLIGSTNNAEDA

SEQ ID NO: 109593 - protein, 31 aa, Artificial Sequence
  Description of Artificial Sequence: Synthetic polypeptide
DENEIRTTNPVATEQWGNVSTEISTNAEEGA

SEQ ID NO: 109594 - protein, 30 aa, Artificial Sequence
  Description of Artificial Sequence: Synthetic polypeptide
DENEIRTTNPVATEQWGNVSETEMNAVEDA

SEQ ID NO: 109595 - protein, 30 aa, Artificial Sequence
  Description of Artificial Sequence: Synthetic polypeptide
DENEIRTTNPVATEQWGNVSETEMNAAEDA

SEQ ID NO: 109596 - protein, 30 aa, Artificial Sequence
  Description of Artificial Sequence: Synthetic polypeptide
DENEIRTTNPVATEQWGNVSEIIQNAAEDA

SEQ ID NO: 109597 - protein, 30 aa, Artificial Sequence
  Description of Artificial Sequence: Synthetic polypeptide
DENEIRTTNPVATEQWGNVSEIETNNAEDE

SEQ ID NO: 109598 - protein, 30 aa, Artificial Sequence
  Description of Artificial Sequence: Synthetic polypeptide
DENEIRTTNPVATEQWGNVSEIEQNAAEDA

SEQ ID NO: 109599 - protein, 30 aa, Artificial Sequence
  Description of Artificial Sequence: Synthetic polypeptide
DENEIRTTNPVATEQWGNVSEIEMSAAEDR

SEQ ID NO: 109600 - protein, 32 aa, Artificial Sequence
  Description of Artificial Sequence: Synthetic polypeptide
NSNEIRTTNPVATEQYGVVWTQNLQDGGPEPM

SEQ ID NO: 109601 - protein, 36 aa, Artificial Sequence
  Description of Artificial Sequence: Synthetic polypeptide
AEEEIRTTNPVATEQYGSVSTVTNNNQNDNGNNNVE

SEQ ID NO: 109602 - protein, 30 aa, Artificial Sequence
  Description of Artificial Sequence: Synthetic polypeptide
DENEIRTTNPVATEQWGLVSEIEMNQAEDA

SEQ ID NO: 109603 - protein, 30 aa, Artificial Sequence
  Description of Artificial Sequence: Synthetic polypeptide
DENEIRTTNPVATEQWGLVSEIEMNAAEDR

SEQ ID NO: 109604 - protein, 31 aa, Artificial Sequence
  Description of Artificial Sequence: Synthetic polypeptide
DENEIRTTNPVATEQWGKVSEIEMNAAEGSA

SEQ ID NO: 109605 - protein, 31 aa, Artificial Sequence
  Description of Artificial Sequence: Synthetic polypeptide
SEEDIRCTNPIAYEQYGSVMSENLMEGQNDE

SEQ ID NO: 109606 - protein, 35 aa, Artificial Sequence
  Description of Artificial Sequence: Synthetic polypeptide
AEEEIRTTNPVATEQYGSVSTVTNNNQNNDEANED

SEQ ID NO: 109607 - protein, 30 aa, Artificial Sequence
  Description of Artificial Sequence: Synthetic polypeptide
DENEIRTTNPVATEQWGIVSEIEMNAAGDA

SEQ ID NO: 109608 - protein, 32 aa, Artificial Sequence
  Description of Artificial Sequence: Synthetic polypeptide
NTEEEIATTNPVAYEQWGSVSTNLNMGEGGET

SEQ ID NO: 109609 - protein, 32 aa, Artificial Sequence
  Description of Artificial Sequence: Synthetic polypeptide
DESEIRTTNPVAYEQWGSTCPTENEDQRQGQQ

SEQ ID NO: 109610 - protein, 33 aa, Artificial Sequence
  Description of Artificial Sequence: Synthetic polypeptide
PESEIRTTNPVATECWGSVSCINEPQDREGENG

SEQ ID NO: 109611 - protein, 34 aa, Artificial Sequence
  Description of Artificial Sequence: Synthetic polypeptide
AEEEIRTTNPVATEQYGSVVVSVTNTNNQEQETD

SEQ ID NO: 109612 - protein, 31 aa, Artificial Sequence
  Description of Artificial Sequence: Synthetic polypeptide
DENEIRTTNPVATEQWGSVSEIIEMNAAENA

SEQ ID NO: 109613 - protein, 31 aa, Artificial Sequence
  Description of Artificial Sequence: Synthetic polypeptide
SEECIACTNPTAYEQYGSVSENNLMRGNESD

SEQ ID NO: 109614 - protein, 31 aa, Artificial Sequence
  Description of Artificial Sequence: Synthetic polypeptide
DENEIRTTNPVATEQWGSVSEIGMNAAGDPA

SEQ ID NO: 109615 - protein, 32 aa, Artificial Sequence
  Description of Artificial Sequence: Synthetic polypeptide
PEEEIRTTNPNATENYGEVSVINLIGMGNMPN

SEQ ID NO: 109616 - protein, 31 aa, Artificial Sequence
  Description of Artificial Sequence: Synthetic polypeptide
NTEHEIATTNPVAYEQWGSVSTNLNGNEGET

SEQ ID NO: 109617 - protein, 31 aa, Artificial Sequence
  Description of Artificial Sequence: Synthetic polypeptide
DENEIRTTNPVATEQWGSVSEIGMMAAGDPA

SEQ ID NO: 109618 - protein, 31 aa, Artificial Sequence
  Description of Artificial Sequence: Synthetic polypeptide
DENEIRTTNPVATEQWGSVSEIEPMNREEDG

SEQ ID NO: 109619 - protein, 31 aa, Artificial Sequence
  Description of Artificial Sequence: Synthetic polypeptide
NTEHEIATTNPVAYEQWGSVSTNLNGGGETH

SEQ ID NO: 109620 - protein, 32 aa, Artificial Sequence
  Description of Artificial Sequence: Synthetic polypeptide
DENEIRTTNPVATEQWGSVSEIEPMDREEENG

SEQ ID NO: 109621 - protein, 31 aa, Artificial Sequence
  Description of Artificial Sequence: Synthetic polypeptide
NTEHEIATTNPVAYEQWGSVSTNLNGGGEDY

SEQ ID NO: 109622 - protein, 34 aa, Artificial Sequence
  Description of Artificial Sequence: Synthetic polypeptide
DESEIRTTNPVAYEPYRGQSVSQNELSQGPGISR

SEQ ID NO: 109623 - protein, 32 aa, Artificial Sequence
  Description of Artificial Sequence: Synthetic polypeptide
DESEIRTTNPVAYEQWGEVSTNLNGEDINGQE

SEQ ID NO: 109624 - protein, 31 aa, Artificial Sequence
  Description of Artificial Sequence: Synthetic polypeptide
NTEHEIATTNPVAYEQWGSVSTNLNDGGMTQ

SEQ ID NO: 109625 - protein, 30 aa, Artificial Sequence
  Description of Artificial Sequence: Synthetic polypeptide
DESEIRTTNPVAYEQWGMTSKNPEDRTNEH

SEQ ID NO: 109626 - protein, 32 aa, Artificial Sequence
  Description of Artificial Sequence: Synthetic polypeptide
NTEHEIATTNPVAYEQWGSVSTNLNDGGGETR

SEQ ID NO: 109627 - protein, 31 aa, Artificial Sequence
  Description of Artificial Sequence: Synthetic polypeptide
DENEIRTTNPVATEQWGSVSEIEMNAAGDPA

SEQ ID NO: 109628 - protein, 30 aa, Artificial Sequence
  Description of Artificial Sequence: Synthetic polypeptide
SEECIACTNPTAYPEQYGSVASNLNRGNED

SEQ ID NO: 109629 - protein, 32 aa, Artificial Sequence
  Description of Artificial Sequence: Synthetic polypeptide
DESEIRTTNPVAYEQWGSTCPTDNGEQNQGQR

SEQ ID NO: 109630 - protein, 33 aa, Artificial Sequence
  Description of Artificial Sequence: Synthetic polypeptide
DESEIRTTNPVAYEQWGSTCPTDNQGDQRQGQR

SEQ ID NO: 109631 - protein, 31 aa, Artificial Sequence
  Description of Artificial Sequence: Synthetic polypeptide
DENEIRTTNPVATEQWGSVSEIEMNAAEEDA

SEQ ID NO: 109632 - protein, 30 aa, Artificial Sequence
  Description of Artificial Sequence: Synthetic polypeptide
DENEIRTTNPVATEQWGSVSEIEMNAAEDA

SEQ ID NO: 109633 - protein, 31 aa, Artificial Sequence
  Description of Artificial Sequence: Synthetic polypeptide
DENEIRTTNPVATEQWGSVSEIEMMAAEMNA

SEQ ID NO: 109634 - protein, 31 aa, Artificial Sequence
  Description of Artificial Sequence: Synthetic polypeptide
DENEIRTTNPVATEQWGSVSEIEENAEEDDA

SEQ ID NO: 109635 - protein, 36 aa, Artificial Sequence
  Description of Artificial Sequence: Synthetic polypeptide
AEEEIRTTNPVATEQYGSVSTVTNNNQNQDEAGNED

SEQ ID NO: 109636 - protein, 35 aa, Artificial Sequence
  Description of Artificial Sequence: Synthetic polypeptide
DENEIRTTNPVATEQWGHSNVSYTNELQHGPESFE

SEQ ID NO: 109637 - protein, 30 aa, Artificial Sequence
  Description of Artificial Sequence: Synthetic polypeptide
SEEEIAATNPVAWYQYGSVCSTDQLMTVNI

SEQ ID NO: 109638 - protein, 36 aa, Artificial Sequence
  Description of Artificial Sequence: Synthetic polypeptide
AEEEIRTTNPVATEQYGSVSTVTNNNNQQIGNNTET

SEQ ID NO: 109639 - protein, 35 aa, Artificial Sequence
  Description of Artificial Sequence: Synthetic polypeptide
AEEEIRTTNPVATEQYGSVVVSVTTNNQQEDENND

SEQ ID NO: 109640 - protein, 30 aa, Artificial Sequence
  Description of Artificial Sequence: Synthetic polypeptide
DENEIRTTNPVATEQWGDVSTLEMNAAEDA

SEQ ID NO: 109641 - protein, 30 aa, Artificial Sequence
  Description of Artificial Sequence: Synthetic polypeptide
DENEIRTTNPVATEQWGDVSTIPMNFAEDA

SEQ ID NO: 109642 - protein, 30 aa, Artificial Sequence
  Description of Artificial Sequence: Synthetic polypeptide
DENEIRTTNPVATEQWGDVSTIPMNAEEDA

SEQ ID NO: 109643 - protein, 35 aa, Artificial Sequence
  Description of Artificial Sequence: Synthetic polypeptide
AEEEIRTTNPVATEQYGSVVVSVTTNNQQQNETTD

SEQ ID NO: 109644 - protein, 37 aa, Artificial Sequence
  Description of Artificial Sequence: Synthetic polypeptide
AEEEIRTTNPVATEQYGSVSTVTNNLQNNQENGNQQG

SEQ ID NO: 109645 - protein, 31 aa, Artificial Sequence
  Description of Artificial Sequence: Synthetic polypeptide
DENEIRTTNPVATEQWGDVSTIGMNANEDPV

SEQ ID NO: 109646 - protein, 37 aa, Artificial Sequence
  Description of Artificial Sequence: Synthetic polypeptide
AEEEIRTTNPVATEQYGSVSTVTNNLQLGNNLVETED

SEQ ID NO: 109647 - protein, 37 aa, Artificial Sequence
  Description of Artificial Sequence: Synthetic polypeptide
AEEEIRTTNPVATEQYGSVSTVTNNLQLGNNLVENAT

SEQ ID NO: 109648 - protein, 36 aa, Artificial Sequence
  Description of Artificial Sequence: Synthetic polypeptide
AEEEIRTTNPVATEQYGSVSTVTNNLNSNNGNNATE

SEQ ID NO: 109649 - protein, 37 aa, Artificial Sequence
  Description of Artificial Sequence: Synthetic polypeptide
AEEEIRTTNPVATEQYGSVSTVTNNLNQQQIGNNNDE

SEQ ID NO: 109650 - protein, 30 aa, Artificial Sequence
  Description of Artificial Sequence: Synthetic polypeptide
DENEIRTTNPVATEQWGDVSTIEMNHEEEA

SEQ ID NO: 109651 - protein, 30 aa, Artificial Sequence
  Description of Artificial Sequence: Synthetic polypeptide
DENEIRTTNPVATEQWGDVSTIEMNHEEDA

SEQ ID NO: 109652 - protein, 31 aa, Artificial Sequence
  Description of Artificial Sequence: Synthetic polypeptide
DENEIRTTNPVATEQWGDVSTIEMNAEEEDA

SEQ ID NO: 109653 - protein, 30 aa, Artificial Sequence
  Description of Artificial Sequence: Synthetic polypeptide
DENEIRTTNPVATEQWGDVSTIEMNAEEDA

SEQ ID NO: 109654 - protein, 30 aa, Artificial Sequence
  Description of Artificial Sequence: Synthetic polypeptide
DENEIRTTNPVATEQWGDVSTIEMNAAESA

SEQ ID NO: 109655 - protein, 31 aa, Artificial Sequence
  Description of Artificial Sequence: Synthetic polypeptide
DENEIRTTNPVATEQWGDVSTIEMNAAEEDA

SEQ ID NO: 109656 - protein, 30 aa, Artificial Sequence
  Description of Artificial Sequence: Synthetic polypeptide
DENEIRTTNPVATEQWGDVSTIEMNAAEDA

SEQ ID NO: 109657 - protein, 30 aa, Artificial Sequence
  Description of Artificial Sequence: Synthetic polypeptide
DENEIRTTNPVATEQWGDVSTIEMMAAEDA

SEQ ID NO: 109658 - protein, 30 aa, Artificial Sequence
  Description of Artificial Sequence: Synthetic polypeptide
DENEIRTTNPVATEQWGDVSTGPENFAEDA

SEQ ID NO: 109659 - protein, 31 aa, Artificial Sequence
  Description of Artificial Sequence: Synthetic polypeptide
DENEIRTTNPVATEQWGDVSTEIQMNAAEDS

SEQ ID NO: 109660 - protein, 31 aa, Artificial Sequence
  Description of Artificial Sequence: Synthetic polypeptide
DENEIRTTNPVATEQWGDVSTEAEMNAAGDA

SEQ ID NO: 109661 - protein, 37 aa, Artificial Sequence
  Description of Artificial Sequence: Synthetic polypeptide
AEEEIRTTNPVATEQYGSVSTVTNNLLQGNQENGNQD

SEQ ID NO: 109662 - protein, 36 aa, Artificial Sequence
  Description of Artificial Sequence: Synthetic polypeptide
AEEEIRTTNPVATEQYGSVSTVTNNLGNQIGTEQGQ

SEQ ID NO: 109663 - protein, 36 aa, Artificial Sequence
  Description of Artificial Sequence: Synthetic polypeptide
AEEEIRTTNPVATEQYGSVSTVTNNLEQGNNGTGEE

SEQ ID NO: 109664 - protein, 30 aa, Artificial Sequence
  Description of Artificial Sequence: Synthetic polypeptide
DENEIRTTNPVATEQWGDVSVIEMNAAERA

SEQ ID NO: 109665 - protein, 30 aa, Artificial Sequence
  Description of Artificial Sequence: Synthetic polypeptide
DENEIRTTNPVATEQWGDVSWEETNAFMDA

SEQ ID NO: 109666 - protein, 36 aa, Artificial Sequence
  Description of Artificial Sequence: Synthetic polypeptide
AEEEIRTTNPVATEQYGSVSTVTNNNLEAGTEENTD

SEQ ID NO: 109667 - protein, 30 aa, Artificial Sequence
  Description of Artificial Sequence: Synthetic polypeptide
DENEIRTTNPVATEQWGDVSWIEMRAMEGA

SEQ ID NO: 109668 - protein, 30 aa, Artificial Sequence
  Description of Artificial Sequence: Synthetic polypeptide
DENEIRTTNPVATEQWGEVSENEMNAAEGA

SEQ ID NO: 109669 - protein, 30 aa, Artificial Sequence
  Description of Artificial Sequence: Synthetic polypeptide
DENEIRTTNPVATEQWGEVSENEMNAAEDA

SEQ ID NO: 109670 - protein, 36 aa, Artificial Sequence
  Description of Artificial Sequence: Synthetic polypeptide
AEEEIRTTNPVATEQYGSVSTVTNNNNQEQNGTNVE

SEQ ID NO: 109671 - protein, 36 aa, Artificial Sequence
  Description of Artificial Sequence: Synthetic polypeptide
AEEEIRTTNPVATEQYGSVSTVTNNNNNQDEGNNVE

SEQ ID NO: 109672 - protein, 35 aa, Artificial Sequence
  Description of Artificial Sequence: Synthetic polypeptide
AEEEIRTTNPVATEQYGSVSTVTNNNNNAQGNNNQ

SEQ ID NO: 109673 - protein, 34 aa, Artificial Sequence
  Description of Artificial Sequence: Synthetic polypeptide
AEEEIRTTNPVATEQYGSVVVSVTTNNQEQAETD

SEQ ID NO: 109674 - protein, 30 aa, Artificial Sequence
  Description of Artificial Sequence: Synthetic polypeptide
DENEIRTTNPVATEQWGEVSEIEMNRAEGA

SEQ ID NO: 109675 - protein, 37 aa, Artificial Sequence
  Description of Artificial Sequence: Synthetic polypeptide
AEEEIRTTNPVATEQYGSVSTVTNNNLQQNQENGNEQ

SEQ ID NO: 109676 - protein, 37 aa, Artificial Sequence
  Description of Artificial Sequence: Synthetic polypeptide
AEEEIRTTNPVATEQYGSVSTVTNNNLQNTEQGTNVD

SEQ ID NO: 109677 - protein, 35 aa, Artificial Sequence
  Description of Artificial Sequence: Synthetic polypeptide
AEEEIRTTNPVATEQYGSVVVSVTTNNQEQDENND

SEQ ID NO: 109678 - protein, 37 aa, Artificial Sequence
  Description of Artificial Sequence: Synthetic polypeptide
AEEEIRTTNPVATEQYGSVSTVTNNNLQLGNNNVEAN

SEQ ID NO: 109679 - protein, 37 aa, Artificial Sequence
  Description of Artificial Sequence: Synthetic polypeptide
AEEEIRTTNPVATEQYGSVSTVTNNNLQLGNNLVETA

SEQ ID NO: 109680 - protein, 30 aa, Artificial Sequence
  Description of Artificial Sequence: Synthetic polypeptide
DENEIRTTNPVATEQWGDVSEIEMSAAGDA

SEQ ID NO: 109681 - protein, 37 aa, Artificial Sequence
  Description of Artificial Sequence: Synthetic polypeptide
AEEEIRTTNPVATEQYGSVSTVTNNNLQLGNNLDEAQ

SEQ ID NO: 109682 - protein, 29 aa, Artificial Sequence
  Description of Artificial Sequence: Synthetic peptide
DENEIRTTNPVATEQWGEVPEIEQHAEEK

SEQ ID NO: 109683 - protein, 29 aa, Artificial Sequence
  Description of Artificial Sequence: Synthetic peptide
DENEIRTTNPVATEQWGEVPEIEQHAEDK

SEQ ID NO: 109684 - protein, 28 aa, Artificial Sequence
  Description of Artificial Sequence: Synthetic peptide
DENEIRTTNPVATEQWGEVPEIEMHEDK

SEQ ID NO: 109685 - protein, 37 aa, Artificial Sequence
  Description of Artificial Sequence: Synthetic polypeptide
AEEEIRTTNPVATEQYGSVSTVTNNNLQGNEQAGNGD

SEQ ID NO: 109686 - protein, 28 aa, Artificial Sequence
  Description of Artificial Sequence: Synthetic peptide
DENEIRTTNPVATEQWGEVPEIEMHEDA

SEQ ID NO: 109687 - protein, 28 aa, Artificial Sequence
  Description of Artificial Sequence: Synthetic peptide
DENEIRTTNPVATEQWGEVPEICMHEDK

SEQ ID NO: 109688 - protein, 33 aa, Artificial Sequence
  Description of Artificial Sequence: Synthetic polypeptide
DESEIRTTNPVAYEQWGVVSTNLNQGDTPNGGA

SEQ ID NO: 109689 - protein, 36 aa, Artificial Sequence
  Description of Artificial Sequence: Synthetic polypeptide
NSEEIRTTNPVATEQYGQSVPSCTPNEGQHPGGNYR

SEQ ID NO: 109690 - protein, 30 aa, Artificial Sequence
  Description of Artificial Sequence: Synthetic polypeptide
DENEIRTTNPVATEQWGDVSYTEMNAAEDA

SEQ ID NO: 109691 - protein, 30 aa, Artificial Sequence
  Description of Artificial Sequence: Synthetic polypeptide
DENEIRTTNPVATEQWGDVSWIEMRNTEDA

SEQ ID NO: 109692 - protein, 36 aa, Artificial Sequence
  Description of Artificial Sequence: Synthetic polypeptide
AEEEIRTTNPVATEQYGSVSTVTNNNLGEQGENETD

SEQ ID NO: 109693 - protein, 36 aa, Artificial Sequence
  Description of Artificial Sequence: Synthetic polypeptide
AEEEIRTTNPVATEQYGSVSTVTNNNLEQSTENETD

SEQ ID NO: 109694 - protein, 32 aa, Artificial Sequence
  Description of Artificial Sequence: Synthetic polypeptide
DESEIRTTNPVAYEQWGTVISCHNAFQGENNR

SEQ ID NO: 109695 - protein, 30 aa, Artificial Sequence
  Description of Artificial Sequence: Synthetic polypeptide
SEECIACTNPTAYEQYGSVASNLNRGNETA

SEQ ID NO: 109696 - protein, 30 aa, Artificial Sequence
  Description of Artificial Sequence: Synthetic polypeptide
DENEIRTTNPVATEQWGDVSEIEMSAAEDR

SEQ ID NO: 109697 - protein, 31 aa, Artificial Sequence
  Description of Artificial Sequence: Synthetic polypeptide
DENEIRTTNPVATEQWGDVSEIEMRAAEGDA

SEQ ID NO: 109698 - protein, 30 aa, Artificial Sequence
  Description of Artificial Sequence: Synthetic polypeptide
DENEIRTTNPVATEQWGDVSCNEMNSAETA

SEQ ID NO: 109699 - protein, 30 aa, Artificial Sequence
  Description of Artificial Sequence: Synthetic polypeptide
DENEIRTTNPVATEQWGDVSCNEMNSAEDA

SEQ ID NO: 109700 - protein, 37 aa, Artificial Sequence
  Description of Artificial Sequence: Synthetic polypeptide
AEEEIRTTNPVATEQYGSVSTVTGNLQQGTNGTENDD

SEQ ID NO: 109701 - protein, 37 aa, Artificial Sequence
  Description of Artificial Sequence: Synthetic polypeptide
AEEEIRTTNPVATEQYGSVSTVTGGNLQQQIGTNSAE

SEQ ID NO: 109702 - protein, 30 aa, Artificial Sequence
  Description of Artificial Sequence: Synthetic polypeptide
DENEIRTTNPVATEQWGDVSCNEMNAAEDA

SEQ ID NO: 109703 - protein, 33 aa, Artificial Sequence
  Description of Artificial Sequence: Synthetic polypeptide
DESEIRTTNPVQTECWGSVSCINEPLDRVGENG

SEQ ID NO: 109704 - protein, 31 aa, Artificial Sequence
  Description of Artificial Sequence: Synthetic polypeptide
DENEIRTTNPVATEQWGDVSCINEMDAEENG

SEQ ID NO: 109705 - protein, 36 aa, Artificial Sequence
  Description of Artificial Sequence: Synthetic polypeptide
AEEEIRTTNPVATEQYGSVSTVTENNQNGDEAGNVD

SEQ ID NO: 109706 - protein, 33 aa, Artificial Sequence
  Description of Artificial Sequence: Synthetic polypeptide
DESEIRTTNPVQTECWGSVSCINEPQDREGENG

SEQ ID NO: 109707 - protein, 33 aa, Artificial Sequence
  Description of Artificial Sequence: Synthetic polypeptide
DESEIRTTNPVQTECWGSVSCINEPQDRQGENG

SEQ ID NO: 109708 - protein, 32 aa, Artificial Sequence
  Description of Artificial Sequence: Synthetic polypeptide
DESEIRTTNPVSSECWGSVSCINEPQDREGTR

SEQ ID NO: 109709 - protein, 30 aa, Artificial Sequence
  Description of Artificial Sequence: Synthetic polypeptide
DENEIRTTNPVATEQWGDVSCIEMNRAEDG

SEQ ID NO: 109710 - protein, 30 aa, Artificial Sequence
  Description of Artificial Sequence: Synthetic polypeptide
DENEIRTTNPVATEQWGDVSCIEMNRAEDA

SEQ ID NO: 109711 - protein, 30 aa, Artificial Sequence
  Description of Artificial Sequence: Synthetic polypeptide
DENEIRTTNPVATEQWGDVSCIEMNAAGDA

SEQ ID NO: 109712 - protein, 31 aa, Artificial Sequence
  Description of Artificial Sequence: Synthetic polypeptide
DENEIRTTNPVATEQWGDVSATIPMNAEENA

SEQ ID NO: 109713 - protein, 31 aa, Artificial Sequence
  Description of Artificial Sequence: Synthetic polypeptide
DESEIRTTNPVSTECWGNVSCITIQSREGNG

SEQ ID NO: 109714 - protein, 29 aa, Artificial Sequence
  Description of Artificial Sequence: Synthetic peptide
SEEEIASVNPVCTEQYGCVCSWEDQSGNQ

SEQ ID NO: 109715 - protein, 31 aa, Artificial Sequence
  Description of Artificial Sequence: Synthetic polypeptide
DENEIRTTNPVATEQWGDVSATDLEDAAEDA

SEQ ID NO: 109716 - protein, 33 aa, Artificial Sequence
  Description of Artificial Sequence: Synthetic polypeptide
DESEIRTTNPVSTECWGSVSCINEPQDREGENG

SEQ ID NO: 109717 - protein, 30 aa, Artificial Sequence
  Description of Artificial Sequence: Synthetic polypeptide
SEEEIASVNPVCTEQYGVVCSWEELQSGNQ

SEQ ID NO: 109718 - protein, 30 aa, Artificial Sequence
  Description of Artificial Sequence: Synthetic polypeptide
DENEIRTTNPVATEQWGDVSAIWMNAKGPA

SEQ ID NO: 109719 - protein, 30 aa, Artificial Sequence
  Description of Artificial Sequence: Synthetic polypeptide
DENEIRTTNPVATEQWGDVSAIEMNQAEDA

SEQ ID NO: 109720 - protein, 30 aa, Artificial Sequence
  Description of Artificial Sequence: Synthetic polypeptide
SEEEIASVNPVCTEQYGVVSDNHQSIGSNQ

SEQ ID NO: 109721 - protein, 37 aa, Artificial Sequence
  Description of Artificial Sequence: Synthetic polypeptide
AEEEIRTTNPVATEQYGSVSTVTANLQAGTEAGNEEG

SEQ ID NO: 109722 - protein, 30 aa, Artificial Sequence
  Description of Artificial Sequence: Synthetic polypeptide
SEEEIASVNPVCTEQYGVVSSNDQSGSNTQ

SEQ ID NO: 109723 - protein, 37 aa, Artificial Sequence
  Description of Artificial Sequence: Synthetic polypeptide
AEEEIRTTNPVATEQYGSVSTVTGNLQQQIGTNSEEE

SEQ ID NO: 109724 - protein, 29 aa, Artificial Sequence
  Description of Artificial Sequence: Synthetic peptide
SEEEIASVNPVCTEQYGVVSSNHQSFGQQ

SEQ ID NO: 109725 - protein, 30 aa, Artificial Sequence
  Description of Artificial Sequence: Synthetic polypeptide
SEEEIACVNPVCTEQYGVVSSNDQSFGSNQ

SEQ ID NO: 109726 - protein, 36 aa, Artificial Sequence
  Description of Artificial Sequence: Synthetic polypeptide
AEEEIRTTNPVATEQYGSVSTVTGTNNQQQGNNQSE

SEQ ID NO: 109727 - protein, 33 aa, Artificial Sequence
  Description of Artificial Sequence: Synthetic polypeptide
SEEEIACTNPVATEQYGSVATNPQNGAGMENVD

SEQ ID NO: 109728 - protein, 36 aa, Artificial Sequence
  Description of Artificial Sequence: Synthetic polypeptide
AEEEIRTTNPVATEQYGSVSTVTNGNDTNLQGNNTD

SEQ ID NO: 109729 - protein, 33 aa, Artificial Sequence
  Description of Artificial Sequence: Synthetic polypeptide
SEEEIACTNPVATEQYGSVATVNHQAEDPGENT

SEQ ID NO: 109730 - protein, 33 aa, Artificial Sequence
  Description of Artificial Sequence: Synthetic polypeptide
SEEEIACTNPVATEQYGSVCATNLQPDNQTEGA

SEQ ID NO: 109731 - protein, 36 aa, Artificial Sequence
  Description of Artificial Sequence: Synthetic polypeptide
AEEEIRTTNPVATEQYGSVSTVTNGEQQGNEGGNTE

SEQ ID NO: 109732 - protein, 30 aa, Artificial Sequence
  Description of Artificial Sequence: Synthetic polypeptide
DENEIRTTNPVATEQWGDVSEDEMNAAGDA

SEQ ID NO: 109733 - protein, 36 aa, Artificial Sequence
  Description of Artificial Sequence: Synthetic polypeptide
AEEEIRTTNPVATEQYGSVSTVTNGEQGNEGGNGTT

SEQ ID NO: 109734 - protein, 36 aa, Artificial Sequence
  Description of Artificial Sequence: Synthetic polypeptide
AEEEIRTTNPVATEQYGSVSTVTNENLLQIGTEQGE

SEQ ID NO: 109735 - protein, 35 aa, Artificial Sequence
  Description of Artificial Sequence: Synthetic polypeptide
AEEEIRTTNPVATEQYGSVSTVTNDNQQQNTEENT

SEQ ID NO: 109736 - protein, 30 aa, Artificial Sequence
  Description of Artificial Sequence: Synthetic polypeptide
DENEIRTTNPVATEQWGDVSEDEENHAGDA

SEQ ID NO: 109737 - protein, 30 aa, Artificial Sequence
  Description of Artificial Sequence: Synthetic polypeptide
DENEIRTTNPVATEQWGDVSECEMNASNDA

SEQ ID NO: 109738 - protein, 35 aa, Artificial Sequence
  Description of Artificial Sequence: Synthetic polypeptide
AEEEIRTTNPVATEQYGSVSTVTNDNQQNEEENDT

SEQ ID NO: 109739 - protein, 33 aa, Artificial Sequence
  Description of Artificial Sequence: Synthetic polypeptide
DESEIRTTNPVNTECWGSVSCINEPQDREGENG

SEQ ID NO: 109740 - protein, 30 aa, Artificial Sequence
  Description of Artificial Sequence: Synthetic polypeptide
DENEIRTTNPVATEQWGDVSEAEMNANEDA

SEQ ID NO: 109741 - protein, 35 aa, Artificial Sequence
  Description of Artificial Sequence: Synthetic polypeptide
AEEEIRTTNPVATEQYGSVSTVTNDEGEIGNNSTN

SEQ ID NO: 109742 - protein, 35 aa, Artificial Sequence
  Description of Artificial Sequence: Synthetic polypeptide
AEEEIRTTNPVATEQYGSVSTVTNDEEEIGTNSTE

SEQ ID NO: 109743 - protein, 31 aa, Artificial Sequence
  Description of Artificial Sequence: Synthetic polypeptide
SEEEIACTNPVATESYGCVAGTNLAPGGDQR

SEQ ID NO: 109744 - protein, 32 aa, Artificial Sequence
  Description of Artificial Sequence: Synthetic polypeptide
SEEEIACTNPVATESYGCVATNLQEAPGNDPA

SEQ ID NO: 109745 - protein, 36 aa, Artificial Sequence
  Description of Artificial Sequence: Synthetic polypeptide
AEEEIRTTNPVATEQYGSVSTVTLQLNDNEEIGTND

SEQ ID NO: 109746 - protein, 32 aa, Artificial Sequence
  Description of Artificial Sequence: Synthetic polypeptide
SEEEIACTNPVATESYGSVATNLQDAPGDQDE

SEQ ID NO: 109747 - protein, 32 aa, Artificial Sequence
  Description of Artificial Sequence: Synthetic polypeptide
SEEEIACTNPVAYEQWGCVATNLQDADGNARE

SEQ ID NO: 109748 - protein, 37 aa, Artificial Sequence
  Description of Artificial Sequence: Synthetic polypeptide
AEEEIRTTNPVATEQYGSVSTVTLGNLQQNIGTNSEV

SEQ ID NO: 109749 - protein, 32 aa, Artificial Sequence
  Description of Artificial Sequence: Synthetic polypeptide
SEEEIACTNPVAYEQYGSVATNLQGAPAEGKF

SEQ ID NO: 109750 - protein, 31 aa, Artificial Sequence
  Description of Artificial Sequence: Synthetic polypeptide
DENEIRTTNPVATEQWGDVSCNEPMNAAGDA

SEQ ID NO: 109751 - protein, 34 aa, Artificial Sequence
  Description of Artificial Sequence: Synthetic polypeptide
AEEEIRTTNPVATEQYGSVSTVTLEGNDNEEGTD

SEQ ID NO: 109752 - protein, 31 aa, Artificial Sequence
  Description of Artificial Sequence: Synthetic polypeptide
SEEEIACTNPVGTEQYGCVATNLQDSGSDEM

SEQ ID NO: 109753 - protein, 33 aa, Artificial Sequence
  Description of Artificial Sequence: Synthetic polypeptide
DESEIRTTNPVMTECWGSVSCINEPQDREGENG

SEQ ID NO: 109754 - protein, 31 aa, Artificial Sequence
  Description of Artificial Sequence: Synthetic polypeptide
DENEIRTTNPVATEQWGDVSAEIEMNRVEQR

SEQ ID NO: 109755 - protein, 29 aa, Artificial Sequence
  Description of Artificial Sequence: Synthetic peptide
SEEEIASVNPVCTEQYGVVSWELQSGSEQ

SEQ ID NO: 109756 - protein, 30 aa, Artificial Sequence
  Description of Artificial Sequence: Synthetic polypeptide
DENEIRTTNPVATEQWGATTAENWARKGPI

SEQ ID NO: 109757 - protein, 33 aa, Artificial Sequence
  Description of Artificial Sequence: Synthetic polypeptide
DENEIRTTNPVATEQWGATAWSNANLQRKGGYI

SEQ ID NO: 109758 - protein, 36 aa, Artificial Sequence
  Description of Artificial Sequence: Synthetic polypeptide
AEEEIRTTNPVATEQYGSVSTVSNNQNQETGTNNTE

SEQ ID NO: 109759 - protein, 34 aa, Artificial Sequence
  Description of Artificial Sequence: Synthetic polypeptide
DENEIRTTNPVATEPYGTVSTPDIPNMQNGMNPV

SEQ ID NO: 109760 - protein, 33 aa, Artificial Sequence
  Description of Artificial Sequence: Synthetic polypeptide
DESEIRTTNPVSTECYGSVSMIDIPQDREGENG

SEQ ID NO: 109761 - protein, 37 aa, Artificial Sequence
  Description of Artificial Sequence: Synthetic polypeptide
AEEEIRTTNPVATEQYGSVSTVSNNLQQGENISTEEE

SEQ ID NO: 109762 - protein, 37 aa, Artificial Sequence
  Description of Artificial Sequence: Synthetic polypeptide
AEEEIRTTNPVATEQYGSVSTVSNNLQAGENGNTEEE

SEQ ID NO: 109763 - protein, 33 aa, Artificial Sequence
  Description of Artificial Sequence: Synthetic polypeptide
DENEIRTTNPVATEPYGTVSMPDIQNQQNGNPV

SEQ ID NO: 109764 - protein, 33 aa, Artificial Sequence
  Description of Artificial Sequence: Synthetic polypeptide
DENEIRTTNPVATEPYGTVSMPDIPNMQNGNPV

SEQ ID NO: 109765 - protein, 31 aa, Artificial Sequence
  Description of Artificial Sequence: Synthetic polypeptide
SEEEIATTNPVATASWGCVAGTGLARDGDNR

SEQ ID NO: 109766 - protein, 33 aa, Artificial Sequence
  Description of Artificial Sequence: Synthetic polypeptide
DESEIRTTNPVSTECYGSVSMIDIPQDREGENH

SEQ ID NO: 109767 - protein, 31 aa, Artificial Sequence
  Description of Artificial Sequence: Synthetic polypeptide
SEEEIATTNPVATASYGCVAGTNLAMNGDER

SEQ ID NO: 109768 - protein, 32 aa, Artificial Sequence
  Description of Artificial Sequence: Synthetic polypeptide
DENEIRTTNPVATEPYGTVSMEDPQQQQNGNH

SEQ ID NO: 109769 - protein, 32 aa, Artificial Sequence
  Description of Artificial Sequence: Synthetic polypeptide
DENEIRTTNPVATEPYGTVSMEDIQQQQNGNH

SEQ ID NO: 109770 - protein, 33 aa, Artificial Sequence
  Description of Artificial Sequence: Synthetic polypeptide
DESEIRTTNPVSTECYGSVSMIDIQQDREGENH

SEQ ID NO: 109771 - protein, 32 aa, Artificial Sequence
  Description of Artificial Sequence: Synthetic polypeptide
DENEIRTTNPVATEPYGTVSMEDIQQQQEGNH

SEQ ID NO: 109772 - protein, 32 aa, Artificial Sequence
  Description of Artificial Sequence: Synthetic polypeptide
DENEIRTTNPVATEPYGTVSMEDIQQDQNGNH

SEQ ID NO: 109773 - protein, 32 aa, Artificial Sequence
  Description of Artificial Sequence: Synthetic polypeptide
DENEIRTTNPVATEPYGTVSMEDIQQDQNGNG

SEQ ID NO: 109774 - protein, 37 aa, Artificial Sequence
  Description of Artificial Sequence: Synthetic polypeptide
AEEEIRTTNPVATEQYGSVSTVSNLNAQSEQGTNPVE

SEQ ID NO: 109775 - protein, 36 aa, Artificial Sequence
  Description of Artificial Sequence: Synthetic polypeptide
AEEEIRTTNPVATEQYGSVSTVSNEQQGENGTNNVN

SEQ ID NO: 109776 - protein, 32 aa, Artificial Sequence
  Description of Artificial Sequence: Synthetic polypeptide
SEEEIATTNPVATEMWGSVSAAELQQAEGNTA

SEQ ID NO: 109777 - protein, 33 aa, Artificial Sequence
  Description of Artificial Sequence: Synthetic polypeptide
DENEIRTTNPVATEPYGTVSATEDIVEQQNGND

SEQ ID NO: 109778 - protein, 32 aa, Artificial Sequence
  Description of Artificial Sequence: Synthetic polypeptide
DENEIRTTNPVATEPYGTVSATDIQQDQEGEL

SEQ ID NO: 109779 - protein, 30 aa, Artificial Sequence
  Description of Artificial Sequence: Synthetic polypeptide
DESEIRTTNPVSTEGWGDVANIEQNRAGDR

SEQ ID NO: 109780 - protein, 32 aa, Artificial Sequence
  Description of Artificial Sequence: Synthetic polypeptide
DENEIRTTNPVATEPYGTVCSMEGPQQQNGNH

SEQ ID NO: 109781 - protein, 35 aa, Artificial Sequence
  Description of Artificial Sequence: Synthetic polypeptide
AEEEIRTTNPVATEQYGSVSTVSNNQQQNDETNNE

SEQ ID NO: 109782 - protein, 31 aa, Artificial Sequence
  Description of Artificial Sequence: Synthetic polypeptide
DENEIRTTNPVATEQWGDVSAEGPMNAAGNA

SEQ ID NO: 109783 - protein, 30 aa, Artificial Sequence
  Description of Artificial Sequence: Synthetic polypeptide
DENEIRTTNPVATEQWGAVSETEMNAAEDA

SEQ ID NO: 109784 - protein, 30 aa, Artificial Sequence
  Description of Artificial Sequence: Synthetic polypeptide
DENEIRTTNPVATEQWGCVSEIEMNAENDA

SEQ ID NO: 109785 - protein, 29 aa, Artificial Sequence
  Description of Artificial Sequence: Synthetic peptide
DENEIRTTNPVATEQWGDVPEIEQHAEDK

SEQ ID NO: 109786 - protein, 30 aa, Artificial Sequence
  Description of Artificial Sequence: Synthetic polypeptide
SEEEIASVNPVCTEQYGVVSWGELQSGNQA

SEQ ID NO: 109787 - protein, 28 aa, Artificial Sequence
  Description of Artificial Sequence: Synthetic peptide
DENEIRTTNPVATEQWGDMSSTEMAEDA

SEQ ID NO: 109788 - protein, 30 aa, Artificial Sequence
  Description of Artificial Sequence: Synthetic polypeptide
DENEIRTTNPVATEQWGDISEIEMNQNENA

SEQ ID NO: 109789 - protein, 33 aa, Artificial Sequence
  Description of Artificial Sequence: Synthetic polypeptide
DESEIRTTNPVSTECWGSVSCINEPQDRHGENG

SEQ ID NO: 109790 - protein, 28 aa, Artificial Sequence
  Description of Artificial Sequence: Synthetic peptide
SEEEIATTNPIATEQYGEAPEVCMREER

SEQ ID NO: 109791 - protein, 28 aa, Artificial Sequence
  Description of Artificial Sequence: Synthetic peptide
SEEEIATTNPIATEQYGEAPEVCQHEER

SEQ ID NO: 109792 - protein, 30 aa, Artificial Sequence
  Description of Artificial Sequence: Synthetic polypeptide
DENEIRTTNPVATEQWGDASEILQNAAEDA

SEQ ID NO: 109793 - protein, 30 aa, Artificial Sequence
  Description of Artificial Sequence: Synthetic polypeptide
DENEIRTTNPVATEQWGDASEIEQNAAGGA

SEQ ID NO: 109794 - protein, 30 aa, Artificial Sequence
  Description of Artificial Sequence: Synthetic polypeptide
DENEIRTTNPVATEQWGDASEIEQNAAGDA

SEQ ID NO: 109795 - protein, 29 aa, Artificial Sequence
  Description of Artificial Sequence: Synthetic peptide
DENEIRTTNPVATEQWGDASEIEMRAEDA

SEQ ID NO: 109796 - protein, 30 aa, Artificial Sequence
  Description of Artificial Sequence: Synthetic polypeptide
DENEIRTTNPVATEQWGDASEIEMNRAEGR

SEQ ID NO: 109797 - protein, 33 aa, Artificial Sequence
  Description of Artificial Sequence: Synthetic polypeptide
DESEIRTTNPVSTECWGSVSCINPPQDREGENG

SEQ ID NO: 109798 - protein, 33 aa, Artificial Sequence
  Description of Artificial Sequence: Synthetic polypeptide
DESEIRTTNPVSTECWGSVSMENEPQQREGENH

SEQ ID NO: 109799 - protein, 30 aa, Artificial Sequence
  Description of Artificial Sequence: Synthetic polypeptide
DENEIRTTNPVATEQWGDASEIEMNRAEDR

SEQ ID NO: 109800 - protein, 30 aa, Artificial Sequence
  Description of Artificial Sequence: Synthetic polypeptide
DENEIRTTNPVATEQWGCVSWEETNALNDA

SEQ ID NO: 109801 - protein, 30 aa, Artificial Sequence
  Description of Artificial Sequence: Synthetic polypeptide
DENEIRTTNPVATEQWGCVSSTEMNAIMDA

SEQ ID NO: 109802 - protein, 31 aa, Artificial Sequence
  Description of Artificial Sequence: Synthetic polypeptide
DENEIRTTNPVATEQWGCVSSPETNAFQSDA

SEQ ID NO: 109803 - protein, 31 aa, Artificial Sequence
  Description of Artificial Sequence: Synthetic polypeptide
DENEIRTTNPVATEQWGCVSSPEMNAFNDNA

SEQ ID NO: 109804 - protein, 31 aa, Artificial Sequence
  Description of Artificial Sequence: Synthetic polypeptide
DENEIRTTNPVATEQWGCVSSEENANAINDA

SEQ ID NO: 109805 - protein, 32 aa, Artificial Sequence
  Description of Artificial Sequence: Synthetic polypeptide
DENEIRTTNPVATEQWGCVSSAETNAFESDNA

SEQ ID NO: 109806 - protein, 30 aa, Artificial Sequence
  Description of Artificial Sequence: Synthetic polypeptide
DENEIRTTNPVATEQWGCVSKIEMRAAEDA

SEQ ID NO: 109807 - protein, 30 aa, Artificial Sequence
  Description of Artificial Sequence: Synthetic polypeptide
DENEIRTTNPVATEQWGCVSIIEMNAGEDA

SEQ ID NO: 109808 - protein, 31 aa, Artificial Sequence
  Description of Artificial Sequence: Synthetic polypeptide
DENEIRTTNPVATEQWGCVSEVEENTAEGES

SEQ ID NO: 109809 - protein, 31 aa, Artificial Sequence
  Description of Artificial Sequence: Synthetic polypeptide
DENEIRTTNPVATEQWGCVSETEMNAAEDAW

SEQ ID NO: 109810 - protein, 30 aa, Artificial Sequence
  Description of Artificial Sequence: Synthetic polypeptide
DENEIRTTNPVATEQWGCVSEGEMNAAEGA

SEQ ID NO: 109811 - protein, 33 aa, Artificial Sequence
  Description of Artificial Sequence: Synthetic polypeptide
DESEIRTTNPVITECWGSVSCINYGQDRIGENG

SEQ ID NO: 109812 - protein, 33 aa, Artificial Sequence
  Description of Artificial Sequence: Synthetic polypeptide
DESEIRTTNPVITECWGSVSCINERQDREGENG

SEQ ID NO: 109813 - protein, 30 aa, Artificial Sequence
  Description of Artificial Sequence: Synthetic polypeptide
DENEIRTTNPVATEQWGDVSEDEMNAAGDL

SEQ ID NO: 109814 - protein, 30 aa, Artificial Sequence
  Description of Artificial Sequence: Synthetic polypeptide
DENEIRTTNPVATEQWGDVSEIEMNANEDV

SEQ ID NO: 109815 - protein, 30 aa, Artificial Sequence
  Description of Artificial Sequence: Synthetic polypeptide
DENEIRTTNPVATEQWGDVSEIEMNANEDA

SEQ ID NO: 109816 - protein, 31 aa, Artificial Sequence
  Description of Artificial Sequence: Synthetic polypeptide
DENEIRTTNPVATEQWGDVSEIEMNAHEDNA

SEQ ID NO: 109817 - protein, 30 aa, Artificial Sequence
  Description of Artificial Sequence: Synthetic polypeptide
DENEIRTTNPVATEQWGDVSEIEMNAGEDA

SEQ ID NO: 109818 - protein, 33 aa, Artificial Sequence
  Description of Artificial Sequence: Synthetic polypeptide
DESEIRTTNPVGTECWGSVSCINEPQDREGENG

SEQ ID NO: 109819 - protein, 29 aa, Artificial Sequence
  Description of Artificial Sequence: Synthetic peptide
DENEIRTTNPVATEQWGDVSEIEMNAEEA

SEQ ID NO: 109820 - protein, 29 aa, Artificial Sequence
  Description of Artificial Sequence: Synthetic peptide
DENEIRTTNPVATEQWGDVSEIEMNAEDI

SEQ ID NO: 109821 - protein, 29 aa, Artificial Sequence
  Description of Artificial Sequence: Synthetic peptide
DENEIRTTNPVATEQWGDVSEIEMNAEDA

SEQ ID NO: 109822 - protein, 30 aa, Artificial Sequence
  Description of Artificial Sequence: Synthetic polypeptide
DENEIRTTNPVATEQWGDVSEIEMNAAYGA

SEQ ID NO: 109823 - protein, 30 aa, Artificial Sequence
  Description of Artificial Sequence: Synthetic polypeptide
DENEIRTTNPVATEQWGDVSEIEMNAARDA

SEQ ID NO: 109824 - protein, 30 aa, Artificial Sequence
  Description of Artificial Sequence: Synthetic polypeptide
DENEIRTTNPVATEQWGDVSEIEMNAANGT

SEQ ID NO: 109825 - protein, 30 aa, Artificial Sequence
  Description of Artificial Sequence: Synthetic polypeptide
DENEIRTTNPVATEQWGDVSEIEMNAANDA

SEQ ID NO: 109826 - protein, 33 aa, Artificial Sequence
  Description of Artificial Sequence: Synthetic polypeptide
DESEIRTTNPVGTECWGSVSFINEPQDREGPNG

SEQ ID NO: 109827 - protein, 30 aa, Artificial Sequence
  Description of Artificial Sequence: Synthetic polypeptide
DENEIRTTNPVATEQWGDVSEIEMNAAGEA

SEQ ID NO: 109828 - protein, 35 aa, Artificial Sequence
  Description of Artificial Sequence: Synthetic polypeptide
AEEEIRTTNPVATEQYGSVVVTNNLLGNTAEGNNV

SEQ ID NO: 109829 - protein, 30 aa, Artificial Sequence
  Description of Artificial Sequence: Synthetic polypeptide
DENEIRTTNPVATEQWGDVSEIEMNAAGDQ

SEQ ID NO: 109830 - protein, 30 aa, Artificial Sequence
  Description of Artificial Sequence: Synthetic polypeptide
DENEIRTTNPVATEQWGDVSEIEMNAAGDL

SEQ ID NO: 109831 - protein, 30 aa, Artificial Sequence
  Description of Artificial Sequence: Synthetic polypeptide
DENEIRTTNPVATEQWGDVSEIEMNAAGDH

SEQ ID NO: 109832 - protein, 30 aa, Artificial Sequence
  Description of Artificial Sequence: Synthetic polypeptide
DENEIRTTNPVATEQWGDVSEIEMNAAGDA

SEQ ID NO: 109833 - protein, 30 aa, Artificial Sequence
  Description of Artificial Sequence: Synthetic polypeptide
DENEIRTTNPVATEQWGDVSEIEMNAAERA

SEQ ID NO: 109834 - protein, 30 aa, Artificial Sequence
  Description of Artificial Sequence: Synthetic polypeptide
DENEIRTTNPVATEQWGDVSEIEMNAAEQR

SEQ ID NO: 109835 - protein, 30 aa, Artificial Sequence
  Description of Artificial Sequence: Synthetic polypeptide
DENEIRTTNPVATEQWGDVSEIEMNAAENQ

SEQ ID NO: 109836 - protein, 30 aa, Artificial Sequence
  Description of Artificial Sequence: Synthetic polypeptide
DENEIRTTNPVATEQWGDVSEIEMNAAENA

SEQ ID NO: 109837 - protein, 31 aa, Artificial Sequence
  Description of Artificial Sequence: Synthetic polypeptide
DENEIRTTNPVATEQWGDVSEIEMNAAEGDP

SEQ ID NO: 109838 - protein, 31 aa, Artificial Sequence
  Description of Artificial Sequence: Synthetic polypeptide
DENEIRTTNPVATEQWGDVSEIEMNAAEGDA

SEQ ID NO: 109839 - protein, 30 aa, Artificial Sequence
  Description of Artificial Sequence: Synthetic polypeptide
DENEIRTTNPVATEQWGDVSEIEMNANENA

SEQ ID NO: 109840 - protein, 30 aa, Artificial Sequence
  Description of Artificial Sequence: Synthetic polypeptide
DENEIRTTNPVATEQWGDVSEIEMNAAEGA

SEQ ID NO: 109841 - protein, 30 aa, Artificial Sequence
  Description of Artificial Sequence: Synthetic polypeptide
DENEIRTTNPVATEQWGDVSEIEMNAQEDA

SEQ ID NO: 109842 - protein, 30 aa, Artificial Sequence
  Description of Artificial Sequence: Synthetic polypeptide
DENEIRTTNPVATEQWGDVSEIEMNAREDA

SEQ ID NO: 109843 - protein, 30 aa, Artificial Sequence
  Description of Artificial Sequence: Synthetic polypeptide
DENEIRTTNPVATEQWGDVSEIEMRAAEDA

SEQ ID NO: 109844 - protein, 30 aa, Artificial Sequence
  Description of Artificial Sequence: Synthetic polypeptide
DENEIRTTNPVATEQWGDVSEIEMQQAEDA

SEQ ID NO: 109845 - protein, 30 aa, Artificial Sequence
  Description of Artificial Sequence: Synthetic polypeptide
DENEIRTTNPVATEQWGDVSEIEMQAAEDI

SEQ ID NO: 109846 - protein, 30 aa, Artificial Sequence
  Description of Artificial Sequence: Synthetic polypeptide
DENEIRTTNPVATEQWGDVSEIEMQAAEDA

SEQ ID NO: 109847 - protein, 30 aa, Artificial Sequence
  Description of Artificial Sequence: Synthetic polypeptide
DENEIRTTNPVATEQWGDVSEIEMNSAENA

SEQ ID NO: 109848 - protein, 35 aa, Artificial Sequence
  Description of Artificial Sequence: Synthetic polypeptide
AEEEIRTTNPVATEQYGSVVVTNNGNEQAGNNEQS

SEQ ID NO: 109849 - protein, 30 aa, Artificial Sequence
  Description of Artificial Sequence: Synthetic polypeptide
DENEIRTTNPVATEQWGDVSEIEMNRHEDA

SEQ ID NO: 109850 - protein, 37 aa, Artificial Sequence
  Description of Artificial Sequence: Synthetic polypeptide
AEEEIRTTNPVATEQYGSVSTVTNLQAGNQQGNNEND

SEQ ID NO: 109851 - protein, 30 aa, Artificial Sequence
  Description of Artificial Sequence: Synthetic polypeptide
AETEIRCTNPVATEQWGEAWSNEDLARGPR

SEQ ID NO: 109852 - protein, 30 aa, Artificial Sequence
  Description of Artificial Sequence: Synthetic polypeptide
DENEIRTTNPVATEQWGDVSEIEMNRAEGA

SEQ ID NO: 109853 - protein, 30 aa, Artificial Sequence
  Description of Artificial Sequence: Synthetic polypeptide
DENEIRTTNPVATEQWGDVSEIEMNRAEDV

SEQ ID NO: 109854 - protein, 33 aa, Artificial Sequence
  Description of Artificial Sequence: Synthetic polypeptide
DESEIRTTNPVCTEYWGSVSCINEPQDREGENG

SEQ ID NO: 109855 - protein, 30 aa, Artificial Sequence
  Description of Artificial Sequence: Synthetic polypeptide
DENEIRTTNPVATEQWGDVSEIEMNRAEDA

SEQ ID NO: 109856 - protein, 30 aa, Artificial Sequence
  Description of Artificial Sequence: Synthetic polypeptide
DENEIRTTNPVATEQWGDVSEIEMNQAEDA

SEQ ID NO: 109857 - protein, 30 aa, Artificial Sequence
  Description of Artificial Sequence: Synthetic polypeptide
DENEIRTTNPVATEQWGDVSEIEMNLAEQA

SEQ ID NO: 109858 - protein, 32 aa, Artificial Sequence
  Description of Artificial Sequence: Synthetic polypeptide
DESEIRTTNPVGTECWGSMSCINLQDHEGENG

SEQ ID NO: 109859 - protein, 30 aa, Artificial Sequence
  Description of Artificial Sequence: Synthetic polypeptide
DENEIRTTNPVATEQWGDVSEIEMNLAEDA

SEQ ID NO: 109860 - protein, 30 aa, Artificial Sequence
  Description of Artificial Sequence: Synthetic polypeptide
DENEIRTTNPVATEQWGDVSEIEMNIAGDA

SEQ ID NO: 109861 - protein, 29 aa, Artificial Sequence
  Description of Artificial Sequence: Synthetic peptide
DENEIRTTNPVATEQWGDVSEIEMNHEEA

SEQ ID NO: 109862 - protein, 30 aa, Artificial Sequence
  Description of Artificial Sequence: Synthetic polypeptide
DENEIRTTNPVATEQWGDVSEIEMNHAGDA

SEQ ID NO: 109863 - protein, 30 aa, Artificial Sequence
  Description of Artificial Sequence: Synthetic polypeptide
DENEIRTTNPVATEQWGDVSEIEMNGGEDA

SEQ ID NO: 109864 - protein, 31 aa, Artificial Sequence
  Description of Artificial Sequence: Synthetic polypeptide
DENEIRTTNPVATEQWGDVSEIEMNGAEDRA

SEQ ID NO: 109865 - protein, 30 aa, Artificial Sequence
  Description of Artificial Sequence: Synthetic polypeptide
DENEIRTTNPVATEQWGDVSEIEMNGAEDA

SEQ ID NO: 109866 - protein, 30 aa, Artificial Sequence
  Description of Artificial Sequence: Synthetic polypeptide
DENEIRTTNPVATEQWGDVSEIEMNFAGDD

SEQ ID NO: 109867 - protein, 32 aa, Artificial Sequence
  Description of Artificial Sequence: Synthetic polypeptide
DENEIRTTNPVATEQWGDVSEIEMNATEGDNA

SEQ ID NO: 109868 - protein, 30 aa, Artificial Sequence
  Description of Artificial Sequence: Synthetic polypeptide
DENEIRTTNPVATEQWGDVSEIEMNAQEHA

SEQ ID NO: 109869 - protein, 30 aa, Artificial Sequence
  Description of Artificial Sequence: Synthetic polypeptide
DENEIRTTNPVATEQWGDVSEIEMNAAEDR

SEQ ID NO: 109870 - protein, 31 aa, Artificial Sequence
  Description of Artificial Sequence: Synthetic polypeptide
DENEIRTTNPVATEQWGDVSEIEMNAAEDNA

SEQ ID NO: 109871 - protein, 30 aa, Artificial Sequence
  Description of Artificial Sequence: Synthetic polypeptide
DENEIRTTNPVATEQWGDVSEIEMNAAEDN

SEQ ID NO: 109872 - protein, 29 aa, Artificial Sequence
  Description of Artificial Sequence: Synthetic peptide
DESEIRTTNPVGTEQWGDVSEIEQNAEDA

SEQ ID NO: 109873 - protein, 28 aa, Artificial Sequence
  Description of Artificial Sequence: Synthetic peptide
DESEIRTTNPVGTEQWGVMSSIEQAEDA

SEQ ID NO: 109874 - protein, 29 aa, Artificial Sequence
  Description of Artificial Sequence: Synthetic peptide
DENEIRTTNPVATEQWGDVSEICMNAEEA

SEQ ID NO: 109875 - protein, 29 aa, Artificial Sequence
  Description of Artificial Sequence: Synthetic peptide
DENEIRTTNPVATEQWGDVSEICMNAEDA

SEQ ID NO: 109876 - protein, 30 aa, Artificial Sequence
  Description of Artificial Sequence: Synthetic polypeptide
DENEIRTTNPVATEQWGDVSEGEVMFAGDA

SEQ ID NO: 109877 - protein, 30 aa, Artificial Sequence
  Description of Artificial Sequence: Synthetic polypeptide
DENEIRTTNPVATEQWGDVSEGEMQAAEDA

SEQ ID NO: 109878 - protein, 30 aa, Artificial Sequence
  Description of Artificial Sequence: Synthetic polypeptide
DENEIRTTNPVATEQWGDVSEGEMNQAEDA

SEQ ID NO: 109879 - protein, 30 aa, Artificial Sequence
  Description of Artificial Sequence: Synthetic polypeptide
DENEIRTTNPVATEQWGDVSEGEMNAARDA

SEQ ID NO: 109880 - protein, 29 aa, Artificial Sequence
  Description of Artificial Sequence: Synthetic peptide
DENEIRTTNPVATEQWGDVSEGEMAAEDA

SEQ ID NO: 109881 - protein, 30 aa, Artificial Sequence
  Description of Artificial Sequence: Synthetic polypeptide
DENEIRTTNPVATEQWGDVSEEEMNQAEDA

SEQ ID NO: 109882 - protein, 30 aa, Artificial Sequence
  Description of Artificial Sequence: Synthetic polypeptide
DENEIRTTNPVATEQWGDVSEEEMNGAEDA

SEQ ID NO: 109883 - protein, 35 aa, Artificial Sequence
  Description of Artificial Sequence: Synthetic polypeptide
DESEIRTTNPVGTEQYGSVSSTSPALNMRNGMNPV

SEQ ID NO: 109884 - protein, 33 aa, Artificial Sequence
  Description of Artificial Sequence: Synthetic polypeptide
DESEIRTTNPVHTECWGSVSCINEPQDREGENG

SEQ ID NO: 109885 - protein, 30 aa, Artificial Sequence
  Description of Artificial Sequence: Synthetic polypeptide
DENEIRTTNPVATEQWGDVSEDEMQQAEDA

SEQ ID NO: 109886 - protein, 30 aa, Artificial Sequence
  Description of Artificial Sequence: Synthetic polypeptide
DENEIRTTNPVATEQWGDVSEDEMNGAEDA

SEQ ID NO: 109887 - protein, 30 aa, Artificial Sequence
  Description of Artificial Sequence: Synthetic polypeptide
DENEIRTTNPVATEQWGDVSEDEMNAGEDA

SEQ ID NO: 109888 - protein, 30 aa, Artificial Sequence
  Description of Artificial Sequence: Synthetic polypeptide
DENEIRTTNPVATEQWGDVSEDEMNAEGDL

SEQ ID NO: 109889 - protein, 33 aa, Artificial Sequence
  Description of Artificial Sequence: Synthetic polypeptide
DESEIRTTNPVHTECWGSVSCINEPQDREGMNG

SEQ ID NO: 109890 - protein, 30 aa, Artificial Sequence
  Description of Artificial Sequence: Synthetic polypeptide
DENEIRTTNPVATEQWGDVSEDEMNAAGEA

SEQ ID NO: 109891 - protein, 33 aa, Artificial Sequence
  Description of Artificial Sequence: Synthetic polypeptide
DESEIRTTNPVITECWGSVSCINEEQDREGENG

SEQ ID NO: 109892 - protein, 33 aa, Artificial Sequence
  Description of Artificial Sequence: Synthetic polypeptide
NNEEIRTTNPVATEQYGVVSPNTQEQWQVNPNR

SEQ ID NO: 109893 - protein, 37 aa, Artificial Sequence
  Description of Artificial Sequence: Synthetic polypeptide
AEEEIRTTNPVATEQYGSVSTVTNLENQEEIGTNNNN

SEQ ID NO: 109894 - protein, 33 aa, Artificial Sequence
  Description of Artificial Sequence: Synthetic polypeptide
DESEIRTTNPVITECWGSVSCINEPQDREGENG

SEQ ID NO: 109895 - protein, 33 aa, Artificial Sequence
  Description of Artificial Sequence: Synthetic polypeptide
DESEIRTTNPVITECWGSVSCINEPQDREGWNG

SEQ ID NO: 109896 - protein, 33 aa, Artificial Sequence
  Description of Artificial Sequence: Synthetic polypeptide
DESEIRTTNPVITECWGSVSCINEPQDRFGENG

SEQ ID NO: 109897 - protein, 30 aa, Artificial Sequence
  Description of Artificial Sequence: Synthetic polypeptide
DENEIRTTNPVATEQWGDVSEICQNAAEDA

SEQ ID NO: 109898 - protein, 30 aa, Artificial Sequence
  Description of Artificial Sequence: Synthetic polypeptide
DENEIRTTNPVATEQWGDVSEIEANAAGDA

SEQ ID NO: 109899 - protein, 30 aa, Artificial Sequence
  Description of Artificial Sequence: Synthetic polypeptide
DENEIRTTNPVATEQWGDVSEIEANAANDY

SEQ ID NO: 109900 - protein, 30 aa, Artificial Sequence
  Description of Artificial Sequence: Synthetic polypeptide
DENEIRTTNPVATEQWGDVSEIEENAAGDA

SEQ ID NO: 109901 - protein, 31 aa, Artificial Sequence
  Description of Artificial Sequence: Synthetic polypeptide
DENEIRTTNPVATEQWGDVSEIEMNAAEDMR

SEQ ID NO: 109902 - protein, 31 aa, Artificial Sequence
  Description of Artificial Sequence: Synthetic polypeptide
DENEIRTTNPVATEQWGDVSEIEMNAAEDAR

SEQ ID NO: 109903 - protein, 30 aa, Artificial Sequence
  Description of Artificial Sequence: Synthetic polypeptide
DENEIRTTNPVATEQWGDVSEIEMMAAENV

SEQ ID NO: 109904 - protein, 30 aa, Artificial Sequence
  Description of Artificial Sequence: Synthetic polypeptide
DENEIRTTNPVATEQWGDVSEIEMMAAENA

SEQ ID NO: 109905 - protein, 31 aa, Artificial Sequence
  Description of Artificial Sequence: Synthetic polypeptide
DENEIRTTNPVATEQWGDVSEIEMLAAEGDA

SEQ ID NO: 109906 - protein, 30 aa, Artificial Sequence
  Description of Artificial Sequence: Synthetic polypeptide
DENEIRTTNPVATEQWGDVSEIEMLAAEDA

SEQ ID NO: 109907 - protein, 29 aa, Artificial Sequence
  Description of Artificial Sequence: Synthetic peptide
DENEIRTTNPVATEQWGDVSEIEMKAEDA

SEQ ID NO: 109908 - protein, 29 aa, Artificial Sequence
  Description of Artificial Sequence: Synthetic peptide
DENEIRTTNPVATEQWGDVSEIEMHAEDK

SEQ ID NO: 109909 - protein, 29 aa, Artificial Sequence
  Description of Artificial Sequence: Synthetic peptide
DENEIRTTNPVATEQWGDVSEIEMHAEDA

SEQ ID NO: 109910 - protein, 36 aa, Artificial Sequence
  Description of Artificial Sequence: Synthetic polypeptide
AEEEIRTTNPVATEQYGSVSTVTNLNQQQQNNNNEE

SEQ ID NO: 109911 - protein, 29 aa, Artificial Sequence
  Description of Artificial Sequence: Synthetic peptide
DESEIRTTNPVGTEGWGVMASTLQDHGDG

SEQ ID NO: 109912 - protein, 35 aa, Artificial Sequence
  Description of Artificial Sequence: Synthetic polypeptide
DESEIRTTNPVGTEGYGSVSSTSPTLQMRNGMNPV

SEQ ID NO: 109913 - protein, 30 aa, Artificial Sequence
  Description of Artificial Sequence: Synthetic polypeptide
DENEIRTTNPVATEQWGDVSEIEMRAQEDA

SEQ ID NO: 109914 - protein, 35 aa, Artificial Sequence
  Description of Artificial Sequence: Synthetic polypeptide
AEEEIRTTNPVATEQYGSVVVTNNQLGNEAGGNNV

SEQ ID NO: 109915 - protein, 29 aa, Artificial Sequence
  Description of Artificial Sequence: Synthetic peptide
DENEIRTTNPVATEQWGDVSEIEMAAETA

SEQ ID NO: 109916 - protein, 29 aa, Artificial Sequence
  Description of Artificial Sequence: Synthetic peptide
DENEIRTTNPVATEQWGDVSEIEMAAEDL

SEQ ID NO: 109917 - protein, 29 aa, Artificial Sequence
  Description of Artificial Sequence: Synthetic peptide
DENEIRTTNPVATEQWGDVSEIEMAAEDA

SEQ ID NO: 109918 - protein, 30 aa, Artificial Sequence
  Description of Artificial Sequence: Synthetic polypeptide
DENEIRTTNPVATEQWGDVSEIELNAAEDV

SEQ ID NO: 109919 - protein, 28 aa, Artificial Sequence
  Description of Artificial Sequence: Synthetic peptide
DESEIRTTNPVGTEQWGDMSSIEQAEDA

SEQ ID NO: 109920 - protein, 30 aa, Artificial Sequence
  Description of Artificial Sequence: Synthetic polypeptide
DENEIRTTNPVATEQWGDVSEIELNAAEDA

SEQ ID NO: 109921 - protein, 36 aa, Artificial Sequence
  Description of Artificial Sequence: Synthetic polypeptide
AEEEIRTTNPVATEQYGSVSTVTNLNNNEQGNEQGD

SEQ ID NO: 109922 - protein, 31 aa, Artificial Sequence
  Description of Artificial Sequence: Synthetic polypeptide
DENEIRTTNPVATEQWGDVSEIELMNAPRDA

SEQ ID NO: 109923 - protein, 34 aa, Artificial Sequence
  Description of Artificial Sequence: Synthetic polypeptide
NNEEIRTTNPVATEQYGVVSSPDNTQEQWQGPNR

SEQ ID NO: 109924 - protein, 37 aa, Artificial Sequence
  Description of Artificial Sequence: Synthetic polypeptide
AEEEIRTTNPVATEQYGSVSTVTNLNLNNEQAGNNVT

SEQ ID NO: 109925 - protein, 30 aa, Artificial Sequence
  Description of Artificial Sequence: Synthetic polypeptide
DENEIRTTNPVATEQWGDVSEIEGNAAEDN

SEQ ID NO: 109926 - protein, 30 aa, Artificial Sequence
  Description of Artificial Sequence: Synthetic polypeptide
DENEIRTTNPVATEQWGDVSEIEENHAGDA

SEQ ID NO: 109927 - protein, 36 aa, Artificial Sequence
  Description of Artificial Sequence: Synthetic polypeptide
AEEEIRTTNPVATEQYGSVSTVTNLNQNQNNNNDEN

SEQ ID NO: 109928 - protein, 33 aa, Artificial Sequence
  Description of Artificial Sequence: Synthetic polypeptide
CEEEISTTNPVATEQYGCVCSNTEHQFFGSNQS

SEQ ID NO: 109929 - protein, 31 aa, Artificial Sequence
  Description of Artificial Sequence: Synthetic polypeptide
SEECIACTNPTAYEQYGSVANANLMRGNERP

SEQ ID NO: 109930 - protein, 30 aa, Artificial Sequence
  Description of Artificial Sequence: Synthetic polypeptide
SEECIACTNPTAYEQYGSVAIANLMRGNED

SEQ ID NO: 109931 - protein, 33 aa, Artificial Sequence
  Description of Artificial Sequence: Synthetic polypeptide
CEEEIRTVNPVAYEQYGSTVSCIRLSQRTNGQE

SEQ ID NO: 109932 - protein, 32 aa, Artificial Sequence
  Description of Artificial Sequence: Synthetic polypeptide
DESEIRTTNPVATKHYGSVSTLYLTEGTMDMI

SEQ ID NO: 109933 - protein, 32 aa, Artificial Sequence
  Description of Artificial Sequence: Synthetic polypeptide
DESEIRTTNPVATKHYGSVSTLYLTTEGTDMF

SEQ ID NO: 109934 - protein, 35 aa, Artificial Sequence
  Description of Artificial Sequence: Synthetic polypeptide
DENEIRTTNPVATEQYGSVCSPTNLMERQDDTQES

SEQ ID NO: 109935 - protein, 32 aa, Artificial Sequence
  Description of Artificial Sequence: Synthetic polypeptide
REQEIATTNPVATEQYGSVSATDLEDHEGEDL

SEQ ID NO: 109936 - protein, 32 aa, Artificial Sequence
  Description of Artificial Sequence: Synthetic polypeptide
QAEEIATTNPVAYEQYGSVATNPTQTGNGDEV

SEQ ID NO: 109937 - protein, 35 aa, Artificial Sequence
  Description of Artificial Sequence: Synthetic polypeptide
AEEEIRTTNPVATEQYGSVVVSVTNNNQEQETNED

SEQ ID NO: 109938 - protein, 33 aa, Artificial Sequence
  Description of Artificial Sequence: Synthetic polypeptide
DESEIRTTNPVATLCWGSVSCINEPQDREGENG

SEQ ID NO: 109939 - protein, 33 aa, Artificial Sequence
  Description of Artificial Sequence: Synthetic polypeptide
DESEIRTTNPVATLCWGSVSCINQPQDREGENG

SEQ ID NO: 109940 - protein, 35 aa, Artificial Sequence
  Description of Artificial Sequence: Synthetic polypeptide
DENEIRTTNPVATEQYGSVCSPTDNLENYNGSDIE

SEQ ID NO: 109941 - protein, 33 aa, Artificial Sequence
  Description of Artificial Sequence: Synthetic polypeptide
RESEIRTTNPVATECWGSVSCINEPQDREGENG

SEQ ID NO: 109942 - protein, 35 aa, Artificial Sequence
  Description of Artificial Sequence: Synthetic polypeptide
AEEEIRTTNPVATEQYGSVVVSVTNNNQEQGETED

SEQ ID NO: 109943 - protein, 33 aa, Artificial Sequence
  Description of Artificial Sequence: Synthetic polypeptide
RESEIRTTNPVATEWWGSVSCINEPQDREGENG

SEQ ID NO: 109944 - protein, 33 aa, Artificial Sequence
  Description of Artificial Sequence: Synthetic polypeptide
DESEIRTTNPVATMCWGSVSCINEPQDREGENG

SEQ ID NO: 109945 - protein, 33 aa, Artificial Sequence
  Description of Artificial Sequence: Synthetic polypeptide
QAEEIATTNPVAYEQYGSVATNLQDTPDGNDNN

SEQ ID NO: 109946 - protein, 29 aa, Artificial Sequence
  Description of Artificial Sequence: Synthetic peptide
SAEEIATTNPVATAQWGCVAGTGLDDGNA

SEQ ID NO: 109947 - protein, 34 aa, Artificial Sequence
  Description of Artificial Sequence: Synthetic polypeptide
DENEIRTTNPVATEQYGSVCSFNVLLTNNMEDHI

SEQ ID NO: 109948 - protein, 30 aa, Artificial Sequence
  Description of Artificial Sequence: Synthetic polypeptide
SAEEIATTNPVATAQWGCVAGTGLQNGNPM

SEQ ID NO: 109949 - protein, 33 aa, Artificial Sequence
  Description of Artificial Sequence: Synthetic polypeptide
DENEIRTTNPVATEQYGSVCSEGSDEQRVQDDV

SEQ ID NO: 109950 - protein, 34 aa, Artificial Sequence
  Description of Artificial Sequence: Synthetic polypeptide
AEEEIRTTNPVATEQYGSVVVSVTNNNQEQTETD

SEQ ID NO: 109951 - protein, 33 aa, Artificial Sequence
  Description of Artificial Sequence: Synthetic polypeptide
DENEIRTTNPVATEQYGSVCETYGVEIRIGQQD

SEQ ID NO: 109952 - protein, 31 aa, Artificial Sequence
  Description of Artificial Sequence: Synthetic polypeptide
SAEEIATTNPVATAQWGSVSGEGLQHGNNAP

SEQ ID NO: 109953 - protein, 32 aa, Artificial Sequence
  Description of Artificial Sequence: Synthetic polypeptide
SAEEIATTNPVATAQWGSVSGTGLQHGDNEAE

SEQ ID NO: 109954 - protein, 34 aa, Artificial Sequence
  Description of Artificial Sequence: Synthetic polypeptide
AEEEIRTTNPVATEQYGSVVVSVTNNQEQDETDG

SEQ ID NO: 109955 - protein, 31 aa, Artificial Sequence
  Description of Artificial Sequence: Synthetic polypeptide
SAEEIATTNPVATAQWGSVSGTGNPDADSNR

SEQ ID NO: 109956 - protein, 35 aa, Artificial Sequence
  Description of Artificial Sequence: Synthetic polypeptide
CEEEIRTTNPVGYTERYGQTVSTNAVSQRGGDNRM

SEQ ID NO: 109957 - protein, 32 aa, Artificial Sequence
  Description of Artificial Sequence: Synthetic polypeptide
SAEEIATTNPVATAQWGSVSGTNPATPDGNRN

SEQ ID NO: 109958 - protein, 33 aa, Artificial Sequence
  Description of Artificial Sequence: Synthetic polypeptide
DESEIRTTNPVATKCWGSVSCINEPQDREGENG

SEQ ID NO: 109959 - protein, 34 aa, Artificial Sequence
  Description of Artificial Sequence: Synthetic polypeptide
DENEIRTTNPVATEQYGSVCSVTWPLEDRDEIEG

SEQ ID NO: 109960 - protein, 34 aa, Artificial Sequence
  Description of Artificial Sequence: Synthetic polypeptide
DESEIRTTNPVATHCWGSVSACINEPQDREGENR

SEQ ID NO: 109961 - protein, 37 aa, Artificial Sequence
  Description of Artificial Sequence: Synthetic polypeptide
AEEEIRTTNPVATEQYGSVSTVTTNLQLGNNNVEEAE

SEQ ID NO: 109962 - protein, 33 aa, Artificial Sequence
  Description of Artificial Sequence: Synthetic polypeptide
DENEIRTTNPVATEQYGSVLYVTEEVDEGEERI

SEQ ID NO: 109963 - protein, 33 aa, Artificial Sequence
  Description of Artificial Sequence: Synthetic polypeptide
DESEIRTTNPVATHCWGSVSCINEPQDREGENG

SEQ ID NO: 109964 - protein, 33 aa, Artificial Sequence
  Description of Artificial Sequence: Synthetic polypeptide
DESEIRTTNPVATICWGSVSCINEPQDREGENG

SEQ ID NO: 109965 - protein, 35 aa, Artificial Sequence
  Description of Artificial Sequence: Synthetic polypeptide
CEEEIRTTNPVGYERYGQSVPSTNAVSQRFGDNRM

SEQ ID NO: 109966 - protein, 33 aa, Artificial Sequence
  Description of Artificial Sequence: Synthetic polypeptide
DESEIRTTNPVATICWGSVSCINEPQDREGERG

SEQ ID NO: 109967 - protein, 33 aa, Artificial Sequence
  Description of Artificial Sequence: Synthetic polypeptide
DENEIRTTNPVATEQYGSVFYIFHSGRTGGNNS

SEQ ID NO: 109968 - protein, 36 aa, Artificial Sequence
  Description of Artificial Sequence: Synthetic polypeptide
DENEIRTTNPVATEQYGSVFWVPNDLGQMEGGNESR

SEQ ID NO: 109969 - protein, 35 aa, Artificial Sequence
  Description of Artificial Sequence: Synthetic polypeptide
DENEIRTTNPVATEQYGSVFSTTNYLFGGLEEDFD

SEQ ID NO: 109970 - protein, 35 aa, Artificial Sequence
  Description of Artificial Sequence: Synthetic polypeptide
DENEIRTTNPVATEQYGSVFSTPNGMQNETIDDRG

SEQ ID NO: 109971 - protein, 34 aa, Artificial Sequence
  Description of Artificial Sequence: Synthetic polypeptide
DENEIRTTNPVATEQYGSVETWVTQERDGDSLVE

SEQ ID NO: 109972 - protein, 31 aa, Artificial Sequence
  Description of Artificial Sequence: Synthetic polypeptide
DENEIRTTNPVATEQYGSVEQSAIAVENVVL

SEQ ID NO: 109973 - protein, 34 aa, Artificial Sequence
  Description of Artificial Sequence: Synthetic polypeptide
DENEIRTTNPVATEQYGSVECTDWLEQETQGAGQ

SEQ ID NO: 109974 - protein, 33 aa, Artificial Sequence
  Description of Artificial Sequence: Synthetic polypeptide
DENEIRTTNPVATEQYGSVECTDWFENETQNGQ

SEQ ID NO: 109975 - protein, 35 aa, Artificial Sequence
  Description of Artificial Sequence: Synthetic polypeptide
DENEIRTTNPVATEQYGSVCYVTWPNLDEDIGNEM

SEQ ID NO: 109976 - protein, 33 aa, Artificial Sequence
  Description of Artificial Sequence: Synthetic polypeptide
DENEIRTTNPVATEQYGSVCYVTWPLEDIDNDM

SEQ ID NO: 109977 - protein, 36 aa, Artificial Sequence
  Description of Artificial Sequence: Synthetic polypeptide
AEEEIRTTNPVATEQYGSVSTVTQQGNQQIGNNEQT

SEQ ID NO: 109978 - protein, 34 aa, Artificial Sequence
  Description of Artificial Sequence: Synthetic polypeptide
CEEEIRTTNPVGYERYGQSVSTNAVSQREGDNFM

SEQ ID NO: 109979 - protein, 36 aa, Artificial Sequence
  Description of Artificial Sequence: Synthetic polypeptide
AEEEIRTTNPVATEQYGSVSTVTQNGNNQEGNNVED

SEQ ID NO: 109980 - protein, 28 aa, Artificial Sequence
  Description of Artificial Sequence: Synthetic peptide
REGEIAPTNPCSSEKYGIVSCNLQSGTR

SEQ ID NO: 109981 - protein, 33 aa, Artificial Sequence
  Description of Artificial Sequence: Synthetic polypeptide
DENEIRTTNPVATEQYGSVCSVVWPLEDPNIEM

SEQ ID NO: 109982 - protein, 34 aa, Artificial Sequence
  Description of Artificial Sequence: Synthetic polypeptide
DENEIRTTNPVATEQYGSVCSVTYPLEDRFVEEM

SEQ ID NO: 109983 - protein, 34 aa, Artificial Sequence
  Description of Artificial Sequence: Synthetic polypeptide
DENEIRTTNPVATEQYGSVCSVTWPNLEDSFIEM

SEQ ID NO: 109984 - protein, 33 aa, Artificial Sequence
  Description of Artificial Sequence: Synthetic polypeptide
DESEIRTTNPVATICWGSVSCINEPQKREGENG

SEQ ID NO: 109985 - protein, 33 aa, Artificial Sequence
  Description of Artificial Sequence: Synthetic polypeptide
DESEIRTTNPVATKCWGSVSCINENQDREGENG

SEQ ID NO: 109986 - protein, 33 aa, Artificial Sequence
  Description of Artificial Sequence: Synthetic polypeptide
DESEIRTTNPVATGCWGSVSCINEPQDREGENG

SEQ ID NO: 109987 - protein, 33 aa, Artificial Sequence
  Description of Artificial Sequence: Synthetic polypeptide
DENEIRTTNPVATEQYGSSSTDWQNRTMSSQDH

SEQ ID NO: 109988 - protein, 37 aa, Artificial Sequence
  Description of Artificial Sequence: Synthetic polypeptide
AEEEIRTTNPVATEQYGSVSTVTQGNLQQNIGTNTEY

SEQ ID NO: 109989 - protein, 37 aa, Artificial Sequence
  Description of Artificial Sequence: Synthetic polypeptide
AEEEIRTTNPVATEQYGSVSTVTNSNLNNEQQGNNVD

SEQ ID NO: 109990 - protein, 33 aa, Artificial Sequence
  Description of Artificial Sequence: Synthetic polypeptide
SAEEIATTNPVATEQYGSVATNLTEAEGGNEEE

SEQ ID NO: 109991 - protein, 34 aa, Artificial Sequence
  Description of Artificial Sequence: Synthetic polypeptide
DENEIRTTNPVATEQYGSCSPDNWGENRSGSNQI

SEQ ID NO: 109992 - protein, 33 aa, Artificial Sequence
  Description of Artificial Sequence: Synthetic polypeptide
SAEEIATTNPVATEQYGSVCAANLQDQGGNETD

SEQ ID NO: 109993 - protein, 33 aa, Artificial Sequence
  Description of Artificial Sequence: Synthetic polypeptide
SAEEIATTNPVATEQYGSVCAANLQDSDGNDMK

SEQ ID NO: 109994 - protein, 32 aa, Artificial Sequence
  Description of Artificial Sequence: Synthetic polypeptide
SAEEIATTNPVATEQYGSVCSPPGQEAEDGNP

SEQ ID NO: 109995 - protein, 34 aa, Artificial Sequence
  Description of Artificial Sequence: Synthetic polypeptide
DENEIRTTNPVATEQYGSCCSVTWPLEDRENEGD

SEQ ID NO: 109996 - protein, 34 aa, Artificial Sequence
  Description of Artificial Sequence: Synthetic polypeptide
DENEIRTTNPVATEQYGSCAVVTHDLQTGEEQQY

SEQ ID NO: 109997 - protein, 34 aa, Artificial Sequence
  Description of Artificial Sequence: Synthetic polypeptide
DENEIRTTNPVATEQYGSCASVTHDLQTGEEQED

SEQ ID NO: 109998 - protein, 33 aa, Artificial Sequence
  Description of Artificial Sequence: Synthetic polypeptide
SAEEIATTNPVAYEQYGSVATNLQAAPGTNGNM

SEQ ID NO: 109999 - protein, 32 aa, Artificial Sequence
  Description of Artificial Sequence: Synthetic polypeptide
SAEEIATTNPVAYEQYGSVATNLQDAGPQGDM

SEQ ID NO: 110000 - protein, 35 aa, Artificial Sequence
  Description of Artificial Sequence: Synthetic polypeptide
AEEEIRTTNPVATEQYGSVSTVTNQQQTQEGTISE

SEQ ID NO: 110001 - protein, 33 aa, Artificial Sequence
  Description of Artificial Sequence: Synthetic polypeptide
QAEEIATTNPVATEQYGSVCAGTNDQDGDQTNE

SEQ ID NO: 110002 - protein, 33 aa, Artificial Sequence
  Description of Artificial Sequence: Synthetic polypeptide
QAEEIATTNPVATEQYGSVCAANNLQEAGEQNQ

SEQ ID NO: 110003 - protein, 33 aa, Artificial Sequence
  Description of Artificial Sequence: Synthetic polypeptide
QAEEIATTNPVATEQYGSVATNLTANPGENAEE

SEQ ID NO: 110004 - protein, 35 aa, Artificial Sequence
  Description of Artificial Sequence: Synthetic polypeptide
AEEEIRTTNPVATEQYGSVVVSVTNNQEQENNEDE

SEQ ID NO: 110005 - protein, 30 aa, Artificial Sequence
  Description of Artificial Sequence: Synthetic polypeptide
DENEIRTTNPVATEQYGNVSEIEMNAAEDA

SEQ ID NO: 110006 - protein, 36 aa, Artificial Sequence
  Description of Artificial Sequence: Synthetic polypeptide
AEEEIRTTNPVATEQYGSVSTVTNQQQQGNQENNQD

SEQ ID NO: 110007 - protein, 35 aa, Artificial Sequence
  Description of Artificial Sequence: Synthetic polypeptide
DENEIRTTNPVATEQYGMSISLTFNETIREGDTRG

SEQ ID NO: 110008 - protein, 31 aa, Artificial Sequence
  Description of Artificial Sequence: Synthetic polypeptide
SAQEIATTNPVATEQWGCVAGTGLQEMGNRN

SEQ ID NO: 110009 - protein, 36 aa, Artificial Sequence
  Description of Artificial Sequence: Synthetic polypeptide
AEEEIRTTNPVATEQYGSVSTVTNQQQQGEQENEEG

SEQ ID NO: 110010 - protein, 33 aa, Artificial Sequence
  Description of Artificial Sequence: Synthetic polypeptide
DESEIRTTNPVATRCWGSVSCINEPQDREGENG

SEQ ID NO: 110011 - protein, 33 aa, Artificial Sequence
  Description of Artificial Sequence: Synthetic polypeptide
DESEIRTTNPVATSCWGSVSCINEPQDREGENG

SEQ ID NO: 110012 - protein, 30 aa, Artificial Sequence
  Description of Artificial Sequence: Synthetic polypeptide
DENEIRTTNPVATEQYGEVSEIEMNAAEDA

SEQ ID NO: 110013 - protein, 30 aa, Artificial Sequence
  Description of Artificial Sequence: Synthetic polypeptide
SDECIATTNPVATEQWGKVSHTNDHQQDNP

SEQ ID NO: 110014 - protein, 36 aa, Artificial Sequence
  Description of Artificial Sequence: Synthetic polypeptide
AEEEIRTTNPVATEQYGSVSTVTNSQAGNTEAGNNL

SEQ ID NO: 110015 - protein, 37 aa, Artificial Sequence
  Description of Artificial Sequence: Synthetic polypeptide
AEEEIRTTNPVATEQYGSVSTVTQGNLQQTIGTNSQD

SEQ ID NO: 110016 - protein, 33 aa, Artificial Sequence
  Description of Artificial Sequence: Synthetic polypeptide
SAEEIATTNPVATEQWGTSSTGNPLQARGENEN

SEQ ID NO: 110017 - protein, 34 aa, Artificial Sequence
  Description of Artificial Sequence: Synthetic polypeptide
DENEIRTTNPVATEQYGSCVSDTEVLPDNIDNQE

SEQ ID NO: 110018 - protein, 33 aa, Artificial Sequence
  Description of Artificial Sequence: Synthetic polypeptide
DENEIRTTNPVATEQYGSIYLTFSETIREGLRG

SEQ ID NO: 110019 - protein, 32 aa, Artificial Sequence
  Description of Artificial Sequence: Synthetic polypeptide
QAEEIATTNPVAYEQYGSVATNLQDAPPNNNN

SEQ ID NO: 110020 - protein, 34 aa, Artificial Sequence
  Description of Artificial Sequence: Synthetic polypeptide
DENEIRTTNPVATEQYGSISTTPDGPNMRNGMNV

SEQ ID NO: 110021 - protein, 37 aa, Artificial Sequence
  Description of Artificial Sequence: Synthetic polypeptide
AEEEIRTTNPVATEQYGSVSTVTQGNLQQIGTNTEDN

SEQ ID NO: 110022 - protein, 37 aa, Artificial Sequence
  Description of Artificial Sequence: Synthetic polypeptide
AEEEIRTTNPVATEQYGSVSTVTQGNLQQIGTNSEEQ

SEQ ID NO: 110023 - protein, 33 aa, Artificial Sequence
  Description of Artificial Sequence: Synthetic polypeptide
DESEIRTTNPVATMCWGSVSIINEPQDREGENG

SEQ ID NO: 110024 - protein, 37 aa, Artificial Sequence
  Description of Artificial Sequence: Synthetic polypeptide
AEEEIRTTNPVATEQYGSVSTVTQGNLQDEIGTNSED

SEQ ID NO: 110025 - protein, 37 aa, Artificial Sequence
  Description of Artificial Sequence: Synthetic polypeptide
AEEEIRTTNPVATEQYGSVSTVTQGNLQAGIGTNSEY

SEQ ID NO: 110026 - protein, 36 aa, Artificial Sequence
  Description of Artificial Sequence: Synthetic polypeptide
AEEEIRTTNPVATEQYGSVSTVTNVNQQGTEGNNQE

SEQ ID NO: 110027 - protein, 33 aa, Artificial Sequence
  Description of Artificial Sequence: Synthetic polypeptide
DESEIRTTNPVATNCWGSVSCINEPQDREGENG

SEQ ID NO: 110028 - protein, 33 aa, Artificial Sequence
  Description of Artificial Sequence: Synthetic polypeptide
DESEIRTTNPVATNCWGSVSCINEYQDREGENG

SEQ ID NO: 110029 - protein, 37 aa, Artificial Sequence
  Description of Artificial Sequence: Synthetic polypeptide
AEEEIRTTNPVATEQYGSVSTVTNVNLQQGTEGNEDT

SEQ ID NO: 110030 - protein, 36 aa, Artificial Sequence
  Description of Artificial Sequence: Synthetic polypeptide
AEEEIRTTNPVATEQYGSVSTVTNVEQGNQDGTNTA

SEQ ID NO: 110031 - protein, 33 aa, Artificial Sequence
  Description of Artificial Sequence: Synthetic polypeptide
QAEEIATTNPVAYEQYGSVATNLQDAGGPQGNP

SEQ ID NO: 110032 - protein, 33 aa, Artificial Sequence
  Description of Artificial Sequence: Synthetic polypeptide
DENEIRTTNPVATEQYGSIELTFNETIAEGLRG

SEQ ID NO: 110033 - protein, 32 aa, Artificial Sequence
  Description of Artificial Sequence: Synthetic polypeptide
SAEEIATTNPVATEQWGCVAGANLQDADGNRN

SEQ ID NO: 110034 - protein, 32 aa, Artificial Sequence
  Description of Artificial Sequence: Synthetic polypeptide
SAEEIATTNPVATEQWGCVAGTGLQDEGDNDR

SEQ ID NO: 110035 - protein, 33 aa, Artificial Sequence
  Description of Artificial Sequence: Synthetic polypeptide
DESEIRTTNPVATQCWGSVSCINEPQDREGENG

SEQ ID NO: 110036 - protein, 32 aa, Artificial Sequence
  Description of Artificial Sequence: Synthetic polypeptide
DENEIRTTNPVATEQYGSCYPNNQMESEINFG

SEQ ID NO: 110037 - protein, 33 aa, Artificial Sequence
  Description of Artificial Sequence: Synthetic polypeptide
DENEIRTTNPVATEQYGSCWVTLDIEQQGNDGM

SEQ ID NO: 110038 - protein, 32 aa, Artificial Sequence
  Description of Artificial Sequence: Synthetic polypeptide
SAEEIATTNPVATEQWGCVAGTNLADAGGNRN

SEQ ID NO: 110039 - protein, 31 aa, Artificial Sequence
  Description of Artificial Sequence: Synthetic polypeptide
QAEEIATTNPVAYEQYGSVATNLQANPAPEN

SEQ ID NO: 110040 - protein, 33 aa, Artificial Sequence
  Description of Artificial Sequence: Synthetic polypeptide
QAEEIATTNPVAYEQYGSACSATNDIPQDNGNR

SEQ ID NO: 110041 - protein, 35 aa, Artificial Sequence
  Description of Artificial Sequence: Synthetic polypeptide
DENEIRTTNPVATEQYGSCWCTMNIEQQEGNDDRV

SEQ ID NO: 110042 - protein, 35 aa, Artificial Sequence
  Description of Artificial Sequence: Synthetic polypeptide
DENEIRTTNPVATEQYGSCVVSITNLENGSEQQEI

SEQ ID NO: 110043 - protein, 36 aa, Artificial Sequence
  Description of Artificial Sequence: Synthetic polypeptide
AEEEIRTTNPVATEQYGSVSTVTNTNLNLEQANNVE

SEQ ID NO: 110044 - protein, 28 aa, Artificial Sequence
  Description of Artificial Sequence: Synthetic peptide
REEEIATTNPVATEQYGEAPEVCQHEEK

SEQ ID NO: 110045 - protein, 35 aa, Artificial Sequence
  Description of Artificial Sequence: Synthetic polypeptide
DENEIRTTNPVATEQYGSVMITNGDETTQSGQDNQ

SEQ ID NO: 110046 - protein, 37 aa, Artificial Sequence
  Description of Artificial Sequence: Synthetic polypeptide
AEEEIRTTNPVATEQYGSVSTVTTNLQNSENGTNTTE

SEQ ID NO: 110047 - protein, 28 aa, Artificial Sequence
  Description of Artificial Sequence: Synthetic peptide
QDEEIATTNPVATEQYGEAAEVCQREEK

SEQ ID NO: 110048 - protein, 28 aa, Artificial Sequence
  Description of Artificial Sequence: Synthetic peptide
QCNEIATTNPVATECYGDVSECLQHEEL

SEQ ID NO: 110049 - protein, 28 aa, Artificial Sequence
  Description of Artificial Sequence: Synthetic peptide
QETEICATNPIISEQYGVVSVNLQSGTS

SEQ ID NO: 110050 - protein, 29 aa, Artificial Sequence
  Description of Artificial Sequence: Synthetic peptide
QETEICATNPISYEQYGVVSVNLQSGTER

SEQ ID NO: 110051 - protein, 28 aa, Artificial Sequence
  Description of Artificial Sequence: Synthetic peptide
QCGEIAPTNPCSSEQYGIVSSNLQSGTR

SEQ ID NO: 110052 - protein, 34 aa, Artificial Sequence
  Description of Artificial Sequence: Synthetic polypeptide
DESEIRTTNPVATEVWGSAVSCINEPQDREGENG

SEQ ID NO: 110053 - protein, 28 aa, Artificial Sequence
  Description of Artificial Sequence: Synthetic peptide
QCGEIAPTNPCSSEQYGIVSCNLQSGTR

SEQ ID NO: 110054 - protein, 29 aa, Artificial Sequence
  Description of Artificial Sequence: Synthetic peptide
QETEIRTTNPCSTECWGIVSCNLQSGPYI

SEQ ID NO: 110055 - protein, 33 aa, Artificial Sequence
  Description of Artificial Sequence: Synthetic polypeptide
QETEIRTTNPVAVEQYGSVIITNGLEGGNGGGI

SEQ ID NO: 110056 - protein, 28 aa, Artificial Sequence
  Description of Artificial Sequence: Synthetic peptide
QANEIATTNPVATECYGDVSECLQHEEL

SEQ ID NO: 110057 - protein, 28 aa, Artificial Sequence
  Description of Artificial Sequence: Synthetic peptide
QETSIAPTNPCSSEQYGIVSCNLQSGTR

SEQ ID NO: 110058 - protein, 28 aa, Artificial Sequence
  Description of Artificial Sequence: Synthetic peptide
QAGEIAPTNPCSSEQYGIVSCNLQSGTR

SEQ ID NO: 110059 - protein, 34 aa, Artificial Sequence
  Description of Artificial Sequence: Synthetic polypeptide
DESEIRTTNPVATEVWGSVSCITEPQDREGENGY

SEQ ID NO: 110060 - protein, 28 aa, Artificial Sequence
  Description of Artificial Sequence: Synthetic peptide
QEVEIASTNPVATECYGDVSECLQHEEL

SEQ ID NO: 110061 - protein, 29 aa, Artificial Sequence
  Description of Artificial Sequence: Synthetic peptide
QEVEIATTNPVATECYGDVSCDLQHEELC

SEQ ID NO: 110062 - protein, 34 aa, Artificial Sequence
  Description of Artificial Sequence: Synthetic polypeptide
DESEIRTTNPVATEWCWGSVSCINEPQDREGENG

SEQ ID NO: 110063 - protein, 28 aa, Artificial Sequence
  Description of Artificial Sequence: Synthetic peptide
QEVEIATTNPVATECYGDVSEMVQHEEL

SEQ ID NO: 110064 - protein, 33 aa, Artificial Sequence
  Description of Artificial Sequence: Synthetic polypeptide
DENEIRTTNPVATEQYGSVSANDTVEGSQEEHD

SEQ ID NO: 110065 - protein, 32 aa, Artificial Sequence
  Description of Artificial Sequence: Synthetic polypeptide
QEVEIATTNPVATEQYGSVSATDLEDGEGEDL

SEQ ID NO: 110066 - protein, 31 aa, Artificial Sequence
  Description of Artificial Sequence: Synthetic polypeptide
QEVEIATTNPVAYEAWGSVSTNLGGADNDGR

SEQ ID NO: 110067 - protein, 32 aa, Artificial Sequence
  Description of Artificial Sequence: Synthetic polypeptide
QEVEIGTTNPVATEQYGSVSVANAGMEGGNGG

SEQ ID NO: 110068 - protein, 34 aa, Artificial Sequence
  Description of Artificial Sequence: Synthetic polypeptide
QEVEIRTTNPVATEQYGSVSINGLGDQGGGFDET

SEQ ID NO: 110069 - protein, 34 aa, Artificial Sequence
  Description of Artificial Sequence: Synthetic polypeptide
DESEIRTTNPVATEWWGSTVSCINEPQDREGENG

SEQ ID NO: 110070 - protein, 34 aa, Artificial Sequence
  Description of Artificial Sequence: Synthetic polypeptide
DENEIRTTNPVATEQYGSVSAMEDIQEDHNGNDL

SEQ ID NO: 110071 - protein, 36 aa, Artificial Sequence
  Description of Artificial Sequence: Synthetic polypeptide
AEEEIRTTNPVATEQYGSVSTVTTNNQGNGDEANED

SEQ ID NO: 110072 - protein, 34 aa, Artificial Sequence
  Description of Artificial Sequence: Synthetic polypeptide
DESEIRTTNPVATETWGSVSACINEPQDREGENG

SEQ ID NO: 110073 - protein, 33 aa, Artificial Sequence
  Description of Artificial Sequence: Synthetic polypeptide
DENEIRTTNPVATEQYGSVSAIWDQIEGSEEHV

SEQ ID NO: 110074 - protein, 28 aa, Artificial Sequence
  Description of Artificial Sequence: Synthetic peptide
QDEEIATTNPVATEQYGEVAEVCQHEQK

SEQ ID NO: 110075 - protein, 34 aa, Artificial Sequence
  Description of Artificial Sequence: Synthetic polypeptide
DESEIRTTNPVATETCWGSVSWINEPQDREGENG

SEQ ID NO: 110076 - protein, 29 aa, Artificial Sequence
  Description of Artificial Sequence: Synthetic peptide
QESEVATTNPVSTECYGNVSECIQRVGER

SEQ ID NO: 110077 - protein, 28 aa, Artificial Sequence
  Description of Artificial Sequence: Synthetic peptide
QDGEIASTNPCSSEQYGIVSCNLQSGTR

SEQ ID NO: 110078 - protein, 28 aa, Artificial Sequence
  Description of Artificial Sequence: Synthetic peptide
QETAIATTNPVATECYGDVSECLQHEEL

SEQ ID NO: 110079 - protein, 29 aa, Artificial Sequence
  Description of Artificial Sequence: Synthetic peptide
QETEIAPTNPCASEQYGIVSNADLQSGTR

SEQ ID NO: 110080 - protein, 28 aa, Artificial Sequence
  Description of Artificial Sequence: Synthetic peptide
QETEIAPTNPCATECWGIVSANWQSGPR

SEQ ID NO: 110081 - protein, 28 aa, Artificial Sequence
  Description of Artificial Sequence: Synthetic peptide
QETEIAPTNPCSSEQWGIVSCNLQSGTR

SEQ ID NO: 110082 - protein, 28 aa, Artificial Sequence
  Description of Artificial Sequence: Synthetic peptide
QETEIAPTNPCSSEQYGIVSADLQSGTR

SEQ ID NO: 110083 - protein, 34 aa, Artificial Sequence
  Description of Artificial Sequence: Synthetic polypeptide
DENEIRTTNPVATEQYGSVSDWVNMESRFGPQDM

SEQ ID NO: 110084 - protein, 33 aa, Artificial Sequence
  Description of Artificial Sequence: Synthetic polypeptide
DENEIRTTNPVATEQYGSVSDWGMESRFGIQDM

SEQ ID NO: 110085 - protein, 33 aa, Artificial Sequence
  Description of Artificial Sequence: Synthetic polypeptide
DESEIRTTNPVATESWGSVSCINEPHDREGENG

SEQ ID NO: 110086 - protein, 34 aa, Artificial Sequence
  Description of Artificial Sequence: Synthetic polypeptide
DENEIRTTNPVATEQYGSVSDWCNMESDFGNQDM

SEQ ID NO: 110087 - protein, 28 aa, Artificial Sequence
  Description of Artificial Sequence: Synthetic peptide
QETEIASTNPVGTEGYGVSASTLQHGDI

SEQ ID NO: 110088 - protein, 28 aa, Artificial Sequence
  Description of Artificial Sequence: Synthetic peptide
QETEIATTNPCSSECWGIVSCNLQSGTR

SEQ ID NO: 110089 - protein, 28 aa, Artificial Sequence
  Description of Artificial Sequence: Synthetic peptide
QDGEIAPTNPVSSEQYGNVSCNIQSGTR

SEQ ID NO: 110090 - protein, 28 aa, Artificial Sequence
  Description of Artificial Sequence: Synthetic peptide
QDGEIAPTNPCSSEQYGIVSCNLQSGTR

SEQ ID NO: 110091 - protein, 29 aa, Artificial Sequence
  Description of Artificial Sequence: Synthetic peptide
QDEEIATTNPVSTEQYGEVPAEVCQHGER

SEQ ID NO: 110092 - protein, 34 aa, Artificial Sequence
  Description of Artificial Sequence: Synthetic polypeptide
DENEIRTTNPVATEQYGSVSDTNATEYEGSDQSD

SEQ ID NO: 110093 - protein, 29 aa, Artificial Sequence
  Description of Artificial Sequence: Synthetic peptide
QETEIATTNPVATECYGDVSECLQHELEL

SEQ ID NO: 110094 - protein, 29 aa, Artificial Sequence
  Description of Artificial Sequence: Synthetic peptide
QETEIATTNPVATECYGDVSECLQHKEEL

SEQ ID NO: 110095 - protein, 34 aa, Artificial Sequence
  Description of Artificial Sequence: Synthetic polypeptide
DENEIRTTNPVATEQYGSVSDANDQIEGSPEEHV

SEQ ID NO: 110096 - protein, 28 aa, Artificial Sequence
  Description of Artificial Sequence: Synthetic peptide
QDEEIATTNPVSTEQYGEAPEVCQHGER

SEQ ID NO: 110097 - protein, 28 aa, Artificial Sequence
  Description of Artificial Sequence: Synthetic peptide
QDEEIATTNPVATEQYGNAAEVCQHGEK

SEQ ID NO: 110098 - protein, 28 aa, Artificial Sequence
  Description of Artificial Sequence: Synthetic peptide
QDEEIATTNPVATEQYGEVPEVCQHEQK

SEQ ID NO: 110099 - protein, 33 aa, Artificial Sequence
  Description of Artificial Sequence: Synthetic polypeptide
DENEIRTTNPVATEQYGSVSCVPNNQLFSQEHG

SEQ ID NO: 110100 - protein, 33 aa, Artificial Sequence
  Description of Artificial Sequence: Synthetic polypeptide
DENEIRTTNPVATEQYGSVSCTPDEQNSSQEIE

SEQ ID NO: 110101 - protein, 28 aa, Artificial Sequence
  Description of Artificial Sequence: Synthetic peptide
QDEEIATTNPVATEQYGEVPEVCQHEEK

SEQ ID NO: 110102 - protein, 33 aa, Artificial Sequence
  Description of Artificial Sequence: Synthetic polypeptide
DESEIRTTNPVATEWWGSVSCIKEPQDREGENG

SEQ ID NO: 110103 - protein, 32 aa, Artificial Sequence
  Description of Artificial Sequence: Synthetic polypeptide
DENEIRTTNPVATEQYGSVSAEIEEDAEGDDL

SEQ ID NO: 110104 - protein, 28 aa, Artificial Sequence
  Description of Artificial Sequence: Synthetic peptide
QEWEIATTNPVATECYGDVCECLQHEEL

SEQ ID NO: 110105 - protein, 28 aa, Artificial Sequence
  Description of Artificial Sequence: Synthetic peptide
QNNEIATTNPVATECYGDVSECLQSEEL

SEQ ID NO: 110106 - protein, 34 aa, Artificial Sequence
  Description of Artificial Sequence: Synthetic polypeptide
DENEIRTTNPVATEQYGSVNPWDLLERIGDNFQQ

SEQ ID NO: 110107 - protein, 28 aa, Artificial Sequence
  Description of Artificial Sequence: Synthetic peptide
QPNEIATTNPVATECYGFVSECLQHEEL

SEQ ID NO: 110108 - protein, 33 aa, Artificial Sequence
  Description of Artificial Sequence: Synthetic polypeptide
DESEIRTTNPVATFCWGSVSCINEPQDREGENG

SEQ ID NO: 110109 - protein, 28 aa, Artificial Sequence
  Description of Artificial Sequence: Synthetic peptide
QQEEIATTNPVATEQYGEAPEVLQHEEK

SEQ ID NO: 110110 - protein, 28 aa, Artificial Sequence
  Description of Artificial Sequence: Synthetic peptide
QQGEIAPTNPCSSEQYGIVSCNLQSGTR

SEQ ID NO: 110111 - protein, 28 aa, Artificial Sequence
  Description of Artificial Sequence: Synthetic peptide
QQIEIAPTNPCSSEQYGIVSCNLQSGTR

SEQ ID NO: 110112 - protein, 36 aa, Artificial Sequence
  Description of Artificial Sequence: Synthetic polypeptide
AEEEIRTTNPVATEQYGSVSTVTTNNNNQDEGTNVE

SEQ ID NO: 110113 - protein, 35 aa, Artificial Sequence
  Description of Artificial Sequence: Synthetic polypeptide
QSEEIRTTNPVATEQWGCSVPSCTTELQGTGVNRH

SEQ ID NO: 110114 - protein, 32 aa, Artificial Sequence
  Description of Artificial Sequence: Synthetic polypeptide
QSEEIRTTNPVAYEHWGSVGSTNPQRMETNAC

SEQ ID NO: 110115 - protein, 28 aa, Artificial Sequence
  Description of Artificial Sequence: Synthetic peptide
QSGEIAPTNPCSSEQYGIVSCNLQSGTR

SEQ ID NO: 110116 - protein, 28 aa, Artificial Sequence
  Description of Artificial Sequence: Synthetic peptide
QSNEIATTNPVATECYGDVSECLQDEEL

SEQ ID NO: 110117 - protein, 28 aa, Artificial Sequence
  Description of Artificial Sequence: Synthetic peptide
QSNEIATTNPVATECYGDVSECLQHEEL

SEQ ID NO: 110118 - protein, 28 aa, Artificial Sequence
  Description of Artificial Sequence: Synthetic peptide
QTGEIAPTNPCSSEQYGIVSCNLQGGTR

SEQ ID NO: 110119 - protein, 35 aa, Artificial Sequence
  Description of Artificial Sequence: Synthetic polypeptide
DENEIRTTNPVATEQYGSVMSQNLDIFNIGNGNGG

SEQ ID NO: 110120 - protein, 28 aa, Artificial Sequence
  Description of Artificial Sequence: Synthetic peptide
QTGEIAPTNPCSSEQYGIVSCNLQSGTR

SEQ ID NO: 110121 - protein, 33 aa, Artificial Sequence
  Description of Artificial Sequence: Synthetic polypeptide
DENEIRTTNPVATEQYGSVMSQNDIFNENMNED

SEQ ID NO: 110122 - protein, 33 aa, Artificial Sequence
  Description of Artificial Sequence: Synthetic polypeptide
DENEIRTTNPVATEQYGSVMSQNDIFNENGGDD

SEQ ID NO: 110123 - protein, 28 aa, Artificial Sequence
  Description of Artificial Sequence: Synthetic peptide
QTNEIATTNPVATECYGDVSECLQHEEL

SEQ ID NO: 110124 - protein, 34 aa, Artificial Sequence
  Description of Artificial Sequence: Synthetic polypeptide
DENEIRTTNPVATEQYGSVMSQNDIFNEGNGGGG

SEQ ID NO: 110125 - protein, 33 aa, Artificial Sequence
  Description of Artificial Sequence: Synthetic polypeptide
DENEIRTTNPVATEQYGSVMSQMNDIFNENENI

SEQ ID NO: 110126 - protein, 34 aa, Artificial Sequence
  Description of Artificial Sequence: Synthetic polypeptide
DENEIRTTNPVATEQYGSVMSNQPNIFQEEMNGD

SEQ ID NO: 110127 - protein, 28 aa, Artificial Sequence
  Description of Artificial Sequence: Synthetic peptide
QVGEIAPTNPCSSEQYGIVSCNLQSGTR

SEQ ID NO: 110128 - protein, 37 aa, Artificial Sequence
  Description of Artificial Sequence: Synthetic polypeptide
AEEEIRTTNPVATEQYGSVSTVTTNLQQQGTNNTEDD

SEQ ID NO: 110129 - protein, 34 aa, Artificial Sequence
  Description of Artificial Sequence: Synthetic polypeptide
DENEIRTTNPVATEQYGSVMSNQNLFEMEMNNGD

SEQ ID NO: 110130 - protein, 28 aa, Artificial Sequence
  Description of Artificial Sequence: Synthetic peptide
QNGEIAPTNPCSSEQYGIVSCNLQSGTR

SEQ ID NO: 110131 - protein, 35 aa, Artificial Sequence
  Description of Artificial Sequence: Synthetic polypeptide
DENEIRTTNPVATEQYGSVNVGSVSIKLQQRPMND

SEQ ID NO: 110132 - protein, 32 aa, Artificial Sequence
  Description of Artificial Sequence: Synthetic polypeptide
DENEIRTTNPVATEQYGSVPDPDLETERQVSM

SEQ ID NO: 110133 - protein, 34 aa, Artificial Sequence
  Description of Artificial Sequence: Synthetic polypeptide
CEEEIRTTNPVGYEHYGEKVSTNAPSQRAGDNRK

SEQ ID NO: 110134 - protein, 34 aa, Artificial Sequence
  Description of Artificial Sequence: Synthetic polypeptide
AEEEIRTTNPVATEQYGSVVVSVTNNNQEQETDD

SEQ ID NO: 110135 - protein, 36 aa, Artificial Sequence
  Description of Artificial Sequence: Synthetic polypeptide
DENEIRTTNPVATEQYGSVSAALNDNNARSGNESRQ

SEQ ID NO: 110136 - protein, 33 aa, Artificial Sequence
  Description of Artificial Sequence: Synthetic polypeptide
DENEIRTTNPVATEQYGSVSAAENQEILEEERN

SEQ ID NO: 110137 - protein, 32 aa, Artificial Sequence
  Description of Artificial Sequence: Synthetic polypeptide
DENEIRTTNPVATEQYGSVQVTEALILEMEQD

SEQ ID NO: 110138 - protein, 34 aa, Artificial Sequence
  Description of Artificial Sequence: Synthetic polypeptide
DESEIRTTNPVATEWWGSVSECINEPQDREGENG

SEQ ID NO: 110139 - protein, 32 aa, Artificial Sequence
  Description of Artificial Sequence: Synthetic polypeptide
DENEIRTTNPVATEQYGSVQTYLVINAAQSLE

SEQ ID NO: 110140 - protein, 32 aa, Artificial Sequence
  Description of Artificial Sequence: Synthetic polypeptide
DENEIRTTNPVATEQYGSVQTYGVIQAAQSLI

SEQ ID NO: 110141 - protein, 33 aa, Artificial Sequence
  Description of Artificial Sequence: Synthetic polypeptide
DESEIRTTNPVATEWWGSVYCINEPQDREGENG

SEQ ID NO: 110142 - protein, 33 aa, Artificial Sequence
  Description of Artificial Sequence: Synthetic polypeptide
DESEIRTTNPVATEYWGCVSWINENQERFGSNQ

SEQ ID NO: 110143 - protein, 35 aa, Artificial Sequence
  Description of Artificial Sequence: Synthetic polypeptide
CEEEIRTTNPVAYEQYGQSIVSYYNQLTQPGIERS

SEQ ID NO: 110144 - protein, 28 aa, Artificial Sequence
  Description of Artificial Sequence: Synthetic peptide
QEYEIATTNPVATECYGDVSECWQHEEL

SEQ ID NO: 110145 - protein, 35 aa, Artificial Sequence
  Description of Artificial Sequence: Synthetic polypeptide
CEEEIRTTNPVAYEQYGQSVSWYNDLTQEPGIERS

SEQ ID NO: 110146 - protein, 33 aa, Artificial Sequence
  Description of Artificial Sequence: Synthetic polypeptide
DENEIRTTNPVATEQYGEMTSTGNGDQDGGGDG

SEQ ID NO: 110147 - protein, 28 aa, Artificial Sequence
  Description of Artificial Sequence: Synthetic peptide
QEYEIATTNPVATEGYGDVVEQLQHEEL

SEQ ID NO: 110148 - protein, 32 aa, Artificial Sequence
  Description of Artificial Sequence: Synthetic polypeptide
QEYEIGTTNPVATEQYGSVITANAGMEGGNEG

SEQ ID NO: 110149 - protein, 28 aa, Artificial Sequence
  Description of Artificial Sequence: Synthetic peptide
QIGEIAPTNPCSSEQYGIVSCNLQSGTR

SEQ ID NO: 110150 - protein, 28 aa, Artificial Sequence
  Description of Artificial Sequence: Synthetic peptide
QLDEIAPTNPCSSEQYGIVSCNLQSGTR

SEQ ID NO: 110151 - protein, 28 aa, Artificial Sequence
  Description of Artificial Sequence: Synthetic peptide
QLGEIAPTNPCSSEQYGEVSCNLQSGTR

SEQ ID NO: 110152 - protein, 33 aa, Artificial Sequence
  Description of Artificial Sequence: Synthetic polypeptide
CEEEIRTTNPVCYEPYGAVSCAPNLSQRGGNNL

SEQ ID NO: 110153 - protein, 28 aa, Artificial Sequence
  Description of Artificial Sequence: Synthetic peptide
QLGEIAPTNPCSSEQYGIVSCNLQSGTR

SEQ ID NO: 110154 - protein, 28 aa, Artificial Sequence
  Description of Artificial Sequence: Synthetic peptide
QMGEIAPTNPCSSEQYGIVSCNLQSGTR

SEQ ID NO: 110155 - protein, 28 aa, Artificial Sequence
  Description of Artificial Sequence: Synthetic peptide
QMNEIATTNPVATECYGDVSECLQHEEL

SEQ ID NO: 110156 - protein, 36 aa, Artificial Sequence
  Description of Artificial Sequence: Synthetic polypeptide
AEEEIRTTNPVATEQYGSVSTVTTNNNQQGIGGNTE

SEQ ID NO: 110157 - protein, 28 aa, Artificial Sequence
  Description of Artificial Sequence: Synthetic peptide
QNGEIAPTNPCSCEQYGIVSCNLQSGTR

SEQ ID NO: 110158 - protein, 28 aa, Artificial Sequence
  Description of Artificial Sequence: Synthetic peptide
QNGEIAPTNPCSSEQYGCVSCNLQSGTR

SEQ ID NO: 110159 - protein, 33 aa, Artificial Sequence
  Description of Artificial Sequence: Synthetic polypeptide
DESEIRTTNPVATEYWGSVSWINEPQDNEGSNQ

SEQ ID NO: 110160 - protein, 33 aa, Artificial Sequence
  Description of Artificial Sequence: Synthetic polypeptide
DESEIRTTNPVATEYWGSVSWINENQDSFGSNQ

SEQ ID NO: 110161 - protein, 31 aa, Artificial Sequence
  Description of Artificial Sequence: Synthetic polypeptide
SDECIRTTNPVATEQWGGVSHTNDHQQDNEL

SEQ ID NO: 110162 - protein, 34 aa, Artificial Sequence
  Description of Artificial Sequence: Synthetic polypeptide
DENEIRTTNPVATEQYGEASTTPALPNMRGMNPV

SEQ ID NO: 110163 - protein, 31 aa, Artificial Sequence
  Description of Artificial Sequence: Synthetic polypeptide
SDECIRTTNPVATEQWGKVSHTNDHQGQNND

SEQ ID NO: 110164 - protein, 30 aa, Artificial Sequence
  Description of Artificial Sequence: Synthetic polypeptide
DENEIRTTNPVATEQWGTVSVEELNAAEDA

SEQ ID NO: 110165 - protein, 31 aa, Artificial Sequence
  Description of Artificial Sequence: Synthetic polypeptide
DENEIRTTNPVATEQWGTVSTVQENNAAEDT

SEQ ID NO: 110166 - protein, 32 aa, Artificial Sequence
  Description of Artificial Sequence: Synthetic polypeptide
DENEIRTTNPVATEQWGTVSTVISTNAGEDAG

SEQ ID NO: 110167 - protein, 31 aa, Artificial Sequence
  Description of Artificial Sequence: Synthetic polypeptide
DENEIRTTNPVATEQWGTVSTQQENNANEDA

SEQ ID NO: 110168 - protein, 31 aa, Artificial Sequence
  Description of Artificial Sequence: Synthetic polypeptide
DENEIRTTNPVATEQWGTVSTQIGNNATEDA

SEQ ID NO: 110169 - protein, 32 aa, Artificial Sequence
  Description of Artificial Sequence: Synthetic polypeptide
SEDEIATTNPVAYEPWGVVSTTNLQGDGNLRQ

SEQ ID NO: 110170 - protein, 36 aa, Artificial Sequence
  Description of Artificial Sequence: Synthetic polypeptide
AEEEIRTTNPVATEQYGSVSTVTNNQNDEQGENETD

SEQ ID NO: 110171 - protein, 31 aa, Artificial Sequence
  Description of Artificial Sequence: Synthetic polypeptide
QAEEIATTNPVATEQYGCVAANNLQDQGPGN

SEQ ID NO: 110172 - protein, 31 aa, Artificial Sequence
  Description of Artificial Sequence: Synthetic polypeptide
DENEIRTTNPVATEQWGTVSTESENNGAEDA

SEQ ID NO: 110173 - protein, 32 aa, Artificial Sequence
  Description of Artificial Sequence: Synthetic polypeptide
SEDEIRATNPVATEQYGSVFCELQDHQGHNQD

SEQ ID NO: 110174 - protein, 32 aa, Artificial Sequence
  Description of Artificial Sequence: Synthetic polypeptide
DENEIRTTNPVATEQWGTVSTEQQGNNAAEEA

SEQ ID NO: 110175 - protein, 31 aa, Artificial Sequence
  Description of Artificial Sequence: Synthetic polypeptide
DENEIRTTNPVATEQWGTVSTEQNENAAEDA

SEQ ID NO: 110176 - protein, 31 aa, Artificial Sequence
  Description of Artificial Sequence: Synthetic polypeptide
DENEIRTTNPVATEQWGTVSTEQENNIGEDA

SEQ ID NO: 110177 - protein, 31 aa, Artificial Sequence
  Description of Artificial Sequence: Synthetic polypeptide
DENEIRTTNPVATEQWGTVSTEQENNATEDN

SEQ ID NO: 110178 - protein, 31 aa, Artificial Sequence
  Description of Artificial Sequence: Synthetic polypeptide
DENEIRTTNPVATEQWGTVSTEQENNAAEGA

SEQ ID NO: 110179 - protein, 31 aa, Artificial Sequence
  Description of Artificial Sequence: Synthetic polypeptide
DENEIRTTNPVATEQWGTVSTEIETNNAEDT

SEQ ID NO: 110180 - protein, 31 aa, Artificial Sequence
  Description of Artificial Sequence: Synthetic polypeptide
DENEIRTTNPVATEQWGTVSTEEENNADEDA

SEQ ID NO: 110181 - protein, 32 aa, Artificial Sequence
  Description of Artificial Sequence: Synthetic polypeptide
DENEIRTTNPVATEQWGTVSTDQEGNNATEDA

SEQ ID NO: 110182 - protein, 31 aa, Artificial Sequence
  Description of Artificial Sequence: Synthetic polypeptide
DENEIRTTNPVATEQWGTVSTDIEENAAGDA

SEQ ID NO: 110183 - protein, 32 aa, Artificial Sequence
  Description of Artificial Sequence: Synthetic polypeptide
QAEEIATTNPVATEQYGCNVATNLQADGPGGN

SEQ ID NO: 110184 - protein, 37 aa, Artificial Sequence
  Description of Artificial Sequence: Synthetic polypeptide
AEEEIRTTNPVATEQYGSVSTVTNNQLNNQNGNNTNQ

SEQ ID NO: 110185 - protein, 30 aa, Artificial Sequence
  Description of Artificial Sequence: Synthetic polypeptide
DENEIRTTNPVATEQWGTVSEQNGNAAEQA

SEQ ID NO: 110186 - protein, 30 aa, Artificial Sequence
  Description of Artificial Sequence: Synthetic polypeptide
DENEIRTTNPVATEQWGTVSEQETNAGEDA

SEQ ID NO: 110187 - protein, 30 aa, Artificial Sequence
  Description of Artificial Sequence: Synthetic polypeptide
DENEIRTTNPVATEQWGTVSELELNEEEDA

SEQ ID NO: 110188 - protein, 32 aa, Artificial Sequence
  Description of Artificial Sequence: Synthetic polypeptide
SEDEIRCTNPVATEQYGCVYYTWNDQHGQNQN

SEQ ID NO: 110189 - protein, 30 aa, Artificial Sequence
  Description of Artificial Sequence: Synthetic polypeptide
DENEIRTTNPVATEQWGVVSEAEMNAINDA

SEQ ID NO: 110190 - protein, 37 aa, Artificial Sequence
  Description of Artificial Sequence: Synthetic polypeptide
AEEEIRTTNPVATEQYGSVSTVTNNQLGNQQGNNEGD

SEQ ID NO: 110191 - protein, 33 aa, Artificial Sequence
  Description of Artificial Sequence: Synthetic polypeptide
QAEEIATTNPVATEQYGCVAATNLMNGGGDNRL

SEQ ID NO: 110192 - protein, 30 aa, Artificial Sequence
  Description of Artificial Sequence: Synthetic polypeptide
DENEIRTTNPVATEQWGVVSENEMNAAEDA

SEQ ID NO: 110193 - protein, 36 aa, Artificial Sequence
  Description of Artificial Sequence: Synthetic polypeptide
AEEEIRTTNPVATEQYGSVSTVTNNQNQQQEGNNET

SEQ ID NO: 110194 - protein, 33 aa, Artificial Sequence
  Description of Artificial Sequence: Synthetic polypeptide
DENEIRTTNPVATEQYGCVCSTGYHQGFGSDQS

SEQ ID NO: 110195 - protein, 31 aa, Artificial Sequence
  Description of Artificial Sequence: Synthetic polypeptide
QAEEIATTNPVATEQYGCVAGTGLQDQGPGQ

SEQ ID NO: 110196 - protein, 34 aa, Artificial Sequence
  Description of Artificial Sequence: Synthetic polypeptide
SEAEIRTTNPVATEQYGSVISVTHDLQTGFSEQV

SEQ ID NO: 110197 - protein, 34 aa, Artificial Sequence
  Description of Artificial Sequence: Synthetic polypeptide
SEAEIRTTNPVATEQYGSVSSSLDTQEGGIENFG

SEQ ID NO: 110198 - protein, 33 aa, Artificial Sequence
  Description of Artificial Sequence: Synthetic polypeptide
DESEIRTTNPVAWECWGSVSCINEPQDREGENG

SEQ ID NO: 110199 - protein, 32 aa, Artificial Sequence
  Description of Artificial Sequence: Synthetic polypeptide
SEAETRTTNPVATECWGSVCSDTNTMMYRGDR

SEQ ID NO: 110200 - protein, 33 aa, Artificial Sequence
  Description of Artificial Sequence: Synthetic polypeptide
DENEIRTTNPVATEQYGCVCSTEHNQHFGSEQP

SEQ ID NO: 110201 - protein, 32 aa, Artificial Sequence
  Description of Artificial Sequence: Synthetic polypeptide
SECEIATTNPVATEGWGSVSTNLNGDTGGNTD

SEQ ID NO: 110202 - protein, 31 aa, Artificial Sequence
  Description of Artificial Sequence: Synthetic polypeptide
QAEEIATTNPVATEQYGCVAGTALADSENRW

SEQ ID NO: 110203 - protein, 31 aa, Artificial Sequence
  Description of Artificial Sequence: Synthetic polypeptide
DENEIRTTNPVATEQYGCTSVPLMENHMDER

SEQ ID NO: 110204 - protein, 32 aa, Artificial Sequence
  Description of Artificial Sequence: Synthetic polypeptide
QAEEIATTNPVATEQYGCVAGNNLQADGPNTN

SEQ ID NO: 110205 - protein, 36 aa, Artificial Sequence
  Description of Artificial Sequence: Synthetic polypeptide
AEEEIRTTNPVATEQYGSVSTVTNNQNQDEAGNEDT

SEQ ID NO: 110206 - protein, 32 aa, Artificial Sequence
  Description of Artificial Sequence: Synthetic polypeptide
SECEIATTNPVAYEGWGSVSTNLNQGDTGGNH

SEQ ID NO: 110207 - protein, 36 aa, Artificial Sequence
  Description of Artificial Sequence: Synthetic polypeptide
AEEEIRTTNPVATEQYGSVSTVTNNQNNQEGNNEEI

SEQ ID NO: 110208 - protein, 36 aa, Artificial Sequence
  Description of Artificial Sequence: Synthetic polypeptide
AEEEIRTTNPVATEQYGSVSTVTNNQNGDEQGNEDL

SEQ ID NO: 110209 - protein, 30 aa, Artificial Sequence
  Description of Artificial Sequence: Synthetic polypeptide
DENEIRTTNPVATEQWGWVSEIHMNLAEDA

SEQ ID NO: 110210 - protein, 30 aa, Artificial Sequence
  Description of Artificial Sequence: Synthetic polypeptide
DENEIRTTNPVATEQWGVVVVTENNAAEDA

SEQ ID NO: 110211 - protein, 30 aa, Artificial Sequence
  Description of Artificial Sequence: Synthetic polypeptide
DENEIRTTNPVATEQWGVVSVYSNNAAEDA

SEQ ID NO: 110212 - protein, 32 aa, Artificial Sequence
  Description of Artificial Sequence: Synthetic polypeptide
QAEEIATTNPVATEQYGCVAGNGLQDQGPGND

SEQ ID NO: 110213 - protein, 30 aa, Artificial Sequence
  Description of Artificial Sequence: Synthetic polypeptide
DENEIRTTNPVATEQWGVVSSIETNAFEDA

SEQ ID NO: 110214 - protein, 30 aa, Artificial Sequence
  Description of Artificial Sequence: Synthetic polypeptide
DENEIRTTNPVATEQWGVVSNGENNAAEDA

SEQ ID NO: 110215 - protein, 30 aa, Artificial Sequence
  Description of Artificial Sequence: Synthetic polypeptide
DENEIRTTNPVATEQWGVVSETETNAAEDA

SEQ ID NO: 110216 - protein, 30 aa, Artificial Sequence
  Description of Artificial Sequence: Synthetic polypeptide
DENEIRTTNPVATEQWGVVSESELNATEDA

SEQ ID NO: 110217 - protein, 36 aa, Artificial Sequence
  Description of Artificial Sequence: Synthetic polypeptide
AEEEIRTTNPVATEQYGSVSTVTNNQNGDEAGNTDY

SEQ ID NO: 110218 - protein, 31 aa, Artificial Sequence
  Description of Artificial Sequence: Synthetic polypeptide
DENEIRTTNPVATEQWGVVSEGEMNAAEGDA

SEQ ID NO: 110219 - protein, 34 aa, Artificial Sequence
  Description of Artificial Sequence: Synthetic polypeptide
DESEIRTTNPVAYECDGQVPSPTVMLSQRNVGNR

SEQ ID NO: 110220 - protein, 33 aa, Artificial Sequence
  Description of Artificial Sequence: Synthetic polypeptide
SEDEIRCTNPVATEQYGSVYCTWNDQMHGGNQD

SEQ ID NO: 110221 - protein, 33 aa, Artificial Sequence
  Description of Artificial Sequence: Synthetic polypeptide
DESEIRTTNPVAYECEGSVSCINEPQDREGENG

SEQ ID NO: 110222 - protein, 33 aa, Artificial Sequence
  Description of Artificial Sequence: Synthetic polypeptide
DESEIRTTNPVAYEEWGSVATGMNGDHQGGNSR

SEQ ID NO: 110223 - protein, 35 aa, Artificial Sequence
  Description of Artificial Sequence: Synthetic polypeptide
AEEEIRTTNPVATEQYGSVSTVTNNNQQQQNNNDE

SEQ ID NO: 110224 - protein, 35 aa, Artificial Sequence
  Description of Artificial Sequence: Synthetic polypeptide
AEEEIRTTNPVATEQYGSVSTVTNNNQQQQNNDEA

SEQ ID NO: 110225 - protein, 32 aa, Artificial Sequence
  Description of Artificial Sequence: Synthetic polypeptide
QAEEIATTNPVATEQWGCVAGTNLQAEMGNQN

SEQ ID NO: 110226 - protein, 33 aa, Artificial Sequence
  Description of Artificial Sequence: Synthetic polypeptide
DESEIRTTNPVAYEHWGSVSCQNESQDREGGNG

SEQ ID NO: 110227 - protein, 33 aa, Artificial Sequence
  Description of Artificial Sequence: Synthetic polypeptide
SEECEIRATNPVAYEPWGSVSTGNAQSQAGNNR

SEQ ID NO: 110228 - protein, 33 aa, Artificial Sequence
  Description of Artificial Sequence: Synthetic polypeptide
DESEIRTTNPVAYEHWGSVSCTNSSSDREGGNV

SEQ ID NO: 110229 - protein, 33 aa, Artificial Sequence
  Description of Artificial Sequence: Synthetic polypeptide
DESEIRTTNPVAYEIPYGSVCSTADTPRNGNHL

SEQ ID NO: 110230 - protein, 33 aa, Artificial Sequence
  Description of Artificial Sequence: Synthetic polypeptide
DESEIRTTNPVAYELWGSVSCINEPQDREGENG

SEQ ID NO: 110231 - protein, 32 aa, Artificial Sequence
  Description of Artificial Sequence: Synthetic polypeptide
DENEIRTTNPVATEQWGSVSTTIGMMAAGDPA

SEQ ID NO: 110232 - protein, 34 aa, Artificial Sequence
  Description of Artificial Sequence: Synthetic polypeptide
CEEEISTTNPVATEQYGCVCSNTEGLQNFGSNQS

SEQ ID NO: 110233 - protein, 32 aa, Artificial Sequence
  Description of Artificial Sequence: Synthetic polypeptide
DENEIRTTNPVATEQWGSVSTEIGMMAAGDPA

SEQ ID NO: 110234 - protein, 30 aa, Artificial Sequence
  Description of Artificial Sequence: Synthetic polypeptide
SEECIACTNPIAYEEPQYGSVSENLMRGDD

SEQ ID NO: 110235 - protein, 31 aa, Artificial Sequence
  Description of Artificial Sequence: Synthetic polypeptide
SEECIACTNPIAYEEQYGSVSENHLMRGDND

SEQ ID NO: 110236 - protein, 30 aa, Artificial Sequence
  Description of Artificial Sequence: Synthetic polypeptide
SEECIACTNPIAYEEQYGSVSENLMRHGDM

SEQ ID NO: 110237 - protein, 29 aa, Artificial Sequence
  Description of Artificial Sequence: Synthetic peptide
SEECIACTNPIAYQQYGSVSENLMRGATA

SEQ ID NO: 110238 - protein, 31 aa, Artificial Sequence
  Description of Artificial Sequence: Synthetic polypeptide
QAEEIATTNPVATAQWGSVSGTGNPDPDGND

SEQ ID NO: 110239 - protein, 32 aa, Artificial Sequence
  Description of Artificial Sequence: Synthetic polypeptide
DESEIRTTNPVAYEPYGETVFCHNLSQTGNPA

SEQ ID NO: 110240 - protein, 29 aa, Artificial Sequence
  Description of Artificial Sequence: Synthetic peptide
SEECIACTNPTAYEPYGSVASNLMRGNQM

SEQ ID NO: 110241 - protein, 30 aa, Artificial Sequence
  Description of Artificial Sequence: Synthetic polypeptide
SEECIACTNPTAYEQYGSVAANLMRGNEMD

SEQ ID NO: 110242 - protein, 32 aa, Artificial Sequence
  Description of Artificial Sequence: Synthetic polypeptide
DENEIRTTNPVATEQWGSVSEPAGMNAAGMNV

SEQ ID NO: 110243 - protein, 37 aa, Artificial Sequence
  Description of Artificial Sequence: Synthetic polypeptide
AEEEIRTTNPVATEQYGSVVVSVTNQLQQGNIGTTNL

SEQ ID NO: 110244 - protein, 32 aa, Artificial Sequence
  Description of Artificial Sequence: Synthetic polypeptide
DENEIRTTNPVATEQWGSVSENEPMNAEEENA

SEQ ID NO: 110245 - protein, 32 aa, Artificial Sequence
  Description of Artificial Sequence: Synthetic polypeptide
DENEIRTTNPVATEQWGSVSENEPMDAEEENA

SEQ ID NO: 110246 - protein, 37 aa, Artificial Sequence
  Description of Artificial Sequence: Synthetic polypeptide
AEEEIRTTNPVATEQYGSVVVSVTNQLQQGNNNNNNL

SEQ ID NO: 110247 - protein, 33 aa, Artificial Sequence
  Description of Artificial Sequence: Synthetic polypeptide
DESEIRTTNPVAYECWGSVSWWNEPQDRDGENG

SEQ ID NO: 110248 - protein, 33 aa, Artificial Sequence
  Description of Artificial Sequence: Synthetic polypeptide
DESEIRTTNPVAYECWGSVSWINEDQDRQGEND

SEQ ID NO: 110249 - protein, 33 aa, Artificial Sequence
  Description of Artificial Sequence: Synthetic polypeptide
DESEIRTTNPVAYECWGSVSWINDPQDREGEND

SEQ ID NO: 110250 - protein, 30 aa, Artificial Sequence
  Description of Artificial Sequence: Synthetic polypeptide
DENEIRTTNPVATEQWGTISMDEQQQAENA

SEQ ID NO: 110251 - protein, 30 aa, Artificial Sequence
  Description of Artificial Sequence: Synthetic polypeptide
DENEIRTTNPVATEQWGTVSEIIQNAAEDH

SEQ ID NO: 110252 - protein, 30 aa, Artificial Sequence
  Description of Artificial Sequence: Synthetic polypeptide
DENEIRTTNPVATEQWGTVSEIGTNAAEQA

SEQ ID NO: 110253 - protein, 33 aa, Artificial Sequence
  Description of Artificial Sequence: Synthetic polypeptide
DESEIRTTNPVAYECWGSVSCANFSQDRTGGNH

SEQ ID NO: 110254 - protein, 30 aa, Artificial Sequence
  Description of Artificial Sequence: Synthetic polypeptide
DENEIRTTNPVATEQWGTVSEIGNNATEEA

SEQ ID NO: 110255 - protein, 33 aa, Artificial Sequence
  Description of Artificial Sequence: Synthetic polypeptide
DESEIRTTNPVAYECWGSVSCINEPQDRDGHNG

SEQ ID NO: 110256 - protein, 33 aa, Artificial Sequence
  Description of Artificial Sequence: Synthetic polypeptide
DESEIRTTNPVAYECWGSVSCINEPQDREGENG

SEQ ID NO: 110257 - protein, 33 aa, Artificial Sequence
  Description of Artificial Sequence: Synthetic polypeptide
DESEIRTTNPVAYECWGSVSCLNISQDREGGNG

SEQ ID NO: 110258 - protein, 36 aa, Artificial Sequence
  Description of Artificial Sequence: Synthetic polypeptide
AEEEIRTTNPVATEQYGSVSTVTNNQGNGDEANEEQ

SEQ ID NO: 110259 - protein, 30 aa, Artificial Sequence
  Description of Artificial Sequence: Synthetic polypeptide
DENEIRTTNPVATEQWGTVSEIEMNAAENA

SEQ ID NO: 110260 - protein, 30 aa, Artificial Sequence
  Description of Artificial Sequence: Synthetic polypeptide
DENEIRTTNPVATEQWGTVSEHETNAAEDA

SEQ ID NO: 110261 - protein, 32 aa, Artificial Sequence
  Description of Artificial Sequence: Synthetic polypeptide
DENEIRTTNPVATEQWGTVSEHEMNAAEGDNA

SEQ ID NO: 110262 - protein, 30 aa, Artificial Sequence
  Description of Artificial Sequence: Synthetic polypeptide
DENEIRTTNPVATEQWGTVSEGGNNAGEDQ

SEQ ID NO: 110263 - protein, 36 aa, Artificial Sequence
  Description of Artificial Sequence: Synthetic polypeptide
AEEEIRTTNPVATEQYGSVSTVTNNQNSENGNNATD

SEQ ID NO: 110264 - protein, 30 aa, Artificial Sequence
  Description of Artificial Sequence: Synthetic polypeptide
DENEIRTTNPVATEQWGTVSEGENNNGEDA

SEQ ID NO: 110265 - protein, 30 aa, Artificial Sequence
  Description of Artificial Sequence: Synthetic polypeptide
DENEIRTTNPVATEQWGTVSEAENNATEDA

SEQ ID NO: 110266 - protein, 33 aa, Artificial Sequence
  Description of Artificial Sequence: Synthetic polypeptide
SEDEIRTTNPVATEQYGVLSATNTLWQEEGQDS

SEQ ID NO: 110267 - protein, 33 aa, Artificial Sequence
  Description of Artificial Sequence: Synthetic polypeptide
SEDEIRTTNPVAYECWGSVSTNLNQGNEGGDSR

SEQ ID NO: 110268 - protein, 33 aa, Artificial Sequence
  Description of Artificial Sequence: Synthetic polypeptide
DESEIRTTNPVAYECWGSVSCVNHSQDRTGENG

SEQ ID NO: 110269 - protein, 32 aa, Artificial Sequence
  Description of Artificial Sequence: Synthetic polypeptide
SEDEIRTTNPVAYEQWGEVSTNLNGDHGDNEQ

SEQ ID NO: 110270 - protein, 33 aa, Artificial Sequence
  Description of Artificial Sequence: Synthetic polypeptide
DESEIRTTNPVAYECWGSVSSGNESQDREGGNE

SEQ ID NO: 110271 - protein, 33 aa, Artificial Sequence
  Description of Artificial Sequence: Synthetic polypeptide
SEDEIRTTNPVAYEQWGSVCSTNDGNHQEGNTS

SEQ ID NO: 110272 - protein, 31 aa, Artificial Sequence
  Description of Artificial Sequence: Synthetic polypeptide
DENEIRTTNPVATEQWGTVCSTIEMNAAENA

SEQ ID NO: 110273 - protein, 33 aa, Artificial Sequence
  Description of Artificial Sequence: Synthetic polypeptide
SEDEIRTTNPVAYEQWGSVSGDNDNGQRGNEDS

SEQ ID NO: 110274 - protein, 32 aa, Artificial Sequence
  Description of Artificial Sequence: Synthetic polypeptide
DENEIRTTNPVATEQWGTVCSTDIEENFAGNA

SEQ ID NO: 110275 - protein, 32 aa, Artificial Sequence
  Description of Artificial Sequence: Synthetic polypeptide
SEDEIRTTNPVAYEQWGSVSWGDDKQRGMNVI

SEQ ID NO: 110276 - protein, 33 aa, Artificial Sequence
  Description of Artificial Sequence: Synthetic polypeptide
SEDEIRTTNPVAYEQWGSVSWVDDKQERGMNHR

SEQ ID NO: 110277 - protein, 36 aa, Artificial Sequence
  Description of Artificial Sequence: Synthetic polypeptide
AEEEIRTTNPVATEQYGSVSTVTNNQDNGDEAGNED

SEQ ID NO: 110278 - protein, 30 aa, Artificial Sequence
  Description of Artificial Sequence: Synthetic polypeptide
DESEIRTTNPVSTEGWGNVANIEQNRAGDR

SEQ ID NO: 110279 - protein, 36 aa, Artificial Sequence
  Description of Artificial Sequence: Synthetic polypeptide
AEEEIRTTNPVATEQYGSVSTVTNNQNSENGNNDTD

SEQ ID NO: 110280 - protein, 33 aa, Artificial Sequence
  Description of Artificial Sequence: Synthetic polypeptide
SEAEIRCTNPIAYEQYGSVVSENALSMRTGGNR

SEQ ID NO: 110281 - protein, 36 aa, Artificial Sequence
  Description of Artificial Sequence: Synthetic polypeptide
AEEEIRTTNPVATEQYGSVSTVTNQNNQEIGNNTEE

SEQ ID NO: 110282 - protein, 33 aa, Artificial Sequence
  Description of Artificial Sequence: Synthetic polypeptide
DESEIRTTNPVATTCWGSVSCINEPQDREGENG

SEQ ID NO: 110283 - protein, 33 aa, Artificial Sequence
  Description of Artificial Sequence: Synthetic polypeptide
DESEIRTTNPVATTCWGSVSCINEPQDRPGENG

SEQ ID NO: 110284 - protein, 32 aa, Artificial Sequence
  Description of Artificial Sequence: Synthetic polypeptide
SEAEIACTNPVATEQYGCVATNLQAEGPNEHQ

SEQ ID NO: 110285 - protein, 30 aa, Artificial Sequence
  Description of Artificial Sequence: Synthetic polypeptide
DENEIRTTNPVATEQYGDVSEIEMNAAQDA

SEQ ID NO: 110286 - protein, 31 aa, Artificial Sequence
  Description of Artificial Sequence: Synthetic polypeptide
DENEIRTTNPVATEQYGDVSEIEMNAAEKDA

SEQ ID NO: 110287 - protein, 32 aa, Artificial Sequence
  Description of Artificial Sequence: Synthetic polypeptide
SEAEIACTNPVATEQYGCVATNLQDQGNNEQA

SEQ ID NO: 110288 - protein, 30 aa, Artificial Sequence
  Description of Artificial Sequence: Synthetic polypeptide
DENEIRTTNPVATEQYGDVSEIEMNAAEDL

SEQ ID NO: 110289 - protein, 30 aa, Artificial Sequence
  Description of Artificial Sequence: Synthetic polypeptide
DENEIRTTNPVATEQYGDVSEIEMNAAEDA

SEQ ID NO: 110290 - protein, 30 aa, Artificial Sequence
  Description of Artificial Sequence: Synthetic polypeptide
DENEIRTTNPVATEQYGDVSEIEINAAEDA

SEQ ID NO: 110291 - protein, 31 aa, Artificial Sequence
  Description of Artificial Sequence: Synthetic polypeptide
DENEIRTTNPVATEQYGDVSEIEENAEGDDL

SEQ ID NO: 110292 - protein, 31 aa, Artificial Sequence
  Description of Artificial Sequence: Synthetic polypeptide
DENEIRTTNPVATEQYGDVSEIEENAAGDDL

SEQ ID NO: 110293 - protein, 31 aa, Artificial Sequence
  Description of Artificial Sequence: Synthetic polypeptide
DENEIRTTNPVATEQYGDVSEIEENAAGDDA

SEQ ID NO: 110294 - protein, 31 aa, Artificial Sequence
  Description of Artificial Sequence: Synthetic polypeptide
SEAEIACTNPVATEQYGSCATNLQAEADNNP

SEQ ID NO: 110295 - protein, 30 aa, Artificial Sequence
  Description of Artificial Sequence: Synthetic polypeptide
DENEIRTTNPVATEQYGDVSEIEENAAEDA

SEQ ID NO: 110296 - protein, 31 aa, Artificial Sequence
  Description of Artificial Sequence: Synthetic polypeptide
SEAEIACTNPVATEQYGSCATNLQAEDNEDE

SEQ ID NO: 110297 - protein, 32 aa, Artificial Sequence
  Description of Artificial Sequence: Synthetic polypeptide
SEAEIACTNPVATEQYGSCATNLQAPDENARE

SEQ ID NO: 110298 - protein, 32 aa, Artificial Sequence
  Description of Artificial Sequence: Synthetic polypeptide
DENEIRTTNPVATEQYGDVSEEIIQQNAAENA

SEQ ID NO: 110299 - protein, 32 aa, Artificial Sequence
  Description of Artificial Sequence: Synthetic polypeptide
DENEIRTTNPVATEQYGDVSEEIEQQNAAENA

SEQ ID NO: 110300 - protein, 35 aa, Artificial Sequence
  Description of Artificial Sequence: Synthetic polypeptide
AEEEIRTTNPVATEQYGSVSTVTNQNNNGEGNNED

SEQ ID NO: 110301 - protein, 32 aa, Artificial Sequence
  Description of Artificial Sequence: Synthetic polypeptide
DENEIRTTNPVATEQYGDVSEEIEQMNAAENA

SEQ ID NO: 110302 - protein, 31 aa, Artificial Sequence
  Description of Artificial Sequence: Synthetic polypeptide
DENEIRTTNPVATEQYGDVSEEIEMNAAENA

SEQ ID NO: 110303 - protein, 30 aa, Artificial Sequence
  Description of Artificial Sequence: Synthetic polypeptide
CAEEIACTNPVATEQWGGSSATNDQRDQNN

SEQ ID NO: 110304 - protein, 33 aa, Artificial Sequence
  Description of Artificial Sequence: Synthetic polypeptide
DESEIRTTNPVATTNWGVVSWTNDLDQRQTHNM

SEQ ID NO: 110305 - protein, 31 aa, Artificial Sequence
  Description of Artificial Sequence: Synthetic polypeptide
DENEIRTTNPVATEQYGDVSEDIQQNAAEDA

SEQ ID NO: 110306 - protein, 29 aa, Artificial Sequence
  Description of Artificial Sequence: Synthetic peptide
SEAEIACTNPCSSEQYGCVSWNLQSGDRA

SEQ ID NO: 110307 - protein, 32 aa, Artificial Sequence
  Description of Artificial Sequence: Synthetic polypeptide
SEAEIACTNPVATEQYGSVATNLQNPMENAEE

SEQ ID NO: 110308 - protein, 36 aa, Artificial Sequence
  Description of Artificial Sequence: Synthetic polypeptide
AEEEIRTTNPVATEQYGSVSTVTNQNNQENGNNNVE

SEQ ID NO: 110309 - protein, 30 aa, Artificial Sequence
  Description of Artificial Sequence: Synthetic polypeptide
DENEIRTTNPVATEQYGDVSEIEMNSAEDA

SEQ ID NO: 110310 - protein, 31 aa, Artificial Sequence
  Description of Artificial Sequence: Synthetic polypeptide
SDECIRTTNPVATEQWGWVSHTNDHQQDQNL

SEQ ID NO: 110311 - protein, 36 aa, Artificial Sequence
  Description of Artificial Sequence: Synthetic polypeptide
AEEEIRTTNPVATEQYGSVSTVTNQQQGNNDEESEP

SEQ ID NO: 110312 - protein, 32 aa, Artificial Sequence
  Description of Artificial Sequence: Synthetic polypeptide
DENEIRTTNPVATEQYGEASSEPAGPNRGNPV

SEQ ID NO: 110313 - protein, 29 aa, Artificial Sequence
  Description of Artificial Sequence: Synthetic peptide
DENEIRTTNPVATEQYGEASEICMNHEEA

SEQ ID NO: 110314 - protein, 29 aa, Artificial Sequence
  Description of Artificial Sequence: Synthetic peptide
DENEIRTTNPVATEQYGEASEICMNHEDA

SEQ ID NO: 110315 - protein, 35 aa, Artificial Sequence
  Description of Artificial Sequence: Synthetic polypeptide
AEEEIRTTNPVATEQYGSVSTVTNQQQEATNNDTQ

SEQ ID NO: 110316 - protein, 37 aa, Artificial Sequence
  Description of Artificial Sequence: Synthetic polypeptide
AEEEIRTTNPVATEQYGSVSTVTNQQLQQNQENGNQG

SEQ ID NO: 110317 - protein, 37 aa, Artificial Sequence
  Description of Artificial Sequence: Synthetic polypeptide
AEEEIRTTNPVATEQYGSVSTVTNQQLQGQTEQGNND

SEQ ID NO: 110318 - protein, 32 aa, Artificial Sequence
  Description of Artificial Sequence: Synthetic polypeptide
DENEIRTTNPVATEQYGDVSTIGPMNANEDPV

SEQ ID NO: 110319 - protein, 36 aa, Artificial Sequence
  Description of Artificial Sequence: Synthetic polypeptide
AEEEIRTTNPVATEQYGSVSTVTNQQGQEQGTNEEE

SEQ ID NO: 110320 - protein, 36 aa, Artificial Sequence
  Description of Artificial Sequence: Synthetic polypeptide
AEEEIRTTNPVATEQYGSVSTVTNQNSTQQGNNDEN

SEQ ID NO: 110321 - protein, 36 aa, Artificial Sequence
  Description of Artificial Sequence: Synthetic polypeptide
AEEEIRTTNPVATEQYGSVSTVTNQNQQQGTEGNNQ

SEQ ID NO: 110322 - protein, 29 aa, Artificial Sequence
  Description of Artificial Sequence: Synthetic peptide
SDEEIRTTNPVATEQWGTYSWNLTEEIAI

SEQ ID NO: 110323 - protein, 32 aa, Artificial Sequence
  Description of Artificial Sequence: Synthetic polypeptide
DENEIRTTNPVATEQYGDVSTAGPMNANGDPV

SEQ ID NO: 110324 - protein, 32 aa, Artificial Sequence
  Description of Artificial Sequence: Synthetic polypeptide
DENEIRTTNPVATEQYGDVSTAEPMMANEDPA

SEQ ID NO: 110325 - protein, 33 aa, Artificial Sequence
  Description of Artificial Sequence: Synthetic polypeptide
DENEIRTTNPVATEQYGDVSSTAGPMNANGNPV

SEQ ID NO: 110326 - protein, 33 aa, Artificial Sequence
  Description of Artificial Sequence: Synthetic polypeptide
DENEIRTTNPVATEQYGDVSSTAGPMMANGNPV

SEQ ID NO: 110327 - protein, 30 aa, Artificial Sequence
  Description of Artificial Sequence: Synthetic polypeptide
DENEIRTTNPVATEQYGDVSMIIMNAAEDA

SEQ ID NO: 110328 - protein, 36 aa, Artificial Sequence
  Description of Artificial Sequence: Synthetic polypeptide
AEEEIRTTNPVATEQYGSVSTVTNQNQEQQGNNDTN

SEQ ID NO: 110329 - protein, 36 aa, Artificial Sequence
  Description of Artificial Sequence: Synthetic polypeptide
AEEEIRTTNPVATEQYGSVSTVTNQNNQNNGNNTED

SEQ ID NO: 110330 - protein, 30 aa, Artificial Sequence
  Description of Artificial Sequence: Synthetic polypeptide
SDSEIASTNPVATEGYGSVAANTIQRVGQR

SEQ ID NO: 110331 - protein, 29 aa, Artificial Sequence
  Description of Artificial Sequence: Synthetic peptide
SDSEIRSTNPIATEGYGSVAETIQRVGQR

SEQ ID NO: 110332 - protein, 29 aa, Artificial Sequence
  Description of Artificial Sequence: Synthetic peptide
SDSEIRSTNPIATEGYGSVANTIQRVGQR

SEQ ID NO: 110333 - protein, 33 aa, Artificial Sequence
  Description of Artificial Sequence: Synthetic polypeptide
DESEIRTTNPVATTCWGSVSCFNEPQDREGENG

SEQ ID NO: 110334 - protein, 33 aa, Artificial Sequence
  Description of Artificial Sequence: Synthetic polypeptide
DESEIRTTNPVATTCWGSVSCINEPQDRCGENG

SEQ ID NO: 110335 - protein, 35 aa, Artificial Sequence
  Description of Artificial Sequence: Synthetic polypeptide
AEEEIRTTNPVATEQYGSVSTVTNQNNQNETNNED

SEQ ID NO: 110336 - protein, 32 aa, Artificial Sequence
  Description of Artificial Sequence: Synthetic polypeptide
DENEIRTTNPVATEQYGDVSEDGPVENAAGND

SEQ ID NO: 110337 - protein, 32 aa, Artificial Sequence
  Description of Artificial Sequence: Synthetic polypeptide
DENEIRTTNPVATEQYGDVSEDGPVENAAGNA

SEQ ID NO: 110338 - protein, 31 aa, Artificial Sequence
  Description of Artificial Sequence: Synthetic polypeptide
DENEIRTTNPVATEQYGDVSEDGPENAAENA

SEQ ID NO: 110339 - protein, 35 aa, Artificial Sequence
  Description of Artificial Sequence: Synthetic polypeptide
AEEEIRTTNPVATEQYGSVSTVTNQLNESTENDTE

SEQ ID NO: 110340 - protein, 30 aa, Artificial Sequence
  Description of Artificial Sequence: Synthetic polypeptide
DENEIRTTNPVATEQYGDISMIIMQQNEDA

SEQ ID NO: 110341 - protein, 36 aa, Artificial Sequence
  Description of Artificial Sequence: Synthetic polypeptide
AEEEIRTTNPVATEQYGSVSTVTNQGNQNIGNNTED

SEQ ID NO: 110342 - protein, 30 aa, Artificial Sequence
  Description of Artificial Sequence: Synthetic polypeptide
DENEIRTTNPVATEQYGDISMIIMNQNEDA

SEQ ID NO: 110343 - protein, 30 aa, Artificial Sequence
  Description of Artificial Sequence: Synthetic polypeptide
DENEIRTTNPVATEQYGDISMIIMNANEDA

SEQ ID NO: 110344 - protein, 32 aa, Artificial Sequence
  Description of Artificial Sequence: Synthetic polypeptide
DENEIRTTNPVATEQYGDISMEDIQQQANGNA

SEQ ID NO: 110345 - protein, 31 aa, Artificial Sequence
  Description of Artificial Sequence: Synthetic polypeptide
DENEIRTTNPVATEQYGDISEDIQQNAAGDA

SEQ ID NO: 110346 - protein, 31 aa, Artificial Sequence
  Description of Artificial Sequence: Synthetic polypeptide
SEAEIATTNPVAYEQWGSISATANLPAPNSR

SEQ ID NO: 110347 - protein, 35 aa, Artificial Sequence
  Description of Artificial Sequence: Synthetic polypeptide
AEEEIRTTNPVATEQYGSVSTVTNQGNNDEGNNSD

SEQ ID NO: 110348 - protein, 32 aa, Artificial Sequence
  Description of Artificial Sequence: Synthetic polypeptide
SEAEIATTNPVAYEQYGSVAGTNLVQDGTPES

SEQ ID NO: 110349 - protein, 33 aa, Artificial Sequence
  Description of Artificial Sequence: Synthetic polypeptide
DESEIRTTNPVATVRWGSVSCINEPQDREGENG

SEQ ID NO: 110350 - protein, 33 aa, Artificial Sequence
  Description of Artificial Sequence: Synthetic polypeptide
DENEIRTTNPVATEQYGCVYALLTENQHGDERI

SEQ ID NO: 110351 - protein, 33 aa, Artificial Sequence
  Description of Artificial Sequence: Synthetic polypeptide
DENEIRTTNPVATEQYGCVTWEDLEIHGNEDRA

SEQ ID NO: 110352 - protein, 33 aa, Artificial Sequence
  Description of Artificial Sequence: Synthetic polypeptide
DESEIRTTNPVATWCWGSVSCINEPQDREGENG

SEQ ID NO: 110353 - protein, 36 aa, Artificial Sequence
  Description of Artificial Sequence: Synthetic polypeptide
AEEEIRTTNPVATEQYGSVSTVTNQGNLQAGTEQGQ

SEQ ID NO: 110354 - protein, 33 aa, Artificial Sequence
  Description of Artificial Sequence: Synthetic polypeptide
DESEIRTTNPVATYCWGSVSCINEPQDREGENG

SEQ ID NO: 110355 - protein, 34 aa, Artificial Sequence
  Description of Artificial Sequence: Synthetic polypeptide
DENEIRTTNPVATEQYGCVSTLLLQFNGLQDDDQ

SEQ ID NO: 110356 - protein, 33 aa, Artificial Sequence
  Description of Artificial Sequence: Synthetic polypeptide
SEAEIATTNPVAYEQYGSVSAGNLDQDAGDNEQ

SEQ ID NO: 110357 - protein, 33 aa, Artificial Sequence
  Description of Artificial Sequence: Synthetic polypeptide
QAEEIATTNPVATEQYGCVAGTNLQTADGPENN

SEQ ID NO: 110358 - protein, 34 aa, Artificial Sequence
  Description of Artificial Sequence: Synthetic polypeptide
SEAEICTTNPVATECYGSVSTGNGLQGDTGGNEQ

SEQ ID NO: 110359 - protein, 33 aa, Artificial Sequence
  Description of Artificial Sequence: Synthetic polypeptide
DESEIRTTNPVAVECWGSVSCINEPQDREGENG

SEQ ID NO: 110360 - protein, 30 aa, Artificial Sequence
  Description of Artificial Sequence: Synthetic polypeptide
ASTEIACTNPVATEQYGCASANLQEAGGQR

SEQ ID NO: 110361 - protein, 36 aa, Artificial Sequence
  Description of Artificial Sequence: Synthetic polypeptide
AEEEIRTTNPVATEQYGSVSTVTNNQQQNQENGNQQ

SEQ ID NO: 110362 - protein, 32 aa, Artificial Sequence
  Description of Artificial Sequence: Synthetic polypeptide
DENEIRTTNPVATEQYGCVSDALDLQMEVDDE

SEQ ID NO: 110363 - protein, 35 aa, Artificial Sequence
  Description of Artificial Sequence: Synthetic polypeptide
AEEEIRTTNPVATEQYGSVSTVTNNQQNQDEANED

SEQ ID NO: 110364 - protein, 30 aa, Artificial Sequence
  Description of Artificial Sequence: Synthetic polypeptide
DENEIRTTNPVATEQYGDVAEILMNAAEDA

SEQ ID NO: 110365 - protein, 33 aa, Artificial Sequence
  Description of Artificial Sequence: Synthetic polypeptide
DESEIRTTNPVATVCWGSVSCRNEPQDREGENG

SEQ ID NO: 110366 - protein, 31 aa, Artificial Sequence
  Description of Artificial Sequence: Synthetic polypeptide
DENEIRTTNPVATEQYGDVCSEIEMNAAENA

SEQ ID NO: 110367 - protein, 32 aa, Artificial Sequence
  Description of Artificial Sequence: Synthetic polypeptide
SEAEIATTNPVATEQYGSVCSTNPLHDSLDEE

SEQ ID NO: 110368 - protein, 33 aa, Artificial Sequence
  Description of Artificial Sequence: Synthetic polypeptide
SEAEIACTNPVATEQYGSVATNLTEAEGGNERE

SEQ ID NO: 110369 - protein, 31 aa, Artificial Sequence
  Description of Artificial Sequence: Synthetic polypeptide
DENEIRTTNPVATEQYGDVSEDEMNHAGDDL

SEQ ID NO: 110370 - protein, 30 aa, Artificial Sequence
  Description of Artificial Sequence: Synthetic polypeptide
SEAEIACTNPVAYEQYGSVATNLQANPTEN

SEQ ID NO: 110371 - protein, 30 aa, Artificial Sequence
  Description of Artificial Sequence: Synthetic polypeptide
SEAEIACTNPVAYEQYGSVATNLQAPPKDE

SEQ ID NO: 110372 - protein, 32 aa, Artificial Sequence
  Description of Artificial Sequence: Synthetic polypeptide
SEAEIACTNPVAYEQYGSVATNLQNPMGNTAK

SEQ ID NO: 110373 - protein, 31 aa, Artificial Sequence
  Description of Artificial Sequence: Synthetic polypeptide
SEAEIACTNPVAYEQYGSVATNLQTHGGLEA

SEQ ID NO: 110374 - protein, 35 aa, Artificial Sequence
  Description of Artificial Sequence: Synthetic polypeptide
AEEEIRTTNPVATEQYGSVSTVTNQNGDEAGNEDE

SEQ ID NO: 110375 - protein, 31 aa, Artificial Sequence
  Description of Artificial Sequence: Synthetic polypeptide
SEAEIATTNPVATEQYGCVAATNLADSGGTP

SEQ ID NO: 110376 - protein, 33 aa, Artificial Sequence
  Description of Artificial Sequence: Synthetic polypeptide
SEAEIATTNPVATEQYGCVAATNLDQTAGPNEQ

SEQ ID NO: 110377 - protein, 30 aa, Artificial Sequence
  Description of Artificial Sequence: Synthetic polypeptide
DENEIRTTNPVATEQYGDVSECEMNAAEDL

SEQ ID NO: 110378 - protein, 33 aa, Artificial Sequence
  Description of Artificial Sequence: Synthetic polypeptide
SEAEIATTNPVATEQYGCVAATNLTEAEGGNER

SEQ ID NO: 110379 - protein, 30 aa, Artificial Sequence
  Description of Artificial Sequence: Synthetic polypeptide
DENEIRTTNPVATEQYGDVSDIEMNAAEDA

SEQ ID NO: 110380 - protein, 33 aa, Artificial Sequence
  Description of Artificial Sequence: Synthetic polypeptide
CEEEISTTNPVATEQYGCVCSNTEDHQNGSNQS

SEQ ID NO: 110381 - protein, 33 aa, Artificial Sequence
  Description of Artificial Sequence: Synthetic polypeptide
SEAEIATTNPVATEQYGCVATNLAQDSGMDNDD

SEQ ID NO: 110382 - protein, 33 aa, Artificial Sequence
  Description of Artificial Sequence: Synthetic polypeptide
QAEEIATTNPVATEQYGCVATNNLENGMGENDR

SEQ ID NO: 110383 - protein, 36 aa, Artificial Sequence
  Description of Artificial Sequence: Synthetic polypeptide
AEEEIRTTNPVATEQYGSVSTVTNQNDNQQGTNATE

SEQ ID NO: 110384 - protein, 31 aa, Artificial Sequence
  Description of Artificial Sequence: Synthetic polypeptide
DENEIRTTNPVATEQYGDVSAEDLENHAEDA

SEQ ID NO: 110385 - protein, 31 aa, Artificial Sequence
  Description of Artificial Sequence: Synthetic polypeptide
DENEIRTTNPVATEQYGDVSAEDLENAAEDA

SEQ ID NO: 110386 - protein, 35 aa, Artificial Sequence
  Description of Artificial Sequence: Synthetic polypeptide
AEEEIRTTNPVATEQYGSVSTVTNQNDESGENDTE

SEQ ID NO: 110387 - protein, 29 aa, Artificial Sequence
  Description of Artificial Sequence: Synthetic peptide
DENEIRTTNPVATEQYGDVPEICMNAEDA

SEQ ID NO: 110388 - protein, 33 aa, Artificial Sequence
  Description of Artificial Sequence: Synthetic polypeptide
DESEIRTTNPVATVCWGSVSCINEPQDREGENG

SEQ ID NO: 110389 - protein, 32 aa, Artificial Sequence
  Description of Artificial Sequence: Synthetic polypeptide
DENEIRTTNPVATEQYGDVCSTIPVMNAAEND

SEQ ID NO: 110390 - protein, 37 aa, Artificial Sequence
  Description of Artificial Sequence: Synthetic polypeptide
AEEEIRTTNPVATEQYGSVSTVTNQLNNQNDEGNNVE

SEQ ID NO: 110391 - protein, 32 aa, Artificial Sequence
  Description of Artificial Sequence: Synthetic polypeptide
SEAEIATTNPVATEQYGSVCATNNLHDSNDDE

SEQ ID NO: 110392 - protein, 33 aa, Artificial Sequence
  Description of Artificial Sequence: Synthetic polypeptide
DESEIRTTNPVATVCWGSVSCKNEPQDREGENG

SEQ ID NO: 110393 - protein, 31 aa, Artificial Sequence
  Description of Artificial Sequence: Synthetic polypeptide
DENEIRTTNPVATEQYGDVCSEIEVEAAENA

SEQ ID NO: 110394 - protein, 34 aa, Artificial Sequence
  Description of Artificial Sequence: Synthetic polypeptide
QAEEIATTNPVATEQYGCVATNNLPQEAPGENVR

SEQ ID NO: 110395 - protein, 28 aa, Artificial Sequence
  Description of Artificial Sequence: Synthetic peptide
QESEVASTNPVSTEGYGNVASTLQRGDI

SEQ ID NO: 110396 - protein, 33 aa, Artificial Sequence
  Description of Artificial Sequence: Synthetic polypeptide
DENEIRTTNPVATEPYGTVCSATEGPQQQNGNH

SEQ ID NO: 110397 - protein, 33 aa, Artificial Sequence
  Description of Artificial Sequence: Synthetic polypeptide
DENEIRTTNPVATEPYGTVCSATEGPQQQEGND

SEQ ID NO: 110398 - protein, 37 aa, Artificial Sequence
  Description of Artificial Sequence: Synthetic polypeptide
AEEEIRTTNPVATEQYGSVSTTVTNLQDNQQGTNNTE

SEQ ID NO: 110399 - protein, 37 aa, Artificial Sequence
  Description of Artificial Sequence: Synthetic polypeptide
AEEEIRTTNPVATEQYGSVSTTVTNLLQQGTTEAGNQ

SEQ ID NO: 110400 - protein, 36 aa, Artificial Sequence
  Description of Artificial Sequence: Synthetic polypeptide
AEEEIRTTNPVATEQYGSVSTTVTNLLAGNEENSEA

SEQ ID NO: 110401 - protein, 31 aa, Artificial Sequence
  Description of Artificial Sequence: Synthetic polypeptide
DENEIATTNPVATESYGSVANNLQNHDETGS

SEQ ID NO: 110402 - protein, 33 aa, Artificial Sequence
  Description of Artificial Sequence: Synthetic polypeptide
DESEVRTTNPVATECWGSVSCINEPQDREGENG

SEQ ID NO: 110403 - protein, 34 aa, Artificial Sequence
  Description of Artificial Sequence: Synthetic polypeptide
DESEVRTTNPVATECWGSVSCINEPQDREGENRG

SEQ ID NO: 110404 - protein, 32 aa, Artificial Sequence
  Description of Artificial Sequence: Synthetic polypeptide
NESEIRTTNPVAYECWGEVSTNLQGNDGQDRN

SEQ ID NO: 110405 - protein, 31 aa, Artificial Sequence
  Description of Artificial Sequence: Synthetic polypeptide
DENEIATTNPVATESYGCVANNNLQDAGTHA

SEQ ID NO: 110406 - protein, 36 aa, Artificial Sequence
  Description of Artificial Sequence: Synthetic polypeptide
AEEEIRTTNPVATEQYGSVSTTVQNLGNLQENNSEE

SEQ ID NO: 110407 - protein, 36 aa, Artificial Sequence
  Description of Artificial Sequence: Synthetic polypeptide
AEEEIRTTNPVATEQYGSVSTTVNQQQSNNNGENED

SEQ ID NO: 110408 - protein, 30 aa, Artificial Sequence
  Description of Artificial Sequence: Synthetic polypeptide
DENEIATTNPVATEQYGVVSEILMNAAEDA

SEQ ID NO: 110409 - protein, 36 aa, Artificial Sequence
  Description of Artificial Sequence: Synthetic polypeptide
AEEEIRTTNPVATEQYGSVSTTVNQQQQGEETNEEG

SEQ ID NO: 110410 - protein, 35 aa, Artificial Sequence
  Description of Artificial Sequence: Synthetic polypeptide
AEEEIRTTNPVATEQYGSVSTTVNQQQANNNNDTD

SEQ ID NO: 110411 - protein, 33 aa, Artificial Sequence
  Description of Artificial Sequence: Synthetic polypeptide
DENEIATTNPVATEQYGTVSATDLQEQHEGEDH

SEQ ID NO: 110412 - protein, 33 aa, Artificial Sequence
  Description of Artificial Sequence: Synthetic polypeptide
DENEIATTNPVATEQYGTVSATDLQEDHEGEDH

SEQ ID NO: 110413 - protein, 33 aa, Artificial Sequence
  Description of Artificial Sequence: Synthetic polypeptide
DESEVRTTNPVATECWGSVSCINIPQDREGENG

SEQ ID NO: 110414 - protein, 31 aa, Artificial Sequence
  Description of Artificial Sequence: Synthetic polypeptide
DENEIATTNPVATEQYGTVCSTDGPEFEEND

SEQ ID NO: 110415 - protein, 36 aa, Artificial Sequence
  Description of Artificial Sequence: Synthetic polypeptide
AEEEIRTTNPVATEQYGSVSTTVNQQNGDEAGNTDE

SEQ ID NO: 110416 - protein, 36 aa, Artificial Sequence
  Description of Artificial Sequence: Synthetic polypeptide
AEEEIRTTNPVATEQYGSVSTTVNQNNQGEQGNNEI

SEQ ID NO: 110417 - protein, 36 aa, Artificial Sequence
  Description of Artificial Sequence: Synthetic polypeptide
AEEEIRTTNPVATEQYGSVSTTVNQNNQEQGNNTED

SEQ ID NO: 110418 - protein, 33 aa, Artificial Sequence
  Description of Artificial Sequence: Synthetic polypeptide
DESEVRTTNPVATECWGSVSCQNEPQDREGENG

SEQ ID NO: 110419 - protein, 31 aa, Artificial Sequence
  Description of Artificial Sequence: Synthetic polypeptide
DESEVRTTNPVATEGWGDVSANIIMSRVGQR

SEQ ID NO: 110420 - protein, 32 aa, Artificial Sequence
  Description of Artificial Sequence: Synthetic polypeptide
DESEVRTTNPVSTECWGSVSCTEPQSRVGEQR

SEQ ID NO: 110421 - protein, 35 aa, Artificial Sequence
  Description of Artificial Sequence: Synthetic polypeptide
AEEEIRTTNPVATEQYGSVSTTVNQNGTQGTNQAN

SEQ ID NO: 110422 - protein, 30 aa, Artificial Sequence
  Description of Artificial Sequence: Synthetic polypeptide
DENEIATTNPVATEQYGTISMVIQQHNENH

SEQ ID NO: 110423 - protein, 37 aa, Artificial Sequence
  Description of Artificial Sequence: Synthetic polypeptide
AEEEIRTTNPVATEQYGSVSTTVTNLQEGTTEENSEQ

SEQ ID NO: 110424 - protein, 30 aa, Artificial Sequence
  Description of Artificial Sequence: Synthetic polypeptide
DENEIATTNPVATEQYGTISMVIQQHNEEH

SEQ ID NO: 110425 - protein, 32 aa, Artificial Sequence
  Description of Artificial Sequence: Synthetic polypeptide
DENEIATTNPVATESYGSVANPNLQDAGETGD

SEQ ID NO: 110426 - protein, 33 aa, Artificial Sequence
  Description of Artificial Sequence: Synthetic polypeptide
DENEIATTNPVAYEQYGSVAATNLADDPGMNNH

SEQ ID NO: 110427 - protein, 36 aa, Artificial Sequence
  Description of Artificial Sequence: Synthetic polypeptide
AEEEIRTTNPVATEQYGSVSTVDNGNNQEEGNNQQG

SEQ ID NO: 110428 - protein, 35 aa, Artificial Sequence
  Description of Artificial Sequence: Synthetic polypeptide
AEEEIRTTNPVATEQYGSVSTVDNGNNEEGNNQDD

SEQ ID NO: 110429 - protein, 37 aa, Artificial Sequence
  Description of Artificial Sequence: Synthetic polypeptide
AEEEIRTTNPVATEQYGSVSTVDNGNLQQGNNNNQDE

SEQ ID NO: 110430 - protein, 36 aa, Artificial Sequence
  Description of Artificial Sequence: Synthetic polypeptide
AEEEIRTTNPVATEQYGSVSTVANQNAQGEQGTNVE

SEQ ID NO: 110431 - protein, 35 aa, Artificial Sequence
  Description of Artificial Sequence: Synthetic polypeptide
AEEEIRTTNPVATEQYGSVVVTTTNLNNTAGTNNS

SEQ ID NO: 110432 - protein, 31 aa, Artificial Sequence
  Description of Artificial Sequence: Synthetic polypeptide
NESEIRTTNPVAYEQWGSVAWTDNGQQDGSG

SEQ ID NO: 110433 - protein, 31 aa, Artificial Sequence
  Description of Artificial Sequence: Synthetic polypeptide
DESEVRSTNPVSTEGYGTVSMTIQQQRVGNH

SEQ ID NO: 110434 - protein, 36 aa, Artificial Sequence
  Description of Artificial Sequence: Synthetic polypeptide
AEEEIRTTNPVATEQYGSVSTVANLNGNDEQGNNVD

SEQ ID NO: 110435 - protein, 34 aa, Artificial Sequence
  Description of Artificial Sequence: Synthetic polypeptide
DENEIATTNPVAYEQYGSVATHLPQDSMGPNDRM

SEQ ID NO: 110436 - protein, 36 aa, Artificial Sequence
  Description of Artificial Sequence: Synthetic polypeptide
AEEEIRTTNPVATEQYGSVSTVANLNASEQGTNSVE

SEQ ID NO: 110437 - protein, 36 aa, Artificial Sequence
  Description of Artificial Sequence: Synthetic polypeptide
AEEEIRTTNPVATEQYGSVSTVANLNADEQGTNQNE

SEQ ID NO: 110438 - protein, 37 aa, Artificial Sequence
  Description of Artificial Sequence: Synthetic polypeptide
AEEEIRTTNPVATEQYGSVSTVANLLNNQEQGTNNVE

SEQ ID NO: 110439 - protein, 36 aa, Artificial Sequence
  Description of Artificial Sequence: Synthetic polypeptide
AEEEIRTTNPVATEQYGSVSTVANLLNADEQGTNVE

SEQ ID NO: 110440 - protein, 37 aa, Artificial Sequence
  Description of Artificial Sequence: Synthetic polypeptide
AEEEIRTTNPVATEQYGSVSTVANLGNAQSEQGTNVE

SEQ ID NO: 110441 - protein, 36 aa, Artificial Sequence
  Description of Artificial Sequence: Synthetic polypeptide
AEEEIRTTNPVATEQYGSVSTVANGNNQDEQGNNVD

SEQ ID NO: 110442 - protein, 36 aa, Artificial Sequence
  Description of Artificial Sequence: Synthetic polypeptide
AEEEIRTTNPVATEQYGSVSTTVVNLQQGEEDEEEV

SEQ ID NO: 110443 - protein, 36 aa, Artificial Sequence
  Description of Artificial Sequence: Synthetic polypeptide
AEEEIRTTNPVATEQYGSVSTTVTNNQLNGDEANED

SEQ ID NO: 110444 - protein, 35 aa, Artificial Sequence
  Description of Artificial Sequence: Synthetic polypeptide
AEEEIRTTNPVATEQYGSVSTTVTNNLGNLQENSE

SEQ ID NO: 110445 - protein, 31 aa, Artificial Sequence
  Description of Artificial Sequence: Synthetic polypeptide
DENEIATTNPVAYEQYGSVANMHGQDSGNAQ

SEQ ID NO: 110446 - protein, 36 aa, Artificial Sequence
  Description of Artificial Sequence: Synthetic polypeptide
AEEEIRTTNPVATEQYGSVSTTVTNNLGLQEENSEQ

SEQ ID NO: 110447 - protein, 32 aa, Artificial Sequence
  Description of Artificial Sequence: Synthetic polypeptide
NESEIRTTNPVAYEQWGSVAWTDNGQQDGGPR

SEQ ID NO: 110448 - protein, 31 aa, Artificial Sequence
  Description of Artificial Sequence: Synthetic polypeptide
NESEIRTTNPVAYEQWGSVAKTLEQTNGDER

SEQ ID NO: 110449 - protein, 31 aa, Artificial Sequence
  Description of Artificial Sequence: Synthetic polypeptide
NESEIRTTNPVAYECWGSVAWTDNSQQDGSR

SEQ ID NO: 110450 - protein, 32 aa, Artificial Sequence
  Description of Artificial Sequence: Synthetic polypeptide
DENEIATTNPVAYEQYGSVAATTNLAPPGEDD

SEQ ID NO: 110451 - protein, 34 aa, Artificial Sequence
  Description of Artificial Sequence: Synthetic polypeptide
DESEVRTTNPVATECWGSVSACINIPQDREGENR

SEQ ID NO: 110452 - protein, 36 aa, Artificial Sequence
  Description of Artificial Sequence: Synthetic polypeptide
AEEEIRTTNPVATEQYGSVSTTVTNLQQGSTDEETQ

SEQ ID NO: 110453 - protein, 36 aa, Artificial Sequence
  Description of Artificial Sequence: Synthetic polypeptide
AEEEIRTTNPVATEQYGSVSTVDNGNQEEIGNNQED

SEQ ID NO: 110454 - protein, 32 aa, Artificial Sequence
  Description of Artificial Sequence: Synthetic polypeptide
DENEIATTNPVATEQYGTISMEVIQQQQNGNK

SEQ ID NO: 110455 - protein, 36 aa, Artificial Sequence
  Description of Artificial Sequence: Synthetic polypeptide
AEEEIRTTNPVATEQYGSVSTTVNQLTNNIGTNTEV

SEQ ID NO: 110456 - protein, 33 aa, Artificial Sequence
  Description of Artificial Sequence: Synthetic polypeptide
DESGIRTTNPVATEWWGSVSCINEPQDREGENG

SEQ ID NO: 110457 - protein, 37 aa, Artificial Sequence
  Description of Artificial Sequence: Synthetic polypeptide
AEEEIRTTNPVATEQYGSVSTTVNNLQQNDEQGTNEQ

SEQ ID NO: 110458 - protein, 32 aa, Artificial Sequence
  Description of Artificial Sequence: Synthetic polypeptide
NESEIRTTNPVATEQYGSVTVTVLDMIDENFD

SEQ ID NO: 110459 - protein, 33 aa, Artificial Sequence
  Description of Artificial Sequence: Synthetic polypeptide
DESHIRTTNPVATECWGSVSCINEPQDREGENG

SEQ ID NO: 110460 - protein, 37 aa, Artificial Sequence
  Description of Artificial Sequence: Synthetic polypeptide
AEEEIRTTNPVATEQYGSVSTTVNNLQLGNQGNGNGV

SEQ ID NO: 110461 - protein, 33 aa, Artificial Sequence
  Description of Artificial Sequence: Synthetic polypeptide
DESHIRTTNPVATECWGSVSCINEPQKREGENG

SEQ ID NO: 110462 - protein, 33 aa, Artificial Sequence
  Description of Artificial Sequence: Synthetic polypeptide
DESHIRTTNPVATECWGSVSCQNEPQDREGENG

SEQ ID NO: 110463 - protein, 33 aa, Artificial Sequence
  Description of Artificial Sequence: Synthetic polypeptide
DESIIRTTNPVATECWGSVSCINEPQDREGENG

SEQ ID NO: 110464 - protein, 33 aa, Artificial Sequence
  Description of Artificial Sequence: Synthetic polypeptide
DESKIRTTNPVATECWGSVSCINEPQDREGENG

SEQ ID NO: 110465 - protein, 33 aa, Artificial Sequence
  Description of Artificial Sequence: Synthetic polypeptide
DESKIRTTNPVATECWGSVSCINEPQDREGENH

SEQ ID NO: 110466 - protein, 37 aa, Artificial Sequence
  Description of Artificial Sequence: Synthetic polypeptide
AEEEIRTTNPVATEQYGSVSTTVNNLQAGTTEENSEE

SEQ ID NO: 110467 - protein, 33 aa, Artificial Sequence
  Description of Artificial Sequence: Synthetic polypeptide
DESLIRTTNPVATECWGSVSCINEPQDREGENG

SEQ ID NO: 110468 - protein, 37 aa, Artificial Sequence
  Description of Artificial Sequence: Synthetic polypeptide
AEEEIRTTNPVATEQYGSVSTTVNNLEQGTEGGNTTS

SEQ ID NO: 110469 - protein, 35 aa, Artificial Sequence
  Description of Artificial Sequence: Synthetic polypeptide
AEEEIRTTNPVATEQYGSVSTTVNNINTEQGTNSD

SEQ ID NO: 110470 - protein, 33 aa, Artificial Sequence
  Description of Artificial Sequence: Synthetic polypeptide
DESLIRTTNPVATECWGSVSCINEPQDRRGENG

SEQ ID NO: 110471 - protein, 35 aa, Artificial Sequence
  Description of Artificial Sequence: Synthetic polypeptide
AEEEIRTTNPVATEQYGSVSTTVNNGNQEGETDED

SEQ ID NO: 110472 - protein, 36 aa, Artificial Sequence
  Description of Artificial Sequence: Synthetic polypeptide
AEEEIRTTNPVATEQYGSVSTTVNNDQAGTTENSEP

SEQ ID NO: 110473 - protein, 33 aa, Artificial Sequence
  Description of Artificial Sequence: Synthetic polypeptide
DESLIRTTNPVATEVWGSVSCINEPQDREGENG

SEQ ID NO: 110474 - protein, 33 aa, Artificial Sequence
  Description of Artificial Sequence: Synthetic polypeptide
DESMIRTTNPVATECWGSVSCINEPQDREGENG

SEQ ID NO: 110475 - protein, 37 aa, Artificial Sequence
  Description of Artificial Sequence: Synthetic polypeptide
AEEEIRTTNPVATEQYGSVSTTVNLNQQGTNNNNEEM

SEQ ID NO: 110476 - protein, 33 aa, Artificial Sequence
  Description of Artificial Sequence: Synthetic polypeptide
DENEIATTNPVATEQYGSVSATDIQEDHEGEDL

SEQ ID NO: 110477 - protein, 32 aa, Artificial Sequence
  Description of Artificial Sequence: Synthetic polypeptide
DENEIATTNPVATEQYGSVSATDIEDHEGEDL

SEQ ID NO: 110478 - protein, 32 aa, Artificial Sequence
  Description of Artificial Sequence: Synthetic polypeptide
DENEIATTNPVATEQYGSVSATDEEDHEGEDL

SEQ ID NO: 110479 - protein, 37 aa, Artificial Sequence
  Description of Artificial Sequence: Synthetic polypeptide
AEEEIRTTNPVATEQYGSVSTTVNLNQQGTNNDTEEF

SEQ ID NO: 110480 - protein, 37 aa, Artificial Sequence
  Description of Artificial Sequence: Synthetic polypeptide
AEEEIRTTNPVATEQYGSVSTTVNLNQQGTNNANELG

SEQ ID NO: 110481 - protein, 34 aa, Artificial Sequence
  Description of Artificial Sequence: Synthetic polypeptide
CEGEIRTTNPVATEAYGSVSSCQGNLSGRTGTNM

SEQ ID NO: 110482 - protein, 31 aa, Artificial Sequence
  Description of Artificial Sequence: Synthetic polypeptide
DENEIATTNPVATEQYGTISMEDIQQQRGGH

SEQ ID NO: 110483 - protein, 35 aa, Artificial Sequence
  Description of Artificial Sequence: Synthetic polypeptide
DENEIATTNPVATEQYGSVSGTGPPPQDAHGENRN

SEQ ID NO: 110484 - protein, 33 aa, Artificial Sequence
  Description of Artificial Sequence: Synthetic polypeptide
DESFIRTTNPVATECWGSVSQINEPQDREGENG

SEQ ID NO: 110485 - protein, 31 aa, Artificial Sequence
  Description of Artificial Sequence: Synthetic polypeptide
DENEIATTNPVATEQYGTISEEDCQQQQGNH

SEQ ID NO: 110486 - protein, 34 aa, Artificial Sequence
  Description of Artificial Sequence: Synthetic polypeptide
DESEVRTTNPVSTECYGSVSACINIPQDREGENR

SEQ ID NO: 110487 - protein, 32 aa, Artificial Sequence
  Description of Artificial Sequence: Synthetic polypeptide
DESEVRTTNPVSTEGWGSVSCTEPQSRVGEQR

SEQ ID NO: 110488 - protein, 36 aa, Artificial Sequence
  Description of Artificial Sequence: Synthetic polypeptide
AEEEIRTTNPVATEQYGSVSTTVNQLNGNNNGNIQE

SEQ ID NO: 110489 - protein, 30 aa, Artificial Sequence
  Description of Artificial Sequence: Synthetic polypeptide
DENEIATTNPVATEQYGTIPEEVIQQHGNH

SEQ ID NO: 110490 - protein, 35 aa, Artificial Sequence
  Description of Artificial Sequence: Synthetic polypeptide
AEEEIRTTNPVATEQYGSVSTTVNQLGGNEENSET

SEQ ID NO: 110491 - protein, 36 aa, Artificial Sequence
  Description of Artificial Sequence: Synthetic polypeptide
AEEEIRTTNPVATEQYGSVSTTVNQGQNGNNGENED

SEQ ID NO: 110492 - protein, 31 aa, Artificial Sequence
  Description of Artificial Sequence: Synthetic polypeptide
DESEVRTTNPVSTEGYGTISMTIQQQRNGNH

SEQ ID NO: 110493 - protein, 32 aa, Artificial Sequence
  Description of Artificial Sequence: Synthetic polypeptide
DENEIATTNPVATEQYGSVVAANGPETVPGNN

SEQ ID NO: 110494 - protein, 36 aa, Artificial Sequence
  Description of Artificial Sequence: Synthetic polypeptide
NESEIRTTNPVATEQYGSVYSTVFNDLQRSGQEDIN

SEQ ID NO: 110495 - protein, 35 aa, Artificial Sequence
  Description of Artificial Sequence: Synthetic polypeptide
DENEIATTNPVATEQYGSVSTTPALPNMRNGMNPV

SEQ ID NO: 110496 - protein, 35 aa, Artificial Sequence
  Description of Artificial Sequence: Synthetic polypeptide
DENEIATTNPVATEQYGSVSTPNPQQDHQDGNENQ

SEQ ID NO: 110497 - protein, 36 aa, Artificial Sequence
  Description of Artificial Sequence: Synthetic polypeptide
AEEEIRTTNPVATEQYGSVSTTVNNQLQVTTENSEY

SEQ ID NO: 110498 - protein, 31 aa, Artificial Sequence
  Description of Artificial Sequence: Synthetic polypeptide
DESEVRTTNPVSTEPYGTISMTIQQQRNGNH

SEQ ID NO: 110499 - protein, 30 aa, Artificial Sequence
  Description of Artificial Sequence: Synthetic polypeptide
DESEVRTTNPVSTEPYGTVAMTIQQRNGQH

SEQ ID NO: 110500 - protein, 36 aa, Artificial Sequence
  Description of Artificial Sequence: Synthetic polypeptide
AEEEIRTTNPVATEQYGSVSTTVNNNQQGTNNNEEA

SEQ ID NO: 110501 - protein, 36 aa, Artificial Sequence
  Description of Artificial Sequence: Synthetic polypeptide
AEEEIRTTNPVATEQYGSVSTTVNNNQQGTIGTNVD

SEQ ID NO: 110502 - protein, 36 aa, Artificial Sequence
  Description of Artificial Sequence: Synthetic polypeptide
AEEEIRTTNPVATEQYGSVVVTTTNNLGNQAGNNDN

SEQ ID NO: 110503 - protein, 31 aa, Artificial Sequence
  Description of Artificial Sequence: Synthetic polypeptide
DESEVVSTNPVATEGYGTVSANTIESRVGNR

SEQ ID NO: 110504 - protein, 34 aa, Artificial Sequence
  Description of Artificial Sequence: Synthetic polypeptide
DENEIATTNPVATEQYGSVSTGNPLGQHDDTPDD

SEQ ID NO: 110505 - protein, 32 aa, Artificial Sequence
  Description of Artificial Sequence: Synthetic polypeptide
DESEVVTTNPVATEQYGTVCSANDGIQFEGND

SEQ ID NO: 110506 - protein, 32 aa, Artificial Sequence
  Description of Artificial Sequence: Synthetic polypeptide
DESEVVTTNPVATEQYGTVCSATDGIQFEGND

SEQ ID NO: 110507 - protein, 35 aa, Artificial Sequence
  Description of Artificial Sequence: Synthetic polypeptide
AEEEIRTTNPVATEQYGSVSTTVNNNLGVTENSEE

SEQ ID NO: 110508 - protein, 33 aa, Artificial Sequence
  Description of Artificial Sequence: Synthetic polypeptide
DESFIRTTNPVATECWGSVSCINEPQDREGENG

SEQ ID NO: 110509 - protein, 33 aa, Artificial Sequence
  Description of Artificial Sequence: Synthetic polypeptide
DESFIRTTNPVATECWGSVSCINSPQDREGENG

SEQ ID NO: 110510 - protein, 33 aa, Artificial Sequence
  Description of Artificial Sequence: Synthetic polypeptide
DESGIRTTNPVATECWGSVSCINEPQDREGENG

SEQ ID NO: 110511 - protein, 32 aa, Artificial Sequence
  Description of Artificial Sequence: Synthetic polypeptide
DENEIATTNPVAYEQYGSVATNLQPDDQTEGA

SEQ ID NO: 110512 - protein, 36 aa, Artificial Sequence
  Description of Artificial Sequence: Synthetic polypeptide
AEEEIRTTNPVATEQYGSVSTVDNGNQEQGNNNDQE

SEQ ID NO: 110513 - protein, 32 aa, Artificial Sequence
  Description of Artificial Sequence: Synthetic polypeptide
DESEVRSTNPVATECWGNVSANNEPQDREGNR

SEQ ID NO: 110514 - protein, 29 aa, Artificial Sequence
  Description of Artificial Sequence: Synthetic peptide
DENEIATVNPVATEQWGDVSENLMNAEDA

SEQ ID NO: 110515 - protein, 32 aa, Artificial Sequence
  Description of Artificial Sequence: Synthetic polypeptide
DENEIATTNPVSTEQYGTVSMEDLQQDHNGNH

SEQ ID NO: 110516 - protein, 29 aa, Artificial Sequence
  Description of Artificial Sequence: Synthetic peptide
DESEVASTNPVSTEGYGNVAANTIQRGQR

SEQ ID NO: 110517 - protein, 33 aa, Artificial Sequence
  Description of Artificial Sequence: Synthetic polypeptide
DENEIATTNPVSTEQYGSVSATDIQEDQEGNDL

SEQ ID NO: 110518 - protein, 33 aa, Artificial Sequence
  Description of Artificial Sequence: Synthetic polypeptide
DENEIATTNPVSTEQYGSVSATDIQEDHEGNDL

SEQ ID NO: 110519 - protein, 34 aa, Artificial Sequence
  Description of Artificial Sequence: Synthetic polypeptide
DENEIATTNPVSTEQYGSVATNLDQTRPGGEAQN

SEQ ID NO: 110520 - protein, 29 aa, Artificial Sequence
  Description of Artificial Sequence: Synthetic peptide
DESEVASTNPVSTEGYGNVAANTIQRGTR

SEQ ID NO: 110521 - protein, 30 aa, Artificial Sequence
  Description of Artificial Sequence: Synthetic polypeptide
DENEIATTNPVSTEPYGVISMETLQQQGNI

SEQ ID NO: 110522 - protein, 30 aa, Artificial Sequence
  Description of Artificial Sequence: Synthetic polypeptide
DENEIATTNPVSTEPYGVISMETLQQQGNH

SEQ ID NO: 110523 - protein, 29 aa, Artificial Sequence
  Description of Artificial Sequence: Synthetic peptide
DESEVASTNPVSTEGYGNVAANTLQREQR

SEQ ID NO: 110524 - protein, 32 aa, Artificial Sequence
  Description of Artificial Sequence: Synthetic polypeptide
SEEEIRCTNPIATEQWGSVWGENDDMHRGGNR

SEQ ID NO: 110525 - protein, 32 aa, Artificial Sequence
  Description of Artificial Sequence: Synthetic polypeptide
SEEEIRCTNPIATEQWGSVWGENDDMRTGNER

SEQ ID NO: 110526 - protein, 28 aa, Artificial Sequence
  Description of Artificial Sequence: Synthetic peptide
DESEVASTNPVSTEGYGNVASTLQHGDI

SEQ ID NO: 110527 - protein, 28 aa, Artificial Sequence
  Description of Artificial Sequence: Synthetic peptide
DESEVASTNPVSTEGYGNVASTLQHGQI

SEQ ID NO: 110528 - protein, 32 aa, Artificial Sequence
  Description of Artificial Sequence: Synthetic polypeptide
DENEIATTNPVSTEPYGTVSMENIQQQQNGNR

SEQ ID NO: 110529 - protein, 29 aa, Artificial Sequence
  Description of Artificial Sequence: Synthetic peptide
DESEVASTNPVSTEGYGNVASTLQRVGQI

SEQ ID NO: 110530 - protein, 29 aa, Artificial Sequence
  Description of Artificial Sequence: Synthetic peptide
DENEIATTNPVSTEPYGTISMDIQQQGNH

SEQ ID NO: 110531 - protein, 29 aa, Artificial Sequence
  Description of Artificial Sequence: Synthetic peptide
DENEIATTNPVSTEPYGTISECIQQNGNH

SEQ ID NO: 110532 - protein, 35 aa, Artificial Sequence
  Description of Artificial Sequence: Synthetic polypeptide
AEEEIRTTNPVATEQYGSVSTVGNGNNDNGTNNSD

SEQ ID NO: 110533 - protein, 35 aa, Artificial Sequence
  Description of Artificial Sequence: Synthetic polypeptide
AEEEIRTTNPVATEQYGSVSTVGNGEQAGVEQIGE

SEQ ID NO: 110534 - protein, 29 aa, Artificial Sequence
  Description of Artificial Sequence: Synthetic peptide
DESEVASTNPVSTEGYGNVSCTIQSRGQR

SEQ ID NO: 110535 - protein, 31 aa, Artificial Sequence
  Description of Artificial Sequence: Synthetic polypeptide
DENEIATTNPVSTEPYGTISCENLQQSNGNH

SEQ ID NO: 110536 - protein, 31 aa, Artificial Sequence
  Description of Artificial Sequence: Synthetic polypeptide
DENEIATTNPVSTEPYGNISMTIQQQRVGNH

SEQ ID NO: 110537 - protein, 31 aa, Artificial Sequence
  Description of Artificial Sequence: Synthetic polypeptide
DESEVASTNPVSTEGYGTVSAMTIQQRVGNR

SEQ ID NO: 110538 - protein, 31 aa, Artificial Sequence
  Description of Artificial Sequence: Synthetic polypeptide
SEEEIRCTNPIATEQYGATVWAENLAERGPI

SEQ ID NO: 110539 - protein, 29 aa, Artificial Sequence
  Description of Artificial Sequence: Synthetic peptide
DESEVASTNPVSTEGYGNVAANCLQREQR

SEQ ID NO: 110540 - protein, 31 aa, Artificial Sequence
  Description of Artificial Sequence: Synthetic polypeptide
SEEEIRCTNPIATEQYGATVWAENLMERGPI

SEQ ID NO: 110541 - protein, 33 aa, Artificial Sequence
  Description of Artificial Sequence: Synthetic polypeptide
SEEEIRCTNPIATEQWGSVSGENDDDMRGGNER

SEQ ID NO: 110542 - protein, 33 aa, Artificial Sequence
  Description of Artificial Sequence: Synthetic polypeptide
DENEIATVNPVATEQYGSVSWTEDLMDEGQGNH

SEQ ID NO: 110543 - protein, 34 aa, Artificial Sequence
  Description of Artificial Sequence: Synthetic polypeptide
NETEIATTNPVATEMWGSVCSTNLGQGNEGNEDR

SEQ ID NO: 110544 - protein, 32 aa, Artificial Sequence
  Description of Artificial Sequence: Synthetic polypeptide
NETEIATTNPVATEMWGMVSTNLQGNEGNNES

SEQ ID NO: 110545 - protein, 31 aa, Artificial Sequence
  Description of Artificial Sequence: Synthetic polypeptide
SEEEIRCTNPIATEQWGAVVEMNVGMRGNDR

SEQ ID NO: 110546 - protein, 29 aa, Artificial Sequence
  Description of Artificial Sequence: Synthetic peptide
SEEEIRCTNPIATEQWGDVSEIEMNRGDA

SEQ ID NO: 110547 - protein, 31 aa, Artificial Sequence
  Description of Artificial Sequence: Synthetic polypeptide
DESEVASTNPVATEGYGNVSANTIQDRVGQR

SEQ ID NO: 110548 - protein, 32 aa, Artificial Sequence
  Description of Artificial Sequence: Synthetic polypeptide
SEEEIRCTNPIATEQWGSCSGENDMRAGTNMR

SEQ ID NO: 110549 - protein, 32 aa, Artificial Sequence
  Description of Artificial Sequence: Synthetic polypeptide
SEEEIRCTNPIATEQWGSTVWSNAENLMPGPR

SEQ ID NO: 110550 - protein, 33 aa, Artificial Sequence
  Description of Artificial Sequence: Synthetic polypeptide
SEEEIRCTNPIATEQWGSVASGEHNDMRHGNSR

SEQ ID NO: 110551 - protein, 30 aa, Artificial Sequence
  Description of Artificial Sequence: Synthetic polypeptide
CEEVIACTNPVAYEQYGSVATNLQANPTEN

SEQ ID NO: 110552 - protein, 31 aa, Artificial Sequence
  Description of Artificial Sequence: Synthetic polypeptide
DESEVASTNPVATEGYGTVSANTIESRVGNR

SEQ ID NO: 110553 - protein, 32 aa, Artificial Sequence
  Description of Artificial Sequence: Synthetic polypeptide
SEEEIRCTNPIATEQWGSVFGELNDMHRGGNR

SEQ ID NO: 110554 - protein, 30 aa, Artificial Sequence
  Description of Artificial Sequence: Synthetic polypeptide
DESEVASTNPVATEQYGNAAETLQSRVGGR

SEQ ID NO: 110555 - protein, 32 aa, Artificial Sequence
  Description of Artificial Sequence: Synthetic polypeptide
NETEIATTNPVATEMWGEVSTNLQGNDGQNTH

SEQ ID NO: 110556 - protein, 33 aa, Artificial Sequence
  Description of Artificial Sequence: Synthetic polypeptide
DESEIRTTNPVATECWGSSSCINEPQDREGRNG

SEQ ID NO: 110557 - protein, 36 aa, Artificial Sequence
  Description of Artificial Sequence: Synthetic polypeptide
AEEEIRTTNPVATEQYGSVSTVGNNQQGNNNNNTDT

SEQ ID NO: 110558 - protein, 36 aa, Artificial Sequence
  Description of Artificial Sequence: Synthetic polypeptide
AEEEIRTTNPVATEQYGSVSTVGNNQQGNNANNEDE

SEQ ID NO: 110559 - protein, 29 aa, Artificial Sequence
  Description of Artificial Sequence: Synthetic peptide
DESEVASTNPVGTEGYGNVASTLQSHGDR

SEQ ID NO: 110560 - protein, 29 aa, Artificial Sequence
  Description of Artificial Sequence: Synthetic peptide
DESEVASTNPVGTEGYGVVASTLQSHGDR

SEQ ID NO: 110561 - protein, 35 aa, Artificial Sequence
  Description of Artificial Sequence: Synthetic polypeptide
AEEEIRTTNPVATEQYGSVSTVGNNNQGNNNNQDT

SEQ ID NO: 110562 - protein, 35 aa, Artificial Sequence
  Description of Artificial Sequence: Synthetic polypeptide
AEEEIRTTNPVATEQYGSVSTVGNNNQGNNNNEDE

SEQ ID NO: 110563 - protein, 35 aa, Artificial Sequence
  Description of Artificial Sequence: Synthetic polypeptide
AEEEIRTTNPVATEQYGSVSTVGNNNQAGVEQIGE

SEQ ID NO: 110564 - protein, 36 aa, Artificial Sequence
  Description of Artificial Sequence: Synthetic polypeptide
AEEEIRTTNPVATEQYGSVSTVGNNNNQQGSTNVNV

SEQ ID NO: 110565 - protein, 36 aa, Artificial Sequence
  Description of Artificial Sequence: Synthetic polypeptide
AEEEIRTTNPVATEQYGSVSTVGNNNNQQGSTNTGE

SEQ ID NO: 110566 - protein, 35 aa, Artificial Sequence
  Description of Artificial Sequence: Synthetic polypeptide
AEEEIRTTNPVATEQYGSVSTVGNNNNQQDENEGN

SEQ ID NO: 110567 - protein, 35 aa, Artificial Sequence
  Description of Artificial Sequence: Synthetic polypeptide
AEEEIRTTNPVATEQYGSVSTVGNNNNQNDTNQGS

SEQ ID NO: 110568 - protein, 29 aa, Artificial Sequence
  Description of Artificial Sequence: Synthetic peptide
DESEVASTNPVSTECYGNVSECIQRVGER

SEQ ID NO: 110569 - protein, 35 aa, Artificial Sequence
  Description of Artificial Sequence: Synthetic polypeptide
AEEEIRTTNPVATEQYGSVSTVEGNNNNQEDENGV

SEQ ID NO: 110570 - protein, 29 aa, Artificial Sequence
  Description of Artificial Sequence: Synthetic peptide
DENEIATTNPVSTEPYGDISECIQQNGNH

SEQ ID NO: 110571 - protein, 30 aa, Artificial Sequence
  Description of Artificial Sequence: Synthetic polypeptide
DENEIATTNPVSTEGYGVISMTLQQQQGNH

SEQ ID NO: 110572 - protein, 30 aa, Artificial Sequence
  Description of Artificial Sequence: Synthetic polypeptide
DENEIATTNPVSTEGYGNVANDIQQRVGQR

SEQ ID NO: 110573 - protein, 30 aa, Artificial Sequence
  Description of Artificial Sequence: Synthetic polypeptide
DENEIATTNPVSTECYGTVSMDLQQQNENH

SEQ ID NO: 110574 - protein, 33 aa, Artificial Sequence
  Description of Artificial Sequence: Synthetic polypeptide
SEEEIRCTNPIATEQYGCVCSWNLTRFGSNTQS

SEQ ID NO: 110575 - protein, 31 aa, Artificial Sequence
  Description of Artificial Sequence: Synthetic polypeptide
SEEEIRCTNPIATEQYGCVCSWNPARFGSDQ

SEQ ID NO: 110576 - protein, 30 aa, Artificial Sequence
  Description of Artificial Sequence: Synthetic polypeptide
DESEVATTNPVATEQYGNVAAEVIQSREER

SEQ ID NO: 110577 - protein, 36 aa, Artificial Sequence
  Description of Artificial Sequence: Synthetic polypeptide
AEEEIRTTNPVATEQYGSVSTVDNNGNQEQGNNQED

SEQ ID NO: 110578 - protein, 32 aa, Artificial Sequence
  Description of Artificial Sequence: Synthetic polypeptide
DESEVATTNPVATEQYGSVSATDLESHEGQDL

SEQ ID NO: 110579 - protein, 32 aa, Artificial Sequence
  Description of Artificial Sequence: Synthetic polypeptide
DESEVATTNPVATEQYGTVCSANDGIQFEGND

SEQ ID NO: 110580 - protein, 28 aa, Artificial Sequence
  Description of Artificial Sequence: Synthetic peptide
DESEVATTNPVSTECYGDVANTIQHGQR

SEQ ID NO: 110581 - protein, 28 aa, Artificial Sequence
  Description of Artificial Sequence: Synthetic peptide
DESEVATTNPVSTECYGDVANTLQHGQL

SEQ ID NO: 110582 - protein, 30 aa, Artificial Sequence
  Description of Artificial Sequence: Synthetic polypeptide
DENEIATTNPVSSEPYGTISMNIQQQQGNR

SEQ ID NO: 110583 - protein, 32 aa, Artificial Sequence
  Description of Artificial Sequence: Synthetic polypeptide
NETEIATTNPVATECWGSVSTNLQGNDGQTDS

SEQ ID NO: 110584 - protein, 31 aa, Artificial Sequence
  Description of Artificial Sequence: Synthetic polypeptide
DENEIATTNPVSSEPYGTISCENLQQSNGNR

SEQ ID NO: 110585 - protein, 31 aa, Artificial Sequence
  Description of Artificial Sequence: Synthetic polypeptide
DESEVATTNPVSTEGYGNVAANDLQSRVGER

SEQ ID NO: 110586 - protein, 35 aa, Artificial Sequence
  Description of Artificial Sequence: Synthetic polypeptide
DENEIATTNPVAYEQYGVSVSATNDIGQARAGIAR

SEQ ID NO: 110587 - protein, 32 aa, Artificial Sequence
  Description of Artificial Sequence: Synthetic polypeptide
DESEVATTNPVSTEQYGSVSATDLQSHEGQDL

SEQ ID NO: 110588 - protein, 34 aa, Artificial Sequence
  Description of Artificial Sequence: Synthetic polypeptide
NETEDEIRTTNPVAYEQYGTVATNLQAGGPNGNG

SEQ ID NO: 110589 - protein, 34 aa, Artificial Sequence
  Description of Artificial Sequence: Synthetic polypeptide
DESEVIRTTNPVATECWGSVSCINEPQDREGENG

SEQ ID NO: 110590 - protein, 34 aa, Artificial Sequence
  Description of Artificial Sequence: Synthetic polypeptide
DESEVIRTTNPVATECWGSVSCINTPQDREGENG

SEQ ID NO: 110591 - protein, 28 aa, Artificial Sequence
  Description of Artificial Sequence: Synthetic peptide
SEEEIRCTNPIATEQYGEAPEVCQHGEK

SEQ ID NO: 110592 - protein, 34 aa, Artificial Sequence
  Description of Artificial Sequence: Synthetic polypeptide
DESEVIRTTNPVATECWGSVSCNNEPQDREGENG

SEQ ID NO: 110593 - protein, 33 aa, Artificial Sequence
  Description of Artificial Sequence: Synthetic polypeptide
DENEIATTNPVAYEQYGSVCAATNNLAETPGER

SEQ ID NO: 110594 - protein, 36 aa, Artificial Sequence
  Description of Artificial Sequence: Synthetic polypeptide
AEEEIRTTNPVATEQYGSVSTVDNGNQQGTNPNEDE

SEQ ID NO: 110595 - protein, 36 aa, Artificial Sequence
  Description of Artificial Sequence: Synthetic polypeptide
AEEEIRTTNPVATEQYGSVSTVDNGNQQGTNNNVTE

SEQ ID NO: 110596 - protein, 36 aa, Artificial Sequence
  Description of Artificial Sequence: Synthetic polypeptide
AEEEIRTTNPVATEQYGSVSTVDNGNQQGTNLQEQE

SEQ ID NO: 110597 - protein, 31 aa, Artificial Sequence
  Description of Artificial Sequence: Synthetic polypeptide
DENEIATTNPVSTEGYGNVSNDIQQQRNGQR

SEQ ID NO: 110598 - protein, 31 aa, Artificial Sequence
  Description of Artificial Sequence: Synthetic polypeptide
DESEVATTNPVATEGWGNVACINEQDREGNR

SEQ ID NO: 110599 - protein, 31 aa, Artificial Sequence
  Description of Artificial Sequence: Synthetic polypeptide
DESEVATTNPVATEGWGNVAACNEQDRVGNR

SEQ ID NO: 110600 - protein, 30 aa, Artificial Sequence
  Description of Artificial Sequence: Synthetic polypeptide
DESEVASVNPVSTEQYGVVSNNLQSSVGNQ

SEQ ID NO: 110601 - protein, 29 aa, Artificial Sequence
  Description of Artificial Sequence: Synthetic peptide
DESEVASTNPVSTEGYGVVAANNLQRGQQ

SEQ ID NO: 110602 - protein, 30 aa, Artificial Sequence
  Description of Artificial Sequence: Synthetic polypeptide
DESEVASTNPVSTEQYGNVAANTIQSRGQR

SEQ ID NO: 110603 - protein, 31 aa, Artificial Sequence
  Description of Artificial Sequence: Synthetic polypeptide
DENEIATTNPVSTEGYGTVSNDIQQQRNGQR

SEQ ID NO: 110604 - protein, 31 aa, Artificial Sequence
  Description of Artificial Sequence: Synthetic polypeptide
DENEIATTNPVSTEGYGTVSMDIQQQRNGQR

SEQ ID NO: 110605 - protein, 32 aa, Artificial Sequence
  Description of Artificial Sequence: Synthetic polypeptide
SEEEIRCTNPIATEQYGAVVSEMNGMRPNDRV

SEQ ID NO: 110606 - protein, 29 aa, Artificial Sequence
  Description of Artificial Sequence: Synthetic peptide
DESEVASTNPVSTEQYGNVANTIQSRGQR

SEQ ID NO: 110607 - protein, 33 aa, Artificial Sequence
  Description of Artificial Sequence: Synthetic polypeptide
SEEEIRCTNPIATEQYGCVCSNWGNLARFGSNQ

SEQ ID NO: 110608 - protein, 30 aa, Artificial Sequence
  Description of Artificial Sequence: Synthetic polypeptide
DENEIATTNPVSTEGYGTISMTLQQQQGNH

SEQ ID NO: 110609 - protein, 31 aa, Artificial Sequence
  Description of Artificial Sequence: Synthetic polypeptide
DESEVASTNPVSTEQYGTVAANDGIQRVGNR

SEQ ID NO: 110610 - protein, 31 aa, Artificial Sequence
  Description of Artificial Sequence: Synthetic polypeptide
SEEEIRCTNPIATEQYGCVCSWEHARFGNQA

SEQ ID NO: 110611 - protein, 30 aa, Artificial Sequence
  Description of Artificial Sequence: Synthetic polypeptide
SEEEIRCTNPIATEQYGCVCSWEHMHGSNQ

SEQ ID NO: 110612 - protein, 32 aa, Artificial Sequence
  Description of Artificial Sequence: Synthetic polypeptide
SEEEIRCTNPIATEQYGCVCSWELMRFGSNQN

SEQ ID NO: 110613 - protein, 37 aa, Artificial Sequence
  Description of Artificial Sequence: Synthetic polypeptide
AEEEIRTTNPVATEQYGSVSTTVNLNQQGTNLGNEEA

SEQ ID NO: 110614 - protein, 31 aa, Artificial Sequence
  Description of Artificial Sequence: Synthetic polypeptide
SEEEIRCTNPIATEQYGCVCSWELTHFGSNQ

SEQ ID NO: 110615 - protein, 30 aa, Artificial Sequence
  Description of Artificial Sequence: Synthetic polypeptide
DESEVASVNPVCTEQYGNVSADNIQSSGNR

SEQ ID NO: 110616 - protein, 31 aa, Artificial Sequence
  Description of Artificial Sequence: Synthetic polypeptide
SEEEIRCTNPIATEQYGCVCSWGNHMNGSNQ

SEQ ID NO: 110617 - protein, 30 aa, Artificial Sequence
  Description of Artificial Sequence: Synthetic polypeptide
DESEVASVNPVCTEQYGNVSANTIQSSGNR

SEQ ID NO: 110618 - protein, 31 aa, Artificial Sequence
  Description of Artificial Sequence: Synthetic polypeptide
SEEEIRCTNPIATEQYGCVCSWGNLINGSDQ

SEQ ID NO: 110619 - protein, 30 aa, Artificial Sequence
  Description of Artificial Sequence: Synthetic polypeptide
DENEIATTNPVSTEGYGTISMTIQQQQGNH

SEQ ID NO: 110620 - protein, 36 aa, Artificial Sequence
  Description of Artificial Sequence: Synthetic polypeptide
AEEEIRTTNPVATEQYGSVSTVDQNGNQEEGNNQTD

SEQ ID NO: 110621 - protein, 31 aa, Artificial Sequence
  Description of Artificial Sequence: Synthetic polypeptide
DENEIATTNPVSTEGYGNVSNDIQQQRVGQR

SEQ ID NO: 110622 - protein, 30 aa, Artificial Sequence
  Description of Artificial Sequence: Synthetic polypeptide
DESEVASVNPVSTEQYGVVSDNLQSSVGNQ

SEQ ID NO: 110623 - protein, 31 aa, Artificial Sequence
  Description of Artificial Sequence: Synthetic polypeptide
SEEEIRCTNPIATEQYGCVCSWNHAYGSNQN

SEQ ID NO: 110624 - protein, 32 aa, Artificial Sequence
  Description of Artificial Sequence: Synthetic polypeptide
SEEEIRCTNPIATEQYGCVCSWNHNIRFGSNQ

SEQ ID NO: 110625 - protein, 32 aa, Artificial Sequence
  Description of Artificial Sequence: Synthetic polypeptide
SEEEIRCTNPIATEQYGCVCSWNLANFGSENQ

SEQ ID NO: 110626 - protein, 31 aa, Artificial Sequence
  Description of Artificial Sequence: Synthetic polypeptide
SEEEIRCTNPIATEQYGCVCSWNLANFNNQS

SEQ ID NO: 110627 - protein, 32 aa, Artificial Sequence
  Description of Artificial Sequence: Synthetic polypeptide
SEEEIRCTNPIATEQYGCVCSWENLMSFGSNQ

SEQ ID NO: 110628 - protein, 31 aa, Artificial Sequence
  Description of Artificial Sequence: Synthetic polypeptide
DESEVASTNPVATEGWGNVSANTIQDRVGNR

SEQ ID NO: 110629 - protein, 33 aa, Artificial Sequence
  Description of Artificial Sequence: Synthetic polypeptide
DESNIRTTNPVATECWGSVSCINEPQDREGENG

SEQ ID NO: 110630 - protein, 32 aa, Artificial Sequence
  Description of Artificial Sequence: Synthetic polypeptide
DENEIATTNPVATEQYGSVSATDEEDHAGEDL

SEQ ID NO: 110631 - protein, 32 aa, Artificial Sequence
  Description of Artificial Sequence: Synthetic polypeptide
NEREIRTTNPVATEQYGCVCQWNLNQYGSDQS

SEQ ID NO: 110632 - protein, 30 aa, Artificial Sequence
  Description of Artificial Sequence: Synthetic polypeptide
AESEVASTNPVATEQYGNVAAETLQSRGQR

SEQ ID NO: 110633 - protein, 31 aa, Artificial Sequence
  Description of Artificial Sequence: Synthetic polypeptide
NEREIRTTNPVATEQYGCVCGWNDQHGSDQA

SEQ ID NO: 110634 - protein, 32 aa, Artificial Sequence
  Description of Artificial Sequence: Synthetic polypeptide
NEREIRTTNPVATEQYGCVCGTGNDQIGSDQA

SEQ ID NO: 110635 - protein, 37 aa, Artificial Sequence
  Description of Artificial Sequence: Synthetic polypeptide
AEEEIRTTNPVATEQYGSVSTTTNLNQQGTNNNNEQF

SEQ ID NO: 110636 - protein, 37 aa, Artificial Sequence
  Description of Artificial Sequence: Synthetic polypeptide
AEEEIRTTNPVATEQYGSVSTTTNLNQQGNNADTDED

SEQ ID NO: 110637 - protein, 36 aa, Artificial Sequence
  Description of Artificial Sequence: Synthetic polypeptide
AEEEIRTTNPVATEQYGSVSTTTNLNQGTNNNNELG

SEQ ID NO: 110638 - protein, 36 aa, Artificial Sequence
  Description of Artificial Sequence: Synthetic polypeptide
AEEEIRTTNPVATEQYGSVSTTTNLNNQGTNNNEEF

SEQ ID NO: 110639 - protein, 36 aa, Artificial Sequence
  Description of Artificial Sequence: Synthetic polypeptide
AEEEIRTTNPVATEQYGSVSTTTNLNEQGTNNNEEF

SEQ ID NO: 110640 - protein, 31 aa, Artificial Sequence
  Description of Artificial Sequence: Synthetic polypeptide
DESVIATTNPVAYEQWGCVETDNDQHTGNRG

SEQ ID NO: 110641 - protein, 30 aa, Artificial Sequence
  Description of Artificial Sequence: Synthetic polypeptide
CENEIACTNPVATEQYGTEALENSQLRGGR

SEQ ID NO: 110642 - protein, 36 aa, Artificial Sequence
  Description of Artificial Sequence: Synthetic polypeptide
AEEEIRTTNPVATEQYGSVSTTTNLLQGNQQGEEEG

SEQ ID NO: 110643 - protein, 36 aa, Artificial Sequence
  Description of Artificial Sequence: Synthetic polypeptide
AEEEIRTTNPVATEQYGSVSTTTNLLQGNPTNNQNE

SEQ ID NO: 110644 - protein, 31 aa, Artificial Sequence
  Description of Artificial Sequence: Synthetic polypeptide
DESVIATTNPVAYEQWGCVETNDHQGMGGNR

SEQ ID NO: 110645 - protein, 28 aa, Artificial Sequence
  Description of Artificial Sequence: Synthetic peptide
CENEIAPTNPVATECYGDVSECLQHEEL

SEQ ID NO: 110646 - protein, 36 aa, Artificial Sequence
  Description of Artificial Sequence: Synthetic polypeptide
AEEEIRTTNPVATEQYGSVVVTVNQLQSNETGTNND

SEQ ID NO: 110647 - protein, 30 aa, Artificial Sequence
  Description of Artificial Sequence: Synthetic polypeptide
DENEIATTNPVATEQYGDVSEILMNAAEDA

SEQ ID NO: 110648 - protein, 35 aa, Artificial Sequence
  Description of Artificial Sequence: Synthetic polypeptide
AEEEIRTTNPVATEQYGSVVVTVNSNQNQNGTNDD

SEQ ID NO: 110649 - protein, 35 aa, Artificial Sequence
  Description of Artificial Sequence: Synthetic polypeptide
AEEEIRTTNPVATEQYGSVVVTVNSNQNQQGTNQD

SEQ ID NO: 110650 - protein, 34 aa, Artificial Sequence
  Description of Artificial Sequence: Synthetic polypeptide
NEQEIRTTNPVATEQYGSVCSTISVLQTADGSQQ

SEQ ID NO: 110651 - protein, 30 aa, Artificial Sequence
  Description of Artificial Sequence: Synthetic polypeptide
DESVIATTNPVAYEQWGCVETNPQGEGGDR

SEQ ID NO: 110652 - protein, 32 aa, Artificial Sequence
  Description of Artificial Sequence: Synthetic polypeptide
NEQEIATTNPVAYEEWGSVSTNLQGNDGNTDE

SEQ ID NO: 110653 - protein, 30 aa, Artificial Sequence
  Description of Artificial Sequence: Synthetic polypeptide
DENEIATTNPVATEQYGDVSEIEMNAAGGA

SEQ ID NO: 110654 - protein, 30 aa, Artificial Sequence
  Description of Artificial Sequence: Synthetic polypeptide
DENEIATTNPVATEQYGDVSEIEMNAAGDA

SEQ ID NO: 110655 - protein, 32 aa, Artificial Sequence
  Description of Artificial Sequence: Synthetic polypeptide
NEQEIATTNPVATEQYGSVSATDLEDHEGEDL

SEQ ID NO: 110656 - protein, 31 aa, Artificial Sequence
  Description of Artificial Sequence: Synthetic polypeptide
DENEIATTNPVATEQYGDVSTEPCGNMHGEL

SEQ ID NO: 110657 - protein, 29 aa, Artificial Sequence
  Description of Artificial Sequence: Synthetic peptide
DENEIATTNPVATEQYGDVSEIEMAAEDL

SEQ ID NO: 110658 - protein, 36 aa, Artificial Sequence
  Description of Artificial Sequence: Synthetic polypeptide
AEEEIRTTNPVATEQYGSVSTTTNLQAGTEAGTEGG

SEQ ID NO: 110659 - protein, 37 aa, Artificial Sequence
  Description of Artificial Sequence: Synthetic polypeptide
AEEEIRTTNPVATEQYGSVSTTTNLQLQGTNGTEDDT

SEQ ID NO: 110660 - protein, 37 aa, Artificial Sequence
  Description of Artificial Sequence: Synthetic polypeptide
AEEEIRTTNPVATEQYGSVSTTTNNLQLGNEGIGNGT

SEQ ID NO: 110661 - protein, 28 aa, Artificial Sequence
  Description of Artificial Sequence: Synthetic peptide
AETEIACTNPVATEQWGAASANWAPGGR

SEQ ID NO: 110662 - protein, 36 aa, Artificial Sequence
  Description of Artificial Sequence: Synthetic polypeptide
AEEEIRTTNPVATEQYGSVSTTTNNLQAGSTDEEED

SEQ ID NO: 110663 - protein, 37 aa, Artificial Sequence
  Description of Artificial Sequence: Synthetic polypeptide
AEEEIRTTNPVATEQYGSVSTTTNNLQAGDEAGNVET

SEQ ID NO: 110664 - protein, 36 aa, Artificial Sequence
  Description of Artificial Sequence: Synthetic polypeptide
AEEEIRTTNPVATEQYGSVSTTTNNLNQNEQGTEQG

SEQ ID NO: 110665 - protein, 36 aa, Artificial Sequence
  Description of Artificial Sequence: Synthetic polypeptide
AEEEIRTTNPVATEQYGSVSTTTNNLNNGNQGTNNV

SEQ ID NO: 110666 - protein, 36 aa, Artificial Sequence
  Description of Artificial Sequence: Synthetic polypeptide
AEEEIRTTNPVATEQYGSVSTTTNNLNGTELGNNLV

SEQ ID NO: 110667 - protein, 37 aa, Artificial Sequence
  Description of Artificial Sequence: Synthetic polypeptide
AEEEIRTTNPVATEQYGSVSTTTNNLGQQGTTTNVET

SEQ ID NO: 110668 - protein, 35 aa, Artificial Sequence
  Description of Artificial Sequence: Synthetic polypeptide
AEEEIRTTNPVATEQYGSVSTTTNNINDEQGNNAD

SEQ ID NO: 110669 - protein, 35 aa, Artificial Sequence
  Description of Artificial Sequence: Synthetic polypeptide
AEEEIRTTNPVATEQYGSVVVTVNNLNNTAGTNNQ

SEQ ID NO: 110670 - protein, 33 aa, Artificial Sequence
  Description of Artificial Sequence: Synthetic polypeptide
DESTIRTTNPVATECWGSVSCINEPQDREGENG

SEQ ID NO: 110671 - protein, 35 aa, Artificial Sequence
  Description of Artificial Sequence: Synthetic polypeptide
AEEEIRTTNPVATEQYGSVSTTTNMEQGTNNVTTE

SEQ ID NO: 110672 - protein, 36 aa, Artificial Sequence
  Description of Artificial Sequence: Synthetic polypeptide
AEEEIRTTNPVATEQYGSVVVTVNNLQSNEQGNNNE

SEQ ID NO: 110673 - protein, 36 aa, Artificial Sequence
  Description of Artificial Sequence: Synthetic polypeptide
AEEEIRTTNPVATEQYGSVSTTTNLQQQGEDEEEEG

SEQ ID NO: 110674 - protein, 36 aa, Artificial Sequence
  Description of Artificial Sequence: Synthetic polypeptide
AEEEIRTTNPVATEQYGSVSTTTNLQQNEIGTEEGV

SEQ ID NO: 110675 - protein, 35 aa, Artificial Sequence
  Description of Artificial Sequence: Synthetic polypeptide
AEEEIRTTNPVATEQYGSVVVTVNNNEQAGTNEQS

SEQ ID NO: 110676 - protein, 35 aa, Artificial Sequence
  Description of Artificial Sequence: Synthetic polypeptide
DENEIATTNPVATEQYGDVSTTPCLPQMRNGMNPV

SEQ ID NO: 110677 - protein, 34 aa, Artificial Sequence
  Description of Artificial Sequence: Synthetic polypeptide
DESTIRTTNPVATEQYGDSVSIMNLIEGQGDNGD

SEQ ID NO: 110678 - protein, 35 aa, Artificial Sequence
  Description of Artificial Sequence: Synthetic polypeptide
AEEEIRTTNPVATEQYGSVSTTTNLQQNEDEEDEG

SEQ ID NO: 110679 - protein, 36 aa, Artificial Sequence
  Description of Artificial Sequence: Synthetic polypeptide
AEEEIRTTNPVATEQYGSVSTTTNLQQNATEQGEDE

SEQ ID NO: 110680 - protein, 31 aa, Artificial Sequence
  Description of Artificial Sequence: Synthetic polypeptide
DENEIATTNPVATEQYGDVSTTPCGNMHGEL

SEQ ID NO: 110681 - protein, 35 aa, Artificial Sequence
  Description of Artificial Sequence: Synthetic polypeptide
AEEEIRTTNPVATEQYGSVVVTVNNNNEQAGNQQS

SEQ ID NO: 110682 - protein, 37 aa, Artificial Sequence
  Description of Artificial Sequence: Synthetic polypeptide
AEEEIRTTNPVATEQYGSVSTTTNLQQGNQQGNNQTQ

SEQ ID NO: 110683 - protein, 35 aa, Artificial Sequence
  Description of Artificial Sequence: Synthetic polypeptide
AEEEIRTTNPVATEQYGSVVVTVNQLNNTQGTNND

SEQ ID NO: 110684 - protein, 31 aa, Artificial Sequence
  Description of Artificial Sequence: Synthetic polypeptide
NEREIRTTNPVATEQYGCVCWTNDQNNSDQA

SEQ ID NO: 110685 - protein, 32 aa, Artificial Sequence
  Description of Artificial Sequence: Synthetic polypeptide
NEREIRTTNPVATEQYGCVCWTELNQNFGSDA

SEQ ID NO: 110686 - protein, 36 aa, Artificial Sequence
  Description of Artificial Sequence: Synthetic polypeptide
AEEEIRTTNPVATEQYGSVVVTVNLQSNEQGTNVNT

SEQ ID NO: 110687 - protein, 30 aa, Artificial Sequence
  Description of Artificial Sequence: Synthetic polypeptide
DENEIATTNPVATEQYGDVSEDEMDAAGDL

SEQ ID NO: 110688 - protein, 29 aa, Artificial Sequence
  Description of Artificial Sequence: Synthetic peptide
CENEIATTNPVATECYGCVCSWELQHEEL

SEQ ID NO: 110689 - protein, 36 aa, Artificial Sequence
  Description of Artificial Sequence: Synthetic polypeptide
AEEEIRTTNPVATEQYGSVSTTSNLGANEQGTNNGG

SEQ ID NO: 110690 - protein, 31 aa, Artificial Sequence
  Description of Artificial Sequence: Synthetic polypeptide
DENEIATTNPVATEQYGDVCSATGPEHEENL

SEQ ID NO: 110691 - protein, 32 aa, Artificial Sequence
  Description of Artificial Sequence: Synthetic polypeptide
DENEIATTNPVATEQYGDVCSAEDGPQFEGNL

SEQ ID NO: 110692 - protein, 29 aa, Artificial Sequence
  Description of Artificial Sequence: Synthetic peptide
DENEIATTNPVATEQYGDASEVEQNHEEK

SEQ ID NO: 110693 - protein, 29 aa, Artificial Sequence
  Description of Artificial Sequence: Synthetic peptide
DENEIATTNPVATEQYGDASEIEQNHEEK

SEQ ID NO: 110694 - protein, 36 aa, Artificial Sequence
  Description of Artificial Sequence: Synthetic polypeptide
AEEEIRTTNPVATEQYGSVSTTSNGNQQGENGTNVN

SEQ ID NO: 110695 - protein, 33 aa, Artificial Sequence
  Description of Artificial Sequence: Synthetic polypeptide
DENEIATTNPVATEQYGCVATNNSERGNQNEYF

SEQ ID NO: 110696 - protein, 32 aa, Artificial Sequence
  Description of Artificial Sequence: Synthetic polypeptide
DENEIATTNPVATEQYGCVATNNEERNQNPEN

SEQ ID NO: 110697 - protein, 33 aa, Artificial Sequence
  Description of Artificial Sequence: Synthetic polypeptide
DENEIATTNPVATEQYGCVATNLQQGAGMEKHN

SEQ ID NO: 110698 - protein, 35 aa, Artificial Sequence
  Description of Artificial Sequence: Synthetic polypeptide
AEEEIRTTNPVATEQYGSVVVTVTNDQGQTGTNLT

SEQ ID NO: 110699 - protein, 33 aa, Artificial Sequence
  Description of Artificial Sequence: Synthetic polypeptide
DENEIATTNPVATEQYGCVATNLQNEENNELLW

SEQ ID NO: 110700 - protein, 36 aa, Artificial Sequence
  Description of Artificial Sequence: Synthetic polypeptide
AEEEIRTTNPVATEQYGSVVVTVTNGNLNQQGTNIA

SEQ ID NO: 110701 - protein, 33 aa, Artificial Sequence
  Description of Artificial Sequence: Synthetic polypeptide
DENEIATTNPVATEQYGCVATNLEAPDNQMERH

SEQ ID NO: 110702 - protein, 32 aa, Artificial Sequence
  Description of Artificial Sequence: Synthetic polypeptide
DENEIATTNPVATEQYGCVATNLDNQANEDAW

SEQ ID NO: 110703 - protein, 32 aa, Artificial Sequence
  Description of Artificial Sequence: Synthetic polypeptide
DENEIATTNPVATEQYGCVATNLADTNPDNTN

SEQ ID NO: 110704 - protein, 33 aa, Artificial Sequence
  Description of Artificial Sequence: Synthetic polypeptide
DENEIATTNPVATEQYGCVAATTNHQEAGNQDP

SEQ ID NO: 110705 - protein, 35 aa, Artificial Sequence
  Description of Artificial Sequence: Synthetic polypeptide
AEEEIRTTNPVATEQYGSVSTTQQQQNQQGNIGTG

SEQ ID NO: 110706 - protein, 33 aa, Artificial Sequence
  Description of Artificial Sequence: Synthetic polypeptide
DENEIATTNPVATEQYGCVAATNLQNQANELMW

SEQ ID NO: 110707 - protein, 32 aa, Artificial Sequence
  Description of Artificial Sequence: Synthetic polypeptide
DESVIRTTNPVAYEQWGCVCEIEGNDQRGNDR

SEQ ID NO: 110708 - protein, 32 aa, Artificial Sequence
  Description of Artificial Sequence: Synthetic polypeptide
DENEIATTNPVATEQYGCVAATNLEAPDQHMN

SEQ ID NO: 110709 - protein, 33 aa, Artificial Sequence
  Description of Artificial Sequence: Synthetic polypeptide
DENEIATTNPVATEQYGCVAATNLATMNPENRM

SEQ ID NO: 110710 - protein, 35 aa, Artificial Sequence
  Description of Artificial Sequence: Synthetic polypeptide
AEEEIRTTNPVATEQYGSVSTTQQQLQGTNNNEQA

SEQ ID NO: 110711 - protein, 33 aa, Artificial Sequence
  Description of Artificial Sequence: Synthetic polypeptide
NEMEIRTTNPVATEQYGSVWAWNLNDEFMDNRN

SEQ ID NO: 110712 - protein, 35 aa, Artificial Sequence
  Description of Artificial Sequence: Synthetic polypeptide
AEEEIRTTNPVATEQYGSVSTTQQQGNQQGEEEES

SEQ ID NO: 110713 - protein, 37 aa, Artificial Sequence
  Description of Artificial Sequence: Synthetic polypeptide
AEEEIRTTNPVATEQYGSVSTTQQNLQQEISTEAGNE

SEQ ID NO: 110714 - protein, 28 aa, Artificial Sequence
  Description of Artificial Sequence: Synthetic peptide
NENEIATTNPVATECWGDVSECLQHEEA

SEQ ID NO: 110715 - protein, 30 aa, Artificial Sequence
  Description of Artificial Sequence: Synthetic polypeptide
DENEIATTNPVATEQYGDVSEDEMDAAGDA

SEQ ID NO: 110716 - protein, 37 aa, Artificial Sequence
  Description of Artificial Sequence: Synthetic polypeptide
AEEEIRTTNPVATEQYGSVSTTSNLGLQIGTTTTNDQ

SEQ ID NO: 110717 - protein, 28 aa, Artificial Sequence
  Description of Artificial Sequence: Synthetic peptide
NENEIATTNPVATECWGDVSESLQHMEE

SEQ ID NO: 110718 - protein, 35 aa, Artificial Sequence
  Description of Artificial Sequence: Synthetic polypeptide
AEEEIRTTNPVATEQYGSVVVTVQLQQNTEGGNNE

SEQ ID NO: 110719 - protein, 36 aa, Artificial Sequence
  Description of Artificial Sequence: Synthetic polypeptide
AEEEIRTTNPVATEQYGSVSTTTNGEQGNQQGTNTE

SEQ ID NO: 110720 - protein, 36 aa, Artificial Sequence
  Description of Artificial Sequence: Synthetic polypeptide
AEEEIRTTNPVATEQYGSVSTTTNDQNGDEAGNEDE

SEQ ID NO: 110721 - protein, 30 aa, Artificial Sequence
  Description of Artificial Sequence: Synthetic polypeptide
DENEIATTNPVATEQYGDVSECLEDHEEEL

SEQ ID NO: 110722 - protein, 32 aa, Artificial Sequence
  Description of Artificial Sequence: Synthetic polypeptide
NENEIRTTNPVAYEQWGQVVWTNLSQIAGGSR

SEQ ID NO: 110723 - protein, 36 aa, Artificial Sequence
  Description of Artificial Sequence: Synthetic polypeptide
AEEEIRTTNPVATEQYGSVVVTVTNAGNLQAGTNIE

SEQ ID NO: 110724 - protein, 29 aa, Artificial Sequence
  Description of Artificial Sequence: Synthetic peptide
CENEIATTNPVATECYGDVSAECLQHEEL

SEQ ID NO: 110725 - protein, 36 aa, Artificial Sequence
  Description of Artificial Sequence: Synthetic polypeptide
AEEEIRTTNPVATEQYGSVSTTTNANQQGEQENEEE

SEQ ID NO: 110726 - protein, 31 aa, Artificial Sequence
  Description of Artificial Sequence: Synthetic polypeptide
DENEIATTNPVATEQYGDVSATILMNHEEDA

SEQ ID NO: 110727 - protein, 31 aa, Artificial Sequence
  Description of Artificial Sequence: Synthetic polypeptide
DENEIATTNPVATEQYGDVSATDLMNHEEDA

SEQ ID NO: 110728 - protein, 37 aa, Artificial Sequence
  Description of Artificial Sequence: Synthetic polypeptide
AEEEIRTTNPVATEQYGSVSTTTENLQAGTEAGNNEG

SEQ ID NO: 110729 - protein, 36 aa, Artificial Sequence
  Description of Artificial Sequence: Synthetic polypeptide
AEEEIRTTNPVATEQYGSVSTTTDNGNQEQGNNQIG

SEQ ID NO: 110730 - protein, 31 aa, Artificial Sequence
  Description of Artificial Sequence: Synthetic polypeptide
DENEIATTNPVATEQYGDVSAECLEDHEGEL

SEQ ID NO: 110731 - protein, 31 aa, Artificial Sequence
  Description of Artificial Sequence: Synthetic polypeptide
AESEVACTNPVATEGYGEVSAENLQSRVGGR

SEQ ID NO: 110732 - protein, 37 aa, Artificial Sequence
  Description of Artificial Sequence: Synthetic polypeptide
AEEEIRTTNPVATEQYGSVSTTSTTNNLQQGSTNNQE

SEQ ID NO: 110733 - protein, 33 aa, Artificial Sequence
  Description of Artificial Sequence: Synthetic polypeptide
DESVIRTTNPVATECWGSVSCINEPQDREGENG

SEQ ID NO: 110734 - protein, 36 aa, Artificial Sequence
  Description of Artificial Sequence: Synthetic polypeptide
AEEEIRTTNPVATEQYGSVSTTSQLQNGTEGGTNMG

SEQ ID NO: 110735 - protein, 36 aa, Artificial Sequence
  Description of Artificial Sequence: Synthetic polypeptide
AEEEIRTTNPVATEQYGSVSTTSNQQANEQGTNTGG

SEQ ID NO: 110736 - protein, 33 aa, Artificial Sequence
  Description of Artificial Sequence: Synthetic polypeptide
DESVIRTTNPVATECWGSVSCINEPQVREGENG

SEQ ID NO: 110737 - protein, 33 aa, Artificial Sequence
  Description of Artificial Sequence: Synthetic polypeptide
DESVIRTTNPVATECWGSVSCINESQDREGENG

SEQ ID NO: 110738 - protein, 29 aa, Artificial Sequence
  Description of Artificial Sequence: Synthetic peptide
NENEIATTNPVATECYGCVSWELQHIELG

SEQ ID NO: 110739 - protein, 31 aa, Artificial Sequence
  Description of Artificial Sequence: Synthetic polypeptide
DENEIATTNPVATEQYGDVCSTDGPEHEEND

SEQ ID NO: 110740 - protein, 35 aa, Artificial Sequence
  Description of Artificial Sequence: Synthetic polypeptide
AEEEIRTTNPVATEQYGSVSTTSNQENNEEGTNVD

SEQ ID NO: 110741 - protein, 37 aa, Artificial Sequence
  Description of Artificial Sequence: Synthetic polypeptide
AEEEIRTTNPVATEQYGSVSTTSNNLQQGTEQGTNEQ

SEQ ID NO: 110742 - protein, 31 aa, Artificial Sequence
  Description of Artificial Sequence: Synthetic polypeptide
DENEIATTNPVATEQYGDVCSTDGPEFEEND

SEQ ID NO: 110743 - protein, 29 aa, Artificial Sequence
  Description of Artificial Sequence: Synthetic peptide
NENEIATTNPVATECWGDVSEMLQHGEEE

SEQ ID NO: 110744 - protein, 33 aa, Artificial Sequence
  Description of Artificial Sequence: Synthetic polypeptide
DENEIATTNPVATEQYGEASTEPALNMRGMGPR

SEQ ID NO: 110745 - protein, 33 aa, Artificial Sequence
  Description of Artificial Sequence: Synthetic polypeptide
DENEIATTNPVATEQYGEASTTPALNMRGMNPV

SEQ ID NO: 110746 - protein, 31 aa, Artificial Sequence
  Description of Artificial Sequence: Synthetic polypeptide
DENEIATTNPVATEQYGEISMEDIQQQRGGH

SEQ ID NO: 110747 - protein, 33 aa, Artificial Sequence
  Description of Artificial Sequence: Synthetic polypeptide
NESEIRTTNPVATECWGSVSCINEEQDREGENG

SEQ ID NO: 110748 - protein, 32 aa, Artificial Sequence
  Description of Artificial Sequence: Synthetic polypeptide
SEEEIRCTNPIATEQYGSVSAEDLEDHEGEDR

SEQ ID NO: 110749 - protein, 36 aa, Artificial Sequence
  Description of Artificial Sequence: Synthetic polypeptide
AEEEIRTTNPVATEQYGSVVVTVANLANQEGTNNVE

SEQ ID NO: 110750 - protein, 35 aa, Artificial Sequence
  Description of Artificial Sequence: Synthetic polypeptide
AEEEIRTTNPVATEQYGSVSTTTQNDTTEQGTNNE

SEQ ID NO: 110751 - protein, 36 aa, Artificial Sequence
  Description of Artificial Sequence: Synthetic polypeptide
AEEEIRTTNPVATEQYGSVVVTVANLNGQEGTNNVD

SEQ ID NO: 110752 - protein, 35 aa, Artificial Sequence
  Description of Artificial Sequence: Synthetic polypeptide
AEEEIRTTNPVATEQYGSVSTTTQLQQGTQEGEGN

SEQ ID NO: 110753 - protein, 35 aa, Artificial Sequence
  Description of Artificial Sequence: Synthetic polypeptide
DENEIATTNPVATEQYGSVCSPMPHNLQTDDGNLH

SEQ ID NO: 110754 - protein, 36 aa, Artificial Sequence
  Description of Artificial Sequence: Synthetic polypeptide
AEEEIRTTNPVATEQYGSVSTTTNTQAGTEAGNEEG

SEQ ID NO: 110755 - protein, 33 aa, Artificial Sequence
  Description of Artificial Sequence: Synthetic polypeptide
DENEIATTNPVATEQYGSVCSPMHNLNTDDGED

SEQ ID NO: 110756 - protein, 33 aa, Artificial Sequence
  Description of Artificial Sequence: Synthetic polypeptide
DENEIATTNPVATEQYGSVCSPMHGLGTPDGND

SEQ ID NO: 110757 - protein, 36 aa, Artificial Sequence
  Description of Artificial Sequence: Synthetic polypeptide
AEEEIRTTNPVATEQYGSVSTTTNQQQQGNQTNNVD

SEQ ID NO: 110758 - protein, 31 aa, Artificial Sequence
  Description of Artificial Sequence: Synthetic polypeptide
AETEIACTNPVATEQYGCASANLQTRGGGQF

SEQ ID NO: 110759 - protein, 35 aa, Artificial Sequence
  Description of Artificial Sequence: Synthetic polypeptide
DENEIATTNPVATEQYGSVCSDTNHGPLDSEGNNG

SEQ ID NO: 110760 - protein, 35 aa, Artificial Sequence
  Description of Artificial Sequence: Synthetic polypeptide
DENEIATTNPVATEQYGSVCSDNNNNQESGDNHRD

SEQ ID NO: 110761 - protein, 33 aa, Artificial Sequence
  Description of Artificial Sequence: Synthetic polypeptide
CEGTIRTTNPVATEQYGSVADTVNLIGPGGGNA

SEQ ID NO: 110762 - protein, 36 aa, Artificial Sequence
  Description of Artificial Sequence: Synthetic polypeptide
AEEEIRTTNPVATEQYGSVSTTTNQQQNDEQGTNEQ

SEQ ID NO: 110763 - protein, 33 aa, Artificial Sequence
  Description of Artificial Sequence: Synthetic polypeptide
DENEIATTNPVATEQYGSVCSAANNLPLDNETN

SEQ ID NO: 110764 - protein, 36 aa, Artificial Sequence
  Description of Artificial Sequence: Synthetic polypeptide
AEEEIRTTNPVATEQYGSVSTTTNQQQGTQEINEEG

SEQ ID NO: 110765 - protein, 36 aa, Artificial Sequence
  Description of Artificial Sequence: Synthetic polypeptide
AEEEIRTTNPVATEQYGSVSTTTNQQQGSNEQNEEG

SEQ ID NO: 110766 - protein, 34 aa, Artificial Sequence
  Description of Artificial Sequence: Synthetic polypeptide
DENEIATTNPVATEQYGSVCATNTQDQDSDNDRQ

SEQ ID NO: 110767 - protein, 35 aa, Artificial Sequence
  Description of Artificial Sequence: Synthetic polypeptide
AEEEIRTTNPVATEQYGSVSTTTNQQQGEESTEEG

SEQ ID NO: 110768 - protein, 31 aa, Artificial Sequence
  Description of Artificial Sequence: Synthetic polypeptide
DESSIATTNPTAYEQWGSVYSFENDQSEGNR

SEQ ID NO: 110769 - protein, 33 aa, Artificial Sequence
  Description of Artificial Sequence: Synthetic polypeptide
DENEIATTNPVATEQYGSVCATNLTQPDQAEAN

SEQ ID NO: 110770 - protein, 33 aa, Artificial Sequence
  Description of Artificial Sequence: Synthetic polypeptide
DENEIATTNPVATEQYGSVCATGLAPGEQMEGN

SEQ ID NO: 110771 - protein, 35 aa, Artificial Sequence
  Description of Artificial Sequence: Synthetic polypeptide
AEEEIRTTNPVATEQYGSVSTTTNQQNQQGEIATE

SEQ ID NO: 110772 - protein, 37 aa, Artificial Sequence
  Description of Artificial Sequence: Synthetic polypeptide
AEEEIRTTNPVATEQYGSVSTTTTNLQAGNEAGNEET

SEQ ID NO: 110773 - protein, 36 aa, Artificial Sequence
  Description of Artificial Sequence: Synthetic polypeptide
AEEEIRTTNPVATEQYGSVSTTTNQQNGDEQGNEDE

SEQ ID NO: 110774 - protein, 37 aa, Artificial Sequence
  Description of Artificial Sequence: Synthetic polypeptide
AEEEIRTTNPVATEQYGSVSTTTTNLQAGTEAGNEDG

SEQ ID NO: 110775 - protein, 33 aa, Artificial Sequence
  Description of Artificial Sequence: Synthetic polypeptide
CEGTIRTTNPVATEQYGSVADTMNLIGIGGGNT

SEQ ID NO: 110776 - protein, 33 aa, Artificial Sequence
  Description of Artificial Sequence: Synthetic polypeptide
DESPIRTTNPVATECWGSVSCINEPQDREGENG

SEQ ID NO: 110777 - protein, 33 aa, Artificial Sequence
  Description of Artificial Sequence: Synthetic polypeptide
DESQIGTTNPVAYEQYGQSTVSTNPSGRGGSTR

SEQ ID NO: 110778 - protein, 33 aa, Artificial Sequence
  Description of Artificial Sequence: Synthetic polypeptide
DESQIRTTNPVATECWGSVSCINEPQDREGENG

SEQ ID NO: 110779 - protein, 36 aa, Artificial Sequence
  Description of Artificial Sequence: Synthetic polypeptide
AEEEIRTTNPVATEQYGSVSTTVNGEQGNQGGNNTE

SEQ ID NO: 110780 - protein, 36 aa, Artificial Sequence
  Description of Artificial Sequence: Synthetic polypeptide
AEEEIRTTNPVATEQYGSVSTTVNGEQGNEGGNTTA

SEQ ID NO: 110781 - protein, 33 aa, Artificial Sequence
  Description of Artificial Sequence: Synthetic polypeptide
DESQIRTTNPVATEGWGSVSCINEEQDREGENG

SEQ ID NO: 110782 - protein, 32 aa, Artificial Sequence
  Description of Artificial Sequence: Synthetic polypeptide
DENEIATTNPVATEQYGSVSANPANDNPEGTP

SEQ ID NO: 110783 - protein, 32 aa, Artificial Sequence
  Description of Artificial Sequence: Synthetic polypeptide
DESRIATTNPVATEQYGSVSATDLEDHEGEDT

SEQ ID NO: 110784 - protein, 33 aa, Artificial Sequence
  Description of Artificial Sequence: Synthetic polypeptide
DESRIRTTNPVATECWGSVSCINEIQDREGENG

SEQ ID NO: 110785 - protein, 32 aa, Artificial Sequence
  Description of Artificial Sequence: Synthetic polypeptide
DENEIATTNPVATEQYGSVSAGPANDNPPGQP

SEQ ID NO: 110786 - protein, 32 aa, Artificial Sequence
  Description of Artificial Sequence: Synthetic polypeptide
DENEIATTNPVATEQYGSVSAEILENHEGDDL

SEQ ID NO: 110787 - protein, 35 aa, Artificial Sequence
  Description of Artificial Sequence: Synthetic polypeptide
AEEEIRTTNPVATEQYGSVSTTVNDNGTQGTNNAT

SEQ ID NO: 110788 - protein, 36 aa, Artificial Sequence
  Description of Artificial Sequence: Synthetic polypeptide
AEEEIRTTNPVATEQYGSVSTTVNDNGNQQGNNANE

SEQ ID NO: 110789 - protein, 32 aa, Artificial Sequence
  Description of Artificial Sequence: Synthetic polypeptide
DENEIATTNPVATEQYGSVSAEILEDHEGDDL

SEQ ID NO: 110790 - protein, 36 aa, Artificial Sequence
  Description of Artificial Sequence: Synthetic polypeptide
AEEEIRTTNPVATEQYGSVSTTVGNNNQQGSTNTNV

SEQ ID NO: 110791 - protein, 33 aa, Artificial Sequence
  Description of Artificial Sequence: Synthetic polypeptide
DESRIRTTNPVATECWGSVSCINEPQDREGENG

SEQ ID NO: 110792 - protein, 37 aa, Artificial Sequence
  Description of Artificial Sequence: Synthetic polypeptide
AEEEIRTTNPVATEQYGSVSTTVANLQNTTEQGTNVE

SEQ ID NO: 110793 - protein, 37 aa, Artificial Sequence
  Description of Artificial Sequence: Synthetic polypeptide
AEEEIRTTNPVATEQYGSVSTTVANLNNAQEQGTNVD

SEQ ID NO: 110794 - protein, 33 aa, Artificial Sequence
  Description of Artificial Sequence: Synthetic polypeptide
NESEIRTTNPVATECWGSVSCINEQQDREGENG

SEQ ID NO: 110795 - protein, 32 aa, Artificial Sequence
  Description of Artificial Sequence: Synthetic polypeptide
DENEIATTNPVATEQYGSVSAEDLEDHEGEDL

SEQ ID NO: 110796 - protein, 33 aa, Artificial Sequence
  Description of Artificial Sequence: Synthetic polypeptide
NESEIRTTNPVATECWGSVSCINEPQDRYGENG

SEQ ID NO: 110797 - protein, 33 aa, Artificial Sequence
  Description of Artificial Sequence: Synthetic polypeptide
NESEIRTTNPVATECWGSVSCINEPQDREGENG

SEQ ID NO: 110798 - protein, 32 aa, Artificial Sequence
  Description of Artificial Sequence: Synthetic polypeptide
CEGTIRTTNPVATEQYGSVADTMLIGIGGENA

SEQ ID NO: 110799 - protein, 35 aa, Artificial Sequence
  Description of Artificial Sequence: Synthetic polypeptide
DENEIATTNPVATEQYGSVCSTNHGPLDSEGNDGH

SEQ ID NO: 110800 - protein, 36 aa, Artificial Sequence
  Description of Artificial Sequence: Synthetic polypeptide
AEEEIRTTNPVATEQYGSVSTTTTNQNNQEQGNNEI

SEQ ID NO: 110801 - protein, 36 aa, Artificial Sequence
  Description of Artificial Sequence: Synthetic polypeptide
AEEEIRTTNPVATEQYGSVSTTTTNLQIGSTDEEQM

SEQ ID NO: 110802 - protein, 34 aa, Artificial Sequence
  Description of Artificial Sequence: Synthetic polypeptide
DENEIATTNPVATEQYGSVCAPNNGLQTDPGNEQ

SEQ ID NO: 110803 - protein, 33 aa, Artificial Sequence
  Description of Artificial Sequence: Synthetic polypeptide
DENEIATTNPVATEQYGSVCANNLEATPGDNPE

SEQ ID NO: 110804 - protein, 33 aa, Artificial Sequence
  Description of Artificial Sequence: Synthetic polypeptide
DENEIATTNPVATEQYGSVCANNLEATPGDERP

SEQ ID NO: 110805 - protein, 34 aa, Artificial Sequence
  Description of Artificial Sequence: Synthetic polypeptide
DENEIATTNPVATEQYGSVAMNGLTQPDDGDTRM

SEQ ID NO: 110806 - protein, 31 aa, Artificial Sequence
  Description of Artificial Sequence: Synthetic polypeptide
DESSIRTTNPLATEFFGSVSFNLTQEGQEKN

SEQ ID NO: 110807 - protein, 33 aa, Artificial Sequence
  Description of Artificial Sequence: Synthetic polypeptide
DENEIATTNPVATEQYGSVAITNLEAPDNQEES

SEQ ID NO: 110808 - protein, 33 aa, Artificial Sequence
  Description of Artificial Sequence: Synthetic polypeptide
NEREIRTTNPVATEQYGSVPWVSELQIEGASQR

SEQ ID NO: 110809 - protein, 36 aa, Artificial Sequence
  Description of Artificial Sequence: Synthetic polypeptide
AEEEIRTTNPVATEQYGSVSTTTNNNQQQQNGTNAD

SEQ ID NO: 110810 - protein, 32 aa, Artificial Sequence
  Description of Artificial Sequence: Synthetic polypeptide
DENEIATTNPVATEQYGSVAATNLEAPDQHHM

SEQ ID NO: 110811 - protein, 36 aa, Artificial Sequence
  Description of Artificial Sequence: Synthetic polypeptide
AEEEIRTTNPVATEQYGSVSTTTNNNQQQIGTNQGQ

SEQ ID NO: 110812 - protein, 33 aa, Artificial Sequence
  Description of Artificial Sequence: Synthetic polypeptide
DENEIATTNPVATEQYGSVAANNPQNRNPNGQP

SEQ ID NO: 110813 - protein, 33 aa, Artificial Sequence
  Description of Artificial Sequence: Synthetic polypeptide
DENEIATTNPVATEQYGSVAAATTNGLPTEANH

SEQ ID NO: 110814 - protein, 33 aa, Artificial Sequence
  Description of Artificial Sequence: Synthetic polypeptide
DENEIATTNPVATEQYGSVAAANNQPTGAGENE

SEQ ID NO: 110815 - protein, 33 aa, Artificial Sequence
  Description of Artificial Sequence: Synthetic polypeptide
DENEIATTNPVATEQYGSTVSATDLEDHEGEDL

SEQ ID NO: 110816 - protein, 36 aa, Artificial Sequence
  Description of Artificial Sequence: Synthetic polypeptide
AEEEIRTTNPVATEQYGSVSTTTNNNQQQIGTNQGE

SEQ ID NO: 110817 - protein, 32 aa, Artificial Sequence
  Description of Artificial Sequence: Synthetic polypeptide
DENEIATTNPVATEQYGSISATDIEQHNGEDL

SEQ ID NO: 110818 - protein, 32 aa, Artificial Sequence
  Description of Artificial Sequence: Synthetic polypeptide
DENEIATTNPVATEQYGSISATDIEQHEGEDL

SEQ ID NO: 110819 - protein, 36 aa, Artificial Sequence
  Description of Artificial Sequence: Synthetic polypeptide
AEEEIRTTNPVATEQYGSVSTTTNNNQQQIGTNEDE

SEQ ID NO: 110820 - protein, 33 aa, Artificial Sequence
  Description of Artificial Sequence: Synthetic polypeptide
DESSIRTTNPVATECWGSVSCINEPQDREGENG

SEQ ID NO: 110821 - protein, 33 aa, Artificial Sequence
  Description of Artificial Sequence: Synthetic polypeptide
DESSISTTNPCATEQWGSVSTVVNNLQSGNTDD

SEQ ID NO: 110822 - protein, 32 aa, Artificial Sequence
  Description of Artificial Sequence: Synthetic polypeptide
DENEIATTNPVATEQYGSASATDLEDHEGEDL

SEQ ID NO: 110823 - protein, 36 aa, Artificial Sequence
  Description of Artificial Sequence: Synthetic polypeptide
AEEEIRTTNPVATEQYGSVSTTTNNNQNQQIGTNGE

SEQ ID NO: 110824 - protein, 32 aa, Artificial Sequence
  Description of Artificial Sequence: Synthetic polypeptide
NEREIRTTNPVATEQYGSVPRVTELNIEGASC

SEQ ID NO: 110825 - protein, 37 aa, Artificial Sequence
  Description of Artificial Sequence: Synthetic polypeptide
AEEEIRTTNPVATEQYGSVSTTTNNNLQQNEQQGNND

SEQ ID NO: 110826 - protein, 37 aa, Artificial Sequence
  Description of Artificial Sequence: Synthetic polypeptide
AEEEIRTTNPVATEQYGSVSTTTNNNLQQGSTNQEDE

SEQ ID NO: 110827 - protein, 35 aa, Artificial Sequence
  Description of Artificial Sequence: Synthetic polypeptide
AEEEIRTTNPVATEQYGSVSTTTNNNDTNLGNNLI

SEQ ID NO: 110828 - protein, 30 aa, Artificial Sequence
  Description of Artificial Sequence: Synthetic polypeptide
DENEIATTNPVATEQYGEVSEIEQNAAEDA

SEQ ID NO: 110829 - protein, 37 aa, Artificial Sequence
  Description of Artificial Sequence: Synthetic polypeptide
AEEEIRTTNPVATEQYGSVSTTTNNLQQGNETGNNTD

SEQ ID NO: 110830 - protein, 36 aa, Artificial Sequence
  Description of Artificial Sequence: Synthetic polypeptide
AEEEIRTTNPVATEQYGSVSTTTNNQNNQQGNNQTQ

SEQ ID NO: 110831 - protein, 34 aa, Artificial Sequence
  Description of Artificial Sequence: Synthetic polypeptide
NEREIRTTNPVATEQYGSVPWVTEPLQVIEGASR

SEQ ID NO: 110832 - protein, 36 aa, Artificial Sequence
  Description of Artificial Sequence: Synthetic polypeptide
AEEEIRTTNPVATEQYGSVSTTTNNQQQGNDEGTQD

SEQ ID NO: 110833 - protein, 31 aa, Artificial Sequence
  Description of Artificial Sequence: Synthetic polypeptide
DENEIATTNPVATEQYGSVANMNNNEAIGEA

SEQ ID NO: 110834 - protein, 34 aa, Artificial Sequence
  Description of Artificial Sequence: Synthetic polypeptide
AEEEIRTTNPVATEQYGSVSTTTNQQGQDEIATE

SEQ ID NO: 110835 - protein, 36 aa, Artificial Sequence
  Description of Artificial Sequence: Synthetic polypeptide
AEEEIRTTNPVATEQYGSVSTTTNQQGNQGNVTNVD

SEQ ID NO: 110836 - protein, 35 aa, Artificial Sequence
  Description of Artificial Sequence: Synthetic polypeptide
DENEIATTNPVATEQYGSVCAADNNLADQDGNDRH

SEQ ID NO: 110837 - protein, 36 aa, Artificial Sequence
  Description of Artificial Sequence: Synthetic polypeptide
AEEEIRTTNPVATEQYGSVSTTTNQQGEQQGTNTNE

SEQ ID NO: 110838 - protein, 35 aa, Artificial Sequence
  Description of Artificial Sequence: Synthetic polypeptide
AEEEIRTTNPVATEQYGSVVVTVNEQGNQAGTNND

SEQ ID NO: 110839 - protein, 36 aa, Artificial Sequence
  Description of Artificial Sequence: Synthetic polypeptide
AEEEIRTTNPVATEQYGSVSTTTNQNNQEIGNNEEI

SEQ ID NO: 110840 - protein, 35 aa, Artificial Sequence
  Description of Artificial Sequence: Synthetic polypeptide
AEEEIRTTNPVATEQYGSVVVTVNLNNTQGTNNTT

SEQ ID NO: 110841 - protein, 37 aa, Artificial Sequence
  Description of Artificial Sequence: Synthetic polypeptide
AEEEIRTTNPVATEQYGSVSTTTNQLQQGNNQETNTE

SEQ ID NO: 110842 - protein, 36 aa, Artificial Sequence
  Description of Artificial Sequence: Synthetic polypeptide
AEEEIRTTNPVATEQYGSVSTTTNQLQNEIGTEEGT

SEQ ID NO: 110843 - protein, 36 aa, Artificial Sequence
  Description of Artificial Sequence: Synthetic polypeptide
AEEEIRTTNPVATEQYGSVSTTTNQLQIGTTDEEME

SEQ ID NO: 110844 - protein, 36 aa, Artificial Sequence
  Description of Artificial Sequence: Synthetic polypeptide
AEEEIRTTNPVATEQYGSVSTTTNQLQGQTNGTEDE

SEQ ID NO: 110845 - protein, 37 aa, Artificial Sequence
  Description of Artificial Sequence: Synthetic polypeptide
AEEEIRTTNPVATEQYGSVSTTTNQLQAGTEAGNEET

SEQ ID NO: 110846 - protein, 36 aa, Artificial Sequence
  Description of Artificial Sequence: Synthetic polypeptide
AEEEIRTTNPVATEQYGSVVVTTTQNGNLQQGTNID

SEQ ID NO: 110847 - protein, 33 aa, Artificial Sequence
  Description of Artificial Sequence: Synthetic polypeptide
DENEIATTNPVATEQYGSVATHALTGTRNGEEH

SEQ ID NO: 110848 - protein, 30 aa, Artificial Sequence
  Description of Artificial Sequence: Synthetic polypeptide
AETEIACTNPVATEQWGEASNAENWQRGPR

SEQ ID NO: 110849 - protein, 32 aa, Artificial Sequence
  Description of Artificial Sequence: Synthetic polypeptide
DENEIATTNPVATEQYGSVASNPANPNPEGQN

SEQ ID NO: 110850 - protein, 32 aa, Artificial Sequence
  Description of Artificial Sequence: Synthetic polypeptide
DENEIATTNPVATEQYGSVASNDANDNPPGQP

SEQ ID NO: 110851 - protein, 31 aa, Artificial Sequence
  Description of Artificial Sequence: Synthetic polypeptide
DENEIATTNPVATEQYGSVASDPANRNPPQP

SEQ ID NO: 110852 - protein, 31 aa, Artificial Sequence
  Description of Artificial Sequence: Synthetic polypeptide
DENEIATTNPVATEQYGSVASDDNNTNPPDH

SEQ ID NO: 110853 - protein, 32 aa, Artificial Sequence
  Description of Artificial Sequence: Synthetic polypeptide
DENEIATTNPVATEQYGSVASDDANDNPGAQA

SEQ ID NO: 110854 - protein, 36 aa, Artificial Sequence
  Description of Artificial Sequence: Synthetic polypeptide
AEEEIRTTNPVATEQYGSVSTTTNQGQQGNNTNNVD

SEQ ID NO: 110855 - protein, 32 aa, Artificial Sequence
  Description of Artificial Sequence: Synthetic polypeptide
DENEIATTNPVATEQYGSVANNPQNMNPNGQH

SEQ ID NO: 110856 - protein, 36 aa, Artificial Sequence
  Description of Artificial Sequence: Synthetic polypeptide
AEEEIRTTNPVATEQYGSVSTTTNQGNQEIGTNEEQ

SEQ ID NO: 110857 - protein, 33 aa, Artificial Sequence
  Description of Artificial Sequence: Synthetic polypeptide
CEMEIRTTNPVATEQYGSCSPTNLETRTEEQEM

SEQ ID NO: 110858 - protein, 36 aa, Artificial Sequence
  Description of Artificial Sequence: Synthetic polypeptide
AEEEIRTTNPVATEQYGSVSTTTNNQQQTIGTNNVD

SEQ ID NO: 110859 - protein, 36 aa, Artificial Sequence
  Description of Artificial Sequence: Synthetic polypeptide
AEEEIRTTNPVATEQYGSVSTTTNNQQQGNQGNEDT

SEQ ID NO: 110860 - protein, 35 aa, Artificial Sequence
  Description of Artificial Sequence: Synthetic polypeptide
AEEEIRTTNPVATEQYGSVSTTTNQLNSNNANNQD

SEQ ID NO: 110861 - protein, 31 aa, Artificial Sequence
  Description of Artificial Sequence: Synthetic polypeptide
DESEVASTNPVATEGWGNVSANNIQDRVGNR

SEQ ID NO: 110862 - protein, 36 aa, Artificial Sequence
  Description of Artificial Sequence: Synthetic polypeptide
AEEEIRTTNPVATEQYGSVSTVGTNLQQGSTESGTQ

SEQ ID NO: 110863 - protein, 30 aa, Artificial Sequence
  Description of Artificial Sequence: Synthetic polypeptide
DESEVACTNPVSTEQYGNVAAETIQRVGNR

SEQ ID NO: 110864 - protein, 33 aa, Artificial Sequence
  Description of Artificial Sequence: Synthetic polypeptide
DESEIRTTNPWATEKWGSVSCINEPQDREGRNG

SEQ ID NO: 110865 - protein, 32 aa, Artificial Sequence
  Description of Artificial Sequence: Synthetic polypeptide
DENEIRTTNPVATEIYGCVCSWEHQERFGSDQ

SEQ ID NO: 110866 - protein, 36 aa, Artificial Sequence
  Description of Artificial Sequence: Synthetic polypeptide
AEEEIRTTNPVATEQYGSVSTVNQNQQGEDEENEED

SEQ ID NO: 110867 - protein, 35 aa, Artificial Sequence
  Description of Artificial Sequence: Synthetic polypeptide
AEEEIRTTNPVATEQYGSVSTVNQNQQGATEQGED

SEQ ID NO: 110868 - protein, 33 aa, Artificial Sequence
  Description of Artificial Sequence: Synthetic polypeptide
DESEIRTTNPYATECWGSVSCINEPQDREGENG

SEQ ID NO: 110869 - protein, 37 aa, Artificial Sequence
  Description of Artificial Sequence: Synthetic polypeptide
AEEEIRTTNPVATEQYGSVSTVNQNQLQGNDEGSNGE

SEQ ID NO: 110870 - protein, 35 aa, Artificial Sequence
  Description of Artificial Sequence: Synthetic polypeptide
AEEEIRTTNPVATEQYGSVSTVNQNQLQETEETEE

SEQ ID NO: 110871 - protein, 36 aa, Artificial Sequence
  Description of Artificial Sequence: Synthetic polypeptide
AEEEIRTTNPVATEQYGSVSTVNQNQENNQGNNQQT

SEQ ID NO: 110872 - protein, 33 aa, Artificial Sequence
  Description of Artificial Sequence: Synthetic polypeptide
DESEIRTTNQVATECWGSVSCINEFQDREGENG

SEQ ID NO: 110873 - protein, 34 aa, Artificial Sequence
  Description of Artificial Sequence: Synthetic polypeptide
CEEEISTTNPVATEQYGQCVCSTNHQNFGSDNQE

SEQ ID NO: 110874 - protein, 32 aa, Artificial Sequence
  Description of Artificial Sequence: Synthetic polypeptide
DENEIRTTNPVATEGYGCVCSWNPQYFGSDQS

SEQ ID NO: 110875 - protein, 36 aa, Artificial Sequence
  Description of Artificial Sequence: Synthetic polypeptide
AEEEIRTTNPVATEQYGSVVVTTNNLLQGTEGGNDT

SEQ ID NO: 110876 - protein, 36 aa, Artificial Sequence
  Description of Artificial Sequence: Synthetic polypeptide
AEEEIRTTNPVATEQYGSVSTVNQNLQGTNNNNEED

SEQ ID NO: 110877 - protein, 36 aa, Artificial Sequence
  Description of Artificial Sequence: Synthetic polypeptide
AEEEIRTTNPVATEQYGSVSTVNQNLNSNDEGNDED

SEQ ID NO: 110878 - protein, 31 aa, Artificial Sequence
  Description of Artificial Sequence: Synthetic polypeptide
DENEIRTTNPVATEGWGDVSAEIIMSRVGQR

SEQ ID NO: 110879 - protein, 31 aa, Artificial Sequence
  Description of Artificial Sequence: Synthetic polypeptide
DENEIRTTNPVATECYGTISMEDIQQQNGNL

SEQ ID NO: 110880 - protein, 36 aa, Artificial Sequence
  Description of Artificial Sequence: Synthetic polypeptide
AEEEIRTTNPVATEQYGSVSTVNQNGNQAIGTNEGS

SEQ ID NO: 110881 - protein, 36 aa, Artificial Sequence
  Description of Artificial Sequence: Synthetic polypeptide
AEEEIRTTNPVATEQYGSVSTVNQNGNNQQGNEEDD

SEQ ID NO: 110882 - protein, 30 aa, Artificial Sequence
  Description of Artificial Sequence: Synthetic polypeptide
DENEIRTTNPVATECYGTISMEDIQQNENL

SEQ ID NO: 110883 - protein, 30 aa, Artificial Sequence
  Description of Artificial Sequence: Synthetic polypeptide
DENEIRTTNPVATECYGTISMECIQQNENL

SEQ ID NO: 110884 - protein, 33 aa, Artificial Sequence
  Description of Artificial Sequence: Synthetic polypeptide
DESEIRTTNQVATECWGSVSCINEPQDREGENG

SEQ ID NO: 110885 - protein, 35 aa, Artificial Sequence
  Description of Artificial Sequence: Synthetic polypeptide
AEEEIRTTNPVATEQYGSVSTVNQNGEQIGTEEGS

SEQ ID NO: 110886 - protein, 33 aa, Artificial Sequence
  Description of Artificial Sequence: Synthetic polypeptide
DESEIRTTNSVATECWGSVSCINEPQDREGENG

SEQ ID NO: 110887 - protein, 31 aa, Artificial Sequence
  Description of Artificial Sequence: Synthetic polypeptide
DENEIRTTNPVATECYGTISEECIQQQQGNH

SEQ ID NO: 110888 - protein, 37 aa, Artificial Sequence
  Description of Artificial Sequence: Synthetic polypeptide
AEEEIRTTNPVATEQYGSVSTVNQGNLQQQIGTNSEY

SEQ ID NO: 110889 - protein, 32 aa, Artificial Sequence
  Description of Artificial Sequence: Synthetic polypeptide
DENEIRTTNPVATEIYGCVCSWELQGFGSQQS

SEQ ID NO: 110890 - protein, 37 aa, Artificial Sequence
  Description of Artificial Sequence: Synthetic polypeptide
AEEEIRTTNPVATEQYGSVSTVNNSNQNLQQGTNQEE

SEQ ID NO: 110891 - protein, 32 aa, Artificial Sequence
  Description of Artificial Sequence: Synthetic polypeptide
DENEIRTTNPVATEIYGCVCSWGNHQNGSDQS

SEQ ID NO: 110892 - protein, 32 aa, Artificial Sequence
  Description of Artificial Sequence: Synthetic polypeptide
DENEIRTTNPVATEIYGCVCSWNHQENGSDQA

SEQ ID NO: 110893 - protein, 36 aa, Artificial Sequence
  Description of Artificial Sequence: Synthetic polypeptide
AEEEIRTTNPVATEQYGSVSTVNSQLGNDEAGNNME

SEQ ID NO: 110894 - protein, 31 aa, Artificial Sequence
  Description of Artificial Sequence: Synthetic polypeptide
DESEIRTTNPVSTEPYGVISSEDLQQQQGNI

SEQ ID NO: 110895 - protein, 36 aa, Artificial Sequence
  Description of Artificial Sequence: Synthetic polypeptide
AEEEIRTTNPVATEQYGSVSTVNSNQQQGEQGNEQD

SEQ ID NO: 110896 - protein, 36 aa, Artificial Sequence
  Description of Artificial Sequence: Synthetic polypeptide
AEEEIRTTNPVATEQYGSVSTVNQQQQGDEGTNNNQ

SEQ ID NO: 110897 - protein, 35 aa, Artificial Sequence
  Description of Artificial Sequence: Synthetic polypeptide
AEEEIRTTNPVATEQYGSVSTVNQQQNDEQINNND

SEQ ID NO: 110898 - protein, 30 aa, Artificial Sequence
  Description of Artificial Sequence: Synthetic polypeptide
DESEIRTTNPVSTEQWGNVANTIQNAAGDR

SEQ ID NO: 110899 - protein, 32 aa, Artificial Sequence
  Description of Artificial Sequence: Synthetic polypeptide
CEEEISTTNPVATEQYGCVCSTNHFGFGSEQS

SEQ ID NO: 110900 - protein, 32 aa, Artificial Sequence
  Description of Artificial Sequence: Synthetic polypeptide
DESEIRTTNPVSTEQWGSVYTIDNHGQGGKQT

SEQ ID NO: 110901 - protein, 34 aa, Artificial Sequence
  Description of Artificial Sequence: Synthetic polypeptide
DENEIRTTNPVATEIYGSVSNNDLDQQGGQTGQG

SEQ ID NO: 110902 - protein, 32 aa, Artificial Sequence
  Description of Artificial Sequence: Synthetic polypeptide
SEEEICSTNPTAYEQYGSVATNLQHANGNDMW

SEQ ID NO: 110903 - protein, 34 aa, Artificial Sequence
  Description of Artificial Sequence: Synthetic polypeptide
DENEIRTTNPVATEIYGSVSANMNLDQQGGGGQQ

SEQ ID NO: 110904 - protein, 36 aa, Artificial Sequence
  Description of Artificial Sequence: Synthetic polypeptide
AEEEIRTTNPVATEQYGSVSTVNQQNANQQGTNATE

SEQ ID NO: 110905 - protein, 36 aa, Artificial Sequence
  Description of Artificial Sequence: Synthetic polypeptide
AEEEIRTTNPVATEQYGSVSTVNQQLQNDEETNNND

SEQ ID NO: 110906 - protein, 32 aa, Artificial Sequence
  Description of Artificial Sequence: Synthetic polypeptide
SEEEICTTNPTAYEQYGSVATNGQHAGGNDMW

SEQ ID NO: 110907 - protein, 32 aa, Artificial Sequence
  Description of Artificial Sequence: Synthetic polypeptide
DENEIRTTNPVATEIYGSVANNLVERVITVPG

SEQ ID NO: 110908 - protein, 35 aa, Artificial Sequence
  Description of Artificial Sequence: Synthetic polypeptide
DENEIRTTNPVATEIYGMVVYSTNEVELQEGNEEK

SEQ ID NO: 110909 - protein, 36 aa, Artificial Sequence
  Description of Artificial Sequence: Synthetic polypeptide
AEEEIRTTNPVATEQYGSVVVTTNNLEQGTEGGNTT

SEQ ID NO: 110910 - protein, 35 aa, Artificial Sequence
  Description of Artificial Sequence: Synthetic polypeptide
DENEIRTTNPVATEIYGLVVYSTNVELQEGNEEKF

SEQ ID NO: 110911 - protein, 35 aa, Artificial Sequence
  Description of Artificial Sequence: Synthetic polypeptide
DESEIRTTNPVSTEQYGSVSSTTTGPQMRNGMNPV

SEQ ID NO: 110912 - protein, 36 aa, Artificial Sequence
  Description of Artificial Sequence: Synthetic polypeptide
AEEEIRTTNPVATEQYGSVSTVNQQIGNNQGTTDES

SEQ ID NO: 110913 - protein, 35 aa, Artificial Sequence
  Description of Artificial Sequence: Synthetic polypeptide
AEEEIRTTNPVATEQYGSVSTVNQNQQQNAEDEED

SEQ ID NO: 110914 - protein, 33 aa, Artificial Sequence
  Description of Artificial Sequence: Synthetic polypeptide
DESEIRTTNPVTTECWGSVSCINEPQDREGENG

SEQ ID NO: 110915 - protein, 33 aa, Artificial Sequence
  Description of Artificial Sequence: Synthetic polypeptide
DESEIRTTNPVVTECWGSVSCINEPQDREGENG

SEQ ID NO: 110916 - protein, 33 aa, Artificial Sequence
  Description of Artificial Sequence: Synthetic polypeptide
DESEIRTTNPVVTECWGSVSCINEPQWREGENL

SEQ ID NO: 110917 - protein, 33 aa, Artificial Sequence
  Description of Artificial Sequence: Synthetic polypeptide
DESEIRTTNPWATECWGSVSCINEPQDREGENG

SEQ ID NO: 110918 - protein, 34 aa, Artificial Sequence
  Description of Artificial Sequence: Synthetic polypeptide
DESEIRTTNPWATECWGSVSCINLEPQDREGENG

SEQ ID NO: 110919 - protein, 31 aa, Artificial Sequence
  Description of Artificial Sequence: Synthetic polypeptide
SEEEIATTNPVATESYGSVANPNLEADGDQD

SEQ ID NO: 110920 - protein, 30 aa, Artificial Sequence
  Description of Artificial Sequence: Synthetic polypeptide
DENEIRTTNPVATECYGTISEDIQQQNGEL

SEQ ID NO: 110921 - protein, 32 aa, Artificial Sequence
  Description of Artificial Sequence: Synthetic polypeptide
CEEEISTTNPVATEQYGSVCSTEHANFGSEQT

SEQ ID NO: 110922 - protein, 36 aa, Artificial Sequence
  Description of Artificial Sequence: Synthetic polypeptide
AEEEIRTTNPVATEQYGSVSTVNNQGSNNQGNNEGD

SEQ ID NO: 110923 - protein, 36 aa, Artificial Sequence
  Description of Artificial Sequence: Synthetic polypeptide
AEEEIRTTNPVATEQYGSVSTVNNQGNNQEGNNQSD

SEQ ID NO: 110924 - protein, 36 aa, Artificial Sequence
  Description of Artificial Sequence: Synthetic polypeptide
AEEEIRTTNPVATEQYGSVSTVNNQDNQQIGTNVAE

SEQ ID NO: 110925 - protein, 36 aa, Artificial Sequence
  Description of Artificial Sequence: Synthetic polypeptide
AEEEIRTTNPVATEQYGSVSTVNNNQQQTQGTNNVD

SEQ ID NO: 110926 - protein, 36 aa, Artificial Sequence
  Description of Artificial Sequence: Synthetic polypeptide
AEEEIRTTNPVATEQYGSVSTVNNNQQQQIGNNQND

SEQ ID NO: 110927 - protein, 35 aa, Artificial Sequence
  Description of Artificial Sequence: Synthetic polypeptide
AEEEIRTTNPVATEQYGSVSTVNNNQQQNAENQED

SEQ ID NO: 110928 - protein, 36 aa, Artificial Sequence
  Description of Artificial Sequence: Synthetic polypeptide
AEEEIRTTNPVATEQYGSVSTVNNNQQQGDEGNNND

SEQ ID NO: 110929 - protein, 36 aa, Artificial Sequence
  Description of Artificial Sequence: Synthetic polypeptide
AEEEIRTTNPVATEQYGSVSTVNNNQQNEDEGNEGT

SEQ ID NO: 110930 - protein, 36 aa, Artificial Sequence
  Description of Artificial Sequence: Synthetic polypeptide
AEEEIRTTNPVATEQYGSVSTVNNNQQGTNNNNELN

SEQ ID NO: 110931 - protein, 33 aa, Artificial Sequence
  Description of Artificial Sequence: Synthetic polypeptide
DESEIRVTNPVATECWGSVSCVNEPQDREGENG

SEQ ID NO: 110932 - protein, 32 aa, Artificial Sequence
  Description of Artificial Sequence: Synthetic polypeptide
DENEIRTTNPVATECWGSVSEINEPMNAAGNA

SEQ ID NO: 110933 - protein, 33 aa, Artificial Sequence
  Description of Artificial Sequence: Synthetic polypeptide
DESEIRWTNPVATECWGSVSCINEPQDREGENG

SEQ ID NO: 110934 - protein, 33 aa, Artificial Sequence
  Description of Artificial Sequence: Synthetic polypeptide
SEEEICTTNPVAYEQYGSCNCTNELDQPGGNNA

SEQ ID NO: 110935 - protein, 33 aa, Artificial Sequence
  Description of Artificial Sequence: Synthetic polypeptide
DESEIRYTNPVATECWGSVSCINDPQDREGENG

SEQ ID NO: 110936 - protein, 33 aa, Artificial Sequence
  Description of Artificial Sequence: Synthetic polypeptide
DESEIRYTNPVATECWGSVSCINEEQDREGENG

SEQ ID NO: 110937 - protein, 32 aa, Artificial Sequence
  Description of Artificial Sequence: Synthetic polypeptide
DENEIRTTNPVATECWGSVSEINEPMDAAGNA

SEQ ID NO: 110938 - protein, 36 aa, Artificial Sequence
  Description of Artificial Sequence: Synthetic polypeptide
AEEEIRTTNPVATEQYGSVSTVNNNQQEEEGTNDTQ

SEQ ID NO: 110939 - protein, 32 aa, Artificial Sequence
  Description of Artificial Sequence: Synthetic polypeptide
DENEIRTTNPVATECWGSVSEIEPMDREGENG

SEQ ID NO: 110940 - protein, 33 aa, Artificial Sequence
  Description of Artificial Sequence: Synthetic polypeptide
DESEIRYTNPVATECWGSVSCINEPQDREGENG

SEQ ID NO: 110941 - protein, 31 aa, Artificial Sequence
  Description of Artificial Sequence: Synthetic polypeptide
SEEEICTTNPVAYEQYGSVATNGTAENPNIM

SEQ ID NO: 110942 - protein, 36 aa, Artificial Sequence
  Description of Artificial Sequence: Synthetic polypeptide
AEEEIRTTNPVATEQYGSVVVTTNNLQLQEGTNVTE

SEQ ID NO: 110943 - protein, 36 aa, Artificial Sequence
  Description of Artificial Sequence: Synthetic polypeptide
AEEEIRTTNPVATEQYGSVSTVNNNQNDEQGNNDTD

SEQ ID NO: 110944 - protein, 36 aa, Artificial Sequence
  Description of Artificial Sequence: Synthetic polypeptide
AEEEIRTTNPVATEQYGSVSTVNNNNQQQQGTNNVD

SEQ ID NO: 110945 - protein, 33 aa, Artificial Sequence
  Description of Artificial Sequence: Synthetic polypeptide
DESEIRYTNPVATECWGSVSCINEPQSREGENG

SEQ ID NO: 110946 - protein, 37 aa, Artificial Sequence
  Description of Artificial Sequence: Synthetic polypeptide
AEEEIRTTNPVATEQYGSVSTVNNNNLQSGTVDNGTT

SEQ ID NO: 110947 - protein, 37 aa, Artificial Sequence
  Description of Artificial Sequence: Synthetic polypeptide
AEEEIRTTNPVATEQYGSVSTVNNQLQAGTEGGNNAT

SEQ ID NO: 110948 - protein, 30 aa, Artificial Sequence
  Description of Artificial Sequence: Synthetic polypeptide
DENEIRTTNPVATECYGTISEDIQQQNGEH

SEQ ID NO: 110949 - protein, 37 aa, Artificial Sequence
  Description of Artificial Sequence: Synthetic polypeptide
AEEEIRTTNPVATEQYGSVSTVNNQLQEGTEGGNEET

SEQ ID NO: 110950 - protein, 37 aa, Artificial Sequence
  Description of Artificial Sequence: Synthetic polypeptide
AEEEIRTTNPVATEQYGSVSTVNNQLQEGTESGNQAN

SEQ ID NO: 110951 - protein, 33 aa, Artificial Sequence
  Description of Artificial Sequence: Synthetic polypeptide
DESEIRTTNSVATECWGSVSCINEPQQREGENG

SEQ ID NO: 110952 - protein, 36 aa, Artificial Sequence
  Description of Artificial Sequence: Synthetic polypeptide
AEEEIRTTNPVATEQYGSVSTVNNQQQQQGTTNNVD

SEQ ID NO: 110953 - protein, 36 aa, Artificial Sequence
  Description of Artificial Sequence: Synthetic polypeptide
AEEEIRTTNPVATEQYGSVSTVNNQQQQNGNGNIGS

SEQ ID NO: 110954 - protein, 33 aa, Artificial Sequence
  Description of Artificial Sequence: Synthetic polypeptide
DESEIRTTNTVATECWGSVSCINEPQDREGENG

SEQ ID NO: 110955 - protein, 35 aa, Artificial Sequence
  Description of Artificial Sequence: Synthetic polypeptide
AEEEIRTTNPVATEQYGSVSTVNNQQQNDEQSNNE

SEQ ID NO: 110956 - protein, 33 aa, Artificial Sequence
  Description of Artificial Sequence: Synthetic polypeptide
DESEIRTTNTVATECWGSVSCINEPQDRLGENG

SEQ ID NO: 110957 - protein, 33 aa, Artificial Sequence
  Description of Artificial Sequence: Synthetic polypeptide
DESEIRTTNVVATECWGSVSCINEPQDREGENG

SEQ ID NO: 110958 - protein, 33 aa, Artificial Sequence
  Description of Artificial Sequence: Synthetic polypeptide
DESEIRTTQPVATECWGSVSCINEPQDREGENG

SEQ ID NO: 110959 - protein, 33 aa, Artificial Sequence
  Description of Artificial Sequence: Synthetic polypeptide
DESEIRTTQPVATECWGSVSCINEPQDRYGENG

SEQ ID NO: 110960 - protein, 36 aa, Artificial Sequence
  Description of Artificial Sequence: Synthetic polypeptide
AEEEIRTTNPVATEQYGSVSTVNNQQQGENGNTEEE

SEQ ID NO: 110961 - protein, 32 aa, Artificial Sequence
  Description of Artificial Sequence: Synthetic polypeptide
DENEIRTTNPVATECYGDVSCINEPQDHEENL

SEQ ID NO: 110962 - protein, 36 aa, Artificial Sequence
  Description of Artificial Sequence: Synthetic polypeptide
AEEEIRTTNPVATEQYGSVSTVNNQQQGDEGTNANE

SEQ ID NO: 110963 - protein, 33 aa, Artificial Sequence
  Description of Artificial Sequence: Synthetic polypeptide
DESEIRTVNPVATECWGSVSCINEPQDREGENG

SEQ ID NO: 110964 - protein, 34 aa, Artificial Sequence
  Description of Artificial Sequence: Synthetic polypeptide
SEEEICTTNPVATEQYGSVSINGLRGERGQEGEN

SEQ ID NO: 110965 - protein, 36 aa, Artificial Sequence
  Description of Artificial Sequence: Synthetic polypeptide
AEEEIRTTNPVATEQYGSVSTVNNQQGSETGTNNAE

SEQ ID NO: 110966 - protein, 34 aa, Artificial Sequence
  Description of Artificial Sequence: Synthetic polypeptide
DESEIRTVNPVATECWGSVSTCINEPQDREGENG

SEQ ID NO: 110967 - protein, 33 aa, Artificial Sequence
  Description of Artificial Sequence: Synthetic polypeptide
DESEIRTVNPVATEQYGCVSGTHVQYTPGDTDR

SEQ ID NO: 110968 - protein, 35 aa, Artificial Sequence
  Description of Artificial Sequence: Synthetic polypeptide
AEEEIRTTNPVATEQYGSVSTVNNQQGEAEEDEEG

SEQ ID NO: 110969 - protein, 30 aa, Artificial Sequence
  Description of Artificial Sequence: Synthetic polypeptide
DENEIRTTNPVATECYGDISECIQQQNGEL

SEQ ID NO: 110970 - protein, 32 aa, Artificial Sequence
  Description of Artificial Sequence: Synthetic polypeptide
DESEIRTVNPVCTECWGSVSCNLPQDSEGENG

SEQ ID NO: 110971 - protein, 31 aa, Artificial Sequence
  Description of Artificial Sequence: Synthetic polypeptide
DESEIRTVNPVCTEQWGVVSDINEQSEGENG

SEQ ID NO: 110972 - protein, 33 aa, Artificial Sequence
  Description of Artificial Sequence: Synthetic polypeptide
DESEIRVTNPVATECWGSVSCINEPQDREGENG

SEQ ID NO: 110973 - protein, 36 aa, Artificial Sequence
  Description of Artificial Sequence: Synthetic polypeptide
AEEEIRTTNPVATEQYGSVSTVNNQNGSEQGTNEET

SEQ ID NO: 110974 - protein, 37 aa, Artificial Sequence
  Description of Artificial Sequence: Synthetic polypeptide
AEEEIRTTNPVATEQYGSVSTVNNQLQQGTETGTNTF

SEQ ID NO: 110975 - protein, 33 aa, Artificial Sequence
  Description of Artificial Sequence: Synthetic polypeptide
DENEIRTTNPVATECWGSVSMEDEQQQRNGENG

SEQ ID NO: 110976 - protein, 37 aa, Artificial Sequence
  Description of Artificial Sequence: Synthetic polypeptide
AEEEIRTTNPVATEQYGSVSTVNNQLQEGTEQGNEAG

SEQ ID NO: 110977 - protein, 35 aa, Artificial Sequence
  Description of Artificial Sequence: Synthetic polypeptide
DENEIRTTNPVATEIYGSVVYSTNVELEQEPNEEK

SEQ ID NO: 110978 - protein, 37 aa, Artificial Sequence
  Description of Artificial Sequence: Synthetic polypeptide
AEEEIRTTNPVATEQYGSVSTVNTDNLQSGTTNNETD

SEQ ID NO: 110979 - protein, 30 aa, Artificial Sequence
  Description of Artificial Sequence: Synthetic polypeptide
SEEEIATTNPVATESYGCVAGTNDAPGDQD

SEQ ID NO: 110980 - protein, 31 aa, Artificial Sequence
  Description of Artificial Sequence: Synthetic polypeptide
DENEIRTTNPVATEPYGTISEEDIQQQNGNH

SEQ ID NO: 110981 - protein, 31 aa, Artificial Sequence
  Description of Artificial Sequence: Synthetic polypeptide
DENEIRTTNPVATEPYGTISEEDCQQQQGNH

SEQ ID NO: 110982 - protein, 31 aa, Artificial Sequence
  Description of Artificial Sequence: Synthetic polypeptide
DENEIRTTNPVATEPYGTISEECIQQQQGNH

SEQ ID NO: 110983 - protein, 28 aa, Artificial Sequence
  Description of Artificial Sequence: Synthetic peptide
SEEEIATTNPVATEQYGEAPEVQQHQEK

SEQ ID NO: 110984 - protein, 28 aa, Artificial Sequence
  Description of Artificial Sequence: Synthetic peptide
SEEEIATTNPVATEQYGEAPEYCQHEEK

SEQ ID NO: 110985 - protein, 36 aa, Artificial Sequence
  Description of Artificial Sequence: Synthetic polypeptide
AEEEIRTTNPVATEQYGSVSTVQQNGNQEEGNNQIG

SEQ ID NO: 110986 - protein, 29 aa, Artificial Sequence
  Description of Artificial Sequence: Synthetic peptide
SEEEIATTNPVATEQYGEYPWVDQHFNEQ

SEQ ID NO: 110987 - protein, 32 aa, Artificial Sequence
  Description of Artificial Sequence: Synthetic polypeptide
DESEIRTTNPVSTEPYGSISCENIPQQQNGNH

SEQ ID NO: 110988 - protein, 31 aa, Artificial Sequence
  Description of Artificial Sequence: Synthetic polypeptide
DENEIRTTNPVATEPYGTASMEDIQQQQGNK

SEQ ID NO: 110989 - protein, 31 aa, Artificial Sequence
  Description of Artificial Sequence: Synthetic polypeptide
DENEIRTTNPVATEPYGTASMEDIQQQNGGR

SEQ ID NO: 110990 - protein, 30 aa, Artificial Sequence
  Description of Artificial Sequence: Synthetic polypeptide
DENEIRTTNPVATEPYGTASEDIQQQNGEK

SEQ ID NO: 110991 - protein, 32 aa, Artificial Sequence
  Description of Artificial Sequence: Synthetic polypeptide
SEEEIATTNPVATEQYGSVAATNDATANPEEA

SEQ ID NO: 110992 - protein, 29 aa, Artificial Sequence
  Description of Artificial Sequence: Synthetic peptide
DENEIRTTNPVATEPYGTASEDIQQQEEK

SEQ ID NO: 110993 - protein, 28 aa, Artificial Sequence
  Description of Artificial Sequence: Synthetic peptide
DENEIRTTNPVATEPYGTAPEDIQQEEK

SEQ ID NO: 110994 - protein, 35 aa, Artificial Sequence
  Description of Artificial Sequence: Synthetic polypeptide
AEEEIRTTNPVATEQYGSVSTVQQGDEQGNNNDDG

SEQ ID NO: 110995 - protein, 33 aa, Artificial Sequence
  Description of Artificial Sequence: Synthetic polypeptide
SEEEIATTNPVATEQYGSVAITNDEQTGEGPEQ

SEQ ID NO: 110996 - protein, 33 aa, Artificial Sequence
  Description of Artificial Sequence: Synthetic polypeptide
DESEIRTTNPVSTEPYGSVSMENEQQDQEGENG

SEQ ID NO: 110997 - protein, 33 aa, Artificial Sequence
  Description of Artificial Sequence: Synthetic polypeptide
DESEIRTTNPVSTEPYGSVSMINEQQDQEGENG

SEQ ID NO: 110998 - protein, 36 aa, Artificial Sequence
  Description of Artificial Sequence: Synthetic polypeptide
AEEEIRTTNPVATEQYGSVSTVQNQQGSEEGTNVEV

SEQ ID NO: 110999 - protein, 35 aa, Artificial Sequence
  Description of Artificial Sequence: Synthetic polypeptide
DENEIRTTNPVATEPYGSVSSTTPAGQNMRNGNPV

SEQ ID NO: 111000 - protein, 33 aa, Artificial Sequence
  Description of Artificial Sequence: Synthetic polypeptide
SEEEIATTNPVATEQYGSVAITPLQPQADNNES

SEQ ID NO: 111001 - protein, 32 aa, Artificial Sequence
  Description of Artificial Sequence: Synthetic polypeptide
DESEIRTTNPVSTEPYGTISCENEPQQRNGNH

SEQ ID NO: 111002 - protein, 33 aa, Artificial Sequence
  Description of Artificial Sequence: Synthetic polypeptide
DENEIRTTNPVATEPYGSVSMIDIQQDQNGENG

SEQ ID NO: 111003 - protein, 33 aa, Artificial Sequence
  Description of Artificial Sequence: Synthetic polypeptide
DENEIRTTNPVATEPYGSVSMEDIQQDQNGENG

SEQ ID NO: 111004 - protein, 31 aa, Artificial Sequence
  Description of Artificial Sequence: Synthetic polypeptide
DESEIRTTNPVSTEPYGTISMDIQQQRNGNH

SEQ ID NO: 111005 - protein, 31 aa, Artificial Sequence
  Description of Artificial Sequence: Synthetic polypeptide
DENEIRTTNPVATEPYGTISEEDIQQQQGNH

SEQ ID NO: 111006 - protein, 35 aa, Artificial Sequence
  Description of Artificial Sequence: Synthetic polypeptide
AEEEIRTTNPVATEQYGSVVVTTNGNEQAGTNEES

SEQ ID NO: 111007 - protein, 28 aa, Artificial Sequence
  Description of Artificial Sequence: Synthetic peptide
SEEEIATTNPVATEQYGEAPEVHQHEEK

SEQ ID NO: 111008 - protein, 30 aa, Artificial Sequence
  Description of Artificial Sequence: Synthetic polypeptide
DENEIRTTNPVATEPYGTISEIIQQANENA

SEQ ID NO: 111009 - protein, 32 aa, Artificial Sequence
  Description of Artificial Sequence: Synthetic polypeptide
DENEIRTTNPVATEPYGTISTEDIVQQQNGNH

SEQ ID NO: 111010 - protein, 32 aa, Artificial Sequence
  Description of Artificial Sequence: Synthetic polypeptide
DENEIRTTNPVATEPYGTISTEDIVQQQNGND

SEQ ID NO: 111011 - protein, 32 aa, Artificial Sequence
  Description of Artificial Sequence: Synthetic polypeptide
DENEIRTTNPVATEPYGTISTEDIVEQQNGND

SEQ ID NO: 111012 - protein, 32 aa, Artificial Sequence
  Description of Artificial Sequence: Synthetic polypeptide
DENEIRTTNPVATEPYGTISTEDIQQQQNGNH

SEQ ID NO: 111013 - protein, 32 aa, Artificial Sequence
  Description of Artificial Sequence: Synthetic polypeptide
DENEIRTTNPVATEPYGTISTDGIQQQFNGND

SEQ ID NO: 111014 - protein, 33 aa, Artificial Sequence
  Description of Artificial Sequence: Synthetic polypeptide
SEEEIATTNPVATEQWGSVSTGNPPQNHQSNDS

SEQ ID NO: 111015 - protein, 32 aa, Artificial Sequence
  Description of Artificial Sequence: Synthetic polypeptide
DENEIRTTNPVATEPYGTISMVDIQQQQNGNH

SEQ ID NO: 111016 - protein, 32 aa, Artificial Sequence
  Description of Artificial Sequence: Synthetic polypeptide
DENEIRTTNPVATEPYGTISMENIQQQQNGNH

SEQ ID NO: 111017 - protein, 32 aa, Artificial Sequence
  Description of Artificial Sequence: Synthetic polypeptide
DENEIRTTNPVATEPYGTISMENIPQQQNGNH

SEQ ID NO: 111018 - protein, 35 aa, Artificial Sequence
  Description of Artificial Sequence: Synthetic polypeptide
AEEEIRTTNPVATEQYGSVSTVQQQGEQAGTNEQS

SEQ ID NO: 111019 - protein, 34 aa, Artificial Sequence
  Description of Artificial Sequence: Synthetic polypeptide
SEEEIATTNPVATEQYGAVATNLPQTQAGPNDTT

SEQ ID NO: 111020 - protein, 31 aa, Artificial Sequence
  Description of Artificial Sequence: Synthetic polypeptide
SEEEIATTNPVATEQYGCVAATNDADSDNQD

SEQ ID NO: 111021 - protein, 31 aa, Artificial Sequence
  Description of Artificial Sequence: Synthetic polypeptide
DENEIRTTNPVATEPYGTISMEDWAQQNGNH

SEQ ID NO: 111022 - protein, 32 aa, Artificial Sequence
  Description of Artificial Sequence: Synthetic polypeptide
DENEIRTTNPVATEPYGTISMEDLQEQQNGNH

SEQ ID NO: 111023 - protein, 32 aa, Artificial Sequence
  Description of Artificial Sequence: Synthetic polypeptide
DENEIRTTNPVATEPYGTISMEDIQQQRNGNH

SEQ ID NO: 111024 - protein, 31 aa, Artificial Sequence
  Description of Artificial Sequence: Synthetic polypeptide
DENEIRTTNPVATEPYGTISMEDIQQQRGGH

SEQ ID NO: 111025 - protein, 31 aa, Artificial Sequence
  Description of Artificial Sequence: Synthetic polypeptide
DENEIRTTNPVATEPYGTISMEDIQQQQGNK

SEQ ID NO: 111026 - protein, 28 aa, Artificial Sequence
  Description of Artificial Sequence: Synthetic peptide
SEEEIATTNPVATEQYGEAPEVCQHEEK

SEQ ID NO: 111027 - protein, 31 aa, Artificial Sequence
  Description of Artificial Sequence: Synthetic polypeptide
DESEIRTTNPVSTEGYGTIASETIQQHNGNH

SEQ ID NO: 111028 - protein, 28 aa, Artificial Sequence
  Description of Artificial Sequence: Synthetic peptide
SEEEIATTNPVATEQYGEAPEVCQHESK

SEQ ID NO: 111029 - protein, 31 aa, Artificial Sequence
  Description of Artificial Sequence: Synthetic polypeptide
DENEIRTTNPVATEPYGTISMEDIQQQNGNH

SEQ ID NO: 111030 - protein, 32 aa, Artificial Sequence
  Description of Artificial Sequence: Synthetic polypeptide
DENEIRTTNPVATEPYGTISMEDIQNQQNGNH

SEQ ID NO: 111031 - protein, 31 aa, Artificial Sequence
  Description of Artificial Sequence: Synthetic polypeptide
DENEIRTTNPVATEPYGTISMEDIQMQNGNH

SEQ ID NO: 111032 - protein, 31 aa, Artificial Sequence
  Description of Artificial Sequence: Synthetic polypeptide
DENEIRTTNPVATEPYGTISMDIQQQQNGNH

SEQ ID NO: 111033 - protein, 31 aa, Artificial Sequence
  Description of Artificial Sequence: Synthetic polypeptide
DESEIRTTNPVSTEGYGTIASETIQQQNGNH

SEQ ID NO: 111034 - protein, 33 aa, Artificial Sequence
  Description of Artificial Sequence: Synthetic polypeptide
DESEIRTTNPVSTEKWGSVSCINEPQDREGENG

SEQ ID NO: 111035 - protein, 33 aa, Artificial Sequence
  Description of Artificial Sequence: Synthetic polypeptide
DENEIRTTNPVATEPYGSVSMEDIQQDHNGNDL

SEQ ID NO: 111036 - protein, 33 aa, Artificial Sequence
  Description of Artificial Sequence: Synthetic polypeptide
DENEIRTTNPVATEPYGSVSMEDIQEDHNGNDL

SEQ ID NO: 111037 - protein, 32 aa, Artificial Sequence
  Description of Artificial Sequence: Synthetic polypeptide
DENEIRTTNPVATEPYGSVSAMDIEQQEGEDH

SEQ ID NO: 111038 - protein, 30 aa, Artificial Sequence
  Description of Artificial Sequence: Synthetic polypeptide
DENEIRTTNPVATEPYGDISEIEMNQNENA

SEQ ID NO: 111039 - protein, 37 aa, Artificial Sequence
  Description of Artificial Sequence: Synthetic polypeptide
AEEEIRTTNPVATEQYGSVSTVNTTNLQSGSVDNGTQ

SEQ ID NO: 111040 - protein, 37 aa, Artificial Sequence
  Description of Artificial Sequence: Synthetic polypeptide
AEEEIRTTNPVATEQYGSVSTVNTQNLQIGTTDNETD

SEQ ID NO: 111041 - protein, 35 aa, Artificial Sequence
  Description of Artificial Sequence: Synthetic polypeptide
SEEEIATTNPVATEQYGSVCAMTNDLQPDDSNGNP

SEQ ID NO: 111042 - protein, 32 aa, Artificial Sequence
  Description of Artificial Sequence: Synthetic polypeptide
NETEIRTTNPVATEYYGNVSTGNDGGPQGNFD

SEQ ID NO: 111043 - protein, 34 aa, Artificial Sequence
  Description of Artificial Sequence: Synthetic polypeptide
SEEEIATTNPVATEQYGSVCATNNEEMAMGDNRI

SEQ ID NO: 111044 - protein, 32 aa, Artificial Sequence
  Description of Artificial Sequence: Synthetic polypeptide
SEEEIATTNPVATEQYGSVCATNNLHDSDDHS

SEQ ID NO: 111045 - protein, 32 aa, Artificial Sequence
  Description of Artificial Sequence: Synthetic polypeptide
SEEEIATTNPVATEQYGSVCATNPLHDSLDEL

SEQ ID NO: 111046 - protein, 33 aa, Artificial Sequence
  Description of Artificial Sequence: Synthetic polypeptide
SEEEIATTNPVATEQYGSVCATNPLHDSLDNMW

SEQ ID NO: 111047 - protein, 33 aa, Artificial Sequence
  Description of Artificial Sequence: Synthetic polypeptide
SEEEIATTNPVATEQYGSVCSTNNPHDSNDFHL

SEQ ID NO: 111048 - protein, 33 aa, Artificial Sequence
  Description of Artificial Sequence: Synthetic polypeptide
NETEIRTTNPVATEYWGNVATNLNQGEEGNNDR

SEQ ID NO: 111049 - protein, 32 aa, Artificial Sequence
  Description of Artificial Sequence: Synthetic polypeptide
DENEIRTTNPVATEPWGTVSCINEQQQQNGNH

SEQ ID NO: 111050 - protein, 35 aa, Artificial Sequence
  Description of Artificial Sequence: Synthetic polypeptide
SEEEIATTNPVATEQYGSVCSVNLPQDSPDGNDNN

SEQ ID NO: 111051 - protein, 36 aa, Artificial Sequence
  Description of Artificial Sequence: Synthetic polypeptide
AEEEIRTTNPVATEQYGSVSTVNTNQQGTTEENDTG

SEQ ID NO: 111052 - protein, 36 aa, Artificial Sequence
  Description of Artificial Sequence: Synthetic polypeptide
AEEEIRTTNPVATEQYGSVSTVNTNQQGNDEENEEG

SEQ ID NO: 111053 - protein, 31 aa, Artificial Sequence
  Description of Artificial Sequence: Synthetic polypeptide
DESEIRTTNPVSTEPYGVISSEDLQQQQGNH

SEQ ID NO: 111054 - protein, 34 aa, Artificial Sequence
  Description of Artificial Sequence: Synthetic polypeptide
SEEEIATTNPVATEQYGSVSGTGPPQEAMDGTRE

SEQ ID NO: 111055 - protein, 33 aa, Artificial Sequence
  Description of Artificial Sequence: Synthetic polypeptide
SEEEIATTNPVATEQYGSVSGTPPANQDGDPQN

SEQ ID NO: 111056 - protein, 36 aa, Artificial Sequence
  Description of Artificial Sequence: Synthetic polypeptide
AEEEIRTTNPVATEQYGSVSTVNTNLQQQNNTNNDD

SEQ ID NO: 111057 - protein, 36 aa, Artificial Sequence
  Description of Artificial Sequence: Synthetic polypeptide
AEEEIRTTNPVATEQYGSVSTVNTNEQQGINTNNDD

SEQ ID NO: 111058 - protein, 32 aa, Artificial Sequence
  Description of Artificial Sequence: Synthetic polypeptide
DENEIRTTNPVATEPWGSISCEDEQQQREGNH

SEQ ID NO: 111059 - protein, 30 aa, Artificial Sequence
  Description of Artificial Sequence: Synthetic polypeptide
DENEIRTTNPVATEPWGDVSMIEQQQNEDA

SEQ ID NO: 111060 - protein, 30 aa, Artificial Sequence
  Description of Artificial Sequence: Synthetic polypeptide
DENEIRTTNPVATEPWGDVSEIIMQAAENA

SEQ ID NO: 111061 - protein, 36 aa, Artificial Sequence
  Description of Artificial Sequence: Synthetic polypeptide
AEEEIRTTNPVATEQYGSVSTVNTDTGNNQLGGNDD

SEQ ID NO: 111062 - protein, 30 aa, Artificial Sequence
  Description of Artificial Sequence: Synthetic polypeptide
DENEIRTTNPVATEPWGDVSEIEMNAAGNA

SEQ ID NO: 111063 - protein, 37 aa, Artificial Sequence
  Description of Artificial Sequence: Synthetic polypeptide
AEEEIRTTNPVATEQYGSVSTVNTTNLQSGTVDNSTD

SEQ ID NO: 111064 - protein, 31 aa, Artificial Sequence
  Description of Artificial Sequence: Synthetic polypeptide
DENEIRTTNPVATEPYGDISMEDIQQQHGNH

SEQ ID NO: 111065 - protein, 31 aa, Artificial Sequence
  Description of Artificial Sequence: Synthetic polypeptide
DENEIRTTNPVATEPYGDISMEDIQQQQGNH

SEQ ID NO: 111066 - protein, 30 aa, Artificial Sequence
  Description of Artificial Sequence: Synthetic polypeptide
DENEIRTTNPVATEPYGDISMIEMNQNENA

SEQ ID NO: 111067 - protein, 30 aa, Artificial Sequence
  Description of Artificial Sequence: Synthetic polypeptide
DESEIRTTNPVSTEPYGTVAMDIQQQVGNH

SEQ ID NO: 111068 - protein, 30 aa, Artificial Sequence
  Description of Artificial Sequence: Synthetic polypeptide
DESEIRTTNPVSTEPYGTVANDIQQQVGNH

SEQ ID NO: 111069 - protein, 34 aa, Artificial Sequence
  Description of Artificial Sequence: Synthetic polypeptide
DENEIRTTNPVATEPYGSISTMEDGPQMRNGMNV

SEQ ID NO: 111070 - protein, 34 aa, Artificial Sequence
  Description of Artificial Sequence: Synthetic polypeptide
DENEIRTTNPVATEPYGSISSTTPAGQNQRNGNV

SEQ ID NO: 111071 - protein, 34 aa, Artificial Sequence
  Description of Artificial Sequence: Synthetic polypeptide
DENEIRTTNPVATEPYGSISSTPAGPNQRNGMNV

SEQ ID NO: 111072 - protein, 33 aa, Artificial Sequence
  Description of Artificial Sequence: Synthetic polypeptide
DENEIRTTNPVATEPYGSISSTEDIQQMQNGNH

SEQ ID NO: 111073 - protein, 35 aa, Artificial Sequence
  Description of Artificial Sequence: Synthetic polypeptide
AEEEIRTTNPVATEQYGSVVVTTNLGGTEQGNNNS

SEQ ID NO: 111074 - protein, 34 aa, Artificial Sequence
  Description of Artificial Sequence: Synthetic polypeptide
AEEEIRTTNPVATEQYGSVSTVQNNNNQNDEQGS

SEQ ID NO: 111075 - protein, 32 aa, Artificial Sequence
  Description of Artificial Sequence: Synthetic polypeptide
DENEIRTTNPVATEPYGSISMPDGQQQQNGNH

SEQ ID NO: 111076 - protein, 35 aa, Artificial Sequence
  Description of Artificial Sequence: Synthetic polypeptide
AEEEIRTTNPVATEQYGSVSTVQNNDTNNNGNNDD

SEQ ID NO: 111077 - protein, 32 aa, Artificial Sequence
  Description of Artificial Sequence: Synthetic polypeptide
DENEIRTTNPVATEPYGSISMEDIPQQQNGNH

SEQ ID NO: 111078 - protein, 36 aa, Artificial Sequence
  Description of Artificial Sequence: Synthetic polypeptide
AEEEIRTTNPVATEQYGSVSTVQNLQQGEEDEETEG

SEQ ID NO: 111079 - protein, 37 aa, Artificial Sequence
  Description of Artificial Sequence: Synthetic polypeptide
AEEEIRTTNPVATEQYGSVSTVNNNNLQLGNNLVEAG

SEQ ID NO: 111080 - protein, 32 aa, Artificial Sequence
  Description of Artificial Sequence: Synthetic polypeptide
DENEIRTTNPVATEPYGSISMEDIPQMQNGNH

SEQ ID NO: 111081 - protein, 31 aa, Artificial Sequence
  Description of Artificial Sequence: Synthetic polypeptide
DENEIRTTNPVATEPYGSISAMDIEDQEGEL

SEQ ID NO: 111082 - protein, 32 aa, Artificial Sequence
  Description of Artificial Sequence: Synthetic polypeptide
DENEIRTTNPVATEPYGSAVYDQNASTRNMLR

SEQ ID NO: 111083 - protein, 35 aa, Artificial Sequence
  Description of Artificial Sequence: Synthetic polypeptide
AEEEIRTTNPVATEQYGSVVVTTNLLQQGTEVGTD

SEQ ID NO: 111084 - protein, 32 aa, Artificial Sequence
  Description of Artificial Sequence: Synthetic polypeptide
DENEIRTTNPVATEPYGEISEEDIQQQRNGNH

SEQ ID NO: 111085 - protein, 33 aa, Artificial Sequence
  Description of Artificial Sequence: Synthetic polypeptide
NETEIRTTNPVAYEAWGNVSTTNLPGQEGNTDR

SEQ ID NO: 111086 - protein, 36 aa, Artificial Sequence
  Description of Artificial Sequence: Synthetic polypeptide
AEEEIRTTNPVATEQYGSVSTVQNGNQQIGTEGNQE

SEQ ID NO: 111087 - protein, 31 aa, Artificial Sequence
  Description of Artificial Sequence: Synthetic polypeptide
DENEIRTTNPVATEPYGDVSMEDIQQHNENH

SEQ ID NO: 111088 - protein, 33 aa, Artificial Sequence
  Description of Artificial Sequence: Synthetic polypeptide
NETEIRTTNPVAYEAWGNVSTNLNQGNEGNTDR

SEQ ID NO: 111089 - protein, 30 aa, Artificial Sequence
  Description of Artificial Sequence: Synthetic polypeptide
DENEIRTTNPVATEPYGDISMIIMNQNENA

SEQ ID NO: 111090 - protein, 36 aa, Artificial Sequence
  Description of Artificial Sequence: Synthetic polypeptide
AEEEIRTTNPVATEQYGSVSTVQNGGTQGIGNNQTE

SEQ ID NO: 111091 - protein, 37 aa, Artificial Sequence
  Description of Artificial Sequence: Synthetic polypeptide
AEEEIRTTNPVATEQYGSVSTVQGNLQQGIGTNNNTE

SEQ ID NO: 111092 - protein, 36 aa, Artificial Sequence
  Description of Artificial Sequence: Synthetic polypeptide
AEEEIRTTNPVATEQYGSVSTVNVNQQGEQEENEEQ

SEQ ID NO: 111093 - protein, 31 aa, Artificial Sequence
  Description of Artificial Sequence: Synthetic polypeptide
DENEIRTTNPVATEPYGSISAMDIQDQEGEL

SEQ ID NO: 111094 - protein, 37 aa, Artificial Sequence
  Description of Artificial Sequence: Synthetic polypeptide
AEEEIRTTNPVATEQYGSVSTVNNNNLQGQGTTNLDE

SEQ ID NO: 111095 - protein, 33 aa, Artificial Sequence
  Description of Artificial Sequence: Synthetic polypeptide
DESEISTTNPVATECWGSVSCINEPQDREGENG

SEQ ID NO: 111096 - protein, 33 aa, Artificial Sequence
  Description of Artificial Sequence: Synthetic polypeptide
DENEIRTTNPVATECWGSVSCINEPQDRAEENG

SEQ ID NO: 111097 - protein, 37 aa, Artificial Sequence
  Description of Artificial Sequence: Synthetic polypeptide
AEEEIRTTNPVATEQYGSVSTVNLNLQQGTNDTGNAS

SEQ ID NO: 111098 - protein, 29 aa, Artificial Sequence
  Description of Artificial Sequence: Synthetic peptide
DESEIVTTNPVATEQYGVMATTPVEHGDD

SEQ ID NO: 111099 - protein, 37 aa, Artificial Sequence
  Description of Artificial Sequence: Synthetic polypeptide
AEEEIRTTNPVATEQYGSVSTVNLNLQQGNNDTNNAD

SEQ ID NO: 111100 - protein, 32 aa, Artificial Sequence
  Description of Artificial Sequence: Synthetic polypeptide
SEEEIRCTNPCATEWYGSVRTNENWLERENQS

SEQ ID NO: 111101 - protein, 37 aa, Artificial Sequence
  Description of Artificial Sequence: Synthetic polypeptide
AEEEIRTTNPVATEQYGSVSTVNLNLQQGEQGTNINN

SEQ ID NO: 111102 - protein, 31 aa, Artificial Sequence
  Description of Artificial Sequence: Synthetic polypeptide
SEEEIRCTNPEATEQYGCVCSWNHANFGSNQ

SEQ ID NO: 111103 - protein, 31 aa, Artificial Sequence
  Description of Artificial Sequence: Synthetic polypeptide
DENEIRCTNPVSTEQYGTVSMEDIMQQNGNH

SEQ ID NO: 111104 - protein, 31 aa, Artificial Sequence
  Description of Artificial Sequence: Synthetic polypeptide
DENEIRCTNPVSTEPYGTISMEDIQMRNGNR

SEQ ID NO: 111105 - protein, 30 aa, Artificial Sequence
  Description of Artificial Sequence: Synthetic polypeptide
DENEIRCTNPVSTEPYGTASMDIQQQQGNR

SEQ ID NO: 111106 - protein, 31 aa, Artificial Sequence
  Description of Artificial Sequence: Synthetic polypeptide
DENEIRCTNPVSTEPYGSISMDIQQQRNGNH

SEQ ID NO: 111107 - protein, 32 aa, Artificial Sequence
  Description of Artificial Sequence: Synthetic polypeptide
DENEIRCTNPVATEQYGTISMEDIQQQRNGNH

SEQ ID NO: 111108 - protein, 30 aa, Artificial Sequence
  Description of Artificial Sequence: Synthetic polypeptide
CEEVIACTNPVATEQYGCVATNLAMNPERL

SEQ ID NO: 111109 - protein, 30 aa, Artificial Sequence
  Description of Artificial Sequence: Synthetic polypeptide
CEEVIACTNPVATEQYGCVATNLAMNPNTG

SEQ ID NO: 111110 - protein, 32 aa, Artificial Sequence
  Description of Artificial Sequence: Synthetic polypeptide
SEEEIRCTNPEATEQYGCVCSWNLAHFGSNQA

SEQ ID NO: 111111 - protein, 31 aa, Artificial Sequence
  Description of Artificial Sequence: Synthetic polypeptide
CEEVIACTNPVATEQYGCVATNLATMNPEGR

SEQ ID NO: 111112 - protein, 32 aa, Artificial Sequence
  Description of Artificial Sequence: Synthetic polypeptide
NETEIATTNPVATEMWGSVSTNLQGNDPNTDS

SEQ ID NO: 111113 - protein, 36 aa, Artificial Sequence
  Description of Artificial Sequence: Synthetic polypeptide
AEEEIRTTNPVATEQYGSVSTVNLLQQNNNGETGTE

SEQ ID NO: 111114 - protein, 33 aa, Artificial Sequence
  Description of Artificial Sequence: Synthetic polypeptide
NETEIATTNPVATEMWGSVSTNLQGNDGGNTDH

SEQ ID NO: 111115 - protein, 32 aa, Artificial Sequence
  Description of Artificial Sequence: Synthetic polypeptide
DESEIVTTNPVSTEGYGTVSATDGPVQRVGND

SEQ ID NO: 111116 - protein, 30 aa, Artificial Sequence
  Description of Artificial Sequence: Synthetic polypeptide
DENEIRCTNPVATEQYGDVSENEMNAAEDA

SEQ ID NO: 111117 - protein, 30 aa, Artificial Sequence
  Description of Artificial Sequence: Synthetic polypeptide
DENEIRCTNPVATEQYGDVSEIEMNAAGDA

SEQ ID NO: 111118 - protein, 31 aa, Artificial Sequence
  Description of Artificial Sequence: Synthetic polypeptide
CEEVIACTNPVATEQYGCVATNLPDNGEQNH

SEQ ID NO: 111119 - protein, 33 aa, Artificial Sequence
  Description of Artificial Sequence: Synthetic polypeptide
DESEIWTTNPVATECWGSVSCINEPQDREGENG

SEQ ID NO: 111120 - protein, 33 aa, Artificial Sequence
  Description of Artificial Sequence: Synthetic polypeptide
DESEIYTTNPVATECWGSVSCINEPQDREGENG

SEQ ID NO: 111121 - protein, 33 aa, Artificial Sequence
  Description of Artificial Sequence: Synthetic polypeptide
DESEIYTTNPVATECWGSVSCINEPQDRIGENG

SEQ ID NO: 111122 - protein, 37 aa, Artificial Sequence
  Description of Artificial Sequence: Synthetic polypeptide
AEEEIRTTNPVATEQYGSVSTVNLNLQQGTNDTNNEQ

SEQ ID NO: 111123 - protein, 32 aa, Artificial Sequence
  Description of Artificial Sequence: Synthetic polypeptide
DENEIRCTNPVATEQYGCVSWPFLTRFQENEF

SEQ ID NO: 111124 - protein, 33 aa, Artificial Sequence
  Description of Artificial Sequence: Synthetic polypeptide
DESEIVTTNPVATEQYGTVVSATDGQVEFEGND

SEQ ID NO: 111125 - protein, 37 aa, Artificial Sequence
  Description of Artificial Sequence: Synthetic polypeptide
AEEEIRTTNPVATEQYGSVSTVNLNLQQGTNVTNNAN

SEQ ID NO: 111126 - protein, 33 aa, Artificial Sequence
  Description of Artificial Sequence: Synthetic polypeptide
DESEIVTTNPVATEQYGTVCSATDGIVQFEGND

SEQ ID NO: 111127 - protein, 29 aa, Artificial Sequence
  Description of Artificial Sequence: Synthetic peptide
DENEIRSTNPVSTEGYGTISMETIQQGNH

SEQ ID NO: 111128 - protein, 33 aa, Artificial Sequence
  Description of Artificial Sequence: Synthetic polypeptide
DESEIVTTNPVATEQYGTVCSATDTPESFEGNR

SEQ ID NO: 111129 - protein, 33 aa, Artificial Sequence
  Description of Artificial Sequence: Synthetic polypeptide
DESEIVTTNPVATEQYGTVCSATINPVEFEGNG

SEQ ID NO: 111130 - protein, 34 aa, Artificial Sequence
  Description of Artificial Sequence: Synthetic polypeptide
DESEIVTTNPVATEQYGTVCSATINPVQDFEGNG

SEQ ID NO: 111131 - protein, 33 aa, Artificial Sequence
  Description of Artificial Sequence: Synthetic polypeptide
DESEIVTTNPVATEQYGTVCSCINPPQDFEGNG

SEQ ID NO: 111132 - protein, 33 aa, Artificial Sequence
  Description of Artificial Sequence: Synthetic polypeptide
SEEEIRCTNPCATEQYGSVRTNENHLERENQFG

SEQ ID NO: 111133 - protein, 30 aa, Artificial Sequence
  Description of Artificial Sequence: Synthetic polypeptide
DENEIRSTNPVATEQWGDVSENEQNAAEDA

SEQ ID NO: 111134 - protein, 33 aa, Artificial Sequence
  Description of Artificial Sequence: Synthetic polypeptide
DESEIVTTNPVATEQYGTVCSCINPVQDFEGNG

SEQ ID NO: 111135 - protein, 30 aa, Artificial Sequence
  Description of Artificial Sequence: Synthetic polypeptide
DENEIRSTNPVATEQWGDVSEIIQNAAEQR

SEQ ID NO: 111136 - protein, 30 aa, Artificial Sequence
  Description of Artificial Sequence: Synthetic polypeptide
DENEIRSTNPVATEQWGDVSEIEQNAAEDR

SEQ ID NO: 111137 - protein, 33 aa, Artificial Sequence
  Description of Artificial Sequence: Synthetic polypeptide
DESEIVTTNPVATEQYGTVSACDNEPQFEGENG

SEQ ID NO: 111138 - protein, 29 aa, Artificial Sequence
  Description of Artificial Sequence: Synthetic peptide
DENEIRPTNPVSTEQYGDVSCILMNAETA

SEQ ID NO: 111139 - protein, 33 aa, Artificial Sequence
  Description of Artificial Sequence: Synthetic polypeptide
DESEIVTTNPVATEQYGTVSACINEPQFEGENG

SEQ ID NO: 111140 - protein, 33 aa, Artificial Sequence
  Description of Artificial Sequence: Synthetic polypeptide
SEEEIRCTNPCATEQYGSVRTNENWLEGRECQR

SEQ ID NO: 111141 - protein, 32 aa, Artificial Sequence
  Description of Artificial Sequence: Synthetic polypeptide
DESEIVTTNPVATEQYGTVSATDGLVEFEGDD

SEQ ID NO: 111142 - protein, 30 aa, Artificial Sequence
  Description of Artificial Sequence: Synthetic polypeptide
DENEIRPTNPVATEQYGDVSCIEMNAAGDA

SEQ ID NO: 111143 - protein, 33 aa, Artificial Sequence
  Description of Artificial Sequence: Synthetic polypeptide
DESEIVTTNPVATEQYGTVSCINPPQDFEGENG

SEQ ID NO: 111144 - protein, 36 aa, Artificial Sequence
  Description of Artificial Sequence: Synthetic polypeptide
AEEEIRTTNPVATEQYGSVSTVNLNQQANNSETGTE

SEQ ID NO: 111145 - protein, 30 aa, Artificial Sequence
  Description of Artificial Sequence: Synthetic polypeptide
DENEIRPTNPCATEQWGIVSENEMNAAGDR

SEQ ID NO: 111146 - protein, 30 aa, Artificial Sequence
  Description of Artificial Sequence: Synthetic polypeptide
DENEIRPTNPCATEQWGIVSCNEMNAAGDR

SEQ ID NO: 111147 - protein, 32 aa, Artificial Sequence
  Description of Artificial Sequence: Synthetic polypeptide
DENEIRGTNPVATEQYGSVVTGLIAGMGQDEG

SEQ ID NO: 111148 - protein, 36 aa, Artificial Sequence
  Description of Artificial Sequence: Synthetic polypeptide
AEEEIRTTNPVATEQYGSVSTVNLNNNELGNTDEDE

SEQ ID NO: 111149 - protein, 37 aa, Artificial Sequence
  Description of Artificial Sequence: Synthetic polypeptide
AEEEIRTTNPVATEQYGSVSTVNLNLQQGTTNTNGAT

SEQ ID NO: 111150 - protein, 30 aa, Artificial Sequence
  Description of Artificial Sequence: Synthetic polypeptide
DESEIVTTNPVATEQYGTVSSGPVEFEGDD

SEQ ID NO: 111151 - protein, 33 aa, Artificial Sequence
  Description of Artificial Sequence: Synthetic polypeptide
DESEIVTTNPVATEQYGTVVSATDGNEEGGGND

SEQ ID NO: 111152 - protein, 36 aa, Artificial Sequence
  Description of Artificial Sequence: Synthetic polypeptide
AEEEIRTTNPVATEQYGSVSTVNLLQGNNNQENDED

SEQ ID NO: 111153 - protein, 31 aa, Artificial Sequence
  Description of Artificial Sequence: Synthetic polypeptide
AETEIACTNPVATEQYGETTSEENLQERGPI

SEQ ID NO: 111154 - protein, 33 aa, Artificial Sequence
  Description of Artificial Sequence: Synthetic polypeptide
NETEIATTNPVATEMWGSVSTNLNQGNEGNNMD

SEQ ID NO: 111155 - protein, 30 aa, Artificial Sequence
  Description of Artificial Sequence: Synthetic polypeptide
DENEIRCTNPVATEPYGTISEDIQQRNGGH

SEQ ID NO: 111156 - protein, 34 aa, Artificial Sequence
  Description of Artificial Sequence: Synthetic polypeptide
DESESIRTTNPVATECWGSVSCINEPQDREGENG

SEQ ID NO: 111157 - protein, 33 aa, Artificial Sequence
  Description of Artificial Sequence: Synthetic polypeptide
DESESRTTNPVATECWGSVSCINEPQDREGENG

SEQ ID NO: 111158 - protein, 36 aa, Artificial Sequence
  Description of Artificial Sequence: Synthetic polypeptide
AEEEIRTTNPVATEQYGSVSTVNGNLQQGEEEETEE

SEQ ID NO: 111159 - protein, 33 aa, Artificial Sequence
  Description of Artificial Sequence: Synthetic polypeptide
DESESRTTNPVATECWGSVSCINEPQDRLGENG

SEQ ID NO: 111160 - protein, 33 aa, Artificial Sequence
  Description of Artificial Sequence: Synthetic polypeptide
DESESRTTNPVATECWGSVSYINEPQDREGENG

SEQ ID NO: 111161 - protein, 36 aa, Artificial Sequence
  Description of Artificial Sequence: Synthetic polypeptide
AEEEIRTTNPVATEQYGSVSTVNGEQQGNEQGTNTM

SEQ ID NO: 111162 - protein, 36 aa, Artificial Sequence
  Description of Artificial Sequence: Synthetic polypeptide
AEEEIRTTNPVATEQYGSVSTVNGEQQGNEGGNNTG

SEQ ID NO: 111163 - protein, 34 aa, Artificial Sequence
  Description of Artificial Sequence: Synthetic polypeptide
DESETIRTTNPVATECWGSVSCINEPQDREGENG

SEQ ID NO: 111164 - protein, 36 aa, Artificial Sequence
  Description of Artificial Sequence: Synthetic polypeptide
AEEEIRTTNPVATEQYGSVSTVNDNQQGGNEENEEG

SEQ ID NO: 111165 - protein, 36 aa, Artificial Sequence
  Description of Artificial Sequence: Synthetic polypeptide
AEEEIRTTNPVATEQYGSVSTVNDNQNNQQGNNTAE

SEQ ID NO: 111166 - protein, 36 aa, Artificial Sequence
  Description of Artificial Sequence: Synthetic polypeptide
AEEEIRTTNPVATEQYGSVSTVNDNQLGNDEGNNVE

SEQ ID NO: 111167 - protein, 37 aa, Artificial Sequence
  Description of Artificial Sequence: Synthetic polypeptide
AEEEIRTTNPVATEQYGSVSTVNDNLQQGTNGQEDDT

SEQ ID NO: 111168 - protein, 33 aa, Artificial Sequence
  Description of Artificial Sequence: Synthetic polypeptide
DESETRTTNPVATECWGSVSCINEPQDREGENG

SEQ ID NO: 111169 - protein, 31 aa, Artificial Sequence
  Description of Artificial Sequence: Synthetic polypeptide
DENEIRCTNPVATECWGEASCINLQDREGGG

SEQ ID NO: 111170 - protein, 30 aa, Artificial Sequence
  Description of Artificial Sequence: Synthetic polypeptide
DENEIRCTNPISTEQYGTISEENIQQQGNH

SEQ ID NO: 111171 - protein, 36 aa, Artificial Sequence
  Description of Artificial Sequence: Synthetic polypeptide
AEEEIRTTNPVATEQYGSVSTVNDGNNQEQGTNEDT

SEQ ID NO: 111172 - protein, 36 aa, Artificial Sequence
  Description of Artificial Sequence: Synthetic polypeptide
AEEEIRTTNPVATEQYGSVSTVNDGEQIGTTNSEEQ

SEQ ID NO: 111173 - protein, 37 aa, Artificial Sequence
  Description of Artificial Sequence: Synthetic polypeptide
AEEEIRTTNPVATEQYGSVSTVNANLQQGTNDTNNAV

SEQ ID NO: 111174 - protein, 36 aa, Artificial Sequence
  Description of Artificial Sequence: Synthetic polypeptide
AEEEIRTTNPVATEQYGSVSTVLQSGNNDEGNNNSD

SEQ ID NO: 111175 - protein, 30 aa, Artificial Sequence
  Description of Artificial Sequence: Synthetic polypeptide
AETEIACTNPVATEQYGEAWAENLQEPGGR

SEQ ID NO: 111176 - protein, 36 aa, Artificial Sequence
  Description of Artificial Sequence: Synthetic polypeptide
AEEEIRTTNPVATEQYGSVSTVLQAGNNDEGNTNQD

SEQ ID NO: 111177 - protein, 35 aa, Artificial Sequence
  Description of Artificial Sequence: Synthetic polypeptide
AEEEIRTTNPVATEQYGSVSTVLNQQQANNNNTTE

SEQ ID NO: 111178 - protein, 36 aa, Artificial Sequence
  Description of Artificial Sequence: Synthetic polypeptide
AEEEIRTTNPVATEQYGSVSTVGVNNNQQGTTNVGV

SEQ ID NO: 111179 - protein, 33 aa, Artificial Sequence
  Description of Artificial Sequence: Synthetic polypeptide
DENEIRATNPVATECWGSVSCINEPQDREGENG

SEQ ID NO: 111180 - protein, 34 aa, Artificial Sequence
  Description of Artificial Sequence: Synthetic polypeptide
DESESIRTTNPVATECWGSVSCFNEPQDREGENG

SEQ ID NO: 111181 - protein, 30 aa, Artificial Sequence
  Description of Artificial Sequence: Synthetic polypeptide
DENEIRCTNPVATEQWGDASENEMNRAEGR

SEQ ID NO: 111182 - protein, 33 aa, Artificial Sequence
  Description of Artificial Sequence: Synthetic polypeptide
DESEQRTTNPVATECWGSVSYINEPQDREGENG

SEQ ID NO: 111183 - protein, 33 aa, Artificial Sequence
  Description of Artificial Sequence: Synthetic polypeptide
DESEQRTTNPVATECWGSVSCINEPQDREGENG

SEQ ID NO: 111184 - protein, 34 aa, Artificial Sequence
  Description of Artificial Sequence: Synthetic polypeptide
NETEIATTNPVATEMWGSVSTNLNQGNEGGNEDR

SEQ ID NO: 111185 - protein, 32 aa, Artificial Sequence
  Description of Artificial Sequence: Synthetic polypeptide
DENEIRCTNPVATEQYGCVSWAYTLTERPENQ

SEQ ID NO: 111186 - protein, 31 aa, Artificial Sequence
  Description of Artificial Sequence: Synthetic polypeptide
DENEIRCTNPVATEQYGCVSWATETLGENLQ

SEQ ID NO: 111187 - protein, 33 aa, Artificial Sequence
  Description of Artificial Sequence: Synthetic polypeptide
DESEIYTTNPVATERWGSVSCINEPQDREGENG

SEQ ID NO: 111188 - protein, 32 aa, Artificial Sequence
  Description of Artificial Sequence: Synthetic polypeptide
DENEIRCTNPVATEQYGCVSWAFLTERQENNQ

SEQ ID NO: 111189 - protein, 36 aa, Artificial Sequence
  Description of Artificial Sequence: Synthetic polypeptide
AEEEIRTTNPVATEQYGSVSTVNGTNNNQQGTNQDE

SEQ ID NO: 111190 - protein, 36 aa, Artificial Sequence
  Description of Artificial Sequence: Synthetic polypeptide
AEEEIRTTNPVATEQYGSVSTVNGSNQQGNNQNNDD

SEQ ID NO: 111191 - protein, 32 aa, Artificial Sequence
  Description of Artificial Sequence: Synthetic polypeptide
DENEIRCTNPVATEQYGCVSADFLTRIQENEQ

SEQ ID NO: 111192 - protein, 33 aa, Artificial Sequence
  Description of Artificial Sequence: Synthetic polypeptide
DESELRTTNPVATECWGSVSCINEPQDREGENG

SEQ ID NO: 111193 - protein, 33 aa, Artificial Sequence
  Description of Artificial Sequence: Synthetic polypeptide
DESEMRTTNPVATECWGSVSCINEPQDREGENG

SEQ ID NO: 111194 - protein, 31 aa, Artificial Sequence
  Description of Artificial Sequence: Synthetic polypeptide
DENEIRCTNPVATEQYGAAANADWQRKGGYR

SEQ ID NO: 111195 - protein, 30 aa, Artificial Sequence
  Description of Artificial Sequence: Synthetic polypeptide
DENEIRCTNPVATEQWGSVSEILMNAAEDA

SEQ ID NO: 111196 - protein, 30 aa, Artificial Sequence
  Description of Artificial Sequence: Synthetic polypeptide
DENEIRSTNPVSTEGYGTISMETIQQQGNH

SEQ ID NO: 111197 - protein, 30 aa, Artificial Sequence
  Description of Artificial Sequence: Synthetic polypeptide
DENEIRCTNPVATEQWGEVSEILMNRAEGA

SEQ ID NO: 111198 - protein, 30 aa, Artificial Sequence
  Description of Artificial Sequence: Synthetic polypeptide
DENEIRCTNPVATEQWGDVSENEQNAAEGA

SEQ ID NO: 111199 - protein, 30 aa, Artificial Sequence
  Description of Artificial Sequence: Synthetic polypeptide
DENEIRCTNPVATEQWGDVSENEQNAAEDA

SEQ ID NO: 111200 - protein, 33 aa, Artificial Sequence
  Description of Artificial Sequence: Synthetic polypeptide
DESEMRTTNPVATECWGSVSCINEPQDREGQNG

SEQ ID NO: 111201 - protein, 29 aa, Artificial Sequence
  Description of Artificial Sequence: Synthetic peptide
DENEIRCTNPVATEQWGDVSENEMAAEDA

SEQ ID NO: 111202 - protein, 36 aa, Artificial Sequence
  Description of Artificial Sequence: Synthetic polypeptide
AEEEIRTTNPVATEQYGSVSTVNGNQQGEAEENEET

SEQ ID NO: 111203 - protein, 30 aa, Artificial Sequence
  Description of Artificial Sequence: Synthetic polypeptide
DENEIRCTNPVATEQWGDVSEILMNRAEGA

SEQ ID NO: 111204 - protein, 34 aa, Artificial Sequence
  Description of Artificial Sequence: Synthetic polypeptide
SEEEIRCTNPIATEAYGSVPSCENLSMRTGGNRD

SEQ ID NO: 111205 - protein, 30 aa, Artificial Sequence
  Description of Artificial Sequence: Synthetic polypeptide
DENEIRCTNPVATEQWGDVSEILMNRAEDA

SEQ ID NO: 111206 - protein, 33 aa, Artificial Sequence
  Description of Artificial Sequence: Synthetic polypeptide
NETEIATTNPVATEMWGSVSTNLNQGNDGNTDM

SEQ ID NO: 111207 - protein, 30 aa, Artificial Sequence
  Description of Artificial Sequence: Synthetic polypeptide
DENEIRCTNPVATEQWGDVSEIEMNRAGDA

SEQ ID NO: 111208 - protein, 33 aa, Artificial Sequence
  Description of Artificial Sequence: Synthetic polypeptide
DESENRTTNPVATECWGSVSCINEPQDREGENG

SEQ ID NO: 111209 - protein, 30 aa, Artificial Sequence
  Description of Artificial Sequence: Synthetic polypeptide
SEEEIRCTNPIATECYGATSNENLAEPGPR

SEQ ID NO: 111210 - protein, 35 aa, Artificial Sequence
  Description of Artificial Sequence: Synthetic polypeptide
AEEEIRTTNPVATEQYGSVSTVNGNQQNDENNNDE

SEQ ID NO: 111211 - protein, 33 aa, Artificial Sequence
  Description of Artificial Sequence: Synthetic polypeptide
DENEIRTTNPVATEPYGTVCSATEGPQQQNGND

SEQ ID NO: 111212 - protein, 29 aa, Artificial Sequence
  Description of Artificial Sequence: Synthetic peptide
DENEIRSTNPVSTEPYGTISMEDIQQGNI

SEQ ID NO: 111213 - protein, 37 aa, Artificial Sequence
  Description of Artificial Sequence: Synthetic polypeptide
AEEEIRTTNPVATEQYGSVSTVNLQLNQNQQGTNATD

SEQ ID NO: 111214 - protein, 34 aa, Artificial Sequence
  Description of Artificial Sequence: Synthetic polypeptide
NETEIRTTNPVATECYGNVSTNLNQGQMGGGGDR

SEQ ID NO: 111215 - protein, 31 aa, Artificial Sequence
  Description of Artificial Sequence: Synthetic polypeptide
AETEIACTNPVAYEQYGETASENLSQRGGGR

SEQ ID NO: 111216 - protein, 36 aa, Artificial Sequence
  Description of Artificial Sequence: Synthetic polypeptide
AEEEIRTTNPVATEQYGSVSTVNNLQIGSTDEEEME

SEQ ID NO: 111217 - protein, 33 aa, Artificial Sequence
  Description of Artificial Sequence: Synthetic polypeptide
DESEITTTNPVATECWGSVSCINEPQDREGENG

SEQ ID NO: 111218 - protein, 33 aa, Artificial Sequence
  Description of Artificial Sequence: Synthetic polypeptide
DESEITTTNPVATECWGSVSLINEPQDREGENG

SEQ ID NO: 111219 - protein, 33 aa, Artificial Sequence
  Description of Artificial Sequence: Synthetic polypeptide
DESEITTTNPVATEQYGVVVSATDGNEEGEGND

SEQ ID NO: 111220 - protein, 36 aa, Artificial Sequence
  Description of Artificial Sequence: Synthetic polypeptide
AEEEIRTTNPVATEQYGSVSTVNNLEQGENQATEEE

SEQ ID NO: 111221 - protein, 35 aa, Artificial Sequence
  Description of Artificial Sequence: Synthetic polypeptide
AEEEIRTTNPVATEQYGSVSTVNNGNQQNDTNNND

SEQ ID NO: 111222 - protein, 36 aa, Artificial Sequence
  Description of Artificial Sequence: Synthetic polypeptide
AEEEIRTTNPVATEQYGSVSTVNNENQGEQGTNNQN

SEQ ID NO: 111223 - protein, 36 aa, Artificial Sequence
  Description of Artificial Sequence: Synthetic polypeptide
AEEEIRTTNPVATEQYGSVSTVNNDQQGENEEQEEG

SEQ ID NO: 111224 - protein, 32 aa, Artificial Sequence
  Description of Artificial Sequence: Synthetic polypeptide
DESEIVSTNPVATEGYGNVSATDGIESREGNR

SEQ ID NO: 111225 - protein, 33 aa, Artificial Sequence
  Description of Artificial Sequence: Synthetic polypeptide
SEEEIRATNPVATESYGSVVDNTNLVREGDGGE

SEQ ID NO: 111226 - protein, 30 aa, Artificial Sequence
  Description of Artificial Sequence: Synthetic polypeptide
DESEIVSTNPVGTEGYGVVSSDTLVQHGNI

SEQ ID NO: 111227 - protein, 36 aa, Artificial Sequence
  Description of Artificial Sequence: Synthetic polypeptide
AEEEIRTTNPVATEQYGSVSTVNLQQQNNNSEQGTE

SEQ ID NO: 111228 - protein, 29 aa, Artificial Sequence
  Description of Artificial Sequence: Synthetic peptide
DENEIRTTNPVATECWGDVSECLMAAEEL

SEQ ID NO: 111229 - protein, 33 aa, Artificial Sequence
  Description of Artificial Sequence: Synthetic polypeptide
DESEIVTTNPVATECWGSVSCINEPQDREGENG

SEQ ID NO: 111230 - protein, 36 aa, Artificial Sequence
  Description of Artificial Sequence: Synthetic polypeptide
AEEEIRTTNPVATEQYGSVSTVNLQQQNNEGETDTE

SEQ ID NO: 111231 - protein, 33 aa, Artificial Sequence
  Description of Artificial Sequence: Synthetic polypeptide
DESEIVTTNPVATECWGSVSCINPPQDREGENG

SEQ ID NO: 111232 - protein, 33 aa, Artificial Sequence
  Description of Artificial Sequence: Synthetic polypeptide
DESEIVTTNPVATECWGSVSCINPVQDREGENG

SEQ ID NO: 111233 - protein, 33 aa, Artificial Sequence
  Description of Artificial Sequence: Synthetic polypeptide
DESEIVTTNPVATECYGSVSCINEPQDFEGENG

SEQ ID NO: 111234 - protein, 32 aa, Artificial Sequence
  Description of Artificial Sequence: Synthetic polypeptide
DENEIRTTNPVATECWGDVSCINEQDREGEDG

SEQ ID NO: 111235 - protein, 34 aa, Artificial Sequence
  Description of Artificial Sequence: Synthetic polypeptide
NETEICTTNPVATEHYGNVSTNLNQGNAGENNDR

SEQ ID NO: 111236 - protein, 33 aa, Artificial Sequence
  Description of Artificial Sequence: Synthetic polypeptide
DESEIVTTNPVATEGYGTVCSATDGPVQRVGND

SEQ ID NO: 111237 - protein, 33 aa, Artificial Sequence
  Description of Artificial Sequence: Synthetic polypeptide
DENEIRTTNPVATECWGDVSCINEPQDREGENG

SEQ ID NO: 111238 - protein, 32 aa, Artificial Sequence
  Description of Artificial Sequence: Synthetic polypeptide
NETEIATTNPVAYERWGNVSTNLQGNSGNTDR

SEQ ID NO: 111239 - protein, 30 aa, Artificial Sequence
  Description of Artificial Sequence: Synthetic polypeptide
DENEIRTTNPVATECWGDVSEIEMNAAGNA

SEQ ID NO: 111240 - protein, 34 aa, Artificial Sequence
  Description of Artificial Sequence: Synthetic polypeptide
DESEIVTTNPVATEQWGSVCSCDNPPQDREGEND

SEQ ID NO: 111241 - protein, 36 aa, Artificial Sequence
  Description of Artificial Sequence: Synthetic polypeptide
AEEEIRTTNPVATEQYGSVSTVNNNDQGTNGNVEEE

SEQ ID NO: 111242 - protein, 32 aa, Artificial Sequence
  Description of Artificial Sequence: Synthetic polypeptide
DENEIRTTNPVATECWGDVSEINEQDRAGEDG

SEQ ID NO: 111243 - protein, 33 aa, Artificial Sequence
  Description of Artificial Sequence: Synthetic polypeptide
DENEIRTTNPVATECWGSVSCINEPQDIEGENG

SEQ ID NO: 111244 - protein, 33 aa, Artificial Sequence
  Description of Artificial Sequence: Synthetic polypeptide
DESEISTTNPVATECWGSVSCINEPQMREGENG

SEQ ID NO: 111245 - protein, 33 aa, Artificial Sequence
  Description of Artificial Sequence: Synthetic polypeptide
DENEIRTTNPVATECWGSVSCINEPMDREGENG

SEQ ID NO: 111246 - protein, 37 aa, Artificial Sequence
  Description of Artificial Sequence: Synthetic polypeptide
AEEEIRTTNPVATEQYGSVSTVNNNLQQGENGTTEEE

SEQ ID NO: 111247 - protein, 37 aa, Artificial Sequence
  Description of Artificial Sequence: Synthetic polypeptide
AEEEIRTTNPVATEQYGSVSTVNNNLQQEEEGTNQTG

SEQ ID NO: 111248 - protein, 31 aa, Artificial Sequence
  Description of Artificial Sequence: Synthetic polypeptide
DENEIRTTNPVATECWGSVSCIIEQDAAENA

SEQ ID NO: 111249 - protein, 32 aa, Artificial Sequence
  Description of Artificial Sequence: Synthetic polypeptide
DENEIRTTNPVATECWGSVSCIIEPQNRAENA

SEQ ID NO: 111250 - protein, 37 aa, Artificial Sequence
  Description of Artificial Sequence: Synthetic polypeptide
AEEEIRTTNPVATEQYGSVSTVNNNLQGTEQGTNQTD

SEQ ID NO: 111251 - protein, 30 aa, Artificial Sequence
  Description of Artificial Sequence: Synthetic polypeptide
DENEIRTTNPVATECWGSVSCIEMNAAENG

SEQ ID NO: 111252 - protein, 30 aa, Artificial Sequence
  Description of Artificial Sequence: Synthetic polypeptide
DENEIRTTNPVATECWGSVSCIEMDAAENG

SEQ ID NO: 111253 - protein, 37 aa, Artificial Sequence
  Description of Artificial Sequence: Synthetic polypeptide
AEEEIRTTNPVATEQYGSVSTVNNNLQEQEQGTNNQS

SEQ ID NO: 111254 - protein, 37 aa, Artificial Sequence
  Description of Artificial Sequence: Synthetic polypeptide
AEEEIRTTNPVATEQYGSVSTVNNNLQEGTEGGNSAE

SEQ ID NO: 111255 - protein, 33 aa, Artificial Sequence
  Description of Artificial Sequence: Synthetic polypeptide
DENEIRTTNPVATECWGSVSCIDEQQQREGENG

SEQ ID NO: 111256 - protein, 37 aa, Artificial Sequence
  Description of Artificial Sequence: Synthetic polypeptide
AEEEIRTTNPVATEQYGSVSTVNNNLQEGTEGGNGTN

SEQ ID NO: 111257 - protein, 33 aa, Artificial Sequence
  Description of Artificial Sequence: Synthetic polypeptide
DENEIRTTNPVATECWGSVHCINEPQDREGENG

SEQ ID NO: 111258 - protein, 32 aa, Artificial Sequence
  Description of Artificial Sequence: Synthetic polypeptide
DENEIRTTNPVATECWGSISCEDEQQQREGNG

SEQ ID NO: 111259 - protein, 35 aa, Artificial Sequence
  Description of Artificial Sequence: Synthetic polypeptide
AEEEIRTTNPVATEQYGSVVVTTNQLGGNEQGNNN

SEQ ID NO: 111260 - protein, 37 aa, Artificial Sequence
  Description of Artificial Sequence: Synthetic polypeptide
AEEEIRTTNPVATEQYGSVSTVNNNLQAGTEGGNEAN

SEQ ID NO: 111261 - protein, 37 aa, Artificial Sequence
  Description of Artificial Sequence: Synthetic polypeptide
AEEEIRTTNPVATEQYGSVSTVNNNLQAGSEEGNDDE

SEQ ID NO: 111262 - protein, 36 aa, Artificial Sequence
  Description of Artificial Sequence: Synthetic polypeptide
AEEEIRTTNPVATEQYGSVSTVNNNLEQGNNGTGGD

SEQ ID NO: 111263 - protein, 35 aa, Artificial Sequence
  Description of Artificial Sequence: Synthetic polypeptide
AEEEIRTTNPVATEQYGSVSTVNNNEQGTNNNELE

SEQ ID NO: 111264 - protein, 29 aa, Artificial Sequence
  Description of Artificial Sequence: Synthetic peptide
AETEIATTNPIATECYGATAEENLARGGR

SEQ ID NO: 111265 - protein, 35 aa, Artificial Sequence
  Description of Artificial Sequence: Synthetic polypeptide
AEEEIRTTNPVATEQYGSVSTVNNNEQGTNANELQ

SEQ ID NO: 111266 - protein, 31 aa, Artificial Sequence
  Description of Artificial Sequence: Synthetic polypeptide
SEEEIRATNPAATEQYGSVVSEGGMGGNGND

SEQ ID NO: 111267 - protein, 32 aa, Artificial Sequence
  Description of Artificial Sequence: Synthetic polypeptide
DENEIRTTNPVATECWGDVSEINEQDREGEDG

SEQ ID NO: 111268 - protein, 31 aa, Artificial Sequence
  Description of Artificial Sequence: Synthetic polypeptide
SEEEIRATNPAATEQYGSVWENNMEMGNGDG

SEQ ID NO: 111269 - protein, 30 aa, Artificial Sequence
  Description of Artificial Sequence: Synthetic polypeptide
DENEIRTTNPVATECWGAVSECLQEHKEEL

SEQ ID NO: 111270 - protein, 34 aa, Artificial Sequence
  Description of Artificial Sequence: Synthetic polypeptide
DESEIVTTNPVATEQWGSVCSCINPPQDREGEND

SEQ ID NO: 111271 - protein, 37 aa, Artificial Sequence
  Description of Artificial Sequence: Synthetic polypeptide
CEEEVRTTNPVATEQYGSVSCAGNGLSQDRTVGPNRC

SEQ ID NO: 111272 - protein, 37 aa, Artificial Sequence
  Description of Artificial Sequence: Synthetic polypeptide
AEEEIRTTNPVATEQYGSVSTVNLQLQQGNSNNTNAT

SEQ ID NO: 111273 - protein, 32 aa, Artificial Sequence
  Description of Artificial Sequence: Synthetic polypeptide
NETEIATTNPVAYEEWGSVSTNLQGNMGNTDQ

SEQ ID NO: 111274 - protein, 33 aa, Artificial Sequence
  Description of Artificial Sequence: Synthetic polypeptide
DESEIVTTNPVATEQYGSVCSTDGPVEFEGEND

SEQ ID NO: 111275 - protein, 30 aa, Artificial Sequence
  Description of Artificial Sequence: Synthetic polypeptide
DENEIRTTNPIATEQWGDVSEILMNAAEDR

SEQ ID NO: 111276 - protein, 37 aa, Artificial Sequence
  Description of Artificial Sequence: Synthetic polypeptide
AEEEIRTTNPVATEQYGSVSTVNLQLQQGNNNANNAT

SEQ ID NO: 111277 - protein, 30 aa, Artificial Sequence
  Description of Artificial Sequence: Synthetic polypeptide
DENEIRTTNPIATECYGAVAAECLQHKGEL

SEQ ID NO: 111278 - protein, 32 aa, Artificial Sequence
  Description of Artificial Sequence: Synthetic polypeptide
NETEIATTNPVAYEEWGSVSTNLQGNDGMNTK

SEQ ID NO: 111279 - protein, 30 aa, Artificial Sequence
  Description of Artificial Sequence: Synthetic polypeptide
DENEIRTTNPIATECYGATVSNECLAPGEI

SEQ ID NO: 111280 - protein, 30 aa, Artificial Sequence
  Description of Artificial Sequence: Synthetic polypeptide
DENEIRTTNPIATECYGATVSNECLAHGEI

SEQ ID NO: 111281 - protein, 33 aa, Artificial Sequence
  Description of Artificial Sequence: Synthetic polypeptide
SEEEIRCTNPCATEQYGACWCCSPENLHRGNRD

SEQ ID NO: 111282 - protein, 30 aa, Artificial Sequence
  Description of Artificial Sequence: Synthetic polypeptide
DENEIRTTNPCSTEPYGIVSCDIQQQQGNH

SEQ ID NO: 111283 - protein, 32 aa, Artificial Sequence
  Description of Artificial Sequence: Synthetic polypeptide
SEEEIRCTNPCATEQYGCSCTSNEVLMRENQR

SEQ ID NO: 111284 - protein, 30 aa, Artificial Sequence
  Description of Artificial Sequence: Synthetic polypeptide
DENEIRTTNPCATEQYGDVSENEMNAAEDA

SEQ ID NO: 111285 - protein, 32 aa, Artificial Sequence
  Description of Artificial Sequence: Synthetic polypeptide
NETEIATTNPVAYECWGVVSTNLQGNEGNTDR

SEQ ID NO: 111286 - protein, 32 aa, Artificial Sequence
  Description of Artificial Sequence: Synthetic polypeptide
NETEIATTNPVAYEAWGNVSTNLQGNEGQNNR

SEQ ID NO: 111287 - protein, 31 aa, Artificial Sequence
  Description of Artificial Sequence: Synthetic polypeptide
SEEEIRCTNPCATEQYGCVCSWNLMSFGSDQ

SEQ ID NO: 111288 - protein, 30 aa, Artificial Sequence
  Description of Artificial Sequence: Synthetic polypeptide
DENEIRTTNPCATEQYGDVSCIEMNSAGDA

SEQ ID NO: 111289 - protein, 32 aa, Artificial Sequence
  Description of Artificial Sequence: Synthetic polypeptide
NETEIATTNPVATEYWGNVSTNLQGNSGENDS

SEQ ID NO: 111290 - protein, 30 aa, Artificial Sequence
  Description of Artificial Sequence: Synthetic polypeptide
DENEIRTTNPCATEQWGIVSENEQNAAEDA

SEQ ID NO: 111291 - protein, 32 aa, Artificial Sequence
  Description of Artificial Sequence: Synthetic polypeptide
SEEEIRCTNPCATEQYGCVCSWNLTYFGSNQS

SEQ ID NO: 111292 - protein, 30 aa, Artificial Sequence
  Description of Artificial Sequence: Synthetic polypeptide
DENEIRTTNPCATEQWGIVSENEMNAAGDA

SEQ ID NO: 111293 - protein, 31 aa, Artificial Sequence
  Description of Artificial Sequence: Synthetic polypeptide
DENEIRTTNPAATEQYGSVPGDLANGQGEEN

SEQ ID NO: 111294 - protein, 31 aa, Artificial Sequence
  Description of Artificial Sequence: Synthetic polypeptide
DENEIRTTNCVATEQWGDVSTEIAMNLAEGA

SEQ ID NO: 111295 - protein, 31 aa, Artificial Sequence
  Description of Artificial Sequence: Synthetic polypeptide
SEEEIRCTNPCATEQYGCVCSWNPAYFGSNQ

SEQ ID NO: 111296 - protein, 33 aa, Artificial Sequence
  Description of Artificial Sequence: Synthetic polypeptide
NETEIATTNPVATEPWGNVSTNLQGNAGENQDR

SEQ ID NO: 111297 - protein, 31 aa, Artificial Sequence
  Description of Artificial Sequence: Synthetic polypeptide
DENEIRTTNPISTEPYGSISMEDLQQQNGNH

SEQ ID NO: 111298 - protein, 34 aa, Artificial Sequence
  Description of Artificial Sequence: Synthetic polypeptide
DENEIRTTNPVAFEQYGSVIITNGLEGGNGNVGI

SEQ ID NO: 111299 - protein, 33 aa, Artificial Sequence
  Description of Artificial Sequence: Synthetic polypeptide
DENEIRTTNPVASEIYGSVSTEDQVQLNNGDNT

SEQ ID NO: 111300 - protein, 32 aa, Artificial Sequence
  Description of Artificial Sequence: Synthetic polypeptide
SEEEIRCTNPAATEQYGSVVSENGMGGGENEG

SEQ ID NO: 111301 - protein, 33 aa, Artificial Sequence
  Description of Artificial Sequence: Synthetic polypeptide
DESEIVTTNPVATEQWGSVSCIGPVQDREGENG

SEQ ID NO: 111302 - protein, 34 aa, Artificial Sequence
  Description of Artificial Sequence: Synthetic polypeptide
CEENIATTNPVATEQYGSVSWNEGQDRQRGTGNH

SEQ ID NO: 111303 - protein, 33 aa, Artificial Sequence
  Description of Artificial Sequence: Synthetic polypeptide
DESEIVTTNPVATEQWGSVSCINEVQDFEGENG

SEQ ID NO: 111304 - protein, 34 aa, Artificial Sequence
  Description of Artificial Sequence: Synthetic polypeptide
CEEPIRTTNPLATEPYGISVVPPTNALSQRGGND

SEQ ID NO: 111305 - protein, 33 aa, Artificial Sequence
  Description of Artificial Sequence: Synthetic polypeptide
DESEIVTTNPVATEQWGSVSCINPPQDFEGENG

SEQ ID NO: 111306 - protein, 31 aa, Artificial Sequence
  Description of Artificial Sequence: Synthetic polypeptide
NETEIATTNPVAYEQWGSVSHGDQDGRGNDG

SEQ ID NO: 111307 - protein, 37 aa, Artificial Sequence
  Description of Artificial Sequence: Synthetic polypeptide
AEEEIRTTNPVATEQYGSVSTVNLQLQQGTTNTNEDT

SEQ ID NO: 111308 - protein, 33 aa, Artificial Sequence
  Description of Artificial Sequence: Synthetic polypeptide
NETEIATTNPVAYEQWGCVSTPNLQGNDMGNTR

SEQ ID NO: 111309 - protein, 31 aa, Artificial Sequence
  Description of Artificial Sequence: Synthetic polypeptide
NETEIATTNPVAYEKWGVVSTNLQGNDGNTD

SEQ ID NO: 111310 - protein, 33 aa, Artificial Sequence
  Description of Artificial Sequence: Synthetic polypeptide
DENEIRTTNPVATEAWGSVSVVNNQQGDEGENG

SEQ ID NO: 111311 - protein, 37 aa, Artificial Sequence
  Description of Artificial Sequence: Synthetic polypeptide
AEEEIRTTNPVATEQYGSVSTVNLQLQQGTTNNNNAT

SEQ ID NO: 111312 - protein, 37 aa, Artificial Sequence
  Description of Artificial Sequence: Synthetic polypeptide
AEEEIRTTNPVATEQYGSVSTVNLQLQQGQTNNNTET

SEQ ID NO: 111313 - protein, 32 aa, Artificial Sequence
  Description of Artificial Sequence: Synthetic polypeptide
SEEEIRCTNPCATEQYGCVTSNEVPLMRENQR

SEQ ID NO: 111314 - protein, 33 aa, Artificial Sequence
  Description of Artificial Sequence: Synthetic polypeptide
DENEIRTTNPVATEAWGSVSVVNNNQQDEGTNG

SEQ ID NO: 111315 - protein, 34 aa, Artificial Sequence
  Description of Artificial Sequence: Synthetic polypeptide
DENEIRTTNPVATEAWGSVSTVVNNNQDNEGENG

SEQ ID NO: 111316 - protein, 34 aa, Artificial Sequence
  Description of Artificial Sequence: Synthetic polypeptide
DENEIRTTNPVATEAWGSVSTVNNNNQGDEGENG

SEQ ID NO: 111317 - protein, 32 aa, Artificial Sequence
  Description of Artificial Sequence: Synthetic polypeptide
DENEIRTTNPVATDQYGSVNTYAEHPRQAQND

SEQ ID NO: 111318 - protein, 33 aa, Artificial Sequence
  Description of Artificial Sequence: Synthetic polypeptide
DENEIRTTNPVATDQYGSVNTVIEHPRQGQNAD

SEQ ID NO: 111319 - protein, 37 aa, Artificial Sequence
  Description of Artificial Sequence: Synthetic polypeptide
AEEEIRTTNPVATEQYGSVSTVNLQLQQGQTNNEEAT

SEQ ID NO: 111320 - protein, 31 aa, Artificial Sequence
  Description of Artificial Sequence: Synthetic polypeptide
NETEIATTNPVAYEHWGNVSTNLQGNDGNTS

SEQ ID NO: 111321 - protein, 31 aa, Artificial Sequence
  Description of Artificial Sequence: Synthetic polypeptide
NETEIATTNPVAYEGWGSVSTNLQGNDGDTD

SEQ ID NO: 111322 - protein, 32 aa, Artificial Sequence
  Description of Artificial Sequence: Synthetic polypeptide
SEEEIRCTNPAATEQYGSVVSENGMEGGENGD

SEQ ID NO: 111323 - protein, 32 aa, Artificial Sequence
  Description of Artificial Sequence: Synthetic polypeptide
DENEIRTTNPVATDQYGSVNTGLEHPRQLQMD

SEQ ID NO: 111324 - protein, 33 aa, Artificial Sequence
  Description of Artificial Sequence: Synthetic polypeptide
DENEIRTTNPVATDQYGSVNTGLEHPRQAENVD

SEQ ID NO: 111325 - protein, 31 aa, Artificial Sequence
  Description of Artificial Sequence: Synthetic polypeptide
SEEEIRCTNPAATEQYGSVVSENGMEGGGGG

SEQ ID NO: 111326 - protein, 33 aa, Artificial Sequence
  Description of Artificial Sequence: Synthetic polypeptide
DESEIVTTNPVATEQYGSVCSTDGPPEFEGEND

SEQ ID NO: 111327 - protein, 33 aa, Artificial Sequence
  Description of Artificial Sequence: Synthetic polypeptide
DENEIRTTNPVATEAWGSVSVVNNNLDDEGENG

SEQ ID NO: 111328 - protein, 28 aa, Artificial Sequence
  Description of Artificial Sequence: Synthetic peptide
QENEIATTNPVATECYGDVSYCGQHEEL

SEQ ID NO: 111329 - protein, 34 aa, Artificial Sequence
  Description of Artificial Sequence: Synthetic polypeptide
DENEIRTTNPVATEQYGSVSETEDATEQPDGIQN

SEQ ID NO: 111330 - protein, 36 aa, Artificial Sequence
  Description of Artificial Sequence: Synthetic polypeptide
DENEIRTTNPVATEQYGSVSITENANQPEEGQQENE

SEQ ID NO: 111331 - protein, 28 aa, Artificial Sequence
  Description of Artificial Sequence: Synthetic peptide
QEEEIASVNPVATEQYGEVPDVLQSEEQ

SEQ ID NO: 111332 - protein, 28 aa, Artificial Sequence
  Description of Artificial Sequence: Synthetic peptide
QEEEIASVNPVATEQYGEVPDVLQSEEK

SEQ ID NO: 111333 - protein, 32 aa, Artificial Sequence
  Description of Artificial Sequence: Synthetic polypeptide
DEQEIATTNPVATEAYGSVSATDLEDHEGSDL

SEQ ID NO: 111334 - protein, 32 aa, Artificial Sequence
  Description of Artificial Sequence: Synthetic polypeptide
DEQEIATTNPVATEAYGSVSATDLEDHEGEDL

SEQ ID NO: 111335 - protein, 35 aa, Artificial Sequence
  Description of Artificial Sequence: Synthetic polypeptide
DEQEIATTNPVATEAYGISTVQSCTDALSQRAGNK

SEQ ID NO: 111336 - protein, 32 aa, Artificial Sequence
  Description of Artificial Sequence: Synthetic polypeptide
DEQEIATTNPVATDQYGSVSATDLEDHEGESL

SEQ ID NO: 111337 - protein, 35 aa, Artificial Sequence
  Description of Artificial Sequence: Synthetic polypeptide
AEEEIRTTNPVATEQYGSVSTVVNNQNQDEGDEDT

SEQ ID NO: 111338 - protein, 32 aa, Artificial Sequence
  Description of Artificial Sequence: Synthetic polypeptide
DEQEIATTNPVATDQYGSVSATDLEDHEGEDL

SEQ ID NO: 111339 - protein, 32 aa, Artificial Sequence
  Description of Artificial Sequence: Synthetic polypeptide
DEQEIATTNPVATCQYGSVSATDLEDHMGEDL

SEQ ID NO: 111340 - protein, 32 aa, Artificial Sequence
  Description of Artificial Sequence: Synthetic polypeptide
DEQEIATTNPVATCQYGSVSATDLEDHEGEDL

SEQ ID NO: 111341 - protein, 32 aa, Artificial Sequence
  Description of Artificial Sequence: Synthetic polypeptide
DEQEIATTNPVATCQYGSVSATDLEDHEGEDD

SEQ ID NO: 111342 - protein, 32 aa, Artificial Sequence
  Description of Artificial Sequence: Synthetic polypeptide
QENEIATTNPVATEQYGSVSSTTPAGQHNENL

SEQ ID NO: 111343 - protein, 30 aa, Artificial Sequence
  Description of Artificial Sequence: Synthetic polypeptide
CEDEIACTNPVATEQYGCVATNLQMHPEGF

SEQ ID NO: 111344 - protein, 36 aa, Artificial Sequence
  Description of Artificial Sequence: Synthetic polypeptide
AEEEIRTTNPVATEQYGSVSTVVNNQLQVETENSEE

SEQ ID NO: 111345 - protein, 32 aa, Artificial Sequence
  Description of Artificial Sequence: Synthetic polypeptide
DESEIRTTNPVATEQWGSVSENEPMDAEEENA

SEQ ID NO: 111346 - protein, 32 aa, Artificial Sequence
  Description of Artificial Sequence: Synthetic polypeptide
DEQEIATTNPVATAQYGSVSATDLEDHMGEDL

SEQ ID NO: 111347 - protein, 32 aa, Artificial Sequence
  Description of Artificial Sequence: Synthetic polypeptide
DEQEIATTNPVATAQYGSVSATDLEDHEGEDL

SEQ ID NO: 111348 - protein, 31 aa, Artificial Sequence
  Description of Artificial Sequence: Synthetic polypeptide
QENEIATTNPVATEQYGSVSTEALNHNEMEV

SEQ ID NO: 111349 - protein, 33 aa, Artificial Sequence
  Description of Artificial Sequence: Synthetic polypeptide
AEEEIRTTNPVATEQYGSVVTVTNQNSEAGEIF

SEQ ID NO: 111350 - protein, 30 aa, Artificial Sequence
  Description of Artificial Sequence: Synthetic polypeptide
DEQEIATTNPVATAQWGCVATALTADGNDM

SEQ ID NO: 111351 - protein, 32 aa, Artificial Sequence
  Description of Artificial Sequence: Synthetic polypeptide
DEQEIATTNPVASEQYGSVSWTDLEDHEGEDL

SEQ ID NO: 111352 - protein, 32 aa, Artificial Sequence
  Description of Artificial Sequence: Synthetic polypeptide
QENEIATTNPVATEQYGSVSTEALPNHNEMEV

SEQ ID NO: 111353 - protein, 35 aa, Artificial Sequence
  Description of Artificial Sequence: Synthetic polypeptide
AEEEIRTTNPVATEQYGSVSTVVNNNNQQDENSGV

SEQ ID NO: 111354 - protein, 29 aa, Artificial Sequence
  Description of Artificial Sequence: Synthetic peptide
QENEIATTNPVATERYGDVSECCLQHEEL

SEQ ID NO: 111355 - protein, 33 aa, Artificial Sequence
  Description of Artificial Sequence: Synthetic polypeptide
DEQEIATTNPVASEQYGSVSATDLWEDHEGEQR

SEQ ID NO: 111356 - protein, 30 aa, Artificial Sequence
  Description of Artificial Sequence: Synthetic polypeptide
QENEIATTNPVATEQYGSVSEALNHNEMEV

SEQ ID NO: 111357 - protein, 32 aa, Artificial Sequence
  Description of Artificial Sequence: Synthetic polypeptide
DEQEIATTNPVASEQYGSVSATDLEDSEGEDL

SEQ ID NO: 111358 - protein, 34 aa, Artificial Sequence
  Description of Artificial Sequence: Synthetic polypeptide
DEQEIATTNPVATECYGCVYCTNLDQHDDNRGNV

SEQ ID NO: 111359 - protein, 31 aa, Artificial Sequence
  Description of Artificial Sequence: Synthetic polypeptide
DEQEIATTNPVATECYGDVSATCLQDHEEEL

SEQ ID NO: 111360 - protein, 32 aa, Artificial Sequence
  Description of Artificial Sequence: Synthetic polypeptide
DEQEIATTNPVATEFYGSVSATDLEDHEGEDL

SEQ ID NO: 111361 - protein, 32 aa, Artificial Sequence
  Description of Artificial Sequence: Synthetic polypeptide
DEQEIATTNPVATEEYGSVSATDLEDHEGEDL

SEQ ID NO: 111362 - protein, 32 aa, Artificial Sequence
  Description of Artificial Sequence: Synthetic polypeptide
DEQEIATTNPVATEDYGSVSATDLEDYEGEDL

SEQ ID NO: 111363 - protein, 32 aa, Artificial Sequence
  Description of Artificial Sequence: Synthetic polypeptide
DEQEIATTNPVATEDYGSVSATDLEDHEGEDL

SEQ ID NO: 111364 - protein, 28 aa, Artificial Sequence
  Description of Artificial Sequence: Synthetic peptide
QENEIATTNPVATEQYGEASEVCQHEEK

SEQ ID NO: 111365 - protein, 28 aa, Artificial Sequence
  Description of Artificial Sequence: Synthetic peptide
QENEIATTNPVATEQYGEASEVCQHEEL

SEQ ID NO: 111366 - protein, 28 aa, Artificial Sequence
  Description of Artificial Sequence: Synthetic peptide
QENEIATTNPVATEQYGEASEVEQHEEK

SEQ ID NO: 111367 - protein, 32 aa, Artificial Sequence
  Description of Artificial Sequence: Synthetic polypeptide
DEQEIATTNPVATECYGSVSNTDLEDHEGEYL

SEQ ID NO: 111368 - protein, 28 aa, Artificial Sequence
  Description of Artificial Sequence: Synthetic peptide
QEEEIASVNPVCTECYGVVSECLQSENQ

SEQ ID NO: 111369 - protein, 32 aa, Artificial Sequence
  Description of Artificial Sequence: Synthetic polypeptide
DEQEIATTNPVATECYGSVSNTDLEDHEGEDL

SEQ ID NO: 111370 - protein, 28 aa, Artificial Sequence
  Description of Artificial Sequence: Synthetic peptide
QENEIATTNPVATEQYGEASMVCQHEEK

SEQ ID NO: 111371 - protein, 30 aa, Artificial Sequence
  Description of Artificial Sequence: Synthetic polypeptide
QENEIATTNPVATEQYGEISMDCQQQNGNH

SEQ ID NO: 111372 - protein, 28 aa, Artificial Sequence
  Description of Artificial Sequence: Synthetic peptide
QENEIATTNPVATEQYGEVPECCQHEEK

SEQ ID NO: 111373 - protein, 28 aa, Artificial Sequence
  Description of Artificial Sequence: Synthetic peptide
QENEIATTNPVATEQYGEVPEVCQHEEK

SEQ ID NO: 111374 - protein, 33 aa, Artificial Sequence
  Description of Artificial Sequence: Synthetic polypeptide
DEQEIATTNPVATECYGSVSATIDLQDHEGEDL

SEQ ID NO: 111375 - protein, 36 aa, Artificial Sequence
  Description of Artificial Sequence: Synthetic polypeptide
AEEEIRTTNPVATEQYGSVSTVVNNQQQDEGNTENG

SEQ ID NO: 111376 - protein, 37 aa, Artificial Sequence
  Description of Artificial Sequence: Synthetic polypeptide
AEEEIRTTNPVATEQYGSVSTVVNNQQLNQDEAGNED

SEQ ID NO: 111377 - protein, 31 aa, Artificial Sequence
  Description of Artificial Sequence: Synthetic polypeptide
QENEIATTNPVATEQYGSVSAECLQDHEEEL

SEQ ID NO: 111378 - protein, 32 aa, Artificial Sequence
  Description of Artificial Sequence: Synthetic polypeptide
DEQEIATTNPVATECYGSVSATDLEDMEGEDL

SEQ ID NO: 111379 - protein, 32 aa, Artificial Sequence
  Description of Artificial Sequence: Synthetic polypeptide
DEQEIATTNPVATECYGSVSATDLEDHEGEYL

SEQ ID NO: 111380 - protein, 32 aa, Artificial Sequence
  Description of Artificial Sequence: Synthetic polypeptide
DEQEIATTNPVATECYGSVSATDLEDHEGEDL

SEQ ID NO: 111381 - protein, 31 aa, Artificial Sequence
  Description of Artificial Sequence: Synthetic polypeptide
DEQEIATTNPVATECYGSVSAEDLEDHGEDL

SEQ ID NO: 111382 - protein, 30 aa, Artificial Sequence
  Description of Artificial Sequence: Synthetic polypeptide
DEQEIATTNPVATECYGSVSAEDLEDHEEL

SEQ ID NO: 111383 - protein, 30 aa, Artificial Sequence
  Description of Artificial Sequence: Synthetic polypeptide
DEQEIATTNPVATECYGSVSAECLEDHEEL

SEQ ID NO: 111384 - protein, 28 aa, Artificial Sequence
  Description of Artificial Sequence: Synthetic peptide
QEEEIASVNPVATEQYGEVPEVLQSEEK

SEQ ID NO: 111385 - protein, 31 aa, Artificial Sequence
  Description of Artificial Sequence: Synthetic polypeptide
DEQEIATTNPVATECYGDVSAEDLQDHGEDL

SEQ ID NO: 111386 - protein, 32 aa, Artificial Sequence
  Description of Artificial Sequence: Synthetic polypeptide
DEQEIATTNPVATEFYGSVSATDLEDHEGWDL

SEQ ID NO: 111387 - protein, 28 aa, Artificial Sequence
  Description of Artificial Sequence: Synthetic peptide
QEEEIASTNPVSTEQYGNVPNVIQREQK

SEQ ID NO: 111388 - protein, 28 aa, Artificial Sequence
  Description of Artificial Sequence: Synthetic peptide
QEEEIASTNPVSTEQYGNVPEVIQREQK

SEQ ID NO: 111389 - protein, 32 aa, Artificial Sequence
  Description of Artificial Sequence: Synthetic polypeptide
DEQEIATTNPVADEQYGSVSATDLEDHEGEDL

SEQ ID NO: 111390 - protein, 32 aa, Artificial Sequence
  Description of Artificial Sequence: Synthetic polypeptide
DEQEIATTNPVACEQYGSVSATDLEDHEGEDL

SEQ ID NO: 111391 - protein, 32 aa, Artificial Sequence
  Description of Artificial Sequence: Synthetic polypeptide
DEQEIATTNPVAAEQYGSVSCTDLEDHEGEDL

SEQ ID NO: 111392 - protein, 32 aa, Artificial Sequence
  Description of Artificial Sequence: Synthetic polypeptide
DEQEIATTNPTATEQYGSVSATDLEDHLGEDL

SEQ ID NO: 111393 - protein, 32 aa, Artificial Sequence
  Description of Artificial Sequence: Synthetic polypeptide
DEQEIATTNPTATEQYGSVSATDLEDHEGEDL

SEQ ID NO: 111394 - protein, 32 aa, Artificial Sequence
  Description of Artificial Sequence: Synthetic polypeptide
DEQEIATTNPSATEQYGSVSATDLEDHEGEDV

SEQ ID NO: 111395 - protein, 32 aa, Artificial Sequence
  Description of Artificial Sequence: Synthetic polypeptide
DEQEIATTNPSATEQYGSVSATDLEDHEGEDQ

SEQ ID NO: 111396 - protein, 32 aa, Artificial Sequence
  Description of Artificial Sequence: Synthetic polypeptide
DEQEIATTNPSATEQYGSVSATDLEDHEGEDL

SEQ ID NO: 111397 - protein, 32 aa, Artificial Sequence
  Description of Artificial Sequence: Synthetic polypeptide
DEQEIATTNPQATEQYGSVSATDLEDHEGEDL

SEQ ID NO: 111398 - protein, 32 aa, Artificial Sequence
  Description of Artificial Sequence: Synthetic polypeptide
DEQEIATTNPNATEQYGSVSATDLEDHEGRDL

SEQ ID NO: 111399 - protein, 32 aa, Artificial Sequence
  Description of Artificial Sequence: Synthetic polypeptide
DEQEIATTNPNATEQYGSVSATDLEDHEGEDL

SEQ ID NO: 111400 - protein, 35 aa, Artificial Sequence
  Description of Artificial Sequence: Synthetic polypeptide
DESEIRTTNPVATEQWGSVSSCINEPQDREGENPV

SEQ ID NO: 111401 - protein, 32 aa, Artificial Sequence
  Description of Artificial Sequence: Synthetic polypeptide
DEQEIATTNPMATEQYGSVSQTDLEDHEGEDL

SEQ ID NO: 111402 - protein, 32 aa, Artificial Sequence
  Description of Artificial Sequence: Synthetic polypeptide
DEQEIATTNPMATEQYGSVSATDLEDKEGEDL

SEQ ID NO: 111403 - protein, 29 aa, Artificial Sequence
  Description of Artificial Sequence: Synthetic peptide
QENEIATTNPVATESYGEVSEALQHEEGL

SEQ ID NO: 111404 - protein, 32 aa, Artificial Sequence
  Description of Artificial Sequence: Synthetic polypeptide
DEQEIATTNPMATEQYGSVSATDLEDHEGEDL

SEQ ID NO: 111405 - protein, 35 aa, Artificial Sequence
  Description of Artificial Sequence: Synthetic polypeptide
DESEIRTTNPVATEQWGSVSSCINEPQDREGMNPV

SEQ ID NO: 111406 - protein, 34 aa, Artificial Sequence
  Description of Artificial Sequence: Synthetic polypeptide
CEEEIRQTNPVAYEQYGQSVSQYNDLEQPGIERS

SEQ ID NO: 111407 - protein, 29 aa, Artificial Sequence
  Description of Artificial Sequence: Synthetic peptide
QENEIATTNPVATESYGTVSEALQHKEEL

SEQ ID NO: 111408 - protein, 32 aa, Artificial Sequence
  Description of Artificial Sequence: Synthetic polypeptide
DEQEIATTNPLATEQYGSVSATDLEDHEGEDL

SEQ ID NO: 111409 - protein, 32 aa, Artificial Sequence
  Description of Artificial Sequence: Synthetic polypeptide
DEQEIATTNPLATEQYGSVSATDLEDAEGEDL

SEQ ID NO: 111410 - protein, 28 aa, Artificial Sequence
  Description of Artificial Sequence: Synthetic peptide
QEEEIASTNPVGTEQYGEAASTCQHGDK

SEQ ID NO: 111411 - protein, 35 aa, Artificial Sequence
  Description of Artificial Sequence: Synthetic polypeptide
DESEIRTTNPVATEQWGSVSSTCPAEPQMREGENG

SEQ ID NO: 111412 - protein, 32 aa, Artificial Sequence
  Description of Artificial Sequence: Synthetic polypeptide
DEQEIATTNPIATEQYGSVSATDLEEHEGEYL

SEQ ID NO: 111413 - protein, 35 aa, Artificial Sequence
  Description of Artificial Sequence: Synthetic polypeptide
DESEIRTTNPVATEQWGSVSSTCPAGPQMREGENG

SEQ ID NO: 111414 - protein, 32 aa, Artificial Sequence
  Description of Artificial Sequence: Synthetic polypeptide
DEQEIATTNPVADEQYGSVSATDLEDHWGEDL

SEQ ID NO: 111415 - protein, 32 aa, Artificial Sequence
  Description of Artificial Sequence: Synthetic polypeptide
DEQEIATTNPVASEQYGSVSATDLEDHEGEDL

SEQ ID NO: 111416 - protein, 32 aa, Artificial Sequence
  Description of Artificial Sequence: Synthetic polypeptide
DEQEIATTNPVAFEQYGSVSATDLEDHEGEDL

SEQ ID NO: 111417 - protein, 32 aa, Artificial Sequence
  Description of Artificial Sequence: Synthetic polypeptide
DEQEIATTNPVAFEQYGSVSATDLEDHGGEDL

SEQ ID NO: 111418 - protein, 28 aa, Artificial Sequence
  Description of Artificial Sequence: Synthetic peptide
QENEIATTNPVATERYGDVYECLQHEEL

SEQ ID NO: 111419 - protein, 28 aa, Artificial Sequence
  Description of Artificial Sequence: Synthetic peptide
QENEIATTNPVATESYGCVAEALQHEEL

SEQ ID NO: 111420 - protein, 32 aa, Artificial Sequence
  Description of Artificial Sequence: Synthetic polypeptide
DEQEIATTNPVASEQYGSVSATDLEDHAGEDL

SEQ ID NO: 111421 - protein, 30 aa, Artificial Sequence
  Description of Artificial Sequence: Synthetic polypeptide
QENEIATTNPVATESYGCVSEALQHEEEGN

SEQ ID NO: 111422 - protein, 31 aa, Artificial Sequence
  Description of Artificial Sequence: Synthetic polypeptide
DEQEIATTNPVASEQYGIVSATDLEDSGTDL

SEQ ID NO: 111423 - protein, 32 aa, Artificial Sequence
  Description of Artificial Sequence: Synthetic polypeptide
DEQEIATTNPVANEQYGSVSATDLEDHEGEDL

SEQ ID NO: 111424 - protein, 32 aa, Artificial Sequence
  Description of Artificial Sequence: Synthetic polypeptide
DEQEIATTNPVAMEQYGSVSATDLEDHEGEDL

SEQ ID NO: 111425 - protein, 32 aa, Artificial Sequence
  Description of Artificial Sequence: Synthetic polypeptide
DEQEIATTNPVALEQYGSVSFTDLEDHEGEDL

SEQ ID NO: 111426 - protein, 29 aa, Artificial Sequence
  Description of Artificial Sequence: Synthetic peptide
QENEIATTNPVATESYGCVSEALQHEEFH

SEQ ID NO: 111427 - protein, 32 aa, Artificial Sequence
  Description of Artificial Sequence: Synthetic polypeptide
DEQEIATTNPVALEQYGSVSATDLKDHEGEDL

SEQ ID NO: 111428 - protein, 29 aa, Artificial Sequence
  Description of Artificial Sequence: Synthetic peptide
QENEIATTNPVATESYGCVSEALQHEEGL

SEQ ID NO: 111429 - protein, 30 aa, Artificial Sequence
  Description of Artificial Sequence: Synthetic polypeptide
QENEIATTNPVATESYGCVSEALQHQNELN

SEQ ID NO: 111430 - protein, 32 aa, Artificial Sequence
  Description of Artificial Sequence: Synthetic polypeptide
DEQEIATTNPVALEQYGSVSATDLEDHMGEDL

SEQ ID NO: 111431 - protein, 32 aa, Artificial Sequence
  Description of Artificial Sequence: Synthetic polypeptide
DEQEIATTNPVALEQYGSVSATDLEDHEGEDL

SEQ ID NO: 111432 - protein, 32 aa, Artificial Sequence
  Description of Artificial Sequence: Synthetic polypeptide
DEQEIATTNPVAIEQYGSVSATDLWDHEGEDS

SEQ ID NO: 111433 - protein, 32 aa, Artificial Sequence
  Description of Artificial Sequence: Synthetic polypeptide
DEQEIATTNPVAIEQYGSVSATDLEDHEGEDL

SEQ ID NO: 111434 - protein, 32 aa, Artificial Sequence
  Description of Artificial Sequence: Synthetic polypeptide
DEQEIATTNPVAHEQYGSVSATILEDHEGEDL

SEQ ID NO: 111435 - protein, 30 aa, Artificial Sequence
  Description of Artificial Sequence: Synthetic polypeptide
QENEIATTNPVATESYGCVSEANLQHQEEL

SEQ ID NO: 111436 - protein, 30 aa, Artificial Sequence
  Description of Artificial Sequence: Synthetic polypeptide
QENEIATTNPVATESYGCVSGEALQNHNEM

SEQ ID NO: 111437 - protein, 32 aa, Artificial Sequence
  Description of Artificial Sequence: Synthetic polypeptide
DEQEIATTNPVAHEQYGSVSATDLEDHEGEDL

SEQ ID NO: 111438 - protein, 32 aa, Artificial Sequence
  Description of Artificial Sequence: Synthetic polypeptide
DEQEIATTNPVAGEQYGSVSATWLEDHEGEDL

SEQ ID NO: 111439 - protein, 32 aa, Artificial Sequence
  Description of Artificial Sequence: Synthetic polypeptide
DEQEIATTNPVAGEQYGSVSATDLEDHHGEDL

SEQ ID NO: 111440 - protein, 32 aa, Artificial Sequence
  Description of Artificial Sequence: Synthetic polypeptide
DEQEIATTNPVAGEQYGSVSATDLEDHEGEDL

SEQ ID NO: 111441 - protein, 32 aa, Artificial Sequence
  Description of Artificial Sequence: Synthetic polypeptide
DEQEIATTNPVAFEQYGSVSATMLEDHEGEDL

SEQ ID NO: 111442 - protein, 32 aa, Artificial Sequence
  Description of Artificial Sequence: Synthetic polypeptide
DEQEIATTNPVAFEQYGSVSATDLEDHSGEDL

SEQ ID NO: 111443 - protein, 32 aa, Artificial Sequence
  Description of Artificial Sequence: Synthetic polypeptide
DEQEIATTNPVAFEQYGSVSATDLEDHEGMDL

SEQ ID NO: 111444 - protein, 31 aa, Artificial Sequence
  Description of Artificial Sequence: Synthetic polypeptide
DEQEIATTNPVATEGYGNVSATDLEDHVGEL

SEQ ID NO: 111445 - protein, 31 aa, Artificial Sequence
  Description of Artificial Sequence: Synthetic polypeptide
DEQEIATTNPVATEGYGSMAATDLQDHGDDI

SEQ ID NO: 111446 - protein, 35 aa, Artificial Sequence
  Description of Artificial Sequence: Synthetic polypeptide
AEEEIRTTNPVATEQYGSVSTVVNQELQNDEQIGT

SEQ ID NO: 111447 - protein, 32 aa, Artificial Sequence
  Description of Artificial Sequence: Synthetic polypeptide
DESEIRTTNPVATEQWGSVSACDEEDHEGENG

SEQ ID NO: 111448 - protein, 36 aa, Artificial Sequence
  Description of Artificial Sequence: Synthetic polypeptide
AEEEIRTTNPVATEQYGSVVTVTNNQGNLQQGTNIN

SEQ ID NO: 111449 - protein, 34 aa, Artificial Sequence
  Description of Artificial Sequence: Synthetic polypeptide
DEQEIATTNPVATEQWGSVSTPNPQDDHGGNQPE

SEQ ID NO: 111450 - protein, 30 aa, Artificial Sequence
  Description of Artificial Sequence: Synthetic polypeptide
DEQEIATTNPVATEQWGSVSTIEMDAEEDA

SEQ ID NO: 111451 - protein, 31 aa, Artificial Sequence
  Description of Artificial Sequence: Synthetic polypeptide
QENEIATTNPVATEQYGDVSAEDCLVQFGED

SEQ ID NO: 111452 - protein, 31 aa, Artificial Sequence
  Description of Artificial Sequence: Synthetic polypeptide
QENEIATTNPVATEQYGDVSAEDCLVQHGED

SEQ ID NO: 111453 - protein, 35 aa, Artificial Sequence
  Description of Artificial Sequence: Synthetic polypeptide
AEEEIRTTNPVATEQYGSVSTVVNQLQQDEQTIAE

SEQ ID NO: 111454 - protein, 36 aa, Artificial Sequence
  Description of Artificial Sequence: Synthetic polypeptide
AEEEIRTTNPVATEQYGSVSTVVNQLNQNNIGTTEM

SEQ ID NO: 111455 - protein, 29 aa, Artificial Sequence
  Description of Artificial Sequence: Synthetic peptide
QENEIATTNPVATEQYGDVSECEQHAEEA

SEQ ID NO: 111456 - protein, 29 aa, Artificial Sequence
  Description of Artificial Sequence: Synthetic peptide
QENEIATTNPVATEQYGDVSECEQNHEDL

SEQ ID NO: 111457 - protein, 30 aa, Artificial Sequence
  Description of Artificial Sequence: Synthetic polypeptide
DEQEIATTNPVATEQWGSVSTIEMDAAEDA

SEQ ID NO: 111458 - protein, 33 aa, Artificial Sequence
  Description of Artificial Sequence: Synthetic polypeptide
DESEIRTTNPVATEQWGSVSCIDEPQDREGEEG

SEQ ID NO: 111459 - protein, 30 aa, Artificial Sequence
  Description of Artificial Sequence: Synthetic polypeptide
QENEIATTNPVATEQYGDVSECLQDHEEEL

SEQ ID NO: 111460 - protein, 33 aa, Artificial Sequence
  Description of Artificial Sequence: Synthetic polypeptide
DESEIRTTNPVATEQWGSVSCIIEPQDREGEDG

SEQ ID NO: 111461 - protein, 31 aa, Artificial Sequence
  Description of Artificial Sequence: Synthetic polypeptide
DEQEIATTNPVATEQWGSVSTDEMDAEGEDA

SEQ ID NO: 111462 - protein, 28 aa, Artificial Sequence
  Description of Artificial Sequence: Synthetic peptide
QEEEIASVNPVCTEQYGVVPEVLQHGEQ

SEQ ID NO: 111463 - protein, 30 aa, Artificial Sequence
  Description of Artificial Sequence: Synthetic polypeptide
QENEIATTNPVATEQYGDVSECLQNAAEEL

SEQ ID NO: 111464 - protein, 36 aa, Artificial Sequence
  Description of Artificial Sequence: Synthetic polypeptide
AEEEIRTTNPVATEQYGSVSTVVNQGNNQDEGTNSD

SEQ ID NO: 111465 - protein, 30 aa, Artificial Sequence
  Description of Artificial Sequence: Synthetic polypeptide
DEQEIATTNPVATEQWGSVSEDEENHEGDA

SEQ ID NO: 111466 - protein, 30 aa, Artificial Sequence
  Description of Artificial Sequence: Synthetic polypeptide
DEQEIATTNPVATEQWGSVSEDEEDHEGDA

SEQ ID NO: 111467 - protein, 33 aa, Artificial Sequence
  Description of Artificial Sequence: Synthetic polypeptide
DEQEIATTNPVATEQWGSVSATNDLADPEGEDF

SEQ ID NO: 111468 - protein, 32 aa, Artificial Sequence
  Description of Artificial Sequence: Synthetic polypeptide
DEQEIATTNPVATEQWGSVSATGLEVTNGEDL

SEQ ID NO: 111469 - protein, 32 aa, Artificial Sequence
  Description of Artificial Sequence: Synthetic polypeptide
DEQEIATTNPVATEQWGSVSATGLEVHQGEDA

SEQ ID NO: 111470 - protein, 32 aa, Artificial Sequence
  Description of Artificial Sequence: Synthetic polypeptide
DEQEIATTNPVATEQWGSVSATGLEDHEGEDS

SEQ ID NO: 111471 - protein, 34 aa, Artificial Sequence
  Description of Artificial Sequence: Synthetic polypeptide
DESEIRTTNPVATEQWGSVSCINEPQDHEGENDG

SEQ ID NO: 111472 - protein, 32 aa, Artificial Sequence
  Description of Artificial Sequence: Synthetic polypeptide
DEQEIATTNPVATEQWGSVSVPNITNNDGNQP

SEQ ID NO: 111473 - protein, 32 aa, Artificial Sequence
  Description of Artificial Sequence: Synthetic polypeptide
DEQEIATTNPVATEQWGSVSATDLTDHMGEDL

SEQ ID NO: 111474 - protein, 28 aa, Artificial Sequence
  Description of Artificial Sequence: Synthetic peptide
QEEEIASVNPVGTEGYGVMSDNLQSGDI

SEQ ID NO: 111475 - protein, 28 aa, Artificial Sequence
  Description of Artificial Sequence: Synthetic peptide
QEEEIASVNPVGTEGYGVMSDNLQSGDQ

SEQ ID NO: 111476 - protein, 33 aa, Artificial Sequence
  Description of Artificial Sequence: Synthetic polypeptide
DEQEIATTNPVATEQYGAVSATDLEDQEGEDGD

SEQ ID NO: 111477 - protein, 32 aa, Artificial Sequence
  Description of Artificial Sequence: Synthetic polypeptide
DEQEIATTNPVATEQYGAVSATDLEDHEGFDL

SEQ ID NO: 111478 - protein, 28 aa, Artificial Sequence
  Description of Artificial Sequence: Synthetic peptide
QENEIATTNPVATEQWGDVSEIEQAEDA

SEQ ID NO: 111479 - protein, 32 aa, Artificial Sequence
  Description of Artificial Sequence: Synthetic polypeptide
DEQEIATTNPVATEQYGAVSATDLEDHEGEDL

SEQ ID NO: 111480 - protein, 28 aa, Artificial Sequence
  Description of Artificial Sequence: Synthetic peptide
QENEIATTNPVATEQWGDVSEIEQHEDA

SEQ ID NO: 111481 - protein, 28 aa, Artificial Sequence
  Description of Artificial Sequence: Synthetic peptide
QENEIATTNPVATEQWGDVSEIEQHEDL

SEQ ID NO: 111482 - protein, 33 aa, Artificial Sequence
  Description of Artificial Sequence: Synthetic polypeptide
DEQEIATTNPVATEQYGASVSATFLEDHEGEDL

SEQ ID NO: 111483 - protein, 28 aa, Artificial Sequence
  Description of Artificial Sequence: Synthetic peptide
QENEIATTNPVATEQWGDVSEILMHEDA

SEQ ID NO: 111484 - protein, 33 aa, Artificial Sequence
  Description of Artificial Sequence: Synthetic polypeptide
DEQEIATTNPVATEQYGASVSATDLEDHHGEDL

SEQ ID NO: 111485 - protein, 33 aa, Artificial Sequence
  Description of Artificial Sequence: Synthetic polypeptide
DEQEIATTNPVATEQYGASVSATDLEDHEGFDL

SEQ ID NO: 111486 - protein, 33 aa, Artificial Sequence
  Description of Artificial Sequence: Synthetic polypeptide
DEQEIATTNPVATEQYGASVSATDLEDHEGEDL

SEQ ID NO: 111487 - protein, 30 aa, Artificial Sequence
  Description of Artificial Sequence: Synthetic polypeptide
DESEIRTTNPVATEQWGNVANTEMNAAGDA

SEQ ID NO: 111488 - protein, 28 aa, Artificial Sequence
  Description of Artificial Sequence: Synthetic peptide
QENEIATTNPVATEQYGDAPECLQHEEK

SEQ ID NO: 111489 - protein, 32 aa, Artificial Sequence
  Description of Artificial Sequence: Synthetic polypeptide
DEQEIATTNPVATEQYASVSATDLRDHEGEDL

SEQ ID NO: 111490 - protein, 33 aa, Artificial Sequence
  Description of Artificial Sequence: Synthetic polypeptide
DEQEIATTNPVATEQWYGSVSKTDLEDHEGEDL

SEQ ID NO: 111491 - protein, 28 aa, Artificial Sequence
  Description of Artificial Sequence: Synthetic peptide
QENEIATTNPVATEQYGDASECCQHEEL

SEQ ID NO: 111492 - protein, 33 aa, Artificial Sequence
  Description of Artificial Sequence: Synthetic polypeptide
DEQEIATTNPVATEQWYGSVSATDLEDHEGEDL

SEQ ID NO: 111493 - protein, 30 aa, Artificial Sequence
  Description of Artificial Sequence: Synthetic polypeptide
DESEIRTTNPVATEQWGNVSETEMNAAEDA

SEQ ID NO: 111494 - protein, 33 aa, Artificial Sequence
  Description of Artificial Sequence: Synthetic polypeptide
DEQEIATTNPVATEQWYGSVSATDLEDHEGEDF

SEQ ID NO: 111495 - protein, 32 aa, Artificial Sequence
  Description of Artificial Sequence: Synthetic polypeptide
DESEIRTTNPVATEQWGSASCINCPQDREEEG

SEQ ID NO: 111496 - protein, 28 aa, Artificial Sequence
  Description of Artificial Sequence: Synthetic peptide
QEEEIASVNPVGTEGYGVVASNLQSGDI

SEQ ID NO: 111497 - protein, 30 aa, Artificial Sequence
  Description of Artificial Sequence: Synthetic polypeptide
QENEIATTNPVATEQYGDVCSTDCPQHEED

SEQ ID NO: 111498 - protein, 35 aa, Artificial Sequence
  Description of Artificial Sequence: Synthetic polypeptide
DEQEIATTNPVATEQWGSVTSATGNLPQPRDMNQV

SEQ ID NO: 111499 - protein, 30 aa, Artificial Sequence
  Description of Artificial Sequence: Synthetic polypeptide
QENEIATTNPVATEQYGDVCSTDGPQHEED

SEQ ID NO: 111500 - protein, 28 aa, Artificial Sequence
  Description of Artificial Sequence: Synthetic peptide
QENEIATTNPVATEQYGDVPEVCQHEEL

SEQ ID NO: 111501 - protein, 32 aa, Artificial Sequence
  Description of Artificial Sequence: Synthetic polypeptide
DEQEIATTNPVATEQWGSVSYTDLEDHEGEDL

SEQ ID NO: 111502 - protein, 32 aa, Artificial Sequence
  Description of Artificial Sequence: Synthetic polypeptide
DEQEIATTNPVATEQWGSVSATDLIDHEGGDL

SEQ ID NO: 111503 - protein, 32 aa, Artificial Sequence
  Description of Artificial Sequence: Synthetic polypeptide
DEQEIATTNPVATEQWGSVSATDLEDHNGEDL

SEQ ID NO: 111504 - protein, 32 aa, Artificial Sequence
  Description of Artificial Sequence: Synthetic polypeptide
DEQEIATTNPVATEQWGSVSATDLEDHEGPDL

SEQ ID NO: 111505 - protein, 29 aa, Artificial Sequence
  Description of Artificial Sequence: Synthetic peptide
QENEIATTNPVATEQYGDVSEPAGQHEEL

SEQ ID NO: 111506 - protein, 32 aa, Artificial Sequence
  Description of Artificial Sequence: Synthetic polypeptide
DEQEIATTNPVATEIYGSVSATELEDHEGEDL

SEQ ID NO: 111507 - protein, 32 aa, Artificial Sequence
  Description of Artificial Sequence: Synthetic polypeptide
DEQEIATTNPVATEIYGSVSATDLESHEGEDL

SEQ ID NO: 111508 - protein, 32 aa, Artificial Sequence
  Description of Artificial Sequence: Synthetic polypeptide
DEQEIATTNPVATEIYGSVSATDLEDHEREDL

SEQ ID NO: 111509 - protein, 32 aa, Artificial Sequence
  Description of Artificial Sequence: Synthetic polypeptide
DEQEIATTNPVATEIYGSVSATDLEDHEGEDL

SEQ ID NO: 111510 - protein, 32 aa, Artificial Sequence
  Description of Artificial Sequence: Synthetic polypeptide
DEQEIATTNPVATEIYGSVSATDLEAHEGEDL

SEQ ID NO: 111511 - protein, 28 aa, Artificial Sequence
  Description of Artificial Sequence: Synthetic peptide
QEEEIASVNPVCTEQYGEVPDVLQSENQ

SEQ ID NO: 111512 - protein, 32 aa, Artificial Sequence
  Description of Artificial Sequence: Synthetic polypeptide
DEQEIATTNPVATEHYGSVSATDLEDHKGEDL

SEQ ID NO: 111513 - protein, 32 aa, Artificial Sequence
  Description of Artificial Sequence: Synthetic polypeptide
DEQEIATTNPVATEHYGSVSATDLEDHEGEDY

SEQ ID NO: 111514 - protein, 32 aa, Artificial Sequence
  Description of Artificial Sequence: Synthetic polypeptide
DEQEIATTNPVATEHYGSVSATDLEDHEGEDL

SEQ ID NO: 111515 - protein, 31 aa, Artificial Sequence
  Description of Artificial Sequence: Synthetic polypeptide
DEQEIATTNPVATEGYGVVSATDLEDHEGEL

SEQ ID NO: 111516 - protein, 29 aa, Artificial Sequence
  Description of Artificial Sequence: Synthetic peptide
QENEIATTNPVATEQYGDVSEVEQNAEDK

SEQ ID NO: 111517 - protein, 29 aa, Artificial Sequence
  Description of Artificial Sequence: Synthetic peptide
QENEIATTNPVATEQYGDVSEVEQNHEDK

SEQ ID NO: 111518 - protein, 30 aa, Artificial Sequence
  Description of Artificial Sequence: Synthetic polypeptide
QENEIATTNPVATEQYGDVSTCLEDHEEDL

SEQ ID NO: 111519 - protein, 31 aa, Artificial Sequence
  Description of Artificial Sequence: Synthetic polypeptide
DEQEIATTNPVATEGYGVVSATDLEDHEGDL

SEQ ID NO: 111520 - protein, 31 aa, Artificial Sequence
  Description of Artificial Sequence: Synthetic polypeptide
QENEIATTNPVATEQYGDVSTDLEDHEGEDL

SEQ ID NO: 111521 - protein, 31 aa, Artificial Sequence
  Description of Artificial Sequence: Synthetic polypeptide
QENEIATTNPVATEQYGDVSTDLQDHEEEDL

SEQ ID NO: 111522 - protein, 30 aa, Artificial Sequence
  Description of Artificial Sequence: Synthetic polypeptide
QENEIATTNPVATEQYGDVSTEPCLNHEEL

SEQ ID NO: 111523 - protein, 32 aa, Artificial Sequence
  Description of Artificial Sequence: Synthetic polypeptide
QENEIATTNPVATEQYGDVSTPCLQMHNGMEV

SEQ ID NO: 111524 - protein, 28 aa, Artificial Sequence
  Description of Artificial Sequence: Synthetic peptide
QENEIATTNPVATEQYGEAPECLQHEEL

SEQ ID NO: 111525 - protein, 28 aa, Artificial Sequence
  Description of Artificial Sequence: Synthetic peptide
QENEIATTNPVATEQYGEAPEVLQHEEK

SEQ ID NO: 111526 - protein, 28 aa, Artificial Sequence
  Description of Artificial Sequence: Synthetic peptide
QENEIATTNPVATEQYGEAPEVLQHEEL

SEQ ID NO: 111527 - protein, 28 aa, Artificial Sequence
  Description of Artificial Sequence: Synthetic peptide
QENEIATTNPVATEQYGEASECCQHEEK

SEQ ID NO: 111528 - protein, 36 aa, Artificial Sequence
  Description of Artificial Sequence: Synthetic polypeptide
AEEEIRTTNPVATEQYGSVSTVVNQENQETGTNVTT

SEQ ID NO: 111529 - protein, 32 aa, Artificial Sequence
  Description of Artificial Sequence: Synthetic polypeptide
DEQEIATTNPVATEGYGSVSATDLEDHEGEDL

SEQ ID NO: 111530 - protein, 32 aa, Artificial Sequence
  Description of Artificial Sequence: Synthetic polypeptide
DEQEIATTNPVATEKYGSVSATDLEDHEGEDL

SEQ ID NO: 111531 - protein, 32 aa, Artificial Sequence
  Description of Artificial Sequence: Synthetic polypeptide
DEQEIATTNPVATEKYGSVSATDLELHEGEDL

SEQ ID NO: 111532 - protein, 32 aa, Artificial Sequence
  Description of Artificial Sequence: Synthetic polypeptide
DEQEIATTNPVATEKYGSVSATDLFDHEGEDL

SEQ ID NO: 111533 - protein, 32 aa, Artificial Sequence
  Description of Artificial Sequence: Synthetic polypeptide
DEQEIATTNPVATEKYGSVSATFLEDHEGEDL

SEQ ID NO: 111534 - protein, 32 aa, Artificial Sequence
  Description of Artificial Sequence: Synthetic polypeptide
DEQEIATTNPVATEQWGSVSATDLEDHEGEDL

SEQ ID NO: 111535 - protein, 32 aa, Artificial Sequence
  Description of Artificial Sequence: Synthetic polypeptide
DEQEIATTNPVATEQWGSVSATDLEDEEGEDL

SEQ ID NO: 111536 - protein, 32 aa, Artificial Sequence
  Description of Artificial Sequence: Synthetic polypeptide
DEQEIATTNPVATEQWGSVSATDLEDAEGEDL

SEQ ID NO: 111537 - protein, 33 aa, Artificial Sequence
  Description of Artificial Sequence: Synthetic polypeptide
DEQEIATTNPVATEQWGSVSATDLADTPGEDNW

SEQ ID NO: 111538 - protein, 31 aa, Artificial Sequence
  Description of Artificial Sequence: Synthetic polypeptide
DEQEIATTNPVATEQWGSVSATDEEDAEGDL

SEQ ID NO: 111539 - protein, 31 aa, Artificial Sequence
  Description of Artificial Sequence: Synthetic polypeptide
DEQEIATTNPVATEQWGSVAMNGEQPEGGEE

SEQ ID NO: 111540 - protein, 30 aa, Artificial Sequence
  Description of Artificial Sequence: Synthetic polypeptide
DEQEIATTNPVATEQWGDVSTDEMNAEGDL

SEQ ID NO: 111541 - protein, 30 aa, Artificial Sequence
  Description of Artificial Sequence: Synthetic polypeptide
DEQEIATTNPVATEQWGDVSTDEENAEGDL

SEQ ID NO: 111542 - protein, 30 aa, Artificial Sequence
  Description of Artificial Sequence: Synthetic polypeptide
QENEIATTNPVATEQYGDVSEDLQHEEEDL

SEQ ID NO: 111543 - protein, 32 aa, Artificial Sequence
  Description of Artificial Sequence: Synthetic polypeptide
DEQEIATTNPVATEQFGSVSATDLEDHEGEDL

SEQ ID NO: 111544 - protein, 29 aa, Artificial Sequence
  Description of Artificial Sequence: Synthetic peptide
QENEIATTNPVATEQYGDVSEIEQAAEDA

SEQ ID NO: 111545 - protein, 29 aa, Artificial Sequence
  Description of Artificial Sequence: Synthetic peptide
QENEIATTNPVATEQYGDVSEIEQHAEDA

SEQ ID NO: 111546 - protein, 32 aa, Artificial Sequence
  Description of Artificial Sequence: Synthetic polypeptide
DEQEIATTNPIATEQYGSVSATDLEDHEGEYL

SEQ ID NO: 111547 - protein, 30 aa, Artificial Sequence
  Description of Artificial Sequence: Synthetic polypeptide
DEQEIATTNPVATEPYGTVSTDIEDHNGEL

SEQ ID NO: 111548 - protein, 31 aa, Artificial Sequence
  Description of Artificial Sequence: Synthetic polypeptide
DEQEIATTNPVATEPYGTISTDIQQQQNGNH

SEQ ID NO: 111549 - protein, 32 aa, Artificial Sequence
  Description of Artificial Sequence: Synthetic polypeptide
DEQEIATTNPVATEPYGSVSATGLEDHEGEDL

SEQ ID NO: 111550 - protein, 33 aa, Artificial Sequence
  Description of Artificial Sequence: Synthetic polypeptide
DEQEIATTNPVATEPYGSVSATDLQEDHEGEDL

SEQ ID NO: 111551 - protein, 32 aa, Artificial Sequence
  Description of Artificial Sequence: Synthetic polypeptide
DEQEIATTNPVATEPYGSVSATDLEDHEGEDL

SEQ ID NO: 111552 - protein, 31 aa, Artificial Sequence
  Description of Artificial Sequence: Synthetic polypeptide
DEQEIATTNPVATEPYGSISTDIQQQHNGEL

SEQ ID NO: 111553 - protein, 32 aa, Artificial Sequence
  Description of Artificial Sequence: Synthetic polypeptide
DEQEIATTNPVATENYGSVSFTDLEDHEGEDL

SEQ ID NO: 111554 - protein, 32 aa, Artificial Sequence
  Description of Artificial Sequence: Synthetic polypeptide
DEQEIATTNPVATENYGSVSATDLEDHEGEDL

SEQ ID NO: 111555 - protein, 32 aa, Artificial Sequence
  Description of Artificial Sequence: Synthetic polypeptide
DEQEIATTNPVATEMYGSVSATDLHDHEGEDL

SEQ ID NO: 111556 - protein, 32 aa, Artificial Sequence
  Description of Artificial Sequence: Synthetic polypeptide
DEQEIATTNPVATEMYGSVSATDLEDHEGEDL

SEQ ID NO: 111557 - protein, 30 aa, Artificial Sequence
  Description of Artificial Sequence: Synthetic polypeptide
QENEIATTNPVATEQYGDVSEILQNAAEEL

SEQ ID NO: 111558 - protein, 32 aa, Artificial Sequence
  Description of Artificial Sequence: Synthetic polypeptide
DEQEIATTNPVATELYGSVSATDLEDHEGEDL

SEQ ID NO: 111559 - protein, 32 aa, Artificial Sequence
  Description of Artificial Sequence: Synthetic polypeptide
DEQEIATTNPVATEKYGSVSHTDLEDHEGEDL

SEQ ID NO: 111560 - protein, 31 aa, Artificial Sequence
  Description of Artificial Sequence: Synthetic polypeptide
DEQEIATTNPVATEPYGTISTDIQQQQNGNL

SEQ ID NO: 111561 - protein, 32 aa, Artificial Sequence
  Description of Artificial Sequence: Synthetic polypeptide
DEQEIATTNPVATEQYGAVSATDNEDHEGEDL

SEQ ID NO: 111562 - protein, 32 aa, Artificial Sequence
  Description of Artificial Sequence: Synthetic polypeptide
DEQEIATTNPIATEQYGSVSATDLEDHEGEDL

SEQ ID NO: 111563 - protein, 32 aa, Artificial Sequence
  Description of Artificial Sequence: Synthetic polypeptide
DEQEIATTNPHATEQYGSVSATDLEDHEGEDL

SEQ ID NO: 111564 - protein, 35 aa, Artificial Sequence
  Description of Artificial Sequence: Synthetic polypeptide
CEEEIRTTNPVATEAYGSVSSCQGNPSQDRTGTNM

SEQ ID NO: 111565 - protein, 33 aa, Artificial Sequence
  Description of Artificial Sequence: Synthetic polypeptide
DEPEIYTTNPVATEQYGSVSLVNNLMYVGEEIL

SEQ ID NO: 111566 - protein, 33 aa, Artificial Sequence
  Description of Artificial Sequence: Synthetic polypeptide
DEPEIYTTNPVATEQYGSVSLVNDMMNVGVNIL

SEQ ID NO: 111567 - protein, 33 aa, Artificial Sequence
  Description of Artificial Sequence: Synthetic polypeptide
DEPEIVTTNPVATEQYGTVVSATDGQEEGEGNG

SEQ ID NO: 111568 - protein, 34 aa, Artificial Sequence
  Description of Artificial Sequence: Synthetic polypeptide
DEPEIVTTNPVATEQYGSVVTTDGQLQEEMGNGE

SEQ ID NO: 111569 - protein, 35 aa, Artificial Sequence
  Description of Artificial Sequence: Synthetic polypeptide
CEEEIRTTNPVATEAYGSVVASCHNELSQDTGDNM

SEQ ID NO: 111570 - protein, 34 aa, Artificial Sequence
  Description of Artificial Sequence: Synthetic polypeptide
CEEEIRTTNPVATEAYGTTVVSLHNLSQHTGGNM

SEQ ID NO: 111571 - protein, 31 aa, Artificial Sequence
  Description of Artificial Sequence: Synthetic polypeptide
CEEEIRTTNPVATECYGKHSMTWNEQPPSEF

SEQ ID NO: 111572 - protein, 29 aa, Artificial Sequence
  Description of Artificial Sequence: Synthetic peptide
QENEIATTNPVSTEPYGTVSMECLQQGEH

SEQ ID NO: 111573 - protein, 32 aa, Artificial Sequence
  Description of Artificial Sequence: Synthetic polypeptide
DEPEISTTNPVATEQYGSVSLVNNPMYVQNIL

SEQ ID NO: 111574 - protein, 37 aa, Artificial Sequence
  Description of Artificial Sequence: Synthetic polypeptide
AEEEIRTTNPVATEQYGSVSTVVNNLQQNDENGNNSN

SEQ ID NO: 111575 - protein, 32 aa, Artificial Sequence
  Description of Artificial Sequence: Synthetic polypeptide
DEPEIRTTNPVSTEPYGTISMSDIQVLQNGNH

SEQ ID NO: 111576 - protein, 29 aa, Artificial Sequence
  Description of Artificial Sequence: Synthetic peptide
QENEIATTNPVSTEQYGEISEEVCQQGNK

SEQ ID NO: 111577 - protein, 28 aa, Artificial Sequence
  Description of Artificial Sequence: Synthetic peptide
QENEIATVNPVATECYGDVSECLQHEEL

SEQ ID NO: 111578 - protein, 34 aa, Artificial Sequence
  Description of Artificial Sequence: Synthetic polypeptide
DEPEIRTTNPVATERWGSVSECINEPQDREGENH

SEQ ID NO: 111579 - protein, 33 aa, Artificial Sequence
  Description of Artificial Sequence: Synthetic polypeptide
DEPEIRTTNPVATEQYGTVIDTNNGQGGGGGQE

SEQ ID NO: 111580 - protein, 28 aa, Artificial Sequence
  Description of Artificial Sequence: Synthetic peptide
QENEIATVNPVATECYGDVSECLQSEEQ

SEQ ID NO: 111581 - protein, 28 aa, Artificial Sequence
  Description of Artificial Sequence: Synthetic peptide
QENEIATVNPVATECYGGVSEGLQHEEM

SEQ ID NO: 111582 - protein, 34 aa, Artificial Sequence
  Description of Artificial Sequence: Synthetic polypeptide
DEPEIRTTNPVATEQYGSVTTYVDLQERDDVQMS

SEQ ID NO: 111583 - protein, 35 aa, Artificial Sequence
  Description of Artificial Sequence: Synthetic polypeptide
DEPEIRTTNPVATEQYGSVTPTNGNETTQSGQDNQ

SEQ ID NO: 111584 - protein, 28 aa, Artificial Sequence
  Description of Artificial Sequence: Synthetic peptide
QENEIATVNPVATECYGHVSECLQHEEL

SEQ ID NO: 111585 - protein, 28 aa, Artificial Sequence
  Description of Artificial Sequence: Synthetic peptide
QENEIATVNPVCTEQYGVVSECLQHEEQ

SEQ ID NO: 111586 - protein, 28 aa, Artificial Sequence
  Description of Artificial Sequence: Synthetic peptide
QEEEIASTNPVCTEGYGVMASTLQSGDI

SEQ ID NO: 111587 - protein, 35 aa, Artificial Sequence
  Description of Artificial Sequence: Synthetic polypeptide
DEPEIRTTNPVATEQYGSVSVMMPALEARNVNERM

SEQ ID NO: 111588 - protein, 35 aa, Artificial Sequence
  Description of Artificial Sequence: Synthetic polypeptide
DEPEIRTTNPVATEQYGSVSTSLLESEENGEVNIY

SEQ ID NO: 111589 - protein, 36 aa, Artificial Sequence
  Description of Artificial Sequence: Synthetic polypeptide
CEEEIRTTNPVATEAYGSVSSCQGNLSQRTGTNEMG

SEQ ID NO: 111590 - protein, 29 aa, Artificial Sequence
  Description of Artificial Sequence: Synthetic peptide
QENEIGTTNPVATECYGHVSEELQHEYEL

SEQ ID NO: 111591 - protein, 28 aa, Artificial Sequence
  Description of Artificial Sequence: Synthetic peptide
QEEEIASTNPVCTEQYGVASDNCQHEEQ

SEQ ID NO: 111592 - protein, 35 aa, Artificial Sequence
  Description of Artificial Sequence: Synthetic polypeptide
CEEEIRTTNPVATEAYGSVSSCHNLSQYLTGGNNM

SEQ ID NO: 111593 - protein, 32 aa, Artificial Sequence
  Description of Artificial Sequence: Synthetic polypeptide
DEQDIATTNPVATEQYGSVSATDLEDHEGTDL

SEQ ID NO: 111594 - protein, 32 aa, Artificial Sequence
  Description of Artificial Sequence: Synthetic polypeptide
DEQDIATTNPVATEQYGSVSATDLEDHEGEDL

SEQ ID NO: 111595 - protein, 29 aa, Artificial Sequence
  Description of Artificial Sequence: Synthetic peptide
QENEIATTNPVSTECYGDVSANCLQHEEL

SEQ ID NO: 111596 - protein, 33 aa, Artificial Sequence
  Description of Artificial Sequence: Synthetic polypeptide
DEQDEIATTNPVAYEGWGTVSTNLQGDVGDNER

SEQ ID NO: 111597 - protein, 28 aa, Artificial Sequence
  Description of Artificial Sequence: Synthetic peptide
QENEIATTNPVSTECYGDVSECIQHGEL

SEQ ID NO: 111598 - protein, 32 aa, Artificial Sequence
  Description of Artificial Sequence: Synthetic polypeptide
DEQCIATTNPVATEQYGSVSATQLEPHEGEDL

SEQ ID NO: 111599 - protein, 32 aa, Artificial Sequence
  Description of Artificial Sequence: Synthetic polypeptide
DEQCIATTNPVATEQYGSVSATDLEDHEGEDS

SEQ ID NO: 111600 - protein, 32 aa, Artificial Sequence
  Description of Artificial Sequence: Synthetic polypeptide
DEQCIATTNPVATEQYGSVSATDLEDHEGEDL

SEQ ID NO: 111601 - protein, 33 aa, Artificial Sequence
  Description of Artificial Sequence: Synthetic polypeptide
DEQAIRTTNPVATEQYGSVSPTMNEHTGESLDE

SEQ ID NO: 111602 - protein, 35 aa, Artificial Sequence
  Description of Artificial Sequence: Synthetic polypeptide
CEEEIRTTNPVATEAYGSVQSYTNMHSHMNGDNNR

SEQ ID NO: 111603 - protein, 28 aa, Artificial Sequence
  Description of Artificial Sequence: Synthetic peptide
QENEIATTNPVSTECYGDVSECLQHEEL

SEQ ID NO: 111604 - protein, 36 aa, Artificial Sequence
  Description of Artificial Sequence: Synthetic polypeptide
AEEEIRTTNPVATEQYGSVVTVTTNLQQGEEGTNVG

SEQ ID NO: 111605 - protein, 34 aa, Artificial Sequence
  Description of Artificial Sequence: Synthetic polypeptide
CEEEIRTTNPVATEAYGSVSSCHEDSQRTGGNNM

SEQ ID NO: 111606 - protein, 35 aa, Artificial Sequence
  Description of Artificial Sequence: Synthetic polypeptide
CEEEIRTTNPVATEAYGSVSSCHNAISQRTGGNNM

SEQ ID NO: 111607 - protein, 29 aa, Artificial Sequence
  Description of Artificial Sequence: Synthetic peptide
QENEIATTNPVSTECYGDVSMCIQQHGNL

SEQ ID NO: 111608 - protein, 32 aa, Artificial Sequence
  Description of Artificial Sequence: Synthetic polypeptide
DEQAIATTNPVATEQYGSVSATDLEDHEGEPL

SEQ ID NO: 111609 - protein, 32 aa, Artificial Sequence
  Description of Artificial Sequence: Synthetic polypeptide
DEQAIATTNPVATEQYGSVSATDLEDHEGEDT

SEQ ID NO: 111610 - protein, 32 aa, Artificial Sequence
  Description of Artificial Sequence: Synthetic polypeptide
DEQAIATTNPVATEQYGSVSATDLEDHEGEDL

SEQ ID NO: 111611 - protein, 32 aa, Artificial Sequence
  Description of Artificial Sequence: Synthetic polypeptide
DEQAIATTNPVATEQYGSVSATDLEDHEGEDA

SEQ ID NO: 111612 - protein, 32 aa, Artificial Sequence
  Description of Artificial Sequence: Synthetic polypeptide
DEQAIATTNPVATEQYGSVSATDLDDHEGEDL

SEQ ID NO: 111613 - protein, 32 aa, Artificial Sequence
  Description of Artificial Sequence: Synthetic polypeptide
DEQAIATTNPVATEQYGSVSATCLEDHEGEDL

SEQ ID NO: 111614 - protein, 29 aa, Artificial Sequence
  Description of Artificial Sequence: Synthetic peptide
QENEIATTNPVSTECYGDVSMCIQQQGNL

SEQ ID NO: 111615 - protein, 28 aa, Artificial Sequence
  Description of Artificial Sequence: Synthetic peptide
QENEIATTNPVSTECYGDVSNCLQHEEL

SEQ ID NO: 111616 - protein, 29 aa, Artificial Sequence
  Description of Artificial Sequence: Synthetic peptide
QENEIATTNPVSTECYGTVSMECLQQGEH

SEQ ID NO: 111617 - protein, 33 aa, Artificial Sequence
  Description of Artificial Sequence: Synthetic polypeptide
DEPNIRTTNPVAYEPYGQVNCTNEASQRVGNRV

SEQ ID NO: 111618 - protein, 36 aa, Artificial Sequence
  Description of Artificial Sequence: Synthetic polypeptide
CEEEIRTTNPVATEAYGSVSSCQGNLSQQRTGTNMP

SEQ ID NO: 111619 - protein, 29 aa, Artificial Sequence
  Description of Artificial Sequence: Synthetic peptide
QENEIATTNPVSTECYGDVAANCLQREEL

SEQ ID NO: 111620 - protein, 31 aa, Artificial Sequence
  Description of Artificial Sequence: Synthetic polypeptide
DESEIRTTNPVATEQWGTVSEIHMNAAEGDA

SEQ ID NO: 111621 - protein, 30 aa, Artificial Sequence
  Description of Artificial Sequence: Synthetic polypeptide
QENEIRPTNPCSTEQYGIVSCDLQQSNGNH

SEQ ID NO: 111622 - protein, 34 aa, Artificial Sequence
  Description of Artificial Sequence: Synthetic polypeptide
DESEIRTTNPVATEQYGCVCSNTGELQNFNSDQG

SEQ ID NO: 111623 - protein, 34 aa, Artificial Sequence
  Description of Artificial Sequence: Synthetic polypeptide
DESEIRTTNPVATEQYGCVCSNTNHQENFGSEQA

SEQ ID NO: 111624 - protein, 31 aa, Artificial Sequence
  Description of Artificial Sequence: Synthetic polypeptide
QENEIRTTNPVATEPYGDVSMECIQQQHGNL

SEQ ID NO: 111625 - protein, 31 aa, Artificial Sequence
  Description of Artificial Sequence: Synthetic polypeptide
QENEIRTTNPVATEPYGDVSMEDIQQQHGNH

SEQ ID NO: 111626 - protein, 33 aa, Artificial Sequence
  Description of Artificial Sequence: Synthetic polypeptide
DESEIRTTNPVATEQYGCVCSTEEDQNFNSDQG

SEQ ID NO: 111627 - protein, 28 aa, Artificial Sequence
  Description of Artificial Sequence: Synthetic peptide
QENEIRTTNPVATEQWGDVSEIEMAEDA

SEQ ID NO: 111628 - protein, 29 aa, Artificial Sequence
  Description of Artificial Sequence: Synthetic peptide
QENEIRTTNPVATEQWGDVSEIEQAAEDK

SEQ ID NO: 111629 - protein, 29 aa, Artificial Sequence
  Description of Artificial Sequence: Synthetic peptide
QENEIRTTNPVATEQWGDVSEIEQHAEDK

SEQ ID NO: 111630 - protein, 33 aa, Artificial Sequence
  Description of Artificial Sequence: Synthetic polypeptide
DESEIRTTNPVATEQYGCVCSTEEHQNFGSEQS

SEQ ID NO: 111631 - protein, 28 aa, Artificial Sequence
  Description of Artificial Sequence: Synthetic peptide
QEEEIASTNPVATEGYGEMAEVLQHGEK

SEQ ID NO: 111632 - protein, 36 aa, Artificial Sequence
  Description of Artificial Sequence: Synthetic polypeptide
DEPEIRTTNPVATEQYGSVSLTPTLDQNTQGLESNT

SEQ ID NO: 111633 - protein, 30 aa, Artificial Sequence
  Description of Artificial Sequence: Synthetic polypeptide
QENEIRTTNPVATEQWGDVSEILQNHAEDA

SEQ ID NO: 111634 - protein, 30 aa, Artificial Sequence
  Description of Artificial Sequence: Synthetic polypeptide
QENEIRTTNPVATEQWGDVSEILQNHAEEA

SEQ ID NO: 111635 - protein, 28 aa, Artificial Sequence
  Description of Artificial Sequence: Synthetic peptide
QENEIRTTNPVATEQWGEVSEICMAEEA

SEQ ID NO: 111636 - protein, 34 aa, Artificial Sequence
  Description of Artificial Sequence: Synthetic polypeptide
CEEEIRTTNPVATEQYGCVCSNTEEDQENFGSNQ

SEQ ID NO: 111637 - protein, 33 aa, Artificial Sequence
  Description of Artificial Sequence: Synthetic polypeptide
CEEEIRTTNPVATEQYGCVCSNTEHAENFGSNQ

SEQ ID NO: 111638 - protein, 34 aa, Artificial Sequence
  Description of Artificial Sequence: Synthetic polypeptide
DEPEIRTTNPVATEQYGSVSDYNLLNQPEDEDDK

SEQ ID NO: 111639 - protein, 30 aa, Artificial Sequence
  Description of Artificial Sequence: Synthetic polypeptide
QENEIRTTNPVATEQYGDVSEPAGQHNEEL

SEQ ID NO: 111640 - protein, 33 aa, Artificial Sequence
  Description of Artificial Sequence: Synthetic polypeptide
QENEIRTTNPVATEQYGDVSSTPCGPQRGMEPL

SEQ ID NO: 111641 - protein, 33 aa, Artificial Sequence
  Description of Artificial Sequence: Synthetic polypeptide
QENEIRTTNPVATEQYGSVSSTEPAGQMHNEEL

SEQ ID NO: 111642 - protein, 35 aa, Artificial Sequence
  Description of Artificial Sequence: Synthetic polypeptide
AEEEIRTTNPVATEQYGSVSTVVNLQQQDEETETE

SEQ ID NO: 111643 - protein, 34 aa, Artificial Sequence
  Description of Artificial Sequence: Synthetic polypeptide
CEEEIRTTNPVATEQYGCVCSNTENHQENFGSEQ

SEQ ID NO: 111644 - protein, 33 aa, Artificial Sequence
  Description of Artificial Sequence: Synthetic polypeptide
DEPEIRTTNPVATEQYGSVSAADWTIEQFEDGD

SEQ ID NO: 111645 - protein, 34 aa, Artificial Sequence
  Description of Artificial Sequence: Synthetic polypeptide
DEPEIRTTNPVATEQYGSVSAADLTQESNFEDGD

SEQ ID NO: 111646 - protein, 33 aa, Artificial Sequence
  Description of Artificial Sequence: Synthetic polypeptide
DEPEIRTTNPVATEQYGSVSAADLTQEQEEDGD

SEQ ID NO: 111647 - protein, 28 aa, Artificial Sequence
  Description of Artificial Sequence: Synthetic peptide
QEEEIASTNPVATEGYGEMASVLQHGEI

SEQ ID NO: 111648 - protein, 33 aa, Artificial Sequence
  Description of Artificial Sequence: Synthetic polypeptide
DESEIRTTNPVATEQWGVVSDINEPQDSEGENG

SEQ ID NO: 111649 - protein, 31 aa, Artificial Sequence
  Description of Artificial Sequence: Synthetic polypeptide
QEEEIASTNPVATEGYGNVAANVCQSRVGER

SEQ ID NO: 111650 - protein, 28 aa, Artificial Sequence
  Description of Artificial Sequence: Synthetic peptide
QENEIRTTNPVATECYGTISMCIQHEEL

SEQ ID NO: 111651 - protein, 34 aa, Artificial Sequence
  Description of Artificial Sequence: Synthetic polypeptide
DEPEIRTTNPVATEQYGSVSTLSGMQNEGTDEMV

SEQ ID NO: 111652 - protein, 34 aa, Artificial Sequence
  Description of Artificial Sequence: Synthetic polypeptide
CEEEIRTTNPVATEQYGCVCSMTEHNQRFNSDQS

SEQ ID NO: 111653 - protein, 35 aa, Artificial Sequence
  Description of Artificial Sequence: Synthetic polypeptide
DEPEIRTTNPVATEQYGSVSSTWNTEIEINDEDRD

SEQ ID NO: 111654 - protein, 33 aa, Artificial Sequence
  Description of Artificial Sequence: Synthetic polypeptide
CEEEIRTTNPVATEQYGCVCSMTEHQGFNSDQS

SEQ ID NO: 111655 - protein, 30 aa, Artificial Sequence
  Description of Artificial Sequence: Synthetic polypeptide
DESEIRTTNPVATEQWGVVSEILMNAAEDI

SEQ ID NO: 111656 - protein, 28 aa, Artificial Sequence
  Description of Artificial Sequence: Synthetic peptide
QEEEIASTNPVATEQYGVAPSVLQHEEK

SEQ ID NO: 111657 - protein, 35 aa, Artificial Sequence
  Description of Artificial Sequence: Synthetic polypeptide
DEPEIRTTNPVATEQYGSVSPTWVNLEERFPDQQG

SEQ ID NO: 111658 - protein, 29 aa, Artificial Sequence
  Description of Artificial Sequence: Synthetic peptide
QENEIRTTNPCSTEPYGIVSCNIQQQGTH

SEQ ID NO: 111659 - protein, 34 aa, Artificial Sequence
  Description of Artificial Sequence: Synthetic polypeptide
DEPEIRTTNPVATEQYGSVSPTTLETTLGDGTQL

SEQ ID NO: 111660 - protein, 35 aa, Artificial Sequence
  Description of Artificial Sequence: Synthetic polypeptide
DEPEIRTTNPVATEQYGSVSPTSLLENENGEVNIG

SEQ ID NO: 111661 - protein, 34 aa, Artificial Sequence
  Description of Artificial Sequence: Synthetic polypeptide
DEPEIRTTNPVATEQYGSVSPANLEIEPDNVTTV

SEQ ID NO: 111662 - protein, 36 aa, Artificial Sequence
  Description of Artificial Sequence: Synthetic polypeptide
AEEEIRTTNPVATEQYGSVSTVVNNGNQEEGNNQGD

SEQ ID NO: 111663 - protein, 32 aa, Artificial Sequence
  Description of Artificial Sequence: Synthetic polypeptide
CEDEIACTNPVATEQYGCVATNLQAEPAGMNH

SEQ ID NO: 111664 - protein, 35 aa, Artificial Sequence
  Description of Artificial Sequence: Synthetic polypeptide
AEEEIRTTNPVATEQYGSVSTVVNNGNNDEGTNTD

SEQ ID NO: 111665 - protein, 28 aa, Artificial Sequence
  Description of Artificial Sequence: Synthetic peptide
QEEEIASTNPVATEQYGEVPEVCQSEEK

SEQ ID NO: 111666 - protein, 35 aa, Artificial Sequence
  Description of Artificial Sequence: Synthetic polypeptide
DESEIRTTNPVATEQYGAVVDTGDLGQRGEGNIDV

SEQ ID NO: 111667 - protein, 29 aa, Artificial Sequence
  Description of Artificial Sequence: Synthetic peptide
QENEIRTTNPVATECYGAVSNEDWQHEPL

SEQ ID NO: 111668 - protein, 36 aa, Artificial Sequence
  Description of Artificial Sequence: Synthetic polypeptide
AEEEIRTTNPVATEQYGSVSTVVNNENQGEQGNNQN

SEQ ID NO: 111669 - protein, 36 aa, Artificial Sequence
  Description of Artificial Sequence: Synthetic polypeptide
DESEIRTTNPVATEQYGAVVSTEGDLGQRGEGNIDV

SEQ ID NO: 111670 - protein, 31 aa, Artificial Sequence
  Description of Artificial Sequence: Synthetic polypeptide
QENEIRTTNPVATECYGDVSTCLNRNEMEPL

SEQ ID NO: 111671 - protein, 28 aa, Artificial Sequence
  Description of Artificial Sequence: Synthetic peptide
QEEEIASTNPVATEQYGEVPEVCQHEEK

SEQ ID NO: 111672 - protein, 28 aa, Artificial Sequence
  Description of Artificial Sequence: Synthetic peptide
QEEEIASTNPVATEQYGEAPTVCQHEEK

SEQ ID NO: 111673 - protein, 28 aa, Artificial Sequence
  Description of Artificial Sequence: Synthetic peptide
QEEEIASTNPVATEGYGVMPSVLQHGEK

SEQ ID NO: 111674 - protein, 36 aa, Artificial Sequence
  Description of Artificial Sequence: Synthetic polypeptide
DEPEIRTTNPVATEQYGSVSNPTDNLIETFGSNQIE

SEQ ID NO: 111675 - protein, 28 aa, Artificial Sequence
  Description of Artificial Sequence: Synthetic peptide
QEEEIASTNPVATEGYGVMASVLQHGEK

SEQ ID NO: 111676 - protein, 28 aa, Artificial Sequence
  Description of Artificial Sequence: Synthetic peptide
QEEEIASTNPVATEGYGVMASTLMHGDI

SEQ ID NO: 111677 - protein, 35 aa, Artificial Sequence
  Description of Artificial Sequence: Synthetic polypeptide
CEEEIRTTNPVATEAYGSTVSSCHNELSQNTGDNM

SEQ ID NO: 111678 - protein, 29 aa, Artificial Sequence
  Description of Artificial Sequence: Synthetic peptide
QENEIATTNPVSTECYGDVAANCIQREER

SEQ ID NO: 111679 - protein, 32 aa, Artificial Sequence
  Description of Artificial Sequence: Synthetic polypeptide
DEQEIAATNPVATEQYGSVSATDLEDHEGEDL

SEQ ID NO: 111680 - protein, 35 aa, Artificial Sequence
  Description of Artificial Sequence: Synthetic polypeptide
DESEIRTTNPVATEQWGSVSTTPAGPQDRNGMNPV

SEQ ID NO: 111681 - protein, 32 aa, Artificial Sequence
  Description of Artificial Sequence: Synthetic polypeptide
DEQEIATTNCVATEQYGSVSATDLEDHEGEHL

SEQ ID NO: 111682 - protein, 32 aa, Artificial Sequence
  Description of Artificial Sequence: Synthetic polypeptide
DEQEIATTNCVATEQYGSVSATDLEDHEGEDM

SEQ ID NO: 111683 - protein, 32 aa, Artificial Sequence
  Description of Artificial Sequence: Synthetic polypeptide
DEQEIATTNCVATEQYGSVSATDLEDHEGEDL

SEQ ID NO: 111684 - protein, 32 aa, Artificial Sequence
  Description of Artificial Sequence: Synthetic polypeptide
DEQEIATTNAVATEQYGSVSWTDLEDHEGEDL

SEQ ID NO: 111685 - protein, 32 aa, Artificial Sequence
  Description of Artificial Sequence: Synthetic polypeptide
DEQEIATTNAVATEQYGSVSATDLEDHEGEDL

SEQ ID NO: 111686 - protein, 32 aa, Artificial Sequence
  Description of Artificial Sequence: Synthetic polypeptide
DEQEIATCNPVATEQYGSVSATDLPDHEGEDL

SEQ ID NO: 111687 - protein, 32 aa, Artificial Sequence
  Description of Artificial Sequence: Synthetic polypeptide
DEQEIATCNPVATEQYGSVSATDLEDHEGEDV

SEQ ID NO: 111688 - protein, 32 aa, Artificial Sequence
  Description of Artificial Sequence: Synthetic polypeptide
DEQEIATCNPVATEQYGSVSATDLEDHEGEDL

SEQ ID NO: 111689 - protein, 35 aa, Artificial Sequence
  Description of Artificial Sequence: Synthetic polypeptide
DESEIRTTNPVATEQWGSVSTTPAGPQMRNGMNPV

SEQ ID NO: 111690 - protein, 29 aa, Artificial Sequence
  Description of Artificial Sequence: Synthetic peptide
QEEEIASTNPVGTEGYGVVATTTGQHGNI

SEQ ID NO: 111691 - protein, 28 aa, Artificial Sequence
  Description of Artificial Sequence: Synthetic peptide
QEEEIASTNPVGTEGYGVMASTLQHGDI

SEQ ID NO: 111692 - protein, 28 aa, Artificial Sequence
  Description of Artificial Sequence: Synthetic peptide
QENEIATTNPVATHCYGDVSECLQHEEL

SEQ ID NO: 111693 - protein, 30 aa, Artificial Sequence
  Description of Artificial Sequence: Synthetic polypeptide
DEQEIASTNPVATEQYGVMSTTLEHEGDDI

SEQ ID NO: 111694 - protein, 28 aa, Artificial Sequence
  Description of Artificial Sequence: Synthetic peptide
QENEIATTNPVATLCYGDVSNCLQHEEL

SEQ ID NO: 111695 - protein, 35 aa, Artificial Sequence
  Description of Artificial Sequence: Synthetic polypeptide
AEEEIRTTNPVATEQYGSVVTVTTNLGGNEQGNNA

SEQ ID NO: 111696 - protein, 28 aa, Artificial Sequence
  Description of Artificial Sequence: Synthetic peptide
QENEIATTNPVATMCYGDVSECLQHEEL

SEQ ID NO: 111697 - protein, 34 aa, Artificial Sequence
  Description of Artificial Sequence: Synthetic polypeptide
CEEEIRTTNPCATEAYGSVSSCHNLSQFTGGNNM

SEQ ID NO: 111698 - protein, 28 aa, Artificial Sequence
  Description of Artificial Sequence: Synthetic peptide
QENEIATTNPVATNCYGMVSECLQHEEL

SEQ ID NO: 111699 - protein, 28 aa, Artificial Sequence
  Description of Artificial Sequence: Synthetic peptide
QENEIATTNPVATRPYGDVSECLQHEEL

SEQ ID NO: 111700 - protein, 28 aa, Artificial Sequence
  Description of Artificial Sequence: Synthetic peptide
QENEIATTNPVATSCYGDVSACLQHEEL

SEQ ID NO: 111701 - protein, 28 aa, Artificial Sequence
  Description of Artificial Sequence: Synthetic peptide
QENEIATTNPVATSCYGDVSECLQHEEL

SEQ ID NO: 111702 - protein, 32 aa, Artificial Sequence
  Description of Artificial Sequence: Synthetic polypeptide
DEQEIASTNPVATEQYGSVSATDLEDTEGEDL

SEQ ID NO: 111703 - protein, 32 aa, Artificial Sequence
  Description of Artificial Sequence: Synthetic polypeptide
DEQEIASTNPVATEQYGSVSATDLEDHEGEDQ

SEQ ID NO: 111704 - protein, 32 aa, Artificial Sequence
  Description of Artificial Sequence: Synthetic polypeptide
DEQEIASTNPVATEQYGSVSATDLEDHEGEDL

SEQ ID NO: 111705 - protein, 32 aa, Artificial Sequence
  Description of Artificial Sequence: Synthetic polypeptide
DEQEIATTNGVATEQYGSVSATDLEDHEGEDL

SEQ ID NO: 111706 - protein, 28 aa, Artificial Sequence
  Description of Artificial Sequence: Synthetic peptide
QENEIATTNPVATVCYGAVSECLQHEEL

SEQ ID NO: 111707 - protein, 32 aa, Artificial Sequence
  Description of Artificial Sequence: Synthetic polypeptide
DEQEIATTNPAATEQYGSVSATDLEDHEGEDL

SEQ ID NO: 111708 - protein, 30 aa, Artificial Sequence
  Description of Artificial Sequence: Synthetic polypeptide
QENEIATTNPVATEYYGCVSWELQHFNELA

SEQ ID NO: 111709 - protein, 32 aa, Artificial Sequence
  Description of Artificial Sequence: Synthetic polypeptide
DEQEIATTNPGATEQYGSVSATLLEDHEGEDL

SEQ ID NO: 111710 - protein, 32 aa, Artificial Sequence
  Description of Artificial Sequence: Synthetic polypeptide
DEQEIATTNPGATEQYGSVSATDLHDHEGEDL

SEQ ID NO: 111711 - protein, 32 aa, Artificial Sequence
  Description of Artificial Sequence: Synthetic polypeptide
DEQEIATTNPGATEQYGSVSATDLEDHEGEDL

SEQ ID NO: 111712 - protein, 32 aa, Artificial Sequence
  Description of Artificial Sequence: Synthetic polypeptide
DEQEIATTNPFATEQYGSVSATDLEDHEGEDL

SEQ ID NO: 111713 - protein, 33 aa, Artificial Sequence
  Description of Artificial Sequence: Synthetic polypeptide
DEQEIATTNPEVATEQYGSVSATDLEDHEGEDL

SEQ ID NO: 111714 - protein, 32 aa, Artificial Sequence
  Description of Artificial Sequence: Synthetic polypeptide
DEQEIATTNPEATEQYGSVSATVLEDHEGEDL

SEQ ID NO: 111715 - protein, 32 aa, Artificial Sequence
  Description of Artificial Sequence: Synthetic polypeptide
DEQEIATTNPEATEQYGSVSATDLEDHEGKDL

SEQ ID NO: 111716 - protein, 32 aa, Artificial Sequence
  Description of Artificial Sequence: Synthetic polypeptide
DEQEIATTNPEATEQYGSVSATDLEDHEGEDL

SEQ ID NO: 111717 - protein, 32 aa, Artificial Sequence
  Description of Artificial Sequence: Synthetic polypeptide
DEQEIATTNPDATEQYGSVSATDLEDHEGEDL

SEQ ID NO: 111718 - protein, 35 aa, Artificial Sequence
  Description of Artificial Sequence: Synthetic polypeptide
DESEIRTTNPVATEQWGSVSSTCPAGPQMRNGENV

SEQ ID NO: 111719 - protein, 36 aa, Artificial Sequence
  Description of Artificial Sequence: Synthetic polypeptide
AEEEIRTTNPVATEQYGSVVTVTTNGNLQQGTNNIN

SEQ ID NO: 111720 - protein, 33 aa, Artificial Sequence
  Description of Artificial Sequence: Synthetic polypeptide
DESEIRTTNPVATEQWGSVSTIDEQDHEGEEDG

SEQ ID NO: 111721 - protein, 29 aa, Artificial Sequence
  Description of Artificial Sequence: Synthetic peptide
QENEIATTNPVATESYGVVSNALQHEDEL

SEQ ID NO: 111722 - protein, 31 aa, Artificial Sequence
  Description of Artificial Sequence: Synthetic polypeptide
DEQEIATTNPCSTEQYGIVSATDLEDHEGER

SEQ ID NO: 111723 - protein, 29 aa, Artificial Sequence
  Description of Artificial Sequence: Synthetic peptide
QENEIATTNPVATETYGDVSRECLQHEEL

SEQ ID NO: 111724 - protein, 31 aa, Artificial Sequence
  Description of Artificial Sequence: Synthetic polypeptide
CEDEIACTNPVATEQYGCVATNLQMHNEGAH

SEQ ID NO: 111725 - protein, 32 aa, Artificial Sequence
  Description of Artificial Sequence: Synthetic polypeptide
DEQEIATTNPCATEQYGSVSWTDLEDHNGEDL

SEQ ID NO: 111726 - protein, 32 aa, Artificial Sequence
  Description of Artificial Sequence: Synthetic polypeptide
DEQEIATTNPCATEQYGSVSFTDLEDHEGEDL

SEQ ID NO: 111727 - protein, 29 aa, Artificial Sequence
  Description of Artificial Sequence: Synthetic peptide
QENEIATTNPVATETYGHVSECLEQHEEL

SEQ ID NO: 111728 - protein, 29 aa, Artificial Sequence
  Description of Artificial Sequence: Synthetic peptide
QENEIATTNPVATETYGHVSEWLQHEEEL

SEQ ID NO: 111729 - protein, 32 aa, Artificial Sequence
  Description of Artificial Sequence: Synthetic polypeptide
DEQEIATTNPCATEQYGSVSATDLEDHEGEDL

SEQ ID NO: 111730 - protein, 35 aa, Artificial Sequence
  Description of Artificial Sequence: Synthetic polypeptide
DESEIRTTNPVATEQWGSVSTTIAGPQDRNGMNPV

SEQ ID NO: 111731 - protein, 29 aa, Artificial Sequence
  Description of Artificial Sequence: Synthetic peptide
QENEIATTNPVATEWYGDVSECLQHEEEL

SEQ ID NO: 111732 - protein, 32 aa, Artificial Sequence
  Description of Artificial Sequence: Synthetic polypeptide
DEQEIATTNPCATEQYGIVSACNLQDHEGEDL

SEQ ID NO: 111733 - protein, 29 aa, Artificial Sequence
  Description of Artificial Sequence: Synthetic peptide
QENEIATTNPVATEYYGCVSWALQHNSEL

SEQ ID NO: 111734 - protein, 32 aa, Artificial Sequence
  Description of Artificial Sequence: Synthetic polypeptide
DEQEIATTNPAATEQYGSVSATDLEDHEGHDL

SEQ ID NO: 111735 - protein, 28 aa, Artificial Sequence
  Description of Artificial Sequence: Synthetic peptide
QENEIATTNPVATWCYGDVSECLQHEEL

SEQ ID NO: 111736 - protein, 32 aa, Artificial Sequence
  Description of Artificial Sequence: Synthetic polypeptide
DEQEIASTNPVATEQYGSVSADDLQDHEGEDQ

SEQ ID NO: 111737 - protein, 32 aa, Artificial Sequence
  Description of Artificial Sequence: Synthetic polypeptide
DEQEIASTNPVATEQYGSVSADDLQDHEGEDL

SEQ ID NO: 111738 - protein, 28 aa, Artificial Sequence
  Description of Artificial Sequence: Synthetic peptide
QENEIATTNPVCTECYGVVSECLQHEEL

SEQ ID NO: 111739 - protein, 28 aa, Artificial Sequence
  Description of Artificial Sequence: Synthetic peptide
QENEIATTNPVCTECYGVVSECLQHEEQ

SEQ ID NO: 111740 - protein, 31 aa, Artificial Sequence
  Description of Artificial Sequence: Synthetic polypeptide
DEQEIACTNPVATEQYGSVSAEDLMHEGEDL

SEQ ID NO: 111741 - protein, 28 aa, Artificial Sequence
  Description of Artificial Sequence: Synthetic peptide
QENEIATTNPVGTECYGDVSECLQHEEL

SEQ ID NO: 111742 - protein, 28 aa, Artificial Sequence
  Description of Artificial Sequence: Synthetic peptide
QENEIATTNPVGTECYGGVSEFLQGTEM

SEQ ID NO: 111743 - protein, 28 aa, Artificial Sequence
  Description of Artificial Sequence: Synthetic peptide
QENEIATTNPVGTECYGVVASTLQHEDI

SEQ ID NO: 111744 - protein, 28 aa, Artificial Sequence
  Description of Artificial Sequence: Synthetic peptide
QENEIATTNPVGTECYGVVSETLQHEEL

SEQ ID NO: 111745 - protein, 28 aa, Artificial Sequence
  Description of Artificial Sequence: Synthetic peptide
QENEIATTNPVGTECYGYVSECLQHEEL

SEQ ID NO: 111746 - protein, 28 aa, Artificial Sequence
  Description of Artificial Sequence: Synthetic peptide
QENEIATTNPVGTEGYGDVAECLQHGEL

SEQ ID NO: 111747 - protein, 28 aa, Artificial Sequence
  Description of Artificial Sequence: Synthetic peptide
QENEIATTNPVGTEGYGVVAECLQHGDI

SEQ ID NO: 111748 - protein, 28 aa, Artificial Sequence
  Description of Artificial Sequence: Synthetic peptide
QENEIATTNPVGTEGYGVVAECLQHGEI

SEQ ID NO: 111749 - protein, 33 aa, Artificial Sequence
  Description of Artificial Sequence: Synthetic polypeptide
DEQEIACTNPVATEQYGCVATNLQEGEGGNADA

SEQ ID NO: 111750 - protein, 28 aa, Artificial Sequence
  Description of Artificial Sequence: Synthetic peptide
QENEIATTNPVGTEGYGVVAECLQHGEL

SEQ ID NO: 111751 - protein, 28 aa, Artificial Sequence
  Description of Artificial Sequence: Synthetic peptide
QENEIATTNPVGTEGYGVVASCLQHGDI

SEQ ID NO: 111752 - protein, 33 aa, Artificial Sequence
  Description of Artificial Sequence: Synthetic polypeptide
DEQEIACTNPVATEQYGCVATNLQAAPGEEARG

SEQ ID NO: 111753 - protein, 32 aa, Artificial Sequence
  Description of Artificial Sequence: Synthetic polypeptide
DEQEIACTNPVATEQYGCVATNLQAAALINDE

SEQ ID NO: 111754 - protein, 34 aa, Artificial Sequence
  Description of Artificial Sequence: Synthetic polypeptide
CEEEIRTTNPVATEAYGCVSSCHNLSARTGGNNM

SEQ ID NO: 111755 - protein, 34 aa, Artificial Sequence
  Description of Artificial Sequence: Synthetic polypeptide
CEEEIRTTNPVATEAYGHVSSCHPLSQRTGGNNM

SEQ ID NO: 111756 - protein, 28 aa, Artificial Sequence
  Description of Artificial Sequence: Synthetic peptide
QENEIATTNPVGTERYGDVSECLQHEEL

SEQ ID NO: 111757 - protein, 34 aa, Artificial Sequence
  Description of Artificial Sequence: Synthetic polypeptide
CEEEIRTTNPVATEAYGKVSCENLSQNKAGGNKP

SEQ ID NO: 111758 - protein, 28 aa, Artificial Sequence
  Description of Artificial Sequence: Synthetic peptide
QENEIATTNPVSSECYGDVSENLQSEEL

SEQ ID NO: 111759 - protein, 31 aa, Artificial Sequence
  Description of Artificial Sequence: Synthetic polypeptide
DEQEIACTNPIATEQYGSVSATDLEDHGEDL

SEQ ID NO: 111760 - protein, 32 aa, Artificial Sequence
  Description of Artificial Sequence: Synthetic polypeptide
DEQEIACTNPIATEQYGSVSATDLEDHEGEDR

SEQ ID NO: 111761 - protein, 36 aa, Artificial Sequence
  Description of Artificial Sequence: Synthetic polypeptide
CEEEIRTTNPVATEAYGSIVSSCHGNLSQRTGGNNM

SEQ ID NO: 111762 - protein, 32 aa, Artificial Sequence
  Description of Artificial Sequence: Synthetic polypeptide
DEQEIAATNPVATEQYGSVSATMLEDHEGEDL

SEQ ID NO: 111763 - protein, 32 aa, Artificial Sequence
  Description of Artificial Sequence: Synthetic polypeptide
DEQEIACTNPVATEQYGSVSATDLCDHEGEDL

SEQ ID NO: 111764 - protein, 32 aa, Artificial Sequence
  Description of Artificial Sequence: Synthetic polypeptide
DEQEIACTNPVATEQYGSVSATDLEDHEGEDL

SEQ ID NO: 111765 - protein, 28 aa, Artificial Sequence
  Description of Artificial Sequence: Synthetic peptide
QENEIATTNPVCTECYGDVSVCLQHEEL

SEQ ID NO: 111766 - protein, 28 aa, Artificial Sequence
  Description of Artificial Sequence: Synthetic peptide
QENEIATTNPVCTECYGDVSECLQSEEQ

SEQ ID NO: 111767 - protein, 31 aa, Artificial Sequence
  Description of Artificial Sequence: Synthetic polypeptide
DEQEIASTNPVATEQYGNVSATDLESHEGEL

SEQ ID NO: 111768 - protein, 30 aa, Artificial Sequence
  Description of Artificial Sequence: Synthetic polypeptide
DEQEIASTNPVATEGYGVVSTDLEDHEGDL

SEQ ID NO: 111769 - protein, 28 aa, Artificial Sequence
  Description of Artificial Sequence: Synthetic peptide
QENEIATTNPVATYCYGDVSECLQHEEL

SEQ ID NO: 111770 - protein, 28 aa, Artificial Sequence
  Description of Artificial Sequence: Synthetic peptide
QENEIATTNPVAWECYGDVSECLQEEEL

SEQ ID NO: 111771 - protein, 31 aa, Artificial Sequence
  Description of Artificial Sequence: Synthetic polypeptide
DEQEIASTNPVATEGYGSVAATTLQSHVGEL

SEQ ID NO: 111772 - protein, 31 aa, Artificial Sequence
  Description of Artificial Sequence: Synthetic polypeptide
DEQEIASTNPVATEGYGSVAATTLQSHEGEL

SEQ ID NO: 111773 - protein, 32 aa, Artificial Sequence
  Description of Artificial Sequence: Synthetic polypeptide
DEQEIAQTNPVATEQYGSVSVTDLEDHEGEDL

SEQ ID NO: 111774 - protein, 32 aa, Artificial Sequence
  Description of Artificial Sequence: Synthetic polypeptide
DEQEIAQTNPVATEQYGSVSATDLEDHEGEDL

SEQ ID NO: 111775 - protein, 28 aa, Artificial Sequence
  Description of Artificial Sequence: Synthetic peptide
QENEIATTNPVAWECYGDVSECLQHDEL

SEQ ID NO: 111776 - protein, 32 aa, Artificial Sequence
  Description of Artificial Sequence: Synthetic polypeptide
CEEEIRTTNPCAYEAYGSVACTNGHQGSGGNA

SEQ ID NO: 111777 - protein, 28 aa, Artificial Sequence
  Description of Artificial Sequence: Synthetic peptide
QENEIATTNPVAWECYGDVSECLQHEEL

SEQ ID NO: 111778 - protein, 28 aa, Artificial Sequence
  Description of Artificial Sequence: Synthetic peptide
QENEIATTNPVAYECYGDVSECLQHEEL

SEQ ID NO: 111779 - protein, 32 aa, Artificial Sequence
  Description of Artificial Sequence: Synthetic polypeptide
DEQEIATTNPIATEQYGSVSATDLADHEGEDL

SEQ ID NO: 111780 - protein, 28 aa, Artificial Sequence
  Description of Artificial Sequence: Synthetic peptide
QENEIATTNPVAYECYGDVSETLQHEEL

SEQ ID NO: 111781 - protein, 32 aa, Artificial Sequence
  Description of Artificial Sequence: Synthetic polypeptide
DEQEIAPTNPVATEQYGSVSATDLEDHEGEDL

SEQ ID NO: 111782 - protein, 28 aa, Artificial Sequence
  Description of Artificial Sequence: Synthetic peptide
QENEIATTNPVAYECYGKVSECLQTEEL

SEQ ID NO: 111783 - protein, 28 aa, Artificial Sequence
  Description of Artificial Sequence: Synthetic peptide
QENEIATTNPVAYECYGVVSECLQHEMS

SEQ ID NO: 111784 - protein, 28 aa, Artificial Sequence
  Description of Artificial Sequence: Synthetic peptide
QENEIATTNPVAYECYGVVSEPLQHEEL

SEQ ID NO: 111785 - protein, 28 aa, Artificial Sequence
  Description of Artificial Sequence: Synthetic peptide
QENEIATTNPVAYEPYGDVSASLQSEEL

SEQ ID NO: 111786 - protein, 28 aa, Artificial Sequence
  Description of Artificial Sequence: Synthetic peptide
QENEIATTNPVAYEPYGNVSEHLQHEEL

SEQ ID NO: 111787 - protein, 32 aa, Artificial Sequence
  Description of Artificial Sequence: Synthetic polypeptide
DEQEIAMTNPVATEQYGSVSATDLEGHMGEDL

SEQ ID NO: 111788 - protein, 32 aa, Artificial Sequence
  Description of Artificial Sequence: Synthetic polypeptide
DEQEIAMTNPVATEQYGSVSATDLEDHEGEDL

SEQ ID NO: 111789 - protein, 32 aa, Artificial Sequence
  Description of Artificial Sequence: Synthetic polypeptide
DEQEIAGTNPVATEQYGSVSATDLEDHEGEDL

SEQ ID NO: 111790 - protein, 34 aa, Artificial Sequence
  Description of Artificial Sequence: Synthetic polypeptide
CEEEIRTTNPIATEAYGSVSSCHNLSDRTGGNNM

SEQ ID NO: 111791 - protein, 33 aa, Artificial Sequence
  Description of Artificial Sequence: Synthetic polypeptide
CEEEIRTTNPIAYEQYGSVPCTGLSARPGGSNP

SEQ ID NO: 111792 - protein, 29 aa, Artificial Sequence
  Description of Artificial Sequence: Synthetic peptide
QENEIATTNPVAYTECYGDVSECLQHEEF

SEQ ID NO: 111793 - protein, 32 aa, Artificial Sequence
  Description of Artificial Sequence: Synthetic polypeptide
DEQEIAPTNPVATEQYGSVSKTDLEDHEGEDL

SEQ ID NO: 111794 - protein, 33 aa, Artificial Sequence
  Description of Artificial Sequence: Synthetic polypeptide
DEQEIATTNPVATEQYGCSVSATDLEAHEGEDL

SEQ ID NO: 111795 - protein, 33 aa, Artificial Sequence
  Description of Artificial Sequence: Synthetic polypeptide
DEQEIATTNPVATEQYGCSVSATDLEDHEGEDL

SEQ ID NO: 111796 - protein, 30 aa, Artificial Sequence
  Description of Artificial Sequence: Synthetic polypeptide
DESEIRTTNPVATEQWGNVAETEMNAAGDA

SEQ ID NO: 111797 - protein, 33 aa, Artificial Sequence
  Description of Artificial Sequence: Synthetic polypeptide
DEQEIATTNPVATEQYGSVCATNLAPDSMDGDQ

SEQ ID NO: 111798 - protein, 34 aa, Artificial Sequence
  Description of Artificial Sequence: Synthetic polypeptide
DESEIRTTNPVATEIYGSVCSNWNDGQDRQGDTE

SEQ ID NO: 111799 - protein, 29 aa, Artificial Sequence
  Description of Artificial Sequence: Synthetic peptide
QENEIATTNPVATECYGRVSECLQHEELL

SEQ ID NO: 111800 - protein, 29 aa, Artificial Sequence
  Description of Artificial Sequence: Synthetic peptide
QENEIATTNPVATECYGRVSEWCLQNQEL

SEQ ID NO: 111801 - protein, 32 aa, Artificial Sequence
  Description of Artificial Sequence: Synthetic polypeptide
DEQEIATTNPVATEQYGSVCATDLEDHEGSDL

SEQ ID NO: 111802 - protein, 29 aa, Artificial Sequence
  Description of Artificial Sequence: Synthetic peptide
QENEIATTNPVATECYGRVSKECLQHEEL

SEQ ID NO: 111803 - protein, 34 aa, Artificial Sequence
  Description of Artificial Sequence: Synthetic polypeptide
DESEIRTTNPVATEIYGSVCSNWNGDGQRGGTQE

SEQ ID NO: 111804 - protein, 32 aa, Artificial Sequence
  Description of Artificial Sequence: Synthetic polypeptide
DEQEIATTNPVATEQYGSVCATDLEDHEGEDL

SEQ ID NO: 111805 - protein, 31 aa, Artificial Sequence
  Description of Artificial Sequence: Synthetic polypeptide
QENEIATTNPVATECYGSVSATCLEHEGEDL

SEQ ID NO: 111806 - protein, 29 aa, Artificial Sequence
  Description of Artificial Sequence: Synthetic peptide
QENEIATTNPVATECYGSVSECGPQHEEL

SEQ ID NO: 111807 - protein, 35 aa, Artificial Sequence
  Description of Artificial Sequence: Synthetic polypeptide
AEEEIRTTNPVATEQYGSVVTVTNLGGNEQGNNNE

SEQ ID NO: 111808 - protein, 33 aa, Artificial Sequence
  Description of Artificial Sequence: Synthetic polypeptide
DEQEIATTNPVATEQYGSVCAGTNPAPDGPNQD

SEQ ID NO: 111809 - protein, 34 aa, Artificial Sequence
  Description of Artificial Sequence: Synthetic polypeptide
DEQEIATTNPVATEQYGSVCADANPLQEADNQRN

SEQ ID NO: 111810 - protein, 34 aa, Artificial Sequence
  Description of Artificial Sequence: Synthetic polypeptide
DESEIRTTNPVATEKWGQSVSCINEPQDREGENG

SEQ ID NO: 111811 - protein, 28 aa, Artificial Sequence
  Description of Artificial Sequence: Synthetic peptide
QEEEIATTNPVATEGYGVMPSVLQHEEK

SEQ ID NO: 111812 - protein, 33 aa, Artificial Sequence
  Description of Artificial Sequence: Synthetic polypeptide
DEQEIATTNPVATEQYGSVCAADNHGQDSDGNH

SEQ ID NO: 111813 - protein, 33 aa, Artificial Sequence
  Description of Artificial Sequence: Synthetic polypeptide
DESEIRTTNPVATEKWGSVSCINEPQDREPENG

SEQ ID NO: 111814 - protein, 33 aa, Artificial Sequence
  Description of Artificial Sequence: Synthetic polypeptide
DEQEIATTNPVATEQYGSVAWTDLQEDHNGEDE

SEQ ID NO: 111815 - protein, 28 aa, Artificial Sequence
  Description of Artificial Sequence: Synthetic peptide
QEEEIATTNPVATEGYGVMPEVLQHEEK

SEQ ID NO: 111816 - protein, 28 aa, Artificial Sequence
  Description of Artificial Sequence: Synthetic peptide
QEEEIATTNPVATEGYGVAPETCQHGEI

SEQ ID NO: 111817 - protein, 33 aa, Artificial Sequence
  Description of Artificial Sequence: Synthetic polypeptide
DEQEIATTNPVATEQYGSVATNLPETEPGGETK

SEQ ID NO: 111818 - protein, 35 aa, Artificial Sequence
  Description of Artificial Sequence: Synthetic polypeptide
AEEEIRTTNPVATEQYGSVSTVVNQQNQTEGEDTE

SEQ ID NO: 111819 - protein, 28 aa, Artificial Sequence
  Description of Artificial Sequence: Synthetic peptide
QEEEIATTNPVATEGYGEMPEVCQHGEK

SEQ ID NO: 111820 - protein, 34 aa, Artificial Sequence
  Description of Artificial Sequence: Synthetic polypeptide
DESEIRTTNPVATEMWGSVHSCINEPQDREGENG

SEQ ID NO: 111821 - protein, 28 aa, Artificial Sequence
  Description of Artificial Sequence: Synthetic peptide
QEEEIATTNPVATEGYGEMAEVCQHGEK

SEQ ID NO: 111822 - protein, 29 aa, Artificial Sequence
  Description of Artificial Sequence: Synthetic peptide
QENEIATTNPVATECYGQVSEPELQHEEL

SEQ ID NO: 111823 - protein, 33 aa, Artificial Sequence
  Description of Artificial Sequence: Synthetic polypeptide
DEQEIATTNPVATEQYGSVASATDLETHEGEDL

SEQ ID NO: 111824 - protein, 29 aa, Artificial Sequence
  Description of Artificial Sequence: Synthetic peptide
QENEIATTNPVATECYGQVSEEWLQHEEL

SEQ ID NO: 111825 - protein, 28 aa, Artificial Sequence
  Description of Artificial Sequence: Synthetic peptide
QEEEIATTNPVATEKYGSAPEVGQHEEK

SEQ ID NO: 111826 - protein, 32 aa, Artificial Sequence
  Description of Artificial Sequence: Synthetic polypeptide
DEQEIATTNPVATEQYGSVFATDLEDHEGGDL

SEQ ID NO: 111827 - protein, 32 aa, Artificial Sequence
  Description of Artificial Sequence: Synthetic polypeptide
DEQEIATTNPVATEQYGSVFATDLEDHEGEDL

SEQ ID NO: 111828 - protein, 33 aa, Artificial Sequence
  Description of Artificial Sequence: Synthetic polypeptide
DEQEIATTNPVATEQYGSVEATDLEDHEGEDLR

SEQ ID NO: 111829 - protein, 33 aa, Artificial Sequence
  Description of Artificial Sequence: Synthetic polypeptide
DEQEIATTNPVATEQYGSVDSATVLEDHEGEDL

SEQ ID NO: 111830 - protein, 33 aa, Artificial Sequence
  Description of Artificial Sequence: Synthetic polypeptide
DEQEIATTNPVATEQYGSVDSATGLEDGEGEDL

SEQ ID NO: 111831 - protein, 29 aa, Artificial Sequence
  Description of Artificial Sequence: Synthetic peptide
QENEIATTNPVATECYGMCVSECLQHEEL

SEQ ID NO: 111832 - protein, 33 aa, Artificial Sequence
  Description of Artificial Sequence: Synthetic polypeptide
DEQEIATTNPVATEQYGSVDSATDLEDHEGCDL

SEQ ID NO: 111833 - protein, 29 aa, Artificial Sequence
  Description of Artificial Sequence: Synthetic peptide
QEEEIATTNPVATEPYGEASMDIQHNGEK

SEQ ID NO: 111834 - protein, 32 aa, Artificial Sequence
  Description of Artificial Sequence: Synthetic polypeptide
DEQEIATTNPVATEQYGSVDATGLEDNEGEDL

SEQ ID NO: 111835 - protein, 32 aa, Artificial Sequence
  Description of Artificial Sequence: Synthetic polypeptide
DEQEIATTNPVATEQYGSVDATDLEDHEGEDL

SEQ ID NO: 111836 - protein, 35 aa, Artificial Sequence
  Description of Artificial Sequence: Synthetic polypeptide
DEQEIATTNPVATEQYGSVCSPTNHGPLDSEGNDH

SEQ ID NO: 111837 - protein, 33 aa, Artificial Sequence
  Description of Artificial Sequence: Synthetic polypeptide
DEQEIATTNPVATEQYGSVCSNTDLDDHEGEDL

SEQ ID NO: 111838 - protein, 29 aa, Artificial Sequence
  Description of Artificial Sequence: Synthetic peptide
QENEIATTNPVATECYGMVSECLQHEELA

SEQ ID NO: 111839 - protein, 33 aa, Artificial Sequence
  Description of Artificial Sequence: Synthetic polypeptide
DEQEIATTNPVATEQYGSVCSATGLEDHEGEDL

SEQ ID NO: 111840 - protein, 29 aa, Artificial Sequence
  Description of Artificial Sequence: Synthetic peptide
QENEIATTNPVATECYGMVSECLQHEELW

SEQ ID NO: 111841 - protein, 33 aa, Artificial Sequence
  Description of Artificial Sequence: Synthetic polypeptide
DEQEIATTNPVATEQYGSVCSATDNEDHEGEDL

SEQ ID NO: 111842 - protein, 33 aa, Artificial Sequence
  Description of Artificial Sequence: Synthetic polypeptide
DEQEIATTNPVATEQYGSVCSATDLEDHMGEDL

SEQ ID NO: 111843 - protein, 33 aa, Artificial Sequence
  Description of Artificial Sequence: Synthetic polypeptide
DEQEIATTNPVATEQYGSVCSATDLEDHEGELL

SEQ ID NO: 111844 - protein, 33 aa, Artificial Sequence
  Description of Artificial Sequence: Synthetic polypeptide
DEQEIATTNPVATEQYGSVCSATDLEDHEGEDL

SEQ ID NO: 111845 - protein, 29 aa, Artificial Sequence
  Description of Artificial Sequence: Synthetic peptide
QENEIATTNPVATECYGMVSGECLQHEEL

SEQ ID NO: 111846 - protein, 34 aa, Artificial Sequence
  Description of Artificial Sequence: Synthetic polypeptide
AEEEIRTTNPVATEQYGSVVTVTDGNNLGGNNDD

SEQ ID NO: 111847 - protein, 34 aa, Artificial Sequence
  Description of Artificial Sequence: Synthetic polypeptide
AEEEIRTTNPVATEQYGSVVTVTNEQAGEEQIGE

SEQ ID NO: 111848 - protein, 28 aa, Artificial Sequence
  Description of Artificial Sequence: Synthetic peptide
QENEIATTNPVATECYGNVSECLWHEEL

SEQ ID NO: 111849 - protein, 32 aa, Artificial Sequence
  Description of Artificial Sequence: Synthetic polypeptide
DEQEIATTNPVATEQYGSVCHTDLEDHNGEDL

SEQ ID NO: 111850 - protein, 34 aa, Artificial Sequence
  Description of Artificial Sequence: Synthetic polypeptide
DEQEIATTNPVATEQYGSVCATNQLQDQGVPTEE

SEQ ID NO: 111851 - protein, 33 aa, Artificial Sequence
  Description of Artificial Sequence: Synthetic polypeptide
DESEIRTTNPVATEIWGSVSVINESQDEEGENG

SEQ ID NO: 111852 - protein, 32 aa, Artificial Sequence
  Description of Artificial Sequence: Synthetic polypeptide
DEQEIATTNPVATEQYGSVFATDLEDHKGEDL

SEQ ID NO: 111853 - protein, 33 aa, Artificial Sequence
  Description of Artificial Sequence: Synthetic polypeptide
DEQEIATTNPVATEQYGSVASATDLEDHEGEDL

SEQ ID NO: 111854 - protein, 28 aa, Artificial Sequence
  Description of Artificial Sequence: Synthetic peptide
QEEEIATTNPVATEGYGEAPEVIQHGEK

SEQ ID NO: 111855 - protein, 33 aa, Artificial Sequence
  Description of Artificial Sequence: Synthetic polypeptide
DEQEIATTNPVATEQYGSSVSATDLEDHEGEDL

SEQ ID NO: 111856 - protein, 32 aa, Artificial Sequence
  Description of Artificial Sequence: Synthetic polypeptide
DEQEIATTNPVATEQYGSSSATDNEDHEGEDL

SEQ ID NO: 111857 - protein, 32 aa, Artificial Sequence
  Description of Artificial Sequence: Synthetic polypeptide
DEQEIATTNPVATEQYGSSSATDLEDHEGEDL

SEQ ID NO: 111858 - protein, 32 aa, Artificial Sequence
  Description of Artificial Sequence: Synthetic polypeptide
QENEIATTNPVATECYGSVSSTEPALQHNENL

SEQ ID NO: 111859 - protein, 32 aa, Artificial Sequence
  Description of Artificial Sequence: Synthetic polypeptide
QENEIATTNPVATECYGSVSSTTPALQHNENL

SEQ ID NO: 111860 - protein, 33 aa, Artificial Sequence
  Description of Artificial Sequence: Synthetic polypeptide
DEQEIATTNPVATEQYGSRVSATDLEDHEGEDL

SEQ ID NO: 111861 - protein, 32 aa, Artificial Sequence
  Description of Artificial Sequence: Synthetic polypeptide
DEQEIATTNPVATEQYGSRSATDLEDHEGEDL

SEQ ID NO: 111862 - protein, 30 aa, Artificial Sequence
  Description of Artificial Sequence: Synthetic polypeptide
QENEIATTNPVATECYGSVSTCLEHEEEDL

SEQ ID NO: 111863 - protein, 33 aa, Artificial Sequence
  Description of Artificial Sequence: Synthetic polypeptide
DEQEIATTNPVATEQYGSNVSATDLEDHEGEDL

SEQ ID NO: 111864 - protein, 33 aa, Artificial Sequence
  Description of Artificial Sequence: Synthetic polypeptide
DEQEIATTNPVATEQYGSNVSATDLDDHEGEDL

SEQ ID NO: 111865 - protein, 28 aa, Artificial Sequence
  Description of Artificial Sequence: Synthetic peptide
QEEEIATTNPVATEGYGEAPEVCQHGEK

SEQ ID NO: 111866 - protein, 32 aa, Artificial Sequence
  Description of Artificial Sequence: Synthetic polypeptide
DEQEIATTNPVATEQYGSNSATDLEVHEGEDL

SEQ ID NO: 111867 - protein, 32 aa, Artificial Sequence
  Description of Artificial Sequence: Synthetic polypeptide
DEQEIATTNPVATEQYGSNSATDLEDHEGWDL

SEQ ID NO: 111868 - protein, 32 aa, Artificial Sequence
  Description of Artificial Sequence: Synthetic polypeptide
DEQEIATTNPVATEQYGSNSATDLEDHEGEDL

SEQ ID NO: 111869 - protein, 31 aa, Artificial Sequence
  Description of Artificial Sequence: Synthetic polypeptide
QENEIATTNPVATECYGSVSTDLEDHEGEDL

SEQ ID NO: 111870 - protein, 33 aa, Artificial Sequence
  Description of Artificial Sequence: Synthetic polypeptide
DEQEIATTNPVATEQYGSMVSATDLEDHEGEDL

SEQ ID NO: 111871 - protein, 33 aa, Artificial Sequence
  Description of Artificial Sequence: Synthetic polypeptide
DESEIRTTNPVATEMWGSVSCISEPQDREGENG

SEQ ID NO: 111872 - protein, 28 aa, Artificial Sequence
  Description of Artificial Sequence: Synthetic peptide
CEEEIGTTNPVATEQYGEAPEVCQHEEK

SEQ ID NO: 111873 - protein, 32 aa, Artificial Sequence
  Description of Artificial Sequence: Synthetic polypeptide
QENEIATTNPVATECYGSVSTEPCLQRNEMEL

SEQ ID NO: 111874 - protein, 28 aa, Artificial Sequence
  Description of Artificial Sequence: Synthetic peptide
QENEIATTNPVATECYGTISEDLQQEEL

SEQ ID NO: 111875 - protein, 29 aa, Artificial Sequence
  Description of Artificial Sequence: Synthetic peptide
QEEEIATTNPVATEGYGEAPETCQSRGEK

SEQ ID NO: 111876 - protein, 28 aa, Artificial Sequence
  Description of Artificial Sequence: Synthetic peptide
QENEIATTNPVATECYGTQSLGLQHEEL

SEQ ID NO: 111877 - protein, 31 aa, Artificial Sequence
  Description of Artificial Sequence: Synthetic polypeptide
DEQEIATTNPVATEQYGSMSSTLEDHEGEDL

SEQ ID NO: 111878 - protein, 32 aa, Artificial Sequence
  Description of Artificial Sequence: Synthetic polypeptide
DEQEIATTNPVATEQYGSMSATQLEDHEGEDL

SEQ ID NO: 111879 - protein, 29 aa, Artificial Sequence
  Description of Artificial Sequence: Synthetic peptide
QENEIATTNPVATECYGTVSAECPQHGEL

SEQ ID NO: 111880 - protein, 32 aa, Artificial Sequence
  Description of Artificial Sequence: Synthetic polypeptide
DEQEIATTNPVATEQYGSTSATDLEDHEGEDI

SEQ ID NO: 111881 - protein, 33 aa, Artificial Sequence
  Description of Artificial Sequence: Synthetic polypeptide
DEQEIATTNPVATEQYGSVANANNLQEAPGTHQ

SEQ ID NO: 111882 - protein, 31 aa, Artificial Sequence
  Description of Artificial Sequence: Synthetic polypeptide
QENEIATTNPVATECYGSVSEPCLQRNEMEL

SEQ ID NO: 111883 - protein, 32 aa, Artificial Sequence
  Description of Artificial Sequence: Synthetic polypeptide
DEQEIATTNPVATEQYGSTSATDLEDHPGEDL

SEQ ID NO: 111884 - protein, 35 aa, Artificial Sequence
  Description of Artificial Sequence: Synthetic polypeptide
AEEEIRTTNPVATEQYGSVSTVVNQQLQTETTEDE

SEQ ID NO: 111885 - protein, 32 aa, Artificial Sequence
  Description of Artificial Sequence: Synthetic polypeptide
DEQEIATTNPVATEQYGSVAATGLTDHQGEDN

SEQ ID NO: 111886 - protein, 32 aa, Artificial Sequence
  Description of Artificial Sequence: Synthetic polypeptide
DEQEIATTNPVATEQYGSVAATDLGDHTGEDL

SEQ ID NO: 111887 - protein, 32 aa, Artificial Sequence
  Description of Artificial Sequence: Synthetic polypeptide
DEQEIATTNPVATEQYGSVAATDLEHHEGGDL

SEQ ID NO: 111888 - protein, 32 aa, Artificial Sequence
  Description of Artificial Sequence: Synthetic polypeptide
DEQEIATTNPVATEQYGSVAATDLEEHEGPDL

SEQ ID NO: 111889 - protein, 32 aa, Artificial Sequence
  Description of Artificial Sequence: Synthetic polypeptide
DEQEIATTNPVATEQYGSVAATDLEDNEGEDL

SEQ ID NO: 111890 - protein, 32 aa, Artificial Sequence
  Description of Artificial Sequence: Synthetic polypeptide
DEQEIATTNPVATEQYGSVAATDLEDHVGEDL

SEQ ID NO: 111891 - protein, 32 aa, Artificial Sequence
  Description of Artificial Sequence: Synthetic polypeptide
DEQEIATTNPVATEQYGSVAATDLEDHKGEDL

SEQ ID NO: 111892 - protein, 32 aa, Artificial Sequence
  Description of Artificial Sequence: Synthetic polypeptide
DEQEIATTNPVATEQYGSVAATDLEDHHGEDA

SEQ ID NO: 111893 - protein, 31 aa, Artificial Sequence
  Description of Artificial Sequence: Synthetic polypeptide
QENEIATTNPVATECYGSVSEDLQDHEGEDL

SEQ ID NO: 111894 - protein, 32 aa, Artificial Sequence
  Description of Artificial Sequence: Synthetic polypeptide
DEQEIATTNPVATEQYGSVAATDLEDHEGEDL

SEQ ID NO: 111895 - protein, 32 aa, Artificial Sequence
  Description of Artificial Sequence: Synthetic polypeptide
DEQEIATTNPVATEQYGSVAATDLADHKGPDL

SEQ ID NO: 111896 - protein, 32 aa, Artificial Sequence
  Description of Artificial Sequence: Synthetic polypeptide
DEQEIATTNPVATEQYGSVAATDLADHKGEDL

SEQ ID NO: 111897 - protein, 33 aa, Artificial Sequence
  Description of Artificial Sequence: Synthetic polypeptide
DESEIRTTNPVATEMWGSVSCINEPQDREGEHG

SEQ ID NO: 111898 - protein, 33 aa, Artificial Sequence
  Description of Artificial Sequence: Synthetic polypeptide
DEQEIATTNPVATEQYGSVAANNLQEADINDDE

SEQ ID NO: 111899 - protein, 33 aa, Artificial Sequence
  Description of Artificial Sequence: Synthetic polypeptide
DEQEIATTNPVATEQYGSTVSGTDLEDHEGEDL

SEQ ID NO: 111900 - protein, 35 aa, Artificial Sequence
  Description of Artificial Sequence: Synthetic polypeptide
DEQEIATTNPVATEQYGSTVSCTYLSEDQEGGENL

SEQ ID NO: 111901 - protein, 35 aa, Artificial Sequence
  Description of Artificial Sequence: Synthetic polypeptide
DEQEIATTNPVATEQYGSTVSCTGLSEQHEGGENI

SEQ ID NO: 111902 - protein, 33 aa, Artificial Sequence
  Description of Artificial Sequence: Synthetic polypeptide
DEQEIATTNPVATEQYGSTVSCTGLEDHEGEDL

SEQ ID NO: 111903 - protein, 33 aa, Artificial Sequence
  Description of Artificial Sequence: Synthetic polypeptide
DEQEIATTNPVATEQYGSTVSATDLIDHEGEDL

SEQ ID NO: 111904 - protein, 33 aa, Artificial Sequence
  Description of Artificial Sequence: Synthetic polypeptide
DEQEIATTNPVATEQYGSTVSATDLEDHEGEKL

SEQ ID NO: 111905 - protein, 33 aa, Artificial Sequence
  Description of Artificial Sequence: Synthetic polypeptide
DEQEIATTNPVATEQYGSTVSATDLEDHEGEDW

SEQ ID NO: 111906 - protein, 33 aa, Artificial Sequence
  Description of Artificial Sequence: Synthetic polypeptide
DEQEIATTNPVATEQYGSTVSATDLEDHEGEDL

SEQ ID NO: 111907 - protein, 32 aa, Artificial Sequence
  Description of Artificial Sequence: Synthetic polypeptide
DEQEIATTNPVATEQYGSTSATDLEWHEGEDL

SEQ ID NO: 111908 - protein, 28 aa, Artificial Sequence
  Description of Artificial Sequence: Synthetic peptide
QEEEIATTNPVATEGYGEAPEVCQREEK

SEQ ID NO: 111909 - protein, 32 aa, Artificial Sequence
  Description of Artificial Sequence: Synthetic polypeptide
DEQEIATTNPVATEQYGSTSATDLEDHEGEDL

SEQ ID NO: 111910 - protein, 33 aa, Artificial Sequence
  Description of Artificial Sequence: Synthetic polypeptide
DEQEIATTNPVATEQYGSVFSATDLEDHEGEDD

SEQ ID NO: 111911 - protein, 33 aa, Artificial Sequence
  Description of Artificial Sequence: Synthetic polypeptide
DEQEIATTNPVATEQYGSVFSATDLEDHEGEDL

SEQ ID NO: 111912 - protein, 32 aa, Artificial Sequence
  Description of Artificial Sequence: Synthetic polypeptide
DEQEIATTNPVATEQYGSVGATDLEDHEGEDL

SEQ ID NO: 111913 - protein, 28 aa, Artificial Sequence
  Description of Artificial Sequence: Synthetic peptide
QEEEIATTNPVATEQYGCAVEVCQHEEK

SEQ ID NO: 111914 - protein, 28 aa, Artificial Sequence
  Description of Artificial Sequence: Synthetic peptide
QEEEIATTNPVATEQYGCAPRVCQHEEK

SEQ ID NO: 111915 - protein, 33 aa, Artificial Sequence
  Description of Artificial Sequence: Synthetic polypeptide
DEQEIATTNPVATEQYGSVSACDLPQDHEGEDG

SEQ ID NO: 111916 - protein, 28 aa, Artificial Sequence
  Description of Artificial Sequence: Synthetic peptide
QEEEIATTNPVATEQYGCAPEVCQHEEK

SEQ ID NO: 111917 - protein, 28 aa, Artificial Sequence
  Description of Artificial Sequence: Synthetic peptide
QEEEIATTNPVATEQYGCAPETCQHEEK

SEQ ID NO: 111918 - protein, 28 aa, Artificial Sequence
  Description of Artificial Sequence: Synthetic peptide
QEEEIATTNPVATEQYGCAPAVIQHEEK

SEQ ID NO: 111919 - protein, 29 aa, Artificial Sequence
  Description of Artificial Sequence: Synthetic peptide
QENEIATTNPVATECYGGVSEFLQHHTGM

SEQ ID NO: 111920 - protein, 29 aa, Artificial Sequence
  Description of Artificial Sequence: Synthetic peptide
QENEIATTNPVATECYGGVSEFLQHPHEM

SEQ ID NO: 111921 - protein, 29 aa, Artificial Sequence
  Description of Artificial Sequence: Synthetic peptide
QENEIATTNPVATECYGGVSEFLQPPEEM

SEQ ID NO: 111922 - protein, 32 aa, Artificial Sequence
  Description of Artificial Sequence: Synthetic polypeptide
DEQEIATTNPVATEQYGSVSACDLEDHEGEEG

SEQ ID NO: 111923 - protein, 32 aa, Artificial Sequence
  Description of Artificial Sequence: Synthetic polypeptide
DEQEIATTNPVATEQYGSVSACDLEDHEGEDL

SEQ ID NO: 111924 - protein, 28 aa, Artificial Sequence
  Description of Artificial Sequence: Synthetic peptide
QEEEIATTNPVATEQYGAAPEVDQHEEF

SEQ ID NO: 111925 - protein, 32 aa, Artificial Sequence
  Description of Artificial Sequence: Synthetic polypeptide
DEQEIATTNPVATEQYGSVSACDLEDHEGEDG

SEQ ID NO: 111926 - protein, 28 aa, Artificial Sequence
  Description of Artificial Sequence: Synthetic peptide
QEEEIATTNPVATEQYGAAPEVCQHEEK

SEQ ID NO: 111927 - protein, 32 aa, Artificial Sequence
  Description of Artificial Sequence: Synthetic polypeptide
DEQEIATTNPVATEQYGSVSAADLEDHEGEDL

SEQ ID NO: 111928 - protein, 33 aa, Artificial Sequence
  Description of Artificial Sequence: Synthetic polypeptide
DEQEIATTNPVATEQYGSVRSATDLPDHEGEDL

SEQ ID NO: 111929 - protein, 32 aa, Artificial Sequence
  Description of Artificial Sequence: Synthetic polypeptide
DESEIRTTNPVATEGWGVVSSINEPQDRGEDI

SEQ ID NO: 111930 - protein, 28 aa, Artificial Sequence
  Description of Artificial Sequence: Synthetic peptide
QEEEIATTNPVATEQYGAAPEVAQHEEQ

SEQ ID NO: 111931 - protein, 33 aa, Artificial Sequence
  Description of Artificial Sequence: Synthetic polypeptide
DEQEIATTNPVATEQYGSVRSATDLEDHEGEDL

SEQ ID NO: 111932 - protein, 35 aa, Artificial Sequence
  Description of Artificial Sequence: Synthetic polypeptide
AEEEIRTTNPVATEQYGSVVTVNTQNGNSEAGTIF

SEQ ID NO: 111933 - protein, 32 aa, Artificial Sequence
  Description of Artificial Sequence: Synthetic polypeptide
DEQEIATTNPVATEQYGSVRATDLEDHEGEDL

SEQ ID NO: 111934 - protein, 30 aa, Artificial Sequence
  Description of Artificial Sequence: Synthetic polypeptide
QEEEIATTNPVATEQWGSAPEIVEPQRENG

SEQ ID NO: 111935 - protein, 28 aa, Artificial Sequence
  Description of Artificial Sequence: Synthetic peptide
QEEEIATTNPVATEQWGEASEICQHEEA

SEQ ID NO: 111936 - protein, 29 aa, Artificial Sequence
  Description of Artificial Sequence: Synthetic peptide
QEEEIATTNPVATEQWGEASCIVCQHENK

SEQ ID NO: 111937 - protein, 33 aa, Artificial Sequence
  Description of Artificial Sequence: Synthetic polypeptide
DEQEIATTNPVATEQYGSVQSNTDLEDHEGEDL

SEQ ID NO: 111938 - protein, 32 aa, Artificial Sequence
  Description of Artificial Sequence: Synthetic polypeptide
DEQEIATTNPVATEQYGSVSADDLEDHEGEDL

SEQ ID NO: 111939 - protein, 32 aa, Artificial Sequence
  Description of Artificial Sequence: Synthetic polypeptide
QEEEIATTNPVATEQWGCVAGTMNLQHDDNPN

SEQ ID NO: 111940 - protein, 35 aa, Artificial Sequence
  Description of Artificial Sequence: Synthetic polypeptide
AEEEIRTTNPVATEQYGSVSTVVNQQQGEQGEDEN

SEQ ID NO: 111941 - protein, 28 aa, Artificial Sequence
  Description of Artificial Sequence: Synthetic peptide
QEEEIATTNPVATEQYGCSPWVDQHNEK

SEQ ID NO: 111942 - protein, 29 aa, Artificial Sequence
  Description of Artificial Sequence: Synthetic peptide
QENEIATTNPVATECYGDVSYECLQHEEL

SEQ ID NO: 111943 - protein, 28 aa, Artificial Sequence
  Description of Artificial Sequence: Synthetic peptide
QENEIATTNPVATECYGDVTECLQHEEL

SEQ ID NO: 111944 - protein, 28 aa, Artificial Sequence
  Description of Artificial Sequence: Synthetic peptide
QENEIATTNPVATECYGDVVECLQEEEL

SEQ ID NO: 111945 - protein, 33 aa, Artificial Sequence
  Description of Artificial Sequence: Synthetic polypeptide
DESEIRTTNPVATEGWGSVSWNNENQDGEGSNQ

SEQ ID NO: 111946 - protein, 34 aa, Artificial Sequence
  Description of Artificial Sequence: Synthetic polypeptide
DESEIRTTNPVATEGWGSVSWVNENQDREGSNQA

SEQ ID NO: 111947 - protein, 28 aa, Artificial Sequence
  Description of Artificial Sequence: Synthetic peptide
QENEIATTNPVATECYGDVVECLQHEEL

SEQ ID NO: 111948 - protein, 29 aa, Artificial Sequence
  Description of Artificial Sequence: Synthetic peptide
QENEIATTNPVATECYGDVVECLQHEELR

SEQ ID NO: 111949 - protein, 29 aa, Artificial Sequence
  Description of Artificial Sequence: Synthetic peptide
QENEIATTNPVATECYGDVVECLQHENEL

SEQ ID NO: 111950 - protein, 32 aa, Artificial Sequence
  Description of Artificial Sequence: Synthetic polypeptide
DEQEIATTNPVATEQYGSVSAEDLMDHEGEDL

SEQ ID NO: 111951 - protein, 29 aa, Artificial Sequence
  Description of Artificial Sequence: Synthetic peptide
QENEIATTNPVATECYGDVVSECLQHEAL

SEQ ID NO: 111952 - protein, 29 aa, Artificial Sequence
  Description of Artificial Sequence: Synthetic peptide
QENEIATTNPVATECYGDVVSECLQHEEL

SEQ ID NO: 111953 - protein, 32 aa, Artificial Sequence
  Description of Artificial Sequence: Synthetic polypeptide
QEEEIATTNPVATEQYGCVAATWLAQNSQNNH

SEQ ID NO: 111954 - protein, 32 aa, Artificial Sequence
  Description of Artificial Sequence: Synthetic polypeptide
DEQEIATTNPVATEQYGSVSAEDLEDHEGMDL

SEQ ID NO: 111955 - protein, 29 aa, Artificial Sequence
  Description of Artificial Sequence: Synthetic peptide
QENEIATTNPVATECYGDVWSECLQHEEL

SEQ ID NO: 111956 - protein, 29 aa, Artificial Sequence
  Description of Artificial Sequence: Synthetic peptide
QENEIATTNPVATECYGDVYSECLQHEEL

SEQ ID NO: 111957 - protein, 32 aa, Artificial Sequence
  Description of Artificial Sequence: Synthetic polypeptide
DEQEIATTNPVATEQYGSVSAEDLEDHEGEDL

SEQ ID NO: 111958 - protein, 36 aa, Artificial Sequence
  Description of Artificial Sequence: Synthetic polypeptide
AEEEIRTTNPVATEQYGSVSTVVNQQQLQENNNNNE

SEQ ID NO: 111959 - protein, 32 aa, Artificial Sequence
  Description of Artificial Sequence: Synthetic polypeptide
DEQEIATTNPVATEQYGSVSAEDCQDHEGEDL

SEQ ID NO: 111960 - protein, 36 aa, Artificial Sequence
  Description of Artificial Sequence: Synthetic polypeptide
AEEEIRTTNPVATEQYGSVSTVVNQQQGTEGGNNNQ

SEQ ID NO: 111961 - protein, 32 aa, Artificial Sequence
  Description of Artificial Sequence: Synthetic polypeptide
DEQEIATTNPVATEQYGSVSAECLEDHEGEDL

SEQ ID NO: 111962 - protein, 28 aa, Artificial Sequence
  Description of Artificial Sequence: Synthetic peptide
QENEIATTNPVATECYGEVPECLQHEEL

SEQ ID NO: 111963 - protein, 28 aa, Artificial Sequence
  Description of Artificial Sequence: Synthetic peptide
QENEIATTNPVATECYGEVSECCQHEEK

SEQ ID NO: 111964 - protein, 29 aa, Artificial Sequence
  Description of Artificial Sequence: Synthetic peptide
QENEIATTNPVATECYGEVSECLQHEDEL

SEQ ID NO: 111965 - protein, 34 aa, Artificial Sequence
  Description of Artificial Sequence: Synthetic polypeptide
QEEEIATTNPVATEQYGCVAATNLDQTPDGNANS

SEQ ID NO: 111966 - protein, 34 aa, Artificial Sequence
  Description of Artificial Sequence: Synthetic polypeptide
QEEEIATTNPVATEQYGCVAATNLATMGGGDNRL

SEQ ID NO: 111967 - protein, 28 aa, Artificial Sequence
  Description of Artificial Sequence: Synthetic peptide
QEEEIATTNPVATEQYGCAYEVMQHEEK

SEQ ID NO: 111968 - protein, 33 aa, Artificial Sequence
  Description of Artificial Sequence: Synthetic polypeptide
DEQEIATTNPVATEQYGSVQSATDLEDHEGEDL

SEQ ID NO: 111969 - protein, 32 aa, Artificial Sequence
  Description of Artificial Sequence: Synthetic polypeptide
DEQEIATTNPVATEQYGSVQATKLEDHEGEDL

SEQ ID NO: 111970 - protein, 28 aa, Artificial Sequence
  Description of Artificial Sequence: Synthetic peptide
QENEIATTNPVATECYGGVSLCLNHEEG

SEQ ID NO: 111971 - protein, 33 aa, Artificial Sequence
  Description of Artificial Sequence: Synthetic polypeptide
DESEIRTTNPVATEIWGSVSCICEPQDREGENG

SEQ ID NO: 111972 - protein, 33 aa, Artificial Sequence
  Description of Artificial Sequence: Synthetic polypeptide
DEQEIATTNPVATEQYGSVLSATPLEDHEGEDL

SEQ ID NO: 111973 - protein, 33 aa, Artificial Sequence
  Description of Artificial Sequence: Synthetic polypeptide
DEQEIATTNPVATEQYGSVLSATDLEDHEGEDL

SEQ ID NO: 111974 - protein, 33 aa, Artificial Sequence
  Description of Artificial Sequence: Synthetic polypeptide
DEQEIATTNPVATEQYGSVLSATDLEDFEGEDL

SEQ ID NO: 111975 - protein, 33 aa, Artificial Sequence
  Description of Artificial Sequence: Synthetic polypeptide
DEQEIATTNPVATEQYGSVLSATDLEDDEGEDL

SEQ ID NO: 111976 - protein, 32 aa, Artificial Sequence
  Description of Artificial Sequence: Synthetic polypeptide
DEQEIATTNPVATEQYGSVLATDLIDHEGEDL

SEQ ID NO: 111977 - protein, 32 aa, Artificial Sequence
  Description of Artificial Sequence: Synthetic polypeptide
DEQEIATTNPVATEQYGSVLATDLEDHEGEDL

SEQ ID NO: 111978 - protein, 29 aa, Artificial Sequence
  Description of Artificial Sequence: Synthetic peptide
QENEIATTNPVATECYGKVSEKCLQHEEL

SEQ ID NO: 111979 - protein, 33 aa, Artificial Sequence
  Description of Artificial Sequence: Synthetic polypeptide
DEQEIATTNPVATEQYGSVKSATDLEDHEGEDL

SEQ ID NO: 111980 - protein, 33 aa, Artificial Sequence
  Description of Artificial Sequence: Synthetic polypeptide
DEQEIATTNPVATEQYGSVKSATDLEDHEGEAL

SEQ ID NO: 111981 - protein, 32 aa, Artificial Sequence
  Description of Artificial Sequence: Synthetic polypeptide
DEQEIATTNPVATEQYGSVKATDLEDHEGEDL

SEQ ID NO: 111982 - protein, 34 aa, Artificial Sequence
  Description of Artificial Sequence: Synthetic polypeptide
AEEEIRTTNPVATEQYGSVVTVSTNTNSEAGTIF

SEQ ID NO: 111983 - protein, 29 aa, Artificial Sequence
  Description of Artificial Sequence: Synthetic peptide
QENEIATTNPVATECYGLVSECLQHEELF

SEQ ID NO: 111984 - protein, 32 aa, Artificial Sequence
  Description of Artificial Sequence: Synthetic polypeptide
DEQEIATTNPVATEQYGSVKATDLEDHEGADL

SEQ ID NO: 111985 - protein, 33 aa, Artificial Sequence
  Description of Artificial Sequence: Synthetic polypeptide
DEQEIATTNPVATEQYGSVISATDLEDHEGEGL

SEQ ID NO: 111986 - protein, 33 aa, Artificial Sequence
  Description of Artificial Sequence: Synthetic polypeptide
DEQEIATTNPVATEQYGSVISATDLEDHEGEDL

SEQ ID NO: 111987 - protein, 33 aa, Artificial Sequence
  Description of Artificial Sequence: Synthetic polypeptide
DEQEIATTNPVATEQYGSVISATDLEDHEGDDL

SEQ ID NO: 111988 - protein, 32 aa, Artificial Sequence
  Description of Artificial Sequence: Synthetic polypeptide
DEQEIATTNPVATEQYGSVIATDLEDHEGEDL

SEQ ID NO: 111989 - protein, 33 aa, Artificial Sequence
  Description of Artificial Sequence: Synthetic polypeptide
DEQEIATTNPVATEQYGSVHSATDLEDHEGEDL

SEQ ID NO: 111990 - protein, 33 aa, Artificial Sequence
  Description of Artificial Sequence: Synthetic polypeptide
DEQEIATTNPVATEQYGSVHSATDLECHEGEDL

SEQ ID NO: 111991 - protein, 33 aa, Artificial Sequence
  Description of Artificial Sequence: Synthetic polypeptide
DEQEIATTNPVATEQYGSVHSATDLADHEGEDL

SEQ ID NO: 111992 - protein, 32 aa, Artificial Sequence
  Description of Artificial Sequence: Synthetic polypeptide
DEQEIATTNPVATEQYGSVHATTLEDHEGEDL

SEQ ID NO: 111993 - protein, 32 aa, Artificial Sequence
  Description of Artificial Sequence: Synthetic polypeptide
DEQEIATTNPVATEQYGSVHATDLEDHEGEDL

SEQ ID NO: 111994 - protein, 33 aa, Artificial Sequence
  Description of Artificial Sequence: Synthetic polypeptide
DEQEIATTNPVATEQYGSVGSATDLEDHEGEDL

SEQ ID NO: 111995 - protein, 33 aa, Artificial Sequence
  Description of Artificial Sequence: Synthetic polypeptide
DEQEIATTNPVATEQYGSVGSATDLDDHEGEDL

SEQ ID NO: 111996 - protein, 29 aa, Artificial Sequence
  Description of Artificial Sequence: Synthetic peptide
QENEIATTNPVATECYGKVSEHLSQHEES

SEQ ID NO: 111997 - protein, 33 aa, Artificial Sequence
  Description of Artificial Sequence: Synthetic polypeptide
DEQEIATTNPVATEQYGSVLSVTDLEDHEGEDL

SEQ ID NO: 111998 - protein, 32 aa, Artificial Sequence
  Description of Artificial Sequence: Synthetic polypeptide
DEQEIATTNPVATEQYGSVMATDLEDHEGEDL

SEQ ID NO: 111999 - protein, 31 aa, Artificial Sequence
  Description of Artificial Sequence: Synthetic polypeptide
DEQEIATTNPVATEQYGSVMAWDLEDHEGEL

SEQ ID NO: 112000 - protein, 32 aa, Artificial Sequence
  Description of Artificial Sequence: Synthetic polypeptide
DEQEIATTNPVATEQYGSVQATDLEDHLGEDL

SEQ ID NO: 112001 - protein, 32 aa, Artificial Sequence
  Description of Artificial Sequence: Synthetic polypeptide
DEQEIATTNPVATEQYGSVQATDLEDHEGEDL

SEQ ID NO: 112002 - protein, 30 aa, Artificial Sequence
  Description of Artificial Sequence: Synthetic polypeptide
QEEEIATTNPVATEQWGCVAGTGLINMMRN

SEQ ID NO: 112003 - protein, 33 aa, Artificial Sequence
  Description of Artificial Sequence: Synthetic polypeptide
DEQEIATTNPVATEQYGSVPSVTDLEDHEGEDL

SEQ ID NO: 112004 - protein, 33 aa, Artificial Sequence
  Description of Artificial Sequence: Synthetic polypeptide
DEQEIATTNPVATEQYGSVPSATVLEDHEGEDL
